United States Patent 7,250,496 (BIOINFORMATICALLY DETECTABLE GROUP OF NOVEL REGULATORY GENES AND USES THEREOF) - sequence listing, part 5

SEQ ID NO: 149165 - RNA, 26 nt, Human
gcugcugcaucucuaaccgggugucc

SEQ ID NO: 149166 - RNA, 23 nt, Human
ggcaagaaaaacaaaccaaggaa

SEQ ID NO: 149167 - RNA, 25 nt, Human
uaaaaagaaacgcuuucgaccccca

SEQ ID NO: 149168 - RNA, 18 nt, Human
uaaaagaaauggcccaaa

SEQ ID NO: 149169 - RNA, 22 nt, Human
uaaaagaagcaaauaaaaagaa

SEQ ID NO: 149170 - RNA, 20 nt, Human
uaaacuucaaaauacuuuuc

SEQ ID NO: 149171 - RNA, 19 nt, Human
uaaaguaacggugcaguuc

SEQ ID NO: 149172 - RNA, 25 nt, Human
uaagaacagaaauagggggaggacg

SEQ ID NO: 149173 - RNA, 19 nt, Human
uaagacagcacgaaaccua

SEQ ID NO: 149174 - RNA, 18 nt, Human
uacaacacaaagccucaa

SEQ ID NO: 149175 - RNA, 24 nt, Human
uagcccccccuuccccaacccaaa

SEQ ID NO: 149176 - RNA, 23 nt, Human
ucaaagaaggcaauagaaugcaa

SEQ ID NO: 149177 - RNA, 23 nt, Human
ucaacacugacuuacaaagacau

SEQ ID NO: 149178 - RNA, 23 nt, Human
ucacagguucaaggcaguuaugu

SEQ ID NO: 149179 - RNA, 21 nt, Human
ucaccaaccccuucucugccu

SEQ ID NO: 149180 - RNA, 24 nt, Human
ucaccaaccccuucucugccuccu

SEQ ID NO: 149181 - RNA, 24 nt, Human
uccaaagcuaaaagaaauggccca

SEQ ID NO: 149182 - RNA, 23 nt, Human
ucucugccuccuucaacugccuu

SEQ ID NO: 149183 - RNA, 19 nt, Human
ugaaacacuuuaaaagguc

SEQ ID NO: 149184 - RNA, 18 nt, Human
ugaaaggggaggggaaac

SEQ ID NO: 149185 - RNA, 24 nt, Human
ugacagguaaaacccuguaccucu

SEQ ID NO: 149186 - RNA, 20 nt, Human
ugacuuacaaagacauuuac

SEQ ID NO: 149187 - RNA, 21 nt, Human
ugccuccuucaacugccuuuu

SEQ ID NO: 149188 - RNA, 20 nt, Human
uuaaaaagacggagagacua

SEQ ID NO: 149189 - RNA, 23 nt, Human
uuaaacagacauaacagcaaugc

SEQ ID NO: 149190 - RNA, 24 nt, Human
uuaaaguaacggugcaguucuccc

SEQ ID NO: 149191 - RNA, 22 nt, Human
uuauguaaaaagaaaagaaaug

SEQ ID NO: 149192 - RNA, 24 nt, Human
uucaacauaaaagauauuuaagaa

SEQ ID NO: 149193 - RNA, 18 nt, Human
uucgacccccaaagucca

SEQ ID NO: 149194 - RNA, 20 nt, Human
uuucucuuaacuugccuuug

SEQ ID NO: 149195 - RNA, 24 nt, Human
aaacaaaaaccuucaccaugaacc

SEQ ID NO: 149196 - RNA, 20 nt, Human
aaccuguuccuccuacccca

SEQ ID NO: 149197 - RNA, 23 nt, Human
agcccagccuggggugggggcag

SEQ ID NO: 149198 - RNA, 21 nt, Human
agccgaaaaaagaaacaaaaa

SEQ ID NO: 149199 - RNA, 19 nt, Human
agggggugggagggcaggc

SEQ ID NO: 149200 - RNA, 21 nt, Human
agggggugggagggcaggcgg

SEQ ID NO: 149201 - RNA, 19 nt, Human
agggugggggugggggcaa

SEQ ID NO: 149202 - RNA, 26 nt, Human
caaaaauagaguuuuucuuccccucc

SEQ ID NO: 149203 - RNA, 18 nt, Human
caagacgagagagugaac

SEQ ID NO: 149204 - RNA, 18 nt, Human
cacaucucugcauucuuu

SEQ ID NO: 149205 - RNA, 19 nt, Human
caccaugaaccaaaccaag

SEQ ID NO: 149206 - RNA, 22 nt, Human
cacuccuaggggggcgcccgau

SEQ ID NO: 149207 - RNA, 27 nt, Human
caucucugcauucuuuuuagccgaaaa

SEQ ID NO: 149208 - RNA, 19 nt, Human
ccacaccccuccucacggu

SEQ ID NO: 149209 - RNA, 21 nt, Human
ccaggccccaccuaggugcug

SEQ ID NO: 149210 - RNA, 19 nt, Human
cccaccccagagugcucac

SEQ ID NO: 149211 - RNA, 21 nt, Human
cccaguaaaaauucuccacga

SEQ ID NO: 149212 - RNA, 24 nt, Human
ccccuggagccccccaagccaucc

SEQ ID NO: 149213 - RNA, 25 nt, Human
ccccuggagccccccaagccauccc

SEQ ID NO: 149214 - RNA, 24 nt, Human
cccugcagacccucccaccccaga

SEQ ID NO: 149215 - RNA, 21 nt, Human
ccgaaaaaagaaacaaaaacc

SEQ ID NO: 149216 - RNA, 18 nt, Human
ccuccuaccccaggcccc

SEQ ID NO: 149217 - RNA, 23 nt, Human
ccugcagacccucccaccccaga

SEQ ID NO: 149218 - RNA, 21 nt, Human
ccugcagacccucccaccccg

SEQ ID NO: 149219 - RNA, 27 nt, Human
ccuguuccuccuaccccaggccccacc

SEQ ID NO: 149220 - RNA, 19 nt, Human
cgaaaaaagaaacaaaaac

SEQ ID NO: 149221 - RNA, 25 nt, Human
cucucugcugcccggggagggggug

SEQ ID NO: 149222 - RNA, 21 nt, Human
cuggagccccccaagccaucc

SEQ ID NO: 149223 - RNA, 21 nt, Human
cuggggugggggcaggaggau

SEQ ID NO: 149224 - RNA, 25 nt, Human
gaaacaaaaaccuucaccaugaacc

SEQ ID NO: 149225 - RNA, 20 nt, Human
gaggauggggcgggggaucc

SEQ ID NO: 149226 - RNA, 23 nt, Human
gagugcucacccuguggcuuccg

SEQ ID NO: 149227 - RNA, 21 nt, Human
gcccagccuggggugggggca

SEQ ID NO: 149228 - RNA, 19 nt, Human
gccccacugccugcucccc

SEQ ID NO: 149229 - RNA, 22 nt, Human
gccugcucccccgcauuccacc

SEQ ID NO: 149230 - RNA, 22 nt, Human
ggagccccccaagccaucccau

SEQ ID NO: 149231 - RNA, 18 nt, Human
ggaggccugggcaagggg

SEQ ID NO: 149232 - RNA, 19 nt, Human
ggcaggaggauggggcggg

SEQ ID NO: 149233 - RNA, 24 nt, Human
ggccugggcaagggggucugggag

SEQ ID NO: 149234 - RNA, 21 nt, Human
gggagggggugggagggcagg

SEQ ID NO: 149235 - RNA, 18 nt, Human
gggcacccccccaauucc

SEQ ID NO: 149236 - RNA, 18 nt, Human
gggcaggaggauggggcg

SEQ ID NO: 149237 - RNA, 20 nt, Human
gggcaggaggauggggcggg

SEQ ID NO: 149238 - RNA, 22 nt, Human
gggcaggaggauggggcggggg

SEQ ID NO: 149239 - RNA, 19 nt, Human
gggcgcgguccguguugag

SEQ ID NO: 149240 - RNA, 19 nt, Human
gggggcacaucucugcauu

SEQ ID NO: 149241 - RNA, 23 nt, Human
gggggugcccacaccccuccuca

SEQ ID NO: 149242 - RNA, 20 nt, Human
gggggugggagggcaggcgg

SEQ ID NO: 149243 - RNA, 19 nt, Human
gggugggggcaggaggaug

SEQ ID NO: 149244 - RNA, 18 nt, Human
gguggucgaggguggggg

SEQ ID NO: 149245 - RNA, 22 nt, Human
gguggugcacuccuaggggggc

SEQ ID NO: 149246 - RNA, 18 nt, Human
gucacgcugggguccgcc

SEQ ID NO: 149247 - RNA, 21 nt, Human
uaaaaauucuccacgaggucu

SEQ ID NO: 149248 - RNA, 23 nt, Human
uaccccaggccccaccuaggugc

SEQ ID NO: 149249 - RNA, 18 nt, Human
uagccgaaaaaagaaaca

SEQ ID NO: 149250 - RNA, 27 nt, Human
ucacccuguggcuuccgcagggacugg

SEQ ID NO: 149251 - RNA, 18 nt, Human
uccccgggcaccccccca

SEQ ID NO: 149252 - RNA, 22 nt, Human
uccccgggcacccccccaauuc

SEQ ID NO: 149253 - RNA, 18 nt, Human
ucucucucuuucucucuc

SEQ ID NO: 149254 - RNA, 18 nt, Human
ucucugcauucuuuuuac

SEQ ID NO: 149255 - RNA, 19 nt, Human
ucuuucucucucucucucc

SEQ ID NO: 149256 - RNA, 18 nt, Human
ugaggggggcuccggggg

SEQ ID NO: 149257 - RNA, 22 nt, Human
ugcugucucucuugggccccuu

SEQ ID NO: 149258 - RNA, 20 nt, Human
uggggcccucgcgucguccg

SEQ ID NO: 149259 - RNA, 19 nt, Human
ugggggcaggaggaugggg

SEQ ID NO: 149260 - RNA, 19 nt, Human
ugggggcaggaggaugggg

SEQ ID NO: 149261 - RNA, 20 nt, Human
ugggggugggggcacaucuc

SEQ ID NO: 149262 - RNA, 19 nt, Human
uggucgagggugggggugg

SEQ ID NO: 149263 - RNA, 20 nt, Human
ugugugcccggcgggcgcgg

SEQ ID NO: 149264 - RNA, 27 nt, Human
uucccugcagacccucccaccccagag

SEQ ID NO: 149265 - RNA, 20 nt, Human
uuucauuuuguuucugcuuc

SEQ ID NO: 149266 - RNA, 20 nt, Human
uuuuucuuccccucccaccc

SEQ ID NO: 149267 - RNA, 26 nt, Human
uuuuucuuccccucccaccccccuuu

SEQ ID NO: 149268 - RNA, 20 nt, Human
uuuuuuuuuuuuuuuuuugg

SEQ ID NO: 149269 - RNA, 24 nt, Human
uuuuuuuuuuuuuuuuuugucuuu

SEQ ID NO: 149270 - RNA, 25 nt, Human
aaaaagaaaaggagcagugagcuga

SEQ ID NO: 149271 - RNA, 19 nt, Human
aaagaaaaaaaagaaaagg

SEQ ID NO: 149272 - RNA, 19 nt, Human
agaaaaaaaagaaaaggag

SEQ ID NO: 149273 - RNA, 28 nt, Human
auauaauuaaagauccacaaaacacagg

SEQ ID NO: 149274 - RNA, 22 nt, Human
augugugugugugcgcgcgugu

SEQ ID NO: 149275 - RNA, 23 nt, Human
augugugugugugcgcgcgugug

SEQ ID NO: 149276 - RNA, 23 nt, Human
gagcagugagcugaaacccccga

SEQ ID NO: 149277 - RNA, 23 nt, Human
uaugugugugugugcgcgcgugu

SEQ ID NO: 149278 - RNA, 21 nt, Human
uauuggcaaauauugggucuc

SEQ ID NO: 149279 - RNA, 21 nt, Human
ucagaauauauauuuaaaaug

SEQ ID NO: 149280 - RNA, 24 nt, Human
ucuguuaaaauuugcaaagauuuc

SEQ ID NO: 149281 - RNA, 20 nt, Human
ugugugugugcgcgcgugug

SEQ ID NO: 149282 - RNA, 26 nt, Human
ugugugugugcgcgcguguguuuuga

SEQ ID NO: 149283 - RNA, 23 nt, Human
uuaauacuuaggcaacacuggcu

SEQ ID NO: 149284 - RNA, 23 nt, Human
uucuaagcauuauaaaauccuuu

SEQ ID NO: 149285 - RNA, 22 nt, Human
uucucucucuuucguguaugug

SEQ ID NO: 149286 - RNA, 21 nt, Human
uuuuugggggggugggcgggg

SEQ ID NO: 149287 - RNA, 19 nt, Human
uuuuuuuuuuuuuuucuaa

SEQ ID NO: 149288 - RNA, 20 nt, Human
aaagaagugcuggagccccu

SEQ ID NO: 149289 - RNA, 23 nt, Human
aaaucaguccuaaacaaggacaa

SEQ ID NO: 149290 - RNA, 20 nt, Human
aagucagcuucaaaccccag

SEQ ID NO: 149291 - RNA, 21 nt, Human
acaucagguccaaacccuagc

SEQ ID NO: 149292 - RNA, 22 nt, Human
agacaaagguuagaaaaagccc

SEQ ID NO: 149293 - RNA, 18 nt, Human
agaugcuucugaccucag

SEQ ID NO: 149294 - RNA, 19 nt, Human
aggcaggccggcaggcggg

SEQ ID NO: 149295 - RNA, 20 nt, Human
aggcaggccggcaggcggga

SEQ ID NO: 149296 - RNA, 18 nt, Human
aggguggggaggcgaggc

SEQ ID NO: 149297 - RNA, 19 nt, Human
aggguggggaggcgaggcc

SEQ ID NO: 149298 - RNA, 19 nt, Human
auacaguuuacagcacacu

SEQ ID NO: 149299 - RNA, 21 nt, Human
auccaaaggcccaaauuucag

SEQ ID NO: 149300 - RNA, 22 nt, Human
caaaacaucagcuucucuccac

SEQ ID NO: 149301 - RNA, 22 nt, Human
caauacaccaaaacaucagcuu

SEQ ID NO: 149302 - RNA, 23 nt, Human
caauucuagacaucuugagaaca

SEQ ID NO: 149303 - RNA, 22 nt, Human
cagcagaugcuucugaccucag

SEQ ID NO: 149304 - RNA, 23 nt, Human
cagcuucucuccacagcacagcu

SEQ ID NO: 149305 - RNA, 21 nt, Human
cagguccaaacccuagccuaa

SEQ ID NO: 149306 - RNA, 19 nt, Human
caucacggugcucccuagg

SEQ ID NO: 149307 - RNA, 22 nt, Human
ccaacagucucagcugcuuccu

SEQ ID NO: 149308 - RNA, 24 nt, Human
ccaagcacugagcagggaggugaa

SEQ ID NO: 149309 - RNA, 23 nt, Human
ccacaccugcuacaggaaaucug

SEQ ID NO: 149310 - RNA, 21 nt, Human
ccagaaagaagugcuggagcc

SEQ ID NO: 149311 - RNA, 21 nt, Human
cccacaccugcuacaggaaau

SEQ ID NO: 149312 - RNA, 20 nt, Human
ccccugcucuguccucucca

SEQ ID NO: 149313 - RNA, 18 nt, Human
cccugcucuguccucucc

SEQ ID NO: 149314 - RNA, 24 nt, Human
ccggcucuaaauagagccugcguc

SEQ ID NO: 149315 - RNA, 19 nt, Human
ccucaguguucugaguuca

SEQ ID NO: 149316 - RNA, 19 nt, Human
ccucccagcccaguccaug

SEQ ID NO: 149317 - RNA, 21 nt, Human
cuagggccucccaagccuccu

SEQ ID NO: 149318 - RNA, 21 nt, Human
cucccagcccaguccaugugu

SEQ ID NO: 149319 - RNA, 18 nt, Human
cuccccuacccggcucua

SEQ ID NO: 149320 - RNA, 18 nt, Human
cucucucucucucucucu

SEQ ID NO: 149321 - RNA, 21 nt, Human
cugcauuuagugucugagacu

SEQ ID NO: 149322 - RNA, 24 nt, Human
cuguccucuccaucacggugcucc

SEQ ID NO: 149323 - RNA, 19 nt, Human
cuucauuuuccuccccucc

SEQ ID NO: 149324 - RNA, 23 nt, Human
cuucgucagccuuugcccucacc

SEQ ID NO: 149325 - RNA, 21 nt, Human
cuuggucaaggucaaggucac

SEQ ID NO: 149326 - RNA, 22 nt, Human
cuuguaacguucuccaacaguc

SEQ ID NO: 149327 - RNA, 25 nt, Human
gaauucgcggccgcgucgaccucga

SEQ ID NO: 149328 - RNA, 22 nt, Human
gaggggaauguuuuagaaaaaa

SEQ ID NO: 149329 - RNA, 18 nt, Human
gaguggggaggggaaugu

SEQ ID NO: 149330 - RNA, 23 nt, Human
gaugcuucugaccucaguguucu

SEQ ID NO: 149331 - RNA, 24 nt, Human
gcaaaaccaucuauuccacaaggc

SEQ ID NO: 149332 - RNA, 18 nt, Human
gcccucacccucauccug

SEQ ID NO: 149333 - RNA, 20 nt, Human
ggagaaaggagcugggagcc

SEQ ID NO: 149334 - RNA, 18 nt, Human
ggagaggaguggggaggg

SEQ ID NO: 149335 - RNA, 18 nt, Human
ggagaggaguggggaggg

SEQ ID NO: 149336 - RNA, 21 nt, Human
ggagugcucugaccccugccc

SEQ ID NO: 149337 - RNA, 22 nt, Human
gggucccagcaucagcccacug

SEQ ID NO: 149338 - RNA, 19 nt, Human
uaaagucagcuucaaaccc

SEQ ID NO: 149339 - RNA, 21 nt, Human
uaacguucuccaacagucuca

SEQ ID NO: 149340 - RNA, 22 nt, Human
uaagacaaagguuagaaaaagc

SEQ ID NO: 149341 - RNA, 21 nt, Human
uacacagguagcuaagacaaa

SEQ ID NO: 149342 - RNA, 27 nt, Human
uacaccaaaacaucagcuucucuccaa

SEQ ID NO: 149343 - RNA, 18 nt, Human
uagaaaaagcccagaagg

SEQ ID NO: 149344 - RNA, 20 nt, Human
uagaaaaagcccagaaggca

SEQ ID NO: 149345 - RNA, 18 nt, Human
uagcacauaaauuaggga

SEQ ID NO: 149346 - RNA, 22 nt, Human
uagggccucccaagccuccuug

SEQ ID NO: 149347 - RNA, 20 nt, Human
ucaaggucacucgagcggug

SEQ ID NO: 149348 - RNA, 25 nt, Human
ucacccucauccugguagaccuuca

SEQ ID NO: 149349 - RNA, 22 nt, Human
uccagaaagaagugcuggagcc

SEQ ID NO: 149350 - RNA, 24 nt, Human
uccagaaagaagugcuggagcccc

SEQ ID NO: 149351 - RNA, 21 nt, Human
ucccagcccaguccauguguc

SEQ ID NO: 149352 - RNA, 23 nt, Human
ucccaggaagguuugcaggccuc

SEQ ID NO: 149353 - RNA, 21 nt, Human
uccgugaguuuggucccgggu

SEQ ID NO: 149354 - RNA, 18 nt, Human
ucugaguucauguccuuc

SEQ ID NO: 149355 - RNA, 19 nt, Human
ucuguaagcccacaccugc

SEQ ID NO: 149356 - RNA, 21 nt, Human
ugaccccugcccguggagccc

SEQ ID NO: 149357 - RNA, 21 nt, Human
ugagacuggguuugaggaggc

SEQ ID NO: 149358 - RNA, 18 nt, Human
ugaguucauguccuucuu

SEQ ID NO: 149359 - RNA, 18 nt, Human
ugcucuguccucuccauc

SEQ ID NO: 149360 - RNA, 21 nt, Human
uggcaggcaggccggcaggcg

SEQ ID NO: 149361 - RNA, 18 nt, Human
uggcggaguccggcugug

SEQ ID NO: 149362 - RNA, 20 nt, Human
ugggagaggaguggggaggg

SEQ ID NO: 149363 - RNA, 25 nt, Human
ugggagcauuccccaguggaggggc

SEQ ID NO: 149364 - RNA, 19 nt, Human
uggggaggcgaggccauag

SEQ ID NO: 149365 - RNA, 24 nt, Human
ugucugagacuggguuugaggagg

SEQ ID NO: 149366 - RNA, 24 nt, Human
uucuccaacagucucagcugcuuc

SEQ ID NO: 149367 - RNA, 18 nt, Human
uucucucucucucucucu

SEQ ID NO: 149368 - RNA, 24 nt, Human
uugagaacaucagguccaaacccu

SEQ ID NO: 149369 - RNA, 22 nt, Human
uuggaggucucugccuccauuc

SEQ ID NO: 149370 - RNA, 19 nt, Human
uuuauuggaggucucugcc

SEQ ID NO: 149371 - RNA, 21 nt, Human
uuugucagacucaaaagcugg

SEQ ID NO: 149372 - RNA, 22 nt, Human
uuuuuuuuuuuuuuuuuccuuu

SEQ ID NO: 149373 - RNA, 23 nt, Human
uuuuuuuuuuuuuuuuuuccuuu

SEQ ID NO: 149374 - RNA, 25 nt, Human
aggcaagagaaggcaggcgcuccca

SEQ ID NO: 149375 - RNA, 18 nt, Human
caaggcaagagaaggcag

SEQ ID NO: 149376 - RNA, 19 nt, Human
cuagguccaaagaggaggc

SEQ ID NO: 149377 - RNA, 25 nt, Human
gagggcagcgguggcuaggggaagc

SEQ ID NO: 149378 - RNA, 19 nt, Human
ucaaggcaagagaaggcag

SEQ ID NO: 149379 - RNA, 20 nt, Human
ucaaggcaagagaaggcagg

SEQ ID NO: 149380 - RNA, 20 nt, Human
ugagggcagcgguggcuagg

SEQ ID NO: 149381 - RNA, 19 nt, Human
aaacaggcaggaccccagg

SEQ ID NO: 149382 - RNA, 20 nt, Human
aaaucccuuccuucccaccc

SEQ ID NO: 149383 - RNA, 23 nt, Human
aagaaaggucguucucaagccag

SEQ ID NO: 149384 - RNA, 26 nt, Human
aaucccuuccuucccacccaccccac

SEQ ID NO: 149385 - RNA, 22 nt, Human
aauucuucccaaggauccccac

SEQ ID NO: 149386 - RNA, 18 nt, Human
acaggaacaauuccccau

SEQ ID NO: 149387 - RNA, 20 nt, Human
acaggugagcccaggagucu

SEQ ID NO: 149388 - RNA, 22 nt, Human
agaacaaaagggacauuccucc

SEQ ID NO: 149389 - RNA, 22 nt, Human
agacgaguguagcacugucccc

SEQ ID NO: 149390 - RNA, 22 nt, Human
aggaaauuggggggcugggagg

SEQ ID NO: 149391 - RNA, 25 nt, Human
aggaauaauaaaacaaaacaaacua

SEQ ID NO: 149392 - RNA, 19 nt, Human
aggcggcgguggagguggu

SEQ ID NO: 149393 - RNA, 27 nt, Human
aggcggcgguggagguggugguggcgg

SEQ ID NO: 149394 - RNA, 24 nt, Human
agguggugguggcgguggcggcgg

SEQ ID NO: 149395 - RNA, 22 nt, Human
caccccccaaaaaaacccucca

SEQ ID NO: 149396 - RNA, 23 nt, Human
cagacagggcucccucaucuccc

SEQ ID NO: 149397 - RNA, 18 nt, Human
cagacggggaccaccccc

SEQ ID NO: 149398 - RNA, 20 nt, Human
cagcaccuagaagccgcccc

SEQ ID NO: 149399 - RNA, 23 nt, Human
caggaauaauaaaacaaaacaaa

SEQ ID NO: 149400 - RNA, 20 nt, Human
cauuccucccucccaacucc

SEQ ID NO: 149401 - RNA, 19 nt, Human
cauugggaggaaacaggca

SEQ ID NO: 149402 - RNA, 23 nt, Human
ccaaaucccuuccuucccaccca

SEQ ID NO: 149403 - RNA, 23 nt, Human
ccaacccccaggucccaaggccu

SEQ ID NO: 149404 - RNA, 30 nt, Human
ccaccccaccaaauauaggaagagaugacu

SEQ ID NO: 149405 - RNA, 19 nt, Human
ccaccccccaaaaaaaccc

SEQ ID NO: 149406 - RNA, 19 nt, Human
ccagaaggggugguggugg

SEQ ID NO: 149407 - RNA, 21 nt, Human
ccagaagggguggugguggug

SEQ ID NO: 149408 - RNA, 26 nt, Human
ccaggagucuuuugaacccacucucu

SEQ ID NO: 149409 - RNA, 22 nt, Human
ccauacgcggccccaccgcccc

SEQ ID NO: 149410 - RNA, 22 nt, Human
cccaaaucccuuccuucccacc

SEQ ID NO: 149411 - RNA, 25 nt, Human
cccaaaucccuuccuucccacccac

SEQ ID NO: 149412 - RNA, 19 nt, Human
cccaaggauccccacccca

SEQ ID NO: 149413 - RNA, 21 nt, Human
cccaccaaauauaggaagaga

SEQ ID NO: 149414 - RNA, 22 nt, Human
cccaccccaccaaauauaggaa

SEQ ID NO: 149415 - RNA, 23 nt, Human
cccaccccaccacaaucagagca

SEQ ID NO: 149416 - RNA, 23 nt, Human
cccaccccaccacaaucagagcc

SEQ ID NO: 149417 - RNA, 23 nt, Human
ccccaaaucccuuccuucccacc

SEQ ID NO: 149418 - RNA, 22 nt, Human
ccccaagggcaggcugagaaau

SEQ ID NO: 149419 - RNA, 21 nt, Human
ccccaccccaccacaaucaga

SEQ ID NO: 149420 - RNA, 21 nt, Human
ccccaccgccccccaggccug

SEQ ID NO: 149421 - RNA, 22 nt, Human
ccccagaagggguggugguggu

SEQ ID NO: 149422 - RNA, 20 nt, Human
cccccaaaaaaacccuccau

SEQ ID NO: 149423 - RNA, 18 nt, Human
cccccaaaucaccaaccc

SEQ ID NO: 149424 - RNA, 22 nt, Human
cccccaaaucccuuccuuccca

SEQ ID NO: 149425 - RNA, 20 nt, Human
ccccccaaaaaaacccucca

SEQ ID NO: 149426 - RNA, 24 nt, Human
ccccccagacggggaccacccccc

SEQ ID NO: 149427 - RNA, 20 nt, Human
ccccccaggccuggguuccc

SEQ ID NO: 149428 - RNA, 31 nt, Human
cccccccaaaucccuuccuucccacccaccu

SEQ ID NO: 149429 - RNA, 24 nt, Human
ccuggaccccugaguauggccagg

SEQ ID NO: 149430 - RNA, 25 nt, Human
ccuggaccccugaguauggccagga

SEQ ID NO: 149431 - RNA, 21 nt, Human
cggcagcaccuagaagccgcc

SEQ ID NO: 149432 - RNA, 28 nt, Human
cgguggagguggugguggcgguggcggc

SEQ ID NO: 149433 - RNA, 23 nt, Human
cgugggcccgaggaggaggagcc

SEQ ID NO: 149434 - RNA, 19 nt, Human
cucagggggaagaacaaaa

SEQ ID NO: 149435 - RNA, 26 nt, Human
cuccauacgcggccccaccgcccccc

SEQ ID NO: 149436 - RNA, 22 nt, Human
cucccaacccauuaaaugguac

SEQ ID NO: 149437 - RNA, 22 nt, Human
cuccccuauugaaaagccccau

SEQ ID NO: 149438 - RNA, 21 nt, Human
cucccucuccccuauugaaaa

SEQ ID NO: 149439 - RNA, 24 nt, Human
cugucugagagaaagguuggggga

SEQ ID NO: 149440 - RNA, 21 nt, Human
cuucccaaggauccccacccc

SEQ ID NO: 149441 - RNA, 23 nt, Human
cuucccaaggauccccaccccac

SEQ ID NO: 149442 - RNA, 19 nt, Human
cuucccacccaccccacca

SEQ ID NO: 149443 - RNA, 23 nt, Human
cuuccuggaccccugaguauggc

SEQ ID NO: 149444 - RNA, 22 nt, Human
cuuuagaaaaaaaaaaggucca

SEQ ID NO: 149445 - RNA, 21 nt, Human
gaccaccccccaaaaaaaccc

SEQ ID NO: 149446 - RNA, 26 nt, Human
gaccaccccccaaaaaaacccuccau

SEQ ID NO: 149447 - RNA, 18 nt, Human
gagagaaagguuggggga

SEQ ID NO: 149448 - RNA, 18 nt, Human
gaggugggggagaugucc

SEQ ID NO: 149449 - RNA, 19 nt, Human
gaguggggaggaggcagaa

SEQ ID NO: 149450 - RNA, 24 nt, Human
gauccccaccccaccacaaucaga

SEQ ID NO: 149451 - RNA, 18 nt, Human
gccccuaccauugaagua

SEQ ID NO: 149452 - RNA, 18 nt, Human
gcccgaggaggaggagcc

SEQ ID NO: 149453 - RNA, 19 nt, Human
gccuggguuccgaggcggc

SEQ ID NO: 149454 - RNA, 22 nt, Human
gcuccucccaguggccuucaaa

SEQ ID NO: 149455 - RNA, 19 nt, Human
ggaauaauaaaacaaaaca

SEQ ID NO: 149456 - RNA, 19 nt, Human
ggaccaccccccaaaaaaa

SEQ ID NO: 149457 - RNA, 21 nt, Human
ggagagacagggagaccugga

SEQ ID NO: 149458 - RNA, 23 nt, Human
ggagggaacugaaaauucauguu

SEQ ID NO: 149459 - RNA, 23 nt, Human
ggagguggugguggcgguggcgg

SEQ ID NO: 149460 - RNA, 19 nt, Human
ggcccgaggaggaggagcc

SEQ ID NO: 149461 - RNA, 22 nt, Human
ggcgguggagguggugguggcg

SEQ ID NO: 149462 - RNA, 18 nt, Human
ggcugggagggagggaac

SEQ ID NO: 149463 - RNA, 25 nt, Human
gggaagaacaaaagggaccgguacc

SEQ ID NO: 149464 - RNA, 23 nt, Human
gggcucccucaucuccccaaggg

SEQ ID NO: 149465 - RNA, 18 nt, Human
ggggaagaacaaaaggga

SEQ ID NO: 149466 - RNA, 23 nt, Human
guggagguggugguggcgguggc

SEQ ID NO: 149467 - RNA, 24 nt, Human
guggcgguggcggcggcagcaccu

SEQ ID NO: 149468 - RNA, 24 nt, Human
gugggcccgaggaggaggagccca

SEQ ID NO: 149469 - RNA, 21 nt, Human
gugguggcgguggcggcggca

SEQ ID NO: 149470 - RNA, 24 nt, Human
gugguggcgguggcggcggcagca

SEQ ID NO: 149471 - RNA, 20 nt, Human
guggugguggcgguggcggc

SEQ ID NO: 149472 - RNA, 20 nt, Human
guggugguggcgguggcggc

SEQ ID NO: 149473 - RNA, 24 nt, Human
uaaaacaaacaguggagacgagug

SEQ ID NO: 149474 - RNA, 19 nt, Human
uaacaggugagcccaggag

SEQ ID NO: 149475 - RNA, 18 nt, Human
uaauaaaacaaaacaaac

SEQ ID NO: 149476 - RNA, 24 nt, Human
uaauaaaacaaaacaaacuaacuc

SEQ ID NO: 149477 - RNA, 23 nt, Human
uagagacaggacaggcuuuaugu

SEQ ID NO: 149478 - RNA, 24 nt, Human
uaggagacguguaagggcggccac

SEQ ID NO: 149479 - RNA, 19 nt, Human
ucaaaaauaaacacuugga

SEQ ID NO: 149480 - RNA, 19 nt, Human
uccauacgcggccccaccg

SEQ ID NO: 149481 - RNA, 22 nt, Human
uccauacgcggccccaccgccc

SEQ ID NO: 149482 - RNA, 23 nt, Human
ucccaaggccugggcugggccag

SEQ ID NO: 149483 - RNA, 18 nt, Human
ucccacccaccccaccaa

SEQ ID NO: 149484 - RNA, 21 nt, Human
ucccucaucuccccaagggca

SEQ ID NO: 149485 - RNA, 21 nt, Human
ucccuuccuucccacccaccc

SEQ ID NO: 149486 - RNA, 24 nt, Human
ucccuuccuucccacccaccccac

SEQ ID NO: 149487 - RNA, 19 nt, Human
uccggggggcgggggcucc

SEQ ID NO: 149488 - RNA, 18 nt, Human
uccuaaccacccuaaaag

SEQ ID NO: 149489 - RNA, 23 nt, Human
ucucucuugccuagaauagagac

SEQ ID NO: 149490 - RNA, 21 nt, Human
uggaccccugaguauggccag

SEQ ID NO: 149491 - RNA, 19 nt, Human
uggagagagcauggaugga

SEQ ID NO: 149492 - RNA, 18 nt, Human
uggaguggggaggaggca

SEQ ID NO: 149493 - RNA, 26 nt, Human
uggcagacaaaggaauggcuucucag

SEQ ID NO: 149494 - RNA, 19 nt, Human
uggcagcuccggggggcgg

SEQ ID NO: 149495 - RNA, 25 nt, Human
uggccaggaauaauaaaacaaaaca

SEQ ID NO: 149496 - RNA, 24 nt, Human
uggcggcggcagcaccuagaagcc

SEQ ID NO: 149497 - RNA, 21 nt, Human
uggcuucucagggggaagaac

SEQ ID NO: 149498 - RNA, 23 nt, Human
ugggacucuuuagaaaaaaaaaa

SEQ ID NO: 149499 - RNA, 24 nt, Human
ugggacucuuuagaaaaaaaaaag

SEQ ID NO: 149500 - RNA, 19 nt, Human
uggggaaaaaaguggggag

SEQ ID NO: 149501 - RNA, 22 nt, Human
uggggaaaaaaguggggaggug

SEQ ID NO: 149502 - RNA, 22 nt, Human
uggggaggaggcagaagauucc

SEQ ID NO: 149503 - RNA, 20 nt, Human
ugguaucaaaaauaaacacu

SEQ ID NO: 149504 - RNA, 18 nt, Human
ugguggcgguggcggcgg

SEQ ID NO: 149505 - RNA, 18 nt, Human
uggugguggcgguggcgg

SEQ ID NO: 149506 - RNA, 19 nt, Human
uguaagggcggccacuggg

SEQ ID NO: 149507 - RNA, 22 nt, Human
ugucccccaaaucaccaacccc

SEQ ID NO: 149508 - RNA, 23 nt, Human
ugucccccaaaucaccaaccccc

SEQ ID NO: 149509 - RNA, 19 nt, Human
ugucccccauuccucccuc

SEQ ID NO: 149510 - RNA, 27 nt, Human
ugucugagagaaagguugggggaggug

SEQ ID NO: 149511 - RNA, 18 nt, Human
uuccucccucccaacucc

SEQ ID NO: 149512 - RNA, 19 nt, Human
uuccucccucccaacucca

SEQ ID NO: 149513 - RNA, 21 nt, Human
uuccuuggccaagacucccaa

SEQ ID NO: 149514 - RNA, 22 nt, Human
uucucagggggaagaacaaaag

SEQ ID NO: 149515 - RNA, 19 nt, Human
uucuccuugagauggcugg

SEQ ID NO: 149516 - RNA, 26 nt, Human
uuggcaauguuggcagcuccgggggg

SEQ ID NO: 149517 - RNA, 27 nt, Human
agauccugauuuuucccccuuuuuuuc

SEQ ID NO: 149518 - RNA, 20 nt, Human
auuuuucccccuuuuuuucu

SEQ ID NO: 149519 - RNA, 18 nt, Human
cugcauuauuccccaggc

SEQ ID NO: 149520 - RNA, 22 nt, Human
cuuuuuuucuuucucucgcucc

SEQ ID NO: 149521 - RNA, 23 nt, Human
gcuccucuuuuuuuuuccccucu

SEQ ID NO: 149522 - RNA, 21 nt, Human
ggaaguuggagcagucaggcc

SEQ ID NO: 149523 - RNA, 19 nt, Human
uacugcauuauuccccagg

SEQ ID NO: 149524 - RNA, 24 nt, Human
uccccaggcggugugcagucugug

SEQ ID NO: 149525 - RNA, 18 nt, Human
ugagagcaggaaguugga

SEQ ID NO: 149526 - RNA, 28 nt, Human
ugauuuuucccccuuuuuuucuuucucu

SEQ ID NO: 149527 - RNA, 19 nt, Human
uguaaugagauccugauuu

SEQ ID NO: 149528 - RNA, 26 nt, Human
uucaucaguuaaugaguccuuaauug

SEQ ID NO: 149529 - RNA, 19 nt, Human
uucuuucucucgcuccucu

SEQ ID NO: 149530 - RNA, 22 nt, Human
uuucccccuuuuuuucuuucuc

SEQ ID NO: 149531 - RNA, 19 nt, Human
uuucuuucucucgcuccuc

SEQ ID NO: 149532 - RNA, 20 nt, Human
uuucuuucucucgcuccucu

SEQ ID NO: 149533 - RNA, 21 nt, Human
uuuuucccccuuuuuuucuuu

SEQ ID NO: 149534 - RNA, 23 nt, Human
uuuuuucuuucucucgcuccucu

SEQ ID NO: 149535 - RNA, 22 nt, Human
aaaagaaaaggaaaagacagag

SEQ ID NO: 149536 - RNA, 22 nt, Human
aaacucgaggacggcgcggcag

SEQ ID NO: 149537 - RNA, 21 nt, Human
aaagaaaaagaaaaggaaaag

SEQ ID NO: 149538 - RNA, 18 nt, Human
aaagauguuuucaauggg

SEQ ID NO: 149539 - RNA, 21 nt, Human
aagaaaaagaaaaggaaaaga

SEQ ID NO: 149540 - RNA, 19 nt, Human
aagcauaauuuuuccuggc

SEQ ID NO: 149541 - RNA, 23 nt, Human
agaaaaaccaaccugaauucagg

SEQ ID NO: 149542 - RNA, 18 nt, Human
agaaaaggaaaagacaga

SEQ ID NO: 149543 - RNA, 19 nt, Human
agcauaauuuuuccuggcc

SEQ ID NO: 149544 - RNA, 22 nt, Human
agcccaccaaaaacuucuucag

SEQ ID NO: 149545 - RNA, 20 nt, Human
aggaaagaaaaagaaaagga

SEQ ID NO: 149546 - RNA, 18 nt, Human
aggaaggaaggaaagaaa

SEQ ID NO: 149547 - RNA, 23 nt, Human
augaggugugugaaaaaucuauu

SEQ ID NO: 149548 - RNA, 24 nt, Human
caacuuguuacucaacaucacacc

SEQ ID NO: 149549 - RNA, 27 nt, Human
caauaguuuuucccccuacaagugguu

SEQ ID NO: 149550 - RNA, 22 nt, Human
cagccuccuccucacgcuggaa

SEQ ID NO: 149551 - RNA, 19 nt, Human
cccgcggcggaguagaagg

SEQ ID NO: 149552 - RNA, 24 nt, Human
cccucagccuccuccucacgcugg

SEQ ID NO: 149553 - RNA, 18 nt, Human
cccucggucuccgccucg

SEQ ID NO: 149554 - RNA, 22 nt, Human
cccucggucuccgccucgaaca

SEQ ID NO: 149555 - RNA, 23 nt, Human
ccucgaacacgaugcgccucucc

SEQ ID NO: 149556 - RNA, 19 nt, Human
ccuggccaaagggucccaa

SEQ ID NO: 149557 - RNA, 23 nt, Human
cgcggggcucccccucggucucc

SEQ ID NO: 149558 - RNA, 25 nt, Human
cuaaaguaacuguaccaacuuguua

SEQ ID NO: 149559 - RNA, 22 nt, Human
cuacuguuuucuaacuugagau

SEQ ID NO: 149560 - RNA, 18 nt, Human
cucaaaauauuuuuaaag

SEQ ID NO: 149561 - RNA, 22 nt, Human
gccuccuccucacgcuggaaac

SEQ ID NO: 149562 - RNA, 24 nt, Human
ggaaaagacagagggagguggagu

SEQ ID NO: 149563 - RNA, 21 nt, Human
ggcucccccucggucuccgcc

SEQ ID NO: 149564 - RNA, 22 nt, Human
gggcucccccucggucuccgcc

SEQ ID NO: 149565 - RNA, 23 nt, Human
gggcucccccucggucuccgccu

SEQ ID NO: 149566 - RNA, 18 nt, Human
gguggaguuuagacucca

SEQ ID NO: 149567 - RNA, 22 nt, Human
uaaagcccaccaaaaacuucuu

SEQ ID NO: 149568 - RNA, 22 nt, Human
uaaauucugagauucuggugcu

SEQ ID NO: 149569 - RNA, 20 nt, Human
uacauggaugaguucuuugg

SEQ ID NO: 149570 - RNA, 24 nt, Human
uacauggaugaguucuuugguggu

SEQ ID NO: 149571 - RNA, 19 nt, Human
ucacgcuggaaacucgagg

SEQ ID NO: 149572 - RNA, 20 nt, Human
ucgaggacggcgcggcagcc

SEQ ID NO: 149573 - RNA, 22 nt, Human
ugagauucuggugcucaaccuc

SEQ ID NO: 149574 - RNA, 21 nt, Human
ugcaaagcacagucacuaaag

SEQ ID NO: 149575 - RNA, 25 nt, Human
uuaaaggagaaaagaaaaggaaggg

SEQ ID NO: 149576 - RNA, 19 nt, Human
uuccaaauagaaaaaccaa

SEQ ID NO: 149577 - RNA, 21 nt, Human
uucuuuggugguaaauucuga

SEQ ID NO: 149578 - RNA, 25 nt, Human
uugaaugucuguuucuucguuccuu

SEQ ID NO: 149579 - RNA, 19 nt, Human
uuuaggaggaaauagaaaa

SEQ ID NO: 149580 - RNA, 22 nt, Human
uuuuuuuuuuuuuuuuucauuu

SEQ ID NO: 149581 - RNA, 22 nt, Human
aaaccgaggacaucgcaaagaa

SEQ ID NO: 149582 - RNA, 19 nt, Human
aaagcccucugcccccuug

SEQ ID NO: 149583 - RNA, 19 nt, Human
aagaaaagucugacgccgc

SEQ ID NO: 149584 - RNA, 21 nt, Human
accagcagaggccaccugccc

SEQ ID NO: 149585 - RNA, 21 nt, Human
acccagggcagcggcuagacc

SEQ ID NO: 149586 - RNA, 20 nt, Human
acccucccagauccccgcca

SEQ ID NO: 149587 - RNA, 20 nt, Human
agagccagagaccagcagag

SEQ ID NO: 149588 - RNA, 18 nt, Human
agagggacggagggaggc

SEQ ID NO: 149589 - RNA, 18 nt, Human
agcagcagcaacaaaugg

SEQ ID NO: 149590 - RNA, 19 nt, Human
aggcaggacccagggcagc

SEQ ID NO: 149591 - RNA, 18 nt, Human
aggcaggcgcgccacccc

SEQ ID NO: 149592 - RNA, 22 nt, Human
aggcaggcgcgccaccccaagg

SEQ ID NO: 149593 - RNA, 21 nt, Human
aggcagugggcuuccugggga

SEQ ID NO: 149594 - RNA, 23 nt, Human
aggcagugggcuuccuggggagc

SEQ ID NO: 149595 - RNA, 23 nt, Human
aguggcugucuuuguauaaaacu

SEQ ID NO: 149596 - RNA, 18 nt, Human
caaaauagccaccugggc

SEQ ID NO: 149597 - RNA, 20 nt, Human
caaaauagccaccugggcca

SEQ ID NO: 149598 - RNA, 23 nt, Human
caaaauagccaccugggccaccc

SEQ ID NO: 149599 - RNA, 19 nt, Human
caaggucucaacagugugg

SEQ ID NO: 149600 - RNA, 23 nt, Human
cagaaacacaguggcccccgaca

SEQ ID NO: 149601 - RNA, 23 nt, Human
cagauccccgccaucggggaggg

SEQ ID NO: 149602 - RNA, 21 nt, Human
cagcaacaaaugggaaaccga

SEQ ID NO: 149603 - RNA, 25 nt, Human
cagcagcaacaaaugggaaacccua

SEQ ID NO: 149604 - RNA, 22 nt, Human
cagcagcagcaacaaaugggaa

SEQ ID NO: 149605 - RNA, 23 nt, Human
cagcagcagcaacaaaugggaaa

SEQ ID NO: 149606 - RNA, 19 nt, Human
caggacccagggcagcggc

SEQ ID NO: 149607 - RNA, 24 nt, Human
caucgagaccacaaggucucaaca

SEQ ID NO: 149608 - RNA, 21 nt, Human
ccacaaguggacagagggacg

SEQ ID NO: 149609 - RNA, 21 nt, Human
ccagcagaggccaccugccca

SEQ ID NO: 149610 - RNA, 21 nt, Human
cccaaggaggagaggcugggg

SEQ ID NO: 149611 - RNA, 31 nt, Human
cccaucauaagcagggacugcucaggaagcu

SEQ ID NO: 149612 - RNA, 22 nt, Human
ccccaagggccuaggagucuuc

SEQ ID NO: 149613 - RNA, 19 nt, Human
cccccgacccucccagauc

SEQ ID NO: 149614 - RNA, 23 nt, Human
ccccggaggcugcagccagggag

SEQ ID NO: 149615 - RNA, 18 nt, Human
cccucccagauccccgcc

SEQ ID NO: 149616 - RNA, 25 nt, Human
cccucugcccccuuggcucugagca

SEQ ID NO: 149617 - RNA, 20 nt, Human
cccuggguguccgaggagag

SEQ ID NO: 149618 - RNA, 22 nt, Human
ccgccuuuugcucccccgaccc

SEQ ID NO: 149619 - RNA, 24 nt, Human
ccuuuugcucccccgacccuccca

SEQ ID NO: 149620 - RNA, 18 nt, Human
cgagacaggaggcugaac

SEQ ID NO: 149621 - RNA, 22 nt, Human
cgagacaggaggcugaaccccg

SEQ ID NO: 149622 - RNA, 21 nt, Human
cgcagggagggccgagguggg

SEQ ID NO: 149623 - RNA, 21 nt, Human
cuagacccuggguguccgagg

SEQ ID NO: 149624 - RNA, 22 nt, Human
cuagacccuggguguccgagga

SEQ ID NO: 149625 - RNA, 25 nt, Human
cucaaaauagccaccugggccaccc

SEQ ID NO: 149626 - RNA, 26 nt, Human
cucaaaauagccaccugggccacccu

SEQ ID NO: 149627 - RNA, 20 nt, Human
cucaccgccuuuugcucccc

SEQ ID NO: 149628 - RNA, 22 nt, Human
cucccccgacccucccagaucc

SEQ ID NO: 149629 - RNA, 19 nt, Human
cugaaagcccucugccccc

SEQ ID NO: 149630 - RNA, 25 nt, Human
cugaaagcccucugcccccuuggcu

SEQ ID NO: 149631 - RNA, 23 nt, Human
cugcagccagggaggaggcagug

SEQ ID NO: 149632 - RNA, 26 nt, Human
cugcccauuccccacgcccucagaac

SEQ ID NO: 149633 - RNA, 24 nt, Human
cuuccucggguuuauuuuuuuaaa

SEQ ID NO: 149634 - RNA, 23 nt, Human
cuugcagccacccgccagggcca

SEQ ID NO: 149635 - RNA, 26 nt, Human
cuugcagccacccgccagggccagac

SEQ ID NO: 149636 - RNA, 21 nt, Human
gaggagagggaggcacagguu

SEQ ID NO: 149637 - RNA, 19 nt, Human
gaggaggcagugggcuucc

SEQ ID NO: 149638 - RNA, 21 nt, Human
gagucucaacuuggagcacag

SEQ ID NO: 149639 - RNA, 23 nt, Human
gcacagaaacacaguggcccccg

SEQ ID NO: 149640 - RNA, 22 nt, Human
gcagcaacaaaugggaaaccga

SEQ ID NO: 149641 - RNA, 23 nt, Human
gcagcagcagcaacaaaugggaa

SEQ ID NO: 149642 - RNA, 21 nt, Human
gcagugggcuuccuggggagc

SEQ ID NO: 149643 - RNA, 19 nt, Human
gccacccgccagggccaga

SEQ ID NO: 149644 - RNA, 21 nt, Human
gcccaaggaggagaggcuggg

SEQ ID NO: 149645 - RNA, 22 nt, Human
gcgccaccccaagggccuagga

SEQ ID NO: 149646 - RNA, 18 nt, Human
ggacggagggaggccagc

SEQ ID NO: 149647 - RNA, 18 nt, Human
ggagaggcuggggaaagg

SEQ ID NO: 149648 - RNA, 21 nt, Human
ggaggagaggcuggggaaagg

SEQ ID NO: 149649 - RNA, 24 nt, Human
ggaggagaggcuggggaaaggggu

SEQ ID NO: 149650 - RNA, 18 nt, Human
gggccgaggugggcuugc

SEQ ID NO: 149651 - RNA, 21 nt, Human
gucugcaggggcugcccugaa

SEQ ID NO: 149652 - RNA, 20 nt, Human
uaaacguagagccagagacc

SEQ ID NO: 149653 - RNA, 22 nt, Human
uaaacguagagccagagaccag

SEQ ID NO: 149654 - RNA, 19 nt, Human
uagagccagagaccagcag

SEQ ID NO: 149655 - RNA, 20 nt, Human
uauaaaacuagaaaaggcag

SEQ ID NO: 149656 - RNA, 26 nt, Human
uccccacgcccucagaacgcagcugc

SEQ ID NO: 149657 - RNA, 18 nt, Human
ucgcaaagaaaagucuga

SEQ ID NO: 149658 - RNA, 27 nt, Human
ucucucaccgccuuuugcucccccgac

SEQ ID NO: 149659 - RNA, 20 nt, Human
ugagcagcagcagcaacaaa

SEQ ID NO: 149660 - RNA, 21 nt, Human
ugcaccuuucgacgaccucug

SEQ ID NO: 149661 - RNA, 20 nt, Human
ugcagccagggaggaggcag

SEQ ID NO: 149662 - RNA, 21 nt, Human
ugcaggcaggacccagggcag

SEQ ID NO: 149663 - RNA, 22 nt, Human
ugcccaaggaggagaggcuggg

SEQ ID NO: 149664 - RNA, 23 nt, Human
ugccuaaacguagagccagagac

SEQ ID NO: 149665 - RNA, 21 nt, Human
uggagcagagacccugcccaa

SEQ ID NO: 149666 - RNA, 21 nt, Human
uggcccccgacagcugagggc

SEQ ID NO: 149667 - RNA, 26 nt, Human
uguggaaugagcagcagcagcaacaa

SEQ ID NO: 149668 - RNA, 18 nt, Human
uuagcaguagcuaaaagu

SEQ ID NO: 149669 - RNA, 25 nt, Human
uuccucggguuuauuuuuuuaaaua

SEQ ID NO: 149670 - RNA, 21 nt, Human
uugcuggagcagagacccugc

SEQ ID NO: 149671 - RNA, 21 nt, Human
uuuguacaaaaauagacucaa

SEQ ID NO: 149672 - RNA, 23 nt, Human
uuuguacaaaaauagacucaagu

SEQ ID NO: 149673 - RNA, 18 nt, Human
aaaaaaaaaacuaaccca

SEQ ID NO: 149674 - RNA, 23 nt, Human
aaaaaaaaaacuaacccaaaacu

SEQ ID NO: 149675 - RNA, 26 nt, Human
aaaaaaacuaacccaaaacucuugca

SEQ ID NO: 149676 - RNA, 19 nt, Human
aaaaacaaagcaaaaaaaa

SEQ ID NO: 149677 - RNA, 18 nt, Human
aaaccccagacuagcugg

SEQ ID NO: 149678 - RNA, 22 nt, Human
aaagaggaacagagcaaggcaa

SEQ ID NO: 149679 - RNA, 22 nt, Human
aacaaagcaaaaaaaaaaaaaa

SEQ ID NO: 149680 - RNA, 21 nt, Human
aacaccaaacgcuuggauagc

SEQ ID NO: 149681 - RNA, 19 nt, Human
aacagagcaaggcaaaagc

SEQ ID NO: 149682 - RNA, 24 nt, Human
aacagagcaaggcaaaagcaggga

SEQ ID NO: 149683 - RNA, 19 nt, Human
aaccacaaauacugauucu

SEQ ID NO: 149684 - RNA, 20 nt, Human
aagaggcugggagcgugggu

SEQ ID NO: 149685 - RNA, 24 nt, Human
aagcaaaaaaaaaaaaaaaacuaa

SEQ ID NO: 149686 - RNA, 30 nt, Human
aagcaaaaaaaaaaaaaaaacuaacccaag

SEQ ID NO: 149687 - RNA, 21 nt, Human
aagcugcugccaccacaaagc

SEQ ID NO: 149688 - RNA, 19 nt, Human
aaggacgguuccaaggcgu

SEQ ID NO: 149689 - RNA, 23 nt, Human
acaaagcaaaaaaaaaaaaaaaa

SEQ ID NO: 149690 - RNA, 20 nt, Human
acagagcaaggcaaaagcag

SEQ ID NO: 149691 - RNA, 23 nt, Human
acagagcaaggcaaaagcaggga

SEQ ID NO: 149692 - RNA, 18 nt, Human
agacaggggccuuggggc

SEQ ID NO: 149693 - RNA, 22 nt, Human
agacaggggccuuggggcacug

SEQ ID NO: 149694 - RNA, 18 nt, Human
agacucuuuuguccaaaa

SEQ ID NO: 149695 - RNA, 18 nt, Human
agagaggggaaaggagga

SEQ ID NO: 149696 - RNA, 21 nt, Human
agccaugugaacagagacccg

SEQ ID NO: 149697 - RNA, 22 nt, Human
aggaagggcaugccugcagagg

SEQ ID NO: 149698 - RNA, 23 nt, Human
aggaagggcaugccugcagaggg

SEQ ID NO: 149699 - RNA, 24 nt, Human
aggaagggcaugccugcagagggc

SEQ ID NO: 149700 - RNA, 19 nt, Human
aggcaaaagcagggagaga

SEQ ID NO: 149701 - RNA, 21 nt, Human
aggcaaaagcagggagagagg

SEQ ID NO: 149702 - RNA, 22 nt, Human
aggggaaaggaggauguggggu

SEQ ID NO: 149703 - RNA, 23 nt, Human
aggggcugaaaguugccagggcu

SEQ ID NO: 149704 - RNA, 21 nt, Human
aguugcagcaggaccucccag

SEQ ID NO: 149705 - RNA, 21 nt, Human
augguuccugaguaagcuugu

SEQ ID NO: 149706 - RNA, 27 nt, Human
caaaaaaaaaaaaaaaacuaacccaaa

SEQ ID NO: 149707 - RNA, 24 nt, Human
caaaaacaaagcaaaaaaaaaaaa

SEQ ID NO: 149708 - RNA, 24 nt, Human
caaacgcuuggauagcaacagucc

SEQ ID NO: 149709 - RNA, 19 nt, Human
caagaugccagcuaggggc

SEQ ID NO: 149710 - RNA, 25 nt, Human
caucacaauccauuuuauuccacag

SEQ ID NO: 149711 - RNA, 22 nt, Human
cauuugugcuuucagcuaagag

SEQ ID NO: 149712 - RNA, 23 nt, Human
ccagggcuagaggugaugcugaa

SEQ ID NO: 149713 - RNA, 20 nt, Human
ccccugaagaacaaugugcu

SEQ ID NO: 149714 - RNA, 21 nt, Human
cuggggcugcuggcuuuccug

SEQ ID NO: 149715 - RNA, 23 nt, Human
gaagaaggcaguucuggccuggg

SEQ ID NO: 149716 - RNA, 19 nt, Human
gacuuagagucgucccccu

SEQ ID NO: 149717 - RNA, 22 nt, Human
gagaggugggaggagauuugag

SEQ ID NO: 149718 - RNA, 19 nt, Human
gaggugggaggagauuuga

SEQ ID NO: 149719 - RNA, 20 nt, Human
gcaguucuggccuggggcag

SEQ ID NO: 149720 - RNA, 22 nt, Human
gcuaagaggcugggagcguggg

SEQ ID NO: 149721 - RNA, 23 nt, Human
ggaaggaagggcaugccugcaga

SEQ ID NO: 149722 - RNA, 19 nt, Human
ggaagggcccuuuggccuu

SEQ ID NO: 149723 - RNA, 20 nt, Human
ggaugugggguuuggucuuc

SEQ ID NO: 149724 - RNA, 20 nt, Human
ggcaugggaccuguggacug

SEQ ID NO: 149725 - RNA, 20 nt, Human
ggggcaugucugggcccggc

SEQ ID NO: 149726 - RNA, 22 nt, Human
gugaugcugaagggaaugugga

SEQ ID NO: 149727 - RNA, 19 nt, Human
uaacccaaaacucuugcaa

SEQ ID NO: 149728 - RNA, 22 nt, Human
uacaaugauguaaacuuggaug

SEQ ID NO: 149729 - RNA, 23 nt, Human
uagagucgucccccugaagaaca

SEQ ID NO: 149730 - RNA, 18 nt, Human
uagcaacaguccguccua

SEQ ID NO: 149731 - RNA, 24 nt, Human
uaggggcugaaaguugccagggcu

SEQ ID NO: 149732 - RNA, 21 nt, Human
uccaaaaacaaagcaaaaaaa

SEQ ID NO: 149733 - RNA, 22 nt, Human
ucccaccaguggacugcagcca

SEQ ID NO: 149734 - RNA, 24 nt, Human
ucccaccaguggacugcagccaug

SEQ ID NO: 149735 - RNA, 21 nt, Human
uccguccuagaggcauuuagg

SEQ ID NO: 149736 - RNA, 21 nt, Human
ucuagagagaggggaaaggag

SEQ ID NO: 149737 - RNA, 22 nt, Human
ucuugcaaauuguaaauaccag

SEQ ID NO: 149738 - RNA, 22 nt, Human
ugaacagagacccgccgcacac

SEQ ID NO: 149739 - RNA, 19 nt, Human
ugagccaugugaacagaga

SEQ ID NO: 149740 - RNA, 19 nt, Human
ugcucuugucccaccagug

SEQ ID NO: 149741 - RNA, 21 nt, Human
uggaacuugaguugcagcagg

SEQ ID NO: 149742 - RNA, 18 nt, Human
uggaauaccaccagaugg

SEQ ID NO: 149743 - RNA, 21 nt, Human
ugggcagucuggggcugcugg

SEQ ID NO: 149744 - RNA, 20 nt, Human
uggugaggagggaagauuug

SEQ ID NO: 149745 - RNA, 21 nt, Human
uggugcgagaugauucuagag

SEQ ID NO: 149746 - RNA, 24 nt, Human
uguccaaaaacaaagcaaaaaaaa

SEQ ID NO: 149747 - RNA, 20 nt, Human
ugugaacagagacccgccgc

SEQ ID NO: 149748 - RNA, 21 nt, Human
ugugaacagagacccgccgca

SEQ ID NO: 149749 - RNA, 18 nt, Human
ugugcuggaauaccacca

SEQ ID NO: 149750 - RNA, 21 nt, Human
uguggacccacagcuucccuu

SEQ ID NO: 149751 - RNA, 19 nt, Human
uguguuuucauuccucucu

SEQ ID NO: 149752 - RNA, 19 nt, Human
uucaccauuugugcuuuca

SEQ ID NO: 149753 - RNA, 24 nt, Human
aaaaacacagacacggcugccuua

SEQ ID NO: 149754 - RNA, 25 nt, Human
aaaaagacaaaagcaaaagccucag

SEQ ID NO: 149755 - RNA, 23 nt, Human
aaacaugguuacugacaggaagc

SEQ ID NO: 149756 - RNA, 23 nt, Human
aaacaugguuacugacaggaagc

SEQ ID NO: 149757 - RNA, 21 nt, Human
aacuuguucuccauguaccuc

SEQ ID NO: 149758 - RNA, 19 nt, Human
aagcaaaagacaaggcacc

SEQ ID NO: 149759 - RNA, 23 nt, Human
aagcaaaagacaaggcaccagaa

SEQ ID NO: 149760 - RNA, 21 nt, Human
aaggccaaaggaaagcaaacu

SEQ ID NO: 149761 - RNA, 20 nt, Human
aaugccaaugugcuaacgua

SEQ ID NO: 149762 - RNA, 21 nt, Human
acaaaaacacagacacggcug

SEQ ID NO: 149763 - RNA, 24 nt, Human
accucuuucuacaccucccuccag

SEQ ID NO: 149764 - RNA, 25 nt, Human
agacaaaaacacagacacggcugcc

SEQ ID NO: 149765 - RNA, 26 nt, Human
agacaaaaacacagacacggcugccc

SEQ ID NO: 149766 - RNA, 26 nt, Human
agacaaaaacacagacacggcugccu

SEQ ID NO: 149767 - RNA, 18 nt, Human
agacaaaagcaaaagccu

SEQ ID NO: 149768 - RNA, 20 nt, Human
agacaaggcaccagaaugua

SEQ ID NO: 149769 - RNA, 18 nt, Human
agacagggaccaagagga

SEQ ID NO: 149770 - RNA, 18 nt, Human
agagcacccugccuucau

SEQ ID NO: 149771 - RNA, 19 nt, Human
agagggcaggacuuggcca

SEQ ID NO: 149772 - RNA, 20 nt, Human
agcuggguuuucccugcagc

SEQ ID NO: 149773 - RNA, 20 nt, Human
agcuggguuuucccugcagc

SEQ ID NO: 149774 - RNA, 18 nt, Human
aggaagcuccuggcugcc

SEQ ID NO: 149775 - RNA, 23 nt, Human
agggaccaagaggaaacucuggg

SEQ ID NO: 149776 - RNA, 22 nt, Human
agggcaggacuuggccaggagg

SEQ ID NO: 149777 - RNA, 23 nt, Human
auaguaaugaaaauauauaguac

SEQ ID NO: 149778 - RNA, 26 nt, Human
aucacuacagauucuguacaagcaaa

SEQ ID NO: 149779 - RNA, 24 nt, Human
auggugauggagugggcagagcac

SEQ ID NO: 149780 - RNA, 20 nt, Human
augugggggaagagcaguag

SEQ ID NO: 149781 - RNA, 24 nt, Human
caaaaacacagacacggcugccuu

SEQ ID NO: 149782 - RNA, 18 nt, Human
caaaagacaaggcaccag

SEQ ID NO: 149783 - RNA, 20 nt, Human
caagaggaaacucugggugg

SEQ ID NO: 149784 - RNA, 25 nt, Human
cacagucuaggcccaggccucagcu

SEQ ID NO: 149785 - RNA, 18 nt, Human
caccauaugaagcuggag

SEQ ID NO: 149786 - RNA, 21 nt, Human
cacccugccuucaugacucuu

SEQ ID NO: 149787 - RNA, 25 nt, Human
caccucccuccagggcgcagacccu

SEQ ID NO: 149788 - RNA, 24 nt, Human
cacuaggaagggaaggccaacuuc

SEQ ID NO: 149789 - RNA, 26 nt, Human
cacuucaaggcucucaacacgcccaa

SEQ ID NO: 149790 - RNA, 20 nt, Human
cagagcacccugccuucaug

SEQ ID NO: 149791 - RNA, 20 nt, Human
caggaagcuccuggcuguug

SEQ ID NO: 149792 - RNA, 20 nt, Human
caggcucaggaggaaaaggu

SEQ ID NO: 149793 - RNA, 26 nt, Human
caguagaaucuagugaccucaccaca

SEQ ID NO: 149794 - RNA, 19 nt, Human
caucaaaaaagacaaaagc

SEQ ID NO: 149795 - RNA, 20 nt, Human
caucaaaaaagacaaaagca

SEQ ID NO: 149796 - RNA, 28 nt, Human
caucaaaaaagacaaaagcaaaagccuc

SEQ ID NO: 149797 - RNA, 21 nt, Human
ccacagucuaggcccaggccu

SEQ ID NO: 149798 - RNA, 24 nt, Human
ccaugccaggccaccaauacugaa

SEQ ID NO: 149799 - RNA, 25 nt, Human
cccaaaaucccuucuccuggguacc

SEQ ID NO: 149800 - RNA, 19 nt, Human
cccaacacaccuguccucu

SEQ ID NO: 149801 - RNA, 20 nt, Human
cuacaccucccuccagggcg

SEQ ID NO: 149802 - RNA, 21 nt, Human
cuagugaccucaccacagucu

SEQ ID NO: 149803 - RNA, 19 nt, Human
cuccuggcuguuguuaaau

SEQ ID NO: 149804 - RNA, 19 nt, Human
cuccugggcccaaaauccc

SEQ ID NO: 149805 - RNA, 20 nt, Human
cuccugggcccaaaaucccu

SEQ ID NO: 149806 - RNA, 19 nt, Human
cucucaacacgcccaacac

SEQ ID NO: 149807 - RNA, 27 nt, Human
cugggccagcuguugcucacgugggga

SEQ ID NO: 149808 - RNA, 19 nt, Human
cuggguuuucccugcagcg

SEQ ID NO: 149809 - RNA, 23 nt, Human
gacuugcugggaugagacugagc

SEQ ID NO: 149810 - RNA, 25 nt, Human
gagccaaccucagaagcagcaacgu

SEQ ID NO: 149811 - RNA, 19 nt, Human
gcacuaggaagggaaggcc

SEQ ID NO: 149812 - RNA, 19 nt, Human
gccaaccucagaagcagca

SEQ ID NO: 149813 - RNA, 25 nt, Human
gccaaccucagaagcaggggaacgc

SEQ ID NO: 149814 - RNA, 19 nt, Human
gccaggaggucuuugacuu

SEQ ID NO: 149815 - RNA, 21 nt, Human
gccaggaggucuuugacuugc

SEQ ID NO: 149816 - RNA, 31 nt, Human
gcccucaucaaaaaagacaaaagcaaaagcu

SEQ ID NO: 149817 - RNA, 19 nt, Human
gcuccuggcugcucucugg

SEQ ID NO: 149818 - RNA, 25 nt, Human
gcugcaauucagguuaggggagauu

SEQ ID NO: 149819 - RNA, 18 nt, Human
ggacuggaaggcaagggc

SEQ ID NO: 149820 - RNA, 20 nt, Human
ggcaggacuuggccaggagg

SEQ ID NO: 149821 - RNA, 19 nt, Human
gggcaggacuuggccagga

SEQ ID NO: 149822 - RNA, 19 nt, Human
gggucuggaaggccaaagg

SEQ ID NO: 149823 - RNA, 18 nt, Human
guguggccucagccggcc

SEQ ID NO: 149824 - RNA, 21 nt, Human
uacaagcaaaagacaaggcac

SEQ ID NO: 149825 - RNA, 19 nt, Human
uacaugaaagaguauuuau

SEQ ID NO: 149826 - RNA, 19 nt, Human
uacaugaaagaguauuuau

SEQ ID NO: 149827 - RNA, 23 nt, Human
uacaugaaagaguauuuauugaa

SEQ ID NO: 149828 - RNA, 23 nt, Human
uacaugaaagaguauuuauugaa

SEQ ID NO: 149829 - RNA, 24 nt, Human
uagagccaaccucagaagcagcaa

SEQ ID NO: 149830 - RNA, 23 nt, Human
uauuuauugaaaacaugguuacu

SEQ ID NO: 149831 - RNA, 23 nt, Human
uauuuauugaaaacaugguuacu

SEQ ID NO: 149832 - RNA, 20 nt, Human
ucaaaaaagacaaaagcaaa

SEQ ID NO: 149833 - RNA, 21 nt, Human
ucaccacagucuaggcccagg

SEQ ID NO: 149834 - RNA, 25 nt, Human
ucacuacagauucuguacaagcaaa

SEQ ID NO: 149835 - RNA, 20 nt, Human
ucagccagcucccugaaauc

SEQ ID NO: 149836 - RNA, 24 nt, Human
ucagccggccucagccagcucccu

SEQ ID NO: 149837 - RNA, 22 nt, Human
ucuacaccucccuccagggcgc

SEQ ID NO: 149838 - RNA, 24 nt, Human
ucuccauguaccucuuuucccaag

SEQ ID NO: 149839 - RNA, 21 nt, Human
ucucugaggaaggaaaagguc

SEQ ID NO: 149840 - RNA, 19 nt, Human
ucucugguuacaaucuugg

SEQ ID NO: 149841 - RNA, 22 nt, Human
ucucugguuacaaucuuggcuc

SEQ ID NO: 149842 - RNA, 22 nt, Human
ucuuggacuggaaggcaagggc

SEQ ID NO: 149843 - RNA, 20 nt, Human
ugaaaucauggccaauggca

SEQ ID NO: 149844 - RNA, 21 nt, Human
ugcagggagaaauuuccgucu

SEQ ID NO: 149845 - RNA, 18 nt, Human
ugcugggaugagacugag

SEQ ID NO: 149846 - RNA, 18 nt, Human
uggcuggcauuuacuggc

SEQ ID NO: 149847 - RNA, 19 nt, Human
ugggggaagagcaguagaa

SEQ ID NO: 149848 - RNA, 18 nt, Human
ugggugguccgagguggg

SEQ ID NO: 149849 - RNA, 20 nt, Human
uguaccucuuucuacaccuc

SEQ ID NO: 149850 - RNA, 22 nt, Human
ugugcuaacguauguccaggga

SEQ ID NO: 149851 - RNA, 23 nt, Human
uguggccucagccggccucagcc

SEQ ID NO: 149852 - RNA, 25 nt, Human
uguugcucacguggggauccagcug

SEQ ID NO: 149853 - RNA, 26 nt, Human
uguuuguuccucguggcccaauccca

SEQ ID NO: 149854 - RNA, 21 nt, Human
uuauauaaauauauauacacg

SEQ ID NO: 149855 - RNA, 19 nt, Human
uuuccugggccagcuguug

SEQ ID NO: 149856 - RNA, 20 nt, Human
uuuuuuuuuuuuuuuguaca

SEQ ID NO: 149857 - RNA, 20 nt, Human
uuuuuuuuuuuuuuuguaca

SEQ ID NO: 149858 - RNA, 18 nt, Human
uuuuuuuuuuuuuuuuug

SEQ ID NO: 149859 - RNA, 19 nt, Human
uuuuuuuuuuuuuuuuugu

SEQ ID NO: 149860 - RNA, 19 nt, Human
uuuuuuuuuuuuuuuuugu

SEQ ID NO: 149861 - RNA, 23 nt, Human
uuuuuuuuuuuuuuuuuuuuggg

SEQ ID NO: 149862 - RNA, 18 nt, Human
acccacugcccuucaugg

SEQ ID NO: 149863 - RNA, 23 nt, Human
agacuuuauuucugcagcaaucu

SEQ ID NO: 149864 - RNA, 20 nt, Human
agcugcucagccucaagguc

SEQ ID NO: 149865 - RNA, 25 nt, Human
caagagcugcucagccucaaggucg

SEQ ID NO: 149866 - RNA, 22 nt, Human
caccuccuucagcacagcggcc

SEQ ID NO: 149867 - RNA, 24 nt, Human
ccauccgcaaacugcagggcguaa

SEQ ID NO: 149868 - RNA, 19 nt, Human
cccaagagcugcucagccu

SEQ ID NO: 149869 - RNA, 26 nt, Human
ccgaggccagcggaacaaggcgcccc

SEQ ID NO: 149870 - RNA, 24 nt, Human
ccugcacuccucuacccacugccc

SEQ ID NO: 149871 - RNA, 23 nt, Human
ccuucagcacagcggccaggggc

SEQ ID NO: 149872 - RNA, 24 nt, Human
cgaggccagcggaacaaggcgccc

SEQ ID NO: 149873 - RNA, 24 nt, Human
cgcucagagugcgucaggcuccac

SEQ ID NO: 149874 - RNA, 18 nt, Human
cucuacccacugcccuuc

SEQ ID NO: 149875 - RNA, 22 nt, Human
cugcaguggccgcagcuguggc

SEQ ID NO: 149876 - RNA, 22 nt, Human
cugcugcaguggccgcagcugu

SEQ ID NO: 149877 - RNA, 25 nt, Human
gagcugcucagccucaaggucuggg

SEQ ID NO: 149878 - RNA, 18 nt, Human
gccgugcugaggcacagg

SEQ ID NO: 149879 - RNA, 18 nt, Human
ggccaggggcuucgccug

SEQ ID NO: 149880 - RNA, 22 nt, Human
uguggcccauggccagccacac

SEQ ID NO: 149881 - RNA, 20 nt, Human
aaggaaaacguuacuccaaa

SEQ ID NO: 149882 - RNA, 19 nt, Human
aaggcagggccaagcggaa

SEQ ID NO: 149883 - RNA, 20 nt, Human
aaucccuuugcaacaucccu

SEQ ID NO: 149884 - RNA, 19 nt, Human
acaccaucaucaucaagcc

SEQ ID NO: 149885 - RNA, 21 nt, Human
accuuguaacaucaagcauug

SEQ ID NO: 149886 - RNA, 22 nt, Human
aggagaaagcggagacccagag

SEQ ID NO: 149887 - RNA, 21 nt, Human
augaaaaaucaggaacagccc

SEQ ID NO: 149888 - RNA, 26 nt, Human
auuacaaccaaaauuauacucugacu

SEQ ID NO: 149889 - RNA, 19 nt, Human
caacaccaucaucaucaag

SEQ ID NO: 149890 - RNA, 24 nt, Human
caacaccuuguaacaucaagcauu

SEQ ID NO: 149891 - RNA, 23 nt, Human
cacauuugucuuuucuccccacc

SEQ ID NO: 149892 - RNA, 20 nt, Human
cacauuuucagcuuuggaca

SEQ ID NO: 149893 - RNA, 25 nt, Human
cagaccgaagaaugagugacuauaa

SEQ ID NO: 149894 - RNA, 19 nt, Human
cagcacauaaauguaacua

SEQ ID NO: 149895 - RNA, 22 nt, Human
cagcauacauccuacacaugca

SEQ ID NO: 149896 - RNA, 21 nt, Human
cauagagcacauuugucuuuu

SEQ ID NO: 149897 - RNA, 18 nt, Human
cccacagugauuugugcc

SEQ ID NO: 149898 - RNA, 21 nt, Human
cccagagagagggcugacccc

SEQ ID NO: 149899 - RNA, 19 nt, Human
cccggcugcgucuucuccu

SEQ ID NO: 149900 - RNA, 21 nt, Human
ccggaggcgguggcggccgac

SEQ ID NO: 149901 - RNA, 19 nt, Human
ccucuaacggcggcggccc

SEQ ID NO: 149902 - RNA, 25 nt, Human
ccugaaauuuuauaugauaugggag

SEQ ID NO: 149903 - RNA, 21 nt, Human
cggcaggagaaagcggagacc

SEQ ID NO: 149904 - RNA, 25 nt, Human
cuaguaaucccuuugcaacaucccu

SEQ ID NO: 149905 - RNA, 21 nt, Human
cuccccacccccaagcucucc

SEQ ID NO: 149906 - RNA, 21 nt, Human
cugcgucuucuccugcuccuc

SEQ ID NO: 149907 - RNA, 18 nt, Human
gaauagcucuugggaacc

SEQ ID NO: 149908 - RNA, 20 nt, Human
gagcggcggccgggaacccc

SEQ ID NO: 149909 - RNA, 23 nt, Human
gagcgggcgcuggcggcaggaga

SEQ ID NO: 149910 - RNA, 20 nt, Human
gccgacggggcgagcggcgg

SEQ ID NO: 149911 - RNA, 19 nt, Human
gcggccgggaaccccucua

SEQ ID NO: 149912 - RNA, 19 nt, Human
gcugaaaucagguagcagg

SEQ ID NO: 149913 - RNA, 21 nt, Human
ggacauagagcacauuugucu

SEQ ID NO: 149914 - RNA, 18 nt, Human
ggagaaagcggagacccg

SEQ ID NO: 149915 - RNA, 22 nt, Human
ggcccggcugcgucuucuccug

SEQ ID NO: 149916 - RNA, 20 nt, Human
ggcggccgacggggcgagcg

SEQ ID NO: 149917 - RNA, 21 nt, Human
uaacaacaccuuguaacauca

SEQ ID NO: 149918 - RNA, 23 nt, Human
uaacaacaccuuguaacaucaag

SEQ ID NO: 149919 - RNA, 25 nt, Human
uaauaaagacaugaguuguuucaug

SEQ ID NO: 149920 - RNA, 23 nt, Human
uagcaccaaggagucaagaauau

SEQ ID NO: 149921 - RNA, 18 nt, Human
uagcuuacaaaauauucu

SEQ ID NO: 149922 - RNA, 20 nt, Human
uagcuuacaaaauauucuga

SEQ ID NO: 149923 - RNA, 22 nt, Human
uaugaaaaaucaggaacagcca

SEQ ID NO: 149924 - RNA, 19 nt, Human
ucauuacacacugagcaac

SEQ ID NO: 149925 - RNA, 23 nt, Human
uccacauaugaaaaaucaggaac

SEQ ID NO: 149926 - RNA, 24 nt, Human
uccacauaugaaaaaucaggaaca

SEQ ID NO: 149927 - RNA, 21 nt, Human
ucccuuugcaacaucccuuaa

SEQ ID NO: 149928 - RNA, 24 nt, Human
ucucugggucaccagacaagacuu

SEQ ID NO: 149929 - RNA, 20 nt, Human
ucuggagaauaucaaggcua

SEQ ID NO: 149930 - RNA, 24 nt, Human
ugaaaaaucaggaacagccauaaa

SEQ ID NO: 149931 - RNA, 22 nt, Human
ugaaagagaaggauaguuucac

SEQ ID NO: 149932 - RNA, 19 nt, Human
ugaauagcucuugggaacc

SEQ ID NO: 149933 - RNA, 18 nt, Human
ugauaugggaguuuuucc

SEQ ID NO: 149934 - RNA, 23 nt, Human
ugcagcuuugacauguuguugag

SEQ ID NO: 149935 - RNA, 20 nt, Human
ugucuuuucuccccaccccc

SEQ ID NO: 149936 - RNA, 19 nt, Human
uuaaugauugcuuuggucu

SEQ ID NO: 149937 - RNA, 19 nt, Human
uuacugcaauucuuucuua

SEQ ID NO: 149938 - RNA, 24 nt, Human
uuagcaccaaggagucaagaauau

SEQ ID NO: 149939 - RNA, 22 nt, Human
uucaaaugcugccuuuucauca

SEQ ID NO: 149940 - RNA, 18 nt, Human
uucauuuguaaauagcaa

SEQ ID NO: 149941 - RNA, 19 nt, Human
uucuuauuuucaccaacac

SEQ ID NO: 149942 - RNA, 21 nt, Human
uugcaccaaaauggguuuaua

SEQ ID NO: 149943 - RNA, 18 nt, Human
uugcuucuguuuucccug

SEQ ID NO: 149944 - RNA, 21 nt, Human
uugucuuucucuaguaauccc

SEQ ID NO: 149945 - RNA, 19 nt, Human
uugugcugaaaucagguag

SEQ ID NO: 149946 - RNA, 24 nt, Human
uuuccucacugucaacaacaguua

SEQ ID NO: 149947 - RNA, 25 nt, Human
uuuuuuuuuuuuuuuuuuuauuuuu

SEQ ID NO: 149948 - RNA, 24 nt, Human
aaaaacacauaaagccccugcccc

SEQ ID NO: 149949 - RNA, 22 nt, Human
aaaacacauaaagccccugccc

SEQ ID NO: 149950 - RNA, 19 nt, Human
aaagaccuagcucugaagc

SEQ ID NO: 149951 - RNA, 24 nt, Human
aaagaccuagcucugaagcccaga

SEQ ID NO: 149952 - RNA, 19 nt, Human
aaagccccugccccugccc

SEQ ID NO: 149953 - RNA, 19 nt, Human
aaagccccugccccugccc

SEQ ID NO: 149954 - RNA, 20 nt, Human
aagcaaaaacacauaaagcc

SEQ ID NO: 149955 - RNA, 19 nt, Human
aauccccuccccccaacaa

SEQ ID NO: 149956 - RNA, 18 nt, Human
acaagaugacaaaaggag

SEQ ID NO: 149957 - RNA, 23 nt, Human
agaggaccauggagggccugagu

SEQ ID NO: 149958 - RNA, 24 nt, Human
agccaggacuuccccaaagaccua

SEQ ID NO: 149959 - RNA, 20 nt, Human
aggcagucagccaggacuuc

SEQ ID NO: 149960 - RNA, 22 nt, Human
aggccuggcggcggcccgggcc

SEQ ID NO: 149961 - RNA, 23 nt, Human
aggccuggcggcggcccgggccu

SEQ ID NO: 149962 - RNA, 22 nt, Human
caaaaacaaagucaggguggcc

SEQ ID NO: 149963 - RNA, 23 nt, Human
caaaaacaaagucaggguggccc

SEQ ID NO: 149964 - RNA, 22 nt, Human
caaagaccuagcucugaagccc

SEQ ID NO: 149965 - RNA, 18 nt, Human
caagaugacaaaaggagg

SEQ ID NO: 149966 - RNA, 21 nt, Human
caagcaaaaacacauaaagcc

SEQ ID NO: 149967 - RNA, 24 nt, Human
cacauaaagccccugccccugccc

SEQ ID NO: 149968 - RNA, 18 nt, Human
cacccccacccccacugc

SEQ ID NO: 149969 - RNA, 22 nt, Human
cagccaggacuuccccaaagac

SEQ ID NO: 149970 - RNA, 21 nt, Human
cagcgccccccaagcaaaaac

SEQ ID NO: 149971 - RNA, 21 nt, Human
cccaacaagaugacaaaagga

SEQ ID NO: 149972 - RNA, 21 nt, Human
cccaagcaaaaacacauaaag

SEQ ID NO: 149973 - RNA, 27 nt, Human
cccacugcuaaggcagucagccaggac

SEQ ID NO: 149974 - RNA, 27 nt, Human
ccccaaagaccuagcucugaagcccag

SEQ ID NO: 149975 - RNA, 22 nt, Human
cccccacccccacccccacugc

SEQ ID NO: 149976 - RNA, 25 nt, Human
cucugggcuaggcccagcgcccccc

SEQ ID NO: 149977 - RNA, 20 nt, Human
cugcccccacccccaccccc

SEQ ID NO: 149978 - RNA, 20 nt, Human
cugccccugcccccaccccc

SEQ ID NO: 149979 - RNA, 19 nt, Human
gcccccacccccaccccca

SEQ ID NO: 149980 - RNA, 20 nt, Human
gcccgggccuaccaaaaccg

SEQ ID NO: 149981 - RNA, 19 nt, Human
ggcccgggccuaccaaaac

SEQ ID NO: 149982 - RNA, 18 nt, Human
ggccugagucugcugccu

SEQ ID NO: 149983 - RNA, 18 nt, Human
ggggagcaagcacuacuc

SEQ ID NO: 149984 - RNA, 23 nt, Human
ggugcgggcucaggcggaggccu

SEQ ID NO: 149985 - RNA, 18 nt, Human
gugggacaaggcaggggg

SEQ ID NO: 149986 - RNA, 18 nt, Human
uaauccccuccccccaac

SEQ ID NO: 149987 - RNA, 25 nt, Human
ucaacaaaaugacaaagaggaccau

SEQ ID NO: 149988 - RNA, 27 nt, Human
ucaacaaaaugacaaagaggaccaugg

SEQ ID NO: 149989 - RNA, 22 nt, Human
ucccuggugggacaaggcaggg

SEQ ID NO: 149990 - RNA, 22 nt, Human
ugacaaagaggaccauggaggg

SEQ ID NO: 149991 - RNA, 21 nt, Human
ugccccugcccccacccccac

SEQ ID NO: 149992 - RNA, 22 nt, Human
uguguguccacaaaaacaaagu

SEQ ID NO: 149993 - RNA, 21 nt, Human
uuugguuaauccccucccccc

SEQ ID NO: 149994 - RNA, 21 nt, Human
aaacaaccagugccauagagc

SEQ ID NO: 149995 - RNA, 19 nt, Human
aaacagaaaucacagugac

SEQ ID NO: 149996 - RNA, 20 nt, Human
aaacuuggaaacgccugugu

SEQ ID NO: 149997 - RNA, 18 nt, Human
aauguaaacguugcaacc

SEQ ID NO: 149998 - RNA, 19 nt, Human
acaacaaaagugaacacgg

SEQ ID NO: 149999 - RNA, 19 nt, Human
acaguuuuccugagguuug

SEQ ID NO: 150000 - RNA, 18 nt, Human
agguagccggcggagggc

SEQ ID NO: 150001 - RNA, 22 nt, Human
auacauuccccaauguaaacaa

SEQ ID NO: 150002 - RNA, 24 nt, Human
caaguaauauacacaagaaggugg

SEQ ID NO: 150003 - RNA, 20 nt, Human
cacugaaacuuggaaacgcc

SEQ ID NO: 150004 - RNA, 18 nt, Human
cagugaccaaggguaaug

SEQ ID NO: 150005 - RNA, 18 nt, Human
cagugccauagagcucag

SEQ ID NO: 150006 - RNA, 20 nt, Human
ccgcgcccgcuccccggccc

SEQ ID NO: 150007 - RNA, 20 nt, Human
ccggccgcgccgccgccgcu

SEQ ID NO: 150008 - RNA, 20 nt, Human
ccuugcccaugcugcucccc

SEQ ID NO: 150009 - RNA, 23 nt, Human
cuccccggcccggccgcgccgcc

SEQ ID NO: 150010 - RNA, 20 nt, Human
cugcagguuuaugguacgcu

SEQ ID NO: 150011 - RNA, 18 nt, Human
gaugcaagccaggugggu

SEQ ID NO: 150012 - RNA, 21 nt, Human
gcacaagagggauacaagccc

SEQ ID NO: 150013 - RNA, 20 nt, Human
gcgugugaacaagggauggg

SEQ ID NO: 150014 - RNA, 21 nt, Human
ggcccggccgcgccgccgccg

SEQ ID NO: 150015 - RNA, 18 nt, Human
gggggaugcaagccaggu

SEQ ID NO: 150016 - RNA, 21 nt, Human
uaaaaggcauucugugaccau

SEQ ID NO: 150017 - RNA, 19 nt, Human
uaaacaaaacagaaaucac

SEQ ID NO: 150018 - RNA, 23 nt, Human
uaaauauuugacuuagcaagcua

SEQ ID NO: 150019 - RNA, 24 nt, Human
uaauacaugguguuuacuggugcc

SEQ ID NO: 150020 - RNA, 27 nt, Human
ucagaacucaaucuuaucucauacugu

SEQ ID NO: 150021 - RNA, 18 nt, Human
ucagggcgugugaacaag

SEQ ID NO: 150022 - RNA, 24 nt, Human
ucaguuauucacucuucugaagug

SEQ ID NO: 150023 - RNA, 21 nt, Human
ucgcccaugcacaaaagacag

SEQ ID NO: 150024 - RNA, 19 nt, Human
ucugcaguaggcuggugau

SEQ ID NO: 150025 - RNA, 21 nt, Human
ugaaucagggcgugugaacaa

SEQ ID NO: 150026 - RNA, 24 nt, Human
ugaccaaggguaaugcgagucuga

SEQ ID NO: 150027 - RNA, 18 nt, Human
ugacuuggucuacuuggu

SEQ ID NO: 150028 - RNA, 21 nt, Human
ugaucuguccuuuuaggacca

SEQ ID NO: 150029 - RNA, 19 nt, Human
ugccauagagcucagauaa

SEQ ID NO: 150030 - RNA, 18 nt, Human
ugcccugcacuucugcag

SEQ ID NO: 150031 - RNA, 20 nt, Human
ugggugugaagaggcugacc

SEQ ID NO: 150032 - RNA, 22 nt, Human
ugguacgcucgagagagaucuu

SEQ ID NO: 150033 - RNA, 26 nt, Human
ugucacugaaacuuggaaacgccugu

SEQ ID NO: 150034 - RNA, 19 nt, Human
ugugcacugugucauauau

SEQ ID NO: 150035 - RNA, 21 nt, Human
uguguacccugcugaaauauu

SEQ ID NO: 150036 - RNA, 21 nt, Human
ugugucuuccuugcccaugcu

SEQ ID NO: 150037 - RNA, 24 nt, Human
uuagcacaagagggauacaagccc

SEQ ID NO: 150038 - RNA, 21 nt, Human
uuaucucauacuguaaugggu

SEQ ID NO: 150039 - RNA, 23 nt, Human
uucgagacuucucucugcagguu

SEQ ID NO: 150040 - RNA, 21 nt, Human
aaagaccauggcaugaggucu

SEQ ID NO: 150041 - RNA, 18 nt, Human
aaaguacuagccaacuac

SEQ ID NO: 150042 - RNA, 24 nt, Human
aagaaaacgucuucccaaaaaacc

SEQ ID NO: 150043 - RNA, 25 nt, Human
aagaagcccaauacaguacuagaac

SEQ ID NO: 150044 - RNA, 24 nt, Human
aagccagagcuaccacugagccua

SEQ ID NO: 150045 - RNA, 21 nt, Human
aaggacccgccucccgagguu

SEQ ID NO: 150046 - RNA, 21 nt, Human
aagggccuguuguuugguuuu

SEQ ID NO: 150047 - RNA, 20 nt, Human
aaugguuugggauuugaccu

SEQ ID NO: 150048 - RNA, 21 nt, Human
acaaaguucaucuucccacag

SEQ ID NO: 150049 - RNA, 23 nt, Human
accaaaaaucauggcauaacaac

SEQ ID NO: 150050 - RNA, 20 nt, Human
accuccacuucccucccaga

SEQ ID NO: 150051 - RNA, 24 nt, Human
acuccagaagagcugccuuggcuu

SEQ ID NO: 150052 - RNA, 21 nt, Human
acugaauuccacagagcuaaa

SEQ ID NO: 150053 - RNA, 19 nt, Human
agccaacuacuuucucccc

SEQ ID NO: 150054 - RNA, 20 nt, Human
agccaacuacuuucucccca

SEQ ID NO: 150055 - RNA, 21 nt, Human
agccuagguaauuugguggcu

SEQ ID NO: 150056 - RNA, 19 nt, Human
aggagaaagcuaauaaaga

SEQ ID NO: 150057 - RNA, 22 nt, Human
aggagaaagcuaauaaagaaaa

SEQ ID NO: 150058 - RNA, 19 nt, Human
aggugcuggcagcagcccu

SEQ ID NO: 150059 - RNA, 22 nt, Human
caaaaaaccccuuuagacagaa

SEQ ID NO: 150060 - RNA, 23 nt, Human
caaagccccccaguaggcacuuc

SEQ ID NO: 150061 - RNA, 24 nt, Human
caagggccuguuguuugguuuugg

SEQ ID NO: 150062 - RNA, 19 nt, Human
cacaggccaaagcccccca

SEQ ID NO: 150063 - RNA, 22 nt, Human
cacugagccuaggagcccugau

SEQ ID NO: 150064 - RNA, 19 nt, Human
cagaaguggggcugguguu

SEQ ID NO: 150065 - RNA, 22 nt, Human
cagaaucugagauggcuuaaaa

SEQ ID NO: 150066 - RNA, 20 nt, Human
cagcaaccuccacuucccuc

SEQ ID NO: 150067 - RNA, 20 nt, Human
cagcagacagcucgucuacc

SEQ ID NO: 150068 - RNA, 22 nt, Human
cagcagcccugguccgcucuuc

SEQ ID NO: 150069 - RNA, 24 nt, Human
cagcagcccugguccgcucuucug

SEQ ID NO: 150070 - RNA, 18 nt, Human
caggauggcuuccaggcu

SEQ ID NO: 150071 - RNA, 23 nt, Human
caguacuagaacaauccaccaga

SEQ ID NO: 150072 - RNA, 18 nt, Human
cagugcaugacccagaag

SEQ ID NO: 150073 - RNA, 19 nt, Human
caugacccagaaguggggc

SEQ ID NO: 150074 - RNA, 21 nt, Human
cauggcauaacaacuccccaa

SEQ ID NO: 150075 - RNA, 19 nt, Human
ccccaccccccagaucccc

SEQ ID NO: 150076 - RNA, 20 nt, Human
ccccagauccccaugaacuc

SEQ ID NO: 150077 - RNA, 21 nt, Human
ccgcacugaggggaaggaccc

SEQ ID NO: 150078 - RNA, 20 nt, Human
ccucaccugugaagugggau

SEQ ID NO: 150079 - RNA, 20 nt, Human
ccucugcugguguacugggg

SEQ ID NO: 150080 - RNA, 21 nt, Human
ccugggguagaucuucucagg

SEQ ID NO: 150081 - RNA, 18 nt, Human
cgaauuguucacuaguga

SEQ ID NO: 150082 - RNA, 20 nt, Human
cgacugggcucugaccaucc

SEQ ID NO: 150083 - RNA, 22 nt, Human
cucacaggccaaagccccccag

SEQ ID NO: 150084 - RNA, 22 nt, Human
cuccuccccaccccccagaucc

SEQ ID NO: 150085 - RNA, 20 nt, Human
cucuaaccucagccuaggua

SEQ ID NO: 150086 - RNA, 18 nt, Human
cugauggggccccagaca

SEQ ID NO: 150087 - RNA, 19 nt, Human
cugguggcugcagggaggc

SEQ ID NO: 150088 - RNA, 20 nt, Human
cuguacagcaaccuccacuu

SEQ ID NO: 150089 - RNA, 24 nt, Human
cuuaaccaggaauaacauacuacu

SEQ ID NO: 150090 - RNA, 23 nt, Human
cuuacaaacucucuuuccuccuc

SEQ ID NO: 150091 - RNA, 25 nt, Human
cuucacaauuauauagcaccuuuca

SEQ ID NO: 150092 - RNA, 18 nt, Human
cuuucagcaagaggccua

SEQ ID NO: 150093 - RNA, 19 nt, Human
cuuucagcaagaggccuag

SEQ ID NO: 150094 - RNA, 25 nt, Human
gaaauaaucuauuaacgaagaagcc

SEQ ID NO: 150095 - RNA, 24 nt, Human
gacagaaucugagauggcuuaaaa

SEQ ID NO: 150096 - RNA, 21 nt, Human
gacccagaaguggggcuggug

SEQ ID NO: 150097 - RNA, 20 nt, Human
gagaauccccucaguaaugg

SEQ ID NO: 150098 - RNA, 22 nt, Human
gaucacuccagguggugucuaa

SEQ ID NO: 150099 - RNA, 19 nt, Human
gcaaugccugcuuaaccag

SEQ ID NO: 150100 - RNA, 23 nt, Human
gcauaacaacuccccaaaaagga

SEQ ID NO: 150101 - RNA, 19 nt, Human
gcccucaacauuuccuuaa

SEQ ID NO: 150102 - RNA, 28 nt, Human
gcuaccacugagccuaggagcccugauc

SEQ ID NO: 150103 - RNA, 20 nt, Human
gcuggcagcagcccuggucc

SEQ ID NO: 150104 - RNA, 21 nt, Human
ggaauaacauacuacuucuaa

SEQ ID NO: 150105 - RNA, 20 nt, Human
ggcugcagggaggcucucug

SEQ ID NO: 150106 - RNA, 18 nt, Human
ggcuuaaaauagcugcuc

SEQ ID NO: 150107 - RNA, 21 nt, Human
ggcuuccuccuccccaccccc

SEQ ID NO: 150108 - RNA, 22 nt, Human
gggaauccuaaaaacauaaccc

SEQ ID NO: 150109 - RNA, 18 nt, Human
gggcugguguuguggcag

SEQ ID NO: 150110 - RNA, 22 nt, Human
guauucagcacaaagacaguau

SEQ ID NO: 150111 - RNA, 27 nt, Human
gucuucccaaaaaaccccuuuagacag

SEQ ID NO: 150112 - RNA, 19 nt, Human
guguaauuuugcggugaga

SEQ ID NO: 150113 - RNA, 21 nt, Human
uaaaagaaacacugacugcau

SEQ ID NO: 150114 - RNA, 23 nt, Human
uaaaauagcugcuccagggcaaa

SEQ ID NO: 150115 - RNA, 21 nt, Human
uaaccaggaauaacauacuac

SEQ ID NO: 150116 - RNA, 23 nt, Human
uaacccaccagcaugaccuuaca

SEQ ID NO: 150117 - RNA, 22 nt, Human
uaacccaccagcaugaccuuag

SEQ ID NO: 150118 - RNA, 21 nt, Human
uaacccuaacauggcacuguu

SEQ ID NO: 150119 - RNA, 21 nt, Human
uaaguccuguauagaggugcu

SEQ ID NO: 150120 - RNA, 22 nt, Human
uacaaacucucuuuccuccucc

SEQ ID NO: 150121 - RNA, 21 nt, Human
uaccaaaaaucauggcauaac

SEQ ID NO: 150122 - RNA, 22 nt, Human
uaccaaaaaucauggcauaaca

SEQ ID NO: 150123 - RNA, 19 nt, Human
uagacaaaacuuccucaaa

SEQ ID NO: 150124 - RNA, 23 nt, Human
uagacagaaucugagauggcuua

SEQ ID NO: 150125 - RNA, 22 nt, Human
uagagaaauagaauuaguaaua

SEQ ID NO: 150126 - RNA, 21 nt, Human
uagcuaacccaccagcaugac

SEQ ID NO: 150127 - RNA, 24 nt, Human
uaggcaagaugucucagauucucc

SEQ ID NO: 150128 - RNA, 23 nt, Human
uaguuugugugguacuuuuacca

SEQ ID NO: 150129 - RNA, 21 nt, Human
ucaaaguacuagccaacuacu

SEQ ID NO: 150130 - RNA, 18 nt, Human
ucaguaaugguuugggau

SEQ ID NO: 150131 - RNA, 18 nt, Human
uccacagagcuaaauauc

SEQ ID NO: 150132 - RNA, 20 nt, Human
uccagguggugucuaagcca

SEQ ID NO: 150133 - RNA, 21 nt, Human
ucccauaguuugugugguacu

SEQ ID NO: 150134 - RNA, 18 nt, Human
ucccccuccccccucccc

SEQ ID NO: 150135 - RNA, 24 nt, Human
uccccuaucucgguuuuuccugua

SEQ ID NO: 150136 - RNA, 20 nt, Human
ucccgagguuauaaguuucc

SEQ ID NO: 150137 - RNA, 25 nt, Human
uccucaaaaauguuagaggaagagu

SEQ ID NO: 150138 - RNA, 21 nt, Human
uccugcggcagcagacagcuc

SEQ ID NO: 150139 - RNA, 20 nt, Human
ucgguuuuuccuguacagca

SEQ ID NO: 150140 - RNA, 21 nt, Human
ucuaaccucagccuagguaau

SEQ ID NO: 150141 - RNA, 23 nt, Human
ucuucccaaaaaaccccuuuaga

SEQ ID NO: 150142 - RNA, 24 nt, Human
ucuuuuuuuuuugguaacuuguga

SEQ ID NO: 150143 - RNA, 22 nt, Human
ugaccuccccccuuugcuuccc

SEQ ID NO: 150144 - RNA, 24 nt, Human
ugaccuuacaaacucucuuuccuc

SEQ ID NO: 150145 - RNA, 18 nt, Human
ugacuuuagagaaacucc

SEQ ID NO: 150146 - RNA, 22 nt, Human
ugagacauaaaugucacagaaa

SEQ ID NO: 150147 - RNA, 23 nt, Human
ugagcaaagagaguucugaaggg

SEQ ID NO: 150148 - RNA, 18 nt, Human
ugagccuaggagcccuga

SEQ ID NO: 150149 - RNA, 21 nt, Human
ugaggucucgacugggcucug

SEQ ID NO: 150150 - RNA, 21 nt, Human
ugaguggcaggugcuggcagc

SEQ ID NO: 150151 - RNA, 24 nt, Human
ugccuuggcuuucagcaagaggcc

SEQ ID NO: 150152 - RNA, 22 nt, Human
uggaaguaugugaccgcacuga

SEQ ID NO: 150153 - RNA, 22 nt, Human
uggaccucagugcaugacccag

SEQ ID NO: 150154 - RNA, 23 nt, Human
uggcauaacaacuccccaaaaag

SEQ ID NO: 150155 - RNA, 22 nt, Human
uggcugcagggaggcucucugg

SEQ ID NO: 150156 - RNA, 21 nt, Human
ugggcucugaccaucccccag

SEQ ID NO: 150157 - RNA, 23 nt, Human
ugggucagaagggcaggauggcu

SEQ ID NO: 150158 - RNA, 21 nt, Human
ugguccgcucuucuggaagua

SEQ ID NO: 150159 - RNA, 24 nt, Human
ugguuuagcuaacccaccagcaug

SEQ ID NO: 150160 - RNA, 19 nt, Human
ugguuugggauuugaccuc

SEQ ID NO: 150161 - RNA, 20 nt, Human
ugugaggucucgacugggcu

SEQ ID NO: 150162 - RNA, 18 nt, Human
uguggcagcugauggggc

SEQ ID NO: 150163 - RNA, 23 nt, Human
uguuugguuuugguuuaugugug

SEQ ID NO: 150164 - RNA, 25 nt, Human
uguuugguuuugguuuauguguguu

SEQ ID NO: 150165 - RNA, 18 nt, Human
uuagcuaacccaccagca

SEQ ID NO: 150166 - RNA, 22 nt, Human
uugcccucaacauuuccuuaac

SEQ ID NO: 150167 - RNA, 19 nt, Human
uuggcucuuuuuuuuuugg

SEQ ID NO: 150168 - RNA, 24 nt, Human
uugguaacuugugagcaaagagag

SEQ ID NO: 150169 - RNA, 23 nt, Human
uuuccugggaaugcaggcacucu

SEQ ID NO: 150170 - RNA, 20 nt, Human
uuugcacuaagacagccuuc

SEQ ID NO: 150171 - RNA, 23 nt, Human
uuugcuucccccuccccccuccc

SEQ ID NO: 150172 - RNA, 23 nt, Human
uuuuuuuuuuuugaagggaauca

SEQ ID NO: 150173 - RNA, 19 nt, Human
aagcaacccagcuccggaa

SEQ ID NO: 150174 - RNA, 19 nt, Human
acugcagcagaagcaaccc

SEQ ID NO: 150175 - RNA, 24 nt, Human
agcuggaucgacggacuggcuggg

SEQ ID NO: 150176 - RNA, 25 nt, Human
aggggucacguuuaaagcccagagc

SEQ ID NO: 150177 - RNA, 20 nt, Human
cagcagaagcaacccagcuc

SEQ ID NO: 150178 - RNA, 25 nt, Human
cguuugcuagaaaaaccucaaaaaa

SEQ ID NO: 150179 - RNA, 25 nt, Human
gcagcagaagcaacccagcuccgga

SEQ ID NO: 150180 - RNA, 19 nt, Human
gccggcgcuggcggcugcg

SEQ ID NO: 150181 - RNA, 18 nt, Human
ucuuuuuuuuuuuuuuuu

SEQ ID NO: 150182 - RNA, 20 nt, Human
uggcuuuuaaaggaaacaau

SEQ ID NO: 150183 - RNA, 25 nt, Human
uuuuuuuuuuuuuuuuggcuuuuaa

SEQ ID NO: 150184 - RNA, 18 nt, Human
uuuuuuuuuuuuuuuuug

SEQ ID NO: 150185 - RNA, 25 nt, Human
uuuuuuuuuuuuuuuuuuggcuuuu

SEQ ID NO: 150186 - RNA, 25 nt, Human
uuuuuuuuuuuuuuuuuuucuuuuu

SEQ ID NO: 150187 - RNA, 22 nt, Human
uuuuuuuuuuuuuuuuuuuggc

SEQ ID NO: 150188 - RNA, 19 nt, Human
aacccuuucucucucgcuc

SEQ ID NO: 150189 - RNA, 19 nt, Human
aagccgagagccgcgaaaa

SEQ ID NO: 150190 - RNA, 27 nt, Human
acccucccgaggcccccgccucucuca

SEQ ID NO: 150191 - RNA, 21 nt, Human
cacccucccgaggcccccgcc

SEQ ID NO: 150192 - RNA, 20 nt, Human
caccgccuuccucccucccu

SEQ ID NO: 150193 - RNA, 21 nt, Human
ccccgcccuucuccucccucc

SEQ ID NO: 150194 - RNA, 22 nt, Human
ccccgcccuucuccucccuccu

SEQ ID NO: 150195 - RNA, 25 nt, Human
ccccgccucucucaccgccuuccuc

SEQ ID NO: 150196 - RNA, 22 nt, Human
cccucccuugcucuccccucca

SEQ ID NO: 150197 - RNA, 24 nt, Human
cccucccuugcucuccccuccaau

SEQ ID NO: 150198 - RNA, 18 nt, Human
cccuucuccucccuccuu

SEQ ID NO: 150199 - RNA, 19 nt, Human
cccuucuccucccuccuuu

SEQ ID NO: 150200 - RNA, 20 nt, Human
cccuucuccucccuccuuuc

SEQ ID NO: 150201 - RNA, 18 nt, Human
ccgcccuucuccucccuc

SEQ ID NO: 150202 - RNA, 23 nt, Human
ccucccgaggcccccgccucucu

SEQ ID NO: 150203 - RNA, 21 nt, Human
ccucccuccuuucacccuccc

SEQ ID NO: 150204 - RNA, 21 nt, Human
ccucccuccuuucacccuccc

SEQ ID NO: 150205 - RNA, 23 nt, Human
ccucccuccuuucacccucccga

SEQ ID NO: 150206 - RNA, 19 nt, Human
ccucccuugcucuccccuc

SEQ ID NO: 150207 - RNA, 23 nt, Human
ccuccugcccucacugucugggc

SEQ ID NO: 150208 - RNA, 23 nt, Human
ccucgcucgggccuccgugcccc

SEQ ID NO: 150209 - RNA, 21 nt, Human
cgccuuccucccucccuugcu

SEQ ID NO: 150210 - RNA, 20 nt, Human
cgcgaaaaaagucagagcug

SEQ ID NO: 150211 - RNA, 19 nt, Human
cgggaaggggcgggggcag

SEQ ID NO: 150212 - RNA, 19 nt, Human
cgggggcagccgagcgagg

SEQ ID NO: 150213 - RNA, 22 nt, Human
cucccgaggcccccgccucucu

SEQ ID NO: 150214 - RNA, 22 nt, Human
cucccuccuuucacccucccga

SEQ ID NO: 150215 - RNA, 20 nt, Human
cucccuugcucuccccucca

SEQ ID NO: 150216 - RNA, 23 nt, Human
cucccuugcucuccccuccaauc

SEQ ID NO: 150217 - RNA, 22 nt, Human
cuccugcccucacugucugggc

SEQ ID NO: 150218 - RNA, 18 nt, Human
cucgcucgcucuccuucu

SEQ ID NO: 150219 - RNA, 23 nt, Human
cucuccccuccaauccagaaccc

SEQ ID NO: 150220 - RNA, 21 nt, Human
gagagccgcgaaaaaagucag

SEQ ID NO: 150221 - RNA, 18 nt, Human
gccuccgugccccgcccu

SEQ ID NO: 150222 - RNA, 19 nt, Human
gcgucucuucucucccucc

SEQ ID NO: 150223 - RNA, 20 nt, Human
ggccgggaaggggcgggggc

SEQ ID NO: 150224 - RNA, 18 nt, Human
gggaaggggcgggggcag

SEQ ID NO: 150225 - RNA, 20 nt, Human
gggccuccgugccccgcccu

SEQ ID NO: 150226 - RNA, 18 nt, Human
ucccucgcucgggccucc

SEQ ID NO: 150227 - RNA, 19 nt, Human
ucgcucgcucuccuucugc

SEQ ID NO: 150228 - RNA, 20 nt, Human
ucucccuccugcccucacug

SEQ ID NO: 150229 - RNA, 20 nt, Human
ucugcgucucuucucucccu

SEQ ID NO: 150230 - RNA, 19 nt, Human
ucuucucucccuccugccc

SEQ ID NO: 150231 - RNA, 24 nt, Human
ugccccgcccuucuccucccuccu

SEQ ID NO: 150232 - RNA, 20 nt, Human
uucuccucccuccuuucacc

SEQ ID NO: 150233 - RNA, 21 nt, Human
uucuccucccuccuuucaccc

SEQ ID NO: 150234 - RNA, 25 nt, Human
uucuccucccuccuuucacccuccc

SEQ ID NO: 150235 - RNA, 20 nt, Human
aagaaguugcagagcacgaa

SEQ ID NO: 150236 - RNA, 22 nt, Human
accacaggaagacggcccccaa

SEQ ID NO: 150237 - RNA, 22 nt, Human
agaaaacaaaaugguagccagg

SEQ ID NO: 150238 - RNA, 18 nt, Human
agaggguucuggggcugg

SEQ ID NO: 150239 - RNA, 20 nt, Human
aggaagacggcccccaacau

SEQ ID NO: 150240 - RNA, 21 nt, Human
auugaauuugggucuguucuc

SEQ ID NO: 150241 - RNA, 24 nt, Human
caaccacaggaagacggcccccaa

SEQ ID NO: 150242 - RNA, 20 nt, Human
caggagaaaacaaaauggua

SEQ ID NO: 150243 - RNA, 18 nt, Human
ccccagaggguucugggg

SEQ ID NO: 150244 - RNA, 26 nt, Human
ccccagaggguucugggggguugaac

SEQ ID NO: 150245 - RNA, 19 nt, Human
cgacaaaucauuuauugag

SEQ ID NO: 150246 - RNA, 21 nt, Human
cgcuuagaaccaugcaccaac

SEQ ID NO: 150247 - RNA, 20 nt, Human
cggcccccaacauucuuccc

SEQ ID NO: 150248 - RNA, 23 nt, Human
cucagaaacucuggaauugaaga

SEQ ID NO: 150249 - RNA, 20 nt, Human
cucugugucaggcguaugau

SEQ ID NO: 150250 - RNA, 21 nt, Human
cuggugggauccucauuucca

SEQ ID NO: 150251 - RNA, 18 nt, Human
ggaagacggcccccaaca

SEQ ID NO: 150252 - RNA, 25 nt, Human
guagccagguguucuuggucaugcc

SEQ ID NO: 150253 - RNA, 22 nt, Human
uccccagaggguucuggggcug

SEQ ID NO: 150254 - RNA, 25 nt, Human
ucuggaauugaagaaguugcagagc

SEQ ID NO: 150255 - RNA, 24 nt, Human
ugcagagcacgaagauaaaauggu

SEQ ID NO: 150256 - RNA, 22 nt, Human
ugcauacaaccacaggaagacg

SEQ ID NO: 150257 - RNA, 18 nt, Human
ugggucuguucucagaaa

SEQ ID NO: 150258 - RNA, 19 nt, Human
ugggucuguucucagaaac

SEQ ID NO: 150259 - RNA, 24 nt, Human
uuccccagaggguucuggggcugg

SEQ ID NO: 150260 - RNA, 25 nt, Human
uuuuuuuuuuuuuuuuuuuuagggg

SEQ ID NO: 150261 - RNA, 23 nt, Human
aaaaaaaaaaaaaaaacagaaaa

SEQ ID NO: 150262 - RNA, 26 nt, Human
aaaaaaaaaaaaaacagaaaaaaccc

SEQ ID NO: 150263 - RNA, 21 nt, Human
aaaaaaaaaaaaacagaaaaa

SEQ ID NO: 150264 - RNA, 24 nt, Human
aaaaaaaaacagaaaaaacccaaa

SEQ ID NO: 150265 - RNA, 22 nt, Human
aaaaaaaaacagaaaaaacccu

SEQ ID NO: 150266 - RNA, 19 nt, Human
aaaaaaaacagaaaaaacc

SEQ ID NO: 150267 - RNA, 23 nt, Human
aaaaaaaacagaaaaaacccaaa

SEQ ID NO: 150268 - RNA, 24 nt, Human
aaaaaaaacagaaaaaacccaaaa

SEQ ID NO: 150269 - RNA, 20 nt, Human
aaaaaaacagaaaaaaccca

SEQ ID NO: 150270 - RNA, 28 nt, Human
aaaaaacagaaaaaacccaaaaccaccc

SEQ ID NO: 150271 - RNA, 24 nt, Human
aaaaacagaaaaaacccaaaacca

SEQ ID NO: 150272 - RNA, 25 nt, Human
aaaaacccaaaaccacccaagaacc

SEQ ID NO: 150273 - RNA, 23 nt, Human
aaaaagaaaaaaaaaaccaucaa

SEQ ID NO: 150274 - RNA, 23 nt, Human
aaaaagaaaaaaaaaaccaucaa

SEQ ID NO: 150275 - RNA, 24 nt, Human
aaaacagaaaaaacccaaaaccac

SEQ ID NO: 150276 - RNA, 20 nt, Human
aaaaccagggucucugcuag

SEQ ID NO: 150277 - RNA, 20 nt, Human
aaaaccagggucucugcuag

SEQ ID NO: 150278 - RNA, 26 nt, Human
aaaacccaaaaccacccaagaaccaa

SEQ ID NO: 150279 - RNA, 27 nt, Human
aaaagcaucagcaaaaguuggagaccc

SEQ ID NO: 150280 - RNA, 20 nt, Human
aaacacaguaauccaaugag

SEQ ID NO: 150281 - RNA, 22 nt, Human
aaagcaaggaugaugagaaaau

SEQ ID NO: 150282 - RNA, 22 nt, Human
aaagcaaggaugaugagaaaau

SEQ ID NO: 150283 - RNA, 23 nt, Human
aaagugaguggccacaaaugcca

SEQ ID NO: 150284 - RNA, 25 nt, Human
aaaugcaccucaggagcaaaaacac

SEQ ID NO: 150285 - RNA, 25 nt, Human
aaaugcaccucaggagcaaaaacac

SEQ ID NO: 150286 - RNA, 22 nt, Human
aacccaaaaccacccaagaacc

SEQ ID NO: 150287 - RNA, 18 nt, Human
aacuacugaaauugaaca

SEQ ID NO: 150288 - RNA, 18 nt, Human
aacuacugaaauugaaca

SEQ ID NO: 150289 - RNA, 22 nt, Human
aagagaaugcgagcucccugaa

SEQ ID NO: 150290 - RNA, 22 nt, Human
aagagaaugcgagcucccugaa

SEQ ID NO: 150291 - RNA, 22 nt, Human
aagcaaggaugaugagaaaaug

SEQ ID NO: 150292 - RNA, 22 nt, Human
aagcaaggaugaugagaaaaug

SEQ ID NO: 150293 - RNA, 22 nt, Human
acaaagugaguggccacaaaug

SEQ ID NO: 150294 - RNA, 18 nt, Human
acaggaaaaaaaccaggg

SEQ ID NO: 150295 - RNA, 18 nt, Human
acaggaaaaaaaccaggg

SEQ ID NO: 150296 - RNA, 18 nt, Human
acaggaaaaaaaccaggg

SEQ ID NO: 150297 - RNA, 30 nt, Human
acagucaauuuggcaaaaaagaaaaaaaaa

SEQ ID NO: 150298 - RNA, 21 nt, Human
acccaaaaccacccaagaacc

SEQ ID NO: 150299 - RNA, 22 nt, Human
acccaaaaccacccaagaacca

SEQ ID NO: 150300 - RNA, 19 nt, Human
accucauugcucauugugg

SEQ ID NO: 150301 - RNA, 19 nt, Human
accucauugcucauugugg

SEQ ID NO: 150302 - RNA, 20 nt, Human
acgguaugacauaggcagau

SEQ ID NO: 150303 - RNA, 20 nt, Human
acgguaugacauaggcagau

SEQ ID NO: 150304 - RNA, 22 nt, Human
acuugaugggcacgagggcaac

SEQ ID NO: 150305 - RNA, 22 nt, Human
acuugaugggcacgagggcaac

SEQ ID NO: 150306 - RNA, 27 nt, Human
agaaaaaacccaaaaccacccaagaac

SEQ ID NO: 150307 - RNA, 18 nt, Human
aggaaaaaaaccaggguc

SEQ ID NO: 150308 - RNA, 18 nt, Human
aggaaaaaaaccaggguc

SEQ ID NO: 150309 - RNA, 18 nt, Human
aggaaggagaugaguuuc

SEQ ID NO: 150310 - RNA, 18 nt, Human
aggaaggagaugaguuuc

SEQ ID NO: 150311 - RNA, 21 nt, Human
aggaaggagaugaguuuccua

SEQ ID NO: 150312 - RNA, 18 nt, Human
aggaggaggguuccuggc

SEQ ID NO: 150313 - RNA, 18 nt, Human
aggaggaggguuccuggc

SEQ ID NO: 150314 - RNA, 22 nt, Human
aucagccuuugugaaaagccaa

SEQ ID NO: 150315 - RNA, 22 nt, Human
aucagccuuugugaaaagccaa

SEQ ID NO: 150316 - RNA, 23 nt, Human
auucuguggcauaaacauuuuca

SEQ ID NO: 150317 - RNA, 19 nt, Human
caaaaccacccaagaacca

SEQ ID NO: 150318 - RNA, 20 nt, Human
caaaaccacccaagaaccaa

SEQ ID NO: 150319 - RNA, 23 nt, Human
caaaaccacccaagaaccaaaga

SEQ ID NO: 150320 - RNA, 28 nt, Human
caaaagcaucagcaaaaguuggagaccc

SEQ ID NO: 150321 - RNA, 22 nt, Human
caaacuacugaaauugaacaug

SEQ ID NO: 150322 - RNA, 22 nt, Human
caaacuacugaaauugaacaug

SEQ ID NO: 150323 - RNA, 23 nt, Human
caaagaaggccugaucuguagug

SEQ ID NO: 150324 - RNA, 24 nt, Human
caaagugaguggccacaaaugcca

SEQ ID NO: 150325 - RNA, 23 nt, Human
caaauucuguggcauaaacauuu

SEQ ID NO: 150326 - RNA, 23 nt, Human
caaauucuguggcauaaacauuu

SEQ ID NO: 150327 - RNA, 21 nt, Human
caaugaggaauuuccaggcau

SEQ ID NO: 150328 - RNA, 23 nt, Human
cacaggaaaaaaaccagggucuc

SEQ ID NO: 150329 - RNA, 23 nt, Human
cacaggaaaaaaaccagggucuc

SEQ ID NO: 150330 - RNA, 22 nt, Human
cagaaaaaacccaaaaccaccc

SEQ ID NO: 150331 - RNA, 20 nt, Human
cagcagagcaggcacugccu

SEQ ID NO: 150332 - RNA, 20 nt, Human
cagcagagcaggcacugccu

SEQ ID NO: 150333 - RNA, 21 nt, Human
cagccuuugugaaaagccaag

SEQ ID NO: 150334 - RNA, 21 nt, Human
cagccuuugugaaaagccaag

SEQ ID NO: 150335 - RNA, 22 nt, Human
caggaaggagaugaguuuccua

SEQ ID NO: 150336 - RNA, 26 nt, Human
ccaaaaccacccaagaaccaaagaag

SEQ ID NO: 150337 - RNA, 19 nt, Human
ccaaggccgagaggccaug

SEQ ID NO: 150338 - RNA, 19 nt, Human
ccaaggccgagaggccaug

SEQ ID NO: 150339 - RNA, 20 nt, Human
ccagccucccggcuccucag

SEQ ID NO: 150340 - RNA, 19 nt, Human
ccaggcaccaggcucuacu

SEQ ID NO: 150341 - RNA, 25 nt, Human
cccaggcugcccgguggcccaggga

SEQ ID NO: 150342 - RNA, 25 nt, Human
cccaggcugcccgguggcccaggga

SEQ ID NO: 150343 - RNA, 25 nt, Human
ccccaccuucaaaaaaaaaaaaaaa

SEQ ID NO: 150344 - RNA, 25 nt, Human
ccccaccuucaaaaaaaaaaaaaaa

SEQ ID NO: 150345 - RNA, 18 nt, Human
ccccagcagugagacucu

SEQ ID NO: 150346 - RNA, 18 nt, Human
ccccagcagugagacucu

SEQ ID NO: 150347 - RNA, 21 nt, Human
cccgacugcacuugaugggca

SEQ ID NO: 150348 - RNA, 21 nt, Human
cccgacugcacuugaugggca

SEQ ID NO: 150349 - RNA, 21 nt, Human
cccgcggggcaggggaggauu

SEQ ID NO: 150350 - RNA, 18 nt, Human
ccgccgcgccagccgcuc

SEQ ID NO: 150351 - RNA, 22 nt, Human
ccgcgccagccgcucccaggca

SEQ ID NO: 150352 - RNA, 22 nt, Human
ccgcuuggagauaaaaggcugu

SEQ ID NO: 150353 - RNA, 18 nt, Human
ccgggggggggcuggggg

SEQ ID NO: 150354 - RNA, 18 nt, Human
ccucaggaaggagaugag

SEQ ID NO: 150355 - RNA, 18 nt, Human
ccucaggaaggagaugag

SEQ ID NO: 150356 - RNA, 22 nt, Human
ccucaggaaggagaugaguuuc

SEQ ID NO: 150357 - RNA, 19 nt, Human
ccuccccagcagugagacu

SEQ ID NO: 150358 - RNA, 19 nt, Human
ccuccccagcagugagacu

SEQ ID NO: 150359 - RNA, 20 nt, Human
ccuucaaaaaaaaaaaaaaa

SEQ ID NO: 150360 - RNA, 20 nt, Human
ccuucaaaaaaaaaaaaaaa

SEQ ID NO: 150361 - RNA, 24 nt, Human
cgccccaggcugcccgguggccca

SEQ ID NO: 150362 - RNA, 24 nt, Human
cgccccaggcugcccgguggccca

SEQ ID NO: 150363 - RNA, 21 nt, Human
cggcggggacaggagaggcuc

SEQ ID NO: 150364 - RNA, 19 nt, Human
cuacacccccauugacagg

SEQ ID NO: 150365 - RNA, 19 nt, Human
cuacacccccauugacagg

SEQ ID NO: 150366 - RNA, 21 nt, Human
cucccaggcaccaggcucuac

SEQ ID NO: 150367 - RNA, 22 nt, Human
cuccccagcagugagacucuag

SEQ ID NO: 150368 - RNA, 22 nt, Human
cuccccagcagugagacucuag

SEQ ID NO: 150369 - RNA, 18 nt, Human
cucugggugacuuagcuc

SEQ ID NO: 150370 - RNA, 18 nt, Human
cucugggugacuuagcuc

SEQ ID NO: 150371 - RNA, 18 nt, Human
cuggaaagacacaccgcc

SEQ ID NO: 150372 - RNA, 21 nt, Human
cuggaaagacacaccgcccaa

SEQ ID NO: 150373 - RNA, 20 nt, Human
cugggugacuuagcuccggg

SEQ ID NO: 150374 - RNA, 20 nt, Human
cugggugacuuagcuccggg

SEQ ID NO: 150375 - RNA, 19 nt, Human
cuguggggggaccuugggg

SEQ ID NO: 150376 - RNA, 19 nt, Human
cuguggggggaccuugggg

SEQ ID NO: 150377 - RNA, 19 nt, Human
gaaaaaacccaaaaccacc

SEQ ID NO: 150378 - RNA, 21 nt, Human
gacaguccuuccugccuaccc

SEQ ID NO: 150379 - RNA, 21 nt, Human
gacaguccuuccugccuaccc

SEQ ID NO: 150380 - RNA, 21 nt, Human
gccacaaaugccaggacagcg

SEQ ID NO: 150381 - RNA, 21 nt, Human
gccacaaaugccaggacagcg

SEQ ID NO: 150382 - RNA, 21 nt, Human
gccaggacagcgguguccugg

SEQ ID NO: 150383 - RNA, 21 nt, Human
gccaggacagcgguguccugg

SEQ ID NO: 150384 - RNA, 23 nt, Human
gcgcagcuccgggggggggcugg

SEQ ID NO: 150385 - RNA, 24 nt, Human
gcgcagcuccggggggggggaacc

SEQ ID NO: 150386 - RNA, 25 nt, Human
gcgcagcuccggggggggggaacgc

SEQ ID NO: 150387 - RNA, 25 nt, Human
gcgcagcuccgggggggggggaacc

SEQ ID NO: 150388 - RNA, 26 nt, Human
gcgcagcuccgggggggggggaacgc

SEQ ID NO: 150389 - RNA, 19 nt, Human
gcggggacaggagaggcuc

SEQ ID NO: 150390 - RNA, 21 nt, Human
gcgguguccuggagcuguggg

SEQ ID NO: 150391 - RNA, 18 nt, Human
gcucccagcagcccuccc

SEQ ID NO: 150392 - RNA, 18 nt, Human
gcucccagcagcccuccc

SEQ ID NO: 150393 - RNA, 20 nt, Human
gcuccgggggggggcugggg

SEQ ID NO: 150394 - RNA, 20 nt, Human
ggcaacacgaacacaagaga

SEQ ID NO: 150395 - RNA, 20 nt, Human
ggcaacacgaacacaagaga

SEQ ID NO: 150396 - RNA, 19 nt, Human
ggcacgagggcaacacgaa

SEQ ID NO: 150397 - RNA, 19 nt, Human
ggcacgagggcaacacgaa

SEQ ID NO: 150398 - RNA, 24 nt, Human
ggcgcagcuccgggggggggcugg

SEQ ID NO: 150399 - RNA, 18 nt, Human
gggaccuuggggaagaac

SEQ ID NO: 150400 - RNA, 18 nt, Human
gggaccuuggggaagaac

SEQ ID NO: 150401 - RNA, 19 nt, Human
gguagagaugaggacaagc

SEQ ID NO: 150402 - RNA, 19 nt, Human
gguagagaugaggacaagc

SEQ ID NO: 150403 - RNA, 18 nt, Human
gguguccuggagcugugg

SEQ ID NO: 150404 - RNA, 23 nt, Human
gugaccuucuggaaagacacacc

SEQ ID NO: 150405 - RNA, 23 nt, Human
gugaccuucuggaaagacacacc

SEQ ID NO: 150406 - RNA, 19 nt, Human
guggggggaccuuggggaa

SEQ ID NO: 150407 - RNA, 19 nt, Human
guggggggaccuuggggaa

SEQ ID NO: 150408 - RNA, 21 nt, Human
uaaaacacaguaauccaauga

SEQ ID NO: 150409 - RNA, 23 nt, Human
uacaauaaguugcauauaaaacc

SEQ ID NO: 150410 - RNA, 23 nt, Human
uacaauaaguugcauauaaaacc

SEQ ID NO: 150411 - RNA, 19 nt, Human
uacacccccauugacagga

SEQ ID NO: 150412 - RNA, 19 nt, Human
uacacccccauugacagga

SEQ ID NO: 150413 - RNA, 18 nt, Human
uagugugaggauccaggg

SEQ ID NO: 150414 - RNA, 25 nt, Human
uauauuccccuccccaccuucaaaa

SEQ ID NO: 150415 - RNA, 25 nt, Human
uauauuccccuccccaccuucaaaa

SEQ ID NO: 150416 - RNA, 22 nt, Human
ucaaaaaaaaaaaaaaaaaaaa

SEQ ID NO: 150417 - RNA, 22 nt, Human
ucaaaaaaaaaaaaaaaaaaaa

SEQ ID NO: 150418 - RNA, 23 nt, Human
ucaaaaaaaaaaaaaaaaaaaaa

SEQ ID NO: 150419 - RNA, 23 nt, Human
ucaaaaaaaaaaaaaaaaaaaaa

SEQ ID NO: 150420 - RNA, 20 nt, Human
ucaacugaucaaacuacuga

SEQ ID NO: 150421 - RNA, 20 nt, Human
ucaacugaucaaacuacuga

SEQ ID NO: 150422 - RNA, 18 nt, Human
ucaaugcauaaaaccaau

SEQ ID NO: 150423 - RNA, 18 nt, Human
ucaaugcauaaaaccaau

SEQ ID NO: 150424 - RNA, 22 nt, Human
ucaaugcauaaaaccaauuacc

SEQ ID NO: 150425 - RNA, 22 nt, Human
ucaaugcauaaaaccaauuacc

SEQ ID NO: 150426 - RNA, 26 nt, Human
ucaauuuggcaaaaaagaaaaaaaaa

SEQ ID NO: 150427 - RNA, 19 nt, Human
ucacgggcacuccgggacc

SEQ ID NO: 150428 - RNA, 19 nt, Human
ucacgggcacuccgggacc

SEQ ID NO: 150429 - RNA, 20 nt, Human
ucaggaaggagaugaguuuc

SEQ ID NO: 150430 - RNA, 21 nt, Human
uccagccucccggcuccucag

SEQ ID NO: 150431 - RNA, 18 nt, Human
ucccaaggccgagaggcc

SEQ ID NO: 150432 - RNA, 18 nt, Human
ucccaaggccgagaggcc

SEQ ID NO: 150433 - RNA, 23 nt, Human
ucccaaggccgagaggccaugcu

SEQ ID NO: 150434 - RNA, 23 nt, Human
ucccaaggccgagaggccaugcu

SEQ ID NO: 150435 - RNA, 26 nt, Human
uccccaccuucaaaaaaaaaaaaaaa

SEQ ID NO: 150436 - RNA, 26 nt, Human
uccccaccuucaaaaaaaaaaaaaaa

SEQ ID NO: 150437 - RNA, 30 nt, Human
uccccaccuucaaaaaaaaaaaaaaaaaaa

SEQ ID NO: 150438 - RNA, 30 nt, Human; identical to SEQ ID NO: 150437

SEQ ID NO: 150439 - RNA, 23 nt, Human
ucuguagugugaggauccagggc

SEQ ID NO: 150440 - RNA, 23 nt, Human
ugacaggaggaggguuccuggcg

SEQ ID NO: 150441 - RNA, 23 nt, Human
ugacaggaggaggguuccuggcg

SEQ ID NO: 150442 - RNA, 19 nt, Human
ugagaaaaugcaccucagg

SEQ ID NO: 150443 - RNA, 19 nt, Human
ugagaaaaugcaccucagg

SEQ ID NO: 150444 - RNA, 20 nt, Human
ugaggaauuuccaggcauug

SEQ ID NO: 150445 - RNA, 18 nt, Human
ugaugagaaaaugcaccu

SEQ ID NO: 150446 - RNA, 18 nt, Human
ugaugagaaaaugcaccu

SEQ ID NO: 150447 - RNA, 22 nt, Human
ugaugggcacgagggcaacacg

SEQ ID NO: 150448 - RNA, 22 nt, Human
ugaugggcacgagggcaacacg

SEQ ID NO: 150449 - RNA, 22 nt, Human
ugccaggacagcgguguccugg

SEQ ID NO: 150450 - RNA, 22 nt, Human
ugccaggacagcgguguccugg

SEQ ID NO: 150451 - RNA, 28 nt, Human
ugcuuguccugggaggucccgacugcac

SEQ ID NO: 150452 - RNA, 28 nt, Human
ugcuuguccugggaggucccgacugcac

SEQ ID NO: 150453 - RNA, 20 nt, Human
uggaaagacacaccgcccac

SEQ ID NO: 150454 - RNA, 20 nt, Human
uggaaagacacaccgcccac

SEQ ID NO: 150455 - RNA, 23 nt, Human
uggcaaaaaagaaaaaaaaaacc

SEQ ID NO: 150456 - RNA, 23 nt, Human
uggcaaaaaagaaaaaaaaaacc

SEQ ID NO: 150457 - RNA, 22 nt, Human
uggcaaaaauacuacaccccca

SEQ ID NO: 150458 - RNA, 22 nt, Human
uggcaaaaauacuacaccccca

SEQ ID NO: 150459 - RNA, 22 nt, Human
uggcacacacaccgccccaggc

SEQ ID NO: 150460 - RNA, 22 nt, Human
uggcacacacaccgccccaggc

SEQ ID NO: 150461 - RNA, 21 nt, Human
ugggcacaggaaaaaaaccag

SEQ ID NO: 150462 - RNA, 21 nt, Human
ugggcacaggaaaaaaaccag

SEQ ID NO: 150463 - RNA, 23 nt, Human
ugggcacaggaaaaaaaccaggg

SEQ ID NO: 150464 - RNA, 23 nt, Human
ugggcacaggaaaaaaaccaggg

SEQ ID NO: 150465 - RNA, 27 nt, Human
ugggcacaggaaaaaaaccagggucuc

SEQ ID NO: 150466 - RNA, 27 nt, Human
ugggcacaggaaaaaaaccagggucuc

SEQ ID NO: 150467 - RNA, 19 nt, Human
uggggucgguccggcccgg

SEQ ID NO: 150468 - RNA, 23 nt, Human
ugggugacuuagcuccggguuaa

SEQ ID NO: 150469 - RNA, 23 nt, Human
ugggugacuuagcuccggguuaa

SEQ ID NO: 150470 - RNA, 23 nt, Human
uguuuaaaacacaguaauccaau

SEQ ID NO: 150471 - RNA, 19 nt, Human
uuccugccuacccgccaca

SEQ ID NO: 150472 - RNA, 19 nt, Human
uuccugccuacccgccaca

SEQ ID NO: 150473 - RNA, 23 nt, Human
uugacaggaggaggguuccuggc

SEQ ID NO: 150474 - RNA, 24 nt, Human
uugacaggaggaggguuccuggcg

SEQ ID NO: 150475 - RNA, 24 nt, Human
uuggcaaaaaagaaaaaaaaaacc

SEQ ID NO: 150476 - RNA, 24 nt, Human
uuggcaaaaaagaaaaaaaaaacc

SEQ ID NO: 150477 - RNA, 23 nt, Human
uuuaaaacacaguaauccaauga

SEQ ID NO: 150478 - RNA, 24 nt, Human
uuuuuuuuuuuuuuuuuuuucacg

SEQ ID NO: 150479 - RNA, 18 nt, Human
ccuccuccagcuucugcc

SEQ ID NO: 150480 - RNA, 20 nt, Human
uccuccuccagcuucugccg

SEQ ID NO: 150481 - RNA, 25 nt, Human
uuccuccuccagcuucugccguuug

SEQ ID NO: 150482 - RNA, 21 nt, Human
aaaaaacaaaaaaguccugug

SEQ ID NO: 150483 - RNA, 25 nt, Human
aaaaaacaaaaaaguccugugccug

SEQ ID NO: 150484 - RNA, 22 nt, Human
aaacuugccgccgugcgcuugg

SEQ ID NO: 150485 - RNA, 21 nt, Human
aaauaaaaagcacacagaacc

SEQ ID NO: 150486 - RNA, 26 nt, Human
aagaauuugcaggcguggauuggggu

SEQ ID NO: 150487 - RNA, 21 nt, Human
aaggaaaaaggaaaggagggg

SEQ ID NO: 150488 - RNA, 22 nt, Human
aaggagccuccauccucugcca

SEQ ID NO: 150489 - RNA, 20 nt, Human
aaucaucuugucuccccggu

SEQ ID NO: 150490 - RNA, 21 nt, Human
acacagcgaagugcaaaaaac

SEQ ID NO: 150491 - RNA, 23 nt, Human
acacagcgaagugcaaaaaacaa

SEQ ID NO: 150492 - RNA, 24 nt, Human
acacagcgaagugcaaaaaacaaa

SEQ ID NO: 150493 - RNA, 22 nt, Human
acuugccgccgugcgcuuggcc

SEQ ID NO: 150494 - RNA, 21 nt, Human
agaaacucagugcuugaaaac

SEQ ID NO: 150495 - RNA, 28 nt, Human
aggaaaaaggaaaggaggggggagggag

SEQ ID NO: 150496 - RNA, 21 nt, Human
aggaaaggaaaggaaaaagga

SEQ ID NO: 150497 - RNA, 25 nt, Human
aggaaagggaauguccaagaaauau

SEQ ID NO: 150498 - RNA, 26 nt, Human
aggaggggggagggagagggagaggc

SEQ ID NO: 150499 - RNA, 21 nt, Human
agggagaggcaaagccgagga

SEQ ID NO: 150500 - RNA, 20 nt, Human
auggaauuuuuguuuuuuau

SEQ ID NO: 150501 - RNA, 25 nt, Human
auuuuuuuucuuuuuuuuucuuuuu

SEQ ID NO: 150502 - RNA, 22 nt, Human
caaggauuugaaacaggugugg

SEQ ID NO: 150503 - RNA, 24 nt, Human
cacagcgaagugcaaaaaacaaaa

SEQ ID NO: 150504 - RNA, 19 nt, Human
cacccccagcccccccguc

SEQ ID NO: 150505 - RNA, 18 nt, Human
cacccucccccgccaccc

SEQ ID NO: 150506 - RNA, 28 nt, Human
cacccucccccgccacccccagcccccc

SEQ ID NO: 150507 - RNA, 21 nt, Human
caccucucccugucucuuuug

SEQ ID NO: 150508 - RNA, 19 nt, Human
cagcccccccgucguccug

SEQ ID NO: 150509 - RNA, 21 nt, Human
cagcugccucuuuagacgagg

SEQ ID NO: 150510 - RNA, 22 nt, Human
cauuccgcugcucccuccgauu

SEQ ID NO: 150511 - RNA, 24 nt, Human
ccaagaaauauaauuaauuuaggg

SEQ ID NO: 150512 - RNA, 21 nt, Human
ccagagucuucgccgcauucc

SEQ ID NO: 150513 - RNA, 24 nt, Human
cccccagcccccccgucguccugc

SEQ ID NO: 150514 - RNA, 20 nt, Human
cccccgccacccccagcccc

SEQ ID NO: 150515 - RNA, 22 nt, Human
cccccgccacccccagcccccc

SEQ ID NO: 150516 - RNA, 21 nt, Human
ccccgccacccccagcccccc

SEQ ID NO: 150517 - RNA, 21 nt, Human
ccccgccacccccagcccccc

SEQ ID NO: 150518 - RNA, 19 nt, Human
ccccgucguccugcucccc

SEQ ID NO: 150519 - RNA, 19 nt, Human
ccccgucguccugcucccc

SEQ ID NO: 150520 - RNA, 20 nt, Human
ccccgucguccugcuccccg

SEQ ID NO: 150521 - RNA, 22 nt, Human
cccgagaaucuugcaccaaacg

SEQ ID NO: 150522 - RNA, 20 nt, Human
cccgucguccugcuccccgu

SEQ ID NO: 150523 - RNA, 20 nt, Human
cccucccccgccacccccag

SEQ ID NO: 150524 - RNA, 19 nt, Human
cccucccucuuucuccuuc

SEQ ID NO: 150525 - RNA, 22 nt, Human
cccucgcuguccagagucuucg

SEQ ID NO: 150526 - RNA, 19 nt, Human
cccucuuucuccuucucuc

SEQ ID NO: 150527 - RNA, 19 nt, Human
ccgccgcacgcugccuccg

SEQ ID NO: 150528 - RNA, 20 nt, Human
ccgccgcccgcugcccgcgg

SEQ ID NO: 150529 - RNA, 21 nt, Human
cgaggagcgggcgcccugggc

SEQ ID NO: 150530 - RNA, 21 nt, Human
cgcacgcugccuccgccgccc

SEQ ID NO: 150531 - RNA, 21 nt, Human
cgcccaacaacugcuacaugc

SEQ ID NO: 150532 - RNA, 22 nt, Human
cgcccugggcucccagcuccug

SEQ ID NO: 150533 - RNA, 21 nt, Human
cgcugcccgcggcgaggacgg

SEQ ID NO: 150534 - RNA, 18 nt, Human
cucccccgccacccccag

SEQ ID NO: 150535 - RNA, 23 nt, Human
cucccugucucuuuugcuccaug

SEQ ID NO: 150536 - RNA, 22 nt, Human
cucgcuguccagagucuucgcc

SEQ ID NO: 150537 - RNA, 25 nt, Human
cucguuuguuugggguggggguggg

SEQ ID NO: 150538 - RNA, 18 nt, Human
cucuuucuccuucucucu

SEQ ID NO: 150539 - RNA, 22 nt, Human
gaaaggaaaggaaaaaggaaag

SEQ ID NO: 150540 - RNA, 20 nt, Human
gacaaaauauugacauugac

SEQ ID NO: 150541 - RNA, 24 nt, Human
gagagggagaggcaaagccgagga

SEQ ID NO: 150542 - RNA, 21 nt, Human
gagggagagggagaggcaaag

SEQ ID NO: 150543 - RNA, 20 nt, Human
gaggggggaaaauccuucca

SEQ ID NO: 150544 - RNA, 24 nt, Human
gcccgcugcccgcggcgaggacgg

SEQ ID NO: 150545 - RNA, 20 nt, Human
gcgguuuguuuuuguuuugu

SEQ ID NO: 150546 - RNA, 20 nt, Human
ggaaaggaaaaaggaaagga

SEQ ID NO: 150547 - RNA, 24 nt, Human
ggaaaggaaaaaggaaaggagggg

SEQ ID NO: 150548 - RNA, 19 nt, Human
ggagagggagaggcaaagc

SEQ ID NO: 150549 - RNA, 18 nt, Human
ggaggggggagggagagg

SEQ ID NO: 150550 - RNA, 22 nt, Human
ggccucgguuugggacccugug

SEQ ID NO: 150551 - RNA, 20 nt, Human
ggcgaccgccgcacgcugcc

SEQ ID NO: 150552 - RNA, 20 nt, Human
gggggagggagagggagagg

SEQ ID NO: 150553 - RNA, 23 nt, Human
ggggugggggugggggugggggg

SEQ ID NO: 150554 - RNA, 19 nt, Human
ggguggggguggggguggg

SEQ ID NO: 150555 - RNA, 18 nt, Human
gguggggguggggggaag

SEQ ID NO: 150556 - RNA, 27 nt, Human
guccagagucuucgccgcauuccgcug

SEQ ID NO: 150557 - RNA, 19 nt, Human
guuagaauucuaacaaauu

SEQ ID NO: 150558 - RNA, 25 nt, Human
uaaaaagcacacagaaccugucuuu

SEQ ID NO: 150559 - RNA, 24 nt, Human
uaacacaaaacacaaaaauauuua

SEQ ID NO: 150560 - RNA, 20 nt, Human
uaagucuaugaucuuggaau

SEQ ID NO: 150561 - RNA, 20 nt, Human
uagaaacucagugcuugaaa

SEQ ID NO: 150562 - RNA, 21 nt, Human
ucagaagguaucaaaaagugu

SEQ ID NO: 150563 - RNA, 23 nt, Human
ucaucaucauuuuuuaaguggac

SEQ ID NO: 150564 - RNA, 22 nt, Human
uccagagucuucgccgcauucc

SEQ ID NO: 150565 - RNA, 18 nt, Human
uccauguuguccguuucu

SEQ ID NO: 150566 - RNA, 20 nt, Human
uccauguuguccguuucugu

SEQ ID NO: 150567 - RNA, 21 nt, Human
ucccccgccacccccagcccc

SEQ ID NO: 150568 - RNA, 23 nt, Human
uccccguuucucuguaagaggac

SEQ ID NO: 150569 - RNA, 21 nt, Human
ucccuccgauucccucucccu

SEQ ID NO: 150570 - RNA, 19 nt, Human
uccuucuccaccucucccu

SEQ ID NO: 150571 - RNA, 27 nt, Human
ucguuuguuuggggugggggugggggu

SEQ ID NO: 150572 - RNA, 18 nt, Human
ucucacucagcugccucu

SEQ ID NO: 150573 - RNA, 23 nt, Human
ucucacucagcugccucuuuaga

SEQ ID NO: 150574 - RNA, 24 nt, Human
ucucucucccucccucuuucuccu

SEQ ID NO: 150575 - RNA, 22 nt, Human
ucucucucuuucucucucuccc

SEQ ID NO: 150576 - RNA, 20 nt, Human
ucucugugucucucacucag

SEQ ID NO: 150577 - RNA, 26 nt, Human
ucuuucuccuucucucugugucucuc

SEQ ID NO: 150578 - RNA, 18 nt, Human
ucuuucucucucuuucuc

SEQ ID NO: 150579 - RNA, 21 nt, Human
ucuuuuuuuuucuuuuuuuuu

SEQ ID NO: 150580 - RNA, 24 nt, Human
ugaaaggagaaguuugcaucaggg

SEQ ID NO: 150581 - RNA, 18 nt, Human
ugaagagaggggggaaaa

SEQ ID NO: 150582 - RNA, 18 nt, Human
ugauugacagcuccccuu

SEQ ID NO: 150583 - RNA, 21 nt, Human
uggauugggguaauuuuuuuu

SEQ ID NO: 150584 - RNA, 18 nt, Human
ugggacccugugcccucg

SEQ ID NO: 150585 - RNA, 22 nt, Human
ugggcucccagcuccuggcgac

SEQ ID NO: 150586 - RNA, 18 nt, Human
ugggggggaaacacagcg

SEQ ID NO: 150587 - RNA, 21 nt, Human
uggggguggggggaaggaaag

SEQ ID NO: 150588 - RNA, 19 nt, Human
ugggggugggggugggggg

SEQ ID NO: 150589 - RNA, 21 nt, Human
ugggguaauuuuuuuucuuuu

SEQ ID NO: 150590 - RNA, 19 nt, Human
uggggugggggugggggug

SEQ ID NO: 150591 - RNA, 18 nt, Human
uguccguuucuguggggu

SEQ ID NO: 150592 - RNA, 21 nt, Human
uuagaauucuaacaaauuaac

SEQ ID NO: 150593 - RNA, 22 nt, Human
uugggguggggguggggguggg

SEQ ID NO: 150594 - RNA, 21 nt, Human
uuuuccuucuccaccucuccc

SEQ ID NO: 150595 - RNA, 22 nt, Human
uuuucggucuuuaaacaccauu

SEQ ID NO: 150596 - RNA, 24 nt, Human
uuuugcaauagauagauuuaaagu

SEQ ID NO: 150597 - RNA, 24 nt, Human
uuuuuuuucuuuuuuuuucuuuuu

SEQ ID NO: 150598 - RNA, 21 nt, Human
aaaaaaagaaaaagaaaagga

SEQ ID NO: 150599 - RNA, 18 nt, Human
aaaaaaaucacccaggca

SEQ ID NO: 150600 - RNA, 23 nt, Human
aaaagaaaaagaaaaggaaaaag

SEQ ID NO: 150601 - RNA, 18 nt, Human
aaaaggaaaaagaaagca

SEQ ID NO: 150602 - RNA, 24 nt, Human
aaaaggaaaaagaaagcaagaaaa

SEQ ID NO: 150603 - RNA, 22 nt, Human
aaaagucccagagaaaccaggg

SEQ ID NO: 150604 - RNA, 24 nt, Human
aaagaaaagucccagagaaaccag

SEQ ID NO: 150605 - RNA, 20 nt, Human
aaaggaaacacacucucgca

SEQ ID NO: 150606 - RNA, 21 nt, Human
aaaggagauuaauaaaaaugu

SEQ ID NO: 150607 - RNA, 19 nt, Human
aaagucccagagaaaccag

SEQ ID NO: 150608 - RNA, 20 nt, Human
aacacacucucgcacacaaa

SEQ ID NO: 150609 - RNA, 19 nt, Human
aaccagggccggcgaugcg

SEQ ID NO: 150610 - RNA, 22 nt, Human
aagaaaaagaaaaggaaaaaga

SEQ ID NO: 150611 - RNA, 20 nt, Human
aagcaagaaaaaaagcucca

SEQ ID NO: 150612 - RNA, 19 nt, Human
aaugaaaaaggcaacgaaa

SEQ ID NO: 150613 - RNA, 19 nt, Human
aaugaaggaaaaaaagaaa

SEQ ID NO: 150614 - RNA, 19 nt, Human
acaaagaaaagucccagag

SEQ ID NO: 150615 - RNA, 26 nt, Human
acacaaagaaaagucccagagaaacc

SEQ ID NO: 150616 - RNA, 23 nt, Human
acacucucgcacacaaagaaaag

SEQ ID NO: 150617 - RNA, 23 nt, Human
agaacagacagaccgacagaagg

SEQ ID NO: 150618 - RNA, 19 nt, Human
agacuacagguuucugaac

SEQ ID NO: 150619 - RNA, 18 nt, Human
agaugcuuucucccccag

SEQ ID NO: 150620 - RNA, 21 nt, Human
agccacggccaaaaaaaugaa

SEQ ID NO: 150621 - RNA, 19 nt, Human
aggaaaaagaaagcaagaa

SEQ ID NO: 150622 - RNA, 24 nt, Human
aggaaaaagaaagcaagaaaaaaa

SEQ ID NO: 150623 - RNA, 21 nt, Human
aggcaaauggagaagcaacuc

SEQ ID NO: 150624 - RNA, 22 nt, Human
aggcaguagugagggguuugac

SEQ ID NO: 150625 - RNA, 28 nt, Human
aggccgggacucaggagggggcagaaga

SEQ ID NO: 150626 - RNA, 20 nt, Human
agggacccgggagguggggg

SEQ ID NO: 150627 - RNA, 23 nt, Human
agggccggcgaugcgggucggga

SEQ ID NO: 150628 - RNA, 22 nt, Human
aggggugaauuuugggauguag

SEQ ID NO: 150629 - RNA, 21 nt, Human
aggugggggagaagagguggg

SEQ ID NO: 150630 - RNA, 18 nt, Human
agguuucugaacauaaua

SEQ ID NO: 150631 - RNA, 24 nt, Human
agguuucugaacauaauaaaaucu

SEQ ID NO: 150632 - RNA, 23 nt, Human
auggagaagcaacuccauaaaca

SEQ ID NO: 150633 - RNA, 27 nt, Human
caaacucucucgcuuaaaaaaaaaauc

SEQ ID NO: 150634 - RNA, 20 nt, Human
caacuuguuagagaaaugcu

SEQ ID NO: 150635 - RNA, 23 nt, Human
cacaaagaaaagucccagagaaa

SEQ ID NO: 150636 - RNA, 23 nt, Human
caccccacuuugccagcggcccg

SEQ ID NO: 150637 - RNA, 19 nt, Human
caccggagaagcaaugaca

SEQ ID NO: 150638 - RNA, 27 nt, Human
cacggccaaaaaaaugaaggaaaaaaa

SEQ ID NO: 150639 - RNA, 24 nt, Human
cacuuuuugccuucaaaccggaag

SEQ ID NO: 150640 - RNA, 22 nt, Human
cagcgccuuuaaucgccuuugc

SEQ ID NO: 150641 - RNA, 19 nt, Human
cccacccgcgccgcacccg

SEQ ID NO: 150642 - RNA, 21 nt, Human
cccacccgcgccgcacccgcg

SEQ ID NO: 150643 - RNA, 22 nt, Human
cccaccgccucgcuccccaccc

SEQ ID NO: 150644 - RNA, 22 nt, Human
cccaggcacacuuuuugccuuc

SEQ ID NO: 150645 - RNA, 20 nt, Human
cccccaccgccucgcucccc

SEQ ID NO: 150646 - RNA, 19 nt, Human
ccccgccgccccggccgcc

SEQ ID NO: 150647 - RNA, 19 nt, Human
cccgcgucccucccccucc

SEQ ID NO: 150648 - RNA, 18 nt, Human
cccucccccacccgcgcc

SEQ ID NO: 150649 - RNA, 24 nt, Human
cccugugcgucggguccgcccucc

SEQ ID NO: 150650 - RNA, 19 nt, Human
cccuuauacugggaauaga

SEQ ID NO: 150651 - RNA, 22 nt, Human
ccgcacccgcgucccucccccu

SEQ ID NO: 150652 - RNA, 21 nt, Human
ccgccccgccgccccggccgc

SEQ ID NO: 150653 - RNA, 19 nt, Human
ccgccgcgccggcccccgc

SEQ ID NO: 150654 - RNA, 21 nt, Human
ccgccucgcuccccaccccac

SEQ ID NO: 150655 - RNA, 19 nt, Human
ccgcgccggcccccgcccc

SEQ ID NO: 150656 - RNA, 22 nt, Human
ccggccgccgcgccggcccccg

SEQ ID NO: 150657 - RNA, 20 nt, Human
cgcggccccggccuguggcc

SEQ ID NO: 150658 - RNA, 24 nt, Human
cgcuuaaaaaaaaaaucacccagg

SEQ ID NO: 150659 - RNA, 21 nt, Human
cggcccaaugggcgcgcgcgg

SEQ ID NO: 150660 - RNA, 18 nt, Human
cgggagacgacggcggcg

SEQ ID NO: 150661 - RNA, 18 nt, Human
cgggagggggcgcgggcg

SEQ ID NO: 150662 - RNA, 22 nt, Human
cgggaggggugaauuuugggau

SEQ ID NO: 150663 - RNA, 21 nt, Human
cguuucaacgucauuguccau

SEQ ID NO: 150664 - RNA, 26 nt, Human
cucggcgcuggcccugugccgguucc

SEQ ID NO: 150665 - RNA, 25 nt, Human
cucguucuuaucuagcagauagauc

SEQ ID NO: 150666 - RNA, 18 nt, Human
cugcaaccagauucaaug

SEQ ID NO: 150667 - RNA, 25 nt, Human
cuuaaagggaaaaaaauaguauuua

SEQ ID NO: 150668 - RNA, 23 nt, Human
cuuucugucucucucgcucuuuu

SEQ ID NO: 150669 - RNA, 19 nt, Human
gagacacuuggcuauuucu

SEQ ID NO: 150670 - RNA, 22 nt, Human
gcacaaacucucucgcuuaaaa

SEQ ID NO: 150671 - RNA, 23 nt, Human
gcagaacagacagaccgacagaa

SEQ ID NO: 150672 - RNA, 24 nt, Human
gccacggccaaaaaaaugaaggaa

SEQ ID NO: 150673 - RNA, 23 nt, Human
gcccccaccgccucgcuccccac

SEQ ID NO: 150674 - RNA, 19 nt, Human
ggacccgggagguggggga

SEQ ID NO: 150675 - RNA, 21 nt, Human
ggagccaauggcgagccggga

SEQ ID NO: 150676 - RNA, 19 nt, Human
ggaggugggggagaagagg

SEQ ID NO: 150677 - RNA, 24 nt, Human
ggcagaacagacagaccgacagaa

SEQ ID NO: 150678 - RNA, 27 nt, Human
ggcagacacgaaaggaaacacacucuc

SEQ ID NO: 150679 - RNA, 21 nt, Human
ggccgccccgccgccccggcc

SEQ ID NO: 150680 - RNA, 21 nt, Human
ggcgggggcagcgaggcggug

SEQ ID NO: 150681 - RNA, 25 nt, Human
ggcugguuuuuuuuuuuuuguuuuu

SEQ ID NO: 150682 - RNA, 21 nt, Human
gggcagaagaaaccgggaggg

SEQ ID NO: 150683 - RNA, 28 nt, Human
gggcagacacgaaaggaaacacacucuc

SEQ ID NO: 150684 - RNA, 19 nt, Human
gggcgcgggcgcggccccg

SEQ ID NO: 150685 - RNA, 21 nt, Human
gggggcagaagaaaccgggag

SEQ ID NO: 150686 - RNA, 19 nt, Human
guauguguuuuccuuaccu

SEQ ID NO: 150687 - RNA, 20 nt, Human
uauuucagacuacagguuuc

SEQ ID NO: 150688 - RNA, 26 nt, Human
uccauaaacaacuuguuagagaaaug

SEQ ID NO: 150689 - RNA, 23 nt, Human
ucccagagaaaccagggccggcg

SEQ ID NO: 150690 - RNA, 26 nt, Human
ucccuccuuggagcagaugcuuucuc

SEQ ID NO: 150691 - RNA, 18 nt, Human
ucccugcgcucccucccu

SEQ ID NO: 150692 - RNA, 22 nt, Human
uccgcccucccccacccgcgcc

SEQ ID NO: 150693 - RNA, 20 nt, Human
ucucucgcuuaaaaaaaaaa

SEQ ID NO: 150694 - RNA, 27 nt, Human
ucugcaaccagauucaaugauuugauu

SEQ ID NO: 150695 - RNA, 23 nt, Human
ugaaaaaggcaacgaaaacgaaa

SEQ ID NO: 150696 - RNA, 21 nt, Human
ugaaggaaaaaaagaaaaaga

SEQ ID NO: 150697 - RNA, 22 nt, Human
ugaaggaaaaaaagaaaaagaa

SEQ ID NO: 150698 - RNA, 19 nt, Human
ugagucagggccgcacgug

SEQ ID NO: 150699 - RNA, 19 nt, Human
ugccagcggcccguggggg

SEQ ID NO: 150700 - RNA, 21 nt, Human
uggcuuguagcggcgguucag

SEQ ID NO: 150701 - RNA, 18 nt, Human
ugggcgcgcgcgggacuu

SEQ ID NO: 150702 - RNA, 22 nt, Human
ugugcccagagcgugaggcugg

SEQ ID NO: 150703 - RNA, 19 nt, Human
uuagagaaaugcaggauua

SEQ ID NO: 150704 - RNA, 19 nt, Human
uuucucaacaagucuccgg

SEQ ID NO: 150705 - RNA, 18 nt, Human
uuuuuuuucaaaucucug

SEQ ID NO: 150706 - RNA, 27 nt, Human
uuuuuuuuuguuuuuuuuuuuuuuuuc

SEQ ID NO: 150707 - RNA, 27 nt, Human
aaaaaaagaaaaaaauagggaagaaaa

SEQ ID NO: 150708 - RNA, 26 nt, Human
aaaaaacagaaaccaacuuugcuucc

SEQ ID NO: 150709 - RNA, 20 nt, Human
aaaaaagaaaaaaauaggga

SEQ ID NO: 150710 - RNA, 22 nt, Human
aaaaacaagaaaagacaaaaag

SEQ ID NO: 150711 - RNA, 25 nt, Human
aaaaagaaaaaaauagggaagaaaa

SEQ ID NO: 150712 - RNA, 18 nt, Human
aaaaagaagaagaaagga

SEQ ID NO: 150713 - RNA, 19 nt, Human
aaaaaucuuuggacuucag

SEQ ID NO: 150714 - RNA, 21 nt, Human
aaaagaagaagaaaggaggag

SEQ ID NO: 150715 - RNA, 19 nt, Human
aaaaggagggucgccccac

SEQ ID NO: 150716 - RNA, 19 nt, Human
aaaauuagcauaaucucau

SEQ ID NO: 150717 - RNA, 18 nt, Human
aaacaaaaaacagaaacc

SEQ ID NO: 150718 - RNA, 20 nt, Human
aaacaaaaaacagaaaccaa

SEQ ID NO: 150719 - RNA, 19 nt, Human
aaacuaaaacaacaaagaa

SEQ ID NO: 150720 - RNA, 24 nt, Human
aaacuaaaacaacaaagaaaacaa

SEQ ID NO: 150721 - RNA, 24 nt, Human
aaagaaaaaaauaaaggaaaaaaa

SEQ ID NO: 150722 - RNA, 23 nt, Human
aaagaagaagaaaggaggagcag

SEQ ID NO: 150723 - RNA, 19 nt, Human
aaagacaagguagccacau

SEQ ID NO: 150724 - RNA, 20 nt, Human
aaagacaagguagccacaug

SEQ ID NO: 150725 - RNA, 19 nt, Human
aacaaagaaaacaaaaaac

SEQ ID NO: 150726 - RNA, 23 nt, Human
aacaugcuuagcgauccgaaaga

SEQ ID NO: 150727 - RNA, 20 nt, Human
aaccugagacacuuucacuc

SEQ ID NO: 150728 - RNA, 23 nt, Human
aagaaaaaaauaaaggaaaaaaa

SEQ ID NO: 150729 - RNA, 21 nt, Human
aagaaaacaaaaaacagaaac

SEQ ID NO: 150730 - RNA, 26 nt, Human
aagaaaagacaaaaagugagggaccc

SEQ ID NO: 150731 - RNA, 24 nt, Human
aagaagaagaaaggaggagcagga

SEQ ID NO: 150732 - RNA, 18 nt, Human
aagacuucaaaaccaagu

SEQ ID NO: 150733 - RNA, 22 nt, Human
aagacuucaaaaccaagucgcc

SEQ ID NO: 150734 - RNA, 18 nt, Human
aagcagcccccuucgcaa

SEQ ID NO: 150735 - RNA, 22 nt, Human
aagcagcccccuucgcaaaaaa

SEQ ID NO: 150736 - RNA, 23 nt, Human
aagccaacacaaacaaaguggca

SEQ ID NO: 150737 - RNA, 21 nt, Human
aaucuuuauacacuggcccuu

SEQ ID NO: 150738 - RNA, 23 nt, Human
acaaaaaacagaaaccaacuuug

SEQ ID NO: 150739 - RNA, 23 nt, Human
acaaagaaaacaaaaaacagaaa

SEQ ID NO: 150740 - RNA, 22 nt, Human
acacaaaaaacucaaaaaaaua

SEQ ID NO: 150741 - RNA, 20 nt, Human
acacacuuucuuccuucuuu

SEQ ID NO: 150742 - RNA, 22 nt, Human
acacggagacccccgcgccccc

SEQ ID NO: 150743 - RNA, 22 nt, Human
acagagccuucugccagcccag

SEQ ID NO: 150744 - RNA, 18 nt, Human
accagguccccuaagcuc

SEQ ID NO: 150745 - RNA, 21 nt, Human
agaaaagaaaaaaauaaagga

SEQ ID NO: 150746 - RNA, 21 nt, Human
agaaaagaaaaaaauaaagga

SEQ ID NO: 150747 - RNA, 19 nt, Human
agaaaagaaaaaggaaagg

SEQ ID NO: 150748 - RNA, 20 nt, Human
agaaaagaaaaaggaaagga

SEQ ID NO: 150749 - RNA, 22 nt, Human
agaaaagaaaaaggaaaggaag

SEQ ID NO: 150750 - RNA, 20 nt, Human
agaagaaaaagaagaagaaa

SEQ ID NO: 150751 - RNA, 21 nt, Human
agaagaaaaagaagaagaaag

SEQ ID NO: 150752 - RNA, 23 nt, Human
agaagaaaaagaagaagaaagga

SEQ ID NO: 150753 - RNA, 24 nt, Human
agaagaagaaaggaggagcaggag

SEQ ID NO: 150754 - RNA, 19 nt, Human
agaaggaggagggaguuag

SEQ ID NO: 150755 - RNA, 29 nt, Human
agacaaaaagugaugauaagagggacccc

SEQ ID NO: 150756 - RNA, 18 nt, Human
agacccccgcgcccccac

SEQ ID NO: 150757 - RNA, 19 nt, Human
agagggagccgggugaggc

SEQ ID NO: 150758 - RNA, 18 nt, Human
agcagcccgccgccccuc

SEQ ID NO: 150759 - RNA, 21 nt, Human
agcauaaucucauaaacacaa

SEQ ID NO: 150760 - RNA, 19 nt, Human
aggaaagagaaggaggagg

SEQ ID NO: 150761 - RNA, 21 nt, Human
aggaaggaaggaggaggagga

SEQ ID NO: 150762 - RNA, 21 nt, Human
aggaaggaaggaggaggagga

SEQ ID NO: 150763 - RNA, 21 nt, Human
aggagaagaaaaagaagaaga

SEQ ID NO: 150764 - RNA, 23 nt, Human
aggaggaagaggaggaaaaagga

SEQ ID NO: 150765 - RNA, 21 nt, Human
aggaggaaggaggaagaggag

SEQ ID NO: 150766 - RNA, 21 nt, Human
aggagggaguuaggugcagga

SEQ ID NO: 150767 - RNA, 23 nt, Human
aggagggaguuaggugcaggagg

SEQ ID NO: 150768 - RNA, 24 nt, Human
aggagggaguuaggugcaggaggg

SEQ ID NO: 150769 - RNA, 25 nt, Human
aggagggaguuaggugcaggagggu

SEQ ID NO: 150770 - RNA, 19 nt, Human
aggauucugaguucuuuug

SEQ ID NO: 150771 - RNA, 19 nt, Human
agggaagaaaagaaaaagg

SEQ ID NO: 150772 - RNA, 21 nt, Human
agggaguuaggugcaggaggg

SEQ ID NO: 150773 - RNA, 22 nt, Human
agguagccacauguuucagaac

SEQ ID NO: 150774 - RNA, 23 nt, Human
auaauaaaaaaguguccaauguc

SEQ ID NO: 150775 - RNA, 21 nt, Human
auacauagaauauuucagaac

SEQ ID NO: 150776 - RNA, 19 nt, Human
augagagauucaacagagc

SEQ ID NO: 150777 - RNA, 23 nt, Human
caaagaaaacaaaaaacagaaac

SEQ ID NO: 150778 - RNA, 24 nt, Human
caaaguggcagaagucauagacca

SEQ ID NO: 150779 - RNA, 24 nt, Human
caaaucccagaacuggcccaagga

SEQ ID NO: 150780 - RNA, 22 nt, Human
caacacaaacaaaguggcagaa

SEQ ID NO: 150781 - RNA, 20 nt, Human
caagaauuucaacacacaaa

SEQ ID NO: 150782 - RNA, 23 nt, Human
caaguccucgacuucgccgcgca

SEQ ID NO: 150783 - RNA, 18 nt, Human
caagucgcccgccccccu

SEQ ID NO: 150784 - RNA, 19 nt, Human
cacaaacaaaguggcagaa

SEQ ID NO: 150785 - RNA, 24 nt, Human
cacacaccccaggccuuuagcccc

SEQ ID NO: 150786 - RNA, 20 nt, Human
cacacauauuuaucuuggaa

SEQ ID NO: 150787 - RNA, 21 nt, Human
cacaccccaggccuuuagccc

SEQ ID NO: 150788 - RNA, 23 nt, Human
cacaccccaggccuuuagcccca

SEQ ID NO: 150789 - RNA, 22 nt, Human
cacacggagacccccgcgcccc

SEQ ID NO: 150790 - RNA, 23 nt, Human
cacacggagacccccgcgccccc

SEQ ID NO: 150791 - RNA, 18 nt, Human
cacagaccacagacgcag

SEQ ID NO: 150792 - RNA, 23 nt, Human
cacccaugauggcugguggaguc

SEQ ID NO: 150793 - RNA, 24 nt, Human
caccccgccgagucuuccgagggc

SEQ ID NO: 150794 - RNA, 21 nt, Human
caccccugggucagccguggg

SEQ ID NO: 150795 - RNA, 21 nt, Human
cacuguaccacaccuucaaaa

SEQ ID NO: 150796 - RNA, 22 nt, Human
cagagcccccucgagugacguc

SEQ ID NO: 150797 - RNA, 19 nt, Human
cagagccuucugccagccc

SEQ ID NO: 150798 - RNA, 20 nt, Human
cagagccuucugccagccca

SEQ ID NO: 150799 - RNA, 22 nt, Human
cagccacuccaagaaaagaaaa

SEQ ID NO: 150800 - RNA, 23 nt, Human
cagcccccuucgcaaaaaagaaa

SEQ ID NO: 150801 - RNA, 23 nt, Human
cagccgugugcacaccccugggu

SEQ ID NO: 150802 - RNA, 19 nt, Human
cagcgcguuccccggcgcu

SEQ ID NO: 150803 - RNA, 20 nt, Human
caggaaauuccuggggccaa

SEQ ID NO: 150804 - RNA, 19 nt, Human
caggagcagcccgccgccc

SEQ ID NO: 150805 - RNA, 20 nt, Human
caggagggugaggagaggga

SEQ ID NO: 150806 - RNA, 19 nt, Human
cauacggccgcauuccacc

SEQ ID NO: 150807 - RNA, 19 nt, Human
caucucccucuacagagcc

SEQ ID NO: 150808 - RNA, 21 nt, Human
ccagcccagaaacagugagcc

SEQ ID NO: 150809 - RNA, 18 nt, Human
ccagggccaaaucccaga

SEQ ID NO: 150810 - RNA, 21 nt, Human
cccagaacuggcccaaggacc

SEQ ID NO: 150811 - RNA, 21 nt, Human
cccauaaaauuagcauaaucu

SEQ ID NO: 150812 - RNA, 21 nt, Human
ccccaggccuuuagccccaga

SEQ ID NO: 150813 - RNA, 18 nt, Human
cccccgcgcccccacccc

SEQ ID NO: 150814 - RNA, 19 nt, Human
cccccgcgcccccaccccg

SEQ ID NO: 150815 - RNA, 20 nt, Human
cccccgcgcccccaccccgc

SEQ ID NO: 150816 - RNA, 22 nt, Human
ccccgcgcccccaccccgccga

SEQ ID NO: 150817 - RNA, 21 nt, Human
ccccgcuccucuccgcguccg

SEQ ID NO: 150818 - RNA, 21 nt, Human
ccccucucucccaccaggucc

SEQ ID NO: 150819 - RNA, 22 nt, Human
ccccucucucccaccagguccc

SEQ ID NO: 150820 - RNA, 22 nt, Human
ccccuggcugucccagccacag

SEQ ID NO: 150821 - RNA, 19 nt, Human
cccgcacgcccuagccggc

SEQ ID NO: 150822 - RNA, 19 nt, Human
cccgcccgggccggcuccg

SEQ ID NO: 150823 - RNA, 21 nt, Human
cccgccgccccuccuccccuu

SEQ ID NO: 150824 - RNA, 22 nt, Human
cccgccgccccuccuccccuua

SEQ ID NO: 150825 - RNA, 18 nt, Human
cccgcuccgggugcggga

SEQ ID NO: 150826 - RNA, 18 nt, Human
cccggccguccccgcccg

SEQ ID NO: 150827 - RNA, 25 nt, Human
cccggcgacagccccgccaggucac

SEQ ID NO: 150828 - RNA, 19 nt, Human
cccuaagcagcccccuucg

SEQ ID NO: 150829 - RNA, 21 nt, Human
cccuaagcuccccaaggccuu

SEQ ID NO: 150830 - RNA, 22 nt, Human
cccucgccgccucggccuccgc

SEQ ID NO: 150831 - RNA, 24 nt, Human
ccgaaagagcgggggaaugcagua

SEQ ID NO: 150832 - RNA, 21 nt, Human
ccgcccgggccggcuccggcc

SEQ ID NO: 150833 - RNA, 23 nt, Human
ccgcccgggccggcuccggccgc

SEQ ID NO: 150834 - RNA, 23 nt, Human
ccgcccucgccgccucggccucc

SEQ ID NO: 150835 - RNA, 24 nt, Human
ccgcccucgccgccucggccuccg

SEQ ID NO: 150836 - RNA, 22 nt, Human
ccgccgcccggccguccccgcc

SEQ ID NO: 150837 - RNA, 18 nt, Human
ccgccgccgcccggccgu

SEQ ID NO: 150838 - RNA, 20 nt, Human
ccgccgccgcccggccgucc

SEQ ID NO: 150839 - RNA, 20 nt, Human
ccgccgccgccgcccggccg

SEQ ID NO: 150840 - RNA, 19 nt, Human
ccgcgcccccgccgagccc

SEQ ID NO: 150841 - RNA, 20 nt, Human
ccgcgcccccgccgagcccc

SEQ ID NO: 150842 - RNA, 24 nt, Human
ccgcgcccccgccgagccccgcag

SEQ ID NO: 150843 - RNA, 23 nt, Human
ccgcugggugacaggagcagccc

SEQ ID NO: 150844 - RNA, 19 nt, Human
ccggccgccgccgccgccc

SEQ ID NO: 150845 - RNA, 20 nt, Human
ccgggcugggccgcccgcgc

SEQ ID NO: 150846 - RNA, 22 nt, Human
ccguccgccgcccucgccgccu

SEQ ID NO: 150847 - RNA, 26 nt, Human
ccguccgccgcccucgccgccucggc

SEQ ID NO: 150848 - RNA, 23 nt, Human
ccucccgcggcgcacacggagac

SEQ ID NO: 150849 - RNA, 22 nt, Human
ccucccgggcuccccgcuccuc

SEQ ID NO: 150850 - RNA, 22 nt, Human
ccugagacacuuucacucugga

SEQ ID NO: 150851 - RNA, 24 nt, Human
ccugcggcaggacugcggugggac

SEQ ID NO: 150852 - RNA, 22 nt, Human
ccugggccgcccggggcgagag

SEQ ID NO: 150853 - RNA, 25 nt, Human
ccugggguacgcugggcugcuuccc

SEQ ID NO: 150854 - RNA, 21 nt, Human
cgaggccagggcccggccggg

SEQ ID NO: 150855 - RNA, 20 nt, Human
cgagggcgugcgcggcggcc

SEQ ID NO: 150856 - RNA, 18 nt, Human
cgcaaaaaagaaaaaaac

SEQ ID NO: 150857 - RNA, 22 nt, Human
cgcccgcgcuccccggccgucc

SEQ ID NO: 150858 - RNA, 20 nt, Human
cgccgagccccgcagagcuc

SEQ ID NO: 150859 - RNA, 23 nt, Human
cgccucccgggcuccccgcuccu

SEQ ID NO: 150860 - RNA, 22 nt, Human
cgccucggccuccgcgcgggcu

SEQ ID NO: 150861 - RNA, 25 nt, Human
cgcggucagcgcgcccgccaccgcc

SEQ ID NO: 150862 - RNA, 20 nt, Human
cggcccgagucgcaugggug

SEQ ID NO: 150863 - RNA, 22 nt, Human
cggccgcgcccccgccgagccc

SEQ ID NO: 150864 - RNA, 19 nt, Human
cggccgggccgggcugggc

SEQ ID NO: 150865 - RNA, 20 nt, Human
cggccgggccgggcugggcc

SEQ ID NO: 150866 - RNA, 21 nt, Human
cggcgcaaccugagacacuuu

SEQ ID NO: 150867 - RNA, 20 nt, Human
cgggcugggccgggcugggc

SEQ ID NO: 150868 - RNA, 22 nt, Human
cguaaaacuauuacugcaauga

SEQ ID NO: 150869 - RNA, 25 nt, Human
cgugggcacacccccuggcuguccc

SEQ ID NO: 150870 - RNA, 25 nt, Human
cgugugcagggaggcgcgugcauac

SEQ ID NO: 150871 - RNA, 23 nt, Human
cucaccaagccaacacaaacaaa

SEQ ID NO: 150872 - RNA, 22 nt, Human
cucccaccagguccccuaagcu

SEQ ID NO: 150873 - RNA, 21 nt, Human
cuccggccgccgccgccgccc

SEQ ID NO: 150874 - RNA, 18 nt, Human
cucgcccgcgcuuucccu

SEQ ID NO: 150875 - RNA, 22 nt, Human
cucggagguucuaaaggaaucc

SEQ ID NO: 150876 - RNA, 23 nt, Human
cucucccaccagguccccuaagc

SEQ ID NO: 150877 - RNA, 18 nt, Human
cucuccgcguccggccgc

SEQ ID NO: 150878 - RNA, 25 nt, Human
cuggaaguccccucucucccaccag

SEQ ID NO: 150879 - RNA, 21 nt, Human
cuuccugucuuaaacgcagag

SEQ ID NO: 150880 - RNA, 20 nt, Human
cuucgcaaaaaagaaaaaaa

SEQ ID NO: 150881 - RNA, 25 nt, Human
cuuuaggccacacaccccaggccuu

SEQ ID NO: 150882 - RNA, 21 nt, Human
gaaacagugagccauggccuc

SEQ ID NO: 150883 - RNA, 19 nt, Human
gaacuggguuagaaacacc

SEQ ID NO: 150884 - RNA, 21 nt, Human
gaaggaggagggaguuaggug

SEQ ID NO: 150885 - RNA, 26 nt, Human
gaauccacgaacuggguuagaaacac

SEQ ID NO: 150886 - RNA, 18 nt, Human
gagaagaaaaagaagaag

SEQ ID NO: 150887 - RNA, 25 nt, Human
gagaagaaaaagaagaagaaaggag

SEQ ID NO: 150888 - RNA, 23 nt, Human
gagagacccccgaccgcgucucc

SEQ ID NO: 150889 - RNA, 20 nt, Human
gagcaggccugggguacgcu

SEQ ID NO: 150890 - RNA, 20 nt, Human
gagcauggagccgacuuccc

SEQ ID NO: 150891 - RNA, 27 nt, Human
gagccgggugaggcugcgggccugggc

SEQ ID NO: 150892 - RNA, 19 nt, Human
gaggaagaggaggaaaaag

SEQ ID NO: 150893 - RNA, 19 nt, Human
gaggaagaggaggaaaaag

SEQ ID NO: 150894 - RNA, 18 nt, Human
gaggagcaggaggaagga

SEQ ID NO: 150895 - RNA, 20 nt, Human
gaggaggaggaaggaaggag

SEQ ID NO: 150896 - RNA, 24 nt, Human
gaucgcuauuuuuaagauuuccau

SEQ ID NO: 150897 - RNA, 22 nt, Human
gcacauggaggcccccuccucg

SEQ ID NO: 150898 - RNA, 19 nt, Human
gcagcccccuucgcaaaaa

SEQ ID NO: 150899 - RNA, 19 nt, Human
gcaggagggugaggagagg

SEQ ID NO: 150900 - RNA, 24 nt, Human
gcagugguccggcggggacgcggg

SEQ ID NO: 150901 - RNA, 18 nt, Human
gccaaaaggagggucgcc

SEQ ID NO: 150902 - RNA, 20 nt, Human
gccacacaccccaggccuuu

SEQ ID NO: 150903 - RNA, 18 nt, Human
gcccgccaccgcccgcac

SEQ ID NO: 150904 - RNA, 20 nt, Human
gcccggccgggccgggcugg

SEQ ID NO: 150905 - RNA, 22 nt, Human
gcccggccguccccgcccgcac

SEQ ID NO: 150906 - RNA, 18 nt, Human
gccgagccccgcagagcu

SEQ ID NO: 150907 - RNA, 22 nt, Human
gccgcccgcgcuccccggccgu

SEQ ID NO: 150908 - RNA, 20 nt, Human
gccgcgcccccgccgagccc

SEQ ID NO: 150909 - RNA, 20 nt, Human
gccgggcugggccgggcugg

SEQ ID NO: 150910 - RNA, 20 nt, Human
gccugggcggcugcugguga

SEQ ID NO: 150911 - RNA, 20 nt, Human
gcgacacagaccacagacgc

SEQ ID NO: 150912 - RNA, 22 nt, Human
gcgcaggacacuccuccugcag

SEQ ID NO: 150913 - RNA, 28 nt, Human
gcgccuggugugugugugugugugugug

SEQ ID NO: 150914 - RNA, 18 nt, Human
gcgcggcggccgcggcca

SEQ ID NO: 150915 - RNA, 24 nt, Human
gcggucagcgcgcccgccaccgcc

SEQ ID NO: 150916 - RNA, 22 nt, Human
gcuuuaggccacacaccccagg

SEQ ID NO: 150917 - RNA, 19 nt, Human
ggaaagagaaggaggagga

SEQ ID NO: 150918 - RNA, 19 nt, Human
ggacagcgacacagaccac

SEQ ID NO: 150919 - RNA, 20 nt, Human
ggacucgggcgcgccuggug

SEQ ID NO: 150920 - RNA, 22 nt, Human
ggagacccccgcgcccccaccc

SEQ ID NO: 150921 - RNA, 22 nt, Human
ggagagggagccgggugaggcu

SEQ ID NO: 150922 - RNA, 20 nt, Human
ggaggaaggaaggaggagga

SEQ ID NO: 150923 - RNA, 20 nt, Human
ggcacccaugauggcuggug

SEQ ID NO: 150924 - RNA, 19 nt, Human
ggcaggaggguuaggccug

SEQ ID NO: 150925 - RNA, 18 nt, Human
ggccgggcugggccgggc

SEQ ID NO: 150926 - RNA, 24 nt, Human
gggacgcccuuccaaaucagccuu

SEQ ID NO: 150927 - RNA, 18 nt, Human
gggccgggcugggccgcc

SEQ ID NO: 150928 - RNA, 21 nt, Human
gggcgcccgcggucagcgcgc

SEQ ID NO: 150929 - RNA, 18 nt, Human
gggcugggccgggcuggg

SEQ ID NO: 150930 - RNA, 22 nt, Human
gggcugggccgggcugggccgc

SEQ ID NO: 150931 - RNA, 24 nt, Human
gggcuuuaggccacacaccccagg

SEQ ID NO: 150932 - RNA, 18 nt, Human
gggugaggagagggagcc

SEQ ID NO: 150933 - RNA, 25 nt, Human
ggguuaggccugcggcaggacugcg

SEQ ID NO: 150934 - RNA, 24 nt, Human
ggugcaggagggugaggagaggga

SEQ ID NO: 150935 - RNA, 19 nt, Human
guccaaugucauauaaugg

SEQ ID NO: 150936 - RNA, 23 nt, Human
gugaaacccuaagcagccccccc

SEQ ID NO: 150937 - RNA, 23 nt, Human
gugugcagggaggcgcgugcaua

SEQ ID NO: 150938 - RNA, 18 nt, Human
gugugugugugugugugu

SEQ ID NO: 150939 - RNA, 20 nt, Human
gugugugugugugugugugu

SEQ ID NO: 150940 - RNA, 21 nt, Human
gugugugugugugugugugug

SEQ ID NO: 150941 - RNA, 21 nt, Human
gugugugugugugugugugug

SEQ ID NO: 150942 - RNA, 23 nt, Human
guguguguguguguguucacaug

SEQ ID NO: 150943 - RNA, 23 nt, Human
guuuagcgcggacugagaccugg

SEQ ID NO: 150944 - RNA, 21 nt, Human
uaaaaaaaggugaaacccuaa

SEQ ID NO: 150945 - RNA, 20 nt, Human
uaaaaaacaagaaaagacaa

SEQ ID NO: 150946 - RNA, 22 nt, Human
uaaaacaacaaagaaaacaaaa

SEQ ID NO: 150947 - RNA, 24 nt, Human
uaaaacaacaaagaaaacaaaaaa

SEQ ID NO: 150948 - RNA, 26 nt, Human
uaaaacaacaaagaaaacaaaaaaca

SEQ ID NO: 150949 - RNA, 21 nt, Human
uaaaauuagcauaaucucaua

SEQ ID NO: 150950 - RNA, 20 nt, Human
uaagcuccccaaggccuuga

SEQ ID NO: 150951 - RNA, 18 nt, Human
uacaagucgccggccgcg

SEQ ID NO: 150952 - RNA, 22 nt, Human
uacacaauauuuucacuauuaa

SEQ ID NO: 150953 - RNA, 19 nt, Human
uaccguggggcgaaauccc

SEQ ID NO: 150954 - RNA, 20 nt, Human
uaccguggggcgaaauccca

SEQ ID NO: 150955 - RNA, 22 nt, Human
uagaaacaccacgagccgcccc

SEQ ID NO: 150956 - RNA, 21 nt, Human
uagauccuggaggauucugag

SEQ ID NO: 150957 - RNA, 20 nt, Human
uagcgcggacugagaccugg

SEQ ID NO: 150958 - RNA, 20 nt, Human
uaggccacacaccccaggcc

SEQ ID NO: 150959 - RNA, 28 nt, Human
uauagucagauauuuuggauuuuauacc

SEQ ID NO: 150960 - RNA, 23 nt, Human
uauuauguacaacguaaaacuau

SEQ ID NO: 150961 - RNA, 23 nt, Human
uauuguaagugugcgugugugug

SEQ ID NO: 150962 - RNA, 19 nt, Human
uauuucagaaccuuagcua

SEQ ID NO: 150963 - RNA, 26 nt, Human
ucaaaaccaagucgcccgccccccuc

SEQ ID NO: 150964 - RNA, 18 nt, Human
ucaacacacaaaaaugcg

SEQ ID NO: 150965 - RNA, 23 nt, Human
ucaacacacaaaaaugcgggggu

SEQ ID NO: 150966 - RNA, 23 nt, Human
uccacgaacuggguuagaaacac

SEQ ID NO: 150967 - RNA, 23 nt, Human
uccccucucucccaccagguccc

SEQ ID NO: 150968 - RNA, 24 nt, Human
ucgcccgcgcuuucccugucgcuu

SEQ ID NO: 150969 - RNA, 18 nt, Human
ucuacagagccuucugcc

SEQ ID NO: 150970 - RNA, 23 nt, Human
ucuacagagccuucugccagccc

SEQ ID NO: 150971 - RNA, 18 nt, Human
ucuauagcagaagcagcc

SEQ ID NO: 150972 - RNA, 18 nt, Human
ucuccuggacacgugccu

SEQ ID NO: 150973 - RNA, 24 nt, Human
ucucuauagcagaagcagccacuc

SEQ ID NO: 150974 - RNA, 25 nt, Human
ucugccagcccagaaacagugagcc

SEQ ID NO: 150975 - RNA, 23 nt, Human
ucuuuggacuucagcaaguuguu

SEQ ID NO: 150976 - RNA, 19 nt, Human
ugaaacaugcuuagcgauc

SEQ ID NO: 150977 - RNA, 18 nt, Human
ugaaacccuaagcagccc

SEQ ID NO: 150978 - RNA, 22 nt, Human
ugaaauaaagagguuuaaggca

SEQ ID NO: 150979 - RNA, 22 nt, Human
ugaauccacgaacuggguuaga

SEQ ID NO: 150980 - RNA, 20 nt, Human
ugagcauggagccgacuucc

SEQ ID NO: 150981 - RNA, 18 nt, Human
ugaggaggaggaggaaag

SEQ ID NO: 150982 - RNA, 19 nt, Human
ugaggaggaggaggaaaga

SEQ ID NO: 150983 - RNA, 22 nt, Human
ugaggcugcgggccugggcgac

SEQ ID NO: 150984 - RNA, 26 nt, Human
ugagguggcugguccaggcuugaggu

SEQ ID NO: 150985 - RNA, 22 nt, Human
ugaggugugggccccuccugcu

SEQ ID NO: 150986 - RNA, 21 nt, Human
ugcacaccccugggucagccg

SEQ ID NO: 150987 - RNA, 23 nt, Human
ugcauacagacauauguguaaca

SEQ ID NO: 150988 - RNA, 21 nt, Human
ugcgcgcaugcaggcagcgcg

SEQ ID NO: 150989 - RNA, 22 nt, Human
ugcgggccugggcggcugcugg

SEQ ID NO: 150990 - RNA, 20 nt, Human
uggaggauucugaguucuuu

SEQ ID NO: 150991 - RNA, 22 nt, Human
uggaggauucugaguucuuuug

SEQ ID NO: 150992 - RNA, 20 nt, Human
uggcugguccaggcuugagg

SEQ ID NO: 150993 - RNA, 19 nt, Human
ugggacccuggcuggcacc

SEQ ID NO: 150994 - RNA, 21 nt, Human
ugggacccuggcuggcaccca

SEQ ID NO: 150995 - RNA, 24 nt, Human
ugggacccuggcuggcacccauga

SEQ ID NO: 150996 - RNA, 23 nt, Human
ugggacuggggacagcgacacag

SEQ ID NO: 150997 - RNA, 20 nt, Human
ugggcccuuggugaggagga

SEQ ID NO: 150998 - RNA, 21 nt, Human
ugggcugcuucccagggccaa

SEQ ID NO: 150999 - RNA, 23 nt, Human
uggggacagcgacacagaccaca

SEQ ID NO: 151000 - RNA, 22 nt, Human
uggugugugugugugugugugu

SEQ ID NO: 151001 - RNA, 20 nt, Human
ugugcgugugugugcgugug

SEQ ID NO: 151002 - RNA, 18 nt, Human
ugugugugugugugugug

SEQ ID NO: 151003 - RNA, 18 nt, Human
ugugugugugugugugug

SEQ ID NO: 151004 - RNA, 18 nt, Human
ugugugugugugugugug

SEQ ID NO: 151005 - RNA, 18 nt, Human
ugugugugugugugugug

SEQ ID NO: 151006 - RNA, 18 nt, Human
ugugugugugugugugug

SEQ ID NO: 151007 - RNA, 18 nt, Human
ugugugugugugugugug

SEQ ID NO: 151008 - RNA, 21 nt, Human
ugugugugugugugugugugu

SEQ ID NO: 151009 - RNA, 21 nt, Human
ugugugugugugugugugugu

SEQ ID NO: 151010 - RNA, 21 nt, Human
ugugugugugugugugugugu

SEQ ID NO: 151011 - RNA, 21 nt, Human
ugugugugugugugugugugu

SEQ ID NO: 151012 - RNA, 21 nt, Human
ugugugugugugugugugugu

SEQ ID NO: 151013 - RNA, 21 nt, Human
ugugugugugugugugugugu

SEQ ID NO: 151014 - RNA, 21 nt, Human
ugugugugugugugugugugu

SEQ ID NO: 151015 - RNA, 21 nt, Human
ugugugugugugugugugugu

SEQ ID NO: 151016 - RNA, 21 nt, Human
ugugugugugugugugugugu

SEQ ID NO: 151017 - RNA, 21 nt, Human
ugugugugugugugugugugu

SEQ ID NO: 151018 - RNA, 22 nt, Human
ugugugugugugugugugugug

SEQ ID NO: 151019 - RNA, 22 nt, Human
ugugugugugugugugugugug

SEQ ID NO: 151020 - RNA, 19 nt, Human
uguguguguguguguucac

SEQ ID NO: 151021 - RNA, 20 nt, Human
uguguguguguguguucaca

SEQ ID NO: 151022 - RNA, 22 nt, Human
uguguucacaugcauacagugu

SEQ ID NO: 151023 - RNA, 28 nt, Human
uguucacaugcauacagacauaugugua

SEQ ID NO: 151024 - RNA, 24 nt, Human
uuauucgguucacaguugugugaa

SEQ ID NO: 151025 - RNA, 21 nt, Human
uucacaguugugugaaaugca

SEQ ID NO: 151026 - RNA, 26 nt, Human
uuccccauacacuaaacagaagacag

SEQ ID NO: 151027 - RNA, 20 nt, Human
uuccuggggccaagccaaaa

SEQ ID NO: 151028 - RNA, 18 nt, Human
uugcugauggagaggaau

SEQ ID NO: 151029 - RNA, 22 nt, Human
uuuaaauuauugcauuguuuag

SEQ ID NO: 151030 - RNA, 19 nt, Human
uuuaacagagcccccucga

SEQ ID NO: 151031 - RNA, 21 nt, Human
uuuuuaaaaagguuuacacua

SEQ ID NO: 151032 - RNA, 22 nt, Human
aaaaaaaaaaaaaacaacuaaa

SEQ ID NO: 151033 - RNA, 27 nt, Human
aaaaaaaaaaaaaacaacuaaacauug

SEQ ID NO: 151034 - RNA, 21 nt, Human
aaaaaaaaaaaacaacuaaac

SEQ ID NO: 151035 - RNA, 21 nt, Human
aaaaaaacaacuaaacauuga

SEQ ID NO: 151036 - RNA, 24 nt, Human
aaaagaaggaagaaagcuaagaaa

SEQ ID NO: 151037 - RNA, 25 nt, Human
aaaaggaaacuaacucagacaagug

SEQ ID NO: 151038 - RNA, 22 nt, Human
aaaaugcuugaagagaauauug

SEQ ID NO: 151039 - RNA, 18 nt, Human
aaagguaaagagaguggc

SEQ ID NO: 151040 - RNA, 23 nt, Human
aaaugguguaacagggaaaaaga

SEQ ID NO: 151041 - RNA, 20 nt, Human
aaaugucuucuacagauccc

SEQ ID NO: 151042 - RNA, 19 nt, Human
aacugaacugugucuacuu

SEQ ID NO: 151043 - RNA, 21 nt, Human
aagacaguguuucccaaaaug

SEQ ID NO: 151044 - RNA, 20 nt, Human
aagcaaaaggaaacuaacuc

SEQ ID NO: 151045 - RNA, 22 nt, Human
aaggaaacuaacucagacaagu

SEQ ID NO: 151046 - RNA, 24 nt, Human
aagugauauacagagagaaaaaga

SEQ ID NO: 151047 - RNA, 19 nt, Human
aaugauaaagguaaagaga

SEQ ID NO: 151048 - RNA, 20 nt, Human
acaagcaaaaaacguacagu

SEQ ID NO: 151049 - RNA, 23 nt, Human
acaagcaaaaaacguacagugca

SEQ ID NO: 151050 - RNA, 22 nt, Human
acacaagcaaaaaacguacagu

SEQ ID NO: 151051 - RNA, 22 nt, Human
acagaacagauagguuggaaga

SEQ ID NO: 151052 - RNA, 19 nt, Human
acccuaagauaacuaaaaa

SEQ ID NO: 151053 - RNA, 23 nt, Human
agaaaaaaaaugcuugaagagaa

SEQ ID NO: 151054 - RNA, 20 nt, Human
agaaaaagaaaugauaaagg

SEQ ID NO: 151055 - RNA, 18 nt, Human
agaaaggaaucagagagg

SEQ ID NO: 151056 - RNA, 25 nt, Human
agaaaggaaucagagaggagaggga

SEQ ID NO: 151057 - RNA, 20 nt, Human
agaaggaagaaagcuaagaa

SEQ ID NO: 151058 - RNA, 19 nt, Human
agacauaaagaagagacua

SEQ ID NO: 151059 - RNA, 22 nt, Human
agacauaauggaggagguagac

SEQ ID NO: 151060 - RNA, 18 nt, Human
agagcaaaagaagucauc

SEQ ID NO: 151061 - RNA, 24 nt, Human
agcaaggcauauagaaauauccac

SEQ ID NO: 151062 - RNA, 19 nt, Human
agcacauacugguagaauc

SEQ ID NO: 151063 - RNA, 22 nt, Human
aggaagaaagcuaagaaaaaga

SEQ ID NO: 151064 - RNA, 18 nt, Human
aggagagggauuaguuga

SEQ ID NO: 151065 - RNA, 18 nt, Human
agggagaucucaagaagc

SEQ ID NO: 151066 - RNA, 24 nt, Human
aggguacgauuuggagaguggaua

SEQ ID NO: 151067 - RNA, 19 nt, Human
caaaaggaaacuaacucag

SEQ ID NO: 151068 - RNA, 22 nt, Human
caaaaggaaacuaacucagaca

SEQ ID NO: 151069 - RNA, 20 nt, Human
caaauugcugaagccaggga

SEQ ID NO: 151070 - RNA, 23 nt, Human
caguaggggauggccuggauaau

SEQ ID NO: 151071 - RNA, 23 nt, Human
cagugauuucucuuuccccaaga

SEQ ID NO: 151072 - RNA, 21 nt, Human
cauucagcauccuagacaguc

SEQ ID NO: 151073 - RNA, 21 nt, Human
ccccaaauuuuugagauguug

SEQ ID NO: 151074 - RNA, 22 nt, Human
ccuucuugcuuuuuuaaggucu

SEQ ID NO: 151075 - RNA, 18 nt, Human
cgguguuuucaugggagu

SEQ ID NO: 151076 - RNA, 22 nt, Human
cugaacuaguaaaaaaaaaaaa

SEQ ID NO: 151077 - RNA, 25 nt, Human
cugaacuaguaaaaaaaaaaaaaaa

SEQ ID NO: 151078 - RNA, 22 nt, Human
gaaccauugguauagaauguca

SEQ ID NO: 151079 - RNA, 25 nt, Human
gaagaaaaaaaaugcuugaagagaa

SEQ ID NO: 151080 - RNA, 22 nt, Human
gaagaaaccaaugccaauuaga

SEQ ID NO: 151081 - RNA, 21 nt, Human
gaagggaagaaaggaaucaga

SEQ ID NO: 151082 - RNA, 23 nt, Human
gacccuaagauaacuaaaaacaa

SEQ ID NO: 151083 - RNA, 19 nt, Human
gagaauauugaguaggaaa

SEQ ID NO: 151084 - RNA, 22 nt, Human
gauaacuaaaaacaaaguagcu

SEQ ID NO: 151085 - RNA, 26 nt, Human
gaucaccaagacagucagacacuuaa

SEQ ID NO: 151086 - RNA, 26 nt, Human
gaucccuucuaacgcugaaauucuau

SEQ ID NO: 151087 - RNA, 22 nt, Human
gcaaguuucgaggcagggaugg

SEQ ID NO: 151088 - RNA, 22 nt, Human
gccuuucagucuugaaaaacca

SEQ ID NO: 151089 - RNA, 24 nt, Human
ggaagaaaaaaaaugcuugaagag

SEQ ID NO: 151090 - RNA, 21 nt, Human
ggggaggggaauguaagcagu

SEQ ID NO: 151091 - RNA, 21 nt, Human
ggguacgauuuggagagugga

SEQ ID NO: 151092 - RNA, 23 nt, Human
guaaaaaaaaaaaaaaacaacua

SEQ ID NO: 151093 - RNA, 23 nt, Human
guagaauggaaaguuaaucugcc

SEQ ID NO: 151094 - RNA, 23 nt, Human
uaaccugagaagaaaccaaugcc

SEQ ID NO: 151095 - RNA, 20 nt, Human
uaacugaacugugucuacuu

SEQ ID NO: 151096 - RNA, 21 nt, Human
uagaaaugguuaaaauagcua

SEQ ID NO: 151097 - RNA, 22 nt, Human
uagacauaaagaagagacuaga

SEQ ID NO: 151098 - RNA, 25 nt, Human
uaguagcacauacugguagaauccc

SEQ ID NO: 151099 - RNA, 27 nt, Human
uauccacuuuucaaaauaauuuacaca

SEQ ID NO: 151100 - RNA, 23 nt, Human
uauccugccuucccuucuccuua

SEQ ID NO: 151101 - RNA, 22 nt, Human
ucaaaaaggcucaaaauaaaaa

SEQ ID NO: 151102 - RNA, 22 nt, Human
ucaacacaagcaaaaaacguac

SEQ ID NO: 151103 - RNA, 22 nt, Human
ucaagaaaaauuuaggguacga

SEQ ID NO: 151104 - RNA, 18 nt, Human
ucacucagauaucauguu

SEQ ID NO: 151105 - RNA, 21 nt, Human
ucacucagauaucauguucag

SEQ ID NO: 151106 - RNA, 21 nt, Human
ucaguaucaaaaaggcucaaa

SEQ ID NO: 151107 - RNA, 22 nt, Human
uccaaaauauauucuguaauga

SEQ ID NO: 151108 - RNA, 24 nt, Human
uccccagaggccuaaucucagcuc

SEQ ID NO: 151109 - RNA, 21 nt, Human
ucuacuugguagagacccuaa

SEQ ID NO: 151110 - RNA, 22 nt, Human
ucuuaggaaguuuucaacguug

SEQ ID NO: 151111 - RNA, 26 nt, Human
ugaacuaguaaaaaaaaaaaaaaaca

SEQ ID NO: 151112 - RNA, 19 nt, Human
ugagaagaaaccaaugcca

SEQ ID NO: 151113 - RNA, 27 nt, Human
ugagaagaaaccaaugccaauuagaag

SEQ ID NO: 151114 - RNA, 22 nt, Human
ugagggagagagaaaagaagga

SEQ ID NO: 151115 - RNA, 23 nt, Human
uggaaauguugcugaauauauaa

SEQ ID NO: 151116 - RNA, 20 nt, Human
uggaacuuugagagcaaaag

SEQ ID NO: 151117 - RNA, 21 nt, Human
uggaagaaaaaaaaugcuuga

SEQ ID NO: 151118 - RNA, 25 nt, Human
uggcaaguccuagucuuuuuuccug

SEQ ID NO: 151119 - RNA, 20 nt, Human
ugguggcucauucagcaucc

SEQ ID NO: 151120 - RNA, 23 nt, Human
uguguuuccccaaauuuuugaga

SEQ ID NO: 151121 - RNA, 23 nt, Human
uguuaugaaaucugccccugaag

SEQ ID NO: 151122 - RNA, 20 nt, Human
uguuuucaugggaguguuga

SEQ ID NO: 151123 - RNA, 21 nt, Human
uuaaaagacaguuuuauacag

SEQ ID NO: 151124 - RNA, 23 nt, Human
uuccaaaauauauucuguaauga

SEQ ID NO: 151125 - RNA, 21 nt, Human
uucuaugauggaaauguugcu

SEQ ID NO: 151126 - RNA, 20 nt, Human
uugaagacacugugcuaggu

SEQ ID NO: 151127 - RNA, 23 nt, Human
uuuauaagccuuuaagaaaaaua

SEQ ID NO: 151128 - RNA, 20 nt, Human
uuuuccugcucuaggcaagg

SEQ ID NO: 151129 - RNA, 20 nt, Human
aaaauaagaagaaccuucuc

SEQ ID NO: 151130 - RNA, 25 nt, Human
aaacaaguacauaugaacaugaaca

SEQ ID NO: 151131 - RNA, 20 nt, Human
aaagaaaaaaacuguaaagc

SEQ ID NO: 151132 - RNA, 24 nt, Human
aaagcacaucucaacagccacaaa

SEQ ID NO: 151133 - RNA, 22 nt, Human
aauccaccccuccccagcccac

SEQ ID NO: 151134 - RNA, 22 nt, Human
acaugcuuaguaaacaagcacu

SEQ ID NO: 151135 - RNA, 22 nt, Human
acauuuuaaaaauccaccccuc

SEQ ID NO: 151136 - RNA, 19 nt, Human
accaaauggcuaccaacaa

SEQ ID NO: 151137 - RNA, 19 nt, Human
acuacagcccacucauuca

SEQ ID NO: 151138 - RNA, 23 nt, Human
acugugcugugaauuguauuugc

SEQ ID NO: 151139 - RNA, 25 nt, Human
acuugcaccaaaaaucccacccccc

SEQ ID NO: 151140 - RNA, 21 nt, Human
agacaaugcaaacacagucac

SEQ ID NO: 151141 - RNA, 23 nt, Human
agacauuugcauugcuuagaaca

SEQ ID NO: 151142 - RNA, 18 nt, Human
agagcaagccugccacug

SEQ ID NO: 151143 - RNA, 19 nt, Human
agcaagaagagaaugaguu

SEQ ID NO: 151144 - RNA, 19 nt, Human
aggaggcgggcugugcgcu

SEQ ID NO: 151145 - RNA, 23 nt, Human
aggggcuacacaauuauaccaga

SEQ ID NO: 151146 - RNA, 25 nt, Human
auaagaagaaccuucucugucuuau

SEQ ID NO: 151147 - RNA, 19 nt, Human
auaggggccacugccuaca

SEQ ID NO: 151148 - RNA, 22 nt, Human
aucauaaacuacagagcuguaa

SEQ ID NO: 151149 - RNA, 28 nt, Human
auccaccccuccccagcccacccuccag

SEQ ID NO: 151150 - RNA, 25 nt, Human
aucccaccccccucccucgccccuu

SEQ ID NO: 151151 - RNA, 20 nt, Human
aucuccagcagcagcuggug

SEQ ID NO: 151152 - RNA, 18 nt, Human
auuuugucauccuucccu

SEQ ID NO: 151153 - RNA, 21 nt, Human
caaaauaagaagaaccuucuc

SEQ ID NO: 151154 - RNA, 23 nt, Human
caacagccacaaaaugugcaaaa

SEQ ID NO: 151155 - RNA, 20 nt, Human
caacugaguucuagcgacgg

SEQ ID NO: 151156 - RNA, 23 nt, Human
caagcucuguccucagagagagg

SEQ ID NO: 151157 - RNA, 25 nt, Human
cacaaagaaaaaaacuguaaagcaa

SEQ ID NO: 151158 - RNA, 24 nt, Human
cacaaccaaaccccaugaaauccc

SEQ ID NO: 151159 - RNA, 25 nt, Human
cacaaccaaaccccaugaaauccca

SEQ ID NO: 151160 - RNA, 19 nt, Human
caccaaaaaucccaccccc

SEQ ID NO: 151161 - RNA, 22 nt, Human
caccaaaaaucccaccccccuc

SEQ ID NO: 151162 - RNA, 22 nt, Human
cacgggcaaggaggcgacgaac

SEQ ID NO: 151163 - RNA, 21 nt, Human
cacuaauaccuacgacggcac

SEQ ID NO: 151164 - RNA, 24 nt, Human
cagaaagcagccuccccuuacccu

SEQ ID NO: 151165 - RNA, 19 nt, Human
cagaaaguucccuacaggc

SEQ ID NO: 151166 - RNA, 23 nt, Human
cagcagcagcugguguggaggcu

SEQ ID NO: 151167 - RNA, 22 nt, Human
cagcagcugguguggaggcuuc

SEQ ID NO: 151168 - RNA, 20 nt, Human
cagcccagggaagcgguggc

SEQ ID NO: 151169 - RNA, 20 nt, Human
caggacccgcagagcgucuc

SEQ ID NO: 151170 - RNA, 21 nt, Human
caggacccgcagagcgucucc

SEQ ID NO: 151171 - RNA, 22 nt, Human
cauggcauggacggacaaacac

SEQ ID NO: 151172 - RNA, 19 nt, Human
cauguccaguuagagcauu

SEQ ID NO: 151173 - RNA, 25 nt, Human
cauucacacacguccauacaugugg

SEQ ID NO: 151174 - RNA, 22 nt, Human
cauuuugucauccuucccuguc

SEQ ID NO: 151175 - RNA, 21 nt, Human
ccaaaaaucccaccccccucc

SEQ ID NO: 151176 - RNA, 23 nt, Human
ccaaaugccuauaucgauucaaa

SEQ ID NO: 151177 - RNA, 21 nt, Human
ccaaauggcuaccaacaaagu

SEQ ID NO: 151178 - RNA, 22 nt, Human
ccaagggaaaguuuaaagucac

SEQ ID NO: 151179 - RNA, 24 nt, Human
ccacccuccaguuaugcuccaaau

SEQ ID NO: 151180 - RNA, 21 nt, Human
ccagcccagccagcuucccuc

SEQ ID NO: 151181 - RNA, 21 nt, Human
ccauggaaaucaaaugcugaa

SEQ ID NO: 151182 - RNA, 24 nt, Human
cccaaagaaaaggggcuacacaau

SEQ ID NO: 151183 - RNA, 22 nt, Human
cccagccagcuucccucucgga

SEQ ID NO: 151184 - RNA, 21 nt, Human
cccagggaagcgguggcgaau

SEQ ID NO: 151185 - RNA, 22 nt, Human
ccccgaacgauggcucgcggac

SEQ ID NO: 151186 - RNA, 24 nt, Human
cccuccccagcccacccuccaguu

SEQ ID NO: 151187 - RNA, 24 nt, Human
cccucucggacccacaguugggcu

SEQ ID NO: 151188 - RNA, 22 nt, Human
cccugcaccucaggggaagcac

SEQ ID NO: 151189 - RNA, 19 nt, Human
ccuccccagcccacccucc

SEQ ID NO: 151190 - RNA, 23 nt, Human
ccugucuugacauuuuaaaaauc

SEQ ID NO: 151191 - RNA, 24 nt, Human
ccuuacccuaucagcacaaccaaa

SEQ ID NO: 151192 - RNA, 24 nt, Human
cgccccgaacgauggcucgcggac

SEQ ID NO: 151193 - RNA, 19 nt, Human
cuaaaauacagcaauguga

SEQ ID NO: 151194 - RNA, 21 nt, Human
cuggccgcaacgcacaacuga

SEQ ID NO: 151195 - RNA, 18 nt, Human
cuuacccuaucagcacaa

SEQ ID NO: 151196 - RNA, 22 nt, Human
cuucauguccaguuagagcauu

SEQ ID NO: 151197 - RNA, 20 nt, Human
gaaaaaaaaaaaaauaacag

SEQ ID NO: 151198 - RNA, 18 nt, Human
gaaaaaaacuguaaagca

SEQ ID NO: 151199 - RNA, 21 nt, Human
gaacacaucuaggaaccaggg

SEQ ID NO: 151200 - RNA, 19 nt, Human
gaaugccccggagaaagga

SEQ ID NO: 151201 - RNA, 20 nt, Human
gagaaacauggacgaaagca

SEQ ID NO: 151202 - RNA, 20 nt, Human
gagcagaccccuuagagauu

SEQ ID NO: 151203 - RNA, 22 nt, Human
gaggcuucaagcucuguccuca

SEQ ID NO: 151204 - RNA, 21 nt, Human
gaguggggagaagggcagaaa

SEQ ID NO: 151205 - RNA, 24 nt, Human
gaguugcaaacuuuggucuucccc

SEQ ID NO: 151206 - RNA, 23 nt, Human
gcaaagcauucuuaggguaauaa

SEQ ID NO: 151207 - RNA, 21 nt, Human
gcagaaagcagccuccccuua

SEQ ID NO: 151208 - RNA, 23 nt, Human
gccaagggaaaguuuaaagucac

SEQ ID NO: 151209 - RNA, 20 nt, Human
gccagccggggagaggacug

SEQ ID NO: 151210 - RNA, 18 nt, Human
gcgcucgggggagggagc

SEQ ID NO: 151211 - RNA, 18 nt, Human
gcuucaagcucuguccuc

SEQ ID NO: 151212 - RNA, 20 nt, Human
ggaaaacuucucaauagggg

SEQ ID NO: 151213 - RNA, 21 nt, Human
ggaagcaccuauuugagacua

SEQ ID NO: 151214 - RNA, 26 nt, Human
ggacggacaaacacaauuagucuaaa

SEQ ID NO: 151215 - RNA, 21 nt, Human
ggagcuagaaagcgccuugug

SEQ ID NO: 151216 - RNA, 20 nt, Human
ggcagaaagcagccuccccu

SEQ ID NO: 151217 - RNA, 19 nt, Human
ggcuucaagcucuguccuc

SEQ ID NO: 151218 - RNA, 20 nt, Human
gguacagcaagggaaaaggu

SEQ ID NO: 151219 - RNA, 25 nt, Human
gugcagcagauuuuauucgagucuu

SEQ ID NO: 151220 - RNA, 19 nt, Human
uaaaaauccaccccucccc

SEQ ID NO: 151221 - RNA, 24 nt, Human
uaaaauacagcaaugugagaaaca

SEQ ID NO: 151222 - RNA, 25 nt, Human
uaaauaaauaaauaaacuuuggaca

SEQ ID NO: 151223 - RNA, 24 nt, Human
uaacugcuacaauauaaacgacac

SEQ ID NO: 151224 - RNA, 18 nt, Human
uaagaagaaccuucucug

SEQ ID NO: 151225 - RNA, 26 nt, Human
uacagcaaccagcccacaaaauaaga

SEQ ID NO: 151226 - RNA, 19 nt, Human
uacccuaucagcacaacca

SEQ ID NO: 151227 - RNA, 23 nt, Human
uagacaaugcaaacacagucaca

SEQ ID NO: 151228 - RNA, 20 nt, Human
uaugaacaugaacauuuucc

SEQ ID NO: 151229 - RNA, 19 nt, Human
ucacaauguaaaagguugu

SEQ ID NO: 151230 - RNA, 22 nt, Human
ucagagagaggugacaaccauu

SEQ ID NO: 151231 - RNA, 22 nt, Human
ucagcacaaccaaaccccauga

SEQ ID NO: 151232 - RNA, 25 nt, Human
ucaggggaagcaccuauuugagacu

SEQ ID NO: 151233 - RNA, 24 nt, Human
ucauuuauuuaggcccaacuacag

SEQ ID NO: 151234 - RNA, 26 nt, Human
uccacaauuacaagacaaggacuaga

SEQ ID NO: 151235 - RNA, 19 nt, Human
uccacgguuucucuaccuc

SEQ ID NO: 151236 - RNA, 22 nt, Human
ucccaccccccucccucgcccc

SEQ ID NO: 151237 - RNA, 27 nt, Human
ucccaccccccucccucgccccuuucc

SEQ ID NO: 151238 - RNA, 18 nt, Human
ucccucgccccuuuccuu

SEQ ID NO: 151239 - RNA, 20 nt, Human
uccuggggagcagaccccuu

SEQ ID NO: 151240 - RNA, 19 nt, Human
uccuuuuuuucucuucauu

SEQ ID NO: 151241 - RNA, 22 nt, Human
ucuaauaauuuauugaccuuca

SEQ ID NO: 151242 - RNA, 21 nt, Human
ucuacacauaaaugguggggc

SEQ ID NO: 151243 - RNA, 21 nt, Human
ucucaauaggggccacugccu

SEQ ID NO: 151244 - RNA, 19 nt, Human
ucuccagcagcagcuggug

SEQ ID NO: 151245 - RNA, 19 nt, Human
ucuggaccgggucuccgca

SEQ ID NO: 151246 - RNA, 21 nt, Human
ugaacaugaacauuuuccuuu

SEQ ID NO: 151247 - RNA, 20 nt, Human
ugaaguauacauugugccaa

SEQ ID NO: 151248 - RNA, 23 nt, Human
ugaauuaaguaaaucagauggga

SEQ ID NO: 151249 - RNA, 19 nt, Human
ugagaaacauggacgaaag

SEQ ID NO: 151250 - RNA, 24 nt, Human
ugaguuaauuuacaucugugauac

SEQ ID NO: 151251 - RNA, 21 nt, Human
ugcaccaaaaaucccaccccc

SEQ ID NO: 151252 - RNA, 23 nt, Human
ugcaggcgccgcggaaggaggcg

SEQ ID NO: 151253 - RNA, 21 nt, Human
ugcuacgggugagcacugaag

SEQ ID NO: 151254 - RNA, 20 nt, Human
ugggaguggggagaagggca

SEQ ID NO: 151255 - RNA, 24 nt, Human
ugggaguggggagaagggcagaaa

SEQ ID NO: 151256 - RNA, 18 nt, Human
ugucauccuucccugucu

SEQ ID NO: 151257 - RNA, 26 nt, Human
uguggccaaauguguuacuugugcac

SEQ ID NO: 151258 - RNA, 27 nt, Human
uguggccaaauguguuacuugugcacc

SEQ ID NO: 151259 - RNA, 24 nt, Human
uuagacauuugcauugcuuagaac

SEQ ID NO: 151260 - RNA, 23 nt, Human
uucaguuucacauugugaaaaaa

SEQ ID NO: 151261 - RNA, 24 nt, Human
uucauucauauuuaaaccaugugc

SEQ ID NO: 151262 - RNA, 20 nt, Human
uuccauagaauuuuccagga

SEQ ID NO: 151263 - RNA, 18 nt, Human
uuuccauuuugucauccu

SEQ ID NO: 151264 - RNA, 18 nt, Human
uuugaaucuccagcagca

SEQ ID NO: 151265 - RNA, 21 nt, Human
cacacacccacagucucacug

SEQ ID NO: 151266 - RNA, 27 nt, Human
ccaaaaaucaccaccuuuaauacuccc

SEQ ID NO: 151267 - RNA, 20 nt, Human
ccaacgagggcacagggcug

SEQ ID NO: 151268 - RNA, 24 nt, Human
ccacucacaaacacugccaagggc

SEQ ID NO: 151269 - RNA, 19 nt, Human
ccccggccugcacacaccc

SEQ ID NO: 151270 - RNA, 25 nt, Human
ccgcgucgcgggauccaacgagggc

SEQ ID NO: 151271 - RNA, 22 nt, Human
ccucggaacccagccucgugcc

SEQ ID NO: 151272 - RNA, 23 nt, Human
cggacgauagcgugaccucccuu

SEQ ID NO: 151273 - RNA, 19 nt, Human
cuuccacucacaaacacug

SEQ ID NO: 151274 - RNA, 18 nt, Human
ugcacacacccacagucu

SEQ ID NO: 151275 - RNA, 19 nt, Human
ugccaagggcuugggccuc

SEQ ID NO: 151276 - RNA, 19 nt, Human
ugcuggggccgcggacgau

SEQ ID NO: 151277 - RNA, 23 nt, Human
aaaaacuuuuuaaaaagcaaaaa

SEQ ID NO: 151278 - RNA, 22 nt, Human
aaaaagcaaaaagcaaagccac

SEQ ID NO: 151279 - RNA, 22 nt, Human
aaaacuuuuuaaaaagcaaaaa

SEQ ID NO: 151280 - RNA, 23 nt, Human
aaagagaaaaacuuuuuaaaaag

SEQ ID NO: 151281 - RNA, 19 nt, Human
aagcaaaaagcaaagccac

SEQ ID NO: 151282 - RNA, 22 nt, Human
aagcaaaaagcaaagccacuaa

SEQ ID NO: 151283 - RNA, 19 nt, Human
acacggcgagaccacaucu

SEQ ID NO: 151284 - RNA, 20 nt, Human
acacggcgagaccacaucuc

SEQ ID NO: 151285 - RNA, 21 nt, Human
acacggcgagaccacaucucu

SEQ ID NO: 151286 - RNA, 18 nt, Human
accaccgcacuccagccu

SEQ ID NO: 151287 - RNA, 18 nt, Human
accgcacuccagccugga

SEQ ID NO: 151288 - RNA, 25 nt, Human
accgcacuccagccuggaugacacg

SEQ ID NO: 151289 - RNA, 23 nt, Human
agcugagggugauggugugugcc

SEQ ID NO: 151290 - RNA, 18 nt, Human
aggauugcuuaagcccag

SEQ ID NO: 151291 - RNA, 19 nt, Human
aggcaggaggauugcuuaa

SEQ ID NO: 151292 - RNA, 23 nt, Human
aggcaggaggauugcuuaagccc

SEQ ID NO: 151293 - RNA, 24 nt, Human
aggcaggaggauugcuuaagccca

SEQ ID NO: 151294 - RNA, 24 nt, Human
caccgcacuccagccuggaugaca

SEQ ID NO: 151295 - RNA, 23 nt, Human
cacuccagccuggaugacacggc

SEQ ID NO: 151296 - RNA, 18 nt, Human
cagaaguuugaggcuaua

SEQ ID NO: 151297 - RNA, 19 nt, Human
ccaccgcacuccagccugg

SEQ ID NO: 151298 - RNA, 20 nt, Human
ccaccgcacuccagccugga

SEQ ID NO: 151299 - RNA, 21 nt, Human
ccaccgcacuccagccuggau

SEQ ID NO: 151300 - RNA, 23 nt, Human
ccaccgcacuccagccuggauga

SEQ ID NO: 151301 - RNA, 19 nt, Human
ccuguagucccagcugcuc

SEQ ID NO: 151302 - RNA, 21 nt, Human
ccuguagucccagcugcucag

SEQ ID NO: 151303 - RNA, 19 nt, Human
gacacggcgagaccacauc

SEQ ID NO: 151304 - RNA, 22 nt, Human
ggcagaggcaggaggauugcuu

SEQ ID NO: 151305 - RNA, 23 nt, Human
ggugauggugugugccuguaguc

SEQ ID NO: 151306 - RNA, 28 nt, Human
uaaaaagcaaaaagcaaagccacuaaaa

SEQ ID NO: 151307 - RNA, 23 nt, Human
uagcugagggugauggugugugc

SEQ ID NO: 151308 - RNA, 25 nt, Human
uccaccaccgcacuccagccuggau

SEQ ID NO: 151309 - RNA, 24 nt, Human
uccagccuggaugacacggcgaga

SEQ ID NO: 151310 - RNA, 22 nt, Human
ugacacggcgagaccacaucuc

SEQ ID NO: 151311 - RNA, 24 nt, Human
ugauggugugugccuguaguccca

SEQ ID NO: 151312 - RNA, 22 nt, Human
ugauuccaccaccgcacuccag

SEQ ID NO: 151313 - RNA, 24 nt, Human
ugccuguagucccagcugcucagg

SEQ ID NO: 151314 - RNA, 25 nt, Human
ugccuguagucccagcugcucaggg

SEQ ID NO: 151315 - RNA, 22 nt, Human
uggaugacacggcgagaccaca

SEQ ID NO: 151316 - RNA, 18 nt, Human
uggugugugccuguaguc

SEQ ID NO: 151317 - RNA, 24 nt, Human
uggugugugccuguagucccagcu

SEQ ID NO: 151318 - RNA, 23 nt, Human
ugugccuguagucccagcugcuc

SEQ ID NO: 151319 - RNA, 24 nt, Human
uugcuuaagcccagaaguuugagg

SEQ ID NO: 151320 - RNA, 21 nt, Human
aaucuguuucaaguucucccu

SEQ ID NO: 151321 - RNA, 18 nt, Human
acgcggggcugggcugga

SEQ ID NO: 151322 - RNA, 21 nt, Human
acuguucuugccacccucugg

SEQ ID NO: 151323 - RNA, 23 nt, Human
agagcaggcuccauucugggucg

SEQ ID NO: 151324 - RNA, 19 nt, Human
agagggaggcgggaagggu

SEQ ID NO: 151325 - RNA, 20 nt, Human
agauccagguggcucugggc

SEQ ID NO: 151326 - RNA, 18 nt, Human
agcgggagcgggggcagg

SEQ ID NO: 151327 - RNA, 19 nt, Human
agcuaggcucccaacgccc

SEQ ID NO: 151328 - RNA, 21 nt, Human
agcuuggcuacucccccucug

SEQ ID NO: 151329 - RNA, 21 nt, Human
aggcccaggacaagcagcuug

SEQ ID NO: 151330 - RNA, 19 nt, Human
aggcggccggagcgacggc

SEQ ID NO: 151331 - RNA, 22 nt, Human
aggcuccugucuccccugccag

SEQ ID NO: 151332 - RNA, 19 nt, Human
aggcugggcuccgcuaggc

SEQ ID NO: 151333 - RNA, 26 nt, Human
agggaccccaagguguuccaagccag

SEQ ID NO: 151334 - RNA, 20 nt, Human
agggaggcgggaaggguagg

SEQ ID NO: 151335 - RNA, 22 nt, Human
aggggcaggcccaggacaagca

SEQ ID NO: 151336 - RNA, 22 nt, Human
agggggcuccauguggcaggag

SEQ ID NO: 151337 - RNA, 21 nt, Human
agguguggaggccgcagggau

SEQ ID NO: 151338 - RNA, 23 nt, Human
aguggaggacuggcucccagggu

SEQ ID NO: 151339 - RNA, 24 nt, Human
aguggcagggcugcgggcgggcac

SEQ ID NO: 151340 - RNA, 22 nt, Human
aguggucugucuccugggcagc

SEQ ID NO: 151341 - RNA, 22 nt, Human
augacagggacuuggguuuuua

SEQ ID NO: 151342 - RNA, 19 nt, Human
caaguucucccuuccugcc

SEQ ID NO: 151343 - RNA, 21 nt, Human
cacccucugggcucccaggcu

SEQ ID NO: 151344 - RNA, 19 nt, Human
cacugggcucccccgggug

SEQ ID NO: 151345 - RNA, 24 nt, Human
cacuguucuugccacccucugggc

SEQ ID NO: 151346 - RNA, 21 nt, Human
cagagggggcuccauguggca

SEQ ID NO: 151347 - RNA, 25 nt, Human
cagccaccgccaccacgggcucccg

SEQ ID NO: 151348 - RNA, 25 nt, Human
cagcguggcaaguggucugucuccu

SEQ ID NO: 151349 - RNA, 18 nt, Human
caggacaagcagcuuggc

SEQ ID NO: 151350 - RNA, 18 nt, Human
cagggcugcgggcgggca

SEQ ID NO: 151351 - RNA, 19 nt, Human
cagucucuccugcugggcg

SEQ ID NO: 151352 - RNA, 22 nt, Human
ccaccgccaccacgggcucccg

SEQ ID NO: 151353 - RNA, 23 nt, Human
ccacgggcucccgcuugcugggg

SEQ ID NO: 151354 - RNA, 22 nt, Human
ccagguggcucugggcugggcc

SEQ ID NO: 151355 - RNA, 18 nt, Human
ccagugcuggauccaggu

SEQ ID NO: 151356 - RNA, 23 nt, Human
cccagacccacuggguugaaggu

SEQ ID NO: 151357 - RNA, 19 nt, Human
cccccucugcuggcugccc

SEQ ID NO: 151358 - RNA, 22 nt, Human
ccgaugcugugguuggugcugc

SEQ ID NO: 151359 - RNA, 19 nt, Human
ccucugagagggaggcggg

SEQ ID NO: 151360 - RNA, 18 nt, Human
cgaugcugugguuggugc

SEQ ID NO: 151361 - RNA, 23 nt, Human
cgccaccacgggcucccgcuugc

SEQ ID NO: 151362 - RNA, 21 nt, Human
cgcccacuguucuugccaccc

SEQ ID NO: 151363 - RNA, 19 nt, Human
cggcugcucagucucuccu

SEQ ID NO: 151364 - RNA, 19 nt, Human
cggggagggggugcugggc

SEQ ID NO: 151365 - RNA, 22 nt, Human
cguggcaaguggucugucuccu

SEQ ID NO: 151366 - RNA, 18 nt, Human
cucccagcuggcggcugc

SEQ ID NO: 151367 - RNA, 21 nt, Human
cucccccucugcuggcugccc

SEQ ID NO: 151368 - RNA, 22 nt, Human
cucccccucugcuggcugcccg

SEQ ID NO: 151369 - RNA, 22 nt, Human
cucccgcuugcugggggaaccu

SEQ ID NO: 151370 - RNA, 25 nt, Human
cucugggcugggcccucuucucuuc

SEQ ID NO: 151371 - RNA, 23 nt, Human
cugcccagcucaguucaccagug

SEQ ID NO: 151372 - RNA, 20 nt, Human
cuggaguugcuguccgaagg

SEQ ID NO: 151373 - RNA, 19 nt, Human
cugggcccucuucucuucc

SEQ ID NO: 151374 - RNA, 20 nt, Human
cugggggaaccugggagcgg

SEQ ID NO: 151375 - RNA, 18 nt, Human
cuggguugaagguucugg

SEQ ID NO: 151376 - RNA, 20 nt, Human
cugugcgcugggccuuaucc

SEQ ID NO: 151377 - RNA, 19 nt, Human
cuguguccaguggcagggc

SEQ ID NO: 151378 - RNA, 22 nt, Human
gagcucccggcucauccagccc

SEQ ID NO: 151379 - RNA, 22 nt, Human
gcagcaguccuggccccagggc

SEQ ID NO: 151380 - RNA, 19 nt, Human
gcaggagcuaggcucccaa

SEQ ID NO: 151381 - RNA, 18 nt, Human
gcggagagcaggcuccau

SEQ ID NO: 151382 - RNA, 22 nt, Human
gcggcugcucagucucuccugc

SEQ ID NO: 151383 - RNA, 21 nt, Human
gcuaugccaugcugcuggugg

SEQ ID NO: 151384 - RNA, 21 nt, Human
gcucccagcuggcggcugcuc

SEQ ID NO: 151385 - RNA, 18 nt, Human
gcucccagggugaguuca

SEQ ID NO: 151386 - RNA, 20 nt, Human
gcuccugucuccccugccag

SEQ ID NO: 151387 - RNA, 19 nt, Human
gcugcugcucuccgaggag

SEQ ID NO: 151388 - RNA, 21 nt, Human
ggaaccugggagcgggagcgg

SEQ ID NO: 151389 - RNA, 24 nt, Human
ggaaccugggagcgggagcggggg

SEQ ID NO: 151390 - RNA, 18 nt, Human
ggagagcaggcuccauuc

SEQ ID NO: 151391 - RNA, 18 nt, Human
ggagcagggggugcucug

SEQ ID NO: 151392 - RNA, 19 nt, Human
ggaggacuggcucccaggg

SEQ ID NO: 151393 - RNA, 24 nt, Human
ggagggggugcugggcuccaaugg

SEQ ID NO: 151394 - RNA, 21 nt, Human
ggcggggagggggugcugggc

SEQ ID NO: 151395 - RNA, 22 nt, Human
ggcuacucccccucugcuggcu

SEQ ID NO: 151396 - RNA, 21 nt, Human
gggagcgggagcgggggcagg

SEQ ID NO: 151397 - RNA, 18 nt, Human
gggcggaggucagggucc

SEQ ID NO: 151398 - RNA, 22 nt, Human
gggcggggagggggugcugggc

SEQ ID NO: 151399 - RNA, 18 nt, Human
ggggagggggugcugggc

SEQ ID NO: 151400 - RNA, 21 nt, Human
ggucgaguggaggacuggcuc

SEQ ID NO: 151401 - RNA, 19 nt, Human
guccaguggcagggcugcg

SEQ ID NO: 151402 - RNA, 24 nt, Human
guggagggaccccaagguguucca

SEQ ID NO: 151403 - RNA, 19 nt, Human
guggcucugggcugggccc

SEQ ID NO: 151404 - RNA, 18 nt, Human
guguuccaagccaguggc

SEQ ID NO: 151405 - RNA, 22 nt, Human
uaugaccggcagcagggagcuc

SEQ ID NO: 151406 - RNA, 19 nt, Human
ucaggagaaguggacacag

SEQ ID NO: 151407 - RNA, 18 nt, Human
uccaguggcagggcugcg

SEQ ID NO: 151408 - RNA, 20 nt, Human
uccauucugggucgagugga

SEQ ID NO: 151409 - RNA, 19 nt, Human
ucccaacgcccacuguucu

SEQ ID NO: 151410 - RNA, 22 nt, Human
ucccucagaggcuucacugggc

SEQ ID NO: 151411 - RNA, 25 nt, Human
ucccucagaggcuucacugggcucc

SEQ ID NO: 151412 - RNA, 24 nt, Human
uccugggcagccauaucccagacc

SEQ ID NO: 151413 - RNA, 23 nt, Human
ucuccgaggaggccggggcagcc

SEQ ID NO: 151414 - RNA, 18 nt, Human
ucuguuucaaguucuccc

SEQ ID NO: 151415 - RNA, 20 nt, Human
ugaccggcagcagggagcuc

SEQ ID NO: 151416 - RNA, 19 nt, Human
ugccagggccccucaaucc

SEQ ID NO: 151417 - RNA, 18 nt, Human
ugcgcugggccuuauccu

SEQ ID NO: 151418 - RNA, 18 nt, Human
ugcuccagccuucugggg

SEQ ID NO: 151419 - RNA, 23 nt, Human
ugcugcucuccgaggaggccggg

SEQ ID NO: 151420 - RNA, 20 nt, Human
ugcugcugguggagcagggg

SEQ ID NO: 151421 - RNA, 21 nt, Human
ugcugcugguggagcaggggg

SEQ ID NO: 151422 - RNA, 18 nt, Human
ugcugggcgagcgcgggg

SEQ ID NO: 151423 - RNA, 19 nt, Human
ugcugugguuggugcugcu

SEQ ID NO: 151424 - RNA, 20 nt, Human
uggaguugcuguccgaagga

SEQ ID NO: 151425 - RNA, 23 nt, Human
uggauggcagugacagcagcagu

SEQ ID NO: 151426 - RNA, 23 nt, Human
uggcagggcugcgggcgggcacc

SEQ ID NO: 151427 - RNA, 23 nt, Human
uggcagugacagcagcaguccug

SEQ ID NO: 151428 - RNA, 23 nt, Human
uggcggcugcucagucucuccug

SEQ ID NO: 151429 - RNA, 19 nt, Human
uggcuacucccccucugcu

SEQ ID NO: 151430 - RNA, 18 nt, Human
uggcucugggcugggccc

SEQ ID NO: 151431 - RNA, 19 nt, Human
uggcucugggcugggcccu

SEQ ID NO: 151432 - RNA, 21 nt, Human
uggcugggcuggccugaaucu

SEQ ID NO: 151433 - RNA, 25 nt, Human
ugggcggggagggggugcugggcuc

SEQ ID NO: 151434 - RNA, 21 nt, Human
ugggggccugugcgcugggcc

SEQ ID NO: 151435 - RNA, 19 nt, Human
uggucugucuccugggcag

SEQ ID NO: 151436 - RNA, 22 nt, Human
uggugaauacacaggggcaggc

SEQ ID NO: 151437 - RNA, 22 nt, Human
ugguggugaauacacaggggca

SEQ ID NO: 151438 - RNA, 19 nt, Human
uuauccuguguccaguggc

SEQ ID NO: 151439 - RNA, 19 nt, Human
uugcuguccgaaggauggg

SEQ ID NO: 151440 - RNA, 24 nt, Human
uuucauggucugauuuauuggugg

SEQ ID NO: 151441 - RNA, 25 nt, Human
uuuuuuuucagguuucauggucuga

SEQ ID NO: 151442 - RNA, 21 nt, Human
uuuuuuuuuuuuucagguuuc

SEQ ID NO: 151443 - RNA, 18 nt, Human
augcagggccacgacucc

SEQ ID NO: 151444 - RNA, 19 nt, Human
caccgcggcagcugugggc

SEQ ID NO: 151445 - RNA, 21 nt, Human
cagggcccagggagccccagg

SEQ ID NO: 151446 - RNA, 24 nt, Human
cccaggcucgggccaggagccagg

SEQ ID NO: 151447 - RNA, 21 nt, Human
ccccaggcucgggccaggagc

SEQ ID NO: 151448 - RNA, 23 nt, Human
ccccaggcucgggccaggagcca

SEQ ID NO: 151449 - RNA, 20 nt, Human
ccugcuuggcccggccaggg

SEQ ID NO: 151450 - RNA, 24 nt, Human
gaggauaagguggguggggcaggg

SEQ ID NO: 151451 - RNA, 18 nt, Human
gcgcugcucugcgucggg

SEQ ID NO: 151452 - RNA, 20 nt, Human
ggccacgacuccaggccccu

SEQ ID NO: 151453 - RNA, 25 nt, Human
ggccagcaccggugugcuguggugg

SEQ ID NO: 151454 - RNA, 24 nt, Human
gugguggagggaguggggugggag

SEQ ID NO: 151455 - RNA, 19 nt, Human
uaaggcaaccauugccagc

SEQ ID NO: 151456 - RNA, 19 nt, Human
ugccagcccuacccagaaa

SEQ ID NO: 151457 - RNA, 20 nt, Human
ugccagcccuacccagaaau

SEQ ID NO: 151458 - RNA, 18 nt, Human
ugcuguggugguggaggg

SEQ ID NO: 151459 - RNA, 20 nt, Human
ugcuguggugguggagggag

SEQ ID NO: 151460 - RNA, 20 nt, Human
ugggaggauaaggugggugg

SEQ ID NO: 151461 - RNA, 23 nt, Human
uggggcagggcccagggagcccc

SEQ ID NO: 151462 - RNA, 24 nt, Human
uggggugggaggauaaggugggug

SEQ ID NO: 151463 - RNA, 25 nt, Human
uggggugggaggauaaggugggugg

SEQ ID NO: 151464 - RNA, 21 nt, Human
uggguggggcagggcccaggg

SEQ ID NO: 151465 - RNA, 22 nt, Human
uggguggggcagggcccaggga

SEQ ID NO: 151466 - RNA, 20 nt, Human
ugguggagggaguggggugg

SEQ ID NO: 151467 - RNA, 18 nt, Human
ugguguggccagcaccgg

SEQ ID NO: 151468 - RNA, 18 nt, Human
uguggugguggagggagu

SEQ ID NO: 151469 - RNA, 21 nt, Human
uguggugguggagggaguggg

SEQ ID NO: 151470 - RNA, 19 nt, Human
cacagauacuguccgcgcc

SEQ ID NO: 151471 - RNA, 23 nt, Human
cagacaccgaggugaacguaaag

SEQ ID NO: 151472 - RNA, 21 nt, Human
cccacagauacuguccgcgcc

SEQ ID NO: 151473 - RNA, 21 nt, Human
ccgcccgcgccgacuuccugc

SEQ ID NO: 151474 - RNA, 22 nt, Human
ccggguacccacagauacuguc

SEQ ID NO: 151475 - RNA, 21 nt, Human
cgaagggcuugccugcccaca

SEQ ID NO: 151476 - RNA, 21 nt, Human
cugacacgaggggaggggucu

SEQ ID NO: 151477 - RNA, 20 nt, Human
gaagcggagggugcugcaga

SEQ ID NO: 151478 - RNA, 18 nt, Human
gagcugccugagcugaca

SEQ ID NO: 151479 - RNA, 24 nt, Human
uaaggaagcgguacgaacuccacg

SEQ ID NO: 151480 - RNA, 21 nt, Human
uacuguccgcgccgcccgcgc

SEQ ID NO: 151481 - RNA, 24 nt, Human
uagccuguggccaccccggagaug

SEQ ID NO: 151482 - RNA, 25 nt, Human
uagccuguggccaccccggagauga

SEQ ID NO: 151483 - RNA, 23 nt, Human
ucacaugacucuagacacuuggu

SEQ ID NO: 151484 - RNA, 18 nt, Human
ucgggggccucgagcucc

SEQ ID NO: 151485 - RNA, 18 nt, Human
ucuagacacuugguggaa

SEQ ID NO: 151486 - RNA, 24 nt, Human
ugacacgaggggaggggucugugu

SEQ ID NO: 151487 - RNA, 24 nt, Human
ugacuugggccaauuacacgacug

SEQ ID NO: 151488 - RNA, 19 nt, Human
ugagcugacacgaggggag

SEQ ID NO: 151489 - RNA, 24 nt, Human
ugaggcgagaaaaacaaugacuug

SEQ ID NO: 151490 - RNA, 20 nt, Human
uggccaccccggagaugacc

SEQ ID NO: 151491 - RNA, 31 nt, Human
aaaacucccccaggcacacagccuccgcucu

SEQ ID NO: 151492 - RNA, 21 nt, Human
aagagcaaagcacaagugaca

SEQ ID NO: 151493 - RNA, 19 nt, Human
aagcacaagugacacaugg

SEQ ID NO: 151494 - RNA, 19 nt, Human
aagccaaggagcagcggag

SEQ ID NO: 151495 - RNA, 23 nt, Human
aaggaagaaguggaaagugcgga

SEQ ID NO: 151496 - RNA, 20 nt, Human
aagugacacauggucccucu

SEQ ID NO: 151497 - RNA, 22 nt, Human
aaugaguagggcacagaaagga

SEQ ID NO: 151498 - RNA, 18 nt, Human
acagaaaggagggcgagc

SEQ ID NO: 151499 - RNA, 20 nt, Human
accaacccugacgcucccau

SEQ ID NO: 151500 - RNA, 23 nt, Human
accaacccugacgcucccaucac

SEQ ID NO: 151501 - RNA, 18 nt, Human
accucagcacaccaaccc

SEQ ID NO: 151502 - RNA, 19 nt, Human
agacagcaagaggucaggu

SEQ ID NO: 151503 - RNA, 20 nt, Human
agagagaaagagaaaggaag

SEQ ID NO: 151504 - RNA, 21 nt, Human
agccaggcgugaucacaugcc

SEQ ID NO: 151505 - RNA, 19 nt, Human
aguggcaguggcggcggcg

SEQ ID NO: 151506 - RNA, 20 nt, Human
aguggcaguggcggcggcgg

SEQ ID NO: 151507 - RNA, 22 nt, Human
aguggcaguggcggcggcggcu

SEQ ID NO: 151508 - RNA, 25 nt, Human
auagaggaaaacucccccaggcaca

SEQ ID NO: 151509 - RNA, 22 nt, Human
caccucagcacaccaacccuga

SEQ ID NO: 151510 - RNA, 20 nt, Human
cacuaaagccuuauuagcca

SEQ ID NO: 151511 - RNA, 20 nt, Human
cagcaagaggucagguaagc

SEQ ID NO: 151512 - RNA, 21 nt, Human
cagcacaccaacccugacgcu

SEQ ID NO: 151513 - RNA, 19 nt, Human
caggagcugccggcggagg

SEQ ID NO: 151514 - RNA, 19 nt, Human
caggcacacagccuccgcu

SEQ ID NO: 151515 - RNA, 25 nt, Human
cauucacauuucuaguuucugaggg

SEQ ID NO: 151516 - RNA, 23 nt, Human
ccccaaugaguagggcacagaaa

SEQ ID NO: 151517 - RNA, 18 nt, Human
ccgggcggcgggcggagg

SEQ ID NO: 151518 - RNA, 20 nt, Human
cucccccaggcacacagccu

SEQ ID NO: 151519 - RNA, 21 nt, Human
gacacaucguucccccaaguc

SEQ ID NO: 151520 - RNA, 18 nt, Human
gagucaggagcugccggc

SEQ ID NO: 151521 - RNA, 20 nt, Human
gcacagaaaggagggcgagc

SEQ ID NO: 151522 - RNA, 21 nt, Human
gcccaacacuccccuccaucc

SEQ ID NO: 151523 - RNA, 22 nt, Human
gcggcggcugcggcucccgggc

SEQ ID NO: 151524 - RNA, 20 nt, Human
gcgguggcgguggcgguggc

SEQ ID NO: 151525 - RNA, 21 nt, Human
ggcgacggcggcgcugagaga

SEQ ID NO: 151526 - RNA, 19 nt, Human
gggaaccuaggguugggga

SEQ ID NO: 151527 - RNA, 23 nt, Human
ggucagguaagccaaggagcagc

SEQ ID NO: 151528 - RNA, 24 nt, Human
guggcaguggcggcggcggcugcg

SEQ ID NO: 151529 - RNA, 20 nt, Human
guggcgguggcgacggcggc

SEQ ID NO: 151530 - RNA, 20 nt, Human
guggcgguggcgguggcgac

SEQ ID NO: 151531 - RNA, 20 nt, Human
guggcgguggcgguggcggu

SEQ ID NO: 151532 - RNA, 20 nt, Human
gugggacaagagcaaagcac

SEQ ID NO: 151533 - RNA, 19 nt, Human
gugguaguggcgguggcgg

SEQ ID NO: 151534 - RNA, 20 nt, Human
gugguaguggcgguggcggu

SEQ ID NO: 151535 - RNA, 26 nt, Human
uaaauacacuaaagccuuauuagcca

SEQ ID NO: 151536 - RNA, 23 nt, Human
uaaugggaugaaugaaaaacaaa

SEQ ID NO: 151537 - RNA, 22 nt, Human
uagcaagaccucccaccccagu

SEQ ID NO: 151538 - RNA, 23 nt, Human
uagggccgcgcgggcgcauguga

SEQ ID NO: 151539 - RNA, 21 nt, Human
uaguggcgguggcgguggcgg

SEQ ID NO: 151540 - RNA, 23 nt, Human
uaugacccuucccauucuagcaa

SEQ ID NO: 151541 - RNA, 24 nt, Human
uaugcacaguucacggcucauaug

SEQ ID NO: 151542 - RNA, 25 nt, Human
ucaaggcccuuucuaugacccuucc

SEQ ID NO: 151543 - RNA, 24 nt, Human
ucagacggugguaguggcgguuuu

SEQ ID NO: 151544 - RNA, 24 nt, Human
ucaggacagcaagguuccaggagg

SEQ ID NO: 151545 - RNA, 24 nt, Human
uccacggacccccuuuuauaauaa

SEQ ID NO: 151546 - RNA, 22 nt, Human
ucccccaggcacacagccuccg

SEQ ID NO: 151547 - RNA, 22 nt, Human
ucuagcaagaccucccacccca

SEQ ID NO: 151548 - RNA, 24 nt, Human
ucuugggaucuacagccacaugaa

SEQ ID NO: 151549 - RNA, 19 nt, Human
ugagagagcgggaguggca

SEQ ID NO: 151550 - RNA, 21 nt, Human
ugagggaagagagaaagagaa

SEQ ID NO: 151551 - RNA, 22 nt, Human
ugaguacacacaaaggaacuga

SEQ ID NO: 151552 - RNA, 20 nt, Human
ugauuaaugggaugaaugaa

SEQ ID NO: 151553 - RNA, 21 nt, Human
ugccacagaggugguggcaac

SEQ ID NO: 151554 - RNA, 18 nt, Human
ugcccaacacuccccucc

SEQ ID NO: 151555 - RNA, 23 nt, Human
ugcccaacacuccccuccauccc

SEQ ID NO: 151556 - RNA, 25 nt, Human
ugcggaaccccaaugaguagggcac

SEQ ID NO: 151557 - RNA, 21 nt, Human
uggcaacuguggaacguggca

SEQ ID NO: 151558 - RNA, 19 nt, Human
uggcaguggcggcggcggc

SEQ ID NO: 151559 - RNA, 21 nt, Human
uggcauggggagugagagguu

SEQ ID NO: 151560 - RNA, 18 nt, Human
uggcggcggcggcugcgg

SEQ ID NO: 151561 - RNA, 23 nt, Human
uggcgguggcgacggcggcgcug

SEQ ID NO: 151562 - RNA, 18 nt, Human
ugggaucuacagccacau

SEQ ID NO: 151563 - RNA, 20 nt, Human
ugggaugaaugaaaaacaaa

SEQ ID NO: 151564 - RNA, 21 nt, Human
ugggaugaaugaaaaacaaau

SEQ ID NO: 151565 - RNA, 23 nt, Human
agaccugggucuguccaguggag

SEQ ID NO: 151566 - RNA, 22 nt, Human
ccccagggcuggaagauucacc

SEQ ID NO: 151567 - RNA, 25 nt, Human
cuaccuccacccccagggcuggaag

SEQ ID NO: 151568 - RNA, 19 nt, Human
uguccaguggaguccugga

SEQ ID NO: 151569 - RNA, 20 nt, Human
aggcaguuuuaggugugguc

SEQ ID NO: 151570 - RNA, 18 nt, Human
aguauuuuggcuucuguu

SEQ ID NO: 151571 - RNA, 24 nt, Human
augggcuaccccaacccuacuaua

SEQ ID NO: 151572 - RNA, 18 nt, Human
caauaguaagaaagauuc

SEQ ID NO: 151573 - RNA, 20 nt, Human
cagcuacuucuccuuuaaga

SEQ ID NO: 151574 - RNA, 22 nt, Human
ccaaucaaaaaauuaaaaagaa

SEQ ID NO: 151575 - RNA, 20 nt, Human
cccgccgggcccucccgggg

SEQ ID NO: 151576 - RNA, 19 nt, Human
cccggggagcgcgcccgcc

SEQ ID NO: 151577 - RNA, 24 nt, Human
ccgaacuugaucaauguauacaau

SEQ ID NO: 151578 - RNA, 26 nt, Human
ccgccccccgcgcagccgucgcgcuc

SEQ ID NO: 151579 - RNA, 19 nt, Human
ccgccgcggcucccgcccc

SEQ ID NO: 151580 - RNA, 21 nt, Human
ccgccgcggcucccgcccccc

SEQ ID NO: 151581 - RNA, 24 nt, Human
cguuccccgccgggcccucccggg

SEQ ID NO: 151582 - RNA, 20 nt, Human
cuaaagaaauccaaucaaaa

SEQ ID NO: 151583 - RNA, 22 nt, Human
cucuccacugcugugcugagua

SEQ ID NO: 151584 - RNA, 20 nt, Human
cuuuaagagaagcagaaagg

SEQ ID NO: 151585 - RNA, 24 nt, Human
gaagcagaaaggcaguuuuaggug

SEQ ID NO: 151586 - RNA, 18 nt, Human
ggccagcaaggacgcggc

SEQ ID NO: 151587 - RNA, 26 nt, Human
ggggccagcaaggacgcggccgccug

SEQ ID NO: 151588 - RNA, 23 nt, Human
uaaaaagaaaacacauaagauua

SEQ ID NO: 151589 - RNA, 20 nt, Human
uaaaagauauccagaaccac

SEQ ID NO: 151590 - RNA, 22 nt, Human
uaacaugggcuaccccaacccu

SEQ ID NO: 151591 - RNA, 19 nt, Human
uaagagaagcagaaaggca

SEQ ID NO: 151592 - RNA, 25 nt, Human
uacaaugaaaagaaaugaaacucca

SEQ ID NO: 151593 - RNA, 23 nt, Human
uaccccaacccuacuauaagucu

SEQ ID NO: 151594 - RNA, 21 nt, Human
ucaaauaucugguauccagac

SEQ ID NO: 151595 - RNA, 21 nt, Human
uccaucguggccccggccgcu

SEQ ID NO: 151596 - RNA, 23 nt, Human
ucgccgccgcggcucccgccccc

SEQ ID NO: 151597 - RNA, 26 nt, Human
ucgcggccguuccccgccgggccccg

SEQ ID NO: 151598 - RNA, 19 nt, Human
ucggcagcguggcugcggc

SEQ ID NO: 151599 - RNA, 24 nt, Human
ugcuuacacauucaaauaugugca

SEQ ID NO: 151600 - RNA, 24 nt, Human
uggucgacaguuucugaacaaugc

SEQ ID NO: 151601 - RNA, 21 nt, Human
acaagcucuacucagaacaca

SEQ ID NO: 151602 - RNA, 21 nt, Human
aguacaggacuaaauguggca

SEQ ID NO: 151603 - RNA, 22 nt, Human
cacaaggcuaccuaaaucaagc

SEQ ID NO: 151604 - RNA, 22 nt, Human
cagaacacaaggcuaccuaaau

SEQ ID NO: 151605 - RNA, 18 nt, Human
caguggagucauucaggc

SEQ ID NO: 151606 - RNA, 23 nt, Human
cuaaaucaagcauuagagaaaaa

SEQ ID NO: 151607 - RNA, 22 nt, Human
cuguacugcagaugcucagaaa

SEQ ID NO: 151608 - RNA, 19 nt, Human
gaagccuuuugcagcgugu

SEQ ID NO: 151609 - RNA, 18 nt, Human
uacugcagaugcucagaa

SEQ ID NO: 151610 - RNA, 24 nt, Human
uagaagcuuccacuuuuucucaag

SEQ ID NO: 151611 - RNA, 28 nt, Human
uauuacaagcucuacucagaacacaagg

SEQ ID NO: 151612 - RNA, 19 nt, Human
aacccuucuccuugcgaag

SEQ ID NO: 151613 - RNA, 22 nt, Human
aacucccaccaccugccuuccc

SEQ ID NO: 151614 - RNA, 18 nt, Human
agcugucggggacuggca

SEQ ID NO: 151615 - RNA, 27 nt, Human
aggggucugguggcccagcaucuccag

SEQ ID NO: 151616 - RNA, 24 nt, Human
aguaucuucuuggagagccaaccc

SEQ ID NO: 151617 - RNA, 23 nt, Human
agugcaauggcgcaaucuuggcu

SEQ ID NO: 151618 - RNA, 24 nt, Human
agugcaauggcgcaaucuuggcuc

SEQ ID NO: 151619 - RNA, 22 nt, Human
caagcgagucuccugccucagc

SEQ ID NO: 151620 - RNA, 20 nt, Human
cacugagccacauggugccc

SEQ ID NO: 151621 - RNA, 21 nt, Human
cacugcaaccucugccucccg

SEQ ID NO: 151622 - RNA, 23 nt, Human
cacugcaaccucugccucccggg

SEQ ID NO: 151623 - RNA, 26 nt, Human
cagccucccaagcccggaauuccuuu

SEQ ID NO: 151624 - RNA, 26 nt, Human
caguggaugugcugguucuaaaacuc

SEQ ID NO: 151625 - RNA, 19 nt, Human
ccacucggggggucagguu

SEQ ID NO: 151626 - RNA, 19 nt, Human
cccaccaccugccuucccu

SEQ ID NO: 151627 - RNA, 21 nt, Human
cccggguucaagcgagucucc

SEQ ID NO: 151628 - RNA, 23 nt, Human
cccggguucaagcgagucuccug

SEQ ID NO: 151629 - RNA, 18 nt, Human
ccgguuuuuuuuuuaagg

SEQ ID NO: 151630 - RNA, 21 nt, Human
ccucccaagcccggaauuccg

SEQ ID NO: 151631 - RNA, 22 nt, Human
ccucccaagcccggaauuccgg

SEQ ID NO: 151632 - RNA, 24 nt, Human
cucacugcaaccucugccucccgg

SEQ ID NO: 151633 - RNA, 18 nt, Human
cucccagggcuguucagc

SEQ ID NO: 151634 - RNA, 23 nt, Human
cuccugccucagccucccaagcc

SEQ ID NO: 151635 - RNA, 19 nt, Human
cugcaaccucugccucccg

SEQ ID NO: 151636 - RNA, 23 nt, Human
cugcaaccucugccucccggguu

SEQ ID NO: 151637 - RNA, 24 nt, Human
cugcaaccucugccucccggguuc

SEQ ID NO: 151638 - RNA, 24 nt, Human
cuguagcucacgccaacuuuaugc

SEQ ID NO: 151639 - RNA, 21 nt, Human
gaacuuugaaucuugaagggu

SEQ ID NO: 151640 - RNA, 22 nt, Human
gcaaccucugccucccggguuc

SEQ ID NO: 151641 - RNA, 24 nt, Human
gcgagucuccugccucagccuccc

SEQ ID NO: 151642 - RNA, 21 nt, Human
gcucacugcaaccucugccuc

SEQ ID NO: 151643 - RNA, 19 nt, Human
ggcagggagccuggagaac

SEQ ID NO: 151644 - RNA, 21 nt, Human
gggucaugaugaggcugagau

SEQ ID NO: 151645 - RNA, 22 nt, Human
guaucagggucucuccaggguc

SEQ ID NO: 151646 - RNA, 26 nt, Human
gugacauuucuccuugcucauucucu

SEQ ID NO: 151647 - RNA, 20 nt, Human
uaaaacucuccuuucucucc

SEQ ID NO: 151648 - RNA, 20 nt, Human
uaacaguauuuugcaauagu

SEQ ID NO: 151649 - RNA, 20 nt, Human
uaauguuuucuauacuguuu

SEQ ID NO: 151650 - RNA, 20 nt, Human
uauuuuauuuauuuauuuuu

SEQ ID NO: 151651 - RNA, 25 nt, Human
uauuuugcccacucagcccugucua

SEQ ID NO: 151652 - RNA, 24 nt, Human
ucaacuuuuauucuuuccuucccc

SEQ ID NO: 151653 - RNA, 24 nt, Human
ucacugcaaccucugccucccggg

SEQ ID NO: 151654 - RNA, 25 nt, Human
ucacugcaaccucugccucccgggu

SEQ ID NO: 151655 - RNA, 22 nt, Human
ucagccuguuucuggcaguggc

SEQ ID NO: 151656 - RNA, 21 nt, Human
ucccagggcuguucagccugu

SEQ ID NO: 151657 - RNA, 21 nt, Human
ucccggguucaagcgagucuc

SEQ ID NO: 151658 - RNA, 24 nt, Human
ucccggguucaagcgagucuccug

SEQ ID NO: 151659 - RNA, 22 nt, Human
uccgcuuagaggugguuugcug

SEQ ID NO: 151660 - RNA, 18 nt, Human
uccggccugaaugggugg

SEQ ID NO: 151661 - RNA, 19 nt, Human
uccggccugaauggguggg

SEQ ID NO: 151662 - RNA, 22 nt, Human
ucuaaaacucuccuuucucucc

SEQ ID NO: 151663 - RNA, 25 nt, Human
ucuccaugaacaacucccaccaccu

SEQ ID NO: 151664 - RNA, 23 nt, Human
ucuccugccucagccucccaagc

SEQ ID NO: 151665 - RNA, 26 nt, Human
ucugucacccaggcucuggagugcaa

SEQ ID NO: 151666 - RNA, 19 nt, Human
ucuugcucugucacccagg

SEQ ID NO: 151667 - RNA, 25 nt, Human
ucuugcucugucacccaggcucugg

SEQ ID NO: 151668 - RNA, 26 nt, Human
ucuugcucugucacccaggcucugga

SEQ ID NO: 151669 - RNA, 20 nt, Human
ugagaucaaaugaggcacca

SEQ ID NO: 151670 - RNA, 22 nt, Human
ugagccacauggugcccucugu

SEQ ID NO: 151671 - RNA, 22 nt, Human
ugaugaggcugagaucaaauga

SEQ ID NO: 151672 - RNA, 23 nt, Human
ugcaauggcgcaaucuuggcuca

SEQ ID NO: 151673 - RNA, 26 nt, Human
ugccuaagcugucggggacuggggcc

SEQ ID NO: 151674 - RNA, 22 nt, Human
ugccucagccucccaagcccgg

SEQ ID NO: 151675 - RNA, 20 nt, Human
ugccuggaaaucccguucuu

SEQ ID NO: 151676 - RNA, 25 nt, Human
ugcgaagugccuuugcuccggggcg

SEQ ID NO: 151677 - RNA, 26 nt, Human
ugcucugucacccaggcucuggagug

SEQ ID NO: 151678 - RNA, 23 nt, Human
uggagugcaauggcgcaaucuug

SEQ ID NO: 151679 - RNA, 24 nt, Human
uggagugcaauggcgcaaucuugg

SEQ ID NO: 151680 - RNA, 18 nt, Human
uggcagaugguaucaggg

SEQ ID NO: 151681 - RNA, 21 nt, Human
ugggaggggucugguggccca

SEQ ID NO: 151682 - RNA, 25 nt, Human
ugucaaauggaacuuugaaucuuga

SEQ ID NO: 151683 - RNA, 23 nt, Human
uucuaaaacucuccuuucucucc

SEQ ID NO: 151684 - RNA, 21 nt, Human
uugagauguagucuugcucug

SEQ ID NO: 151685 - RNA, 19 nt, Human
uugcucauucucucugcug

SEQ ID NO: 151686 - RNA, 18 nt, Human
uuugugacauuucuccuu

SEQ ID NO: 151687 - RNA, 23 nt, Human
aagcaggaaggggcaggagccag

SEQ ID NO: 151688 - RNA, 22 nt, Human
acccgagccaccuccugacccc

SEQ ID NO: 151689 - RNA, 18 nt, Human
agaagggaagggggaggg

SEQ ID NO: 151690 - RNA, 21 nt, Human
agggaggggaagcgucucagg

SEQ ID NO: 151691 - RNA, 25 nt, Human
aggggcaggagccagcacaggaccc

SEQ ID NO: 151692 - RNA, 23 nt, Human
agguaaaacaaaaaagguucaag

SEQ ID NO: 151693 - RNA, 18 nt, Human
auuucucccaacuguuau

SEQ ID NO: 151694 - RNA, 23 nt, Human
caacaggaaagggcuucugccuc

SEQ ID NO: 151695 - RNA, 19 nt, Human
cagcacaggacccgggugg

SEQ ID NO: 151696 - RNA, 19 nt, Human
cagcccaagggguccaugu

SEQ ID NO: 151697 - RNA, 19 nt, Human
caggacccggguggggcag

SEQ ID NO: 151698 - RNA, 23 nt, Human
caggacccggguggggcagggag

SEQ ID NO: 151699 - RNA, 19 nt, Human
caggagccagcacaggacc

SEQ ID NO: 151700 - RNA, 18 nt, Human
caggaucuggcagagccc

SEQ ID NO: 151701 - RNA, 22 nt, Human
ccacacccgagccaccuccuga

SEQ ID NO: 151702 - RNA, 23 nt, Human
ccacacccgagccaccuccugac

SEQ ID NO: 151703 - RNA, 19 nt, Human
ccagcccacacccgagcca

SEQ ID NO: 151704 - RNA, 22 nt, Human
ccagcccacacccgagccaccu

SEQ ID NO: 151705 - RNA, 25 nt, Human
cccacacccgagccaccuccugacc

SEQ ID NO: 151706 - RNA, 20 nt, Human
ccccuggcugcaaaagcagg

SEQ ID NO: 151707 - RNA, 24 nt, Human
cgggaaggcaaccggagaagggaa

SEQ ID NO: 151708 - RNA, 19 nt, Human
cuccagcccacacccgagc

SEQ ID NO: 151709 - RNA, 27 nt, Human
cuccugaccccuggcugcaaaagcagg

SEQ ID NO: 151710 - RNA, 20 nt, Human
gaagggaagggggaggggaa

SEQ ID NO: 151711 - RNA, 18 nt, Human
gagaagggaagggggagg

SEQ ID NO: 151712 - RNA, 22 nt, Human
gaucuggcagagccccgggcag

SEQ ID NO: 151713 - RNA, 20 nt, Human
ggagaagggaagggggaggg

SEQ ID NO: 151714 - RNA, 26 nt, Human
gguaaaacaaaaaagguucaaggucu

SEQ ID NO: 151715 - RNA, 24 nt, Human
gugcucagcccaagggguccaugu

SEQ ID NO: 151716 - RNA, 20 nt, Human
guggaguguaaggggcccgg

SEQ ID NO: 151717 - RNA, 20 nt, Human
uccaugugcugggacaccaa

SEQ ID NO: 151718 - RNA, 20 nt, Human
ucuccagcccacacccgagc

SEQ ID NO: 151719 - RNA, 26 nt, Human
ucuccagcccacacccgagccaccuc

SEQ ID NO: 151720 - RNA, 19 nt, Human
uggaguguaaggggcccgg

SEQ ID NO: 151721 - RNA, 20 nt, Human
uggggcagggaggggaagcg

SEQ ID NO: 151722 - RNA, 22 nt, Human
uggggcagggaggggaagcguc

SEQ ID NO: 151723 - RNA, 18 nt, Human
uggugcucagcccaaggg

SEQ ID NO: 151724 - RNA, 20 nt, Human
ugugcugggacaccaacagg

SEQ ID NO: 151725 - RNA, 25 nt, Human
aaagaaaggcuucaguaaaagccaa

SEQ ID NO: 151726 - RNA, 20 nt, Human
aaagagacaguaucugccga

SEQ ID NO: 151727 - RNA, 19 nt, Human
aacuuccccuuugcccucu

SEQ ID NO: 151728 - RNA, 19 nt, Human
acagggaaggauggccuug

SEQ ID NO: 151729 - RNA, 22 nt, Human
agcacaaaguacaaaggagaaa

SEQ ID NO: 151730 - RNA, 20 nt, Human
caagcacaaaguacaaagga

SEQ ID NO: 151731 - RNA, 19 nt, Human
cacagcaccaaaacuggag

SEQ ID NO: 151732 - RNA, 25 nt, Human
ccagccagcauauuucagcugcuuu

SEQ ID NO: 151733 - RNA, 22 nt, Human
ccuauacaagcacaaaguacaa

SEQ ID NO: 151734 - RNA, 27 nt, Human
ccuggacgauuuuuuccucacuccagc

SEQ ID NO: 151735 - RNA, 27 nt, Human
cugaaguuucacugacaaucgcugacc

SEQ ID NO: 151736 - RNA, 23 nt, Human
cugacaaucgcugacaaaaaagg

SEQ ID NO: 151737 - RNA, 18 nt, Human
gaacacugcgauggagga

SEQ ID NO: 151738 - RNA, 28 nt, Human
gacaaaaaaggcagguuaauaggagaaa

SEQ ID NO: 151739 - RNA, 24 nt, Human
gauauugaauaccuccaaaagaaa

SEQ ID NO: 151740 - RNA, 19 nt, Human
gcacaaaguacaaaggaga

SEQ ID NO: 151741 - RNA, 19 nt, Human
ucaguaaaagccaaggaag

SEQ ID NO: 151742 - RNA, 24 nt, Human
uccucacuccagccagcauauuuc

SEQ ID NO: 151743 - RNA, 20 nt, Human
uccuugaggcaaaggauauu

SEQ ID NO: 151744 - RNA, 20 nt, Human
ucuuuuauaaagcaaagauu

SEQ ID NO: 151745 - RNA, 27 nt, Human
ugaaagagacaguaucugccgaagucc

SEQ ID NO: 151746 - RNA, 20 nt, Human
ugacaaaaaaggcagguuaa

SEQ ID NO: 151747 - RNA, 21 nt, Human
ugacaaucgcugacaaaaaag

SEQ ID NO: 151748 - RNA, 20 nt, Human
uucacugacaaucgcugaca

SEQ ID NO: 151749 - RNA, 21 nt, Human
uucacugacaaucgcugacaa

SEQ ID NO: 151750 - RNA, 22 nt, Human
uuuuuuuuuucuagacaaaguc

SEQ ID NO: 151751 - RNA, 19 nt, Human
acagggguugggggaggga

SEQ ID NO: 151752 - RNA, 21 nt, Human
gaguacgggguggggauacag

SEQ ID NO: 151753 - RNA, 22 nt, Human
gggguugggggagggauggggc

SEQ ID NO: 151754 - RNA, 22 nt, Human
uggggcagcugcccccgucggc

SEQ ID NO: 151755 - RNA, 22 nt, Human
aaaaacuauaaaaugagauucu

SEQ ID NO: 151756 - RNA, 18 nt, Human
aaaagccuagcaaaggca

SEQ ID NO: 151757 - RNA, 25 nt, Human
aagaccaaugggaaaaaccgguacc

SEQ ID NO: 151758 - RNA, 21 nt, Human
aagcaaaagccuagcaaaggc

SEQ ID NO: 151759 - RNA, 22 nt, Human
aagcaaaagccuagcaaaggca

SEQ ID NO: 151760 - RNA, 23 nt, Human
aaggcgacuagcgcugccgcaga

SEQ ID NO: 151761 - RNA, 21 nt, Human
aauauaaagagccugaccuua

SEQ ID NO: 151762 - RNA, 21 nt, Human
aauggugacaaaaauauauac

SEQ ID NO: 151763 - RNA, 19 nt, Human
accuguaugacagaagccu

SEQ ID NO: 151764 - RNA, 23 nt, Human
agaagccuggcuguggcugcugc

SEQ ID NO: 151765 - RNA, 24 nt, Human
augacaaacacacagguugcaauc

SEQ ID NO: 151766 - RNA, 18 nt, Human
augauaacaauggaaagu

SEQ ID NO: 151767 - RNA, 22 nt, Human
auggaaagucagcccuuugcua

SEQ ID NO: 151768 - RNA, 20 nt, Human
augggaaaaacuauaaaaug

SEQ ID NO: 151769 - RNA, 20 nt, Human
auggugagaugaggaugaug

SEQ ID NO: 151770 - RNA, 18 nt, Human
cacagaauagccaaggga

SEQ ID NO: 151771 - RNA, 21 nt, Human
cagagaggucuaugaucuggg

SEQ ID NO: 151772 - RNA, 20 nt, Human
cagcuaagaaacagcaauau

SEQ ID NO: 151773 - RNA, 19 nt, Human
cauugccuggugccaccca

SEQ ID NO: 151774 - RNA, 19 nt, Human
cccuuugcuaagcaaaagc

SEQ ID NO: 151775 - RNA, 20 nt, Human
cccuuugcuaagcaaaagcu

SEQ ID NO: 151776 - RNA, 21 nt, Human
ccugucucuucucuguucccc

SEQ ID NO: 151777 - RNA, 24 nt, Human
cuaagaaacagcaauaugaaauaa

SEQ ID NO: 151778 - RNA, 27 nt, Human
cuaagcagccauuggacuccaggagcc

SEQ ID NO: 151779 - RNA, 21 nt, Human
cucuaagcagccauuggacuc

SEQ ID NO: 151780 - RNA, 25 nt, Human
gaaaaacuauaaaaugagauucuga

SEQ ID NO: 151781 - RNA, 20 nt, Human
gacagaagccuggcuguggc

SEQ ID NO: 151782 - RNA, 28 nt, Human
gauaacaauggaaagucagccgguaccc

SEQ ID NO: 151783 - RNA, 18 nt, Human
gcccugaggucaauucuu

SEQ ID NO: 151784 - RNA, 21 nt, Human
gcuggaguucuuucucauucg

SEQ ID NO: 151785 - RNA, 24 nt, Human
ggagauaaauauuccugcagcuuc

SEQ ID NO: 151786 - RNA, 18 nt, Human
ggagggaaauggaaacug

SEQ ID NO: 151787 - RNA, 21 nt, Human
ggaguucuuucucauucgacu

SEQ ID NO: 151788 - RNA, 23 nt, Human
guagugaggucucugaagaacaa

SEQ ID NO: 151789 - RNA, 24 nt, Human
uagcaaaggcaguaaaaucuggaa

SEQ ID NO: 151790 - RNA, 22 nt, Human
uauuccugcagcuuccuuuucu

SEQ ID NO: 151791 - RNA, 19 nt, Human
uccccaaagucaagaccua

SEQ ID NO: 151792 - RNA, 21 nt, Human
ucuaccuguaugacagaagcu

SEQ ID NO: 151793 - RNA, 20 nt, Human
ugaaauaaugcugauuuuua

SEQ ID NO: 151794 - RNA, 24 nt, Human
ugacaaaaauauauacaccaugau

SEQ ID NO: 151795 - RNA, 23 nt, Human
ugacaaacacacagguugcaauc

SEQ ID NO: 151796 - RNA, 27 nt, Human
ugacagaagccuggcuggucaagcgug

SEQ ID NO: 151797 - RNA, 19 nt, Human
ugaccagagcccuaagugg

SEQ ID NO: 151798 - RNA, 25 nt, Human
ugagggagggaaauggaaacugagc

SEQ ID NO: 151799 - RNA, 18 nt, Human
ugcagcuuccuuuucuuu

SEQ ID NO: 151800 - RNA, 19 nt, Human
ugccaggaagaauacugag

SEQ ID NO: 151801 - RNA, 21 nt, Human
ugccucaagaggugcuguggc

SEQ ID NO: 151802 - RNA, 25 nt, Human
uggagauaaauauuccugcagcuuc

SEQ ID NO: 151803 - RNA, 23 nt, Human
ugggaaaaacuauaaaaugagau

SEQ ID NO: 151804 - RNA, 19 nt, Human
ugggaaaguaauugguuag

SEQ ID NO: 151805 - RNA, 23 nt, Human
ugggagggcauagcaauacaaug

SEQ ID NO: 151806 - RNA, 23 nt, Human
uggugagaugaggaugaugacaa

SEQ ID NO: 151807 - RNA, 28 nt, Human
uuaguggccugucucuucucuguucccc

SEQ ID NO: 151808 - RNA, 21 nt, Human
uuaguuaguuguauuuccuga

SEQ ID NO: 151809 - RNA, 18 nt, Human
acaaggaaaacgcgcgcg

SEQ ID NO: 151810 - RNA, 20 nt, Human
agggaggaaaaaaauacuga

SEQ ID NO: 151811 - RNA, 19 nt, Human
aguggaaugaggcacucaa

SEQ ID NO: 151812 - RNA, 23 nt, Human
auuucuuuguugaccaggaacaa

SEQ ID NO: 151813 - RNA, 20 nt, Human
ccagggaccugucccugggc

SEQ ID NO: 151814 - RNA, 23 nt, Human
cucgcacaccugcagaggcaauu

SEQ ID NO: 151815 - RNA, 18 nt, Human
gcagcaguucacauuaga

SEQ ID NO: 151816 - RNA, 22 nt, Human
guguacucuugagugguuaggc

SEQ ID NO: 151817 - RNA, 22 nt, Human
uaaaucucuaggcucaagucca

SEQ ID NO: 151818 - RNA, 23 nt, Human
uauagggaggaaaaaaauacuga

SEQ ID NO: 151819 - RNA, 19 nt, Human
ucaaaggguugaaaugcga

SEQ ID NO: 151820 - RNA, 19 nt, Human
uccacauuucuuuguugac

SEQ ID NO: 151821 - RNA, 23 nt, Human
ucucucuuuuucaggggaggugg

SEQ ID NO: 151822 - RNA, 19 nt, Human
ugaucuugucuguaugagg

SEQ ID NO: 151823 - RNA, 18 nt, Human
ugcucuggugccagcugu

SEQ ID NO: 151824 - RNA, 24 nt, Human
uggcucacagggcucucugugaug

SEQ ID NO: 151825 - RNA, 23 nt, Human
uggguggaggcuuuuguugcaga

SEQ ID NO: 151826 - RNA, 22 nt, Human
ugucccagacuaguucagaaac

SEQ ID NO: 151827 - RNA, 21 nt, Human
uucagaaacuaagugcucucu

SEQ ID NO: 151828 - RNA, 19 nt, Human
uuuuucuuugguuuccagg

SEQ ID NO: 151829 - RNA, 21 nt, Human
uuuuuuuuuuuuuuuucucuc

SEQ ID NO: 151830 - RNA, 27 nt, Human
uuuuuuuuuuuuuuuuucucucuuuuu

SEQ ID NO: 151831 - RNA, 18 nt, Human
aagaggugucucccucca

SEQ ID NO: 151832 - RNA, 19 nt, Human
aagcagcacagccacaaau

SEQ ID NO: 151833 - RNA, 24 nt, Human
acagguggcauugagcagggccca

SEQ ID NO: 151834 - RNA, 24 nt, Human
agcugacccguggcacagcugcac

SEQ ID NO: 151835 - RNA, 26 nt, Human
aggaagagcaaacacacucaagucca

SEQ ID NO: 151836 - RNA, 23 nt, Human
aggaaggggagcucugcccuggg

SEQ ID NO: 151837 - RNA, 21 nt, Human
aggcugaugccagggcagcac

SEQ ID NO: 151838 - RNA, 23 nt, Human
agggacaugcacagcagcagcca

SEQ ID NO: 151839 - RNA, 23 nt, Human
aggugggcggaugguggcccgag

SEQ ID NO: 151840 - RNA, 23 nt, Human
agguggggucagcccgagguggg

SEQ ID NO: 151841 - RNA, 18 nt, Human
caagcacuuggcacccac

SEQ ID NO: 151842 - RNA, 22 nt, Human
cacacucaaguccagaguuccc

SEQ ID NO: 151843 - RNA, 21 nt, Human
caccaggccuucugcaagucc

SEQ ID NO: 151844 - RNA, 21 nt, Human
caccgccucccagacucuugc

SEQ ID NO: 151845 - RNA, 21 nt, Human
cagacacugcugacggggaca

SEQ ID NO: 151846 - RNA, 25 nt, Human
cagccaggacagccugcaccgccuc

SEQ ID NO: 151847 - RNA, 27 nt, Human
cagccaggacagccugcaccgccuccc

SEQ ID NO: 151848 - RNA, 21 nt, Human
caggcggcagccggucuuuug

SEQ ID NO: 151849 - RNA, 22 nt, Human
cagugugugccugugguucugu

SEQ ID NO: 151850 - RNA, 19 nt, Human
caugagguucagcucgugc

SEQ ID NO: 151851 - RNA, 20 nt, Human
caugcacagcagcagccaca

SEQ ID NO: 151852 - RNA, 27 nt, Human
ccacacugcccccucagugugugccug

SEQ ID NO: 151853 - RNA, 19 nt, Human
cccaaggaagagcaaacac

SEQ ID NO: 151854 - RNA, 23 nt, Human
cccaaggaagagcaaacacacuc

SEQ ID NO: 151855 - RNA, 23 nt, Human
cccacacgacagagacgucacuc

SEQ ID NO: 151856 - RNA, 27 nt, Human
ccccgccccggccggcgccaccccggc

SEQ ID NO: 151857 - RNA, 27 nt, Human
cccgcggacggggcauggggaugggac

SEQ ID NO: 151858 - RNA, 19 nt, Human
cccggcauccgcccaugcu

SEQ ID NO: 151859 - RNA, 25 nt, Human
cccguggcacagcugcaccuaagac

SEQ ID NO: 151860 - RNA, 19 nt, Human
ccuucugcaagucccagag

SEQ ID NO: 151861 - RNA, 20 nt, Human
cgacacugacgccacacuga

SEQ ID NO: 151862 - RNA, 21 nt, Human
cgagagcuugguucugggacu

SEQ ID NO: 151863 - RNA, 24 nt, Human
cguggcacagcugcaccuaagaca

SEQ ID NO: 151864 - RNA, 18 nt, Human
cucagccccgacacugac

SEQ ID NO: 151865 - RNA, 20 nt, Human
cucagccccgacacugacgc

SEQ ID NO: 151866 - RNA, 21 nt, Human
cucccuccaucauuaacccca

SEQ ID NO: 151867 - RNA, 18 nt, Human
cugaagcagcucaagggg

SEQ ID NO: 151868 - RNA, 20 nt, Human
cugcccccucagugugugcc

SEQ ID NO: 151869 - RNA, 20 nt, Human
gacagagacgucacucaagc

SEQ ID NO: 151870 - RNA, 20 nt, Human
gagagcuugguucugggacu

SEQ ID NO: 151871 - RNA, 21 nt, Human
gaggaaacugacaggcuggga

SEQ ID NO: 151872 - RNA, 18 nt, Human
gaguggaacacaugaggu

SEQ ID NO: 151873 - RNA, 22 nt, Human
gcacagcagcagccacagcccc

SEQ ID NO: 151874 - RNA, 21 nt, Human
gcagccaggacagccugcacc

SEQ ID NO: 151875 - RNA, 23 nt, Human
gcagggagccacacugcccccuc

SEQ ID NO: 151876 - RNA, 21 nt, Human
gcauggggaugggacaggcag

SEQ ID NO: 151877 - RNA, 24 nt, Human
gcccaugcugggagacucccugaa

SEQ ID NO: 151878 - RNA, 20 nt, Human
gcccggggcucacacugucc

SEQ ID NO: 151879 - RNA, 19 nt, Human
gccugugcuguggcuccuc

SEQ ID NO: 151880 - RNA, 20 nt, Human
ggagacaagacucccaucgc

SEQ ID NO: 151881 - RNA, 23 nt, Human
ggagcaggcggcagccggucuuu

SEQ ID NO: 151882 - RNA, 19 nt, Human
gucacguccaggacaggag

SEQ ID NO: 151883 - RNA, 21 nt, Human
gucucccuccaucauuaaccc

SEQ ID NO: 151884 - RNA, 22 nt, Human
uacacaagcacuuggcacccac

SEQ ID NO: 151885 - RNA, 20 nt, Human
uacagcagcucaugcccggc

SEQ ID NO: 151886 - RNA, 22 nt, Human
uacccaaggaagagcaaacaca

SEQ ID NO: 151887 - RNA, 21 nt, Human
ucacacauucauacccaagga

SEQ ID NO: 151888 - RNA, 18 nt, Human
ucacucaagcagcacagc

SEQ ID NO: 151889 - RNA, 20 nt, Human
ucacugaagcagcucaaggg

SEQ ID NO: 151890 - RNA, 19 nt, Human
uccaucauuaaccccaaac

SEQ ID NO: 151891 - RNA, 24 nt, Human
uccccagagcagccaggacagccu

SEQ ID NO: 151892 - RNA, 21 nt, Human
ucccuccaucauuaaccccaa

SEQ ID NO: 151893 - RNA, 22 nt, Human
ucuaugaagaggugucucccuc

SEQ ID NO: 151894 - RNA, 18 nt, Human
ucuguccugguccugccc

SEQ ID NO: 151895 - RNA, 21 nt, Human
ugacggggacagggauggcuc

SEQ ID NO: 151896 - RNA, 21 nt, Human
ugagguucagcucgugccggg

SEQ ID NO: 151897 - RNA, 18 nt, Human
ugccagcacggccugugc

SEQ ID NO: 151898 - RNA, 24 nt, Human
ugccagggcagcaccaggccuucu

SEQ ID NO: 151899 - RNA, 22 nt, Human
ugggacaggcagggagccacac

SEQ ID NO: 151900 - RNA, 21 nt, Human
uggggaggaaacugacaggcu

SEQ ID NO: 151901 - RNA, 22 nt, Human
uguacauucacugaagcagcuc

SEQ ID NO: 151902 - RNA, 23 nt, Human
ugugacuggaagaggcugaugcc

SEQ ID NO: 151903 - RNA, 19 nt, Human
ugugugaggagagcaggcc

SEQ ID NO: 151904 - RNA, 23 nt, Human
uuccaugcaccgcgcgcuccgcc

SEQ ID NO: 151905 - RNA, 24 nt, Human
uuuuuuuuuuuugaaggagaagcc

SEQ ID NO: 151906 - RNA, 21 nt, Human
uuuuuuuuuuuuuuuugaagg

SEQ ID NO: 151907 - RNA, 18 nt, Human
uuuuuuuuuuuuuuuuug

SEQ ID NO: 151908 - RNA, 21 nt, Human
aaaaccuauuggaggugcaag

SEQ ID NO: 151909 - RNA, 19 nt, Human
aaaccacaaacggcuacug

SEQ ID NO: 151910 - RNA, 18 nt, Human
aaaccagaauccucagga

SEQ ID NO: 151911 - RNA, 22 nt, Human
accagaauccucaggaaaucuc

SEQ ID NO: 151912 - RNA, 24 nt, Human
accuccucccggugcccccucccg

SEQ ID NO: 151913 - RNA, 24 nt, Human
acucaccuccucccggugcccccu

SEQ ID NO: 151914 - RNA, 19 nt, Human
agaacucgcccgagccgag

SEQ ID NO: 151915 - RNA, 18 nt, Human
agagaaaaaaaacuggua

SEQ ID NO: 151916 - RNA, 20 nt, Human
agaggcgcaguccccggccc

SEQ ID NO: 151917 - RNA, 22 nt, Human
agcauauuguuuggcuucacag

SEQ ID NO: 151918 - RNA, 19 nt, Human
agcccauaacaaaaauaua

SEQ ID NO: 151919 - RNA, 20 nt, Human
aggccucagccuccucccag

SEQ ID NO: 151920 - RNA, 23 nt, Human
aggcggccccuccucgcgccggc

SEQ ID NO: 151921 - RNA, 21 nt, Human
agugaggaaaauagggaaaaa

SEQ ID NO: 151922 - RNA, 19 nt, Human
auaaagugaggaaaauagg

SEQ ID NO: 151923 - RNA, 21 nt, Human
auagaaaagguaagggcaagu

SEQ ID NO: 151924 - RNA, 22 nt, Human
auuggaggugcaaggcaggagc

SEQ ID NO: 151925 - RNA, 24 nt, Human
caaaggggaagaaaggcugguggu

SEQ ID NO: 151926 - RNA, 24 nt, Human
caagagcacaaauucgccgaggcc

SEQ ID NO: 151927 - RNA, 18 nt, Human
caaggaggcgggggcgaa

SEQ ID NO: 151928 - RNA, 18 nt, Human
cacacacaaaggggaaga

SEQ ID NO: 151929 - RNA, 23 nt, Human
cacgccggcggccagugcuggag

SEQ ID NO: 151930 - RNA, 21 nt, Human
cacggccggccccugcccagc

SEQ ID NO: 151931 - RNA, 23 nt, Human
cagaauccucaggaaaucucuuc

SEQ ID NO: 151932 - RNA, 20 nt, Human
ccacaaacggcuacugcaca

SEQ ID NO: 151933 - RNA, 21 nt, Human
ccacacacacaaaggggaaga

SEQ ID NO: 151934 - RNA, 19 nt, Human
ccaggggugggcugggggg

SEQ ID NO: 151935 - RNA, 19 nt, Human
ccagugcacacuugaacca

SEQ ID NO: 151936 - RNA, 20 nt, Human
ccagugcacacuugaaccac

SEQ ID NO: 151937 - RNA, 18 nt, Human
cccccugccacuguucug

SEQ ID NO: 151938 - RNA, 21 nt, Human
cccccugccacuguucuggcc

SEQ ID NO: 151939 - RNA, 21 nt, Human
ccccuuuuguccucugguuua

SEQ ID NO: 151940 - RNA, 23 nt, Human
cccgccacggccggccccugccc

SEQ ID NO: 151941 - RNA, 23 nt, Human
cccgggccugcgcccccacccuc

SEQ ID NO: 151942 - RNA, 18 nt, Human
cccuccuucgccuuccuu

SEQ ID NO: 151943 - RNA, 20 nt, Human
cccuccuucgccuuccuuuc

SEQ ID NO: 151944 - RNA, 24 nt, Human
ccgcaccggccccuaauggccgca

SEQ ID NO: 151945 - RNA, 22 nt, Human
ccgccacggccggccccugccc

SEQ ID NO: 151946 - RNA, 20 nt, Human
ccgccgcgcuccgcgccgcc

SEQ ID NO: 151947 - RNA, 25 nt, Human
ccgccgcgcuccgcgccgccgccgg

SEQ ID NO: 151948 - RNA, 22 nt, Human
ccggcccgccacggccggcccc

SEQ ID NO: 151949 - RNA, 20 nt, Human
ccucacaucgcgcggcggcc

SEQ ID NO: 151950 - RNA, 21 nt, Human
ccucacaucgcgcggcggccg

SEQ ID NO: 151951 - RNA, 21 nt, Human
ccuccgaacccuccuccugcc

SEQ ID NO: 151952 - RNA, 26 nt, Human
ccuccucccggugcccccucccgggc

SEQ ID NO: 151953 - RNA, 18 nt, Human
ccugcgcccccacccucc

SEQ ID NO: 151954 - RNA, 21 nt, Human
cgaaaaggggggagaggagga

SEQ ID NO: 151955 - RNA, 22 nt, Human
cgacaagagacacucaccuccu

SEQ ID NO: 151956 - RNA, 21 nt, Human
cgagcagcgccgcccgcacgc

SEQ ID NO: 151957 - RNA, 19 nt, Human
cgccgcacccagggguggg

SEQ ID NO: 151958 - RNA, 19 nt, Human
cgccgcccgcacgcccgcg

SEQ ID NO: 151959 - RNA, 21 nt, Human
cgccggcgcuccccuccuucg

SEQ ID NO: 151960 - RNA, 18 nt, Human
cgccgggagcggagcugg

SEQ ID NO: 151961 - RNA, 18 nt, Human
cggcggccagugcuggag

SEQ ID NO: 151962 - RNA, 18 nt, Human
cggcgggagaagacggcc

SEQ ID NO: 151963 - RNA, 20 nt, Human
cgggcgcaggcggccccucc

SEQ ID NO: 151964 - RNA, 18 nt, Human
cucagguucaucuugcau

SEQ ID NO: 151965 - RNA, 20 nt, Human
cucccccccagccuagcaca

SEQ ID NO: 151966 - RNA, 22 nt, Human
cucccgggccugcgcccccacc

SEQ ID NO: 151967 - RNA, 20 nt, Human
cucgcccucucuccccccca

SEQ ID NO: 151968 - RNA, 18 nt, Human
cugcgcccccacccuccg

SEQ ID NO: 151969 - RNA, 22 nt, Human
cuggccccugccgccucucucc

SEQ ID NO: 151970 - RNA, 20 nt, Human
cuucacaggccucagccucc

SEQ ID NO: 151971 - RNA, 20 nt, Human
cuuccuccucggcgcugucc

SEQ ID NO: 151972 - RNA, 19 nt, Human
gacuccccuccgcacucuc

SEQ ID NO: 151973 - RNA, 21 nt, Human
gcaguggcuggagagggaugc

SEQ ID NO: 151974 - RNA, 19 nt, Human
gccccgggcccccugccac

SEQ ID NO: 151975 - RNA, 22 nt, Human
gcccgggguccccgcgccgcac

SEQ ID NO: 151976 - RNA, 18 nt, Human
gcgcggcggccggcggag

SEQ ID NO: 151977 - RNA, 20 nt, Human
gcgcuccccuccuucgccuu

SEQ ID NO: 151978 - RNA, 21 nt, Human
gcggagcuggccggaccagag

SEQ ID NO: 151979 - RNA, 20 nt, Human
gcggcggcgggagaagacgg

SEQ ID NO: 151980 - RNA, 19 nt, Human
ggacucgauagaaaaggua

SEQ ID NO: 151981 - RNA, 23 nt, Human
ggacucgauagaaaagguaaggg

SEQ ID NO: 151982 - RNA, 21 nt, Human
ggcgcaggcggccccuccucg

SEQ ID NO: 151983 - RNA, 20 nt, Human
gggagaagacggccggggcg

SEQ ID NO: 151984 - RNA, 20 nt, Human
gggagaggaggaggcgacaa

SEQ ID NO: 151985 - RNA, 21 nt, Human
gggagggggcugggggucgcc

SEQ ID NO: 151986 - RNA, 19 nt, Human
gggccgggccgagcagcgc

SEQ ID NO: 151987 - RNA, 23 nt, Human
gggccugcgcccccacccuccga

SEQ ID NO: 151988 - RNA, 23 nt, Human
gggcgaaaaggggggagaggagg

SEQ ID NO: 151989 - RNA, 19 nt, Human
gggcgcaggcggccccucc

SEQ ID NO: 151990 - RNA, 21 nt, Human
gggcgccgcggcggcgggaga

SEQ ID NO: 151991 - RNA, 21 nt, Human
gggggaaguuccuuuuucucu

SEQ ID NO: 151992 - RNA, 20 nt, Human
ggggucgccucagcccgugc

SEQ ID NO: 151993 - RNA, 18 nt, Human
gugcgaggggccggccug

SEQ ID NO: 151994 - RNA, 26 nt, Human
gugcggacgggagggggcuggggguc

SEQ ID NO: 151995 - RNA, 22 nt, Human
uaaaccacaaacggcuacugca

SEQ ID NO: 151996 - RNA, 18 nt, Human
uagcacucagcccggcgu

SEQ ID NO: 151997 - RNA, 20 nt, Human
uauauauuuauauauauaua

SEQ ID NO: 151998 - RNA, 23 nt, Human
uauucuaucaucccucagguuca

SEQ ID NO: 151999 - RNA, 19 nt, Human
ucagccuccucccagugca

SEQ ID NO: 152000 - RNA, 21 nt, Human
uccccgcgccgcacccagggg

SEQ ID NO: 152001 - RNA, 20 nt, Human
uccccggcccgccacggccg

SEQ ID NO: 152002 - RNA, 23 nt, Human
ucccgggccugcgcccccacccu

SEQ ID NO: 152003 - RNA, 22 nt, Human
uccucccagugcacacuugaac

SEQ ID NO: 152004 - RNA, 20 nt, Human
uccucccggugcccccuccc

SEQ ID NO: 152005 - RNA, 20 nt, Human
uccucggcgcuguccuccuc

SEQ ID NO: 152006 - RNA, 19 nt, Human
ucgccucagcccgugcgcc

SEQ ID NO: 152007 - RNA, 20 nt, Human
ucucccccccagccuagcac

SEQ ID NO: 152008 - RNA, 18 nt, Human
ucuccgacccgacucccc

SEQ ID NO: 152009 - RNA, 23 nt, Human
ucucucgcccucucuccccccca

SEQ ID NO: 152010 - RNA, 25 nt, Human
ucuggccccugccgccucucuccga

SEQ ID NO: 152011 - RNA, 23 nt, Human
ugcccagccgaggucucucggag

SEQ ID NO: 152012 - RNA, 24 nt, Human
ugcccagccgaggucucucggagc

SEQ ID NO: 152013 - RNA, 21 nt, Human
ugggggugugugcggacggga

SEQ ID NO: 152014 - RNA, 24 nt, Human
uuagcacucagcccggcguccugc

SEQ ID NO: 152015 - RNA, 24 nt, Human
uuggcuucacaggccucagccucc

SEQ ID NO: 152016 - RNA, 18 nt, Human
aacugggccagugccuag

SEQ ID NO: 152017 - RNA, 22 nt, Human
acacaacgucccagcacacucc

SEQ ID NO: 152018 - RNA, 18 nt, Human
agcacacuccacucucca

SEQ ID NO: 152019 - RNA, 21 nt, Human
aggcccaccugccagcagcuc

SEQ ID NO: 152020 - RNA, 23 nt, Human
caagugccugcuccagcuccagu

SEQ ID NO: 152021 - RNA, 21 nt, Human
cacacaacgucccagcacacu

SEQ ID NO: 152022 - RNA, 19 nt, Human
cacacugccugcuccaggg

SEQ ID NO: 152023 - RNA, 24 nt, Human
cacccgcggugcucccagagcugg

SEQ ID NO: 152024 - RNA, 19 nt, Human
cagagcugggcuauccucc

SEQ ID NO: 152025 - RNA, 23 nt, Human
caggcucuagcaaaaggcugggg

SEQ ID NO: 152026 - RNA, 19 nt, Human
ccacacugccugcuccagg

SEQ ID NO: 152027 - RNA, 18 nt, Human
ccacgucagggagggcuc

SEQ ID NO: 152028 - RNA, 24 nt, Human
ccagcacacuccacucuccaccca

SEQ ID NO: 152029 - RNA, 26 nt, Human
ccagcagcucucaccuggccagccca

SEQ ID NO: 152030 - RNA, 23 nt, Human
cccacccgcggugcucccagagc

SEQ ID NO: 152031 - RNA, 21 nt, Human
cccagcacacuccacucucca

SEQ ID NO: 152032 - RNA, 22 nt, Human
cccaucagcuuugauaagggga

SEQ ID NO: 152033 - RNA, 18 nt, Human
cccgcggugcucccagag

SEQ ID NO: 152034 - RNA, 23 nt, Human
cccggcacacccuggcuuucccg

SEQ ID NO: 152035 - RNA, 21 nt, Human
ccuccacaggcaggcccaccu

SEQ ID NO: 152036 - RNA, 19 nt, Human
ccucucuguccucccuucc

SEQ ID NO: 152037 - RNA, 19 nt, Human
ccugccagcagcucucacc

SEQ ID NO: 152038 - RNA, 19 nt, Human
ccugcuccagcuccagucc

SEQ ID NO: 152039 - RNA, 21 nt, Human
ccugcuccagggacucgaguc

SEQ ID NO: 152040 - RNA, 18 nt, Human
ccuggggccucucugucc

SEQ ID NO: 152041 - RNA, 18 nt, Human
ccugugaguaucuuggcc

SEQ ID NO: 152042 - RNA, 21 nt, Human
cuccagcuccagucccagccu

SEQ ID NO: 152043 - RNA, 20 nt, Human
cuccagggacucgaguccac

SEQ ID NO: 152044 - RNA, 18 nt, Human
cuccagucccagccccuc

SEQ ID NO: 152045 - RNA, 21 nt, Human
cuggccagcccaccuucaugu

SEQ ID NO: 152046 - RNA, 21 nt, Human
cuuggcccggcacacccuggc

SEQ ID NO: 152047 - RNA, 26 nt, Human
gagaccucucuauugcacacaacguc

SEQ ID NO: 152048 - RNA, 19 nt, Human
gccugugaguaucuuggcc

SEQ ID NO: 152049 - RNA, 22 nt, Human
ggcacacccuggcuuucccggc

SEQ ID NO: 152050 - RNA, 27 nt, Human
ggccucucuguccucccuuccuuggcc

SEQ ID NO: 152051 - RNA, 18 nt, Human
ggugcucccagagcuggg

SEQ ID NO: 152052 - RNA, 21 nt, Human
gugccugcuccagcuccaguc

SEQ ID NO: 152053 - RNA, 24 nt, Human
uagcaaaaggcuggggggucccca

SEQ ID NO: 152054 - RNA, 24 nt, Human
ucaagcucgcacagccgugcaggc

SEQ ID NO: 152055 - RNA, 22 nt, Human
uccacacugccugcuccaggga

SEQ ID NO: 152056 - RNA, 19 nt, Human
uccacggagagccuugccc

SEQ ID NO: 152057 - RNA, 18 nt, Human
ugccagcagcucucaccu

SEQ ID NO: 152058 - RNA, 23 nt, Human
ugcuccagcuccagucccagccc

SEQ ID NO: 152059 - RNA, 18 nt, Human
uggacuggcugccagggc

SEQ ID NO: 152060 - RNA, 19 nt, Human
uggacuggcugccagggcc

SEQ ID NO: 152061 - RNA, 23 nt, Human
ugggggguccccagcgaccccca

SEQ ID NO: 152062 - RNA, 22 nt, Human
uguggagaccucucuauugcaa

SEQ ID NO: 152063 - RNA, 24 nt, Human
uguggccagccugugaguaucuug

SEQ ID NO: 152064 - RNA, 25 nt, Human
uuccuggcucggguccacuccgagg

SEQ ID NO: 152065 - RNA, 23 nt, Human
uuucccggcugcaagugccugcu

SEQ ID NO: 152066 - RNA, 22 nt, Human
uuuuuuuuuuuuuuggugugga

SEQ ID NO: 152067 - RNA, 19 nt, Human
cccgagcgccccgcgcagu

SEQ ID NO: 152068 - RNA, 18 nt, Human
cccucguccgcuccccgc

SEQ ID NO: 152069 - RNA, 20 nt, Human
ccuggcggguggggggcugu

SEQ ID NO: 152070 - RNA, 19 nt, Human
cgcaggucccgagcgcccc

SEQ ID NO: 152071 - RNA, 23 nt, Human
cguucagacgccgagcaccuggg

SEQ ID NO: 152072 - RNA, 23 nt, Human
cuggcggguggggggcuguggcc

SEQ ID NO: 152073 - RNA, 22 nt, Human
cuguggcccucguccgcucccc

SEQ ID NO: 152074 - RNA, 18 nt, Human
ggcggguggggggcugug

SEQ ID NO: 152075 - RNA, 20 nt, Human
gguggugaagguccgaggug

SEQ ID NO: 152076 - RNA, 19 nt, Human
uccccgcggcccgggcggg

SEQ ID NO: 152077 - RNA, 21 nt, Human
uccgcuccccgcggcccgggc

SEQ ID NO: 152078 - RNA, 21 nt, Human
uggcggguggggggcuguggc

SEQ ID NO: 152079 - RNA, 20 nt, Human
uggggggcuguggcccucgu

SEQ ID NO: 152080 - RNA, 21 nt, Human
aaccccccaaaacucuuaaaa

SEQ ID NO: 152081 - RNA, 22 nt, Human
aaggaucaaugagaucuagaag

SEQ ID NO: 152082 - RNA, 24 nt, Human
aaugaucucuucaucaagacuggu

SEQ ID NO: 152083 - RNA, 23 nt, Human
acaaaccacccaauuaaaaaccc

SEQ ID NO: 152084 - RNA, 21 nt, Human
accacccaauuaaaaaccccc

SEQ ID NO: 152085 - RNA, 18 nt, Human
accccccaaaacucuuaa

SEQ ID NO: 152086 - RNA, 20 nt, Human
agugaaaaguugaacaauuc

SEQ ID NO: 152087 - RNA, 24 nt, Human
auaagaagacucuaaaaauaauuc

SEQ ID NO: 152088 - RNA, 22 nt, Human
aucucuucaucaagacugguuc

SEQ ID NO: 152089 - RNA, 23 nt, Human
auuaaaaaccccccaaaacucuu

SEQ ID NO: 152090 - RNA, 25 nt, Human
caaguccuucuccuuccuuaauuuc

SEQ ID NO: 152091 - RNA, 19 nt, Human
cagaaauaagaagacucua

SEQ ID NO: 152092 - RNA, 24 nt, Human
ccacccaauuaaaaaccccccaaa

SEQ ID NO: 152093 - RNA, 26 nt, Human
cccccaaaacucuuaaaacagucuau

SEQ ID NO: 152094 - RNA, 19 nt, Human
ccgaccgcguucucggucg

SEQ ID NO: 152095 - RNA, 19 nt, Human
ccugccacuuugccccucu

SEQ ID NO: 152096 - RNA, 22 nt, Human
cggacaccugagauuugggccu

SEQ ID NO: 152097 - RNA, 21 nt, Human
cuucaaguccuucuccuuccu

SEQ ID NO: 152098 - RNA, 19 nt, Human
gagaucuagaagaaucucu

SEQ ID NO: 152099 - RNA, 22 nt, Human
gcugggugcggcggggaccggg

SEQ ID NO: 152100 - RNA, 19 nt, Human
ggaugggagaagggcagag

SEQ ID NO: 152101 - RNA, 18 nt, Human
ggccugaguuuauggcuu

SEQ ID NO: 152102 - RNA, 19 nt, Human
ucaaguccuucuccuuccu

SEQ ID NO: 152103 - RNA, 18 nt, Human
ucacaccaauuaucuccu

SEQ ID NO: 152104 - RNA, 24 nt, Human
ucacaugcuucagaaauaagaaga

SEQ ID NO: 152105 - RNA, 21 nt, Human
ucaggagcugcaauuggggcc

SEQ ID NO: 152106 - RNA, 22 nt, Human
uccaaagaugggucuguuuuga

SEQ ID NO: 152107 - RNA, 18 nt, Human
uccuucuguuggugcugu

SEQ ID NO: 152108 - RNA, 20 nt, Human
ucuugaaagucugaagucug

SEQ ID NO: 152109 - RNA, 21 nt, Human
ugaaaguccucugcuuucuga

SEQ ID NO: 152110 - RNA, 19 nt, Human
ugagguucuuguuggccug

SEQ ID NO: 152111 - RNA, 20 nt, Human
uggcuuccucacccucuucc

SEQ ID NO: 152112 - RNA, 21 nt, Human
uggugcugugaauuuucggcc

SEQ ID NO: 152113 - RNA, 23 nt, Human
uuacaaaccacccaauuaaaaac

SEQ ID NO: 152114 - RNA, 22 nt, Human
uucaaguccuucuccuuccuua

SEQ ID NO: 152115 - RNA, 22 nt, Human
uucaccuuguguucacaccaau

SEQ ID NO: 152116 - RNA, 23 nt, Human
uucauguguaggagugucuccau

SEQ ID NO: 152117 - RNA, 22 nt, Human
uuccaaauucuaucucuuucug

SEQ ID NO: 152118 - RNA, 21 nt, Human
uuccugccacuuugccccucu

SEQ ID NO: 152119 - RNA, 22 nt, Human
uucucugaguucuuccugagca

SEQ ID NO: 152120 - RNA, 19 nt, Human
uucugauugguuuuuggga

SEQ ID NO: 152121 - RNA, 18 nt, Human
uuggaugggagaagggca

SEQ ID NO: 152122 - RNA, 23 nt, Human
uugggguagguuaguuccugagc

SEQ ID NO: 152123 - RNA, 18 nt, Human
uuugacaagauuccuccu

SEQ ID NO: 152124 - RNA, 19 nt, Human
uuuugggaagcuuuuaauu

SEQ ID NO: 152125 - RNA, 23 nt, Human
aaacagaaaacaaaaccaaaacc

SEQ ID NO: 152126 - RNA, 27 nt, Human
aaaccccuuaauuaacaacaacaaaaa

SEQ ID NO: 152127 - RNA, 23 nt, Human
aaaguaaacagaaaacaaaacca

SEQ ID NO: 152128 - RNA, 18 nt, Human
aacagaacaccaccacag

SEQ ID NO: 152129 - RNA, 20 nt, Human
aagcaagaguucuacccaag

SEQ ID NO: 152130 - RNA, 19 nt, Human
aagcacuaagguuuuaagc

SEQ ID NO: 152131 - RNA, 24 nt, Human
aaguaaacagaaaacaaaaccaaa

SEQ ID NO: 152132 - RNA, 19 nt, Human
aauaguauuacaggaagca

SEQ ID NO: 152133 - RNA, 24 nt, Human
aaugaaaagaauccagaagaagga

SEQ ID NO: 152134 - RNA, 20 nt, Human
acaggacuggaaagucaaaa

SEQ ID NO: 152135 - RNA, 22 nt, Human
acauguguagacaaagagguuu

SEQ ID NO: 152136 - RNA, 25 nt, Human
accaaaaccccuuaauuaacaacaa

SEQ ID NO: 152137 - RNA, 18 nt, Human
accacagcccccuccccc

SEQ ID NO: 152138 - RNA, 28 nt, Human
accacagcccccucccccucuccccagg

SEQ ID NO: 152139 - RNA, 19 nt, Human
agaaaacaaaaccaaaacc

SEQ ID NO: 152140 - RNA, 24 nt, Human
agaaagcacuaagguuuuaagcug

SEQ ID NO: 152141 - RNA, 23 nt, Human
agaacaccaccacagcccccucc

SEQ ID NO: 152142 - RNA, 19 nt, Human
agaccagagcugguaagga

SEQ ID NO: 152143 - RNA, 23 nt, Human
agaccagagcugguaaggaaagg

SEQ ID NO: 152144 - RNA, 22 nt, Human
agcaccuguucaagugaacagc

SEQ ID NO: 152145 - RNA, 19 nt, Human
auaaaacaaaauaauauau

SEQ ID NO: 152146 - RNA, 23 nt, Human
caaaaccccuuaauuaacaacaa

SEQ ID NO: 152147 - RNA, 21 nt, Human
caaauaauggaaagaauugaa

SEQ ID NO: 152148 - RNA, 20 nt, Human
caacagaacaccaccacagc

SEQ ID NO: 152149 - RNA, 25 nt, Human
cacagcuuaugcccaggagcugccu

SEQ ID NO: 152150 - RNA, 22 nt, Human
caccuguucaagugaacagcac

SEQ ID NO: 152151 - RNA, 19 nt, Human
cacuguggugcggcagggu

SEQ ID NO: 152152 - RNA, 21 nt, Human
cagaacaccaccacagccccc

SEQ ID NO: 152153 - RNA, 22 nt, Human
cagaacaccaccacagcccccu

SEQ ID NO: 152154 - RNA, 18 nt, Human
cagcccccucccccucuc

SEQ ID NO: 152155 - RNA, 18 nt, Human
cagcuugggcuggcuuug

SEQ ID NO: 152156 - RNA, 19 nt, Human
ccaccacagcccccucccc

SEQ ID NO: 152157 - RNA, 20 nt, Human
ccccagcauccucaaaccug

SEQ ID NO: 152158 - RNA, 22 nt, Human
gagcaauauagaccagagcugg

SEQ ID NO: 152159 - RNA, 20 nt, Human
gcacuguggugcggcagggu

SEQ ID NO: 152160 - RNA, 21 nt, Human
gccacagcuuaugcccaggag

SEQ ID NO: 152161 - RNA, 21 nt, Human
ggagcugccucgccgcgggac

SEQ ID NO: 152162 - RNA, 20 nt, Human
gggucaaaggcaaaggaaaa

SEQ ID NO: 152163 - RNA, 22 nt, Human
uaaacagaaaacaaaaccaaaa

SEQ ID NO: 152164 - RNA, 18 nt, Human
uauguuaagaaagaaagc

SEQ ID NO: 152165 - RNA, 25 nt, Human
uauuagaaaauuuucaagauguaag

SEQ ID NO: 152166 - RNA, 24 nt, Human
ucaaaagggucccaauauaaaaaa

SEQ ID NO: 152167 - RNA, 23 nt, Human
ucacugucauuugaucaaaguga

SEQ ID NO: 152168 - RNA, 22 nt, Human
uccccagcauccucaaaccugu

SEQ ID NO: 152169 - RNA, 21 nt, Human
ucugcgcaacagcaccuguuc

SEQ ID NO: 152170 - RNA, 23 nt, Human
ucuuguaaccaacagaacaccac

SEQ ID NO: 152171 - RNA, 22 nt, Human
ugaacagcaccuuaccagcuug

SEQ ID NO: 152172 - RNA, 24 nt, Human
ugcacacaaaguaaacagaaaaca

SEQ ID NO: 152173 - RNA, 23 nt, Human
uggaaagaauugaaauuugggua

SEQ ID NO: 152174 - RNA, 18 nt, Human
uggcaucguaacuauaca

SEQ ID NO: 152175 - RNA, 22 nt, Human
uguaaccaacagaacaccacca

SEQ ID NO: 152176 - RNA, 19 nt, Human
ugucauuugaucaaaguga

SEQ ID NO: 152177 - RNA, 18 nt, Human
ugucugacaagcauuggc

SEQ ID NO: 152178 - RNA, 19 nt, Human
uguucuggaaugcugccga

SEQ ID NO: 152179 - RNA, 24 nt, Human
uuaaaagcagguaguugcacacaa

SEQ ID NO: 152180 - RNA, 23 nt, Human
uuaauuaacaacaacaaaaagaa

SEQ ID NO: 152181 - RNA, 18 nt, Human
uuagucacagaguuuccu

SEQ ID NO: 152182 - RNA, 20 nt, Human
uucacaaaguugaguguugu

SEQ ID NO: 152183 - RNA, 21 nt, Human
uuggcauuuuaauucuucagg

SEQ ID NO: 152184 - RNA, 27 nt, Human
uuguaaccaacagaacaccaccacagc

SEQ ID NO: 152185 - RNA, 20 nt, Human
uuucuuguaaccaacagaac

SEQ ID NO: 152186 - RNA, 21 nt, Human
uuugcugcaauuugaaaacuc

SEQ ID NO: 152187 - RNA, 21 nt, Human
aaaaccuccccccacuacucc

SEQ ID NO: 152188 - RNA, 19 nt, Human
accuccccccacuacuccu

SEQ ID NO: 152189 - RNA, 19 nt, Human
accuugaagccucuugcuu

SEQ ID NO: 152190 - RNA, 20 nt, Human
acucggaagagaggcaggcc

SEQ ID NO: 152191 - RNA, 19 nt, Human
agacagaaaauaugaaggc

SEQ ID NO: 152192 - RNA, 18 nt, Human
agacucggaagagaggca

SEQ ID NO: 152193 - RNA, 19 nt, Human
agacucggaagagaggcag

SEQ ID NO: 152194 - RNA, 22 nt, Human
aggcaggaauacgccuggcagc

SEQ ID NO: 152195 - RNA, 19 nt, Human
aggcaggccacaaacagga

SEQ ID NO: 152196 - RNA, 19 nt, Human
auagcaaaaccucccccca

SEQ ID NO: 152197 - RNA, 21 nt, Human
caggaauacgccuggcagccc

SEQ ID NO: 152198 - RNA, 22 nt, Human
ccagacagaaaauaugaaggca

SEQ ID NO: 152199 - RNA, 19 nt, Human
ccccacuacuccugugagc

SEQ ID NO: 152200 - RNA, 22 nt, Human
ccccacuacuccugugagcacc

SEQ ID NO: 152201 - RNA, 19 nt, Human
ccuccccccacuacuccug

SEQ ID NO: 152202 - RNA, 21 nt, Human
ccugccaacuagagaagccua

SEQ ID NO: 152203 - RNA, 21 nt, Human
cguuaucuggacugcacugga

SEQ ID NO: 152204 - RNA, 20 nt, Human
cuagagaagccuagaacaaa

SEQ ID NO: 152205 - RNA, 22 nt, Human
cucucugcugguaucuccugga

SEQ ID NO: 152206 - RNA, 21 nt, Human
cuucugggcuuucugucuucc

SEQ ID NO: 152207 - RNA, 23 nt, Human
cuugaagccucuugcuucagugg

SEQ ID NO: 152208 - RNA, 26 nt, Human
gaauacgccuggcagcccugggggag

SEQ ID NO: 152209 - RNA, 24 nt, Human
gaucguuaucuggacugcacugga

SEQ ID NO: 152210 - RNA, 21 nt, Human
gcaggagaguggugauagagc

SEQ ID NO: 152211 - RNA, 19 nt, Human
gcccugggggagggggugg

SEQ ID NO: 152212 - RNA, 24 nt, Human
ggaaauagcaaaaccuccccccac

SEQ ID NO: 152213 - RNA, 19 nt, Human
ggagggggugggaucgggg

SEQ ID NO: 152214 - RNA, 19 nt, Human
ggcccaggcaggaauacgc

SEQ ID NO: 152215 - RNA, 19 nt, Human
uagcaaaaccuccccccaa

SEQ ID NO: 152216 - RNA, 19 nt, Human
uaucuggacugcacuggaa

SEQ ID NO: 152217 - RNA, 20 nt, Human
uccagacagaaaauaugaag

SEQ ID NO: 152218 - RNA, 20 nt, Human
uccucuuauccacuuggccg

SEQ ID NO: 152219 - RNA, 22 nt, Human
ucugcugguaucuccuggacca

SEQ ID NO: 152220 - RNA, 26 nt, Human
ucuucucuccuacucccucucugcug

SEQ ID NO: 152221 - RNA, 22 nt, Human
ucuugcuucaguggucucaaga

SEQ ID NO: 152222 - RNA, 23 nt, Human
uggccgcagaagcgccucucuca

SEQ ID NO: 152223 - RNA, 22 nt, Human
uucaguggucucaagagacucu

SEQ ID NO: 152224 - RNA, 23 nt, Human
uuggccgcagaagcgccucucuc

SEQ ID NO: 152225 - RNA, 21 nt, Human
uuuuaucucuugugccaggag

SEQ ID NO: 152226 - RNA, 21 nt, Human
aagacagccaaccggccuaac

SEQ ID NO: 152227 - RNA, 24 nt, Human
aagagcagcugggagugugggggc

SEQ ID NO: 152228 - RNA, 22 nt, Human
aagcaaccuuuuaauuccaagc

SEQ ID NO: 152229 - RNA, 18 nt, Human
aagcagcagggguaaggg

SEQ ID NO: 152230 - RNA, 20 nt, Human
aagcagcagggguaaggggg

SEQ ID NO: 152231 - RNA, 22 nt, Human
aagcagcagggguaagggggcc

SEQ ID NO: 152232 - RNA, 19 nt, Human
aagcaggcuggcgucggug

SEQ ID NO: 152233 - RNA, 22 nt, Human
aagcucgggguuugcgagcggg

SEQ ID NO: 152234 - RNA, 20 nt, Human
aaugccccucauuccucuca

SEQ ID NO: 152235 - RNA, 24 nt, Human
aauucccauuucguggccuggagg

SEQ ID NO: 152236 - RNA, 20 nt, Human
acacacacaguggaaaggga

SEQ ID NO: 152237 - RNA, 22 nt, Human
acagggagggccagggacgaga

SEQ ID NO: 152238 - RNA, 20 nt, Human
accccaccuccugccccucc

SEQ ID NO: 152239 - RNA, 22 nt, Human
accccaccuccugccccuccca

SEQ ID NO: 152240 - RNA, 23 nt, Human
accccaccuccugccccucccaa

SEQ ID NO: 152241 - RNA, 19 nt, Human
acccgccggggaaaaaccc

SEQ ID NO: 152242 - RNA, 22 nt, Human
acccugaagcagcagggguaag

SEQ ID NO: 152243 - RNA, 23 nt, Human
agcaaccuuuuaauuccaagcag

SEQ ID NO: 152244 - RNA, 21 nt, Human
agcagagucccccucccccag

SEQ ID NO: 152245 - RNA, 20 nt, Human
agcagcugggaguguggggg

SEQ ID NO: 152246 - RNA, 21 nt, Human
agccaggacacuccaaaaugu

SEQ ID NO: 152247 - RNA, 21 nt, Human
agcggaggucagggcaagcug

SEQ ID NO: 152248 - RNA, 18 nt, Human
aggcagguggagggccag

SEQ ID NO: 152249 - RNA, 19 nt, Human
aggcugaggccggcuggug

SEQ ID NO: 152250 - RNA, 19 nt, Human
aggcuggcgucgguggggg

SEQ ID NO: 152251 - RNA, 20 nt, Human
agggaugucagggucugggc

SEQ ID NO: 152252 - RNA, 20 nt, Human
agggcuggagcaaaaggcuu

SEQ ID NO: 152253 - RNA, 20 nt, Human
aggguccagccaggcugagg

SEQ ID NO: 152254 - RNA, 19 nt, Human
agguagggcaggggcaggu

SEQ ID NO: 152255 - RNA, 27 nt, Human
caacccgccggggaaaaaggccaaugg

SEQ ID NO: 152256 - RNA, 19 nt, Human
caagcuggggguguaaggu

SEQ ID NO: 152257 - RNA, 18 nt, Human
caagggaggcggaaggcc

SEQ ID NO: 152258 - RNA, 18 nt, Human
caccccaccuccugcccc

SEQ ID NO: 152259 - RNA, 21 nt, Human
cacccuaagcccaggcuucug

SEQ ID NO: 152260 - RNA, 22 nt, Human
cacccuauuuccaccccaccuc

SEQ ID NO: 152261 - RNA, 20 nt, Human
cacguggacuggaaagaagu

SEQ ID NO: 152262 - RNA, 23 nt, Human
cagagcccagacuggcuuugccc

SEQ ID NO: 152263 - RNA, 23 nt, Human
cagcauggucacacacacagugg

SEQ ID NO: 152264 - RNA, 21 nt, Human
cagccaggcugaggccggcug

SEQ ID NO: 152265 - RNA, 21 nt, Human
caggagcaauacccagaccug

SEQ ID NO: 152266 - RNA, 18 nt, Human
cagggcaagcugaagugg

SEQ ID NO: 152267 - RNA, 21 nt, Human
caucuccacccuaagcccagg

SEQ ID NO: 152268 - RNA, 19 nt, Human
ccaagcagagucccccucc

SEQ ID NO: 152269 - RNA, 22 nt, Human
ccaaugccccucauuccucuca

SEQ ID NO: 152270 - RNA, 18 nt, Human
ccaccuccugccccuccc

SEQ ID NO: 152271 - RNA, 23 nt, Human
ccaccuccugccccucccaaccc

SEQ ID NO: 152272 - RNA, 23 nt, Human
ccaggacacuccaaaaugugcca

SEQ ID NO: 152273 - RNA, 20 nt, Human
cccaccuccugccccuccca

SEQ ID NO: 152274 - RNA, 18 nt, Human
ccccaccuccugccccuc

SEQ ID NO: 152275 - RNA, 21 nt, Human
ccccaccuccugccccuccca

SEQ ID NO: 152276 - RNA, 24 nt, Human
ccccgcuucgccuucuccuguucu

SEQ ID NO: 152277 - RNA, 19 nt, Human
ccccucauuccucucaccu

SEQ ID NO: 152278 - RNA, 19 nt, Human
ccccugcaucuucccucca

SEQ ID NO: 152279 - RNA, 22 nt, Human
cccucggcggugacucuccagg

SEQ ID NO: 152280 - RNA, 22 nt, Human
cccucucucccuuucuuccucc

SEQ ID NO: 152281 - RNA, 22 nt, Human
cccucucucccuuucuuccucc

SEQ ID NO: 152282 - RNA, 20 nt, Human
ccuggcccucucucccuuuc

SEQ ID NO: 152283 - RNA, 22 nt, Human
cguggccuggaggcagguggag

SEQ ID NO: 152284 - RNA, 22 nt, Human
cuccacccuaagcccaggcuuc

SEQ ID NO: 152285 - RNA, 18 nt, Human
cugcaucuucccuccagc

SEQ ID NO: 152286 - RNA, 22 nt, Human
cugccccucccaacccgccggg

SEQ ID NO: 152287 - RNA, 23 nt, Human
cuggcccucucucccuuucuucc

SEQ ID NO: 152288 - RNA, 19 nt, Human
cuggccgcuucccaccccu

SEQ ID NO: 152289 - RNA, 18 nt, Human
cuggggaagccgcagggc

SEQ ID NO: 152290 - RNA, 24 nt, Human
cugucaggagugaguaugggaggg

SEQ ID NO: 152291 - RNA, 23 nt, Human
gaaagcagcuggcgcguuccccc

SEQ ID NO: 152292 - RNA, 18 nt, Human
gaaagcagcugggggggc

SEQ ID NO: 152293 - RNA, 20 nt, Human
gaagagcagcugggagugug

SEQ ID NO: 152294 - RNA, 22 nt, Human
gagcaaaaggcuuggaagcucg

SEQ ID NO: 152295 - RNA, 23 nt, Human
gagcagcugggagugugggggcc

SEQ ID NO: 152296 - RNA, 19 nt, Human
gcaagcugaaguggagggg

SEQ ID NO: 152297 - RNA, 19 nt, Human
gccacacaggcagcagggu

SEQ ID NO: 152298 - RNA, 23 nt, Human
gcccggugccuggcuuagugcug

SEQ ID NO: 152299 - RNA, 20 nt, Human
gcccucucucccuuucuucc

SEQ ID NO: 152300 - RNA, 21 nt, Human
gcugcagugcaggaaagcugg

SEQ ID NO: 152301 - RNA, 19 nt, Human
ggacuggaaagaagucaag

SEQ ID NO: 152302 - RNA, 23 nt, Human
ggagcaaaaggcuuggaagcucg

SEQ ID NO: 152303 - RNA, 24 nt, Human
ggagcucuuucugccuggccgcuu

SEQ ID NO: 152304 - RNA, 21 nt, Human
ggcaggagcaauacccagacc

SEQ ID NO: 152305 - RNA, 23 nt, Human
ggcaggagcaauacccagaccug

SEQ ID NO: 152306 - RNA, 21 nt, Human
ggcgacacaagagccuggagc

SEQ ID NO: 152307 - RNA, 21 nt, Human
gggaaaaacccugaagcagca

SEQ ID NO: 152308 - RNA, 18 nt, Human
gggagggccagggacgag

SEQ ID NO: 152309 - RNA, 21 nt, Human
gggccagggacgagagcagga

SEQ ID NO: 152310 - RNA, 21 nt, Human
gggcugggugggcgacacaag

SEQ ID NO: 152311 - RNA, 22 nt, Human
ggggugaggggcagggagaggg

SEQ ID NO: 152312 - RNA, 21 nt, Human
ggggugcguggguguaggugu

SEQ ID NO: 152313 - RNA, 19 nt, Human
gguccagccaggcugaggc

SEQ ID NO: 152314 - RNA, 19 nt, Human
uaaccaccaaugccccuca

SEQ ID NO: 152315 - RNA, 18 nt, Human
uaccugaggaaaggagcc

SEQ ID NO: 152316 - RNA, 18 nt, Human
uaggcggcaucuccaccc

SEQ ID NO: 152317 - RNA, 24 nt, Human
uaugaaacgaggcaagucauccaa

SEQ ID NO: 152318 - RNA, 19 nt, Human
uaugggagggcuggguggg

SEQ ID NO: 152319 - RNA, 22 nt, Human
ucacugccggggacugcagagg

SEQ ID NO: 152320 - RNA, 21 nt, Human
uccaagggaggcggaaggccc

SEQ ID NO: 152321 - RNA, 25 nt, Human
ucccaccccugcaucuucccuccag

SEQ ID NO: 152322 - RNA, 22 nt, Human
ucgcggaggcugagcuggggcc

SEQ ID NO: 152323 - RNA, 20 nt, Human
ucugugugccagagcccaga

SEQ ID NO: 152324 - RNA, 24 nt, Human
ugaaacgaggcaagucauccaagc

SEQ ID NO: 152325 - RNA, 22 nt, Human
ugaggaaagcagcugggggggc

SEQ ID NO: 152326 - RNA, 18 nt, Human
ugaggaaaggagcccacc

SEQ ID NO: 152327 - RNA, 22 nt, Human
ugccagagcccagacuggcuuu

SEQ ID NO: 152328 - RNA, 21 nt, Human
ugcguggguguaggugugaga

SEQ ID NO: 152329 - RNA, 21 nt, Human
uggaaagaagucaagcugggg

SEQ ID NO: 152330 - RNA, 25 nt, Human
uggcccucucucccuuucuuccucc

SEQ ID NO: 152331 - RNA, 19 nt, Human
uggccucuugaccccaucc

SEQ ID NO: 152332 - RNA, 20 nt, Human
ugggagggcugggugggcga

SEQ ID NO: 152333 - RNA, 26 nt, Human
uggggugaggggcagggagagggcgg

SEQ ID NO: 152334 - RNA, 21 nt, Human
ugugagggggugcgugggugu

SEQ ID NO: 152335 - RNA, 21 nt, Human
ugugugagggggugcgugggu

SEQ ID NO: 152336 - RNA, 22 nt, Human
ugugugagggggugcgugggug

SEQ ID NO: 152337 - RNA, 21 nt, Human
uucccccgggcuggcgcgucc

SEQ ID NO: 152338 - RNA, 19 nt, Human
aaaaagaaaagcccuaccc

SEQ ID NO: 152339 - RNA, 19 nt, Human
aaaaguacuguuacucuaa

SEQ ID NO: 152340 - RNA, 18 nt, Human
aaaauuagcugggcaugg

SEQ ID NO: 152341 - RNA, 20 nt, Human
aaacacggcuggauuuagaa

SEQ ID NO: 152342 - RNA, 22 nt, Human
aaaccccgucucuacuaaaaaa

SEQ ID NO: 152343 - RNA, 19 nt, Human
aaagaaaagcccuacccuc

SEQ ID NO: 152344 - RNA, 24 nt, Human
aaagaaaggcucaaaauaaguuaa

SEQ ID NO: 152345 - RNA, 19 nt, Human
aaagacagaacaaggagga

SEQ ID NO: 152346 - RNA, 18 nt, Human
aaagaggaaauguuacaa

SEQ ID NO: 152347 - RNA, 19 nt, Human
aacauggugaaaccccguc

SEQ ID NO: 152348 - RNA, 20 nt, Human
aacauggugaaaccccgucu

SEQ ID NO: 152349 - RNA, 21 nt, Human
aacauggugaaaccccgucuc

SEQ ID NO: 152350 - RNA, 18 nt, Human
aacucagagucucaaaga

SEQ ID NO: 152351 - RNA, 22 nt, Human
aagcagaaguccagguugcuca

SEQ ID NO: 152352 - RNA, 18 nt, Human
aaggaaccaaaaguacug

SEQ ID NO: 152353 - RNA, 18 nt, Human
aaggcagaaaagucaagg

SEQ ID NO: 152354 - RNA, 24 nt, Human
aaucucuugaacccaggaggcgga

SEQ ID NO: 152355 - RNA, 23 nt, Human
acaacagauaaaaccaucauuua

SEQ ID NO: 152356 - RNA, 25 nt, Human
acaacagauaaaaccaucauuuaaa

SEQ ID NO: 152357 - RNA, 19 nt, Human
acaagagugaaacuccauc

SEQ ID NO: 152358 - RNA, 20 nt, Human
acaagagugaaacuccaucu

SEQ ID NO: 152359 - RNA, 21 nt, Human
acaagagugaaacuccaucuc

SEQ ID NO: 152360 - RNA, 19 nt, Human
acaaggcagaaaagucaag

SEQ ID NO: 152361 - RNA, 19 nt, Human
acagaacaaggaggaauca

SEQ ID NO: 152362 - RNA, 18 nt, Human
acagcccagguucuugcc

SEQ ID NO: 152363 - RNA, 22 nt, Human
accaaaaguacuguuacucuaa

SEQ ID NO: 152364 - RNA, 24 nt, Human
acccaggaggcggagguugcagug

SEQ ID NO: 152365 - RNA, 23 nt, Human
accccgucucuacuaaaaaacaa

SEQ ID NO: 152366 - RNA, 25 nt, Human
acuccagccugggcaacaagaguga

SEQ ID NO: 152367 - RNA, 18 nt, Human
agacaggagaacucaagg

SEQ ID NO: 152368 - RNA, 23 nt, Human
agagcuccuucuaugcgucccuu

SEQ ID NO: 152369 - RNA, 23 nt, Human
agcacuuuggaggcagagguggg

SEQ ID NO: 152370 - RNA, 22 nt, Human
agccuggccaacauggugaaac

SEQ ID NO: 152371 - RNA, 24 nt, Human
agccuggccaacauggugaaaccc

SEQ ID NO: 152372 - RNA, 21 nt, Human
agccuguaauccagcacuuug

SEQ ID NO: 152373 - RNA, 22 nt, Human
agccuguaaucccagcuacugg

SEQ ID NO: 152374 - RNA, 23 nt, Human
agccuguaaucccagcuacuggg

SEQ ID NO: 152375 - RNA, 23 nt, Human
agcugggcaugguggcaugagcc

SEQ ID NO: 152376 - RNA, 22 nt, Human
aggaaccaaaaguacuguuacu

SEQ ID NO: 152377 - RNA, 21 nt, Human
aggcagagguggguggaucac

SEQ ID NO: 152378 - RNA, 23 nt, Human
aggcaggagaaucucuugaaccc

SEQ ID NO: 152379 - RNA, 24 nt, Human
aggcaggagaaucucuugaaccca

SEQ ID NO: 152380 - RNA, 21 nt, Human
aggcggagguugcagugagcc

SEQ ID NO: 152381 - RNA, 24 nt, Human
aggcggagguugcagugagccgag

SEQ ID NO: 152382 - RNA, 24 nt, Human
aggcugaggcaggagaaucucuug

SEQ ID NO: 152383 - RNA, 22 nt, Human
agguggguggaucaccugaggu

SEQ ID NO: 152384 - RNA, 24 nt, Human
aucaugcuauugcacuccagccug

SEQ ID NO: 152385 - RNA, 18 nt, Human
auugcacuccagccuggg

SEQ ID NO: 152386 - RNA, 23 nt, Human
auugcacuccagccugggcaaca

SEQ ID NO: 152387 - RNA, 24 nt, Human
auugcacuccagccugggcaacaa

SEQ ID NO: 152388 - RNA, 24 nt, Human
caacauggugaaaccccgucucua

SEQ ID NO: 152389 - RNA, 22 nt, Human
caauaacucagcuagagccaga

SEQ ID NO: 152390 - RNA, 28 nt, Human
cacaaggcagaaaagucaaggucauuua

SEQ ID NO: 152391 - RNA, 19 nt, Human
cacaguguaccacaguuaa

SEQ ID NO: 152392 - RNA, 20 nt, Human
cacauaugaccuggagaagc

SEQ ID NO: 152393 - RNA, 18 nt, Human
caccuggagaaacuucug

SEQ ID NO: 152394 - RNA, 23 nt, Human
cacggcuggauuuagaaaauaaa

SEQ ID NO: 152395 - RNA, 23 nt, Human
cacuccagccugggcaacaagag

SEQ ID NO: 152396 - RNA, 24 nt, Human
cacuccagccugggcaacaagagu

SEQ ID NO: 152397 - RNA, 25 nt, Human
cacuccagccugggcaacaagagug

SEQ ID NO: 152398 - RNA, 23 nt, Human
cacuggcacuguguuccuagagc

SEQ ID NO: 152399 - RNA, 18 nt, Human
cacuuuugugacaaauau

SEQ ID NO: 152400 - RNA, 19 nt, Human
cagaaaagguuuucaguca

SEQ ID NO: 152401 - RNA, 22 nt, Human
cagagguggguggaucaccuga

SEQ ID NO: 152402 - RNA, 25 nt, Human
cagagguggguggaucaccugaggu

SEQ ID NO: 152403 - RNA, 23 nt, Human
cagcacuuuggaggcagaggugg

SEQ ID NO: 152404 - RNA, 22 nt, Human
cauaugaccuggagaagcuggu

SEQ ID NO: 152405 - RNA, 25 nt, Human
cauauggaaaaagaaaagcccuacc

SEQ ID NO: 152406 - RNA, 23 nt, Human
caucacuuucugcaaagcauuua

SEQ ID NO: 152407 - RNA, 18 nt, Human
ccaaaaguacuguuacuc

SEQ ID NO: 152408 - RNA, 24 nt, Human
ccaaaccagggugguagcucagcc

SEQ ID NO: 152409 - RNA, 22 nt, Human
ccaccuggagaaacuucugcac

SEQ ID NO: 152410 - RNA, 18 nt, Human
cccgccagcuuucuggcc

SEQ ID NO: 152411 - RNA, 20 nt, Human
ccucaagggugaaccacuuc

SEQ ID NO: 152412 - RNA, 24 nt, Human
ccucaauaacucagcuagagccag

SEQ ID NO: 152413 - RNA, 21 nt, Human
ccuggagaagcugguuguggu

SEQ ID NO: 152414 - RNA, 23 nt, Human
ccuggccaacauggugaaacccc

SEQ ID NO: 152415 - RNA, 24 nt, Human
ccuggccaacauggugaaaccccg

SEQ ID NO: 152416 - RNA, 22 nt, Human
ccuguaaucccagcuacugggg

SEQ ID NO: 152417 - RNA, 24 nt, Human
cgagaucaugcuauugcacuccag

SEQ ID NO: 152418 - RNA, 19 nt, Human
cgucccucccaagugauuu

SEQ ID NO: 152419 - RNA, 24 nt, Human
cgugacuagccuggccaacauggu

SEQ ID NO: 152420 - RNA, 20 nt, Human
cuauugcacuccagccuggg

SEQ ID NO: 152421 - RNA, 21 nt, Human
cuauugcacuccagccugggc

SEQ ID NO: 152422 - RNA, 24 nt, Human
cuauugcacuccagccugggcaac

SEQ ID NO: 152423 - RNA, 19 nt, Human
cucaaggaaccaaaaguac

SEQ ID NO: 152424 - RNA, 23 nt, Human
gagacaggagaacucaaggaacc

SEQ ID NO: 152425 - RNA, 30 nt, Human
gaggcagagguggguggaucaccugagguu

SEQ ID NO: 152426 - RNA, 22 nt, Human
gagguugcagugagccgagauc

SEQ ID NO: 152427 - RNA, 23 nt, Human
gaucaccugagguuaggaguucg

SEQ ID NO: 152428 - RNA, 22 nt, Human
gcaggagaaucucuugaaccca

SEQ ID NO: 152429 - RNA, 24 nt, Human
gccaacauggugaaaccccgucuc

SEQ ID NO: 152430 - RNA, 25 nt, Human
gcgucccucccaagugauuuaauuu

SEQ ID NO: 152431 - RNA, 22 nt, Human
gcuauugcacuccagccugggc

SEQ ID NO: 152432 - RNA, 24 nt, Human
gcuauugcacuccagccugggcaa

SEQ ID NO: 152433 - RNA, 20 nt, Human
ggaaagggaggccaccugga

SEQ ID NO: 152434 - RNA, 22 nt, Human
ggaggcggagguugcagugagc

SEQ ID NO: 152435 - RNA, 18 nt, Human
ggagguugcagugagccg

SEQ ID NO: 152436 - RNA, 20 nt, Human
ggagguugcagugagccgag

SEQ ID NO: 152437 - RNA, 22 nt, Human
ggagguugcagugagccgagau

SEQ ID NO: 152438 - RNA, 23 nt, Human
ggagguugcagugagccgagauc

SEQ ID NO: 152439 - RNA, 24 nt, Human
ggagguugcagugagccgagauca

SEQ ID NO: 152440 - RNA, 19 nt, Human
ggccugggugcuuaggggg

SEQ ID NO: 152441 - RNA, 24 nt, Human
gggcaugguggcaugagccuguaa

SEQ ID NO: 152442 - RNA, 24 nt, Human
gguggcaugagccuguaaucccag

SEQ ID NO: 152443 - RNA, 23 nt, Human
guacuguuacucuaagucucaga

SEQ ID NO: 152444 - RNA, 22 nt, Human
uaaccuacuacauaauaaucua

SEQ ID NO: 152445 - RNA, 27 nt, Human
uaacguugcacuggcucaauccucaau

SEQ ID NO: 152446 - RNA, 19 nt, Human
uaacugcuauacauucugg

SEQ ID NO: 152447 - RNA, 20 nt, Human
uaaggguuagaguaauguuu

SEQ ID NO: 152448 - RNA, 22 nt, Human
uaccuuauauaaaucaccaauc

SEQ ID NO: 152449 - RNA, 21 nt, Human
uagaacguagagaaaaauuuu

SEQ ID NO: 152450 - RNA, 24 nt, Human
uagccuggccaacauggugaaacc

SEQ ID NO: 152451 - RNA, 20 nt, Human
uagcugggcaugguggcaug

SEQ ID NO: 152452 - RNA, 22 nt, Human
uauaaugguuuccugaaguuau

SEQ ID NO: 152453 - RNA, 21 nt, Human
uaugaaaauaggcaacaguga

SEQ ID NO: 152454 - RNA, 24 nt, Human
uauugcacuccagccugggcaaca

SEQ ID NO: 152455 - RNA, 24 nt, Human
ucacaaggcagaaaagucaagguc

SEQ ID NO: 152456 - RNA, 22 nt, Human
ucagaaaaaaaaaaaaaaaaaa

SEQ ID NO: 152457 - RNA, 19 nt, Human
ucagcuagagccagauaca

SEQ ID NO: 152458 - RNA, 21 nt, Human
ucaguggaagucaaaacaagg

SEQ ID NO: 152459 - RNA, 18 nt, Human
ucauaaaagaaaggcuca

SEQ ID NO: 152460 - RNA, 23 nt, Human
ucaugcuauugcacuccagccug

SEQ ID NO: 152461 - RNA, 19 nt, Human
ucauuagucuuggcuauuu

SEQ ID NO: 152462 - RNA, 23 nt, Human
uccaucucagaaaaaaaaaaaaa

SEQ ID NO: 152463 - RNA, 19 nt, Human
ucccuaaaauaagcuugaa

SEQ ID NO: 152464 - RNA, 19 nt, Human
ucuggagacaggagaacuc

SEQ ID NO: 152465 - RNA, 24 nt, Human
ucuuaaaaaaguauuuuaguccuu

SEQ ID NO: 152466 - RNA, 25 nt, Human
ugacauauggaaaaagaaaagcccu

SEQ ID NO: 152467 - RNA, 21 nt, Human
ugaccuggagaagcugguugu

SEQ ID NO: 152468 - RNA, 22 nt, Human
ugagccgagaucaugcuauugc

SEQ ID NO: 152469 - RNA, 23 nt, Human
ugagccuguaaucccagcuacug

SEQ ID NO: 152470 - RNA, 24 nt, Human
ugagcuaaagagagcuauaaaggc

SEQ ID NO: 152471 - RNA, 20 nt, Human
ugaggcaggagaaucucuug

SEQ ID NO: 152472 - RNA, 24 nt, Human
ugaggcaggagaaucucuugaacc

SEQ ID NO: 152473 - RNA, 25 nt, Human
ugaggcaggagaaucucuugaaccc

SEQ ID NO: 152474 - RNA, 19 nt, Human
ugaguuaaaggcuaauuug

SEQ ID NO: 152475 - RNA, 24 nt, Human
ugcaaaacuagagaugucuccuaa

SEQ ID NO: 152476 - RNA, 18 nt, Human
ugcacuccagccugggca

SEQ ID NO: 152477 - RNA, 19 nt, Human
ugcacuccagccugggcaa

SEQ ID NO: 152478 - RNA, 19 nt, Human
ugcacuccagccugggcaa

SEQ ID NO: 152479 - RNA, 20 nt, Human
ugcacuccagccugggcaac

SEQ ID NO: 152480 - RNA, 22 nt, Human
ugcacuccagccugggcaacaa

SEQ ID NO: 152481 - RNA, 18 nt, Human
ugccuguggccugggugc

SEQ ID NO: 152482 - RNA, 20 nt, Human
ugccuguggccugggugcuu

SEQ ID NO: 152483 - RNA, 24 nt, Human
ugcuauugcacuccagccugggca

SEQ ID NO: 152484 - RNA, 21 nt, Human
uggaaagggaggccaccugga

SEQ ID NO: 152485 - RNA, 18 nt, Human
uggaggcagaggugggug

SEQ ID NO: 152486 - RNA, 24 nt, Human
uggaucaccugagguuaggaguuc

SEQ ID NO: 152487 - RNA, 22 nt, Human
uggcaugagccuguaaucccag

SEQ ID NO: 152488 - RNA, 24 nt, Human
uggccaacauggugaaaccccguc

SEQ ID NO: 152489 - RNA, 20 nt, Human
uggccugggugcuuaggggg

SEQ ID NO: 152490 - RNA, 19 nt, Human
uggcucaauccucaauaac

SEQ ID NO: 152491 - RNA, 18 nt, Human
ugggcaugguggcaugag

SEQ ID NO: 152492 - RNA, 24 nt, Human
uggguggaucaccugagguuagga

SEQ ID NO: 152493 - RNA, 24 nt, Human
ugguggcaugagccuguaauccca

SEQ ID NO: 152494 - RNA, 20 nt, Human
ugguguaaggucaucacuuu

SEQ ID NO: 152495 - RNA, 27 nt, Human
uguaaucaacauauuucacaguguacc

SEQ ID NO: 152496 - RNA, 21 nt, Human
uguacauuguuggaaagggag

SEQ ID NO: 152497 - RNA, 18 nt, Human
uuagcugggcaugguggc

SEQ ID NO: 152498 - RNA, 21 nt, Human
uucacaaggcagaaaagucaa

SEQ ID NO: 152499 - RNA, 24 nt, Human
uugaacccaggaggcggagguugc

SEQ ID NO: 152500 - RNA, 21 nt, Human
uugcaaaacuagagaugucuc

SEQ ID NO: 152501 - RNA, 20 nt, Human
uugcagugagccgagaucau

SEQ ID NO: 152502 - RNA, 21 nt, Human
uugcagugagccgagaucaug

SEQ ID NO: 152503 - RNA, 22 nt, Human
uugcagugagccgagaucaugc

SEQ ID NO: 152504 - RNA, 19 nt, Human
uuggaggcagaggugggug

SEQ ID NO: 152505 - RNA, 19 nt, Human
uuucuggccaguaagcaga

SEQ ID NO: 152506 - RNA, 20 nt, Human
aggcagaaaaucauuuccug

SEQ ID NO: 152507 - RNA, 20 nt, Human
agguuuucuggggugcagag

SEQ ID NO: 152508 - RNA, 24 nt, Human
auguguauguauguauauauauua

SEQ ID NO: 152509 - RNA, 19 nt, Human
ccaccucccuuuuaaaaca

SEQ ID NO: 152510 - RNA, 23 nt, Human
cgaccuuggccccguccuugcuc

SEQ ID NO: 152511 - RNA, 19 nt, Human
cggggcgggccgggcgggg

SEQ ID NO: 152512 - RNA, 18 nt, Human
cuggcagguugugggaag

SEQ ID NO: 152513 - RNA, 25 nt, Human
cuucuacccccaccucccuuuuaaa

SEQ ID NO: 152514 - RNA, 26 nt, Human
gaucauccuuuuacuucuacccccac

SEQ ID NO: 152515 - RNA, 25 nt, Human
gcaggguucuccuuaaagcgggcag

SEQ ID NO: 152516 - RNA, 19 nt, Human
gcauggggugagaggaggg

SEQ ID NO: 152517 - RNA, 20 nt, Human
gcucccucccaugaucaucc

SEQ ID NO: 152518 - RNA, 21 nt, Human
ggcauggggugagaggaggga

SEQ ID NO: 152519 - RNA, 19 nt, Human
gggcauggggugagaggag

SEQ ID NO: 152520 - RNA, 21 nt, Human
gggcauggggugagaggaggg

SEQ ID NO: 152521 - RNA, 22 nt, Human
gggccgggaccugggaccuggg

SEQ ID NO: 152522 - RNA, 23 nt, Human
gggccgggaccugggaccuggga

SEQ ID NO: 152523 - RNA, 18 nt, Human
guauguauguauauauau

SEQ ID NO: 152524 - RNA, 20 nt, Human
guccuugcuccuugcacccu

SEQ ID NO: 152525 - RNA, 19 nt, Human
gugccugcagcccugaugg

SEQ ID NO: 152526 - RNA, 26 nt, Human
uacccccaccucccuuuuaaaacaaa

SEQ ID NO: 152527 - RNA, 25 nt, Human
uagucuggcagguugugggaagggg

SEQ ID NO: 152528 - RNA, 18 nt, Human
uauauauauguguaugua

SEQ ID NO: 152529 - RNA, 18 nt, Human
uauauguguauguaugua

SEQ ID NO: 152530 - RNA, 27 nt, Human
uauguauguauauauauuaaccccucc

SEQ ID NO: 152531 - RNA, 22 nt, Human
uauguguauguauguauauaua

SEQ ID NO: 152532 - RNA, 27 nt, Human
uccgggccgggaccugggaccugggac

SEQ ID NO: 152533 - RNA, 18 nt, Human
uccuugcuccuugcaccc

SEQ ID NO: 152534 - RNA, 22 nt, Human
ucuccuuaaagcgggcagaagc

SEQ ID NO: 152535 - RNA, 20 nt, Human
ugaccaugagcgaccuuggc

SEQ ID NO: 152536 - RNA, 22 nt, Human
ugaccaugagcgaccuuggccc

SEQ ID NO: 152537 - RNA, 24 nt, Human
ugaugggugggauggaggcagaaa

SEQ ID NO: 152538 - RNA, 20 nt, Human
ugcaagggacuaggagagcg

SEQ ID NO: 152539 - RNA, 23 nt, Human
ugccugcagcccugauggguggg

SEQ ID NO: 152540 - RNA, 24 nt, Human
uggaggcagaaaaucauuuccugu

SEQ ID NO: 152541 - RNA, 22 nt, Human
uggcagguugugggaaggggcg

SEQ ID NO: 152542 - RNA, 21 nt, Human
uggccccguccuugcuccuug

SEQ ID NO: 152543 - RNA, 20 nt, Human
uggcccggaugcagcgccag

SEQ ID NO: 152544 - RNA, 20 nt, Human
ugggaaggggcgcagggagu

SEQ ID NO: 152545 - RNA, 21 nt, Human
ugggaaggggcgcagggagug

SEQ ID NO: 152546 - RNA, 19 nt, Human
uguauguauguauauauau

SEQ ID NO: 152547 - RNA, 18 nt, Human
uguguauguauguauaua

SEQ ID NO: 152548 - RNA, 18 nt, Human
uguguauguauguauaua

SEQ ID NO: 152549 - RNA, 20 nt, Human
uguguauguauguauauaua

SEQ ID NO: 152550 - RNA, 21 nt, Human
uguguauguauguauauauau

SEQ ID NO: 152551 - RNA, 19 nt, Human
uugcacccugauugggcau

SEQ ID NO: 152552 - RNA, 24 nt, Human
uuuacaacaauauauauaugugua

SEQ ID NO: 152553 - RNA, 23 nt, Human
uuucuggggugcagagcaggguu

SEQ ID NO: 152554 - RNA, 24 nt, Human
uuuucuggggugcagagcaggguu

SEQ ID NO: 152555 - RNA, 22 nt, Human
aaaaucuuuaacacugacagaa

SEQ ID NO: 152556 - RNA, 22 nt, Human
aaccaagcaucuugcaaaggcc

SEQ ID NO: 152557 - RNA, 28 nt, Human
aagaaggcacuagagggacagggaccgc

SEQ ID NO: 152558 - RNA, 18 nt, Human
aagcaucuugcaaaggcc

SEQ ID NO: 152559 - RNA, 19 nt, Human
aaggcacuagagggacagg

SEQ ID NO: 152560 - RNA, 24 nt, Human
acaaccaagcaucuugcaaaggcc

SEQ ID NO: 152561 - RNA, 25 nt, Human
acaaccaagcaucuugcaaaggccc

SEQ ID NO: 152562 - RNA, 20 nt, Human
acacacacauucucuccacu

SEQ ID NO: 152563 - RNA, 22 nt, Human
acacacauucucuccacaaagu

SEQ ID NO: 152564 - RNA, 21 nt, Human
acccagucaaguucacagucu

SEQ ID NO: 152565 - RNA, 23 nt, Human
agaauagaaacuuauccaaaagg

SEQ ID NO: 152566 - RNA, 24 nt, Human
agaauagaaacuuauccaaaagga

SEQ ID NO: 152567 - RNA, 25 nt, Human
agagauggggccgacuggggcaugg

SEQ ID NO: 152568 - RNA, 18 nt, Human
agcagggaggccacucug

SEQ ID NO: 152569 - RNA, 20 nt, Human
aggcggagggaaggucggcu

SEQ ID NO: 152570 - RNA, 23 nt, Human
agggacagggaccgcuuuggguc

SEQ ID NO: 152571 - RNA, 24 nt, Human
agggacagggaccgcuuugggucu

SEQ ID NO: 152572 - RNA, 19 nt, Human
agggaggccacucuguuuc

SEQ ID NO: 152573 - RNA, 25 nt, Human
agggucuaaagaaggcacuagaggg

SEQ ID NO: 152574 - RNA, 22 nt, Human
auggccucaugugggagaaggc

SEQ ID NO: 152575 - RNA, 18 nt, Human
augucuguccgaaggcug

SEQ ID NO: 152576 - RNA, 25 nt, Human
cacaaccaagcaucuugcaaaggcc

SEQ ID NO: 152577 - RNA, 22 nt, Human
cacccgcacgccugcacgccgg

SEQ ID NO: 152578 - RNA, 18 nt, Human
cacccucuguccccagcc

SEQ ID NO: 152579 - RNA, 18 nt, Human
caccggucccugaguccc

SEQ ID NO: 152580 - RNA, 19 nt, Human
cagaauagaaacuuaucca

SEQ ID NO: 152581 - RNA, 21 nt, Human
cagucugcccucuuaguguga

SEQ ID NO: 152582 - RNA, 20 nt, Human
caguucaggccaggguguca

SEQ ID NO: 152583 - RNA, 21 nt, Human
cauccgagaccccucagcgga

SEQ ID NO: 152584 - RNA, 22 nt, Human
ccagcccagcaucccuggucau

SEQ ID NO: 152585 - RNA, 24 nt, Human
cccagcaucccuggucaucuccuc

SEQ ID NO: 152586 - RNA, 20 nt, Human
ccccccgagcccggcucccg

SEQ ID NO: 152587 - RNA, 19 nt, Human
cccgcacgccugcacgccg

SEQ ID NO: 152588 - RNA, 19 nt, Human
ccgaaggcuguggcggggc

SEQ ID NO: 152589 - RNA, 25 nt, Human
ccucaacacaaccaagcaucuugca

SEQ ID NO: 152590 - RNA, 21 nt, Human
ccucaugugggagaaggcgga

SEQ ID NO: 152591 - RNA, 22 nt, Human
cgcacacccgcacgccugcacg

SEQ ID NO: 152592 - RNA, 21 nt, Human
cucacgaauguuugacacccu

SEQ ID NO: 152593 - RNA, 21 nt, Human
cuccugcagcaccggucccug

SEQ ID NO: 152594 - RNA, 19 nt, Human
cugggccaagcccuccauc

SEQ ID NO: 152595 - RNA, 23 nt, Human
cuuggcgcugggccaagcccucc

SEQ ID NO: 152596 - RNA, 18 nt, Human
gaaggcacuagagggaca

SEQ ID NO: 152597 - RNA, 18 nt, Human
gcagggaggccacucugu

SEQ ID NO: 152598 - RNA, 23 nt, Human
gcccagcauggcacagcagggag

SEQ ID NO: 152599 - RNA, 24 nt, Human
gccucgguguccgcucccgcccgc

SEQ ID NO: 152600 - RNA, 23 nt, Human
gcggugccugcuaagugcucagc

SEQ ID NO: 152601 - RNA, 18 nt, Human
ggccgauggggcuccagc

SEQ ID NO: 152602 - RNA, 22 nt, Human
gggaugaggauggggcccgagg

SEQ ID NO: 152603 - RNA, 21 nt, Human
uaaaaaccucaacacaaccaa

SEQ ID NO: 152604 - RNA, 23 nt, Human
uacccuguuuacuuggcgcuggg

SEQ ID NO: 152605 - RNA, 19 nt, Human
uagagggacagggaccgcu

SEQ ID NO: 152606 - RNA, 18 nt, Human
uagugugaggaaaugggg

SEQ ID NO: 152607 - RNA, 26 nt, Human
uauuuaaaaaccucaacacaaccaag

SEQ ID NO: 152608 - RNA, 19 nt, Human
ucacagucugcccucuuag

SEQ ID NO: 152609 - RNA, 19 nt, Human
uccucaguucaggccaggg

SEQ ID NO: 152610 - RNA, 24 nt, Human
ucugcccucuuagugugaggaaau

SEQ ID NO: 152611 - RNA, 24 nt, Human
ugacagaauagaaacuuauccaaa

SEQ ID NO: 152612 - RNA, 19 nt, Human
ugagagauggggccgacug

SEQ ID NO: 152613 - RNA, 23 nt, Human
ugggagaaggcggagggaagguc

SEQ ID NO: 152614 - RNA, 23 nt, Human
uguccccagcccuggcggggccc

SEQ ID NO: 152615 - RNA, 21 nt, Human
uucaaguauucuuggccgaug

SEQ ID NO: 152616 - RNA, 20 nt, Human
uuuucuaacaauaaauauaa

SEQ ID NO: 152617 - RNA, 19 nt, Human
aaaaaaauaccccacccac

SEQ ID NO: 152618 - RNA, 19 nt, Human
aaaauaccccacccaccca

SEQ ID NO: 152619 - RNA, 21 nt, Human
aaacaccagugauacagagga

SEQ ID NO: 152620 - RNA, 19 nt, Human
aaauaccccacccacccau

SEQ ID NO: 152621 - RNA, 20 nt, Human
aaauaccuguuacagauuuc

SEQ ID NO: 152622 - RNA, 25 nt, Human
aacaauaaaaacaauucaaaagaaa

SEQ ID NO: 152623 - RNA, 22 nt, Human
aaccacagccaaaauaagugaa

SEQ ID NO: 152624 - RNA, 19 nt, Human
acaaaacagaucauauggu

SEQ ID NO: 152625 - RNA, 21 nt, Human
agagagcauuuggcacuuggc

SEQ ID NO: 152626 - RNA, 22 nt, Human
agcaagcucauaguuagccuuu

SEQ ID NO: 152627 - RNA, 19 nt, Human
agccaccacuuccguccag

SEQ ID NO: 152628 - RNA, 21 nt, Human
agccugauuugacuaaggaau

SEQ ID NO: 152629 - RNA, 21 nt, Human
aggggaaaauaaagaguuuuu

SEQ ID NO: 152630 - RNA, 23 nt, Human
auuccaaacacaaaauacuugau

SEQ ID NO: 152631 - RNA, 20 nt, Human
auugcuggagaaguuaccau

SEQ ID NO: 152632 - RNA, 21 nt, Human
caaggcauaaauagaaaacaa

SEQ ID NO: 152633 - RNA, 21 nt, Human
caccaaaacugcaccaugugc

SEQ ID NO: 152634 - RNA, 19 nt, Human
cacuggagauaaggaggag

SEQ ID NO: 152635 - RNA, 23 nt, Human
cagcucagcaaguuucagcaaca

SEQ ID NO: 152636 - RNA, 24 nt, Human
cauauccgaaggagcacaaucuaa

SEQ ID NO: 152637 - RNA, 22 nt, Human
cauaucuccaugaagcaugcca

SEQ ID NO: 152638 - RNA, 20 nt, Human
cauuguacaacauaaacaca

SEQ ID NO: 152639 - RNA, 20 nt, Human
cuaagucuuauuacacuaaa

SEQ ID NO: 152640 - RNA, 21 nt, Human
cucagcaaguuucagcaacaa

SEQ ID NO: 152641 - RNA, 19 nt, Human
cucauauuugagugucuua

SEQ ID NO: 152642 - RNA, 19 nt, Human
cugguacuaaugaucacaa

SEQ ID NO: 152643 - RNA, 22 nt, Human
gaaacaaaauaccuguuacaga

SEQ ID NO: 152644 - RNA, 25 nt, Human
gagcauuuggcacuuggcuguaaca

SEQ ID NO: 152645 - RNA, 20 nt, Human
gcaauuacaaaaaaauaccc

SEQ ID NO: 152646 - RNA, 29 nt, Human
ggaaaaggauuucauuuuuuaaaaauauu

SEQ ID NO: 152647 - RNA, 21 nt, Human
guacaacauaaacacauauug

SEQ ID NO: 152648 - RNA, 25 nt, Human
guacacuuauguuuacauauguaca

SEQ ID NO: 152649 - RNA, 21 nt, Human
gucuucagcgugcgcugaagc

SEQ ID NO: 152650 - RNA, 18 nt, Human
gugaaauagauucaacaa

SEQ ID NO: 152651 - RNA, 27 nt, Human
uaaacacauauugccaaucauaucaca

SEQ ID NO: 152652 - RNA, 22 nt, Human
uaacaauuuaaaaauguguagu

SEQ ID NO: 152653 - RNA, 20 nt, Human
uaacacggcuccuucacuaa

SEQ ID NO: 152654 - RNA, 19 nt, Human
uaagguaguaaauauggcc

SEQ ID NO: 152655 - RNA, 25 nt, Human
uaagugaaauagauucaacaauccu

SEQ ID NO: 152656 - RNA, 18 nt, Human
uaagugacuuuucaaagc

SEQ ID NO: 152657 - RNA, 18 nt, Human
uaauaguaagucuaaauc

SEQ ID NO: 152658 - RNA, 24 nt, Human
uacauggcuugauugauauuuagc

SEQ ID NO: 152659 - RNA, 19 nt, Human
uaccaugcuccgcucgcag

SEQ ID NO: 152660 - RNA, 23 nt, Human
uagaaaacaauaaaaacaauuca

SEQ ID NO: 152661 - RNA, 26 nt, Human
uagaaagaguaucaauagagcuaaaa

SEQ ID NO: 152662 - RNA, 19 nt, Human
uaguguaugaacaggaaaa

SEQ ID NO: 152663 - RNA, 18 nt, Human
uaugaacaggaaaaggau

SEQ ID NO: 152664 - RNA, 22 nt, Human
uauuacacuaaguugugagcau

SEQ ID NO: 152665 - RNA, 18 nt, Human
ucauaguuagccuuuaug

SEQ ID NO: 152666 - RNA, 25 nt, Human
ucauuauguuuauuauaaaaauaua

SEQ ID NO: 152667 - RNA, 19 nt, Human
uccaguaaauucaaagaag

SEQ ID NO: 152668 - RNA, 20 nt, Human
uccaguaaauucaaagaagu

SEQ ID NO: 152669 - RNA, 18 nt, Human
ucccuggguccuagugcc

SEQ ID NO: 152670 - RNA, 21 nt, Human
uccgcgaaccccgcucgggga

SEQ ID NO: 152671 - RNA, 18 nt, Human
ugagaaacaaucauaucc

SEQ ID NO: 152672 - RNA, 21 nt, Human
ugagaaauuucucuccugcuu

SEQ ID NO: 152673 - RNA, 20 nt, Human
ugagagagcauuuggcacuu

SEQ ID NO: 152674 - RNA, 24 nt, Human
ugagagauuugguuaguguaugaa

SEQ ID NO: 152675 - RNA, 20 nt, Human
ugcuacgccuuccacagcca

SEQ ID NO: 152676 - RNA, 19 nt, Human
ugcuagaugaccaacuauu

SEQ ID NO: 152677 - RNA, 18 nt, Human
ugcuggugcagagggcag

SEQ ID NO: 152678 - RNA, 19 nt, Human
uggagauaaggaggagucu

SEQ ID NO: 152679 - RNA, 20 nt, Human
uggccagauaguuugaggua

SEQ ID NO: 152680 - RNA, 18 nt, Human
ugguacauaacaucaugu

SEQ ID NO: 152681 - RNA, 26 nt, Human
uguccauuuuguuauuucacuugauc

SEQ ID NO: 152682 - RNA, 24 nt, Human
uuauuacacuaaaucuacaacaga

SEQ ID NO: 152683 - RNA, 20 nt, Human
uugacacuggagauaaggag

SEQ ID NO: 152684 - RNA, 23 nt, Human
uuuauguuuacugaaagucaaug

SEQ ID NO: 152685 - RNA, 19 nt, Human
aacggcccccgggaugggg

SEQ ID NO: 152686 - RNA, 18 nt, Human
aagacaggaucccccccc

SEQ ID NO: 152687 - RNA, 19 nt, Human
aagcagcggugagagccgg

SEQ ID NO: 152688 - RNA, 24 nt, Human
acacacaugcacgcacacagaggc

SEQ ID NO: 152689 - RNA, 18 nt, Human
acacgcucauaacaugca

SEQ ID NO: 152690 - RNA, 19 nt, Human
acaucauccaccaucaccc

SEQ ID NO: 152691 - RNA, 20 nt, Human
accacagagaggcagauccc

SEQ ID NO: 152692 - RNA, 23 nt, Human
acccugagagggaccacacacua

SEQ ID NO: 152693 - RNA, 18 nt, Human
acguggaggccccaggcu

SEQ ID NO: 152694 - RNA, 19 nt, Human
acuagagugaggggccaca

SEQ ID NO: 152695 - RNA, 21 nt, Human
acuagagugaggggccacacu

SEQ ID NO: 152696 - RNA, 18 nt, Human
acugaccgggaacccugu

SEQ ID NO: 152697 - RNA, 18 nt, Human
acugaguucccugcucac

SEQ ID NO: 152698 - RNA, 19 nt, Human
acugaguucccugcucaca

SEQ ID NO: 152699 - RNA, 18 nt, Human
agacaggauccccccccc

SEQ ID NO: 152700 - RNA, 23 nt, Human
agcugggcucgccacucccucug

SEQ ID NO: 152701 - RNA, 20 nt, Human
aggagggagagggggcucag

SEQ ID NO: 152702 - RNA, 23 nt, Human
aggcagagacgagggugggccug

SEQ ID NO: 152703 - RNA, 26 nt, Human
aggcaggcgagugauguccugguuuu

SEQ ID NO: 152704 - RNA, 24 nt, Human
aggcaucagaggcuagaggaggcu

SEQ ID NO: 152705 - RNA, 21 nt, Human
aggccuggggccgcccugccu

SEQ ID NO: 152706 - RNA, 21 nt, Human
aggcucuggaaaagagaaggu

SEQ ID NO: 152707 - RNA, 20 nt, Human
aggcugcugagcccccggcc

SEQ ID NO: 152708 - RNA, 23 nt, Human
aggggugggcugggugcugagaa

SEQ ID NO: 152709 - RNA, 21 nt, Human
agugcugguguccccgcggga

SEQ ID NO: 152710 - RNA, 20 nt, Human
aguggccccuggcuccagcc

SEQ ID NO: 152711 - RNA, 21 nt, Human
augacugugaggauccagagc

SEQ ID NO: 152712 - RNA, 23 nt, Human
auggggagggggggcagggcugg

SEQ ID NO: 152713 - RNA, 20 nt, Human
cacaucauccaccaucaccc

SEQ ID NO: 152714 - RNA, 19 nt, Human
cacaugagaucccaugacc

SEQ ID NO: 152715 - RNA, 23 nt, Human
caccaggguggccaccaaaggcc

SEQ ID NO: 152716 - RNA, 24 nt, Human
caccaucacccacaugugccucca

SEQ ID NO: 152717 - RNA, 18 nt, Human
cacccacaugugccucca

SEQ ID NO: 152718 - RNA, 19 nt, Human
caccccccaccacacacac

SEQ ID NO: 152719 - RNA, 19 nt, Human
caccccccaccacacacac

SEQ ID NO: 152720 - RNA, 20 nt, Human
caccccccaccacacacaca

SEQ ID NO: 152721 - RNA, 31 nt, Human
caccccccaccacacacacacaugcacgcag

SEQ ID NO: 152722 - RNA, 20 nt, Human
caccccucucuccaggccuu

SEQ ID NO: 152723 - RNA, 19 nt, Human
caggcucuggaaaagagaa

SEQ ID NO: 152724 - RNA, 21 nt, Human
cauaacaugcacacguccaug

SEQ ID NO: 152725 - RNA, 18 nt, Human
ccaagcccagcugaggac

SEQ ID NO: 152726 - RNA, 20 nt, Human
ccacacuuuugcaagugcca

SEQ ID NO: 152727 - RNA, 18 nt, Human
ccacaugugccuccagcc

SEQ ID NO: 152728 - RNA, 26 nt, Human
ccaccaucacccacaugugccuccag

SEQ ID NO: 152729 - RNA, 22 nt, Human
ccagaccugagauacagccggg

SEQ ID NO: 152730 - RNA, 21 nt, Human
ccagcaccugagaggagggca

SEQ ID NO: 152731 - RNA, 19 nt, Human
ccagccuccaggugugggg

SEQ ID NO: 152732 - RNA, 23 nt, Human
ccagguccuguggcgaagccuuc

SEQ ID NO: 152733 - RNA, 21 nt, Human
cccacaugugccuccagccuu

SEQ ID NO: 152734 - RNA, 18 nt, Human
ccccaccacacacacaca

SEQ ID NO: 152735 - RNA, 29 nt, Human
ccccaccacacacacacaugcacgcacac

SEQ ID NO: 152736 - RNA, 26 nt, Human
cccccagcgcccuugugggauggugu

SEQ ID NO: 152737 - RNA, 18 nt, Human
ccccuggcuccagccucc

SEQ ID NO: 152738 - RNA, 21 nt, Human
cccgcccccaugggugcugga

SEQ ID NO: 152739 - RNA, 19 nt, Human
cccgcgcgucgggagggag

SEQ ID NO: 152740 - RNA, 22 nt, Human
cccgcgcgucgggagggagcgc

SEQ ID NO: 152741 - RNA, 19 nt, Human
cccggcccuggccaggcag

SEQ ID NO: 152742 - RNA, 18 nt, Human
cccugauccuaggccugg

SEQ ID NO: 152743 - RNA, 19 nt, Human
cccugauccuaggccuggg

SEQ ID NO: 152744 - RNA, 20 nt, Human
cccugcucacacaccuccuc

SEQ ID NO: 152745 - RNA, 21 nt, Human
cccugggugcuuuuuaugugc

SEQ ID NO: 152746 - RNA, 22 nt, Human
ccuccagccuuaacggauaagc

SEQ ID NO: 152747 - RNA, 21 nt, Human
ccucggcuagagggaggaccc

SEQ ID NO: 152748 - RNA, 21 nt, Human
ccuggggccgcccugccugcu

SEQ ID NO: 152749 - RNA, 24 nt, Human
cgaagggguggacacacuugauca

SEQ ID NO: 152750 - RNA, 23 nt, Human
cgacuuccauaggaaggaagaac

SEQ ID NO: 152751 - RNA, 22 nt, Human
cgcggcaccuggauggggcuga

SEQ ID NO: 152752 - RNA, 22 nt, Human
cuaggccugggggacaaagggc

SEQ ID NO: 152753 - RNA, 27 nt, Human
cuccucauucaugacacaucauccacc

SEQ ID NO: 152754 - RNA, 22 nt, Human
cugagaggagggcagaggccug

SEQ ID NO: 152755 - RNA, 19 nt, Human
cugagcccccggcccuggc

SEQ ID NO: 152756 - RNA, 21 nt, Human
cugccaugaugccuccaugaa

SEQ ID NO: 152757 - RNA, 23 nt, Human
cugggcucgccacucccucuggg

SEQ ID NO: 152758 - RNA, 20 nt, Human
gacaagagccuuggcaggag

SEQ ID NO: 152759 - RNA, 18 nt, Human
gaccccugauaacuccag

SEQ ID NO: 152760 - RNA, 23 nt, Human
gaccugggccguggagggaaggc

SEQ ID NO: 152761 - RNA, 21 nt, Human
gaccuggggugggcuuggugg

SEQ ID NO: 152762 - RNA, 22 nt, Human
gaggacaucucaugugcucugc

SEQ ID NO: 152763 - RNA, 19 nt, Human
gaggucagugugagagggg

SEQ ID NO: 152764 - RNA, 18 nt, Human
gauccagagcccagaaau

SEQ ID NO: 152765 - RNA, 25 nt, Human
gcacacguccaugcugagacccgaa

SEQ ID NO: 152766 - RNA, 19 nt, Human
gccaagcccagcugaggac

SEQ ID NO: 152767 - RNA, 20 nt, Human
gccgcugcggcccgcgcguc

SEQ ID NO: 152768 - RNA, 19 nt, Human
gccgggccgggcgggcggg

SEQ ID NO: 152769 - RNA, 20 nt, Human
gccuccucggcuagagggag

SEQ ID NO: 152770 - RNA, 21 nt, Human
gcggcaccuggauggggcuga

SEQ ID NO: 152771 - RNA, 22 nt, Human
gcucagugcugguguccccgcg

SEQ ID NO: 152772 - RNA, 27 nt, Human
gcuggcagggggcacacggugggguuc

SEQ ID NO: 152773 - RNA, 23 nt, Human
ggaaaaaauauucugacauggua

SEQ ID NO: 152774 - RNA, 21 nt, Human
ggaaggggugggcugggugcu

SEQ ID NO: 152775 - RNA, 23 nt, Human
ggcagggcugggcagcugggcuc

SEQ ID NO: 152776 - RNA, 19 nt, Human
ggccuggggccgcccugcc

SEQ ID NO: 152777 - RNA, 24 nt, Human
ggcuauggggagggggggcagggc

SEQ ID NO: 152778 - RNA, 20 nt, Human
gggagcgcgcucccucgcuc

SEQ ID NO: 152779 - RNA, 19 nt, Human
gggagggggggcagggcug

SEQ ID NO: 152780 - RNA, 22 nt, Human
gggagggggggcagggcugggc

SEQ ID NO: 152781 - RNA, 19 nt, Human
gggcagggcugggcagcug

SEQ ID NO: 152782 - RNA, 25 nt, Human
gggcuuccagggcacuuccaccccc

SEQ ID NO: 152783 - RNA, 21 nt, Human
ggggagggggggcagggcugg

SEQ ID NO: 152784 - RNA, 22 nt, Human
gggugggguggggaggaagaca

SEQ ID NO: 152785 - RNA, 25 nt, Human
gggugggguggggaggaagacagga

SEQ ID NO: 152786 - RNA, 20 nt, Human
ggugggcugggugcugagaa

SEQ ID NO: 152787 - RNA, 29 nt, Human
gugaggaaaaaauauucugacaugguaga

SEQ ID NO: 152788 - RNA, 18 nt, Human
gugcuuugaagaccauuu

SEQ ID NO: 152789 - RNA, 18 nt, Human
gugcuuuuuaugugcuuu

SEQ ID NO: 152790 - RNA, 19 nt, Human
guggcugccugggcccugc

SEQ ID NO: 152791 - RNA, 23 nt, Human
gugugagaggggaggggcuucca

SEQ ID NO: 152792 - RNA, 21 nt, Human
guucacaugagaucccaugac

SEQ ID NO: 152793 - RNA, 25 nt, Human
uaacaugcacacguccaugcugaga

SEQ ID NO: 152794 - RNA, 27 nt, Human
uaagcacacgcucauaacaugcacacg

SEQ ID NO: 152795 - RNA, 18 nt, Human
uacaggaaggggugggcu

SEQ ID NO: 152796 - RNA, 24 nt, Human
uaggccugggggacaaagggcagg

SEQ ID NO: 152797 - RNA, 19 nt, Human
ucacacugaguucccugcu

SEQ ID NO: 152798 - RNA, 20 nt, Human
ucacaugagaucccaugacc

SEQ ID NO: 152799 - RNA, 20 nt, Human
ucagggcugggcauugaaag

SEQ ID NO: 152800 - RNA, 20 nt, Human
ucagugugagaggggagggg

SEQ ID NO: 152801 - RNA, 21 nt, Human
ucauccaccaucacccacaug

SEQ ID NO: 152802 - RNA, 26 nt, Human
uccacccccagcgcccuugugggaug

SEQ ID NO: 152803 - RNA, 21 nt, Human
uccaugacugugaggauccag

SEQ ID NO: 152804 - RNA, 24 nt, Human
uccaugacugugaggauccagagc

SEQ ID NO: 152805 - RNA, 21 nt, Human
uccaugcugagacccgaaggg

SEQ ID NO: 152806 - RNA, 20 nt, Human
ucccugauccuaggccuggg

SEQ ID NO: 152807 - RNA, 23 nt, Human
ucccugccugccaacggcccccg

SEQ ID NO: 152808 - RNA, 22 nt, Human
ucccugcucacacaccuccuca

SEQ ID NO: 152809 - RNA, 24 nt, Human
uccuaggccugggggacaaagggc

SEQ ID NO: 152810 - RNA, 19 nt, Human
uccucggcuagagggagga

SEQ ID NO: 152811 - RNA, 21 nt, Human
uccucuggucccugauccuag

SEQ ID NO: 152812 - RNA, 19 nt, Human
ugaaagguuggcgaaggga

SEQ ID NO: 152813 - RNA, 22 nt, Human
ugacguggaggccccaggcucu

SEQ ID NO: 152814 - RNA, 20 nt, Human
ugacugugaggauccagagc

SEQ ID NO: 152815 - RNA, 21 nt, Human
ugagaagauaggauccucugg

SEQ ID NO: 152816 - RNA, 19 nt, Human
ugagaggagggcagaggcc

SEQ ID NO: 152817 - RNA, 22 nt, Human
ugagcccccggcccuggccagg

SEQ ID NO: 152818 - RNA, 22 nt, Human
ugaggauccagagcccagaaau

SEQ ID NO: 152819 - RNA, 18 nt, Human
ugauaacuccagguccug

SEQ ID NO: 152820 - RNA, 18 nt, Human
ugcaggagggagaggggg

SEQ ID NO: 152821 - RNA, 21 nt, Human
ugccaugaugccuccaugaag

SEQ ID NO: 152822 - RNA, 22 nt, Human
ugcccugggggacagguguccu

SEQ ID NO: 152823 - RNA, 19 nt, Human
ugccuccagccuuaacgga

SEQ ID NO: 152824 - RNA, 19 nt, Human
uggcagggggcacacggug

SEQ ID NO: 152825 - RNA, 21 nt, Human
uggccaccaaaggccccuucc

SEQ ID NO: 152826 - RNA, 19 nt, Human
uggccaggcagccaagccc

SEQ ID NO: 152827 - RNA, 19 nt, Human
uggccccuggcuccagccu

SEQ ID NO: 152828 - RNA, 26 nt, Human
uggcgaagggacuuugagugaggaga

SEQ ID NO: 152829 - RNA, 20 nt, Human
uggggaggaagacaggaucc

SEQ ID NO: 152830 - RNA, 21 nt, Human
uggggggacguaggggugagc

SEQ ID NO: 152831 - RNA, 21 nt, Human
uggggugggguggggaggaag

SEQ ID NO: 152832 - RNA, 21 nt, Human
ugguggcugccugggcccugc

SEQ ID NO: 152833 - RNA, 18 nt, Human
ugugagaggggaggggcu

SEQ ID NO: 152834 - RNA, 24 nt, Human
uuauugcaggagggagagggggcu

SEQ ID NO: 152835 - RNA, 21 nt, Human
uucccaggcgccugaccccug

SEQ ID NO: 152836 - RNA, 23 nt, Human
aaacaaaagaaaaacgagguuuu

SEQ ID NO: 152837 - RNA, 19 nt, Human
aacaugcuucugucacugg

SEQ ID NO: 152838 - RNA, 25 nt, Human
aagccgaggcagcagcgccgggaga

SEQ ID NO: 152839 - RNA, 19 nt, Human
aaggagaaaagaaaagaau

SEQ ID NO: 152840 - RNA, 22 nt, Human
aauuugugguuucuuuuuccuu

SEQ ID NO: 152841 - RNA, 21 nt, Human
acaucuggagacucaggagcu

SEQ ID NO: 152842 - RNA, 24 nt, Human
acccugguccuuuucccuccucuc

SEQ ID NO: 152843 - RNA, 23 nt, Human
agaacaacaucuggagacucagg

SEQ ID NO: 152844 - RNA, 19 nt, Human
agcuggguuuacucuuguu

SEQ ID NO: 152845 - RNA, 24 nt, Human
caaccucuggucccccuugacccu

SEQ ID NO: 152846 - RNA, 20 nt, Human
caucucaaacaugcuucugu

SEQ ID NO: 152847 - RNA, 20 nt, Human
caugcaguggucagcaaagu

SEQ ID NO: 152848 - RNA, 21 nt, Human
cccgcaggccgagaccaagcc

SEQ ID NO: 152849 - RNA, 22 nt, Human
cccggaccggacuucccggagc

SEQ ID NO: 152850 - RNA, 23 nt, Human
ccgcugcgcucuccgcggguggc

SEQ ID NO: 152851 - RNA, 18 nt, Human
ccuccuucccuuucuucc

SEQ ID NO: 152852 - RNA, 18 nt, Human
ccuccuucccuuucuucc

SEQ ID NO: 152853 - RNA, 24 nt, Human
ccucuccuuccccaagaaacaaga

SEQ ID NO: 152854 - RNA, 22 nt, Human
ccugugguugggcaacugcagc

SEQ ID NO: 152855 - RNA, 19 nt, Human
ccuuucuuccugugguugg

SEQ ID NO: 152856 - RNA, 18 nt, Human
ccuuuucccuccucuccu

SEQ ID NO: 152857 - RNA, 23 nt, Human
ccuuuucccuccucuccuucccc

SEQ ID NO: 152858 - RNA, 18 nt, Human
cgaggcagcagcgccggg

SEQ ID NO: 152859 - RNA, 20 nt, Human
cgcugcgugggcgugggcag

SEQ ID NO: 152860 - RNA, 21 nt, Human
cggagcgcugcgugggcgugg

SEQ ID NO: 152861 - RNA, 24 nt, Human
cuucuucaauaugaagacauuaau

SEQ ID NO: 152862 - RNA, 18 nt, Human
gaagggaggggacucuca

SEQ ID NO: 152863 - RNA, 18 nt, Human
gacagaacaacaucugga

SEQ ID NO: 152864 - RNA, 22 nt, Human
gcccggaccggacuucccggag

SEQ ID NO: 152865 - RNA, 19 nt, Human
gcggugcgggcgcgcgugg

SEQ ID NO: 152866 - RNA, 24 nt, Human
gcguggggcggugcgggcgcgcgu

SEQ ID NO: 152867 - RNA, 25 nt, Human
gggaggggacucucagggaggagua

SEQ ID NO: 152868 - RNA, 23 nt, Human
gggcgcgcgugggugugggugug

SEQ ID NO: 152869 - RNA, 20 nt, Human
guccuuuucccuccucucca

SEQ ID NO: 152870 - RNA, 18 nt, Human
gugaggaagaaaauggaa

SEQ ID NO: 152871 - RNA, 21 nt, Human
gugcgggcgcgcgugggugug

SEQ ID NO: 152872 - RNA, 20 nt, Human
guuucuuuuuccuuuuugca

SEQ ID NO: 152873 - RNA, 20 nt, Human
uaccuccuucccuuucuucc

SEQ ID NO: 152874 - RNA, 21 nt, Human
uacucuuguucuccugaugca

SEQ ID NO: 152875 - RNA, 21 nt, Human
uauauuugguuucccacggca

SEQ ID NO: 152876 - RNA, 22 nt, Human
uccaguacauuccacagugguc

SEQ ID NO: 152877 - RNA, 21 nt, Human
uccugugguugggcaacugca

SEQ ID NO: 152878 - RNA, 19 nt, Human
uccuuuucccuccucuccu

SEQ ID NO: 152879 - RNA, 22 nt, Human
ucuaccuccuucccuuucuucc

SEQ ID NO: 152880 - RNA, 22 nt, Human
ucuggagacucaggagcugggu

SEQ ID NO: 152881 - RNA, 19 nt, Human
ucuggucccccuugacccu

SEQ ID NO: 152882 - RNA, 22 nt, Human
ucuguuucuucccucuaccucc

SEQ ID NO: 152883 - RNA, 21 nt, Human
ugacagaacaacaucuggaga

SEQ ID NO: 152884 - RNA, 20 nt, Human
ugacccugguccuuuucccu

SEQ ID NO: 152885 - RNA, 18 nt, Human
ugagcaaagggaaacgag

SEQ ID NO: 152886 - RNA, 21 nt, Human
ugagcaaagggaaacgagugu

SEQ ID NO: 152887 - RNA, 24 nt, Human
ugcagaaaaugcaaacaaaagaaa

SEQ ID NO: 152888 - RNA, 20 nt, Human
ugcgugggcgugggcaggag

SEQ ID NO: 152889 - RNA, 19 nt, Human
ugggagaagggaggggacu

SEQ ID NO: 152890 - RNA, 20 nt, Human
ugggugugggugugcaugug

SEQ ID NO: 152891 - RNA, 18 nt, Human
uggugaggaagaaaaugg

SEQ ID NO: 152892 - RNA, 23 nt, Human
uguuugaagaaacuucccuacag

SEQ ID NO: 152893 - RNA, 18 nt, Human
uuauauauuugguuuccc

SEQ ID NO: 152894 - RNA, 21 nt, Human
uucacuucuguugaacaucac

SEQ ID NO: 152895 - RNA, 23 nt, Human
uuuuuccuuuuugcagaaaaugc

SEQ ID NO: 152896 - RNA, 28 nt, Human
aaaaaacaacccaacaaacaaacccccc

SEQ ID NO: 152897 - RNA, 28 nt, Human
aaaaaacaacccaacaaacaaacccccc

SEQ ID NO: 152898 - RNA, 22 nt, Human
aaaaaaccaaaaaacaaaaaac

SEQ ID NO: 152899 - RNA, 22 nt, Human
aaaaaaccaaaaaacaaaaaac

SEQ ID NO: 152900 - RNA, 22 nt, Human
aaaaauuggugaagguuaugaa

SEQ ID NO: 152901 - RNA, 21 nt, Human
aaaagaaacaacaaacaugug

SEQ ID NO: 152902 - RNA, 20 nt, Human
aaacaaacccccuaaaccaa

SEQ ID NO: 152903 - RNA, 20 nt, Human
aaacaaacccccuaaaccaa

SEQ ID NO: 152904 - RNA, 22 nt, Human
aaacaaacccccuaaaccaaaa

SEQ ID NO: 152905 - RNA, 22 nt, Human
aaacaaacccccuaaaccaaaa

SEQ ID NO: 152906 - RNA, 22 nt, Human
aaacaacccaacaaacaaaccc

SEQ ID NO: 152907 - RNA, 22 nt, Human
aaacaacccaacaaacaaaccc

SEQ ID NO: 152908 - RNA, 23 nt, Human
aaaccaaaaccacccugugacca

SEQ ID NO: 152909 - RNA, 23 nt, Human
aaaccaaaaccacccugugacca

SEQ ID NO: 152910 - RNA, 21 nt, Human
aaaccacccugugaccaaaau

SEQ ID NO: 152911 - RNA, 21 nt, Human
aaaccacccugugaccaaaau

SEQ ID NO: 152912 - RNA, 25 nt, Human
aaacccccuaaaccaaaaccacccu

SEQ ID NO: 152913 - RNA, 25 nt, Human
aaacccccuaaaccaaaaccacccu

SEQ ID NO: 152914 - RNA, 24 nt, Human
aacaaacaaacccccuaaaccaaa

SEQ ID NO: 152915 - RNA, 24 nt, Human
aacaaacaaacccccuaaaccaaa

SEQ ID NO: 152916 - RNA, 25 nt, Human
aacaaacauguggccaacaaacaua

SEQ ID NO: 152917 - RNA, 26 nt, Human
aacaacaaacauguggccaacaaaca

SEQ ID NO: 152918 - RNA, 27 nt, Human
aacaacaaacauguggccaacaaacau

SEQ ID NO: 152919 - RNA, 24 nt, Human
aacaacccaacaaacaaacccccu

SEQ ID NO: 152920 - RNA, 24 nt, Human
aacaaccucaucaaaaauugguga

SEQ ID NO: 152921 - RNA, 19 nt, Human
aaccaaaaaacaaaaaaca

SEQ ID NO: 152922 - RNA, 19 nt, Human
aaccaaaaaacaaaaaaca

SEQ ID NO: 152923 - RNA, 20 nt, Human
aaccaaaaaacaaaaaacaa

SEQ ID NO: 152924 - RNA, 20 nt, Human
aaccaaaaaacaaaaaacaa

SEQ ID NO: 152925 - RNA, 23 nt, Human
aaccagaaaaaccauuugaccca

SEQ ID NO: 152926 - RNA, 24 nt, Human
aaccagaaaaaccauuugacccag

SEQ ID NO: 152927 - RNA, 23 nt, Human
aacccacaaugagauaccaucuc

SEQ ID NO: 152928 - RNA, 20 nt, Human
aacuugguuucauucucccu

SEQ ID NO: 152929 - RNA, 20 nt, Human
aauagauuuucccagagggg

SEQ ID NO: 152930 - RNA, 23 nt, Human
aauugcuguaaacaaacccagau

SEQ ID NO: 152931 - RNA, 23 nt, Human
aauugcuguaaacaaacccagau

SEQ ID NO: 152932 - RNA, 22 nt, Human
acaaaaaacaacccaacaaaca

SEQ ID NO: 152933 - RNA, 22 nt, Human
acaaaaaacaacccaacaaaca

SEQ ID NO: 152934 - RNA, 18 nt, Human
acaaacaaccucaucaaa

SEQ ID NO: 152935 - RNA, 25 nt, Human
acaacaaacauguggccaacaaaca

SEQ ID NO: 152936 - RNA, 19 nt, Human
acaacccaacaaacaaacc

SEQ ID NO: 152937 - RNA, 19 nt, Human
acaacccaacaaacaaacc

SEQ ID NO: 152938 - RNA, 23 nt, Human
acaacccaacaaacaaacccccu

SEQ ID NO: 152939 - RNA, 21 nt, Human
accaaaaaacaaaaaacaacc

SEQ ID NO: 152940 - RNA, 21 nt, Human
accaaaaaacaaaaaacaacc

SEQ ID NO: 152941 - RNA, 27 nt, Human
agaaaagaacaaacaaccucaucaaaa

SEQ ID NO: 152942 - RNA, 18 nt, Human
agauagauuggggcagga

SEQ ID NO: 152943 - RNA, 21 nt, Human
agauagauuggggcaggagag

SEQ ID NO: 152944 - RNA, 20 nt, Human
agauuggggcaggagagugg

SEQ ID NO: 152945 - RNA, 18 nt, Human
agcaaaggucuggugggg

SEQ ID NO: 152946 - RNA, 19 nt, Human
agccaagggcggccccugu

SEQ ID NO: 152947 - RNA, 20 nt, Human
agccaagggcggccccuguc

SEQ ID NO: 152948 - RNA, 20 nt, Human
agggaagagugucaaugaaa

SEQ ID NO: 152949 - RNA, 19 nt, Human
agggcacucaggagccuca

SEQ ID NO: 152950 - RNA, 24 nt, Human
agggguucucaggguggcugucug

SEQ ID NO: 152951 - RNA, 24 nt, Human
agggguucucaggguggcugucug

SEQ ID NO: 152952 - RNA, 19 nt, Human
aggugggaggagggaagag

SEQ ID NO: 152953 - RNA, 24 nt, Human
aguggcuggcccugcaguggauag

SEQ ID NO: 152954 - RNA, 18 nt, Human
auagagcaccaggagggc

SEQ ID NO: 152955 - RNA, 23 nt, Human
auuucuccuuugcuuaugaagcu

SEQ ID NO: 152956 - RNA, 30 nt, Human
caaaaaacaacccaacaaacaaaccccccc

SEQ ID NO: 152957 - RNA, 30 nt, Human; identical to SEQ ID NO: 152956

SEQ ID NO: 152958 - RNA, 18 nt, Human
caaaaccacccugugacc

SEQ ID NO: 152959 - RNA, 18 nt, Human
caaaaccacccugugacc

SEQ ID NO: 152960 - RNA, 19 nt, Human
caaaaccacccugugacca

SEQ ID NO: 152961 - RNA, 19 nt, Human
caaaaccacccugugacca

SEQ ID NO: 152962 - RNA, 20 nt, Human
caaaaccacccugugaccaa

SEQ ID NO: 152963 - RNA, 20 nt, Human
caaaaccacccugugaccaa

SEQ ID NO: 152964 - RNA, 22 nt, Human
caaaauacccccgaguccagga

SEQ ID NO: 152965 - RNA, 22 nt, Human
caaaauacccccgaguccagga

SEQ ID NO: 152966 - RNA, 25 nt, Human
caaacccccuaaaccaaaaccaccc

SEQ ID NO: 152967 - RNA, 26 nt, Human
caaacccccuaaaccaaaaccacccu

SEQ ID NO: 152968 - RNA, 25 nt, Human
caacccaacaaacaaacccccuaaa

SEQ ID NO: 152969 - RNA, 25 nt, Human
caacccaacaaacaaacccccuaaa

SEQ ID NO: 152970 - RNA, 22 nt, Human
caagaaaagaacaaacaaccuc

SEQ ID NO: 152971 - RNA, 27 nt, Human
caaguccucaaaagguaggaaauguca

SEQ ID NO: 152972 - RNA, 25 nt, Human
cacaaugagauaccaucucacacca

SEQ ID NO: 152973 - RNA, 19 nt, Human
cacacccaaaucucacucc

SEQ ID NO: 152974 - RNA, 21 nt, Human
cacacuuucucuccagggaag

SEQ ID NO: 152975 - RNA, 18 nt, Human
cacgugagaugggucucc

SEQ ID NO: 152976 - RNA, 19 nt, Human
cagaucccuagacugaggg

SEQ ID NO: 152977 - RNA, 19 nt, Human
cagcaaaggucuggugggg

SEQ ID NO: 152978 - RNA, 21 nt, Human
cagccucagagcccacuuccu

SEQ ID NO: 152979 - RNA, 20 nt, Human
cagcggcagucggagcugac

SEQ ID NO: 152980 - RNA, 20 nt, Human
cagcggcagucggagcugac

SEQ ID NO: 152981 - RNA, 19 nt, Human
caggaaacaacagaugcug

SEQ ID NO: 152982 - RNA, 23 nt, Human
caggaaacaacagaugcuggaga

SEQ ID NO: 152983 - RNA, 22 nt, Human
caggaucaacccuucucagcgg

SEQ ID NO: 152984 - RNA, 23 nt, Human
caggggcuggcgggagugggcac

SEQ ID NO: 152985 - RNA, 23 nt, Human
caggggcuggcgggagugggcac

SEQ ID NO: 152986 - RNA, 19 nt, Human
cagucggagcugacggcag

SEQ ID NO: 152987 - RNA, 19 nt, Human
cagucggagcugacggcag

SEQ ID NO: 152988 - RNA, 22 nt, Human
cagugucuuucauuggaguuuc

SEQ ID NO: 152989 - RNA, 22 nt, Human
cagugucuuucauuggaguuuc

SEQ ID NO: 152990 - RNA, 21 nt, Human
cauggccaagaccuuuaggcc

SEQ ID NO: 152991 - RNA, 23 nt, Human
cauggccaagaccuuuaggcccc

SEQ ID NO: 152992 - RNA, 21 nt, Human
cauuaaaaagucaggaaacaa

SEQ ID NO: 152993 - RNA, 20 nt, Human
ccaaaaaacaaaaaacaacc

SEQ ID NO: 152994 - RNA, 20 nt, Human
ccaaaaaacaaaaaacaacc

SEQ ID NO: 152995 - RNA, 24 nt, Human
ccaaaauacccccgaguccaggaa

SEQ ID NO: 152996 - RNA, 25 nt, Human
ccaaaauacccccgaguccaggaau

SEQ ID NO: 152997 - RNA, 23 nt, Human
ccacacccaaaucucacuccagu

SEQ ID NO: 152998 - RNA, 18 nt, Human
ccagauggccccauggca

SEQ ID NO: 152999 - RNA, 22 nt, Human
cccaacaaacaaacccccuaaa

SEQ ID NO: 153000 - RNA, 22 nt, Human
cccaacaaacaaacccccuaaa

SEQ ID NO: 153001 - RNA, 25 nt, Human
cccaacaaacaaacccccuaaacca

SEQ ID NO: 153002 - RNA, 25 nt, Human
cccaacaaacaaacccccuaaacca

SEQ ID NO: 153003 - RNA, 30 nt, Human
cccaacaaacaaacccccuaaaccaaaacc

SEQ ID NO: 153004 - RNA, 30 nt, Human; identical to SEQ ID NO: 153003

SEQ ID NO: 153005 - RNA, 20 nt, Human
cccagcaaaggucugguggg

SEQ ID NO: 153006 - RNA, 22 nt, Human
cccauggccaagaccuuuaggc

SEQ ID NO: 153007 - RNA, 20 nt, Human
cccauucccuuuuuuuuucc

SEQ ID NO: 153008 - RNA, 19 nt, Human
ccccgaguccaggaauugc

SEQ ID NO: 153009 - RNA, 19 nt, Human
ccccgaguccaggaauugc

SEQ ID NO: 153010 - RNA, 27 nt, Human
ccccuaaaccaaaaccacccugugacc

SEQ ID NO: 153011 - RNA, 27 nt, Human
ccccuaaaccaaaaccacccugugacc

SEQ ID NO: 153012 - RNA, 21 nt, Human
ccccugucucuccccuucaca

SEQ ID NO: 153013 - RNA, 21 nt, Human
ccccugucucuccccuucaca

SEQ ID NO: 153014 - RNA, 26 nt, Human
cccuccacacccaaaucucacuccag

SEQ ID NO: 153015 - RNA, 22 nt, Human
cccucuggagggcaggguauca

SEQ ID NO: 153016 - RNA, 23 nt, Human
cccugcaguggauagagcaccag

SEQ ID NO: 153017 - RNA, 22 nt, Human
ccgauuggacacaucgcaugaa

SEQ ID NO: 153018 - RNA, 22 nt, Human
ccgauuggacacaucgcaugaa

SEQ ID NO: 153019 - RNA, 22 nt, Human
ccuaaaccaaaaccacccugug

SEQ ID NO: 153020 - RNA, 19 nt, Human
ccucagagcccacuuccuc

SEQ ID NO: 153021 - RNA, 20 nt, Human
ccucagagcccacuuccucc

SEQ ID NO: 153022 - RNA, 18 nt, Human
ccucccccuccacaccca

SEQ ID NO: 153023 - RNA, 22 nt, Human
ccucccccuccacacccaaauc

SEQ ID NO: 153024 - RNA, 24 nt, Human
ccugaagaguguuuuccaacuugg

SEQ ID NO: 153025 - RNA, 24 nt, Human
ccugcaguggauagagccgggguc

SEQ ID NO: 153026 - RNA, 18 nt, Human
ccuuguauuucccgcccc

SEQ ID NO: 153027 - RNA, 26 nt, Human
cuaaaauacucuccaaagacagaaaa

SEQ ID NO: 153028 - RNA, 23 nt, Human
cuagaaccagaaaaaccauuuga

SEQ ID NO: 153029 - RNA, 20 nt, Human
cucaaaagaaacaacaaaca

SEQ ID NO: 153030 - RNA, 19 nt, Human
cuccacacccaaaucucac

SEQ ID NO: 153031 - RNA, 22 nt, Human
cugaaaguguuucuuggcucug

SEQ ID NO: 153032 - RNA, 22 nt, Human
cugaaaguguuucuuggcucug

SEQ ID NO: 153033 - RNA, 28 nt, Human
cugagggcacucaggagccucaaagggg

SEQ ID NO: 153034 - RNA, 18 nt, Human
cuggccaggucaccuucc

SEQ ID NO: 153035 - RNA, 18 nt, Human
cuucucaaaagaaacaac

SEQ ID NO: 153036 - RNA, 18 nt, Human
cuuguaaggcaggccugg

SEQ ID NO: 153037 - RNA, 23 nt, Human
cuuugcacgugagaugggucucc

SEQ ID NO: 153038 - RNA, 21 nt, Human
gaaaaccguauaaaaaaaucc

SEQ ID NO: 153039 - RNA, 26 nt, Human
gaaacaacaaacauguggccaacaaa

SEQ ID NO: 153040 - RNA, 23 nt, Human
gaagcuccuccaccuuggcgccu

SEQ ID NO: 153041 - RNA, 22 nt, Human
gagaaaugcaaaucaaacccac

SEQ ID NO: 153042 - RNA, 26 nt, Human
gaggaagaggugagccgaggcaggug

SEQ ID NO: 153043 - RNA, 20 nt, Human
gaguuucuaaaauacucucc

SEQ ID NO: 153044 - RNA, 20 nt, Human
gaguuucuaaaauacucucc

SEQ ID NO: 153045 - RNA, 18 nt, Human
gaucaaguccucaaaagg

SEQ ID NO: 153046 - RNA, 20 nt, Human
gcacccucuggagggcaggg

SEQ ID NO: 153047 - RNA, 22 nt, Human
gcccagauggccccauggcagu

SEQ ID NO: 153048 - RNA, 20 nt, Human
gccccugucucuccccuuca

SEQ ID NO: 153049 - RNA, 20 nt, Human
gccccugucucuccccuuca

SEQ ID NO: 153050 - RNA, 21 nt, Human
gccccugucucuccccuucac

SEQ ID NO: 153051 - RNA, 21 nt, Human
gccccugucucuccccuucac

SEQ ID NO: 153052 - RNA, 22 nt, Human
gcgggagugggcaccaggaggg

SEQ ID NO: 153053 - RNA, 22 nt, Human
gcgggagugggcaccaggaggg

SEQ ID NO: 153054 - RNA, 20 nt, Human
ggaucaacccuucucagcgg

SEQ ID NO: 153055 - RNA, 21 nt, Human
ggcgaguggcuggcccugcag

SEQ ID NO: 153056 - RNA, 20 nt, Human
ggcucuggccaggucaccuu

SEQ ID NO: 153057 - RNA, 20 nt, Human
ggcucuggccaggucaccuu

SEQ ID NO: 153058 - RNA, 21 nt, Human
gggaaggaggugggagagaaa

SEQ ID NO: 153059 - RNA, 19 nt, Human
gggcagagggggcggggcu

SEQ ID NO: 153060 - RNA, 19 nt, Human
gggcagagggggcggggcu

SEQ ID NO: 153061 - RNA, 19 nt, Human
ggggcagagggggcggggc

SEQ ID NO: 153062 - RNA, 24 nt, Human
ggggcagagggggcggggcuugga

SEQ ID NO: 153063 - RNA, 18 nt, Human
ggguuuugaccaucugag

SEQ ID NO: 153064 - RNA, 25 nt, Human
ggucaccuucccagagggaguugga

SEQ ID NO: 153065 - RNA, 25 nt, Human
ggucaccuucccagagggaguugga

SEQ ID NO: 153066 - RNA, 21 nt, Human
gguucacaggagggagucugu

SEQ ID NO: 153067 - RNA, 20 nt, Human
guaaggcaggccugguggug

SEQ ID NO: 153068 - RNA, 23 nt, Human
gugaaugauccggguccuggccu

SEQ ID NO: 153069 - RNA, 23 nt, Human
guucuucccguggcccguggccu

SEQ ID NO: 153070 - RNA, 18 nt, Human
uaaaaaaaaccaaaaaac

SEQ ID NO: 153071 - RNA, 21 nt, Human
uaaaaaaaaccaaaaaacaaa

SEQ ID NO: 153072 - RNA, 24 nt, Human
uaaaaaaaaccaaaaaacaaaaaa

SEQ ID NO: 153073 - RNA, 24 nt, Human
uaaaaaaaaccaaaaaacaaaaaa

SEQ ID NO: 153074 - RNA, 25 nt, Human
uaaaauacucuccaaagacagaaaa

SEQ ID NO: 153075 - RNA, 24 nt, Human
uacaagaaaagaacaaacaaccuc

SEQ ID NO: 153076 - RNA, 20 nt, Human
uaggcccagcaaaggucugg

SEQ ID NO: 153077 - RNA, 21 nt, Human
uaugaacagacacuucucaaa

SEQ ID NO: 153078 - RNA, 30 nt, Human
ucaaaagaaacaacaaacauguggccaacc

SEQ ID NO: 153079 - RNA, 18 nt, Human
ucaaccuuggugaaucug

SEQ ID NO: 153080 - RNA, 23 nt, Human
ucaauggucucuacaauuugggg

SEQ ID NO: 153081 - RNA, 23 nt, Human
ucaguaagcagaaagcaccuucu

SEQ ID NO: 153082 - RNA, 19 nt, Human
uccaaagacagaaaaauuc

SEQ ID NO: 153083 - RNA, 19 nt, Human
ucccagagggaaaacuggg

SEQ ID NO: 153084 - RNA, 19 nt, Human
ucccagagggguucucagg

SEQ ID NO: 153085 - RNA, 19 nt, Human
ucccagagggguucucagg

SEQ ID NO: 153086 - RNA, 26 nt, Human
ucccaggaucuguuuucuuuuuuccc

SEQ ID NO: 153087 - RNA, 26 nt, Human
ucccuuuuuuuuuccgucguuugagu

SEQ ID NO: 153088 - RNA, 18 nt, Human
uccuggcgaguggcuggc

SEQ ID NO: 153089 - RNA, 22 nt, Human
ucuaaaauacucuccaaagaca

SEQ ID NO: 153090 - RNA, 22 nt, Human
ucuaaaauacucuccaaagaca

SEQ ID NO: 153091 - RNA, 23 nt, Human
ucucugaauggcccagauggccc

SEQ ID NO: 153092 - RNA, 19 nt, Human
ucucugagcgcacccucug

SEQ ID NO: 153093 - RNA, 19 nt, Human
ucugagcgcacccucugga

SEQ ID NO: 153094 - RNA, 20 nt, Human
ucuguggccagaucccuaga

SEQ ID NO: 153095 - RNA, 21 nt, Human
ugaaaaaaagcucaucuucac

SEQ ID NO: 153096 - RNA, 19 nt, Human
ugaacguuggucugucuug

SEQ ID NO: 153097 - RNA, 19 nt, Human
ugaagaguguuuuccaacu

SEQ ID NO: 153098 - RNA, 21 nt, Human
ugaagaguguuuuccaacuug

SEQ ID NO: 153099 - RNA, 18 nt, Human
ugaauacggcacaccaau

SEQ ID NO: 153100 - RNA, 24 nt, Human
ugaccaaaauacccccgaguccag

SEQ ID NO: 153101 - RNA, 24 nt, Human
ugaccaaaauacccccgaguccag

SEQ ID NO: 153102 - RNA, 19 nt, Human
ugaggccuagaggagcagc

SEQ ID NO: 153103 - RNA, 19 nt, Human
ugaggccuagaggagcagc

SEQ ID NO: 153104 - RNA, 19 nt, Human
ugauccggguccuggccuc

SEQ ID NO: 153105 - RNA, 24 nt, Human
ugcaguaucaguccucgaggcagg

SEQ ID NO: 153106 - RNA, 24 nt, Human
ugcaguaucaguccucgaggcagg

SEQ ID NO: 153107 - RNA, 24 nt, Human
ugcccgugucucugagcgcacccu

SEQ ID NO: 153108 - RNA, 18 nt, Human
uggaaaugucaaaguguc

SEQ ID NO: 153109 - RNA, 18 nt, Human
uggcaaucauuaaaaagu

SEQ ID NO: 153110 - RNA, 18 nt, Human
uggcaccgcuugguucuu

SEQ ID NO: 153111 - RNA, 23 nt, Human
uggcaggaauagauuuucccaga

SEQ ID NO: 153112 - RNA, 23 nt, Human
uggcaggaauagauuuucccaga

SEQ ID NO: 153113 - RNA, 22 nt, Human
uggcagugggcuuuggugaggc

SEQ ID NO: 153114 - RNA, 24 nt, Human
uggcagugggcuuuggugaggccu

SEQ ID NO: 153115 - RNA, 22 nt, Human
uggccaggucaccuucccagag

SEQ ID NO: 153116 - RNA, 22 nt, Human
uggccaggucaccuucccagag

SEQ ID NO: 153117 - RNA, 24 nt, Human
uggccaggucaccuucccagaggg

SEQ ID NO: 153118 - RNA, 24 nt, Human
uggccaggucaccuucccagaggg

SEQ ID NO: 153119 - RNA, 20 nt, Human
uggcccguggccuccuggcg

SEQ ID NO: 153120 - RNA, 22 nt, Human
ugggaagugggcaaggacuucc

SEQ ID NO: 153121 - RNA, 18 nt, Human
uggggggaaggagguggg

SEQ ID NO: 153122 - RNA, 21 nt, Human
ugguggcaggugggaggaggg

SEQ ID NO: 153123 - RNA, 25 nt, Human
ugucuuugcacgugagaugggucuc

SEQ ID NO: 153124 - RNA, 24 nt, Human
ugugagccaacaggagaaacagug

SEQ ID NO: 153125 - RNA, 24 nt, Human
ugugagccaacaggagaaacagug

SEQ ID NO: 153126 - RNA, 19 nt, Human
uguuucuuggcucuggcca

SEQ ID NO: 153127 - RNA, 19 nt, Human
uguuucuuggcucuggcca

SEQ ID NO: 153128 - RNA, 19 nt, Human
uuaaaaaaaaccaaaaaac

SEQ ID NO: 153129 - RNA, 19 nt, Human
uuaaaaaaaaccaaaaaac

SEQ ID NO: 153130 - RNA, 24 nt, Human
uuaaccaauuugccagucugcguc

SEQ ID NO: 153131 - RNA, 22 nt, Human
uuacuggguacauacccagagg

SEQ ID NO: 153132 - RNA, 24 nt, Human
uucaaccuuggugaaucugacaau

SEQ ID NO: 153133 - RNA, 22 nt, Human
uuccauauuuagugcuuccuuc

SEQ ID NO: 153134 - RNA, 19 nt, Human
uuccugaauuugaacguug

SEQ ID NO: 153135 - RNA, 24 nt, Human
uucuuggcucuggccaggucaccu

SEQ ID NO: 153136 - RNA, 18 nt, Human
uuguuuguuccuuuucau

SEQ ID NO: 153137 - RNA, 23 nt, Human
uuucccauucccuuuuuuuuucc

SEQ ID NO: 153138 - RNA, 18 nt, Human
uuugccagucugcgucuu

SEQ ID NO: 153139 - RNA, 21 nt, Human
uuugcccauuaguugacacgg

SEQ ID NO: 153140 - RNA, 23 nt, Human
uuuggugaggccugguggcaggu

SEQ ID NO: 153141 - RNA, 24 nt, Human
uuuucuuuuuucccauucccuuuu

SEQ ID NO: 153142 - RNA, 18 nt, Human
uuuuuuuuuuuuuuuuug

SEQ ID NO: 153143 - RNA, 28 nt, Human
uuuuuuuuuuuuuuuuuuuuuuuggggg

SEQ ID NO: 153144 - RNA, 20 nt, Human
aagaguccgaaaguccagcc

SEQ ID NO: 153145 - RNA, 18 nt, Human
aagcuuuuacacgcucac

SEQ ID NO: 153146 - RNA, 21 nt, Human
acacacacacacacucacaca

SEQ ID NO: 153147 - RNA, 24 nt, Human
acacacacacacacucacacaucc

SEQ ID NO: 153148 - RNA, 22 nt, Human
acacacacacgcgcgcgcgcgc

SEQ ID NO: 153149 - RNA, 19 nt, Human
agcuucugggccacagccu

SEQ ID NO: 153150 - RNA, 21 nt, Human
aggacaaaucccugugcaaac

SEQ ID NO: 153151 - RNA, 19 nt, Human
aucacccccucuccuaauc

SEQ ID NO: 153152 - RNA, 20 nt, Human
aucccugugcaaacuggagg

SEQ ID NO: 153153 - RNA, 24 nt, Human
caaacuuccagcuucugggccaca

SEQ ID NO: 153154 - RNA, 20 nt, Human
caacuccucagccugccccu

SEQ ID NO: 153155 - RNA, 22 nt, Human
caagggcggggguggggacagg

SEQ ID NO: 153156 - RNA, 27 nt, Human
cacacacacacacacacucacacaucc

SEQ ID NO: 153157 - RNA, 18 nt, Human
cacacacgcgcgcgcgcg

SEQ ID NO: 153158 - RNA, 22 nt, Human
cacacacucacacaucccaucu

SEQ ID NO: 153159 - RNA, 20 nt, Human
cacacgcgcgcgcgcgcgca

SEQ ID NO: 153160 - RNA, 22 nt, Human
cacagccuaaggccaggcaucc

SEQ ID NO: 153161 - RNA, 24 nt, Human
cacagccuaaggccaggcauccaa

SEQ ID NO: 153162 - RNA, 19 nt, Human
cacccccucuccuaaucca

SEQ ID NO: 153163 - RNA, 18 nt, Human
cacgcgcgcgcgcgcgca

SEQ ID NO: 153164 - RNA, 22 nt, Human
cagcuggccccauuguagggca

SEQ ID NO: 153165 - RNA, 22 nt, Human
cagucucuggggggcaaagggc

SEQ ID NO: 153166 - RNA, 19 nt, Human
cauccaaaaguccaagagu

SEQ ID NO: 153167 - RNA, 25 nt, Human
caucucuggcucugagagucagucu

SEQ ID NO: 153168 - RNA, 18 nt, Human
ccagccggcugcuuggca

SEQ ID NO: 153169 - RNA, 23 nt, Human
ccagcuggccccauuguagggca

SEQ ID NO: 153170 - RNA, 21 nt, Human
ccagcuucugggccacagccu

SEQ ID NO: 153171 - RNA, 24 nt, Human
ccaguuccugagggagggacugcu

SEQ ID NO: 153172 - RNA, 22 nt, Human
cccagccugacccugccaggac

SEQ ID NO: 153173 - RNA, 27 nt, Human
ccccauuccuggaguccccuccuccag

SEQ ID NO: 153174 - RNA, 21 nt, Human
ccccugcuggagagcaggaag

SEQ ID NO: 153175 - RNA, 18 nt, Human
cccucagcccccaggaca

SEQ ID NO: 153176 - RNA, 21 nt, Human
ccucagccugccccugccugc

SEQ ID NO: 153177 - RNA, 22 nt, Human
ccugcccuuuuaugacagcacc

SEQ ID NO: 153178 - RNA, 23 nt, Human
ccuguggaaccccggcuuacccc

SEQ ID NO: 153179 - RNA, 24 nt, Human
ccuguggaaccccggcuuacccca

SEQ ID NO: 153180 - RNA, 20 nt, Human
cgcacacacacacacacaca

SEQ ID NO: 153181 - RNA, 23 nt, Human
cgccuaccuggggggccagaccc

SEQ ID NO: 153182 - RNA, 27 nt, Human
cgcgcacacacacacacacacacucac

SEQ ID NO: 153183 - RNA, 25 nt, Human
cgugcacacacacacgcgcgcgcgc

SEQ ID NO: 153184 - RNA, 26 nt, Human
cuccagcacugaagaacaggguaccc

SEQ ID NO: 153185 - RNA, 18 nt, Human
cucuccgccuaccugggg

SEQ ID NO: 153186 - RNA, 22 nt, Human
cugaagaacagacaagugugaa

SEQ ID NO: 153187 - RNA, 21 nt, Human
cugccccugccugcccuuuua

SEQ ID NO: 153188 - RNA, 23 nt, Human
cuggaguccccuccuccaguucc

SEQ ID NO: 153189 - RNA, 22 nt, Human
cugggcccuguggaaccccggc

SEQ ID NO: 153190 - RNA, 23 nt, Human
gaacacaggccuggagaaguccc

SEQ ID NO: 153191 - RNA, 18 nt, Human
gagagcaggaaggucugg

SEQ ID NO: 153192 - RNA, 22 nt, Human
gagcaggaaggucugggcccuu

SEQ ID NO: 153193 - RNA, 20 nt, Human
gccaggaccuccagcacuga

SEQ ID NO: 153194 - RNA, 24 nt, Human
gcgcgcacacacacacacacacac

SEQ ID NO: 153195 - RNA, 21 nt, Human
gcucacccaugcucucugugc

SEQ ID NO: 153196 - RNA, 22 nt, Human
ggaccuccagcacugaagaaca

SEQ ID NO: 153197 - RNA, 20 nt, Human
gggagggaacacaggccugg

SEQ ID NO: 153198 - RNA, 22 nt, Human
gggcccuguggaaccccggcuu

SEQ ID NO: 153199 - RNA, 21 nt, Human
gggcggggguggggacagggc

SEQ ID NO: 153200 - RNA, 22 nt, Human
gggcggggguggggacagggcc

SEQ ID NO: 153201 - RNA, 22 nt, Human
ggggacagggcccucagccccc

SEQ ID NO: 153202 - RNA, 18 nt, Human
ggggagggaacacaggcc

SEQ ID NO: 153203 - RNA, 22 nt, Human
gucaucacccccucuccuaauc

SEQ ID NO: 153204 - RNA, 18 nt, Human
gugcacacacacacgcgc

SEQ ID NO: 153205 - RNA, 23 nt, Human
gugcacacacacacgcgcgcgcg

SEQ ID NO: 153206 - RNA, 23 nt, Human
ucccugugcaaacuggaggugca

SEQ ID NO: 153207 - RNA, 19 nt, Human
uccucagccugccccugcc

SEQ ID NO: 153208 - RNA, 18 nt, Human
uccucaggguccccgugg

SEQ ID NO: 153209 - RNA, 26 nt, Human
ucugugcaggccagugcgugcacaca

SEQ ID NO: 153210 - RNA, 22 nt, Human
ugagggagggacugcucuccgc

SEQ ID NO: 153211 - RNA, 25 nt, Human
ugcacacacacacgcgcgcgcgcgc

SEQ ID NO: 153212 - RNA, 25 nt, Human
ugcgugcacacacacacgcgcgcgg

SEQ ID NO: 153213 - RNA, 23 nt, Human
uggaaccccggcuuaccccagcc

SEQ ID NO: 153214 - RNA, 19 nt, Human
uggggagggaacacaggcc

SEQ ID NO: 153215 - RNA, 18 nt, Human
uguggggauccccugcug

SEQ ID NO: 153216 - RNA, 20 nt, Human
uuccagcuucugggccacag

SEQ ID NO: 153217 - RNA, 23 nt, Human
aaaacaaaacgaagaaacaaaaa

SEQ ID NO: 153218 - RNA, 19 nt, Human
aaaacaaaacucaaaaacc

SEQ ID NO: 153219 - RNA, 24 nt, Human
aaaauuaagaccaaaaacaaaacu

SEQ ID NO: 153220 - RNA, 19 nt, Human
aaacaaaaagggaacgggg

SEQ ID NO: 153221 - RNA, 24 nt, Human
aaacaaaacucaaaaaccuucaau

SEQ ID NO: 153222 - RNA, 19 nt, Human
aaauauaauuuaagaaccc

SEQ ID NO: 153223 - RNA, 23 nt, Human
aacaaaaagggaacggggagaaa

SEQ ID NO: 153224 - RNA, 19 nt, Human
aacaaaacgaagaaacaaa

SEQ ID NO: 153225 - RNA, 20 nt, Human
aacgaagaaacaaaaaggga

SEQ ID NO: 153226 - RNA, 25 nt, Human
aaggacgguagaaaaacaaaacgaa

SEQ ID NO: 153227 - RNA, 19 nt, Human
acaaaaagggaacggggag

SEQ ID NO: 153228 - RNA, 22 nt, Human
acagguucccuccaacacaaag

SEQ ID NO: 153229 - RNA, 24 nt, Human
agaaaaacaaaacgaagaaacaaa

SEQ ID NO: 153230 - RNA, 27 nt, Human
agaaaaacaaaacgaagaaacaaaaag

SEQ ID NO: 153231 - RNA, 18 nt, Human
agaaacaaaaagggaacc

SEQ ID NO: 153232 - RNA, 21 nt, Human
agaaccccuccaagcaccggc

SEQ ID NO: 153233 - RNA, 21 nt, Human
augacaaggacgguagaaaaa

SEQ ID NO: 153234 - RNA, 21 nt, Human
caacuccucaccccacgggcu

SEQ ID NO: 153235 - RNA, 24 nt, Human
caccccacaccccuucauaggaca

SEQ ID NO: 153236 - RNA, 22 nt, Human
caccccacgggcucaaagugca

SEQ ID NO: 153237 - RNA, 25 nt, Human
caccccacgggcucaaagugcaauc

SEQ ID NO: 153238 - RNA, 24 nt, Human
caccccuucauaggacacagcuug

SEQ ID NO: 153239 - RNA, 23 nt, Human
cagaacccccaaauccugucucu

SEQ ID NO: 153240 - RNA, 21 nt, Human
cagcggggcacagggcugggg

SEQ ID NO: 153241 - RNA, 21 nt, Human
cagguucccuccaacacaaag

SEQ ID NO: 153242 - RNA, 23 nt, Human
caguccugagggaaaggcgcccu

SEQ ID NO: 153243 - RNA, 21 nt, Human
ccaacuccucaccccacgggc

SEQ ID NO: 153244 - RNA, 19 nt, Human
ccagcggggcacagggcug

SEQ ID NO: 153245 - RNA, 19 nt, Human
cccaaauccugucucucca

SEQ ID NO: 153246 - RNA, 22 nt, Human
ccccaaauccugucucuccaaa

SEQ ID NO: 153247 - RNA, 21 nt, Human
cccccaaauccugucucucca

SEQ ID NO: 153248 - RNA, 24 nt, Human
cccccccaggucugacucucccug

SEQ ID NO: 153249 - RNA, 21 nt, Human
cccccugggacagccccccca

SEQ ID NO: 153250 - RNA, 19 nt, Human
ccccugggacagccccccc

SEQ ID NO: 153251 - RNA, 20 nt, Human
ccucgcccccccaggucuga

SEQ ID NO: 153252 - RNA, 20 nt, Human
ccucuggucacacccagucc

SEQ ID NO: 153253 - RNA, 21 nt, Human
ccugucucuccaaauugccag

SEQ ID NO: 153254 - RNA, 24 nt, Human
ccuucauaggacacagcuuggggg

SEQ ID NO: 153255 - RNA, 27 nt, Human
cgcccucacccuuggucuggaguucuu

SEQ ID NO: 153256 - RNA, 23 nt, Human
cggggagaaaaauuaagaccaaa

SEQ ID NO: 153257 - RNA, 18 nt, Human
cgggguccggggaugugg

SEQ ID NO: 153258 - RNA, 19 nt, Human
cucaccccacaccccuuca

SEQ ID NO: 153259 - RNA, 23 nt, Human
cuggaguuccccgagguggcugg

SEQ ID NO: 153260 - RNA, 23 nt, Human
gaacugaguuuggggggcccucg

SEQ ID NO: 153261 - RNA, 23 nt, Human
gcccugacaccccuucuugcccc

SEQ ID NO: 153262 - RNA, 18 nt, Human
ggaggcggugucccuggg

SEQ ID NO: 153263 - RNA, 20 nt, Human
ggggccucugugagucccca

SEQ ID NO: 153264 - RNA, 21 nt, Human
ggugacagcagcaaguuggga

SEQ ID NO: 153265 - RNA, 23 nt, Human
gucccugggguggggaguuccug

SEQ ID NO: 153266 - RNA, 23 nt, Human
uaagaccaaaaacaaaacucaaa

SEQ ID NO: 153267 - RNA, 22 nt, Human
uagugaaacagguucccuccaa

SEQ ID NO: 153268 - RNA, 19 nt, Human
uaugaaggcagcagcuggg

SEQ ID NO: 153269 - RNA, 22 nt, Human
uaugacaaggacgguagaaaaa

SEQ ID NO: 153270 - RNA, 24 nt, Human
ucaaaaaccuucaauaugaaggca

SEQ ID NO: 153271 - RNA, 26 nt, Human
ucaaagugcaauccagcggggcacag

SEQ ID NO: 153272 - RNA, 19 nt, Human
uccaccaccaacuaccgcc

SEQ ID NO: 153273 - RNA, 27 nt, Human
uccccuccuauuauggcagaaccccca

SEQ ID NO: 153274 - RNA, 23 nt, Human
uccguuucuggguuccaccacca

SEQ ID NO: 153275 - RNA, 18 nt, Human
ucuccaaauugccaacuc

SEQ ID NO: 153276 - RNA, 27 nt, Human
ucuuuggucugcgggaacgcacccauc

SEQ ID NO: 153277 - RNA, 22 nt, Human
ugaaacagguucccuccaacac

SEQ ID NO: 153278 - RNA, 18 nt, Human
ugaaggcagcagcugggg

SEQ ID NO: 153279 - RNA, 26 nt, Human
ugaccaaggcacuguucuggaaacag

SEQ ID NO: 153280 - RNA, 24 nt, Human
ugaugggccccuguuucaacuugg

SEQ ID NO: 153281 - RNA, 22 nt, Human
ugcaauccagcggggcacaggg

SEQ ID NO: 153282 - RNA, 19 nt, Human
uggcaagggagucacacuc

SEQ ID NO: 153283 - RNA, 22 nt, Human
uggcaagggagucacacucucu

SEQ ID NO: 153284 - RNA, 20 nt, Human
ugggcaaaggaggccauagu

SEQ ID NO: 153285 - RNA, 23 nt, Human
uggggaggcugggagauguuggg

SEQ ID NO: 153286 - RNA, 22 nt, Human
ugggggccucugugagucccca

SEQ ID NO: 153287 - RNA, 24 nt, Human
ugggggccucugugaguccccacu

SEQ ID NO: 153288 - RNA, 18 nt, Human
uggggggugauuuucccc

SEQ ID NO: 153289 - RNA, 18 nt, Human
ugggguggggaguuccug

SEQ ID NO: 153290 - RNA, 19 nt, Human
uuacaagggaaaaaaauga

SEQ ID NO: 153291 - RNA, 19 nt, Human
uucuggaaacagacaugau

SEQ ID NO: 153292 - RNA, 25 nt, Human
uugggggucccaggcgggguccggg

SEQ ID NO: 153293 - RNA, 21 nt, Human
uuuaagaaccccuccaagcac

SEQ ID NO: 153294 - RNA, 18 nt, Human
aagagaggcuucgccagg

SEQ ID NO: 153295 - RNA, 22 nt, Human
acaaagaagagggcagucugaa

SEQ ID NO: 153296 - RNA, 20 nt, Human
acccgcgucuucuccagucc

SEQ ID NO: 153297 - RNA, 19 nt, Human
acccggggcuccuggagcu

SEQ ID NO: 153298 - RNA, 23 nt, Human
accggcccggguccguucggcgc

SEQ ID NO: 153299 - RNA, 20 nt, Human
acgcagcccggcccgccccc

SEQ ID NO: 153300 - RNA, 24 nt, Human
agacaaacaggcuuggcaccuccu

SEQ ID NO: 153301 - RNA, 19 nt, Human
agaggcuguuggagcccgg

SEQ ID NO: 153302 - RNA, 22 nt, Human
aggcuuggcaccuccuuugcuu

SEQ ID NO: 153303 - RNA, 21 nt, Human
aguggacccggggcuccugga

SEQ ID NO: 153304 - RNA, 20 nt, Human
auaaucccuuuauuucuucc

SEQ ID NO: 153305 - RNA, 22 nt, Human
aucccuuuauuucuucccguug

SEQ ID NO: 153306 - RNA, 20 nt, Human
caaauucccuucuuucccuu

SEQ ID NO: 153307 - RNA, 23 nt, Human
caccaucgccccagccaccaccc

SEQ ID NO: 153308 - RNA, 19 nt, Human
cacccgcgucuucuccagu

SEQ ID NO: 153309 - RNA, 21 nt, Human
cacccgcgucuucuccagucc

SEQ ID NO: 153310 - RNA, 18 nt, Human
cacucuguucccuaacug

SEQ ID NO: 153311 - RNA, 20 nt, Human
cagccaccacccugcuccug

SEQ ID NO: 153312 - RNA, 18 nt, Human
cagcccggcccgcccccu

SEQ ID NO: 153313 - RNA, 23 nt, Human
caugucccuucucggaccagugu

SEQ ID NO: 153314 - RNA, 21 nt, Human
cccccgaggccucgcagugga

SEQ ID NO: 153315 - RNA, 21 nt, Human
cccgaggccucgcaguggacc

SEQ ID NO: 153316 - RNA, 19 nt, Human
ccgcccgcugcuguagagc

SEQ ID NO: 153317 - RNA, 23 nt, Human
ccucgcaguggacccggggcucc

SEQ ID NO: 153318 - RNA, 20 nt, Human
ccuuuaaugaggagggggcc

SEQ ID NO: 153319 - RNA, 24 nt, Human
cgagagucccugggauuccggggu

SEQ ID NO: 153320 - RNA, 19 nt, Human
cgcagcccggcccgccccc

SEQ ID NO: 153321 - RNA, 21 nt, Human
cgccgagagucccugggauuc

SEQ ID NO: 153322 - RNA, 21 nt, Human
cgccgggagaauccugggggc

SEQ ID NO: 153323 - RNA, 23 nt, Human
cggcaggggcugcuccagaggug

SEQ ID NO: 153324 - RNA, 19 nt, Human
cguccaccaucgccccagc

SEQ ID NO: 153325 - RNA, 26 nt, Human
cuaagcuucccuuuuuuuuuuuuucu

SEQ ID NO: 153326 - RNA, 21 nt, Human
cuccaacagccaccccuuuuu

SEQ ID NO: 153327 - RNA, 19 nt, Human
cucccuuccuccaacagcc

SEQ ID NO: 153328 - RNA, 21 nt, Human
cuccucccuuccuccaacagc

SEQ ID NO: 153329 - RNA, 26 nt, Human
cugcaggucugcgccccccgaggccu

SEQ ID NO: 153330 - RNA, 20 nt, Human
cugcuguagagccgcggcug

SEQ ID NO: 153331 - RNA, 21 nt, Human
cugggcagccccuucaguagc

SEQ ID NO: 153332 - RNA, 22 nt, Human
cuucccagcaucuagacuccag

SEQ ID NO: 153333 - RNA, 23 nt, Human
cuucccagcaucuagacuccagu

SEQ ID NO: 153334 - RNA, 24 nt, Human
gaagagggcagucugaaaccuaga

SEQ ID NO: 153335 - RNA, 19 nt, Human
gacaucuucagggcgucca

SEQ ID NO: 153336 - RNA, 19 nt, Human
gacccggggcuccuggagc

SEQ ID NO: 153337 - RNA, 20 nt, Human
gaggaccagggaaugcagcc

SEQ ID NO: 153338 - RNA, 20 nt, Human
gaggcuguuggagcccggcu

SEQ ID NO: 153339 - RNA, 20 nt, Human
gaggguuggguuuggugugg

SEQ ID NO: 153340 - RNA, 18 nt, Human
gcgccccccgaggccucg

SEQ ID NO: 153341 - RNA, 20 nt, Human
gcgccgggagaauccugggg

SEQ ID NO: 153342 - RNA, 21 nt, Human
gcuuggcaccuccuuugcuug

SEQ ID NO: 153343 - RNA, 22 nt, Human
ggcaucucucacagaggcuguu

SEQ ID NO: 153344 - RNA, 22 nt, Human
gggcagucugaaaccuagaaga

SEQ ID NO: 153345 - RNA, 18 nt, Human
guccaccaucgccccagc

SEQ ID NO: 153346 - RNA, 19 nt, Human
gucccgggucccgccgccc

SEQ ID NO: 153347 - RNA, 19 nt, Human
guccguucggcgccgagag

SEQ ID NO: 153348 - RNA, 18 nt, Human
uaaugaggagggggcugg

SEQ ID NO: 153349 - RNA, 21 nt, Human
uccaccaucgccccagccacc

SEQ ID NO: 153350 - RNA, 20 nt, Human
ucccuuuauuucuucccguu

SEQ ID NO: 153351 - RNA, 25 nt, Human
ucggcgccgagagucccugggauuc

SEQ ID NO: 153352 - RNA, 18 nt, Human
ucuccucccuuccuccaa

SEQ ID NO: 153353 - RNA, 20 nt, Human
ucugaaaccuagaagagagg

SEQ ID NO: 153354 - RNA, 20 nt, Human
ucuucauuuacucuccuccc

SEQ ID NO: 153355 - RNA, 19 nt, Human
ugaagacaaacaggcuugg

SEQ ID NO: 153356 - RNA, 22 nt, Human
ugaccaugccggcacccugauc

SEQ ID NO: 153357 - RNA, 18 nt, Human
ugaggagggggcuggugg

SEQ ID NO: 153358 - RNA, 23 nt, Human
ugaggagggggcugguggagagg

SEQ ID NO: 153359 - RNA, 23 nt, Human
ugcaggucugcgccccccgaggc

SEQ ID NO: 153360 - RNA, 19 nt, Human
ugccacccgcgucuucucc

SEQ ID NO: 153361 - RNA, 20 nt, Human
ugcuguagagccgcggcugg

SEQ ID NO: 153362 - RNA, 24 nt, Human
ugcuguagagccgcggcuggagcg

SEQ ID NO: 153363 - RNA, 23 nt, Human
uggacuucccagcaucuagacuc

SEQ ID NO: 153364 - RNA, 23 nt, Human
uggcggcaggggcugcuccagag

SEQ ID NO: 153365 - RNA, 22 nt, Human
ugggucccgggucccgccgccc

SEQ ID NO: 153366 - RNA, 20 nt, Human
uucccuaacugggcagcccc

SEQ ID NO: 153367 - RNA, 22 nt, Human
uucccuucuuucccuuuaauga

SEQ ID NO: 153368 - RNA, 23 nt, Human
uucgaggacacaacaaagaagag

SEQ ID NO: 153369 - RNA, 23 nt, Human
uugcaaauucccuucuuucccuu

SEQ ID NO: 153370 - RNA, 23 nt, Human
uuggcgguucucuaucucuccuc

SEQ ID NO: 153371 - RNA, 21 nt, Human
uuugcaaauucccuucuuucc

SEQ ID NO: 153372 - RNA, 18 nt, Human
agaagcacugcugucgcu

SEQ ID NO: 153373 - RNA, 23 nt, Human
agagaggcagggcaggcugcagg

SEQ ID NO: 153374 - RNA, 26 nt, Human
agagcuguggagcucugcaccuggcg

SEQ ID NO: 153375 - RNA, 22 nt, Human
caccuggcgaugcucuaagggc

SEQ ID NO: 153376 - RNA, 19 nt, Human
caggcugcaggcacuggcc

SEQ ID NO: 153377 - RNA, 24 nt, Human
cagugcuuucaccuguccaccagg

SEQ ID NO: 153378 - RNA, 24 nt, Human
ccccacuccccacggccuucugac

SEQ ID NO: 153379 - RNA, 20 nt, Human
ccuguaccucagcacaggga

SEQ ID NO: 153380 - RNA, 20 nt, Human
cucugcaccuggcgaugcuc

SEQ ID NO: 153381 - RNA, 19 nt, Human
gcaggcggggggagagggg

SEQ ID NO: 153382 - RNA, 18 nt, Human
ggaggggugaggggguga

SEQ ID NO: 153383 - RNA, 18 nt, Human
ggaguuggggguugggga

SEQ ID NO: 153384 - RNA, 24 nt, Human
ggccuucugacaauugcacagucc

SEQ ID NO: 153385 - RNA, 20 nt, Human
gggagugagcuuggaggggu

SEQ ID NO: 153386 - RNA, 20 nt, Human
gggggagguggcaggcgggg

SEQ ID NO: 153387 - RNA, 20 nt, Human
gggugagggggugagcgugg

SEQ ID NO: 153388 - RNA, 18 nt, Human
uaccucagcacagggaga

SEQ ID NO: 153389 - RNA, 24 nt, Human
uccuugggaaagagagcuguggag

SEQ ID NO: 153390 - RNA, 18 nt, Human
ucuaagggccugugagag

SEQ ID NO: 153391 - RNA, 23 nt, Human
ucugacaauugcacaguccugcc

SEQ ID NO: 153392 - RNA, 26 nt, Human
ugagagaggcagggcaggcugcaggc

SEQ ID NO: 153393 - RNA, 24 nt, Human
ugcaggcacuggcccccacucccc

SEQ ID NO: 153394 - RNA, 25 nt, Human
uggaggggugagggggugagcgugg

SEQ ID NO: 153395 - RNA, 18 nt, Human
uggggagugagcuuggag

SEQ ID NO: 153396 - RNA, 23 nt, Human
uggggguuggggagugagcuugg

SEQ ID NO: 153397 - RNA, 22 nt, Human
accccauucugucccccuacag

SEQ ID NO: 153398 - RNA, 24 nt, Human
caaagagaaaucaccaccuggcca

SEQ ID NO: 153399 - RNA, 23 nt, Human
caggacacuaaggguucuuacag

SEQ ID NO: 153400 - RNA, 18 nt, Human
caucccaaucucugcuaa

SEQ ID NO: 153401 - RNA, 24 nt, Human
cauucugucccccuacaggacacu

SEQ ID NO: 153402 - RNA, 22 nt, Human
cccccuacaggacacuaagggu

SEQ ID NO: 153403 - RNA, 21 nt, Human
ccuucagaacaaugcugccau

SEQ ID NO: 153404 - RNA, 25 nt, Human
ccuucagaacaaugcugccauccau

SEQ ID NO: 153405 - RNA, 19 nt, Human
cuaaggguucuuacagaua

SEQ ID NO: 153406 - RNA, 21 nt, Human
uacaggacacuaaggguucuu

SEQ ID NO: 153407 - RNA, 26 nt, Human
uacaggacacuaaggguucuuacaga

SEQ ID NO: 153408 - RNA, 25 nt, Human
uagcuuuauugaguaaggcauccca

SEQ ID NO: 153409 - RNA, 24 nt, Human
uauacuaagaauggugccccagca

SEQ ID NO: 153410 - RNA, 20 nt, Human
ucuaaaugaacggcugauuu

SEQ ID NO: 153411 - RNA, 20 nt, Human
ucuaaaugaacggcugauuu

SEQ ID NO: 153412 - RNA, 18 nt, Human
ucugcuaagauucuucua

SEQ ID NO: 153413 - RNA, 20 nt, Human
ugcauuggucaaagagaaau

SEQ ID NO: 153414 - RNA, 21 nt, Human
uggaaggauggcacaccugcu

SEQ ID NO: 153415 - RNA, 24 nt, Human
uggcacaccugcugagcgugggca

SEQ ID NO: 153416 - RNA, 19 nt, Human
uguaaagaaaaucuuuuuu

SEQ ID NO: 153417 - RNA, 22 nt, Human
uguaaagaaaaucuuuuuuuuc

SEQ ID NO: 153418 - RNA, 22 nt, Human
uuuucugcaaaccccuucagaa

SEQ ID NO: 153419 - RNA, 18 nt, Human
cucaagccugucccgagc

SEQ ID NO: 153420 - RNA, 24 nt, Human
cuccggccgggccgcgggcucucc

SEQ ID NO: 153421 - RNA, 23 nt, Human
gccccgccgcucaagccuguccc

SEQ ID NO: 153422 - RNA, 18 nt, Human
ggcagcgcgccccgccgc

SEQ ID NO: 153423 - RNA, 19 nt, Human
gggcucuccggucuccgcc

SEQ ID NO: 153424 - RNA, 25 nt, Human
ucuccggucuccgccucaggccccg

SEQ ID NO: 153425 - RNA, 22 nt, Human
ugagaaucaauaaacaaacuuc

SEQ ID NO: 153426 - RNA, 19 nt, Human
ugauuugguucauugcagc

SEQ ID NO: 153427 - RNA, 21 nt, Human
uucauugcagcaggaaucuug

SEQ ID NO: 153428 - RNA, 23 nt, Human
aaaaaagaucuuuguaucaugga

SEQ ID NO: 153429 - RNA, 22 nt, Human
aagagaaaacgggguucgggga

SEQ ID NO: 153430 - RNA, 20 nt, Human
aagcaaaugucaucuccccu

SEQ ID NO: 153431 - RNA, 20 nt, Human
aaguccugaaagccaucacu

SEQ ID NO: 153432 - RNA, 21 nt, Human
aauacagccccaaaacaaagc

SEQ ID NO: 153433 - RNA, 25 nt, Human
aaugucaucuccccuaagugccacc

SEQ ID NO: 153434 - RNA, 26 nt, Human
acagccccaaaacaaaggggaacgcc

SEQ ID NO: 153435 - RNA, 21 nt, Human
acagugcuguaaagcaaaggc

SEQ ID NO: 153436 - RNA, 19 nt, Human
accaacaucaucccaggcu

SEQ ID NO: 153437 - RNA, 23 nt, Human
agcaaaaggaacaaagguaaaaa

SEQ ID NO: 153438 - RNA, 25 nt, Human
aggaaaaagacaguuuauuccaaaa

SEQ ID NO: 153439 - RNA, 25 nt, Human
aggcaggauaaaaaacaaguccuga

SEQ ID NO: 153440 - RNA, 25 nt, Human
aggcauauugacuauacccugagaa

SEQ ID NO: 153441 - RNA, 21 nt, Human
aggccucgucugccugcaggc

SEQ ID NO: 153442 - RNA, 22 nt, Human
aggcggccgcagcgauugggcg

SEQ ID NO: 153443 - RNA, 19 nt, Human
aguggaaauguguccuggc

SEQ ID NO: 153444 - RNA, 23 nt, Human
auacaacuaauuuccuagauucu

SEQ ID NO: 153445 - RNA, 23 nt, Human
auacagccccaaaacaaagcaua

SEQ ID NO: 153446 - RNA, 24 nt, Human
aucaucccaggcuccuuagggaaa

SEQ ID NO: 153447 - RNA, 23 nt, Human
aucccauucauugaggaaaaaga

SEQ ID NO: 153448 - RNA, 27 nt, Human
caaaaggaacaaagguaaaaauccacc

SEQ ID NO: 153449 - RNA, 20 nt, Human
caacaacaaaugagagauaa

SEQ ID NO: 153450 - RNA, 19 nt, Human
cacggcacacauacuagug

SEQ ID NO: 153451 - RNA, 22 nt, Human
cacuacaugaugcugggaaaac

SEQ ID NO: 153452 - RNA, 28 nt, Human
cagccccaaaacaaagcauaaucgaaag

SEQ ID NO: 153453 - RNA, 18 nt, Human
caggaacugcauauuaua

SEQ ID NO: 153454 - RNA, 21 nt, Human
caggguuguuggguagagaag

SEQ ID NO: 153455 - RNA, 20 nt, Human
caucacgcggcucccaagcc

SEQ ID NO: 153456 - RNA, 24 nt, Human
cauuaugacuguaaaugaguuacc

SEQ ID NO: 153457 - RNA, 20 nt, Human
ccaccugugggcgcugggga

SEQ ID NO: 153458 - RNA, 22 nt, Human
ccaggccggcgggaagggguca

SEQ ID NO: 153459 - RNA, 22 nt, Human
ccccgcgggcgguugauuucca

SEQ ID NO: 153460 - RNA, 21 nt, Human
cccgagcacuaggcggccgca

SEQ ID NO: 153461 - RNA, 21 nt, Human
ccgcgggcgguugauuuccac

SEQ ID NO: 153462 - RNA, 24 nt, Human
ccgcgggcgguugauuuccaccac

SEQ ID NO: 153463 - RNA, 22 nt, Human
ccuuucaguucagguagaaucc

SEQ ID NO: 153464 - RNA, 21 nt, Human
cgcuauagaaacuccugcagg

SEQ ID NO: 153465 - RNA, 24 nt, Human
cgggcccggaguccccgcggcugg

SEQ ID NO: 153466 - RNA, 22 nt, Human
cgggcggcggcggcgcgaauac

SEQ ID NO: 153467 - RNA, 23 nt, Human
cgguugauuuccaccugugggag

SEQ ID NO: 153468 - RNA, 21 nt, Human
cguccucugagcuccacugaa

SEQ ID NO: 153469 - RNA, 23 nt, Human
cguccucugagcuccacugaaac

SEQ ID NO: 153470 - RNA, 23 nt, Human
cgugcaacacauacagugcugua

SEQ ID NO: 153471 - RNA, 22 nt, Human
cuccccguccucugagcuccac

SEQ ID NO: 153472 - RNA, 19 nt, Human
cucugagcuccacugaaac

SEQ ID NO: 153473 - RNA, 23 nt, Human
cucuggucuuaaaacagcccauc

SEQ ID NO: 153474 - RNA, 23 nt, Human
cugcaggcagcaggaacugcacg

SEQ ID NO: 153475 - RNA, 19 nt, Human
cuggucuuaaaacagccca

SEQ ID NO: 153476 - RNA, 22 nt, Human
gaaaacgggguucggggaggga

SEQ ID NO: 153477 - RNA, 23 nt, Human
gacaucucaacuauaaaaaacaa

SEQ ID NO: 153478 - RNA, 22 nt, Human
gcagcacauuuuugaaggcaaa

SEQ ID NO: 153479 - RNA, 20 nt, Human
gcaggauaaaaaacaagucc

SEQ ID NO: 153480 - RNA, 22 nt, Human
gcaggucuguuucuaggcagca

SEQ ID NO: 153481 - RNA, 19 nt, Human
gcccagacuucguccaggc

SEQ ID NO: 153482 - RNA, 21 nt, Human
gcgguggugugggagccccgg

SEQ ID NO: 153483 - RNA, 28 nt, Human
ggcgcuggggacacgcgaccggaagaaa

SEQ ID NO: 153484 - RNA, 20 nt, Human
ggcggcggcgcgaauacccg

SEQ ID NO: 153485 - RNA, 19 nt, Human
ggcgggcggcggcggcgcg

SEQ ID NO: 153486 - RNA, 23 nt, Human
ggcuugggggaggucacacaguc

SEQ ID NO: 153487 - RNA, 21 nt, Human
gguagagaaggaaggugaugc

SEQ ID NO: 153488 - RNA, 23 nt, Human
gugcuguucugcgccuucuuugg

SEQ ID NO: 153489 - RNA, 21 nt, Human
uaaaaaacaaguccugaaagc

SEQ ID NO: 153490 - RNA, 22 nt, Human
uaaagcaaaggccucgucugcc

SEQ ID NO: 153491 - RNA, 23 nt, Human
uaaauaagagucucuugcaucua

SEQ ID NO: 153492 - RNA, 21 nt, Human
uaaaugcacuacaugaugcug

SEQ ID NO: 153493 - RNA, 24 nt, Human
uaauuaggaaaguaagggcuuuga

SEQ ID NO: 153494 - RNA, 25 nt, Human
uacagccccaaaacaaagcauaauc

SEQ ID NO: 153495 - RNA, 19 nt, Human
uacaguugguugaaugcag

SEQ ID NO: 153496 - RNA, 21 nt, Human
uacccgggcccggaguccccg

SEQ ID NO: 153497 - RNA, 24 nt, Human
uagggaaaucaggagggggcagaa

SEQ ID NO: 153498 - RNA, 18 nt, Human
uaucagagcaaaaggaac

SEQ ID NO: 153499 - RNA, 18 nt, Human
uaucauggagauaaugag

SEQ ID NO: 153500 - RNA, 22 nt, Human
ucaacuauaaaaaacaagggua

SEQ ID NO: 153501 - RNA, 19 nt, Human
ucaggagggggcagaagca

SEQ ID NO: 153502 - RNA, 20 nt, Human
ucagugcaacaggaaagugc

SEQ ID NO: 153503 - RNA, 19 nt, Human
ucaugagaccuuggacaag

SEQ ID NO: 153504 - RNA, 19 nt, Human
uccaccugugggcgcuggg

SEQ ID NO: 153505 - RNA, 20 nt, Human
uccauaucuuuuccucuaca

SEQ ID NO: 153506 - RNA, 22 nt, Human
ucccaggugaaagugguuggcu

SEQ ID NO: 153507 - RNA, 27 nt, Human
ucccaggugaaagugguuggcuugggg

SEQ ID NO: 153508 - RNA, 21 nt, Human
ucgucugccugcaggcagcag

SEQ ID NO: 153509 - RNA, 23 nt, Human
ugagaaagacaaaacuaaaugca

SEQ ID NO: 153510 - RNA, 25 nt, Human
ugagaaagacaaaacuaaaugcacu

SEQ ID NO: 153511 - RNA, 22 nt, Human
ugaugcugggaaaacaaguugu

SEQ ID NO: 153512 - RNA, 26 nt, Human
ugcacaaaauacaacuaauuuccuag

SEQ ID NO: 153513 - RNA, 24 nt, Human
ugccccgcaaccccgcgggcgguu

SEQ ID NO: 153514 - RNA, 24 nt, Human
ugcuguucugcgccuucuuuggga

SEQ ID NO: 153515 - RNA, 19 nt, Human
uggaaauuaugaagcugga

SEQ ID NO: 153516 - RNA, 22 nt, Human
uggaacagacuuuaacaacugu

SEQ ID NO: 153517 - RNA, 23 nt, Human
uggaagagaaaacgggguucggg

SEQ ID NO: 153518 - RNA, 19 nt, Human
uggcaggcgcggcccgagc

SEQ ID NO: 153519 - RNA, 19 nt, Human
uggcuagcugccucugccc

SEQ ID NO: 153520 - RNA, 18 nt, Human
uggugugggagccccggg

SEQ ID NO: 153521 - RNA, 18 nt, Human
ugguuggcuugggggagg

SEQ ID NO: 153522 - RNA, 19 nt, Human
ugucccccacgccuucuaa

SEQ ID NO: 153523 - RNA, 21 nt, Human
ugugaagauuaaacuggauau

SEQ ID NO: 153524 - RNA, 23 nt, Human
uuaaugcuagcuuauaaauuuaa

SEQ ID NO: 153525 - RNA, 19 nt, Human
uucuuuggcaacugaucag

SEQ ID NO: 153526 - RNA, 20 nt, Human
uuggacaagcuaccuaugcu

SEQ ID NO: 153527 - RNA, 19 nt, Human
uugguugaaugcaggucug

SEQ ID NO: 153528 - RNA, 21 nt, Human
uuuaacuucuugacaucucaa

SEQ ID NO: 153529 - RNA, 23 nt, Human
uuugaccaacaucaucccaggcu

SEQ ID NO: 153530 - RNA, 23 nt, Human
uuuuuuuuuucuuuuuuuuuggg

SEQ ID NO: 153531 - RNA, 22 nt, Human
aaacagguaaaucgccuccaaa

SEQ ID NO: 153532 - RNA, 23 nt, Human
aagcugcucucugaaugcuuccu

SEQ ID NO: 153533 - RNA, 25 nt, Human
accccaugagagccagaggccagcc

SEQ ID NO: 153534 - RNA, 21 nt, Human
agagccagaggccagccccca

SEQ ID NO: 153535 - RNA, 22 nt, Human
agagcgggcgcgguggccccgg

SEQ ID NO: 153536 - RNA, 24 nt, Human
agcuugccaccuaaguucuccagg

SEQ ID NO: 153537 - RNA, 20 nt, Human
aguucuccaggucauccugu

SEQ ID NO: 153538 - RNA, 21 nt, Human
auccuuagaucucagaguugc

SEQ ID NO: 153539 - RNA, 25 nt, Human
augcccgugagaccuggagaaguca

SEQ ID NO: 153540 - RNA, 24 nt, Human
caggcgucuucccagcauggcucu

SEQ ID NO: 153541 - RNA, 22 nt, Human
ccagccccacgggccuggagga

SEQ ID NO: 153542 - RNA, 23 nt, Human
cccauccugucuucaugguuccc

SEQ ID NO: 153543 - RNA, 21 nt, Human
cccaugcccgugagaccugga

SEQ ID NO: 153544 - RNA, 24 nt, Human
cgaaaacagguaaaucgccuccaa

SEQ ID NO: 153545 - RNA, 24 nt, Human
cuccgcgccuggccggggucccuc

SEQ ID NO: 153546 - RNA, 21 nt, Human
cucucuggacaguuccucugg

SEQ ID NO: 153547 - RNA, 21 nt, Human
gaagaauacacaaaacuugga

SEQ ID NO: 153548 - RNA, 26 nt, Human
gacaggcuggcgcugagccggacccc

SEQ ID NO: 153549 - RNA, 23 nt, Human
gaccuggggcgcgccgggugacc

SEQ ID NO: 153550 - RNA, 22 nt, Human
gccggggucccucagcgaccug

SEQ ID NO: 153551 - RNA, 19 nt, Human
gcgcggugucggagcagag

SEQ ID NO: 153552 - RNA, 18 nt, Human
ggaguggcgggggagggu

SEQ ID NO: 153553 - RNA, 23 nt, Human
ggccuggaggagagggcggcugu

SEQ ID NO: 153554 - RNA, 22 nt, Human
ggcggcuguccagggggcgcgg

SEQ ID NO: 153555 - RNA, 20 nt, Human
ggggcccucaucccgggaag

SEQ ID NO: 153556 - RNA, 20 nt, Human
uacacaaaacuuggacccca

SEQ ID NO: 153557 - RNA, 18 nt, Human
ucuccaggucauccuguc

SEQ ID NO: 153558 - RNA, 23 nt, Human
ucucugaaugcuuccugcucugg

SEQ ID NO: 153559 - RNA, 23 nt, Human
ucucuggacaguuccucuggccc

SEQ ID NO: 153560 - RNA, 25 nt, Human
ugaccacaccgggggcccucauccc

SEQ ID NO: 153561 - RNA, 18 nt, Human
ugagaugucauugcuggc

SEQ ID NO: 153562 - RNA, 19 nt, Human
ugccgagugagcucaggcg

SEQ ID NO: 153563 - RNA, 22 nt, Human
uggaccccaugagagccagagg

SEQ ID NO: 153564 - RNA, 23 nt, Human
uggcaucaaauuuugcagggugc

SEQ ID NO: 153565 - RNA, 22 nt, Human
uggccggggucccucagcgacc

SEQ ID NO: 153566 - RNA, 21 nt, Human
ugggacaggcuggcgcugagc

SEQ ID NO: 153567 - RNA, 18 nt, Human
uggugagggagguggugg

SEQ ID NO: 153568 - RNA, 22 nt, Human
ugguggauaugcccagguggac

SEQ ID NO: 153569 - RNA, 19 nt, Human
uugucaaugagguugaaga

SEQ ID NO: 153570 - RNA, 22 nt, Human
uuuuuuuuuuuuggugguuuca

SEQ ID NO: 153571 - RNA, 20 nt, Human
acauauuuaaaaauacugca

SEQ ID NO: 153572 - RNA, 22 nt, Human
agacaaaaucagcaaugccccu

SEQ ID NO: 153573 - RNA, 18 nt, Human
caaaaucagcaaugcccc

SEQ ID NO: 153574 - RNA, 19 nt, Human
cacagcugggucagcagcu

SEQ ID NO: 153575 - RNA, 21 nt, Human
cagcaaugccccugcuccuga

SEQ ID NO: 153576 - RNA, 24 nt, Human
caucccuguuccauaagucuugag

SEQ ID NO: 153577 - RNA, 19 nt, Human
ccuccgccggacgcagcug

SEQ ID NO: 153578 - RNA, 23 nt, Human
cugcacugguucucugagucaua

SEQ ID NO: 153579 - RNA, 18 nt, Human
ucagcagcugccuccgcc

SEQ ID NO: 153580 - RNA, 19 nt, Human
uccacagcugggucagcag

SEQ ID NO: 153581 - RNA, 20 nt, Human
uccauaagucuugagucugc

SEQ ID NO: 153582 - RNA, 20 nt, Human
ucccugaucaucugcagccu

SEQ ID NO: 153583 - RNA, 26 nt, Human
ugaccaggcccuucccgaccaggcgc

SEQ ID NO: 153584 - RNA, 21 nt, Human
uggaucccugaucaucugcag

SEQ ID NO: 153585 - RNA, 24 nt, Human
uggaucccugaucaucugcagccu

SEQ ID NO: 153586 - RNA, 23 nt, Human
ugggcagacaaaaucagcaaugc

SEQ ID NO: 153587 - RNA, 22 nt, Human
uuccugagcaggauggauuggg

SEQ ID NO: 153588 - RNA, 24 nt, Human
uuuaaaaauacugcaagguugugg

SEQ ID NO: 153589 - RNA, 23 nt, Human
ccagcuguaguugcaacucuagc

SEQ ID NO: 153590 - RNA, 24 nt, Human
uaauuguccugugugacuucauuu

SEQ ID NO: 153591 - RNA, 22 nt, Human
ugagaagauacuaauaucaaug

SEQ ID NO: 153592 - RNA, 23 nt, Human
ugagaagauacuaauaucaaugc

SEQ ID NO: 153593 - RNA, 18 nt, Human
ugagaggaguugaagagg

SEQ ID NO: 153594 - RNA, 21 nt, Human
uuguccugugugacuucauuu

SEQ ID NO: 153595 - RNA, 28 nt, Human
aaaaaaaagacgaaucuguaaugaagaa

SEQ ID NO: 153596 - RNA, 31 nt, Human
aaaaaaaagacgaaucuguaaugaagaaaaa

SEQ ID NO: 153597 - RNA, 25 nt, Human
aaagcaauaugauauaaaacacauc

SEQ ID NO: 153598 - RNA, 23 nt, Human
aagaacuaaacaggacagggcca

SEQ ID NO: 153599 - RNA, 27 nt, Human
aagcucacaguaaauguaucccagaac

SEQ ID NO: 153600 - RNA, 19 nt, Human
aaggugaauuugucugacu

SEQ ID NO: 153601 - RNA, 22 nt, Human
acuaaacaggacagggccacgg

SEQ ID NO: 153602 - RNA, 19 nt, Human
agaacuaaacaggacaggg

SEQ ID NO: 153603 - RNA, 27 nt, Human
aggaaaagaucgaaucugaggcuauaa

SEQ ID NO: 153604 - RNA, 20 nt, Human
aggugauaaauuuucuccac

SEQ ID NO: 153605 - RNA, 22 nt, Human
agugaguaaauaaacuaaacca

SEQ ID NO: 153606 - RNA, 20 nt, Human
aucacuuaaaaugaacauuu

SEQ ID NO: 153607 - RNA, 23 nt, Human
aucuguaaugaagaaaaaaaaaa

SEQ ID NO: 153608 - RNA, 20 nt, Human
caagaagaaaugaauuggau

SEQ ID NO: 153609 - RNA, 23 nt, Human
cacacugagagguaucuguugau

SEQ ID NO: 153610 - RNA, 28 nt, Human
caccaaucauaaaagaaauaagauauuc

SEQ ID NO: 153611 - RNA, 22 nt, Human
cacuaagaacuaaacaggacag

SEQ ID NO: 153612 - RNA, 21 nt, Human
caggacagggccacggcaaag

SEQ ID NO: 153613 - RNA, 23 nt, Human
cguguuaaacaaaauuaaaauga

SEQ ID NO: 153614 - RNA, 18 nt, Human
cuacagcaucccuuuucc

SEQ ID NO: 153615 - RNA, 20 nt, Human
cucagauuaacacagaucaa

SEQ ID NO: 153616 - RNA, 21 nt, Human
cucccaauuaaaaaaacaaga

SEQ ID NO: 153617 - RNA, 18 nt, Human
cuuaaaaugaacauuuuc

SEQ ID NO: 153618 - RNA, 18 nt, Human
gaaaagaucgaaucugag

SEQ ID NO: 153619 - RNA, 21 nt, Human
gaagaaaaaaaaaaaauccua

SEQ ID NO: 153620 - RNA, 25 nt, Human
gagguaucuguugaucuaaaauucu

SEQ ID NO: 153621 - RNA, 25 nt, Human
gcaaaaguacaaaaauuaacccagu

SEQ ID NO: 153622 - RNA, 19 nt, Human
gcagaagcuugggugcucu

SEQ ID NO: 153623 - RNA, 18 nt, Human
ggcagaagcuugggugcu

SEQ ID NO: 153624 - RNA, 23 nt, Human
ggggcggggaggaggcggaggga

SEQ ID NO: 153625 - RNA, 19 nt, Human
uaaaauagcacaggcaggc

SEQ ID NO: 153626 - RNA, 18 nt, Human
uaacccacuaagaacuag

SEQ ID NO: 153627 - RNA, 21 nt, Human
uaagaaaaaaaaaaaagacga

SEQ ID NO: 153628 - RNA, 22 nt, Human
uaagaaaaaaaaaaaagacgaa

SEQ ID NO: 153629 - RNA, 24 nt, Human
uaagucaguaaccguguuaaacaa

SEQ ID NO: 153630 - RNA, 25 nt, Human
uauaagaaaaaaaaaaaagacgaau

SEQ ID NO: 153631 - RNA, 19 nt, Human
uauuucacacaugaggcuu

SEQ ID NO: 153632 - RNA, 18 nt, Human
ucagugaaaguuuuuaca

SEQ ID NO: 153633 - RNA, 23 nt, Human
ucauuaaaaaaaaaaaaaaacaa

SEQ ID NO: 153634 - RNA, 19 nt, Human
ucuaaaauucucuaaaucc

SEQ ID NO: 153635 - RNA, 28 nt, Human
ucuaaaauucucuaaauccagauaaauc

SEQ ID NO: 153636 - RNA, 24 nt, Human
ucucccaauuaaaaaaacaagagu

SEQ ID NO: 153637 - RNA, 21 nt, Human
ucuucugcaaaaguacaaaaa

SEQ ID NO: 153638 - RNA, 25 nt, Human
ugaagugaguaaauaaacuaaacca

SEQ ID NO: 153639 - RNA, 25 nt, Human
ugagccuucauuaaaaaaaaaaaaa

SEQ ID NO: 153640 - RNA, 29 nt, Human
ugagccuucauuaaaaaaaaaaaaaaaaa

SEQ ID NO: 153641 - RNA, 22 nt, Human
uggacaaaaagcaauaugauau

SEQ ID NO: 153642 - RNA, 22 nt, Human
uggcaggucucuucucucccaa

SEQ ID NO: 153643 - RNA, 19 nt, Human
uggggcucggggcggggag

SEQ ID NO: 153644 - RNA, 19 nt, Human
uggguauauuuuaggugau

SEQ ID NO: 153645 - RNA, 24 nt, Human
uggucuuuuaacaugaagaggucu

SEQ ID NO: 153646 - RNA, 21 nt, Human
uuaaaaaaaaaaaaaaacaaa

SEQ ID NO: 153647 - RNA, 23 nt, Human
uuaacacagaucaauaccaccuu

SEQ ID NO: 153648 - RNA, 19 nt, Human
uuauaggugaaaaacauga

SEQ ID NO: 153649 - RNA, 21 nt, Human
uucaaguaaaugagccuucau

SEQ ID NO: 153650 - RNA, 22 nt, Human
uucucuauauuccagaaggcag

SEQ ID NO: 153651 - RNA, 21 nt, Human
uuuacaaguaaaauagcacag

SEQ ID NO: 153652 - RNA, 19 nt, Human
uuuguauucagugaaaguu

SEQ ID NO: 153653 - RNA, 24 nt, Human
uuuuuugcuagcuugacaauuuua

SEQ ID NO: 153654 - RNA, 24 nt, Human
aaaaacaauggaguuuaaauacaa

SEQ ID NO: 153655 - RNA, 21 nt, Human
aaaaauaaugggccuagaagc

SEQ ID NO: 153656 - RNA, 23 nt, Human
aaagcauguuggaauaaugccaa

SEQ ID NO: 153657 - RNA, 18 nt, Human
aaauacuugacacagaua

SEQ ID NO: 153658 - RNA, 21 nt, Human
aacauuguugcuuuguugcag

SEQ ID NO: 153659 - RNA, 27 nt, Human
aagcauguuggaauaaugccaaaaaca

SEQ ID NO: 153660 - RNA, 23 nt, Human
acauucuuacauaacaucuguuu

SEQ ID NO: 153661 - RNA, 21 nt, Human
acuccaccacuaucaaaacaa

SEQ ID NO: 153662 - RNA, 24 nt, Human
agaaaaauauuuuccaaggucaaa

SEQ ID NO: 153663 - RNA, 25 nt, Human
caaaauacuguaaugcacaccaaug

SEQ ID NO: 153664 - RNA, 27 nt, Human
caaaauacuguaaugcacaccaaugca

SEQ ID NO: 153665 - RNA, 18 nt, Human
caaggucaaaaaauucag

SEQ ID NO: 153666 - RNA, 22 nt, Human
cacaguauacauaauaagcaga

SEQ ID NO: 153667 - RNA, 21 nt, Human
caccauauucacaggcaaaau

SEQ ID NO: 153668 - RNA, 21 nt, Human
cacccagcuaaagagcagcga

SEQ ID NO: 153669 - RNA, 25 nt, Human
cagauaaacacauaaaauggcccca

SEQ ID NO: 153670 - RNA, 25 nt, Human
caucaagaaaaaugaaucugacauu

SEQ ID NO: 153671 - RNA, 19 nt, Human
ccccaaucugauucgcgcc

SEQ ID NO: 153672 - RNA, 27 nt, Human
cccugaaugacagacaccaaccauugg

SEQ ID NO: 153673 - RNA, 18 nt, Human
cccugggauggggauaaa

SEQ ID NO: 153674 - RNA, 20 nt, Human
ccucggggccacggcuuucc

SEQ ID NO: 153675 - RNA, 22 nt, Human
ccucggggccacggcuuucccc

SEQ ID NO: 153676 - RNA, 19 nt, Human
ccuugguaaaguaagaaaa

SEQ ID NO: 153677 - RNA, 23 nt, Human
cuccaccacuaucaaaacaauuc

SEQ ID NO: 153678 - RNA, 24 nt, Human
gagcagcgaucuccgaggcgagca

SEQ ID NO: 153679 - RNA, 23 nt, Human
gcagcgaucuccgaggcgagcac

SEQ ID NO: 153680 - RNA, 19 nt, Human
ggagacgccgcgagcccag

SEQ ID NO: 153681 - RNA, 20 nt, Human
ggucaaaaaauucaguuuaa

SEQ ID NO: 153682 - RNA, 24 nt, Human
guacuuuacaguucauucaaaugu

SEQ ID NO: 153683 - RNA, 24 nt, Human
uaagaaaaauauuuuccaagguca

SEQ ID NO: 153684 - RNA, 24 nt, Human
uaagcagaauauaaacuaaaucaa

SEQ ID NO: 153685 - RNA, 22 nt, Human
uacauaacaucuguuuuauaua

SEQ ID NO: 153686 - RNA, 21 nt, Human
uagauuuugaaucauggacaa

SEQ ID NO: 153687 - RNA, 21 nt, Human
uagucuaauuaaggaaacuuc

SEQ ID NO: 153688 - RNA, 19 nt, Human
uauguuaaaauauacaaca

SEQ ID NO: 153689 - RNA, 20 nt, Human
ucaacagagccaugacaaac

SEQ ID NO: 153690 - RNA, 19 nt, Human
ucggggccacggcuuuccc

SEQ ID NO: 153691 - RNA, 19 nt, Human
ucguccgcgagccgcggag

SEQ ID NO: 153692 - RNA, 25 nt, Human
ucuuucuuuucucuauguggaaucu

SEQ ID NO: 153693 - RNA, 22 nt, Human
ugacaaaaauuguguuuccaaa

SEQ ID NO: 153694 - RNA, 22 nt, Human
ugcacaccaaugcagacuacuu

SEQ ID NO: 153695 - RNA, 22 nt, Human
ugcccugaaugacagacaccau

SEQ ID NO: 153696 - RNA, 19 nt, Human
ugcuuagauuuugaaucau

SEQ ID NO: 153697 - RNA, 20 nt, Human
uggaauaaugccaaaaacaa

SEQ ID NO: 153698 - RNA, 19 nt, Human
ugggauggggauaaaauaa

SEQ ID NO: 153699 - RNA, 18 nt, Human
uguccaagguauggcugu

SEQ ID NO: 153700 - RNA, 22 nt, Human
ugugcucacucagguuugcaug

SEQ ID NO: 153701 - RNA, 18 nt, Human
uuauacccugggaugggg

SEQ ID NO: 153702 - RNA, 21 nt, Human
uuccaaggucaaaaaauucag

SEQ ID NO: 153703 - RNA, 21 nt, Human
uucccuucaaggcuucuuaaa

SEQ ID NO: 153704 - RNA, 21 nt, Human
uugcaaucaacagagccauga

SEQ ID NO: 153705 - RNA, 19 nt, Human
uuguguuuccaaaaauaac

SEQ ID NO: 153706 - RNA, 25 nt, Human
aaaaaaguaaaaacuaaacagaaaa

SEQ ID NO: 153707 - RNA, 22 nt, Human
aaaaaguaaaaacuaaacagaa

SEQ ID NO: 153708 - RNA, 21 nt, Human
aaaagcacucuguacaaagcc

SEQ ID NO: 153709 - RNA, 19 nt, Human
aaacuaaacagaaaagcac

SEQ ID NO: 153710 - RNA, 22 nt, Human
aacaaaacaaaaaaaguaaaaa

SEQ ID NO: 153711 - RNA, 22 nt, Human
aacacccauucuccccuggguc

SEQ ID NO: 153712 - RNA, 19 nt, Human
aagcacucuguacaaagcc

SEQ ID NO: 153713 - RNA, 20 nt, Human
aagcaggaaggaagguuccu

SEQ ID NO: 153714 - RNA, 23 nt, Human
aagcaggaaggaagguuccuuag

SEQ ID NO: 153715 - RNA, 26 nt, Human
acaaaacaaaaaaaguaaaaacuaaa

SEQ ID NO: 153716 - RNA, 27 nt, Human
agaaaagcacucuguacaaagccugga

SEQ ID NO: 153717 - RNA, 27 nt, Human
agaaggaccccccacacuuuguaccuc

SEQ ID NO: 153718 - RNA, 22 nt, Human
aggccuucccugcucccugagg

SEQ ID NO: 153719 - RNA, 20 nt, Human
agguuccuggcauggcaggu

SEQ ID NO: 153720 - RNA, 22 nt, Human
caaagacuccccagugcuguuc

SEQ ID NO: 153721 - RNA, 18 nt, Human
caaauggacaaagugggu

SEQ ID NO: 153722 - RNA, 18 nt, Human
caacgaggcuggaccccu

SEQ ID NO: 153723 - RNA, 19 nt, Human
cagaauccacaaagacucc

SEQ ID NO: 153724 - RNA, 20 nt, Human
cagaauccacaaagacuccc

SEQ ID NO: 153725 - RNA, 22 nt, Human
caggccagcuucccuaaggcuu

SEQ ID NO: 153726 - RNA, 20 nt, Human
cauggggggcaguacuaggu

SEQ ID NO: 153727 - RNA, 23 nt, Human
ccagcagaagucaggccuucccu

SEQ ID NO: 153728 - RNA, 19 nt, Human
cccagugcuguuccucuuc

SEQ ID NO: 153729 - RNA, 18 nt, Human
ccucagaauccacaaaga

SEQ ID NO: 153730 - RNA, 21 nt, Human
ccucuugaugccagcagaagu

SEQ ID NO: 153731 - RNA, 23 nt, Human
ccuggcauggcagguuccccugg

SEQ ID NO: 153732 - RNA, 21 nt, Human
cgcccucgagcucgucgaccc

SEQ ID NO: 153733 - RNA, 19 nt, Human
cggcugggagggcgcgggg

SEQ ID NO: 153734 - RNA, 29 nt, Human
cgucuuuaaaaaaacaaaacaaaaaaagg

SEQ ID NO: 153735 - RNA, 21 nt, Human
cucagaauccacaaagacucc

SEQ ID NO: 153736 - RNA, 25 nt, Human
cuccccagugcuguuccucuuccaa

SEQ ID NO: 153737 - RNA, 21 nt, Human
cucucaggccagcuucccuaa

SEQ ID NO: 153738 - RNA, 20 nt, Human
cuggcauggcagguuccccu

SEQ ID NO: 153739 - RNA, 24 nt, Human
cuuagggccgcuuccccucucagg

SEQ ID NO: 153740 - RNA, 18 nt, Human
gaucuggaaggaaagggc

SEQ ID NO: 153741 - RNA, 21 nt, Human
gcacucuguacaaagccugga

SEQ ID NO: 153742 - RNA, 22 nt, Human
gcggggcgcggggugcugcgag

SEQ ID NO: 153743 - RNA, 20 nt, Human
ggagggcgcggggcgcgggg

SEQ ID NO: 153744 - RNA, 20 nt, Human
ggcuguggcauccacuggac

SEQ ID NO: 153745 - RNA, 20 nt, Human
gggcgcggggugcugcgagg

SEQ ID NO: 153746 - RNA, 18 nt, Human
uagguuucagggacaguc

SEQ ID NO: 153747 - RNA, 21 nt, Human
uagguuucagggacagucucu

SEQ ID NO: 153748 - RNA, 21 nt, Human
ucacugcggcuccggccccau

SEQ ID NO: 153749 - RNA, 22 nt, Human
ucauggggggcaguacuagguu

SEQ ID NO: 153750 - RNA, 22 nt, Human
uccccauacaacacccauucuc

SEQ ID NO: 153751 - RNA, 21 nt, Human
ucccugaggacacaucagggc

SEQ ID NO: 153752 - RNA, 26 nt, Human
ucccugaggacacaucagggcuucug

SEQ ID NO: 153753 - RNA, 18 nt, Human
ucccugcucccugaggac

SEQ ID NO: 153754 - RNA, 18 nt, Human
uccggcuggacccggcug

SEQ ID NO: 153755 - RNA, 21 nt, Human
ucucauugggcagggccucag

SEQ ID NO: 153756 - RNA, 21 nt, Human
ugcgaggggugggggccgggc

SEQ ID NO: 153757 - RNA, 25 nt, Human
ugcgaggggugggggccgggcgcgc

SEQ ID NO: 153758 - RNA, 21 nt, Human
ugcugcgaggggugggggccg

SEQ ID NO: 153759 - RNA, 22 nt, Human
uggaaggaaagggccaagcugg

SEQ ID NO: 153760 - RNA, 22 nt, Human
uggcauggcagguuccccugga

SEQ ID NO: 153761 - RNA, 21 nt, Human
aaaaaauuaaaaacugaauca

SEQ ID NO: 153762 - RNA, 25 nt, Human
aaaaacaaauaaaauuaauggucug

SEQ ID NO: 153763 - RNA, 21 nt, Human
aaaacacuauuacacugauac

SEQ ID NO: 153764 - RNA, 22 nt, Human
aaaagaaaaaaaaaaaaaaaag

SEQ ID NO: 153765 - RNA, 23 nt, Human
aaaagucuuaauuaaaaucaagg

SEQ ID NO: 153766 - RNA, 25 nt, Human
aaaauaaaccuacaaucuauacaaa

SEQ ID NO: 153767 - RNA, 25 nt, Human
aaaauacagcacauuucuucuacua

SEQ ID NO: 153768 - RNA, 20 nt, Human
aaacaaaauuaauaaaccuc

SEQ ID NO: 153769 - RNA, 20 nt, Human
aaacagauugcaaguaccac

SEQ ID NO: 153770 - RNA, 22 nt, Human
aaagaggcuuuccuaaaccuuc

SEQ ID NO: 153771 - RNA, 26 nt, Human
aaagguuccagacuagccucaacuaa

SEQ ID NO: 153772 - RNA, 24 nt, Human
aacgaggaucuccgccgaaaaaaa

SEQ ID NO: 153773 - RNA, 22 nt, Human
aagaagugcaauauuugaguuc

SEQ ID NO: 153774 - RNA, 24 nt, Human
aagaguagguggcuuugguggggg

SEQ ID NO: 153775 - RNA, 23 nt, Human
aagccaacacuucaaaucucuug

SEQ ID NO: 153776 - RNA, 19 nt, Human
acaaagcauaacagauuaa

SEQ ID NO: 153777 - RNA, 22 nt, Human
acaggcaacacaaucuuaaaac

SEQ ID NO: 153778 - RNA, 19 nt, Human
accuguagaaacagcccuu

SEQ ID NO: 153779 - RNA, 22 nt, Human
agauuuuuauagaaaauaacug

SEQ ID NO: 153780 - RNA, 22 nt, Human
agcaauucucuaucacugugcc

SEQ ID NO: 153781 - RNA, 21 nt, Human
agcuccaaguguacuguuucc

SEQ ID NO: 153782 - RNA, 21 nt, Human
aggcaacacaaucuuaaaacu

SEQ ID NO: 153783 - RNA, 19 nt, Human
auuggucuucuauggcacu

SEQ ID NO: 153784 - RNA, 18 nt, Human
auuuguuacaguaacuag

SEQ ID NO: 153785 - RNA, 24 nt, Human
caaagcauaacagauuaaaaauuc

SEQ ID NO: 153786 - RNA, 21 nt, Human
caagaacagauccugccgagc

SEQ ID NO: 153787 - RNA, 22 nt, Human
caaggccaaacaaaaaucaaag

SEQ ID NO: 153788 - RNA, 23 nt, Human
caagggccaaugcaaggccaaac

SEQ ID NO: 153789 - RNA, 23 nt, Human
caauggcuaugacaagaacagau

SEQ ID NO: 153790 - RNA, 22 nt, Human
cacaaagcuugcuuugguuucc

SEQ ID NO: 153791 - RNA, 18 nt, Human
cacagaaaaugcauggac

SEQ ID NO: 153792 - RNA, 18 nt, Human
caccagcaccaccuucac

SEQ ID NO: 153793 - RNA, 23 nt, Human
caccaguagcaaauguauaguca

SEQ ID NO: 153794 - RNA, 22 nt, Human
cacugugccaguuucacaaagc

SEQ ID NO: 153795 - RNA, 18 nt, Human
cagauugcaaguaccacc

SEQ ID NO: 153796 - RNA, 20 nt, Human
cauaacacagaaaaugcaug

SEQ ID NO: 153797 - RNA, 21 nt, Human
cauccccauucuuugcuucca

SEQ ID NO: 153798 - RNA, 19 nt, Human
ccaaaaauaaaccuacaau

SEQ ID NO: 153799 - RNA, 22 nt, Human
ccaaaaauaaaccuacaaucua

SEQ ID NO: 153800 - RNA, 18 nt, Human
ccaccuucaccuacucac

SEQ ID NO: 153801 - RNA, 20 nt, Human
ccaccuucaccuacucacuc

SEQ ID NO: 153802 - RNA, 19 nt, Human
ccccuguaaguaucuucca

SEQ ID NO: 153803 - RNA, 24 nt, Human
ccgaaaaaaaaagaaaaaaaaaaa

SEQ ID NO: 153804 - RNA, 23 nt, Human
ccucccacagaagaagaguaggu

SEQ ID NO: 153805 - RNA, 24 nt, Human
cuaccacguagcucuccccauccc

SEQ ID NO: 153806 - RNA, 18 nt, Human
cuagcaagaauggaaagu

SEQ ID NO: 153807 - RNA, 26 nt, Human
cucuccccauccccauucuuugcuuc

SEQ ID NO: 153808 - RNA, 19 nt, Human
cuuuggauccagcugaaua

SEQ ID NO: 153809 - RNA, 20 nt, Human
gacaaaaacaaauaaaauua

SEQ ID NO: 153810 - RNA, 19 nt, Human
gauccagcugaauaucucu

SEQ ID NO: 153811 - RNA, 19 nt, Human
gcgggacaccgucucaggg

SEQ ID NO: 153812 - RNA, 21 nt, Human
gcgggcuggcuuccuggucuc

SEQ ID NO: 153813 - RNA, 20 nt, Human
gcuuccuggucucgaguuuu

SEQ ID NO: 153814 - RNA, 27 nt, Human
ggagaaaaacauuaauaccaguugaau

SEQ ID NO: 153815 - RNA, 22 nt, Human
ggcauaaaagcuaugagagaga

SEQ ID NO: 153816 - RNA, 26 nt, Human
gguuggggugcgggcuggcuuccugg

SEQ ID NO: 153817 - RNA, 24 nt, Human
guagcucuccccauccccauucuu

SEQ ID NO: 153818 - RNA, 19 nt, Human
gugcgggcuggcuuccugg

SEQ ID NO: 153819 - RNA, 19 nt, Human
gugcugccuacuuacucuu

SEQ ID NO: 153820 - RNA, 23 nt, Human
uaaacaaagcauaacagauuaaa

SEQ ID NO: 153821 - RNA, 22 nt, Human
uaaaccucuaucaucaaauauu

SEQ ID NO: 153822 - RNA, 20 nt, Human
uaacacagaaaaugcaugga

SEQ ID NO: 153823 - RNA, 22 nt, Human
uaaguaucuuccaauaaaucuu

SEQ ID NO: 153824 - RNA, 24 nt, Human
uacacacuggcaggccucaaggac

SEQ ID NO: 153825 - RNA, 24 nt, Human
uagacaaaaacaaauaaaauuaau

SEQ ID NO: 153826 - RNA, 19 nt, Human
uagcaagaauggaaaguga

SEQ ID NO: 153827 - RNA, 18 nt, Human
uagcucuccccaucccca

SEQ ID NO: 153828 - RNA, 23 nt, Human
uauagucaauggcuaugacaaga

SEQ ID NO: 153829 - RNA, 25 nt, Human
uaucacugugccaguuucacaaagc

SEQ ID NO: 153830 - RNA, 23 nt, Human
uaugcacauagcaaaagccaaca

SEQ ID NO: 153831 - RNA, 23 nt, Human
ucaccaguagcaaauguauaguc

SEQ ID NO: 153832 - RNA, 18 nt, Human
ucacugugccaguuucac

SEQ ID NO: 153833 - RNA, 18 nt, Human
uccauaaaaaucaauucc

SEQ ID NO: 153834 - RNA, 21 nt, Human
uccccgcuuuuuuuguccaca

SEQ ID NO: 153835 - RNA, 20 nt, Human
ucccuuugcucuauaacucu

SEQ ID NO: 153836 - RNA, 24 nt, Human
uccgccgaaaaaaaaagaaaaaaa

SEQ ID NO: 153837 - RNA, 25 nt, Human
uccgccgaaaaaaaaagaaaaaaaa

SEQ ID NO: 153838 - RNA, 23 nt, Human
ucgcuugacaugauuuccuuccc

SEQ ID NO: 153839 - RNA, 19 nt, Human
ucucagggcagcuuuuuca

SEQ ID NO: 153840 - RNA, 18 nt, Human
ucuccgccgaaaaaaaaa

SEQ ID NO: 153841 - RNA, 25 nt, Human
ugaaauccaaaaauaaaccuacaau

SEQ ID NO: 153842 - RNA, 22 nt, Human
ugaagugcaauaaccaaauauu

SEQ ID NO: 153843 - RNA, 20 nt, Human
ugagagagauagcucugcca

SEQ ID NO: 153844 - RNA, 21 nt, Human
ugaguuaaaauuuacaaagag

SEQ ID NO: 153845 - RNA, 21 nt, Human
ugcaaggccaaacaaaaauca

SEQ ID NO: 153846 - RNA, 25 nt, Human
ugcacacaguucagucauguauaug

SEQ ID NO: 153847 - RNA, 23 nt, Human
ugcacauagcaaaagccaacacu

SEQ ID NO: 153848 - RNA, 24 nt, Human
ugccaucugucucugggcuaaaau

SEQ ID NO: 153849 - RNA, 20 nt, Human
uggcaggccucaaggaccca

SEQ ID NO: 153850 - RNA, 24 nt, Human
uggcuuugguggggguuggggugc

SEQ ID NO: 153851 - RNA, 21 nt, Human
ugggcuaaaaucaaggcuaac

SEQ ID NO: 153852 - RNA, 18 nt, Human
uggggguuggggugcggg

SEQ ID NO: 153853 - RNA, 23 nt, Human
uggggugcgggcuggcuuccugg

SEQ ID NO: 153854 - RNA, 19 nt, Human
uguggacuggccucccaca

SEQ ID NO: 153855 - RNA, 21 nt, Human
uuaaaaauuuccugugacuaa

SEQ ID NO: 153856 - RNA, 23 nt, Human
uuaauaaaccucuaucaucaaau

SEQ ID NO: 153857 - RNA, 22 nt, Human
uuacaaagaguuguuaaagggu

SEQ ID NO: 153858 - RNA, 19 nt, Human
uucacauauuuuuaaaagu

SEQ ID NO: 153859 - RNA, 21 nt, Human
uucacauuuaauguuaccugu

SEQ ID NO: 153860 - RNA, 21 nt, Human
uucccagccccaacgaggauc

SEQ ID NO: 153861 - RNA, 19 nt, Human
uugaacaccuuuacacacu

SEQ ID NO: 153862 - RNA, 25 nt, Human
uugcugcuuaaaauaaaaauuauaa

SEQ ID NO: 153863 - RNA, 18 nt, Human
uuuuguuucauuugcugc

SEQ ID NO: 153864 - RNA, 21 nt, Human
uuuuuuuuuuuuuugucuuaa

SEQ ID NO: 153865 - RNA, 18 nt, Human
uuuuuuuuuuuuuuuuug

SEQ ID NO: 153866 - RNA, 24 nt, Human
aaagugcugagauuacaggcauga

SEQ ID NO: 153867 - RNA, 18 nt, Human
aaaugcucccugagugcc

SEQ ID NO: 153868 - RNA, 26 nt, Human
aagcuucugucuuucuaggggguuuu

SEQ ID NO: 153869 - RNA, 26 nt, Human
aagugcugagauuacaggcaugagcc

SEQ ID NO: 153870 - RNA, 23 nt, Human
acuauguuggcuaagcuggucuc

SEQ ID NO: 153871 - RNA, 19 nt, Human
agaggaagggauauggaga

SEQ ID NO: 153872 - RNA, 19 nt, Human
agagggugaagggagccca

SEQ ID NO: 153873 - RNA, 22 nt, Human
agauuacaggcaugagccacca

SEQ ID NO: 153874 - RNA, 24 nt, Human
agauuacaggcaugagccaccaug

SEQ ID NO: 153875 - RNA, 24 nt, Human
agcuggucucaaacuccuugccuc

SEQ ID NO: 153876 - RNA, 21 nt, Human
aggcaugagccaccaugcccg

SEQ ID NO: 153877 - RNA, 21 nt, Human
auggcaggggaggggugugug

SEQ ID NO: 153878 - RNA, 22 nt, Human
augggggucuuacuauguuggc

SEQ ID NO: 153879 - RNA, 20 nt, Human
caaaauaaggaaaaccuuuc

SEQ ID NO: 153880 - RNA, 24 nt, Human
caaaauuacacuuuccucugcuag

SEQ ID NO: 153881 - RNA, 24 nt, Human
caaagugcugagauuacaggcaug

SEQ ID NO: 153882 - RNA, 25 nt, Human
caagagccaccugaaccgcuggccg

SEQ ID NO: 153883 - RNA, 22 nt, Human
cacauaagagccuaguuccaag

SEQ ID NO: 153884 - RNA, 18 nt, Human
caccaugcccgacuuccc

SEQ ID NO: 153885 - RNA, 22 nt, Human
cagguaauccuucugccucagc

SEQ ID NO: 153886 - RNA, 23 nt, Human
ccaaagugcugagauuacaggca

SEQ ID NO: 153887 - RNA, 24 nt, Human
ccaaagugcugagauuacaggcau

SEQ ID NO: 153888 - RNA, 21 nt, Human
cccucuaaaggcacuagcugc

SEQ ID NO: 153889 - RNA, 21 nt, Human
ccuaggcuaggacaucgaggc

SEQ ID NO: 153890 - RNA, 26 nt, Human
ccuucugccucagccucccaaagugc

SEQ ID NO: 153891 - RNA, 19 nt, Human
cgacggcagcggagguugc

SEQ ID NO: 153892 - RNA, 25 nt, Human
cggggagggauggcaggggaggggu

SEQ ID NO: 153893 - RNA, 25 nt, Human
cucaaacuccuugccucagguaauc

SEQ ID NO: 153894 - RNA, 21 nt, Human
cucccaaagugcugagauuac

SEQ ID NO: 153895 - RNA, 23 nt, Human
cugccucagccucccaaagugcu

SEQ ID NO: 153896 - RNA, 21 nt, Human
cugggacuggggaaaaggggc

SEQ ID NO: 153897 - RNA, 21 nt, Human
cuuuccucuucuugacagucu

SEQ ID NO: 153898 - RNA, 19 nt, Human
gaagaagcugaggaauggg

SEQ ID NO: 153899 - RNA, 22 nt, Human
gaagacgguacccucuaaaggc

SEQ ID NO: 153900 - RNA, 27 nt, Human
gagccggagccggaguccggggaggga

SEQ ID NO: 153901 - RNA, 24 nt, Human
gaggcaagagccaccugaaccgcu

SEQ ID NO: 153902 - RNA, 18 nt, Human
gauuacaggcaugagcca

SEQ ID NO: 153903 - RNA, 24 nt, Human
gauuacaggcaugagccaccaugc

SEQ ID NO: 153904 - RNA, 21 nt, Human
gccucagccucccaaagugcu

SEQ ID NO: 153905 - RNA, 22 nt, Human
ggaaaaggggcugggaccuggg

SEQ ID NO: 153906 - RNA, 22 nt, Human
ggagaagacgguacccucuaaa

SEQ ID NO: 153907 - RNA, 24 nt, Human
ggagccggagccggaguccgggga

SEQ ID NO: 153908 - RNA, 22 nt, Human
ggagugccugugaagaagcuga

SEQ ID NO: 153909 - RNA, 19 nt, Human
gggaauagggagaagacgg

SEQ ID NO: 153910 - RNA, 21 nt, Human
gggcugggaccugggagagag

SEQ ID NO: 153911 - RNA, 23 nt, Human
ggggaaaaggggcugggaccugg

SEQ ID NO: 153912 - RNA, 23 nt, Human
ggggagggauggcaggggagggg

SEQ ID NO: 153913 - RNA, 20 nt, Human
gggguugggaaagagaagaa

SEQ ID NO: 153914 - RNA, 24 nt, Human
guaauccuucugccucagccuccc

SEQ ID NO: 153915 - RNA, 23 nt, Human
uacaggcaugagccaccaugccc

SEQ ID NO: 153916 - RNA, 21 nt, Human
uacuauguuggcuaagcuggu

SEQ ID NO: 153917 - RNA, 23 nt, Human
uaguuccaaguagucaagagccu

SEQ ID NO: 153918 - RNA, 24 nt, Human
uauguuggcuaagcuggucucaaa

SEQ ID NO: 153919 - RNA, 24 nt, Human
ucccaaagugcugagauuacaggc

SEQ ID NO: 153920 - RNA, 24 nt, Human
uccuaaccucuuucuucacagauu

SEQ ID NO: 153921 - RNA, 19 nt, Human
ucggagccggagccggagu

SEQ ID NO: 153922 - RNA, 22 nt, Human
ucugggacuggggaaaaggggc

SEQ ID NO: 153923 - RNA, 23 nt, Human
ucuuacuauguuggcuaagcugg

SEQ ID NO: 153924 - RNA, 24 nt, Human
ucuuacuauguuggcuaagcuggu

SEQ ID NO: 153925 - RNA, 22 nt, Human
ugaagggagcccagccaagucc

SEQ ID NO: 153926 - RNA, 23 nt, Human
ugagauaauauguaugucacaga

SEQ ID NO: 153927 - RNA, 22 nt, Human
ugagauuacaggcaugagccac

SEQ ID NO: 153928 - RNA, 23 nt, Human
ugagauuacaggcaugagccacc

SEQ ID NO: 153929 - RNA, 24 nt, Human
ugagauuacaggcaugagccacca

SEQ ID NO: 153930 - RNA, 24 nt, Human
ugccucagccucccaaagugcuga

SEQ ID NO: 153931 - RNA, 21 nt, Human
ugccucagguaauccuucugc

SEQ ID NO: 153932 - RNA, 23 nt, Human
ugccucagguaauccuucugccu

SEQ ID NO: 153933 - RNA, 25 nt, Human
ugccucagguaauccuucugccuca

SEQ ID NO: 153934 - RNA, 24 nt, Human
uggcuaagcuggucucaaacuccu

SEQ ID NO: 153935 - RNA, 19 nt, Human
ugggaaacaaaggcacaca

SEQ ID NO: 153936 - RNA, 21 nt, Human
ugggaccugggagagagaggg

SEQ ID NO: 153937 - RNA, 24 nt, Human
ugggacuggggaaaaggggcuggg

SEQ ID NO: 153938 - RNA, 21 nt, Human
ugucacagaauuguuuuaagg

SEQ ID NO: 153939 - RNA, 24 nt, Human
uugccucagguaauccuucugccu

SEQ ID NO: 153940 - RNA, 18 nt, Human
uugguggcugcugcggcg

SEQ ID NO: 153941 - RNA, 21 nt, Human
aaaaaaaaaaaaagaagagga

SEQ ID NO: 153942 - RNA, 23 nt, Human
aaaaaaaaaaagaagaggaagaa

SEQ ID NO: 153943 - RNA, 22 nt, Human
aaaaaaaaaagaagaggaagaa

SEQ ID NO: 153944 - RNA, 18 nt, Human
aaaaaagaagaggaagaa

SEQ ID NO: 153945 - RNA, 24 nt, Human
aaaacaaaaugaaaaaaaccaaaa

SEQ ID NO: 153946 - RNA, 22 nt, Human
aaagaaaaagaaaaaaagugac

SEQ ID NO: 153947 - RNA, 22 nt, Human
aaagaaaaagaaaaagaaaaaa

SEQ ID NO: 153948 - RNA, 21 nt, Human
aaagaaagaaaaagaaaaaga

SEQ ID NO: 153949 - RNA, 26 nt, Human
aaagaagaggaagaaagaaacaaaga

SEQ ID NO: 153950 - RNA, 21 nt, Human
aaaugaaaaaaaccaaaaagu

SEQ ID NO: 153951 - RNA, 19 nt, Human
aaauguacuuaaauuaguu

SEQ ID NO: 153952 - RNA, 24 nt, Human
aacaaagaaagaaaaagaaaaaga

SEQ ID NO: 153953 - RNA, 24 nt, Human
aacugucucuuaguuucccuucua

SEQ ID NO: 153954 - RNA, 19 nt, Human
aagaaagaaaaagaaaaag

SEQ ID NO: 153955 - RNA, 20 nt, Human
aagaaagaaaaagaaaaaga

SEQ ID NO: 153956 - RNA, 23 nt, Human
aagaaagaaacaaagaaagaaaa

SEQ ID NO: 153957 - RNA, 22 nt, Human
aagaagaggaagaaagaaacaa

SEQ ID NO: 153958 - RNA, 24 nt, Human
aaguaucaguaguuuuccugaacc

SEQ ID NO: 153959 - RNA, 25 nt, Human
aaguguugaaaacauaauuacuucg

SEQ ID NO: 153960 - RNA, 27 nt, Human
acaaagaaagaaaaagaaaaagaaaaa

SEQ ID NO: 153961 - RNA, 22 nt, Human
acauaacuaucauugcaucucu

SEQ ID NO: 153962 - RNA, 24 nt, Human
agaaaaaaaaauguugaaaaaugu

SEQ ID NO: 153963 - RNA, 22 nt, Human
agaaaaagaaaaaaagugacag

SEQ ID NO: 153964 - RNA, 21 nt, Human
agaaaaagaaaaagaaaaaaa

SEQ ID NO: 153965 - RNA, 19 nt, Human
agaaaaagaacaaauaaaa

SEQ ID NO: 153966 - RNA, 25 nt, Human
agaagaggaagaaagaaacaaagaa

SEQ ID NO: 153967 - RNA, 21 nt, Human
agacauacccaauccagugug

SEQ ID NO: 153968 - RNA, 18 nt, Human
agagaaagagaggggggu

SEQ ID NO: 153969 - RNA, 22 nt, Human
agaggaagaaagaaacaaagaa

SEQ ID NO: 153970 - RNA, 24 nt, Human
agagggggguggggaaauuggagc

SEQ ID NO: 153971 - RNA, 20 nt, Human
agcaaaacaaaaugaaaaaa

SEQ ID NO: 153972 - RNA, 26 nt, Human
agcaaaacaaaaugaaaaaaaccaaa

SEQ ID NO: 153973 - RNA, 19 nt, Human
agcuuaagugcaaacuaca

SEQ ID NO: 153974 - RNA, 23 nt, Human
aggaagaaagaaacaaagaaaga

SEQ ID NO: 153975 - RNA, 24 nt, Human
aggacagaaacugcuggggaaaga

SEQ ID NO: 153976 - RNA, 21 nt, Human
agggggguggggaaauuggag

SEQ ID NO: 153977 - RNA, 24 nt, Human
caaaauggaguucagaaaaagaac

SEQ ID NO: 153978 - RNA, 21 nt, Human
caaaggugacauaugaagaua

SEQ ID NO: 153979 - RNA, 27 nt, Human
caaauaaaauuacagcuuaagugcaaa

SEQ ID NO: 153980 - RNA, 24 nt, Human
caacccaugcagagaaaugaagaa

SEQ ID NO: 153981 - RNA, 19 nt, Human
caaggaccuaucccuaagc

SEQ ID NO: 153982 - RNA, 20 nt, Human
cacauuuauuuacaacuuuu

SEQ ID NO: 153983 - RNA, 19 nt, Human
caccuaaaaaaccacaacu

SEQ ID NO: 153984 - RNA, 25 nt, Human
cacuauauuaaaauauuucuugcuu

SEQ ID NO: 153985 - RNA, 23 nt, Human
caguguguuucuuccaguucaau

SEQ ID NO: 153986 - RNA, 24 nt, Human
caucucuguaucuuccacugggaa

SEQ ID NO: 153987 - RNA, 28 nt, Human
ccaucugcuuuaaaaaaaaaaaaaaaaa

SEQ ID NO: 153988 - RNA, 24 nt, Human
cccaugcagagaaaugaagaaaca

SEQ ID NO: 153989 - RNA, 18 nt, Human
cgaaguauacgaacugaa

SEQ ID NO: 153990 - RNA, 19 nt, Human
cucuagcuguuucauucuc

SEQ ID NO: 153991 - RNA, 20 nt, Human
cucuagcuguuucauucucc

SEQ ID NO: 153992 - RNA, 21 nt, Human
gaaaauguuauucuuuuguuc

SEQ ID NO: 153993 - RNA, 21 nt, Human
gaaacugcuggggaaagaaac

SEQ ID NO: 153994 - RNA, 24 nt, Human
gaagaaagaaacaaagaaagaaaa

SEQ ID NO: 153995 - RNA, 23 nt, Human
gaccaccagagaaagagaggggg

SEQ ID NO: 153996 - RNA, 22 nt, Human
gagcaaaacaaaaugaaaaaaa

SEQ ID NO: 153997 - RNA, 26 nt, Human
gagcaaaacaaaaugaaaaaaaccaa

SEQ ID NO: 153998 - RNA, 22 nt, Human
gcaauuagaaauuaaagccaaa

SEQ ID NO: 153999 - RNA, 23 nt, Human
gccuugggguagaaggaagacca

SEQ ID NO: 154000 - RNA, 18 nt, Human
ggaacagauagcaugggu

SEQ ID NO: 154001 - RNA, 23 nt, Human
ggagaaaaaaaaauguugaaaaa

SEQ ID NO: 154002 - RNA, 23 nt, Human
ggauucccucauugggccacccu

SEQ ID NO: 154003 - RNA, 21 nt, Human
gggaaagaaacuggauucuca

SEQ ID NO: 154004 - RNA, 20 nt, Human
gggggguggggaaauuggag

SEQ ID NO: 154005 - RNA, 24 nt, Human
guuccuccuaucuuucucuuucaa

SEQ ID NO: 154006 - RNA, 22 nt, Human
uaacuuuaauggagauuuuuaa

SEQ ID NO: 154007 - RNA, 24 nt, Human
uagcaugaaaaauauuagccuccc

SEQ ID NO: 154008 - RNA, 21 nt, Human
uaggaacagauagcaugggug

SEQ ID NO: 154009 - RNA, 21 nt, Human
uagguaagcacauaacuauca

SEQ ID NO: 154010 - RNA, 26 nt, Human
uaucuuucucuuucagucuuucccuc

SEQ ID NO: 154011 - RNA, 22 nt, Human
uccaaaauggaguucagaaaaa

SEQ ID NO: 154012 - RNA, 26 nt, Human
ucccucauugggccaccccugaaagu

SEQ ID NO: 154013 - RNA, 18 nt, Human
uccugaaccacagagaac

SEQ ID NO: 154014 - RNA, 18 nt, Human
uccuugcguagcaaaggu

SEQ ID NO: 154015 - RNA, 21 nt, Human
ucuccaccuaaaaaaccacaa

SEQ ID NO: 154016 - RNA, 20 nt, Human
ucucuguaucuuccacuggg

SEQ ID NO: 154017 - RNA, 25 nt, Human
ucugccagguagacauacccaaucc

SEQ ID NO: 154018 - RNA, 23 nt, Human
ucugcuuuaaaaaaaaaaaaaaa

SEQ ID NO: 154019 - RNA, 28 nt, Human
ucugcuuuaaaaaaaaaaaaaaaaagaa

SEQ ID NO: 154020 - RNA, 21 nt, Human
ucuucagacaaccaacggccu

SEQ ID NO: 154021 - RNA, 18 nt, Human
ucuuucucuuucagucuu

SEQ ID NO: 154022 - RNA, 20 nt, Human
ucuuuuuauuauaccaauuu

SEQ ID NO: 154023 - RNA, 18 nt, Human
ugaaaaaaaccaaaaagu

SEQ ID NO: 154024 - RNA, 30 nt, Human
ugaaaaaaaccaaaaaguguugaaaacauu

SEQ ID NO: 154025 - RNA, 22 nt, Human
ugaaaaauguaaaggaugaggg

SEQ ID NO: 154026 - RNA, 19 nt, Human
ugaaccacagagaacuguc

SEQ ID NO: 154027 - RNA, 20 nt, Human
ugaagaaacauugugguucc

SEQ ID NO: 154028 - RNA, 20 nt, Human
ugacccaaggaccuaucccu

SEQ ID NO: 154029 - RNA, 18 nt, Human
ugccagguagacauaccc

SEQ ID NO: 154030 - RNA, 21 nt, Human
ugcuuccauauugcuugauuc

SEQ ID NO: 154031 - RNA, 18 nt, Human
ugcuuuaaaaaaaaaaaa

SEQ ID NO: 154032 - RNA, 26 nt, Human
uguuucauucuccugaccaacccaug

SEQ ID NO: 154033 - RNA, 22 nt, Human
uuacauuuucugguccuucucu

SEQ ID NO: 154034 - RNA, 21 nt, Human
uucaagccaauccuuacucgc

SEQ ID NO: 154035 - RNA, 23 nt, Human
uucuuacuugcuaggacagaaac

SEQ ID NO: 154036 - RNA, 26 nt, Human
uugcaauuagaaauuaaagccaaaaa

SEQ ID NO: 154037 - RNA, 24 nt, Human
uugcuugauucaaaauccaaaaug

SEQ ID NO: 154038 - RNA, 26 nt, Human
uuuaaaaaaaaaaaaaaaaagaagag

SEQ ID NO: 154039 - RNA, 22 nt, Human
aucgaggcggcccacugccagc

SEQ ID NO: 154040 - RNA, 18 nt, Human
cagcguggcccagggcuc

SEQ ID NO: 154041 - RNA, 21 nt, Human
cuggagccugugguccgggcc

SEQ ID NO: 154042 - RNA, 18 nt, Human
gcccagggcucgcagcac

SEQ ID NO: 154043 - RNA, 19 nt, Human
ggagccugugguccgggcc

SEQ ID NO: 154044 - RNA, 25 nt, Human
gugguccgggccucacgguuucagc

SEQ ID NO: 154045 - RNA, 23 nt, Human
uggccugggaggacgauuuauua

SEQ ID NO: 154046 - RNA, 24 nt, Human
aaaacccuagaugaccuaugaagg

SEQ ID NO: 154047 - RNA, 29 nt, Human
aaauauugucuccuccuccuuuauaaaaa

SEQ ID NO: 154048 - RNA, 19 nt, Human
aaaugaccccacuccccaa

SEQ ID NO: 154049 - RNA, 22 nt, Human
aaggaaaauguuaugcugaaaa

SEQ ID NO: 154050 - RNA, 21 nt, Human
acagaaaugaccccacucccc

SEQ ID NO: 154051 - RNA, 19 nt, Human
agaaaugaccccacucccc

SEQ ID NO: 154052 - RNA, 23 nt, Human
agaugaccuaugaaggcacagcc

SEQ ID NO: 154053 - RNA, 22 nt, Human
agcagcagagagaagaugaccc

SEQ ID NO: 154054 - RNA, 22 nt, Human
cagcagagagaagaugaccccg

SEQ ID NO: 154055 - RNA, 21 nt, Human
cagcagcagagagaagaugac

SEQ ID NO: 154056 - RNA, 22 nt, Human
cagcuacagcagcagagagaag

SEQ ID NO: 154057 - RNA, 23 nt, Human
cauaaauacaccuuaaauauuaa

SEQ ID NO: 154058 - RNA, 18 nt, Human
ccaacgcuggagggaagg

SEQ ID NO: 154059 - RNA, 19 nt, Human
ccccaaaaaguuugaaaaa

SEQ ID NO: 154060 - RNA, 18 nt, Human
ccccgcucccacaggccc

SEQ ID NO: 154061 - RNA, 20 nt, Human
ccggucuugaacgaaguacc

SEQ ID NO: 154062 - RNA, 24 nt, Human
cugguucaaugguccauucuguuu

SEQ ID NO: 154063 - RNA, 22 nt, Human
gaaggucaaagagguggaagga

SEQ ID NO: 154064 - RNA, 23 nt, Human
uacagaaaugaccccacucccca

SEQ ID NO: 154065 - RNA, 24 nt, Human
uauacagaaaugaccccacucccc

SEQ ID NO: 154066 - RNA, 19 nt, Human
ucccacaggcccgccgcgg

SEQ ID NO: 154067 - RNA, 19 nt, Human
uccccaaaaaguuugaaaa

SEQ ID NO: 154068 - RNA, 24 nt, Human
ugaaaaaauauugucuccuccucc

SEQ ID NO: 154069 - RNA, 20 nt, Human
ugaccuaugaaggcacagcc

SEQ ID NO: 154070 - RNA, 21 nt, Human
ugcugaaaaucccuuuccaac

SEQ ID NO: 154071 - RNA, 19 nt, Human
uuccucagcacaauuuggc

SEQ ID NO: 154072 - RNA, 21 nt, Human
acugcaccgccgccuaggacc

SEQ ID NO: 154073 - RNA, 23 nt, Human
caacuucuacucuaauucuucua

SEQ ID NO: 154074 - RNA, 22 nt, Human
cagaagccacgguuuuccagug

SEQ ID NO: 154075 - RNA, 20 nt, Human
cccgacaacuucuacucuaa

SEQ ID NO: 154076 - RNA, 23 nt, Human
cccgacaacuucuacucuaauuc

SEQ ID NO: 154077 - RNA, 19 nt, Human
ccgacaacuucuacucuaa

SEQ ID NO: 154078 - RNA, 21 nt, Human
cgggaggaagcccucccugcu

SEQ ID NO: 154079 - RNA, 22 nt, Human
cugcaccgccgccuaggacccc

SEQ ID NO: 154080 - RNA, 22 nt, Human
cugcuccuacacaacaaagaug

SEQ ID NO: 154081 - RNA, 18 nt, Human
gaagcccucccugcuccu

SEQ ID NO: 154082 - RNA, 19 nt, Human
gcugcguccuaagagcgga

SEQ ID NO: 154083 - RNA, 25 nt, Human
gggagcgcauuaaagcggagagacu

SEQ ID NO: 154084 - RNA, 21 nt, Human
uaggaccccgggaggaagccc

SEQ ID NO: 154085 - RNA, 18 nt, Human
uuccagugggggacggca

SEQ ID NO: 154086 - RNA, 25 nt, Human
uuccagugggggacggcacuaaugg

SEQ ID NO: 154087 - RNA, 22 nt, Human
uucuacgacggacugcaccgcc

SEQ ID NO: 154088 - RNA, 20 nt, Human
aaacaucaagugcagccaac

SEQ ID NO: 154089 - RNA, 20 nt, Human
aaacaugauuauuaauaaua

SEQ ID NO: 154090 - RNA, 21 nt, Human
acccagggccgcgcgagcgcc

SEQ ID NO: 154091 - RNA, 23 nt, Human
caaacaaacaucaagugcagcca

SEQ ID NO: 154092 - RNA, 28 nt, Human
caaacaaacaucaagugcagccaacuuc

SEQ ID NO: 154093 - RNA, 21 nt, Human
cccacaaggaaacagagacgc

SEQ ID NO: 154094 - RNA, 21 nt, Human
cgagcgcccacaaggaaacag

SEQ ID NO: 154095 - RNA, 19 nt, Human
cgccagccgccuuggaacc

SEQ ID NO: 154096 - RNA, 18 nt, Human
cuacccagggccgcgcga

SEQ ID NO: 154097 - RNA, 18 nt, Human
cuaccgccgccagccgcc

SEQ ID NO: 154098 - RNA, 21 nt, Human
cuaccgccgccagccgccuug

SEQ ID NO: 154099 - RNA, 18 nt, Human
guagacaucaugcaaaca

SEQ ID NO: 154100 - RNA, 21 nt, Human
uccauugacaaacaugauuau

SEQ ID NO: 154101 - RNA, 22 nt, Human
uccauugacaaacaugauuauu

SEQ ID NO: 154102 - RNA, 19 nt, Human
ugagguagacaucaugcaa

SEQ ID NO: 154103 - RNA, 21 nt, Human
ugagguagacaucaugcaaac

SEQ ID NO: 154104 - RNA, 22 nt, Human
uuaaaguuuuaauucugaggua

SEQ ID NO: 154105 - RNA, 23 nt, Human
aaaaaaaaaagaaagagaaagaa

SEQ ID NO: 154106 - RNA, 23 nt, Human
aaaagaaagagaaagaaaaagag

SEQ ID NO: 154107 - RNA, 18 nt, Human
aaacaggauuacuaugau

SEQ ID NO: 154108 - RNA, 21 nt, Human
aaagaaagagaaagaaaaaga

SEQ ID NO: 154109 - RNA, 19 nt, Human
aaaguagauaugaacaguu

SEQ ID NO: 154110 - RNA, 25 nt, Human
aacaagauccucacauuucaucuaa

SEQ ID NO: 154111 - RNA, 21 nt, Human
aagaaaaagaggagguaacgg

SEQ ID NO: 154112 - RNA, 20 nt, Human
aagaaagagaaagaaaaaga

SEQ ID NO: 154113 - RNA, 21 nt, Human
aagcccaccccaaccccccca

SEQ ID NO: 154114 - RNA, 22 nt, Human
acaccgccgccguuacacgagc

SEQ ID NO: 154115 - RNA, 18 nt, Human
accccccaccccaucuug

SEQ ID NO: 154116 - RNA, 24 nt, Human
acuacagcacgcuguacacaccug

SEQ ID NO: 154117 - RNA, 20 nt, Human
agaaaaagaggagguaacgg

SEQ ID NO: 154118 - RNA, 24 nt, Human
agaaaaagaggagguaacgggggg

SEQ ID NO: 154119 - RNA, 20 nt, Human
agcagcugccgacaccgccg

SEQ ID NO: 154120 - RNA, 20 nt, Human
agcccaccccaaccccccca

SEQ ID NO: 154121 - RNA, 21 nt, Human
agcccaccccaacccccccag

SEQ ID NO: 154122 - RNA, 24 nt, Human
aguaaaaaaaaaaaaaagaaagag

SEQ ID NO: 154123 - RNA, 18 nt, Human
auuuccaccccccacccc

SEQ ID NO: 154124 - RNA, 20 nt, Human
auuuccaccccccaccccau

SEQ ID NO: 154125 - RNA, 23 nt, Human
caccccaacccccccagugcuuc

SEQ ID NO: 154126 - RNA, 24 nt, Human
caccccaacccccccagugcuucc

SEQ ID NO: 154127 - RNA, 18 nt, Human
caccccccaccccaucuu

SEQ ID NO: 154128 - RNA, 22 nt, Human
cccaccccaacccccccagugc

SEQ ID NO: 154129 - RNA, 20 nt, Human
cccaccccaucuugaagaag

SEQ ID NO: 154130 - RNA, 22 nt, Human
ccccaacccccccagugcuucc

SEQ ID NO: 154131 - RNA, 25 nt, Human
ccccaacccccccagugcuuccaac

SEQ ID NO: 154132 - RNA, 18 nt, Human
ccccaccccaucuugaag

SEQ ID NO: 154133 - RNA, 20 nt, Human
ccccccaccccaucuugaag

SEQ ID NO: 154134 - RNA, 23 nt, Human
cgaagaacaacuuccaucuaaau

SEQ ID NO: 154135 - RNA, 24 nt, Human
gaacaguugaaggacuggaaccaa

SEQ ID NO: 154136 - RNA, 20 nt, Human
gagcuuaacuacaacgccgc

SEQ ID NO: 154137 - RNA, 23 nt, Human
uaccaagacuuuaucuugaggac

SEQ ID NO: 154138 - RNA, 20 nt, Human
ugacgaagaacaacuuccau

SEQ ID NO: 154139 - RNA, 22 nt, Human
uggaaccaacauuaagugacga

SEQ ID NO: 154140 - RNA, 19 nt, Human
uuccaagcccaccccaacc

SEQ ID NO: 154141 - RNA, 25 nt, Human
uuuaaguaaaaaaaaaaaaaagaaa

SEQ ID NO: 154142 - RNA, 18 nt, Human
cagcauggagaccauuug

SEQ ID NO: 154143 - RNA, 21 nt, Human
cauggagaccauuuguguggc

SEQ ID NO: 154144 - RNA, 22 nt, Human
aaguaaaaggcggggcucaaga

SEQ ID NO: 154145 - RNA, 22 nt, Human
aauuuuuuuuuuuuuugcucag

SEQ ID NO: 154146 - RNA, 22 nt, Human
augccccgccccuccgguccca

SEQ ID NO: 154147 - RNA, 21 nt, Human
cagaagaagcgggccgaagua

SEQ ID NO: 154148 - RNA, 23 nt, Human
cagaagaagcgggccgaaguaaa

SEQ ID NO: 154149 - RNA, 21 nt, Human
ccauaugaugccccgccccuc

SEQ ID NO: 154150 - RNA, 18 nt, Human
cccgccccuccgguccca

SEQ ID NO: 154151 - RNA, 18 nt, Human
cccuccggucccacucac

SEQ ID NO: 154152 - RNA, 19 nt, Human
ccgccggggccucgccuca

SEQ ID NO: 154153 - RNA, 21 nt, Human
ccggucccacucacucucggc

SEQ ID NO: 154154 - RNA, 22 nt, Human
cgaaguaaaaggcggggcucaa

SEQ ID NO: 154155 - RNA, 22 nt, Human
cuuuuagcacuauaaaauccaa

SEQ ID NO: 154156 - RNA, 21 nt, Human
gccccgccccuccggucccac

SEQ ID NO: 154157 - RNA, 20 nt, Human
ugccccgccccuccgguccc

SEQ ID NO: 154158 - RNA, 19 nt, Human
uucaacuauagaauaaagc

SEQ ID NO: 154159 - RNA, 20 nt, Human
aacaaagucaccacccacgg

SEQ ID NO: 154160 - RNA, 25 nt, Human
acuugagggagguggggccagaggu

SEQ ID NO: 154161 - RNA, 19 nt, Human
agagguggggucccggggg

SEQ ID NO: 154162 - RNA, 20 nt, Human
aggcccgggcuaggccgcgc

SEQ ID NO: 154163 - RNA, 22 nt, Human
aggcggagcggcugugggcccg

SEQ ID NO: 154164 - RNA, 25 nt, Human
agggagguggggccagaggugggga

SEQ ID NO: 154165 - RNA, 21 nt, Human
agggcuggggauacggggggc

SEQ ID NO: 154166 - RNA, 19 nt, Human
aggggagggcugugcggcu

SEQ ID NO: 154167 - RNA, 22 nt, Human
agggggcugcauccuggagggg

SEQ ID NO: 154168 - RNA, 23 nt, Human
aguuggagacacagggucagggc

SEQ ID NO: 154169 - RNA, 20 nt, Human
auagucaacgaacaugcaaa

SEQ ID NO: 154170 - RNA, 19 nt, Human
caccagggccuggcuggcu

SEQ ID NO: 154171 - RNA, 19 nt, Human
cagggccccucauccucua

SEQ ID NO: 154172 - RNA, 20 nt, Human
cagggugggggucagggagg

SEQ ID NO: 154173 - RNA, 22 nt, Human
caguguugccaagggcugggga

SEQ ID NO: 154174 - RNA, 21 nt, Human
ccacccacggggcuggggaga

SEQ ID NO: 154175 - RNA, 21 nt, Human
ccacccaggaugcgccagcga

SEQ ID NO: 154176 - RNA, 21 nt, Human
ccacggggcuggggagagcuc

SEQ ID NO: 154177 - RNA, 22 nt, Human
ccagagguggggucccgggggc

SEQ ID NO: 154178 - RNA, 22 nt, Human
cccgagcucggggccugccucc

SEQ ID NO: 154179 - RNA, 21 nt, Human
ccgcacucagcgccuucccca

SEQ ID NO: 154180 - RNA, 18 nt, Human
ccgcgugcggcgccgcga

SEQ ID NO: 154181 - RNA, 20 nt, Human
ccgcuccgcgcugccuggcg

SEQ ID NO: 154182 - RNA, 18 nt, Human
cgaggcugcggacaggag

SEQ ID NO: 154183 - RNA, 23 nt, Human
cgccgcgacuccgcacucagcgc

SEQ ID NO: 154184 - RNA, 21 nt, Human
cgggggagggggcugcauccc

SEQ ID NO: 154185 - RNA, 19 nt, Human
cuccgcacucagcgccuuc

SEQ ID NO: 154186 - RNA, 18 nt, Human
cuggggcuggggcggagg

SEQ ID NO: 154187 - RNA, 18 nt, Human
gaucugcgggccgggagg

SEQ ID NO: 154188 - RNA, 19 nt, Human
gcggagcggcugugggccc

SEQ ID NO: 154189 - RNA, 20 nt, Human
gcugugcggcucccagccuu

SEQ ID NO: 154190 - RNA, 21 nt, Human
gcuugggcacuuuuucugggc

SEQ ID NO: 154191 - RNA, 23 nt, Human
ggaaaacaaagucaccacccacg

SEQ ID NO: 154192 - RNA, 23 nt, Human
ggagggggcugcauccuggaggg

SEQ ID NO: 154193 - RNA, 21 nt, Human
ggccuggcuggcuggggcugg

SEQ ID NO: 154194 - RNA, 22 nt, Human
gggcaaccguggcggcgugugc

SEQ ID NO: 154195 - RNA, 18 nt, Human
gggccugccuccacccag

SEQ ID NO: 154196 - RNA, 19 nt, Human
gggcgcagacuugagggag

SEQ ID NO: 154197 - RNA, 20 nt, Human
gggcuggggauacggggggc

SEQ ID NO: 154198 - RNA, 21 nt, Human
ggggcuggggcggagggcccc

SEQ ID NO: 154199 - RNA, 20 nt, Human
gggggagggggcugcauccu

SEQ ID NO: 154200 - RNA, 21 nt, Human
gggugcagcaguuggagacac

SEQ ID NO: 154201 - RNA, 22 nt, Human
gguggcggagacagggucggga

SEQ ID NO: 154202 - RNA, 21 nt, Human
guggggccagagguggggucc

SEQ ID NO: 154203 - RNA, 21 nt, Human
uccaccggggcagugaaaggg

SEQ ID NO: 154204 - RNA, 18 nt, Human
uccagcgcaggaggggag

SEQ ID NO: 154205 - RNA, 19 nt, Human
uccccgagcucggggccug

SEQ ID NO: 154206 - RNA, 21 nt, Human
uccccgagcucggggccugcc

SEQ ID NO: 154207 - RNA, 22 nt, Human
ucugcgggccgggaggcggagc

SEQ ID NO: 154208 - RNA, 18 nt, Human
ugaaagggucccggcagc

SEQ ID NO: 154209 - RNA, 19 nt, Human
ugagaggaaacccuuggcg

SEQ ID NO: 154210 - RNA, 20 nt, Human
ugagggagguggggccagag

SEQ ID NO: 154211 - RNA, 22 nt, Human
ugagggagguggggccagaggu

SEQ ID NO: 154212 - RNA, 22 nt, Human
ugcacuccaguguugccaaggg

SEQ ID NO: 154213 - RNA, 19 nt, Human
ugcagcaguuggagacaca

SEQ ID NO: 154214 - RNA, 21 nt, Human
ugccaagggcuggggauacgg

SEQ ID NO: 154215 - RNA, 23 nt, Human
ugccaagggcuggggauacgggg

SEQ ID NO: 154216 - RNA, 21 nt, Human
ugccgcgugcggcgccgcgac

SEQ ID NO: 154217 - RNA, 21 nt, Human
ugcgggccagaggagcccgcg

SEQ ID NO: 154218 - RNA, 20 nt, Human
ugcgggggagggggcugcau

SEQ ID NO: 154219 - RNA, 19 nt, Human
uggcggggauaagaaauga

SEQ ID NO: 154220 - RNA, 21 nt, Human
uggcuggggcuggggcggagg

SEQ ID NO: 154221 - RNA, 23 nt, Human
uggggccagagguggggucccgg

SEQ ID NO: 154222 - RNA, 20 nt, Human
uggggucccgggggccacaa

SEQ ID NO: 154223 - RNA, 18 nt, Human
uuuuuuccagaugagagc

SEQ ID NO: 154224 - RNA, 21 nt, Human
uuuuuuuuuuuuuuuuccaga

SEQ ID NO: 154225 - RNA, 22 nt, Human
uuuuuuuuuuuuuuuuuuccag

SEQ ID NO: 154226 - RNA, 21 nt, Human
aaaaacaaaaaucaggaacuu

SEQ ID NO: 154227 - RNA, 24 nt, Human
aaaagauggauauuugggaccaaa

SEQ ID NO: 154228 - RNA, 19 nt, Human
aaaagcauuguuuaucacc

SEQ ID NO: 154229 - RNA, 22 nt, Human
aaaauaaaaacaaaaaucagga

SEQ ID NO: 154230 - RNA, 21 nt, Human
aaaauuagcugcccugaauaa

SEQ ID NO: 154231 - RNA, 20 nt, Human
aaacaaacagcaacaaaaga

SEQ ID NO: 154232 - RNA, 22 nt, Human
aaacaaagcaaagcugcgacaa

SEQ ID NO: 154233 - RNA, 21 nt, Human
aaacaagacauaccaagagaa

SEQ ID NO: 154234 - RNA, 23 nt, Human
aaacaucacuccaggcacaacuc

SEQ ID NO: 154235 - RNA, 26 nt, Human
aaagagcacagcccgagguuagaggc

SEQ ID NO: 154236 - RNA, 18 nt, Human
aaaggaaauugaaggaaa

SEQ ID NO: 154237 - RNA, 27 nt, Human
aacaagcaauguaauuucaaaaaaaua

SEQ ID NO: 154238 - RNA, 20 nt, Human
aacccugauuuuggauuauc

SEQ ID NO: 154239 - RNA, 21 nt, Human
aagaaacacagaccacuagcu

SEQ ID NO: 154240 - RNA, 23 nt, Human
aagccagaggcagagcuucagga

SEQ ID NO: 154241 - RNA, 18 nt, Human
aaugucuacucuccaggc

SEQ ID NO: 154242 - RNA, 23 nt, Human
acaaguauguuguuuccuucugg

SEQ ID NO: 154243 - RNA, 19 nt, Human
acaaguauguuguuucuag

SEQ ID NO: 154244 - RNA, 21 nt, Human
acagcaacaaaagaauuaugu

SEQ ID NO: 154245 - RNA, 21 nt, Human
acccaauaccaacaucagcca

SEQ ID NO: 154246 - RNA, 27 nt, Human
agagaacagaaacuggcauaauguuau

SEQ ID NO: 154247 - RNA, 23 nt, Human
agaucacgcucccaagacuugca

SEQ ID NO: 154248 - RNA, 21 nt, Human
agcccgagguuagaggcgacg

SEQ ID NO: 154249 - RNA, 20 nt, Human
agccuuggaaucccuuuggc

SEQ ID NO: 154250 - RNA, 22 nt, Human
agcuacgggaauccucacgcuu

SEQ ID NO: 154251 - RNA, 21 nt, Human
agcuccugggcucccgggccu

SEQ ID NO: 154252 - RNA, 20 nt, Human
aggcaugggcuauggcuugg

SEQ ID NO: 154253 - RNA, 18 nt, Human
aggcucagaaaccggcgg

SEQ ID NO: 154254 - RNA, 21 nt, Human
agggugcuauaauaaacccuu

SEQ ID NO: 154255 - RNA, 21 nt, Human
aggugcuucuuaaacaaacag

SEQ ID NO: 154256 - RNA, 21 nt, Human
aguugagaguaaguuuucagg

SEQ ID NO: 154257 - RNA, 23 nt, Human
auaaaauuguccccaaauuuaag

SEQ ID NO: 154258 - RNA, 21 nt, Human
auaaacauuaaaaagaaccca

SEQ ID NO: 154259 - RNA, 19 nt, Human
auccacuuccccaccauac

SEQ ID NO: 154260 - RNA, 22 nt, Human
augaauagaaacacauuggaug

SEQ ID NO: 154261 - RNA, 18 nt, Human
augaauuaacuggaaccc

SEQ ID NO: 154262 - RNA, 19 nt, Human
augacaagguagcuugaaa

SEQ ID NO: 154263 - RNA, 25 nt, Human
augacuguauacaugacaagguagc

SEQ ID NO: 154264 - RNA, 21 nt, Human
caaagcaaagcugcgacaaaa

SEQ ID NO: 154265 - RNA, 18 nt, Human
caaguacagugcccacug

SEQ ID NO: 154266 - RNA, 19 nt, Human
caccacagugaacaguuca

SEQ ID NO: 154267 - RNA, 23 nt, Human
caccccuguguaaggcacacaca

SEQ ID NO: 154268 - RNA, 26 nt, Human
caccuggaaaaagagcacagcccgag

SEQ ID NO: 154269 - RNA, 18 nt, Human
cacuuauuaauucaaguc

SEQ ID NO: 154270 - RNA, 23 nt, Human
cacuucaaguaaaaauacaaaga

SEQ ID NO: 154271 - RNA, 21 nt, Human
cagaaaauaucugcuguccau

SEQ ID NO: 154272 - RNA, 20 nt, Human
cagcccgagguuagaggcga

SEQ ID NO: 154273 - RNA, 22 nt, Human
cagccugaguagugacagcaac

SEQ ID NO: 154274 - RNA, 21 nt, Human
caggacgaacgcccuccgccg

SEQ ID NO: 154275 - RNA, 20 nt, Human
cagggaaggcugcccugugg

SEQ ID NO: 154276 - RNA, 22 nt, Human
cauugccauaggaauacaagag

SEQ ID NO: 154277 - RNA, 20 nt, Human
ccacccuucucccgugcccc

SEQ ID NO: 154278 - RNA, 18 nt, Human
ccacuuccccaccauacc

SEQ ID NO: 154279 - RNA, 26 nt, Human
ccagaggcagagcuucaggacacucu

SEQ ID NO: 154280 - RNA, 22 nt, Human
ccagggcacccccaaaggcaau

SEQ ID NO: 154281 - RNA, 20 nt, Human
ccagucaaauuaaauccaga

SEQ ID NO: 154282 - RNA, 22 nt, Human
ccauaccugagccccccagaua

SEQ ID NO: 154283 - RNA, 19 nt, Human
ccauuaguggcacuucaag

SEQ ID NO: 154284 - RNA, 24 nt, Human
cccaauaccaacaucagccagaaa

SEQ ID NO: 154285 - RNA, 24 nt, Human
cccaccauaccugagccccccaga

SEQ ID NO: 154286 - RNA, 24 nt, Human
cccaugaccggaaagccagaggca

SEQ ID NO: 154287 - RNA, 21 nt, Human
ccccaacccauagacugaguu

SEQ ID NO: 154288 - RNA, 21 nt, Human
ccccggcccugccccgggagc

SEQ ID NO: 154289 - RNA, 19 nt, Human
cccggcccugccccgggag

SEQ ID NO: 154290 - RNA, 21 nt, Human
cccuacuuucccucuuguucu

SEQ ID NO: 154291 - RNA, 26 nt, Human
ccgacacgcgagcucuggccccggcc

SEQ ID NO: 154292 - RNA, 20 nt, Human
ccgcagggcagaaggcucag

SEQ ID NO: 154293 - RNA, 18 nt, Human
ccugaagcugaccuuacu

SEQ ID NO: 154294 - RNA, 20 nt, Human
ccugggcucccgggccucca

SEQ ID NO: 154295 - RNA, 19 nt, Human
ccuuacugcaaguucaggg

SEQ ID NO: 154296 - RNA, 21 nt, Human
cgaacgcccuccgccagcucc

SEQ ID NO: 154297 - RNA, 21 nt, Human
cgggccuccaacuuuaaguac

SEQ ID NO: 154298 - RNA, 26 nt, Human
cggggucugcaaggaauguuccuagg

SEQ ID NO: 154299 - RNA, 23 nt, Human
cuacugaaccuuggugcacaccc

SEQ ID NO: 154300 - RNA, 22 nt, Human
cuccaaauacuuucaauacucu

SEQ ID NO: 154301 - RNA, 25 nt, Human
cucccaguacccacaguccaucucc

SEQ ID NO: 154302 - RNA, 18 nt, Human
cuccgccagcuccugggc

SEQ ID NO: 154303 - RNA, 21 nt, Human
cuccgccagcuccugggcucc

SEQ ID NO: 154304 - RNA, 18 nt, Human
cuccugggcucccgggcc

SEQ ID NO: 154305 - RNA, 21 nt, Human
cuccugggcucccgggccucc

SEQ ID NO: 154306 - RNA, 23 nt, Human
cugcuccuuucaacuaccauuua

SEQ ID NO: 154307 - RNA, 21 nt, Human
cugcuguccauuaguggcacu

SEQ ID NO: 154308 - RNA, 25 nt, Human
cuuaauauauuugccauuccccaga

SEQ ID NO: 154309 - RNA, 25 nt, Human
cuuagaaaacaauuuuaaaugacua

SEQ ID NO: 154310 - RNA, 22 nt, Human
gaaaagaaacacagaccacuag

SEQ ID NO: 154311 - RNA, 21 nt, Human
gaaaggaaaugcaguuggaaa

SEQ ID NO: 154312 - RNA, 25 nt, Human
gaacugagcaagcaaaugaauggcc

SEQ ID NO: 154313 - RNA, 20 nt, Human
gaaugcaaaggggucugugu

SEQ ID NO: 154314 - RNA, 23 nt, Human
gagcacagcccgagguuagaggc

SEQ ID NO: 154315 - RNA, 21 nt, Human
gagccuuuucccauaaaacaa

SEQ ID NO: 154316 - RNA, 21 nt, Human
gccacucaucuagaaagccau

SEQ ID NO: 154317 - RNA, 19 nt, Human
gccccagggugcugggcca

SEQ ID NO: 154318 - RNA, 24 nt, Human
ggaaaaagagcacagcccgagguu

SEQ ID NO: 154319 - RNA, 18 nt, Human
ggaaagccagaggcagag

SEQ ID NO: 154320 - RNA, 21 nt, Human
ggaaguaacccauaauugugc

SEQ ID NO: 154321 - RNA, 20 nt, Human
ggauuaucucuaaaccacca

SEQ ID NO: 154322 - RNA, 22 nt, Human
ggauuuucuuccccaaaccaaa

SEQ ID NO: 154323 - RNA, 25 nt, Human
ggccuccaacuuuaaguacuggucu

SEQ ID NO: 154324 - RNA, 21 nt, Human
ggcucccgggccuccaacuuu

SEQ ID NO: 154325 - RNA, 20 nt, Human
gggaaggaguacucuaagcc

SEQ ID NO: 154326 - RNA, 19 nt, Human
guccaugggaggcaugaau

SEQ ID NO: 154327 - RNA, 26 nt, Human
guccguggccgcgggcagggugcaga

SEQ ID NO: 154328 - RNA, 21 nt, Human
gugagagaacagaaacuggca

SEQ ID NO: 154329 - RNA, 20 nt, Human
gugcugggccaauuguagga

SEQ ID NO: 154330 - RNA, 25 nt, Human
uaaaaacgaggccacacuuuaauuc

SEQ ID NO: 154331 - RNA, 21 nt, Human
uaaaaagaacccacugaccca

SEQ ID NO: 154332 - RNA, 19 nt, Human
uaaaacaagagcucuacac

SEQ ID NO: 154333 - RNA, 21 nt, Human
uaaaagcaaaauuagcugccc

SEQ ID NO: 154334 - RNA, 23 nt, Human
uaaaugcaacaccagggccccug

SEQ ID NO: 154335 - RNA, 20 nt, Human
uaacacagacaucaccucuc

SEQ ID NO: 154336 - RNA, 22 nt, Human
uaacacagacaucaccucucaa

SEQ ID NO: 154337 - RNA, 26 nt, Human
uaacacagauacauaaaauugucccc

SEQ ID NO: 154338 - RNA, 19 nt, Human
uaagaucaacuuguugcuc

SEQ ID NO: 154339 - RNA, 24 nt, Human
uaaguauaaacauuaaaaagaacc

SEQ ID NO: 154340 - RNA, 22 nt, Human
uaccccagggaucccagggcac

SEQ ID NO: 154341 - RNA, 20 nt, Human
uaccugagccccccagauaa

SEQ ID NO: 154342 - RNA, 22 nt, Human
uacugaaaagauggauauuugg

SEQ ID NO: 154343 - RNA, 21 nt, Human
uagcaagggggaaagagagcu

SEQ ID NO: 154344 - RNA, 21 nt, Human
uagccacaacaauccugcaca

SEQ ID NO: 154345 - RNA, 30 nt, Human
uauaaccaaugaccucucugugaaugcaag

SEQ ID NO: 154346 - RNA, 18 nt, Human
ucaaauuaaauccagaac

SEQ ID NO: 154347 - RNA, 19 nt, Human
ucaggacacucugaaucug

SEQ ID NO: 154348 - RNA, 21 nt, Human
ucaggacacucugaaucugca

SEQ ID NO: 154349 - RNA, 24 nt, Human
ucaggcacaauuggaugcaaaaaa

SEQ ID NO: 154350 - RNA, 20 nt, Human
ucaucuagaaagccauuggu

SEQ ID NO: 154351 - RNA, 21 nt, Human
uccaaacaagacauaccaaga

SEQ ID NO: 154352 - RNA, 19 nt, Human
ucccaagacuugcaccaaa

SEQ ID NO: 154353 - RNA, 21 nt, Human
ucccaggacgaacgcccuccg

SEQ ID NO: 154354 - RNA, 22 nt, Human
uccccaaaccaaacccugauuu

SEQ ID NO: 154355 - RNA, 23 nt, Human
uccccaccauaccugagcccccc

SEQ ID NO: 154356 - RNA, 21 nt, Human
uccccagauuccugaauccac

SEQ ID NO: 154357 - RNA, 18 nt, Human
ucccgugccccagggugc

SEQ ID NO: 154358 - RNA, 19 nt, Human
ucccuguguggccccuugu

SEQ ID NO: 154359 - RNA, 22 nt, Human
uccgccagcuccugggcucccg

SEQ ID NO: 154360 - RNA, 26 nt, Human
uccguggccgcgggcagggugcagac

SEQ ID NO: 154361 - RNA, 18 nt, Human
uccugggcucccgggccu

SEQ ID NO: 154362 - RNA, 20 nt, Human
ucucaggcaccugcucaugg

SEQ ID NO: 154363 - RNA, 21 nt, Human
ucuuaacaugaauagaaacac

SEQ ID NO: 154364 - RNA, 24 nt, Human
ucuuugcuguggcuuauucuuaga

SEQ ID NO: 154365 - RNA, 19 nt, Human
ucuuuggaugaccuagccu

SEQ ID NO: 154366 - RNA, 29 nt, Human
ugaaaagauggauauuugggaccaacugg

SEQ ID NO: 154367 - RNA, 21 nt, Human
ugaaugcaaaggggucugugu

SEQ ID NO: 154368 - RNA, 20 nt, Human
ugaauggccacucaucuaga

SEQ ID NO: 154369 - RNA, 24 nt, Human
ugacuguauacaugacaagguagc

SEQ ID NO: 154370 - RNA, 18 nt, Human
ugagaaaauuguuuacag

SEQ ID NO: 154371 - RNA, 22 nt, Human
ugagcaagcaaaugaauggcca

SEQ ID NO: 154372 - RNA, 20 nt, Human
ugagcuacuguaugacuuua

SEQ ID NO: 154373 - RNA, 20 nt, Human
ugaggguaaaaugcagcagg

SEQ ID NO: 154374 - RNA, 18 nt, Human
ugcacagcucuaaacaca

SEQ ID NO: 154375 - RNA, 20 nt, Human
ugcaugccggaguguaugca

SEQ ID NO: 154376 - RNA, 24 nt, Human
ugccacuaagaacugagcaagcaa

SEQ ID NO: 154377 - RNA, 18 nt, Human
ugccccagggugcugggc

SEQ ID NO: 154378 - RNA, 20 nt, Human
ugcccuguggcuggaaugag

SEQ ID NO: 154379 - RNA, 18 nt, Human
ugcuggagaccccugggc

SEQ ID NO: 154380 - RNA, 19 nt, Human
uggagaccccugggcgaac

SEQ ID NO: 154381 - RNA, 21 nt, Human
uggauuaucucuaaaccacca

SEQ ID NO: 154382 - RNA, 18 nt, Human
uggcauaaugucacuuau

SEQ ID NO: 154383 - RNA, 21 nt, Human
uggccaacuaggggaucugcc

SEQ ID NO: 154384 - RNA, 21 nt, Human
uggcgaaaagaaacacagacc

SEQ ID NO: 154385 - RNA, 19 nt, Human
uggcuggaaugagccuuuc

SEQ ID NO: 154386 - RNA, 24 nt, Human
uggcuuaaacaucacuccaggcac

SEQ ID NO: 154387 - RNA, 18 nt, Human
ugggacaaguauguuguu

SEQ ID NO: 154388 - RNA, 23 nt, Human
ugggacaaguauguuguuucuag

SEQ ID NO: 154389 - RNA, 20 nt, Human
ugggcucccgggccuccaac

SEQ ID NO: 154390 - RNA, 25 nt, Human
ugggucauuggcuaacacagacauc

SEQ ID NO: 154391 - RNA, 18 nt, Human
uguaugcaggagacagaa

SEQ ID NO: 154392 - RNA, 21 nt, Human
ugucugauaaacaagcaaugu

SEQ ID NO: 154393 - RNA, 20 nt, Human
ugugucucaggcaccugcuc

SEQ ID NO: 154394 - RNA, 19 nt, Human
uguucagcccucaaaaggc

SEQ ID NO: 154395 - RNA, 21 nt, Human
uuacugcaaguucagggaggg

SEQ ID NO: 154396 - RNA, 22 nt, Human
uuagugcuauuuugucuacugu

SEQ ID NO: 154397 - RNA, 18 nt, Human
uucacauaacuagcuucc

SEQ ID NO: 154398 - RNA, 19 nt, Human
uucagcuccaugccccagg

SEQ ID NO: 154399 - RNA, 19 nt, Human
uuccuccaaauacuuucaa

SEQ ID NO: 154400 - RNA, 23 nt, Human
uugguuuuugcauguuaacccag

SEQ ID NO: 154401 - RNA, 18 nt, Human
uuucugcccuacuuuccc

SEQ ID NO: 154402 - RNA, 19 nt, Human
uuuguuaagaaaaaggaag

SEQ ID NO: 154403 - RNA, 19 nt, Human
uuuguucagcccucaaaag

SEQ ID NO: 154404 - RNA, 23 nt, Human
accggccuugccuucucuaaaau

SEQ ID NO: 154405 - RNA, 21 nt, Human
agcccgucgcagcucgggugg

SEQ ID NO: 154406 - RNA, 18 nt, Human
agcugagaaaacaccuug

SEQ ID NO: 154407 - RNA, 24 nt, Human
aggcaguuauuucucgcagccucc

SEQ ID NO: 154408 - RNA, 19 nt, Human
cagcccugccccgcagccc

SEQ ID NO: 154409 - RNA, 22 nt, Human
cagcucaggcuccgggcgccag

SEQ ID NO: 154410 - RNA, 19 nt, Human
ccccgcagccccagagccc

SEQ ID NO: 154411 - RNA, 21 nt, Human
ccugcagcucaggcuccgggc

SEQ ID NO: 154412 - RNA, 20 nt, Human
cgcccugcaaguuucaagag

SEQ ID NO: 154413 - RNA, 19 nt, Human
cgcucgccgccugcucuuc

SEQ ID NO: 154414 - RNA, 21 nt, Human
cuccugcagcucaggcuccgg

SEQ ID NO: 154415 - RNA, 20 nt, Human
cucgcagccuccgcgcuugc

SEQ ID NO: 154416 - RNA, 24 nt, Human
cucgcagccuccgcgcuugcaacu

SEQ ID NO: 154417 - RNA, 18 nt, Human
cuugcagauaaacacacc

SEQ ID NO: 154418 - RNA, 19 nt, Human
gccagcccugccccgcagc

SEQ ID NO: 154419 - RNA, 25 nt, Human
gccccagagcccgucgcagcucggg

SEQ ID NO: 154420 - RNA, 19 nt, Human
gccuucucuaaaaugcgga

SEQ ID NO: 154421 - RNA, 21 nt, Human
gcgcuugcaacugccuccugg

SEQ ID NO: 154422 - RNA, 23 nt, Human
uauaauggcuugcagauaaacac

SEQ ID NO: 154423 - RNA, 21 nt, Human
uccaaaaagccagcagcugga

SEQ ID NO: 154424 - RNA, 24 nt, Human
uccccggcccagcgcucgccgccu

SEQ ID NO: 154425 - RNA, 23 nt, Human
ucgcagcucggguggucccuccc

SEQ ID NO: 154426 - RNA, 22 nt, Human
ugagaaaacaccuugcaagaag

SEQ ID NO: 154427 - RNA, 21 nt, Human
ugccccgcagccccagagccc

SEQ ID NO: 154428 - RNA, 18 nt, Human
uugagauaacagcugaga

SEQ ID NO: 154429 - RNA, 24 nt, Human
uugagauaacagcugagaaaacac

SEQ ID NO: 154430 - RNA, 21 nt, Human
aacccccaccagucccacccc

SEQ ID NO: 154431 - RNA, 22 nt, Human
aagcagcagcaaaagcaucacc

SEQ ID NO: 154432 - RNA, 22 nt, Human
acucuggccuccauccccuucc

SEQ ID NO: 154433 - RNA, 25 nt, Human
agaccccagcuccgccccagcccuu

SEQ ID NO: 154434 - RNA, 19 nt, Human
aggagggggaggagagggc

SEQ ID NO: 154435 - RNA, 20 nt, Human
aggcucguugggagcugaug

SEQ ID NO: 154436 - RNA, 21 nt, Human
aggggcagcacugugcccaga

SEQ ID NO: 154437 - RNA, 24 nt, Human
agggggaggagagggcguggggcc

SEQ ID NO: 154438 - RNA, 24 nt, Human
aggggguaggauuaagcagcagca

SEQ ID NO: 154439 - RNA, 25 nt, Human
caaggggcagcacugugcccagagc

SEQ ID NO: 154440 - RNA, 22 nt, Human
caccgcgccgcguccccucacu

SEQ ID NO: 154441 - RNA, 25 nt, Human
cacugcccagaccccagcuccgccc

SEQ ID NO: 154442 - RNA, 19 nt, Human
cagcagcaaaagcaucacc

SEQ ID NO: 154443 - RNA, 22 nt, Human
cagcagcaaaagcaucacccac

SEQ ID NO: 154444 - RNA, 19 nt, Human
cagcuucugacacccccua

SEQ ID NO: 154445 - RNA, 24 nt, Human
caucccgugcagcccccuauggcu

SEQ ID NO: 154446 - RNA, 20 nt, Human
ccaccgcgccgcguccccuc

SEQ ID NO: 154447 - RNA, 21 nt, Human
ccagaacccccaccaguccca

SEQ ID NO: 154448 - RNA, 23 nt, Human
ccagaccccagcuccgccccagc

SEQ ID NO: 154449 - RNA, 18 nt, Human
ccagcuccgccccagccc

SEQ ID NO: 154450 - RNA, 20 nt, Human
cccacgcaucccgugcagcc

SEQ ID NO: 154451 - RNA, 23 nt, Human
cccacgcaucccgugcagccccc

SEQ ID NO: 154452 - RNA, 22 nt, Human
ccccaccgcgccgcguccccuc

SEQ ID NO: 154453 - RNA, 22 nt, Human
ccccaugucccugcgccucccu

SEQ ID NO: 154454 - RNA, 19 nt, Human
cccccuacacucugggggc

SEQ ID NO: 154455 - RNA, 18 nt, Human
ccccuaggagggggagga

SEQ ID NO: 154456 - RNA, 21 nt, Human
ccccuccuccgccgccuccuc

SEQ ID NO: 154457 - RNA, 18 nt, Human
cccuggccaaacccaaaa

SEQ ID NO: 154458 - RNA, 23 nt, Human
cccuggccaccccagggguccag

SEQ ID NO: 154459 - RNA, 19 nt, Human
ccgccccagcccuuggggc

SEQ ID NO: 154460 - RNA, 27 nt, Human
ccgccgccuccucgggccgcgccgccc

SEQ ID NO: 154461 - RNA, 25 nt, Human
ccugccagaacccccaccaguccca

SEQ ID NO: 154462 - RNA, 18 nt, Human
cgggcaggcaugggggcc

SEQ ID NO: 154463 - RNA, 21 nt, Human
cguucccagcuucugacaccc

SEQ ID NO: 154464 - RNA, 19 nt, Human
cuaggcagguccugccaga

SEQ ID NO: 154465 - RNA, 22 nt, Human
cuccgccccagcccuuggggcu

SEQ ID NO: 154466 - RNA, 25 nt, Human
cuccgccccagcccuuggggcugac

SEQ ID NO: 154467 - RNA, 21 nt, Human
cuccucgggccgcgccgcccc

SEQ ID NO: 154468 - RNA, 18 nt, Human
cucuccuacccccugagg

SEQ ID NO: 154469 - RNA, 21 nt, Human
cuggccaaacccaaaaauaaa

SEQ ID NO: 154470 - RNA, 21 nt, Human
cuggcccugccagcaggcugu

SEQ ID NO: 154471 - RNA, 19 nt, Human
cuggccuccauccccuucc

SEQ ID NO: 154472 - RNA, 22 nt, Human
cuggcuugccccaugucccugc

SEQ ID NO: 154473 - RNA, 23 nt, Human
gaacccccaccagucccaccccu

SEQ ID NO: 154474 - RNA, 20 nt, Human
gacucuggccuccauccccu

SEQ ID NO: 154475 - RNA, 21 nt, Human
gagccgggggccgcgggcggc

SEQ ID NO: 154476 - RNA, 23 nt, Human
gagccuggacacacguucccagc

SEQ ID NO: 154477 - RNA, 26 nt, Human
gccagaacccccaccagucccacccc

SEQ ID NO: 154478 - RNA, 19 nt, Human
gcccccuauggcuuccgca

SEQ ID NO: 154479 - RNA, 18 nt, Human
gcccugccagcaggcugu

SEQ ID NO: 154480 - RNA, 20 nt, Human
gcgcggucgggcaggcaugg

SEQ ID NO: 154481 - RNA, 20 nt, Human
ggaagcccuggccaccccag

SEQ ID NO: 154482 - RNA, 21 nt, Human
ggcccuggcuugccccauguc

SEQ ID NO: 154483 - RNA, 21 nt, Human
gggagacucuggccuccaucc

SEQ ID NO: 154484 - RNA, 23 nt, Human
gggccgcgggcggccccuccucc

SEQ ID NO: 154485 - RNA, 21 nt, Human
gggcguggggccuguucccag

SEQ ID NO: 154486 - RNA, 24 nt, Human
gggggaggagagggcguggggccu

SEQ ID NO: 154487 - RNA, 21 nt, Human
ggucgggcaggcaugggggcc

SEQ ID NO: 154488 - RNA, 23 nt, Human
uaagcagcagcaaaagcaucacc

SEQ ID NO: 154489 - RNA, 24 nt, Human
uauacauuaaaauagagucucugu

SEQ ID NO: 154490 - RNA, 20 nt, Human
uauauuuuuuucucauuaaa

SEQ ID NO: 154491 - RNA, 24 nt, Human
ucugggggcacguuauggcuugca

SEQ ID NO: 154492 - RNA, 19 nt, Human
ugagaggaggagcgaaggg

SEQ ID NO: 154493 - RNA, 19 nt, Human
ugauggggaagcccuggcc

SEQ ID NO: 154494 - RNA, 20 nt, Human
ugcaaaugaugagaggagga

SEQ ID NO: 154495 - RNA, 23 nt, Human
ugcagcaaauauacauuaaaaua

SEQ ID NO: 154496 - RNA, 19 nt, Human
ugccagaacccccaccagu

SEQ ID NO: 154497 - RNA, 23 nt, Human
ugccagaacccccaccaguccca

SEQ ID NO: 154498 - RNA, 20 nt, Human
ugcccagagccuggacacac

SEQ ID NO: 154499 - RNA, 18 nt, Human
ugcccuggcccugccagc

SEQ ID NO: 154500 - RNA, 19 nt, Human
uggccuccauccccuuccc

SEQ ID NO: 154501 - RNA, 18 nt, Human
uggcuuccgcaaggcccc

SEQ ID NO: 154502 - RNA, 22 nt, Human
uuaaaaccaaaagcgguuucuc

SEQ ID NO: 154503 - RNA, 20 nt, Human
uucccagcuucugacacccc

SEQ ID NO: 154504 - RNA, 19 nt, Human
aggacagugcuccaugggc

SEQ ID NO: 154505 - RNA, 20 nt, Human
cacagugacuaaggugggcc

SEQ ID NO: 154506 - RNA, 21 nt, Human
cacugccuuuuaugguccuau

SEQ ID NO: 154507 - RNA, 20 nt, Human
cacuggaucaccucuggccu

SEQ ID NO: 154508 - RNA, 22 nt, Human
cagugagccuaaccugcgcauc

SEQ ID NO: 154509 - RNA, 22 nt, Human
cccaggaaggggaggaugccuc

SEQ ID NO: 154510 - RNA, 23 nt, Human
ccucugagcagccugugugaccu

SEQ ID NO: 154511 - RNA, 19 nt, Human
ccugcagcucccaaaucac

SEQ ID NO: 154512 - RNA, 23 nt, Human
cuagggcagguguguccaggaag

SEQ ID NO: 154513 - RNA, 25 nt, Human
cuggccuagacagugagccuaaccu

SEQ ID NO: 154514 - RNA, 18 nt, Human
gcagguguguccaggaag

SEQ ID NO: 154515 - RNA, 25 nt, Human
gcccucugagcagccugugugaccu

SEQ ID NO: 154516 - RNA, 22 nt, Human
ucagcagcccucugagcagccu

SEQ ID NO: 154517 - RNA, 22 nt, Human
uccaggaagagcuuccauugcc

SEQ ID NO: 154518 - RNA, 24 nt, Human
ucucuuccaccccagggugagggc

SEQ ID NO: 154519 - RNA, 18 nt, Human
ugagcagccugugugacc

SEQ ID NO: 154520 - RNA, 23 nt, Human
ugcaagccaagcucauuucucuu

SEQ ID NO: 154521 - RNA, 22 nt, Human
uggccucaaaguucuggacacc

SEQ ID NO: 154522 - RNA, 22 nt, Human
uuuggcagggaaaaggaagucc

SEQ ID NO: 154523 - RNA, 23 nt, Human
aaaaaacccaacuaaucagaaac

SEQ ID NO: 154524 - RNA, 21 nt, Human
aaaccaacuucaaauguuaau

SEQ ID NO: 154525 - RNA, 21 nt, Human
aaacgcaggucauauaccuug

SEQ ID NO: 154526 - RNA, 24 nt, Human
aaagaauccugccuaccaucuuca

SEQ ID NO: 154527 - RNA, 22 nt, Human
aacagccaugaaaauaaauucc

SEQ ID NO: 154528 - RNA, 27 nt, Human
aagaaaaaaauaauaauauucagugga

SEQ ID NO: 154529 - RNA, 24 nt, Human
aagaauccugccuaccaucuucag

SEQ ID NO: 154530 - RNA, 23 nt, Human
aaucagaaacaugaaaaccagua

SEQ ID NO: 154531 - RNA, 23 nt, Human
acacaggaaaagagcaacuucag

SEQ ID NO: 154532 - RNA, 22 nt, Human
acgcaggucauauaccuuggcu

SEQ ID NO: 154533 - RNA, 18 nt, Human
agaaaaagguagaaauug

SEQ ID NO: 154534 - RNA, 21 nt, Human
agaaagaaaaagcuaagaaaa

SEQ ID NO: 154535 - RNA, 21 nt, Human
agaaagaaaaagcuaagaaaa

SEQ ID NO: 154536 - RNA, 26 nt, Human
agaaggaaguaaaaauagggggaccc

SEQ ID NO: 154537 - RNA, 19 nt, Human
agaccucugcggccuaagc

SEQ ID NO: 154538 - RNA, 22 nt, Human
agacuccucccaaagaccacac

SEQ ID NO: 154539 - RNA, 21 nt, Human
agcacagaacccaagcugagu

SEQ ID NO: 154540 - RNA, 23 nt, Human
aggaagagaggaggagcacagaa

SEQ ID NO: 154541 - RNA, 19 nt, Human
aggagcacagaacccaagc

SEQ ID NO: 154542 - RNA, 24 nt, Human
aggcuuuaaccaucauaaucacca

SEQ ID NO: 154543 - RNA, 21 nt, Human
aguggccucugggcacaaagc

SEQ ID NO: 154544 - RNA, 24 nt, Human
aguguucuauaggaagagaggagg

SEQ ID NO: 154545 - RNA, 21 nt, Human
auaaagcauucuuaucaaaga

SEQ ID NO: 154546 - RNA, 25 nt, Human
augcauuuuaaggagaguucugauu

SEQ ID NO: 154547 - RNA, 20 nt, Human
auuaaaaaaaaaaauuaacg

SEQ ID NO: 154548 - RNA, 25 nt, Human
caaaaaacuacucagccaugacaac

SEQ ID NO: 154549 - RNA, 27 nt, Human
caaaaugguucccuaguauagccgaag

SEQ ID NO: 154550 - RNA, 26 nt, Human
caacuaaucagaaacaugaaaaccag

SEQ ID NO: 154551 - RNA, 19 nt, Human
caaggaaugcuaugaaaaa

SEQ ID NO: 154552 - RNA, 19 nt, Human
caagguaaaggacuguguc

SEQ ID NO: 154553 - RNA, 23 nt, Human
caauuuagaaauccuagccuaga

SEQ ID NO: 154554 - RNA, 20 nt, Human
cacacaggaaaagagcaacu

SEQ ID NO: 154555 - RNA, 21 nt, Human
cacaggaaaagagcaacuuca

SEQ ID NO: 154556 - RNA, 21 nt, Human
cagaacggacagaguccagcg

SEQ ID NO: 154557 - RNA, 18 nt, Human
caggaaaagagcaacuuc

SEQ ID NO: 154558 - RNA, 22 nt, Human
caggaagaugcauaaguaaaga

SEQ ID NO: 154559 - RNA, 19 nt, Human
cauauaccuuggcuuacac

SEQ ID NO: 154560 - RNA, 20 nt, Human
ccaaagaccacacaggaaaa

SEQ ID NO: 154561 - RNA, 22 nt, Human
ccauaaagcugaggcaaaggca

SEQ ID NO: 154562 - RNA, 19 nt, Human
cuaguaaggaaagggaaag

SEQ ID NO: 154563 - RNA, 18 nt, Human
cucagccaugacaacagc

SEQ ID NO: 154564 - RNA, 21 nt, Human
cucuucauucuaagaacagag

SEQ ID NO: 154565 - RNA, 22 nt, Human
cuggaauauuucagagaaggaa

SEQ ID NO: 154566 - RNA, 19 nt, Human
gaaauauucauaagaaacc

SEQ ID NO: 154567 - RNA, 18 nt, Human
gaccugucaucguuccuu

SEQ ID NO: 154568 - RNA, 23 nt, Human
gcagcagcaucugcagaaaacgc

SEQ ID NO: 154569 - RNA, 22 nt, Human
gccaccaggugggagcuuuaac

SEQ ID NO: 154570 - RNA, 20 nt, Human
gccacgaaauauucauaaga

SEQ ID NO: 154571 - RNA, 18 nt, Human
ggccuaagccgccagccc

SEQ ID NO: 154572 - RNA, 19 nt, Human
ggguucuuggaaagaaucc

SEQ ID NO: 154573 - RNA, 24 nt, Human
guacuagacuccucccaaagacca

SEQ ID NO: 154574 - RNA, 24 nt, Human
gugacagcagcagcaucugcagaa

SEQ ID NO: 154575 - RNA, 22 nt, Human
uaaaaaaugcuuauuuucccau

SEQ ID NO: 154576 - RNA, 23 nt, Human
uaagccgccagcccugccgccgc

SEQ ID NO: 154577 - RNA, 19 nt, Human
uaaguaaagaucaucagua

SEQ ID NO: 154578 - RNA, 21 nt, Human
uacuagacuccucccaaagac

SEQ ID NO: 154579 - RNA, 19 nt, Human
uaguuugauauaaaaaacc

SEQ ID NO: 154580 - RNA, 21 nt, Human
uauaaaaaacccaacuaauca

SEQ ID NO: 154581 - RNA, 24 nt, Human
uauaaaaaacccaacuaaucagaa

SEQ ID NO: 154582 - RNA, 19 nt, Human
uaucaucauucauuuaucc

SEQ ID NO: 154583 - RNA, 18 nt, Human
ucaagguaugcacagugu

SEQ ID NO: 154584 - RNA, 24 nt, Human
ucagagaaggaaguaaaaauaggu

SEQ ID NO: 154585 - RNA, 23 nt, Human
ucagccaugacaacagccaugaa

SEQ ID NO: 154586 - RNA, 23 nt, Human
ucaucaaaaaacuacucagccau

SEQ ID NO: 154587 - RNA, 19 nt, Human
ucccaaagaccacacagga

SEQ ID NO: 154588 - RNA, 23 nt, Human
uccuaaacauaaagcauucuuau

SEQ ID NO: 154589 - RNA, 24 nt, Human
ucuagaaagaaaaagcuaagaaaa

SEQ ID NO: 154590 - RNA, 26 nt, Human
ucugcauaaauaauggguguacuuug

SEQ ID NO: 154591 - RNA, 24 nt, Human
ucugcggccuaagccgccagcccu

SEQ ID NO: 154592 - RNA, 20 nt, Human
ugagaauuuguaauuucuuu

SEQ ID NO: 154593 - RNA, 22 nt, Human
ugagacaugcauaugcaccuuc

SEQ ID NO: 154594 - RNA, 21 nt, Human
ugaguuaacuggaauauuuca

SEQ ID NO: 154595 - RNA, 19 nt, Human
ugcugcuuuuuucaccaau

SEQ ID NO: 154596 - RNA, 20 nt, Human
uggccaguuuuccccagugc

SEQ ID NO: 154597 - RNA, 19 nt, Human
uggguucuuggaaagaauc

SEQ ID NO: 154598 - RNA, 24 nt, Human
uguaaaaaaauacccauugaacau

SEQ ID NO: 154599 - RNA, 23 nt, Human
uguacuagacuccucccaaagac

SEQ ID NO: 154600 - RNA, 26 nt, Human
uguuuugaaaucuaugcaacaugaaa

SEQ ID NO: 154601 - RNA, 22 nt, Human
uuacauacacuuucuccugucu

SEQ ID NO: 154602 - RNA, 21 nt, Human
uuccccagugcuaauucuggc

SEQ ID NO: 154603 - RNA, 21 nt, Human
uuccccuggccaguuuucccc

SEQ ID NO: 154604 - RNA, 26 nt, Human
uucccuauaaaaucauuuuagccacg

SEQ ID NO: 154605 - RNA, 24 nt, Human
uucuucuacaaaaugguucccuag

SEQ ID NO: 154606 - RNA, 23 nt, Human
uuucaguuuuuguacuagacucc

SEQ ID NO: 154607 - RNA, 21 nt, Human
uuucugccuuuuuuuuuuuaa

SEQ ID NO: 154608 - RNA, 22 nt, Human
uuuucaguuuuuguacuagacu

SEQ ID NO: 154609 - RNA, 19 nt, Human
aaaagaaagaaggcaggca

SEQ ID NO: 154610 - RNA, 25 nt, Human
aaaagagaggaaugagaguagguaa

SEQ ID NO: 154611 - RNA, 19 nt, Human
aaaagcacauauauuggcu

SEQ ID NO: 154612 - RNA, 19 nt, Human
aaaagcacauauauuggcu

SEQ ID NO: 154613 - RNA, 27 nt, Human
aaaaggagaaaaaauaaagagaaagag

SEQ ID NO: 154614 - RNA, 22 nt, Human
aaaagugguaaagcugguacaa

SEQ ID NO: 154615 - RNA, 21 nt, Human
aaaauacaaucaccaacaccc

SEQ ID NO: 154616 - RNA, 22 nt, Human
aaacaggcaguaucacauuccu

SEQ ID NO: 154617 - RNA, 22 nt, Human
aaaggaaagggaaaaaggaaag

SEQ ID NO: 154618 - RNA, 24 nt, Human
aaagggaaaaaggaaagaaaggga

SEQ ID NO: 154619 - RNA, 23 nt, Human
aaauacaaucaccaacacccauu

SEQ ID NO: 154620 - RNA, 27 nt, Human
aacaacacagagcgaguuaauaacaac

SEQ ID NO: 154621 - RNA, 25 nt, Human
aacccugcacaaacuuucuggaaaa

SEQ ID NO: 154622 - RNA, 19 nt, Human
aagaaaagaaagaaggcag

SEQ ID NO: 154623 - RNA, 20 nt, Human
aagaagaaaaggagaaaaaa

SEQ ID NO: 154624 - RNA, 23 nt, Human
aagaagaaaaggagaaaaaauaa

SEQ ID NO: 154625 - RNA, 26 nt, Human
aagaagaaaaggagaaaaaauaaaga

SEQ ID NO: 154626 - RNA, 21 nt, Human
aagcacacaccacaagaaucc

SEQ ID NO: 154627 - RNA, 22 nt, Human
aagcagccgaugcaacguugcu

SEQ ID NO: 154628 - RNA, 20 nt, Human
aagcccaaguacuuuaaugu

SEQ ID NO: 154629 - RNA, 23 nt, Human
aauaaauggcugaaaagugguaa

SEQ ID NO: 154630 - RNA, 23 nt, Human
aauaauuugaguuacacaucuga

SEQ ID NO: 154631 - RNA, 20 nt, Human
acacaguauuccuagcacug

SEQ ID NO: 154632 - RNA, 21 nt, Human
acaccacaagaacaagacaac

SEQ ID NO: 154633 - RNA, 23 nt, Human
acaggcaguaucacauuccuaac

SEQ ID NO: 154634 - RNA, 19 nt, Human
acaguaugguucacaauaa

SEQ ID NO: 154635 - RNA, 21 nt, Human
accaaaaaguuuugcaacaac

SEQ ID NO: 154636 - RNA, 23 nt, Human
agaaaagcacagcaaacaugaaa

SEQ ID NO: 154637 - RNA, 18 nt, Human
agaaagaaacucaucagg

SEQ ID NO: 154638 - RNA, 23 nt, Human
agaaagauggaaagaaggucaag

SEQ ID NO: 154639 - RNA, 18 nt, Human
agaaagggaaaggaaagg

SEQ ID NO: 154640 - RNA, 26 nt, Human
agaagaaaaggagaaaaaauaaagag

SEQ ID NO: 154641 - RNA, 19 nt, Human
agagaaagagaaauguggg

SEQ ID NO: 154642 - RNA, 22 nt, Human
agagaggugcacuccugacaau

SEQ ID NO: 154643 - RNA, 20 nt, Human
agaggaaaggaaaggaaagg

SEQ ID NO: 154644 - RNA, 26 nt, Human
agcucucacacucuccuaaucaagga

SEQ ID NO: 154645 - RNA, 22 nt, Human
aggaaagaaagggaaaggaaag

SEQ ID NO: 154646 - RNA, 19 nt, Human
aggaaagggggaagggagg

SEQ ID NO: 154647 - RNA, 26 nt, Human
aggaagaaaaagaaagauggaaagaa

SEQ ID NO: 154648 - RNA, 18 nt, Human
aggcauuuucugucuuug

SEQ ID NO: 154649 - RNA, 19 nt, Human
agggaugugccaauuucug

SEQ ID NO: 154650 - RNA, 18 nt, Human
auaacuuuccaaaacuuc

SEQ ID NO: 154651 - RNA, 18 nt, Human
auacacaguauuccuagc

SEQ ID NO: 154652 - RNA, 23 nt, Human
auagaauauacuacuguagucuc

SEQ ID NO: 154653 - RNA, 22 nt, Human
aucacauuccuaaccaccaugg

SEQ ID NO: 154654 - RNA, 23 nt, Human
auccugaaaggcauaauaauuug

SEQ ID NO: 154655 - RNA, 23 nt, Human
caaacaggcaguaucacauuccu

SEQ ID NO: 154656 - RNA, 19 nt, Human
caaagcucucacacucucc

SEQ ID NO: 154657 - RNA, 21 nt, Human
caagaacaagacaacagucuu

SEQ ID NO: 154658 - RNA, 27 nt, Human
caagaauccaaacaccacaagaacaag

SEQ ID NO: 154659 - RNA, 24 nt, Human
cacaagaauccaaacaccacaaga

SEQ ID NO: 154660 - RNA, 21 nt, Human
cacagcuccuucugaggcaag

SEQ ID NO: 154661 - RNA, 22 nt, Human
cagccaguugggaccaaagcuc

SEQ ID NO: 154662 - RNA, 19 nt, Human
cauaauacagggagcagcu

SEQ ID NO: 154663 - RNA, 23 nt, Human
cauauggcaauuguaccucccaa

SEQ ID NO: 154664 - RNA, 19 nt, Human
ccacaagaauccaaacacc

SEQ ID NO: 154665 - RNA, 21 nt, Human
ccacaagaauccaaacaccac

SEQ ID NO: 154666 - RNA, 24 nt, Human
ccacaagaauccaaacaccacaag

SEQ ID NO: 154667 - RNA, 19 nt, Human
ccagacuggcacacaacau

SEQ ID NO: 154668 - RNA, 23 nt, Human
ccaucucucuucaguuagagacc

SEQ ID NO: 154669 - RNA, 23 nt, Human
ccuaggcagguaaacagagacgc

SEQ ID NO: 154670 - RNA, 21 nt, Human
cgugauaauaugcaccuuccc

SEQ ID NO: 154671 - RNA, 19 nt, Human
cuaggcagguaaacagaga

SEQ ID NO: 154672 - RNA, 21 nt, Human
cucagguuuucaguugguugg

SEQ ID NO: 154673 - RNA, 23 nt, Human
cucccaugaaaucuaauacugca

SEQ ID NO: 154674 - RNA, 22 nt, Human
cuugacagagcacagugcaauu

SEQ ID NO: 154675 - RNA, 21 nt, Human
gaaagaagaaaaggagaaaaa

SEQ ID NO: 154676 - RNA, 22 nt, Human
gaaaggaaagggaaaaggaaag

SEQ ID NO: 154677 - RNA, 18 nt, Human
gaaagggaaaaggaaagg

SEQ ID NO: 154678 - RNA, 18 nt, Human
gaacauuuagguaaacug

SEQ ID NO: 154679 - RNA, 18 nt, Human
gaagaaaaagaaagaugg

SEQ ID NO: 154680 - RNA, 23 nt, Human
gaagaaaaagaaagauggaaaga

SEQ ID NO: 154681 - RNA, 19 nt, Human
gaagaaagaggaaagaaga

SEQ ID NO: 154682 - RNA, 22 nt, Human
gacuugaaaaaacaauuaagga

SEQ ID NO: 154683 - RNA, 18 nt, Human
gagaaagagaaauguggg

SEQ ID NO: 154684 - RNA, 25 nt, Human
gauugaaacacaaguguaacuacaa

SEQ ID NO: 154685 - RNA, 21 nt, Human
ggaaaggaaagggggaaggga

SEQ ID NO: 154686 - RNA, 18 nt, Human
ggagaaugggaacuagga

SEQ ID NO: 154687 - RNA, 18 nt, Human
ggaugagaaaagagagga

SEQ ID NO: 154688 - RNA, 19 nt, Human
ggcucacagcuccuucuga

SEQ ID NO: 154689 - RNA, 22 nt, Human
gggaagaaagaggaaagaagau

SEQ ID NO: 154690 - RNA, 20 nt, Human
gggaaggaugagaaaagaga

SEQ ID NO: 154691 - RNA, 21 nt, Human
guagguaaagaaaagaaagaa

SEQ ID NO: 154692 - RNA, 19 nt, Human
uaaaagaagcaaaauuaaa

SEQ ID NO: 154693 - RNA, 18 nt, Human
uaaauaagaacgaaccua

SEQ ID NO: 154694 - RNA, 22 nt, Human
uaaauacauuuacacaaaugga

SEQ ID NO: 154695 - RNA, 25 nt, Human
uaacaaauaccuggaagacuugaaa

SEQ ID NO: 154696 - RNA, 20 nt, Human
uaacaacaucugagagauga

SEQ ID NO: 154697 - RNA, 22 nt, Human
uaagaagaaacaaaacauuuuu

SEQ ID NO: 154698 - RNA, 19 nt, Human
uaagaagcagccgaugcaa

SEQ ID NO: 154699 - RNA, 22 nt, Human
uaagaagcagccgaugcaacgu

SEQ ID NO: 154700 - RNA, 22 nt, Human
uacaacaaucugaucugauuga

SEQ ID NO: 154701 - RNA, 25 nt, Human
uagaaagaaacucaucaggaaccuc

SEQ ID NO: 154702 - RNA, 22 nt, Human
uagcuaaacuaacaaauaccug

SEQ ID NO: 154703 - RNA, 22 nt, Human
uaguagcuaaacuaacaaauac

SEQ ID NO: 154704 - RNA, 18 nt, Human
uaguauugcaugaaugaa

SEQ ID NO: 154705 - RNA, 21 nt, Human
uagugacaagccuauaggcac

SEQ ID NO: 154706 - RNA, 23 nt, Human
uauaaaauaaauacauuuacaca

SEQ ID NO: 154707 - RNA, 21 nt, Human
uauggaggaaucugaaagcug

SEQ ID NO: 154708 - RNA, 21 nt, Human
uauggcaauuguaccucccaa

SEQ ID NO: 154709 - RNA, 19 nt, Human
uauguugcacuguacuuuu

SEQ ID NO: 154710 - RNA, 21 nt, Human
ucccaggaguuguauuuucug

SEQ ID NO: 154711 - RNA, 19 nt, Human
uccuucaggauucauuugu

SEQ ID NO: 154712 - RNA, 18 nt, Human
ucuccuagugacaagccu

SEQ ID NO: 154713 - RNA, 18 nt, Human
ucugaagcccaaguacuu

SEQ ID NO: 154714 - RNA, 23 nt, Human
ugaaaagcacauauauuggcuua

SEQ ID NO: 154715 - RNA, 24 nt, Human
ugaaaagugguaaagcugguacaa

SEQ ID NO: 154716 - RNA, 23 nt, Human
ugaaacacaaguguaacuacaag

SEQ ID NO: 154717 - RNA, 24 nt, Human
ugaaaggcauaauaauuugaguua

SEQ ID NO: 154718 - RNA, 23 nt, Human
ugaagcccaucuacagcuauaga

SEQ ID NO: 154719 - RNA, 23 nt, Human
ugaaugcaacauaaaauucagaa

SEQ ID NO: 154720 - RNA, 23 nt, Human
ugacagagcacagugcaauuaac

SEQ ID NO: 154721 - RNA, 25 nt, Human
ugacagagcacagugcaauuaacac

SEQ ID NO: 154722 - RNA, 20 nt, Human
ugagaaaccacaaucuacaa

SEQ ID NO: 154723 - RNA, 18 nt, Human
ugagaguagguaaagaaa

SEQ ID NO: 154724 - RNA, 18 nt, Human
ugauaagaagcagccgau

SEQ ID NO: 154725 - RNA, 20 nt, Human
ugauaagaagcagccgaugc

SEQ ID NO: 154726 - RNA, 23 nt, Human
ugauaagaagcagccgaugcaac

SEQ ID NO: 154727 - RNA, 18 nt, Human
ugauugaaacacaagugu

SEQ ID NO: 154728 - RNA, 24 nt, Human
ugauuuaucuagaaucacacuaca

SEQ ID NO: 154729 - RNA, 23 nt, Human
uggaaaagcaaugauaagaagca

SEQ ID NO: 154730 - RNA, 26 nt, Human
uggaaagaaggucaagaggaaaggaa

SEQ ID NO: 154731 - RNA, 26 nt, Human
uggaaccugacuugacuuucaugcug

SEQ ID NO: 154732 - RNA, 24 nt, Human
uggcacacaacauaaauugcaucc

SEQ ID NO: 154733 - RNA, 19 nt, Human
ugguauagcauuugaugga

SEQ ID NO: 154734 - RNA, 18 nt, Human
uguaagaagaaacaaaac

SEQ ID NO: 154735 - RNA, 23 nt, Human
uuaaaaaucuuccuucaggauuc

SEQ ID NO: 154736 - RNA, 22 nt, Human
uucccauauuaauaaauggcug

SEQ ID NO: 154737 - RNA, 23 nt, Human
uuccuugacagagcacagugcaa

SEQ ID NO: 154738 - RNA, 21 nt, Human
aaaaguacccaauuugaaaac

SEQ ID NO: 154739 - RNA, 23 nt, Human
aaacaaauagcagagcccaaagc

SEQ ID NO: 154740 - RNA, 24 nt, Human
aaacagauggaaguaaacagugca

SEQ ID NO: 154741 - RNA, 25 nt, Human
aaaccaaaguguagggcugggucug

SEQ ID NO: 154742 - RNA, 18 nt, Human
aagcauauucaaaaaugu

SEQ ID NO: 154743 - RNA, 23 nt, Human
aaggagcugguucagaccaauaa

SEQ ID NO: 154744 - RNA, 23 nt, Human
aagugccuccuauuagcucaccc

SEQ ID NO: 154745 - RNA, 20 nt, Human
acaagagcaaccaauuucac

SEQ ID NO: 154746 - RNA, 21 nt, Human
acaccggcucccucucuccag

SEQ ID NO: 154747 - RNA, 24 nt, Human
acagaagccccaucauauccaucc

SEQ ID NO: 154748 - RNA, 23 nt, Human
acagcagucaggcacuaaagugu

SEQ ID NO: 154749 - RNA, 23 nt, Human
accaaaguguagggcugggucug

SEQ ID NO: 154750 - RNA, 21 nt, Human
acguaggacaccggcucccuc

SEQ ID NO: 154751 - RNA, 22 nt, Human
agaaccagaaacuuuacauuua

SEQ ID NO: 154752 - RNA, 23 nt, Human
agacauacucccuucauucaagu

SEQ ID NO: 154753 - RNA, 24 nt, Human
agagaccaagagagaaaugguucc

SEQ ID NO: 154754 - RNA, 19 nt, Human
agagcccaaagcaaaaaag

SEQ ID NO: 154755 - RNA, 21 nt, Human
agagcccaaagcaaaaaagcc

SEQ ID NO: 154756 - RNA, 18 nt, Human
agaugcuccaaccccacc

SEQ ID NO: 154757 - RNA, 21 nt, Human
agcaauagcacagaagcccca

SEQ ID NO: 154758 - RNA, 19 nt, Human
agcccaaagcaaaaaagcc

SEQ ID NO: 154759 - RNA, 19 nt, Human
agggcccaguccugggcgg

SEQ ID NO: 154760 - RNA, 23 nt, Human
auaaaaacuacaaaaggagcugc

SEQ ID NO: 154761 - RNA, 19 nt, Human
auaaaauacaagagcaacc

SEQ ID NO: 154762 - RNA, 25 nt, Human
auaaaauccucuuuaaauuucuucg

SEQ ID NO: 154763 - RNA, 24 nt, Human
auagcacagaagccccaucauauc

SEQ ID NO: 154764 - RNA, 21 nt, Human
auccaacacaaggaaacacau

SEQ ID NO: 154765 - RNA, 26 nt, Human
auggucuuaaauccauggugccagaa

SEQ ID NO: 154766 - RNA, 22 nt, Human
auggugccagaagcuguguccc

SEQ ID NO: 154767 - RNA, 19 nt, Human
caaacagauggaaguaaac

SEQ ID NO: 154768 - RNA, 21 nt, Human
caaaccaaaguguagggcugg

SEQ ID NO: 154769 - RNA, 21 nt, Human
caaacgccgggcacaaaugug

SEQ ID NO: 154770 - RNA, 25 nt, Human
caaagggcucccaaacgccgggcac

SEQ ID NO: 154771 - RNA, 19 nt, Human
caaaugugucugcaaacag

SEQ ID NO: 154772 - RNA, 27 nt, Human
caacacaaggaaacacauccaccuccc

SEQ ID NO: 154773 - RNA, 26 nt, Human
caaccccaccaggaggucaggaguuu

SEQ ID NO: 154774 - RNA, 24 nt, Human
caaggaaacacauccaccucccuu

SEQ ID NO: 154775 - RNA, 18 nt, Human
caauagcacagaagcccc

SEQ ID NO: 154776 - RNA, 22 nt, Human
cacauuugaaacagaugcucca

SEQ ID NO: 154777 - RNA, 19 nt, Human
caccggcucccucucucca

SEQ ID NO: 154778 - RNA, 18 nt, Human
cacgccaugaccuugcau

SEQ ID NO: 154779 - RNA, 20 nt, Human
cacuuuguucaacugucacc

SEQ ID NO: 154780 - RNA, 23 nt, Human
cagagcccaaagcaaaaaagccu

SEQ ID NO: 154781 - RNA, 23 nt, Human
caggaguuuauaauuacaugcag

SEQ ID NO: 154782 - RNA, 24 nt, Human
caguaaagaacagcagucaggcac

SEQ ID NO: 154783 - RNA, 24 nt, Human
cauaucagcuggguucaagucuga

SEQ ID NO: 154784 - RNA, 18 nt, Human
caucgcuaccacugggca

SEQ ID NO: 154785 - RNA, 28 nt, Human
ccaaagcaaaaaagccuguuguccggac

SEQ ID NO: 154786 - RNA, 18 nt, Human
ccaacacaaggaaacaca

SEQ ID NO: 154787 - RNA, 23 nt, Human
ccaaucccagcaauagcacagaa

SEQ ID NO: 154788 - RNA, 20 nt, Human
ccauguaaaugggucacugc

SEQ ID NO: 154789 - RNA, 19 nt, Human
cccaaagcaaaaaagccug

SEQ ID NO: 154790 - RNA, 20 nt, Human
cccaaucccagcaauagcac

SEQ ID NO: 154791 - RNA, 22 nt, Human
ccccaucauauccaucccaguc

SEQ ID NO: 154792 - RNA, 18 nt, Human
cccuaagguacugcugug

SEQ ID NO: 154793 - RNA, 22 nt, Human
ccuccuccucccuaagggccca

SEQ ID NO: 154794 - RNA, 21 nt, Human
cuauagagaaugcaaaggcua

SEQ ID NO: 154795 - RNA, 21 nt, Human
cucaugugagaagugcuugua

SEQ ID NO: 154796 - RNA, 21 nt, Human
cuccaaccccaccaggagguc

SEQ ID NO: 154797 - RNA, 23 nt, Human
cucgcggcggcggcggcucugac

SEQ ID NO: 154798 - RNA, 25 nt, Human
cugacguaggacaccggcucccucu

SEQ ID NO: 154799 - RNA, 25 nt, Human
cugggcggcagcggcugcuccuccc

SEQ ID NO: 154800 - RNA, 21 nt, Human
gaaacaacaagcauauucaaa

SEQ ID NO: 154801 - RNA, 21 nt, Human
gaagccccaucauauccaucc

SEQ ID NO: 154802 - RNA, 21 nt, Human
gacauacucccuucauucaag

SEQ ID NO: 154803 - RNA, 25 nt, Human
gacccauuuacaauggcaaaacccu

SEQ ID NO: 154804 - RNA, 22 nt, Human
gagcaaccaauuucaccaucca

SEQ ID NO: 154805 - RNA, 19 nt, Human
gcagcaauuuaauuuuucu

SEQ ID NO: 154806 - RNA, 18 nt, Human
gcggcggcggcggcucug

SEQ ID NO: 154807 - RNA, 22 nt, Human
gcggcggcucgcggcggcggcg

SEQ ID NO: 154808 - RNA, 21 nt, Human
ggcggcucgcggcggcggcgg

SEQ ID NO: 154809 - RNA, 27 nt, Human
gggggacgggguagcgugagggaguga

SEQ ID NO: 154810 - RNA, 18 nt, Human
gucuaagcugagaaugcc

SEQ ID NO: 154811 - RNA, 24 nt, Human
gugaaacaacaagcauauucaaaa

SEQ ID NO: 154812 - RNA, 24 nt, Human
guuccugugaaaaaccuugcaguu

SEQ ID NO: 154813 - RNA, 24 nt, Human
uaaaaguacccaauuugaaaacca

SEQ ID NO: 154814 - RNA, 21 nt, Human
uaaauccauggugccagaagc

SEQ ID NO: 154815 - RNA, 18 nt, Human
uaaauuaguccaaagugg

SEQ ID NO: 154816 - RNA, 24 nt, Human
uaaggcagggaucuguuuggauuc

SEQ ID NO: 154817 - RNA, 24 nt, Human
uacaaaaggagcugcauacccuaa

SEQ ID NO: 154818 - RNA, 25 nt, Human
uacaaaaggagcugcauacccuaaa

SEQ ID NO: 154819 - RNA, 25 nt, Human
uacugcugugaagagagcguguuug

SEQ ID NO: 154820 - RNA, 21 nt, Human
uagcacagaagccccaucaua

SEQ ID NO: 154821 - RNA, 20 nt, Human
ucaaaguccauuugguauac

SEQ ID NO: 154822 - RNA, 22 nt, Human
uccaacauuucaccacauauau

SEQ ID NO: 154823 - RNA, 22 nt, Human
uccaccucccuuuuaacaagga

SEQ ID NO: 154824 - RNA, 27 nt, Human
uccaccucccuuuuaacaaggauugac

SEQ ID NO: 154825 - RNA, 21 nt, Human
ucccaaacgccgggcacaaau

SEQ ID NO: 154826 - RNA, 21 nt, Human
ucccaaucccagcaauagcac

SEQ ID NO: 154827 - RNA, 21 nt, Human
ucccacguuggugaacaccaa

SEQ ID NO: 154828 - RNA, 19 nt, Human
ucccaucccuucccacccg

SEQ ID NO: 154829 - RNA, 18 nt, Human
ucucaugccauccaacac

SEQ ID NO: 154830 - RNA, 22 nt, Human
ucucaugccauccaacacaagg

SEQ ID NO: 154831 - RNA, 24 nt, Human
ucuccaaucaaaauaagaaacaaa

SEQ ID NO: 154832 - RNA, 26 nt, Human
ucucgccuccuccucccuaagggccc

SEQ ID NO: 154833 - RNA, 22 nt, Human
ucucuggucuugucauaucaca

SEQ ID NO: 154834 - RNA, 18 nt, Human
ucugcaaacagauggaag

SEQ ID NO: 154835 - RNA, 23 nt, Human
ucuguaaccugggaacaaggagc

SEQ ID NO: 154836 - RNA, 23 nt, Human
ugaaacagaugcuccaaccccac

SEQ ID NO: 154837 - RNA, 20 nt, Human
ugaagguuuacagcaguuaa

SEQ ID NO: 154838 - RNA, 23 nt, Human
ugagggagugaaguugaaagugc

SEQ ID NO: 154839 - RNA, 20 nt, Human
ugauacacacaucaauauau

SEQ ID NO: 154840 - RNA, 21 nt, Human
ugauacacacaucaauauaua

SEQ ID NO: 154841 - RNA, 24 nt, Human
ugcaaacaaauagcagagcccaaa

SEQ ID NO: 154842 - RNA, 20 nt, Human
ugcagcaauuuaauuuuucu

SEQ ID NO: 154843 - RNA, 18 nt, Human
ugcagucauacaugucug

SEQ ID NO: 154844 - RNA, 18 nt, Human
ugccauccaacacaagga

SEQ ID NO: 154845 - RNA, 24 nt, Human
uggaaguaaacagugcacuggccc

SEQ ID NO: 154846 - RNA, 25 nt, Human
ugggaacaaggagcuggucgggauc

SEQ ID NO: 154847 - RNA, 23 nt, Human
uggguguucugcaaacaaauagc

SEQ ID NO: 154848 - RNA, 25 nt, Human
uggucuuaaauccauggugccagaa

SEQ ID NO: 154849 - RNA, 20 nt, Human
ugucauaucacaucagaccc

SEQ ID NO: 154850 - RNA, 22 nt, Human
ugucccaucccuucccacccgc

SEQ ID NO: 154851 - RNA, 22 nt, Human
uguuuuauuucucccaauccca

SEQ ID NO: 154852 - RNA, 21 nt, Human
uuaauacucuucuccauuucu

SEQ ID NO: 154853 - RNA, 20 nt, Human
uuagcucacccuuucaacau

SEQ ID NO: 154854 - RNA, 23 nt, Human
uuccaauuguaaggcagggaucu

SEQ ID NO: 154855 - RNA, 20 nt, Human
uugacccaagcaaaauaaaa

SEQ ID NO: 154856 - RNA, 20 nt, Human
uugcuucuauguaugaaggu

SEQ ID NO: 154857 - RNA, 24 nt, Human
aaccacaaauaauuaaaaggaaac

SEQ ID NO: 154858 - RNA, 20 nt, Human
aucuguuagaaauuuucccu

SEQ ID NO: 154859 - RNA, 23 nt, Human
cucuccaugcuuuccaaugauug

SEQ ID NO: 154860 - RNA, 24 nt, Human
uaaaaggaaacacagcaaucccau

SEQ ID NO: 154861 - RNA, 26 nt, Human
uaaaaggaaacacagcaaucccauaa

SEQ ID NO: 154862 - RNA, 22 nt, Human
uuagaaauuuucccucaaauua

SEQ ID NO: 154863 - RNA, 18 nt, Human
uucuuuuuaaggcaugau

SEQ ID NO: 154864 - RNA, 21 nt, Human
uuggaaccacaaauaauuaac

SEQ ID NO: 154865 - RNA, 19 nt, Human
cuucccgccgcagccacuu

SEQ ID NO: 154866 - RNA, 22 nt, Human
uucccgccgcagccacuuacag

SEQ ID NO: 154867 - RNA, 24 nt, Human
uuuuuuuuuuuuuuuuugauguug

SEQ ID NO: 154868 - RNA, 21 nt, Human
accaggacucucggucggaca

SEQ ID NO: 154869 - RNA, 21 nt, Human
cuugccauacuugaaagaaac

SEQ ID NO: 154870 - RNA, 21 nt, Human
gcagaaagacauucugaaauc

SEQ ID NO: 154871 - RNA, 24 nt, Human
ggacacaacaggaggacuguccgc

SEQ ID NO: 154872 - RNA, 24 nt, Human
uaugcagaaagacauucugaaauc

SEQ ID NO: 154873 - RNA, 22 nt, Human
ucaccugccggaaagcaagagc

SEQ ID NO: 154874 - RNA, 20 nt, Human
ugcagaaagacauucugaaa

SEQ ID NO: 154875 - RNA, 24 nt, Human
ugcagaaagacauucugaaaucuc

SEQ ID NO: 154876 - RNA, 18 nt, Human
ugccauacuugaaagaaa

SEQ ID NO: 154877 - RNA, 21 nt, Human
uugaaagaaacuggcuagcug

SEQ ID NO: 154878 - RNA, 21 nt, Human
aaauccgacuuucuucccaaa

SEQ ID NO: 154879 - RNA, 18 nt, Human
aaauucccgcugccuuuc

SEQ ID NO: 154880 - RNA, 18 nt, Human
auccgacuuucuucccaa

SEQ ID NO: 154881 - RNA, 22 nt, Human
auuguuguuuuucuuuuuaaug

SEQ ID NO: 154882 - RNA, 21 nt, Human
caggggaaguuggcacuuugc

SEQ ID NO: 154883 - RNA, 19 nt, Human
cccccgcgcccggacggug

SEQ ID NO: 154884 - RNA, 24 nt, Human
cccgccgcgcgcccgcuccuccug

SEQ ID NO: 154885 - RNA, 18 nt, Human
ccgccgcgcgcccgcucc

SEQ ID NO: 154886 - RNA, 20 nt, Human
ccgccgcgcgcccgcuccuc

SEQ ID NO: 154887 - RNA, 22 nt, Human
ccgcgcgcccgcuccuccugcc

SEQ ID NO: 154888 - RNA, 25 nt, Human
ccucgcccgccgcgcgcccgcuccu

SEQ ID NO: 154889 - RNA, 22 nt, Human
cgaagugagcgcgcucgggucc

SEQ ID NO: 154890 - RNA, 22 nt, Human
cgcgcgcccgcuccuccugccc

SEQ ID NO: 154891 - RNA, 22 nt, Human
cgcucgggucccagccucgccc

SEQ ID NO: 154892 - RNA, 22 nt, Human
gcccgccgcgcgcccgcuccuc

SEQ ID NO: 154893 - RNA, 26 nt, Human
uccgacuuucuucccaaaaaucucaa

SEQ ID NO: 154894 - RNA, 19 nt, Human
ugcccggcccucgcccgga

SEQ ID NO: 154895 - RNA, 21 nt, Human
uuaguaacagggggaagggga

SEQ ID NO: 154896 - RNA, 25 nt, Human
aaaaaacacaaaaagcagggauuac

SEQ ID NO: 154897 - RNA, 23 nt, Human
aaaaacacaaaaagcagggauua

SEQ ID NO: 154898 - RNA, 23 nt, Human
aaaaagcagggauuaccccccac

SEQ ID NO: 154899 - RNA, 26 nt, Human
aaacaaacaaaaaaacacaaaaagca

SEQ ID NO: 154900 - RNA, 24 nt, Human
aaacaaacaaacaaaaaaacacaa

SEQ ID NO: 154901 - RNA, 25 nt, Human
aaacaaacaaacaaacaaaaaaaca

SEQ ID NO: 154902 - RNA, 18 nt, Human
aaacagccagaaccaucc

SEQ ID NO: 154903 - RNA, 21 nt, Human
aaaccccccaaaaacaaacaa

SEQ ID NO: 154904 - RNA, 23 nt, Human
aacuguuaagggauucugagaac

SEQ ID NO: 154905 - RNA, 22 nt, Human
aacuucucuuagucggcccuuu

SEQ ID NO: 154906 - RNA, 23 nt, Human
aagaaaaccccccaaaaacaaac

SEQ ID NO: 154907 - RNA, 22 nt, Human
aagaaaaucuaaaaauagucug

SEQ ID NO: 154908 - RNA, 19 nt, Human
aaggcaagaaaacccccca

SEQ ID NO: 154909 - RNA, 22 nt, Human
aaggcaagaaaaccccccaaaa

SEQ ID NO: 154910 - RNA, 23 nt, Human
acaaacaaacaaacaaaaaaaca

SEQ ID NO: 154911 - RNA, 20 nt, Human
acaaccaaggcaagaaaacc

SEQ ID NO: 154912 - RNA, 25 nt, Human
accccccaaaaacaaacaaacaaac

SEQ ID NO: 154913 - RNA, 23 nt, Human
acgacaugcucgcuccuuugaga

SEQ ID NO: 154914 - RNA, 22 nt, Human
agaaaaccccccaaaaacaaag

SEQ ID NO: 154915 - RNA, 22 nt, Human
agaggcgugguuugggaugcaa

SEQ ID NO: 154916 - RNA, 22 nt, Human
auaaaaacucccaaauguacaa

SEQ ID NO: 154917 - RNA, 22 nt, Human
auuuucaauccugccuuuccug

SEQ ID NO: 154918 - RNA, 26 nt, Human
caaaaaaacacaaaaagcagggauua

SEQ ID NO: 154919 - RNA, 27 nt, Human
caaacaaacaaaaaaacacaaaaagca

SEQ ID NO: 154920 - RNA, 30 nt, Human
caaacaaacaaaaaaacacaaaaagcuguc

SEQ ID NO: 154921 - RNA, 23 nt, Human
caaacaaacaaacaaaaaaacac

SEQ ID NO: 154922 - RNA, 23 nt, Human
caaacuaacuucugaaaugacau

SEQ ID NO: 154923 - RNA, 27 nt, Human
caaggcaagaaaaccccccaaaaacaa

SEQ ID NO: 154924 - RNA, 26 nt, Human
cacaaaaagcagggauuaccccccac

SEQ ID NO: 154925 - RNA, 22 nt, Human
cacccuccuacccucucaaaga

SEQ ID NO: 154926 - RNA, 25 nt, Human
cauuuucacuuaaaagcacugugag

SEQ ID NO: 154927 - RNA, 21 nt, Human
ccaaaaacaaacaaacaaaca

SEQ ID NO: 154928 - RNA, 23 nt, Human
ccaaaaacaaacaaacaaacaaa

SEQ ID NO: 154929 - RNA, 25 nt, Human
ccaaggcaagaaaaccccccaaaaa

SEQ ID NO: 154930 - RNA, 25 nt, Human
ccacugcuucuuggccacuuuccug

SEQ ID NO: 154931 - RNA, 25 nt, Human
cccaaaaacaaacaaacaaacaaac

SEQ ID NO: 154932 - RNA, 22 nt, Human
cccacccuccuacccucucaaa

SEQ ID NO: 154933 - RNA, 18 nt, Human
ccccaaaaacaaacaaac

SEQ ID NO: 154934 - RNA, 22 nt, Human
ccccccaaaaacaaacaaacaa

SEQ ID NO: 154935 - RNA, 18 nt, Human
cgagggcgccggccagag

SEQ ID NO: 154936 - RNA, 22 nt, Human
cggcucaggguggucccggcga

SEQ ID NO: 154937 - RNA, 21 nt, Human
cucggugcgcgccgggcgagg

SEQ ID NO: 154938 - RNA, 21 nt, Human
cugccaggcgccaggacggcu

SEQ ID NO: 154939 - RNA, 23 nt, Human
cugguugcaaaaggcaaaagaaa

SEQ ID NO: 154940 - RNA, 22 nt, Human
cugugaguagaauuagcugugc

SEQ ID NO: 154941 - RNA, 23 nt, Human
cuuccuggugccucuuucucgac

SEQ ID NO: 154942 - RNA, 20 nt, Human
cuucuuggccacuuuccugg

SEQ ID NO: 154943 - RNA, 18 nt, Human
gcgcgccgggcgagggcg

SEQ ID NO: 154944 - RNA, 23 nt, Human
ggacgguggcugcucggcgcccg

SEQ ID NO: 154945 - RNA, 21 nt, Human
ggaggccggacgcuggccggg

SEQ ID NO: 154946 - RNA, 19 nt, Human
guggcugcucggcgcccgc

SEQ ID NO: 154947 - RNA, 20 nt, Human
uaaaaccucagaugucugaa

SEQ ID NO: 154948 - RNA, 24 nt, Human
uaaauguaaauaauacauacuuua

SEQ ID NO: 154949 - RNA, 24 nt, Human
uacaaaguccuugccagacaacca

SEQ ID NO: 154950 - RNA, 18 nt, Human
uauuucaaauacaguuau

SEQ ID NO: 154951 - RNA, 23 nt, Human
ucaaacagccagaaccaucccgu

SEQ ID NO: 154952 - RNA, 21 nt, Human
ucaguccacgagccuggggcc

SEQ ID NO: 154953 - RNA, 26 nt, Human
uccacgacaugcucgcuccuuugaga

SEQ ID NO: 154954 - RNA, 23 nt, Human
ucccacccuccuacccucucaaa

SEQ ID NO: 154955 - RNA, 20 nt, Human
ucccacggacugccaggcgc

SEQ ID NO: 154956 - RNA, 21 nt, Human
ucccuguaagucuauuaaaug

SEQ ID NO: 154957 - RNA, 19 nt, Human
ucuuugcaaaauuccauau

SEQ ID NO: 154958 - RNA, 21 nt, Human
ugcaaaaggcaaaagaaaauc

SEQ ID NO: 154959 - RNA, 18 nt, Human
ugccagacaaccaaggca

SEQ ID NO: 154960 - RNA, 18 nt, Human
ugccaggcgccaggacgg

SEQ ID NO: 154961 - RNA, 23 nt, Human
ugcucgcuccuuugagaaucuca

SEQ ID NO: 154962 - RNA, 19 nt, Human
uggccgggcggcuccggga

SEQ ID NO: 154963 - RNA, 18 nt, Human
ugggcuucccacucaguc

SEQ ID NO: 154964 - RNA, 19 nt, Human
uggucaagaggcgugguuu

SEQ ID NO: 154965 - RNA, 23 nt, Human
ugugcuauugaaaaaugaaauaa

SEQ ID NO: 154966 - RNA, 19 nt, Human
uucaaauacaguuauauaa

SEQ ID NO: 154967 - RNA, 19 nt, Human
uuggcagauuaaaucuuug

SEQ ID NO: 154968 - RNA, 24 nt, Human
uuuccuggguccucggagcagcug

SEQ ID NO: 154969 - RNA, 25 nt, Human
uuuuuuuuugucaagaaaaauacug

SEQ ID NO: 154970 - RNA, 21 nt, Human
uuuuuuuuuuuuuuugucaag

SEQ ID NO: 154971 - RNA, 18 nt, Human
uuuuuuuuuuuuuuuuug

SEQ ID NO: 154972 - RNA, 19 nt, Human
uuuuuuuuuuuuuuuuugu

SEQ ID NO: 154973 - RNA, 22 nt, Human
aaaaaaggaaaagcgcaaaaaa

SEQ ID NO: 154974 - RNA, 21 nt, Human
aaaaaggaaaagcgcaaaaaa

SEQ ID NO: 154975 - RNA, 20 nt, Human
aggaaaagcgcaaaaaacgc

SEQ ID NO: 154976 - RNA, 24 nt, Human
auuacucccacccacccucaaaua

SEQ ID NO: 154977 - RNA, 18 nt, Human
caacaacagaaauaaaac

SEQ ID NO: 154978 - RNA, 18 nt, Human
ccacccacccucaaauaa

SEQ ID NO: 154979 - RNA, 24 nt, Human
cgcaaaaaacgcccugcuugacug

SEQ ID NO: 154980 - RNA, 25 nt, Human
cuuuuuguguauuauuauuuaaaaa

SEQ ID NO: 154981 - RNA, 25 nt, Human
uagaauaaugcaacaggaaaagccc

SEQ ID NO: 154982 - RNA, 20 nt, Human
uagcuuccuguuacacagaa

SEQ ID NO: 154983 - RNA, 19 nt, Human
ucacccauuagcuuccugu

SEQ ID NO: 154984 - RNA, 19 nt, Human
ucccucugcccauucaccc

SEQ ID NO: 154985 - RNA, 22 nt, Human
ucuguaucuugcagaaaaaagg

SEQ ID NO: 154986 - RNA, 21 nt, Human
uggcagaccauagaauaaugc

SEQ ID NO: 154987 - RNA, 21 nt, Human
aaaaaaccacacaacaacaaa

SEQ ID NO: 154988 - RNA, 22 nt, Human
aaaaucuuccuaaacaugccau

SEQ ID NO: 154989 - RNA, 22 nt, Human
aaacaaaaaaccacacaacaac

SEQ ID NO: 154990 - RNA, 20 nt, Human
aaacaugugaaccucccccu

SEQ ID NO: 154991 - RNA, 23 nt, Human
aaaccaaagaaaucuaucuugau

SEQ ID NO: 154992 - RNA, 21 nt, Human
aaauaaaccaaagaaaucuau

SEQ ID NO: 154993 - RNA, 19 nt, Human
aacaaaaaaccacacaaca

SEQ ID NO: 154994 - RNA, 23 nt, Human
aacaucauucccaaacaagauag

SEQ ID NO: 154995 - RNA, 21 nt, Human
aaccacacaacaacaaagucu

SEQ ID NO: 154996 - RNA, 27 nt, Human
aaccacacaacaacaaagucuuuugag

SEQ ID NO: 154997 - RNA, 26 nt, Human
aagaaaaaacaucauauauaugaaug

SEQ ID NO: 154998 - RNA, 23 nt, Human
aagaucaucacaaaccuaugaaa

SEQ ID NO: 154999 - RNA, 23 nt, Human
aaggaaaaaaaucacaaacaaaa

SEQ ID NO: 155000 - RNA, 23 nt, Human
acaaacaaaaaaccacacaacaa

SEQ ID NO: 155001 - RNA, 24 nt, Human
acaaacaaaaaaccacacaacaac

SEQ ID NO: 155002 - RNA, 25 nt, Human
acaaacaauaugcagaaaagggaac

SEQ ID NO: 155003 - RNA, 27 nt, Human
acaacaaagucuuuugagagacugcuu

SEQ ID NO: 155004 - RNA, 19 nt, Human
agagacugcuuucaacauc

SEQ ID NO: 155005 - RNA, 23 nt, Human
agcugugauggaaagcuauaacc

SEQ ID NO: 155006 - RNA, 24 nt, Human
aggaaaaaaaucacaaacaaaaaa

SEQ ID NO: 155007 - RNA, 22 nt, Human
aucuaucuugauacugaauagc

SEQ ID NO: 155008 - RNA, 23 nt, Human
auuugcauaaggaaaaaaaucac

SEQ ID NO: 155009 - RNA, 19 nt, Human
caaaaaaccacacaacaac

SEQ ID NO: 155010 - RNA, 20 nt, Human
caaaaaaccacacaacaaca

SEQ ID NO: 155011 - RNA, 22 nt, Human
cauaaggaaaaaaaucacaaac

SEQ ID NO: 155012 - RNA, 23 nt, Human
ccggcuccuccucauccaccccc

SEQ ID NO: 155013 - RNA, 19 nt, Human
cgccugcucuucccggcac

SEQ ID NO: 155014 - RNA, 22 nt, Human
cggcuccuccucauccaccccc

SEQ ID NO: 155015 - RNA, 23 nt, Human
cggcuccuccucauccacccccc

SEQ ID NO: 155016 - RNA, 21 nt, Human
cuccuccucauccaccccccc

SEQ ID NO: 155017 - RNA, 24 nt, Human
gcaaacaugugaaccucccccuuc

SEQ ID NO: 155018 - RNA, 20 nt, Human
ggaaccaaccaaauaaacca

SEQ ID NO: 155019 - RNA, 24 nt, Human
gucuccggcuccuccucauccacc

SEQ ID NO: 155020 - RNA, 23 nt, Human
uaagaacauugaggcaauccagu

SEQ ID NO: 155021 - RNA, 25 nt, Human
uaagggagagcuugguaguuucaca

SEQ ID NO: 155022 - RNA, 21 nt, Human
uauaaccaggaaagucaagag

SEQ ID NO: 155023 - RNA, 22 nt, Human
uaugcagaaaagggaaccaacc

SEQ ID NO: 155024 - RNA, 24 nt, Human
ucacaaacaaaaaaccacacaaca

SEQ ID NO: 155025 - RNA, 24 nt, Human
uccgcggcgucuccggcuccuccu

SEQ ID NO: 155026 - RNA, 18 nt, Human
ugaaagaaccacugggcu

SEQ ID NO: 155027 - RNA, 24 nt, Human
ugaacguaaagaucaucacaaacc

SEQ ID NO: 155028 - RNA, 25 nt, Human
ugcaaacaugugaaccucccccuuc

SEQ ID NO: 155029 - RNA, 24 nt, Human
ugcagaaaagggaaccaaccaaau

SEQ ID NO: 155030 - RNA, 18 nt, Human
ugcugugguuuugaugau

SEQ ID NO: 155031 - RNA, 21 nt, Human
uugauaagggagagcuuggua

SEQ ID NO: 155032 - RNA, 20 nt, Human
uuucuugggcaggaguauga

SEQ ID NO: 155033 - RNA, 26 nt, Human
uuuucuauuuuauuauugucauuaau

SEQ ID NO: 155034 - RNA, 23 nt, Human
aaaaaaaaaaaaaaaaauccaaa

SEQ ID NO: 155035 - RNA, 21 nt, Human
aaaaaaacaaaaaccauccgg

SEQ ID NO: 155036 - RNA, 19 nt, Human
aaaaacacaaacaaaacca

SEQ ID NO: 155037 - RNA, 22 nt, Human
aaaaacacaaacaaaaccacug

SEQ ID NO: 155038 - RNA, 19 nt, Human
aaacaaaaccacugcccuu

SEQ ID NO: 155039 - RNA, 21 nt, Human
aaacaaacaaaccccaaagaa

SEQ ID NO: 155040 - RNA, 23 nt, Human
aaacaaacaaaccccaaagaacc

SEQ ID NO: 155041 - RNA, 25 nt, Human
aaacaaacaaaccccaaagaacccc

SEQ ID NO: 155042 - RNA, 23 nt, Human
aaacaaaccccaaagaacccccg

SEQ ID NO: 155043 - RNA, 23 nt, Human
aaacaaacugaugaaauggaaau

SEQ ID NO: 155044 - RNA, 26 nt, Human
aaacaaccaccaaaacaaaacaaucc

SEQ ID NO: 155045 - RNA, 27 nt, Human
aaaucaguuuauaaacuguuuuuccaa

SEQ ID NO: 155046 - RNA, 18 nt, Human
aacaaaacaaucccccaa

SEQ ID NO: 155047 - RNA, 20 nt, Human
aacaaauaaaucucuagcca

SEQ ID NO: 155048 - RNA, 25 nt, Human
aaccaaaaacacaaacaaaaccacu

SEQ ID NO: 155049 - RNA, 19 nt, Human
aaccaccaaaacaaaacaa

SEQ ID NO: 155050 - RNA, 22 nt, Human
aacuuuuccucuacuuugagcu

SEQ ID NO: 155051 - RNA, 21 nt, Human
aagaacccccgaaaaaaacaa

SEQ ID NO: 155052 - RNA, 23 nt, Human
aagaacccccgaaaaaaacaaaa

SEQ ID NO: 155053 - RNA, 22 nt, Human
aagagaaagggggcuugcucua

SEQ ID NO: 155054 - RNA, 19 nt, Human
aagcaaacaaacaaacccc

SEQ ID NO: 155055 - RNA, 23 nt, Human
aagcaaacaaacaaaccccaaag

SEQ ID NO: 155056 - RNA, 22 nt, Human
aagcacaaagcaggcaacaagg

SEQ ID NO: 155057 - RNA, 19 nt, Human
aagcaguucaaagcacgug

SEQ ID NO: 155058 - RNA, 24 nt, Human
aagcaguucaaagcacgugucuca

SEQ ID NO: 155059 - RNA, 21 nt, Human
aaggagacuccauuuugaucu

SEQ ID NO: 155060 - RNA, 21 nt, Human
acaaaacaaucccccaaauca

SEQ ID NO: 155061 - RNA, 21 nt, Human
acaaaccccaaagaacccccg

SEQ ID NO: 155062 - RNA, 25 nt, Human
acaaccaaaaacacaaacaaaacca

SEQ ID NO: 155063 - RNA, 26 nt, Human
accaaaacaaaacaaucccccaaauc

SEQ ID NO: 155064 - RNA, 21 nt, Human
accccaaagaacccccgaaaa

SEQ ID NO: 155065 - RNA, 20 nt, Human
acccccgaaaaaaacaaaaa

SEQ ID NO: 155066 - RNA, 28 nt, Human
acucuggaaaagaagcaaacaaacaaac

SEQ ID NO: 155067 - RNA, 24 nt, Human
acuuugagagguuucagcauugag

SEQ ID NO: 155068 - RNA, 20 nt, Human
agaaaccucaucagaaucaa

SEQ ID NO: 155069 - RNA, 20 nt, Human
agaaaggaaaaccaaaucua

SEQ ID NO: 155070 - RNA, 18 nt, Human
agagagggcauguuagug

SEQ ID NO: 155071 - RNA, 24 nt, Human
agagguuucagcauugaguaauuu

SEQ ID NO: 155072 - RNA, 20 nt, Human
agcaaagccccucucaagcu

SEQ ID NO: 155073 - RNA, 22 nt, Human
agcgggccugggcgccugggcg

SEQ ID NO: 155074 - RNA, 19 nt, Human
aggaugcauacggcccugc

SEQ ID NO: 155075 - RNA, 22 nt, Human
agggggcuugcucuacuuggcg

SEQ ID NO: 155076 - RNA, 23 nt, Human
agggguagcucaagcuacagagg

SEQ ID NO: 155077 - RNA, 22 nt, Human
agguuuguuuuuguuuuuuguu

SEQ ID NO: 155078 - RNA, 26 nt, Human
aucccccaaaucagggcaaaacaaaa

SEQ ID NO: 155079 - RNA, 20 nt, Human
auugugcaaaucagagcccu

SEQ ID NO: 155080 - RNA, 18 nt, Human
caaaaacacaaacaaaac

SEQ ID NO: 155081 - RNA, 22 nt, Human
caaaaacacaaacaaaaccacu

SEQ ID NO: 155082 - RNA, 21 nt, Human
caaaaauguacaacucaggug

SEQ ID NO: 155083 - RNA, 19 nt, Human
caaaacaaaacaauccccc

SEQ ID NO: 155084 - RNA, 23 nt, Human
caaaacaaaacaaucccccaaau

SEQ ID NO: 155085 - RNA, 18 nt, Human
caaaacaaccaccaaaac

SEQ ID NO: 155086 - RNA, 22 nt, Human
caaaacaaccaccaaaacaaag

SEQ ID NO: 155087 - RNA, 22 nt, Human
caaacaaacaaaccccaaagaa

SEQ ID NO: 155088 - RNA, 24 nt, Human
caaaccccaaagaacccccgaaaa

SEQ ID NO: 155089 - RNA, 18 nt, Human
caaagcaggcaacaaggc

SEQ ID NO: 155090 - RNA, 22 nt, Human
caaccaaaaacacaaacaaaac

SEQ ID NO: 155091 - RNA, 25 nt, Human
caaccaaaaacacaaacaaaaccac

SEQ ID NO: 155092 - RNA, 20 nt, Human
cacagcuaagucucaaaccc

SEQ ID NO: 155093 - RNA, 22 nt, Human
caccaaaacaaaacaauccccc

SEQ ID NO: 155094 - RNA, 24 nt, Human
cacggaguggggaacagcuguucu

SEQ ID NO: 155095 - RNA, 20 nt, Human
cacucuggaaaagaagcaaa

SEQ ID NO: 155096 - RNA, 24 nt, Human
cagaaucaagaguugaggcacugg

SEQ ID NO: 155097 - RNA, 19 nt, Human
cagcaggggagggguagcu

SEQ ID NO: 155098 - RNA, 19 nt, Human
cagcuagaagagcuuucca

SEQ ID NO: 155099 - RNA, 21 nt, Human
cauacgaggaacaguguaguc

SEQ ID NO: 155100 - RNA, 23 nt, Human
ccaaaacaaaacaaucccccaaa

SEQ ID NO: 155101 - RNA, 21 nt, Human
ccaauauaauacagcaaugag

SEQ ID NO: 155102 - RNA, 20 nt, Human
ccagagacagcuuggguucu

SEQ ID NO: 155103 - RNA, 21 nt, Human
ccaugaauagaaaagcaguuc

SEQ ID NO: 155104 - RNA, 23 nt, Human
cccaaagaacccccgaaaaaaac

SEQ ID NO: 155105 - RNA, 25 nt, Human
cccaaaucagggcaaaaccgggguc

SEQ ID NO: 155106 - RNA, 19 nt, Human
ccccaaaucagggcaaaac

SEQ ID NO: 155107 - RNA, 21 nt, Human
cccccaaaucagggcaaaaca

SEQ ID NO: 155108 - RNA, 22 nt, Human
cccccaaaucagggcaaaacaa

SEQ ID NO: 155109 - RNA, 20 nt, Human
cccccgaaaaaaacaaaaac

SEQ ID NO: 155110 - RNA, 19 nt, Human
cccccuuuuucuagacaag

SEQ ID NO: 155111 - RNA, 20 nt, Human
ccccgaaaaaaacaaaaacc

SEQ ID NO: 155112 - RNA, 24 nt, Human
ccuccccaacuuagccuacucacu

SEQ ID NO: 155113 - RNA, 20 nt, Human
ccucccuguucccacucccc

SEQ ID NO: 155114 - RNA, 20 nt, Human
ccugggcgaaaggcugggcc

SEQ ID NO: 155115 - RNA, 23 nt, Human
ccuucuauguaaaggccauuuag

SEQ ID NO: 155116 - RNA, 21 nt, Human
ccuucuccuaaaauaaaaguc

SEQ ID NO: 155117 - RNA, 28 nt, Human
cgcaggcgcgcucacgcacgcgcgcagu

SEQ ID NO: 155118 - RNA, 23 nt, Human
cgcgcucacgcacgcgcgcagcg

SEQ ID NO: 155119 - RNA, 22 nt, Human
cggcccugcgcagggugaaagu

SEQ ID NO: 155120 - RNA, 20 nt, Human
cuagcacuguugcuuaccug

SEQ ID NO: 155121 - RNA, 19 nt, Human
cuccuccccuugcagcggc

SEQ ID NO: 155122 - RNA, 23 nt, Human
cucuucccagaaaccucaucaga

SEQ ID NO: 155123 - RNA, 23 nt, Human
cuuugagagguuucagcauugag

SEQ ID NO: 155124 - RNA, 22 nt, Human
cuuuuccaauauaauacagcaa

SEQ ID NO: 155125 - RNA, 20 nt, Human
gaaaaaaacaaaaaccaucc

SEQ ID NO: 155126 - RNA, 22 nt, Human
gaaagcacaaagcaggcaacaa

SEQ ID NO: 155127 - RNA, 19 nt, Human
gaaauggaaauugucauca

SEQ ID NO: 155128 - RNA, 22 nt, Human
gaacaaccaaaaacacaaacaa

SEQ ID NO: 155129 - RNA, 18 nt, Human
gagaacacggagugggga

SEQ ID NO: 155130 - RNA, 22 nt, Human
gagagggcauguuagugaacac

SEQ ID NO: 155131 - RNA, 20 nt, Human
gagcacagaauucuaccagc

SEQ ID NO: 155132 - RNA, 18 nt, Human
gauuuaaagaaaaaggaa

SEQ ID NO: 155133 - RNA, 23 nt, Human
gcaaacaaacaaaccccaaagaa

SEQ ID NO: 155134 - RNA, 23 nt, Human
gcaaagccccucucaagcugcag

SEQ ID NO: 155135 - RNA, 20 nt, Human
gccgggugguucccaagagu

SEQ ID NO: 155136 - RNA, 20 nt, Human
gccgggugguucccaagagu

SEQ ID NO: 155137 - RNA, 19 nt, Human
gccugggcgaaaggcuggg

SEQ ID NO: 155138 - RNA, 20 nt, Human
gcuaauuaaggcccaaucua

SEQ ID NO: 155139 - RNA, 27 nt, Human
gcugcagugucuucauaaguugcacgg

SEQ ID NO: 155140 - RNA, 21 nt, Human
gcugcccugcacacuucaaaa

SEQ ID NO: 155141 - RNA, 24 nt, Human
gcuuggcaggaugcauacggcccu

SEQ ID NO: 155142 - RNA, 19 nt, Human
ggccaaggggaagccucag

SEQ ID NO: 155143 - RNA, 19 nt, Human
gggaagccucagcaaagcc

SEQ ID NO: 155144 - RNA, 24 nt, Human
gggcaaaacaaaauacugucaaaa

SEQ ID NO: 155145 - RNA, 24 nt, Human
gggggaaaagggauccuccugagg

SEQ ID NO: 155146 - RNA, 25 nt, Human
gggugguucccaagaguagccaugg

SEQ ID NO: 155147 - RNA, 19 nt, Human
guaaagaaaggaaaaccaa

SEQ ID NO: 155148 - RNA, 19 nt, Human
gugcagaaagcacaaagca

SEQ ID NO: 155149 - RNA, 23 nt, Human
uaaaauaaaagucauccacacuc

SEQ ID NO: 155150 - RNA, 24 nt, Human
uaaaauaaaagucauccacacuca

SEQ ID NO: 155151 - RNA, 25 nt, Human
uaaagaaaaaggaaaacaaaacaaa

SEQ ID NO: 155152 - RNA, 20 nt, Human
uaaagugcaccccuuauccc

SEQ ID NO: 155153 - RNA, 30 nt, Human
uaaauccauucaaaaaaaaaaaaaaaaaaa

SEQ ID NO: 155154 - RNA, 24 nt, Human
uaaaucucuagccagcugggggua

SEQ ID NO: 155155 - RNA, 24 nt, Human
uaccugucaguaucacagcuaagu

SEQ ID NO: 155156 - RNA, 19 nt, Human
uaggaacaaccaaaaacac

SEQ ID NO: 155157 - RNA, 19 nt, Human
uagguuaagaaagcuauaa

SEQ ID NO: 155158 - RNA, 18 nt, Human
uauaaagugcaccccuua

SEQ ID NO: 155159 - RNA, 19 nt, Human
uaugguuuagaaagagucc

SEQ ID NO: 155160 - RNA, 24 nt, Human
uaugguuuagaaagaguccuuuga

SEQ ID NO: 155161 - RNA, 24 nt, Human
uauuucagauucagcuagaagagc

SEQ ID NO: 155162 - RNA, 22 nt, Human
ucaaaaaaaaaaaaaaaaaaaa

SEQ ID NO: 155163 - RNA, 22 nt, Human
ucaccaggugaccagguuucca

SEQ ID NO: 155164 - RNA, 19 nt, Human
uccaaaacaaccaccaaaa

SEQ ID NO: 155165 - RNA, 22 nt, Human
uccaaaacaaccaccaaaacaa

SEQ ID NO: 155166 - RNA, 25 nt, Human
uccaaaacaaccaccaaaacaaaac

SEQ ID NO: 155167 - RNA, 18 nt, Human
ucccuguucccacucccc

SEQ ID NO: 155168 - RNA, 19 nt, Human
uccgcgcaccagcggcugg

SEQ ID NO: 155169 - RNA, 21 nt, Human
uccuucacauacgaggaacag

SEQ ID NO: 155170 - RNA, 22 nt, Human
uccuucacauacgaggaacagu

SEQ ID NO: 155171 - RNA, 22 nt, Human
ucuacagguuuaccaccuuugu

SEQ ID NO: 155172 - RNA, 26 nt, Human
ucuggaaaagaagcaaacaaacaaac

SEQ ID NO: 155173 - RNA, 20 nt, Human
ugaaauggaaauugucauca

SEQ ID NO: 155174 - RNA, 22 nt, Human
ugagaacacggaguggggaaca

SEQ ID NO: 155175 - RNA, 18 nt, Human
ugaggcggccgcucuccu

SEQ ID NO: 155176 - RNA, 21 nt, Human
ugaucucuucccagaaaccuc

SEQ ID NO: 155177 - RNA, 23 nt, Human
ugcacggcccuggcuaaagacac

SEQ ID NO: 155178 - RNA, 18 nt, Human
ugcacuguagacuuucca

SEQ ID NO: 155179 - RNA, 24 nt, Human
ugcacuguagacuuuccacacucu

SEQ ID NO: 155180 - RNA, 24 nt, Human
ugccugaaugggaacugcuagcuc

SEQ ID NO: 155181 - RNA, 23 nt, Human
ugggcgccugggcgaaaggcugg

SEQ ID NO: 155182 - RNA, 21 nt, Human
uggggaacagcuguucugacu

SEQ ID NO: 155183 - RNA, 19 nt, Human
ugucacggggagcacagaa

SEQ ID NO: 155184 - RNA, 24 nt, Human
ugucuggugcagaaagcacaaagg

SEQ ID NO: 155185 - RNA, 19 nt, Human
uuaggaacaaccaaaaaca

SEQ ID NO: 155186 - RNA, 23 nt, Human
uuauaaacuguuuuuccaaaaca

SEQ ID NO: 155187 - RNA, 25 nt, Human
uucaaaaaaaaaaaaaaaaaaaauc

SEQ ID NO: 155188 - RNA, 21 nt, Human
uuccagagagggcauguuagu

SEQ ID NO: 155189 - RNA, 19 nt, Human
uuccauagcuauaaagugc

SEQ ID NO: 155190 - RNA, 18 nt, Human
uugggaagagaaaggggg

SEQ ID NO: 155191 - RNA, 24 nt, Human
uuguuuuuuguuuuucguuuuuuu

SEQ ID NO: 155192 - RNA, 21 nt, Human
uuuaagauguauuuuuaaccc

SEQ ID NO: 155193 - RNA, 19 nt, Human
uuucuuuuuaaaaaaaggc

SEQ ID NO: 155194 - RNA, 22 nt, Human
aaaaacaaaaacaccaugauac

SEQ ID NO: 155195 - RNA, 28 nt, Human
aaaacaaaaacaaaaacaaaaacaccau

SEQ ID NO: 155196 - RNA, 22 nt, Human
aaacaaaaacaaaaacaccaug

SEQ ID NO: 155197 - RNA, 19 nt, Human
aacaucagaugucuucccc

SEQ ID NO: 155198 - RNA, 18 nt, Human
acaaaaacaaaaacaaaa

SEQ ID NO: 155199 - RNA, 23 nt, Human
agaugaacgaugaagagucaaac

SEQ ID NO: 155200 - RNA, 20 nt, Human
aguaacaggaacagaccuga

SEQ ID NO: 155201 - RNA, 19 nt, Human
caaaaacaccaugauacua

SEQ ID NO: 155202 - RNA, 21 nt, Human
caacaguaacaggaacagacc

SEQ ID NO: 155203 - RNA, 19 nt, Human
cagaugucuuccccuagau

SEQ ID NO: 155204 - RNA, 23 nt, Human
caggaaaaagaggaaccugaacc

SEQ ID NO: 155205 - RNA, 18 nt, Human
caggaacagaccugaucc

SEQ ID NO: 155206 - RNA, 23 nt, Human
ccaaaucagaaggaaacgugaca

SEQ ID NO: 155207 - RNA, 25 nt, Human
ccaacaguaacaggaacagaccuga

SEQ ID NO: 155208 - RNA, 21 nt, Human
ccaagacccaacaguaacagg

SEQ ID NO: 155209 - RNA, 28 nt, Human
cguggcaggaaaaagaggaaccugaacc

SEQ ID NO: 155210 - RNA, 22 nt, Human
ggcaggaaaaagaggaaccuga

SEQ ID NO: 155211 - RNA, 22 nt, Human
gucacacuuccagcaauccugg

SEQ ID NO: 155212 - RNA, 20 nt, Human
guggcaggaaaaagaggaac

SEQ ID NO: 155213 - RNA, 27 nt, Human
uaaaacaaaaacaaaaacaaaaacacc

SEQ ID NO: 155214 - RNA, 20 nt, Human
uaacaggaacagaccugauc

SEQ ID NO: 155215 - RNA, 22 nt, Human
uaacaggaacagaccugaucca

SEQ ID NO: 155216 - RNA, 20 nt, Human
uccagggucccucuuggucu

SEQ ID NO: 155217 - RNA, 19 nt, Human
ugacauggagucccaggcu

SEQ ID NO: 155218 - RNA, 21 nt, Human
ugacauggagucccaggcucg

SEQ ID NO: 155219 - RNA, 20 nt, Human
ugaccagcugggcuugccgc

SEQ ID NO: 155220 - RNA, 19 nt, Human
ugagauuugcaaaaaauau

SEQ ID NO: 155221 - RNA, 19 nt, Human
uggcaggaaaaagaggaac

SEQ ID NO: 155222 - RNA, 23 nt, Human
uggugggcagggguucccugggc

SEQ ID NO: 155223 - RNA, 25 nt, Human
uuaaaacaaaaacaaaaacaaaaac

SEQ ID NO: 155224 - RNA, 18 nt, Human
uuuccacucuccucagcc

SEQ ID NO: 155225 - RNA, 23 nt, Human
aaaacaacaaaaaucuaucaccu

SEQ ID NO: 155226 - RNA, 22 nt, Human
aaaaggcagaaugagacagaua

SEQ ID NO: 155227 - RNA, 20 nt, Human
aaacaacaaaaaucuaucac

SEQ ID NO: 155228 - RNA, 27 nt, Human
aaacaacaaaaaucuaucaccuggaau

SEQ ID NO: 155229 - RNA, 23 nt, Human
aacccagccuuggccccagagac

SEQ ID NO: 155230 - RNA, 19 nt, Human
aacugguuggaaaacgggu

SEQ ID NO: 155231 - RNA, 23 nt, Human
aagaaaagugacaagugauucau

SEQ ID NO: 155232 - RNA, 23 nt, Human
aagaaauucaguaaaacaagaug

SEQ ID NO: 155233 - RNA, 18 nt, Human
aaggaggagcuauccaua

SEQ ID NO: 155234 - RNA, 21 nt, Human
aagugauucauccugcaaugg

SEQ ID NO: 155235 - RNA, 18 nt, Human
aaugugggaaggaaagag

SEQ ID NO: 155236 - RNA, 30 nt, Human
acaaaacaacaaaaaucuaucaccuggaag

SEQ ID NO: 155237 - RNA, 23 nt, Human
acaacaaaaaucuaucaccugga

SEQ ID NO: 155238 - RNA, 23 nt, Human
acaggcccauauuaccccuugac

SEQ ID NO: 155239 - RNA, 23 nt, Human
accccgaagccacaaauaaccuu

SEQ ID NO: 155240 - RNA, 19 nt, Human
accuauuugugaaccuuac

SEQ ID NO: 155241 - RNA, 25 nt, Human
accuuaauaaugaggcuguguauga

SEQ ID NO: 155242 - RNA, 21 nt, Human
acugcucaugaaagacccaca

SEQ ID NO: 155243 - RNA, 22 nt, Human
agaaacaccgaggaggcuuagc

SEQ ID NO: 155244 - RNA, 27 nt, Human
agaaagcugaagaaagaaaucaaccua

SEQ ID NO: 155245 - RNA, 18 nt, Human
agacagauauguaaugaa

SEQ ID NO: 155246 - RNA, 23 nt, Human
agaguccagcuucuuaaucuuuu

SEQ ID NO: 155247 - RNA, 24 nt, Human
aguaguaauaaauauaaccccgaa

SEQ ID NO: 155248 - RNA, 19 nt, Human
agucgauuaaaaacugaaa

SEQ ID NO: 155249 - RNA, 18 nt, Human
agugucuuaagggcaaaa

SEQ ID NO: 155250 - RNA, 22 nt, Human
auaaauauaaccccgaagccac

SEQ ID NO: 155251 - RNA, 22 nt, Human
auaccaaagucuuccuccccca

SEQ ID NO: 155252 - RNA, 20 nt, Human
augagcauagacuuugcucu

SEQ ID NO: 155253 - RNA, 20 nt, Human
auugcacuuuaaaacuuugc

SEQ ID NO: 155254 - RNA, 24 nt, Human
caaaacaacaaaaaucuaucaccu

SEQ ID NO: 155255 - RNA, 21 nt, Human
caaagucuuccucccccaaaa

SEQ ID NO: 155256 - RNA, 21 nt, Human
cacugugcuggcuccagaggg

SEQ ID NO: 155257 - RNA, 23 nt, Human
cagaaagcugaagaaagaaauca

SEQ ID NO: 155258 - RNA, 20 nt, Human
cagccuuggccccagagacc

SEQ ID NO: 155259 - RNA, 24 nt, Human
caguaaaacaagaugugucucaua

SEQ ID NO: 155260 - RNA, 22 nt, Human
ccaaagucuuccucccccaaaa

SEQ ID NO: 155261 - RNA, 23 nt, Human
ccagcacagaagaaaagugacaa

SEQ ID NO: 155262 - RNA, 18 nt, Human
ccagucgauuaaaaacug

SEQ ID NO: 155263 - RNA, 20 nt, Human
ccccaaaauaaacaagugaa

SEQ ID NO: 155264 - RNA, 23 nt, Human
ccccagagaccggacggggcaga

SEQ ID NO: 155265 - RNA, 19 nt, Human
ccgaagccacaaauaaccu

SEQ ID NO: 155266 - RNA, 19 nt, Human
cgggaggagcaagcaccgc

SEQ ID NO: 155267 - RNA, 21 nt, Human
cuccaacacccugccaaggcc

SEQ ID NO: 155268 - RNA, 21 nt, Human
cugccaaucuuuucauaucua

SEQ ID NO: 155269 - RNA, 19 nt, Human
cuggaaaagccaaagaaaa

SEQ ID NO: 155270 - RNA, 19 nt, Human
cuuggaaaucaucucagcu

SEQ ID NO: 155271 - RNA, 24 nt, Human
cuuugcucuguuguuauagaucau

SEQ ID NO: 155272 - RNA, 25 nt, Human
gaaaaaauuuacacucugaaauuaa

SEQ ID NO: 155273 - RNA, 21 nt, Human
gaaaauaucaaucuguaaaga

SEQ ID NO: 155274 - RNA, 20 nt, Human
gaaacaccuaacagccauaa

SEQ ID NO: 155275 - RNA, 21 nt, Human
gaaacaccuaacagccauaaa

SEQ ID NO: 155276 - RNA, 20 nt, Human
gaauuaaaaaagaaaaaaag

SEQ ID NO: 155277 - RNA, 20 nt, Human
gaauugggggggaaacauag

SEQ ID NO: 155278 - RNA, 23 nt, Human
gagacauaaaaauaaaaauguca

SEQ ID NO: 155279 - RNA, 21 nt, Human
gagcaagcaccgcguuuuccc

SEQ ID NO: 155280 - RNA, 18 nt, Human
gaguuccucaccugugcc

SEQ ID NO: 155281 - RNA, 20 nt, Human
gcacagaagaaaagugacaa

SEQ ID NO: 155282 - RNA, 18 nt, Human
gcaguagaguccagcuuc

SEQ ID NO: 155283 - RNA, 20 nt, Human
gcaguagaguccagcuucuu

SEQ ID NO: 155284 - RNA, 24 nt, Human
gcugcagaacugguuggaaaacgg

SEQ ID NO: 155285 - RNA, 23 nt, Human
ggaaaaacuguccauacauuuuu

SEQ ID NO: 155286 - RNA, 24 nt, Human
gggguguugcuugucuagaaucua

SEQ ID NO: 155287 - RNA, 20 nt, Human
uaaaacaagaugugucucau

SEQ ID NO: 155288 - RNA, 23 nt, Human
uaaauauaaccccgaagccacaa

SEQ ID NO: 155289 - RNA, 21 nt, Human
uaacaaaacaacaaaaaucua

SEQ ID NO: 155290 - RNA, 22 nt, Human
uaacuucaagaaauacuagggu

SEQ ID NO: 155291 - RNA, 20 nt, Human
uaaggagagacauaaaaaua

SEQ ID NO: 155292 - RNA, 23 nt, Human
uaccaaagucuuccucccccaaa

SEQ ID NO: 155293 - RNA, 18 nt, Human
uagaauuaaaaaagaaaa

SEQ ID NO: 155294 - RNA, 19 nt, Human
uagacaguauaaaaggcag

SEQ ID NO: 155295 - RNA, 20 nt, Human
ucagaaagcugaagaaagaa

SEQ ID NO: 155296 - RNA, 24 nt, Human
ucagaaagcugaagaaagaaauca

SEQ ID NO: 155297 - RNA, 25 nt, Human
ucaguaaaacaagaugugucucaua

SEQ ID NO: 155298 - RNA, 21 nt, Human
uccaacacccugccaaggcca

SEQ ID NO: 155299 - RNA, 23 nt, Human
ucuaccaguaugggggaaaaaaa

SEQ ID NO: 155300 - RNA, 24 nt, Human
ucucucagcuuuaauggcaguaga

SEQ ID NO: 155301 - RNA, 19 nt, Human
ucuuggaaaucaucucagc

SEQ ID NO: 155302 - RNA, 21 nt, Human
ugaagaaaaaauauaaaaugu

SEQ ID NO: 155303 - RNA, 18 nt, Human
ugaagaaagaaaucaacc

SEQ ID NO: 155304 - RNA, 28 nt, Human
ugcuccauaccaaagucuuccuccccca

SEQ ID NO: 155305 - RNA, 19 nt, Human
uggaaaagccaaagaaaag

SEQ ID NO: 155306 - RNA, 19 nt, Human
uggaaaucaucucagcuuc

SEQ ID NO: 155307 - RNA, 19 nt, Human
ugggaaacaccuaacagcc

SEQ ID NO: 155308 - RNA, 18 nt, Human
ugguuggaaaacggguca

SEQ ID NO: 155309 - RNA, 23 nt, Human
ugucagaaagcugaagaaagaaa

SEQ ID NO: 155310 - RNA, 25 nt, Human
ugugcuggcuccagagggguguugc

SEQ ID NO: 155311 - RNA, 20 nt, Human
uguuaaucagaaacaccgag

SEQ ID NO: 155312 - RNA, 24 nt, Human
uuaauggcaguagaguccagcuuc

SEQ ID NO: 155313 - RNA, 21 nt, Human
uuacauaguguuuaaagcaua

SEQ ID NO: 155314 - RNA, 23 nt, Human
uuagaugcuuucuauccuuugaa

SEQ ID NO: 155315 - RNA, 22 nt, Human
uuccauuuaaaguaguuuuggu

SEQ ID NO: 155316 - RNA, 21 nt, Human
uugaguuccucaccugugccu

SEQ ID NO: 155317 - RNA, 20 nt, Human
uuugguauuucuuugcucca

SEQ ID NO: 155318 - RNA, 20 nt, Human
uuuuuuuuuuuuuuuauaac

SEQ ID NO: 155319 - RNA, 18 nt, Human
uuuuuuuuuuuuuuuuug

SEQ ID NO: 155320 - RNA, 23 nt, Human
uuuuuuuuuuuuuuuuuugauuu

SEQ ID NO: 155321 - RNA, 22 nt, Human
ccagggcggcgacgcgggacuu

SEQ ID NO: 155322 - RNA, 22 nt, Human
ccccgccgcaucccgccgccug

SEQ ID NO: 155323 - RNA, 32 nt, Human
ccgcaucccgccgccugcugcaccgucccccc

SEQ ID NO: 155324 - RNA, 23 nt, Human
ccgccccgccgcaucccgccgcc

SEQ ID NO: 155325 - RNA, 25 nt, Human
ccgccccgccgcaucccgccgccuc

SEQ ID NO: 155326 - RNA, 18 nt, Human
ccgccgcaucccgccgcc

SEQ ID NO: 155327 - RNA, 20 nt, Human
ccugcuucucuccccuuccc

SEQ ID NO: 155328 - RNA, 24 nt, Human
cggcgacgcgggacuuggagcccg

SEQ ID NO: 155329 - RNA, 19 nt, Human
cugcaccguccccgccagg

SEQ ID NO: 155330 - RNA, 25 nt, Human
cuucccugcuucgccgagccggagg

SEQ ID NO: 155331 - RNA, 19 nt, Human
gacuccugcuucucucccc

SEQ ID NO: 155332 - RNA, 22 nt, Human
gacuuucuggccugugcagucu

SEQ ID NO: 155333 - RNA, 18 nt, Human
gcaucccgccgccugcug

SEQ ID NO: 155334 - RNA, 19 nt, Human
gcgacgcgggacuuggagc

SEQ ID NO: 155335 - RNA, 23 nt, Human
ggcgcucaggcugccgccccgcc

SEQ ID NO: 155336 - RNA, 18 nt, Human
ugccgccccgccgcaucc

SEQ ID NO: 155337 - RNA, 19 nt, Human
uucccugcuucgccgagcc

SEQ ID NO: 155338 - RNA, 19 nt, Human
aaacaaaaguacacaguuu

SEQ ID NO: 155339 - RNA, 22 nt, Human
aacugacuucauuuuuacucca

SEQ ID NO: 155340 - RNA, 20 nt, Human
accaaaccacagaugacaca

SEQ ID NO: 155341 - RNA, 19 nt, Human
agccuuaaaguaaaucugc

SEQ ID NO: 155342 - RNA, 21 nt, Human
auccagcaaggaagauaccau

SEQ ID NO: 155343 - RNA, 19 nt, Human
caaaccacagaugacacau

SEQ ID NO: 155344 - RNA, 22 nt, Human
cacaguuuagcucucucuaucu

SEQ ID NO: 155345 - RNA, 20 nt, Human
cacuuuuaaaaaccaaacca

SEQ ID NO: 155346 - RNA, 18 nt, Human
cugguguggauucugcca

SEQ ID NO: 155347 - RNA, 20 nt, Human
cuuuuaaaaaccaaaccaca

SEQ ID NO: 155348 - RNA, 24 nt, Human
gauaaucagaacaacacuuuggga

SEQ ID NO: 155349 - RNA, 23 nt, Human
uaaaaaccaaaccacagaugaca

SEQ ID NO: 155350 - RNA, 23 nt, Human
uaaaauuuuccucaaaugcuuag

SEQ ID NO: 155351 - RNA, 21 nt, Human
uaaggacacacuaaaacuagu

SEQ ID NO: 155352 - RNA, 21 nt, Human
uaauaguagaaaaacacuuuc

SEQ ID NO: 155353 - RNA, 20 nt, Human
uacacaguuuaaauaauuaa

SEQ ID NO: 155354 - RNA, 19 nt, Human
uacuccauaagccuucuca

SEQ ID NO: 155355 - RNA, 21 nt, Human
uaugcauuaggaauuugacuu

SEQ ID NO: 155356 - RNA, 23 nt, Human
ucaaaaucugauuauaacgugau

SEQ ID NO: 155357 - RNA, 26 nt, Human
ucauuuuuacuccauaagccuucuca

SEQ ID NO: 155358 - RNA, 20 nt, Human
uccauaagccuucucauugc

SEQ ID NO: 155359 - RNA, 21 nt, Human
ugggauuaaauaccaacugac

SEQ ID NO: 155360 - RNA, 23 nt, Human
uguguugguugauaagcuggugu

SEQ ID NO: 155361 - RNA, 24 nt, Human
uuaaaauuuuccucaaaugcuuag

SEQ ID NO: 155362 - RNA, 22 nt, Human
uuuaauuaucccuugcuaucuc

SEQ ID NO: 155363 - RNA, 27 nt, Human
uuuccacuuuuaaaaaccaaaccacag

SEQ ID NO: 155364 - RNA, 24 nt, Human
agauaguuccugaauaaaaaucaa

SEQ ID NO: 155365 - RNA, 22 nt, Human
aggauggaagaucagcuaaaaa

SEQ ID NO: 155366 - RNA, 19 nt, Human
aucucagcuguuaacuucu

SEQ ID NO: 155367 - RNA, 22 nt, Human
auguaaaauguacuauacuuua

SEQ ID NO: 155368 - RNA, 21 nt, Human
cagcuaaaaagcaaguuguaa

SEQ ID NO: 155369 - RNA, 23 nt, Human
cauauaaagaaaaaagagucauu

SEQ ID NO: 155370 - RNA, 20 nt, Human
uaaaaagcaaguuguaauau

SEQ ID NO: 155371 - RNA, 24 nt, Human
uaaauagauuacuguuaaauaacu

SEQ ID NO: 155372 - RNA, 24 nt, Human
uaacauauaaagaaaaaagaguca

SEQ ID NO: 155373 - RNA, 20 nt, Human
uacuauaauuaguaaauaga

SEQ ID NO: 155374 - RNA, 20 nt, Human
uauguagauuguuucagagu

SEQ ID NO: 155375 - RNA, 25 nt, Human
ugaaauggaaacauaaaaguuuauu

SEQ ID NO: 155376 - RNA, 28 nt, Human
ugaggauggaagaucagcuccgagggug

SEQ ID NO: 155377 - RNA, 18 nt, Human
uuagucucuuauuccucu

SEQ ID NO: 155378 - RNA, 19 nt, Human
uucaggggaaaaaaaacug

SEQ ID NO: 155379 - RNA, 22 nt, Human
uucccacaaacuuggaauauuu

SEQ ID NO: 155380 - RNA, 24 nt, Human
uuccucguuaucucagcuguuaac

SEQ ID NO: 155381 - RNA, 25 nt, Human
uucuuguucuaacuggacauuuugg

SEQ ID NO: 155382 - RNA, 26 nt, Human
uucuuguucuaacuggacauuuuggu

SEQ ID NO: 155383 - RNA, 25 nt, Human
acacacgcacuuccccacuggcucc

SEQ ID NO: 155384 - RNA, 25 nt, Human
acacgcacuuccccacuggcuccuu

SEQ ID NO: 155385 - RNA, 18 nt, Human
aggcaagugcuggcucag

SEQ ID NO: 155386 - RNA, 19 nt, Human
cacuggguggagguggagg

SEQ ID NO: 155387 - RNA, 18 nt, Human
caggugggaggcagcggg

SEQ ID NO: 155388 - RNA, 24 nt, Human
ccaagguuaggggagggagcccau

SEQ ID NO: 155389 - RNA, 21 nt, Human
ccccacuggcuccuuggcccg

SEQ ID NO: 155390 - RNA, 21 nt, Human
cugccugggaugaggcugcuc

SEQ ID NO: 155391 - RNA, 19 nt, Human
ggacagagggaagacccac

SEQ ID NO: 155392 - RNA, 22 nt, Human
ggcaccaagguuaggggaggga

SEQ ID NO: 155393 - RNA, 18 nt, Human
gggcaggugggaggcagc

SEQ ID NO: 155394 - RNA, 23 nt, Human
ggggagggagcccaucaccaugu

SEQ ID NO: 155395 - RNA, 21 nt, Human
uaaaacagugguuggacagag

SEQ ID NO: 155396 - RNA, 21 nt, Human
uauugggaucacuggguggag

SEQ ID NO: 155397 - RNA, 19 nt, Human
ucacuggguggagguggag

SEQ ID NO: 155398 - RNA, 23 nt, Human
ucacuggguggagguggaggaag

SEQ ID NO: 155399 - RNA, 19 nt, Human
uccuggucuggggauggau

SEQ ID NO: 155400 - RNA, 21 nt, Human
ucuggggauggaucaggcacc

SEQ ID NO: 155401 - RNA, 24 nt, Human
ugaggcaagagguguacguauccu

SEQ ID NO: 155402 - RNA, 23 nt, Human
uggaggaagaacugaguggcugc

SEQ ID NO: 155403 - RNA, 19 nt, Human
uggcccaacacacgcacuu

SEQ ID NO: 155404 - RNA, 24 nt, Human
uggcgaaagacggcaggagggcag

SEQ ID NO: 155405 - RNA, 19 nt, Human
accccggcucccugggucu

SEQ ID NO: 155406 - RNA, 22 nt, Human
accccggcucccugggucucca

SEQ ID NO: 155407 - RNA, 22 nt, Human
aggcgaggcuggcugagucccg

SEQ ID NO: 155408 - RNA, 19 nt, Human
aggcuggcugagucccggg

SEQ ID NO: 155409 - RNA, 18 nt, Human
cccucuccuuucccccuu

SEQ ID NO: 155410 - RNA, 19 nt, Human
cccugggucuccagcggcc

SEQ ID NO: 155411 - RNA, 22 nt, Human
cccuuggcguccuaggggcgag

SEQ ID NO: 155412 - RNA, 19 nt, Human
ccuaaccccggcucccugg

SEQ ID NO: 155413 - RNA, 18 nt, Human
ccucuccuuucccccuug

SEQ ID NO: 155414 - RNA, 19 nt, Human
ccucugugccgcaccgccu

SEQ ID NO: 155415 - RNA, 19 nt, Human
ccuuucccccuuggcgucc

SEQ ID NO: 155416 - RNA, 22 nt, Human
cgcgaccgcggcgguggcggug

SEQ ID NO: 155417 - RNA, 24 nt, Human
cucuccuuucccccuuggcguccu

SEQ ID NO: 155418 - RNA, 21 nt, Human
gaccgcggcgguggcgguggg

SEQ ID NO: 155419 - RNA, 18 nt, Human
gccggcagccaccagccc

SEQ ID NO: 155420 - RNA, 22 nt, Human
gggcgucuggagcgcgaccgcg

SEQ ID NO: 155421 - RNA, 21 nt, Human
ggugccugggagggcgcggag

SEQ ID NO: 155422 - RNA, 20 nt, Human
guccuuuuccgcccucuccu

SEQ ID NO: 155423 - RNA, 19 nt, Human
ugccugggagggcgcggag

SEQ ID NO: 155424 - RNA, 20 nt, Human
uggcggugggagcuaggguc

SEQ ID NO: 155425 - RNA, 24 nt, Human
uggcggugggagcuagggucaccu

SEQ ID NO: 155426 - RNA, 21 nt, Human
ugggagggcgcggagcugcug

SEQ ID NO: 155427 - RNA, 22 nt, Human
ugggagggcgcggagcugcugg

SEQ ID NO: 155428 - RNA, 24 nt, Human
ugggagggcgcggagcugcuggag

SEQ ID NO: 155429 - RNA, 24 nt, Human
uuccuaaccccggcucccuggguc

SEQ ID NO: 155430 - RNA, 24 nt, Human
aaaaaaaaaaaaaaaacaucacaa

SEQ ID NO: 155431 - RNA, 25 nt, Human
aaaaaaaaaaaacaucacaaccaug

SEQ ID NO: 155432 - RNA, 20 nt, Human
aaaaacaucacaaccaugaa

SEQ ID NO: 155433 - RNA, 18 nt, Human
aaacaucacaaccaugaa

SEQ ID NO: 155434 - RNA, 20 nt, Human
aaauacuaaaguacagacaa

SEQ ID NO: 155435 - RNA, 23 nt, Human
aauggugaaaaauacuaaaguac

SEQ ID NO: 155436 - RNA, 23 nt, Human
agggguucccauuguuaaagucu

SEQ ID NO: 155437 - RNA, 24 nt, Human
auuuuuaaaagaaggaagaaaaaa

SEQ ID NO: 155438 - RNA, 22 nt, Human
cacaaauggugaaaaauacuaa

SEQ ID NO: 155439 - RNA, 19 nt, Human
cauuuuuaaaagaaggaag

SEQ ID NO: 155440 - RNA, 18 nt, Human
gaaggaagaaaaaaaaac

SEQ ID NO: 155441 - RNA, 24 nt, Human
uaaaacauuuucugguuuaaaaaa

SEQ ID NO: 155442 - RNA, 19 nt, Human
uaagaggcccucuugguuc

SEQ ID NO: 155443 - RNA, 19 nt, Human
uauggaauuauaaauuuaa

SEQ ID NO: 155444 - RNA, 22 nt, Human
ucuccuuccuccucguucucuc

SEQ ID NO: 155445 - RNA, 22 nt, Human
ucuccuuccuccucguucucuc

SEQ ID NO: 155446 - RNA, 23 nt, Human
ucuuaaacaaccauuuuuaaaag

SEQ ID NO: 155447 - RNA, 27 nt, Human
ugaaaaauacuaaaguacagacaagga

SEQ ID NO: 155448 - RNA, 18 nt, Human
uucuccacaaugauacug

SEQ ID NO: 155449 - RNA, 19 nt, Human
uucuccacaaugauacuga

SEQ ID NO: 155450 - RNA, 24 nt, Human
aagcuuugcagcagucugcauuua

SEQ ID NO: 155451 - RNA, 21 nt, Human
agaaaaaauucuucaugcuga

SEQ ID NO: 155452 - RNA, 21 nt, Human
agaaaaaauucuucaugcuga

SEQ ID NO: 155453 - RNA, 19 nt, Human
cacccacggccggcaacgc

SEQ ID NO: 155454 - RNA, 22 nt, Human
cacuuuaucccucugucucgcg

SEQ ID NO: 155455 - RNA, 22 nt, Human
cacuuuaucccucugucucgcg

SEQ ID NO: 155456 - RNA, 21 nt, Human
ccagacgacacguuuccuuag

SEQ ID NO: 155457 - RNA, 21 nt, Human
ccagacgacacguuuccuuag

SEQ ID NO: 155458 - RNA, 23 nt, Human
cccgcuccgacgccccuaacuca

SEQ ID NO: 155459 - RNA, 22 nt, Human
cgagaagggacucuccuccucc

SEQ ID NO: 155460 - RNA, 24 nt, Human
cggagaugugcaggcguggccccc

SEQ ID NO: 155461 - RNA, 24 nt, Human
cggagaugugcaggcguggccccc

SEQ ID NO: 155462 - RNA, 19 nt, Human
cgguuggagaaacccgcuc

SEQ ID NO: 155463 - RNA, 21 nt, Human
cuaaaaagaguuuucucucac

SEQ ID NO: 155464 - RNA, 21 nt, Human
cuaaaaagaguuuucucucac

SEQ ID NO: 155465 - RNA, 20 nt, Human
cuaaaggcucugguccagcg

SEQ ID NO: 155466 - RNA, 18 nt, Human
cucgagguaacaauaaca

SEQ ID NO: 155467 - RNA, 18 nt, Human
cucgagguaacaauaaca

SEQ ID NO: 155468 - RNA, 21 nt, Human
cucucaacuccacucagugac

SEQ ID NO: 155469 - RNA, 23 nt, Human
cucucaacuccacucagugacug

SEQ ID NO: 155470 - RNA, 27 nt, Human
cugguccagcaguucucaaauuucaga

SEQ ID NO: 155471 - RNA, 21 nt, Human
gcacagaaugagaaaaaauuc

SEQ ID NO: 155472 - RNA, 21 nt, Human
gcacagaaugagaaaaaauuc

SEQ ID NO: 155473 - RNA, 23 nt, Human
ggagaugugcaggcguggccccc

SEQ ID NO: 155474 - RNA, 18 nt, Human
guacauaucucagagauc

SEQ ID NO: 155475 - RNA, 20 nt, Human
guguacauaucucagagauc

SEQ ID NO: 155476 - RNA, 19 nt, Human
guuggauguuaucucugac

SEQ ID NO: 155477 - RNA, 23 nt, Human
uaacaauaacagcaccaucuuca

SEQ ID NO: 155478 - RNA, 23 nt, Human
uaacaauaacagcaccaucuuca

SEQ ID NO: 155479 - RNA, 21 nt, Human
uaacuaccucucagaugauau

SEQ ID NO: 155480 - RNA, 21 nt, Human
ucagagaucgcauguggcacu

SEQ ID NO: 155481 - RNA, 21 nt, Human
ucagaggucgcauguggcacu

SEQ ID NO: 155482 - RNA, 21 nt, Human
ucagguuuguuaaauauaucc

SEQ ID NO: 155483 - RNA, 22 nt, Human
ucuaaaaagaguuuucucucac

SEQ ID NO: 155484 - RNA, 22 nt, Human
ucuaaaaagaguuuucucucac

SEQ ID NO: 155485 - RNA, 19 nt, Human
ucucugacuggggacaggg

SEQ ID NO: 155486 - RNA, 21 nt, Human
ucucugacuggggacaggggu

SEQ ID NO: 155487 - RNA, 24 nt, Human
ucucuugcaggcaaaagcuuugca

SEQ ID NO: 155488 - RNA, 20 nt, Human
ucuucugggccaggcaaaua

SEQ ID NO: 155489 - RNA, 20 nt, Human
ucuucugggccaggcaaaua

SEQ ID NO: 155490 - RNA, 18 nt, Human
ugagcggagccgauugcg

SEQ ID NO: 155491 - RNA, 20 nt, Human
ugagugcgauaguaagaaug

SEQ ID NO: 155492 - RNA, 20 nt, Human
ugagugcgauaguaagaaug

SEQ ID NO: 155493 - RNA, 25 nt, Human
ugcgauaguaagaaugacuguguac

SEQ ID NO: 155494 - RNA, 25 nt, Human
ugcgauaguaagaaugacuguguac

SEQ ID NO: 155495 - RNA, 23 nt, Human
uggcacagaaugagaaaaaauuc

SEQ ID NO: 155496 - RNA, 18 nt, Human
uggccagagcacccacgg

SEQ ID NO: 155497 - RNA, 19 nt, Human
uggcccccaagcccauucc

SEQ ID NO: 155498 - RNA, 19 nt, Human
uggcccccaagcccauucc

SEQ ID NO: 155499 - RNA, 21 nt, Human
ugggauucacuaguucucuca

SEQ ID NO: 155500 - RNA, 24 nt, Human
uggggacagggguuucuucccccg

SEQ ID NO: 155501 - RNA, 18 nt, Human
ugugcaggcguggccccc

SEQ ID NO: 155502 - RNA, 18 nt, Human
ugugcaggcguggccccc

SEQ ID NO: 155503 - RNA, 18 nt, Human
uguggccagagcacccac

SEQ ID NO: 155504 - RNA, 33 nt, Human
uguggccagagcacccacggccggcaacgcccc

SEQ ID NO: 155505 - RNA, 18 nt, Human
uuccuuaggccuuccgag

SEQ ID NO: 155506 - RNA, 26 nt, Human
uucucuugcaggcaaaagcuuugcag

SEQ ID NO: 155507 - RNA, 24 nt, Human
uuuuuuuuuuuuuuuuuuuuaaag

SEQ ID NO: 155508 - RNA, 27 nt, Human
aaacacaagaaucacccaaguuuccca

SEQ ID NO: 155509 - RNA, 25 nt, Human
aacaagacggaggaaaagaaagaga

SEQ ID NO: 155510 - RNA, 23 nt, Human
aaccucacaaaucccugcaucuc

SEQ ID NO: 155511 - RNA, 25 nt, Human
aagaaagagagaggggagaaaaaaa

SEQ ID NO: 155512 - RNA, 19 nt, Human
aagaaucacccaaguuucc

SEQ ID NO: 155513 - RNA, 19 nt, Human
acugggaagagagagcagc

SEQ ID NO: 155514 - RNA, 21 nt, Human
acuuucuccccuucggucuuu

SEQ ID NO: 155515 - RNA, 26 nt, Human
agaagccagugaggugaguuuggagc

SEQ ID NO: 155516 - RNA, 18 nt, Human
agagagcagcuugacccc

SEQ ID NO: 155517 - RNA, 21 nt, Human
agagagcagcuugacccccau

SEQ ID NO: 155518 - RNA, 20 nt, Human
aggaaaagaaagagagaggg

SEQ ID NO: 155519 - RNA, 21 nt, Human
aggcggcggcggcggcggcgc

SEQ ID NO: 155520 - RNA, 23 nt, Human
augcacgggagagagcggggcug

SEQ ID NO: 155521 - RNA, 22 nt, Human
caagaggauuguaaauaaacac

SEQ ID NO: 155522 - RNA, 19 nt, Human
cacaaaucccugcaucucu

SEQ ID NO: 155523 - RNA, 18 nt, Human
cagaagccagugagguga

SEQ ID NO: 155524 - RNA, 18 nt, Human
cagccggcuagugcaucu

SEQ ID NO: 155525 - RNA, 20 nt, Human
cagcuugacccccaucccuu

SEQ ID NO: 155526 - RNA, 25 nt, Human
cagcuugacccccaucccuucuugc

SEQ ID NO: 155527 - RNA, 18 nt, Human
caggagccaggaguugag

SEQ ID NO: 155528 - RNA, 19 nt, Human
cagugccggccccgagcag

SEQ ID NO: 155529 - RNA, 21 nt, Human
cauccaccacucuccgugcag

SEQ ID NO: 155530 - RNA, 20 nt, Human
ccagggcgggcgagcagcgg

SEQ ID NO: 155531 - RNA, 21 nt, Human
ccagggcgggcgagcagcgga

SEQ ID NO: 155532 - RNA, 21 nt, Human
ccaguccgccaucuucccgcc

SEQ ID NO: 155533 - RNA, 25 nt, Human
ccccgagcagcgcuucgcaggcccc

SEQ ID NO: 155534 - RNA, 22 nt, Human
cccgcgcgaacgcugccgaccg

SEQ ID NO: 155535 - RNA, 23 nt, Human
ccggccccgagcagcgcuucgca

SEQ ID NO: 155536 - RNA, 19 nt, Human
ccucucggcagcguggaaa

SEQ ID NO: 155537 - RNA, 23 nt, Human
ccuguaaagacuucaaacucucc

SEQ ID NO: 155538 - RNA, 22 nt, Human
cgcgaacgcugccgaccgccgc

SEQ ID NO: 155539 - RNA, 22 nt, Human
cggcggcggcggcgcugggugg

SEQ ID NO: 155540 - RNA, 29 nt, Human
cggcuggaggcggcggcggcggcggcgac

SEQ ID NO: 155541 - RNA, 25 nt, Human
cgggagagagcggggcugaauagug

SEQ ID NO: 155542 - RNA, 18 nt, Human
cuccgugcagagcacucc

SEQ ID NO: 155543 - RNA, 25 nt, Human
cugcagcggcuccaagacuccggcc

SEQ ID NO: 155544 - RNA, 24 nt, Human
cuuucagcuccaguccgccaucuu

SEQ ID NO: 155545 - RNA, 19 nt, Human
gaaaaugagccccgggaag

SEQ ID NO: 155546 - RNA, 18 nt, Human
gaggggagaaaaaaaaaa

SEQ ID NO: 155547 - RNA, 18 nt, Human
gaguggaucugcacuggg

SEQ ID NO: 155548 - RNA, 18 nt, Human
gcacaaucuggcucugcu

SEQ ID NO: 155549 - RNA, 24 nt, Human
gcagcgcuucgcaggcccccgcgc

SEQ ID NO: 155550 - RNA, 29 nt, Human
gccccgagcagcgcuucgcaggcccccgg

SEQ ID NO: 155551 - RNA, 19 nt, Human
gccccgggaaggcaacuuc

SEQ ID NO: 155552 - RNA, 20 nt, Human
gccccgggaaggcaacuuca

SEQ ID NO: 155553 - RNA, 19 nt, Human
gccggccccgagcagcgcu

SEQ ID NO: 155554 - RNA, 21 nt, Human
gcggcggcgcguccuccccgc

SEQ ID NO: 155555 - RNA, 30 nt, Human
gcggcggcgcuggguggcggcggcggcgac

SEQ ID NO: 155556 - RNA, 27 nt, Human
gcggcggcggcgcuggguggcggcggc

SEQ ID NO: 155557 - RNA, 30 nt, Human
gcggcggcggcggcgcuggguggcggcgac

SEQ ID NO: 155558 - RNA, 18 nt, Human
gcucccgauacccaauca

SEQ ID NO: 155559 - RNA, 20 nt, Human
ggaggcggcggcggcggcgg

SEQ ID NO: 155560 - RNA, 24 nt, Human
ggcggcgcuggguggcggcggcgg

SEQ ID NO: 155561 - RNA, 20 nt, Human
ggcggcggcggcggcggcgc

SEQ ID NO: 155562 - RNA, 22 nt, Human
ggcggcggcggcggcggcgcug

SEQ ID NO: 155563 - RNA, 19 nt, Human
gggacgcgcggcggcccgg

SEQ ID NO: 155564 - RNA, 20 nt, Human
uaaauaaacacaagaaucac

SEQ ID NO: 155565 - RNA, 21 nt, Human
uagugcaucuugcagcugggg

SEQ ID NO: 155566 - RNA, 20 nt, Human
ucauuggccuuuuuuuuuuu

SEQ ID NO: 155567 - RNA, 21 nt, Human
ucauuggccuuuuuuuuuuuu

SEQ ID NO: 155568 - RNA, 30 nt, Human
ucccaccuucucuggaugccuuuccccaag

SEQ ID NO: 155569 - RNA, 18 nt, Human
ucccaggagccaggaguu

SEQ ID NO: 155570 - RNA, 22 nt, Human
uccccaagccguggacugaucc

SEQ ID NO: 155571 - RNA, 21 nt, Human
uccccgcgggcagugccggcc

SEQ ID NO: 155572 - RNA, 19 nt, Human
ucuggugcagucccaggag

SEQ ID NO: 155573 - RNA, 24 nt, Human
ucuugcaugcaacaagacggagga

SEQ ID NO: 155574 - RNA, 19 nt, Human
ucuugcuuccccuccccca

SEQ ID NO: 155575 - RNA, 21 nt, Human
ugaauaucucgcacccagggc

SEQ ID NO: 155576 - RNA, 25 nt, Human
ugacccccaucccuucuugcuuccc

SEQ ID NO: 155577 - RNA, 20 nt, Human
ugccggccccgagcagcgcu

SEQ ID NO: 155578 - RNA, 19 nt, Human
uggaaaaugagccccggga

SEQ ID NO: 155579 - RNA, 20 nt, Human
uggaaaaugagccccgggaa

SEQ ID NO: 155580 - RNA, 25 nt, Human
uggaucugcacugggaagagagagc

SEQ ID NO: 155581 - RNA, 20 nt, Human
uggaugccuuuccccaagcc

SEQ ID NO: 155582 - RNA, 23 nt, Human
uuaacuuucuccccuucggucuu

SEQ ID NO: 155583 - RNA, 23 nt, Human
uucuugcuuccccucccccacuc

SEQ ID NO: 155584 - RNA, 22 nt, Human
uugucauucugcucaucuaagu

SEQ ID NO: 155585 - RNA, 20 nt, Human
uuuuuugucauucugcucau

SEQ ID NO: 155586 - RNA, 19 nt, Human
aaaaagccaaaccaaagag

SEQ ID NO: 155587 - RNA, 19 nt, Human
aaaagcaucucaaggagaa

SEQ ID NO: 155588 - RNA, 18 nt, Human
aaacagcaacucugagua

SEQ ID NO: 155589 - RNA, 23 nt, Human
aaagaacucauugauguaaauaa

SEQ ID NO: 155590 - RNA, 25 nt, Human
aaccaaagaggaauagcucauggaa

SEQ ID NO: 155591 - RNA, 19 nt, Human
aagaacagagguugcauag

SEQ ID NO: 155592 - RNA, 25 nt, Human
aagcaaacagauuccucuggagguu

SEQ ID NO: 155593 - RNA, 27 nt, Human
aagcaucucaaggagaaacagcaacuc

SEQ ID NO: 155594 - RNA, 18 nt, Human
aaguggguuaggugggug

SEQ ID NO: 155595 - RNA, 21 nt, Human
acaaagggagccucagcugga

SEQ ID NO: 155596 - RNA, 25 nt, Human
acacuccaaaagcaucucaaggaga

SEQ ID NO: 155597 - RNA, 23 nt, Human
accaaagaggaauagcucaugga

SEQ ID NO: 155598 - RNA, 20 nt, Human
accgcaagggaugccgcagg

SEQ ID NO: 155599 - RNA, 22 nt, Human
acuccaaaagcaucucaaggag

SEQ ID NO: 155600 - RNA, 26 nt, Human
acuccaaaagcaucucaaggagaaac

SEQ ID NO: 155601 - RNA, 24 nt, Human
acugaaaacaaagggagccucagc

SEQ ID NO: 155602 - RNA, 18 nt, Human
agccgccacugccagggc

SEQ ID NO: 155603 - RNA, 19 nt, Human
aggcgcgcucaggcuccgc

SEQ ID NO: 155604 - RNA, 21 nt, Human
aucaggaagcaaacagauucc

SEQ ID NO: 155605 - RNA, 23 nt, Human
caaacagauuccucuggagguuu

SEQ ID NO: 155606 - RNA, 29 nt, Human
caaaccaaagaggaauagcucauggaacc

SEQ ID NO: 155607 - RNA, 23 nt, Human
caaagucuuccacuuggcauuuu

SEQ ID NO: 155608 - RNA, 23 nt, Human
caaaucccaccaagauguuuggc

SEQ ID NO: 155609 - RNA, 21 nt, Human
caagaacagagguugcauagc

SEQ ID NO: 155610 - RNA, 21 nt, Human
caagggaugccgcaggccacc

SEQ ID NO: 155611 - RNA, 23 nt, Human
caagggaugccgcaggccaccac

SEQ ID NO: 155612 - RNA, 22 nt, Human
cacaguagaaaaaggaauaaaa

SEQ ID NO: 155613 - RNA, 18 nt, Human
cacugcgcaugcgggagc

SEQ ID NO: 155614 - RNA, 20 nt, Human
cagaggguaucagacauucc

SEQ ID NO: 155615 - RNA, 26 nt, Human
cagcagucuuccuguccgugaaguuu

SEQ ID NO: 155616 - RNA, 23 nt, Human
cagccucuuccucacacuccaaa

SEQ ID NO: 155617 - RNA, 24 nt, Human
caggccaaagacggaguuaaauau

SEQ ID NO: 155618 - RNA, 22 nt, Human
cauggaacugacaggauccuga

SEQ ID NO: 155619 - RNA, 25 nt, Human
ccaaaccaaagaggaauagcucaug

SEQ ID NO: 155620 - RNA, 21 nt, Human
ccaccggacccugaggcgcag

SEQ ID NO: 155621 - RNA, 24 nt, Human
ccagaaccucccuggcuaauguua

SEQ ID NO: 155622 - RNA, 19 nt, Human
ccccagaccucaaaugggc

SEQ ID NO: 155623 - RNA, 24 nt, Human
ccccugggaggaaucagaucccug

SEQ ID NO: 155624 - RNA, 22 nt, Human
cccuguggcucggccacggcug

SEQ ID NO: 155625 - RNA, 18 nt, Human
ccgcugcaguguuuuccc

SEQ ID NO: 155626 - RNA, 19 nt, Human
ccucccgcucggccccgag

SEQ ID NO: 155627 - RNA, 22 nt, Human
ccuccugcuggacaggaggagu

SEQ ID NO: 155628 - RNA, 26 nt, Human
ccucugucccagccucacauucagac

SEQ ID NO: 155629 - RNA, 21 nt, Human
ccuuccacccuuaaccuacua

SEQ ID NO: 155630 - RNA, 22 nt, Human
cgagcagcgagcgaggggccgg

SEQ ID NO: 155631 - RNA, 23 nt, Human
cgcaagggaugccgcaggccacc

SEQ ID NO: 155632 - RNA, 25 nt, Human
cucggccccgagcuuggucaccggc

SEQ ID NO: 155633 - RNA, 21 nt, Human
gaaaacaaagggagccucagc

SEQ ID NO: 155634 - RNA, 18 nt, Human
gaauagcucauggaacug

SEQ ID NO: 155635 - RNA, 18 nt, Human
gagaagaacccaucagag

SEQ ID NO: 155636 - RNA, 18 nt, Human
gagcagcgagcgaggggc

SEQ ID NO: 155637 - RNA, 18 nt, Human
gcaggacaucccccuggg

SEQ ID NO: 155638 - RNA, 20 nt, Human
gcuuuugcaccgaauucugg

SEQ ID NO: 155639 - RNA, 25 nt, Human
ggccuuguucucucccucuguccca

SEQ ID NO: 155640 - RNA, 18 nt, Human
ggcguguguucccagaca

SEQ ID NO: 155641 - RNA, 21 nt, Human
gugcugggaggccuuguucuc

SEQ ID NO: 155642 - RNA, 23 nt, Human
uaacacgcuucucuucuccagca

SEQ ID NO: 155643 - RNA, 26 nt, Human
uaacacgcuucucuucuccagcaguc

SEQ ID NO: 155644 - RNA, 24 nt, Human
uaacauuaaagacacucgucccac

SEQ ID NO: 155645 - RNA, 22 nt, Human
uaaccuacuacucugacaucag

SEQ ID NO: 155646 - RNA, 20 nt, Human
uagcagcauuuaacguuagc

SEQ ID NO: 155647 - RNA, 23 nt, Human
uagcucauggaacugacaggauc

SEQ ID NO: 155648 - RNA, 24 nt, Human
uauaccagcaacuguugcaaagca

SEQ ID NO: 155649 - RNA, 22 nt, Human
ucccaaggcauuuaucaaaucc

SEQ ID NO: 155650 - RNA, 21 nt, Human
uccccagaccucaaaugggcu

SEQ ID NO: 155651 - RNA, 18 nt, Human
uccccuugggaugggggg

SEQ ID NO: 155652 - RNA, 23 nt, Human
ucuuccacuuggcauuuucgaga

SEQ ID NO: 155653 - RNA, 18 nt, Human
ugaaagaacucauugaug

SEQ ID NO: 155654 - RNA, 24 nt, Human
ugacaauaccuuuaaaacauugac

SEQ ID NO: 155655 - RNA, 20 nt, Human
ugacacagacagccucuucc

SEQ ID NO: 155656 - RNA, 18 nt, Human
ugacucagcggcuggugc

SEQ ID NO: 155657 - RNA, 18 nt, Human
ugacuggaucuaaucagg

SEQ ID NO: 155658 - RNA, 22 nt, Human
ugauuuaaauauaccagcaacu

SEQ ID NO: 155659 - RNA, 18 nt, Human
ugccacaaagucuuccac

SEQ ID NO: 155660 - RNA, 22 nt, Human
ugccacaaagucuuccacuugg

SEQ ID NO: 155661 - RNA, 25 nt, Human
uggaacugaaaacaaagggagccuc

SEQ ID NO: 155662 - RNA, 22 nt, Human
uggcauccccuugggauggggg

SEQ ID NO: 155663 - RNA, 28 nt, Human
uggcucggccacggcugccccguacucg

SEQ ID NO: 155664 - RNA, 26 nt, Human
uguucucucccucugucccagccuca

SEQ ID NO: 155665 - RNA, 20 nt, Human
uguucuugagaaaguggguu

SEQ ID NO: 155666 - RNA, 21 nt, Human
uuccuguccgugaaguuuccu

SEQ ID NO: 155667 - RNA, 20 nt, Human
uuccuuggacuaucaggaau

SEQ ID NO: 155668 - RNA, 20 nt, Human
uucucugacaauaccuuuaa

SEQ ID NO: 155669 - RNA, 21 nt, Human
uugcauagcucgaggugcuug

SEQ ID NO: 155670 - RNA, 23 nt, Human
uugcauagcucgaggugcuugga

SEQ ID NO: 155671 - RNA, 21 nt, Human
uuuaaaacauugacuggaucu

SEQ ID NO: 155672 - RNA, 19 nt, Human
uuugggaccuucuuacgcu

SEQ ID NO: 155673 - RNA, 28 nt, Human
aaaaggacacgacacgacccgccccccg

SEQ ID NO: 155674 - RNA, 21 nt, Human
aagcaggaagagcagggccug

SEQ ID NO: 155675 - RNA, 21 nt, Human
aagcgcaaaggagaccgaacc

SEQ ID NO: 155676 - RNA, 19 nt, Human
aaggagaccgaacccauug

SEQ ID NO: 155677 - RNA, 19 nt, Human
acaggcuggagggagcugg

SEQ ID NO: 155678 - RNA, 20 nt, Human
acagugcagaggccagggcc

SEQ ID NO: 155679 - RNA, 21 nt, Human
accccggagaccuaguguccc

SEQ ID NO: 155680 - RNA, 21 nt, Human
agaagguaaggccacgccccc

SEQ ID NO: 155681 - RNA, 19 nt, Human
agacaaugcucugaaagac

SEQ ID NO: 155682 - RNA, 23 nt, Human
agaccgaacccauugggggcgga

SEQ ID NO: 155683 - RNA, 19 nt, Human
agaccuagugucccccccc

SEQ ID NO: 155684 - RNA, 20 nt, Human
agagauggggcuguucuuca

SEQ ID NO: 155685 - RNA, 23 nt, Human
agagcagggccuggggcgggaga

SEQ ID NO: 155686 - RNA, 22 nt, Human
agcaagcaggaagagcagggcc

SEQ ID NO: 155687 - RNA, 18 nt, Human
agcaggaagagcagggcc

SEQ ID NO: 155688 - RNA, 22 nt, Human
agccaggcaggaggaggccagg

SEQ ID NO: 155689 - RNA, 20 nt, Human
agccaguccuggggccugac

SEQ ID NO: 155690 - RNA, 21 nt, Human
agccccucuuccccgcagccc

SEQ ID NO: 155691 - RNA, 22 nt, Human
agcuugcuggccuggccccccu

SEQ ID NO: 155692 - RNA, 21 nt, Human
aggaagagcagggccuggggc

SEQ ID NO: 155693 - RNA, 21 nt, Human
aggacacgcgcuuuauuucgg

SEQ ID NO: 155694 - RNA, 19 nt, Human
aggcaggaggaggccaggu

SEQ ID NO: 155695 - RNA, 21 nt, Human
aggcaggaggaggccaggugg

SEQ ID NO: 155696 - RNA, 23 nt, Human
aggcggcuuggccagggacaggc

SEQ ID NO: 155697 - RNA, 18 nt, Human
aggcuccgcggcugaggg

SEQ ID NO: 155698 - RNA, 21 nt, Human
agggccgugucccccugcccu

SEQ ID NO: 155699 - RNA, 23 nt, Human
agucccugcucgcgcccagccca

SEQ ID NO: 155700 - RNA, 19 nt, Human
aucccgcuuuccucgcccc

SEQ ID NO: 155701 - RNA, 19 nt, Human
auggggcuguucuucagau

SEQ ID NO: 155702 - RNA, 19 nt, Human
caaccgggguccgacgugu

SEQ ID NO: 155703 - RNA, 23 nt, Human
caagccagccuuuucccucccag

SEQ ID NO: 155704 - RNA, 19 nt, Human
caagccccccaaacccuau

SEQ ID NO: 155705 - RNA, 19 nt, Human
cacaccugccuagccagag

SEQ ID NO: 155706 - RNA, 19 nt, Human
cacaucccggccgcccucu

SEQ ID NO: 155707 - RNA, 22 nt, Human
cacccuccacaucccggccgcc

SEQ ID NO: 155708 - RNA, 22 nt, Human
cacucccaucccuuuccagucg

SEQ ID NO: 155709 - RNA, 22 nt, Human
cagaaugcagggccgugucccc

SEQ ID NO: 155710 - RNA, 21 nt, Human
cagagcugggaccgaccugcu

SEQ ID NO: 155711 - RNA, 28 nt, Human
cagccgguguccccccgccuuggagggc

SEQ ID NO: 155712 - RNA, 19 nt, Human
cagcugccuugcaccauuu

SEQ ID NO: 155713 - RNA, 18 nt, Human
caggaggaggccaggugg

SEQ ID NO: 155714 - RNA, 19 nt, Human
caggaggcggcuuggccag

SEQ ID NO: 155715 - RNA, 18 nt, Human
caggcaggaggaggccag

SEQ ID NO: 155716 - RNA, 20 nt, Human
caggcaggaggaggccaggu

SEQ ID NO: 155717 - RNA, 21 nt, Human
cagggccguugugccaagccc

SEQ ID NO: 155718 - RNA, 19 nt, Human
cagucccuucuugcugagu

SEQ ID NO: 155719 - RNA, 25 nt, Human
ccaccuagaaacagucccuucuugc

SEQ ID NO: 155720 - RNA, 21 nt, Human
ccagcuugcuggccuggcccc

SEQ ID NO: 155721 - RNA, 18 nt, Human
ccaucccgcuuuccucgc

SEQ ID NO: 155722 - RNA, 20 nt, Human
cccacagucagggcuaggga

SEQ ID NO: 155723 - RNA, 20 nt, Human
cccagcagcugccuugcacc

SEQ ID NO: 155724 - RNA, 25 nt, Human
ccccaacuccauucucaccuauacc

SEQ ID NO: 155725 - RNA, 24 nt, Human
cccccaaacccuaugguaucacuc

SEQ ID NO: 155726 - RNA, 22 nt, Human
ccccccaacuccauucucaccu

SEQ ID NO: 155727 - RNA, 22 nt, Human
cccccccaacuccauucucacc

SEQ ID NO: 155728 - RNA, 21 nt, Human
ccccccccaacuccauucuca

SEQ ID NO: 155729 - RNA, 22 nt, Human
ccccccccaacuccauucucac

SEQ ID NO: 155730 - RNA, 24 nt, Human
ccccccugcucucaggacucugcc

SEQ ID NO: 155731 - RNA, 19 nt, Human
cccccugcccuccuggcug

SEQ ID NO: 155732 - RNA, 21 nt, Human
cccccugcccuccuggcugca

SEQ ID NO: 155733 - RNA, 22 nt, Human
ccccggagaccuaguguccccc

SEQ ID NO: 155734 - RNA, 18 nt, Human
ccccucuuccccgcagcc

SEQ ID NO: 155735 - RNA, 18 nt, Human
ccccugggagcugggcug

SEQ ID NO: 155736 - RNA, 21 nt, Human
ccccugggcacugcucuggcu

SEQ ID NO: 155737 - RNA, 21 nt, Human
cccgcagcccagcagcugccu

SEQ ID NO: 155738 - RNA, 18 nt, Human
cccgcuggcagacgcuuc

SEQ ID NO: 155739 - RNA, 21 nt, Human
cccugggagcugggcugagac

SEQ ID NO: 155740 - RNA, 26 nt, Human
ccgcucacccugucccgccgccgccc

SEQ ID NO: 155741 - RNA, 27 nt, Human
ccgcucacccugucccgccgccgcccu

SEQ ID NO: 155742 - RNA, 19 nt, Human
ccgugucccccugcccucc

SEQ ID NO: 155743 - RNA, 23 nt, Human
ccucccagcagggaccccugccc

SEQ ID NO: 155744 - RNA, 21 nt, Human
ccuccccuugccugagcagcc

SEQ ID NO: 155745 - RNA, 22 nt, Human
ccucguuuacccgcaccccucu

SEQ ID NO: 155746 - RNA, 19 nt, Human
ccugcccuccuggcugcac

SEQ ID NO: 155747 - RNA, 24 nt, Human
ccugggagcugggcugagaccuuu

SEQ ID NO: 155748 - RNA, 19 nt, Human
ccuggggcgggagaccaga

SEQ ID NO: 155749 - RNA, 25 nt, Human
ccuguggcuggagcuaaaauuagac

SEQ ID NO: 155750 - RNA, 21 nt, Human
ccuugccugagcagcccuggc

SEQ ID NO: 155751 - RNA, 22 nt, Human
ccuuggagggccaggagggcuc

SEQ ID NO: 155752 - RNA, 23 nt, Human
ccuuuggacaaccaagccagccu

SEQ ID NO: 155753 - RNA, 24 nt, Human
cgcgcccagcccaccuagaaacag

SEQ ID NO: 155754 - RNA, 27 nt, Human
cgcgcccagcccaccuagaaacagucc

SEQ ID NO: 155755 - RNA, 21 nt, Human
cgcuucugggcuguggccccu

SEQ ID NO: 155756 - RNA, 21 nt, Human
cgcuuuccucgccccacuccu

SEQ ID NO: 155757 - RNA, 18 nt, Human
cggagaccuagugucccc

SEQ ID NO: 155758 - RNA, 18 nt, Human
cgggacuaggaacccuag

SEQ ID NO: 155759 - RNA, 20 nt, Human
cuaggaacccuaggaauggg

SEQ ID NO: 155760 - RNA, 23 nt, Human
cucgggguccugauccccuaagg

SEQ ID NO: 155761 - RNA, 19 nt, Human
cucuggcugacgcaacccc

SEQ ID NO: 155762 - RNA, 21 nt, Human
cugccaggccauggggaccag

SEQ ID NO: 155763 - RNA, 22 nt, Human
cugcuaguccugugcugucauu

SEQ ID NO: 155764 - RNA, 20 nt, Human
cuggcagacgcuucugggcu

SEQ ID NO: 155765 - RNA, 22 nt, Human
cuguucuucagauuucucuucc

SEQ ID NO: 155766 - RNA, 22 nt, Human
cuuccccgcagcccagcagcug

SEQ ID NO: 155767 - RNA, 18 nt, Human
cuugaccuugcccucaac

SEQ ID NO: 155768 - RNA, 21 nt, Human
cuuugauggggucuccgcggg

SEQ ID NO: 155769 - RNA, 21 nt, Human
cuuuggacaaccaagccagcc

SEQ ID NO: 155770 - RNA, 22 nt, Human
gacaggcuggagggagcugggc

SEQ ID NO: 155771 - RNA, 24 nt, Human
gaccuaguguccccccccaacucc

SEQ ID NO: 155772 - RNA, 19 nt, Human
gagauggggcuguucuuca

SEQ ID NO: 155773 - RNA, 19 nt, Human
gagcaggagaagguaaggc

SEQ ID NO: 155774 - RNA, 19 nt, Human
gagcagggccuggggcggg

SEQ ID NO: 155775 - RNA, 21 nt, Human
gagcagggccuggggcgggag

SEQ ID NO: 155776 - RNA, 22 nt, Human
gagggagcugggcuggucuucc

SEQ ID NO: 155777 - RNA, 19 nt, Human
gcaggaggaggccaggugg

SEQ ID NO: 155778 - RNA, 20 nt, Human
gcccagcccaccuagaaaca

SEQ ID NO: 155779 - RNA, 23 nt, Human
gccgggcccccugggagcugggc

SEQ ID NO: 155780 - RNA, 27 nt, Human
gcgaaagcgcaaaggagaccgaaccca

SEQ ID NO: 155781 - RNA, 20 nt, Human
gcuccgcggcugagggcgag

SEQ ID NO: 155782 - RNA, 20 nt, Human
gcucgggguccugauccuua

SEQ ID NO: 155783 - RNA, 21 nt, Human
gcucucaggacucugccuucu

SEQ ID NO: 155784 - RNA, 19 nt, Human
gcucugaaagacgagcaga

SEQ ID NO: 155785 - RNA, 18 nt, Human
gcucuggcugacgcaacc

SEQ ID NO: 155786 - RNA, 22 nt, Human
gcuggucuucccacuccucccc

SEQ ID NO: 155787 - RNA, 18 nt, Human
gcuuuauuucggaaguga

SEQ ID NO: 155788 - RNA, 18 nt, Human
ggacaggccacuuguucc

SEQ ID NO: 155789 - RNA, 23 nt, Human
ggccauggggaccagucagagcu

SEQ ID NO: 155790 - RNA, 26 nt, Human
ggccuggccccccugcucucaggacu

SEQ ID NO: 155791 - RNA, 20 nt, Human
ggcgggagaccagagcuggg

SEQ ID NO: 155792 - RNA, 18 nt, Human
ggcuccgcggcugagggc

SEQ ID NO: 155793 - RNA, 20 nt, Human
gggcggagggggaggagggc

SEQ ID NO: 155794 - RNA, 21 nt, Human
gggcuguggccccuguggcug

SEQ ID NO: 155795 - RNA, 24 nt, Human
gggggaggagggccaggcaagucc

SEQ ID NO: 155796 - RNA, 18 nt, Human
guaguugccuucccggga

SEQ ID NO: 155797 - RNA, 23 nt, Human
gucagauagugagucaccagcca

SEQ ID NO: 155798 - RNA, 19 nt, Human
gucccuucuugcugaguuc

SEQ ID NO: 155799 - RNA, 19 nt, Human
uaccagcucgggacagucc

SEQ ID NO: 155800 - RNA, 18 nt, Human
uaggaauggguggcgggg

SEQ ID NO: 155801 - RNA, 20 nt, Human
uagugagucaccagccaggc

SEQ ID NO: 155802 - RNA, 18 nt, Human
uauaccagcucgggacag

SEQ ID NO: 155803 - RNA, 21 nt, Human
ucacagccugggugcagccgg

SEQ ID NO: 155804 - RNA, 19 nt, Human
ucagagcucccacaggagg

SEQ ID NO: 155805 - RNA, 19 nt, Human
uccgcggcugagggcgagc

SEQ ID NO: 155806 - RNA, 23 nt, Human
uccugugcugucauuguacagau

SEQ ID NO: 155807 - RNA, 20 nt, Human
ucucaggacucugccuucuc

SEQ ID NO: 155808 - RNA, 20 nt, Human
ugacaugauagguuuuaccg

SEQ ID NO: 155809 - RNA, 22 nt, Human
ugagaggagggcugucugccag

SEQ ID NO: 155810 - RNA, 21 nt, Human
ugagggcgagcaggagaaggu

SEQ ID NO: 155811 - RNA, 21 nt, Human
ugagggcgagcaggagaaggu

SEQ ID NO: 155812 - RNA, 21 nt, Human
ugcagccccucuuccccgcag

SEQ ID NO: 155813 - RNA, 21 nt, Human
ugcagccgguguccccccgcc

SEQ ID NO: 155814 - RNA, 20 nt, Human
ugcccuccuggcugcacccc

SEQ ID NO: 155815 - RNA, 20 nt, Human
ugcuggccuggccccccugc

SEQ ID NO: 155816 - RNA, 20 nt, Human
uggagaagcggagagcggcg

SEQ ID NO: 155817 - RNA, 18 nt, Human
uggcgggguggggcgggg

SEQ ID NO: 155818 - RNA, 21 nt, Human
uggcugccccugugcccgcug

SEQ ID NO: 155819 - RNA, 18 nt, Human
uggcuuggagcuaucaca

SEQ ID NO: 155820 - RNA, 20 nt, Human
ugggacccagcuugcuggcc

SEQ ID NO: 155821 - RNA, 18 nt, Human
ugggcccgcuggcugaca

SEQ ID NO: 155822 - RNA, 21 nt, Human
ugggcuggucuucccacuccu

SEQ ID NO: 155823 - RNA, 21 nt, Human
uggggcgggagaccagagcuc

SEQ ID NO: 155824 - RNA, 21 nt, Human
uggggcggggacaguucuguc

SEQ ID NO: 155825 - RNA, 24 nt, Human
uggggcggggacaguucugucucu

SEQ ID NO: 155826 - RNA, 21 nt, Human
uguucccaucccgcuuuccuc

SEQ ID NO: 155827 - RNA, 24 nt, Human
uucacccuccacaucccggccgcc

SEQ ID NO: 155828 - RNA, 22 nt, Human
uugccugagcagcccuggcugc

SEQ ID NO: 155829 - RNA, 23 nt, Human
uugggggcggagggggaggaggg

SEQ ID NO: 155830 - RNA, 21 nt, Human
uuggguaguugccuucccggg

SEQ ID NO: 155831 - RNA, 23 nt, Human
uuuuuuuuuuugcaaggacacgc

SEQ ID NO: 155832 - RNA, 21 nt, Human
uuuuuuuuuuuuuugcaagga

SEQ ID NO: 155833 - RNA, 18 nt, Human
uuuuuuuuuuuuuuuuug

SEQ ID NO: 155834 - RNA, 20 nt, Human
aaacaauaaaaucacugacc

SEQ ID NO: 155835 - RNA, 21 nt, Human
aaacagaggccuaguuaagaa

SEQ ID NO: 155836 - RNA, 23 nt, Human
aaaugccaggagucaaagaaacu

SEQ ID NO: 155837 - RNA, 26 nt, Human
aaaugccucucuugaguuucugaucc

SEQ ID NO: 155838 - RNA, 24 nt, Human
aaccagugcucuaccaauaaagau

SEQ ID NO: 155839 - RNA, 20 nt, Human
aaggcaaaugccaggaguca

SEQ ID NO: 155840 - RNA, 20 nt, Human
aauaagagggaaaggaggag

SEQ ID NO: 155841 - RNA, 20 nt, Human
aauguacauucucaagguca

SEQ ID NO: 155842 - RNA, 20 nt, Human
acaaauaucaagcaaacaac

SEQ ID NO: 155843 - RNA, 20 nt, Human
acaaggaaagcacuggcagc

SEQ ID NO: 155844 - RNA, 19 nt, Human
acauauacucuuuaaugua

SEQ ID NO: 155845 - RNA, 24 nt, Human
accucauuauuggaacauuagcca

SEQ ID NO: 155846 - RNA, 20 nt, Human
acuacccgaaucuaguaaca

SEQ ID NO: 155847 - RNA, 18 nt, Human
acugucccagucacaaaa

SEQ ID NO: 155848 - RNA, 21 nt, Human
agaagcacugcacuuuuuuuu

SEQ ID NO: 155849 - RNA, 20 nt, Human
agacacauauacucuuuaau

SEQ ID NO: 155850 - RNA, 22 nt, Human
agaggagaaggaggaauaagag

SEQ ID NO: 155851 - RNA, 18 nt, Human
agcaguuuucagguuugu

SEQ ID NO: 155852 - RNA, 21 nt, Human
agcuacucaaaugccaagcag

SEQ ID NO: 155853 - RNA, 19 nt, Human
aguugguaaacagaggccu

SEQ ID NO: 155854 - RNA, 18 nt, Human
auggcaaaaguuucuuuu

SEQ ID NO: 155855 - RNA, 19 nt, Human
caaaugccaggagucaaag

SEQ ID NO: 155856 - RNA, 22 nt, Human
caaccuggaaaaagugccgccc

SEQ ID NO: 155857 - RNA, 18 nt, Human
caaguguuuggcuuugua

SEQ ID NO: 155858 - RNA, 21 nt, Human
caaguguuuggcuuuguaaua

SEQ ID NO: 155859 - RNA, 24 nt, Human
cauaagaggcaaaaaaguacuacc

SEQ ID NO: 155860 - RNA, 20 nt, Human
ccuagaagcacugcacuuuu

SEQ ID NO: 155861 - RNA, 22 nt, Human
cuacuaaaauuaacugucccag

SEQ ID NO: 155862 - RNA, 19 nt, Human
cuggaagagcugguuggca

SEQ ID NO: 155863 - RNA, 20 nt, Human
cuggacugaguucguccugg

SEQ ID NO: 155864 - RNA, 20 nt, Human
cugguuggcagggccacaag

SEQ ID NO: 155865 - RNA, 23 nt, Human
cuuaacaaaaauaaaagcaugga

SEQ ID NO: 155866 - RNA, 19 nt, Human
gaaaggaggagaaagagaa

SEQ ID NO: 155867 - RNA, 21 nt, Human
gaaaugccucucuugaguuuc

SEQ ID NO: 155868 - RNA, 19 nt, Human
gaaugcaaguguuuggcuu

SEQ ID NO: 155869 - RNA, 18 nt, Human
gaggaauaagagggaaag

SEQ ID NO: 155870 - RNA, 23 nt, Human
gauguaaacaauaaaaucacuga

SEQ ID NO: 155871 - RNA, 22 nt, Human
gcaucuauccuucuccauuagc

SEQ ID NO: 155872 - RNA, 20 nt, Human
gcauggagaagcuacucaaa

SEQ ID NO: 155873 - RNA, 21 nt, Human
ggaaaaagugccgcccgcaaa

SEQ ID NO: 155874 - RNA, 20 nt, Human
ggaaagcacuggcagcugca

SEQ ID NO: 155875 - RNA, 21 nt, Human
guaaacaauaaaaucacugac

SEQ ID NO: 155876 - RNA, 21 nt, Human
guaaauguucacaaauaucaa

SEQ ID NO: 155877 - RNA, 26 nt, Human
guagaacagucucaggauguaaacaa

SEQ ID NO: 155878 - RNA, 25 nt, Human
gucucguuugcucauuuuuguuuuu

SEQ ID NO: 155879 - RNA, 23 nt, Human
uaaaaaaauacauagcauggaga

SEQ ID NO: 155880 - RNA, 18 nt, Human
uaaauguucacaaauauc

SEQ ID NO: 155881 - RNA, 21 nt, Human
uaacaaaaauaaaagcaugga

SEQ ID NO: 155882 - RNA, 25 nt, Human
uaacaaaaauaaaagcauggauggu

SEQ ID NO: 155883 - RNA, 24 nt, Human
uaacugacauuaucgauuuuuagu

SEQ ID NO: 155884 - RNA, 20 nt, Human
uaagaagaccuaacuggaua

SEQ ID NO: 155885 - RNA, 24 nt, Human
uaagacacauauacucuuuaaugu

SEQ ID NO: 155886 - RNA, 19 nt, Human
uaagaccaacuucuuggcu

SEQ ID NO: 155887 - RNA, 21 nt, Human
uaaggcaaaugccaggaguca

SEQ ID NO: 155888 - RNA, 21 nt, Human
uaccacaggcuuugcuaaaga

SEQ ID NO: 155889 - RNA, 19 nt, Human
uacccgaaucuaguaacac

SEQ ID NO: 155890 - RNA, 23 nt, Human
uagauugcaguagggccagccga

SEQ ID NO: 155891 - RNA, 20 nt, Human
uagcgugcaucuauccuucu

SEQ ID NO: 155892 - RNA, 24 nt, Human
uagcuucaguaauugacagaagca

SEQ ID NO: 155893 - RNA, 19 nt, Human
ucaguaauugacagaagca

SEQ ID NO: 155894 - RNA, 25 nt, Human
ucagugacaaaaugcacuacccgaa

SEQ ID NO: 155895 - RNA, 21 nt, Human
uccuuauagcuucaguaauug

SEQ ID NO: 155896 - RNA, 27 nt, Human
ucguuugcucauuuuuguuuuuuuuuc

SEQ ID NO: 155897 - RNA, 19 nt, Human
ucuaaaccaaguagcgugc

SEQ ID NO: 155898 - RNA, 27 nt, Human
ucucuugaguuucugauccuagaaaca

SEQ ID NO: 155899 - RNA, 22 nt, Human
ucuucagcuacuaaaauuaacu

SEQ ID NO: 155900 - RNA, 23 nt, Human
ugaccaaggaguuauaucccugg

SEQ ID NO: 155901 - RNA, 18 nt, Human
ugagacuauucucuucuu

SEQ ID NO: 155902 - RNA, 26 nt, Human
ugaguuucugauccuagaaacagcuu

SEQ ID NO: 155903 - RNA, 20 nt, Human
ugccaagcaguuuucagguu

SEQ ID NO: 155904 - RNA, 18 nt, Human
uggaguagauaaaauuca

SEQ ID NO: 155905 - RNA, 22 nt, Human
uggcguguaagaaauacagggu

SEQ ID NO: 155906 - RNA, 18 nt, Human
uggcuuuaccccauacca

SEQ ID NO: 155907 - RNA, 19 nt, Human
ugguuggcagggccacaag

SEQ ID NO: 155908 - RNA, 20 nt, Human
ugguuggcagggccacaagg

SEQ ID NO: 155909 - RNA, 19 nt, Human
uguaguugaaauuucauca

SEQ ID NO: 155910 - RNA, 19 nt, Human
uuaacaaccuggaaaaagu

SEQ ID NO: 155911 - RNA, 22 nt, Human
uuacaucaaaaccaugcuggac

SEQ ID NO: 155912 - RNA, 23 nt, Human
uucugauccuagaaacagcuugc

SEQ ID NO: 155913 - RNA, 22 nt, Human
uugcucauuuuuguuuuuuuuu

SEQ ID NO: 155914 - RNA, 19 nt, Human
uuuaguaagauucuuaguu

SEQ ID NO: 155915 - RNA, 21 nt, Human
uuuagugaaaaagcagagaaa

SEQ ID NO: 155916 - RNA, 21 nt, Human
uuuuccucuucauaugugacu

SEQ ID NO: 155917 - RNA, 23 nt, Human
aaaacucacacucccccagccaa

SEQ ID NO: 155918 - RNA, 24 nt, Human
aaaaugaacauuucauuuuccuca

SEQ ID NO: 155919 - RNA, 23 nt, Human
aaacacccuggaaucagacagac

SEQ ID NO: 155920 - RNA, 20 nt, Human
aaacgauaaaaggugccaca

SEQ ID NO: 155921 - RNA, 22 nt, Human
aaacucacacucccccagccaa

SEQ ID NO: 155922 - RNA, 24 nt, Human
aaagagcccagcuucaaaacagua

SEQ ID NO: 155923 - RNA, 22 nt, Human
aaagaucccauccuuccggaca

SEQ ID NO: 155924 - RNA, 23 nt, Human
aaaugaacauuucauuuuccuca

SEQ ID NO: 155925 - RNA, 19 nt, Human
aaaugccacucacacccuc

SEQ ID NO: 155926 - RNA, 27 nt, Human
aagcagggaguggaaagugggggaccc

SEQ ID NO: 155927 - RNA, 22 nt, Human
aagccagugacacaaggccagg

SEQ ID NO: 155928 - RNA, 20 nt, Human
aaggagccugcgcggucccg

SEQ ID NO: 155929 - RNA, 25 nt, Human
aaggugccacauucuugcugagaug

SEQ ID NO: 155930 - RNA, 20 nt, Human
aaucacagccucccauuguu

SEQ ID NO: 155931 - RNA, 22 nt, Human
acaaaagagcccagcuucaaaa

SEQ ID NO: 155932 - RNA, 23 nt, Human
acaaggcaccaaauaaaaugaac

SEQ ID NO: 155933 - RNA, 21 nt, Human
acaggcaggucagaggagaac

SEQ ID NO: 155934 - RNA, 20 nt, Human
acaguggccugcagagcccu

SEQ ID NO: 155935 - RNA, 18 nt, Human
accaaggaauuaucccaa

SEQ ID NO: 155936 - RNA, 23 nt, Human
accacacagacggccccagcuca

SEQ ID NO: 155937 - RNA, 23 nt, Human
accacacagacggccccggcuca

SEQ ID NO: 155938 - RNA, 23 nt, Human
accagcagaugugcccaaggucc

SEQ ID NO: 155939 - RNA, 25 nt, Human
acccaaaaaauuagcuuauuucagu

SEQ ID NO: 155940 - RNA, 18 nt, Human
acccggggucuguggcgc

SEQ ID NO: 155941 - RNA, 18 nt, Human
acucuuuggcuccccgag

SEQ ID NO: 155942 - RNA, 20 nt, Human
agagccugucugcaguccuu

SEQ ID NO: 155943 - RNA, 21 nt, Human
agagccugucugcaguccuuc

SEQ ID NO: 155944 - RNA, 22 nt, Human
agaggcccuggcuccaccacac

SEQ ID NO: 155945 - RNA, 24 nt, Human
agaguuagugugcuccccagacaa

SEQ ID NO: 155946 - RNA, 24 nt, Human
agccagcgcucacaguggccugca

SEQ ID NO: 155947 - RNA, 19 nt, Human
aggagcuccccacucuguc

SEQ ID NO: 155948 - RNA, 21 nt, Human
aggccaggacccaucuccgcc

SEQ ID NO: 155949 - RNA, 19 nt, Human
agggaacagaauccuaagc

SEQ ID NO: 155950 - RNA, 20 nt, Human
agggagccagcgcucacagu

SEQ ID NO: 155951 - RNA, 21 nt, Human
aggggugggguggauggacgu

SEQ ID NO: 155952 - RNA, 24 nt, Human
agggucaggcgcucccagggauuc

SEQ ID NO: 155953 - RNA, 22 nt, Human
aggguucaagaaacacgucaug

SEQ ID NO: 155954 - RNA, 23 nt, Human
aggugggugggagcuacacaaaa

SEQ ID NO: 155955 - RNA, 18 nt, Human
agguuccccuacugccac

SEQ ID NO: 155956 - RNA, 20 nt, Human
augaaacccaggaaaaacac

SEQ ID NO: 155957 - RNA, 21 nt, Human
augaccaggacaaaccugagc

SEQ ID NO: 155958 - RNA, 22 nt, Human
augaugccuuugccaacaauca

SEQ ID NO: 155959 - RNA, 23 nt, Human
caaaacgaucucuguuucacuga

SEQ ID NO: 155960 - RNA, 23 nt, Human
caaagaacauguccuuaaucuuu

SEQ ID NO: 155961 - RNA, 18 nt, Human
caaaugccauagcucuug

SEQ ID NO: 155962 - RNA, 18 nt, Human
caaggaauuaucccaagg

SEQ ID NO: 155963 - RNA, 19 nt, Human
caaggaauuaucccaaggc

SEQ ID NO: 155964 - RNA, 21 nt, Human
cacaauauagcgccacacacc

SEQ ID NO: 155965 - RNA, 19 nt, Human
cacacccuccuagguuccc

SEQ ID NO: 155966 - RNA, 18 nt, Human
cacacucccccagccaaa

SEQ ID NO: 155967 - RNA, 22 nt, Human
cacccuccuagguuccccuacu

SEQ ID NO: 155968 - RNA, 23 nt, Human
cacccuggaaucagacagacuuu

SEQ ID NO: 155969 - RNA, 19 nt, Human
caccggcaccacagcccuc

SEQ ID NO: 155970 - RNA, 18 nt, Human
cacgaaccagcuguccug

SEQ ID NO: 155971 - RNA, 18 nt, Human
cacuucagaaacgccuga

SEQ ID NO: 155972 - RNA, 24 nt, Human
cagaaacgccugaggcccacagca

SEQ ID NO: 155973 - RNA, 29 nt, Human
cagcagcaggaagcugaacagcccaccag

SEQ ID NO: 155974 - RNA, 27 nt, Human
cagccaagcugacauuagggguccaaa

SEQ ID NO: 155975 - RNA, 21 nt, Human
cagcccaaaccggagcagcaa

SEQ ID NO: 155976 - RNA, 27 nt, Human
cagcccaccagggucaggcgcucccag

SEQ ID NO: 155977 - RNA, 22 nt, Human
cagcccucccugcggcauguuu

SEQ ID NO: 155978 - RNA, 22 nt, Human
caggaagcugaacagcccacca

SEQ ID NO: 155979 - RNA, 24 nt, Human
caggaccccagcuggugagcccug

SEQ ID NO: 155980 - RNA, 22 nt, Human
cauaaccacacugccucagcag

SEQ ID NO: 155981 - RNA, 25 nt, Human
cauucggggcccgacaaccuggcuc

SEQ ID NO: 155982 - RNA, 20 nt, Human
ccaaaccggagcagcaagcc

SEQ ID NO: 155983 - RNA, 18 nt, Human
ccaaggucuagggaagac

SEQ ID NO: 155984 - RNA, 21 nt, Human
ccacagacagccaaggagacc

SEQ ID NO: 155985 - RNA, 21 nt, Human
ccaccacacagacggccccag

SEQ ID NO: 155986 - RNA, 21 nt, Human
ccaccacacagacggccccgg

SEQ ID NO: 155987 - RNA, 18 nt, Human
ccacuucagaccacagca

SEQ ID NO: 155988 - RNA, 20 nt, Human
ccacuuccagaaaguagggu

SEQ ID NO: 155989 - RNA, 18 nt, Human
ccaggcccaguguggcug

SEQ ID NO: 155990 - RNA, 23 nt, Human
cccacaaacuaggagcuccccac

SEQ ID NO: 155991 - RNA, 24 nt, Human
cccacaaacuaggagcuccccacu

SEQ ID NO: 155992 - RNA, 24 nt, Human
cccagaucacgucgggucacucgc

SEQ ID NO: 155993 - RNA, 20 nt, Human
cccaggaaaaacacccugga

SEQ ID NO: 155994 - RNA, 23 nt, Human
cccagggaacagaauccuaagca

SEQ ID NO: 155995 - RNA, 22 nt, Human
ccccacaaacuaggagcucccc

SEQ ID NO: 155996 - RNA, 23 nt, Human
ccccacaaacuaggagcucccca

SEQ ID NO: 155997 - RNA, 19 nt, Human
ccccagcucacugaguccc

SEQ ID NO: 155998 - RNA, 21 nt, Human
ccccagcucacugagucccgc

SEQ ID NO: 155999 - RNA, 21 nt, Human
cccccacaaacuaggagcucc

SEQ ID NO: 156000 - RNA, 25 nt, Human
ccccccacaaacuaggagcucccca

SEQ ID NO: 156001 - RNA, 23 nt, Human
ccccccagaucacgucgggucac

SEQ ID NO: 156002 - RNA, 19 nt, Human
ccccggggacuccgcccag

SEQ ID NO: 156003 - RNA, 20 nt, Human
ccccggggacuccgcccagg

SEQ ID NO: 156004 - RNA, 19 nt, Human
cccgccgccgccgccgccg

SEQ ID NO: 156005 - RNA, 25 nt, Human
cccgccgccgccgccgccgccgccu

SEQ ID NO: 156006 - RNA, 18 nt, Human
cccggccagccggguggg

SEQ ID NO: 156007 - RNA, 24 nt, Human
cccucugcucauccucuuccccag

SEQ ID NO: 156008 - RNA, 21 nt, Human
cccuggccugaggcacagucc

SEQ ID NO: 156009 - RNA, 19 nt, Human
cccuggcuccaccacacag

SEQ ID NO: 156010 - RNA, 21 nt, Human
cccuuagaaaggcaaaacuca

SEQ ID NO: 156011 - RNA, 18 nt, Human
ccgcccagggcuccaggc

SEQ ID NO: 156012 - RNA, 23 nt, Human
ccgccgccgccgccgccgccgcc

SEQ ID NO: 156013 - RNA, 24 nt, Human
ccgccgccgccgccgccgccgccu

SEQ ID NO: 156014 - RNA, 22 nt, Human
ccgccgccgccgccgccgccgg

SEQ ID NO: 156015 - RNA, 22 nt, Human
ccggccacccagagaacgaggc

SEQ ID NO: 156016 - RNA, 20 nt, Human
ccuacagccaagcugacauu

SEQ ID NO: 156017 - RNA, 24 nt, Human
ccuacugccaccgugacccaaaaa

SEQ ID NO: 156018 - RNA, 20 nt, Human
ccucaaaaaucgcuggcccc

SEQ ID NO: 156019 - RNA, 25 nt, Human
ccugaccagugacacuguggccacc

SEQ ID NO: 156020 - RNA, 19 nt, Human
ccugcaaaccacuucagac

SEQ ID NO: 156021 - RNA, 20 nt, Human
ccugcgagccaggacaaggu

SEQ ID NO: 156022 - RNA, 19 nt, Human
ccuggcuccaccacacaga

SEQ ID NO: 156023 - RNA, 20 nt, Human
ccuuccagcagaggcucugg

SEQ ID NO: 156024 - RNA, 21 nt, Human
ccuuccggacaggaccccagc

SEQ ID NO: 156025 - RNA, 19 nt, Human
ccuugcuguaaaacuuccc

SEQ ID NO: 156026 - RNA, 18 nt, Human
cgagccaggacaaggugg

SEQ ID NO: 156027 - RNA, 22 nt, Human
cgagccaggacaagguggccag

SEQ ID NO: 156028 - RNA, 23 nt, Human
cgccagaauacagaacaaaggag

SEQ ID NO: 156029 - RNA, 19 nt, Human
cgccgccgccgccgccgcc

SEQ ID NO: 156030 - RNA, 18 nt, Human
cgguuuccuuccacuccu

SEQ ID NO: 156031 - RNA, 21 nt, Human
cucacaguggccugcagagcc

SEQ ID NO: 156032 - RNA, 21 nt, Human
cuccaccacacagacggcccc

SEQ ID NO: 156033 - RNA, 21 nt, Human
cucugcucauccucuucccca

SEQ ID NO: 156034 - RNA, 24 nt, Human
cugaugaugaaacccaggaaaaac

SEQ ID NO: 156035 - RNA, 21 nt, Human
cugcaaaccacuucagaccac

SEQ ID NO: 156036 - RNA, 23 nt, Human
cugcaaaccacuucagaccacag

SEQ ID NO: 156037 - RNA, 21 nt, Human
cugcagccugccccccagauc

SEQ ID NO: 156038 - RNA, 19 nt, Human
cugcaguccuucaagccag

SEQ ID NO: 156039 - RNA, 20 nt, Human
cugcugccccuuccagcaga

SEQ ID NO: 156040 - RNA, 22 nt, Human
cugcugccccuuccagcagagg

SEQ ID NO: 156041 - RNA, 19 nt, Human
cuggccccagcagcaggaa

SEQ ID NO: 156042 - RNA, 18 nt, Human
cuuagauccaccagugag

SEQ ID NO: 156043 - RNA, 22 nt, Human
cuuucagggucaaggagggcug

SEQ ID NO: 156044 - RNA, 23 nt, Human
cuuugcuuccucauucucucuca

SEQ ID NO: 156045 - RNA, 21 nt, Human
gaacauaaccacacugccuca

SEQ ID NO: 156046 - RNA, 18 nt, Human
gaagcaccggcaccacag

SEQ ID NO: 156047 - RNA, 22 nt, Human
gacaaaugccacucacacccuc

SEQ ID NO: 156048 - RNA, 18 nt, Human
gaccagugacacuguggc

SEQ ID NO: 156049 - RNA, 21 nt, Human
gacccggggucuguggcgccg

SEQ ID NO: 156050 - RNA, 21 nt, Human
gagcacuucagaaacgccuga

SEQ ID NO: 156051 - RNA, 25 nt, Human
gaggcgcuccugcacccugcgagcc

SEQ ID NO: 156052 - RNA, 19 nt, Human
gaguccucugcagccugcc

SEQ ID NO: 156053 - RNA, 21 nt, Human
gauagaaagagccaucuggga

SEQ ID NO: 156054 - RNA, 21 nt, Human
gaugaugaaacccaggaaaaa

SEQ ID NO: 156055 - RNA, 24 nt, Human
gcaggcgccuugcuguaaaacuuc

SEQ ID NO: 156056 - RNA, 29 nt, Human
gccagaauacagaacaaaggagccugguc

SEQ ID NO: 156057 - RNA, 19 nt, Human
gccaggacaagguggccag

SEQ ID NO: 156058 - RNA, 21 nt, Human
gccaggacccaucuccgccag

SEQ ID NO: 156059 - RNA, 24 nt, Human
gccauaaccauggguugccggcgc

SEQ ID NO: 156060 - RNA, 26 nt, Human
gcgcagcucccagaaagagggaacgc

SEQ ID NO: 156061 - RNA, 21 nt, Human
gcgcagcucccagaaagaucc

SEQ ID NO: 156062 - RNA, 19 nt, Human
gcucugggccacccaccag

SEQ ID NO: 156063 - RNA, 19 nt, Human
gcugaggagggcgugcccc

SEQ ID NO: 156064 - RNA, 22 nt, Human
ggagaggaggcugaccugcaaa

SEQ ID NO: 156065 - RNA, 19 nt, Human
ggagaugaucuuuaaggaa

SEQ ID NO: 156066 - RNA, 21 nt, Human
ggagcacugcccagggagccc

SEQ ID NO: 156067 - RNA, 24 nt, Human
ggagccaucuuccucccucugcuc

SEQ ID NO: 156068 - RNA, 18 nt, Human
gggguugggggcggggaa

SEQ ID NO: 156069 - RNA, 19 nt, Human
gguaaggaagagaccuugu

SEQ ID NO: 156070 - RNA, 18 nt, Human
ggucccaccacacagacg

SEQ ID NO: 156071 - RNA, 18 nt, Human
uaaaaaccacgaaccagc

SEQ ID NO: 156072 - RNA, 18 nt, Human
uaaagggggucccaccac

SEQ ID NO: 156073 - RNA, 25 nt, Human
uaaauccucaaaaaucgcuggcccc

SEQ ID NO: 156074 - RNA, 19 nt, Human
uaacacaggauggggcucc

SEQ ID NO: 156075 - RNA, 21 nt, Human
uaagccagugacacaaggcca

SEQ ID NO: 156076 - RNA, 23 nt, Human
uagcacauaccaaaccucgggga

SEQ ID NO: 156077 - RNA, 23 nt, Human
uagcccuacaggugggugggagc

SEQ ID NO: 156078 - RNA, 21 nt, Human
uagcgccacacaccacacucu

SEQ ID NO: 156079 - RNA, 22 nt, Human
uagguuagaacagaaauaaaug

SEQ ID NO: 156080 - RNA, 19 nt, Human
uauauacacacacauauau

SEQ ID NO: 156081 - RNA, 23 nt, Human
ucaagaaacacgucaugggcuaa

SEQ ID NO: 156082 - RNA, 20 nt, Human
ucacagccucccauuguucu

SEQ ID NO: 156083 - RNA, 21 nt, Human
ucacugacacguuuccagaag

SEQ ID NO: 156084 - RNA, 24 nt, Human
ucagcacacgacuucuugaaagag

SEQ ID NO: 156085 - RNA, 21 nt, Human
ucagguagagggcaacuagaa

SEQ ID NO: 156086 - RNA, 21 nt, Human
uccaaaaaccacagauaacac

SEQ ID NO: 156087 - RNA, 18 nt, Human
uccacuccuccugcugcc

SEQ ID NO: 156088 - RNA, 23 nt, Human
uccagcagauuuuaaguucuggc

SEQ ID NO: 156089 - RNA, 21 nt, Human
ucccagggauucacugggaag

SEQ ID NO: 156090 - RNA, 21 nt, Human
uccccagaccgugcgcugccc

SEQ ID NO: 156091 - RNA, 21 nt, Human
uccccuacugccaccgugacc

SEQ ID NO: 156092 - RNA, 21 nt, Human
uccucaaaaaucgcuggcccc

SEQ ID NO: 156093 - RNA, 22 nt, Human
uccuuguuggaagcaccggcac

SEQ ID NO: 156094 - RNA, 21 nt, Human
ucugacccuauuccagcagau

SEQ ID NO: 156095 - RNA, 18 nt, Human
ucugcagagucgccacag

SEQ ID NO: 156096 - RNA, 19 nt, Human
ucugggccacccaccagca

SEQ ID NO: 156097 - RNA, 18 nt, Human
ugaaagagugaaccucca

SEQ ID NO: 156098 - RNA, 19 nt, Human
ugaaagagugaaccuccag

SEQ ID NO: 156099 - RNA, 21 nt, Human
ugaauguaaaaaccacgaacc

SEQ ID NO: 156100 - RNA, 23 nt, Human
ugacaaaugccacucacacccuc

SEQ ID NO: 156101 - RNA, 19 nt, Human
ugaccaggacaaaccugag

SEQ ID NO: 156102 - RNA, 18 nt, Human
ugaguuacagguugcuga

SEQ ID NO: 156103 - RNA, 26 nt, Human
ugaugaugaaacccaggaaaaacacc

SEQ ID NO: 156104 - RNA, 21 nt, Human
ugcaguccuucaagccagugu

SEQ ID NO: 156105 - RNA, 21 nt, Human
ugccaauggggagaguucccu

SEQ ID NO: 156106 - RNA, 23 nt, Human
ugccccuuccagcagaggcucug

SEQ ID NO: 156107 - RNA, 20 nt, Human
ugccuaggaaccuugggagc

SEQ ID NO: 156108 - RNA, 18 nt, Human
ugcugggaacauaaccac

SEQ ID NO: 156109 - RNA, 21 nt, Human
ugcugggguugggggcgggga

SEQ ID NO: 156110 - RNA, 22 nt, Human
uggaagcaccggcaccacagcc

SEQ ID NO: 156111 - RNA, 22 nt, Human
uggccaggggcggcccacagac

SEQ ID NO: 156112 - RNA, 23 nt, Human
uggccaggggcggcccacagaca

SEQ ID NO: 156113 - RNA, 19 nt, Human
uggcggcggccggguccgg

SEQ ID NO: 156114 - RNA, 22 nt, Human
uggcugacuucaagauaaaggc

SEQ ID NO: 156115 - RNA, 21 nt, Human
ugggaguggcgucuucagccc

SEQ ID NO: 156116 - RNA, 24 nt, Human
ugggaguggcgucuucagccccua

SEQ ID NO: 156117 - RNA, 22 nt, Human
uggugagcccuggccugaggca

SEQ ID NO: 156118 - RNA, 24 nt, Human
uguaaaacuucccggccagccggg

SEQ ID NO: 156119 - RNA, 25 nt, Human
uguaaaacuucccggccagccgggu

SEQ ID NO: 156120 - RNA, 20 nt, Human
ugugcauguauuuauauaca

SEQ ID NO: 156121 - RNA, 26 nt, Human
uucaaaacaguacuugaagaggaccc

SEQ ID NO: 156122 - RNA, 19 nt, Human
uuccacuccuccugcugcc

SEQ ID NO: 156123 - RNA, 18 nt, Human
uuccccccacaaacuagg

SEQ ID NO: 156124 - RNA, 23 nt, Human
aaacagcagaaucucaucccucg

SEQ ID NO: 156125 - RNA, 21 nt, Human
aaacucagauaaggcacggca

SEQ ID NO: 156126 - RNA, 22 nt, Human
aacacacaacuucagaaaagaa

SEQ ID NO: 156127 - RNA, 20 nt, Human
aaggcccucagaagaacuga

SEQ ID NO: 156128 - RNA, 20 nt, Human
aaguucuggaggccggcgcu

SEQ ID NO: 156129 - RNA, 20 nt, Human
acaaaauccuuacugacacu

SEQ ID NO: 156130 - RNA, 28 nt, Human
acacaacuucagaaaagaagggaacgcc

SEQ ID NO: 156131 - RNA, 22 nt, Human
acaguacuagagucaacagccg

SEQ ID NO: 156132 - RNA, 20 nt, Human
acaugauugucucagugaug

SEQ ID NO: 156133 - RNA, 20 nt, Human
accacagcuauucucuuguc

SEQ ID NO: 156134 - RNA, 19 nt, Human
acuaucaucuauauucuuu

SEQ ID NO: 156135 - RNA, 22 nt, Human
acucuuauggucugacaaaggu

SEQ ID NO: 156136 - RNA, 19 nt, Human
acugcuguguuauuucauc

SEQ ID NO: 156137 - RNA, 24 nt, Human
agaaaaaacuaauucaauugugaa

SEQ ID NO: 156138 - RNA, 24 nt, Human
agaaaauacgcacauagggaguaa

SEQ ID NO: 156139 - RNA, 18 nt, Human
agaaacccgccacagugg

SEQ ID NO: 156140 - RNA, 24 nt, Human
agacaccaaaaaguaaaccuucuu

SEQ ID NO: 156141 - RNA, 18 nt, Human
agagcucauuuuguuuca

SEQ ID NO: 156142 - RNA, 19 nt, Human
agcucggcgcagggggcag

SEQ ID NO: 156143 - RNA, 21 nt, Human
aguguggaaaugaaaaaguga

SEQ ID NO: 156144 - RNA, 23 nt, Human
aguguggaaaugaaaaagugagg

SEQ ID NO: 156145 - RNA, 18 nt, Human
aucugaacuggcuugaga

SEQ ID NO: 156146 - RNA, 20 nt, Human
augagacaccaaaaaguaaa

SEQ ID NO: 156147 - RNA, 21 nt, Human
caaaaaguaaaccuucuuuac

SEQ ID NO: 156148 - RNA, 19 nt, Human
caacuugaggaaacagcaa

SEQ ID NO: 156149 - RNA, 22 nt, Human
caaugugcuaaaauucaaagua

SEQ ID NO: 156150 - RNA, 18 nt, Human
cacaaaauuaaugaagaa

SEQ ID NO: 156151 - RNA, 23 nt, Human
cacaacgguggacacagcauacc

SEQ ID NO: 156152 - RNA, 25 nt, Human
cacggcacaugaauuugugcacgug

SEQ ID NO: 156153 - RNA, 22 nt, Human
cacuauccaggcauugcuaccu

SEQ ID NO: 156154 - RNA, 20 nt, Human
cacuggagaguuucuaccuc

SEQ ID NO: 156155 - RNA, 18 nt, Human
cacuugacauccaugcuu

SEQ ID NO: 156156 - RNA, 18 nt, Human
cagcaacaucugaacugg

SEQ ID NO: 156157 - RNA, 20 nt, Human
cagccgcggcgcuucuggga

SEQ ID NO: 156158 - RNA, 21 nt, Human
cagcggcagauagcaucugag

SEQ ID NO: 156159 - RNA, 24 nt, Human
cagcucccaccguucuguuuggua

SEQ ID NO: 156160 - RNA, 19 nt, Human
cauauaauacauuagugug

SEQ ID NO: 156161 - RNA, 23 nt, Human
caugaauuugugcacgugcugcc

SEQ ID NO: 156162 - RNA, 25 nt, Human
ccaaaaggaagaaaaaacuaauuca

SEQ ID NO: 156163 - RNA, 22 nt, Human
ccgcggcgcuucugggagugga

SEQ ID NO: 156164 - RNA, 18 nt, Human
ccucagggugacaggaag

SEQ ID NO: 156165 - RNA, 19 nt, Human
ccucugcaggggaaagcuc

SEQ ID NO: 156166 - RNA, 22 nt, Human
cgcaaaccacagcuauucucuu

SEQ ID NO: 156167 - RNA, 20 nt, Human
cggggcuuucuuuuuuuuuu

SEQ ID NO: 156168 - RNA, 23 nt, Human
cucggggcuuucuuuuccuaagg

SEQ ID NO: 156169 - RNA, 22 nt, Human
cugaccacuuuuggagaaacuc

SEQ ID NO: 156170 - RNA, 22 nt, Human
cuggagaguuucuaccucgccc

SEQ ID NO: 156171 - RNA, 19 nt, Human
cuguuugcuucaagccaaa

SEQ ID NO: 156172 - RNA, 20 nt, Human
cuuugcgcccagcgcuccuu

SEQ ID NO: 156173 - RNA, 23 nt, Human
cuuuuggucuugacaacauuauc

SEQ ID NO: 156174 - RNA, 19 nt, Human
gauuguguuuguuagauga

SEQ ID NO: 156175 - RNA, 23 nt, Human
gcaacacacaacuucagaaaaga

SEQ ID NO: 156176 - RNA, 18 nt, Human
gcagaguacaaaaacaua

SEQ ID NO: 156177 - RNA, 23 nt, Human
ggcuuucuuuuuuuuuuuuuuuu

SEQ ID NO: 156178 - RNA, 22 nt, Human
ggggcaggcgccuggccgcugc

SEQ ID NO: 156179 - RNA, 18 nt, Human
ggugacaggaagaaagag

SEQ ID NO: 156180 - RNA, 19 nt, Human
ggugacaggaagaaagaga

SEQ ID NO: 156181 - RNA, 24 nt, Human
uaaaaaaaaauccauuaucuacau

SEQ ID NO: 156182 - RNA, 24 nt, Human
uaaacacaaaauuaaugaagaaaa

SEQ ID NO: 156183 - RNA, 21 nt, Human
uaauucacaaaugacuauuuc

SEQ ID NO: 156184 - RNA, 20 nt, Human
uacaguaaggccaagauaaa

SEQ ID NO: 156185 - RNA, 21 nt, Human
uacauuaguguggaaaugaaa

SEQ ID NO: 156186 - RNA, 22 nt, Human
uaccucgccccaaacucggagc

SEQ ID NO: 156187 - RNA, 25 nt, Human
uacgcgcgggggcucucaggcgcuc

SEQ ID NO: 156188 - RNA, 21 nt, Human
uacuagagucaacagcuguuc

SEQ ID NO: 156189 - RNA, 19 nt, Human
uacuguacuugccauguug

SEQ ID NO: 156190 - RNA, 18 nt, Human
uagcaaaccuccauuccu

SEQ ID NO: 156191 - RNA, 27 nt, Human
uagcaaaccuccauuccugacauaguu

SEQ ID NO: 156192 - RNA, 20 nt, Human
ucaaagcugguguuuuuucc

SEQ ID NO: 156193 - RNA, 24 nt, Human
ucaaaguacuguacuugccauguu

SEQ ID NO: 156194 - RNA, 21 nt, Human
ucaagccaaaaggaagaaaaa

SEQ ID NO: 156195 - RNA, 21 nt, Human
ucacaaaugacuauuucuagc

SEQ ID NO: 156196 - RNA, 22 nt, Human
ucaugcuucacuauccaggcau

SEQ ID NO: 156197 - RNA, 24 nt, Human
uccccagauugaugccugucaugu

SEQ ID NO: 156198 - RNA, 20 nt, Human
uccccaggaagaaacccgcc

SEQ ID NO: 156199 - RNA, 21 nt, Human
ucccuggucacagagcagcug

SEQ ID NO: 156200 - RNA, 22 nt, Human
ucccuggucacagagcagcugu

SEQ ID NO: 156201 - RNA, 19 nt, Human
uccuucgaauuuucugggu

SEQ ID NO: 156202 - RNA, 18 nt, Human
ucuguuugguaacagcuu

SEQ ID NO: 156203 - RNA, 18 nt, Human
ucuuuuuuuuuuuuuuuu

SEQ ID NO: 156204 - RNA, 26 nt, Human
ucuuuuuuuuuuuuuuuuuuuuuuug

SEQ ID NO: 156205 - RNA, 18 nt, Human
ugaaaaagugagguggua

SEQ ID NO: 156206 - RNA, 18 nt, Human
ugaaaagguuaaaaaugg

SEQ ID NO: 156207 - RNA, 18 nt, Human
ugaggaaacagcaacauc

SEQ ID NO: 156208 - RNA, 18 nt, Human
ugaggaaacagcaacauc

SEQ ID NO: 156209 - RNA, 19 nt, Human
ugaggugguaggagagcuc

SEQ ID NO: 156210 - RNA, 20 nt, Human
ugaggugguaggagagcuca

SEQ ID NO: 156211 - RNA, 18 nt, Human
ugcagccgcggcgcuucu

SEQ ID NO: 156212 - RNA, 23 nt, Human
ugcaggaaaaaauuuuagaaaac

SEQ ID NO: 156213 - RNA, 24 nt, Human
ugcgcagccuuguaggucugccca

SEQ ID NO: 156214 - RNA, 22 nt, Human
ugcuuuuggucuugacaacauu

SEQ ID NO: 156215 - RNA, 22 nt, Human
uggagcgccucugcaggggaaa

SEQ ID NO: 156216 - RNA, 19 nt, Human
uggcaaugaaccuuccuuc

SEQ ID NO: 156217 - RNA, 24 nt, Human
uggcagacacauaacgcugugcua

SEQ ID NO: 156218 - RNA, 22 nt, Human
ugggaagaagcauuugaauagu

SEQ ID NO: 156219 - RNA, 21 nt, Human
ugucucagugauguacauauu

SEQ ID NO: 156220 - RNA, 19 nt, Human
uguggcagacacauaacgc

SEQ ID NO: 156221 - RNA, 22 nt, Human
uucacuauccaggcauugcuac

SEQ ID NO: 156222 - RNA, 23 nt, Human
uucaucaaggcccucagaagaac

SEQ ID NO: 156223 - RNA, 20 nt, Human
uugaaaaugcuaacaacuga

SEQ ID NO: 156224 - RNA, 18 nt, Human
uugagauguuugcacagc

SEQ ID NO: 156225 - RNA, 21 nt, Human
uugcuaccuuucaauaucauu

SEQ ID NO: 156226 - RNA, 23 nt, Human
uugugcacgugcugccucaugcu

SEQ ID NO: 156227 - RNA, 20 nt, Human
uuuacaagaaaauuccucca

SEQ ID NO: 156228 - RNA, 19 nt, Human
uuuauacaguaaggccaag

SEQ ID NO: 156229 - RNA, 22 nt, Human
uuugcuguauuggagaagcugu

SEQ ID NO: 156230 - RNA, 22 nt, Human
uuugugggaagaagcauuugaa

SEQ ID NO: 156231 - RNA, 26 nt, Human
uuuuuuuuuuuuuuuuuuugguuuuu

SEQ ID NO: 156232 - RNA, 28 nt, Human
uuuuuuuuuuuuuuuuuuuuuuuggggg

SEQ ID NO: 156233 - RNA, 21 nt, Human
aaaaaaccaaaccaaaccaac

SEQ ID NO: 156234 - RNA, 22 nt, Human
aaaaaaccaaaccaaaccaacg

SEQ ID NO: 156235 - RNA, 19 nt, Human
aaaaagaagacaagacaaa

SEQ ID NO: 156236 - RNA, 22 nt, Human
aaaccaaaccaacgacuaagaa

SEQ ID NO: 156237 - RNA, 23 nt, Human
aaaccaacgacuaagaaacccag

SEQ ID NO: 156238 - RNA, 23 nt, Human
aaagcacccauuccuucccagca

SEQ ID NO: 156239 - RNA, 22 nt, Human
aagaaacccagccacacaggua

SEQ ID NO: 156240 - RNA, 22 nt, Human
aagcaauagucuuuucaacagc

SEQ ID NO: 156241 - RNA, 18 nt, Human
aagcacccauuccuuccc

SEQ ID NO: 156242 - RNA, 21 nt, Human
aagucaaauacuccgaagcca

SEQ ID NO: 156243 - RNA, 20 nt, Human
acaagacaaacccauccccu

SEQ ID NO: 156244 - RNA, 21 nt, Human
accaggcaccccccaaaucag

SEQ ID NO: 156245 - RNA, 29 nt, Human
accaggcaccccccaaaucagcaauuccu

SEQ ID NO: 156246 - RNA, 19 nt, Human
acccauccccuccucauca

SEQ ID NO: 156247 - RNA, 25 nt, Human
acccauuccuucccagcaucccccu

SEQ ID NO: 156248 - RNA, 20 nt, Human
acugccuuccucucuaaugu

SEQ ID NO: 156249 - RNA, 22 nt, Human
agacaaacccauccccuccuca

SEQ ID NO: 156250 - RNA, 21 nt, Human
agcacccauuccuucccagca

SEQ ID NO: 156251 - RNA, 19 nt, Human
agguggggaaggcgagggg

SEQ ID NO: 156252 - RNA, 19 nt, Human
agucaaauacuccgaagcc

SEQ ID NO: 156253 - RNA, 21 nt, Human
agucuuacagaagagucuaga

SEQ ID NO: 156254 - RNA, 19 nt, Human
auaccaguucaaaaaacca

SEQ ID NO: 156255 - RNA, 21 nt, Human
auagagugcuuacauuagaac

SEQ ID NO: 156256 - RNA, 22 nt, Human
caaagucaaauacuccgaagcc

SEQ ID NO: 156257 - RNA, 20 nt, Human
caagacaaacccauccccuc

SEQ ID NO: 156258 - RNA, 24 nt, Human
caagacaaacccauccccuccuca

SEQ ID NO: 156259 - RNA, 23 nt, Human
cacaaagcacccauuccuuccca

SEQ ID NO: 156260 - RNA, 19 nt, Human
cacagguacaagagcauaa

SEQ ID NO: 156261 - RNA, 25 nt, Human
cacagguacaagagcauaauuccgg

SEQ ID NO: 156262 - RNA, 20 nt, Human
caccaggcaccccccaaauc

SEQ ID NO: 156263 - RNA, 24 nt, Human
caccccccaaaucagcaauuccuu

SEQ ID NO: 156264 - RNA, 19 nt, Human
cagcccuuuuccccaaagu

SEQ ID NO: 156265 - RNA, 23 nt, Human
cagcccuuuuccccaaagucaaa

SEQ ID NO: 156266 - RNA, 24 nt, Human
cauaccaguucaaaaaaccaaacc

SEQ ID NO: 156267 - RNA, 26 nt, Human
caucacaaagcacccauuccuuccca

SEQ ID NO: 156268 - RNA, 19 nt, Human
caucaccaggcacccccca

SEQ ID NO: 156269 - RNA, 21 nt, Human
caucaccaggcaccccccaaa

SEQ ID NO: 156270 - RNA, 24 nt, Human
cauccccuccucaucaccaggcac

SEQ ID NO: 156271 - RNA, 19 nt, Human
cauuccuucccagcauccc

SEQ ID NO: 156272 - RNA, 20 nt, Human
ccaaaccaaaccaacgacua

SEQ ID NO: 156273 - RNA, 18 nt, Human
ccauccccuccucaucac

SEQ ID NO: 156274 - RNA, 21 nt, Human
ccucaucaccaggcacccccc

SEQ ID NO: 156275 - RNA, 22 nt, Human
cgacuaagaaacccagccacac

SEQ ID NO: 156276 - RNA, 20 nt, Human
cuccucaucaccaggcaccc

SEQ ID NO: 156277 - RNA, 23 nt, Human
cugugagucuuacagaagagucu

SEQ ID NO: 156278 - RNA, 19 nt, Human
gaaccaccccacauaccag

SEQ ID NO: 156279 - RNA, 19 nt, Human
gaaggcgagggggucugag

SEQ ID NO: 156280 - RNA, 20 nt, Human
gacuaagaaacccagccaca

SEQ ID NO: 156281 - RNA, 23 nt, Human
gacuaagaaacccagccacacag

SEQ ID NO: 156282 - RNA, 19 nt, Human
gagacuaguccauaaauua

SEQ ID NO: 156283 - RNA, 21 nt, Human
gcaauagucuuuucaacagcu

SEQ ID NO: 156284 - RNA, 23 nt, Human
gccacacagguacaagagcauaa

SEQ ID NO: 156285 - RNA, 20 nt, Human
ggagguggggaaggcgaggg

SEQ ID NO: 156286 - RNA, 21 nt, Human
ggagguggggaaggcgagggg

SEQ ID NO: 156287 - RNA, 21 nt, Human
ggggagguggggaaggcgagg

SEQ ID NO: 156288 - RNA, 19 nt, Human
ggucucuggaguucucggu

SEQ ID NO: 156289 - RNA, 20 nt, Human
ggucucuggaguucucggug

SEQ ID NO: 156290 - RNA, 26 nt, Human
gguggggaaggcgagggggucugagg

SEQ ID NO: 156291 - RNA, 19 nt, Human
guucaaagaaugauugucc

SEQ ID NO: 156292 - RNA, 18 nt, Human
uaaaaacaaaaauaagca

SEQ ID NO: 156293 - RNA, 24 nt, Human
uaaaaacaaaaauaagcaauaguc

SEQ ID NO: 156294 - RNA, 18 nt, Human
uaaaaagaagacaagaca

SEQ ID NO: 156295 - RNA, 19 nt, Human
uagacuccgagccagcccu

SEQ ID NO: 156296 - RNA, 24 nt, Human
ucacuggacagucgucucggcugu

SEQ ID NO: 156297 - RNA, 22 nt, Human
uccaucacaaagcacccauucc

SEQ ID NO: 156298 - RNA, 23 nt, Human
uccgagccagcccuuuuccccaa

SEQ ID NO: 156299 - RNA, 20 nt, Human
uccucaucaccaggcacccc

SEQ ID NO: 156300 - RNA, 25 nt, Human
ucugagggugagauggcagguggag

SEQ ID NO: 156301 - RNA, 20 nt, Human
ugagauggucacuggacagu

SEQ ID NO: 156302 - RNA, 22 nt, Human
uggggaaggcgagggggucuga

SEQ ID NO: 156303 - RNA, 21 nt, Human
uggggagguggggaaggcgag

SEQ ID NO: 156304 - RNA, 23 nt, Human
uggggagguggggaaggcgaggg

SEQ ID NO: 156305 - RNA, 18 nt, Human
ugggucucuggaguucuc

SEQ ID NO: 156306 - RNA, 23 nt, Human
uucaaaaaaccaaaccaaaccaa

SEQ ID NO: 156307 - RNA, 18 nt, Human
uucaaagaaugauugucc

SEQ ID NO: 156308 - RNA, 22 nt, Human
uucaaagaaugauuguccccac

SEQ ID NO: 156309 - RNA, 24 nt, Human
uuccugguguccaacaucuggguc

SEQ ID NO: 156310 - RNA, 18 nt, Human
uucucgguggggaggugg

SEQ ID NO: 156311 - RNA, 19 nt, Human
acagagagagacagacaga

SEQ ID NO: 156312 - RNA, 19 nt, Human
agagaaagagagaaagaga

SEQ ID NO: 156313 - RNA, 23 nt, Human
agagacagagacacagagagaga

SEQ ID NO: 156314 - RNA, 27 nt, Human
agagauagagacagagacacagagaga

SEQ ID NO: 156315 - RNA, 18 nt, Human
agugaaaaggagcucaag

SEQ ID NO: 156316 - RNA, 23 nt, Human
cgaaacaggaacugagagaauau

SEQ ID NO: 156317 - RNA, 24 nt, Human
cuggccacaaugcaccaaaaggag

SEQ ID NO: 156318 - RNA, 21 nt, Human
gaaagagagagagauagagac

SEQ ID NO: 156319 - RNA, 20 nt, Human
gagacagacagagaaaguuc

SEQ ID NO: 156320 - RNA, 20 nt, Human
gagagaaagagagaaagaga

SEQ ID NO: 156321 - RNA, 20 nt, Human
gagggagagagagaaagaga

SEQ ID NO: 156322 - RNA, 21 nt, Human
ugagucugcuguagugucugg

SEQ ID NO: 156323 - RNA, 22 nt, Human
uggccacaaugcaccaaaagga

SEQ ID NO: 156324 - RNA, 24 nt, Human
aaaggagaagaaaagaaaaugaga

SEQ ID NO: 156325 - RNA, 25 nt, Human
aagaaaaugagagagcgcgcccagc

SEQ ID NO: 156326 - RNA, 22 nt, Human
aagcggggcggagggagaagcc

SEQ ID NO: 156327 - RNA, 24 nt, Human
aagcggggcggagggagaagccgg

SEQ ID NO: 156328 - RNA, 24 nt, Human
aaggagaagaaaagaaaaugagaa

SEQ ID NO: 156329 - RNA, 26 nt, Human
aagucagauucaaaccucagggcuga

SEQ ID NO: 156330 - RNA, 21 nt, Human
acaacaaauagcguacacaag

SEQ ID NO: 156331 - RNA, 19 nt, Human
acucauuugguguguacca

SEQ ID NO: 156332 - RNA, 18 nt, Human
agaaaagaaaaugagaga

SEQ ID NO: 156333 - RNA, 20 nt, Human
agaagaaaagaaaaugagag

SEQ ID NO: 156334 - RNA, 22 nt, Human
agaagaaaagaaaaugagagag

SEQ ID NO: 156335 - RNA, 23 nt, Human
aggagaagaaaagaaaaugagag

SEQ ID NO: 156336 - RNA, 20 nt, Human
agggggaggaggaaaggaag

SEQ ID NO: 156337 - RNA, 24 nt, Human
auauucccauuuccccucccauug

SEQ ID NO: 156338 - RNA, 19 nt, Human
auuucauccauuaagacaa

SEQ ID NO: 156339 - RNA, 23 nt, Human
caacaaaagaaagaaaaauugca

SEQ ID NO: 156340 - RNA, 22 nt, Human
caaccuccacagauuuuuaaaa

SEQ ID NO: 156341 - RNA, 22 nt, Human
caaguagaagcagcuuccuuca

SEQ ID NO: 156342 - RNA, 18 nt, Human
cacacauaaaaauucagu

SEQ ID NO: 156343 - RNA, 24 nt, Human
cacuaaaguuuaacuccauucagc

SEQ ID NO: 156344 - RNA, 18 nt, Human
cagacggagcaugugugu

SEQ ID NO: 156345 - RNA, 18 nt, Human
cagcaaccuccacagauu

SEQ ID NO: 156346 - RNA, 20 nt, Human
cagccgccgcagucgucacu

SEQ ID NO: 156347 - RNA, 19 nt, Human
caggggggaaaggagaaga

SEQ ID NO: 156348 - RNA, 21 nt, Human
ccaaacuuaaaaaagagacaa

SEQ ID NO: 156349 - RNA, 22 nt, Human
ccaaguagaagcagcuuccuuc

SEQ ID NO: 156350 - RNA, 18 nt, Human
cccaacaaaagaaagaaa

SEQ ID NO: 156351 - RNA, 20 nt, Human
cccgcagcucuuucccccuc

SEQ ID NO: 156352 - RNA, 21 nt, Human
cggggcggagggagaagccgg

SEQ ID NO: 156353 - RNA, 24 nt, Human
cuaaaguuuaacuccauucagcaa

SEQ ID NO: 156354 - RNA, 24 nt, Human
cuccgagggggaggaggaaaggaa

SEQ ID NO: 156355 - RNA, 26 nt, Human
gaacauucuguuugccaaacuuaaaa

SEQ ID NO: 156356 - RNA, 20 nt, Human
gagaagcggggcggagggag

SEQ ID NO: 156357 - RNA, 23 nt, Human
gccaaacuuaaaaaagagacaau

SEQ ID NO: 156358 - RNA, 18 nt, Human
ggaaaggagaagaaaaga

SEQ ID NO: 156359 - RNA, 26 nt, Human
gggagaagccggcuccgagggggagg

SEQ ID NO: 156360 - RNA, 21 nt, Human
gggaggaggaaaggaagagga

SEQ ID NO: 156361 - RNA, 23 nt, Human
gggggaggaggaaaggaagagga

SEQ ID NO: 156362 - RNA, 18 nt, Human
guagaagcagcuuccuuc

SEQ ID NO: 156363 - RNA, 24 nt, Human
gucacuccccggcuuuucccgcag

SEQ ID NO: 156364 - RNA, 25 nt, Human
uaaaaaauagaucuccggcuaaaga

SEQ ID NO: 156365 - RNA, 23 nt, Human
uaaaaaugacuaucucgucgccc

SEQ ID NO: 156366 - RNA, 22 nt, Human
uagcacuaaaguuuaacuccau

SEQ ID NO: 156367 - RNA, 25 nt, Human
uauuauauucccauuuccccuccca

SEQ ID NO: 156368 - RNA, 20 nt, Human
ucagauuuucuggguuaggu

SEQ ID NO: 156369 - RNA, 18 nt, Human
ucagcugcuaauaaaguc

SEQ ID NO: 156370 - RNA, 18 nt, Human
uccccggcuuuucccgca

SEQ ID NO: 156371 - RNA, 22 nt, Human
uccccucccauuggccucccca

SEQ ID NO: 156372 - RNA, 29 nt, Human
ucccgaagugucugucccagccgcgguuc

SEQ ID NO: 156373 - RNA, 24 nt, Human
uccgagggggaggaggaaaggaag

SEQ ID NO: 156374 - RNA, 19 nt, Human
uccugccacucccaaguag

SEQ ID NO: 156375 - RNA, 23 nt, Human
ucuacagagauuuuaaccaaagu

SEQ ID NO: 156376 - RNA, 25 nt, Human
ucuccugccacucccaaguagaagc

SEQ ID NO: 156377 - RNA, 21 nt, Human
ugaaaacaggacauccccuuc

SEQ ID NO: 156378 - RNA, 22 nt, Human
ugaggaauguuguugaccaccu

SEQ ID NO: 156379 - RNA, 20 nt, Human
uggaauuuuuauuccaaaua

SEQ ID NO: 156380 - RNA, 21 nt, Human
uggaauuuuuauuccaaauau

SEQ ID NO: 156381 - RNA, 25 nt, Human
uggccuccccaacaaaagaaagaaa

SEQ ID NO: 156382 - RNA, 21 nt, Human
ugucagacggagcaugugugu

SEQ ID NO: 156383 - RNA, 18 nt, Human
uguguaccagcaaccucc

SEQ ID NO: 156384 - RNA, 23 nt, Human
uguuugccaaacuuaaaaaagag

SEQ ID NO: 156385 - RNA, 19 nt, Human
uuccaauucagauuuucug

SEQ ID NO: 156386 - RNA, 20 nt, Human
uucccccucucuaaggcagc

SEQ ID NO: 156387 - RNA, 18 nt, Human
uuugaggaauguuguuga

SEQ ID NO: 156388 - RNA, 23 nt, Human
uuugccaaacuuaaaaaagagac

SEQ ID NO: 156389 - RNA, 25 nt, Human
uuuggacucauuugguguguaccag

SEQ ID NO: 156390 - RNA, 21 nt, Human
uuuucaucaauaauuuacaca

SEQ ID NO: 156391 - RNA, 21 nt, Human
uuuucccgcagcucuuucccc

SEQ ID NO: 156392 - RNA, 21 nt, Human
aaacacccacaaauccagcga

SEQ ID NO: 156393 - RNA, 22 nt, Human
aaacacccacaaauccagcgag

SEQ ID NO: 156394 - RNA, 24 nt, Human
aaacacccacaaauccagcgagcc

SEQ ID NO: 156395 - RNA, 21 nt, Human
aacagguguccagccuccauc

SEQ ID NO: 156396 - RNA, 22 nt, Human
aacagguguccagccuccaucc

SEQ ID NO: 156397 - RNA, 23 nt, Human
aagcuacaauuacaggcuagcgc

SEQ ID NO: 156398 - RNA, 21 nt, Human
aaguggagugggaagaagcgg

SEQ ID NO: 156399 - RNA, 23 nt, Human
acaggaaagcagauuacaccaau

SEQ ID NO: 156400 - RNA, 23 nt, Human
acagucucccauuucuguaacuc

SEQ ID NO: 156401 - RNA, 24 nt, Human
accccacuucuuccuucaugggac

SEQ ID NO: 156402 - RNA, 21 nt, Human
acccugaagcgauaagcaaca

SEQ ID NO: 156403 - RNA, 19 nt, Human
acuaucaucuggcugguuc

SEQ ID NO: 156404 - RNA, 18 nt, Human
acucgagcagcaguggug

SEQ ID NO: 156405 - RNA, 24 nt, Human
agacaggaaagcagauuacaccaa

SEQ ID NO: 156406 - RNA, 19 nt, Human
agcagcaguggugugagca

SEQ ID NO: 156407 - RNA, 21 nt, Human
aggagguaguaaggugaccug

SEQ ID NO: 156408 - RNA, 20 nt, Human
aggaugggaaacuggaggaa

SEQ ID NO: 156409 - RNA, 20 nt, Human
aggcuccccuaguccccacc

SEQ ID NO: 156410 - RNA, 21 nt, Human
aguaauuuggaacccacaguc

SEQ ID NO: 156411 - RNA, 23 nt, Human
aucacgcauaagucauccacccc

SEQ ID NO: 156412 - RNA, 22 nt, Human
aucuuauagaaugcaaggggaa

SEQ ID NO: 156413 - RNA, 24 nt, Human
augggacaacaaguggagugggaa

SEQ ID NO: 156414 - RNA, 19 nt, Human
auuugggugggaggagcuu

SEQ ID NO: 156415 - RNA, 18 nt, Human
cacaaugaauacaaacca

SEQ ID NO: 156416 - RNA, 22 nt, Human
cacacucuuucaguuugagccc

SEQ ID NO: 156417 - RNA, 21 nt, Human
cacaugaaauucuucugugug

SEQ ID NO: 156418 - RNA, 23 nt, Human
cacccacaaauccagcgagccag

SEQ ID NO: 156419 - RNA, 18 nt, Human
cacccuuucuacucaaca

SEQ ID NO: 156420 - RNA, 24 nt, Human
cagaacagguguccagccuccauc

SEQ ID NO: 156421 - RNA, 24 nt, Human
cagcgagccccuggcauuucaaau

SEQ ID NO: 156422 - RNA, 18 nt, Human
cagcucuugcuggcccca

SEQ ID NO: 156423 - RNA, 20 nt, Human
ccacacccuuucuacucaac

SEQ ID NO: 156424 - RNA, 21 nt, Human
ccacuuguaggcuccagggac

SEQ ID NO: 156425 - RNA, 23 nt, Human
ccagggaccacacuucacuuagc

SEQ ID NO: 156426 - RNA, 20 nt, Human
cccacaaauccagcgagcca

SEQ ID NO: 156427 - RNA, 22 nt, Human
ccccaccaccuugccccaucca

SEQ ID NO: 156428 - RNA, 21 nt, Human
cccuaaugcuucuucaauagc

SEQ ID NO: 156429 - RNA, 19 nt, Human
ccuaaguugauuccugagg

SEQ ID NO: 156430 - RNA, 23 nt, Human
ccucuaacccagaccacuuguag

SEQ ID NO: 156431 - RNA, 18 nt, Human
ccucugucuccccucuca

SEQ ID NO: 156432 - RNA, 23 nt, Human
ccugaagcgauaagcaacacugg

SEQ ID NO: 156433 - RNA, 23 nt, Human
ccugugcccaccuacccugaagc

SEQ ID NO: 156434 - RNA, 23 nt, Human
ccuugccucuauggggaauggaa

SEQ ID NO: 156435 - RNA, 21 nt, Human
cgaaagccaagacagugccgg

SEQ ID NO: 156436 - RNA, 21 nt, Human
cgagcagcaguggugugagca

SEQ ID NO: 156437 - RNA, 20 nt, Human
cgugguggggagggguugag

SEQ ID NO: 156438 - RNA, 21 nt, Human
cucacucgucugccucuccca

SEQ ID NO: 156439 - RNA, 25 nt, Human
cuccagggaccacacuucacuuagc

SEQ ID NO: 156440 - RNA, 22 nt, Human
cucucuucuucccccucccuca

SEQ ID NO: 156441 - RNA, 19 nt, Human
cugaaaacacccacaaauc

SEQ ID NO: 156442 - RNA, 22 nt, Human
cugcucacugaaggaagggugg

SEQ ID NO: 156443 - RNA, 21 nt, Human
cugcucccuacuguaacacuc

SEQ ID NO: 156444 - RNA, 22 nt, Human
cugcucccuacuguaacacucc

SEQ ID NO: 156445 - RNA, 23 nt, Human
cuggcccauuugggugggaggag

SEQ ID NO: 156446 - RNA, 22 nt, Human
cugggacaggagacugaccaca

SEQ ID NO: 156447 - RNA, 19 nt, Human
cuuaggccaaacucuaccc

SEQ ID NO: 156448 - RNA, 21 nt, Human
cuugccugcagcugcuaagcc

SEQ ID NO: 156449 - RNA, 19 nt, Human
cuuuccuucccccagccuu

SEQ ID NO: 156450 - RNA, 22 nt, Human
gaacugaagcugggacaggaga

SEQ ID NO: 156451 - RNA, 22 nt, Human
gaaggccugaaaacacccacaa

SEQ ID NO: 156452 - RNA, 23 nt, Human
gacaacaaguggagugggaagaa

SEQ ID NO: 156453 - RNA, 19 nt, Human
gagaauggcaggacacaac

SEQ ID NO: 156454 - RNA, 19 nt, Human
gagcagcaguggugugagc

SEQ ID NO: 156455 - RNA, 19 nt, Human
gagccccuggcauuucaaa

SEQ ID NO: 156456 - RNA, 19 nt, Human
gagugugugugcauguccc

SEQ ID NO: 156457 - RNA, 19 nt, Human
gcguagcuuuccuuccccc

SEQ ID NO: 156458 - RNA, 20 nt, Human
gcugccguuggggccuggga

SEQ ID NO: 156459 - RNA, 18 nt, Human
ggaagaagcggggcucug

SEQ ID NO: 156460 - RNA, 20 nt, Human
ggacaacaaguggaguggga

SEQ ID NO: 156461 - RNA, 21 nt, Human
ggaggagcuggagcacuggug

SEQ ID NO: 156462 - RNA, 21 nt, Human
ggagguaguaaggugaccugu

SEQ ID NO: 156463 - RNA, 20 nt, Human
ggaugcagauuucaggauca

SEQ ID NO: 156464 - RNA, 20 nt, Human
ggcaggacacaacagcagaa

SEQ ID NO: 156465 - RNA, 23 nt, Human
ggccaaucuauacccgcccacac

SEQ ID NO: 156466 - RNA, 21 nt, Human
gggaagaagcggggcucugag

SEQ ID NO: 156467 - RNA, 21 nt, Human
gggaauggaaggccugaaaac

SEQ ID NO: 156468 - RNA, 21 nt, Human
gggagggguugagacccaucu

SEQ ID NO: 156469 - RNA, 24 nt, Human
gggaguggguugggggguuucuca

SEQ ID NO: 156470 - RNA, 22 nt, Human
ggggaaguguuggguuuuacag

SEQ ID NO: 156471 - RNA, 21 nt, Human
gggguuucucagugugggaga

SEQ ID NO: 156472 - RNA, 21 nt, Human
ggugggaggagcuuucuguca

SEQ ID NO: 156473 - RNA, 20 nt, Human
gguggggagggguugagacc

SEQ ID NO: 156474 - RNA, 18 nt, Human
gucacaagccacaggacu

SEQ ID NO: 156475 - RNA, 20 nt, Human
gugcccaccuacccugaagc

SEQ ID NO: 156476 - RNA, 19 nt, Human
gugcugccguuggggccug

SEQ ID NO: 156477 - RNA, 21 nt, Human
gugcugccguuggggccuggg

SEQ ID NO: 156478 - RNA, 19 nt, Human
guggaaagcuacaauuaca

SEQ ID NO: 156479 - RNA, 22 nt, Human
guucucccucucuggccgggcc

SEQ ID NO: 156480 - RNA, 20 nt, Human
uaacuccuccucuucaucuu

SEQ ID NO: 156481 - RNA, 20 nt, Human
uaagaggucacaagccacag

SEQ ID NO: 156482 - RNA, 21 nt, Human
uacacagagaaggcuuucuca

SEQ ID NO: 156483 - RNA, 23 nt, Human
uacacagagaaggcuuucucaaa

SEQ ID NO: 156484 - RNA, 19 nt, Human
uaccaggcuccccuagucc

SEQ ID NO: 156485 - RNA, 22 nt, Human
uacccgcccacacccuuucuac

SEQ ID NO: 156486 - RNA, 21 nt, Human
uacccugaagcgauaagcaac

SEQ ID NO: 156487 - RNA, 18 nt, Human
uaccugcuucuucuccca

SEQ ID NO: 156488 - RNA, 21 nt, Human
uaugaguaauuuggaacccac

SEQ ID NO: 156489 - RNA, 18 nt, Human
ucaggaguugcugggugc

SEQ ID NO: 156490 - RNA, 21 nt, Human
ucauccaccccagccugugcu

SEQ ID NO: 156491 - RNA, 23 nt, Human
uccaggucuuaggaccacagagg

SEQ ID NO: 156492 - RNA, 26 nt, Human
ucccaggccaaucuauacccgcccac

SEQ ID NO: 156493 - RNA, 21 nt, Human
ucccuacuguaacacucccag

SEQ ID NO: 156494 - RNA, 22 nt, Human
ucugaaaacacuucuccaucua

SEQ ID NO: 156495 - RNA, 24 nt, Human
ucugccagugugcccugcacacgg

SEQ ID NO: 156496 - RNA, 21 nt, Human
ucuggcugguucucccucucu

SEQ ID NO: 156497 - RNA, 20 nt, Human
ucuguaacucucuguccugg

SEQ ID NO: 156498 - RNA, 19 nt, Human
ucuuucucugguuuucucc

SEQ ID NO: 156499 - RNA, 22 nt, Human
ugaaaacacccacaaauccagc

SEQ ID NO: 156500 - RNA, 26 nt, Human
ugaaaacacccacaaauccagcgagc

SEQ ID NO: 156501 - RNA, 23 nt, Human
ugaaaacacuucuccaucuaucu

SEQ ID NO: 156502 - RNA, 25 nt, Human
ugaaaacacuucuccaucuaucucc

SEQ ID NO: 156503 - RNA, 22 nt, Human
ugaagcugggacaggagacuga

SEQ ID NO: 156504 - RNA, 20 nt, Human
ugaaggaaggguggggucag

SEQ ID NO: 156505 - RNA, 23 nt, Human
ugaccugucuaccucugaguuca

SEQ ID NO: 156506 - RNA, 19 nt, Human
ugaguucagucugugcugc

SEQ ID NO: 156507 - RNA, 24 nt, Human
ugccagagaggguggcaccacagc

SEQ ID NO: 156508 - RNA, 20 nt, Human
ugccucugucuccccucuca

SEQ ID NO: 156509 - RNA, 18 nt, Human
ugcucccuacuguaacac

SEQ ID NO: 156510 - RNA, 18 nt, Human
ugcuggggccuggcccau

SEQ ID NO: 156511 - RNA, 18 nt, Human
ugcuguaaucuuauagaa

SEQ ID NO: 156512 - RNA, 18 nt, Human
ugcuuugcucugcaugaa

SEQ ID NO: 156513 - RNA, 18 nt, Human
ugggaacugccuaaguug

SEQ ID NO: 156514 - RNA, 18 nt, Human
ugggacaggagacugacc

SEQ ID NO: 156515 - RNA, 22 nt, Human
ugggacagguggucuaccugcu

SEQ ID NO: 156516 - RNA, 20 nt, Human
ugggggguuucucagugugg

SEQ ID NO: 156517 - RNA, 18 nt, Human
uggggucagucuagucuc

SEQ ID NO: 156518 - RNA, 24 nt, Human
ugguggggagggguugagacccau

SEQ ID NO: 156519 - RNA, 22 nt, Human
uguaacucucuguccugggaga

SEQ ID NO: 156520 - RNA, 21 nt, Human
uguacuuagaacccacacucu

SEQ ID NO: 156521 - RNA, 22 nt, Human
uguccagccuccaucccgagcc

SEQ ID NO: 156522 - RNA, 19 nt, Human
uguuggguuuuacagugug

SEQ ID NO: 156523 - RNA, 22 nt, Human
uuacaccaaucuuucuccucuc

SEQ ID NO: 156524 - RNA, 19 nt, Human
uucccagccagcccggcac

SEQ ID NO: 156525 - RNA, 25 nt, Human
uucccagccagcccggcacacccac

SEQ ID NO: 156526 - RNA, 19 nt, Human
uucucccacuucagauacc

SEQ ID NO: 156527 - RNA, 22 nt, Human
uugaaugccuguacuuagaacc

SEQ ID NO: 156528 - RNA, 22 nt, Human
uuuuggauucuaacacuuuauu

SEQ ID NO: 156529 - RNA, 22 nt, Human
aaggcagcuguuucagaggagg

SEQ ID NO: 156530 - RNA, 27 nt, Human
acuuugcaaauucagaauuucaaacug

SEQ ID NO: 156531 - RNA, 19 nt, Human
agaggaggggggaggaggu

SEQ ID NO: 156532 - RNA, 22 nt, Human
aggcagcuguuucagaggaggg

SEQ ID NO: 156533 - RNA, 19 nt, Human
cccccgcgcgccgccgccg

SEQ ID NO: 156534 - RNA, 22 nt, Human
cccccgcgcgccgccgccgccg

SEQ ID NO: 156535 - RNA, 20 nt, Human
cccgcgcgccgccgccgccg

SEQ ID NO: 156536 - RNA, 23 nt, Human
cccgcgcgccgccgccgccgccg

SEQ ID NO: 156537 - RNA, 19 nt, Human
cccgcgcgucgcccccgcg

SEQ ID NO: 156538 - RNA, 18 nt, Human
ccgccgccgccgccgccg

SEQ ID NO: 156539 - RNA, 19 nt, Human
ccgccgccgccgccgccgg

SEQ ID NO: 156540 - RNA, 25 nt, Human
ccgcgcgccgccgccgccgccgccg

SEQ ID NO: 156541 - RNA, 23 nt, Human
ccugaagcuaaggcagcuguuuc

SEQ ID NO: 156542 - RNA, 18 nt, Human
cgccgccgccgccggggc

SEQ ID NO: 156543 - RNA, 24 nt, Human
cuucugagucccaccgggugucgg

SEQ ID NO: 156544 - RNA, 18 nt, Human
ggaggggggaggagguag

SEQ ID NO: 156545 - RNA, 21 nt, Human
ucccgcgcgucgcccccgcgg

SEQ ID NO: 156546 - RNA, 25 nt, Human
ucgcccccgcgcgccgccgccgccg

SEQ ID NO: 156547 - RNA, 29 nt, Human
ucgcccccgcgcgccgccgccgccgccgg

SEQ ID NO: 156548 - RNA, 22 nt, Human
ugagaaggcaauaaaaaguuga

SEQ ID NO: 156549 - RNA, 22 nt, Human
ugccuucugagucccaccgggu

SEQ ID NO: 156550 - RNA, 23 nt, Human
uucagaauuucaaacugcauguu

SEQ ID NO: 156551 - RNA, 21 nt, Human
uucagaggaggggggaggagg

SEQ ID NO: 156552 - RNA, 19 nt, Human
uguggccgaguacuguguc

SEQ ID NO: 156553 - RNA, 19 nt, Human
aauggccccugggaaccca

SEQ ID NO: 156554 - RNA, 22 nt, Human
acaaacaccaagccccuucagc

SEQ ID NO: 156555 - RNA, 24 nt, Human
acucaacacccucucccagcaaau

SEQ ID NO: 156556 - RNA, 23 nt, Human
acuguggaggaagcaugcuggca

SEQ ID NO: 156557 - RNA, 18 nt, Human
auggucuucauccuccuc

SEQ ID NO: 156558 - RNA, 20 nt, Human
cacccucucccagcaaaucc

SEQ ID NO: 156559 - RNA, 21 nt, Human
ccaauggccccugggaaccca

SEQ ID NO: 156560 - RNA, 22 nt, Human
ccaauggccccugggaacccau

SEQ ID NO: 156561 - RNA, 22 nt, Human
cguguuacuguggaggaagcau

SEQ ID NO: 156562 - RNA, 23 nt, Human
cucaacacccucucccagcaaau

SEQ ID NO: 156563 - RNA, 18 nt, Human
cuuacaaacaccaagccc

SEQ ID NO: 156564 - RNA, 22 nt, Human
cuuacuugcugcaauucuuaau

SEQ ID NO: 156565 - RNA, 23 nt, Human
cuucagggacuccaauggccccu

SEQ ID NO: 156566 - RNA, 22 nt, Human
cuugugacaguuuguuuucuuc

SEQ ID NO: 156567 - RNA, 19 nt, Human
gugacaguuuguuuucuuc

SEQ ID NO: 156568 - RNA, 24 nt, Human
uacuguggaggaagcaugcuggca

SEQ ID NO: 156569 - RNA, 21 nt, Human
uccuggguccuucagggacuc

SEQ ID NO: 156570 - RNA, 21 nt, Human
ugaaaagaccuuguuggcuua

SEQ ID NO: 156571 - RNA, 23 nt, Human
uggcacagugaacucaacacccu

SEQ ID NO: 156572 - RNA, 19 nt, Human
uguggaggaagcaugcugg

SEQ ID NO: 156573 - RNA, 22 nt, Human
uguuauguaacauucucucuca

SEQ ID NO: 156574 - RNA, 20 nt, Human
uuaauaagggugcuuuucuu

SEQ ID NO: 156575 - RNA, 26 nt, Human
aaucuugccuuccaugccccagccac

SEQ ID NO: 156576 - RNA, 24 nt, Human
acaaucuugccuuccaugccccag

SEQ ID NO: 156577 - RNA, 23 nt, Human
caccaaggagggaaagaugaguc

SEQ ID NO: 156578 - RNA, 25 nt, Human
caccaaggagggaaagaugaguccc

SEQ ID NO: 156579 - RNA, 24 nt, Human
gaguuccucgccauccuggcgcgg

SEQ ID NO: 156580 - RNA, 20 nt, Human
gcggagcuggccgcacuggg

SEQ ID NO: 156581 - RNA, 22 nt, Human
gcggagcuggccgcacuggggg

SEQ ID NO: 156582 - RNA, 19 nt, Human
uccagcugccuauccagga

SEQ ID NO: 156583 - RNA, 23 nt, Human
ucucacugcggaaucaccaagga

SEQ ID NO: 156584 - RNA, 22 nt, Human
aaccugaccccgagaaagggga

SEQ ID NO: 156585 - RNA, 20 nt, Human
aaucacagucuacugaccua

SEQ ID NO: 156586 - RNA, 20 nt, Human
acagucucaaaggcuuagaa

SEQ ID NO: 156587 - RNA, 22 nt, Human
acuacaagaggccaaaugccag

SEQ ID NO: 156588 - RNA, 23 nt, Human
acucuggagcccucugcaguccu

SEQ ID NO: 156589 - RNA, 21 nt, Human
acuuccucaaacggacucggg

SEQ ID NO: 156590 - RNA, 22 nt, Human
agagaugggugaaauauaauca

SEQ ID NO: 156591 - RNA, 20 nt, Human
agcaggcagccuucucugua

SEQ ID NO: 156592 - RNA, 23 nt, Human
agcauguuuuugaaauauguggg

SEQ ID NO: 156593 - RNA, 20 nt, Human
agguccugcaggcgcucccc

SEQ ID NO: 156594 - RNA, 18 nt, Human
aggugguuaaguuucccc

SEQ ID NO: 156595 - RNA, 18 nt, Human
auucaauagacuugagug

SEQ ID NO: 156596 - RNA, 20 nt, Human
caaaugaugucagcauccuc

SEQ ID NO: 156597 - RNA, 18 nt, Human
caagagagaaucaguggc

SEQ ID NO: 156598 - RNA, 26 nt, Human
cacacccuagacauaucagagggaaa

SEQ ID NO: 156599 - RNA, 21 nt, Human
caccuaagucaaagcaagagc

SEQ ID NO: 156600 - RNA, 22 nt, Human
cagaaaggguuaaaguaaggga

SEQ ID NO: 156601 - RNA, 21 nt, Human
cagccuugcaaauacauagca

SEQ ID NO: 156602 - RNA, 18 nt, Human
cagguauugagcaaaucu

SEQ ID NO: 156603 - RNA, 24 nt, Human
cagucuacugaccuaaaucacacc

SEQ ID NO: 156604 - RNA, 30 nt, Human
cauuucauuuuaaaauuggauauugggagg

SEQ ID NO: 156605 - RNA, 19 nt, Human
ccaaaugccaggguucauc

SEQ ID NO: 156606 - RNA, 22 nt, Human
cccccaguauacuuaucacugu

SEQ ID NO: 156607 - RNA, 19 nt, Human
ccuaagucaaagcaagagc

SEQ ID NO: 156608 - RNA, 20 nt, Human
ccugcaggcgcuccccucca

SEQ ID NO: 156609 - RNA, 21 nt, Human
ccugucugggucuucacaccu

SEQ ID NO: 156610 - RNA, 21 nt, Human
cgccucggggacuuccucaaa

SEQ ID NO: 156611 - RNA, 20 nt, Human
cuagagcccaaaucaugugc

SEQ ID NO: 156612 - RNA, 23 nt, Human
cuagagcccaaaucaugugcuau

SEQ ID NO: 156613 - RNA, 21 nt, Human
cuccugcugaucaggccacag

SEQ ID NO: 156614 - RNA, 20 nt, Human
cucuuaugagcuaugagagc

SEQ ID NO: 156615 - RNA, 21 nt, Human
cugcaguccuucuauauaucu

SEQ ID NO: 156616 - RNA, 23 nt, Human
cuuucuuaucuccuuguaggugg

SEQ ID NO: 156617 - RNA, 20 nt, Human
gaggucucaacaugggugau

SEQ ID NO: 156618 - RNA, 21 nt, Human
gcaaauacauagcaggcagcc

SEQ ID NO: 156619 - RNA, 24 nt, Human
gcaaauacauagcaggcagccuuc

SEQ ID NO: 156620 - RNA, 21 nt, Human
gcaguccuucuauauaucugg

SEQ ID NO: 156621 - RNA, 18 nt, Human
gcuauuugcaaggcugag

SEQ ID NO: 156622 - RNA, 19 nt, Human
ggagaugauuccugagaga

SEQ ID NO: 156623 - RNA, 24 nt, Human
gugacacauucuauaaaaugcauc

SEQ ID NO: 156624 - RNA, 25 nt, Human
guuuggaaaagcauguuuuugaaau

SEQ ID NO: 156625 - RNA, 19 nt, Human
uaaagagauaaauucuuca

SEQ ID NO: 156626 - RNA, 24 nt, Human
uaacuuuauuuuaagcuucuauua

SEQ ID NO: 156627 - RNA, 23 nt, Human
uaaguuucccacaaaugcaauuu

SEQ ID NO: 156628 - RNA, 20 nt, Human
uaauacaaaugaugucagca

SEQ ID NO: 156629 - RNA, 22 nt, Human
uacaaaugaugucagcauccuc

SEQ ID NO: 156630 - RNA, 24 nt, Human
uauaaaaugcaucacaaaacuaca

SEQ ID NO: 156631 - RNA, 19 nt, Human
uaucuggucacuagauccg

SEQ ID NO: 156632 - RNA, 23 nt, Human
uauuuggagauguagccauuugu

SEQ ID NO: 156633 - RNA, 19 nt, Human
ucacauggaggguagaacc

SEQ ID NO: 156634 - RNA, 18 nt, Human
ucaggccacagugugaca

SEQ ID NO: 156635 - RNA, 18 nt, Human
ucccugguaagagagccc

SEQ ID NO: 156636 - RNA, 24 nt, Human
uccuuagccaagacuacaagaggc

SEQ ID NO: 156637 - RNA, 21 nt, Human
ucuaacaagguaaaucuaaaa

SEQ ID NO: 156638 - RNA, 21 nt, Human
ucugcaguccugucugggucu

SEQ ID NO: 156639 - RNA, 27 nt, Human
ucugugguugggucagaaccggggucc

SEQ ID NO: 156640 - RNA, 22 nt, Human
ugaaauauaaucacuaacuaaa

SEQ ID NO: 156641 - RNA, 20 nt, Human
ugaaauaugugggaucucca

SEQ ID NO: 156642 - RNA, 24 nt, Human
ugaccuaaaucacacccuagacau

SEQ ID NO: 156643 - RNA, 21 nt, Human
ugagagcuuaauuaaagcuaa

SEQ ID NO: 156644 - RNA, 22 nt, Human
ugagcaaaucucccugguaaga

SEQ ID NO: 156645 - RNA, 24 nt, Human
ugaggucucaacaugggugaugug

SEQ ID NO: 156646 - RNA, 20 nt, Human
ugccaagcugaggucucaac

SEQ ID NO: 156647 - RNA, 23 nt, Human
ugcuuggcugcaggugcaaaaug

SEQ ID NO: 156648 - RNA, 25 nt, Human
ugggaaaaauauucucacauggagg

SEQ ID NO: 156649 - RNA, 26 nt, Human
uggggaaucugaagucuuguuuuaaa

SEQ ID NO: 156650 - RNA, 18 nt, Human
ugugaugauaaaugauga

SEQ ID NO: 156651 - RNA, 19 nt, Human
uuaaaugaggccagguauu

SEQ ID NO: 156652 - RNA, 23 nt, Human
uuaaaugaggccagguauugagc

SEQ ID NO: 156653 - RNA, 23 nt, Human
uucauuuuaaaauuggauauugg

SEQ ID NO: 156654 - RNA, 21 nt, Human
uuggauauugggagacuuggc

SEQ ID NO: 156655 - RNA, 21 nt, Human
uugggcuuauuauaucucuga

SEQ ID NO: 156656 - RNA, 22 nt, Human
uugggucagaacuagcacuggc

SEQ ID NO: 156657 - RNA, 22 nt, Human
uuuggcaggcauuugcuuggcu

SEQ ID NO: 156658 - RNA, 20 nt, Human
aacuuauuuccucaaaauua

SEQ ID NO: 156659 - RNA, 24 nt, Human
aagcaaggaaaaacuccgaaguuu

SEQ ID NO: 156660 - RNA, 19 nt, Human
uaagcaaggaaaaacuccg

SEQ ID NO: 156661 - RNA, 21 nt, Human
ugaaauguucagcacaaauaa

SEQ ID NO: 156662 - RNA, 21 nt, Human
agucacuuuuauugggaacca

SEQ ID NO: 156663 - RNA, 21 nt, Human
agucacuuuuauugggaacca

SEQ ID NO: 156664 - RNA, 20 nt, Human
caggagcccagaauaugaga

SEQ ID NO: 156665 - RNA, 20 nt, Human
caggagcccagaauaugaga

SEQ ID NO: 156666 - RNA, 21 nt, Human
ucgcugagagucacuuuuauu

SEQ ID NO: 156667 - RNA, 24 nt, Human
ucuuucacgggauugguuccagga

SEQ ID NO: 156668 - RNA, 24 nt, Human
ucuuucacgggauugguuccagga

SEQ ID NO: 156669 - RNA, 21 nt, Human
aaaauugaaaacacuagaacu

SEQ ID NO: 156670 - RNA, 19 nt, Human
aaacaugaucaguucacag

SEQ ID NO: 156671 - RNA, 23 nt, Human
aaacuuuucuuuuuaaccuccca

SEQ ID NO: 156672 - RNA, 24 nt, Human
aaagugcugggauuacaggcguga

SEQ ID NO: 156673 - RNA, 20 nt, Human
aacacuagaacuucuacgca

SEQ ID NO: 156674 - RNA, 22 nt, Human
aacuacuagauguguuuacacc

SEQ ID NO: 156675 - RNA, 23 nt, Human
aacuucuuuagcugacaggccuu

SEQ ID NO: 156676 - RNA, 19 nt, Human
aagugcugggauuacaggc

SEQ ID NO: 156677 - RNA, 19 nt, Human
aagugcugggauuacaggc

SEQ ID NO: 156678 - RNA, 26 nt, Human
aagugcugggauuacaggcgugagcc

SEQ ID NO: 156679 - RNA, 25 nt, Human
acacucagcaccuauuggaguggcc

SEQ ID NO: 156680 - RNA, 19 nt, Human
acaggugccugccaccacg

SEQ ID NO: 156681 - RNA, 21 nt, Human
acaguggcgcgaucucggcuc

SEQ ID NO: 156682 - RNA, 24 nt, Human
acccaguggaugggcauccagaag

SEQ ID NO: 156683 - RNA, 21 nt, Human
acccauaucaaaacagaggcu

SEQ ID NO: 156684 - RNA, 25 nt, Human
acccgccucagccucccaaagugcu

SEQ ID NO: 156685 - RNA, 19 nt, Human
acggguuucaccguguuag

SEQ ID NO: 156686 - RNA, 23 nt, Human
acggguuucaccguguuagccag

SEQ ID NO: 156687 - RNA, 19 nt, Human
acuacaggugccugccacc

SEQ ID NO: 156688 - RNA, 22 nt, Human
acugcacugcaaauaauauaug

SEQ ID NO: 156689 - RNA, 22 nt, Human
acuuuuauaaacuuuucuuuuu

SEQ ID NO: 156690 - RNA, 23 nt, Human
agaacugacauuucagaacaacu

SEQ ID NO: 156691 - RNA, 18 nt, Human
aggaaggggccuccggcg

SEQ ID NO: 156692 - RNA, 18 nt, Human
aggcagagcgcagggugc

SEQ ID NO: 156693 - RNA, 19 nt, Human
aguagagacggguuucacc

SEQ ID NO: 156694 - RNA, 18 nt, Human
aguagcugggacuacagg

SEQ ID NO: 156695 - RNA, 21 nt, Human
agucuccugccucagccuccc

SEQ ID NO: 156696 - RNA, 25 nt, Human
auaucagaacugacauuucagaaca

SEQ ID NO: 156697 - RNA, 24 nt, Human
auuuuuaguagagacggguuucac

SEQ ID NO: 156698 - RNA, 24 nt, Human
caaagugcugggauuacaggcgug

SEQ ID NO: 156699 - RNA, 22 nt, Human
caacuuucuauuuuguuuaaaa

SEQ ID NO: 156700 - RNA, 21 nt, Human
caagaaauaguaacccaaaug

SEQ ID NO: 156701 - RNA, 21 nt, Human
caagcccaaacuauggagucu

SEQ ID NO: 156702 - RNA, 22 nt, Human
cacauacaucacacucuaugca

SEQ ID NO: 156703 - RNA, 24 nt, Human
cacauacaucacacucuaugcaug

SEQ ID NO: 156704 - RNA, 19 nt, Human
caccaugaaauguucaggg

SEQ ID NO: 156705 - RNA, 23 nt, Human
cacccgccucagccucccaaagu

SEQ ID NO: 156706 - RNA, 19 nt, Human
cacccucucuccugacuuc

SEQ ID NO: 156707 - RNA, 18 nt, Human
caccgucaucucguccug

SEQ ID NO: 156708 - RNA, 18 nt, Human
caccguguuagccaggau

SEQ ID NO: 156709 - RNA, 24 nt, Human
caccguguuagccaggauggucuc

SEQ ID NO: 156710 - RNA, 19 nt, Human
caccuagcuauauccagaa

SEQ ID NO: 156711 - RNA, 22 nt, Human
cacgccagucuccugccucagc

SEQ ID NO: 156712 - RNA, 20 nt, Human
cacucuguacacucagcacc

SEQ ID NO: 156713 - RNA, 22 nt, Human
cacucuguacacucagcaccuu

SEQ ID NO: 156714 - RNA, 19 nt, Human
caggugccugccaccacgc

SEQ ID NO: 156715 - RNA, 21 nt, Human
caggugccugccaccacgccc

SEQ ID NO: 156716 - RNA, 23 nt, Human
caggugccugccaccacgcccgg

SEQ ID NO: 156717 - RNA, 18 nt, Human
caguggcgcgaucucggc

SEQ ID NO: 156718 - RNA, 20 nt, Human
cauacaucuacauauacaca

SEQ ID NO: 156719 - RNA, 22 nt, Human
cauauacacacauguaaguaug

SEQ ID NO: 156720 - RNA, 22 nt, Human
ccaaagugcugggauuacaggc

SEQ ID NO: 156721 - RNA, 22 nt, Human
ccaaagugcugggauuacaggc

SEQ ID NO: 156722 - RNA, 24 nt, Human
ccaaagugcugggauuacaggcgu

SEQ ID NO: 156723 - RNA, 22 nt, Human
ccacaagaaauaguaacccaaa

SEQ ID NO: 156724 - RNA, 20 nt, Human
ccaccacgcccggcuaauuu

SEQ ID NO: 156725 - RNA, 26 nt, Human
ccacccgccucagccucccaaagugc

SEQ ID NO: 156726 - RNA, 18 nt, Human
ccaccgcgccuggccugc

SEQ ID NO: 156727 - RNA, 18 nt, Human
ccaccgcgccuggccugc

SEQ ID NO: 156728 - RNA, 20 nt, Human
ccaccgcgccuggccugcuc

SEQ ID NO: 156729 - RNA, 21 nt, Human
cccaggcuggagcacaguggc

SEQ ID NO: 156730 - RNA, 23 nt, Human
cccgaguagcugggacuacaggu

SEQ ID NO: 156731 - RNA, 24 nt, Human
cccgaguagcugggacuacaggug

SEQ ID NO: 156732 - RNA, 18 nt, Human
cccucggcgagcgcugug

SEQ ID NO: 156733 - RNA, 18 nt, Human
cccuuggaauaacaccgu

SEQ ID NO: 156734 - RNA, 19 nt, Human
ccgccgcucgcaagccccu

SEQ ID NO: 156735 - RNA, 23 nt, Human
ccgccucagccucccaaagugcu

SEQ ID NO: 156736 - RNA, 24 nt, Human
ccucagccgccgcucgcaagcccc

SEQ ID NO: 156737 - RNA, 21 nt, Human
ccuccggcgugcagugagagu

SEQ ID NO: 156738 - RNA, 20 nt, Human
ccugaccucgugauccaccc

SEQ ID NO: 156739 - RNA, 23 nt, Human
ccugccucagccucccgaguagc

SEQ ID NO: 156740 - RNA, 18 nt, Human
ccuguacugcauuguuuu

SEQ ID NO: 156741 - RNA, 19 nt, Human
cgccuccuggguucacgcc

SEQ ID NO: 156742 - RNA, 24 nt, Human
cgugauccacccgccucagccucc

SEQ ID NO: 156743 - RNA, 21 nt, Human
cuacgcacagauaguacuaag

SEQ ID NO: 156744 - RNA, 24 nt, Human
cucagccucccgaguagcugggac

SEQ ID NO: 156745 - RNA, 22 nt, Human
cucauaaacaugaucaguucac

SEQ ID NO: 156746 - RNA, 24 nt, Human
cuccugaccucgugauccacccgc

SEQ ID NO: 156747 - RNA, 20 nt, Human
cucuguugcccaggcuggag

SEQ ID NO: 156748 - RNA, 19 nt, Human
cugccccgccucgggcugc

SEQ ID NO: 156749 - RNA, 23 nt, Human
cugccucagccucccgaguagcu

SEQ ID NO: 156750 - RNA, 23 nt, Human
cuggaguccuccaucgggggcgg

SEQ ID NO: 156751 - RNA, 23 nt, Human
gaagucuuucauggucauuaccu

SEQ ID NO: 156752 - RNA, 22 nt, Human
gaccucgugauccacccgccuc

SEQ ID NO: 156753 - RNA, 24 nt, Human
gaccucgugauccacccgccucag

SEQ ID NO: 156754 - RNA, 21 nt, Human
gagauggagucuugcucuguu

SEQ ID NO: 156755 - RNA, 18 nt, Human
gauuacaggcgugagcca

SEQ ID NO: 156756 - RNA, 22 nt, Human
gauuacaggcgugagccaccgc

SEQ ID NO: 156757 - RNA, 22 nt, Human
gauuacaggcgugagccaccgc

SEQ ID NO: 156758 - RNA, 19 nt, Human
gcagagcgcagggugccca

SEQ ID NO: 156759 - RNA, 19 nt, Human
gccuauucuauacugcacu

SEQ ID NO: 156760 - RNA, 23 nt, Human
gccucagccucccaaagugcugg

SEQ ID NO: 156761 - RNA, 19 nt, Human
gcgcggcgcugcuccggga

SEQ ID NO: 156762 - RNA, 20 nt, Human
gcgcggcgcugcuccgggag

SEQ ID NO: 156763 - RNA, 19 nt, Human
gcggagcgaggaaggggcc

SEQ ID NO: 156764 - RNA, 25 nt, Human
gcucuguugcccaggcuggagcaca

SEQ ID NO: 156765 - RNA, 20 nt, Human
ggacuggggcgcgcggucgc

SEQ ID NO: 156766 - RNA, 23 nt, Human
ggagucuugcucuguugcccagg

SEQ ID NO: 156767 - RNA, 19 nt, Human
gggaaucagagauuauuuu

SEQ ID NO: 156768 - RNA, 20 nt, Human
gggcggagcgaggaaggggc

SEQ ID NO: 156769 - RNA, 21 nt, Human
ggggacuaauagaauccucag

SEQ ID NO: 156770 - RNA, 21 nt, Human
ggggcggggcgggacuggggc

SEQ ID NO: 156771 - RNA, 22 nt, Human
ggggcgguuagcggggcggggc

SEQ ID NO: 156772 - RNA, 20 nt, Human
gggucggggagccggucuuc

SEQ ID NO: 156773 - RNA, 22 nt, Human
ggguuucaccguguuagccagg

SEQ ID NO: 156774 - RNA, 20 nt, Human
ggucucgaucuccugaccuc

SEQ ID NO: 156775 - RNA, 26 nt, Human
guaacccaaauguucaaacuucuuua

SEQ ID NO: 156776 - RNA, 24 nt, Human
gucuugcucuguugcccaggcugg

SEQ ID NO: 156777 - RNA, 24 nt, Human
gugauccacccgccucagccuccc

SEQ ID NO: 156778 - RNA, 20 nt, Human
uaaaaugcuaccauuuuuuc

SEQ ID NO: 156779 - RNA, 18 nt, Human
uaaccucccagcaguccc

SEQ ID NO: 156780 - RNA, 22 nt, Human
uaagaucaggguccaagcgacc

SEQ ID NO: 156781 - RNA, 20 nt, Human
uaagcagacugacaugauug

SEQ ID NO: 156782 - RNA, 27 nt, Human
uaauuuuuuuugcauuuuuaguagaga

SEQ ID NO: 156783 - RNA, 19 nt, Human
uacaagguccgccuccugg

SEQ ID NO: 156784 - RNA, 22 nt, Human
uacaggcgugagccaccgcgcc

SEQ ID NO: 156785 - RNA, 22 nt, Human
uacaggcgugagccaccgcgcc

SEQ ID NO: 156786 - RNA, 23 nt, Human
uacaggcgugagccaccgcgccu

SEQ ID NO: 156787 - RNA, 23 nt, Human
uacaggugccugccaccacgccc

SEQ ID NO: 156788 - RNA, 24 nt, Human
uacauauacacacauguaaguaug

SEQ ID NO: 156789 - RNA, 28 nt, Human
uacauauacacacauguaaguauguaua

SEQ ID NO: 156790 - RNA, 18 nt, Human
uacugcauuguuuucauu

SEQ ID NO: 156791 - RNA, 20 nt, Human
uaguagagacggguuucacc

SEQ ID NO: 156792 - RNA, 23 nt, Human
uaguagagacggguuucaccgug

SEQ ID NO: 156793 - RNA, 24 nt, Human
uaguagagacggguuucaccgugu

SEQ ID NO: 156794 - RNA, 20 nt, Human
uaguggccccagucucacug

SEQ ID NO: 156795 - RNA, 19 nt, Human
uauuacuguagcauuggca

SEQ ID NO: 156796 - RNA, 21 nt, Human
ucaaaauacacuuauuugcaa

SEQ ID NO: 156797 - RNA, 20 nt, Human
ucaauaaaguuugggugggg

SEQ ID NO: 156798 - RNA, 18 nt, Human
ucacccucucuccugacu

SEQ ID NO: 156799 - RNA, 24 nt, Human
ucaccguguuagccaggauggucu

SEQ ID NO: 156800 - RNA, 24 nt, Human
ucacuacaagguccgccuccuggg

SEQ ID NO: 156801 - RNA, 25 nt, Human
ucagcaccuauuggaguggccacag

SEQ ID NO: 156802 - RNA, 23 nt, Human
ucagccucccgaguagcugggac

SEQ ID NO: 156803 - RNA, 21 nt, Human
uccacccgccucagccuccca

SEQ ID NO: 156804 - RNA, 24 nt, Human
ucccaaagugcugggauuacaggc

SEQ ID NO: 156805 - RNA, 23 nt, Human
ucccgaguagcugggacuacagg

SEQ ID NO: 156806 - RNA, 24 nt, Human
ucccgaguagcugggacuacaggu

SEQ ID NO: 156807 - RNA, 19 nt, Human
ucccuuggaauaacaccgu

SEQ ID NO: 156808 - RNA, 24 nt, Human
uccuggguucacgccagucuccug

SEQ ID NO: 156809 - RNA, 19 nt, Human
ucgcaagccccucuggcuc

SEQ ID NO: 156810 - RNA, 24 nt, Human
ucuccugccucagccucccgagua

SEQ ID NO: 156811 - RNA, 18 nt, Human
ucuguugcccaggcugga

SEQ ID NO: 156812 - RNA, 22 nt, Human
ucuugcucuguugcccaggcug

SEQ ID NO: 156813 - RNA, 23 nt, Human
ucuugcucuguugcccaggcugg

SEQ ID NO: 156814 - RNA, 24 nt, Human
ucuugcucuguugcccaggcugga

SEQ ID NO: 156815 - RNA, 20 nt, Human
ugacagcucccauaaaaagc

SEQ ID NO: 156816 - RNA, 23 nt, Human
ugacagcucccauaaaaagcagg

SEQ ID NO: 156817 - RNA, 20 nt, Human
ugcagcucucaggaauagcc

SEQ ID NO: 156818 - RNA, 19 nt, Human
ugcauuguuuucauuaagu

SEQ ID NO: 156819 - RNA, 20 nt, Human
ugcauuguuuucauuaaguu

SEQ ID NO: 156820 - RNA, 20 nt, Human
ugccaguuucucauaaacau

SEQ ID NO: 156821 - RNA, 21 nt, Human
ugcccaggcuggagcacagug

SEQ ID NO: 156822 - RNA, 24 nt, Human
ugcccaggcuggagcacaguggcg

SEQ ID NO: 156823 - RNA, 24 nt, Human
ugccucagccucccgaguagcugg

SEQ ID NO: 156824 - RNA, 22 nt, Human
ugccuggaguccuccaucgggg

SEQ ID NO: 156825 - RNA, 24 nt, Human
ugccuucuuucguuguuuuuaaga

SEQ ID NO: 156826 - RNA, 24 nt, Human
ugcugggauuacaggcgugagcca

SEQ ID NO: 156827 - RNA, 27 nt, Human
ugcuggggugcggggaaagaguguuuu

SEQ ID NO: 156828 - RNA, 24 nt, Human
uggagcacaguggcgcgaucucgg

SEQ ID NO: 156829 - RNA, 24 nt, Human
uggagucuugcucuguugcccagg

SEQ ID NO: 156830 - RNA, 20 nt, Human
uggaugggcauccagaaguc

SEQ ID NO: 156831 - RNA, 18 nt, Human
uggcaauauucccuugga

SEQ ID NO: 156832 - RNA, 24 nt, Human
uggcgcgaucucggcucacuacaa

SEQ ID NO: 156833 - RNA, 21 nt, Human
ugggacuacaggugccugcca

SEQ ID NO: 156834 - RNA, 22 nt, Human
ugggacuacaggugccugccac

SEQ ID NO: 156835 - RNA, 24 nt, Human
ugggacuacaggugccugccacca

SEQ ID NO: 156836 - RNA, 18 nt, Human
ugggauuacaggcgugag

SEQ ID NO: 156837 - RNA, 19 nt, Human
ugggauuacaggcgugagc

SEQ ID NO: 156838 - RNA, 21 nt, Human
ugggauuacaggcgugagcca

SEQ ID NO: 156839 - RNA, 22 nt, Human
ugggauuacaggcgugagccac

SEQ ID NO: 156840 - RNA, 23 nt, Human
ugggauuacaggcgugagccacc

SEQ ID NO: 156841 - RNA, 24 nt, Human
ugggauuacaggcgugagccaccg

SEQ ID NO: 156842 - RNA, 21 nt, Human
uggggcgcgcggucgcgcggg

SEQ ID NO: 156843 - RNA, 21 nt, Human
uggggugcggggaaagagugu

SEQ ID NO: 156844 - RNA, 21 nt, Human
uguaaguauguauaugucacc

SEQ ID NO: 156845 - RNA, 18 nt, Human
uguacugcauuguuuuca

SEQ ID NO: 156846 - RNA, 21 nt, Human
ugucuggggcgguuagcgggg

SEQ ID NO: 156847 - RNA, 20 nt, Human
ugugaggcucagcaggaagg

SEQ ID NO: 156848 - RNA, 18 nt, Human
ugugcauacaucuacaua

SEQ ID NO: 156849 - RNA, 22 nt, Human
ugugugcauacaucuacauaua

SEQ ID NO: 156850 - RNA, 26 nt, Human
ugugugcauacaucuacauauacaca

SEQ ID NO: 156851 - RNA, 18 nt, Human
uuaccuccuaggauauca

SEQ ID NO: 156852 - RNA, 21 nt, Human
uuaguagagacggguuucacc

SEQ ID NO: 156853 - RNA, 23 nt, Human
uuaguagagacggguuucaccgu

SEQ ID NO: 156854 - RNA, 24 nt, Human
uuaguagagacggguuucaccgug

SEQ ID NO: 156855 - RNA, 22 nt, Human
uucauggucauuaccuccuagg

SEQ ID NO: 156856 - RNA, 21 nt, Human
uugcauauuaaaucagggaau

SEQ ID NO: 156857 - RNA, 23 nt, Human
uugugugaaacauauuuauuaca

SEQ ID NO: 156858 - RNA, 24 nt, Human
uuuaguagagacggguuucaccgu

SEQ ID NO: 156859 - RNA, 19 nt, Human
uuucaccguguuagccagg

SEQ ID NO: 156860 - RNA, 18 nt, Human
uuuucaucuguuuccaua

SEQ ID NO: 156861 - RNA, 21 nt, Human
uuuuugcauuuuuaguagaga

SEQ ID NO: 156862 - RNA, 21 nt, Human
uuuuuugcauuuuuaguagag

SEQ ID NO: 156863 - RNA, 24 nt, Human
uuuuuugcauuuuuaguagagacg

SEQ ID NO: 156864 - RNA, 19 nt, Human
ccgggcgcgcggggaaucc

SEQ ID NO: 156865 - RNA, 24 nt, Human
ccuggaagccccgacgccgggcgc

SEQ ID NO: 156866 - RNA, 18 nt, Human
cgccgggcgcgcggggaa

SEQ ID NO: 156867 - RNA, 22 nt, Human
cugcugcgcgccuccccagggc

SEQ ID NO: 156868 - RNA, 22 nt, Human
gccgauucgaaacucagagcuc

SEQ ID NO: 156869 - RNA, 19 nt, Human
ucugcugcgcgccucccca

SEQ ID NO: 156870 - RNA, 21 nt, Human
ugccccgaaucggagccucug

SEQ ID NO: 156871 - RNA, 20 nt, Human
ugguauguggugagaccuuu

SEQ ID NO: 156872 - RNA, 24 nt, Human
ugguauguggugagaccuuuuuga

SEQ ID NO: 156873 - RNA, 18 nt, Human
aaacaaacaaacuacuaa

SEQ ID NO: 156874 - RNA, 19 nt, Human
aacauggugaaaccccguc

SEQ ID NO: 156875 - RNA, 20 nt, Human
aacauggugaaaccccgucu

SEQ ID NO: 156876 - RNA, 21 nt, Human
aacauggugaaaccccgucuc

SEQ ID NO: 156877 - RNA, 24 nt, Human
aagaucacuugaggucaggaguuc

SEQ ID NO: 156878 - RNA, 24 nt, Human
accccgucucuacuaaaaauacaa

SEQ ID NO: 156879 - RNA, 24 nt, Human
acuugaggucaggaguucaagacc

SEQ ID NO: 156880 - RNA, 22 nt, Human
agagguugcaaugagccaagau

SEQ ID NO: 156881 - RNA, 20 nt, Human
agaucacuugaggucaggaa

SEQ ID NO: 156882 - RNA, 22 nt, Human
agaucacuugaggucaggaguu

SEQ ID NO: 156883 - RNA, 23 nt, Human
agaucacuugaggucaggaguuc

SEQ ID NO: 156884 - RNA, 19 nt, Human
agcaauaaggcaaauggaa

SEQ ID NO: 156885 - RNA, 24 nt, Human
agcacuuugggaggcugaggccgg

SEQ ID NO: 156886 - RNA, 22 nt, Human
agccuggucaacauggugaaac

SEQ ID NO: 156887 - RNA, 24 nt, Human
agccuggucaacauggugaaaccc

SEQ ID NO: 156888 - RNA, 22 nt, Human
agcugggcauggugguguaauc

SEQ ID NO: 156889 - RNA, 22 nt, Human
aggaguucaagaccagccuggu

SEQ ID NO: 156890 - RNA, 19 nt, Human
aggcagagguugcaaugag

SEQ ID NO: 156891 - RNA, 24 nt, Human
aggcagagguugcaaugagccaag

SEQ ID NO: 156892 - RNA, 23 nt, Human
agucugggugauaaagugagacu

SEQ ID NO: 156893 - RNA, 24 nt, Human
agucugggugauaaagugagacuc

SEQ ID NO: 156894 - RNA, 21 nt, Human
aguggcucacgccuguaaucc

SEQ ID NO: 156895 - RNA, 23 nt, Human
aguggcucacgccuguaauccag

SEQ ID NO: 156896 - RNA, 24 nt, Human
auaaagugagacucagucucaaaa

SEQ ID NO: 156897 - RNA, 24 nt, Human
auagugccacugcacgccagucug

SEQ ID NO: 156898 - RNA, 19 nt, Human
caaacaaacaaacuacuaa

SEQ ID NO: 156899 - RNA, 20 nt, Human
caacauggugaaaccccguc

SEQ ID NO: 156900 - RNA, 22 nt, Human
caacauggugaaaccccgucuc

SEQ ID NO: 156901 - RNA, 24 nt, Human
caacauggugaaaccccgucucua

SEQ ID NO: 156902 - RNA, 24 nt, Human
caagaccagccuggucaacauggu

SEQ ID NO: 156903 - RNA, 20 nt, Human
cacaauuucaccucaguucc

SEQ ID NO: 156904 - RNA, 25 nt, Human
caccucaguuccaugugucagcagc

SEQ ID NO: 156905 - RNA, 20 nt, Human
cacugcacgccagucugggu

SEQ ID NO: 156906 - RNA, 23 nt, Human
cacugcacgccagucugggugau

SEQ ID NO: 156907 - RNA, 23 nt, Human
cacuugaggucaggaguucaaga

SEQ ID NO: 156908 - RNA, 25 nt, Human
cagcacuuugggaggcugaggccgg

SEQ ID NO: 156909 - RNA, 20 nt, Human
ccacugcacgccagucuggg

SEQ ID NO: 156910 - RNA, 20 nt, Human
ccacugcacgccagucuggg

SEQ ID NO: 156911 - RNA, 20 nt, Human
ccacugcacgccagucuggg

SEQ ID NO: 156912 - RNA, 23 nt, Human
ccacugcacgccagucuggguga

SEQ ID NO: 156913 - RNA, 24 nt, Human
ccacugcacgccagucugggugau

SEQ ID NO: 156914 - RNA, 25 nt, Human
ccugggaggcagagguugcaaugag

SEQ ID NO: 156915 - RNA, 23 nt, Human
ccuggucaacauggugaaacccc

SEQ ID NO: 156916 - RNA, 24 nt, Human
ccuggucaacauggugaaaccccg

SEQ ID NO: 156917 - RNA, 21 nt, Human
ccuguaauccagcacuuuggg

SEQ ID NO: 156918 - RNA, 26 nt, Human
cgccuguaauccagcacuuugggagg

SEQ ID NO: 156919 - RNA, 27 nt, Human
cguuaugaaaucuguaaaaucauggag

SEQ ID NO: 156920 - RNA, 23 nt, Human
cuacuugggaggcugaccuggga

SEQ ID NO: 156921 - RNA, 21 nt, Human
cucaaaaacaaacaaacaaac

SEQ ID NO: 156922 - RNA, 23 nt, Human
cucacgccuguaauccagcacuu

SEQ ID NO: 156923 - RNA, 21 nt, Human
cugggugauaaagugagacuc

SEQ ID NO: 156924 - RNA, 24 nt, Human
gaagaucacuugaggucaggaguu

SEQ ID NO: 156925 - RNA, 18 nt, Human
gagguugcaaugagccaa

SEQ ID NO: 156926 - RNA, 18 nt, Human
gaucacuugaggucagga

SEQ ID NO: 156927 - RNA, 23 nt, Human
gaucacuugaggucaggaguuca

SEQ ID NO: 156928 - RNA, 24 nt, Human
gaucacuugaggucaggaguucaa

SEQ ID NO: 156929 - RNA, 24 nt, Human
gccacugcacgccagucuggguga

SEQ ID NO: 156930 - RNA, 19 nt, Human
gcucuccugugccgugcag

SEQ ID NO: 156931 - RNA, 21 nt, Human
ggagcuccuugcacuaugcuu

SEQ ID NO: 156932 - RNA, 23 nt, Human
gggcauggugguguaaucccagc

SEQ ID NO: 156933 - RNA, 20 nt, Human
guagcugggcaugguggugu

SEQ ID NO: 156934 - RNA, 18 nt, Human
uaaugcuuuuguaauguu

SEQ ID NO: 156935 - RNA, 23 nt, Human
uacuaaaaauacaaguauuuuua

SEQ ID NO: 156936 - RNA, 24 nt, Human
ucacgccuguaauccagcacuuug

SEQ ID NO: 156937 - RNA, 23 nt, Human
ucacuugaggucaggaguucaag

SEQ ID NO: 156938 - RNA, 18 nt, Human
ucucuacuaaaaauacaa

SEQ ID NO: 156939 - RNA, 23 nt, Human
ugaccugggaggcagagguugca

SEQ ID NO: 156940 - RNA, 22 nt, Human
ugcaaugagccaagauagugcc

SEQ ID NO: 156941 - RNA, 23 nt, Human
uggcucacgccuguaauccagca

SEQ ID NO: 156942 - RNA, 18 nt, Human
uggcucaguggcucacgc

SEQ ID NO: 156943 - RNA, 24 nt, Human
uggcucaguggcucacgccuguaa

SEQ ID NO: 156944 - RNA, 19 nt, Human
ugggaggcugaccugggag

SEQ ID NO: 156945 - RNA, 24 nt, Human
ugggaggcugaggccggaagauca

SEQ ID NO: 156946 - RNA, 21 nt, Human
ugguguaaucccagcuacuug

SEQ ID NO: 156947 - RNA, 22 nt, Human
ugguguaaucccagcuacuugg

SEQ ID NO: 156948 - RNA, 20 nt, Human
uguaaucccagcuacuuggg

SEQ ID NO: 156949 - RNA, 25 nt, Human
uugggaggcugaggccggaagauca

SEQ ID NO: 156950 - RNA, 27 nt, Human
uuuuuaguagcugggcaugguggugua

SEQ ID NO: 156951 - RNA, 30 nt, Human
aaaaaaaaaaaaaaagaaaaguaaaagaag

SEQ ID NO: 156952 - RNA, 18 nt, Human
aaagugcugggauuacag

SEQ ID NO: 156953 - RNA, 20 nt, Human
aaagugcugggauuacaggc

SEQ ID NO: 156954 - RNA, 20 nt, Human
aaagugcugggauuacaggc

SEQ ID NO: 156955 - RNA, 23 nt, Human
aaagugcugggauuacaggcgug

SEQ ID NO: 156956 - RNA, 24 nt, Human
aaagugcugggauuacaggcguga

SEQ ID NO: 156957 - RNA, 20 nt, Human
aaagugcugggauugcaggu

SEQ ID NO: 156958 - RNA, 24 nt, Human
aaagugcugggauugcagguguga

SEQ ID NO: 156959 - RNA, 24 nt, Human
aacagcgcgagacucugucucagg

SEQ ID NO: 156960 - RNA, 20 nt, Human
aacauggugaaacuccgucu

SEQ ID NO: 156961 - RNA, 21 nt, Human
aacauggugaaacuccgucuu

SEQ ID NO: 156962 - RNA, 21 nt, Human
aagagacaucccaaagccaga

SEQ ID NO: 156963 - RNA, 22 nt, Human
aagagacaucccaaagccagaa

SEQ ID NO: 156964 - RNA, 24 nt, Human
aagcaauccuccaucuuggccucc

SEQ ID NO: 156965 - RNA, 26 nt, Human
aaggcugccccugcccccgcagaccc

SEQ ID NO: 156966 - RNA, 24 nt, Human
aagugauccauccgccuuggccuc

SEQ ID NO: 156967 - RNA, 25 nt, Human
aagugauccucccgccugugccucu

SEQ ID NO: 156968 - RNA, 19 nt, Human
aagugcugggauuacaggc

SEQ ID NO: 156969 - RNA, 19 nt, Human
aagugcugggauuacaggc

SEQ ID NO: 156970 - RNA, 18 nt, Human
aagugcugggauugcagg

SEQ ID NO: 156971 - RNA, 19 nt, Human
aagugcugggauugcaggu

SEQ ID NO: 156972 - RNA, 19 nt, Human
aaucauagcucacugcaac

SEQ ID NO: 156973 - RNA, 24 nt, Human
aaucauuugaacccaggaggccga

SEQ ID NO: 156974 - RNA, 24 nt, Human
acagaaagugaaaagaaggaucag

SEQ ID NO: 156975 - RNA, 24 nt, Human
acagcgcgagacucugucucagga

SEQ ID NO: 156976 - RNA, 21 nt, Human
acaggugcccaccaccacgcc

SEQ ID NO: 156977 - RNA, 19 nt, Human
acauggugaaacuccgucu

SEQ ID NO: 156978 - RNA, 21 nt, Human
accacaaccucccaggcucaa

SEQ ID NO: 156979 - RNA, 22 nt, Human
accauguuagccaggcuggucu

SEQ ID NO: 156980 - RNA, 18 nt, Human
accauguugcucaggcug

SEQ ID NO: 156981 - RNA, 20 nt, Human
accauguugcucaggcuggu

SEQ ID NO: 156982 - RNA, 19 nt, Human
acccaaagaauaaaaaaug

SEQ ID NO: 156983 - RNA, 23 nt, Human
acccccaccccccauugucccac

SEQ ID NO: 156984 - RNA, 22 nt, Human
acccgaaccccccagcacacac

SEQ ID NO: 156985 - RNA, 24 nt, Human
acccuauuuccaaauaaggucaca

SEQ ID NO: 156986 - RNA, 19 nt, Human
acccucggacgccagggag

SEQ ID NO: 156987 - RNA, 22 nt, Human
accgcaaccuccgccucccagg

SEQ ID NO: 156988 - RNA, 24 nt, Human
acgccacugcacuccagccugggc

SEQ ID NO: 156989 - RNA, 24 nt, Human
acgccacugcacuccagccugggc

SEQ ID NO: 156990 - RNA, 21 nt, Human
acuauaggcgcaugccacaau

SEQ ID NO: 156991 - RNA, 24 nt, Human
acugcacucaggcugcucugggcu

SEQ ID NO: 156992 - RNA, 24 nt, Human
acugcacuccagccugggcaacag

SEQ ID NO: 156993 - RNA, 22 nt, Human
acuguccacccccaccccccau

SEQ ID NO: 156994 - RNA, 19 nt, Human
agaagggaguuccaggucu

SEQ ID NO: 156995 - RNA, 19 nt, Human
agacaccagugcgucgugg

SEQ ID NO: 156996 - RNA, 22 nt, Human
agagaugcuggcagggcccagg

SEQ ID NO: 156997 - RNA, 19 nt, Human
agaggagggaaggcgaggg

SEQ ID NO: 156998 - RNA, 24 nt, Human
agagugcugagauuauaggcguga

SEQ ID NO: 156999 - RNA, 24 nt, Human
agauuauaggcgugagccacugca

SEQ ID NO: 157000 - RNA, 22 nt, Human
agccaccacacccacuaucucu

SEQ ID NO: 157001 - RNA, 21 nt, Human
agccccagcuucuggagccga

SEQ ID NO: 157002 - RNA, 22 nt, Human
agccuggccaacauggugaaac

SEQ ID NO: 157003 - RNA, 24 nt, Human
agccuggccaacauggugaaacuc

SEQ ID NO: 157004 - RNA, 24 nt, Human
agccugggcaacagcgcgagacuc

SEQ ID NO: 157005 - RNA, 28 nt, Human
agcucacugcaaccacaaccucccaggg

SEQ ID NO: 157006 - RNA, 18 nt, Human
agcucagcgccccgggcc

SEQ ID NO: 157007 - RNA, 22 nt, Human
aggaagcagaguuugauccuga

SEQ ID NO: 157008 - RNA, 18 nt, Human
aggaaggacgugaagugg

SEQ ID NO: 157009 - RNA, 20 nt, Human
aggacaccacccacacugga

SEQ ID NO: 157010 - RNA, 27 nt, Human
aggaggccgagcuugcagugagccgag

SEQ ID NO: 157011 - RNA, 21 nt, Human
aggaguuggagaccagccugg

SEQ ID NO: 157012 - RNA, 23 nt, Human
aggauuucaccauguuagccagg

SEQ ID NO: 157013 - RNA, 19 nt, Human
aggcaaauccguagaguug

SEQ ID NO: 157014 - RNA, 18 nt, Human
aggcaggagaaucauuug

SEQ ID NO: 157015 - RNA, 23 nt, Human
aggcaggagaaucauuugaaccc

SEQ ID NO: 157016 - RNA, 24 nt, Human
aggccgagcuugcagugagccgag

SEQ ID NO: 157017 - RNA, 25 nt, Human
aggccgagcuugcagugagccgaga

SEQ ID NO: 157018 - RNA, 20 nt, Human
aggcggaucacuugagggca

SEQ ID NO: 157019 - RNA, 19 nt, Human
aggcgugagccacugcacc

SEQ ID NO: 157020 - RNA, 19 nt, Human
aggcgugagccacugcacc

SEQ ID NO: 157021 - RNA, 23 nt, Human
aggcucaagugauccucccgccu

SEQ ID NO: 157022 - RNA, 20 nt, Human
aggcugaggcaggagaauca

SEQ ID NO: 157023 - RNA, 24 nt, Human
aggcugaggcaggagaaucauuug

SEQ ID NO: 157024 - RNA, 21 nt, Human
aggcugcucugggcuguggcc

SEQ ID NO: 157025 - RNA, 25 nt, Human
aggcuggagugcaguggcaccaucu

SEQ ID NO: 157026 - RNA, 21 nt, Human
agggaguuccaggucugcagc

SEQ ID NO: 157027 - RNA, 19 nt, Human
agguugcgguggguguggu

SEQ ID NO: 157028 - RNA, 18 nt, Human
aguagcugggauuacagg

SEQ ID NO: 157029 - RNA, 25 nt, Human
aguagcugggauuacaggcgccagc

SEQ ID NO: 157030 - RNA, 20 nt, Human
aguccaguggcgcaaucucg

SEQ ID NO: 157031 - RNA, 24 nt, Human
aguccaguggcgcaaucucggcuc

SEQ ID NO: 157032 - RNA, 21 nt, Human
agugcagugguacaaucauag

SEQ ID NO: 157033 - RNA, 23 nt, Human
agugcagugguacaaucauagcu

SEQ ID NO: 157034 - RNA, 22 nt, Human
agugcugagauuauaggcguga

SEQ ID NO: 157035 - RNA, 18 nt, Human
agugcugggauuacaggc

SEQ ID NO: 157036 - RNA, 18 nt, Human
agugcugggauuacaggc

SEQ ID NO: 157037 - RNA, 18 nt, Human
aguggcugggacuauagg

SEQ ID NO: 157038 - RNA, 19 nt, Human
aguggcugggacuauaggc

SEQ ID NO: 157039 - RNA, 24 nt, Human
auagcucacugcaaccacaaccuc

SEQ ID NO: 157040 - RNA, 24 nt, Human
aucacgccacugcacuccagccug

SEQ ID NO: 157041 - RNA, 22 nt, Human
aucuuaugaggacaccacccac

SEQ ID NO: 157042 - RNA, 24 nt, Human
augaucugcccaccucggccuucc

SEQ ID NO: 157043 - RNA, 18 nt, Human
augggguuuuaccauguu

SEQ ID NO: 157044 - RNA, 19 nt, Human
augggguuuuaccauguug

SEQ ID NO: 157045 - RNA, 18 nt, Human
auuaauuuagagacaggc

SEQ ID NO: 157046 - RNA, 22 nt, Human
auuacaggcgccagccaccaag

SEQ ID NO: 157047 - RNA, 24 nt, Human
auuuuuguauuuuugguagagaug

SEQ ID NO: 157048 - RNA, 24 nt, Human
caaagugcugggauugcaggugug

SEQ ID NO: 157049 - RNA, 21 nt, Human
caacauggugaaacuccgucu

SEQ ID NO: 157050 - RNA, 23 nt, Human
caacauggugaaacuccgucuug

SEQ ID NO: 157051 - RNA, 24 nt, Human
caaccacaaccucccaggcucaag

SEQ ID NO: 157052 - RNA, 20 nt, Human
caaccaggcucugggccugg

SEQ ID NO: 157053 - RNA, 20 nt, Human
caacguaaagucaggagaac

SEQ ID NO: 157054 - RNA, 19 nt, Human
caagagacaucccaaagcc

SEQ ID NO: 157055 - RNA, 25 nt, Human
caagagacaucccaaagccagaagc

SEQ ID NO: 157056 - RNA, 20 nt, Human
caagcgauccuucugccuca

SEQ ID NO: 157057 - RNA, 21 nt, Human
caagcgauccuucugccucag

SEQ ID NO: 157058 - RNA, 24 nt, Human
caaggucuugcucuguugcccagg

SEQ ID NO: 157059 - RNA, 19 nt, Human
caagugauccucccgccug

SEQ ID NO: 157060 - RNA, 23 nt, Human
cacacaaaaaggagugguguuuc

SEQ ID NO: 157061 - RNA, 23 nt, Human
cacacacaaaaaggagugguguu

SEQ ID NO: 157062 - RNA, 19 nt, Human
cacacacacaaaaaggagu

SEQ ID NO: 157063 - RNA, 21 nt, Human
cacacacuguccacccccacc

SEQ ID NO: 157064 - RNA, 25 nt, Human
cacacacuguccacccccacccccc

SEQ ID NO: 157065 - RNA, 19 nt, Human
cacaccccgacucccaccc

SEQ ID NO: 157066 - RNA, 24 nt, Human
caccaagcccagcuaauuuuugua

SEQ ID NO: 157067 - RNA, 24 nt, Human
caccacgccuggcuaauuuuugua

SEQ ID NO: 157068 - RNA, 21 nt, Human
caccauguuagccaggcuggu

SEQ ID NO: 157069 - RNA, 23 nt, Human
caccauguuagccaggcuggucu

SEQ ID NO: 157070 - RNA, 24 nt, Human
caccauguuagccaggcuggucuu

SEQ ID NO: 157071 - RNA, 27 nt, Human
caccauguuagccaggcuggucuugaa

SEQ ID NO: 157072 - RNA, 21 nt, Human
caccccccauugucccaccuu

SEQ ID NO: 157073 - RNA, 22 nt, Human
cacccuucuccaaagugaccuc

SEQ ID NO: 157074 - RNA, 20 nt, Human
cacuccagccugggcaacag

SEQ ID NO: 157075 - RNA, 21 nt, Human
cacuccagccugggcaacagc

SEQ ID NO: 157076 - RNA, 21 nt, Human
cacucccaucucugccucugc

SEQ ID NO: 157077 - RNA, 21 nt, Human
cacugcaaccacaaccuccca

SEQ ID NO: 157078 - RNA, 22 nt, Human
cacugcaaccacaaccucccag

SEQ ID NO: 157079 - RNA, 18 nt, Human
cacugcaaccucugccuc

SEQ ID NO: 157080 - RNA, 21 nt, Human
cacugcaaccucugccuccca

SEQ ID NO: 157081 - RNA, 18 nt, Human
cacugcacuccagccugg

SEQ ID NO: 157082 - RNA, 19 nt, Human
cacugcacuccagccuggg

SEQ ID NO: 157083 - RNA, 21 nt, Human
cacugcacuccagccugggca

SEQ ID NO: 157084 - RNA, 23 nt, Human
cacugcacuccagccugggcaac

SEQ ID NO: 157085 - RNA, 24 nt, Human
cacugcacuccagccugggcaaca

SEQ ID NO: 157086 - RNA, 24 nt, Human
cagagugcugagauuauaggcgug

SEQ ID NO: 157087 - RNA, 21 nt, Human
cagcccacucgcccgggaacu

SEQ ID NO: 157088 - RNA, 22 nt, Human
cagcccacucgcccgggaacug

SEQ ID NO: 157089 - RNA, 18 nt, Human
cagccggugccugacgug

SEQ ID NO: 157090 - RNA, 19 nt, Human
cagcgcgagacucugucuc

SEQ ID NO: 157091 - RNA, 24 nt, Human
cagcuacuugggaggcugaggcag

SEQ ID NO: 157092 - RNA, 19 nt, Human
cagcuccagccccaucuca

SEQ ID NO: 157093 - RNA, 19 nt, Human
cagggagggcuccccuggg

SEQ ID NO: 157094 - RNA, 19 nt, Human
cagggcccaggaagcagag

SEQ ID NO: 157095 - RNA, 19 nt, Human
caggugcccaccaccacgc

SEQ ID NO: 157096 - RNA, 22 nt, Human
caggugugagccaccacaccca

SEQ ID NO: 157097 - RNA, 20 nt, Human
caguauacugggggcagggc

SEQ ID NO: 157098 - RNA, 20 nt, Human
cagucuccugaguagcuggg

SEQ ID NO: 157099 - RNA, 22 nt, Human
caguucugcaggccagaagucc

SEQ ID NO: 157100 - RNA, 18 nt, Human
cauagcucacugcaacca

SEQ ID NO: 157101 - RNA, 22 nt, Human
caugccacaaugccugguucau

SEQ ID NO: 157102 - RNA, 25 nt, Human
caugccaggcagcuuaaaacaauga

SEQ ID NO: 157103 - RNA, 23 nt, Human
cauguuagccaggcuggucuuga

SEQ ID NO: 157104 - RNA, 24 nt, Human
cauguuagccaggcuggucuugaa

SEQ ID NO: 157105 - RNA, 23 nt, Human
cauguugcucaggcugguguuga

SEQ ID NO: 157106 - RNA, 24 nt, Human
cauguugcucaggcugguguugaa

SEQ ID NO: 157107 - RNA, 22 nt, Human
ccaaagaauaaaaaaugggacc

SEQ ID NO: 157108 - RNA, 21 nt, Human
ccaaagugcugggauugcagg

SEQ ID NO: 157109 - RNA, 21 nt, Human
ccaaagugcugggauugcagg

SEQ ID NO: 157110 - RNA, 24 nt, Human
ccaaagugcugggauugcaggugu

SEQ ID NO: 157111 - RNA, 19 nt, Human
ccacacccacuaucucucg

SEQ ID NO: 157112 - RNA, 20 nt, Human
ccacugcacuccagccuggg

SEQ ID NO: 157113 - RNA, 21 nt, Human
ccacugcacuccagccugggc

SEQ ID NO: 157114 - RNA, 23 nt, Human
ccacugcacuccagccugggcaa

SEQ ID NO: 157115 - RNA, 24 nt, Human
ccacugcacuccagccugggcaac

SEQ ID NO: 157116 - RNA, 20 nt, Human
ccacugccgccccccaccgc

SEQ ID NO: 157117 - RNA, 21 nt, Human
ccagaagcuggugggcaugag

SEQ ID NO: 157118 - RNA, 22 nt, Human
ccagagugcugagauuauaggc

SEQ ID NO: 157119 - RNA, 22 nt, Human
ccagagugcugagauuauaggc

SEQ ID NO: 157120 - RNA, 24 nt, Human
ccagagugcugagauuauaggcgu

SEQ ID NO: 157121 - RNA, 20 nt, Human
ccagggucaaggugguggca

SEQ ID NO: 157122 - RNA, 23 nt, Human
cccaaagaauaaaaaaugggacc

SEQ ID NO: 157123 - RNA, 24 nt, Human
cccacccacacaugcucagccaug

SEQ ID NO: 157124 - RNA, 24 nt, Human
cccagaacaggcaaauccguagag

SEQ ID NO: 157125 - RNA, 22 nt, Human
cccagcacacacuguccacccc

SEQ ID NO: 157126 - RNA, 24 nt, Human
cccagcacacacuguccaccccca

SEQ ID NO: 157127 - RNA, 27 nt, Human
cccagccccagcuccagccccaucuca

SEQ ID NO: 157128 - RNA, 24 nt, Human
cccagcuucuggagccgaggcgga

SEQ ID NO: 157129 - RNA, 22 nt, Human
cccaggcucaagugauccuccc

SEQ ID NO: 157130 - RNA, 19 nt, Human
cccagguucaagcgauccu

SEQ ID NO: 157131 - RNA, 20 nt, Human
cccagguucaagcgauccuu

SEQ ID NO: 157132 - RNA, 20 nt, Human
cccagguucaagcgauucuc

SEQ ID NO: 157133 - RNA, 23 nt, Human
cccagguucaagcgauucuccug

SEQ ID NO: 157134 - RNA, 21 nt, Human
cccagugggauggaaggaccc

SEQ ID NO: 157135 - RNA, 24 nt, Human
ccccaccgcggccugccacacccc

SEQ ID NO: 157136 - RNA, 21 nt, Human
ccccagccccagcuccagccc

SEQ ID NO: 157137 - RNA, 21 nt, Human
ccccagccccagcuccagccu

SEQ ID NO: 157138 - RNA, 21 nt, Human
cccccagcacacacuguccac

SEQ ID NO: 157139 - RNA, 25 nt, Human
cccccgcagacccaccagggccgcu

SEQ ID NO: 157140 - RNA, 19 nt, Human
cccccggcccggcccgguc

SEQ ID NO: 157141 - RNA, 18 nt, Human
ccccgggccuccuggccc

SEQ ID NO: 157142 - RNA, 19 nt, Human
cccgcacccccggcccggc

SEQ ID NO: 157143 - RNA, 21 nt, Human
cccgcacccccggcccggccc

SEQ ID NO: 157144 - RNA, 19 nt, Human
cccgcagacccaccagggc

SEQ ID NO: 157145 - RNA, 22 nt, Human
cccgccgcugccccacagaucc

SEQ ID NO: 157146 - RNA, 23 nt, Human
cccggcccggcccggucccugac

SEQ ID NO: 157147 - RNA, 18 nt, Human
cccggggcccgggugagu

SEQ ID NO: 157148 - RNA, 21 nt, Human
cccgucccaggccugucuccu

SEQ ID NO: 157149 - RNA, 21 nt, Human
cccgugcaaggcuuacaaccg

SEQ ID NO: 157150 - RNA, 19 nt, Human
cccucagccuccugggcag

SEQ ID NO: 157151 - RNA, 18 nt, Human
cccucggacgccagggag

SEQ ID NO: 157152 - RNA, 19 nt, Human
cccugagccccagcuucug

SEQ ID NO: 157153 - RNA, 20 nt, Human
cccugcccccgcagacccac

SEQ ID NO: 157154 - RNA, 21 nt, Human
ccgcaaccuccgccucccagg

SEQ ID NO: 157155 - RNA, 23 nt, Human
ccgcaaccuccgccucccagguu

SEQ ID NO: 157156 - RNA, 24 nt, Human
ccgcaaccuccgccucccagguuc

SEQ ID NO: 157157 - RNA, 18 nt, Human
ccgccccccaccgcggcc

SEQ ID NO: 157158 - RNA, 21 nt, Human
ccgccuuggccucuuaaagug

SEQ ID NO: 157159 - RNA, 20 nt, Human
ccggacccugagccccagcc

SEQ ID NO: 157160 - RNA, 20 nt, Human
ccgggucgagccugcgcccg

SEQ ID NO: 157161 - RNA, 21 nt, Human
ccgggucgagccugcgcccgc

SEQ ID NO: 157162 - RNA, 23 nt, Human
ccgggucgagccugcgcccgccg

SEQ ID NO: 157163 - RNA, 24 nt, Human
ccgugcucuccgggagugcguggu

SEQ ID NO: 157164 - RNA, 24 nt, Human
ccucccagguucaagcgauccuuc

SEQ ID NO: 157165 - RNA, 24 nt, Human
ccucccagguucaagcgauucucc

SEQ ID NO: 157166 - RNA, 20 nt, Human
ccucuggaggcugugaggga

SEQ ID NO: 157167 - RNA, 20 nt, Human
ccugacucagccuccccagu

SEQ ID NO: 157168 - RNA, 23 nt, Human
ccugaguagcugggauuacaggc

SEQ ID NO: 157169 - RNA, 24 nt, Human
ccugaguagcugggauuacaggcg

SEQ ID NO: 157170 - RNA, 23 nt, Human
ccugccacaccccgacucccacc

SEQ ID NO: 157171 - RNA, 18 nt, Human
ccugcgcccgccgcugcc

SEQ ID NO: 157172 - RNA, 23 nt, Human
ccuggccaacauggugaaacucc

SEQ ID NO: 157173 - RNA, 24 nt, Human
ccuggccaacauggugaaacuccg

SEQ ID NO: 157174 - RNA, 18 nt, Human
ccuggcccgggucgagcc

SEQ ID NO: 157175 - RNA, 18 nt, Human
ccuggcccgggucgagcc

SEQ ID NO: 157176 - RNA, 24 nt, Human
ccuggccucagaugaucugcccac

SEQ ID NO: 157177 - RNA, 21 nt, Human
ccuggcuucaagcaauccucc

SEQ ID NO: 157178 - RNA, 22 nt, Human
ccugggcucaagugauccaucc

SEQ ID NO: 157179 - RNA, 22 nt, Human
ccugggcucaagugauccaucc

SEQ ID NO: 157180 - RNA, 18 nt, Human
ccuguuaucccagcuacu

SEQ ID NO: 157181 - RNA, 21 nt, Human
cgaaggggacgggguugagag

SEQ ID NO: 157182 - RNA, 20 nt, Human
cgagccagagaugcuggcag

SEQ ID NO: 157183 - RNA, 24 nt, Human
cgccacugcacuccagccugggca

SEQ ID NO: 157184 - RNA, 19 nt, Human
cgcccgggaacugugcgcc

SEQ ID NO: 157185 - RNA, 22 nt, Human
cgccgcugccccacagaucccc

SEQ ID NO: 157186 - RNA, 18 nt, Human
cgccggacccugagcccc

SEQ ID NO: 157187 - RNA, 24 nt, Human
cgccgguggagauaaaccaggaag

SEQ ID NO: 157188 - RNA, 24 nt, Human
cgccuguuaucccagcuacuuggg

SEQ ID NO: 157189 - RNA, 22 nt, Human
cgcggagccacugccgcccccc

SEQ ID NO: 157190 - RNA, 21 nt, Human
cgcucuuucgcccaggcugga

SEQ ID NO: 157191 - RNA, 20 nt, Human
cggcccggcccggucccuga

SEQ ID NO: 157192 - RNA, 21 nt, Human
cgggagugcguggugggcagg

SEQ ID NO: 157193 - RNA, 20 nt, Human
cucaagugauccauccgccu

SEQ ID NO: 157194 - RNA, 24 nt, Human
cucaagugauccauccgccuuggc

SEQ ID NO: 157195 - RNA, 20 nt, Human
cucaagugauccucccgccu

SEQ ID NO: 157196 - RNA, 24 nt, Human
cucaagugauccucccgccugugc

SEQ ID NO: 157197 - RNA, 18 nt, Human
cucacaguucugcaggcc

SEQ ID NO: 157198 - RNA, 24 nt, Human
cucacugcaaccacaaccucccag

SEQ ID NO: 157199 - RNA, 24 nt, Human
cucacugcaaccucugccucccag

SEQ ID NO: 157200 - RNA, 24 nt, Human
cucacugcaaccucugccucccag

SEQ ID NO: 157201 - RNA, 24 nt, Human
cucagucuccugaguagcugggau

SEQ ID NO: 157202 - RNA, 19 nt, Human
cucccacccacacaugcuc

SEQ ID NO: 157203 - RNA, 25 nt, Human
cucccaggcucaagugauccucccg

SEQ ID NO: 157204 - RNA, 21 nt, Human
cucgccggacccugagcccca

SEQ ID NO: 157205 - RNA, 20 nt, Human
cucuguugcccaggcuggag

SEQ ID NO: 157206 - RNA, 18 nt, Human
cucuuucgcccaggcugg

SEQ ID NO: 157207 - RNA, 20 nt, Human
cucuuucgcccaggcuggag

SEQ ID NO: 157208 - RNA, 21 nt, Human
cugacucccacccacacaugc

SEQ ID NO: 157209 - RNA, 22 nt, Human
cugaguagcugggauuacaggc

SEQ ID NO: 157210 - RNA, 18 nt, Human
cugcaaccacaaccuccc

SEQ ID NO: 157211 - RNA, 23 nt, Human
cugcaaccacaaccucccaggcu

SEQ ID NO: 157212 - RNA, 23 nt, Human
cugcaaccucugccucccagguu

SEQ ID NO: 157213 - RNA, 24 nt, Human
cugcaaccucugccucccagguuc

SEQ ID NO: 157214 - RNA, 18 nt, Human
cugcccaccucggccuuc

SEQ ID NO: 157215 - RNA, 21 nt, Human
cugccccacagauccccagcc

SEQ ID NO: 157216 - RNA, 23 nt, Human
cugccucagucuccugaguagcu

SEQ ID NO: 157217 - RNA, 22 nt, Human
cuggauguaaggcccacccuuc

SEQ ID NO: 157218 - RNA, 21 nt, Human
cugugcgccggacccgcgugc

SEQ ID NO: 157219 - RNA, 19 nt, Human
cuguugcccaggcuggagu

SEQ ID NO: 157220 - RNA, 19 nt, Human
cuugcagugagccgagauc

SEQ ID NO: 157221 - RNA, 23 nt, Human
gaaaagaaggaucagccugcagg

SEQ ID NO: 157222 - RNA, 20 nt, Human
gaacuugcagugagucuccg

SEQ ID NO: 157223 - RNA, 19 nt, Human
gaaggcugccccugccccc

SEQ ID NO: 157224 - RNA, 18 nt, Human
gaagggaaguggcugggg

SEQ ID NO: 157225 - RNA, 20 nt, Human
gacagaaagugaaaagaagg

SEQ ID NO: 157226 - RNA, 20 nt, Human
gacccaguacagccuucccc

SEQ ID NO: 157227 - RNA, 22 nt, Human
gacccaguacagccuuccccac

SEQ ID NO: 157228 - RNA, 18 nt, Human
gacucugucucaggaaaa

SEQ ID NO: 157229 - RNA, 23 nt, Human
gagaaucauuugaacccaggagg

SEQ ID NO: 157230 - RNA, 21 nt, Human
gagaauggccaaccaggcucu

SEQ ID NO: 157231 - RNA, 23 nt, Human
gagaucacgccacugcacuccag

SEQ ID NO: 157232 - RNA, 18 nt, Human
gagaugggguuuuaccau

SEQ ID NO: 157233 - RNA, 25 nt, Human
gagccaccacacccacuaucucucg

SEQ ID NO: 157234 - RNA, 19 nt, Human
gagccacugccgcccccca

SEQ ID NO: 157235 - RNA, 21 nt, Human
gagccgaggcggacgagcaga

SEQ ID NO: 157236 - RNA, 19 nt, Human
gagcucagcgccccgggcc

SEQ ID NO: 157237 - RNA, 18 nt, Human
gagcuugcagugagccga

SEQ ID NO: 157238 - RNA, 22 nt, Human
gaggauggggugcccucagccu

SEQ ID NO: 157239 - RNA, 24 nt, Human
gaggauggggugcccucagccucc

SEQ ID NO: 157240 - RNA, 25 nt, Human
gagggugcgggguugagggcgggag

SEQ ID NO: 157241 - RNA, 21 nt, Human
gaucacuugagggcaggaguu

SEQ ID NO: 157242 - RNA, 24 nt, Human
gaucacuugagggcaggaguugga

SEQ ID NO: 157243 - RNA, 20 nt, Human
gaugagguugcggugggugu

SEQ ID NO: 157244 - RNA, 23 nt, Human
gauggguuuuggggagcagaguu

SEQ ID NO: 157245 - RNA, 18 nt, Human
gauuacaggcgccagcca

SEQ ID NO: 157246 - RNA, 18 nt, Human
gauuacaggcgugagcca

SEQ ID NO: 157247 - RNA, 21 nt, Human
gauuacaggcgugagccacca

SEQ ID NO: 157248 - RNA, 24 nt, Human
gauuacaggcgugagccaccaggc

SEQ ID NO: 157249 - RNA, 18 nt, Human
gauuauaggcgugagcca

SEQ ID NO: 157250 - RNA, 19 nt, Human
gauuauaggcgugagccac

SEQ ID NO: 157251 - RNA, 19 nt, Human
gauuccugggcugcccuga

SEQ ID NO: 157252 - RNA, 21 nt, Human
gauucuccugacucagccucc

SEQ ID NO: 157253 - RNA, 18 nt, Human
gauugcaggugugagcca

SEQ ID NO: 157254 - RNA, 21 nt, Human
gauugcaggugugagccacca

SEQ ID NO: 157255 - RNA, 22 nt, Human
gauugcaggugugagccaccac

SEQ ID NO: 157256 - RNA, 22 nt, Human
gcaggagaaucauuugaaccca

SEQ ID NO: 157257 - RNA, 18 nt, Human
gcaggaguuggagaccag

SEQ ID NO: 157258 - RNA, 21 nt, Human
gcaguggcaccaucucagcug

SEQ ID NO: 157259 - RNA, 23 nt, Human
gccaacauggugaaacuccgucu

SEQ ID NO: 157260 - RNA, 22 nt, Human
gccacugcacuccagccugggc

SEQ ID NO: 157261 - RNA, 24 nt, Human
gccacugcacuccagccugggcaa

SEQ ID NO: 157262 - RNA, 18 nt, Human
gcccacucgcccgggaac

SEQ ID NO: 157263 - RNA, 22 nt, Human
gcccagcuaauuuuuguauuuu

SEQ ID NO: 157264 - RNA, 21 nt, Human
gcccaggaagcagaguuugau

SEQ ID NO: 157265 - RNA, 19 nt, Human
gcccaggcuggagugcagu

SEQ ID NO: 157266 - RNA, 20 nt, Human
gcccaggcuggagugcagug

SEQ ID NO: 157267 - RNA, 23 nt, Human
gcccaggcuggagugcaguggca

SEQ ID NO: 157268 - RNA, 20 nt, Human
gcccgcacccccggcccggc

SEQ ID NO: 157269 - RNA, 20 nt, Human
gccgagaucacgccacugca

SEQ ID NO: 157270 - RNA, 20 nt, Human
gccggacccugagccccagc

SEQ ID NO: 157271 - RNA, 19 nt, Human
gccucaggcuuccugccuc

SEQ ID NO: 157272 - RNA, 24 nt, Human
gccucagucuccugaguagcuggg

SEQ ID NO: 157273 - RNA, 19 nt, Human
gcggagccacugccgcccc

SEQ ID NO: 157274 - RNA, 19 nt, Human
gcucaagugauccucccgc

SEQ ID NO: 157275 - RNA, 20 nt, Human
gcucaggcugguguugaacu

SEQ ID NO: 157276 - RNA, 25 nt, Human
gcucuguugcccaggcuggagugca

SEQ ID NO: 157277 - RNA, 19 nt, Human
gcucuuucgcccaggcugg

SEQ ID NO: 157278 - RNA, 19 nt, Human
gcugauggcgaugggguuu

SEQ ID NO: 157279 - RNA, 26 nt, Human
gcugccccacagauccccagccggug

SEQ ID NO: 157280 - RNA, 21 nt, Human
gcugccccugcccccgcagac

SEQ ID NO: 157281 - RNA, 20 nt, Human
gcuggagugcaguggcacca

SEQ ID NO: 157282 - RNA, 19 nt, Human
gcuggucccaaacuccugg

SEQ ID NO: 157283 - RNA, 23 nt, Human
gcuggucuugaacuccuggccuc

SEQ ID NO: 157284 - RNA, 19 nt, Human
gcuguuggcugugcuuggc

SEQ ID NO: 157285 - RNA, 23 nt, Human
ggaauggucaguauacugggggc

SEQ ID NO: 157286 - RNA, 24 nt, Human
ggagaccagccuggccaacauggu

SEQ ID NO: 157287 - RNA, 19 nt, Human
ggaguggggagugagugcu

SEQ ID NO: 157288 - RNA, 25 nt, Human
ggaucacuugagggcaggaguugga

SEQ ID NO: 157289 - RNA, 19 nt, Human
ggauuacaggcgugagcca

SEQ ID NO: 157290 - RNA, 19 nt, Human
ggcaggaguuggagaccag

SEQ ID NO: 157291 - RNA, 21 nt, Human
ggcagggcccaggaagcagag

SEQ ID NO: 157292 - RNA, 21 nt, Human
ggccagaaguccagggucaag

SEQ ID NO: 157293 - RNA, 23 nt, Human
ggccgaacggggugggugugguc

SEQ ID NO: 157294 - RNA, 24 nt, Human
ggccucagaugaucugcccaccuc

SEQ ID NO: 157295 - RNA, 23 nt, Human
ggcgaugggguuucuuuggggga

SEQ ID NO: 157296 - RNA, 25 nt, Human
ggcgaugggguuucuuugggggaaa

SEQ ID NO: 157297 - RNA, 19 nt, Human
ggcuggucccaaacuccug

SEQ ID NO: 157298 - RNA, 24 nt, Human
ggcuggucuugaacuccuggccuc

SEQ ID NO: 157299 - RNA, 18 nt, Human
gggaguguucagugcggg

SEQ ID NO: 157300 - RNA, 22 nt, Human
gggcacugaggauggggugccc

SEQ ID NO: 157301 - RNA, 24 nt, Human
gggcacugaggauggggugcccuc

SEQ ID NO: 157302 - RNA, 18 nt, Human
gggcucaagugauccauc

SEQ ID NO: 157303 - RNA, 22 nt, Human
gggguuuuaccauguugcucag

SEQ ID NO: 157304 - RNA, 18 nt, Human
gggucaaggugguggcag

SEQ ID NO: 157305 - RNA, 22 nt, Human
ggguguggucacuguggugggg

SEQ ID NO: 157306 - RNA, 21 nt, Human
gguagagauaggauuucacca

SEQ ID NO: 157307 - RNA, 19 nt, Human
ggugggcgggcgcucugcc

SEQ ID NO: 157308 - RNA, 21 nt, Human
guagagauaggauuucaccau

SEQ ID NO: 157309 - RNA, 22 nt, Human
guagagauaggauuucaccaug

SEQ ID NO: 157310 - RNA, 19 nt, Human
guagagaugggguuuuacc

SEQ ID NO: 157311 - RNA, 21 nt, Human
guagagaugggguuuuaccau

SEQ ID NO: 157312 - RNA, 22 nt, Human
guagagaugggguuuuaccaug

SEQ ID NO: 157313 - RNA, 23 nt, Human
guagagaugggguuuuaccaugu

SEQ ID NO: 157314 - RNA, 18 nt, Human
guagcugggauuacaggc

SEQ ID NO: 157315 - RNA, 21 nt, Human
gucagcggggaggggcguggc

SEQ ID NO: 157316 - RNA, 24 nt, Human
guccaguggcgcaaucucggcuca

SEQ ID NO: 157317 - RNA, 23 nt, Human
guccccagcagucaggggauagc

SEQ ID NO: 157318 - RNA, 20 nt, Human
gucccguagccuucgaggcc

SEQ ID NO: 157319 - RNA, 19 nt, Human
guccucuccucuucucuuu

SEQ ID NO: 157320 - RNA, 24 nt, Human
gugauccauccgccuuggccucuu

SEQ ID NO: 157321 - RNA, 19 nt, Human
gugcaaggcuuacaaccgg

SEQ ID NO: 157322 - RNA, 23 nt, Human
gugcacacacacaaaaaggagug

SEQ ID NO: 157323 - RNA, 20 nt, Human
gugcgugcgguuccgugcuc

SEQ ID NO: 157324 - RNA, 19 nt, Human
guggagcgcgccccugccc

SEQ ID NO: 157325 - RNA, 18 nt, Human
guguccucuccucuucuc

SEQ ID NO: 157326 - RNA, 20 nt, Human
guguccucuccucuucucuu

SEQ ID NO: 157327 - RNA, 22 nt, Human
guuuuggggagcagaguugggg

SEQ ID NO: 157328 - RNA, 22 nt, Human
uaaaaaaugggaccgaggcgga

SEQ ID NO: 157329 - RNA, 21 nt, Human
uaaaccaggaaggcugccccu

SEQ ID NO: 157330 - RNA, 21 nt, Human
uaaggcccacccuucuccaaa

SEQ ID NO: 157331 - RNA, 22 nt, Human
uaaggucacauucugagguccc

SEQ ID NO: 157332 - RNA, 24 nt, Human
uaauuuuuguauuuuugguagaga

SEQ ID NO: 157333 - RNA, 24 nt, Human
uaauuuuuguauuuuugguagaga

SEQ ID NO: 157334 - RNA, 22 nt, Human
uacaggcgugagccaccaggcc

SEQ ID NO: 157335 - RNA, 23 nt, Human
uacaggcgugagccaccaggccu

SEQ ID NO: 157336 - RNA, 22 nt, Human
uacaggugcccaccaccacgcc

SEQ ID NO: 157337 - RNA, 21 nt, Human
uaccauguugcucaggcuggu

SEQ ID NO: 157338 - RNA, 31 nt, Human
uaccauguugcucaggcugguguugaacucc

SEQ ID NO: 157339 - RNA, 18 nt, Human
uagagacaggcucucugu

SEQ ID NO: 157340 - RNA, 22 nt, Human
uagagauaggauuucaccaugu

SEQ ID NO: 157341 - RNA, 22 nt, Human
uagagaugggguuuuaccaugu

SEQ ID NO: 157342 - RNA, 21 nt, Human
uagcaggaggcugagccgugc

SEQ ID NO: 157343 - RNA, 24 nt, Human
uagccaggcuggucuugaacuccu

SEQ ID NO: 157344 - RNA, 21 nt, Human
uagcugggugggcaccucccu

SEQ ID NO: 157345 - RNA, 24 nt, Human
uaggauuucaccauguuagccagg

SEQ ID NO: 157346 - RNA, 23 nt, Human
uauaggcgugagccacugcaccu

SEQ ID NO: 157347 - RNA, 23 nt, Human
uauguugcccaggcuggucccaa

SEQ ID NO: 157348 - RNA, 24 nt, Human
uauguugcccaggcuggucccaaa

SEQ ID NO: 157349 - RNA, 19 nt, Human
uauuuuugguagagauggg

SEQ ID NO: 157350 - RNA, 23 nt, Human
ucacgccacugcacuccagccug

SEQ ID NO: 157351 - RNA, 24 nt, Human
ucacugcaaccacaaccucccagg

SEQ ID NO: 157352 - RNA, 19 nt, Human
ucacugcaaccucugccuc

SEQ ID NO: 157353 - RNA, 24 nt, Human
ucacugcaaccucugccucccagg

SEQ ID NO: 157354 - RNA, 25 nt, Human
ucacugcaaccucugccucccaggu

SEQ ID NO: 157355 - RNA, 19 nt, Human
ucacuugagggcaggaguu

SEQ ID NO: 157356 - RNA, 22 nt, Human
ucagauuccugggcugcccuga

SEQ ID NO: 157357 - RNA, 18 nt, Human
ucagccuccccaguagcu

SEQ ID NO: 157358 - RNA, 20 nt, Human
ucagccuccccaguagcugg

SEQ ID NO: 157359 - RNA, 24 nt, Human
ucaggaaaaaaaaaaaaaaagaaa

SEQ ID NO: 157360 - RNA, 23 nt, Human
ucagucuccugaguagcugggau

SEQ ID NO: 157361 - RNA, 20 nt, Human
ucauagcucacugcaaccac

SEQ ID NO: 157362 - RNA, 22 nt, Human
uccaaagugcugggauugcagg

SEQ ID NO: 157363 - RNA, 22 nt, Human
uccacccccaccccccauuguc

SEQ ID NO: 157364 - RNA, 25 nt, Human
uccagggucaaggugguggcagggc

SEQ ID NO: 157365 - RNA, 24 nt, Human
ucccagagugcugagauuauaggc

SEQ ID NO: 157366 - RNA, 21 nt, Human
ucccaggccugucuccuggcu

SEQ ID NO: 157367 - RNA, 23 nt, Human
ucccaggccugucuccuggcugc

SEQ ID NO: 157368 - RNA, 21 nt, Human
ucccaggcucaagugauccuc

SEQ ID NO: 157369 - RNA, 20 nt, Human
ucccagguucaagcgauccu

SEQ ID NO: 157370 - RNA, 24 nt, Human
ucccagguucaagcgauccuucug

SEQ ID NO: 157371 - RNA, 21 nt, Human
ucccagguucaagcgauucuc

SEQ ID NO: 157372 - RNA, 24 nt, Human
ucccagguucaagcgauucuccug

SEQ ID NO: 157373 - RNA, 24 nt, Human
uccugaguagcugggauuacaggc

SEQ ID NO: 157374 - RNA, 23 nt, Human
uccugccucgccggacccugagc

SEQ ID NO: 157375 - RNA, 26 nt, Human
uccuggcuucaagcaauccuccaucu

SEQ ID NO: 157376 - RNA, 18 nt, Human
uccugggcucaagugauc

SEQ ID NO: 157377 - RNA, 19 nt, Human
uccugggcucaagugaucc

SEQ ID NO: 157378 - RNA, 22 nt, Human
ucgcccaggcuggagugcagug

SEQ ID NO: 157379 - RNA, 24 nt, Human
ucgcucuuucgcccaggcuggagu

SEQ ID NO: 157380 - RNA, 28 nt, Human
ucuccagggaaugcagccccagcccuuu

SEQ ID NO: 157381 - RNA, 21 nt, Human
ucuccugacucagccucccca

SEQ ID NO: 157382 - RNA, 18 nt, Human
ucucugccucugccgcca

SEQ ID NO: 157383 - RNA, 20 nt, Human
ucucugccucugccgccaca

SEQ ID NO: 157384 - RNA, 22 nt, Human
ucucuguguccucuccucuucu

SEQ ID NO: 157385 - RNA, 18 nt, Human
ucuguugcccaggcugga

SEQ ID NO: 157386 - RNA, 24 nt, Human
ucuguugcccaggcuggagugcag

SEQ ID NO: 157387 - RNA, 24 nt, Human
ucuuaaagugcugggauuacaggc

SEQ ID NO: 157388 - RNA, 24 nt, Human
ucuucuguguuucacgcguccugg

SEQ ID NO: 157389 - RNA, 20 nt, Human
ucuugaacuccuggccucag

SEQ ID NO: 157390 - RNA, 24 nt, Human
ucuugaguggcugggacuauaggc

SEQ ID NO: 157391 - RNA, 22 nt, Human
ucuugcucuguugcccaggcug

SEQ ID NO: 157392 - RNA, 23 nt, Human
ucuugcucuguugcccaggcugg

SEQ ID NO: 157393 - RNA, 24 nt, Human
ucuugcucuguugcccaggcugga

SEQ ID NO: 157394 - RNA, 19 nt, Human
ucuuucgcccaggcuggag

SEQ ID NO: 157395 - RNA, 24 nt, Human
ucuuucgcccaggcuggagugcag

SEQ ID NO: 157396 - RNA, 20 nt, Human
ucuuuuuuuuggagacagag

SEQ ID NO: 157397 - RNA, 19 nt, Human
ugaaaagaaggaucagccu

SEQ ID NO: 157398 - RNA, 22 nt, Human
ugaagugggggaagggacccug

SEQ ID NO: 157399 - RNA, 20 nt, Human
ugacaugaaaugcccagaac

SEQ ID NO: 157400 - RNA, 19 nt, Human
ugacauugacagaaaguga

SEQ ID NO: 157401 - RNA, 25 nt, Human
ugacauugacagaaagugaaaagaa

SEQ ID NO: 157402 - RNA, 24 nt, Human
ugaccgcaaccuccgccucccagg

SEQ ID NO: 157403 - RNA, 20 nt, Human
ugacucagccuccccaguag

SEQ ID NO: 157404 - RNA, 21 nt, Human
ugacucagccuccccaguagc

SEQ ID NO: 157405 - RNA, 24 nt, Human
ugacucagccuccccaguagcugg

SEQ ID NO: 157406 - RNA, 22 nt, Human
ugacucccacccacacaugcuc

SEQ ID NO: 157407 - RNA, 19 nt, Human
ugagauuauaggcgugagc

SEQ ID NO: 157408 - RNA, 21 nt, Human
ugagauuauaggcgugagcca

SEQ ID NO: 157409 - RNA, 22 nt, Human
ugagauuauaggcgugagccac

SEQ ID NO: 157410 - RNA, 22 nt, Human
ugagauuauaggcgugagccac

SEQ ID NO: 157411 - RNA, 24 nt, Human
ugagauuauaggcgugagccacug

SEQ ID NO: 157412 - RNA, 22 nt, Human
ugagccgagaucacgccacugc

SEQ ID NO: 157413 - RNA, 20 nt, Human
ugaggcaggagaaucauuug

SEQ ID NO: 157414 - RNA, 24 nt, Human
ugaggcaggagaaucauuugaacc

SEQ ID NO: 157415 - RNA, 25 nt, Human
ugaggcaggagaaucauuugaaccc

SEQ ID NO: 157416 - RNA, 21 nt, Human
ugaggggaugagguugcggug

SEQ ID NO: 157417 - RNA, 24 nt, Human
ugaggggaugagguugcggugggu

SEQ ID NO: 157418 - RNA, 24 nt, Human
ugaucugcccaccucggccuucca

SEQ ID NO: 157419 - RNA, 19 nt, Human
ugcacacacacaaaaagga

SEQ ID NO: 157420 - RNA, 19 nt, Human
ugcacaguaucgugaaugu

SEQ ID NO: 157421 - RNA, 18 nt, Human
ugcccaggcuggagugca

SEQ ID NO: 157422 - RNA, 21 nt, Human
ugcccaggcuggagugcagug

SEQ ID NO: 157423 - RNA, 21 nt, Human
ugcccaggcuggagugcagug

SEQ ID NO: 157424 - RNA, 22 nt, Human
ugcccaggcuggagugcagugg

SEQ ID NO: 157425 - RNA, 24 nt, Human
ugcccaggcuggucccaaacuccu

SEQ ID NO: 157426 - RNA, 21 nt, Human
ugccccugcccccgcagaccc

SEQ ID NO: 157427 - RNA, 23 nt, Human
ugccucagucuccugaguagcug

SEQ ID NO: 157428 - RNA, 24 nt, Human
ugccucagucuccugaguagcugg

SEQ ID NO: 157429 - RNA, 24 nt, Human
ugccucccagguucaagcgauccu

SEQ ID NO: 157430 - RNA, 26 nt, Human
ugccucgccggacccugagccccagc

SEQ ID NO: 157431 - RNA, 21 nt, Human
ugcgccggacccgcgugcaac

SEQ ID NO: 157432 - RNA, 22 nt, Human
ugcucaggcugguguugaacuc

SEQ ID NO: 157433 - RNA, 24 nt, Human
ugcucaggcugguguugaacuccu

SEQ ID NO: 157434 - RNA, 24 nt, Human
ugcugggauuacaggcgugagcca

SEQ ID NO: 157435 - RNA, 19 nt, Human
uggaguccaguggcgcaau

SEQ ID NO: 157436 - RNA, 24 nt, Human
uggaguccaguggcgcaaucucgg

SEQ ID NO: 157437 - RNA, 19 nt, Human
uggagugcaguggcaccau

SEQ ID NO: 157438 - RNA, 23 nt, Human
uggagugcaguggcaccaucuca

SEQ ID NO: 157439 - RNA, 18 nt, Human
uggagugcagugguacaa

SEQ ID NO: 157440 - RNA, 19 nt, Human
uggagugcagugguacaau

SEQ ID NO: 157441 - RNA, 21 nt, Human
uggagugcagugguacaauca

SEQ ID NO: 157442 - RNA, 22 nt, Human
uggcagggcugguucccucugg

SEQ ID NO: 157443 - RNA, 24 nt, Human
uggccaacauggugaaacuccguc

SEQ ID NO: 157444 - RNA, 22 nt, Human
uggccgucacuuuucgucuuuu

SEQ ID NO: 157445 - RNA, 20 nt, Human
uggccucagaugaucugccc

SEQ ID NO: 157446 - RNA, 19 nt, Human
uggccucaggcuuccugcc

SEQ ID NO: 157447 - RNA, 21 nt, Human
uggccucaggcuuccugccuc

SEQ ID NO: 157448 - RNA, 21 nt, Human
uggcugugcuuggcaucgugg

SEQ ID NO: 157449 - RNA, 21 nt, Human
uggcuguuggcugugcuuggc

SEQ ID NO: 157450 - RNA, 20 nt, Human
uggcuucaagcaauccucca

SEQ ID NO: 157451 - RNA, 24 nt, Human
uggcuucaagcaauccuccaucuu

SEQ ID NO: 157452 - RNA, 21 nt, Human
ugggacuauaggcgcaugcca

SEQ ID NO: 157453 - RNA, 22 nt, Human
ugggacuauaggcgcaugccac

SEQ ID NO: 157454 - RNA, 19 nt, Human
ugggaggcugaggcaggag

SEQ ID NO: 157455 - RNA, 24 nt, Human
ugggaggcugaggcaggagaauca

SEQ ID NO: 157456 - RNA, 24 nt, Human
ugggaucccccuauguugcccagg

SEQ ID NO: 157457 - RNA, 22 nt, Human
ugggauuacaggcgccagccac

SEQ ID NO: 157458 - RNA, 24 nt, Human
ugggauuacaggcgccagccacca

SEQ ID NO: 157459 - RNA, 18 nt, Human
ugggauuacaggcgugag

SEQ ID NO: 157460 - RNA, 19 nt, Human
ugggauuacaggcgugagc

SEQ ID NO: 157461 - RNA, 22 nt, Human
ugggauuacaggcgugagccac

SEQ ID NO: 157462 - RNA, 23 nt, Human
ugggauuacaggcgugagccacc

SEQ ID NO: 157463 - RNA, 24 nt, Human
ugggauuacaggcgugagccacca

SEQ ID NO: 157464 - RNA, 23 nt, Human
ugggauugcaggugugagccacc

SEQ ID NO: 157465 - RNA, 24 nt, Human
ugggauugcaggugugagccacca

SEQ ID NO: 157466 - RNA, 21 nt, Human
ugggcaggaacuugcagugag

SEQ ID NO: 157467 - RNA, 18 nt, Human
ugggcgcaauggguugag

SEQ ID NO: 157468 - RNA, 19 nt, Human
ugggcucaagugauccauc

SEQ ID NO: 157469 - RNA, 18 nt, Human
ugggcuguggccucaggc

SEQ ID NO: 157470 - RNA, 21 nt, Human
uggggagcagaguugggggug

SEQ ID NO: 157471 - RNA, 23 nt, Human
uggggugcccucagccuccuggg

SEQ ID NO: 157472 - RNA, 24 nt, Human
ugggguuuuaccauguugcucagg

SEQ ID NO: 157473 - RNA, 24 nt, Human
ugguacaaucauagcucacugcaa

SEQ ID NO: 157474 - RNA, 24 nt, Human
ugguagagauaggauuucaccaug

SEQ ID NO: 157475 - RNA, 24 nt, Human
ugguagagaugggguuuuaccaug

SEQ ID NO: 157476 - RNA, 22 nt, Human
uggugggcgccuguuaucccag

SEQ ID NO: 157477 - RNA, 25 nt, Human
ugguggggacugggcgcaauggguc

SEQ ID NO: 157478 - RNA, 24 nt, Human
uguagagaugggaucccccuaugu

SEQ ID NO: 157479 - RNA, 20 nt, Human
ugugucucuguguccucucc

SEQ ID NO: 157480 - RNA, 21 nt, Human
uguugaacuccugggcucaag

SEQ ID NO: 157481 - RNA, 20 nt, Human
uguuucagauuccugggcug

SEQ ID NO: 157482 - RNA, 24 nt, Human
uuaaagugcugggauuacaggcgu

SEQ ID NO: 157483 - RNA, 24 nt, Human
uuagcagggugcgguggugggcgc

SEQ ID NO: 157484 - RNA, 23 nt, Human
uucaagcaauccuccaucuuggc

SEQ ID NO: 157485 - RNA, 24 nt, Human
uucaagcgauccuucugccucagu

SEQ ID NO: 157486 - RNA, 23 nt, Human
uucaagcgauucuccugacucag

SEQ ID NO: 157487 - RNA, 24 nt, Human
uucaagcgauucuccugacucagc

SEQ ID NO: 157488 - RNA, 18 nt, Human
uucccagugggauggaag

SEQ ID NO: 157489 - RNA, 23 nt, Human
uuccugccucgccggacccugag

SEQ ID NO: 157490 - RNA, 22 nt, Human
uucucugugugucucugugucc

SEQ ID NO: 157491 - RNA, 20 nt, Human
uugcagugagccgagaucac

SEQ ID NO: 157492 - RNA, 21 nt, Human
uugcagugagccgagaucacg

SEQ ID NO: 157493 - RNA, 25 nt, Human
uugggaggcugaggcaggagaauca

SEQ ID NO: 157494 - RNA, 24 nt, Human
uugguagagauaggauuucaccau

SEQ ID NO: 157495 - RNA, 24 nt, Human
uugguagagaugggguuuuaccau

SEQ ID NO: 157496 - RNA, 18 nt, Human
uuucacagaguacaugau

SEQ ID NO: 157497 - RNA, 21 nt, Human
uuucaccauguuagccaggcu

SEQ ID NO: 157498 - RNA, 23 nt, Human
uuuuaccauguugcucaggcugg

SEQ ID NO: 157499 - RNA, 20 nt, Human
uuuuguauuuuugguagaga

SEQ ID NO: 157500 - RNA, 24 nt, Human
uuuuugguagagauaggauuucac

SEQ ID NO: 157501 - RNA, 21 nt, Human
uuuuugguagagaugggguuu

SEQ ID NO: 157502 - RNA, 24 nt, Human
uuuuugguagagaugggguuuuac

SEQ ID NO: 157503 - RNA, 20 nt, Human
uuuuuguauuuuugguagag

SEQ ID NO: 157504 - RNA, 20 nt, Human
uuuuuguauuuuugguagag

SEQ ID NO: 157505 - RNA, 26 nt, Human
aaaaaaaaaaaaaaaagcuuuucaaa

SEQ ID NO: 157506 - RNA, 23 nt, Human
aaaaaaaaaaagcuuuucaaaag

SEQ ID NO: 157507 - RNA, 22 nt, Human
aaaagcuuuucaaaaguccacc

SEQ ID NO: 157508 - RNA, 22 nt, Human
aaaccccaucucuacuaaaaaa

SEQ ID NO: 157509 - RNA, 18 nt, Human
aacacauuaauacaaagu

SEQ ID NO: 157510 - RNA, 21 nt, Human
aacagagcaagacuccgucuc

SEQ ID NO: 157511 - RNA, 24 nt, Human
aacagagcaagacuccgucucaaa

SEQ ID NO: 157512 - RNA, 20 nt, Human
aagauggugaaaccccaucu

SEQ ID NO: 157513 - RNA, 24 nt, Human
aaggcgcccugggccggccagagg

SEQ ID NO: 157514 - RNA, 20 nt, Human
aaggugccaugguguuaaaa

SEQ ID NO: 157515 - RNA, 23 nt, Human
aauacuagcacuuugggaggcca

SEQ ID NO: 157516 - RNA, 20 nt, Human
aauuagcuuggugugguagu

SEQ ID NO: 157517 - RNA, 18 nt, Human
aauugcuugaacccgaga

SEQ ID NO: 157518 - RNA, 24 nt, Human
acaaugucaaccauagaagcuuua

SEQ ID NO: 157519 - RNA, 24 nt, Human
acagagcaagacuccgucucaaaa

SEQ ID NO: 157520 - RNA, 25 nt, Human
accccaucucuacuaaaaaauacaa

SEQ ID NO: 157521 - RNA, 28 nt, Human
acuccgucucaaaaaaaaaaaaaaaaaa

SEQ ID NO: 157522 - RNA, 18 nt, Human
acugcacuccagccuggg

SEQ ID NO: 157523 - RNA, 18 nt, Human
acugcacuccagccuggg

SEQ ID NO: 157524 - RNA, 19 nt, Human
acugcacuccagccugggc

SEQ ID NO: 157525 - RNA, 21 nt, Human
acugcacuccagccugggcaa

SEQ ID NO: 157526 - RNA, 22 nt, Human
acugcacuccagccugggcaac

SEQ ID NO: 157527 - RNA, 24 nt, Human
acugcacuccagccugggcaacag

SEQ ID NO: 157528 - RNA, 24 nt, Human
acugcacuccagccugggcaacag

SEQ ID NO: 157529 - RNA, 24 nt, Human
agacggagggugcagugagccgag

SEQ ID NO: 157530 - RNA, 24 nt, Human
agcacuuugggaggccaagguggg

SEQ ID NO: 157531 - RNA, 24 nt, Human
agccuggccaagauggugaaaccc

SEQ ID NO: 157532 - RNA, 24 nt, Human
agccugggcaacagagcaagacuc

SEQ ID NO: 157533 - RNA, 23 nt, Human
aggcagacaauugcuugaacccg

SEQ ID NO: 157534 - RNA, 18 nt, Human
aggccaagguggguggau

SEQ ID NO: 157535 - RNA, 23 nt, Human
aggcugaggcagacaauugcuug

SEQ ID NO: 157536 - RNA, 20 nt, Human
auagaacaauauuaccuaca

SEQ ID NO: 157537 - RNA, 18 nt, Human
aucaacugaggucaggaa

SEQ ID NO: 157538 - RNA, 24 nt, Human
aucgugcuacugcacuccagccug

SEQ ID NO: 157539 - RNA, 24 nt, Human
caaaaggugccaugguguuaaaaa

SEQ ID NO: 157540 - RNA, 22 nt, Human
caaccauagaagcuuuaaguac

SEQ ID NO: 157541 - RNA, 21 nt, Human
caagacuccgucucaaaaaaa

SEQ ID NO: 157542 - RNA, 24 nt, Human
caagguggguggaucaacugaggu

SEQ ID NO: 157543 - RNA, 26 nt, Human
caagguggguggaucaacugagguca

SEQ ID NO: 157544 - RNA, 23 nt, Human
caccuguaaucccagcuacucgg

SEQ ID NO: 157545 - RNA, 24 nt, Human
caccuguaaucccagcuacucggg

SEQ ID NO: 157546 - RNA, 24 nt, Human
cagcuacucgggaggcugaggcag

SEQ ID NO: 157547 - RNA, 18 nt, Human
caggucauaucaagaguu

SEQ ID NO: 157548 - RNA, 22 nt, Human
cauuuucccauuuguuuuugcu

SEQ ID NO: 157549 - RNA, 27 nt, Human
ccaauuuccuuccauuuuacuuuccua

SEQ ID NO: 157550 - RNA, 24 nt, Human
ccccauauagaaaaccuuuuuaaa

SEQ ID NO: 157551 - RNA, 20 nt, Human
ccuagaaaugcacccaauuu

SEQ ID NO: 157552 - RNA, 20 nt, Human
ccucaaaagcuuuucggcug

SEQ ID NO: 157553 - RNA, 24 nt, Human
ccuggccaagauggugaaacccca

SEQ ID NO: 157554 - RNA, 22 nt, Human
ccugggcaacagagcaagacuc

SEQ ID NO: 157555 - RNA, 21 nt, Human
ccuguaaucccagcuacucgg

SEQ ID NO: 157556 - RNA, 23 nt, Human
cuaaugcugaugucaaaaccaga

SEQ ID NO: 157557 - RNA, 19 nt, Human
cuacuaaaaaauacaaaaa

SEQ ID NO: 157558 - RNA, 20 nt, Human
cuacugcacuccagccuggg

SEQ ID NO: 157559 - RNA, 21 nt, Human
cuacugcacuccagccugggc

SEQ ID NO: 157560 - RNA, 24 nt, Human
cuacugcacuccagccugggcaac

SEQ ID NO: 157561 - RNA, 18 nt, Human
cucaaaaaaaaaaaaaaa

SEQ ID NO: 157562 - RNA, 23 nt, Human
cucaaaaaaaaaaaaaaaaaaaa

SEQ ID NO: 157563 - RNA, 19 nt, Human
cuccgucucaaaaaaaaaa

SEQ ID NO: 157564 - RNA, 21 nt, Human
cucuacuaaaaaauacaaaaa

SEQ ID NO: 157565 - RNA, 19 nt, Human
cugaaggcgcccugggccg

SEQ ID NO: 157566 - RNA, 19 nt, Human
cuggggagguugggcugaa

SEQ ID NO: 157567 - RNA, 21 nt, Human
cuguaaucccagcuacucggg

SEQ ID NO: 157568 - RNA, 21 nt, Human
gaacccgagagacggagggug

SEQ ID NO: 157569 - RNA, 23 nt, Human
gagaucgugcuacugcacuccag

SEQ ID NO: 157570 - RNA, 18 nt, Human
gaucaacugaggucagga

SEQ ID NO: 157571 - RNA, 24 nt, Human
gaucaacugaggucaggaauucaa

SEQ ID NO: 157572 - RNA, 24 nt, Human
gcacuccagccugggcaacagagc

SEQ ID NO: 157573 - RNA, 20 nt, Human
gcacuuugggaggccaaggu

SEQ ID NO: 157574 - RNA, 24 nt, Human
gccaagauggugaaaccccaucuc

SEQ ID NO: 157575 - RNA, 18 nt, Human
gcgcaccuguaaucccag

SEQ ID NO: 157576 - RNA, 22 nt, Human
gcuacugcacuccagccugggc

SEQ ID NO: 157577 - RNA, 24 nt, Human
gcuacugcacuccagccugggcaa

SEQ ID NO: 157578 - RNA, 24 nt, Human
ggagggugcagugagccgagaucg

SEQ ID NO: 157579 - RNA, 23 nt, Human
ggcauggugguucacgcccauaa

SEQ ID NO: 157580 - RNA, 20 nt, Human
ggccaagauggugaaacccc

SEQ ID NO: 157581 - RNA, 22 nt, Human
gggcuggggagguugggcugaa

SEQ ID NO: 157582 - RNA, 24 nt, Human
gguagugcgcaccuguaaucccag

SEQ ID NO: 157583 - RNA, 24 nt, Human
gucagccccucaaaagcuuuucgg

SEQ ID NO: 157584 - RNA, 22 nt, Human
gugcagugagccgagaucgugc

SEQ ID NO: 157585 - RNA, 22 nt, Human
guggaucaacugaggucaggaa

SEQ ID NO: 157586 - RNA, 23 nt, Human
uaaaaaauacaaaaauuagcuug

SEQ ID NO: 157587 - RNA, 21 nt, Human
uacugcacuccagccugggca

SEQ ID NO: 157588 - RNA, 22 nt, Human
uacugcacuccagccugggcaa

SEQ ID NO: 157589 - RNA, 23 nt, Human
uacugcacuccagccugggcaac

SEQ ID NO: 157590 - RNA, 24 nt, Human
uacugcacuccagccugggcaaca

SEQ ID NO: 157591 - RNA, 19 nt, Human
uagaacaauauuaccuaca

SEQ ID NO: 157592 - RNA, 22 nt, Human
uagacauauguuagaaaagucc

SEQ ID NO: 157593 - RNA, 24 nt, Human
uagcacuuugggaggccaaggugg

SEQ ID NO: 157594 - RNA, 19 nt, Human
uagcauuugcaguagcucc

SEQ ID NO: 157595 - RNA, 20 nt, Human
uaggaaggugcccagaauag

SEQ ID NO: 157596 - RNA, 19 nt, Human
uaguuuguauaguagucuu

SEQ ID NO: 157597 - RNA, 25 nt, Human
uauaaaaauauaguuagcucucaaa

SEQ ID NO: 157598 - RNA, 27 nt, Human
uauucuauccucuuaaaaguucucggu

SEQ ID NO: 157599 - RNA, 23 nt, Human
ucaaaaaaaaaaaaaaaaaaaaa

SEQ ID NO: 157600 - RNA, 24 nt, Human
ucaagaguuuuuugaacuccaggg

SEQ ID NO: 157601 - RNA, 18 nt, Human
ucagccccucaaaagcuu

SEQ ID NO: 157602 - RNA, 23 nt, Human
uccgucucaaaaaaaaaaaaaaa

SEQ ID NO: 157603 - RNA, 18 nt, Human
ucggcugggcaugguggu

SEQ ID NO: 157604 - RNA, 22 nt, Human
ucgggaggcugaggcagacaau

SEQ ID NO: 157605 - RNA, 23 nt, Human
ucgugcuacugcacuccagccug

SEQ ID NO: 157606 - RNA, 22 nt, Human
ucucuacuaaaaaauacaaaaa

SEQ ID NO: 157607 - RNA, 19 nt, Human
ugaaaccccaucucuacua

SEQ ID NO: 157608 - RNA, 23 nt, Human
ugacuaaugcugaugucaaaacc

SEQ ID NO: 157609 - RNA, 22 nt, Human
ugagccgagaucgugcuacugc

SEQ ID NO: 157610 - RNA, 23 nt, Human
ugaggcagacaauugcuugaacc

SEQ ID NO: 157611 - RNA, 23 nt, Human
ugaggcagacaauugcuugaacc

SEQ ID NO: 157612 - RNA, 24 nt, Human
ugaggcagacaauugcuugaaccc

SEQ ID NO: 157613 - RNA, 21 nt, Human
ugcaguagcuccaacagugcu

SEQ ID NO: 157614 - RNA, 23 nt, Human
ugcaguagcuccaacagugcuuc

SEQ ID NO: 157615 - RNA, 23 nt, Human
ugccaugguguuaaaaauuaaaa

SEQ ID NO: 157616 - RNA, 24 nt, Human
ugcuacugcacuccagccugggca

SEQ ID NO: 157617 - RNA, 24 nt, Human
uggaucaacugaggucaggaauuc

SEQ ID NO: 157618 - RNA, 23 nt, Human
ugggaggccaagguggguggauc

SEQ ID NO: 157619 - RNA, 24 nt, Human
ugggaggccaagguggguggauca

SEQ ID NO: 157620 - RNA, 24 nt, Human
uggguggaucaacugaggucagga

SEQ ID NO: 157621 - RNA, 24 nt, Human
ugguagugcgcaccuguaauccca

SEQ ID NO: 157622 - RNA, 20 nt, Human
uggugugguagugcgcaccu

SEQ ID NO: 157623 - RNA, 23 nt, Human
uggugugguagugcgcaccugua

SEQ ID NO: 157624 - RNA, 19 nt, Human
uuaaaaguucucggucaca

SEQ ID NO: 157625 - RNA, 20 nt, Human
uuagcuuggugugguagugc

SEQ ID NO: 157626 - RNA, 20 nt, Human
uuagcuuggugugguagugc

SEQ ID NO: 157627 - RNA, 24 nt, Human
uugcuugaacccgagagacggagg

SEQ ID NO: 157628 - RNA, 21 nt, Human
uuuaaugccacuuaagucagu

SEQ ID NO: 157629 - RNA, 20 nt, Human
uuuccauguauucuauccuc

SEQ ID NO: 157630 - RNA, 24 nt, Human
aaaagaaagagaaauaguggaaaa

SEQ ID NO: 157631 - RNA, 24 nt, Human
aaagaaagagaaauaguggaaaac

SEQ ID NO: 157632 - RNA, 23 nt, Human
aacauuuaacacagcguaaaaua

SEQ ID NO: 157633 - RNA, 22 nt, Human
aagaaagagaaauaguggaaaa

SEQ ID NO: 157634 - RNA, 18 nt, Human
accacacuccgggcuguc

SEQ ID NO: 157635 - RNA, 19 nt, Human
accccaggaccugggcagc

SEQ ID NO: 157636 - RNA, 22 nt, Human
agaaauaguggaaaacuguuaa

SEQ ID NO: 157637 - RNA, 20 nt, Human
cacuaauagaaaagaaagag

SEQ ID NO: 157638 - RNA, 19 nt, Human
cacuccgggcugucccagc

SEQ ID NO: 157639 - RNA, 20 nt, Human
cagcguaaaauacauugccc

SEQ ID NO: 157640 - RNA, 19 nt, Human
caggaccugggcagcgcuu

SEQ ID NO: 157641 - RNA, 22 nt, Human
ccccaggaccugggcagcgcuu

SEQ ID NO: 157642 - RNA, 18 nt, Human
cucccgcuggcugccacc

SEQ ID NO: 157643 - RNA, 21 nt, Human
cuuaaagagucucuuccaggg

SEQ ID NO: 157644 - RNA, 18 nt, Human
gagcugcuaaccacacuc

SEQ ID NO: 157645 - RNA, 21 nt, Human
gaggucuuaaagagucucuuc

SEQ ID NO: 157646 - RNA, 19 nt, Human
gagucucuuccagggguuu

SEQ ID NO: 157647 - RNA, 20 nt, Human
ggcagcgcuugccgagcugc

SEQ ID NO: 157648 - RNA, 20 nt, Human
gggcagcgcuugccgagcug

SEQ ID NO: 157649 - RNA, 24 nt, Human
uaacacagcguaaaauacauugcc

SEQ ID NO: 157650 - RNA, 22 nt, Human
uaaccacacuccgggcuguccc

SEQ ID NO: 157651 - RNA, 26 nt, Human
ugccaccaccccaggaccugggcagc

SEQ ID NO: 157652 - RNA, 19 nt, Human
ugccgagcugcuaaccaca

SEQ ID NO: 157653 - RNA, 20 nt, Human
uugccgagcugcuaaccacc

SEQ ID NO: 157654 - RNA, 18 nt, Human
aauggauaagaaccagaa

SEQ ID NO: 157655 - RNA, 22 nt, Human
acauuugggggagaguuugggg

SEQ ID NO: 157656 - RNA, 18 nt, Human
acugcagaagaauauaug

SEQ ID NO: 157657 - RNA, 19 nt, Human
acuuggugugugugugcuc

SEQ ID NO: 157658 - RNA, 21 nt, Human
aggcagagcagcagccugagg

SEQ ID NO: 157659 - RNA, 22 nt, Human
agugagagcuaaacaaccgccu

SEQ ID NO: 157660 - RNA, 23 nt, Human
auaauggauaagaaccagaaaag

SEQ ID NO: 157661 - RNA, 21 nt, Human
auccaugugugugcauaucug

SEQ ID NO: 157662 - RNA, 23 nt, Human
auccgugugugugcauaucucug

SEQ ID NO: 157663 - RNA, 24 nt, Human
aucuguguguguacaucggugugu

SEQ ID NO: 157664 - RNA, 23 nt, Human
augugcgugcauccauguguaua

SEQ ID NO: 157665 - RNA, 21 nt, Human
auguguauaucugugugugca

SEQ ID NO: 157666 - RNA, 18 nt, Human
caccucucccucccuccc

SEQ ID NO: 157667 - RNA, 18 nt, Human
cagagcagcagccugagg

SEQ ID NO: 157668 - RNA, 20 nt, Human
cagcagaucacgugcaggug

SEQ ID NO: 157669 - RNA, 18 nt, Human
cagcccggcacccagcga

SEQ ID NO: 157670 - RNA, 18 nt, Human
cauaucucugugugugug

SEQ ID NO: 157671 - RNA, 24 nt, Human
caugugcgugcauccauguguaua

SEQ ID NO: 157672 - RNA, 18 nt, Human
ccccaccucucccucccu

SEQ ID NO: 157673 - RNA, 25 nt, Human
cccuccccaccucucccucccuccc

SEQ ID NO: 157674 - RNA, 20 nt, Human
cccuccucuaccccauuaaa

SEQ ID NO: 157675 - RNA, 21 nt, Human
cccugccuguugacauucccc

SEQ ID NO: 157676 - RNA, 20 nt, Human
ccggcacccagcgaagggag

SEQ ID NO: 157677 - RNA, 21 nt, Human
ccgugugugugcauaucucug

SEQ ID NO: 157678 - RNA, 22 nt, Human
ccuuggcacuccccugccccuc

SEQ ID NO: 157679 - RNA, 21 nt, Human
cgcacuuggugugugugugcu

SEQ ID NO: 157680 - RNA, 19 nt, Human
cggcacccagcgaagggag

SEQ ID NO: 157681 - RNA, 21 nt, Human
cggugugugcauaucucugug

SEQ ID NO: 157682 - RNA, 23 nt, Human
cgguguguuugcguaucucugug

SEQ ID NO: 157683 - RNA, 23 nt, Human
cuaaacaaccgccuucagaggac

SEQ ID NO: 157684 - RNA, 20 nt, Human
cuccaggacaaccuuggcac

SEQ ID NO: 157685 - RNA, 20 nt, Human
cucuuugagucucucuccau

SEQ ID NO: 157686 - RNA, 21 nt, Human
cugaagggagguaaggaggcu

SEQ ID NO: 157687 - RNA, 25 nt, Human
cugaauugucugaagugaagaugau

SEQ ID NO: 157688 - RNA, 22 nt, Human
cugcagugcugccccugccugu

SEQ ID NO: 157689 - RNA, 23 nt, Human
cugucucugucucccuccccacc

SEQ ID NO: 157690 - RNA, 21 nt, Human
cugugugaccaucugugugug

SEQ ID NO: 157691 - RNA, 18 nt, Human
cugugugugcauaucucu

SEQ ID NO: 157692 - RNA, 21 nt, Human
cuuggcacuccccugccccuc

SEQ ID NO: 157693 - RNA, 23 nt, Human
gaagcugggaagcagguggggaa

SEQ ID NO: 157694 - RNA, 23 nt, Human
gaucacgugcagguggggcuugg

SEQ ID NO: 157695 - RNA, 21 nt, Human
gcauaucucugugugugugca

SEQ ID NO: 157696 - RNA, 21 nt, Human
gcucagcugggcugucugccu

SEQ ID NO: 157697 - RNA, 22 nt, Human
gguggcaggcaccacaggugug

SEQ ID NO: 157698 - RNA, 22 nt, Human
ggugugugugcaucugugugug

SEQ ID NO: 157699 - RNA, 24 nt, Human
ggugugugugcgcacuuggugugu

SEQ ID NO: 157700 - RNA, 21 nt, Human
gugcauccauguguauaucug

SEQ ID NO: 157701 - RNA, 25 nt, Human
gugugugcauaucucuaugugcgug

SEQ ID NO: 157702 - RNA, 24 nt, Human
gugugugcauaucucugugcaucc

SEQ ID NO: 157703 - RNA, 21 nt, Human
gugugugcauccgugugugug

SEQ ID NO: 157704 - RNA, 21 nt, Human
gugugugcaucugugugugca

SEQ ID NO: 157705 - RNA, 23 nt, Human
gugugugcauuggcgugugugug

SEQ ID NO: 157706 - RNA, 20 nt, Human
gugugugugcaucugugugu

SEQ ID NO: 157707 - RNA, 24 nt, Human
gugugugugugugcauccaugugu

SEQ ID NO: 157708 - RNA, 22 nt, Human
guuugggggcauucgccaccau

SEQ ID NO: 157709 - RNA, 21 nt, Human
uaaacaaccgccuucagagga

SEQ ID NO: 157710 - RNA, 24 nt, Human
uaucugugugugcaucugugugug

SEQ ID NO: 157711 - RNA, 25 nt, Human
ucagagucucucccucagucucucu

SEQ ID NO: 157712 - RNA, 22 nt, Human
uccagcgccugucugccucugc

SEQ ID NO: 157713 - RNA, 20 nt, Human
uccaucucugugucucuauu

SEQ ID NO: 157714 - RNA, 18 nt, Human
uccccaccucucccuccc

SEQ ID NO: 157715 - RNA, 22 nt, Human
uccccaccucucccucccuccc

SEQ ID NO: 157716 - RNA, 24 nt, Human
uccgugugugugcauaucucugug

SEQ ID NO: 157717 - RNA, 23 nt, Human
ucggugugugugcaucugugugu

SEQ ID NO: 157718 - RNA, 24 nt, Human
ucggugugugugcaucugugugug

SEQ ID NO: 157719 - RNA, 27 nt, Human
ucucucugucucugucucucucuguuu

SEQ ID NO: 157720 - RNA, 20 nt, Human
ucucugucucccuccccacc

SEQ ID NO: 157721 - RNA, 23 nt, Human
ucucugugucucuauuagucucu

SEQ ID NO: 157722 - RNA, 19 nt, Human
ucucuguuucugucucugu

SEQ ID NO: 157723 - RNA, 23 nt, Human
ucugccucugccucucaucuuuu

SEQ ID NO: 157724 - RNA, 25 nt, Human
ucugucucucucuguuucugucucu

SEQ ID NO: 157725 - RNA, 18 nt, Human
ucugucucugucucucuc

SEQ ID NO: 157726 - RNA, 21 nt, Human
ucugugugugcauccgugugu

SEQ ID NO: 157727 - RNA, 21 nt, Human
ucugugugugcaucugugugu

SEQ ID NO: 157728 - RNA, 21 nt, Human
ucugugugugcaucugugugu

SEQ ID NO: 157729 - RNA, 25 nt, Human
ucugugugugcgcacaucggugugu

SEQ ID NO: 157730 - RNA, 23 nt, Human
ucuguguguguacaucggugugu

SEQ ID NO: 157731 - RNA, 22 nt, Human
ucuguuucugucucugucuccc

SEQ ID NO: 157732 - RNA, 22 nt, Human
ugaagggagguaaggaggcuca

SEQ ID NO: 157733 - RNA, 21 nt, Human
ugcauaucucuaugugcgugu

SEQ ID NO: 157734 - RNA, 24 nt, Human
ugcauccauguguauaucugugug

SEQ ID NO: 157735 - RNA, 24 nt, Human
ugcccuccucuaccccauuaacug

SEQ ID NO: 157736 - RNA, 19 nt, Human
uggcacuccccugccccuc

SEQ ID NO: 157737 - RNA, 28 nt, Human
uggcgugugugugugugcauccaugugu

SEQ ID NO: 157738 - RNA, 20 nt, Human
uggugugugugugcucaucc

SEQ ID NO: 157739 - RNA, 21 nt, Human
uguccucagagucucucccuc

SEQ ID NO: 157740 - RNA, 24 nt, Human
ugugcauaucucugugugugugca

SEQ ID NO: 157741 - RNA, 19 nt, Human
uguguacaucggugugugu

SEQ ID NO: 157742 - RNA, 22 nt, Human
ugugugaccaucugugugugca

SEQ ID NO: 157743 - RNA, 19 nt, Human
ugugugcauaucucuaugu

SEQ ID NO: 157744 - RNA, 19 nt, Human
ugugugcauaucucugugc

SEQ ID NO: 157745 - RNA, 23 nt, Human
ugugugcauaucucugugcaucc

SEQ ID NO: 157746 - RNA, 19 nt, Human
ugugugcauaucucugugu

SEQ ID NO: 157747 - RNA, 21 nt, Human
ugugugcauaucucugugugu

SEQ ID NO: 157748 - RNA, 24 nt, Human
ugugugcauaucucugugugugug

SEQ ID NO: 157749 - RNA, 19 nt, Human
ugugugcauaucugugugu

SEQ ID NO: 157750 - RNA, 22 nt, Human
ugugugcauaucugugugugcg

SEQ ID NO: 157751 - RNA, 18 nt, Human
ugugugcauccaugugug

SEQ ID NO: 157752 - RNA, 19 nt, Human
ugugugcauccgugugugu

SEQ ID NO: 157753 - RNA, 20 nt, Human
ugugugcaucugugugugca

SEQ ID NO: 157754 - RNA, 20 nt, Human
ugugugcaucugugugugca

SEQ ID NO: 157755 - RNA, 20 nt, Human
ugugugcaucugugugugua

SEQ ID NO: 157756 - RNA, 19 nt, Human
ugugugcauuggcgugugu

SEQ ID NO: 157757 - RNA, 22 nt, Human
ugugugcauuggcgugugugug

SEQ ID NO: 157758 - RNA, 22 nt, Human
ugugugcgcacaucggugugug

SEQ ID NO: 157759 - RNA, 20 nt, Human
ugugugcgcacuuggugugu

SEQ ID NO: 157760 - RNA, 23 nt, Human
ugugugcgcacuuggugugugug

SEQ ID NO: 157761 - RNA, 26 nt, Human
ugugugcgugcauuggcaugugcgug

SEQ ID NO: 157762 - RNA, 22 nt, Human
ugugugcucauccaugugugug

SEQ ID NO: 157763 - RNA, 24 nt, Human
ugugugugcauaucugugugugcg

SEQ ID NO: 157764 - RNA, 22 nt, Human
ugugugugcauccauguguguu

SEQ ID NO: 157765 - RNA, 20 nt, Human
ugugugugcauccgugugug

SEQ ID NO: 157766 - RNA, 21 nt, Human
ugugugugcauccgugugugu

SEQ ID NO: 157767 - RNA, 19 nt, Human
ugugugugcaucugugugu

SEQ ID NO: 157768 - RNA, 20 nt, Human
ugugugugcaucugugugug

SEQ ID NO: 157769 - RNA, 21 nt, Human
ugugugugcaucugugugugc

SEQ ID NO: 157770 - RNA, 21 nt, Human
ugugugugcaucugugugugc

SEQ ID NO: 157771 - RNA, 21 nt, Human
ugugugugcaucugugugugu

SEQ ID NO: 157772 - RNA, 22 nt, Human
ugugugugcaucugugugugua

SEQ ID NO: 157773 - RNA, 23 nt, Human
ugugugugcgcacuuggugugug

SEQ ID NO: 157774 - RNA, 26 nt, Human
ugugugugcgcacuuggugugugugu

SEQ ID NO: 157775 - RNA, 22 nt, Human
uguguguguacaucggugugug

SEQ ID NO: 157776 - RNA, 23 nt, Human
uguguguguacaucggugugugu

SEQ ID NO: 157777 - RNA, 22 nt, Human
ugugugugugcauccaugugug

SEQ ID NO: 157778 - RNA, 21 nt, Human
ugugugugugcucauccaugu

SEQ ID NO: 157779 - RNA, 26 nt, Human
ugugugugugcucauccaugugugug

SEQ ID NO: 157780 - RNA, 18 nt, Human
ugugugugugugcaucca

SEQ ID NO: 157781 - RNA, 18 nt, Human
uguuucugucucugucuc

SEQ ID NO: 157782 - RNA, 19 nt, Human
uuaacugcagaagaauaua

SEQ ID NO: 157783 - RNA, 24 nt, Human
uuggugccaggacaguucgacgca

SEQ ID NO: 157784 - RNA, 26 nt, Human
aaauguucaacuggagaagcaaaagg

SEQ ID NO: 157785 - RNA, 20 nt, Human
acaacagaggaaguggugac

SEQ ID NO: 157786 - RNA, 26 nt, Human
agaagacauuguuauuuuauuucaaa

SEQ ID NO: 157787 - RNA, 21 nt, Human
agcacaaagguagaaggcaag

SEQ ID NO: 157788 - RNA, 22 nt, Human
aggaaaauaaaagagcuaguuc

SEQ ID NO: 157789 - RNA, 18 nt, Human
aggaagcagaaacagacu

SEQ ID NO: 157790 - RNA, 22 nt, Human
aggaagcagaaacagacuuuac

SEQ ID NO: 157791 - RNA, 21 nt, Human
agggauucuugaaccccaucu

SEQ ID NO: 157792 - RNA, 19 nt, Human
agguagaaggcaagccagg

SEQ ID NO: 157793 - RNA, 21 nt, Human
agugaaggggucaggcagaug

SEQ ID NO: 157794 - RNA, 19 nt, Human
aucaucauuuucuuucuug

SEQ ID NO: 157795 - RNA, 21 nt, Human
caaucuuauggggguggaggg

SEQ ID NO: 157796 - RNA, 24 nt, Human
caccaaagaaaugcaggacugaug

SEQ ID NO: 157797 - RNA, 25 nt, Human
caccaaagaaaugcaggacugauga

SEQ ID NO: 157798 - RNA, 20 nt, Human
cacccuccuggccccccacc

SEQ ID NO: 157799 - RNA, 21 nt, Human
caccugcaucauuuguggauu

SEQ ID NO: 157800 - RNA, 21 nt, Human
cagaaaauagguaagaguuaa

SEQ ID NO: 157801 - RNA, 18 nt, Human
cagaggaaguggugacuc

SEQ ID NO: 157802 - RNA, 22 nt, Human
cagcaggaaaauaaaagagcua

SEQ ID NO: 157803 - RNA, 23 nt, Human
cagcauagaaaaaaguagccauu

SEQ ID NO: 157804 - RNA, 21 nt, Human
caggagauucuguguagucau

SEQ ID NO: 157805 - RNA, 21 nt, Human
caggaggggaaaaaaguaaaa

SEQ ID NO: 157806 - RNA, 18 nt, Human
caggggacuuagggauuc

SEQ ID NO: 157807 - RNA, 22 nt, Human
ccaggaggggaaaaaaguaaaa

SEQ ID NO: 157808 - RNA, 23 nt, Human
cccccuuuacuaucaggagauuc

SEQ ID NO: 157809 - RNA, 18 nt, Human
cccuccuggccccccacc

SEQ ID NO: 157810 - RNA, 18 nt, Human
ccuccagcccccuuuacu

SEQ ID NO: 157811 - RNA, 20 nt, Human
ccuccuggccccccaccaaa

SEQ ID NO: 157812 - RNA, 18 nt, Human
cuccucacuucuuuuugc

SEQ ID NO: 157813 - RNA, 22 nt, Human
gaggagggagaggugacggcag

SEQ ID NO: 157814 - RNA, 21 nt, Human
gaggugacggcaguggcaggu

SEQ ID NO: 157815 - RNA, 18 nt, Human
gcuuuguuccaugcuuga

SEQ ID NO: 157816 - RNA, 20 nt, Human
ggcuauaaaccauuugcacc

SEQ ID NO: 157817 - RNA, 22 nt, Human
gggagcagcugcagaaaauagg

SEQ ID NO: 157818 - RNA, 18 nt, Human
guaaggaagcagaaacag

SEQ ID NO: 157819 - RNA, 22 nt, Human
gucaauguuuuauuuaacucau

SEQ ID NO: 157820 - RNA, 18 nt, Human
guggugauauggcagacu

SEQ ID NO: 157821 - RNA, 24 nt, Human
guuuguaucuccuaucucagauaa

SEQ ID NO: 157822 - RNA, 19 nt, Human
uaaaacaaaacaacuuauu

SEQ ID NO: 157823 - RNA, 22 nt, Human
uaaaacaaaacaacuuauucaa

SEQ ID NO: 157824 - RNA, 21 nt, Human
uacaacagaggaaguggugac

SEQ ID NO: 157825 - RNA, 20 nt, Human
uacuccagcauagaaaaaag

SEQ ID NO: 157826 - RNA, 18 nt, Human
uagaaaauacuccagcau

SEQ ID NO: 157827 - RNA, 26 nt, Human
uagaaaauacuccagcauagaaaaaa

SEQ ID NO: 157828 - RNA, 24 nt, Human
uagccucuaaacuuuaagaacuuc

SEQ ID NO: 157829 - RNA, 20 nt, Human
uauuucaaagcuuucaacaa

SEQ ID NO: 157830 - RNA, 18 nt, Human
ucacaaauuucaagaaga

SEQ ID NO: 157831 - RNA, 22 nt, Human
uccaaaugauuugccuuuugac

SEQ ID NO: 157832 - RNA, 21 nt, Human
uccaagauuguauugaucuga

SEQ ID NO: 157833 - RNA, 22 nt, Human
uccaagauuguauugaucugau

SEQ ID NO: 157834 - RNA, 21 nt, Human
uccaugaacauuugagaaaua

SEQ ID NO: 157835 - RNA, 21 nt, Human
uccuuuagaagccuaauguca

SEQ ID NO: 157836 - RNA, 22 nt, Human
ucuaaaauaucuuuagcuccca

SEQ ID NO: 157837 - RNA, 20 nt, Human
ucuccucacuucuuuuugcc

SEQ ID NO: 157838 - RNA, 23 nt, Human
ucucuccauuuugcagauugucc

SEQ ID NO: 157839 - RNA, 26 nt, Human
ugcacccuccuggccccccaccaaag

SEQ ID NO: 157840 - RNA, 21 nt, Human
ugcauccuccugacuuauuuu

SEQ ID NO: 157841 - RNA, 24 nt, Human
ugcauccuccugacuuauuuuuuu

SEQ ID NO: 157842 - RNA, 22 nt, Human
ugcuacaaauguucaacuggag

SEQ ID NO: 157843 - RNA, 24 nt, Human
uggagggcaagaagggggauccua

SEQ ID NO: 157844 - RNA, 21 nt, Human
ugggagcagcugcagaaaaua

SEQ ID NO: 157845 - RNA, 25 nt, Human
uggggguggagggcaagaaggggga

SEQ ID NO: 157846 - RNA, 24 nt, Human
uguauauagucaaugggaaaagaa

SEQ ID NO: 157847 - RNA, 23 nt, Human
uguguggugauauggcagacugg

SEQ ID NO: 157848 - RNA, 19 nt, Human
uucaccaguccaauuuucu

SEQ ID NO: 157849 - RNA, 22 nt, Human
uugcaaucuuuggaugcuuccu

SEQ ID NO: 157850 - RNA, 18 nt, Human
uugcaccugcaucauuug

SEQ ID NO: 157851 - RNA, 18 nt, Human
uuuagcucccaggagggg

SEQ ID NO: 157852 - RNA, 23 nt, Human
uuucaugcagguuucuccucacu

SEQ ID NO: 157853 - RNA, 23 nt, Human
uuuuugccuaguuauauuggaag

SEQ ID NO: 157854 - RNA, 24 nt, Human
aaaauccucacuaugaaacaaagg

SEQ ID NO: 157855 - RNA, 20 nt, Human
aaaauguguucucggggugc

SEQ ID NO: 157856 - RNA, 19 nt, Human
aauaaaauccucacuauga

SEQ ID NO: 157857 - RNA, 19 nt, Human
acaaaacgcagaagcggga

SEQ ID NO: 157858 - RNA, 26 nt, Human
acaggcaaagucaucugguuaacgug

SEQ ID NO: 157859 - RNA, 18 nt, Human
agaagacagccauguccu

SEQ ID NO: 157860 - RNA, 19 nt, Human
aggaaggagacgaaaggga

SEQ ID NO: 157861 - RNA, 25 nt, Human
aggaauaacaaaacgcagaagccgg

SEQ ID NO: 157862 - RNA, 23 nt, Human
aggcaggaggcugcguuaggugg

SEQ ID NO: 157863 - RNA, 19 nt, Human
aggcggaggcaggaggcug

SEQ ID NO: 157864 - RNA, 18 nt, Human
caaaacgcagaagcggga

SEQ ID NO: 157865 - RNA, 19 nt, Human
caggccugggcaaaaagaa

SEQ ID NO: 157866 - RNA, 21 nt, Human
ccaagcacuucccgacgcgcc

SEQ ID NO: 157867 - RNA, 23 nt, Human
ccagacgcaaacguggaugcaug

SEQ ID NO: 157868 - RNA, 22 nt, Human
cccgacgcgccgccgcagcugg

SEQ ID NO: 157869 - RNA, 24 nt, Human
cccgacgcgccgccgcagcuggcg

SEQ ID NO: 157870 - RNA, 26 nt, Human
ccucacuaugaaacaaaggcggaggc

SEQ ID NO: 157871 - RNA, 22 nt, Human
cgacgcgccgccgcagcuggcg

SEQ ID NO: 157872 - RNA, 18 nt, Human
cgccgugcaaaauaaaau

SEQ ID NO: 157873 - RNA, 23 nt, Human
cguggcuuuuuagaagacagcca

SEQ ID NO: 157874 - RNA, 19 nt, Human
cugauucuaucaaaaugug

SEQ ID NO: 157875 - RNA, 23 nt, Human
gaagacagccauguccucuacuc

SEQ ID NO: 157876 - RNA, 21 nt, Human
gaggaaggagacgaaagggau

SEQ ID NO: 157877 - RNA, 23 nt, Human
uauguuaagaagugaggggcagg

SEQ ID NO: 157878 - RNA, 21 nt, Human
uccuauggcggcaguaggaau

SEQ ID NO: 157879 - RNA, 23 nt, Human
ugcaaaaaguccaggccugggca

SEQ ID NO: 157880 - RNA, 25 nt, Human
ugcaaaauaaaauccucacuaugaa

SEQ ID NO: 157881 - RNA, 18 nt, Human
uggaagcagcggaggaag

SEQ ID NO: 157882 - RNA, 24 nt, Human
uggaagcagcggaggaaggagacg

SEQ ID NO: 157883 - RNA, 23 nt, Human
uggcggcaguaggaauaacaaaa

SEQ ID NO: 157884 - RNA, 21 nt, Human
ugggcaaaaagaagucacugg

SEQ ID NO: 157885 - RNA, 24 nt, Human
uuggccauuacaaagacacaggaa

SEQ ID NO: 157886 - RNA, 24 nt, Human
uuuagagggagggcgccgugcaaa

SEQ ID NO: 157887 - RNA, 19 nt, Human
uuuagggcugugguuacaa

SEQ ID NO: 157888 - RNA, 22 nt, Human
aacacgaaaccagaaaaggaca

SEQ ID NO: 157889 - RNA, 21 nt, Human
aacuuaguuggcugauuggaa

SEQ ID NO: 157890 - RNA, 21 nt, Human
aacuuuucccccaaacuuuuc

SEQ ID NO: 157891 - RNA, 23 nt, Human
acacacacgcauacacacacaca

SEQ ID NO: 157892 - RNA, 29 nt, Human
acacacgcauacacacacacacuauauag

SEQ ID NO: 157893 - RNA, 19 nt, Human
acauguauaacuguguaca

SEQ ID NO: 157894 - RNA, 25 nt, Human
agaagaucgggaagauggaaugcug

SEQ ID NO: 157895 - RNA, 21 nt, Human
agacaugauacuuauguccuc

SEQ ID NO: 157896 - RNA, 21 nt, Human
agagaaaaacugauuugggga

SEQ ID NO: 157897 - RNA, 24 nt, Human
agcaagucuccacuauggaagcaa

SEQ ID NO: 157898 - RNA, 23 nt, Human
aggaauaggguagaggaaaagga

SEQ ID NO: 157899 - RNA, 20 nt, Human
aggcaacuucaacuucuugc

SEQ ID NO: 157900 - RNA, 22 nt, Human
agggagagagggaguaagaaag

SEQ ID NO: 157901 - RNA, 22 nt, Human
auauguguguaugcgugugugu

SEQ ID NO: 157902 - RNA, 23 nt, Human
auuauauuccucuagugguucca

SEQ ID NO: 157903 - RNA, 23 nt, Human
auucuuccucaaagucucuacua

SEQ ID NO: 157904 - RNA, 19 nt, Human
auugaggaauaggguagag

SEQ ID NO: 157905 - RNA, 22 nt, Human
auuuuauauauauauuauauau

SEQ ID NO: 157906 - RNA, 22 nt, Human
caaaauguuccauggugaacac

SEQ ID NO: 157907 - RNA, 19 nt, Human
caacucucuagaagauuca

SEQ ID NO: 157908 - RNA, 22 nt, Human
caacucucuagaagauucaaga

SEQ ID NO: 157909 - RNA, 22 nt, Human
cacacacgcauacacacacaca

SEQ ID NO: 157910 - RNA, 27 nt, Human
cacacacgcauacacacacacacuaua

SEQ ID NO: 157911 - RNA, 22 nt, Human
cacgaaaccagaaaaggacaac

SEQ ID NO: 157912 - RNA, 19 nt, Human
cacugcugaagacacacug

SEQ ID NO: 157913 - RNA, 23 nt, Human
cagaaugaugcuccccaucucuc

SEQ ID NO: 157914 - RNA, 27 nt, Human
cagcaacucucuagaagauucaagaua

SEQ ID NO: 157915 - RNA, 23 nt, Human
cagguaaaauaugaaauucuccc

SEQ ID NO: 157916 - RNA, 25 nt, Human
cauacacacacacacuauauauuua

SEQ ID NO: 157917 - RNA, 26 nt, Human
caucucuccuuuaacgaccauggagg

SEQ ID NO: 157918 - RNA, 19 nt, Human
ccagaaaaggacaacuuag

SEQ ID NO: 157919 - RNA, 20 nt, Human
ccuccauaaccauacaagcu

SEQ ID NO: 157920 - RNA, 22 nt, Human
cucaaagucucuacuagcugua

SEQ ID NO: 157921 - RNA, 20 nt, Human
cugauggacagaguggagaa

SEQ ID NO: 157922 - RNA, 21 nt, Human
gaccauggaggguaaaaggga

SEQ ID NO: 157923 - RNA, 19 nt, Human
gaggaauaggguagaggaa

SEQ ID NO: 157924 - RNA, 18 nt, Human
gauugggauuuggaaaag

SEQ ID NO: 157925 - RNA, 25 nt, Human
gcauacacacacacacuauauauuu

SEQ ID NO: 157926 - RNA, 21 nt, Human
ggagggaaaauugagugaguu

SEQ ID NO: 157927 - RNA, 23 nt, Human
ggaguaagaaagagaaaaacuga

SEQ ID NO: 157928 - RNA, 18 nt, Human
ggggauugggauuuggaa

SEQ ID NO: 157929 - RNA, 20 nt, Human
guuagcauuauuauuauuau

SEQ ID NO: 157930 - RNA, 21 nt, Human
uaacaaaagaugggaaaguga

SEQ ID NO: 157931 - RNA, 21 nt, Human
uaacuuaacucucugaaagaa

SEQ ID NO: 157932 - RNA, 27 nt, Human
uacacacacgcauacacacacacacua

SEQ ID NO: 157933 - RNA, 21 nt, Human
uacagaacuaauaaacauuga

SEQ ID NO: 157934 - RNA, 18 nt, Human
uacuucaucccuauguuc

SEQ ID NO: 157935 - RNA, 19 nt, Human
uagccucucagcuacuccu

SEQ ID NO: 157936 - RNA, 23 nt, Human
uaguaucugauggacagagugga

SEQ ID NO: 157937 - RNA, 19 nt, Human
uauauguguguaugcgugu

SEQ ID NO: 157938 - RNA, 22 nt, Human
uauauguguguaugcgugugug

SEQ ID NO: 157939 - RNA, 25 nt, Human
uauauuuuauauauauauuauauau

SEQ ID NO: 157940 - RNA, 19 nt, Human
ucaacuucuugcuuggcuc

SEQ ID NO: 157941 - RNA, 21 nt, Human
uccccuguaaagagaaaaagc

SEQ ID NO: 157942 - RNA, 19 nt, Human
ucuccacuauggaagcaag

SEQ ID NO: 157943 - RNA, 23 nt, Human
ucucugaaagaaacuuuuccccc

SEQ ID NO: 157944 - RNA, 28 nt, Human
ugaaaagcaagucuccacuauggaagca

SEQ ID NO: 157945 - RNA, 18 nt, Human
ugaagacacacuguugaa

SEQ ID NO: 157946 - RNA, 24 nt, Human
ugaguuaguugccauaguggagaa

SEQ ID NO: 157947 - RNA, 19 nt, Human
ugauguuuugguuggagaa

SEQ ID NO: 157948 - RNA, 21 nt, Human
uggaaugacuuaugccuuuga

SEQ ID NO: 157949 - RNA, 19 nt, Human
ugggaaagugauuaguuag

SEQ ID NO: 157950 - RNA, 19 nt, Human
uggugaacacgaaaccaga

SEQ ID NO: 157951 - RNA, 26 nt, Human
ugucuacacacacgcauacacacaca

SEQ ID NO: 157952 - RNA, 18 nt, Human
uguguguaugcgugugug

SEQ ID NO: 157953 - RNA, 20 nt, Human
uuagaaagaguacaauaugu

SEQ ID NO: 157954 - RNA, 18 nt, Human
uuauugcuuccauuauau

SEQ ID NO: 157955 - RNA, 22 nt, Human
uucaggcaccuuacuucauccc

SEQ ID NO: 157956 - RNA, 21 nt, Human
uucccccaaacuuuucaggca

SEQ ID NO: 157957 - RNA, 21 nt, Human
uuggagaagcaaagaagaucg

SEQ ID NO: 157958 - RNA, 22 nt, Human
uuuaacgaccauggaggguaaa

SEQ ID NO: 157959 - RNA, 20 nt, Human
uuuaacuucacaauuuuguc

SEQ ID NO: 157960 - RNA, 21 nt, Human
uuugauagacauguauaacug

SEQ ID NO: 157961 - RNA, 19 nt, Human
uuugucaagggcugggccc

SEQ ID NO: 157962 - RNA, 28 nt, Human
aaacaguacaaaucacaagguccgucaa

SEQ ID NO: 157963 - RNA, 18 nt, Human
aacauuuuuuacauaagc

SEQ ID NO: 157964 - RNA, 25 nt, Human
aacauuuuuuacauaagcucaacau

SEQ ID NO: 157965 - RNA, 21 nt, Human
aagaauggccagggacggggu

SEQ ID NO: 157966 - RNA, 22 nt, Human
aagccuccccagaagggacagc

SEQ ID NO: 157967 - RNA, 22 nt, Human
acacagcccauccugccuggcc

SEQ ID NO: 157968 - RNA, 21 nt, Human
accacagaucccacagaccca

SEQ ID NO: 157969 - RNA, 22 nt, Human
accgcagcucccagcgcgcagc

SEQ ID NO: 157970 - RNA, 19 nt, Human
accucggagggcgagaagg

SEQ ID NO: 157971 - RNA, 20 nt, Human
accugcugaugcuccacaau

SEQ ID NO: 157972 - RNA, 18 nt, Human
acgggguggggcugccac

SEQ ID NO: 157973 - RNA, 24 nt, Human
agaaggaggcggcggggggcggag

SEQ ID NO: 157974 - RNA, 25 nt, Human
agaaggaggcggcggggggcggagc

SEQ ID NO: 157975 - RNA, 21 nt, Human
agaggggcugccccagggucu

SEQ ID NO: 157976 - RNA, 20 nt, Human
agcaaacaguacaaaucaca

SEQ ID NO: 157977 - RNA, 18 nt, Human
agcuggcagggccagagg

SEQ ID NO: 157978 - RNA, 22 nt, Human
aggaagaagugggucaccaagg

SEQ ID NO: 157979 - RNA, 19 nt, Human
aggacggagggggugggag

SEQ ID NO: 157980 - RNA, 18 nt, Human
aggaggcggcggggggcg

SEQ ID NO: 157981 - RNA, 21 nt, Human
aggauggagacaggaccgaga

SEQ ID NO: 157982 - RNA, 18 nt, Human
aggcaggggagggacggc

SEQ ID NO: 157983 - RNA, 19 nt, Human
aggcagggggaggugaggc

SEQ ID NO: 157984 - RNA, 25 nt, Human
aggcggcggggggcggagcgggggc

SEQ ID NO: 157985 - RNA, 23 nt, Human
agggacagcagggaggacaggga

SEQ ID NO: 157986 - RNA, 19 nt, Human
aguccugugggcugagcuc

SEQ ID NO: 157987 - RNA, 20 nt, Human
aucccuucagccugcugcug

SEQ ID NO: 157988 - RNA, 18 nt, Human
auuggccaaaugcuucuc

SEQ ID NO: 157989 - RNA, 22 nt, Human
caaaucuucuacuucuuauugc

SEQ ID NO: 157990 - RNA, 22 nt, Human
caagaaaagcugcgagguccua

SEQ ID NO: 157991 - RNA, 19 nt, Human
cacaauuggacagcaggac

SEQ ID NO: 157992 - RNA, 21 nt, Human
caccaagggccaccuggccac

SEQ ID NO: 157993 - RNA, 27 nt, Human
cagaaagacacgaacaggauggagaca

SEQ ID NO: 157994 - RNA, 19 nt, Human
cagcagcugcucgcccccc

SEQ ID NO: 157995 - RNA, 21 nt, Human
cagcagggcagcugugcccug

SEQ ID NO: 157996 - RNA, 18 nt, Human
cagccucccuuggggaga

SEQ ID NO: 157997 - RNA, 18 nt, Human
cagcgcgcagcccggcgu

SEQ ID NO: 157998 - RNA, 20 nt, Human
cagcucccagcgcgcagccc

SEQ ID NO: 157999 - RNA, 21 nt, Human
cagcucccagcgcgcagcccg

SEQ ID NO: 158000 - RNA, 20 nt, Human
cagcuccuaggcagcccaug

SEQ ID NO: 158001 - RNA, 19 nt, Human
cagcuggcagggccagagg

SEQ ID NO: 158002 - RNA, 18 nt, Human
cagcugggacuccugcca

SEQ ID NO: 158003 - RNA, 22 nt, Human
caggcagcuccuaggcagccca

SEQ ID NO: 158004 - RNA, 25 nt, Human
caggcagcuccuaggcagcccauga

SEQ ID NO: 158005 - RNA, 19 nt, Human
cagggacgcuccaggaaga

SEQ ID NO: 158006 - RNA, 22 nt, Human
cagggcccccucagcaccuucc

SEQ ID NO: 158007 - RNA, 20 nt, Human
caucacgcugucucuucuug

SEQ ID NO: 158008 - RNA, 25 nt, Human
caugaggcuaaggcacaagggugac

SEQ ID NO: 158009 - RNA, 22 nt, Human
ccaaaaacaggaggaaacaaca

SEQ ID NO: 158010 - RNA, 24 nt, Human
ccaaccuucuuaauggggucugaa

SEQ ID NO: 158011 - RNA, 21 nt, Human
ccaagggccaccuggccacca

SEQ ID NO: 158012 - RNA, 19 nt, Human
ccacagaucccacagaccc

SEQ ID NO: 158013 - RNA, 18 nt, Human
ccaccaaagccuccccag

SEQ ID NO: 158014 - RNA, 22 nt, Human
ccacugguggagaagccuccuc

SEQ ID NO: 158015 - RNA, 21 nt, Human
ccagggacgggguggggcugc

SEQ ID NO: 158016 - RNA, 18 nt, Human
ccccgcggcggacccagc

SEQ ID NO: 158017 - RNA, 18 nt, Human
cccggcgucugcuccucg

SEQ ID NO: 158018 - RNA, 20 nt, Human
ccgaaaacugcagaaagaca

SEQ ID NO: 158019 - RNA, 24 nt, Human
ccucagagccaccaaagccucccc

SEQ ID NO: 158020 - RNA, 22 nt, Human
ccugcucacuggcuucuccuuc

SEQ ID NO: 158021 - RNA, 19 nt, Human
ccuggagaugggguagggg

SEQ ID NO: 158022 - RNA, 21 nt, Human
ccuguggccacggccugaagc

SEQ ID NO: 158023 - RNA, 23 nt, Human
ccugugggcugagcucuaggcag

SEQ ID NO: 158024 - RNA, 27 nt, Human
cgcagcccggcgucugcuccucgugcc

SEQ ID NO: 158025 - RNA, 19 nt, Human
cgcccuggcccgcagcagc

SEQ ID NO: 158026 - RNA, 23 nt, Human
cgggaaggggccagggccgggcu

SEQ ID NO: 158027 - RNA, 24 nt, Human
cgggggccauggccggagaccgcc

SEQ ID NO: 158028 - RNA, 23 nt, Human
cgggguggaggccaagaauggcc

SEQ ID NO: 158029 - RNA, 21 nt, Human
cuaccaggggucaggagggcg

SEQ ID NO: 158030 - RNA, 19 nt, Human
cucagagccaccaaagccu

SEQ ID NO: 158031 - RNA, 24 nt, Human
cucucccacguaguacugcuccag

SEQ ID NO: 158032 - RNA, 21 nt, Human
cugcagaaagacacgaacagg

SEQ ID NO: 158033 - RNA, 19 nt, Human
cugcugccuaccgcccggc

SEQ ID NO: 158034 - RNA, 18 nt, Human
cugcugcuccccgcggag

SEQ ID NO: 158035 - RNA, 18 nt, Human
cugcugcugccuaccgcc

SEQ ID NO: 158036 - RNA, 20 nt, Human
cuuauugccgaaaacugcag

SEQ ID NO: 158037 - RNA, 21 nt, Human
cuucuaagccccuaagcgggc

SEQ ID NO: 158038 - RNA, 21 nt, Human
cuucuaagccccuaagcgggc

SEQ ID NO: 158039 - RNA, 18 nt, Human
gaaagacacgaacaggau

SEQ ID NO: 158040 - RNA, 25 nt, Human
gaaggaggcggcggggggcggagcg

SEQ ID NO: 158041 - RNA, 25 nt, Human
gaggcaggggagggacggcaagaaa

SEQ ID NO: 158042 - RNA, 21 nt, Human
gagggcaggacggagggggug

SEQ ID NO: 158043 - RNA, 19 nt, Human
gagggcgguccugccucag

SEQ ID NO: 158044 - RNA, 22 nt, Human
gcagcuggcagggccagagggg

SEQ ID NO: 158045 - RNA, 23 nt, Human
gcaguccugugggcugagcucua

SEQ ID NO: 158046 - RNA, 24 nt, Human
gccaagaauggccagggacggggu

SEQ ID NO: 158047 - RNA, 20 nt, Human
gccacauggggguggaggga

SEQ ID NO: 158048 - RNA, 24 nt, Human
gcccauccugccuggccaagccaa

SEQ ID NO: 158049 - RNA, 22 nt, Human
gcccccucagcaccuuccacua

SEQ ID NO: 158050 - RNA, 24 nt, Human
gcgcagcccggcgucugcuccucg

SEQ ID NO: 158051 - RNA, 21 nt, Human
gcugccacugguggagaagcc

SEQ ID NO: 158052 - RNA, 20 nt, Human
gcugugauucuggaggcagg

SEQ ID NO: 158053 - RNA, 21 nt, Human
ggagaagccuccucagccucc

SEQ ID NO: 158054 - RNA, 25 nt, Human
ggagcucucccacguaguacugcuc

SEQ ID NO: 158055 - RNA, 23 nt, Human
ggcaggaaccucaucugcggagg

SEQ ID NO: 158056 - RNA, 18 nt, Human
ggcccgcagcagcugcuc

SEQ ID NO: 158057 - RNA, 20 nt, Human
ggcggagcgggggccauggc

SEQ ID NO: 158058 - RNA, 21 nt, Human
ggcugcagagagugugagucu

SEQ ID NO: 158059 - RNA, 23 nt, Human
ggcugccacauggggguggaggg

SEQ ID NO: 158060 - RNA, 22 nt, Human
ggcugccacugguggagaagcc

SEQ ID NO: 158061 - RNA, 19 nt, Human
gggagaggacacggaagcc

SEQ ID NO: 158062 - RNA, 19 nt, Human
gggaggacagggaccacag

SEQ ID NO: 158063 - RNA, 23 nt, Human
gggauggagguccagacucaggg

SEQ ID NO: 158064 - RNA, 24 nt, Human
gggcaggacggagggggugggagu

SEQ ID NO: 158065 - RNA, 24 nt, Human
gggccagaggggcugccccagggu

SEQ ID NO: 158066 - RNA, 26 nt, Human
gggccagggccgggcugagggcagga

SEQ ID NO: 158067 - RNA, 20 nt, Human
gggccccgcggcggacccag

SEQ ID NO: 158068 - RNA, 21 nt, Human
ggggccauggccggagaccgc

SEQ ID NO: 158069 - RNA, 20 nt, Human
ggggcggagcgggggccaug

SEQ ID NO: 158070 - RNA, 21 nt, Human
gggucgggaaggggccagggc

SEQ ID NO: 158071 - RNA, 19 nt, Human
ggguggacugugggaggca

SEQ ID NO: 158072 - RNA, 19 nt, Human
ggugaggcacugagaggug

SEQ ID NO: 158073 - RNA, 22 nt, Human
guccugccucagggcccccuca

SEQ ID NO: 158074 - RNA, 20 nt, Human
gucucuucuugcgagagcuc

SEQ ID NO: 158075 - RNA, 24 nt, Human
gugcggcggcccguccaggucggc

SEQ ID NO: 158076 - RNA, 24 nt, Human
guggggcugccacugguggagaag

SEQ ID NO: 158077 - RNA, 19 nt, Human
uaaagcaagcagcugggac

SEQ ID NO: 158078 - RNA, 19 nt, Human
uaagaaaggaaccaaaaac

SEQ ID NO: 158079 - RNA, 22 nt, Human
uaagccccuaagcgggcagcaa

SEQ ID NO: 158080 - RNA, 19 nt, Human
uaccaggggucaggagggc

SEQ ID NO: 158081 - RNA, 18 nt, Human
ucacuggcuucuccuucu

SEQ ID NO: 158082 - RNA, 23 nt, Human
ucagggcccccucagcaccuucc

SEQ ID NO: 158083 - RNA, 21 nt, Human
uccaggaagaagugggucacc

SEQ ID NO: 158084 - RNA, 18 nt, Human
ucccaguuuccaguuucu

SEQ ID NO: 158085 - RNA, 22 nt, Human
ucccuucagccugcugcugccu

SEQ ID NO: 158086 - RNA, 18 nt, Human
ucccuuggggagaagggc

SEQ ID NO: 158087 - RNA, 22 nt, Human
uccggggagguggugagcgcca

SEQ ID NO: 158088 - RNA, 21 nt, Human
ucuggaggcaggggagggacg

SEQ ID NO: 158089 - RNA, 20 nt, Human
ucugggagcgcccgaguagg

SEQ ID NO: 158090 - RNA, 20 nt, Human
ucuugcuucagggauugggu

SEQ ID NO: 158091 - RNA, 21 nt, Human
ugaagcaguccugugggcuga

SEQ ID NO: 158092 - RNA, 18 nt, Human
ugaggcuaaggcacaagg

SEQ ID NO: 158093 - RNA, 21 nt, Human
ugagugaguuggaaaccugcu

SEQ ID NO: 158094 - RNA, 21 nt, Human
ugauucuggaggcaggggagg

SEQ ID NO: 158095 - RNA, 18 nt, Human
ugccacugguggagaagc

SEQ ID NO: 158096 - RNA, 19 nt, Human
ugcccugacuaggcugggc

SEQ ID NO: 158097 - RNA, 22 nt, Human
ugccucagggcccccucagcac

SEQ ID NO: 158098 - RNA, 27 nt, Human
ugccucagggcccccucagcaccuucc

SEQ ID NO: 158099 - RNA, 21 nt, Human
ugcggaggcugggaggcaggg

SEQ ID NO: 158100 - RNA, 21 nt, Human
ugcuguggcagcagggcagcu

SEQ ID NO: 158101 - RNA, 20 nt, Human
uggagaugggguagggguua

SEQ ID NO: 158102 - RNA, 18 nt, Human
uggcagggccagaggggc

SEQ ID NO: 158103 - RNA, 20 nt, Human
uggccagggacggggugggg

SEQ ID NO: 158104 - RNA, 18 nt, Human
uggcgggugggggucggg

SEQ ID NO: 158105 - RNA, 19 nt, Human
uggggcugccacuggugga

SEQ ID NO: 158106 - RNA, 18 nt, Human
ugggggucgggaaggggc

SEQ ID NO: 158107 - RNA, 22 nt, Human
ugggggucgggaaggggccagg

SEQ ID NO: 158108 - RNA, 19 nt, Human
ugggguagggguuaaugag

SEQ ID NO: 158109 - RNA, 22 nt, Human
uuaaauagcuccgcagcaaaca

SEQ ID NO: 158110 - RNA, 20 nt, Human
uuauuggccaaaugcuucuc

SEQ ID NO: 158111 - RNA, 22 nt, Human
uucauuuccccuugcggcugcu

SEQ ID NO: 158112 - RNA, 26 nt, Human
uuuacauaagcucaacauguaggauc

SEQ ID NO: 158113 - RNA, 22 nt, Human
uuuguccaccucagagccacca

SEQ ID NO: 158114 - RNA, 24 nt, Human
uuuugguuacgaggaggaaggggc

SEQ ID NO: 158115 - RNA, 18 nt, Human
uuuuuuuuuuuuuguuuc

SEQ ID NO: 158116 - RNA, 18 nt, Human
uuuuuuuuuuuuuuuuug

SEQ ID NO: 158117 - RNA, 18 nt, Human
uuuuuuuuuuuuuuuuug

SEQ ID NO: 158118 - RNA, 19 nt, Human
uuuuuuuuuuuuuuuuuug

SEQ ID NO: 158119 - RNA, 22 nt, Human
uuuuuuuuuuuuuuuuuuguuu

SEQ ID NO: 158120 - RNA, 19 nt, Human
aaaauaauaugaaaugcag

SEQ ID NO: 158121 - RNA, 19 nt, Human
guggcaauagagcucccuc

SEQ ID NO: 158122 - RNA, 24 nt, Human
uaaaauaauaugaaaugcagacuu

SEQ ID NO: 158123 - RNA, 18 nt, Human
uucacgacugaccugcgg

SEQ ID NO: 158124 - RNA, 23 nt, Human
aaaaagaaaacaaaacaaaaauu

SEQ ID NO: 158125 - RNA, 24 nt, Human
aaaaagaaaacaaaacaaaaauua

SEQ ID NO: 158126 - RNA, 21 nt, Human
aaaaagaagggggugguuaaa

SEQ ID NO: 158127 - RNA, 20 nt, Human
aaaaauuguacccccucucc

SEQ ID NO: 158128 - RNA, 20 nt, Human
aaaagaaaacaaaacaaaaa

SEQ ID NO: 158129 - RNA, 23 nt, Human
aaagaaaaaaaacaacuugagag

SEQ ID NO: 158130 - RNA, 24 nt, Human
aaagaaaacaaaacaaaaauuagc

SEQ ID NO: 158131 - RNA, 24 nt, Human
aacaacuugagaggcugaggcagg

SEQ ID NO: 158132 - RNA, 20 nt, Human
aaccaucacccccugaauaa

SEQ ID NO: 158133 - RNA, 22 nt, Human
aacccacaacaacaaaaaagaa

SEQ ID NO: 158134 - RNA, 27 nt, Human
aacccacaacaacaaaaaaggaaaguc

SEQ ID NO: 158135 - RNA, 21 nt, Human
aaggaaacuuuuugagcccug

SEQ ID NO: 158136 - RNA, 22 nt, Human
aaggaaacuuuuugagcccugg

SEQ ID NO: 158137 - RNA, 18 nt, Human
acuacauuccagccugag

SEQ ID NO: 158138 - RNA, 20 nt, Human
acuugauggggugaaauaaa

SEQ ID NO: 158139 - RNA, 19 nt, Human
agagcugagaggauaucua

SEQ ID NO: 158140 - RNA, 25 nt, Human
agauguuaaagacucauaugcagcc

SEQ ID NO: 158141 - RNA, 24 nt, Human
aggauugcuugaggccagggguuc

SEQ ID NO: 158142 - RNA, 24 nt, Human
aggcaggaagauugcaugagucca

SEQ ID NO: 158143 - RNA, 18 nt, Human
aggcaggaggauugcuug

SEQ ID NO: 158144 - RNA, 23 nt, Human
aggcaggaggauugcuugaggcc

SEQ ID NO: 158145 - RNA, 27 nt, Human
aggccagggguucaagaccagccuggg

SEQ ID NO: 158146 - RNA, 21 nt, Human
aggcugaggcaggaggauugc

SEQ ID NO: 158147 - RNA, 24 nt, Human
aggcugaggcaggaggauugcuug

SEQ ID NO: 158148 - RNA, 21 nt, Human
aggcugcaucagaaucaccag

SEQ ID NO: 158149 - RNA, 19 nt, Human
auagaucuucuguccaauu

SEQ ID NO: 158150 - RNA, 18 nt, Human
caagauguuaaagacuca

SEQ ID NO: 158151 - RNA, 21 nt, Human
cacgcaguauucagcuuucaa

SEQ ID NO: 158152 - RNA, 21 nt, Human
cacuacauuccagccugagug

SEQ ID NO: 158153 - RNA, 22 nt, Human
cacuacauuccagccugaguga

SEQ ID NO: 158154 - RNA, 19 nt, Human
cagaagccugaggcaggaa

SEQ ID NO: 158155 - RNA, 18 nt, Human
caggaguuugagguuaca

SEQ ID NO: 158156 - RNA, 23 nt, Human
cagugccagaaaauuauucacaa

SEQ ID NO: 158157 - RNA, 18 nt, Human
caucgcccccugccaacc

SEQ ID NO: 158158 - RNA, 23 nt, Human
cauuccagccugagugaaagagu

SEQ ID NO: 158159 - RNA, 20 nt, Human
ccacuacauuccagccugag

SEQ ID NO: 158160 - RNA, 20 nt, Human
ccacuacauuccagccugag

SEQ ID NO: 158161 - RNA, 21 nt, Human
ccacuacauuccagccugagu

SEQ ID NO: 158162 - RNA, 24 nt, Human
ccagaaaauuauucacaaccaguu

SEQ ID NO: 158163 - RNA, 23 nt, Human
cccucucucuacgaaaacagucu

SEQ ID NO: 158164 - RNA, 19 nt, Human
cccugccaacccuccaacu

SEQ ID NO: 158165 - RNA, 24 nt, Human
ccuagcuacucagaagccugaggc

SEQ ID NO: 158166 - RNA, 21 nt, Human
ccucuaggcagcuagagauuc

SEQ ID NO: 158167 - RNA, 24 nt, Human
cgcccccugccaacccuccaacuc

SEQ ID NO: 158168 - RNA, 19 nt, Human
cuaaaauacaauuauguga

SEQ ID NO: 158169 - RNA, 23 nt, Human
cuaugaucucuccacuacauucc

SEQ ID NO: 158170 - RNA, 21 nt, Human
cuguaaccaucacccccugaa

SEQ ID NO: 158171 - RNA, 19 nt, Human
cuugaggccagggguucaa

SEQ ID NO: 158172 - RNA, 24 nt, Human
gaaaaaacccacaacaacaaaaaa

SEQ ID NO: 158173 - RNA, 26 nt, Human
gaaaaaacccacaacaacaaaaaaga

SEQ ID NO: 158174 - RNA, 22 nt, Human
gagucagccucuaggcagcuag

SEQ ID NO: 158175 - RNA, 24 nt, Human
gauugcaugaguccaggaguuuga

SEQ ID NO: 158176 - RNA, 20 nt, Human
gccaacccuccaacucuucc

SEQ ID NO: 158177 - RNA, 23 nt, Human
ggauugcuugaggccagggguuc

SEQ ID NO: 158178 - RNA, 20 nt, Human
gguacaauauagaucuucug

SEQ ID NO: 158179 - RNA, 22 nt, Human
gucauauguauauaccacuuag

SEQ ID NO: 158180 - RNA, 19 nt, Human
guccaauuuguauuuugga

SEQ ID NO: 158181 - RNA, 26 nt, Human
uaaaaagaaaacaaaacaaaaauuag

SEQ ID NO: 158182 - RNA, 23 nt, Human
uaagacccucucucuacgaaaac

SEQ ID NO: 158183 - RNA, 23 nt, Human
uaaguaaauuaucaucgcccccu

SEQ ID NO: 158184 - RNA, 21 nt, Human
uaaguuuucuggcugagcaua

SEQ ID NO: 158185 - RNA, 18 nt, Human
uacaaaaauguaauacaa

SEQ ID NO: 158186 - RNA, 26 nt, Human
uacauuuuaauauauaugucauaugu

SEQ ID NO: 158187 - RNA, 24 nt, Human
uaccaauguuuauaaaaggaccaa

SEQ ID NO: 158188 - RNA, 22 nt, Human
uacgucaugugaaaauaugaau

SEQ ID NO: 158189 - RNA, 24 nt, Human
uauagcaagaccccaucucuaaaa

SEQ ID NO: 158190 - RNA, 27 nt, Human
uauagcaagaccccaucucuaaaaaaa

SEQ ID NO: 158191 - RNA, 24 nt, Human
uauaugucauauguauauaccacu

SEQ ID NO: 158192 - RNA, 19 nt, Human
ucagccaagcgugggaaug

SEQ ID NO: 158193 - RNA, 21 nt, Human
ucgcccccugccaacccucca

SEQ ID NO: 158194 - RNA, 18 nt, Human
ucucagaugauccugauu

SEQ ID NO: 158195 - RNA, 20 nt, Human
ucucuaaaaaaaauaaaaag

SEQ ID NO: 158196 - RNA, 27 nt, Human
ugaaaaaacccacaacaacaaaaaaga

SEQ ID NO: 158197 - RNA, 19 nt, Human
ugaaauaaauaguucuggu

SEQ ID NO: 158198 - RNA, 27 nt, Human
ugaauaaaaggaaacuuuuugagcccc

SEQ ID NO: 158199 - RNA, 23 nt, Human
ugagaggauaucuaucaaaauca

SEQ ID NO: 158200 - RNA, 22 nt, Human
ugagaggcugaggcaggaggau

SEQ ID NO: 158201 - RNA, 24 nt, Human
ugaggcaggaagauugcaugaguc

SEQ ID NO: 158202 - RNA, 24 nt, Human
ugaggcaggaggauugcuugaggc

SEQ ID NO: 158203 - RNA, 25 nt, Human
ugaggcaggaggauugcuugaggcc

SEQ ID NO: 158204 - RNA, 26 nt, Human
ugaggcaggaggauugcuugaggcca

SEQ ID NO: 158205 - RNA, 18 nt, Human
ugcaugaguccaggaguu

SEQ ID NO: 158206 - RNA, 22 nt, Human
ugggcaauauagcaagacccca

SEQ ID NO: 158207 - RNA, 18 nt, Human
uguaaccaucacccccug

SEQ ID NO: 158208 - RNA, 21 nt, Human
uguaaccaucacccccugaau

SEQ ID NO: 158209 - RNA, 20 nt, Human
uguauugggaaauaucugcc

SEQ ID NO: 158210 - RNA, 21 nt, Human
ugucaauucauauucacauac

SEQ ID NO: 158211 - RNA, 19 nt, Human
ugucuauuauucuacacuc

SEQ ID NO: 158212 - RNA, 21 nt, Human
ugugaaaaaacccacaacaac

SEQ ID NO: 158213 - RNA, 23 nt, Human
uguguuuaugugaaaaaacccac

SEQ ID NO: 158214 - RNA, 21 nt, Human
uuauaagugagaacacgcagu

SEQ ID NO: 158215 - RNA, 24 nt, Human
uuauaagugagaacacgcaguauu

SEQ ID NO: 158216 - RNA, 25 nt, Human
uugagaggcugaggcaggaggauug

SEQ ID NO: 158217 - RNA, 22 nt, Human
uugaggccagggguucaagacc

SEQ ID NO: 158218 - RNA, 23 nt, Human
uugcagcugcaaaugcuuaaaaa

SEQ ID NO: 158219 - RNA, 23 nt, Human
uugcuugaggccagggguucaag

SEQ ID NO: 158220 - RNA, 20 nt, Human
uuucucagaugauccugauu

SEQ ID NO: 158221 - RNA, 20 nt, Human
uuuucagccaagcgugggaa

SEQ ID NO: 158222 - RNA, 22 nt, Human
uuuuugagcccuggaaaauugg

SEQ ID NO: 158223 - RNA, 21 nt, Human
aaaaaaaaaaaaaaccacaua

SEQ ID NO: 158224 - RNA, 31 nt, Human
augagugcaguuaaaaaaaaaaaaaaaaaaa

SEQ ID NO: 158225 - RNA, 19 nt, Human
ccaugggaacuggaacugg

SEQ ID NO: 158226 - RNA, 20 nt, Human
ccaugggaacuggaacugga

SEQ ID NO: 158227 - RNA, 23 nt, Human
cuaugagugcaguuaaaaaaaaa

SEQ ID NO: 158228 - RNA, 25 nt, Human
cucagagcacccuaugagugcaguu

SEQ ID NO: 158229 - RNA, 21 nt, Human
cugaccccagaagaauucgug

SEQ ID NO: 158230 - RNA, 26 nt, Human
gugcaguuaaaaaaaaaaaaaaaaaa

SEQ ID NO: 158231 - RNA, 20 nt, Human
guggugcugagucgaggggu

SEQ ID NO: 158232 - RNA, 22 nt, Human
ucagagcacccuaugagugcag

SEQ ID NO: 158233 - RNA, 18 nt, Human
ugaccucagagcacccua

SEQ ID NO: 158234 - RNA, 24 nt, Human
ugagugcaguuaaaaaaaaaaaaa

SEQ ID NO: 158235 - RNA, 20 nt, Human
uuggcagaguaguagucagc

SEQ ID NO: 158236 - RNA, 23 nt, Human
aaacaacaauaucuuuuugaaca

SEQ ID NO: 158237 - RNA, 25 nt, Human
caauaucuuuuugaacaauauaucc

SEQ ID NO: 158238 - RNA, 20 nt, Human
uaaaucagggaaaacaacaa

SEQ ID NO: 158239 - RNA, 18 nt, Human
ucaaugcgaacuucaguc

SEQ ID NO: 158240 - RNA, 21 nt, Human
ucagggaaaacaacaauaucu

SEQ ID NO: 158241 - RNA, 19 nt, Human
ugaauaaaaucagcuuggg

SEQ ID NO: 158242 - RNA, 21 nt, Human
uuuugaacaauauaucccaca

SEQ ID NO: 158243 - RNA, 25 nt, Human
aaaaaaagaaagaaacaguauggag

SEQ ID NO: 158244 - RNA, 18 nt, Human
aauuaacuccuguccaaa

SEQ ID NO: 158245 - RNA, 18 nt, Human
acaguauggagauuugcu

SEQ ID NO: 158246 - RNA, 22 nt, Human
augaaaaaaaaaagaaagaaac

SEQ ID NO: 158247 - RNA, 23 nt, Human
gcuggcgugcagagaggggucug

SEQ ID NO: 158248 - RNA, 18 nt, Human
gggcgggcuggcgugcag

SEQ ID NO: 158249 - RNA, 21 nt, Human
ugaacacaguaaugaaaaaaa

SEQ ID NO: 158250 - RNA, 20 nt, Human
uguccaaagugaugauggaa

SEQ ID NO: 158251 - RNA, 23 nt, Human
cagccccuaagucaccccacuuc

SEQ ID NO: 158252 - RNA, 18 nt, Human
cccugggccgggccuggc

SEQ ID NO: 158253 - RNA, 21 nt, Human
cuuauaaacucucccaguugc

SEQ ID NO: 158254 - RNA, 21 nt, Human
uaaacucucccaguugcugag

SEQ ID NO: 158255 - RNA, 20 nt, Human
uagcucccugggccgggccu

SEQ ID NO: 158256 - RNA, 24 nt, Human
uaucccagcuuauaaacucuccca

SEQ ID NO: 158257 - RNA, 23 nt, Human
ugaggagaauggguggugcugag

SEQ ID NO: 158258 - RNA, 25 nt, Human
uguagcucccugggccgggccuggc

SEQ ID NO: 158259 - RNA, 28 nt, Human
uuauaaacucucccaguugcugaggcuc

SEQ ID NO: 158260 - RNA, 24 nt, Human
uuguagcucccugggccgggccug

SEQ ID NO: 158261 - RNA, 24 nt, Human
uuuuuuguccuuauaucaguuuua

SEQ ID NO: 158262 - RNA, 19 nt, Human
aaacacgaacgcuuccuuc

SEQ ID NO: 158263 - RNA, 19 nt, Human
aaagcaaacauucaaaacc

SEQ ID NO: 158264 - RNA, 21 nt, Human
aaauaaccccugaaaaaggau

SEQ ID NO: 158265 - RNA, 22 nt, Human
aacacuuaaagcaaacauucaa

SEQ ID NO: 158266 - RNA, 21 nt, Human
aacauagaaauagccaacacu

SEQ ID NO: 158267 - RNA, 19 nt, Human
aacuuuaaaaaaucccugg

SEQ ID NO: 158268 - RNA, 24 nt, Human
aagaaccccgaauggacaagucaa

SEQ ID NO: 158269 - RNA, 24 nt, Human
aagcaaacauucaaaaccccaagg

SEQ ID NO: 158270 - RNA, 23 nt, Human
accuuaugcuccaacagaaacca

SEQ ID NO: 158271 - RNA, 19 nt, Human
acugugccauuuccucuga

SEQ ID NO: 158272 - RNA, 19 nt, Human
agacagaagauuuaaaacc

SEQ ID NO: 158273 - RNA, 21 nt, Human
agcagacaucucagagauagc

SEQ ID NO: 158274 - RNA, 23 nt, Human
agguaacucuuucuugaaaugcu

SEQ ID NO: 158275 - RNA, 24 nt, Human
auagaaaucagguagcauuauaag

SEQ ID NO: 158276 - RNA, 21 nt, Human
auagccaacacuuaaagcaaa

SEQ ID NO: 158277 - RNA, 20 nt, Human
auauacucccuuaauagcuu

SEQ ID NO: 158278 - RNA, 22 nt, Human
caaaauuaacaacaugaaggcc

SEQ ID NO: 158279 - RNA, 24 nt, Human
cacauuuauaguauccccuuuaca

SEQ ID NO: 158280 - RNA, 21 nt, Human
cagacagcugcagaauuugca

SEQ ID NO: 158281 - RNA, 19 nt, Human
cagcugcagaauuugcagc

SEQ ID NO: 158282 - RNA, 20 nt, Human
caggagaagagauuguggaa

SEQ ID NO: 158283 - RNA, 23 nt, Human
ccagaggcuccuuaucugcaugg

SEQ ID NO: 158284 - RNA, 23 nt, Human
cccaggaaaugaacuuuccagau

SEQ ID NO: 158285 - RNA, 20 nt, Human
ccccgaauggacaagucaaa

SEQ ID NO: 158286 - RNA, 19 nt, Human
ccuaugagaagaaccccga

SEQ ID NO: 158287 - RNA, 21 nt, Human
cucacagaccccaaaacagcu

SEQ ID NO: 158288 - RNA, 23 nt, Human
cucccgcuuacuggaaaccuuau

SEQ ID NO: 158289 - RNA, 23 nt, Human
cugaaaaaggauggagucgggga

SEQ ID NO: 158290 - RNA, 20 nt, Human
cuggaaaccuuaugcuccaa

SEQ ID NO: 158291 - RNA, 23 nt, Human
cuuacuggaaaccuuaugcucca

SEQ ID NO: 158292 - RNA, 21 nt, Human
gaaucaggccuggagaaccga

SEQ ID NO: 158293 - RNA, 19 nt, Human
gccugugagaagggacagu

SEQ ID NO: 158294 - RNA, 21 nt, Human
guacucucacagaccccaaaa

SEQ ID NO: 158295 - RNA, 24 nt, Human
guauauacucccuuaauagcuuua

SEQ ID NO: 158296 - RNA, 18 nt, Human
guucugugaaugccugug

SEQ ID NO: 158297 - RNA, 22 nt, Human
uaaaaaaucccuggagaaguga

SEQ ID NO: 158298 - RNA, 21 nt, Human
uaaagcaaacauucaaaaccc

SEQ ID NO: 158299 - RNA, 22 nt, Human
uaaagcaaacauucaaaacccc

SEQ ID NO: 158300 - RNA, 28 nt, Human
uaaagcaaacauucaaaaccccaaggug

SEQ ID NO: 158301 - RNA, 19 nt, Human
uaaagugaacugcuguuaa

SEQ ID NO: 158302 - RNA, 19 nt, Human
uaacuuagcacauuuauag

SEQ ID NO: 158303 - RNA, 23 nt, Human
uaagaauacauauaugaaguuag

SEQ ID NO: 158304 - RNA, 28 nt, Human
uaccauaaacauggucugcaacaugagg

SEQ ID NO: 158305 - RNA, 21 nt, Human
uagaaaagcagggagacagaa

SEQ ID NO: 158306 - RNA, 21 nt, Human
uagcacauuuauaguaucccc

SEQ ID NO: 158307 - RNA, 23 nt, Human
uauuaccauaaacauggucugca

SEQ ID NO: 158308 - RNA, 23 nt, Human
uauucaaaauuaacaacaugaag

SEQ ID NO: 158309 - RNA, 22 nt, Human
uauuuugguuuccuucauuguu

SEQ ID NO: 158310 - RNA, 18 nt, Human
ucaauaaguacucaagua

SEQ ID NO: 158311 - RNA, 20 nt, Human
ucacuauagaaucuaaggca

SEQ ID NO: 158312 - RNA, 24 nt, Human
ucagucaaauguggcaaagacuca

SEQ ID NO: 158313 - RNA, 20 nt, Human
uccccuuuacaauuuuuaag

SEQ ID NO: 158314 - RNA, 26 nt, Human
ucccucuagugcacuguacucuuuag

SEQ ID NO: 158315 - RNA, 24 nt, Human
ucucacagaccccaaaacagcugc

SEQ ID NO: 158316 - RNA, 26 nt, Human
ucugcaacaugaggugacuguaaggc

SEQ ID NO: 158317 - RNA, 19 nt, Human
ugagaagaaccccgaaugg

SEQ ID NO: 158318 - RNA, 20 nt, Human
ugagaagaaccccgaaugga

SEQ ID NO: 158319 - RNA, 18 nt, Human
ugagaagggacaguagca

SEQ ID NO: 158320 - RNA, 21 nt, Human
uggagaaccgaguccaagagc

SEQ ID NO: 158321 - RNA, 19 nt, Human
ugguucagugaagauaaag

SEQ ID NO: 158322 - RNA, 18 nt, Human
ugguuuccuucauuguuu

SEQ ID NO: 158323 - RNA, 25 nt, Human
uguucuguuuccucuagcauuccua

SEQ ID NO: 158324 - RNA, 20 nt, Human
uuaaagcaaacauucaaaac

SEQ ID NO: 158325 - RNA, 24 nt, Human
uuauaguauccccuuuacaauuuu

SEQ ID NO: 158326 - RNA, 25 nt, Human
uuauuuuuuggggaaaaaggcaagu

SEQ ID NO: 158327 - RNA, 21 nt, Human
uugugagauucuccagccagg

SEQ ID NO: 158328 - RNA, 22 nt, Human
uuugcagcaaguagcagacauc

SEQ ID NO: 158329 - RNA, 25 nt, Human
uuuuggaaauuuuguuuugguuuau

SEQ ID NO: 158330 - RNA, 19 nt, Human
uuuuuuggggaaaaaggca

SEQ ID NO: 158331 - RNA, 23 nt, Human
aaaaaauaaauauauaaagaaga

SEQ ID NO: 158332 - RNA, 21 nt, Human
aaaaagcccccaaauaaccaa

SEQ ID NO: 158333 - RNA, 19 nt, Human
aaagcccccaaauaaccaa

SEQ ID NO: 158334 - RNA, 18 nt, Human
aacaaugacaucaaaacc

SEQ ID NO: 158335 - RNA, 21 nt, Human
aaggugcuuuuuaaauaagcu

SEQ ID NO: 158336 - RNA, 18 nt, Human
aaguccugauuugagcac

SEQ ID NO: 158337 - RNA, 20 nt, Human
aauaaugauuaucuagacua

SEQ ID NO: 158338 - RNA, 26 nt, Human
acaagacaauaauuacacagcaacaa

SEQ ID NO: 158339 - RNA, 22 nt, Human
acagcaacaaaucuuuuguuca

SEQ ID NO: 158340 - RNA, 18 nt, Human
acauccaaacuuuuaaaa

SEQ ID NO: 158341 - RNA, 26 nt, Human
acugacucacacacauccauacacgc

SEQ ID NO: 158342 - RNA, 21 nt, Human
agacaauaauuacacagcaac

SEQ ID NO: 158343 - RNA, 24 nt, Human
aguagaauuaacagacuucagcga

SEQ ID NO: 158344 - RNA, 24 nt, Human
aguguacaaagguuaugggagaaa

SEQ ID NO: 158345 - RNA, 20 nt, Human
aucuagacuaaaaggagacu

SEQ ID NO: 158346 - RNA, 20 nt, Human
auucuuccauuuaaguuugg

SEQ ID NO: 158347 - RNA, 20 nt, Human
caaaaaguagaauuaacaga

SEQ ID NO: 158348 - RNA, 19 nt, Human
caaacuaugaaaaacacua

SEQ ID NO: 158349 - RNA, 23 nt, Human
cacacacauccauacacgcauca

SEQ ID NO: 158350 - RNA, 28 nt, Human
cacacacauccauacacgcaucagugca

SEQ ID NO: 158351 - RNA, 19 nt, Human
caggaccagcagcuucuga

SEQ ID NO: 158352 - RNA, 21 nt, Human
ccacugacucacacacaucca

SEQ ID NO: 158353 - RNA, 22 nt, Human
cccucucuugcuauuuuguuuc

SEQ ID NO: 158354 - RNA, 19 nt, Human
ccuucccaacaacgaauuc

SEQ ID NO: 158355 - RNA, 19 nt, Human
cuaauuuuaaaaugaaaua

SEQ ID NO: 158356 - RNA, 19 nt, Human
cuagagaccaauuaucaac

SEQ ID NO: 158357 - RNA, 22 nt, Human
cucacacacauccauacacgca

SEQ ID NO: 158358 - RNA, 21 nt, Human
cucacuguagcaaacugaugc

SEQ ID NO: 158359 - RNA, 24 nt, Human
cuugcagcuugagacaugcauuuc

SEQ ID NO: 158360 - RNA, 21 nt, Human
gaagagacagacacaaguuug

SEQ ID NO: 158361 - RNA, 25 nt, Human
gagaaucuuccucgaucaagaggcu

SEQ ID NO: 158362 - RNA, 19 nt, Human
ggagaaaggauaaggugcu

SEQ ID NO: 158363 - RNA, 23 nt, Human
uaaaaaagcccccaaauaaccaa

SEQ ID NO: 158364 - RNA, 24 nt, Human
uaaauacaguaaguaaaaaagccc

SEQ ID NO: 158365 - RNA, 18 nt, Human
uaacuucaacaaugacau

SEQ ID NO: 158366 - RNA, 20 nt, Human
uaagcuaccacugacucaca

SEQ ID NO: 158367 - RNA, 18 nt, Human
uaagguggugugacacag

SEQ ID NO: 158368 - RNA, 20 nt, Human
uaauccagauauaacaacag

SEQ ID NO: 158369 - RNA, 21 nt, Human
uacacagcaacaaaucuuuug

SEQ ID NO: 158370 - RNA, 24 nt, Human
uacacagcaacaaaucuuuuguuc

SEQ ID NO: 158371 - RNA, 23 nt, Human
uacauauagucaacgaaauauuc

SEQ ID NO: 158372 - RNA, 20 nt, Human
uagagaccaauuaucaacug

SEQ ID NO: 158373 - RNA, 23 nt, Human
uaugaaaaacacuaauuuuaaaa

SEQ ID NO: 158374 - RNA, 22 nt, Human
ucacacaagcaagguuucugaa

SEQ ID NO: 158375 - RNA, 19 nt, Human
ucagugcaaacuaugaaaa

SEQ ID NO: 158376 - RNA, 21 nt, Human
uccucgaucaagaggcuaagg

SEQ ID NO: 158377 - RNA, 22 nt, Human
ucucaugugucuuagugagaau

SEQ ID NO: 158378 - RNA, 19 nt, Human
ugaaagaagagacagacac

SEQ ID NO: 158379 - RNA, 22 nt, Human
ugaaauaaugauuaucuagacu

SEQ ID NO: 158380 - RNA, 22 nt, Human
ugaacagaagacuucauugaac

SEQ ID NO: 158381 - RNA, 23 nt, Human
ugaacauuauacagaacauauaa

SEQ ID NO: 158382 - RNA, 24 nt, Human
ugagaaugcuaucaucaaauacau

SEQ ID NO: 158383 - RNA, 24 nt, Human
ugcauacaagacaauaauuacaca

SEQ ID NO: 158384 - RNA, 19 nt, Human
ugggagaaaggauaaggug

SEQ ID NO: 158385 - RNA, 18 nt, Human
uggguauuuuccuaguuu

SEQ ID NO: 158386 - RNA, 26 nt, Human
ugugacacaggaccagcagcuucuga

SEQ ID NO: 158387 - RNA, 20 nt, Human
uguuacagcuguuuccccag

SEQ ID NO: 158388 - RNA, 23 nt, Human
uuacaaauaacuucaacaaugac

SEQ ID NO: 158389 - RNA, 24 nt, Human
uucaugcaucaccaaccaaacuuc

SEQ ID NO: 158390 - RNA, 24 nt, Human
uucucauacugacaaguacaguca

SEQ ID NO: 158391 - RNA, 23 nt, Human
uucucaugugucuuagugagaau

SEQ ID NO: 158392 - RNA, 24 nt, Human
uucugaggguggcaaauguuacag

SEQ ID NO: 158393 - RNA, 21 nt, Human
uuuaaaaucacugcuucccca

SEQ ID NO: 158394 - RNA, 24 nt, Human
uuuccuaguuucaacagaugaaca

SEQ ID NO: 158395 - RNA, 25 nt, Human
aaacaaccagggaaggaauaaaagc

SEQ ID NO: 158396 - RNA, 20 nt, Human
aaacacaaaaucuaaacaau

SEQ ID NO: 158397 - RNA, 21 nt, Human
aaacaggaaaaaaugauaaca

SEQ ID NO: 158398 - RNA, 25 nt, Human
aaacagguauaaaaaugugagauca

SEQ ID NO: 158399 - RNA, 27 nt, Human
aaacagguauaaaaaugugagaucaaa

SEQ ID NO: 158400 - RNA, 20 nt, Human
aaagaaaccacacucccaag

SEQ ID NO: 158401 - RNA, 21 nt, Human
aaagaaaccacacucccaagg

SEQ ID NO: 158402 - RNA, 20 nt, Human
aaauccaaaacaccacacaa

SEQ ID NO: 158403 - RNA, 18 nt, Human
aaaugugagaucaaaauc

SEQ ID NO: 158404 - RNA, 21 nt, Human
aaauucuagagguugaaaacc

SEQ ID NO: 158405 - RNA, 25 nt, Human
aacacaaaaucuaaacaauucugca

SEQ ID NO: 158406 - RNA, 19 nt, Human
aacacacacacacacauau

SEQ ID NO: 158407 - RNA, 23 nt, Human
aacagguauaaaaaugugagauc

SEQ ID NO: 158408 - RNA, 24 nt, Human
aagaacaaacaaagcuuuucauca

SEQ ID NO: 158409 - RNA, 22 nt, Human
aagaaugagaauacucacauac

SEQ ID NO: 158410 - RNA, 23 nt, Human
aagcaaaaugaaaggcuuucuga

SEQ ID NO: 158411 - RNA, 19 nt, Human
aauaacuuuugguuuuguu

SEQ ID NO: 158412 - RNA, 23 nt, Human
aauaauagaagcagcaguaagaa

SEQ ID NO: 158413 - RNA, 19 nt, Human
aaugcaaacuacugaucaa

SEQ ID NO: 158414 - RNA, 22 nt, Human
acaaacaaagcuuuucaucaag

SEQ ID NO: 158415 - RNA, 21 nt, Human
acaacauaagcaacacacaca

SEQ ID NO: 158416 - RNA, 23 nt, Human
acacacacacacacauauauagg

SEQ ID NO: 158417 - RNA, 22 nt, Human
acacacacacacauauauauau

SEQ ID NO: 158418 - RNA, 24 nt, Human
acacacacauauauauaugcauau

SEQ ID NO: 158419 - RNA, 21 nt, Human
acacagcuaaagggaaauaac

SEQ ID NO: 158420 - RNA, 19 nt, Human
acagcuaaagggaaauaac

SEQ ID NO: 158421 - RNA, 26 nt, Human
acauaacuucagggaaaagggaacgc

SEQ ID NO: 158422 - RNA, 24 nt, Human
accacacucccaaguuacugcaca

SEQ ID NO: 158423 - RNA, 21 nt, Human
acccggacagccggcggaggc

SEQ ID NO: 158424 - RNA, 24 nt, Human
acucggaaagcucgcaaaaaggaa

SEQ ID NO: 158425 - RNA, 25 nt, Human
agaaaaaaagaauaaauacaaauau

SEQ ID NO: 158426 - RNA, 19 nt, Human
agaaaaagccgcagcggcg

SEQ ID NO: 158427 - RNA, 21 nt, Human
agaaacaugauucuccuuaac

SEQ ID NO: 158428 - RNA, 18 nt, Human
agaauuagcagcacccaa

SEQ ID NO: 158429 - RNA, 24 nt, Human
agagaaaaaaagaauaaauacaaa

SEQ ID NO: 158430 - RNA, 26 nt, Human
agccuuauugugcugaagaaggcaau

SEQ ID NO: 158431 - RNA, 21 nt, Human
agcgcugggacgaggaggagc

SEQ ID NO: 158432 - RNA, 22 nt, Human
agcuuuugggaguugggggcag

SEQ ID NO: 158433 - RNA, 21 nt, Human
aggcaauaauagaagcagccg

SEQ ID NO: 158434 - RNA, 24 nt, Human
aggcauuggaagcugcaaauuucc

SEQ ID NO: 158435 - RNA, 21 nt, Human
aggcgggacucagcgcgagcc

SEQ ID NO: 158436 - RNA, 21 nt, Human
agggauaaacaaccagggaag

SEQ ID NO: 158437 - RNA, 20 nt, Human
aggggcgggcggagcggggg

SEQ ID NO: 158438 - RNA, 19 nt, Human
aguugggggcagauugggg

SEQ ID NO: 158439 - RNA, 24 nt, Human
auaaaguacgccuucaacugagaa

SEQ ID NO: 158440 - RNA, 31 nt, Human
auaagcaacacacacacacacauauauauag

SEQ ID NO: 158441 - RNA, 23 nt, Human
auacacauaacuucagggaaaac

SEQ ID NO: 158442 - RNA, 27 nt, Human
auacauguacauuuuaaaaucaauccc

SEQ ID NO: 158443 - RNA, 21 nt, Human
caaaaaggaaccgcgugcccg

SEQ ID NO: 158444 - RNA, 21 nt, Human
caaagaauuagcagcacccaa

SEQ ID NO: 158445 - RNA, 24 nt, Human
caaguguuugacuuagaaauguac

SEQ ID NO: 158446 - RNA, 22 nt, Human
cacacacacacacauauauaua

SEQ ID NO: 158447 - RNA, 22 nt, Human
cacacacacauauauauaugca

SEQ ID NO: 158448 - RNA, 22 nt, Human
cacauauauauaugcauauaua

SEQ ID NO: 158449 - RNA, 20 nt, Human
cacccggacagccggcggag

SEQ ID NO: 158450 - RNA, 22 nt, Human
cacccggacagccggcggaggc

SEQ ID NO: 158451 - RNA, 21 nt, Human
cacuguaauuauucacaacau

SEQ ID NO: 158452 - RNA, 19 nt, Human
cagccggccggcgccuggc

SEQ ID NO: 158453 - RNA, 19 nt, Human
caguuucuaagcucuuccc

SEQ ID NO: 158454 - RNA, 18 nt, Human
cauaaauauuuuagagca

SEQ ID NO: 158455 - RNA, 18 nt, Human
cauauauauaaaaaauga

SEQ ID NO: 158456 - RNA, 21 nt, Human
ccaguuucuaagcucuuccca

SEQ ID NO: 158457 - RNA, 21 nt, Human
cccaccgcgucuucgcagccg

SEQ ID NO: 158458 - RNA, 18 nt, Human
ccggcgccuggcacucgg

SEQ ID NO: 158459 - RNA, 23 nt, Human
ccucuuuuucucuuaagaagaac

SEQ ID NO: 158460 - RNA, 24 nt, Human
cgcagccggccggcgccuggcacu

SEQ ID NO: 158461 - RNA, 19 nt, Human
cgcccggaggggcgggcgg

SEQ ID NO: 158462 - RNA, 22 nt, Human
cgcgcgcgcacccggacagccg

SEQ ID NO: 158463 - RNA, 21 nt, Human
cggaaagcucgcaaaaaggaa

SEQ ID NO: 158464 - RNA, 22 nt, Human
cggagcgggggcgcgcgguggu

SEQ ID NO: 158465 - RNA, 18 nt, Human
cuagaacuaugcaaaacu

SEQ ID NO: 158466 - RNA, 22 nt, Human
cucacacauuuaaaaucaccau

SEQ ID NO: 158467 - RNA, 21 nt, Human
cucuuggucucagcuuuucag

SEQ ID NO: 158468 - RNA, 18 nt, Human
cugugacuuuuugaauca

SEQ ID NO: 158469 - RNA, 21 nt, Human
cuuuaucuguucucaucuugu

SEQ ID NO: 158470 - RNA, 24 nt, Human
gaaaaaaagaauaaauacaaauau

SEQ ID NO: 158471 - RNA, 18 nt, Human
gaaaaccaccaggcuacc

SEQ ID NO: 158472 - RNA, 20 nt, Human
gagaaaaagccgcagcggcg

SEQ ID NO: 158473 - RNA, 18 nt, Human
gaggaggagcgcgcggcg

SEQ ID NO: 158474 - RNA, 20 nt, Human
gcaaagaauaacaguauuaa

SEQ ID NO: 158475 - RNA, 18 nt, Human
gcacccggacagccggcg

SEQ ID NO: 158476 - RNA, 18 nt, Human
gcacucggaaagcucgca

SEQ ID NO: 158477 - RNA, 22 nt, Human
gcagcaguaagaauagcaguac

SEQ ID NO: 158478 - RNA, 23 nt, Human
gcccacaucuguacaaaacaaca

SEQ ID NO: 158479 - RNA, 19 nt, Human
gccggcggaggcgggacuc

SEQ ID NO: 158480 - RNA, 21 nt, Human
gcgccuggcacucggaaagcu

SEQ ID NO: 158481 - RNA, 27 nt, Human
gcuuuugggaguugggggcagauucuc

SEQ ID NO: 158482 - RNA, 21 nt, Human
ggaaaggcuucuaaaauggug

SEQ ID NO: 158483 - RNA, 19 nt, Human
ggccggcgccuggcacucg

SEQ ID NO: 158484 - RNA, 20 nt, Human
ggccggcgccuggcacucgg

SEQ ID NO: 158485 - RNA, 18 nt, Human
gggcgggcggagcggggg

SEQ ID NO: 158486 - RNA, 21 nt, Human
guauuucugaaauaucacaca

SEQ ID NO: 158487 - RNA, 19 nt, Human
guuuucuuuuuacucuauc

SEQ ID NO: 158488 - RNA, 21 nt, Human
uaaaaaugugagaucaaaauc

SEQ ID NO: 158489 - RNA, 24 nt, Human
uaaaauauuucucuccaaauccaa

SEQ ID NO: 158490 - RNA, 20 nt, Human
uaaaaucagcaacagcaaac

SEQ ID NO: 158491 - RNA, 18 nt, Human
uaaagcccugcagcacuu

SEQ ID NO: 158492 - RNA, 21 nt, Human
uaacugugacuuuuugaauca

SEQ ID NO: 158493 - RNA, 21 nt, Human
uaacugugagcaauuuaaaca

SEQ ID NO: 158494 - RNA, 24 nt, Human
uaacuuuucaauuucagcugcacu

SEQ ID NO: 158495 - RNA, 19 nt, Human
uaagaaaaagugcaaagaa

SEQ ID NO: 158496 - RNA, 18 nt, Human
uaagaagaacacgaauau

SEQ ID NO: 158497 - RNA, 25 nt, Human
uaagaagaacacgaauaucuucugu

SEQ ID NO: 158498 - RNA, 26 nt, Human
uaagaagaacacgaauaucuucugug

SEQ ID NO: 158499 - RNA, 22 nt, Human
uaagagaaaauguuugccuguu

SEQ ID NO: 158500 - RNA, 20 nt, Human
uaagcaacacacacacacac

SEQ ID NO: 158501 - RNA, 23 nt, Human
uacaaaacaacauaagcaacaca

SEQ ID NO: 158502 - RNA, 21 nt, Human
uacaaauaucaaggaggcagg

SEQ ID NO: 158503 - RNA, 26 nt, Human
uacauguacauuuuaaaaucaauccc

SEQ ID NO: 158504 - RNA, 20 nt, Human
uaccuuagaaacauuuguca

SEQ ID NO: 158505 - RNA, 19 nt, Human
uagcagcacccaaccuuaa

SEQ ID NO: 158506 - RNA, 23 nt, Human
uagcuuuugggaguugggggcag

SEQ ID NO: 158507 - RNA, 21 nt, Human
uaggcaagacuuacuaaucag

SEQ ID NO: 158508 - RNA, 23 nt, Human
uauaggcaagacuuacuaaucag

SEQ ID NO: 158509 - RNA, 20 nt, Human
uauauauaugcauauauaua

SEQ ID NO: 158510 - RNA, 18 nt, Human
uaucaaagauaaauucag

SEQ ID NO: 158511 - RNA, 19 nt, Human
uauggaaagauuuguuuac

SEQ ID NO: 158512 - RNA, 21 nt, Human
uauuuuaggcacuguaauuau

SEQ ID NO: 158513 - RNA, 25 nt, Human
ucaaaguuucaaaaaaagcagcuca

SEQ ID NO: 158514 - RNA, 24 nt, Human
uccucuuuuucucuuaagaagaac

SEQ ID NO: 158515 - RNA, 22 nt, Human
ucgcaaaaaggaaccgcgugcc

SEQ ID NO: 158516 - RNA, 20 nt, Human
ucuagcuuuugggaguuggg

SEQ ID NO: 158517 - RNA, 18 nt, Human
ucuccaaauccaaaacac

SEQ ID NO: 158518 - RNA, 21 nt, Human
ucucuccaaauccaaaacacc

SEQ ID NO: 158519 - RNA, 18 nt, Human
ucugcccuucucccaaau

SEQ ID NO: 158520 - RNA, 19 nt, Human
ucuuguuauucuuuggcuu

SEQ ID NO: 158521 - RNA, 24 nt, Human
ugaaauaucacacaauuauaccuc

SEQ ID NO: 158522 - RNA, 22 nt, Human
ugaaaugcaaacuacugaucaa

SEQ ID NO: 158523 - RNA, 23 nt, Human
ugaagaaggcaauaauagaagca

SEQ ID NO: 158524 - RNA, 19 nt, Human
ugaauaaacacagaaaggc

SEQ ID NO: 158525 - RNA, 20 nt, Human
ugaauaaacacagaaaggca

SEQ ID NO: 158526 - RNA, 18 nt, Human
ugagaucaaaaucuuuag

SEQ ID NO: 158527 - RNA, 18 nt, Human
ugauaauaaugguauuuc

SEQ ID NO: 158528 - RNA, 25 nt, Human
ugaucaagaauaaaaucagcaacag

SEQ ID NO: 158529 - RNA, 21 nt, Human
uggaauuaaagcaaaagucac

SEQ ID NO: 158530 - RNA, 24 nt, Human
uggcacucggaaagcucgcaaaaa

SEQ ID NO: 158531 - RNA, 18 nt, Human
ugggaguugggggcagau

SEQ ID NO: 158532 - RNA, 21 nt, Human
uggucucagcuuuucaguuug

SEQ ID NO: 158533 - RNA, 24 nt, Human
uggugcuuauuucuuguuauucuu

SEQ ID NO: 158534 - RNA, 21 nt, Human
uguauguaauaacugugagca

SEQ ID NO: 158535 - RNA, 21 nt, Human
ugugcaaggguucuaauucca

SEQ ID NO: 158536 - RNA, 24 nt, Human
uguggcagagccagccgaaucccg

SEQ ID NO: 158537 - RNA, 20 nt, Human
uguuuacauaaacauguaua

SEQ ID NO: 158538 - RNA, 19 nt, Human
uuaaagcaaaaugaaaggc

SEQ ID NO: 158539 - RNA, 18 nt, Human
uuacauaaacauguauau

SEQ ID NO: 158540 - RNA, 20 nt, Human
uuacauaaacauguauauuu

SEQ ID NO: 158541 - RNA, 22 nt, Human
uuagauggaaaaucaaggggua

SEQ ID NO: 158542 - RNA, 24 nt, Human
uucaaaaagaaaccacacucccaa

SEQ ID NO: 158543 - RNA, 18 nt, Human
uucccaaacaggaaaaaa

SEQ ID NO: 158544 - RNA, 23 nt, Human
uucuaagagaaaauguuugccug

SEQ ID NO: 158545 - RNA, 21 nt, Human
uucuagagguugaaaaccacc

SEQ ID NO: 158546 - RNA, 24 nt, Human
uucucuccaaauccaaaacaccac

SEQ ID NO: 158547 - RNA, 19 nt, Human
uugauaauaaugguauuuc

SEQ ID NO: 158548 - RNA, 20 nt, Human
uuuaaagcccugcagcacuu

SEQ ID NO: 158549 - RNA, 21 nt, Human
uuuaacuucccaaaacucauc

SEQ ID NO: 158550 - RNA, 21 nt, Human
aaacaaagaagaaggcacaga

SEQ ID NO: 158551 - RNA, 19 nt, Human
aaacaaauguaagaauagu

SEQ ID NO: 158552 - RNA, 19 nt, Human
aaagaagaaggcacagagg

SEQ ID NO: 158553 - RNA, 19 nt, Human
aacaaaagcuauggcuuua

SEQ ID NO: 158554 - RNA, 23 nt, Human
aacagguuaaaaaaaaauaggag

SEQ ID NO: 158555 - RNA, 23 nt, Human
aacuccuucccccacagcuucca

SEQ ID NO: 158556 - RNA, 22 nt, Human
acaaaacaaagaagaaggcaca

SEQ ID NO: 158557 - RNA, 24 nt, Human
acaaaacaaagaagaaggcacaga

SEQ ID NO: 158558 - RNA, 25 nt, Human
acaaaacaaagaagaaggcacagag

SEQ ID NO: 158559 - RNA, 19 nt, Human
acaagcagugcacaguggg

SEQ ID NO: 158560 - RNA, 21 nt, Human
acaagcagugcacagugggcc

SEQ ID NO: 158561 - RNA, 24 nt, Human
acgagucccuguccuucuucccuc

SEQ ID NO: 158562 - RNA, 25 nt, Human
agaagaaggcacagagggucccuuu

SEQ ID NO: 158563 - RNA, 22 nt, Human
agacaggauugauuuauuuggg

SEQ ID NO: 158564 - RNA, 19 nt, Human
agauaugauugacaugagu

SEQ ID NO: 158565 - RNA, 18 nt, Human
aggagguuuuuauucagu

SEQ ID NO: 158566 - RNA, 22 nt, Human
aggauugauuuauuugggaacu

SEQ ID NO: 158567 - RNA, 18 nt, Human
agugguuuguggaguggc

SEQ ID NO: 158568 - RNA, 21 nt, Human
auagauaugauugacaugagu

SEQ ID NO: 158569 - RNA, 22 nt, Human
aucuuuguucccaguucaggag

SEQ ID NO: 158570 - RNA, 23 nt, Human
caaaacaaagaagaaggcacaga

SEQ ID NO: 158571 - RNA, 18 nt, Human
caaacuguagggaacaga

SEQ ID NO: 158572 - RNA, 20 nt, Human
cacaaaacaaagaagaaggc

SEQ ID NO: 158573 - RNA, 21 nt, Human
cacaaaacaaagaagaaggca

SEQ ID NO: 158574 - RNA, 22 nt, Human
cacaaaacaaagaagaaggcac

SEQ ID NO: 158575 - RNA, 24 nt, Human
cacaaaacaaagaagaaggcacag

SEQ ID NO: 158576 - RNA, 20 nt, Human
cacacgagucccuguccuuc

SEQ ID NO: 158577 - RNA, 19 nt, Human
cagcaggaaauucagaccc

SEQ ID NO: 158578 - RNA, 22 nt, Human
caggcagaaggccggcccagag

SEQ ID NO: 158579 - RNA, 21 nt, Human
ccagcucagcagcaaacugua

SEQ ID NO: 158580 - RNA, 18 nt, Human
ccccaguucugcccugcu

SEQ ID NO: 158581 - RNA, 18 nt, Human
cccugcucugagcugucc

SEQ ID NO: 158582 - RNA, 24 nt, Human
cgcucgugguuccuccagagacag

SEQ ID NO: 158583 - RNA, 18 nt, Human
cggcucugaguucuuccu

SEQ ID NO: 158584 - RNA, 18 nt, Human
cucuaauccaaggguggg

SEQ ID NO: 158585 - RNA, 21 nt, Human
cugaagccuuaauauuagcaa

SEQ ID NO: 158586 - RNA, 21 nt, Human
cuuuguucccaguucaggagg

SEQ ID NO: 158587 - RNA, 21 nt, Human
ggaaaucaugaggaaggaccg

SEQ ID NO: 158588 - RNA, 21 nt, Human
gggggcuucccggcucugagu

SEQ ID NO: 158589 - RNA, 22 nt, Human
guccccaguucugcccugcucu

SEQ ID NO: 158590 - RNA, 24 nt, Human
uaaaaguagcccugaagccuuaau

SEQ ID NO: 158591 - RNA, 22 nt, Human
uagagaguuuaggaaauguuug

SEQ ID NO: 158592 - RNA, 24 nt, Human
uaggcuaaaacuaaaauuuuagug

SEQ ID NO: 158593 - RNA, 28 nt, Human
ucacagaaaauaagccuguuguccggac

SEQ ID NO: 158594 - RNA, 24 nt, Human
ucaggagguuuuuauucagugcuu

SEQ ID NO: 158595 - RNA, 19 nt, Human
uccaagggugggggagauc

SEQ ID NO: 158596 - RNA, 20 nt, Human
uccaugcaggcagaaggccg

SEQ ID NO: 158597 - RNA, 22 nt, Human
uccccaguucugcccugcucug

SEQ ID NO: 158598 - RNA, 22 nt, Human
ucccuguccuucuucccucgcu

SEQ ID NO: 158599 - RNA, 21 nt, Human
ucgaagaugggaaagacagga

SEQ ID NO: 158600 - RNA, 24 nt, Human
ucucaauauaaaacaaaagcuaug

SEQ ID NO: 158601 - RNA, 21 nt, Human
ugggggcuucccggcucugag

SEQ ID NO: 158602 - RNA, 26 nt, Human
uuaauacucccaagucagauaucuaa

SEQ ID NO: 158603 - RNA, 20 nt, Human
uuccuacuguaaauaaugcu

SEQ ID NO: 158604 - RNA, 26 nt, Human
uuccuacuguaaauaauggacaucgg

SEQ ID NO: 158605 - RNA, 21 nt, Human
uuccugccacacgagucccug

SEQ ID NO: 158606 - RNA, 24 nt, Human
uucuaacgugcucggggacuucac

SEQ ID NO: 158607 - RNA, 22 nt, Human
uucuucccucgcucgugguucc

SEQ ID NO: 158608 - RNA, 23 nt, Human
agcugugucauuuugacucauua

SEQ ID NO: 158609 - RNA, 18 nt, Human
caaacucuacccagaagc

SEQ ID NO: 158610 - RNA, 21 nt, Human
cagaggaagaagcgaucagca

SEQ ID NO: 158611 - RNA, 27 nt, Human
caggaaaaggcucagucauaaaaucag

SEQ ID NO: 158612 - RNA, 21 nt, Human
ccucuugggacaggaaaaggc

SEQ ID NO: 158613 - RNA, 21 nt, Human
cgacacagaggaagaagcgau

SEQ ID NO: 158614 - RNA, 21 nt, Human
cuauaauauugcuagacaguu

SEQ ID NO: 158615 - RNA, 23 nt, Human
gagaggacaaacucuacccagaa

SEQ ID NO: 158616 - RNA, 23 nt, Human
gcaugguggucagcagcggggca

SEQ ID NO: 158617 - RNA, 22 nt, Human
ggaagaagcgaucagcauggug

SEQ ID NO: 158618 - RNA, 21 nt, Human
uacccagaagccccccgacac

SEQ ID NO: 158619 - RNA, 27 nt, Human
uccaccacaauaucauuuuuauaauaa

SEQ ID NO: 158620 - RNA, 21 nt, Human
ucuugggacaggaaaaggcuc

SEQ ID NO: 158621 - RNA, 24 nt, Human
ucuugggacaggaaaaggcucagu

SEQ ID NO: 158622 - RNA, 22 nt, Human
ugagaaaaugucuugauuuuua

SEQ ID NO: 158623 - RNA, 18 nt, Human
ugcuuauucauuuucagc

SEQ ID NO: 158624 - RNA, 18 nt, Human
uuagugguacaaguucuu

SEQ ID NO: 158625 - RNA, 22 nt, Human
uuuucagcugugucauuuugac

SEQ ID NO: 158626 - RNA, 22 nt, Human
aaaucccaguucuccaccucuc

SEQ ID NO: 158627 - RNA, 19 nt, Human
aaccaaaguccaggcugug

SEQ ID NO: 158628 - RNA, 24 nt, Human
acaaaacaguaagaaacuguagaa

SEQ ID NO: 158629 - RNA, 23 nt, Human
accacagcaccccgccugacccu

SEQ ID NO: 158630 - RNA, 20 nt, Human
acccccaccccagccaugcc

SEQ ID NO: 158631 - RNA, 30 nt, Human
acccccaccccagccaugccucuccccacu

SEQ ID NO: 158632 - RNA, 19 nt, Human
accuuccuggagagaacca

SEQ ID NO: 158633 - RNA, 19 nt, Human
acugcaggggcagcagaac

SEQ ID NO: 158634 - RNA, 19 nt, Human
agaacgccacagugguuga

SEQ ID NO: 158635 - RNA, 23 nt, Human
agaagcagguggucuguggcuca

SEQ ID NO: 158636 - RNA, 18 nt, Human
agcggccggggcugcggc

SEQ ID NO: 158637 - RNA, 18 nt, Human
agugaggaagaaauggaa

SEQ ID NO: 158638 - RNA, 20 nt, Human
caaaacauccuuucugccaa

SEQ ID NO: 158639 - RNA, 26 nt, Human
caaccaggucuccccacccccacccc

SEQ ID NO: 158640 - RNA, 22 nt, Human
caaggaaaugggacaaaacauc

SEQ ID NO: 158641 - RNA, 20 nt, Human
caaggauuccacccccgaac

SEQ ID NO: 158642 - RNA, 22 nt, Human
cacaaggaagauuuagagagug

SEQ ID NO: 158643 - RNA, 24 nt, Human
cacacaggggccaagagcuggacc

SEQ ID NO: 158644 - RNA, 21 nt, Human
cacagcaccccgccugacccu

SEQ ID NO: 158645 - RNA, 18 nt, Human
caccacagcaccccgccu

SEQ ID NO: 158646 - RNA, 18 nt, Human
caccagcgcaaagcagcg

SEQ ID NO: 158647 - RNA, 21 nt, Human
caccagcgcaaagcagcggcc

SEQ ID NO: 158648 - RNA, 24 nt, Human
cacugccccuacuuagcagucuca

SEQ ID NO: 158649 - RNA, 21 nt, Human
caggacccauaauccucacaa

SEQ ID NO: 158650 - RNA, 25 nt, Human
ccacagcaccccgccugacccuagu

SEQ ID NO: 158651 - RNA, 21 nt, Human
ccaccacagcaccccgccuga

SEQ ID NO: 158652 - RNA, 21 nt, Human
ccacccccaccccagccaugc

SEQ ID NO: 158653 - RNA, 20 nt, Human
ccaguucuccaccucucugc

SEQ ID NO: 158654 - RNA, 24 nt, Human
cccaaggauuccacccccgaaccu

SEQ ID NO: 158655 - RNA, 22 nt, Human
cccaccacagcaccccgccuga

SEQ ID NO: 158656 - RNA, 23 nt, Human
ccccaccccagccaugccucucc

SEQ ID NO: 158657 - RNA, 20 nt, Human
ccccagccaugccucucccc

SEQ ID NO: 158658 - RNA, 22 nt, Human
cccggcccuccgugcgcccucu

SEQ ID NO: 158659 - RNA, 20 nt, Human
ccucuccccaccacagcacc

SEQ ID NO: 158660 - RNA, 21 nt, Human
ccugggccucugagcuggucu

SEQ ID NO: 158661 - RNA, 21 nt, Human
cgccgcuugcccagcggccca

SEQ ID NO: 158662 - RNA, 19 nt, Human
cuccccacccccaccccag

SEQ ID NO: 158663 - RNA, 21 nt, Human
cucggcucgcuggcccuggcc

SEQ ID NO: 158664 - RNA, 18 nt, Human
cucugagcuggucuccuc

SEQ ID NO: 158665 - RNA, 18 nt, Human
cugcacagauuccuucug

SEQ ID NO: 158666 - RNA, 18 nt, Human
cuggucuccuccgcugug

SEQ ID NO: 158667 - RNA, 24 nt, Human
cuguggcucacucagccuggcuuc

SEQ ID NO: 158668 - RNA, 23 nt, Human
cuugcucagugucauagugagga

SEQ ID NO: 158669 - RNA, 24 nt, Human
gaccacggccaaccaggucucccc

SEQ ID NO: 158670 - RNA, 19 nt, Human
gacugcuuuuuaaagauac

SEQ ID NO: 158671 - RNA, 22 nt, Human
gccaugccucuccccaccacag

SEQ ID NO: 158672 - RNA, 18 nt, Human
gcccggccuggugcggga

SEQ ID NO: 158673 - RNA, 22 nt, Human
gccucuccccaccacagcaccc

SEQ ID NO: 158674 - RNA, 19 nt, Human
gccugugguccaccagcgc

SEQ ID NO: 158675 - RNA, 22 nt, Human
gcuaccuuccuggagagaacca

SEQ ID NO: 158676 - RNA, 20 nt, Human
gcugggcuaccuuccuggag

SEQ ID NO: 158677 - RNA, 18 nt, Human
gcuguguagaugccugug

SEQ ID NO: 158678 - RNA, 20 nt, Human
ggcccaaggauuccaccccc

SEQ ID NO: 158679 - RNA, 20 nt, Human
guccaggcuguguagaugcc

SEQ ID NO: 158680 - RNA, 21 nt, Human
uaaagauacgagaucccgcug

SEQ ID NO: 158681 - RNA, 19 nt, Human
ucaaaucccaguucuccac

SEQ ID NO: 158682 - RNA, 22 nt, Human
uccccaccacagcaccccgccu

SEQ ID NO: 158683 - RNA, 20 nt, Human
uccccacccccaccccagcc

SEQ ID NO: 158684 - RNA, 23 nt, Human
uccugggccucugagcuggucuc

SEQ ID NO: 158685 - RNA, 21 nt, Human
ucgcuggcccuggccaggucu

SEQ ID NO: 158686 - RNA, 22 nt, Human
ucugugcuggacacgguuccaa

SEQ ID NO: 158687 - RNA, 19 nt, Human
ugcagggcccaagcccggc

SEQ ID NO: 158688 - RNA, 21 nt, Human
uggagacaagaucuugcucag

SEQ ID NO: 158689 - RNA, 23 nt, Human
ugggacaaaacauccuuucugcc

SEQ ID NO: 158690 - RNA, 22 nt, Human
ugggccucugagcuggucuccu

SEQ ID NO: 158691 - RNA, 19 nt, Human
uguccucggcucgcuggcc

SEQ ID NO: 158692 - RNA, 23 nt, Human
uucaaaucccaguucuccaccuc

SEQ ID NO: 158693 - RNA, 18 nt, Human
uucacagugcugggcuac

SEQ ID NO: 158694 - RNA, 21 nt, Human
uuccuggagagaaccaaaguc

SEQ ID NO: 158695 - RNA, 25 nt, Human
uuccugggccucugagcuggucucc

SEQ ID NO: 158696 - RNA, 21 nt, Human
uugauacaaaacaguaagaaa

SEQ ID NO: 158697 - RNA, 24 nt, Human
uugcucagugucauagugaggaag

SEQ ID NO: 158698 - RNA, 21 nt, Human
agagcacccggcacggcugcg

SEQ ID NO: 158699 - RNA, 22 nt, Human
ccagucacaggguugaaagggg

SEQ ID NO: 158700 - RNA, 18 nt, Human
gagcacccggcacggcug

SEQ ID NO: 158701 - RNA, 23 nt, Human
aacugguuuaacugcacacucca

SEQ ID NO: 158702 - RNA, 18 nt, Human
ccuccucccccccccccc

SEQ ID NO: 158703 - RNA, 18 nt, Human
ccuguuucuucucuuuuu

SEQ ID NO: 158704 - RNA, 22 nt, Human
cuaaagauucucgccauauugg

SEQ ID NO: 158705 - RNA, 25 nt, Human
cuuuuuuuuuuuuuuuuuugacuuu

SEQ ID NO: 158706 - RNA, 19 nt, Human
ucccccccccccccccccc

SEQ ID NO: 158707 - RNA, 23 nt, Human
uccuuuucuucucuuucaauuga

SEQ ID NO: 158708 - RNA, 18 nt, Human
ucuuuuuuuuuuuuuuuu

SEQ ID NO: 158709 - RNA, 25 nt, Human
ucuuuuuuuuuuuuuuuuuugacuu

SEQ ID NO: 158710 - RNA, 29 nt, Human
uguuucuucucuuuuuuuuuuuuuuuuuu

SEQ ID NO: 158711 - RNA, 23 nt, Human
uucuccuuuucuucucuuucaaa

SEQ ID NO: 158712 - RNA, 18 nt, Human
uuuuuuuuuuuuuuuuug

SEQ ID NO: 158713 - RNA, 30 nt, Human
uuuuuuuuuuuuuuuuugacuuucuccuuu

SEQ ID NO: 158714 - RNA, 20 nt, Human
aaccucaauguacacauguc

SEQ ID NO: 158715 - RNA, 22 nt, Human
aacgaggcccucauaggccccu

SEQ ID NO: 158716 - RNA, 19 nt, Human
aagcaguuuaaagaucuua

SEQ ID NO: 158717 - RNA, 23 nt, Human
aaguaccacaugaccaaacacaa

SEQ ID NO: 158718 - RNA, 18 nt, Human
acauugucaucgucgucc

SEQ ID NO: 158719 - RNA, 18 nt, Human
accugggccaccgagccc

SEQ ID NO: 158720 - RNA, 18 nt, Human
acgcugagugacucgggg

SEQ ID NO: 158721 - RNA, 25 nt, Human
acucacuggacucuccccucucaga

SEQ ID NO: 158722 - RNA, 21 nt, Human
agcccgaacccaccugaggac

SEQ ID NO: 158723 - RNA, 19 nt, Human
agugcaggcagcgggcauc

SEQ ID NO: 158724 - RNA, 19 nt, Human
auccugaaaugcacacagc

SEQ ID NO: 158725 - RNA, 25 nt, Human
caaguaccacaugaccaaacacagu

SEQ ID NO: 158726 - RNA, 21 nt, Human
caaguagccuuccucugcucu

SEQ ID NO: 158727 - RNA, 24 nt, Human
cacagacccaggacaaggcccuuu

SEQ ID NO: 158728 - RNA, 19 nt, Human
cacauugucaucgucgucc

SEQ ID NO: 158729 - RNA, 19 nt, Human
cacccgcugacacagaccc

SEQ ID NO: 158730 - RNA, 19 nt, Human
caccugggccaccgagccc

SEQ ID NO: 158731 - RNA, 22 nt, Human
cagagggccaggcggugaagcc

SEQ ID NO: 158732 - RNA, 20 nt, Human
caucaggggccuggacucac

SEQ ID NO: 158733 - RNA, 22 nt, Human
caucccucaaguaccacaugac

SEQ ID NO: 158734 - RNA, 20 nt, Human
cauccugaaaugcacacagc

SEQ ID NO: 158735 - RNA, 22 nt, Human
cauugucaucgucguccccccg

SEQ ID NO: 158736 - RNA, 19 nt, Human
ccaccaccugggccaccga

SEQ ID NO: 158737 - RNA, 19 nt, Human
cccccaggugugaggucug

SEQ ID NO: 158738 - RNA, 21 nt, Human
ccccgggagguuggagcauca

SEQ ID NO: 158739 - RNA, 18 nt, Human
ccccuugcuugggcccac

SEQ ID NO: 158740 - RNA, 20 nt, Human
cccuuggugcuggaggcggg

SEQ ID NO: 158741 - RNA, 26 nt, Human
ccucauaggccccuugcuugggccca

SEQ ID NO: 158742 - RNA, 24 nt, Human
ccucuagcagccuggacuccgcag

SEQ ID NO: 158743 - RNA, 18 nt, Human
ccucucagaggugcggaa

SEQ ID NO: 158744 - RNA, 20 nt, Human
cggaaccaccaccugggcca

SEQ ID NO: 158745 - RNA, 24 nt, Human
cggcgguuugagaaggcccacaac

SEQ ID NO: 158746 - RNA, 19 nt, Human
cucaaguagccuuccucug

SEQ ID NO: 158747 - RNA, 22 nt, Human
cucacuggacucuccccucuca

SEQ ID NO: 158748 - RNA, 18 nt, Human
cugagacugagcuggacu

SEQ ID NO: 158749 - RNA, 20 nt, Human
cugugaccaguguggccggc

SEQ ID NO: 158750 - RNA, 23 nt, Human
cuguggccucgcaccuucuuauc

SEQ ID NO: 158751 - RNA, 21 nt, Human
cuuggcgccuacagccccggc

SEQ ID NO: 158752 - RNA, 21 nt, Human
gacggcagugaggaugagcac

SEQ ID NO: 158753 - RNA, 19 nt, Human
gacucacuggacucucccc

SEQ ID NO: 158754 - RNA, 18 nt, Human
gaggcccucauaggcccc

SEQ ID NO: 158755 - RNA, 22 nt, Human
gagguuggagcaucaggggccu

SEQ ID NO: 158756 - RNA, 19 nt, Human
gcaguaagugugagucagg

SEQ ID NO: 158757 - RNA, 20 nt, Human
gcccugccccuggaggcgga

SEQ ID NO: 158758 - RNA, 23 nt, Human
ggccaggcggugaagcccgaacc

SEQ ID NO: 158759 - RNA, 18 nt, Human
ggccuuggcgccuacagc

SEQ ID NO: 158760 - RNA, 21 nt, Human
ggcuggugugcaguggcaggu

SEQ ID NO: 158761 - RNA, 18 nt, Human
ggugcugcccgcccuugg

SEQ ID NO: 158762 - RNA, 18 nt, Human
guccauggugcacccgcu

SEQ ID NO: 158763 - RNA, 20 nt, Human
gucuguggguuccagugcag

SEQ ID NO: 158764 - RNA, 24 nt, Human
uaaggaaauagcuuucugagguuu

SEQ ID NO: 158765 - RNA, 18 nt, Human
uaccacaugaccaaacac

SEQ ID NO: 158766 - RNA, 23 nt, Human
uaccacaugaccaaacacaaggc

SEQ ID NO: 158767 - RNA, 22 nt, Human
uagcagccuggacuccgcagug

SEQ ID NO: 158768 - RNA, 18 nt, Human
uagcuuucugagguuucu

SEQ ID NO: 158769 - RNA, 23 nt, Human
ucauaggccccuugcuugggccc

SEQ ID NO: 158770 - RNA, 18 nt, Human
ucccagggcuguggccuc

SEQ ID NO: 158771 - RNA, 26 nt, Human
ucccagggcuguggccucgcaccuuc

SEQ ID NO: 158772 - RNA, 18 nt, Human
ucccccaggugugagguc

SEQ ID NO: 158773 - RNA, 26 nt, Human
ucccucaaguaccacaugaccaaaca

SEQ ID NO: 158774 - RNA, 18 nt, Human
ucgcaccuucuuaucugc

SEQ ID NO: 158775 - RNA, 21 nt, Human
ucugugaccacagagggccag

SEQ ID NO: 158776 - RNA, 24 nt, Human
ugacgaauguggacaaaccuucaa

SEQ ID NO: 158777 - RNA, 18 nt, Human
ugacucggggccggacag

SEQ ID NO: 158778 - RNA, 19 nt, Human
ugccucugucccccaggug

SEQ ID NO: 158779 - RNA, 22 nt, Human
ugcggaacuauaucugugacga

SEQ ID NO: 158780 - RNA, 24 nt, Human
uggacaaaccuucaagcagcggaa

SEQ ID NO: 158781 - RNA, 22 nt, Human
uggguuccagugcaggcagcgg

SEQ ID NO: 158782 - RNA, 18 nt, Human
ugucccccaggugugagg

SEQ ID NO: 158783 - RNA, 18 nt, Human
ugugaccacagagggcca

SEQ ID NO: 158784 - RNA, 23 nt, Human
uuccuuuccccacuaaagcaguc

SEQ ID NO: 158785 - RNA, 23 nt, Human
uuuaaggaaauagcuuucugagg

SEQ ID NO: 158786 - RNA, 23 nt, Human
uuuuagugcaacaagagcuccau

SEQ ID NO: 158787 - RNA, 19 nt, Human
uuuuuuuuuuuuuaaggaa

SEQ ID NO: 158788 - RNA, 25 nt, Human
uuuuuuuuuuuuuuuuuuuuuaagg

SEQ ID NO: 158789 - RNA, 21 nt, Human
aaaaauagacaacaaauuaca

SEQ ID NO: 158790 - RNA, 18 nt, Human
aaaagcaagucuugacuc

SEQ ID NO: 158791 - RNA, 24 nt, Human
aaagugcugggaucacagguguga

SEQ ID NO: 158792 - RNA, 18 nt, Human
aaccuguucucccaccca

SEQ ID NO: 158793 - RNA, 24 nt, Human
aagcaugcagcuccuuuuucaacc

SEQ ID NO: 158794 - RNA, 24 nt, Human
aaguaaucccccugccuuggccuc

SEQ ID NO: 158795 - RNA, 26 nt, Human
aagugcugggaucacaggugugagcc

SEQ ID NO: 158796 - RNA, 18 nt, Human
aauagcugggauuacaga

SEQ ID NO: 158797 - RNA, 18 nt, Human
acagcaagacaguguggc

SEQ ID NO: 158798 - RNA, 20 nt, Human
accaaaauacuuuaccagca

SEQ ID NO: 158799 - RNA, 22 nt, Human
accccgauaauuuuuguauuuu

SEQ ID NO: 158800 - RNA, 19 nt, Human
acgccgcguccccgcccag

SEQ ID NO: 158801 - RNA, 22 nt, Human
agaacaggagagaggcccucaa

SEQ ID NO: 158802 - RNA, 23 nt, Human
agaaggaaggaaggggcaugggc

SEQ ID NO: 158803 - RNA, 20 nt, Human
agaaugucccugaaaggaaa

SEQ ID NO: 158804 - RNA, 19 nt, Human
agaggacucggcagcugug

SEQ ID NO: 158805 - RNA, 20 nt, Human
agaggcccucaacuccagug

SEQ ID NO: 158806 - RNA, 20 nt, Human
agcaagacaguguggcuuua

SEQ ID NO: 158807 - RNA, 18 nt, Human
agccucuugaauagcugg

SEQ ID NO: 158808 - RNA, 22 nt, Human
agcgagggcacuuacuccacaa

SEQ ID NO: 158809 - RNA, 24 nt, Human
aggaaccccuggcugcccagaaag

SEQ ID NO: 158810 - RNA, 20 nt, Human
aggccuggcaggggaggagg

SEQ ID NO: 158811 - RNA, 25 nt, Human
aggcuggagugcagugucaugaucu

SEQ ID NO: 158812 - RNA, 18 nt, Human
aggggaggaggaagaggc

SEQ ID NO: 158813 - RNA, 19 nt, Human
aggggcaugggcagaggcc

SEQ ID NO: 158814 - RNA, 23 nt, Human
aggguauugccauguuagccagg

SEQ ID NO: 158815 - RNA, 24 nt, Human
agugcagugucaugaucucggcuc

SEQ ID NO: 158816 - RNA, 20 nt, Human
aguggaaagagugugccgga

SEQ ID NO: 158817 - RNA, 20 nt, Human
agugugccggaggcccgggc

SEQ ID NO: 158818 - RNA, 23 nt, Human
auaauuuuuguauuuuuaguaga

SEQ ID NO: 158819 - RNA, 19 nt, Human
auacaauuccagaaugucc

SEQ ID NO: 158820 - RNA, 24 nt, Human
aucgaaggcaacaagagggggagg

SEQ ID NO: 158821 - RNA, 22 nt, Human
augccucagccucuugaauagc

SEQ ID NO: 158822 - RNA, 21 nt, Human
augucccugaaaggaaaaagc

SEQ ID NO: 158823 - RNA, 19 nt, Human
auuacagaugcaugccauu

SEQ ID NO: 158824 - RNA, 24 nt, Human
auuuuuguauuuuuaguagagaua

SEQ ID NO: 158825 - RNA, 20 nt, Human
caaaacggagccaagacuca

SEQ ID NO: 158826 - RNA, 23 nt, Human
caaaacggagccaagacucagac

SEQ ID NO: 158827 - RNA, 20 nt, Human
caaaauacuuuaccagcaca

SEQ ID NO: 158828 - RNA, 23 nt, Human
caaagggccacaugaagccagca

SEQ ID NO: 158829 - RNA, 28 nt, Human
caaagggccacaugaagccagcaggcac

SEQ ID NO: 158830 - RNA, 24 nt, Human
caaagugcugggaucacaggugug

SEQ ID NO: 158831 - RNA, 19 nt, Human
caacaagagggggaggugg

SEQ ID NO: 158832 - RNA, 23 nt, Human
caacucccaccucccggguucaa

SEQ ID NO: 158833 - RNA, 20 nt, Human
caaguucuggcuuaaaguca

SEQ ID NO: 158834 - RNA, 21 nt, Human
cacacauuaaaucgggugguc

SEQ ID NO: 158835 - RNA, 24 nt, Human
cacaggaccacaggacagggugga

SEQ ID NO: 158836 - RNA, 24 nt, Human
cacaggugugagccacugcaccca

SEQ ID NO: 158837 - RNA, 19 nt, Human
caccaccggcaaggccgcc

SEQ ID NO: 158838 - RNA, 21 nt, Human
caccaggaguaccgaaggcuc

SEQ ID NO: 158839 - RNA, 19 nt, Human
caccgcccgggaucugugg

SEQ ID NO: 158840 - RNA, 24 nt, Human
caccucccggguucaagagauccu

SEQ ID NO: 158841 - RNA, 22 nt, Human
caccucugaagaccuuggucca

SEQ ID NO: 158842 - RNA, 21 nt, Human
cacuacaacucccaccucccg

SEQ ID NO: 158843 - RNA, 24 nt, Human
cagaaagcaccaccggcaaggccg

SEQ ID NO: 158844 - RNA, 22 nt, Human
cagaauagacacaaaagaaugu

SEQ ID NO: 158845 - RNA, 19 nt, Human
cagaaugucccugaaagga

SEQ ID NO: 158846 - RNA, 26 nt, Human
cagacuaauacacacaaaucaaaaug

SEQ ID NO: 158847 - RNA, 23 nt, Human
cagaugcaugccauugcaccccg

SEQ ID NO: 158848 - RNA, 26 nt, Human
cagcaggcacuucagugccacguccc

SEQ ID NO: 158849 - RNA, 18 nt, Human
cagcucauucucacagcc

SEQ ID NO: 158850 - RNA, 19 nt, Human
cagcuuccauggcccagcc

SEQ ID NO: 158851 - RNA, 19 nt, Human
caggaaccccuggcugccc

SEQ ID NO: 158852 - RNA, 24 nt, Human
caggaggccuggucccaguggccc

SEQ ID NO: 158853 - RNA, 18 nt, Human
caggccccgccaacgccg

SEQ ID NO: 158854 - RNA, 22 nt, Human
caggcuuugccgaaaucgaagg

SEQ ID NO: 158855 - RNA, 24 nt, Human
cagucuggaacuccugggcugaag

SEQ ID NO: 158856 - RNA, 21 nt, Human
caguggagccgcgcgcgcgca

SEQ ID NO: 158857 - RNA, 20 nt, Human
cauguuagccaggcagucug

SEQ ID NO: 158858 - RNA, 21 nt, Human
ccaaagugcugggaucacagg

SEQ ID NO: 158859 - RNA, 24 nt, Human
ccaaagugcugggaucacaggugu

SEQ ID NO: 158860 - RNA, 23 nt, Human
ccaacgccgucaaggcccccucg

SEQ ID NO: 158861 - RNA, 20 nt, Human
ccacacggccugcgugccuu

SEQ ID NO: 158862 - RNA, 25 nt, Human
ccaccgcccgggaucuguggcuuga

SEQ ID NO: 158863 - RNA, 18 nt, Human
ccacugcacccagccagg

SEQ ID NO: 158864 - RNA, 18 nt, Human
ccacugcacccagccagg

SEQ ID NO: 158865 - RNA, 19 nt, Human
ccacugcacccagccaggc

SEQ ID NO: 158866 - RNA, 18 nt, Human
ccaggcuaggaagaaguc

SEQ ID NO: 158867 - RNA, 22 nt, Human
ccaggcuuugccgaaaucgaag

SEQ ID NO: 158868 - RNA, 24 nt, Human
ccagucccaggagaaggaaggaag

SEQ ID NO: 158869 - RNA, 20 nt, Human
ccauacagcaagacagugug

SEQ ID NO: 158870 - RNA, 19 nt, Human
ccauguuagccaggcaguc

SEQ ID NO: 158871 - RNA, 19 nt, Human
cccaggcuggagugcagug

SEQ ID NO: 158872 - RNA, 21 nt, Human
ccccaacaccucugacgaagc

SEQ ID NO: 158873 - RNA, 24 nt, Human
ccccagagggacaguccucccacc

SEQ ID NO: 158874 - RNA, 22 nt, Human
cccccucggccacgccgcgucc

SEQ ID NO: 158875 - RNA, 26 nt, Human
cccccugccuuggccucccaaagugc

SEQ ID NO: 158876 - RNA, 20 nt, Human
ccccugugcccaggccccgc

SEQ ID NO: 158877 - RNA, 19 nt, Human
cccggguucaagagauccu

SEQ ID NO: 158878 - RNA, 25 nt, Human
cccucggccacgccgcguccccgcc

SEQ ID NO: 158879 - RNA, 21 nt, Human
cccugcggcugccccugugcc

SEQ ID NO: 158880 - RNA, 20 nt, Human
cccugugcccaggccccgcc

SEQ ID NO: 158881 - RNA, 23 nt, Human
ccgccaacgccgucaaggccccc

SEQ ID NO: 158882 - RNA, 20 nt, Human
ccgcgcgcgcgcacacgugg

SEQ ID NO: 158883 - RNA, 19 nt, Human
ccuagcuucaccaguccca

SEQ ID NO: 158884 - RNA, 26 nt, Human
ccucaugccucagccucuugaauagc

SEQ ID NO: 158885 - RNA, 20 nt, Human
ccugggcugaaguaaucccc

SEQ ID NO: 158886 - RNA, 20 nt, Human
ccuguccuguggcccuggcc

SEQ ID NO: 158887 - RNA, 21 nt, Human
cgccaacgccgucaaggcccc

SEQ ID NO: 158888 - RNA, 19 nt, Human
cgccgcguccccgcccagc

SEQ ID NO: 158889 - RNA, 24 nt, Human
cgcgcgcgcgcacacgugucagca

SEQ ID NO: 158890 - RNA, 24 nt, Human
cgcucuguugcccaggcuggagug

SEQ ID NO: 158891 - RNA, 18 nt, Human
cggcaaggccgccuccac

SEQ ID NO: 158892 - RNA, 20 nt, Human
cggcaaggccgccuccaccg

SEQ ID NO: 158893 - RNA, 24 nt, Human
cgggcaccaggaguaccgaaggcu

SEQ ID NO: 158894 - RNA, 21 nt, Human
cgggcuugggugugcugucug

SEQ ID NO: 158895 - RNA, 24 nt, Human
cuacaacucccaccucccggguuc

SEQ ID NO: 158896 - RNA, 21 nt, Human
cucacagcccagcgagggcac

SEQ ID NO: 158897 - RNA, 24 nt, Human
cucacuacaacucccaccucccgg

SEQ ID NO: 158898 - RNA, 21 nt, Human
cuccuaaaaagagucuaaaaa

SEQ ID NO: 158899 - RNA, 24 nt, Human
cuccugggcugaaguaaucccccu

SEQ ID NO: 158900 - RNA, 24 nt, Human
cucgcucuguugcccaggcuggag

SEQ ID NO: 158901 - RNA, 23 nt, Human
cucuugaauagcugggauuacag

SEQ ID NO: 158902 - RNA, 20 nt, Human
cugacggucuggccgggcgg

SEQ ID NO: 158903 - RNA, 20 nt, Human
cugcagaugggccgagguca

SEQ ID NO: 158904 - RNA, 19 nt, Human
cugcccaggcuuugccgaa

SEQ ID NO: 158905 - RNA, 23 nt, Human
cugccuuggccucccaaagugcu

SEQ ID NO: 158906 - RNA, 21 nt, Human
cugcggcugccccugugccca

SEQ ID NO: 158907 - RNA, 24 nt, Human
cuggagugcagugucaugaucucg

SEQ ID NO: 158908 - RNA, 18 nt, Human
cugucuuggagguggagg

SEQ ID NO: 158909 - RNA, 25 nt, Human
gaacuaacuaacugaauuaauccug

SEQ ID NO: 158910 - RNA, 19 nt, Human
gaaggcaacaagaggggga

SEQ ID NO: 158911 - RNA, 26 nt, Human
gaauagcugggauuacagaugcaugc

SEQ ID NO: 158912 - RNA, 21 nt, Human
gagaggacucggcagcuguga

SEQ ID NO: 158913 - RNA, 24 nt, Human
gagauccucaugccucagccucuu

SEQ ID NO: 158914 - RNA, 19 nt, Human
gagggaauggccgaggggu

SEQ ID NO: 158915 - RNA, 18 nt, Human
gagggaccuggcucugca

SEQ ID NO: 158916 - RNA, 21 nt, Human
gaguuuuuuuggaauuuuccc

SEQ ID NO: 158917 - RNA, 18 nt, Human
gaucacaggugugagcca

SEQ ID NO: 158918 - RNA, 22 nt, Human
gaucacaggugugagccacugc

SEQ ID NO: 158919 - RNA, 23 nt, Human
gaucacaggugugagccacugca

SEQ ID NO: 158920 - RNA, 20 nt, Human
gauggcagcugccaccaaaa

SEQ ID NO: 158921 - RNA, 18 nt, Human
gauuacagaugcaugcca

SEQ ID NO: 158922 - RNA, 23 nt, Human
gauuacagaugcaugccauugca

SEQ ID NO: 158923 - RNA, 18 nt, Human
gcagucuggaacuccugg

SEQ ID NO: 158924 - RNA, 22 nt, Human
gcaguggcggaaaggaagccac

SEQ ID NO: 158925 - RNA, 20 nt, Human
gccacugcacccagccaggc

SEQ ID NO: 158926 - RNA, 21 nt, Human
gcccaggcuggagugcagugu

SEQ ID NO: 158927 - RNA, 22 nt, Human
gccuuggccucccaaagugcug

SEQ ID NO: 158928 - RNA, 19 nt, Human
gcggcugccccugugccca

SEQ ID NO: 158929 - RNA, 25 nt, Human
gcucuguugcccaggcuggagugca

SEQ ID NO: 158930 - RNA, 19 nt, Human
ggacaguccucccacccag

SEQ ID NO: 158931 - RNA, 22 nt, Human
ggagacacaagggaagccugag

SEQ ID NO: 158932 - RNA, 24 nt, Human
ggagacacaagggaagccugaggg

SEQ ID NO: 158933 - RNA, 25 nt, Human
ggagucccuccacaacaggaggccu

SEQ ID NO: 158934 - RNA, 20 nt, Human
ggcucccccagcuccccacc

SEQ ID NO: 158935 - RNA, 18 nt, Human
gggaagccugagggaccc

SEQ ID NO: 158936 - RNA, 20 nt, Human
gggagcugcuucagcaguuu

SEQ ID NO: 158937 - RNA, 18 nt, Human
gggaucuguggcuugaaa

SEQ ID NO: 158938 - RNA, 19 nt, Human
gggcagaggccuggcaggg

SEQ ID NO: 158939 - RNA, 21 nt, Human
gggcagaggccuggcagggga

SEQ ID NO: 158940 - RNA, 23 nt, Human
gguccaguuccuuccaggguggc

SEQ ID NO: 158941 - RNA, 22 nt, Human
ggugaugucccuucacagcagc

SEQ ID NO: 158942 - RNA, 19 nt, Human
guggagggaauggccgagg

SEQ ID NO: 158943 - RNA, 19 nt, Human
guuuguuauaugaaggcaa

SEQ ID NO: 158944 - RNA, 22 nt, Human
uaaaaagagucuaaaaagagcu

SEQ ID NO: 158945 - RNA, 24 nt, Human
uaauuuuuguauuuuuaguagaga

SEQ ID NO: 158946 - RNA, 21 nt, Human
uacacacaaaucaaaauggac

SEQ ID NO: 158947 - RNA, 22 nt, Human
uaccaaaauaaggaauuucccu

SEQ ID NO: 158948 - RNA, 20 nt, Human
uaccuucgccugccggcucc

SEQ ID NO: 158949 - RNA, 20 nt, Human
uagaaugaaaaaauagacaa

SEQ ID NO: 158950 - RNA, 22 nt, Human
uagagauaggguauugccaugu

SEQ ID NO: 158951 - RNA, 24 nt, Human
uaguagagauaggguauugccaug

SEQ ID NO: 158952 - RNA, 22 nt, Human
uaucaaaaacuaaacuaucagg

SEQ ID NO: 158953 - RNA, 22 nt, Human
uaucaggaauuuccaauuccca

SEQ ID NO: 158954 - RNA, 18 nt, Human
ucaaaauggacaaaagca

SEQ ID NO: 158955 - RNA, 21 nt, Human
ucaaccccaacaccucugacg

SEQ ID NO: 158956 - RNA, 24 nt, Human
ucacuacaacucccaccucccggg

SEQ ID NO: 158957 - RNA, 21 nt, Human
ucagugccacguccccagagg

SEQ ID NO: 158958 - RNA, 19 nt, Human
ucaguggaucuauuagcau

SEQ ID NO: 158959 - RNA, 19 nt, Human
uccacaaaugcguggccac

SEQ ID NO: 158960 - RNA, 23 nt, Human
uccaggcuaggaagaagucuucc

SEQ ID NO: 158961 - RNA, 25 nt, Human
uccagggagacacaagggaaggaag

SEQ ID NO: 158962 - RNA, 23 nt, Human
ucccaaagugcugggaucacagg

SEQ ID NO: 158963 - RNA, 22 nt, Human
ucccccagcuccccaccuuuga

SEQ ID NO: 158964 - RNA, 19 nt, Human
ucccccugccuuggccucc

SEQ ID NO: 158965 - RNA, 18 nt, Human
ucccggguucaagagauc

SEQ ID NO: 158966 - RNA, 24 nt, Human
ucccgguggcaccugcccaggcuu

SEQ ID NO: 158967 - RNA, 23 nt, Human
ucccugaaaggaaaaagcacccu

SEQ ID NO: 158968 - RNA, 19 nt, Human
ucccugcggcugccccugu

SEQ ID NO: 158969 - RNA, 20 nt, Human
ucccugcugccaccaugucc

SEQ ID NO: 158970 - RNA, 24 nt, Human
ucgcucuguugcccaggcuggagu

SEQ ID NO: 158971 - RNA, 20 nt, Human
ucggaugccauuccuucccg

SEQ ID NO: 158972 - RNA, 21 nt, Human
ucuaaauucuuuaaugguuca

SEQ ID NO: 158973 - RNA, 18 nt, Human
ucucagaagaaaggcuca

SEQ ID NO: 158974 - RNA, 19 nt, Human
ucucgcucuguugcccagg

SEQ ID NO: 158975 - RNA, 23 nt, Human
ucucgcucuguugcccaggcugg

SEQ ID NO: 158976 - RNA, 24 nt, Human
ucucgcucuguugcccaggcugga

SEQ ID NO: 158977 - RNA, 26 nt, Human
ucucgcucuguugcccaggcuggagu

SEQ ID NO: 158978 - RNA, 24 nt, Human
ucugacugcagcauuucucagaag

SEQ ID NO: 158979 - RNA, 21 nt, Human
ucuggaacuccugggcugaag

SEQ ID NO: 158980 - RNA, 18 nt, Human
ucuguugcccaggcugga

SEQ ID NO: 158981 - RNA, 24 nt, Human
ucuguugcccaggcuggagugcag

SEQ ID NO: 158982 - RNA, 18 nt, Human
ucuugaauagcugggauu

SEQ ID NO: 158983 - RNA, 22 nt, Human
ugaaaaaauagacaacaaauua

SEQ ID NO: 158984 - RNA, 22 nt, Human
ugaaggaacugggagauucugc

SEQ ID NO: 158985 - RNA, 19 nt, Human
ugacugagucugggcugag

SEQ ID NO: 158986 - RNA, 24 nt, Human
ugagcacgaagcauguuauaugaa

SEQ ID NO: 158987 - RNA, 22 nt, Human
ugaugucccuucacagcagccu

SEQ ID NO: 158988 - RNA, 21 nt, Human
ugccauguuagccaggcaguc

SEQ ID NO: 158989 - RNA, 30 nt, Human
ugccauguuagccaggcagucuggaacucc

SEQ ID NO: 158990 - RNA, 24 nt, Human
ugccauugcaccccgauaauuuuu

SEQ ID NO: 158991 - RNA, 18 nt, Human
ugcccaggccccgccaac

SEQ ID NO: 158992 - RNA, 18 nt, Human
ugcccaggcuggagugca

SEQ ID NO: 158993 - RNA, 21 nt, Human
ugcccaggcuggagugcagug

SEQ ID NO: 158994 - RNA, 21 nt, Human
ugcccaggcuuugccgaaauc

SEQ ID NO: 158995 - RNA, 23 nt, Human
ugccggaggcccgggcuugggug

SEQ ID NO: 158996 - RNA, 22 nt, Human
ugccucagccucuugaauagcu

SEQ ID NO: 158997 - RNA, 24 nt, Human
ugccucagccucuugaauagcugg

SEQ ID NO: 158998 - RNA, 24 nt, Human
ugcugggaucacaggugugagcca

SEQ ID NO: 158999 - RNA, 19 nt, Human
ugcuucagcaguuugggca

SEQ ID NO: 159000 - RNA, 20 nt, Human
uggaaaaagcgaaaagguga

SEQ ID NO: 159001 - RNA, 22 nt, Human
uggaaaaagcgaaaaggugaug

SEQ ID NO: 159002 - RNA, 20 nt, Human
uggaaagagugugccggagg

SEQ ID NO: 159003 - RNA, 19 nt, Human
uggagugcagugucaugau

SEQ ID NO: 159004 - RNA, 24 nt, Human
uggagugcagugucaugaucucgg

SEQ ID NO: 159005 - RNA, 20 nt, Human
uggcaggggaggaggaagag

SEQ ID NO: 159006 - RNA, 19 nt, Human
uggcggaaaggaagccacc

SEQ ID NO: 159007 - RNA, 19 nt, Human
ugggaucacaggugugagc

SEQ ID NO: 159008 - RNA, 21 nt, Human
ugggaucacaggugugagcca

SEQ ID NO: 159009 - RNA, 22 nt, Human
ugggaucacaggugugagccac

SEQ ID NO: 159010 - RNA, 22 nt, Human
ugggaucacaggugugagccac

SEQ ID NO: 159011 - RNA, 24 nt, Human
ugggaucacaggugugagccacug

SEQ ID NO: 159012 - RNA, 21 nt, Human
ugggauuacagaugcaugcca

SEQ ID NO: 159013 - RNA, 21 nt, Human
ugggauuacagaugcaugcca

SEQ ID NO: 159014 - RNA, 22 nt, Human
ugggauuacagaugcaugccau

SEQ ID NO: 159015 - RNA, 24 nt, Human
ugggauuacagaugcaugccauug

SEQ ID NO: 159016 - RNA, 21 nt, Human
ugguccucgcgggagcugcuu

SEQ ID NO: 159017 - RNA, 23 nt, Human
ugguucaugaccaaauucuuggu

SEQ ID NO: 159018 - RNA, 23 nt, Human
uguauuuuuggcucucucugagg

SEQ ID NO: 159019 - RNA, 24 nt, Human
ugucaugaucucggcucacuacaa

SEQ ID NO: 159020 - RNA, 22 nt, Human
ugucugcuccuguggccuguca

SEQ ID NO: 159021 - RNA, 23 nt, Human
ugugcccaggccccgccaacgcc

SEQ ID NO: 159022 - RNA, 24 nt, Human
ugugccggaggcccgggcuugggu

SEQ ID NO: 159023 - RNA, 19 nt, Human
uuaaagucagaacaggaga

SEQ ID NO: 159024 - RNA, 19 nt, Human
uuaauccugccuucuaaug

SEQ ID NO: 159025 - RNA, 24 nt, Human
uuaguagagauaggguauugccau

SEQ ID NO: 159026 - RNA, 20 nt, Human
uuagugaacaugucugacug

SEQ ID NO: 159027 - RNA, 23 nt, Human
uuagugaacaugucugacugagu

SEQ ID NO: 159028 - RNA, 21 nt, Human
uucaaccccaacaccucugac

SEQ ID NO: 159029 - RNA, 21 nt, Human
uuccagaucuucaguggaucu

SEQ ID NO: 159030 - RNA, 21 nt, Human
uuccaggcuaggaagaagucu

SEQ ID NO: 159031 - RNA, 21 nt, Human
uuccauggcccagccacaagu

SEQ ID NO: 159032 - RNA, 19 nt, Human
uuccuggaauuuuccagau

SEQ ID NO: 159033 - RNA, 23 nt, Human
uugccauguuagccaggcagucu

SEQ ID NO: 159034 - RNA, 24 nt, Human
uugcccaggcuggagugcaguguc

SEQ ID NO: 159035 - RNA, 25 nt, Human
uuggaauuuucccgcggucgcccgg

SEQ ID NO: 159036 - RNA, 18 nt, Human
uuggccucccaaagugcu

SEQ ID NO: 159037 - RNA, 25 nt, Human
uuggcuuuuugaguuuuuuuggaau

SEQ ID NO: 159038 - RNA, 24 nt, Human
uuggguaaaaacuagaaaccuguu

SEQ ID NO: 159039 - RNA, 18 nt, Human
uuuagcaaauacagagug

SEQ ID NO: 159040 - RNA, 25 nt, Human
uuugcucauaccucaaaacggagcc

SEQ ID NO: 159041 - RNA, 21 nt, Human
uuuuuaguagagauaggguau

SEQ ID NO: 159042 - RNA, 20 nt, Human
uuuuuguauuuuuaguagag

SEQ ID NO: 159043 - RNA, 24 nt, Human
aaaagugcuaggauuacaagcaug

SEQ ID NO: 159044 - RNA, 22 nt, Human
aaagcaucuguaccacaaaaaa

SEQ ID NO: 159045 - RNA, 18 nt, Human
aaagugcuaggauuacaa

SEQ ID NO: 159046 - RNA, 24 nt, Human
aaagugcuaggauuacaagcauga

SEQ ID NO: 159047 - RNA, 24 nt, Human
aaagugcugggauuacagguguga

SEQ ID NO: 159048 - RNA, 20 nt, Human
aaaugccacaacucgagaua

SEQ ID NO: 159049 - RNA, 26 nt, Human
aagugcuaggauuacaagcaugagcc

SEQ ID NO: 159050 - RNA, 18 nt, Human
aagugcugggauuacagg

SEQ ID NO: 159051 - RNA, 19 nt, Human
aagugcugggauuacaggu

SEQ ID NO: 159052 - RNA, 26 nt, Human
aagugcugggauuacaggugugagcc

SEQ ID NO: 159053 - RNA, 23 nt, Human
acaggcacgugccaccacaccca

SEQ ID NO: 159054 - RNA, 18 nt, Human
accuugugaucugcccac

SEQ ID NO: 159055 - RNA, 24 nt, Human
acuauguuggccaggcuggucuug

SEQ ID NO: 159056 - RNA, 20 nt, Human
agauaacaggcacgugccac

SEQ ID NO: 159057 - RNA, 23 nt, Human
augggguuucacuauguuggcca

SEQ ID NO: 159058 - RNA, 24 nt, Human
augggguuucacuauguuggccag

SEQ ID NO: 159059 - RNA, 24 nt, Human
caaagugcugggauuacaggugug

SEQ ID NO: 159060 - RNA, 22 nt, Human
caccaaaugcuuucacauuucu

SEQ ID NO: 159061 - RNA, 24 nt, Human
caccacacccagcuaauuuuugua

SEQ ID NO: 159062 - RNA, 21 nt, Human
cacuauguuggccaggcuggu

SEQ ID NO: 159063 - RNA, 24 nt, Human
cacuauguuggccaggcuggucuu

SEQ ID NO: 159064 - RNA, 24 nt, Human
cagaaaauugucaacucuauaaca

SEQ ID NO: 159065 - RNA, 24 nt, Human
caguagagaugggguuucacuaug

SEQ ID NO: 159066 - RNA, 20 nt, Human
ccaaagugcugggauuacag

SEQ ID NO: 159067 - RNA, 21 nt, Human
ccaaagugcugggauuacagg

SEQ ID NO: 159068 - RNA, 21 nt, Human
ccaaagugcugggauuacagg

SEQ ID NO: 159069 - RNA, 24 nt, Human
ccaaagugcugggauuacaggugu

SEQ ID NO: 159070 - RNA, 18 nt, Human
ccacaucggccucccaaa

SEQ ID NO: 159071 - RNA, 20 nt, Human
ccaccacacccagcuaauuu

SEQ ID NO: 159072 - RNA, 18 nt, Human
cccggacucaagcaaucc

SEQ ID NO: 159073 - RNA, 22 nt, Human
ccucaaaaagugcuaggauuac

SEQ ID NO: 159074 - RNA, 24 nt, Human
cgaaagcaucuguaccacaaaaaa

SEQ ID NO: 159075 - RNA, 23 nt, Human
cuaauuuuuguauuuucaguaga

SEQ ID NO: 159076 - RNA, 24 nt, Human
cucaagcaauccuccuaccuuggc

SEQ ID NO: 159077 - RNA, 24 nt, Human
cucauucuucucaacacucagaaa

SEQ ID NO: 159078 - RNA, 22 nt, Human
cuccugaccuugugaucugccc

SEQ ID NO: 159079 - RNA, 23 nt, Human
cuucugggucccaaaaauuauau

SEQ ID NO: 159080 - RNA, 21 nt, Human
cuuggccucaaaaagugcuag

SEQ ID NO: 159081 - RNA, 22 nt, Human
gaccuugugaucugcccacauc

SEQ ID NO: 159082 - RNA, 24 nt, Human
gagaugggguuucacuauguuggc

SEQ ID NO: 159083 - RNA, 18 nt, Human
gauuacaagcaugagcca

SEQ ID NO: 159084 - RNA, 22 nt, Human
gauuacaagcaugagccacugc

SEQ ID NO: 159085 - RNA, 22 nt, Human
gauuacaagcaugagccacugc

SEQ ID NO: 159086 - RNA, 18 nt, Human
gauuacaggugugagcca

SEQ ID NO: 159087 - RNA, 22 nt, Human
gauuacaggugugagccaccgc

SEQ ID NO: 159088 - RNA, 23 nt, Human
gauuacaggugugagccaccgca

SEQ ID NO: 159089 - RNA, 22 nt, Human
ggauuacaagcaugagccacug

SEQ ID NO: 159090 - RNA, 24 nt, Human
ggcuggucuugaacuccugaccuu

SEQ ID NO: 159091 - RNA, 22 nt, Human
gggguuucacuauguuggccag

SEQ ID NO: 159092 - RNA, 20 nt, Human
ggucuugaacuccugaccuu

SEQ ID NO: 159093 - RNA, 18 nt, Human
gugucguuguuucuucug

SEQ ID NO: 159094 - RNA, 18 nt, Human
uaacaggcacgugccacc

SEQ ID NO: 159095 - RNA, 24 nt, Human
uaauuuuuguauuuucaguagaga

SEQ ID NO: 159096 - RNA, 24 nt, Human
uacaggugugagccaccgcaccca

SEQ ID NO: 159097 - RNA, 22 nt, Human
uaccuuggccucaaaaagugcu

SEQ ID NO: 159098 - RNA, 18 nt, Human
uacuucgaugacuucucc

SEQ ID NO: 159099 - RNA, 22 nt, Human
uagagaugggguuucacuaugu

SEQ ID NO: 159100 - RNA, 22 nt, Human
uaggauuacaagcaugagccac

SEQ ID NO: 159101 - RNA, 22 nt, Human
uaggauuacaagcaugagccac

SEQ ID NO: 159102 - RNA, 24 nt, Human
uaggauuacaagcaugagccacug

SEQ ID NO: 159103 - RNA, 26 nt, Human
uaggauuacaagcaugagccacugcg

SEQ ID NO: 159104 - RNA, 30 nt, Human
uaggauuacaagcaugagccacugcgccaa

SEQ ID NO: 159105 - RNA, 21 nt, Human
uauaacaaaugccacaacucg

SEQ ID NO: 159106 - RNA, 24 nt, Human
uauguuggccaggcuggucuugaa

SEQ ID NO: 159107 - RNA, 24 nt, Human
uauguugugcagcuuugccuugag

SEQ ID NO: 159108 - RNA, 26 nt, Human
uauuuuuguauguuucaaauguguuu

SEQ ID NO: 159109 - RNA, 24 nt, Human
ucaagcaauccuccuaccuuggcc

SEQ ID NO: 159110 - RNA, 22 nt, Human
ucacuauguuggccaggcuggu

SEQ ID NO: 159111 - RNA, 18 nt, Human
ucaguagagaugggguuu

SEQ ID NO: 159112 - RNA, 21 nt, Human
ucaguagagaugggguuucac

SEQ ID NO: 159113 - RNA, 24 nt, Human
ucaguagagaugggguuucacuau

SEQ ID NO: 159114 - RNA, 23 nt, Human
ucccaaagugcugggauuacagg

SEQ ID NO: 159115 - RNA, 24 nt, Human
ucccaaguagcugagauaacaggc

SEQ ID NO: 159116 - RNA, 18 nt, Human
ucggccucccaaagugcu

SEQ ID NO: 159117 - RNA, 23 nt, Human
ucuauuuuuauuucaguucucua

SEQ ID NO: 159118 - RNA, 23 nt, Human
ucucuaagguggcagcuucugac

SEQ ID NO: 159119 - RNA, 18 nt, Human
ucuguaccacaaaaaagc

SEQ ID NO: 159120 - RNA, 19 nt, Human
ucuugaacuccugaccuug

SEQ ID NO: 159121 - RNA, 18 nt, Human
ugacucugugcuuuggcu

SEQ ID NO: 159122 - RNA, 24 nt, Human
ugagauaacaggcacgugccacca

SEQ ID NO: 159123 - RNA, 24 nt, Human
ugagcucccggacucaagcaaucc

SEQ ID NO: 159124 - RNA, 25 nt, Human
ugagcucccggacucaagcaauccu

SEQ ID NO: 159125 - RNA, 23 nt, Human
ugccacaacucgagauacucagg

SEQ ID NO: 159126 - RNA, 21 nt, Human
ugcccacaucggccucccaaa

SEQ ID NO: 159127 - RNA, 20 nt, Human
ugccuugagcucccggacuc

SEQ ID NO: 159128 - RNA, 24 nt, Human
ugcuaggauuacaagcaugagcca

SEQ ID NO: 159129 - RNA, 24 nt, Human
ugcugggauuacaggugugagcca

SEQ ID NO: 159130 - RNA, 24 nt, Human
uggccaggcuggucuugaacuccu

SEQ ID NO: 159131 - RNA, 18 nt, Human
ugggauuacaggugugag

SEQ ID NO: 159132 - RNA, 19 nt, Human
ugggauuacaggugugagc

SEQ ID NO: 159133 - RNA, 21 nt, Human
ugggauuacaggugugagcca

SEQ ID NO: 159134 - RNA, 22 nt, Human
ugggauuacaggugugagccac

SEQ ID NO: 159135 - RNA, 23 nt, Human
ugggauuacaggugugagccacc

SEQ ID NO: 159136 - RNA, 24 nt, Human
ugggauuacaggugugagccaccg

SEQ ID NO: 159137 - RNA, 24 nt, Human
ugggguuucacuauguuggccagg

SEQ ID NO: 159138 - RNA, 22 nt, Human
uuaacucauucuucucaacacu

SEQ ID NO: 159139 - RNA, 20 nt, Human
uucgaugacuucucccuucu

SEQ ID NO: 159140 - RNA, 18 nt, Human
uucucccuucuaaaaugg

SEQ ID NO: 159141 - RNA, 25 nt, Human
uuggccucaaaaagugcuaggauua

SEQ ID NO: 159142 - RNA, 21 nt, Human
uugugucguuguuucuucugg

SEQ ID NO: 159143 - RNA, 23 nt, Human
uuucacuauguuggccaggcugu

SEQ ID NO: 159144 - RNA, 24 nt, Human
uuuucaguagagaugggguuucac

SEQ ID NO: 159145 - RNA, 20 nt, Human
uuuuuguauuuucaguagag

SEQ ID NO: 159146 - RNA, 23 nt, Human
uuuuuguauuuucaguagagaug

SEQ ID NO: 159147 - RNA, 23 nt, Human
aaaaacaaaagaaaugaaaaaga

SEQ ID NO: 159148 - RNA, 24 nt, Human
aaaaacaaaagaaaugaaaaagaa

SEQ ID NO: 159149 - RNA, 25 nt, Human
aaaaacacagaaggucauaauauac

SEQ ID NO: 159150 - RNA, 19 nt, Human
aaaaagaaaauauagcuga

SEQ ID NO: 159151 - RNA, 20 nt, Human
aaacaaaaacacagaagguc

SEQ ID NO: 159152 - RNA, 24 nt, Human
aagaucacuugagcucaggaguuc

SEQ ID NO: 159153 - RNA, 22 nt, Human
aaggcaggaagaucacuugagc

SEQ ID NO: 159154 - RNA, 22 nt, Human
aagucagaaacaaaaacacaga

SEQ ID NO: 159155 - RNA, 21 nt, Human
acagagcaauaccuucucuca

SEQ ID NO: 159156 - RNA, 24 nt, Human
acagagcaauaccuucucucaaaa

SEQ ID NO: 159157 - RNA, 24 nt, Human
acugcacuccagccuggaugacag

SEQ ID NO: 159158 - RNA, 26 nt, Human
acugcacuccagccuggaugacagag

SEQ ID NO: 159159 - RNA, 23 nt, Human
agacaagguggugaagaaagaaa

SEQ ID NO: 159160 - RNA, 19 nt, Human
agaggguggucccuuggug

SEQ ID NO: 159161 - RNA, 18 nt, Human
agagguuacagugagcca

SEQ ID NO: 159162 - RNA, 19 nt, Human
agcucaggaguucaagacc

SEQ ID NO: 159163 - RNA, 24 nt, Human
aggaguucaagaccagcccugacc

SEQ ID NO: 159164 - RNA, 19 nt, Human
aggcagagguuacagugag

SEQ ID NO: 159165 - RNA, 27 nt, Human
aggcagagguuacagugagccaugauc

SEQ ID NO: 159166 - RNA, 18 nt, Human
aggcaggaagaucacuug

SEQ ID NO: 159167 - RNA, 19 nt, Human
aggcaggaagaucacuuga

SEQ ID NO: 159168 - RNA, 21 nt, Human
aggcucagccuuuauccucag

SEQ ID NO: 159169 - RNA, 24 nt, Human
aucgcaucacugcacuccagccug

SEQ ID NO: 159170 - RNA, 24 nt, Human
caaaaacaaaagaaaugaaaaaga

SEQ ID NO: 159171 - RNA, 25 nt, Human
cacaccuguaaaucucaacacuuug

SEQ ID NO: 159172 - RNA, 24 nt, Human
caccuguaaaucucaacacuuugg

SEQ ID NO: 159173 - RNA, 25 nt, Human
caccuguaaaucucaacacuuuggg

SEQ ID NO: 159174 - RNA, 18 nt, Human
cacugcacuccagccugg

SEQ ID NO: 159175 - RNA, 19 nt, Human
cacugcacuccagccugga

SEQ ID NO: 159176 - RNA, 19 nt, Human
cacugcacuccagccugga

SEQ ID NO: 159177 - RNA, 20 nt, Human
cacugcacuccagccuggau

SEQ ID NO: 159178 - RNA, 22 nt, Human
cacugcacuccagccuggauga

SEQ ID NO: 159179 - RNA, 23 nt, Human
cacugcacuccagccuggaugac

SEQ ID NO: 159180 - RNA, 24 nt, Human
cacugcacuccagccuggaugaca

SEQ ID NO: 159181 - RNA, 22 nt, Human
cagaccuccuggagcaucccau

SEQ ID NO: 159182 - RNA, 20 nt, Human
caucugagcccacugguacc

SEQ ID NO: 159183 - RNA, 21 nt, Human
cauguagucccagcuacuugg

SEQ ID NO: 159184 - RNA, 23 nt, Human
cccuuagcccaggagccucccug

SEQ ID NO: 159185 - RNA, 19 nt, Human
ccgcccgaagccgcagccg

SEQ ID NO: 159186 - RNA, 19 nt, Human
ccucccugcuggcugggaa

SEQ ID NO: 159187 - RNA, 25 nt, Human
ccugggaggcagagguuacagugag

SEQ ID NO: 159188 - RNA, 19 nt, Human
ccuguuacaagcucuccuc

SEQ ID NO: 159189 - RNA, 21 nt, Human
cgcaucacugcacuccagccu

SEQ ID NO: 159190 - RNA, 19 nt, Human
cggaaaguuugucccugca

SEQ ID NO: 159191 - RNA, 27 nt, Human
cgucccugacgcggcgguggcgggcca

SEQ ID NO: 159192 - RNA, 23 nt, Human
cuacugagcccuaucggaaaguu

SEQ ID NO: 159193 - RNA, 22 nt, Human
cucagaggcugaggggaacgga

SEQ ID NO: 159194 - RNA, 21 nt, Human
gaaaaagaaaauauagcugaa

SEQ ID NO: 159195 - RNA, 18 nt, Human
gacaagguggugaagaaa

SEQ ID NO: 159196 - RNA, 18 nt, Human
gacgcggcgguggcgggc

SEQ ID NO: 159197 - RNA, 20 nt, Human
gacgcggcgguggcgggcca

SEQ ID NO: 159198 - RNA, 23 nt, Human
gaucacuugagcucaggaguuca

SEQ ID NO: 159199 - RNA, 24 nt, Human
gaucacuugagcucaggaguucaa

SEQ ID NO: 159200 - RNA, 24 nt, Human
gcacuccagccuggaugacagagc

SEQ ID NO: 159201 - RNA, 20 nt, Human
gcaucacugcacuccagccu

SEQ ID NO: 159202 - RNA, 22 nt, Human
gcccaggagccucccugcuggc

SEQ ID NO: 159203 - RNA, 20 nt, Human
gcccaggagccucccugcuu

SEQ ID NO: 159204 - RNA, 20 nt, Human
gccuguuacaagcucuccuc

SEQ ID NO: 159205 - RNA, 21 nt, Human
ggagaaacccggccgcccgaa

SEQ ID NO: 159206 - RNA, 27 nt, Human
ggagaaacccggccgcccgaagccgca

SEQ ID NO: 159207 - RNA, 23 nt, Human
ggaggaucgagccugggaggcag

SEQ ID NO: 159208 - RNA, 21 nt, Human
ggaggcagagguuacagugag

SEQ ID NO: 159209 - RNA, 20 nt, Human
ggccgcccgaagccgcagcc

SEQ ID NO: 159210 - RNA, 21 nt, Human
ggccuggugugguggcucaca

SEQ ID NO: 159211 - RNA, 23 nt, Human
ggcgguggcgggccagcuccagc

SEQ ID NO: 159212 - RNA, 23 nt, Human
ggugugguggcucacaccuguaa

SEQ ID NO: 159213 - RNA, 18 nt, Human
gugugguggcucacaccu

SEQ ID NO: 159214 - RNA, 20 nt, Human
uaccccagaccuccuggagc

SEQ ID NO: 159215 - RNA, 18 nt, Human
uaccuucucucaaaaaca

SEQ ID NO: 159216 - RNA, 22 nt, Human
uagcugggcauagugucaugug

SEQ ID NO: 159217 - RNA, 21 nt, Human
uauccucaggcuagggcucaa

SEQ ID NO: 159218 - RNA, 19 nt, Human
ucacugcacuccagccugg

SEQ ID NO: 159219 - RNA, 21 nt, Human
ucacugcacuccagccuggau

SEQ ID NO: 159220 - RNA, 24 nt, Human
ucacugcacuccagccuggaugac

SEQ ID NO: 159221 - RNA, 23 nt, Human
ucacuugagcucaggaguucaag

SEQ ID NO: 159222 - RNA, 18 nt, Human
uccagccuggaugacaga

SEQ ID NO: 159223 - RNA, 18 nt, Human
uccuggagcaucccaugc

SEQ ID NO: 159224 - RNA, 23 nt, Human
ucgcaucacugcacuccagccug

SEQ ID NO: 159225 - RNA, 21 nt, Human
ucucucaaaaacaaaagaaau

SEQ ID NO: 159226 - RNA, 18 nt, Human
ugacagagcaauaccuuc

SEQ ID NO: 159227 - RNA, 21 nt, Human
ugagcccacugguaccccaga

SEQ ID NO: 159228 - RNA, 23 nt, Human
ugcauguagucccagcuacuugg

SEQ ID NO: 159229 - RNA, 24 nt, Human
ugcauguagucccagcuacuuggg

SEQ ID NO: 159230 - RNA, 20 nt, Human
uggagcaucccaugcccacu

SEQ ID NO: 159231 - RNA, 22 nt, Human
uggcgggccagcuccagcgccu

SEQ ID NO: 159232 - RNA, 18 nt, Human
ugggaggcugacauggga

SEQ ID NO: 159233 - RNA, 19 nt, Human
ugggaggcugacaugggag

SEQ ID NO: 159234 - RNA, 23 nt, Human
ugggaggcugacaugggaggauc

SEQ ID NO: 159235 - RNA, 20 nt, Human
uguagucccagcuacuuggg

SEQ ID NO: 159236 - RNA, 21 nt, Human
ugugguggcucacaccuguaa

SEQ ID NO: 159237 - RNA, 24 nt, Human
uuagcugggcauagugucaugugc

SEQ ID NO: 159238 - RNA, 22 nt, Human
uucaagucagaaacaaaaacac

SEQ ID NO: 159239 - RNA, 24 nt, Human
uugggaggcugacaugggaggauc

SEQ ID NO: 159240 - RNA, 18 nt, Human
aaaaaaaaaaaaguuuga

SEQ ID NO: 159241 - RNA, 21 nt, Human
aaaggcauauauuuguauuua

SEQ ID NO: 159242 - RNA, 24 nt, Human
aacacaacuagguuccuacacaca

SEQ ID NO: 159243 - RNA, 23 nt, Human
aacuauucaaaauuagcaucuaa

SEQ ID NO: 159244 - RNA, 18 nt, Human
aagaaaacucuucacuac

SEQ ID NO: 159245 - RNA, 23 nt, Human
aaggcggacggaucacaagguca

SEQ ID NO: 159246 - RNA, 24 nt, Human
acagagcgagacuccaucucaaaa

SEQ ID NO: 159247 - RNA, 24 nt, Human
accccgucucuacuaaaaauacaa

SEQ ID NO: 159248 - RNA, 18 nt, Human
accuaguuaacggcagaa

SEQ ID NO: 159249 - RNA, 19 nt, Human
acugcacuccagacugggu

SEQ ID NO: 159250 - RNA, 24 nt, Human
acugcacuccagacugggugacag

SEQ ID NO: 159251 - RNA, 26 nt, Human
acugcacuccagacugggugacagag

SEQ ID NO: 159252 - RNA, 19 nt, Human
agaaacaaacuuucugaac

SEQ ID NO: 159253 - RNA, 24 nt, Human
agacugggugacagagcgagacuc

SEQ ID NO: 159254 - RNA, 20 nt, Human
agagguugcacugagcagug

SEQ ID NO: 159255 - RNA, 24 nt, Human
agauaggccaacagcuuuucaaac

SEQ ID NO: 159256 - RNA, 20 nt, Human
agcauggugaaaccccgucu

SEQ ID NO: 159257 - RNA, 22 nt, Human
agccuggccagcauggugaaac

SEQ ID NO: 159258 - RNA, 24 nt, Human
agccuggccagcauggugaaaccc

SEQ ID NO: 159259 - RNA, 22 nt, Human
aggaaucagaccacaaggaaaa

SEQ ID NO: 159260 - RNA, 19 nt, Human
aggcagagguugcacugag

SEQ ID NO: 159261 - RNA, 21 nt, Human
aggccaaggcggacggaucac

SEQ ID NO: 159262 - RNA, 23 nt, Human
aggccaaggcggacggaucacaa

SEQ ID NO: 159263 - RNA, 24 nt, Human
aggcgcgguggcucacgccuguaa

SEQ ID NO: 159264 - RNA, 24 nt, Human
aggcggacggaucacaaggucagg

SEQ ID NO: 159265 - RNA, 21 nt, Human
aggcugagucagaauugcuug

SEQ ID NO: 159266 - RNA, 24 nt, Human
aucacaccacugcacuccagacug

SEQ ID NO: 159267 - RNA, 22 nt, Human
aucccagcacuuugggaggcca

SEQ ID NO: 159268 - RNA, 26 nt, Human
caaggcggacggaucacaaggucagg

SEQ ID NO: 159269 - RNA, 23 nt, Human
cacacaaaacaaauauucuaaac

SEQ ID NO: 159270 - RNA, 21 nt, Human
caccuguaaucccagcuacuu

SEQ ID NO: 159271 - RNA, 23 nt, Human
caccuguaaucccagcuacuugg

SEQ ID NO: 159272 - RNA, 24 nt, Human
caccuguaaucccagcuacuuggg

SEQ ID NO: 159273 - RNA, 24 nt, Human
cacgccuguaaucccagcacuuug

SEQ ID NO: 159274 - RNA, 23 nt, Human
cacuaucagcuguggaacaccca

SEQ ID NO: 159275 - RNA, 22 nt, Human
cacucaagauuuaucuagaaaa

SEQ ID NO: 159276 - RNA, 23 nt, Human
cacuccagacugggugacagagc

SEQ ID NO: 159277 - RNA, 24 nt, Human
cacuccagacugggugacagagcg

SEQ ID NO: 159278 - RNA, 19 nt, Human
cacugcacuccagacuggg

SEQ ID NO: 159279 - RNA, 23 nt, Human
cacugcacuccagacugggugac

SEQ ID NO: 159280 - RNA, 24 nt, Human
cacugcacuccagacugggugaca

SEQ ID NO: 159281 - RNA, 24 nt, Human
cacugcacuccagacugggugaca

SEQ ID NO: 159282 - RNA, 21 nt, Human
cacugccaggaauaaagaaaa

SEQ ID NO: 159283 - RNA, 24 nt, Human
cagaccacaaggaaaaagaaauug

SEQ ID NO: 159284 - RNA, 24 nt, Human
cagcacuuugggaggccaaggcgg

SEQ ID NO: 159285 - RNA, 18 nt, Human
cauggugaaaccccgucu

SEQ ID NO: 159286 - RNA, 19 nt, Human
cauggugaaaccccgucuc

SEQ ID NO: 159287 - RNA, 21 nt, Human
cauggugaaaccccgucucua

SEQ ID NO: 159288 - RNA, 20 nt, Human
ccaagggaaaaauaaggaaa

SEQ ID NO: 159289 - RNA, 23 nt, Human
ccacagggcagccaccaagggaa

SEQ ID NO: 159290 - RNA, 20 nt, Human
ccacugcacuccagacuggg

SEQ ID NO: 159291 - RNA, 20 nt, Human
ccacugcacuccagacuggg

SEQ ID NO: 159292 - RNA, 21 nt, Human
ccacugcacuccagacugggu

SEQ ID NO: 159293 - RNA, 24 nt, Human
ccacugcacuccagacugggugac

SEQ ID NO: 159294 - RNA, 18 nt, Human
ccauacuaaaagaaaaag

SEQ ID NO: 159295 - RNA, 21 nt, Human
ccauacuaaaagaaaaagggu

SEQ ID NO: 159296 - RNA, 23 nt, Human
ccuggccagcauggugaaacccc

SEQ ID NO: 159297 - RNA, 24 nt, Human
ccuggccagcauggugaaaccccg

SEQ ID NO: 159298 - RNA, 25 nt, Human
ccugggaggcagagguugcacugag

SEQ ID NO: 159299 - RNA, 21 nt, Human
ccuguaaucccagcuacuugg

SEQ ID NO: 159300 - RNA, 23 nt, Human
cgagacuccaucucaaaaaaaaa

SEQ ID NO: 159301 - RNA, 24 nt, Human
cgccuguaaucccagcacuuuggg

SEQ ID NO: 159302 - RNA, 19 nt, Human
cuaaagcuaaagcuaacau

SEQ ID NO: 159303 - RNA, 21 nt, Human
cuacacacaaaacaaauauuc

SEQ ID NO: 159304 - RNA, 22 nt, Human
cucacgccuguaaucccagcac

SEQ ID NO: 159305 - RNA, 24 nt, Human
cucacgccuguaaucccagcacuu

SEQ ID NO: 159306 - RNA, 19 nt, Human
cuccaucucaaaaaaaaaa

SEQ ID NO: 159307 - RNA, 19 nt, Human
cugcaccuguaaucccagc

SEQ ID NO: 159308 - RNA, 21 nt, Human
cugggugacagagcgagacuc

SEQ ID NO: 159309 - RNA, 21 nt, Human
cuguaaucccagcuacuuggg

SEQ ID NO: 159310 - RNA, 20 nt, Human
gaaaaauaaaccauacuaaa

SEQ ID NO: 159311 - RNA, 25 nt, Human
gacagaaaaccuagaaaaauaaacc

SEQ ID NO: 159312 - RNA, 23 nt, Human
gacggaucacaaggucagguguu

SEQ ID NO: 159313 - RNA, 18 nt, Human
gauaaauguaaucuacaa

SEQ ID NO: 159314 - RNA, 24 nt, Human
gcacuccagacugggugacagagc

SEQ ID NO: 159315 - RNA, 24 nt, Human
gcagaagcugcacuaaaaccugga

SEQ ID NO: 159316 - RNA, 20 nt, Human
gcagugaucacaccacugca

SEQ ID NO: 159317 - RNA, 18 nt, Human
gcaugguggccugcaccu

SEQ ID NO: 159318 - RNA, 24 nt, Human
gccaccaagggaaaaauaaggaaa

SEQ ID NO: 159319 - RNA, 24 nt, Human
gccagcauggugaaaccccgucuc

SEQ ID NO: 159320 - RNA, 22 nt, Human
gcuaauuccauggcuuuaagug

SEQ ID NO: 159321 - RNA, 20 nt, Human
ggaacacccagguaaacuaa

SEQ ID NO: 159322 - RNA, 23 nt, Human
ggcaugguggccugcaccuguaa

SEQ ID NO: 159323 - RNA, 24 nt, Human
gguggccugcaccuguaaucccag

SEQ ID NO: 159324 - RNA, 23 nt, Human
gguggcucacgccuguaauccca

SEQ ID NO: 159325 - RNA, 24 nt, Human
gguggcucacgccuguaaucccag

SEQ ID NO: 159326 - RNA, 19 nt, Human
guagaacucuucacugggu

SEQ ID NO: 159327 - RNA, 18 nt, Human
guuuuggccaggcgcggu

SEQ ID NO: 159328 - RNA, 24 nt, Human
uaaaaaugaauaaauugcccuuga

SEQ ID NO: 159329 - RNA, 21 nt, Human
uaaaauaauuauacuuuggac

SEQ ID NO: 159330 - RNA, 22 nt, Human
uacacacaaaacaaauauucua

SEQ ID NO: 159331 - RNA, 21 nt, Human
uacuagguuaacaaggccaaa

SEQ ID NO: 159332 - RNA, 24 nt, Human
uagaaaaauaaaccauacuaaaag

SEQ ID NO: 159333 - RNA, 22 nt, Human
uagguuaacaaggccaaacucc

SEQ ID NO: 159334 - RNA, 24 nt, Human
uauaacuguuuaauaaacuauuca

SEQ ID NO: 159335 - RNA, 23 nt, Human
uauccagaaaauccgugacacua

SEQ ID NO: 159336 - RNA, 24 nt, Human
uauuuguauuuacugugcuuuaaa

SEQ ID NO: 159337 - RNA, 18 nt, Human
ucacaaacuguuauuuuc

SEQ ID NO: 159338 - RNA, 24 nt, Human
ucacaaggucagguguuugagacc

SEQ ID NO: 159339 - RNA, 23 nt, Human
ucacaccacugcacuccagacug

SEQ ID NO: 159340 - RNA, 24 nt, Human
uccagacugggugacagagcgaga

SEQ ID NO: 159341 - RNA, 18 nt, Human
ucuaaagcuaaagcuaac

SEQ ID NO: 159342 - RNA, 19 nt, Human
ucuauccagaaaauccgug

SEQ ID NO: 159343 - RNA, 22 nt, Human
ucuccaaaaaaauccucuuacc

SEQ ID NO: 159344 - RNA, 22 nt, Human
ucucuacuaaaaauacaaaaaa

SEQ ID NO: 159345 - RNA, 18 nt, Human
ucuuuuaucaucaagcau

SEQ ID NO: 159346 - RNA, 24 nt, Human
ugacacugccaggaauaaagaaaa

SEQ ID NO: 159347 - RNA, 23 nt, Human
ugagaccagccuggccagcaugg

SEQ ID NO: 159348 - RNA, 24 nt, Human
ugagaccagccuggccagcauggu

SEQ ID NO: 159349 - RNA, 24 nt, Human
ugccaggaauaaagaaaacucuuc

SEQ ID NO: 159350 - RNA, 21 nt, Human
uggaacacccagguaaacuaa

SEQ ID NO: 159351 - RNA, 24 nt, Human
uggccagcauggugaaaccccguc

SEQ ID NO: 159352 - RNA, 24 nt, Human
uggccaggcgcgguggcucacgcc

SEQ ID NO: 159353 - RNA, 22 nt, Human
uggccugcaccuguaaucccag

SEQ ID NO: 159354 - RNA, 22 nt, Human
uggcucacgccuguaaucccag

SEQ ID NO: 159355 - RNA, 24 nt, Human
uggcucacgccuguaaucccagca

SEQ ID NO: 159356 - RNA, 20 nt, Human
ugggaggcagagguugcacu

SEQ ID NO: 159357 - RNA, 24 nt, Human
ugggaggccaaggcggacggauca

SEQ ID NO: 159358 - RNA, 21 nt, Human
ugggaggcugagucagaauug

SEQ ID NO: 159359 - RNA, 21 nt, Human
uggguuguuucuuaaaaaaaa

SEQ ID NO: 159360 - RNA, 23 nt, Human
uggugagaacauuguaauuuuca

SEQ ID NO: 159361 - RNA, 24 nt, Human
ugguggccugcaccuguaauccca

SEQ ID NO: 159362 - RNA, 22 nt, Human
uguuauuuucuaaagcuaaagc

SEQ ID NO: 159363 - RNA, 23 nt, Human
uuaaagggacauacuauguggug

SEQ ID NO: 159364 - RNA, 18 nt, Human
uuacaauuuuauuguaaa

SEQ ID NO: 159365 - RNA, 25 nt, Human
uuagaauacuagguuaacaaggcca

SEQ ID NO: 159366 - RNA, 22 nt, Human
uuagccgggcaugguggccugc

SEQ ID NO: 159367 - RNA, 23 nt, Human
uugcuugauccugggaggcagag

SEQ ID NO: 159368 - RNA, 24 nt, Human
uugcuugauccugggaggcagagg

SEQ ID NO: 159369 - RNA, 20 nt, Human
uugggaggcugagucagaau

SEQ ID NO: 159370 - RNA, 22 nt, Human
uuugcagaaaaugagaaacaaa

SEQ ID NO: 159371 - RNA, 24 nt, Human
uuuggccaggcgcgguggcucacg

SEQ ID NO: 159372 - RNA, 24 nt, Human
uuuuguaaacuauauauucuauau

SEQ ID NO: 159373 - RNA, 21 nt, Human
aaacaggaaaaaaggugccuc

SEQ ID NO: 159374 - RNA, 22 nt, Human
aaacgagucagcaaccccaaac

SEQ ID NO: 159375 - RNA, 19 nt, Human
aaacucggggaggaaacga

SEQ ID NO: 159376 - RNA, 24 nt, Human
acaguccguggcucggcccuuccu

SEQ ID NO: 159377 - RNA, 28 nt, Human
agaaacaggaaaaaaggugccgguaccc

SEQ ID NO: 159378 - RNA, 21 nt, Human
agaccagaagcggacuuagga

SEQ ID NO: 159379 - RNA, 22 nt, Human
agaccagaagcggacuuaggaa

SEQ ID NO: 159380 - RNA, 27 nt, Human
agcuggccugcccaagcucccaacccc

SEQ ID NO: 159381 - RNA, 19 nt, Human
aggaauggucacauuccua

SEQ ID NO: 159382 - RNA, 24 nt, Human
caacagaaaaggagaaacaggaaa

SEQ ID NO: 159383 - RNA, 20 nt, Human
caaccccagcggggaggggc

SEQ ID NO: 159384 - RNA, 20 nt, Human
cacagccucgagaaagggug

SEQ ID NO: 159385 - RNA, 19 nt, Human
caccccgccgagcuccccu

SEQ ID NO: 159386 - RNA, 25 nt, Human
cagagagacagcccacuggggaccc

SEQ ID NO: 159387 - RNA, 21 nt, Human
cagagauuguuuccuccaaaa

SEQ ID NO: 159388 - RNA, 23 nt, Human
cagcaaccccaaacaggcuuagg

SEQ ID NO: 159389 - RNA, 23 nt, Human
cagcccacuggggacccagcuca

SEQ ID NO: 159390 - RNA, 20 nt, Human
ccacacccccagguccuccc

SEQ ID NO: 159391 - RNA, 22 nt, Human
cccaagcucccaaccccagcgg

SEQ ID NO: 159392 - RNA, 19 nt, Human
cccaauccacccgcccagg

SEQ ID NO: 159393 - RNA, 27 nt, Human
ccccgccgagcuccccugcuucucucg

SEQ ID NO: 159394 - RNA, 22 nt, Human
ccccugcuucucucgggguccc

SEQ ID NO: 159395 - RNA, 21 nt, Human
ccguggcucggcccuuccucg

SEQ ID NO: 159396 - RNA, 25 nt, Human
ccucgagaaagggugggcgggagcg

SEQ ID NO: 159397 - RNA, 24 nt, Human
ccugcccaagcucccaaccccagc

SEQ ID NO: 159398 - RNA, 22 nt, Human
cgaggcugggcccggagaccag

SEQ ID NO: 159399 - RNA, 24 nt, Human
cgccgggcucucaaccucgccucu

SEQ ID NO: 159400 - RNA, 22 nt, Human
cucaaccucgccucugguuggc

SEQ ID NO: 159401 - RNA, 25 nt, Human
cucccaaccccagcggggaggggcc

SEQ ID NO: 159402 - RNA, 18 nt, Human
cucgcugccacaccccca

SEQ ID NO: 159403 - RNA, 20 nt, Human
cucggggucccaauccaccc

SEQ ID NO: 159404 - RNA, 23 nt, Human
gaaaaggagaaacaggaaaaaag

SEQ ID NO: 159405 - RNA, 20 nt, Human
gaguuucggccccacagucc

SEQ ID NO: 159406 - RNA, 24 nt, Human
gcccuccccacagagagacagccc

SEQ ID NO: 159407 - RNA, 18 nt, Human
gcuggccugcccaagcuc

SEQ ID NO: 159408 - RNA, 20 nt, Human
ggaagggugaagcuggccug

SEQ ID NO: 159409 - RNA, 19 nt, Human
ggacagaugggacgcucuc

SEQ ID NO: 159410 - RNA, 21 nt, Human
ggcaaauuucacaggccuacc

SEQ ID NO: 159411 - RNA, 22 nt, Human
ggugguggcagagauuguuucc

SEQ ID NO: 159412 - RNA, 20 nt, Human
guaguaacuagggcaaauuu

SEQ ID NO: 159413 - RNA, 19 nt, Human
guccaggaauuauauagga

SEQ ID NO: 159414 - RNA, 24 nt, Human
gucccaauccacccgcccaggcuu

SEQ ID NO: 159415 - RNA, 23 nt, Human
guccguggcucggcccuuccucg

SEQ ID NO: 159416 - RNA, 21 nt, Human
uaacuagggcaaauuucacag

SEQ ID NO: 159417 - RNA, 18 nt, Human
uaggaagggugaagcugg

SEQ ID NO: 159418 - RNA, 19 nt, Human
uaugaaauuuuacucgaca

SEQ ID NO: 159419 - RNA, 20 nt, Human
ucaaugacuuggugguggca

SEQ ID NO: 159420 - RNA, 19 nt, Human
ucccgcgggaaacucgggg

SEQ ID NO: 159421 - RNA, 19 nt, Human
uccguggcucggcccuucc

SEQ ID NO: 159422 - RNA, 25 nt, Human
uccuccaaaacgagaaugguaguaa

SEQ ID NO: 159423 - RNA, 20 nt, Human
ucgccucugguuggccgggu

SEQ ID NO: 159424 - RNA, 19 nt, Human
ucgcggaggccacagccuc

SEQ ID NO: 159425 - RNA, 19 nt, Human
ucggccccacaguccgugg

SEQ ID NO: 159426 - RNA, 23 nt, Human
ugaagcagaaagcccuccccaca

SEQ ID NO: 159427 - RNA, 18 nt, Human
ugaagcuggccugcccaa

SEQ ID NO: 159428 - RNA, 27 nt, Human
ugauggugaagcagaaagcccuccccu

SEQ ID NO: 159429 - RNA, 20 nt, Human
ugccacacccccagguccuc

SEQ ID NO: 159430 - RNA, 18 nt, Human
uggccgggucugcgaagc

SEQ ID NO: 159431 - RNA, 23 nt, Human
uggccgggucugcgaagcucugg

SEQ ID NO: 159432 - RNA, 21 nt, Human
uggggacccagcucaagcucu

SEQ ID NO: 159433 - RNA, 23 nt, Human
ugguaguaacuagggcaaauuuc

SEQ ID NO: 159434 - RNA, 21 nt, Human
uuccaggacagaugggacgcu

SEQ ID NO: 159435 - RNA, 27 nt, Human
uuggugguggcagagauuguuuccucc

SEQ ID NO: 159436 - RNA, 22 nt, Human
aaaaccguugaaaaggaccaag

SEQ ID NO: 159437 - RNA, 22 nt, Human
aaagcaaaaugcaugacucccu

SEQ ID NO: 159438 - RNA, 20 nt, Human
cacuguguccaaagcaaaau

SEQ ID NO: 159439 - RNA, 18 nt, Human
cagaguaccagaaaaugu

SEQ ID NO: 159440 - RNA, 19 nt, Human
cagaguaccagaaaaugua

SEQ ID NO: 159441 - RNA, 19 nt, Human
gaaaaccguugaaaaggac

SEQ ID NO: 159442 - RNA, 20 nt, Human
gaacuucugaguccucaucu

SEQ ID NO: 159443 - RNA, 21 nt, Human
uaguuggaagcugaagccagg

SEQ ID NO: 159444 - RNA, 20 nt, Human
ucacuggaucugugaaaacc

SEQ ID NO: 159445 - RNA, 21 nt, Human
ucccuuuucucuucuuucaca

SEQ ID NO: 159446 - RNA, 24 nt, Human
ucccuuuucucuucuuucacagag

SEQ ID NO: 159447 - RNA, 23 nt, Human
ugaaaaccguugaaaaggaccaa

SEQ ID NO: 159448 - RNA, 18 nt, Human
ugaaaaggaccaagucug

SEQ ID NO: 159449 - RNA, 19 nt, Human
ugaacuucugacuuuauua

SEQ ID NO: 159450 - RNA, 22 nt, Human
uguaguuggaagcugaagccag

SEQ ID NO: 159451 - RNA, 24 nt, Human
uucacagaguaccagaaaauguaa

SEQ ID NO: 159452 - RNA, 22 nt, Human
aaaacaaacacagacaaacacc

SEQ ID NO: 159453 - RNA, 19 nt, Human
aaacaaacacagacaaaca

SEQ ID NO: 159454 - RNA, 25 nt, Human
aaacaaacacagacaaacaccaaac

SEQ ID NO: 159455 - RNA, 18 nt, Human
aaacacagacaaacacca

SEQ ID NO: 159456 - RNA, 23 nt, Human
aaacaccaaacauggaguuggug

SEQ ID NO: 159457 - RNA, 23 nt, Human
aaauccaagcacagaaagaccaa

SEQ ID NO: 159458 - RNA, 23 nt, Human
aacaaacacagacaaacaccaaa

SEQ ID NO: 159459 - RNA, 22 nt, Human
aacauggaguuggugcccggcg

SEQ ID NO: 159460 - RNA, 18 nt, Human
acagacaaacaccaaaca

SEQ ID NO: 159461 - RNA, 22 nt, Human
agacaaacaccaaacauggagu

SEQ ID NO: 159462 - RNA, 23 nt, Human
agacaaacaccaaacauggaguu

SEQ ID NO: 159463 - RNA, 22 nt, Human
aggggcccagcuccucggggac

SEQ ID NO: 159464 - RNA, 18 nt, Human
caaacacagacaaacacc

SEQ ID NO: 159465 - RNA, 23 nt, Human
cacagaaagaccaagcgcagacc

SEQ ID NO: 159466 - RNA, 23 nt, Human
cacagaaagaccaagcgcagacc

SEQ ID NO: 159467 - RNA, 25 nt, Human
cacagaaagaccaagcgcagacccc

SEQ ID NO: 159468 - RNA, 26 nt, Human
cacagaaagaccaagcgcagacccca

SEQ ID NO: 159469 - RNA, 19 nt, Human
cagcgggcugagccaaugc

SEQ ID NO: 159470 - RNA, 19 nt, Human
caggguggacaggccuggg

SEQ ID NO: 159471 - RNA, 19 nt, Human
caguggcacugggccggac

SEQ ID NO: 159472 - RNA, 21 nt, Human
cccaccggcaggacccuucaa

SEQ ID NO: 159473 - RNA, 22 nt, Human
cccacgggcgcacgaggcccag

SEQ ID NO: 159474 - RNA, 18 nt, Human
cccacggguggcugugcg

SEQ ID NO: 159475 - RNA, 22 nt, Human
ccccccacucagcgggcugagc

SEQ ID NO: 159476 - RNA, 24 nt, Human
ccgcagccagcaggcuuggguggc

SEQ ID NO: 159477 - RNA, 18 nt, Human
ccggcgccgggcauaagg

SEQ ID NO: 159478 - RNA, 19 nt, Human
cggcggagagggaggccgg

SEQ ID NO: 159479 - RNA, 24 nt, Human
cggcucuucacagaccaggagucu

SEQ ID NO: 159480 - RNA, 24 nt, Human
cgggcggcggugcgggcggcggag

SEQ ID NO: 159481 - RNA, 19 nt, Human
cgguggcaggcgggggcac

SEQ ID NO: 159482 - RNA, 24 nt, Human
cugacaguuacaguaaauuucaaa

SEQ ID NO: 159483 - RNA, 21 nt, Human
cuggccgagagggggccgcag

SEQ ID NO: 159484 - RNA, 19 nt, Human
cugguguccccgaggugcc

SEQ ID NO: 159485 - RNA, 24 nt, Human
gagcagcauuuuuaccaaauuggu

SEQ ID NO: 159486 - RNA, 21 nt, Human
gagucuccaagucggcagcuc

SEQ ID NO: 159487 - RNA, 24 nt, Human
gcaaauccaagcacagaaagacca

SEQ ID NO: 159488 - RNA, 19 nt, Human
gcacagaaagaccaagcgc

SEQ ID NO: 159489 - RNA, 22 nt, Human
gcacagaaagaccaagcgcaga

SEQ ID NO: 159490 - RNA, 19 nt, Human
gcccagcuccucggggacu

SEQ ID NO: 159491 - RNA, 21 nt, Human
gccgcagccagcaggcuuggg

SEQ ID NO: 159492 - RNA, 22 nt, Human
gccgcuggguguggccgggccc

SEQ ID NO: 159493 - RNA, 21 nt, Human
gcggugcgggcggcggagagc

SEQ ID NO: 159494 - RNA, 21 nt, Human
ggacuggcccacgacccccca

SEQ ID NO: 159495 - RNA, 25 nt, Human
ggagagggaggccggggccgcugcc

SEQ ID NO: 159496 - RNA, 20 nt, Human
ggcagcaccccacggguggc

SEQ ID NO: 159497 - RNA, 26 nt, Human
ggcccagcuccucggggacuggggcc

SEQ ID NO: 159498 - RNA, 21 nt, Human
ggcugugcggggggccgcugg

SEQ ID NO: 159499 - RNA, 20 nt, Human
gggcggcggugcgggcggcg

SEQ ID NO: 159500 - RNA, 21 nt, Human
gggcggcggugcgggcggcgg

SEQ ID NO: 159501 - RNA, 18 nt, Human
ggggacuggcccacgacc

SEQ ID NO: 159502 - RNA, 19 nt, Human
ggggugggguggggugggg

SEQ ID NO: 159503 - RNA, 18 nt, Human
gggugggguggggugggg

SEQ ID NO: 159504 - RNA, 18 nt, Human
gggugggguggggugggg

SEQ ID NO: 159505 - RNA, 18 nt, Human
gugcggggggccgcuggg

SEQ ID NO: 159506 - RNA, 24 nt, Human
guggggaugguggagugaccuccg

SEQ ID NO: 159507 - RNA, 27 nt, Human
uaaauuucaaaauccaagcagcaauuu

SEQ ID NO: 159508 - RNA, 22 nt, Human
uaagggcagcaccccacgggug

SEQ ID NO: 159509 - RNA, 21 nt, Human
uagcagccucggggggcagug

SEQ ID NO: 159510 - RNA, 19 nt, Human
ucccguugcauggcggggg

SEQ ID NO: 159511 - RNA, 22 nt, Human
ucuccaagucggcagcucuggu

SEQ ID NO: 159512 - RNA, 18 nt, Human
ucuucacagaccaggagu

SEQ ID NO: 159513 - RNA, 25 nt, Human
ucuugaaaaacaaacacagacaaac

SEQ ID NO: 159514 - RNA, 21 nt, Human
ugaaaaacaaacacagacaaa

SEQ ID NO: 159515 - RNA, 26 nt, Human
ugaaaaacaaacacagacaaacacca

SEQ ID NO: 159516 - RNA, 23 nt, Human
ugaaacgggguccagacguguac

SEQ ID NO: 159517 - RNA, 28 nt, Human
uggccgggcccugugugccccguacucg

SEQ ID NO: 159518 - RNA, 19 nt, Human
uggcggggguggggugggg

SEQ ID NO: 159519 - RNA, 23 nt, Human
uggcugugcggggggccgcuggg

SEQ ID NO: 159520 - RNA, 24 nt, Human
ugggaggcugagagcagcauuuuu

SEQ ID NO: 159521 - RNA, 18 nt, Human
uggugcccggcgccgggc

SEQ ID NO: 159522 - RNA, 22 nt, Human
ugugcaggggcccagcuccucg

SEQ ID NO: 159523 - RNA, 21 nt, Human
uguggccgggcccugugugcc

SEQ ID NO: 159524 - RNA, 19 nt, Human
uugugggaggcugagagca

SEQ ID NO: 159525 - RNA, 20 nt, Human
aaaaaaaagagacaggaaaa

SEQ ID NO: 159526 - RNA, 24 nt, Human
aaaagacguugggaaauggcacag

SEQ ID NO: 159527 - RNA, 20 nt, Human
aaacaaaugcacaaaauauc

SEQ ID NO: 159528 - RNA, 22 nt, Human
aaacaaaugcacaaaauaucuu

SEQ ID NO: 159529 - RNA, 23 nt, Human
aaacagguaugcagaaggucccc

SEQ ID NO: 159530 - RNA, 22 nt, Human
acuacacugaaauguacuaaca

SEQ ID NO: 159531 - RNA, 18 nt, Human
agacagaaugaaacccug

SEQ ID NO: 159532 - RNA, 19 nt, Human
agacagaaugaaacccugg

SEQ ID NO: 159533 - RNA, 18 nt, Human
aguggaaaaagacagaau

SEQ ID NO: 159534 - RNA, 18 nt, Human
auaguaaaaaaaaaaaaa

SEQ ID NO: 159535 - RNA, 19 nt, Human
auggugguuuugguucuaa

SEQ ID NO: 159536 - RNA, 19 nt, Human
auguacagcuagaaaugaa

SEQ ID NO: 159537 - RNA, 22 nt, Human
caaaauaucuuggaaaucuagu

SEQ ID NO: 159538 - RNA, 27 nt, Human
caaagaacagcgcggauuacucacauc

SEQ ID NO: 159539 - RNA, 21 nt, Human
cacuuuggggggaguugagag

SEQ ID NO: 159540 - RNA, 21 nt, Human
cagccaugcccauucggcuca

SEQ ID NO: 159541 - RNA, 18 nt, Human
cagcgcgcccccgagcag

SEQ ID NO: 159542 - RNA, 22 nt, Human
caugcccauucggcucaccaaa

SEQ ID NO: 159543 - RNA, 18 nt, Human
caugcugacaacacagga

SEQ ID NO: 159544 - RNA, 20 nt, Human
ccaaaaaaagcuuggaagca

SEQ ID NO: 159545 - RNA, 19 nt, Human
cccaaaagacguugggaaa

SEQ ID NO: 159546 - RNA, 20 nt, Human
cccaaaagacguugggaaau

SEQ ID NO: 159547 - RNA, 18 nt, Human
cccccgagcagggacggg

SEQ ID NO: 159548 - RNA, 18 nt, Human
ccccgcgcccggccgccc

SEQ ID NO: 159549 - RNA, 26 nt, Human
cccgccgucucagcgcgcccccgagc

SEQ ID NO: 159550 - RNA, 18 nt, Human
cccgcgcccucuccccgc

SEQ ID NO: 159551 - RNA, 20 nt, Human
cccugguuauaguaaaaaaa

SEQ ID NO: 159552 - RNA, 22 nt, Human
ccgaaguggcgacggcgcucuc

SEQ ID NO: 159553 - RNA, 19 nt, Human
ccucuagguucacuaaagu

SEQ ID NO: 159554 - RNA, 21 nt, Human
cgaugacaguaguugggacac

SEQ ID NO: 159555 - RNA, 20 nt, Human
cggauuacucacaucaccuc

SEQ ID NO: 159556 - RNA, 23 nt, Human
cuaaauacagcaacccauguaag

SEQ ID NO: 159557 - RNA, 26 nt, Human
cucacccgccgucucagcgcgccccc

SEQ ID NO: 159558 - RNA, 24 nt, Human
cuccuucauccuauguacagcuag

SEQ ID NO: 159559 - RNA, 18 nt, Human
cugccgcacgagccgcuc

SEQ ID NO: 159560 - RNA, 19 nt, Human
cuuuggggggaguugagag

SEQ ID NO: 159561 - RNA, 22 nt, Human
gaagcacugcugcaaagaacag

SEQ ID NO: 159562 - RNA, 21 nt, Human
gacaguaguugggacacugga

SEQ ID NO: 159563 - RNA, 20 nt, Human
ggaaucgcaaaguuggcccg

SEQ ID NO: 159564 - RNA, 22 nt, Human
gggacgggccugccggggccuc

SEQ ID NO: 159565 - RNA, 22 nt, Human
gguuauaguaaaaaaaaaaaaa

SEQ ID NO: 159566 - RNA, 20 nt, Human
uaaaaaaaaaaaaaucaggg

SEQ ID NO: 159567 - RNA, 23 nt, Human
uaaaucccaaaagacguugggaa

SEQ ID NO: 159568 - RNA, 22 nt, Human
uaacacagacagauguaaaucc

SEQ ID NO: 159569 - RNA, 23 nt, Human
uaacacagacagauguaaauccc

SEQ ID NO: 159570 - RNA, 22 nt, Human
uaagaaagacuggcuaauggua

SEQ ID NO: 159571 - RNA, 22 nt, Human
uacaagaccauugcaucacaaa

SEQ ID NO: 159572 - RNA, 24 nt, Human
uacacugaaauguacuaacaaaau

SEQ ID NO: 159573 - RNA, 23 nt, Human
uacagacacuauaaaaacugugu

SEQ ID NO: 159574 - RNA, 22 nt, Human
uacagcaacccauguaagacau

SEQ ID NO: 159575 - RNA, 21 nt, Human
uauaaaaacugugucauggug

SEQ ID NO: 159576 - RNA, 23 nt, Human
ucacacuucaguggaaaaagaca

SEQ ID NO: 159577 - RNA, 19 nt, Human
ucaguggaaaaagacagaa

SEQ ID NO: 159578 - RNA, 20 nt, Human
ucaguggaaaaagacagaaa

SEQ ID NO: 159579 - RNA, 18 nt, Human
uccccgcgcccggccgcc

SEQ ID NO: 159580 - RNA, 21 nt, Human
uccccgcgcccggccgcccag

SEQ ID NO: 159581 - RNA, 22 nt, Human
ucccgcgcccucuccccgcgcc

SEQ ID NO: 159582 - RNA, 24 nt, Human
ucuaaauacagcaacccauguaag

SEQ ID NO: 159583 - RNA, 21 nt, Human
ugaaacaaaugcacaaaauau

SEQ ID NO: 159584 - RNA, 25 nt, Human
ugacaguaguugggacacuggaaau

SEQ ID NO: 159585 - RNA, 24 nt, Human
uggaaaaagacagaaugaaacccu

SEQ ID NO: 159586 - RNA, 19 nt, Human
uggaagcacugcugcaaag

SEQ ID NO: 159587 - RNA, 21 nt, Human
uggaagcacugcugcaaagaa

SEQ ID NO: 159588 - RNA, 23 nt, Human
uggaagcacugcugcaaagaaca

SEQ ID NO: 159589 - RNA, 19 nt, Human
uggcccgaaguggcgacgg

SEQ ID NO: 159590 - RNA, 19 nt, Human
uggcgacggcgcucucgug

SEQ ID NO: 159591 - RNA, 22 nt, Human
uuaaaacuaugaaaaaucaaau

SEQ ID NO: 159592 - RNA, 22 nt, Human
uuauaguaaaaaaaaaaaaauc

SEQ ID NO: 159593 - RNA, 24 nt, Human
uugguucuaaacagguaugcagaa

SEQ ID NO: 159594 - RNA, 25 nt, Human
uuuacaaaaaaaagagacaggaaaa

SEQ ID NO: 159595 - RNA, 21 nt, Human
aaccugccugccuccaaaaug

SEQ ID NO: 159596 - RNA, 18 nt, Human
aaggcuccacugcucuuc

SEQ ID NO: 159597 - RNA, 20 nt, Human
acaacacauaugaaaaggca

SEQ ID NO: 159598 - RNA, 23 nt, Human
acacagccacaaaccacucacac

SEQ ID NO: 159599 - RNA, 18 nt, Human
accugccugccuccaaaa

SEQ ID NO: 159600 - RNA, 19 nt, Human
accugccugccuccaaaau

SEQ ID NO: 159601 - RNA, 23 nt, Human
acgcagcccucuagagcuccucu

SEQ ID NO: 159602 - RNA, 26 nt, Human
acuuuauuguuaaaaaaaaaaaugac

SEQ ID NO: 159603 - RNA, 22 nt, Human
agacaggaagaaauaagccaag

SEQ ID NO: 159604 - RNA, 26 nt, Human
agacaggaagaaauaagccaagucca

SEQ ID NO: 159605 - RNA, 20 nt, Human
agcagcccugugggcaaggc

SEQ ID NO: 159606 - RNA, 27 nt, Human
agcgggaccucuggggcccgaggccug

SEQ ID NO: 159607 - RNA, 20 nt, Human
aggcaggggcagaggggacu

SEQ ID NO: 159608 - RNA, 21 nt, Human
aggcccugacuggcagccagu

SEQ ID NO: 159609 - RNA, 19 nt, Human
aggguugagucgcugcagg

SEQ ID NO: 159610 - RNA, 24 nt, Human
aggucaccaaaggccacagaggcu

SEQ ID NO: 159611 - RNA, 24 nt, Human
aucaccauuuucuccccggugcaa

SEQ ID NO: 159612 - RNA, 21 nt, Human
caacacauaugaaaaggcagu

SEQ ID NO: 159613 - RNA, 25 nt, Human
cacaaaccacucacacaaauuggcu

SEQ ID NO: 159614 - RNA, 22 nt, Human
cacacacacagccacaaaccac

SEQ ID NO: 159615 - RNA, 18 nt, Human
cacacacagccacaaacc

SEQ ID NO: 159616 - RNA, 24 nt, Human
cacagccacaaaccacucacacaa

SEQ ID NO: 159617 - RNA, 19 nt, Human
cacagugccugacguggag

SEQ ID NO: 159618 - RNA, 26 nt, Human
cacucaacucacccccuacgagacag

SEQ ID NO: 159619 - RNA, 24 nt, Human
cacugcgguccagcucccugcuuc

SEQ ID NO: 159620 - RNA, 21 nt, Human
caggagucaauuguuccuggu

SEQ ID NO: 159621 - RNA, 21 nt, Human
caggcuuugccccggggacug

SEQ ID NO: 159622 - RNA, 21 nt, Human
caguggaccagagggagggac

SEQ ID NO: 159623 - RNA, 20 nt, Human
caugggcacccacaugugua

SEQ ID NO: 159624 - RNA, 18 nt, Human
cauguguagacaugugcc

SEQ ID NO: 159625 - RNA, 25 nt, Human
ccaaccggcccuaaauaggaguuca

SEQ ID NO: 159626 - RNA, 21 nt, Human
ccacaaaccacucacacaaau

SEQ ID NO: 159627 - RNA, 22 nt, Human
ccacauugacccuccaugcaua

SEQ ID NO: 159628 - RNA, 21 nt, Human
ccagccacacucaacucaccc

SEQ ID NO: 159629 - RNA, 23 nt, Human
cccccuacgagacaggaagaaau

SEQ ID NO: 159630 - RNA, 22 nt, Human
cccgccugccuugcucugggaa

SEQ ID NO: 159631 - RNA, 20 nt, Human
cccuccaucaccauuuucuc

SEQ ID NO: 159632 - RNA, 24 nt, Human
ccuccaucaccauuuucuccccgg

SEQ ID NO: 159633 - RNA, 18 nt, Human
cgagacaggaagaaauaa

SEQ ID NO: 159634 - RNA, 22 nt, Human
cgagacaggaagaaauaagcca

SEQ ID NO: 159635 - RNA, 27 nt, Human
cgagacaggaagaaauaagccaagucc

SEQ ID NO: 159636 - RNA, 23 nt, Human
cggcagaucagggagcccuccuc

SEQ ID NO: 159637 - RNA, 25 nt, Human
cuacauacacucuacacauguguac

SEQ ID NO: 159638 - RNA, 18 nt, Human
cucacagucacacacaca

SEQ ID NO: 159639 - RNA, 27 nt, Human
cucacagucacacacacagccacaaac

SEQ ID NO: 159640 - RNA, 20 nt, Human
cuccacugcucuuccuuuug

SEQ ID NO: 159641 - RNA, 28 nt, Human
cuccaucaccauuuucuccccggugcaa

SEQ ID NO: 159642 - RNA, 23 nt, Human
cucccagccacacucaacucacc

SEQ ID NO: 159643 - RNA, 19 nt, Human
cucggaguccuuguugccc

SEQ ID NO: 159644 - RNA, 26 nt, Human
cucucccagccacacucaacucaccc

SEQ ID NO: 159645 - RNA, 20 nt, Human
cucuguacggcccgcguagu

SEQ ID NO: 159646 - RNA, 21 nt, Human
cugcaguggagaggaggcaau

SEQ ID NO: 159647 - RNA, 22 nt, Human
cugguggugcuccucggagucc

SEQ ID NO: 159648 - RNA, 18 nt, Human
cuugacaaagacacagug

SEQ ID NO: 159649 - RNA, 18 nt, Human
gacaacagccugggcuga

SEQ ID NO: 159650 - RNA, 18 nt, Human
gaguccuuguugcccucc

SEQ ID NO: 159651 - RNA, 21 nt, Human
gcaccaaccugccugccucca

SEQ ID NO: 159652 - RNA, 22 nt, Human
gcagccaguggugugacucuga

SEQ ID NO: 159653 - RNA, 21 nt, Human
gcaguggagaggaggcaaugg

SEQ ID NO: 159654 - RNA, 21 nt, Human
ggacacugcgguccagcuccc

SEQ ID NO: 159655 - RNA, 21 nt, Human
ggacugggugggagggagugg

SEQ ID NO: 159656 - RNA, 26 nt, Human
ggagggacugggugggagggaguggg

SEQ ID NO: 159657 - RNA, 19 nt, Human
ggcaaggcuccacugcucu

SEQ ID NO: 159658 - RNA, 21 nt, Human
ggcagguguccagccuggaca

SEQ ID NO: 159659 - RNA, 23 nt, Human
gggugggagggaguggugagguc

SEQ ID NO: 159660 - RNA, 18 nt, Human
gucaggcaccaaccugcc

SEQ ID NO: 159661 - RNA, 18 nt, Human
gugggcccguuccucugc

SEQ ID NO: 159662 - RNA, 20 nt, Human
guguaggcugaggagcggga

SEQ ID NO: 159663 - RNA, 20 nt, Human
guugcccuccaucaccauuu

SEQ ID NO: 159664 - RNA, 24 nt, Human
uacgagacaggaagaaauaagcca

SEQ ID NO: 159665 - RNA, 20 nt, Human
uacuugaugggcaggcgucu

SEQ ID NO: 159666 - RNA, 20 nt, Human
uaggaguucagacuuccuug

SEQ ID NO: 159667 - RNA, 24 nt, Human
ucaaaaagugccuaagaauuuuua

SEQ ID NO: 159668 - RNA, 19 nt, Human
uccagggucacugcucuag

SEQ ID NO: 159669 - RNA, 18 nt, Human
uccaugaggucugaauuc

SEQ ID NO: 159670 - RNA, 24 nt, Human
uccaugggcacccacauguguaga

SEQ ID NO: 159671 - RNA, 21 nt, Human
ucccagccacacucaacucac

SEQ ID NO: 159672 - RNA, 18 nt, Human
uccucagcuucccuccac

SEQ ID NO: 159673 - RNA, 22 nt, Human
uccuuuggccaaaagugccugg

SEQ ID NO: 159674 - RNA, 22 nt, Human
ucuagaaaugccccucuccugg

SEQ ID NO: 159675 - RNA, 21 nt, Human
ucucccagccacacucaacuc

SEQ ID NO: 159676 - RNA, 23 nt, Human
ucugaggugggcccguuccucug

SEQ ID NO: 159677 - RNA, 22 nt, Human
ugaagaauuaguuccuuccuuc

SEQ ID NO: 159678 - RNA, 21 nt, Human
ugaggcaggggcagaggggac

SEQ ID NO: 159679 - RNA, 23 nt, Human
ugccugggaaacuugggaugaag

SEQ ID NO: 159680 - RNA, 27 nt, Human
ugcucuuccuuuugacuucugucucca

SEQ ID NO: 159681 - RNA, 20 nt, Human
ugcuuccaaccggcccuaaa

SEQ ID NO: 159682 - RNA, 24 nt, Human
uggaagagcacauuucaagggaca

SEQ ID NO: 159683 - RNA, 20 nt, Human
uggagaggaggcaauggcag

SEQ ID NO: 159684 - RNA, 23 nt, Human
uggagcagacacuugacaaagac

SEQ ID NO: 159685 - RNA, 19 nt, Human
uggcaggcccugacuggca

SEQ ID NO: 159686 - RNA, 23 nt, Human
uggcaggcccugacuggcagcca

SEQ ID NO: 159687 - RNA, 20 nt, Human
uggcagguguccagccugga

SEQ ID NO: 159688 - RNA, 19 nt, Human
ugggaugaagaacccagag

SEQ ID NO: 159689 - RNA, 23 nt, Human
ugguccccaccacuccuggcuac

SEQ ID NO: 159690 - RNA, 18 nt, Human
ugguuuuccagggucacu

SEQ ID NO: 159691 - RNA, 20 nt, Human
uguagacuccuggcaggccc

SEQ ID NO: 159692 - RNA, 22 nt, Human
ugugcccgcuccccugcugcuc

SEQ ID NO: 159693 - RNA, 23 nt, Human
uguguacacacguacuauccaug

SEQ ID NO: 159694 - RNA, 21 nt, Human
uucagagcuguguagacuccu

SEQ ID NO: 159695 - RNA, 26 nt, Human
uuccagggucacugcucuagaaaugc

SEQ ID NO: 159696 - RNA, 19 nt, Human
uuuaacaaagaagguucag

SEQ ID NO: 159697 - RNA, 19 nt, Human
uuucaagggacaacagccu

SEQ ID NO: 159698 - RNA, 21 nt, Human
aaguggcuuuuuuauuagaga

SEQ ID NO: 159699 - RNA, 23 nt, Human
aaguggcuuuuuuauuagagaag

SEQ ID NO: 159700 - RNA, 19 nt, Human
agaaagaggaagaagcgag

SEQ ID NO: 159701 - RNA, 19 nt, Human
agaggaagaagcgagggcg

SEQ ID NO: 159702 - RNA, 21 nt, Human
ccgcgaagauggagucgagaa

SEQ ID NO: 159703 - RNA, 19 nt, Human
gaagauggagucgagaaag

SEQ ID NO: 159704 - RNA, 18 nt, Human
uuuuuuuuuuuuuuuuug

SEQ ID NO: 159705 - RNA, 19 nt, Human
aaacaccgaaaauacaucg

SEQ ID NO: 159706 - RNA, 22 nt, Human
aaagagccuggcuaguggggac

SEQ ID NO: 159707 - RNA, 23 nt, Human
acaacacaaugggguaaaugcuc

SEQ ID NO: 159708 - RNA, 26 nt, Human
acagcucaaagggugggcagaggcca

SEQ ID NO: 159709 - RNA, 25 nt, Human
acaugcuaaagccacaagaaggcaa

SEQ ID NO: 159710 - RNA, 19 nt, Human
accacagucacuggcagca

SEQ ID NO: 159711 - RNA, 19 nt, Human
agacacaaucccugcccuc

SEQ ID NO: 159712 - RNA, 21 nt, Human
agacaguggcaagggccgugg

SEQ ID NO: 159713 - RNA, 21 nt, Human
aggagaauggcagucugcagg

SEQ ID NO: 159714 - RNA, 19 nt, Human
aggcuccugggcugcaucu

SEQ ID NO: 159715 - RNA, 22 nt, Human
augagcaagguuuucaaccaaa

SEQ ID NO: 159716 - RNA, 19 nt, Human
cacaacacaaugggguaaa

SEQ ID NO: 159717 - RNA, 21 nt, Human
cagacacaaucccugcccuca

SEQ ID NO: 159718 - RNA, 21 nt, Human
cagcauggcacaugcuaaagc

SEQ ID NO: 159719 - RNA, 22 nt, Human
cagccacaacacaaugggguaa

SEQ ID NO: 159720 - RNA, 18 nt, Human
ccguggggaaaagggcuc

SEQ ID NO: 159721 - RNA, 24 nt, Human
ccuaacauuaaaaaagucugaggg

SEQ ID NO: 159722 - RNA, 19 nt, Human
ccucaaagagccuggcuag

SEQ ID NO: 159723 - RNA, 23 nt, Human
ccucccaugccauuccaaggagg

SEQ ID NO: 159724 - RNA, 19 nt, Human
cucaaagggugggcagagg

SEQ ID NO: 159725 - RNA, 22 nt, Human
cucaggcuaacugcacugagga

SEQ ID NO: 159726 - RNA, 21 nt, Human
cugcucagcgcaaggugugga

SEQ ID NO: 159727 - RNA, 22 nt, Human
cuggcagcaaugauuuggccuu

SEQ ID NO: 159728 - RNA, 21 nt, Human
cuggcucagcuugauacaugu

SEQ ID NO: 159729 - RNA, 24 nt, Human
cugggcucauuuuuuaaacaccga

SEQ ID NO: 159730 - RNA, 19 nt, Human
gaaaagacaaccauggaag

SEQ ID NO: 159731 - RNA, 23 nt, Human
gaggcaccuggggccaggggagc

SEQ ID NO: 159732 - RNA, 20 nt, Human
gaggcuggugcaaaccuggc

SEQ ID NO: 159733 - RNA, 22 nt, Human
gcacaugcuaaagccacaagaa

SEQ ID NO: 159734 - RNA, 18 nt, Human
gcagucugcagggggaca

SEQ ID NO: 159735 - RNA, 25 nt, Human
gcuucaucugcugggaaaagacaac

SEQ ID NO: 159736 - RNA, 18 nt, Human
gggaaaagacaaccaugg

SEQ ID NO: 159737 - RNA, 21 nt, Human
gggagacucgaggcuggugca

SEQ ID NO: 159738 - RNA, 20 nt, Human
ggggccaggggagcucaggc

SEQ ID NO: 159739 - RNA, 21 nt, Human
ggguauaaacaaguacagacc

SEQ ID NO: 159740 - RNA, 23 nt, Human
uaaaaaaugagcaagguuuucaa

SEQ ID NO: 159741 - RNA, 18 nt, Human
uaaacaaguacagaccac

SEQ ID NO: 159742 - RNA, 26 nt, Human
uaaccagacacaaucccugcccucaa

SEQ ID NO: 159743 - RNA, 25 nt, Human
ucacuggcagcaaugauuuggccug

SEQ ID NO: 159744 - RNA, 19 nt, Human
ucagagaggcuccugggcu

SEQ ID NO: 159745 - RNA, 18 nt, Human
ucaggccaggccucccau

SEQ ID NO: 159746 - RNA, 21 nt, Human
ucugauggaggcaccuggggc

SEQ ID NO: 159747 - RNA, 24 nt, Human
ugagcugggguggggcagguacag

SEQ ID NO: 159748 - RNA, 19 nt, Human
ugauggaggcaccuggggc

SEQ ID NO: 159749 - RNA, 19 nt, Human
ugcugggaaaagacaacca

SEQ ID NO: 159750 - RNA, 19 nt, Human
uggcacaaucacagcugcu

SEQ ID NO: 159751 - RNA, 21 nt, Human
uggcacaaucacagcugcuca

SEQ ID NO: 159752 - RNA, 19 nt, Human
uggcacaugcuaaagccac

SEQ ID NO: 159753 - RNA, 19 nt, Human
uggcagcaaugauuuggcc

SEQ ID NO: 159754 - RNA, 23 nt, Human
uggcagcaaugauuuggccugga

SEQ ID NO: 159755 - RNA, 18 nt, Human
ugggaaaagacaaccaug

SEQ ID NO: 159756 - RNA, 19 nt, Human
ugggaaaagacaaccaugg

SEQ ID NO: 159757 - RNA, 21 nt, Human
ugggcagaggccagaucaggc

SEQ ID NO: 159758 - RNA, 21 nt, Human
ugggguggggcagguacagcu

SEQ ID NO: 159759 - RNA, 22 nt, Human
ugggguggggcagguacagcuc

SEQ ID NO: 159760 - RNA, 19 nt, Human
uucagggaagggcaagccu

SEQ ID NO: 159761 - RNA, 20 nt, Human
uucaucuggcucagcuugau

SEQ ID NO: 159762 - RNA, 20 nt, Human
uuuacugagcuccuucuuca

SEQ ID NO: 159763 - RNA, 20 nt, Human
acauguacuacuuuauaguu

SEQ ID NO: 159764 - RNA, 29 nt, Human
acccgcagguggcccgugcuggcaccacg

SEQ ID NO: 159765 - RNA, 22 nt, Human
acguuuggggacgggucaucca

SEQ ID NO: 159766 - RNA, 23 nt, Human
caagcuuccacuuggugccuaca

SEQ ID NO: 159767 - RNA, 18 nt, Human
cacccagccucacccaca

SEQ ID NO: 159768 - RNA, 22 nt, Human
cacccagccucacccacagggc

SEQ ID NO: 159769 - RNA, 24 nt, Human
cacccagccucacccacagggcac

SEQ ID NO: 159770 - RNA, 19 nt, Human
cagcccaggacgguccccu

SEQ ID NO: 159771 - RNA, 18 nt, Human
caggacgguccccucucc

SEQ ID NO: 159772 - RNA, 25 nt, Human
ccacaauagugacccagucccuccc

SEQ ID NO: 159773 - RNA, 20 nt, Human
ccagaggaguccaagagccc

SEQ ID NO: 159774 - RNA, 21 nt, Human
cccgcagguggcccgugcugg

SEQ ID NO: 159775 - RNA, 21 nt, Human
ccucaggucaucacccagccu

SEQ ID NO: 159776 - RNA, 24 nt, Human
ccuccugcggggcagaggaggggu

SEQ ID NO: 159777 - RNA, 22 nt, Human
ccugcggggcagaggagggguc

SEQ ID NO: 159778 - RNA, 22 nt, Human
ccuguaagacccgcggggcacu

SEQ ID NO: 159779 - RNA, 22 nt, Human
cgcaccaccugccguggaacuu

SEQ ID NO: 159780 - RNA, 19 nt, Human
cgccacggccguggcccac

SEQ ID NO: 159781 - RNA, 20 nt, Human
cuggcugcgccacacccgca

SEQ ID NO: 159782 - RNA, 22 nt, Human
gcagugugagcccuggcugcgc

SEQ ID NO: 159783 - RNA, 23 nt, Human
gccagcccaggacgguccccucu

SEQ ID NO: 159784 - RNA, 18 nt, Human
gcgccacacccgcaggug

SEQ ID NO: 159785 - RNA, 24 nt, Human
gcggggcagaggagggguccagaa

SEQ ID NO: 159786 - RNA, 22 nt, Human
gggcagaggagggguccggggg

SEQ ID NO: 159787 - RNA, 20 nt, Human
gguccagaagccacaggagu

SEQ ID NO: 159788 - RNA, 19 nt, Human
guccagaagccacaggagu

SEQ ID NO: 159789 - RNA, 18 nt, Human
gugucucugguccucagg

SEQ ID NO: 159790 - RNA, 21 nt, Human
ucaacguuuggggacggguca

SEQ ID NO: 159791 - RNA, 23 nt, Human
uccaagagccccaacauggucgc

SEQ ID NO: 159792 - RNA, 20 nt, Human
uccucaggucaucacccagc

SEQ ID NO: 159793 - RNA, 22 nt, Human
ucuccuguaagacccgcggggc

SEQ ID NO: 159794 - RNA, 20 nt, Human
ugcaagcuuccacuuggugc

SEQ ID NO: 159795 - RNA, 25 nt, Human
ugccguggaacuuccuccugcgggg

SEQ ID NO: 159796 - RNA, 21 nt, Human
uuaaaaaagaaaagaaguuaa

SEQ ID NO: 159797 - RNA, 25 nt, Human
uuuuauauaauguacauguacuacu

SEQ ID NO: 159798 - RNA, 20 nt, Human
uuuuuuuuuuuaaagggacc

SEQ ID NO: 159799 - RNA, 20 nt, Human
aaaaagcaaacuagcuacuc

SEQ ID NO: 159800 - RNA, 24 nt, Human
aaaauacucaaaaugaacaagaca

SEQ ID NO: 159801 - RNA, 24 nt, Human
aacacugggcuaaaauggagagga

SEQ ID NO: 159802 - RNA, 23 nt, Human
aagcucgcgggcgggacccccgg

SEQ ID NO: 159803 - RNA, 23 nt, Human
acugaaggccuugaaaauucacc

SEQ ID NO: 159804 - RNA, 18 nt, Human
agcgucggaggcuccagc

SEQ ID NO: 159805 - RNA, 20 nt, Human
agcuacucccaggguucccc

SEQ ID NO: 159806 - RNA, 24 nt, Human
aggagacuggguuugggaagacag

SEQ ID NO: 159807 - RNA, 21 nt, Human
aguaacacagugagagaagga

SEQ ID NO: 159808 - RNA, 24 nt, Human
aguaacacagugagagaaggagug

SEQ ID NO: 159809 - RNA, 19 nt, Human
agucaggaagucggggcug

SEQ ID NO: 159810 - RNA, 22 nt, Human
cacagugagagaaggaguggaa

SEQ ID NO: 159811 - RNA, 20 nt, Human
caccaacaaucuucuaucag

SEQ ID NO: 159812 - RNA, 25 nt, Human
cacugggcuaaaauggagaggagac

SEQ ID NO: 159813 - RNA, 21 nt, Human
caggguuccccgccagcuccc

SEQ ID NO: 159814 - RNA, 18 nt, Human
cagugcucggcgcuggga

SEQ ID NO: 159815 - RNA, 22 nt, Human
ccaauuggguaaaaauucuaaa

SEQ ID NO: 159816 - RNA, 24 nt, Human
ccaggguuccccgccagcucccgg

SEQ ID NO: 159817 - RNA, 23 nt, Human
cccccggaggagcucgggcacgu

SEQ ID NO: 159818 - RNA, 23 nt, Human
cccgccagcucccgggucuuugc

SEQ ID NO: 159819 - RNA, 18 nt, Human
cccuucgauccugcugug

SEQ ID NO: 159820 - RNA, 22 nt, Human
ccgcgcucggcugcgagcgccc

SEQ ID NO: 159821 - RNA, 19 nt, Human
ccgggucuuugcaaagcag

SEQ ID NO: 159822 - RNA, 18 nt, Human
ccucucuucuccuguccc

SEQ ID NO: 159823 - RNA, 21 nt, Human
cucaaaaugaacaagacagaa

SEQ ID NO: 159824 - RNA, 18 nt, Human
cuccugucccuuggugcc

SEQ ID NO: 159825 - RNA, 25 nt, Human
cucggcgcugggaggagagcccuuc

SEQ ID NO: 159826 - RNA, 19 nt, Human
cucugggcccucggggcuc

SEQ ID NO: 159827 - RNA, 20 nt, Human
cuuagcccucuucaguaauc

SEQ ID NO: 159828 - RNA, 20 nt, Human
cuucauuuucuaaguauguu

SEQ ID NO: 159829 - RNA, 20 nt, Human
gaacauagacucagaccccc

SEQ ID NO: 159830 - RNA, 20 nt, Human
gccuugaaaauucaccaaca

SEQ ID NO: 159831 - RNA, 19 nt, Human
gcgaggaggagaugcgaag

SEQ ID NO: 159832 - RNA, 19 nt, Human
gcgcaagcaccugguuuug

SEQ ID NO: 159833 - RNA, 22 nt, Human
gcgucugccagggcccagugcu

SEQ ID NO: 159834 - RNA, 21 nt, Human
gcuaaaauggagaggagacug

SEQ ID NO: 159835 - RNA, 26 nt, Human
ggagaccucugcauuccaauccaauu

SEQ ID NO: 159836 - RNA, 20 nt, Human
gggcgggacccccggaggag

SEQ ID NO: 159837 - RNA, 21 nt, Human
uaaaaauacucaaaaugaaca

SEQ ID NO: 159838 - RNA, 18 nt, Human
uagcaugugucugaaggc

SEQ ID NO: 159839 - RNA, 19 nt, Human
ucagauuacagcgcucacc

SEQ ID NO: 159840 - RNA, 19 nt, Human
uccccgccagcucccgggu

SEQ ID NO: 159841 - RNA, 21 nt, Human
ucucuaaaaacccuucgaucc

SEQ ID NO: 159842 - RNA, 20 nt, Human
ucuguuauuuccucucuucu

SEQ ID NO: 159843 - RNA, 21 nt, Human
ucuucggggaaacguucagca

SEQ ID NO: 159844 - RNA, 23 nt, Human
ugaacaagacagaauuaaaccgu

SEQ ID NO: 159845 - RNA, 18 nt, Human
ugaacauagacucagacc

SEQ ID NO: 159846 - RNA, 23 nt, Human
ugaagaagugacagcaagcuguu

SEQ ID NO: 159847 - RNA, 20 nt, Human
ugccagggcccagugcucgg

SEQ ID NO: 159848 - RNA, 20 nt, Human
uggaagaggugaagaaguga

SEQ ID NO: 159849 - RNA, 20 nt, Human
ugggaagacagaacauagca

SEQ ID NO: 159850 - RNA, 21 nt, Human
ugggcccucggggcucgcggg

SEQ ID NO: 159851 - RNA, 19 nt, Human
ugguugaaaauaccaggca

SEQ ID NO: 159852 - RNA, 18 nt, Human
ugucauaggaacuggggg

SEQ ID NO: 159853 - RNA, 21 nt, Human
uguuaaacaaugcaaaugggg

SEQ ID NO: 159854 - RNA, 24 nt, Human
uguuuacauagccuucucugugua

SEQ ID NO: 159855 - RNA, 24 nt, Human
uucaccaacaaucuucuaucaggg

SEQ ID NO: 159856 - RNA, 25 nt, Human
uucaccaacaaucuucuaucagggg

SEQ ID NO: 159857 - RNA, 20 nt, Human
uuuaugguugaaaauaccag

SEQ ID NO: 159858 - RNA, 21 nt, Human
uuuccucucuucuccuguccc

SEQ ID NO: 159859 - RNA, 20 nt, Human
uuuuuuuuuuuuuuuucucu

SEQ ID NO: 159860 - RNA, 24 nt, Human
aaauuaaugaaguauuggaacuga

SEQ ID NO: 159861 - RNA, 18 nt, Human
aagugguuguuuugaacu

SEQ ID NO: 159862 - RNA, 18 nt, Human
agggcauuauuauucuag

SEQ ID NO: 159863 - RNA, 25 nt, Human
aguauacacacacuuaauuuacaug

SEQ ID NO: 159864 - RNA, 23 nt, Human
caaacccucacauuaagggcauu

SEQ ID NO: 159865 - RNA, 23 nt, Human
caagucuuuggucuuaauaagca

SEQ ID NO: 159866 - RNA, 23 nt, Human
cagcauaaauggccaacccccaa

SEQ ID NO: 159867 - RNA, 28 nt, Human
caguauacacacacuuaauuuacaugua

SEQ ID NO: 159868 - RNA, 23 nt, Human
cauucccguacguuugcuggaag

SEQ ID NO: 159869 - RNA, 28 nt, Human
ccccuuguugacaggaaugaccgagggu

SEQ ID NO: 159870 - RNA, 23 nt, Human
cccgccgccucuugccgcgcccg

SEQ ID NO: 159871 - RNA, 21 nt, Human
ccgccgccucuugccgcgccc

SEQ ID NO: 159872 - RNA, 19 nt, Human
ccgcugcgcccugaagcgc

SEQ ID NO: 159873 - RNA, 23 nt, Human
cgcccggggcucggucugcggcc

SEQ ID NO: 159874 - RNA, 18 nt, Human
cgccggggucccgcuauc

SEQ ID NO: 159875 - RNA, 19 nt, Human
cggggcucggucugcggcc

SEQ ID NO: 159876 - RNA, 20 nt, Human
cuaggguagucaccuguacc

SEQ ID NO: 159877 - RNA, 20 nt, Human
cugaagcgcaccgcgccgcc

SEQ ID NO: 159878 - RNA, 21 nt, Human
cugcggccgccgcugcgcccu

SEQ ID NO: 159879 - RNA, 21 nt, Human
cuggccacugaggcuguuucc

SEQ ID NO: 159880 - RNA, 22 nt, Human
cuggugauccucuggccacuga

SEQ ID NO: 159881 - RNA, 21 nt, Human
gcgcccggggcucggucugcg

SEQ ID NO: 159882 - RNA, 23 nt, Human
gcugugaugaaggaugcacuggu

SEQ ID NO: 159883 - RNA, 21 nt, Human
ggcucggucugcggccgccgc

SEQ ID NO: 159884 - RNA, 28 nt, Human
uaaauggacaaccuaguacuguaaugac

SEQ ID NO: 159885 - RNA, 21 nt, Human
uaacugagauaagcuacugaa

SEQ ID NO: 159886 - RNA, 22 nt, Human
uacacacaugagaagccugaga

SEQ ID NO: 159887 - RNA, 19 nt, Human
uacauuuaacaagucuuug

SEQ ID NO: 159888 - RNA, 19 nt, Human
uacugaacuaacuuugguu

SEQ ID NO: 159889 - RNA, 23 nt, Human
uagcacgauuacaguauacacac

SEQ ID NO: 159890 - RNA, 18 nt, Human
uaugaugauucugauugg

SEQ ID NO: 159891 - RNA, 25 nt, Human
ucuuuggucuuaauaagcaccauuu

SEQ ID NO: 159892 - RNA, 18 nt, Human
ugaaagcacauucccgua

SEQ ID NO: 159893 - RNA, 19 nt, Human
ugaagcgcaccgcgccgcc

SEQ ID NO: 159894 - RNA, 20 nt, Human
ugaagcgcaccgcgccgccu

SEQ ID NO: 159895 - RNA, 24 nt, Human
ugagaagccugagaaagugguugu

SEQ ID NO: 159896 - RNA, 20 nt, Human
ugauaugaugauucugauug

SEQ ID NO: 159897 - RNA, 23 nt, Human
ugauaugaugauucugauugggg

SEQ ID NO: 159898 - RNA, 23 nt, Human
uggccaacccccaauggaaauac

SEQ ID NO: 159899 - RNA, 20 nt, Human
uguacauauuacagugcauu

SEQ ID NO: 159900 - RNA, 20 nt, Human
uguauacauuuaacaagucu

SEQ ID NO: 159901 - RNA, 18 nt, Human
uuaauuauuuggucucug

SEQ ID NO: 159902 - RNA, 24 nt, Human
uucuaaguuguguacauauuacag

SEQ ID NO: 159903 - RNA, 21 nt, Human
uucuaguuuauaaauguuuca

SEQ ID NO: 159904 - RNA, 21 nt, Human
uugcaaaaaauagaguagucc

SEQ ID NO: 159905 - RNA, 23 nt, Human
aaaaaaaaauggguuuaaaacaa

SEQ ID NO: 159906 - RNA, 18 nt, Human
aagacagcacgaaacacc

SEQ ID NO: 159907 - RNA, 23 nt, Human
aauccugaaauaacuugaacaua

SEQ ID NO: 159908 - RNA, 26 nt, Human
aauggguuuaaaacaacaacaacaac

SEQ ID NO: 159909 - RNA, 19 nt, Human
acagcacgaaacaccacag

SEQ ID NO: 159910 - RNA, 22 nt, Human
acaguauuaaugaaaauucuaa

SEQ ID NO: 159911 - RNA, 18 nt, Human
accaggagccugcaugug

SEQ ID NO: 159912 - RNA, 21 nt, Human
acgaaacaccacagaaugcca

SEQ ID NO: 159913 - RNA, 28 nt, Human
agcaaaauacccaaaguguuacagacug

SEQ ID NO: 159914 - RNA, 31 nt, Human
aggcauaugguguauaacuacaguauuaauu

SEQ ID NO: 159915 - RNA, 22 nt, Human
auacaguacgguuuggccugca

SEQ ID NO: 159916 - RNA, 19 nt, Human
caaaucuuuggccauacca

SEQ ID NO: 159917 - RNA, 24 nt, Human
caaaucuuuggccauaccagaguc

SEQ ID NO: 159918 - RNA, 23 nt, Human
caccucuaaaaaaaauagcucaa

SEQ ID NO: 159919 - RNA, 22 nt, Human
cagcacgaaacaccacagaaug

SEQ ID NO: 159920 - RNA, 22 nt, Human
cagcgcacccuggguaagaauu

SEQ ID NO: 159921 - RNA, 22 nt, Human
cauaccagagucuaaauuaucc

SEQ ID NO: 159922 - RNA, 24 nt, Human
ccaaaguguuacagacugcuaaca

SEQ ID NO: 159923 - RNA, 19 nt, Human
ccagagucuaaauuauccc

SEQ ID NO: 159924 - RNA, 18 nt, Human
ccucuuuaaaauuagucc

SEQ ID NO: 159925 - RNA, 19 nt, Human
cgaaacaccacagaaugcc

SEQ ID NO: 159926 - RNA, 23 nt, Human
cuaagacagggaggaaagaaaca

SEQ ID NO: 159927 - RNA, 27 nt, Human
cugcccgauucagcucuguguggcuuu

SEQ ID NO: 159928 - RNA, 20 nt, Human
gaaacaccacagaaugccag

SEQ ID NO: 159929 - RNA, 25 nt, Human
gcaauccugaaauaacuugaacaua

SEQ ID NO: 159930 - RNA, 22 nt, Human
gcaccucuaaaaaaaauagcuc

SEQ ID NO: 159931 - RNA, 20 nt, Human
gcucuuaauagcacauccug

SEQ ID NO: 159932 - RNA, 18 nt, Human
ggccauaccagagucuaa

SEQ ID NO: 159933 - RNA, 30 nt, Human
gucacaaaugagcugcuuuggcuucgaucu

SEQ ID NO: 159934 - RNA, 18 nt, Human
guuucuuuuaauauauuu

SEQ ID NO: 159935 - RNA, 21 nt, Human
uaaaacaacaacaacaacaua

SEQ ID NO: 159936 - RNA, 21 nt, Human
uaacaggaaaaaaaaaaaaaa

SEQ ID NO: 159937 - RNA, 19 nt, Human
uaagacagcacgaaacacc

SEQ ID NO: 159938 - RNA, 25 nt, Human
uagcaacuauagcaaaauacccaaa

SEQ ID NO: 159939 - RNA, 18 nt, Human
uaugagaaggaaauacag

SEQ ID NO: 159940 - RNA, 19 nt, Human
ucagcucuguguggcuuuc

SEQ ID NO: 159941 - RNA, 19 nt, Human
uccauauauuacugcauua

SEQ ID NO: 159942 - RNA, 21 nt, Human
ucuuuuuaaaugacuaaagca

SEQ ID NO: 159943 - RNA, 21 nt, Human
ugaaauaacuugaacauaaua

SEQ ID NO: 159944 - RNA, 18 nt, Human
ugaaauguugucacaaau

SEQ ID NO: 159945 - RNA, 21 nt, Human
ugacuaaagcaaacuaaacau

SEQ ID NO: 159946 - RNA, 23 nt, Human
ugacuggcagaaaaccaaaggaa

SEQ ID NO: 159947 - RNA, 18 nt, Human
ugagaaggaaauacagua

SEQ ID NO: 159948 - RNA, 21 nt, Human
ugagaaggaaauacaguacgg

SEQ ID NO: 159949 - RNA, 22 nt, Human
ugauaugaaauguugucacaaa

SEQ ID NO: 159950 - RNA, 23 nt, Human
ugcccgauucagcucuguguggc

SEQ ID NO: 159951 - RNA, 18 nt, Human
ugcuaacaggaaaaaaaa

SEQ ID NO: 159952 - RNA, 23 nt, Human
ugcuaacaggaaaaaaaaaaaaa

SEQ ID NO: 159953 - RNA, 23 nt, Human
ugcuaacaggaaaaaaaaaaaaa

SEQ ID NO: 159954 - RNA, 21 nt, Human
uguggcuuucuuuaaaaucga

SEQ ID NO: 159955 - RNA, 19 nt, Human
uuaaaacaacaacaacaac

SEQ ID NO: 159956 - RNA, 23 nt, Human
uuaagacagcacgaaacaccaca

SEQ ID NO: 159957 - RNA, 24 nt, Human
uuacuaaucuuuggucagcacagg

SEQ ID NO: 159958 - RNA, 18 nt, Human
uucauuguacaaacaucu

SEQ ID NO: 159959 - RNA, 18 nt, Human
uugcacauauggcaaucc

SEQ ID NO: 159960 - RNA, 24 nt, Human
uuggucacugguccaggaaacagg

SEQ ID NO: 159961 - RNA, 18 nt, Human
uuuaaaaugaaguuauau

SEQ ID NO: 159962 - RNA, 22 nt, Human
aagcggcaggugcggggcugca

SEQ ID NO: 159963 - RNA, 23 nt, Human
acagcauuugguuagggagugcc

SEQ ID NO: 159964 - RNA, 24 nt, Human
agacaaaagguccagguagaggca

SEQ ID NO: 159965 - RNA, 20 nt, Human
agcauuugaugguggaaaua

SEQ ID NO: 159966 - RNA, 21 nt, Human
auccacucaaaauauaucuua

SEQ ID NO: 159967 - RNA, 24 nt, Human
cgcagcgcucguggugcaacuggg

SEQ ID NO: 159968 - RNA, 20 nt, Human
cggagcugcaggugcgggcg

SEQ ID NO: 159969 - RNA, 27 nt, Human
cgggcggcaagagagggcaguaggcac

SEQ ID NO: 159970 - RNA, 19 nt, Human
cggggcugcaggugcaagc

SEQ ID NO: 159971 - RNA, 19 nt, Human
cggggcugcaggugcgggc

SEQ ID NO: 159972 - RNA, 21 nt, Human
cguggugcaacugggccaggc

SEQ ID NO: 159973 - RNA, 19 nt, Human
cugcaggugcaagcggcag

SEQ ID NO: 159974 - RNA, 24 nt, Human
cuggccgcaggugcggagcugcag

SEQ ID NO: 159975 - RNA, 20 nt, Human
gagcugcaggugcgggcggc

SEQ ID NO: 159976 - RNA, 20 nt, Human
gcaggugcgggccgcgggac

SEQ ID NO: 159977 - RNA, 20 nt, Human
gcggggcugcaggugcaagc

SEQ ID NO: 159978 - RNA, 22 nt, Human
ggaccuggcgggaggacugaca

SEQ ID NO: 159979 - RNA, 23 nt, Human
ggcggcaggugcgggccgcggga

SEQ ID NO: 159980 - RNA, 21 nt, Human
ggggcugcaggugcgggcggc

SEQ ID NO: 159981 - RNA, 19 nt, Human
gguacugcugugugagaca

SEQ ID NO: 159982 - RNA, 22 nt, Human
uaacaccaguggcauuauggag

SEQ ID NO: 159983 - RNA, 23 nt, Human
ugcaggugcgggcggcaagagag

SEQ ID NO: 159984 - RNA, 21 nt, Human
ugcgggcggcaggugcgggcc

SEQ ID NO: 159985 - RNA, 26 nt, Human
uugaugguggaaauagucaugcuuuu

SEQ ID NO: 159986 - RNA, 23 nt, Human
uuuuuuuuuuuuuuuuuuuaagg

SEQ ID NO: 159987 - RNA, 20 nt, Human
aaaacaaacagaagagggca

SEQ ID NO: 159988 - RNA, 23 nt, Human
auagaaucgccuguggcuuccaa

SEQ ID NO: 159989 - RNA, 18 nt, Human
ucauagcuaccaucucug

SEQ ID NO: 159990 - RNA, 18 nt, Human
ucucccggcaggaaaccu

SEQ ID NO: 159991 - RNA, 18 nt, Human
uucaaauccuuuucuccc

SEQ ID NO: 159992 - RNA, 22 nt, Human
uuugcauacucauagcuaccau

SEQ ID NO: 159993 - RNA, 18 nt, Human
uuuguuguugcucuucug

SEQ ID NO: 159994 - RNA, 20 nt, Human
uuuuuuuuuuuuuuuuccac

SEQ ID NO: 159995 - RNA, 21 nt, Human
uuuuuuuuuuuuuuuuccaca

SEQ ID NO: 159996 - RNA, 21 nt, Human
aaaaaacaaacauaaaaacca

SEQ ID NO: 159997 - RNA, 21 nt, Human
aaaaaacaaacauaaaaacca

SEQ ID NO: 159998 - RNA, 25 nt, Human
aaaaaacaaacauaaaaaccaaaac

SEQ ID NO: 159999 - RNA, 23 nt, Human
aaaacaaacauaaaaaccaaaac

SEQ ID NO: 160000 - RNA, 25 nt, Human
aaaacaaacauaaaaaccaaaaccc

SEQ ID NO: 160001 - RNA, 23 nt, Human
aaaacccaaaagaaaccauuggc

SEQ ID NO: 160002 - RNA, 24 nt, Human
aaaagacaacaaaauaaaacaaag

SEQ ID NO: 160003 - RNA, 18 nt, Human
aaaaugccacccccuacc

SEQ ID NO: 160004 - RNA, 24 nt, Human
aaacaaacauaaaaaccaaaaccc

SEQ ID NO: 160005 - RNA, 19 nt, Human
aaacaccccaaacugagag

SEQ ID NO: 160006 - RNA, 18 nt, Human
aaaccaaaacccaaaaga

SEQ ID NO: 160007 - RNA, 21 nt, Human
aaaccaaaacccaaaagaaac

SEQ ID NO: 160008 - RNA, 23 nt, Human
aaaccaaaacccaaaagaaacca

SEQ ID NO: 160009 - RNA, 21 nt, Human
aaagaaaccacuccagggcug

SEQ ID NO: 160010 - RNA, 20 nt, Human
aaagaaaccauuggcuugga

SEQ ID NO: 160011 - RNA, 27 nt, Human
aacauaaaaaccaaaacccaaaagaaa

SEQ ID NO: 160012 - RNA, 21 nt, Human
aacauaagugacuuuaggagu

SEQ ID NO: 160013 - RNA, 20 nt, Human
aacccaaaagaaaccauugg

SEQ ID NO: 160014 - RNA, 25 nt, Human
aaccccaaaaaacaaacauaaaaac

SEQ ID NO: 160015 - RNA, 21 nt, Human
aagaaaaggaaaacccagcaa

SEQ ID NO: 160016 - RNA, 21 nt, Human
aagacacauggaaaagggcag

SEQ ID NO: 160017 - RNA, 21 nt, Human
aaggagauggugccugucuca

SEQ ID NO: 160018 - RNA, 19 nt, Human
aaggggucucuccaccucc

SEQ ID NO: 160019 - RNA, 19 nt, Human
acacacacagaggcacgug

SEQ ID NO: 160020 - RNA, 23 nt, Human
acacacacagaggcacgugcaca

SEQ ID NO: 160021 - RNA, 24 nt, Human
acacacuuaaaaauauugacccaa

SEQ ID NO: 160022 - RNA, 20 nt, Human
acccagcaagggcauggucc

SEQ ID NO: 160023 - RNA, 24 nt, Human
accccaaaaaacaaacauaaaaac

SEQ ID NO: 160024 - RNA, 23 nt, Human
acccucaccucuaaaaaccauua

SEQ ID NO: 160025 - RNA, 21 nt, Human
acuggacaccacaagaaccug

SEQ ID NO: 160026 - RNA, 21 nt, Human
agaaaccacuccagggcugcc

SEQ ID NO: 160027 - RNA, 21 nt, Human
agaaugaagacacauggaaaa

SEQ ID NO: 160028 - RNA, 23 nt, Human
agacaacaaaauaaaacaaagua

SEQ ID NO: 160029 - RNA, 22 nt, Human
agacacauggaaaagggcaguc

SEQ ID NO: 160030 - RNA, 21 nt, Human
agagagagggggaacaaggga

SEQ ID NO: 160031 - RNA, 19 nt, Human
agaggaaaggagggagagc

SEQ ID NO: 160032 - RNA, 20 nt, Human
aggaagaggaaagccugaga

SEQ ID NO: 160033 - RNA, 22 nt, Human
aggaagagggccagaaagggac

SEQ ID NO: 160034 - RNA, 24 nt, Human
aggagcaggcagauaagccuggug

SEQ ID NO: 160035 - RNA, 19 nt, Human
aggagccuggcugggaggc

SEQ ID NO: 160036 - RNA, 21 nt, Human
aggcagaaugaagacacaugg

SEQ ID NO: 160037 - RNA, 21 nt, Human
aggcagggguucugguccugc

SEQ ID NO: 160038 - RNA, 18 nt, Human
aggccugggcucaggggg

SEQ ID NO: 160039 - RNA, 19 nt, Human
aggcucuccucggugggga

SEQ ID NO: 160040 - RNA, 22 nt, Human
agggcagucagugggaggcaac

SEQ ID NO: 160041 - RNA, 20 nt, Human
agggccagaaagggacaggg

SEQ ID NO: 160042 - RNA, 21 nt, Human
agggcgguggagcgggagaca

SEQ ID NO: 160043 - RNA, 18 nt, Human
agggcucaagggacagga

SEQ ID NO: 160044 - RNA, 23 nt, Human
aggggucucuccaccuccccuuu

SEQ ID NO: 160045 - RNA, 21 nt, Human
aggguucuuuacagagaaguu

SEQ ID NO: 160046 - RNA, 24 nt, Human
augaagacacauggaaaagggcag

SEQ ID NO: 160047 - RNA, 23 nt, Human
augcauguuuuuccaaaccccaa

SEQ ID NO: 160048 - RNA, 18 nt, Human
auggaagugggcagaggg

SEQ ID NO: 160049 - RNA, 23 nt, Human
auggggaggaggggcacagggcc

SEQ ID NO: 160050 - RNA, 25 nt, Human
caaaaaacaaacauaaaaaccaaaa

SEQ ID NO: 160051 - RNA, 20 nt, Human
caaaccccaaaaaacaaaca

SEQ ID NO: 160052 - RNA, 20 nt, Human
caaagucagaggcacucucc

SEQ ID NO: 160053 - RNA, 20 nt, Human
caacaaaauaaaacaaagua

SEQ ID NO: 160054 - RNA, 23 nt, Human
caacccucaccucuaaaaaccau

SEQ ID NO: 160055 - RNA, 24 nt, Human
caacccucaccucuaaaaaccauu

SEQ ID NO: 160056 - RNA, 25 nt, Human
cacagucccaaagaaaaggaaaacc

SEQ ID NO: 160057 - RNA, 20 nt, Human
cacccucucugccccaccuc

SEQ ID NO: 160058 - RNA, 21 nt, Human
cacuccagggcugccuuccuc

SEQ ID NO: 160059 - RNA, 18 nt, Human
cacugcuggggaccaugg

SEQ ID NO: 160060 - RNA, 19 nt, Human
cacuggggcuagacacagg

SEQ ID NO: 160061 - RNA, 18 nt, Human
cagaaccaggcacugcug

SEQ ID NO: 160062 - RNA, 18 nt, Human
cagcagauuggaagaaac

SEQ ID NO: 160063 - RNA, 22 nt, Human
caggacccccugacugcccuga

SEQ ID NO: 160064 - RNA, 27 nt, Human
cagugggaggcaaaagagagaggggga

SEQ ID NO: 160065 - RNA, 21 nt, Human
caugcuccccucccucccucc

SEQ ID NO: 160066 - RNA, 23 nt, Human
cauggaccaacccucaccucuaa

SEQ ID NO: 160067 - RNA, 22 nt, Human
cauguuuuuccaaaccccaaaa

SEQ ID NO: 160068 - RNA, 20 nt, Human
cauuggcuuggaaauuucug

SEQ ID NO: 160069 - RNA, 23 nt, Human
ccagggucaaaacuggccuaggg

SEQ ID NO: 160070 - RNA, 27 nt, Human
cccaaaaaacaaacauaaaaaccaaaa

SEQ ID NO: 160071 - RNA, 20 nt, Human
cccagguuccucuguccccc

SEQ ID NO: 160072 - RNA, 22 nt, Human
ccccaaaaaacaaacauaaaaa

SEQ ID NO: 160073 - RNA, 22 nt, Human
ccccaaacugagagcccggccu

SEQ ID NO: 160074 - RNA, 19 nt, Human
ccccucccucccucccucc

SEQ ID NO: 160075 - RNA, 20 nt, Human
cccucucugccccaccugua

SEQ ID NO: 160076 - RNA, 20 nt, Human
ccgccuccagcuugggggag

SEQ ID NO: 160077 - RNA, 20 nt, Human
ccucugaagagcuucaaccc

SEQ ID NO: 160078 - RNA, 25 nt, Human
ccugcagucugagggcaggcucucc

SEQ ID NO: 160079 - RNA, 18 nt, Human
ccuggugccugggcucca

SEQ ID NO: 160080 - RNA, 18 nt, Human
cgacagcacagccugugc

SEQ ID NO: 160081 - RNA, 22 nt, Human
cgcgcagaauacacucagccac

SEQ ID NO: 160082 - RNA, 22 nt, Human
cgcuggccucagagcccgugca

SEQ ID NO: 160083 - RNA, 20 nt, Human
cggggcgggguggggggaag

SEQ ID NO: 160084 - RNA, 18 nt, Human
cgggguggggggaagagg

SEQ ID NO: 160085 - RNA, 25 nt, Human
cucaacaaagggcgguggagcggga

SEQ ID NO: 160086 - RNA, 18 nt, Human
cucaagggacaggagagc

SEQ ID NO: 160087 - RNA, 20 nt, Human
cuccagggcugccuuccucu

SEQ ID NO: 160088 - RNA, 22 nt, Human
cuccccucccucccucccucca

SEQ ID NO: 160089 - RNA, 24 nt, Human
cuccucugaagagcuucaaccccc

SEQ ID NO: 160090 - RNA, 22 nt, Human
cugcuggggaccauggaugggg

SEQ ID NO: 160091 - RNA, 18 nt, Human
cuggggcugcuggccccu

SEQ ID NO: 160092 - RNA, 20 nt, Human
cuucaggaagaggaaagccc

SEQ ID NO: 160093 - RNA, 21 nt, Human
gaaacaaacaaaaugccaccc

SEQ ID NO: 160094 - RNA, 18 nt, Human
gaagggcucaagggacag

SEQ ID NO: 160095 - RNA, 18 nt, Human
gagagcacaguuaaggac

SEQ ID NO: 160096 - RNA, 27 nt, Human
gaggacgugcauccugggaaagccuuc

SEQ ID NO: 160097 - RNA, 24 nt, Human
gaggagccuggcugggaggcaggu

SEQ ID NO: 160098 - RNA, 18 nt, Human
gagggagaggagcaggca

SEQ ID NO: 160099 - RNA, 22 nt, Human
gagggggaacaaggagauggug

SEQ ID NO: 160100 - RNA, 25 nt, Human
gcacugcuggggaccauggaugggg

SEQ ID NO: 160101 - RNA, 18 nt, Human
gcagaaugaagacacaug

SEQ ID NO: 160102 - RNA, 23 nt, Human
gcgggguggggggaagagguugu

SEQ ID NO: 160103 - RNA, 20 nt, Human
gcucaagggagaggaaagga

SEQ ID NO: 160104 - RNA, 24 nt, Human
gcuccccucccucccucccuccac

SEQ ID NO: 160105 - RNA, 21 nt, Human
gcuccucugaagagcuucaac

SEQ ID NO: 160106 - RNA, 18 nt, Human
gcugcccuagagagagga

SEQ ID NO: 160107 - RNA, 26 nt, Human
ggaaagccuucuucaggcagaaugaa

SEQ ID NO: 160108 - RNA, 18 nt, Human
ggaggcaaaagagagagg

SEQ ID NO: 160109 - RNA, 18 nt, Human
ggcugcugcuacugagca

SEQ ID NO: 160110 - RNA, 22 nt, Human
gggacaggagagcagagaggga

SEQ ID NO: 160111 - RNA, 20 nt, Human
gggaggcaaaagagagaggg

SEQ ID NO: 160112 - RNA, 22 nt, Human
gggcagaaccaagcucaaggga

SEQ ID NO: 160113 - RNA, 22 nt, Human
gggcgggguggggggaagaggu

SEQ ID NO: 160114 - RNA, 18 nt, Human
gggcucaagggacaggag

SEQ ID NO: 160115 - RNA, 22 nt, Human
ggggaacaaggagauggugccu

SEQ ID NO: 160116 - RNA, 22 nt, Human
ggggcuagacacaggccugggc

SEQ ID NO: 160117 - RNA, 20 nt, Human
ggguagcaacgaaauggguc

SEQ ID NO: 160118 - RNA, 25 nt, Human
guccucugccgccuccagcuugggg

SEQ ID NO: 160119 - RNA, 18 nt, Human
gugaacaagcacgagugc

SEQ ID NO: 160120 - RNA, 23 nt, Human
uaaaaagacaacaaaauaaaaca

SEQ ID NO: 160121 - RNA, 22 nt, Human
uaaaccagaggccuggaggagc

SEQ ID NO: 160122 - RNA, 22 nt, Human
uaagagcagauuguaggacaug

SEQ ID NO: 160123 - RNA, 18 nt, Human
uaccaggauccaguuucu

SEQ ID NO: 160124 - RNA, 21 nt, Human
uagcaacgaaauggguguguc

SEQ ID NO: 160125 - RNA, 18 nt, Human
uauuggggccuggagacc

SEQ ID NO: 160126 - RNA, 27 nt, Human
ucacacacuuaaaaauauugacccaaa

SEQ ID NO: 160127 - RNA, 22 nt, Human
ucacagucccaaagaaaaggaa

SEQ ID NO: 160128 - RNA, 24 nt, Human
ucaccaagugauuuuauauuauau

SEQ ID NO: 160129 - RNA, 18 nt, Human
ucagaaccaggcacugcu

SEQ ID NO: 160130 - RNA, 26 nt, Human
ucagugggaggcaaaagagagagggg

SEQ ID NO: 160131 - RNA, 23 nt, Human
uccaaaccccaaaaaacaaacau

SEQ ID NO: 160132 - RNA, 18 nt, Human
uccaccacccucucugcc

SEQ ID NO: 160133 - RNA, 22 nt, Human
ucccaaagaaaaggaaaaccca

SEQ ID NO: 160134 - RNA, 19 nt, Human
ucccaaagucagaggcacu

SEQ ID NO: 160135 - RNA, 19 nt, Human
uccccagguuccucugucc

SEQ ID NO: 160136 - RNA, 21 nt, Human
ucccugggguagacaguucca

SEQ ID NO: 160137 - RNA, 22 nt, Human
uccucuuccuccuuaggaacca

SEQ ID NO: 160138 - RNA, 19 nt, Human
uccugcgcaagccgggaga

SEQ ID NO: 160139 - RNA, 21 nt, Human
uccugggaaagccuucuucag

SEQ ID NO: 160140 - RNA, 18 nt, Human
uccuggggcugcuggccc

SEQ ID NO: 160141 - RNA, 24 nt, Human
uccuuugugguuuuucgccccggu

SEQ ID NO: 160142 - RNA, 24 nt, Human
ucgacagcacagccugugcuuucc

SEQ ID NO: 160143 - RNA, 18 nt, Human
ucggcacgggucugggac

SEQ ID NO: 160144 - RNA, 22 nt, Human
ucuaaaaaccauuuccccucac

SEQ ID NO: 160145 - RNA, 22 nt, Human
ucucccggcacaaucccugcuc

SEQ ID NO: 160146 - RNA, 21 nt, Human
ugaaaguucagugagccacug

SEQ ID NO: 160147 - RNA, 23 nt, Human
ugaacaagcacgagugcugggca

SEQ ID NO: 160148 - RNA, 18 nt, Human
ugagggcaggcucuccug

SEQ ID NO: 160149 - RNA, 25 nt, Human
ugcucaauacccaggguucuuuaca

SEQ ID NO: 160150 - RNA, 25 nt, Human
ugcugccuuuucugggcucccuuuu

SEQ ID NO: 160151 - RNA, 21 nt, Human
ugcuggggaccauggaugggg

SEQ ID NO: 160152 - RNA, 18 nt, Human
uggaagaaacaaacaaaa

SEQ ID NO: 160153 - RNA, 20 nt, Human
uggacaccacaagaaccugg

SEQ ID NO: 160154 - RNA, 21 nt, Human
uggacaccacaagaaccuggc

SEQ ID NO: 160155 - RNA, 21 nt, Human
uggaggcagggguucuggucc

SEQ ID NO: 160156 - RNA, 22 nt, Human
uggauggggaggaggggcacag

SEQ ID NO: 160157 - RNA, 19 nt, Human
uggccuagguggcaaagag

SEQ ID NO: 160158 - RNA, 20 nt, Human
uggcuucuaagcaggacccc

SEQ ID NO: 160159 - RNA, 21 nt, Human
uggcuucuaagcaggaccccc

SEQ ID NO: 160160 - RNA, 21 nt, Human
ugggacuccuggggcugcugg

SEQ ID NO: 160161 - RNA, 19 nt, Human
uggggaggaggggcacagg

SEQ ID NO: 160162 - RNA, 23 nt, Human
uggggaggaggggcacagggccc

SEQ ID NO: 160163 - RNA, 21 nt, Human
uggggagucaggggaagaucg

SEQ ID NO: 160164 - RNA, 21 nt, Human
uggggcucaacaaagggcggu

SEQ ID NO: 160165 - RNA, 20 nt, Human
uggggcugcuggccccuccu

SEQ ID NO: 160166 - RNA, 25 nt, Human
uguagaggaagggcucaagggacag

SEQ ID NO: 160167 - RNA, 23 nt, Human
ugucucagaauccacuuggguag

SEQ ID NO: 160168 - RNA, 21 nt, Human
ugugacgcuggccucagagcc

SEQ ID NO: 160169 - RNA, 20 nt, Human
uuacagagggggagcagagu

SEQ ID NO: 160170 - RNA, 20 nt, Human
uucagcagauuggaagaaac

SEQ ID NO: 160171 - RNA, 21 nt, Human
uuccauggcugcaggcagagg

SEQ ID NO: 160172 - RNA, 22 nt, Human
uuccucaaaguuucaaccccag

SEQ ID NO: 160173 - RNA, 23 nt, Human
uuccucuuccuccuuaggaacca

SEQ ID NO: 160174 - RNA, 22 nt, Human
uuccuuaggagggagaggagca

SEQ ID NO: 160175 - RNA, 25 nt, Human
uugacccaaaagaaauuccgaccuu

SEQ ID NO: 160176 - RNA, 28 nt, Human
uuuauaaaaagacaacaaaauaaaacaa

SEQ ID NO: 160177 - RNA, 18 nt, Human
uuuccacaggagcaacca

SEQ ID NO: 160178 - RNA, 20 nt, Human
uuucugggcucccuuuucug

SEQ ID NO: 160179 - RNA, 22 nt, Human
aaaagguaccaacacuuacuga

SEQ ID NO: 160180 - RNA, 20 nt, Human
aacacuuacugaucugaguu

SEQ ID NO: 160181 - RNA, 26 nt, Human
aagacccugcuccacccagggcacuc

SEQ ID NO: 160182 - RNA, 19 nt, Human
acagcccgaagucacacgg

SEQ ID NO: 160183 - RNA, 19 nt, Human
accagaguaacugcaaucc

SEQ ID NO: 160184 - RNA, 21 nt, Human
acugcaauccauacagaaguc

SEQ ID NO: 160185 - RNA, 18 nt, Human
agacccugcuccacccag

SEQ ID NO: 160186 - RNA, 22 nt, Human
agccgcgagcgagcccacagcc

SEQ ID NO: 160187 - RNA, 23 nt, Human
agcugcuuuuguuuuuggucccu

SEQ ID NO: 160188 - RNA, 21 nt, Human
agcuugaaaaaaaaucacauc

SEQ ID NO: 160189 - RNA, 18 nt, Human
augagucuaaaagguacc

SEQ ID NO: 160190 - RNA, 20 nt, Human
augagucuaaaagguaccaa

SEQ ID NO: 160191 - RNA, 21 nt, Human
auggaaaccuauuaacaugcc

SEQ ID NO: 160192 - RNA, 21 nt, Human
cacacggcgccggcgacgccc

SEQ ID NO: 160193 - RNA, 20 nt, Human
cacagcagaauaaaggugaa

SEQ ID NO: 160194 - RNA, 21 nt, Human
caccagagcuucuacuuucca

SEQ ID NO: 160195 - RNA, 18 nt, Human
caccagaguaacugcaau

SEQ ID NO: 160196 - RNA, 20 nt, Human
cccacagcccgaagucacac

SEQ ID NO: 160197 - RNA, 19 nt, Human
ccccuugggcccaggcagc

SEQ ID NO: 160198 - RNA, 19 nt, Human
ccucuuuucuuuggugucu

SEQ ID NO: 160199 - RNA, 18 nt, Human
ccuguaaaugccuuuccc

SEQ ID NO: 160200 - RNA, 23 nt, Human
ccuuaguucuuucucuuuaaggu

SEQ ID NO: 160201 - RNA, 19 nt, Human
gcaguacagucacuuugau

SEQ ID NO: 160202 - RNA, 19 nt, Human
guuucuggcaugguccuag

SEQ ID NO: 160203 - RNA, 21 nt, Human
uaaaaauguguuaugugcugu

SEQ ID NO: 160204 - RNA, 19 nt, Human
uaauuagcuuuuuuccuuu

SEQ ID NO: 160205 - RNA, 20 nt, Human
uagaguccucuuuucuuugg

SEQ ID NO: 160206 - RNA, 24 nt, Human
ucaaaauaagcuugaaaaaaaauc

SEQ ID NO: 160207 - RNA, 22 nt, Human
ucuuucucuuuaagguuccccc

SEQ ID NO: 160208 - RNA, 23 nt, Human
ugacagaaacaaaaaggugaaga

SEQ ID NO: 160209 - RNA, 23 nt, Human
ugaguagcuaugguguaaccuga

SEQ ID NO: 160210 - RNA, 21 nt, Human
ugccuuccacauaagucucua

SEQ ID NO: 160211 - RNA, 20 nt, Human
ugcuuuuguuuuuggucccu

SEQ ID NO: 160212 - RNA, 23 nt, Human
uggagaaucaacagauuggguga

SEQ ID NO: 160213 - RNA, 18 nt, Human
uggcuuaaguaucaggua

SEQ ID NO: 160214 - RNA, 25 nt, Human
uucaaaauaagcuugaaaaaaaauc

SEQ ID NO: 160215 - RNA, 21 nt, Human
uugcaguacagucacuuugau

SEQ ID NO: 160216 - RNA, 24 nt, Human
uuucuggcaugguccuagcugcau

SEQ ID NO: 160217 - RNA, 22 nt, Human
uuuuuuuuuuuuuuuuuuaaag

SEQ ID NO: 160218 - RNA, 21 nt, Human
aaaaacaacaacuugacuagc

SEQ ID NO: 160219 - RNA, 25 nt, Human
aaacaaguggaauuuucugaccaaa

SEQ ID NO: 160220 - RNA, 19 nt, Human
aaaccaaggagaacuagua

SEQ ID NO: 160221 - RNA, 23 nt, Human
aaaguuguucaaggaaaaacaac

SEQ ID NO: 160222 - RNA, 20 nt, Human
aaaguuuuccaguucacuga

SEQ ID NO: 160223 - RNA, 24 nt, Human
aacaaucuuuacauauacugacug

SEQ ID NO: 160224 - RNA, 20 nt, Human
aacauauacuuuacaguaua

SEQ ID NO: 160225 - RNA, 22 nt, Human
aaccaaauuaacaaucacaaaa

SEQ ID NO: 160226 - RNA, 21 nt, Human
aaggaaacaaguggaauuuuc

SEQ ID NO: 160227 - RNA, 20 nt, Human
aauucaauuuguacaaaaag

SEQ ID NO: 160228 - RNA, 26 nt, Human
acaaaauaguagaauuauaucagaac

SEQ ID NO: 160229 - RNA, 20 nt, Human
acuaaaauuuacuggaaacu

SEQ ID NO: 160230 - RNA, 20 nt, Human
agacuaccucagcgagcggc

SEQ ID NO: 160231 - RNA, 19 nt, Human
agcagauuacagagcaaac

SEQ ID NO: 160232 - RNA, 22 nt, Human
agcagauuacagagcaaaccua

SEQ ID NO: 160233 - RNA, 23 nt, Human
augauuaugaacuuaaauauguc

SEQ ID NO: 160234 - RNA, 19 nt, Human
caaaaaguaaauuuccaaa

SEQ ID NO: 160235 - RNA, 24 nt, Human
caaagcuaaacacugccucccuuc

SEQ ID NO: 160236 - RNA, 25 nt, Human
caagugccacauacauaauaacaua

SEQ ID NO: 160237 - RNA, 19 nt, Human
cacaccaccccgugcuccc

SEQ ID NO: 160238 - RNA, 22 nt, Human
caccaccccgugcuccggggac

SEQ ID NO: 160239 - RNA, 23 nt, Human
caccuuuugcuuuauucuuaaga

SEQ ID NO: 160240 - RNA, 24 nt, Human
cagacauuuuucuauuaaaguuuu

SEQ ID NO: 160241 - RNA, 20 nt, Human
cagauuacagagcaaaccua

SEQ ID NO: 160242 - RNA, 18 nt, Human
cagccgcggccccccgcg

SEQ ID NO: 160243 - RNA, 19 nt, Human
caguauaaacaaauuaagu

SEQ ID NO: 160244 - RNA, 22 nt, Human
cauacagugccucaagugccac

SEQ ID NO: 160245 - RNA, 23 nt, Human
caugggucuuccgauaaacaauc

SEQ ID NO: 160246 - RNA, 24 nt, Human
cauuaguaacuuuuuauucucaaa

SEQ ID NO: 160247 - RNA, 21 nt, Human
cauuugagaacauucauccaa

SEQ ID NO: 160248 - RNA, 18 nt, Human
cauuuuauagacucuaca

SEQ ID NO: 160249 - RNA, 26 nt, Human
ccacauuaaaaaaaauucggagauau

SEQ ID NO: 160250 - RNA, 19 nt, Human
cccccacacaccaccccgu

SEQ ID NO: 160251 - RNA, 20 nt, Human
cccccgcuucgcgcucccgc

SEQ ID NO: 160252 - RNA, 20 nt, Human
ccgcagccgcggccccccgc

SEQ ID NO: 160253 - RNA, 26 nt, Human
ccggggacggcggcggcugcaggucc

SEQ ID NO: 160254 - RNA, 20 nt, Human
ccuggccccccgcuucgcgc

SEQ ID NO: 160255 - RNA, 21 nt, Human
ccuucuguuccauuuauuguc

SEQ ID NO: 160256 - RNA, 20 nt, Human
ccuuuuuucuucucauaugu

SEQ ID NO: 160257 - RNA, 20 nt, Human
cgcgagagacuaccucagcg

SEQ ID NO: 160258 - RNA, 21 nt, Human
cucuacaaugcauggauuacu

SEQ ID NO: 160259 - RNA, 22 nt, Human
cugaagacccuaaaaugucaag

SEQ ID NO: 160260 - RNA, 21 nt, Human
cugccgggggcggcuuccccc

SEQ ID NO: 160261 - RNA, 18 nt, Human
gacggcggcggcugcagg

SEQ ID NO: 160262 - RNA, 25 nt, Human
gagcaaaccuaaaaguuuauacaaa

SEQ ID NO: 160263 - RNA, 24 nt, Human
gcagauuacagagcaaaccuaaaa

SEQ ID NO: 160264 - RNA, 18 nt, Human
gcagccgcggccccccgc

SEQ ID NO: 160265 - RNA, 19 nt, Human
gcagccgcggccccccgcg

SEQ ID NO: 160266 - RNA, 21 nt, Human
gcggccccccgcgcuccgccc

SEQ ID NO: 160267 - RNA, 23 nt, Human
gcucccuuuaugauuuuuaaaaa

SEQ ID NO: 160268 - RNA, 19 nt, Human
ggccccccgcuucgcgcuc

SEQ ID NO: 160269 - RNA, 21 nt, Human
ggcgccccuggccccccgcuu

SEQ ID NO: 160270 - RNA, 18 nt, Human
uaaaaccaaggagaacua

SEQ ID NO: 160271 - RNA, 26 nt, Human
uaaacaaagauaaaaccaaucaacgg

SEQ ID NO: 160272 - RNA, 25 nt, Human
uaaaugcauagagaauauaacauuu

SEQ ID NO: 160273 - RNA, 23 nt, Human
uaacagguguauguguaacugaa

SEQ ID NO: 160274 - RNA, 25 nt, Human
uaacagguguauguguaacugaaga

SEQ ID NO: 160275 - RNA, 24 nt, Human
uaauaacauaucacaaaagaaugu

SEQ ID NO: 160276 - RNA, 19 nt, Human
uaauugcuguuaauuuucg

SEQ ID NO: 160277 - RNA, 19 nt, Human
uaauuugaucuuggcucug

SEQ ID NO: 160278 - RNA, 18 nt, Human
uacaauggugcucccuuu

SEQ ID NO: 160279 - RNA, 22 nt, Human
uacuuuaaagcuaguuuaaaca

SEQ ID NO: 160280 - RNA, 19 nt, Human
uauaacauuucagaaaacc

SEQ ID NO: 160281 - RNA, 22 nt, Human
uauauucauuuuucucacaaaa

SEQ ID NO: 160282 - RNA, 18 nt, Human
ucccgcgcugucuguguu

SEQ ID NO: 160283 - RNA, 21 nt, Human
uccgaaccacauuaaaaaaaa

SEQ ID NO: 160284 - RNA, 23 nt, Human
ucuaucagucuucuaaguguucu

SEQ ID NO: 160285 - RNA, 19 nt, Human
ugaagacccuaaaauguca

SEQ ID NO: 160286 - RNA, 25 nt, Human
ugagaacauucauccaaucuuuucc

SEQ ID NO: 160287 - RNA, 18 nt, Human
ugaggcgccccuggcccc

SEQ ID NO: 160288 - RNA, 18 nt, Human
ugcauggauuacuuuuau

SEQ ID NO: 160289 - RNA, 23 nt, Human
ugcccagaaucaaaguuuauauc

SEQ ID NO: 160290 - RNA, 25 nt, Human
uggaaagcaaaaauuauguagaaaa

SEQ ID NO: 160291 - RNA, 21 nt, Human
uuaaacaaagauaaaaccaag

SEQ ID NO: 160292 - RNA, 21 nt, Human
uuaaguacuaugcauuuugcu

SEQ ID NO: 160293 - RNA, 19 nt, Human
uuacacuaaggaaacaagu

SEQ ID NO: 160294 - RNA, 24 nt, Human
uuauguagaaaaucaccuuuugcu

SEQ ID NO: 160295 - RNA, 19 nt, Human
uucaaggaaaaacaacaac

SEQ ID NO: 160296 - RNA, 22 nt, Human
uucacugagcaauauuuacuga

SEQ ID NO: 160297 - RNA, 19 nt, Human
uucgcgcucccgcagccgc

SEQ ID NO: 160298 - RNA, 23 nt, Human
uuuaaaaguagaucuaagacugu

SEQ ID NO: 160299 - RNA, 21 nt, Human
uuucgaaucuagauaagccuu

SEQ ID NO: 160300 - RNA, 23 nt, Human
uuuuucuucucauauguugcugu

SEQ ID NO: 160301 - RNA, 23 nt, Human
uuuuuuuuuugcauuaguaacuu

SEQ ID NO: 160302 - RNA, 18 nt, Human
uuuuuuuuuuuuuuuuug

SEQ ID NO: 160303 - RNA, 26 nt, Human
uuuuuuuuuuuuuuuuuuugcauuag

SEQ ID NO: 160304 - RNA, 18 nt, Human
aaaacccaaaaccaaucc

SEQ ID NO: 160305 - RNA, 25 nt, Human
aaacaaaacccaaaaccaaucccaa

SEQ ID NO: 160306 - RNA, 25 nt, Human
aaaccaaucccaaaauuaaacccca

SEQ ID NO: 160307 - RNA, 23 nt, Human
aacaacuaaaaacaaaacccaaa

SEQ ID NO: 160308 - RNA, 23 nt, Human
aaccaaucccaaaauuaaacccc

SEQ ID NO: 160309 - RNA, 18 nt, Human
aacccaaaaccaauccca

SEQ ID NO: 160310 - RNA, 22 nt, Human
aacccaaaaccaaucccaaaau

SEQ ID NO: 160311 - RNA, 23 nt, Human
aacuaaaaacaaaacccaaaacc

SEQ ID NO: 160312 - RNA, 25 nt, Human
aacuaaaaacaaaacccaaaaccaa

SEQ ID NO: 160313 - RNA, 26 nt, Human
aacuaaaaacaaaacccaaaaccaau

SEQ ID NO: 160314 - RNA, 18 nt, Human
aauuaugaagcuucaaaa

SEQ ID NO: 160315 - RNA, 25 nt, Human
acaacuaaaaacaaaacccaaaacc

SEQ ID NO: 160316 - RNA, 22 nt, Human
aggcagcgcgagaaggccuggg

SEQ ID NO: 160317 - RNA, 18 nt, Human
agguguaaaaaauuaacu

SEQ ID NO: 160318 - RNA, 25 nt, Human
auuuaauggacaauuucauauuuuu

SEQ ID NO: 160319 - RNA, 25 nt, Human
caaaaccaaucccaaaauuaaaccc

SEQ ID NO: 160320 - RNA, 19 nt, Human
caaaaggucagguguccuc

SEQ ID NO: 160321 - RNA, 24 nt, Human
caaccgccgcaagcccggccuagc

SEQ ID NO: 160322 - RNA, 23 nt, Human
caacuaaaaacaaaacccaaaac

SEQ ID NO: 160323 - RNA, 18 nt, Human
caccagcgaccaggcagc

SEQ ID NO: 160324 - RNA, 22 nt, Human
cagcgcgagaaggccugggugc

SEQ ID NO: 160325 - RNA, 23 nt, Human
ccaaaauuaaaccccaacaaagc

SEQ ID NO: 160326 - RNA, 24 nt, Human
ccaaucccaaaauuaaaccccaac

SEQ ID NO: 160327 - RNA, 22 nt, Human
ccacaccuggcuagaaaaacua

SEQ ID NO: 160328 - RNA, 18 nt, Human
ccagagaaauaaccaaac

SEQ ID NO: 160329 - RNA, 21 nt, Human
cccaacaaagcacauuaauuu

SEQ ID NO: 160330 - RNA, 23 nt, Human
ccgccgcaagcccggccuagcgc

SEQ ID NO: 160331 - RNA, 19 nt, Human
cgaccaggcagcgcgagaa

SEQ ID NO: 160332 - RNA, 20 nt, Human
cgacccggaaggaagacgcg

SEQ ID NO: 160333 - RNA, 18 nt, Human
cgcggaggccgcgaggag

SEQ ID NO: 160334 - RNA, 20 nt, Human
cgggagaggcgcgcgccgcg

SEQ ID NO: 160335 - RNA, 22 nt, Human
gaacuuugcaugcugacuucag

SEQ ID NO: 160336 - RNA, 24 nt, Human
gccgcaagcccggccuagcgcgac

SEQ ID NO: 160337 - RNA, 21 nt, Human
gcuucaccagcgaccaggcag

SEQ ID NO: 160338 - RNA, 22 nt, Human
uaaaccccaacaaagcacauuu

SEQ ID NO: 160339 - RNA, 23 nt, Human
uaaccaaacagcuggaaaagcau

SEQ ID NO: 160340 - RNA, 21 nt, Human
uaagguaaaaauaauauccac

SEQ ID NO: 160341 - RNA, 20 nt, Human
uaaguuagcaugauuccaug

SEQ ID NO: 160342 - RNA, 24 nt, Human
uaccauuaaaacaacuaaaaacaa

SEQ ID NO: 160343 - RNA, 25 nt, Human
uacccugaacuuugcaugcugacuu

SEQ ID NO: 160344 - RNA, 19 nt, Human
uccagagaaauaaccaaac

SEQ ID NO: 160345 - RNA, 21 nt, Human
uccagguacccugaacuuugc

SEQ ID NO: 160346 - RNA, 22 nt, Human
ucucauucuccaacuagcucug

SEQ ID NO: 160347 - RNA, 19 nt, Human
ugaagagaagugcuugcag

SEQ ID NO: 160348 - RNA, 21 nt, Human
ugauuuaauggacaauuucau

SEQ ID NO: 160349 - RNA, 19 nt, Human
ugggaaaugcaaaaguugg

SEQ ID NO: 160350 - RNA, 19 nt, Human
ugggaaaugcaaaaguugg

SEQ ID NO: 160351 - RNA, 23 nt, Human
uuaaaacaacuaaaaacaaaacc

SEQ ID NO: 160352 - RNA, 22 nt, Human
uucccagauagaauggucacag

SEQ ID NO: 160353 - RNA, 21 nt, Human
uugccaggucacaggcuuaau

SEQ ID NO: 160354 - RNA, 20 nt, Human
uuuguacauaccaaacaaaa

SEQ ID NO: 160355 - RNA, 25 nt, Human
aaaaagaaaauucagcucaauaaaa

SEQ ID NO: 160356 - RNA, 20 nt, Human
aaaaguauaauuugcaagag

SEQ ID NO: 160357 - RNA, 19 nt, Human
aaagaaccuuaaauguggg

SEQ ID NO: 160358 - RNA, 22 nt, Human
aaaggaaauauuacggaaaaga

SEQ ID NO: 160359 - RNA, 19 nt, Human
aaauuaagauuucugaagu

SEQ ID NO: 160360 - RNA, 21 nt, Human
aaccuuaaauguggguuuguu

SEQ ID NO: 160361 - RNA, 20 nt, Human
aagcaucucggagaguuuau

SEQ ID NO: 160362 - RNA, 21 nt, Human
aaggaaacaaauaucgauugg

SEQ ID NO: 160363 - RNA, 25 nt, Human
aauaaaggaaauauuacggaaaaga

SEQ ID NO: 160364 - RNA, 21 nt, Human
acaaaguaucccuaaaggaaa

SEQ ID NO: 160365 - RNA, 20 nt, Human
acauuauaaauggucuggcu

SEQ ID NO: 160366 - RNA, 23 nt, Human
accagcugcuucauccgccagug

SEQ ID NO: 160367 - RNA, 22 nt, Human
accuaaucccuuucuaaaccaa

SEQ ID NO: 160368 - RNA, 19 nt, Human
acugccucagccuccgccu

SEQ ID NO: 160369 - RNA, 22 nt, Human
agaaucauugaaauaaaggaaa

SEQ ID NO: 160370 - RNA, 19 nt, Human
agacaaagaucagaaguca

SEQ ID NO: 160371 - RNA, 21 nt, Human
aggcggcgcgcccccuugcgc

SEQ ID NO: 160372 - RNA, 18 nt, Human
agggacaguggugagaac

SEQ ID NO: 160373 - RNA, 24 nt, Human
auaaaggaaauauuacggaaaaga

SEQ ID NO: 160374 - RNA, 21 nt, Human
caaaccaauaauguauucauu

SEQ ID NO: 160375 - RNA, 18 nt, Human
caaagaucagaagucaag

SEQ ID NO: 160376 - RNA, 22 nt, Human
caaagugcaauaaagcaaaacg

SEQ ID NO: 160377 - RNA, 23 nt, Human
cacccucgccgcggggcagaggc

SEQ ID NO: 160378 - RNA, 21 nt, Human
cacccuuuugaaaagaccuaa

SEQ ID NO: 160379 - RNA, 22 nt, Human
cacugagcuaacacucagaagc

SEQ ID NO: 160380 - RNA, 18 nt, Human
cacugccucagccuccgc

SEQ ID NO: 160381 - RNA, 24 nt, Human
cauggcaccaauagacuggcucaa

SEQ ID NO: 160382 - RNA, 22 nt, Human
cauuacaauucacugguaaauu

SEQ ID NO: 160383 - RNA, 22 nt, Human
cauucuuacuguaagaauccag

SEQ ID NO: 160384 - RNA, 22 nt, Human
ccagucaacaguaguaggcuuu

SEQ ID NO: 160385 - RNA, 19 nt, Human
cccccuugcgcaugcgccc

SEQ ID NO: 160386 - RNA, 19 nt, Human
cccucgccgcggggcagag

SEQ ID NO: 160387 - RNA, 21 nt, Human
cccucgccgcggggcagaggc

SEQ ID NO: 160388 - RNA, 24 nt, Human
ccucagcagccgcggccgccgccu

SEQ ID NO: 160389 - RNA, 23 nt, Human
cgccgccucuccauagacacccu

SEQ ID NO: 160390 - RNA, 21 nt, Human
cgcggggcagaggcggcgcgc

SEQ ID NO: 160391 - RNA, 27 nt, Human
cucagccuccgccucagcagccgcggc

SEQ ID NO: 160392 - RNA, 25 nt, Human
cugcucaugcauuuugaacuccuuc

SEQ ID NO: 160393 - RNA, 21 nt, Human
cuucauccgccaguguggggc

SEQ ID NO: 160394 - RNA, 19 nt, Human
cuucuucaggaaagggcgc

SEQ ID NO: 160395 - RNA, 21 nt, Human
cuuguaaaagccuccaaucuc

SEQ ID NO: 160396 - RNA, 24 nt, Human
cuuuccuagcucacugagcuaaca

SEQ ID NO: 160397 - RNA, 25 nt, Human
gaaccaaucaccuccauggacuuua

SEQ ID NO: 160398 - RNA, 18 nt, Human
gagaaucauugaaauaaa

SEQ ID NO: 160399 - RNA, 18 nt, Human
gagccccaccagcugcuu

SEQ ID NO: 160400 - RNA, 18 nt, Human
gcagaggcggcgcgcccc

SEQ ID NO: 160401 - RNA, 24 nt, Human
gcucaauaaaauucaguaucuguc

SEQ ID NO: 160402 - RNA, 19 nt, Human
gcugcuucauccgccagug

SEQ ID NO: 160403 - RNA, 27 nt, Human
ggaaaagagauuaguuuccaaaaaugu

SEQ ID NO: 160404 - RNA, 18 nt, Human
ggaaacaaauaucgauug

SEQ ID NO: 160405 - RNA, 19 nt, Human
ggcagaggcggcgcgcccc

SEQ ID NO: 160406 - RNA, 21 nt, Human
gggacaguggugagaacaaag

SEQ ID NO: 160407 - RNA, 22 nt, Human
uaagucuucagacauguguguc

SEQ ID NO: 160408 - RNA, 21 nt, Human
uaauaaguucaugggaggucc

SEQ ID NO: 160409 - RNA, 20 nt, Human
uacuuuaaaugacauggcau

SEQ ID NO: 160410 - RNA, 21 nt, Human
uacuuuaaaugacauggcauu

SEQ ID NO: 160411 - RNA, 21 nt, Human
uagagccccaccagcugcuuc

SEQ ID NO: 160412 - RNA, 23 nt, Human
uagggacaguggugagaacaaag

SEQ ID NO: 160413 - RNA, 27 nt, Human
ucaacaguaguaggcuuaacauucuuc

SEQ ID NO: 160414 - RNA, 21 nt, Human
ucacugagcuaacacucagaa

SEQ ID NO: 160415 - RNA, 26 nt, Human
ucagcagccgcggccgccgccucucc

SEQ ID NO: 160416 - RNA, 21 nt, Human
ucagucccuuuucaaagaggc

SEQ ID NO: 160417 - RNA, 22 nt, Human
uccacuucuucaggaaagggcg

SEQ ID NO: 160418 - RNA, 20 nt, Human
ucuaaaccaaaaguauaauu

SEQ ID NO: 160419 - RNA, 21 nt, Human
ucugcaaagcuugguacagug

SEQ ID NO: 160420 - RNA, 22 nt, Human
ucuguaucaauaggaggaacau

SEQ ID NO: 160421 - RNA, 23 nt, Human
ugaaauaaaggaaauauuacgga

SEQ ID NO: 160422 - RNA, 25 nt, Human
ugaaguagacaaagaucagaaguca

SEQ ID NO: 160423 - RNA, 23 nt, Human
ugacauagggacaguggugagaa

SEQ ID NO: 160424 - RNA, 19 nt, Human
ugagaacaaaguaucccua

SEQ ID NO: 160425 - RNA, 22 nt, Human
ugagcuaacacucagaagccaa

SEQ ID NO: 160426 - RNA, 25 nt, Human
ugccauaaaccuuccauuuguaaaa

SEQ ID NO: 160427 - RNA, 21 nt, Human
ugccucagccuccgccucagc

SEQ ID NO: 160428 - RNA, 24 nt, Human
ugccucagccuccgccucagcagc

SEQ ID NO: 160429 - RNA, 23 nt, Human
ugcuaugaguaaagugcaugaaa

SEQ ID NO: 160430 - RNA, 18 nt, Human
uggcaggccuccacucuc

SEQ ID NO: 160431 - RNA, 20 nt, Human
ugggagguccaaagacaaag

SEQ ID NO: 160432 - RNA, 19 nt, Human
uggguggcaggccuccacu

SEQ ID NO: 160433 - RNA, 24 nt, Human
uguaaagagaaccaaucaccucca

SEQ ID NO: 160434 - RNA, 24 nt, Human
uguaaagagaaccaaucaccucca

SEQ ID NO: 160435 - RNA, 23 nt, Human
uguuuugcauaauuuaacuguuc

SEQ ID NO: 160436 - RNA, 18 nt, Human
uuaaaacucaaaauuauc

SEQ ID NO: 160437 - RNA, 18 nt, Human
uuaacauucuucaguccc

SEQ ID NO: 160438 - RNA, 22 nt, Human
uuugaacuccuugaaaguagca

SEQ ID NO: 160439 - RNA, 20 nt, Human
aaaacaacaacaacaaacaa

SEQ ID NO: 160440 - RNA, 23 nt, Human
aaacaacaacaacaaacaaugag

SEQ ID NO: 160441 - RNA, 18 nt, Human
aaagaaauaaauagauga

SEQ ID NO: 160442 - RNA, 22 nt, Human
aaauagaugagaagaggucaaa

SEQ ID NO: 160443 - RNA, 20 nt, Human
aaaugcaaucugaaugacaa

SEQ ID NO: 160444 - RNA, 23 nt, Human
aacagaauuuaaacaccuggaag

SEQ ID NO: 160445 - RNA, 22 nt, Human
aaccuccaucauagauucccac

SEQ ID NO: 160446 - RNA, 21 nt, Human
aaccuccugggcagacaccac

SEQ ID NO: 160447 - RNA, 22 nt, Human
aagcgccuugcucaaggaacag

SEQ ID NO: 160448 - RNA, 24 nt, Human
aagcuccggggccgaccuccggcc

SEQ ID NO: 160449 - RNA, 26 nt, Human
acaaacuuaaccccaauaggcuucau

SEQ ID NO: 160450 - RNA, 26 nt, Human
acagaaucaguucuccuggaagaggu

SEQ ID NO: 160451 - RNA, 19 nt, Human
acugccuacaaaugaccug

SEQ ID NO: 160452 - RNA, 20 nt, Human
agaaaagaagaaacuggcaa

SEQ ID NO: 160453 - RNA, 20 nt, Human
agaaaagaagaaacuggcaa

SEQ ID NO: 160454 - RNA, 19 nt, Human
agagaggaggucuggagag

SEQ ID NO: 160455 - RNA, 23 nt, Human
agagcugggggaggacugcaugu

SEQ ID NO: 160456 - RNA, 22 nt, Human
agaggcucaccgcgccgccgcc

SEQ ID NO: 160457 - RNA, 20 nt, Human
agcuguuugcuguaaugaau

SEQ ID NO: 160458 - RNA, 24 nt, Human
agcuguuuugaguggguugggcuc

SEQ ID NO: 160459 - RNA, 18 nt, Human
aggaggucuggagagcac

SEQ ID NO: 160460 - RNA, 19 nt, Human
agggaaagggcggccuugg

SEQ ID NO: 160461 - RNA, 21 nt, Human
agggagggaggguguggccuu

SEQ ID NO: 160462 - RNA, 20 nt, Human
aggguguggccuuggggggg

SEQ ID NO: 160463 - RNA, 23 nt, Human
caaacuuaaccccaauaggcuuc

SEQ ID NO: 160464 - RNA, 18 nt, Human
caaagaaccgaggcaucu

SEQ ID NO: 160465 - RNA, 19 nt, Human
caaaugaccugaccaaaau

SEQ ID NO: 160466 - RNA, 25 nt, Human
caagugaauuucgugaaaaccagca

SEQ ID NO: 160467 - RNA, 22 nt, Human
cacacuaaccucuccauccccc

SEQ ID NO: 160468 - RNA, 23 nt, Human
cacagcccgcgccccggggccgc

SEQ ID NO: 160469 - RNA, 22 nt, Human
caccgcgccgccgccgccgggu

SEQ ID NO: 160470 - RNA, 18 nt, Human
cacuagauccuggccuag

SEQ ID NO: 160471 - RNA, 20 nt, Human
cagagacgacagcauccagc

SEQ ID NO: 160472 - RNA, 21 nt, Human
caggagccuacaguaggagug

SEQ ID NO: 160473 - RNA, 20 nt, Human
caggccccugggcuccgcgg

SEQ ID NO: 160474 - RNA, 19 nt, Human
cagggccaaggauuaggga

SEQ ID NO: 160475 - RNA, 23 nt, Human
cagggccaaggauuagggacaau

SEQ ID NO: 160476 - RNA, 23 nt, Human
caucauagauucccaccccaagg

SEQ ID NO: 160477 - RNA, 18 nt, Human
ccaggcggggccgggcac

SEQ ID NO: 160478 - RNA, 25 nt, Human
ccaguaaccuccaucauagauuccc

SEQ ID NO: 160479 - RNA, 21 nt, Human
ccauccgcccgccccgauccc

SEQ ID NO: 160480 - RNA, 22 nt, Human
cccagggccaaggauuagggac

SEQ ID NO: 160481 - RNA, 18 nt, Human
ccccaguaaccuccaucc

SEQ ID NO: 160482 - RNA, 20 nt, Human
cccccaagcuccggggccga

SEQ ID NO: 160483 - RNA, 19 nt, Human
cccccauggcacagagccu

SEQ ID NO: 160484 - RNA, 18 nt, Human
ccccccaagcuccggggc

SEQ ID NO: 160485 - RNA, 22 nt, Human
ccccggggccgcccagaggcuc

SEQ ID NO: 160486 - RNA, 20 nt, Human
cccgauccccuccggugggc

SEQ ID NO: 160487 - RNA, 21 nt, Human
cccgcacuccagugggagggg

SEQ ID NO: 160488 - RNA, 25 nt, Human
cccgcgccccggggccgcccagagg

SEQ ID NO: 160489 - RNA, 18 nt, Human
cccugggcuccgcggcuc

SEQ ID NO: 160490 - RNA, 20 nt, Human
ccgccggguccccauccgcc

SEQ ID NO: 160491 - RNA, 21 nt, Human
ccgccggguccccauccgccc

SEQ ID NO: 160492 - RNA, 21 nt, Human
ccgcgccccggggccgcccag

SEQ ID NO: 160493 - RNA, 24 nt, Human
ccgcgccgccgccgccgggucccc

SEQ ID NO: 160494 - RNA, 22 nt, Human
ccuacaaaugaccugaccaagg

SEQ ID NO: 160495 - RNA, 23 nt, Human
ccucuguugcccaugagaaauga

SEQ ID NO: 160496 - RNA, 25 nt, Human
ccugaaacuucaaauagggucacaa

SEQ ID NO: 160497 - RNA, 18 nt, Human
cgacagcauccagccugg

SEQ ID NO: 160498 - RNA, 24 nt, Human
cgagggaaagggcggccuuggggg

SEQ ID NO: 160499 - RNA, 23 nt, Human
cgccccgauccccuccggugggc

SEQ ID NO: 160500 - RNA, 21 nt, Human
cgccgccgccgccgggucccc

SEQ ID NO: 160501 - RNA, 20 nt, Human
cgcgccccggggccgcccag

SEQ ID NO: 160502 - RNA, 22 nt, Human
cggccuggagagguccccgcac

SEQ ID NO: 160503 - RNA, 21 nt, Human
cggggagggcgcggcggccac

SEQ ID NO: 160504 - RNA, 21 nt, Human
cggggccgcccagaggcucac

SEQ ID NO: 160505 - RNA, 21 nt, Human
cguggaacugugggggugggg

SEQ ID NO: 160506 - RNA, 23 nt, Human
cuccagugggagggggugcugcg

SEQ ID NO: 160507 - RNA, 22 nt, Human
cuccaucauagauucccacccc

SEQ ID NO: 160508 - RNA, 25 nt, Human
cuccuucggcugccccugcgcgccc

SEQ ID NO: 160509 - RNA, 20 nt, Human
cugaaaucacauccauccac

SEQ ID NO: 160510 - RNA, 24 nt, Human
cugaaaucacauccauccacagaa

SEQ ID NO: 160511 - RNA, 25 nt, Human
cugccuacaaaugaccugaccaaaa

SEQ ID NO: 160512 - RNA, 25 nt, Human
cugcucauucucagaguauuaaacc

SEQ ID NO: 160513 - RNA, 22 nt, Human
cugcugagcuguuuccccaguu

SEQ ID NO: 160514 - RNA, 25 nt, Human
gaaauaaauagaugagaagagguca

SEQ ID NO: 160515 - RNA, 23 nt, Human
gaaauucucccacugaaacacag

SEQ ID NO: 160516 - RNA, 20 nt, Human
gacacccaaauccugaaacu

SEQ ID NO: 160517 - RNA, 20 nt, Human
gagaagagaaacugccuaca

SEQ ID NO: 160518 - RNA, 19 nt, Human
gaggccaugauguuugaaa

SEQ ID NO: 160519 - RNA, 23 nt, Human
gauaaugggcauuuugagaagaa

SEQ ID NO: 160520 - RNA, 26 nt, Human
gauaauuugaaguuucauccauuuaa

SEQ ID NO: 160521 - RNA, 23 nt, Human
gaugaacaggagacugggagaaa

SEQ ID NO: 160522 - RNA, 18 nt, Human
gcauguccuuccccagcu

SEQ ID NO: 160523 - RNA, 20 nt, Human
gcccagaggcucaccgcgcc

SEQ ID NO: 160524 - RNA, 20 nt, Human
gccccggggccgcccagagg

SEQ ID NO: 160525 - RNA, 24 nt, Human
gcccgccgucucccgggacacucc

SEQ ID NO: 160526 - RNA, 19 nt, Human
gccucuguugcccaugaga

SEQ ID NO: 160527 - RNA, 21 nt, Human
gccuugggggccugagcggag

SEQ ID NO: 160528 - RNA, 19 nt, Human
gcgcagcgccgcgcacagc

SEQ ID NO: 160529 - RNA, 20 nt, Human
gcggguccccggagcgagug

SEQ ID NO: 160530 - RNA, 19 nt, Human
gcugcagcacuuacaaucc

SEQ ID NO: 160531 - RNA, 18 nt, Human
gcuggugccucgcuagga

SEQ ID NO: 160532 - RNA, 23 nt, Human
ggagagguccccgcacuccagug

SEQ ID NO: 160533 - RNA, 23 nt, Human
ggggggggggcguggaacugugg

SEQ ID NO: 160534 - RNA, 22 nt, Human
gggugugggauugaagagagug

SEQ ID NO: 160535 - RNA, 21 nt, Human
gugaagugcuuuggccaaggu

SEQ ID NO: 160536 - RNA, 20 nt, Human
guggaaaacacgcagacaga

SEQ ID NO: 160537 - RNA, 18 nt, Human
uaaaaaggccugaaaagu

SEQ ID NO: 160538 - RNA, 20 nt, Human
uaaaugauucauuuccccca

SEQ ID NO: 160539 - RNA, 22 nt, Human
uaaaugauucauuucccccaac

SEQ ID NO: 160540 - RNA, 22 nt, Human
uaacaaagguggggcuuggcua

SEQ ID NO: 160541 - RNA, 22 nt, Human
uacagagacgacagcauccagc

SEQ ID NO: 160542 - RNA, 21 nt, Human
uacuccuauuugaaaacacug

SEQ ID NO: 160543 - RNA, 18 nt, Human
uagcuaaaugauucauuu

SEQ ID NO: 160544 - RNA, 21 nt, Human
uaggacagaugugccugaugc

SEQ ID NO: 160545 - RNA, 25 nt, Human
uaugccaaggugcuucuguguaugg

SEQ ID NO: 160546 - RNA, 19 nt, Human
ucacaagucacagagcuga

SEQ ID NO: 160547 - RNA, 21 nt, Human
ucagaaaaacuuuugaggaca

SEQ ID NO: 160548 - RNA, 21 nt, Human
ucaugcccgccgucucccggg

SEQ ID NO: 160549 - RNA, 21 nt, Human
ucauugacagagcugggggag

SEQ ID NO: 160550 - RNA, 25 nt, Human
uccaaaaaucugcugagcuguuucc

SEQ ID NO: 160551 - RNA, 21 nt, Human
uccccaguaaccuccaucaua

SEQ ID NO: 160552 - RNA, 19 nt, Human
uccccggggagggcgcggc

SEQ ID NO: 160553 - RNA, 19 nt, Human
ucccggaagaaagagcugu

SEQ ID NO: 160554 - RNA, 19 nt, Human
ucccugcucauucucagag

SEQ ID NO: 160555 - RNA, 19 nt, Human
ucuccaaaaaucugcugag

SEQ ID NO: 160556 - RNA, 19 nt, Human
ucucuggaucucccugcuc

SEQ ID NO: 160557 - RNA, 20 nt, Human
ucugcugagcuguuucccca

SEQ ID NO: 160558 - RNA, 21 nt, Human
ucugggaaagggccauguguu

SEQ ID NO: 160559 - RNA, 23 nt, Human
ugaaaacacugaguaaaagcaac

SEQ ID NO: 160560 - RNA, 19 nt, Human
ugaaagaaaccuccugggc

SEQ ID NO: 160561 - RNA, 26 nt, Human
ugaaagaaaccuccugggcagacacc

SEQ ID NO: 160562 - RNA, 20 nt, Human
ugaaaucacauccauccaca

SEQ ID NO: 160563 - RNA, 18 nt, Human
ugacaaagaaccgaggca

SEQ ID NO: 160564 - RNA, 21 nt, Human
ugacaaagaaccgaggcaucu

SEQ ID NO: 160565 - RNA, 21 nt, Human
ugacaagaauguccaugggug

SEQ ID NO: 160566 - RNA, 23 nt, Human
ugaguaaaagcaacugauggggg

SEQ ID NO: 160567 - RNA, 20 nt, Human
ugaugcaugccaggugugca

SEQ ID NO: 160568 - RNA, 22 nt, Human
ugauucugaugauggauccucg

SEQ ID NO: 160569 - RNA, 21 nt, Human
ugcacaaucuccugaaaucac

SEQ ID NO: 160570 - RNA, 21 nt, Human
ugcauguccuuccccagcugu

SEQ ID NO: 160571 - RNA, 20 nt, Human
uggaagaggucgaugccugg

SEQ ID NO: 160572 - RNA, 22 nt, Human
uggaggggggaaugcagaaagu

SEQ ID NO: 160573 - RNA, 19 nt, Human
uggcaaaagaggaugugag

SEQ ID NO: 160574 - RNA, 21 nt, Human
uggcaagacgguaugugcugg

SEQ ID NO: 160575 - RNA, 20 nt, Human
ugggagaaaagaagaaacug

SEQ ID NO: 160576 - RNA, 21 nt, Human
ugggagaaaagaagaaacugg

SEQ ID NO: 160577 - RNA, 21 nt, Human
ugggagggggugcugcguccc

SEQ ID NO: 160578 - RNA, 19 nt, Human
ugggcauuuugagaagaaa

SEQ ID NO: 160579 - RNA, 24 nt, Human
uggggggaucugggcuuugcugug

SEQ ID NO: 160580 - RNA, 20 nt, Human
uggggguggggccugugugc

SEQ ID NO: 160581 - RNA, 18 nt, Human
ugucaagggugucuaagu

SEQ ID NO: 160582 - RNA, 22 nt, Human
ugucucugccagcuguaggaca

SEQ ID NO: 160583 - RNA, 21 nt, Human
ugugaggaggugggagaggaa

SEQ ID NO: 160584 - RNA, 22 nt, Human
ugugauuaggugugcuggugcc

SEQ ID NO: 160585 - RNA, 24 nt, Human
ugugugcgagggaaagggcggccu

SEQ ID NO: 160586 - RNA, 19 nt, Human
uguuuugagugggugucgg

SEQ ID NO: 160587 - RNA, 21 nt, Human
uuagaauuaaaaaacaacaac

SEQ ID NO: 160588 - RNA, 26 nt, Human
uuagaauuaaaaaacaacaacaacaa

SEQ ID NO: 160589 - RNA, 23 nt, Human
uucaacuucuuucaugguuuuaa

SEQ ID NO: 160590 - RNA, 19 nt, Human
uuccaagggucugguuggu

SEQ ID NO: 160591 - RNA, 24 nt, Human
uugaaaacacugaguaaaagcaac

SEQ ID NO: 160592 - RNA, 24 nt, Human
uugcagccaaaggacauacaggac

SEQ ID NO: 160593 - RNA, 21 nt, Human
uuggaagacaguuuaggugau

SEQ ID NO: 160594 - RNA, 19 nt, Human
uugggggccugagcggagg

SEQ ID NO: 160595 - RNA, 19 nt, Human
uuggucuccaaaaaucugc

SEQ ID NO: 160596 - RNA, 20 nt, Human
aaaagguuucugggagugca

SEQ ID NO: 160597 - RNA, 18 nt, Human
aaacaaauggagcuccag

SEQ ID NO: 160598 - RNA, 22 nt, Human
aaacaaauggagcuccagaaau

SEQ ID NO: 160599 - RNA, 22 nt, Human
aacacucgagaucagcacccca

SEQ ID NO: 160600 - RNA, 20 nt, Human
aaggccaaccuugucacaga

SEQ ID NO: 160601 - RNA, 21 nt, Human
accccgagagcuggaggcggg

SEQ ID NO: 160602 - RNA, 18 nt, Human
acucgagaucagcacccc

SEQ ID NO: 160603 - RNA, 18 nt, Human
agaacagcaucagaaaac

SEQ ID NO: 160604 - RNA, 24 nt, Human
agagccccgccacaguggccgccc

SEQ ID NO: 160605 - RNA, 19 nt, Human
agguuucugggagugcaac

SEQ ID NO: 160606 - RNA, 22 nt, Human
auagagcgcccgccccucuccu

SEQ ID NO: 160607 - RNA, 20 nt, Human
caaggccaaccuugucacag

SEQ ID NO: 160608 - RNA, 19 nt, Human
cacaaucagaaaauaacac

SEQ ID NO: 160609 - RNA, 21 nt, Human
cagcaucagaaaacaaacuuc

SEQ ID NO: 160610 - RNA, 24 nt, Human
cauaccaccccuaggggggaagcc

SEQ ID NO: 160611 - RNA, 19 nt, Human
ccccaaacggcgacgaccc

SEQ ID NO: 160612 - RNA, 18 nt, Human
ccccgagagcuggaggcg

SEQ ID NO: 160613 - RNA, 20 nt, Human
cccgccccucuccugagggc

SEQ ID NO: 160614 - RNA, 20 nt, Human
cccggacuggcgacuaccgg

SEQ ID NO: 160615 - RNA, 19 nt, Human
ccgaggggccuggacccgg

SEQ ID NO: 160616 - RNA, 20 nt, Human
ccggagcugagggguagcug

SEQ ID NO: 160617 - RNA, 21 nt, Human
cgccacaguggccgcccugcc

SEQ ID NO: 160618 - RNA, 21 nt, Human
cgccccaaacggcgacgaccc

SEQ ID NO: 160619 - RNA, 19 nt, Human
cggggacggcggcggggcc

SEQ ID NO: 160620 - RNA, 22 nt, Human
cucaacaccacaaucagaaaau

SEQ ID NO: 160621 - RNA, 23 nt, Human
cuccuagagccgaccccgagagc

SEQ ID NO: 160622 - RNA, 21 nt, Human
cugguaagaacagcaucagaa

SEQ ID NO: 160623 - RNA, 23 nt, Human
gaaacggggaaagagccccgcca

SEQ ID NO: 160624 - RNA, 21 nt, Human
gacaucuguaguuuagaaaca

SEQ ID NO: 160625 - RNA, 19 nt, Human
gagccgaccccgagagcug

SEQ ID NO: 160626 - RNA, 21 nt, Human
gaguugacaucuguaguuuag

SEQ ID NO: 160627 - RNA, 23 nt, Human
gcagcucccgccccaaacggcga

SEQ ID NO: 160628 - RNA, 23 nt, Human
gcgaaacggggaaagagccccgc

SEQ ID NO: 160629 - RNA, 22 nt, Human
gggaaagagccccgccacagug

SEQ ID NO: 160630 - RNA, 19 nt, Human
uaccggagcugagggguag

SEQ ID NO: 160631 - RNA, 18 nt, Human
ucgagaucagcaccccaa

SEQ ID NO: 160632 - RNA, 22 nt, Human
ugagggcgccuccuagagccga

SEQ ID NO: 160633 - RNA, 24 nt, Human
uuuagaaacaaaaacaaauggagc

SEQ ID NO: 160634 - RNA, 20 nt, Human
aaaaacacacacaaaccaca

SEQ ID NO: 160635 - RNA, 24 nt, Human
aaaaacuaaaaaagcaaagccaac

SEQ ID NO: 160636 - RNA, 25 nt, Human
aaaaacuaaaaaagcaaagccaacu

SEQ ID NO: 160637 - RNA, 20 nt, Human
aaaaagcaaagccaacucaa

SEQ ID NO: 160638 - RNA, 23 nt, Human
aaaacuaaaaaagcaaagccaac

SEQ ID NO: 160639 - RNA, 24 nt, Human
aaaauccauucauucauucagaau

SEQ ID NO: 160640 - RNA, 19 nt, Human
aaacacacacaaaccacac

SEQ ID NO: 160641 - RNA, 23 nt, Human
aaagcaauauaaauuagaggcca

SEQ ID NO: 160642 - RNA, 20 nt, Human
aaaggccaucaucucccaag

SEQ ID NO: 160643 - RNA, 23 nt, Human
aaauccauucauucauucagaau

SEQ ID NO: 160644 - RNA, 20 nt, Human
aaccaauuccagcuucauaa

SEQ ID NO: 160645 - RNA, 25 nt, Human
aacuaaaaaagcaaagccaacucaa

SEQ ID NO: 160646 - RNA, 24 nt, Human
aagcaauauaaauuagaggccaag

SEQ ID NO: 160647 - RNA, 18 nt, Human
aagcacauuccacaguac

SEQ ID NO: 160648 - RNA, 21 nt, Human
aagcuaaggucuccuucucaa

SEQ ID NO: 160649 - RNA, 23 nt, Human
acacacacacugauccccacacc

SEQ ID NO: 160650 - RNA, 20 nt, Human
acaguuaauaaaagaaagag

SEQ ID NO: 160651 - RNA, 21 nt, Human
acauccaccuuaugaauggag

SEQ ID NO: 160652 - RNA, 19 nt, Human
acccugaaacgggugaaag

SEQ ID NO: 160653 - RNA, 26 nt, Human
acugauccccacaccguucucaaugc

SEQ ID NO: 160654 - RNA, 21 nt, Human
acuucagagcacccaccccuc

SEQ ID NO: 160655 - RNA, 21 nt, Human
acuuuauuaagaguauuggcu

SEQ ID NO: 160656 - RNA, 21 nt, Human
agaaaaagaauaagaacaaaa

SEQ ID NO: 160657 - RNA, 23 nt, Human
agaaaaagaauaagaacaaaaaa

SEQ ID NO: 160658 - RNA, 21 nt, Human
agaaaacccugaaacggguga

SEQ ID NO: 160659 - RNA, 24 nt, Human
agaaaggaaguauaaucccaaaaa

SEQ ID NO: 160660 - RNA, 27 nt, Human
agaaaggaaguauaaucccaaaaauau

SEQ ID NO: 160661 - RNA, 22 nt, Human
agagcccaggggccuucccuuu

SEQ ID NO: 160662 - RNA, 23 nt, Human
agaguuaggcugcuuugcaucua

SEQ ID NO: 160663 - RNA, 22 nt, Human
agcacagggggcccugacucca

SEQ ID NO: 160664 - RNA, 21 nt, Human
agccaaaugaauacuauggga

SEQ ID NO: 160665 - RNA, 20 nt, Human
agcuaaggucuccuucucaa

SEQ ID NO: 160666 - RNA, 21 nt, Human
aggcgggcagaggcggaggcg

SEQ ID NO: 160667 - RNA, 21 nt, Human
aggcgggcagaggcggaggcg

SEQ ID NO: 160668 - RNA, 21 nt, Human
aggcgggcagaggcggaggcg

SEQ ID NO: 160669 - RNA, 19 nt, Human
agguguuuggcacccaaaa

SEQ ID NO: 160670 - RNA, 18 nt, Human
agguuuacuuuauaggag

SEQ ID NO: 160671 - RNA, 19 nt, Human
agugucucaagcacagggg

SEQ ID NO: 160672 - RNA, 24 nt, Human
auaaaaacacuguaugaauacugc

SEQ ID NO: 160673 - RNA, 22 nt, Human
aucccaaaaauauuacuaaaac

SEQ ID NO: 160674 - RNA, 22 nt, Human
augcaaaaacaacaaaaaaucc

SEQ ID NO: 160675 - RNA, 23 nt, Human
augcaaaaacaacaaaaaaucca

SEQ ID NO: 160676 - RNA, 19 nt, Human
auucaaagguugucugcau

SEQ ID NO: 160677 - RNA, 24 nt, Human
caaaaacauaaauuaauuuaguaa

SEQ ID NO: 160678 - RNA, 19 nt, Human
caaaaggagaaugcuaacu

SEQ ID NO: 160679 - RNA, 22 nt, Human
caaagcaauauaaauuagaggc

SEQ ID NO: 160680 - RNA, 24 nt, Human
caaagcaauauaaauuagaggcca

SEQ ID NO: 160681 - RNA, 26 nt, Human
caaaggacaaaucagagcccaggggc

SEQ ID NO: 160682 - RNA, 21 nt, Human
caaaggccaucaucucccaag

SEQ ID NO: 160683 - RNA, 18 nt, Human
caaagugcaaagcaauau

SEQ ID NO: 160684 - RNA, 19 nt, Human
caacaacaaaauaaaaaca

SEQ ID NO: 160685 - RNA, 22 nt, Human
caagacuagaaaacccugaaac

SEQ ID NO: 160686 - RNA, 20 nt, Human
cacacaaaccacacacacgc

SEQ ID NO: 160687 - RNA, 23 nt, Human
cacacaaaccacacacacgcaau

SEQ ID NO: 160688 - RNA, 27 nt, Human
cacacacgcaaugacaacaacaaaauu

SEQ ID NO: 160689 - RNA, 25 nt, Human
cacacgcaaugacaacaacaaaauu

SEQ ID NO: 160690 - RNA, 22 nt, Human
cacagcagcagcugacaccaga

SEQ ID NO: 160691 - RNA, 20 nt, Human
caccguucucaaugcaaagg

SEQ ID NO: 160692 - RNA, 25 nt, Human
cacuccacuucagagcacccacccc

SEQ ID NO: 160693 - RNA, 19 nt, Human
cagagcccaggggccuucc

SEQ ID NO: 160694 - RNA, 21 nt, Human
cagcagcagcugacaccagag

SEQ ID NO: 160695 - RNA, 24 nt, Human
cagcagcgaacggcccgggcggag

SEQ ID NO: 160696 - RNA, 24 nt, Human
cagcagcgaacggcccgggcggag

SEQ ID NO: 160697 - RNA, 24 nt, Human
cagcagcgaacggcccgggcggag

SEQ ID NO: 160698 - RNA, 25 nt, Human
caggaugcaugaauuccagagccaa

SEQ ID NO: 160699 - RNA, 20 nt, Human
caugcaaaaacaacaaaaaa

SEQ ID NO: 160700 - RNA, 22 nt, Human
caugcaaaaacaacaaaaaauc

SEQ ID NO: 160701 - RNA, 25 nt, Human
caugcaaaaacaacaaaaaauccau

SEQ ID NO: 160702 - RNA, 23 nt, Human
ccacaguacaaagcugucaugaa

SEQ ID NO: 160703 - RNA, 20 nt, Human
ccagaguauggcugggaauu

SEQ ID NO: 160704 - RNA, 19 nt, Human
cccaaaaauauuacuaaaa

SEQ ID NO: 160705 - RNA, 19 nt, Human
cccaccccucagcaugggc

SEQ ID NO: 160706 - RNA, 22 nt, Human
cccacucuagcugccagcccgc

SEQ ID NO: 160707 - RNA, 22 nt, Human
cccacucuagcugccagcccgc

SEQ ID NO: 160708 - RNA, 19 nt, Human
cccauggcuaagugcgaac

SEQ ID NO: 160709 - RNA, 21 nt, Human
cccccucccuucccccugggc

SEQ ID NO: 160710 - RNA, 18 nt, Human
ccccgccucgcucucccc

SEQ ID NO: 160711 - RNA, 18 nt, Human
ccccgccucgcucucccc

SEQ ID NO: 160712 - RNA, 18 nt, Human
ccccgccucgcucucccc

SEQ ID NO: 160713 - RNA, 20 nt, Human
ccccgccucgcucuccccgc

SEQ ID NO: 160714 - RNA, 20 nt, Human
ccccgccucgcucuccccgc

SEQ ID NO: 160715 - RNA, 20 nt, Human
ccccgccucgcucuccccgc

SEQ ID NO: 160716 - RNA, 23 nt, Human
ccccgcgcagcagcgaacggccc

SEQ ID NO: 160717 - RNA, 23 nt, Human
ccccgcgcagcagcgaacggccc

SEQ ID NO: 160718 - RNA, 23 nt, Human
ccccgcgcagcagcgaacggccc

SEQ ID NO: 160719 - RNA, 21 nt, Human
ccccucagcaugggccucuga

SEQ ID NO: 160720 - RNA, 19 nt, Human
ccccugcccccucccuucc

SEQ ID NO: 160721 - RNA, 20 nt, Human
ccccugcccccucccuuccc

SEQ ID NO: 160722 - RNA, 19 nt, Human
ccccugggcuuuccuaacc

SEQ ID NO: 160723 - RNA, 20 nt, Human
cccucagcaugggccucuga

SEQ ID NO: 160724 - RNA, 21 nt, Human
cccuggacauucuggguaggu

SEQ ID NO: 160725 - RNA, 18 nt, Human
cccugggcuuuccuaacc

SEQ ID NO: 160726 - RNA, 18 nt, Human
ccgcccgggccgccggca

SEQ ID NO: 160727 - RNA, 18 nt, Human
ccgcccgggccgccggca

SEQ ID NO: 160728 - RNA, 23 nt, Human
ccgccggcagcuccgcccucccc

SEQ ID NO: 160729 - RNA, 23 nt, Human
ccggcggccccgccucgcucucc

SEQ ID NO: 160730 - RNA, 23 nt, Human
ccggcggccccgccucgcucucc

SEQ ID NO: 160731 - RNA, 20 nt, Human
ccucugaaccagccugaccu

SEQ ID NO: 160732 - RNA, 22 nt, Human
ccugcaggcuccaacacaccag

SEQ ID NO: 160733 - RNA, 28 nt, Human
ccugcaggcuccaacacaccagcaggcc

SEQ ID NO: 160734 - RNA, 23 nt, Human
ccugcuggggccacagcagcagc

SEQ ID NO: 160735 - RNA, 20 nt, Human
cgccucgcucuccccgcgca

SEQ ID NO: 160736 - RNA, 20 nt, Human
cgccucgcucuccccgcgca

SEQ ID NO: 160737 - RNA, 20 nt, Human
cgccucgcucuccccgcgca

SEQ ID NO: 160738 - RNA, 22 nt, Human
cggcccgggcggaggaggcgac

SEQ ID NO: 160739 - RNA, 22 nt, Human
cggcccgggcggaggaggcgac

SEQ ID NO: 160740 - RNA, 22 nt, Human
cggcccgggcggaggaggcgac

SEQ ID NO: 160741 - RNA, 24 nt, Human
cggcccgggcggaggaggcgacgg

SEQ ID NO: 160742 - RNA, 24 nt, Human
cggcccgggcggaggaggcgacgg

SEQ ID NO: 160743 - RNA, 24 nt, Human
cggcccgggcggaggaggcgacgg

SEQ ID NO: 160744 - RNA, 22 nt, Human
cggcggccccgccucgcucucc

SEQ ID NO: 160745 - RNA, 21 nt, Human
cuccccugcccccucccuucc

SEQ ID NO: 160746 - RNA, 21 nt, Human
cucugaaccagccugaccugc

SEQ ID NO: 160747 - RNA, 18 nt, Human
cuggacauucuggguagg

SEQ ID NO: 160748 - RNA, 20 nt, Human
cuucagagcacccaccccuc

SEQ ID NO: 160749 - RNA, 19 nt, Human
cuugagcccagcccauggc

SEQ ID NO: 160750 - RNA, 20 nt, Human
cuugagcccagcccauggcc

SEQ ID NO: 160751 - RNA, 29 nt, Human
gaaaaacuaaaaaagcaaagccaacucag

SEQ ID NO: 160752 - RNA, 27 nt, Human
gagaaaaagaauaagaacaaaaaaugu

SEQ ID NO: 160753 - RNA, 18 nt, Human
gagcccaggggccuuccc

SEQ ID NO: 160754 - RNA, 23 nt, Human
gagcccaggggccuucccuuuag

SEQ ID NO: 160755 - RNA, 23 nt, Human
gagccggaaucagaggugagaaa

SEQ ID NO: 160756 - RNA, 22 nt, Human
gaguuaggcugcuuugcaucua

SEQ ID NO: 160757 - RNA, 26 nt, Human
gccccggcggccccgccucgcucucc

SEQ ID NO: 160758 - RNA, 26 nt, Human
gccccggcggccccgccucgcucucc

SEQ ID NO: 160759 - RNA, 26 nt, Human
gccccggcggccccgccucgcucucc

SEQ ID NO: 160760 - RNA, 18 nt, Human
gccuccuccccugccccc

SEQ ID NO: 160761 - RNA, 18 nt, Human
gccucgcucuccccgcgc

SEQ ID NO: 160762 - RNA, 21 nt, Human
gccucgcucuccccgcgcagc

SEQ ID NO: 160763 - RNA, 21 nt, Human
gccucgcucuccccgcgcagc

SEQ ID NO: 160764 - RNA, 21 nt, Human
gccucgcucuccccgcgcagc

SEQ ID NO: 160765 - RNA, 24 nt, Human
gcggaggcgggcagaggcggaggc

SEQ ID NO: 160766 - RNA, 24 nt, Human
gcggaggcgggcagaggcggaggc

SEQ ID NO: 160767 - RNA, 20 nt, Human
gcggccccgccucgcucucc

SEQ ID NO: 160768 - RNA, 18 nt, Human
gcgggcagaggcggaggc

SEQ ID NO: 160769 - RNA, 18 nt, Human
ggacaaaucagagcccag

SEQ ID NO: 160770 - RNA, 22 nt, Human
ggaggcgggcagaggcggaggc

SEQ ID NO: 160771 - RNA, 22 nt, Human
ggaggcgggcagaggcggaggc

SEQ ID NO: 160772 - RNA, 22 nt, Human
ggaggcgggcagaggcggaggc

SEQ ID NO: 160773 - RNA, 22 nt, Human
ggaugccaacguccuuuccaug

SEQ ID NO: 160774 - RNA, 19 nt, Human
ggcgacggcggaggcgggc

SEQ ID NO: 160775 - RNA, 19 nt, Human
ggcgacggcggaggcgggc

SEQ ID NO: 160776 - RNA, 19 nt, Human
ggcgacggcggaggcgggc

SEQ ID NO: 160777 - RNA, 21 nt, Human
ggcggccccgccucgcucucc

SEQ ID NO: 160778 - RNA, 21 nt, Human
ggcggccccgccucgcucucc

SEQ ID NO: 160779 - RNA, 20 nt, Human
gggaaggaaacgggcuucug

SEQ ID NO: 160780 - RNA, 19 nt, Human
gggcagaggcggaggcggc

SEQ ID NO: 160781 - RNA, 19 nt, Human
gggcagaggcggaggcggc

SEQ ID NO: 160782 - RNA, 19 nt, Human
gggcagaggcggaggcggc

SEQ ID NO: 160783 - RNA, 18 nt, Human
gggccucugaaccagccu

SEQ ID NO: 160784 - RNA, 19 nt, Human
gggcggaggaggcgacggc

SEQ ID NO: 160785 - RNA, 19 nt, Human
gggcggaggaggcgacggc

SEQ ID NO: 160786 - RNA, 19 nt, Human
gggcggaggaggcgacggc

SEQ ID NO: 160787 - RNA, 26 nt, Human
guacauuauaucuacaugcgaauaca

SEQ ID NO: 160788 - RNA, 20 nt, Human
gucuccuucucaaaggagag

SEQ ID NO: 160789 - RNA, 24 nt, Human
uaaaacaagauucucauuaaaaac

SEQ ID NO: 160790 - RNA, 23 nt, Human
uaaaagaaagagcuauauuaccu

SEQ ID NO: 160791 - RNA, 21 nt, Human
uaaaauguuauugacauuccu

SEQ ID NO: 160792 - RNA, 21 nt, Human
uaagcacauuccacaguacaa

SEQ ID NO: 160793 - RNA, 24 nt, Human
uacccauacucgauuuauugacau

SEQ ID NO: 160794 - RNA, 21 nt, Human
uacugcaggaaggguucuagg

SEQ ID NO: 160795 - RNA, 18 nt, Human
uagaaaacccugaaacgg

SEQ ID NO: 160796 - RNA, 18 nt, Human
uagcaaaauaaaguccag

SEQ ID NO: 160797 - RNA, 22 nt, Human
uagccaguaguucaagacuaga

SEQ ID NO: 160798 - RNA, 21 nt, Human
uagcugaaguaacaauugcau

SEQ ID NO: 160799 - RNA, 19 nt, Human
uaggaugaaaaguggucaa

SEQ ID NO: 160800 - RNA, 24 nt, Human
uagguguuuggcacccaaaauuuc

SEQ ID NO: 160801 - RNA, 20 nt, Human
uagugucucaagcacagggg

SEQ ID NO: 160802 - RNA, 21 nt, Human
uauguacauuauaucuacaug

SEQ ID NO: 160803 - RNA, 23 nt, Human
uauguacauuauaucuacaugcg

SEQ ID NO: 160804 - RNA, 31 nt, Human
uccagagccaagacagcccgucaacagggcc

SEQ ID NO: 160805 - RNA, 20 nt, Human
uccagaguauggcugggaau

SEQ ID NO: 160806 - RNA, 18 nt, Human
uccccugcccccucccuu

SEQ ID NO: 160807 - RNA, 21 nt, Human
ucccuuaggcauuugguagcc

SEQ ID NO: 160808 - RNA, 20 nt, Human
uccuccccugcccccucccu

SEQ ID NO: 160809 - RNA, 19 nt, Human
ucuacaugcgaauacagua

SEQ ID NO: 160810 - RNA, 18 nt, Human
ucuccuucucaaaggaga

SEQ ID NO: 160811 - RNA, 21 nt, Human
ucugcauauucaaaggccauc

SEQ ID NO: 160812 - RNA, 24 nt, Human
ucuuaauaucaaaccaaagugcaa

SEQ ID NO: 160813 - RNA, 18 nt, Human
ugaaaaguggucaaagcu

SEQ ID NO: 160814 - RNA, 19 nt, Human
ugaaagcccuggacauucu

SEQ ID NO: 160815 - RNA, 21 nt, Human
ugaaccagccugaccugcccu

SEQ ID NO: 160816 - RNA, 22 nt, Human
ugaaccagccugaccugcccug

SEQ ID NO: 160817 - RNA, 21 nt, Human
ugaacgaacucccuuaggcau

SEQ ID NO: 160818 - RNA, 24 nt, Human
ugaagaguuaggcugcuuugcauc

SEQ ID NO: 160819 - RNA, 19 nt, Human
ugacagcgaagccaaauga

SEQ ID NO: 160820 - RNA, 21 nt, Human
ugagguuaaacuguuauguac

SEQ ID NO: 160821 - RNA, 19 nt, Human
ugccuccuccccugccccc

SEQ ID NO: 160822 - RNA, 23 nt, Human
uggaaacaauggcgaagggcaaa

SEQ ID NO: 160823 - RNA, 18 nt, Human
uggcacccaaaauuucac

SEQ ID NO: 160824 - RNA, 20 nt, Human
uggggccacagcagcagcug

SEQ ID NO: 160825 - RNA, 19 nt, Human
ugguagauaauauaacuga

SEQ ID NO: 160826 - RNA, 20 nt, Human
ugguuagcaaaauaaagucc

SEQ ID NO: 160827 - RNA, 22 nt, Human
ugugaacgaacucccuuaggca

SEQ ID NO: 160828 - RNA, 22 nt, Human
uuaaaagaaaaacuaaaaaagc

SEQ ID NO: 160829 - RNA, 22 nt, Human
uuauguacauuauaucuacaug

SEQ ID NO: 160830 - RNA, 22 nt, Human
uucacuccacuucagagcaccc

SEQ ID NO: 160831 - RNA, 23 nt, Human
uucacuccacuucagagcaccca

SEQ ID NO: 160832 - RNA, 23 nt, Human
uucagagcacccaccccucagca

SEQ ID NO: 160833 - RNA, 19 nt, Human
uucuggguagguguuuggc

SEQ ID NO: 160834 - RNA, 21 nt, Human
uuggcaaacauaauuaauuac

SEQ ID NO: 160835 - RNA, 20 nt, Human
uuuaaaauguuauugacauu

SEQ ID NO: 160836 - RNA, 18 nt, Human
aaaagaacaggcuagcag

SEQ ID NO: 160837 - RNA, 21 nt, Human
aaaaugacuuuuuguugcaga

SEQ ID NO: 160838 - RNA, 21 nt, Human
aauaaugagagagaacggaga

SEQ ID NO: 160839 - RNA, 18 nt, Human
aaugagagagaacggaga

SEQ ID NO: 160840 - RNA, 20 nt, Human
acuaucagaagaugcaaagg

SEQ ID NO: 160841 - RNA, 20 nt, Human
agaaaauaaagaaauaauug

SEQ ID NO: 160842 - RNA, 28 nt, Human
agggaauaaugagagagaaccgguaccc

SEQ ID NO: 160843 - RNA, 24 nt, Human
augagacagcagacgccucucuug

SEQ ID NO: 160844 - RNA, 20 nt, Human
caagccaacauccugcacca

SEQ ID NO: 160845 - RNA, 26 nt, Human
caaucuguugccccaagccaacaucc

SEQ ID NO: 160846 - RNA, 19 nt, Human
cagcuugacugagaagaac

SEQ ID NO: 160847 - RNA, 21 nt, Human
cagcuugacugagaagaacuc

SEQ ID NO: 160848 - RNA, 21 nt, Human
cagggggaagggcagggagua

SEQ ID NO: 160849 - RNA, 18 nt, Human
caguuaugguuugucauc

SEQ ID NO: 160850 - RNA, 18 nt, Human
ccccaagccaacauccug

SEQ ID NO: 160851 - RNA, 19 nt, Human
ccccaagccaacauccugc

SEQ ID NO: 160852 - RNA, 20 nt, Human
cccucagucaaaagugaagc

SEQ ID NO: 160853 - RNA, 21 nt, Human
ccugguuugauuuagaaaguc

SEQ ID NO: 160854 - RNA, 22 nt, Human
cucgagggaauaaugagagaga

SEQ ID NO: 160855 - RNA, 21 nt, Human
cugcccaaugaccacuggaga

SEQ ID NO: 160856 - RNA, 21 nt, Human
cuguaggucuuuucaaucuuu

SEQ ID NO: 160857 - RNA, 25 nt, Human
cuuuuuguugcagaugcucucuaau

SEQ ID NO: 160858 - RNA, 24 nt, Human
gacuuuuuguugcagaugcucucu

SEQ ID NO: 160859 - RNA, 18 nt, Human
gagaagauuauuggagga

SEQ ID NO: 160860 - RNA, 22 nt, Human
gcaaagcugcccucagucaaaa

SEQ ID NO: 160861 - RNA, 21 nt, Human
gcagggaguauaucgucuaca

SEQ ID NO: 160862 - RNA, 19 nt, Human
gcccaaugaccacuggaga

SEQ ID NO: 160863 - RNA, 24 nt, Human
uagaaagucaaccaguacuuguuu

SEQ ID NO: 160864 - RNA, 22 nt, Human
ucagaagaugcaaagguuuuca

SEQ ID NO: 160865 - RNA, 28 nt, Human
ucuuuucuuuuuuucuuuuugcaggggg

SEQ ID NO: 160866 - RNA, 24 nt, Human
ugagaagaacucgagggaauaaug

SEQ ID NO: 160867 - RNA, 25 nt, Human
ugagagagaacggagaagauuauug

SEQ ID NO: 160868 - RNA, 26 nt, Human
ugagagagaacggagaagauuauugg

SEQ ID NO: 160869 - RNA, 23 nt, Human
uguaggucuuuucaaucuguugc

SEQ ID NO: 160870 - RNA, 21 nt, Human
uguugccccaagccaacaucc

SEQ ID NO: 160871 - RNA, 19 nt, Human
uguuucagcauuaacacug

SEQ ID NO: 160872 - RNA, 19 nt, Human
uucagcauuaacacugccc

SEQ ID NO: 160873 - RNA, 24 nt, Human
uucuucuuuuccuucuuagucugu

SEQ ID NO: 160874 - RNA, 23 nt, Human
uugauauuauugcaguuccuuuc

SEQ ID NO: 160875 - RNA, 18 nt, Human
uuuguugcagaugcucuc

SEQ ID NO: 160876 - RNA, 23 nt, Human
uuuucuuuuugcagggggaaggg

SEQ ID NO: 160877 - RNA, 22 nt, Human
aaacaggauauaaaaaaucaga

SEQ ID NO: 160878 - RNA, 23 nt, Human
aaacaggauauaaaaaaucagaa

SEQ ID NO: 160879 - RNA, 22 nt, Human
aaacugaguuagcccuucuguu

SEQ ID NO: 160880 - RNA, 18 nt, Human
aaagagaagaacaaugaa

SEQ ID NO: 160881 - RNA, 24 nt, Human
aaagagcaagacucuaucccggaa

SEQ ID NO: 160882 - RNA, 20 nt, Human
aaauaccuaaucacaucucu

SEQ ID NO: 160883 - RNA, 27 nt, Human
aacaaugaaggaagaaaagggagggcc

SEQ ID NO: 160884 - RNA, 19 nt, Human
aacacagugaaaccccauc

SEQ ID NO: 160885 - RNA, 20 nt, Human
aacacagugaaaccccaucu

SEQ ID NO: 160886 - RNA, 20 nt, Human
aacacagugaaaccccaucu

SEQ ID NO: 160887 - RNA, 21 nt, Human
aacacagugaaaccccaucuc

SEQ ID NO: 160888 - RNA, 21 nt, Human
aacacagugaaaccccaucuc

SEQ ID NO: 160889 - RNA, 24 nt, Human
aacagagugagacucugucucaaa

SEQ ID NO: 160890 - RNA, 19 nt, Human
aacauggugaaacccuguc

SEQ ID NO: 160891 - RNA, 20 nt, Human
aacauggugaaacccugucu

SEQ ID NO: 160892 - RNA, 23 nt, Human
aacccugucuggagaacucuagc

SEQ ID NO: 160893 - RNA, 23 nt, Human
aagguggguggaucaccugaggu

SEQ ID NO: 160894 - RNA, 25 nt, Human
aagguggguggaucaccugagguca

SEQ ID NO: 160895 - RNA, 25 nt, Human
aaucacuugaacccaagagguucaa

SEQ ID NO: 160896 - RNA, 18 nt, Human
aauugcuugaaccuggga

SEQ ID NO: 160897 - RNA, 23 nt, Human
aauugcuugaaccugggaggcga

SEQ ID NO: 160898 - RNA, 23 nt, Human
acagagccagacucugucucaaa

SEQ ID NO: 160899 - RNA, 24 nt, Human
acagagccagacucugucucaaaa

SEQ ID NO: 160900 - RNA, 21 nt, Human
acagagugagacucugucuca

SEQ ID NO: 160901 - RNA, 23 nt, Human
acagagugagacucugucucaaa

SEQ ID NO: 160902 - RNA, 19 nt, Human
acaggcucacgccaccacg

SEQ ID NO: 160903 - RNA, 22 nt, Human
acaggcucacgccaccacgccc

SEQ ID NO: 160904 - RNA, 24 nt, Human
acccaggcuggagugcaauggcgu

SEQ ID NO: 160905 - RNA, 24 nt, Human
acccaggcuggagugcaauggcgu

SEQ ID NO: 160906 - RNA, 24 nt, Human
accccaucucuacuaaaaauacaa

SEQ ID NO: 160907 - RNA, 22 nt, Human
acccugucuggagaacucuagc

SEQ ID NO: 160908 - RNA, 24 nt, Human
accugaggucaggaguucgagacc

SEQ ID NO: 160909 - RNA, 22 nt, Human
acgccaccacgcccggccaggc

SEQ ID NO: 160910 - RNA, 24 nt, Human
acugcacuccagccugggugacag

SEQ ID NO: 160911 - RNA, 26 nt, Human
acugcacuccagccugggugacagag

SEQ ID NO: 160912 - RNA, 26 nt, Human
acugcacuccagccuuggcgaaagag

SEQ ID NO: 160913 - RNA, 19 nt, Human
acugcacuccagccuuggg

SEQ ID NO: 160914 - RNA, 24 nt, Human
acugcacuucagccugggugacag

SEQ ID NO: 160915 - RNA, 26 nt, Human
acugcacuucagccugggugacagag

SEQ ID NO: 160916 - RNA, 18 nt, Human
agagcaagacucuauccc

SEQ ID NO: 160917 - RNA, 18 nt, Human
agagccagacucugucuc

SEQ ID NO: 160918 - RNA, 21 nt, Human
agagguucaaugagccgagau

SEQ ID NO: 160919 - RNA, 23 nt, Human
agagguucaaugagccgagauug

SEQ ID NO: 160920 - RNA, 24 nt, Human
agcacuuugggaggccaagguggg

SEQ ID NO: 160921 - RNA, 24 nt, Human
agcacuuugggaggccgaggcagg

SEQ ID NO: 160922 - RNA, 24 nt, Human
agccuggccaacacagugaaaccc

SEQ ID NO: 160923 - RNA, 22 nt, Human
agccuggccaacauggugaaac

SEQ ID NO: 160924 - RNA, 24 nt, Human
agccuggccaacauggugaaaccc

SEQ ID NO: 160925 - RNA, 24 nt, Human
agccugggugacagagccagacuc

SEQ ID NO: 160926 - RNA, 23 nt, Human
agcugggugcagugguaugugcc

SEQ ID NO: 160927 - RNA, 20 nt, Human
aggaaguaugaggacagagc

SEQ ID NO: 160928 - RNA, 22 nt, Human
aggcaggagaauugcuugaacc

SEQ ID NO: 160929 - RNA, 24 nt, Human
aggcaggagaauugcuugaaccug

SEQ ID NO: 160930 - RNA, 18 nt, Human
aggcagguggaucaccug

SEQ ID NO: 160931 - RNA, 21 nt, Human
aggcagguggaucaccugagg

SEQ ID NO: 160932 - RNA, 22 nt, Human
aggcagguggaucaccugaggu

SEQ ID NO: 160933 - RNA, 21 nt, Human
aggccaagguggguggaucac

SEQ ID NO: 160934 - RNA, 21 nt, Human
aggccgaggcagguggaucac

SEQ ID NO: 160935 - RNA, 19 nt, Human
aggcgaagguugcagugag

SEQ ID NO: 160936 - RNA, 24 nt, Human
aggcgaagguugcagugagucgag

SEQ ID NO: 160937 - RNA, 24 nt, Human
aggcgcgguggcucacgccuguaa

SEQ ID NO: 160938 - RNA, 24 nt, Human
aggcgugguggcucaugccuauaa

SEQ ID NO: 160939 - RNA, 24 nt, Human
agugauucuccugccucagccucc

SEQ ID NO: 160940 - RNA, 23 nt, Human
agugcaauggcgugaucuuggcu

SEQ ID NO: 160941 - RNA, 23 nt, Human
agugcaauggcgugaucuuggcu

SEQ ID NO: 160942 - RNA, 24 nt, Human
agugcaauggcgugaucuuggcuc

SEQ ID NO: 160943 - RNA, 24 nt, Human
agugcaauggcgugaucuuggcuc

SEQ ID NO: 160944 - RNA, 24 nt, Human
agugguaugugccuguaauuccag

SEQ ID NO: 160945 - RNA, 24 nt, Human
aucaccugaggucaggaguucgag

SEQ ID NO: 160946 - RNA, 21 nt, Human
aucaccugaggucgggaguuc

SEQ ID NO: 160947 - RNA, 25 nt, Human
aucgugccacugcacuccagccuug

SEQ ID NO: 160948 - RNA, 23 nt, Human
augaaacaaacugaguuagcccu

SEQ ID NO: 160949 - RNA, 19 nt, Human
augccuauaaucucagcac

SEQ ID NO: 160950 - RNA, 20 nt, Human
augugccuguaauuccagcu

SEQ ID NO: 160951 - RNA, 24 nt, Human
auugcuccacugcacuccagccug

SEQ ID NO: 160952 - RNA, 24 nt, Human
auugcuccacugcacuucagccug

SEQ ID NO: 160953 - RNA, 21 nt, Human
caacauggugaaacccugucu

SEQ ID NO: 160954 - RNA, 22 nt, Human
caacauggugaaacccugucug

SEQ ID NO: 160955 - RNA, 24 nt, Human
caagguggguggaucaccugaggu

SEQ ID NO: 160956 - RNA, 26 nt, Human
caagguggguggaucaccugagguca

SEQ ID NO: 160957 - RNA, 22 nt, Human
caagugauucuccugccucagc

SEQ ID NO: 160958 - RNA, 23 nt, Human
cacaucuauugccucacaacaaa

SEQ ID NO: 160959 - RNA, 23 nt, Human
caccugaggucaggaguucgaga

SEQ ID NO: 160960 - RNA, 19 nt, Human
cacgccaccacgcccggcc

SEQ ID NO: 160961 - RNA, 24 nt, Human
cacgccuguaaucccagcacuuug

SEQ ID NO: 160962 - RNA, 27 nt, Human
cacggccucagccccguugccgguucc

SEQ ID NO: 160963 - RNA, 22 nt, Human
cacuccagccugggugacagag

SEQ ID NO: 160964 - RNA, 23 nt, Human
cacuccagccugggugacagagc

SEQ ID NO: 160965 - RNA, 23 nt, Human
cacuccagccuuggcgaaagagc

SEQ ID NO: 160966 - RNA, 23 nt, Human
cacugcaacagcugccuccuggg

SEQ ID NO: 160967 - RNA, 23 nt, Human
cacugcaacagcugccuccuggg

SEQ ID NO: 160968 - RNA, 19 nt, Human
cacugcacuccagccuggg

SEQ ID NO: 160969 - RNA, 21 nt, Human
cacugcacuccagccugggug

SEQ ID NO: 160970 - RNA, 22 nt, Human
cacugcacuccagccuggguga

SEQ ID NO: 160971 - RNA, 23 nt, Human
cacugcacuccagccugggugac

SEQ ID NO: 160972 - RNA, 24 nt, Human
cacugcacuccagccugggugaca

SEQ ID NO: 160973 - RNA, 25 nt, Human
cacugcacuccagccugggugacag

SEQ ID NO: 160974 - RNA, 19 nt, Human
cacugcacuccagccuugg

SEQ ID NO: 160975 - RNA, 20 nt, Human
cacugcacuccagccuuggc

SEQ ID NO: 160976 - RNA, 21 nt, Human
cacugcacuccagccuuggcg

SEQ ID NO: 160977 - RNA, 22 nt, Human
cacugcacuccagccuuggcga

SEQ ID NO: 160978 - RNA, 27 nt, Human
cacugcacuccagccuuggcgaaagag

SEQ ID NO: 160979 - RNA, 19 nt, Human
cacugcacuucagccuggg

SEQ ID NO: 160980 - RNA, 19 nt, Human
cacugcacuucagccuggg

SEQ ID NO: 160981 - RNA, 19 nt, Human
cacugcacuucagccuggg

SEQ ID NO: 160982 - RNA, 21 nt, Human
cacugcacuucagccugggug

SEQ ID NO: 160983 - RNA, 22 nt, Human
cacugcacuucagccuggguga

SEQ ID NO: 160984 - RNA, 23 nt, Human
cacugcacuucagccugggugac

SEQ ID NO: 160985 - RNA, 24 nt, Human
cacugcacuucagccugggugaca

SEQ ID NO: 160986 - RNA, 24 nt, Human
cacugcacuucagccugggugaca

SEQ ID NO: 160987 - RNA, 25 nt, Human
cacugcacuucagccugggugacag

SEQ ID NO: 160988 - RNA, 22 nt, Human
cacuucagccugggugacagag

SEQ ID NO: 160989 - RNA, 23 nt, Human
cacuucagccugggugacagagc

SEQ ID NO: 160990 - RNA, 21 nt, Human
cagcacuuugggaggccaagg

SEQ ID NO: 160991 - RNA, 24 nt, Human
cagcacuuugggaggccaaggugg

SEQ ID NO: 160992 - RNA, 24 nt, Human
cagcacuuugggaggccgaggcag

SEQ ID NO: 160993 - RNA, 26 nt, Human
cagcacuuugggaggccgaggcaggu

SEQ ID NO: 160994 - RNA, 20 nt, Human
cagccuccugaguagcuggg

SEQ ID NO: 160995 - RNA, 24 nt, Human
cagguggaucaccugaggucggga

SEQ ID NO: 160996 - RNA, 20 nt, Human
caugccuauaaucucagcac

SEQ ID NO: 160997 - RNA, 24 nt, Human
caugccuauaaucucagcacuuug

SEQ ID NO: 160998 - RNA, 18 nt, Human
ccacugcacuccagccug

SEQ ID NO: 160999 - RNA, 20 nt, Human
ccacugcacuccagccuggg

SEQ ID NO: 161000 - RNA, 20 nt, Human
ccacugcacuccagccuggg

SEQ ID NO: 161001 - RNA, 21 nt, Human
ccacugcacuccagccugggu

SEQ ID NO: 161002 - RNA, 23 nt, Human
ccacugcacuccagccuggguga

SEQ ID NO: 161003 - RNA, 24 nt, Human
ccacugcacuccagccugggugac

SEQ ID NO: 161004 - RNA, 20 nt, Human
ccacugcacuccagccuugg

SEQ ID NO: 161005 - RNA, 20 nt, Human
ccacugcacuccagccuugg

SEQ ID NO: 161006 - RNA, 21 nt, Human
ccacugcacuccagccuuggc

SEQ ID NO: 161007 - RNA, 18 nt, Human
ccacugcacuucagccug

SEQ ID NO: 161008 - RNA, 20 nt, Human
ccacugcacuucagccuggg

SEQ ID NO: 161009 - RNA, 20 nt, Human
ccacugcacuucagccuggg

SEQ ID NO: 161010 - RNA, 20 nt, Human
ccacugcacuucagccuggg

SEQ ID NO: 161011 - RNA, 20 nt, Human
ccacugcacuucagccuggg

SEQ ID NO: 161012 - RNA, 21 nt, Human
ccacugcacuucagccugggu

SEQ ID NO: 161013 - RNA, 24 nt, Human
ccacugcacuucagccugggugac

SEQ ID NO: 161014 - RNA, 20 nt, Human
ccuauaaucucagcacuuug

SEQ ID NO: 161015 - RNA, 22 nt, Human
ccuauaaucucagcacuuuggg

SEQ ID NO: 161016 - RNA, 24 nt, Human
ccuccuggguucaagugauucucc

SEQ ID NO: 161017 - RNA, 24 nt, Human
ccuccuggguucaagugauucucc

SEQ ID NO: 161018 - RNA, 22 nt, Human
ccugaggucaggaguucgagac

SEQ ID NO: 161019 - RNA, 22 nt, Human
ccugaggucgggaguucgagac

SEQ ID NO: 161020 - RNA, 24 nt, Human
ccugaguagcugggacgacaggcu

SEQ ID NO: 161021 - RNA, 23 nt, Human
ccugccucagccuccugaguagc

SEQ ID NO: 161022 - RNA, 24 nt, Human
ccugccucagccuccugaguagcu

SEQ ID NO: 161023 - RNA, 24 nt, Human
ccuggccaacacagugaaacccca

SEQ ID NO: 161024 - RNA, 22 nt, Human
ccuggccaacauggugaaaccc

SEQ ID NO: 161025 - RNA, 24 nt, Human
ccuggccaacauggugaaacccug

SEQ ID NO: 161026 - RNA, 22 nt, Human
ccugggugacagagccagacuc

SEQ ID NO: 161027 - RNA, 23 nt, Human
ccuggguucaagugauucuccuc

SEQ ID NO: 161028 - RNA, 23 nt, Human
ccuggguucaagugauucuccuc

SEQ ID NO: 161029 - RNA, 23 nt, Human
ccuggguucaagugauucuccug

SEQ ID NO: 161030 - RNA, 23 nt, Human
ccuggguucaagugauucuccug

SEQ ID NO: 161031 - RNA, 18 nt, Human
ccuguaauuccagcuacu

SEQ ID NO: 161032 - RNA, 19 nt, Human
ccuguaauuccagcuacuu

SEQ ID NO: 161033 - RNA, 21 nt, Human
ccuguaauuccagcuacuugg

SEQ ID NO: 161034 - RNA, 22 nt, Human
ccuguaauuccagcuacuuggg

SEQ ID NO: 161035 - RNA, 24 nt, Human
cgagaccagccuggccaacacagu

SEQ ID NO: 161036 - RNA, 24 nt, Human
cgagaccagccuggccaacauggu

SEQ ID NO: 161037 - RNA, 24 nt, Human
cgagaucgugccacugcacuccag

SEQ ID NO: 161038 - RNA, 20 nt, Human
cgaggcagguggaucaccug

SEQ ID NO: 161039 - RNA, 23 nt, Human
cgccuguaaucccagcacuuugg

SEQ ID NO: 161040 - RNA, 24 nt, Human
cgccuguaaucccagcacuuuggg

SEQ ID NO: 161041 - RNA, 24 nt, Human
cggccucagccccguugccgguuc

SEQ ID NO: 161042 - RNA, 24 nt, Human
cguucugucacccaggcuggagug

SEQ ID NO: 161043 - RNA, 24 nt, Human
cguucugucacccaggcuggagug

SEQ ID NO: 161044 - RNA, 19 nt, Human
cuaaauaccuaaucacauc

SEQ ID NO: 161045 - RNA, 22 nt, Human
cucacgccuguaaucccagcac

SEQ ID NO: 161046 - RNA, 24 nt, Human
cucacgccuguaaucccagcacuu

SEQ ID NO: 161047 - RNA, 23 nt, Human
cucacugcaacagcugccuccug

SEQ ID NO: 161048 - RNA, 23 nt, Human
cucacugcaacagcugccuccug

SEQ ID NO: 161049 - RNA, 24 nt, Human
cucacugcaacagcugccuccugg

SEQ ID NO: 161050 - RNA, 24 nt, Human
cucacugcaacagcugccuccugg

SEQ ID NO: 161051 - RNA, 24 nt, Human
cucagccuccugaguagcugggac

SEQ ID NO: 161052 - RNA, 24 nt, Human
cucaugccuauaaucucagcacuu

SEQ ID NO: 161053 - RNA, 23 nt, Human
cuccacugcacuccagccugggu

SEQ ID NO: 161054 - RNA, 23 nt, Human
cuccacugcacuucagccugggu

SEQ ID NO: 161055 - RNA, 20 nt, Human
cuccuggguucaagugauuc

SEQ ID NO: 161056 - RNA, 20 nt, Human
cuccuggguucaagugauuc

SEQ ID NO: 161057 - RNA, 21 nt, Human
cuccuggguucaagugauucu

SEQ ID NO: 161058 - RNA, 21 nt, Human
cuccuggguucaagugauucu

SEQ ID NO: 161059 - RNA, 24 nt, Human
cucguucugucacccaggcuggag

SEQ ID NO: 161060 - RNA, 24 nt, Human
cucguucugucacccaggcuggag

SEQ ID NO: 161061 - RNA, 19 nt, Human
cucucuucacuucacucuc

SEQ ID NO: 161062 - RNA, 20 nt, Human
cucucuucacuucacucuca

SEQ ID NO: 161063 - RNA, 19 nt, Human
cucugucucaaaaaaaaaa

SEQ ID NO: 161064 - RNA, 20 nt, Human
cugcaacagcugccuccugg

SEQ ID NO: 161065 - RNA, 20 nt, Human
cugcaacagcugccuccugg

SEQ ID NO: 161066 - RNA, 23 nt, Human
cugcaacagcugccuccuggguu

SEQ ID NO: 161067 - RNA, 23 nt, Human
cugcaacagcugccuccuggguu

SEQ ID NO: 161068 - RNA, 23 nt, Human
cugccuccuggguucaagugauu

SEQ ID NO: 161069 - RNA, 23 nt, Human
cuggccaacacagugaaacccca

SEQ ID NO: 161070 - RNA, 24 nt, Human
cuggccaacauggugaaacccugu

SEQ ID NO: 161071 - RNA, 21 nt, Human
cuuggcgaaagagcaagacuc

SEQ ID NO: 161072 - RNA, 19 nt, Human
cuuggcucacugcaacagc

SEQ ID NO: 161073 - RNA, 19 nt, Human
cuuggcucacugcaacagc

SEQ ID NO: 161074 - RNA, 19 nt, Human
gaagccuuucucucuccac

SEQ ID NO: 161075 - RNA, 23 nt, Human
gaagguugcagugagucgagauc

SEQ ID NO: 161076 - RNA, 24 nt, Human
gaagguugcagugagucgagaucg

SEQ ID NO: 161077 - RNA, 19 nt, Human
gaaucacuugaacccaaga

SEQ ID NO: 161078 - RNA, 24 nt, Human
gacagagccagacucugucucaaa

SEQ ID NO: 161079 - RNA, 23 nt, Human
gagaauugcuugaaccugggagg

SEQ ID NO: 161080 - RNA, 23 nt, Human
gagaucgugccacugcacuccag

SEQ ID NO: 161081 - RNA, 23 nt, Human
gagauugcuccacugcacuccag

SEQ ID NO: 161082 - RNA, 23 nt, Human
gagauugcuccacugcacuucag

SEQ ID NO: 161083 - RNA, 24 nt, Human
gagcugaggcaggagaauugcuug

SEQ ID NO: 161084 - RNA, 23 nt, Human
gaggcagguggaucaccugaggu

SEQ ID NO: 161085 - RNA, 21 nt, Human
gaucaccugaggucaggaguu

SEQ ID NO: 161086 - RNA, 24 nt, Human
gaucaccugaggucaggaguucga

SEQ ID NO: 161087 - RNA, 24 nt, Human
gaucaccugaggucgggaguucga

SEQ ID NO: 161088 - RNA, 24 nt, Human
gcaacagagugagacucugucuca

SEQ ID NO: 161089 - RNA, 22 nt, Human
gcacaagaaucacuugaaccca

SEQ ID NO: 161090 - RNA, 24 nt, Human
gcacuccagccugggugacagagc

SEQ ID NO: 161091 - RNA, 24 nt, Human
gcacuucagccugggugacagagc

SEQ ID NO: 161092 - RNA, 20 nt, Human
gcacuuugggaggccaaggu

SEQ ID NO: 161093 - RNA, 19 nt, Human
gcaggaugacagauauucu

SEQ ID NO: 161094 - RNA, 22 nt, Human
gccaacauggugaaacccuguc

SEQ ID NO: 161095 - RNA, 20 nt, Human
gccuguaauuccagcuacuu

SEQ ID NO: 161096 - RNA, 21 nt, Human
gcucacugcaacagcugccuc

SEQ ID NO: 161097 - RNA, 21 nt, Human
gcucacugcaacagcugccuc

SEQ ID NO: 161098 - RNA, 19 nt, Human
gcuggagugcaauggcgug

SEQ ID NO: 161099 - RNA, 19 nt, Human
gcuggagugcaauggcgug

SEQ ID NO: 161100 - RNA, 22 nt, Human
ggaucaccugaggucaggaguu

SEQ ID NO: 161101 - RNA, 21 nt, Human
ggccaggcgcgguggcucacg

SEQ ID NO: 161102 - RNA, 21 nt, Human
ggccaggcgugguggcucaug

SEQ ID NO: 161103 - RNA, 21 nt, Human
ggcucacgccuguaaucccag

SEQ ID NO: 161104 - RNA, 21 nt, Human
ggcucaugccuauaaucucag

SEQ ID NO: 161105 - RNA, 22 nt, Human
ggcuggagugcaauggcgugau

SEQ ID NO: 161106 - RNA, 22 nt, Human
ggcuggagugcaauggcgugau

SEQ ID NO: 161107 - RNA, 24 nt, Human
gggugcagugguaugugccuguaa

SEQ ID NO: 161108 - RNA, 23 nt, Human
ggugcagugguaugugccuguaa

SEQ ID NO: 161109 - RNA, 23 nt, Human
gguggcucacgccuguaauccca

SEQ ID NO: 161110 - RNA, 24 nt, Human
gguggcucacgccuguaaucccag

SEQ ID NO: 161111 - RNA, 24 nt, Human
gguggcucaugccuauaaucucag

SEQ ID NO: 161112 - RNA, 20 nt, Human
gucucaaaaaaaaaaaaaag

SEQ ID NO: 161113 - RNA, 24 nt, Human
gucucguucugucacccaggcugg

SEQ ID NO: 161114 - RNA, 23 nt, Human
gugauucuccugccucagccucc

SEQ ID NO: 161115 - RNA, 20 nt, Human
guuccagguugcucuugggu

SEQ ID NO: 161116 - RNA, 24 nt, Human
guugcagugagucgagaucgugcc

SEQ ID NO: 161117 - RNA, 19 nt, Human
uaaaaaaagagaagaacaa

SEQ ID NO: 161118 - RNA, 22 nt, Human
uaaaauaaauaaaaaaagagaa

SEQ ID NO: 161119 - RNA, 24 nt, Human
uaaacaggauauaaaaaaucagaa

SEQ ID NO: 161120 - RNA, 22 nt, Human
uacaacaccagaacaaggugga

SEQ ID NO: 161121 - RNA, 18 nt, Human
uagcaggaugacagauau

SEQ ID NO: 161122 - RNA, 21 nt, Human
uagcaggaugacagauauucu

SEQ ID NO: 161123 - RNA, 22 nt, Human
uagcaggaugacagauauucuu

SEQ ID NO: 161124 - RNA, 25 nt, Human
uagugagcuuuucucucuugugucc

SEQ ID NO: 161125 - RNA, 18 nt, Human
uaugaggacagagccccu

SEQ ID NO: 161126 - RNA, 18 nt, Human
ucaaaaaaaaaaaaaagu

SEQ ID NO: 161127 - RNA, 24 nt, Human
ucaagcuucuuagugagcuuuucu

SEQ ID NO: 161128 - RNA, 19 nt, Human
ucaagugauucuccugccu

SEQ ID NO: 161129 - RNA, 22 nt, Human
ucacaucucuacaacaccagaa

SEQ ID NO: 161130 - RNA, 18 nt, Human
ucacccaggcuggagugc

SEQ ID NO: 161131 - RNA, 18 nt, Human
ucacccaggcuggagugc

SEQ ID NO: 161132 - RNA, 20 nt, Human
ucaccugaggucaggaguuc

SEQ ID NO: 161133 - RNA, 24 nt, Human
ucacugcaacagcugccuccuggg

SEQ ID NO: 161134 - RNA, 24 nt, Human
ucacugcaacagcugccuccuggg

SEQ ID NO: 161135 - RNA, 23 nt, Human
ucagccuccugaguagcugggac

SEQ ID NO: 161136 - RNA, 26 nt, Human
uccacaguccuggcuccucucugccu

SEQ ID NO: 161137 - RNA, 24 nt, Human
uccacugcacuccagccuggguga

SEQ ID NO: 161138 - RNA, 24 nt, Human
uccacugcacuucagccuggguga

SEQ ID NO: 161139 - RNA, 22 nt, Human
uccacuguccuggagugagagc

SEQ ID NO: 161140 - RNA, 24 nt, Human
uccagccugggugacagagccaga

SEQ ID NO: 161141 - RNA, 24 nt, Human
uccugaguagcugggacgacaggc

SEQ ID NO: 161142 - RNA, 21 nt, Human
uccuggguucaagugauucuc

SEQ ID NO: 161143 - RNA, 21 nt, Human
uccuggguucaagugauucuc

SEQ ID NO: 161144 - RNA, 24 nt, Human
uccuggguucaagugauucuccug

SEQ ID NO: 161145 - RNA, 24 nt, Human
uccuggguucaagugauucuccug

SEQ ID NO: 161146 - RNA, 23 nt, Human
ucgugccacugcacuccagccuu

SEQ ID NO: 161147 - RNA, 22 nt, Human
ucguucugucacccaggcugga

SEQ ID NO: 161148 - RNA, 22 nt, Human
ucguucugucacccaggcugga

SEQ ID NO: 161149 - RNA, 24 nt, Human
ucguucugucacccaggcuggagu

SEQ ID NO: 161150 - RNA, 24 nt, Human
ucguucugucacccaggcuggagu

SEQ ID NO: 161151 - RNA, 24 nt, Human
ucuccugccucagccuccugagua

SEQ ID NO: 161152 - RNA, 19 nt, Human
ucucguucugucacccagg

SEQ ID NO: 161153 - RNA, 19 nt, Human
ucucguucugucacccagg

SEQ ID NO: 161154 - RNA, 23 nt, Human
ucucguucugucacccaggcugg

SEQ ID NO: 161155 - RNA, 23 nt, Human
ucucguucugucacccaggcugg

SEQ ID NO: 161156 - RNA, 24 nt, Human
ucucguucugucacccaggcugga

SEQ ID NO: 161157 - RNA, 24 nt, Human
ucucguucugucacccaggcugga

SEQ ID NO: 161158 - RNA, 21 nt, Human
ucucuacuaaaaauacaaaaa

SEQ ID NO: 161159 - RNA, 23 nt, Human
ucucuacuaaaaauacaaaaauu

SEQ ID NO: 161160 - RNA, 19 nt, Human
ucucucuccacuguccugg

SEQ ID NO: 161161 - RNA, 24 nt, Human
ucuggccaggcgugguggcucaug

SEQ ID NO: 161162 - RNA, 24 nt, Human
ucugucacccaggcuggagugcaa

SEQ ID NO: 161163 - RNA, 24 nt, Human
ucugucacccaggcuggagugcaa

SEQ ID NO: 161164 - RNA, 22 nt, Human
ucugucucaaaaaaaaaaaaaa

SEQ ID NO: 161165 - RNA, 24 nt, Human
ucugucucaaaaaaaaaaaaaagg

SEQ ID NO: 161166 - RNA, 23 nt, Human
ucuuacgacaauaagcuccgcag

SEQ ID NO: 161167 - RNA, 28 nt, Human
ucuugagguggagucucguuccaccagg

SEQ ID NO: 161168 - RNA, 28 nt, Human
ucuugagguggagucucguuccaccagg

SEQ ID NO: 161169 - RNA, 19 nt, Human
ugaaaccccaucucuacua

SEQ ID NO: 161170 - RNA, 24 nt, Human
ugaaccugggaggcgaagguugca

SEQ ID NO: 161171 - RNA, 23 nt, Human
ugaaggaagaaauuaaacaggau

SEQ ID NO: 161172 - RNA, 22 nt, Human
ugagccgagauugcuccacugc

SEQ ID NO: 161173 - RNA, 20 nt, Human
ugaggacagagccccucguc

SEQ ID NO: 161174 - RNA, 30 nt, Human
ugaggacagagccccucgucagggaauuuu

SEQ ID NO: 161175 - RNA, 20 nt, Human
ugaggcacaagaaucacuug

SEQ ID NO: 161176 - RNA, 24 nt, Human
ugaggcacaagaaucacuugaacc

SEQ ID NO: 161177 - RNA, 24 nt, Human
ugaggcaggagaauugcuugaacc

SEQ ID NO: 161178 - RNA, 25 nt, Human
ugaggcaggagaauugcuugaaccu

SEQ ID NO: 161179 - RNA, 22 nt, Human
ugagguggagucucguucuguc

SEQ ID NO: 161180 - RNA, 22 nt, Human
ugagguggagucucguucuguc

SEQ ID NO: 161181 - RNA, 22 nt, Human
ugagucgagaucgugccacugc

SEQ ID NO: 161182 - RNA, 20 nt, Human
ugauucuccugccucagccu

SEQ ID NO: 161183 - RNA, 23 nt, Human
ugccuauaaucucagcacuuugg

SEQ ID NO: 161184 - RNA, 24 nt, Human
ugccuauaaucucagcacuuuggg

SEQ ID NO: 161185 - RNA, 24 nt, Human
ugccucagccuccugaguagcugg

SEQ ID NO: 161186 - RNA, 22 nt, Human
ugccuccuggguucaagugauu

SEQ ID NO: 161187 - RNA, 23 nt, Human
ugccuguaauuccagcuacuugg

SEQ ID NO: 161188 - RNA, 24 nt, Human
ugccuguaauuccagcuacuuggg

SEQ ID NO: 161189 - RNA, 19 nt, Human
ugccuucaccuccaggugu

SEQ ID NO: 161190 - RNA, 19 nt, Human
ugcuccacugcacuccagc

SEQ ID NO: 161191 - RNA, 19 nt, Human
uggagugcaauggcgugau

SEQ ID NO: 161192 - RNA, 19 nt, Human
uggagugcaauggcgugau

SEQ ID NO: 161193 - RNA, 23 nt, Human
uggagugcaauggcgugaucuug

SEQ ID NO: 161194 - RNA, 23 nt, Human
uggagugcaauggcgugaucuug

SEQ ID NO: 161195 - RNA, 24 nt, Human
uggagugcaauggcgugaucuugg

SEQ ID NO: 161196 - RNA, 24 nt, Human
uggagugcaauggcgugaucuugg

SEQ ID NO: 161197 - RNA, 24 nt, Human
uggaucaccugaggucaggaguuc

SEQ ID NO: 161198 - RNA, 26 nt, Human
uggaucaccugaggucaggaguucga

SEQ ID NO: 161199 - RNA, 27 nt, Human
uggaucaccugaggucaggaguucgag

SEQ ID NO: 161200 - RNA, 24 nt, Human
uggaucaccugaggucgggaguuc

SEQ ID NO: 161201 - RNA, 24 nt, Human
uggccaacauggugaaacccuguc

SEQ ID NO: 161202 - RNA, 24 nt, Human
uggccaggcgcgguggcucacgcc

SEQ ID NO: 161203 - RNA, 24 nt, Human
uggccaggcgugguggcucaugcc

SEQ ID NO: 161204 - RNA, 26 nt, Human
uggcgugaucuuggcucacugcaaca

SEQ ID NO: 161205 - RNA, 26 nt, Human
uggcgugaucuuggcucacugcaaca

SEQ ID NO: 161206 - RNA, 22 nt, Human
uggcucacgccuguaaucccag

SEQ ID NO: 161207 - RNA, 24 nt, Human
uggcucacgccuguaaucccagca

SEQ ID NO: 161208 - RNA, 21 nt, Human
uggcucaugccuauaaucuca

SEQ ID NO: 161209 - RNA, 22 nt, Human
uggcucaugccuauaaucucag

SEQ ID NO: 161210 - RNA, 24 nt, Human
uggcucaugccuauaaucucagca

SEQ ID NO: 161211 - RNA, 24 nt, Human
uggcuccucucugccuucaccucc

SEQ ID NO: 161212 - RNA, 23 nt, Human
ugggaggccaagguggguggauc

SEQ ID NO: 161213 - RNA, 24 nt, Human
ugggaggccaagguggguggauca

SEQ ID NO: 161214 - RNA, 24 nt, Human
ugggaggccgaggcagguggauca

SEQ ID NO: 161215 - RNA, 24 nt, Human
ugggaggcgaagguugcagugagu

SEQ ID NO: 161216 - RNA, 26 nt, Human
ugggaggcugaggcacaagaaucacu

SEQ ID NO: 161217 - RNA, 27 nt, Human
ugggaggcugaggcacaagaaucacuu

SEQ ID NO: 161218 - RNA, 21 nt, Human
ugggcaacagagugagacucu

SEQ ID NO: 161219 - RNA, 18 nt, Human
ugggugcagugguaugug

SEQ ID NO: 161220 - RNA, 24 nt, Human
uggguggaucaccugaggucagga

SEQ ID NO: 161221 - RNA, 23 nt, Human
uggguucaagugauucuccugcc

SEQ ID NO: 161222 - RNA, 24 nt, Human
uggguucaagugauucuccugccu

SEQ ID NO: 161223 - RNA, 22 nt, Human
uggguucaagugauucuccugg

SEQ ID NO: 161224 - RNA, 21 nt, Human
ugguaugugccuguaauucca

SEQ ID NO: 161225 - RNA, 22 nt, Human
ugguaugugccuguaauuccag

SEQ ID NO: 161226 - RNA, 24 nt, Human
ugguaugugccuguaauuccagcu

SEQ ID NO: 161227 - RNA, 24 nt, Human
ugguggcucaugccuauaaucuca

SEQ ID NO: 161228 - RNA, 20 nt, Human
ugucacccaggcuggagugc

SEQ ID NO: 161229 - RNA, 20 nt, Human
ugucacccaggcuggagugc

SEQ ID NO: 161230 - RNA, 22 nt, Human
ugucuggagaacucuagcgagg

SEQ ID NO: 161231 - RNA, 24 nt, Human
ugugccuguaauuccagcuacuug

SEQ ID NO: 161232 - RNA, 19 nt, Human
ugugugcagccuggccagg

SEQ ID NO: 161233 - RNA, 23 nt, Human
uuagcaggaugacagauauucuu

SEQ ID NO: 161234 - RNA, 18 nt, Human
uuagcugggugcaguggu

SEQ ID NO: 161235 - RNA, 20 nt, Human
uuagugagcuuuucucucuu

SEQ ID NO: 161236 - RNA, 18 nt, Human
uuaguuccagguugcucu

SEQ ID NO: 161237 - RNA, 25 nt, Human
uucaaguagcuuugucggacuccac

SEQ ID NO: 161238 - RNA, 21 nt, Human
uucaagugauucuccugccuc

SEQ ID NO: 161239 - RNA, 23 nt, Human
uucaagugauucuccugccucag

SEQ ID NO: 161240 - RNA, 24 nt, Human
uucaagugauucuccugccucagc

SEQ ID NO: 161241 - RNA, 22 nt, Human
uucacuaaauaccuaaucacau

SEQ ID NO: 161242 - RNA, 21 nt, Human
uucacuucacucucagugcac

SEQ ID NO: 161243 - RNA, 24 nt, Human
uucagccugggugacagagccaga

SEQ ID NO: 161244 - RNA, 19 nt, Human
uucuccugggaggcgaagg

SEQ ID NO: 161245 - RNA, 24 nt, Human
uucuuacgacaauaagcuccgcag

SEQ ID NO: 161246 - RNA, 24 nt, Human
uugaaccugggaggcgaagguugc

SEQ ID NO: 161247 - RNA, 18 nt, Human
uugcagugagucgagauc

SEQ ID NO: 161248 - RNA, 21 nt, Human
uugcagugagucgagaucgug

SEQ ID NO: 161249 - RNA, 22 nt, Human
uugcagugagucgagaucgugc

SEQ ID NO: 161250 - RNA, 23 nt, Human
uugcuccacugcacuucagccug

SEQ ID NO: 161251 - RNA, 18 nt, Human
uugcuugaaccugggagg

SEQ ID NO: 161252 - RNA, 24 nt, Human
uugcuugaaccugggaggcgaagg

SEQ ID NO: 161253 - RNA, 25 nt, Human
uugggaggccgaggcagguggauca

SEQ ID NO: 161254 - RNA, 25 nt, Human
uugggaggcugaggcacaagaauca

SEQ ID NO: 161255 - RNA, 24 nt, Human
uuugccucucuucacuucacucuc

SEQ ID NO: 161256 - RNA, 25 nt, Human
uuuuuuuuucuugagguggagucuc

SEQ ID NO: 161257 - RNA, 25 nt, Human
uuuuuuuuucuugagguggagucuc

SEQ ID NO: 161258 - RNA, 21 nt, Human
uuuuuuuuuuuuuucuugagg

SEQ ID NO: 161259 - RNA, 21 nt, Human
uuuuuuuuuuuuuucuugagg

SEQ ID NO: 161260 - RNA, 19 nt, Human
aacaucucuuuuacaaaug

SEQ ID NO: 161261 - RNA, 18 nt, Human
ccacuuaaccaguuucac

SEQ ID NO: 161262 - RNA, 20 nt, Human
gaagcauuucuauaaauccu

SEQ ID NO: 161263 - RNA, 19 nt, Human
ucaaauauaggcccaugcu

SEQ ID NO: 161264 - RNA, 22 nt, Human
ucagaagcauucuguuacaugg

SEQ ID NO: 161265 - RNA, 18 nt, Human
ugaacaucucuuuuacaa

SEQ ID NO: 161266 - RNA, 19 nt, Human
ugaagcauuucuauaaauc

SEQ ID NO: 161267 - RNA, 19 nt, Human
ugcuggagagaucuaaggc

SEQ ID NO: 161268 - RNA, 19 nt, Human
uggaaaaaaacuaauguug

SEQ ID NO: 161269 - RNA, 23 nt, Human
uggaaaaaaacuaauguugcaaa

SEQ ID NO: 161270 - RNA, 19 nt, Human
uggaggaugcuggagacuc

SEQ ID NO: 161271 - RNA, 20 nt, Human
uugcugaugcuggaaaaaaa

SEQ ID NO: 161272 - RNA, 24 nt, Human
uuuuuuuuuuuuuuuuuuacucag

SEQ ID NO: 161273 - RNA, 21 nt, Human
agaagaagggugggacaagag

SEQ ID NO: 161274 - RNA, 22 nt, Human
agaagaagggugggacaagaga

SEQ ID NO: 161275 - RNA, 20 nt, Human
agaagggugggacaagagag

SEQ ID NO: 161276 - RNA, 24 nt, Human
agacuagaauauaaauauccguaa

SEQ ID NO: 161277 - RNA, 22 nt, Human
agcuggaguugggaauggggaa

SEQ ID NO: 161278 - RNA, 23 nt, Human
cagaagccaaagaagaauaugac

SEQ ID NO: 161279 - RNA, 18 nt, Human
ccaaagaagaauaugacc

SEQ ID NO: 161280 - RNA, 24 nt, Human
ccaugagggcuggaagaaccagaa

SEQ ID NO: 161281 - RNA, 23 nt, Human
gcaggcauaugugaugccaacca

SEQ ID NO: 161282 - RNA, 21 nt, Human
ggaauggggaagagaagaagg

SEQ ID NO: 161283 - RNA, 19 nt, Human
gggaauggggaagagaaga

SEQ ID NO: 161284 - RNA, 20 nt, Human
gggaauggggaagagaagaa

SEQ ID NO: 161285 - RNA, 23 nt, Human
uagggccagcugguguuaauggc

SEQ ID NO: 161286 - RNA, 21 nt, Human
ugagcauuagucuuuaacagg

SEQ ID NO: 161287 - RNA, 25 nt, Human
uggcaugcaggcauaugugaugcca

SEQ ID NO: 161288 - RNA, 21 nt, Human
uuaauggcaugcaggcauaug

SEQ ID NO: 161289 - RNA, 24 nt, Human
agcacucacucccugacaacgcag

SEQ ID NO: 161290 - RNA, 18 nt, Human
aggcaggggccauagagg

SEQ ID NO: 161291 - RNA, 20 nt, Human
cacugccccauuuuauugau

SEQ ID NO: 161292 - RNA, 19 nt, Human
cagaaaaugucacagggac

SEQ ID NO: 161293 - RNA, 21 nt, Human
cagguccuggggugcugagga

SEQ ID NO: 161294 - RNA, 23 nt, Human
ccgaugauggagcacucacuccc

SEQ ID NO: 161295 - RNA, 20 nt, Human
ccuggggugcugaggagaug

SEQ ID NO: 161296 - RNA, 24 nt, Human
ccuggggugcugaggagauggggc

SEQ ID NO: 161297 - RNA, 23 nt, Human
cgaugauggagcacucacucccu

SEQ ID NO: 161298 - RNA, 19 nt, Human
cucccugacaacgcagucc

SEQ ID NO: 161299 - RNA, 20 nt, Human
cuugcucugggccuggcugu

SEQ ID NO: 161300 - RNA, 18 nt, Human
gaccagagcgauuggcag

SEQ ID NO: 161301 - RNA, 21 nt, Human
gcuguugggggcacucccauc

SEQ ID NO: 161302 - RNA, 18 nt, Human
gcuguugggguguacucc

SEQ ID NO: 161303 - RNA, 19 nt, Human
ggaggccaucacugcccca

SEQ ID NO: 161304 - RNA, 20 nt, Human
ggaggccaucacugccccau

SEQ ID NO: 161305 - RNA, 24 nt, Human
ggcacucccaucuggagagggugc

SEQ ID NO: 161306 - RNA, 18 nt, Human
ggcugcaucuggagaggg

SEQ ID NO: 161307 - RNA, 21 nt, Human
gggccauagaggagcgggaga

SEQ ID NO: 161308 - RNA, 21 nt, Human
gggccauagaggagcgggaga

SEQ ID NO: 161309 - RNA, 24 nt, Human
ggggcacucccaucuggagagggu

SEQ ID NO: 161310 - RNA, 19 nt, Human
gggugcugaggagaugggg

SEQ ID NO: 161311 - RNA, 22 nt, Human
ggugcugaggagauggggcugc

SEQ ID NO: 161312 - RNA, 24 nt, Human
ggugcuguugggguguacuccugg

SEQ ID NO: 161313 - RNA, 23 nt, Human
gugcuguugggguguacuccugg

SEQ ID NO: 161314 - RNA, 21 nt, Human
guuuggagccugugucugucc

SEQ ID NO: 161315 - RNA, 21 nt, Human
uacuccugggaaggcaggggc

SEQ ID NO: 161316 - RNA, 22 nt, Human
ucagguccuggggugcugagga

SEQ ID NO: 161317 - RNA, 26 nt, Human
uccugggaaggcaggggccauagagg

SEQ ID NO: 161318 - RNA, 25 nt, Human
uccuggggugcugaggagauggggc

SEQ ID NO: 161319 - RNA, 19 nt, Human
ucuggagagggugcuguug

SEQ ID NO: 161320 - RNA, 19 nt, Human
ucuggagagggugcuguug

SEQ ID NO: 161321 - RNA, 19 nt, Human
ucuggagagggugcuguug

SEQ ID NO: 161322 - RNA, 19 nt, Human
ucuggagagggugcuguug

SEQ ID NO: 161323 - RNA, 19 nt, Human
ucuggagagggugcuguug

SEQ ID NO: 161324 - RNA, 24 nt, Human
uguugggggcacucccaucuggag

SEQ ID NO: 161325 - RNA, 19 nt, Human
uguugggguguacuccugg

SEQ ID NO: 161326 - RNA, 25 nt, Human
uguugggguguacucucaucuggag

SEQ ID NO: 161327 - RNA, 25 nt, Human
uguugggguguacucucaucuggag

SEQ ID NO: 161328 - RNA, 25 nt, Human
uguugggguguacucucaucuggag

SEQ ID NO: 161329 - RNA, 22 nt, Human
uuggagccugugucuguccucc

SEQ ID NO: 161330 - RNA, 18 nt, Human
uuuuuuuuuuugggaggc

SEQ ID NO: 161331 - RNA, 20 nt, Human
uuuuuuuuuuuugggaggcc

SEQ ID NO: 161332 - RNA, 26 nt, Human
uuuuuuuuuuuuuuuuuuuuuuuggg

SEQ ID NO: 161333 - RNA, 23 nt, Human
aaaaaaaaaaagauguuaaagga

SEQ ID NO: 161334 - RNA, 22 nt, Human
aaacccugucucuacuaaaaaa

SEQ ID NO: 161335 - RNA, 18 nt, Human
aaagaagauguuaaagag

SEQ ID NO: 161336 - RNA, 20 nt, Human
aacauugcgaaacccugucu

SEQ ID NO: 161337 - RNA, 21 nt, Human
aacauugcgaaacccugucuc

SEQ ID NO: 161338 - RNA, 24 nt, Human
aaccuguaacauaagcguuucuca

SEQ ID NO: 161339 - RNA, 19 nt, Human
aagaguccuucucuuuugg

SEQ ID NO: 161340 - RNA, 25 nt, Human
aauuacauaauuguuuuuugggggu

SEQ ID NO: 161341 - RNA, 24 nt, Human
aauucucuucucaaaucccaaggc

SEQ ID NO: 161342 - RNA, 22 nt, Human
acagauugagacucugucaaaa

SEQ ID NO: 161343 - RNA, 19 nt, Human
acagugguuugacuaauug

SEQ ID NO: 161344 - RNA, 19 nt, Human
acauaauuguuuuuugggg

SEQ ID NO: 161345 - RNA, 19 nt, Human
accacugcacuccagccug

SEQ ID NO: 161346 - RNA, 21 nt, Human
accagauccucaccucucuaa

SEQ ID NO: 161347 - RNA, 18 nt, Human
acccugucucuacuaaaa

SEQ ID NO: 161348 - RNA, 22 nt, Human
accucucuaauucucuucucaa

SEQ ID NO: 161349 - RNA, 24 nt, Human
acugcacuccagccuggguaacag

SEQ ID NO: 161350 - RNA, 18 nt, Human
agaguccuucucuuuugg

SEQ ID NO: 161351 - RNA, 24 nt, Human
agcacuuugggaggccgaggcggg

SEQ ID NO: 161352 - RNA, 24 nt, Human
agccuggguaacagauugagacuc

SEQ ID NO: 161353 - RNA, 23 nt, Human
agcuggguaugauggcacaugcc

SEQ ID NO: 161354 - RNA, 21 nt, Human
aggaaagaagauguuaaagag

SEQ ID NO: 161355 - RNA, 22 nt, Human
aggcaaguauuuauugggaaaa

SEQ ID NO: 161356 - RNA, 22 nt, Human
aggcagaaaccagcaguaggga

SEQ ID NO: 161357 - RNA, 22 nt, Human
aggcaugagaaucgcuuaaacc

SEQ ID NO: 161358 - RNA, 24 nt, Human
aggcaugagaaucgcuuaaaccug

SEQ ID NO: 161359 - RNA, 18 nt, Human
aggccgaggcgggcagau

SEQ ID NO: 161360 - RNA, 25 nt, Human
aggccgaggcgggcagaucgcuaga

SEQ ID NO: 161361 - RNA, 21 nt, Human
aggcgggcagaucgcuagagg

SEQ ID NO: 161362 - RNA, 26 nt, Human
aggcgggcagaucgcuagaggccaga

SEQ ID NO: 161363 - RNA, 21 nt, Human
aggcggguuugcagugagcca

SEQ ID NO: 161364 - RNA, 23 nt, Human
aggcggguuugcagugagccaag

SEQ ID NO: 161365 - RNA, 22 nt, Human
aggugguuuuguuugcucagga

SEQ ID NO: 161366 - RNA, 24 nt, Human
auagcaccacugcacuccagccug

SEQ ID NO: 161367 - RNA, 19 nt, Human
aucccuucgucuuccccaa

SEQ ID NO: 161368 - RNA, 18 nt, Human
augaccccgugaaguuuu

SEQ ID NO: 161369 - RNA, 23 nt, Human
auggcacaugccucuaaucccag

SEQ ID NO: 161370 - RNA, 20 nt, Human
auuauagaaaaauaaaauag

SEQ ID NO: 161371 - RNA, 26 nt, Human
caaaucccaaggcaaaacaauggaga

SEQ ID NO: 161372 - RNA, 24 nt, Human
caacauugcgaaacccugucucua

SEQ ID NO: 161373 - RNA, 27 nt, Human
cacaggcaaguauuuauugggaaaaug

SEQ ID NO: 161374 - RNA, 26 nt, Human
caccacugcacuccagccuggguaac

SEQ ID NO: 161375 - RNA, 19 nt, Human
cacugcacuccagccuggg

SEQ ID NO: 161376 - RNA, 21 nt, Human
cacugcacuccagccugggua

SEQ ID NO: 161377 - RNA, 22 nt, Human
cacugcacuccagccuggguaa

SEQ ID NO: 161378 - RNA, 23 nt, Human
cacugcacuccagccuggguaac

SEQ ID NO: 161379 - RNA, 24 nt, Human
cacugcacuccagccuggguaaca

SEQ ID NO: 161380 - RNA, 23 nt, Human
cacuuuuaauuuguuguuagagg

SEQ ID NO: 161381 - RNA, 24 nt, Human
cagaucgcuagaggccagaaguuc

SEQ ID NO: 161382 - RNA, 24 nt, Human
cagcacuuugggaggccgaggcgg

SEQ ID NO: 161383 - RNA, 19 nt, Human
caggaaauaccagauccuc

SEQ ID NO: 161384 - RNA, 23 nt, Human
cauauagacuuacaugauugcuc

SEQ ID NO: 161385 - RNA, 23 nt, Human
caugccucuaaucccagcuacug

SEQ ID NO: 161386 - RNA, 20 nt, Human
ccacugcacuccagccuggg

SEQ ID NO: 161387 - RNA, 20 nt, Human
ccacugcacuccagccuggg

SEQ ID NO: 161388 - RNA, 20 nt, Human
ccacugcacuccagccuggg

SEQ ID NO: 161389 - RNA, 21 nt, Human
ccacugcacuccagccugggu

SEQ ID NO: 161390 - RNA, 22 nt, Human
ccacugcacuccagccugggua

SEQ ID NO: 161391 - RNA, 24 nt, Human
ccacugcacuccagccuggguaac

SEQ ID NO: 161392 - RNA, 18 nt, Human
ccucuaaucccagcuacu

SEQ ID NO: 161393 - RNA, 21 nt, Human
ccucuaaucccagcuacuggg

SEQ ID NO: 161394 - RNA, 22 nt, Human
ccuggccaacauugcgaaaccc

SEQ ID NO: 161395 - RNA, 21 nt, Human
cgagaucggccuggccaacau

SEQ ID NO: 161396 - RNA, 26 nt, Human
cgaggcgggcagaucgcuagaggcca

SEQ ID NO: 161397 - RNA, 24 nt, Human
cgggcagaucgcuagaggccagaa

SEQ ID NO: 161398 - RNA, 19 nt, Human
cucagcauggagaaggcag

SEQ ID NO: 161399 - RNA, 18 nt, Human
cucuacuaaaaaaaaaaa

SEQ ID NO: 161400 - RNA, 20 nt, Human
cucuacuaaaaaaaaaaaau

SEQ ID NO: 161401 - RNA, 19 nt, Human
cucugucaaaaaaaaaaaa

SEQ ID NO: 161402 - RNA, 24 nt, Human
cugggaggcugaggcaugagaauc

SEQ ID NO: 161403 - RNA, 18 nt, Human
cuuaaaccugggaggcgg

SEQ ID NO: 161404 - RNA, 22 nt, Human
cuuucaggacagggagcuuugg

SEQ ID NO: 161405 - RNA, 19 nt, Human
gaaacccugucucuacuaa

SEQ ID NO: 161406 - RNA, 24 nt, Human
gaugcuggucaucccagcacuuug

SEQ ID NO: 161407 - RNA, 24 nt, Human
gccaacauugcgaaacccugucuc

SEQ ID NO: 161408 - RNA, 23 nt, Human
gccuggccaacauugcgaaaccc

SEQ ID NO: 161409 - RNA, 19 nt, Human
gcuggucaucccagcacuu

SEQ ID NO: 161410 - RNA, 19 nt, Human
gcuuaaaccugggaggcgg

SEQ ID NO: 161411 - RNA, 24 nt, Human
guagguaucuucuuagaaaguccc

SEQ ID NO: 161412 - RNA, 18 nt, Human
guaucuucuuagaaaguc

SEQ ID NO: 161413 - RNA, 19 nt, Human
gugauuuuguucucagcau

SEQ ID NO: 161414 - RNA, 19 nt, Human
uaacauaagcguuucucau

SEQ ID NO: 161415 - RNA, 25 nt, Human
uaccagauccucaccucucuaauuc

SEQ ID NO: 161416 - RNA, 22 nt, Human
uagaaagucccuagucaccuaa

SEQ ID NO: 161417 - RNA, 21 nt, Human
uagaugacucuggaagagucc

SEQ ID NO: 161418 - RNA, 20 nt, Human
uagcaccacugcacuccagc

SEQ ID NO: 161419 - RNA, 18 nt, Human
uagguaucuucuuagaaa

SEQ ID NO: 161420 - RNA, 24 nt, Human
ucaggacagggagcuuugggacuc

SEQ ID NO: 161421 - RNA, 21 nt, Human
uccccaaggggaauuuagucc

SEQ ID NO: 161422 - RNA, 21 nt, Human
ucccuagucaccuaauuauau

SEQ ID NO: 161423 - RNA, 24 nt, Human
ucuaauucucuucucaaaucccaa

SEQ ID NO: 161424 - RNA, 20 nt, Human
ucucuacuaaaaaaaaaaaa

SEQ ID NO: 161425 - RNA, 20 nt, Human
ucugguaauugggcucuuug

SEQ ID NO: 161426 - RNA, 26 nt, Human
ucugucaaaaaaaaaaaagauguuaa

SEQ ID NO: 161427 - RNA, 24 nt, Human
ucuuagaaagucccuagucaccua

SEQ ID NO: 161428 - RNA, 25 nt, Human
ucuuagaaagucccuagucaccuaa

SEQ ID NO: 161429 - RNA, 21 nt, Human
ucuucuggagcuuccgacugc

SEQ ID NO: 161430 - RNA, 21 nt, Human
ugagaguaugaccacauggca

SEQ ID NO: 161431 - RNA, 19 nt, Human
ugagccaagauagcaccac

SEQ ID NO: 161432 - RNA, 24 nt, Human
ugaggcaugagaaucgcuuaaacc

SEQ ID NO: 161433 - RNA, 18 nt, Human
uggaacagaagauucuug

SEQ ID NO: 161434 - RNA, 21 nt, Human
uggaacagaagauucuugaug

SEQ ID NO: 161435 - RNA, 21 nt, Human
uggaagcaaaauaaaggcaau

SEQ ID NO: 161436 - RNA, 24 nt, Human
uggccaacauugcgaaacccuguc

SEQ ID NO: 161437 - RNA, 22 nt, Human
uggcuguguggauguggaacag

SEQ ID NO: 161438 - RNA, 20 nt, Human
ugggaggccgaggcgggcag

SEQ ID NO: 161439 - RNA, 23 nt, Human
ugggaggccgaggcgggcagauc

SEQ ID NO: 161440 - RNA, 24 nt, Human
ugggaggccgaggcgggcagaucg

SEQ ID NO: 161441 - RNA, 23 nt, Human
ugggaggcggguuugcagugagc

SEQ ID NO: 161442 - RNA, 18 nt, Human
ugggaggcugaggcauga

SEQ ID NO: 161443 - RNA, 23 nt, Human
ugggaggcugaggcaugagaauc

SEQ ID NO: 161444 - RNA, 19 nt, Human
ugggcucuuuguucuucug

SEQ ID NO: 161445 - RNA, 19 nt, Human
uguauuggcuguguggaug

SEQ ID NO: 161446 - RNA, 19 nt, Human
ugucaaaaaaaaaaaagau

SEQ ID NO: 161447 - RNA, 21 nt, Human
uguggaacagaagauucuuga

SEQ ID NO: 161448 - RNA, 18 nt, Human
uuaaagaggcuggacauu

SEQ ID NO: 161449 - RNA, 18 nt, Human
uuagcuggguaugauggc

SEQ ID NO: 161450 - RNA, 22 nt, Human
uuccaguggcaaaaugucacag

SEQ ID NO: 161451 - RNA, 22 nt, Human
uugcagugagccaagauagcac

SEQ ID NO: 161452 - RNA, 24 nt, Human
uugggaggccgaggcgggcagauc

SEQ ID NO: 161453 - RNA, 19 nt, Human
uuguucuucuggagcuucc

SEQ ID NO: 161454 - RNA, 21 nt, Human
uuucaggacagggagcuuugg

SEQ ID NO: 161455 - RNA, 24 nt, Human
aaccuguaacauaagcauuuccca

SEQ ID NO: 161456 - RNA, 20 nt, Human
aagaagagcugaagacagca

SEQ ID NO: 161457 - RNA, 24 nt, Human
acagugguuugauuaauuggauug

SEQ ID NO: 161458 - RNA, 26 nt, Human
caaaucccaaugcaagacaauggaga

SEQ ID NO: 161459 - RNA, 19 nt, Human
caauaaaucacccagaaac

SEQ ID NO: 161460 - RNA, 20 nt, Human
caauaaaucacccagaaaca

SEQ ID NO: 161461 - RNA, 23 nt, Human
cauauagauuuagaugauuguuc

SEQ ID NO: 161462 - RNA, 22 nt, Human
ccagagcacagcagucacagcc

SEQ ID NO: 161463 - RNA, 21 nt, Human
cgcccagagcacagcagucac

SEQ ID NO: 161464 - RNA, 23 nt, Human
cuguuaauaacagugguuugauu

SEQ ID NO: 161465 - RNA, 19 nt, Human
gagcugaagacagcaggug

SEQ ID NO: 161466 - RNA, 19 nt, Human
gauuguucucaacgguaac

SEQ ID NO: 161467 - RNA, 24 nt, Human
uaccagaucuucccucucugauuu

SEQ ID NO: 161468 - RNA, 18 nt, Human
ucaauaaaucacccagaa

SEQ ID NO: 161469 - RNA, 24 nt, Human
ucccucucugauuuucuucucaaa

SEQ ID NO: 161470 - RNA, 21 nt, Human
ucccuggagcgagcuggcgcc

SEQ ID NO: 161471 - RNA, 19 nt, Human
ucccuggagcgagcugggg

SEQ ID NO: 161472 - RNA, 22 nt, Human
ucuucucaaaucccaaugcaag

SEQ ID NO: 161473 - RNA, 19 nt, Human
uggauuggcuguguggaug

SEQ ID NO: 161474 - RNA, 23 nt, Human
ugucaagaagagcugaagacagc

SEQ ID NO: 161475 - RNA, 21 nt, Human
uguggaacggaagagccuuga

SEQ ID NO: 161476 - RNA, 19 nt, Human
uuaucuguuaauaacagug

SEQ ID NO: 161477 - RNA, 22 nt, Human
uucaggacagggagcuucagga

SEQ ID NO: 161478 - RNA, 23 nt, Human
uuggaacucgagcaucucccugu

SEQ ID NO: 161479 - RNA, 25 nt, Human
uuuauagaaaaauaaagaaaauaaa

SEQ ID NO: 161480 - RNA, 20 nt, Human
aggccugaggaugauagggu

SEQ ID NO: 161481 - RNA, 20 nt, Human
agggaucuggcucugaguuc

SEQ ID NO: 161482 - RNA, 18 nt, Human
augauaggguugcaaauc

SEQ ID NO: 161483 - RNA, 21 nt, Human
cacccccggccguaaugggca

SEQ ID NO: 161484 - RNA, 23 nt, Human
ccaaggaaaagucgagaguugga

SEQ ID NO: 161485 - RNA, 26 nt, Human
cguaaugggcacucugcguugauacc

SEQ ID NO: 161486 - RNA, 21 nt, Human
gagaguuggauaagggaucug

SEQ ID NO: 161487 - RNA, 22 nt, Human
gcucugaguucuauguuuccug

SEQ ID NO: 161488 - RNA, 21 nt, Human
uacugcucuuauuacccccau

SEQ ID NO: 161489 - RNA, 21 nt, Human
uagagaggccugaggaugaua

SEQ ID NO: 161490 - RNA, 18 nt, Human
ucuauguuuccugcugcu

SEQ ID NO: 161491 - RNA, 23 nt, Human
uggcucugaguucuauguuuccu

SEQ ID NO: 161492 - RNA, 19 nt, Human
uguagagaggccugaggau

SEQ ID NO: 161493 - RNA, 18 nt, Human
ugugagggaacgguuggg

SEQ ID NO: 161494 - RNA, 22 nt, Human
uugaagaucaugggcuuuuccc

SEQ ID NO: 161495 - RNA, 22 nt, Human
uuuguguagcucugaaacuuca

SEQ ID NO: 161496 - RNA, 20 nt, Human
uuuugcugugagggaacggu

SEQ ID NO: 161497 - RNA, 26 nt, Human
uuuuuuuuuuuuuuuugcugugaggg

SEQ ID NO: 161498 - RNA, 18 nt, Human
uuuuuuuuuuuuuuuuug

SEQ ID NO: 161499 - RNA, 20 nt, Human
uuuuuuuuuuuuuuuuugcu

SEQ ID NO: 161500 - RNA, 24 nt, Human
uuuuuuuuuuuuuuuuugcuguga

SEQ ID NO: 161501 - RNA, 24 nt, Human
accaggacgccgaggaggggcuuc

SEQ ID NO: 161502 - RNA, 19 nt, Human
cacagcaugaaaggggccu

SEQ ID NO: 161503 - RNA, 21 nt, Human
cacggccgggaccaggacgcc

SEQ ID NO: 161504 - RNA, 20 nt, Human
cccggcccgccccuuccucc

SEQ ID NO: 161505 - RNA, 21 nt, Human
cccggcccgccccuuccuccc

SEQ ID NO: 161506 - RNA, 19 nt, Human
cgacccccggcccgccccu

SEQ ID NO: 161507 - RNA, 21 nt, Human
cgaccuggggcgggagggggc

SEQ ID NO: 161508 - RNA, 19 nt, Human
cggccgggaccaggacgcc

SEQ ID NO: 161509 - RNA, 24 nt, Human
cggccgggaccaggacgccgagga

SEQ ID NO: 161510 - RNA, 21 nt, Human
cuaggcccagaaccccuucug

SEQ ID NO: 161511 - RNA, 20 nt, Human
cuccucccgacccccggccc

SEQ ID NO: 161512 - RNA, 20 nt, Human
gaccuggggcgggagggggc

SEQ ID NO: 161513 - RNA, 23 nt, Human
gacgaccuggggcgggagggggc

SEQ ID NO: 161514 - RNA, 19 nt, Human
ggaccaggacgccgaggag

SEQ ID NO: 161515 - RNA, 18 nt, Human
ggaggcucagagaugcca

SEQ ID NO: 161516 - RNA, 21 nt, Human
ggcccagaaccccuucuggag

SEQ ID NO: 161517 - RNA, 26 nt, Human
ucccgacccccggcccgccccuuccu

SEQ ID NO: 161518 - RNA, 23 nt, Human
uguauuaggaggggaaacugagg

SEQ ID NO: 161519 - RNA, 25 nt, Human
aaaaaaaaaucuugaaaacugcaaa

SEQ ID NO: 161520 - RNA, 23 nt, Human
aaaaacuagauacucuagucucc

SEQ ID NO: 161521 - RNA, 18 nt, Human
aaaaacuggggagggaca

SEQ ID NO: 161522 - RNA, 20 nt, Human
aaacagcauccuagcugacu

SEQ ID NO: 161523 - RNA, 24 nt, Human
aaacugcugguauuacagguguga

SEQ ID NO: 161524 - RNA, 22 nt, Human
aaagaaaucagcugucccacca

SEQ ID NO: 161525 - RNA, 21 nt, Human
aaaguagcacuaacauaccag

SEQ ID NO: 161526 - RNA, 20 nt, Human
aacuguuaaaauacauaaga

SEQ ID NO: 161527 - RNA, 22 nt, Human
aagaaaaguauuucagcagcca

SEQ ID NO: 161528 - RNA, 22 nt, Human
aagagacgggguuucacuaugu

SEQ ID NO: 161529 - RNA, 21 nt, Human
aagcaaaugguccucaucaag

SEQ ID NO: 161530 - RNA, 21 nt, Human
aagcucauuccaaauguguuu

SEQ ID NO: 161531 - RNA, 19 nt, Human
aaguccaggggagagcagg

SEQ ID NO: 161532 - RNA, 18 nt, Human
aagucugaguucuugccc

SEQ ID NO: 161533 - RNA, 24 nt, Human
aagugauccaccugccuuagcuuc

SEQ ID NO: 161534 - RNA, 19 nt, Human
aagugccaucagaggucag

SEQ ID NO: 161535 - RNA, 19 nt, Human
aaguggcaaugggaugcau

SEQ ID NO: 161536 - RNA, 22 nt, Human
aauucagucaugcaaucuuuug

SEQ ID NO: 161537 - RNA, 24 nt, Human
aauuugagggcagaaaguagaaau

SEQ ID NO: 161538 - RNA, 19 nt, Human
acauucaugggugccuaac

SEQ ID NO: 161539 - RNA, 18 nt, Human
acgggguuucacuauguu

SEQ ID NO: 161540 - RNA, 23 nt, Human
acgggguuucacuauguuggcca

SEQ ID NO: 161541 - RNA, 24 nt, Human
acgggguuucacuauguuggccag

SEQ ID NO: 161542 - RNA, 24 nt, Human
acuauguuggccaggcuggucucg

SEQ ID NO: 161543 - RNA, 21 nt, Human
acuccacagaacccaacuguu

SEQ ID NO: 161544 - RNA, 21 nt, Human
acucuaugggcugauuuucua

SEQ ID NO: 161545 - RNA, 21 nt, Human
acugaaguuuuuccaugcauu

SEQ ID NO: 161546 - RNA, 19 nt, Human
acugagcacaagcaaaugg

SEQ ID NO: 161547 - RNA, 23 nt, Human
acuguguugugaugcgaaacaga

SEQ ID NO: 161548 - RNA, 25 nt, Human
agaaaagaaacauggaacuagaaaa

SEQ ID NO: 161549 - RNA, 23 nt, Human
agaaauucucuugacuggucagu

SEQ ID NO: 161550 - RNA, 21 nt, Human
agaaauuugagggcagaaagu

SEQ ID NO: 161551 - RNA, 19 nt, Human
agaagagacgggguuucac

SEQ ID NO: 161552 - RNA, 20 nt, Human
agaaggaggcaaacugguaa

SEQ ID NO: 161553 - RNA, 22 nt, Human
agaaucagagguaagccuggcc

SEQ ID NO: 161554 - RNA, 22 nt, Human
agacaacugcuuaaccaagaaa

SEQ ID NO: 161555 - RNA, 21 nt, Human
agacugaaaaacuggggaggg

SEQ ID NO: 161556 - RNA, 19 nt, Human
agagaggacugggugacua

SEQ ID NO: 161557 - RNA, 22 nt, Human
agcuccagaaaguaguccuaaa

SEQ ID NO: 161558 - RNA, 19 nt, Human
agcugucccaccaagcagc

SEQ ID NO: 161559 - RNA, 20 nt, Human
agcugucccaccaagcagcu

SEQ ID NO: 161560 - RNA, 19 nt, Human
aggaaggaaagagccucau

SEQ ID NO: 161561 - RNA, 22 nt, Human
aggagcuuguuaaugggucccu

SEQ ID NO: 161562 - RNA, 24 nt, Human
aggcugaagugcaaugccgcgauc

SEQ ID NO: 161563 - RNA, 22 nt, Human
agggacacaaacuuuacaaacu

SEQ ID NO: 161564 - RNA, 29 nt, Human
agggcagaaaguagaaaugaggggacccc

SEQ ID NO: 161565 - RNA, 24 nt, Human
agguacugaagauggauauaccua

SEQ ID NO: 161566 - RNA, 24 nt, Human
aguacaaucuauucuuaacuaccu

SEQ ID NO: 161567 - RNA, 18 nt, Human
agucacggcagucuuggg

SEQ ID NO: 161568 - RNA, 24 nt, Human
agugauucuccugccucagccucc

SEQ ID NO: 161569 - RNA, 24 nt, Human
agugcaaugccgcgaucuuggcuc

SEQ ID NO: 161570 - RNA, 23 nt, Human
aguuuugugaaaucauggccucu

SEQ ID NO: 161571 - RNA, 23 nt, Human
auacugagcacaagcaaaugguc

SEQ ID NO: 161572 - RNA, 20 nt, Human
auaucacuuuguuuagaaau

SEQ ID NO: 161573 - RNA, 25 nt, Human
auguguuuuccagauuuagcucugg

SEQ ID NO: 161574 - RNA, 22 nt, Human
auuacaggugugagccacugca

SEQ ID NO: 161575 - RNA, 23 nt, Human
caaacugcugguauuacaggugu

SEQ ID NO: 161576 - RNA, 21 nt, Human
caaagggugggggaggguucc

SEQ ID NO: 161577 - RNA, 20 nt, Human
caaauaagcucucaccuucc

SEQ ID NO: 161578 - RNA, 22 nt, Human
caagugauccaccugccuuagc

SEQ ID NO: 161579 - RNA, 20 nt, Human
caagugauucuccugccuca

SEQ ID NO: 161580 - RNA, 22 nt, Human
caagugauucuccugccucagc

SEQ ID NO: 161581 - RNA, 27 nt, Human
caauuccacauaagauuaguugaaaaa

SEQ ID NO: 161582 - RNA, 24 nt, Human
cacaggaccuauacaaaaggacau

SEQ ID NO: 161583 - RNA, 22 nt, Human
caccaccaugcccagcuaauuu

SEQ ID NO: 161584 - RNA, 23 nt, Human
cacccaaaagaagcagggauuuc

SEQ ID NO: 161585 - RNA, 21 nt, Human
cacuauguuggccaggcuggu

SEQ ID NO: 161586 - RNA, 24 nt, Human
cacuauguuggccaggcuggucuc

SEQ ID NO: 161587 - RNA, 18 nt, Human
cacuccacagaacccaac

SEQ ID NO: 161588 - RNA, 22 nt, Human
cagaaacacccugagacuuagc

SEQ ID NO: 161589 - RNA, 22 nt, Human
cagaagacuguugguuaucauu

SEQ ID NO: 161590 - RNA, 23 nt, Human
cagacugaaaaacuggggaggga

SEQ ID NO: 161591 - RNA, 24 nt, Human
cagagucuugcucuaucgcccagg

SEQ ID NO: 161592 - RNA, 18 nt, Human
cagcuuaaaauggcauca

SEQ ID NO: 161593 - RNA, 18 nt, Human
caucuaggaaaggcuaga

SEQ ID NO: 161594 - RNA, 19 nt, Human
caucuugagcuuagagaau

SEQ ID NO: 161595 - RNA, 20 nt, Human
cauggaacuagaaaauugca

SEQ ID NO: 161596 - RNA, 24 nt, Human
cauuuaggauuuaaaaaacuguuc

SEQ ID NO: 161597 - RNA, 21 nt, Human
ccaaaagagaaauucucccau

SEQ ID NO: 161598 - RNA, 23 nt, Human
ccaccugccuuagcuucucaaac

SEQ ID NO: 161599 - RNA, 21 nt, Human
ccacugcacccaaaagaagca

SEQ ID NO: 161600 - RNA, 21 nt, Human
cccacaugauuaagcugaaau

SEQ ID NO: 161601 - RNA, 21 nt, Human
cccggguucaagugauucucc

SEQ ID NO: 161602 - RNA, 23 nt, Human
cccggguucaagugauucuccug

SEQ ID NO: 161603 - RNA, 23 nt, Human
cccuuaggaaggaaagagccuca

SEQ ID NO: 161604 - RNA, 24 nt, Human
cccuugggaaauagaaugguaaag

SEQ ID NO: 161605 - RNA, 23 nt, Human
ccugccucagccuccuguguagc

SEQ ID NO: 161606 - RNA, 18 nt, Human
ccuggccucaagugaucc

SEQ ID NO: 161607 - RNA, 21 nt, Human
ccuggccucaagugauccacc

SEQ ID NO: 161608 - RNA, 23 nt, Human
ccuggccucaagugauccaccug

SEQ ID NO: 161609 - RNA, 23 nt, Human
ccuggccucaagugauccaccug

SEQ ID NO: 161610 - RNA, 24 nt, Human
cgaaaaagucuaccagcccauucc

SEQ ID NO: 161611 - RNA, 24 nt, Human
cgggguuucacuauguuggccagg

SEQ ID NO: 161612 - RNA, 23 nt, Human
cgugcaccaccaugcccagcuaa

SEQ ID NO: 161613 - RNA, 23 nt, Human
cuaacagacugucugagaauaaa

SEQ ID NO: 161614 - RNA, 23 nt, Human
cucaagugauccaccugccuuag

SEQ ID NO: 161615 - RNA, 24 nt, Human
cucacugcagacucugcuucccgg

SEQ ID NO: 161616 - RNA, 24 nt, Human
cucagacuccacaaucuuaaaagu

SEQ ID NO: 161617 - RNA, 24 nt, Human
cucagccuccuguguagcugggac

SEQ ID NO: 161618 - RNA, 23 nt, Human
cucuaucgcccaggcugaagugc

SEQ ID NO: 161619 - RNA, 23 nt, Human
cucugauacaaauaagcucucac

SEQ ID NO: 161620 - RNA, 23 nt, Human
cugaagauggauauaccuaaccc

SEQ ID NO: 161621 - RNA, 22 nt, Human
cugaugugaagcagcuuaaaau

SEQ ID NO: 161622 - RNA, 23 nt, Human
cugcaaagugacuccaguuacau

SEQ ID NO: 161623 - RNA, 23 nt, Human
cugccucagccuccuguguagcu

SEQ ID NO: 161624 - RNA, 18 nt, Human
cuggacacuccacagaac

SEQ ID NO: 161625 - RNA, 22 nt, Human
cugguauuacaggugugagcca

SEQ ID NO: 161626 - RNA, 18 nt, Human
cuguaccugaagauaaaa

SEQ ID NO: 161627 - RNA, 19 nt, Human
cuguaccugaagauaaaac

SEQ ID NO: 161628 - RNA, 22 nt, Human
cuuaaaauggcaucaugcaccc

SEQ ID NO: 161629 - RNA, 22 nt, Human
cuucaggaaggggagagacuuc

SEQ ID NO: 161630 - RNA, 22 nt, Human
cuuccaguucaaacauuacuuc

SEQ ID NO: 161631 - RNA, 21 nt, Human
cuucccggguucaagugauuc

SEQ ID NO: 161632 - RNA, 21 nt, Human
gaaauucucccauuucaaccu

SEQ ID NO: 161633 - RNA, 19 nt, Human
gaagaggagaagaaacagg

SEQ ID NO: 161634 - RNA, 23 nt, Human
gaagaggaguggguuauucuuuu

SEQ ID NO: 161635 - RNA, 23 nt, Human
gacaaguaauaagcucugauaca

SEQ ID NO: 161636 - RNA, 24 nt, Human
gacuauaggcgugcaccaccaugc

SEQ ID NO: 161637 - RNA, 19 nt, Human
gagaaggcauuuuccagau

SEQ ID NO: 161638 - RNA, 24 nt, Human
gagacgggguuucacuauguuggc

SEQ ID NO: 161639 - RNA, 21 nt, Human
gagagaaggcauuuuccagau

SEQ ID NO: 161640 - RNA, 22 nt, Human
gagcagguaccaaaucuaguga

SEQ ID NO: 161641 - RNA, 18 nt, Human
gagccacugcacccaaaa

SEQ ID NO: 161642 - RNA, 21 nt, Human
gcaaaugguccucaucaagau

SEQ ID NO: 161643 - RNA, 24 nt, Human
gcccagcuaauuuuuuuguauuuu

SEQ ID NO: 161644 - RNA, 23 nt, Human
gcuggucucgaacuccuggccuc

SEQ ID NO: 161645 - RNA, 25 nt, Human
gcuucccggguucaagugauucucc

SEQ ID NO: 161646 - RNA, 24 nt, Human
ggacuauaggcgugcaccaccaug

SEQ ID NO: 161647 - RNA, 24 nt, Human
ggccucaagugauccaccugccuu

SEQ ID NO: 161648 - RNA, 24 nt, Human
ggcuggucucgaacuccuggccuc

SEQ ID NO: 161649 - RNA, 20 nt, Human
gggcccccaccauaaauccc

SEQ ID NO: 161650 - RNA, 23 nt, Human
gggguuucacuauguuggccagg

SEQ ID NO: 161651 - RNA, 22 nt, Human
ggguucaagugauucuccugcc

SEQ ID NO: 161652 - RNA, 23 nt, Human
ggguucaagugauucuccugccu

SEQ ID NO: 161653 - RNA, 18 nt, Human
guacuugguaaaguagaa

SEQ ID NO: 161654 - RNA, 18 nt, Human
guagcugggacuauaggc

SEQ ID NO: 161655 - RNA, 18 nt, Human
guagcugggacuauaggc

SEQ ID NO: 161656 - RNA, 24 nt, Human
gucacucaaagucugaucacuuga

SEQ ID NO: 161657 - RNA, 24 nt, Human
gugauccaccugccuuagcuucuc

SEQ ID NO: 161658 - RNA, 24 nt, Human
gugauucuccugccucagccuccu

SEQ ID NO: 161659 - RNA, 21 nt, Human
gugcugcucacuugguugucu

SEQ ID NO: 161660 - RNA, 24 nt, Human
guguaugcauuucuaaauacugag

SEQ ID NO: 161661 - RNA, 19 nt, Human
gugugguacuugguaaagu

SEQ ID NO: 161662 - RNA, 18 nt, Human
uaaaaccacacaguaaac

SEQ ID NO: 161663 - RNA, 19 nt, Human
uaaaagaaguagguauuug

SEQ ID NO: 161664 - RNA, 18 nt, Human
uaaaauggcaucaugcac

SEQ ID NO: 161665 - RNA, 23 nt, Human
uaaacagcauccuagcugacuca

SEQ ID NO: 161666 - RNA, 24 nt, Human
uaaaugcccagaagaggagugggu

SEQ ID NO: 161667 - RNA, 25 nt, Human
uaaauucagaaaauauaaaauguac

SEQ ID NO: 161668 - RNA, 24 nt, Human
uaacaaacauaugaacuauucccc

SEQ ID NO: 161669 - RNA, 20 nt, Human
uaaccuagcauuguaugugg

SEQ ID NO: 161670 - RNA, 28 nt, Human
uaagauuaguugaaaaaugaaccugaua

SEQ ID NO: 161671 - RNA, 21 nt, Human
uaagcggcagaaacacccuga

SEQ ID NO: 161672 - RNA, 21 nt, Human
uacaaacucuaugaucugagg

SEQ ID NO: 161673 - RNA, 19 nt, Human
uacaggugugagccacugc

SEQ ID NO: 161674 - RNA, 24 nt, Human
uacaggugugagccacugcaccca

SEQ ID NO: 161675 - RNA, 22 nt, Human
uaccacaaacuaucuguaccug

SEQ ID NO: 161676 - RNA, 21 nt, Human
uaccagcccauucccucagac

SEQ ID NO: 161677 - RNA, 25 nt, Human
uacccaauguauaaauuccugcuua

SEQ ID NO: 161678 - RNA, 23 nt, Human
uaccuaacccaaggucucuggac

SEQ ID NO: 161679 - RNA, 22 nt, Human
uaccugaagauaaaaccacaca

SEQ ID NO: 161680 - RNA, 24 nt, Human
uagaagagacgggguuucacuaug

SEQ ID NO: 161681 - RNA, 23 nt, Human
uagaaggugccaggggguauucu

SEQ ID NO: 161682 - RNA, 20 nt, Human
uagaaggugggaauguggca

SEQ ID NO: 161683 - RNA, 21 nt, Human
uaggacagaagacuguugguu

SEQ ID NO: 161684 - RNA, 23 nt, Human
uaucaaagguuuucauguugcuu

SEQ ID NO: 161685 - RNA, 19 nt, Human
uauguuggccaggcugguc

SEQ ID NO: 161686 - RNA, 24 nt, Human
uauguuggccaggcuggucucgaa

SEQ ID NO: 161687 - RNA, 22 nt, Human
uauuacaggugugagccacugc

SEQ ID NO: 161688 - RNA, 19 nt, Human
uauuagaagaggagaagaa

SEQ ID NO: 161689 - RNA, 21 nt, Human
uauugugccuacauuuuccuu

SEQ ID NO: 161690 - RNA, 24 nt, Human
ucaaacugcugguauuacaggugu

SEQ ID NO: 161691 - RNA, 26 nt, Human
ucaacagacugaaaaacuggggaggg

SEQ ID NO: 161692 - RNA, 20 nt, Human
ucaagugauauaagagagag

SEQ ID NO: 161693 - RNA, 21 nt, Human
ucaagugauccaccugccuua

SEQ ID NO: 161694 - RNA, 19 nt, Human
ucaagugauucuccugccu

SEQ ID NO: 161695 - RNA, 22 nt, Human
ucacuauguuggccaggcuggu

SEQ ID NO: 161696 - RNA, 24 nt, Human
ucacugcagacucugcuucccggg

SEQ ID NO: 161697 - RNA, 22 nt, Human
ucagaaggcuguaaaauccugu

SEQ ID NO: 161698 - RNA, 24 nt, Human
ucagaugacucuuucugugucuuc

SEQ ID NO: 161699 - RNA, 18 nt, Human
ucaggaaggggagagacu

SEQ ID NO: 161700 - RNA, 20 nt, Human
ucaggaaggggagagacuuc

SEQ ID NO: 161701 - RNA, 19 nt, Human
ucccaccaagcagcuacuc

SEQ ID NO: 161702 - RNA, 18 nt, Human
uccccaaguuagggugga

SEQ ID NO: 161703 - RNA, 20 nt, Human
ucccccuaaaaacccuuaga

SEQ ID NO: 161704 - RNA, 21 nt, Human
ucccggguucaagugauucuc

SEQ ID NO: 161705 - RNA, 24 nt, Human
ucccggguucaagugauucuccug

SEQ ID NO: 161706 - RNA, 18 nt, Human
ucccuugggaaauagaau

SEQ ID NO: 161707 - RNA, 20 nt, Human
uccuuuaagcacaggaccua

SEQ ID NO: 161708 - RNA, 18 nt, Human
ucgcccaggcugaagugc

SEQ ID NO: 161709 - RNA, 24 nt, Human
ucucaaacugcugguauuacaggu

SEQ ID NO: 161710 - RNA, 24 nt, Human
ucuccacuguaaccuagcauugua

SEQ ID NO: 161711 - RNA, 20 nt, Human
ucucccauuucaaccuacua

SEQ ID NO: 161712 - RNA, 26 nt, Human
ucuccugccucagccuccuguguagc

SEQ ID NO: 161713 - RNA, 21 nt, Human
ucucgaacuccuggccucaag

SEQ ID NO: 161714 - RNA, 28 nt, Human
ucuguaccugaagauaaaaccggggucc

SEQ ID NO: 161715 - RNA, 23 nt, Human
ucuguauuagguuggguuagaag

SEQ ID NO: 161716 - RNA, 22 nt, Human
ucuuaaaugucuccagaaacca

SEQ ID NO: 161717 - RNA, 21 nt, Human
ucuugaguacuuacuuaaucc

SEQ ID NO: 161718 - RNA, 19 nt, Human
ucuugcucuaucgcccagg

SEQ ID NO: 161719 - RNA, 23 nt, Human
ucuugcucuaucgcccaggcuga

SEQ ID NO: 161720 - RNA, 24 nt, Human
ucuugcucuaucgcccaggcugaa

SEQ ID NO: 161721 - RNA, 22 nt, Human
ucuuugguucccacuuauguuu

SEQ ID NO: 161722 - RNA, 20 nt, Human
ugaaagaaaagugauccaau

SEQ ID NO: 161723 - RNA, 22 nt, Human
ugaaagaaaagugauccaauga

SEQ ID NO: 161724 - RNA, 23 nt, Human
ugaagauggauauaccuaaccca

SEQ ID NO: 161725 - RNA, 19 nt, Human
ugaagugcaaugccgcgau

SEQ ID NO: 161726 - RNA, 24 nt, Human
ugaagugcaaugccgcgaucuugg

SEQ ID NO: 161727 - RNA, 27 nt, Human
ugaaugaaucaucagaaggcuguaaaa

SEQ ID NO: 161728 - RNA, 22 nt, Human
ugagacagagucuugcucuauc

SEQ ID NO: 161729 - RNA, 20 nt, Human
ugagagaauuacaucagaug

SEQ ID NO: 161730 - RNA, 18 nt, Human
ugagauagaaacagaaau

SEQ ID NO: 161731 - RNA, 23 nt, Human
ugagguagggugaauaguuguca

SEQ ID NO: 161732 - RNA, 18 nt, Human
ugaguaaaggaauauguu

SEQ ID NO: 161733 - RNA, 20 nt, Human
ugaguaaaggaauauguucu

SEQ ID NO: 161734 - RNA, 21 nt, Human
ugaguuuugugaaaucauggc

SEQ ID NO: 161735 - RNA, 23 nt, Human
ugauacaaauaagcucucaccuu

SEQ ID NO: 161736 - RNA, 25 nt, Human
ugauauaagagagagaugggguaaa

SEQ ID NO: 161737 - RNA, 21 nt, Human
ugaugcgaaacagacauugga

SEQ ID NO: 161738 - RNA, 20 nt, Human
ugauucuccugccucagccu

SEQ ID NO: 161739 - RNA, 22 nt, Human
ugcaaugccgcgaucuuggcuc

SEQ ID NO: 161740 - RNA, 23 nt, Human
ugccaggggguauucuaggguag

SEQ ID NO: 161741 - RNA, 22 nt, Human
ugccuaguugagauagaaacag

SEQ ID NO: 161742 - RNA, 24 nt, Human
ugccucagccuccuguguagcugg

SEQ ID NO: 161743 - RNA, 23 nt, Human
ugccucucaggaugucucuggag

SEQ ID NO: 161744 - RNA, 19 nt, Human
ugcucccugcuuagagagg

SEQ ID NO: 161745 - RNA, 24 nt, Human
ugcucuaucgcccaggcugaagug

SEQ ID NO: 161746 - RNA, 22 nt, Human
ugcugcucacuugguugucuuu

SEQ ID NO: 161747 - RNA, 19 nt, Human
ugcuuauaauuauauagga

SEQ ID NO: 161748 - RNA, 24 nt, Human
uggaagacaaggaggaaagaggga

SEQ ID NO: 161749 - RNA, 20 nt, Human
uggcaaagaaugggaguccc

SEQ ID NO: 161750 - RNA, 24 nt, Human
uggccaggcuggucucgaacuccu

SEQ ID NO: 161751 - RNA, 24 nt, Human
uggccucaagugauccaccugccu

SEQ ID NO: 161752 - RNA, 21 nt, Human
ugggacuauaggcgugcacca

SEQ ID NO: 161753 - RNA, 24 nt, Human
ugggacuauaggcgugcaccacca

SEQ ID NO: 161754 - RNA, 25 nt, Human
ugggacuauaggcgugcaccaccau

SEQ ID NO: 161755 - RNA, 19 nt, Human
uggguuagaaggugccagg

SEQ ID NO: 161756 - RNA, 19 nt, Human
ugguauuacaggugugagc

SEQ ID NO: 161757 - RNA, 21 nt, Human
ugguauuacaggugugagcca

SEQ ID NO: 161758 - RNA, 22 nt, Human
ugguauuacaggugugagccac

SEQ ID NO: 161759 - RNA, 24 nt, Human
ugguauuacaggugugagccacug

SEQ ID NO: 161760 - RNA, 19 nt, Human
uguagcugggacuauaggc

SEQ ID NO: 161761 - RNA, 24 nt, Human
uguagggaagaauauagaaccugu

SEQ ID NO: 161762 - RNA, 25 nt, Human
ugucucauucaucuuggcuucucca

SEQ ID NO: 161763 - RNA, 18 nt, Human
ugugaaaccagaagacaa

SEQ ID NO: 161764 - RNA, 19 nt, Human
ugugagccacugcacccaa

SEQ ID NO: 161765 - RNA, 22 nt, Human
ugugagccacugcacccaaaag

SEQ ID NO: 161766 - RNA, 22 nt, Human
uguggcacuuucuugacuaggu

SEQ ID NO: 161767 - RNA, 22 nt, Human
ugugucaauugggccaagaugu

SEQ ID NO: 161768 - RNA, 20 nt, Human
ugugucuucaaacuugucac

SEQ ID NO: 161769 - RNA, 19 nt, Human
uuagaaauucauauauaug

SEQ ID NO: 161770 - RNA, 24 nt, Human
uuagaagagacgggguuucacuau

SEQ ID NO: 161771 - RNA, 21 nt, Human
uuaguugaaaaaugaaccuga

SEQ ID NO: 161772 - RNA, 21 nt, Human
uucaagugauucuccugccuc

SEQ ID NO: 161773 - RNA, 23 nt, Human
uucaagugauucuccugccucag

SEQ ID NO: 161774 - RNA, 24 nt, Human
uucaagugauucuccugccucagc

SEQ ID NO: 161775 - RNA, 21 nt, Human
uucaggaaggggagagacuuc

SEQ ID NO: 161776 - RNA, 23 nt, Human
uucaucuuuuuggauuuggaaag

SEQ ID NO: 161777 - RNA, 19 nt, Human
uuccuagacaaagagaaaa

SEQ ID NO: 161778 - RNA, 20 nt, Human
uuccuuagcuuugccuggug

SEQ ID NO: 161779 - RNA, 18 nt, Human
uuccuuauauucucuuuc

SEQ ID NO: 161780 - RNA, 21 nt, Human
uuccuuuuuuuuuuuucugag

SEQ ID NO: 161781 - RNA, 18 nt, Human
uugcugggauuuuucuug

SEQ ID NO: 161782 - RNA, 20 nt, Human
uuggauuuggaaaggaagau

SEQ ID NO: 161783 - RNA, 24 nt, Human
uugggagugcacagauuauaaauu

SEQ ID NO: 161784 - RNA, 20 nt, Human
uuggguuuuagccucagcug

SEQ ID NO: 161785 - RNA, 19 nt, Human
uugugccuacauuuuccuu

SEQ ID NO: 161786 - RNA, 23 nt, Human
uuguucagaucauucuuuucugu

SEQ ID NO: 161787 - RNA, 24 nt, Human
uuucacuauguuggccaggcuggu

SEQ ID NO: 161788 - RNA, 18 nt, Human
uuuccagauuuagcucug

SEQ ID NO: 161789 - RNA, 24 nt, Human
uuuccaugcauuaaagcuauuaca

SEQ ID NO: 161790 - RNA, 23 nt, Human
uuucuucccucuccaaaucaugg

SEQ ID NO: 161791 - RNA, 27 nt, Human
uuugcugacaaucuuaaaugucuccaa

SEQ ID NO: 161792 - RNA, 19 nt, Human
uuugugaaaucauggccuc

SEQ ID NO: 161793 - RNA, 21 nt, Human
uuuuguauuuuuagaagagac

SEQ ID NO: 161794 - RNA, 24 nt, Human
uuuuuagaagagacgggguuucac

SEQ ID NO: 161795 - RNA, 21 nt, Human
uuuuuuguauuuuuagaagag

SEQ ID NO: 161796 - RNA, 20 nt, Human
uuuuuuuuucugagacagag

SEQ ID NO: 161797 - RNA, 20 nt, Human
acagggcagaggaaaccagc

SEQ ID NO: 161798 - RNA, 24 nt, Human
auucucccucuggugagguugugg

SEQ ID NO: 161799 - RNA, 21 nt, Human
cucucuggccuuugacucuga

SEQ ID NO: 161800 - RNA, 21 nt, Human
cugagcugggggcaaaggggc

SEQ ID NO: 161801 - RNA, 21 nt, Human
cuuguggguguggccucccca

SEQ ID NO: 161802 - RNA, 26 nt, Human
gcauguggcggcuugacugagcuggg

SEQ ID NO: 161803 - RNA, 23 nt, Human
gccuuugacucugaagagucccc

SEQ ID NO: 161804 - RNA, 19 nt, Human
gcuggggaaauggggugac

SEQ ID NO: 161805 - RNA, 19 nt, Human
gcugggggcaaaggggcag

SEQ ID NO: 161806 - RNA, 22 nt, Human
guggcggcuugacugagcuggg

SEQ ID NO: 161807 - RNA, 22 nt, Human
uccacgacgcagcgcuuguggg

SEQ ID NO: 161808 - RNA, 20 nt, Human
ucccaaaguaaacauauuua

SEQ ID NO: 161809 - RNA, 20 nt, Human
ucugaagagucccccagcuc

SEQ ID NO: 161810 - RNA, 19 nt, Human
ugagcugggggcaaagggg

SEQ ID NO: 161811 - RNA, 20 nt, Human
ugagcugggggcaaaggggc

SEQ ID NO: 161812 - RNA, 18 nt, Human
ugggagugugucuggcug

SEQ ID NO: 161813 - RNA, 20 nt, Human
aaacaucacagcacaauuuc

SEQ ID NO: 161814 - RNA, 20 nt, Human
aacccuaccccccaaccaac

SEQ ID NO: 161815 - RNA, 22 nt, Human
aaccguagggccaagcucccaa

SEQ ID NO: 161816 - RNA, 18 nt, Human
aaccucucccagccuccc

SEQ ID NO: 161817 - RNA, 24 nt, Human
aaccuguucuccucacaagacucc

SEQ ID NO: 161818 - RNA, 24 nt, Human
aaccuguucuccucacaagacucc

SEQ ID NO: 161819 - RNA, 26 nt, Human
aaccuguucuccucacaagacuccac

SEQ ID NO: 161820 - RNA, 26 nt, Human
aaccuguucuccucacaagacuccac

SEQ ID NO: 161821 - RNA, 26 nt, Human
aaccuguucuccucacaagacuccag

SEQ ID NO: 161822 - RNA, 26 nt, Human
aaccuguucuccucacaagacuccag

SEQ ID NO: 161823 - RNA, 20 nt, Human
aagaagcagggccauaggcg

SEQ ID NO: 161824 - RNA, 21 nt, Human
aagccaggggacaggagccgg

SEQ ID NO: 161825 - RNA, 18 nt, Human
aagccccaagccacacag

SEQ ID NO: 161826 - RNA, 18 nt, Human
aagccccaagccacacag

SEQ ID NO: 161827 - RNA, 20 nt, Human
aagcucccaaacccuacccc

SEQ ID NO: 161828 - RNA, 22 nt, Human
aagcucccaaacccuacccccc

SEQ ID NO: 161829 - RNA, 22 nt, Human
aagcucccaaacccuacccccc

SEQ ID NO: 161830 - RNA, 24 nt, Human
aagcucccaaacccuaccccccaa

SEQ ID NO: 161831 - RNA, 24 nt, Human
aagcucccaaacccuaccccccaa

SEQ ID NO: 161832 - RNA, 21 nt, Human
aagggcagccacaagccgugg

SEQ ID NO: 161833 - RNA, 23 nt, Human
acaagccccaagccacacagcag

SEQ ID NO: 161834 - RNA, 23 nt, Human
acaagccccaagccacacagcag

SEQ ID NO: 161835 - RNA, 20 nt, Human
acccaccggucaucuccccc

SEQ ID NO: 161836 - RNA, 20 nt, Human
acccaccggucaucuccccc

SEQ ID NO: 161837 - RNA, 19 nt, Human
acccuaccccccaaccaac

SEQ ID NO: 161838 - RNA, 19 nt, Human
acccuaccccccaaccaac

SEQ ID NO: 161839 - RNA, 19 nt, Human
accucucccagccuccccc

SEQ ID NO: 161840 - RNA, 19 nt, Human
accucucccagccuccccc

SEQ ID NO: 161841 - RNA, 24 nt, Human
acuuagcaaacugguaguuguccu

SEQ ID NO: 161842 - RNA, 24 nt, Human
acuuagcaaacugguaguuguccu

SEQ ID NO: 161843 - RNA, 23 nt, Human
agccaagggcagccacaagccgu

SEQ ID NO: 161844 - RNA, 21 nt, Human
aggaaacgggcaagcaaccau

SEQ ID NO: 161845 - RNA, 20 nt, Human
aggaagaagcagggccauaa

SEQ ID NO: 161846 - RNA, 18 nt, Human
aggagccgggggggccag

SEQ ID NO: 161847 - RNA, 18 nt, Human
aggagccgggggggccag

SEQ ID NO: 161848 - RNA, 20 nt, Human
aggaugaaggaggaaauggg

SEQ ID NO: 161849 - RNA, 20 nt, Human
aggaugaaggaggaaauggg

SEQ ID NO: 161850 - RNA, 23 nt, Human
aggcaacaagccccaagccacac

SEQ ID NO: 161851 - RNA, 27 nt, Human
aggcaacaagccccaagccacacagca

SEQ ID NO: 161852 - RNA, 27 nt, Human
aggcaacaagccccaagccacacagca

SEQ ID NO: 161853 - RNA, 18 nt, Human
aggggacaggagccgggg

SEQ ID NO: 161854 - RNA, 18 nt, Human
aggggacaggagccgggg

SEQ ID NO: 161855 - RNA, 23 nt, Human
auccacccuccgcuggaaaaccu

SEQ ID NO: 161856 - RNA, 24 nt, Human
caaaccguagggccaagcucccaa

SEQ ID NO: 161857 - RNA, 24 nt, Human
caaaccguagggccaagcucccaa

SEQ ID NO: 161858 - RNA, 22 nt, Human
caaccucucccagccuccccca

SEQ ID NO: 161859 - RNA, 22 nt, Human
caaccucucccagccuccccca

SEQ ID NO: 161860 - RNA, 25 nt, Human
caagccccaagccacacagcaggag

SEQ ID NO: 161861 - RNA, 25 nt, Human
caagccccaagccacacagcaggag

SEQ ID NO: 161862 - RNA, 22 nt, Human
caagcucccaaacccuaccccc

SEQ ID NO: 161863 - RNA, 22 nt, Human
caagcucccaaacccuaccccc

SEQ ID NO: 161864 - RNA, 23 nt, Human
caagcucccaaacccuacccccc

SEQ ID NO: 161865 - RNA, 23 nt, Human
caagcucccaaacccuacccccc

SEQ ID NO: 161866 - RNA, 24 nt, Human
cacccccaccuucagcuccugggc

SEQ ID NO: 161867 - RNA, 27 nt, Human
caccuucagcuccugggcacccggccu

SEQ ID NO: 161868 - RNA, 21 nt, Human
cacgaaggcccccaggaccag

SEQ ID NO: 161869 - RNA, 21 nt, Human
cacgaaggcccccaggaccag

SEQ ID NO: 161870 - RNA, 22 nt, Human
cacuuccuugaauaauuagggg

SEQ ID NO: 161871 - RNA, 22 nt, Human
cagcacgggggaccgcucucca

SEQ ID NO: 161872 - RNA, 22 nt, Human
cagcacgggggaccgcucucca

SEQ ID NO: 161873 - RNA, 18 nt, Human
cagcauuuguaguuggca

SEQ ID NO: 161874 - RNA, 21 nt, Human
cagcccccuccguccgugucc

SEQ ID NO: 161875 - RNA, 21 nt, Human
cagcuccugggcacccggccu

SEQ ID NO: 161876 - RNA, 25 nt, Human
cagcuccugggcacccggccuucug

SEQ ID NO: 161877 - RNA, 22 nt, Human
caggagcccugggcagggcaca

SEQ ID NO: 161878 - RNA, 19 nt, Human
caggagccgggggggccag

SEQ ID NO: 161879 - RNA, 18 nt, Human
caguaggagggaggccug

SEQ ID NO: 161880 - RNA, 19 nt, Human
caguaggagggaggccugg

SEQ ID NO: 161881 - RNA, 20 nt, Human
ccaaccucucccagccuccc

SEQ ID NO: 161882 - RNA, 21 nt, Human
ccaaccucucccagccucccc

SEQ ID NO: 161883 - RNA, 22 nt, Human
ccaaccucucccagccuccccc

SEQ ID NO: 161884 - RNA, 23 nt, Human
ccaccaggugugcagccuggccu

SEQ ID NO: 161885 - RNA, 22 nt, Human
ccagccaagggcagccacaagc

SEQ ID NO: 161886 - RNA, 23 nt, Human
ccagccaagggcagccacaagcc

SEQ ID NO: 161887 - RNA, 23 nt, Human
ccagccagaacucccccagccga

SEQ ID NO: 161888 - RNA, 23 nt, Human
ccagccagaacucccccagccga

SEQ ID NO: 161889 - RNA, 25 nt, Human
ccauccacccuccgcuggaaaaccu

SEQ ID NO: 161890 - RNA, 22 nt, Human
cccaaccucucccagccucccc

SEQ ID NO: 161891 - RNA, 22 nt, Human
cccaaccucucccagccucccc

SEQ ID NO: 161892 - RNA, 19 nt, Human
cccaagccacacagcagga

SEQ ID NO: 161893 - RNA, 19 nt, Human
cccaagccacacagcagga

SEQ ID NO: 161894 - RNA, 19 nt, Human
cccacacucacgguccagc

SEQ ID NO: 161895 - RNA, 19 nt, Human
ccccaaaggccuggacuuu

SEQ ID NO: 161896 - RNA, 19 nt, Human
ccccaaaggccuggacuuu

SEQ ID NO: 161897 - RNA, 23 nt, Human
ccccaaaggccuggacuuuuacc

SEQ ID NO: 161898 - RNA, 23 nt, Human
ccccaaaggccuggacuuuuacc

SEQ ID NO: 161899 - RNA, 26 nt, Human
ccccaaaggccuggacuuuuaccucg

SEQ ID NO: 161900 - RNA, 27 nt, Human
ccccaaaggccuggacuuuuaccucgu

SEQ ID NO: 161901 - RNA, 19 nt, Human
ccccacacucacgguccag

SEQ ID NO: 161902 - RNA, 18 nt, Human
ccccagccgacugccgaa

SEQ ID NO: 161903 - RNA, 18 nt, Human
ccccagccgacugccgaa

SEQ ID NO: 161904 - RNA, 21 nt, Human
cccccagccgacugccgaagc

SEQ ID NO: 161905 - RNA, 21 nt, Human
cccccagccgacugccgaagc

SEQ ID NO: 161906 - RNA, 23 nt, Human
cccccagccgacugccgaagccc

SEQ ID NO: 161907 - RNA, 23 nt, Human
cccccagccgacugccgaagccc

SEQ ID NO: 161908 - RNA, 21 nt, Human
ccccugagguagcgaccauuc

SEQ ID NO: 161909 - RNA, 18 nt, Human
cccugaggccggccuggg

SEQ ID NO: 161910 - RNA, 18 nt, Human
cccugaggccggccuggg

SEQ ID NO: 161911 - RNA, 22 nt, Human
cccuggacuuccagccaagggc

SEQ ID NO: 161912 - RNA, 18 nt, Human
cccugggcagggcacagg

SEQ ID NO: 161913 - RNA, 20 nt, Human
ccgcagccaguuggccugga

SEQ ID NO: 161914 - RNA, 20 nt, Human
ccgcagccaguuggccuggc

SEQ ID NO: 161915 - RNA, 21 nt, Human
ccucucccagccucccccaaa

SEQ ID NO: 161916 - RNA, 21 nt, Human
ccucucccagccucccccaaa

SEQ ID NO: 161917 - RNA, 24 nt, Human
cggcagucgggcagguagauggug

SEQ ID NO: 161918 - RNA, 25 nt, Human
cucccaaacccuaccccccaaccaa

SEQ ID NO: 161919 - RNA, 25 nt, Human
cucccaaacccuaccccccaaccaa

SEQ ID NO: 161920 - RNA, 26 nt, Human
cucccaaacccuaccccccaaccaac

SEQ ID NO: 161921 - RNA, 26 nt, Human
cucccaaacccuaccccccaaccaac

SEQ ID NO: 161922 - RNA, 23 nt, Human
cucccaccucccagugucacccc

SEQ ID NO: 161923 - RNA, 26 nt, Human
cucccaggcugaccgccucugcccag

SEQ ID NO: 161924 - RNA, 23 nt, Human
cucccagugucacccccaccuuc

SEQ ID NO: 161925 - RNA, 18 nt, Human
cucccccagccgacugcc

SEQ ID NO: 161926 - RNA, 18 nt, Human
cucccccagccgacugcc

SEQ ID NO: 161927 - RNA, 24 nt, Human
cuggacaauauuugucacuuccuu

SEQ ID NO: 161928 - RNA, 20 nt, Human
cuggacuuuuacccaccggu

SEQ ID NO: 161929 - RNA, 20 nt, Human
cuggacuuuuacccaccggu

SEQ ID NO: 161930 - RNA, 22 nt, Human
cuguaugaacagagcgggacuc

SEQ ID NO: 161931 - RNA, 22 nt, Human
gaagccaggggacaggagccgg

SEQ ID NO: 161932 - RNA, 18 nt, Human
gaaggaggaaaugggggc

SEQ ID NO: 161933 - RNA, 18 nt, Human
gaaggaggaaaugggggc

SEQ ID NO: 161934 - RNA, 18 nt, Human
gaaggcccccaggaccag

SEQ ID NO: 161935 - RNA, 18 nt, Human
gaaggcccccaggaccag

SEQ ID NO: 161936 - RNA, 21 nt, Human
gacaggagcccugggcagggc

SEQ ID NO: 161937 - RNA, 20 nt, Human
gacuuccagccaagggcagc

SEQ ID NO: 161938 - RNA, 20 nt, Human
gagcacagucaggggccggc

SEQ ID NO: 161939 - RNA, 21 nt, Human
gcaacaagccccaagccacac

SEQ ID NO: 161940 - RNA, 18 nt, Human
gcagccuggccuccggga

SEQ ID NO: 161941 - RNA, 23 nt, Human
gccaagcucccaaacccuacccc

SEQ ID NO: 161942 - RNA, 19 nt, Human
gcccccuccguccgugucc

SEQ ID NO: 161943 - RNA, 18 nt, Human
gccgcagccaguuggccu

SEQ ID NO: 161944 - RNA, 20 nt, Human
gcuggaaaaccuguggagaa

SEQ ID NO: 161945 - RNA, 21 nt, Human
ggacaaggaaacgggcaagca

SEQ ID NO: 161946 - RNA, 21 nt, Human
ggacucccaggcugaccgccu

SEQ ID NO: 161947 - RNA, 24 nt, Human
ggaggaaaugggggcucagagagg

SEQ ID NO: 161948 - RNA, 24 nt, Human
ggaggaaaugggggcucagagagg

SEQ ID NO: 161949 - RNA, 25 nt, Human
ggaggaaaugggggcucagagaggg

SEQ ID NO: 161950 - RNA, 25 nt, Human
ggaggaaaugggggcucagagaggg

SEQ ID NO: 161951 - RNA, 22 nt, Human
ggaggaagaagcagggccauag

SEQ ID NO: 161952 - RNA, 20 nt, Human
ggcagagaucacaggugggg

SEQ ID NO: 161953 - RNA, 20 nt, Human
ggcagagaucacaggugggg

SEQ ID NO: 161954 - RNA, 19 nt, Human
ggcaguaggagggaggccu

SEQ ID NO: 161955 - RNA, 18 nt, Human
ggccuccgggacucccag

SEQ ID NO: 161956 - RNA, 19 nt, Human
ggccugggcuaggcagguc

SEQ ID NO: 161957 - RNA, 20 nt, Human
gggacaggagccgggggggc

SEQ ID NO: 161958 - RNA, 20 nt, Human
gggacaggagccgggggggc

SEQ ID NO: 161959 - RNA, 21 nt, Human
gggcagcauuuguaguuggca

SEQ ID NO: 161960 - RNA, 23 nt, Human
gggcagccacaagccgugggagg

SEQ ID NO: 161961 - RNA, 19 nt, Human
guaguuguccucaaagucc

SEQ ID NO: 161962 - RNA, 19 nt, Human
guaguuguccucaaagucc

SEQ ID NO: 161963 - RNA, 21 nt, Human
guaugacccuggacuuccagc

SEQ ID NO: 161964 - RNA, 20 nt, Human
guauguaaguugucuggaca

SEQ ID NO: 161965 - RNA, 18 nt, Human
gugcagccuggccuccgg

SEQ ID NO: 161966 - RNA, 18 nt, Human
gugggaggaguguggggg

SEQ ID NO: 161967 - RNA, 25 nt, Human
guuaagaucauuguccuggucuuug

SEQ ID NO: 161968 - RNA, 19 nt, Human
uacccaccggucaucuccc

SEQ ID NO: 161969 - RNA, 19 nt, Human
uacccaccggucaucuccc

SEQ ID NO: 161970 - RNA, 23 nt, Human
uaggagggaggccugggaggaag

SEQ ID NO: 161971 - RNA, 22 nt, Human
uauaaauagaaaaaaaaauugc

SEQ ID NO: 161972 - RNA, 22 nt, Human
uaugaacagagcgggacucuga

SEQ ID NO: 161973 - RNA, 27 nt, Human
ucauuguccuggucuuugguggagaag

SEQ ID NO: 161974 - RNA, 21 nt, Human
uccacgaaggcccccaggacc

SEQ ID NO: 161975 - RNA, 21 nt, Human
uccacgaaggcccccaggacc

SEQ ID NO: 161976 - RNA, 27 nt, Human
ucccaaacccuaccccccaaccaacua

SEQ ID NO: 161977 - RNA, 27 nt, Human
ucccaaacccuaccccccaaccaacua

SEQ ID NO: 161978 - RNA, 19 nt, Human
ucccagugucacccccacc

SEQ ID NO: 161979 - RNA, 22 nt, Human
ucccagugucacccccaccuuc

SEQ ID NO: 161980 - RNA, 20 nt, Human
uccccgaccaggagaauaga

SEQ ID NO: 161981 - RNA, 20 nt, Human
ucccgguagaaguccacaga

SEQ ID NO: 161982 - RNA, 20 nt, Human
ucccgguagaaguccacaga

SEQ ID NO: 161983 - RNA, 18 nt, Human
ucccugggcggucagggc

SEQ ID NO: 161984 - RNA, 18 nt, Human
ucccugggcggucagggc

SEQ ID NO: 161985 - RNA, 24 nt, Human
uccgcuggaaaaccuguggagaag

SEQ ID NO: 161986 - RNA, 23 nt, Human
uccucaaaguccaccaggucuac

SEQ ID NO: 161987 - RNA, 23 nt, Human
uccucaaaguccaccaggucuac

SEQ ID NO: 161988 - RNA, 22 nt, Human
uccuugcagguacgcgggccug

SEQ ID NO: 161989 - RNA, 24 nt, Human
uccuugcagguacgcgggccuggg

SEQ ID NO: 161990 - RNA, 22 nt, Human
ucucugacuguccccgaccagg

SEQ ID NO: 161991 - RNA, 18 nt, Human
ugaaggaggaaauggggg

SEQ ID NO: 161992 - RNA, 18 nt, Human
ugaaggaggaaauggggg

SEQ ID NO: 161993 - RNA, 22 nt, Human
ugaaggaggaaaugggggcuca

SEQ ID NO: 161994 - RNA, 22 nt, Human
ugaaggaggaaaugggggcuca

SEQ ID NO: 161995 - RNA, 18 nt, Human
ugcaggacaggagcccug

SEQ ID NO: 161996 - RNA, 22 nt, Human
ugcaggacaggagcccugggca

SEQ ID NO: 161997 - RNA, 19 nt, Human
ugccaugagucccccugag

SEQ ID NO: 161998 - RNA, 24 nt, Human
ugccaugagucccccugagguagc

SEQ ID NO: 161999 - RNA, 21 nt, Human
ugcccucggucuagcaggucc

SEQ ID NO: 162000 - RNA, 18 nt, Human
uggcagagaucacaggug

SEQ ID NO: 162001 - RNA, 18 nt, Human
uggcagagaucacaggug

SEQ ID NO: 162002 - RNA, 18 nt, Human
uggcagagaucacaggug

SEQ ID NO: 162003 - RNA, 18 nt, Human
uggcagagaucacaggug

SEQ ID NO: 162004 - RNA, 18 nt, Human
uggccgcagccaguuggc

SEQ ID NO: 162005 - RNA, 19 nt, Human
uggccgcagccaguuggcc

SEQ ID NO: 162006 - RNA, 21 nt, Human
ugggaggaagaagcagggcca

SEQ ID NO: 162007 - RNA, 23 nt, Human
ugggggcucagagaggggaggca

SEQ ID NO: 162008 - RNA, 23 nt, Human
ugggggcucagagaggggaggca

SEQ ID NO: 162009 - RNA, 18 nt, Human
ugucacagagcacaguca

SEQ ID NO: 162010 - RNA, 21 nt, Human
ugucacagagcacagucaggg

SEQ ID NO: 162011 - RNA, 22 nt, Human
uguuaagaucauuguccugguc

SEQ ID NO: 162012 - RNA, 19 nt, Human
uuccccagccagaacuccc

SEQ ID NO: 162013 - RNA, 19 nt, Human
uuccccagccagaacuccc

SEQ ID NO: 162014 - RNA, 18 nt, Human
uucuccucacaagacucc

SEQ ID NO: 162015 - RNA, 19 nt, Human
uucuccucacaagacucca

SEQ ID NO: 162016 - RNA, 18 nt, Human
uuguacguggcccagucc

SEQ ID NO: 162017 - RNA, 18 nt, Human
uuguacguggcccagucc

SEQ ID NO: 162018 - RNA, 20 nt, Human
uuuccgguguuaagaucauu

SEQ ID NO: 162019 - RNA, 25 nt, Human
uuuuacccaccggucaucuccccca

SEQ ID NO: 162020 - RNA, 25 nt, Human
uuuuacccaccggucaucuccccca

SEQ ID NO: 162021 - RNA, 23 nt, Human
aaagaaccaugcagaaaccaaag

SEQ ID NO: 162022 - RNA, 22 nt, Human
aagaaccaugcagaaaccaaag

SEQ ID NO: 162023 - RNA, 22 nt, Human
acuguuuugagauagaaggaaa

SEQ ID NO: 162024 - RNA, 18 nt, Human
agcagaggugguuggcaa

SEQ ID NO: 162025 - RNA, 22 nt, Human
agguggcugacgauccggaagc

SEQ ID NO: 162026 - RNA, 21 nt, Human
auaucacaggcacuugccuac

SEQ ID NO: 162027 - RNA, 19 nt, Human
caaagaaccaugcagaaac

SEQ ID NO: 162028 - RNA, 22 nt, Human
caaagaaccaugcagaaaccaa

SEQ ID NO: 162029 - RNA, 21 nt, Human
cagaggugguuggcaaaggca

SEQ ID NO: 162030 - RNA, 23 nt, Human
cagaggugguuggcaaaggcaag

SEQ ID NO: 162031 - RNA, 26 nt, Human
gagcuugcuuuuuugucucggguucc

SEQ ID NO: 162032 - RNA, 20 nt, Human
uacaggagagauaagggcac

SEQ ID NO: 162033 - RNA, 24 nt, Human
uacuguuuugagauagaaggaaau

SEQ ID NO: 162034 - RNA, 26 nt, Human
uagaaucccggucuuuucccccgagg

SEQ ID NO: 162035 - RNA, 22 nt, Human
ugcaaagaaccaugcagaaacc

SEQ ID NO: 162036 - RNA, 20 nt, Human
uggcugacgauccggaagcu

SEQ ID NO: 162037 - RNA, 20 nt, Human
uguggacaggcaagcagagg

SEQ ID NO: 162038 - RNA, 23 nt, Human
uguggacaggcaagcagaggugg

SEQ ID NO: 162039 - RNA, 24 nt, Human
uguggacaggcaagcagagguggu

SEQ ID NO: 162040 - RNA, 23 nt, Human
uucguaagcacuugcugaacugc

SEQ ID NO: 162041 - RNA, 22 nt, Human
uugcauggucuuugcagacuac

SEQ ID NO: 162042 - RNA, 19 nt, Human
uugggaaaguaaggacaaa

SEQ ID NO: 162043 - RNA, 21 nt, Human
uuuaaaaaccucucauuaccu

SEQ ID NO: 162044 - RNA, 25 nt, Human
uuuaaaaaccucucauuaccuucuu

SEQ ID NO: 162045 - RNA, 22 nt, Human
aaaacggugaaaucuugucucc

SEQ ID NO: 162046 - RNA, 23 nt, Human
aaacagaagagcacaauaugacc

SEQ ID NO: 162047 - RNA, 18 nt, Human
aagcacuuggacugaaug

SEQ ID NO: 162048 - RNA, 20 nt, Human
acagagugagacccugucuc

SEQ ID NO: 162049 - RNA, 27 nt, Human
acagagugagacccugucucaauuuaa

SEQ ID NO: 162050 - RNA, 18 nt, Human
acggugaaaucuugucuc

SEQ ID NO: 162051 - RNA, 21 nt, Human
agccugggcaaaacggugaaa

SEQ ID NO: 162052 - RNA, 20 nt, Human
aggaguuugagaccagccug

SEQ ID NO: 162053 - RNA, 19 nt, Human
aggcaggcguugcagugag

SEQ ID NO: 162054 - RNA, 24 nt, Human
aggcugaggugagagguuugcuug

SEQ ID NO: 162055 - RNA, 18 nt, Human
aggcuuggggucauggau

SEQ ID NO: 162056 - RNA, 24 nt, Human
auugcuugagcccaggaguuugag

SEQ ID NO: 162057 - RNA, 22 nt, Human
caaaacggugaaaucuugucuc

SEQ ID NO: 162058 - RNA, 24 nt, Human
caaaacggugaaaucuugucucua

SEQ ID NO: 162059 - RNA, 28 nt, Human
caaaauaaauagaaucauauuuuaggug

SEQ ID NO: 162060 - RNA, 24 nt, Human
caagauugugccacugcauuccag

SEQ ID NO: 162061 - RNA, 20 nt, Human
cacgauuucaaaaauuuugu

SEQ ID NO: 162062 - RNA, 19 nt, Human
cacugcauuccagauugag

SEQ ID NO: 162063 - RNA, 19 nt, Human
caggaucucugaagaacau

SEQ ID NO: 162064 - RNA, 23 nt, Human
cauuccagauugagugacagagu

SEQ ID NO: 162065 - RNA, 24 nt, Human
cauugcuugagcccaggaguuuga

SEQ ID NO: 162066 - RNA, 20 nt, Human
ccacugcauuccagauugag

SEQ ID NO: 162067 - RNA, 20 nt, Human
ccacugcauuccagauugag

SEQ ID NO: 162068 - RNA, 24 nt, Human
ccacugcauuccagauugagugac

SEQ ID NO: 162069 - RNA, 21 nt, Human
ccagaagagguauacuggaaa

SEQ ID NO: 162070 - RNA, 23 nt, Human
ccucuuguaaacagaagagcaca

SEQ ID NO: 162071 - RNA, 19 nt, Human
ccugggcaaaacggugaaa

SEQ ID NO: 162072 - RNA, 24 nt, Human
ccugggcaaaacggugaaaucuug

SEQ ID NO: 162073 - RNA, 24 nt, Human
ccuguagucccagcuacucagcag

SEQ ID NO: 162074 - RNA, 22 nt, Human
cucucugugaaguccugcagag

SEQ ID NO: 162075 - RNA, 24 nt, Human
cuucagggcugcgccaacuucacu

SEQ ID NO: 162076 - RNA, 19 nt, Human
cuuguaaacagaagagcac

SEQ ID NO: 162077 - RNA, 28 nt, Human
gaagaacauaucaggccugaggcuuggg

SEQ ID NO: 162078 - RNA, 18 nt, Human
gaggaccaggucagggau

SEQ ID NO: 162079 - RNA, 19 nt, Human
gaguucugugcugucuggg

SEQ ID NO: 162080 - RNA, 20 nt, Human
gaucucugaagaacauauca

SEQ ID NO: 162081 - RNA, 20 nt, Human
gcagagaaagcacuuggacu

SEQ ID NO: 162082 - RNA, 18 nt, Human
gcagugaggcaagauugu

SEQ ID NO: 162083 - RNA, 22 nt, Human
gcaugugccuguagucccagcu

SEQ ID NO: 162084 - RNA, 22 nt, Human
gccauggagaauggcauccaga

SEQ ID NO: 162085 - RNA, 22 nt, Human
gcccaggaguuugagaccagcc

SEQ ID NO: 162086 - RNA, 19 nt, Human
gcuugagccugagaggcag

SEQ ID NO: 162087 - RNA, 21 nt, Human
ggcaaaacggugaaaucuugu

SEQ ID NO: 162088 - RNA, 21 nt, Human
gguauacuggaaagcuaaugg

SEQ ID NO: 162089 - RNA, 20 nt, Human
guugcagugaggcaagauug

SEQ ID NO: 162090 - RNA, 21 nt, Human
uacauugcuugagcccaggag

SEQ ID NO: 162091 - RNA, 20 nt, Human
uacguaagacaaaaaauggc

SEQ ID NO: 162092 - RNA, 18 nt, Human
ucaaaauaaauagaauca

SEQ ID NO: 162093 - RNA, 21 nt, Human
ucauggaugguuuucaaagag

SEQ ID NO: 162094 - RNA, 19 nt, Human
uccagauugagugacagag

SEQ ID NO: 162095 - RNA, 24 nt, Human
uccagauugagugacagagugaga

SEQ ID NO: 162096 - RNA, 21 nt, Human
uccucuuguaaacagaagagc

SEQ ID NO: 162097 - RNA, 24 nt, Human
uccucuuguaaacagaagagcaca

SEQ ID NO: 162098 - RNA, 20 nt, Human
ucuaauuugguaacagugac

SEQ ID NO: 162099 - RNA, 19 nt, Human
ucugugcugucugggcaga

SEQ ID NO: 162100 - RNA, 21 nt, Human
ugaagaacauaucaggccuga

SEQ ID NO: 162101 - RNA, 22 nt, Human
ugacagagugagacccugucuc

SEQ ID NO: 162102 - RNA, 23 nt, Human
ugagcccaggaguuugagaccag

SEQ ID NO: 162103 - RNA, 24 nt, Human
ugagccugagaggcaggcguugca

SEQ ID NO: 162104 - RNA, 21 nt, Human
ugagugacagagugagacccu

SEQ ID NO: 162105 - RNA, 24 nt, Human
ugagugacagagugagacccuguc

SEQ ID NO: 162106 - RNA, 25 nt, Human
ugauaacaaagucccugucacuccc

SEQ ID NO: 162107 - RNA, 22 nt, Human
ugccccaggaucucugaagaac

SEQ ID NO: 162108 - RNA, 19 nt, Human
ugccuguagucccagcuac

SEQ ID NO: 162109 - RNA, 22 nt, Human
ugccuguagucccagcuacuca

SEQ ID NO: 162110 - RNA, 26 nt, Human
ugccuguagucccagcuacucagcag

SEQ ID NO: 162111 - RNA, 18 nt, Human
ugcuugagcccaggaguu

SEQ ID NO: 162112 - RNA, 21 nt, Human
uggagaauggcauccagaaga

SEQ ID NO: 162113 - RNA, 24 nt, Human
ugggcaaaacggugaaaucuuguc

SEQ ID NO: 162114 - RNA, 24 nt, Human
ugguggcaugugccuguaguccca

SEQ ID NO: 162115 - RNA, 22 nt, Human
ugugccacugcauuccagauug

SEQ ID NO: 162116 - RNA, 22 nt, Human
uucuccuagguaguuucuucag

SEQ ID NO: 162117 - RNA, 22 nt, Human
uugagcccaggaguuugagacc

SEQ ID NO: 162118 - RNA, 22 nt, Human
uugcagugaggcaagauugugc

SEQ ID NO: 162119 - RNA, 21 nt, Human
uugcuugagcccaggaguuug

SEQ ID NO: 162120 - RNA, 18 nt, Human
uugcuugagccugagagg

SEQ ID NO: 162121 - RNA, 22 nt, Human
uugcuugagccugagaggcagg

SEQ ID NO: 162122 - RNA, 22 nt, Human
acaaaaaagggaaacaaaauau

SEQ ID NO: 162123 - RNA, 22 nt, Human
accaaaagcccgacuuaucucc

SEQ ID NO: 162124 - RNA, 19 nt, Human
accuuuugcucagccucac

SEQ ID NO: 162125 - RNA, 23 nt, Human
acgugucuccacugugaaaauaa

SEQ ID NO: 162126 - RNA, 19 nt, Human
agaaaaaaaaauggugcag

SEQ ID NO: 162127 - RNA, 21 nt, Human
agaaguuggggcucaucuucc

SEQ ID NO: 162128 - RNA, 21 nt, Human
agaccauuucucucuccuccu

SEQ ID NO: 162129 - RNA, 18 nt, Human
agagauggaugaugugug

SEQ ID NO: 162130 - RNA, 19 nt, Human
aggcacaggggagauuugc

SEQ ID NO: 162131 - RNA, 22 nt, Human
agggcaggaagcugcuacucag

SEQ ID NO: 162132 - RNA, 20 nt, Human
caagaaggagggcaggaagc

SEQ ID NO: 162133 - RNA, 20 nt, Human
cacagugcuugcucagaggc

SEQ ID NO: 162134 - RNA, 23 nt, Human
cacuaccagccacacaaaaaagg

SEQ ID NO: 162135 - RNA, 23 nt, Human
cagaccuuuugcucagccucaca

SEQ ID NO: 162136 - RNA, 20 nt, Human
ccacacaaaaaagggaaaca

SEQ ID NO: 162137 - RNA, 19 nt, Human
cccuaggagcugagggccc

SEQ ID NO: 162138 - RNA, 22 nt, Human
cccuaggagcugagggcccucc

SEQ ID NO: 162139 - RNA, 25 nt, Human
cccuggcuagaccauuucucucucc

SEQ ID NO: 162140 - RNA, 19 nt, Human
ccgguagugauacauuuuu

SEQ ID NO: 162141 - RNA, 23 nt, Human
ccuggcuagaccauuucucucuc

SEQ ID NO: 162142 - RNA, 21 nt, Human
cgggcagaggguugggaaagu

SEQ ID NO: 162143 - RNA, 24 nt, Human
cuacucagaugagaccuuccuaaa

SEQ ID NO: 162144 - RNA, 21 nt, Human
cuagaccauuucucucuccuc

SEQ ID NO: 162145 - RNA, 21 nt, Human
cucagaggcugccugcucucu

SEQ ID NO: 162146 - RNA, 22 nt, Human
cuccucuauucgacagcccuag

SEQ ID NO: 162147 - RNA, 22 nt, Human
cuugccacgugucuccacugug

SEQ ID NO: 162148 - RNA, 20 nt, Human
gaaggagggcaggaagcugc

SEQ ID NO: 162149 - RNA, 21 nt, Human
gagaacagaaaaaaaaauggu

SEQ ID NO: 162150 - RNA, 25 nt, Human
gagaacagaaaaaaaaauggugcag

SEQ ID NO: 162151 - RNA, 20 nt, Human
gagagauggaugaugugugg

SEQ ID NO: 162152 - RNA, 23 nt, Human
gauugugcccuuguaacccuggc

SEQ ID NO: 162153 - RNA, 22 nt, Human
ggcuagaccauuucucucuccu

SEQ ID NO: 162154 - RNA, 19 nt, Human
ggggaacacacagaucagg

SEQ ID NO: 162155 - RNA, 26 nt, Human
uaugguagcaaggauacagcauauac

SEQ ID NO: 162156 - RNA, 24 nt, Human
ucagaggcugccugcucucuuccu

SEQ ID NO: 162157 - RNA, 23 nt, Human
uccuccucuauucgacagcccua

SEQ ID NO: 162158 - RNA, 21 nt, Human
ucucuagaaauaucaaguugu

SEQ ID NO: 162159 - RNA, 19 nt, Human
ucucucuccuccucuauuc

SEQ ID NO: 162160 - RNA, 19 nt, Human
ucuggagagauggaugaug

SEQ ID NO: 162161 - RNA, 18 nt, Human
ugcccuuguaacccuggc

SEQ ID NO: 162162 - RNA, 22 nt, Human
uggagcaaauuguuuauacaga

SEQ ID NO: 162163 - RNA, 25 nt, Human
uggugcaggcuguuuccugugggcc

SEQ ID NO: 162164 - RNA, 22 nt, Human
ugguuggagagaacagaaaaaa

SEQ ID NO: 162165 - RNA, 23 nt, Human
uugcucagaggcugccugcucuc

SEQ ID NO: 162166 - RNA, 27 nt, Human
uuggagcaaauuguuuauacagagaaa

SEQ ID NO: 162167 - RNA, 18 nt, Human
aggaaaaaaauaaagaga

SEQ ID NO: 162168 - RNA, 25 nt, Human
cacacagcguucuuuuagggauuaa

SEQ ID NO: 162169 - RNA, 21 nt, Human
cugggaugaggcacccuuucc

SEQ ID NO: 162170 - RNA, 19 nt, Human
cuuuccuuuuauguuuagg

SEQ ID NO: 162171 - RNA, 23 nt, Human
gaaaaaaauaaagagaacacaac

SEQ ID NO: 162172 - RNA, 20 nt, Human
uacuuuuaauuaucauucua

SEQ ID NO: 162173 - RNA, 19 nt, Human
uaggaaaaaaauaaagaga

SEQ ID NO: 162174 - RNA, 21 nt, Human
uccuuaaagaaaaaaaguaaa

SEQ ID NO: 162175 - RNA, 20 nt, Human
uggcacugaaugcucugcca

SEQ ID NO: 162176 - RNA, 22 nt, Human
aagaaugacaaaauucaguagu

SEQ ID NO: 162177 - RNA, 23 nt, Human
acuccaaagaggcgggggcggca

SEQ ID NO: 162178 - RNA, 25 nt, Human
agcaguuuacugagcaauuaaauau

SEQ ID NO: 162179 - RNA, 27 nt, Human
agucgcuaaacaaacauaagaaaaaaa

SEQ ID NO: 162180 - RNA, 21 nt, Human
auggcccuaaacaagccaggu

SEQ ID NO: 162181 - RNA, 23 nt, Human
caagaaugacaaaauucaguagu

SEQ ID NO: 162182 - RNA, 24 nt, Human
cacagguucuagcacagauuuucu

SEQ ID NO: 162183 - RNA, 25 nt, Human
cccgcggucgggaacugccggaagc

SEQ ID NO: 162184 - RNA, 18 nt, Human
cgcuaaacaaacauaaga

SEQ ID NO: 162185 - RNA, 20 nt, Human
cgggggcggcagcugcggcc

SEQ ID NO: 162186 - RNA, 21 nt, Human
gccgcggcgaggggcgcgggg

SEQ ID NO: 162187 - RNA, 22 nt, Human
ggccgcgagagacuccaaagag

SEQ ID NO: 162188 - RNA, 21 nt, Human
uauggcccuaaacaagccagg

SEQ ID NO: 162189 - RNA, 20 nt, Human
ucaguaguuaugcaagguga

SEQ ID NO: 162190 - RNA, 18 nt, Human
ucuagcacagauuuucua

SEQ ID NO: 162191 - RNA, 25 nt, Human
ucuguuauaggcagagauuuauaaa

SEQ ID NO: 162192 - RNA, 18 nt, Human
uuaaaauaguaaagcuag

SEQ ID NO: 162193 - RNA, 19 nt, Human
uucaagaaugacaaaauuc

SEQ ID NO: 162194 - RNA, 27 nt, Human
uuccuuaaccuaucuucuagguaaaca

SEQ ID NO: 162195 - RNA, 21 nt, Human
uuuaauauuugauugacauuu

SEQ ID NO: 162196 - RNA, 19 nt, Human
aagccagggccggccggga

SEQ ID NO: 162197 - RNA, 24 nt, Human
agacgcuggaagagcagccaagcc

SEQ ID NO: 162198 - RNA, 18 nt, Human
agagagauggguaagggg

SEQ ID NO: 162199 - RNA, 24 nt, Human
agcccuuccccucccaacacucau

SEQ ID NO: 162200 - RNA, 22 nt, Human
agcuguuuuauuuccagcaugu

SEQ ID NO: 162201 - RNA, 22 nt, Human
auuuccagcauguucccaaccu

SEQ ID NO: 162202 - RNA, 19 nt, Human
cagccaagccuccaagcca

SEQ ID NO: 162203 - RNA, 20 nt, Human
cagccaagccuccaagccag

SEQ ID NO: 162204 - RNA, 28 nt, Human
cauguucccaaccuggugacccuccaca

SEQ ID NO: 162205 - RNA, 21 nt, Human
ccacaccuccaccugucccua

SEQ ID NO: 162206 - RNA, 24 nt, Human
ccaggagggaggagagacgcugga

SEQ ID NO: 162207 - RNA, 21 nt, Human
cccacaccuccaccugucccu

SEQ ID NO: 162208 - RNA, 22 nt, Human
cccacaccuccaccugucccua

SEQ ID NO: 162209 - RNA, 23 nt, Human
ccuugcgcgcaagggcgaccuuc

SEQ ID NO: 162210 - RNA, 21 nt, Human
gacccagcccuuccccuccca

SEQ ID NO: 162211 - RNA, 24 nt, Human
gcaaagucccacucagacggaccc

SEQ ID NO: 162212 - RNA, 25 nt, Human
gcaaagucccacucagacggaccca

SEQ ID NO: 162213 - RNA, 22 nt, Human
gcgcgcaagggcgaccuucccc

SEQ ID NO: 162214 - RNA, 24 nt, Human
guucccaaccuggugacccuccac

SEQ ID NO: 162215 - RNA, 19 nt, Human
uagagagauggguaagggg

SEQ ID NO: 162216 - RNA, 18 nt, Human
ucagcagaggugcaaagu

SEQ ID NO: 162217 - RNA, 21 nt, Human
ucccaacacucaucccuuccc

SEQ ID NO: 162218 - RNA, 22 nt, Human
ucccaaccuggugacccuccac

SEQ ID NO: 162219 - RNA, 18 nt, Human
ucccacucagacggaccc

SEQ ID NO: 162220 - RNA, 23 nt, Human
ugggggccggggcuggggcuggg

SEQ ID NO: 162221 - RNA, 26 nt, Human
ugggggccggggcuggggcugggccg

SEQ ID NO: 162222 - RNA, 24 nt, Human
uugcgcgcaagggcgaccuucccc

SEQ ID NO: 162223 - RNA, 24 nt, Human
aaaccgcugacaccaccgcccaac

SEQ ID NO: 162224 - RNA, 19 nt, Human
aaggaacacaaggacccaa

SEQ ID NO: 162225 - RNA, 19 nt, Human
aaggaacacaaggacccaa

SEQ ID NO: 162226 - RNA, 19 nt, Human
aaggaacacaaggacccaa

SEQ ID NO: 162227 - RNA, 25 nt, Human
aaggacccaaggaaaggggagccag

SEQ ID NO: 162228 - RNA, 25 nt, Human
aaggacccaaggaaaggggagccag

SEQ ID NO: 162229 - RNA, 25 nt, Human
aaggacccaaggaaaggggagccag

SEQ ID NO: 162230 - RNA, 20 nt, Human
acaccaccgcccaacuauga

SEQ ID NO: 162231 - RNA, 22 nt, Human
acaccaccgcccaacuaugaac

SEQ ID NO: 162232 - RNA, 21 nt, Human
acagaagggaaucagcccagc

SEQ ID NO: 162233 - RNA, 18 nt, Human
accagggcuggaccaggc

SEQ ID NO: 162234 - RNA, 18 nt, Human
accccggcugcuccccgc

SEQ ID NO: 162235 - RNA, 23 nt, Human
accccggcugcuccccgccagcc

SEQ ID NO: 162236 - RNA, 22 nt, Human
accgacacgccgaacaugcgcc

SEQ ID NO: 162237 - RNA, 28 nt, Human
acgaacgccagcgaaaccgcugacacca

SEQ ID NO: 162238 - RNA, 22 nt, Human
acgguacagaguuaggcaugga

SEQ ID NO: 162239 - RNA, 22 nt, Human
acgguacagaguuaggcaugga

SEQ ID NO: 162240 - RNA, 24 nt, Human
acucuccccaaacugucccugcug

SEQ ID NO: 162241 - RNA, 18 nt, Human
acugagcaugguggggac

SEQ ID NO: 162242 - RNA, 18 nt, Human
acugagcaugguggggac

SEQ ID NO: 162243 - RNA, 22 nt, Human
agagccuacuuccccagccuuc

SEQ ID NO: 162244 - RNA, 22 nt, Human
agagccuacuuccccagccuuc

SEQ ID NO: 162245 - RNA, 22 nt, Human
agagccuacuuccccagccuuc

SEQ ID NO: 162246 - RNA, 21 nt, Human
agcagagaggguuucagccgg

SEQ ID NO: 162247 - RNA, 22 nt, Human
agccuacuuccccagccuuccc

SEQ ID NO: 162248 - RNA, 22 nt, Human
agccuacuuccccagccuuccc

SEQ ID NO: 162249 - RNA, 22 nt, Human
agccuacuuccccagccuuccc

SEQ ID NO: 162250 - RNA, 22 nt, Human
agcugggcccacccuccccaac

SEQ ID NO: 162251 - RNA, 23 nt, Human
aggcaggggaagcaguccugggu

SEQ ID NO: 162252 - RNA, 23 nt, Human
aggcugcggggccagcuggcgcc

SEQ ID NO: 162253 - RNA, 22 nt, Human
agucccccugcauggggcuggc

SEQ ID NO: 162254 - RNA, 22 nt, Human
agucccccugcauggggcuggc

SEQ ID NO: 162255 - RNA, 19 nt, Human
aguuaggcauggacccaga

SEQ ID NO: 162256 - RNA, 19 nt, Human
aguuaggcauggacccaga

SEQ ID NO: 162257 - RNA, 19 nt, Human
aguuaggcauggacccaga

SEQ ID NO: 162258 - RNA, 23 nt, Human
aucaagaaaagagaagacacccc

SEQ ID NO: 162259 - RNA, 19 nt, Human
caaggaacacaaggaccca

SEQ ID NO: 162260 - RNA, 19 nt, Human
caaggaacacaaggaccca

SEQ ID NO: 162261 - RNA, 19 nt, Human
caaggaacacaaggaccca

SEQ ID NO: 162262 - RNA, 22 nt, Human
caaggacccaaggaaaggggag

SEQ ID NO: 162263 - RNA, 22 nt, Human
caaggacccaaggaaaggggag

SEQ ID NO: 162264 - RNA, 22 nt, Human
caaggacccaaggaaaggggag

SEQ ID NO: 162265 - RNA, 21 nt, Human
cacagcuucagagaguccccc

SEQ ID NO: 162266 - RNA, 21 nt, Human
cacagcuucagagaguccccc

SEQ ID NO: 162267 - RNA, 22 nt, Human
caccaccgcccaacuaugaacu

SEQ ID NO: 162268 - RNA, 21 nt, Human
caccgcccaacuaugaacuca

SEQ ID NO: 162269 - RNA, 21 nt, Human
cacuggaagcucugacggccc

SEQ ID NO: 162270 - RNA, 21 nt, Human
cacuggaagcucugacggccc

SEQ ID NO: 162271 - RNA, 21 nt, Human
cagcccagccucucggacucu

SEQ ID NO: 162272 - RNA, 22 nt, Human
cagcccgcccagggguggugcg

SEQ ID NO: 162273 - RNA, 20 nt, Human
cagcgcgaccucuggagcua

SEQ ID NO: 162274 - RNA, 22 nt, Human
cagcgcgaccucuggagcuacu

SEQ ID NO: 162275 - RNA, 20 nt, Human
caggagagauggggucuggg

SEQ ID NO: 162276 - RNA, 20 nt, Human
caggagagauggggucuggg

SEQ ID NO: 162277 - RNA, 25 nt, Human
caggagagauggggucuggggagca

SEQ ID NO: 162278 - RNA, 25 nt, Human
caggagagauggggucuggggagca

SEQ ID NO: 162279 - RNA, 19 nt, Human
caggcugcggggccagcug

SEQ ID NO: 162280 - RNA, 25 nt, Human
cagggcacugccacaauggcuccuc

SEQ ID NO: 162281 - RNA, 25 nt, Human
cagggcacugccacaauggcuccuc

SEQ ID NO: 162282 - RNA, 19 nt, Human
caggggaagcaguccuggg

SEQ ID NO: 162283 - RNA, 27 nt, Human
caggggaccuccuggggaauccaugga

SEQ ID NO: 162284 - RNA, 27 nt, Human
caggggaccuccuggggaauccaugga

SEQ ID NO: 162285 - RNA, 21 nt, Human
cauacaggcagccugcacagc

SEQ ID NO: 162286 - RNA, 21 nt, Human
cauacaggcagccugcacagc

SEQ ID NO: 162287 - RNA, 20 nt, Human
caucaagaaaagagaagaca

SEQ ID NO: 162288 - RNA, 20 nt, Human
caucaagaaaagagaagaca

SEQ ID NO: 162289 - RNA, 22 nt, Human
caucaagaaaagagaagacacc

SEQ ID NO: 162290 - RNA, 22 nt, Human
caucaagaaaagagaagacacc

SEQ ID NO: 162291 - RNA, 24 nt, Human
caucaagaaaagagaagacacccc

SEQ ID NO: 162292 - RNA, 23 nt, Human
cauggacccagagccuacuuccc

SEQ ID NO: 162293 - RNA, 23 nt, Human
cauggacccagagccuacuuccc

SEQ ID NO: 162294 - RNA, 23 nt, Human
cauggacccagagccuacuuccc

SEQ ID NO: 162295 - RNA, 23 nt, Human
ccaacaccaauaaaugucacaag

SEQ ID NO: 162296 - RNA, 23 nt, Human
ccaacaccaauaaaugucacaag

SEQ ID NO: 162297 - RNA, 24 nt, Human
ccacaagacacuucugguacugaa

SEQ ID NO: 162298 - RNA, 24 nt, Human
ccacaagacacuucugguacugaa

SEQ ID NO: 162299 - RNA, 22 nt, Human
ccacgaacgccagcgaaaccgc

SEQ ID NO: 162300 - RNA, 19 nt, Human
ccauacaggcagccugcac

SEQ ID NO: 162301 - RNA, 19 nt, Human
ccauacaggcagccugcac

SEQ ID NO: 162302 - RNA, 23 nt, Human
ccccgccagccucugccggcccg

SEQ ID NO: 162303 - RNA, 21 nt, Human
ccccugcaccgccaaccccuc

SEQ ID NO: 162304 - RNA, 21 nt, Human
ccccugcaccgccaaccccuc

SEQ ID NO: 162305 - RNA, 23 nt, Human
cccgccagccucugccggcccgc

SEQ ID NO: 162306 - RNA, 20 nt, Human
cccugcaccgccaaccccuc

SEQ ID NO: 162307 - RNA, 20 nt, Human
cccugcaccgccaaccccuc

SEQ ID NO: 162308 - RNA, 25 nt, Human
cccugcugagcugggcccacccucc

SEQ ID NO: 162309 - RNA, 18 nt, Human
ccgcacagcccgcccagg

SEQ ID NO: 162310 - RNA, 22 nt, Human
ccgccagccucugccggcccgc

SEQ ID NO: 162311 - RNA, 19 nt, Human
ccgcccaacuaugaacuca

SEQ ID NO: 162312 - RNA, 22 nt, Human
ccgcugacaccaccgcccaacu

SEQ ID NO: 162313 - RNA, 19 nt, Human
ccgcuugagccgcaggcgg

SEQ ID NO: 162314 - RNA, 19 nt, Human
ccuacuuccccagccuucc

SEQ ID NO: 162315 - RNA, 24 nt, Human
ccuccucuguacuggccucugccu

SEQ ID NO: 162316 - RNA, 24 nt, Human
ccuccucuguacuggccucugccu

SEQ ID NO: 162317 - RNA, 24 nt, Human
ccuccuuugagcagggggaggggc

SEQ ID NO: 162318 - RNA, 24 nt, Human
ccuccuuugagcagggggaggggc

SEQ ID NO: 162319 - RNA, 25 nt, Human
ccucuggagcuacugcgccugcaag

SEQ ID NO: 162320 - RNA, 22 nt, Human
cgaaacacauggcacuugagca

SEQ ID NO: 162321 - RNA, 23 nt, Human
cgccagccucugccggcccgcac

SEQ ID NO: 162322 - RNA, 24 nt, Human
cgccagccucugccggcccgcacu

SEQ ID NO: 162323 - RNA, 18 nt, Human
cgccagcgaaaccgcuga

SEQ ID NO: 162324 - RNA, 22 nt, Human
cgccagcgaaaccgcugacacc

SEQ ID NO: 162325 - RNA, 27 nt, Human
cgccgcacaaauacggggcgggacagc

SEQ ID NO: 162326 - RNA, 20 nt, Human
cgccgcaggcugcggggcca

SEQ ID NO: 162327 - RNA, 18 nt, Human
cgcucugacaagaucugg

SEQ ID NO: 162328 - RNA, 18 nt, Human
cgcucugacaagaucugg

SEQ ID NO: 162329 - RNA, 20 nt, Human
cgcugacaccaccgcccaac

SEQ ID NO: 162330 - RNA, 20 nt, Human
cggccaacaccaauaaaugu

SEQ ID NO: 162331 - RNA, 23 nt, Human
cggccaacaccaauaaaugucac

SEQ ID NO: 162332 - RNA, 23 nt, Human
cggccaacaccaauaaaugucac

SEQ ID NO: 162333 - RNA, 21 nt, Human
cgggggaggcccacgaacgcc

SEQ ID NO: 162334 - RNA, 25 nt, Human
cguauaaacaauaaauugggcaaua

SEQ ID NO: 162335 - RNA, 25 nt, Human
cguauaaacaauaaauugggcaaua

SEQ ID NO: 162336 - RNA, 25 nt, Human
cguauaaacaauaaauugggcaaua

SEQ ID NO: 162337 - RNA, 25 nt, Human
cgucuggauccccgaaugguugcgu

SEQ ID NO: 162338 - RNA, 26 nt, Human
cucucggacucuccccaaacuguccc

SEQ ID NO: 162339 - RNA, 19 nt, Human
cucuguacuggccucugcc

SEQ ID NO: 162340 - RNA, 19 nt, Human
cucuguacuggccucugcc

SEQ ID NO: 162341 - RNA, 20 nt, Human
cugauuuugcuauaaagugu

SEQ ID NO: 162342 - RNA, 20 nt, Human
cugauuuugcuauaaagugu

SEQ ID NO: 162343 - RNA, 20 nt, Human
cugauuuugcuauaaagugu

SEQ ID NO: 162344 - RNA, 21 nt, Human
cugccggcccgcacucucagc

SEQ ID NO: 162345 - RNA, 22 nt, Human
cugucccugcugagcugggccc

SEQ ID NO: 162346 - RNA, 21 nt, Human
gaaacacauggcacuugagca

SEQ ID NO: 162347 - RNA, 26 nt, Human
gaacgccagcgaaaccgcugacacca

SEQ ID NO: 162348 - RNA, 26 nt, Human
gacccagagccuacuuccccagccuu

SEQ ID NO: 162349 - RNA, 26 nt, Human
gacccagagccuacuuccccagccuu

SEQ ID NO: 162350 - RNA, 26 nt, Human
gacccagagccuacuuccccagccuu

SEQ ID NO: 162351 - RNA, 21 nt, Human
gagagauggggucuggggagc

SEQ ID NO: 162352 - RNA, 21 nt, Human
gagagauggggucuggggagc

SEQ ID NO: 162353 - RNA, 22 nt, Human
gagcagagaggguuucagccgg

SEQ ID NO: 162354 - RNA, 21 nt, Human
gagcagggggaggggcagggg

SEQ ID NO: 162355 - RNA, 21 nt, Human
gagcagggggaggggcagggg

SEQ ID NO: 162356 - RNA, 18 nt, Human
gcaauaaauagacggugg

SEQ ID NO: 162357 - RNA, 18 nt, Human
gcaauaaauagacggugg

SEQ ID NO: 162358 - RNA, 18 nt, Human
gcaauaaauagacggugg

SEQ ID NO: 162359 - RNA, 23 nt, Human
gcaggcugcggggccagcuggcg

SEQ ID NO: 162360 - RNA, 24 nt, Human
gcaucaagaaaagagaagacaccc

SEQ ID NO: 162361 - RNA, 24 nt, Human
gcaucaagaaaagagaagacaccc

SEQ ID NO: 162362 - RNA, 22 nt, Human
gccagccucugccggcccgcac

SEQ ID NO: 162363 - RNA, 25 nt, Human
gccgcacaaauacggggcgggacag

SEQ ID NO: 162364 - RNA, 19 nt, Human
gccgcaggcugcggggcca

SEQ ID NO: 162365 - RNA, 21 nt, Human
gcgaaaccgcugacaccaccg

SEQ ID NO: 162366 - RNA, 19 nt, Human
gcgggacacggggcgggac

SEQ ID NO: 162367 - RNA, 27 nt, Human
gcugacaccaccgcccaacuaugaacu

SEQ ID NO: 162368 - RNA, 21 nt, Human
gcugcggggccagcuggcgcc

SEQ ID NO: 162369 - RNA, 20 nt, Human
ggcaggggaagcaguccugg

SEQ ID NO: 162370 - RNA, 18 nt, Human
ggccaacaccaauaaaug

SEQ ID NO: 162371 - RNA, 24 nt, Human
gggagggccugagccgcacagccc

SEQ ID NO: 162372 - RNA, 22 nt, Human
ggggcgggacacggggcgggac

SEQ ID NO: 162373 - RNA, 20 nt, Human
ggucuggggagcagcaagag

SEQ ID NO: 162374 - RNA, 20 nt, Human
ggucuggggagcagcaagag

SEQ ID NO: 162375 - RNA, 21 nt, Human
gguggacaaggaucggaggga

SEQ ID NO: 162376 - RNA, 21 nt, Human
gguggacaaggaucggaggga

SEQ ID NO: 162377 - RNA, 21 nt, Human
gguggacaaggaucggaggga

SEQ ID NO: 162378 - RNA, 23 nt, Human
gguggugcguguaaacgggcguc

SEQ ID NO: 162379 - RNA, 20 nt, Human
guccgggggaggcccacgaa

SEQ ID NO: 162380 - RNA, 22 nt, Human
uaaaacgguacagaguuaggca

SEQ ID NO: 162381 - RNA, 22 nt, Human
uaaaacgguacagaguuaggca

SEQ ID NO: 162382 - RNA, 22 nt, Human
uaaaacgguacagaguuaggca

SEQ ID NO: 162383 - RNA, 20 nt, Human
uacuucugagcagcuuggcu

SEQ ID NO: 162384 - RNA, 20 nt, Human
uacuucugagcagcuuggcu

SEQ ID NO: 162385 - RNA, 19 nt, Human
uaggcauggacccagagcc

SEQ ID NO: 162386 - RNA, 19 nt, Human
uaggcauggacccagagcc

SEQ ID NO: 162387 - RNA, 19 nt, Human
uaggcauggacccagagcc

SEQ ID NO: 162388 - RNA, 19 nt, Human
uauggagcagagaggguuu

SEQ ID NO: 162389 - RNA, 19 nt, Human
uauggagcagagaggguuu

SEQ ID NO: 162390 - RNA, 23 nt, Human
uauggagcagagaggguuucagc

SEQ ID NO: 162391 - RNA, 23 nt, Human
uauggagcagagaggguuucagc

SEQ ID NO: 162392 - RNA, 21 nt, Human
ucacagcgaaacacauggcac

SEQ ID NO: 162393 - RNA, 21 nt, Human
ucacagcgaaacacauggcac

SEQ ID NO: 162394 - RNA, 20 nt, Human
ucaggagagauggggucugg

SEQ ID NO: 162395 - RNA, 20 nt, Human
ucaggagagauggggucugg

SEQ ID NO: 162396 - RNA, 19 nt, Human
uccaggguuggacaggggc

SEQ ID NO: 162397 - RNA, 19 nt, Human
uccaggguuggacaggggc

SEQ ID NO: 162398 - RNA, 19 nt, Human
uccaggguuggacaggggc

SEQ ID NO: 162399 - RNA, 22 nt, Human
uccccaaccagggcuggaccag

SEQ ID NO: 162400 - RNA, 25 nt, Human
uccccauauacagugccucguacuu

SEQ ID NO: 162401 - RNA, 25 nt, Human
uccccauauacagugccucguacuu

SEQ ID NO: 162402 - RNA, 19 nt, Human
uccccccuggcggugaggg

SEQ ID NO: 162403 - RNA, 19 nt, Human
uccccccuggcggugaggg

SEQ ID NO: 162404 - RNA, 22 nt, Human
ucccugcugagcugggcccacc

SEQ ID NO: 162405 - RNA, 20 nt, Human
uccgcuugagccgcaggcgg

SEQ ID NO: 162406 - RNA, 21 nt, Human
ucugcgccgcaggcugcgggg

SEQ ID NO: 162407 - RNA, 23 nt, Human
ucuggauccccgaaugguugcgu

SEQ ID NO: 162408 - RNA, 23 nt, Human
ucuucaggagagauggggucugg

SEQ ID NO: 162409 - RNA, 23 nt, Human
ucuucaggagagauggggucugg

SEQ ID NO: 162410 - RNA, 21 nt, Human
ugagccgcacagcccgcccag

SEQ ID NO: 162411 - RNA, 21 nt, Human
ugagcugggcccacccucccc

SEQ ID NO: 162412 - RNA, 19 nt, Human
ugcaccgccaaccccuccu

SEQ ID NO: 162413 - RNA, 19 nt, Human
ugcaccgccaaccccuccu

SEQ ID NO: 162414 - RNA, 20 nt, Human
ugccggcccgcacucucagc

SEQ ID NO: 162415 - RNA, 27 nt, Human
ugccggcccgcacucucagcccagcgc

SEQ ID NO: 162416 - RNA, 20 nt, Human
ugccucguacuucugagcaa

SEQ ID NO: 162417 - RNA, 20 nt, Human
ugccucguacuucugagcaa

SEQ ID NO: 162418 - RNA, 21 nt, Human
ugcuauaaaguguuacugagg

SEQ ID NO: 162419 - RNA, 21 nt, Human
ugcuauaaaguguuacugagg

SEQ ID NO: 162420 - RNA, 21 nt, Human
ugcuauaaaguguuacugagg

SEQ ID NO: 162421 - RNA, 18 nt, Human
ugcuccccgccagccucu

SEQ ID NO: 162422 - RNA, 22 nt, Human
uggacaggggcaaggaacacaa

SEQ ID NO: 162423 - RNA, 22 nt, Human
uggacaggggcaaggaacacaa

SEQ ID NO: 162424 - RNA, 22 nt, Human
uggacaggggcaaggaacacaa

SEQ ID NO: 162425 - RNA, 20 nt, Human
ugggcacaaagcccauguag

SEQ ID NO: 162426 - RNA, 20 nt, Human
ugggcacaaagcccauguag

SEQ ID NO: 162427 - RNA, 21 nt, Human
ugggcaccccaggccuugccu

SEQ ID NO: 162428 - RNA, 21 nt, Human
ugggcaccccaggccuugccu

SEQ ID NO: 162429 - RNA, 21 nt, Human
uguaaacgggcgucuggaucc

SEQ ID NO: 162430 - RNA, 21 nt, Human
uuuuuugaggucacugaggga

SEQ ID NO: 162431 - RNA, 21 nt, Human
uuuuuugaggucacugaggga

SEQ ID NO: 162432 - RNA, 21 nt, Human
uuuuuugaggucacugaggga

SEQ ID NO: 162433 - RNA, 18 nt, Human
uuuuuuuuuuuugagguc

SEQ ID NO: 162434 - RNA, 18 nt, Human
uuuuuuuuuuuugagguc

SEQ ID NO: 162435 - RNA, 18 nt, Human
uuuuuuuuuuuugagguc

SEQ ID NO: 162436 - RNA, 18 nt, Human
uuuuuuuuuuuuuuuuug

SEQ ID NO: 162437 - RNA, 18 nt, Human
uuuuuuuuuuuuuuuuug

SEQ ID NO: 162438 - RNA, 18 nt, Human
uuuuuuuuuuuuuuuuug

SEQ ID NO: 162439 - RNA, 21 nt, Human
uuuuuuuuuuuuuuuuugagg

SEQ ID NO: 162440 - RNA, 21 nt, Human
uuuuuuuuuuuuuuuuugagg

SEQ ID NO: 162441 - RNA, 23 nt, Human
uuuuuuuuuuuuuuuuuuugagg

SEQ ID NO: 162442 - RNA, 23 nt, Human
uuuuuuuuuuuuuuuuuuugagg

SEQ ID NO: 162443 - RNA, 23 nt, Human
aaaccacacaauuuguacccaaa

SEQ ID NO: 162444 - RNA, 19 nt, Human
aaauaacacccucuccaca

SEQ ID NO: 162445 - RNA, 26 nt, Human
aaauaacacccucuccacaucggagg

SEQ ID NO: 162446 - RNA, 19 nt, Human
aagagcaccucugaaaucc

SEQ ID NO: 162447 - RNA, 20 nt, Human
aagauagagaagaugcugga

SEQ ID NO: 162448 - RNA, 20 nt, Human
aagaugcuggauggagaggc

SEQ ID NO: 162449 - RNA, 22 nt, Human
aagccaaaaucugugcuuaaau

SEQ ID NO: 162450 - RNA, 22 nt, Human
aaggucccgggaggagcuccag

SEQ ID NO: 162451 - RNA, 24 nt, Human
acaggcaaggacuaccacgaaaua

SEQ ID NO: 162452 - RNA, 25 nt, Human
agaaacacuuuucacucauaaaucc

SEQ ID NO: 162453 - RNA, 25 nt, Human
agagaagaugcuggauggagaggcu

SEQ ID NO: 162454 - RNA, 20 nt, Human
agaugaccaaugaauggugg

SEQ ID NO: 162455 - RNA, 19 nt, Human
aggaaagugagauucacag

SEQ ID NO: 162456 - RNA, 23 nt, Human
aggaaggaugacuuccuuccuug

SEQ ID NO: 162457 - RNA, 23 nt, Human
caaauaccaagaugaccaaugaa

SEQ ID NO: 162458 - RNA, 20 nt, Human
caaauuuuuagccucauuua

SEQ ID NO: 162459 - RNA, 19 nt, Human
caagcaaaguauuguugac

SEQ ID NO: 162460 - RNA, 21 nt, Human
caaggucccgggaggagcucc

SEQ ID NO: 162461 - RNA, 19 nt, Human
cacaaauaccaagaugacc

SEQ ID NO: 162462 - RNA, 20 nt, Human
caccacggacucccaccaag

SEQ ID NO: 162463 - RNA, 21 nt, Human
caccacggacucccaccaagg

SEQ ID NO: 162464 - RNA, 19 nt, Human
cacgagacuaaacagaucu

SEQ ID NO: 162465 - RNA, 18 nt, Human
cacugccagcccacagag

SEQ ID NO: 162466 - RNA, 24 nt, Human
cagcacaaauaccaagaugaccaa

SEQ ID NO: 162467 - RNA, 26 nt, Human
cagcacaaauaccaagaugaccaaug

SEQ ID NO: 162468 - RNA, 22 nt, Human
caucaagaguccaauccucaag

SEQ ID NO: 162469 - RNA, 22 nt, Human
ccaauccucaagaaaccacaca

SEQ ID NO: 162470 - RNA, 22 nt, Human
ccuagagagagaaaauacaaau

SEQ ID NO: 162471 - RNA, 20 nt, Human
ccucugaaauccauacuuga

SEQ ID NO: 162472 - RNA, 23 nt, Human
ccucugaaauccauacuugauuc

SEQ ID NO: 162473 - RNA, 23 nt, Human
ccugggcagccucggcccgaccc

SEQ ID NO: 162474 - RNA, 23 nt, Human
cgccacgggguccaccggcgggg

SEQ ID NO: 162475 - RNA, 22 nt, Human
cuaaauaacacccucuccacau

SEQ ID NO: 162476 - RNA, 28 nt, Human
cucaagaaaccacacaauuuguacccaa

SEQ ID NO: 162477 - RNA, 18 nt, Human
cuggauggagaggcuugc

SEQ ID NO: 162478 - RNA, 24 nt, Human
cuucacaugucccauuguaucacu

SEQ ID NO: 162479 - RNA, 23 nt, Human
cuuuccagcagcacugucccugg

SEQ ID NO: 162480 - RNA, 22 nt, Human
gaaagugagauucacagcacaa

SEQ ID NO: 162481 - RNA, 19 nt, Human
gaaggcauucaacuaagag

SEQ ID NO: 162482 - RNA, 18 nt, Human
gcauuaaaaauaucuaca

SEQ ID NO: 162483 - RNA, 19 nt, Human
gguaaccaaauugccuccc

SEQ ID NO: 162484 - RNA, 19 nt, Human
gguaucuggagguugggca

SEQ ID NO: 162485 - RNA, 22 nt, Human
uaaaaauagaaauccaucaaga

SEQ ID NO: 162486 - RNA, 19 nt, Human
uaaacagaucucauucaca

SEQ ID NO: 162487 - RNA, 20 nt, Human
uacaaaugcuuacuguauag

SEQ ID NO: 162488 - RNA, 20 nt, Human
uacauugaggaaagugagau

SEQ ID NO: 162489 - RNA, 24 nt, Human
uauaaaaauagaaauccaucaaga

SEQ ID NO: 162490 - RNA, 19 nt, Human
uaucuggagguugggcauu

SEQ ID NO: 162491 - RNA, 23 nt, Human
uauuacccuuggguguaugggga

SEQ ID NO: 162492 - RNA, 18 nt, Human
uccaaggugacaauggca

SEQ ID NO: 162493 - RNA, 21 nt, Human
ucccuguggcaccacggacuc

SEQ ID NO: 162494 - RNA, 18 nt, Human
ucuaagagcaccucugaa

SEQ ID NO: 162495 - RNA, 24 nt, Human
ucuguauucuucacaugucccauu

SEQ ID NO: 162496 - RNA, 22 nt, Human
ugacaauggcauuaaauggcau

SEQ ID NO: 162497 - RNA, 20 nt, Human
ugacuuccuuccuugaucuc

SEQ ID NO: 162498 - RNA, 21 nt, Human
ugaggaaagugagauucacag

SEQ ID NO: 162499 - RNA, 20 nt, Human
ugaucucuaaauaacacccu

SEQ ID NO: 162500 - RNA, 22 nt, Human
uggcaccacggacucccaccaa

SEQ ID NO: 162501 - RNA, 21 nt, Human
ugggagccccuucccuguggc

SEQ ID NO: 162502 - RNA, 18 nt, Human
ugggcaauaaagccaaaa

SEQ ID NO: 162503 - RNA, 22 nt, Human
uggguguauggggaaucuaaga

SEQ ID NO: 162504 - RNA, 23 nt, Human
uguacacguuuauuacccuuggg

SEQ ID NO: 162505 - RNA, 27 nt, Human
uuaaaaaacagcaacuauaugcacgaa

SEQ ID NO: 162506 - RNA, 22 nt, Human
uuuuucaaauucacuucaaaua

SEQ ID NO: 162507 - RNA, 22 nt, Human
aaaacaaaaacagcgcaugaaa

SEQ ID NO: 162508 - RNA, 18 nt, Human
aacuccaggggcuccagc

SEQ ID NO: 162509 - RNA, 23 nt, Human
aacuuguugcuaucuaucacuuu

SEQ ID NO: 162510 - RNA, 22 nt, Human
aagccuuagaauccucucucca

SEQ ID NO: 162511 - RNA, 19 nt, Human
aagcucgcucucccuucuc

SEQ ID NO: 162512 - RNA, 23 nt, Human
aaggagguauaauggggaaacac

SEQ ID NO: 162513 - RNA, 22 nt, Human
aagggacuagcacuacugaaaa

SEQ ID NO: 162514 - RNA, 24 nt, Human
aagggacuagcacuacugaaaagg

SEQ ID NO: 162515 - RNA, 20 nt, Human
acacagccaacuccaggggc

SEQ ID NO: 162516 - RNA, 26 nt, Human
accagguccccgcaggccccugcucc

SEQ ID NO: 162517 - RNA, 24 nt, Human
acccuggcguacccuucuccaccg

SEQ ID NO: 162518 - RNA, 24 nt, Human
acccuucuccaccgcuugucccca

SEQ ID NO: 162519 - RNA, 21 nt, Human
agaaaagcacagucuaggucc

SEQ ID NO: 162520 - RNA, 21 nt, Human
agacagaaaagcacagucuag

SEQ ID NO: 162521 - RNA, 26 nt, Human
agacagaaaagcacagucuaggucca

SEQ ID NO: 162522 - RNA, 20 nt, Human
aggcgguccuaagcucgcuc

SEQ ID NO: 162523 - RNA, 24 nt, Human
cacagacacagccaacuccagggg

SEQ ID NO: 162524 - RNA, 24 nt, Human
cacagucuagguccaccaucaccu

SEQ ID NO: 162525 - RNA, 19 nt, Human
caccagguccccgcaggcc

SEQ ID NO: 162526 - RNA, 18 nt, Human
cagccgccuuccaaagcc

SEQ ID NO: 162527 - RNA, 18 nt, Human
caucaccucccacuggcc

SEQ ID NO: 162528 - RNA, 20 nt, Human
caucuucucucagcaguucc

SEQ ID NO: 162529 - RNA, 22 nt, Human
ccaaagcccgcgcucccgucac

SEQ ID NO: 162530 - RNA, 22 nt, Human
ccacuggccaccaguuggccag

SEQ ID NO: 162531 - RNA, 23 nt, Human
ccagugucuuauuccaaagucuc

SEQ ID NO: 162532 - RNA, 19 nt, Human
cccacccaagacacagcca

SEQ ID NO: 162533 - RNA, 20 nt, Human
cccuuuuaucucccucucuc

SEQ ID NO: 162534 - RNA, 22 nt, Human
ccuuagaauccucucuccaccc

SEQ ID NO: 162535 - RNA, 20 nt, Human
ccuuugggacacgcggccuc

SEQ ID NO: 162536 - RNA, 20 nt, Human
cggcggguggccugacguuc

SEQ ID NO: 162537 - RNA, 21 nt, Human
cgguccuaagcucgcucuccc

SEQ ID NO: 162538 - RNA, 22 nt, Human
cuaaagcuugguucgggguugc

SEQ ID NO: 162539 - RNA, 22 nt, Human
cucagcuuagcggcggguggcc

SEQ ID NO: 162540 - RNA, 22 nt, Human
cuccagggagaacagagucucu

SEQ ID NO: 162541 - RNA, 21 nt, Human
cuccaggggcuccagcuuucu

SEQ ID NO: 162542 - RNA, 18 nt, Human
cucccucucucuucucca

SEQ ID NO: 162543 - RNA, 20 nt, Human
cucccucucucuucuccaaa

SEQ ID NO: 162544 - RNA, 21 nt, Human
cucccucucucuucuccaaaa

SEQ ID NO: 162545 - RNA, 19 nt, Human
cucuucuccaaaacuuguu

SEQ ID NO: 162546 - RNA, 19 nt, Human
cugaacaagacagaaaagc

SEQ ID NO: 162547 - RNA, 22 nt, Human
cugagaagugguuugagccuga

SEQ ID NO: 162548 - RNA, 20 nt, Human
cugauugccaggugaacauc

SEQ ID NO: 162549 - RNA, 22 nt, Human
cugcccacccaagacacagcca

SEQ ID NO: 162550 - RNA, 20 nt, Human
cuuagaauccucucuccacc

SEQ ID NO: 162551 - RNA, 22 nt, Human
cuuagaauccucucuccacccc

SEQ ID NO: 162552 - RNA, 23 nt, Human
cuuccaaagcccgcgcucccguc

SEQ ID NO: 162553 - RNA, 24 nt, Human
cuuguccccacuccacccacacca

SEQ ID NO: 162554 - RNA, 22 nt, Human
gcacuacugaaaagggucacgc

SEQ ID NO: 162555 - RNA, 24 nt, Human
guagugcaggcugcguccccucag

SEQ ID NO: 162556 - RNA, 25 nt, Human
uaaaacaaaaacagcgcaugaaaac

SEQ ID NO: 162557 - RNA, 24 nt, Human
uaacuuuaaaacaaaaacagcgca

SEQ ID NO: 162558 - RNA, 20 nt, Human
uaagcucgcucucccuucuc

SEQ ID NO: 162559 - RNA, 22 nt, Human
uacugaaaagggucacgcuaga

SEQ ID NO: 162560 - RNA, 18 nt, Human
uagaauccucucuccacc

SEQ ID NO: 162561 - RNA, 23 nt, Human
uagcaaguucgaguuucugccca

SEQ ID NO: 162562 - RNA, 22 nt, Human
uagcacuacugaaaagggucac

SEQ ID NO: 162563 - RNA, 20 nt, Human
uaguguccauuaaacugccu

SEQ ID NO: 162564 - RNA, 21 nt, Human
uaguguccauuaaacugccug

SEQ ID NO: 162565 - RNA, 24 nt, Human
ucacgcuagaaaagccuuagaauc

SEQ ID NO: 162566 - RNA, 26 nt, Human
ucagucacaaacacagacacagccaa

SEQ ID NO: 162567 - RNA, 21 nt, Human
uccacccacaccagguccccg

SEQ ID NO: 162568 - RNA, 19 nt, Human
ucccucucucuucuccaaa

SEQ ID NO: 162569 - RNA, 22 nt, Human
ucuacacccgaaaucgcaggac

SEQ ID NO: 162570 - RNA, 24 nt, Human
ucuaucacuuucauguaacaaugg

SEQ ID NO: 162571 - RNA, 22 nt, Human
ucucauggcaaccagucccucc

SEQ ID NO: 162572 - RNA, 21 nt, Human
ucucucucaaggugggucaag

SEQ ID NO: 162573 - RNA, 23 nt, Human
ucucucucaaggugggucaaggc

SEQ ID NO: 162574 - RNA, 23 nt, Human
ucuguggccuucuugccauuaag

SEQ ID NO: 162575 - RNA, 21 nt, Human
ugaaaagggucacgcuagaaa

SEQ ID NO: 162576 - RNA, 19 nt, Human
ugaacaagacagaaaagca

SEQ ID NO: 162577 - RNA, 20 nt, Human
ugaacaagacagaaaagcac

SEQ ID NO: 162578 - RNA, 19 nt, Human
ugaccugcucgccacgcac

SEQ ID NO: 162579 - RNA, 19 nt, Human
ugguucgggguugccccgg

SEQ ID NO: 162580 - RNA, 21 nt, Human
ugucucccccuuuuaucuccc

SEQ ID NO: 162581 - RNA, 19 nt, Human
ugucuuauuccaaagucuc

SEQ ID NO: 162582 - RNA, 18 nt, Human
uucugcccaucuucucuc

SEQ ID NO: 162583 - RNA, 21 nt, Human
uucuguacaucuuuugucucc

SEQ ID NO: 162584 - RNA, 21 nt, Human
uuguccccacuccacccacac

SEQ ID NO: 162585 - RNA, 24 nt, Human
uuuuuuuuuuuuuuuuuuacuuuu

SEQ ID NO: 162586 - RNA, 26 nt, Human
uuuuuuuuuuuuuuuuuuacuuuuag

SEQ ID NO: 162587 - RNA, 18 nt, Human
aaacaugagcucuucggg

SEQ ID NO: 162588 - RNA, 20 nt, Human
aaagaagauacuugagaaaa

SEQ ID NO: 162589 - RNA, 19 nt, Human
aagcguccuucaccaaaag

SEQ ID NO: 162590 - RNA, 22 nt, Human
acaaagaagauacuugagaaaa

SEQ ID NO: 162591 - RNA, 21 nt, Human
acacauuagggacaaagaaga

SEQ ID NO: 162592 - RNA, 18 nt, Human
acaguaggauagguaugc

SEQ ID NO: 162593 - RNA, 19 nt, Human
caaaagaauuuggugaaaa

SEQ ID NO: 162594 - RNA, 20 nt, Human
caagugagccuucuaaucag

SEQ ID NO: 162595 - RNA, 20 nt, Human
cuagaaugcguggagaaccc

SEQ ID NO: 162596 - RNA, 26 nt, Human
gacaaagaagauacuugagaaaacgu

SEQ ID NO: 162597 - RNA, 22 nt, Human
gccuucuaaucagcacauaucu

SEQ ID NO: 162598 - RNA, 21 nt, Human
ggccguuucugaagcguccuu

SEQ ID NO: 162599 - RNA, 19 nt, Human
gggagucuagaaugcgugg

SEQ ID NO: 162600 - RNA, 22 nt, Human
gggucugcucuucagugauggc

SEQ ID NO: 162601 - RNA, 24 nt, Human
uaaggcacugguuauccuccacac

SEQ ID NO: 162602 - RNA, 26 nt, Human
uagccaaaaaacaugagcucuucggg

SEQ ID NO: 162603 - RNA, 21 nt, Human
ucauaggucuagccaaaaaac

SEQ ID NO: 162604 - RNA, 21 nt, Human
ucuagaaugcguggagaaccc

SEQ ID NO: 162605 - RNA, 19 nt, Human
ucugaagcguccuucacca

SEQ ID NO: 162606 - RNA, 20 nt, Human
ugaagcguccuucaccaaaa

SEQ ID NO: 162607 - RNA, 20 nt, Human
ugagaaaacgugcagugaag

SEQ ID NO: 162608 - RNA, 20 nt, Human
ugagaaaacgugcagugaag

SEQ ID NO: 162609 - RNA, 19 nt, Human
uggugaaaaaugaguaaug

SEQ ID NO: 162610 - RNA, 22 nt, Human
acagagaggacacggcgcugca

SEQ ID NO: 162611 - RNA, 18 nt, Human
agaggccaccagcuugag

SEQ ID NO: 162612 - RNA, 19 nt, Human
aggaagcccuggcagcagc

SEQ ID NO: 162613 - RNA, 18 nt, Human
caccuaggccugcagagg

SEQ ID NO: 162614 - RNA, 24 nt, Human
cucaggcccggugcggaccccggc

SEQ ID NO: 162615 - RNA, 23 nt, Human
cuggcagcagcagggacacagag

SEQ ID NO: 162616 - RNA, 21 nt, Human
cuugagaagggggucccagcc

SEQ ID NO: 162617 - RNA, 22 nt, Human
gcccggaagaggaagcccuggc

SEQ ID NO: 162618 - RNA, 18 nt, Human
gggcagcugcuccuggga

SEQ ID NO: 162619 - RNA, 19 nt, Human
ugcccggaagaggaagccc

SEQ ID NO: 162620 - RNA, 21 nt, Human
aaggcguccuucacuagccac

SEQ ID NO: 162621 - RNA, 19 nt, Human
acuagccacucuacgugug

SEQ ID NO: 162622 - RNA, 21 nt, Human
acuggcuggcuuguaaggcuc

SEQ ID NO: 162623 - RNA, 23 nt, Human
acuggcuggcuuguaaggcucuu

SEQ ID NO: 162624 - RNA, 19 nt, Human
agcccaagccgagggucag

SEQ ID NO: 162625 - RNA, 20 nt, Human
agcugcagggacuggcuggc

SEQ ID NO: 162626 - RNA, 18 nt, Human
aggaggugaugcagcuca

SEQ ID NO: 162627 - RNA, 20 nt, Human
aggcaguguacaggguagag

SEQ ID NO: 162628 - RNA, 22 nt, Human
aggcaguguacaggguagagug

SEQ ID NO: 162629 - RNA, 22 nt, Human
aguaucuuuauaagugaguggc

SEQ ID NO: 162630 - RNA, 19 nt, Human
augcggcgcaccauacccc

SEQ ID NO: 162631 - RNA, 20 nt, Human
caagaagagucaaaaaggcg

SEQ ID NO: 162632 - RNA, 24 nt, Human
cccaggaugggucaguuuguggag

SEQ ID NO: 162633 - RNA, 20 nt, Human
ccccaucgccucccauguca

SEQ ID NO: 162634 - RNA, 23 nt, Human
ccccuacagaagacucuguguga

SEQ ID NO: 162635 - RNA, 18 nt, Human
cugcugaaaagauaagua

SEQ ID NO: 162636 - RNA, 21 nt, Human
ggagcugcagggacuggcugg

SEQ ID NO: 162637 - RNA, 24 nt, Human
uaagagaggcaucucuccauggua

SEQ ID NO: 162638 - RNA, 18 nt, Human
uagagugcagcccaagcc

SEQ ID NO: 162639 - RNA, 25 nt, Human
uagagugcagcccaagccgaggguc

SEQ ID NO: 162640 - RNA, 21 nt, Human
ucagcacauauauacugcuga

SEQ ID NO: 162641 - RNA, 22 nt, Human
ucuccaugguaugagacugcuc

SEQ ID NO: 162642 - RNA, 23 nt, Human
ucuguggagaacaaggcccagga

SEQ ID NO: 162643 - RNA, 26 nt, Human
ugaaaagauaaguaucuuuauaagug

SEQ ID NO: 162644 - RNA, 24 nt, Human
uggcugaagacauaagagaggcau

SEQ ID NO: 162645 - RNA, 18 nt, Human
ugggucaguuuguggagc

SEQ ID NO: 162646 - RNA, 19 nt, Human
ugucucuguccaucguccc

SEQ ID NO: 162647 - RNA, 20 nt, Human
ugucucuguccaucgucccc

SEQ ID NO: 162648 - RNA, 21 nt, Human
uuuguggagcugcagggacug

SEQ ID NO: 162649 - RNA, 24 nt, Human
aaaaaaaaacaaaacaaaacaaaa

SEQ ID NO: 162650 - RNA, 26 nt, Human
aaaaaaacaaaacaaaacaaaacaaa

SEQ ID NO: 162651 - RNA, 19 nt, Human
aaaaaaacacaucccccga

SEQ ID NO: 162652 - RNA, 24 nt, Human
aaaaaaacacaucccccgaggaua

SEQ ID NO: 162653 - RNA, 23 nt, Human
aaaaaacacaucccccgaggaua

SEQ ID NO: 162654 - RNA, 27 nt, Human
aaaacaaaacaaaacaaaaaaacacau

SEQ ID NO: 162655 - RNA, 26 nt, Human
aaaacauaucccccaccaugggccag

SEQ ID NO: 162656 - RNA, 27 nt, Human
aaacaaaacaaaaaaacacaucccccg

SEQ ID NO: 162657 - RNA, 19 nt, Human
aaacaaaacaaaacaaaaa

SEQ ID NO: 162658 - RNA, 23 nt, Human
aaacaaaacaaaacaaaaaaaca

SEQ ID NO: 162659 - RNA, 22 nt, Human
aaacaaaacaaaacaaaacaaa

SEQ ID NO: 162660 - RNA, 26 nt, Human
aaaguucuccucaggggacuguaaag

SEQ ID NO: 162661 - RNA, 19 nt, Human
aaaugccuaagacauccuu

SEQ ID NO: 162662 - RNA, 20 nt, Human
aacauggugaaacucccauc

SEQ ID NO: 162663 - RNA, 21 nt, Human
aacauggugaaacucccaucu

SEQ ID NO: 162664 - RNA, 22 nt, Human
aacauggugaaacucccaucuc

SEQ ID NO: 162665 - RNA, 23 nt, Human
aagaaagcuuaagauagacagac

SEQ ID NO: 162666 - RNA, 20 nt, Human
aagcaggagagggcaauuaa

SEQ ID NO: 162667 - RNA, 23 nt, Human
aaggcgggcaaaucaccagguca

SEQ ID NO: 162668 - RNA, 24 nt, Human
aauagcuugaaccugggaggugga

SEQ ID NO: 162669 - RNA, 21 nt, Human
aaucaccaggucaggaguucg

SEQ ID NO: 162670 - RNA, 24 nt, Human
aaucaccaggucaggaguucgaga

SEQ ID NO: 162671 - RNA, 20 nt, Human
aauuuaagaaaguucuccuc

SEQ ID NO: 162672 - RNA, 24 nt, Human
acaaaacaaaaaaacacauccccc

SEQ ID NO: 162673 - RNA, 23 nt, Human
acaaaacaaaacaaaaaaacaca

SEQ ID NO: 162674 - RNA, 22 nt, Human
acaaaacaaaacaaaacaaaaa

SEQ ID NO: 162675 - RNA, 18 nt, Human
acauaucacccccuucuc

SEQ ID NO: 162676 - RNA, 20 nt, Human
acauggugaaacucccaucu

SEQ ID NO: 162677 - RNA, 21 nt, Human
acauggugaaacucccaucuc

SEQ ID NO: 162678 - RNA, 23 nt, Human
acaugucggagguuacauggucu

SEQ ID NO: 162679 - RNA, 23 nt, Human
accuguagucccagcuacucagg

SEQ ID NO: 162680 - RNA, 21 nt, Human
acgaaaaugaaaguaauagcc

SEQ ID NO: 162681 - RNA, 22 nt, Human
acuucaucucaaaaaaaaacaa

SEQ ID NO: 162682 - RNA, 28 nt, Human
agaaaguucuccucaggggacuguaaag

SEQ ID NO: 162683 - RNA, 22 nt, Human
agccuggccaacauggugaaac

SEQ ID NO: 162684 - RNA, 24 nt, Human
agccuggccaacauggugaaacuc

SEQ ID NO: 162685 - RNA, 22 nt, Human
agccugggcgauagaaugaaac

SEQ ID NO: 162686 - RNA, 24 nt, Human
agccugggcgauagaaugaaacuu

SEQ ID NO: 162687 - RNA, 20 nt, Human
agcgcagcgcagcggagagc

SEQ ID NO: 162688 - RNA, 22 nt, Human
aggcaggagaauagcuugaacc

SEQ ID NO: 162689 - RNA, 24 nt, Human
aggcaggagaauagcuugaaccug

SEQ ID NO: 162690 - RNA, 24 nt, Human
aggcgggcaaaucaccaggucagg

SEQ ID NO: 162691 - RNA, 24 nt, Human
aggcugaggcaggagaauagcuug

SEQ ID NO: 162692 - RNA, 21 nt, Human
aggguuugguacuagcagcgg

SEQ ID NO: 162693 - RNA, 19 nt, Human
agguggagguugcagugag

SEQ ID NO: 162694 - RNA, 23 nt, Human
agguggagguugcagugagccaa

SEQ ID NO: 162695 - RNA, 24 nt, Human
agguguggugacucacgccuguaa

SEQ ID NO: 162696 - RNA, 21 nt, Human
aucaccaggucaggaguucga

SEQ ID NO: 162697 - RNA, 22 nt, Human
aucccagcacuuugggaggcca

SEQ ID NO: 162698 - RNA, 18 nt, Human
aucccggggcucagccgg

SEQ ID NO: 162699 - RNA, 22 nt, Human
aucccuuuucuugacuacuauu

SEQ ID NO: 162700 - RNA, 24 nt, Human
augggccagguguggugacucacg

SEQ ID NO: 162701 - RNA, 23 nt, Human
auugcacuccagccugggcgaua

SEQ ID NO: 162702 - RNA, 24 nt, Human
auugcacuccagccugggcgauag

SEQ ID NO: 162703 - RNA, 24 nt, Human
auugugccauugcacuccagccug

SEQ ID NO: 162704 - RNA, 24 nt, Human
caaaaaaaaacaaaacaaaacaaa

SEQ ID NO: 162705 - RNA, 23 nt, Human
caaaacaaaaaaacacauccccc

SEQ ID NO: 162706 - RNA, 23 nt, Human
caaaacaaaacaaaacaaaaaaa

SEQ ID NO: 162707 - RNA, 26 nt, Human
caaaauacaaaaauuagucgggcaug

SEQ ID NO: 162708 - RNA, 24 nt, Human
caaaauugugccauugcacuccag

SEQ ID NO: 162709 - RNA, 25 nt, Human
caacauggugaaacucccaucucua

SEQ ID NO: 162710 - RNA, 19 nt, Human
caauaacauagauucaucc

SEQ ID NO: 162711 - RNA, 21 nt, Human
caaugauuacuagcacuagaa

SEQ ID NO: 162712 - RNA, 19 nt, Human
cacaccuguagucccagcu

SEQ ID NO: 162713 - RNA, 23 nt, Human
cacaucccccgaggauagcgggg

SEQ ID NO: 162714 - RNA, 23 nt, Human
caccagcaagggggaggcaccaa

SEQ ID NO: 162715 - RNA, 23 nt, Human
cacccccuucucuuucuaguccc

SEQ ID NO: 162716 - RNA, 22 nt, Human
caccggcccugccccaucaugc

SEQ ID NO: 162717 - RNA, 24 nt, Human
caccuguagucccagcuacucagg

SEQ ID NO: 162718 - RNA, 24 nt, Human
cacgccuguaaucccagcacuuug

SEQ ID NO: 162719 - RNA, 22 nt, Human
cagcacuuugggaggccaaggc

SEQ ID NO: 162720 - RNA, 24 nt, Human
cagcacuuugggaggccaaggcgg

SEQ ID NO: 162721 - RNA, 19 nt, Human
cagccggacacccccaucc

SEQ ID NO: 162722 - RNA, 24 nt, Human
cagcuacucaggaggcugaggcag

SEQ ID NO: 162723 - RNA, 20 nt, Human
caggguagcccgcugugcuc

SEQ ID NO: 162724 - RNA, 26 nt, Human
caucucaaaaaaaaacaaaacaaaac

SEQ ID NO: 162725 - RNA, 19 nt, Human
cauugcacuccagccuggg

SEQ ID NO: 162726 - RNA, 21 nt, Human
cauugcacuccagccugggcg

SEQ ID NO: 162727 - RNA, 22 nt, Human
cauugcacuccagccugggcga

SEQ ID NO: 162728 - RNA, 24 nt, Human
cauugcacuccagccugggcgaua

SEQ ID NO: 162729 - RNA, 20 nt, Human
ccauugcacuccagccuggg

SEQ ID NO: 162730 - RNA, 21 nt, Human
ccauugcacuccagccugggc

SEQ ID NO: 162731 - RNA, 22 nt, Human
ccauugcacuccagccugggcg

SEQ ID NO: 162732 - RNA, 24 nt, Human
ccauugcacuccagccugggcgau

SEQ ID NO: 162733 - RNA, 25 nt, Human
cccaucucuacucaaaauacaaaaa

SEQ ID NO: 162734 - RNA, 18 nt, Human
cccccgaggauagcgggg

SEQ ID NO: 162735 - RNA, 21 nt, Human
cccccuucucuuucuaguccc

SEQ ID NO: 162736 - RNA, 20 nt, Human
ccccuucucuuucuaguccc

SEQ ID NO: 162737 - RNA, 18 nt, Human
cccgcgcgcuugcucgug

SEQ ID NO: 162738 - RNA, 18 nt, Human
ccggacacccccauccac

SEQ ID NO: 162739 - RNA, 19 nt, Human
ccggcccugccccaucaug

SEQ ID NO: 162740 - RNA, 22 nt, Human
ccugcagcgaggcugcuccaaa

SEQ ID NO: 162741 - RNA, 23 nt, Human
ccuggccaacauggugaaacucc

SEQ ID NO: 162742 - RNA, 25 nt, Human
ccuggccaacauggugaaacuccca

SEQ ID NO: 162743 - RNA, 21 nt, Human
ccugggagguggagguugcag

SEQ ID NO: 162744 - RNA, 24 nt, Human
ccugggcgauagaaugaaacuuca

SEQ ID NO: 162745 - RNA, 22 nt, Human
ccuguaaucccagcacuuuggg

SEQ ID NO: 162746 - RNA, 21 nt, Human
ccuguagucccagcuacucag

SEQ ID NO: 162747 - RNA, 24 nt, Human
cgagaccagccuggccaacauggu

SEQ ID NO: 162748 - RNA, 19 nt, Human
cggccggagcgcagcgcag

SEQ ID NO: 162749 - RNA, 20 nt, Human
cgggagcggccggagcgcag

SEQ ID NO: 162750 - RNA, 23 nt, Human
cuaacuuauaaacugaacuuuau

SEQ ID NO: 162751 - RNA, 22 nt, Human
cucacgccuguaaucccagcac

SEQ ID NO: 162752 - RNA, 24 nt, Human
cucacgccuguaaucccagcacuu

SEQ ID NO: 162753 - RNA, 23 nt, Human
cucagccggacacccccauccac

SEQ ID NO: 162754 - RNA, 22 nt, Human
cuccugacaccagcaaggggga

SEQ ID NO: 162755 - RNA, 18 nt, Human
gaaacucccaucucuacu

SEQ ID NO: 162756 - RNA, 19 nt, Human
gaaagcggcugccuucccc

SEQ ID NO: 162757 - RNA, 18 nt, Human
gagcgcagcgcagcgcag

SEQ ID NO: 162758 - RNA, 21 nt, Human
gagguugcagugagccaaaau

SEQ ID NO: 162759 - RNA, 23 nt, Human
gagguugcagugagccaaaauug

SEQ ID NO: 162760 - RNA, 22 nt, Human
gcagcgcagcgcagcggagagc

SEQ ID NO: 162761 - RNA, 22 nt, Human
gccauugcacuccagccugggc

SEQ ID NO: 162762 - RNA, 24 nt, Human
gccauugcacuccagccugggcga

SEQ ID NO: 162763 - RNA, 24 nt, Human
gcucagccggacacccccauccac

SEQ ID NO: 162764 - RNA, 19 nt, Human
gcuuaagauagacagaccc

SEQ ID NO: 162765 - RNA, 19 nt, Human
gcuugaaccugggaggugg

SEQ ID NO: 162766 - RNA, 20 nt, Human
gcuugaaccugggaggugga

SEQ ID NO: 162767 - RNA, 22 nt, Human
gcuugaaccugggagguggagg

SEQ ID NO: 162768 - RNA, 18 nt, Human
ggacacccccauccacgg

SEQ ID NO: 162769 - RNA, 20 nt, Human
ggagcgcagcgcagcgcagc

SEQ ID NO: 162770 - RNA, 22 nt, Human
ggagguugcagugagccaaaau

SEQ ID NO: 162771 - RNA, 24 nt, Human
ggagguugcagugagccaaaauug

SEQ ID NO: 162772 - RNA, 23 nt, Human
ggcaaaucaccaggucaggaguu

SEQ ID NO: 162773 - RNA, 22 nt, Human
ggcaugguggcgcacaccugua

SEQ ID NO: 162774 - RNA, 18 nt, Human
ggccggagcgcagcgcag

SEQ ID NO: 162775 - RNA, 18 nt, Human
gguccuggcggagggagg

SEQ ID NO: 162776 - RNA, 24 nt, Human
ggugacucacgccuguaaucccag

SEQ ID NO: 162777 - RNA, 24 nt, Human
gguggcgcacaccuguagucccag

SEQ ID NO: 162778 - RNA, 19 nt, Human
guaaagggacauauauaga

SEQ ID NO: 162779 - RNA, 22 nt, Human
uaaaccuauagacagaaaccag

SEQ ID NO: 162780 - RNA, 23 nt, Human
uaauagcccauaaaccuauagac

SEQ ID NO: 162781 - RNA, 27 nt, Human
uaauuuguguaacauaucacccccuuu

SEQ ID NO: 162782 - RNA, 22 nt, Human
uacagggcucucgacugaagca

SEQ ID NO: 162783 - RNA, 23 nt, Human
uacagggcucucgacugaagcag

SEQ ID NO: 162784 - RNA, 21 nt, Human
uacguacauacaggaaaaaac

SEQ ID NO: 162785 - RNA, 22 nt, Human
uacuaaaugccuaagacauccu

SEQ ID NO: 162786 - RNA, 23 nt, Human
uagacagaaaccagcacuauguc

SEQ ID NO: 162787 - RNA, 24 nt, Human
uagcuugaaccugggagguggagg

SEQ ID NO: 162788 - RNA, 24 nt, Human
uagucuuaagaguauaagcuguuu

SEQ ID NO: 162789 - RNA, 18 nt, Human
uaucugugcggguccugg

SEQ ID NO: 162790 - RNA, 24 nt, Human
ucaaaaaaaaacaaaacaaaacaa

SEQ ID NO: 162791 - RNA, 21 nt, Human
ucaaggagacaaggacuacag

SEQ ID NO: 162792 - RNA, 20 nt, Human
ucaccaggucaggaguucga

SEQ ID NO: 162793 - RNA, 24 nt, Human
ucaccaggucaggaguucgagacc

SEQ ID NO: 162794 - RNA, 20 nt, Human
ucaguucaguuuagaugcuu

SEQ ID NO: 162795 - RNA, 18 nt, Human
uccagccugggcgauaga

SEQ ID NO: 162796 - RNA, 18 nt, Human
ucccugugauggaaugac

SEQ ID NO: 162797 - RNA, 22 nt, Human
uccgcuggcaacacgaaaauga

SEQ ID NO: 162798 - RNA, 20 nt, Human
ucuaggaaaaccuucauucc

SEQ ID NO: 162799 - RNA, 21 nt, Human
ucucaaaaaaaaacaaaacaa

SEQ ID NO: 162800 - RNA, 25 nt, Human
ucucaaaaaaaaacaaaacaaaaca

SEQ ID NO: 162801 - RNA, 23 nt, Human
ucucgacugaagcaggagagggc

SEQ ID NO: 162802 - RNA, 22 nt, Human
ucuugacuacuauuaagacccu

SEQ ID NO: 162803 - RNA, 24 nt, Human
ugaaagcggcugccuuccccucuc

SEQ ID NO: 162804 - RNA, 24 nt, Human
ugaaccugggagguggagguugca

SEQ ID NO: 162805 - RNA, 21 nt, Human
ugacucacgccuguaauccca

SEQ ID NO: 162806 - RNA, 22 nt, Human
ugacucacgccuguaaucccag

SEQ ID NO: 162807 - RNA, 24 nt, Human
ugacucacgccuguaaucccagca

SEQ ID NO: 162808 - RNA, 24 nt, Human
ugaggcaggagaauagcuugaacc

SEQ ID NO: 162809 - RNA, 24 nt, Human
ugaggcaggagaauagcuugaacc

SEQ ID NO: 162810 - RNA, 18 nt, Human
ugcucagugaccuccugc

SEQ ID NO: 162811 - RNA, 18 nt, Human
ugcucagugaccuccugg

SEQ ID NO: 162812 - RNA, 20 nt, Human
uggccaacauggugaaacuc

SEQ ID NO: 162813 - RNA, 24 nt, Human
ugggaggccaaggcgggcaaauca

SEQ ID NO: 162814 - RNA, 18 nt, Human
ugggagguggagguugca

SEQ ID NO: 162815 - RNA, 29 nt, Human
ugggagguggagguugcagugacaacggu

SEQ ID NO: 162816 - RNA, 24 nt, Human
ugggagguggagguugcagugagc

SEQ ID NO: 162817 - RNA, 24 nt, Human
uggugacucacgccuguaauccca

SEQ ID NO: 162818 - RNA, 24 nt, Human
ugguggcgcacaccuguaguccca

SEQ ID NO: 162819 - RNA, 18 nt, Human
uuagucgggcaugguggc

SEQ ID NO: 162820 - RNA, 18 nt, Human
uuagucuuaagaguauaa

SEQ ID NO: 162821 - RNA, 18 nt, Human
uucaucucaaaaaaaaac

SEQ ID NO: 162822 - RNA, 24 nt, Human
uugaaccugggagguggagguugc

SEQ ID NO: 162823 - RNA, 22 nt, Human
uugcagugagccaaaauugugc

SEQ ID NO: 162824 - RNA, 23 nt, Human
uugugccauugcacuccagccug

SEQ ID NO: 162825 - RNA, 24 nt, Human
uuuuuaauuaaaugaagguuuuau

SEQ ID NO: 162826 - RNA, 22 nt, Human
uuuuuuuuuuuuuuuuucacau

SEQ ID NO: 162827 - RNA, 18 nt, Human
aaaaaaaaccuuacauaa

SEQ ID NO: 162828 - RNA, 22 nt, Human
aaauguuaaaacccacagagcu

SEQ ID NO: 162829 - RNA, 22 nt, Human
aacaacuuuuugcuuuccaaug

SEQ ID NO: 162830 - RNA, 20 nt, Human
aagagaaaaugacaaauaua

SEQ ID NO: 162831 - RNA, 20 nt, Human
aaggggccaugggaacacug

SEQ ID NO: 162832 - RNA, 24 nt, Human
aaucagaaggcaagaccaccagga

SEQ ID NO: 162833 - RNA, 22 nt, Human
acagacaaaggcccugccccca

SEQ ID NO: 162834 - RNA, 19 nt, Human
accaggauuaaagaugcaa

SEQ ID NO: 162835 - RNA, 22 nt, Human
agaaaaggauacaaauuaaaaa

SEQ ID NO: 162836 - RNA, 20 nt, Human
agaaggaaaugcaaggggcc

SEQ ID NO: 162837 - RNA, 19 nt, Human
agacaaaggcccugccccc

SEQ ID NO: 162838 - RNA, 23 nt, Human
agacaaaggcccugcccccaagg

SEQ ID NO: 162839 - RNA, 19 nt, Human
agacagacaaaggcccugc

SEQ ID NO: 162840 - RNA, 22 nt, Human
agcacaaaaacagaccaaaaaa

SEQ ID NO: 162841 - RNA, 19 nt, Human
aggaaaugcaaggggccau

SEQ ID NO: 162842 - RNA, 19 nt, Human
aggcauuugggaauacaga

SEQ ID NO: 162843 - RNA, 20 nt, Human
aggcauuugggaauacagag

SEQ ID NO: 162844 - RNA, 25 nt, Human
agguugcagagagaagcuucugucu

SEQ ID NO: 162845 - RNA, 22 nt, Human
augagacagacaaaggcccugc

SEQ ID NO: 162846 - RNA, 20 nt, Human
caaaaacagaccaaaaaagu

SEQ ID NO: 162847 - RNA, 20 nt, Human
cacuucucuagcaaagaaga

SEQ ID NO: 162848 - RNA, 21 nt, Human
cccccaaggaacuuacagucu

SEQ ID NO: 162849 - RNA, 19 nt, Human
gaagagaaguucucaaacc

SEQ ID NO: 162850 - RNA, 21 nt, Human
guaacagagaguuaagaagga

SEQ ID NO: 162851 - RNA, 22 nt, Human
uaacagagaguuaagaaggaaa

SEQ ID NO: 162852 - RNA, 24 nt, Human
uagaaagaaauugguuacuccuug

SEQ ID NO: 162853 - RNA, 23 nt, Human
uagaucaaauauugaccaaagua

SEQ ID NO: 162854 - RNA, 19 nt, Human
uagcacaaaaacagaccaa

SEQ ID NO: 162855 - RNA, 23 nt, Human
uagcaccuaggaauuuuuuaggu

SEQ ID NO: 162856 - RNA, 21 nt, Human
uaggaaagaauguuucucuug

SEQ ID NO: 162857 - RNA, 27 nt, Human
uaucuuuacaaaaauguuaaaacccac

SEQ ID NO: 162858 - RNA, 18 nt, Human
uccugauguacugaaugg

SEQ ID NO: 162859 - RNA, 22 nt, Human
ucgaacuaacgacuuacauuua

SEQ ID NO: 162860 - RNA, 24 nt, Human
ucgaacuaacgacuuacauuuaau

SEQ ID NO: 162861 - RNA, 21 nt, Human
ugggaauacagagaugagaca

SEQ ID NO: 162862 - RNA, 20 nt, Human
ugggauauuuuaauacauau

SEQ ID NO: 162863 - RNA, 23 nt, Human
ugguaugggaagagaaguucuca

SEQ ID NO: 162864 - RNA, 22 nt, Human
ugguuacuccuugggaaaaaaa

SEQ ID NO: 162865 - RNA, 24 nt, Human
uguacugaauggcccuugguauau

SEQ ID NO: 162866 - RNA, 22 nt, Human
uguacuguuaggcauuugggaa

SEQ ID NO: 162867 - RNA, 18 nt, Human
ugucacagaauauaguuu

SEQ ID NO: 162868 - RNA, 22 nt, Human
ugugcagaaauauuuaacuuag

SEQ ID NO: 162869 - RNA, 20 nt, Human
uucucuugccuuccuggauu

SEQ ID NO: 162870 - RNA, 22 nt, Human
uuguauuuucucuccacuucuc

SEQ ID NO: 162871 - RNA, 19 nt, Human
uuuaauaauaauuagcaug

SEQ ID NO: 162872 - RNA, 23 nt, Human
uuugggaauacagagaugagaca

SEQ ID NO: 162873 - RNA, 23 nt, Human
uuugggugguaugggaagagaag

SEQ ID NO: 162874 - RNA, 20 nt, Human
aagaaaacaaaagaaaauca

SEQ ID NO: 162875 - RNA, 24 nt, Human
aagaaaacaaaagaaaaucaugug

SEQ ID NO: 162876 - RNA, 27 nt, Human
acauacagaagagcaaaaaucuacgua

SEQ ID NO: 162877 - RNA, 23 nt, Human
agaaaugaagaaaacaaaagaaa

SEQ ID NO: 162878 - RNA, 24 nt, Human
auugcaacagagucugguuuaauu

SEQ ID NO: 162879 - RNA, 23 nt, Human
caaggauaaaagaccccucuucc

SEQ ID NO: 162880 - RNA, 23 nt, Human
ccuacgacaaggauaaaagaccc

SEQ ID NO: 162881 - RNA, 21 nt, Human
gaacaccaacucugucaaaac

SEQ ID NO: 162882 - RNA, 24 nt, Human
gagaaaugaagaaaacaaaagaaa

SEQ ID NO: 162883 - RNA, 19 nt, Human
gagcaagagaaaugaagaa

SEQ ID NO: 162884 - RNA, 23 nt, Human
ggugagcaagagaaaugaagaaa

SEQ ID NO: 162885 - RNA, 22 nt, Human
uaauaaaucuuuuuggaaguuu

SEQ ID NO: 162886 - RNA, 22 nt, Human
ugagcaagagaaaugaagaaaa

SEQ ID NO: 162887 - RNA, 21 nt, Human
uggacuuuuaaacaucaguuu

SEQ ID NO: 162888 - RNA, 20 nt, Human
uggugagcaagagaaaugaa

SEQ ID NO: 162889 - RNA, 28 nt, Human
uguacaaaaauguugucacauacagaag

SEQ ID NO: 162890 - RNA, 23 nt, Human
uucuuggugagcaagagaaauga

SEQ ID NO: 162891 - RNA, 24 nt, Human
uugaaaauucucgcaaucaacuag

SEQ ID NO: 162892 - RNA, 24 nt, Human
aaaaaaaaaaaaacacacaaaaaa

SEQ ID NO: 162893 - RNA, 23 nt, Human
aaaaaaaacacacaaaaaaacac

SEQ ID NO: 162894 - RNA, 21 nt, Human
aaaaacacaaaaaacugagua

SEQ ID NO: 162895 - RNA, 21 nt, Human
aaaaacacacaaaaaaacaca

SEQ ID NO: 162896 - RNA, 21 nt, Human
aaaaacccaagacccagcauu

SEQ ID NO: 162897 - RNA, 21 nt, Human
aaaacacacaaaaaaacacaa

SEQ ID NO: 162898 - RNA, 23 nt, Human
aaacacaaaaaacugaguauccc

SEQ ID NO: 162899 - RNA, 24 nt, Human
aaacacacaaaaaaacacaaaaaa

SEQ ID NO: 162900 - RNA, 21 nt, Human
aaagaugaauuaaaaaaccca

SEQ ID NO: 162901 - RNA, 22 nt, Human
aaggggcuagagcccccaauca

SEQ ID NO: 162902 - RNA, 25 nt, Human
acaaaaaaacacaaaaaacugagua

SEQ ID NO: 162903 - RNA, 18 nt, Human
acaaaaaacugaguaucc

SEQ ID NO: 162904 - RNA, 23 nt, Human
acuggguagccuuggggccgggu

SEQ ID NO: 162905 - RNA, 20 nt, Human
agaggaggggagggaagaga

SEQ ID NO: 162906 - RNA, 24 nt, Human
agaggggaggggagaggaggggag

SEQ ID NO: 162907 - RNA, 23 nt, Human
aggagaggggaggggagaggagg

SEQ ID NO: 162908 - RNA, 24 nt, Human
aggagaggggaggggagaggaggg

SEQ ID NO: 162909 - RNA, 20 nt, Human
aggaggcagggcugggucgg

SEQ ID NO: 162910 - RNA, 24 nt, Human
aggccgggggcggaggagagggga

SEQ ID NO: 162911 - RNA, 25 nt, Human
aggggagggaagagagaacggcggu

SEQ ID NO: 162912 - RNA, 19 nt, Human
aggggaggggagaggaggg

SEQ ID NO: 162913 - RNA, 25 nt, Human
caaaaaaacacaaaaaacugaguau

SEQ ID NO: 162914 - RNA, 24 nt, Human
caagcccccagcccgggcccgcgc

SEQ ID NO: 162915 - RNA, 20 nt, Human
caccguccuccccagcuuca

SEQ ID NO: 162916 - RNA, 20 nt, Human
cagcagccguggcagcggug

SEQ ID NO: 162917 - RNA, 23 nt, Human
cagcccgggcccgcgccagcagc

SEQ ID NO: 162918 - RNA, 19 nt, Human
cagcuccuggggcggaggc

SEQ ID NO: 162919 - RNA, 19 nt, Human
caggagaggucuaguugca

SEQ ID NO: 162920 - RNA, 27 nt, Human
ccaggcaucgccggccccggccccggc

SEQ ID NO: 162921 - RNA, 18 nt, Human
cccaagacccagcauucg

SEQ ID NO: 162922 - RNA, 19 nt, Human
cccaagacccagcauucgg

SEQ ID NO: 162923 - RNA, 22 nt, Human
cccagcccgggcccgcgccagc

SEQ ID NO: 162924 - RNA, 23 nt, Human
ccccaaucagacaugggcaacua

SEQ ID NO: 162925 - RNA, 20 nt, Human
ccccagcccgggcccgcgcc

SEQ ID NO: 162926 - RNA, 19 nt, Human
ccccagcuucagccugggu

SEQ ID NO: 162927 - RNA, 20 nt, Human
ccgcagccgaggccgggggc

SEQ ID NO: 162928 - RNA, 23 nt, Human
ccgcuggggagcgcugucuaugc

SEQ ID NO: 162929 - RNA, 19 nt, Human
ccucccgccgcagccgagg

SEQ ID NO: 162930 - RNA, 20 nt, Human
ccucccuggggacagggauu

SEQ ID NO: 162931 - RNA, 22 nt, Human
ccuguccugcccgcuggcccug

SEQ ID NO: 162932 - RNA, 24 nt, Human
cgccagcagccguggcagcggugg

SEQ ID NO: 162933 - RNA, 18 nt, Human
cgcccggcggagcagcgg

SEQ ID NO: 162934 - RNA, 26 nt, Human
cgccggccccggccccggccccgcgc

SEQ ID NO: 162935 - RNA, 24 nt, Human
cggcugcgguugggcgaggguuuc

SEQ ID NO: 162936 - RNA, 23 nt, Human
cgggcggaggaggcccggcgccc

SEQ ID NO: 162937 - RNA, 19 nt, Human
cggggccgggggccgcugg

SEQ ID NO: 162938 - RNA, 24 nt, Human
cguguccugcgcuugggcugcggg

SEQ ID NO: 162939 - RNA, 23 nt, Human
cuccaccguccuccccagcuuca

SEQ ID NO: 162940 - RNA, 18 nt, Human
cuccuggcugguugggaa

SEQ ID NO: 162941 - RNA, 21 nt, Human
cuggcugaggaggcagggcug

SEQ ID NO: 162942 - RNA, 19 nt, Human
cugggagggaaggggcuag

SEQ ID NO: 162943 - RNA, 25 nt, Human
cuggggcggaggcgcgggcggaggg

SEQ ID NO: 162944 - RNA, 20 nt, Human
cuuaaaaaaaaaaaaacaca

SEQ ID NO: 162945 - RNA, 25 nt, Human
cuuggcuccagcuccuggggcggag

SEQ ID NO: 162946 - RNA, 20 nt, Human
gaagagagaacggcgguggc

SEQ ID NO: 162947 - RNA, 20 nt, Human
gagaggcaggagaggucuag

SEQ ID NO: 162948 - RNA, 19 nt, Human
gagcuccccgcuuggcucc

SEQ ID NO: 162949 - RNA, 20 nt, Human
gaggggagggaagagagaac

SEQ ID NO: 162950 - RNA, 22 nt, Human
gaugcuccagccgcgggggcag

SEQ ID NO: 162951 - RNA, 20 nt, Human
gcagcagcagccgcggccac

SEQ ID NO: 162952 - RNA, 20 nt, Human
gcaggaucugugguagggua

SEQ ID NO: 162953 - RNA, 21 nt, Human
gccggccccggccccggcccc

SEQ ID NO: 162954 - RNA, 21 nt, Human
gccgggggcggaggagagggg

SEQ ID NO: 162955 - RNA, 19 nt, Human
gccuuggggccggguagag

SEQ ID NO: 162956 - RNA, 23 nt, Human
gcgcggggagugggcucgcgggg

SEQ ID NO: 162957 - RNA, 22 nt, Human
gcgcggggcccgagcuccccgc

SEQ ID NO: 162958 - RNA, 20 nt, Human
gcuccagccgcgggggcagg

SEQ ID NO: 162959 - RNA, 19 nt, Human
ggagaggggaggggagagg

SEQ ID NO: 162960 - RNA, 20 nt, Human
ggagaggggaggggagagga

SEQ ID NO: 162961 - RNA, 24 nt, Human
ggagaggggaggggagaggagggg

SEQ ID NO: 162962 - RNA, 22 nt, Human
ggagcgcugucuaugcggcugc

SEQ ID NO: 162963 - RNA, 24 nt, Human
ggaggcagggcugggucggggccc

SEQ ID NO: 162964 - RNA, 22 nt, Human
ggcaguagcagcagcagcagcc

SEQ ID NO: 162965 - RNA, 24 nt, Human
ggcccggcgcccggcggagcagcg

SEQ ID NO: 162966 - RNA, 24 nt, Human
ggccugggcgcggggcccgagcuc

SEQ ID NO: 162967 - RNA, 20 nt, Human
ggcgcgggcggaggaggccc

SEQ ID NO: 162968 - RNA, 21 nt, Human
gggccgggcuccaccguccuc

SEQ ID NO: 162969 - RNA, 21 nt, Human
gggccgggggccgcuggggag

SEQ ID NO: 162970 - RNA, 22 nt, Human
gggcggaggcgcgggcggagga

SEQ ID NO: 162971 - RNA, 23 nt, Human
gggcugggucggggccccagggu

SEQ ID NO: 162972 - RNA, 23 nt, Human
ggggaggggagaggaggggaggg

SEQ ID NO: 162973 - RNA, 24 nt, Human
ggggaggggagaggaggggaggga

SEQ ID NO: 162974 - RNA, 24 nt, Human
ggggaggggagaggaggggagggg

SEQ ID NO: 162975 - RNA, 21 nt, Human
ggggagugggcucgcggggcc

SEQ ID NO: 162976 - RNA, 23 nt, Human
gguauugagggaugagggagaaa

SEQ ID NO: 162977 - RNA, 22 nt, Human
guagcagcagcagcagccgcgg

SEQ ID NO: 162978 - RNA, 19 nt, Human
gucggauccaagugcgggg

SEQ ID NO: 162979 - RNA, 24 nt, Human
gugaaaagaugaauuaaaaaaccc

SEQ ID NO: 162980 - RNA, 25 nt, Human
uaaaaagcccacguuuuugugaaaa

SEQ ID NO: 162981 - RNA, 24 nt, Human
uaaagccugaaauaaacuguauuu

SEQ ID NO: 162982 - RNA, 18 nt, Human
uagcagcagcagcagccg

SEQ ID NO: 162983 - RNA, 19 nt, Human
uccaggucuccuaccucug

SEQ ID NO: 162984 - RNA, 21 nt, Human
ucccacccucccuggggacag

SEQ ID NO: 162985 - RNA, 18 nt, Human
uccccagcuucagccugg

SEQ ID NO: 162986 - RNA, 23 nt, Human
uccccagcuucagccugggucuc

SEQ ID NO: 162987 - RNA, 22 nt, Human
uccuccccagcuucagccuggg

SEQ ID NO: 162988 - RNA, 22 nt, Human
ucgccuucagccaguaguccca

SEQ ID NO: 162989 - RNA, 21 nt, Human
ucggauccaagugcggggucu

SEQ ID NO: 162990 - RNA, 24 nt, Human
ucuuaaaaaaaaaaaaacacacaa

SEQ ID NO: 162991 - RNA, 23 nt, Human
ugaaauaaacuguauuuuucuua

SEQ ID NO: 162992 - RNA, 18 nt, Human
ugagcugggagggaaggg

SEQ ID NO: 162993 - RNA, 23 nt, Human
ugagcugggagggaaggggcuag

SEQ ID NO: 162994 - RNA, 21 nt, Human
uggcaacggcucccacccucc

SEQ ID NO: 162995 - RNA, 18 nt, Human
uggcugaggaggcagggc

SEQ ID NO: 162996 - RNA, 20 nt, Human
uggcugaggaggcagggcug

SEQ ID NO: 162997 - RNA, 22 nt, Human
uggcugaggaggcagggcuggg

SEQ ID NO: 162998 - RNA, 19 nt, Human
ugggaagcguucuuccucc

SEQ ID NO: 162999 - RNA, 21 nt, Human
ugggaagcguucuuccucccg

SEQ ID NO: 163000 - RNA, 19 nt, Human
ugggagggaaggggcuaga

SEQ ID NO: 163001 - RNA, 24 nt, Human
uggggccggguagagcuguagcca

SEQ ID NO: 163002 - RNA, 22 nt, Human
uggggugggggcucccaguuug

SEQ ID NO: 163003 - RNA, 26 nt, Human
uggggugggggcucccaguuuguccc

SEQ ID NO: 163004 - RNA, 23 nt, Human
uguccugcgcuugggcugcgggg

SEQ ID NO: 163005 - RNA, 18 nt, Human
aaaaggcucugcaaagaa

SEQ ID NO: 163006 - RNA, 18 nt, Human
aaaaggcucugcaaagaa

SEQ ID NO: 163007 - RNA, 20 nt, Human
aaacauacagucucacagua

SEQ ID NO: 163008 - RNA, 20 nt, Human
aaacauacagucucacagua

SEQ ID NO: 163009 - RNA, 26 nt, Human
aaacuucucuggaguggucaacaccc

SEQ ID NO: 163010 - RNA, 26 nt, Human
aaacuucucuggaguggucaacaccc

SEQ ID NO: 163011 - RNA, 22 nt, Human
aaccacuucuagugcucuccac

SEQ ID NO: 163012 - RNA, 22 nt, Human
aaccacuucuagugcucuccac

SEQ ID NO: 163013 - RNA, 22 nt, Human
aacugcagaaacucugccccca

SEQ ID NO: 163014 - RNA, 22 nt, Human
aacugcagaaacucugccccca

SEQ ID NO: 163015 - RNA, 25 nt, Human
aaugguucuccuccagccuuuccag

SEQ ID NO: 163016 - RNA, 19 nt, Human
acaaauucaggcucugugg

SEQ ID NO: 163017 - RNA, 19 nt, Human
acaaauucaggcucugugg

SEQ ID NO: 163018 - RNA, 20 nt, Human
accccaaagccucugcuuac

SEQ ID NO: 163019 - RNA, 20 nt, Human
accccaaagccucugcuuac

SEQ ID NO: 163020 - RNA, 19 nt, Human
acucaguccccagauccac

SEQ ID NO: 163021 - RNA, 19 nt, Human
acucaguccccagauccac

SEQ ID NO: 163022 - RNA, 19 nt, Human
agagacuggcagggggaga

SEQ ID NO: 163023 - RNA, 20 nt, Human
agagggaaauagugugcagu

SEQ ID NO: 163024 - RNA, 20 nt, Human
agagggaaauagugugcagu

SEQ ID NO: 163025 - RNA, 23 nt, Human
aggcauaacuauugucagugcug

SEQ ID NO: 163026 - RNA, 23 nt, Human
aggcauaacuauugucagugcug

SEQ ID NO: 163027 - RNA, 21 nt, Human
auacaaguaaugguaauacaa

SEQ ID NO: 163028 - RNA, 21 nt, Human
auacaaguaaugguaauacaa

SEQ ID NO: 163029 - RNA, 18 nt, Human
auggaacugcagaaacuc

SEQ ID NO: 163030 - RNA, 18 nt, Human
auggaacugcagaaacuc

SEQ ID NO: 163031 - RNA, 20 nt, Human
auggaacugcagaaacucug

SEQ ID NO: 163032 - RNA, 20 nt, Human
auggaacugcagaaacucug

SEQ ID NO: 163033 - RNA, 22 nt, Human
auggaacugcagaaacucugcc

SEQ ID NO: 163034 - RNA, 22 nt, Human
auggaacugcagaaacucugcc

SEQ ID NO: 163035 - RNA, 19 nt, Human
auggagggacucagccugc

SEQ ID NO: 163036 - RNA, 22 nt, Human
caaaagggagccaugccagaug

SEQ ID NO: 163037 - RNA, 22 nt, Human
caaaagggagccaugccagaug

SEQ ID NO: 163038 - RNA, 22 nt, Human
caccugaagucacccagggcuc

SEQ ID NO: 163039 - RNA, 22 nt, Human
caccugaagucacccagggcuc

SEQ ID NO: 163040 - RNA, 26 nt, Human
cagaaacucugcccccaacccacuga

SEQ ID NO: 163041 - RNA, 26 nt, Human
cagaaacucugcccccaacccacuga

SEQ ID NO: 163042 - RNA, 18 nt, Human
cagcaccugcaccugggg

SEQ ID NO: 163043 - RNA, 20 nt, Human
cagcagcugcugcuuguggc

SEQ ID NO: 163044 - RNA, 20 nt, Human
cagcagcugcugcuuguggc

SEQ ID NO: 163045 - RNA, 19 nt, Human
caggggaagcagaauccac

SEQ ID NO: 163046 - RNA, 22 nt, Human
caggggccaagcacaaugugug

SEQ ID NO: 163047 - RNA, 22 nt, Human
caggggccaagcacaaugugug

SEQ ID NO: 163048 - RNA, 23 nt, Human
cauacagucucacaguaaauuuc

SEQ ID NO: 163049 - RNA, 23 nt, Human
cauacagucucacaguaaauuuc

SEQ ID NO: 163050 - RNA, 24 nt, Human
caugaggugugcauuuuuaagggu

SEQ ID NO: 163051 - RNA, 24 nt, Human
caugaggugugcauuuuuaagggu

SEQ ID NO: 163052 - RNA, 21 nt, Human
cauggagggacucagccugca

SEQ ID NO: 163053 - RNA, 21 nt, Human
cauggagggacucagccugca

SEQ ID NO: 163054 - RNA, 26 nt, Human
ccaaacccagacccagacuggcccuc

SEQ ID NO: 163055 - RNA, 26 nt, Human
ccaaacccagacccagacuggcccuc

SEQ ID NO: 163056 - RNA, 21 nt, Human
ccaccugaagucacccagggc

SEQ ID NO: 163057 - RNA, 21 nt, Human
ccaccugaagucacccagggc

SEQ ID NO: 163058 - RNA, 19 nt, Human
ccagggcucucugcugcug

SEQ ID NO: 163059 - RNA, 19 nt, Human
ccagggcucucugcugcug

SEQ ID NO: 163060 - RNA, 22 nt, Human
ccccaaagccucugcuuaccag

SEQ ID NO: 163061 - RNA, 22 nt, Human
ccccaaagccucugcuuaccag

SEQ ID NO: 163062 - RNA, 18 nt, Human
ccccagaugaucugcaag

SEQ ID NO: 163063 - RNA, 18 nt, Human
ccccagaugaucugcaag

SEQ ID NO: 163064 - RNA, 19 nt, Human
cccccaacccacugaauca

SEQ ID NO: 163065 - RNA, 19 nt, Human
cccccaacccacugaauca

SEQ ID NO: 163066 - RNA, 25 nt, Human
cccucuguucuaaacugugcagggg

SEQ ID NO: 163067 - RNA, 22 nt, Human
cccuuucuuucucugcacuccc

SEQ ID NO: 163068 - RNA, 22 nt, Human
cccuuucuuucucugcacuccc

SEQ ID NO: 163069 - RNA, 23 nt, Human
ccuccagccuuuccaggaacaaa

SEQ ID NO: 163070 - RNA, 18 nt, Human
ccucuguucuaaacugug

SEQ ID NO: 163071 - RNA, 18 nt, Human
ccucuguucuaaacugug

SEQ ID NO: 163072 - RNA, 21 nt, Human
ccucuguucuaaacugugcag

SEQ ID NO: 163073 - RNA, 23 nt, Human
ccucuguucuaaacugugcaggg

SEQ ID NO: 163074 - RNA, 24 nt, Human
ccucuguucuaaacugugcagggg

SEQ ID NO: 163075 - RNA, 21 nt, Human
ccugggaaaagcuguugguaa

SEQ ID NO: 163076 - RNA, 19 nt, Human
cucaugaggugugcauuuu

SEQ ID NO: 163077 - RNA, 19 nt, Human
cucaugaggugugcauuuu

SEQ ID NO: 163078 - RNA, 22 nt, Human
cuuacaaauucaggcucugugg

SEQ ID NO: 163079 - RNA, 23 nt, Human
cuuucuggccauagugaguccga

SEQ ID NO: 163080 - RNA, 19 nt, Human
cuuucuuuuuccuucuccu

SEQ ID NO: 163081 - RNA, 20 nt, Human
cuuucuuuuuccuucuccuu

SEQ ID NO: 163082 - RNA, 25 nt, Human
gaaucagaaucuccauucaaaccag

SEQ ID NO: 163083 - RNA, 25 nt, Human
gaaucagaaucuccauucaaaccag

SEQ ID NO: 163084 - RNA, 22 nt, Human
gcagggcacaggaaggacaaaa

SEQ ID NO: 163085 - RNA, 22 nt, Human
gcagggcacaggaaggacaaaa

SEQ ID NO: 163086 - RNA, 18 nt, Human
ggaaaacaaaaaucucau

SEQ ID NO: 163087 - RNA, 24 nt, Human
ggaagcagaauccacuuggugucu

SEQ ID NO: 163088 - RNA, 23 nt, Human
ggagaaacaagauugcuuucugg

SEQ ID NO: 163089 - RNA, 18 nt, Human
ggagggacucagccugca

SEQ ID NO: 163090 - RNA, 19 nt, Human
ggagggacucagccugcaa

SEQ ID NO: 163091 - RNA, 19 nt, Human
ggagggacucagccugcaa

SEQ ID NO: 163092 - RNA, 22 nt, Human
ggcacaggaaggacaaaaggga

SEQ ID NO: 163093 - RNA, 22 nt, Human
ggcacaggaaggacaaaaggga

SEQ ID NO: 163094 - RNA, 24 nt, Human
gguuuaacauuuuugaaguauguu

SEQ ID NO: 163095 - RNA, 20 nt, Human
gucagugcugccugaaugcu

SEQ ID NO: 163096 - RNA, 20 nt, Human
gucagugcugccugaaugcu

SEQ ID NO: 163097 - RNA, 19 nt, Human
gugcauuuuuaaggguuag

SEQ ID NO: 163098 - RNA, 20 nt, Human
gugcauuuuuaaggguuagu

SEQ ID NO: 163099 - RNA, 20 nt, Human
gugcauuuuuaaggguuagu

SEQ ID NO: 163100 - RNA, 22 nt, Human
uaaaugccucuguucugaaggg

SEQ ID NO: 163101 - RNA, 22 nt, Human
uaaaugccucuguucugaaggg

SEQ ID NO: 163102 - RNA, 21 nt, Human
uaccaggggccaagcacaaug

SEQ ID NO: 163103 - RNA, 21 nt, Human
uaccaggggccaagcacaaug

SEQ ID NO: 163104 - RNA, 20 nt, Human
ucaaguuuaagcaggaagug

SEQ ID NO: 163105 - RNA, 20 nt, Human
ucaaguuuaagcaggaagug

SEQ ID NO: 163106 - RNA, 19 nt, Human
ucagcaccugcaccugggg

SEQ ID NO: 163107 - RNA, 19 nt, Human
ucagcaccugcaccugggg

SEQ ID NO: 163108 - RNA, 21 nt, Human
ucagcagcugcugcuuguggc

SEQ ID NO: 163109 - RNA, 24 nt, Human
ucaguaucauauguuagagaugaa

SEQ ID NO: 163110 - RNA, 24 nt, Human
ucaguaucauauguuagagaugaa

SEQ ID NO: 163111 - RNA, 22 nt, Human
uccaaacccagacccagacugg

SEQ ID NO: 163112 - RNA, 22 nt, Human
uccaaacccagacccagacugg

SEQ ID NO: 163113 - RNA, 23 nt, Human
ucccaaggauuuauucugccuuc

SEQ ID NO: 163114 - RNA, 23 nt, Human
ucccaaggauuuauucugccuuc

SEQ ID NO: 163115 - RNA, 18 nt, Human
ucccacuuagccgacccc

SEQ ID NO: 163116 - RNA, 18 nt, Human
ucccacuuagccgacccc

SEQ ID NO: 163117 - RNA, 22 nt, Human
uccccagauccacaugaauuuc

SEQ ID NO: 163118 - RNA, 22 nt, Human
uccccagauccacaugaauuuc

SEQ ID NO: 163119 - RNA, 18 nt, Human
uccuaaccuggcaugaag

SEQ ID NO: 163120 - RNA, 18 nt, Human
uccuaaccuggcaugaag

SEQ ID NO: 163121 - RNA, 24 nt, Human
uccugggaaaagcuguugguaagg

SEQ ID NO: 163122 - RNA, 21 nt, Human
uccuucuaaguuacccaccaa

SEQ ID NO: 163123 - RNA, 21 nt, Human
uccuucuaaguuacccaccaa

SEQ ID NO: 163124 - RNA, 26 nt, Human
ucgcucagugcugucccaggggaagg

SEQ ID NO: 163125 - RNA, 19 nt, Human
ucucagaguagcccggcuc

SEQ ID NO: 163126 - RNA, 24 nt, Human
ucucugcacucccacacucagucc

SEQ ID NO: 163127 - RNA, 24 nt, Human
ucucugcacucccacacucagucc

SEQ ID NO: 163128 - RNA, 20 nt, Human
ucugccuuccugcggcuggg

SEQ ID NO: 163129 - RNA, 20 nt, Human
ucugccuuccugcggcuggg

SEQ ID NO: 163130 - RNA, 23 nt, Human
ucugccuuccugcggcugggccu

SEQ ID NO: 163131 - RNA, 23 nt, Human
ucugccuuccugcggcugggccu

SEQ ID NO: 163132 - RNA, 18 nt, Human
ucuucucugcaugcuucu

SEQ ID NO: 163133 - RNA, 19 nt, Human
ucuuuuuccuucuccuucu

SEQ ID NO: 163134 - RNA, 19 nt, Human
ucuuuuuccuucuccuucu

SEQ ID NO: 163135 - RNA, 19 nt, Human
ugaaucagaaucuccauuc

SEQ ID NO: 163136 - RNA, 19 nt, Human
ugaaucagaaucuccauuc

SEQ ID NO: 163137 - RNA, 19 nt, Human
ugaggucaggugagguucg

SEQ ID NO: 163138 - RNA, 19 nt, Human
ugaggucaggugagguucg

SEQ ID NO: 163139 - RNA, 20 nt, Human
ugaggucaggugagguucgg

SEQ ID NO: 163140 - RNA, 20 nt, Human
ugaggucaggugagguucgg

SEQ ID NO: 163141 - RNA, 19 nt, Human
ugcaagaggcaauuggaga

SEQ ID NO: 163142 - RNA, 19 nt, Human
ugcaagaggcaauuggaga

SEQ ID NO: 163143 - RNA, 19 nt, Human
uggaaaacaaaaaucucau

SEQ ID NO: 163144 - RNA, 19 nt, Human
uggaaaacaaaaaucucau

SEQ ID NO: 163145 - RNA, 21 nt, Human
uggagauccaaacccagaccc

SEQ ID NO: 163146 - RNA, 21 nt, Human
uggagauccaaacccagaccc

SEQ ID NO: 163147 - RNA, 19 nt, Human
uggagggacucagccugca

SEQ ID NO: 163148 - RNA, 19 nt, Human
uggagggacucagccugca

SEQ ID NO: 163149 - RNA, 23 nt, Human
uggagggacucagccugcaagag

SEQ ID NO: 163150 - RNA, 23 nt, Human
uggagggacucagccugcaagag

SEQ ID NO: 163151 - RNA, 18 nt, Human
ugggaaaagcuguuggua

SEQ ID NO: 163152 - RNA, 18 nt, Human
ugggaaaagcuguuggua

SEQ ID NO: 163153 - RNA, 18 nt, Human
ugggaaaagcuguuggua

SEQ ID NO: 163154 - RNA, 18 nt, Human
ugggaaaagcuguuggua

SEQ ID NO: 163155 - RNA, 19 nt, Human
ugggaaaagcuguugguaa

SEQ ID NO: 163156 - RNA, 20 nt, Human
ugggaaaagcuguugguaag

SEQ ID NO: 163157 - RNA, 20 nt, Human
ugggaaaagcuguugguaag

SEQ ID NO: 163158 - RNA, 21 nt, Human
ugggaaggucaaggcguggua

SEQ ID NO: 163159 - RNA, 21 nt, Human
ugggaaggucaaggcguggua

SEQ ID NO: 163160 - RNA, 22 nt, Human
ugggcuaggaccccaaagccuc

SEQ ID NO: 163161 - RNA, 22 nt, Human
ugggcuaggaccccaaagccuc

SEQ ID NO: 163162 - RNA, 20 nt, Human
ugucagugcugccugaaugc

SEQ ID NO: 163163 - RNA, 20 nt, Human
ugucagugcugccugaaugc

SEQ ID NO: 163164 - RNA, 20 nt, Human
ugugcagggguaaaaggcuc

SEQ ID NO: 163165 - RNA, 20 nt, Human
ugugcagggguaaaaggcuc

SEQ ID NO: 163166 - RNA, 23 nt, Human
uguuguaaugguucuccuccagg

SEQ ID NO: 163167 - RNA, 20 nt, Human
uuaaaggccuuuacauggca

SEQ ID NO: 163168 - RNA, 20 nt, Human
uuaaaggccuuuacauggca

SEQ ID NO: 163169 - RNA, 22 nt, Human
uuaacacucucaucaauuuuua

SEQ ID NO: 163170 - RNA, 22 nt, Human
uuaacacucucaucaauuuuua

SEQ ID NO: 163171 - RNA, 28 nt, Human
uuaacacucucaucaauuuuuauucaca

SEQ ID NO: 163172 - RNA, 28 nt, Human
uuaacacucucaucaauuuuuauucaca

SEQ ID NO: 163173 - RNA, 24 nt, Human
uuccauuuuaaaugccucuguucc

SEQ ID NO: 163174 - RNA, 24 nt, Human
uuccauuuuaaaugccucuguucc

SEQ ID NO: 163175 - RNA, 22 nt, Human
uuguaauagcacaguggaaaac

SEQ ID NO: 163176 - RNA, 22 nt, Human
uuguaauagcacaguggaaaac

SEQ ID NO: 163177 - RNA, 18 nt, Human
uuguaggccgagggcugu

SEQ ID NO: 163178 - RNA, 21 nt, Human
uuuaggaccaggacccugcuc

SEQ ID NO: 163179 - RNA, 21 nt, Human
uuuaggaccaggacccugcuc

SEQ ID NO: 163180 - RNA, 25 nt, Human
uuucccuuucuuucucugcacuccc

SEQ ID NO: 163181 - RNA, 21 nt, Human
uuuuuaaggguuaguugaggu

SEQ ID NO: 163182 - RNA, 21 nt, Human
uuuuuaaggguuaguugaggu

SEQ ID NO: 163183 - RNA, 22 nt, Human
uuuuuuuuuuuuaacacucuca

SEQ ID NO: 163184 - RNA, 22 nt, Human
uuuuuuuuuuuuaacacucuca

SEQ ID NO: 163185 - RNA, 23 nt, Human
aaaaaaaaaaaaaaaagaaagaa

SEQ ID NO: 163186 - RNA, 18 nt, Human
aaaaaaaaaaaaaaagaa

SEQ ID NO: 163187 - RNA, 23 nt, Human
aaaaaaaaaagaaagaaagaaga

SEQ ID NO: 163188 - RNA, 21 nt, Human
aaaaaaaagaaagaaagaaga

SEQ ID NO: 163189 - RNA, 21 nt, Human
aaacaaaugaauugcaaacug

SEQ ID NO: 163190 - RNA, 19 nt, Human
aaauaaaauacaaaaucaa

SEQ ID NO: 163191 - RNA, 19 nt, Human
aacaaauuagcuacuggcu

SEQ ID NO: 163192 - RNA, 18 nt, Human
aacaauacaugcuggaca

SEQ ID NO: 163193 - RNA, 19 nt, Human
aacuggacuuguaacagga

SEQ ID NO: 163194 - RNA, 22 nt, Human
aagaaagaaagaagaacuccgg

SEQ ID NO: 163195 - RNA, 23 nt, Human
aagaaagaaagaagaacuccgga

SEQ ID NO: 163196 - RNA, 21 nt, Human
aagaacuccggaaauaauauc

SEQ ID NO: 163197 - RNA, 19 nt, Human
aagaagaaauacagcuaga

SEQ ID NO: 163198 - RNA, 22 nt, Human
aagacaggguacaaagcuuucu

SEQ ID NO: 163199 - RNA, 21 nt, Human
aagcaaaaaaaucagaccaaa

SEQ ID NO: 163200 - RNA, 23 nt, Human
aauuacuaaaaaaaaaaaaaaaa

SEQ ID NO: 163201 - RNA, 19 nt, Human
acaaagcaaaaaaaucaga

SEQ ID NO: 163202 - RNA, 25 nt, Human
acaaagcaaaaaaaucagaccaaau

SEQ ID NO: 163203 - RNA, 22 nt, Human
acaaagcuuucuaaaacaugcu

SEQ ID NO: 163204 - RNA, 24 nt, Human
acaggaucauacauagagcaacaa

SEQ ID NO: 163205 - RNA, 24 nt, Human
acaggguacaaagcuuucuaaaac

SEQ ID NO: 163206 - RNA, 18 nt, Human
accuggugaaggauaugg

SEQ ID NO: 163207 - RNA, 19 nt, Human
agagggaagaaggggagag

SEQ ID NO: 163208 - RNA, 19 nt, Human
agccuucuacuaauaacaa

SEQ ID NO: 163209 - RNA, 20 nt, Human
aggaaauggguaaaugggaa

SEQ ID NO: 163210 - RNA, 24 nt, Human
agguuugaggugagggccuagagc

SEQ ID NO: 163211 - RNA, 18 nt, Human
aucuauuuauuccaaugc

SEQ ID NO: 163212 - RNA, 25 nt, Human
augguccacuauugaagaauaauga

SEQ ID NO: 163213 - RNA, 24 nt, Human
auuuauuuuuuccuuugcuuuuaa

SEQ ID NO: 163214 - RNA, 20 nt, Human
caaagcaaaaaaaucagacc

SEQ ID NO: 163215 - RNA, 24 nt, Human
cacaaagcaaaaaaaucagaccaa

SEQ ID NO: 163216 - RNA, 21 nt, Human
cacaccugagacauugcuuug

SEQ ID NO: 163217 - RNA, 19 nt, Human
caccuggacauggcacugg

SEQ ID NO: 163218 - RNA, 21 nt, Human
cauugcaacaagcaagcuuug

SEQ ID NO: 163219 - RNA, 20 nt, Human
cauugcuuuguggauacucu

SEQ ID NO: 163220 - RNA, 20 nt, Human
ccacaaagcaaaaaaaucag

SEQ ID NO: 163221 - RNA, 18 nt, Human
ccagggguauucuuuucc

SEQ ID NO: 163222 - RNA, 25 nt, Human
ccauauuauuucucuacacaccuug

SEQ ID NO: 163223 - RNA, 24 nt, Human
cccaaauaaaauacaaaaucaagc

SEQ ID NO: 163224 - RNA, 24 nt, Human
cggcaaccaauggcaagguuugag

SEQ ID NO: 163225 - RNA, 23 nt, Human
cuaaaaaaaaaaaaaaaagaaag

SEQ ID NO: 163226 - RNA, 22 nt, Human
cuaccacauugcaacaagcaag

SEQ ID NO: 163227 - RNA, 25 nt, Human
cuauguaugugccuucucuuacacu

SEQ ID NO: 163228 - RNA, 19 nt, Human
gaaauuccuucauuucauu

SEQ ID NO: 163229 - RNA, 18 nt, Human
gaaggaagggaaggggaa

SEQ ID NO: 163230 - RNA, 21 nt, Human
ggaaauguucaauuucauggg

SEQ ID NO: 163231 - RNA, 20 nt, Human
ggacaguagagauauaggag

SEQ ID NO: 163232 - RNA, 20 nt, Human
ggcaagguuugaggugaggg

SEQ ID NO: 163233 - RNA, 18 nt, Human
gggaaggaagggaagggg

SEQ ID NO: 163234 - RNA, 18 nt, Human
gggaugagagagggaaga

SEQ ID NO: 163235 - RNA, 23 nt, Human
gggccuagagcuucugcaaagug

SEQ ID NO: 163236 - RNA, 19 nt, Human
ggggaagggaugagagagg

SEQ ID NO: 163237 - RNA, 20 nt, Human
uaacaauacaguuuaguuua

SEQ ID NO: 163238 - RNA, 19 nt, Human
uaacagaaauaggauaccu

SEQ ID NO: 163239 - RNA, 24 nt, Human
uaacagaaauaggauaccugguga

SEQ ID NO: 163240 - RNA, 20 nt, Human
uacacugaguucuuuuuugc

SEQ ID NO: 163241 - RNA, 19 nt, Human
uaccacauugcaacaagca

SEQ ID NO: 163242 - RNA, 18 nt, Human
uagaaaauuuaaaugucu

SEQ ID NO: 163243 - RNA, 19 nt, Human
uagagcuucugcaaagugu

SEQ ID NO: 163244 - RNA, 18 nt, Human
uagauaacagaaauagga

SEQ ID NO: 163245 - RNA, 19 nt, Human
uagcugcuaauuccauauu

SEQ ID NO: 163246 - RNA, 22 nt, Human
ucauuaaggcuauucgaugcca

SEQ ID NO: 163247 - RNA, 21 nt, Human
uccacaaagcaaaaaaaucag

SEQ ID NO: 163248 - RNA, 24 nt, Human
uccacaaagcaaaaaaaucagacc

SEQ ID NO: 163249 - RNA, 25 nt, Human
ucuaggaaacaaaugaauugcaaac

SEQ ID NO: 163250 - RNA, 21 nt, Human
ucucaaagguguccacaaagc

SEQ ID NO: 163251 - RNA, 24 nt, Human
ucucuacacaccuugaacauuuag

SEQ ID NO: 163252 - RNA, 20 nt, Human
ucugcuaaccucuagauaac

SEQ ID NO: 163253 - RNA, 19 nt, Human
ucuguuuuguguuuuuuuu

SEQ ID NO: 163254 - RNA, 21 nt, Human
ugagggaaacuauauugaccu

SEQ ID NO: 163255 - RNA, 18 nt, Human
ugaugauaaaugguuccu

SEQ ID NO: 163256 - RNA, 21 nt, Human
ugccuacaugcauacaauuug

SEQ ID NO: 163257 - RNA, 21 nt, Human
ugcuaugucuucucauugaua

SEQ ID NO: 163258 - RNA, 21 nt, Human
uggaacaauacaugcuggaca

SEQ ID NO: 163259 - RNA, 21 nt, Human
uggaugucucuacaccacucc

SEQ ID NO: 163260 - RNA, 18 nt, Human
uggcaagguuugagguga

SEQ ID NO: 163261 - RNA, 23 nt, Human
uggcaagguuugaggugaggaaa

SEQ ID NO: 163262 - RNA, 20 nt, Human
uggcacuggcaaaagucacu

SEQ ID NO: 163263 - RNA, 25 nt, Human
ugggaaggaagggaaggggaaggga

SEQ ID NO: 163264 - RNA, 18 nt, Human
ugguucugguagugacag

SEQ ID NO: 163265 - RNA, 19 nt, Human
uguaacauuuauuucuucc

SEQ ID NO: 163266 - RNA, 18 nt, Human
ugugcuaaucuuugugca

SEQ ID NO: 163267 - RNA, 24 nt, Human
uguuuuuuuuucuuuaaauuugga

SEQ ID NO: 163268 - RNA, 18 nt, Human
uuauauuuuugccccagg

SEQ ID NO: 163269 - RNA, 24 nt, Human
uuccugccacaagacaggguacaa

SEQ ID NO: 163270 - RNA, 24 nt, Human
uugcguugacuaauuuccuaggac

SEQ ID NO: 163271 - RNA, 21 nt, Human
uuggaacaauacaugcuggac

SEQ ID NO: 163272 - RNA, 22 nt, Human
uuggaacaauacaugcuggaca

SEQ ID NO: 163273 - RNA, 21 nt, Human
uuggguggauuuacuggaagg

SEQ ID NO: 163274 - RNA, 22 nt, Human
uugguucugguagugacaggug

SEQ ID NO: 163275 - RNA, 26 nt, Human
uuucuuuccugccacaagacagggua

SEQ ID NO: 163276 - RNA, 21 nt, Human
uuugguuaaacaaauaucucu

SEQ ID NO: 163277 - RNA, 22 nt, Human
uuuugguuaaacaaauaucucu

SEQ ID NO: 163278 - RNA, 20 nt, Human
uuuuuuuuuuuuuuuuuugg

SEQ ID NO: 163279 - RNA, 18 nt, Human
aaaaaagaaagaaaaaca

SEQ ID NO: 163280 - RNA, 22 nt, Human
aaaaagucaauagaaccauuga

SEQ ID NO: 163281 - RNA, 21 nt, Human
aaagaaaaacaauuggucaaa

SEQ ID NO: 163282 - RNA, 23 nt, Human
aacaacacaaaagacaacaucac

SEQ ID NO: 163283 - RNA, 21 nt, Human
aacaauuaugaaugcacaaaa

SEQ ID NO: 163284 - RNA, 23 nt, Human
aagaaaacaacacaauucacaua

SEQ ID NO: 163285 - RNA, 24 nt, Human
aagaaaacaacacaauucacauaa

SEQ ID NO: 163286 - RNA, 18 nt, Human
aagaagccacaacaauag

SEQ ID NO: 163287 - RNA, 20 nt, Human
aagccaagaaaacaacacaa

SEQ ID NO: 163288 - RNA, 22 nt, Human
aagccaauucagauucaacccu

SEQ ID NO: 163289 - RNA, 20 nt, Human
aaguauaggugagaucauga

SEQ ID NO: 163290 - RNA, 22 nt, Human
aaguauaggugagaucaugaga

SEQ ID NO: 163291 - RNA, 18 nt, Human
aauuuuguuuuguuuugu

SEQ ID NO: 163292 - RNA, 26 nt, Human
acaaaagacaacaucacaguuccaca

SEQ ID NO: 163293 - RNA, 22 nt, Human
acaacacaaaagacaacaucac

SEQ ID NO: 163294 - RNA, 22 nt, Human
acacaauauucaugugccaaau

SEQ ID NO: 163295 - RNA, 19 nt, Human
accagaauaccacaaaucu

SEQ ID NO: 163296 - RNA, 23 nt, Human
acuugaccagaauaccacaaauc

SEQ ID NO: 163297 - RNA, 24 nt, Human
agaaaaacaauuggucaaaccaca

SEQ ID NO: 163298 - RNA, 19 nt, Human
aggaagacucauacauaua

SEQ ID NO: 163299 - RNA, 22 nt, Human
agguaagguucuguuacagagc

SEQ ID NO: 163300 - RNA, 21 nt, Human
aguucucuuuacugacugggg

SEQ ID NO: 163301 - RNA, 21 nt, Human
auacaacaacaaauauuaaac

SEQ ID NO: 163302 - RNA, 22 nt, Human
auggaaaccuagcuaagucuua

SEQ ID NO: 163303 - RNA, 23 nt, Human
auuguggucuuuuacauuuucuu

SEQ ID NO: 163304 - RNA, 21 nt, Human
caaaguacagcacaauaacuu

SEQ ID NO: 163305 - RNA, 22 nt, Human
caacacaaaagacaacaucaca

SEQ ID NO: 163306 - RNA, 25 nt, Human
caagaaaacaacacaauucacauaa

SEQ ID NO: 163307 - RNA, 18 nt, Human
caagaagccacaacaaua

SEQ ID NO: 163308 - RNA, 21 nt, Human
caagaagccacaacaauaguu

SEQ ID NO: 163309 - RNA, 19 nt, Human
caagccaagaaaacaacac

SEQ ID NO: 163310 - RNA, 21 nt, Human
caauaacuugaccagaauacc

SEQ ID NO: 163311 - RNA, 18 nt, Human
caauucagauucaacccu

SEQ ID NO: 163312 - RNA, 18 nt, Human
cacaggacagaaaacugc

SEQ ID NO: 163313 - RNA, 21 nt, Human
cagagcccuucuuuugcccuc

SEQ ID NO: 163314 - RNA, 22 nt, Human
caggacagaaaacugccuguac

SEQ ID NO: 163315 - RNA, 20 nt, Human
ccaagaacccaacuuucuuc

SEQ ID NO: 163316 - RNA, 22 nt, Human
ccagaauaccacaaaucuaaaa

SEQ ID NO: 163317 - RNA, 20 nt, Human
cccuucuuuugcccucacug

SEQ ID NO: 163318 - RNA, 26 nt, Human
cgcaaaaagucaauagaaccauugaa

SEQ ID NO: 163319 - RNA, 20 nt, Human
cuagcuaagucuuaaacacu

SEQ ID NO: 163320 - RNA, 18 nt, Human
cuaugccaaagaaaagag

SEQ ID NO: 163321 - RNA, 22 nt, Human
cuuaaacacuuuuccaguagca

SEQ ID NO: 163322 - RNA, 23 nt, Human
gaaguucucuuuacugacugggg

SEQ ID NO: 163323 - RNA, 21 nt, Human
gagguaagguucuguuacaga

SEQ ID NO: 163324 - RNA, 19 nt, Human
gcaacucuaugccaagaac

SEQ ID NO: 163325 - RNA, 20 nt, Human
gccuguacaugcuaugucca

SEQ ID NO: 163326 - RNA, 21 nt, Human
ggucuuuuacauuuucuuggu

SEQ ID NO: 163327 - RNA, 19 nt, Human
gugcugugaaauacuuuug

SEQ ID NO: 163328 - RNA, 22 nt, Human
uaacaauuccuuguacacaaua

SEQ ID NO: 163329 - RNA, 18 nt, Human
uaagaaggucuaauggca

SEQ ID NO: 163330 - RNA, 20 nt, Human
uacaacucaauuucuacgca

SEQ ID NO: 163331 - RNA, 19 nt, Human
uacacuugaggauaauuuu

SEQ ID NO: 163332 - RNA, 21 nt, Human
ucaagccaagaaaacaacaca

SEQ ID NO: 163333 - RNA, 23 nt, Human
ucagauucaacccugaauuuggu

SEQ ID NO: 163334 - RNA, 24 nt, Human
ucuaaaaaaaaaaaaagaaagaaa

SEQ ID NO: 163335 - RNA, 25 nt, Human
ucuacauuuggagcagaccgggguc

SEQ ID NO: 163336 - RNA, 18 nt, Human
ucucagauuuaguucacu

SEQ ID NO: 163337 - RNA, 26 nt, Human
ugaaauacuuuuggauuaucaucccc

SEQ ID NO: 163338 - RNA, 18 nt, Human
ugagggaaaaccagucuu

SEQ ID NO: 163339 - RNA, 22 nt, Human
ugcaacucuaugccaagaaccc

SEQ ID NO: 163340 - RNA, 18 nt, Human
uggcauucuuaugcacaa

SEQ ID NO: 163341 - RNA, 24 nt, Human
ugguugauuuggauuaagugacgc

SEQ ID NO: 163342 - RNA, 21 nt, Human
ugugaaucaagcguagauaga

SEQ ID NO: 163343 - RNA, 28 nt, Human
ugugcacaggacagaaaacugccuguac

SEQ ID NO: 163344 - RNA, 18 nt, Human
uguggucuuuuacauuuu

SEQ ID NO: 163345 - RNA, 24 nt, Human
uguggucuuuuacauuuucuuggu

SEQ ID NO: 163346 - RNA, 26 nt, Human
uguuuuguuuuguuuuguuuguuuuu

SEQ ID NO: 163347 - RNA, 22 nt, Human
uucacauaauuuuguuugcccc

SEQ ID NO: 163348 - RNA, 23 nt, Human
uucacuaaaaugcuuggcauucu

SEQ ID NO: 163349 - RNA, 21 nt, Human
uucagauucaacccugaauuu

SEQ ID NO: 163350 - RNA, 24 nt, Human
uuccaugcaacagauaugaagauc

SEQ ID NO: 163351 - RNA, 21 nt, Human
uuggagcagacacagagagag

SEQ ID NO: 163352 - RNA, 18 nt, Human
uuuguuuuguuuuguuug

SEQ ID NO: 163353 - RNA, 19 nt, Human
uuuguuuuguuuuguuuug

SEQ ID NO: 163354 - RNA, 18 nt, Human
uuuuguuuuguuuguuuu

SEQ ID NO: 163355 - RNA, 20 nt, Human
agcgccccgcgcggcuccuc

SEQ ID NO: 163356 - RNA, 31 nt, Human
caacaauaaaauccuuaucaccccucccccc

SEQ ID NO: 163357 - RNA, 18 nt, Human
cacugcuggccggccggc

SEQ ID NO: 163358 - RNA, 20 nt, Human
cagcgccccgcgcggcuccu

SEQ ID NO: 163359 - RNA, 26 nt, Human
cagcgccccgcgcggcuccucccgag

SEQ ID NO: 163360 - RNA, 18 nt, Human
cagucccuuugcgugagu

SEQ ID NO: 163361 - RNA, 18 nt, Human
cagucccuuugcgugagu

SEQ ID NO: 163362 - RNA, 23 nt, Human
caugucuccuccuccgcgucucu

SEQ ID NO: 163363 - RNA, 18 nt, Human
cccagccugcacaugucc

SEQ ID NO: 163364 - RNA, 18 nt, Human
ccccgcgcggcuccuccc

SEQ ID NO: 163365 - RNA, 22 nt, Human
ccccgcgcggcuccucccgagc

SEQ ID NO: 163366 - RNA, 19 nt, Human
cccuuugcgugagucuuuu

SEQ ID NO: 163367 - RNA, 19 nt, Human
cccuuugcgugagucuuuu

SEQ ID NO: 163368 - RNA, 18 nt, Human
ccgccgccgccgccgccg

SEQ ID NO: 163369 - RNA, 18 nt, Human
ccgccgccgccgccgccg

SEQ ID NO: 163370 - RNA, 22 nt, Human
ccgccgccgccgccgccgccgc

SEQ ID NO: 163371 - RNA, 24 nt, Human
ccgccgccgccgccgccgccgccg

SEQ ID NO: 163372 - RNA, 24 nt, Human
ccgccgccgccgccgccgccgccg

SEQ ID NO: 163373 - RNA, 23 nt, Human
ccgccgccgccgccgccgccgcu

SEQ ID NO: 163374 - RNA, 22 nt, Human
ccgccgccgccgccgccgcugc

SEQ ID NO: 163375 - RNA, 25 nt, Human
ccgccgccgccgccgccgcugcugc

SEQ ID NO: 163376 - RNA, 22 nt, Human
ccgccgccgccgccgcugcugc

SEQ ID NO: 163377 - RNA, 18 nt, Human
ccgccgcugcugcugcuc

SEQ ID NO: 163378 - RNA, 18 nt, Human
ccggcucaugucuccucc

SEQ ID NO: 163379 - RNA, 21 nt, Human
ccgugggaggcuggcugcccg

SEQ ID NO: 163380 - RNA, 24 nt, Human
ccuccgccgccgccgccgccgccg

SEQ ID NO: 163381 - RNA, 21 nt, Human
ccuccgggcuggcgcaggggc

SEQ ID NO: 163382 - RNA, 23 nt, Human
ccugcacauguccgcuccgcgcg

SEQ ID NO: 163383 - RNA, 21 nt, Human
ccuuaucaccccuccccccaa

SEQ ID NO: 163384 - RNA, 21 nt, Human
cgccuccgccgccgccgccgc

SEQ ID NO: 163385 - RNA, 19 nt, Human
cgcggccgggaccgggcgc

SEQ ID NO: 163386 - RNA, 22 nt, Human
cgcugcugcugcucccuccucg

SEQ ID NO: 163387 - RNA, 18 nt, Human
cggcuccuagcccagccu

SEQ ID NO: 163388 - RNA, 18 nt, Human
cgggagggaggcggcggc

SEQ ID NO: 163389 - RNA, 21 nt, Human
cuccgccgccgccgccgccgc

SEQ ID NO: 163390 - RNA, 22 nt, Human
cuccgcgcggccgggaccgggc

SEQ ID NO: 163391 - RNA, 24 nt, Human
cuccucgccggcugcugcugcugc

SEQ ID NO: 163392 - RNA, 22 nt, Human
cugcguggggccaggggucagc

SEQ ID NO: 163393 - RNA, 19 nt, Human
cugcucccuccucgccggc

SEQ ID NO: 163394 - RNA, 18 nt, Human
cugcugcucccuccucgc

SEQ ID NO: 163395 - RNA, 23 nt, Human
cugcugcucccuccucgccggcu

SEQ ID NO: 163396 - RNA, 24 nt, Human
cugcugcucccuccucgccgggac

SEQ ID NO: 163397 - RNA, 19 nt, Human
cugcugcugcucccuccuc

SEQ ID NO: 163398 - RNA, 18 nt, Human
cugugcaggaggcgccug

SEQ ID NO: 163399 - RNA, 23 nt, Human
cugugcaggaggcgccuggccgg

SEQ ID NO: 163400 - RNA, 20 nt, Human
cuuaucaccccuccccccaa

SEQ ID NO: 163401 - RNA, 20 nt, Human
gaccugaggggccgcggcgg

SEQ ID NO: 163402 - RNA, 18 nt, Human
gccgggaccgggcgccuc

SEQ ID NO: 163403 - RNA, 18 nt, Human
gcggccgggaccgggcgc

SEQ ID NO: 163404 - RNA, 18 nt, Human
gcggggcggcagccgcug

SEQ ID NO: 163405 - RNA, 20 nt, Human
gcugcguggggccagggguc

SEQ ID NO: 163406 - RNA, 21 nt, Human
ggccagggcgaccugagggcc

SEQ ID NO: 163407 - RNA, 19 nt, Human
gggcgcccgccggcucaug

SEQ ID NO: 163408 - RNA, 21 nt, Human
gggcugcggggcggcagccgc

SEQ ID NO: 163409 - RNA, 21 nt, Human
guuuuuuuuuuuuuuuccuuu

SEQ ID NO: 163410 - RNA, 24 nt, Human
uacaaaaauagagcuucuuccuua

SEQ ID NO: 163411 - RNA, 18 nt, Human
uagcccagccugcacaug

SEQ ID NO: 163412 - RNA, 20 nt, Human
uaucaccccuccccccaaga

SEQ ID NO: 163413 - RNA, 20 nt, Human
ucaccccuccccccaagagu

SEQ ID NO: 163414 - RNA, 24 nt, Human
ucagcgccccgcgcggcuccuccc

SEQ ID NO: 163415 - RNA, 24 nt, Human
ucaugucuccuccuccgcgucucu

SEQ ID NO: 163416 - RNA, 25 nt, Human
ucaugucuccuccuccgcgucucuc

SEQ ID NO: 163417 - RNA, 19 nt, Human
uccgccgccgccgccgccg

SEQ ID NO: 163418 - RNA, 18 nt, Human
uccggcccgggcgcggag

SEQ ID NO: 163419 - RNA, 26 nt, Human
uccuagcccagccugcacauguccgc

SEQ ID NO: 163420 - RNA, 22 nt, Human
uccuccgcgucucuccggccgu

SEQ ID NO: 163421 - RNA, 20 nt, Human
ugcggggcggcagccgcugu

SEQ ID NO: 163422 - RNA, 24 nt, Human
ugcugcugcugcagacucugcugc

SEQ ID NO: 163423 - RNA, 21 nt, Human
uggcgcaggggcugcggggcg

SEQ ID NO: 163424 - RNA, 22 nt, Human
uuucugggagugugaguguggc

SEQ ID NO: 163425 - RNA, 22 nt, Human
uuucugggagugugaguguggc

SEQ ID NO: 163426 - RNA, 21 nt, Human
uuuguuuuuuuuuuuuuuucc

SEQ ID NO: 163427 - RNA, 24 nt, Human
uuuguuuuuuuuuuuuuuuccuuu

SEQ ID NO: 163428 - RNA, 24 nt, Human
uuuguuuuuuuuuuuuuuuccuuu

SEQ ID NO: 163429 - RNA, 27 nt, Human
uuuuuuuuuguuuuuuuuuuuuuuucc

SEQ ID NO: 163430 - RNA, 22 nt, Human
uuuuuuuuuuuuuuuuguuuuu

SEQ ID NO: 163431 - RNA, 22 nt, Human
uuuuuuuuuuuuuuuuguuuuu

SEQ ID NO: 163432 - RNA, 25 nt, Human
aaaaaagaagaaacgagggagaaag

SEQ ID NO: 163433 - RNA, 19 nt, Human
aaaaaauauauucucaacc

SEQ ID NO: 163434 - RNA, 19 nt, Human
aaaaagagcugaccccaaa

SEQ ID NO: 163435 - RNA, 21 nt, Human
aaaaagcagccacaaaaauau

SEQ ID NO: 163436 - RNA, 18 nt, Human
aaaaauaaaaacaaaacc

SEQ ID NO: 163437 - RNA, 20 nt, Human
aaaaauguacagguagauaa

SEQ ID NO: 163438 - RNA, 24 nt, Human
aaaaauuucaauucaucuugaaau

SEQ ID NO: 163439 - RNA, 21 nt, Human
aaaagcuucuugaauuuacag

SEQ ID NO: 163440 - RNA, 24 nt, Human
aaaauagaaauaacaaauauaaac

SEQ ID NO: 163441 - RNA, 21 nt, Human
aaacaagaaaaauagaggcaa

SEQ ID NO: 163442 - RNA, 21 nt, Human
aaacagcauagaucaugagcu

SEQ ID NO: 163443 - RNA, 18 nt, Human
aaacaugcaauguacuuu

SEQ ID NO: 163444 - RNA, 24 nt, Human
aaagugcagggaauauaggcauga

SEQ ID NO: 163445 - RNA, 25 nt, Human
aaauaacaaauauaaacuccauuuc

SEQ ID NO: 163446 - RNA, 25 nt, Human
aacagaauaaagcacacuaucuuga

SEQ ID NO: 163447 - RNA, 20 nt, Human
aacccuaguuaacugggaaa

SEQ ID NO: 163448 - RNA, 21 nt, Human
aaccuuauaaaaugugaaaac

SEQ ID NO: 163449 - RNA, 22 nt, Human
aacgagggagaaaggauggaag

SEQ ID NO: 163450 - RNA, 22 nt, Human
aacucaacauaaaacaaaagau

SEQ ID NO: 163451 - RNA, 23 nt, Human
aagaaacaaaggaacugcagcca

SEQ ID NO: 163452 - RNA, 21 nt, Human
aagcaaaugcgugaaaaagau

SEQ ID NO: 163453 - RNA, 24 nt, Human
aagcgauccuccugcuuuggccuc

SEQ ID NO: 163454 - RNA, 27 nt, Human
aauauaaaagggagaauauacauuuua

SEQ ID NO: 163455 - RNA, 19 nt, Human
acagccuaauucucucaca

SEQ ID NO: 163456 - RNA, 19 nt, Human
accccaaaaauguacaggu

SEQ ID NO: 163457 - RNA, 18 nt, Human
acccccgacacccaccag

SEQ ID NO: 163458 - RNA, 19 nt, Human
acccccgacacccaccagc

SEQ ID NO: 163459 - RNA, 20 nt, Human
acccugaaagcagcuagaaa

SEQ ID NO: 163460 - RNA, 23 nt, Human
accucagccucccaaguaucuga

SEQ ID NO: 163461 - RNA, 20 nt, Human
acgggguuucaccagguugg

SEQ ID NO: 163462 - RNA, 21 nt, Human
acgggguuucaccagguuggu

SEQ ID NO: 163463 - RNA, 22 nt, Human
acuagagucagaggaaacacca

SEQ ID NO: 163464 - RNA, 25 nt, Human
acucuguugccuaggcuggacugca

SEQ ID NO: 163465 - RNA, 23 nt, Human
acugcaguggcacgauuauggcu

SEQ ID NO: 163466 - RNA, 19 nt, Human
acugguauaaaaucagaau

SEQ ID NO: 163467 - RNA, 26 nt, Human
acuuauauuuccugaagagaaaaggu

SEQ ID NO: 163468 - RNA, 19 nt, Human
acuuauuugcccauucaau

SEQ ID NO: 163469 - RNA, 22 nt, Human
acuuucuugcuuuauagcuaag

SEQ ID NO: 163470 - RNA, 23 nt, Human
agaaaaacacauuuccaagccaa

SEQ ID NO: 163471 - RNA, 18 nt, Human
agaaacagcauagaucau

SEQ ID NO: 163472 - RNA, 24 nt, Human
agaauguaucacguuaaccaaaca

SEQ ID NO: 163473 - RNA, 18 nt, Human
agacugguauaaaaucag

SEQ ID NO: 163474 - RNA, 21 nt, Human
agagacugguauaaaaucaga

SEQ ID NO: 163475 - RNA, 21 nt, Human
agcaagaaguuaaaaagagcu

SEQ ID NO: 163476 - RNA, 21 nt, Human
agcagucugcagguuugcaag

SEQ ID NO: 163477 - RNA, 21 nt, Human
agcugagccuuaucagagauc

SEQ ID NO: 163478 - RNA, 23 nt, Human
aggcagcuuuuuaaagggcuucu

SEQ ID NO: 163479 - RNA, 20 nt, Human
aggcagugcugauuuucagu

SEQ ID NO: 163480 - RNA, 20 nt, Human
aggcaugagccacugcaccc

SEQ ID NO: 163481 - RNA, 24 nt, Human
agggaauauaggcaugagccacug

SEQ ID NO: 163482 - RNA, 20 nt, Human
agucugaacauuucagaaau

SEQ ID NO: 163483 - RNA, 24 nt, Human
agugauuauauaauucuucacuuu

SEQ ID NO: 163484 - RNA, 25 nt, Human
auaaagcaaaugcgugaaaaagauc

SEQ ID NO: 163485 - RNA, 20 nt, Human
auauaaaagaugauuuugua

SEQ ID NO: 163486 - RNA, 24 nt, Human
aucaacccucccaccucagccucc

SEQ ID NO: 163487 - RNA, 23 nt, Human
auccugccacacaaauuugcauu

SEQ ID NO: 163488 - RNA, 19 nt, Human
aucuccacccccgacaccc

SEQ ID NO: 163489 - RNA, 18 nt, Human
augauacaguuucuaaaa

SEQ ID NO: 163490 - RNA, 19 nt, Human
auggcaauaaaaauccugc

SEQ ID NO: 163491 - RNA, 20 nt, Human
auguaauugaaaaauggcag

SEQ ID NO: 163492 - RNA, 23 nt, Human
auuuuuuguguuuuuuuguagag

SEQ ID NO: 163493 - RNA, 25 nt, Human
caaaaaaagaagaaacgagggagaa

SEQ ID NO: 163494 - RNA, 24 nt, Human
caaagugcagggaauauaggcaug

SEQ ID NO: 163495 - RNA, 18 nt, Human
caaauuucuaaaauauac

SEQ ID NO: 163496 - RNA, 18 nt, Human
caaccgcgggcagccguc

SEQ ID NO: 163497 - RNA, 26 nt, Human
caacucccaucaccagcagaguugcu

SEQ ID NO: 163498 - RNA, 23 nt, Human
caagaaacaaaggaacugcagcc

SEQ ID NO: 163499 - RNA, 22 nt, Human
caagcgauccuccugcuuuggc

SEQ ID NO: 163500 - RNA, 27 nt, Human
caagcgauccuccugcuuuggccuccc

SEQ ID NO: 163501 - RNA, 20 nt, Human
cacaacaacucaccuaccca

SEQ ID NO: 163502 - RNA, 20 nt, Human
cacagcacaugggaauugag

SEQ ID NO: 163503 - RNA, 23 nt, Human
cacccaccagccucccgcgcccc

SEQ ID NO: 163504 - RNA, 21 nt, Human
cacccccgacacccaccagcc

SEQ ID NO: 163505 - RNA, 22 nt, Human
cacccccgacacccaccagccu

SEQ ID NO: 163506 - RNA, 21 nt, Human
cacucuguugccuaggcugga

SEQ ID NO: 163507 - RNA, 22 nt, Human
cacugcaaccuugaccucucag

SEQ ID NO: 163508 - RNA, 21 nt, Human
cagaaauuaccucagagcuga

SEQ ID NO: 163509 - RNA, 19 nt, Human
cagaggaaacaccaggaaa

SEQ ID NO: 163510 - RNA, 20 nt, Human
cagcaaaaauaaaaacaaaa

SEQ ID NO: 163511 - RNA, 18 nt, Human
cagcacacaaauccugga

SEQ ID NO: 163512 - RNA, 21 nt, Human
cagccguccgcuaaucuggca

SEQ ID NO: 163513 - RNA, 21 nt, Human
cagccuaauucucucacacua

SEQ ID NO: 163514 - RNA, 21 nt, Human
cagccucaagugaucaacccu

SEQ ID NO: 163515 - RNA, 22 nt, Human
cagcuagaaaugaaaacugaca

SEQ ID NO: 163516 - RNA, 20 nt, Human
cagcucccccaaaaaaagag

SEQ ID NO: 163517 - RNA, 24 nt, Human
cagcuuuuuaaagggcuucuccua

SEQ ID NO: 163518 - RNA, 21 nt, Human
cauauagaaaauagaaugcaa

SEQ ID NO: 163519 - RNA, 22 nt, Human
caucacaaaauuagagaaagcc

SEQ ID NO: 163520 - RNA, 24 nt, Human
ccaaagugcagggaauauaggcau

SEQ ID NO: 163521 - RNA, 22 nt, Human
ccacaaggcaaagaauuuguau

SEQ ID NO: 163522 - RNA, 18 nt, Human
ccacugcacccggccuag

SEQ ID NO: 163523 - RNA, 19 nt, Human
ccacugcacccggccuaga

SEQ ID NO: 163524 - RNA, 20 nt, Human
ccacugcacccggccuagau

SEQ ID NO: 163525 - RNA, 24 nt, Human
ccagcucccccaaaaaaagaagaa

SEQ ID NO: 163526 - RNA, 18 nt, Human
ccccaaaaaaagaagaaa

SEQ ID NO: 163527 - RNA, 19 nt, Human
cccccaaaaaaagaagaaa

SEQ ID NO: 163528 - RNA, 23 nt, Human
cccccaguucuccucccuccugc

SEQ ID NO: 163529 - RNA, 20 nt, Human
cccccgacacccaccagccu

SEQ ID NO: 163530 - RNA, 28 nt, Human
cccccgacacccaccagccucccgcgcc

SEQ ID NO: 163531 - RNA, 21 nt, Human
ccccuggugcgcggcgagccc

SEQ ID NO: 163532 - RNA, 22 nt, Human
cccguugcaaccgcgggcagcc

SEQ ID NO: 163533 - RNA, 20 nt, Human
cccucccaccucagccuccc

SEQ ID NO: 163534 - RNA, 23 nt, Human
ccgccucccaagcugcagcgccc

SEQ ID NO: 163535 - RNA, 20 nt, Human
ccgccuggggagagccgccu

SEQ ID NO: 163536 - RNA, 20 nt, Human
ccgggccgcggcgucacauc

SEQ ID NO: 163537 - RNA, 19 nt, Human
ccuauguucuucaaaccua

SEQ ID NO: 163538 - RNA, 23 nt, Human
ccucccaccucagccucccaagu

SEQ ID NO: 163539 - RNA, 23 nt, Human
ccugcgcgccgcccccuacucgc

SEQ ID NO: 163540 - RNA, 20 nt, Human
ccugggcucaagcgauccuc

SEQ ID NO: 163541 - RNA, 23 nt, Human
ccugggcucaagcgauccuccug

SEQ ID NO: 163542 - RNA, 21 nt, Human
ccuuuugggaaaaagagcagc

SEQ ID NO: 163543 - RNA, 21 nt, Human
cgaauaaagcaaaugcgugaa

SEQ ID NO: 163544 - RNA, 21 nt, Human
cgccgggccgcggcgucacau

SEQ ID NO: 163545 - RNA, 21 nt, Human
cgccuaaagccauauucauuc

SEQ ID NO: 163546 - RNA, 21 nt, Human
cguccugaguauucggcaaca

SEQ ID NO: 163547 - RNA, 26 nt, Human
cguugcaaccgcgggcagccguccgc

SEQ ID NO: 163548 - RNA, 19 nt, Human
cuaaauaggauccccauaa

SEQ ID NO: 163549 - RNA, 21 nt, Human
cucacacuauccacuggugcc

SEQ ID NO: 163550 - RNA, 21 nt, Human
cucccaaguaucugagaccac

SEQ ID NO: 163551 - RNA, 23 nt, Human
cuccugggcucaagcgauccucc

SEQ ID NO: 163552 - RNA, 19 nt, Human
cucuuuuuuugagacaaag

SEQ ID NO: 163553 - RNA, 18 nt, Human
cugacaguagaggucuga

SEQ ID NO: 163554 - RNA, 22 nt, Human
gaaaaagcagccacaaaaauau

SEQ ID NO: 163555 - RNA, 18 nt, Human
gaaaacacaaacuaauca

SEQ ID NO: 163556 - RNA, 22 nt, Human
gaauauaggcaugagccacugc

SEQ ID NO: 163557 - RNA, 23 nt, Human
gaauauaggcaugagccacugca

SEQ ID NO: 163558 - RNA, 22 nt, Human
gaauugauuaaauucacauuua

SEQ ID NO: 163559 - RNA, 20 nt, Human
gagacgggguuucaccaggu

SEQ ID NO: 163560 - RNA, 24 nt, Human
gagacgggguuucaccagguuggu

SEQ ID NO: 163561 - RNA, 20 nt, Human
gcaaccuugaccucucagcc

SEQ ID NO: 163562 - RNA, 22 nt, Human
gcagccuuacccaaucuauauu

SEQ ID NO: 163563 - RNA, 20 nt, Human
gccuaggcuggacugcagug

SEQ ID NO: 163564 - RNA, 21 nt, Human
gcucacugcaaccuugaccuc

SEQ ID NO: 163565 - RNA, 23 nt, Human
ggaaaaaacaagagcauauccag

SEQ ID NO: 163566 - RNA, 22 nt, Human
ggaauauaggcaugagccacug

SEQ ID NO: 163567 - RNA, 24 nt, Human
ggcaacagcacacaaauccuggag

SEQ ID NO: 163568 - RNA, 18 nt, Human
ggcagugcugauuuucag

SEQ ID NO: 163569 - RNA, 21 nt, Human
ggcuuaaaaauguugaggaaa

SEQ ID NO: 163570 - RNA, 21 nt, Human
gggaauauaggcaugagccac

SEQ ID NO: 163571 - RNA, 19 nt, Human
gggcucaagcgauccuccu

SEQ ID NO: 163572 - RNA, 23 nt, Human
guagagacgggguuucaccaggu

SEQ ID NO: 163573 - RNA, 27 nt, Human
uaaaaaauauauucucaaccacuuuga

SEQ ID NO: 163574 - RNA, 20 nt, Human
uaaaaagagcugaccccaaa

SEQ ID NO: 163575 - RNA, 22 nt, Human
uaaaaagagcugaccccaaaaa

SEQ ID NO: 163576 - RNA, 25 nt, Human
uaaaaagagcugaccccaaaaaugu

SEQ ID NO: 163577 - RNA, 21 nt, Human
uaaaaauccugccacacaaau

SEQ ID NO: 163578 - RNA, 23 nt, Human
uaaaacagcaaauguuauuucag

SEQ ID NO: 163579 - RNA, 25 nt, Human
uaaagcaaaugcgugaaaaagauca

SEQ ID NO: 163580 - RNA, 20 nt, Human
uaaagcacacuaucuugauu

SEQ ID NO: 163581 - RNA, 21 nt, Human
uaaagcacacuaucuugauua

SEQ ID NO: 163582 - RNA, 25 nt, Human
uaagaagaaaaaaacugccguuggc

SEQ ID NO: 163583 - RNA, 21 nt, Human
uaccucagagcugauauaauu

SEQ ID NO: 163584 - RNA, 23 nt, Human
uaccuuuugggaaaaagagcagc

SEQ ID NO: 163585 - RNA, 23 nt, Human
uacuccagaauccuucuuaaagu

SEQ ID NO: 163586 - RNA, 19 nt, Human
uagaaaaagcagccacaaa

SEQ ID NO: 163587 - RNA, 23 nt, Human
uagaaaaagcagccacaaaaaua

SEQ ID NO: 163588 - RNA, 23 nt, Human
uagaaauaacaaauauaaacucc

SEQ ID NO: 163589 - RNA, 19 nt, Human
uagcagcauaauuucuaau

SEQ ID NO: 163590 - RNA, 18 nt, Human
uagcagcaucuguaagau

SEQ ID NO: 163591 - RNA, 20 nt, Human
uaguagaaauaauaucauua

SEQ ID NO: 163592 - RNA, 20 nt, Human
uaguggugugaaugcugaaa

SEQ ID NO: 163593 - RNA, 23 nt, Human
uauucauucaccauaaauuuuug

SEQ ID NO: 163594 - RNA, 19 nt, Human
uauugggcaaaaagcaguc

SEQ ID NO: 163595 - RNA, 18 nt, Human
ucacaaaauuagagaaag

SEQ ID NO: 163596 - RNA, 21 nt, Human
ucacaacaacucaccuaccca

SEQ ID NO: 163597 - RNA, 24 nt, Human
ucaccagguuggucuugaacuccu

SEQ ID NO: 163598 - RNA, 25 nt, Human
ucacuacccccauccggugcuucca

SEQ ID NO: 163599 - RNA, 19 nt, Human
ucacugcaaccuugaccuc

SEQ ID NO: 163600 - RNA, 23 nt, Human
ucacugcaaccuugaccucucag

SEQ ID NO: 163601 - RNA, 22 nt, Human
ucagagccugaagaagauauug

SEQ ID NO: 163602 - RNA, 20 nt, Human
ucaucugccgccuaaagcca

SEQ ID NO: 163603 - RNA, 18 nt, Human
uccacaaggcaaagaauu

SEQ ID NO: 163604 - RNA, 19 nt, Human
uccacccccgacacccacc

SEQ ID NO: 163605 - RNA, 20 nt, Human
uccacccccgacacccacca

SEQ ID NO: 163606 - RNA, 26 nt, Human
uccacccccgacacccaccagccucc

SEQ ID NO: 163607 - RNA, 22 nt, Human
uccaugaagaaauuuuguuucu

SEQ ID NO: 163608 - RNA, 24 nt, Human
ucccaaagugcagggaauauaggc

SEQ ID NO: 163609 - RNA, 21 nt, Human
uccugggcucaagcgauccuc

SEQ ID NO: 163610 - RNA, 22 nt, Human
uccugggcucaagcgauccucc

SEQ ID NO: 163611 - RNA, 24 nt, Human
uccugggcucaagcgauccuccug

SEQ ID NO: 163612 - RNA, 22 nt, Human
uccuuaaacuauuggaucaaau

SEQ ID NO: 163613 - RNA, 19 nt, Human
ucuaugguaagacagucua

SEQ ID NO: 163614 - RNA, 23 nt, Human
ucucacucuguugccuaggcugg

SEQ ID NO: 163615 - RNA, 24 nt, Human
ucucacucuguugccuaggcugga

SEQ ID NO: 163616 - RNA, 19 nt, Human
ucucuagccaaucuugguu

SEQ ID NO: 163617 - RNA, 24 nt, Human
ucugaaaaggagaagcuuuggaua

SEQ ID NO: 163618 - RNA, 24 nt, Human
ucuguugccuaggcuggacugcag

SEQ ID NO: 163619 - RNA, 19 nt, Human
ucuugaacuccugggcuca

SEQ ID NO: 163620 - RNA, 23 nt, Human
ucuugaacuccugggcucaagcg

SEQ ID NO: 163621 - RNA, 21 nt, Human
ucuuuuaugcuuucaguuguu

SEQ ID NO: 163622 - RNA, 19 nt, Human
ugaaaauacaacucccauc

SEQ ID NO: 163623 - RNA, 19 nt, Human
ugaaagcagcuagaaauga

SEQ ID NO: 163624 - RNA, 22 nt, Human
ugaaauaaauauaauaaaguca

SEQ ID NO: 163625 - RNA, 25 nt, Human
ugaacuccugggcucaagcgauccu

SEQ ID NO: 163626 - RNA, 21 nt, Human
ugaagaaaaacacauuuccaa

SEQ ID NO: 163627 - RNA, 22 nt, Human
ugaagagacugguauaaaauca

SEQ ID NO: 163628 - RNA, 20 nt, Human
ugaauaaaaauggacauuuu

SEQ ID NO: 163629 - RNA, 23 nt, Human
ugaauugauuuuuuucaugugaa

SEQ ID NO: 163630 - RNA, 21 nt, Human
ugacaaacaagaaaaauagag

SEQ ID NO: 163631 - RNA, 22 nt, Human
ugacaauugugaagcuuuccag

SEQ ID NO: 163632 - RNA, 24 nt, Human
ugaccuggcgaagacugaaaauac

SEQ ID NO: 163633 - RNA, 23 nt, Human
ugagaaauaauccccuaacacaa

SEQ ID NO: 163634 - RNA, 22 nt, Human
ugagacaaagucucacucuguu

SEQ ID NO: 163635 - RNA, 21 nt, Human
ugagaccacauguacacgcca

SEQ ID NO: 163636 - RNA, 24 nt, Human
ugagaccacauguacacgccacca

SEQ ID NO: 163637 - RNA, 23 nt, Human
ugaugaaauuuauauuuucuacu

SEQ ID NO: 163638 - RNA, 22 nt, Human
ugauuagugguacuaagagcua

SEQ ID NO: 163639 - RNA, 23 nt, Human
ugcaguggcacgauuauggcuca

SEQ ID NO: 163640 - RNA, 19 nt, Human
ugccuaggcuggacugcag

SEQ ID NO: 163641 - RNA, 21 nt, Human
ugccuaggcuggacugcagug

SEQ ID NO: 163642 - RNA, 20 nt, Human
ugccugaaaauucauaaaac

SEQ ID NO: 163643 - RNA, 30 nt, Human
ugccugaaaauucauaaaacccugaaagcc

SEQ ID NO: 163644 - RNA, 24 nt, Human
uggacugcaguggcacgauuaugg

SEQ ID NO: 163645 - RNA, 22 nt, Human
uggauggaucucaaugaccugg

SEQ ID NO: 163646 - RNA, 18 nt, Human
uggcacgauuauggcuca

SEQ ID NO: 163647 - RNA, 18 nt, Human
uggcucacugcaaccuug

SEQ ID NO: 163648 - RNA, 24 nt, Human
uggcucacugcaaccuugaccucu

SEQ ID NO: 163649 - RNA, 22 nt, Human
ugggcaaaaagcagucugcagg

SEQ ID NO: 163650 - RNA, 24 nt, Human
ugggcucaagcgauccuccugcuu

SEQ ID NO: 163651 - RNA, 22 nt, Human
uggugccacgugagagcagagc

SEQ ID NO: 163652 - RNA, 23 nt, Human
ugguguguaucuuuuauauuuuu

SEQ ID NO: 163653 - RNA, 24 nt, Human
uguaauugaaaaauggcagaugaa

SEQ ID NO: 163654 - RNA, 20 nt, Human
uguacagguagauaagccuc

SEQ ID NO: 163655 - RNA, 22 nt, Human
uguaucaugacaaaucaaugua

SEQ ID NO: 163656 - RNA, 20 nt, Human
ugucacaacaacucaccuac

SEQ ID NO: 163657 - RNA, 23 nt, Human
ugucacaacaacucaccuaccca

SEQ ID NO: 163658 - RNA, 21 nt, Human
ugugaaaucuacauaugugug

SEQ ID NO: 163659 - RNA, 20 nt, Human
ugugaagcuuuccagcaaag

SEQ ID NO: 163660 - RNA, 18 nt, Human
uuaaacugaucaaaacua

SEQ ID NO: 163661 - RNA, 21 nt, Human
uuacugggacaaugguuacau

SEQ ID NO: 163662 - RNA, 22 nt, Human
uuagagaaagcccaguuagagg

SEQ ID NO: 163663 - RNA, 22 nt, Human
uuagcagcauaauuucuaauau

SEQ ID NO: 163664 - RNA, 18 nt, Human
uuaggguaauguuuugag

SEQ ID NO: 163665 - RNA, 22 nt, Human
uucaaaagcuucuugaauuuac

SEQ ID NO: 163666 - RNA, 24 nt, Human
uucagcauuucaaaagcuucuuga

SEQ ID NO: 163667 - RNA, 20 nt, Human
uucaucuugaaauccuuggg

SEQ ID NO: 163668 - RNA, 18 nt, Human
uuccugaagagaaaaggu

SEQ ID NO: 163669 - RNA, 19 nt, Human
uugaaaaauggcagaugaa

SEQ ID NO: 163670 - RNA, 24 nt, Human
uugaccuuuugcuuaguuuaugcu

SEQ ID NO: 163671 - RNA, 19 nt, Human
uugcuaggcugcugcugua

SEQ ID NO: 163672 - RNA, 29 nt, Human
uuggggaagaaauauccaucuugaggaaa

SEQ ID NO: 163673 - RNA, 21 nt, Human
uuguaagggaagucagcaugu

SEQ ID NO: 163674 - RNA, 23 nt, Human
uuguagagacgggguuucaccag

SEQ ID NO: 163675 - RNA, 24 nt, Human
uuuaaaaaaaaaaaaagugcuugu

SEQ ID NO: 163676 - RNA, 21 nt, Human
uuucaccagguuggucuugaa

SEQ ID NO: 163677 - RNA, 23 nt, Human
uuucugugacuuccucuucuuug

SEQ ID NO: 163678 - RNA, 23 nt, Human
uuucuuuacugggacaaugguua

SEQ ID NO: 163679 - RNA, 24 nt, Human
uuugcaaggcuuccucucuccugc

SEQ ID NO: 163680 - RNA, 22 nt, Human
uuugggaaaaagagcagcaaga

SEQ ID NO: 163681 - RNA, 18 nt, Human
uuuguagagacgggguuu

SEQ ID NO: 163682 - RNA, 23 nt, Human
uuuguagagacgggguuucacca

SEQ ID NO: 163683 - RNA, 18 nt, Human
uuuugcagccuuacccaa

SEQ ID NO: 163684 - RNA, 24 nt, Human
uuuuuguguuuuuuuguagagacg

SEQ ID NO: 163685 - RNA, 24 nt, Human
uuuuuuguagagacgggguuucac

SEQ ID NO: 163686 - RNA, 23 nt, Human
uuuuuuuguagagacgggguuuc

SEQ ID NO: 163687 - RNA, 18 nt, Human
aaggcccgguuacuccuc

SEQ ID NO: 163688 - RNA, 20 nt, Human
agauccggaacacaaaagac

SEQ ID NO: 163689 - RNA, 21 nt, Human
caaaacgagcgcaaaaaguua

SEQ ID NO: 163690 - RNA, 21 nt, Human
cccccaguaaagaguguugug

SEQ ID NO: 163691 - RNA, 21 nt, Human
cggaacacaaaagaccccccc

SEQ ID NO: 163692 - RNA, 22 nt, Human
gggauggagguggauagagaaa

SEQ ID NO: 163693 - RNA, 20 nt, Human
ggugggauggagguggauag

SEQ ID NO: 163694 - RNA, 20 nt, Human
uagcaaaacgagcgcaaaaa

SEQ ID NO: 163695 - RNA, 26 nt, Human
uaugaugggaacuaugacaagaaaga

SEQ ID NO: 163696 - RNA, 18 nt, Human
ugggauggagguggauag

SEQ ID NO: 163697 - RNA, 21 nt, Human
ugggauggagguggauagaga

SEQ ID NO: 163698 - RNA, 20 nt, Human
ugguaaggacuaauccaaug

SEQ ID NO: 163699 - RNA, 28 nt, Human
aaaaggacacgauuuuucaguccacaga

SEQ ID NO: 163700 - RNA, 21 nt, Human
aaaccagagauggggccaaaa

SEQ ID NO: 163701 - RNA, 18 nt, Human
aaagagagggaggaaaau

SEQ ID NO: 163702 - RNA, 27 nt, Human
aacaggaaaugaaaacagaagggaccc

SEQ ID NO: 163703 - RNA, 19 nt, Human
aacauuucucucauaacca

SEQ ID NO: 163704 - RNA, 22 nt, Human
aacccagagcagucccagucuc

SEQ ID NO: 163705 - RNA, 20 nt, Human
aaccccaugacuugggccuc

SEQ ID NO: 163706 - RNA, 24 nt, Human
aagugauaaagaggagaggcacaa

SEQ ID NO: 163707 - RNA, 23 nt, Human
acaaagaggauaagcuaacagaa

SEQ ID NO: 163708 - RNA, 23 nt, Human
acagacaagagccugaccaugug

SEQ ID NO: 163709 - RNA, 25 nt, Human
acaggaaaugaaaacagaaauauua

SEQ ID NO: 163710 - RNA, 19 nt, Human
accccaugacuugggccuc

SEQ ID NO: 163711 - RNA, 18 nt, Human
acuccugucgggacucuc

SEQ ID NO: 163712 - RNA, 19 nt, Human
agaaaaccuaacccagagc

SEQ ID NO: 163713 - RNA, 24 nt, Human
agaaaaccuaacccagagcagucc

SEQ ID NO: 163714 - RNA, 18 nt, Human
agacuggauucccuccuu

SEQ ID NO: 163715 - RNA, 21 nt, Human
agagaccccuucucucuaccu

SEQ ID NO: 163716 - RNA, 23 nt, Human
agagaccccuucucucuaccuuc

SEQ ID NO: 163717 - RNA, 22 nt, Human
agagggagacagcgagacagaa

SEQ ID NO: 163718 - RNA, 21 nt, Human
augaacugcuugggaacagag

SEQ ID NO: 163719 - RNA, 20 nt, Human
caacaggaaaugaaaacaga

SEQ ID NO: 163720 - RNA, 21 nt, Human
caaguuuucaccagccuacca

SEQ ID NO: 163721 - RNA, 23 nt, Human
cacagaaaaccuaacccagagca

SEQ ID NO: 163722 - RNA, 22 nt, Human
caccaagaauuuccaaggggau

SEQ ID NO: 163723 - RNA, 22 nt, Human
cagaguggggccauucugggcc

SEQ ID NO: 163724 - RNA, 21 nt, Human
cagucucucaaagcccccuuc

SEQ ID NO: 163725 - RNA, 19 nt, Human
cagugagaaaaaaaaaagu

SEQ ID NO: 163726 - RNA, 21 nt, Human
ccacagaaaaccuaacccaga

SEQ ID NO: 163727 - RNA, 24 nt, Human
ccacagaaaaccuaacccagagcu

SEQ ID NO: 163728 - RNA, 22 nt, Human
ccauucugggcccucuggcugu

SEQ ID NO: 163729 - RNA, 23 nt, Human
cccagagaagcagcaaauuccau

SEQ ID NO: 163730 - RNA, 24 nt, Human
cccaggccuuacuggccuuuuccu

SEQ ID NO: 163731 - RNA, 18 nt, Human
ccccugucaccuuuccca

SEQ ID NO: 163732 - RNA, 21 nt, Human
cccugucaccuuucccauccu

SEQ ID NO: 163733 - RNA, 24 nt, Human
ccgcaguaaugggguaaggcuuca

SEQ ID NO: 163734 - RNA, 19 nt, Human
ccuaacccagagcaguccc

SEQ ID NO: 163735 - RNA, 18 nt, Human
ccuaccaccagucuuuug

SEQ ID NO: 163736 - RNA, 21 nt, Human
ccuuacuggccuuuuccuucu

SEQ ID NO: 163737 - RNA, 18 nt, Human
cguuugcugagggauggg

SEQ ID NO: 163738 - RNA, 19 nt, Human
cucaaccuggaaguagagc

SEQ ID NO: 163739 - RNA, 20 nt, Human
cucaaggaagaacgaaggcu

SEQ ID NO: 163740 - RNA, 21 nt, Human
cugcacagagggagacagcga

SEQ ID NO: 163741 - RNA, 22 nt, Human
gaagagccacugcugcugcaga

SEQ ID NO: 163742 - RNA, 19 nt, Human
gcaguggagaagcuucugg

SEQ ID NO: 163743 - RNA, 18 nt, Human
ggaagaacgaaggcuuga

SEQ ID NO: 163744 - RNA, 26 nt, Human
gggaacagaguggggccgggaucccu

SEQ ID NO: 163745 - RNA, 18 nt, Human
gggcaucuaacauaaaug

SEQ ID NO: 163746 - RNA, 20 nt, Human
ggugcugagauugaaaccug

SEQ ID NO: 163747 - RNA, 23 nt, Human
gucaaguuuucaccagccuacca

SEQ ID NO: 163748 - RNA, 22 nt, Human
gucaccuuucccauccucggaa

SEQ ID NO: 163749 - RNA, 22 nt, Human
guccacagaaaaccuaacccag

SEQ ID NO: 163750 - RNA, 23 nt, Human
guggggccauucugggcccucug

SEQ ID NO: 163751 - RNA, 18 nt, Human
guucagaauggauuccua

SEQ ID NO: 163752 - RNA, 18 nt, Human
uaaaagcuauuuauuccu

SEQ ID NO: 163753 - RNA, 22 nt, Human
uaaccaaaaagaauagaucaaa

SEQ ID NO: 163754 - RNA, 24 nt, Human
uaagcuaacagaagcugagauaaa

SEQ ID NO: 163755 - RNA, 25 nt, Human
uagaaggauaggcaaacuuccaaau

SEQ ID NO: 163756 - RNA, 23 nt, Human
uagagaaaaggacacgauuuuuc

SEQ ID NO: 163757 - RNA, 25 nt, Human
uagaucaauuaaaaucauugagucu

SEQ ID NO: 163758 - RNA, 22 nt, Human
uaggagaguuuuaacuaaucga

SEQ ID NO: 163759 - RNA, 18 nt, Human
uauaagguuaguauguga

SEQ ID NO: 163760 - RNA, 19 nt, Human
uauggagugaggaaggcgg

SEQ ID NO: 163761 - RNA, 21 nt, Human
uauggagugaggaaggcggug

SEQ ID NO: 163762 - RNA, 23 nt, Human
ucaguccacagaaaaccuaaccc

SEQ ID NO: 163763 - RNA, 19 nt, Human
uccacagaaaaccuaaccc

SEQ ID NO: 163764 - RNA, 22 nt, Human
uccacagaaaaccuaacccaga

SEQ ID NO: 163765 - RNA, 22 nt, Human
uccauacaugccccugucaccu

SEQ ID NO: 163766 - RNA, 21 nt, Human
ucccauaauccuuuuuauucu

SEQ ID NO: 163767 - RNA, 27 nt, Human
ucccuugcaaguagcuggugugaggau

SEQ ID NO: 163768 - RNA, 19 nt, Human
ucuaguuuaccuguugggg

SEQ ID NO: 163769 - RNA, 21 nt, Human
ucucuggauuucccuaauguu

SEQ ID NO: 163770 - RNA, 23 nt, Human
ucuggauuucccuaauguucccc

SEQ ID NO: 163771 - RNA, 25 nt, Human
ugaaaagcaaauucuagcagggcag

SEQ ID NO: 163772 - RNA, 23 nt, Human
ugaaaccugacacuccugucggu

SEQ ID NO: 163773 - RNA, 18 nt, Human
ugacugggaagaagcugu

SEQ ID NO: 163774 - RNA, 22 nt, Human
ugaggaaggcggugaaacccca

SEQ ID NO: 163775 - RNA, 19 nt, Human
ugcugcagagcccuagaga

SEQ ID NO: 163776 - RNA, 20 nt, Human
uggaagggaccccagagaag

SEQ ID NO: 163777 - RNA, 24 nt, Human
uggggccauucugggcccucuggc

SEQ ID NO: 163778 - RNA, 22 nt, Human
uguggaagggaccccagagaag

SEQ ID NO: 163779 - RNA, 21 nt, Human
uuacuggccuuuuccuucucc

SEQ ID NO: 163780 - RNA, 20 nt, Human
uuaguaugugauggcaguga

SEQ ID NO: 163781 - RNA, 24 nt, Human
uuccaaggggauugagacccagau

SEQ ID NO: 163782 - RNA, 27 nt, Human
uucugggaucuccgauuuccucuuccc

SEQ ID NO: 163783 - RNA, 20 nt, Human
uuuccaccaaaauccuuuug

SEQ ID NO: 163784 - RNA, 25 nt, Human
uuugggaucuuucacugaggagccu

SEQ ID NO: 163785 - RNA, 26 nt, Human
uuuuuuuuuuuuuuuuuuaugcuuaa

SEQ ID NO: 163786 - RNA, 30 nt, Human
aaaaaacacacccgcagaacuauaaauaaa

SEQ ID NO: 163787 - RNA, 24 nt, Human
agaaagugcaccaaggugacccuc

SEQ ID NO: 163788 - RNA, 26 nt, Human
agcuggggggcagagcugcgccugug

SEQ ID NO: 163789 - RNA, 19 nt, Human
aggcaaggguccucuggag

SEQ ID NO: 163790 - RNA, 21 nt, Human
aggcaaggguccucuggaggg

SEQ ID NO: 163791 - RNA, 23 nt, Human
aggcggucagugcgcccgggaag

SEQ ID NO: 163792 - RNA, 24 nt, Human
aggcggucagugcgcccgggaagc

SEQ ID NO: 163793 - RNA, 22 nt, Human
aggugcgggaggcaagcgacgg

SEQ ID NO: 163794 - RNA, 22 nt, Human
auccgaagaaagugcaccaagg

SEQ ID NO: 163795 - RNA, 21 nt, Human
cauggagcggcgagccgggcg

SEQ ID NO: 163796 - RNA, 23 nt, Human
ccaggcccgcccgaggccgaggc

SEQ ID NO: 163797 - RNA, 22 nt, Human
cccagaaaauuaaaaaacacac

SEQ ID NO: 163798 - RNA, 24 nt, Human
ccccagaaaauuaaaaaacacacc

SEQ ID NO: 163799 - RNA, 18 nt, Human
cccccgggcgccgggcuc

SEQ ID NO: 163800 - RNA, 20 nt, Human
cccccgggcgccgggcucua

SEQ ID NO: 163801 - RNA, 21 nt, Human
cccccgggcgccgggcucuac

SEQ ID NO: 163802 - RNA, 22 nt, Human
ccccgggcgccgggcucuaccc

SEQ ID NO: 163803 - RNA, 21 nt, Human
cccugagcgccaggcccgccc

SEQ ID NO: 163804 - RNA, 19 nt, Human
ccgaagaaagugcaccaag

SEQ ID NO: 163805 - RNA, 19 nt, Human
ccgaagaaagugcaccaag

SEQ ID NO: 163806 - RNA, 22 nt, Human
ccucgcacugcccucccagggg

SEQ ID NO: 163807 - RNA, 20 nt, Human
cgcccgaggccgaggccgcc

SEQ ID NO: 163808 - RNA, 21 nt, Human
cggcccgagggcgugcgucgg

SEQ ID NO: 163809 - RNA, 19 nt, Human
cggcugcauggagcggcga

SEQ ID NO: 163810 - RNA, 18 nt, Human
cugcgccuguggcguccc

SEQ ID NO: 163811 - RNA, 18 nt, Human
gaggcaagcgacggggcc

SEQ ID NO: 163812 - RNA, 21 nt, Human
gaggcaaggguccucuggagg

SEQ ID NO: 163813 - RNA, 19 nt, Human
gcaaggguccucuggaggg

SEQ ID NO: 163814 - RNA, 25 nt, Human
gcaccagaaaagucagaguugguuu

SEQ ID NO: 163815 - RNA, 18 nt, Human
ggaaagcgcgcggcugga

SEQ ID NO: 163816 - RNA, 18 nt, Human
ggaagcuggggggcagag

SEQ ID NO: 163817 - RNA, 22 nt, Human
ggccgaccucgggcgggagugc

SEQ ID NO: 163818 - RNA, 18 nt, Human
gggaagcuggggggcaga

SEQ ID NO: 163819 - RNA, 22 nt, Human
gggcgccgggcucuaccccggc

SEQ ID NO: 163820 - RNA, 23 nt, Human
gggcgggagugcgcaaccgagga

SEQ ID NO: 163821 - RNA, 18 nt, Human
ggggcuucccgaggcuga

SEQ ID NO: 163822 - RNA, 20 nt, Human
gugcgggaggcaagcgacgg

SEQ ID NO: 163823 - RNA, 18 nt, Human
uaaaaaacacacccgcag

SEQ ID NO: 163824 - RNA, 21 nt, Human
uaaaaaacacacccgcagaac

SEQ ID NO: 163825 - RNA, 25 nt, Human
uaaaaaacacacccgcagaacuaua

SEQ ID NO: 163826 - RNA, 23 nt, Human
uaucuuacaccuacucuugcauu

SEQ ID NO: 163827 - RNA, 21 nt, Human
ucccaggggcuucccgaggcu

SEQ ID NO: 163828 - RNA, 18 nt, Human
ucccugagcgccaggccc

SEQ ID NO: 163829 - RNA, 19 nt, Human
ucccugagcgccaggcccg

SEQ ID NO: 163830 - RNA, 22 nt, Human
ugaggcaaggguccucuggagg

SEQ ID NO: 163831 - RNA, 24 nt, Human
ugcauggagcggcgagccgggcgg

SEQ ID NO: 163832 - RNA, 18 nt, Human
ugguuuuuuguuuugucu

SEQ ID NO: 163833 - RNA, 21 nt, Human
uuaaaaaacacacccgcagaa

SEQ ID NO: 163834 - RNA, 27 nt, Human
uuaaaaaacacacccgcagaacuauaa

SEQ ID NO: 163835 - RNA, 20 nt, Human
uuugucuuuuuuucccccca

SEQ ID NO: 163836 - RNA, 22 nt, Human
aaaaggcuuuaugucuugcuga

SEQ ID NO: 163837 - RNA, 22 nt, Human
aaaaggcuuuaugucuugcuga

SEQ ID NO: 163838 - RNA, 19 nt, Human
aaaauaacagaaauaaaag

SEQ ID NO: 163839 - RNA, 19 nt, Human
aaaauaacagaaauaaaag

SEQ ID NO: 163840 - RNA, 22 nt, Human
aaaccaaacaccacauauucuc

SEQ ID NO: 163841 - RNA, 22 nt, Human
aaaccaaacaccacauauucuc

SEQ ID NO: 163842 - RNA, 22 nt, Human
aaaccaucauucucagcaaacu

SEQ ID NO: 163843 - RNA, 22 nt, Human
aaaccaucauucucagcaaacu

SEQ ID NO: 163844 - RNA, 21 nt, Human
aaagaaccaagaaaauuaaua

SEQ ID NO: 163845 - RNA, 21 nt, Human
aaagaaccaagaaaauuaaua

SEQ ID NO: 163846 - RNA, 19 nt, Human
aaauaaaaacaauaaaaaa

SEQ ID NO: 163847 - RNA, 21 nt, Human
aacaaaugacgugacuucaau

SEQ ID NO: 163848 - RNA, 21 nt, Human
aacaaaugacgugacuucaau

SEQ ID NO: 163849 - RNA, 25 nt, Human
aacaaauucccaaauuaaguuaccu

SEQ ID NO: 163850 - RNA, 25 nt, Human
aacaaauucccaaauuaaguuaccu

SEQ ID NO: 163851 - RNA, 19 nt, Human
aacauggugaaaccccguc

SEQ ID NO: 163852 - RNA, 19 nt, Human
aacauggugaaaccccguc

SEQ ID NO: 163853 - RNA, 20 nt, Human
aacauggugaaaccccgucu

SEQ ID NO: 163854 - RNA, 20 nt, Human
aacauggugaaaccccgucu

SEQ ID NO: 163855 - RNA, 21 nt, Human
aacauggugaaaccccgucuc

SEQ ID NO: 163856 - RNA, 21 nt, Human
aacauggugaaaccccgucuc

SEQ ID NO: 163857 - RNA, 19 nt, Human
aaccaaacaccacauauuc

SEQ ID NO: 163858 - RNA, 19 nt, Human
aaggaccaaaaaccaaaca

SEQ ID NO: 163859 - RNA, 23 nt, Human
aaggaccaaaaaccaaacaccac

SEQ ID NO: 163860 - RNA, 23 nt, Human
aaggaccaaaaaccaaacaccac

SEQ ID NO: 163861 - RNA, 26 nt, Human
aaggaccaaaaaccaaacaccacaua

SEQ ID NO: 163862 - RNA, 18 nt, Human
aauaacagaaauaaaagc

SEQ ID NO: 163863 - RNA, 18 nt, Human
aauaacagaaauaaaagc

SEQ ID NO: 163864 - RNA, 18 nt, Human
acaaauccaagcugagcc

SEQ ID NO: 163865 - RNA, 18 nt, Human
acaaauccaagcugagcc

SEQ ID NO: 163866 - RNA, 23 nt, Human
acagagcaagacucugucucaaa

SEQ ID NO: 163867 - RNA, 24 nt, Human
acagagcaagacucugucucaaaa

SEQ ID NO: 163868 - RNA, 24 nt, Human
acagagcaagacucugucucaaaa

SEQ ID NO: 163869 - RNA, 21 nt, Human
acagugcacaauacuuaacaa

SEQ ID NO: 163870 - RNA, 21 nt, Human
acagugcacaauacuuaacaa

SEQ ID NO: 163871 - RNA, 24 nt, Human
acaucauuguaccuguaaucccag

SEQ ID NO: 163872 - RNA, 24 nt, Human
acaucauuguaccuguaaucccag

SEQ ID NO: 163873 - RNA, 19 nt, Human
acaucuauucacuggaaug

SEQ ID NO: 163874 - RNA, 24 nt, Human
accaacauggugaaaccccgucuc

SEQ ID NO: 163875 - RNA, 24 nt, Human
accaacauggugaaaccccgucuc

SEQ ID NO: 163876 - RNA, 24 nt, Human
accccgucucuacuaaaaauacaa

SEQ ID NO: 163877 - RNA, 24 nt, Human
accccgucucuacuaaaaauacaa

SEQ ID NO: 163878 - RNA, 19 nt, Human
accucuaaauccuuuuccu

SEQ ID NO: 163879 - RNA, 18 nt, Human
accuguaaucccagcacu

SEQ ID NO: 163880 - RNA, 19 nt, Human
accuguaaucccagcacuu

SEQ ID NO: 163881 - RNA, 19 nt, Human
accuguaaucccagcacuu

SEQ ID NO: 163882 - RNA, 20 nt, Human
acuacaucuuauugaaaauu

SEQ ID NO: 163883 - RNA, 20 nt, Human
acuacaucuuauugaaaauu

SEQ ID NO: 163884 - RNA, 23 nt, Human
acugcacuccagccuggugacag

SEQ ID NO: 163885 - RNA, 23 nt, Human
acugcacuccagccuggugacag

SEQ ID NO: 163886 - RNA, 25 nt, Human
acugcacuccagccuggugacagag

SEQ ID NO: 163887 - RNA, 25 nt, Human
acugcacuccagccuggugacagag

SEQ ID NO: 163888 - RNA, 18 nt, Human
acuguaaaaauuaugcca

SEQ ID NO: 163889 - RNA, 18 nt, Human
acuguaaaaauuaugcca

SEQ ID NO: 163890 - RNA, 25 nt, Human
agaaacaauucucugcaacuguaaa

SEQ ID NO: 163891 - RNA, 25 nt, Human
agaaacaauucucugcaacuguaaa

SEQ ID NO: 163892 - RNA, 23 nt, Human
agaaggaagugaagagaggggac

SEQ ID NO: 163893 - RNA, 23 nt, Human
agaaggaagugaagagaggggac

SEQ ID NO: 163894 - RNA, 18 nt, Human
agagcaagacucugucuc

SEQ ID NO: 163895 - RNA, 20 nt, Human
agaugaacauaaccauaacc

SEQ ID NO: 163896 - RNA, 20 nt, Human
agaugaacauaaccauaacc

SEQ ID NO: 163897 - RNA, 19 nt, Human
agcaagaacccucuuagaa

SEQ ID NO: 163898 - RNA, 19 nt, Human
agcaagaacccucuuagaa

SEQ ID NO: 163899 - RNA, 25 nt, Human
agcacuuuggggaggccgagguggg

SEQ ID NO: 163900 - RNA, 25 nt, Human
agcacuuuggggaggccgagguggg

SEQ ID NO: 163901 - RNA, 21 nt, Human
agccuggugacagagcaagac

SEQ ID NO: 163902 - RNA, 21 nt, Human
agccuggugacagagcaagac

SEQ ID NO: 163903 - RNA, 23 nt, Human
agccuggugacagagcaagacuc

SEQ ID NO: 163904 - RNA, 23 nt, Human
agccuggugacagagcaagacuc

SEQ ID NO: 163905 - RNA, 21 nt, Human
agcgaaacuugagucuguauu

SEQ ID NO: 163906 - RNA, 21 nt, Human
agcuacauaagcaagaacccu

SEQ ID NO: 163907 - RNA, 21 nt, Human
agcuacauaagcaagaacccu

SEQ ID NO: 163908 - RNA, 19 nt, Human
aggcaggagaaucccuuaa

SEQ ID NO: 163909 - RNA, 19 nt, Human
aggcaggagaaucccuuaa

SEQ ID NO: 163910 - RNA, 21 nt, Human
aggccgaggugggcagaucau

SEQ ID NO: 163911 - RNA, 21 nt, Human
aggccgaggugggcagaucau

SEQ ID NO: 163912 - RNA, 19 nt, Human
aggcugaggcaggagaauc

SEQ ID NO: 163913 - RNA, 19 nt, Human
aggcugaggcaggagaauc

SEQ ID NO: 163914 - RNA, 18 nt, Human
agggacauggaugaagcu

SEQ ID NO: 163915 - RNA, 18 nt, Human
agggacauggaugaagcu

SEQ ID NO: 163916 - RNA, 24 nt, Human
agggaguuggagguugcagugagc

SEQ ID NO: 163917 - RNA, 24 nt, Human
aggugggcagaucaugaggucagg

SEQ ID NO: 163918 - RNA, 24 nt, Human
aggugggcagaucaugaggucagg

SEQ ID NO: 163919 - RNA, 23 nt, Human
agucuguaaucccagcuacuugg

SEQ ID NO: 163920 - RNA, 24 nt, Human
agucuguaaucccagcuacuuggg

SEQ ID NO: 163921 - RNA, 24 nt, Human
agucuguaaucccagcuacuuggg

SEQ ID NO: 163922 - RNA, 18 nt, Human
agugcaucuuguagggcu

SEQ ID NO: 163923 - RNA, 24 nt, Human
aguuggagguugcagugagccgag

SEQ ID NO: 163924 - RNA, 24 nt, Human
aguuggagguugcagugagccgag

SEQ ID NO: 163925 - RNA, 24 nt, Human
aucaugccacugcacuccagccug

SEQ ID NO: 163926 - RNA, 24 nt, Human
aucaugccacugcacuccagccug

SEQ ID NO: 163927 - RNA, 22 nt, Human
augccacugcacuccagccugg

SEQ ID NO: 163928 - RNA, 22 nt, Human
augccacugcacuccagccugg

SEQ ID NO: 163929 - RNA, 20 nt, Human
augccagaaugcaaguuuuu

SEQ ID NO: 163930 - RNA, 20 nt, Human
augccagaaugcaaguuuuu

SEQ ID NO: 163931 - RNA, 23 nt, Human
caaaauagacuccuaaauauuaa

SEQ ID NO: 163932 - RNA, 23 nt, Human
caaaauagacuccuaaauauuaa

SEQ ID NO: 163933 - RNA, 24 nt, Human
caacauggugaaaccccgucucua

SEQ ID NO: 163934 - RNA, 24 nt, Human
caacauggugaaaccccgucucua

SEQ ID NO: 163935 - RNA, 22 nt, Human
caauagcaaagacuuggaacca

SEQ ID NO: 163936 - RNA, 22 nt, Human
caauagcaaagacuuggaacca

SEQ ID NO: 163937 - RNA, 20 nt, Human
caccacauauucucacucau

SEQ ID NO: 163938 - RNA, 20 nt, Human
caccacauauucucacucau

SEQ ID NO: 163939 - RNA, 21 nt, Human
caccacauauucucacucaua

SEQ ID NO: 163940 - RNA, 21 nt, Human
caccacauauucucacucaua

SEQ ID NO: 163941 - RNA, 22 nt, Human
cacuccagccuggugacagagc

SEQ ID NO: 163942 - RNA, 22 nt, Human
cacuccagccuggugacagagc

SEQ ID NO: 163943 - RNA, 18 nt, Human
cacugcacuccagccugg

SEQ ID NO: 163944 - RNA, 18 nt, Human
cacugcacuccagccugg

SEQ ID NO: 163945 - RNA, 18 nt, Human
cacugcacuccagccugg

SEQ ID NO: 163946 - RNA, 20 nt, Human
cacugcacuccagccuggug

SEQ ID NO: 163947 - RNA, 22 nt, Human
cacugcacuccagccuggugac

SEQ ID NO: 163948 - RNA, 22 nt, Human
cacugcacuccagccuggugac

SEQ ID NO: 163949 - RNA, 23 nt, Human
cacugcacuccagccuggugaca

SEQ ID NO: 163950 - RNA, 23 nt, Human
cacugcacuccagccuggugaca

SEQ ID NO: 163951 - RNA, 24 nt, Human
cacugcacuccagccuggugacag

SEQ ID NO: 163952 - RNA, 24 nt, Human
cacugcacuccagccuggugacag

SEQ ID NO: 163953 - RNA, 25 nt, Human
cagcacuuuggggaggccgaggugg

SEQ ID NO: 163954 - RNA, 25 nt, Human
cagcacuuuggggaggccgaggugg

SEQ ID NO: 163955 - RNA, 22 nt, Human
cagcagucaguauuuagguuga

SEQ ID NO: 163956 - RNA, 22 nt, Human
cagcagucaguauuuagguuga

SEQ ID NO: 163957 - RNA, 19 nt, Human
cagcauaaaaugauugcuu

SEQ ID NO: 163958 - RNA, 24 nt, Human
cagcuacuugggaggcugaggcag

SEQ ID NO: 163959 - RNA, 24 nt, Human
cagcuacuugggaggcugaggcag

SEQ ID NO: 163960 - RNA, 22 nt, Human
ccaaacaccacauauucucacu

SEQ ID NO: 163961 - RNA, 22 nt, Human
ccaaacaccacauauucucacu

SEQ ID NO: 163962 - RNA, 19 nt, Human
ccacugcacuccagccugg

SEQ ID NO: 163963 - RNA, 19 nt, Human
ccacugcacuccagccugg

SEQ ID NO: 163964 - RNA, 19 nt, Human
ccacugcacuccagccugg

SEQ ID NO: 163965 - RNA, 19 nt, Human
ccacugcacuccagccugg

SEQ ID NO: 163966 - RNA, 19 nt, Human
ccacugcacuccagccugg

SEQ ID NO: 163967 - RNA, 20 nt, Human
ccacugcacuccagccuggu

SEQ ID NO: 163968 - RNA, 20 nt, Human
ccacugcacuccagccuggu

SEQ ID NO: 163969 - RNA, 23 nt, Human
ccacugcacuccagccuggugac

SEQ ID NO: 163970 - RNA, 23 nt, Human
ccacugcacuccagccuggugac

SEQ ID NO: 163971 - RNA, 22 nt, Human
ccagcagucaguauuuagguug

SEQ ID NO: 163972 - RNA, 22 nt, Human
ccagcagucaguauuuagguug

SEQ ID NO: 163973 - RNA, 19 nt, Human
ccggggccugcuguggggu

SEQ ID NO: 163974 - RNA, 19 nt, Human
ccggggccugcuguggggu

SEQ ID NO: 163975 - RNA, 22 nt, Human
ccugaccaacauggugaaaccc

SEQ ID NO: 163976 - RNA, 22 nt, Human
ccugaccaacauggugaaaccc

SEQ ID NO: 163977 - RNA, 23 nt, Human
ccugaccaacauggugaaacccc

SEQ ID NO: 163978 - RNA, 23 nt, Human
ccugaccaacauggugaaacccc

SEQ ID NO: 163979 - RNA, 24 nt, Human
ccugaccaacauggugaaaccccg

SEQ ID NO: 163980 - RNA, 24 nt, Human
ccugaccaacauggugaaaccccg

SEQ ID NO: 163981 - RNA, 22 nt, Human
ccugcugugggguggguggaga

SEQ ID NO: 163982 - RNA, 22 nt, Human
ccugcugugggguggguggaga

SEQ ID NO: 163983 - RNA, 21 nt, Human
ccuggugacagagcaagacuc

SEQ ID NO: 163984 - RNA, 21 nt, Human
ccuggugacagagcaagacuc

SEQ ID NO: 163985 - RNA, 24 nt, Human
cgaggugggcagaucaugagguca

SEQ ID NO: 163986 - RNA, 24 nt, Human
cgaggugggcagaucaugagguca

SEQ ID NO: 163987 - RNA, 18 nt, Human
cucuaaauccuuuuccuu

SEQ ID NO: 163988 - RNA, 18 nt, Human
cucuaaauccuuuuccuu

SEQ ID NO: 163989 - RNA, 19 nt, Human
cucugucucaaaaaaaaaa

SEQ ID NO: 163990 - RNA, 19 nt, Human
cucugucucaaaaaaaaaa

SEQ ID NO: 163991 - RNA, 18 nt, Human
cugaagcuguguccagua

SEQ ID NO: 163992 - RNA, 18 nt, Human
cugaagcuguguccagua

SEQ ID NO: 163993 - RNA, 20 nt, Human
cugcaauacuacuuuuuuua

SEQ ID NO: 163994 - RNA, 20 nt, Human
cugcaauacuacuuuuuuua

SEQ ID NO: 163995 - RNA, 19 nt, Human
cugcaucaaaauauucuuu

SEQ ID NO: 163996 - RNA, 19 nt, Human
cugcaucaaaauauucuuu

SEQ ID NO: 163997 - RNA, 21 nt, Human
cuguaaucccagcuacuuggg

SEQ ID NO: 163998 - RNA, 21 nt, Human
cuguaaucccagcuacuuggg

SEQ ID NO: 163999 - RNA, 21 nt, Human
cuuguucccuuuucuccccug

SEQ ID NO: 164000 - RNA, 21 nt, Human
cuuguucccuuuucuccccug

SEQ ID NO: 164001 - RNA, 23 nt, Human
gaaaauaugcucaaugcagaggg

SEQ ID NO: 164002 - RNA, 23 nt, Human
gaaaauaugcucaaugcagaggg

SEQ ID NO: 164003 - RNA, 18 nt, Human
gaacugaaggagugugcu

SEQ ID NO: 164004 - RNA, 24 nt, Human
gacagagcaagacucugucucaaa

SEQ ID NO: 164005 - RNA, 23 nt, Human
gagaccauccugaccaacauggu

SEQ ID NO: 164006 - RNA, 23 nt, Human
gagaucaugccacugcacuccag

SEQ ID NO: 164007 - RNA, 23 nt, Human
gagaucaugccacugcacuccag

SEQ ID NO: 164008 - RNA, 23 nt, Human
gaggugggcagaucaugagguca

SEQ ID NO: 164009 - RNA, 22 nt, Human
gagguugcagugagccgagauc

SEQ ID NO: 164010 - RNA, 22 nt, Human
gagguugcagugagccgagauc

SEQ ID NO: 164011 - RNA, 21 nt, Human
gaguuggagguugcagugagc

SEQ ID NO: 164012 - RNA, 18 nt, Human
gaugacagguuggugggu

SEQ ID NO: 164013 - RNA, 18 nt, Human
gaugacagguuggugggu

SEQ ID NO: 164014 - RNA, 23 nt, Human
gcacuccagccuggugacagagc

SEQ ID NO: 164015 - RNA, 23 nt, Human
gcacuccagccuggugacagagc

SEQ ID NO: 164016 - RNA, 20 nt, Human
gccgagaucaugccacugca

SEQ ID NO: 164017 - RNA, 20 nt, Human
gccgagaucaugccacugca

SEQ ID NO: 164018 - RNA, 21 nt, Human
gcggcugcgugccucuggcuc

SEQ ID NO: 164019 - RNA, 22 nt, Human
gcggcugcgugccucuggcucu

SEQ ID NO: 164020 - RNA, 18 nt, Human
gcgugccucuggcucugc

SEQ ID NO: 164021 - RNA, 28 nt, Human
gcugaagcuguguccaguaauuuuucuu

SEQ ID NO: 164022 - RNA, 28 nt, Human
gcugaagcuguguccaguaauuuuucuu

SEQ ID NO: 164023 - RNA, 19 nt, Human
gcugugggguggguggaga

SEQ ID NO: 164024 - RNA, 19 nt, Human
gcugugggguggguggaga

SEQ ID NO: 164025 - RNA, 18 nt, Human
ggaagagaaggggagagg

SEQ ID NO: 164026 - RNA, 18 nt, Human
ggagguugcagugagccg

SEQ ID NO: 164027 - RNA, 20 nt, Human
ggagguugcagugagccgag

SEQ ID NO: 164028 - RNA, 20 nt, Human
ggagguugcagugagccgag

SEQ ID NO: 164029 - RNA, 22 nt, Human
ggagguugcagugagccgagau

SEQ ID NO: 164030 - RNA, 22 nt, Human
ggagguugcagugagccgagau

SEQ ID NO: 164031 - RNA, 23 nt, Human
ggagguugcagugagccgagauc

SEQ ID NO: 164032 - RNA, 23 nt, Human
ggagguugcagugagccgagauc

SEQ ID NO: 164033 - RNA, 24 nt, Human
ggagguugcagugagccgagauca

SEQ ID NO: 164034 - RNA, 24 nt, Human
ggagguugcagugagccgagauca

SEQ ID NO: 164035 - RNA, 18 nt, Human
ggaguuggagguugcagu

SEQ ID NO: 164036 - RNA, 18 nt, Human
ggaguuggagguugcagu

SEQ ID NO: 164037 - RNA, 22 nt, Human
ggaguuggagguugcagugagc

SEQ ID NO: 164038 - RNA, 22 nt, Human
ggaguuggagguugcagugagc

SEQ ID NO: 164039 - RNA, 23 nt, Human
ggaucagcaucuuguuccuccgg

SEQ ID NO: 164040 - RNA, 23 nt, Human
ggaucagcaucuuguuccuccgg

SEQ ID NO: 164041 - RNA, 20 nt, Human
ggcagaucaugaggucagga

SEQ ID NO: 164042 - RNA, 20 nt, Human
ggcagaucaugaggucagga

SEQ ID NO: 164043 - RNA, 25 nt, Human
ggccaguaaagacaaguguaauugu

SEQ ID NO: 164044 - RNA, 25 nt, Human
ggccaguaaagacaaguguaauugu

SEQ ID NO: 164045 - RNA, 20 nt, Human
ggcugcgugccucuggcucu

SEQ ID NO: 164046 - RNA, 19 nt, Human
gggaggccgaggugggcag

SEQ ID NO: 164047 - RNA, 19 nt, Human
gggaggccgaggugggcag

SEQ ID NO: 164048 - RNA, 23 nt, Human
gggaggccgaggugggcagauca

SEQ ID NO: 164049 - RNA, 23 nt, Human
gggaggccgaggugggcagauca

SEQ ID NO: 164050 - RNA, 18 nt, Human
gggagggauagcauuagg

SEQ ID NO: 164051 - RNA, 18 nt, Human
gggagggauagcauuagg

SEQ ID NO: 164052 - RNA, 24 nt, Human
ggggaacaucacauaccggggccu

SEQ ID NO: 164053 - RNA, 24 nt, Human
ggggaacaucacauaccggggccu

SEQ ID NO: 164054 - RNA, 20 nt, Human
ggggaagagaaggggagagg

SEQ ID NO: 164055 - RNA, 24 nt, Human
gguggcaugagucuguaaucccag

SEQ ID NO: 164056 - RNA, 24 nt, Human
gguggcaugagucuguaaucccag

SEQ ID NO: 164057 - RNA, 23 nt, Human
ggugggcagaucaugaggucagg

SEQ ID NO: 164058 - RNA, 23 nt, Human
ggugggcagaucaugaggucagg

SEQ ID NO: 164059 - RNA, 19 nt, Human
guauuuuuccgaggugcag

SEQ ID NO: 164060 - RNA, 19 nt, Human
gugcagcacaccagcaugg

SEQ ID NO: 164061 - RNA, 19 nt, Human
gugcagcacaccagcaugg

SEQ ID NO: 164062 - RNA, 21 nt, Human
guguaaguauagcugaagcug

SEQ ID NO: 164063 - RNA, 21 nt, Human
guguaaguauagcugaagcug

SEQ ID NO: 164064 - RNA, 24 nt, Human
guugcagugagccgagaucaugcc

SEQ ID NO: 164065 - RNA, 24 nt, Human
guugcagugagccgagaucaugcc

SEQ ID NO: 164066 - RNA, 24 nt, Human
uaaaaauaacagaaauaaaagccu

SEQ ID NO: 164067 - RNA, 24 nt, Human
uaaaaauaacagaaauaaaagccu

SEQ ID NO: 164068 - RNA, 22 nt, Human
uaaaaugauuaccugagaauaa

SEQ ID NO: 164069 - RNA, 21 nt, Human
uaaaauguaaaacuaaacaua

SEQ ID NO: 164070 - RNA, 21 nt, Human
uaaaauguaaaacuaaacaua

SEQ ID NO: 164071 - RNA, 19 nt, Human
uaaaggagguguagaauuc

SEQ ID NO: 164072 - RNA, 19 nt, Human
uaaaggagguguagaauuc

SEQ ID NO: 164073 - RNA, 20 nt, Human
uaacagaaauaaaagccuua

SEQ ID NO: 164074 - RNA, 19 nt, Human
uaacuucugucaguauccc

SEQ ID NO: 164075 - RNA, 19 nt, Human
uaacuucugucaguauccc

SEQ ID NO: 164076 - RNA, 24 nt, Human
uaagaaaacaaacaaaaaaaaaca

SEQ ID NO: 164077 - RNA, 24 nt, Human
uaagaaaacaaacaaaaaaaaaca

SEQ ID NO: 164078 - RNA, 22 nt, Human
uaagcaagaacccucuuagaaa

SEQ ID NO: 164079 - RNA, 22 nt, Human
uaagcaagaacccucuuagaaa

SEQ ID NO: 164080 - RNA, 23 nt, Human
uaauugauaaaacugacauguua

SEQ ID NO: 164081 - RNA, 23 nt, Human
uaauugauaaaacugacauguua

SEQ ID NO: 164082 - RNA, 23 nt, Human
uacaaaguucuaaauaucccuca

SEQ ID NO: 164083 - RNA, 23 nt, Human
uacaaaguucuaaauaucccuca

SEQ ID NO: 164084 - RNA, 24 nt, Human
uacacacaaauccaagcugagcca

SEQ ID NO: 164085 - RNA, 19 nt, Human
uaccggggccugcuguggg

SEQ ID NO: 164086 - RNA, 19 nt, Human
uaccggggccugcuguggg

SEQ ID NO: 164087 - RNA, 21 nt, Human
uaccggggccugcuguggggu

SEQ ID NO: 164088 - RNA, 21 nt, Human
uaccggggccugcuguggggu

SEQ ID NO: 164089 - RNA, 23 nt, Human
uaccuguaaucccagcacuuugg

SEQ ID NO: 164090 - RNA, 24 nt, Human
uaccuguaaucccagcacuuuggg

SEQ ID NO: 164091 - RNA, 24 nt, Human
uaccuguaaucccagcacuuuggg

SEQ ID NO: 164092 - RNA, 23 nt, Human
uagaaauaaaaacaauaaaaaag

SEQ ID NO: 164093 - RNA, 21 nt, Human
uagccccugugcggcugcgug

SEQ ID NO: 164094 - RNA, 19 nt, Human
uagccuuuagcuaugccuu

SEQ ID NO: 164095 - RNA, 19 nt, Human
uagccuuuagcuaugccuu

SEQ ID NO: 164096 - RNA, 19 nt, Human
uagcuggcgugguggcaug

SEQ ID NO: 164097 - RNA, 19 nt, Human
uagcuggcgugguggcaug

SEQ ID NO: 164098 - RNA, 21 nt, Human
uaguagcuauccuacuuucac

SEQ ID NO: 164099 - RNA, 21 nt, Human
uaguagcuauccuacuuucac

SEQ ID NO: 164100 - RNA, 22 nt, Human
uagugccauaguucguuuuguu

SEQ ID NO: 164101 - RNA, 22 nt, Human
uagugccauaguucguuuuguu

SEQ ID NO: 164102 - RNA, 21 nt, Human
uaguuugcuuuaagaaaaaaa

SEQ ID NO: 164103 - RNA, 21 nt, Human
uaguuugcuuuaagaaaaaaa

SEQ ID NO: 164104 - RNA, 23 nt, Human
uauauacacaaacuuggaaauaa

SEQ ID NO: 164105 - RNA, 23 nt, Human
uauauacacaaacuuggaaauaa

SEQ ID NO: 164106 - RNA, 24 nt, Human
uauauacacaaacuuggaaauaac

SEQ ID NO: 164107 - RNA, 24 nt, Human
uauauacacaaacuuggaaauaac

SEQ ID NO: 164108 - RNA, 26 nt, Human
ucaaaaaaaaaaaaaaaaucauuuug

SEQ ID NO: 164109 - RNA, 26 nt, Human
ucaaaaaaaaaaaaaaaaucauuuug

SEQ ID NO: 164110 - RNA, 24 nt, Human
ucaagaaugagggcaagggggaga

SEQ ID NO: 164111 - RNA, 24 nt, Human
ucaagaaugagggcaagggggaga

SEQ ID NO: 164112 - RNA, 22 nt, Human
ucaagaggccaggauugagacc

SEQ ID NO: 164113 - RNA, 22 nt, Human
ucaagaggccaggauugagacc

SEQ ID NO: 164114 - RNA, 19 nt, Human
ucaagcauaaagcaaaagg

SEQ ID NO: 164115 - RNA, 19 nt, Human
ucaagcauaaagcaaaagg

SEQ ID NO: 164116 - RNA, 25 nt, Human
ucacacugaaacaaauggugggaac

SEQ ID NO: 164117 - RNA, 22 nt, Human
ucagcaucuuguucccuuuucu

SEQ ID NO: 164118 - RNA, 22 nt, Human
ucagcaucuuguucccuuuucu

SEQ ID NO: 164119 - RNA, 25 nt, Human
ucagucacacugaaacaaaugacgu

SEQ ID NO: 164120 - RNA, 25 nt, Human
ucagucacauugaaacaaaugacgu

SEQ ID NO: 164121 - RNA, 23 nt, Human
ucaugccacugcacuccagccug

SEQ ID NO: 164122 - RNA, 23 nt, Human
ucaugccacugcacuccagccug

SEQ ID NO: 164123 - RNA, 22 nt, Human
ucccuguggaucuauacagugg

SEQ ID NO: 164124 - RNA, 22 nt, Human
ucccuguggaucuauacagugg

SEQ ID NO: 164125 - RNA, 23 nt, Human
ucucuacuaaaaauacaaaaauu

SEQ ID NO: 164126 - RNA, 23 nt, Human
ucucuacuaaaaauacaaaaauu

SEQ ID NO: 164127 - RNA, 23 nt, Human
ucugcaacuguaaaaauuaugcc

SEQ ID NO: 164128 - RNA, 23 nt, Human
ucugcaacuguaaaaauuaugcc

SEQ ID NO: 164129 - RNA, 21 nt, Human
ucuguaaucccagcuacuugg

SEQ ID NO: 164130 - RNA, 21 nt, Human
ucuguaaucccagcuacuugg

SEQ ID NO: 164131 - RNA, 22 nt, Human
ucuguagccccugugcggcugc

SEQ ID NO: 164132 - RNA, 23 nt, Human
ucugucucaaaaaaaaaaaaaaa

SEQ ID NO: 164133 - RNA, 23 nt, Human
ucugucucaaaaaaaaaaaaaaa

SEQ ID NO: 164134 - RNA, 20 nt, Human
ucuuuuauucagggccacaa

SEQ ID NO: 164135 - RNA, 26 nt, Human
ugaaacaaaugacgugacuucaauac

SEQ ID NO: 164136 - RNA, 28 nt, Human
ugaagacaccuauagaaacuggagaccc

SEQ ID NO: 164137 - RNA, 28 nt, Human
ugaagacaccuauagaaacuggagaccc

SEQ ID NO: 164138 - RNA, 24 nt, Human
ugaccaacauggugaaaccccguc

SEQ ID NO: 164139 - RNA, 24 nt, Human
ugaccaacauggugaaaccccguc

SEQ ID NO: 164140 - RNA, 24 nt, Human
ugagaccauccugaccaacauggu

SEQ ID NO: 164141 - RNA, 22 nt, Human
ugagccgagaucaugccacugc

SEQ ID NO: 164142 - RNA, 22 nt, Human
ugagccgagaucaugccacugc

SEQ ID NO: 164143 - RNA, 24 nt, Human
ugaggcaggagaaucccuuaaacc

SEQ ID NO: 164144 - RNA, 24 nt, Human
ugaggcaggagaaucccuuaaacc

SEQ ID NO: 164145 - RNA, 25 nt, Human
ugaggcaggagaaucccuuaaacca

SEQ ID NO: 164146 - RNA, 24 nt, Human
ugagucuguaaucccagcuacuug

SEQ ID NO: 164147 - RNA, 24 nt, Human
ugagucuguaaucccagcuacuug

SEQ ID NO: 164148 - RNA, 19 nt, Human
ugagucuguauuucacuga

SEQ ID NO: 164149 - RNA, 23 nt, Human
ugauucugggcucuguagccccu

SEQ ID NO: 164150 - RNA, 19 nt, Human
ugcaaggaccaaaaaccaa

SEQ ID NO: 164151 - RNA, 19 nt, Human
ugcaaggaccaaaaaccaa

SEQ ID NO: 164152 - RNA, 20 nt, Human
ugcaaggaccaaaaaccaaa

SEQ ID NO: 164153 - RNA, 26 nt, Human
ugccucaccugacuccacucagguug

SEQ ID NO: 164154 - RNA, 26 nt, Human
ugccucaccugacuccacucagguug

SEQ ID NO: 164155 - RNA, 22 nt, Human
ugccucuggcucugcccgccuc

SEQ ID NO: 164156 - RNA, 23 nt, Human
ugccucuggcucugcccgccucg

SEQ ID NO: 164157 - RNA, 24 nt, Human
ugcugggguuuaacccgggggcuc

SEQ ID NO: 164158 - RNA, 19 nt, Human
ugcuugaaucuuggcagaa

SEQ ID NO: 164159 - RNA, 20 nt, Human
uggaauacuaugcagccaua

SEQ ID NO: 164160 - RNA, 20 nt, Human
uggaauacuaugcagccaua

SEQ ID NO: 164161 - RNA, 20 nt, Human
uggauuaagaaaauguggcc

SEQ ID NO: 164162 - RNA, 20 nt, Human
uggauuaagaaaauguggcc

SEQ ID NO: 164163 - RNA, 18 nt, Human
uggcuagaaauaaaaaca

SEQ ID NO: 164164 - RNA, 18 nt, Human
uggcuagaaauaaaaaca

SEQ ID NO: 164165 - RNA, 18 nt, Human
ugggaggcugaggcagga

SEQ ID NO: 164166 - RNA, 18 nt, Human
ugggaggcugaggcagga

SEQ ID NO: 164167 - RNA, 19 nt, Human
ugggaggcugaggcaggag

SEQ ID NO: 164168 - RNA, 19 nt, Human
ugggaggcugaggcaggag

SEQ ID NO: 164169 - RNA, 22 nt, Human
ugggcagaucaugaggucagga

SEQ ID NO: 164170 - RNA, 19 nt, Human
ugggcucuguagccccugu

SEQ ID NO: 164171 - RNA, 20 nt, Human
ugggcucuguagccccugug

SEQ ID NO: 164172 - RNA, 18 nt, Human
uggguagagauaugcugg

SEQ ID NO: 164173 - RNA, 24 nt, Human
ugguggcaugagucuguaauccca

SEQ ID NO: 164174 - RNA, 24 nt, Human
ugguggcaugagucuguaauccca

SEQ ID NO: 164175 - RNA, 24 nt, Human
uguaccuguaaucccagcacuuug

SEQ ID NO: 164176 - RNA, 24 nt, Human
uguaccuguaaucccagcacuuug

SEQ ID NO: 164177 - RNA, 21 nt, Human
ugugugcaugugugacagaca

SEQ ID NO: 164178 - RNA, 21 nt, Human
ugugugcaugugugacagaca

SEQ ID NO: 164179 - RNA, 22 nt, Human
uguuauauauauguguguacua

SEQ ID NO: 164180 - RNA, 22 nt, Human
uguuauauauauguguguacua

SEQ ID NO: 164181 - RNA, 21 nt, Human
uuagccuauacaacuuaugca

SEQ ID NO: 164182 - RNA, 21 nt, Human
uuagccuauacaacuuaugca

SEQ ID NO: 164183 - RNA, 19 nt, Human
uuaggagauauaccuaaug

SEQ ID NO: 164184 - RNA, 19 nt, Human
uuaggagauauaccuaaug

SEQ ID NO: 164185 - RNA, 23 nt, Human
uucaacacaacaaauucccaaau

SEQ ID NO: 164186 - RNA, 23 nt, Human
uucaacacaacaaauucccaaau

SEQ ID NO: 164187 - RNA, 21 nt, Human
uucauaaacagcauaaaauga

SEQ ID NO: 164188 - RNA, 21 nt, Human
uucauaaacagcauaaaauga

SEQ ID NO: 164189 - RNA, 20 nt, Human
uucuuagauguaaagaugcc

SEQ ID NO: 164190 - RNA, 20 nt, Human
uucuuagauguaaagaugcc

SEQ ID NO: 164191 - RNA, 30 nt, Human
uugauagggcuagguggcuuuuucuuuucc

SEQ ID NO: 164192 - RNA, 21 nt, Human
uugcaaggaccaaaaaccaaa

SEQ ID NO: 164193 - RNA, 18 nt, Human
uugcagugagccgagauc

SEQ ID NO: 164194 - RNA, 18 nt, Human
uugcagugagccgagauc

SEQ ID NO: 164195 - RNA, 19 nt, Human
uugcagugagccgagauca

SEQ ID NO: 164196 - RNA, 20 nt, Human
uugcagugagccgagaucau

SEQ ID NO: 164197 - RNA, 20 nt, Human
uugcagugagccgagaucau

SEQ ID NO: 164198 - RNA, 21 nt, Human
uugcagugagccgagaucaug

SEQ ID NO: 164199 - RNA, 20 nt, Human
uugcucccuguggaucuaua

SEQ ID NO: 164200 - RNA, 20 nt, Human
uugcucccuguggaucuaua

SEQ ID NO: 164201 - RNA, 26 nt, Human
uuggaucagcaucuuguuccuccggg

SEQ ID NO: 164202 - RNA, 26 nt, Human
uuggaucagcaucuuguuccuccggg

SEQ ID NO: 164203 - RNA, 22 nt, Human
uuuagccuauacaacuuaugca

SEQ ID NO: 164204 - RNA, 22 nt, Human
uuuagccuauacaacuuaugca

SEQ ID NO: 164205 - RNA, 21 nt, Human
uuuauaauauauacacaaacu

SEQ ID NO: 164206 - RNA, 21 nt, Human
uuuauaauauauacacaaacu

SEQ ID NO: 164207 - RNA, 22 nt, Human
uuuccauauuacaaaugagcua

SEQ ID NO: 164208 - RNA, 22 nt, Human
uuuccauauuacaaaugagcua

SEQ ID NO: 164209 - RNA, 21 nt, Human
uuuggggaggccgaggugggc

SEQ ID NO: 164210 - RNA, 21 nt, Human
uuuggggaggccgaggugggc

SEQ ID NO: 164211 - RNA, 19 nt, Human
uuuuuccgaggugcagaaa

SEQ ID NO: 164212 - RNA, 24 nt, Human
cuguaagccuucuuuugugggucc

SEQ ID NO: 164213 - RNA, 25 nt, Human
uucuucgcuggugcaaaauuucaau

SEQ ID NO: 164214 - RNA, 22 nt, Human
aaaaaacaaaaacaugccaaag

SEQ ID NO: 164215 - RNA, 23 nt, Human
aaaaaacaaaaacaugccaaaga

SEQ ID NO: 164216 - RNA, 25 nt, Human
aaaaaacaaaaacaugccaaagacc

SEQ ID NO: 164217 - RNA, 21 nt, Human
aaaacaauaaaguucaaaaac

SEQ ID NO: 164218 - RNA, 25 nt, Human
aaacaaaaggugaauaggagggacc

SEQ ID NO: 164219 - RNA, 23 nt, Human
aaacaaacauaaaugcacaaguc

SEQ ID NO: 164220 - RNA, 22 nt, Human
aaacauccuuuuagcaauaccc

SEQ ID NO: 164221 - RNA, 20 nt, Human
aacauaaugaaaaugaaucu

SEQ ID NO: 164222 - RNA, 20 nt, Human
aaccacaggaaaauuaaaug

SEQ ID NO: 164223 - RNA, 19 nt, Human
aagaaagaaaacaguccac

SEQ ID NO: 164224 - RNA, 28 nt, Human
aagaaagaaaacaguccacuuaaagaaa

SEQ ID NO: 164225 - RNA, 21 nt, Human
aagccauauucccaaauauga

SEQ ID NO: 164226 - RNA, 18 nt, Human
aaguccuccucugcccuc

SEQ ID NO: 164227 - RNA, 23 nt, Human
aauacccuuuccacuugagcagc

SEQ ID NO: 164228 - RNA, 22 nt, Human
acaaaacaauaaaguucaaaaa

SEQ ID NO: 164229 - RNA, 22 nt, Human
acaaccaguuuuacaauuuuuu

SEQ ID NO: 164230 - RNA, 19 nt, Human
acauaaaugcacaagucca

SEQ ID NO: 164231 - RNA, 24 nt, Human
acuaaaaaauaaaaggaaagaaaa

SEQ ID NO: 164232 - RNA, 18 nt, Human
acuacaguuacugaagcc

SEQ ID NO: 164233 - RNA, 22 nt, Human
agcuguauaucuacccagcugc

SEQ ID NO: 164234 - RNA, 22 nt, Human
aggaaagaaaauuuugagaaga

SEQ ID NO: 164235 - RNA, 18 nt, Human
aggcagaaggauuuucuc

SEQ ID NO: 164236 - RNA, 18 nt, Human
aggugaauaggaaucaga

SEQ ID NO: 164237 - RNA, 23 nt, Human
aguaagagggauggaggccccuu

SEQ ID NO: 164238 - RNA, 23 nt, Human
agucagaaaagggagggaaacuu

SEQ ID NO: 164239 - RNA, 24 nt, Human
auaaaguucaaaaacaacuuaaaa

SEQ ID NO: 164240 - RNA, 19 nt, Human
auagcagccauuuuauaag

SEQ ID NO: 164241 - RNA, 21 nt, Human
augcucacaagacuacaguua

SEQ ID NO: 164242 - RNA, 20 nt, Human
auuaguuuuaguguguauuu

SEQ ID NO: 164243 - RNA, 21 nt, Human
caaaaacaugccaaagaccau

SEQ ID NO: 164244 - RNA, 19 nt, Human
cagcugaaaaguucuccag

SEQ ID NO: 164245 - RNA, 22 nt, Human
cauaaaugcacaaguccagcuu

SEQ ID NO: 164246 - RNA, 24 nt, Human
ccaccuuuugaacagcagagauuu

SEQ ID NO: 164247 - RNA, 18 nt, Human
cugacaaauccugccaga

SEQ ID NO: 164248 - RNA, 19 nt, Human
cuguuugcuauuugacuuu

SEQ ID NO: 164249 - RNA, 22 nt, Human
cuuccaggauuugcuggcccaa

SEQ ID NO: 164250 - RNA, 23 nt, Human
cuugccguugagccagacaguuu

SEQ ID NO: 164251 - RNA, 21 nt, Human
gaacagcagagauuucuagag

SEQ ID NO: 164252 - RNA, 20 nt, Human
gaccucuuccuaucugugaa

SEQ ID NO: 164253 - RNA, 23 nt, Human
ggaaacauccuuuuagcaauacc

SEQ ID NO: 164254 - RNA, 18 nt, Human
ggacuugaaugacaaaua

SEQ ID NO: 164255 - RNA, 21 nt, Human
ggcaguucuuucuaguuuucu

SEQ ID NO: 164256 - RNA, 25 nt, Human
ggcugaccucaagccuucaugacau

SEQ ID NO: 164257 - RNA, 26 nt, Human
gugcugccaccuuuugaacagcagag

SEQ ID NO: 164258 - RNA, 21 nt, Human
gugucagucagaaaagggagg

SEQ ID NO: 164259 - RNA, 24 nt, Human
uaaaaaacaaaaacaugccaaaga

SEQ ID NO: 164260 - RNA, 26 nt, Human
uaaaacaaacauaaaugcacaagucc

SEQ ID NO: 164261 - RNA, 22 nt, Human
uaaaauuaaaagcauaugaaac

SEQ ID NO: 164262 - RNA, 23 nt, Human
uaaagugcuaccaagaucugcca

SEQ ID NO: 164263 - RNA, 22 nt, Human
uaacaucaugauuguacaacca

SEQ ID NO: 164264 - RNA, 24 nt, Human
uaacucucaucuauaaauguauua

SEQ ID NO: 164265 - RNA, 22 nt, Human
uaacugcaucuucuauuuuggg

SEQ ID NO: 164266 - RNA, 19 nt, Human
uaaguccuccucugcccuc

SEQ ID NO: 164267 - RNA, 22 nt, Human
uaaugcagugucuuaaaacaaa

SEQ ID NO: 164268 - RNA, 24 nt, Human
uacaagauuuuuggaaacauccuu

SEQ ID NO: 164269 - RNA, 22 nt, Human
uacaguauuaucaucaaucacu

SEQ ID NO: 164270 - RNA, 19 nt, Human
uacauaguuuuaaaauaug

SEQ ID NO: 164271 - RNA, 19 nt, Human
uagauugauuuaagaaaga

SEQ ID NO: 164272 - RNA, 24 nt, Human
uagcuagcaaaguccuugaaucag

SEQ ID NO: 164273 - RNA, 19 nt, Human
uaggucaaccacaggaaaa

SEQ ID NO: 164274 - RNA, 24 nt, Human
uaugaacagauagucugcuaggca

SEQ ID NO: 164275 - RNA, 18 nt, Human
ucaacagaaauaaaaaac

SEQ ID NO: 164276 - RNA, 24 nt, Human
ucaacaggcagaaggauuuucucu

SEQ ID NO: 164277 - RNA, 27 nt, Human
ucagaaaagggagggaaacuugccguu

SEQ ID NO: 164278 - RNA, 20 nt, Human
ucaggcucuuauuuuugucu

SEQ ID NO: 164279 - RNA, 23 nt, Human
ucaguaguuuuuccagccuuucu

SEQ ID NO: 164280 - RNA, 21 nt, Human
uccacuugagcagcauuagaa

SEQ ID NO: 164281 - RNA, 22 nt, Human
uccuccuuaaauaacucuguug

SEQ ID NO: 164282 - RNA, 23 nt, Human
ucuguaggcugaccucaagccuu

SEQ ID NO: 164283 - RNA, 23 nt, Human
ugaacagauagucugcuaggcac

SEQ ID NO: 164284 - RNA, 19 nt, Human
ugacuuauacuaccaggaa

SEQ ID NO: 164285 - RNA, 23 nt, Human
ugaggaagggcaguucuuucuag

SEQ ID NO: 164286 - RNA, 21 nt, Human
ugagucaaaucaucacaguaa

SEQ ID NO: 164287 - RNA, 19 nt, Human
ugccaaagaccauuagcua

SEQ ID NO: 164288 - RNA, 18 nt, Human
ugccaaugaaagacuuuu

SEQ ID NO: 164289 - RNA, 24 nt, Human
ugcuguaaccauaggaaaaaagca

SEQ ID NO: 164290 - RNA, 21 nt, Human
ugggaagaacauuauuaaaag

SEQ ID NO: 164291 - RNA, 24 nt, Human
uguaacuagagcaaauuuuauuuu

SEQ ID NO: 164292 - RNA, 18 nt, Human
ugugggaagaacauuauu

SEQ ID NO: 164293 - RNA, 22 nt, Human
uguugguuuugccuaauucagc

SEQ ID NO: 164294 - RNA, 22 nt, Human
uuacuaaaucugauuuuugugu

SEQ ID NO: 164295 - RNA, 22 nt, Human
uuaguuuuaguguguauuuucu

SEQ ID NO: 164296 - RNA, 18 nt, Human
uuaucuguaggcugaccu

SEQ ID NO: 164297 - RNA, 18 nt, Human
uuguguacaaauguaaag

SEQ ID NO: 164298 - RNA, 24 nt, Human
uuuaaaauaugauauuuucuaccc

SEQ ID NO: 164299 - RNA, 28 nt, Human
aaaaaaaaaaaaaaacagcaaaaaccca

SEQ ID NO: 164300 - RNA, 23 nt, Human
aaaaaaaaaaaaaacagcaaaaa

SEQ ID NO: 164301 - RNA, 24 nt, Human
aaaaaaaaaaaacagcaaaaaccc

SEQ ID NO: 164302 - RNA, 24 nt, Human
aaaaaaaaaaaacagcaaaaaccc

SEQ ID NO: 164303 - RNA, 25 nt, Human
aaaaaaaaaaaacagcaaaaaccca

SEQ ID NO: 164304 - RNA, 19 nt, Human
aaaaaaaacagcaaaaacc

SEQ ID NO: 164305 - RNA, 22 nt, Human
aaaaaaaacagcaaaaacccaa

SEQ ID NO: 164306 - RNA, 20 nt, Human
aaaaaaacagcaaaaaccca

SEQ ID NO: 164307 - RNA, 20 nt, Human
aaaaaacagcaaaaacccaa

SEQ ID NO: 164308 - RNA, 24 nt, Human
aaaaaacagcaaaaacccaacagc

SEQ ID NO: 164309 - RNA, 25 nt, Human
aaaaacccaacagcaaacaauauca

SEQ ID NO: 164310 - RNA, 20 nt, Human
aaacaauaucaacaaccgga

SEQ ID NO: 164311 - RNA, 25 nt, Human
aaacaauaucaacaaccggaaccca

SEQ ID NO: 164312 - RNA, 19 nt, Human
aaacagcaaaaacccaaca

SEQ ID NO: 164313 - RNA, 23 nt, Human
aacagcaaaaacccaacagcaaa

SEQ ID NO: 164314 - RNA, 19 nt, Human
acccagggcucccccagca

SEQ ID NO: 164315 - RNA, 21 nt, Human
accggaacccagggcuccccc

SEQ ID NO: 164316 - RNA, 22 nt, Human
accggaacccagggcuccccca

SEQ ID NO: 164317 - RNA, 22 nt, Human
agagcccggcgggucacgccgu

SEQ ID NO: 164318 - RNA, 19 nt, Human
agagggugcgggugcggga

SEQ ID NO: 164319 - RNA, 21 nt, Human
agcaaaaacccaacagcaaac

SEQ ID NO: 164320 - RNA, 23 nt, Human
caaacaauaucaacaaccggaac

SEQ ID NO: 164321 - RNA, 21 nt, Human
cagcaaaaacccaacagcaaa

SEQ ID NO: 164322 - RNA, 22 nt, Human
cagcaaaaacccaacagcaaac

SEQ ID NO: 164323 - RNA, 24 nt, Human
cagcaaaaacccaacagcaaacaa

SEQ ID NO: 164324 - RNA, 19 nt, Human
cagcgcacagcucaucuug

SEQ ID NO: 164325 - RNA, 22 nt, Human
cagggcucccccagcaccuccc

SEQ ID NO: 164326 - RNA, 19 nt, Human
cauuguggggagggccagg

SEQ ID NO: 164327 - RNA, 19 nt, Human
ccccagcaccuccccagcc

SEQ ID NO: 164328 - RNA, 23 nt, Human
cccccagcaccuccccagccugc

SEQ ID NO: 164329 - RNA, 20 nt, Human
ccccggggcaccgagagccc

SEQ ID NO: 164330 - RNA, 27 nt, Human
ccggcggcgaucacgacgcggcuccuu

SEQ ID NO: 164331 - RNA, 18 nt, Human
cgcggcuccgcggguccc

SEQ ID NO: 164332 - RNA, 25 nt, Human
cggcggcgaucacgacgcggcuccu

SEQ ID NO: 164333 - RNA, 18 nt, Human
cucccccagcaccucccc

SEQ ID NO: 164334 - RNA, 22 nt, Human
cucucugcggucuggcauugug

SEQ ID NO: 164335 - RNA, 22 nt, Human
cuggcauuguggggagggccag

SEQ ID NO: 164336 - RNA, 28 nt, Human
cuuuuguuuuaaaaaaaaaaaaaaaaaa

SEQ ID NO: 164337 - RNA, 18 nt, Human
gacgcgcugagcagggcg

SEQ ID NO: 164338 - RNA, 21 nt, Human
gagggugcgggugcgggaggc

SEQ ID NO: 164339 - RNA, 19 nt, Human
gcaaaaacccaacagcaaa

SEQ ID NO: 164340 - RNA, 24 nt, Human
gcaaacaauaucaacaaccggaac

SEQ ID NO: 164341 - RNA, 20 nt, Human
ggcgcgagcggagagggugc

SEQ ID NO: 164342 - RNA, 21 nt, Human
gggcgcgagcggagagggugc

SEQ ID NO: 164343 - RNA, 18 nt, Human
gucacgccgucccgcggg

SEQ ID NO: 164344 - RNA, 21 nt, Human
ucucugcggucuggcauugug

SEQ ID NO: 164345 - RNA, 18 nt, Human
ugcgggugcgggaggccg

SEQ ID NO: 164346 - RNA, 24 nt, Human
ugcggucuggcauuguggggaggg

SEQ ID NO: 164347 - RNA, 20 nt, Human
uggaacgucgugcucgccgc

SEQ ID NO: 164348 - RNA, 21 nt, Human
uggcauuguggggagggccag

SEQ ID NO: 164349 - RNA, 24 nt, Human
ugggugcccuacaggaugagccuc

SEQ ID NO: 164350 - RNA, 20 nt, Human
uuaaaaaaaaaaaaaaaaaa

SEQ ID NO: 164351 - RNA, 20 nt, Human
uuaaaaaaaaaaaaaaaaaa

SEQ ID NO: 164352 - RNA, 23 nt, Human
acacacacacacacacacacaca

SEQ ID NO: 164353 - RNA, 23 nt, Human
acacacacacacacacacacaca

SEQ ID NO: 164354 - RNA, 23 nt, Human
acacacacacacacacacacaca

SEQ ID NO: 164355 - RNA, 23 nt, Human
acacacacacacacacacacaca

SEQ ID NO: 164356 - RNA, 23 nt, Human
acacacacacacacacacacaua

SEQ ID NO: 164357 - RNA, 23 nt, Human
acacacacacacacacacauaca

SEQ ID NO: 164358 - RNA, 21 nt, Human
acacacacacacauacacaca

SEQ ID NO: 164359 - RNA, 22 nt, Human
acacacacacacauacacacac

SEQ ID NO: 164360 - RNA, 23 nt, Human
acacacauacacacacacacaca

SEQ ID NO: 164361 - RNA, 23 nt, Human
acauacacacacacacacacaca

SEQ ID NO: 164362 - RNA, 20 nt, Human
agccagaauccugauaaguc

SEQ ID NO: 164363 - RNA, 24 nt, Human
agggcucaagugaagaaauugucu

SEQ ID NO: 164364 - RNA, 21 nt, Human
auaaaucaagcaaguggcccu

SEQ ID NO: 164365 - RNA, 23 nt, Human
auacacacacacacacacacaca

SEQ ID NO: 164366 - RNA, 23 nt, Human
auacacacacacacacacacaca

SEQ ID NO: 164367 - RNA, 25 nt, Human
auccaacuccccucccuuacugcag

SEQ ID NO: 164368 - RNA, 22 nt, Human
caacccaggagauauuaggcga

SEQ ID NO: 164369 - RNA, 23 nt, Human
caaguggcccuaggcagcccucc

SEQ ID NO: 164370 - RNA, 20 nt, Human
cacacacacacacacacaca

SEQ ID NO: 164371 - RNA, 20 nt, Human
cacacacacacacacacaca

SEQ ID NO: 164372 - RNA, 20 nt, Human
cacacacacacacacacaca

SEQ ID NO: 164373 - RNA, 20 nt, Human
cacacacacacacacacaca

SEQ ID NO: 164374 - RNA, 20 nt, Human
cacacacacacacacacaca

SEQ ID NO: 164375 - RNA, 20 nt, Human
cacacacacacacacacaca

SEQ ID NO: 164376 - RNA, 22 nt, Human
cacacacacacacacacacaca

SEQ ID NO: 164377 - RNA, 22 nt, Human
cacacacacacacacacacaca

SEQ ID NO: 164378 - RNA, 26 nt, Human
cacacacacacacacacacacacaca

SEQ ID NO: 164379 - RNA, 26 nt, Human
cacacacacacacacacacacacaca

SEQ ID NO: 164380 - RNA, 26 nt, Human
cacacacacacacacacacacacaua

SEQ ID NO: 164381 - RNA, 25 nt, Human
cacacacacacacacacacacauac

SEQ ID NO: 164382 - RNA, 26 nt, Human
cacacacacacacacacacauacaca

SEQ ID NO: 164383 - RNA, 20 nt, Human
cacacacacacacacacaua

SEQ ID NO: 164384 - RNA, 26 nt, Human
cacacacacacacacacauacacaca

SEQ ID NO: 164385 - RNA, 19 nt, Human
cacacacacacacacauac

SEQ ID NO: 164386 - RNA, 23 nt, Human
cacccucgcgcaggccaccagcc

SEQ ID NO: 164387 - RNA, 20 nt, Human
cauuaugcaugcgacaaagu

SEQ ID NO: 164388 - RNA, 21 nt, Human
cccuuacugcaguugcagaga

SEQ ID NO: 164389 - RNA, 24 nt, Human
cgcuacacacauacacacacacag

SEQ ID NO: 164390 - RNA, 18 nt, Human
cucucgcuccgcccacau

SEQ ID NO: 164391 - RNA, 24 nt, Human
cucucuccucuucucucaugauaa

SEQ ID NO: 164392 - RNA, 23 nt, Human
cucucucuccucuucucucauga

SEQ ID NO: 164393 - RNA, 22 nt, Human
cuuuaaguucacugcgaugaua

SEQ ID NO: 164394 - RNA, 21 nt, Human
gaacaaaaucagcauauuccc

SEQ ID NO: 164395 - RNA, 23 nt, Human
gcuccgcccacaucucccgcuac

SEQ ID NO: 164396 - RNA, 18 nt, Human
uaagugcagaacaaaauc

SEQ ID NO: 164397 - RNA, 20 nt, Human
uacacacacacacacacaca

SEQ ID NO: 164398 - RNA, 25 nt, Human
uacacacacacacacacacacacac

SEQ ID NO: 164399 - RNA, 20 nt, Human
uacacacauacacacacaca

SEQ ID NO: 164400 - RNA, 25 nt, Human
uacacacauacacacacacacacag

SEQ ID NO: 164401 - RNA, 21 nt, Human
uaggaugaaguacaacugauc

SEQ ID NO: 164402 - RNA, 19 nt, Human
ucgcgcaggccaccagcca

SEQ ID NO: 164403 - RNA, 18 nt, Human
ucucucuccucuucucuc

SEQ ID NO: 164404 - RNA, 19 nt, Human
ugaaguacaacugaucaga

SEQ ID NO: 164405 - RNA, 20 nt, Human
uggaauuucuauaaauaaau

SEQ ID NO: 164406 - RNA, 21 nt, Human
uggcaacaguggagcugaugu

SEQ ID NO: 164407 - RNA, 19 nt, Human
ugucaacccaggagauauu

SEQ ID NO: 164408 - RNA, 23 nt, Human
uucccauccaagccuccaucaua

SEQ ID NO: 164409 - RNA, 20 nt, Human
uuuauagugguuacuuuuuu

SEQ ID NO: 164410 - RNA, 19 nt, Human
uuuuauuuuuuacuaagag

SEQ ID NO: 164411 - RNA, 22 nt, Human
uuuuggagcacaagaauaaaca

SEQ ID NO: 164412 - RNA, 19 nt, Human
aaaaaaaaaaaaaaaaaga

SEQ ID NO: 164413 - RNA, 25 nt, Human
aaaagacauguaaauauauacucag

SEQ ID NO: 164414 - RNA, 21 nt, Human
aaaccgacaggagaaagcuca

SEQ ID NO: 164415 - RNA, 21 nt, Human
aaaccgacaggagaaagcuca

SEQ ID NO: 164416 - RNA, 22 nt, Human
aaagccccagugacguugcucu

SEQ ID NO: 164417 - RNA, 20 nt, Human
aaagugcugggauuacaggc

SEQ ID NO: 164418 - RNA, 20 nt, Human
aaagugcugggauuacaggc

SEQ ID NO: 164419 - RNA, 22 nt, Human
aaagugcugggauuacaggcgu

SEQ ID NO: 164420 - RNA, 23 nt, Human
aaagugcugggauuacaggcgug

SEQ ID NO: 164421 - RNA, 24 nt, Human
aaagugcugggauuacaggcguga

SEQ ID NO: 164422 - RNA, 22 nt, Human
aaaguuccuccacaggcacacu

SEQ ID NO: 164423 - RNA, 22 nt, Human
aacacugcccccaaccuggccu

SEQ ID NO: 164424 - RNA, 22 nt, Human
aacacugcccccaaccuggccu

SEQ ID NO: 164425 - RNA, 21 nt, Human
aacccacucccuccaggacug

SEQ ID NO: 164426 - RNA, 20 nt, Human
aagagcuccgcggccggcgc

SEQ ID NO: 164427 - RNA, 20 nt, Human
aagagcuccgcggccggcgc

SEQ ID NO: 164428 - RNA, 19 nt, Human
aagugcugggauuacaggc

SEQ ID NO: 164429 - RNA, 19 nt, Human
aagugcugggauuacaggc

SEQ ID NO: 164430 - RNA, 24 nt, Human
aaguggacuucaaaaguccaaagc

SEQ ID NO: 164431 - RNA, 23 nt, Human
aauggagccggagcuggugcccc

SEQ ID NO: 164432 - RNA, 23 nt, Human
aauggagccggagcuggugcccc

SEQ ID NO: 164433 - RNA, 24 nt, Human
aauggagccggagcuggugccccc

SEQ ID NO: 164434 - RNA, 18 nt, Human
acaaguacagaacaagug

SEQ ID NO: 164435 - RNA, 20 nt, Human
accagagugcgaggggcuua

SEQ ID NO: 164436 - RNA, 20 nt, Human
accagagugcgaggggcuua

SEQ ID NO: 164437 - RNA, 18 nt, Human
accauguuggccgggcug

SEQ ID NO: 164438 - RNA, 24 nt, Human
acccaggcuggagugcaguggcgu

SEQ ID NO: 164439 - RNA, 20 nt, Human
accccaaagccccagugacg

SEQ ID NO: 164440 - RNA, 19 nt, Human
accuuguagccuccaauuc

SEQ ID NO: 164441 - RNA, 23 nt, Human
acgaggggucucggucccguccg

SEQ ID NO: 164442 - RNA, 22 nt, Human
acggacagguggugggcccagc

SEQ ID NO: 164443 - RNA, 22 nt, Human
acggacagguggugggcccagc

SEQ ID NO: 164444 - RNA, 24 nt, Human
acucacucugucacccaggcugga

SEQ ID NO: 164445 - RNA, 18 nt, Human
acucugguggguguagau

SEQ ID NO: 164446 - RNA, 18 nt, Human
acucugucacccaggcug

SEQ ID NO: 164447 - RNA, 24 nt, Human
acucugucacccaggcuggagugc

SEQ ID NO: 164448 - RNA, 25 nt, Human
acucugucacccaggcuggagugca

SEQ ID NO: 164449 - RNA, 22 nt, Human
acugucuuggcagccggcacug

SEQ ID NO: 164450 - RNA, 18 nt, Human
agaagggagggccaguau

SEQ ID NO: 164451 - RNA, 23 nt, Human
agaccaaaccgacaggagaaagc

SEQ ID NO: 164452 - RNA, 23 nt, Human
agaccaaaccgacaggagaaagc

SEQ ID NO: 164453 - RNA, 21 nt, Human
agaggagguggagggagaggu

SEQ ID NO: 164454 - RNA, 21 nt, Human
agaggagguggagggagaggu

SEQ ID NO: 164455 - RNA, 24 nt, Human
agaguccauuaugaugcuccaggu

SEQ ID NO: 164456 - RNA, 19 nt, Human
agcaaaaaauauaugaccu

SEQ ID NO: 164457 - RNA, 19 nt, Human
agcaaaaaauauaugaccu

SEQ ID NO: 164458 - RNA, 22 nt, Human
agcucccggcacacccggguuc

SEQ ID NO: 164459 - RNA, 22 nt, Human
agcuucugguuccuuccuguug

SEQ ID NO: 164460 - RNA, 19 nt, Human
aggaaaaaggaagaaaaug

SEQ ID NO: 164461 - RNA, 20 nt, Human
aggcagggguccaaaugccu

SEQ ID NO: 164462 - RNA, 23 nt, Human
aggcagugccuguggcagggagg

SEQ ID NO: 164463 - RNA, 25 nt, Human
aggcagugccuguggcagggagggg

SEQ ID NO: 164464 - RNA, 20 nt, Human
aggcggggcggggggagggc

SEQ ID NO: 164465 - RNA, 20 nt, Human
aggcggggcggggggagggc

SEQ ID NO: 164466 - RNA, 25 nt, Human
aggcuggagugcaguggcgugaucu

SEQ ID NO: 164467 - RNA, 21 nt, Human
aggggucucggucccguccgg

SEQ ID NO: 164468 - RNA, 18 nt, Human
aguagcugggacuacagg

SEQ ID NO: 164469 - RNA, 24 nt, Human
agucuggggagggcgugugggugg

SEQ ID NO: 164470 - RNA, 24 nt, Human
agucuggggagggcgugugggugg

SEQ ID NO: 164471 - RNA, 19 nt, Human
agugcaguggcgugaucuc

SEQ ID NO: 164472 - RNA, 21 nt, Human
agugcaguggcgugaucucag

SEQ ID NO: 164473 - RNA, 23 nt, Human
agugcaguggcgugaucucagcu

SEQ ID NO: 164474 - RNA, 24 nt, Human
agugcaguggcgugaucucagcuc

SEQ ID NO: 164475 - RNA, 19 nt, Human
agugcgaggggcuuauggg

SEQ ID NO: 164476 - RNA, 19 nt, Human
agugcgaggggcuuauggg

SEQ ID NO: 164477 - RNA, 18 nt, Human
agugcugggauuacaggc

SEQ ID NO: 164478 - RNA, 22 nt, Human
aguggccaaugaccuacagagc

SEQ ID NO: 164479 - RNA, 24 nt, Human
aguggcgugaucucagcucacugc

SEQ ID NO: 164480 - RNA, 18 nt, Human
aguggggugaaggcaggc

SEQ ID NO: 164481 - RNA, 23 nt, Human
auaaaacagcaaaaguagcaaaa

SEQ ID NO: 164482 - RNA, 23 nt, Human
auaaaacagcaaaaguagcaaaa

SEQ ID NO: 164483 - RNA, 18 nt, Human
auccggucaaauaaugcc

SEQ ID NO: 164484 - RNA, 25 nt, Human
aucugccucuuugcaccucucacca

SEQ ID NO: 164485 - RNA, 25 nt, Human
aucugccucuuugcaccucucacca

SEQ ID NO: 164486 - RNA, 18 nt, Human
auggggagccgcccagag

SEQ ID NO: 164487 - RNA, 22 nt, Human
augggguuucaccauguuggcc

SEQ ID NO: 164488 - RNA, 23 nt, Human
augggguuucaccauguuggccg

SEQ ID NO: 164489 - RNA, 24 nt, Human
augggguuucaccauguuggccgg

SEQ ID NO: 164490 - RNA, 21 nt, Human
auuaaaaaaaaaaaaaaaaaa

SEQ ID NO: 164491 - RNA, 24 nt, Human
auuuuuguauuuuuaguagagaug

SEQ ID NO: 164492 - RNA, 21 nt, Human
caaagagguaaacaacuuucc

SEQ ID NO: 164493 - RNA, 24 nt, Human
caaauaaugccucgggugccaucc

SEQ ID NO: 164494 - RNA, 21 nt, Human
caacacugcccccaaccuggc

SEQ ID NO: 164495 - RNA, 21 nt, Human
caacacugcccccaaccuggc

SEQ ID NO: 164496 - RNA, 24 nt, Human
caccagcagguggagaggaggugg

SEQ ID NO: 164497 - RNA, 24 nt, Human
caccagcagguggagaggaggugg

SEQ ID NO: 164498 - RNA, 21 nt, Human
caccauguuggccgggcuggu

SEQ ID NO: 164499 - RNA, 24 nt, Human
caccauguuggccgggcuggucuc

SEQ ID NO: 164500 - RNA, 24 nt, Human
cacccaggcuggagugcaguggcg

SEQ ID NO: 164501 - RNA, 23 nt, Human
caccuucaaucgaggcacgaagc

SEQ ID NO: 164502 - RNA, 23 nt, Human
caccuucaaucgaggcacgaagc

SEQ ID NO: 164503 - RNA, 24 nt, Human
cacuaugcacagcuaauuuuugua

SEQ ID NO: 164504 - RNA, 22 nt, Human
cacucugucacccaggcuggag

SEQ ID NO: 164505 - RNA, 23 nt, Human
cacucugucacccaggcuggagu

SEQ ID NO: 164506 - RNA, 24 nt, Human
cacucugucacccaggcuggagug

SEQ ID NO: 164507 - RNA, 23 nt, Human
cacugcaaccucugccuucuggg

SEQ ID NO: 164508 - RNA, 20 nt, Human
cacugcaugccagcaguccc

SEQ ID NO: 164509 - RNA, 18 nt, Human
cacugcccccaaccuggc

SEQ ID NO: 164510 - RNA, 25 nt, Human
cacugcccccaaccuggccuucgcc

SEQ ID NO: 164511 - RNA, 25 nt, Human
cacugcccccaaccuggccuucgcc

SEQ ID NO: 164512 - RNA, 21 nt, Human
cacuuuguguuuucuucauag

SEQ ID NO: 164513 - RNA, 21 nt, Human
cacuuuguguuuucuucauag

SEQ ID NO: 164514 - RNA, 18 nt, Human
cagaaagcucucacuugc

SEQ ID NO: 164515 - RNA, 19 nt, Human
cagaacacagggcuaagac

SEQ ID NO: 164516 - RNA, 19 nt, Human
cagaccaaaccgacaggag

SEQ ID NO: 164517 - RNA, 19 nt, Human
cagaccaaaccgacaggag

SEQ ID NO: 164518 - RNA, 21 nt, Human
cagagugaagaucucccacag

SEQ ID NO: 164519 - RNA, 18 nt, Human
cagcaaaaguagcaaaaa

SEQ ID NO: 164520 - RNA, 18 nt, Human
cagcaaaaguagcaaaaa

SEQ ID NO: 164521 - RNA, 20 nt, Human
cagcaaagcaaacuaguauc

SEQ ID NO: 164522 - RNA, 20 nt, Human
cagcaaagcaaacuaguauc

SEQ ID NO: 164523 - RNA, 20 nt, Human
cagccaccaggagcaucuua

SEQ ID NO: 164524 - RNA, 20 nt, Human
cagccaccaggagcaucuua

SEQ ID NO: 164525 - RNA, 20 nt, Human
cagccuccugaguagcuggg

SEQ ID NO: 164526 - RNA, 22 nt, Human
cagcggcggcgccucacuuucc

SEQ ID NO: 164527 - RNA, 22 nt, Human
cagcggcggcgccucacuuucc

SEQ ID NO: 164528 - RNA, 19 nt, Human
cagcuucugguuccuuccu

SEQ ID NO: 164529 - RNA, 18 nt, Human
caggaagcucucacuugc

SEQ ID NO: 164530 - RNA, 21 nt, Human
cagguuugaauucuuugccau

SEQ ID NO: 164531 - RNA, 23 nt, Human
cauaacggaccuuguagccucca

SEQ ID NO: 164532 - RNA, 20 nt, Human
caugccagcagucccgcauc

SEQ ID NO: 164533 - RNA, 21 nt, Human
ccacaucuccauggauacucc

SEQ ID NO: 164534 - RNA, 21 nt, Human
ccacaucuccauggauacucc

SEQ ID NO: 164535 - RNA, 23 nt, Human
ccaccuaucuggggcagagguug

SEQ ID NO: 164536 - RNA, 23 nt, Human
ccaccuaucuggggcagagguug

SEQ ID NO: 164537 - RNA, 24 nt, Human
cccaaagccccagugacguugcuc

SEQ ID NO: 164538 - RNA, 18 nt, Human
cccacaggagcaccccga

SEQ ID NO: 164539 - RNA, 22 nt, Human
cccacuggaagggcauuugaac

SEQ ID NO: 164540 - RNA, 21 nt, Human
cccagggccacaacacugccc

SEQ ID NO: 164541 - RNA, 21 nt, Human
cccccaaccuggccuucgccu

SEQ ID NO: 164542 - RNA, 21 nt, Human
cccccaaccuggccuucgccu

SEQ ID NO: 164543 - RNA, 24 nt, Human
cccccaguuuggggcugggcccca

SEQ ID NO: 164544 - RNA, 20 nt, Human
ccccccuccuccagaacgca

SEQ ID NO: 164545 - RNA, 20 nt, Human
ccccccuccuccagaacgca

SEQ ID NO: 164546 - RNA, 19 nt, Human
cccccuccuccagaacgca

SEQ ID NO: 164547 - RNA, 24 nt, Human
ccccgagcucggaccggagaaaag

SEQ ID NO: 164548 - RNA, 22 nt, Human
ccccggcgccgcggcgugcccg

SEQ ID NO: 164549 - RNA, 21 nt, Human
ccccgggcccgcggcgugccc

SEQ ID NO: 164550 - RNA, 19 nt, Human
cccgauggguaaaucucug

SEQ ID NO: 164551 - RNA, 20 nt, Human
cccgccgcccccgggcucug

SEQ ID NO: 164552 - RNA, 18 nt, Human
cccgcguccccggcuccg

SEQ ID NO: 164553 - RNA, 18 nt, Human
cccgcguccccggcuccg

SEQ ID NO: 164554 - RNA, 18 nt, Human
ccgccacccggggucucc

SEQ ID NO: 164555 - RNA, 18 nt, Human
ccgccacccggggucucc

SEQ ID NO: 164556 - RNA, 20 nt, Human
ccgccgcccccgggcucugu

SEQ ID NO: 164557 - RNA, 24 nt, Human
ccggcccgccgcccccgggcucug

SEQ ID NO: 164558 - RNA, 24 nt, Human
ccggcccgccgcccccgggcucug

SEQ ID NO: 164559 - RNA, 21 nt, Human
ccggcgccgcggcgugcccga

SEQ ID NO: 164560 - RNA, 18 nt, Human
ccuccagcccgggcggga

SEQ ID NO: 164561 - RNA, 18 nt, Human
ccuccagcccgggcggga

SEQ ID NO: 164562 - RNA, 19 nt, Human
ccuccaggacuggagcagg

SEQ ID NO: 164563 - RNA, 21 nt, Human
ccuccaggcagugccuguggc

SEQ ID NO: 164564 - RNA, 20 nt, Human
ccuccuuuucaaacugaccc

SEQ ID NO: 164565 - RNA, 20 nt, Human
ccuccuuuucaaacugaccc

SEQ ID NO: 164566 - RNA, 24 nt, Human
ccucugccuucuggguucaagcag

SEQ ID NO: 164567 - RNA, 22 nt, Human
ccugaccucaagugaucuaaag

SEQ ID NO: 164568 - RNA, 22 nt, Human
ccugaguagcugggacuacagg

SEQ ID NO: 164569 - RNA, 23 nt, Human
ccugaguagcugggacuacaggu

SEQ ID NO: 164570 - RNA, 24 nt, Human
ccugaguagcugggacuacaggug

SEQ ID NO: 164571 - RNA, 21 nt, Human
ccugcggaggcccccggcgcc

SEQ ID NO: 164572 - RNA, 20 nt, Human
ccugcggaggccccgggccc

SEQ ID NO: 164573 - RNA, 21 nt, Human
ccuuccuguugcgagauccac

SEQ ID NO: 164574 - RNA, 20 nt, Human
ccuugugccccccuccucca

SEQ ID NO: 164575 - RNA, 20 nt, Human
ccuugugccccccuccucca

SEQ ID NO: 164576 - RNA, 25 nt, Human
ccuuuuuuuucuuuuuuguuuuuaa

SEQ ID NO: 164577 - RNA, 25 nt, Human
ccuuuuuuuucuuuuuuguuuuuaa

SEQ ID NO: 164578 - RNA, 18 nt, Human
cgcagugugggguuuggg

SEQ ID NO: 164579 - RNA, 24 nt, Human
cgcccccgggcucuguucgggucc

SEQ ID NO: 164580 - RNA, 24 nt, Human
cgcccccgggcucuguucgggucc

SEQ ID NO: 164581 - RNA, 21 nt, Human
cgccguggcuugugcgagcgg

SEQ ID NO: 164582 - RNA, 21 nt, Human
cgccguggcuugugcgagcgg

SEQ ID NO: 164583 - RNA, 20 nt, Human
cgcggccggcgcucgacucc

SEQ ID NO: 164584 - RNA, 20 nt, Human
cgcggccggcgcucgacucc

SEQ ID NO: 164585 - RNA, 21 nt, Human
cggcgcgcucgcggccgggga

SEQ ID NO: 164586 - RNA, 21 nt, Human
cguacguaacucagaacacag

SEQ ID NO: 164587 - RNA, 24 nt, Human
cuaaagugcugggauuacaggcgu

SEQ ID NO: 164588 - RNA, 23 nt, Human
cucacucugucacccaggcugga

SEQ ID NO: 164589 - RNA, 24 nt, Human
cucacucugucacccaggcuggag

SEQ ID NO: 164590 - RNA, 19 nt, Human
cucacugcaaccucugccu

SEQ ID NO: 164591 - RNA, 24 nt, Human
cucagccuccugaguagcugggac

SEQ ID NO: 164592 - RNA, 24 nt, Human
cucauauggcuuagaauuuauaua

SEQ ID NO: 164593 - RNA, 20 nt, Human
cuccacaggcacaccggggu

SEQ ID NO: 164594 - RNA, 25 nt, Human
cuccacaggcacaccgggguauggg

SEQ ID NO: 164595 - RNA, 23 nt, Human
cuccacaucuccauggauacucc

SEQ ID NO: 164596 - RNA, 19 nt, Human
cucccacucccugcccucc

SEQ ID NO: 164597 - RNA, 21 nt, Human
cucccacucccugcccuccag

SEQ ID NO: 164598 - RNA, 24 nt, Human
cucccuacugcuguagcccugagg

SEQ ID NO: 164599 - RNA, 23 nt, Human
cuccggcccgccgcccccgggcu

SEQ ID NO: 164600 - RNA, 23 nt, Human
cuccggcccgccgcccccgggcu

SEQ ID NO: 164601 - RNA, 23 nt, Human
cucguuggugcaguuacugggcu

SEQ ID NO: 164602 - RNA, 25 nt, Human
cucugguuucgggcaaugaaaaggc

SEQ ID NO: 164603 - RNA, 20 nt, Human
cugcaaccucugccuucugg

SEQ ID NO: 164604 - RNA, 24 nt, Human
cugcaaccucugccuucuggguuc

SEQ ID NO: 164605 - RNA, 20 nt, Human
cugcaugcaauuucuuuucc

SEQ ID NO: 164606 - RNA, 20 nt, Human
cugcggaggcccccggcgcc

SEQ ID NO: 164607 - RNA, 20 nt, Human
cuggagcagggguugugagu

SEQ ID NO: 164608 - RNA, 24 nt, Human
cuggagugcaguggcgugaucuca

SEQ ID NO: 164609 - RNA, 19 nt, Human
cuggugccccggaggcggg

SEQ ID NO: 164610 - RNA, 22 nt, Human
cuucauagcuauauacagagcc

SEQ ID NO: 164611 - RNA, 22 nt, Human
cuucauagcuauauacagagcc

SEQ ID NO: 164612 - RNA, 23 nt, Human
cuugccucagccuccugaguagc

SEQ ID NO: 164613 - RNA, 24 nt, Human
cuugccucagccuccugaguagcu

SEQ ID NO: 164614 - RNA, 22 nt, Human
cuuuuuuuucuuuuuuguuuuu

SEQ ID NO: 164615 - RNA, 21 nt, Human
gaacaauggagccggagcugg

SEQ ID NO: 164616 - RNA, 21 nt, Human
gaacaauggagccggagcugg

SEQ ID NO: 164617 - RNA, 21 nt, Human
gaagcacugaccucccuacug

SEQ ID NO: 164618 - RNA, 21 nt, Human
gaagcacugaccucccuacug

SEQ ID NO: 164619 - RNA, 18 nt, Human
gaagggagggccaguaua

SEQ ID NO: 164620 - RNA, 20 nt, Human
gaagggcauuugaacuucac

SEQ ID NO: 164621 - RNA, 21 nt, Human
gaaggugggucucugugaggg

SEQ ID NO: 164622 - RNA, 19 nt, Human
gacuacaggugccaaccac

SEQ ID NO: 164623 - RNA, 21 nt, Human
gacuacaggugccaaccacua

SEQ ID NO: 164624 - RNA, 18 nt, Human
gagaugggguuucaccau

SEQ ID NO: 164625 - RNA, 24 nt, Human
gagaugggguuucaccauguuggc

SEQ ID NO: 164626 - RNA, 21 nt, Human
gagcaccccgaaagaccacac

SEQ ID NO: 164627 - RNA, 18 nt, Human
gagcaguuuuagcaccag

SEQ ID NO: 164628 - RNA, 22 nt, Human
gaggcggggcggggggagggcu

SEQ ID NO: 164629 - RNA, 21 nt, Human
gauuacaggcgugacgacugc

SEQ ID NO: 164630 - RNA, 24 nt, Human
gcaaugaaaaggcagggguccaaa

SEQ ID NO: 164631 - RNA, 20 nt, Human
gcaccagcagcaaagagaag

SEQ ID NO: 164632 - RNA, 28 nt, Human
gcauuugauuaaaaaaaaaaaaaaaaaa

SEQ ID NO: 164633 - RNA, 21 nt, Human
gccacaacacugcccccaacc

SEQ ID NO: 164634 - RNA, 23 nt, Human
gccacaacacugcccccaaccug

SEQ ID NO: 164635 - RNA, 21 nt, Human
gccauuggcaagcugggcugg

SEQ ID NO: 164636 - RNA, 27 nt, Human
gcccagagugaagaucuccuccuacgg

SEQ ID NO: 164637 - RNA, 23 nt, Human
gcccccgggcucuguucgggucc

SEQ ID NO: 164638 - RNA, 21 nt, Human
gcccgccgcccccgggcucug

SEQ ID NO: 164639 - RNA, 21 nt, Human
gcccgccgcccccgggcucug

SEQ ID NO: 164640 - RNA, 21 nt, Human
gccucgggugccauccacuuc

SEQ ID NO: 164641 - RNA, 22 nt, Human
gccuguucauuggcucccacuc

SEQ ID NO: 164642 - RNA, 22 nt, Human
gccuguucauuggcucccacuc

SEQ ID NO: 164643 - RNA, 22 nt, Human
gccuucuuucccuuuuacaagu

SEQ ID NO: 164644 - RNA, 21 nt, Human
gcgcucggugcucggcgccuu

SEQ ID NO: 164645 - RNA, 21 nt, Human
gcgcucggugcucggcgccuu

SEQ ID NO: 164646 - RNA, 18 nt, Human
gcggggcggggggagggc

SEQ ID NO: 164647 - RNA, 18 nt, Human
gcggggcggggggagggc

SEQ ID NO: 164648 - RNA, 20 nt, Human
gcuccagguggcauaacgga

SEQ ID NO: 164649 - RNA, 19 nt, Human
gcuggagugcaguggcgug

SEQ ID NO: 164650 - RNA, 23 nt, Human
gcuggucucaaacuccugaccuc

SEQ ID NO: 164651 - RNA, 20 nt, Human
gcuggugccccggaggcggg

SEQ ID NO: 164652 - RNA, 20 nt, Human
gcuggugccccggaggcggg

SEQ ID NO: 164653 - RNA, 20 nt, Human
ggacaaagagguaaacaacu

SEQ ID NO: 164654 - RNA, 18 nt, Human
ggacaagcaccugccacc

SEQ ID NO: 164655 - RNA, 21 nt, Human
ggacguggccgcccagcuccc

SEQ ID NO: 164656 - RNA, 23 nt, Human
ggaggcggggcggggggagggcu

SEQ ID NO: 164657 - RNA, 23 nt, Human
ggaggcggggcggggggagggcu

SEQ ID NO: 164658 - RNA, 23 nt, Human
ggaguacugguccaggggcaugg

SEQ ID NO: 164659 - RNA, 18 nt, Human
ggcaauuaccuucccugg

SEQ ID NO: 164660 - RNA, 18 nt, Human
ggcagggagggguguugg

SEQ ID NO: 164661 - RNA, 21 nt, Human
ggcauaacggaccuuguagcc

SEQ ID NO: 164662 - RNA, 22 nt, Human
ggccacaacacugcccccaacc

SEQ ID NO: 164663 - RNA, 22 nt, Human
ggcuggagugcaguggcgugau

SEQ ID NO: 164664 - RNA, 24 nt, Human
ggcuggucucaaacuccugaccuc

SEQ ID NO: 164665 - RNA, 24 nt, Human
gggagugagaggaaaaaggaagaa

SEQ ID NO: 164666 - RNA, 22 nt, Human
gggcugugggugaggguuacag

SEQ ID NO: 164667 - RNA, 20 nt, Human
ggggagggcguguggguggc

SEQ ID NO: 164668 - RNA, 20 nt, Human
ggggagggcguguggguggc

SEQ ID NO: 164669 - RNA, 20 nt, Human
gggguuucaccauguuggcc

SEQ ID NO: 164670 - RNA, 22 nt, Human
ggguuucaccauguuggccggg

SEQ ID NO: 164671 - RNA, 20 nt, Human
ggucaccuucaaucgaggca

SEQ ID NO: 164672 - RNA, 20 nt, Human
ggucaccuucaaucgaggca

SEQ ID NO: 164673 - RNA, 23 nt, Human
guagagaugggguuucaccaugu

SEQ ID NO: 164674 - RNA, 20 nt, Human
gugagaggaaaaaggaagaa

SEQ ID NO: 164675 - RNA, 22 nt, Human
gugucgggaaagcugggggagu

SEQ ID NO: 164676 - RNA, 27 nt, Human
uaaaaagacauguaaauauauacucag

SEQ ID NO: 164677 - RNA, 27 nt, Human
uaaaaagacauguaaauauauacucag

SEQ ID NO: 164678 - RNA, 24 nt, Human
uaaaacagcaaaaguagcaaaaaa

SEQ ID NO: 164679 - RNA, 24 nt, Human
uaaaacagcaaaaguagcaaaaaa

SEQ ID NO: 164680 - RNA, 24 nt, Human
uaaagugcugggauuacaggcgug

SEQ ID NO: 164681 - RNA, 21 nt, Human
uaauauauagcaacugaugcc

SEQ ID NO: 164682 - RNA, 24 nt, Human
uaauuuuuguauuuuuaguagaga

SEQ ID NO: 164683 - RNA, 19 nt, Human
uacaaguacagaacaagug

SEQ ID NO: 164684 - RNA, 20 nt, Human
uacagagcccccaguuuggg

SEQ ID NO: 164685 - RNA, 21 nt, Human
uacccgauggguaaaucucug

SEQ ID NO: 164686 - RNA, 21 nt, Human
uacugcuguagcccugaggac

SEQ ID NO: 164687 - RNA, 21 nt, Human
uacugcuguagcccugaggac

SEQ ID NO: 164688 - RNA, 22 nt, Human
uagagaugggguuucaccaugu

SEQ ID NO: 164689 - RNA, 21 nt, Human
uagcaaaaaauauaugaccuu

SEQ ID NO: 164690 - RNA, 21 nt, Human
uagcaaaaaauauaugaccuu

SEQ ID NO: 164691 - RNA, 22 nt, Human
uagcaccagcagcaaagagaag

SEQ ID NO: 164692 - RNA, 27 nt, Human
uagcugaccccaaagccccagugacgu

SEQ ID NO: 164693 - RNA, 24 nt, Human
uaguagagaugggguuucaccaug

SEQ ID NO: 164694 - RNA, 26 nt, Human
uaguagagaugggguuucaccauguu

SEQ ID NO: 164695 - RNA, 23 nt, Human
uauacagagcccccaguuugggg

SEQ ID NO: 164696 - RNA, 18 nt, Human
uauauagcaacugaugcc

SEQ ID NO: 164697 - RNA, 20 nt, Human
ucaaauggaauguucuauuu

SEQ ID NO: 164698 - RNA, 22 nt, Human
ucacccaggcuggagugcagug

SEQ ID NO: 164699 - RNA, 24 nt, Human
ucacccaggcuggagugcaguggc

SEQ ID NO: 164700 - RNA, 24 nt, Human
ucacucugucacccaggcuggagu

SEQ ID NO: 164701 - RNA, 24 nt, Human
ucacugcaaccucugccuucuggg

SEQ ID NO: 164702 - RNA, 23 nt, Human
ucagccuccugaguagcugggac

SEQ ID NO: 164703 - RNA, 24 nt, Human
uccaucgcccugcggaggccccgg

SEQ ID NO: 164704 - RNA, 19 nt, Human
ucccacaggagcaccccga

SEQ ID NO: 164705 - RNA, 18 nt, Human
ucccacucccugcccucc

SEQ ID NO: 164706 - RNA, 20 nt, Human
ucccacucccugcccuccag

SEQ ID NO: 164707 - RNA, 23 nt, Human
uccccggcuccggcccgccgccc

SEQ ID NO: 164708 - RNA, 23 nt, Human
uccccggcuccggcccgccgccc

SEQ ID NO: 164709 - RNA, 24 nt, Human
ucccuccaggacuggagcaggggu

SEQ ID NO: 164710 - RNA, 20 nt, Human
uccggacguggccgcccagc

SEQ ID NO: 164711 - RNA, 22 nt, Human
uccggacguggccgcccagcuc

SEQ ID NO: 164712 - RNA, 24 nt, Human
uccugaguagcugggacuacaggu

SEQ ID NO: 164713 - RNA, 19 nt, Human
uccugguuggaggucaagg

SEQ ID NO: 164714 - RNA, 18 nt, Human
ucggucccguccggacgu

SEQ ID NO: 164715 - RNA, 18 nt, Human
ucggugcucggcgccucc

SEQ ID NO: 164716 - RNA, 18 nt, Human
ucggugcucggcgccucc

SEQ ID NO: 164717 - RNA, 23 nt, Human
ucuaaagugcugggauuacaggc

SEQ ID NO: 164718 - RNA, 24 nt, Human
ucuaaagugcugggauuacaggcg

SEQ ID NO: 164719 - RNA, 28 nt, Human
ucucacucacucugucacccaggcugga

SEQ ID NO: 164720 - RNA, 19 nt, Human
ucuccagcagagcagggau

SEQ ID NO: 164721 - RNA, 19 nt, Human
ucucccacaggagcacccc

SEQ ID NO: 164722 - RNA, 27 nt, Human
ucugcaguuagagguuggucgguacuc

SEQ ID NO: 164723 - RNA, 27 nt, Human
ucugcaguuagagguuggucgguacuc

SEQ ID NO: 164724 - RNA, 19 nt, Human
ucuggggauguccaauaug

SEQ ID NO: 164725 - RNA, 24 nt, Human
ucugucacccaggcuggagugcag

SEQ ID NO: 164726 - RNA, 20 nt, Human
ucuguuucuuucuccucuga

SEQ ID NO: 164727 - RNA, 23 nt, Human
ucuucauagcuauauacagagcc

SEQ ID NO: 164728 - RNA, 19 nt, Human
ugaaaaggcagggguccaa

SEQ ID NO: 164729 - RNA, 20 nt, Human
ugacccuccuucagcagcuu

SEQ ID NO: 164730 - RNA, 24 nt, Human
ugaccuacagagcaguuuuagcac

SEQ ID NO: 164731 - RNA, 23 nt, Human
ugaccucaagugaucuaaagugc

SEQ ID NO: 164732 - RNA, 24 nt, Human
ugaccucaagugaucuaaagugcu

SEQ ID NO: 164733 - RNA, 24 nt, Human
ugagaggaaaaaggaagaaaaugc

SEQ ID NO: 164734 - RNA, 20 nt, Human
ugagcugaguggggugaagg

SEQ ID NO: 164735 - RNA, 20 nt, Human
ugagcugaguggggugaagg

SEQ ID NO: 164736 - RNA, 18 nt, Human
ugaguggagacaguggcc

SEQ ID NO: 164737 - RNA, 18 nt, Human
ugaguggggugaaggcag

SEQ ID NO: 164738 - RNA, 19 nt, Human
ugaguggggugaaggcagg

SEQ ID NO: 164739 - RNA, 19 nt, Human
ugaguggggugaaggcagg

SEQ ID NO: 164740 - RNA, 22 nt, Human
ugaguggggugaaggcaggcca

SEQ ID NO: 164741 - RNA, 22 nt, Human
ugaguggggugaaggcaggcca

SEQ ID NO: 164742 - RNA, 24 nt, Human
ugaguggggugaaggcaggccaca

SEQ ID NO: 164743 - RNA, 24 nt, Human
ugaguggggugaaggcaggccaca

SEQ ID NO: 164744 - RNA, 18 nt, Human
ugcaccccauuugccaga

SEQ ID NO: 164745 - RNA, 22 nt, Human
ugcaguggcgugaucucagcuc

SEQ ID NO: 164746 - RNA, 18 nt, Human
ugccaccagagugcgagg

SEQ ID NO: 164747 - RNA, 18 nt, Human
ugccaccagagugcgagg

SEQ ID NO: 164748 - RNA, 26 nt, Human
ugccagaaagaucguacguaacucag

SEQ ID NO: 164749 - RNA, 22 nt, Human
ugccucagccuccugaguagcu

SEQ ID NO: 164750 - RNA, 24 nt, Human
ugccucagccuccugaguagcugg

SEQ ID NO: 164751 - RNA, 18 nt, Human
ugccugguggcagggagg

SEQ ID NO: 164752 - RNA, 21 nt, Human
ugccugguggcagggaggggu

SEQ ID NO: 164753 - RNA, 19 nt, Human
ugcgaggggcuuaugggug

SEQ ID NO: 164754 - RNA, 19 nt, Human
ugcgaggggcuuaugggug

SEQ ID NO: 164755 - RNA, 20 nt, Human
ugcugggauuacaggcguga

SEQ ID NO: 164756 - RNA, 19 nt, Human
uggagaggagguggaggga

SEQ ID NO: 164757 - RNA, 19 nt, Human
uggagaggagguggaggga

SEQ ID NO: 164758 - RNA, 24 nt, Human
uggagaggagguggagggagaggu

SEQ ID NO: 164759 - RNA, 24 nt, Human
uggagaggagguggagggagaggu

SEQ ID NO: 164760 - RNA, 19 nt, Human
uggagggagaggugagcug

SEQ ID NO: 164761 - RNA, 19 nt, Human
uggagggagaggugagcug

SEQ ID NO: 164762 - RNA, 19 nt, Human
uggagucuggggagggcgu

SEQ ID NO: 164763 - RNA, 19 nt, Human
uggagucuggggagggcgu

SEQ ID NO: 164764 - RNA, 19 nt, Human
uggagugcaguggcgugau

SEQ ID NO: 164765 - RNA, 24 nt, Human
uggagugcaguggcgugaucucag

SEQ ID NO: 164766 - RNA, 19 nt, Human
uggcaagcugggcugggug

SEQ ID NO: 164767 - RNA, 21 nt, Human
uggcagcaaagaucugccucu

SEQ ID NO: 164768 - RNA, 24 nt, Human
uggccgggcuggucucaaacuccu

SEQ ID NO: 164769 - RNA, 25 nt, Human
uggcggggucgcaagagcuccgcgg

SEQ ID NO: 164770 - RNA, 25 nt, Human
uggcggggucgcaagagcuccgcgg

SEQ ID NO: 164771 - RNA, 24 nt, Human
uggcgugaucucagcucacugcaa

SEQ ID NO: 164772 - RNA, 22 nt, Human
uggcucccacucccugcccucc

SEQ ID NO: 164773 - RNA, 22 nt, Human
uggcucccacucccugcccucc

SEQ ID NO: 164774 - RNA, 22 nt, Human
ugggacagggcacaacacugcc

SEQ ID NO: 164775 - RNA, 22 nt, Human
ugggacuacaggugccaaccac

SEQ ID NO: 164776 - RNA, 22 nt, Human
ugggacuacaggugccaaccac

SEQ ID NO: 164777 - RNA, 22 nt, Human
ugggacuacaggugccaaccac

SEQ ID NO: 164778 - RNA, 24 nt, Human
ugggacuacaggugccaaccacua

SEQ ID NO: 164779 - RNA, 21 nt, Human
ugggaggggaugaaguggcug

SEQ ID NO: 164780 - RNA, 21 nt, Human
ugggaggggaugaaguggcug

SEQ ID NO: 164781 - RNA, 22 nt, Human
ugggaggggaugaaguggcugg

SEQ ID NO: 164782 - RNA, 22 nt, Human
ugggaggggaugaaguggcugg

SEQ ID NO: 164783 - RNA, 22 nt, Human
ugggaggggaugaaguggcugg

SEQ ID NO: 164784 - RNA, 25 nt, Human
ugggagugagaggaaaaaggaagaa

SEQ ID NO: 164785 - RNA, 18 nt, Human
ugggauuacaggcgugac

SEQ ID NO: 164786 - RNA, 19 nt, Human
ugggauuacaggcgugacg

SEQ ID NO: 164787 - RNA, 20 nt, Human
ugggauuacaggcgugacga

SEQ ID NO: 164788 - RNA, 21 nt, Human
ugggauuacaggcgugacgac

SEQ ID NO: 164789 - RNA, 23 nt, Human
ugggauuacaggcgugacgacug

SEQ ID NO: 164790 - RNA, 24 nt, Human
ugggguuucaccauguuggccggg

SEQ ID NO: 164791 - RNA, 23 nt, Human
ugggugaaggcaaaacagaccaa

SEQ ID NO: 164792 - RNA, 23 nt, Human
ugggugaaggcaaaacagaccaa

SEQ ID NO: 164793 - RNA, 19 nt, Human
ugggugaggguuacagcug

SEQ ID NO: 164794 - RNA, 19 nt, Human
ugggugaggguuacagcug

SEQ ID NO: 164795 - RNA, 18 nt, Human
ugguaggcagccggcucc

SEQ ID NO: 164796 - RNA, 18 nt, Human
ugguaggcagccggcucc

SEQ ID NO: 164797 - RNA, 20 nt, Human
ugguaggcagccggcuccug

SEQ ID NO: 164798 - RNA, 20 nt, Human
ugguaggcagccggcuccug

SEQ ID NO: 164799 - RNA, 25 nt, Human
ugguccaacaucugggaggggauga

SEQ ID NO: 164800 - RNA, 22 nt, Human
ugguggcagggagggguguugg

SEQ ID NO: 164801 - RNA, 19 nt, Human
uguagcccugaggacaagg

SEQ ID NO: 164802 - RNA, 21 nt, Human
uguauuuuuaguagagauggg

SEQ ID NO: 164803 - RNA, 18 nt, Human
ugucagagggcaccacag

SEQ ID NO: 164804 - RNA, 24 nt, Human
uguccaugcggugacccuccuuca

SEQ ID NO: 164805 - RNA, 21 nt, Human
ugugaguggagacaguggcca

SEQ ID NO: 164806 - RNA, 18 nt, Human
uguuuaacccacucccuc

SEQ ID NO: 164807 - RNA, 20 nt, Human
uuaaaaaaaaaaaaaaaaaa

SEQ ID NO: 164808 - RNA, 27 nt, Human
uuaaaaaaaaaaaaaaaaaaaaagaau

SEQ ID NO: 164809 - RNA, 28 nt, Human
uuaaaaaaaaaaaaaaaaaaaaagaauc

SEQ ID NO: 164810 - RNA, 22 nt, Human
uuagcaccagcagcaaagagaa

SEQ ID NO: 164811 - RNA, 18 nt, Human
uuaguagagaugggguuu

SEQ ID NO: 164812 - RNA, 22 nt, Human
uuaguagagaugggguuucacc

SEQ ID NO: 164813 - RNA, 24 nt, Human
uuaguagagaugggguuucaccau

SEQ ID NO: 164814 - RNA, 20 nt, Human
uuggcagccggcacugcaug

SEQ ID NO: 164815 - RNA, 33 nt, Human
uuggcagccggcacugcaugcaauuucuuuuuu

SEQ ID NO: 164816 - RNA, 26 nt, Human
uugguccaacaucugggaggggauga

SEQ ID NO: 164817 - RNA, 23 nt, Human
uuguauuuuuaguagagaugggg

SEQ ID NO: 164818 - RNA, 24 nt, Human
uuucaccauguuggccgggcuggu

SEQ ID NO: 164819 - RNA, 19 nt, Human
uuuccaucuuuucugggga

SEQ ID NO: 164820 - RNA, 25 nt, Human
uuucccagcuucugguuccuuccug

SEQ ID NO: 164821 - RNA, 18 nt, Human
uuuggggcugggccccag

SEQ ID NO: 164822 - RNA, 20 nt, Human
uuuuguauuuuuaguagaga

SEQ ID NO: 164823 - RNA, 24 nt, Human
uuuuuaguagagaugggguuucac

SEQ ID NO: 164824 - RNA, 27 nt, Human
uuuuucaaccagcgcagugugggguuu

SEQ ID NO: 164825 - RNA, 20 nt, Human
uuuuuguauuuuuaguagag

SEQ ID NO: 164826 - RNA, 22 nt, Human
uuuuuuucuuuuuuguuuuuaa

SEQ ID NO: 164827 - RNA, 21 nt, Human
uuuuuuuucuuuuuuguuuuu

SEQ ID NO: 164828 - RNA, 21 nt, Human
uuuuuuuucuuuuuuguuuuu

SEQ ID NO: 164829 - RNA, 26 nt, Human
uuuuuuuuuuuuaacgcagagucuca

SEQ ID NO: 164830 - RNA, 20 nt, Human
uuuuuuuuuuuuuuuuuaac

SEQ ID NO: 164831 - RNA, 24 nt, Human
aaagugcugggauuacaggcauga

SEQ ID NO: 164832 - RNA, 19 nt, Human
aacauuaauaucuguagaa

SEQ ID NO: 164833 - RNA, 19 nt, Human
aacauuaauaucuguagaa

SEQ ID NO: 164834 - RNA, 20 nt, Human
aaccuccgccuccccgguuc

SEQ ID NO: 164835 - RNA, 23 nt, Human
aagcagaaggccagcugccagag

SEQ ID NO: 164836 - RNA, 23 nt, Human
aagcagaaggccagcugccagag

SEQ ID NO: 164837 - RNA, 24 nt, Human
aagcugcggccucggggcccccgg

SEQ ID NO: 164838 - RNA, 23 nt, Human
aagggcccucaacauucaccuuu

SEQ ID NO: 164839 - RNA, 19 nt, Human
aagugcugggauuacaggc

SEQ ID NO: 164840 - RNA, 21 nt, Human
aagugcugggauuacaggcau

SEQ ID NO: 164841 - RNA, 26 nt, Human
aagugcugggauuacaggcaugagcc

SEQ ID NO: 164842 - RNA, 22 nt, Human
aaguuuucaacuguauaaaucu

SEQ ID NO: 164843 - RNA, 22 nt, Human
aaguuuucaacuguauaaaucu

SEQ ID NO: 164844 - RNA, 19 nt, Human
aauauagagaaccucaauc

SEQ ID NO: 164845 - RNA, 23 nt, Human
aaucgucugacagcagcauuuaa

SEQ ID NO: 164846 - RNA, 23 nt, Human
aaucgucugacagcagcauuuaa

SEQ ID NO: 164847 - RNA, 18 nt, Human
aaugaugcuucucuuuua

SEQ ID NO: 164848 - RNA, 18 nt, Human
acaggguuucaccauguu

SEQ ID NO: 164849 - RNA, 21 nt, Human
acaggguuucaccauguuggc

SEQ ID NO: 164850 - RNA, 23 nt, Human
acaggguuucaccauguuggcca

SEQ ID NO: 164851 - RNA, 24 nt, Human
acaggguuucaccauguuggccag

SEQ ID NO: 164852 - RNA, 18 nt, Human
acauaaaucuucuccaau

SEQ ID NO: 164853 - RNA, 18 nt, Human
accauguuggccaggcug

SEQ ID NO: 164854 - RNA, 26 nt, Human
acggagcugaaggacucuugccguag

SEQ ID NO: 164855 - RNA, 26 nt, Human
acguauccccaaaacuaucagcagaa

SEQ ID NO: 164856 - RNA, 26 nt, Human
acguauccccaaaacuaucagcagaa

SEQ ID NO: 164857 - RNA, 22 nt, Human
acuuuaguacagaaggaacaac

SEQ ID NO: 164858 - RNA, 18 nt, Human
agaaagcgacgagcccgg

SEQ ID NO: 164859 - RNA, 18 nt, Human
agaaagcgacgagcccgg

SEQ ID NO: 164860 - RNA, 18 nt, Human
agaaagcgacgagcccgg

SEQ ID NO: 164861 - RNA, 19 nt, Human
agaaagcgacgagcccggg

SEQ ID NO: 164862 - RNA, 19 nt, Human
agaaagcgacgagcccggg

SEQ ID NO: 164863 - RNA, 19 nt, Human
agaaagcgacgagcccggg

SEQ ID NO: 164864 - RNA, 19 nt, Human
agaaggaacaacggcgaua

SEQ ID NO: 164865 - RNA, 19 nt, Human
agaaggaacaacggcgaua

SEQ ID NO: 164866 - RNA, 22 nt, Human
agacaacaagcucugggaggca

SEQ ID NO: 164867 - RNA, 22 nt, Human
agacaacaagcucugggaggca

SEQ ID NO: 164868 - RNA, 19 nt, Human
agacaggcugcuugccggg

SEQ ID NO: 164869 - RNA, 21 nt, Human
agaggaagaaaggacucaggc

SEQ ID NO: 164870 - RNA, 21 nt, Human
agaggaagaaaggacucaggc

SEQ ID NO: 164871 - RNA, 19 nt, Human
agcagccaaagaccuaacu

SEQ ID NO: 164872 - RNA, 19 nt, Human
agcgacaucaccagucagc

SEQ ID NO: 164873 - RNA, 18 nt, Human
agcugaaggacucuugcc

SEQ ID NO: 164874 - RNA, 21 nt, Human
aggcucagagcgcgcaggcaa

SEQ ID NO: 164875 - RNA, 18 nt, Human
aguagcugggauuacagg

SEQ ID NO: 164876 - RNA, 19 nt, Human
aguagcugggauuacaggc

SEQ ID NO: 164877 - RNA, 18 nt, Human
agugcugggauuacaggc

SEQ ID NO: 164878 - RNA, 25 nt, Human
auacauccagcaccuauauacugca

SEQ ID NO: 164879 - RNA, 25 nt, Human
auacauccagcaccuauauacugca

SEQ ID NO: 164880 - RNA, 23 nt, Human
auauacaugguucccuuugcaca

SEQ ID NO: 164881 - RNA, 21 nt, Human
auccauuuaaaaucaauacaa

SEQ ID NO: 164882 - RNA, 24 nt, Human
auccccaaaacuaucagcagaaca

SEQ ID NO: 164883 - RNA, 19 nt, Human
auucaccuuuuuccagcca

SEQ ID NO: 164884 - RNA, 25 nt, Human
caaaacacaauacuuuaguacagaa

SEQ ID NO: 164885 - RNA, 25 nt, Human
caaaacacaauacuuuaguacagaa

SEQ ID NO: 164886 - RNA, 20 nt, Human
caaaacuucauuuuccccaa

SEQ ID NO: 164887 - RNA, 20 nt, Human
caaaacuucauuuuccccaa

SEQ ID NO: 164888 - RNA, 24 nt, Human
caaagugcugggauuacaggcaug

SEQ ID NO: 164889 - RNA, 20 nt, Human
caaggaaggcagaacgcacg

SEQ ID NO: 164890 - RNA, 20 nt, Human
caaggaaggcagaacgcacg

SEQ ID NO: 164891 - RNA, 22 nt, Human
caagugacucuccugccucagc

SEQ ID NO: 164892 - RNA, 21 nt, Human
caccauguuggccaggcuggu

SEQ ID NO: 164893 - RNA, 22 nt, Human
caccauguuggccaggcugguc

SEQ ID NO: 164894 - RNA, 27 nt, Human
caccauguuggccaggcuggucuggaa

SEQ ID NO: 164895 - RNA, 26 nt, Human
caccucugcucggugaaaauuaagaa

SEQ ID NO: 164896 - RNA, 26 nt, Human
caccucugcucggugaaaauuaagaa

SEQ ID NO: 164897 - RNA, 18 nt, Human
caccuugaguccuacugg

SEQ ID NO: 164898 - RNA, 18 nt, Human
caccuugaguccuacugg

SEQ ID NO: 164899 - RNA, 20 nt, Human
caccuuuuuccagccagcca

SEQ ID NO: 164900 - RNA, 20 nt, Human
cagaaaccuucuucuccucc

SEQ ID NO: 164901 - RNA, 20 nt, Human
cagaaaccuucuucuccucc

SEQ ID NO: 164902 - RNA, 20 nt, Human
cagaaggaacaacggcgaua

SEQ ID NO: 164903 - RNA, 21 nt, Human
cagaguaaucucagcuuccaa

SEQ ID NO: 164904 - RNA, 19 nt, Human
cagccagaacgcacggcag

SEQ ID NO: 164905 - RNA, 19 nt, Human
cagccagaacgcacggcag

SEQ ID NO: 164906 - RNA, 18 nt, Human
cagccagccacaggcuca

SEQ ID NO: 164907 - RNA, 24 nt, Human
caggguuucaccauguuggccagg

SEQ ID NO: 164908 - RNA, 26 nt, Human
caucuggcccagcaggcccagacugu

SEQ ID NO: 164909 - RNA, 19 nt, Human
cauggggucuggagaaaaa

SEQ ID NO: 164910 - RNA, 21 nt, Human
caugguucccuuugcacagag

SEQ ID NO: 164911 - RNA, 24 nt, Human
cauguuggccaggcuggucuggaa

SEQ ID NO: 164912 - RNA, 18 nt, Human
cauuucaacuaaggucug

SEQ ID NO: 164913 - RNA, 18 nt, Human
cauuucaacuaaggucug

SEQ ID NO: 164914 - RNA, 19 nt, Human
cauuuuagaacauuggcua

SEQ ID NO: 164915 - RNA, 23 nt, Human
ccaaagugcugggauuacaggca

SEQ ID NO: 164916 - RNA, 24 nt, Human
ccaaagugcugggauuacaggcau

SEQ ID NO: 164917 - RNA, 27 nt, Human
ccaccucugcucggugaaaauuaagaa

SEQ ID NO: 164918 - RNA, 18 nt, Human
ccagaaaccuucuucucc

SEQ ID NO: 164919 - RNA, 24 nt, Human
ccagaaaccuucuucuccuccugg

SEQ ID NO: 164920 - RNA, 24 nt, Human
ccagaaaccuucuucuccuccugg

SEQ ID NO: 164921 - RNA, 21 nt, Human
ccagccagccacaggcucagu

SEQ ID NO: 164922 - RNA, 21 nt, Human
ccagcccggagagcagucgcc

SEQ ID NO: 164923 - RNA, 18 nt, Human
ccauuuaaaaucaauaca

SEQ ID NO: 164924 - RNA, 18 nt, Human
ccauuuaaaaucaauaca

SEQ ID NO: 164925 - RNA, 24 nt, Human
cccaaagugcugggauuacaggca

SEQ ID NO: 164926 - RNA, 20 nt, Human
cccagacuguauccauccaa

SEQ ID NO: 164927 - RNA, 26 nt, Human
cccagcguccucaaaaguuacauucc

SEQ ID NO: 164928 - RNA, 24 nt, Human
ccccgcggcgcccgagcuuugugg

SEQ ID NO: 164929 - RNA, 23 nt, Human
ccccgguucaagugacucuccug

SEQ ID NO: 164930 - RNA, 27 nt, Human
ccccugaggucuccccaacaaccaucc

SEQ ID NO: 164931 - RNA, 21 nt, Human
cccgagcuuuguggcggccgc

SEQ ID NO: 164932 - RNA, 26 nt, Human
cccgccagcccggagagcagucgccg

SEQ ID NO: 164933 - RNA, 24 nt, Human
cccggaguagcugggauuacaggc

SEQ ID NO: 164934 - RNA, 21 nt, Human
cccucggaacaucuggcccag

SEQ ID NO: 164935 - RNA, 18 nt, Human
cccugaggucuccccaac

SEQ ID NO: 164936 - RNA, 20 nt, Human
ccgcgcgcgcucccucgccc

SEQ ID NO: 164937 - RNA, 21 nt, Human
ccggagagcagucgccgcgcc

SEQ ID NO: 164938 - RNA, 19 nt, Human
ccggaguagcugggauuac

SEQ ID NO: 164939 - RNA, 23 nt, Human
ccggaguagcugggauuacaggc

SEQ ID NO: 164940 - RNA, 24 nt, Human
ccggaguagcugggauuacaggcg

SEQ ID NO: 164941 - RNA, 21 nt, Human
ccgggccagguacgccgcaug

SEQ ID NO: 164942 - RNA, 20 nt, Human
ccgggcuucagcgcguaccc

SEQ ID NO: 164943 - RNA, 20 nt, Human
ccgggcuucagcgcguaccc

SEQ ID NO: 164944 - RNA, 20 nt, Human
ccucggauuuggggaacgag

SEQ ID NO: 164945 - RNA, 20 nt, Human
ccucggauuuggggaacgag

SEQ ID NO: 164946 - RNA, 24 nt, Human
ccugccucagccucccggaguagc

SEQ ID NO: 164947 - RNA, 25 nt, Human
ccugccucagccucccggaguagcu

SEQ ID NO: 164948 - RNA, 21 nt, Human
ccuugggucuucgccggcgcc

SEQ ID NO: 164949 - RNA, 21 nt, Human
ccuugggucuucgccggcgcc

SEQ ID NO: 164950 - RNA, 21 nt, Human
ccuugggucuucgccggcgcc

SEQ ID NO: 164951 - RNA, 22 nt, Human
cgacaucaccagucagcagcca

SEQ ID NO: 164952 - RNA, 23 nt, Human
cgagaggaagaaaggacucaggc

SEQ ID NO: 164953 - RNA, 23 nt, Human
cgagaggaagaaaggacucaggc

SEQ ID NO: 164954 - RNA, 19 nt, Human
cgagagguuggcugagguc

SEQ ID NO: 164955 - RNA, 23 nt, Human
cgcgaccuguguuguccccgcgc

SEQ ID NO: 164956 - RNA, 23 nt, Human
cgcgaccuguguuguccccgcgc

SEQ ID NO: 164957 - RNA, 21 nt, Human
cgcgaguugcgaaggcucaga

SEQ ID NO: 164958 - RNA, 19 nt, Human
cgcgcaggcaagcugcggc

SEQ ID NO: 164959 - RNA, 19 nt, Human
cgcgcgcgcucccucgccc

SEQ ID NO: 164960 - RNA, 19 nt, Human
cgggcauggacuacgcgca

SEQ ID NO: 164961 - RNA, 25 nt, Human
cguauccccaaaacuaucagcagaa

SEQ ID NO: 164962 - RNA, 21 nt, Human
cguccacuuuacacagaugac

SEQ ID NO: 164963 - RNA, 19 nt, Human
cucacuguaaccuccgccu

SEQ ID NO: 164964 - RNA, 25 nt, Human
cucacuguaaccuccgccuccccgg

SEQ ID NO: 164965 - RNA, 20 nt, Human
cuccagaaaccuucuucucc

SEQ ID NO: 164966 - RNA, 20 nt, Human
cuccagaaaccuucuucucc

SEQ ID NO: 164967 - RNA, 19 nt, Human
cuccccgguucaagugacu

SEQ ID NO: 164968 - RNA, 19 nt, Human
cuccugaagaacaagaacu

SEQ ID NO: 164969 - RNA, 24 nt, Human
cuccugaccucaugauccgccugc

SEQ ID NO: 164970 - RNA, 23 nt, Human
cuccugccucagccucccggagu

SEQ ID NO: 164971 - RNA, 21 nt, Human
cucgcucugucgccaaggcug

SEQ ID NO: 164972 - RNA, 19 nt, Human
cucggggcccccggggcuc

SEQ ID NO: 164973 - RNA, 26 nt, Human
cucuccugccucagccucccggagua

SEQ ID NO: 164974 - RNA, 24 nt, Human
cugaagaacaagaacuucuugugu

SEQ ID NO: 164975 - RNA, 24 nt, Human
cugccucagccucccggaguagcu

SEQ ID NO: 164976 - RNA, 23 nt, Human
cugccucggccucccaaagugcu

SEQ ID NO: 164977 - RNA, 22 nt, Human
cugcggaggagcgccaugacgc

SEQ ID NO: 164978 - RNA, 24 nt, Human
cuggaaugcaauggcaugaucucg

SEQ ID NO: 164979 - RNA, 22 nt, Human
cuguguuguccccggccccgcg

SEQ ID NO: 164980 - RNA, 22 nt, Human
cuguguuguccccggccccgcg

SEQ ID NO: 164981 - RNA, 24 nt, Human
cuuaaaaagauggacguaucccca

SEQ ID NO: 164982 - RNA, 24 nt, Human
cuuaaaaagauggacguaucccca

SEQ ID NO: 164983 - RNA, 20 nt, Human
cuuagagcuugugucuaaaa

SEQ ID NO: 164984 - RNA, 24 nt, Human
cuuguggcaguccacugcuccaga

SEQ ID NO: 164985 - RNA, 24 nt, Human
cuuguggcaguccacugcuccaga

SEQ ID NO: 164986 - RNA, 19 nt, Human
gaaugaguucuuuuaauau

SEQ ID NO: 164987 - RNA, 19 nt, Human
gaaugaguucuuuuaauau

SEQ ID NO: 164988 - RNA, 20 nt, Human
gaaugcaauggcaugaucuc

SEQ ID NO: 164989 - RNA, 22 nt, Human
gaccucaugauccgccugccuc

SEQ ID NO: 164990 - RNA, 22 nt, Human
gaccucaugauccgccugccuc

SEQ ID NO: 164991 - RNA, 24 nt, Human
gaccucaugauccgccugccucgg

SEQ ID NO: 164992 - RNA, 22 nt, Human
gagaggaagaaaggacucaggc

SEQ ID NO: 164993 - RNA, 18 nt, Human
gagcaacuccaaacgcaa

SEQ ID NO: 164994 - RNA, 18 nt, Human
gagcaacuccaaacgcaa

SEQ ID NO: 164995 - RNA, 18 nt, Human
gagcaacuccaaacgcaa

SEQ ID NO: 164996 - RNA, 18 nt, Human
gagcugaaggacucuugc

SEQ ID NO: 164997 - RNA, 20 nt, Human
gaggucuaagaacaaucguc

SEQ ID NO: 164998 - RNA, 25 nt, Human
gaguagcugggauuacaggcgcaca

SEQ ID NO: 164999 - RNA, 18 nt, Human
gauuacaggcaugagcca

SEQ ID NO: 165000 - RNA, 19 nt, Human
gauuacaggcaugagccac

SEQ ID NO: 165001 - RNA, 22 nt, Human
gauuacaggcaugagccacugc

SEQ ID NO: 165002 - RNA, 22 nt, Human
gauuacaggcaugagccacugc

SEQ ID NO: 165003 - RNA, 20 nt, Human
gcacaucuguacccuuuuca

SEQ ID NO: 165004 - RNA, 21 nt, Human
gccgggccagguacgccgcau

SEQ ID NO: 165005 - RNA, 22 nt, Human
gcgaccuguguuguccccgcgc

SEQ ID NO: 165006 - RNA, 22 nt, Human
gcgaccuguguuguccccgcgc

SEQ ID NO: 165007 - RNA, 23 nt, Human
gcgccgggccagguacgccgcau

SEQ ID NO: 165008 - RNA, 31 nt, Human
gcuacagcacaucuguacccuuuucaccugg

SEQ ID NO: 165009 - RNA, 19 nt, Human
gcuggaaugcaauggcaug

SEQ ID NO: 165010 - RNA, 23 nt, Human
gcuggucuggaacuccugaccuc

SEQ ID NO: 165011 - RNA, 21 nt, Human
ggaagaaaggacucaggcuug

SEQ ID NO: 165012 - RNA, 21 nt, Human
ggagaaagcgacgagcccggg

SEQ ID NO: 165013 - RNA, 21 nt, Human
ggagaaagcgacgagcccggg

SEQ ID NO: 165014 - RNA, 21 nt, Human
ggagaaagcgacgagcccggg

SEQ ID NO: 165015 - RNA, 22 nt, Human
ggauuacaggcaugagccacug

SEQ ID NO: 165016 - RNA, 24 nt, Human
ggcuggucuggaacuccugaccuc

SEQ ID NO: 165017 - RNA, 21 nt, Human
gggaacgagaggaagaaagga

SEQ ID NO: 165018 - RNA, 21 nt, Human
gggaacgagaggaagaaagga

SEQ ID NO: 165019 - RNA, 24 nt, Human
ggguguuuccaaagcaaaacacaa

SEQ ID NO: 165020 - RNA, 24 nt, Human
ggguguuuccaaagcaaaacacaa

SEQ ID NO: 165021 - RNA, 22 nt, Human
ggguuucaccauguuggccagg

SEQ ID NO: 165022 - RNA, 18 nt, Human
guagcugggauuacaggc

SEQ ID NO: 165023 - RNA, 24 nt, Human
gugacucuccugccucagccuccc

SEQ ID NO: 165024 - RNA, 20 nt, Human
gugagagggguuacauggug

SEQ ID NO: 165025 - RNA, 21 nt, Human
guggcaguccacugcuccaga

SEQ ID NO: 165026 - RNA, 21 nt, Human
guggcaguccacugcuccaga

SEQ ID NO: 165027 - RNA, 19 nt, Human
guguuucaauuuucuauga

SEQ ID NO: 165028 - RNA, 19 nt, Human
guguuucaauuuucuauga

SEQ ID NO: 165029 - RNA, 22 nt, Human
guguuuccaaagcaaaacacaa

SEQ ID NO: 165030 - RNA, 22 nt, Human
guguuuccaaagcaaaacacaa

SEQ ID NO: 165031 - RNA, 25 nt, Human
uaaaaucaauacaaaaaauaacucc

SEQ ID NO: 165032 - RNA, 25 nt, Human
uaaaaucaauacaaaaaauaacucc

SEQ ID NO: 165033 - RNA, 26 nt, Human
uaaacacaaauaaaucaaaacuucau

SEQ ID NO: 165034 - RNA, 26 nt, Human
uaaacacaaauaaaucaaaacuucau

SEQ ID NO: 165035 - RNA, 24 nt, Human
uaaaucaaaacuucauuuucccca

SEQ ID NO: 165036 - RNA, 24 nt, Human
uaaaucaaaacuucauuuucccca

SEQ ID NO: 165037 - RNA, 21 nt, Human
uaaccuccgccuccccgguuc

SEQ ID NO: 165038 - RNA, 24 nt, Human
uaagaucaguguaaucugcauuca

SEQ ID NO: 165039 - RNA, 24 nt, Human
uaagaucaguguaaucugcauuca

SEQ ID NO: 165040 - RNA, 24 nt, Human
uaauuuuuuguaucuuuaguagag

SEQ ID NO: 165041 - RNA, 25 nt, Human
uaauuuuuuguaucuuuaguagaga

SEQ ID NO: 165042 - RNA, 21 nt, Human
uacaaguggagacaacaagcu

SEQ ID NO: 165043 - RNA, 20 nt, Human
uacagcacaucuguacccuu

SEQ ID NO: 165044 - RNA, 22 nt, Human
uacaggcaugagccacugcgcc

SEQ ID NO: 165045 - RNA, 22 nt, Human
uacaguugcccuguuggggaaa

SEQ ID NO: 165046 - RNA, 23 nt, Human
uacauacauccagcaccuauaua

SEQ ID NO: 165047 - RNA, 23 nt, Human
uacauacauccagcaccuauaua

SEQ ID NO: 165048 - RNA, 21 nt, Human
uacgggcauggacuacgcgca

SEQ ID NO: 165049 - RNA, 21 nt, Human
uacgggcauggacuacgcgca

SEQ ID NO: 165050 - RNA, 21 nt, Human
uacgggcauggacuacgcgca

SEQ ID NO: 165051 - RNA, 21 nt, Human
uacgggcauggacuacgcgca

SEQ ID NO: 165052 - RNA, 24 nt, Human
uacugguccacagccagaacgcac

SEQ ID NO: 165053 - RNA, 24 nt, Human
uacugguccacagccagaacgcac

SEQ ID NO: 165054 - RNA, 22 nt, Human
uacugguccacagccaguacgc

SEQ ID NO: 165055 - RNA, 23 nt, Human
uacuuuaguacagaaggaacaac

SEQ ID NO: 165056 - RNA, 23 nt, Human
uacuuuaguacagaaggaacaac

SEQ ID NO: 165057 - RNA, 22 nt, Human
uagagacaggguuucaccaugu

SEQ ID NO: 165058 - RNA, 19 nt, Human
uagaugccaggaacagaca

SEQ ID NO: 165059 - RNA, 26 nt, Human
uagcaaauagcuauuaaaaaaagaga

SEQ ID NO: 165060 - RNA, 26 nt, Human
uagcaaauagcuauuaaaaaaagaga

SEQ ID NO: 165061 - RNA, 23 nt, Human
uaggaggucuaagaacaaucguc

SEQ ID NO: 165062 - RNA, 23 nt, Human
uaggaggucuaagaacaaucguc

SEQ ID NO: 165063 - RNA, 24 nt, Human
uaguagagacaggguuucaccaug

SEQ ID NO: 165064 - RNA, 25 nt, Human
uaguagagacaggguuucaccaugu

SEQ ID NO: 165065 - RNA, 26 nt, Human
uaguagagacaggguuucaccauguu

SEQ ID NO: 165066 - RNA, 23 nt, Human
uauacaaguggagacaacaagcu

SEQ ID NO: 165067 - RNA, 23 nt, Human
uauacaaguggagacaacaagcu

SEQ ID NO: 165068 - RNA, 25 nt, Human
uauccccaaaacuaucagcagaaca

SEQ ID NO: 165069 - RNA, 25 nt, Human
uauccccaaaacuaucagcagaaca

SEQ ID NO: 165070 - RNA, 18 nt, Human
uaugcugauuacuuuucc

SEQ ID NO: 165071 - RNA, 20 nt, Human
uaugcugauuacuuuuccaa

SEQ ID NO: 165072 - RNA, 21 nt, Human
uauuuuuccaccucugcucgg

SEQ ID NO: 165073 - RNA, 21 nt, Human
uauuuuuccaccucugcucgg

SEQ ID NO: 165074 - RNA, 19 nt, Human
ucacuguaaccuccgccuc

SEQ ID NO: 165075 - RNA, 24 nt, Human
ucacuguaaccuccgccuccccgg

SEQ ID NO: 165076 - RNA, 25 nt, Human
ucacuguaaccuccgccuccccggu

SEQ ID NO: 165077 - RNA, 26 nt, Human
ucacuguaaccuccgccuccccgguu

SEQ ID NO: 165078 - RNA, 27 nt, Human
ucacuguaaccuccgccuccccgguuc

SEQ ID NO: 165079 - RNA, 19 nt, Human
ucaucuccugaagaacaag

SEQ ID NO: 165080 - RNA, 20 nt, Human
uccaaagcaaaacacaauac

SEQ ID NO: 165081 - RNA, 22 nt, Human
uccaaguauuccugaaagaagg

SEQ ID NO: 165082 - RNA, 21 nt, Human
uccacagccagaacgcacggc

SEQ ID NO: 165083 - RNA, 21 nt, Human
uccacagccagaacgcacggc

SEQ ID NO: 165084 - RNA, 22 nt, Human
uccauauauacaaguggagaca

SEQ ID NO: 165085 - RNA, 22 nt, Human
uccauauauacaaguggagaca

SEQ ID NO: 165086 - RNA, 24 nt, Human
ucccaaagugcugggauuacaggc

SEQ ID NO: 165087 - RNA, 24 nt, Human
uccccaaaacuaucagcagaacaa

SEQ ID NO: 165088 - RNA, 24 nt, Human
uccccaaaacuaucagcagaacaa

SEQ ID NO: 165089 - RNA, 23 nt, Human
uccccagcguccucaaaaguuac

SEQ ID NO: 165090 - RNA, 23 nt, Human
uccccgguccucuuccauaucuc

SEQ ID NO: 165091 - RNA, 23 nt, Human
uccccgguccucuuccauaucuc

SEQ ID NO: 165092 - RNA, 23 nt, Human
uccccgguccucuuccauaucuc

SEQ ID NO: 165093 - RNA, 23 nt, Human
uccccgguccucuuccauaucuc

SEQ ID NO: 165094 - RNA, 19 nt, Human
uccccgguucaagugacuc

SEQ ID NO: 165095 - RNA, 24 nt, Human
uccccgguucaagugacucuccug

SEQ ID NO: 165096 - RNA, 18 nt, Human
uccccugaggucucccca

SEQ ID NO: 165097 - RNA, 23 nt, Human
uccccugaggucuccccaacaac

SEQ ID NO: 165098 - RNA, 20 nt, Human
uccuuaugagcauuuuagaa

SEQ ID NO: 165099 - RNA, 18 nt, Human
ucggccucccaaagugcu

SEQ ID NO: 165100 - RNA, 19 nt, Human
ucuccugaagaacaagaac

SEQ ID NO: 165101 - RNA, 24 nt, Human
ucucgcucugucgccaaggcugga

SEQ ID NO: 165102 - RNA, 18 nt, Human
ucugauccauauauacaa

SEQ ID NO: 165103 - RNA, 18 nt, Human
ucugauccauauauacaa

SEQ ID NO: 165104 - RNA, 20 nt, Human
ucugauccauauauacaagu

SEQ ID NO: 165105 - RNA, 19 nt, Human
ucuggagaaaaaacagaau

SEQ ID NO: 165106 - RNA, 21 nt, Human
ucugugacggagcugaaggac

SEQ ID NO: 165107 - RNA, 24 nt, Human
ucuuuaguagagacaggguuucac

SEQ ID NO: 165108 - RNA, 18 nt, Human
ucuuuuuuuuuuuuuuuu

SEQ ID NO: 165109 - RNA, 18 nt, Human
ugaaacaccuuccuauga

SEQ ID NO: 165110 - RNA, 18 nt, Human
ugaaacaccuuccuauga

SEQ ID NO: 165111 - RNA, 19 nt, Human
ugaccaacuuuucccaguu

SEQ ID NO: 165112 - RNA, 21 nt, Human
ugagacagggucuucaauguu

SEQ ID NO: 165113 - RNA, 19 nt, Human
ugagagggguuacauggug

SEQ ID NO: 165114 - RNA, 19 nt, Human
ugagagggguuacauggug

SEQ ID NO: 165115 - RNA, 18 nt, Human
ugaggcuggaucuuuugg

SEQ ID NO: 165116 - RNA, 18 nt, Human
ugaggcuggaucuuuugg

SEQ ID NO: 165117 - RNA, 18 nt, Human
ugaguggguguuuccaaa

SEQ ID NO: 165118 - RNA, 18 nt, Human
ugaguggguguuuccaaa

SEQ ID NO: 165119 - RNA, 21 nt, Human
ugauggaagugaagggcccuc

SEQ ID NO: 165120 - RNA, 19 nt, Human
ugcacaccaaaaugaaaca

SEQ ID NO: 165121 - RNA, 19 nt, Human
ugcacaccaaaaugaaaca

SEQ ID NO: 165122 - RNA, 20 nt, Human
ugccagaauuagaugaaagc

SEQ ID NO: 165123 - RNA, 20 nt, Human
ugccagaauuagaugaaagc

SEQ ID NO: 165124 - RNA, 20 nt, Human
ugccucagccucccggagua

SEQ ID NO: 165125 - RNA, 25 nt, Human
ugccucagccucccggaguagcugg

SEQ ID NO: 165126 - RNA, 21 nt, Human
ugccucggccucccaaagugc

SEQ ID NO: 165127 - RNA, 24 nt, Human
ugccucggccucccaaagugcugg

SEQ ID NO: 165128 - RNA, 23 nt, Human
ugccuucagccugcggugggcuc

SEQ ID NO: 165129 - RNA, 23 nt, Human
ugccuucagccugcggugggcuc

SEQ ID NO: 165130 - RNA, 22 nt, Human
ugccuucagcugcggugggcuc

SEQ ID NO: 165131 - RNA, 22 nt, Human
ugccuucagcugcggugggcuc

SEQ ID NO: 165132 - RNA, 19 nt, Human
uggaaugcaauggcaugau

SEQ ID NO: 165133 - RNA, 24 nt, Human
uggaaugcaauggcaugaucucgg

SEQ ID NO: 165134 - RNA, 18 nt, Human
uggagaguacucugugac

SEQ ID NO: 165135 - RNA, 24 nt, Human
uggcaugaucucggcucacuguaa

SEQ ID NO: 165136 - RNA, 24 nt, Human
uggccaggcuggucuggaacuccu

SEQ ID NO: 165137 - RNA, 25 nt, Human
ugggaggcauggucucccugcucag

SEQ ID NO: 165138 - RNA, 25 nt, Human
ugggaggcauggucucccugcucag

SEQ ID NO: 165139 - RNA, 26 nt, Human
ugggaggcauggucucccugcucagu

SEQ ID NO: 165140 - RNA, 26 nt, Human
ugggaggcauggucucccugcucagu

SEQ ID NO: 165141 - RNA, 18 nt, Human
ugggauuacaggcaugag

SEQ ID NO: 165142 - RNA, 19 nt, Human
ugggauuacaggcaugagc

SEQ ID NO: 165143 - RNA, 21 nt, Human
ugggauuacaggcaugagcca

SEQ ID NO: 165144 - RNA, 22 nt, Human
ugggauuacaggcaugagccac

SEQ ID NO: 165145 - RNA, 22 nt, Human
ugggauuacaggcaugagccac

SEQ ID NO: 165146 - RNA, 23 nt, Human
ugggauuacaggcaugagccacu

SEQ ID NO: 165147 - RNA, 24 nt, Human
ugggauuacaggcaugagccacug

SEQ ID NO: 165148 - RNA, 24 nt, Human
ugggauuacaggcaugagccacug

SEQ ID NO: 165149 - RNA, 21 nt, Human
ugggauuacaggcgcacacca

SEQ ID NO: 165150 - RNA, 19 nt, Human
ugggauuacaggcgcacca

SEQ ID NO: 165151 - RNA, 26 nt, Human
uggggaacgagaggaagaaaggacuc

SEQ ID NO: 165152 - RNA, 26 nt, Human
uggggaacgagaggaagaaaggacuc

SEQ ID NO: 165153 - RNA, 18 nt, Human
uggggcauuuaggagguc

SEQ ID NO: 165154 - RNA, 18 nt, Human
uggggcauuuaggagguc

SEQ ID NO: 165155 - RNA, 19 nt, Human
ugguggcuuguggcagucc

SEQ ID NO: 165156 - RNA, 19 nt, Human
ugguggcuuguggcagucc

SEQ ID NO: 165157 - RNA, 23 nt, Human
uguaaucugcauucaucuugcac

SEQ ID NO: 165158 - RNA, 23 nt, Human
uguaaucugcauucaucuugcac

SEQ ID NO: 165159 - RNA, 21 nt, Human
uguccccgcgccccggcuggg

SEQ ID NO: 165160 - RNA, 20 nt, Human
ugucugauguagguaugagg

SEQ ID NO: 165161 - RNA, 20 nt, Human
ugucugauguagguaugagg

SEQ ID NO: 165162 - RNA, 22 nt, Human
uguggcaguccacugcuccaga

SEQ ID NO: 165163 - RNA, 26 nt, Human
uguucgagagguuggcugaggucccg

SEQ ID NO: 165164 - RNA, 22 nt, Human
uguuggggaaaugaugcuucuc

SEQ ID NO: 165165 - RNA, 19 nt, Human
uuaaaaaaagagagaccaa

SEQ ID NO: 165166 - RNA, 19 nt, Human
uuaaaaaaagagagaccaa

SEQ ID NO: 165167 - RNA, 27 nt, Human
uuaaacacaaauaaaucaaaacuucau

SEQ ID NO: 165168 - RNA, 24 nt, Human
uuacauacauccagcaccuauaua

SEQ ID NO: 165169 - RNA, 24 nt, Human
uuacauacauccagcaccuauaua

SEQ ID NO: 165170 - RNA, 24 nt, Human
uuagagcuugugucuaaaggguaa

SEQ ID NO: 165171 - RNA, 24 nt, Human
uuaguagagacaggguuucaccau

SEQ ID NO: 165172 - RNA, 23 nt, Human
uucaagugacucuccugccucag

SEQ ID NO: 165173 - RNA, 24 nt, Human
uucaagugacucuccugccucagc

SEQ ID NO: 165174 - RNA, 18 nt, Human
uucccugaaagcaaaagu

SEQ ID NO: 165175 - RNA, 21 nt, Human
uucugcuaucauuucaacuaa

SEQ ID NO: 165176 - RNA, 21 nt, Human
uucugcuaucauuucaacuaa

SEQ ID NO: 165177 - RNA, 26 nt, Human
uucuuuuuuuuuuuuuuuuuuugaga

SEQ ID NO: 165178 - RNA, 20 nt, Human
uugaauggcaacgcuccucc

SEQ ID NO: 165179 - RNA, 20 nt, Human
uugaauggcaacgcuccucc

SEQ ID NO: 165180 - RNA, 20 nt, Human
uugaauggcaacgcuccucc

SEQ ID NO: 165181 - RNA, 21 nt, Human
uugagacagggucuucaaugu

SEQ ID NO: 165182 - RNA, 23 nt, Human
uugccgggccgcccucggaacau

SEQ ID NO: 165183 - RNA, 26 nt, Human
uuuaaaaucaauacaaaaaauaacuc

SEQ ID NO: 165184 - RNA, 26 nt, Human
uuuaaaaucaauacaaaaaauaacuc

SEQ ID NO: 165185 - RNA, 24 nt, Human
uuuaaacacaaauaaaucaaaacu

SEQ ID NO: 165186 - RNA, 24 nt, Human
uuuaaacacaaauaaaucaaaacu

SEQ ID NO: 165187 - RNA, 27 nt, Human
uuuauucuuuucuuuucuuuuuuuuuu

SEQ ID NO: 165188 - RNA, 24 nt, Human
uuucaccauguuggccaggcuggu

SEQ ID NO: 165189 - RNA, 27 nt, Human
uuucuuuuuuuuuuuuuuuuuuugggg

SEQ ID NO: 165190 - RNA, 22 nt, Human
uuuuguaucuuuaguagagaca

SEQ ID NO: 165191 - RNA, 21 nt, Human
uuuuuguaucuuuaguagaga

SEQ ID NO: 165192 - RNA, 24 nt, Human
uuuuuuguaucuuuaguagagaca

SEQ ID NO: 165193 - RNA, 23 nt, Human
uuuuuuuuuugagacagggucuu

SEQ ID NO: 165194 - RNA, 20 nt, Human
uuuuuuuuuuugagacaggg

SEQ ID NO: 165195 - RNA, 23 nt, Human
uuuuuuuuuuuugagacaggguc

SEQ ID NO: 165196 - RNA, 25 nt, Human
uuuuuuuuuuuuuuugagacagggg

SEQ ID NO: 165197 - RNA, 20 nt, Human
aaagcccugguccucugcuu

SEQ ID NO: 165198 - RNA, 21 nt, Human
aacaagagugccaggggccca

SEQ ID NO: 165199 - RNA, 22 nt, Human
aacaagagugccaggggcccau

SEQ ID NO: 165200 - RNA, 21 nt, Human
aacaguacagaacgaaccaac

SEQ ID NO: 165201 - RNA, 22 nt, Human
aaccuuuugcauaaaagguaaa

SEQ ID NO: 165202 - RNA, 22 nt, Human
aagcuuugaaagguagcagucc

SEQ ID NO: 165203 - RNA, 20 nt, Human
aauaacaucggaaccugcac

SEQ ID NO: 165204 - RNA, 23 nt, Human
acacacacacacgcacacacaca

SEQ ID NO: 165205 - RNA, 23 nt, Human
acacacacgcacacacacacaca

SEQ ID NO: 165206 - RNA, 23 nt, Human
acacacacgcacacacacacaca

SEQ ID NO: 165207 - RNA, 24 nt, Human
acacgcacacacacacacacagac

SEQ ID NO: 165208 - RNA, 33 nt, Human
acacgcggaugugcacacacacacacacacggu

SEQ ID NO: 165209 - RNA, 20 nt, Human
acaguacagaacgaaccaac

SEQ ID NO: 165210 - RNA, 24 nt, Human
accgucucccugccugggacacac

SEQ ID NO: 165211 - RNA, 25 nt, Human
acgaaccaacugaauuccccacucg

SEQ ID NO: 165212 - RNA, 19 nt, Human
acgcacacacacacacaca

SEQ ID NO: 165213 - RNA, 20 nt, Human
agaaguguuaagucuacaac

SEQ ID NO: 165214 - RNA, 18 nt, Human
agaccccuggggccuccc

SEQ ID NO: 165215 - RNA, 21 nt, Human
agacucagggcccaguaacag

SEQ ID NO: 165216 - RNA, 20 nt, Human
aggcaagaugcgcacgcaca

SEQ ID NO: 165217 - RNA, 19 nt, Human
aggcaagcaagggacagcu

SEQ ID NO: 165218 - RNA, 25 nt, Human
aggcaagcaagggacagcugcccag

SEQ ID NO: 165219 - RNA, 18 nt, Human
auauauaccauauacaca

SEQ ID NO: 165220 - RNA, 19 nt, Human
auguuauauauauauaugu

SEQ ID NO: 165221 - RNA, 18 nt, Human
auucacggcuucccucca

SEQ ID NO: 165222 - RNA, 22 nt, Human
caaaaaauaaaucuccuaaaga

SEQ ID NO: 165223 - RNA, 26 nt, Human
cacacacacacacacacgcacacaca

SEQ ID NO: 165224 - RNA, 21 nt, Human
cacacacacacacacagacca

SEQ ID NO: 165225 - RNA, 26 nt, Human
cacacacacacacacgcacacacaca

SEQ ID NO: 165226 - RNA, 24 nt, Human
cacacacacacacgcacacacaca

SEQ ID NO: 165227 - RNA, 20 nt, Human
cacacacagaccaaagcucu

SEQ ID NO: 165228 - RNA, 25 nt, Human
cacacagaccaaagcucuguguagc

SEQ ID NO: 165229 - RNA, 19 nt, Human
caccagcagcagggagggc

SEQ ID NO: 165230 - RNA, 19 nt, Human
caccagcagcagggagggc

SEQ ID NO: 165231 - RNA, 24 nt, Human
cacugggccccaagaagagaccac

SEQ ID NO: 165232 - RNA, 18 nt, Human
cagccuuuuccucuuccc

SEQ ID NO: 165233 - RNA, 19 nt, Human
caguaacaguacagaacga

SEQ ID NO: 165234 - RNA, 22 nt, Human
cauggcccugcaggcaagcaag

SEQ ID NO: 165235 - RNA, 25 nt, Human
ccaacuauuaacaaccuuuuaggcu

SEQ ID NO: 165236 - RNA, 21 nt, Human
ccaccaugcacugggccccaa

SEQ ID NO: 165237 - RNA, 20 nt, Human
ccaguaacaguacagaacga

SEQ ID NO: 165238 - RNA, 18 nt, Human
ccauguggccagcuaaau

SEQ ID NO: 165239 - RNA, 19 nt, Human
cccagggccaugccugccu

SEQ ID NO: 165240 - RNA, 21 nt, Human
cccagggccaugccugccucc

SEQ ID NO: 165241 - RNA, 21 nt, Human
cccaguaacaguacagaacga

SEQ ID NO: 165242 - RNA, 18 nt, Human
ccccacgccccgcccagg

SEQ ID NO: 165243 - RNA, 20 nt, Human
ccccagaacaaaggccccuc

SEQ ID NO: 165244 - RNA, 21 nt, Human
cccccagaacaaaggccccuc

SEQ ID NO: 165245 - RNA, 20 nt, Human
ccccccagaacaaaggcccc

SEQ ID NO: 165246 - RNA, 24 nt, Human
ccccucccuggaaaccgucucccu

SEQ ID NO: 165247 - RNA, 19 nt, Human
ccccuggggccucccucca

SEQ ID NO: 165248 - RNA, 28 nt, Human
ccccuggggccucccuccacgccccccc

SEQ ID NO: 165249 - RNA, 19 nt, Human
cccguggugcaaaggcaga

SEQ ID NO: 165250 - RNA, 21 nt, Human
cccguggugcaaaggcagagg

SEQ ID NO: 165251 - RNA, 19 nt, Human
cccuggggccucccuccac

SEQ ID NO: 165252 - RNA, 26 nt, Human
ccucuggccaccaugcacugggcccc

SEQ ID NO: 165253 - RNA, 30 nt, Human
cgcggaugugcacacacacacacacacgca

SEQ ID NO: 165254 - RNA, 21 nt, Human
cguugcacagcagcggggaca

SEQ ID NO: 165255 - RNA, 23 nt, Human
cguuguaccagccuuuuccucuu

SEQ ID NO: 165256 - RNA, 23 nt, Human
cucccugccccacggggucccac

SEQ ID NO: 165257 - RNA, 21 nt, Human
cuccuaaagaaaaauccuaua

SEQ ID NO: 165258 - RNA, 18 nt, Human
cuccugaaaaaggacaaa

SEQ ID NO: 165259 - RNA, 18 nt, Human
cugcaggcaagcaaggga

SEQ ID NO: 165260 - RNA, 20 nt, Human
cugguccucugcuugcaugg

SEQ ID NO: 165261 - RNA, 19 nt, Human
gaaccaacugaauucacgg

SEQ ID NO: 165262 - RNA, 25 nt, Human
gaagaauuuguaugaaaauaccagc

SEQ ID NO: 165263 - RNA, 21 nt, Human
gaauucacggcuucccuccaa

SEQ ID NO: 165264 - RNA, 26 nt, Human
gaugcgcacgcacacaggcacacgcg

SEQ ID NO: 165265 - RNA, 24 nt, Human
gcacacaggcacacgcggaugugc

SEQ ID NO: 165266 - RNA, 23 nt, Human
gcacgcacacaggcacacgcgga

SEQ ID NO: 165267 - RNA, 24 nt, Human
gcacugggccccaagaagagacca

SEQ ID NO: 165268 - RNA, 20 nt, Human
gcagcagggagggcugcuag

SEQ ID NO: 165269 - RNA, 18 nt, Human
gcccagacucagggccca

SEQ ID NO: 165270 - RNA, 23 nt, Human
gcccccagggucgcaggccuccg

SEQ ID NO: 165271 - RNA, 18 nt, Human
gcccccccacgccccgcc

SEQ ID NO: 165272 - RNA, 21 nt, Human
gcccccccacgccccgcccag

SEQ ID NO: 165273 - RNA, 19 nt, Human
gcuucccugcaggcucagc

SEQ ID NO: 165274 - RNA, 18 nt, Human
gggaagugggaaagccug

SEQ ID NO: 165275 - RNA, 23 nt, Human
gggacagcugcccagacucaggg

SEQ ID NO: 165276 - RNA, 24 nt, Human
ggugggaagugggaaagccuggag

SEQ ID NO: 165277 - RNA, 22 nt, Human
uaaaacaaaacugcggugccag

SEQ ID NO: 165278 - RNA, 19 nt, Human
uaacaccccaggcacaagg

SEQ ID NO: 165279 - RNA, 22 nt, Human
uacacagcaucuauuuauagaa

SEQ ID NO: 165280 - RNA, 22 nt, Human
uacccguaauuucagucucuga

SEQ ID NO: 165281 - RNA, 24 nt, Human
uagcuuuacaaauauacaggucca

SEQ ID NO: 165282 - RNA, 19 nt, Human
uauauagauauauauaaac

SEQ ID NO: 165283 - RNA, 19 nt, Human
uauauauaccauauacaca

SEQ ID NO: 165284 - RNA, 31 nt, Human
uauauauauauauguauauauaccauaauau

SEQ ID NO: 165285 - RNA, 18 nt, Human
uauauauauguauauaua

SEQ ID NO: 165286 - RNA, 23 nt, Human
uauauguauauauaccauauaca

SEQ ID NO: 165287 - RNA, 23 nt, Human
ucaccuccaacuauuaacaaccu

SEQ ID NO: 165288 - RNA, 23 nt, Human
ucacuggaaucaccuccaacuau

SEQ ID NO: 165289 - RNA, 19 nt, Human
uccacgcccccccacgccc

SEQ ID NO: 165290 - RNA, 22 nt, Human
uccagcuccggggcaggcugga

SEQ ID NO: 165291 - RNA, 24 nt, Human
uccauauauguuauauauauauau

SEQ ID NO: 165292 - RNA, 18 nt, Human
ucccuccacgccccccca

SEQ ID NO: 165293 - RNA, 21 nt, Human
ucccuggaaaccgucucccug

SEQ ID NO: 165294 - RNA, 23 nt, Human
uccugaaaaaggacaaagcaaau

SEQ ID NO: 165295 - RNA, 23 nt, Human
ucgcuggguuaacaaaaucgcac

SEQ ID NO: 165296 - RNA, 25 nt, Human
ucggugcugcagcaccagucaggag

SEQ ID NO: 165297 - RNA, 23 nt, Human
ucugcacuggguccccccagaac

SEQ ID NO: 165298 - RNA, 27 nt, Human
ugaaaaaggacaaagcaaauaaaauaa

SEQ ID NO: 165299 - RNA, 25 nt, Human
ugcacacacacacacacacgcacac

SEQ ID NO: 165300 - RNA, 23 nt, Human
ugccagaaaaagcccugguccuc

SEQ ID NO: 165301 - RNA, 24 nt, Human
ugccaggggcccauaaauagcuuu

SEQ ID NO: 165302 - RNA, 24 nt, Human
uggccaccaugcacugggccccaa

SEQ ID NO: 165303 - RNA, 18 nt, Human
ugggaaagccuggaggug

SEQ ID NO: 165304 - RNA, 21 nt, Human
ugggaacaagagugccagggg

SEQ ID NO: 165305 - RNA, 23 nt, Human
ugggaggggccgagcgcacccug

SEQ ID NO: 165306 - RNA, 22 nt, Human
uggggcuucccugcaggcucag

SEQ ID NO: 165307 - RNA, 19 nt, Human
ugucgggcccagcucccug

SEQ ID NO: 165308 - RNA, 25 nt, Human
ugugcacacacacacacacacgcac

SEQ ID NO: 165309 - RNA, 23 nt, Human
uguuauauauauauauguauaua

SEQ ID NO: 165310 - RNA, 18 nt, Human
uguuggggaccaguggcc

SEQ ID NO: 165311 - RNA, 19 nt, Human
uucacuggaaucaccucca

SEQ ID NO: 165312 - RNA, 21 nt, Human
uucuuggccgucccucuaucg

SEQ ID NO: 165313 - RNA, 21 nt, Human
uugggugacaccucuggccac

SEQ ID NO: 165314 - RNA, 23 nt, Human
uuuuuuuuuuuuuuuuuuucagg

SEQ ID NO: 165315 - RNA, 20 nt, Human
aaacccgggauggggacuaa

SEQ ID NO: 165316 - RNA, 24 nt, Human
acagcaacucugggccaggggccc

SEQ ID NO: 165317 - RNA, 20 nt, Human
accagccuaugugccugcac

SEQ ID NO: 165318 - RNA, 28 nt, Human
acugccuuccuggcuccuccccugucag

SEQ ID NO: 165319 - RNA, 19 nt, Human
agcagcagcagggggaggu

SEQ ID NO: 165320 - RNA, 23 nt, Human
aggacacaggcacggcagcucca

SEQ ID NO: 165321 - RNA, 20 nt, Human
aggcucagccaaacccggga

SEQ ID NO: 165322 - RNA, 18 nt, Human
agggacccaagcuggacu

SEQ ID NO: 165323 - RNA, 22 nt, Human
aggggguucagaggcccagaac

SEQ ID NO: 165324 - RNA, 21 nt, Human
caccagccuaugugccugcac

SEQ ID NO: 165325 - RNA, 19 nt, Human
cagcagcagcagggggagg

SEQ ID NO: 165326 - RNA, 20 nt, Human
cagcagcagcagggggaggu

SEQ ID NO: 165327 - RNA, 21 nt, Human
cagcagcagggggaggugugg

SEQ ID NO: 165328 - RNA, 24 nt, Human
cagcucucagggacccaagcugga

SEQ ID NO: 165329 - RNA, 20 nt, Human
caggacacaggcacggcagc

SEQ ID NO: 165330 - RNA, 22 nt, Human
ccaaacccgggauggggacuaa

SEQ ID NO: 165331 - RNA, 22 nt, Human
ccagaaccuccugcugguauug

SEQ ID NO: 165332 - RNA, 21 nt, Human
ccagcuucucugggcucaggg

SEQ ID NO: 165333 - RNA, 28 nt, Human
cccgucaagacgcuggggcagcagcagc

SEQ ID NO: 165334 - RNA, 18 nt, Human
ccgccgccucacucccag

SEQ ID NO: 165335 - RNA, 24 nt, Human
ccgccgccucacucccagcuccag

SEQ ID NO: 165336 - RNA, 19 nt, Human
ccuccugcugguauuggga

SEQ ID NO: 165337 - RNA, 26 nt, Human
ccugacauuugggccaucaggacaca

SEQ ID NO: 165338 - RNA, 18 nt, Human
ccugcacagccuugagcc

SEQ ID NO: 165339 - RNA, 18 nt, Human
cgccgccucacucccagc

SEQ ID NO: 165340 - RNA, 21 nt, Human
cgccucacucccagcuccagc

SEQ ID NO: 165341 - RNA, 24 nt, Human
cgucaagacgcuggggcagcagca

SEQ ID NO: 165342 - RNA, 18 nt, Human
cuccugcugguauuggga

SEQ ID NO: 165343 - RNA, 23 nt, Human
cuccuguuuucggcaggcuucca

SEQ ID NO: 165344 - RNA, 23 nt, Human
cugagccccaaggcccaaggcca

SEQ ID NO: 165345 - RNA, 20 nt, Human
cuguggcugagccccaaggc

SEQ ID NO: 165346 - RNA, 21 nt, Human
gagcagaacccugacauuugg

SEQ ID NO: 165347 - RNA, 22 nt, Human
gcagcagcagcagggggaggug

SEQ ID NO: 165348 - RNA, 19 nt, Human
gccccaaggcccaaggcca

SEQ ID NO: 165349 - RNA, 21 nt, Human
gccccaaggcccaaggccacc

SEQ ID NO: 165350 - RNA, 21 nt, Human
gccgcgaccccugcacgcggc

SEQ ID NO: 165351 - RNA, 20 nt, Human
gccucacucccagcuccagc

SEQ ID NO: 165352 - RNA, 21 nt, Human
gcuccuccgccgccucacucc

SEQ ID NO: 165353 - RNA, 24 nt, Human
ggcccuuggacacggcacagcaac

SEQ ID NO: 165354 - RNA, 19 nt, Human
ggcuguggcugagccccaa

SEQ ID NO: 165355 - RNA, 20 nt, Human
ggggagguguggggaaaggg

SEQ ID NO: 165356 - RNA, 21 nt, Human
gucaagacgcuggggcagcag

SEQ ID NO: 165357 - RNA, 21 nt, Human
gucaggcuguggcugagcccc

SEQ ID NO: 165358 - RNA, 25 nt, Human
uaaaacgccauuugcuccuguuuuc

SEQ ID NO: 165359 - RNA, 22 nt, Human
uagcagcucuccagccaggcuc

SEQ ID NO: 165360 - RNA, 19 nt, Human
uagcauagcagcucuccag

SEQ ID NO: 165361 - RNA, 19 nt, Human
uaucaaggucgagcacugu

SEQ ID NO: 165362 - RNA, 20 nt, Human
uaucaaggucgagcacugug

SEQ ID NO: 165363 - RNA, 20 nt, Human
uccaagaagccgagcagaaa

SEQ ID NO: 165364 - RNA, 20 nt, Human
ucgagcacugugucaggcug

SEQ ID NO: 165365 - RNA, 25 nt, Human
ucucagggacccaagcuggacuucc

SEQ ID NO: 165366 - RNA, 26 nt, Human
ucucagggacccaagcuggacuuccc

SEQ ID NO: 165367 - RNA, 20 nt, Human
ugguauugggaggcaggagg

SEQ ID NO: 165368 - RNA, 25 nt, Human
ugugccugcacagccuucucgucga

SEQ ID NO: 165369 - RNA, 23 nt, Human
uguggggaaaggggguucagagg

SEQ ID NO: 165370 - RNA, 24 nt, Human
uguggggaaaggggguucagaggc

SEQ ID NO: 165371 - RNA, 26 nt, Human
uguggggaaaggggguucagaggcca

SEQ ID NO: 165372 - RNA, 19 nt, Human
ugugucaggcuguggcuga

SEQ ID NO: 165373 - RNA, 18 nt, Human
uuagcauagcagcucucc

SEQ ID NO: 165374 - RNA, 22 nt, Human
aaauaccaaggccccuucucug

SEQ ID NO: 165375 - RNA, 18 nt, Human
acagcauaucugcacgug

SEQ ID NO: 165376 - RNA, 18 nt, Human
acagcauaucugcgugug

SEQ ID NO: 165377 - RNA, 18 nt, Human
acagcaugucugcgugug

SEQ ID NO: 165378 - RNA, 18 nt, Human
acccaaggcagguggcaa

SEQ ID NO: 165379 - RNA, 20 nt, Human
acgcgugugugugugugugu

SEQ ID NO: 165380 - RNA, 21 nt, Human
agcacgugugcgcgcaugugu

SEQ ID NO: 165381 - RNA, 18 nt, Human
aggcaauaucugcacgug

SEQ ID NO: 165382 - RNA, 28 nt, Human
aggcagguggcaaaaauagccgccaagg

SEQ ID NO: 165383 - RNA, 19 nt, Human
aggcggggauggaggcggg

SEQ ID NO: 165384 - RNA, 19 nt, Human
caaaaauagccgccaaggc

SEQ ID NO: 165385 - RNA, 21 nt, Human
caaaaauagccgccaaggcca

SEQ ID NO: 165386 - RNA, 20 nt, Human
cagaggcggggauggaggcg

SEQ ID NO: 165387 - RNA, 21 nt, Human
cagcacaucugcgcaugggug

SEQ ID NO: 165388 - RNA, 20 nt, Human
cagcaguaggggacuccugg

SEQ ID NO: 165389 - RNA, 23 nt, Human
cagcaguaggggacuccugggac

SEQ ID NO: 165390 - RNA, 21 nt, Human
cagcauaucugcacgugugug

SEQ ID NO: 165391 - RNA, 21 nt, Human
cagcauaucugcaugugugcg

SEQ ID NO: 165392 - RNA, 19 nt, Human
cagcauaucugcgccugug

SEQ ID NO: 165393 - RNA, 19 nt, Human
cagcauaucugcgugcgug

SEQ ID NO: 165394 - RNA, 21 nt, Human
cagcauaucugcgugcgugug

SEQ ID NO: 165395 - RNA, 23 nt, Human
cagcauaucugugcacaugugug

SEQ ID NO: 165396 - RNA, 23 nt, Human
cagcauaucugugcacgugugug

SEQ ID NO: 165397 - RNA, 21 nt, Human
cagcaugucugcgugugugug

SEQ ID NO: 165398 - RNA, 21 nt, Human
cagcuccguccuccauccucc

SEQ ID NO: 165399 - RNA, 23 nt, Human
caggcaauaucugcacgugugug

SEQ ID NO: 165400 - RNA, 24 nt, Human
caggcagcauaucugugcacgugu

SEQ ID NO: 165401 - RNA, 19 nt, Human
caggggacagaggcgggga

SEQ ID NO: 165402 - RNA, 22 nt, Human
cauauccgugugugugugugug

SEQ ID NO: 165403 - RNA, 22 nt, Human
caugucucugugcgugugcgug

SEQ ID NO: 165404 - RNA, 20 nt, Human
ccaggcagcauaucugcacc

SEQ ID NO: 165405 - RNA, 20 nt, Human
ccaggcagcauaucugcgcc

SEQ ID NO: 165406 - RNA, 18 nt, Human
ccccaaccccagcccaca

SEQ ID NO: 165407 - RNA, 21 nt, Human
cccccaaccccagcccacagc

SEQ ID NO: 165408 - RNA, 24 nt, Human
ccucaucaacuaugagccucacgg

SEQ ID NO: 165409 - RNA, 19 nt, Human
ccucgccauggguccccug

SEQ ID NO: 165410 - RNA, 25 nt, Human
cggauaccauaucugcacgugugug

SEQ ID NO: 165411 - RNA, 23 nt, Human
cggcauaucugugcaugugcgug

SEQ ID NO: 165412 - RNA, 20 nt, Human
cggggacagaggcgggcaga

SEQ ID NO: 165413 - RNA, 18 nt, Human
cggggauggaggcgggga

SEQ ID NO: 165414 - RNA, 27 nt, Human
cgugugcgcgcaugugugugcauacau

SEQ ID NO: 165415 - RNA, 20 nt, Human
cucacggcacacguacugca

SEQ ID NO: 165416 - RNA, 21 nt, Human
cugcaugugugugccuguccu

SEQ ID NO: 165417 - RNA, 22 nt, Human
cugugcgugugcgugcauuugg

SEQ ID NO: 165418 - RNA, 21 nt, Human
cuguguguguguguccagggg

SEQ ID NO: 165419 - RNA, 30 nt, Human
gacagaggcgggcagaguugggggagugaa

SEQ ID NO: 165420 - RNA, 24 nt, Human
gagagaccacagucccugcaaccc

SEQ ID NO: 165421 - RNA, 18 nt, Human
gcacgugugcgcgcaugu

SEQ ID NO: 165422 - RNA, 21 nt, Human
gcagcauuaucugugugucca

SEQ ID NO: 165423 - RNA, 24 nt, Human
gcagcuuaucugugugcccaggcg

SEQ ID NO: 165424 - RNA, 19 nt, Human
gcauaucugcaugugugug

SEQ ID NO: 165425 - RNA, 25 nt, Human
gcaugugcgugugugcguacgugug

SEQ ID NO: 165426 - RNA, 22 nt, Human
gccaggggacagaggcggggau

SEQ ID NO: 165427 - RNA, 20 nt, Human
gcccccaaccccagcccaca

SEQ ID NO: 165428 - RNA, 22 nt, Human
gcugugcccccaaccccagccc

SEQ ID NO: 165429 - RNA, 23 nt, Human
gggacugaggcggggacagaggc

SEQ ID NO: 165430 - RNA, 20 nt, Human
ggggguggugucuggccugg

SEQ ID NO: 165431 - RNA, 21 nt, Human
ggggugggggguggugucugg

SEQ ID NO: 165432 - RNA, 22 nt, Human
gucccgggccccaggagagacc

SEQ ID NO: 165433 - RNA, 24 nt, Human
gucucugugcgugugcgugcauuu

SEQ ID NO: 165434 - RNA, 23 nt, Human
gucuguguguguguguccagggg

SEQ ID NO: 165435 - RNA, 21 nt, Human
gugcacgcgugugugugugug

SEQ ID NO: 165436 - RNA, 25 nt, Human
gugugugcauacaugcauccaggua

SEQ ID NO: 165437 - RNA, 27 nt, Human
uaaaauuacagagaucuggggccacca

SEQ ID NO: 165438 - RNA, 20 nt, Human
uaaauauaaauaccaaggcc

SEQ ID NO: 165439 - RNA, 26 nt, Human
uagugugugugucugugugugugugu

SEQ ID NO: 165440 - RNA, 19 nt, Human
uauccgugugugugugugu

SEQ ID NO: 165441 - RNA, 24 nt, Human
uaucugcaugugugcgugcgugug

SEQ ID NO: 165442 - RNA, 25 nt, Human
ucccgggccccaggagagaccacag

SEQ ID NO: 165443 - RNA, 22 nt, Human
ucccugcaacccagucuuccuu

SEQ ID NO: 165444 - RNA, 22 nt, Human
uccuccucgccauggguccccu

SEQ ID NO: 165445 - RNA, 21 nt, Human
ucucugugcgugugcgugcau

SEQ ID NO: 165446 - RNA, 18 nt, Human
ucugcacgugugugagug

SEQ ID NO: 165447 - RNA, 26 nt, Human
ucugcgcaugggugugcguguguaug

SEQ ID NO: 165448 - RNA, 30 nt, Human
ugcauacaugcauccagguagugugugugg

SEQ ID NO: 165449 - RNA, 18 nt, Human
ugcaugugugugccuguc

SEQ ID NO: 165450 - RNA, 23 nt, Human
ugcccccaaccccagcccacagc

SEQ ID NO: 165451 - RNA, 23 nt, Human
ugcgugugcgugcauuugggcag

SEQ ID NO: 165452 - RNA, 22 nt, Human
uggggugggggguggugucugg

SEQ ID NO: 165453 - RNA, 18 nt, Human
ugucuguguguguguguc

SEQ ID NO: 165454 - RNA, 22 nt, Human
ugugcacauguguguguccagg

SEQ ID NO: 165455 - RNA, 18 nt, Human
ugugcacgcgugugugug

SEQ ID NO: 165456 - RNA, 21 nt, Human
ugugcacgcgugugugugugu

SEQ ID NO: 165457 - RNA, 22 nt, Human
ugugcaugugcgugugugcgua

SEQ ID NO: 165458 - RNA, 19 nt, Human
ugugcgcgcaugugugugc

SEQ ID NO: 165459 - RNA, 20 nt, Human
ugugcgcgcaugugugugca

SEQ ID NO: 165460 - RNA, 22 nt, Human
ugugcgcgcaugugugugcaua

SEQ ID NO: 165461 - RNA, 19 nt, Human
ugugcgugugcgugcauuu

SEQ ID NO: 165462 - RNA, 23 nt, Human
uguguauguucaggcagcauguc

SEQ ID NO: 165463 - RNA, 21 nt, Human
ugugucagggggagaaugcag

SEQ ID NO: 165464 - RNA, 33 nt, Human
ugugugcauacaugcauccagguaguguguggu

SEQ ID NO: 165465 - RNA, 18 nt, Human
ugugugcgugcgugugua

SEQ ID NO: 165466 - RNA, 19 nt, Human
ugugugugcauacaugcau

SEQ ID NO: 165467 - RNA, 18 nt, Human
ugugugugucugugugug

SEQ ID NO: 165468 - RNA, 21 nt, Human
ugugugugucugugugugugu

SEQ ID NO: 165469 - RNA, 21 nt, Human
ugugugugucugugugugugu

SEQ ID NO: 165470 - RNA, 22 nt, Human
ugugugugucugugugugugug

SEQ ID NO: 165471 - RNA, 18 nt, Human
uuggggcugcugugcccc

SEQ ID NO: 165472 - RNA, 21 nt, Human
uuguauguucuggcaugucuc

SEQ ID NO: 165473 - RNA, 18 nt, Human
uuuuuuuuuuuuggaggg

SEQ ID NO: 165474 - RNA, 19 nt, Human
uuuuuuuuuuuuuuggagg

SEQ ID NO: 165475 - RNA, 18 nt, Human
uuuuuuuuuuuuuuuuug

SEQ ID NO: 165476 - RNA, 24 nt, Human
uuuuuuuuuuuuuuuuuuggaggg

SEQ ID NO: 165477 - RNA, 19 nt, Human
aauacaguccuaaaugagu

SEQ ID NO: 165478 - RNA, 25 nt, Human
agcauaaaacuguuauggaguuuuc

SEQ ID NO: 165479 - RNA, 24 nt, Human
aguaaaucucuuuugaaacggucu

SEQ ID NO: 165480 - RNA, 21 nt, Human
aguaagagaaaaagggaagaa

SEQ ID NO: 165481 - RNA, 24 nt, Human
agugcccggagcuccgagccuugu

SEQ ID NO: 165482 - RNA, 21 nt, Human
cucuguucagauaaaguccuu

SEQ ID NO: 165483 - RNA, 22 nt, Human
cugaaacuuugugggucaauag

SEQ ID NO: 165484 - RNA, 20 nt, Human
gcccggagcuccgagccuug

SEQ ID NO: 165485 - RNA, 31 nt, Human
uaaaacuguuauggaguuuucaacauggggg

SEQ ID NO: 165486 - RNA, 18 nt, Human
uaagagaaaaagggaaga

SEQ ID NO: 165487 - RNA, 26 nt, Human
uugaaaucaauaaauauaguaagaga

SEQ ID NO: 165488 - RNA, 19 nt, Human
aaaagcacuacucacaaca

SEQ ID NO: 165489 - RNA, 18 nt, Human
aaacgaaagcccaacagc

SEQ ID NO: 165490 - RNA, 23 nt, Human
aaacgaaagcccaacagcagcaa

SEQ ID NO: 165491 - RNA, 22 nt, Human
aaaucacuuuaaacaaagcuga

SEQ ID NO: 165492 - RNA, 21 nt, Human
acauuaaguaacaaaggcaag

SEQ ID NO: 165493 - RNA, 26 nt, Human
agcugaauugcagaaacgaaagccca

SEQ ID NO: 165494 - RNA, 20 nt, Human
aguaacaaaggcaagugaga

SEQ ID NO: 165495 - RNA, 24 nt, Human
aguaacaaaggcaagugagaagaa

SEQ ID NO: 165496 - RNA, 23 nt, Human
agucagaagugagucagagaccc

SEQ ID NO: 165497 - RNA, 25 nt, Human
cgaaagcccaacagcagcuggagac

SEQ ID NO: 165498 - RNA, 18 nt, Human
gaaaagcacuacucacaa

SEQ ID NO: 165499 - RNA, 27 nt, Human
gcugaauugcagaaacgaaagcccagu

SEQ ID NO: 165500 - RNA, 24 nt, Human
uaaacaaagcugaauugcagaaac

SEQ ID NO: 165501 - RNA, 19 nt, Human
ugaaaaaacuaaagucaga

SEQ ID NO: 165502 - RNA, 24 nt, Human
ugaaaaaacuaaagucagaaguga

SEQ ID NO: 165503 - RNA, 24 nt, Human
ugaauugcagaaacgaaagcccaa

SEQ ID NO: 165504 - RNA, 19 nt, Human
ugagaagaaugaaaagcac

SEQ ID NO: 165505 - RNA, 21 nt, Human
ugagaagaaugaaaagcacua

SEQ ID NO: 165506 - RNA, 21 nt, Human
uggugaauauugcauaucugc

SEQ ID NO: 165507 - RNA, 21 nt, Human
uuaucaugauugcgcauggau

SEQ ID NO: 165508 - RNA, 22 nt, Human
uugaaaaaacuaaagucagaag

SEQ ID NO: 165509 - RNA, 21 nt, Human
gauaacgaauaccuggaggaa

SEQ ID NO: 165510 - RNA, 24 nt, Human
uacagugcugcucacccagcaggg

SEQ ID NO: 165511 - RNA, 19 nt, Human
uaccuggaggaaugaacag

SEQ ID NO: 165512 - RNA, 21 nt, Human
ugaaaaauaugaaacaaggca

SEQ ID NO: 165513 - RNA, 22 nt, Human
uuuagcuaugaaaaauaugaaa

SEQ ID NO: 165514 - RNA, 19 nt, Human
aacagcucuggggauuggc

SEQ ID NO: 165515 - RNA, 24 nt, Human
aacuucucccucaaaccugggccc

SEQ ID NO: 165516 - RNA, 24 nt, Human
aaggaccccugccaggugcaccag

SEQ ID NO: 165517 - RNA, 18 nt, Human
aaguggaaaaggaagaaa

SEQ ID NO: 165518 - RNA, 21 nt, Human
aaguggaaaaggaagaaauag

SEQ ID NO: 165519 - RNA, 19 nt, Human
acucaaggaccccugccag

SEQ ID NO: 165520 - RNA, 23 nt, Human
agugauaggagagaagugaggga

SEQ ID NO: 165521 - RNA, 25 nt, Human
augcacaugcucauacgcucauaca

SEQ ID NO: 165522 - RNA, 19 nt, Human
augccucacucaaggaccc

SEQ ID NO: 165523 - RNA, 23 nt, Human
caaguagguugcccuagguggug

SEQ ID NO: 165524 - RNA, 20 nt, Human
caauaaaucaacacauacac

SEQ ID NO: 165525 - RNA, 26 nt, Human
cacacacgcgcaugcacaugcucaua

SEQ ID NO: 165526 - RNA, 19 nt, Human
caccuggacuagagugaga

SEQ ID NO: 165527 - RNA, 24 nt, Human
cagaccccaguccuggaccacugc

SEQ ID NO: 165528 - RNA, 18 nt, Human
ccacugcauccacccagc

SEQ ID NO: 165529 - RNA, 19 nt, Human
ccacugcauccacccagca

SEQ ID NO: 165530 - RNA, 19 nt, Human
ccacugcauccacccagca

SEQ ID NO: 165531 - RNA, 26 nt, Human
ccugugcacacacgcgcaugcacagu

SEQ ID NO: 165532 - RNA, 22 nt, Human
ccugugcacacacgcgcauggu

SEQ ID NO: 165533 - RNA, 19 nt, Human
cuaaguggaaaaggaagaa

SEQ ID NO: 165534 - RNA, 24 nt, Human
cugggccuccuuuugccccaucug

SEQ ID NO: 165535 - RNA, 24 nt, Human
cugugcacacacgcgcaugcacau

SEQ ID NO: 165536 - RNA, 18 nt, Human
gaaaaggaagaaauagug

SEQ ID NO: 165537 - RNA, 25 nt, Human
gaagugcucugcaaacuucucccuc

SEQ ID NO: 165538 - RNA, 21 nt, Human
gagaauagaggguagaaggga

SEQ ID NO: 165539 - RNA, 21 nt, Human
gcaaggacugguggccaccgc

SEQ ID NO: 165540 - RNA, 19 nt, Human
gggccagagcggaugagag

SEQ ID NO: 165541 - RNA, 22 nt, Human
gggcuuuggaagaacagcucug

SEQ ID NO: 165542 - RNA, 21 nt, Human
guaaaacaaguagguugcccu

SEQ ID NO: 165543 - RNA, 25 nt, Human
uaaaacaaguagguugcccuaggug

SEQ ID NO: 165544 - RNA, 24 nt, Human
uacagaauggggcaugccucacuc

SEQ ID NO: 165545 - RNA, 20 nt, Human
uacgcucauacaggcacgug

SEQ ID NO: 165546 - RNA, 21 nt, Human
uaggaaagcagugauaggaga

SEQ ID NO: 165547 - RNA, 21 nt, Human
ucagagcagccacguccucgg

SEQ ID NO: 165548 - RNA, 24 nt, Human
ucauacaggcacguggccuuuccc

SEQ ID NO: 165549 - RNA, 21 nt, Human
ucccucaaaccugggcccaga

SEQ ID NO: 165550 - RNA, 23 nt, Human
ucccucuugggccuagauugggg

SEQ ID NO: 165551 - RNA, 24 nt, Human
uccucggugaugcuaggacucuau

SEQ ID NO: 165552 - RNA, 24 nt, Human
ucugcaaacuucucccucaaaccu

SEQ ID NO: 165553 - RNA, 19 nt, Human
ugagaaagggcuacaggca

SEQ ID NO: 165554 - RNA, 20 nt, Human
ugcucugcaaacuucucccu

SEQ ID NO: 165555 - RNA, 22 nt, Human
ugcucugcaaacuucucccuca

SEQ ID NO: 165556 - RNA, 21 nt, Human
uggaccacugcauccacccag

SEQ ID NO: 165557 - RNA, 20 nt, Human
uggccuuucccucuugggcc

SEQ ID NO: 165558 - RNA, 20 nt, Human
ugggaagugcucugcaaacu

SEQ ID NO: 165559 - RNA, 20 nt, Human
ugggguucuaagccagccug

SEQ ID NO: 165560 - RNA, 21 nt, Human
acuuauccguuuuuaagaaau

SEQ ID NO: 165561 - RNA, 24 nt, Human
uuaaguucaauagcaguuuccuuu

SEQ ID NO: 165562 - RNA, 20 nt, Human
aaaaguccugugaccggaca

SEQ ID NO: 165563 - RNA, 23 nt, Human
aaacugguuggcaauagcucuuu

SEQ ID NO: 165564 - RNA, 21 nt, Human
aagaaacugcauuuucaugcu

SEQ ID NO: 165565 - RNA, 22 nt, Human
aaggagacagggggaaaccuca

SEQ ID NO: 165566 - RNA, 18 nt, Human
aauaaggagacaggggga

SEQ ID NO: 165567 - RNA, 21 nt, Human
aggauguugacagcugggaau

SEQ ID NO: 165568 - RNA, 22 nt, Human
aggcagagggagggagcgcggg

SEQ ID NO: 165569 - RNA, 24 nt, Human
aggcagagggagggagcgcggggc

SEQ ID NO: 165570 - RNA, 19 nt, Human
auaccuucuuucucuuucu

SEQ ID NO: 165571 - RNA, 23 nt, Human
caauagcucuuuugcuggaauuc

SEQ ID NO: 165572 - RNA, 23 nt, Human
cagagggcaaaaaguccugugac

SEQ ID NO: 165573 - RNA, 28 nt, Human
caguggauuucucuucuuuccugagcuu

SEQ ID NO: 165574 - RNA, 24 nt, Human
ccgccugagggacccgggaacaga

SEQ ID NO: 165575 - RNA, 22 nt, Human
ccucuuggggagaggcgggggg

SEQ ID NO: 165576 - RNA, 23 nt, Human
ccugugaccggacagagcagagc

SEQ ID NO: 165577 - RNA, 21 nt, Human
ccuucuuucucuuucucuccc

SEQ ID NO: 165578 - RNA, 22 nt, Human
cucacaguugaagucuuucaga

SEQ ID NO: 165579 - RNA, 25 nt, Human
cucuuucucucccuuccaccgucug

SEQ ID NO: 165580 - RNA, 24 nt, Human
cugggaaugaaaggcagagggagg

SEQ ID NO: 165581 - RNA, 21 nt, Human
cugguuggcaauagcucuuuu

SEQ ID NO: 165582 - RNA, 22 nt, Human
cuuucucuuucucucccuucca

SEQ ID NO: 165583 - RNA, 18 nt, Human
gacccgggaacagagggc

SEQ ID NO: 165584 - RNA, 20 nt, Human
gaguuggagugaccgaggug

SEQ ID NO: 165585 - RNA, 21 nt, Human
gauaccuucuuucucuuucuc

SEQ ID NO: 165586 - RNA, 19 nt, Human
ggaaugaaaggcagaggga

SEQ ID NO: 165587 - RNA, 23 nt, Human
ggcggucuucaaacugguuggca

SEQ ID NO: 165588 - RNA, 24 nt, Human
gggaaugaaaggcagagggaggga

SEQ ID NO: 165589 - RNA, 21 nt, Human
gggggaaaccucaaaucugcc

SEQ ID NO: 165590 - RNA, 20 nt, Human
ggucuaagcaggcagguauu

SEQ ID NO: 165591 - RNA, 23 nt, Human
uacagacuguucucaguggauuu

SEQ ID NO: 165592 - RNA, 19 nt, Human
uaccuucuuucucuuucuc

SEQ ID NO: 165593 - RNA, 23 nt, Human
uacggaccuuuacagacuguucu

SEQ ID NO: 165594 - RNA, 22 nt, Human
ucaaagcuuccaggauguugac

SEQ ID NO: 165595 - RNA, 18 nt, Human
ucaguggauuucucuucu

SEQ ID NO: 165596 - RNA, 22 nt, Human
ucaguuccucuuggggagaggc

SEQ ID NO: 165597 - RNA, 23 nt, Human
ucaguuccucuuggggagaggcg

SEQ ID NO: 165598 - RNA, 18 nt, Human
uccaggauguugacagcu

SEQ ID NO: 165599 - RNA, 19 nt, Human
ucuuucucuuucucucccc

SEQ ID NO: 165600 - RNA, 21 nt, Human
ugaaaggcagagggagggagc

SEQ ID NO: 165601 - RNA, 24 nt, Human
ugacagcugggaaugaaaggcaga

SEQ ID NO: 165602 - RNA, 19 nt, Human
ugcacagagcuuuuauaga

SEQ ID NO: 165603 - RNA, 19 nt, Human
ugcuggaauucaggaucug

SEQ ID NO: 165604 - RNA, 22 nt, Human
uggcaggaugcacagagcuuuu

SEQ ID NO: 165605 - RNA, 20 nt, Human
uggggagaggcgggggggcg

SEQ ID NO: 165606 - RNA, 21 nt, Human
uggggagaggcgggggggcgg

SEQ ID NO: 165607 - RNA, 19 nt, Human
ugggggaucacugguugaa

SEQ ID NO: 165608 - RNA, 23 nt, Human
uucaaacugguuggcaauagcuc

SEQ ID NO: 165609 - RNA, 22 nt, Human
uuccugagcuucaaagcuucca

SEQ ID NO: 165610 - RNA, 18 nt, Human
uucuuucucuuucucucc

SEQ ID NO: 165611 - RNA, 21 nt, Human
uugaagaauacaggaugguga

SEQ ID NO: 165612 - RNA, 21 nt, Human
uuucucuucuuuccugagcuu

SEQ ID NO: 165613 - RNA, 23 nt, Human
uuuuuuuuuugcagcagagaagg

SEQ ID NO: 165614 - RNA, 26 nt, Human
aaaaacaauaaaaaggaccgguaccc

SEQ ID NO: 165615 - RNA, 19 nt, Human
aagaacagaaggaagggcc

SEQ ID NO: 165616 - RNA, 26 nt, Human
acaaaagaacagaaggaagggcagag

SEQ ID NO: 165617 - RNA, 22 nt, Human
acaacagaagggacuuugcagu

SEQ ID NO: 165618 - RNA, 20 nt, Human
acagaauguagaaaugaggc

SEQ ID NO: 165619 - RNA, 18 nt, Human
acuacuacguuacaaggg

SEQ ID NO: 165620 - RNA, 21 nt, Human
aggacagcaggguuaguuuug

SEQ ID NO: 165621 - RNA, 25 nt, Human
aggcaugagaggcaucucagugggg

SEQ ID NO: 165622 - RNA, 21 nt, Human
aggccgaggcgcggcgguggc

SEQ ID NO: 165623 - RNA, 19 nt, Human
auaugcugcuuuauuucug

SEQ ID NO: 165624 - RNA, 18 nt, Human
augcaugucaguaggguu

SEQ ID NO: 165625 - RNA, 22 nt, Human
caaaagaacagaaggaagggca

SEQ ID NO: 165626 - RNA, 20 nt, Human
caagggauucaacuagucac

SEQ ID NO: 165627 - RNA, 23 nt, Human
caagggauucaacuagucacugu

SEQ ID NO: 165628 - RNA, 19 nt, Human
caccgaggccgaggcgcgg

SEQ ID NO: 165629 - RNA, 22 nt, Human
cacugugugcccuuauuugagu

SEQ ID NO: 165630 - RNA, 19 nt, Human
cagaagagggugagcagug

SEQ ID NO: 165631 - RNA, 21 nt, Human
cagcuaaguucaaauguuaau

SEQ ID NO: 165632 - RNA, 21 nt, Human
caggacaggagccccugucag

SEQ ID NO: 165633 - RNA, 21 nt, Human
ccgaggccgaggccggggucc

SEQ ID NO: 165634 - RNA, 19 nt, Human
ccgcugccugcaccgaggc

SEQ ID NO: 165635 - RNA, 22 nt, Human
cgcggcgguggcggcggcggcu

SEQ ID NO: 165636 - RNA, 18 nt, Human
cgcucagaaaacaugcca

SEQ ID NO: 165637 - RNA, 21 nt, Human
cggggaaaccaaacguuagua

SEQ ID NO: 165638 - RNA, 18 nt, Human
cuaaaugcuaauaugauc

SEQ ID NO: 165639 - RNA, 19 nt, Human
cuacacuucccaaaucacc

SEQ ID NO: 165640 - RNA, 26 nt, Human
cucagaaaacaugccacacggggaaa

SEQ ID NO: 165641 - RNA, 20 nt, Human
cugcauuucagguaagcggu

SEQ ID NO: 165642 - RNA, 20 nt, Human
cuuacaucacuaaguggcua

SEQ ID NO: 165643 - RNA, 19 nt, Human
gaaagcacaaaagaacaga

SEQ ID NO: 165644 - RNA, 18 nt, Human
gaagggcagaguucugau

SEQ ID NO: 165645 - RNA, 18 nt, Human
gaggcgcggcgguggcgg

SEQ ID NO: 165646 - RNA, 24 nt, Human
gaggcgcggcgguggcggcggcgg

SEQ ID NO: 165647 - RNA, 20 nt, Human
gcgguggcggcggcggcugc

SEQ ID NO: 165648 - RNA, 23 nt, Human
ggcgcggcgguggcggcggcgac

SEQ ID NO: 165649 - RNA, 18 nt, Human
ggcgguggcggcggcggc

SEQ ID NO: 165650 - RNA, 19 nt, Human
ggggcuaaaauauuuucau

SEQ ID NO: 165651 - RNA, 22 nt, Human
guuaguuuuguuaagcuuccag

SEQ ID NO: 165652 - RNA, 18 nt, Human
uaaguaggugauccugca

SEQ ID NO: 165653 - RNA, 20 nt, Human
uaaguaggugauccugcauu

SEQ ID NO: 165654 - RNA, 22 nt, Human
ucagaaaacaugccacacgggg

SEQ ID NO: 165655 - RNA, 21 nt, Human
ucagcuucucuaaccacuccu

SEQ ID NO: 165656 - RNA, 22 nt, Human
ucccagcugaggcaugagaggc

SEQ ID NO: 165657 - RNA, 22 nt, Human
ucggcggcggcggccgcugccu

SEQ ID NO: 165658 - RNA, 25 nt, Human
ucgugugucuacacgguggguccca

SEQ ID NO: 165659 - RNA, 24 nt, Human
ucucggcggcggcggccgcugccu

SEQ ID NO: 165660 - RNA, 18 nt, Human
ucuugcaugucguguguc

SEQ ID NO: 165661 - RNA, 19 nt, Human
ugacagaauguagaaauga

SEQ ID NO: 165662 - RNA, 22 nt, Human
ugacgauguuccucugaaacag

SEQ ID NO: 165663 - RNA, 25 nt, Human
ugaggcaugagaggcaucucagugg

SEQ ID NO: 165664 - RNA, 18 nt, Human
ugaguuggagcagccgcu

SEQ ID NO: 165665 - RNA, 21 nt, Human
ugaguuggagcagccgcugca

SEQ ID NO: 165666 - RNA, 23 nt, Human
ugcaaguuuccaaacccauaaac

SEQ ID NO: 165667 - RNA, 19 nt, Human
ugcucaacucccccucuag

SEQ ID NO: 165668 - RNA, 22 nt, Human
uggcagauaggauguauucggc

SEQ ID NO: 165669 - RNA, 22 nt, Human
uggcggcggcggcugcggacug

SEQ ID NO: 165670 - RNA, 19 nt, Human
ugggagaaaagacggaagg

SEQ ID NO: 165671 - RNA, 22 nt, Human
ugggagaaaagacggaaggaga

SEQ ID NO: 165672 - RNA, 21 nt, Human
ugggucccagcugaggcauga

SEQ ID NO: 165673 - RNA, 19 nt, Human
ugguugaaaacaacuucca

SEQ ID NO: 165674 - RNA, 19 nt, Human
uguauugucauuacauguu

SEQ ID NO: 165675 - RNA, 18 nt, Human
uguuaagcuuccagaagu

SEQ ID NO: 165676 - RNA, 23 nt, Human
uuaacacauggacaaagagcaga

SEQ ID NO: 165677 - RNA, 22 nt, Human
uuaguacggggaaaggucaguu

SEQ ID NO: 165678 - RNA, 18 nt, Human
uuccaaggugcugcgugg

SEQ ID NO: 165679 - RNA, 19 nt, Human
uugcugcaggguugcuuuu

SEQ ID NO: 165680 - RNA, 18 nt, Human
uuucucaggucuuucuac

SEQ ID NO: 165681 - RNA, 18 nt, Human
uuugcaguccucauuaac

SEQ ID NO: 165682 - RNA, 23 nt, Human
aaagcacuaaaggguuuaagcaa

SEQ ID NO: 165683 - RNA, 24 nt, Human
aaccuguagucccagcuacuuggg

SEQ ID NO: 165684 - RNA, 23 nt, Human
acaaagcacuaaaggguuuaagc

SEQ ID NO: 165685 - RNA, 24 nt, Human
acaaagcgagacuccgucccaaag

SEQ ID NO: 165686 - RNA, 19 nt, Human
accuguagucccagcuacu

SEQ ID NO: 165687 - RNA, 23 nt, Human
accuguagucccagcuacuuggg

SEQ ID NO: 165688 - RNA, 18 nt, Human
acugcacuccagccuggg

SEQ ID NO: 165689 - RNA, 23 nt, Human
acugcacuccagccugggcgaca

SEQ ID NO: 165690 - RNA, 18 nt, Human
agagcuugcagugagcug

SEQ ID NO: 165691 - RNA, 24 nt, Human
agagcuugcagugagcugagaucg

SEQ ID NO: 165692 - RNA, 24 nt, Human
agccugggcgacaaagcgagacuc

SEQ ID NO: 165693 - RNA, 19 nt, Human
aggcuggggcaggagaaug

SEQ ID NO: 165694 - RNA, 20 nt, Human
agguagagcuugcagugagc

SEQ ID NO: 165695 - RNA, 24 nt, Human
agguagagcuugcagugagcugag

SEQ ID NO: 165696 - RNA, 18 nt, Human
aguuuucagccacagucu

SEQ ID NO: 165697 - RNA, 22 nt, Human
auaaaaaucugugugugagauc

SEQ ID NO: 165698 - RNA, 24 nt, Human
aucgugccacugcacuccagccug

SEQ ID NO: 165699 - RNA, 24 nt, Human
caaaaauuucaaaccaucuuccca

SEQ ID NO: 165700 - RNA, 18 nt, Human
caaagcgagacuccgucc

SEQ ID NO: 165701 - RNA, 20 nt, Human
caacgggagguuacagagcu

SEQ ID NO: 165702 - RNA, 19 nt, Human
cacugcacuccagccuggg

SEQ ID NO: 165703 - RNA, 20 nt, Human
cacugcacuccagccugggc

SEQ ID NO: 165704 - RNA, 22 nt, Human
cacugcacuccagccugggcga

SEQ ID NO: 165705 - RNA, 23 nt, Human
cacugcacuccagccugggcgac

SEQ ID NO: 165706 - RNA, 24 nt, Human
cacugcacuccagccugggcgaca

SEQ ID NO: 165707 - RNA, 24 nt, Human
cagcuacuugggaggcuggggcag

SEQ ID NO: 165708 - RNA, 25 nt, Human
cagcucccgcccucgagaaaccccc

SEQ ID NO: 165709 - RNA, 25 nt, Human
ccacagucuccccaacuccggcucu

SEQ ID NO: 165710 - RNA, 20 nt, Human
ccacugcacuccagccuggg

SEQ ID NO: 165711 - RNA, 20 nt, Human
ccacugcacuccagccuggg

SEQ ID NO: 165712 - RNA, 21 nt, Human
ccacugcacuccagccugggc

SEQ ID NO: 165713 - RNA, 21 nt, Human
ccacugcacuccagccugggc

SEQ ID NO: 165714 - RNA, 24 nt, Human
ccacugcacuccagccugggcgac

SEQ ID NO: 165715 - RNA, 21 nt, Human
ccuguagucccagcuacuugg

SEQ ID NO: 165716 - RNA, 20 nt, Human
ccuugggucucgcaccggau

SEQ ID NO: 165717 - RNA, 24 nt, Human
cgagacuccgucccaaagucaaaa

SEQ ID NO: 165718 - RNA, 25 nt, Human
cgauuacaaaaauuucaaaccaucu

SEQ ID NO: 165719 - RNA, 18 nt, Human
cggcucugcuccccucuc

SEQ ID NO: 165720 - RNA, 20 nt, Human
cucgcuggcaccgggcgugg

SEQ ID NO: 165721 - RNA, 19 nt, Human
cugcuccccucuccuuggg

SEQ ID NO: 165722 - RNA, 28 nt, Human
cugguggcuaagccccucggccucccuc

SEQ ID NO: 165723 - RNA, 24 nt, Human
cuugcagugagcugagaucgugcc

SEQ ID NO: 165724 - RNA, 24 nt, Human
cuugguuuagacuugacgcaacgg

SEQ ID NO: 165725 - RNA, 23 nt, Human
gacuccuggcuuuucagcaaccu

SEQ ID NO: 165726 - RNA, 20 nt, Human
gagaaagaaaacauaaaaaa

SEQ ID NO: 165727 - RNA, 23 nt, Human
gagaucgugccacugcacuccag

SEQ ID NO: 165728 - RNA, 18 nt, Human
gaggcuggggcaggagaa

SEQ ID NO: 165729 - RNA, 22 nt, Human
gccacugcacuccagccugggc

SEQ ID NO: 165730 - RNA, 24 nt, Human
gccacugcacuccagccugggcga

SEQ ID NO: 165731 - RNA, 21 nt, Human
gccgugcccccgccccgggcu

SEQ ID NO: 165732 - RNA, 23 nt, Human
gcggcggucccggcccguacccu

SEQ ID NO: 165733 - RNA, 20 nt, Human
gcugagaucgugccacugca

SEQ ID NO: 165734 - RNA, 22 nt, Human
gcuggggcaggagaauggcgug

SEQ ID NO: 165735 - RNA, 23 nt, Human
ggacugaacuaucacaaagcacu

SEQ ID NO: 165736 - RNA, 19 nt, Human
ggcgcgggcggcugguggg

SEQ ID NO: 165737 - RNA, 19 nt, Human
ggcguggggcgcggggggc

SEQ ID NO: 165738 - RNA, 21 nt, Human
gggcguggggcgcggggggcg

SEQ ID NO: 165739 - RNA, 24 nt, Human
ggucauuaccuuauugaguuuaga

SEQ ID NO: 165740 - RNA, 22 nt, Human
gguuggagguacucacggcacc

SEQ ID NO: 165741 - RNA, 21 nt, Human
guggagcgcugcgcagcuccc

SEQ ID NO: 165742 - RNA, 22 nt, Human
guggagcgcugcgcagcucccg

SEQ ID NO: 165743 - RNA, 24 nt, Human
uaaaggcaucauucaaaaggauuu

SEQ ID NO: 165744 - RNA, 30 nt, Human
uacaaaaauuucaaaccaucuucccaccuu

SEQ ID NO: 165745 - RNA, 24 nt, Human
uccagccugggcgacaaagcgaga

SEQ ID NO: 165746 - RNA, 23 nt, Human
ucgugccacugcacuccagccug

SEQ ID NO: 165747 - RNA, 22 nt, Human
ucucgcaccggauucggccccc

SEQ ID NO: 165748 - RNA, 19 nt, Human
ugagaucacaagcagcaac

SEQ ID NO: 165749 - RNA, 22 nt, Human
ugagaucacaagcagcaacuuc

SEQ ID NO: 165750 - RNA, 22 nt, Human
ugagcugagaucgugccacugc

SEQ ID NO: 165751 - RNA, 24 nt, Human
ugcacgccucggcucgcuggcacc

SEQ ID NO: 165752 - RNA, 23 nt, Human
ugccagccuagucuccaggaaga

SEQ ID NO: 165753 - RNA, 21 nt, Human
ugccugggugagaaagaaaac

SEQ ID NO: 165754 - RNA, 19 nt, Human
uggaagaaaccagaaggca

SEQ ID NO: 165755 - RNA, 19 nt, Human
uggcgugaaccaagaggua

SEQ ID NO: 165756 - RNA, 18 nt, Human
ugggaggcuggggcagga

SEQ ID NO: 165757 - RNA, 21 nt, Human
ugggcgacaaagcgagacucc

SEQ ID NO: 165758 - RNA, 23 nt, Human
uggggcaggagaauggcgugaac

SEQ ID NO: 165759 - RNA, 24 nt, Human
uggggcaggagaauggcgugaacc

SEQ ID NO: 165760 - RNA, 19 nt, Human
ugugagaucacaagcagca

SEQ ID NO: 165761 - RNA, 18 nt, Human
uguggcuggaagaaacca

SEQ ID NO: 165762 - RNA, 24 nt, Human
ugugugugagaucacaagcagcaa

SEQ ID NO: 165763 - RNA, 24 nt, Human
uucaaaccaucuucccaccuaggg

SEQ ID NO: 165764 - RNA, 18 nt, Human
uugcagugagcugagauc

SEQ ID NO: 165765 - RNA, 22 nt, Human
uugcagugagcugagaucgugc

SEQ ID NO: 165766 - RNA, 24 nt, Human
uugggugugccuuacucgauuaca

SEQ ID NO: 165767 - RNA, 24 nt, Human
uuuagacuugacgcaacgggaggu

SEQ ID NO: 165768 - RNA, 26 nt, Human
uuuagacuugacgcaacgggagguua

SEQ ID NO: 165769 - RNA, 23 nt, Human
uuucucuuucccugggacugaac

SEQ ID NO: 165770 - RNA, 18 nt, Human
uuuuuuuuucuguucuga

SEQ ID NO: 165771 - RNA, 22 nt, Human
uuuuuuuuuuuuuuuuucuguu

SEQ ID NO: 165772 - RNA, 23 nt, Human
uuuuuuuuuuuuuuuuuucuggg

SEQ ID NO: 165773 - RNA, 21 nt, Human
acacacacacauacacacaca

SEQ ID NO: 165774 - RNA, 25 nt, Human
acacacacacauacacacacacuca

SEQ ID NO: 165775 - RNA, 25 nt, Human
acacacaugcacaugcauaugcaug

SEQ ID NO: 165776 - RNA, 24 nt, Human
acauacacacacacucacaugcag

SEQ ID NO: 165777 - RNA, 31 nt, Human
acaugcacaugcauaugcaugcacacacaca

SEQ ID NO: 165778 - RNA, 25 nt, Human
auacacacacacucacaugcauaca

SEQ ID NO: 165779 - RNA, 24 nt, Human
auacacacacacucacaugcauag

SEQ ID NO: 165780 - RNA, 24 nt, Human
auaugcaugcacacacacacauac

SEQ ID NO: 165781 - RNA, 24 nt, Human
auaugcaugcacacacacacauag

SEQ ID NO: 165782 - RNA, 26 nt, Human
augcacaugcauaugcaugcacacag

SEQ ID NO: 165783 - RNA, 24 nt, Human
auucugcucugggcccuccucacu

SEQ ID NO: 165784 - RNA, 30 nt, Human
caaggagcucacacacaugcacaugcauag

SEQ ID NO: 165785 - RNA, 21 nt, Human
cacacacaugcacaugcauau

SEQ ID NO: 165786 - RNA, 30 nt, Human
cacacauacacacacacucacaugcauaca

SEQ ID NO: 165787 - RNA, 29 nt, Human
cacucacaugcauacacacacggcuaaua

SEQ ID NO: 165788 - RNA, 21 nt, Human
cacucugucaucuccugcacu

SEQ ID NO: 165789 - RNA, 23 nt, Human
cagaauucugcucugggcccucc

SEQ ID NO: 165790 - RNA, 25 nt, Human
caugcacacacacacauacacacac

SEQ ID NO: 165791 - RNA, 23 nt, Human
ccagauagauuuccgggauacag

SEQ ID NO: 165792 - RNA, 21 nt, Human
ccugggcacagaguucugggg

SEQ ID NO: 165793 - RNA, 22 nt, Human
cucacucugucaucuccugcac

SEQ ID NO: 165794 - RNA, 19 nt, Human
cuccugggcacagaguucu

SEQ ID NO: 165795 - RNA, 28 nt, Human
gcacacacacacauacacacacacucac

SEQ ID NO: 165796 - RNA, 20 nt, Human
gccagaauucugcucugggc

SEQ ID NO: 165797 - RNA, 24 nt, Human
gcuaauacugcucaaggcauggcu

SEQ ID NO: 165798 - RNA, 24 nt, Human
ggcuaauacugcucaaggcauggc

SEQ ID NO: 165799 - RNA, 21 nt, Human
gucaucuccugcacugcaguc

SEQ ID NO: 165800 - RNA, 20 nt, Human
guccagauagauuuccggga

SEQ ID NO: 165801 - RNA, 23 nt, Human
uacacacacacucacaugcauac

SEQ ID NO: 165802 - RNA, 22 nt, Human
uagauuuccgggauacagcacc

SEQ ID NO: 165803 - RNA, 23 nt, Human
uagauuuccgggauacagcaccu

SEQ ID NO: 165804 - RNA, 23 nt, Human
ucacacacaugcacaugcauaug

SEQ ID NO: 165805 - RNA, 24 nt, Human
ugcaugcacacacacacauacaca

SEQ ID NO: 165806 - RNA, 23 nt, Human
uggcuccugggcacagaguucug

SEQ ID NO: 165807 - RNA, 30 nt, Human
aaaaaacaaaaacaaaacuaaacaaaaggg

SEQ ID NO: 165808 - RNA, 25 nt, Human
aaaaacagugacagcaaccgguacc

SEQ ID NO: 165809 - RNA, 19 nt, Human
aaaaauaaucagaaggugg

SEQ ID NO: 165810 - RNA, 23 nt, Human
aaaacaaaaacaaaacuaaacaa

SEQ ID NO: 165811 - RNA, 19 nt, Human
aaaggauuacauggguccc

SEQ ID NO: 165812 - RNA, 27 nt, Human
aacuuuuuugcacaaccuucauggaag

SEQ ID NO: 165813 - RNA, 22 nt, Human
aagcagcaugcuguuaaaaaug

SEQ ID NO: 165814 - RNA, 19 nt, Human
aauggaagguuggucugga

SEQ ID NO: 165815 - RNA, 20 nt, Human
acacagaaaaccaaauaauc

SEQ ID NO: 165816 - RNA, 23 nt, Human
accaaaaaacaaaaacaaaacua

SEQ ID NO: 165817 - RNA, 24 nt, Human
accaaaaaacaaaaacaaaacuaa

SEQ ID NO: 165818 - RNA, 24 nt, Human
agaaagucaguacugaucauacga

SEQ ID NO: 165819 - RNA, 20 nt, Human
agaaggaaaguuugaaaccu

SEQ ID NO: 165820 - RNA, 20 nt, Human
agcaaaggacucagagacua

SEQ ID NO: 165821 - RNA, 21 nt, Human
agcacaccuuucucauucacc

SEQ ID NO: 165822 - RNA, 22 nt, Human
cacaccuuucucauucaccaaa

SEQ ID NO: 165823 - RNA, 23 nt, Human
cacaccuuucucauucaccaaaa

SEQ ID NO: 165824 - RNA, 19 nt, Human
caccaaaaaacaaaaacaa

SEQ ID NO: 165825 - RNA, 21 nt, Human
caccaaaaaacaaaaacaaaa

SEQ ID NO: 165826 - RNA, 22 nt, Human
caccaaaaaacaaaaacaaaac

SEQ ID NO: 165827 - RNA, 29 nt, Human
caccaaaaaacaaaaacaaaacuaaacaa

SEQ ID NO: 165828 - RNA, 18 nt, Human
caccaaugcuuacagcua

SEQ ID NO: 165829 - RNA, 21 nt, Human
caccugggaaaaaaacaguga

SEQ ID NO: 165830 - RNA, 24 nt, Human
cagcaugcuguuaaaaaugacagg

SEQ ID NO: 165831 - RNA, 22 nt, Human
cagcuagagaaaauuguuucaa

SEQ ID NO: 165832 - RNA, 22 nt, Human
cagugacagcaacuuggcaaag

SEQ ID NO: 165833 - RNA, 22 nt, Human
caucaaugaaccagggacuccu

SEQ ID NO: 165834 - RNA, 20 nt, Human
cauggguccccuccucucca

SEQ ID NO: 165835 - RNA, 18 nt, Human
ccaacucuggauugaaac

SEQ ID NO: 165836 - RNA, 19 nt, Human
ccugggaaaaaaacaguga

SEQ ID NO: 165837 - RNA, 19 nt, Human
cucuccaauguaugccgca

SEQ ID NO: 165838 - RNA, 25 nt, Human
gaagacauccaucaaugaaccaggg

SEQ ID NO: 165839 - RNA, 18 nt, Human
ggaaaguuugaaaccuca

SEQ ID NO: 165840 - RNA, 23 nt, Human
ggaagguuggucuggauucacug

SEQ ID NO: 165841 - RNA, 18 nt, Human
ggguggggagagagagau

SEQ ID NO: 165842 - RNA, 22 nt, Human
gugaauggaagguuggucugga

SEQ ID NO: 165843 - RNA, 20 nt, Human
guggugcuguguaaaaugga

SEQ ID NO: 165844 - RNA, 20 nt, Human
uaagcaguugacaucaggca

SEQ ID NO: 165845 - RNA, 25 nt, Human
uacauggguccccuccucuccauuc

SEQ ID NO: 165846 - RNA, 23 nt, Human
uaccugaaauuagaaagcacucu

SEQ ID NO: 165847 - RNA, 22 nt, Human
uacgcuuuuuuugcacaaucuu

SEQ ID NO: 165848 - RNA, 18 nt, Human
uagcuggugugaauggaa

SEQ ID NO: 165849 - RNA, 21 nt, Human
uaugacaccugccauuccaug

SEQ ID NO: 165850 - RNA, 20 nt, Human
ucaaaacuucacacagaaaa

SEQ ID NO: 165851 - RNA, 21 nt, Human
ucagaagguggacaugucuuc

SEQ ID NO: 165852 - RNA, 24 nt, Human
ucagagacuacaguuuuccucauc

SEQ ID NO: 165853 - RNA, 23 nt, Human
ucagucauaugacaccugccauu

SEQ ID NO: 165854 - RNA, 26 nt, Human
ucucauucaccaaaaaacaaaaacaa

SEQ ID NO: 165855 - RNA, 26 nt, Human
ugaaaaaaaucaaaauguucuccaaa

SEQ ID NO: 165856 - RNA, 20 nt, Human
ugcauaaaaaagaaucagaa

SEQ ID NO: 165857 - RNA, 18 nt, Human
ugcuuacagcuacagaaa

SEQ ID NO: 165858 - RNA, 19 nt, Human
uggugcuguguaaaaugga

SEQ ID NO: 165859 - RNA, 20 nt, Human
uguggugcuguguaaaaugg

SEQ ID NO: 165860 - RNA, 20 nt, Human
uucacaagaguugcgauuag

SEQ ID NO: 165861 - RNA, 25 nt, Human
uugaauaaugguguuuauuuucuuu

SEQ ID NO: 165862 - RNA, 22 nt, Human
uuuuuuuuuuuuuuuuuggcuu

SEQ ID NO: 165863 - RNA, 20 nt, Human
uuuuuuuuuuuuuuuuuugg

SEQ ID NO: 165864 - RNA, 21 nt, Human
cagcucccccgcaaccccucc

SEQ ID NO: 165865 - RNA, 23 nt, Human
caucaucaucaucaucaucaucu

SEQ ID NO: 165866 - RNA, 22 nt, Human
ccagcucccccgcaaccccucc

SEQ ID NO: 165867 - RNA, 24 nt, Human
ccaucaucaucaucaucaucaucu

SEQ ID NO: 165868 - RNA, 22 nt, Human
cccccgcaaccccuccggaccu

SEQ ID NO: 165869 - RNA, 20 nt, Human
ccgcgcugugcacgcgcugc

SEQ ID NO: 165870 - RNA, 20 nt, Human
ccuccggaccuggagccgcc

SEQ ID NO: 165871 - RNA, 21 nt, Human
ccugcaggcgccucucggugg

SEQ ID NO: 165872 - RNA, 24 nt, Human
ccugcaggcgccucucggugggcu

SEQ ID NO: 165873 - RNA, 19 nt, Human
ccuggagccgccuccgccc

SEQ ID NO: 165874 - RNA, 20 nt, Human
cucccccgcaaccccuccgg

SEQ ID NO: 165875 - RNA, 21 nt, Human
cucccccgcaaccccuccgga

SEQ ID NO: 165876 - RNA, 22 nt, Human
ucaucaucaucaucaucaucuc

SEQ ID NO: 165877 - RNA, 19 nt, Human
ugugcacgcgcugcgcgcg

SEQ ID NO: 165878 - RNA, 22 nt, Human
uuuccagcucccccgcaacccc

SEQ ID NO: 165879 - RNA, 21 nt, Human
aaacauuuuaaggaagugguu

SEQ ID NO: 165880 - RNA, 20 nt, Human
aaccuccuuccccccgccuc

SEQ ID NO: 165881 - RNA, 20 nt, Human
aagugguuuagggauggaag

SEQ ID NO: 165882 - RNA, 22 nt, Human
accuccuuccccccgccuccca

SEQ ID NO: 165883 - RNA, 20 nt, Human
agaaagagaaaguuugggga

SEQ ID NO: 165884 - RNA, 26 nt, Human
agcuaacuacagcccagucuggccuc

SEQ ID NO: 165885 - RNA, 23 nt, Human
aggagccagucaggauuggggag

SEQ ID NO: 165886 - RNA, 18 nt, Human
aggggcugggagugggga

SEQ ID NO: 165887 - RNA, 19 nt, Human
aggggcugggaguggggau

SEQ ID NO: 165888 - RNA, 18 nt, Human
aggucagucccaccgcca

SEQ ID NO: 165889 - RNA, 19 nt, Human
auggaagagaaacacggua

SEQ ID NO: 165890 - RNA, 23 nt, Human
caaccccaggcuccacaggcccc

SEQ ID NO: 165891 - RNA, 19 nt, Human
caccccucagccccaaauc

SEQ ID NO: 165892 - RNA, 20 nt, Human
cagagcucugcccucccucc

SEQ ID NO: 165893 - RNA, 19 nt, Human
cagcccagggucagcucag

SEQ ID NO: 165894 - RNA, 18 nt, Human
cagggucagcucagccuc

SEQ ID NO: 165895 - RNA, 25 nt, Human
cagugggccucugugucucaggccu

SEQ ID NO: 165896 - RNA, 20 nt, Human
ccaaccccaggcuccacagg

SEQ ID NO: 165897 - RNA, 21 nt, Human
ccacccaugcagcuucccuca

SEQ ID NO: 165898 - RNA, 20 nt, Human
ccaggagccuuccccuuccc

SEQ ID NO: 165899 - RNA, 18 nt, Human
ccagucuggccuccagca

SEQ ID NO: 165900 - RNA, 22 nt, Human
ccagucuggccuccagcagccc

SEQ ID NO: 165901 - RNA, 20 nt, Human
cccaccccucagccccaaau

SEQ ID NO: 165902 - RNA, 23 nt, Human
cccaccgccacugucccccucgc

SEQ ID NO: 165903 - RNA, 25 nt, Human
ccccaaauccaagauuucauagccc

SEQ ID NO: 165904 - RNA, 18 nt, Human
ccccaggcuccacaggcc

SEQ ID NO: 165905 - RNA, 21 nt, Human
ccccccgccucccagaacugg

SEQ ID NO: 165906 - RNA, 25 nt, Human
ccccucagccccaaauccaagauuu

SEQ ID NO: 165907 - RNA, 20 nt, Human
ccccucgcagugggccucug

SEQ ID NO: 165908 - RNA, 22 nt, Human
cccucccaccccucagccccaa

SEQ ID NO: 165909 - RNA, 18 nt, Human
cccucccucccaccccuc

SEQ ID NO: 165910 - RNA, 20 nt, Human
ccgccggcagugagggcgag

SEQ ID NO: 165911 - RNA, 21 nt, Human
ccggcagugagggcgagcgag

SEQ ID NO: 165912 - RNA, 24 nt, Human
ccuauccaaccccaggcuccacag

SEQ ID NO: 165913 - RNA, 19 nt, Human
ccuggccaggcucccugcc

SEQ ID NO: 165914 - RNA, 23 nt, Human
cuccaggagccuuccccuucccu

SEQ ID NO: 165915 - RNA, 23 nt, Human
cucccucccaccccucagcccca

SEQ ID NO: 165916 - RNA, 23 nt, Human
cucugcccucccucccaccccuc

SEQ ID NO: 165917 - RNA, 20 nt, Human
cugcccucccucccaccccu

SEQ ID NO: 165918 - RNA, 22 nt, Human
gaugacaagaaguacaaagaaa

SEQ ID NO: 165919 - RNA, 24 nt, Human
gaugacaagaaguacaaagaaaga

SEQ ID NO: 165920 - RNA, 25 nt, Human
gccaccaaccuccuuccccccgccu

SEQ ID NO: 165921 - RNA, 20 nt, Human
gcccagggucagcucagccu

SEQ ID NO: 165922 - RNA, 22 nt, Human
gccuccacuggaggcgagggag

SEQ ID NO: 165923 - RNA, 21 nt, Human
gcucugcccucccucccaccc

SEQ ID NO: 165924 - RNA, 25 nt, Human
ggaaagccuucuuuagggaugaaaa

SEQ ID NO: 165925 - RNA, 20 nt, Human
ggagggcaaagggcauggga

SEQ ID NO: 165926 - RNA, 24 nt, Human
ggauuuucaucuagggugguggga

SEQ ID NO: 165927 - RNA, 20 nt, Human
ggcgagggaggagggcaaag

SEQ ID NO: 165928 - RNA, 21 nt, Human
gggaguggggaugacaagaag

SEQ ID NO: 165929 - RNA, 22 nt, Human
gggucagcucagccuccacugg

SEQ ID NO: 165930 - RNA, 20 nt, Human
gguggugggaacaccagaga

SEQ ID NO: 165931 - RNA, 24 nt, Human
gugggaacaccagagaugucuccu

SEQ ID NO: 165932 - RNA, 20 nt, Human
uacagcccagucuggccucc

SEQ ID NO: 165933 - RNA, 23 nt, Human
uagccuuugagugugcagagcuc

SEQ ID NO: 165934 - RNA, 18 nt, Human
uaggguggugggaacacc

SEQ ID NO: 165935 - RNA, 20 nt, Human
uauccaaccccaggcuccac

SEQ ID NO: 165936 - RNA, 20 nt, Human
ucaggccuggccaggcuccc

SEQ ID NO: 165937 - RNA, 20 nt, Human
uccacaggccccaaauuggc

SEQ ID NO: 165938 - RNA, 21 nt, Human
uccacaggccccaaauuggcu

SEQ ID NO: 165939 - RNA, 18 nt, Human
ucccaccccucagcccca

SEQ ID NO: 165940 - RNA, 20 nt, Human
ucccaccccucagccccaaa

SEQ ID NO: 165941 - RNA, 23 nt, Human
ucccaccgccacugucccccucg

SEQ ID NO: 165942 - RNA, 19 nt, Human
uccccuucccuaggagcca

SEQ ID NO: 165943 - RNA, 19 nt, Human
ugaaaagcuaacuacagcc

SEQ ID NO: 165944 - RNA, 24 nt, Human
ugacaagaaguacaaagaaagaga

SEQ ID NO: 165945 - RNA, 27 nt, Human
ugccuggaguugggaccgccggcaaca

SEQ ID NO: 165946 - RNA, 20 nt, Human
uggcuccuggaccucauccc

SEQ ID NO: 165947 - RNA, 19 nt, Human
ugggaacaccagagauguu

SEQ ID NO: 165948 - RNA, 18 nt, Human
uggggaggaaggcagagg

SEQ ID NO: 165949 - RNA, 23 nt, Human
uggggaggaaggcagaggggucc

SEQ ID NO: 165950 - RNA, 24 nt, Human
uggggaugacaagaaguacaaaga

SEQ ID NO: 165951 - RNA, 21 nt, Human
uuagggaaagccuucuuuagg

SEQ ID NO: 165952 - RNA, 20 nt, Human
uuccccuucccuaggagcca

SEQ ID NO: 165953 - RNA, 26 nt, Human
uucuaugguuccuuagggaaagccgg

SEQ ID NO: 165954 - RNA, 22 nt, Human
uuucauagcccuaacacccacc

SEQ ID NO: 165955 - RNA, 24 nt, Human
uuuuaaggaagugguuuagggaug

SEQ ID NO: 165956 - RNA, 23 nt, Human
aaaaaaaaaaaggccacaaagaa

SEQ ID NO: 165957 - RNA, 18 nt, Human
aaaaaacaggagaugcug

SEQ ID NO: 165958 - RNA, 20 nt, Human
aaaacaggagaugcugaagc

SEQ ID NO: 165959 - RNA, 21 nt, Human
aaacagaggugucggaagcaa

SEQ ID NO: 165960 - RNA, 19 nt, Human
aaccacaggaugaaaaaaa

SEQ ID NO: 165961 - RNA, 22 nt, Human
aagaacuaaaauguuggcacua

SEQ ID NO: 165962 - RNA, 23 nt, Human
aagaaugcagggggaaaaauagc

SEQ ID NO: 165963 - RNA, 25 nt, Human
aaggcucuccccauccccaccucag

SEQ ID NO: 165964 - RNA, 21 nt, Human
aauacagaaagaaugcagggg

SEQ ID NO: 165965 - RNA, 24 nt, Human
acaaacagcaccuucaauugaaac

SEQ ID NO: 165966 - RNA, 21 nt, Human
acaggacagcaaaggggugag

SEQ ID NO: 165967 - RNA, 25 nt, Human
accacaggaugaaaaaaaaaaaaga

SEQ ID NO: 165968 - RNA, 22 nt, Human
accccaaaaugaaaacaaaaua

SEQ ID NO: 165969 - RNA, 21 nt, Human
agaaaaacauuuaaacagcug

SEQ ID NO: 165970 - RNA, 20 nt, Human
agaugcugaagcugcgauga

SEQ ID NO: 165971 - RNA, 20 nt, Human
agcgggcgggcggcgcgacc

SEQ ID NO: 165972 - RNA, 18 nt, Human
aggaaacagaggugucgg

SEQ ID NO: 165973 - RNA, 19 nt, Human
aggaagugguggagcuugg

SEQ ID NO: 165974 - RNA, 21 nt, Human
aggcucuccccauccccaccu

SEQ ID NO: 165975 - RNA, 22 nt, Human
agggugggugggaaugguggag

SEQ ID NO: 165976 - RNA, 22 nt, Human
aggguuuaaggggagggugggu

SEQ ID NO: 165977 - RNA, 18 nt, Human
aggucccugcuggcccag

SEQ ID NO: 165978 - RNA, 18 nt, Human
aggugucggaagcaaagc

SEQ ID NO: 165979 - RNA, 21 nt, Human
aggugucggaagcaaagcuga

SEQ ID NO: 165980 - RNA, 21 nt, Human
auaaaauauucuugcaaaccc

SEQ ID NO: 165981 - RNA, 23 nt, Human
auaacacugaaaggauacucaau

SEQ ID NO: 165982 - RNA, 23 nt, Human
auagaaaaacauuuaaacagcug

SEQ ID NO: 165983 - RNA, 20 nt, Human
auccaaaagacugaaacuga

SEQ ID NO: 165984 - RNA, 23 nt, Human
augaaaacaaaauaaaaugaaua

SEQ ID NO: 165985 - RNA, 21 nt, Human
caaaccccccccccaacacca

SEQ ID NO: 165986 - RNA, 24 nt, Human
caaaccccccccccaacaccaauu

SEQ ID NO: 165987 - RNA, 22 nt, Human
caauaauaaaacuugagacuca

SEQ ID NO: 165988 - RNA, 19 nt, Human
cacaggacagcaaaggggu

SEQ ID NO: 165989 - RNA, 20 nt, Human
cagcugccaucuccaugaga

SEQ ID NO: 165990 - RNA, 20 nt, Human
cagugaagggcccuucagua

SEQ ID NO: 165991 - RNA, 21 nt, Human
cauccccaccucaguuuuagg

SEQ ID NO: 165992 - RNA, 24 nt, Human
caucuccaugaguugaacugggaa

SEQ ID NO: 165993 - RNA, 26 nt, Human
ccaauuccuauucuaauguuaaccua

SEQ ID NO: 165994 - RNA, 21 nt, Human
ccacaggaugaaaaaaaaaaa

SEQ ID NO: 165995 - RNA, 22 nt, Human
ccagaucccuccauggcagauc

SEQ ID NO: 165996 - RNA, 20 nt, Human
ccccccaacaccaauuccua

SEQ ID NO: 165997 - RNA, 19 nt, Human
cccccccccaacaccaauu

SEQ ID NO: 165998 - RNA, 21 nt, Human
cggcggcggacgcugagcggg

SEQ ID NO: 165999 - RNA, 18 nt, Human
cucuccccauccccaccu

SEQ ID NO: 166000 - RNA, 20 nt, Human
cucuccccauccccaccuca

SEQ ID NO: 166001 - RNA, 22 nt, Human
cugaaaguccauuagaaaaacc

SEQ ID NO: 166002 - RNA, 18 nt, Human
cuuaagagaacauucaag

SEQ ID NO: 166003 - RNA, 18 nt, Human
cuuggaaaguuaugagau

SEQ ID NO: 166004 - RNA, 24 nt, Human
gaaaaaaaaaaaaggccacaaaga

SEQ ID NO: 166005 - RNA, 23 nt, Human
gagaucagcagagggagccaagc

SEQ ID NO: 166006 - RNA, 18 nt, Human
gagaugcugaagcugcga

SEQ ID NO: 166007 - RNA, 19 nt, Human
gagauuacaaaauuccuga

SEQ ID NO: 166008 - RNA, 19 nt, Human
gcagauccaagaacaggga

SEQ ID NO: 166009 - RNA, 21 nt, Human
gcauacacuaauaacacugaa

SEQ ID NO: 166010 - RNA, 19 nt, Human
gccuugugguguuuuuugu

SEQ ID NO: 166011 - RNA, 18 nt, Human
gcgacgggcggcguggac

SEQ ID NO: 166012 - RNA, 22 nt, Human
ggaacaucaggaaaagcuccau

SEQ ID NO: 166013 - RNA, 22 nt, Human
ggacagcaaaggggugagaagg

SEQ ID NO: 166014 - RNA, 20 nt, Human
ggagcuaagggaggaggcca

SEQ ID NO: 166015 - RNA, 23 nt, Human
gggcgggcggcgcgacgggcggc

SEQ ID NO: 166016 - RNA, 22 nt, Human
ggggaaaaauagccuuguggug

SEQ ID NO: 166017 - RNA, 20 nt, Human
gggugggaaugguggaggca

SEQ ID NO: 166018 - RNA, 24 nt, Human
ggugagaaggggcugagggaggaa

SEQ ID NO: 166019 - RNA, 23 nt, Human
gugaagggcccuucaguauucca

SEQ ID NO: 166020 - RNA, 19 nt, Human
gugcugggggaagggugca

SEQ ID NO: 166021 - RNA, 24 nt, Human
uaacacugaaaggauacucaauac

SEQ ID NO: 166022 - RNA, 20 nt, Human
uaagagaacauucaaggauu

SEQ ID NO: 166023 - RNA, 19 nt, Human
uagguaaacacacauacga

SEQ ID NO: 166024 - RNA, 23 nt, Human
uauggcuuugcagcgcagcagca

SEQ ID NO: 166025 - RNA, 22 nt, Human
ucagaggucccugcuggcccag

SEQ ID NO: 166026 - RNA, 23 nt, Human
ucaguccucaacagcgccucaaa

SEQ ID NO: 166027 - RNA, 19 nt, Human
ucauccaaaaaauuaaaau

SEQ ID NO: 166028 - RNA, 19 nt, Human
uccacggcucugccuagua

SEQ ID NO: 166029 - RNA, 20 nt, Human
ucuugcaaacccccccccca

SEQ ID NO: 166030 - RNA, 23 nt, Human
ugaaaaaaaaaaaaggccacaaa

SEQ ID NO: 166031 - RNA, 22 nt, Human
ugaaacugucaauuaaaguucu

SEQ ID NO: 166032 - RNA, 22 nt, Human
ugagaaaagccggcauaaagca

SEQ ID NO: 166033 - RNA, 23 nt, Human
ugagaaaagccggcauaaagcac

SEQ ID NO: 166034 - RNA, 25 nt, Human
ugagaaaagccggcauaaagcacuu

SEQ ID NO: 166035 - RNA, 21 nt, Human
ugagaaggggcugagggagga

SEQ ID NO: 166036 - RNA, 19 nt, Human
ugagggaggaaaagccagg

SEQ ID NO: 166037 - RNA, 24 nt, Human
ugcaaaccccccccccaacaccaa

SEQ ID NO: 166038 - RNA, 21 nt, Human
uggaacaucaggaaaagcucc

SEQ ID NO: 166039 - RNA, 20 nt, Human
uggcacuacaaauuuggccu

SEQ ID NO: 166040 - RNA, 20 nt, Human
uggcugggcuuucacugggu

SEQ ID NO: 166041 - RNA, 22 nt, Human
uggcugggcuuucacugggugu

SEQ ID NO: 166042 - RNA, 20 nt, Human
ugggaggagcaaaggcagug

SEQ ID NO: 166043 - RNA, 18 nt, Human
ugguggaggcaaaggcuc

SEQ ID NO: 166044 - RNA, 19 nt, Human
ugugguguuuuuuguucuc

SEQ ID NO: 166045 - RNA, 22 nt, Human
uuaaggggagggugggugggaa

SEQ ID NO: 166046 - RNA, 24 nt, Human
uuaauacuugaccauguacuuaau

SEQ ID NO: 166047 - RNA, 26 nt, Human
uuaauuuaacccaaagacaucucuca

SEQ ID NO: 166048 - RNA, 21 nt, Human
uuagaaaaaccacaggaugau

SEQ ID NO: 166049 - RNA, 22 nt, Human
uuccacggcucugccuaguacc

SEQ ID NO: 166050 - RNA, 22 nt, Human
uuccugaaaguccauuagaaaa

SEQ ID NO: 166051 - RNA, 27 nt, Human
uugcaaaccccccccccaacaccaauu

SEQ ID NO: 166052 - RNA, 21 nt, Human
uuuaaggggaggguggguggg

SEQ ID NO: 166053 - RNA, 22 nt, Human
uuuuuuuuuuuugagaaaagcc

SEQ ID NO: 166054 - RNA, 20 nt, Human
uuuuuuuuuuuuuuuuuugg

SEQ ID NO: 166055 - RNA, 20 nt, Human
aaaaugcacaaccugaaaug

SEQ ID NO: 166056 - RNA, 20 nt, Human
aaaaugcacaaccugaaaug

SEQ ID NO: 166057 - RNA, 23 nt, Human
aacaagagaucuguguucuguca

SEQ ID NO: 166058 - RNA, 23 nt, Human
aacaagagaucuguguucuguca

SEQ ID NO: 166059 - RNA, 21 nt, Human
aagcaagaauucgcaugaaca

SEQ ID NO: 166060 - RNA, 21 nt, Human
aagcaagaauucgcaugaaca

SEQ ID NO: 166061 - RNA, 22 nt, Human
aaucugcaaccgaaguuuccuc

SEQ ID NO: 166062 - RNA, 22 nt, Human
aaucugcaaccgaaguuuccuc

SEQ ID NO: 166063 - RNA, 19 nt, Human
accugaaaugcuucaaucu

SEQ ID NO: 166064 - RNA, 19 nt, Human
accugaaaugcuucaaucu

SEQ ID NO: 166065 - RNA, 19 nt, Human
accuugaguuccuuccugc

SEQ ID NO: 166066 - RNA, 19 nt, Human
accuugaguuccuuccugc

SEQ ID NO: 166067 - RNA, 29 nt, Human
agagagaaagugacagcaaaggggacccc

SEQ ID NO: 166068 - RNA, 29 nt, Human
agagagaaagugacagcaaaggggacccc

SEQ ID NO: 166069 - RNA, 24 nt, Human
agcagcagccaucuccagccaccu

SEQ ID NO: 166070 - RNA, 19 nt, Human
agcagccaucuccagccac

SEQ ID NO: 166071 - RNA, 24 nt, Human
agcuaacagaauuuauaagagaga

SEQ ID NO: 166072 - RNA, 20 nt, Human
aggagggugagcagcagcca

SEQ ID NO: 166073 - RNA, 20 nt, Human
aggagggugagcagcagcca

SEQ ID NO: 166074 - RNA, 23 nt, Human
aggcuaggagggugagcagcagc

SEQ ID NO: 166075 - RNA, 23 nt, Human
aggcuaggagggugagcagcagc

SEQ ID NO: 166076 - RNA, 19 nt, Human
agggaugacaccggggugg

SEQ ID NO: 166077 - RNA, 25 nt, Human
cacacugaucaagagccccaaaagc

SEQ ID NO: 166078 - RNA, 25 nt, Human
cacacugaucaagagccccaaaagc

SEQ ID NO: 166079 - RNA, 19 nt, Human
caggagccgucccaguggc

SEQ ID NO: 166080 - RNA, 19 nt, Human
caggagccgucccaguggc

SEQ ID NO: 166081 - RNA, 23 nt, Human
caggagccgucccaguggcagag

SEQ ID NO: 166082 - RNA, 23 nt, Human
caggagccgucccaguggcagag

SEQ ID NO: 166083 - RNA, 20 nt, Human
ccagccccgccgucgcuccg

SEQ ID NO: 166084 - RNA, 19 nt, Human
ccccaaaagcaggagccgu

SEQ ID NO: 166085 - RNA, 21 nt, Human
ccccaaaagcaggagccgucc

SEQ ID NO: 166086 - RNA, 21 nt, Human
ccccaaaagcaggagccgucc

SEQ ID NO: 166087 - RNA, 22 nt, Human
ccugcugcugcccgaccccggc

SEQ ID NO: 166088 - RNA, 26 nt, Human
ccuucacucuaaguugagcagcucca

SEQ ID NO: 166089 - RNA, 24 nt, Human
cgaacacauacagagcaacuugga

SEQ ID NO: 166090 - RNA, 24 nt, Human
cgaacacauacagagcaacuugga

SEQ ID NO: 166091 - RNA, 23 nt, Human
cggccccagccccgccgucgcuc

SEQ ID NO: 166092 - RNA, 19 nt, Human
cuccggccccagccccgcc

SEQ ID NO: 166093 - RNA, 20 nt, Human
cuccggccccagccccgccu

SEQ ID NO: 166094 - RNA, 26 nt, Human
cucggcuccggccccagccccgccgu

SEQ ID NO: 166095 - RNA, 18 nt, Human
cugcugcugcccgacccc

SEQ ID NO: 166096 - RNA, 19 nt, Human
gaacacauacagagcaacu

SEQ ID NO: 166097 - RNA, 19 nt, Human
gaacacauacagagcaacu

SEQ ID NO: 166098 - RNA, 19 nt, Human
gccccagccccgccgucgc

SEQ ID NO: 166099 - RNA, 31 nt, Human
gcccgaccccggcucggcuccggccccagcc

SEQ ID NO: 166100 - RNA, 23 nt, Human
gcuaacagaauuuauaagagaga

SEQ ID NO: 166101 - RNA, 22 nt, Human
gcuccacgucaaagaugagggu

SEQ ID NO: 166102 - RNA, 20 nt, Human
gcugcccgaccccggcucgg

SEQ ID NO: 166103 - RNA, 21 nt, Human
ggcagagagaauggaugaugc

SEQ ID NO: 166104 - RNA, 24 nt, Human
uacaugcaucacacaaaaugcaca

SEQ ID NO: 166105 - RNA, 24 nt, Human
uacaugcaucacacaaaaugcaca

SEQ ID NO: 166106 - RNA, 24 nt, Human
uagcacacugaucaagagccccaa

SEQ ID NO: 166107 - RNA, 24 nt, Human
uagcacacugaucaagagccccaa

SEQ ID NO: 166108 - RNA, 25 nt, Human
ucaaucugcaaccgaaguuuccuca

SEQ ID NO: 166109 - RNA, 25 nt, Human
ucaaucugcaaccgaaguuuccuca

SEQ ID NO: 166110 - RNA, 18 nt, Human
ucaggaaaggcuacuaca

SEQ ID NO: 166111 - RNA, 18 nt, Human
ucaggaaaggcuacuaca

SEQ ID NO: 166112 - RNA, 19 nt, Human
ucccacaggccccgccucu

SEQ ID NO: 166113 - RNA, 22 nt, Human
ucgcccucugccccaagcucau

SEQ ID NO: 166114 - RNA, 21 nt, Human
ucggcuccggccccagccccg

SEQ ID NO: 166115 - RNA, 24 nt, Human
ucuccagccaccaccuugaguucc

SEQ ID NO: 166116 - RNA, 18 nt, Human
ucugucaucaggaaaggc

SEQ ID NO: 166117 - RNA, 18 nt, Human
ucugucaucaggaaaggc

SEQ ID NO: 166118 - RNA, 19 nt, Human
ucugucaucaggaaaggcu

SEQ ID NO: 166119 - RNA, 21 nt, Human
ucugucaucaggaaaggcuac

SEQ ID NO: 166120 - RNA, 25 nt, Human
ugacaccgggguggcccguggcucc

SEQ ID NO: 166121 - RNA, 21 nt, Human
ugagguuagcacacugaucaa

SEQ ID NO: 166122 - RNA, 21 nt, Human
ugagguuagcacacugaucaa

SEQ ID NO: 166123 - RNA, 18 nt, Human
ugcccgaccccggcucgg

SEQ ID NO: 166124 - RNA, 22 nt, Human
uggcucaagucccucuguguac

SEQ ID NO: 166125 - RNA, 22 nt, Human
uggcucaagucccucuguguac

SEQ ID NO: 166126 - RNA, 22 nt, Human
ugggagggaugacaccggggug

SEQ ID NO: 166127 - RNA, 23 nt, Human
ugggcagagagaauggaugaugc

SEQ ID NO: 166128 - RNA, 19 nt, Human
uggggggucccugcugcug

SEQ ID NO: 166129 - RNA, 22 nt, Human
uucacucuaaguugagcagcuc

SEQ ID NO: 166130 - RNA, 21 nt, Human
uuuuuuuuuuuuuuugucaag

SEQ ID NO: 166131 - RNA, 21 nt, Human
uuuuuuuuuuuuuuugucaag

SEQ ID NO: 166132 - RNA, 18 nt, Human
uuuuuuuuuuuuuuuuug

SEQ ID NO: 166133 - RNA, 18 nt, Human
uuuuuuuuuuuuuuuuug

SEQ ID NO: 166134 - RNA, 19 nt, Human
uuuuuuuuuuuuuuuuugu

SEQ ID NO: 166135 - RNA, 19 nt, Human
uuuuuuuuuuuuuuuuugu

SEQ ID NO: 166136 - RNA, 19 nt, Human
aaacccgcggccacacgcc

SEQ ID NO: 166137 - RNA, 25 nt, Human
aaacccgcggccacacgcccgcugg

SEQ ID NO: 166138 - RNA, 23 nt, Human
accgugcgaaacccgcggccaca

SEQ ID NO: 166139 - RNA, 18 nt, Human
aggccacagcagccaggg

SEQ ID NO: 166140 - RNA, 22 nt, Human
agguggugggguaugcuggagc

SEQ ID NO: 166141 - RNA, 23 nt, Human
agguggugggguaugcuggagcu

SEQ ID NO: 166142 - RNA, 23 nt, Human
cacaaacacacaggcuuacuccu

SEQ ID NO: 166143 - RNA, 21 nt, Human
cacacaggcuuacuccuuggg

SEQ ID NO: 166144 - RNA, 18 nt, Human
cacgcccgcuggcacggg

SEQ ID NO: 166145 - RNA, 19 nt, Human
cacgggucuuucccgagcc

SEQ ID NO: 166146 - RNA, 23 nt, Human
cagcagccagggacccgccccuu

SEQ ID NO: 166147 - RNA, 22 nt, Human
cagcggggggagggggucaggg

SEQ ID NO: 166148 - RNA, 21 nt, Human
caggggaggccacagcagcca

SEQ ID NO: 166149 - RNA, 19 nt, Human
caguccagugagaaggggg

SEQ ID NO: 166150 - RNA, 21 nt, Human
ccacagcagccagggacccgc

SEQ ID NO: 166151 - RNA, 28 nt, Human
ccacgccgcccucccuuauuggaccgug

SEQ ID NO: 166152 - RNA, 23 nt, Human
ccccgcccccgcgacgccgcugc

SEQ ID NO: 166153 - RNA, 23 nt, Human
ccccggagucaaccccgguggug

SEQ ID NO: 166154 - RNA, 18 nt, Human
cccgcgacgccgcugccc

SEQ ID NO: 166155 - RNA, 22 nt, Human
cccgcgacgccgcugcccugcg

SEQ ID NO: 166156 - RNA, 19 nt, Human
cccugccccuccccagucu

SEQ ID NO: 166157 - RNA, 23 nt, Human
ccgcccccgcgacgccgcugccc

SEQ ID NO: 166158 - RNA, 24 nt, Human
ccgcccccgcgacgccgcugcccu

SEQ ID NO: 166159 - RNA, 23 nt, Human
ccgcgcccccggagucaaccccg

SEQ ID NO: 166160 - RNA, 20 nt, Human
ccgugcgaaacccgcggcca

SEQ ID NO: 166161 - RNA, 21 nt, Human
ccgugcgaaacccgcggccac

SEQ ID NO: 166162 - RNA, 20 nt, Human
ccucccuuauuggaccgugc

SEQ ID NO: 166163 - RNA, 21 nt, Human
cgaaacccgcggccacacgcc

SEQ ID NO: 166164 - RNA, 23 nt, Human
cgcggccacacgcccgcuggcac

SEQ ID NO: 166165 - RNA, 20 nt, Human
cgcuggcacgggucuuuccc

SEQ ID NO: 166166 - RNA, 19 nt, Human
cucucagggcccacaaaca

SEQ ID NO: 166167 - RNA, 20 nt, Human
cucugcgcaggcgcguccuc

SEQ ID NO: 166168 - RNA, 18 nt, Human
ggaaaggagaagguggug

SEQ ID NO: 166169 - RNA, 22 nt, Human
ggagaagguggugggguaugcu

SEQ ID NO: 166170 - RNA, 18 nt, Human
ggagcugaggucucugag

SEQ ID NO: 166171 - RNA, 19 nt, Human
ggccgaggaccccagcagc

SEQ ID NO: 166172 - RNA, 18 nt, Human
gggcuuggccgaggaccc

SEQ ID NO: 166173 - RNA, 19 nt, Human
ggggagggggucaggggag

SEQ ID NO: 166174 - RNA, 21 nt, Human
gguggugggguaugcuggagc

SEQ ID NO: 166175 - RNA, 18 nt, Human
gugcugccgccucugcgc

SEQ ID NO: 166176 - RNA, 23 nt, Human
guuuuuuuuuuggaacagucugg

SEQ ID NO: 166177 - RNA, 18 nt, Human
ugagaagggggcuuggcc

SEQ ID NO: 166178 - RNA, 18 nt, Human
ugcgaaacccgcggccac

SEQ ID NO: 166179 - RNA, 18 nt, Human
uggaacagucuggucccu

SEQ ID NO: 166180 - RNA, 24 nt, Human
ugggguaugcuggagcugaggucu

SEQ ID NO: 166181 - RNA, 22 nt, Human
uguuuuuguuuuuuguuuuuuu

SEQ ID NO: 166182 - RNA, 22 nt, Human
uguuuuuuguuuuuuuuuugga

SEQ ID NO: 166183 - RNA, 19 nt, Human
uuggaacagucuggucccu

SEQ ID NO: 166184 - RNA, 19 nt, Human
uuguuuguuuuuguuuuuu

SEQ ID NO: 166185 - RNA, 19 nt, Human
uuguuuguuuuuguuuuuu

SEQ ID NO: 166186 - RNA, 30 nt, Human
uuguuuguuuuuguuuuuuguuuuuuuuuu

SEQ ID NO: 166187 - RNA, 22 nt, Human
uuguuuuuuuuuuggaacaguc

SEQ ID NO: 166188 - RNA, 19 nt, Human
uuuuguuuguuuuuguuuu

SEQ ID NO: 166189 - RNA, 22 nt, Human
uuuuuguuuguuuuuguuuuuu

SEQ ID NO: 166190 - RNA, 26 nt, Human
aaaaaaacaagaaacugccuuaaaaa

SEQ ID NO: 166191 - RNA, 25 nt, Human
acagaaaacagcaccugugaaaaca

SEQ ID NO: 166192 - RNA, 20 nt, Human
cacggaaaacagaaaacagc

SEQ ID NO: 166193 - RNA, 23 nt, Human
cagcaccugugaaaacacguuuc

SEQ ID NO: 166194 - RNA, 19 nt, Human
caguagcugcgcuuucccc

SEQ ID NO: 166195 - RNA, 18 nt, Human
cauuccagccccugcucc

SEQ ID NO: 166196 - RNA, 29 nt, Human
ccaaugauggagaaccacagcucucuccu

SEQ ID NO: 166197 - RNA, 21 nt, Human
ccacggcugcgcugggagcuc

SEQ ID NO: 166198 - RNA, 21 nt, Human
cccaaugauggagaaccacag

SEQ ID NO: 166199 - RNA, 24 nt, Human
ccgucuaaaaaaacaagaaacugc

SEQ ID NO: 166200 - RNA, 24 nt, Human
ccuacaaaauacacaaagcaaucu

SEQ ID NO: 166201 - RNA, 20 nt, Human
ccuggugcgccccgcugccc

SEQ ID NO: 166202 - RNA, 19 nt, Human
cuccccucguugguaggug

SEQ ID NO: 166203 - RNA, 22 nt, Human
cugggacugggagggaagccaa

SEQ ID NO: 166204 - RNA, 18 nt, Human
gaacacggaaaacagaaa

SEQ ID NO: 166205 - RNA, 25 nt, Human
gcugcgcugggagcucccuuccacu

SEQ ID NO: 166206 - RNA, 22 nt, Human
ggaaaacagaaaacagcaccug

SEQ ID NO: 166207 - RNA, 18 nt, Human
ggaagcagggcugggacu

SEQ ID NO: 166208 - RNA, 18 nt, Human
ggacauuccagccccugc

SEQ ID NO: 166209 - RNA, 19 nt, Human
uaaaaaaacaagaaacugc

SEQ ID NO: 166210 - RNA, 24 nt, Human
ucccuguggcgugagccuucggcc

SEQ ID NO: 166211 - RNA, 21 nt, Human
ucuaaaaaaacaagaaacugc

SEQ ID NO: 166212 - RNA, 21 nt, Human
ucuguuacgaacacggaaaac

SEQ ID NO: 166213 - RNA, 20 nt, Human
ugaaaacacguuucagccgc

SEQ ID NO: 166214 - RNA, 20 nt, Human
ugacucagggacauucgcag

SEQ ID NO: 166215 - RNA, 18 nt, Human
ugagccuucggccuggug

SEQ ID NO: 166216 - RNA, 23 nt, Human
ugagccuucggccuggugcgccc

SEQ ID NO: 166217 - RNA, 18 nt, Human
ugggagggaagccaagga

SEQ ID NO: 166218 - RNA, 19 nt, Human
ugucaguagcugcgcuuuu

SEQ ID NO: 166219 - RNA, 23 nt, Human
uugucaguagcugcgcuuucccc

SEQ ID NO: 166220 - RNA, 24 nt, Human
aaagugcugggauuacaggcguga

SEQ ID NO: 166221 - RNA, 24 nt, Human
aaauagagacggggucuuggcaug

SEQ ID NO: 166222 - RNA, 23 nt, Human
aagcaaccccugcagccaagggu

SEQ ID NO: 166223 - RNA, 18 nt, Human
aagcaacugaggcacaga

SEQ ID NO: 166224 - RNA, 25 nt, Human
aagcgauccucccaccucggccucc

SEQ ID NO: 166225 - RNA, 27 nt, Human
aagcgauccucccaccucggccuccca

SEQ ID NO: 166226 - RNA, 23 nt, Human
aagguaaaugaauccaaauucuc

SEQ ID NO: 166227 - RNA, 19 nt, Human
aagugcugggauuacaggc

SEQ ID NO: 166228 - RNA, 19 nt, Human
aagugcugggauuacaggc

SEQ ID NO: 166229 - RNA, 26 nt, Human
aagugcugggauuacaggcgugagcc

SEQ ID NO: 166230 - RNA, 22 nt, Human
acagagcuucuccacauccaga

SEQ ID NO: 166231 - RNA, 20 nt, Human
acccccgaaaaacaaaggcu

SEQ ID NO: 166232 - RNA, 21 nt, Human
acgcccccccaggcccaccug

SEQ ID NO: 166233 - RNA, 21 nt, Human
acucugagaguuuacuugucu

SEQ ID NO: 166234 - RNA, 19 nt, Human
acuugucucuccagucccc

SEQ ID NO: 166235 - RNA, 27 nt, Human
agacagacccccgaaaaacaaaggcga

SEQ ID NO: 166236 - RNA, 19 nt, Human
agacccccgaaaaacaaag

SEQ ID NO: 166237 - RNA, 21 nt, Human
agagaaguccaaaggcucaag

SEQ ID NO: 166238 - RNA, 21 nt, Human
agcaacugaggcacagagaga

SEQ ID NO: 166239 - RNA, 18 nt, Human
agcauuuccuccucugca

SEQ ID NO: 166240 - RNA, 24 nt, Human
caaaacaagguaaaugaauccaaa

SEQ ID NO: 166241 - RNA, 23 nt, Human
caaaacucugccccugcccuaga

SEQ ID NO: 166242 - RNA, 24 nt, Human
caaagugcugggauuacaggcgug

SEQ ID NO: 166243 - RNA, 27 nt, Human
caagcgauccucccaccucggccuccc

SEQ ID NO: 166244 - RNA, 25 nt, Human
cacagagagacugcgacgccccccc

SEQ ID NO: 166245 - RNA, 20 nt, Human
cacagugggccaccaggagc

SEQ ID NO: 166246 - RNA, 24 nt, Human
caccucggccucccaaagugcugg

SEQ ID NO: 166247 - RNA, 21 nt, Human
cacgcauauccacggcuccca

SEQ ID NO: 166248 - RNA, 25 nt, Human
cagacagacccccgaaaaacaaagg

SEQ ID NO: 166249 - RNA, 21 nt, Human
cagacccccgaaaaacaaagg

SEQ ID NO: 166250 - RNA, 25 nt, Human
cagacuccugggcucaagcgauccu

SEQ ID NO: 166251 - RNA, 21 nt, Human
cagcacccgguucucgaccac

SEQ ID NO: 166252 - RNA, 24 nt, Human
cagccuucucucaugcucuccuua

SEQ ID NO: 166253 - RNA, 18 nt, Human
caguuaagaguagcaugc

SEQ ID NO: 166254 - RNA, 19 nt, Human
cauguugccgaggcugguc

SEQ ID NO: 166255 - RNA, 22 nt, Human
ccaaagugcugggauuacaggc

SEQ ID NO: 166256 - RNA, 22 nt, Human
ccaaagugcugggauuacaggc

SEQ ID NO: 166257 - RNA, 24 nt, Human
ccaaagugcugggauuacaggcgu

SEQ ID NO: 166258 - RNA, 27 nt, Human
ccacaaaacaagguaaaugaauccaaa

SEQ ID NO: 166259 - RNA, 19 nt, Human
ccagcacccgguucucgac

SEQ ID NO: 166260 - RNA, 20 nt, Human
ccagcccagcugagcugcgc

SEQ ID NO: 166261 - RNA, 24 nt, Human
ccaggauguccccacgcauaucca

SEQ ID NO: 166262 - RNA, 21 nt, Human
cccauccucguccuggugcuc

SEQ ID NO: 166263 - RNA, 20 nt, Human
cccccaggcccaccuggcuc

SEQ ID NO: 166264 - RNA, 22 nt, Human
cccccaggcccaccuggcuccg

SEQ ID NO: 166265 - RNA, 21 nt, Human
ccccccaggcccaccuggcuc

SEQ ID NO: 166266 - RNA, 21 nt, Human
cccccgaaaaacaaaggcgag

SEQ ID NO: 166267 - RNA, 22 nt, Human
ccccgcgcccggcccagcaccc

SEQ ID NO: 166268 - RNA, 18 nt, Human
ccgcugccgccgccgccg

SEQ ID NO: 166269 - RNA, 23 nt, Human
ccuccaugacugagaugacccag

SEQ ID NO: 166270 - RNA, 26 nt, Human
ccucccaccucggccucccaaagugc

SEQ ID NO: 166271 - RNA, 18 nt, Human
ccuccucugcaagacuga

SEQ ID NO: 166272 - RNA, 19 nt, Human
ccucguccuggugcucucc

SEQ ID NO: 166273 - RNA, 20 nt, Human
ccugggcucaagcgauccuc

SEQ ID NO: 166274 - RNA, 21 nt, Human
ccuucucucaugcucuccuua

SEQ ID NO: 166275 - RNA, 18 nt, Human
cgacaucccuccaccccu

SEQ ID NO: 166276 - RNA, 18 nt, Human
cgcauauccacggcuccc

SEQ ID NO: 166277 - RNA, 26 nt, Human
cgccagucuggcuccagagccugcac

SEQ ID NO: 166278 - RNA, 24 nt, Human
cgcccgggcagccacagugggcca

SEQ ID NO: 166279 - RNA, 21 nt, Human
cgcgacaucccuccaccccuc

SEQ ID NO: 166280 - RNA, 21 nt, Human
cgcucccgcugccgccgccgc

SEQ ID NO: 166281 - RNA, 22 nt, Human
cggcgugacauccccgucuccc

SEQ ID NO: 166282 - RNA, 21 nt, Human
cguccuggugcucuccuccug

SEQ ID NO: 166283 - RNA, 24 nt, Human
cucaagagaguagauggcuaugga

SEQ ID NO: 166284 - RNA, 24 nt, Human
cucaagcgauccucccaccucggc

SEQ ID NO: 166285 - RNA, 26 nt, Human
cuccacauccagacagacccccgaaa

SEQ ID NO: 166286 - RNA, 25 nt, Human
cuccugggcucaagcgauccuccca

SEQ ID NO: 166287 - RNA, 22 nt, Human
cuucuccacauccagacagacc

SEQ ID NO: 166288 - RNA, 21 nt, Human
gagacugcgacgcccccccag

SEQ ID NO: 166289 - RNA, 18 nt, Human
gauuacaggcgugagccc

SEQ ID NO: 166290 - RNA, 21 nt, Human
gauuacaggcgugagcccccg

SEQ ID NO: 166291 - RNA, 24 nt, Human
gcaguccaaaagaaggggaggugg

SEQ ID NO: 166292 - RNA, 26 nt, Human
gcaguccaaaagaaggggaggugguc

SEQ ID NO: 166293 - RNA, 22 nt, Human
gcauccuggaagcaacugaggc

SEQ ID NO: 166294 - RNA, 24 nt, Human
gccaaugccagccuucucucaugc

SEQ ID NO: 166295 - RNA, 21 nt, Human
gccacagugggccaccaggag

SEQ ID NO: 166296 - RNA, 18 nt, Human
gccucagucccugcaccu

SEQ ID NO: 166297 - RNA, 24 nt, Human
gcgcucccgcugccgccgccgccg

SEQ ID NO: 166298 - RNA, 18 nt, Human
ggacggcgugacaucccc

SEQ ID NO: 166299 - RNA, 19 nt, Human
ggcggaagcaaccccugca

SEQ ID NO: 166300 - RNA, 18 nt, Human
gggccuccggggcauccu

SEQ ID NO: 166301 - RNA, 22 nt, Human
gggcugugcugggcccugcggg

SEQ ID NO: 166302 - RNA, 18 nt, Human
ggggucuuggcauguugc

SEQ ID NO: 166303 - RNA, 24 nt, Human
ggucuuggcauguugccgaggcug

SEQ ID NO: 166304 - RNA, 18 nt, Human
uagaauuucuuucuuggu

SEQ ID NO: 166305 - RNA, 25 nt, Human
uaggcugggggaguuccaggagggc

SEQ ID NO: 166306 - RNA, 23 nt, Human
ucaggccuuggguucacuggguc

SEQ ID NO: 166307 - RNA, 18 nt, Human
uccaccccucaccgcuca

SEQ ID NO: 166308 - RNA, 22 nt, Human
uccaccccucaccgcucacaca

SEQ ID NO: 166309 - RNA, 21 nt, Human
uccaggagggcaguuccagcc

SEQ ID NO: 166310 - RNA, 24 nt, Human
ucccaaagugcugggauuacaggc

SEQ ID NO: 166311 - RNA, 18 nt, Human
ucccgcugccgccgccgc

SEQ ID NO: 166312 - RNA, 22 nt, Human
ucccgcugccgccgccgccgcc

SEQ ID NO: 166313 - RNA, 21 nt, Human
ucccuccaccccucaccgcuc

SEQ ID NO: 166314 - RNA, 22 nt, Human
ucccuccaccccucaccgcuca

SEQ ID NO: 166315 - RNA, 21 nt, Human
uccugggcucaagcgauccuc

SEQ ID NO: 166316 - RNA, 22 nt, Human
uccugggcucaagcgauccucc

SEQ ID NO: 166317 - RNA, 18 nt, Human
uccuuagaauuucuuucu

SEQ ID NO: 166318 - RNA, 21 nt, Human
ucgcaguccaaaagaagggga

SEQ ID NO: 166319 - RNA, 18 nt, Human
ucggccucccaaagugcu

SEQ ID NO: 166320 - RNA, 19 nt, Human
ucguccuggugcucuccuc

SEQ ID NO: 166321 - RNA, 23 nt, Human
ucucagacuccugggcucaagcg

SEQ ID NO: 166322 - RNA, 22 nt, Human
ucuccgcgacaucccuccaccc

SEQ ID NO: 166323 - RNA, 24 nt, Human
ucucuucaggccuuggguucacug

SEQ ID NO: 166324 - RNA, 21 nt, Human
ucuggggcugugcugggcccu

SEQ ID NO: 166325 - RNA, 19 nt, Human
ucuucaggccuuggguuca

SEQ ID NO: 166326 - RNA, 20 nt, Human
ugacccaggauguccccacg

SEQ ID NO: 166327 - RNA, 20 nt, Human
ugacugagaugacccaggau

SEQ ID NO: 166328 - RNA, 22 nt, Human
ugagcccccgcgcccggcccag

SEQ ID NO: 166329 - RNA, 26 nt, Human
ugccccugcccuagagcgcagggcuc

SEQ ID NO: 166330 - RNA, 24 nt, Human
ugccgccgccgccgccaucuugga

SEQ ID NO: 166331 - RNA, 20 nt, Human
ugcugggauuacaggcguga

SEQ ID NO: 166332 - RNA, 20 nt, Human
uggagagaaguccaaaggcu

SEQ ID NO: 166333 - RNA, 24 nt, Human
uggcauguugccgaggcuggucuc

SEQ ID NO: 166334 - RNA, 18 nt, Human
ugggauuacaggcgugag

SEQ ID NO: 166335 - RNA, 19 nt, Human
ugggauuacaggcgugagc

SEQ ID NO: 166336 - RNA, 20 nt, Human
ugggauuacaggcgugagcc

SEQ ID NO: 166337 - RNA, 23 nt, Human
ugggauuacaggcgugagccccc

SEQ ID NO: 166338 - RNA, 24 nt, Human
ugggauuacaggcgugagcccccg

SEQ ID NO: 166339 - RNA, 23 nt, Human
ugggcaugaccauuugauaaauc

SEQ ID NO: 166340 - RNA, 22 nt, Human
uggggcugugcugggcccugcg

SEQ ID NO: 166341 - RNA, 20 nt, Human
ugguagucagaggggacagu

SEQ ID NO: 166342 - RNA, 20 nt, Human
uuacaggcgugagcccccgc

SEQ ID NO: 166343 - RNA, 22 nt, Human
uucccauccucguccuggugcu

SEQ ID NO: 166344 - RNA, 22 nt, Human
aaaaauaagcuaccaccaaacu

SEQ ID NO: 166345 - RNA, 20 nt, Human
aaaauaagcuaccaccaaac

SEQ ID NO: 166346 - RNA, 21 nt, Human
aaacagauugacaggaaaaga

SEQ ID NO: 166347 - RNA, 22 nt, Human
aaacagauugacaggaaaagau

SEQ ID NO: 166348 - RNA, 18 nt, Human
aacuugcuucauucuucu

SEQ ID NO: 166349 - RNA, 19 nt, Human
aagcagacucagaucgccu

SEQ ID NO: 166350 - RNA, 23 nt, Human
aaggauaauagagaaagaugugc

SEQ ID NO: 166351 - RNA, 18 nt, Human
aagugaacuugcuucauu

SEQ ID NO: 166352 - RNA, 25 nt, Human
acccagaaucuccuaaaauacucca

SEQ ID NO: 166353 - RNA, 25 nt, Human
acccccagugucuacugucucugac

SEQ ID NO: 166354 - RNA, 22 nt, Human
agaauuccaauagaaggauaau

SEQ ID NO: 166355 - RNA, 21 nt, Human
agcugucucgugccugcucgu

SEQ ID NO: 166356 - RNA, 21 nt, Human
agcugucucgugccugcucgu

SEQ ID NO: 166357 - RNA, 24 nt, Human
auccuugucuucguccagugcugg

SEQ ID NO: 166358 - RNA, 19 nt, Human
augauuuuuugaauacaga

SEQ ID NO: 166359 - RNA, 23 nt, Human
caaacuaaugaaauacuauagca

SEQ ID NO: 166360 - RNA, 25 nt, Human
caccauaaucauaaucugcacuacc

SEQ ID NO: 166361 - RNA, 21 nt, Human
caccugguagaggaaagaccc

SEQ ID NO: 166362 - RNA, 22 nt, Human
cacuucuggauccugacugccc

SEQ ID NO: 166363 - RNA, 19 nt, Human
cagacucagaucgccucuc

SEQ ID NO: 166364 - RNA, 22 nt, Human
cagauugacaggaaaagauaac

SEQ ID NO: 166365 - RNA, 19 nt, Human
cagugcugguccugguccg

SEQ ID NO: 166366 - RNA, 19 nt, Human
caugucuccaaacuaaacc

SEQ ID NO: 166367 - RNA, 19 nt, Human
ccaaacuaaaccugauuga

SEQ ID NO: 166368 - RNA, 20 nt, Human
ccacauaaaccuggguccuu

SEQ ID NO: 166369 - RNA, 19 nt, Human
ccagaccuucccccugacc

SEQ ID NO: 166370 - RNA, 21 nt, Human
ccagcuaguuuucuaaaguua

SEQ ID NO: 166371 - RNA, 18 nt, Human
cccagaaucuccuaaaau

SEQ ID NO: 166372 - RNA, 25 nt, Human
cccagaaucuccuaaaauacucccu

SEQ ID NO: 166373 - RNA, 19 nt, Human
cccccagugucuacugucu

SEQ ID NO: 166374 - RNA, 19 nt, Human
cccugaaaguauuaugaag

SEQ ID NO: 166375 - RNA, 18 nt, Human
cccugaacguccagaccu

SEQ ID NO: 166376 - RNA, 18 nt, Human
cccugagugccuggagcc

SEQ ID NO: 166377 - RNA, 21 nt, Human
cccuggcgccugcuucuccug

SEQ ID NO: 166378 - RNA, 20 nt, Human
cccugucuuccuccucuccu

SEQ ID NO: 166379 - RNA, 22 nt, Human
ccgcccaugggcagacucagac

SEQ ID NO: 166380 - RNA, 20 nt, Human
ccuccaguacugggcccagc

SEQ ID NO: 166381 - RNA, 18 nt, Human
cuacugucucugacugca

SEQ ID NO: 166382 - RNA, 23 nt, Human
cuccuggaccccgcugauucacc

SEQ ID NO: 166383 - RNA, 21 nt, Human
cugacuguuccucauuacgug

SEQ ID NO: 166384 - RNA, 19 nt, Human
cugugacugacuaaauccc

SEQ ID NO: 166385 - RNA, 22 nt, Human
cuugucuucguccagugcuggu

SEQ ID NO: 166386 - RNA, 18 nt, Human
gaaaacaacaggauugga

SEQ ID NO: 166387 - RNA, 25 nt, Human
gccuggagccgucuccugacuguuc

SEQ ID NO: 166388 - RNA, 19 nt, Human
ggagugucuaaaacuuaaa

SEQ ID NO: 166389 - RNA, 23 nt, Human
gucuggagccaucucuugacugc

SEQ ID NO: 166390 - RNA, 25 nt, Human
gucuggagccaucucuugacugcuc

SEQ ID NO: 166391 - RNA, 22 nt, Human
guggcugugaugggacccugag

SEQ ID NO: 166392 - RNA, 22 nt, Human
guggcugugaugggacccugag

SEQ ID NO: 166393 - RNA, 18 nt, Human
uaaaaauaagcuaccacc

SEQ ID NO: 166394 - RNA, 22 nt, Human
uaaaauacuccagcuaguuuuc

SEQ ID NO: 166395 - RNA, 20 nt, Human
uaaagugaccauguuccuua

SEQ ID NO: 166396 - RNA, 28 nt, Human
uacugggcccagcccguccaugggcaac

SEQ ID NO: 166397 - RNA, 24 nt, Human
uauuaugaaguuucuugauugaaa

SEQ ID NO: 166398 - RNA, 20 nt, Human
uccaccagaggaagucucug

SEQ ID NO: 166399 - RNA, 22 nt, Human
uccacgaaugguguccugaccc

SEQ ID NO: 166400 - RNA, 22 nt, Human
uccacgaaugguguccugaccc

SEQ ID NO: 166401 - RNA, 20 nt, Human
uccauggccugacacugacu

SEQ ID NO: 166402 - RNA, 19 nt, Human
uccaugggcagacucagac

SEQ ID NO: 166403 - RNA, 23 nt, Human
ucccucacuaucacuggccugac

SEQ ID NO: 166404 - RNA, 18 nt, Human
ucccugggauguggugug

SEQ ID NO: 166405 - RNA, 18 nt, Human
ucccugggauguggugug

SEQ ID NO: 166406 - RNA, 20 nt, Human
ucccugggaugugguguggc

SEQ ID NO: 166407 - RNA, 20 nt, Human
ucccugggaugugguguggc

SEQ ID NO: 166408 - RNA, 24 nt, Human
ucguccagugcugguccugguccg

SEQ ID NO: 166409 - RNA, 19 nt, Human
ucuccaugauauugauuuc

SEQ ID NO: 166410 - RNA, 18 nt, Human
ucuccuaaaauacuccag

SEQ ID NO: 166411 - RNA, 20 nt, Human
ucuccuggacuugaucuugc

SEQ ID NO: 166412 - RNA, 20 nt, Human
ucuggagcugucugcugacu

SEQ ID NO: 166413 - RNA, 24 nt, Human
ugaaaguauuaugaaguuucuuga

SEQ ID NO: 166414 - RNA, 18 nt, Human
ugaaugucccucacuauc

SEQ ID NO: 166415 - RNA, 20 nt, Human
ugacaggaaaagauaacuuc

SEQ ID NO: 166416 - RNA, 24 nt, Human
ugacgcgacccugagugccuggag

SEQ ID NO: 166417 - RNA, 25 nt, Human
ugacgcgacccugagugccuggagc

SEQ ID NO: 166418 - RNA, 22 nt, Human
ugacuaccacuggacccccagu

SEQ ID NO: 166419 - RNA, 23 nt, Human
ugagugcucaccugguagaggaa

SEQ ID NO: 166420 - RNA, 27 nt, Human
ugauauagccacuuugguauacagaac

SEQ ID NO: 166421 - RNA, 24 nt, Human
ugccuggagccgucuccugacugu

SEQ ID NO: 166422 - RNA, 23 nt, Human
ugcugauggggcccagccugucc

SEQ ID NO: 166423 - RNA, 18 nt, Human
uggaucccuggcgccugc

SEQ ID NO: 166424 - RNA, 26 nt, Human
uggaucccuggcgccugcuucuccug

SEQ ID NO: 166425 - RNA, 28 nt, Human
uggccggacugugagugucccguacucg

SEQ ID NO: 166426 - RNA, 24 nt, Human
uggcuaacacuggaucccuggcgc

SEQ ID NO: 166427 - RNA, 22 nt, Human
uguaacuaacacuuccgugcug

SEQ ID NO: 166428 - RNA, 20 nt, Human
uguccaccagaggaagucuc

SEQ ID NO: 166429 - RNA, 18 nt, Human
uguccagaccuaucuacc

SEQ ID NO: 166430 - RNA, 18 nt, Human
uguccagaccuaucuacc

SEQ ID NO: 166431 - RNA, 21 nt, Human
uguccagaccuaucuaccgau

SEQ ID NO: 166432 - RNA, 19 nt, Human
uguccauggccugacacug

SEQ ID NO: 166433 - RNA, 22 nt, Human
ugucuccaaacuaaaccugauu

SEQ ID NO: 166434 - RNA, 25 nt, Human
ugucugacucuucugaaugucccuc

SEQ ID NO: 166435 - RNA, 21 nt, Human
ugucuggagcggucugcagag

SEQ ID NO: 166436 - RNA, 23 nt, Human
uguuuuauauuuuuggcuccuuc

SEQ ID NO: 166437 - RNA, 19 nt, Human
uuccuccaguacugggccc

SEQ ID NO: 166438 - RNA, 19 nt, Human
uucguccagugcugguccu

SEQ ID NO: 166439 - RNA, 23 nt, Human
uugcuucauucuucuauucuugg

SEQ ID NO: 166440 - RNA, 22 nt, Human
uugggacgcugagugccuggag

SEQ ID NO: 166441 - RNA, 22 nt, Human
uugggacgcugagugccuggag

SEQ ID NO: 166442 - RNA, 26 nt, Human
uugguggcucugcugauggggcccag

SEQ ID NO: 166443 - RNA, 22 nt, Human
uuuaaacagauugacaggaaaa

SEQ ID NO: 166444 - RNA, 23 nt, Human
aagucugcagccgagccccccaa

SEQ ID NO: 166445 - RNA, 23 nt, Human
acaagugauucacccgucuuggc

SEQ ID NO: 166446 - RNA, 24 nt, Human
accacguuggcuaggcuggucuug

SEQ ID NO: 166447 - RNA, 25 nt, Human
acccgucuuggccucucaaagugcu

SEQ ID NO: 166448 - RNA, 19 nt, Human
agcccggcgcggccucccu

SEQ ID NO: 166449 - RNA, 20 nt, Human
augagguuucaccacguugg

SEQ ID NO: 166450 - RNA, 21 nt, Human
caccacguuggcuaggcuggu

SEQ ID NO: 166451 - RNA, 23 nt, Human
caccacguuggcuaggcuggucu

SEQ ID NO: 166452 - RNA, 24 nt, Human
caccacguuggcuaggcuggucuu

SEQ ID NO: 166453 - RNA, 23 nt, Human
cacccgucuuggccucucaaagu

SEQ ID NO: 166454 - RNA, 24 nt, Human
cacccgucuuggccucucaaagug

SEQ ID NO: 166455 - RNA, 21 nt, Human
cagccccuucggauuagcccg

SEQ ID NO: 166456 - RNA, 23 nt, Human
cagccccuucggauuagcccggc

SEQ ID NO: 166457 - RNA, 24 nt, Human
cagccgagccccccaauauuccaa

SEQ ID NO: 166458 - RNA, 19 nt, Human
cagccugaccucgcagccc

SEQ ID NO: 166459 - RNA, 23 nt, Human
ccccaauauuccacacauugacc

SEQ ID NO: 166460 - RNA, 24 nt, Human
cccuggcgcccugggcccucccug

SEQ ID NO: 166461 - RNA, 19 nt, Human
ccugacaagugauucaccc

SEQ ID NO: 166462 - RNA, 19 nt, Human
cgcccugggcccucccugc

SEQ ID NO: 166463 - RNA, 22 nt, Human
cguuggcuaggcuggucuugaa

SEQ ID NO: 166464 - RNA, 18 nt, Human
cucucucucucucucucu

SEQ ID NO: 166465 - RNA, 18 nt, Human
cucucucucucucucucu

SEQ ID NO: 166466 - RNA, 18 nt, Human
cucucucucucucucucu

SEQ ID NO: 166467 - RNA, 18 nt, Human
cucucucucucucucucu

SEQ ID NO: 166468 - RNA, 18 nt, Human
cucucucucucucucucu

SEQ ID NO: 166469 - RNA, 18 nt, Human
cucucucucucucucucu

SEQ ID NO: 166470 - RNA, 18 nt, Human
cucucucucucucucucu

SEQ ID NO: 166471 - RNA, 18 nt, Human
cucucucucucucucucu

SEQ ID NO: 166472 - RNA, 21 nt, Human
cuggcgcccugggcccucccu

SEQ ID NO: 166473 - RNA, 22 nt, Human
gaaagagacaguuaaccggaug

SEQ ID NO: 166474 - RNA, 23 nt, Human
gagcgcccugcccucacuccccu

SEQ ID NO: 166475 - RNA, 19 nt, Human
gagguuucaccacguuggc

SEQ ID NO: 166476 - RNA, 25 nt, Human
gcccugggcccucccugcgugcccc

SEQ ID NO: 166477 - RNA, 18 nt, Human
ggcuggucuugaacuccu

SEQ ID NO: 166478 - RNA, 24 nt, Human
uacagccugaccucgcagccccuu

SEQ ID NO: 166479 - RNA, 21 nt, Human
uagcggagcgaaagagacagu

SEQ ID NO: 166480 - RNA, 24 nt, Human
uaguagagaugagguuucaccacg

SEQ ID NO: 166481 - RNA, 26 nt, Human
uaguagagaugagguuucaccacguu

SEQ ID NO: 166482 - RNA, 19 nt, Human
uaucucucucucucucucu

SEQ ID NO: 166483 - RNA, 18 nt, Human
ucuugaacuccugacaag

SEQ ID NO: 166484 - RNA, 21 nt, Human
ugacaagugauucacccgucu

SEQ ID NO: 166485 - RNA, 24 nt, Human
ugagguuucaccacguuggcuagg

SEQ ID NO: 166486 - RNA, 18 nt, Human
uggccucucaaagugcug

SEQ ID NO: 166487 - RNA, 24 nt, Human
uggcuaggcuggucuugaacuccu

SEQ ID NO: 166488 - RNA, 18 nt, Human
uuaguagagaugagguuu

SEQ ID NO: 166489 - RNA, 22 nt, Human
uuaguagagaugagguuucacc

SEQ ID NO: 166490 - RNA, 24 nt, Human
uuaguagagaugagguuucaccac

SEQ ID NO: 166491 - RNA, 25 nt, Human
uuaguagagaugagguuucaccacg

SEQ ID NO: 166492 - RNA, 24 nt, Human
uucacuuugcgaaucggggaggaa

SEQ ID NO: 166493 - RNA, 21 nt, Human
uuucaccacguuggcuaggcu

SEQ ID NO: 166494 - RNA, 24 nt, Human
uuuuuaguagagaugagguuucac

SEQ ID NO: 166495 - RNA, 21 nt, Human
uuuuucagcuaauuuugggaa

SEQ ID NO: 166496 - RNA, 23 nt, Human
aggcuacuggggacuguggcacu

SEQ ID NO: 166497 - RNA, 19 nt, Human
cacgugcacucacacugug

SEQ ID NO: 166498 - RNA, 19 nt, Human
cacuggacguggcuggagc

SEQ ID NO: 166499 - RNA, 21 nt, Human
ccccuuccucuuccucaccaa

SEQ ID NO: 166500 - RNA, 22 nt, Human
ccccuuccucuuccucaccaag

SEQ ID NO: 166501 - RNA, 22 nt, Human
ccucuuccucaccaagccuggg

SEQ ID NO: 166502 - RNA, 19 nt, Human
uagcggaagagugaggggg

SEQ ID NO: 166503 - RNA, 20 nt, Human
uaucccuagcggaagaguga

SEQ ID NO: 166504 - RNA, 23 nt, Human
ucgcugccgggccgcgccgggcu

SEQ ID NO: 166505 - RNA, 23 nt, Human
uggcacuggacguggcuggagca

SEQ ID NO: 166506 - RNA, 22 nt, Human
uggugcugcuugaggcuacugg

SEQ ID NO: 166507 - RNA, 22 nt, Human
uggugucaccugaguacauucu

SEQ ID NO: 166508 - RNA, 20 nt, Human
uuccucuuccucaccaagcc

SEQ ID NO: 166509 - RNA, 18 nt, Human
aagaagacaagcagcgcc

SEQ ID NO: 166510 - RNA, 23 nt, Human
aagaagacaagcagcgccaccaa

SEQ ID NO: 166511 - RNA, 22 nt, Human
aagagggcggggcugcuugggu

SEQ ID NO: 166512 - RNA, 24 nt, Human
aauggcucccucugcccaagugaa

SEQ ID NO: 166513 - RNA, 25 nt, Human
acaagcagcgccaccaaauggccga

SEQ ID NO: 166514 - RNA, 20 nt, Human
agacaagcagcgccaccaaa

SEQ ID NO: 166515 - RNA, 20 nt, Human
agcggcuggcuggggaggca

SEQ ID NO: 166516 - RNA, 20 nt, Human
aggcgcgagaagccgggggg

SEQ ID NO: 166517 - RNA, 20 nt, Human
caaauggcucccucugccca

SEQ ID NO: 166518 - RNA, 20 nt, Human
cacggcacagggcaggggca

SEQ ID NO: 166519 - RNA, 24 nt, Human
cagcgccaccaaauggcucccucu

SEQ ID NO: 166520 - RNA, 18 nt, Human
cagcugcagugacaggcg

SEQ ID NO: 166521 - RNA, 22 nt, Human
ccaccaaauggcucccucugcc

SEQ ID NO: 166522 - RNA, 23 nt, Human
ccaccaaauggcucccucugccc

SEQ ID NO: 166523 - RNA, 23 nt, Human
ccccaucccucaccccucccaga

SEQ ID NO: 166524 - RNA, 24 nt, Human
ccccaucccucaccccucccagaa

SEQ ID NO: 166525 - RNA, 21 nt, Human
cccucaccccucccagaacca

SEQ ID NO: 166526 - RNA, 21 nt, Human
cccucugcccaagugaaagcc

SEQ ID NO: 166527 - RNA, 26 nt, Human
cccucugcccaagugaaagccgagag

SEQ ID NO: 166528 - RNA, 22 nt, Human
ccgggggggcggugcugcagcc

SEQ ID NO: 166529 - RNA, 21 nt, Human
ccucaccccucccagaaccaa

SEQ ID NO: 166530 - RNA, 22 nt, Human
ccucaccccucccagaaccaaa

SEQ ID NO: 166531 - RNA, 24 nt, Human
ccucccagaaccaaagaagacaag

SEQ ID NO: 166532 - RNA, 23 nt, Human
cgcgagaagccgggggggcggug

SEQ ID NO: 166533 - RNA, 19 nt, Human
cugggccgggguugagggg

SEQ ID NO: 166534 - RNA, 18 nt, Human
gaagacaagcagcgccac

SEQ ID NO: 166535 - RNA, 21 nt, Human
gagcgcagcacggcacagggc

SEQ ID NO: 166536 - RNA, 22 nt, Human
gaggcaggugagcgcagcacgg

SEQ ID NO: 166537 - RNA, 19 nt, Human
gaggggaagagggcggggc

SEQ ID NO: 166538 - RNA, 20 nt, Human
gcagcugcagugacaggcgg

SEQ ID NO: 166539 - RNA, 24 nt, Human
gccaccaaauggcucccucugccc

SEQ ID NO: 166540 - RNA, 19 nt, Human
gcggugcugcagccucggc

SEQ ID NO: 166541 - RNA, 22 nt, Human
gggcagcugcagugacaggcgg

SEQ ID NO: 166542 - RNA, 21 nt, Human
gggcggugcugcagccucggc

SEQ ID NO: 166543 - RNA, 20 nt, Human
ucaccccucccagaaccaaa

SEQ ID NO: 166544 - RNA, 24 nt, Human
ucccucaccccucccagaaccaaa

SEQ ID NO: 166545 - RNA, 21 nt, Human
ucccucugcccaagugaaagc

SEQ ID NO: 166546 - RNA, 24 nt, Human
ugaccgaugaccgcgggguggcgc

SEQ ID NO: 166547 - RNA, 21 nt, Human
ugagcgcagcacggcacaggg

SEQ ID NO: 166548 - RNA, 22 nt, Human
ugaggcgcgagaagccgggggg

SEQ ID NO: 166549 - RNA, 19 nt, Human
aaaguugaaaaccuccagc

SEQ ID NO: 166550 - RNA, 22 nt, Human
aacccccuucaagacaaggcac

SEQ ID NO: 166551 - RNA, 19 nt, Human
agacaaggcacaaacuauu

SEQ ID NO: 166552 - RNA, 24 nt, Human
agggaccugggagccgggcagggg

SEQ ID NO: 166553 - RNA, 19 nt, Human
aggggugggaccucacugu

SEQ ID NO: 166554 - RNA, 28 nt, Human
aggugggguggagugggaucaucagaag

SEQ ID NO: 166555 - RNA, 22 nt, Human
augggaccgcuggaguuggcaa

SEQ ID NO: 166556 - RNA, 19 nt, Human
caacccccuucaagacaag

SEQ ID NO: 166557 - RNA, 21 nt, Human
caagacaaggcacaaacuauu

SEQ ID NO: 166558 - RNA, 24 nt, Human
caagacaaggcacaaacuauuugg

SEQ ID NO: 166559 - RNA, 20 nt, Human
cagggaccugggagccgggc

SEQ ID NO: 166560 - RNA, 21 nt, Human
ccccuucaagacaaggcacaa

SEQ ID NO: 166561 - RNA, 18 nt, Human
cccgcguuccccacccug

SEQ ID NO: 166562 - RNA, 24 nt, Human
ccucacugucaauggacaugcuca

SEQ ID NO: 166563 - RNA, 20 nt, Human
ccuccagcccaucccucagu

SEQ ID NO: 166564 - RNA, 18 nt, Human
ccugggagcuggccccgc

SEQ ID NO: 166565 - RNA, 18 nt, Human
cggcagcccggcuggggu

SEQ ID NO: 166566 - RNA, 25 nt, Human
cucccgcguuccccacccugccgca

SEQ ID NO: 166567 - RNA, 19 nt, Human
cuuacagcaauuuauuugg

SEQ ID NO: 166568 - RNA, 22 nt, Human
gaccagcuuuccugggagcugg

SEQ ID NO: 166569 - RNA, 19 nt, Human
gaggcugggcaucugugag

SEQ ID NO: 166570 - RNA, 19 nt, Human
gcaaggggagcaacccccu

SEQ ID NO: 166571 - RNA, 21 nt, Human
gcucaaacagucugauuuaau

SEQ ID NO: 166572 - RNA, 26 nt, Human
ggcaaggggagcaacccccuucaaga

SEQ ID NO: 166573 - RNA, 20 nt, Human
gggacgcgggcggcagcccg

SEQ ID NO: 166574 - RNA, 19 nt, Human
ggggucucgggaagggcgg

SEQ ID NO: 166575 - RNA, 23 nt, Human
guuacaugcaacaggaggaucau

SEQ ID NO: 166576 - RNA, 22 nt, Human
guugaaaaccuccagcccaucc

SEQ ID NO: 166577 - RNA, 26 nt, Human
ucaauggacaugcucagggaggccag

SEQ ID NO: 166578 - RNA, 18 nt, Human
ucccucagucuuggucag

SEQ ID NO: 166579 - RNA, 23 nt, Human
ugaggugggguggagugggauca

SEQ ID NO: 166580 - RNA, 18 nt, Human
ugagguuggcaaggggag

SEQ ID NO: 166581 - RNA, 18 nt, Human
uggagugggaucaucaga

SEQ ID NO: 166582 - RNA, 20 nt, Human
uggcaaggagagaugagggg

SEQ ID NO: 166583 - RNA, 21 nt, Human
ugggaucaucagaaggcugac

SEQ ID NO: 166584 - RNA, 22 nt, Human
ugggguggagugggaucaucag

SEQ ID NO: 166585 - RNA, 28 nt, Human
ugggguggagugggaucaucagaaggcu

SEQ ID NO: 166586 - RNA, 23 nt, Human
uugaaaaccuccagcccaucccu

SEQ ID NO: 166587 - RNA, 24 nt, Human
uuggcaaggggagcaacccccuuc

SEQ ID NO: 166588 - RNA, 20 nt, Human
aaaaagacagacaaaggaaa

SEQ ID NO: 166589 - RNA, 19 nt, Human
aaaaagacagacaaaggag

SEQ ID NO: 166590 - RNA, 22 nt, Human
aaagaaaaagacagacaaagga

SEQ ID NO: 166591 - RNA, 21 nt, Human
aagaaaaagacagacaaagga

SEQ ID NO: 166592 - RNA, 23 nt, Human
aagacacgcagggagaugagaca

SEQ ID NO: 166593 - RNA, 19 nt, Human
aagacagacaaaggaaaag

SEQ ID NO: 166594 - RNA, 21 nt, Human
acagacaaaggaaaagacacg

SEQ ID NO: 166595 - RNA, 21 nt, Human
acagagaacuucaaggcacca

SEQ ID NO: 166596 - RNA, 19 nt, Human
acgcagcacuucugguccc

SEQ ID NO: 166597 - RNA, 20 nt, Human
agaagggacaggcagugggg

SEQ ID NO: 166598 - RNA, 24 nt, Human
agacagccagagauggccugaaca

SEQ ID NO: 166599 - RNA, 18 nt, Human
agaccuagaggggcagca

SEQ ID NO: 166600 - RNA, 18 nt, Human
agaggaagaggaggaggu

SEQ ID NO: 166601 - RNA, 25 nt, Human
agaggaagaggaggagguggacagg

SEQ ID NO: 166602 - RNA, 19 nt, Human
agaggaggagguggacaga

SEQ ID NO: 166603 - RNA, 25 nt, Human
agaggaggagguggacagacaggag

SEQ ID NO: 166604 - RNA, 21 nt, Human
agcagcagggccaccccccac

SEQ ID NO: 166605 - RNA, 22 nt, Human
agcagcagggccaccccccaca

SEQ ID NO: 166606 - RNA, 23 nt, Human
agcagcagggccaccccccacag

SEQ ID NO: 166607 - RNA, 23 nt, Human
agcaggugaggcugugggcuucc

SEQ ID NO: 166608 - RNA, 18 nt, Human
aggaagcugcuguagaca

SEQ ID NO: 166609 - RNA, 19 nt, Human
aggaagcugcuguagacag

SEQ ID NO: 166610 - RNA, 25 nt, Human
aggacagugucucugggcccugcag

SEQ ID NO: 166611 - RNA, 22 nt, Human
aggaggagguggacagacagga

SEQ ID NO: 166612 - RNA, 24 nt, Human
aggcuggggcagggccaggguggg

SEQ ID NO: 166613 - RNA, 22 nt, Human
agggagaugagacacaaaccug

SEQ ID NO: 166614 - RNA, 18 nt, Human
aguggcagugaaaguggg

SEQ ID NO: 166615 - RNA, 21 nt, Human
auggcacaagggcucuggggu

SEQ ID NO: 166616 - RNA, 22 nt, Human
caacagcccccugaaaccacca

SEQ ID NO: 166617 - RNA, 20 nt, Human
caacauccaagccccagacc

SEQ ID NO: 166618 - RNA, 22 nt, Human
caaggcaccaggauucugagga

SEQ ID NO: 166619 - RNA, 22 nt, Human
caccaccaggcccaggcccagc

SEQ ID NO: 166620 - RNA, 24 nt, Human
caccaggauucugaggagcagcag

SEQ ID NO: 166621 - RNA, 18 nt, Human
cagagaacuucaaggcac

SEQ ID NO: 166622 - RNA, 18 nt, Human
cagcagcaggugaggcug

SEQ ID NO: 166623 - RNA, 25 nt, Human
cagcaggugaggcugugggcuuccu

SEQ ID NO: 166624 - RNA, 23 nt, Human
cagcauccacaugcaggaagagc

SEQ ID NO: 166625 - RNA, 24 nt, Human
cagcccuagcaggaagaaggucua

SEQ ID NO: 166626 - RNA, 22 nt, Human
caggguaugagcgcuggcuggg

SEQ ID NO: 166627 - RNA, 21 nt, Human
cagugcaacauccaagcccca

SEQ ID NO: 166628 - RNA, 21 nt, Human
ccagaagggcccaacacccag

SEQ ID NO: 166629 - RNA, 24 nt, Human
ccagaccagacaugcagcauccac

SEQ ID NO: 166630 - RNA, 21 nt, Human
ccaggcccagccgccaaacac

SEQ ID NO: 166631 - RNA, 19 nt, Human
cccagaccagacaugcagc

SEQ ID NO: 166632 - RNA, 21 nt, Human
ccccugaaaccaccagcgccu

SEQ ID NO: 166633 - RNA, 23 nt, Human
ccccugaaaccaccagcgccucg

SEQ ID NO: 166634 - RNA, 19 nt, Human
ccuccuaaggcaguaggaa

SEQ ID NO: 166635 - RNA, 21 nt, Human
ccuuguccaccagaagggccc

SEQ ID NO: 166636 - RNA, 24 nt, Human
cucagaaaacuuagcagaguuggg

SEQ ID NO: 166637 - RNA, 18 nt, Human
cucaucucagaaaacuua

SEQ ID NO: 166638 - RNA, 21 nt, Human
cugcaggucauggcugcccag

SEQ ID NO: 166639 - RNA, 19 nt, Human
cugccuccauuggagcaag

SEQ ID NO: 166640 - RNA, 19 nt, Human
cuggagggagggccgggug

SEQ ID NO: 166641 - RNA, 20 nt, Human
cugugggauuaaaacgggug

SEQ ID NO: 166642 - RNA, 20 nt, Human
cuuccccauggcuggaaccc

SEQ ID NO: 166643 - RNA, 19 nt, Human
gaaccacaacagcccccug

SEQ ID NO: 166644 - RNA, 24 nt, Human
gaagacagccagagauggccugaa

SEQ ID NO: 166645 - RNA, 21 nt, Human
gaccaaaccgcaccgccccag

SEQ ID NO: 166646 - RNA, 24 nt, Human
gagcagcagggccaccccccacag

SEQ ID NO: 166647 - RNA, 23 nt, Human
gagggccggguggcugcugaaga

SEQ ID NO: 166648 - RNA, 21 nt, Human
gccaccccccacagagaguga

SEQ ID NO: 166649 - RNA, 18 nt, Human
gccccagaccagacaugc

SEQ ID NO: 166650 - RNA, 21 nt, Human
ggacagaugcacagagaacuu

SEQ ID NO: 166651 - RNA, 18 nt, Human
ggagcaaggagacagagg

SEQ ID NO: 166652 - RNA, 19 nt, Human
ggcagggccagggugggga

SEQ ID NO: 166653 - RNA, 24 nt, Human
ggcccaggcccagccgccaaacac

SEQ ID NO: 166654 - RNA, 23 nt, Human
ggcuggaaccccaucacucuggc

SEQ ID NO: 166655 - RNA, 20 nt, Human
ggcuggggcagggccagggu

SEQ ID NO: 166656 - RNA, 23 nt, Human
gggaaagaaaaagacagacaaag

SEQ ID NO: 166657 - RNA, 21 nt, Human
gggaggauggacagaugcaca

SEQ ID NO: 166658 - RNA, 19 nt, Human
gggagggccggguggcugc

SEQ ID NO: 166659 - RNA, 23 nt, Human
gggcagcagcaggugaggcugug

SEQ ID NO: 166660 - RNA, 23 nt, Human
gggcagcagcaggugaggcugug

SEQ ID NO: 166661 - RNA, 19 nt, Human
gggcagggccagggugggg

SEQ ID NO: 166662 - RNA, 20 nt, Human
gggcagggccagggugggga

SEQ ID NO: 166663 - RNA, 20 nt, Human
gggcaggguuuagggcuggg

SEQ ID NO: 166664 - RNA, 22 nt, Human
gggcaggguuuagggcugggaa

SEQ ID NO: 166665 - RNA, 21 nt, Human
gggccaggguggggagcuggg

SEQ ID NO: 166666 - RNA, 26 nt, Human
gggcuagacccucaucucagaaaacu

SEQ ID NO: 166667 - RNA, 21 nt, Human
ggggucuggccaggcuacagc

SEQ ID NO: 166668 - RNA, 24 nt, Human
gguccugggcucuucugggagagc

SEQ ID NO: 166669 - RNA, 18 nt, Human
gguggacagacaggagag

SEQ ID NO: 166670 - RNA, 18 nt, Human
guagacaggaggccuugc

SEQ ID NO: 166671 - RNA, 19 nt, Human
guggcagugaaaguggggu

SEQ ID NO: 166672 - RNA, 22 nt, Human
uacccagaaccccugcccaugc

SEQ ID NO: 166673 - RNA, 25 nt, Human
uacccagaaccccugcccaugcuga

SEQ ID NO: 166674 - RNA, 22 nt, Human
uagcagaguugggaccaaaccg

SEQ ID NO: 166675 - RNA, 26 nt, Human
uccccauggcuggaaccccaucacuc

SEQ ID NO: 166676 - RNA, 18 nt, Human
ucgagauaaggcaccaga

SEQ ID NO: 166677 - RNA, 20 nt, Human
ucggaaccacaacagccccc

SEQ ID NO: 166678 - RNA, 20 nt, Human
ucuacacacuuuucuguccc

SEQ ID NO: 166679 - RNA, 24 nt, Human
ucuacacacuuuucuguccccaac

SEQ ID NO: 166680 - RNA, 23 nt, Human
ucuucagcuuaaucuacaugaug

SEQ ID NO: 166681 - RNA, 22 nt, Human
ugaggcugugggcuuccugggg

SEQ ID NO: 166682 - RNA, 29 nt, Human
ugaggcugugggcuuccuggggcaggguu

SEQ ID NO: 166683 - RNA, 18 nt, Human
ugcccagaccuagagggg

SEQ ID NO: 166684 - RNA, 22 nt, Human
ugcccaugaagaggccuucccu

SEQ ID NO: 166685 - RNA, 20 nt, Human
ugcuggagggagggccgggu

SEQ ID NO: 166686 - RNA, 22 nt, Human
ugcuggagggagggccgggugg

SEQ ID NO: 166687 - RNA, 25 nt, Human
ugcuggagggagggccggguggcug

SEQ ID NO: 166688 - RNA, 23 nt, Human
ugcuggagggagggccggguggg

SEQ ID NO: 166689 - RNA, 21 nt, Human
uggacauucacagcaccccug

SEQ ID NO: 166690 - RNA, 21 nt, Human
uggagcaaggagacagaggau

SEQ ID NO: 166691 - RNA, 22 nt, Human
uggcacaagggcucuggggucu

SEQ ID NO: 166692 - RNA, 18 nt, Human
uggccaggaagaaagaug

SEQ ID NO: 166693 - RNA, 24 nt, Human
uggccaggaagaaagauggcacaa

SEQ ID NO: 166694 - RNA, 21 nt, Human
uggccagggccauagggagga

SEQ ID NO: 166695 - RNA, 21 nt, Human
uggcuggaaccccaucacucu

SEQ ID NO: 166696 - RNA, 20 nt, Human
ugggguaaaggagaggaaga

SEQ ID NO: 166697 - RNA, 20 nt, Human
uggguccugggcucuucugc

SEQ ID NO: 166698 - RNA, 22 nt, Human
uggguccugggcucuucugccu

SEQ ID NO: 166699 - RNA, 22 nt, Human
uuauagucggaaccacaacagc

SEQ ID NO: 166700 - RNA, 22 nt, Human
uuccccauggcuggaaccccau

SEQ ID NO: 166701 - RNA, 22 nt, Human
aaaaaaaaaaaacccaacccag

SEQ ID NO: 166702 - RNA, 22 nt, Human
aaaaaaaaaaacccaacccagc

SEQ ID NO: 166703 - RNA, 18 nt, Human
aaaaacccaacccagccc

SEQ ID NO: 166704 - RNA, 20 nt, Human
aaaacccaacccagcccugc

SEQ ID NO: 166705 - RNA, 22 nt, Human
aagaucuuuucuucccucucuc

SEQ ID NO: 166706 - RNA, 22 nt, Human
acccauggaauuucucuuccuu

SEQ ID NO: 166707 - RNA, 19 nt, Human
accuccuucgucgcugccg

SEQ ID NO: 166708 - RNA, 23 nt, Human
agagccggcugcuucucccuggc

SEQ ID NO: 166709 - RNA, 20 nt, Human
caaaaucgucagcccucccc

SEQ ID NO: 166710 - RNA, 26 nt, Human
cagggcaaaagaucuuuucuucccuc

SEQ ID NO: 166711 - RNA, 23 nt, Human
ccaacccagcccugccugcaaua

SEQ ID NO: 166712 - RNA, 21 nt, Human
ccacgccagggcagcuggggc

SEQ ID NO: 166713 - RNA, 21 nt, Human
ccagggcaaaagaucuuuucu

SEQ ID NO: 166714 - RNA, 25 nt, Human
ccaguucaggggggaaaaaaaaaaa

SEQ ID NO: 166715 - RNA, 18 nt, Human
cccaacccagcccugccu

SEQ ID NO: 166716 - RNA, 23 nt, Human
cccaacccagcccugccugcaau

SEQ ID NO: 166717 - RNA, 23 nt, Human
ccgcccaagacccucuggguuug

SEQ ID NO: 166718 - RNA, 22 nt, Human
ccggaggccccugccaaaguca

SEQ ID NO: 166719 - RNA, 19 nt, Human
ccucagcccuggggugacu

SEQ ID NO: 166720 - RNA, 26 nt, Human
ccuccuucgucgcugccgcccaagac

SEQ ID NO: 166721 - RNA, 22 nt, Human
ccucuggguuugacugggguca

SEQ ID NO: 166722 - RNA, 20 nt, Human
cucccuggcgguuccuuugu

SEQ ID NO: 166723 - RNA, 23 nt, Human
cuucucccuggcgguuccuuugu

SEQ ID NO: 166724 - RNA, 23 nt, Human
gaggcugugggccacaaucagca

SEQ ID NO: 166725 - RNA, 20 nt, Human
gccggcugcuucucccuggc

SEQ ID NO: 166726 - RNA, 20 nt, Human
gcgguuccuuugugauggcc

SEQ ID NO: 166727 - RNA, 21 nt, Human
ggggcagcccgggugggcggg

SEQ ID NO: 166728 - RNA, 23 nt, Human
ggggcagcccgggugggcgggca

SEQ ID NO: 166729 - RNA, 27 nt, Human
ggggcugaggcggggcagcccgggugg

SEQ ID NO: 166730 - RNA, 21 nt, Human
ggugccucgguauccuggucu

SEQ ID NO: 166731 - RNA, 21 nt, Human
gucuucaacaaugucgaauuc

SEQ ID NO: 166732 - RNA, 23 nt, Human
uaguccuucccuccccaacuggc

SEQ ID NO: 166733 - RNA, 22 nt, Human
uauccuggucuccuggcguuca

SEQ ID NO: 166734 - RNA, 23 nt, Human
uaugucuucaacaaugucgaauu

SEQ ID NO: 166735 - RNA, 26 nt, Human
uauuuuuaguccuucccuccccaacu

SEQ ID NO: 166736 - RNA, 31 nt, Human
uccuucgucgcugccgcccaagacccucugg

SEQ ID NO: 166737 - RNA, 24 nt, Human
ucuauucuuuuaaaaaaaauuguc

SEQ ID NO: 166738 - RNA, 18 nt, Human
ucuggguuugacuggggu

SEQ ID NO: 166739 - RNA, 20 nt, Human
ucuuuucuucccucucuccu

SEQ ID NO: 166740 - RNA, 21 nt, Human
ugaauaccuccuucgucgcug

SEQ ID NO: 166741 - RNA, 24 nt, Human
ugacuggggucacugguccggagg

SEQ ID NO: 166742 - RNA, 19 nt, Human
ugauggccuugaacagagc

SEQ ID NO: 166743 - RNA, 22 nt, Human
ugcagcaggcugggcaaagcca

SEQ ID NO: 166744 - RNA, 22 nt, Human
ugcggaggaaagucacccaugg

SEQ ID NO: 166745 - RNA, 19 nt, Human
uuaguccuucccuccccaa

SEQ ID NO: 166746 - RNA, 18 nt, Human
uucaggggggaaaaaaaa

SEQ ID NO: 166747 - RNA, 21 nt, Human
uucaggggggaaaaaaaaaaa

SEQ ID NO: 166748 - RNA, 22 nt, Human
uucaggggggaaaaaaaaaaaa

SEQ ID NO: 166749 - RNA, 24 nt, Human
uucaggggggaaaaaaaaaaaacc

SEQ ID NO: 166750 - RNA, 22 nt, Human
uuccuugcucucuuggauugca

SEQ ID NO: 166751 - RNA, 19 nt, Human
uucugcggaggaaagucac

SEQ ID NO: 166752 - RNA, 28 nt, Human
aaaaaaaaaaauaaacagcaaaaucaaa

SEQ ID NO: 166753 - RNA, 21 nt, Human
aaaaaagcaacagccaaaacc

SEQ ID NO: 166754 - RNA, 25 nt, Human
aaaacaaaggugucauaaacaacua

SEQ ID NO: 166755 - RNA, 27 nt, Human
aaacagaaaccagaagcaaagggaccc

SEQ ID NO: 166756 - RNA, 18 nt, Human
aaaugauucuucugccuc

SEQ ID NO: 166757 - RNA, 19 nt, Human
aagcauccauucccugugg

SEQ ID NO: 166758 - RNA, 24 nt, Human
acagagcgcugggauuacagacgu

SEQ ID NO: 166759 - RNA, 19 nt, Human
acaucacagauuccaucac

SEQ ID NO: 166760 - RNA, 18 nt, Human
acauuccagggacaccuu

SEQ ID NO: 166761 - RNA, 18 nt, Human
acgugaacuaucaugcug

SEQ ID NO: 166762 - RNA, 25 nt, Human
agaaaaaaaaaaauaaacagcaaaa

SEQ ID NO: 166763 - RNA, 26 nt, Human
agacaccaaugggaauuaaccccuuu

SEQ ID NO: 166764 - RNA, 19 nt, Human
agaccaagaacaagaccaa

SEQ ID NO: 166765 - RNA, 22 nt, Human
agagagagagcuaguaagauga

SEQ ID NO: 166766 - RNA, 24 nt, Human
agagcgcugggauuacagacguga

SEQ ID NO: 166767 - RNA, 25 nt, Human
agcaaaagggacccugucagaccau

SEQ ID NO: 166768 - RNA, 24 nt, Human
agcagccagaaaucccacuggggg

SEQ ID NO: 166769 - RNA, 20 nt, Human
agcgcugggauuacagacgu

SEQ ID NO: 166770 - RNA, 22 nt, Human
agcgcugggauuacagacguga

SEQ ID NO: 166771 - RNA, 23 nt, Human
agcuaauuaacacauccaauacg

SEQ ID NO: 166772 - RNA, 22 nt, Human
agcugcgauggccucugcagcc

SEQ ID NO: 166773 - RNA, 19 nt, Human
aggaaaauuugugcuuauu

SEQ ID NO: 166774 - RNA, 22 nt, Human
aggaagaggcaagauucauuua

SEQ ID NO: 166775 - RNA, 20 nt, Human
aggaagugugccaccaugcc

SEQ ID NO: 166776 - RNA, 27 nt, Human
aggaggaagugugccaccaugccuggc

SEQ ID NO: 166777 - RNA, 23 nt, Human
aggcaagguuugacaagaccaag

SEQ ID NO: 166778 - RNA, 22 nt, Human
agggacccugucagaccaucuu

SEQ ID NO: 166779 - RNA, 27 nt, Human
agguuugacaagaccaagaacaagacc

SEQ ID NO: 166780 - RNA, 20 nt, Human
agugguccuccugcuucagc

SEQ ID NO: 166781 - RNA, 22 nt, Human
aucacugugucuucuagccacu

SEQ ID NO: 166782 - RNA, 18 nt, Human
aucauccuugccgcccug

SEQ ID NO: 166783 - RNA, 19 nt, Human
aucccauuauauaguacac

SEQ ID NO: 166784 - RNA, 24 nt, Human
augaagauguuguccucccuggug

SEQ ID NO: 166785 - RNA, 22 nt, Human
augaauggaauagaaaacagga

SEQ ID NO: 166786 - RNA, 20 nt, Human
augguagauaaaugaaugga

SEQ ID NO: 166787 - RNA, 18 nt, Human
caaagacaccaaugggaa

SEQ ID NO: 166788 - RNA, 21 nt, Human
caaagcagaauccccagggac

SEQ ID NO: 166789 - RNA, 23 nt, Human
caaauauacauucccaugacuaa

SEQ ID NO: 166790 - RNA, 18 nt, Human
caacagccaaaacccucu

SEQ ID NO: 166791 - RNA, 21 nt, Human
caagaccaagaacaagaccaa

SEQ ID NO: 166792 - RNA, 21 nt, Human
caagaccaagaacuguuuugu

SEQ ID NO: 166793 - RNA, 22 nt, Human
caagcagguauuaacaacuacc

SEQ ID NO: 166794 - RNA, 25 nt, Human
caagguacuguauaguguagaguga

SEQ ID NO: 166795 - RNA, 25 nt, Human
cacacuaaacagaaaccagaagccg

SEQ ID NO: 166796 - RNA, 19 nt, Human
cagaauuauuagcagugaa

SEQ ID NO: 166797 - RNA, 25 nt, Human
cagacuggucccugaagaugacuga

SEQ ID NO: 166798 - RNA, 24 nt, Human
cagagcgcugggauuacagacgug

SEQ ID NO: 166799 - RNA, 18 nt, Human
caggaucaaagucagucc

SEQ ID NO: 166800 - RNA, 24 nt, Human
caggaucuugcucuguugcuuagg

SEQ ID NO: 166801 - RNA, 21 nt, Human
cagguagaaaacaaaaaacua

SEQ ID NO: 166802 - RNA, 20 nt, Human
cauaugguucaaacaauaac

SEQ ID NO: 166803 - RNA, 22 nt, Human
caucagacuggucccugaagau

SEQ ID NO: 166804 - RNA, 18 nt, Human
caugaagauguuguccuc

SEQ ID NO: 166805 - RNA, 20 nt, Human
caugucauugucuugauuuu

SEQ ID NO: 166806 - RNA, 19 nt, Human
cauuguacaacccuguaca

SEQ ID NO: 166807 - RNA, 21 nt, Human
cauuuaucaaauguaaucugc

SEQ ID NO: 166808 - RNA, 18 nt, Human
ccggaccuggagguauag

SEQ ID NO: 166809 - RNA, 22 nt, Human
ccggagaucaagugaagcaucc

SEQ ID NO: 166810 - RNA, 26 nt, Human
ccuccugcuucagccucccgacaggc

SEQ ID NO: 166811 - RNA, 18 nt, Human
ccuggugcaggugaggcu

SEQ ID NO: 166812 - RNA, 21 nt, Human
ccuugcuuugugcucuucugg

SEQ ID NO: 166813 - RNA, 20 nt, Human
ccuuuuuuuuuuuuugagac

SEQ ID NO: 166814 - RNA, 21 nt, Human
cgacacacacuuggcaaugcc

SEQ ID NO: 166815 - RNA, 27 nt, Human
cgagugguccuccugcuucagccuccc

SEQ ID NO: 166816 - RNA, 20 nt, Human
cgcugggauuacagacguga

SEQ ID NO: 166817 - RNA, 23 nt, Human
cuaaaaaugccaaucaaagcaga

SEQ ID NO: 166818 - RNA, 20 nt, Human
cuacgcccugcucugccagg

SEQ ID NO: 166819 - RNA, 23 nt, Human
cucccgacaggcugggacuacag

SEQ ID NO: 166820 - RNA, 19 nt, Human
cucguucuuuuugccuugg

SEQ ID NO: 166821 - RNA, 20 nt, Human
cugacuuguuuuucaugggu

SEQ ID NO: 166822 - RNA, 23 nt, Human
cugcuucagccucccgacaggcu

SEQ ID NO: 166823 - RNA, 18 nt, Human
cuggugcaggugaggcug

SEQ ID NO: 166824 - RNA, 19 nt, Human
cuggugggugugcagguag

SEQ ID NO: 166825 - RNA, 18 nt, Human
cuuagcagucuuugccau

SEQ ID NO: 166826 - RNA, 21 nt, Human
cuugcucuguugcuuaggcug

SEQ ID NO: 166827 - RNA, 18 nt, Human
cuugcugugucgcccggg

SEQ ID NO: 166828 - RNA, 19 nt, Human
cuugcugugucgcccgggc

SEQ ID NO: 166829 - RNA, 22 nt, Human
cuugcugugucgcccgggcugg

SEQ ID NO: 166830 - RNA, 20 nt, Human
cuugcuuugugcucuucugg

SEQ ID NO: 166831 - RNA, 19 nt, Human
cuuuaaaaaaagcaacagc

SEQ ID NO: 166832 - RNA, 22 nt, Human
cuuuaaaaaaagcaacagccaa

SEQ ID NO: 166833 - RNA, 21 nt, Human
gaauaacagaaauaaaaaccc

SEQ ID NO: 166834 - RNA, 24 nt, Human
gaauaacagaaauaaaaagggagc

SEQ ID NO: 166835 - RNA, 19 nt, Human
gaguaucuuuuuuccauuu

SEQ ID NO: 166836 - RNA, 24 nt, Human
gauuacagacgugaacuaucaugc

SEQ ID NO: 166837 - RNA, 18 nt, Human
gcagaauccccagggaca

SEQ ID NO: 166838 - RNA, 19 nt, Human
gcagugggcugcuaaugca

SEQ ID NO: 166839 - RNA, 21 nt, Human
gccaaaguagaggaacaucca

SEQ ID NO: 166840 - RNA, 19 nt, Human
gcugacauaacagaaccac

SEQ ID NO: 166841 - RNA, 19 nt, Human
gcuggagugcagcggcaca

SEQ ID NO: 166842 - RNA, 19 nt, Human
gcuggucuggaacuccugg

SEQ ID NO: 166843 - RNA, 20 nt, Human
ggaauuaaccccuucacuuu

SEQ ID NO: 166844 - RNA, 22 nt, Human
ggaucuugcugugucgcccggg

SEQ ID NO: 166845 - RNA, 19 nt, Human
ggccaggcagcaucaagcu

SEQ ID NO: 166846 - RNA, 18 nt, Human
gggaaaaagaaaaagaaa

SEQ ID NO: 166847 - RNA, 18 nt, Human
guaaaauguaaugucucc

SEQ ID NO: 166848 - RNA, 19 nt, Human
guaaaauguaaugucuccu

SEQ ID NO: 166849 - RNA, 18 nt, Human
guagauaaaugaauggaa

SEQ ID NO: 166850 - RNA, 22 nt, Human
guagauaaaugaauggaauaga

SEQ ID NO: 166851 - RNA, 18 nt, Human
gucacguacuuuuuguuu

SEQ ID NO: 166852 - RNA, 21 nt, Human
gugaagcauccauucccugug

SEQ ID NO: 166853 - RNA, 24 nt, Human
gugguccuccugcuucagccuccc

SEQ ID NO: 166854 - RNA, 25 nt, Human
guggugggaaaaagaaaaagaaaaa

SEQ ID NO: 166855 - RNA, 23 nt, Human
gugugcaaugugacauuuugaua

SEQ ID NO: 166856 - RNA, 19 nt, Human
guguguguguguguguaca

SEQ ID NO: 166857 - RNA, 21 nt, Human
gugugugugugugugugugug

SEQ ID NO: 166858 - RNA, 23 nt, Human
uaaaaaaagcaacagccaaaacc

SEQ ID NO: 166859 - RNA, 20 nt, Human
uaaaaacccucaaaagucaa

SEQ ID NO: 166860 - RNA, 27 nt, Human
uaaaaacccucaaaagucaaaguacca

SEQ ID NO: 166861 - RNA, 20 nt, Human
uaaaaagcaaagaguuacaa

SEQ ID NO: 166862 - RNA, 24 nt, Human
uaaaaagcaaagaguuacaaaacu

SEQ ID NO: 166863 - RNA, 21 nt, Human
uaaaagauauuacuucaagcu

SEQ ID NO: 166864 - RNA, 18 nt, Human
uaaacagaaaccagaagc

SEQ ID NO: 166865 - RNA, 19 nt, Human
uaaacagaaaccagaagca

SEQ ID NO: 166866 - RNA, 19 nt, Human
uaaaugauucuucugccuc

SEQ ID NO: 166867 - RNA, 21 nt, Human
uaaaugauucuucugccucga

SEQ ID NO: 166868 - RNA, 20 nt, Human
uaacagaaauaaaaacccuc

SEQ ID NO: 166869 - RNA, 24 nt, Human
uaacagaaauaaaaacccucaaaa

SEQ ID NO: 166870 - RNA, 23 nt, Human
uaacauaagauugauuagcccuc

SEQ ID NO: 166871 - RNA, 25 nt, Human
uaaccucagggagaaugucuaauau

SEQ ID NO: 166872 - RNA, 24 nt, Human
uaagaauauaaucuucucucucuc

SEQ ID NO: 166873 - RNA, 22 nt, Human
uaagcaaagacaccaaugggaa

SEQ ID NO: 166874 - RNA, 26 nt, Human
uaagccccaaauaauucugugaaccc

SEQ ID NO: 166875 - RNA, 24 nt, Human
uaaguucccagucagaaagccaac

SEQ ID NO: 166876 - RNA, 19 nt, Human
uaauauuagcuacuucauu

SEQ ID NO: 166877 - RNA, 22 nt, Human
uaaucaaacauaucuccccaaa

SEQ ID NO: 166878 - RNA, 23 nt, Human
uacauaaaugagaaugaguauuu

SEQ ID NO: 166879 - RNA, 25 nt, Human
uaccauaaauauaaagaugaaagca

SEQ ID NO: 166880 - RNA, 19 nt, Human
uacgcccugcucugccagg

SEQ ID NO: 166881 - RNA, 26 nt, Human
uagaaaacaaaaaacuauaguaaaaa

SEQ ID NO: 166882 - RNA, 18 nt, Human
uagaaaacaggaagaggc

SEQ ID NO: 166883 - RNA, 18 nt, Human
uagaaaacaggaagaggc

SEQ ID NO: 166884 - RNA, 21 nt, Human
uagaaaacaggaagaggcaag

SEQ ID NO: 166885 - RNA, 21 nt, Human
uagaaaagauagcacuuuuuu

SEQ ID NO: 166886 - RNA, 22 nt, Human
uagaauauaucucuguugaaug

SEQ ID NO: 166887 - RNA, 19 nt, Human
uagaggaacauccacgaug

SEQ ID NO: 166888 - RNA, 24 nt, Human
uagcagugaaaauuaguacucauu

SEQ ID NO: 166889 - RNA, 22 nt, Human
uaggggaaaaagccuucacucu

SEQ ID NO: 166890 - RNA, 24 nt, Human
uaguagguaugggaucuugcugug

SEQ ID NO: 166891 - RNA, 22 nt, Human
uaucaaaaauaauuccauucaa

SEQ ID NO: 166892 - RNA, 23 nt, Human
uaucaaaaauaauuccauucaau

SEQ ID NO: 166893 - RNA, 20 nt, Human
uaucaugcugguuccauuuu

SEQ ID NO: 166894 - RNA, 22 nt, Human
uauguguuuucugaagguguug

SEQ ID NO: 166895 - RNA, 21 nt, Human
uauuacuucaagcuauuucaa

SEQ ID NO: 166896 - RNA, 22 nt, Human
uauuauuccucuuacccugaug

SEQ ID NO: 166897 - RNA, 21 nt, Human
uauucuagaauauaucucugu

SEQ ID NO: 166898 - RNA, 27 nt, Human
uauucugagggacaagggagauuaaaa

SEQ ID NO: 166899 - RNA, 23 nt, Human
ucaaaaguggaacaggaucaaag

SEQ ID NO: 166900 - RNA, 18 nt, Human
ucaaagcagaauccccag

SEQ ID NO: 166901 - RNA, 19 nt, Human
ucacugcagccuuggacuc

SEQ ID NO: 166902 - RNA, 23 nt, Human
ucacugcagccuuggacucuugg

SEQ ID NO: 166903 - RNA, 23 nt, Human
ucacugcagccuuggacucuugg

SEQ ID NO: 166904 - RNA, 24 nt, Human
ucacugcagccuuggacucuuggg

SEQ ID NO: 166905 - RNA, 18 nt, Human
ucagccucccgacaggcu

SEQ ID NO: 166906 - RNA, 24 nt, Human
uccacagugacaagcauuccccau

SEQ ID NO: 166907 - RNA, 19 nt, Human
uccauucaauauaauucuu

SEQ ID NO: 166908 - RNA, 24 nt, Human
uccuccugcuucagccucccgaca

SEQ ID NO: 166909 - RNA, 21 nt, Human
ucucugacuuguuuuucaugg

SEQ ID NO: 166910 - RNA, 19 nt, Human
ucugcuuugcuuucccaug

SEQ ID NO: 166911 - RNA, 22 nt, Human
ucuggaacuccugggcuaaaug

SEQ ID NO: 166912 - RNA, 22 nt, Human
ucuguugcuuaggcuggagugc

SEQ ID NO: 166913 - RNA, 24 nt, Human
ucuguugcuuaggcuggagugcag

SEQ ID NO: 166914 - RNA, 22 nt, Human
ucuucuagccacugugauaugc

SEQ ID NO: 166915 - RNA, 20 nt, Human
ucuugcucuguugcuuaggc

SEQ ID NO: 166916 - RNA, 23 nt, Human
ucuugcucuguugcuuaggcugg

SEQ ID NO: 166917 - RNA, 24 nt, Human
ucuugcucuguugcuuaggcugga

SEQ ID NO: 166918 - RNA, 19 nt, Human
ucuugcugugucgcccggg

SEQ ID NO: 166919 - RNA, 30 nt, Human
ucuugcugugucgcccgggcuggucuggaa

SEQ ID NO: 166920 - RNA, 24 nt, Human
ucuugggcucgagugguccuccug

SEQ ID NO: 166921 - RNA, 20 nt, Human
ugacaagaccaagaacaaga

SEQ ID NO: 166922 - RNA, 24 nt, Human
ugacuaaaaaugccaaucaaagca

SEQ ID NO: 166923 - RNA, 22 nt, Human
ugagacaggaucuugcucuguu

SEQ ID NO: 166924 - RNA, 20 nt, Human
ugagagagagagagcuagua

SEQ ID NO: 166925 - RNA, 20 nt, Human
ugaggaaacaagauacuuuu

SEQ ID NO: 166926 - RNA, 18 nt, Human
ugaggguggcccagaguc

SEQ ID NO: 166927 - RNA, 26 nt, Human
ugaucaccuucacagacucuuuuccc

SEQ ID NO: 166928 - RNA, 19 nt, Human
ugcagaccucauuuuucaa

SEQ ID NO: 166929 - RNA, 19 nt, Human
ugcagaccucauuuuucaa

SEQ ID NO: 166930 - RNA, 18 nt, Human
ugccuguugcaauggccu

SEQ ID NO: 166931 - RNA, 19 nt, Human
ugccuucuuagcauucaua

SEQ ID NO: 166932 - RNA, 19 nt, Human
ugcuuaggcuggagugcag

SEQ ID NO: 166933 - RNA, 20 nt, Human
ugcuuaggcuggagugcagc

SEQ ID NO: 166934 - RNA, 24 nt, Human
ugcuucagccucccgacaggcugg

SEQ ID NO: 166935 - RNA, 25 nt, Human
ugcuucagccucccgacaggcuggg

SEQ ID NO: 166936 - RNA, 19 nt, Human
ugcuuucuauccuggugca

SEQ ID NO: 166937 - RNA, 20 nt, Human
uggaaaccagguauugcuuu

SEQ ID NO: 166938 - RNA, 19 nt, Human
uggaacuccugggcuaaau

SEQ ID NO: 166939 - RNA, 18 nt, Human
uggaagacaagaauuugc

SEQ ID NO: 166940 - RNA, 19 nt, Human
uggaauagaaaacaggaag

SEQ ID NO: 166941 - RNA, 21 nt, Human
uggaauagaaaacaggaagag

SEQ ID NO: 166942 - RNA, 24 nt, Human
uggaauagaaaacaggaagaggca

SEQ ID NO: 166943 - RNA, 19 nt, Human
uggaaugguaagucaugag

SEQ ID NO: 166944 - RNA, 25 nt, Human
uggacucuugggcucgagugguccu

SEQ ID NO: 166945 - RNA, 21 nt, Human
uggagugcagcggcacaguua

SEQ ID NO: 166946 - RNA, 24 nt, Human
uggagugcagcggcacaguuaugg

SEQ ID NO: 166947 - RNA, 20 nt, Human
uggaugggguucuguugaag

SEQ ID NO: 166948 - RNA, 19 nt, Human
uggccagcuuugauguguc

SEQ ID NO: 166949 - RNA, 22 nt, Human
uggcccaaagugguuucagcag

SEQ ID NO: 166950 - RNA, 23 nt, Human
uggccuguacucgcaaccuugac

SEQ ID NO: 166951 - RNA, 28 nt, Human
ugggacuacaggaggaagugugccacca

SEQ ID NO: 166952 - RNA, 24 nt, Human
ugggaucuugcugugucgcccggg

SEQ ID NO: 166953 - RNA, 19 nt, Human
ugggauuacagacgugaac

SEQ ID NO: 166954 - RNA, 19 nt, Human
ugggauuacagacgugaac

SEQ ID NO: 166955 - RNA, 21 nt, Human
ugggauuacagacgugaacua

SEQ ID NO: 166956 - RNA, 23 nt, Human
ugggauuacagacgugaacuauc

SEQ ID NO: 166957 - RNA, 24 nt, Human
ugggauuacagacgugaacuauca

SEQ ID NO: 166958 - RNA, 25 nt, Human
ugggauuacagacgugaacuaucaa

SEQ ID NO: 166959 - RNA, 27 nt, Human
ugggauuacagacgugaacuaucaugc

SEQ ID NO: 166960 - RNA, 20 nt, Human
ugggcucgagugguccuccu

SEQ ID NO: 166961 - RNA, 20 nt, Human
ugguccuccugcuucagccu

SEQ ID NO: 166962 - RNA, 25 nt, Human
uguacucgcaaccuugacucuugac

SEQ ID NO: 166963 - RNA, 18 nt, Human
ugucgcccgggcuggucu

SEQ ID NO: 166964 - RNA, 19 nt, Human
ugucgcccgggcuggucug

SEQ ID NO: 166965 - RNA, 21 nt, Human
ugugacauuuugauaugugua

SEQ ID NO: 166966 - RNA, 23 nt, Human
ugugugaguaucuuuuuuccauu

SEQ ID NO: 166967 - RNA, 21 nt, Human
uguguguguguacaagcaugu

SEQ ID NO: 166968 - RNA, 18 nt, Human
ugugugugugugugugug

SEQ ID NO: 166969 - RNA, 18 nt, Human
ugugugugugugugugug

SEQ ID NO: 166970 - RNA, 18 nt, Human
ugugugugugugugugug

SEQ ID NO: 166971 - RNA, 21 nt, Human
ugugugugugugugugugugu

SEQ ID NO: 166972 - RNA, 21 nt, Human
ugugugugugugugugugugu

SEQ ID NO: 166973 - RNA, 24 nt, Human
uguuugugugugugugugugugug

SEQ ID NO: 166974 - RNA, 24 nt, Human
uuaaagcuaauuaacacauccaau

SEQ ID NO: 166975 - RNA, 22 nt, Human
uucagccucccgacaggcuggg

SEQ ID NO: 166976 - RNA, 20 nt, Human
uuccuuuuuuuuuuuuugag

SEQ ID NO: 166977 - RNA, 19 nt, Human
uucugugaaccccauaaga

SEQ ID NO: 166978 - RNA, 20 nt, Human
uucuuccuuuuuuuuuuuuu

SEQ ID NO: 166979 - RNA, 22 nt, Human
uucuugauucugucaggccggg

SEQ ID NO: 166980 - RNA, 23 nt, Human
uucuugcagaccucauuuuucaa

SEQ ID NO: 166981 - RNA, 22 nt, Human
uugaaauagaaaagauagcacu

SEQ ID NO: 166982 - RNA, 20 nt, Human
uugacauagccucagugaau

SEQ ID NO: 166983 - RNA, 22 nt, Human
uugagacaggaucuugcucugu

SEQ ID NO: 166984 - RNA, 25 nt, Human
uuggacucuugggcucgaguggucc

SEQ ID NO: 166985 - RNA, 22 nt, Human
uuggccuguacucgcaaccuug

SEQ ID NO: 166986 - RNA, 23 nt, Human
uuggggcacuguuuucugcuuug

SEQ ID NO: 166987 - RNA, 21 nt, Human
uugucucaaaaguaucuagaa

SEQ ID NO: 166988 - RNA, 21 nt, Human
uuuaaaauaagacuuuacuga

SEQ ID NO: 166989 - RNA, 22 nt, Human
uuucuugcagaccucauuuuuc

SEQ ID NO: 166990 - RNA, 22 nt, Human
uuugauguguccuuacagaauu

SEQ ID NO: 166991 - RNA, 18 nt, Human
uuugcugagagagagaga

SEQ ID NO: 166992 - RNA, 23 nt, Human
uuugugcuuauuaguauuuuuau

SEQ ID NO: 166993 - RNA, 23 nt, Human
uuuguuuuuaaccucagggagaa

SEQ ID NO: 166994 - RNA, 22 nt, Human
uuuuuuuuuuugagacaggauc

SEQ ID NO: 166995 - RNA, 20 nt, Human
uuuuuuuuuuugagacaggg

SEQ ID NO: 166996 - RNA, 24 nt, Human
uuuuuuuuuuuugagacaggaucu

SEQ ID NO: 166997 - RNA, 20 nt, Human
aaaacccaaaacacaagucu

SEQ ID NO: 166998 - RNA, 24 nt, Human
aaauucacuuucacagucaacaag

SEQ ID NO: 166999 - RNA, 22 nt, Human
aaggaucucauaugaaugcagu

SEQ ID NO: 167000 - RNA, 21 nt, Human
aauuacuaaaaaauacuaaaa

SEQ ID NO: 167001 - RNA, 22 nt, Human
acacaagucugcugugaguccu

SEQ ID NO: 167002 - RNA, 22 nt, Human
agguuuaaaaaacccaaaacac

SEQ ID NO: 167003 - RNA, 19 nt, Human
caguagaacaggguuccua

SEQ ID NO: 167004 - RNA, 25 nt, Human
ccacacaaagcccacggcagcugca

SEQ ID NO: 167005 - RNA, 25 nt, Human
ccccgucucccaagcucugcgucca

SEQ ID NO: 167006 - RNA, 18 nt, Human
ccugugcuuauacuacaa

SEQ ID NO: 167007 - RNA, 20 nt, Human
cugcaggcugagcuuguccu

SEQ ID NO: 167008 - RNA, 24 nt, Human
gaaaaagcaauccuauauacacug

SEQ ID NO: 167009 - RNA, 18 nt, Human
gcuuccguuacuucagaa

SEQ ID NO: 167010 - RNA, 21 nt, Human
uaaaaaacccaaaacacaagu

SEQ ID NO: 167011 - RNA, 22 nt, Human
uaauagcccucccccgucuccc

SEQ ID NO: 167012 - RNA, 24 nt, Human
uaauagcccucccccgucucccaa

SEQ ID NO: 167013 - RNA, 23 nt, Human
uauggcaaauguacaguacauug

SEQ ID NO: 167014 - RNA, 20 nt, Human
ucagcaguguugaggucuuu

SEQ ID NO: 167015 - RNA, 20 nt, Human
ucagucucuuuuuccagugu

SEQ ID NO: 167016 - RNA, 24 nt, Human
ucauaugaaugcaguccugauugu

SEQ ID NO: 167017 - RNA, 22 nt, Human
ugaaaaauggccugugcuuaua

SEQ ID NO: 167018 - RNA, 18 nt, Human
ugcaaggaaaauacagua

SEQ ID NO: 167019 - RNA, 24 nt, Human
ugcaaggaaaauacaguacaaauu

SEQ ID NO: 167020 - RNA, 19 nt, Human
uggaguaauagcccucccc

SEQ ID NO: 167021 - RNA, 23 nt, Human
uggaguaauagcccucccccguc

SEQ ID NO: 167022 - RNA, 18 nt, Human
uggcaaauguacaguaca

SEQ ID NO: 167023 - RNA, 18 nt, Human
uuauacuacaaggaucuc

SEQ ID NO: 167024 - RNA, 20 nt, Human
uucacagucaacaagucauc

SEQ ID NO: 167025 - RNA, 22 nt, Human
uucacagucaacaagucaucuu

SEQ ID NO: 167026 - RNA, 20 nt, Human
uuuucagucucuuuuuccag

SEQ ID NO: 167027 - RNA, 23 nt, Human
aaaaaaaucacaaaaagcagcug

SEQ ID NO: 167028 - RNA, 19 nt, Human
aaaaagcagcuggcuccca

SEQ ID NO: 167029 - RNA, 22 nt, Human
aaaacacacauacacccacacc

SEQ ID NO: 167030 - RNA, 21 nt, Human
aaaauagaaugugacauuuuc

SEQ ID NO: 167031 - RNA, 19 nt, Human
aaacagaauaauaccaaga

SEQ ID NO: 167032 - RNA, 19 nt, Human
aaacagagccagcuuagcg

SEQ ID NO: 167033 - RNA, 19 nt, Human
aaacagagccagcuuagcg

SEQ ID NO: 167034 - RNA, 19 nt, Human
aaagaugcacuccuccuuu

SEQ ID NO: 167035 - RNA, 24 nt, Human
aaaggaagcauacucuucucccca

SEQ ID NO: 167036 - RNA, 24 nt, Human
aaaguuuuucuuaauuuuucucug

SEQ ID NO: 167037 - RNA, 19 nt, Human
aacaugccacgaaugagaa

SEQ ID NO: 167038 - RNA, 18 nt, Human
aacugugcaaaacagaau

SEQ ID NO: 167039 - RNA, 20 nt, Human
aagcacuuuguaacuagcuc

SEQ ID NO: 167040 - RNA, 22 nt, Human
aagcauacucuucuccccaaga

SEQ ID NO: 167041 - RNA, 24 nt, Human
aagcauacucuucuccccaagaag

SEQ ID NO: 167042 - RNA, 21 nt, Human
aauagcaucaaacagagccag

SEQ ID NO: 167043 - RNA, 21 nt, Human
aauagcaucaaacagagccag

SEQ ID NO: 167044 - RNA, 20 nt, Human
aauugguuugguugguauag

SEQ ID NO: 167045 - RNA, 21 nt, Human
acaaaagccgcugccaggagc

SEQ ID NO: 167046 - RNA, 23 nt, Human
acacacacacacacacacacaca

SEQ ID NO: 167047 - RNA, 23 nt, Human
acacacacacacacacacacaca

SEQ ID NO: 167048 - RNA, 23 nt, Human
acacacacacacacacacacaca

SEQ ID NO: 167049 - RNA, 23 nt, Human
acacacacacacacacacacaca

SEQ ID NO: 167050 - RNA, 25 nt, Human
acacacauacacccacacccacaca

SEQ ID NO: 167051 - RNA, 24 nt, Human
acagaacauaaaagcaguugccaa

SEQ ID NO: 167052 - RNA, 22 nt, Human
acagagagccuuuaaacaagga

SEQ ID NO: 167053 - RNA, 21 nt, Human
acccacacacacacacacaca

SEQ ID NO: 167054 - RNA, 19 nt, Human
acccacacccacacacaca

SEQ ID NO: 167055 - RNA, 26 nt, Human
acuagaggagccaaaaguaugggcuc

SEQ ID NO: 167056 - RNA, 26 nt, Human
acuauuaaaaaaaucacaaaaagcag

SEQ ID NO: 167057 - RNA, 19 nt, Human
agacacagacuugcacaug

SEQ ID NO: 167058 - RNA, 23 nt, Human
agaggcauacauucuucgguuac

SEQ ID NO: 167059 - RNA, 24 nt, Human
agccccgucccccuccgugcccac

SEQ ID NO: 167060 - RNA, 21 nt, Human
agccgccgccgcugccgggga

SEQ ID NO: 167061 - RNA, 21 nt, Human
aggaaacaaggcacggguccc

SEQ ID NO: 167062 - RNA, 24 nt, Human
aggaccaaaccaugucugucuuau

SEQ ID NO: 167063 - RNA, 19 nt, Human
aggagccaaaaguaugggc

SEQ ID NO: 167064 - RNA, 22 nt, Human
aggagccaaaaguaugggcuca

SEQ ID NO: 167065 - RNA, 23 nt, Human
aggcaaaacuagccaauauccau

SEQ ID NO: 167066 - RNA, 22 nt, Human
aggcaaguuucaaagcaguuga

SEQ ID NO: 167067 - RNA, 18 nt, Human
aggcccgcuggccgcugc

SEQ ID NO: 167068 - RNA, 25 nt, Human
auacacccacacccacacacacaca

SEQ ID NO: 167069 - RNA, 23 nt, Human
auacauagacccuaacuugcaua

SEQ ID NO: 167070 - RNA, 24 nt, Human
aucaagacaugaacagcuaagguu

SEQ ID NO: 167071 - RNA, 21 nt, Human
auccaaggcccacuugaucuu

SEQ ID NO: 167072 - RNA, 21 nt, Human
auccaaggcccacuugaucuu

SEQ ID NO: 167073 - RNA, 22 nt, Human
auugcugagccccgucccccuc

SEQ ID NO: 167074 - RNA, 23 nt, Human
auuugcauuuucauggacaggaa

SEQ ID NO: 167075 - RNA, 21 nt, Human
caaaaagcagcuggcucccau

SEQ ID NO: 167076 - RNA, 24 nt, Human
caaaccugaguuugaaggagcuga

SEQ ID NO: 167077 - RNA, 27 nt, Human
cacaaaacacacauacacccacaccca

SEQ ID NO: 167078 - RNA, 20 nt, Human
cacacacacacacacacaca

SEQ ID NO: 167079 - RNA, 20 nt, Human
cacacacacacacacacaca

SEQ ID NO: 167080 - RNA, 20 nt, Human
cacacacacacacacacaca

SEQ ID NO: 167081 - RNA, 20 nt, Human
cacacacacacacacacaca

SEQ ID NO: 167082 - RNA, 20 nt, Human
cacacacacacacacacaca

SEQ ID NO: 167083 - RNA, 20 nt, Human
cacacacacacacacacaca

SEQ ID NO: 167084 - RNA, 20 nt, Human
cacacacacacacacacaca

SEQ ID NO: 167085 - RNA, 20 nt, Human
cacacacacacacacacaca

SEQ ID NO: 167086 - RNA, 20 nt, Human
cacacacacacacacacaca

SEQ ID NO: 167087 - RNA, 20 nt, Human
cacacacacacacacacaca

SEQ ID NO: 167088 - RNA, 22 nt, Human
cacacacacacacacacacaca

SEQ ID NO: 167089 - RNA, 22 nt, Human
cacacacacacacacacacaca

SEQ ID NO: 167090 - RNA, 22 nt, Human
cacacacacacacacacacaca

SEQ ID NO: 167091 - RNA, 22 nt, Human
cacacacacacacacacacaca

SEQ ID NO: 167092 - RNA, 22 nt, Human
cacacacacacacacacacaca

SEQ ID NO: 167093 - RNA, 22 nt, Human
cacacacacacacacacacaca

SEQ ID NO: 167094 - RNA, 18 nt, Human
cacacauacacccacacc

SEQ ID NO: 167095 - RNA, 21 nt, Human
cacacauacacccacacccac

SEQ ID NO: 167096 - RNA, 24 nt, Human
cacauaagaacagaggcauacauu

SEQ ID NO: 167097 - RNA, 25 nt, Human
cacaugguuucagccccauuccacc

SEQ ID NO: 167098 - RNA, 24 nt, Human
cacccacacccacacacacacaca

SEQ ID NO: 167099 - RNA, 22 nt, Human
cagacauucaggcugaaaugaa

SEQ ID NO: 167100 - RNA, 23 nt, Human
cagaccccaggcaaguuucaaag

SEQ ID NO: 167101 - RNA, 18 nt, Human
caggagacaaccacuucc

SEQ ID NO: 167102 - RNA, 20 nt, Human
caggagacaaccacuucccc

SEQ ID NO: 167103 - RNA, 22 nt, Human
caggagccaguaggcucacuag

SEQ ID NO: 167104 - RNA, 22 nt, Human
caucgcuguccaucugcuccug

SEQ ID NO: 167105 - RNA, 18 nt, Human
cauugggugaucagugca

SEQ ID NO: 167106 - RNA, 26 nt, Human
cauuggguuuaggaaggauuucucua

SEQ ID NO: 167107 - RNA, 26 nt, Human
ccacaaaagccgcugccaggagccuc

SEQ ID NO: 167108 - RNA, 21 nt, Human
ccacacacacacacacacaca

SEQ ID NO: 167109 - RNA, 19 nt, Human
ccagcuaaugcucuuccac

SEQ ID NO: 167110 - RNA, 20 nt, Human
cccaagaagcagcaauccac

SEQ ID NO: 167111 - RNA, 24 nt, Human
cccacacacacacacacacacaca

SEQ ID NO: 167112 - RNA, 20 nt, Human
cccacacccacacacacaca

SEQ ID NO: 167113 - RNA, 19 nt, Human
cccaggcaaguuucaaagc

SEQ ID NO: 167114 - RNA, 24 nt, Human
cccaucaugcucagaccccaggca

SEQ ID NO: 167115 - RNA, 21 nt, Human
ccccaagaagcagcaauccac

SEQ ID NO: 167116 - RNA, 18 nt, Human
ccccgcgcccugagcgcc

SEQ ID NO: 167117 - RNA, 20 nt, Human
ccccgcgcccugagcgcccg

SEQ ID NO: 167118 - RNA, 21 nt, Human
ccccggagcccgcuccgagcc

SEQ ID NO: 167119 - RNA, 21 nt, Human
ccccgucccccuccgugccca

SEQ ID NO: 167120 - RNA, 21 nt, Human
cccgagccccggagcccgcuc

SEQ ID NO: 167121 - RNA, 24 nt, Human
cccugagcgcccgucucgcggcuc

SEQ ID NO: 167122 - RNA, 21 nt, Human
cccuuuccuacccugucuccc

SEQ ID NO: 167123 - RNA, 25 nt, Human
ccgcuccgagccgccgccgcugccg

SEQ ID NO: 167124 - RNA, 18 nt, Human
ccucaaucaaacuggucc

SEQ ID NO: 167125 - RNA, 19 nt, Human
ccuccgugcccacauggug

SEQ ID NO: 167126 - RNA, 21 nt, Human
ccuucucccgguuucucuuuu

SEQ ID NO: 167127 - RNA, 20 nt, Human
cgaaaaccccauacaaucag

SEQ ID NO: 167128 - RNA, 22 nt, Human
cgucccccuccgugcccacaug

SEQ ID NO: 167129 - RNA, 23 nt, Human
cuaggaaacaaggcacggguccc

SEQ ID NO: 167130 - RNA, 24 nt, Human
cucagaccccaggcaaguuucaaa

SEQ ID NO: 167131 - RNA, 26 nt, Human
cucauuaacuaauauccugaguccca

SEQ ID NO: 167132 - RNA, 18 nt, Human
cucccagaauccagaaaa

SEQ ID NO: 167133 - RNA, 19 nt, Human
cucccccggccaacgaccc

SEQ ID NO: 167134 - RNA, 18 nt, Human
cuccucaaucaaacuggu

SEQ ID NO: 167135 - RNA, 18 nt, Human
cucucguucgccgccgcc

SEQ ID NO: 167136 - RNA, 19 nt, Human
cucuuccacauccuuucag

SEQ ID NO: 167137 - RNA, 19 nt, Human
cugccaggagccaguaggc

SEQ ID NO: 167138 - RNA, 20 nt, Human
cugccggggaggagccgaga

SEQ ID NO: 167139 - RNA, 22 nt, Human
cugcuccuggcugggcccucaa

SEQ ID NO: 167140 - RNA, 27 nt, Human
cugguccugcgugcccugagguggcgg

SEQ ID NO: 167141 - RNA, 19 nt, Human
cuguagcauauauucuugg

SEQ ID NO: 167142 - RNA, 19 nt, Human
cuuucacaacuaacugugc

SEQ ID NO: 167143 - RNA, 21 nt, Human
cuuuuugcuuuuuuuccuuuu

SEQ ID NO: 167144 - RNA, 20 nt, Human
gaaggagacagaacauaaaa

SEQ ID NO: 167145 - RNA, 21 nt, Human
gaaggagacagaacauaaaag

SEQ ID NO: 167146 - RNA, 22 nt, Human
gaaugagaauggacauagaacc

SEQ ID NO: 167147 - RNA, 20 nt, Human
gacccugaagaguaggcgca

SEQ ID NO: 167148 - RNA, 22 nt, Human
gagcccgcuccgagccgccgcc

SEQ ID NO: 167149 - RNA, 21 nt, Human
gcacaaaacacacauacaccc

SEQ ID NO: 167150 - RNA, 19 nt, Human
gcagcuccucaaucaaacu

SEQ ID NO: 167151 - RNA, 22 nt, Human
gccccggagcccgcuccgagcc

SEQ ID NO: 167152 - RNA, 20 nt, Human
gcccugagcgcccgucucgc

SEQ ID NO: 167153 - RNA, 19 nt, Human
gcccuuuccuacccugucu

SEQ ID NO: 167154 - RNA, 19 nt, Human
gcuccagccaggagacaac

SEQ ID NO: 167155 - RNA, 19 nt, Human
ggagaaaacucuccucagg

SEQ ID NO: 167156 - RNA, 19 nt, Human
ggagacagaacauaaaagc

SEQ ID NO: 167157 - RNA, 19 nt, Human
ggcugcagggcuggcccag

SEQ ID NO: 167158 - RNA, 20 nt, Human
gggaagccacugaaauggca

SEQ ID NO: 167159 - RNA, 27 nt, Human
gggaagccacugaaauggcauugcuga

SEQ ID NO: 167160 - RNA, 19 nt, Human
gggaggagccgagaggagu

SEQ ID NO: 167161 - RNA, 20 nt, Human
gggaggagccgagaggagug

SEQ ID NO: 167162 - RNA, 18 nt, Human
ggggguuggagcagggaa

SEQ ID NO: 167163 - RNA, 21 nt, Human
ggguacgugaugcauugggug

SEQ ID NO: 167164 - RNA, 22 nt, Human
ggucagagcugggaagccacug

SEQ ID NO: 167165 - RNA, 23 nt, Human
guuacaccacugucggccaaaga

SEQ ID NO: 167166 - RNA, 25 nt, Human
uaaaaaaaucacaaaaagcagcugg

SEQ ID NO: 167167 - RNA, 18 nt, Human
uaaaagcaguugccaagu

SEQ ID NO: 167168 - RNA, 19 nt, Human
uaaaaggaagcauacucuu

SEQ ID NO: 167169 - RNA, 18 nt, Human
uaaaggcaaaacuagcca

SEQ ID NO: 167170 - RNA, 26 nt, Human
uaaauacauagacccuaacuugcaua

SEQ ID NO: 167171 - RNA, 19 nt, Human
uaaauuacauaccaccuuu

SEQ ID NO: 167172 - RNA, 22 nt, Human
uaacgggcuuguugcccugggu

SEQ ID NO: 167173 - RNA, 25 nt, Human
uaacucuggcuaaguuuucagugca

SEQ ID NO: 167174 - RNA, 22 nt, Human
uaacugugcaaaacagaauaaa

SEQ ID NO: 167175 - RNA, 19 nt, Human
uacaaucagcuaaacuaac

SEQ ID NO: 167176 - RNA, 27 nt, Human
uacacaugugcuucuagaaauaaggcu

SEQ ID NO: 167177 - RNA, 21 nt, Human
uacccugucucccuauuccca

SEQ ID NO: 167178 - RNA, 19 nt, Human
uaccuugcauaaauuacau

SEQ ID NO: 167179 - RNA, 18 nt, Human
uagaaugugacauuuuca

SEQ ID NO: 167180 - RNA, 23 nt, Human
uagcaucaaacagagccagcuua

SEQ ID NO: 167181 - RNA, 23 nt, Human
uagcaucaaacagagccagcuua

SEQ ID NO: 167182 - RNA, 23 nt, Human
uaggaaaaaaaagagcuuuuucu

SEQ ID NO: 167183 - RNA, 20 nt, Human
uagucaaaaaaaaaaagcac

SEQ ID NO: 167184 - RNA, 20 nt, Human
uauagagacggggucuuccc

SEQ ID NO: 167185 - RNA, 22 nt, Human
uauaggaccaaaccaugucugu

SEQ ID NO: 167186 - RNA, 20 nt, Human
uauggagaaaacucuccuca

SEQ ID NO: 167187 - RNA, 24 nt, Human
ucaugccuucucccgguuucucuu

SEQ ID NO: 167188 - RNA, 20 nt, Human
uccagaaaauguccccucau

SEQ ID NO: 167189 - RNA, 21 nt, Human
uccagccaggagacaaccacu

SEQ ID NO: 167190 - RNA, 21 nt, Human
uccauugaaaauauuuagcaa

SEQ ID NO: 167191 - RNA, 30 nt, Human
ucccagaauccagaaaauguccccucaucu

SEQ ID NO: 167192 - RNA, 23 nt, Human
uccccauuaaaugaaaaggaaac

SEQ ID NO: 167193 - RNA, 20 nt, Human
ucccccggccaacgacccgg

SEQ ID NO: 167194 - RNA, 18 nt, Human
ucgccgccgccggccccg

SEQ ID NO: 167195 - RNA, 25 nt, Human
ucuacauuaagacuccagauggaac

SEQ ID NO: 167196 - RNA, 21 nt, Human
ucucuucuggcucuagccugc

SEQ ID NO: 167197 - RNA, 26 nt, Human
ucugcuccuggcugggcccucaaaug

SEQ ID NO: 167198 - RNA, 25 nt, Human
ucuuggacugacaagacacagacuu

SEQ ID NO: 167199 - RNA, 18 nt, Human
ugaaauagguaaaacaaa

SEQ ID NO: 167200 - RNA, 19 nt, Human
ugaaaucaagacaugaaca

SEQ ID NO: 167201 - RNA, 23 nt, Human
ugaaaucaagacaugaacagcua

SEQ ID NO: 167202 - RNA, 19 nt, Human
ugagaauggacauagaacc

SEQ ID NO: 167203 - RNA, 22 nt, Human
ugaggucuucuuuuuucugagu

SEQ ID NO: 167204 - RNA, 20 nt, Human
ugauuggaauauuaucaguu

SEQ ID NO: 167205 - RNA, 21 nt, Human
ugcaaaacagaauaauaccaa

SEQ ID NO: 167206 - RNA, 21 nt, Human
ugcaaaacagaauaauaccuu

SEQ ID NO: 167207 - RNA, 24 nt, Human
ugcacaaaacacacauacacccac

SEQ ID NO: 167208 - RNA, 19 nt, Human
ugcucaggccagccaguga

SEQ ID NO: 167209 - RNA, 21 nt, Human
ugcuuaauaaaggcaaaacua

SEQ ID NO: 167210 - RNA, 19 nt, Human
uggaaaaaaaaaaaaaaaa

SEQ ID NO: 167211 - RNA, 18 nt, Human
uggagaaaacucuccuca

SEQ ID NO: 167212 - RNA, 23 nt, Human
uggagaaaacucuccucaggacu

SEQ ID NO: 167213 - RNA, 24 nt, Human
uggagaaauaccuugcauaaauua

SEQ ID NO: 167214 - RNA, 19 nt, Human
uggcggggguuggagcagg

SEQ ID NO: 167215 - RNA, 24 nt, Human
uggcuagugagucuuccacaaaag

SEQ ID NO: 167216 - RNA, 21 nt, Human
uggcugcagaaggugcagaca

SEQ ID NO: 167217 - RNA, 19 nt, Human
ugguauacaaaauacauuc

SEQ ID NO: 167218 - RNA, 23 nt, Human
ugguauagagacggggucuuccc

SEQ ID NO: 167219 - RNA, 23 nt, Human
ugugaaauagguaaaacaaacaa

SEQ ID NO: 167220 - RNA, 18 nt, Human
uguguaaagaagaggaac

SEQ ID NO: 167221 - RNA, 19 nt, Human
uguuuugggucccaacugu

SEQ ID NO: 167222 - RNA, 21 nt, Human
uguuuugggucccaacugugu

SEQ ID NO: 167223 - RNA, 23 nt, Human
uuaacaucucggugucacuucuu

SEQ ID NO: 167224 - RNA, 23 nt, Human
uuagacccugaagaguaggcgca

SEQ ID NO: 167225 - RNA, 18 nt, Human
uuagagcucagguucuac

SEQ ID NO: 167226 - RNA, 20 nt, Human
uuagucaaaaaaaaaaagca

SEQ ID NO: 167227 - RNA, 20 nt, Human
uuccacguacauuaucucag

SEQ ID NO: 167228 - RNA, 22 nt, Human
uucuucacuugucacuauuucu

SEQ ID NO: 167229 - RNA, 23 nt, Human
uucuuucacaacuaacugugcaa

SEQ ID NO: 167230 - RNA, 18 nt, Human
uugaccuuauugaccuuu

SEQ ID NO: 167231 - RNA, 21 nt, Human
uuucauucuucucagcuuucu

SEQ ID NO: 167232 - RNA, 21 nt, Human
uuucuacauuaagacuccaga

SEQ ID NO: 167233 - RNA, 25 nt, Human
uuucucccuugcuuuuugcuuuuuu

SEQ ID NO: 167234 - RNA, 21 nt, Human
uuuucuugccucccagaaucc

SEQ ID NO: 167235 - RNA, 23 nt, Human
agagaaaagucuggugaagcagc

SEQ ID NO: 167236 - RNA, 19 nt, Human
caaaagucccuuugaaaac

SEQ ID NO: 167237 - RNA, 19 nt, Human
cccacccauaaaauauauc

SEQ ID NO: 167238 - RNA, 23 nt, Human
cccccagggcgccggcccagccc

SEQ ID NO: 167239 - RNA, 21 nt, Human
cggagcccggggucccccagg

SEQ ID NO: 167240 - RNA, 22 nt, Human
cuguaguagaaauuuuauuccc

SEQ ID NO: 167241 - RNA, 23 nt, Human
ggauagguggagggaugaagucc

SEQ ID NO: 167242 - RNA, 22 nt, Human
uaaaguucauuaucagcuccuc

SEQ ID NO: 167243 - RNA, 23 nt, Human
uacuguacuucagguacacaauu

SEQ ID NO: 167244 - RNA, 18 nt, Human
ucacucaagccggccuga

SEQ ID NO: 167245 - RNA, 20 nt, Human
ucccuuugaaaacaagaguu

SEQ ID NO: 167246 - RNA, 18 nt, Human
ugaaaacaagaguaaacg

SEQ ID NO: 167247 - RNA, 20 nt, Human
uuagugaugaaauuaaucuu

SEQ ID NO: 167248 - RNA, 25 nt, Human
aaaaugcugacguaugcugccuucu

SEQ ID NO: 167249 - RNA, 20 nt, Human
aaggaauaaucggcgggcac

SEQ ID NO: 167250 - RNA, 26 nt, Human
ccuuguccacuuucaugcuccucuug

SEQ ID NO: 167251 - RNA, 19 nt, Human
cggaggccuaaccccuccc

SEQ ID NO: 167252 - RNA, 19 nt, Human
cugguuccucuuugaaguu

SEQ ID NO: 167253 - RNA, 21 nt, Human
gaaaaugcugacguaugcugc

SEQ ID NO: 167254 - RNA, 21 nt, Human
gaaggcaccuguuacucagca

SEQ ID NO: 167255 - RNA, 20 nt, Human
gaccuagaaggcaagaggug

SEQ ID NO: 167256 - RNA, 20 nt, Human
gaggcuggauauuauccagg

SEQ ID NO: 167257 - RNA, 18 nt, Human
gccuucucucucucugcu

SEQ ID NO: 167258 - RNA, 24 nt, Human
ggcaagaggugagcccucugucac

SEQ ID NO: 167259 - RNA, 21 nt, Human
gugcagagaagaaaaugcuga

SEQ ID NO: 167260 - RNA, 24 nt, Human
uaagugcagagaagaaaaugcuga

SEQ ID NO: 167261 - RNA, 22 nt, Human
uaccaaggaauaaucggcgggc

SEQ ID NO: 167262 - RNA, 24 nt, Human
uauuaccaaggaauaaucggcggg

SEQ ID NO: 167263 - RNA, 22 nt, Human
uccggaggccuaaccccucccu

SEQ ID NO: 167264 - RNA, 23 nt, Human
ucuuugaucuuucuuauaagugc

SEQ ID NO: 167265 - RNA, 23 nt, Human
ugagaagugaccuagaaggcaag

SEQ ID NO: 167266 - RNA, 19 nt, Human
ugagggcucuuuggucaag

SEQ ID NO: 167267 - RNA, 21 nt, Human
ugcuucaguggucacacuccu

SEQ ID NO: 167268 - RNA, 23 nt, Human
ugugggaggcuggauauuaucca

SEQ ID NO: 167269 - RNA, 21 nt, Human
uuuggucaagcaguaacgccc

SEQ ID NO: 167270 - RNA, 18 nt, Human
uuuguaguagauagcagu

SEQ ID NO: 167271 - RNA, 20 nt, Human
aaaacaaaaagauuaugcaa

SEQ ID NO: 167272 - RNA, 24 nt, Human
aaaacacccagcucauacaaaacc

SEQ ID NO: 167273 - RNA, 21 nt, Human
aaaaguaauggaaaaaaacac

SEQ ID NO: 167274 - RNA, 26 nt, Human
aaaaguaauggaaaaaaacacccagc

SEQ ID NO: 167275 - RNA, 23 nt, Human
aaaauguggacuggaacaggaug

SEQ ID NO: 167276 - RNA, 21 nt, Human
aaacuaaaaaguaagagacca

SEQ ID NO: 167277 - RNA, 23 nt, Human
aaccaucacaaugcauuacgagc

SEQ ID NO: 167278 - RNA, 24 nt, Human
aacuaaaaaguaagagaccauacu

SEQ ID NO: 167279 - RNA, 19 nt, Human
aagaagaaacaugagcaga

SEQ ID NO: 167280 - RNA, 20 nt, Human
aagaagaaacaugagcagaa

SEQ ID NO: 167281 - RNA, 18 nt, Human
acaaaacaauagaaaaaa

SEQ ID NO: 167282 - RNA, 23 nt, Human
agacaugaaacugauacaaacaa

SEQ ID NO: 167283 - RNA, 22 nt, Human
cacaacagugaauuguaguuaa

SEQ ID NO: 167284 - RNA, 20 nt, Human
cacccagcucauacaaaacc

SEQ ID NO: 167285 - RNA, 19 nt, Human
cagcucauacaaaaccauc

SEQ ID NO: 167286 - RNA, 21 nt, Human
cagcugaauuuugugaaaguc

SEQ ID NO: 167287 - RNA, 20 nt, Human
cauccuagaaaaauugaaau

SEQ ID NO: 167288 - RNA, 19 nt, Human
cauuuuauuuucauauaaa

SEQ ID NO: 167289 - RNA, 25 nt, Human
ccuagaaaaauugaaauagaaacac

SEQ ID NO: 167290 - RNA, 18 nt, Human
cgcucugaaaaguugggg

SEQ ID NO: 167291 - RNA, 21 nt, Human
cuacaaaacaauagaaaaaaa

SEQ ID NO: 167292 - RNA, 18 nt, Human
gaaaacaaaaagauuaug

SEQ ID NO: 167293 - RNA, 18 nt, Human
gaacaggaugcaaaagac

SEQ ID NO: 167294 - RNA, 24 nt, Human
gacugaaggggacaggaagacuac

SEQ ID NO: 167295 - RNA, 26 nt, Human
gagcaacccaagaguugggaaagcac

SEQ ID NO: 167296 - RNA, 19 nt, Human
ggaggacugguugucagua

SEQ ID NO: 167297 - RNA, 22 nt, Human
uacaaaacaauagaaaaaaaac

SEQ ID NO: 167298 - RNA, 19 nt, Human
uacaaaaccaucacaaugc

SEQ ID NO: 167299 - RNA, 26 nt, Human
uagaaaacaaaaagauuaugcaagag

SEQ ID NO: 167300 - RNA, 19 nt, Human
uagugcagauacugccucu

SEQ ID NO: 167301 - RNA, 24 nt, Human
uauaauaccauaaacuuuuacaaa

SEQ ID NO: 167302 - RNA, 21 nt, Human
uauacacacuggagggacuga

SEQ ID NO: 167303 - RNA, 24 nt, Human
uauccacaacuauaacuugcaacg

SEQ ID NO: 167304 - RNA, 18 nt, Human
ucaagaagaaacaugagc

SEQ ID NO: 167305 - RNA, 23 nt, Human
uccacaacuauaacuugcaacga

SEQ ID NO: 167306 - RNA, 22 nt, Human
ucccacucucaggucagcugaa

SEQ ID NO: 167307 - RNA, 19 nt, Human
ugaaaaguuggggauuagu

SEQ ID NO: 167308 - RNA, 21 nt, Human
ugaaaauguggacuggaacag

SEQ ID NO: 167309 - RNA, 18 nt, Human
ugaaauagaaacacuaaa

SEQ ID NO: 167310 - RNA, 25 nt, Human
ugaaauagaaacacuaaauacagua

SEQ ID NO: 167311 - RNA, 26 nt, Human
ugaaauagaaacacuaaauacaguau

SEQ ID NO: 167312 - RNA, 22 nt, Human
ugagaauuagugcagauacugc

SEQ ID NO: 167313 - RNA, 24 nt, Human
ugauacaaacaauucacuagaaau

SEQ ID NO: 167314 - RNA, 23 nt, Human
ugauguggaggacugguugucag

SEQ ID NO: 167315 - RNA, 22 nt, Human
uggaaaaaaacacccagcucau

SEQ ID NO: 167316 - RNA, 25 nt, Human
uggaacaggaugcaaaagacucgcu

SEQ ID NO: 167317 - RNA, 23 nt, Human
ugggaaagcacugauuauaaacg

SEQ ID NO: 167318 - RNA, 23 nt, Human
ugucuaaaugcugugauguggag

SEQ ID NO: 167319 - RNA, 24 nt, Human
uuacgagcugacccaagucauuau

SEQ ID NO: 167320 - RNA, 20 nt, Human
uugcacuuaaacuacaaacu

SEQ ID NO: 167321 - RNA, 25 nt, Human
aaccccuucuccuccagcuccucca

SEQ ID NO: 167322 - RNA, 25 nt, Human
aagcagcauuugggggaaggggcgg

SEQ ID NO: 167323 - RNA, 19 nt, Human
aaggggcgggcgaugcugc

SEQ ID NO: 167324 - RNA, 23 nt, Human
aaguuacaggccaggcuccugcu

SEQ ID NO: 167325 - RNA, 23 nt, Human
acuccugggcccaauucugaguc

SEQ ID NO: 167326 - RNA, 20 nt, Human
agccggcucugcugcaggug

SEQ ID NO: 167327 - RNA, 19 nt, Human
aggcggcggcggcggcggc

SEQ ID NO: 167328 - RNA, 24 nt, Human
aggcggcggcggcggcggcggcgg

SEQ ID NO: 167329 - RNA, 23 nt, Human
aggcgggccacagcggaggaggg

SEQ ID NO: 167330 - RNA, 21 nt, Human
agggagaggcggggccugugg

SEQ ID NO: 167331 - RNA, 18 nt, Human
caccagcccguuugaggc

SEQ ID NO: 167332 - RNA, 24 nt, Human
caccuucagcuccagggccgaggg

SEQ ID NO: 167333 - RNA, 18 nt, Human
cagcaucccccggccccc

SEQ ID NO: 167334 - RNA, 21 nt, Human
ccaccuuccuugagccucagc

SEQ ID NO: 167335 - RNA, 21 nt, Human
cccacaccccugcagaaucca

SEQ ID NO: 167336 - RNA, 22 nt, Human
ccccacaccccugcagaaucca

SEQ ID NO: 167337 - RNA, 20 nt, Human
ccccgcagaauacggauuaa

SEQ ID NO: 167338 - RNA, 23 nt, Human
cccgcagaauacggauuaacccc

SEQ ID NO: 167339 - RNA, 22 nt, Human
cccggaggugguggcgguggcg

SEQ ID NO: 167340 - RNA, 20 nt, Human
ccuccagcuccuccaccuuc

SEQ ID NO: 167341 - RNA, 23 nt, Human
ccucggggcuggggcuugcgggg

SEQ ID NO: 167342 - RNA, 18 nt, Human
ccugcggggaggggaggc

SEQ ID NO: 167343 - RNA, 24 nt, Human
cgagggccgcgucggggcagcggg

SEQ ID NO: 167344 - RNA, 19 nt, Human
cggcggcgguggcgcugcu

SEQ ID NO: 167345 - RNA, 18 nt, Human
cgggaggcggcggcggcg

SEQ ID NO: 167346 - RNA, 22 nt, Human
cggggcuggggcuugcgggggc

SEQ ID NO: 167347 - RNA, 20 nt, Human
cggucgauucgcugaagcgc

SEQ ID NO: 167348 - RNA, 28 nt, Human
cuauuuggagggggcuuuagggugggug

SEQ ID NO: 167349 - RNA, 25 nt, Human
cuccagcuccuccaccuucagcucc

SEQ ID NO: 167350 - RNA, 18 nt, Human
cuccgggagccggcucug

SEQ ID NO: 167351 - RNA, 19 nt, Human
cuccuccaccuucagcucc

SEQ ID NO: 167352 - RNA, 21 nt, Human
cuccuccaccuucagcuccag

SEQ ID NO: 167353 - RNA, 18 nt, Human
cugcaagcagcauuuggg

SEQ ID NO: 167354 - RNA, 21 nt, Human
cuggggcuugcgggggcgagg

SEQ ID NO: 167355 - RNA, 23 nt, Human
gaggaccuccgggaggcggcggc

SEQ ID NO: 167356 - RNA, 22 nt, Human
gaggugguggcgguggcggggg

SEQ ID NO: 167357 - RNA, 18 nt, Human
gcggcgcaggcgggggcu

SEQ ID NO: 167358 - RNA, 21 nt, Human
gcggcggcggaggcaccggcc

SEQ ID NO: 167359 - RNA, 18 nt, Human
gcggcggcggcggcggag

SEQ ID NO: 167360 - RNA, 21 nt, Human
gcggcggcggcggcggaggca

SEQ ID NO: 167361 - RNA, 24 nt, Human
gcggcggcggcggcggcggcggcg

SEQ ID NO: 167362 - RNA, 22 nt, Human
gcgggcgaugcugcccucugug

SEQ ID NO: 167363 - RNA, 19 nt, Human
gcgggggugggggcggcag

SEQ ID NO: 167364 - RNA, 20 nt, Human
gcuccgggcugccagggaga

SEQ ID NO: 167365 - RNA, 19 nt, Human
gcugcuccgggagccggcu

SEQ ID NO: 167366 - RNA, 21 nt, Human
ggagcaucaccgccgcucgga

SEQ ID NO: 167367 - RNA, 22 nt, Human
ggcacccccggagucggagcau

SEQ ID NO: 167368 - RNA, 22 nt, Human
ggcagcggcggcgcaggcgggg

SEQ ID NO: 167369 - RNA, 22 nt, Human
ggcggcggcggcggcggcggag

SEQ ID NO: 167370 - RNA, 23 nt, Human
ggcggcggcggcggcggcggcgg

SEQ ID NO: 167371 - RNA, 20 nt, Human
ggcggucgauucgcugaagc

SEQ ID NO: 167372 - RNA, 21 nt, Human
ggcgguggcgcugcuccggga

SEQ ID NO: 167373 - RNA, 24 nt, Human
gggaggcggcggcggcggcggcgg

SEQ ID NO: 167374 - RNA, 25 nt, Human
gggcagcggcggcgcaggcgggggc

SEQ ID NO: 167375 - RNA, 27 nt, Human
gggcagugggggcggcggcgguggcga

SEQ ID NO: 167376 - RNA, 18 nt, Human
gggcggcggcgguggcgc

SEQ ID NO: 167377 - RNA, 20 nt, Human
gggcuggggcuugcgggggc

SEQ ID NO: 167378 - RNA, 19 nt, Human
ggggaaggggcgggcgaug

SEQ ID NO: 167379 - RNA, 20 nt, Human
ggggaggggaggccgggcag

SEQ ID NO: 167380 - RNA, 18 nt, Human
ggggcggcggcgguggcg

SEQ ID NO: 167381 - RNA, 20 nt, Human
ggggcuggggcuugcggggg

SEQ ID NO: 167382 - RNA, 24 nt, Human
gggugggugcugcaagcagcauuu

SEQ ID NO: 167383 - RNA, 21 nt, Human
guggcgggggugggggcggca

SEQ ID NO: 167384 - RNA, 22 nt, Human
guugccacagcgacggggagga

SEQ ID NO: 167385 - RNA, 22 nt, Human
uaaccccuucuccuccagcucc

SEQ ID NO: 167386 - RNA, 20 nt, Human
uauggcuauuuggagggggc

SEQ ID NO: 167387 - RNA, 23 nt, Human
ucagugcccggaggugguggcgg

SEQ ID NO: 167388 - RNA, 18 nt, Human
uccaccuucagcuccagg

SEQ ID NO: 167389 - RNA, 23 nt, Human
uccaccuucagcuccagggccga

SEQ ID NO: 167390 - RNA, 21 nt, Human
uccuagggcaucaggaggacc

SEQ ID NO: 167391 - RNA, 18 nt, Human
uccuccagcuccuccacc

SEQ ID NO: 167392 - RNA, 22 nt, Human
uccucggggcuggggcuugcgg

SEQ ID NO: 167393 - RNA, 23 nt, Human
ucggggcuggggcuugcgggggc

SEQ ID NO: 167394 - RNA, 21 nt, Human
ucucaggcucugggggacgcc

SEQ ID NO: 167395 - RNA, 18 nt, Human
ucugcugcaggugcgaga

SEQ ID NO: 167396 - RNA, 21 nt, Human
ugcccggaggugguggcggug

SEQ ID NO: 167397 - RNA, 21 nt, Human
ugcccggccagccgagcugag

SEQ ID NO: 167398 - RNA, 18 nt, Human
ugcuccgggagccggcuc

SEQ ID NO: 167399 - RNA, 20 nt, Human
uggcgggggugggggcggcc

SEQ ID NO: 167400 - RNA, 18 nt, Human
uggcgguggcgggggugg

SEQ ID NO: 167401 - RNA, 18 nt, Human
ugggcugggggagccggu

SEQ ID NO: 167402 - RNA, 18 nt, Human
ugggggcggcggcggugg

SEQ ID NO: 167403 - RNA, 23 nt, Human
ugggggcggcggcgguggcgcug

SEQ ID NO: 167404 - RNA, 18 nt, Human
uuccuugagccucagccu

SEQ ID NO: 167405 - RNA, 22 nt, Human
uuuuuuuuucuuuugcaaacau

SEQ ID NO: 167406 - RNA, 22 nt, Human
aacaaccuucaaaugcacagaa

SEQ ID NO: 167407 - RNA, 24 nt, Human
aaccuguaacuuuccaacaaccuu

SEQ ID NO: 167408 - RNA, 18 nt, Human
aaugaaucaguaugagcc

SEQ ID NO: 167409 - RNA, 21 nt, Human
acaaccuucaaaugcacagaa

SEQ ID NO: 167410 - RNA, 21 nt, Human
aucaauuuuuagguuuauuuu

SEQ ID NO: 167411 - RNA, 22 nt, Human
augagccagugcuggcuugggu

SEQ ID NO: 167412 - RNA, 22 nt, Human
caaaaugaaucaguaugagcca

SEQ ID NO: 167413 - RNA, 26 nt, Human
cacaacacaaucauuugugaaguaag

SEQ ID NO: 167414 - RNA, 19 nt, Human
cauuucagcacaacacaau

SEQ ID NO: 167415 - RNA, 21 nt, Human
cauuucagcacaacacaauca

SEQ ID NO: 167416 - RNA, 21 nt, Human
ccagccagggaagcgagaggg

SEQ ID NO: 167417 - RNA, 22 nt, Human
cccuggggccagccagggaagc

SEQ ID NO: 167418 - RNA, 24 nt, Human
cucagagugcugucaagaacagcu

SEQ ID NO: 167419 - RNA, 19 nt, Human
cucuagcauuagaagugga

SEQ ID NO: 167420 - RNA, 21 nt, Human
ggagcugggagaggcucagga

SEQ ID NO: 167421 - RNA, 24 nt, Human
ggccagccagggaagcgagagggu

SEQ ID NO: 167422 - RNA, 23 nt, Human
ggcucagagugcugucaagaaca

SEQ ID NO: 167423 - RNA, 22 nt, Human
gggguuuuaguugagaucugug

SEQ ID NO: 167424 - RNA, 18 nt, Human
guagcccuggggccagcc

SEQ ID NO: 167425 - RNA, 19 nt, Human
guggagcugggagaggcuc

SEQ ID NO: 167426 - RNA, 27 nt, Human
guuuauaacugugaaggcaauauugcu

SEQ ID NO: 167427 - RNA, 18 nt, Human
uaaaaugaaccuguaacu

SEQ ID NO: 167428 - RNA, 22 nt, Human
uaagggguuuuaguugagaucu

SEQ ID NO: 167429 - RNA, 18 nt, Human
uaccagugguagcccugg

SEQ ID NO: 167430 - RNA, 22 nt, Human
uaccagugguagcccuggggcc

SEQ ID NO: 167431 - RNA, 22 nt, Human
uauaacugugaaggcaauauug

SEQ ID NO: 167432 - RNA, 25 nt, Human
ucaggaauaccagugguagcccuga

SEQ ID NO: 167433 - RNA, 24 nt, Human
ucaguaugagccagugcuggcuug

SEQ ID NO: 167434 - RNA, 18 nt, Human
uggagcugggagaggcuc

SEQ ID NO: 167435 - RNA, 18 nt, Human
ugggaaagagguaugaug

SEQ ID NO: 167436 - RNA, 19 nt, Human
ugggagaggcucaggaaua

SEQ ID NO: 167437 - RNA, 20 nt, Human
ugugaaaauaguuuauaugg

SEQ ID NO: 167438 - RNA, 19 nt, Human
ugugcaucuuccauuuagg

SEQ ID NO: 167439 - RNA, 27 nt, Human
aaaaggccacaacaacagcagugggca

SEQ ID NO: 167440 - RNA, 21 nt, Human
aacaacagcaagaaggcccag

SEQ ID NO: 167441 - RNA, 20 nt, Human
aagauaauaaagcccaaagc

SEQ ID NO: 167442 - RNA, 24 nt, Human
acagaaaagaaacugagaaauuag

SEQ ID NO: 167443 - RNA, 24 nt, Human
accauugaaguuggcaaaaaaagg

SEQ ID NO: 167444 - RNA, 18 nt, Human
agauaauaaagcccaaag

SEQ ID NO: 167445 - RNA, 20 nt, Human
agcuccuuuguuuuugccuu

SEQ ID NO: 167446 - RNA, 20 nt, Human
aggcccaggauuuucaacag

SEQ ID NO: 167447 - RNA, 24 nt, Human
aggcccaggauuuucaacagaaaa

SEQ ID NO: 167448 - RNA, 21 nt, Human
agggcccgagucuugaguggc

SEQ ID NO: 167449 - RNA, 21 nt, Human
auaaagcccaaagcauuaugc

SEQ ID NO: 167450 - RNA, 24 nt, Human
auuagaugaauccuucagggcccg

SEQ ID NO: 167451 - RNA, 22 nt, Human
caagauaauaaagcccaaagca

SEQ ID NO: 167452 - RNA, 22 nt, Human
ccauugcccaggcccaaccagg

SEQ ID NO: 167453 - RNA, 19 nt, Human
cccauugcccaggcccaac

SEQ ID NO: 167454 - RNA, 23 nt, Human
cccauugcccaggcccaaccagg

SEQ ID NO: 167455 - RNA, 24 nt, Human
gacuaggaccauugaaguuggcaa

SEQ ID NO: 167456 - RNA, 20 nt, Human
gcaaaaaaaggccacaacaa

SEQ ID NO: 167457 - RNA, 25 nt, Human
gcaaaaaaaggccacaacaacagca

SEQ ID NO: 167458 - RNA, 23 nt, Human
uaaagcccaaagcauuaugcuga

SEQ ID NO: 167459 - RNA, 21 nt, Human
ucuuuguuucugggugaagau

SEQ ID NO: 167460 - RNA, 21 nt, Human
ugaauccuucagggcccgagu

SEQ ID NO: 167461 - RNA, 19 nt, Human
ugacaagauaauaaagccc

SEQ ID NO: 167462 - RNA, 21 nt, Human
ugacaagauaauaaagcccaa

SEQ ID NO: 167463 - RNA, 18 nt, Human
ugcccaggcccaaccagg

SEQ ID NO: 167464 - RNA, 19 nt, Human
ugggugaagauggcauuuc

SEQ ID NO: 167465 - RNA, 24 nt, Human
uucaguauucuuuguuucugggug

SEQ ID NO: 167466 - RNA, 19 nt, Human
uucuggcuccuucccauug

SEQ ID NO: 167467 - RNA, 22 nt, Human
uugaaguuggcaaaaaaaggcc

SEQ ID NO: 167468 - RNA, 20 nt, Human
uugacagaauaguuuucucc

SEQ ID NO: 167469 - RNA, 27 nt, Human
uuucuggcuccuucccauuggggccgc

SEQ ID NO: 167470 - RNA, 21 nt, Human
uuugacagaauaguuuucucc

SEQ ID NO: 167471 - RNA, 23 nt, Human
aaguggcuauuucagagccuaga

SEQ ID NO: 167472 - RNA, 25 nt, Human
acugcaaaagaugcugaauagaaaa

SEQ ID NO: 167473 - RNA, 22 nt, Human
acuuucagaaauccuagagaaa

SEQ ID NO: 167474 - RNA, 22 nt, Human
caaaagaugcugaauagaaaag

SEQ ID NO: 167475 - RNA, 25 nt, Human
ccuacccguucuuugucuucuuuuc

SEQ ID NO: 167476 - RNA, 22 nt, Human
gguauugucaguaacuuucaga

SEQ ID NO: 167477 - RNA, 19 nt, Human
gugugucuacguccugucc

SEQ ID NO: 167478 - RNA, 21 nt, Human
uacagaguacugcaaaagaug

SEQ ID NO: 167479 - RNA, 23 nt, Human
ucagagccuagaaauaacacugu

SEQ ID NO: 167480 - RNA, 22 nt, Human
uggguauugucaguaacuuuca

SEQ ID NO: 167481 - RNA, 23 nt, Human
uuaaaguggcuauuucagagccu

SEQ ID NO: 167482 - RNA, 20 nt, Human
uuuaauuuuccuacccguuc

SEQ ID NO: 167483 - RNA, 22 nt, Human
uuucagaaauccuagagaaaau

SEQ ID NO: 167484 - RNA, 23 nt, Human
aaacaaagaagaagauaauacaa

SEQ ID NO: 167485 - RNA, 23 nt, Human
aaauggccuccaccaauaagaau

SEQ ID NO: 167486 - RNA, 24 nt, Human
aagaagauaauacaauaauucaga

SEQ ID NO: 167487 - RNA, 22 nt, Human
agauaggagaugacugggccug

SEQ ID NO: 167488 - RNA, 18 nt, Human
aggccuggggcuggcaga

SEQ ID NO: 167489 - RNA, 23 nt, Human
aggguggcaagaaagaggguacu

SEQ ID NO: 167490 - RNA, 21 nt, Human
caaagaagaagauaauacaau

SEQ ID NO: 167491 - RNA, 23 nt, Human
cagaaacaaauggccuccaccaa

SEQ ID NO: 167492 - RNA, 20 nt, Human
ccuuugaguugaggaguagg

SEQ ID NO: 167493 - RNA, 20 nt, Human
gcaagaaagaggguacugaa

SEQ ID NO: 167494 - RNA, 19 nt, Human
gcucuguguuuuccuuuga

SEQ ID NO: 167495 - RNA, 20 nt, Human
ggccuggggcuggcagaucu

SEQ ID NO: 167496 - RNA, 21 nt, Human
gguacugaaaacaaagaagaa

SEQ ID NO: 167497 - RNA, 25 nt, Human
uaagaauacuugaauuuccaggcca

SEQ ID NO: 167498 - RNA, 20 nt, Human
uacuugaauuuccaggccac

SEQ ID NO: 167499 - RNA, 25 nt, Human
uagcauagagcagauucuuugacuu

SEQ ID NO: 167500 - RNA, 22 nt, Human
uagcaugacuugguguaacccu

SEQ ID NO: 167501 - RNA, 23 nt, Human
uaugauggagagcagaggaggga

SEQ ID NO: 167502 - RNA, 23 nt, Human
uccaccaauaagaauacuugaau

SEQ ID NO: 167503 - RNA, 24 nt, Human
ugaaaacaaagaagaagauaauac

SEQ ID NO: 167504 - RNA, 19 nt, Human
ugaguugaggaguaggagg

SEQ ID NO: 167505 - RNA, 18 nt, Human
ugcucuaucucuugguua

SEQ ID NO: 167506 - RNA, 24 nt, Human
ugcucuguguuuuccuuugaguug

SEQ ID NO: 167507 - RNA, 19 nt, Human
uggcaagaaagaggguacu

SEQ ID NO: 167508 - RNA, 20 nt, Human
uggcaagaaagaggguacug

SEQ ID NO: 167509 - RNA, 24 nt, Human
uggcaagaaagaggguacugaaaa

SEQ ID NO: 167510 - RNA, 24 nt, Human
aaagacauacaaagaugacuaaaa

SEQ ID NO: 167511 - RNA, 24 nt, Human
aagagugacggaucaugaguggaa

SEQ ID NO: 167512 - RNA, 23 nt, Human
accacaugucaagaacucugcua

SEQ ID NO: 167513 - RNA, 21 nt, Human
accauguuucaaguacacuag

SEQ ID NO: 167514 - RNA, 25 nt, Human
caacaaacauuuauuaagcaccuac

SEQ ID NO: 167515 - RNA, 19 nt, Human
caagaacucugcuaaagac

SEQ ID NO: 167516 - RNA, 18 nt, Human
cccaaugaaaaacagggc

SEQ ID NO: 167517 - RNA, 20 nt, Human
gacuuacucucccuaccaua

SEQ ID NO: 167518 - RNA, 21 nt, Human
gcgcucaacagauccuucagc

SEQ ID NO: 167519 - RNA, 21 nt, Human
gugaaacaaaaugucuuaagc

SEQ ID NO: 167520 - RNA, 18 nt, Human
uaagcgauuuuauaccga

SEQ ID NO: 167521 - RNA, 23 nt, Human
uaagcuucccaaugaaaaacagg

SEQ ID NO: 167522 - RNA, 19 nt, Human
uaaggaaaagggcuaaaaa

SEQ ID NO: 167523 - RNA, 21 nt, Human
uacaaauggaaaacagguuuc

SEQ ID NO: 167524 - RNA, 20 nt, Human
uaccauaaaauuugauaaac

SEQ ID NO: 167525 - RNA, 22 nt, Human
uauuucucuuaucucucaggaa

SEQ ID NO: 167526 - RNA, 18 nt, Human
ucaaucucgucagauucu

SEQ ID NO: 167527 - RNA, 18 nt, Human
ucccaaugaaaaacaggg

SEQ ID NO: 167528 - RNA, 20 nt, Human
ucgccuguccgccuuuccuu

SEQ ID NO: 167529 - RNA, 22 nt, Human
ucucucaggaaacauauuuagu

SEQ ID NO: 167530 - RNA, 23 nt, Human
ugaaaaaaaacuaaaauugagcu

SEQ ID NO: 167531 - RNA, 19 nt, Human
ugaauagcaagugaaacaa

SEQ ID NO: 167532 - RNA, 22 nt, Human
ugaguugaaaguaauuucuuua

SEQ ID NO: 167533 - RNA, 24 nt, Human
uggaguaagcgauuuuauaccgau

SEQ ID NO: 167534 - RNA, 21 nt, Human
aaacagauuaaccacauccuc

SEQ ID NO: 167535 - RNA, 18 nt, Human
aaagagcuacccagcugc

SEQ ID NO: 167536 - RNA, 22 nt, Human
aaagcaaaagccaccuucacua

SEQ ID NO: 167537 - RNA, 27 nt, Human
aaccaaaccaucaagcccuggaacgcc

SEQ ID NO: 167538 - RNA, 19 nt, Human
aaccauguggccgcuaccu

SEQ ID NO: 167539 - RNA, 20 nt, Human
aacugcacgaccagcccagc

SEQ ID NO: 167540 - RNA, 22 nt, Human
aacuguguuucucauacuuuaa

SEQ ID NO: 167541 - RNA, 22 nt, Human
aagaauuaagugcuccccagcc

SEQ ID NO: 167542 - RNA, 23 nt, Human
aagcaacaaaugggagcccagag

SEQ ID NO: 167543 - RNA, 23 nt, Human
aagccaccuucacuaaugaggau

SEQ ID NO: 167544 - RNA, 21 nt, Human
accuugcccaaagggcaggug

SEQ ID NO: 167545 - RNA, 19 nt, Human
acucaugcuuuuccuguaa

SEQ ID NO: 167546 - RNA, 19 nt, Human
acuugggcuaacucuccuc

SEQ ID NO: 167547 - RNA, 22 nt, Human
agagggagagcugucaagugcu

SEQ ID NO: 167548 - RNA, 19 nt, Human
agcaaguccagggcugccu

SEQ ID NO: 167549 - RNA, 24 nt, Human
agccaaaccaaaccaucaagccaa

SEQ ID NO: 167550 - RNA, 21 nt, Human
agggaugugauggcaucuggg

SEQ ID NO: 167551 - RNA, 18 nt, Human
auaaagcaaaagccaccu

SEQ ID NO: 167552 - RNA, 23 nt, Human
auaaagcaaaagccaccuucacu

SEQ ID NO: 167553 - RNA, 21 nt, Human
auagaaucuuccugcuuggau

SEQ ID NO: 167554 - RNA, 22 nt, Human
auagaaucuuccugcuuggaua

SEQ ID NO: 167555 - RNA, 21 nt, Human
augaccucagaucauugggaa

SEQ ID NO: 167556 - RNA, 19 nt, Human
auggccuuaggacaaacca

SEQ ID NO: 167557 - RNA, 20 nt, Human
caaaccaaaccaucaagcca

SEQ ID NO: 167558 - RNA, 19 nt, Human
caaaccaucaagccaaaug

SEQ ID NO: 167559 - RNA, 24 nt, Human
caaacuauaaagcaaaagccaccu

SEQ ID NO: 167560 - RNA, 18 nt, Human
caaagagcuacccagcug

SEQ ID NO: 167561 - RNA, 19 nt, Human
cagaagaggcagcugggca

SEQ ID NO: 167562 - RNA, 19 nt, Human
cagagggugcccguggacu

SEQ ID NO: 167563 - RNA, 19 nt, Human
cagcacagagggagagcug

SEQ ID NO: 167564 - RNA, 18 nt, Human
cagggggcagccuugccc

SEQ ID NO: 167565 - RNA, 21 nt, Human
cagggggcagccuugccccuc

SEQ ID NO: 167566 - RNA, 19 nt, Human
caggugaaacagauuaacc

SEQ ID NO: 167567 - RNA, 20 nt, Human
cagguggguuaagccccagg

SEQ ID NO: 167568 - RNA, 21 nt, Human
cagguggguuaagccccaggc

SEQ ID NO: 167569 - RNA, 26 nt, Human
cauaagccaaaccaaaccaucaagau

SEQ ID NO: 167570 - RNA, 24 nt, Human
cauguggccgcuaccuuuguggau

SEQ ID NO: 167571 - RNA, 18 nt, Human
ccaaaccaucaagccaaa

SEQ ID NO: 167572 - RNA, 22 nt, Human
ccaggcaacauuaccuuuugaa

SEQ ID NO: 167573 - RNA, 21 nt, Human
ccaucuaccaccacuucuguc

SEQ ID NO: 167574 - RNA, 25 nt, Human
cccccccuaaccccaccuacaggaa

SEQ ID NO: 167575 - RNA, 19 nt, Human
ccccccuaaccccaccuac

SEQ ID NO: 167576 - RNA, 19 nt, Human
ccccucuucccuucucagg

SEQ ID NO: 167577 - RNA, 18 nt, Human
ccccugacugcccagaug

SEQ ID NO: 167578 - RNA, 20 nt, Human
cccuggggcagggggcagcc

SEQ ID NO: 167579 - RNA, 27 nt, Human
ccuggccugggcuucacggaccccagc

SEQ ID NO: 167580 - RNA, 21 nt, Human
ccuuggggucuccugacucug

SEQ ID NO: 167581 - RNA, 23 nt, Human
cuccaacaguccuugccccugac

SEQ ID NO: 167582 - RNA, 19 nt, Human
cugcucacagacagccagg

SEQ ID NO: 167583 - RNA, 24 nt, Human
cuggugaccuccaaucugguggcu

SEQ ID NO: 167584 - RNA, 24 nt, Human
cugucccugaucgcccccccuaac

SEQ ID NO: 167585 - RNA, 22 nt, Human
cuugccccugacugcccagaug

SEQ ID NO: 167586 - RNA, 21 nt, Human
gaaaguggagugggugaagug

SEQ ID NO: 167587 - RNA, 23 nt, Human
gagggugcccguggacuucuguc

SEQ ID NO: 167588 - RNA, 19 nt, Human
gauuaaccacauccuccuu

SEQ ID NO: 167589 - RNA, 22 nt, Human
gcagaugcucacaugccuuggg

SEQ ID NO: 167590 - RNA, 24 nt, Human
gcagggggcagccuugccccucac

SEQ ID NO: 167591 - RNA, 19 nt, Human
gccaagaacguaguccaaa

SEQ ID NO: 167592 - RNA, 19 nt, Human
gccugggcuucacggaccc

SEQ ID NO: 167593 - RNA, 21 nt, Human
gccugggcuucacggacccca

SEQ ID NO: 167594 - RNA, 18 nt, Human
gccuuuccucuucugaag

SEQ ID NO: 167595 - RNA, 19 nt, Human
ggcaagagguauauuuuga

SEQ ID NO: 167596 - RNA, 19 nt, Human
gggagagcugucaagugcu

SEQ ID NO: 167597 - RNA, 24 nt, Human
gggcagguggguuaagccccaggc

SEQ ID NO: 167598 - RNA, 21 nt, Human
gguguguuuggcccauugcag

SEQ ID NO: 167599 - RNA, 18 nt, Human
guauagaagugacuccug

SEQ ID NO: 167600 - RNA, 18 nt, Human
gucagguuagccaccacu

SEQ ID NO: 167601 - RNA, 19 nt, Human
gucccugaucgcccccccu

SEQ ID NO: 167602 - RNA, 23 nt, Human
uaaaaacccagguaggaugcugu

SEQ ID NO: 167603 - RNA, 22 nt, Human
uagcucagagaugugaaagcag

SEQ ID NO: 167604 - RNA, 20 nt, Human
uaggacaaaccaggugaaac

SEQ ID NO: 167605 - RNA, 19 nt, Human
uauacuauugcccaugcca

SEQ ID NO: 167606 - RNA, 19 nt, Human
uauauacuauugcccaugc

SEQ ID NO: 167607 - RNA, 18 nt, Human
ucaagccaaaugccacgg

SEQ ID NO: 167608 - RNA, 24 nt, Human
uccaaagauccccucuucccuucu

SEQ ID NO: 167609 - RNA, 22 nt, Human
uccagggauccuuccaucuacc

SEQ ID NO: 167610 - RNA, 22 nt, Human
uccaggggugagguuagggagg

SEQ ID NO: 167611 - RNA, 25 nt, Human
uccauaagccaaaccaaaccaucaa

SEQ ID NO: 167612 - RNA, 20 nt, Human
uccaucuaccaccacuucug

SEQ ID NO: 167613 - RNA, 23 nt, Human
ucccagaucuuccauaagccaaa

SEQ ID NO: 167614 - RNA, 24 nt, Human
ucccagaucuuccauaagccaaac

SEQ ID NO: 167615 - RNA, 24 nt, Human
ucccugaucgcccccccuaacccc

SEQ ID NO: 167616 - RNA, 24 nt, Human
ucccuggaaaagagugagcuucug

SEQ ID NO: 167617 - RNA, 19 nt, Human
uccuccaacaguccuugcc

SEQ ID NO: 167618 - RNA, 19 nt, Human
ucugaagucuuauccaccu

SEQ ID NO: 167619 - RNA, 21 nt, Human
ucugaagucuuauccaccuuc

SEQ ID NO: 167620 - RNA, 20 nt, Human
ucugucccuggaaaagagug

SEQ ID NO: 167621 - RNA, 18 nt, Human
ugaaacagauuaaccaca

SEQ ID NO: 167622 - RNA, 24 nt, Human
ugacuccugguguccuuucacccu

SEQ ID NO: 167623 - RNA, 18 nt, Human
ugaggauauagcucagag

SEQ ID NO: 167624 - RNA, 23 nt, Human
ugaugguaagcaaagucuggccu

SEQ ID NO: 167625 - RNA, 19 nt, Human
ugccccugacugcccagau

SEQ ID NO: 167626 - RNA, 21 nt, Human
ugccuggccugggcuucacgg

SEQ ID NO: 167627 - RNA, 19 nt, Human
ugccuuggggucuccugac

SEQ ID NO: 167628 - RNA, 23 nt, Human
ugcuggugaccuccaaucuggug

SEQ ID NO: 167629 - RNA, 18 nt, Human
uggcugccuggccugggc

SEQ ID NO: 167630 - RNA, 21 nt, Human
uggcugucuccucccacauca

SEQ ID NO: 167631 - RNA, 22 nt, Human
ugggaagaacuuaagagccgug

SEQ ID NO: 167632 - RNA, 20 nt, Human
ugggagcccagaguaacugc

SEQ ID NO: 167633 - RNA, 22 nt, Human
ugguguccuuucacccucagac

SEQ ID NO: 167634 - RNA, 20 nt, Human
ugucccugaucgcccccccu

SEQ ID NO: 167635 - RNA, 21 nt, Human
ugucuccucccacaucagguc

SEQ ID NO: 167636 - RNA, 25 nt, Human
uugccccugacugcccagauggcuu

SEQ ID NO: 167637 - RNA, 22 nt, Human
uugcugggcagaugcucacaug

SEQ ID NO: 167638 - RNA, 21 nt, Human
aaaaaaaaaagacucaaaaaa

SEQ ID NO: 167639 - RNA, 22 nt, Human
aaaaaaaagacucaaaaaacaa

SEQ ID NO: 167640 - RNA, 23 nt, Human
aaaaaaagacucaaaaaacaaaa

SEQ ID NO: 167641 - RNA, 23 nt, Human
aaaaaacaaaaccaaaccccaac

SEQ ID NO: 167642 - RNA, 19 nt, Human
aaaagacucaaaaaacaaa

SEQ ID NO: 167643 - RNA, 21 nt, Human
aaaagcaaucauuuguaagga

SEQ ID NO: 167644 - RNA, 23 nt, Human
aaacaaaaacaaaaacaaguccu

SEQ ID NO: 167645 - RNA, 24 nt, Human
aaacaaaaacaaaaacaaguccua

SEQ ID NO: 167646 - RNA, 22 nt, Human
aaacagcuuacagaugaugugu

SEQ ID NO: 167647 - RNA, 23 nt, Human
aaacauuuaaccugcuuccaaug

SEQ ID NO: 167648 - RNA, 19 nt, Human
aaacucacaaaauacaucg

SEQ ID NO: 167649 - RNA, 22 nt, Human
aaacugacacaggacaugaaau

SEQ ID NO: 167650 - RNA, 20 nt, Human
aaacugagaauguacuggug

SEQ ID NO: 167651 - RNA, 23 nt, Human
aaagaaacaaacucacaaaauac

SEQ ID NO: 167652 - RNA, 18 nt, Human
aacaaaacaaaaacaaaa

SEQ ID NO: 167653 - RNA, 23 nt, Human
aaccccaacacuucaaaaaacaa

SEQ ID NO: 167654 - RNA, 22 nt, Human
aacuuaucuucccugaacucug

SEQ ID NO: 167655 - RNA, 25 nt, Human
acaaaacaaaaacaaaaacaagucc

SEQ ID NO: 167656 - RNA, 18 nt, Human
acaaaagaaaaaaagaaa

SEQ ID NO: 167657 - RNA, 22 nt, Human
accaaaaaauaaaaaauucuua

SEQ ID NO: 167658 - RNA, 22 nt, Human
acccaaugcaggaaaauggucc

SEQ ID NO: 167659 - RNA, 19 nt, Human
aggcuaacuuccuaugacg

SEQ ID NO: 167660 - RNA, 22 nt, Human
auacauucccagaauaaauaac

SEQ ID NO: 167661 - RNA, 19 nt, Human
auccuacuaacuuucgacc

SEQ ID NO: 167662 - RNA, 24 nt, Human
augguacacuguggaaaaguacca

SEQ ID NO: 167663 - RNA, 20 nt, Human
caaaacauaaacugacacag

SEQ ID NO: 167664 - RNA, 21 nt, Human
caaaauuaaaaaaaaaagcuc

SEQ ID NO: 167665 - RNA, 26 nt, Human
caaaccccaacacuucaaaaaacaaa

SEQ ID NO: 167666 - RNA, 24 nt, Human
caaagaaacaaacucacaaaauac

SEQ ID NO: 167667 - RNA, 23 nt, Human
caacaaaacaaaaacaaaaacaa

SEQ ID NO: 167668 - RNA, 25 nt, Human
caacacuucaaaaaacaaaagaaaa

SEQ ID NO: 167669 - RNA, 24 nt, Human
caacaucaauuuagcagaggaaga

SEQ ID NO: 167670 - RNA, 23 nt, Human
cacaaaacuuggggcagacaaaa

SEQ ID NO: 167671 - RNA, 22 nt, Human
cagaugaagauaguucuuucuu

SEQ ID NO: 167672 - RNA, 24 nt, Human
cagauucagugguaccccuacuag

SEQ ID NO: 167673 - RNA, 21 nt, Human
cagcccugcuagcgccgggag

SEQ ID NO: 167674 - RNA, 23 nt, Human
cagcccugcuagcgccgggagcc

SEQ ID NO: 167675 - RNA, 28 nt, Human
cagugcaacaaaacaaaaacaaaaacaa

SEQ ID NO: 167676 - RNA, 18 nt, Human
cauacauggaaaugaccu

SEQ ID NO: 167677 - RNA, 25 nt, Human
ccaaugguaacaguuacauuuugua

SEQ ID NO: 167678 - RNA, 18 nt, Human
cccccgagaggugggcug

SEQ ID NO: 167679 - RNA, 18 nt, Human
ccgccgccgccgccgccg

SEQ ID NO: 167680 - RNA, 18 nt, Human
ccgccgccgccgccgccg

SEQ ID NO: 167681 - RNA, 18 nt, Human
ccgccgccgccgccgccg

SEQ ID NO: 167682 - RNA, 18 nt, Human
ccgccgccgccgccgccg

SEQ ID NO: 167683 - RNA, 18 nt, Human
ccgccgccgccgccgccg

SEQ ID NO: 167684 - RNA, 18 nt, Human
ccgccgccgccgccgccg

SEQ ID NO: 167685 - RNA, 18 nt, Human
ccgccgccgccgccgccg

SEQ ID NO: 167686 - RNA, 18 nt, Human
ccgccgccgccgccgccg

SEQ ID NO: 167687 - RNA, 18 nt, Human
ccgccgccgccgccgccg

SEQ ID NO: 167688 - RNA, 23 nt, Human
ccgccgccgccgccgccgccgcc

SEQ ID NO: 167689 - RNA, 23 nt, Human
ccgccgccgccgccgccgccgcc

SEQ ID NO: 167690 - RNA, 24 nt, Human
ccgccgccgccgccgccgccgccg

SEQ ID NO: 167691 - RNA, 24 nt, Human
ccgccgccgccgccgccgccgccg

SEQ ID NO: 167692 - RNA, 24 nt, Human
ccgccgccgccgccgccgccgccg

SEQ ID NO: 167693 - RNA, 24 nt, Human
ccgccgccgccgccgccgccgccg

SEQ ID NO: 167694 - RNA, 24 nt, Human
ccgccgccgccgccgccgccgccg

SEQ ID NO: 167695 - RNA, 24 nt, Human
ccgccgccgccgccgccgccgccg

SEQ ID NO: 167696 - RNA, 24 nt, Human
ccgccgccgccgccgccgccgccg

SEQ ID NO: 167697 - RNA, 24 nt, Human
ccgccgccgccgccgccgccgccu

SEQ ID NO: 167698 - RNA, 24 nt, Human
ccgccgccgccgccgccgccgccu

SEQ ID NO: 167699 - RNA, 27 nt, Human
ccgccgccgccgccgccuccgccgccg

SEQ ID NO: 167700 - RNA, 27 nt, Human
ccgccgccgccgccgccuccgccgccg

SEQ ID NO: 167701 - RNA, 18 nt, Human
ccgccgccgccgccgcgc

SEQ ID NO: 167702 - RNA, 19 nt, Human
ccgccgccgccgccgcgcu

SEQ ID NO: 167703 - RNA, 18 nt, Human
ccgccgccgccgccuccg

SEQ ID NO: 167704 - RNA, 18 nt, Human
ccgccgccgccgccuccg

SEQ ID NO: 167705 - RNA, 18 nt, Human
ccgccgccgccgcgcugc

SEQ ID NO: 167706 - RNA, 20 nt, Human
ccgccgccgccuccgccgcc

SEQ ID NO: 167707 - RNA, 20 nt, Human
ccgccgccgccuccgccgcc

SEQ ID NO: 167708 - RNA, 21 nt, Human
ccgccgccgccuccgccgccg

SEQ ID NO: 167709 - RNA, 21 nt, Human
ccgccgccgccuccgccgccg

SEQ ID NO: 167710 - RNA, 23 nt, Human
ccgccgccgccuccgccgccgcc

SEQ ID NO: 167711 - RNA, 23 nt, Human
ccgccgccgccuccgccgccgcc

SEQ ID NO: 167712 - RNA, 24 nt, Human
ccgccgccuccgccgccgccgccg

SEQ ID NO: 167713 - RNA, 24 nt, Human
ccgccgccuccgccgccgccgccg

SEQ ID NO: 167714 - RNA, 21 nt, Human
ccgccgcgcugccgcacgccc

SEQ ID NO: 167715 - RNA, 24 nt, Human
ccgccgcgcugccgcacgcccccu

SEQ ID NO: 167716 - RNA, 24 nt, Human
ccgccuccgccgccgccgccgccg

SEQ ID NO: 167717 - RNA, 24 nt, Human
ccgccuccgccgccgccgccgccg

SEQ ID NO: 167718 - RNA, 19 nt, Human
ccgcgcugccgcacgcccc

SEQ ID NO: 167719 - RNA, 21 nt, Human
ccuccgucaccgccgccgccc

SEQ ID NO: 167720 - RNA, 20 nt, Human
cgagauugaaaacagaaguc

SEQ ID NO: 167721 - RNA, 23 nt, Human
cgccgccgccgccgccgccuccg

SEQ ID NO: 167722 - RNA, 23 nt, Human
cgccgccgccgccgccgccuccg

SEQ ID NO: 167723 - RNA, 25 nt, Human
cgccgccgccgccgccgcgcugccg

SEQ ID NO: 167724 - RNA, 18 nt, Human
cgccgccgccgcgcugcc

SEQ ID NO: 167725 - RNA, 21 nt, Human
cgccuccgccgccgccgccgc

SEQ ID NO: 167726 - RNA, 21 nt, Human
cgccuccgccgccgccgccgc

SEQ ID NO: 167727 - RNA, 25 nt, Human
cuauaaccaaacaaaugucaacaua

SEQ ID NO: 167728 - RNA, 22 nt, Human
cucaaaaaacaaaaccaaaccc

SEQ ID NO: 167729 - RNA, 21 nt, Human
cuccgccgccgccgccgccgc

SEQ ID NO: 167730 - RNA, 21 nt, Human
cuccgccgccgccgccgccgc

SEQ ID NO: 167731 - RNA, 24 nt, Human
cuucaaaaaacaaaagaaaaaaag

SEQ ID NO: 167732 - RNA, 25 nt, Human
gaaaaauuacacaucucucucaaua

SEQ ID NO: 167733 - RNA, 22 nt, Human
gaaaaauuucacaaaacuuggg

SEQ ID NO: 167734 - RNA, 22 nt, Human
gccgccgccgccgccgccgccg

SEQ ID NO: 167735 - RNA, 19 nt, Human
gcugcgggcgcucgaggcc

SEQ ID NO: 167736 - RNA, 22 nt, Human
ggaaauauaacuucagaauuau

SEQ ID NO: 167737 - RNA, 30 nt, Human
uaaaaaaaaaagacucaaaaaacaaaaccu

SEQ ID NO: 167738 - RNA, 23 nt, Human
uaaaaagagacuagugcauauuu

SEQ ID NO: 167739 - RNA, 22 nt, Human
uaaaagcaaucauuuguaagga

SEQ ID NO: 167740 - RNA, 19 nt, Human
uaaaagcaauguuucaaaa

SEQ ID NO: 167741 - RNA, 20 nt, Human
uaaacugacacaggacauga

SEQ ID NO: 167742 - RNA, 25 nt, Human
uaaauuucacuuaaaaaaaaaagac

SEQ ID NO: 167743 - RNA, 20 nt, Human
uaacaaagaauaucacugcu

SEQ ID NO: 167744 - RNA, 19 nt, Human
uaaccaaacaaaugucaag

SEQ ID NO: 167745 - RNA, 18 nt, Human
uaaggaaaaaaauaugga

SEQ ID NO: 167746 - RNA, 21 nt, Human
uacaaggucauucuaccuugg

SEQ ID NO: 167747 - RNA, 26 nt, Human
uacagaaaaauuacacaucucucuca

SEQ ID NO: 167748 - RNA, 23 nt, Human
uaccugccaagauauaaaaaagg

SEQ ID NO: 167749 - RNA, 18 nt, Human
uacuauuugucuuuggcc

SEQ ID NO: 167750 - RNA, 20 nt, Human
uacugccuaaccugauguuu

SEQ ID NO: 167751 - RNA, 18 nt, Human
uagaccauauauuucaaa

SEQ ID NO: 167752 - RNA, 24 nt, Human
uaugaaugaacuccaacuccauuu

SEQ ID NO: 167753 - RNA, 23 nt, Human
uauggccaauaccaaaaaauaaa

SEQ ID NO: 167754 - RNA, 20 nt, Human
uauuaugcauacauggaaau

SEQ ID NO: 167755 - RNA, 18 nt, Human
ucacacacauuucagggu

SEQ ID NO: 167756 - RNA, 25 nt, Human
ucaccgccgccgcccgcgcucgccg

SEQ ID NO: 167757 - RNA, 24 nt, Human
ucaugugcaguuuguugccauuuu

SEQ ID NO: 167758 - RNA, 24 nt, Human
uccaaaauaagcuugaaauuaaaa

SEQ ID NO: 167759 - RNA, 25 nt, Human
uccaauucugcuuaaacauuagacc

SEQ ID NO: 167760 - RNA, 20 nt, Human
ucuccaaaauaagcuugaaa

SEQ ID NO: 167761 - RNA, 27 nt, Human
ugaaaaacauacacguuuagcacacaa

SEQ ID NO: 167762 - RNA, 22 nt, Human
ugaaauuaaaauaugaaaaauu

SEQ ID NO: 167763 - RNA, 27 nt, Human
ugaaauuuccaaugguaacaguuacau

SEQ ID NO: 167764 - RNA, 22 nt, Human
ugaaugaucacccaaugcagga

SEQ ID NO: 167765 - RNA, 19 nt, Human
ugacacaggacaugaaaug

SEQ ID NO: 167766 - RNA, 21 nt, Human
ugacacaggacaugaaaugac

SEQ ID NO: 167767 - RNA, 25 nt, Human
ugaugugugcaagguaccaauuucu

SEQ ID NO: 167768 - RNA, 24 nt, Human
ugcaaaucugaaaauuguugcuua

SEQ ID NO: 167769 - RNA, 23 nt, Human
ugcaacaaaacaaaaacaaaaac

SEQ ID NO: 167770 - RNA, 18 nt, Human
ugcuagcgccgggagccc

SEQ ID NO: 167771 - RNA, 21 nt, Human
uggaccaaaacauaaacugac

SEQ ID NO: 167772 - RNA, 24 nt, Human
uggcaauacuuuuuaaaagacuuu

SEQ ID NO: 167773 - RNA, 19 nt, Human
uggggcagacaaaauuaaa

SEQ ID NO: 167774 - RNA, 19 nt, Human
uggggcagacaaaauuaaa

SEQ ID NO: 167775 - RNA, 21 nt, Human
uggugaaugaucacccaaugc

SEQ ID NO: 167776 - RNA, 21 nt, Human
uguaaggaaaaaaauauggaa

SEQ ID NO: 167777 - RNA, 25 nt, Human
ugugcaaaucugaaaauuguugcuu

SEQ ID NO: 167778 - RNA, 23 nt, Human
ugugcaagguaccaauuucuguu

SEQ ID NO: 167779 - RNA, 20 nt, Human
uuagacaaaguaccuguacu

SEQ ID NO: 167780 - RNA, 23 nt, Human
uuccaacuuaucuucccugaacu

SEQ ID NO: 167781 - RNA, 23 nt, Human
uucccagaauaaauaacuagaaa

SEQ ID NO: 167782 - RNA, 24 nt, Human
uuuggccuaacaaaguuuucuaau

SEQ ID NO: 167783 - RNA, 22 nt, Human
aaaaagaaaguagaaaacagaa

SEQ ID NO: 167784 - RNA, 20 nt, Human
aaaaagcaguucaguguccc

SEQ ID NO: 167785 - RNA, 19 nt, Human
aaaaaggcaucccgaccuu

SEQ ID NO: 167786 - RNA, 21 nt, Human
aaaagaaaaaaaaugacuaag

SEQ ID NO: 167787 - RNA, 26 nt, Human
aaaagaaaaacacaguaaauucugga

SEQ ID NO: 167788 - RNA, 19 nt, Human
aaaaucccaugaaggacag

SEQ ID NO: 167789 - RNA, 21 nt, Human
aaacuccaacuucaaccuccg

SEQ ID NO: 167790 - RNA, 20 nt, Human
aaaggacagcuuugcacaca

SEQ ID NO: 167791 - RNA, 23 nt, Human
aaagugcuggguucagcugcagg

SEQ ID NO: 167792 - RNA, 24 nt, Human
aacaaaaaacuuagauucccuaau

SEQ ID NO: 167793 - RNA, 25 nt, Human
aacaaaacacauuuuuagccaaugg

SEQ ID NO: 167794 - RNA, 21 nt, Human
aacaacaacaauaacaacaac

SEQ ID NO: 167795 - RNA, 18 nt, Human
aacacaaacuugucaaac

SEQ ID NO: 167796 - RNA, 20 nt, Human
aaccaaaaagguaaagcauc

SEQ ID NO: 167797 - RNA, 19 nt, Human
aaccaggugcuuucuauuc

SEQ ID NO: 167798 - RNA, 22 nt, Human
aacuagaacuacaagucuuuca

SEQ ID NO: 167799 - RNA, 21 nt, Human
aacugcagaagaugcacagga

SEQ ID NO: 167800 - RNA, 19 nt, Human
aacuuacaagucaagccag

SEQ ID NO: 167801 - RNA, 26 nt, Human
aagaaaaggugguucagaagggaccc

SEQ ID NO: 167802 - RNA, 18 nt, Human
aagaagcauaaaaacaaa

SEQ ID NO: 167803 - RNA, 18 nt, Human
aagaccacuuguugcauu

SEQ ID NO: 167804 - RNA, 19 nt, Human
aagagaaaaaagaaaguag

SEQ ID NO: 167805 - RNA, 21 nt, Human
aagagaaaaaagaaaguagaa

SEQ ID NO: 167806 - RNA, 18 nt, Human
aagcaaaagccagagcca

SEQ ID NO: 167807 - RNA, 21 nt, Human
aagcaaaagccagagccagag

SEQ ID NO: 167808 - RNA, 26 nt, Human
aagcauaaaaacaaacauaaccaaag

SEQ ID NO: 167809 - RNA, 18 nt, Human
aagcggcggcaguggcac

SEQ ID NO: 167810 - RNA, 21 nt, Human
aagcggcggcaguggcacugg

SEQ ID NO: 167811 - RNA, 21 nt, Human
aagggccagaaagagcgagua

SEQ ID NO: 167812 - RNA, 25 nt, Human
aaguagaaaacagaaaaccuauaag

SEQ ID NO: 167813 - RNA, 26 nt, Human
aaguagauauaacaagucacugaaac

SEQ ID NO: 167814 - RNA, 22 nt, Human
aauacaaagccaagccaacauc

SEQ ID NO: 167815 - RNA, 18 nt, Human
aaucaugaaacugaaaga

SEQ ID NO: 167816 - RNA, 22 nt, Human
aauccuaccuaccaaacucaga

SEQ ID NO: 167817 - RNA, 19 nt, Human
aaucucuucuuugcaggau

SEQ ID NO: 167818 - RNA, 23 nt, Human
aauggugcaaaccaggugcuuuc

SEQ ID NO: 167819 - RNA, 22 nt, Human
acaaaaagaugguggaaucuga

SEQ ID NO: 167820 - RNA, 20 nt, Human
acaauaauauggacuuuaau

SEQ ID NO: 167821 - RNA, 22 nt, Human
acaaugaaaauucucaccugaa

SEQ ID NO: 167822 - RNA, 18 nt, Human
acaauuuaauggccaccu

SEQ ID NO: 167823 - RNA, 21 nt, Human
acacacacacacacacacaca

SEQ ID NO: 167824 - RNA, 31 nt, Human
acacacacacacacacacacugacgaugugg

SEQ ID NO: 167825 - RNA, 31 nt, Human
acacacacacacacacacugacgauguguag

SEQ ID NO: 167826 - RNA, 27 nt, Human
acacacacacgcacgugcgugcgcgca

SEQ ID NO: 167827 - RNA, 23 nt, Human
acagagccuuuuucaucacaaag

SEQ ID NO: 167828 - RNA, 21 nt, Human
acagcaacaauccuuaaucau

SEQ ID NO: 167829 - RNA, 21 nt, Human
acagggcuugagcaucugggg

SEQ ID NO: 167830 - RNA, 31 nt, Human
acaugcagggacacacacacgcacgugcgug

SEQ ID NO: 167831 - RNA, 24 nt, Human
accaccagaaaagaaaagaaacca

SEQ ID NO: 167832 - RNA, 21 nt, Human
acccuggucuguacaggaaau

SEQ ID NO: 167833 - RNA, 21 nt, Human
acuaaguaauaaaacguacac

SEQ ID NO: 167834 - RNA, 23 nt, Human
acuaccaccaccagaaaagaaaa

SEQ ID NO: 167835 - RNA, 25 nt, Human
acugcagcauccugucaggggccug

SEQ ID NO: 167836 - RNA, 25 nt, Human
agaaaaaagaaaguagaaaacagaa

SEQ ID NO: 167837 - RNA, 19 nt, Human
agaaaagaaaagaaaccaa

SEQ ID NO: 167838 - RNA, 21 nt, Human
agaaagaacacuagcaggaaa

SEQ ID NO: 167839 - RNA, 20 nt, Human
agaacaaagcaccaacaaaa

SEQ ID NO: 167840 - RNA, 24 nt, Human
agaauauaucacucaucuaaccaa

SEQ ID NO: 167841 - RNA, 23 nt, Human
agagagacaaguaacaacaacca

SEQ ID NO: 167842 - RNA, 18 nt, Human
agagagagggggagagag

SEQ ID NO: 167843 - RNA, 19 nt, Human
agagggaaggaggaaagaa

SEQ ID NO: 167844 - RNA, 21 nt, Human
agauacaaaccucuuauuaac

SEQ ID NO: 167845 - RNA, 20 nt, Human
agauacaaccacuaccacca

SEQ ID NO: 167846 - RNA, 28 nt, Human
agauaucuuugggaaagauaugcuagaa

SEQ ID NO: 167847 - RNA, 18 nt, Human
agaugccacuucuguugu

SEQ ID NO: 167848 - RNA, 18 nt, Human
agcaggaaagcaaaagcc

SEQ ID NO: 167849 - RNA, 22 nt, Human
agcggccaggcggcggcggcgg

SEQ ID NO: 167850 - RNA, 23 nt, Human
agcggcggcggcggcggcggcgg

SEQ ID NO: 167851 - RNA, 18 nt, Human
agcggcggcgggggcggc

SEQ ID NO: 167852 - RNA, 19 nt, Human
aggaaauuggaacuuacug

SEQ ID NO: 167853 - RNA, 21 nt, Human
aggcaaaagacagaagggccc

SEQ ID NO: 167854 - RNA, 21 nt, Human
aggcagaggugugaauuccuu

SEQ ID NO: 167855 - RNA, 19 nt, Human
aggcaggcgagcuugagcu

SEQ ID NO: 167856 - RNA, 22 nt, Human
aggccaggcacgggccccaggg

SEQ ID NO: 167857 - RNA, 22 nt, Human
aggcggcggcggcgggcgggcg

SEQ ID NO: 167858 - RNA, 23 nt, Human
agggcccaaugaacauggagcau

SEQ ID NO: 167859 - RNA, 22 nt, Human
agggugaguuugugugugugug

SEQ ID NO: 167860 - RNA, 19 nt, Human
agugguggcccuaccuggg

SEQ ID NO: 167861 - RNA, 19 nt, Human
aguugauugaaaaauccug

SEQ ID NO: 167862 - RNA, 20 nt, Human
auaaaaacaaacauaaccaa

SEQ ID NO: 167863 - RNA, 21 nt, Human
auaaagagacaacuugaguca

SEQ ID NO: 167864 - RNA, 18 nt, Human
auaagagagaaaauguga

SEQ ID NO: 167865 - RNA, 23 nt, Human
auaaucaaguggugauccagagc

SEQ ID NO: 167866 - RNA, 24 nt, Human
auacaaaucacagagccaacaaaa

SEQ ID NO: 167867 - RNA, 25 nt, Human
auacaaccacuaccaccaccagaaa

SEQ ID NO: 167868 - RNA, 18 nt, Human
auagccaggcacucuacc

SEQ ID NO: 167869 - RNA, 22 nt, Human
auccaguggcguguugaagcau

SEQ ID NO: 167870 - RNA, 19 nt, Human
aucuccaucccuuaguccc

SEQ ID NO: 167871 - RNA, 28 nt, Human
augaaacagaauccaaauuagauaucuu

SEQ ID NO: 167872 - RNA, 20 nt, Human
augaaacugaaagaugucuu

SEQ ID NO: 167873 - RNA, 18 nt, Human
augaaggacagcaagcua

SEQ ID NO: 167874 - RNA, 23 nt, Human
augauaaagagacaacuugaguc

SEQ ID NO: 167875 - RNA, 29 nt, Human
augcagggacacacacacgcacgugcggu

SEQ ID NO: 167876 - RNA, 24 nt, Human
augguuuugaauuaggggaugcac

SEQ ID NO: 167877 - RNA, 22 nt, Human
augugugugugugugagugugu

SEQ ID NO: 167878 - RNA, 22 nt, Human
auguuuguacacagaguuacug

SEQ ID NO: 167879 - RNA, 19 nt, Human
caaaaagaauugcagaggc

SEQ ID NO: 167880 - RNA, 20 nt, Human
caaaaagaauugcagaggca

SEQ ID NO: 167881 - RNA, 21 nt, Human
caaacacacacgcuauagacc

SEQ ID NO: 167882 - RNA, 22 nt, Human
caaacuauucccagcugaaagc

SEQ ID NO: 167883 - RNA, 20 nt, Human
caaagcaccaacaaaacgcu

SEQ ID NO: 167884 - RNA, 23 nt, Human
caaagcaccaacaaaacgcuugu

SEQ ID NO: 167885 - RNA, 25 nt, Human
caaagcaccaacaaaacuggagacc

SEQ ID NO: 167886 - RNA, 22 nt, Human
caaagccaagccaacaucauaa

SEQ ID NO: 167887 - RNA, 20 nt, Human
caacaaaacgcuugugcgcc

SEQ ID NO: 167888 - RNA, 24 nt, Human
caacaacaauaacaacaacgauga

SEQ ID NO: 167889 - RNA, 22 nt, Human
caacacuacagcaaacaaucuu

SEQ ID NO: 167890 - RNA, 26 nt, Human
caacauguuacagcuaaauucuaccc

SEQ ID NO: 167891 - RNA, 22 nt, Human
caacucagcucauguucuccag

SEQ ID NO: 167892 - RNA, 22 nt, Human
caacuucaaccuccgggaugca

SEQ ID NO: 167893 - RNA, 20 nt, Human
caaguaacaacaaccaucac

SEQ ID NO: 167894 - RNA, 24 nt, Human
caagugcuucccauucuuuguuuu

SEQ ID NO: 167895 - RNA, 19 nt, Human
caauaauuuuuccccacag

SEQ ID NO: 167896 - RNA, 24 nt, Human
caauaggaacaaacuauucccagc

SEQ ID NO: 167897 - RNA, 23 nt, Human
cacaaccagugagaaaugucucc

SEQ ID NO: 167898 - RNA, 20 nt, Human
cacacacacacacacacaca

SEQ ID NO: 167899 - RNA, 20 nt, Human
cacacacacacacacacaca

SEQ ID NO: 167900 - RNA, 26 nt, Human
cacacacacacugacgauguguacuc

SEQ ID NO: 167901 - RNA, 22 nt, Human
cacacaggcagauauaguuuua

SEQ ID NO: 167902 - RNA, 26 nt, Human
cacaccacugguugcaugcuaggcug

SEQ ID NO: 167903 - RNA, 21 nt, Human
cacacgcacgugcgugcgcgc

SEQ ID NO: 167904 - RNA, 24 nt, Human
cacaugucucauaucccucccaca

SEQ ID NO: 167905 - RNA, 23 nt, Human
caccaaccuuggguguucagagu

SEQ ID NO: 167906 - RNA, 20 nt, Human
caccaccagaaaagaaaaga

SEQ ID NO: 167907 - RNA, 21 nt, Human
caccagaaaagaaaagaaacc

SEQ ID NO: 167908 - RNA, 18 nt, Human
caccagcaacugcuggca

SEQ ID NO: 167909 - RNA, 23 nt, Human
caccccugacaacucucaggggu

SEQ ID NO: 167910 - RNA, 21 nt, Human
cacuacagcaaacaaucuuca

SEQ ID NO: 167911 - RNA, 20 nt, Human
cacugagggcucaacucagc

SEQ ID NO: 167912 - RNA, 21 nt, Human
cacuucccccuucccuccuca

SEQ ID NO: 167913 - RNA, 20 nt, Human
cagaaagagcgaguaagaca

SEQ ID NO: 167914 - RNA, 19 nt, Human
cagaauaucuccaucccuu

SEQ ID NO: 167915 - RNA, 22 nt, Human
cagaauaucuccaucccuuagu

SEQ ID NO: 167916 - RNA, 22 nt, Human
cagagccuuuuucaucacaaag

SEQ ID NO: 167917 - RNA, 20 nt, Human
cagcacaccacugguugcau

SEQ ID NO: 167918 - RNA, 18 nt, Human
cagcagcagcgggcgcug

SEQ ID NO: 167919 - RNA, 18 nt, Human
cagcagcgggcgcuggag

SEQ ID NO: 167920 - RNA, 21 nt, Human
cagccggggcggcagcggcgg

SEQ ID NO: 167921 - RNA, 25 nt, Human
cagcggcggcgggggcggccggggc

SEQ ID NO: 167922 - RNA, 19 nt, Human
cagcggcugcacaggcggc

SEQ ID NO: 167923 - RNA, 21 nt, Human
cagcucaagucuggcuguuuu

SEQ ID NO: 167924 - RNA, 19 nt, Human
cagcuuggagcaagucaac

SEQ ID NO: 167925 - RNA, 19 nt, Human
caggaccaggagaaugaau

SEQ ID NO: 167926 - RNA, 22 nt, Human
caggggccuggacguaggcuuu

SEQ ID NO: 167927 - RNA, 21 nt, Human
cagugaccaucagugcgcugg

SEQ ID NO: 167928 - RNA, 22 nt, Human
caguuuacccuggucuguacag

SEQ ID NO: 167929 - RNA, 20 nt, Human
cauaaacacugcagaaccac

SEQ ID NO: 167930 - RNA, 24 nt, Human
cauaaagcucaaccacagugggag

SEQ ID NO: 167931 - RNA, 19 nt, Human
cauaucccucccacaaacu

SEQ ID NO: 167932 - RNA, 22 nt, Human
caucaagaucuagaggcacgau

SEQ ID NO: 167933 - RNA, 19 nt, Human
caucucuuuccaaccaugu

SEQ ID NO: 167934 - RNA, 24 nt, Human
caucuggggugcauuugacuaccc

SEQ ID NO: 167935 - RNA, 22 nt, Human
cauguucuccagcugagguggc

SEQ ID NO: 167936 - RNA, 22 nt, Human
ccaaacaaaggaaagggaaaca

SEQ ID NO: 167937 - RNA, 22 nt, Human
ccaaacuguucuucaaaaggac

SEQ ID NO: 167938 - RNA, 21 nt, Human
ccaaccucaaacuccaacuuc

SEQ ID NO: 167939 - RNA, 18 nt, Human
ccacacaggcagauauag

SEQ ID NO: 167940 - RNA, 22 nt, Human
ccacagauacaaccacuaccac

SEQ ID NO: 167941 - RNA, 28 nt, Human
ccaccagaaaagaaaagaaaccaaucuc

SEQ ID NO: 167942 - RNA, 20 nt, Human
ccagaaaagaaaagaaacca

SEQ ID NO: 167943 - RNA, 21 nt, Human
ccagaaagagcgaguaagaca

SEQ ID NO: 167944 - RNA, 19 nt, Human
ccagagagagagagagaca

SEQ ID NO: 167945 - RNA, 21 nt, Human
ccaggaagaagagaaagguua

SEQ ID NO: 167946 - RNA, 22 nt, Human
ccaggcagaagacaccccugac

SEQ ID NO: 167947 - RNA, 22 nt, Human
ccauccacaugucucauauccc

SEQ ID NO: 167948 - RNA, 21 nt, Human
ccaugaaaggauagaccccca

SEQ ID NO: 167949 - RNA, 21 nt, Human
ccauggaaauuggcaaauggu

SEQ ID NO: 167950 - RNA, 21 nt, Human
cccacacacaaagcauaugau

SEQ ID NO: 167951 - RNA, 21 nt, Human
ccccacagaauuaaauuuggg

SEQ ID NO: 167952 - RNA, 22 nt, Human
ccccagugaguggaguuccacc

SEQ ID NO: 167953 - RNA, 21 nt, Human
cccccuucccuccucaaaguc

SEQ ID NO: 167954 - RNA, 23 nt, Human
ccccuaacccaaugugagcacaa

SEQ ID NO: 167955 - RNA, 18 nt, Human
cccggcucuccagcccuc

SEQ ID NO: 167956 - RNA, 19 nt, Human
cccucccgcccagcuaaaa

SEQ ID NO: 167957 - RNA, 22 nt, Human
ccuacuacaauuuccucuugga

SEQ ID NO: 167958 - RNA, 23 nt, Human
ccucaaacuccaacuucaaccuc

SEQ ID NO: 167959 - RNA, 22 nt, Human
ccucccacaaacugguauacug

SEQ ID NO: 167960 - RNA, 23 nt, Human
ccuccgaauaugacagcuggcuu

SEQ ID NO: 167961 - RNA, 26 nt, Human
ccugcaaccacuccacuugcuccaga

SEQ ID NO: 167962 - RNA, 19 nt, Human
cgacccgacgcugcggcgg

SEQ ID NO: 167963 - RNA, 20 nt, Human
cgcacacacacacacacaca

SEQ ID NO: 167964 - RNA, 25 nt, Human
cgcgcacacacacacacacacacac

SEQ ID NO: 167965 - RNA, 19 nt, Human
cgcggcgcggcagccgggg

SEQ ID NO: 167966 - RNA, 24 nt, Human
cggcagcagcagcgggcgcuggag

SEQ ID NO: 167967 - RNA, 23 nt, Human
cggcagcggcggcgggggcggcc

SEQ ID NO: 167968 - RNA, 22 nt, Human
cggcccccggcucuccagcccu

SEQ ID NO: 167969 - RNA, 21 nt, Human
cggccggggcagaggcagcgg

SEQ ID NO: 167970 - RNA, 19 nt, Human
cggcgcggcagccggggcg

SEQ ID NO: 167971 - RNA, 18 nt, Human
cggcgcggcgcggcagcc

SEQ ID NO: 167972 - RNA, 19 nt, Human
cggcggcagcggcggcggg

SEQ ID NO: 167973 - RNA, 20 nt, Human
cggcggcaguggcacugggc

SEQ ID NO: 167974 - RNA, 18 nt, Human
cggcggcgggcgggcgcc

SEQ ID NO: 167975 - RNA, 21 nt, Human
cggcggcgggggcggccgggg

SEQ ID NO: 167976 - RNA, 22 nt, Human
cuacgacacgcaucaccauuua

SEQ ID NO: 167977 - RNA, 22 nt, Human
cucaagggauaggaagguaauu

SEQ ID NO: 167978 - RNA, 23 nt, Human
cucaagggauaggaagguaauuc

SEQ ID NO: 167979 - RNA, 25 nt, Human
cucagaaaagauucuuucagguuuc

SEQ ID NO: 167980 - RNA, 20 nt, Human
cuccagcccucccgcccagc

SEQ ID NO: 167981 - RNA, 24 nt, Human
cucucugugguuggagcuugggug

SEQ ID NO: 167982 - RNA, 21 nt, Human
cugaagauguuuguaauugcc

SEQ ID NO: 167983 - RNA, 28 nt, Human
cugaucccaaagaggaugucugagcaug

SEQ ID NO: 167984 - RNA, 21 nt, Human
cugcagcauccugucaggggc

SEQ ID NO: 167985 - RNA, 20 nt, Human
cugccucaacauucuaaugu

SEQ ID NO: 167986 - RNA, 23 nt, Human
cuguaaacauaaagcucaaccac

SEQ ID NO: 167987 - RNA, 21 nt, Human
cuuaccaacuguguaaauguu

SEQ ID NO: 167988 - RNA, 21 nt, Human
cuugucaaacucucugugguu

SEQ ID NO: 167989 - RNA, 22 nt, Human
cuuuuuaaaaaaucaaucguga

SEQ ID NO: 167990 - RNA, 20 nt, Human
gaacaaagcaccaacaaaac

SEQ ID NO: 167991 - RNA, 28 nt, Human
gaacaaguacaauucagaaaggguuucc

SEQ ID NO: 167992 - RNA, 22 nt, Human
gaaccacaacagggcuugagca

SEQ ID NO: 167993 - RNA, 22 nt, Human
gaagaagagaaagguuauagag

SEQ ID NO: 167994 - RNA, 22 nt, Human
gaagcggcggcaguggcacugg

SEQ ID NO: 167995 - RNA, 20 nt, Human
gacaccaaccuuggguguuc

SEQ ID NO: 167996 - RNA, 21 nt, Human
gagaauuacugaguuuccacg

SEQ ID NO: 167997 - RNA, 23 nt, Human
gagccaaacaaaggaaagggaaa

SEQ ID NO: 167998 - RNA, 25 nt, Human
gaggcaaaagacagaagggccagaa

SEQ ID NO: 167999 - RNA, 21 nt, Human
gaggcagcggcgcggcgcggc

SEQ ID NO: 168000 - RNA, 19 nt, Human
gauauggaaggagaugaug

SEQ ID NO: 168001 - RNA, 19 nt, Human
gaucucucacugccaucca

SEQ ID NO: 168002 - RNA, 18 nt, Human
gauguguacucuuugugc

SEQ ID NO: 168003 - RNA, 25 nt, Human
gcaaaaaggggcaagaacugcaauc

SEQ ID NO: 168004 - RNA, 24 nt, Human
gcacacacacacacacacacacac

SEQ ID NO: 168005 - RNA, 28 nt, Human
gcacacacacacacacacacacacugac

SEQ ID NO: 168006 - RNA, 22 nt, Human
gcagcggcggcggcggcggcuu

SEQ ID NO: 168007 - RNA, 18 nt, Human
gcagcggcugcacaggcg

SEQ ID NO: 168008 - RNA, 27 nt, Human
gcaggaaagcaaaagccagagccagag

SEQ ID NO: 168009 - RNA, 20 nt, Human
gcaguggcacugggcgggca

SEQ ID NO: 168010 - RNA, 21 nt, Human
gcccgcgcacccagcgacccg

SEQ ID NO: 168011 - RNA, 22 nt, Human
gcccgcgcacccagcgacccga

SEQ ID NO: 168012 - RNA, 20 nt, Human
gcgcacccagcgacccgacg

SEQ ID NO: 168013 - RNA, 20 nt, Human
gcgccacacauuugaaaugc

SEQ ID NO: 168014 - RNA, 18 nt, Human
gcgcggcgcggcagccgg

SEQ ID NO: 168015 - RNA, 23 nt, Human
gcggcagcggcggcggcggcggc

SEQ ID NO: 168016 - RNA, 23 nt, Human
gcggcagcggcggcggcggcggc

SEQ ID NO: 168017 - RNA, 21 nt, Human
gcggccaggcggcggcggcga

SEQ ID NO: 168018 - RNA, 23 nt, Human
gcggcggcagcggcugcacaggc

SEQ ID NO: 168019 - RNA, 24 nt, Human
gcggcggcggcggcggcagcggcu

SEQ ID NO: 168020 - RNA, 20 nt, Human
gcggcggcggcggcggcggc

SEQ ID NO: 168021 - RNA, 20 nt, Human
gcggcggcggcggcggcggc

SEQ ID NO: 168022 - RNA, 20 nt, Human
gcggcggcggcggcggcggc

SEQ ID NO: 168023 - RNA, 20 nt, Human
gcggcggcggcggcggcggc

SEQ ID NO: 168024 - RNA, 20 nt, Human
gcggcggcggcggcggcggc

SEQ ID NO: 168025 - RNA, 20 nt, Human
gcggcggcggcggcggcggc

SEQ ID NO: 168026 - RNA, 20 nt, Human
gcggcggcggcggcggcggc

SEQ ID NO: 168027 - RNA, 23 nt, Human
gcggcggcggcggcggcggcagc

SEQ ID NO: 168028 - RNA, 23 nt, Human
gcggcggcggcggcggcggcggc

SEQ ID NO: 168029 - RNA, 23 nt, Human
gcggcggcggcggcggcggcggc

SEQ ID NO: 168030 - RNA, 23 nt, Human
gcggcggcggcggcggcggcggc

SEQ ID NO: 168031 - RNA, 23 nt, Human
gcggcggcggcggcggcggcggc

SEQ ID NO: 168032 - RNA, 23 nt, Human
gcggcggcggcggcggcggcggc

SEQ ID NO: 168033 - RNA, 23 nt, Human
gcggcggcggcggcggcggcggc

SEQ ID NO: 168034 - RNA, 24 nt, Human
gcggcggcggcggcggcggcggca

SEQ ID NO: 168035 - RNA, 24 nt, Human
gcggcggcggcggcggcggcggcg

SEQ ID NO: 168036 - RNA, 24 nt, Human
gcggcggcggcggcggcggcggcg

SEQ ID NO: 168037 - RNA, 22 nt, Human
gcggcgggggcggccggggcag

SEQ ID NO: 168038 - RNA, 19 nt, Human
gcgggccggcggcggcagc

SEQ ID NO: 168039 - RNA, 23 nt, Human
ggaagaagagaaagguuauagag

SEQ ID NO: 168040 - RNA, 23 nt, Human
ggagaacaaugaguuccccaaua

SEQ ID NO: 168041 - RNA, 21 nt, Human
ggagagagagagagaggggga

SEQ ID NO: 168042 - RNA, 22 nt, Human
ggagcuuccuuuuacucugccc

SEQ ID NO: 168043 - RNA, 20 nt, Human
ggaguugaaaaacacugaug

SEQ ID NO: 168044 - RNA, 19 nt, Human
ggaucuaaaaagcaguuca

SEQ ID NO: 168045 - RNA, 20 nt, Human
ggaugcauaaguguuguugc

SEQ ID NO: 168046 - RNA, 20 nt, Human
ggcaaauggugcaaaccagg

SEQ ID NO: 168047 - RNA, 22 nt, Human
ggcagcggcggcgggggcggcc

SEQ ID NO: 168048 - RNA, 25 nt, Human
ggccagaaagagcgaguaagacaug

SEQ ID NO: 168049 - RNA, 23 nt, Human
ggcggcggcggcggcagcggcug

SEQ ID NO: 168050 - RNA, 23 nt, Human
ggcggcggcggcggcggcggcgg

SEQ ID NO: 168051 - RNA, 23 nt, Human
ggcggcggcggcggcggcggcgg

SEQ ID NO: 168052 - RNA, 23 nt, Human
ggcggcggcggcggcggcggcgg

SEQ ID NO: 168053 - RNA, 23 nt, Human
ggcggcggcggcggcggcggcgg

SEQ ID NO: 168054 - RNA, 23 nt, Human
ggcggcggcggcggcggcggcgg

SEQ ID NO: 168055 - RNA, 23 nt, Human
ggcggcggcggcggcggcggcgg

SEQ ID NO: 168056 - RNA, 23 nt, Human
ggcggcggcggcggcggcggcgg

SEQ ID NO: 168057 - RNA, 23 nt, Human
ggcggcggcggcggcggcggcgg

SEQ ID NO: 168058 - RNA, 20 nt, Human
ggcggcggcggcgggcgggc

SEQ ID NO: 168059 - RNA, 18 nt, Human
ggcggcggcgggcgggcg

SEQ ID NO: 168060 - RNA, 19 nt, Human
gggaaagcuaaaaucccau

SEQ ID NO: 168061 - RNA, 19 nt, Human
gggcggcagcggcggcggc

SEQ ID NO: 168062 - RNA, 28 nt, Human
ggggauggucccuugugucuaaguucuc

SEQ ID NO: 168063 - RNA, 22 nt, Human
ggggcggcagcggcggcggcgg

SEQ ID NO: 168064 - RNA, 24 nt, Human
gggggauggucccuugugucuaag

SEQ ID NO: 168065 - RNA, 19 nt, Human
gguagagguagagugaugg

SEQ ID NO: 168066 - RNA, 20 nt, Human
guaaagcaucugaaauuccc

SEQ ID NO: 168067 - RNA, 21 nt, Human
guaaccagggccuccuggaac

SEQ ID NO: 168068 - RNA, 22 nt, Human
gucacugaaacuagaacuacaa

SEQ ID NO: 168069 - RNA, 18 nt, Human
gugcucagagucccugug

SEQ ID NO: 168070 - RNA, 21 nt, Human
gugcugaauugacccauucau

SEQ ID NO: 168071 - RNA, 24 nt, Human
gugggauacacaaaaguuugacag

SEQ ID NO: 168072 - RNA, 19 nt, Human
guguaugugugugugugug

SEQ ID NO: 168073 - RNA, 21 nt, Human
gugugugagugugugugugug

SEQ ID NO: 168074 - RNA, 21 nt, Human
gugugugugugagugugugug

SEQ ID NO: 168075 - RNA, 20 nt, Human
guucccguaaauacuuuauc

SEQ ID NO: 168076 - RNA, 21 nt, Human
guuugggggauggucccuugu

SEQ ID NO: 168077 - RNA, 22 nt, Human
uaaaaacaaacauaaccaaaga

SEQ ID NO: 168078 - RNA, 20 nt, Human
uaaaacuacuaguauuuucc

SEQ ID NO: 168079 - RNA, 23 nt, Human
uaaaagaaaaacacaguaaauuc

SEQ ID NO: 168080 - RNA, 20 nt, Human
uaaaaguuacaaauagcauu

SEQ ID NO: 168081 - RNA, 23 nt, Human
uaaaccuaaaaagucuugacuga

SEQ ID NO: 168082 - RNA, 23 nt, Human
uaacaaaaaacuuagauucccua

SEQ ID NO: 168083 - RNA, 24 nt, Human
uaacaacaacgaugaagaauuuag

SEQ ID NO: 168084 - RNA, 22 nt, Human
uaacaagucacugaaacuagaa

SEQ ID NO: 168085 - RNA, 24 nt, Human
uaacacaaacuugucaaacucucu

SEQ ID NO: 168086 - RNA, 23 nt, Human
uaaccaaagagaacguuccccag

SEQ ID NO: 168087 - RNA, 18 nt, Human
uaaguagaaucauccagg

SEQ ID NO: 168088 - RNA, 23 nt, Human
uacaaaaagaauugcagaggcaa

SEQ ID NO: 168089 - RNA, 18 nt, Human
uacaaaucacagagccaa

SEQ ID NO: 168090 - RNA, 19 nt, Human
uacaacaucuaaccagugg

SEQ ID NO: 168091 - RNA, 19 nt, Human
uacaaccacuaccaccacc

SEQ ID NO: 168092 - RNA, 20 nt, Human
uacaauuuaaaaauccugcc

SEQ ID NO: 168093 - RNA, 26 nt, Human
uacagagacaucuuguuggucagucg

SEQ ID NO: 168094 - RNA, 27 nt, Human
uacagagacaucuuguuggucagucgg

SEQ ID NO: 168095 - RNA, 19 nt, Human
uaccaacuguguaaauguu

SEQ ID NO: 168096 - RNA, 22 nt, Human
uaccaugaaaggauagaccccc

SEQ ID NO: 168097 - RNA, 22 nt, Human
uaccugggucaaguugcagggc

SEQ ID NO: 168098 - RNA, 21 nt, Human
uaccugugagauauggaagga

SEQ ID NO: 168099 - RNA, 24 nt, Human
uacuguccagggucuccuuccucc

SEQ ID NO: 168100 - RNA, 18 nt, Human
uacuugggagggagcaua

SEQ ID NO: 168101 - RNA, 18 nt, Human
uagaaaacagaaaaccua

SEQ ID NO: 168102 - RNA, 23 nt, Human
uagaacuacaagucuuucaucca

SEQ ID NO: 168103 - RNA, 20 nt, Human
uagacccccagucccugcua

SEQ ID NO: 168104 - RNA, 23 nt, Human
uagcagcuaaucugcuuuuucca

SEQ ID NO: 168105 - RNA, 27 nt, Human
uagcaucuuuuuaagaguagcauugcu

SEQ ID NO: 168106 - RNA, 23 nt, Human
uagcuuaaaaucaucuaaagugg

SEQ ID NO: 168107 - RNA, 22 nt, Human
uaggaagaaaacuguauaucau

SEQ ID NO: 168108 - RNA, 20 nt, Human
uaggcuuccuucacuucccc

SEQ ID NO: 168109 - RNA, 18 nt, Human
uagguagugauaccuuga

SEQ ID NO: 168110 - RNA, 29 nt, Human
uauaaaacuacuaguauuuucccaaugaa

SEQ ID NO: 168111 - RNA, 19 nt, Human
uauaacacugucucaucug

SEQ ID NO: 168112 - RNA, 21 nt, Human
uaucaaagacaacacuacagc

SEQ ID NO: 168113 - RNA, 22 nt, Human
uaucaaagacaacacuacagca

SEQ ID NO: 168114 - RNA, 25 nt, Human
uaucuuuuuaaaaaaucaaucguga

SEQ ID NO: 168115 - RNA, 20 nt, Human
uaugacaaaaccacuaaaaa

SEQ ID NO: 168116 - RNA, 23 nt, Human
uaugacaaaaccacuaaaaaucc

SEQ ID NO: 168117 - RNA, 23 nt, Human
uaugcuuguuucucugggaaacu

SEQ ID NO: 168118 - RNA, 23 nt, Human
uaugugugugugugugagugugu

SEQ ID NO: 168119 - RNA, 23 nt, Human
uaugugugugugugugagugugu

SEQ ID NO: 168120 - RNA, 23 nt, Human
uaugugugugugugugagugugu

SEQ ID NO: 168121 - RNA, 20 nt, Human
uauuuaaugaaagccucauu

SEQ ID NO: 168122 - RNA, 22 nt, Human
ucaaagacaacacuacagcaaa

SEQ ID NO: 168123 - RNA, 25 nt, Human
ucaaugauaacaacccccccaucga

SEQ ID NO: 168124 - RNA, 18 nt, Human
ucacauaaaagaaaaaca

SEQ ID NO: 168125 - RNA, 20 nt, Human
ucacuggcaaaagaguuuga

SEQ ID NO: 168126 - RNA, 20 nt, Human
ucagacaguuauaugacaaa

SEQ ID NO: 168127 - RNA, 23 nt, Human
ucagagacacuuucguagccaca

SEQ ID NO: 168128 - RNA, 25 nt, Human
ucagcuauucuccugcuuaaaaccu

SEQ ID NO: 168129 - RNA, 23 nt, Human
ucagcucaggagggcuucauucu

SEQ ID NO: 168130 - RNA, 20 nt, Human
ucagguuucauuugugagug

SEQ ID NO: 168131 - RNA, 23 nt, Human
uccaucccuuagucccucaaaua

SEQ ID NO: 168132 - RNA, 22 nt, Human
uccaucuuuccagauacaaacc

SEQ ID NO: 168133 - RNA, 20 nt, Human
uccaugaggcaauaugcuug

SEQ ID NO: 168134 - RNA, 19 nt, Human
ucccauagauuugagcaaa

SEQ ID NO: 168135 - RNA, 22 nt, Human
uccccagugaguggaguuccac

SEQ ID NO: 168136 - RNA, 23 nt, Human
ucccuccucaaagucugauacaa

SEQ ID NO: 168137 - RNA, 24 nt, Human
ucccugcuaucgugccagcuacaa

SEQ ID NO: 168138 - RNA, 18 nt, Human
uccgggaugcaaauuugc

SEQ ID NO: 168139 - RNA, 20 nt, Human
uccuaagcugcuuuauaaau

SEQ ID NO: 168140 - RNA, 23 nt, Human
uccucuacuuacuugggagggag

SEQ ID NO: 168141 - RNA, 22 nt, Human
ucgauugucagauuuggucacu

SEQ ID NO: 168142 - RNA, 19 nt, Human
ucggcggcccccggcucuc

SEQ ID NO: 168143 - RNA, 23 nt, Human
ucuacaggcuggcuaacaacaug

SEQ ID NO: 168144 - RNA, 21 nt, Human
ucuacuccuaaauccaugaug

SEQ ID NO: 168145 - RNA, 23 nt, Human
ucuagguagugauaccuugacuu

SEQ ID NO: 168146 - RNA, 18 nt, Human
ucuaguuucuggaugugg

SEQ ID NO: 168147 - RNA, 19 nt, Human
ucucagcgagcugguuguu

SEQ ID NO: 168148 - RNA, 20 nt, Human
ucucagucaauuuaccuacu

SEQ ID NO: 168149 - RNA, 20 nt, Human
ucuccaauuuugcuuacugu

SEQ ID NO: 168150 - RNA, 22 nt, Human
ucuccaauuuugcuuacugucc

SEQ ID NO: 168151 - RNA, 20 nt, Human
ucugaggaggaggauggaaa

SEQ ID NO: 168152 - RNA, 20 nt, Human
ucugauuagucuccugccag

SEQ ID NO: 168153 - RNA, 21 nt, Human
ucugcaaugagcaugaauguu

SEQ ID NO: 168154 - RNA, 23 nt, Human
ucugcaaugagcaugaauguugg

SEQ ID NO: 168155 - RNA, 23 nt, Human
ucugggcaacacggcauuaacuu

SEQ ID NO: 168156 - RNA, 19 nt, Human
ucugguguggugacggggg

SEQ ID NO: 168157 - RNA, 18 nt, Human
ucuguacaggaaauugga

SEQ ID NO: 168158 - RNA, 23 nt, Human
ucuuucagguuucauuugugagu

SEQ ID NO: 168159 - RNA, 25 nt, Human
ugaaacagcaaagcuccaaucucuu

SEQ ID NO: 168160 - RNA, 18 nt, Human
ugaaaggauagaccccca

SEQ ID NO: 168161 - RNA, 18 nt, Human
ugacaccaaccuugggug

SEQ ID NO: 168162 - RNA, 20 nt, Human
ugaccuacuacaauuuccuc

SEQ ID NO: 168163 - RNA, 19 nt, Human
ugacgauguguacucuuug

SEQ ID NO: 168164 - RNA, 19 nt, Human
ugagaacaaagcaccaaca

SEQ ID NO: 168165 - RNA, 24 nt, Human
ugagaacaaagcaccaacaaaacg

SEQ ID NO: 168166 - RNA, 27 nt, Human
ugagacuguaaacauaaagcucaacca

SEQ ID NO: 168167 - RNA, 22 nt, Human
ugagagugcagagucaucaccu

SEQ ID NO: 168168 - RNA, 19 nt, Human
ugagauggaaucaaucuca

SEQ ID NO: 168169 - RNA, 22 nt, Human
ugaggcuucacccucacaacuc

SEQ ID NO: 168170 - RNA, 19 nt, Human
ugagguggccuccaucuuc

SEQ ID NO: 168171 - RNA, 23 nt, Human
ugagugcccauuuuaccugugag

SEQ ID NO: 168172 - RNA, 18 nt, Human
ugauacaaaucacagagc

SEQ ID NO: 168173 - RNA, 23 nt, Human
ugcaaaggaggcagaggugugaa

SEQ ID NO: 168174 - RNA, 18 nt, Human
ugcacaccuacgacacgc

SEQ ID NO: 168175 - RNA, 21 nt, Human
ugcagaagaugcacaggacca

SEQ ID NO: 168176 - RNA, 21 nt, Human
ugcauuucucaggagccuguc

SEQ ID NO: 168177 - RNA, 20 nt, Human
ugccacaaugguccagcgac

SEQ ID NO: 168178 - RNA, 18 nt, Human
ugcccaggcuugcaagag

SEQ ID NO: 168179 - RNA, 22 nt, Human
ugccugcaaccacuccacuugc

SEQ ID NO: 168180 - RNA, 25 nt, Human
ugcgcgcacacacacacacacacac

SEQ ID NO: 168181 - RNA, 23 nt, Human
ugcuaaaagaaaaaaaaugacua

SEQ ID NO: 168182 - RNA, 20 nt, Human
uggaaaacaacaaaaccaca

SEQ ID NO: 168183 - RNA, 24 nt, Human
uggaaaacaacaaaaccacauuaa

SEQ ID NO: 168184 - RNA, 18 nt, Human
uggaaagagaauuaauac

SEQ ID NO: 168185 - RNA, 20 nt, Human
uggaaagagaauuaauacuu

SEQ ID NO: 168186 - RNA, 18 nt, Human
uggacacuuuccagaccu

SEQ ID NO: 168187 - RNA, 24 nt, Human
uggaugugggauuucaagaagaau

SEQ ID NO: 168188 - RNA, 18 nt, Human
ugggaaagauaugcuaga

SEQ ID NO: 168189 - RNA, 22 nt, Human
ugggagggagcauaggccaggc

SEQ ID NO: 168190 - RNA, 19 nt, Human
ugggcaaaaggggagaauu

SEQ ID NO: 168191 - RNA, 24 nt, Human
uggggcauucuucaggaggcuucc

SEQ ID NO: 168192 - RNA, 19 nt, Human
uggggugcccuuggggaaa

SEQ ID NO: 168193 - RNA, 20 nt, Human
uggguagugugggcuuaaaa

SEQ ID NO: 168194 - RNA, 25 nt, Human
ugggucuuuucauuuccuuacaugg

SEQ ID NO: 168195 - RNA, 19 nt, Human
uggugacgggggugcucag

SEQ ID NO: 168196 - RNA, 19 nt, Human
ugguuacagaaacaucuga

SEQ ID NO: 168197 - RNA, 18 nt, Human
ugguucagaagacuaauu

SEQ ID NO: 168198 - RNA, 23 nt, Human
ugguuggagcuugggugacaagu

SEQ ID NO: 168199 - RNA, 23 nt, Human
uguaaacauaaagcucaaccaca

SEQ ID NO: 168200 - RNA, 18 nt, Human
ugucuaguuucuggaugu

SEQ ID NO: 168201 - RNA, 24 nt, Human
ugucuccaaauuaggugaaugguu

SEQ ID NO: 168202 - RNA, 22 nt, Human
ugucugguguggugacgggggu

SEQ ID NO: 168203 - RNA, 19 nt, Human
ugucuguguguguccacau

SEQ ID NO: 168204 - RNA, 18 nt, Human
ugugaaagggcccaauga

SEQ ID NO: 168205 - RNA, 19 nt, Human
ugugaaggugggagaauua

SEQ ID NO: 168206 - RNA, 22 nt, Human
ugugaaggugggagaauuacug

SEQ ID NO: 168207 - RNA, 23 nt, Human
ugugaguguguguguguguguaa

SEQ ID NO: 168208 - RNA, 19 nt, Human
ugugcugcagacuuggcac

SEQ ID NO: 168209 - RNA, 25 nt, Human
uguggugacgggggugcucagaguc

SEQ ID NO: 168210 - RNA, 22 nt, Human
ugugguuuagguugaacuuaca

SEQ ID NO: 168211 - RNA, 22 nt, Human
uguguaagggugaguuugugug

SEQ ID NO: 168212 - RNA, 22 nt, Human
uguguccacaugaacacauaua

SEQ ID NO: 168213 - RNA, 21 nt, Human
ugugugagugugugugugugu

SEQ ID NO: 168214 - RNA, 22 nt, Human
ugugugagugugugugugugug

SEQ ID NO: 168215 - RNA, 21 nt, Human
ugugugugugagugugugugu

SEQ ID NO: 168216 - RNA, 21 nt, Human
ugugugugugagugugugugu

SEQ ID NO: 168217 - RNA, 21 nt, Human
ugugugugugagugugugugu

SEQ ID NO: 168218 - RNA, 20 nt, Human
ugugugugugugagugugug

SEQ ID NO: 168219 - RNA, 25 nt, Human
ugugugugugugagugugugugugu

SEQ ID NO: 168220 - RNA, 21 nt, Human
ugugugugugugucugugugu

SEQ ID NO: 168221 - RNA, 21 nt, Human
ugugugugugugucugugugu

SEQ ID NO: 168222 - RNA, 22 nt, Human
ugugugugugugucugugugug

SEQ ID NO: 168223 - RNA, 20 nt, Human
uguugagaaguaugugaggc

SEQ ID NO: 168224 - RNA, 33 nt, Human
uguugcacaugcagggacacacacacgcacggu

SEQ ID NO: 168225 - RNA, 21 nt, Human
uguuggaaaacaacaaaacca

SEQ ID NO: 168226 - RNA, 21 nt, Human
uguuuggaugcauaaguguug

SEQ ID NO: 168227 - RNA, 26 nt, Human
uuaaacucaaagaugaccagagcaca

SEQ ID NO: 168228 - RNA, 21 nt, Human
uuaccaacuguguaaauguug

SEQ ID NO: 168229 - RNA, 22 nt, Human
uuauacacauaaagcacaugaa

SEQ ID NO: 168230 - RNA, 21 nt, Human
uuauauacuuuaguuuaugcc

SEQ ID NO: 168231 - RNA, 20 nt, Human
uuaucaaagacaacacuacc

SEQ ID NO: 168232 - RNA, 18 nt, Human
uucaaaguaauccuaccu

SEQ ID NO: 168233 - RNA, 22 nt, Human
uucauaaacacugcagaaccac

SEQ ID NO: 168234 - RNA, 22 nt, Human
uuccaaccucaaacuccaacuu

SEQ ID NO: 168235 - RNA, 19 nt, Human
uucuauucucagcgagcug

SEQ ID NO: 168236 - RNA, 18 nt, Human
uucucggcggcccccggc

SEQ ID NO: 168237 - RNA, 24 nt, Human
uucuucaggaggcuucccacagcu

SEQ ID NO: 168238 - RNA, 21 nt, Human
uuggaguacaacuuccacagc

SEQ ID NO: 168239 - RNA, 23 nt, Human
uuggagucuacuaacacuaaaga

SEQ ID NO: 168240 - RNA, 23 nt, Human
uuggaugcauaaguguuguugcu

SEQ ID NO: 168241 - RNA, 25 nt, Human
uugguagcuuaaaaucaucuaaagu

SEQ ID NO: 168242 - RNA, 25 nt, Human
uuguugcauuucucaggagccuguc

SEQ ID NO: 168243 - RNA, 21 nt, Human
uuguugcugagacuguaaaca

SEQ ID NO: 168244 - RNA, 21 nt, Human
uuuacaacauguugggauuau

SEQ ID NO: 168245 - RNA, 20 nt, Human
uuuauacacauaaagcacau

SEQ ID NO: 168246 - RNA, 20 nt, Human
uuucaaaguaauccuaccua

SEQ ID NO: 168247 - RNA, 26 nt, Human
uuucaagaagggaaagcuaaaauccc

SEQ ID NO: 168248 - RNA, 23 nt, Human
uuugugugugugugucugugugu

SEQ ID NO: 168249 - RNA, 24 nt, Human
uuuuaccagcacaccacugguugc

SEQ ID NO: 168250 - RNA, 21 nt, Human
uuuuccaaccucaaacuccaa

SEQ ID NO: 168251 - RNA, 20 nt, Human
uuuuuugaagagguuuuuuu

SEQ ID NO: 168252 - RNA, 18 nt, Human
aaaaaagaaaccaucaga

SEQ ID NO: 168253 - RNA, 22 nt, Human
aaaaucccuucuaaugccuccc

SEQ ID NO: 168254 - RNA, 21 nt, Human
aaaaucccuucuaaugccuuu

SEQ ID NO: 168255 - RNA, 22 nt, Human
aaacaaauauaguaaaugcuau

SEQ ID NO: 168256 - RNA, 21 nt, Human
aaagcugggaaaaaaagaaac

SEQ ID NO: 168257 - RNA, 22 nt, Human
aagaaagaaagaagaacucuaa

SEQ ID NO: 168258 - RNA, 23 nt, Human
aagaaagaaagaagaacucuaag

SEQ ID NO: 168259 - RNA, 19 nt, Human
aagcuuuggcacauacagu

SEQ ID NO: 168260 - RNA, 19 nt, Human
aauaacagguaagagaaag

SEQ ID NO: 168261 - RNA, 20 nt, Human
acaggcaaugugcagcccuc

SEQ ID NO: 168262 - RNA, 21 nt, Human
acaguaguaaagcuuuggcac

SEQ ID NO: 168263 - RNA, 23 nt, Human
agaagggaugcagaggaccagag

SEQ ID NO: 168264 - RNA, 21 nt, Human
agaguuguuggcucaaaagcu

SEQ ID NO: 168265 - RNA, 19 nt, Human
agcaaagggcuuaagaaag

SEQ ID NO: 168266 - RNA, 18 nt, Human
agcugggaaaaaaagaaa

SEQ ID NO: 168267 - RNA, 21 nt, Human
aggguggggaaggggacgggu

SEQ ID NO: 168268 - RNA, 22 nt, Human
aucauuuggaaaaagugaguac

SEQ ID NO: 168269 - RNA, 18 nt, Human
aucccuucuaaugccucc

SEQ ID NO: 168270 - RNA, 20 nt, Human
ccccucuucccgcucgcgcc

SEQ ID NO: 168271 - RNA, 19 nt, Human
ccccugugcagcacagccg

SEQ ID NO: 168272 - RNA, 21 nt, Human
ccgcucgcgccugggguuccc

SEQ ID NO: 168273 - RNA, 22 nt, Human
ccucccccugugcagcacagcc

SEQ ID NO: 168274 - RNA, 19 nt, Human
ccucccggggguugucgcc

SEQ ID NO: 168275 - RNA, 22 nt, Human
ccugggguucccucuccucccc

SEQ ID NO: 168276 - RNA, 18 nt, Human
ccugugcagcacagccgg

SEQ ID NO: 168277 - RNA, 24 nt, Human
cuccucccccugugcagcacagcc

SEQ ID NO: 168278 - RNA, 25 nt, Human
cugcauaugcuuuccuauugauccc

SEQ ID NO: 168279 - RNA, 18 nt, Human
gaaggugggggccagagg

SEQ ID NO: 168280 - RNA, 24 nt, Human
gagcaaagggcuuaagaaagaaaa

SEQ ID NO: 168281 - RNA, 19 nt, Human
gcacagccggcgcgggcgu

SEQ ID NO: 168282 - RNA, 24 nt, Human
gcagaacaggcaaugugcagcccu

SEQ ID NO: 168283 - RNA, 19 nt, Human
gcucgcgccugggguuccc

SEQ ID NO: 168284 - RNA, 19 nt, Human
ggaaaaaucccuucuaaug

SEQ ID NO: 168285 - RNA, 19 nt, Human
ggaaggggacggguggagg

SEQ ID NO: 168286 - RNA, 21 nt, Human
ggguggagggacagaagggau

SEQ ID NO: 168287 - RNA, 22 nt, Human
guccccucuucccgcucgcgcc

SEQ ID NO: 168288 - RNA, 19 nt, Human
gugggggccagaggguggg

SEQ ID NO: 168289 - RNA, 23 nt, Human
uaagugaaagcagaaguguuugg

SEQ ID NO: 168290 - RNA, 19 nt, Human
uaguaaaugcuauaggaau

SEQ ID NO: 168291 - RNA, 25 nt, Human
uauaaaaaauaaucacccaccauaa

SEQ ID NO: 168292 - RNA, 24 nt, Human
uauaccaaauuccucuuaucaacu

SEQ ID NO: 168293 - RNA, 20 nt, Human
uauaggaauaguuaaucaga

SEQ ID NO: 168294 - RNA, 22 nt, Human
uccagagcaaagggcuuaagaa

SEQ ID NO: 168295 - RNA, 19 nt, Human
ucccggggguugucgccuc

SEQ ID NO: 168296 - RNA, 23 nt, Human
uccguauaaaaauacugggaaaa

SEQ ID NO: 168297 - RNA, 21 nt, Human
uccuauugaucccaaaccaaa

SEQ ID NO: 168298 - RNA, 19 nt, Human
uccucccccugugcagcac

SEQ ID NO: 168299 - RNA, 21 nt, Human
ucuaagcugggucugcuaaca

SEQ ID NO: 168300 - RNA, 28 nt, Human
ucuaaugccucccgggggucgaggacuc

SEQ ID NO: 168301 - RNA, 18 nt, Human
ucugcuaacaucacucca

SEQ ID NO: 168302 - RNA, 23 nt, Human
ugaguugagcugaagcuggagaa

SEQ ID NO: 168303 - RNA, 19 nt, Human
ugcuuggagaagcugugag

SEQ ID NO: 168304 - RNA, 19 nt, Human
uggaaaaagugaguacugu

SEQ ID NO: 168305 - RNA, 18 nt, Human
uucccucuccucccccug

SEQ ID NO: 168306 - RNA, 18 nt, Human
uugauaaauaacagguaa

SEQ ID NO: 168307 - RNA, 24 nt, Human
uugaucccaaaccaaaucuuagaa

SEQ ID NO: 168308 - RNA, 21 nt, Human
uuguggcugcagguccccucu

SEQ ID NO: 168309 - RNA, 23 nt, Human
uuuuuuuuuuuuuuuuuuuucag

SEQ ID NO: 168310 - RNA, 21 nt, Human
aaaaauaggucccuaaccccc

SEQ ID NO: 168311 - RNA, 20 nt, Human
aaccagacaccuuggaaggu

SEQ ID NO: 168312 - RNA, 20 nt, Human
aauaaauucucccuccccuc

SEQ ID NO: 168313 - RNA, 23 nt, Human
acguccugcgcccgccgcugucu

SEQ ID NO: 168314 - RNA, 29 nt, Human
agaggugauucaccgccccccaccccccu

SEQ ID NO: 168315 - RNA, 20 nt, Human
agccagaggcagggcaacca

SEQ ID NO: 168316 - RNA, 22 nt, Human
caccuuggaagguuccccugaa

SEQ ID NO: 168317 - RNA, 23 nt, Human
cagcgugaggcucccuuucuguu

SEQ ID NO: 168318 - RNA, 19 nt, Human
cagggcaaccagacaccuu

SEQ ID NO: 168319 - RNA, 21 nt, Human
ccaaaauaaauaucuccuccc

SEQ ID NO: 168320 - RNA, 19 nt, Human
ccagccccuaguguuaaaa

SEQ ID NO: 168321 - RNA, 23 nt, Human
cccccaagucagccuggccccca

SEQ ID NO: 168322 - RNA, 19 nt, Human
ccccuccaaacucucccca

SEQ ID NO: 168323 - RNA, 21 nt, Human
ccccugaacccugggcccagg

SEQ ID NO: 168324 - RNA, 21 nt, Human
cccgugguggaauuucaggac

SEQ ID NO: 168325 - RNA, 25 nt, Human
cccuccccuccaaacucuccccaaa

SEQ ID NO: 168326 - RNA, 27 nt, Human
cccugaacccugggcccaggccucaga

SEQ ID NO: 168327 - RNA, 20 nt, Human
ccgccgcugucugcgcccgg

SEQ ID NO: 168328 - RNA, 24 nt, Human
ccgugguggaauuucaggacaucu

SEQ ID NO: 168329 - RNA, 24 nt, Human
ccuaaggaaggagggcaccccccu

SEQ ID NO: 168330 - RNA, 24 nt, Human
ccuccaaacucuccccaaaauaaa

SEQ ID NO: 168331 - RNA, 23 nt, Human
ccuuucuguucuggagccagagg

SEQ ID NO: 168332 - RNA, 23 nt, Human
cuccccuccaaacucuccccaaa

SEQ ID NO: 168333 - RNA, 22 nt, Human
cugggcccaggccucagaggug

SEQ ID NO: 168334 - RNA, 20 nt, Human
cuguucuggagccagaggca

SEQ ID NO: 168335 - RNA, 22 nt, Human
gcaccccccuccccugugcaaa

SEQ ID NO: 168336 - RNA, 24 nt, Human
gggcaccccccuccccugugcaaa

SEQ ID NO: 168337 - RNA, 18 nt, Human
ggggaguugggggggucu

SEQ ID NO: 168338 - RNA, 23 nt, Human
uaaaaauaggucccuaacccccc

SEQ ID NO: 168339 - RNA, 21 nt, Human
uaaccccccagggugaccccc

SEQ ID NO: 168340 - RNA, 26 nt, Human
uagaauggaugaaugaaugaugagug

SEQ ID NO: 168341 - RNA, 19 nt, Human
uaggucccuaaccccccag

SEQ ID NO: 168342 - RNA, 23 nt, Human
uccccgcuuuggggaguuggggg

SEQ ID NO: 168343 - RNA, 25 nt, Human
uccugcgcccgccgcugucugcgcc

SEQ ID NO: 168344 - RNA, 20 nt, Human
ugaacccugggcccaggccu

SEQ ID NO: 168345 - RNA, 22 nt, Human
ugaaugaaugaugagugggcca

SEQ ID NO: 168346 - RNA, 20 nt, Human
ugagugaguggggccuagug

SEQ ID NO: 168347 - RNA, 21 nt, Human
uggaggagcuuggcucccgcc

SEQ ID NO: 168348 - RNA, 23 nt, Human
ugggaggcagagacuggcucuag

SEQ ID NO: 168349 - RNA, 18 nt, Human
ugucaagucugcccccca

SEQ ID NO: 168350 - RNA, 19 nt, Human
ugugugagccagcgugagg

SEQ ID NO: 168351 - RNA, 28 nt, Human
uuaauaaauucucccuccccuccaaacu

SEQ ID NO: 168352 - RNA, 21 nt, Human
uuuuuuuuuuuuuuuuuaaag

SEQ ID NO: 168353 - RNA, 22 nt, Human
acauccauuacauacaagugac

SEQ ID NO: 168354 - RNA, 22 nt, Human
acauuacuuagagcuagucuga

SEQ ID NO: 168355 - RNA, 23 nt, Human
acuuuuucuuccuccucccaucc

SEQ ID NO: 168356 - RNA, 18 nt, Human
agcagcagcacccaagga

SEQ ID NO: 168357 - RNA, 21 nt, Human
agugauagcaagauaauguga

SEQ ID NO: 168358 - RNA, 19 nt, Human
auggaacgacuguauuccc

SEQ ID NO: 168359 - RNA, 20 nt, Human
caaacuucggcuaccucaca

SEQ ID NO: 168360 - RNA, 18 nt, Human
caccacaggcaaagggaa

SEQ ID NO: 168361 - RNA, 19 nt, Human
cagcagcacccaaggagca

SEQ ID NO: 168362 - RNA, 25 nt, Human
cauacaagugaccugcaguuauuac

SEQ ID NO: 168363 - RNA, 25 nt, Human
cccugcuuacugaaccaaacuucuu

SEQ ID NO: 168364 - RNA, 19 nt, Human
ccugcaguuauuacugcua

SEQ ID NO: 168365 - RNA, 21 nt, Human
cugaaccaaacuucggcuacc

SEQ ID NO: 168366 - RNA, 22 nt, Human
cuuuuucuuccuccucccaucc

SEQ ID NO: 168367 - RNA, 22 nt, Human
gaaucacauuacuuagagcuag

SEQ ID NO: 168368 - RNA, 22 nt, Human
gacuuuuucuuccuccucccau

SEQ ID NO: 168369 - RNA, 21 nt, Human
ggacuuuuucuuccuccuccc

SEQ ID NO: 168370 - RNA, 22 nt, Human
gugagugugcagaccagcucug

SEQ ID NO: 168371 - RNA, 21 nt, Human
gugcagaccagcucugaugga

SEQ ID NO: 168372 - RNA, 20 nt, Human
guucuuuuggcauuaguuga

SEQ ID NO: 168373 - RNA, 20 nt, Human
uacaccacaggcaaagggaa

SEQ ID NO: 168374 - RNA, 24 nt, Human
uauuacaaaaccguucuuuuggca

SEQ ID NO: 168375 - RNA, 21 nt, Human
uauuacugcuacaaaucuuga

SEQ ID NO: 168376 - RNA, 23 nt, Human
ugggacuuuuucuuccuccuccc

SEQ ID NO: 168377 - RNA, 19 nt, Human
uuagauuauauguugauaa

SEQ ID NO: 168378 - RNA, 20 nt, Human
uuuucuuccuccucccaucc

SEQ ID NO: 168379 - RNA, 21 nt, Human
aaagagcugccgggacccagg

SEQ ID NO: 168380 - RNA, 21 nt, Human
aaaguaccaagagaaccacag

SEQ ID NO: 168381 - RNA, 26 nt, Human
aagcaaaagggaauuagaggggaccc

SEQ ID NO: 168382 - RNA, 18 nt, Human
aagcagacuuauuccacc

SEQ ID NO: 168383 - RNA, 22 nt, Human
accccacgcugccaccaccagc

SEQ ID NO: 168384 - RNA, 25 nt, Human
acuccacugacugagaaagggcuca

SEQ ID NO: 168385 - RNA, 26 nt, Human
agaaaagacaacacagucuuggagga

SEQ ID NO: 168386 - RNA, 21 nt, Human
agaaaguaccaagagaaccag

SEQ ID NO: 168387 - RNA, 21 nt, Human
agaagggccucggccugcagg

SEQ ID NO: 168388 - RNA, 21 nt, Human
agcaaauggccagguuuuucu

SEQ ID NO: 168389 - RNA, 20 nt, Human
aggcagaggcaccuccuggu

SEQ ID NO: 168390 - RNA, 18 nt, Human
aggcaggugggcacugga

SEQ ID NO: 168391 - RNA, 19 nt, Human
aggucuaagucaccacacc

SEQ ID NO: 168392 - RNA, 20 nt, Human
augcaaggcucaguucucca

SEQ ID NO: 168393 - RNA, 21 nt, Human
caaagcaaaagggaauuagag

SEQ ID NO: 168394 - RNA, 22 nt, Human
caaagcaaaagggaauuagagg

SEQ ID NO: 168395 - RNA, 18 nt, Human
caaagcccagccuuggca

SEQ ID NO: 168396 - RNA, 22 nt, Human
caagaaaguaccaagagaacca

SEQ ID NO: 168397 - RNA, 20 nt, Human
caagagaaccacagcuccac

SEQ ID NO: 168398 - RNA, 24 nt, Human
caccacaccuggggcugaagcaag

SEQ ID NO: 168399 - RNA, 18 nt, Human
cacgcugccaccaccagc

SEQ ID NO: 168400 - RNA, 22 nt, Human
ccacugaggcuaaggcuugugu

SEQ ID NO: 168401 - RNA, 20 nt, Human
cccaaagcccagccuuggca

SEQ ID NO: 168402 - RNA, 22 nt, Human
cccaacuugauacuccacugac

SEQ ID NO: 168403 - RNA, 20 nt, Human
ccccacgcugccaccaccag

SEQ ID NO: 168404 - RNA, 18 nt, Human
ccuccagcucuuuucccu

SEQ ID NO: 168405 - RNA, 19 nt, Human
ccuuaguagcagccagugu

SEQ ID NO: 168406 - RNA, 23 nt, Human
cgagaggcagaggcaccuccugg

SEQ ID NO: 168407 - RNA, 19 nt, Human
cggccugcaggcacugccu

SEQ ID NO: 168408 - RNA, 22 nt, Human
cguccuggcuggagagcuggug

SEQ ID NO: 168409 - RNA, 18 nt, Human
cuccacugaggcuaaggc

SEQ ID NO: 168410 - RNA, 19 nt, Human
cugcuuccuccuggcaugc

SEQ ID NO: 168411 - RNA, 18 nt, Human
cuggaugccguaauacuc

SEQ ID NO: 168412 - RNA, 21 nt, Human
cuuggugggacccaaagccca

SEQ ID NO: 168413 - RNA, 22 nt, Human
cuuggugggacccaaagcccag

SEQ ID NO: 168414 - RNA, 24 nt, Human
gaaaagacaacacagucuuggagg

SEQ ID NO: 168415 - RNA, 22 nt, Human
gaagcaagucuugccugugcac

SEQ ID NO: 168416 - RNA, 19 nt, Human
gaauuuuuaaaaccagcca

SEQ ID NO: 168417 - RNA, 20 nt, Human
gagaacucaucuugguggga

SEQ ID NO: 168418 - RNA, 21 nt, Human
gaggagggacugcuuccuccu

SEQ ID NO: 168419 - RNA, 20 nt, Human
gaggcaggugggcacuggag

SEQ ID NO: 168420 - RNA, 20 nt, Human
gaucuuucucuccccaccuc

SEQ ID NO: 168421 - RNA, 22 nt, Human
gcaaagcaaaagggaauuagag

SEQ ID NO: 168422 - RNA, 23 nt, Human
gcaaagcaaaagggaauuagagg

SEQ ID NO: 168423 - RNA, 24 nt, Human
gcaaagcaaaagggaauuagaggc

SEQ ID NO: 168424 - RNA, 23 nt, Human
gcacgcugggcggcaccccacgc

SEQ ID NO: 168425 - RNA, 22 nt, Human
gcacuggagggcuguuuccucu

SEQ ID NO: 168426 - RNA, 22 nt, Human
ggagaucuuucucuccccaccu

SEQ ID NO: 168427 - RNA, 21 nt, Human
gggcuuggagucugguggaag

SEQ ID NO: 168428 - RNA, 18 nt, Human
gucagcaguggcucugga

SEQ ID NO: 168429 - RNA, 21 nt, Human
uaaguuaaggugaaagacuua

SEQ ID NO: 168430 - RNA, 21 nt, Human
uaccaagagaaccacagcucc

SEQ ID NO: 168431 - RNA, 22 nt, Human
uacucuuggugagaaaagacaa

SEQ ID NO: 168432 - RNA, 23 nt, Human
uacucuuggugagaaaagacaac

SEQ ID NO: 168433 - RNA, 21 nt, Human
uagcacagaaugcaguaugua

SEQ ID NO: 168434 - RNA, 21 nt, Human
uagggaggagugaggcaggug

SEQ ID NO: 168435 - RNA, 23 nt, Human
ucaugcugcaucucugagcuccu

SEQ ID NO: 168436 - RNA, 18 nt, Human
uccuaggucuaagucacc

SEQ ID NO: 168437 - RNA, 22 nt, Human
uccucuggcacaguugaacuag

SEQ ID NO: 168438 - RNA, 24 nt, Human
ucgagaggcagaggcaccuccugg

SEQ ID NO: 168439 - RNA, 22 nt, Human
ucuaagucaccacaccuggggc

SEQ ID NO: 168440 - RNA, 21 nt, Human
ucuagcacuugauuuuauucc

SEQ ID NO: 168441 - RNA, 20 nt, Human
ucucugugugaucguccugg

SEQ ID NO: 168442 - RNA, 18 nt, Human
ucugagcuccugucugcc

SEQ ID NO: 168443 - RNA, 23 nt, Human
ucugugugaucguccuggcugga

SEQ ID NO: 168444 - RNA, 22 nt, Human
ugacaagaaaguaccaagagaa

SEQ ID NO: 168445 - RNA, 24 nt, Human
ugagaaagggcucaaugugcagca

SEQ ID NO: 168446 - RNA, 24 nt, Human
ugagcuccugucugcccgcagccc

SEQ ID NO: 168447 - RNA, 24 nt, Human
ugaggagggacugcuuccuccugg

SEQ ID NO: 168448 - RNA, 25 nt, Human
ugaggagggacugcuuccuccuggc

SEQ ID NO: 168449 - RNA, 21 nt, Human
ugaggccaucagaggggguuu

SEQ ID NO: 168450 - RNA, 24 nt, Human
ugaggccaucagaggggguuuuca

SEQ ID NO: 168451 - RNA, 27 nt, Human
ugaggcuaaggcuugugucauguacca

SEQ ID NO: 168452 - RNA, 23 nt, Human
ugauagauuuuugguuugacagg

SEQ ID NO: 168453 - RNA, 25 nt, Human
ugcacuguucaccaaccacaccacg

SEQ ID NO: 168454 - RNA, 23 nt, Human
ugcaucucugagcuccugucugc

SEQ ID NO: 168455 - RNA, 21 nt, Human
uggaaagaauuuuuaaaacca

SEQ ID NO: 168456 - RNA, 18 nt, Human
uggaggagagugggcuug

SEQ ID NO: 168457 - RNA, 19 nt, Human
uggcaugaagcagacuuau

SEQ ID NO: 168458 - RNA, 20 nt, Human
uggcuggagagcuggugagg

SEQ ID NO: 168459 - RNA, 23 nt, Human
uguggaaagaauuuuuaaaacca

SEQ ID NO: 168460 - RNA, 26 nt, Human
uucccuuacaaaugaccagggugcaa

SEQ ID NO: 168461 - RNA, 20 nt, Human
uuccugugagccuagagugg

SEQ ID NO: 168462 - RNA, 21 nt, Human
uuuuuuuuuuuuuuuuuuugg

SEQ ID NO: 168463 - RNA, 24 nt, Human
acaagaaaaaaauugccaucuuca

SEQ ID NO: 168464 - RNA, 24 nt, Human
agacagagcugcaucagcgaaaga

SEQ ID NO: 168465 - RNA, 24 nt, Human
agguuuaaaaauugagacagagcu

SEQ ID NO: 168466 - RNA, 24 nt, Human
caaaugacuuuaauauaaaguuuu

SEQ ID NO: 168467 - RNA, 20 nt, Human
caaaugcaaagccuagugac

SEQ ID NO: 168468 - RNA, 21 nt, Human
cagccauaaugaauuaucucc

SEQ ID NO: 168469 - RNA, 20 nt, Human
cauauacaugcauaguaaca

SEQ ID NO: 168470 - RNA, 21 nt, Human
cuauacaagaaaaaaauugcc

SEQ ID NO: 168471 - RNA, 25 nt, Human
cuuauuuuuuuuucuggacugguua

SEQ ID NO: 168472 - RNA, 21 nt, Human
gaagcuauuucuaaaaugcuu

SEQ ID NO: 168473 - RNA, 19 nt, Human
gcuacuauacagugcaaac

SEQ ID NO: 168474 - RNA, 18 nt, Human
uaaagugcaaacagagcc

SEQ ID NO: 168475 - RNA, 24 nt, Human
uaaauagaucuuauauaugaauuu

SEQ ID NO: 168476 - RNA, 20 nt, Human
uaacauaaccacagcuauga

SEQ ID NO: 168477 - RNA, 24 nt, Human
uaacauacagguucaggauuaaga

SEQ ID NO: 168478 - RNA, 22 nt, Human
uaacauuacaaaugacuuuaau

SEQ ID NO: 168479 - RNA, 24 nt, Human
uaaugaauuaucuccugauugccc

SEQ ID NO: 168480 - RNA, 19 nt, Human
uacuauacagugcaaacca

SEQ ID NO: 168481 - RNA, 23 nt, Human
uauacaagaaaaaaauugccauc

SEQ ID NO: 168482 - RNA, 21 nt, Human
uccauccauauacaugcauag

SEQ ID NO: 168483 - RNA, 19 nt, Human
ugagacagagcugcaucag

SEQ ID NO: 168484 - RNA, 25 nt, Human
ugcaaacagagccugauuauccaag

SEQ ID NO: 168485 - RNA, 19 nt, Human
uggcaccaauaauacacuu

SEQ ID NO: 168486 - RNA, 21 nt, Human
uguauuuagaacaucuuugca

SEQ ID NO: 168487 - RNA, 22 nt, Human
uuaaauagaucuuauauaugaa

SEQ ID NO: 168488 - RNA, 24 nt, Human
uuuagacugugccuuucaaaagau

SEQ ID NO: 168489 - RNA, 19 nt, Human
agccggccucccgggaccc

SEQ ID NO: 168490 - RNA, 18 nt, Human
aggagaaggaaauccggc

SEQ ID NO: 168491 - RNA, 19 nt, Human
cagcaguguuucuagagug

SEQ ID NO: 168492 - RNA, 22 nt, Human
ccaaccaccacggcgggguaaa

SEQ ID NO: 168493 - RNA, 23 nt, Human
ccaggagaaggaaauccggcccc

SEQ ID NO: 168494 - RNA, 21 nt, Human
cucccgggacccgcgccugug

SEQ ID NO: 168495 - RNA, 18 nt, Human
cucucucaaucucacuaa

SEQ ID NO: 168496 - RNA, 19 nt, Human
gcgcccuccaaccaccacg

SEQ ID NO: 168497 - RNA, 18 nt, Human
uacugcgcgcccuccaac

SEQ ID NO: 168498 - RNA, 19 nt, Human
ucuagagugcacugaacca

SEQ ID NO: 168499 - RNA, 18 nt, Human
ugugcugcugcucuacug

SEQ ID NO: 168500 - RNA, 24 nt, Human
aagaaagagcuguggucaguggca

SEQ ID NO: 168501 - RNA, 19 nt, Human
accccagcccucacuccac

SEQ ID NO: 168502 - RNA, 23 nt, Human
agacaggcagggagugggaaugg

SEQ ID NO: 168503 - RNA, 21 nt, Human
agagaagcaaacuaucuugag

SEQ ID NO: 168504 - RNA, 19 nt, Human
agagcuguggucaguggca

SEQ ID NO: 168505 - RNA, 21 nt, Human
agcccaggaguggagccuggg

SEQ ID NO: 168506 - RNA, 19 nt, Human
aggcagggagugggaaugg

SEQ ID NO: 168507 - RNA, 23 nt, Human
agggagugggaauggagcccagg

SEQ ID NO: 168508 - RNA, 21 nt, Human
auggagcccaggaguggagcc

SEQ ID NO: 168509 - RNA, 22 nt, Human
auggagcccaggaguggagccu

SEQ ID NO: 168510 - RNA, 23 nt, Human
auggagcccaggaguggagccug

SEQ ID NO: 168511 - RNA, 19 nt, Human
cagcacagaugagggccau

SEQ ID NO: 168512 - RNA, 23 nt, Human
cccagcccucacuccaccuucuc

SEQ ID NO: 168513 - RNA, 22 nt, Human
ccccagcccucacuccaccuuc

SEQ ID NO: 168514 - RNA, 23 nt, Human
cccgaccccagcccucacuccac

SEQ ID NO: 168515 - RNA, 20 nt, Human
cccugaagaaagagcugugg

SEQ ID NO: 168516 - RNA, 20 nt, Human
cccuugccuuauuccagggg

SEQ ID NO: 168517 - RNA, 20 nt, Human
ccucacuccaccuucuccuu

SEQ ID NO: 168518 - RNA, 21 nt, Human
ccucacuccaccuucuccuug

SEQ ID NO: 168519 - RNA, 25 nt, Human
ccucacuccaccuucuccuuggccu

SEQ ID NO: 168520 - RNA, 18 nt, Human
ccugggagaggagguggc

SEQ ID NO: 168521 - RNA, 22 nt, Human
cgucuggcucaggcuucugcuc

SEQ ID NO: 168522 - RNA, 22 nt, Human
cgucuggcucaggcuucugcuc

SEQ ID NO: 168523 - RNA, 18 nt, Human
cucugcucuacacucccc

SEQ ID NO: 168524 - RNA, 18 nt, Human
cucugcucuacacucccc

SEQ ID NO: 168525 - RNA, 20 nt, Human
cuguacucucagggaauacc

SEQ ID NO: 168526 - RNA, 20 nt, Human
gaaggccacucagcaguuaa

SEQ ID NO: 168527 - RNA, 18 nt, Human
gacagcugugguuuagug

SEQ ID NO: 168528 - RNA, 18 nt, Human
gaccacccaaguucaggc

SEQ ID NO: 168529 - RNA, 19 nt, Human
gaccauggagcaggaacca

SEQ ID NO: 168530 - RNA, 19 nt, Human
gaccccagcccucacucca

SEQ ID NO: 168531 - RNA, 24 nt, Human
ggagacaggcagggagugggaaug

SEQ ID NO: 168532 - RNA, 25 nt, Human
ggagcccaggaguggagccugggau

SEQ ID NO: 168533 - RNA, 24 nt, Human
ggagcuguggggcugaacagggca

SEQ ID NO: 168534 - RNA, 22 nt, Human
ucagcacagaugagggccaugc

SEQ ID NO: 168535 - RNA, 23 nt, Human
ucaguuccugcgggaacaaaccc

SEQ ID NO: 168536 - RNA, 18 nt, Human
ucaguuccugggagagga

SEQ ID NO: 168537 - RNA, 20 nt, Human
ucccgaccccagcccucacu

SEQ ID NO: 168538 - RNA, 20 nt, Human
ucccugggagaggagguggc

SEQ ID NO: 168539 - RNA, 21 nt, Human
ucuguacucucagggaauacc

SEQ ID NO: 168540 - RNA, 22 nt, Human
ucugucccugggagaggaggug

SEQ ID NO: 168541 - RNA, 29 nt, Human
uggagcccaggaguggagccugggauugg

SEQ ID NO: 168542 - RNA, 26 nt, Human
ugggaauggagcccaggaguggagcc

SEQ ID NO: 168543 - RNA, 21 nt, Human
ugggagcuguggggcugaaca

SEQ ID NO: 168544 - RNA, 19 nt, Human
ugggauugggcgaaggcca

SEQ ID NO: 168545 - RNA, 22 nt, Human
ugggugcggccaacacacagug

SEQ ID NO: 168546 - RNA, 23 nt, Human
ugucagaggcccgaccauggagc

SEQ ID NO: 168547 - RNA, 24 nt, Human
ugucagaggcccgaccauggagca

SEQ ID NO: 168548 - RNA, 22 nt, Human
ugucccgaccccagcccucacu

SEQ ID NO: 168549 - RNA, 22 nt, Human
ugugguuuaguggccuaggaga

SEQ ID NO: 168550 - RNA, 22 nt, Human
uucaaccugucccgaccccagc

SEQ ID NO: 168551 - RNA, 19 nt, Human
uuggguucaguuccuggga

SEQ ID NO: 168552 - RNA, 19 nt, Human
uuuccagguaucagaaggu

SEQ ID NO: 168553 - RNA, 18 nt, Human
uuuggccuuugcccccug

SEQ ID NO: 168554 - RNA, 21 nt, Human
aaccuccguugcugcugggag

SEQ ID NO: 168555 - RNA, 20 nt, Human
accauggagcagcaacagac

SEQ ID NO: 168556 - RNA, 23 nt, Human
accuccguugcugcugggagcau

SEQ ID NO: 168557 - RNA, 18 nt, Human
agacugggugacagaggg

SEQ ID NO: 168558 - RNA, 20 nt, Human
agccugguuauccaagcuga

SEQ ID NO: 168559 - RNA, 22 nt, Human
aggcaauagauccaggccccua

SEQ ID NO: 168560 - RNA, 19 nt, Human
caggccccuaggcuguccc

SEQ ID NO: 168561 - RNA, 20 nt, Human
caggcggagcugaaccuccg

SEQ ID NO: 168562 - RNA, 23 nt, Human
cccuaggcuguccccacagccuc

SEQ ID NO: 168563 - RNA, 25 nt, Human
cuaaguaggcaauagauccaggccc

SEQ ID NO: 168564 - RNA, 24 nt, Human
cuguccccacagccucugucuucg

SEQ ID NO: 168565 - RNA, 25 nt, Human
cugucccugcaggcggagcugaacc

SEQ ID NO: 168566 - RNA, 18 nt, Human
gagcagcaacagacuggg

SEQ ID NO: 168567 - RNA, 23 nt, Human
gagcugaaccuccguugcugcug

SEQ ID NO: 168568 - RNA, 19 nt, Human
gagggcagguagucuggga

SEQ ID NO: 168569 - RNA, 20 nt, Human
gcugaaccuccguugcugcu

SEQ ID NO: 168570 - RNA, 25 nt, Human
gcugaaccuccguugcugcugggac

SEQ ID NO: 168571 - RNA, 18 nt, Human
ggagcugagcugagccca

SEQ ID NO: 168572 - RNA, 21 nt, Human
gggagcugagcugagcccagc

SEQ ID NO: 168573 - RNA, 23 nt, Human
guaggcaauagauccaggccccu

SEQ ID NO: 168574 - RNA, 19 nt, Human
ucuaaguaggcaauagauc

SEQ ID NO: 168575 - RNA, 22 nt, Human
ucucuaaguaggcaauagaucc

SEQ ID NO: 168576 - RNA, 23 nt, Human
uuagaaaacagucuguuuauuag

SEQ ID NO: 168577 - RNA, 22 nt, Human
aaaaaaaaaaauggaaccgguc

SEQ ID NO: 168578 - RNA, 22 nt, Human
accuuucaucaugcucuuaaca

SEQ ID NO: 168579 - RNA, 26 nt, Human
agccgcgcuaacggccaacggccgca

SEQ ID NO: 168580 - RNA, 24 nt, Human
caccaauagagagcagacauucca

SEQ ID NO: 168581 - RNA, 19 nt, Human
caggguacgcuccgcgcgc

SEQ ID NO: 168582 - RNA, 20 nt, Human
ccgaagccgcgcuaacggcc

SEQ ID NO: 168583 - RNA, 21 nt, Human
cuguaaugaaacugaguguag

SEQ ID NO: 168584 - RNA, 18 nt, Human
uaaaaaauaucugcagug

SEQ ID NO: 168585 - RNA, 20 nt, Human
uaaaucuuccacacaugggc

SEQ ID NO: 168586 - RNA, 24 nt, Human
uaguaaaaugaaaauuacuuuuaa

SEQ ID NO: 168587 - RNA, 24 nt, Human
ucauggguuccuucccuguaauga

SEQ ID NO: 168588 - RNA, 20 nt, Human
uccaagacaaccgccgaagc

SEQ ID NO: 168589 - RNA, 21 nt, Human
uccaagacaaccgccgaagcc

SEQ ID NO: 168590 - RNA, 21 nt, Human
uccgcgcgcgggcuacgcggc

SEQ ID NO: 168591 - RNA, 23 nt, Human
uccgcgcgcgggcuacgcggccg

SEQ ID NO: 168592 - RNA, 18 nt, Human
uccucuguccuuguuaau

SEQ ID NO: 168593 - RNA, 21 nt, Human
uggguuccuucccuguaauga

SEQ ID NO: 168594 - RNA, 22 nt, Human
uugacaccuuucaucaugcucu

SEQ ID NO: 168595 - RNA, 24 nt, Human
aagagaaaagagacacagacccag

SEQ ID NO: 168596 - RNA, 22 nt, Human
aaguccuugaggcccacagccu

SEQ ID NO: 168597 - RNA, 18 nt, Human
acacagacccaggccugg

SEQ ID NO: 168598 - RNA, 20 nt, Human
agaaaagagacacagaccca

SEQ ID NO: 168599 - RNA, 24 nt, Human
agaacacacuauugccaggaacac

SEQ ID NO: 168600 - RNA, 24 nt, Human
agacacagacccaggccuggcuca

SEQ ID NO: 168601 - RNA, 23 nt, Human
aggggccgaggggcggagacagg

SEQ ID NO: 168602 - RNA, 23 nt, Human
aggugggcgcugugaagcagagc

SEQ ID NO: 168603 - RNA, 22 nt, Human
auaaaauaaaaauauaaauauc

SEQ ID NO: 168604 - RNA, 21 nt, Human
auaagguccucccuaggucua

SEQ ID NO: 168605 - RNA, 19 nt, Human
cacacuauugccaggaaca

SEQ ID NO: 168606 - RNA, 19 nt, Human
caccagcucgggcaguggc

SEQ ID NO: 168607 - RNA, 24 nt, Human
cagaccaccucaacaaugcaugau

SEQ ID NO: 168608 - RNA, 20 nt, Human
cagacccaggccuggcucaa

SEQ ID NO: 168609 - RNA, 21 nt, Human
caguugcucgcugcagaugcg

SEQ ID NO: 168610 - RNA, 19 nt, Human
cauuacaaugaacauugau

SEQ ID NO: 168611 - RNA, 18 nt, Human
ccgcggccgccggcucag

SEQ ID NO: 168612 - RNA, 19 nt, Human
ccggcugccuccccuuccc

SEQ ID NO: 168613 - RNA, 23 nt, Human
cggcugccuccccuucccugccc

SEQ ID NO: 168614 - RNA, 20 nt, Human
cucaagguagaaaaaaauaa

SEQ ID NO: 168615 - RNA, 22 nt, Human
cucaagguagaaaaaaauaaaa

SEQ ID NO: 168616 - RNA, 25 nt, Human
cucaagguagaaaaaaauaaaauaa

SEQ ID NO: 168617 - RNA, 24 nt, Human
cucccuaggucuacaggaacccuc

SEQ ID NO: 168618 - RNA, 18 nt, Human
cugugaagcagagcuggg

SEQ ID NO: 168619 - RNA, 23 nt, Human
gagcacggucacugcucguucgc

SEQ ID NO: 168620 - RNA, 19 nt, Human
gaguccacacauggaugcu

SEQ ID NO: 168621 - RNA, 22 nt, Human
gcaccagguuaauuccaauaau

SEQ ID NO: 168622 - RNA, 19 nt, Human
ggagaaagagaaaagagac

SEQ ID NO: 168623 - RNA, 18 nt, Human
gggccgaggggcggagac

SEQ ID NO: 168624 - RNA, 18 nt, Human
gggugccggcugccuccc

SEQ ID NO: 168625 - RNA, 23 nt, Human
uaaaaauauaaauaucugagaau

SEQ ID NO: 168626 - RNA, 27 nt, Human
uaaaauaaaaauauaaauaucugagaa

SEQ ID NO: 168627 - RNA, 25 nt, Human
uacacacuccaugcguuuugcuaca

SEQ ID NO: 168628 - RNA, 25 nt, Human
ucaaaagaccucaagguagaaaaaa

SEQ ID NO: 168629 - RNA, 28 nt, Human
ucagaacacacuauugccaggaacacag

SEQ ID NO: 168630 - RNA, 21 nt, Human
ucaguugcucgcugcagaugc

SEQ ID NO: 168631 - RNA, 18 nt, Human
uccaauaaugaacccaau

SEQ ID NO: 168632 - RNA, 25 nt, Human
ucgcugcgccgcggccgccggcuca

SEQ ID NO: 168633 - RNA, 18 nt, Human
ucuccggaagagguaagg

SEQ ID NO: 168634 - RNA, 21 nt, Human
ucuuggaacaauaagcaaaca

SEQ ID NO: 168635 - RNA, 20 nt, Human
ugaagaaaaacuacaguaca

SEQ ID NO: 168636 - RNA, 23 nt, Human
ugaagcagagcuggguaggagca

SEQ ID NO: 168637 - RNA, 21 nt, Human
uggaugcuuucaaguccuuga

SEQ ID NO: 168638 - RNA, 26 nt, Human
uggcacuugugggugccggcugccuc

SEQ ID NO: 168639 - RNA, 19 nt, Human
ugggcgcugugaagcagag

SEQ ID NO: 168640 - RNA, 25 nt, Human
ugucagaacauucagaccaccucaa

SEQ ID NO: 168641 - RNA, 28 nt, Human
uuccaauaaugaacccaauaggguaccc

SEQ ID NO: 168642 - RNA, 18 nt, Human
uucgcugcgccgcggccg

SEQ ID NO: 168643 - RNA, 22 nt, Human
uugaagaaaaacuacaguacau

SEQ ID NO: 168644 - RNA, 22 nt, Human
uugauguugaagaaaaacuaca

SEQ ID NO: 168645 - RNA, 22 nt, Human
uugugggugccggcugccuccc

SEQ ID NO: 168646 - RNA, 20 nt, Human
uuucauggaaaacuguuaau

SEQ ID NO: 168647 - RNA, 24 nt, Human
aaaaaaaagauuaaugaaauuuca

SEQ ID NO: 168648 - RNA, 25 nt, Human
aaaaaaaagauuaaugaaauuucau

SEQ ID NO: 168649 - RNA, 22 nt, Human
aaaaaauaaaaucucauguccc

SEQ ID NO: 168650 - RNA, 21 nt, Human
aaacacaaggaauccuccugu

SEQ ID NO: 168651 - RNA, 19 nt, Human
aaagaagaccaaaaaaagu

SEQ ID NO: 168652 - RNA, 25 nt, Human
aaccaggaaagggauaaauagcuaa

SEQ ID NO: 168653 - RNA, 22 nt, Human
aagaaucuuuccaaaaacuuuc

SEQ ID NO: 168654 - RNA, 25 nt, Human
aagauuaaugaaauuucauaacccc

SEQ ID NO: 168655 - RNA, 19 nt, Human
aagcucggggaaggagcaa

SEQ ID NO: 168656 - RNA, 24 nt, Human
aauaaagaagaccaaaaaaaguaa

SEQ ID NO: 168657 - RNA, 23 nt, Human
aaucucauguccccaacgaaccc

SEQ ID NO: 168658 - RNA, 23 nt, Human
aaucuggccaacucauuucacag

SEQ ID NO: 168659 - RNA, 18 nt, Human
aaugaagaaauaucugga

SEQ ID NO: 168660 - RNA, 22 nt, Human
acacacacacauccauauauaa

SEQ ID NO: 168661 - RNA, 23 nt, Human
acagaaacaagaggcaggacaaa

SEQ ID NO: 168662 - RNA, 20 nt, Human
acagccuaccucccaccccc

SEQ ID NO: 168663 - RNA, 20 nt, Human
acaguauaaaucacuccagc

SEQ ID NO: 168664 - RNA, 23 nt, Human
accccaaaaaaagggugggugug

SEQ ID NO: 168665 - RNA, 21 nt, Human
acccccaagaagaaccacaac

SEQ ID NO: 168666 - RNA, 19 nt, Human
acccccgucccuucauccu

SEQ ID NO: 168667 - RNA, 26 nt, Human
acccgccccccuccccacccaucccc

SEQ ID NO: 168668 - RNA, 23 nt, Human
accuaggccgaggcugcagaagc

SEQ ID NO: 168669 - RNA, 21 nt, Human
acgcugaggucgccgggaagc

SEQ ID NO: 168670 - RNA, 24 nt, Human
acggucuccuccacgcguccggcg

SEQ ID NO: 168671 - RNA, 20 nt, Human
agaaaagacagagggagagg

SEQ ID NO: 168672 - RNA, 26 nt, Human
agaaaaugaagaaauaucuggaagaa

SEQ ID NO: 168673 - RNA, 25 nt, Human
agaaaggagacaagugaaaacgguc

SEQ ID NO: 168674 - RNA, 22 nt, Human
agaaguuggcguccuaggcugg

SEQ ID NO: 168675 - RNA, 21 nt, Human
agacaagugaaaacggucaga

SEQ ID NO: 168676 - RNA, 22 nt, Human
agcccgagacaggcugagccag

SEQ ID NO: 168677 - RNA, 21 nt, Human
agcugcaccccacaaucuggc

SEQ ID NO: 168678 - RNA, 25 nt, Human
aggaggccagaaauuccaaucagag

SEQ ID NO: 168679 - RNA, 24 nt, Human
aggaugccgcuguaccucuugaaa

SEQ ID NO: 168680 - RNA, 18 nt, Human
agggaugggcggacucgg

SEQ ID NO: 168681 - RNA, 19 nt, Human
aggggaggaagaaggggga

SEQ ID NO: 168682 - RNA, 18 nt, Human
agggugggugugggagac

SEQ ID NO: 168683 - RNA, 23 nt, Human
aguaauaaagaagaccaaaaaaa

SEQ ID NO: 168684 - RNA, 25 nt, Human
aguccaaaaauauuggggguuuggg

SEQ ID NO: 168685 - RNA, 22 nt, Human
caaaauacaaaaagagaaccac

SEQ ID NO: 168686 - RNA, 24 nt, Human
cacacacacacauccauauauaau

SEQ ID NO: 168687 - RNA, 26 nt, Human
cacacacacacauccauauauaauau

SEQ ID NO: 168688 - RNA, 21 nt, Human
cacacacccacuuugucucuu

SEQ ID NO: 168689 - RNA, 21 nt, Human
cacacucucacacucgcaccc

SEQ ID NO: 168690 - RNA, 21 nt, Human
cacagccccucacugccuucc

SEQ ID NO: 168691 - RNA, 29 nt, Human
cacagccuaccucccacccccgucccuuu

SEQ ID NO: 168692 - RNA, 21 nt, Human
cacaggcggaggagaaaagac

SEQ ID NO: 168693 - RNA, 18 nt, Human
caccauggaaauguggga

SEQ ID NO: 168694 - RNA, 18 nt, Human
caccccacaaucuggcca

SEQ ID NO: 168695 - RNA, 20 nt, Human
caccccacagccuaccuccc

SEQ ID NO: 168696 - RNA, 21 nt, Human
cacccccuguccccaaaguca

SEQ ID NO: 168697 - RNA, 23 nt, Human
cacccccuguccccaaagucacc

SEQ ID NO: 168698 - RNA, 25 nt, Human
cacccccuguccccaaagucaccag

SEQ ID NO: 168699 - RNA, 20 nt, Human
cacccgccccccuccccacc

SEQ ID NO: 168700 - RNA, 24 nt, Human
cacgcacacacacacauccauaua

SEQ ID NO: 168701 - RNA, 18 nt, Human
cagcuggagcauuggcag

SEQ ID NO: 168702 - RNA, 22 nt, Human
cagcuggggguguccauccccu

SEQ ID NO: 168703 - RNA, 21 nt, Human
caggacaaaacacaaggaauc

SEQ ID NO: 168704 - RNA, 18 nt, Human
cauccccuucccaccccc

SEQ ID NO: 168705 - RNA, 20 nt, Human
ccaaggcuauggccggguug

SEQ ID NO: 168706 - RNA, 18 nt, Human
ccagcccaccccacagcc

SEQ ID NO: 168707 - RNA, 20 nt, Human
ccagcccaccccacagccua

SEQ ID NO: 168708 - RNA, 20 nt, Human
ccauggucagggaugggcgg

SEQ ID NO: 168709 - RNA, 28 nt, Human
cccaagaagaaccacaacaaucaaguuu

SEQ ID NO: 168710 - RNA, 22 nt, Human
cccacaaucuggccaacucauu

SEQ ID NO: 168711 - RNA, 21 nt, Human
cccauccccagagcuuggguu

SEQ ID NO: 168712 - RNA, 23 nt, Human
ccccacccagcugcaccccacaa

SEQ ID NO: 168713 - RNA, 25 nt, Human
ccccagagcuuggguugacgucaga

SEQ ID NO: 168714 - RNA, 22 nt, Human
ccccccagaggugugcugcccc

SEQ ID NO: 168715 - RNA, 19 nt, Human
ccccccuccccacccaucc

SEQ ID NO: 168716 - RNA, 18 nt, Human
ccccgucccuucauccuc

SEQ ID NO: 168717 - RNA, 20 nt, Human
ccccuccccacccauccccc

SEQ ID NO: 168718 - RNA, 19 nt, Human
ccccuucccacccccuguc

SEQ ID NO: 168719 - RNA, 19 nt, Human
cccgagacaggcugagcca

SEQ ID NO: 168720 - RNA, 20 nt, Human
cccucagucucacucacaaa

SEQ ID NO: 168721 - RNA, 18 nt, Human
cccuccccacccaucccc

SEQ ID NO: 168722 - RNA, 21 nt, Human
cccugggcacaggggggcccc

SEQ ID NO: 168723 - RNA, 19 nt, Human
ccgagacaggcugagccag

SEQ ID NO: 168724 - RNA, 25 nt, Human
ccggggcacagaaacaagaggcagg

SEQ ID NO: 168725 - RNA, 21 nt, Human
ccguggccguagcucugaguc

SEQ ID NO: 168726 - RNA, 22 nt, Human
ccuaggccgaggcugcagaagc

SEQ ID NO: 168727 - RNA, 18 nt, Human
ccucacacaggacugccc

SEQ ID NO: 168728 - RNA, 19 nt, Human
ccuccuccucuuccaaguc

SEQ ID NO: 168729 - RNA, 18 nt, Human
ccuccuucuccuccuccu

SEQ ID NO: 168730 - RNA, 20 nt, Human
ccuccuucuccuccuccucc

SEQ ID NO: 168731 - RNA, 24 nt, Human
ccugaaaucagagcggcccaacga

SEQ ID NO: 168732 - RNA, 21 nt, Human
ccugcugccugaaaucagagc

SEQ ID NO: 168733 - RNA, 18 nt, Human
ccuggagaggaugugagg

SEQ ID NO: 168734 - RNA, 23 nt, Human
ccugugaccacgcugaggucgcc

SEQ ID NO: 168735 - RNA, 25 nt, Human
cgaaggugggcgucacccgcccccc

SEQ ID NO: 168736 - RNA, 20 nt, Human
cgaauucccuuuaagggggg

SEQ ID NO: 168737 - RNA, 18 nt, Human
cgccccccuccccaccca

SEQ ID NO: 168738 - RNA, 23 nt, Human
cgcgcacgcacacacacacaucc

SEQ ID NO: 168739 - RNA, 24 nt, Human
cgcgcacgcacacacacacaucca

SEQ ID NO: 168740 - RNA, 26 nt, Human
cgcucacacacucacgcgcacgcaca

SEQ ID NO: 168741 - RNA, 24 nt, Human
cggaggagaaaagacagagggaga

SEQ ID NO: 168742 - RNA, 20 nt, Human
cggcaucacagcagccccug

SEQ ID NO: 168743 - RNA, 22 nt, Human
cgucagagagccaacagucagg

SEQ ID NO: 168744 - RNA, 23 nt, Human
cuccaaaagaaaaugaagaaaua

SEQ ID NO: 168745 - RNA, 22 nt, Human
cuccguaggacccaggggcgag

SEQ ID NO: 168746 - RNA, 20 nt, Human
cuccuccuccuccuccucuu

SEQ ID NO: 168747 - RNA, 19 nt, Human
cuccuccuccuccucuucc

SEQ ID NO: 168748 - RNA, 22 nt, Human
cuccuccuucuccuccuccucc

SEQ ID NO: 168749 - RNA, 21 nt, Human
cugaggguccugaggagagag

SEQ ID NO: 168750 - RNA, 19 nt, Human
cugggcaccccaaaaaaag

SEQ ID NO: 168751 - RNA, 19 nt, Human
cuuccccucucucuccucc

SEQ ID NO: 168752 - RNA, 19 nt, Human
cuucuccuccuccuccucc

SEQ ID NO: 168753 - RNA, 21 nt, Human
cuuugucucuuccccucucuc

SEQ ID NO: 168754 - RNA, 29 nt, Human
gaaacaagaggcaggacaaaagggacccc

SEQ ID NO: 168755 - RNA, 21 nt, Human
gaacccagagucagacgacag

SEQ ID NO: 168756 - RNA, 20 nt, Human
gaagaaucuuuccaaaaacu

SEQ ID NO: 168757 - RNA, 19 nt, Human
gaaucagcuucagcuacgg

SEQ ID NO: 168758 - RNA, 24 nt, Human
gacaaaacacaaggaauccuccug

SEQ ID NO: 168759 - RNA, 18 nt, Human
gagagagagagaggccac

SEQ ID NO: 168760 - RNA, 22 nt, Human
gagccaaaaccauggucaggga

SEQ ID NO: 168761 - RNA, 22 nt, Human
gaggaugugaggggccaagggg

SEQ ID NO: 168762 - RNA, 19 nt, Human
gaggcaggacaaaacacaa

SEQ ID NO: 168763 - RNA, 20 nt, Human
gaugcaaaauacaaaaagag

SEQ ID NO: 168764 - RNA, 26 nt, Human
gcaggacaaaacacaaggaauccucc

SEQ ID NO: 168765 - RNA, 19 nt, Human
gccaaggggugggagaagu

SEQ ID NO: 168766 - RNA, 19 nt, Human
gcccagaguaaagaggauc

SEQ ID NO: 168767 - RNA, 19 nt, Human
gccccccuccccacccauc

SEQ ID NO: 168768 - RNA, 21 nt, Human
gccccccuccccacccauccc

SEQ ID NO: 168769 - RNA, 24 nt, Human
gcgcacgcacacacacacauccau

SEQ ID NO: 168770 - RNA, 22 nt, Human
ggaaaccaaccugggcacccca

SEQ ID NO: 168771 - RNA, 25 nt, Human
ggaagaagggggauggacggaaggg

SEQ ID NO: 168772 - RNA, 19 nt, Human
ggaccuuaaagaaaaaggc

SEQ ID NO: 168773 - RNA, 18 nt, Human
ggacggcaucacagcagc

SEQ ID NO: 168774 - RNA, 21 nt, Human
ggagacaagugaaaacgguca

SEQ ID NO: 168775 - RNA, 21 nt, Human
ggagagccaaaaccaugguca

SEQ ID NO: 168776 - RNA, 24 nt, Human
ggagaggaugugaggggccaaggg

SEQ ID NO: 168777 - RNA, 21 nt, Human
ggaggagccagggaggccaca

SEQ ID NO: 168778 - RNA, 24 nt, Human
ggcacagaaacaagaggcaggaca

SEQ ID NO: 168779 - RNA, 20 nt, Human
ggcgagggagggguugcucc

SEQ ID NO: 168780 - RNA, 21 nt, Human
ggcggggugggagagccaaaa

SEQ ID NO: 168781 - RNA, 18 nt, Human
ggcgugguccaccccccg

SEQ ID NO: 168782 - RNA, 18 nt, Human
gggaguaauaaagaagac

SEQ ID NO: 168783 - RNA, 19 nt, Human
gggaugggcggacucgggc

SEQ ID NO: 168784 - RNA, 23 nt, Human
gggccaacgugaccuaggccgag

SEQ ID NO: 168785 - RNA, 19 nt, Human
gggccgagacgaucagaaa

SEQ ID NO: 168786 - RNA, 26 nt, Human
ggggaaaccaaccugggcaccccaaa

SEQ ID NO: 168787 - RNA, 24 nt, Human
ggggcugauuucgggguggggagc

SEQ ID NO: 168788 - RNA, 24 nt, Human
ggggggcucacuucugcccagagu

SEQ ID NO: 168789 - RNA, 23 nt, Human
ggugggugugggagacauugggu

SEQ ID NO: 168790 - RNA, 21 nt, Human
guacagcaugggguagggggg

SEQ ID NO: 168791 - RNA, 23 nt, Human
guccccaacgaacccagagucag

SEQ ID NO: 168792 - RNA, 23 nt, Human
guccugaggagagagagagaggc

SEQ ID NO: 168793 - RNA, 18 nt, Human
gucgccgggaagccaagg

SEQ ID NO: 168794 - RNA, 18 nt, Human
gugcugccccacccagcu

SEQ ID NO: 168795 - RNA, 21 nt, Human
gugggcgucacccgccccccu

SEQ ID NO: 168796 - RNA, 18 nt, Human
guucugucacccccuuga

SEQ ID NO: 168797 - RNA, 20 nt, Human
uaaaaaauauaaauuugccu

SEQ ID NO: 168798 - RNA, 18 nt, Human
uacagcaugggguagggg

SEQ ID NO: 168799 - RNA, 21 nt, Human
uagaagcaguuuccaauucaa

SEQ ID NO: 168800 - RNA, 23 nt, Human
uaggaggccagaaauuccaauca

SEQ ID NO: 168801 - RNA, 19 nt, Human
ucacacaggacugcccgaa

SEQ ID NO: 168802 - RNA, 26 nt, Human
ucacacucucacacucgcacccagaa

SEQ ID NO: 168803 - RNA, 22 nt, Human
ucacagccccucacugccuucc

SEQ ID NO: 168804 - RNA, 28 nt, Human
ucacgcgcacgcacacacacacauccau

SEQ ID NO: 168805 - RNA, 24 nt, Human
ucacucacaaaaaauaaaaucuca

SEQ ID NO: 168806 - RNA, 23 nt, Human
ucauaaagaaauccucaugagau

SEQ ID NO: 168807 - RNA, 24 nt, Human
uccaagucucucucccccaugugu

SEQ ID NO: 168808 - RNA, 23 nt, Human
uccacgcguccggcgggucccac

SEQ ID NO: 168809 - RNA, 20 nt, Human
ucccacccccgucccuucau

SEQ ID NO: 168810 - RNA, 18 nt, Human
ucccacccccugucccca

SEQ ID NO: 168811 - RNA, 20 nt, Human
ucccacccccuguccccaaa

SEQ ID NO: 168812 - RNA, 19 nt, Human
uccccaacgaacccagagu

SEQ ID NO: 168813 - RNA, 21 nt, Human
uccccagagcuuggguugacg

SEQ ID NO: 168814 - RNA, 24 nt, Human
ucccugggcacaggggggccccug

SEQ ID NO: 168815 - RNA, 23 nt, Human
uccuccaaaagaaaaugaagaaa

SEQ ID NO: 168816 - RNA, 22 nt, Human
uccuccuccuccuccucuucca

SEQ ID NO: 168817 - RNA, 22 nt, Human
ucggggauucauugaauugugg

SEQ ID NO: 168818 - RNA, 19 nt, Human
ucuccccggaaaaaaaaaa

SEQ ID NO: 168819 - RNA, 23 nt, Human
ucuccuccuccuccuccucuucc

SEQ ID NO: 168820 - RNA, 22 nt, Human
ucucuggagaggacuccagccc

SEQ ID NO: 168821 - RNA, 19 nt, Human
ucuggaagaaucuuuccaa

SEQ ID NO: 168822 - RNA, 18 nt, Human
ugaaauuucauaaccccc

SEQ ID NO: 168823 - RNA, 18 nt, Human
ugaagaaauaucuggaag

SEQ ID NO: 168824 - RNA, 19 nt, Human
ugaccacgcugaggucgcc

SEQ ID NO: 168825 - RNA, 22 nt, Human
ugaggagagagagagaggccac

SEQ ID NO: 168826 - RNA, 23 nt, Human
ugaggagagagagagaggccacg

SEQ ID NO: 168827 - RNA, 18 nt, Human
ugaggggccaaggggugg

SEQ ID NO: 168828 - RNA, 21 nt, Human
ugcugccccacccagcugcac

SEQ ID NO: 168829 - RNA, 21 nt, Human
uggcaggagcaagcccugcuc

SEQ ID NO: 168830 - RNA, 20 nt, Human
uggcagggggcagggucuug

SEQ ID NO: 168831 - RNA, 18 nt, Human
uggcgcaguggccgcaga

SEQ ID NO: 168832 - RNA, 18 nt, Human
ugggagggaguggcuaga

SEQ ID NO: 168833 - RNA, 19 nt, Human
ugggagggaguggcuagac

SEQ ID NO: 168834 - RNA, 22 nt, Human
ugggagggaguggcuagacagu

SEQ ID NO: 168835 - RNA, 24 nt, Human
ugggaguccccggugagcugagcg

SEQ ID NO: 168836 - RNA, 24 nt, Human
ugggaucaauaagcuaaggucggg

SEQ ID NO: 168837 - RNA, 19 nt, Human
ugggcaccccaaaaaaagg

SEQ ID NO: 168838 - RNA, 19 nt, Human
uggggaaguaaggugcaag

SEQ ID NO: 168839 - RNA, 25 nt, Human
uggggaaguaaggugcaaguccccu

SEQ ID NO: 168840 - RNA, 18 nt, Human
uggggggaugagauuauu

SEQ ID NO: 168841 - RNA, 24 nt, Human
uggggguaccaaagccucagcucu

SEQ ID NO: 168842 - RNA, 18 nt, Human
ugucucuuccccucucuc

SEQ ID NO: 168843 - RNA, 21 nt, Human
ugugaggggccaagggguggg

SEQ ID NO: 168844 - RNA, 22 nt, Human
uucauaacccccaagaagaacc

SEQ ID NO: 168845 - RNA, 24 nt, Human
uuccgcgugucccugccguggccg

SEQ ID NO: 168846 - RNA, 19 nt, Human
uuccuuguugagccucucu

SEQ ID NO: 168847 - RNA, 20 nt, Human
uuccuuguugagccucucug

SEQ ID NO: 168848 - RNA, 19 nt, Human
uucucgguucugucacccc

SEQ ID NO: 168849 - RNA, 21 nt, Human
agcuggaccggugggggaagg

SEQ ID NO: 168850 - RNA, 19 nt, Human
aggguggcaucugcaggga

SEQ ID NO: 168851 - RNA, 19 nt, Human
cggggcuggcggcucugcg

SEQ ID NO: 168852 - RNA, 18 nt, Human
gggcuggcggcucugcgg

SEQ ID NO: 168853 - RNA, 20 nt, Human
uggcaucugcagggaguagg

SEQ ID NO: 168854 - RNA, 22 nt, Human
uggcuaggguggcaucugcagg

SEQ ID NO: 168855 - RNA, 22 nt, Human
ugggggaaggggaggagacauu

SEQ ID NO: 168856 - RNA, 22 nt, Human
uguccaggccagcuggaccggu

SEQ ID NO: 168857 - RNA, 22 nt, Human
aaaacaccgaaccaccaagacg

SEQ ID NO: 168858 - RNA, 20 nt, Human
aaacaccgaaccaccaagac

SEQ ID NO: 168859 - RNA, 21 nt, Human
aacaaaacaccgaaccaccaa

SEQ ID NO: 168860 - RNA, 22 nt, Human
aaccaccaagacgagaaaagga

SEQ ID NO: 168861 - RNA, 26 nt, Human
aaguguaaaaaucuuacauuuagaau

SEQ ID NO: 168862 - RNA, 18 nt, Human
acaaaacaccgaaccacc

SEQ ID NO: 168863 - RNA, 18 nt, Human
acaccgaaccaccaagac

SEQ ID NO: 168864 - RNA, 23 nt, Human
acaguuuuguccgagaauucgca

SEQ ID NO: 168865 - RNA, 21 nt, Human
accaccaagacgagaaaagga

SEQ ID NO: 168866 - RNA, 23 nt, Human
acgcugggggcgcugcgacugcg

SEQ ID NO: 168867 - RNA, 23 nt, Human
acuuuauaacuccugcgccgccg

SEQ ID NO: 168868 - RNA, 20 nt, Human
agacgagaaaaggagccggg

SEQ ID NO: 168869 - RNA, 18 nt, Human
aggaggggguggcggggc

SEQ ID NO: 168870 - RNA, 18 nt, Human
caaaacaccgaaccacca

SEQ ID NO: 168871 - RNA, 23 nt, Human
caaaacaccgaaccaccaagacg

SEQ ID NO: 168872 - RNA, 18 nt, Human
caagacgagaaaaggagc

SEQ ID NO: 168873 - RNA, 19 nt, Human
caccagacaaguguccuca

SEQ ID NO: 168874 - RNA, 19 nt, Human
cacccucuuccucccuacc

SEQ ID NO: 168875 - RNA, 22 nt, Human
cacccucuuccucccuacccca

SEQ ID NO: 168876 - RNA, 22 nt, Human
cagcccgggucccgggcggcag

SEQ ID NO: 168877 - RNA, 22 nt, Human
cccaggucggggguuggggggc

SEQ ID NO: 168878 - RNA, 19 nt, Human
cccgcagagccaaaaggcg

SEQ ID NO: 168879 - RNA, 23 nt, Human
cccgcagagccaaaaggcgcgcc

SEQ ID NO: 168880 - RNA, 20 nt, Human
cccugggcuccgcucggccc

SEQ ID NO: 168881 - RNA, 18 nt, Human
ccgaaccaccaagacgag

SEQ ID NO: 168882 - RNA, 22 nt, Human
ccucccuaccccaggucggggg

SEQ ID NO: 168883 - RNA, 19 nt, Human
ccucuuccucccuacccca

SEQ ID NO: 168884 - RNA, 21 nt, Human
ccuucuccucucggagcagcu

SEQ ID NO: 168885 - RNA, 18 nt, Human
cgaacaaaacaccgaacc

SEQ ID NO: 168886 - RNA, 25 nt, Human
cgaacaaaacaccgaaccaccaaga

SEQ ID NO: 168887 - RNA, 19 nt, Human
cgaccaggaacgugcggga

SEQ ID NO: 168888 - RNA, 22 nt, Human
cgcaguaaguacaaaaaaaucc

SEQ ID NO: 168889 - RNA, 22 nt, Human
cgccuggaccugagaaucucua

SEQ ID NO: 168890 - RNA, 23 nt, Human
cgggcgggcgaaucagaacgcca

SEQ ID NO: 168891 - RNA, 24 nt, Human
cggggcugccggguggcggcgacg

SEQ ID NO: 168892 - RNA, 22 nt, Human
cgucaagggagccucuagugcc

SEQ ID NO: 168893 - RNA, 19 nt, Human
cucaaauaaaaaagaauug

SEQ ID NO: 168894 - RNA, 21 nt, Human
cuuuauaacuccugcgccgcc

SEQ ID NO: 168895 - RNA, 21 nt, Human
gaaaaggagccgggauuccua

SEQ ID NO: 168896 - RNA, 24 nt, Human
gagccucuagugccuggacagggc

SEQ ID NO: 168897 - RNA, 18 nt, Human
gaggacuugaccuucucc

SEQ ID NO: 168898 - RNA, 19 nt, Human
gaggaggggguggcggggc

SEQ ID NO: 168899 - RNA, 18 nt, Human
gcagcggcgaaaaugggc

SEQ ID NO: 168900 - RNA, 24 nt, Human
gcccgggucccgggcggcaggccc

SEQ ID NO: 168901 - RNA, 19 nt, Human
gcggcggcggcggggcggc

SEQ ID NO: 168902 - RNA, 21 nt, Human
gcugccggagcugcgccgggg

SEQ ID NO: 168903 - RNA, 24 nt, Human
ggacagggcggacucccuuccccg

SEQ ID NO: 168904 - RNA, 21 nt, Human
ggcggcaggcccggccggggg

SEQ ID NO: 168905 - RNA, 24 nt, Human
gggacgggugagagucuaagaaca

SEQ ID NO: 168906 - RNA, 18 nt, Human
gucagcugaggagggggu

SEQ ID NO: 168907 - RNA, 21 nt, Human
uaaccauuuuuccuuuucaug

SEQ ID NO: 168908 - RNA, 21 nt, Human
ucccugggcuccgcucggccc

SEQ ID NO: 168909 - RNA, 22 nt, Human
ucccugggcuccgcucggcccg

SEQ ID NO: 168910 - RNA, 21 nt, Human
uccuuuucaugaaaaaguaca

SEQ ID NO: 168911 - RNA, 21 nt, Human
ucuccucucggagcagcuuuu

SEQ ID NO: 168912 - RNA, 27 nt, Human
ucucuacaccucaaaaaggcuuaguug

SEQ ID NO: 168913 - RNA, 21 nt, Human
ugaaaaaguguaaaaaucuua

SEQ ID NO: 168914 - RNA, 19 nt, Human
ugaggaggggguggcgggg

SEQ ID NO: 168915 - RNA, 20 nt, Human
ugaggaggggguggcggggc

SEQ ID NO: 168916 - RNA, 21 nt, Human
ugaggaggggguggcggggcc

SEQ ID NO: 168917 - RNA, 21 nt, Human
ugccggagcugcgccggggcu

SEQ ID NO: 168918 - RNA, 24 nt, Human
ugccggguggcggcggagucuccc

SEQ ID NO: 168919 - RNA, 22 nt, Human
uggcgcggcggcggcggggcgg

SEQ ID NO: 168920 - RNA, 25 nt, Human
uguaaacauguuaaccauuuuuccu

SEQ ID NO: 168921 - RNA, 22 nt, Human
uguauuauucuuuugaccauua

SEQ ID NO: 168922 - RNA, 20 nt, Human
uguguaaacauguuaaccau

SEQ ID NO: 168923 - RNA, 18 nt, Human
uuguauuauucuuuugac

SEQ ID NO: 168924 - RNA, 19 nt, Human
uuuauaacuccugcgccgc

SEQ ID NO: 168925 - RNA, 21 nt, Human
aaaaaaacgaagcccccaccc

SEQ ID NO: 168926 - RNA, 20 nt, Human
aaacgaagcccccacccccc

SEQ ID NO: 168927 - RNA, 18 nt, Human
aaagacccccugcuucac

SEQ ID NO: 168928 - RNA, 25 nt, Human
aaaugaggcuaguaacaccuaccuc

SEQ ID NO: 168929 - RNA, 21 nt, Human
aacaagcagcuucaacacaga

SEQ ID NO: 168930 - RNA, 20 nt, Human
aacagaguuggguugcaacc

SEQ ID NO: 168931 - RNA, 24 nt, Human
aacagcaaaaaaaaaaaaaaaaaa

SEQ ID NO: 168932 - RNA, 19 nt, Human
aacguuggggaagaaguga

SEQ ID NO: 168933 - RNA, 21 nt, Human
aacuguaaagaaucuuggccu

SEQ ID NO: 168934 - RNA, 20 nt, Human
aaggcggcgcccgggccacc

SEQ ID NO: 168935 - RNA, 21 nt, Human
aauccaacucucccauuccac

SEQ ID NO: 168936 - RNA, 20 nt, Human
aauccgcuuaauuucucccu

SEQ ID NO: 168937 - RNA, 21 nt, Human
aauccugccuucacuacuuac

SEQ ID NO: 168938 - RNA, 21 nt, Human
acccugugcucccugaagccg

SEQ ID NO: 168939 - RNA, 28 nt, Human
accucuuucucccccggccucccuccag

SEQ ID NO: 168940 - RNA, 20 nt, Human
accugggcgggccucagccc

SEQ ID NO: 168941 - RNA, 25 nt, Human
acgccgggacccacgccgccccagc

SEQ ID NO: 168942 - RNA, 18 nt, Human
acggaaggagcugaggcu

SEQ ID NO: 168943 - RNA, 28 nt, Human
agaaagaacucacccaggcuccugcaaa

SEQ ID NO: 168944 - RNA, 19 nt, Human
agagcugcgggcuagggcg

SEQ ID NO: 168945 - RNA, 25 nt, Human
agaggaaacgaacuuccuuggagaa

SEQ ID NO: 168946 - RNA, 19 nt, Human
agaggggaaaggcagaaag

SEQ ID NO: 168947 - RNA, 20 nt, Human
agccagggaaguggcggcgg

SEQ ID NO: 168948 - RNA, 22 nt, Human
aggcggcaggaccuccuccgcc

SEQ ID NO: 168949 - RNA, 21 nt, Human
aggcuucagaggaaacgaacu

SEQ ID NO: 168950 - RNA, 22 nt, Human
agggacccggcgggaacaaacc

SEQ ID NO: 168951 - RNA, 24 nt, Human
agggcggagcucccugggcggggu

SEQ ID NO: 168952 - RNA, 23 nt, Human
agugguugguggugggggauugu

SEQ ID NO: 168953 - RNA, 22 nt, Human
auggaaggcaggucugacuacu

SEQ ID NO: 168954 - RNA, 18 nt, Human
auggagcuacagaggccc

SEQ ID NO: 168955 - RNA, 21 nt, Human
caaguguugccuucaucucuc

SEQ ID NO: 168956 - RNA, 27 nt, Human
caccaaguguugccuucaucucucaaa

SEQ ID NO: 168957 - RNA, 18 nt, Human
cacccccucagugaaccc

SEQ ID NO: 168958 - RNA, 24 nt, Human
cacccccucagugaacccugaccu

SEQ ID NO: 168959 - RNA, 25 nt, Human
cacccgagcccgcacgcuuccagcc

SEQ ID NO: 168960 - RNA, 25 nt, Human
caccgggccgaagcgcagugggagc

SEQ ID NO: 168961 - RNA, 22 nt, Human
caccucuccguucagcuccgcc

SEQ ID NO: 168962 - RNA, 22 nt, Human
cacucgggcgccagccgcagcc

SEQ ID NO: 168963 - RNA, 19 nt, Human
cagaaaaaaauggaaggca

SEQ ID NO: 168964 - RNA, 20 nt, Human
cagaaacaagcagcuucaac

SEQ ID NO: 168965 - RNA, 25 nt, Human
cagaauccucaaaauagaguucuuc

SEQ ID NO: 168966 - RNA, 25 nt, Human
cagaauccucaaaauagaguucuuc

SEQ ID NO: 168967 - RNA, 18 nt, Human
cagaggcccaggauaggg

SEQ ID NO: 168968 - RNA, 21 nt, Human
cagccuugggccugggagagg

SEQ ID NO: 168969 - RNA, 20 nt, Human
caggauagggagaaagaacu

SEQ ID NO: 168970 - RNA, 23 nt, Human
caggcuccugggguuccaauccu

SEQ ID NO: 168971 - RNA, 23 nt, Human
cagggaaaaaaacgaagccccca

SEQ ID NO: 168972 - RNA, 19 nt, Human
cauaguaguuaagagcagc

SEQ ID NO: 168973 - RNA, 20 nt, Human
ccaauccugccuucacuacu

SEQ ID NO: 168974 - RNA, 24 nt, Human
ccaccccucuccgcgcggagaggc

SEQ ID NO: 168975 - RNA, 19 nt, Human
ccaggauagggagaaagaa

SEQ ID NO: 168976 - RNA, 22 nt, Human
cccagcgcggcccgccggcgcc

SEQ ID NO: 168977 - RNA, 19 nt, Human
ccccaaggcggcgcccggg

SEQ ID NO: 168978 - RNA, 22 nt, Human
ccccaagguaagggcagaaaaa

SEQ ID NO: 168979 - RNA, 18 nt, Human
ccccacccguccucuccc

SEQ ID NO: 168980 - RNA, 21 nt, Human
cccccaccuuccuggcuccca

SEQ ID NO: 168981 - RNA, 19 nt, Human
cccccuggcggcccagcuc

SEQ ID NO: 168982 - RNA, 21 nt, Human
ccccucagugaacccugaccu

SEQ ID NO: 168983 - RNA, 22 nt, Human
ccccucuccgcgcggagaggcc

SEQ ID NO: 168984 - RNA, 20 nt, Human
ccccugcuucaccucucccc

SEQ ID NO: 168985 - RNA, 21 nt, Human
cccgacacccccucagugaac

SEQ ID NO: 168986 - RNA, 22 nt, Human
cccgcagccuugggccugggag

SEQ ID NO: 168987 - RNA, 18 nt, Human
cccgccaccccucuccgc

SEQ ID NO: 168988 - RNA, 18 nt, Human
cccucgggguggcagugg

SEQ ID NO: 168989 - RNA, 21 nt, Human
cccucugggaccucugaccaa

SEQ ID NO: 168990 - RNA, 19 nt, Human
cccugcccgacacccccuc

SEQ ID NO: 168991 - RNA, 18 nt, Human
cccuggauguuaaggcuc

SEQ ID NO: 168992 - RNA, 22 nt, Human
ccgcagcgcccccuggcggccc

SEQ ID NO: 168993 - RNA, 23 nt, Human
ccgccgccgccgccacucuccgg

SEQ ID NO: 168994 - RNA, 18 nt, Human
ccgcgcugccucuggggc

SEQ ID NO: 168995 - RNA, 19 nt, Human
ccgcugagggacccggcgg

SEQ ID NO: 168996 - RNA, 18 nt, Human
ccgcugccgccgccgccg

SEQ ID NO: 168997 - RNA, 19 nt, Human
ccggcccugggccugcugc

SEQ ID NO: 168998 - RNA, 20 nt, Human
ccggcccugggccugcugcg

SEQ ID NO: 168999 - RNA, 19 nt, Human
ccggggagugggauccagg

SEQ ID NO: 169000 - RNA, 23 nt, Human
ccuccaaucuacgggauagccug

SEQ ID NO: 169001 - RNA, 24 nt, Human
ccuccgcugucgggcccgccaccc

SEQ ID NO: 169002 - RNA, 19 nt, Human
ccugaccuccaccaagugu

SEQ ID NO: 169003 - RNA, 20 nt, Human
ccuggcggcccagcucggcc

SEQ ID NO: 169004 - RNA, 19 nt, Human
ccugggcgggccucagccc

SEQ ID NO: 169005 - RNA, 21 nt, Human
ccugggguuccaauccugccu

SEQ ID NO: 169006 - RNA, 24 nt, Human
ccugggguuccaauccugccuuca

SEQ ID NO: 169007 - RNA, 22 nt, Human
ccuuaccugggcgggccucagc

SEQ ID NO: 169008 - RNA, 19 nt, Human
cgagaggcgcagaggcagg

SEQ ID NO: 169009 - RNA, 20 nt, Human
cgccgccgcuccugcacccu

SEQ ID NO: 169010 - RNA, 22 nt, Human
cggagccucaguuuccuggucu

SEQ ID NO: 169011 - RNA, 21 nt, Human
cggcagcggcucgggcucggc

SEQ ID NO: 169012 - RNA, 19 nt, Human
cggcgcccucuccucccuc

SEQ ID NO: 169013 - RNA, 21 nt, Human
cgggaacaaaccgccgccgcg

SEQ ID NO: 169014 - RNA, 22 nt, Human
cgggccucagccccuagucccc

SEQ ID NO: 169015 - RNA, 19 nt, Human
cggggagggggcgggggac

SEQ ID NO: 169016 - RNA, 19 nt, Human
cucccccggccucccucca

SEQ ID NO: 169017 - RNA, 22 nt, Human
cucccuccccucucccuggccc

SEQ ID NO: 169018 - RNA, 20 nt, Human
cuccugcaaagaaauagaac

SEQ ID NO: 169019 - RNA, 19 nt, Human
cucuccggcuccgcuccgg

SEQ ID NO: 169020 - RNA, 22 nt, Human
cucugugacuaucucacucucc

SEQ ID NO: 169021 - RNA, 23 nt, Human
cuggacaccccccaccuuccugg

SEQ ID NO: 169022 - RNA, 24 nt, Human
cugguuuaggcuucagaggaaacg

SEQ ID NO: 169023 - RNA, 21 nt, Human
cuguggccgcguucccggggc

SEQ ID NO: 169024 - RNA, 19 nt, Human
cuguucaugggucugggaa

SEQ ID NO: 169025 - RNA, 20 nt, Human
cuugucuucgccgccgcucc

SEQ ID NO: 169026 - RNA, 18 nt, Human
gaacugagcggaugccug

SEQ ID NO: 169027 - RNA, 23 nt, Human
gacuuccccgcuucggagccuca

SEQ ID NO: 169028 - RNA, 20 nt, Human
gagcugggacccgccgcugg

SEQ ID NO: 169029 - RNA, 23 nt, Human
gaggcaggcagggaggggugucc

SEQ ID NO: 169030 - RNA, 23 nt, Human
gagggacccggcgggaacaaacc

SEQ ID NO: 169031 - RNA, 20 nt, Human
gauagagcccgcuuaguccc

SEQ ID NO: 169032 - RNA, 20 nt, Human
gcagaggcagggaaaaaaac

SEQ ID NO: 169033 - RNA, 24 nt, Human
gcccccgccacuaccccgggaauc

SEQ ID NO: 169034 - RNA, 19 nt, Human
gcccugagcgauagagccc

SEQ ID NO: 169035 - RNA, 19 nt, Human
gccgcugccgccgccgccg

SEQ ID NO: 169036 - RNA, 23 nt, Human
gccucccuccaggacccagaaac

SEQ ID NO: 169037 - RNA, 21 nt, Human
gccugggcccccucugggacc

SEQ ID NO: 169038 - RNA, 21 nt, Human
gcggggagggggcgggggacu

SEQ ID NO: 169039 - RNA, 22 nt, Human
gcgugccggcccaaggucugga

SEQ ID NO: 169040 - RNA, 18 nt, Human
gcuaaagcucgggcgugc

SEQ ID NO: 169041 - RNA, 19 nt, Human
gcuccugcacccugugcuc

SEQ ID NO: 169042 - RNA, 24 nt, Human
gcugccucuggggcgagugcguuu

SEQ ID NO: 169043 - RNA, 25 nt, Human
ggcacgacccgccggcggcccccgg

SEQ ID NO: 169044 - RNA, 20 nt, Human
ggcagcggcucgggcucggc

SEQ ID NO: 169045 - RNA, 21 nt, Human
ggcccugugccuuguuucucg

SEQ ID NO: 169046 - RNA, 20 nt, Human
ggccugggagaggugagauu

SEQ ID NO: 169047 - RNA, 24 nt, Human
ggcgggcccuugucuucgccgccg

SEQ ID NO: 169048 - RNA, 20 nt, Human
ggcucggccgcgcugccucu

SEQ ID NO: 169049 - RNA, 18 nt, Human
gggagaggcugaggagug

SEQ ID NO: 169050 - RNA, 20 nt, Human
gggagggggcgggggacuga

SEQ ID NO: 169051 - RNA, 21 nt, Human
gggcggggagggggcggggga

SEQ ID NO: 169052 - RNA, 22 nt, Human
gggcuagggcggagcucccugg

SEQ ID NO: 169053 - RNA, 18 nt, Human
ggggaagaagugagaggg

SEQ ID NO: 169054 - RNA, 21 nt, Human
ggggagggggcgggggacuga

SEQ ID NO: 169055 - RNA, 25 nt, Human
gggggacugaggcaggcagggaggg

SEQ ID NO: 169056 - RNA, 25 nt, Human
gucaccuugggcaagguucuuugcg

SEQ ID NO: 169057 - RNA, 19 nt, Human
gucgggcccgccaccccuc

SEQ ID NO: 169058 - RNA, 21 nt, Human
gucucaacguuggggaagaag

SEQ ID NO: 169059 - RNA, 19 nt, Human
guggaaacggcauuugucu

SEQ ID NO: 169060 - RNA, 20 nt, Human
uacagaggcccaggauaggg

SEQ ID NO: 169061 - RNA, 21 nt, Human
uagccccgggccugucgcccu

SEQ ID NO: 169062 - RNA, 24 nt, Human
uaggcuucagaggaaacgaacuuc

SEQ ID NO: 169063 - RNA, 22 nt, Human
uauuagaccucuuucucccccg

SEQ ID NO: 169064 - RNA, 21 nt, Human
ucaaaagucuugugcaacuaa

SEQ ID NO: 169065 - RNA, 19 nt, Human
ucacucuccgugagucucu

SEQ ID NO: 169066 - RNA, 18 nt, Human
ucagccccuaguccccuc

SEQ ID NO: 169067 - RNA, 20 nt, Human
ucaggcuccugggguuccaa

SEQ ID NO: 169068 - RNA, 22 nt, Human
uccacagauggagcuacagagg

SEQ ID NO: 169069 - RNA, 24 nt, Human
uccacagauggagcuacagaggcc

SEQ ID NO: 169070 - RNA, 21 nt, Human
uccccacccguccucucccca

SEQ ID NO: 169071 - RNA, 22 nt, Human
uccccacccguccucuccccaa

SEQ ID NO: 169072 - RNA, 23 nt, Human
uccccgagaggcgcagaggcagg

SEQ ID NO: 169073 - RNA, 22 nt, Human
ucccuccaggacccagaaacaa

SEQ ID NO: 169074 - RNA, 19 nt, Human
ucccuggccccaguugccc

SEQ ID NO: 169075 - RNA, 18 nt, Human
ucccugggcggggugggg

SEQ ID NO: 169076 - RNA, 26 nt, Human
uccgagcugggacccgccgcuggggc

SEQ ID NO: 169077 - RNA, 19 nt, Human
uccgcccccugcccgacac

SEQ ID NO: 169078 - RNA, 18 nt, Human
uccggggagugggaucca

SEQ ID NO: 169079 - RNA, 19 nt, Human
uccuggcucccaggguucu

SEQ ID NO: 169080 - RNA, 22 nt, Human
ucggccgcgcucaccuuccagg

SEQ ID NO: 169081 - RNA, 19 nt, Human
ucucucaaaagucuugugc

SEQ ID NO: 169082 - RNA, 19 nt, Human
ucucugugacuaucucacu

SEQ ID NO: 169083 - RNA, 23 nt, Human
ucuggggcacggaaggggagaug

SEQ ID NO: 169084 - RNA, 23 nt, Human
ucugucaccuugggcaagguucu

SEQ ID NO: 169085 - RNA, 19 nt, Human
ugagaggaagucgccuggg

SEQ ID NO: 169086 - RNA, 19 nt, Human
ugagaggggaaaggcagaa

SEQ ID NO: 169087 - RNA, 23 nt, Human
ugagucucuguggaaacggcauu

SEQ ID NO: 169088 - RNA, 18 nt, Human
ugccccgacagcgccgca

SEQ ID NO: 169089 - RNA, 19 nt, Human
ugccccgacagcgccgcac

SEQ ID NO: 169090 - RNA, 24 nt, Human
ugcccgacacccccucagugaacc

SEQ ID NO: 169091 - RNA, 19 nt, Human
ugcccugaggacuggacac

SEQ ID NO: 169092 - RNA, 21 nt, Human
ugccuguucuccgacccucug

SEQ ID NO: 169093 - RNA, 21 nt, Human
ugccuuguuucucgcuagccg

SEQ ID NO: 169094 - RNA, 20 nt, Human
ugccuuuguaaaaaugaggc

SEQ ID NO: 169095 - RNA, 21 nt, Human
ugcggcggcgcccucuccucc

SEQ ID NO: 169096 - RNA, 18 nt, Human
uggacaccccccaccuuc

SEQ ID NO: 169097 - RNA, 23 nt, Human
uggagaacagcaaaaaaaaaaaa

SEQ ID NO: 169098 - RNA, 19 nt, Human
uggcccugugccuuguuuc

SEQ ID NO: 169099 - RNA, 23 nt, Human
uggcucccaggguucugggcccc

SEQ ID NO: 169100 - RNA, 22 nt, Human
ugggaccgcaggaacucccggg

SEQ ID NO: 169101 - RNA, 22 nt, Human
ugggagaggugagauugcggcg

SEQ ID NO: 169102 - RNA, 21 nt, Human
ugggagcgcgaggcugagacg

SEQ ID NO: 169103 - RNA, 20 nt, Human
ugggccugggagaggugagg

SEQ ID NO: 169104 - RNA, 21 nt, Human
uuaauccaacucucccauucc

SEQ ID NO: 169105 - RNA, 21 nt, Human
uuacccuaucugucaccuugg

SEQ ID NO: 169106 - RNA, 18 nt, Human
uucacagaauccucaaaa

SEQ ID NO: 169107 - RNA, 21 nt, Human
uucauaaauagacucccugag

SEQ ID NO: 169108 - RNA, 20 nt, Human
uucccggggcgcgggccggu

SEQ ID NO: 169109 - RNA, 20 nt, Human
uuccuggcucccaggguucu

SEQ ID NO: 169110 - RNA, 24 nt, Human
uucugggccccaccgacaggcggc

SEQ ID NO: 169111 - RNA, 19 nt, Human
uugggcccauuucagccuc

SEQ ID NO: 169112 - RNA, 20 nt, Human
uugggcccauuucagccucu

SEQ ID NO: 169113 - RNA, 24 nt, Human
uuucacagaauccucaaaauagag

SEQ ID NO: 169114 - RNA, 22 nt, Human
uuugcgcuuuguuucugccuuu

SEQ ID NO: 169115 - RNA, 22 nt, Human
aaaauaaaaauuaccaaugguu

SEQ ID NO: 169116 - RNA, 21 nt, Human
aagcucacuuuacugacugcc

SEQ ID NO: 169117 - RNA, 23 nt, Human
aagggucccuugcgcgcuggugc

SEQ ID NO: 169118 - RNA, 24 nt, Human
acaaucuucuuuuucacaccccag

SEQ ID NO: 169119 - RNA, 25 nt, Human
acagccaugaaauuaccagcacguc

SEQ ID NO: 169120 - RNA, 19 nt, Human
acagcggcuaggcuuuggg

SEQ ID NO: 169121 - RNA, 23 nt, Human
agacagggaaaaccagcccaggu

SEQ ID NO: 169122 - RNA, 18 nt, Human
agagcccuccccagcuac

SEQ ID NO: 169123 - RNA, 24 nt, Human
agagcccuccccagcuacugaaag

SEQ ID NO: 169124 - RNA, 21 nt, Human
agauuuuuauuaaaacagucc

SEQ ID NO: 169125 - RNA, 21 nt, Human
agccaugaaauuaccagcacg

SEQ ID NO: 169126 - RNA, 24 nt, Human
aggcgaggcgggggcagcgagguc

SEQ ID NO: 169127 - RNA, 22 nt, Human
aggcgggggcagcgaggucggg

SEQ ID NO: 169128 - RNA, 19 nt, Human
auggagccucugaaauauu

SEQ ID NO: 169129 - RNA, 26 nt, Human
auggagccucugaaauauuuaaugcu

SEQ ID NO: 169130 - RNA, 24 nt, Human
caaaugaacgaauguacuucucuc

SEQ ID NO: 169131 - RNA, 20 nt, Human
cacaauuuggauccuggucu

SEQ ID NO: 169132 - RNA, 20 nt, Human
cacccccgggcucuggaucc

SEQ ID NO: 169133 - RNA, 21 nt, Human
cacccccgggcucuggauccc

SEQ ID NO: 169134 - RNA, 19 nt, Human
cacgcgcuggaggcucagc

SEQ ID NO: 169135 - RNA, 24 nt, Human
cagaaagaggcugaguuucucuug

SEQ ID NO: 169136 - RNA, 24 nt, Human
cagaggcccuggguggcccaccau

SEQ ID NO: 169137 - RNA, 18 nt, Human
cagauugcggggaacgug

SEQ ID NO: 169138 - RNA, 22 nt, Human
cagcccaggucaaccagagcag

SEQ ID NO: 169139 - RNA, 19 nt, Human
cagcggcuaggcuuugggu

SEQ ID NO: 169140 - RNA, 24 nt, Human
ccaaugguuuucauacaaucuucu

SEQ ID NO: 169141 - RNA, 26 nt, Human
ccaauuuaaaaaagaagaaaagccua

SEQ ID NO: 169142 - RNA, 21 nt, Human
cccaguugaguccucucucca

SEQ ID NO: 169143 - RNA, 22 nt, Human
ccccauuuggacugaaccaagu

SEQ ID NO: 169144 - RNA, 21 nt, Human
cccccgggcucuggauccccg

SEQ ID NO: 169145 - RNA, 22 nt, Human
cccccgggcucuggauccccgc

SEQ ID NO: 169146 - RNA, 18 nt, Human
cccgggcucuggaucccc

SEQ ID NO: 169147 - RNA, 22 nt, Human
cccugugccaguccaagggcuc

SEQ ID NO: 169148 - RNA, 19 nt, Human
cccuugcgcgcuggugccg

SEQ ID NO: 169149 - RNA, 18 nt, Human
ccgccaaggacccucccc

SEQ ID NO: 169150 - RNA, 21 nt, Human
ccguuugagggcuucgcucca

SEQ ID NO: 169151 - RNA, 22 nt, Human
ccuccucacuuuaagaagaaag

SEQ ID NO: 169152 - RNA, 19 nt, Human
ccucgccccaccuccuccc

SEQ ID NO: 169153 - RNA, 19 nt, Human
ccucgccccaccuccuccc

SEQ ID NO: 169154 - RNA, 21 nt, Human
ccucgccccaccuccucccgu

SEQ ID NO: 169155 - RNA, 23 nt, Human
ccucuguggccugcucggucuuu

SEQ ID NO: 169156 - RNA, 25 nt, Human
cgagagcccagcggcccaggcuggc

SEQ ID NO: 169157 - RNA, 21 nt, Human
cgaggcgggggcagcgagguc

SEQ ID NO: 169158 - RNA, 22 nt, Human
cgagggucccugugccagucca

SEQ ID NO: 169159 - RNA, 22 nt, Human
cgccaaggacccuccccgauag

SEQ ID NO: 169160 - RNA, 21 nt, Human
cgccccaccuccucccguuua

SEQ ID NO: 169161 - RNA, 18 nt, Human
cgcucggcccuucugcgg

SEQ ID NO: 169162 - RNA, 18 nt, Human
cgggcccaggcggggcga

SEQ ID NO: 169163 - RNA, 25 nt, Human
cgggcgucccgcacccccgggcucu

SEQ ID NO: 169164 - RNA, 19 nt, Human
cgggggccgcccaugcccu

SEQ ID NO: 169165 - RNA, 23 nt, Human
cuaaagcucacuuuacugacugc

SEQ ID NO: 169166 - RNA, 21 nt, Human
cucaagggaaagggggagagu

SEQ ID NO: 169167 - RNA, 25 nt, Human
cucaagggaaagggggagaguuauu

SEQ ID NO: 169168 - RNA, 21 nt, Human
cucucugccuuauaauggaaa

SEQ ID NO: 169169 - RNA, 18 nt, Human
cugaaaguuuuugcucca

SEQ ID NO: 169170 - RNA, 18 nt, Human
cuggauccccgcggcugu

SEQ ID NO: 169171 - RNA, 22 nt, Human
cuuaagcaagauacaaaaugaa

SEQ ID NO: 169172 - RNA, 20 nt, Human
gaaauauuuaaugcugaaag

SEQ ID NO: 169173 - RNA, 26 nt, Human
gaagagcccuccccagcuacugaaag

SEQ ID NO: 169174 - RNA, 23 nt, Human
gacggcucagcccgcguggugcu

SEQ ID NO: 169175 - RNA, 22 nt, Human
gaggcgggcagcggcgguggcc

SEQ ID NO: 169176 - RNA, 23 nt, Human
gcagagauuucuccaauuuaaaa

SEQ ID NO: 169177 - RNA, 22 nt, Human
gccccgagagcccagcggccca

SEQ ID NO: 169178 - RNA, 18 nt, Human
gcgcgggcccaggcgggg

SEQ ID NO: 169179 - RNA, 19 nt, Human
gcgggcagcggcgguggcc

SEQ ID NO: 169180 - RNA, 18 nt, Human
gcgggcccaggcggggcg

SEQ ID NO: 169181 - RNA, 18 nt, Human
gcgggcgucccgcacccc

SEQ ID NO: 169182 - RNA, 18 nt, Human
gcgguggccucgugaccg

SEQ ID NO: 169183 - RNA, 18 nt, Human
gcucgggagugacccgcu

SEQ ID NO: 169184 - RNA, 18 nt, Human
gcugcagcuggucugugg

SEQ ID NO: 169185 - RNA, 20 nt, Human
gcugcagcuggucuguggug

SEQ ID NO: 169186 - RNA, 22 nt, Human
ggauagaguccugcagcccucu

SEQ ID NO: 169187 - RNA, 20 nt, Human
ggcagagaggcgaggcgggg

SEQ ID NO: 169188 - RNA, 19 nt, Human
ggcagcggcgguggccucg

SEQ ID NO: 169189 - RNA, 26 nt, Human
gggaaaaccagcccaggucaaccaga

SEQ ID NO: 169190 - RNA, 22 nt, Human
gggcagagaggcgaggcggggg

SEQ ID NO: 169191 - RNA, 21 nt, Human
gggcagcggcgguggccucgu

SEQ ID NO: 169192 - RNA, 22 nt, Human
gggcccugaaugauaacccggg

SEQ ID NO: 169193 - RNA, 19 nt, Human
gggcgggccuggcgucccc

SEQ ID NO: 169194 - RNA, 19 nt, Human
gggcgggggcgggccuggc

SEQ ID NO: 169195 - RNA, 20 nt, Human
gggcucgaaggccagagcga

SEQ ID NO: 169196 - RNA, 19 nt, Human
ggggauggaagagcccucc

SEQ ID NO: 169197 - RNA, 19 nt, Human
ggguggcccaccauugcug

SEQ ID NO: 169198 - RNA, 21 nt, Human
ggucuguggugcccgcuaguu

SEQ ID NO: 169199 - RNA, 22 nt, Human
gguguagcagggggugcugggg

SEQ ID NO: 169200 - RNA, 18 nt, Human
uaaaaaagaagaaaagcc

SEQ ID NO: 169201 - RNA, 24 nt, Human
uaaaaaggcccgaguuccggcagc

SEQ ID NO: 169202 - RNA, 19 nt, Human
uaaaacaguccaucugaac

SEQ ID NO: 169203 - RNA, 26 nt, Human
uaaaauuacauauguggcuugcacca

SEQ ID NO: 169204 - RNA, 23 nt, Human
uaaaggcacuagaggacgaaccg

SEQ ID NO: 169205 - RNA, 22 nt, Human
uaccaaugguuuucauacaauc

SEQ ID NO: 169206 - RNA, 21 nt, Human
uaccagaaagcaucccguuuu

SEQ ID NO: 169207 - RNA, 18 nt, Human
uagaguccugcagcccuc

SEQ ID NO: 169208 - RNA, 23 nt, Human
uauacagaaagaggcugaguuuc

SEQ ID NO: 169209 - RNA, 19 nt, Human
uaucugaaagcugugaaug

SEQ ID NO: 169210 - RNA, 18 nt, Human
uccaagggcucuggcugc

SEQ ID NO: 169211 - RNA, 19 nt, Human
uccaagggcucuggcugcc

SEQ ID NO: 169212 - RNA, 21 nt, Human
uccaauuuaaaaaagaagaaa

SEQ ID NO: 169213 - RNA, 22 nt, Human
uccaauuuaaaaaagaagaaaa

SEQ ID NO: 169214 - RNA, 20 nt, Human
ucccaaaaauaaaaaauaaa

SEQ ID NO: 169215 - RNA, 22 nt, Human
ucccaaaaauaaaaaauaaaaa

SEQ ID NO: 169216 - RNA, 23 nt, Human
uccccggaacggacgcucggccc

SEQ ID NO: 169217 - RNA, 21 nt, Human
ucccuagaacagcggcuaggc

SEQ ID NO: 169218 - RNA, 18 nt, Human
ucccuggguugggguggc

SEQ ID NO: 169219 - RNA, 20 nt, Human
ucggggggcgggggcgggcc

SEQ ID NO: 169220 - RNA, 22 nt, Human
ucucaagggaaagggggagagu

SEQ ID NO: 169221 - RNA, 21 nt, Human
ucuccacggcgugggucucca

SEQ ID NO: 169222 - RNA, 18 nt, Human
ugaaacugauuccccaca

SEQ ID NO: 169223 - RNA, 19 nt, Human
ugaaauuaccagcacgucc

SEQ ID NO: 169224 - RNA, 20 nt, Human
ugacaagaaacaguggacaa

SEQ ID NO: 169225 - RNA, 24 nt, Human
ugacugggcaguaacagccaugaa

SEQ ID NO: 169226 - RNA, 20 nt, Human
ugcccuaacuuaauuuuucu

SEQ ID NO: 169227 - RNA, 20 nt, Human
ugccuagguugugcgcgcag

SEQ ID NO: 169228 - RNA, 18 nt, Human
ugcucaaaaguucaauaa

SEQ ID NO: 169229 - RNA, 20 nt, Human
ugcuggggauggaagagccc

SEQ ID NO: 169230 - RNA, 19 nt, Human
uggauccuggucucuggug

SEQ ID NO: 169231 - RNA, 22 nt, Human
uggauccuggucucugguguug

SEQ ID NO: 169232 - RNA, 24 nt, Human
ugggggagacugaagguucaggug

SEQ ID NO: 169233 - RNA, 19 nt, Human
ugucggggggcgggggcgg

SEQ ID NO: 169234 - RNA, 21 nt, Human
ugucggggggcgggggcgggc

SEQ ID NO: 169235 - RNA, 23 nt, Human
uucaacucggagcuaggucucaa

SEQ ID NO: 169236 - RNA, 23 nt, Human
uucauacaaucuucuuuuucaca

SEQ ID NO: 169237 - RNA, 20 nt, Human
uucgcuccaucgaggguccc

SEQ ID NO: 169238 - RNA, 22 nt, Human
uucucagauugcggggaacgug

SEQ ID NO: 169239 - RNA, 18 nt, Human
uuggauccuggucucugg

SEQ ID NO: 169240 - RNA, 19 nt, Human
uuucacaccccagcccuuc

SEQ ID NO: 169241 - RNA, 21 nt, Human
uuucuuuugcaaauuuguccu

SEQ ID NO: 169242 - RNA, 21 nt, Human
uuuuccguucccuagaacagc

SEQ ID NO: 169243 - RNA, 21 nt, Human
accugggguauggacucacug

SEQ ID NO: 169244 - RNA, 20 nt, Human
aggagcccuggugcugccug

SEQ ID NO: 169245 - RNA, 26 nt, Human
agggagaagaaaugagaggcuggcag

SEQ ID NO: 169246 - RNA, 21 nt, Human
agguggggggcaaacuugugg

SEQ ID NO: 169247 - RNA, 22 nt, Human
augaacccaggagucugaccca

SEQ ID NO: 169248 - RNA, 21 nt, Human
caccgccgggggagagggcuc

SEQ ID NO: 169249 - RNA, 20 nt, Human
cacggccccccccccaacca

SEQ ID NO: 169250 - RNA, 19 nt, Human
caggaagaagcugagggca

SEQ ID NO: 169251 - RNA, 23 nt, Human
caggaguuugaguccaggaggcc

SEQ ID NO: 169252 - RNA, 21 nt, Human
caggguggggggcagagaugg

SEQ ID NO: 169253 - RNA, 22 nt, Human
caugaacccaggagucugaccc

SEQ ID NO: 169254 - RNA, 24 nt, Human
ccagcgccuccccucuaauuuccu

SEQ ID NO: 169255 - RNA, 21 nt, Human
ccagggaugggggacggagaa

SEQ ID NO: 169256 - RNA, 23 nt, Human
ccagggaugggggacggagaagg

SEQ ID NO: 169257 - RNA, 22 nt, Human
cccagcccccuuacucuguuca

SEQ ID NO: 169258 - RNA, 24 nt, Human
cccaggaagaagcugagggcagac

SEQ ID NO: 169259 - RNA, 20 nt, Human
cccgcgcggcuccgggaccg

SEQ ID NO: 169260 - RNA, 22 nt, Human
cccgcgcggcuccgggaccgca

SEQ ID NO: 169261 - RNA, 20 nt, Human
cgccccucccuuucugccuu

SEQ ID NO: 169262 - RNA, 20 nt, Human
cgccgcagguccggggcacc

SEQ ID NO: 169263 - RNA, 18 nt, Human
cggccccccccccaacca

SEQ ID NO: 169264 - RNA, 18 nt, Human
cggccccccccccaacca

SEQ ID NO: 169265 - RNA, 19 nt, Human
cggcgccgcagguccgggg

SEQ ID NO: 169266 - RNA, 21 nt, Human
cgggaccgcaggggccgccga

SEQ ID NO: 169267 - RNA, 21 nt, Human
cggggcacaggucgcacaggu

SEQ ID NO: 169268 - RNA, 20 nt, Human
cgggggagagggcucaggcc

SEQ ID NO: 169269 - RNA, 21 nt, Human
cuccaagaaguguccucaggg

SEQ ID NO: 169270 - RNA, 20 nt, Human
cucuguucacgguacccucc

SEQ ID NO: 169271 - RNA, 24 nt, Human
cucuguucacgguacccuccucca

SEQ ID NO: 169272 - RNA, 22 nt, Human
cugcccgcgcggcuccgggacc

SEQ ID NO: 169273 - RNA, 22 nt, Human
cuuuauauggacacggcccccc

SEQ ID NO: 169274 - RNA, 19 nt, Human
gagugucggaaaaacauga

SEQ ID NO: 169275 - RNA, 19 nt, Human
gcaggggccgccgacccgc

SEQ ID NO: 169276 - RNA, 21 nt, Human
gccccccccccaaccaccgcc

SEQ ID NO: 169277 - RNA, 23 nt, Human
gcgcggcuccgggaccgcagggg

SEQ ID NO: 169278 - RNA, 23 nt, Human
ggaagaagcugagggcagacagg

SEQ ID NO: 169279 - RNA, 18 nt, Human
ggacacggcccccccccc

SEQ ID NO: 169280 - RNA, 18 nt, Human
ggagcccuggugcugccu

SEQ ID NO: 169281 - RNA, 19 nt, Human
ggagcccuggugcugccug

SEQ ID NO: 169282 - RNA, 25 nt, Human
ggcagacagguaaguggaggugggg

SEQ ID NO: 169283 - RNA, 22 nt, Human
gggaaaaugaagggacgcuagc

SEQ ID NO: 169284 - RNA, 21 nt, Human
gggaugggggacggagaagga

SEQ ID NO: 169285 - RNA, 25 nt, Human
gggcacaggucgcacaggugccugc

SEQ ID NO: 169286 - RNA, 20 nt, Human
gggggcucucucccaggaag

SEQ ID NO: 169287 - RNA, 25 nt, Human
uaaguggagguggggggcaaacuug

SEQ ID NO: 169288 - RNA, 20 nt, Human
uccaaaggcuuggaacucac

SEQ ID NO: 169289 - RNA, 20 nt, Human
uccaagccaggguggggggc

SEQ ID NO: 169290 - RNA, 25 nt, Human
uccaggaggccacgacgagaggcgc

SEQ ID NO: 169291 - RNA, 18 nt, Human
ucccagcccccuuacucu

SEQ ID NO: 169292 - RNA, 22 nt, Human
uccccucuaauuuccucuccca

SEQ ID NO: 169293 - RNA, 19 nt, Human
ucuaauuuccucucccagc

SEQ ID NO: 169294 - RNA, 26 nt, Human
ucuaauuuccucucccagcccccuua

SEQ ID NO: 169295 - RNA, 19 nt, Human
ucucccagcccccuuacuc

SEQ ID NO: 169296 - RNA, 20 nt, Human
ucucccagcccccuuacuca

SEQ ID NO: 169297 - RNA, 22 nt, Human
ucugccuuuggaucaguuuuuu

SEQ ID NO: 169298 - RNA, 21 nt, Human
ugaaaggggggcucucuccca

SEQ ID NO: 169299 - RNA, 22 nt, Human
ugaacccaggagucugacccag

SEQ ID NO: 169300 - RNA, 19 nt, Human
ugaagggacgcuagcaagu

SEQ ID NO: 169301 - RNA, 22 nt, Human
ugccugucugaaaucuccaaga

SEQ ID NO: 169302 - RNA, 19 nt, Human
ugcuccaagccaggguggg

SEQ ID NO: 169303 - RNA, 18 nt, Human
uggagguggggggcaaac

SEQ ID NO: 169304 - RNA, 20 nt, Human
uggagguggggggcaaacuu

SEQ ID NO: 169305 - RNA, 24 nt, Human
uggcuuccaaaggcuuggaacuca

SEQ ID NO: 169306 - RNA, 22 nt, Human
ugggaaaaugaagggacgcuag

SEQ ID NO: 169307 - RNA, 25 nt, Human
ugggguggggggcgccgcaaagcug

SEQ ID NO: 169308 - RNA, 18 nt, Human
uguccucagggcgugaag

SEQ ID NO: 169309 - RNA, 21 nt, Human
ugucugaaaucuccaagaagu

SEQ ID NO: 169310 - RNA, 21 nt, Human
uuccaaaggcuuggaacucac

SEQ ID NO: 169311 - RNA, 25 nt, Human
uucuuucuuuuuaauuaaaccagcu

SEQ ID NO: 169312 - RNA, 20 nt, Human
uuuuccagaaaaaaguuucu

SEQ ID NO: 169313 - RNA, 21 nt, Human
uuuuuuuuuuuuuuuuccaga

SEQ ID NO: 169314 - RNA, 24 nt, Human
uuuuuuuuuuuuuuuuuuuuccag

SEQ ID NO: 169315 - RNA, 20 nt, Human
aaaacuuuuauuuaccgaug

SEQ ID NO: 169316 - RNA, 24 nt, Human
aaaauacccacugaaaaagucuaa

SEQ ID NO: 169317 - RNA, 23 nt, Human
aaaauuuucccccacuucugcca

SEQ ID NO: 169318 - RNA, 19 nt, Human
aaacaggagccuugcuaua

SEQ ID NO: 169319 - RNA, 21 nt, Human
aagacaaaacauaacagaaga

SEQ ID NO: 169320 - RNA, 23 nt, Human
aaggaagaggaggaacauggaag

SEQ ID NO: 169321 - RNA, 21 nt, Human
aauacaaaaaaaaaaaaagga

SEQ ID NO: 169322 - RNA, 21 nt, Human
acaaaacauaacagaagaggc

SEQ ID NO: 169323 - RNA, 21 nt, Human
acacggcaaauauugccaaca

SEQ ID NO: 169324 - RNA, 24 nt, Human
acacggcaaauauugccaacaaag

SEQ ID NO: 169325 - RNA, 18 nt, Human
agacaaaacauaacagaa

SEQ ID NO: 169326 - RNA, 25 nt, Human
agagguggaacccuuuucuucugcc

SEQ ID NO: 169327 - RNA, 21 nt, Human
aggaaaaaauacacaaaaggc

SEQ ID NO: 169328 - RNA, 22 nt, Human
aggaaaaaauacacaaaaggca

SEQ ID NO: 169329 - RNA, 19 nt, Human
aggaacauggaaggggacc

SEQ ID NO: 169330 - RNA, 21 nt, Human
aggaggaacauggaaggggac

SEQ ID NO: 169331 - RNA, 25 nt, Human
aguuuuuaaaagugccuuaaccuuu

SEQ ID NO: 169332 - RNA, 22 nt, Human
auuuuuguucuuuuuuuaggaa

SEQ ID NO: 169333 - RNA, 23 nt, Human
caaaaggcaaaacauccucaaau

SEQ ID NO: 169334 - RNA, 21 nt, Human
cacagcaccgucucaggcggg

SEQ ID NO: 169335 - RNA, 24 nt, Human
cacggcaaauauugccaacaaagu

SEQ ID NO: 169336 - RNA, 22 nt, Human
cagaaaaauacccacugaaaaa

SEQ ID NO: 169337 - RNA, 19 nt, Human
cagaagaggcugaagcgaa

SEQ ID NO: 169338 - RNA, 24 nt, Human
cagccaaaauacaaaaaaaaaaaa

SEQ ID NO: 169339 - RNA, 26 nt, Human
caggaucaaaaacuuuuauuuaccga

SEQ ID NO: 169340 - RNA, 24 nt, Human
cauaacagaagaggcugaagcgaa

SEQ ID NO: 169341 - RNA, 19 nt, Human
cauuggccggaaggagggg

SEQ ID NO: 169342 - RNA, 24 nt, Human
ccaacaaaguuacaccauuaauac

SEQ ID NO: 169343 - RNA, 22 nt, Human
ccaagacauucuuucaaaaaaa

SEQ ID NO: 169344 - RNA, 23 nt, Human
ccacuucugccauuggccggaag

SEQ ID NO: 169345 - RNA, 25 nt, Human
cccccgccgccgccgccgccgccgg

SEQ ID NO: 169346 - RNA, 19 nt, Human
ccccgccgccgccgccgcc

SEQ ID NO: 169347 - RNA, 18 nt, Human
ccccugcacagcaccguc

SEQ ID NO: 169348 - RNA, 26 nt, Human
cccgcaauccugaauccgcgcgguca

SEQ ID NO: 169349 - RNA, 18 nt, Human
ccgccgccgccgccgccg

SEQ ID NO: 169350 - RNA, 25 nt, Human
ccgccgccgccgccgccgccgccgg

SEQ ID NO: 169351 - RNA, 22 nt, Human
ccgccgccgccgccgccgccgu

SEQ ID NO: 169352 - RNA, 23 nt, Human
ccgccgccgccgccgccgugcgg

SEQ ID NO: 169353 - RNA, 18 nt, Human
ccgccgccgccgccgugc

SEQ ID NO: 169354 - RNA, 22 nt, Human
ccgccgugcgguggcugcugcu

SEQ ID NO: 169355 - RNA, 18 nt, Human
ccgcgccgccucccccgc

SEQ ID NO: 169356 - RNA, 21 nt, Human
ccugcaaaagacggcucuaaa

SEQ ID NO: 169357 - RNA, 26 nt, Human
ccuugccaaaaacuccgguuggggag

SEQ ID NO: 169358 - RNA, 21 nt, Human
cgagaagaaagcaguuucuug

SEQ ID NO: 169359 - RNA, 18 nt, Human
cgccgaagacaucgggug

SEQ ID NO: 169360 - RNA, 26 nt, Human
cgccgccucccccgccgccgccgccg

SEQ ID NO: 169361 - RNA, 22 nt, Human
cgcucccugcaaaagacggcuc

SEQ ID NO: 169362 - RNA, 23 nt, Human
cgguuauaccucgagaagaaagc

SEQ ID NO: 169363 - RNA, 21 nt, Human
cucccccgccgccgccgccgc

SEQ ID NO: 169364 - RNA, 20 nt, Human
cuccuugccaaaaacuccgg

SEQ ID NO: 169365 - RNA, 23 nt, Human
cugaaaaagucuaaauaaaauuc

SEQ ID NO: 169366 - RNA, 20 nt, Human
cuucauauuauauauauauu

SEQ ID NO: 169367 - RNA, 18 nt, Human
cuucugccauuggccgga

SEQ ID NO: 169368 - RNA, 19 nt, Human
gacuccuugccaaaaacuc

SEQ ID NO: 169369 - RNA, 24 nt, Human
gagggagugaggaaggaggugcca

SEQ ID NO: 169370 - RNA, 18 nt, Human
ggaggaacauggaagggg

SEQ ID NO: 169371 - RNA, 18 nt, Human
ggaggagccuacgcggug

SEQ ID NO: 169372 - RNA, 19 nt, Human
ggaggcggacgcccggacg

SEQ ID NO: 169373 - RNA, 25 nt, Human
ggagguggggagggagaucgggagg

SEQ ID NO: 169374 - RNA, 27 nt, Human
ggagguggggagggagaucgggaggga

SEQ ID NO: 169375 - RNA, 18 nt, Human
ggcuuccgaaaugcaagu

SEQ ID NO: 169376 - RNA, 23 nt, Human
gggagacagaaaaauacccacug

SEQ ID NO: 169377 - RNA, 24 nt, Human
gggagacagaaaaauacccacuga

SEQ ID NO: 169378 - RNA, 19 nt, Human
guccagggucccugugacc

SEQ ID NO: 169379 - RNA, 20 nt, Human
gugugggugcggggcuuucc

SEQ ID NO: 169380 - RNA, 18 nt, Human
guucgcacaaagauccac

SEQ ID NO: 169381 - RNA, 23 nt, Human
uaaaauucaagacaaaacauaac

SEQ ID NO: 169382 - RNA, 18 nt, Human
uacaaaaaaaaaaaaagg

SEQ ID NO: 169383 - RNA, 25 nt, Human
uacaccauuaauacugauaaacgga

SEQ ID NO: 169384 - RNA, 22 nt, Human
uacaguagagguugggagacag

SEQ ID NO: 169385 - RNA, 19 nt, Human
uagcagccaaaauacaaaa

SEQ ID NO: 169386 - RNA, 24 nt, Human
ucaaauacgugucacaaaugcugc

SEQ ID NO: 169387 - RNA, 26 nt, Human
ucaccgggccguccuagucccugcgu

SEQ ID NO: 169388 - RNA, 23 nt, Human
ucccccgccgccgccgccgccgc

SEQ ID NO: 169389 - RNA, 20 nt, Human
uccgcgcggucaccgggccg

SEQ ID NO: 169390 - RNA, 21 nt, Human
ucguucucggaccagaaaguu

SEQ ID NO: 169391 - RNA, 23 nt, Human
ucuaaaaauuuucccccacuucu

SEQ ID NO: 169392 - RNA, 21 nt, Human
ucuugugccgguccagggucc

SEQ ID NO: 169393 - RNA, 22 nt, Human
ugaaaaagucuaaauaaaauuc

SEQ ID NO: 169394 - RNA, 19 nt, Human
ugaagcgaaggaagaggag

SEQ ID NO: 169395 - RNA, 23 nt, Human
ugaagcgaaggaagaggaggaac

SEQ ID NO: 169396 - RNA, 20 nt, Human
ugaggaaggaggugccaacc

SEQ ID NO: 169397 - RNA, 24 nt, Human
ugaggaaggaggugccaaccgcag

SEQ ID NO: 169398 - RNA, 22 nt, Human
ugagggagugaggaaggaggug

SEQ ID NO: 169399 - RNA, 24 nt, Human
ugcuauaguuuuuaaaagugccuu

SEQ ID NO: 169400 - RNA, 18 nt, Human
uggaacccuuuucuucug

SEQ ID NO: 169401 - RNA, 18 nt, Human
uggaaggggacggaggcg

SEQ ID NO: 169402 - RNA, 21 nt, Human
uggauaucuaaaaaaaauucu

SEQ ID NO: 169403 - RNA, 19 nt, Human
uggggagggagaucgggag

SEQ ID NO: 169404 - RNA, 21 nt, Human
uggggagggagaucgggaggg

SEQ ID NO: 169405 - RNA, 19 nt, Human
ugucacaaaugcugcacuc

SEQ ID NO: 169406 - RNA, 18 nt, Human
uucauauuauauauauau

SEQ ID NO: 169407 - RNA, 22 nt, Human
uucuaaaaauuuucccccacuu

SEQ ID NO: 169408 - RNA, 18 nt, Human
uugauuauuagggaaaga

SEQ ID NO: 169409 - RNA, 18 nt, Human
uugccaaaaacuccgguu

SEQ ID NO: 169410 - RNA, 22 nt, Human
uuggccggaaggagggggaccu

SEQ ID NO: 169411 - RNA, 18 nt, Human
uuuacaauggauaucuaa

SEQ ID NO: 169412 - RNA, 21 nt, Human
uuuaggaaaaaauacacaaaa

SEQ ID NO: 169413 - RNA, 20 nt, Human
aacagugaccaacgcgaucc

SEQ ID NO: 169414 - RNA, 25 nt, Human
aagaggcuuucuugaaaucuugugc

SEQ ID NO: 169415 - RNA, 19 nt, Human
acaagaagaggcuuucuug

SEQ ID NO: 169416 - RNA, 21 nt, Human
acaauacugaaaaccacuuuc

SEQ ID NO: 169417 - RNA, 19 nt, Human
acacaaguuuucuuagaca

SEQ ID NO: 169418 - RNA, 20 nt, Human
agcggccaucgcuuggccuc

SEQ ID NO: 169419 - RNA, 24 nt, Human
auaagugcaaauauauccuccuuu

SEQ ID NO: 169420 - RNA, 22 nt, Human
auccuccuuuuaaaauacaagc

SEQ ID NO: 169421 - RNA, 26 nt, Human
caagaagaggcuuucuugaaaucuug

SEQ ID NO: 169422 - RNA, 18 nt, Human
cacacacacacacacaca

SEQ ID NO: 169423 - RNA, 27 nt, Human
cacacacacacacacacaacuugucug

SEQ ID NO: 169424 - RNA, 18 nt, Human
cagcaguaggcaaauaac

SEQ ID NO: 169425 - RNA, 19 nt, Human
cagcuaggcaacaagaaga

SEQ ID NO: 169426 - RNA, 19 nt, Human
cccagaagcccugcgagcg

SEQ ID NO: 169427 - RNA, 23 nt, Human
cccagaagcccugcgagcgcccu

SEQ ID NO: 169428 - RNA, 20 nt, Human
ccgcgagggcgggccccggg

SEQ ID NO: 169429 - RNA, 25 nt, Human
ccggagcggggucggcccagaagcc

SEQ ID NO: 169430 - RNA, 19 nt, Human
ccugcgagcgcccuagccc

SEQ ID NO: 169431 - RNA, 21 nt, Human
ccuuacgcauggcacaucuuc

SEQ ID NO: 169432 - RNA, 18 nt, Human
cuagcccgccgcccgggc

SEQ ID NO: 169433 - RNA, 20 nt, Human
cucugaggaggggagaggag

SEQ ID NO: 169434 - RNA, 19 nt, Human
cugaaggcaacgaagaucc

SEQ ID NO: 169435 - RNA, 21 nt, Human
gaaggcaacgaagaucccaca

SEQ ID NO: 169436 - RNA, 18 nt, Human
gacccgggagcgaggccg

SEQ ID NO: 169437 - RNA, 24 nt, Human
gcuaaguggcagguguguggcuua

SEQ ID NO: 169438 - RNA, 22 nt, Human
ggagcggggucggcccagaagc

SEQ ID NO: 169439 - RNA, 18 nt, Human
ggaggggagaggagagag

SEQ ID NO: 169440 - RNA, 22 nt, Human
uacugcuauccgcgugcaugug

SEQ ID NO: 169441 - RNA, 27 nt, Human
uagacacacacacacacacacaacuug

SEQ ID NO: 169442 - RNA, 22 nt, Human
ucccaccugagucugcccucuc

SEQ ID NO: 169443 - RNA, 24 nt, Human
uccuccuuuuaaaauacaagcaaa

SEQ ID NO: 169444 - RNA, 20 nt, Human
ucggcccagaagcccugcga

SEQ ID NO: 169445 - RNA, 19 nt, Human
ugaggaggggagaggagag

SEQ ID NO: 169446 - RNA, 18 nt, Human
uggugguagaaaacaacc

SEQ ID NO: 169447 - RNA, 21 nt, Human
ugucugcuuuuuucacacccu

SEQ ID NO: 169448 - RNA, 22 nt, Human
uucuuccagcaguaggcaaaua

SEQ ID NO: 169449 - RNA, 21 nt, Human
uucuuuggcaccuguauccaa

SEQ ID NO: 169450 - RNA, 21 nt, Human
uuucuugaaaucuugugcuua

SEQ ID NO: 169451 - RNA, 21 nt, Human
uuuggcaccuguauccaaaug

SEQ ID NO: 169452 - RNA, 31 nt, Human
uuuucuuagacacacacacacacacacagug

SEQ ID NO: 169453 - RNA, 18 nt, Human
aaacaacccuagagacug

SEQ ID NO: 169454 - RNA, 21 nt, Human
aaacaacccuagagacugaac

SEQ ID NO: 169455 - RNA, 30 nt, Human
aagaaaaaaaaacaguucuuuaaagaaaaa

SEQ ID NO: 169456 - RNA, 18 nt, Human
aagcagcaaccaccccuc

SEQ ID NO: 169457 - RNA, 24 nt, Human
aaguaaacaaaagaaaaaaaaaca

SEQ ID NO: 169458 - RNA, 22 nt, Human
aauuuuguccccuucugauuca

SEQ ID NO: 169459 - RNA, 20 nt, Human
acaacacaaacugaaggcaa

SEQ ID NO: 169460 - RNA, 19 nt, Human
acagcggcgcgcgggcggc

SEQ ID NO: 169461 - RNA, 18 nt, Human
acagucuggucccaggga

SEQ ID NO: 169462 - RNA, 24 nt, Human
acaucaaaauauacacaacacaaa

SEQ ID NO: 169463 - RNA, 22 nt, Human
accacauacaucaaaauauaca

SEQ ID NO: 169464 - RNA, 23 nt, Human
agacaacauuaacaaucacucaa

SEQ ID NO: 169465 - RNA, 22 nt, Human
agcaaaagcagcaaccaccccu

SEQ ID NO: 169466 - RNA, 21 nt, Human
aggcgcauuuucuagaaccca

SEQ ID NO: 169467 - RNA, 18 nt, Human
caagaaauuuuaagacaa

SEQ ID NO: 169468 - RNA, 18 nt, Human
cacaguaucacaaucaag

SEQ ID NO: 169469 - RNA, 23 nt, Human
cacuuacagucuggucccaggga

SEQ ID NO: 169470 - RNA, 23 nt, Human
cagcagcgcaguuggacgcaggc

SEQ ID NO: 169471 - RNA, 18 nt, Human
cauugcaccucgcugaca

SEQ ID NO: 169472 - RNA, 27 nt, Human
cauugcaccucgcugacacuccacacc

SEQ ID NO: 169473 - RNA, 18 nt, Human
ccgaacggggcgcggggg

SEQ ID NO: 169474 - RNA, 18 nt, Human
cggcgcgcgggcggcgcg

SEQ ID NO: 169475 - RNA, 18 nt, Human
cggcgcgggagcgggaca

SEQ ID NO: 169476 - RNA, 20 nt, Human
cggcggcggcggcgcgggag

SEQ ID NO: 169477 - RNA, 18 nt, Human
cgucggggggaaacggcg

SEQ ID NO: 169478 - RNA, 26 nt, Human
cuaaaaguaaacaaaagaaaaaaaaa

SEQ ID NO: 169479 - RNA, 19 nt, Human
cuacaauguauucucccca

SEQ ID NO: 169480 - RNA, 19 nt, Human
cucaggaauuaaaaaaaaa

SEQ ID NO: 169481 - RNA, 19 nt, Human
gaacaaacguacagaaaug

SEQ ID NO: 169482 - RNA, 20 nt, Human
gaacaaacguacagaaaugg

SEQ ID NO: 169483 - RNA, 21 nt, Human
gcggcagcggcggcacugagc

SEQ ID NO: 169484 - RNA, 21 nt, Human
gcggcgcgggagcgggacagc

SEQ ID NO: 169485 - RNA, 18 nt, Human
ggaaacggcggcggcggc

SEQ ID NO: 169486 - RNA, 18 nt, Human
ggaaacggcggcggcggc

SEQ ID NO: 169487 - RNA, 22 nt, Human
ggccaaaauaauuucuugggca

SEQ ID NO: 169488 - RNA, 21 nt, Human
gggacagcggcgcgcgggccg

SEQ ID NO: 169489 - RNA, 20 nt, Human
gggcgcgggggggcggcggg

SEQ ID NO: 169490 - RNA, 19 nt, Human
gggcggcagcggcggcacu

SEQ ID NO: 169491 - RNA, 20 nt, Human
gggggaaacggcggcggcgg

SEQ ID NO: 169492 - RNA, 24 nt, Human
gggggcggcgggcggcagcggcgg

SEQ ID NO: 169493 - RNA, 21 nt, Human
guaaacaaaagaaaaaaaaac

SEQ ID NO: 169494 - RNA, 24 nt, Human
uaaaagugaccuguuagugaccac

SEQ ID NO: 169495 - RNA, 21 nt, Human
uaaagaaaaggagaaaacaau

SEQ ID NO: 169496 - RNA, 18 nt, Human
uacacaacacaaacugaa

SEQ ID NO: 169497 - RNA, 19 nt, Human
uagcaaaagcagcaaccac

SEQ ID NO: 169498 - RNA, 19 nt, Human
uccccacauugcaccucgc

SEQ ID NO: 169499 - RNA, 19 nt, Human
ugccgaacggggcgcgggg

SEQ ID NO: 169500 - RNA, 25 nt, Human
ugggcaccuuuacuacgaaugcuuu

SEQ ID NO: 169501 - RNA, 19 nt, Human
uguagcaaaagcagcaacc

SEQ ID NO: 169502 - RNA, 23 nt, Human
uuguuagaauaauaaacaacccu

SEQ ID NO: 169503 - RNA, 18 nt, Human
uuuaaauacaaauuacag

SEQ ID NO: 169504 - RNA, 24 nt, Human
aaaaaaaaggaagcgcuuauccaa

SEQ ID NO: 169505 - RNA, 20 nt, Human
aaacagaagccuuaaccagu

SEQ ID NO: 169506 - RNA, 18 nt, Human
aaacugggcuuuacaaga

SEQ ID NO: 169507 - RNA, 20 nt, Human
aacauccaccucuccugggc

SEQ ID NO: 169508 - RNA, 23 nt, Human
aaccaauucuccauccuggccuc

SEQ ID NO: 169509 - RNA, 24 nt, Human
aagaaaacaaacaacacuucccag

SEQ ID NO: 169510 - RNA, 23 nt, Human
aagaaaauaagaaaacaaacaac

SEQ ID NO: 169511 - RNA, 24 nt, Human
aagcagaauaaggacuuggaccag

SEQ ID NO: 169512 - RNA, 18 nt, Human
aaugcugucucuccaugg

SEQ ID NO: 169513 - RNA, 20 nt, Human
accuggauuugacucuuagc

SEQ ID NO: 169514 - RNA, 23 nt, Human
acugcuuuucucucuggcauguc

SEQ ID NO: 169515 - RNA, 18 nt, Human
acugguccaugacaugca

SEQ ID NO: 169516 - RNA, 21 nt, Human
acugguccaugacaugcacac

SEQ ID NO: 169517 - RNA, 20 nt, Human
agacccccugugaggguggg

SEQ ID NO: 169518 - RNA, 23 nt, Human
agcaccugccacuguuagugcug

SEQ ID NO: 169519 - RNA, 19 nt, Human
agggccaccagggcugagu

SEQ ID NO: 169520 - RNA, 21 nt, Human
caaaaacaaggagaaauccca

SEQ ID NO: 169521 - RNA, 21 nt, Human
caaaaggagugucugcaggua

SEQ ID NO: 169522 - RNA, 22 nt, Human
cacacaggaaacugggcuuuac

SEQ ID NO: 169523 - RNA, 18 nt, Human
cacaccacuccucucacu

SEQ ID NO: 169524 - RNA, 21 nt, Human
cagaauaaggacuuggaccag

SEQ ID NO: 169525 - RNA, 22 nt, Human
cagacaaacauccaccucuccu

SEQ ID NO: 169526 - RNA, 24 nt, Human
cagcaccugccacuguuagugcug

SEQ ID NO: 169527 - RNA, 23 nt, Human
ccaauucuccauccuggccucca

SEQ ID NO: 169528 - RNA, 20 nt, Human
ccaccguggggcuggcaugg

SEQ ID NO: 169529 - RNA, 20 nt, Human
cccaagagaucacacagaga

SEQ ID NO: 169530 - RNA, 24 nt, Human
cuccugggcuaaaaaaaaggaagc

SEQ ID NO: 169531 - RNA, 21 nt, Human
cucucuggcauguccaccugg

SEQ ID NO: 169532 - RNA, 23 nt, Human
cugcuuuucucucuggcaugucc

SEQ ID NO: 169533 - RNA, 22 nt, Human
cuggggugggaggauuuagggg

SEQ ID NO: 169534 - RNA, 25 nt, Human
gaaaacaaacaacacuucccaggua

SEQ ID NO: 169535 - RNA, 24 nt, Human
gaaaauaagaaaacaaacaacacu

SEQ ID NO: 169536 - RNA, 24 nt, Human
gcccaaggccccucccuugaggcc

SEQ ID NO: 169537 - RNA, 24 nt, Human
gcuauauuugccauagcaagcuuu

SEQ ID NO: 169538 - RNA, 20 nt, Human
ggaaauguuacuuaaccucc

SEQ ID NO: 169539 - RNA, 22 nt, Human
ggagaaaucccaagagaucaca

SEQ ID NO: 169540 - RNA, 20 nt, Human
ggagccaccugccuggcacc

SEQ ID NO: 169541 - RNA, 21 nt, Human
gggaugcaucgcacaugucag

SEQ ID NO: 169542 - RNA, 19 nt, Human
gggcugggcuggccggagc

SEQ ID NO: 169543 - RNA, 18 nt, Human
gguggauuccucggaggc

SEQ ID NO: 169544 - RNA, 22 nt, Human
gucugugugugggccuaugugu

SEQ ID NO: 169545 - RNA, 23 nt, Human
uagcaagcuuuucacacugaccu

SEQ ID NO: 169546 - RNA, 22 nt, Human
ucaagguuucuggagggcuggg

SEQ ID NO: 169547 - RNA, 21 nt, Human
uccaccucuccugggcuaaaa

SEQ ID NO: 169548 - RNA, 19 nt, Human
ucccuggaucugcucaagg

SEQ ID NO: 169549 - RNA, 21 nt, Human
ucccuggaucugcucaagguu

SEQ ID NO: 169550 - RNA, 25 nt, Human
ucccuggaucugcucaagguuucug

SEQ ID NO: 169551 - RNA, 26 nt, Human
uccgcagucauggaccaccguggggc

SEQ ID NO: 169552 - RNA, 20 nt, Human
uccugcacuaaggccacugg

SEQ ID NO: 169553 - RNA, 24 nt, Human
ucggaggcuccugcuuaugucugg

SEQ ID NO: 169554 - RNA, 23 nt, Human
ucucuggcauguccaccuggcuc

SEQ ID NO: 169555 - RNA, 22 nt, Human
ucucuuggaagauucagccauc

SEQ ID NO: 169556 - RNA, 22 nt, Human
ucugcucaagguuucuggaggg

SEQ ID NO: 169557 - RNA, 21 nt, Human
ucugugugugggccuaugugu

SEQ ID NO: 169558 - RNA, 21 nt, Human
ugagccucaguuccucaucug

SEQ ID NO: 169559 - RNA, 23 nt, Human
ugcaaaguuggugagucugugug

SEQ ID NO: 169560 - RNA, 23 nt, Human
ugccacuguuagugcugcucuuc

SEQ ID NO: 169561 - RNA, 18 nt, Human
ugccuggcaccugcaccc

SEQ ID NO: 169562 - RNA, 19 nt, Human
uggcauguccaccuggcuc

SEQ ID NO: 169563 - RNA, 19 nt, Human
uggcuacucaaccaauucu

SEQ ID NO: 169564 - RNA, 25 nt, Human
ugggcuuuacaagauuuuacagaug

SEQ ID NO: 169565 - RNA, 19 nt, Human
uggggugggaggauuuagg

SEQ ID NO: 169566 - RNA, 28 nt, Human
uggggugguuugugaaccuuacggggug

SEQ ID NO: 169567 - RNA, 20 nt, Human
ugucugggcaguuccgcagu

SEQ ID NO: 169568 - RNA, 19 nt, Human
uuccucaucuguucaaugg

SEQ ID NO: 169569 - RNA, 20 nt, Human
uugaggccauuguuuucuca

SEQ ID NO: 169570 - RNA, 19 nt, Human
uugagugguagcaaaagga

SEQ ID NO: 169571 - RNA, 23 nt, Human
uuucucagacaaacauccaccuc

SEQ ID NO: 169572 - RNA, 19 nt, Human
uuucuggagggcuggggag

SEQ ID NO: 169573 - RNA, 22 nt, Human
aaaaaaaaauagaaaagaccug

SEQ ID NO: 169574 - RNA, 18 nt, Human
aaaaaaacuaccagaggc

SEQ ID NO: 169575 - RNA, 21 nt, Human
aaacaaaaaaaaauagaaaag

SEQ ID NO: 169576 - RNA, 24 nt, Human
aaacagguaguacaaacaaaaguu

SEQ ID NO: 169577 - RNA, 18 nt, Human
aaaccacucaagucccau

SEQ ID NO: 169578 - RNA, 21 nt, Human
aaacuaccagaggccacauaa

SEQ ID NO: 169579 - RNA, 25 nt, Human
aacaagagcaaagaauuaugagggg

SEQ ID NO: 169580 - RNA, 23 nt, Human
aaccacucaagucccauuuuuaa

SEQ ID NO: 169581 - RNA, 21 nt, Human
aagaaagacaccaagccauuu

SEQ ID NO: 169582 - RNA, 28 nt, Human
aagaacacaagaggaacagugcugugca

SEQ ID NO: 169583 - RNA, 20 nt, Human
aagagggggagaacgcagca

SEQ ID NO: 169584 - RNA, 24 nt, Human
aagcagaugaaauuucuuuaaaau

SEQ ID NO: 169585 - RNA, 23 nt, Human
aagucccaacaauaacaucaaaa

SEQ ID NO: 169586 - RNA, 21 nt, Human
aauggagauucaguucuuugu

SEQ ID NO: 169587 - RNA, 20 nt, Human
acaaagcaaucauguacaau

SEQ ID NO: 169588 - RNA, 22 nt, Human
acaggaaaaaaacuaccagagg

SEQ ID NO: 169589 - RNA, 18 nt, Human
accagggccugaaacguu

SEQ ID NO: 169590 - RNA, 18 nt, Human
acccccgccccuccccca

SEQ ID NO: 169591 - RNA, 22 nt, Human
accuccaccuggacugaaacaa

SEQ ID NO: 169592 - RNA, 26 nt, Human
agaaaaaccaaaaacacacacaaaua

SEQ ID NO: 169593 - RNA, 19 nt, Human
agaaaacagguaguacaaa

SEQ ID NO: 169594 - RNA, 20 nt, Human
agaaaacagguaguacaaac

SEQ ID NO: 169595 - RNA, 20 nt, Human
agaccuguacaaagcuggca

SEQ ID NO: 169596 - RNA, 19 nt, Human
agagguauaauuacccaga

SEQ ID NO: 169597 - RNA, 20 nt, Human
agaggucucuagagaagacu

SEQ ID NO: 169598 - RNA, 22 nt, Human
agcggacggaaacugggaggaa

SEQ ID NO: 169599 - RNA, 19 nt, Human
aggaacacuuguguucuug

SEQ ID NO: 169600 - RNA, 26 nt, Human
aggcagaacuacaaaaccaaccucca

SEQ ID NO: 169601 - RNA, 18 nt, Human
agggggcgcgaagggacg

SEQ ID NO: 169602 - RNA, 21 nt, Human
auaggacacaaagccaauuaa

SEQ ID NO: 169603 - RNA, 19 nt, Human
aucaaaaucccucguuuga

SEQ ID NO: 169604 - RNA, 19 nt, Human
aucccucguuugacaaagg

SEQ ID NO: 169605 - RNA, 23 nt, Human
augcaauuaacauacaagacaaa

SEQ ID NO: 169606 - RNA, 24 nt, Human
auggagaugcagaauggagauuca

SEQ ID NO: 169607 - RNA, 21 nt, Human
auggcacaguccuuaucuaca

SEQ ID NO: 169608 - RNA, 23 nt, Human
caaaaaaaaauagaaaagaccug

SEQ ID NO: 169609 - RNA, 27 nt, Human
caaaauggugaaguggaucaaaauccc

SEQ ID NO: 169610 - RNA, 21 nt, Human
caaagcaagugugaugugggc

SEQ ID NO: 169611 - RNA, 21 nt, Human
caaccuccaccuggacugaaa

SEQ ID NO: 169612 - RNA, 21 nt, Human
caagacaaagcaagugugaug

SEQ ID NO: 169613 - RNA, 22 nt, Human
caagaggaacagugcugugcac

SEQ ID NO: 169614 - RNA, 20 nt, Human
caauuauagcaaagauuguu

SEQ ID NO: 169615 - RNA, 27 nt, Human
cacacacaaauacaaucuguaucuacu

SEQ ID NO: 169616 - RNA, 21 nt, Human
caccuggacugaaacaagagc

SEQ ID NO: 169617 - RNA, 23 nt, Human
cagaacuacaaaaccaaccucca

SEQ ID NO: 169618 - RNA, 24 nt, Human
cagaacuuaacuucgcggggccau

SEQ ID NO: 169619 - RNA, 26 nt, Human
caugugaauucuguggcaacgugaac

SEQ ID NO: 169620 - RNA, 19 nt, Human
ccaagagggggagaacgca

SEQ ID NO: 169621 - RNA, 19 nt, Human
ccaagccaaugaagaugca

SEQ ID NO: 169622 - RNA, 20 nt, Human
ccaaggcuguucaauggaga

SEQ ID NO: 169623 - RNA, 22 nt, Human
ccacacugccaggcugugccca

SEQ ID NO: 169624 - RNA, 20 nt, Human
cccaccucaaggagaggcca

SEQ ID NO: 169625 - RNA, 19 nt, Human
cccccagccgcaggagagc

SEQ ID NO: 169626 - RNA, 20 nt, Human
cccccgccccucccccagcc

SEQ ID NO: 169627 - RNA, 22 nt, Human
cccuccuuccacuuaaacuucc

SEQ ID NO: 169628 - RNA, 24 nt, Human
ccgggccggggcagagccugcgcc

SEQ ID NO: 169629 - RNA, 25 nt, Human
ccugcacacauugggcaaacauccu

SEQ ID NO: 169630 - RNA, 20 nt, Human
cgaaaggaaaaaaaggaggg

SEQ ID NO: 169631 - RNA, 19 nt, Human
cgcacggacuggacggccg

SEQ ID NO: 169632 - RNA, 23 nt, Human
cgcuugcucuccccagcggcgcg

SEQ ID NO: 169633 - RNA, 20 nt, Human
cggcgcgcccgcugcgcugc

SEQ ID NO: 169634 - RNA, 20 nt, Human
cuaaaaccagaaaagaaacu

SEQ ID NO: 169635 - RNA, 24 nt, Human
cuaaaaccagaaaagaaacuucuc

SEQ ID NO: 169636 - RNA, 19 nt, Human
cuaaauaggacacaaagcc

SEQ ID NO: 169637 - RNA, 23 nt, Human
cugcacacauugggcaaacaucc

SEQ ID NO: 169638 - RNA, 21 nt, Human
cuuccacuuaaacuuccacag

SEQ ID NO: 169639 - RNA, 25 nt, Human
gaaaaaccaaaaacacacacaaaua

SEQ ID NO: 169640 - RNA, 24 nt, Human
gaacaaaugggggcucugagguuc

SEQ ID NO: 169641 - RNA, 18 nt, Human
gacuugaaaauacugaug

SEQ ID NO: 169642 - RNA, 18 nt, Human
gagccugcgccgcgcucc

SEQ ID NO: 169643 - RNA, 23 nt, Human
gaguaucggaacaagaacgugga

SEQ ID NO: 169644 - RNA, 24 nt, Human
gcagaaaacagguaguacaaacaa

SEQ ID NO: 169645 - RNA, 18 nt, Human
gcgcccgcugcgcugcug

SEQ ID NO: 169646 - RNA, 18 nt, Human
gcgcuccagcugacaggg

SEQ ID NO: 169647 - RNA, 22 nt, Human
gcggcgcgcccgcugcgcugcu

SEQ ID NO: 169648 - RNA, 19 nt, Human
gcuccagcugacagggccg

SEQ ID NO: 169649 - RNA, 18 nt, Human
ggaaacugggaggaaggc

SEQ ID NO: 169650 - RNA, 23 nt, Human
ggaaggacggacggacgccgcgg

SEQ ID NO: 169651 - RNA, 19 nt, Human
ggaggaaggcgcggcggag

SEQ ID NO: 169652 - RNA, 21 nt, Human
ggcaugacuacguccugaugg

SEQ ID NO: 169653 - RNA, 19 nt, Human
ggccagagccgccgggccg

SEQ ID NO: 169654 - RNA, 19 nt, Human
gggagggggcgcgaaggga

SEQ ID NO: 169655 - RNA, 19 nt, Human
gggcagagccugcgccgcg

SEQ ID NO: 169656 - RNA, 23 nt, Human
gggcagagccugcgccgcgcucc

SEQ ID NO: 169657 - RNA, 18 nt, Human
gggcggacggggaggggg

SEQ ID NO: 169658 - RNA, 22 nt, Human
gggcucugagguuccuuguauu

SEQ ID NO: 169659 - RNA, 23 nt, Human
gucagaaacaucacuaaguagca

SEQ ID NO: 169660 - RNA, 24 nt, Human
guccaaggcuguucaauggagaug

SEQ ID NO: 169661 - RNA, 18 nt, Human
uaaaaccagaaaagaaac

SEQ ID NO: 169662 - RNA, 18 nt, Human
uaaaaccagcuaugucuu

SEQ ID NO: 169663 - RNA, 22 nt, Human
uaaacaaaaaaaaauagaaaag

SEQ ID NO: 169664 - RNA, 23 nt, Human
uaaacaaaaaaaaauagaaaaga

SEQ ID NO: 169665 - RNA, 19 nt, Human
uaaauaggacacaaagcca

SEQ ID NO: 169666 - RNA, 20 nt, Human
uaaauucccuccuuccacuu

SEQ ID NO: 169667 - RNA, 25 nt, Human
uaacaaaauaaacaaaaaaaaauag

SEQ ID NO: 169668 - RNA, 27 nt, Human
uaacuuaucaagacaugaggccaaugg

SEQ ID NO: 169669 - RNA, 21 nt, Human
uaagaaacgcaaaguguccau

SEQ ID NO: 169670 - RNA, 18 nt, Human
uaagauuagucagaaaca

SEQ ID NO: 169671 - RNA, 25 nt, Human
uaagucccaacaauaacaucaaaaa

SEQ ID NO: 169672 - RNA, 24 nt, Human
uacaaaaccaaccuccaccuggac

SEQ ID NO: 169673 - RNA, 24 nt, Human
uacaaaaccaaccuccaccuggac

SEQ ID NO: 169674 - RNA, 24 nt, Human
uacaaaacuugaaagcacaccagg

SEQ ID NO: 169675 - RNA, 24 nt, Human
uacaggaaaaaugucuuugcugcc

SEQ ID NO: 169676 - RNA, 18 nt, Human
uacaggcuaaagaaauuu

SEQ ID NO: 169677 - RNA, 25 nt, Human
uaccagaggccacauaauguuugcu

SEQ ID NO: 169678 - RNA, 21 nt, Human
uacuccaugaaguaguaagau

SEQ ID NO: 169679 - RNA, 18 nt, Human
uagaauacaaaaugaaaa

SEQ ID NO: 169680 - RNA, 21 nt, Human
uagagugguggcuguucaaug

SEQ ID NO: 169681 - RNA, 25 nt, Human
uagagugguggcuguucaaugaauc

SEQ ID NO: 169682 - RNA, 27 nt, Human
uagagugguggcuguucaaugaaucuu

SEQ ID NO: 169683 - RNA, 19 nt, Human
uaggaaauaccaagccaau

SEQ ID NO: 169684 - RNA, 19 nt, Human
uaguuauaaauuaagaacu

SEQ ID NO: 169685 - RNA, 25 nt, Human
uaucuacugcuuauauacaaaacuu

SEQ ID NO: 169686 - RNA, 19 nt, Human
ucagagagcuaccaaggau

SEQ ID NO: 169687 - RNA, 19 nt, Human
ucaguuccgcagaaaacag

SEQ ID NO: 169688 - RNA, 19 nt, Human
ucauuuagacuuugucagu

SEQ ID NO: 169689 - RNA, 23 nt, Human
uccaaaaguuuaacaaguccauu

SEQ ID NO: 169690 - RNA, 23 nt, Human
uccacaugacuugaaaauacuga

SEQ ID NO: 169691 - RNA, 19 nt, Human
uccacaugacuugaaaauu

SEQ ID NO: 169692 - RNA, 24 nt, Human
uccgccgcacggacuggacggccg

SEQ ID NO: 169693 - RNA, 21 nt, Human
ucuacaaacauuaugaggccu

SEQ ID NO: 169694 - RNA, 19 nt, Human
ucuacaaaccacucaaguc

SEQ ID NO: 169695 - RNA, 23 nt, Human
ucuauaauacaauaugcuuuuaa

SEQ ID NO: 169696 - RNA, 23 nt, Human
ucugaaaaucuuuucugcaauua

SEQ ID NO: 169697 - RNA, 25 nt, Human
ugaaacaagagcaaagaagggaggc

SEQ ID NO: 169698 - RNA, 21 nt, Human
ugaaacaagagcaaagaauua

SEQ ID NO: 169699 - RNA, 23 nt, Human
ugaaagcacaccaggaucugaaa

SEQ ID NO: 169700 - RNA, 27 nt, Human
ugaaauuuccaauggcacaguccuuau

SEQ ID NO: 169701 - RNA, 18 nt, Human
ugaaguggaucaaaaucc

SEQ ID NO: 169702 - RNA, 22 nt, Human
ugaaguggaucaaaaucccucg

SEQ ID NO: 169703 - RNA, 21 nt, Human
ugaaugcugccccaaauaccu

SEQ ID NO: 169704 - RNA, 18 nt, Human
ugacccccgccccucccc

SEQ ID NO: 169705 - RNA, 21 nt, Human
ugaguuuggcacuucauugua

SEQ ID NO: 169706 - RNA, 25 nt, Human
ugaucuacaaacauuaugaggccuc

SEQ ID NO: 169707 - RNA, 23 nt, Human
ugccuuucccuggacuucacugu

SEQ ID NO: 169708 - RNA, 21 nt, Human
ugcucauuuagacuuugucag

SEQ ID NO: 169709 - RNA, 24 nt, Human
ugcugccccaaauaccugugguuc

SEQ ID NO: 169710 - RNA, 21 nt, Human
uggaagcgcgagcccagaacu

SEQ ID NO: 169711 - RNA, 18 nt, Human
uggcacgggaggaaagug

SEQ ID NO: 169712 - RNA, 22 nt, Human
uggcacgggaggaaagugacag

SEQ ID NO: 169713 - RNA, 22 nt, Human
uggccacacugccaggcugugc

SEQ ID NO: 169714 - RNA, 19 nt, Human
ugggggcucugagguuccu

SEQ ID NO: 169715 - RNA, 23 nt, Human
uguucgcauaaaccacaauacau

SEQ ID NO: 169716 - RNA, 18 nt, Human
uuacugcucacugggaua

SEQ ID NO: 169717 - RNA, 24 nt, Human
uuagguugcuacaggcuaaagaaa

SEQ ID NO: 169718 - RNA, 22 nt, Human
uucccaaacuaaaaccagaaaa

SEQ ID NO: 169719 - RNA, 19 nt, Human
uucuuugugauccgucagu

SEQ ID NO: 169720 - RNA, 19 nt, Human
uuuaaccaagaaaacuaaa

SEQ ID NO: 169721 - RNA, 24 nt, Human
uuuaauaacaguacaaaccagaga

SEQ ID NO: 169722 - RNA, 19 nt, Human
uuuuccaaaaguuuaacaa

SEQ ID NO: 169723 - RNA, 20 nt, Human
aaaaaagccagcacagaaaa

SEQ ID NO: 169724 - RNA, 22 nt, Human
aaaaagaagggaaaacucagaa

SEQ ID NO: 169725 - RNA, 20 nt, Human
aaaaauuaggaagauucaaa

SEQ ID NO: 169726 - RNA, 18 nt, Human
agaaaacaguauaaaaag

SEQ ID NO: 169727 - RNA, 19 nt, Human
agaaaacaguauaaaaaga

SEQ ID NO: 169728 - RNA, 20 nt, Human
aguuuguuaaagagaugaaa

SEQ ID NO: 169729 - RNA, 21 nt, Human
auuugucaaauauucaugguu

SEQ ID NO: 169730 - RNA, 18 nt, Human
caaaaaagccagcacaga

SEQ ID NO: 169731 - RNA, 26 nt, Human
cagaaaacaguauaaaaagaagggaa

SEQ ID NO: 169732 - RNA, 19 nt, Human
cagcacagaaaacaguaua

SEQ ID NO: 169733 - RNA, 22 nt, Human
ccagcacagaaaacaguauaaa

SEQ ID NO: 169734 - RNA, 22 nt, Human
ggaaaacucagaagcuagcuca

SEQ ID NO: 169735 - RNA, 20 nt, Human
gguacugaaucccaaagggc

SEQ ID NO: 169736 - RNA, 21 nt, Human
uaggaagauucaaaaaagcca

SEQ ID NO: 169737 - RNA, 22 nt, Human
uaggaagauucaaaaaagccag

SEQ ID NO: 169738 - RNA, 25 nt, Human
uucccgguuucaacuucauaggagu

SEQ ID NO: 169739 - RNA, 22 nt, Human
aaaaagacauccucucccggcc

SEQ ID NO: 169740 - RNA, 24 nt, Human
aaacaaaaggcaccuaguauguaa

SEQ ID NO: 169741 - RNA, 23 nt, Human
aaagacauccucucccggccucc

SEQ ID NO: 169742 - RNA, 21 nt, Human
aacggccaggccacugcaaca

SEQ ID NO: 169743 - RNA, 18 nt, Human
aagaggaaggagagacca

SEQ ID NO: 169744 - RNA, 23 nt, Human
aagccaaaaacaaaaggcaccua

SEQ ID NO: 169745 - RNA, 21 nt, Human
aagcccuggccccuaggccag

SEQ ID NO: 169746 - RNA, 22 nt, Human
aagcucccaccuccaaccccgg

SEQ ID NO: 169747 - RNA, 22 nt, Human
aaucuaccacccagcacauggg

SEQ ID NO: 169748 - RNA, 21 nt, Human
acaauaagcugggccugagcc

SEQ ID NO: 169749 - RNA, 22 nt, Human
acaccacccaccaggugcaggc

SEQ ID NO: 169750 - RNA, 23 nt, Human
acagagccuuaaaaaagacaucc

SEQ ID NO: 169751 - RNA, 18 nt, Human
acagugagagacccgggg

SEQ ID NO: 169752 - RNA, 26 nt, Human
accauggcgguccugccgcugcagcc

SEQ ID NO: 169753 - RNA, 22 nt, Human
acccagcacauggcaagaccca

SEQ ID NO: 169754 - RNA, 21 nt, Human
accccgggccuuggcuacugg

SEQ ID NO: 169755 - RNA, 21 nt, Human
accgcuggugcucccccucca

SEQ ID NO: 169756 - RNA, 22 nt, Human
agaaccaggaaagccaaaaaca

SEQ ID NO: 169757 - RNA, 22 nt, Human
agacagaaccaggaaagccaaa

SEQ ID NO: 169758 - RNA, 19 nt, Human
agacaggcugaacggccag

SEQ ID NO: 169759 - RNA, 21 nt, Human
agacaggcugaacggccaggc

SEQ ID NO: 169760 - RNA, 26 nt, Human
agaccaaggcacagagccuuaaaaaa

SEQ ID NO: 169761 - RNA, 21 nt, Human
agacguggaaggccaugagug

SEQ ID NO: 169762 - RNA, 21 nt, Human
agcacagugaaggcagggaca

SEQ ID NO: 169763 - RNA, 18 nt, Human
agcauugaagagcaagac

SEQ ID NO: 169764 - RNA, 18 nt, Human
agccaggaggcaggcggg

SEQ ID NO: 169765 - RNA, 21 nt, Human
agccaggaggcaggcggggug

SEQ ID NO: 169766 - RNA, 19 nt, Human
agcucccaccuccaacccc

SEQ ID NO: 169767 - RNA, 19 nt, Human
aggaaagccaaaaacaaaa

SEQ ID NO: 169768 - RNA, 19 nt, Human
aggaagacguggaaggcca

SEQ ID NO: 169769 - RNA, 24 nt, Human
aggaggcccuuugggggacuaggu

SEQ ID NO: 169770 - RNA, 21 nt, Human
aggcaggcgggguguuggggg

SEQ ID NO: 169771 - RNA, 20 nt, Human
aggcaugugaaaugcagcug

SEQ ID NO: 169772 - RNA, 20 nt, Human
aggcccagggucagcggcgg

SEQ ID NO: 169773 - RNA, 23 nt, Human
aggcccucucccuucccagaagg

SEQ ID NO: 169774 - RNA, 22 nt, Human
aggcggcguuggaccgcugguc

SEQ ID NO: 169775 - RNA, 22 nt, Human
aggcggcguuggaccgcuggug

SEQ ID NO: 169776 - RNA, 24 nt, Human
aggcggcguuggaccgcuggugcu

SEQ ID NO: 169777 - RNA, 19 nt, Human
aggcugccagugacuagca

SEQ ID NO: 169778 - RNA, 24 nt, Human
agggagcuggcacugcaggugugg

SEQ ID NO: 169779 - RNA, 23 nt, Human
aggggcagcugccacaggagccc

SEQ ID NO: 169780 - RNA, 19 nt, Human
aucggacacagguauagag

SEQ ID NO: 169781 - RNA, 21 nt, Human
caaacuggcagggcugcagca

SEQ ID NO: 169782 - RNA, 24 nt, Human
cacccucugucccgcaguguccca

SEQ ID NO: 169783 - RNA, 19 nt, Human
caccugcguccggcccggc

SEQ ID NO: 169784 - RNA, 21 nt, Human
cacugccagguccaccuucuc

SEQ ID NO: 169785 - RNA, 21 nt, Human
cagaaccaggaaagccaaaaa

SEQ ID NO: 169786 - RNA, 23 nt, Human
cagcagcuucagcagggccgccg

SEQ ID NO: 169787 - RNA, 18 nt, Human
cagccacccucugucccg

SEQ ID NO: 169788 - RNA, 19 nt, Human
cagccagcagugggccagc

SEQ ID NO: 169789 - RNA, 21 nt, Human
cagcgcacgcaggccugcgcg

SEQ ID NO: 169790 - RNA, 23 nt, Human
cagcggcggccccccuuccucga

SEQ ID NO: 169791 - RNA, 19 nt, Human
cagcugcaaggccaaggcg

SEQ ID NO: 169792 - RNA, 24 nt, Human
caggacaccacccaccaggugcag

SEQ ID NO: 169793 - RNA, 18 nt, Human
caggaggcaggcggggug

SEQ ID NO: 169794 - RNA, 21 nt, Human
cagugcgggcuccagcagcuu

SEQ ID NO: 169795 - RNA, 18 nt, Human
ccaaccccgggccuuggc

SEQ ID NO: 169796 - RNA, 27 nt, Human
ccaagagaggagacuccgcacaccaca

SEQ ID NO: 169797 - RNA, 23 nt, Human
ccacccagcacauggcaagaccc

SEQ ID NO: 169798 - RNA, 18 nt, Human
ccaccgcucggcaucucg

SEQ ID NO: 169799 - RNA, 23 nt, Human
ccaccuccaccacugccaggucc

SEQ ID NO: 169800 - RNA, 24 nt, Human
ccacuccguguuccgaagcccgag

SEQ ID NO: 169801 - RNA, 22 nt, Human
ccacugcaacagugagagaccc

SEQ ID NO: 169802 - RNA, 23 nt, Human
ccaggcagaggcccucucccuuc

SEQ ID NO: 169803 - RNA, 22 nt, Human
ccaggcagcgcacacaauaagc

SEQ ID NO: 169804 - RNA, 22 nt, Human
ccagucuagacagaaccaggaa

SEQ ID NO: 169805 - RNA, 28 nt, Human
cccaccuccaccacugccaaccccuagg

SEQ ID NO: 169806 - RNA, 19 nt, Human
cccacugugagccacaggg

SEQ ID NO: 169807 - RNA, 24 nt, Human
ccccgguagcauugaagagcaaga

SEQ ID NO: 169808 - RNA, 24 nt, Human
ccccucugcuaucucagccaagag

SEQ ID NO: 169809 - RNA, 24 nt, Human
cccgcagugucccaggcagaggcc

SEQ ID NO: 169810 - RNA, 25 nt, Human
cccgcgccgcagcaccugcguccgg

SEQ ID NO: 169811 - RNA, 18 nt, Human
ccgcgccgcagcaccugc

SEQ ID NO: 169812 - RNA, 22 nt, Human
ccuaggccagucuagacagaac

SEQ ID NO: 169813 - RNA, 18 nt, Human
ccuccaaccccgggccuu

SEQ ID NO: 169814 - RNA, 20 nt, Human
ccucugucccgcaguguccc

SEQ ID NO: 169815 - RNA, 24 nt, Human
ccucugucccgcagugucccaggc

SEQ ID NO: 169816 - RNA, 18 nt, Human
ccugcgcgcugcuggcgg

SEQ ID NO: 169817 - RNA, 25 nt, Human
ccuggccccuaggccagucuagaca

SEQ ID NO: 169818 - RNA, 19 nt, Human
cgccuggcggaaccagcgc

SEQ ID NO: 169819 - RNA, 20 nt, Human
cggcccugcagcgccuggcg

SEQ ID NO: 169820 - RNA, 21 nt, Human
cuccaaccccgggccuuggcc

SEQ ID NO: 169821 - RNA, 21 nt, Human
cuccagcagcuucaggacacc

SEQ ID NO: 169822 - RNA, 22 nt, Human
cucccaccuccaaccccgggcc

SEQ ID NO: 169823 - RNA, 23 nt, Human
cucccaucccaaagcccuggccc

SEQ ID NO: 169824 - RNA, 25 nt, Human
cucccggccucccaucccaaagccc

SEQ ID NO: 169825 - RNA, 20 nt, Human
cucugggcugggggcacucc

SEQ ID NO: 169826 - RNA, 20 nt, Human
cugcguugccuguggaugac

SEQ ID NO: 169827 - RNA, 20 nt, Human
cuggaacacaggugccaggg

SEQ ID NO: 169828 - RNA, 21 nt, Human
cuggcacugcagguguggggu

SEQ ID NO: 169829 - RNA, 18 nt, Human
cuggccccuaggccaguc

SEQ ID NO: 169830 - RNA, 25 nt, Human
gaagagcaagacucgaaccucgggg

SEQ ID NO: 169831 - RNA, 20 nt, Human
gacccagggccuggccaggc

SEQ ID NO: 169832 - RNA, 21 nt, Human
gacccggggagccccucugcu

SEQ ID NO: 169833 - RNA, 19 nt, Human
gacuagcacauggauggca

SEQ ID NO: 169834 - RNA, 19 nt, Human
gaggcugguguggucgaug

SEQ ID NO: 169835 - RNA, 25 nt, Human
gaggggcccgcgccgcagcaccugc

SEQ ID NO: 169836 - RNA, 19 nt, Human
gcagcaccugcguccggcc

SEQ ID NO: 169837 - RNA, 18 nt, Human
gcagcagcuucagcaggg

SEQ ID NO: 169838 - RNA, 19 nt, Human
gcagcuucaggacaccacc

SEQ ID NO: 169839 - RNA, 22 nt, Human
gcagugucccaggcagaggccc

SEQ ID NO: 169840 - RNA, 19 nt, Human
gccagucuagacagaaccg

SEQ ID NO: 169841 - RNA, 19 nt, Human
gcccgagccgcauguggga

SEQ ID NO: 169842 - RNA, 23 nt, Human
gcccugcagcgccuggcggaacc

SEQ ID NO: 169843 - RNA, 23 nt, Human
gcccuuugggggacuagguggcu

SEQ ID NO: 169844 - RNA, 24 nt, Human
gccgcagcaccugcguccggcccg

SEQ ID NO: 169845 - RNA, 23 nt, Human
gccucccaucccaaagcccuggc

SEQ ID NO: 169846 - RNA, 22 nt, Human
gcggacccaccgggcucugggc

SEQ ID NO: 169847 - RNA, 22 nt, Human
gcucccaccuccaaccccgggc

SEQ ID NO: 169848 - RNA, 28 nt, Human
gcuggaacacaggugccaggggcagucu

SEQ ID NO: 169849 - RNA, 18 nt, Human
gcuggcacugcaggugug

SEQ ID NO: 169850 - RNA, 19 nt, Human
gcuucaggacaccacccac

SEQ ID NO: 169851 - RNA, 24 nt, Human
ggacaugagaucugcugggcucgg

SEQ ID NO: 169852 - RNA, 23 nt, Human
ggcacagagccuuaaaaaagaca

SEQ ID NO: 169853 - RNA, 22 nt, Human
gggaagcucccaccuccaaccc

SEQ ID NO: 169854 - RNA, 18 nt, Human
gggccaccgcucggcauc

SEQ ID NO: 169855 - RNA, 21 nt, Human
gggguguugggggagacaggc

SEQ ID NO: 169856 - RNA, 20 nt, Human
ggguguugggggagacaggc

SEQ ID NO: 169857 - RNA, 18 nt, Human
ggucccucagcacugcca

SEQ ID NO: 169858 - RNA, 19 nt, Human
guccaggugguuccagugc

SEQ ID NO: 169859 - RNA, 20 nt, Human
guccaggugguuccagugcu

SEQ ID NO: 169860 - RNA, 18 nt, Human
gugaggaggcccuuuggg

SEQ ID NO: 169861 - RNA, 21 nt, Human
gugcagucauaagccccgcca

SEQ ID NO: 169862 - RNA, 23 nt, Human
gugugggguggguggggcgccag

SEQ ID NO: 169863 - RNA, 19 nt, Human
uaaagaugcccccuuucug

SEQ ID NO: 169864 - RNA, 21 nt, Human
uaagcugggccugagccagga

SEQ ID NO: 169865 - RNA, 19 nt, Human
ucagccaagaggaaggaga

SEQ ID NO: 169866 - RNA, 18 nt, Human
uccagcagcuucaggaca

SEQ ID NO: 169867 - RNA, 18 nt, Human
ucccaaagcccuggcccc

SEQ ID NO: 169868 - RNA, 26 nt, Human
ucccaaagcccuggccccuaggccag

SEQ ID NO: 169869 - RNA, 23 nt, Human
uccccagcaccauggcgguccug

SEQ ID NO: 169870 - RNA, 20 nt, Human
uccgggcuggccugcucuuc

SEQ ID NO: 169871 - RNA, 22 nt, Human
ucucccggccucccaucccaaa

SEQ ID NO: 169872 - RNA, 20 nt, Human
ucucgcggcccugcagcgcc

SEQ ID NO: 169873 - RNA, 22 nt, Human
ucucggccuuggcugauccauu

SEQ ID NO: 169874 - RNA, 23 nt, Human
ucucggccuuggcugauccauug

SEQ ID NO: 169875 - RNA, 25 nt, Human
ucugucccgcagugucccaggcaga

SEQ ID NO: 169876 - RNA, 23 nt, Human
ugcagcgccuggcggaaccagcg

SEQ ID NO: 169877 - RNA, 19 nt, Human
ugcagcugaagacgaggga

SEQ ID NO: 169878 - RNA, 25 nt, Human
ugcagucauaagccccgccaaugcc

SEQ ID NO: 169879 - RNA, 22 nt, Human
ugccaggggcagcugccacagg

SEQ ID NO: 169880 - RNA, 19 nt, Human
ugccuuuggcuccccagca

SEQ ID NO: 169881 - RNA, 22 nt, Human
ugcgcgcugcuggcggugugcg

SEQ ID NO: 169882 - RNA, 18 nt, Human
uggcacugcagguguggg

SEQ ID NO: 169883 - RNA, 24 nt, Human
uggcacugcagguguggggugggu

SEQ ID NO: 169884 - RNA, 18 nt, Human
uggccccuaggccagucu

SEQ ID NO: 169885 - RNA, 19 nt, Human
uggcggaaccagcgcacgc

SEQ ID NO: 169886 - RNA, 18 nt, Human
ugucacugugaaguucug

SEQ ID NO: 169887 - RNA, 23 nt, Human
ugucccaggcagaggcccucucc

SEQ ID NO: 169888 - RNA, 22 nt, Human
ugugaaaugcagcugaagacga

SEQ ID NO: 169889 - RNA, 22 nt, Human
uguuggucugcguugccugugg

SEQ ID NO: 169890 - RNA, 21 nt, Human
uucauggggagaacgcaggca

SEQ ID NO: 169891 - RNA, 23 nt, Human
uucguccaggugguuccagugcu

SEQ ID NO: 169892 - RNA, 23 nt, Human
uuggaggaagacguggaaggcca

SEQ ID NO: 169893 - RNA, 18 nt, Human
auucuccccaaaucaggg

SEQ ID NO: 169894 - RNA, 22 nt, Human
cucaaggugagacgaagcugga

SEQ ID NO: 169895 - RNA, 21 nt, Human
cuguuuauucuccccaaauca

SEQ ID NO: 169896 - RNA, 21 nt, Human
gucuugcucuggguaguucua

SEQ ID NO: 169897 - RNA, 19 nt, Human
ucaggggacacaaaggcuu

SEQ ID NO: 169898 - RNA, 21 nt, Human
ucaggggacacaaaggcuuuu

SEQ ID NO: 169899 - RNA, 23 nt, Human
ucaggggacacaaaggcuuuuuu

SEQ ID NO: 169900 - RNA, 19 nt, Human
uccuaaaauaagcaggaaa

SEQ ID NO: 169901 - RNA, 19 nt, Human
uggagcugggagcucgaaa

SEQ ID NO: 169902 - RNA, 26 nt, Human
aaaaagaaacagaaaacucuuagcaa

SEQ ID NO: 169903 - RNA, 21 nt, Human
aaaacucuuagcaaacuaaaa

SEQ ID NO: 169904 - RNA, 19 nt, Human
aaacagaaucagaggaauu

SEQ ID NO: 169905 - RNA, 26 nt, Human
aaacaguugauugucucauccuccca

SEQ ID NO: 169906 - RNA, 25 nt, Human
aaacauaaacacagaaauucuaacc

SEQ ID NO: 169907 - RNA, 22 nt, Human
aaauccccacuggucuuucucu

SEQ ID NO: 169908 - RNA, 19 nt, Human
aagaaaaagaaacagaaaa

SEQ ID NO: 169909 - RNA, 19 nt, Human
aagaagaagaauaauauga

SEQ ID NO: 169910 - RNA, 19 nt, Human
aagcucaauuggccaccgc

SEQ ID NO: 169911 - RNA, 21 nt, Human
aauuccuuuucagagaccauu

SEQ ID NO: 169912 - RNA, 18 nt, Human
agaaaacagaaucagagg

SEQ ID NO: 169913 - RNA, 24 nt, Human
agaaaacagaaucagaggaauuac

SEQ ID NO: 169914 - RNA, 22 nt, Human
agaacucaaaauaucccugacc

SEQ ID NO: 169915 - RNA, 24 nt, Human
agaacucaaaauaucccugacccc

SEQ ID NO: 169916 - RNA, 21 nt, Human
agcaaggauaguagaaaaagu

SEQ ID NO: 169917 - RNA, 22 nt, Human
aggaauguuugcgccaacuuug

SEQ ID NO: 169918 - RNA, 29 nt, Human
aggcagaagucaaaaaacaaaagggaccc

SEQ ID NO: 169919 - RNA, 24 nt, Human
auaggcagaagucaaaaaacaaaa

SEQ ID NO: 169920 - RNA, 22 nt, Human
auugucucauccucccaaaccu

SEQ ID NO: 169921 - RNA, 21 nt, Human
cagagccaucucuaucucuac

SEQ ID NO: 169922 - RNA, 23 nt, Human
cauuauuuauaaugauuuacaua

SEQ ID NO: 169923 - RNA, 21 nt, Human
cccaaaccugccacucuucca

SEQ ID NO: 169924 - RNA, 21 nt, Human
cccguagacauuucaaaccua

SEQ ID NO: 169925 - RNA, 18 nt, Human
ccucccaaaccugccacu

SEQ ID NO: 169926 - RNA, 18 nt, Human
ccucccaaaccugccacu

SEQ ID NO: 169927 - RNA, 24 nt, Human
cucaaaauaucccugaccccaucc

SEQ ID NO: 169928 - RNA, 19 nt, Human
gccagagccaucucuaucu

SEQ ID NO: 169929 - RNA, 20 nt, Human
gucaaaaaacaaaaaauaac

SEQ ID NO: 169930 - RNA, 20 nt, Human
uaaaacuuccaaacuagaac

SEQ ID NO: 169931 - RNA, 21 nt, Human
uaaauguacacacaacacacu

SEQ ID NO: 169932 - RNA, 24 nt, Human
uaacaccagaaaacagaaucagag

SEQ ID NO: 169933 - RNA, 21 nt, Human
uaacguggcucaaccaaacag

SEQ ID NO: 169934 - RNA, 23 nt, Human
uaauaaagauauaacaccagaaa

SEQ ID NO: 169935 - RNA, 20 nt, Human
uagcaaggauaguagaaaaa

SEQ ID NO: 169936 - RNA, 19 nt, Human
uagccccaaaucagggaca

SEQ ID NO: 169937 - RNA, 22 nt, Human
uaggaugaacagaacucaaaau

SEQ ID NO: 169938 - RNA, 27 nt, Human
uauaacaccagaaaacagaaucagagg

SEQ ID NO: 169939 - RNA, 19 nt, Human
ucaaaaaacaaaaaauaac

SEQ ID NO: 169940 - RNA, 19 nt, Human
ucaaaccuaacguggcuca

SEQ ID NO: 169941 - RNA, 25 nt, Human
ucaaaccuaacguggcucaaccaaa

SEQ ID NO: 169942 - RNA, 20 nt, Human
ucaccacaaucccauccaag

SEQ ID NO: 169943 - RNA, 21 nt, Human
ucaccacaaucccauccaagu

SEQ ID NO: 169944 - RNA, 20 nt, Human
uccuuaaaucacguuuuucc

SEQ ID NO: 169945 - RNA, 22 nt, Human
ucuuucucuucuuguauuuccc

SEQ ID NO: 169946 - RNA, 18 nt, Human
ugacucaaggguagauga

SEQ ID NO: 169947 - RNA, 23 nt, Human
ugaggaugcuuaugaccucaagg

SEQ ID NO: 169948 - RNA, 23 nt, Human
ugcauuugaagcucaauuggcca

SEQ ID NO: 169949 - RNA, 24 nt, Human
uguaagaaaaagaaacagaaaacu

SEQ ID NO: 169950 - RNA, 18 nt, Human
uguacacacaacacacuu

SEQ ID NO: 169951 - RNA, 21 nt, Human
uugaaugccucaauaugacuc

SEQ ID NO: 169952 - RNA, 23 nt, Human
uugcauuugaagcucaauuggcc

SEQ ID NO: 169953 - RNA, 19 nt, Human
uugccagcagcaccuggug

SEQ ID NO: 169954 - RNA, 19 nt, Human
uuggaucgcuuccuucucc

SEQ ID NO: 169955 - RNA, 24 nt, Human
uuuaguagccugacugucuauuuc

SEQ ID NO: 169956 - RNA, 20 nt, Human
ccacaccaccagcuuagauc

SEQ ID NO: 169957 - RNA, 21 nt, Human
cccacaccaccagcuuagauc

SEQ ID NO: 169958 - RNA, 19 nt, Human
guggagcaacucaggcucu

SEQ ID NO: 169959 - RNA, 19 nt, Human
uggauuccuguggagcaac

SEQ ID NO: 169960 - RNA, 28 nt, Human
aacagaguauuuugaccacugaaaaaag

SEQ ID NO: 169961 - RNA, 23 nt, Human
aacauggugucuagacauggcua

SEQ ID NO: 169962 - RNA, 21 nt, Human
acagaguauuuugaccacuga

SEQ ID NO: 169963 - RNA, 22 nt, Human
accacugaaaacaucccagaac

SEQ ID NO: 169964 - RNA, 21 nt, Human
acuaaaguacaaaagccucag

SEQ ID NO: 169965 - RNA, 23 nt, Human
agaaggccagugagggugguccc

SEQ ID NO: 169966 - RNA, 18 nt, Human
agcgaucugaauaaaccu

SEQ ID NO: 169967 - RNA, 24 nt, Human
aggauccuaauccauguucuccac

SEQ ID NO: 169968 - RNA, 22 nt, Human
aguacaaaagccucagaaaaaa

SEQ ID NO: 169969 - RNA, 27 nt, Human
aucccagaacccugcugcagaaggcca

SEQ ID NO: 169970 - RNA, 21 nt, Human
caaaaauuauucugauacaac

SEQ ID NO: 169971 - RNA, 19 nt, Human
caacuaggucauucuucca

SEQ ID NO: 169972 - RNA, 20 nt, Human
cagaguauuuugaccacuga

SEQ ID NO: 169973 - RNA, 22 nt, Human
cagcaccuccaugacaguauuu

SEQ ID NO: 169974 - RNA, 22 nt, Human
cagcugccgccgccagcaccgg

SEQ ID NO: 169975 - RNA, 26 nt, Human
ccacugaaaacaucccagaacccugc

SEQ ID NO: 169976 - RNA, 22 nt, Human
cgaccugaggcuucuuggcugu

SEQ ID NO: 169977 - RNA, 21 nt, Human
cgccgccagcaccgguaccgc

SEQ ID NO: 169978 - RNA, 24 nt, Human
cuaggauccuaauccauguucucc

SEQ ID NO: 169979 - RNA, 21 nt, Human
cucagaaaaaacgugaugggc

SEQ ID NO: 169980 - RNA, 21 nt, Human
cugaaaacaucccagaacccu

SEQ ID NO: 169981 - RNA, 19 nt, Human
cugaggcuucuuggcugug

SEQ ID NO: 169982 - RNA, 23 nt, Human
cugcugcuguccacagaccagug

SEQ ID NO: 169983 - RNA, 23 nt, Human
cugugcaucugcucagccgaggc

SEQ ID NO: 169984 - RNA, 20 nt, Human
cugugucuuuacagucuagg

SEQ ID NO: 169985 - RNA, 20 nt, Human
cuucuuggcugugcugaguu

SEQ ID NO: 169986 - RNA, 24 nt, Human
cuucuuggcugugcugaguuugcu

SEQ ID NO: 169987 - RNA, 22 nt, Human
cuugcaaacauuucugcugcug

SEQ ID NO: 169988 - RNA, 23 nt, Human
gaaaacaucccagaacccugcug

SEQ ID NO: 169989 - RNA, 18 nt, Human
gaaggccagugagggugg

SEQ ID NO: 169990 - RNA, 21 nt, Human
gguauuacuauuguuucacug

SEQ ID NO: 169991 - RNA, 20 nt, Human
uaaaguacaaaagccucaga

SEQ ID NO: 169992 - RNA, 26 nt, Human
uaacaaagucaaacuuucucaccaug

SEQ ID NO: 169993 - RNA, 26 nt, Human
uauuucuguuuucugagcccuugcuc

SEQ ID NO: 169994 - RNA, 21 nt, Human
ucagaaaaaacgugaugggca

SEQ ID NO: 169995 - RNA, 22 nt, Human
ucagcaaguacuuaugaugagu

SEQ ID NO: 169996 - RNA, 19 nt, Human
uccacagaccagugagguc

SEQ ID NO: 169997 - RNA, 24 nt, Human
uccaucagcaaguacuuaugauga

SEQ ID NO: 169998 - RNA, 22 nt, Human
ucccagaacccugcugcagaag

SEQ ID NO: 169999 - RNA, 24 nt, Human
uccccaaaaugaauggcuugauuu

SEQ ID NO: 170000 - RNA, 20 nt, Human
uccuaauccauguucuccac

SEQ ID NO: 170001 - RNA, 22 nt, Human
ugaggucuugggauagguggca

SEQ ID NO: 170002 - RNA, 18 nt, Human
ugaugucauuuauuggca

SEQ ID NO: 170003 - RNA, 20 nt, Human
ugcccugagguucgcgcggc

SEQ ID NO: 170004 - RNA, 22 nt, Human
ugccgccgccagcaccgguacc

SEQ ID NO: 170005 - RNA, 18 nt, Human
uggaagcauuuacuaaag

SEQ ID NO: 170006 - RNA, 22 nt, Human
ugguucaaaccaacuuuuaaua

SEQ ID NO: 170007 - RNA, 22 nt, Human
uuaguggaagcauuuacuaaag

SEQ ID NO: 170008 - RNA, 18 nt, Human
uuucugcugcuguccaca

SEQ ID NO: 170009 - RNA, 20 nt, Human
aaaaaggaaagcacagaaaa

SEQ ID NO: 170010 - RNA, 23 nt, Human
aaaaggaaagcacagaaaacagg

SEQ ID NO: 170011 - RNA, 19 nt, Human
aagaaaagacuccggggug

SEQ ID NO: 170012 - RNA, 19 nt, Human
aagaaagagacucaagaga

SEQ ID NO: 170013 - RNA, 19 nt, Human
aagaacucucccuacacgu

SEQ ID NO: 170014 - RNA, 21 nt, Human
aagagaaagaaaagacuccgg

SEQ ID NO: 170015 - RNA, 23 nt, Human
aagcucucccaggaaccccacag

SEQ ID NO: 170016 - RNA, 21 nt, Human
aaguagcugccauaguucucc

SEQ ID NO: 170017 - RNA, 24 nt, Human
aagucauuuacaaguccacauuca

SEQ ID NO: 170018 - RNA, 31 nt, Human
agaacucucccuacacgucccucucugccuu

SEQ ID NO: 170019 - RNA, 19 nt, Human
agacacaaaagaagggcug

SEQ ID NO: 170020 - RNA, 21 nt, Human
agagcagaaaaacguccaggg

SEQ ID NO: 170021 - RNA, 24 nt, Human
agcacagaaaacaggaaagaacuc

SEQ ID NO: 170022 - RNA, 21 nt, Human
agccagcggcuucuucucugg

SEQ ID NO: 170023 - RNA, 24 nt, Human
aggaaagcacagaaaacaggaaag

SEQ ID NO: 170024 - RNA, 22 nt, Human
aggaggaaauaaauugugaggg

SEQ ID NO: 170025 - RNA, 22 nt, Human
agggccagaagagagcagaaaa

SEQ ID NO: 170026 - RNA, 18 nt, Human
caaaguggucgcucccag

SEQ ID NO: 170027 - RNA, 19 nt, Human
caagccacccaccaccaaa

SEQ ID NO: 170028 - RNA, 26 nt, Human
caauccaagcucacgacgcccccaag

SEQ ID NO: 170029 - RNA, 24 nt, Human
cacauucaaauccaaaucucccac

SEQ ID NO: 170030 - RNA, 22 nt, Human
ccacagcaaaccgugaccuuga

SEQ ID NO: 170031 - RNA, 21 nt, Human
ccaccagaaaauaagaaaaug

SEQ ID NO: 170032 - RNA, 21 nt, Human
ccagggucucucaugcauucc

SEQ ID NO: 170033 - RNA, 23 nt, Human
cccaccugcaaaauucuucaccu

SEQ ID NO: 170034 - RNA, 22 nt, Human
cccacgcgccuccccgcagcca

SEQ ID NO: 170035 - RNA, 23 nt, Human
ccccacagcaaaccgugaccuug

SEQ ID NO: 170036 - RNA, 18 nt, Human
ccccacgcgccuccccgc

SEQ ID NO: 170037 - RNA, 24 nt, Human
ccccacgcgccuccccgcagccaa

SEQ ID NO: 170038 - RNA, 23 nt, Human
ccuacacgucccucucugccugu

SEQ ID NO: 170039 - RNA, 23 nt, Human
ccuaccccugagcccuccuuaaa

SEQ ID NO: 170040 - RNA, 22 nt, Human
cgccgaggccgaggcccauggc

SEQ ID NO: 170041 - RNA, 25 nt, Human
cggagcugcgggcgaagccggagca

SEQ ID NO: 170042 - RNA, 18 nt, Human
cggccuccacuuccuccu

SEQ ID NO: 170043 - RNA, 23 nt, Human
cggggugaguaagcucucccagg

SEQ ID NO: 170044 - RNA, 23 nt, Human
cguccagggucucucaugcauuc

SEQ ID NO: 170045 - RNA, 20 nt, Human
cuaccccugagcccuccuua

SEQ ID NO: 170046 - RNA, 21 nt, Human
cuaccccugagcccuccuuaa

SEQ ID NO: 170047 - RNA, 20 nt, Human
cuuacuaagcuccuccacca

SEQ ID NO: 170048 - RNA, 20 nt, Human
cuucaccucucuccaguccc

SEQ ID NO: 170049 - RNA, 19 nt, Human
gaaagcacagaaaacagga

SEQ ID NO: 170050 - RNA, 18 nt, Human
gacaagaaagagacucaa

SEQ ID NO: 170051 - RNA, 20 nt, Human
gagagucacauuuuaaaacc

SEQ ID NO: 170052 - RNA, 22 nt, Human
gagcugugcgggcuucgcuggg

SEQ ID NO: 170053 - RNA, 19 nt, Human
gagucacauuuuaaaaccg

SEQ ID NO: 170054 - RNA, 21 nt, Human
gauuccuaccccugagcccuc

SEQ ID NO: 170055 - RNA, 23 nt, Human
gcacagaaaacaggaaagaacuc

SEQ ID NO: 170056 - RNA, 27 nt, Human
gccaagccacccaccaccaaacuuuua

SEQ ID NO: 170057 - RNA, 22 nt, Human
gcccauggcuccauggagggcc

SEQ ID NO: 170058 - RNA, 19 nt, Human
gccuccacuuccuccucca

SEQ ID NO: 170059 - RNA, 19 nt, Human
ggaaagaacucucccuaca

SEQ ID NO: 170060 - RNA, 19 nt, Human
ggagggccagaagagagca

SEQ ID NO: 170061 - RNA, 23 nt, Human
ggccaugaguggccuuccgggag

SEQ ID NO: 170062 - RNA, 24 nt, Human
gguggcaccuuacaaaagcgccgu

SEQ ID NO: 170063 - RNA, 20 nt, Human
gucuacgcagcggccuccac

SEQ ID NO: 170064 - RNA, 23 nt, Human
uaaaaccgguuucagacacaaaa

SEQ ID NO: 170065 - RNA, 23 nt, Human
uaagcucucccaggaaccccaca

SEQ ID NO: 170066 - RNA, 27 nt, Human
uaccccugagcccuccuuaaacaaucc

SEQ ID NO: 170067 - RNA, 20 nt, Human
uaccuuaaaguuugggggug

SEQ ID NO: 170068 - RNA, 21 nt, Human
uauaaaucaggaccaccacaa

SEQ ID NO: 170069 - RNA, 20 nt, Human
ucaaauccaaaucucccacc

SEQ ID NO: 170070 - RNA, 18 nt, Human
ucaccucucuccaguccc

SEQ ID NO: 170071 - RNA, 23 nt, Human
ucauacagccagcggcuucuucu

SEQ ID NO: 170072 - RNA, 20 nt, Human
uccaccagaaaauaagaaaa

SEQ ID NO: 170073 - RNA, 20 nt, Human
uccccacgcgccuccccgca

SEQ ID NO: 170074 - RNA, 22 nt, Human
ucgccgcggcugguaacuucuc

SEQ ID NO: 170075 - RNA, 19 nt, Human
ucucaugccccacggaagc

SEQ ID NO: 170076 - RNA, 23 nt, Human
ugagcccuccuuaaacaauccaa

SEQ ID NO: 170077 - RNA, 20 nt, Human
ugagggugaggagccgccga

SEQ ID NO: 170078 - RNA, 21 nt, Human
ugccuguuuguguccucggga

SEQ ID NO: 170079 - RNA, 19 nt, Human
uggcaccuuacaaaagcgc

SEQ ID NO: 170080 - RNA, 19 nt, Human
uggcacgggaggaggaaau

SEQ ID NO: 170081 - RNA, 20 nt, Human
uggcacgggaggaggaaaua

SEQ ID NO: 170082 - RNA, 24 nt, Human
ugggagagucacauuuuaaaaccg

SEQ ID NO: 170083 - RNA, 24 nt, Human
ugugagggugaggagccgccgagg

SEQ ID NO: 170084 - RNA, 22 nt, Human
uucaaguauuguuauaaagcca

SEQ ID NO: 170085 - RNA, 22 nt, Human
uuccgggaguccuguaaaaagg

SEQ ID NO: 170086 - RNA, 20 nt, Human
uucucccaguuuaucccagg

SEQ ID NO: 170087 - RNA, 18 nt, Human
uucucugggagagucaca

SEQ ID NO: 170088 - RNA, 20 nt, Human
uuggagcaagagaaagaaaa

SEQ ID NO: 170089 - RNA, 19 nt, Human
uuggaguucacaucuccca

SEQ ID NO: 170090 - RNA, 28 nt, Human
uuucuccgacggccucgccgcggcuggu

SEQ ID NO: 170091 - RNA, 21 nt, Human
aaaaaacacaccucagcugca

SEQ ID NO: 170092 - RNA, 23 nt, Human
aaaaaacacaccucagcugcaua

SEQ ID NO: 170093 - RNA, 18 nt, Human
aacaacaacaaaaaacac

SEQ ID NO: 170094 - RNA, 25 nt, Human
aacaacaacaacaaaaaacacaccu

SEQ ID NO: 170095 - RNA, 20 nt, Human
aacaacaacaacaacaaaaa

SEQ ID NO: 170096 - RNA, 23 nt, Human
aagcaggaauaaaaaaaagggac

SEQ ID NO: 170097 - RNA, 22 nt, Human
aagcaggaauaaaaaaaauaaa

SEQ ID NO: 170098 - RNA, 25 nt, Human
aagcaggaauaaaaaaaauaaacaa

SEQ ID NO: 170099 - RNA, 25 nt, Human
acaacaaaaaacacaccucagcugc

SEQ ID NO: 170100 - RNA, 19 nt, Human
acaacaacaacaacaaaaa

SEQ ID NO: 170101 - RNA, 20 nt, Human
acauagcccaaguguccuca

SEQ ID NO: 170102 - RNA, 22 nt, Human
auaaacaacaacaacaacaaaa

SEQ ID NO: 170103 - RNA, 18 nt, Human
caaaaaacacaccucagc

SEQ ID NO: 170104 - RNA, 22 nt, Human
caaaaaacacaccucagcugca

SEQ ID NO: 170105 - RNA, 24 nt, Human
caacaaaaaacacaccucagcugc

SEQ ID NO: 170106 - RNA, 19 nt, Human
caacaacaaaaaacacacc

SEQ ID NO: 170107 - RNA, 22 nt, Human
caacaacaacaaaaaacacacc

SEQ ID NO: 170108 - RNA, 23 nt, Human
caacaacaacaaaaaacacaccu

SEQ ID NO: 170109 - RNA, 27 nt, Human
caacaacaacaacaaaaaacacaccuc

SEQ ID NO: 170110 - RNA, 22 nt, Human
ccauagaaauuaaaaaucagaa

SEQ ID NO: 170111 - RNA, 20 nt, Human
cuucuuauuauuuugcuuuu

SEQ ID NO: 170112 - RNA, 21 nt, Human
guaggaggcaacacauuguuu

SEQ ID NO: 170113 - RNA, 21 nt, Human
uaaacaacaacaacaacaaaa

SEQ ID NO: 170114 - RNA, 22 nt, Human
uagcccaaguguccucaaaagc

SEQ ID NO: 170115 - RNA, 18 nt, Human
ugaagcuggggucuuggc

SEQ ID NO: 170116 - RNA, 22 nt, Human
ugcuuuuuuaaagguuguuaua

SEQ ID NO: 170117 - RNA, 21 nt, Human
uguacagagcugugacacaua

SEQ ID NO: 170118 - RNA, 25 nt, Human
uguuuguacagagcugugacacaua

SEQ ID NO: 170119 - RNA, 24 nt, Human
uuuuuuuuuucccuccuggaauuu

SEQ ID NO: 170120 - RNA, 20 nt, Human
uuuuuuuuuuuucccucccc

SEQ ID NO: 170121 - RNA, 20 nt, Human
aaagaacagaccauagcacc

SEQ ID NO: 170122 - RNA, 18 nt, Human
aaauuuauuuacacucac

SEQ ID NO: 170123 - RNA, 18 nt, Human
aagaggaaguaaaucuaa

SEQ ID NO: 170124 - RNA, 21 nt, Human
aaucacuucccaaaggcccac

SEQ ID NO: 170125 - RNA, 19 nt, Human
acacaauuauagcuaaacu

SEQ ID NO: 170126 - RNA, 22 nt, Human
acaucccaccaucccccaaccc

SEQ ID NO: 170127 - RNA, 23 nt, Human
accuuggggauuaggauuucaac

SEQ ID NO: 170128 - RNA, 24 nt, Human
acugucucaucuccuugcaucccu

SEQ ID NO: 170129 - RNA, 19 nt, Human
agaaauuccugaucuagac

SEQ ID NO: 170130 - RNA, 19 nt, Human
aggaagagaaaauaaagaa

SEQ ID NO: 170131 - RNA, 19 nt, Human
aguacuuaugcauaugugc

SEQ ID NO: 170132 - RNA, 24 nt, Human
aucccaccaucccccaacccccca

SEQ ID NO: 170133 - RNA, 25 nt, Human
aucccaccaucccccaaccccccaa

SEQ ID NO: 170134 - RNA, 18 nt, Human
auuggggugguuaaguga

SEQ ID NO: 170135 - RNA, 22 nt, Human
caaaacacugggacaacuugua

SEQ ID NO: 170136 - RNA, 19 nt, Human
caaaauugcccccaguuga

SEQ ID NO: 170137 - RNA, 26 nt, Human
caacacugauuuucuucaacaugaaa

SEQ ID NO: 170138 - RNA, 23 nt, Human
cacaucccaccaucccccaaccc

SEQ ID NO: 170139 - RNA, 19 nt, Human
cagagcccaacaccuaggg

SEQ ID NO: 170140 - RNA, 24 nt, Human
caguacaacugacauuuugggcca

SEQ ID NO: 170141 - RNA, 18 nt, Human
cauagcaccagcuaaaga

SEQ ID NO: 170142 - RNA, 19 nt, Human
caucccaccaucccccaac

SEQ ID NO: 170143 - RNA, 19 nt, Human
ccaccaucccccaaccccc

SEQ ID NO: 170144 - RNA, 20 nt, Human
ccuaggguuucauuaggcug

SEQ ID NO: 170145 - RNA, 24 nt, Human
ccuaggguuucauuaggcuggggu

SEQ ID NO: 170146 - RNA, 22 nt, Human
cuaaagaacagaccauagcacc

SEQ ID NO: 170147 - RNA, 19 nt, Human
cucucuggggccuuuuuaa

SEQ ID NO: 170148 - RNA, 22 nt, Human
cucucuggggccuuuuuaaaua

SEQ ID NO: 170149 - RNA, 27 nt, Human
cucuuuaaaucacaacauucuggucgg

SEQ ID NO: 170150 - RNA, 21 nt, Human
gcaaaauugcccccaguugag

SEQ ID NO: 170151 - RNA, 22 nt, Human
ggggccuuuuuaaauaagggca

SEQ ID NO: 170152 - RNA, 23 nt, Human
gggugguuaagugagaucaugga

SEQ ID NO: 170153 - RNA, 18 nt, Human
ggugguuaagugagauca

SEQ ID NO: 170154 - RNA, 20 nt, Human
guucuggaggcuggaaguuc

SEQ ID NO: 170155 - RNA, 22 nt, Human
uaaagaacagaccauagcacca

SEQ ID NO: 170156 - RNA, 18 nt, Human
uaacaaaacacugggaca

SEQ ID NO: 170157 - RNA, 22 nt, Human
uaagaauagcugaaugaggcug

SEQ ID NO: 170158 - RNA, 21 nt, Human
uacacucaccuaacuacauua

SEQ ID NO: 170159 - RNA, 18 nt, Human
uagaagggacaaaguccc

SEQ ID NO: 170160 - RNA, 20 nt, Human
uagaagggacaaagucccau

SEQ ID NO: 170161 - RNA, 18 nt, Human
uagcuaaacucuaauucu

SEQ ID NO: 170162 - RNA, 20 nt, Human
ucagauuagaaaagaggaag

SEQ ID NO: 170163 - RNA, 18 nt, Human
uccuaaucaugagggcuc

SEQ ID NO: 170164 - RNA, 20 nt, Human
uccugaucuaaucacuuccc

SEQ ID NO: 170165 - RNA, 19 nt, Human
ugaggcuggaaagagauaa

SEQ ID NO: 170166 - RNA, 18 nt, Human
ugaucuaaucacuuccca

SEQ ID NO: 170167 - RNA, 20 nt, Human
ugcccugugcauuauaggau

SEQ ID NO: 170168 - RNA, 21 nt, Human
uguccucuggggggcaaaauu

SEQ ID NO: 170169 - RNA, 21 nt, Human
uuagcggcaccccuggcuucu

SEQ ID NO: 170170 - RNA, 23 nt, Human
uuccugaucuagacagcagaauu

SEQ ID NO: 170171 - RNA, 20 nt, Human
acccgccuccgucuucaccc

SEQ ID NO: 170172 - RNA, 18 nt, Human
agaaaaaaacacagaaag

SEQ ID NO: 170173 - RNA, 22 nt, Human
agaaaaaaacacagaaagauaa

SEQ ID NO: 170174 - RNA, 19 nt, Human
aggcagaaacaaaaauccc

SEQ ID NO: 170175 - RNA, 21 nt, Human
cagaaagauaaggcagaaaca

SEQ ID NO: 170176 - RNA, 19 nt, Human
cgcggagaggcugaggccg

SEQ ID NO: 170177 - RNA, 21 nt, Human
gaaauaaacacucccugacag

SEQ ID NO: 170178 - RNA, 19 nt, Human
gcagcacaggggcgcggag

SEQ ID NO: 170179 - RNA, 21 nt, Human
gcgcggaggaacagaagcgga

SEQ ID NO: 170180 - RNA, 25 nt, Human
gcggaggaacagaagcggacgcgaa

SEQ ID NO: 170181 - RNA, 23 nt, Human
gugagucggggcagcacaggggc

SEQ ID NO: 170182 - RNA, 21 nt, Human
uaaggcagaaacaaaaauccc

SEQ ID NO: 170183 - RNA, 19 nt, Human
uggcucagaguuccacuuc

SEQ ID NO: 170184 - RNA, 19 nt, Human
uggcucagaguuccacuuc

SEQ ID NO: 170185 - RNA, 22 nt, Human
uggcucagaguuccacuuccgg

SEQ ID NO: 170186 - RNA, 27 nt, Human
aaaaagacuucguuuucucaacagcug

SEQ ID NO: 170187 - RNA, 21 nt, Human
aagucuaggccacagcaaucu

SEQ ID NO: 170188 - RNA, 22 nt, Human
aauaaaaaguuagcaagaggaa

SEQ ID NO: 170189 - RNA, 24 nt, Human
acaauaaauggaaauguaaguauc

SEQ ID NO: 170190 - RNA, 20 nt, Human
acuucggagaguaugcaaag

SEQ ID NO: 170191 - RNA, 21 nt, Human
agagaaaaaaaaaucucaaag

SEQ ID NO: 170192 - RNA, 22 nt, Human
agagauuaaaacuaauguauau

SEQ ID NO: 170193 - RNA, 18 nt, Human
agaguaugcaaagucccg

SEQ ID NO: 170194 - RNA, 19 nt, Human
aggagcugggcagcugcuc

SEQ ID NO: 170195 - RNA, 24 nt, Human
aggcaacuuugaagucagcaccaa

SEQ ID NO: 170196 - RNA, 22 nt, Human
aguaaacaggaaaaugcuacaa

SEQ ID NO: 170197 - RNA, 24 nt, Human
aguuacaggauauuuuaaaagaga

SEQ ID NO: 170198 - RNA, 22 nt, Human
auacugaaguacagaaaaauuc

SEQ ID NO: 170199 - RNA, 19 nt, Human
caaaacugagcaggagcug

SEQ ID NO: 170200 - RNA, 24 nt, Human
caaauuccuucauaauaacagccu

SEQ ID NO: 170201 - RNA, 23 nt, Human
caauauuaagagauuaaaacuaa

SEQ ID NO: 170202 - RNA, 21 nt, Human
cacagcaaucuacuguucucc

SEQ ID NO: 170203 - RNA, 22 nt, Human
cagcaaagcaaucaaauuccuu

SEQ ID NO: 170204 - RNA, 23 nt, Human
cauacugaaguacagaaaaauuc

SEQ ID NO: 170205 - RNA, 19 nt, Human
cauccguuuugcaaccuga

SEQ ID NO: 170206 - RNA, 19 nt, Human
cccacaacaaaaauaaaau

SEQ ID NO: 170207 - RNA, 18 nt, Human
ccugcugugcagcaaagc

SEQ ID NO: 170208 - RNA, 20 nt, Human
ccuggagagacuuaccggcu

SEQ ID NO: 170209 - RNA, 22 nt, Human
ccuggagagacuuaccggcuug

SEQ ID NO: 170210 - RNA, 21 nt, Human
cugcaucauuuuuuuaugcau

SEQ ID NO: 170211 - RNA, 23 nt, Human
gaagucuaggccacagcaaucua

SEQ ID NO: 170212 - RNA, 21 nt, Human
gcuugcuuucuguggcuggag

SEQ ID NO: 170213 - RNA, 24 nt, Human
guugauucucuugaucgacauuuc

SEQ ID NO: 170214 - RNA, 23 nt, Human
uaccccgaggcaaaacugagcag

SEQ ID NO: 170215 - RNA, 21 nt, Human
uaccuggagagacuuaccggc

SEQ ID NO: 170216 - RNA, 24 nt, Human
uaggccaaaggguacuucuuuuuc

SEQ ID NO: 170217 - RNA, 24 nt, Human
uaugcauagaaaaaaaugugcaau

SEQ ID NO: 170218 - RNA, 24 nt, Human
uauuuuaaaagagaaaaaaaaauc

SEQ ID NO: 170219 - RNA, 21 nt, Human
ucagcaccaacucaccauacu

SEQ ID NO: 170220 - RNA, 22 nt, Human
ucauuuuuuuaugcauagaaaa

SEQ ID NO: 170221 - RNA, 19 nt, Human
uccaccuuaucuuccuuca

SEQ ID NO: 170222 - RNA, 22 nt, Human
uccaucauuuccuucugcaaaa

SEQ ID NO: 170223 - RNA, 25 nt, Human
uccaucauuuccuucugcaaaauga

SEQ ID NO: 170224 - RNA, 22 nt, Human
uccuucugcaaaaugaaaaaga

SEQ ID NO: 170225 - RNA, 20 nt, Human
ucuaggccacagcaaucuac

SEQ ID NO: 170226 - RNA, 28 nt, Human
ucuguggcuggaggugcuaccccgaggc

SEQ ID NO: 170227 - RNA, 22 nt, Human
ugaauaaccacucuaaucagua

SEQ ID NO: 170228 - RNA, 19 nt, Human
ugagcaggagcugggcagc

SEQ ID NO: 170229 - RNA, 23 nt, Human
ugagcaggagcugggcagcugcu

SEQ ID NO: 170230 - RNA, 21 nt, Human
ugaggaaauuauauaucaccu

SEQ ID NO: 170231 - RNA, 24 nt, Human
ugcaaccugauucucaauauuagu

SEQ ID NO: 170232 - RNA, 26 nt, Human
ugccuugguggggagaagaggagcag

SEQ ID NO: 170233 - RNA, 19 nt, Human
ugcuacaacagucacugag

SEQ ID NO: 170234 - RNA, 23 nt, Human
uggggagaagaggagcagggcuu

SEQ ID NO: 170235 - RNA, 20 nt, Human
ugguggggagaagaggagca

SEQ ID NO: 170236 - RNA, 23 nt, Human
uguaaguaucucuuaaaaagaaa

SEQ ID NO: 170237 - RNA, 23 nt, Human
uuaaaaagaaaaauaacuugguu

SEQ ID NO: 170238 - RNA, 25 nt, Human
uuaccaggcagugaggaaauuauau

SEQ ID NO: 170239 - RNA, 22 nt, Human
uucuguggcuggaggugcuacc

SEQ ID NO: 170240 - RNA, 24 nt, Human
uucuuaucugcuuaagaaucccac

SEQ ID NO: 170241 - RNA, 21 nt, Human
uuuaaaagagaaaaaaaaauc

SEQ ID NO: 170242 - RNA, 24 nt, Human
uuuuccuaaacuauuuugauaccu

SEQ ID NO: 170243 - RNA, 26 nt, Human
uuuuggaauggauuauuugaauuugu

SEQ ID NO: 170244 - RNA, 19 nt, Human
uuuuuuuuuuuuguaggcc

SEQ ID NO: 170245 - RNA, 21 nt, Human
uuuuuuuuuuuuuuuuguagg

SEQ ID NO: 170246 - RNA, 19 nt, Human
aaacagaaguaauaaucag

SEQ ID NO: 170247 - RNA, 20 nt, Human
aaagagaaacagaaguaaua

SEQ ID NO: 170248 - RNA, 22 nt, Human
aagagagaagcagaaaccaaaa

SEQ ID NO: 170249 - RNA, 26 nt, Human
aguaaacaauagaauaugaugugcaa

SEQ ID NO: 170250 - RNA, 18 nt, Human
aguggacacaaggaucug

SEQ ID NO: 170251 - RNA, 21 nt, Human
caaaagaacaguuuuucucau

SEQ ID NO: 170252 - RNA, 19 nt, Human
cagcaaugcaaguaagucu

SEQ ID NO: 170253 - RNA, 19 nt, Human
caguggacgccaaaaggcc

SEQ ID NO: 170254 - RNA, 22 nt, Human
cccccaaaccauuacaaagggg

SEQ ID NO: 170255 - RNA, 18 nt, Human
ccucccccggcaaucacc

SEQ ID NO: 170256 - RNA, 21 nt, Human
cuaguccagcaaugcaaguaa

SEQ ID NO: 170257 - RNA, 21 nt, Human
gcagaaaccaaaagagaaaca

SEQ ID NO: 170258 - RNA, 22 nt, Human
uaauaaucaguuaucacaugau

SEQ ID NO: 170259 - RNA, 21 nt, Human
uagugaaauagaaaacucaca

SEQ ID NO: 170260 - RNA, 22 nt, Human
uauaguaaacaauagaauauga

SEQ ID NO: 170261 - RNA, 19 nt, Human
ucccccggcaaucaccgcu

SEQ ID NO: 170262 - RNA, 19 nt, Human
uccuuugcuaguccagcaa

SEQ ID NO: 170263 - RNA, 19 nt, Human
ucuccgccucccccgcugc

SEQ ID NO: 170264 - RNA, 21 nt, Human
ugcaauagugcaauuuuccuu

SEQ ID NO: 170265 - RNA, 21 nt, Human
ugcagccgcgcaguggacgcc

SEQ ID NO: 170266 - RNA, 23 nt, Human
aacggacucagcuggccugggcc

SEQ ID NO: 170267 - RNA, 21 nt, Human
acccccaccggccugggcgga

SEQ ID NO: 170268 - RNA, 18 nt, Human
accccggcgcggaaaacg

SEQ ID NO: 170269 - RNA, 25 nt, Human
agacaaaaaaaaguguaagaauugg

SEQ ID NO: 170270 - RNA, 21 nt, Human
agggaggcgggacagggcugg

SEQ ID NO: 170271 - RNA, 19 nt, Human
auccauggcaacccccagg

SEQ ID NO: 170272 - RNA, 19 nt, Human
cagggcaggcagcggggcc

SEQ ID NO: 170273 - RNA, 19 nt, Human
cccccuuuccucaaguggg

SEQ ID NO: 170274 - RNA, 19 nt, Human
ccugggcggaugaggcugu

SEQ ID NO: 170275 - RNA, 24 nt, Human
ccuggucucugaggucccaggaac

SEQ ID NO: 170276 - RNA, 21 nt, Human
cgggaaagacaaaaaaaagug

SEQ ID NO: 170277 - RNA, 24 nt, Human
cgggaaagacaaaaaaaaguguaa

SEQ ID NO: 170278 - RNA, 22 nt, Human
gaggggcgccaccccggcgcgg

SEQ ID NO: 170279 - RNA, 21 nt, Human
gcccggcguuaggacgguugg

SEQ ID NO: 170280 - RNA, 23 nt, Human
ggaaaacggacucagcuggccug

SEQ ID NO: 170281 - RNA, 22 nt, Human
ggcagcggggccgcgggaaaga

SEQ ID NO: 170282 - RNA, 18 nt, Human
ggccugggcggaugaggc

SEQ ID NO: 170283 - RNA, 25 nt, Human
gggccgcgggaaagacaaaaaaaag

SEQ ID NO: 170284 - RNA, 19 nt, Human
uaggacgguuggaggggcg

SEQ ID NO: 170285 - RNA, 21 nt, Human
uccauggcaacccccagcucc

SEQ ID NO: 170286 - RNA, 21 nt, Human
ucugaggucccaggaacacuc

SEQ ID NO: 170287 - RNA, 26 nt, Human
ugacagggaggcgggacagggcucca

SEQ ID NO: 170288 - RNA, 19 nt, Human
ugagccuggucucugaggu

SEQ ID NO: 170289 - RNA, 21 nt, Human
ugcugggggcugcaccugagc

SEQ ID NO: 170290 - RNA, 18 nt, Human
uggagcagggcaggcagc

SEQ ID NO: 170291 - RNA, 23 nt, Human
uggguccccauccauggcaaccc

SEQ ID NO: 170292 - RNA, 21 nt, Human
uggguucaugaggcccccuuu

SEQ ID NO: 170293 - RNA, 18 nt, Human
ugguggcugcaggucuuu

SEQ ID NO: 170294 - RNA, 21 nt, Human
aacacagugagaccaaugucu

SEQ ID NO: 170295 - RNA, 22 nt, Human
aacacagugagaccaaugucuc

SEQ ID NO: 170296 - RNA, 19 nt, Human
accagucugggcaacacag

SEQ ID NO: 170297 - RNA, 24 nt, Human
acugcacuccagccugggugacag

SEQ ID NO: 170298 - RNA, 26 nt, Human
acugcacuccagccugggugacagag

SEQ ID NO: 170299 - RNA, 19 nt, Human
agagccgugauugcgccac

SEQ ID NO: 170300 - RNA, 24 nt, Human
agccugggugacagagcaagacuu

SEQ ID NO: 170301 - RNA, 19 nt, Human
aggucgaggcugcagagag

SEQ ID NO: 170302 - RNA, 22 nt, Human
agucugggcaacacagugagac

SEQ ID NO: 170303 - RNA, 24 nt, Human
auugcgccacugcacuccagccug

SEQ ID NO: 170304 - RNA, 18 nt, Human
caacacagugagaccaau

SEQ ID NO: 170305 - RNA, 22 nt, Human
cacuccagccugggugacagag

SEQ ID NO: 170306 - RNA, 23 nt, Human
cacuccagccugggugacagagc

SEQ ID NO: 170307 - RNA, 19 nt, Human
cacugcacuccagccuggg

SEQ ID NO: 170308 - RNA, 21 nt, Human
cacugcacuccagccugggug

SEQ ID NO: 170309 - RNA, 22 nt, Human
cacugcacuccagccuggguga

SEQ ID NO: 170310 - RNA, 23 nt, Human
cacugcacuccagccugggugac

SEQ ID NO: 170311 - RNA, 24 nt, Human
cacugcacuccagccugggugaca

SEQ ID NO: 170312 - RNA, 24 nt, Human
cacugcacuccagccugggugaca

SEQ ID NO: 170313 - RNA, 18 nt, Human
cagcacuucgggaggcag

SEQ ID NO: 170314 - RNA, 18 nt, Human
ccacugcacuccagccug

SEQ ID NO: 170315 - RNA, 20 nt, Human
ccacugcacuccagccuggg

SEQ ID NO: 170316 - RNA, 20 nt, Human
ccacugcacuccagccuggg

SEQ ID NO: 170317 - RNA, 20 nt, Human
ccacugcacuccagccuggg

SEQ ID NO: 170318 - RNA, 20 nt, Human
ccacugcacuccagccuggg

SEQ ID NO: 170319 - RNA, 21 nt, Human
ccacugcacuccagccugggu

SEQ ID NO: 170320 - RNA, 21 nt, Human
ccacugcacuccagccugggu

SEQ ID NO: 170321 - RNA, 24 nt, Human
ccacugcacuccagccugggugac

SEQ ID NO: 170322 - RNA, 21 nt, Human
ccugggugacagagcaagacu

SEQ ID NO: 170323 - RNA, 26 nt, Human
cgccacugcacuccagccugggugac

SEQ ID NO: 170324 - RNA, 24 nt, Human
cgugauugcgccacugcacuccag

SEQ ID NO: 170325 - RNA, 20 nt, Human
cuguaauacagcacuucggg

SEQ ID NO: 170326 - RNA, 19 nt, Human
gcaacacagugagaccaau

SEQ ID NO: 170327 - RNA, 24 nt, Human
gcacuccagccugggugacagagc

SEQ ID NO: 170328 - RNA, 19 nt, Human
gccacugcacuccagccug

SEQ ID NO: 170329 - RNA, 24 nt, Human
gccacugcacuccagccuggguga

SEQ ID NO: 170330 - RNA, 18 nt, Human
ggaggucgaggcugcaga

SEQ ID NO: 170331 - RNA, 24 nt, Human
uaccuguagucccaucuacucagg

SEQ ID NO: 170332 - RNA, 24 nt, Human
uccagccugggugacagagcaaga

SEQ ID NO: 170333 - RNA, 28 nt, Human
ucccuucaaccuaggaguucaaggaacu

SEQ ID NO: 170334 - RNA, 22 nt, Human
ucuguaauacagcacuucggga

SEQ ID NO: 170335 - RNA, 22 nt, Human
uucaaccuaggaguucaagacc

SEQ ID NO: 170336 - RNA, 22 nt, Human
aaauguguagaagcacugucag

SEQ ID NO: 170337 - RNA, 21 nt, Human
accuuaaagguaugccaggaa

SEQ ID NO: 170338 - RNA, 20 nt, Human
cagagaaaaaccuccacaga

SEQ ID NO: 170339 - RNA, 21 nt, Human
cagagaaaaaccuccacagau

SEQ ID NO: 170340 - RNA, 22 nt, Human
cagcuuccuaauguaucacaug

SEQ ID NO: 170341 - RNA, 21 nt, Human
cauggaauuaauaguuccuga

SEQ ID NO: 170342 - RNA, 19 nt, Human
gcagagaaaaaccuccaca

SEQ ID NO: 170343 - RNA, 21 nt, Human
gcagagaaaaaccuccacaga

SEQ ID NO: 170344 - RNA, 23 nt, Human
uagaagcacugucagcuccuugu

SEQ ID NO: 170345 - RNA, 26 nt, Human
uagaagcacugucagcuccuugugac

SEQ ID NO: 170346 - RNA, 28 nt, Human
uucuuuaauuauuauuguuguuacuaau

SEQ ID NO: 170347 - RNA, 20 nt, Human
aagauauaggaaagcuguag

SEQ ID NO: 170348 - RNA, 22 nt, Human
aauagaagauauaggaaagcug

SEQ ID NO: 170349 - RNA, 21 nt, Human
aaucuaugaagucaaaaacug

SEQ ID NO: 170350 - RNA, 23 nt, Human
acugcagaaaguucugaagaauc

SEQ ID NO: 170351 - RNA, 18 nt, Human
agaauagaagauauagga

SEQ ID NO: 170352 - RNA, 19 nt, Human
ccgaaauggcuagaugggg

SEQ ID NO: 170353 - RNA, 21 nt, Human
ccucggugucuuccgaaaugg

SEQ ID NO: 170354 - RNA, 19 nt, Human
cgaaauggcuagauggggg

SEQ ID NO: 170355 - RNA, 19 nt, Human
cuaugaagucaaaaacugc

SEQ ID NO: 170356 - RNA, 21 nt, Human
cuuccgaaauggcuagauggg

SEQ ID NO: 170357 - RNA, 22 nt, Human
cuugcagugagaugcuuuuuuu

SEQ ID NO: 170358 - RNA, 26 nt, Human
uaaagcauaaucuaugaagucaaaaa

SEQ ID NO: 170359 - RNA, 22 nt, Human
uagaauagaagauauaggaaag

SEQ ID NO: 170360 - RNA, 21 nt, Human
ucaguguauguuuucaaagcc

SEQ ID NO: 170361 - RNA, 27 nt, Human
ucuuccuccucuuccucggugucuucc

SEQ ID NO: 170362 - RNA, 24 nt, Human
ucuuccucggugucuuccgaaaug

SEQ ID NO: 170363 - RNA, 20 nt, Human
ugacuugcagugagaugcuu

SEQ ID NO: 170364 - RNA, 23 nt, Human
ugcaauaaguuaaaaaaaauuuu

SEQ ID NO: 170365 - RNA, 24 nt, Human
uuauagagaguuuaccacucuaga

SEQ ID NO: 170366 - RNA, 21 nt, Human
uuuuuguuuuuggcaucugcu

SEQ ID NO: 170367 - RNA, 22 nt, Human
uuuuuuuuuuuugcacaaaggc

SEQ ID NO: 170368 - RNA, 22 nt, Human
uuuuuuuuuuuugcacaaaggc

SEQ ID NO: 170369 - RNA, 18 nt, Human
uuuuuuuuuuuuuuuuug

SEQ ID NO: 170370 - RNA, 18 nt, Human
uuuuuuuuuuuuuuuuug

SEQ ID NO: 170371 - RNA, 23 nt, Human
uuuuuuuuuuuuuuuuugcacaa

SEQ ID NO: 170372 - RNA, 23 nt, Human
uuuuuuuuuuuuuuuuugcacaa

SEQ ID NO: 170373 - RNA, 21 nt, Human
aaaaacaaauuaauguuugga

SEQ ID NO: 170374 - RNA, 23 nt, Human
aaaacuacacacacagagaaagc

SEQ ID NO: 170375 - RNA, 18 nt, Human
aaaaucacaggaaccuau

SEQ ID NO: 170376 - RNA, 21 nt, Human
aaacaugaaaugcaaauauga

SEQ ID NO: 170377 - RNA, 23 nt, Human
aaaccucuccuccggggacaccc

SEQ ID NO: 170378 - RNA, 18 nt, Human
aagaagagacagggccaa

SEQ ID NO: 170379 - RNA, 21 nt, Human
aagagguucagauuugggucu

SEQ ID NO: 170380 - RNA, 25 nt, Human
aagcaaauacuggugauuuggcgac

SEQ ID NO: 170381 - RNA, 19 nt, Human
aagcacuccuagaaaugaa

SEQ ID NO: 170382 - RNA, 20 nt, Human
aagcccuaugcuuuuagagg

SEQ ID NO: 170383 - RNA, 19 nt, Human
aagcugcagaacucaagag

SEQ ID NO: 170384 - RNA, 22 nt, Human
aagcugcagaacucaagaggaa

SEQ ID NO: 170385 - RNA, 20 nt, Human
aaggcacccuugcuccucug

SEQ ID NO: 170386 - RNA, 18 nt, Human
aagggcugguaaaaccuu

SEQ ID NO: 170387 - RNA, 19 nt, Human
aaguaucugcaucauuugg

SEQ ID NO: 170388 - RNA, 21 nt, Human
aaguaucugcaucauuugggu

SEQ ID NO: 170389 - RNA, 21 nt, Human
aaucaggaguuacaaaaacaa

SEQ ID NO: 170390 - RNA, 19 nt, Human
aaucuggucaucuuguuuu

SEQ ID NO: 170391 - RNA, 19 nt, Human
acaaaacuacacacacaga

SEQ ID NO: 170392 - RNA, 24 nt, Human
acacagagaaagcccaaggaagcc

SEQ ID NO: 170393 - RNA, 22 nt, Human
acacuggguuaacuagcaguau

SEQ ID NO: 170394 - RNA, 21 nt, Human
acagaagcugcagaacucaag

SEQ ID NO: 170395 - RNA, 21 nt, Human
acccugcuaaguucucucugg

SEQ ID NO: 170396 - RNA, 18 nt, Human
acccugcuuuccaaaaac

SEQ ID NO: 170397 - RNA, 26 nt, Human
acggcggcagcgagcuguaagcggag

SEQ ID NO: 170398 - RNA, 23 nt, Human
acugauuugccucaacuucucag

SEQ ID NO: 170399 - RNA, 19 nt, Human
acuuucuuuuauccucauc

SEQ ID NO: 170400 - RNA, 19 nt, Human
agaagaaggaaaaaucaca

SEQ ID NO: 170401 - RNA, 23 nt, Human
agacacuggucugugccuccuca

SEQ ID NO: 170402 - RNA, 19 nt, Human
agaggcaguuauugggacc

SEQ ID NO: 170403 - RNA, 22 nt, Human
agcaaauacuggugauuuggcg

SEQ ID NO: 170404 - RNA, 23 nt, Human
agcagacacuuguguauacugaa

SEQ ID NO: 170405 - RNA, 23 nt, Human
aggaagaaucaggaguuacaaaa

SEQ ID NO: 170406 - RNA, 19 nt, Human
agggcugaaggaaccaaac

SEQ ID NO: 170407 - RNA, 26 nt, Human
aucuccauuuucuucccccuguugaa

SEQ ID NO: 170408 - RNA, 22 nt, Human
augaaaugcaaauaugaagaca

SEQ ID NO: 170409 - RNA, 27 nt, Human
caacuugccaaaaaaaaaggccaaugg

SEQ ID NO: 170410 - RNA, 20 nt, Human
caaugaucagaaccacagaa

SEQ ID NO: 170411 - RNA, 23 nt, Human
cacacacagagaaagcccaagga

SEQ ID NO: 170412 - RNA, 23 nt, Human
caccaggaagaaccccaaacucc

SEQ ID NO: 170413 - RNA, 22 nt, Human
cacgugggcuuguuagcaggca

SEQ ID NO: 170414 - RNA, 23 nt, Human
cagaaccacagaauuuauaacuu

SEQ ID NO: 170415 - RNA, 21 nt, Human
cagagaaagcccaaggaagcc

SEQ ID NO: 170416 - RNA, 24 nt, Human
cagagaaagcccaaggaagccugc

SEQ ID NO: 170417 - RNA, 19 nt, Human
cagggccaacucacccucc

SEQ ID NO: 170418 - RNA, 23 nt, Human
caguuauugggaccaagagaugc

SEQ ID NO: 170419 - RNA, 23 nt, Human
cauucagacugguccacgugggc

SEQ ID NO: 170420 - RNA, 19 nt, Human
ccagaaaaaagaagagaca

SEQ ID NO: 170421 - RNA, 19 nt, Human
cccauaguguccaagggcu

SEQ ID NO: 170422 - RNA, 26 nt, Human
cccccuguugaaucugaaagguuuuc

SEQ ID NO: 170423 - RNA, 19 nt, Human
ccccugcaccaggaagaac

SEQ ID NO: 170424 - RNA, 20 nt, Human
cccugcaccaggaagaaccc

SEQ ID NO: 170425 - RNA, 18 nt, Human
ccucagaucaugugauuc

SEQ ID NO: 170426 - RNA, 21 nt, Human
ccuccagccccagagcaccau

SEQ ID NO: 170427 - RNA, 23 nt, Human
ccucuccguggagcuucccaaac

SEQ ID NO: 170428 - RNA, 18 nt, Human
ccugcuaaguucucucug

SEQ ID NO: 170429 - RNA, 21 nt, Human
ccuuccuagccagccaccuuc

SEQ ID NO: 170430 - RNA, 20 nt, Human
cggcauagacgacagcugcc

SEQ ID NO: 170431 - RNA, 19 nt, Human
cucuuucccacucucuucc

SEQ ID NO: 170432 - RNA, 24 nt, Human
cugauggucuuuaaucugcuuucu

SEQ ID NO: 170433 - RNA, 19 nt, Human
cugcaggcuaagcccuaug

SEQ ID NO: 170434 - RNA, 20 nt, Human
cugcauuucagacugaacaa

SEQ ID NO: 170435 - RNA, 21 nt, Human
cugcauuucagacugaacaag

SEQ ID NO: 170436 - RNA, 23 nt, Human
gaaaugcaaauaugaagacagag

SEQ ID NO: 170437 - RNA, 23 nt, Human
gaaccaaaccuaguuuaauccug

SEQ ID NO: 170438 - RNA, 19 nt, Human
gaagaauaaagucaacuug

SEQ ID NO: 170439 - RNA, 18 nt, Human
gacacugugguuucuugc

SEQ ID NO: 170440 - RNA, 18 nt, Human
gacagaguggggugguuc

SEQ ID NO: 170441 - RNA, 23 nt, Human
gaccaaugaucagaaccacagaa

SEQ ID NO: 170442 - RNA, 19 nt, Human
gcaucuaguauguggcagg

SEQ ID NO: 170443 - RNA, 19 nt, Human
gcugggauccagacacugg

SEQ ID NO: 170444 - RNA, 20 nt, Human
ggaggucugucaugcugacg

SEQ ID NO: 170445 - RNA, 20 nt, Human
ggauacauaaaagcuugaaa

SEQ ID NO: 170446 - RNA, 22 nt, Human
ggcgcggggcaggacggcggca

SEQ ID NO: 170447 - RNA, 19 nt, Human
gggcugaaggaaccaaacc

SEQ ID NO: 170448 - RNA, 20 nt, Human
ggugggacuacugaaaaaua

SEQ ID NO: 170449 - RNA, 18 nt, Human
gucaacuugccaaaaaaa

SEQ ID NO: 170450 - RNA, 22 nt, Human
gucaacuugccaaaaaaaaagu

SEQ ID NO: 170451 - RNA, 24 nt, Human
uaaauacaaauacaaguucacaaa

SEQ ID NO: 170452 - RNA, 22 nt, Human
uaacagaugcuauaguguuuac

SEQ ID NO: 170453 - RNA, 18 nt, Human
uaaggcacccuugcuccu

SEQ ID NO: 170454 - RNA, 22 nt, Human
uaaucacagaagucgaaagaca

SEQ ID NO: 170455 - RNA, 22 nt, Human
uacaaccuaaauaauuuccuuc

SEQ ID NO: 170456 - RNA, 24 nt, Human
uacugauuugccucaacuucucag

SEQ ID NO: 170457 - RNA, 18 nt, Human
uagaaggaauucuauuuu

SEQ ID NO: 170458 - RNA, 22 nt, Human
uagccuccagccccagagcacc

SEQ ID NO: 170459 - RNA, 18 nt, Human
uaguggacugcuggaagc

SEQ ID NO: 170460 - RNA, 21 nt, Human
uauggaagacuccccagacua

SEQ ID NO: 170461 - RNA, 19 nt, Human
uccaagggcugguaaaacc

SEQ ID NO: 170462 - RNA, 23 nt, Human
uccuuacuagccuccagccccag

SEQ ID NO: 170463 - RNA, 23 nt, Human
uccuuuauugcaaaacaaauaaa

SEQ ID NO: 170464 - RNA, 19 nt, Human
ucugcaaaugagaucuuau

SEQ ID NO: 170465 - RNA, 20 nt, Human
ucugcuuucugcaaaugaga

SEQ ID NO: 170466 - RNA, 19 nt, Human
ugaagacagaguggggugg

SEQ ID NO: 170467 - RNA, 22 nt, Human
ugaagagacacugugguuucuu

SEQ ID NO: 170468 - RNA, 20 nt, Human
ugaaucugaaacuuucuuuu

SEQ ID NO: 170469 - RNA, 25 nt, Human
ugacggcaauggaaagaggcuggaa

SEQ ID NO: 170470 - RNA, 26 nt, Human
ugagaacaagaaaaacuagaaggaau

SEQ ID NO: 170471 - RNA, 18 nt, Human
ugcaaaacaaauaaacaa

SEQ ID NO: 170472 - RNA, 23 nt, Human
ugcaaaacaaauaaacaaaauaa

SEQ ID NO: 170473 - RNA, 21 nt, Human
ugccucaacuucucagaauaa

SEQ ID NO: 170474 - RNA, 22 nt, Human
uggcaucgugugcacucccugc

SEQ ID NO: 170475 - RNA, 18 nt, Human
ugggacuacugaaaaaua

SEQ ID NO: 170476 - RNA, 23 nt, Human
ugggacuacugaaaaauaauuac

SEQ ID NO: 170477 - RNA, 24 nt, Human
ugggcugcaucuaguauguggcag

SEQ ID NO: 170478 - RNA, 25 nt, Human
uggucugguccaggucuccuggggg

SEQ ID NO: 170479 - RNA, 24 nt, Human
ugguucucuuucccacucucuucc

SEQ ID NO: 170480 - RNA, 18 nt, Human
uguuuagauuguuucuug

SEQ ID NO: 170481 - RNA, 20 nt, Human
uuaaacaugaaaugcaaaua

SEQ ID NO: 170482 - RNA, 21 nt, Human
uuacaaaagcuuaauaccuag

SEQ ID NO: 170483 - RNA, 23 nt, Human
uuacccaugaggacuccauauca

SEQ ID NO: 170484 - RNA, 22 nt, Human
uucacaaacacauaugcaacag

SEQ ID NO: 170485 - RNA, 22 nt, Human
uucucagaauaaauaaaaacaa

SEQ ID NO: 170486 - RNA, 23 nt, Human
uugaagaguuuuuagaugggaug

SEQ ID NO: 170487 - RNA, 18 nt, Human
uugcccuccucccauagu

SEQ ID NO: 170488 - RNA, 21 nt, Human
uugcucuugggaguucaaugu

SEQ ID NO: 170489 - RNA, 19 nt, Human
uugggucuguuccucuuuc

SEQ ID NO: 170490 - RNA, 19 nt, Human
uuuacaguuucucuuaaag

SEQ ID NO: 170491 - RNA, 25 nt, Human
uuucucuuaaagcacuccuagaaau

SEQ ID NO: 170492 - RNA, 19 nt, Human
uuuuuuuuuuuuucacuuu

SEQ ID NO: 170493 - RNA, 26 nt, Human
uuuuuuuuuuuuuuuuucacuuuaau

SEQ ID NO: 170494 - RNA, 26 nt, Human
aaaaaaaaaaaaaaaggcuucuuuga

SEQ ID NO: 170495 - RNA, 24 nt, Human
aagcacagcccgugucaggagcac

SEQ ID NO: 170496 - RNA, 18 nt, Human
aagcuccccacacuccuc

SEQ ID NO: 170497 - RNA, 21 nt, Human
aagcuccccacacuccucacc

SEQ ID NO: 170498 - RNA, 20 nt, Human
aaggcuucuuugagucuuuu

SEQ ID NO: 170499 - RNA, 20 nt, Human
aagggccuggcuugcugggc

SEQ ID NO: 170500 - RNA, 18 nt, Human
acagugcccugcucugag

SEQ ID NO: 170501 - RNA, 19 nt, Human
acuagacccuccguacaca

SEQ ID NO: 170502 - RNA, 23 nt, Human
agcacagcccgugucaggagcac

SEQ ID NO: 170503 - RNA, 28 nt, Human
aggagcccugggugugaaccccacugug

SEQ ID NO: 170504 - RNA, 18 nt, Human
agggggcacacugggcau

SEQ ID NO: 170505 - RNA, 19 nt, Human
caagaccagcaccuggcug

SEQ ID NO: 170506 - RNA, 18 nt, Human
caagcuccccacacuccu

SEQ ID NO: 170507 - RNA, 21 nt, Human
cacagcccgugucaggagcac

SEQ ID NO: 170508 - RNA, 25 nt, Human
cacaggacgcaaaggggcacacaga

SEQ ID NO: 170509 - RNA, 24 nt, Human
cacagguaaggcacugccuggggg

SEQ ID NO: 170510 - RNA, 23 nt, Human
cacccagacuagaggcuuggggc

SEQ ID NO: 170511 - RNA, 23 nt, Human
cacuccucaccccagaccgggga

SEQ ID NO: 170512 - RNA, 22 nt, Human
cagauggaggggagggugagcc

SEQ ID NO: 170513 - RNA, 21 nt, Human
cagcagcaggggagacgcugg

SEQ ID NO: 170514 - RNA, 23 nt, Human
cagggccccaggguggggugggc

SEQ ID NO: 170515 - RNA, 22 nt, Human
cauccuagagaagggcccuaaa

SEQ ID NO: 170516 - RNA, 22 nt, Human
ccacacgcacucagacuagacc

SEQ ID NO: 170517 - RNA, 21 nt, Human
ccaccagccggcccccaggcc

SEQ ID NO: 170518 - RNA, 19 nt, Human
ccagacuagaggcuugggg

SEQ ID NO: 170519 - RNA, 22 nt, Human
ccagcagagaaugcccagcccu

SEQ ID NO: 170520 - RNA, 23 nt, Human
cccacacgcacucagacuagacc

SEQ ID NO: 170521 - RNA, 24 nt, Human
cccacacgcacucagacuagaccc

SEQ ID NO: 170522 - RNA, 22 nt, Human
cccaccagccggcccccaggcc

SEQ ID NO: 170523 - RNA, 25 nt, Human
cccacccaccagccggcccccaggc

SEQ ID NO: 170524 - RNA, 21 nt, Human
cccagacuagaggcuuggggc

SEQ ID NO: 170525 - RNA, 18 nt, Human
cccauagcuggucugagg

SEQ ID NO: 170526 - RNA, 19 nt, Human
cccauagcuggucugaggc

SEQ ID NO: 170527 - RNA, 21 nt, Human
cccgugguccccgccagagcu

SEQ ID NO: 170528 - RNA, 23 nt, Human
cccuccauacacacccaggcuag

SEQ ID NO: 170529 - RNA, 23 nt, Human
cccuccauacacacccaggcuag

SEQ ID NO: 170530 - RNA, 24 nt, Human
cccuccauacucacccaggcuaga

SEQ ID NO: 170531 - RNA, 24 nt, Human
cccuccauacucacccaggcuaga

SEQ ID NO: 170532 - RNA, 24 nt, Human
cccuccauacucacccaggcuaga

SEQ ID NO: 170533 - RNA, 24 nt, Human
cccuccauacucacccaggcuaga

SEQ ID NO: 170534 - RNA, 24 nt, Human
cccuccguacucacccaggcuaga

SEQ ID NO: 170535 - RNA, 24 nt, Human
cccuccguacucacccaggcuaga

SEQ ID NO: 170536 - RNA, 22 nt, Human
cccugcucugagcugccgcugg

SEQ ID NO: 170537 - RNA, 18 nt, Human
ccgcuggcugcuccacgu

SEQ ID NO: 170538 - RNA, 19 nt, Human
ccucaugaacugacgugga

SEQ ID NO: 170539 - RNA, 23 nt, Human
ccuccauacacacccaggcuaga

SEQ ID NO: 170540 - RNA, 23 nt, Human
ccuccauacacacccaggcuaga

SEQ ID NO: 170541 - RNA, 23 nt, Human
ccuccauacacacccaggcuaga

SEQ ID NO: 170542 - RNA, 19 nt, Human
ccuccauacucacccaggc

SEQ ID NO: 170543 - RNA, 19 nt, Human
ccuccauacucacccaggc

SEQ ID NO: 170544 - RNA, 19 nt, Human
ccuccauacucacccaggc

SEQ ID NO: 170545 - RNA, 19 nt, Human
ccuccauacucacccaggc

SEQ ID NO: 170546 - RNA, 23 nt, Human
ccuccguacacacccagacuaga

SEQ ID NO: 170547 - RNA, 23 nt, Human
ccuccguacacacccaggcuaga

SEQ ID NO: 170548 - RNA, 23 nt, Human
ccuccguacacacccaggcuaga

SEQ ID NO: 170549 - RNA, 22 nt, Human
ccuucuuggccuucaugaaggg

SEQ ID NO: 170550 - RNA, 20 nt, Human
cggaugucacacaugcgugg

SEQ ID NO: 170551 - RNA, 22 nt, Human
cggcccccaggccucccuuccu

SEQ ID NO: 170552 - RNA, 24 nt, Human
cgugggagaacuggcccaagacca

SEQ ID NO: 170553 - RNA, 19 nt, Human
cguguuguccucuccccau

SEQ ID NO: 170554 - RNA, 22 nt, Human
cuagacccuccauacacaccca

SEQ ID NO: 170555 - RNA, 22 nt, Human
cuagacccuccauacacaccca

SEQ ID NO: 170556 - RNA, 22 nt, Human
cuagacccuccauacucaccca

SEQ ID NO: 170557 - RNA, 22 nt, Human
cuagacccuccauacucaccca

SEQ ID NO: 170558 - RNA, 22 nt, Human
cuagacccuccauacucaccca

SEQ ID NO: 170559 - RNA, 22 nt, Human
cuagacccuccauacucaccca

SEQ ID NO: 170560 - RNA, 22 nt, Human
cuagacccuccguacacaccca

SEQ ID NO: 170561 - RNA, 22 nt, Human
cuagacccuccguacacaccca

SEQ ID NO: 170562 - RNA, 22 nt, Human
cuagacccuccguacacaccca

SEQ ID NO: 170563 - RNA, 22 nt, Human
cuagacccuccguacucaccca

SEQ ID NO: 170564 - RNA, 22 nt, Human
cuagacccuccguacucaccca

SEQ ID NO: 170565 - RNA, 22 nt, Human
cuagauccuccauacacaccca

SEQ ID NO: 170566 - RNA, 22 nt, Human
cuccauacacacccaggcuaga

SEQ ID NO: 170567 - RNA, 22 nt, Human
cuccauacacacccaggcuaga

SEQ ID NO: 170568 - RNA, 22 nt, Human
cuccauacacacccaggcuaga

SEQ ID NO: 170569 - RNA, 20 nt, Human
cuccccggcaauaggucuua

SEQ ID NO: 170570 - RNA, 22 nt, Human
cuccguacacacccagacuaga

SEQ ID NO: 170571 - RNA, 22 nt, Human
cuccguacacacccaggcuaga

SEQ ID NO: 170572 - RNA, 22 nt, Human
cuccguacacacccaggcuaga

SEQ ID NO: 170573 - RNA, 22 nt, Human
cuccguacucacccaggcuaga

SEQ ID NO: 170574 - RNA, 24 nt, Human
cucuccguacucacccaggcuaga

SEQ ID NO: 170575 - RNA, 23 nt, Human
cuggggcauccuagagaagggcc

SEQ ID NO: 170576 - RNA, 21 nt, Human
cuggugucgccagccccggcu

SEQ ID NO: 170577 - RNA, 18 nt, Human
gaagcuggaguucuuggg

SEQ ID NO: 170578 - RNA, 19 nt, Human
gaagcuggaguucuugggc

SEQ ID NO: 170579 - RNA, 22 nt, Human
gacacagugcccugcucugagc

SEQ ID NO: 170580 - RNA, 23 nt, Human
gacagcagcaggggagacgcugg

SEQ ID NO: 170581 - RNA, 18 nt, Human
gaccagcaccuggcugga

SEQ ID NO: 170582 - RNA, 23 nt, Human
gagcacaggccgugcccuuuccc

SEQ ID NO: 170583 - RNA, 21 nt, Human
gagcaucaacgcagauggagg

SEQ ID NO: 170584 - RNA, 19 nt, Human
gagcugccgcuggcugcuc

SEQ ID NO: 170585 - RNA, 22 nt, Human
gaggcuggaggaggaugcccaa

SEQ ID NO: 170586 - RNA, 20 nt, Human
gauggggggccucgggcacc

SEQ ID NO: 170587 - RNA, 18 nt, Human
gcagggccccaggguggg

SEQ ID NO: 170588 - RNA, 25 nt, Human
gcagggccccaggguggggugggcu

SEQ ID NO: 170589 - RNA, 22 nt, Human
gccggcccccaggccucccuuc

SEQ ID NO: 170590 - RNA, 18 nt, Human
gccucccuuccucagucc

SEQ ID NO: 170591 - RNA, 18 nt, Human
gccuggcugaggcuccug

SEQ ID NO: 170592 - RNA, 18 nt, Human
ggauccccaagugguccg

SEQ ID NO: 170593 - RNA, 19 nt, Human
ggcaauaaauaacagggga

SEQ ID NO: 170594 - RNA, 23 nt, Human
ggcacuuuucugggcaccacagg

SEQ ID NO: 170595 - RNA, 21 nt, Human
ggcugccuggcugaggcuccu

SEQ ID NO: 170596 - RNA, 22 nt, Human
ggcuggugucgccagccccggc

SEQ ID NO: 170597 - RNA, 21 nt, Human
gggcuggggcauccuagagaa

SEQ ID NO: 170598 - RNA, 20 nt, Human
gggggaccaaggagcccugg

SEQ ID NO: 170599 - RNA, 23 nt, Human
gggucugcaggccuggccggggc

SEQ ID NO: 170600 - RNA, 24 nt, Human
gggucugcaggccuggccggggca

SEQ ID NO: 170601 - RNA, 24 nt, Human
gggugguucuguggccaagcacag

SEQ ID NO: 170602 - RNA, 22 nt, Human
gguaaggcacugccugggggcu

SEQ ID NO: 170603 - RNA, 18 nt, Human
gguucugggauccccaag

SEQ ID NO: 170604 - RNA, 24 nt, Human
gugggcugccuggcugaggcuccu

SEQ ID NO: 170605 - RNA, 21 nt, Human
uaaaucaggcgcucagugucc

SEQ ID NO: 170606 - RNA, 18 nt, Human
uaaggucacaguguucug

SEQ ID NO: 170607 - RNA, 25 nt, Human
uaaggucacaguguucugagguccc

SEQ ID NO: 170608 - RNA, 18 nt, Human
uacacacccaggcuagac

SEQ ID NO: 170609 - RNA, 18 nt, Human
uacacacccaggcuagac

SEQ ID NO: 170610 - RNA, 18 nt, Human
uacacacccaggcuagac

SEQ ID NO: 170611 - RNA, 18 nt, Human
uacacacccaggcuagac

SEQ ID NO: 170612 - RNA, 25 nt, Human
uaucccacccaccagccggccccca

SEQ ID NO: 170613 - RNA, 20 nt, Human
ucaguguccggaacgcaggu

SEQ ID NO: 170614 - RNA, 24 nt, Human
uccauacacacccaggcuagaccc

SEQ ID NO: 170615 - RNA, 24 nt, Human
uccauacacacccaggcuagaccc

SEQ ID NO: 170616 - RNA, 24 nt, Human
uccauacacacccaggcuagacuc

SEQ ID NO: 170617 - RNA, 24 nt, Human
uccauacucacccaggcuagaccc

SEQ ID NO: 170618 - RNA, 24 nt, Human
uccauacucacccaggcuagaccc

SEQ ID NO: 170619 - RNA, 24 nt, Human
uccauacucacccaggcuagaccc

SEQ ID NO: 170620 - RNA, 18 nt, Human
ucccagggggcacacugg

SEQ ID NO: 170621 - RNA, 23 nt, Human
uccccggcaauaggucuuagggu

SEQ ID NO: 170622 - RNA, 21 nt, Human
uccgccggacacagugcccug

SEQ ID NO: 170623 - RNA, 24 nt, Human
uccguacucacccaggcuagaccc

SEQ ID NO: 170624 - RNA, 24 nt, Human
uccguacucacccaggcuagaccc

SEQ ID NO: 170625 - RNA, 24 nt, Human
uccguacucacccaggcuagaccc

SEQ ID NO: 170626 - RNA, 23 nt, Human
uccuccauacacacccaggcuag

SEQ ID NO: 170627 - RNA, 23 nt, Human
uccuccguguuguccucucccca

SEQ ID NO: 170628 - RNA, 33 nt, Human
ucuguggccaagcacagcccgugucaggagccg

SEQ ID NO: 170629 - RNA, 21 nt, Human
ugaagggccuggcuugcuggg

SEQ ID NO: 170630 - RNA, 19 nt, Human
ugacguggacagcagcagg

SEQ ID NO: 170631 - RNA, 24 nt, Human
ugagcaucaacgcagauggagggg

SEQ ID NO: 170632 - RNA, 21 nt, Human
ugauggggggccucgggcacc

SEQ ID NO: 170633 - RNA, 19 nt, Human
ugcaggccuggccggggca

SEQ ID NO: 170634 - RNA, 21 nt, Human
ugcccaagcuccccacacucc

SEQ ID NO: 170635 - RNA, 19 nt, Human
ugccuggcugaggcuccug

SEQ ID NO: 170636 - RNA, 23 nt, Human
ugccugggggcuggaggaggcug

SEQ ID NO: 170637 - RNA, 19 nt, Human
uggaggaggcuggaggagg

SEQ ID NO: 170638 - RNA, 25 nt, Human
uggaggaggcuggaggaggaugccc

SEQ ID NO: 170639 - RNA, 24 nt, Human
uggaguucuugggcuggcagggaa

SEQ ID NO: 170640 - RNA, 21 nt, Human
uggccaagcacagcccguguc

SEQ ID NO: 170641 - RNA, 21 nt, Human
uggcccaagaccagcaccugg

SEQ ID NO: 170642 - RNA, 23 nt, Human
uggccggggcagguuguggggga

SEQ ID NO: 170643 - RNA, 24 nt, Human
uggcuccgccggacacagugcccu

SEQ ID NO: 170644 - RNA, 22 nt, Human
ugggggcuggaggaggcuggag

SEQ ID NO: 170645 - RNA, 18 nt, Human
uggggugggcugccuggc

SEQ ID NO: 170646 - RNA, 21 nt, Human
uggugggugaggcaggucugg

SEQ ID NO: 170647 - RNA, 21 nt, Human
ugucaggagcacaggccgugc

SEQ ID NO: 170648 - RNA, 24 nt, Human
ugugggggaccaaggagcccuggg

SEQ ID NO: 170649 - RNA, 23 nt, Human
uuagacucugcuguggcaauaaa

SEQ ID NO: 170650 - RNA, 22 nt, Human
uucacaggacgcaaaggggcac

SEQ ID NO: 170651 - RNA, 23 nt, Human
uucaugaagggccuggcuugcug

SEQ ID NO: 170652 - RNA, 20 nt, Human
uuccuuggugaggcagggcc

SEQ ID NO: 170653 - RNA, 24 nt, Human
aaggagaggcggcggcggcggcgg

SEQ ID NO: 170654 - RNA, 27 nt, Human
acaacaccuggguaccaaauuucuuua

SEQ ID NO: 170655 - RNA, 19 nt, Human
accaaauuucuuuauuuga

SEQ ID NO: 170656 - RNA, 19 nt, Human
agacugaaccauuggaaac

SEQ ID NO: 170657 - RNA, 26 nt, Human
aggagaggcggcggcggcggcgguga

SEQ ID NO: 170658 - RNA, 23 nt, Human
aggcggcggcggcggcgguggcu

SEQ ID NO: 170659 - RNA, 23 nt, Human
aucccaagaccucaaagacaaca

SEQ ID NO: 170660 - RNA, 31 nt, Human
cccacggcuauggggaaauuagcccgaggcc

SEQ ID NO: 170661 - RNA, 18 nt, Human
cggcggcgggggccuugg

SEQ ID NO: 170662 - RNA, 18 nt, Human
cuggagcggcggcggggg

SEQ ID NO: 170663 - RNA, 22 nt, Human
cuggagcggcggcgggggccuu

SEQ ID NO: 170664 - RNA, 22 nt, Human
cuguugaagcaggaaaccccga

SEQ ID NO: 170665 - RNA, 21 nt, Human
cuuggugaccagggaagucac

SEQ ID NO: 170666 - RNA, 20 nt, Human
gcggcggcggcggcgguggc

SEQ ID NO: 170667 - RNA, 23 nt, Human
gcggcggcggcggcgguggcuuu

SEQ ID NO: 170668 - RNA, 20 nt, Human
gcggcggcggcgguggcugc

SEQ ID NO: 170669 - RNA, 22 nt, Human
gcggcggcggcgguggcugcgc

SEQ ID NO: 170670 - RNA, 21 nt, Human
gcggcgggggccuuggggcag

SEQ ID NO: 170671 - RNA, 20 nt, Human
gcuggcuaugggcggccggc

SEQ ID NO: 170672 - RNA, 18 nt, Human
ggccggccggggugggga

SEQ ID NO: 170673 - RNA, 24 nt, Human
ggcggcggcggcggcgguggcugg

SEQ ID NO: 170674 - RNA, 19 nt, Human
ggggaaauuagcccgaggc

SEQ ID NO: 170675 - RNA, 19 nt, Human
ggugaccagggaagucacc

SEQ ID NO: 170676 - RNA, 21 nt, Human
uaaauacaaauacucguuucu

SEQ ID NO: 170677 - RNA, 21 nt, Human
uaacucagacucuggauucag

SEQ ID NO: 170678 - RNA, 20 nt, Human
uacaaaucaaagaacuuaag

SEQ ID NO: 170679 - RNA, 24 nt, Human
uacaacuuauagaaaagguaaagg

SEQ ID NO: 170680 - RNA, 24 nt, Human
uauacugcccaaacuaaugaguuu

SEQ ID NO: 170681 - RNA, 25 nt, Human
uggagcggcggcgggggccuugggg

SEQ ID NO: 170682 - RNA, 21 nt, Human
uugaagcaggaaaccccgacg

SEQ ID NO: 170683 - RNA, 21 nt, Human
uuggugaccagggaagucacc

SEQ ID NO: 170684 - RNA, 18 nt, Human
aagauaaaacugaagaga

SEQ ID NO: 170685 - RNA, 18 nt, Human
ccuuuauugcuuugagaa

SEQ ID NO: 170686 - RNA, 18 nt, Human
cgagggcagcagcugagg

SEQ ID NO: 170687 - RNA, 18 nt, Human
cgccccgccuaguggccu

SEQ ID NO: 170688 - RNA, 19 nt, Human
cuuugagaaccagauaacu

SEQ ID NO: 170689 - RNA, 22 nt, Human
gcagcagcugaggugacaagaa

SEQ ID NO: 170690 - RNA, 18 nt, Human
gggaagggaccccguggc

SEQ ID NO: 170691 - RNA, 18 nt, Human
ucggugcgguagcgaggg

SEQ ID NO: 170692 - RNA, 23 nt, Human
ugaaagauaaaacugaagagaac

SEQ ID NO: 170693 - RNA, 22 nt, Human
ugaaagggcaacaugcacgccc

SEQ ID NO: 170694 - RNA, 19 nt, Human
ugacaagaauggcggauag

SEQ ID NO: 170695 - RNA, 27 nt, Human
ugcgguagcgagggcagcagcugaggg

SEQ ID NO: 170696 - RNA, 22 nt, Human
uuuuauggacaccuuuauugcu

SEQ ID NO: 170697 - RNA, 24 nt, Human
aaggagcuaaccacaaaaacggug

SEQ ID NO: 170698 - RNA, 21 nt, Human
agagaguccccggaucuguuc

SEQ ID NO: 170699 - RNA, 20 nt, Human
agauggccgagaagaugguc

SEQ ID NO: 170700 - RNA, 21 nt, Human
aggcuggaagagaguccccgg

SEQ ID NO: 170701 - RNA, 25 nt, Human
caagaaggagcuaaccacaaaaacg

SEQ ID NO: 170702 - RNA, 21 nt, Human
caagagacagacccgcgggac

SEQ ID NO: 170703 - RNA, 31 nt, Human
caggucccagaagcaggagauggccgagaag

SEQ ID NO: 170704 - RNA, 21 nt, Human
uccaaacacuguugaagcaag

SEQ ID NO: 170705 - RNA, 20 nt, Human
ucccagaagcaggagauggc

SEQ ID NO: 170706 - RNA, 20 nt, Human
ucgcugggcucagaaggcuc

SEQ ID NO: 170707 - RNA, 18 nt, Human
ugaagcaagagacagacc

SEQ ID NO: 170708 - RNA, 19 nt, Human
ugcuggcaggucccagaag

SEQ ID NO: 170709 - RNA, 21 nt, Human
ugguuggcaagaaggagcuaa

SEQ ID NO: 170710 - RNA, 20 nt, Human
uuggcuggagggagaggcuu

SEQ ID NO: 170711 - RNA, 19 nt, Human
uuuuuuuuuuuuuuuugca

SEQ ID NO: 170712 - RNA, 18 nt, Human
uuuuuuuuuuuuuuuuug

SEQ ID NO: 170713 - RNA, 21 nt, Human
uuuuuuuuuuuuuuuuugcau

SEQ ID NO: 170714 - RNA, 24 nt, Human
aaaaaccaaagcagacccacugcc

SEQ ID NO: 170715 - RNA, 20 nt, Human
aaaucagcucaaaucucccg

SEQ ID NO: 170716 - RNA, 24 nt, Human
aauuacauuuauguucuugggagc

SEQ ID NO: 170717 - RNA, 21 nt, Human
accauuaugaaaauggcacaa

SEQ ID NO: 170718 - RNA, 19 nt, Human
agagaaagagagagagaga

SEQ ID NO: 170719 - RNA, 19 nt, Human
agagagagagagaaagaga

SEQ ID NO: 170720 - RNA, 22 nt, Human
agcaaaaaccaaagcagaccca

SEQ ID NO: 170721 - RNA, 21 nt, Human
agcaaucccccagccucagcc

SEQ ID NO: 170722 - RNA, 19 nt, Human
agcuuaaaaggagcuaaug

SEQ ID NO: 170723 - RNA, 24 nt, Human
caccagaaagacagaaguuaaucc

SEQ ID NO: 170724 - RNA, 25 nt, Human
caccagaaagacagaaguuaauccc

SEQ ID NO: 170725 - RNA, 24 nt, Human
caccucuuucucuugauaacuuuc

SEQ ID NO: 170726 - RNA, 24 nt, Human
cagcaaaaaccaaagcagacccac

SEQ ID NO: 170727 - RNA, 24 nt, Human
cagccacacuaagaacuggaaauc

SEQ ID NO: 170728 - RNA, 18 nt, Human
cagccucagccuucuaaa

SEQ ID NO: 170729 - RNA, 18 nt, Human
cagcucaaaucucccagg

SEQ ID NO: 170730 - RNA, 21 nt, Human
cagcucaaaucucccaggaac

SEQ ID NO: 170731 - RNA, 23 nt, Human
cauacgucuucccuaauuguucc

SEQ ID NO: 170732 - RNA, 19 nt, Human
caucuccaaaaucagcuca

SEQ ID NO: 170733 - RNA, 21 nt, Human
ccacuuguccugcuccaucuc

SEQ ID NO: 170734 - RNA, 21 nt, Human
ccagacacugauauaaauuuc

SEQ ID NO: 170735 - RNA, 24 nt, Human
ccccagccucagccuucuaaagcc

SEQ ID NO: 170736 - RNA, 24 nt, Human
cccccagccucagccuucuaaagc

SEQ ID NO: 170737 - RNA, 19 nt, Human
cccgcgccugcagcgcgcc

SEQ ID NO: 170738 - RNA, 20 nt, Human
cggcggauuccuucugaucc

SEQ ID NO: 170739 - RNA, 20 nt, Human
gagagagaaagagagagaga

SEQ ID NO: 170740 - RNA, 18 nt, Human
gagagagagagaaagaga

SEQ ID NO: 170741 - RNA, 19 nt, Human
gcuauguugcccagguugg

SEQ ID NO: 170742 - RNA, 20 nt, Human
gcuauguugcccagguuggu

SEQ ID NO: 170743 - RNA, 24 nt, Human
ggggguguugcuauguugcccagg

SEQ ID NO: 170744 - RNA, 24 nt, Human
gguuggucuugaacuccugacuuc

SEQ ID NO: 170745 - RNA, 23 nt, Human
uaaaaggagcuaaugaccauuau

SEQ ID NO: 170746 - RNA, 24 nt, Human
uauguugcccagguuggucuugaa

SEQ ID NO: 170747 - RNA, 21 nt, Human
uauuguucaccagaaagacag

SEQ ID NO: 170748 - RNA, 23 nt, Human
ucauuuuuguagacauggggggu

SEQ ID NO: 170749 - RNA, 21 nt, Human
uccagcaaaaaccaaagcaga

SEQ ID NO: 170750 - RNA, 22 nt, Human
uccagcaaaaaccaaagcagac

SEQ ID NO: 170751 - RNA, 26 nt, Human
uccagcaaaaaccaaagcagacccac

SEQ ID NO: 170752 - RNA, 23 nt, Human
ucccuaauuguuccgggaacuuu

SEQ ID NO: 170753 - RNA, 18 nt, Human
ucuguuuuucuccauccu

SEQ ID NO: 170754 - RNA, 21 nt, Human
ucuugaacuccugacuucaag

SEQ ID NO: 170755 - RNA, 24 nt, Human
ugaacuccugacuucaagcaaucc

SEQ ID NO: 170756 - RNA, 21 nt, Human
ugaccauuaugaaaauggcac

SEQ ID NO: 170757 - RNA, 19 nt, Human
ugacuucaagcaauccccc

SEQ ID NO: 170758 - RNA, 20 nt, Human
ugacuucaagcaauccccca

SEQ ID NO: 170759 - RNA, 24 nt, Human
ugacuucaagcaaucccccagccu

SEQ ID NO: 170760 - RNA, 24 nt, Human
ugcccagguuggucuugaacuccu

SEQ ID NO: 170761 - RNA, 22 nt, Human
ugcuauguugcccagguugguc

SEQ ID NO: 170762 - RNA, 23 nt, Human
ugggagcccagacacugauauaa

SEQ ID NO: 170763 - RNA, 20 nt, Human
uggguuuacaggcaugagug

SEQ ID NO: 170764 - RNA, 24 nt, Human
uggguuuacaggcaugaguggccu

SEQ ID NO: 170765 - RNA, 20 nt, Human
ugguuaaaaagagagagaga

SEQ ID NO: 170766 - RNA, 22 nt, Human
ugguuugcuuuuugguuuuuca

SEQ ID NO: 170767 - RNA, 19 nt, Human
uguccugcuccaucuccaa

SEQ ID NO: 170768 - RNA, 20 nt, Human
uguccugcuccaucuccaaa

SEQ ID NO: 170769 - RNA, 23 nt, Human
uguugcuauguugcccagguugg

SEQ ID NO: 170770 - RNA, 21 nt, Human
uuaaaaggagcuaaugaccau

SEQ ID NO: 170771 - RNA, 21 nt, Human
uuaaacagccacacuaagaac

SEQ ID NO: 170772 - RNA, 21 nt, Human
uuccuucugauccuucccaca

SEQ ID NO: 170773 - RNA, 18 nt, Human
uugcccagguuggucuug

SEQ ID NO: 170774 - RNA, 21 nt, Human
uugcuauguugcccagguugg

SEQ ID NO: 170775 - RNA, 18 nt, Human
uuuucuuuugguuugcuu

SEQ ID NO: 170776 - RNA, 22 nt, Human
uuuuugguuuuucauuuuugua

SEQ ID NO: 170777 - RNA, 23 nt, Human
aaaaagcuguuccagaaccuggg

SEQ ID NO: 170778 - RNA, 20 nt, Human
aagcaagcaacgaaguucca

SEQ ID NO: 170779 - RNA, 25 nt, Human
acaggacaaaaagcuguuccagaac

SEQ ID NO: 170780 - RNA, 21 nt, Human
aguuccaacaccgcugagcac

SEQ ID NO: 170781 - RNA, 18 nt, Human
caaaauaacgaggguaac

SEQ ID NO: 170782 - RNA, 25 nt, Human
caaaauaacgaggguaaccgguacc

SEQ ID NO: 170783 - RNA, 23 nt, Human
caacaccgcugagcaccgacgcc

SEQ ID NO: 170784 - RNA, 22 nt, Human
cacuuuuaaugggaaccagagg

SEQ ID NO: 170785 - RNA, 22 nt, Human
cgcacaggcaagcaagcaacga

SEQ ID NO: 170786 - RNA, 24 nt, Human
cgcgcacaggcaagcaagcaacga

SEQ ID NO: 170787 - RNA, 26 nt, Human
cgcgcacaggcaagcaagcaacgaag

SEQ ID NO: 170788 - RNA, 24 nt, Human
uacaaaauaacgaggguaacacug

SEQ ID NO: 170789 - RNA, 21 nt, Human
uacaauuacauaguccgacac

SEQ ID NO: 170790 - RNA, 21 nt, Human
uaguccgacacaaaaaaaacc

SEQ ID NO: 170791 - RNA, 21 nt, Human
uccaacaccgcugagcaccga

SEQ ID NO: 170792 - RNA, 22 nt, Human
uccagaaccuggggagccaggc

SEQ ID NO: 170793 - RNA, 18 nt, Human
uccgcgcacgcgcgcaca

SEQ ID NO: 170794 - RNA, 24 nt, Human
aaaagucaccucuauauagaaauc

SEQ ID NO: 170795 - RNA, 18 nt, Human
aaagggaagugaaggaaa

SEQ ID NO: 170796 - RNA, 22 nt, Human
aacuacuggcaccagccuuagg

SEQ ID NO: 170797 - RNA, 21 nt, Human
aagccacaccuugauugagcc

SEQ ID NO: 170798 - RNA, 19 nt, Human
aaggaaccagguaacgggc

SEQ ID NO: 170799 - RNA, 22 nt, Human
aagggguggggguuacuguaag

SEQ ID NO: 170800 - RNA, 23 nt, Human
aagggguggggguuacuguaagg

SEQ ID NO: 170801 - RNA, 24 nt, Human
acagagcuugcacaguacuuaaaa

SEQ ID NO: 170802 - RNA, 19 nt, Human
accuugauugagccuggga

SEQ ID NO: 170803 - RNA, 18 nt, Human
agacucugccacgacauc

SEQ ID NO: 170804 - RNA, 24 nt, Human
agcccccacccaguccccacuccu

SEQ ID NO: 170805 - RNA, 21 nt, Human
aggcacaagcauccgcagccu

SEQ ID NO: 170806 - RNA, 21 nt, Human
aggggccauccuccccaagcc

SEQ ID NO: 170807 - RNA, 25 nt, Human
agugaaggaaaggaaguuccuacuu

SEQ ID NO: 170808 - RNA, 25 nt, Human
auccuccccaagccauuucccacau

SEQ ID NO: 170809 - RNA, 18 nt, Human
caacuccucaacuggggg

SEQ ID NO: 170810 - RNA, 20 nt, Human
cacacaaaccaacacccaac

SEQ ID NO: 170811 - RNA, 23 nt, Human
cacaggaggaaucgagguagcaa

SEQ ID NO: 170812 - RNA, 21 nt, Human
caccucuuguccacacacaaa

SEQ ID NO: 170813 - RNA, 25 nt, Human
cacugcccccagccucuguccaaca

SEQ ID NO: 170814 - RNA, 23 nt, Human
cagagcuugcacaguacuuaaaa

SEQ ID NO: 170815 - RNA, 27 nt, Human
cagccuguccugaccccagccugcacu

SEQ ID NO: 170816 - RNA, 20 nt, Human
caggaggaaucgagguagca

SEQ ID NO: 170817 - RNA, 20 nt, Human
cagucuuccuaagcuagggg

SEQ ID NO: 170818 - RNA, 19 nt, Human
ccacuccuaucaauagcca

SEQ ID NO: 170819 - RNA, 20 nt, Human
cccacuccuaucaauagcca

SEQ ID NO: 170820 - RNA, 21 nt, Human
cccaggcaaacuuggaagaaa

SEQ ID NO: 170821 - RNA, 23 nt, Human
ccccagccgcugaucgcaggugc

SEQ ID NO: 170822 - RNA, 23 nt, Human
ccgcagccuguccugaccccagc

SEQ ID NO: 170823 - RNA, 21 nt, Human
ccgccgccgccuuccgcaggc

SEQ ID NO: 170824 - RNA, 23 nt, Human
ccgccgccgccuuccgcaggcuc

SEQ ID NO: 170825 - RNA, 21 nt, Human
ccucccaauuggaggggugga

SEQ ID NO: 170826 - RNA, 27 nt, Human
ccugaccccagccugcacucucucaac

SEQ ID NO: 170827 - RNA, 18 nt, Human
ccuugauugagccuggga

SEQ ID NO: 170828 - RNA, 19 nt, Human
cgcacuaccauaaccugcc

SEQ ID NO: 170829 - RNA, 20 nt, Human
cgcaggugccgccgccgccg

SEQ ID NO: 170830 - RNA, 20 nt, Human
cgccgccgccuuccgcaggc

SEQ ID NO: 170831 - RNA, 20 nt, Human
cuccccaagccauuucccac

SEQ ID NO: 170832 - RNA, 21 nt, Human
cugaaggcgggaacaaauggc

SEQ ID NO: 170833 - RNA, 21 nt, Human
cugcuaugcugcuugcagggg

SEQ ID NO: 170834 - RNA, 19 nt, Human
cuucaccacccaccaacca

SEQ ID NO: 170835 - RNA, 21 nt, Human
cuucaccacccaccaaccacc

SEQ ID NO: 170836 - RNA, 23 nt, Human
cuuccuaagcuaggggccauccu

SEQ ID NO: 170837 - RNA, 18 nt, Human
cuucugucugccaccucc

SEQ ID NO: 170838 - RNA, 20 nt, Human
cuugggagaguggggugcua

SEQ ID NO: 170839 - RNA, 23 nt, Human
gaacaaauaacacaacagucuuc

SEQ ID NO: 170840 - RNA, 24 nt, Human
gaacaaauaacacaacagucuucc

SEQ ID NO: 170841 - RNA, 24 nt, Human
gaagcccccacccaguccccacuc

SEQ ID NO: 170842 - RNA, 19 nt, Human
gagaagcccccacccaguc

SEQ ID NO: 170843 - RNA, 20 nt, Human
gagaagcccccacccagucc

SEQ ID NO: 170844 - RNA, 18 nt, Human
gcacuaccauaaccugcc

SEQ ID NO: 170845 - RNA, 19 nt, Human
gcagaccaggcaaggaacc

SEQ ID NO: 170846 - RNA, 20 nt, Human
gccgccgccgccgccuuccg

SEQ ID NO: 170847 - RNA, 21 nt, Human
gcuggcacugcccccagccuc

SEQ ID NO: 170848 - RNA, 23 nt, Human
gggaguuucuugccggggcaggg

SEQ ID NO: 170849 - RNA, 18 nt, Human
ggggguucgggguugggg

SEQ ID NO: 170850 - RNA, 20 nt, Human
ggggguucgggguugggggg

SEQ ID NO: 170851 - RNA, 19 nt, Human
gggguucgggguugggggg

SEQ ID NO: 170852 - RNA, 20 nt, Human
ggguguugucccuuaccaca

SEQ ID NO: 170853 - RNA, 25 nt, Human
gguggaggauuuggugcaaagccag

SEQ ID NO: 170854 - RNA, 18 nt, Human
guagagggagaagccccc

SEQ ID NO: 170855 - RNA, 21 nt, Human
uaacuccccauaggcacaagc

SEQ ID NO: 170856 - RNA, 22 nt, Human
uaagcuaggggccauccucccc

SEQ ID NO: 170857 - RNA, 21 nt, Human
uacaaaccuucacauuauaag

SEQ ID NO: 170858 - RNA, 23 nt, Human
uagagggagaagcccccacccag

SEQ ID NO: 170859 - RNA, 23 nt, Human
uaggcacaagcauccgcagccug

SEQ ID NO: 170860 - RNA, 23 nt, Human
uaggccccaggcaaacuuggaag

SEQ ID NO: 170861 - RNA, 21 nt, Human
uagugcuuucccuugacugau

SEQ ID NO: 170862 - RNA, 26 nt, Human
ucaccacccaccaaccaccucuuguc

SEQ ID NO: 170863 - RNA, 24 nt, Human
ucaggguuguggccccagccuggg

SEQ ID NO: 170864 - RNA, 22 nt, Human
ucauggacuauuuacaaaccuu

SEQ ID NO: 170865 - RNA, 20 nt, Human
uccacacacaaaccaacacc

SEQ ID NO: 170866 - RNA, 21 nt, Human
uccacacacaaaccaacaccc

SEQ ID NO: 170867 - RNA, 25 nt, Human
uccgcagccuguccugaccccagcc

SEQ ID NO: 170868 - RNA, 21 nt, Human
uccuuucuuucccuacccagg

SEQ ID NO: 170869 - RNA, 20 nt, Human
uccuuuuaugguuuuucccu

SEQ ID NO: 170870 - RNA, 22 nt, Human
ugaacaaauaacacaacagucu

SEQ ID NO: 170871 - RNA, 21 nt, Human
ugaaggcgggaacaaauggca

SEQ ID NO: 170872 - RNA, 20 nt, Human
ugccacgacaucaucaugga

SEQ ID NO: 170873 - RNA, 19 nt, Human
ugccccagccgcugaucgc

SEQ ID NO: 170874 - RNA, 19 nt, Human
ugcuucugucugccaccuc

SEQ ID NO: 170875 - RNA, 21 nt, Human
uggaagaaagcagaccaggca

SEQ ID NO: 170876 - RNA, 20 nt, Human
uggcaccagccuuagggugu

SEQ ID NO: 170877 - RNA, 21 nt, Human
uggcuugggagaguggggugc

SEQ ID NO: 170878 - RNA, 21 nt, Human
ugguaggcuacucauaacuac

SEQ ID NO: 170879 - RNA, 21 nt, Human
uguauacagugcccacagccu

SEQ ID NO: 170880 - RNA, 22 nt, Human
ugucuccacggaaacgcggccu

SEQ ID NO: 170881 - RNA, 25 nt, Human
uucaccacccaccaaccaccucuug

SEQ ID NO: 170882 - RNA, 21 nt, Human
uucaggguuguggccccagcc

SEQ ID NO: 170883 - RNA, 23 nt, Human
uucccacauuauagaagcacaga

SEQ ID NO: 170884 - RNA, 21 nt, Human
uugcaguagggggaucagccc

SEQ ID NO: 170885 - RNA, 18 nt, Human
aagcugccccccaggggc

SEQ ID NO: 170886 - RNA, 22 nt, Human
aguguaggggucagcuuggcug

SEQ ID NO: 170887 - RNA, 19 nt, Human
aguuccuugcccuggaugg

SEQ ID NO: 170888 - RNA, 19 nt, Human
cacaggauccagguucagc

SEQ ID NO: 170889 - RNA, 23 nt, Human
cagaccacaguggcucuccuccu

SEQ ID NO: 170890 - RNA, 21 nt, Human
cagguucagcugagucaggcu

SEQ ID NO: 170891 - RNA, 24 nt, Human
ccuggccccacugguacccaggaa

SEQ ID NO: 170892 - RNA, 19 nt, Human
cuaugcacaggauccaggu

SEQ ID NO: 170893 - RNA, 21 nt, Human
cucugagccagagccaccucc

SEQ ID NO: 170894 - RNA, 21 nt, Human
ggcucagugccaggcuggagg

SEQ ID NO: 170895 - RNA, 19 nt, Human
ggcugggagccaaggucac

SEQ ID NO: 170896 - RNA, 20 nt, Human
gggcugagguauggucagug

SEQ ID NO: 170897 - RNA, 23 nt, Human
gggucagcuuggcugggccaggg

SEQ ID NO: 170898 - RNA, 20 nt, Human
uaaagcugccccccaggggc

SEQ ID NO: 170899 - RNA, 22 nt, Human
ucagaccacaguggcucuccuc

SEQ ID NO: 170900 - RNA, 19 nt, Human
ucagugccaggcuggaggu

SEQ ID NO: 170901 - RNA, 26 nt, Human
ugaggcuuguagacugucggggcagu

SEQ ID NO: 170902 - RNA, 30 nt, Human
ugcccagguuaaagcugccccccaggggcc

SEQ ID NO: 170903 - RNA, 23 nt, Human
uggccccacugguacccaggaaa

SEQ ID NO: 170904 - RNA, 23 nt, Human
uucagaccacaguggcucuccuc

SEQ ID NO: 170905 - RNA, 25 nt, Human
uugaaccagaaagacaguuccuugc

SEQ ID NO: 170906 - RNA, 25 nt, Human
aaaaaaaaaaaaaaaaacuaaaaag

SEQ ID NO: 170907 - RNA, 23 nt, Human
aaaaaaaaaacuaaaaagauucu

SEQ ID NO: 170908 - RNA, 18 nt, Human
aaaaagauucuucaccuu

SEQ ID NO: 170909 - RNA, 20 nt, Human
aaacacagaaggggacuugg

SEQ ID NO: 170910 - RNA, 22 nt, Human
aaacagaucccagacccucagc

SEQ ID NO: 170911 - RNA, 20 nt, Human
aaacagcaaggggcuccuga

SEQ ID NO: 170912 - RNA, 23 nt, Human
aaagucuuugaggggcugugggg

SEQ ID NO: 170913 - RNA, 18 nt, Human
aacaagucucccucuaga

SEQ ID NO: 170914 - RNA, 21 nt, Human
aacaccacaagcuucuccaga

SEQ ID NO: 170915 - RNA, 19 nt, Human
aacacgaugaaaccccguc

SEQ ID NO: 170916 - RNA, 20 nt, Human
aacacgaugaaaccccgucu

SEQ ID NO: 170917 - RNA, 21 nt, Human
aacacgaugaaaccccgucuc

SEQ ID NO: 170918 - RNA, 20 nt, Human
aacauggugaaacccugucu

SEQ ID NO: 170919 - RNA, 21 nt, Human
aacauggugaaacccugucuc

SEQ ID NO: 170920 - RNA, 23 nt, Human
aagacagguggaugacaagguca

SEQ ID NO: 170921 - RNA, 23 nt, Human
aagaucacgccacugcacuccag

SEQ ID NO: 170922 - RNA, 23 nt, Human
aagccuacaggcauggggucugg

SEQ ID NO: 170923 - RNA, 23 nt, Human
aagucucccucuagaaucacucc

SEQ ID NO: 170924 - RNA, 22 nt, Human
acaaggucaggagaucgagacc

SEQ ID NO: 170925 - RNA, 21 nt, Human
acagagcaagacgcuggccaa

SEQ ID NO: 170926 - RNA, 20 nt, Human
acagagcaagacuccgucuc

SEQ ID NO: 170927 - RNA, 22 nt, Human
acagagcaagacuccgucucaa

SEQ ID NO: 170928 - RNA, 25 nt, Human
acagagcgagacccugucuccaaaa

SEQ ID NO: 170929 - RNA, 21 nt, Human
accaacuaccccagcuuuucc

SEQ ID NO: 170930 - RNA, 26 nt, Human
accaacuaccccagcuuuuccagaga

SEQ ID NO: 170931 - RNA, 21 nt, Human
acccagcauucugggaggcca

SEQ ID NO: 170932 - RNA, 24 nt, Human
accccgucucuacuaaaaauacaa

SEQ ID NO: 170933 - RNA, 30 nt, Human
acccugucuccaaaaaaaaaaaaaaaaaaa

SEQ ID NO: 170934 - RNA, 24 nt, Human
acccugucucuacuaaaaauacaa

SEQ ID NO: 170935 - RNA, 24 nt, Human
acgccacugcacuccagccugggc

SEQ ID NO: 170936 - RNA, 24 nt, Human
acgccacugcacuccagccugggc

SEQ ID NO: 170937 - RNA, 24 nt, Human
acugcacuccagccugggcaacag

SEQ ID NO: 170938 - RNA, 24 nt, Human
acugcacuccagccugggcaacag

SEQ ID NO: 170939 - RNA, 18 nt, Human
acugcacucuggccuggg

SEQ ID NO: 170940 - RNA, 24 nt, Human
acugcacucuggccugggcuacag

SEQ ID NO: 170941 - RNA, 22 nt, Human
agaaucgcuugaacacaggagg

SEQ ID NO: 170942 - RNA, 21 nt, Human
agacaaagaccaacuuccuuc

SEQ ID NO: 170943 - RNA, 18 nt, Human
agacaggagaaucgcuug

SEQ ID NO: 170944 - RNA, 24 nt, Human
agacagguggaugacaaggucagg

SEQ ID NO: 170945 - RNA, 19 nt, Human
agagcugacuauguuuaag

SEQ ID NO: 170946 - RNA, 18 nt, Human
agagcuugcagugagcug

SEQ ID NO: 170947 - RNA, 24 nt, Human
agagcuugcagugagcugagaucg

SEQ ID NO: 170948 - RNA, 25 nt, Human
agaucucgacaaccccguccaccuu

SEQ ID NO: 170949 - RNA, 24 nt, Human
agcacugugggaggccgagguggg

SEQ ID NO: 170950 - RNA, 24 nt, Human
agcauucugggaggccaagguggg

SEQ ID NO: 170951 - RNA, 24 nt, Human
agccugggcaauaucacaagaccu

SEQ ID NO: 170952 - RNA, 25 nt, Human
agcuuuaaaaaaaagugucccugga

SEQ ID NO: 170953 - RNA, 19 nt, Human
aggaggcugaggcagaaug

SEQ ID NO: 170954 - RNA, 21 nt, Human
aggcagaauggcaugaacccg

SEQ ID NO: 170955 - RNA, 22 nt, Human
aggcagaauggcaugaacccgg

SEQ ID NO: 170956 - RNA, 20 nt, Human
aggcagagcuugcagugagc

SEQ ID NO: 170957 - RNA, 24 nt, Human
aggcagagcuugcagugagcugag

SEQ ID NO: 170958 - RNA, 24 nt, Human
aggcaugguggcucacgccgguaa

SEQ ID NO: 170959 - RNA, 21 nt, Human
aggccgaggugggcagaucac

SEQ ID NO: 170960 - RNA, 19 nt, Human
aggcggaaguugcagugag

SEQ ID NO: 170961 - RNA, 24 nt, Human
aggcggaaguugcagugagccaag

SEQ ID NO: 170962 - RNA, 24 nt, Human
aggcugagacaggagaaucgcuug

SEQ ID NO: 170963 - RNA, 21 nt, Human
aggggcuguggggcuuguugg

SEQ ID NO: 170964 - RNA, 24 nt, Human
agguggaugacaaggucaggagau

SEQ ID NO: 170965 - RNA, 24 nt, Human
aggugggcagaucacgaggucagg

SEQ ID NO: 170966 - RNA, 24 nt, Human
aguggcucaugccaguaaucccag

SEQ ID NO: 170967 - RNA, 20 nt, Human
auaccugcacacuuccagaa

SEQ ID NO: 170968 - RNA, 24 nt, Human
aucacgccacugcacuccagccug

SEQ ID NO: 170969 - RNA, 22 nt, Human
aucccagcacuuugggaggcca

SEQ ID NO: 170970 - RNA, 24 nt, Human
aucgcgccacugcacucuggccug

SEQ ID NO: 170971 - RNA, 22 nt, Human
auggccugugccuguaguccca

SEQ ID NO: 170972 - RNA, 23 nt, Human
caaagccagauguagugguucug

SEQ ID NO: 170973 - RNA, 22 nt, Human
caacagagcgagacccugucuc

SEQ ID NO: 170974 - RNA, 24 nt, Human
caacauggugaaacccugucucua

SEQ ID NO: 170975 - RNA, 19 nt, Human
caaccugaacucacaccca

SEQ ID NO: 170976 - RNA, 21 nt, Human
caacuaccccagcuuuuccag

SEQ ID NO: 170977 - RNA, 24 nt, Human
caauaucacaagaccucgucucua

SEQ ID NO: 170978 - RNA, 19 nt, Human
caccugcagacaaagacca

SEQ ID NO: 170979 - RNA, 22 nt, Human
cacgccgguaaucccagcacug

SEQ ID NO: 170980 - RNA, 18 nt, Human
cacuccagaaacacagaa

SEQ ID NO: 170981 - RNA, 24 nt, Human
cacuccagccugggcaacagagcg

SEQ ID NO: 170982 - RNA, 18 nt, Human
cacugcacuccagccugg

SEQ ID NO: 170983 - RNA, 19 nt, Human
cacugcacuccagccuggg

SEQ ID NO: 170984 - RNA, 21 nt, Human
cacugcacuccagccugggca

SEQ ID NO: 170985 - RNA, 23 nt, Human
cacugcacuccagccugggcaac

SEQ ID NO: 170986 - RNA, 24 nt, Human
cacugcacuccagccugggcaaca

SEQ ID NO: 170987 - RNA, 18 nt, Human
cacugcacucuggccugg

SEQ ID NO: 170988 - RNA, 19 nt, Human
cacugcacucuggccuggg

SEQ ID NO: 170989 - RNA, 20 nt, Human
cacugcacucuggccugggc

SEQ ID NO: 170990 - RNA, 23 nt, Human
cacuguggcuucuagaacugccu

SEQ ID NO: 170991 - RNA, 22 nt, Human
cagaaaacagaucccagacccu

SEQ ID NO: 170992 - RNA, 19 nt, Human
cagaccugcccaaagccag

SEQ ID NO: 170993 - RNA, 18 nt, Human
cagagcaagacgcuggcc

SEQ ID NO: 170994 - RNA, 24 nt, Human
cagcacugugggaggccgaggugg

SEQ ID NO: 170995 - RNA, 20 nt, Human
cagcacuuugggaggccaag

SEQ ID NO: 170996 - RNA, 24 nt, Human
cagcacuuugggaggccaagacag

SEQ ID NO: 170997 - RNA, 24 nt, Human
cagcauucugggaggccaaggugg

SEQ ID NO: 170998 - RNA, 24 nt, Human
cagcuacucaggaggcugaggcag

SEQ ID NO: 170999 - RNA, 22 nt, Human
cagguggaugacaaggucagga

SEQ ID NO: 171000 - RNA, 21 nt, Human
caugaacccgggaggcagagc

SEQ ID NO: 171001 - RNA, 24 nt, Human
caugccaguaaucccagcacuuug

SEQ ID NO: 171002 - RNA, 23 nt, Human
cauuuuggcagugaucccucacc

SEQ ID NO: 171003 - RNA, 20 nt, Human
ccacugcacuccagccuggg

SEQ ID NO: 171004 - RNA, 21 nt, Human
ccacugcacuccagccugggc

SEQ ID NO: 171005 - RNA, 23 nt, Human
ccacugcacuccagccugggcaa

SEQ ID NO: 171006 - RNA, 24 nt, Human
ccacugcacuccagccugggcaac

SEQ ID NO: 171007 - RNA, 20 nt, Human
ccacugcacucuggccuggg

SEQ ID NO: 171008 - RNA, 21 nt, Human
ccacugcacucuggccugggc

SEQ ID NO: 171009 - RNA, 21 nt, Human
ccacugcacucuggccugggc

SEQ ID NO: 171010 - RNA, 24 nt, Human
ccacugcacucuggccugggcuac

SEQ ID NO: 171011 - RNA, 26 nt, Human
ccagaaaacagaucccagacccucag

SEQ ID NO: 171012 - RNA, 22 nt, Human
ccagaaacgucccccuucucuc

SEQ ID NO: 171013 - RNA, 21 nt, Human
ccaggcauaauggccugugcc

SEQ ID NO: 171014 - RNA, 22 nt, Human
ccaguaaucccagcacuuuggg

SEQ ID NO: 171015 - RNA, 22 nt, Human
ccccuucucuccaacucuccca

SEQ ID NO: 171016 - RNA, 22 nt, Human
cccggccaacauggugaaaccc

SEQ ID NO: 171017 - RNA, 22 nt, Human
cccggccaacauggugaaaccc

SEQ ID NO: 171018 - RNA, 24 nt, Human
cccggccaacauggugaaacccug

SEQ ID NO: 171019 - RNA, 19 nt, Human
cccuggaucccuggaaagu

SEQ ID NO: 171020 - RNA, 27 nt, Human
cccuggaucccuggaaaguucugcucc

SEQ ID NO: 171021 - RNA, 24 nt, Human
ccgggccaggcaugguggcucacg

SEQ ID NO: 171022 - RNA, 24 nt, Human
ccgggcugggcacaguggcucaug

SEQ ID NO: 171023 - RNA, 24 nt, Human
ccuccugcucucucacccguggca

SEQ ID NO: 171024 - RNA, 22 nt, Human
ccugggcuacagagcaagacuc

SEQ ID NO: 171025 - RNA, 21 nt, Human
ccugggggcagccaucuggaa

SEQ ID NO: 171026 - RNA, 22 nt, Human
ccugguuaacacgaugaaaccc

SEQ ID NO: 171027 - RNA, 23 nt, Human
ccugguuaacacgaugaaacccc

SEQ ID NO: 171028 - RNA, 24 nt, Human
ccugguuaacacgaugaaaccccg

SEQ ID NO: 171029 - RNA, 21 nt, Human
ccuguagucccagcuacucag

SEQ ID NO: 171030 - RNA, 22 nt, Human
ccuguagucccaucuacucagg

SEQ ID NO: 171031 - RNA, 25 nt, Human
ccugucugcucaaaacaaacaaaaa

SEQ ID NO: 171032 - RNA, 22 nt, Human
ccuuggccagaccucgugcucc

SEQ ID NO: 171033 - RNA, 22 nt, Human
cgacaaccccguccaccuuggc

SEQ ID NO: 171034 - RNA, 24 nt, Human
cgagaccaucccggccaacauggu

SEQ ID NO: 171035 - RNA, 19 nt, Human
cgagaccauccugguuaac

SEQ ID NO: 171036 - RNA, 24 nt, Human
cgaggugggcagaucacgagguca

SEQ ID NO: 171037 - RNA, 24 nt, Human
cgccacugcacuccagccugggca

SEQ ID NO: 171038 - RNA, 24 nt, Human
cgccgguaaucccagcacuguggg

SEQ ID NO: 171039 - RNA, 24 nt, Human
cgccuguagucccagcuacucagg

SEQ ID NO: 171040 - RNA, 24 nt, Human
cggccaacauggugaaacccuguc

SEQ ID NO: 171041 - RNA, 21 nt, Human
cuagaaucacuccagaaacac

SEQ ID NO: 171042 - RNA, 23 nt, Human
cucacgccgguaaucccagcacu

SEQ ID NO: 171043 - RNA, 24 nt, Human
cucaugccaguaaucccagcacuu

SEQ ID NO: 171044 - RNA, 22 nt, Human
cuccagaagaugccaggccucu

SEQ ID NO: 171045 - RNA, 19 nt, Human
cugaagccacguacugcug

SEQ ID NO: 171046 - RNA, 24 nt, Human
cugaggcuggguccagggucugcc

SEQ ID NO: 171047 - RNA, 19 nt, Human
cugcucaaaacaaacaaaa

SEQ ID NO: 171048 - RNA, 20 nt, Human
cugcuugagcccaggaguug

SEQ ID NO: 171049 - RNA, 25 nt, Human
cuucaggaacaccacaagcuucucc

SEQ ID NO: 171050 - RNA, 25 nt, Human
cuucuagaacugccugccagccauc

SEQ ID NO: 171051 - RNA, 19 nt, Human
cuugcagugagcugagauc

SEQ ID NO: 171052 - RNA, 21 nt, Human
cuugcagugagcugagaucgc

SEQ ID NO: 171053 - RNA, 20 nt, Human
gaacccgggaggcagagcuu

SEQ ID NO: 171054 - RNA, 18 nt, Human
gaaguugcagugagccaa

SEQ ID NO: 171055 - RNA, 19 nt, Human
gaaguugcagugagccaag

SEQ ID NO: 171056 - RNA, 24 nt, Human
gacugcuugagcccaggaguugaa

SEQ ID NO: 171057 - RNA, 20 nt, Human
gagaucgcgccacugcacuc

SEQ ID NO: 171058 - RNA, 22 nt, Human
gagcugcuugcagguggcagau

SEQ ID NO: 171059 - RNA, 22 nt, Human
gaggcagagcuugcagugagcu

SEQ ID NO: 171060 - RNA, 18 nt, Human
gaugacaaggucaggaga

SEQ ID NO: 171061 - RNA, 24 nt, Human
gcacuccagccugggcaacagagc

SEQ ID NO: 171062 - RNA, 24 nt, Human
gccaacauggugaaacccugucuc

SEQ ID NO: 171063 - RNA, 20 nt, Human
gccaagaucacgccacugca

SEQ ID NO: 171064 - RNA, 22 nt, Human
gccacugcacuccagccugggc

SEQ ID NO: 171065 - RNA, 24 nt, Human
gccacugcacuccagccugggcaa

SEQ ID NO: 171066 - RNA, 20 nt, Human
gccacugcacucuggccugg

SEQ ID NO: 171067 - RNA, 18 nt, Human
gccugggcuacagagcaa

SEQ ID NO: 171068 - RNA, 23 nt, Human
gccugggcuacagagcaagacuc

SEQ ID NO: 171069 - RNA, 21 nt, Human
gcuacaauuagguugcacauu

SEQ ID NO: 171070 - RNA, 22 nt, Human
gcucugcucaccaacuacccca

SEQ ID NO: 171071 - RNA, 24 nt, Human
gcucugcucaccaacuaccccagc

SEQ ID NO: 171072 - RNA, 20 nt, Human
gcugagaucgcgccacugca

SEQ ID NO: 171073 - RNA, 20 nt, Human
gcugaguugggaacaguacu

SEQ ID NO: 171074 - RNA, 20 nt, Human
ggaaguugcagugagccaag

SEQ ID NO: 171075 - RNA, 24 nt, Human
ggaaguugcagugagccaagauca

SEQ ID NO: 171076 - RNA, 23 nt, Human
ggcacaguggcucaugccaguaa

SEQ ID NO: 171077 - RNA, 21 nt, Human
ggcagaucacgaggucaggag

SEQ ID NO: 171078 - RNA, 21 nt, Human
ggcagccaucuggaaguacug

SEQ ID NO: 171079 - RNA, 20 nt, Human
ggccgagcugcuugcaggug

SEQ ID NO: 171080 - RNA, 18 nt, Human
ggcgugguggcgggcgcc

SEQ ID NO: 171081 - RNA, 22 nt, Human
ggcgugguggcgggcgccugua

SEQ ID NO: 171082 - RNA, 21 nt, Human
ggcucacgccgguaaucccag

SEQ ID NO: 171083 - RNA, 21 nt, Human
ggcugggaagagcaggugggc

SEQ ID NO: 171084 - RNA, 23 nt, Human
ggcugggcacaguggcucaugcc

SEQ ID NO: 171085 - RNA, 19 nt, Human
gggacagacagugguuagc

SEQ ID NO: 171086 - RNA, 21 nt, Human
gggcacaguggcucaugccag

SEQ ID NO: 171087 - RNA, 19 nt, Human
gggcacccauuugcuucag

SEQ ID NO: 171088 - RNA, 20 nt, Human
gggucugccuaccuuuagau

SEQ ID NO: 171089 - RNA, 18 nt, Human
gggucuggaugaguagac

SEQ ID NO: 171090 - RNA, 24 nt, Human
gguggcgggcgccuguagucccag

SEQ ID NO: 171091 - RNA, 24 nt, Human
gguggcucacgccgguaaucccag

SEQ ID NO: 171092 - RNA, 23 nt, Human
gguguguuuauaccugcacacuu

SEQ ID NO: 171093 - RNA, 18 nt, Human
gucuuugaggggcugugg

SEQ ID NO: 171094 - RNA, 21 nt, Human
gugaaacccugucucuacuaa

SEQ ID NO: 171095 - RNA, 23 nt, Human
gugagaggcaaccugaacucaca

SEQ ID NO: 171096 - RNA, 23 nt, Human
guggccggagcgcaccccguggc

SEQ ID NO: 171097 - RNA, 24 nt, Human
guggcucaugccaguaaucccagc

SEQ ID NO: 171098 - RNA, 21 nt, Human
uaaaaauacaaaaauuagcca

SEQ ID NO: 171099 - RNA, 25 nt, Human
uaaacccagcauucugggaggccaa

SEQ ID NO: 171100 - RNA, 22 nt, Human
uaacacgaugaaaccccgucuc

SEQ ID NO: 171101 - RNA, 24 nt, Human
uaacacgaugaaaccccgucucua

SEQ ID NO: 171102 - RNA, 24 nt, Human
uacaaaaauuagccaggcauaaug

SEQ ID NO: 171103 - RNA, 23 nt, Human
uacagagcaagacuccgucucaa

SEQ ID NO: 171104 - RNA, 21 nt, Human
uaccccagcuuuuccagagac

SEQ ID NO: 171105 - RNA, 23 nt, Human
uacuucagaaagucucccuggcu

SEQ ID NO: 171106 - RNA, 19 nt, Human
uagaauauucagacaguuc

SEQ ID NO: 171107 - RNA, 18 nt, Human
ucacgaggucaggagauc

SEQ ID NO: 171108 - RNA, 24 nt, Human
ucacgaggucaggagaucgagacc

SEQ ID NO: 171109 - RNA, 23 nt, Human
ucacgccacugcacuccagccug

SEQ ID NO: 171110 - RNA, 20 nt, Human
uccaaaaaacagcaaggggc

SEQ ID NO: 171111 - RNA, 23 nt, Human
uccagccugggcaacagagcgag

SEQ ID NO: 171112 - RNA, 24 nt, Human
uccagccugggcaacagagcgaga

SEQ ID NO: 171113 - RNA, 23 nt, Human
uccuguccauaagggcccugcag

SEQ ID NO: 171114 - RNA, 22 nt, Human
ucuagaaucacuccagaaacac

SEQ ID NO: 171115 - RNA, 20 nt, Human
ucuccaaaaaaaaaaaaaaa

SEQ ID NO: 171116 - RNA, 21 nt, Human
ucucuacuaaaaauacaaaaa

SEQ ID NO: 171117 - RNA, 22 nt, Human
ucucuacuaaaaauacaaaaaa

SEQ ID NO: 171118 - RNA, 18 nt, Human
ucuuuggaggacccaggg

SEQ ID NO: 171119 - RNA, 24 nt, Human
ugacaaggucaggagaucgagacc

SEQ ID NO: 171120 - RNA, 20 nt, Human
ugagacaggagaaucgcuug

SEQ ID NO: 171121 - RNA, 23 nt, Human
ugagacaggagaaucgcuugaac

SEQ ID NO: 171122 - RNA, 23 nt, Human
ugagcccaggaguugaagaacag

SEQ ID NO: 171123 - RNA, 22 nt, Human
ugagcugagaucgcgccacugc

SEQ ID NO: 171124 - RNA, 22 nt, Human
ugaggcagaauggcaugaaccc

SEQ ID NO: 171125 - RNA, 23 nt, Human
ugaggcuggguccagggucugcc

SEQ ID NO: 171126 - RNA, 18 nt, Human
ugaguagacaggggaugu

SEQ ID NO: 171127 - RNA, 20 nt, Human
ugccuggaucugaggcuggg

SEQ ID NO: 171128 - RNA, 24 nt, Human
ugccuguagucccaucuacucagg

SEQ ID NO: 171129 - RNA, 19 nt, Human
uggaacauucauuagaugc

SEQ ID NO: 171130 - RNA, 23 nt, Human
uggcagcugaguugggaacagua

SEQ ID NO: 171131 - RNA, 24 nt, Human
uggcccggugugcuggcucacauc

SEQ ID NO: 171132 - RNA, 22 nt, Human
uggcucacgccgguaaucccag

SEQ ID NO: 171133 - RNA, 24 nt, Human
uggcucacgccgguaaucccagca

SEQ ID NO: 171134 - RNA, 22 nt, Human
uggcucaugccaguaaucccag

SEQ ID NO: 171135 - RNA, 24 nt, Human
uggcucaugccaguaaucccagca

SEQ ID NO: 171136 - RNA, 18 nt, Human
uggcuucuagaacugccu

SEQ ID NO: 171137 - RNA, 19 nt, Human
ugggaggccaaggugggag

SEQ ID NO: 171138 - RNA, 19 nt, Human
ugggaggccgaggugggca

SEQ ID NO: 171139 - RNA, 20 nt, Human
ugggaggccgaggugggcag

SEQ ID NO: 171140 - RNA, 24 nt, Human
ugggaggccgaggugggcagauca

SEQ ID NO: 171141 - RNA, 24 nt, Human
ugggcaacagagcgagacccuguc

SEQ ID NO: 171142 - RNA, 26 nt, Human
ugggcaauaucacaagaccucgucuc

SEQ ID NO: 171143 - RNA, 22 nt, Human
ugggcagaucacgaggucagga

SEQ ID NO: 171144 - RNA, 19 nt, Human
uggggcuuguuggacagag

SEQ ID NO: 171145 - RNA, 24 nt, Human
ugguggcgggcgccuguaguccca

SEQ ID NO: 171146 - RNA, 24 nt, Human
ugguggcucacgccgguaauccca

SEQ ID NO: 171147 - RNA, 19 nt, Human
ugugggaggccgagguggg

SEQ ID NO: 171148 - RNA, 18 nt, Human
uuagccgggcgugguggc

SEQ ID NO: 171149 - RNA, 24 nt, Human
uuagccgggcgugguggcgggcgc

SEQ ID NO: 171150 - RNA, 22 nt, Human
uuaguuaucuggauuuccagaa

SEQ ID NO: 171151 - RNA, 19 nt, Human
uucuucaccuuaguuaucu

SEQ ID NO: 171152 - RNA, 20 nt, Human
uugcagugagccaagaucac

SEQ ID NO: 171153 - RNA, 18 nt, Human
uugcagugagcugagauc

SEQ ID NO: 171154 - RNA, 19 nt, Human
uugcagugagcugagaucg

SEQ ID NO: 171155 - RNA, 22 nt, Human
uugcagugagcugagaucgcgc

SEQ ID NO: 171156 - RNA, 22 nt, Human
uuggacagagucccgcucugcu

SEQ ID NO: 171157 - RNA, 24 nt, Human
uuucuucuuucacccuccaaaaaa

SEQ ID NO: 171158 - RNA, 19 nt, Human
aaacaggugauuggugggg

SEQ ID NO: 171159 - RNA, 19 nt, Human
aaagugcuggaauuacagg

SEQ ID NO: 171160 - RNA, 24 nt, Human
aaagugcuggaauuacaggcguga

SEQ ID NO: 171161 - RNA, 22 nt, Human
aacaacaucacaaacaaaucag

SEQ ID NO: 171162 - RNA, 19 nt, Human
aacacaggcccucagggac

SEQ ID NO: 171163 - RNA, 22 nt, Human
aacuggucuaagccuugcagug

SEQ ID NO: 171164 - RNA, 26 nt, Human
aagugcuggaauuacaggcgugagcc

SEQ ID NO: 171165 - RNA, 18 nt, Human
aauuacaggcgugagcca

SEQ ID NO: 171166 - RNA, 22 nt, Human
aauuacaggcgugagccacagc

SEQ ID NO: 171167 - RNA, 24 nt, Human
acaacaucacaaacaaaucagcca

SEQ ID NO: 171168 - RNA, 22 nt, Human
acaccaagguucuggaaagaga

SEQ ID NO: 171169 - RNA, 19 nt, Human
acagcagcaauuucccuca

SEQ ID NO: 171170 - RNA, 18 nt, Human
accuucaggaggguagau

SEQ ID NO: 171171 - RNA, 18 nt, Human
agacacgucaucauuuuu

SEQ ID NO: 171172 - RNA, 19 nt, Human
agagugaggagacacguca

SEQ ID NO: 171173 - RNA, 18 nt, Human
agcaggugaggccccagg

SEQ ID NO: 171174 - RNA, 23 nt, Human
agcaggugagguccccaacaggc

SEQ ID NO: 171175 - RNA, 19 nt, Human
agcaggugagguccccagc

SEQ ID NO: 171176 - RNA, 22 nt, Human
agcccaggcaccaugccggccu

SEQ ID NO: 171177 - RNA, 19 nt, Human
agcgccuguccacccuugg

SEQ ID NO: 171178 - RNA, 21 nt, Human
aggucccuagcaggcaagucu

SEQ ID NO: 171179 - RNA, 24 nt, Human
auuucccucaaccccagaauauuu

SEQ ID NO: 171180 - RNA, 27 nt, Human
caaaacacaggcccucagggacagccg

SEQ ID NO: 171181 - RNA, 24 nt, Human
caaagugcuggaauuacaggcgug

SEQ ID NO: 171182 - RNA, 23 nt, Human
caagcuaagccaucgauaucccc

SEQ ID NO: 171183 - RNA, 21 nt, Human
cacaggcccucagggacagcc

SEQ ID NO: 171184 - RNA, 24 nt, Human
caccaggaggccauggcagguuuc

SEQ ID NO: 171185 - RNA, 19 nt, Human
cacuguauggguugcgaau

SEQ ID NO: 171186 - RNA, 21 nt, Human
cagccucuccuaggagacaau

SEQ ID NO: 171187 - RNA, 21 nt, Human
cagcgagcaguggaugaggac

SEQ ID NO: 171188 - RNA, 19 nt, Human
caggaggguagauuggggg

SEQ ID NO: 171189 - RNA, 21 nt, Human
cagguaaaguccccgaccgcc

SEQ ID NO: 171190 - RNA, 19 nt, Human
caggugauuggugggggcg

SEQ ID NO: 171191 - RNA, 26 nt, Human
caucacaaacaaaucagccagaacca

SEQ ID NO: 171192 - RNA, 22 nt, Human
ccaaagugcuggaauuacaggc

SEQ ID NO: 171193 - RNA, 24 nt, Human
ccaaagugcuggaauuacaggcgu

SEQ ID NO: 171194 - RNA, 20 nt, Human
ccaagaccuaaguucacacc

SEQ ID NO: 171195 - RNA, 18 nt, Human
ccaagcuaagccaucgau

SEQ ID NO: 171196 - RNA, 18 nt, Human
cccagguaagagagaggg

SEQ ID NO: 171197 - RNA, 18 nt, Human
ccccagggcccagggccc

SEQ ID NO: 171198 - RNA, 21 nt, Human
ccccagggcccagggcccucc

SEQ ID NO: 171199 - RNA, 19 nt, Human
ccccucacaggcggcuaac

SEQ ID NO: 171200 - RNA, 25 nt, Human
ccccugaggugagaaccugggguga

SEQ ID NO: 171201 - RNA, 26 nt, Human
ccccugaggugagaaccuggggugag

SEQ ID NO: 171202 - RNA, 21 nt, Human
cccuccagggugaggucccca

SEQ ID NO: 171203 - RNA, 22 nt, Human
ccggcagcccaggcaccaugcc

SEQ ID NO: 171204 - RNA, 18 nt, Human
ccuccagcagccaagguc

SEQ ID NO: 171205 - RNA, 19 nt, Human
ccugagugugacgaaaagg

SEQ ID NO: 171206 - RNA, 18 nt, Human
ccuugggcucuggggccu

SEQ ID NO: 171207 - RNA, 21 nt, Human
cucaaaacacaggcccucagg

SEQ ID NO: 171208 - RNA, 24 nt, Human
cucaaucaauccuccuaccucagc

SEQ ID NO: 171209 - RNA, 19 nt, Human
cuccagcagccaagguccc

SEQ ID NO: 171210 - RNA, 19 nt, Human
cucuuggccucaaucaauc

SEQ ID NO: 171211 - RNA, 21 nt, Human
cuggcagccgugaagcccagc

SEQ ID NO: 171212 - RNA, 18 nt, Human
gaagcccagcgugugagg

SEQ ID NO: 171213 - RNA, 23 nt, Human
gaauguuccagaaguccucauuu

SEQ ID NO: 171214 - RNA, 25 nt, Human
gagcaggucccagcagguaaagucc

SEQ ID NO: 171215 - RNA, 23 nt, Human
gccccaggcagaugagguucccg

SEQ ID NO: 171216 - RNA, 22 nt, Human
ggagaggcuccuggcagccgug

SEQ ID NO: 171217 - RNA, 22 nt, Human
ggaggggagaggcuccuggcag

SEQ ID NO: 171218 - RNA, 20 nt, Human
ggcucuggggccucaggcac

SEQ ID NO: 171219 - RNA, 18 nt, Human
gguaagagagaggguugg

SEQ ID NO: 171220 - RNA, 18 nt, Human
ggucccagcagguaaagu

SEQ ID NO: 171221 - RNA, 18 nt, Human
ggugcagccuccagcagc

SEQ ID NO: 171222 - RNA, 20 nt, Human
guccccgaccgccgacaucc

SEQ ID NO: 171223 - RNA, 24 nt, Human
guccccgaccgccgacauccucag

SEQ ID NO: 171224 - RNA, 21 nt, Human
gucccuagcaggcaagucuuc

SEQ ID NO: 171225 - RNA, 20 nt, Human
uaaaguccccgaccgccgac

SEQ ID NO: 171226 - RNA, 21 nt, Human
uaacaacaucacaaacaaauc

SEQ ID NO: 171227 - RNA, 22 nt, Human
uaacccaugggaccaaccccuc

SEQ ID NO: 171228 - RNA, 21 nt, Human
uaaccccugaggugagaaccu

SEQ ID NO: 171229 - RNA, 22 nt, Human
uacaggcgugagccacagcgcc

SEQ ID NO: 171230 - RNA, 22 nt, Human
uacaggcgugagccacagcgcc

SEQ ID NO: 171231 - RNA, 23 nt, Human
uacaggcgugagccacagcgccu

SEQ ID NO: 171232 - RNA, 24 nt, Human
uaccucagccucccaaagugcugg

SEQ ID NO: 171233 - RNA, 20 nt, Human
uagagacguggucuugcuau

SEQ ID NO: 171234 - RNA, 18 nt, Human
uauaaguggugguccugg

SEQ ID NO: 171235 - RNA, 23 nt, Human
uauauugaccaggcuggucuuua

SEQ ID NO: 171236 - RNA, 23 nt, Human
ucaaaacacaggcccucagggac

SEQ ID NO: 171237 - RNA, 25 nt, Human
ucaaucaauccuccuaccucagccu

SEQ ID NO: 171238 - RNA, 19 nt, Human
ucacaggcggcuaacaaca

SEQ ID NO: 171239 - RNA, 24 nt, Human
ucagcccugauauauggcagccuc

SEQ ID NO: 171240 - RNA, 18 nt, Human
ucagccucccaaagugcu

SEQ ID NO: 171241 - RNA, 24 nt, Human
ucccaaagugcuggaauuacaggc

SEQ ID NO: 171242 - RNA, 22 nt, Human
uccccaacaggcgaggucccca

SEQ ID NO: 171243 - RNA, 22 nt, Human
uccccagcaggcgaggucccua

SEQ ID NO: 171244 - RNA, 22 nt, Human
uccccagcaggugaggucccca

SEQ ID NO: 171245 - RNA, 22 nt, Human
uccccagcaggugaggucccca

SEQ ID NO: 171246 - RNA, 21 nt, Human
ucccucaaccccagaauauuu

SEQ ID NO: 171247 - RNA, 27 nt, Human
uccuccuaccucagccucccaaagugc

SEQ ID NO: 171248 - RNA, 23 nt, Human
ucuugcuauauugaccaggcugg

SEQ ID NO: 171249 - RNA, 24 nt, Human
ucuugcuauauugaccaggcuggu

SEQ ID NO: 171250 - RNA, 23 nt, Human
ugaacucugagcucuuaaccccu

SEQ ID NO: 171251 - RNA, 20 nt, Human
ugacauggugguugccugcu

SEQ ID NO: 171252 - RNA, 22 nt, Human
ugacauggugguugccugcuuu

SEQ ID NO: 171253 - RNA, 24 nt, Human
ugaccaggcuggucuuuaacucuu

SEQ ID NO: 171254 - RNA, 21 nt, Human
ugacuaauuacugcuuugcac

SEQ ID NO: 171255 - RNA, 23 nt, Human
ugagcucuuaacccaugggacca

SEQ ID NO: 171256 - RNA, 18 nt, Human
ugaggugagaaccugggg

SEQ ID NO: 171257 - RNA, 18 nt, Human
ugagugugacgaaaaggg

SEQ ID NO: 171258 - RNA, 20 nt, Human
ugcgaauuauaucccgauga

SEQ ID NO: 171259 - RNA, 24 nt, Human
ugcuauauugaccaggcuggucuu

SEQ ID NO: 171260 - RNA, 25 nt, Human
ugcuggaauuacaggcgugagccac

SEQ ID NO: 171261 - RNA, 19 nt, Human
uggaaaccgugccgugaug

SEQ ID NO: 171262 - RNA, 25 nt, Human
uggaaagagacucaaaacacaggcc

SEQ ID NO: 171263 - RNA, 21 nt, Human
uggaauguuccagaaguccuc

SEQ ID NO: 171264 - RNA, 18 nt, Human
uggaauuacaggcgugag

SEQ ID NO: 171265 - RNA, 19 nt, Human
uggaauuacaggcgugagc

SEQ ID NO: 171266 - RNA, 21 nt, Human
uggaauuacaggcgugagcca

SEQ ID NO: 171267 - RNA, 22 nt, Human
uggaauuacaggcgugagccac

SEQ ID NO: 171268 - RNA, 24 nt, Human
uggaauuacaggcgugagccacag

SEQ ID NO: 171269 - RNA, 26 nt, Human
uggaauuacaggcgugagccacagcg

SEQ ID NO: 171270 - RNA, 18 nt, Human
uggcaaggucucugggag

SEQ ID NO: 171271 - RNA, 19 nt, Human
uggcaaggucucugggagc

SEQ ID NO: 171272 - RNA, 21 nt, Human
uggcaaggucucugggagcag

SEQ ID NO: 171273 - RNA, 19 nt, Human
uggcagguuuccuggggcg

SEQ ID NO: 171274 - RNA, 23 nt, Human
ugggaggggaaguugaacuuuga

SEQ ID NO: 171275 - RNA, 24 nt, Human
ugggggaaacaggugauugguggg

SEQ ID NO: 171276 - RNA, 21 nt, Human
uggugguccugggcuugaacu

SEQ ID NO: 171277 - RNA, 22 nt, Human
uggugguccugggcuugaacuu

SEQ ID NO: 171278 - RNA, 25 nt, Human
ugucugaacucugagcucuuaaccc

SEQ ID NO: 171279 - RNA, 18 nt, Human
ugugacgaaaagggaucc

SEQ ID NO: 171280 - RNA, 20 nt, Human
uguggcaaggucucugggag

SEQ ID NO: 171281 - RNA, 24 nt, Human
uuuacagucgaucccaccuguacc

SEQ ID NO: 171282 - RNA, 24 nt, Human
aaaccgggcccccaucucugugcu

SEQ ID NO: 171283 - RNA, 20 nt, Human
aacccccuccuucaccccua

SEQ ID NO: 171284 - RNA, 24 nt, Human
aagaagucagcggccccucuugga

SEQ ID NO: 171285 - RNA, 25 nt, Human
aagcugacaacuuggccuccccugg

SEQ ID NO: 171286 - RNA, 24 nt, Human
agaaaaacauaaagacagaagaaa

SEQ ID NO: 171287 - RNA, 22 nt, Human
agauuuggaagcugcacgggcc

SEQ ID NO: 171288 - RNA, 24 nt, Human
aggcccgguucaucccugggaagg

SEQ ID NO: 171289 - RNA, 21 nt, Human
aggcugugaggaauccaaaca

SEQ ID NO: 171290 - RNA, 21 nt, Human
auacugaacuccccuaaguca

SEQ ID NO: 171291 - RNA, 21 nt, Human
caacaaggcuccuucuacaac

SEQ ID NO: 171292 - RNA, 19 nt, Human
cacaguccuuccacucucc

SEQ ID NO: 171293 - RNA, 22 nt, Human
caccugcagccacaguccuucc

SEQ ID NO: 171294 - RNA, 23 nt, Human
caccuugguccagaaaaacguga

SEQ ID NO: 171295 - RNA, 18 nt, Human
caccuuucucaggagcca

SEQ ID NO: 171296 - RNA, 20 nt, Human
caccuuucucaggagccaag

SEQ ID NO: 171297 - RNA, 20 nt, Human
cagcugccgcgcaggagcag

SEQ ID NO: 171298 - RNA, 22 nt, Human
cagucaaggagaugcacaguag

SEQ ID NO: 171299 - RNA, 24 nt, Human
ccaccaacaaggcuccuucuacaa

SEQ ID NO: 171300 - RNA, 20 nt, Human
ccacucuccaccaacaaggc

SEQ ID NO: 171301 - RNA, 24 nt, Human
ccagaaaaacgugaaucgggaaca

SEQ ID NO: 171302 - RNA, 21 nt, Human
cccccuccuucaccccuaaac

SEQ ID NO: 171303 - RNA, 20 nt, Human
ccccuaaacaaugaugccca

SEQ ID NO: 171304 - RNA, 21 nt, Human
ccccucuuggacugcccuccu

SEQ ID NO: 171305 - RNA, 18 nt, Human
ccccugggucgcuuccag

SEQ ID NO: 171306 - RNA, 22 nt, Human
cccucuuggacugcccuccuca

SEQ ID NO: 171307 - RNA, 25 nt, Human
ccgcuaagcuauuucauuucugcac

SEQ ID NO: 171308 - RNA, 22 nt, Human
ccucaccuuucucaggagccaa

SEQ ID NO: 171309 - RNA, 18 nt, Human
ccucgcucacuguggccc

SEQ ID NO: 171310 - RNA, 22 nt, Human
ccucugcgcgcgcccaccgccc

SEQ ID NO: 171311 - RNA, 19 nt, Human
ccugcagccacaguccuuc

SEQ ID NO: 171312 - RNA, 22 nt, Human
cuacucuugauucucucucaac

SEQ ID NO: 171313 - RNA, 21 nt, Human
cuauggcuuccuucucuucug

SEQ ID NO: 171314 - RNA, 20 nt, Human
cucaccuuucucaggagcca

SEQ ID NO: 171315 - RNA, 18 nt, Human
cuccccugggucgcuucc

SEQ ID NO: 171316 - RNA, 18 nt, Human
cucucucaacugauccgg

SEQ ID NO: 171317 - RNA, 19 nt, Human
cugcgcgcgcccaccgccc

SEQ ID NO: 171318 - RNA, 18 nt, Human
cuugauucucucucaacu

SEQ ID NO: 171319 - RNA, 20 nt, Human
cuuggacugcccuccucacc

SEQ ID NO: 171320 - RNA, 20 nt, Human
gagauuuggaagcugcacgg

SEQ ID NO: 171321 - RNA, 18 nt, Human
gaggaagaacccccuccu

SEQ ID NO: 171322 - RNA, 22 nt, Human
ggccccucuuggacugcccucc

SEQ ID NO: 171323 - RNA, 21 nt, Human
ggccuccccugggucgcuucc

SEQ ID NO: 171324 - RNA, 21 nt, Human
gggaacaguuguguaugagau

SEQ ID NO: 171325 - RNA, 23 nt, Human
gggaagagggaaaaagguugcuu

SEQ ID NO: 171326 - RNA, 21 nt, Human
gugaaagaagucagcggcccc

SEQ ID NO: 171327 - RNA, 18 nt, Human
guuauagaaaaacauaaa

SEQ ID NO: 171328 - RNA, 23 nt, Human
uaaagcagcugccgcgcaggagc

SEQ ID NO: 171329 - RNA, 18 nt, Human
uacugaacuccccuaagu

SEQ ID NO: 171330 - RNA, 24 nt, Human
uagaaaaacauaaagacagaagaa

SEQ ID NO: 171331 - RNA, 28 nt, Human
uauguaaagugagguacacgcauguagu

SEQ ID NO: 171332 - RNA, 18 nt, Human
ucaaaaagcugacaacuu

SEQ ID NO: 171333 - RNA, 27 nt, Human
ucagcggccccucuuggacugcccucc

SEQ ID NO: 171334 - RNA, 21 nt, Human
ucaggagccaaggcugugagg

SEQ ID NO: 171335 - RNA, 20 nt, Human
ucaucuuaaguuuccuccaa

SEQ ID NO: 171336 - RNA, 23 nt, Human
uccagagggaaggcccgguucau

SEQ ID NO: 171337 - RNA, 19 nt, Human
ucucaggagccaaggcugu

SEQ ID NO: 171338 - RNA, 21 nt, Human
ucuuggacugcccuccucacc

SEQ ID NO: 171339 - RNA, 18 nt, Human
ugaaagaagucagcggcc

SEQ ID NO: 171340 - RNA, 22 nt, Human
ugaaauaaauaauuguguggaa

SEQ ID NO: 171341 - RNA, 20 nt, Human
ugaagaacuuacucccauga

SEQ ID NO: 171342 - RNA, 21 nt, Human
ugaaucgggaacaguugugua

SEQ ID NO: 171343 - RNA, 21 nt, Human
ugagauuuggaagcugcacgg

SEQ ID NO: 171344 - RNA, 21 nt, Human
ugaggaauccaaacaacaaag

SEQ ID NO: 171345 - RNA, 25 nt, Human
ugaugcggcagucaaggagaugcac

SEQ ID NO: 171346 - RNA, 22 nt, Human
ugcacgggccacaaauauggcc

SEQ ID NO: 171347 - RNA, 21 nt, Human
ugccagcacuccugcaggacu

SEQ ID NO: 171348 - RNA, 25 nt, Human
ugcccuccucaccuuucucaggagc

SEQ ID NO: 171349 - RNA, 22 nt, Human
ugcggcagucaaggagaugcac

SEQ ID NO: 171350 - RNA, 23 nt, Human
uggaaaccgggcccccaucucug

SEQ ID NO: 171351 - RNA, 23 nt, Human
uggaagugacacuauggcuuccu

SEQ ID NO: 171352 - RNA, 26 nt, Human
ugugaaagaagucagcggccccucuu

SEQ ID NO: 171353 - RNA, 25 nt, Human
ugugcaaaaaauauggaaaccgggc

SEQ ID NO: 171354 - RNA, 26 nt, Human
ugugcaaaaaauauggaaaccgggcc

SEQ ID NO: 171355 - RNA, 19 nt, Human
uguggaagugacacuaugg

SEQ ID NO: 171356 - RNA, 23 nt, Human
uucaccuugguccagaaaaacgu

SEQ ID NO: 171357 - RNA, 23 nt, Human
uuccuucucuucugucuguaaac

SEQ ID NO: 171358 - RNA, 20 nt, Human
uugcuucugcuuuauuuuca

SEQ ID NO: 171359 - RNA, 24 nt, Human
uugcuucugcuuuauuuucacauu

SEQ ID NO: 171360 - RNA, 24 nt, Human
uuggaagcugcacgggccacaaau

SEQ ID NO: 171361 - RNA, 19 nt, Human
uuggacugcccuccucacc

SEQ ID NO: 171362 - RNA, 21 nt, Human
uuuaaaaaauccagguuauag

SEQ ID NO: 171363 - RNA, 28 nt, Human
aacaacagcaauaaaaccacaagcaaac

SEQ ID NO: 171364 - RNA, 23 nt, Human
aacagcaauaaaaccacaagcaa

SEQ ID NO: 171365 - RNA, 25 nt, Human
aaccacaagcaaaccagccugcacc

SEQ ID NO: 171366 - RNA, 19 nt, Human
aagcaagguccccaguagg

SEQ ID NO: 171367 - RNA, 23 nt, Human
acaauggaauaucacucagcuau

SEQ ID NO: 171368 - RNA, 24 nt, Human
acaccgagugucccccagccaugu

SEQ ID NO: 171369 - RNA, 23 nt, Human
acagcaauaaaaccacaagcaaa

SEQ ID NO: 171370 - RNA, 18 nt, Human
agcaggugaggccccagg

SEQ ID NO: 171371 - RNA, 19 nt, Human
agcauuaucuguuugcacc

SEQ ID NO: 171372 - RNA, 20 nt, Human
agccgaggccccaggcagcc

SEQ ID NO: 171373 - RNA, 21 nt, Human
aggcaccauccccagccccag

SEQ ID NO: 171374 - RNA, 19 nt, Human
aggcagccgaggccccagg

SEQ ID NO: 171375 - RNA, 19 nt, Human
aggcagccgaggccccagg

SEQ ID NO: 171376 - RNA, 19 nt, Human
aggcagccgaggccccagg

SEQ ID NO: 171377 - RNA, 19 nt, Human
aggcagccgaggccccagg

SEQ ID NO: 171378 - RNA, 22 nt, Human
aggcagccgaggccccaggcag

SEQ ID NO: 171379 - RNA, 22 nt, Human
aggcagccgaggccccagguag

SEQ ID NO: 171380 - RNA, 19 nt, Human
aggcaggugagaccccagg

SEQ ID NO: 171381 - RNA, 19 nt, Human
aggcuccuggcagugaagc

SEQ ID NO: 171382 - RNA, 19 nt, Human
agguaagucacaugccugg

SEQ ID NO: 171383 - RNA, 23 nt, Human
augcauuugugacacccauccgc

SEQ ID NO: 171384 - RNA, 22 nt, Human
caaagacuccagcaggugaggc

SEQ ID NO: 171385 - RNA, 18 nt, Human
caacagcaauaaaaccac

SEQ ID NO: 171386 - RNA, 25 nt, Human
caacagcaauaaaaccacaagcaaa

SEQ ID NO: 171387 - RNA, 22 nt, Human
caagcaaaccagccugcaccau

SEQ ID NO: 171388 - RNA, 20 nt, Human
caauaaaaccacaagcaaac

SEQ ID NO: 171389 - RNA, 19 nt, Human
cacauacccuucgcccucc

SEQ ID NO: 171390 - RNA, 22 nt, Human
caccaaagacuccagcagguga

SEQ ID NO: 171391 - RNA, 18 nt, Human
cacccguucucagggccc

SEQ ID NO: 171392 - RNA, 27 nt, Human
cagcaauaaaaccacaagaccuucggg

SEQ ID NO: 171393 - RNA, 22 nt, Human
cagcaauaaaaccacaagcaaa

SEQ ID NO: 171394 - RNA, 25 nt, Human
cagcaauaaaaccacaagcaaacca

SEQ ID NO: 171395 - RNA, 19 nt, Human
cagccuccagaaagcaagg

SEQ ID NO: 171396 - RNA, 18 nt, Human
cagggccucaagggcacc

SEQ ID NO: 171397 - RNA, 23 nt, Human
cagguaagucacaugccuggcca

SEQ ID NO: 171398 - RNA, 19 nt, Human
caguaggcaccauccccag

SEQ ID NO: 171399 - RNA, 22 nt, Human
caugugcacaccacugcugaug

SEQ ID NO: 171400 - RNA, 21 nt, Human
ccacaagcaaaccagccugca

SEQ ID NO: 171401 - RNA, 23 nt, Human
ccagcagguaaaguccccaacag

SEQ ID NO: 171402 - RNA, 24 nt, Human
ccagcagguaaaguccccaacagc

SEQ ID NO: 171403 - RNA, 23 nt, Human
cccauccgcuggcgcucacaccg

SEQ ID NO: 171404 - RNA, 18 nt, Human
ccccaggcagccgaggcc

SEQ ID NO: 171405 - RNA, 18 nt, Human
ccccaggcagccgaggcc

SEQ ID NO: 171406 - RNA, 19 nt, Human
ccccaggcagccgaggccc

SEQ ID NO: 171407 - RNA, 19 nt, Human
ccccaggcagccgaggccc

SEQ ID NO: 171408 - RNA, 19 nt, Human
ccccaggcagccgaggccc

SEQ ID NO: 171409 - RNA, 19 nt, Human
ccccaggcagccgaggccc

SEQ ID NO: 171410 - RNA, 21 nt, Human
cccccagccaugugcacacca

SEQ ID NO: 171411 - RNA, 19 nt, Human
cccugcacaccuugggcaa

SEQ ID NO: 171412 - RNA, 23 nt, Human
cccuucgcccuccuccuuagggg

SEQ ID NO: 171413 - RNA, 19 nt, Human
ccuccuccuuaggggaccc

SEQ ID NO: 171414 - RNA, 20 nt, Human
ccuggcagugaagcccggca

SEQ ID NO: 171415 - RNA, 19 nt, Human
ccuggccaccaaagacucc

SEQ ID NO: 171416 - RNA, 21 nt, Human
ccuugggcaacacauccagcu

SEQ ID NO: 171417 - RNA, 22 nt, Human
ccuugggcaacacauccagcuc

SEQ ID NO: 171418 - RNA, 25 nt, Human
cgcccgggggcagggccucaagggc

SEQ ID NO: 171419 - RNA, 21 nt, Human
cucccuugggcccugugccuc

SEQ ID NO: 171420 - RNA, 18 nt, Human
cugaccugcccugcacac

SEQ ID NO: 171421 - RNA, 21 nt, Human
cuggccaccaaagacuccagc

SEQ ID NO: 171422 - RNA, 26 nt, Human
cuggccaccaaagacuccccuuccgg

SEQ ID NO: 171423 - RNA, 25 nt, Human
gagauccucaguaggugcagccucc

SEQ ID NO: 171424 - RNA, 25 nt, Human
gagcaggucccagcagguaaagucc

SEQ ID NO: 171425 - RNA, 24 nt, Human
gcacaccuugggcaacacauccag

SEQ ID NO: 171426 - RNA, 24 nt, Human
gggcgagguggcucaugucuguaa

SEQ ID NO: 171427 - RNA, 20 nt, Human
ggucccagcagguaaagucc

SEQ ID NO: 171428 - RNA, 19 nt, Human
gguggcucaugucuguaau

SEQ ID NO: 171429 - RNA, 22 nt, Human
uaaaaccacaagcaaaccagcc

SEQ ID NO: 171430 - RNA, 24 nt, Human
uaacaacagcaauaaaaccacaag

SEQ ID NO: 171431 - RNA, 25 nt, Human
uaucacucagcuaugaaaaggcugg

SEQ ID NO: 171432 - RNA, 22 nt, Human
uccccagcaggggaggcuccug

SEQ ID NO: 171433 - RNA, 19 nt, Human
uccucaguaggugcagccu

SEQ ID NO: 171434 - RNA, 19 nt, Human
ucucagggcccagugccuc

SEQ ID NO: 171435 - RNA, 22 nt, Human
ugaaaucccagguaagucacau

SEQ ID NO: 171436 - RNA, 27 nt, Human
ugaggccccaggcaggugagaccccag

SEQ ID NO: 171437 - RNA, 23 nt, Human
ugcacaccuugggcaacacaucc

SEQ ID NO: 171438 - RNA, 22 nt, Human
ugcccugcacaccuugggcaac

SEQ ID NO: 171439 - RNA, 23 nt, Human
ugccuggccaccaaagacuccag

SEQ ID NO: 171440 - RNA, 19 nt, Human
ugcugauggucacacacau

SEQ ID NO: 171441 - RNA, 23 nt, Human
uggaauaucacucagcuaugaaa

SEQ ID NO: 171442 - RNA, 18 nt, Human
uggcaaggucucugggag

SEQ ID NO: 171443 - RNA, 19 nt, Human
uggcaaggucucugggagc

SEQ ID NO: 171444 - RNA, 21 nt, Human
uggcaaggucucugggagcag

SEQ ID NO: 171445 - RNA, 18 nt, Human
uggcucaugucuguaauc

SEQ ID NO: 171446 - RNA, 24 nt, Human
ugggcgagguggcucaugucugua

SEQ ID NO: 171447 - RNA, 20 nt, Human
uguggcaaggucucugggag

SEQ ID NO: 171448 - RNA, 18 nt, Human
uugggcaacacauccagc

SEQ ID NO: 171449 - RNA, 22 nt, Human
aaacccggcccuuuccaaccac

SEQ ID NO: 171450 - RNA, 19 nt, Human
aaaccggugggcaagucag

SEQ ID NO: 171451 - RNA, 23 nt, Human
aaagccacuuccuuuccccaccc

SEQ ID NO: 171452 - RNA, 24 nt, Human
aaagugcugggauuacagguguga

SEQ ID NO: 171453 - RNA, 22 nt, Human
aacaacaucacaaacaaaucag

SEQ ID NO: 171454 - RNA, 19 nt, Human
aagcagaaguccagggagc

SEQ ID NO: 171455 - RNA, 24 nt, Human
aagccccucugugugccucaaagc

SEQ ID NO: 171456 - RNA, 19 nt, Human
aaguagcugggacugcagg

SEQ ID NO: 171457 - RNA, 19 nt, Human
aaguagcugggacugcagg

SEQ ID NO: 171458 - RNA, 22 nt, Human
aaguagcugggacugcaggagc

SEQ ID NO: 171459 - RNA, 23 nt, Human
aaguagcugggacugcaggagcc

SEQ ID NO: 171460 - RNA, 18 nt, Human
aagugcugggauuacagg

SEQ ID NO: 171461 - RNA, 19 nt, Human
aagugcugggauuacaggu

SEQ ID NO: 171462 - RNA, 26 nt, Human
aagugcugggauuacaggugugagcc

SEQ ID NO: 171463 - RNA, 21 nt, Human
aaguguacccggagcugaaac

SEQ ID NO: 171464 - RNA, 24 nt, Human
acaacaucacaaacaaaucagcca

SEQ ID NO: 171465 - RNA, 24 nt, Human
accuuccgccuuuccuucccacca

SEQ ID NO: 171466 - RNA, 24 nt, Human
accuugugauccgccugccucggc

SEQ ID NO: 171467 - RNA, 19 nt, Human
acggguuucaccauauugg

SEQ ID NO: 171468 - RNA, 23 nt, Human
acggguuucaccauauuggccag

SEQ ID NO: 171469 - RNA, 19 nt, Human
acuuccuuuccccacccac

SEQ ID NO: 171470 - RNA, 18 nt, Human
agaaggaaggaggaagug

SEQ ID NO: 171471 - RNA, 25 nt, Human
agaaggaaggaggaaguguacccgg

SEQ ID NO: 171472 - RNA, 20 nt, Human
agccaccgcacccggccuca

SEQ ID NO: 171473 - RNA, 21 nt, Human
agcugggacugcaggagccug

SEQ ID NO: 171474 - RNA, 23 nt, Human
aggagccugagaccacgccccac

SEQ ID NO: 171475 - RNA, 18 nt, Human
aggcaggugaagcuucag

SEQ ID NO: 171476 - RNA, 18 nt, Human
aggcaggugaguccucag

SEQ ID NO: 171477 - RNA, 23 nt, Human
agggauuuggagacucagucaug

SEQ ID NO: 171478 - RNA, 21 nt, Human
agggcauuccaguuacaagga

SEQ ID NO: 171479 - RNA, 19 nt, Human
agguaggugaauccccagg

SEQ ID NO: 171480 - RNA, 22 nt, Human
agguucacaccauucuccugcc

SEQ ID NO: 171481 - RNA, 20 nt, Human
agugaaaaggcugaccugaa

SEQ ID NO: 171482 - RNA, 23 nt, Human
agugcaauggcgcgaucuuggcu

SEQ ID NO: 171483 - RNA, 24 nt, Human
agugcaauggcgcgaucuuggcuc

SEQ ID NO: 171484 - RNA, 21 nt, Human
aucguggggcuccccuaaucc

SEQ ID NO: 171485 - RNA, 24 nt, Human
augggugccaguucccagggccca

SEQ ID NO: 171486 - RNA, 21 nt, Human
auucuccugccucagccuccc

SEQ ID NO: 171487 - RNA, 24 nt, Human
caaagugcugggauuacaggugug

SEQ ID NO: 171488 - RNA, 19 nt, Human
caaccaccacaccugucau

SEQ ID NO: 171489 - RNA, 24 nt, Human
caaccaccacaccugucaucaggu

SEQ ID NO: 171490 - RNA, 23 nt, Human
caaggaacaaccuucgcaaaggc

SEQ ID NO: 171491 - RNA, 24 nt, Human
caaggcaauagggagccaugugag

SEQ ID NO: 171492 - RNA, 22 nt, Human
cacaccauucuccugccucagc

SEQ ID NO: 171493 - RNA, 18 nt, Human
caccaaggcaauagggag

SEQ ID NO: 171494 - RNA, 18 nt, Human
caccauauuggccaggau

SEQ ID NO: 171495 - RNA, 22 nt, Human
caccauauuggccaggaugguc

SEQ ID NO: 171496 - RNA, 24 nt, Human
caccauauuggccaggauggucuc

SEQ ID NO: 171497 - RNA, 21 nt, Human
caccgaagacuccagcaggug

SEQ ID NO: 171498 - RNA, 22 nt, Human
caccgaagacuccagcagguga

SEQ ID NO: 171499 - RNA, 18 nt, Human
cacuaagugccaggccaa

SEQ ID NO: 171500 - RNA, 20 nt, Human
cagcagaaaugcaggcaugg

SEQ ID NO: 171501 - RNA, 18 nt, Human
cagcccaggccccacacc

SEQ ID NO: 171502 - RNA, 21 nt, Human
cagcccaggccccacaccagc

SEQ ID NO: 171503 - RNA, 20 nt, Human
cagccgagguccccaguagg

SEQ ID NO: 171504 - RNA, 21 nt, Human
caggugaagcugcaacaggug

SEQ ID NO: 171505 - RNA, 20 nt, Human
caggugaccgucccaggcag

SEQ ID NO: 171506 - RNA, 26 nt, Human
caucacaaacaaaucagccagaacca

SEQ ID NO: 171507 - RNA, 22 nt, Human
caugaaccuuggaagggaacuu

SEQ ID NO: 171508 - RNA, 20 nt, Human
ccaaagugcugggauuacag

SEQ ID NO: 171509 - RNA, 21 nt, Human
ccaaagugcugggauuacagg

SEQ ID NO: 171510 - RNA, 21 nt, Human
ccaaagugcugggauuacagg

SEQ ID NO: 171511 - RNA, 24 nt, Human
ccaaagugcugggauuacaggugu

SEQ ID NO: 171512 - RNA, 23 nt, Human
ccacaccacgcagcagaaggaag

SEQ ID NO: 171513 - RNA, 23 nt, Human
ccagcagguaaaguccccaacag

SEQ ID NO: 171514 - RNA, 24 nt, Human
ccagcagguaaaguccccaacagc

SEQ ID NO: 171515 - RNA, 21 nt, Human
ccaggaaagugaggacccagg

SEQ ID NO: 171516 - RNA, 19 nt, Human
ccagggguuccuugggagg

SEQ ID NO: 171517 - RNA, 20 nt, Human
ccagguaggugaauccccaa

SEQ ID NO: 171518 - RNA, 23 nt, Human
cccaaguagcugggacugcagga

SEQ ID NO: 171519 - RNA, 25 nt, Human
ccccacccacuccugcagggcaggg

SEQ ID NO: 171520 - RNA, 19 nt, Human
ccccaggaaaaugagguuc

SEQ ID NO: 171521 - RNA, 19 nt, Human
ccccaggaaagugaggacc

SEQ ID NO: 171522 - RNA, 19 nt, Human
ccccaguaggcaaaguccc

SEQ ID NO: 171523 - RNA, 18 nt, Human
ccccucacaggcggcuaa

SEQ ID NO: 171524 - RNA, 22 nt, Human
cccggagcugaaacccggcccu

SEQ ID NO: 171525 - RNA, 18 nt, Human
cccuagagcugagaggcc

SEQ ID NO: 171526 - RNA, 21 nt, Human
cccucugugugccucaaagcc

SEQ ID NO: 171527 - RNA, 23 nt, Human
ccucaaagccacuuccuuucccc

SEQ ID NO: 171528 - RNA, 24 nt, Human
ccucacagguucacaccauucucc

SEQ ID NO: 171529 - RNA, 18 nt, Human
ccugaaccaccgguuccc

SEQ ID NO: 171530 - RNA, 23 nt, Human
ccugccucagccucccaaguagc

SEQ ID NO: 171531 - RNA, 19 nt, Human
ccuggccaccgaagacucc

SEQ ID NO: 171532 - RNA, 23 nt, Human
ccugucaucaggugacccagggc

SEQ ID NO: 171533 - RNA, 24 nt, Human
cgcacccggccucaucauugguuu

SEQ ID NO: 171534 - RNA, 23 nt, Human
cggguuucaccauauuggccagg

SEQ ID NO: 171535 - RNA, 26 nt, Human
cucaaagccacuuccuuuccccaccc

SEQ ID NO: 171536 - RNA, 24 nt, Human
cucagccucccaaguagcugggac

SEQ ID NO: 171537 - RNA, 24 nt, Human
cuccugaccuugugauccgccugc

SEQ ID NO: 171538 - RNA, 18 nt, Human
cuccuggaagccagcaug

SEQ ID NO: 171539 - RNA, 20 nt, Human
cucugucguccagguuggag

SEQ ID NO: 171540 - RNA, 20 nt, Human
cugcaggagccugagaccac

SEQ ID NO: 171541 - RNA, 23 nt, Human
cugccucagccucccaaguagcu

SEQ ID NO: 171542 - RNA, 23 nt, Human
cugccucggccucccaaagugcu

SEQ ID NO: 171543 - RNA, 23 nt, Human
cugggccacggucagccauaggg

SEQ ID NO: 171544 - RNA, 26 nt, Human
cugggggggccagugugcagagggcc

SEQ ID NO: 171545 - RNA, 22 nt, Human
cugggucuucaccacuggagag

SEQ ID NO: 171546 - RNA, 19 nt, Human
cuuuccaaccaccacaccu

SEQ ID NO: 171547 - RNA, 21 nt, Human
cuuuccaaccaccacaccugu

SEQ ID NO: 171548 - RNA, 21 nt, Human
gaaggucucugggagcagguc

SEQ ID NO: 171549 - RNA, 20 nt, Human
gacaccagggguuccuuggg

SEQ ID NO: 171550 - RNA, 19 nt, Human
gacaccuucugggagaugc

SEQ ID NO: 171551 - RNA, 22 nt, Human
gaccuugugauccgccugccuc

SEQ ID NO: 171552 - RNA, 24 nt, Human
gaccuugugauccgccugccucgg

SEQ ID NO: 171553 - RNA, 18 nt, Human
gagaggaggcagagcugu

SEQ ID NO: 171554 - RNA, 25 nt, Human
gagcaggucccagcagguaaagucc

SEQ ID NO: 171555 - RNA, 18 nt, Human
gaggcagagcuguugcag

SEQ ID NO: 171556 - RNA, 18 nt, Human
gauuacaggugugagcca

SEQ ID NO: 171557 - RNA, 22 nt, Human
gauuacaggugugagccaccgc

SEQ ID NO: 171558 - RNA, 23 nt, Human
gauuacaggugugagccaccgca

SEQ ID NO: 171559 - RNA, 19 nt, Human
gcaaagcagaaguccaggg

SEQ ID NO: 171560 - RNA, 22 nt, Human
gcaagcuccaccucacagguuc

SEQ ID NO: 171561 - RNA, 21 nt, Human
gccagugugcagagggcccua

SEQ ID NO: 171562 - RNA, 21 nt, Human
gcuccccuaauccccguugca

SEQ ID NO: 171563 - RNA, 26 nt, Human
gcuucaaugcgauguggcuuugagua

SEQ ID NO: 171564 - RNA, 22 nt, Human
ggaacugcaggaggagucucag

SEQ ID NO: 171565 - RNA, 18 nt, Human
ggacguggaagaggccac

SEQ ID NO: 171566 - RNA, 19 nt, Human
ggagaggaggcagagcugu

SEQ ID NO: 171567 - RNA, 22 nt, Human
ggagaugcuagagggacucggg

SEQ ID NO: 171568 - RNA, 23 nt, Human
ggagaugcuagagggacucgggg

SEQ ID NO: 171569 - RNA, 22 nt, Human
gggcauccuguccuggagcccg

SEQ ID NO: 171570 - RNA, 21 nt, Human
gggggccagugugcagagggc

SEQ ID NO: 171571 - RNA, 22 nt, Human
ggguuccacagggacaccaggg

SEQ ID NO: 171572 - RNA, 18 nt, Human
ggucccagcagguaaagu

SEQ ID NO: 171573 - RNA, 19 nt, Human
ggucucgaucuccugaccu

SEQ ID NO: 171574 - RNA, 20 nt, Human
ggucucgaucuccugaccuu

SEQ ID NO: 171575 - RNA, 24 nt, Human
gguuucaccauauuggccaggaug

SEQ ID NO: 171576 - RNA, 18 nt, Human
gucguccagguuggagug

SEQ ID NO: 171577 - RNA, 20 nt, Human
gucucugccgcuccuggaca

SEQ ID NO: 171578 - RNA, 22 nt, Human
guugcagaggcugggccacggu

SEQ ID NO: 171579 - RNA, 21 nt, Human
uaacaacaucacaaacaaauc

SEQ ID NO: 171580 - RNA, 19 nt, Human
uaacagcuggauucugagg

SEQ ID NO: 171581 - RNA, 27 nt, Human
uaagggacauaccuggccaccgaagac

SEQ ID NO: 171582 - RNA, 25 nt, Human
uaauuuuuguauuuuuuaauagaga

SEQ ID NO: 171583 - RNA, 24 nt, Human
uacaaagugaaaaggcugaccuga

SEQ ID NO: 171584 - RNA, 23 nt, Human
uacaggugugagccaccgcaccc

SEQ ID NO: 171585 - RNA, 21 nt, Human
uacccggagcugaaacccggc

SEQ ID NO: 171586 - RNA, 23 nt, Human
uaccuggccaccgaagacuccag

SEQ ID NO: 171587 - RNA, 18 nt, Human
uagcaggugagauucagu

SEQ ID NO: 171588 - RNA, 18 nt, Human
uagcugggacugcaggag

SEQ ID NO: 171589 - RNA, 21 nt, Human
ucacaccauucuccugccuca

SEQ ID NO: 171590 - RNA, 20 nt, Human
ucacaggcggcuaacaacau

SEQ ID NO: 171591 - RNA, 21 nt, Human
ucacagguucacaccauucuc

SEQ ID NO: 171592 - RNA, 24 nt, Human
ucacagguucacaccauucuccug

SEQ ID NO: 171593 - RNA, 24 nt, Human
ucaccauauuggccaggauggucu

SEQ ID NO: 171594 - RNA, 19 nt, Human
ucacugcaagcuccaccuc

SEQ ID NO: 171595 - RNA, 24 nt, Human
ucacugcaagcuccaccucacagg

SEQ ID NO: 171596 - RNA, 18 nt, Human
ucagccucccaaguagcu

SEQ ID NO: 171597 - RNA, 20 nt, Human
ucagccucccaaguagcugg

SEQ ID NO: 171598 - RNA, 21 nt, Human
uccaaccaccacaccugucau

SEQ ID NO: 171599 - RNA, 22 nt, Human
uccaccucacagguucacacca

SEQ ID NO: 171600 - RNA, 23 nt, Human
ucccaaagugcugggauuacagg

SEQ ID NO: 171601 - RNA, 20 nt, Human
ucccaaguagcugggacugc

SEQ ID NO: 171602 - RNA, 22 nt, Human
ucccaccagaucccaccuucuc

SEQ ID NO: 171603 - RNA, 19 nt, Human
ucccagggcccagugccuc

SEQ ID NO: 171604 - RNA, 22 nt, Human
uccccaacagccgaggucccca

SEQ ID NO: 171605 - RNA, 18 nt, Human
uccccagcaggccaggcu

SEQ ID NO: 171606 - RNA, 22 nt, Human
uccccagcaggugaggcuccua

SEQ ID NO: 171607 - RNA, 21 nt, Human
uccccaggagacauccccagc

SEQ ID NO: 171608 - RNA, 22 nt, Human
uccccaguaggcaaagucccca

SEQ ID NO: 171609 - RNA, 28 nt, Human
uccccaguaggcaaaguccccaggagac

SEQ ID NO: 171610 - RNA, 19 nt, Human
uccuuagguagaugaggcc

SEQ ID NO: 171611 - RNA, 18 nt, Human
ucggccucccaaagugcu

SEQ ID NO: 171612 - RNA, 18 nt, Human
ucguccagguuggagugc

SEQ ID NO: 171613 - RNA, 26 nt, Human
ucuccugccucagccucccaaguagc

SEQ ID NO: 171614 - RNA, 24 nt, Human
ucugucguccagguuggagugcaa

SEQ ID NO: 171615 - RNA, 21 nt, Human
ucuucugguaggcugggcaca

SEQ ID NO: 171616 - RNA, 23 nt, Human
ucuugcucugucguccagguugg

SEQ ID NO: 171617 - RNA, 24 nt, Human
ucuugcucugucguccagguugga

SEQ ID NO: 171618 - RNA, 19 nt, Human
ugaaaaggcugaccugaac

SEQ ID NO: 171619 - RNA, 22 nt, Human
ugaccugaaccaccgguuccca

SEQ ID NO: 171620 - RNA, 20 nt, Human
ugaccuugccccaccugugg

SEQ ID NO: 171621 - RNA, 20 nt, Human
ugacggcagcagaaaugcag

SEQ ID NO: 171622 - RNA, 22 nt, Human
ugagauggagucuugcucuguc

SEQ ID NO: 171623 - RNA, 21 nt, Human
ugaggaagugagcagaauuuc

SEQ ID NO: 171624 - RNA, 19 nt, Human
ugaggacguggaagaggcc

SEQ ID NO: 171625 - RNA, 20 nt, Human
ugaggccccaggaaaaugag

SEQ ID NO: 171626 - RNA, 22 nt, Human
ugaggccccaggaaagugagga

SEQ ID NO: 171627 - RNA, 23 nt, Human
ugaguacaaagugaaaaggcuga

SEQ ID NO: 171628 - RNA, 20 nt, Human
ugauuaucucucugcacccc

SEQ ID NO: 171629 - RNA, 21 nt, Human
ugcagagggcccuagagcuga

SEQ ID NO: 171630 - RNA, 25 nt, Human
ugcagccuuuugaauaaaaaaaggg

SEQ ID NO: 171631 - RNA, 19 nt, Human
ugcagggcagugcaaagca

SEQ ID NO: 171632 - RNA, 24 nt, Human
ugccucagccucccaaguagcugg

SEQ ID NO: 171633 - RNA, 21 nt, Human
ugccucggccucccaaagugc

SEQ ID NO: 171634 - RNA, 24 nt, Human
ugccucggccucccaaagugcugg

SEQ ID NO: 171635 - RNA, 24 nt, Human
ugcugggauuacaggugugagcca

SEQ ID NO: 171636 - RNA, 24 nt, Human
uggaagaggccacaccacgcagca

SEQ ID NO: 171637 - RNA, 21 nt, Human
uggaaggucucugggagcagg

SEQ ID NO: 171638 - RNA, 23 nt, Human
uggagucuugcucugucguccag

SEQ ID NO: 171639 - RNA, 23 nt, Human
uggagugcaauggcgcgaucuug

SEQ ID NO: 171640 - RNA, 24 nt, Human
uggagugcaauggcgcgaucuugg

SEQ ID NO: 171641 - RNA, 24 nt, Human
uggccaggauggucucgaucuccu

SEQ ID NO: 171642 - RNA, 19 nt, Human
uggcucacugcaagcucca

SEQ ID NO: 171643 - RNA, 21 nt, Human
ugggagaugcuagagggacuc

SEQ ID NO: 171644 - RNA, 18 nt, Human
ugggaggugggaaugagg

SEQ ID NO: 171645 - RNA, 18 nt, Human
ugggauuacaggugugag

SEQ ID NO: 171646 - RNA, 19 nt, Human
ugggauuacaggugugagc

SEQ ID NO: 171647 - RNA, 21 nt, Human
ugggauuacaggugugagcca

SEQ ID NO: 171648 - RNA, 22 nt, Human
ugggauuacaggugugagccac

SEQ ID NO: 171649 - RNA, 23 nt, Human
ugggauuacaggugugagccacc

SEQ ID NO: 171650 - RNA, 24 nt, Human
ugggauuacaggugugagccaccg

SEQ ID NO: 171651 - RNA, 25 nt, Human
ugggccacggucagccauagggugu

SEQ ID NO: 171652 - RNA, 18 nt, Human
uguggaaggucucuggga

SEQ ID NO: 171653 - RNA, 23 nt, Human
uuaauagagacggguuucaccau

SEQ ID NO: 171654 - RNA, 27 nt, Human
uuauuuuauuuuuuugagauggagucu

SEQ ID NO: 171655 - RNA, 22 nt, Human
uucaagcagagggguuaccaug

SEQ ID NO: 171656 - RNA, 18 nt, Human
uucccagggcccagugcc

SEQ ID NO: 171657 - RNA, 23 nt, Human
uuccugagcacuaagugccaggc

SEQ ID NO: 171658 - RNA, 20 nt, Human
uuccuugggaggugggaaug

SEQ ID NO: 171659 - RNA, 19 nt, Human
uugaggaacugcaggagga

SEQ ID NO: 171660 - RNA, 19 nt, Human
uuucaccauauuggccagg

SEQ ID NO: 171661 - RNA, 20 nt, Human
uuucaccauauuggccagga

SEQ ID NO: 171662 - RNA, 23 nt, Human
uuuuuaauagagacggguuucac

SEQ ID NO: 171663 - RNA, 24 nt, Human
uuuuugagauggagucuugcucug

SEQ ID NO: 171664 - RNA, 21 nt, Human
uuuuuguauuuuuuaauagag

SEQ ID NO: 171665 - RNA, 24 nt, Human
uuuuuguauuuuuuaauagagacg

SEQ ID NO: 171666 - RNA, 24 nt, Human
aacuauggacguggcagggacccg

SEQ ID NO: 171667 - RNA, 21 nt, Human
aagggcccugccuuucacccu

SEQ ID NO: 171668 - RNA, 21 nt, Human
acacccaccucccccggccag

SEQ ID NO: 171669 - RNA, 20 nt, Human
acccacacccaccucccccg

SEQ ID NO: 171670 - RNA, 21 nt, Human
acccagcccuuccacccacac

SEQ ID NO: 171671 - RNA, 22 nt, Human
acccagcccuuccacccacacc

SEQ ID NO: 171672 - RNA, 20 nt, Human
accccugcuuccugaccucu

SEQ ID NO: 171673 - RNA, 23 nt, Human
agcaggcacccguuaccucccuc

SEQ ID NO: 171674 - RNA, 21 nt, Human
aucacagcuacgcccuagcuc

SEQ ID NO: 171675 - RNA, 25 nt, Human
caagagacccgagauucucaaauca

SEQ ID NO: 171676 - RNA, 24 nt, Human
cacccaagauuuguucaggguggg

SEQ ID NO: 171677 - RNA, 21 nt, Human
caccccugcuuccugaccucu

SEQ ID NO: 171678 - RNA, 24 nt, Human
cacccguuaccucccucccacucu

SEQ ID NO: 171679 - RNA, 23 nt, Human
cacugcucagacguuuauugucc

SEQ ID NO: 171680 - RNA, 27 nt, Human
cagcaggcacccguuaccucccuccca

SEQ ID NO: 171681 - RNA, 19 nt, Human
cagccccaagggcccugcc

SEQ ID NO: 171682 - RNA, 18 nt, Human
cagccuuuccccucccgu

SEQ ID NO: 171683 - RNA, 25 nt, Human
cagugcccaccugcaccccccaccc

SEQ ID NO: 171684 - RNA, 19 nt, Human
ccaccccugcuuccugacc

SEQ ID NO: 171685 - RNA, 21 nt, Human
cccacacccaccucccccggc

SEQ ID NO: 171686 - RNA, 18 nt, Human
ccccaagggcccugccuu

SEQ ID NO: 171687 - RNA, 23 nt, Human
ccccaagggcccugccuuucacc

SEQ ID NO: 171688 - RNA, 19 nt, Human
cccccagccccaagggccc

SEQ ID NO: 171689 - RNA, 22 nt, Human
ccccccagccccaagggcccug

SEQ ID NO: 171690 - RNA, 19 nt, Human
ccccugcuuccugaccucu

SEQ ID NO: 171691 - RNA, 19 nt, Human
cccucccucccugagccca

SEQ ID NO: 171692 - RNA, 21 nt, Human
cccugccuuucacccucuucc

SEQ ID NO: 171693 - RNA, 21 nt, Human
ccuagcucagccccgccugga

SEQ ID NO: 171694 - RNA, 21 nt, Human
ccucccucccacucucaccuc

SEQ ID NO: 171695 - RNA, 18 nt, Human
ccugcaccccccaccccu

SEQ ID NO: 171696 - RNA, 19 nt, Human
ccugcuuccugaccucugu

SEQ ID NO: 171697 - RNA, 22 nt, Human
cggcagccgccagaggugcccc

SEQ ID NO: 171698 - RNA, 21 nt, Human
cggggucccagguuuggcccc

SEQ ID NO: 171699 - RNA, 23 nt, Human
cgguaagggccggaugccuggug

SEQ ID NO: 171700 - RNA, 24 nt, Human
cguggcagggacccgugccugugu

SEQ ID NO: 171701 - RNA, 21 nt, Human
cuccugggccccgccccagcc

SEQ ID NO: 171702 - RNA, 21 nt, Human
cuccugggccccgccccagcc

SEQ ID NO: 171703 - RNA, 20 nt, Human
cucggggaccacagggccuc

SEQ ID NO: 171704 - RNA, 18 nt, Human
cucugugcccagccuccc

SEQ ID NO: 171705 - RNA, 22 nt, Human
cugaaaucacagcuacgcccua

SEQ ID NO: 171706 - RNA, 18 nt, Human
cugcaccccccaccccug

SEQ ID NO: 171707 - RNA, 23 nt, Human
cugcaccccccaccccugcuucc

SEQ ID NO: 171708 - RNA, 21 nt, Human
cuucaggcuggggugcccccc

SEQ ID NO: 171709 - RNA, 21 nt, Human
gaaaucacagcuacgcccuag

SEQ ID NO: 171710 - RNA, 22 nt, Human
gcccccacaaacuucaggcugg

SEQ ID NO: 171711 - RNA, 18 nt, Human
gccccgccccagccuaca

SEQ ID NO: 171712 - RNA, 22 nt, Human
gcccugccuuucacccucuucc

SEQ ID NO: 171713 - RNA, 23 nt, Human
gcccugccuuucacccucuucca

SEQ ID NO: 171714 - RNA, 21 nt, Human
gcuccagugcccaccugcacc

SEQ ID NO: 171715 - RNA, 21 nt, Human
uaccucccucccacucucacc

SEQ ID NO: 171716 - RNA, 20 nt, Human
ucagaacuauggacguggca

SEQ ID NO: 171717 - RNA, 22 nt, Human
ucagacguuuauuguccaccgc

SEQ ID NO: 171718 - RNA, 20 nt, Human
ucaggguggggaggguccuc

SEQ ID NO: 171719 - RNA, 21 nt, Human
ucagucagccaagagacccga

SEQ ID NO: 171720 - RNA, 19 nt, Human
ucccguuagcccgcugcuu

SEQ ID NO: 171721 - RNA, 21 nt, Human
ucgacacccagcccuuccacc

SEQ ID NO: 171722 - RNA, 22 nt, Human
ucuuccagccaggccuucaccc

SEQ ID NO: 171723 - RNA, 21 nt, Human
ugaaaucacagcuacgcccua

SEQ ID NO: 171724 - RNA, 20 nt, Human
ugaccucugugcccagccuc

SEQ ID NO: 171725 - RNA, 22 nt, Human
ugaccucugugcccagccuccc

SEQ ID NO: 171726 - RNA, 19 nt, Human
ugcuccagugcccaccugc

SEQ ID NO: 171727 - RNA, 23 nt, Human
uuccugaccucugugcccagccu

SEQ ID NO: 171728 - RNA, 20 nt, Human
aaaaaaaaaaaaacagacaa

SEQ ID NO: 171729 - RNA, 18 nt, Human
aaaaaaaaccaaacgucc

SEQ ID NO: 171730 - RNA, 20 nt, Human
aaaaaaacagacaaccuuau

SEQ ID NO: 171731 - RNA, 24 nt, Human
aaaaaacaaaaacaaaaacaaaaa

SEQ ID NO: 171732 - RNA, 20 nt, Human
aaaaacaaaaaaaaaccaaa

SEQ ID NO: 171733 - RNA, 25 nt, Human
aaaacaaaaacaaaaaaaaaccaaa

SEQ ID NO: 171734 - RNA, 22 nt, Human
aaaacaaaaacaaaaacaaaaa

SEQ ID NO: 171735 - RNA, 28 nt, Human
aaaacaaaaacaaaaacaaaaaaaaacc

SEQ ID NO: 171736 - RNA, 23 nt, Human
aaacaaaaacaaaaaaaaaccaa

SEQ ID NO: 171737 - RNA, 24 nt, Human
aaacaaaaacaaaaaaaaaccaaa

SEQ ID NO: 171738 - RNA, 24 nt, Human
aaacaaaaacaaaaacaaaaaaaa

SEQ ID NO: 171739 - RNA, 22 nt, Human
acaaaaacaaaaaaaaaccaaa

SEQ ID NO: 171740 - RNA, 26 nt, Human
aggaaaaaacaaaaacaaaaacaaaa

SEQ ID NO: 171741 - RNA, 28 nt, Human
auaaaggaaaaaacaaaaacaaaaacaa

SEQ ID NO: 171742 - RNA, 24 nt, Human
auuuaaaaaaaaaaaaacagacaa

SEQ ID NO: 171743 - RNA, 20 nt, Human
caaagagaauguccagaaac

SEQ ID NO: 171744 - RNA, 21 nt, Human
caaaguagaaaacaaccuguu

SEQ ID NO: 171745 - RNA, 26 nt, Human
caaccuuauaaaggaaaaaacaaaaa

SEQ ID NO: 171746 - RNA, 21 nt, Human
cagcugcucuuggugcugaga

SEQ ID NO: 171747 - RNA, 21 nt, Human
cagcugcucuuggugcugaga

SEQ ID NO: 171748 - RNA, 24 nt, Human
cauuguuuuacaaaauuuucuaau

SEQ ID NO: 171749 - RNA, 18 nt, Human
cugaaucuguugacugga

SEQ ID NO: 171750 - RNA, 25 nt, Human
ggaaaaaacaaaaacaaaaacaaaa

SEQ ID NO: 171751 - RNA, 19 nt, Human
uagaaaacaaccuguuugc

SEQ ID NO: 171752 - RNA, 22 nt, Human
ucaaagagaauguccagaaaca

SEQ ID NO: 171753 - RNA, 19 nt, Human
ucaauaguucacacagguc

SEQ ID NO: 171754 - RNA, 23 nt, Human
ucaguggucacaauaccaccauc

SEQ ID NO: 171755 - RNA, 20 nt, Human
ucucacacaaaaugucugug

SEQ ID NO: 171756 - RNA, 20 nt, Human
ugaaaggggcaaaguagaaa

SEQ ID NO: 171757 - RNA, 22 nt, Human
uucugaaucuguugacuggagu

SEQ ID NO: 171758 - RNA, 20 nt, Human
uucuuccacauaaggcugau

SEQ ID NO: 171759 - RNA, 21 nt, Human
uuuaaaaaaaaaaaaacagac

SEQ ID NO: 171760 - RNA, 23 nt, Human
uuuaaaaaaaaaaaaacagacaa

SEQ ID NO: 171761 - RNA, 26 nt, Human
uuuaaaaaaaaaaaaacagacaaccu

SEQ ID NO: 171762 - RNA, 23 nt, Human
uuuuacaaaauuuucuaauggag

SEQ ID NO: 171763 - RNA, 24 nt, Human
aaacagcugaucaguguggaaaca

SEQ ID NO: 171764 - RNA, 25 nt, Human
aaacagguaaaaaaaauagaucaaa

SEQ ID NO: 171765 - RNA, 24 nt, Human
aacaaauuggauauuuaaaaauac

SEQ ID NO: 171766 - RNA, 18 nt, Human
aauuuuauuuaggcucuc

SEQ ID NO: 171767 - RNA, 24 nt, Human
augauaaugaagaauaaauuacuc

SEQ ID NO: 171768 - RNA, 21 nt, Human
caaaaugggauauaaaaguca

SEQ ID NO: 171769 - RNA, 23 nt, Human
caauaaucaaaccacaagcuuac

SEQ ID NO: 171770 - RNA, 25 nt, Human
cagugcacauaauuagguauauaca

SEQ ID NO: 171771 - RNA, 19 nt, Human
caucaaaauauuuaucaag

SEQ ID NO: 171772 - RNA, 18 nt, Human
cauucaucuucggaguca

SEQ ID NO: 171773 - RNA, 23 nt, Human
cauuguaauacuuagugaaaauu

SEQ ID NO: 171774 - RNA, 25 nt, Human
ccaaaaugggauauaaaagucaucu

SEQ ID NO: 171775 - RNA, 20 nt, Human
cccuagagagggugauaaaa

SEQ ID NO: 171776 - RNA, 24 nt, Human
cuccaccaaaauauacacguuacc

SEQ ID NO: 171777 - RNA, 25 nt, Human
gaaaauaaaugagaagucuaauagc

SEQ ID NO: 171778 - RNA, 21 nt, Human
gagugucaucaguagcagaaa

SEQ ID NO: 171779 - RNA, 18 nt, Human
gcugagcuuuuaaaaauc

SEQ ID NO: 171780 - RNA, 21 nt, Human
gguaaaauaagaccauuuuaa

SEQ ID NO: 171781 - RNA, 20 nt, Human
gucauaugugcuauguauga

SEQ ID NO: 171782 - RNA, 20 nt, Human
uaaacagcugaucagugugg

SEQ ID NO: 171783 - RNA, 27 nt, Human
uaauuaaacauuguucauaaaugacac

SEQ ID NO: 171784 - RNA, 20 nt, Human
uagauuuucuaaaguauuau

SEQ ID NO: 171785 - RNA, 23 nt, Human
uagcuucccgaauagaacaguuc

SEQ ID NO: 171786 - RNA, 20 nt, Human
uaguacuucuaaaguagaac

SEQ ID NO: 171787 - RNA, 22 nt, Human
uauaaauauauuuauagguauc

SEQ ID NO: 171788 - RNA, 23 nt, Human
uauccauaugguaaaauaagacc

SEQ ID NO: 171789 - RNA, 18 nt, Human
uaugugcuauguaugaau

SEQ ID NO: 171790 - RNA, 19 nt, Human
uauuaucaaauccuugagu

SEQ ID NO: 171791 - RNA, 20 nt, Human
ucacaaaugugauaaacagg

SEQ ID NO: 171792 - RNA, 22 nt, Human
ucacuccaugaauaauuucacc

SEQ ID NO: 171793 - RNA, 21 nt, Human
uccaacaaaugugcauugaga

SEQ ID NO: 171794 - RNA, 20 nt, Human
uccauaugguaaaauaagac

SEQ ID NO: 171795 - RNA, 33 nt, Human
ucuaaaguagaacugucacuuccuugaaacaac

SEQ ID NO: 171796 - RNA, 22 nt, Human
ucuucuuauccucaauacuugg

SEQ ID NO: 171797 - RNA, 22 nt, Human
ugauaaacagguaaaaaaaaua

SEQ ID NO: 171798 - RNA, 18 nt, Human
ugcaagugaugaaaaauu

SEQ ID NO: 171799 - RNA, 23 nt, Human
ugcacauaauuagguauauacag

SEQ ID NO: 171800 - RNA, 18 nt, Human
ugcauugagaucuuacug

SEQ ID NO: 171801 - RNA, 20 nt, Human
uguuuuauuaugacaaugag

SEQ ID NO: 171802 - RNA, 18 nt, Human
uuacccuagagaggguga

SEQ ID NO: 171803 - RNA, 18 nt, Human
uuaggcucucuuaaauga

SEQ ID NO: 171804 - RNA, 20 nt, Human
uucccaaauagauuaaacag

SEQ ID NO: 171805 - RNA, 19 nt, Human
uugaaacaaucauuuuucu

SEQ ID NO: 171806 - RNA, 18 nt, Human
uuuuauuaugacaaugag

SEQ ID NO: 171807 - RNA, 22 nt, Human
aaagagagagagagagagagac

SEQ ID NO: 171808 - RNA, 19 nt, Human
aaagucacacuuuuuaauu

SEQ ID NO: 171809 - RNA, 18 nt, Human
aagcuucuagauuuuacc

SEQ ID NO: 171810 - RNA, 23 nt, Human
acuuuuuaauuuuuucauuugcu

SEQ ID NO: 171811 - RNA, 24 nt, Human
agacagagagacagagagacagag

SEQ ID NO: 171812 - RNA, 24 nt, Human
agacagagagacagagagacagag

SEQ ID NO: 171813 - RNA, 24 nt, Human
agacagagagacagagagacagag

SEQ ID NO: 171814 - RNA, 27 nt, Human
agacagagagacagagagaggggaccc

SEQ ID NO: 171815 - RNA, 23 nt, Human
agagacagagagacagagagaga

SEQ ID NO: 171816 - RNA, 20 nt, Human
agagagagagacagagagac

SEQ ID NO: 171817 - RNA, 20 nt, Human
agcagcagagugaguccuga

SEQ ID NO: 171818 - RNA, 21 nt, Human
agcuggucuuuuuuuuccuuu

SEQ ID NO: 171819 - RNA, 20 nt, Human
aggggcccggagcggccggg

SEQ ID NO: 171820 - RNA, 23 nt, Human
auccuguucuuuacuuuguucac

SEQ ID NO: 171821 - RNA, 24 nt, Human
auuacagcaguauaagcaaaauug

SEQ ID NO: 171822 - RNA, 21 nt, Human
caaaagcaacucucuucaaaa

SEQ ID NO: 171823 - RNA, 19 nt, Human
caaguagaugcuaaaaugg

SEQ ID NO: 171824 - RNA, 22 nt, Human
cacaacacagggcugucaguga

SEQ ID NO: 171825 - RNA, 26 nt, Human
cagagagacagagagacagagagaga

SEQ ID NO: 171826 - RNA, 19 nt, Human
cauuuuauuucaaaagcaa

SEQ ID NO: 171827 - RNA, 22 nt, Human
ccaggggcccggagcggccggg

SEQ ID NO: 171828 - RNA, 19 nt, Human
ccggagcggccgggcgggg

SEQ ID NO: 171829 - RNA, 22 nt, Human
cucccgucccccucguagcuuu

SEQ ID NO: 171830 - RNA, 21 nt, Human
cucucuaccacaaagccuaga

SEQ ID NO: 171831 - RNA, 24 nt, Human
cuggaaaauaucucuuuacuuccc

SEQ ID NO: 171832 - RNA, 26 nt, Human
cuuuuuuuuuuuuuuuacaaaaauau

SEQ ID NO: 171833 - RNA, 19 nt, Human
gaaaaacaaguagaugcua

SEQ ID NO: 171834 - RNA, 23 nt, Human
gagcacaacacagggcugucagu

SEQ ID NO: 171835 - RNA, 23 nt, Human
gagcggccgggcgggggccgccg

SEQ ID NO: 171836 - RNA, 21 nt, Human
gccgggcaaggcgcgcagggc

SEQ ID NO: 171837 - RNA, 21 nt, Human
gcuggucuuuuuuuuccuuuu

SEQ ID NO: 171838 - RNA, 19 nt, Human
ggccaaaaauuggguccca

SEQ ID NO: 171839 - RNA, 20 nt, Human
ggcccggagcggccgggcgg

SEQ ID NO: 171840 - RNA, 24 nt, Human
ggcccggagcggccgggcgggggc

SEQ ID NO: 171841 - RNA, 24 nt, Human
gggaaaaacaaguagaugcuaaaa

SEQ ID NO: 171842 - RNA, 21 nt, Human
guccugagcacaacacagggc

SEQ ID NO: 171843 - RNA, 19 nt, Human
uacacaaagaaagaaagag

SEQ ID NO: 171844 - RNA, 24 nt, Human
uaucucuuuacuucccauugcacu

SEQ ID NO: 171845 - RNA, 22 nt, Human
ucaaaagcaacucucuucaaaa

SEQ ID NO: 171846 - RNA, 18 nt, Human
ucagccuuuccuaaaagc

SEQ ID NO: 171847 - RNA, 19 nt, Human
ucagccuuuccuaaaagcu

SEQ ID NO: 171848 - RNA, 18 nt, Human
ucaucaugguuauugaag

SEQ ID NO: 171849 - RNA, 19 nt, Human
ucccauugcacugcccucu

SEQ ID NO: 171850 - RNA, 21 nt, Human
ucucauaccuucaccucucua

SEQ ID NO: 171851 - RNA, 24 nt, Human
ucucccgucccccucguagcuuua

SEQ ID NO: 171852 - RNA, 24 nt, Human
ugccagaaaguacauuucuggacc

SEQ ID NO: 171853 - RNA, 23 nt, Human
ugggauaggugaacuucagguca

SEQ ID NO: 171854 - RNA, 22 nt, Human
uguucuuuacuuuguucacacg

SEQ ID NO: 171855 - RNA, 19 nt, Human
uguuuuuuuauggaagguu

SEQ ID NO: 171856 - RNA, 20 nt, Human
uuacagcaguauaagcaaaa

SEQ ID NO: 171857 - RNA, 30 nt, Human
uugcacugcccucucccgucccccucguag

SEQ ID NO: 171858 - RNA, 23 nt, Human
aaagaacuguaaacuaggaacuu

SEQ ID NO: 171859 - RNA, 23 nt, Human
aggaucccuccccuuuuugaauu

SEQ ID NO: 171860 - RNA, 21 nt, Human
aucccuccccuuuuugaauuc

SEQ ID NO: 171861 - RNA, 20 nt, Human
caaauggaggaacugaaagu

SEQ ID NO: 171862 - RNA, 25 nt, Human
caggaucccuccccuuuuugaauuc

SEQ ID NO: 171863 - RNA, 24 nt, Human
gcacuauuguaaauguaauguaaa

SEQ ID NO: 171864 - RNA, 25 nt, Human
ggaggaacugaaagugcgauguaaa

SEQ ID NO: 171865 - RNA, 23 nt, Human
ugaauuccaaauggaggaacuga

SEQ ID NO: 171866 - RNA, 22 nt, Human
uggaggaacugaaagugcgaug

SEQ ID NO: 171867 - RNA, 19 nt, Human
uggcgauccauauucuauc

SEQ ID NO: 171868 - RNA, 19 nt, Human
aagcugcugugccaccccc

SEQ ID NO: 171869 - RNA, 27 nt, Human
acagugaaaaauaaauacgccuucuca

SEQ ID NO: 171870 - RNA, 19 nt, Human
accccugguucuacuccaa

SEQ ID NO: 171871 - RNA, 24 nt, Human
acccuguuacacaccccuccacua

SEQ ID NO: 171872 - RNA, 21 nt, Human
acuauccccgucuuccacagu

SEQ ID NO: 171873 - RNA, 24 nt, Human
acuccaaaaccuuccccgugccuc

SEQ ID NO: 171874 - RNA, 24 nt, Human
agaaaugggggguacaggaugggg

SEQ ID NO: 171875 - RNA, 23 nt, Human
agacaagguugguccccucccca

SEQ ID NO: 171876 - RNA, 22 nt, Human
agcaagcgagauggagaaggga

SEQ ID NO: 171877 - RNA, 25 nt, Human
agccggagggggagccgcggggggc

SEQ ID NO: 171878 - RNA, 18 nt, Human
agggaggggugcagguug

SEQ ID NO: 171879 - RNA, 21 nt, Human
caaaaccuuccccgugccucc

SEQ ID NO: 171880 - RNA, 21 nt, Human
caaaaccuuccccgugccucc

SEQ ID NO: 171881 - RNA, 22 nt, Human
cacaccccuccacuagcuccug

SEQ ID NO: 171882 - RNA, 20 nt, Human
caccccccuucauacacacc

SEQ ID NO: 171883 - RNA, 19 nt, Human
caggcccccggcgucuccc

SEQ ID NO: 171884 - RNA, 18 nt, Human
ccaccccccuccccccua

SEQ ID NO: 171885 - RNA, 25 nt, Human
ccaccccccuccccccuagauaaga

SEQ ID NO: 171886 - RNA, 22 nt, Human
ccagacaagguugguccccucc

SEQ ID NO: 171887 - RNA, 24 nt, Human
cccccuagauaagagcagcuccag

SEQ ID NO: 171888 - RNA, 26 nt, Human
cccccuagauaagagcagcuccagcg

SEQ ID NO: 171889 - RNA, 23 nt, Human
cccccuagauaagagcagcuccc

SEQ ID NO: 171890 - RNA, 26 nt, Human
cccccuccccccuagauaagagcugg

SEQ ID NO: 171891 - RNA, 18 nt, Human
ccccggaggaggagccgg

SEQ ID NO: 171892 - RNA, 20 nt, Human
ccccguccgccgccgccgcc

SEQ ID NO: 171893 - RNA, 20 nt, Human
ccccguccgccgccgccgcc

SEQ ID NO: 171894 - RNA, 23 nt, Human
ccccguccgccgccgccgccuug

SEQ ID NO: 171895 - RNA, 20 nt, Human
ccccuuacccuggggguagg

SEQ ID NO: 171896 - RNA, 24 nt, Human
cccguccgccgccgccgccuuggu

SEQ ID NO: 171897 - RNA, 23 nt, Human
cccuccccagggggaccuuguca

SEQ ID NO: 171898 - RNA, 22 nt, Human
ccggaggaggagccggaggggg

SEQ ID NO: 171899 - RNA, 20 nt, Human
ccggagggggagccgcgggg

SEQ ID NO: 171900 - RNA, 22 nt, Human
cggggccgggccgcuccccguc

SEQ ID NO: 171901 - RNA, 19 nt, Human
cggucaaaucugggugggu

SEQ ID NO: 171902 - RNA, 23 nt, Human
cuagcuccuggagguuggggggu

SEQ ID NO: 171903 - RNA, 21 nt, Human
cuccaaaaccuuccccgugcc

SEQ ID NO: 171904 - RNA, 25 nt, Human
cuccccagggggaccuugucacccc

SEQ ID NO: 171905 - RNA, 27 nt, Human
cuguuacacaccccuccacuagcuccu

SEQ ID NO: 171906 - RNA, 25 nt, Human
gagaauggggguguucagagagaga

SEQ ID NO: 171907 - RNA, 19 nt, Human
gagccgggccggccccacg

SEQ ID NO: 171908 - RNA, 19 nt, Human
gagggaggggguaugaccc

SEQ ID NO: 171909 - RNA, 18 nt, Human
gaugggaggagggauagc

SEQ ID NO: 171910 - RNA, 19 nt, Human
gcagcagcagucugagugc

SEQ ID NO: 171911 - RNA, 21 nt, Human
gccaccccccuccccccuaga

SEQ ID NO: 171912 - RNA, 22 nt, Human
gccccacggcggcccugccaca

SEQ ID NO: 171913 - RNA, 19 nt, Human
gccgccaccgccuccgacu

SEQ ID NO: 171914 - RNA, 19 nt, Human
gccggggccgggccgcucc

SEQ ID NO: 171915 - RNA, 19 nt, Human
gccugugagggccauggug

SEQ ID NO: 171916 - RNA, 18 nt, Human
gccuucucauccaccaga

SEQ ID NO: 171917 - RNA, 21 nt, Human
ggcgccgccaccgccuccgac

SEQ ID NO: 171918 - RNA, 19 nt, Human
gggaaggagagaggcuccc

SEQ ID NO: 171919 - RNA, 18 nt, Human
gggccggggccgggccgc

SEQ ID NO: 171920 - RNA, 21 nt, Human
ggguacaggaugggaggaggg

SEQ ID NO: 171921 - RNA, 24 nt, Human
ggguaggguggacaagagggaggg

SEQ ID NO: 171922 - RNA, 18 nt, Human
ggucaaaucugggugggu

SEQ ID NO: 171923 - RNA, 19 nt, Human
uaaaggcacauccagucug

SEQ ID NO: 171924 - RNA, 18 nt, Human
uagaggauaaaggcacau

SEQ ID NO: 171925 - RNA, 19 nt, Human
ucagagagagauuggggca

SEQ ID NO: 171926 - RNA, 24 nt, Human
uccaaaaccuuccccgugccuccc

SEQ ID NO: 171927 - RNA, 28 nt, Human
uccaaaaccuuccccgugccucccaccc

SEQ ID NO: 171928 - RNA, 20 nt, Human
uccccagggggaccuuguca

SEQ ID NO: 171929 - RNA, 19 nt, Human
uccccggaggaggagccgg

SEQ ID NO: 171930 - RNA, 22 nt, Human
uccccguccgccgccgccgccu

SEQ ID NO: 171931 - RNA, 21 nt, Human
uccccgugccucccacccacu

SEQ ID NO: 171932 - RNA, 27 nt, Human
ucucuuacuauccccgucuuccacagu

SEQ ID NO: 171933 - RNA, 23 nt, Human
ugagugcgggccgggccaggccc

SEQ ID NO: 171934 - RNA, 21 nt, Human
ugauggggaaggagagaggcu

SEQ ID NO: 171935 - RNA, 22 nt, Human
ugccaccccccuccccccuaga

SEQ ID NO: 171936 - RNA, 21 nt, Human
ugccucccacccacuuaucuc

SEQ ID NO: 171937 - RNA, 19 nt, Human
uggagaagggaggggugca

SEQ ID NO: 171938 - RNA, 21 nt, Human
uggagaauggggguguucaga

SEQ ID NO: 171939 - RNA, 19 nt, Human
ugggggguacaggauggga

SEQ ID NO: 171940 - RNA, 24 nt, Human
ugggggguacaggaugggaggagg

SEQ ID NO: 171941 - RNA, 21 nt, Human
uggggguaggguggacaagag

SEQ ID NO: 171942 - RNA, 19 nt, Human
ugggucgaggagcaccccc

SEQ ID NO: 171943 - RNA, 21 nt, Human
uguacagugaaaaauaaauac

SEQ ID NO: 171944 - RNA, 22 nt, Human
ugugccaccccccuccccccua

SEQ ID NO: 171945 - RNA, 26 nt, Human
uucauacacaccccugguucuacucc

SEQ ID NO: 171946 - RNA, 18 nt, Human
uuuuuuuuuuuuuuuuug

SEQ ID NO: 171947 - RNA, 23 nt, Human
uuuuuuuuuuuuuuuuugccauu

SEQ ID NO: 171948 - RNA, 27 nt, Human
uuuuuuuuuuuuuuuuuugccauuugg

SEQ ID NO: 171949 - RNA, 22 nt, Human
aagcugccggggugaggcccag

SEQ ID NO: 171950 - RNA, 24 nt, Human
aaggggcggcggagggggcggugg

SEQ ID NO: 171951 - RNA, 20 nt, Human
aggccaccaugcaacagccu

SEQ ID NO: 171952 - RNA, 24 nt, Human
agggggcggugggcgcgcaggugg

SEQ ID NO: 171953 - RNA, 20 nt, Human
ccccugcugaaagaaggccc

SEQ ID NO: 171954 - RNA, 21 nt, Human
cccugcugaaagaaggccccc

SEQ ID NO: 171955 - RNA, 22 nt, Human
cugcgggggcagggcuggggaa

SEQ ID NO: 171956 - RNA, 22 nt, Human
ggcggcggagggggcggugggc

SEQ ID NO: 171957 - RNA, 24 nt, Human
gggagucugcgggggcagggcugg

SEQ ID NO: 171958 - RNA, 20 nt, Human
gggcagggcuggggaagggg

SEQ ID NO: 171959 - RNA, 19 nt, Human
gggcggcggagggggcggu

SEQ ID NO: 171960 - RNA, 18 nt, Human
ggggaaggggcggcggag

SEQ ID NO: 171961 - RNA, 21 nt, Human
gugggagaugucaggugccag

SEQ ID NO: 171962 - RNA, 23 nt, Human
ucugcgggggcagggcuggggaa

SEQ ID NO: 171963 - RNA, 18 nt, Human
ugcugaaagaaggccccc

SEQ ID NO: 171964 - RNA, 25 nt, Human
uggcggcagggggagucugcggggg

SEQ ID NO: 171965 - RNA, 19 nt, Human
aaaggucuaaagcccaggg

SEQ ID NO: 171966 - RNA, 19 nt, Human
aagcaugagguggcacgag

SEQ ID NO: 171967 - RNA, 20 nt, Human
aagcaugagguggcacgagg

SEQ ID NO: 171968 - RNA, 26 nt, Human
agcccagggaagaaggggaggcgcca

SEQ ID NO: 171969 - RNA, 20 nt, Human
aggcaggcguuggcgaugcc

SEQ ID NO: 171970 - RNA, 25 nt, Human
aggcaggcguuggcgaugccaccug

SEQ ID NO: 171971 - RNA, 19 nt, Human
aggcguuggcgaugccacc

SEQ ID NO: 171972 - RNA, 18 nt, Human
aggugcugcuugccuggg

SEQ ID NO: 171973 - RNA, 26 nt, Human
agguggcacgaggcaggcguuggcga

SEQ ID NO: 171974 - RNA, 21 nt, Human
agucuggagcuuccuucagcc

SEQ ID NO: 171975 - RNA, 18 nt, Human
augccaccugggggucac

SEQ ID NO: 171976 - RNA, 18 nt, Human
caaaggucuaaagcccag

SEQ ID NO: 171977 - RNA, 18 nt, Human
ccaggagugcaggagagc

SEQ ID NO: 171978 - RNA, 19 nt, Human
cgcuggcagugacggggac

SEQ ID NO: 171979 - RNA, 21 nt, Human
cuuggcuucccagcuggcccc

SEQ ID NO: 171980 - RNA, 22 nt, Human
gacggggacaaaggucuaaagc

SEQ ID NO: 171981 - RNA, 25 nt, Human
gagcagggaggugcugcuugccugg

SEQ ID NO: 171982 - RNA, 18 nt, Human
gcuggcagugacggggac

SEQ ID NO: 171983 - RNA, 22 nt, Human
ggaagaaggggaggcgccagag

SEQ ID NO: 171984 - RNA, 22 nt, Human
ggacaaaggucuaaagcccagg

SEQ ID NO: 171985 - RNA, 24 nt, Human
ggggacaaaggucuaaagcccagg

SEQ ID NO: 171986 - RNA, 22 nt, Human
gugcugcuugccuggggccugg

SEQ ID NO: 171987 - RNA, 18 nt, Human
uccccaggugaaugggcu

SEQ ID NO: 171988 - RNA, 19 nt, Human
uccccaggugaaugggcug

SEQ ID NO: 171989 - RNA, 25 nt, Human
ugcaguggguggcaccgccgaggcu

SEQ ID NO: 171990 - RNA, 23 nt, Human
uggcagugacggggacaaagguc

SEQ ID NO: 171991 - RNA, 19 nt, Human
uggcuucccagcuggcccc

SEQ ID NO: 171992 - RNA, 18 nt, Human
uggguggcaccgccgagg

SEQ ID NO: 171993 - RNA, 21 nt, Human
aaacaaguagccacaaagacc

SEQ ID NO: 171994 - RNA, 25 nt, Human
aaacaaguagccacaaagaccacag

SEQ ID NO: 171995 - RNA, 22 nt, Human
aaagaccacaguuagcaaacac

SEQ ID NO: 171996 - RNA, 18 nt, Human
aacacaauaccauccaca

SEQ ID NO: 171997 - RNA, 22 nt, Human
aacacacacagucacacacaca

SEQ ID NO: 171998 - RNA, 23 nt, Human
aacccaccucgcucaccgcucug

SEQ ID NO: 171999 - RNA, 20 nt, Human
aaccuucccaggucccaaga

SEQ ID NO: 172000 - RNA, 18 nt, Human
aagagaccuucagacugg

SEQ ID NO: 172001 - RNA, 25 nt, Human
aagcagccuccuaggagcagaaggu

SEQ ID NO: 172002 - RNA, 26 nt, Human
aaguagccacaaagaccacaguuagc

SEQ ID NO: 172003 - RNA, 23 nt, Human
aauaccauccacaaacaaguagc

SEQ ID NO: 172004 - RNA, 21 nt, Human
acaaacaaguagccacaaaga

SEQ ID NO: 172005 - RNA, 21 nt, Human
acacaauaccauccacaaaca

SEQ ID NO: 172006 - RNA, 23 nt, Human
acacacacacacacacacacaca

SEQ ID NO: 172007 - RNA, 23 nt, Human
accacaguuagcaaacacacaca

SEQ ID NO: 172008 - RNA, 24 nt, Human
agaggacaggaggggcgggaucug

SEQ ID NO: 172009 - RNA, 21 nt, Human
agaguagaagcccugggccug

SEQ ID NO: 172010 - RNA, 18 nt, Human
agcagaaggugauggagg

SEQ ID NO: 172011 - RNA, 19 nt, Human
aggaggggcgggaucuggg

SEQ ID NO: 172012 - RNA, 20 nt, Human
aggaggggcgggaucugggu

SEQ ID NO: 172013 - RNA, 19 nt, Human
aggcagagaagcaaaggcc

SEQ ID NO: 172014 - RNA, 21 nt, Human
aggcugcaguggggaggcaag

SEQ ID NO: 172015 - RNA, 23 nt, Human
aggcugcaguggggaggcaagug

SEQ ID NO: 172016 - RNA, 22 nt, Human
aggggacguaggcagagaagca

SEQ ID NO: 172017 - RNA, 21 nt, Human
aguagaagcccugggccugga

SEQ ID NO: 172018 - RNA, 18 nt, Human
augcaggggacacauucc

SEQ ID NO: 172019 - RNA, 18 nt, Human
auggagggccacgggggc

SEQ ID NO: 172020 - RNA, 22 nt, Human
caacggaacaggaguccuucaa

SEQ ID NO: 172021 - RNA, 19 nt, Human
caagcagccuccuaggagc

SEQ ID NO: 172022 - RNA, 25 nt, Human
cacaaacaaguagccacaaagacca

SEQ ID NO: 172023 - RNA, 18 nt, Human
cacaaguucuuggcuucu

SEQ ID NO: 172024 - RNA, 22 nt, Human
cacaauaccauccacaaacaag

SEQ ID NO: 172025 - RNA, 20 nt, Human
cacacacacacacacacaca

SEQ ID NO: 172026 - RNA, 20 nt, Human
cacacacacacacacacaca

SEQ ID NO: 172027 - RNA, 20 nt, Human
cacacacacacacacacaca

SEQ ID NO: 172028 - RNA, 22 nt, Human
cacacacacacacacacacaca

SEQ ID NO: 172029 - RNA, 26 nt, Human
cacacacacacacacacacacacaca

SEQ ID NO: 172030 - RNA, 29 nt, Human
cacacacacacacacacacacacaucacg

SEQ ID NO: 172031 - RNA, 22 nt, Human
cacacacacacacacaucacgg

SEQ ID NO: 172032 - RNA, 22 nt, Human
cacacacagucacacacacaca

SEQ ID NO: 172033 - RNA, 31 nt, Human
cacagucacacacacacacacacacacacag

SEQ ID NO: 172034 - RNA, 21 nt, Human
cacgauacagagaacagcaau

SEQ ID NO: 172035 - RNA, 18 nt, Human
cacugcccgugcucuuac

SEQ ID NO: 172036 - RNA, 25 nt, Human
cacugcccgugcucuuacccuacgc

SEQ ID NO: 172037 - RNA, 19 nt, Human
cagaagcagggaagguugg

SEQ ID NO: 172038 - RNA, 22 nt, Human
cagccgguccccuccgagacuc

SEQ ID NO: 172039 - RNA, 20 nt, Human
caggaccgcaggcugcagug

SEQ ID NO: 172040 - RNA, 22 nt, Human
caggaggacccgccgagucccg

SEQ ID NO: 172041 - RNA, 22 nt, Human
caggucccaagacgacugaaga

SEQ ID NO: 172042 - RNA, 20 nt, Human
cauccacaaacaaguagcca

SEQ ID NO: 172043 - RNA, 19 nt, Human
ccaagggcugcacggagcc

SEQ ID NO: 172044 - RNA, 23 nt, Human
ccacaaagaccacaguuagcaaa

SEQ ID NO: 172045 - RNA, 19 nt, Human
ccaccgacaggcagagcaa

SEQ ID NO: 172046 - RNA, 21 nt, Human
ccaccgacaggcagagcaaag

SEQ ID NO: 172047 - RNA, 22 nt, Human
ccagagacccaauugcagggac

SEQ ID NO: 172048 - RNA, 23 nt, Human
ccagagcccauggaguuauugcu

SEQ ID NO: 172049 - RNA, 21 nt, Human
ccagaggcuuccaccugaugg

SEQ ID NO: 172050 - RNA, 26 nt, Human
ccauccacaaacaaguagccacaaag

SEQ ID NO: 172051 - RNA, 18 nt, Human
cccuccgagacucccagg

SEQ ID NO: 172052 - RNA, 19 nt, Human
ccuaaaucaggggaggggg

SEQ ID NO: 172053 - RNA, 21 nt, Human
ccuccgagacucccaggagga

SEQ ID NO: 172054 - RNA, 30 nt, Human
ccuccuaggagcagaaggugauggagggcu

SEQ ID NO: 172055 - RNA, 23 nt, Human
ccucugcucucccuccauccauc

SEQ ID NO: 172056 - RNA, 23 nt, Human
ccugacgucaaacgcugggcuca

SEQ ID NO: 172057 - RNA, 20 nt, Human
ccugcugagucuccaaccca

SEQ ID NO: 172058 - RNA, 23 nt, Human
cgggaacacagaggacaggaggg

SEQ ID NO: 172059 - RNA, 19 nt, Human
cuaggaaacaaaggauauu

SEQ ID NO: 172060 - RNA, 21 nt, Human
cuauugccugccagagaccca

SEQ ID NO: 172061 - RNA, 18 nt, Human
cucccuccauccaucccg

SEQ ID NO: 172062 - RNA, 21 nt, Human
cugcaucuggaugagcugggc

SEQ ID NO: 172063 - RNA, 20 nt, Human
gaagguuggaagggguaggg

SEQ ID NO: 172064 - RNA, 19 nt, Human
gacacauuccccaggggca

SEQ ID NO: 172065 - RNA, 20 nt, Human
gacaggaggggcgggaucug

SEQ ID NO: 172066 - RNA, 22 nt, Human
gagaacagcaaugggucacagc

SEQ ID NO: 172067 - RNA, 27 nt, Human
gaguccuucaacuauugccugccagag

SEQ ID NO: 172068 - RNA, 18 nt, Human
gaugacaaagugcugcaa

SEQ ID NO: 172069 - RNA, 21 nt, Human
gcagagcaaaggaugcgggag

SEQ ID NO: 172070 - RNA, 26 nt, Human
gccacaaagaccacaguuagcaaaca

SEQ ID NO: 172071 - RNA, 21 nt, Human
gcccugggccuggaauccccg

SEQ ID NO: 172072 - RNA, 21 nt, Human
gccuggaauccccgggcgcuc

SEQ ID NO: 172073 - RNA, 20 nt, Human
ggaaacaaaggauauuuuau

SEQ ID NO: 172074 - RNA, 19 nt, Human
ggaacacagaggacaggag

SEQ ID NO: 172075 - RNA, 20 nt, Human
ggaggggcgggaucuggguu

SEQ ID NO: 172076 - RNA, 21 nt, Human
ggaguccuucaacuauugccu

SEQ ID NO: 172077 - RNA, 18 nt, Human
ggccauguggcucagccc

SEQ ID NO: 172078 - RNA, 19 nt, Human
ggcucaccagcuccuugcu

SEQ ID NO: 172079 - RNA, 25 nt, Human
gucacacacacacacacacacacag

SEQ ID NO: 172080 - RNA, 23 nt, Human
uacagagaacagcaaugggucac

SEQ ID NO: 172081 - RNA, 23 nt, Human
uaggagcagaaggugauggaggg

SEQ ID NO: 172082 - RNA, 19 nt, Human
uaugaccuucaaccucuca

SEQ ID NO: 172083 - RNA, 26 nt, Human
uauuccuuuuuucuguuguuguugag

SEQ ID NO: 172084 - RNA, 21 nt, Human
ucacacacacacacacacaca

SEQ ID NO: 172085 - RNA, 18 nt, Human
ucagguggaggaauggug

SEQ ID NO: 172086 - RNA, 24 nt, Human
uccacaaacaaguagccacaaaga

SEQ ID NO: 172087 - RNA, 26 nt, Human
uccacaaacaaguagccacaaagacc

SEQ ID NO: 172088 - RNA, 20 nt, Human
ucccaagacgacugaagacc

SEQ ID NO: 172089 - RNA, 25 nt, Human
ucccaagggcugcacggagccugcu

SEQ ID NO: 172090 - RNA, 24 nt, Human
ucccaggucccaagacgacugaag

SEQ ID NO: 172091 - RNA, 18 nt, Human
ucccuaaaucaggggagg

SEQ ID NO: 172092 - RNA, 18 nt, Human
uccuggggaaagggcugu

SEQ ID NO: 172093 - RNA, 20 nt, Human
ucuccaguugcuaagagacc

SEQ ID NO: 172094 - RNA, 19 nt, Human
ucucgggcaacaagcagcc

SEQ ID NO: 172095 - RNA, 26 nt, Human
ucugugaaggggcggggcagaugggg

SEQ ID NO: 172096 - RNA, 18 nt, Human
ugaaaggaguccaugaag

SEQ ID NO: 172097 - RNA, 25 nt, Human
ugaaaggaguccaugaagaaugaug

SEQ ID NO: 172098 - RNA, 21 nt, Human
ugaaggggcggggcagauggg

SEQ ID NO: 172099 - RNA, 18 nt, Human
ugcccgugcucuuacccu

SEQ ID NO: 172100 - RNA, 22 nt, Human
ugcccgugcucuuacccuacgg

SEQ ID NO: 172101 - RNA, 19 nt, Human
uggaagggguaggguccca

SEQ ID NO: 172102 - RNA, 28 nt, Human
uggaauccccgggcgcucuccccgaggg

SEQ ID NO: 172103 - RNA, 18 nt, Human
uggcucagccccugccug

SEQ ID NO: 172104 - RNA, 20 nt, Human
uggcuucuccuggggaaagg

SEQ ID NO: 172105 - RNA, 23 nt, Human
ugggaagaaauuaaccacggaag

SEQ ID NO: 172106 - RNA, 25 nt, Human
ugguguuagaggggauagggugggg

SEQ ID NO: 172107 - RNA, 19 nt, Human
uuagaggggauaggguggg

SEQ ID NO: 172108 - RNA, 20 nt, Human
uuagcaaacacacacaguca

SEQ ID NO: 172109 - RNA, 22 nt, Human
uucaaccucucacuguucccaa

SEQ ID NO: 172110 - RNA, 22 nt, Human
uucaacuauugccugccagaga

SEQ ID NO: 172111 - RNA, 22 nt, Human
uucuuggcuucuccuggggaaa

SEQ ID NO: 172112 - RNA, 22 nt, Human
caccgccuccacccgguccuca

SEQ ID NO: 172113 - RNA, 23 nt, Human
caggagcuggaggccugaggccc

SEQ ID NO: 172114 - RNA, 22 nt, Human
ccacccgguccucaggcucccg

SEQ ID NO: 172115 - RNA, 23 nt, Human
ccaccgccuccacccgguccuca

SEQ ID NO: 172116 - RNA, 18 nt, Human
ccccaccgccuccacccg

SEQ ID NO: 172117 - RNA, 23 nt, Human
ccccaccgccuccacccgguccu

SEQ ID NO: 172118 - RNA, 21 nt, Human
cugaggggccagggggacgga

SEQ ID NO: 172119 - RNA, 24 nt, Human
cuggggugcagacgggcucuuugg

SEQ ID NO: 172120 - RNA, 19 nt, Human
cugggucuggggugcagac

SEQ ID NO: 172121 - RNA, 19 nt, Human
gaugcugggggugcugggc

SEQ ID NO: 172122 - RNA, 18 nt, Human
gccuuggggugggugggg

SEQ ID NO: 172123 - RNA, 20 nt, Human
gcgaaggcgcgcugcagcag

SEQ ID NO: 172124 - RNA, 20 nt, Human
gcuccagccuuggggugggu

SEQ ID NO: 172125 - RNA, 18 nt, Human
gcugggggugcugggccg

SEQ ID NO: 172126 - RNA, 18 nt, Human
gggggccauacacgggga

SEQ ID NO: 172127 - RNA, 21 nt, Human
ggguccccaccgccuccaccc

SEQ ID NO: 172128 - RNA, 24 nt, Human
gugcagcggcuccagccuuggggu

SEQ ID NO: 172129 - RNA, 19 nt, Human
ucaagacauggacacugag

SEQ ID NO: 172130 - RNA, 19 nt, Human
uccagccuuggggugggug

SEQ ID NO: 172131 - RNA, 19 nt, Human
ucccaggagcuggaggccu

SEQ ID NO: 172132 - RNA, 19 nt, Human
ucggcagcggaguuuccuc

SEQ ID NO: 172133 - RNA, 23 nt, Human
uggacucccggaucccaggagcu

SEQ ID NO: 172134 - RNA, 23 nt, Human
uggaggccugaggcccugggucu

SEQ ID NO: 172135 - RNA, 18 nt, Human
ugggguggguggggcggc

SEQ ID NO: 172136 - RNA, 22 nt, Human
ugggguggguggggcggcucau

SEQ ID NO: 172137 - RNA, 21 nt, Human
uggguggggcggcucauuccg

SEQ ID NO: 172138 - RNA, 22 nt, Human
aaaagacuuugaaggaagagga

SEQ ID NO: 172139 - RNA, 19 nt, Human
aagcgggaagggagaaaag

SEQ ID NO: 172140 - RNA, 18 nt, Human
aaggaagagauauaaaga

SEQ ID NO: 172141 - RNA, 18 nt, Human
aaggcaccaagagaccag

SEQ ID NO: 172142 - RNA, 22 nt, Human
acaaagcagggagccugaagag

SEQ ID NO: 172143 - RNA, 23 nt, Human
acaaagcagggagccugaagagc

SEQ ID NO: 172144 - RNA, 19 nt, Human
acucaaaggcaaagggagg

SEQ ID NO: 172145 - RNA, 23 nt, Human
acuuugaaggaagaggaaaaaag

SEQ ID NO: 172146 - RNA, 23 nt, Human
agaaaagaugaggaggaaaagga

SEQ ID NO: 172147 - RNA, 20 nt, Human
agaaggaaaaagacuuugaa

SEQ ID NO: 172148 - RNA, 19 nt, Human
agaggaaaaaagcgggaag

SEQ ID NO: 172149 - RNA, 21 nt, Human
agcauaggaaggagagaagga

SEQ ID NO: 172150 - RNA, 26 nt, Human
aggaaaaagacuuugaaggaagagga

SEQ ID NO: 172151 - RNA, 23 nt, Human
aggaagagauauaaagacugagg

SEQ ID NO: 172152 - RNA, 24 nt, Human
aggaagagauauaaagacugaggg

SEQ ID NO: 172153 - RNA, 22 nt, Human
aggaaggagagaaggaaaaaga

SEQ ID NO: 172154 - RNA, 26 nt, Human
aggcaccaagagaccaggauggaacu

SEQ ID NO: 172155 - RNA, 18 nt, Human
agugcaaggucagaagga

SEQ ID NO: 172156 - RNA, 21 nt, Human
caaggucagaaggaaaggcac

SEQ ID NO: 172157 - RNA, 24 nt, Human
caggaacaguccuggggaagccag

SEQ ID NO: 172158 - RNA, 20 nt, Human
cauacucacccugugcagac

SEQ ID NO: 172159 - RNA, 20 nt, Human
cccugugcagacaguucccc

SEQ ID NO: 172160 - RNA, 20 nt, Human
ccuggggaagccagggcagc

SEQ ID NO: 172161 - RNA, 19 nt, Human
cgggaagggagaaaagaug

SEQ ID NO: 172162 - RNA, 21 nt, Human
gaaaggcaccaagagaccagu

SEQ ID NO: 172163 - RNA, 21 nt, Human
gaacaguccuggggaagccag

SEQ ID NO: 172164 - RNA, 21 nt, Human
gaagaggaaaaaagcgggaag

SEQ ID NO: 172165 - RNA, 18 nt, Human
gaaggaagaggaaaaaag

SEQ ID NO: 172166 - RNA, 24 nt, Human
gaaggaagaggaaaaaagcgggaa

SEQ ID NO: 172167 - RNA, 22 nt, Human
gacaaagcagggagccugaaga

SEQ ID NO: 172168 - RNA, 24 nt, Human
gacagagaggaaggucggguggga

SEQ ID NO: 172169 - RNA, 20 nt, Human
gacugaggggcaaacagcag

SEQ ID NO: 172170 - RNA, 18 nt, Human
gagaaaagaugaggagga

SEQ ID NO: 172171 - RNA, 22 nt, Human
gagggacacaagagggagcuag

SEQ ID NO: 172172 - RNA, 18 nt, Human
gaggggaggacagagagg

SEQ ID NO: 172173 - RNA, 19 nt, Human
gcaggaacaguccugggga

SEQ ID NO: 172174 - RNA, 18 nt, Human
gcaggugggaggggagga

SEQ ID NO: 172175 - RNA, 20 nt, Human
gccuggccccauacucaccc

SEQ ID NO: 172176 - RNA, 24 nt, Human
ggaagaggaaaaaagcgggaaggg

SEQ ID NO: 172177 - RNA, 21 nt, Human
ggacaaagcagggagccugaa

SEQ ID NO: 172178 - RNA, 23 nt, Human
ggacaaagcagggagccugaaga

SEQ ID NO: 172179 - RNA, 20 nt, Human
ggcaaacagcaggggaaaug

SEQ ID NO: 172180 - RNA, 25 nt, Human
ggcaaagggagggacacaagaggga

SEQ ID NO: 172181 - RNA, 22 nt, Human
gggagaacaaggucucugcagg

SEQ ID NO: 172182 - RNA, 19 nt, Human
gggagggacacaagaggga

SEQ ID NO: 172183 - RNA, 18 nt, Human
gggcaggugggaggggag

SEQ ID NO: 172184 - RNA, 18 nt, Human
uagggauaagggacucug

SEQ ID NO: 172185 - RNA, 19 nt, Human
ugaaggaagaggaaaaaag

SEQ ID NO: 172186 - RNA, 20 nt, Human
ugaaggaagaggaaaaaagc

SEQ ID NO: 172187 - RNA, 18 nt, Human
ugcaggagucagaugcag

SEQ ID NO: 172188 - RNA, 19 nt, Human
ugggaggggaggacagaga

SEQ ID NO: 172189 - RNA, 18 nt, Human
aaauguugaaaguguaca

SEQ ID NO: 172190 - RNA, 24 nt, Human
aacccauaucuucagucucuucca

SEQ ID NO: 172191 - RNA, 21 nt, Human
aagcaaacaucaacuccuuaa

SEQ ID NO: 172192 - RNA, 22 nt, Human
aaucucaguaaccacaucuuuc

SEQ ID NO: 172193 - RNA, 18 nt, Human
acacauuucuguaaaucc

SEQ ID NO: 172194 - RNA, 19 nt, Human
acacuagagaaugaaauga

SEQ ID NO: 172195 - RNA, 22 nt, Human
acagaauaaauguauaccaaau

SEQ ID NO: 172196 - RNA, 20 nt, Human
acaguuaaaaauccagcuuc

SEQ ID NO: 172197 - RNA, 24 nt, Human
accauaaaauguaaaauaguucag

SEQ ID NO: 172198 - RNA, 23 nt, Human
acccggguggcuagggcgcgccg

SEQ ID NO: 172199 - RNA, 19 nt, Human
acuaaggugggagaaggga

SEQ ID NO: 172200 - RNA, 20 nt, Human
agacacuagagaaugaaaug

SEQ ID NO: 172201 - RNA, 24 nt, Human
agacacuagagaaugaaaugagcu

SEQ ID NO: 172202 - RNA, 23 nt, Human
agagccccuaccucaagccagga

SEQ ID NO: 172203 - RNA, 23 nt, Human
agaugucaggauuggcacgaacu

SEQ ID NO: 172204 - RNA, 22 nt, Human
agccgccgccgccgcggaaacu

SEQ ID NO: 172205 - RNA, 21 nt, Human
agcgcagcccuagucgcaccc

SEQ ID NO: 172206 - RNA, 20 nt, Human
aggaaagaaagggaggggac

SEQ ID NO: 172207 - RNA, 24 nt, Human
aggaaguccaugacacugaaauau

SEQ ID NO: 172208 - RNA, 22 nt, Human
aggagggggagggggcaaaagg

SEQ ID NO: 172209 - RNA, 19 nt, Human
agggagaggcgcgcgagga

SEQ ID NO: 172210 - RNA, 24 nt, Human
agggaggggacagaaggaggggga

SEQ ID NO: 172211 - RNA, 18 nt, Human
aggggacagaaggagggg

SEQ ID NO: 172212 - RNA, 21 nt, Human
agggggagggggcaaaaggga

SEQ ID NO: 172213 - RNA, 18 nt, Human
agggggcaaaaggaggag

SEQ ID NO: 172214 - RNA, 21 nt, Human
agggggcaaaaggaggaggcg

SEQ ID NO: 172215 - RNA, 18 nt, Human
auaccaaauucaaagacc

SEQ ID NO: 172216 - RNA, 21 nt, Human
auaccaaauucaaagaccaau

SEQ ID NO: 172217 - RNA, 24 nt, Human
auagugaacagaauaaauguauac

SEQ ID NO: 172218 - RNA, 18 nt, Human
aucauaaaagcgaacagu

SEQ ID NO: 172219 - RNA, 20 nt, Human
augaaaugagcucaccccuc

SEQ ID NO: 172220 - RNA, 23 nt, Human
auuauuuucaggcacaaaaucca

SEQ ID NO: 172221 - RNA, 19 nt, Human
auuucuguaaauccaaaag

SEQ ID NO: 172222 - RNA, 23 nt, Human
caaagcuucaugcuucuucccaa

SEQ ID NO: 172223 - RNA, 18 nt, Human
caacccacacaaagcuuc

SEQ ID NO: 172224 - RNA, 21 nt, Human
cacccuguaaccaacuaaggu

SEQ ID NO: 172225 - RNA, 25 nt, Human
cagacauagauaaauuuagguccua

SEQ ID NO: 172226 - RNA, 19 nt, Human
cagccgccgccgccgcgga

SEQ ID NO: 172227 - RNA, 23 nt, Human
cagcgcagcccuagucgcacccc

SEQ ID NO: 172228 - RNA, 23 nt, Human
cagcgcagcccuagucgcacccc

SEQ ID NO: 172229 - RNA, 19 nt, Human
cagcgggcucggcuccccc

SEQ ID NO: 172230 - RNA, 24 nt, Human
cagcucaagcucuauuauuuucag

SEQ ID NO: 172231 - RNA, 18 nt, Human
caggauuggcacgaacuc

SEQ ID NO: 172232 - RNA, 18 nt, Human
caguaaccacaucuuucc

SEQ ID NO: 172233 - RNA, 24 nt, Human
caugacacugaaauauccuucaag

SEQ ID NO: 172234 - RNA, 19 nt, Human
ccacacccgugggccccca

SEQ ID NO: 172235 - RNA, 23 nt, Human
ccacacccgugggcccccaugaa

SEQ ID NO: 172236 - RNA, 24 nt, Human
ccacacccgugggcccccaugaag

SEQ ID NO: 172237 - RNA, 21 nt, Human
ccagcgggcucggcucccccc

SEQ ID NO: 172238 - RNA, 18 nt, Human
ccaggcauccguaugcaa

SEQ ID NO: 172239 - RNA, 21 nt, Human
cccagccgucccgagcacccg

SEQ ID NO: 172240 - RNA, 18 nt, Human
cccccugcggccagggag

SEQ ID NO: 172241 - RNA, 20 nt, Human
cccccugcggccagggagac

SEQ ID NO: 172242 - RNA, 18 nt, Human
ccccggccgaggccuggg

SEQ ID NO: 172243 - RNA, 22 nt, Human
ccccgucaauuauuccaccuuc

SEQ ID NO: 172244 - RNA, 24 nt, Human
ccccgucaauuauuccaccuucuu

SEQ ID NO: 172245 - RNA, 21 nt, Human
cccgugggcccccaugaaguu

SEQ ID NO: 172246 - RNA, 26 nt, Human
cccuggcagcgcagcccuagucgcac

SEQ ID NO: 172247 - RNA, 20 nt, Human
ccgccgccgccgccugacca

SEQ ID NO: 172248 - RNA, 18 nt, Human
ccgcuccgcuggggcugc

SEQ ID NO: 172249 - RNA, 20 nt, Human
ccgcuuucggcccgcucccc

SEQ ID NO: 172250 - RNA, 20 nt, Human
ccggggucgugucccgccuu

SEQ ID NO: 172251 - RNA, 18 nt, Human
ccuccgccuccuucuccg

SEQ ID NO: 172252 - RNA, 20 nt, Human
ccuucaaguuuucaauuucu

SEQ ID NO: 172253 - RNA, 21 nt, Human
cgcccacacccgugggccccc

SEQ ID NO: 172254 - RNA, 22 nt, Human
cgcccacacccgugggccccca

SEQ ID NO: 172255 - RNA, 21 nt, Human
cgccccggccgaggccugggc

SEQ ID NO: 172256 - RNA, 24 nt, Human
cggcggcggcucccccugcggcca

SEQ ID NO: 172257 - RNA, 19 nt, Human
cggcuccccccugcgccuc

SEQ ID NO: 172258 - RNA, 20 nt, Human
cggcuccccccugcgccucc

SEQ ID NO: 172259 - RNA, 18 nt, Human
cgggcggcggggagaacc

SEQ ID NO: 172260 - RNA, 19 nt, Human
cuccuguucugcguaccgc

SEQ ID NO: 172261 - RNA, 22 nt, Human
cucggcuccccccugcgccucc

SEQ ID NO: 172262 - RNA, 24 nt, Human
cugcgccccggccgaggccuggga

SEQ ID NO: 172263 - RNA, 23 nt, Human
cuuccaacccacacaaagcuuca

SEQ ID NO: 172264 - RNA, 21 nt, Human
gaaagggaggggacagaagga

SEQ ID NO: 172265 - RNA, 20 nt, Human
gaaggagggggagggggcaa

SEQ ID NO: 172266 - RNA, 20 nt, Human
gaccugcacacauuuucccu

SEQ ID NO: 172267 - RNA, 20 nt, Human
gaggggacagaaggaggggg

SEQ ID NO: 172268 - RNA, 18 nt, Human
gagggggcaaaaggagga

SEQ ID NO: 172269 - RNA, 24 nt, Human
gcacggccggcggcggcucccccu

SEQ ID NO: 172270 - RNA, 22 nt, Human
gcagcccagcgggcucggcucc

SEQ ID NO: 172271 - RNA, 22 nt, Human
gcggggagaacccggguggcua

SEQ ID NO: 172272 - RNA, 22 nt, Human
gcgguugcacaccaguuuuagc

SEQ ID NO: 172273 - RNA, 24 nt, Human
ggaggggacagaaggagggggagg

SEQ ID NO: 172274 - RNA, 22 nt, Human
ggcuauuuacaaucauaaaagc

SEQ ID NO: 172275 - RNA, 18 nt, Human
gggcaaaaggaggaggcg

SEQ ID NO: 172276 - RNA, 21 nt, Human
gggcaugggcugagccccggg

SEQ ID NO: 172277 - RNA, 23 nt, Human
ggggacagaaggagggggagggg

SEQ ID NO: 172278 - RNA, 19 nt, Human
ggggagggggcaaaaggag

SEQ ID NO: 172279 - RNA, 22 nt, Human
gguggcuagggcgcgccggggu

SEQ ID NO: 172280 - RNA, 22 nt, Human
uaaaguuuaaaacaauacaauc

SEQ ID NO: 172281 - RNA, 18 nt, Human
uaaccaacuaagguggga

SEQ ID NO: 172282 - RNA, 22 nt, Human
uaagagccccuaccucaagcca

SEQ ID NO: 172283 - RNA, 21 nt, Human
uaauguaugggggcccuccuc

SEQ ID NO: 172284 - RNA, 27 nt, Human
uaauuaaaaacuuuugaaaaagaaaaa

SEQ ID NO: 172285 - RNA, 19 nt, Human
uaccgcagccgccgccgcc

SEQ ID NO: 172286 - RNA, 22 nt, Human
uaguucagacagcucaagcucu

SEQ ID NO: 172287 - RNA, 18 nt, Human
ucaagccaggaaagaaag

SEQ ID NO: 172288 - RNA, 18 nt, Human
ucaauuucuguuuacguu

SEQ ID NO: 172289 - RNA, 19 nt, Human
ucacagagaacuaaaguga

SEQ ID NO: 172290 - RNA, 27 nt, Human
ucaccccucaaaaauuagacuucaaaa

SEQ ID NO: 172291 - RNA, 23 nt, Human
ucacccuguaaccaacuaaggug

SEQ ID NO: 172292 - RNA, 21 nt, Human
ucccggcuggcggcgccgcgc

SEQ ID NO: 172293 - RNA, 21 nt, Human
ucgcugcgccccggccgaggc

SEQ ID NO: 172294 - RNA, 25 nt, Human
ucucuuggcgccgcuccgcuggggc

SEQ ID NO: 172295 - RNA, 20 nt, Human
ucuucagucucuuccaaccc

SEQ ID NO: 172296 - RNA, 23 nt, Human
ucuucagucucuuccaacccaca

SEQ ID NO: 172297 - RNA, 20 nt, Human
ugagacaccauaaaauguaa

SEQ ID NO: 172298 - RNA, 24 nt, Human
ugauuaaaaauaagaaaauagcac

SEQ ID NO: 172299 - RNA, 20 nt, Human
ugcgauucaugaagcgcggg

SEQ ID NO: 172300 - RNA, 19 nt, Human
uggaggaaaguucuggaca

SEQ ID NO: 172301 - RNA, 18 nt, Human
uggcagucgggcccucgu

SEQ ID NO: 172302 - RNA, 18 nt, Human
uggcauugguuaucucac

SEQ ID NO: 172303 - RNA, 21 nt, Human
uggccaaacccauaccagguu

SEQ ID NO: 172304 - RNA, 21 nt, Human
uggcccucggcucgcuggcuc

SEQ ID NO: 172305 - RNA, 24 nt, Human
ugggauuggcuaugagacaccaua

SEQ ID NO: 172306 - RNA, 22 nt, Human
uguccuuuugccucagggacgg

SEQ ID NO: 172307 - RNA, 19 nt, Human
uguggaguucuguaccuua

SEQ ID NO: 172308 - RNA, 21 nt, Human
uucaggcacaaaauccauaua

SEQ ID NO: 172309 - RNA, 23 nt, Human
uuuucaauuucuguuuacguuuu

SEQ ID NO: 172310 - RNA, 21 nt, Human
aaaaaaaaaaaaagaagaaga

SEQ ID NO: 172311 - RNA, 22 nt, Human
aaaaaaaaaaaaagaagaagaa

SEQ ID NO: 172312 - RNA, 21 nt, Human
aaaaaaaaaagaagaagaaga

SEQ ID NO: 172313 - RNA, 19 nt, Human
aaaaaaaagaagaagaaga

SEQ ID NO: 172314 - RNA, 18 nt, Human
aaaaaagaagaagaagaa

SEQ ID NO: 172315 - RNA, 25 nt, Human
aaaaagccacaaaauguagcacuga

SEQ ID NO: 172316 - RNA, 22 nt, Human
aaaacccuuuaaguacauuuuu

SEQ ID NO: 172317 - RNA, 21 nt, Human
aaacacaaccaagaaaagcac

SEQ ID NO: 172318 - RNA, 23 nt, Human
aaacacaaccaagaaaagcacca

SEQ ID NO: 172319 - RNA, 19 nt, Human
aaaccaaaacaaaacaaaa

SEQ ID NO: 172320 - RNA, 20 nt, Human
aaaccaaaacaaaacaaaaa

SEQ ID NO: 172321 - RNA, 31 nt, Human
aaagaaaaacacaaccaagaaaagcaccacu

SEQ ID NO: 172322 - RNA, 22 nt, Human
aaccaaaacaaaacaaaacccu

SEQ ID NO: 172323 - RNA, 20 nt, Human
aaccaagaaaagcaccacau

SEQ ID NO: 172324 - RNA, 21 nt, Human
aaccuagugcuuccugaucug

SEQ ID NO: 172325 - RNA, 24 nt, Human
aagaaagaaaaacacaaccaagaa

SEQ ID NO: 172326 - RNA, 26 nt, Human
aagaaagaaaaacacaaccaagaaaa

SEQ ID NO: 172327 - RNA, 21 nt, Human
aagaagaagaagaaagaaaaa

SEQ ID NO: 172328 - RNA, 21 nt, Human
aagcaacuccaaauccacugg

SEQ ID NO: 172329 - RNA, 21 nt, Human
aaggguuucugagggcugggc

SEQ ID NO: 172330 - RNA, 21 nt, Human
aaugauccuucucccucuucc

SEQ ID NO: 172331 - RNA, 19 nt, Human
accaaaacaaaacaaaacc

SEQ ID NO: 172332 - RNA, 26 nt, Human
agaagaaagaaaaacacaaccaagaa

SEQ ID NO: 172333 - RNA, 20 nt, Human
agcagcaaaguuugcaaaca

SEQ ID NO: 172334 - RNA, 22 nt, Human
agcucgcggcgcccccacagcc

SEQ ID NO: 172335 - RNA, 19 nt, Human
aggagcuucccuucgcugg

SEQ ID NO: 172336 - RNA, 24 nt, Human
aggccggagucuauuuuaagcaac

SEQ ID NO: 172337 - RNA, 18 nt, Human
agguggcgcgucuggagc

SEQ ID NO: 172338 - RNA, 22 nt, Human
aguggagcaugaaaaauaucau

SEQ ID NO: 172339 - RNA, 21 nt, Human
auaaaaaaaaaaaaagaagaa

SEQ ID NO: 172340 - RNA, 18 nt, Human
auccacuggggugugagg

SEQ ID NO: 172341 - RNA, 22 nt, Human
auuaguuacacaagaggcuacu

SEQ ID NO: 172342 - RNA, 22 nt, Human
caaaacaaaacaaaacccuuua

SEQ ID NO: 172343 - RNA, 23 nt, Human
caaaacaaaacaaaacccuuuaa

SEQ ID NO: 172344 - RNA, 22 nt, Human
caaaacaaaacccuuuaaguac

SEQ ID NO: 172345 - RNA, 19 nt, Human
caacucacggccgcggcaa

SEQ ID NO: 172346 - RNA, 22 nt, Human
caagaaaagcaccacaucuuag

SEQ ID NO: 172347 - RNA, 21 nt, Human
cacagcauccugaauuucagg

SEQ ID NO: 172348 - RNA, 22 nt, Human
caccccugcucgggcccccgcc

SEQ ID NO: 172349 - RNA, 18 nt, Human
caccgaggccggcccagc

SEQ ID NO: 172350 - RNA, 18 nt, Human
cagcgcccccggcucggc

SEQ ID NO: 172351 - RNA, 23 nt, Human
cagcgcccccggcucggcucucc

SEQ ID NO: 172352 - RNA, 19 nt, Human
ccacuggggugugaggcgg

SEQ ID NO: 172353 - RNA, 24 nt, Human
cccacagcccgggcggcuccuccc

SEQ ID NO: 172354 - RNA, 21 nt, Human
ccccacagcccgggcggcucc

SEQ ID NO: 172355 - RNA, 23 nt, Human
ccccggagcucccggcgcagcgg

SEQ ID NO: 172356 - RNA, 24 nt, Human
ccccuccuuuccacaaaucagucc

SEQ ID NO: 172357 - RNA, 24 nt, Human
cccucagcgccgccgcucccgggc

SEQ ID NO: 172358 - RNA, 18 nt, Human
cccucuuccccccuccuu

SEQ ID NO: 172359 - RNA, 19 nt, Human
cccugcgccggccucggcc

SEQ ID NO: 172360 - RNA, 22 nt, Human
cccugcgccggccucggccggg

SEQ ID NO: 172361 - RNA, 22 nt, Human
ccgcgccccucagcgccgccgc

SEQ ID NO: 172362 - RNA, 24 nt, Human
ccgcggcaaacuucggccucuucu

SEQ ID NO: 172363 - RNA, 21 nt, Human
ccgcggcggagagcagcaaag

SEQ ID NO: 172364 - RNA, 19 nt, Human
ccugggggugggcccuggg

SEQ ID NO: 172365 - RNA, 22 nt, Human
ccugugcccuucccuccagccc

SEQ ID NO: 172366 - RNA, 19 nt, Human
cgaggccggcccagcucgc

SEQ ID NO: 172367 - RNA, 26 nt, Human
cgccccugugcccuucccuccagccc

SEQ ID NO: 172368 - RNA, 23 nt, Human
cgccggccucggccgggaccagc

SEQ ID NO: 172369 - RNA, 18 nt, Human
cgcggcgcccccacagcc

SEQ ID NO: 172370 - RNA, 24 nt, Human
cgggccccggguccugucuuuccu

SEQ ID NO: 172371 - RNA, 26 nt, Human
cuccgcgccccucagcgccgccgcuc

SEQ ID NO: 172372 - RNA, 22 nt, Human
cugaaggguuucugagggcugg

SEQ ID NO: 172373 - RNA, 19 nt, Human
cuggccccggcucuccacc

SEQ ID NO: 172374 - RNA, 24 nt, Human
cuuuaccacaaauuaguuacacaa

SEQ ID NO: 172375 - RNA, 26 nt, Human
gaaaaacacaaccaagaaaagcacca

SEQ ID NO: 172376 - RNA, 22 nt, Human
gaagaaagaaaaacacaaccaa

SEQ ID NO: 172377 - RNA, 24 nt, Human
gaagaagaagaaagaaaaacacaa

SEQ ID NO: 172378 - RNA, 18 nt, Human
gaggcgggccccgggucc

SEQ ID NO: 172379 - RNA, 22 nt, Human
gcccagcacuguggccuuccug

SEQ ID NO: 172380 - RNA, 22 nt, Human
gcccggcguccgccgaguuggg

SEQ ID NO: 172381 - RNA, 21 nt, Human
gcggcgcgggcacaccgaggc

SEQ ID NO: 172382 - RNA, 18 nt, Human
ggaggagcuucccuucgc

SEQ ID NO: 172383 - RNA, 22 nt, Human
ggcacgggcugcugcuggcccc

SEQ ID NO: 172384 - RNA, 23 nt, Human
ggcgcgucuggagcgggcuggcg

SEQ ID NO: 172385 - RNA, 21 nt, Human
ggcugggccucuuaguucuuu

SEQ ID NO: 172386 - RNA, 22 nt, Human
ggcuugguuuccauuaaaaagc

SEQ ID NO: 172387 - RNA, 18 nt, Human
gggauggcucauuuguua

SEQ ID NO: 172388 - RNA, 20 nt, Human
gggcugcugcuggccccggc

SEQ ID NO: 172389 - RNA, 20 nt, Human
ggugggcccuggggauggcu

SEQ ID NO: 172390 - RNA, 19 nt, Human
gugaagagaauacacuaga

SEQ ID NO: 172391 - RNA, 21 nt, Human
guuuguggaaaucauuuguuu

SEQ ID NO: 172392 - RNA, 23 nt, Human
uaaaaaaaaaaaaagaagaagaa

SEQ ID NO: 172393 - RNA, 22 nt, Human
uagcacugaaggguuucugagg

SEQ ID NO: 172394 - RNA, 21 nt, Human
uagcagcaaacuaaagaacau

SEQ ID NO: 172395 - RNA, 28 nt, Human
uauaaaaaaaaaaaaagaagaagaagaa

SEQ ID NO: 172396 - RNA, 22 nt, Human
ucaaggaaagagaaaaaaaugu

SEQ ID NO: 172397 - RNA, 20 nt, Human
ucacuggaggagcuucccuu

SEQ ID NO: 172398 - RNA, 21 nt, Human
ucaguccaaacgucuauaaca

SEQ ID NO: 172399 - RNA, 20 nt, Human
uccacaaaucaguccaaacg

SEQ ID NO: 172400 - RNA, 27 nt, Human
uccacuggggugugaggcgggccccgg

SEQ ID NO: 172401 - RNA, 21 nt, Human
ucccucuuccccccuccuuuc

SEQ ID NO: 172402 - RNA, 22 nt, Human
ucccucuuccccccuccuuucc

SEQ ID NO: 172403 - RNA, 21 nt, Human
uccugaauuucaggguaaaca

SEQ ID NO: 172404 - RNA, 19 nt, Human
uccuggcacugugaagaga

SEQ ID NO: 172405 - RNA, 20 nt, Human
ucgcggcgcccccacagccc

SEQ ID NO: 172406 - RNA, 29 nt, Human
ucucuuuugcuuuuauaaaaaaaaaaaaa

SEQ ID NO: 172407 - RNA, 20 nt, Human
ugaaugauccuucucccucu

SEQ ID NO: 172408 - RNA, 19 nt, Human
ugaauuucaggguaaacac

SEQ ID NO: 172409 - RNA, 23 nt, Human
ugaggcgggccccggguccuguc

SEQ ID NO: 172410 - RNA, 23 nt, Human
ugauccuucucccucuucccccc

SEQ ID NO: 172411 - RNA, 21 nt, Human
ugcaaacaauaccgggaagcg

SEQ ID NO: 172412 - RNA, 22 nt, Human
uggaaaaccaaaacaaaacaaa

SEQ ID NO: 172413 - RNA, 21 nt, Human
uggccccggcucuccaccccu

SEQ ID NO: 172414 - RNA, 21 nt, Human
uggcccgagcgcugcgcacag

SEQ ID NO: 172415 - RNA, 19 nt, Human
uggcucauuuguuaaccca

SEQ ID NO: 172416 - RNA, 18 nt, Human
ugggggugggcccugggg

SEQ ID NO: 172417 - RNA, 20 nt, Human
uggguagcaaagccaacuca

SEQ ID NO: 172418 - RNA, 25 nt, Human
uggguagcaaagccaacucaaauac

SEQ ID NO: 172419 - RNA, 23 nt, Human
uuaaaaagccacaaaauguagca

SEQ ID NO: 172420 - RNA, 18 nt, Human
uuccugggggugggcccu

SEQ ID NO: 172421 - RNA, 22 nt, Human
uucugagggcugggccucuuag

SEQ ID NO: 172422 - RNA, 22 nt, Human
uugaauuugcaaagcaguuauc

SEQ ID NO: 172423 - RNA, 20 nt, Human
uugaguucacaaaugugagg

SEQ ID NO: 172424 - RNA, 22 nt, Human
uuugaaugauccuucucccucu

SEQ ID NO: 172425 - RNA, 23 nt, Human
aaaaagcaaccuaaaagugaaau

SEQ ID NO: 172426 - RNA, 20 nt, Human
aaccuaaaagugaaaugguu

SEQ ID NO: 172427 - RNA, 24 nt, Human
aagcaaccuaaaagugaaaugguu

SEQ ID NO: 172428 - RNA, 25 nt, Human
aagcaaccuaaaagugaaaugguuu

SEQ ID NO: 172429 - RNA, 18 nt, Human
acccggagacugcgcuuc

SEQ ID NO: 172430 - RNA, 23 nt, Human
ccccccccgcccccgcccccaac

SEQ ID NO: 172431 - RNA, 24 nt, Human
cccccccgcccccgcccccaaccc

SEQ ID NO: 172432 - RNA, 21 nt, Human
ccccccgcccccgcccccaac

SEQ ID NO: 172433 - RNA, 22 nt, Human
cccccgcccccgcccccaaccc

SEQ ID NO: 172434 - RNA, 20 nt, Human
ccccgccgccuccucgcugc

SEQ ID NO: 172435 - RNA, 25 nt, Human
ccccgccgccuccucgcugcggcug

SEQ ID NO: 172436 - RNA, 18 nt, Human
ccgcccccgcccccaacc

SEQ ID NO: 172437 - RNA, 21 nt, Human
ccgccgccuccucgcugcggc

SEQ ID NO: 172438 - RNA, 21 nt, Human
ccggcuccuuggcgccccccc

SEQ ID NO: 172439 - RNA, 18 nt, Human
ccuuggcgccccccccgc

SEQ ID NO: 172440 - RNA, 25 nt, Human
cgccccccccgcccccgcccccaac

SEQ ID NO: 172441 - RNA, 18 nt, Human
cggcuccuuggcgccccc

SEQ ID NO: 172442 - RNA, 21 nt, Human
cggcugccgccucccgcgccu

SEQ ID NO: 172443 - RNA, 18 nt, Human
cuccucgcugcggcugcc

SEQ ID NO: 172444 - RNA, 26 nt, Human
cugcggcugccgccucccgcgccucu

SEQ ID NO: 172445 - RNA, 19 nt, Human
gcccccaacccggagacug

SEQ ID NO: 172446 - RNA, 22 nt, Human
gcccccaacccggagacugcgc

SEQ ID NO: 172447 - RNA, 22 nt, Human
ggcgccccccccgcccccgccc

SEQ ID NO: 172448 - RNA, 21 nt, Human
ggcugccgccucccgcgccuc

SEQ ID NO: 172449 - RNA, 19 nt, Human
ucgcugcggcugccgccuc

SEQ ID NO: 172450 - RNA, 20 nt, Human
ucgcugcggcugccgccucc

SEQ ID NO: 172451 - RNA, 22 nt, Human
ucgcugcggcugccgccucccg

SEQ ID NO: 172452 - RNA, 23 nt, Human
ucgcugcggcugccgccucccgc

SEQ ID NO: 172453 - RNA, 23 nt, Human
ucuuccccgccgccuccucgcug

SEQ ID NO: 172454 - RNA, 21 nt, Human
aaaacacaguucuuuuuucac

SEQ ID NO: 172455 - RNA, 23 nt, Human
aaacaagaaugauccagaaucug

SEQ ID NO: 172456 - RNA, 24 nt, Human
aaacaagaaugauccagaaucuga

SEQ ID NO: 172457 - RNA, 19 nt, Human
aaacagcacaagauuucca

SEQ ID NO: 172458 - RNA, 23 nt, Human
aaaggcaaagaauaaaaucugcu

SEQ ID NO: 172459 - RNA, 19 nt, Human
aacaagaaugauccagaau

SEQ ID NO: 172460 - RNA, 18 nt, Human
aacagcacaauuauaggg

SEQ ID NO: 172461 - RNA, 21 nt, Human
aagagaaccuuucauagacua

SEQ ID NO: 172462 - RNA, 22 nt, Human
aagcauguuccagcauuuuucu

SEQ ID NO: 172463 - RNA, 20 nt, Human
aauuaucucuucauaaccua

SEQ ID NO: 172464 - RNA, 23 nt, Human
acaaaaguuauaaaaacagcaca

SEQ ID NO: 172465 - RNA, 21 nt, Human
acaagauuuccaccuuagaca

SEQ ID NO: 172466 - RNA, 22 nt, Human
acacaaucuguacuugacugaa

SEQ ID NO: 172467 - RNA, 21 nt, Human
acagcacaauuauaggggaaa

SEQ ID NO: 172468 - RNA, 19 nt, Human
accacauucccaaaccaca

SEQ ID NO: 172469 - RNA, 22 nt, Human
agaaaugcuauccucagacccc

SEQ ID NO: 172470 - RNA, 25 nt, Human
agagaaccuuucauagacuaaucaa

SEQ ID NO: 172471 - RNA, 21 nt, Human
agcauguuccagcauuuuucu

SEQ ID NO: 172472 - RNA, 24 nt, Human
agcuaccagaauguuaucucacaa

SEQ ID NO: 172473 - RNA, 18 nt, Human
aguggaaauaaaacuaca

SEQ ID NO: 172474 - RNA, 25 nt, Human
aguuauaaaaacacagccagaaaaa

SEQ ID NO: 172475 - RNA, 19 nt, Human
aucaucuugucucuucuuu

SEQ ID NO: 172476 - RNA, 19 nt, Human
caagugauucuuaucugca

SEQ ID NO: 172477 - RNA, 19 nt, Human
cagacaaauaauuaucucu

SEQ ID NO: 172478 - RNA, 18 nt, Human
caggguugaggacccuug

SEQ ID NO: 172479 - RNA, 25 nt, Human
caucuugucucuucuuuucauuuua

SEQ ID NO: 172480 - RNA, 22 nt, Human
caugccuccacaaagcaaauuu

SEQ ID NO: 172481 - RNA, 24 nt, Human
caugccuccacaaagcaaauuuug

SEQ ID NO: 172482 - RNA, 20 nt, Human
cccaagugauucuuaucugc

SEQ ID NO: 172483 - RNA, 21 nt, Human
ccuacaguuuaaaaacacagu

SEQ ID NO: 172484 - RNA, 23 nt, Human
ccucagaccccggcgccuggcuc

SEQ ID NO: 172485 - RNA, 19 nt, Human
ccuggcuccaagggguggg

SEQ ID NO: 172486 - RNA, 23 nt, Human
ccuggcuccaagggguggggggg

SEQ ID NO: 172487 - RNA, 24 nt, Human
cgccuggcuccaaggggugggggg

SEQ ID NO: 172488 - RNA, 22 nt, Human
cggccgcgcgucccucagguac

SEQ ID NO: 172489 - RNA, 18 nt, Human
cucacuguagaaaaauac

SEQ ID NO: 172490 - RNA, 21 nt, Human
cucagaccccggcgccuggcc

SEQ ID NO: 172491 - RNA, 23 nt, Human
cuccauaagucaggucuugagaa

SEQ ID NO: 172492 - RNA, 22 nt, Human
cuuacuguuaaauucuucaaaa

SEQ ID NO: 172493 - RNA, 25 nt, Human
cuugucucuucuuuucaaggacggc

SEQ ID NO: 172494 - RNA, 21 nt, Human
gcugcaccgccugccgcgggc

SEQ ID NO: 172495 - RNA, 19 nt, Human
ggccaacauaucaaguuga

SEQ ID NO: 172496 - RNA, 19 nt, Human
gggggggcugcaccgccug

SEQ ID NO: 172497 - RNA, 21 nt, Human
guuccagcauuuuucuuucuc

SEQ ID NO: 172498 - RNA, 21 nt, Human
guuuguuagcuuggucucaca

SEQ ID NO: 172499 - RNA, 18 nt, Human
uaaaaacacagccagaaa

SEQ ID NO: 172500 - RNA, 21 nt, Human
uaaaacuacaaaguccuacug

SEQ ID NO: 172501 - RNA, 24 nt, Human
uaagagaaccuuucauagacuaau

SEQ ID NO: 172502 - RNA, 23 nt, Human
uaaguuauaaaaacacagccaga

SEQ ID NO: 172503 - RNA, 24 nt, Human
uaauucugaaauuguuuuauuaac

SEQ ID NO: 172504 - RNA, 18 nt, Human
uacaacaaugaauacaga

SEQ ID NO: 172505 - RNA, 22 nt, Human
uacaacaaugaauacagagaaa

SEQ ID NO: 172506 - RNA, 28 nt, Human
uacuaagacuaaucaugcuucauuuagc

SEQ ID NO: 172507 - RNA, 19 nt, Human
uacucaaaucaaucaccac

SEQ ID NO: 172508 - RNA, 21 nt, Human
uagccuacuggcuauugggca

SEQ ID NO: 172509 - RNA, 18 nt, Human
uagcuacaacaauuuuca

SEQ ID NO: 172510 - RNA, 18 nt, Human
uaggagaagagcuauuuc

SEQ ID NO: 172511 - RNA, 23 nt, Human
uaggcaucugaaguaacccaagu

SEQ ID NO: 172512 - RNA, 20 nt, Human
uauaguauaugaaaguucac

SEQ ID NO: 172513 - RNA, 23 nt, Human
uccacugcuaauccaaacccuga

SEQ ID NO: 172514 - RNA, 19 nt, Human
uccagaaucugaaaauaag

SEQ ID NO: 172515 - RNA, 20 nt, Human
ugaaagcauguuaacuguga

SEQ ID NO: 172516 - RNA, 23 nt, Human
ugaugcaauauaaaaaagcaauc

SEQ ID NO: 172517 - RNA, 18 nt, Human
ugccuugauguuccaagu

SEQ ID NO: 172518 - RNA, 23 nt, Human
ugcuaauccaaacccugaauauc

SEQ ID NO: 172519 - RNA, 24 nt, Human
uggaaauaaaacuacaaaguccua

SEQ ID NO: 172520 - RNA, 24 nt, Human
uggcaagaucacaucucacuguag

SEQ ID NO: 172521 - RNA, 18 nt, Human
uuacaaaaguuauaaaaa

SEQ ID NO: 172522 - RNA, 25 nt, Human
uucuuaucugcagucaggguugagg

SEQ ID NO: 172523 - RNA, 21 nt, Human
uuuaauucugaaauuguuuua

SEQ ID NO: 172524 - RNA, 21 nt, Human
uuuccaccuuagacaagacaa

SEQ ID NO: 172525 - RNA, 20 nt, Human
uuuuuuuuuuuuaagaaagc

SEQ ID NO: 172526 - RNA, 19 nt, Human
uuuuuuuuuuuuuuuuuaa

SEQ ID NO: 172527 - RNA, 21 nt, Human
agcagcggcagcggcuggggc

SEQ ID NO: 172528 - RNA, 22 nt, Human
agccagcagccagcgcugcgca

SEQ ID NO: 172529 - RNA, 21 nt, Human
agccggcgccggccgcguccg

SEQ ID NO: 172530 - RNA, 21 nt, Human
ccacaagccggcgccggccgc

SEQ ID NO: 172531 - RNA, 20 nt, Human
cccacaagccggcgccggcc

SEQ ID NO: 172532 - RNA, 21 nt, Human
cccgggccgaggccgagggac

SEQ ID NO: 172533 - RNA, 19 nt, Human
ccggcgccggccgcguccg

SEQ ID NO: 172534 - RNA, 21 nt, Human
ccggcgccggccgcguccguu

SEQ ID NO: 172535 - RNA, 20 nt, Human
cgaggccagccagcagccag

SEQ ID NO: 172536 - RNA, 24 nt, Human
cgucccgggccgaggccgagggac

SEQ ID NO: 172537 - RNA, 20 nt, Human
gaggccagccagcagccagc

SEQ ID NO: 172538 - RNA, 21 nt, Human
gaugcggcgacgagggggcag

SEQ ID NO: 172539 - RNA, 19 nt, Human
gcagcggcuggggcugcuc

SEQ ID NO: 172540 - RNA, 23 nt, Human
gcgagcccacaagccggcgccgg

SEQ ID NO: 172541 - RNA, 18 nt, Human
gcggcgacgagggggcag

SEQ ID NO: 172542 - RNA, 22 nt, Human
ggccgaggccgagggacaggcu

SEQ ID NO: 172543 - RNA, 21 nt, Human
ggcgccggcugcccgcgcugc

SEQ ID NO: 172544 - RNA, 26 nt, Human
gggccgaggccgagggacaggcugcg

SEQ ID NO: 172545 - RNA, 23 nt, Human
guagcagcggcagcggcuggggc

SEQ ID NO: 172546 - RNA, 18 nt, Human
ucuccagcagcugcgcgc

SEQ ID NO: 172547 - RNA, 19 nt, Human
ugcggcgacgagggggcag

SEQ ID NO: 172548 - RNA, 19 nt, Human
uugcacgggggcgccggcu

SEQ ID NO: 172549 - RNA, 20 nt, Human
aaaacgccccccuccccuca

SEQ ID NO: 172550 - RNA, 19 nt, Human
aaacaaaacgccccccucc

SEQ ID NO: 172551 - RNA, 26 nt, Human
aaacaaaacgccccccuccccucagc

SEQ ID NO: 172552 - RNA, 20 nt, Human
aaacgccccccuccccucag

SEQ ID NO: 172553 - RNA, 23 nt, Human
aaccuguugguugcuuuuuccuu

SEQ ID NO: 172554 - RNA, 19 nt, Human
aagaaacgcaaaauagaau

SEQ ID NO: 172555 - RNA, 24 nt, Human
accaugaagguaaacggaagugac

SEQ ID NO: 172556 - RNA, 26 nt, Human
auagaauacacgugagcugggccccc

SEQ ID NO: 172557 - RNA, 24 nt, Human
caaacaaaacgccccccuccccuc

SEQ ID NO: 172558 - RNA, 25 nt, Human
caaacaaaacgccccccuccccuca

SEQ ID NO: 172559 - RNA, 25 nt, Human
caacagcaccaugaagguaaacgga

SEQ ID NO: 172560 - RNA, 23 nt, Human
cagcccgcgagggacgcacacag

SEQ ID NO: 172561 - RNA, 19 nt, Human
ccaaacaaaacgccccccu

SEQ ID NO: 172562 - RNA, 26 nt, Human
ccaaagauaaacugcuucgggaaggc

SEQ ID NO: 172563 - RNA, 21 nt, Human
ccccucccuccccucgccucc

SEQ ID NO: 172564 - RNA, 21 nt, Human
ccccucgccuccagcagcccg

SEQ ID NO: 172565 - RNA, 18 nt, Human
ccccucuucccucucucc

SEQ ID NO: 172566 - RNA, 23 nt, Human
cccgccgagaagagcagacaguc

SEQ ID NO: 172567 - RNA, 22 nt, Human
ccgggccggggcuucucccucc

SEQ ID NO: 172568 - RNA, 18 nt, Human
ccuccgcuggcagcgcuc

SEQ ID NO: 172569 - RNA, 24 nt, Human
cgcccccucccuccccucgccucc

SEQ ID NO: 172570 - RNA, 23 nt, Human
cgccccucuucccucucuccaag

SEQ ID NO: 172571 - RNA, 23 nt, Human
cgcugccuccgcuggcagcgcuc

SEQ ID NO: 172572 - RNA, 21 nt, Human
cgcuggcagcgcuccgcuccu

SEQ ID NO: 172573 - RNA, 20 nt, Human
cgugagcugggccccuugga

SEQ ID NO: 172574 - RNA, 21 nt, Human
cuccucgccggauagggcugg

SEQ ID NO: 172575 - RNA, 24 nt, Human
cucgaaaacgccccucuucccucu

SEQ ID NO: 172576 - RNA, 22 nt, Human
cugccuccgcuggcagcgcucc

SEQ ID NO: 172577 - RNA, 22 nt, Human
gaauccgggccggggcuucucc

SEQ ID NO: 172578 - RNA, 22 nt, Human
gagaagaccugggacagguucu

SEQ ID NO: 172579 - RNA, 23 nt, Human
gaggaauccgggccggggcuucu

SEQ ID NO: 172580 - RNA, 18 nt, Human
gagucccucggcggcagc

SEQ ID NO: 172581 - RNA, 31 nt, Human
gcaaaauagaauacacgugagcugggccccu

SEQ ID NO: 172582 - RNA, 18 nt, Human
ggaaaggacucuccacgg

SEQ ID NO: 172583 - RNA, 22 nt, Human
ggagagacgguuagggcucgga

SEQ ID NO: 172584 - RNA, 25 nt, Human
uccagggaaaggacucuccacggau

SEQ ID NO: 172585 - RNA, 24 nt, Human
ucccuccccucgccuccagcagcc

SEQ ID NO: 172586 - RNA, 20 nt, Human
uggcagcgcuccgcuccucg

SEQ ID NO: 172587 - RNA, 25 nt, Human
aacccaccguuccccccagggaccu

SEQ ID NO: 172588 - RNA, 18 nt, Human
aagugcuaaaauaucaca

SEQ ID NO: 172589 - RNA, 19 nt, Human
aauauacaaaagacuaaca

SEQ ID NO: 172590 - RNA, 22 nt, Human
agggaccugagacggcuccggg

SEQ ID NO: 172591 - RNA, 18 nt, Human
augauaaaaauacuugaa

SEQ ID NO: 172592 - RNA, 23 nt, Human
caaaagaagaacguaacagugau

SEQ ID NO: 172593 - RNA, 28 nt, Human
caaagugcuaaaauaucacaauagcaug

SEQ ID NO: 172594 - RNA, 19 nt, Human
cacuuggccuaauauacaa

SEQ ID NO: 172595 - RNA, 18 nt, Human
cagaagauccccauccaa

SEQ ID NO: 172596 - RNA, 26 nt, Human
cagggaccugagacggcuccgggguu

SEQ ID NO: 172597 - RNA, 18 nt, Human
caguguaaaagcuaccaa

SEQ ID NO: 172598 - RNA, 23 nt, Human
cccccagggaccugagacggcuc

SEQ ID NO: 172599 - RNA, 19 nt, Human
ccuaaaacgagacuauaaa

SEQ ID NO: 172600 - RNA, 20 nt, Human
cuaacucuguccucccacac

SEQ ID NO: 172601 - RNA, 18 nt, Human
cugagacggcuccggggu

SEQ ID NO: 172602 - RNA, 21 nt, Human
ggaccugagacggcuccgggg

SEQ ID NO: 172603 - RNA, 18 nt, Human
ggccgcugucccuucccg

SEQ ID NO: 172604 - RNA, 24 nt, Human
ggucaugaaacauuaaaaaaggga

SEQ ID NO: 172605 - RNA, 22 nt, Human
gucuaacccaccguucccccca

SEQ ID NO: 172606 - RNA, 19 nt, Human
uaaaauguucaaauuccuc

SEQ ID NO: 172607 - RNA, 23 nt, Human
uaauauacaaaagacuaacauuu

SEQ ID NO: 172608 - RNA, 21 nt, Human
uauauuguugucauuaaccuu

SEQ ID NO: 172609 - RNA, 22 nt, Human
uauauuguugucauuaaccuuu

SEQ ID NO: 172610 - RNA, 21 nt, Human
ugaaucacucuuugcauccuc

SEQ ID NO: 172611 - RNA, 22 nt, Human
ugcaaaagaagaacguaacagu

SEQ ID NO: 172612 - RNA, 20 nt, Human
ugcagaaggaucagugagca

SEQ ID NO: 172613 - RNA, 22 nt, Human
uguaacacaaauuugcuucuga

SEQ ID NO: 172614 - RNA, 19 nt, Human
uguauaaaaagauacaagg

SEQ ID NO: 172615 - RNA, 21 nt, Human
uucauaaauagaaaaggaaga

SEQ ID NO: 172616 - RNA, 21 nt, Human
uuuccugaaaaugaguccugg

SEQ ID NO: 172617 - RNA, 19 nt, Human
aaaaauaccuacuccacgu

SEQ ID NO: 172618 - RNA, 24 nt, Human
aaaagaugccaaaaccuguguugg

SEQ ID NO: 172619 - RNA, 21 nt, Human
aaacagauugauggaaccaag

SEQ ID NO: 172620 - RNA, 19 nt, Human
aaagaacuucucacuucca

SEQ ID NO: 172621 - RNA, 22 nt, Human
aaagccaacaaaacaaaaaucc

SEQ ID NO: 172622 - RNA, 20 nt, Human
aaaggauccaaaugggagaa

SEQ ID NO: 172623 - RNA, 20 nt, Human
aacaaagacaaggggaaaag

SEQ ID NO: 172624 - RNA, 23 nt, Human
aaccaaauuaacaaccaacggga

SEQ ID NO: 172625 - RNA, 24 nt, Human
aacuucucacuuccaggucacuuc

SEQ ID NO: 172626 - RNA, 24 nt, Human
aagccaacaaaacaaaaauccaaa

SEQ ID NO: 172627 - RNA, 31 nt, Human
acaaaaauccaaaguaaaaauguauaaauag

SEQ ID NO: 172628 - RNA, 20 nt, Human
accaaauaaaacacccgucu

SEQ ID NO: 172629 - RNA, 18 nt, Human
accacacagagacagggu

SEQ ID NO: 172630 - RNA, 18 nt, Human
accgcuuuccacccaggu

SEQ ID NO: 172631 - RNA, 18 nt, Human
agacagggucagcauaug

SEQ ID NO: 172632 - RNA, 19 nt, Human
agcaaaaauaccuacucca

SEQ ID NO: 172633 - RNA, 21 nt, Human
aggacaaaauggcucuuugcu

SEQ ID NO: 172634 - RNA, 23 nt, Human
agggcuggggugggaaagguggg

SEQ ID NO: 172635 - RNA, 19 nt, Human
agggggcaggggaggagag

SEQ ID NO: 172636 - RNA, 20 nt, Human
aucaccccucgccccaaauc

SEQ ID NO: 172637 - RNA, 19 nt, Human
caaaccgcuuuccacccag

SEQ ID NO: 172638 - RNA, 21 nt, Human
caaagacaaggggaaaaaugc

SEQ ID NO: 172639 - RNA, 22 nt, Human
caaagacaaggggaaaaaugca

SEQ ID NO: 172640 - RNA, 24 nt, Human
caaagcagccaccgcagacagggc

SEQ ID NO: 172641 - RNA, 18 nt, Human
caacaaagcagccaccgc

SEQ ID NO: 172642 - RNA, 26 nt, Human
caaccaaauuaacaaccaacgggaaa

SEQ ID NO: 172643 - RNA, 21 nt, Human
cacagagacagggucagcaua

SEQ ID NO: 172644 - RNA, 23 nt, Human
caccccucgccccaaaucugcaa

SEQ ID NO: 172645 - RNA, 19 nt, Human
caccgcaggaggcccuccc

SEQ ID NO: 172646 - RNA, 19 nt, Human
cagaaaaugaaaaaguagc

SEQ ID NO: 172647 - RNA, 19 nt, Human
cagaaacaggcccccaccc

SEQ ID NO: 172648 - RNA, 22 nt, Human
cagaaacaggcccccacccagc

SEQ ID NO: 172649 - RNA, 24 nt, Human
cagcacaaaagaugccaaaaccug

SEQ ID NO: 172650 - RNA, 19 nt, Human
cagcggugcucucagccug

SEQ ID NO: 172651 - RNA, 24 nt, Human
caguacgggaggaaaaacaggcgg

SEQ ID NO: 172652 - RNA, 21 nt, Human
caucaucuuccugcaagucuu

SEQ ID NO: 172653 - RNA, 21 nt, Human
cccagugaaaagagauuaugg

SEQ ID NO: 172654 - RNA, 19 nt, Human
ccccaaaucugcaaagaac

SEQ ID NO: 172655 - RNA, 22 nt, Human
cccgucuuucugccuccugccu

SEQ ID NO: 172656 - RNA, 22 nt, Human
cccugcagcagggggaucgcuc

SEQ ID NO: 172657 - RNA, 21 nt, Human
ccggggccucacaggggucug

SEQ ID NO: 172658 - RNA, 18 nt, Human
ccugaaagcaguacggga

SEQ ID NO: 172659 - RNA, 21 nt, Human
ccuuuauuaugaggcugaaga

SEQ ID NO: 172660 - RNA, 21 nt, Human
cgccccaaaucugcaaagaac

SEQ ID NO: 172661 - RNA, 19 nt, Human
cgcccugcagcagggggau

SEQ ID NO: 172662 - RNA, 19 nt, Human
cucacaguccccguucagc

SEQ ID NO: 172663 - RNA, 21 nt, Human
cucccaacccaaccacacaga

SEQ ID NO: 172664 - RNA, 21 nt, Human
cuccucuugcaagagggcugg

SEQ ID NO: 172665 - RNA, 21 nt, Human
cuccucuugcaagagggcugg

SEQ ID NO: 172666 - RNA, 18 nt, Human
cucuuacaacaaagacaa

SEQ ID NO: 172667 - RNA, 19 nt, Human
cugccuccugccuucccca

SEQ ID NO: 172668 - RNA, 23 nt, Human
cuuccugcaagucuuugccugaa

SEQ ID NO: 172669 - RNA, 19 nt, Human
gaaaaaguaaaugaaggga

SEQ ID NO: 172670 - RNA, 18 nt, Human
gaccuuuaaagccaacaa

SEQ ID NO: 172671 - RNA, 18 nt, Human
gaggaaaaacaggcggga

SEQ ID NO: 172672 - RNA, 22 nt, Human
gaucgccucccaacccaaccac

SEQ ID NO: 172673 - RNA, 18 nt, Human
gcagcagggggaucgcuc

SEQ ID NO: 172674 - RNA, 25 nt, Human
ggaaaaacaggcgggagggggcagg

SEQ ID NO: 172675 - RNA, 18 nt, Human
ggaaagguggggaggggc

SEQ ID NO: 172676 - RNA, 21 nt, Human
ggccucacaggggucuggaca

SEQ ID NO: 172677 - RNA, 18 nt, Human
gggaaagguggggagggg

SEQ ID NO: 172678 - RNA, 23 nt, Human
gggaggaaaaacaggcgggaggg

SEQ ID NO: 172679 - RNA, 27 nt, Human
gggagggggcaggggaggagagaccgu

SEQ ID NO: 172680 - RNA, 22 nt, Human
gggcuggggugggaaagguggg

SEQ ID NO: 172681 - RNA, 20 nt, Human
ggggugggaaagguggggag

SEQ ID NO: 172682 - RNA, 22 nt, Human
ggggugggaaagguggggaggg

SEQ ID NO: 172683 - RNA, 24 nt, Human
gguagaccuuuaaagccaacaaaa

SEQ ID NO: 172684 - RNA, 19 nt, Human
guuggaguuuuaaaaaucu

SEQ ID NO: 172685 - RNA, 20 nt, Human
uaaaaacuguucugagaaac

SEQ ID NO: 172686 - RNA, 24 nt, Human
uaaaaacuguucugagaaacagga

SEQ ID NO: 172687 - RNA, 27 nt, Human
uaaaaagcaguuccacucaagugaaca

SEQ ID NO: 172688 - RNA, 18 nt, Human
uaaaacagacaacaaaac

SEQ ID NO: 172689 - RNA, 26 nt, Human
uaaagugggguagaccuuuaaagcca

SEQ ID NO: 172690 - RNA, 18 nt, Human
uaacuuguacacuuuaca

SEQ ID NO: 172691 - RNA, 21 nt, Human
uacaacaaagacaaggggaaa

SEQ ID NO: 172692 - RNA, 23 nt, Human
uacaacaaagacaaggggaaaaa

SEQ ID NO: 172693 - RNA, 21 nt, Human
uacagaaaaaaaguacaugau

SEQ ID NO: 172694 - RNA, 24 nt, Human
uacagaaacaggcccccacccagc

SEQ ID NO: 172695 - RNA, 24 nt, Human
uaccucaaaggauccaaaugggag

SEQ ID NO: 172696 - RNA, 26 nt, Human
uagcaggcaggccucccaagacuucc

SEQ ID NO: 172697 - RNA, 20 nt, Human
ucaaaggauccaaaugggag

SEQ ID NO: 172698 - RNA, 25 nt, Human
ucacuuccaggucacuucucaguaa

SEQ ID NO: 172699 - RNA, 25 nt, Human
ucacuucuuuucaggguauuagacc

SEQ ID NO: 172700 - RNA, 18 nt, Human
ucagccucggagccggga

SEQ ID NO: 172701 - RNA, 22 nt, Human
ucauccaaaccgcuuuccaccc

SEQ ID NO: 172702 - RNA, 24 nt, Human
uccaguuuggccccagugaaaaga

SEQ ID NO: 172703 - RNA, 20 nt, Human
ucccaacccaaccacacaga

SEQ ID NO: 172704 - RNA, 19 nt, Human
ucccggggccucacagggg

SEQ ID NO: 172705 - RNA, 21 nt, Human
ucugccuccugccuucccccc

SEQ ID NO: 172706 - RNA, 19 nt, Human
ucugcuaagcuuuacccca

SEQ ID NO: 172707 - RNA, 29 nt, Human
ucuuccagcacauuucaaagaacuccagg

SEQ ID NO: 172708 - RNA, 18 nt, Human
ugaagggagagauuuccc

SEQ ID NO: 172709 - RNA, 28 nt, Human
ugacaagcacaccgcaggaaggguuucc

SEQ ID NO: 172710 - RNA, 23 nt, Human
ugagaaacaggauaguguugcaa

SEQ ID NO: 172711 - RNA, 18 nt, Human
ugaggagugcgacgaggc

SEQ ID NO: 172712 - RNA, 25 nt, Human
uggaaccaagaaaacaggacaaaau

SEQ ID NO: 172713 - RNA, 21 nt, Human
ugggaaagguggggaggggcc

SEQ ID NO: 172714 - RNA, 21 nt, Human
uggggugggaaagguggggag

SEQ ID NO: 172715 - RNA, 18 nt, Human
ugugacagcacacugcuc

SEQ ID NO: 172716 - RNA, 22 nt, Human
uuaaaaacuguucugagaaaca

SEQ ID NO: 172717 - RNA, 19 nt, Human
uuaaaagauacagcacaaa

SEQ ID NO: 172718 - RNA, 24 nt, Human
uuaaagccaacaaaacaaaaaucc

SEQ ID NO: 172719 - RNA, 24 nt, Human
uuacaaaaaugggagauuuacaaa

SEQ ID NO: 172720 - RNA, 19 nt, Human
uuacagaaacaggccccca

SEQ ID NO: 172721 - RNA, 23 nt, Human
uuaggcacaagcuggcccguacc

SEQ ID NO: 172722 - RNA, 21 nt, Human
uucaaaccuuccucuucguuc

SEQ ID NO: 172723 - RNA, 24 nt, Human
uugaaguuuaccuucuuuuaauga

SEQ ID NO: 172724 - RNA, 23 nt, Human
uuuaaagccaacaaaacaaaaau

SEQ ID NO: 172725 - RNA, 20 nt, Human
uuuaacauagucuguuggaa

SEQ ID NO: 172726 - RNA, 21 nt, Human
uuucccggggccucacagggg

SEQ ID NO: 172727 - RNA, 18 nt, Human
uuugaaguuuaccuucuu

SEQ ID NO: 172728 - RNA, 18 nt, Human
aaaauguccauuuucccc

SEQ ID NO: 172729 - RNA, 23 nt, Human
aaacgccgcagaguccacccucc

SEQ ID NO: 172730 - RNA, 24 nt, Human
aaagagcucccaugaaaaacaccg

SEQ ID NO: 172731 - RNA, 21 nt, Human
aagcacuuuaaaggugacagc

SEQ ID NO: 172732 - RNA, 20 nt, Human
aauguccauuuuccccaugc

SEQ ID NO: 172733 - RNA, 20 nt, Human
acagggguaagccucuaaac

SEQ ID NO: 172734 - RNA, 25 nt, Human
accccuccugggcgcccccuccccu

SEQ ID NO: 172735 - RNA, 19 nt, Human
accucagcccaucaagugu

SEQ ID NO: 172736 - RNA, 20 nt, Human
accucagcccaucaaguguc

SEQ ID NO: 172737 - RNA, 23 nt, Human
acuaaagugagaguuguuaucca

SEQ ID NO: 172738 - RNA, 18 nt, Human
agaguuguuauccauggg

SEQ ID NO: 172739 - RNA, 19 nt, Human
agccagaaaauguccauuu

SEQ ID NO: 172740 - RNA, 22 nt, Human
aggcgggggagagggcaauggu

SEQ ID NO: 172741 - RNA, 23 nt, Human
agggagaaaaagagguucuccca

SEQ ID NO: 172742 - RNA, 21 nt, Human
aggguaagucaggggugggag

SEQ ID NO: 172743 - RNA, 24 nt, Human
caccccuccuccaggguaagucag

SEQ ID NO: 172744 - RNA, 19 nt, Human
caccccuccugggcgcccc

SEQ ID NO: 172745 - RNA, 22 nt, Human
cacuugggucuccucgcccccc

SEQ ID NO: 172746 - RNA, 23 nt, Human
cagaaaauguccauuuuccccau

SEQ ID NO: 172747 - RNA, 22 nt, Human
cagaaugacaagccagaaaaug

SEQ ID NO: 172748 - RNA, 24 nt, Human
ccaccccuccugggcgcccccucc

SEQ ID NO: 172749 - RNA, 20 nt, Human
ccagaaaauguccauuuucc

SEQ ID NO: 172750 - RNA, 20 nt, Human
ccccccuccccaccccuccc

SEQ ID NO: 172751 - RNA, 24 nt, Human
ccccccuccccaccccuccugggc

SEQ ID NO: 172752 - RNA, 26 nt, Human
ccccuccccaccccuccugggcgccc

SEQ ID NO: 172753 - RNA, 23 nt, Human
ccuccccaccccuccugggcgcc

SEQ ID NO: 172754 - RNA, 20 nt, Human
ccuccucagccaacagaaau

SEQ ID NO: 172755 - RNA, 31 nt, Human
ccuccuccaggguaagucaggggugggaguu

SEQ ID NO: 172756 - RNA, 19 nt, Human
ccucgccccccuccccacc

SEQ ID NO: 172757 - RNA, 23 nt, Human
ccucgccccccuccccaccccuc

SEQ ID NO: 172758 - RNA, 26 nt, Human
ccucgccccccuccccaccccuccug

SEQ ID NO: 172759 - RNA, 20 nt, Human
ccugggcgcccccuccccuc

SEQ ID NO: 172760 - RNA, 22 nt, Human
cucagcccaucaagugucccuu

SEQ ID NO: 172761 - RNA, 20 nt, Human
cugcacuugggucuccucgc

SEQ ID NO: 172762 - RNA, 23 nt, Human
cugggucugggaggcuucaaugc

SEQ ID NO: 172763 - RNA, 22 nt, Human
cuggucauuaagaauacccaaa

SEQ ID NO: 172764 - RNA, 25 nt, Human
gaaaagagcucccaugaaaaacacc

SEQ ID NO: 172765 - RNA, 24 nt, Human
gaggaaaaggggcugggucuggga

SEQ ID NO: 172766 - RNA, 18 nt, Human
gaggcuucaaugccaggu

SEQ ID NO: 172767 - RNA, 23 nt, Human
gcaaacccagccaagugcagcca

SEQ ID NO: 172768 - RNA, 19 nt, Human
gccccccuccccaccccuc

SEQ ID NO: 172769 - RNA, 20 nt, Human
gcgggaggagcuccccgcac

SEQ ID NO: 172770 - RNA, 18 nt, Human
gcugggucugggaggcuu

SEQ ID NO: 172771 - RNA, 20 nt, Human
ggaaacgccgcagaguccac

SEQ ID NO: 172772 - RNA, 19 nt, Human
ggaggaaaaggggcugggu

SEQ ID NO: 172773 - RNA, 19 nt, Human
gggagggcuccaaaucucg

SEQ ID NO: 172774 - RNA, 20 nt, Human
gggcugggucugggaggcuu

SEQ ID NO: 172775 - RNA, 24 nt, Human
ggucuccucgccccccuccccacc

SEQ ID NO: 172776 - RNA, 20 nt, Human
ggugggaguuuacguaggaa

SEQ ID NO: 172777 - RNA, 23 nt, Human
guccauuuuccccaugcguccuu

SEQ ID NO: 172778 - RNA, 23 nt, Human
uaagaaacccguauuuacguggg

SEQ ID NO: 172779 - RNA, 25 nt, Human
uaagaaacccguauuuacguggggu

SEQ ID NO: 172780 - RNA, 19 nt, Human
uaagaauacccaaaccgug

SEQ ID NO: 172781 - RNA, 22 nt, Human
uaauggauaccauuaagaguuc

SEQ ID NO: 172782 - RNA, 22 nt, Human
uacccaaaccgugcaaucccau

SEQ ID NO: 172783 - RNA, 22 nt, Human
ucaauggaggaaaaggggcugg

SEQ ID NO: 172784 - RNA, 23 nt, Human
ucaauuuugauuucaguucaaca

SEQ ID NO: 172785 - RNA, 22 nt, Human
uccauggaucagaaaagagcuc

SEQ ID NO: 172786 - RNA, 21 nt, Human
ucccaucagguggcggucacc

SEQ ID NO: 172787 - RNA, 20 nt, Human
ucgccccccuccccaccccu

SEQ ID NO: 172788 - RNA, 22 nt, Human
ucgccccccuccccaccccucc

SEQ ID NO: 172789 - RNA, 18 nt, Human
ucuccucgccccccuccc

SEQ ID NO: 172790 - RNA, 24 nt, Human
ugaaggggugggaaccucagccca

SEQ ID NO: 172791 - RNA, 24 nt, Human
ugccuggucauuaagaauacccaa

SEQ ID NO: 172792 - RNA, 19 nt, Human
ugccuugcagaaguuccau

SEQ ID NO: 172793 - RNA, 23 nt, Human
ugcuaauagcaaucaacacugug

SEQ ID NO: 172794 - RNA, 23 nt, Human
uggauauauacauauuuuacacu

SEQ ID NO: 172795 - RNA, 18 nt, Human
uggcgggaggagcucccc

SEQ ID NO: 172796 - RNA, 18 nt, Human
uggcgggaggagcucccc

SEQ ID NO: 172797 - RNA, 21 nt, Human
uguacacacuauaucuuugga

SEQ ID NO: 172798 - RNA, 20 nt, Human
ugugaaggggugggaaccuc

SEQ ID NO: 172799 - RNA, 24 nt, Human
uuacugccuugcagaaguuccauu

SEQ ID NO: 172800 - RNA, 20 nt, Human
uucaggguuuugaaaccuuu

SEQ ID NO: 172801 - RNA, 25 nt, Human
aaaaaaaaaaaaaaaaaaggcaaag

SEQ ID NO: 172802 - RNA, 25 nt, Human
aaaaaaaaaaaaaaaggcaaaguuc

SEQ ID NO: 172803 - RNA, 25 nt, Human
aaaaaaaaaaaaggcaaaguucuag

SEQ ID NO: 172804 - RNA, 21 nt, Human
aaaaaaaaggcaaaguucuag

SEQ ID NO: 172805 - RNA, 21 nt, Human
aagaaggaagaagagguucug

SEQ ID NO: 172806 - RNA, 21 nt, Human
aagcaaucuucagcccggagc

SEQ ID NO: 172807 - RNA, 22 nt, Human
aaggaagaagagguucugggag

SEQ ID NO: 172808 - RNA, 22 nt, Human
accuuggaggagagaagagaag

SEQ ID NO: 172809 - RNA, 21 nt, Human
acugcacucuagccuggacaa

SEQ ID NO: 172810 - RNA, 25 nt, Human
acugcacucuagccuggacaauaua

SEQ ID NO: 172811 - RNA, 23 nt, Human
agaagcaaucuucagcccggagc

SEQ ID NO: 172812 - RNA, 21 nt, Human
agaaggaagaagagguucugg

SEQ ID NO: 172813 - RNA, 24 nt, Human
agaaggaagaagagguucugggaa

SEQ ID NO: 172814 - RNA, 18 nt, Human
agacaggaggaucacuug

SEQ ID NO: 172815 - RNA, 23 nt, Human
agagaagcaaucuucagcccgga

SEQ ID NO: 172816 - RNA, 19 nt, Human
agccuggacaauauaguga

SEQ ID NO: 172817 - RNA, 23 nt, Human
agccuggacaauauagugagaac

SEQ ID NO: 172818 - RNA, 24 nt, Human
aggaguuggaggcugcaguguacu

SEQ ID NO: 172819 - RNA, 21 nt, Human
aggaucacuugaggcuaggag

SEQ ID NO: 172820 - RNA, 24 nt, Human
agguugagacaggaggaucacuug

SEQ ID NO: 172821 - RNA, 24 nt, Human
auauagugagaacccaucucaaaa

SEQ ID NO: 172822 - RNA, 20 nt, Human
aucacuugaggcuaggaguu

SEQ ID NO: 172823 - RNA, 18 nt, Human
cacugcacucuagccugg

SEQ ID NO: 172824 - RNA, 19 nt, Human
cacugcacucuagccugga

SEQ ID NO: 172825 - RNA, 21 nt, Human
cacugcacucuagccuggaca

SEQ ID NO: 172826 - RNA, 24 nt, Human
cacugcacucuagccuggacaaua

SEQ ID NO: 172827 - RNA, 19 nt, Human
ccacugcacucuagccugg

SEQ ID NO: 172828 - RNA, 19 nt, Human
ccacugcacucuagccugg

SEQ ID NO: 172829 - RNA, 20 nt, Human
ccacugcacucuagccugga

SEQ ID NO: 172830 - RNA, 20 nt, Human
ccacugcacucuagccugga

SEQ ID NO: 172831 - RNA, 21 nt, Human
ccacugcacucuagccuggac

SEQ ID NO: 172832 - RNA, 25 nt, Human
ccacugcacucuagccuggacaaua

SEQ ID NO: 172833 - RNA, 25 nt, Human
ccaucucaaaaaaaaaaaaaaaaaa

SEQ ID NO: 172834 - RNA, 19 nt, Human
cggcgcaugcuuguaaucc

SEQ ID NO: 172835 - RNA, 19 nt, Human
cuaggaguuggaggcugca

SEQ ID NO: 172836 - RNA, 18 nt, Human
cucaaaaaaaaaaaaaaa

SEQ ID NO: 172837 - RNA, 18 nt, Human
cucaaaaaaaaaaaaaaa

SEQ ID NO: 172838 - RNA, 23 nt, Human
cucaaaaaaaaaaaaaaaaaaaa

SEQ ID NO: 172839 - RNA, 23 nt, Human
gaaggaagaagagguucugggag

SEQ ID NO: 172840 - RNA, 24 nt, Human
gaauagccacugcacucuagccug

SEQ ID NO: 172841 - RNA, 21 nt, Human
gagaagagaagcaaucuucag

SEQ ID NO: 172842 - RNA, 22 nt, Human
gaggaucacuugaggcuaggag

SEQ ID NO: 172843 - RNA, 18 nt, Human
gaucacuugaggcuagga

SEQ ID NO: 172844 - RNA, 23 nt, Human
gaucacuugaggcuaggaguugg

SEQ ID NO: 172845 - RNA, 24 nt, Human
gaucacuugaggcuaggaguugga

SEQ ID NO: 172846 - RNA, 20 nt, Human
gccacugcacucuagccugg

SEQ ID NO: 172847 - RNA, 20 nt, Human
gccuggacaauauagugaga

SEQ ID NO: 172848 - RNA, 22 nt, Human
gcgcgggcuccgucacuagacc

SEQ ID NO: 172849 - RNA, 23 nt, Human
gcuaggaguuggaggcugcagug

SEQ ID NO: 172850 - RNA, 18 nt, Human
ggaguuggaggcugcagu

SEQ ID NO: 172851 - RNA, 21 nt, Human
ggcgcaugcuuguaauccuac

SEQ ID NO: 172852 - RNA, 19 nt, Human
uauagugagaacccaucuc

SEQ ID NO: 172853 - RNA, 23 nt, Human
uauagugagaacccaucucaaaa

SEQ ID NO: 172854 - RNA, 22 nt, Human
ucaaaaaaaaaaaaaaaaaaaa

SEQ ID NO: 172855 - RNA, 23 nt, Human
ucaaaaaaaaaaaaaaaaaaaaa

SEQ ID NO: 172856 - RNA, 19 nt, Human
ucacuagaccuuggaggag

SEQ ID NO: 172857 - RNA, 21 nt, Human
ucggcgcaugcuuguaauccu

SEQ ID NO: 172858 - RNA, 24 nt, Human
ucuagccuggacaauauagugaga

SEQ ID NO: 172859 - RNA, 18 nt, Human
ucucaaaaaaaaaaaaaa

SEQ ID NO: 172860 - RNA, 28 nt, Human
ucugugaauagccacugcacucuagccu

SEQ ID NO: 172861 - RNA, 20 nt, Human
ugagacaggaggaucacuug

SEQ ID NO: 172862 - RNA, 23 nt, Human
ugagacaggaggaucacuugagg

SEQ ID NO: 172863 - RNA, 24 nt, Human
ugagacaggaggaucacuugaggc

SEQ ID NO: 172864 - RNA, 25 nt, Human
ugagacaggaggaucacuugaggcu

SEQ ID NO: 172865 - RNA, 22 nt, Human
ugcugauagaugggcacagcag

SEQ ID NO: 172866 - RNA, 19 nt, Human
ugggagguugagacaggag

SEQ ID NO: 172867 - RNA, 24 nt, Human
ugggagguugagacaggaggauca

SEQ ID NO: 172868 - RNA, 20 nt, Human
aacgcgaggugccgccuccu

SEQ ID NO: 172869 - RNA, 25 nt, Human
aagaacagcaaagugggagggccgg

SEQ ID NO: 172870 - RNA, 23 nt, Human
acacugcggaagggcagcuggac

SEQ ID NO: 172871 - RNA, 20 nt, Human
acauaaagucccucgacuua

SEQ ID NO: 172872 - RNA, 18 nt, Human
accgcccaaaaaccuccc

SEQ ID NO: 172873 - RNA, 22 nt, Human
agaaagccucaaaaacauaaag

SEQ ID NO: 172874 - RNA, 20 nt, Human
agaacagcaaagugggaggg

SEQ ID NO: 172875 - RNA, 19 nt, Human
aggacaaggccaggcagcc

SEQ ID NO: 172876 - RNA, 26 nt, Human
aggcagccuggccacacugcggaagg

SEQ ID NO: 172877 - RNA, 24 nt, Human
auaccgcccaaaaaccuccccaaa

SEQ ID NO: 172878 - RNA, 24 nt, Human
aucucagcuaucccucacguuuca

SEQ ID NO: 172879 - RNA, 24 nt, Human
caauaccgcccaaaaaccucccca

SEQ ID NO: 172880 - RNA, 18 nt, Human
cagaaagccucaaaaaca

SEQ ID NO: 172881 - RNA, 22 nt, Human
ccaaaaaccuccccaaauuccu

SEQ ID NO: 172882 - RNA, 18 nt, Human
ccaggcagccuggccaca

SEQ ID NO: 172883 - RNA, 22 nt, Human
ccauggcaacagaaagccucaa

SEQ ID NO: 172884 - RNA, 24 nt, Human
ccauggcaacagaaagccucaaaa

SEQ ID NO: 172885 - RNA, 23 nt, Human
cccaaaaaccuccccaaauuccu

SEQ ID NO: 172886 - RNA, 24 nt, Human
cccccucguccucaauaccgccca

SEQ ID NO: 172887 - RNA, 24 nt, Human
cccgcccccgacgccauuuagacg

SEQ ID NO: 172888 - RNA, 20 nt, Human
ccgcccaaaaaccuccccaa

SEQ ID NO: 172889 - RNA, 25 nt, Human
ccgcccaaaaaccuccccaaauucc

SEQ ID NO: 172890 - RNA, 21 nt, Human
ccucaaacgcaggcgggccuc

SEQ ID NO: 172891 - RNA, 27 nt, Human
ccucaauaccgcccaaaaaccucccca

SEQ ID NO: 172892 - RNA, 22 nt, Human
ccucuagcaaggcuaugggggc

SEQ ID NO: 172893 - RNA, 19 nt, Human
cgaaaaaauaccgaccucu

SEQ ID NO: 172894 - RNA, 20 nt, Human
cgggacgaggccaggccuag

SEQ ID NO: 172895 - RNA, 22 nt, Human
cguuucagggccggcggcggcc

SEQ ID NO: 172896 - RNA, 24 nt, Human
cuaacggacccccucguccucaau

SEQ ID NO: 172897 - RNA, 20 nt, Human
cuagcuggcgaacaacacaa

SEQ ID NO: 172898 - RNA, 23 nt, Human
cucaaaaacauaaagucccucga

SEQ ID NO: 172899 - RNA, 20 nt, Human
cucaauaccgcccaaaaacc

SEQ ID NO: 172900 - RNA, 23 nt, Human
cugcugccucgaaagcucggcag

SEQ ID NO: 172901 - RNA, 26 nt, Human
gcaacagaaagccucaaaaacauaaa

SEQ ID NO: 172902 - RNA, 20 nt, Human
gcagacaggccucaagcgca

SEQ ID NO: 172903 - RNA, 18 nt, Human
gcccaaaaaccuccccaa

SEQ ID NO: 172904 - RNA, 24 nt, Human
gcccaaaaaccuccccaaauuccu

SEQ ID NO: 172905 - RNA, 23 nt, Human
ggcaacagaaagccucaaaaaca

SEQ ID NO: 172906 - RNA, 19 nt, Human
uaaagaacagcaaaguggg

SEQ ID NO: 172907 - RNA, 19 nt, Human
uaaauccugcugccucgaa

SEQ ID NO: 172908 - RNA, 25 nt, Human
uaaaucgaaaaaauaccgaccucua

SEQ ID NO: 172909 - RNA, 24 nt, Human
uaacaggcaaauuuaaaucgaaaa

SEQ ID NO: 172910 - RNA, 22 nt, Human
uagcucaggagaaacacauuuu

SEQ ID NO: 172911 - RNA, 22 nt, Human
uagcuggcgaacaacacaaaug

SEQ ID NO: 172912 - RNA, 22 nt, Human
uaugcugacuaacggacccccu

SEQ ID NO: 172913 - RNA, 22 nt, Human
ucaccauggcaacagaaagccu

SEQ ID NO: 172914 - RNA, 21 nt, Human
ucaggcaguaaaguaaagaac

SEQ ID NO: 172915 - RNA, 24 nt, Human
ucaggcaguaaaguaaagaacagc

SEQ ID NO: 172916 - RNA, 18 nt, Human
ucccggaggucccgcccc

SEQ ID NO: 172917 - RNA, 18 nt, Human
uccucaauaccgcccaaa

SEQ ID NO: 172918 - RNA, 25 nt, Human
ucguccucaauaccgcccaaaaacc

SEQ ID NO: 172919 - RNA, 23 nt, Human
ugacuaacggacccccucguccu

SEQ ID NO: 172920 - RNA, 19 nt, Human
uucccgcuccaggauucua

SEQ ID NO: 172921 - RNA, 23 nt, Human
aaaaaaagaaaaaaaaagaaaag

SEQ ID NO: 172922 - RNA, 22 nt, Human
aaaaaagaaaagcaggcaagga

SEQ ID NO: 172923 - RNA, 21 nt, Human
aaaaacaggcaaggagggccg

SEQ ID NO: 172924 - RNA, 21 nt, Human
aaaagaaaagcaggcaaggag

SEQ ID NO: 172925 - RNA, 21 nt, Human
aaaagcaccaccagagucgcc

SEQ ID NO: 172926 - RNA, 21 nt, Human
aaagcaccaccagagucgccc

SEQ ID NO: 172927 - RNA, 23 nt, Human
aaauauaguaauuaacaagacuu

SEQ ID NO: 172928 - RNA, 20 nt, Human
aacauagugagacccugucu

SEQ ID NO: 172929 - RNA, 20 nt, Human
aacaugaugaaaucccaucu

SEQ ID NO: 172930 - RNA, 21 nt, Human
aacaugaugaaaucccaucuc

SEQ ID NO: 172931 - RNA, 24 nt, Human
aaccaggaggaagagguugcagug

SEQ ID NO: 172932 - RNA, 19 nt, Human
aacccaacuucuagcaaca

SEQ ID NO: 172933 - RNA, 21 nt, Human
aagaaaaaaaaagaaaagcag

SEQ ID NO: 172934 - RNA, 22 nt, Human
acaacccaacuucuagcaacag

SEQ ID NO: 172935 - RNA, 20 nt, Human
acaguaaaaaaaauacuaga

SEQ ID NO: 172936 - RNA, 24 nt, Human
acauagugagacccugucucaaaa

SEQ ID NO: 172937 - RNA, 21 nt, Human
accucaggaagaugucagcag

SEQ ID NO: 172938 - RNA, 18 nt, Human
acuccacuccagccuggg

SEQ ID NO: 172939 - RNA, 24 nt, Human
acuccacuccagccugggugauag

SEQ ID NO: 172940 - RNA, 18 nt, Human
acuccagccugggugaua

SEQ ID NO: 172941 - RNA, 24 nt, Human
acuugaggucaggaguucgagacc

SEQ ID NO: 172942 - RNA, 21 nt, Human
agaaucgcuugaaccaggagg

SEQ ID NO: 172943 - RNA, 24 nt, Human
agagguugcagugagccaagaucg

SEQ ID NO: 172944 - RNA, 19 nt, Human
agagucgcccucuagccuu

SEQ ID NO: 172945 - RNA, 20 nt, Human
agccaggcgacccuccaauu

SEQ ID NO: 172946 - RNA, 23 nt, Human
agccuggcaugguggugcacgcc

SEQ ID NO: 172947 - RNA, 24 nt, Human
agccuggccaacaugaugaaaucc

SEQ ID NO: 172948 - RNA, 22 nt, Human
agccugggcaacauagugagac

SEQ ID NO: 172949 - RNA, 24 nt, Human
agccugggcaacauagugagaccc

SEQ ID NO: 172950 - RNA, 24 nt, Human
agccugggcaacauagugagaccc

SEQ ID NO: 172951 - RNA, 21 nt, Human
agccugggugauaggugcgcc

SEQ ID NO: 172952 - RNA, 24 nt, Human
aggaagagguugcagugagccaag

SEQ ID NO: 172953 - RNA, 23 nt, Human
aggaauucaagagcagccugggc

SEQ ID NO: 172954 - RNA, 18 nt, Human
aggcaaggaggaguuggc

SEQ ID NO: 172955 - RNA, 18 nt, Human
aggcaaggagggcccggu

SEQ ID NO: 172956 - RNA, 18 nt, Human
aggcagguggaucacuug

SEQ ID NO: 172957 - RNA, 22 nt, Human
aggcagguggaucacuugaggu

SEQ ID NO: 172958 - RNA, 26 nt, Human
aggcagguggaucacuugaggucagg

SEQ ID NO: 172959 - RNA, 19 nt, Human
aggcuucagcuuuuuuugg

SEQ ID NO: 172960 - RNA, 22 nt, Human
agguggaucacuugaggucagg

SEQ ID NO: 172961 - RNA, 18 nt, Human
agguggguggggcagaaa

SEQ ID NO: 172962 - RNA, 22 nt, Human
auaguaguccuccucaaucccu

SEQ ID NO: 172963 - RNA, 24 nt, Human
aucgugccacuccacuccagccug

SEQ ID NO: 172964 - RNA, 19 nt, Human
augccuguaauccuagcac

SEQ ID NO: 172965 - RNA, 26 nt, Human
caaaaaaaaaaaaaaagagagaaaaa

SEQ ID NO: 172966 - RNA, 23 nt, Human
caaaaugggcuggcagaagacca

SEQ ID NO: 172967 - RNA, 21 nt, Human
caacauagugagacccugucu

SEQ ID NO: 172968 - RNA, 22 nt, Human
caacauagugagacccugucuc

SEQ ID NO: 172969 - RNA, 24 nt, Human
caacaugaugaaaucccaucucuu

SEQ ID NO: 172970 - RNA, 24 nt, Human
caaggcagguggaucacuugaggu

SEQ ID NO: 172971 - RNA, 26 nt, Human
caaggcagguggaucacuugagguca

SEQ ID NO: 172972 - RNA, 18 nt, Human
cacagguagaaaauucuc

SEQ ID NO: 172973 - RNA, 18 nt, Human
caccgaagacuccacauc

SEQ ID NO: 172974 - RNA, 23 nt, Human
caccucuggccucaaaaugggcu

SEQ ID NO: 172975 - RNA, 22 nt, Human
cacuccacuccagccuggguga

SEQ ID NO: 172976 - RNA, 20 nt, Human
cacuccagccugggugauag

SEQ ID NO: 172977 - RNA, 22 nt, Human
cacuccagccugggugauaggu

SEQ ID NO: 172978 - RNA, 23 nt, Human
cacuccagccugggugauaggug

SEQ ID NO: 172979 - RNA, 23 nt, Human
cacuugaggucaggaguucgaga

SEQ ID NO: 172980 - RNA, 20 nt, Human
cagccugggcaacauaguga

SEQ ID NO: 172981 - RNA, 22 nt, Human
caggggaaaauccagaacaacc

SEQ ID NO: 172982 - RNA, 24 nt, Human
cagguggaucacuugaggucagga

SEQ ID NO: 172983 - RNA, 20 nt, Human
caugccuguaauccuagcac

SEQ ID NO: 172984 - RNA, 18 nt, Human
caugggaauaagccaggc

SEQ ID NO: 172985 - RNA, 20 nt, Human
ccacuccacuccagccuggg

SEQ ID NO: 172986 - RNA, 20 nt, Human
ccacuccacuccagccuggg

SEQ ID NO: 172987 - RNA, 21 nt, Human
ccacuccacuccagccugggu

SEQ ID NO: 172988 - RNA, 21 nt, Human
ccacuccacuccagccugggu

SEQ ID NO: 172989 - RNA, 23 nt, Human
ccacuccacuccagccuggguga

SEQ ID NO: 172990 - RNA, 24 nt, Human
ccacuccacuccagccugggugau

SEQ ID NO: 172991 - RNA, 18 nt, Human
ccagccugggcuugugag

SEQ ID NO: 172992 - RNA, 20 nt, Human
ccaguggaagaaucuggaaa

SEQ ID NO: 172993 - RNA, 24 nt, Human
ccauucaaagauaaaaugggcugu

SEQ ID NO: 172994 - RNA, 19 nt, Human
cccugucucaaaaaaaaaa

SEQ ID NO: 172995 - RNA, 22 nt, Human
ccgucucaaaaaaagaaaaaaa

SEQ ID NO: 172996 - RNA, 23 nt, Human
ccgucucaaaaaaagaaaaaaaa

SEQ ID NO: 172997 - RNA, 24 nt, Human
ccuggccaacaugaugaaauccca

SEQ ID NO: 172998 - RNA, 22 nt, Human
ccugggcaacauagugagaccc

SEQ ID NO: 172999 - RNA, 19 nt, Human
ccuguaauccuagcaccuu

SEQ ID NO: 173000 - RNA, 20 nt, Human
ccuguaauccuagcaccuug

SEQ ID NO: 173001 - RNA, 23 nt, Human
ccugucucaaaaaaaaaaaaaaa

SEQ ID NO: 173002 - RNA, 21 nt, Human
cgagaccagccuggccaacau

SEQ ID NO: 173003 - RNA, 22 nt, Human
cgugccacuccacuccagccug

SEQ ID NO: 173004 - RNA, 19 nt, Human
cuagcaccuugggaggcca

SEQ ID NO: 173005 - RNA, 24 nt, Human
cucaaaaaaaaaaaaaaagagaga

SEQ ID NO: 173006 - RNA, 18 nt, Human
cucaaaaaaagaaaaaaa

SEQ ID NO: 173007 - RNA, 25 nt, Human
cucaugccuguaauccuagcaccuu

SEQ ID NO: 173008 - RNA, 18 nt, Human
cuucaaauaguaguccuc

SEQ ID NO: 173009 - RNA, 19 nt, Human
gaaacauacaaaagcacca

SEQ ID NO: 173010 - RNA, 21 nt, Human
gagaagauguugacuuuuccu

SEQ ID NO: 173011 - RNA, 18 nt, Human
gagcugacagcaccucug

SEQ ID NO: 173012 - RNA, 18 nt, Human
gagguugcagugagccaa

SEQ ID NO: 173013 - RNA, 22 nt, Human
gagucacacaugggaauaagcc

SEQ ID NO: 173014 - RNA, 21 nt, Human
gaucacuugaggucaggaguu

SEQ ID NO: 173015 - RNA, 24 nt, Human
gaucacuugaggucaggaguucga

SEQ ID NO: 173016 - RNA, 21 nt, Human
gcacaguaaaaaaaauacuag

SEQ ID NO: 173017 - RNA, 24 nt, Human
gccaacaugaugaaaucccaucuc

SEQ ID NO: 173018 - RNA, 19 nt, Human
gccacuccacuccagccug

SEQ ID NO: 173019 - RNA, 24 nt, Human
gccacuccacuccagccuggguga

SEQ ID NO: 173020 - RNA, 19 nt, Human
gcccggugcgguggcucau

SEQ ID NO: 173021 - RNA, 22 nt, Human
ggaggaagagguugcagugagc

SEQ ID NO: 173022 - RNA, 23 nt, Human
ggagggcccggugcgguggcuca

SEQ ID NO: 173023 - RNA, 18 nt, Human
ggcaugguggugcacgcc

SEQ ID NO: 173024 - RNA, 21 nt, Human
gggcuguuccagugggaguga

SEQ ID NO: 173025 - RNA, 22 nt, Human
gggguagguggguggggcagaa

SEQ ID NO: 173026 - RNA, 23 nt, Human
ggugcgguggcucaugccuguaa

SEQ ID NO: 173027 - RNA, 21 nt, Human
gguggcucaugccuguaaucc

SEQ ID NO: 173028 - RNA, 24 nt, Human
gguggcucaugccuguaauccuag

SEQ ID NO: 173029 - RNA, 21 nt, Human
ggugggaggacugcuugagcc

SEQ ID NO: 173030 - RNA, 21 nt, Human
gucucaaaaaaaaaaaaaaag

SEQ ID NO: 173031 - RNA, 19 nt, Human
uaaaaaaaauacuagaagc

SEQ ID NO: 173032 - RNA, 24 nt, Human
uaaaaaaaauacuagaagcagaau

SEQ ID NO: 173033 - RNA, 22 nt, Human
uaaaaauauaaaaauuagccug

SEQ ID NO: 173034 - RNA, 22 nt, Human
uaacaagacuuuauucuuaaau

SEQ ID NO: 173035 - RNA, 24 nt, Human
uaaggaggaugauguaaugugaua

SEQ ID NO: 173036 - RNA, 21 nt, Human
uaccagugcccauugcuucaa

SEQ ID NO: 173037 - RNA, 22 nt, Human
uaccagugcccauugcuucaaa

SEQ ID NO: 173038 - RNA, 19 nt, Human
uacuaaaaacuccuccuua

SEQ ID NO: 173039 - RNA, 20 nt, Human
uagaagcagaauuaccccac

SEQ ID NO: 173040 - RNA, 22 nt, Human
uagaagcagaauuaccccacua

SEQ ID NO: 173041 - RNA, 23 nt, Human
uagcaaaaacaaggacuuucaaa

SEQ ID NO: 173042 - RNA, 25 nt, Human
uagcaaaaacaaggacuuucaaaua

SEQ ID NO: 173043 - RNA, 21 nt, Human
uagcaccuugggaggccaagg

SEQ ID NO: 173044 - RNA, 24 nt, Human
uagcaccuugggaggccaaggcag

SEQ ID NO: 173045 - RNA, 20 nt, Human
uagcuggacauaguggcuug

SEQ ID NO: 173046 - RNA, 22 nt, Human
uagcuuuucaaaaacauuaccc

SEQ ID NO: 173047 - RNA, 23 nt, Human
uagggugggaggacugcuugagc

SEQ ID NO: 173048 - RNA, 23 nt, Human
uaguagcaaaaacaaggacuuuc

SEQ ID NO: 173049 - RNA, 19 nt, Human
ucaaaaaaaaaaaaaaaga

SEQ ID NO: 173050 - RNA, 19 nt, Human
ucaagagcagccugggcaa

SEQ ID NO: 173051 - RNA, 22 nt, Human
ucacugcagccauucagaaauc

SEQ ID NO: 173052 - RNA, 20 nt, Human
ucacuugaggucaggaguuc

SEQ ID NO: 173053 - RNA, 20 nt, Human
uccaaggaaauacgaugaac

SEQ ID NO: 173054 - RNA, 18 nt, Human
uccagccugggugauagg

SEQ ID NO: 173055 - RNA, 24 nt, Human
ucugugcugagggcaggcuggagu

SEQ ID NO: 173056 - RNA, 18 nt, Human
ugaaaaacaggcaaggaa

SEQ ID NO: 173057 - RNA, 24 nt, Human
ugaaaaacaggcaaggagggcccg

SEQ ID NO: 173058 - RNA, 20 nt, Human
ugaaacauacaaaagcacca

SEQ ID NO: 173059 - RNA, 22 nt, Human
ugaaacauacaaaagcaccacc

SEQ ID NO: 173060 - RNA, 20 nt, Human
ugaccuagugcaauaucugg

SEQ ID NO: 173061 - RNA, 24 nt, Human
ugagacaugagaaucgcuugaacc

SEQ ID NO: 173062 - RNA, 19 nt, Human
ugagagaggaauccuggcc

SEQ ID NO: 173063 - RNA, 19 nt, Human
ugagccaagaucgugccac

SEQ ID NO: 173064 - RNA, 18 nt, Human
ugauacgccacauacuaa

SEQ ID NO: 173065 - RNA, 21 nt, Human
ugcagccauucagaaauccaa

SEQ ID NO: 173066 - RNA, 22 nt, Human
ugccauccgugauuuaauucca

SEQ ID NO: 173067 - RNA, 23 nt, Human
ugccuguaauccuagcaccuugg

SEQ ID NO: 173068 - RNA, 23 nt, Human
ugccuguaauccuagcaccuugg

SEQ ID NO: 173069 - RNA, 24 nt, Human
ugccuguaauccuagcaccuuggg

SEQ ID NO: 173070 - RNA, 24 nt, Human
ugcuccaaauaccagugcccauug

SEQ ID NO: 173071 - RNA, 24 nt, Human
uggaucacuugaggucaggaguuc

SEQ ID NO: 173072 - RNA, 27 nt, Human
uggaucacuugaggucaggaguucgag

SEQ ID NO: 173073 - RNA, 19 nt, Human
uggcucaugccuguaaucc

SEQ ID NO: 173074 - RNA, 24 nt, Human
uggcucaugccuguaauccuagca

SEQ ID NO: 173075 - RNA, 21 nt, Human
uggcuugcaccuguaugccag

SEQ ID NO: 173076 - RNA, 24 nt, Human
ugggaggccaaggcagguggauca

SEQ ID NO: 173077 - RNA, 24 nt, Human
ugggcaacauagugagacccuguc

SEQ ID NO: 173078 - RNA, 18 nt, Human
uggugcacgccgguaguc

SEQ ID NO: 173079 - RNA, 20 nt, Human
uguaaaagaggaccaccuga

SEQ ID NO: 173080 - RNA, 21 nt, Human
ugucauuuugcccaagauuuc

SEQ ID NO: 173081 - RNA, 24 nt, Human
uuagccuggcaugguggugcacgc

SEQ ID NO: 173082 - RNA, 24 nt, Human
uucaaauaguaguccuccucaauc

SEQ ID NO: 173083 - RNA, 21 nt, Human
uucaaguagagagaggaggac

SEQ ID NO: 173084 - RNA, 21 nt, Human
uucauuagcuuuucaaaaaca

SEQ ID NO: 173085 - RNA, 23 nt, Human
uugaaacauacaaaagcaccacc

SEQ ID NO: 173086 - RNA, 22 nt, Human
uugcagugagccaagaucgugc

SEQ ID NO: 173087 - RNA, 21 nt, Human
uuuuuugggggguaggugggu

SEQ ID NO: 173088 - RNA, 27 nt, Human
acccgcugccgcugcucuggggagccc

SEQ ID NO: 173089 - RNA, 24 nt, Human
acgaaugggcgcccuccuccuucc

SEQ ID NO: 173090 - RNA, 18 nt, Human
acgccuccucugggcugu

SEQ ID NO: 173091 - RNA, 19 nt, Human
acucagcuccugggcucag

SEQ ID NO: 173092 - RNA, 23 nt, Human
agauguugcuggugacaaggaau

SEQ ID NO: 173093 - RNA, 22 nt, Human
agauucucucacgugggugcuc

SEQ ID NO: 173094 - RNA, 18 nt, Human
agcagagaggcugccuac

SEQ ID NO: 173095 - RNA, 19 nt, Human
aggcagauucucucacgug

SEQ ID NO: 173096 - RNA, 19 nt, Human
aguagcagcagcgaggggc

SEQ ID NO: 173097 - RNA, 21 nt, Human
cagagaggcugccuacgggug

SEQ ID NO: 173098 - RNA, 23 nt, Human
cagagaggcugccuacggguggc

SEQ ID NO: 173099 - RNA, 19 nt, Human
cagagcccggggccaggaa

SEQ ID NO: 173100 - RNA, 19 nt, Human
cagagcccggggccaggaa

SEQ ID NO: 173101 - RNA, 22 nt, Human
caggggacauccagggggcucg

SEQ ID NO: 173102 - RNA, 22 nt, Human
caggguggccagagcccggggc

SEQ ID NO: 173103 - RNA, 23 nt, Human
ccagggggcucgagauguugcug

SEQ ID NO: 173104 - RNA, 23 nt, Human
cccacccuggccccacucaggag

SEQ ID NO: 173105 - RNA, 20 nt, Human
ccccuugucccucccuccca

SEQ ID NO: 173106 - RNA, 25 nt, Human
cccgcauccccaucgccggcccggc

SEQ ID NO: 173107 - RNA, 23 nt, Human
cccgcugccgcugcucugcaucc

SEQ ID NO: 173108 - RNA, 21 nt, Human
cccuccuccuuccuucuguug

SEQ ID NO: 173109 - RNA, 20 nt, Human
ccgaaguuacgaccguuucc

SEQ ID NO: 173110 - RNA, 19 nt, Human
ccgcauccccaucgccggc

SEQ ID NO: 173111 - RNA, 19 nt, Human
ccggcagcguggccacgcc

SEQ ID NO: 173112 - RNA, 25 nt, Human
ccggcagcguggccacgccuccucu

SEQ ID NO: 173113 - RNA, 21 nt, Human
ccggcccgccggcugccuggc

SEQ ID NO: 173114 - RNA, 21 nt, Human
ccuccgcgcucgcagccccga

SEQ ID NO: 173115 - RNA, 25 nt, Human
ccucgugcgggcggggcggggcgag

SEQ ID NO: 173116 - RNA, 19 nt, Human
ccuuccuucuguugggcug

SEQ ID NO: 173117 - RNA, 21 nt, Human
ccuuccuucuguugggcugga

SEQ ID NO: 173118 - RNA, 22 nt, Human
ccuuccuucuguugggcuggag

SEQ ID NO: 173119 - RNA, 21 nt, Human
cgacucggggucgggcggcgg

SEQ ID NO: 173120 - RNA, 21 nt, Human
cgcguagugcucccgcauccc

SEQ ID NO: 173121 - RNA, 20 nt, Human
cgcuggaggccggcccgccg

SEQ ID NO: 173122 - RNA, 22 nt, Human
cgcuucgucgucgucgcccucc

SEQ ID NO: 173123 - RNA, 20 nt, Human
cggcgggaaggaggguggcc

SEQ ID NO: 173124 - RNA, 19 nt, Human
cggcugccugccauacccg

SEQ ID NO: 173125 - RNA, 21 nt, Human
cggcugccugccauacccgcu

SEQ ID NO: 173126 - RNA, 18 nt, Human
cgggaaggaggguggccg

SEQ ID NO: 173127 - RNA, 23 nt, Human
cgggaaggaggguggccguggcg

SEQ ID NO: 173128 - RNA, 21 nt, Human
cggggcggggccucggccacc

SEQ ID NO: 173129 - RNA, 18 nt, Human
cgugcgggcggggcgggg

SEQ ID NO: 173130 - RNA, 18 nt, Human
cucccucccacccuggcc

SEQ ID NO: 173131 - RNA, 21 nt, Human
cucgcggagggcuccacuucc

SEQ ID NO: 173132 - RNA, 19 nt, Human
cuuccuucuguugggcugg

SEQ ID NO: 173133 - RNA, 21 nt, Human
gagguugggaggggucccagc

SEQ ID NO: 173134 - RNA, 20 nt, Human
gcccuccgcgcucgcagccc

SEQ ID NO: 173135 - RNA, 19 nt, Human
gccuacggguggcacgggg

SEQ ID NO: 173136 - RNA, 27 nt, Human
gccucgcgcgcucgcggagggcuccac

SEQ ID NO: 173137 - RNA, 18 nt, Human
gccugggcugagcggacc

SEQ ID NO: 173138 - RNA, 25 nt, Human
gccugggcugagcggaccggggguc

SEQ ID NO: 173139 - RNA, 18 nt, Human
gcgcccuccuccuuccuu

SEQ ID NO: 173140 - RNA, 19 nt, Human
gcgcgcgcaucccaggcca

SEQ ID NO: 173141 - RNA, 20 nt, Human
gcucgccccuuuccuccccc

SEQ ID NO: 173142 - RNA, 21 nt, Human
ggaguccucccgacucggggu

SEQ ID NO: 173143 - RNA, 18 nt, Human
ggcaccugcgcuggaggc

SEQ ID NO: 173144 - RNA, 19 nt, Human
ggcgggggcgggcgccugg

SEQ ID NO: 173145 - RNA, 19 nt, Human
gggaaggaggguggccgug

SEQ ID NO: 173146 - RNA, 20 nt, Human
gggaaggaggguggccgugg

SEQ ID NO: 173147 - RNA, 20 nt, Human
gggacaggggacauccaggg

SEQ ID NO: 173148 - RNA, 23 nt, Human
gggacaggggacauccagggaag

SEQ ID NO: 173149 - RNA, 23 nt, Human
gggacaggggacauccagggggc

SEQ ID NO: 173150 - RNA, 26 nt, Human
gggacaggggacauccagggggcucc

SEQ ID NO: 173151 - RNA, 20 nt, Human
gggcaaggccacaggcagau

SEQ ID NO: 173152 - RNA, 20 nt, Human
gggcggcgggaaggagggug

SEQ ID NO: 173153 - RNA, 20 nt, Human
gggcggggcggggcgagggc

SEQ ID NO: 173154 - RNA, 23 nt, Human
gggcgggggcgggcgccugggcu

SEQ ID NO: 173155 - RNA, 21 nt, Human
gggcucggguaguagcagcag

SEQ ID NO: 173156 - RNA, 22 nt, Human
ggguggaggugggugcccaggg

SEQ ID NO: 173157 - RNA, 21 nt, Human
gguggaggugggugcccaggg

SEQ ID NO: 173158 - RNA, 19 nt, Human
gguggccagagcccggggc

SEQ ID NO: 173159 - RNA, 23 nt, Human
guaguagcagcagcgaggggcgg

SEQ ID NO: 173160 - RNA, 19 nt, Human
uagcagcagcgaggggcgg

SEQ ID NO: 173161 - RNA, 21 nt, Human
ucaauggucccggaguccucc

SEQ ID NO: 173162 - RNA, 21 nt, Human
ucacgugggugcucgccccuu

SEQ ID NO: 173163 - RNA, 22 nt, Human
ucccccuugucccucccuccca

SEQ ID NO: 173164 - RNA, 20 nt, Human
ucccgcauccccaucgccgg

SEQ ID NO: 173165 - RNA, 20 nt, Human
ucccggaguccucccgacuc

SEQ ID NO: 173166 - RNA, 20 nt, Human
ucccggaguccucccgacuc

SEQ ID NO: 173167 - RNA, 24 nt, Human
ucgccccuuuccucccccuugucc

SEQ ID NO: 173168 - RNA, 18 nt, Human
ucgcccuccgcgcucgca

SEQ ID NO: 173169 - RNA, 23 nt, Human
ucgcggagggcuccacuuccgcc

SEQ ID NO: 173170 - RNA, 19 nt, Human
ucucgggcaccugcgcugg

SEQ ID NO: 173171 - RNA, 22 nt, Human
ucuuauagcagagaggcugccu

SEQ ID NO: 173172 - RNA, 19 nt, Human
ugacaaggaaugucaagug

SEQ ID NO: 173173 - RNA, 21 nt, Human
ugaggcuggcgggcaaggcca

SEQ ID NO: 173174 - RNA, 18 nt, Human
ugcagcuccgcguagugc

SEQ ID NO: 173175 - RNA, 21 nt, Human
ugccccggcggccucgcgcgc

SEQ ID NO: 173176 - RNA, 19 nt, Human
ugccuacggguggcacggg

SEQ ID NO: 173177 - RNA, 18 nt, Human
ugcggggcggggccucgg

SEQ ID NO: 173178 - RNA, 22 nt, Human
uggcagggcauugagguuggga

SEQ ID NO: 173179 - RNA, 27 nt, Human
uggcggggguggaggugggucgacucc

SEQ ID NO: 173180 - RNA, 21 nt, Human
uggcggggguggaggugggug

SEQ ID NO: 173181 - RNA, 18 nt, Human
uguugggcuggagugagu

SEQ ID NO: 173182 - RNA, 18 nt, Human
uuuuuuuuuuuuuuuuug

SEQ ID NO: 173183 - RNA, 21 nt, Human
uuuuuuuuuuuuuuuuuggcu

SEQ ID NO: 173184 - RNA, 22 nt, Human
uuuuuuuuuuuuuuuuuuuggc

SEQ ID NO: 173185 - RNA, 21 nt, Human
aaaagaagaaggguacaggag

SEQ ID NO: 173186 - RNA, 22 nt, Human
aagaggcggcgggcucguggca

SEQ ID NO: 173187 - RNA, 22 nt, Human
accacaguuccugcuugccgcu

SEQ ID NO: 173188 - RNA, 21 nt, Human
acccagccucccaggcucccu

SEQ ID NO: 173189 - RNA, 22 nt, Human
accugcucagccccgugggucc

SEQ ID NO: 173190 - RNA, 21 nt, Human
agaaguuuccuguuugucuga

SEQ ID NO: 173191 - RNA, 19 nt, Human
agagcaggcccuaccagcc

SEQ ID NO: 173192 - RNA, 20 nt, Human
agccucugaccacaguuccu

SEQ ID NO: 173193 - RNA, 21 nt, Human
agcucgugggcgggaaggugc

SEQ ID NO: 173194 - RNA, 24 nt, Human
aggaaaagaagaaggguacaggag

SEQ ID NO: 173195 - RNA, 30 nt, Human
aggcggcgggcggcgaagaggcggcgggcu

SEQ ID NO: 173196 - RNA, 22 nt, Human
agggauagccucacuucaggug

SEQ ID NO: 173197 - RNA, 22 nt, Human
agggcuagccaggcaggccccu

SEQ ID NO: 173198 - RNA, 24 nt, Human
auagagcauaggaucagggagcug

SEQ ID NO: 173199 - RNA, 19 nt, Human
caagggucauuagugcccu

SEQ ID NO: 173200 - RNA, 21 nt, Human
cacccgggugacagaaaaggc

SEQ ID NO: 173201 - RNA, 20 nt, Human
cagggccccggcaacaugcc

SEQ ID NO: 173202 - RNA, 18 nt, Human
caggggccgcaagcagag

SEQ ID NO: 173203 - RNA, 21 nt, Human
ccagccaagacgcacagccuc

SEQ ID NO: 173204 - RNA, 21 nt, Human
cccuuuauagccgccuucugg

SEQ ID NO: 173205 - RNA, 19 nt, Human
ccgcccagggccccggcaa

SEQ ID NO: 173206 - RNA, 20 nt, Human
ccgccuucuggacaaucauu

SEQ ID NO: 173207 - RNA, 18 nt, Human
ccuaggaaaagaagaagg

SEQ ID NO: 173208 - RNA, 21 nt, Human
ccuccacccagccucccaggc

SEQ ID NO: 173209 - RNA, 19 nt, Human
ccugugggacguuggcagg

SEQ ID NO: 173210 - RNA, 20 nt, Human
cgcacgcggagcgggcgacc

SEQ ID NO: 173211 - RNA, 20 nt, Human
cggaggccccgcgcuucugg

SEQ ID NO: 173212 - RNA, 19 nt, Human
cggcaacaugccccggcuu

SEQ ID NO: 173213 - RNA, 21 nt, Human
cuaccagccaagacgcacagc

SEQ ID NO: 173214 - RNA, 21 nt, Human
cuccacccagccucccaggcu

SEQ ID NO: 173215 - RNA, 24 nt, Human
cuccacccagccucccaggcuccc

SEQ ID NO: 173216 - RNA, 21 nt, Human
cucccaggcucccuuuauagc

SEQ ID NO: 173217 - RNA, 19 nt, Human
cucccuccuccacccagcc

SEQ ID NO: 173218 - RNA, 18 nt, Human
cuccuccacccagccucc

SEQ ID NO: 173219 - RNA, 21 nt, Human
cugcucccuccuccacccagc

SEQ ID NO: 173220 - RNA, 19 nt, Human
cuggcagccagaggcucag

SEQ ID NO: 173221 - RNA, 23 nt, Human
cuggcagccagaggcucagccug

SEQ ID NO: 173222 - RNA, 21 nt, Human
cugguaggggagggccaggcg

SEQ ID NO: 173223 - RNA, 23 nt, Human
cuuaggacccagcagaagucaag

SEQ ID NO: 173224 - RNA, 22 nt, Human
gacagggccuaggaaaagaaga

SEQ ID NO: 173225 - RNA, 21 nt, Human
gaggagaggcggcgggcggcg

SEQ ID NO: 173226 - RNA, 22 nt, Human
gcagagcgugcagggggaaggc

SEQ ID NO: 173227 - RNA, 18 nt, Human
gcagccagaggcucagcc

SEQ ID NO: 173228 - RNA, 23 nt, Human
gcaggaaauaggagcuaacggag

SEQ ID NO: 173229 - RNA, 27 nt, Human
gcggcgggcggcgaagaggcggcgggc

SEQ ID NO: 173230 - RNA, 18 nt, Human
ggagaggaggagaggcgg

SEQ ID NO: 173231 - RNA, 23 nt, Human
ggcgggcggcgaagaggcggcgg

SEQ ID NO: 173232 - RNA, 20 nt, Human
gggaaccacgggggccgggg

SEQ ID NO: 173233 - RNA, 18 nt, Human
gggccaggcggcgggcgg

SEQ ID NO: 173234 - RNA, 18 nt, Human
gggccgggggugcaggag

SEQ ID NO: 173235 - RNA, 21 nt, Human
gggcgggagaggaggagaggc

SEQ ID NO: 173236 - RNA, 24 nt, Human
ggggaugggguaggaugcgggcag

SEQ ID NO: 173237 - RNA, 18 nt, Human
gggggccgggggugcagg

SEQ ID NO: 173238 - RNA, 22 nt, Human
ggugacagaaaaggcgcagaaa

SEQ ID NO: 173239 - RNA, 19 nt, Human
gugcagggggaaggccacc

SEQ ID NO: 173240 - RNA, 23 nt, Human
guguccugugggacguuggcagg

SEQ ID NO: 173241 - RNA, 25 nt, Human
guuuuuucugcucccuccuccaccc

SEQ ID NO: 173242 - RNA, 19 nt, Human
uagaaaagagcaggcccua

SEQ ID NO: 173243 - RNA, 19 nt, Human
uagagcauaggaucaggga

SEQ ID NO: 173244 - RNA, 21 nt, Human
uagccacugauaacuuccagc

SEQ ID NO: 173245 - RNA, 24 nt, Human
uagccacugauaacuuccagcgcc

SEQ ID NO: 173246 - RNA, 23 nt, Human
uaggacccagcagaagucaaggg

SEQ ID NO: 173247 - RNA, 23 nt, Human
uaggaucagggagcugggaccuc

SEQ ID NO: 173248 - RNA, 23 nt, Human
uauaacaagucaccuuuucuucc

SEQ ID NO: 173249 - RNA, 25 nt, Human
uauaacaagucaccuuuucuuccca

SEQ ID NO: 173250 - RNA, 19 nt, Human
ucaagggucauuagugccc

SEQ ID NO: 173251 - RNA, 21 nt, Human
ucagguggggaugggguagga

SEQ ID NO: 173252 - RNA, 20 nt, Human
uccacccagccucccaggcu

SEQ ID NO: 173253 - RNA, 22 nt, Human
ucccuggagucugagguauugg

SEQ ID NO: 173254 - RNA, 26 nt, Human
ucccuuuauagccgccuucuggacaa

SEQ ID NO: 173255 - RNA, 23 nt, Human
uccuccacccagccucccaggcu

SEQ ID NO: 173256 - RNA, 21 nt, Human
ucucacaguucccagaucugc

SEQ ID NO: 173257 - RNA, 18 nt, Human
ucugcucccuccuccacc

SEQ ID NO: 173258 - RNA, 24 nt, Human
ugacagaaaaggcgcagaaauggg

SEQ ID NO: 173259 - RNA, 21 nt, Human
ugagaaugauggccuccucuc

SEQ ID NO: 173260 - RNA, 22 nt, Human
ugagaaugauggccuccucucu

SEQ ID NO: 173261 - RNA, 23 nt, Human
ugcagggggaaggccaccguggg

SEQ ID NO: 173262 - RNA, 18 nt, Human
ugcggagaccacaggacu

SEQ ID NO: 173263 - RNA, 19 nt, Human
ugcggagaccacaggacug

SEQ ID NO: 173264 - RNA, 18 nt, Human
uggcaccugcucagcccc

SEQ ID NO: 173265 - RNA, 20 nt, Human
uggcagccagaggcucagcc

SEQ ID NO: 173266 - RNA, 18 nt, Human
ugggaaccacgggggccg

SEQ ID NO: 173267 - RNA, 24 nt, Human
ugggaccucacuagccacugauaa

SEQ ID NO: 173268 - RNA, 20 nt, Human
uggguccucacgcuacccag

SEQ ID NO: 173269 - RNA, 20 nt, Human
uggucagggacagcgccucc

SEQ ID NO: 173270 - RNA, 21 nt, Human
uguccugugggacguuggcag

SEQ ID NO: 173271 - RNA, 25 nt, Human
uguccugugggacguuggcaggggc

SEQ ID NO: 173272 - RNA, 22 nt, Human
uucagguggggaugggguagga

SEQ ID NO: 173273 - RNA, 23 nt, Human
uucccuggagucugagguauugg

SEQ ID NO: 173274 - RNA, 22 nt, Human
uuccuguuugucugaaggcagg

SEQ ID NO: 173275 - RNA, 23 nt, Human
uuuuucugcucccuccuccaccc

SEQ ID NO: 173276 - RNA, 22 nt, Human
uuuuuuuuuuuuuuuuuuucag

SEQ ID NO: 173277 - RNA, 26 nt, Human
aaagcuggcuccaggguuaggggcac

SEQ ID NO: 173278 - RNA, 18 nt, Human
accugggugaagagcugg

SEQ ID NO: 173279 - RNA, 24 nt, Human
agaaugugggcccggugggugggg

SEQ ID NO: 173280 - RNA, 20 nt, Human
agagcugggaugguuuugag

SEQ ID NO: 173281 - RNA, 27 nt, Human
agaggaagaggagaccugggugaagag

SEQ ID NO: 173282 - RNA, 19 nt, Human
agggaaugggguauuuuga

SEQ ID NO: 173283 - RNA, 21 nt, Human
augaaggagaacccggguggc

SEQ ID NO: 173284 - RNA, 18 nt, Human
caagccuccggcucugca

SEQ ID NO: 173285 - RNA, 18 nt, Human
cagaguaucucucucaug

SEQ ID NO: 173286 - RNA, 23 nt, Human
caugcuuuuucuugagcaggggc

SEQ ID NO: 173287 - RNA, 21 nt, Human
ccauguauauagccauuccca

SEQ ID NO: 173288 - RNA, 24 nt, Human
cucaggacaggggcuaggugagga

SEQ ID NO: 173289 - RNA, 20 nt, Human
cugaagcaguguagcucucc

SEQ ID NO: 173290 - RNA, 22 nt, Human
cugcagguguccucugaggccc

SEQ ID NO: 173291 - RNA, 21 nt, Human
cuguggcugggaaggaggggc

SEQ ID NO: 173292 - RNA, 24 nt, Human
gagacaaggugcgggggaguucug

SEQ ID NO: 173293 - RNA, 18 nt, Human
gcaagccuccggcucugc

SEQ ID NO: 173294 - RNA, 19 nt, Human
gccagcucaugcuuuuucu

SEQ ID NO: 173295 - RNA, 19 nt, Human
gcccgguggguggggcugg

SEQ ID NO: 173296 - RNA, 20 nt, Human
gcuccaggguuaggggcacc

SEQ ID NO: 173297 - RNA, 18 nt, Human
ggaccuggaagacggaga

SEQ ID NO: 173298 - RNA, 19 nt, Human
ggcccgguggguggggcug

SEQ ID NO: 173299 - RNA, 18 nt, Human
gggaguagauuucuccag

SEQ ID NO: 173300 - RNA, 20 nt, Human
gggcaggagaaggggccugg

SEQ ID NO: 173301 - RNA, 18 nt, Human
gggcuggggcaggagaag

SEQ ID NO: 173302 - RNA, 18 nt, Human
gggcuggggcaggagaag

SEQ ID NO: 173303 - RNA, 22 nt, Human
gggcuggggcuggggcaggaga

SEQ ID NO: 173304 - RNA, 18 nt, Human
ggggaugaaggagaaccc

SEQ ID NO: 173305 - RNA, 20 nt, Human
ggggcuggggcaggagaagg

SEQ ID NO: 173306 - RNA, 21 nt, Human
ggguggggcuggggcuggggc

SEQ ID NO: 173307 - RNA, 18 nt, Human
guggggcuggggcugggg

SEQ ID NO: 173308 - RNA, 20 nt, Human
uagccauucccacuucccaa

SEQ ID NO: 173309 - RNA, 23 nt, Human
uagcuguggcugggaaggagggg

SEQ ID NO: 173310 - RNA, 22 nt, Human
ucaccaaaugacugcuuggucc

SEQ ID NO: 173311 - RNA, 23 nt, Human
ucaccaaaugacugcuugguccc

SEQ ID NO: 173312 - RNA, 24 nt, Human
uccaccagaguaucucucucauga

SEQ ID NO: 173313 - RNA, 20 nt, Human
ucucucucaugaugguuucu

SEQ ID NO: 173314 - RNA, 19 nt, Human
ucugcaggugcgcccggga

SEQ ID NO: 173315 - RNA, 21 nt, Human
ugagggaaugggguauuuuga

SEQ ID NO: 173316 - RNA, 21 nt, Human
uggggcaggagaaggggccug

SEQ ID NO: 173317 - RNA, 23 nt, Human
uggggcuggggcaggagaagggg

SEQ ID NO: 173318 - RNA, 24 nt, Human
uguggauauguacaugugcauggu

SEQ ID NO: 173319 - RNA, 20 nt, Human
uguggcugggaaggaggggc

SEQ ID NO: 173320 - RNA, 21 nt, Human
uuauuugaacacaaaauacuu

SEQ ID NO: 173321 - RNA, 21 nt, Human
uucccacuucccauauucugu

SEQ ID NO: 173322 - RNA, 23 nt, Human
aacccccaggcccgcacacagcu

SEQ ID NO: 173323 - RNA, 21 nt, Human
aaccucagcuuucccaacuga

SEQ ID NO: 173324 - RNA, 23 nt, Human
acagagcagcccuccaggccccg

SEQ ID NO: 173325 - RNA, 23 nt, Human
acccgcggccccggcgacaaccu

SEQ ID NO: 173326 - RNA, 22 nt, Human
agccccggcccggcucaccucc

SEQ ID NO: 173327 - RNA, 23 nt, Human
agcccucugggcagccgggaagc

SEQ ID NO: 173328 - RNA, 22 nt, Human
agcucuccuagacacguugggg

SEQ ID NO: 173329 - RNA, 21 nt, Human
aggccggcgcgggcagccgac

SEQ ID NO: 173330 - RNA, 19 nt, Human
agugcccagcuccagguga

SEQ ID NO: 173331 - RNA, 23 nt, Human
caacccccaggcccgcacacagc

SEQ ID NO: 173332 - RNA, 18 nt, Human
caacgggcggacgaggag

SEQ ID NO: 173333 - RNA, 22 nt, Human
cacaggcucugcuucccugggg

SEQ ID NO: 173334 - RNA, 24 nt, Human
cacccccuucuccggugcugggaa

SEQ ID NO: 173335 - RNA, 24 nt, Human
caggcccagagccucccucgcuga

SEQ ID NO: 173336 - RNA, 28 nt, Human
caggugacacaugcaacccccugaaagg

SEQ ID NO: 173337 - RNA, 22 nt, Human
caggugcauaccccacaccucc

SEQ ID NO: 173338 - RNA, 25 nt, Human
cauccccgaccuccacccgcggccc

SEQ ID NO: 173339 - RNA, 21 nt, Human
caugcaacccccaggcccgca

SEQ ID NO: 173340 - RNA, 19 nt, Human
ccacaccuccaccugagca

SEQ ID NO: 173341 - RNA, 26 nt, Human
ccagagccucccucgcugaacaacgg

SEQ ID NO: 173342 - RNA, 19 nt, Human
cccacaccuccaccugagc

SEQ ID NO: 173343 - RNA, 21 nt, Human
ccccacaccuccaccugagca

SEQ ID NO: 173344 - RNA, 22 nt, Human
ccccacaccuccaccugagcac

SEQ ID NO: 173345 - RNA, 23 nt, Human
ccccaccgacccggcccgcgcuc

SEQ ID NO: 173346 - RNA, 19 nt, Human
cccccaggcccgcacacag

SEQ ID NO: 173347 - RNA, 22 nt, Human
ccccgcagccccggcccggcuc

SEQ ID NO: 173348 - RNA, 25 nt, Human
cccgaccuccacccgcggccccggc

SEQ ID NO: 173349 - RNA, 25 nt, Human
cccgcacacagcugcugcccgcaca

SEQ ID NO: 173350 - RNA, 22 nt, Human
cccgcuccgugccucaguuucc

SEQ ID NO: 173351 - RNA, 24 nt, Human
ccgcagccccggcccggcucaccu

SEQ ID NO: 173352 - RNA, 25 nt, Human
ccgcggccccggcgacaaccucagc

SEQ ID NO: 173353 - RNA, 24 nt, Human
ccggcaacaggugaggagggcaaa

SEQ ID NO: 173354 - RNA, 18 nt, Human
ccggcccggcucaccucc

SEQ ID NO: 173355 - RNA, 24 nt, Human
ccuaccugcugccucauccccgac

SEQ ID NO: 173356 - RNA, 22 nt, Human
ccucagcuuucccaacugagag

SEQ ID NO: 173357 - RNA, 25 nt, Human
cgacaaccucagcuuucccaacuga

SEQ ID NO: 173358 - RNA, 20 nt, Human
cgaccuccacccgcggcccc

SEQ ID NO: 173359 - RNA, 24 nt, Human
cgcgcacgcgcgcccuggccgccc

SEQ ID NO: 173360 - RNA, 22 nt, Human
cggcgacaaccucagcuuuccc

SEQ ID NO: 173361 - RNA, 22 nt, Human
cucagggaagccccgcagcccc

SEQ ID NO: 173362 - RNA, 24 nt, Human
cuccacccgcggccccggcgacaa

SEQ ID NO: 173363 - RNA, 21 nt, Human
cuccaccugagcacccccuuc

SEQ ID NO: 173364 - RNA, 24 nt, Human
cuccggggucgugcccgggggcgc

SEQ ID NO: 173365 - RNA, 18 nt, Human
cugaacaacgggcggacg

SEQ ID NO: 173366 - RNA, 18 nt, Human
cugagcacccccuucucc

SEQ ID NO: 173367 - RNA, 19 nt, Human
cugugaauuuuccugaguu

SEQ ID NO: 173368 - RNA, 24 nt, Human
gacaaccucagcuuucccaacuga

SEQ ID NO: 173369 - RNA, 28 nt, Human
gcagccccggcccggcucaccuccgcgc

SEQ ID NO: 173370 - RNA, 18 nt, Human
gcccagagccucccucgc

SEQ ID NO: 173371 - RNA, 23 nt, Human
gcccgggggcgcgcagaggcggg

SEQ ID NO: 173372 - RNA, 19 nt, Human
gccggcaacaggugaggag

SEQ ID NO: 173373 - RNA, 20 nt, Human
gccucauccccgaccuccac

SEQ ID NO: 173374 - RNA, 20 nt, Human
ggaccggcaggcauccagcc

SEQ ID NO: 173375 - RNA, 20 nt, Human
ggcccagagccucccucgcu

SEQ ID NO: 173376 - RNA, 23 nt, Human
gggaacagauggagggggguggc

SEQ ID NO: 173377 - RNA, 21 nt, Human
ggggaccggcaggcauccagc

SEQ ID NO: 173378 - RNA, 23 nt, Human
gugccucaguuuccccgucagcu

SEQ ID NO: 173379 - RNA, 22 nt, Human
guuggagauggccuggacagcu

SEQ ID NO: 173380 - RNA, 22 nt, Human
uaacacagagcagcccuccagg

SEQ ID NO: 173381 - RNA, 24 nt, Human
uaccccacaccuccaccugagcac

SEQ ID NO: 173382 - RNA, 22 nt, Human
ucaccuccgcgcacgcgcgccc

SEQ ID NO: 173383 - RNA, 21 nt, Human
ucacuguccuaccugcugccu

SEQ ID NO: 173384 - RNA, 21 nt, Human
ucccucgcugaacaacgggcu

SEQ ID NO: 173385 - RNA, 18 nt, Human
ucccuggggaaccagccu

SEQ ID NO: 173386 - RNA, 23 nt, Human
ucccuggggaaccagccucccuc

SEQ ID NO: 173387 - RNA, 23 nt, Human
uccgcgcacgcgcgcccuggccg

SEQ ID NO: 173388 - RNA, 22 nt, Human
uccugaguucccaggcuugcuc

SEQ ID NO: 173389 - RNA, 18 nt, Human
ucuggagagacuaacaca

SEQ ID NO: 173390 - RNA, 22 nt, Human
ugcaacccccaggcccgcacac

SEQ ID NO: 173391 - RNA, 22 nt, Human
ugcauaccccacaccuccaccu

SEQ ID NO: 173392 - RNA, 23 nt, Human
uggagggggguggcuaauacuac

SEQ ID NO: 173393 - RNA, 21 nt, Human
uggcuaauacuacccgcaugc

SEQ ID NO: 173394 - RNA, 18 nt, Human
ugggaacagauggagggg

SEQ ID NO: 173395 - RNA, 21 nt, Human
uuccaaaugccccuuuuauua

SEQ ID NO: 173396 - RNA, 21 nt, Human
uucccaggcuugcucggggac

SEQ ID NO: 173397 - RNA, 18 nt, Human
uugcucggggaccggcag

SEQ ID NO: 173398 - RNA, 19 nt, Human
uuuagaaucucccaagucc

SEQ ID NO: 173399 - RNA, 28 nt, Human
uuuagaaucucccaaguccugugaauuu

SEQ ID NO: 173400 - RNA, 18 nt, Human
uuuccugaguucccaggc

SEQ ID NO: 173401 - RNA, 22 nt, Human
aaacaggaaugaaaaaggggac

SEQ ID NO: 173402 - RNA, 20 nt, Human
aaaccagcguuucuuccagg

SEQ ID NO: 173403 - RNA, 21 nt, Human
aaaggccuuuuuuucccaaga

SEQ ID NO: 173404 - RNA, 25 nt, Human
aacaaauacacaacacaugccacca

SEQ ID NO: 173405 - RNA, 24 nt, Human
aacacacuccugucccacccaccg

SEQ ID NO: 173406 - RNA, 21 nt, Human
aacaugcucacauguuuaugg

SEQ ID NO: 173407 - RNA, 22 nt, Human
aacaugcucacauguuuauggg

SEQ ID NO: 173408 - RNA, 23 nt, Human
aacaugcucacauguuuauggga

SEQ ID NO: 173409 - RNA, 22 nt, Human
aaccacuaaagucaagcuagga

SEQ ID NO: 173410 - RNA, 18 nt, Human
aagaaguuacagaggagg

SEQ ID NO: 173411 - RNA, 22 nt, Human
aagacacaaguagccaacaaau

SEQ ID NO: 173412 - RNA, 20 nt, Human
aagcuaggaggggacugggg

SEQ ID NO: 173413 - RNA, 19 nt, Human
aaguacuuccucugcccuc

SEQ ID NO: 173414 - RNA, 24 nt, Human
aauccaccuucccugaucccccac

SEQ ID NO: 173415 - RNA, 26 nt, Human
acaccacacucccucccauauucccc

SEQ ID NO: 173416 - RNA, 25 nt, Human
acagaauaaauuaauaacuuaagug

SEQ ID NO: 173417 - RNA, 21 nt, Human
acagcccaugggcacaagcug

SEQ ID NO: 173418 - RNA, 19 nt, Human
acaugacagccuggaucuc

SEQ ID NO: 173419 - RNA, 18 nt, Human
accaaaggucuaauuccc

SEQ ID NO: 173420 - RNA, 22 nt, Human
accacagcaaaaacaugaccca

SEQ ID NO: 173421 - RNA, 22 nt, Human
accccaaucccccagaaagaag

SEQ ID NO: 173422 - RNA, 22 nt, Human
accccagaaacuggagacagca

SEQ ID NO: 173423 - RNA, 25 nt, Human
accccauuguggucccagguccuaa

SEQ ID NO: 173424 - RNA, 19 nt, Human
acucccucccauauucccc

SEQ ID NO: 173425 - RNA, 21 nt, Human
acucccucccauauuccccac

SEQ ID NO: 173426 - RNA, 19 nt, Human
agaaaaacaggaaugaaaa

SEQ ID NO: 173427 - RNA, 20 nt, Human
agaaacuggagacagcagcc

SEQ ID NO: 173428 - RNA, 23 nt, Human
agaauaaauuaauaacuuaagug

SEQ ID NO: 173429 - RNA, 22 nt, Human
agacaggcagaucaaggacuua

SEQ ID NO: 173430 - RNA, 22 nt, Human
agagaggagguggaugggagga

SEQ ID NO: 173431 - RNA, 18 nt, Human
agaggggagaggggagau

SEQ ID NO: 173432 - RNA, 24 nt, Human
agaggggagaggggagaugggaag

SEQ ID NO: 173433 - RNA, 26 nt, Human
agaggggagaggggagaugggaaggg

SEQ ID NO: 173434 - RNA, 20 nt, Human
agaggggagaugggaagggc

SEQ ID NO: 173435 - RNA, 20 nt, Human
agagguggacuuugacccau

SEQ ID NO: 173436 - RNA, 23 nt, Human
agaguagagaggagguggauggg

SEQ ID NO: 173437 - RNA, 22 nt, Human
agagugaaccagcacccugcca

SEQ ID NO: 173438 - RNA, 21 nt, Human
agaucaaggacuuaaggagac

SEQ ID NO: 173439 - RNA, 24 nt, Human
agcccuucccuccaaacaucuggu

SEQ ID NO: 173440 - RNA, 21 nt, Human
agcuaccaccacugcuuccau

SEQ ID NO: 173441 - RNA, 22 nt, Human
aggaaacacugggccggcacca

SEQ ID NO: 173442 - RNA, 22 nt, Human
aggagguggaugggaggaagaa

SEQ ID NO: 173443 - RNA, 19 nt, Human
aggcacucccuuuuccuag

SEQ ID NO: 173444 - RNA, 24 nt, Human
aggcccagauggggaaggaagaac

SEQ ID NO: 173445 - RNA, 21 nt, Human
aggcuccuuggagagccccag

SEQ ID NO: 173446 - RNA, 19 nt, Human
agguccacucacaucaugg

SEQ ID NO: 173447 - RNA, 22 nt, Human
agguggggcuggcgggggccuc

SEQ ID NO: 173448 - RNA, 20 nt, Human
auacgccacagcccaugggc

SEQ ID NO: 173449 - RNA, 24 nt, Human
augcugccuccugggcucugcggu

SEQ ID NO: 173450 - RNA, 20 nt, Human
augcuuuuuggaaguagcuc

SEQ ID NO: 173451 - RNA, 23 nt, Human
auggggcauacuuuguuaacuuc

SEQ ID NO: 173452 - RNA, 19 nt, Human
augguaacaagacaagaac

SEQ ID NO: 173453 - RNA, 19 nt, Human
augugucaccacagcaaaa

SEQ ID NO: 173454 - RNA, 21 nt, Human
caaaaggucaauuucaccucu

SEQ ID NO: 173455 - RNA, 18 nt, Human
caaaggccuuuuuuuccc

SEQ ID NO: 173456 - RNA, 26 nt, Human
caacaaauacacaacacaugccacca

SEQ ID NO: 173457 - RNA, 19 nt, Human
caagacaagaacucaagac

SEQ ID NO: 173458 - RNA, 21 nt, Human
caagacacaaguagccaacaa

SEQ ID NO: 173459 - RNA, 21 nt, Human
caagacacaaguagccaacag

SEQ ID NO: 173460 - RNA, 26 nt, Human
caagauggcuccuggaaugcuaggga

SEQ ID NO: 173461 - RNA, 18 nt, Human
caagcuaggaggggacug

SEQ ID NO: 173462 - RNA, 19 nt, Human
caaggacuuaaggagacac

SEQ ID NO: 173463 - RNA, 18 nt, Human
caagguggggcuggcggg

SEQ ID NO: 173464 - RNA, 18 nt, Human
cacacuccugucccaccc

SEQ ID NO: 173465 - RNA, 20 nt, Human
cacagcaaaaacaugaccca

SEQ ID NO: 173466 - RNA, 20 nt, Human
caccacagcaaaaacaugac

SEQ ID NO: 173467 - RNA, 20 nt, Human
caccacccgagcuccaagcc

SEQ ID NO: 173468 - RNA, 24 nt, Human
caccauaaaucacaugacagccug

SEQ ID NO: 173469 - RNA, 24 nt, Human
caccaugcacaccacucuugcacg

SEQ ID NO: 173470 - RNA, 19 nt, Human
caccccaaucccccagaaa

SEQ ID NO: 173471 - RNA, 21 nt, Human
caccccaaucccccagaaaga

SEQ ID NO: 173472 - RNA, 20 nt, Human
cacccugcacccccaaggau

SEQ ID NO: 173473 - RNA, 19 nt, Human
cacccugccaacucugccc

SEQ ID NO: 173474 - RNA, 18 nt, Human
cacucagaacaugcucac

SEQ ID NO: 173475 - RNA, 25 nt, Human
cacucccucccauauuccccacccc

SEQ ID NO: 173476 - RNA, 21 nt, Human
cacuccgcaggauaaaccagc

SEQ ID NO: 173477 - RNA, 18 nt, Human
cacugcacugcucacugc

SEQ ID NO: 173478 - RNA, 21 nt, Human
cagaaagacgaccccccacgg

SEQ ID NO: 173479 - RNA, 22 nt, Human
cagaacaugcucacauguuuau

SEQ ID NO: 173480 - RNA, 20 nt, Human
cagaggagggagucuccccu

SEQ ID NO: 173481 - RNA, 23 nt, Human
cagcgcagcuaauccaaccuccc

SEQ ID NO: 173482 - RNA, 22 nt, Human
cauacgccacagcccaugggcu

SEQ ID NO: 173483 - RNA, 23 nt, Human
cauccccuucuaaggccuaccuc

SEQ ID NO: 173484 - RNA, 21 nt, Human
caugccaccauaaaucacaug

SEQ ID NO: 173485 - RNA, 20 nt, Human
caugugucaccacagcaaaa

SEQ ID NO: 173486 - RNA, 22 nt, Human
ccaaaggucuaauucccucacu

SEQ ID NO: 173487 - RNA, 21 nt, Human
ccaaccucccauuccacagac

SEQ ID NO: 173488 - RNA, 19 nt, Human
ccaccacccgagcuccaag

SEQ ID NO: 173489 - RNA, 22 nt, Human
ccacucacaucauggcacacuc

SEQ ID NO: 173490 - RNA, 23 nt, Human
ccacuugaacacacuccuguccc

SEQ ID NO: 173491 - RNA, 19 nt, Human
ccagauggggaaggaagaa

SEQ ID NO: 173492 - RNA, 23 nt, Human
ccagcccuucccuccaaacaucu

SEQ ID NO: 173493 - RNA, 24 nt, Human
ccagcguuucuuccaggccuuuuc

SEQ ID NO: 173494 - RNA, 24 nt, Human
ccagguccuaaacagcagggcuaa

SEQ ID NO: 173495 - RNA, 18 nt, Human
ccauauuccccaccccuu

SEQ ID NO: 173496 - RNA, 22 nt, Human
ccaugcacaccacucuugcacg

SEQ ID NO: 173497 - RNA, 19 nt, Human
ccauuaauaaauacuccuu

SEQ ID NO: 173498 - RNA, 23 nt, Human
ccauuaauaaauacuccuugagu

SEQ ID NO: 173499 - RNA, 22 nt, Human
cccaacucccaggcccuuugga

SEQ ID NO: 173500 - RNA, 18 nt, Human
cccacaguguccuuguca

SEQ ID NO: 173501 - RNA, 20 nt, Human
cccacaguguccuugucauc

SEQ ID NO: 173502 - RNA, 24 nt, Human
cccacccaccggauaaauauguua

SEQ ID NO: 173503 - RNA, 21 nt, Human
cccagaaagacgaccccccac

SEQ ID NO: 173504 - RNA, 21 nt, Human
cccagcccuucccuccaaaca

SEQ ID NO: 173505 - RNA, 22 nt, Human
cccaggguuccccucagucccu

SEQ ID NO: 173506 - RNA, 18 nt, Human
cccauauuccccaccccu

SEQ ID NO: 173507 - RNA, 23 nt, Human
cccaugcuccaguaacuucagaa

SEQ ID NO: 173508 - RNA, 21 nt, Human
cccaugggcacaagcugucag

SEQ ID NO: 173509 - RNA, 19 nt, Human
ccccaaucccccagaaaga

SEQ ID NO: 173510 - RNA, 20 nt, Human
ccccacuugcuacauggccu

SEQ ID NO: 173511 - RNA, 24 nt, Human
ccccagaaacuggagacagcagcc

SEQ ID NO: 173512 - RNA, 19 nt, Human
ccccaugggagaaggggcc

SEQ ID NO: 173513 - RNA, 18 nt, Human
cccccauccacaccacac

SEQ ID NO: 173514 - RNA, 20 nt, Human
ccccugcacugcccugugcc

SEQ ID NO: 173515 - RNA, 19 nt, Human
cccuacacuugcacccgag

SEQ ID NO: 173516 - RNA, 20 nt, Human
cccucaagaccacugcugag

SEQ ID NO: 173517 - RNA, 21 nt, Human
cccugcauuuuaugaaggccc

SEQ ID NO: 173518 - RNA, 26 nt, Human
cccugcuccuugcugcucuagguugg

SEQ ID NO: 173519 - RNA, 21 nt, Human
ccuaaacagcagggcuagucc

SEQ ID NO: 173520 - RNA, 24 nt, Human
ccucaagaccacugcugagccucc

SEQ ID NO: 173521 - RNA, 20 nt, Human
ccuccacuggacccaagccc

SEQ ID NO: 173522 - RNA, 19 nt, Human
ccucucauccuuccaucuc

SEQ ID NO: 173523 - RNA, 21 nt, Human
ccucucauccuuccaucucua

SEQ ID NO: 173524 - RNA, 22 nt, Human
ccucuccuuccuucuuccucca

SEQ ID NO: 173525 - RNA, 21 nt, Human
ccugcaagcuccaagccugua

SEQ ID NO: 173526 - RNA, 22 nt, Human
ccugugagccagagcuuugcuu

SEQ ID NO: 173527 - RNA, 20 nt, Human
ccuuccaucucuaccccuac

SEQ ID NO: 173528 - RNA, 21 nt, Human
cgagcuccaagcccugcuccu

SEQ ID NO: 173529 - RNA, 20 nt, Human
cgcagcuaauccaaccuccc

SEQ ID NO: 173530 - RNA, 24 nt, Human
cggcagguaccccauugugguccc

SEQ ID NO: 173531 - RNA, 20 nt, Human
cuaauccaaccucccauucc

SEQ ID NO: 173532 - RNA, 22 nt, Human
cuaccaccacugcuuccauuca

SEQ ID NO: 173533 - RNA, 19 nt, Human
cuagcccauuuucucuucc

SEQ ID NO: 173534 - RNA, 24 nt, Human
cuaggaacgguccucaugucacac

SEQ ID NO: 173535 - RNA, 22 nt, Human
cuagucccagaaagacgacccc

SEQ ID NO: 173536 - RNA, 20 nt, Human
cucagcgcagcuaauccaac

SEQ ID NO: 173537 - RNA, 22 nt, Human
cucaugucacaccaccaugcac

SEQ ID NO: 173538 - RNA, 19 nt, Human
cuccacccugcacccccaa

SEQ ID NO: 173539 - RNA, 19 nt, Human
cuccacuggacccaagccc

SEQ ID NO: 173540 - RNA, 25 nt, Human
cucccaggcccuuuggauguauuuc

SEQ ID NO: 173541 - RNA, 21 nt, Human
cuccuuggagagccccaggca

SEQ ID NO: 173542 - RNA, 24 nt, Human
cucuccuuccuucuuccuccacug

SEQ ID NO: 173543 - RNA, 23 nt, Human
cucugcaccccacagcagcuguc

SEQ ID NO: 173544 - RNA, 19 nt, Human
cucuggaaaugggauaggg

SEQ ID NO: 173545 - RNA, 18 nt, Human
cucuugcacgugucccuc

SEQ ID NO: 173546 - RNA, 29 nt, Human
cugaaaggggaaugggggcagaggacagu

SEQ ID NO: 173547 - RNA, 19 nt, Human
cugcaagcuccaagccugu

SEQ ID NO: 173548 - RNA, 22 nt, Human
cugcaucacccccauccacacc

SEQ ID NO: 173549 - RNA, 19 nt, Human
cugguccuugacucccugg

SEQ ID NO: 173550 - RNA, 20 nt, Human
cuuccaucucuaccccuaca

SEQ ID NO: 173551 - RNA, 24 nt, Human
cuucuaaggccuaccucaggcacu

SEQ ID NO: 173552 - RNA, 18 nt, Human
cuucugccucugcacccc

SEQ ID NO: 173553 - RNA, 18 nt, Human
cuugucuucugggacuga

SEQ ID NO: 173554 - RNA, 18 nt, Human
cuuuccguaggcucagcc

SEQ ID NO: 173555 - RNA, 23 nt, Human
cuuucugcuccacccugcacccc

SEQ ID NO: 173556 - RNA, 20 nt, Human
cuuugucucaguuacuccuc

SEQ ID NO: 173557 - RNA, 19 nt, Human
gaaaccacuaaagucaagc

SEQ ID NO: 173558 - RNA, 18 nt, Human
gaaugggggcagaggaca

SEQ ID NO: 173559 - RNA, 22 nt, Human
gacugggcuuccacuagcccau

SEQ ID NO: 173560 - RNA, 18 nt, Human
gagcaacagagggcggau

SEQ ID NO: 173561 - RNA, 21 nt, Human
gagccccagcccuucccucca

SEQ ID NO: 173562 - RNA, 22 nt, Human
gagccccagcccuucccuccaa

SEQ ID NO: 173563 - RNA, 22 nt, Human
gaggagaggugcagcucuugaa

SEQ ID NO: 173564 - RNA, 21 nt, Human
gauguauuuccccacuugcua

SEQ ID NO: 173565 - RNA, 20 nt, Human
gcacugcucacugcaaagaa

SEQ ID NO: 173566 - RNA, 20 nt, Human
gccggcaccaggccagacuc

SEQ ID NO: 173567 - RNA, 19 nt, Human
gcuccaagccuguaccaug

SEQ ID NO: 173568 - RNA, 20 nt, Human
gcugaaggaugcuuuuugga

SEQ ID NO: 173569 - RNA, 18 nt, Human
gcugagccuccgucucca

SEQ ID NO: 173570 - RNA, 18 nt, Human
gcugccuccugggcucug

SEQ ID NO: 173571 - RNA, 23 nt, Human
gcuggaaggaagccuccugggag

SEQ ID NO: 173572 - RNA, 21 nt, Human
ggaacgguccucaugucacac

SEQ ID NO: 173573 - RNA, 22 nt, Human
ggagaaggggccagagggagga

SEQ ID NO: 173574 - RNA, 18 nt, Human
ggagaugggaagggccag

SEQ ID NO: 173575 - RNA, 18 nt, Human
ggagcugaaaggggaaug

SEQ ID NO: 173576 - RNA, 23 nt, Human
ggaggagaggugcagcucuugaa

SEQ ID NO: 173577 - RNA, 23 nt, Human
ggagggaagauagcugagggcug

SEQ ID NO: 173578 - RNA, 18 nt, Human
ggccugugugaagcagug

SEQ ID NO: 173579 - RNA, 22 nt, Human
ggccuuucaaaccuggggagga

SEQ ID NO: 173580 - RNA, 18 nt, Human
ggcuggaaggaagccucc

SEQ ID NO: 173581 - RNA, 18 nt, Human
ggcuggaaggaagccucc

SEQ ID NO: 173582 - RNA, 18 nt, Human
gggauaggggugcugggc

SEQ ID NO: 173583 - RNA, 21 nt, Human
gggcaccccccaacucccagg

SEQ ID NO: 173584 - RNA, 18 nt, Human
gggggccucugaggggac

SEQ ID NO: 173585 - RNA, 27 nt, Human
gggggcuggaaggaagccuccugggag

SEQ ID NO: 173586 - RNA, 22 nt, Human
gguguggaaucuggcucagagc

SEQ ID NO: 173587 - RNA, 18 nt, Human
uaaaaacauucagauccc

SEQ ID NO: 173588 - RNA, 21 nt, Human
uaaaaacauucagauccccca

SEQ ID NO: 173589 - RNA, 23 nt, Human
uaaacagcagggcuagucccaga

SEQ ID NO: 173590 - RNA, 18 nt, Human
uaaaggacaggaagaggc

SEQ ID NO: 173591 - RNA, 25 nt, Human
uaacaagacaagaacucaagacugg

SEQ ID NO: 173592 - RNA, 23 nt, Human
uaagguggguggaggcauggcca

SEQ ID NO: 173593 - RNA, 23 nt, Human
uaauccaaccucccauuccacag

SEQ ID NO: 173594 - RNA, 27 nt, Human
uacacaacacaugccaccauaaaucac

SEQ ID NO: 173595 - RNA, 22 nt, Human
uaccaaaggucuaauucccuca

SEQ ID NO: 173596 - RNA, 20 nt, Human
uaugcugcuuucaagguggg

SEQ ID NO: 173597 - RNA, 19 nt, Human
ucagggagaaggucugauu

SEQ ID NO: 173598 - RNA, 18 nt, Human
ucaguccucuccaggccc

SEQ ID NO: 173599 - RNA, 22 nt, Human
uccaccacccgagcuccaagcc

SEQ ID NO: 173600 - RNA, 21 nt, Human
uccacccugcacccccaagga

SEQ ID NO: 173601 - RNA, 19 nt, Human
uccaccuucccugaucccc

SEQ ID NO: 173602 - RNA, 25 nt, Human
uccacugcacugcucacugcaaaga

SEQ ID NO: 173603 - RNA, 23 nt, Human
uccagaguucuggggacccagac

SEQ ID NO: 173604 - RNA, 19 nt, Human
uccagccagguccacucac

SEQ ID NO: 173605 - RNA, 18 nt, Human
uccgucuccaccaucucc

SEQ ID NO: 173606 - RNA, 21 nt, Human
uccuaacuaagguggguggag

SEQ ID NO: 173607 - RNA, 23 nt, Human
uccugccauggccucagccucaa

SEQ ID NO: 173608 - RNA, 21 nt, Human
uccugggcucugcgguggccc

SEQ ID NO: 173609 - RNA, 21 nt, Human
uccuugacucccuggguuggu

SEQ ID NO: 173610 - RNA, 26 nt, Human
uccuugacucccuggguuggugagac

SEQ ID NO: 173611 - RNA, 28 nt, Human
uccuugcugcucuagguugggguggaac

SEQ ID NO: 173612 - RNA, 23 nt, Human
uccuuggagagccccaggcaggg

SEQ ID NO: 173613 - RNA, 20 nt, Human
uccuuuuguccuucaucuuc

SEQ ID NO: 173614 - RNA, 21 nt, Human
ucgccccaggguagaaugaaa

SEQ ID NO: 173615 - RNA, 21 nt, Human
ucuccaccacccgagcuccaa

SEQ ID NO: 173616 - RNA, 18 nt, Human
ucuccuuccuucuuccuc

SEQ ID NO: 173617 - RNA, 24 nt, Human
ucugcaccccacagcagcuguccu

SEQ ID NO: 173618 - RNA, 18 nt, Human
ucugcccaguguagcuac

SEQ ID NO: 173619 - RNA, 18 nt, Human
ucuggagaugcugccucc

SEQ ID NO: 173620 - RNA, 20 nt, Human
ugaaaauuuagucaagaaca

SEQ ID NO: 173621 - RNA, 25 nt, Human
ugaaauaauucuagauuucaagaca

SEQ ID NO: 173622 - RNA, 19 nt, Human
ugacaccaaccucccuaag

SEQ ID NO: 173623 - RNA, 21 nt, Human
ugacagccuggaucucuuggg

SEQ ID NO: 173624 - RNA, 20 nt, Human
ugacccauggauaggccaaa

SEQ ID NO: 173625 - RNA, 21 nt, Human
ugacuccuuuguuggaggagg

SEQ ID NO: 173626 - RNA, 22 nt, Human
ugacuuaaccuugcagaagugg

SEQ ID NO: 173627 - RNA, 21 nt, Human
ugagacuugucuucugggacu

SEQ ID NO: 173628 - RNA, 19 nt, Human
ugagcaccagcuguggaug

SEQ ID NO: 173629 - RNA, 19 nt, Human
ugagcugagcccaugcucc

SEQ ID NO: 173630 - RNA, 19 nt, Human
ugaucaggcccucaccucc

SEQ ID NO: 173631 - RNA, 19 nt, Human
ugauugauucuuguguccu

SEQ ID NO: 173632 - RNA, 22 nt, Human
ugauuugaaaauuaaaugucaa

SEQ ID NO: 173633 - RNA, 27 nt, Human
ugcaaagaaacucacuucccgacccca

SEQ ID NO: 173634 - RNA, 21 nt, Human
ugcacugcucacugcaaagaa

SEQ ID NO: 173635 - RNA, 18 nt, Human
ugcccgacuuccacugca

SEQ ID NO: 173636 - RNA, 22 nt, Human
ugcccugcuuucuccuuguccu

SEQ ID NO: 173637 - RNA, 22 nt, Human
ugcucaaaggccuuuuuuuccc

SEQ ID NO: 173638 - RNA, 21 nt, Human
ugcuccacccugcacccccaa

SEQ ID NO: 173639 - RNA, 22 nt, Human
ugcugccuccugggcucugcgg

SEQ ID NO: 173640 - RNA, 18 nt, Human
ugcugcucuagguuggcc

SEQ ID NO: 173641 - RNA, 24 nt, Human
ugcuucucuccugccaagaaaaac

SEQ ID NO: 173642 - RNA, 21 nt, Human
uggaagugggugaagaaggcu

SEQ ID NO: 173643 - RNA, 20 nt, Human
uggaggguggggauaugcua

SEQ ID NO: 173644 - RNA, 21 nt, Human
uggaggguggggauaugcuag

SEQ ID NO: 173645 - RNA, 24 nt, Human
uggaugggaggaagaacgggagag

SEQ ID NO: 173646 - RNA, 18 nt, Human
uggcagaguagagaggag

SEQ ID NO: 173647 - RNA, 20 nt, Human
uggcaggaagucauuguuug

SEQ ID NO: 173648 - RNA, 21 nt, Human
uggcaggaagucauuguuugg

SEQ ID NO: 173649 - RNA, 22 nt, Human
uggccaucaguuuucccuuccu

SEQ ID NO: 173650 - RNA, 21 nt, Human
uggcuccuggaaugcuaggga

SEQ ID NO: 173651 - RNA, 22 nt, Human
uggcugcugcggguacagggaa

SEQ ID NO: 173652 - RNA, 18 nt, Human
uggcuggacccauaugcu

SEQ ID NO: 173653 - RNA, 24 nt, Human
ugggagcugaaaggggaauggggg

SEQ ID NO: 173654 - RNA, 18 nt, Human
ugggcaccccccaacucc

SEQ ID NO: 173655 - RNA, 27 nt, Human
ugggcagaggaggugccuugaucaggc

SEQ ID NO: 173656 - RNA, 24 nt, Human
uggggaggagaguccaagauggag

SEQ ID NO: 173657 - RNA, 25 nt, Human
uggggaggagaguccaagauggcuc

SEQ ID NO: 173658 - RNA, 23 nt, Human
uggggcuggcgggggccucugag

SEQ ID NO: 173659 - RNA, 20 nt, Human
uggggugcauuucuagugga

SEQ ID NO: 173660 - RNA, 23 nt, Human
uggguuggugagacuugucuucu

SEQ ID NO: 173661 - RNA, 19 nt, Human
ugguaguuuggggccugug

SEQ ID NO: 173662 - RNA, 24 nt, Human
uguccuguugcuucugaaacucuu

SEQ ID NO: 173663 - RNA, 23 nt, Human
ugugaagcagugcugagugggaa

SEQ ID NO: 173664 - RNA, 19 nt, Human
uuagagaauggcuaggcca

SEQ ID NO: 173665 - RNA, 21 nt, Human
uucaagacacaaguagccaac

SEQ ID NO: 173666 - RNA, 23 nt, Human
uucacuuauuggaacaccaaggc

SEQ ID NO: 173667 - RNA, 21 nt, Human
uucagaaugguugugcuuuug

SEQ ID NO: 173668 - RNA, 23 nt, Human
uucagggcugggcagagugaacc

SEQ ID NO: 173669 - RNA, 26 nt, Human
uuccacugcacugcucacugcaaaga

SEQ ID NO: 173670 - RNA, 22 nt, Human
uucgccccaggguagaaugaaa

SEQ ID NO: 173671 - RNA, 20 nt, Human
uugacccauggauaggccaa

SEQ ID NO: 173672 - RNA, 22 nt, Human
uugacuccuuuguuggaggagg

SEQ ID NO: 173673 - RNA, 20 nt, Human
uugcugcucuagguuggccc

SEQ ID NO: 173674 - RNA, 23 nt, Human
uuuaccauguguuccugccccau

SEQ ID NO: 173675 - RNA, 28 nt, Human
uuuguuaacuucuacauuggaaaccacc

SEQ ID NO: 173676 - RNA, 22 nt, Human
aaaagauccaaauucacaagag

SEQ ID NO: 173677 - RNA, 20 nt, Human
aaacauuuuaagaaagacuu

SEQ ID NO: 173678 - RNA, 26 nt, Human
aagcagcagagaggggaaacaguuau

SEQ ID NO: 173679 - RNA, 22 nt, Human
aagccagacuguuuccuagaga

SEQ ID NO: 173680 - RNA, 24 nt, Human
aaggaucagucccacuccggaauc

SEQ ID NO: 173681 - RNA, 21 nt, Human
acuccagggccggcugaagaa

SEQ ID NO: 173682 - RNA, 22 nt, Human
agacuguacagccuagaaauaa

SEQ ID NO: 173683 - RNA, 22 nt, Human
agcaacaucuaaagcagcagag

SEQ ID NO: 173684 - RNA, 20 nt, Human
agcgucucuccggguaagac

SEQ ID NO: 173685 - RNA, 20 nt, Human
agggcuacacauuaauacug

SEQ ID NO: 173686 - RNA, 24 nt, Human
cacaaugaaccugccuucacacug

SEQ ID NO: 173687 - RNA, 22 nt, Human
cagcagagaggggaaacaguua

SEQ ID NO: 173688 - RNA, 23 nt, Human
ccacgugcagcgucucuccgggu

SEQ ID NO: 173689 - RNA, 24 nt, Human
ccagggccggcugaagaacggcag

SEQ ID NO: 173690 - RNA, 21 nt, Human
cccugucgcccccgcccgcac

SEQ ID NO: 173691 - RNA, 24 nt, Human
cccugucgcccccgcccgcacucc

SEQ ID NO: 173692 - RNA, 24 nt, Human
ccuucacacugcagacauugugga

SEQ ID NO: 173693 - RNA, 22 nt, Human
cggcccugucgcccccgcccgc

SEQ ID NO: 173694 - RNA, 19 nt, Human
cuucacacugcagacauug

SEQ ID NO: 173695 - RNA, 19 nt, Human
gaacggcagcggcgagggc

SEQ ID NO: 173696 - RNA, 22 nt, Human
gcccugucgcccccgcccgcac

SEQ ID NO: 173697 - RNA, 20 nt, Human
gcccugucgcccccgcccgg

SEQ ID NO: 173698 - RNA, 22 nt, Human
guagggcuacacauuaauacug

SEQ ID NO: 173699 - RNA, 23 nt, Human
uaaagcagcagagaggggaaaca

SEQ ID NO: 173700 - RNA, 22 nt, Human
uaagaaagacuuuggagucuca

SEQ ID NO: 173701 - RNA, 21 nt, Human
uacagccuagaaauaaaagaa

SEQ ID NO: 173702 - RNA, 23 nt, Human
ucaaaaauaguuaagccagacug

SEQ ID NO: 173703 - RNA, 24 nt, Human
ucagucccacuccggaaucggccc

SEQ ID NO: 173704 - RNA, 22 nt, Human
ucucuccggguaagaccugcag

SEQ ID NO: 173705 - RNA, 24 nt, Human
uucaaauucaguaauaaagguaag

SEQ ID NO: 173706 - RNA, 24 nt, Human
uuuggagucucagaauguccuggg

SEQ ID NO: 173707 - RNA, 26 nt, Human
uuuggagucucagaauguccuggggc

SEQ ID NO: 173708 - RNA, 24 nt, Human
aaaaaaaaaaaacuauuuacagaa

SEQ ID NO: 173709 - RNA, 21 nt, Human
aaaaaaagaaaaagugaacag

SEQ ID NO: 173710 - RNA, 20 nt, Human
aaaaaagcacagauuuugca

SEQ ID NO: 173711 - RNA, 21 nt, Human
aaaaagauauuuaauugcaaa

SEQ ID NO: 173712 - RNA, 21 nt, Human
aaaacacugaaaaauaaagca

SEQ ID NO: 173713 - RNA, 25 nt, Human
aaacaguucauaaagcaauaaaaca

SEQ ID NO: 173714 - RNA, 22 nt, Human
aaagggguuuuguuuuuguuuu

SEQ ID NO: 173715 - RNA, 19 nt, Human
aaaucuucucuucauacag

SEQ ID NO: 173716 - RNA, 22 nt, Human
aagaaaaagggguuugaaguaa

SEQ ID NO: 173717 - RNA, 19 nt, Human
aagaaaaagugaacagucu

SEQ ID NO: 173718 - RNA, 19 nt, Human
aagcgcuucagcugcacag

SEQ ID NO: 173719 - RNA, 24 nt, Human
acacaacuuaaagcuguacaaaga

SEQ ID NO: 173720 - RNA, 23 nt, Human
aggagguggugcggggacccgag

SEQ ID NO: 173721 - RNA, 20 nt, Human
aggcagcaggagguggugcg

SEQ ID NO: 173722 - RNA, 23 nt, Human
aggcagcaggagguggugcgggg

SEQ ID NO: 173723 - RNA, 19 nt, Human
agggcgcuauuuuccgaaa

SEQ ID NO: 173724 - RNA, 27 nt, Human
auaaaacaugcagaauauguacaaaca

SEQ ID NO: 173725 - RNA, 22 nt, Human
caaaaagaauucacaaaaacag

SEQ ID NO: 173726 - RNA, 23 nt, Human
caaaaagaauucacaaaaacagu

SEQ ID NO: 173727 - RNA, 25 nt, Human
caaaauagaaaaguaggccagagua

SEQ ID NO: 173728 - RNA, 18 nt, Human
cacugaaaaauaaagcaa

SEQ ID NO: 173729 - RNA, 18 nt, Human
cagcugccagcuuacuuc

SEQ ID NO: 173730 - RNA, 21 nt, Human
cccgaggcgccucguacccgg

SEQ ID NO: 173731 - RNA, 24 nt, Human
cccgcuacacacaaagcgcuucag

SEQ ID NO: 173732 - RNA, 21 nt, Human
cgaggcgccucguacccggcc

SEQ ID NO: 173733 - RNA, 23 nt, Human
cuggaaaagcuucgggagcggcg

SEQ ID NO: 173734 - RNA, 19 nt, Human
gaacagucugccaguguuu

SEQ ID NO: 173735 - RNA, 22 nt, Human
gacacugagcuuucaaaaggaa

SEQ ID NO: 173736 - RNA, 20 nt, Human
gagcaagucauagcacagac

SEQ ID NO: 173737 - RNA, 22 nt, Human
guacaaacagaaauuuuuaaaa

SEQ ID NO: 173738 - RNA, 21 nt, Human
uaaaauauuucagaaacccau

SEQ ID NO: 173739 - RNA, 19 nt, Human
uaaccaacaacgaucaccc

SEQ ID NO: 173740 - RNA, 23 nt, Human
uaaccuagagggauuucaggguu

SEQ ID NO: 173741 - RNA, 19 nt, Human
uacauguaaaucuacuugg

SEQ ID NO: 173742 - RNA, 20 nt, Human
uaccaaaaaaaaaaaaagaa

SEQ ID NO: 173743 - RNA, 22 nt, Human
uauacaguauagauaaccuaga

SEQ ID NO: 173744 - RNA, 21 nt, Human
uaucuuguaggcugcuccuuc

SEQ ID NO: 173745 - RNA, 22 nt, Human
ucaaaaagaauucacaaaaaca

SEQ ID NO: 173746 - RNA, 23 nt, Human
ucagagaaucugacacaacuuaa

SEQ ID NO: 173747 - RNA, 26 nt, Human
ucaguccaccauaauuauuacacaac

SEQ ID NO: 173748 - RNA, 21 nt, Human
ucauuuggaacuguaaaaaaa

SEQ ID NO: 173749 - RNA, 20 nt, Human
uccauacauuguggaauuca

SEQ ID NO: 173750 - RNA, 20 nt, Human
ucccauggcuguaccuuugu

SEQ ID NO: 173751 - RNA, 22 nt, Human
uccguaagaaucguuuccuggg

SEQ ID NO: 173752 - RNA, 20 nt, Human
ugaaaaauaaagcaagaaaa

SEQ ID NO: 173753 - RNA, 24 nt, Human
ugcagaauuggcaaauucaaguua

SEQ ID NO: 173754 - RNA, 23 nt, Human
ugcauuggguuuuccaaaaacau

SEQ ID NO: 173755 - RNA, 23 nt, Human
uggaacuguaaaaaaaaaaaaac

SEQ ID NO: 173756 - RNA, 18 nt, Human
uggaucucuucaacaauc

SEQ ID NO: 173757 - RNA, 18 nt, Human
uggccuaaccaacaacga

SEQ ID NO: 173758 - RNA, 23 nt, Human
ugggagaaaucuucucuucauac

SEQ ID NO: 173759 - RNA, 20 nt, Human
ugguuuuggaucucuucaac

SEQ ID NO: 173760 - RNA, 23 nt, Human
uguacuaaaaucaaaaagaauuc

SEQ ID NO: 173761 - RNA, 18 nt, Human
uguccauacauuguggaa

SEQ ID NO: 173762 - RNA, 19 nt, Human
uguccauacauuguggaau

SEQ ID NO: 173763 - RNA, 26 nt, Human
uguggaauucaacaauauugugauga

SEQ ID NO: 173764 - RNA, 22 nt, Human
uuaucuuguaggcugcuccuuc

SEQ ID NO: 173765 - RNA, 23 nt, Human
uucaggguuaaacaguucauaaa

SEQ ID NO: 173766 - RNA, 22 nt, Human
uucaucauuucugugggagaaa

SEQ ID NO: 173767 - RNA, 24 nt, Human
uucaucauuucugugggagaaaua

SEQ ID NO: 173768 - RNA, 24 nt, Human
uucgggagcggcgacgggaaggca

SEQ ID NO: 173769 - RNA, 23 nt, Human
uugaaauuauaaaacaugcagaa

SEQ ID NO: 173770 - RNA, 23 nt, Human
uuggaacuguaaaaaaaaaaaaa

SEQ ID NO: 173771 - RNA, 21 nt, Human
uuggaucucuucaacaaucuu

SEQ ID NO: 173772 - RNA, 26 nt, Human
uuuaccaaaaaaaaaaaaagaaaaaa

SEQ ID NO: 173773 - RNA, 18 nt, Human
uuuguuuuuguuuuuuuc

SEQ ID NO: 173774 - RNA, 18 nt, Human
aggaaacuuucaaauucu

SEQ ID NO: 173775 - RNA, 21 nt, Human
aggcaauaaaggcagauggga

SEQ ID NO: 173776 - RNA, 24 nt, Human
ccaaauuugcuucccaauauccaa

SEQ ID NO: 173777 - RNA, 26 nt, Human
ccaaauuugcuucccaauauccaauc

SEQ ID NO: 173778 - RNA, 21 nt, Human
ccagagcagaggggcguccuc

SEQ ID NO: 173779 - RNA, 19 nt, Human
ccagugcagaggaacugaa

SEQ ID NO: 173780 - RNA, 23 nt, Human
cguugagaacauaaauaaauucc

SEQ ID NO: 173781 - RNA, 19 nt, Human
cugaagauuucacacccaa

SEQ ID NO: 173782 - RNA, 23 nt, Human
cugaagauuucacacccaaauuu

SEQ ID NO: 173783 - RNA, 23 nt, Human
cuggagcagcuaaggcccccucu

SEQ ID NO: 173784 - RNA, 24 nt, Human
gaaucguggagagacuggagccag

SEQ ID NO: 173785 - RNA, 23 nt, Human
gagaaucguggagagacuggagc

SEQ ID NO: 173786 - RNA, 18 nt, Human
gcagaggggcguccucgc

SEQ ID NO: 173787 - RNA, 23 nt, Human
gccagagcagaggggcguccucg

SEQ ID NO: 173788 - RNA, 18 nt, Human
gcgaguccgaguccgggc

SEQ ID NO: 173789 - RNA, 24 nt, Human
gcguccucgcucugccucucacuc

SEQ ID NO: 173790 - RNA, 19 nt, Human
ggagagacuggagccagcg

SEQ ID NO: 173791 - RNA, 21 nt, Human
uaaauaaauucccagugcaga

SEQ ID NO: 173792 - RNA, 23 nt, Human
uaugaaaauaaggaaacuuucaa

SEQ ID NO: 173793 - RNA, 24 nt, Human
uccucgcucugccucucacucacu

SEQ ID NO: 173794 - RNA, 20 nt, Human
uggaggcaacuguuugucua

SEQ ID NO: 173795 - RNA, 23 nt, Human
uuggaggcaacuguuugucuaug

SEQ ID NO: 173796 - RNA, 19 nt, Human
aaaaaggcaauggcuguuu

SEQ ID NO: 173797 - RNA, 23 nt, Human
aaauaccccuacuuaagagcuaa

SEQ ID NO: 173798 - RNA, 23 nt, Human
acuucaaaggauucaucuaggaa

SEQ ID NO: 173799 - RNA, 23 nt, Human
agagagagaccgagacugcagca

SEQ ID NO: 173800 - RNA, 18 nt, Human
aggauccccauuuucauc

SEQ ID NO: 173801 - RNA, 23 nt, Human
auggagugcuuucugucugcagu

SEQ ID NO: 173802 - RNA, 22 nt, Human
caacaguagaaaauaccccuac

SEQ ID NO: 173803 - RNA, 20 nt, Human
caagagagcguggagcgaug

SEQ ID NO: 173804 - RNA, 20 nt, Human
cagacuguacauagcaaaac

SEQ ID NO: 173805 - RNA, 21 nt, Human
cauuuucaucucauuuggaag

SEQ ID NO: 173806 - RNA, 21 nt, Human
cgcucugaaacggcaagcaga

SEQ ID NO: 173807 - RNA, 24 nt, Human
cgguguuuucuucuuuugcccuuu

SEQ ID NO: 173808 - RNA, 24 nt, Human
cuaggaaugacaauguuaucuucc

SEQ ID NO: 173809 - RNA, 21 nt, Human
cuauauacauacuguacaugg

SEQ ID NO: 173810 - RNA, 22 nt, Human
gagauaggaaacuugggagaga

SEQ ID NO: 173811 - RNA, 20 nt, Human
uaaaccaaaaggguccacaa

SEQ ID NO: 173812 - RNA, 18 nt, Human
uacauguuggaucacaaa

SEQ ID NO: 173813 - RNA, 24 nt, Human
uagaaaauaccccuacuuaagagc

SEQ ID NO: 173814 - RNA, 27 nt, Human
uauguacauggcuauagauacuauaua

SEQ ID NO: 173815 - RNA, 19 nt, Human
ucaaaggauucaucuagga

SEQ ID NO: 173816 - RNA, 21 nt, Human
ucauuuggaagaauaggaaau

SEQ ID NO: 173817 - RNA, 19 nt, Human
ucuuuugcccugaucuuga

SEQ ID NO: 173818 - RNA, 23 nt, Human
ugaacagagcugaugucagauac

SEQ ID NO: 173819 - RNA, 23 nt, Human
ugacgagauaggaaacuugggag

SEQ ID NO: 173820 - RNA, 25 nt, Human
ugcagcagccaagagagcguggagc

SEQ ID NO: 173821 - RNA, 19 nt, Human
uggaagaauaggaaauuaa

SEQ ID NO: 173822 - RNA, 23 nt, Human
uggaagccggagaggagcgcuaa

SEQ ID NO: 173823 - RNA, 20 nt, Human
uggagcgaugggcuggugga

SEQ ID NO: 173824 - RNA, 23 nt, Human
uggcuauagauacuauauagagu

SEQ ID NO: 173825 - RNA, 22 nt, Human
uguaccaagcuuccaauuacau

SEQ ID NO: 173826 - RNA, 22 nt, Human
aaacuuggagagaccgagcucu

SEQ ID NO: 173827 - RNA, 21 nt, Human
ugagcggaaaggagagaagga

SEQ ID NO: 173828 - RNA, 22 nt, Human
ugagcggaaaggagagaaggau

SEQ ID NO: 173829 - RNA, 24 nt, Human
ugggugccuggaugcuucacgggg

SEQ ID NO: 173830 - RNA, 23 nt, Human
aacacuugaagcaguuaaaaaua

SEQ ID NO: 173831 - RNA, 24 nt, Human
aacaugcaaaaauuuccugaaaga

SEQ ID NO: 173832 - RNA, 20 nt, Human
aagaucaugcaguacuuucc

SEQ ID NO: 173833 - RNA, 23 nt, Human
auuuauucacugggaaaauuugu

SEQ ID NO: 173834 - RNA, 19 nt, Human
ccgccaccaccaccgacuu

SEQ ID NO: 173835 - RNA, 21 nt, Human
ccgccaccaccaccgacuugg

SEQ ID NO: 173836 - RNA, 23 nt, Human
cuaauaaucauggagaguuuccu

SEQ ID NO: 173837 - RNA, 19 nt, Human
uaaauguccaaguuuccuc

SEQ ID NO: 173838 - RNA, 19 nt, Human
uacauauagaaacaucaag

SEQ ID NO: 173839 - RNA, 23 nt, Human
uauucacugggaaaauuuguaug

SEQ ID NO: 173840 - RNA, 21 nt, Human
ucguauccuguuuuuccagaa

SEQ ID NO: 173841 - RNA, 24 nt, Human
ugucuuggaguuugggaguguggc

SEQ ID NO: 173842 - RNA, 22 nt, Human
uucagaacaguaagaauuauca

SEQ ID NO: 173843 - RNA, 23 nt, Human
acagaaaacaagaacuuauagaa

SEQ ID NO: 173844 - RNA, 20 nt, Human
agaaaacauaggaaacagaa

SEQ ID NO: 173845 - RNA, 18 nt, Human
agucauauuuuucagcaa

SEQ ID NO: 173846 - RNA, 21 nt, Human
auaggaaacagaaaacaagaa

SEQ ID NO: 173847 - RNA, 21 nt, Human
cccacacaugcuuacagaagc

SEQ ID NO: 173848 - RNA, 18 nt, Human
cugaacaauggaagacaa

SEQ ID NO: 173849 - RNA, 20 nt, Human
guuacagauuuccaauuuga

SEQ ID NO: 173850 - RNA, 21 nt, Human
guuacagauuuccaauuugau

SEQ ID NO: 173851 - RNA, 22 nt, Human
uauuuuucagcaaucuucaacu

SEQ ID NO: 173852 - RNA, 20 nt, Human
ucagcaaucuucaacuuucu

SEQ ID NO: 173853 - RNA, 21 nt, Human
ugaggaguaggauuauugcuu

SEQ ID NO: 173854 - RNA, 23 nt, Human
uuaaaaauacugaacaauggaag

SEQ ID NO: 173855 - RNA, 21 nt, Human
uuucuuuuuuuuuugccuuga

SEQ ID NO: 173856 - RNA, 25 nt, Human
aaagacugcuaaagaucuaccuguc

SEQ ID NO: 173857 - RNA, 23 nt, Human
aacugauaugcaagaccuaaaac

SEQ ID NO: 173858 - RNA, 26 nt, Human
aaguaaacauggugcaguaauaaaac

SEQ ID NO: 173859 - RNA, 22 nt, Human
aaucagugaaauccagggaaac

SEQ ID NO: 173860 - RNA, 24 nt, Human
aauuuuuuuuuuguuuugucuuuu

SEQ ID NO: 173861 - RNA, 19 nt, Human
accuggaccacgguagacu

SEQ ID NO: 173862 - RNA, 23 nt, Human
agaggaaaguagucuaaauggaa

SEQ ID NO: 173863 - RNA, 23 nt, Human
agcaguaucgcuguuggggacug

SEQ ID NO: 173864 - RNA, 20 nt, Human
aggaaaguagucuaaaugga

SEQ ID NO: 173865 - RNA, 24 nt, Human
agguccucuuuucauuuucccuaa

SEQ ID NO: 173866 - RNA, 22 nt, Human
cagggaaacuagaaaagacugc

SEQ ID NO: 173867 - RNA, 21 nt, Human
ccugucuaacuucucucuuug

SEQ ID NO: 173868 - RNA, 19 nt, Human
cggacagcaagguccucuu

SEQ ID NO: 173869 - RNA, 18 nt, Human
cuaaagaucuaccugucu

SEQ ID NO: 173870 - RNA, 19 nt, Human
cuagaaaagacugcuaaag

SEQ ID NO: 173871 - RNA, 22 nt, Human
gaaaagacugcuaaagaucuac

SEQ ID NO: 173872 - RNA, 20 nt, Human
gggaaacuagaaaagacugc

SEQ ID NO: 173873 - RNA, 20 nt, Human
guccucuuuucauuuucccu

SEQ ID NO: 173874 - RNA, 22 nt, Human
uaaaacugauaugcaagaccua

SEQ ID NO: 173875 - RNA, 23 nt, Human
uaaaagaauugucuuuucugcga

SEQ ID NO: 173876 - RNA, 23 nt, Human
uaaccuggaccacgguagacugg

SEQ ID NO: 173877 - RNA, 19 nt, Human
uaccaggaagcagugcagg

SEQ ID NO: 173878 - RNA, 18 nt, Human
uaccucgagaaacagcag

SEQ ID NO: 173879 - RNA, 18 nt, Human
ucaaggaaugcaacuuag

SEQ ID NO: 173880 - RNA, 24 nt, Human
ucccuaaaaaauaaaucagugaaa

SEQ ID NO: 173881 - RNA, 24 nt, Human
ugauaugcaagaccuaaaaccaau

SEQ ID NO: 173882 - RNA, 23 nt, Human
ugcaagaccuaaaaccaauugga

SEQ ID NO: 173883 - RNA, 19 nt, Human
ugcaggcggacagcaaggu

SEQ ID NO: 173884 - RNA, 20 nt, Human
uggcugaaucucuuaccucu

SEQ ID NO: 173885 - RNA, 20 nt, Human
uguuuugucuuuuugaagua

SEQ ID NO: 173886 - RNA, 21 nt, Human
aacuuagucugcccagugcag

SEQ ID NO: 173887 - RNA, 19 nt, Human
acaucaaaggggaagcgcg

SEQ ID NO: 173888 - RNA, 21 nt, Human
aguuuuugauggaauugaggg

SEQ ID NO: 173889 - RNA, 25 nt, Human
ccaaaacaucaaaggggaagcgcgg

SEQ ID NO: 173890 - RNA, 18 nt, Human
ccucuucuucccuucccc

SEQ ID NO: 173891 - RNA, 18 nt, Human
ccuugcuuccagugggag

SEQ ID NO: 173892 - RNA, 18 nt, Human
ccuugcuuccagugggag

SEQ ID NO: 173893 - RNA, 23 nt, Human
cgcauggccacggcguaccaaaa

SEQ ID NO: 173894 - RNA, 20 nt, Human
gaggcacuguguucucccgc

SEQ ID NO: 173895 - RNA, 23 nt, Human
gaggcgcauggccacggcguacc

SEQ ID NO: 173896 - RNA, 18 nt, Human
uaccaaaacaucaaaggg

SEQ ID NO: 173897 - RNA, 19 nt, Human
uaccaaaacaucaaagggg

SEQ ID NO: 173898 - RNA, 21 nt, Human
uaccaaaacaucaaaggggaa

SEQ ID NO: 173899 - RNA, 19 nt, Human
uacuugcguuuuaacugga

SEQ ID NO: 173900 - RNA, 19 nt, Human
uaugaaauggaccacagga

SEQ ID NO: 173901 - RNA, 19 nt, Human
uaugaaauggaccacagga

SEQ ID NO: 173902 - RNA, 22 nt, Human
uauucauuacuuagcagaagca

SEQ ID NO: 173903 - RNA, 18 nt, Human
ucccgcggucucugcgcc

SEQ ID NO: 173904 - RNA, 21 nt, Human
ucccgcggucucugcgccacc

SEQ ID NO: 173905 - RNA, 22 nt, Human
ucugcgccaccucguccucuuc

SEQ ID NO: 173906 - RNA, 23 nt, Human
ugaaauggaccacaggauaggcc

SEQ ID NO: 173907 - RNA, 23 nt, Human
ugaaauggaccacaggauaggcc

SEQ ID NO: 173908 - RNA, 24 nt, Human
ugaaauggaccacaggauaggcca

SEQ ID NO: 173909 - RNA, 24 nt, Human
ugaaauggaccacaggauaggcca

SEQ ID NO: 173910 - RNA, 21 nt, Human
ugcgccaccucguccucuucu

SEQ ID NO: 173911 - RNA, 21 nt, Human
uggccacggcguaccaaaaca

SEQ ID NO: 173912 - RNA, 22 nt, Human
ugguaugaaauggaccacagga

SEQ ID NO: 173913 - RNA, 22 nt, Human
ugguaugaaauggaccacagga

SEQ ID NO: 173914 - RNA, 23 nt, Human
uuaguuuuugauggaauugaggg

SEQ ID NO: 173915 - RNA, 20 nt, Human
uucauuacuuagcagaagca

SEQ ID NO: 173916 - RNA, 25 nt, Human
uuuuugauggaauugaggguuucac

SEQ ID NO: 173917 - RNA, 20 nt, Human
aaacuugacaggcagaguaa

SEQ ID NO: 173918 - RNA, 22 nt, Human
augugugugucugcuugugugu

SEQ ID NO: 173919 - RNA, 23 nt, Human
cagaguaauauuucacucagugu

SEQ ID NO: 173920 - RNA, 21 nt, Human
ccccgccgccgucgcgacccg

SEQ ID NO: 173921 - RNA, 23 nt, Human
cccgcagccggggcugcuccugc

SEQ ID NO: 173922 - RNA, 18 nt, Human
ccgccgccgccgccgccg

SEQ ID NO: 173923 - RNA, 18 nt, Human
ccgccgccgccgccgcgc

SEQ ID NO: 173924 - RNA, 26 nt, Human
ccgccgccgccgccgcgcuggcccgg

SEQ ID NO: 173925 - RNA, 21 nt, Human
ccgcuguccccccuacucucc

SEQ ID NO: 173926 - RNA, 20 nt, Human
ccggagcggaggagggcgga

SEQ ID NO: 173927 - RNA, 22 nt, Human
ccggagcggaggagggcggagg

SEQ ID NO: 173928 - RNA, 20 nt, Human
cgccccgccgccgucgcgac

SEQ ID NO: 173929 - RNA, 20 nt, Human
cgccgccgccgccgccgcgc

SEQ ID NO: 173930 - RNA, 21 nt, Human
cgggggagggggcgccccgcc

SEQ ID NO: 173931 - RNA, 19 nt, Human
cguauguauauaugugugu

SEQ ID NO: 173932 - RNA, 22 nt, Human
gauccgcuguccccccuacucu

SEQ ID NO: 173933 - RNA, 22 nt, Human
gcguauguauauaugugugugu

SEQ ID NO: 173934 - RNA, 22 nt, Human
gcugccgccgccgccgccgccg

SEQ ID NO: 173935 - RNA, 22 nt, Human
gcugcugccgccgccgccgccg

SEQ ID NO: 173936 - RNA, 21 nt, Human
ggaggagggcggagggggagg

SEQ ID NO: 173937 - RNA, 20 nt, Human
ggcccggagcggaggagggc

SEQ ID NO: 173938 - RNA, 22 nt, Human
ggcccggagcggaggagggccg

SEQ ID NO: 173939 - RNA, 21 nt, Human
gggcugcuccugcugcugccg

SEQ ID NO: 173940 - RNA, 18 nt, Human
guauguauauaugugugu

SEQ ID NO: 173941 - RNA, 21 nt, Human
gugugucugcuugugugucug

SEQ ID NO: 173942 - RNA, 22 nt, Human
uauacaauugcguauguauaua

SEQ ID NO: 173943 - RNA, 25 nt, Human
uauacaauugcguauguauauaugu

SEQ ID NO: 173944 - RNA, 22 nt, Human
uauauacaauugcguauguaua

SEQ ID NO: 173945 - RNA, 23 nt, Human
uauaugugugugucugcuugugu

SEQ ID NO: 173946 - RNA, 19 nt, Human
uauguauauaugugugugu

SEQ ID NO: 173947 - RNA, 21 nt, Human
uccugcugcugccgccgccgc

SEQ ID NO: 173948 - RNA, 21 nt, Human
ugcguauguauauaugugugu

SEQ ID NO: 173949 - RNA, 21 nt, Human
ugcguauguauauaugugugu

SEQ ID NO: 173950 - RNA, 21 nt, Human
ugcuccugcugcugccgccgc

SEQ ID NO: 173951 - RNA, 23 nt, Human
uggcccggagcggaggagggcgg

SEQ ID NO: 173952 - RNA, 18 nt, Human
ugugucuguguguguaca

SEQ ID NO: 173953 - RNA, 22 nt, Human
ugugucuguguguguacaggua

SEQ ID NO: 173954 - RNA, 19 nt, Human
uguguguacagguauaaaa

SEQ ID NO: 173955 - RNA, 20 nt, Human
ugugugugucugcuugugug

SEQ ID NO: 173956 - RNA, 22 nt, Human
ugugugugucugcuuguguguc

SEQ ID NO: 173957 - RNA, 23 nt, Human
uucacauauauauacaauugcgu

SEQ ID NO: 173958 - RNA, 21 nt, Human
aaaauagauacccauuggaug

SEQ ID NO: 173959 - RNA, 25 nt, Human
aaaccaagaccuagauuuuaaaaga

SEQ ID NO: 173960 - RNA, 23 nt, Human
aaauaggcucucuugcugccccc

SEQ ID NO: 173961 - RNA, 19 nt, Human
aaauguuaaaggccaucug

SEQ ID NO: 173962 - RNA, 24 nt, Human
aagaaaaaaucaacaaaaccaaga

SEQ ID NO: 173963 - RNA, 25 nt, Human
aagaaaaagaagaagauuaguaaga

SEQ ID NO: 173964 - RNA, 19 nt, Human
aaggugacagugggcucuu

SEQ ID NO: 173965 - RNA, 19 nt, Human
aaggugacagugggcucuu

SEQ ID NO: 173966 - RNA, 18 nt, Human
aaguuuucaacacaaaac

SEQ ID NO: 173967 - RNA, 21 nt, Human
aauuucuuuaaaaccuugcug

SEQ ID NO: 173968 - RNA, 20 nt, Human
acaaaaauagauacccauug

SEQ ID NO: 173969 - RNA, 24 nt, Human
acacaaaaauagauacccauugga

SEQ ID NO: 173970 - RNA, 24 nt, Human
acacugagcaucacggaugcuccu

SEQ ID NO: 173971 - RNA, 21 nt, Human
acccacagacagccauccagg

SEQ ID NO: 173972 - RNA, 21 nt, Human
accccacccuauccacccccc

SEQ ID NO: 173973 - RNA, 21 nt, Human
accccacccuauccacccccc

SEQ ID NO: 173974 - RNA, 23 nt, Human
accccacccuauccaccccccaa

SEQ ID NO: 173975 - RNA, 23 nt, Human
accccacccuauccaccccccaa

SEQ ID NO: 173976 - RNA, 18 nt, Human
acccuauccaccccccaa

SEQ ID NO: 173977 - RNA, 18 nt, Human
acccuauccaccccccaa

SEQ ID NO: 173978 - RNA, 19 nt, Human
accuccuggggaacuggag

SEQ ID NO: 173979 - RNA, 24 nt, Human
acuacagccaggagagauuugauc

SEQ ID NO: 173980 - RNA, 24 nt, Human
acuacagccaggagagauuugauc

SEQ ID NO: 173981 - RNA, 25 nt, Human
agaaaaagaagaagauuaguaagaa

SEQ ID NO: 173982 - RNA, 19 nt, Human
agaagaagauuaguaagaa

SEQ ID NO: 173983 - RNA, 19 nt, Human
agaaggugacagugggcuc

SEQ ID NO: 173984 - RNA, 19 nt, Human
agaaggugacagugggcuc

SEQ ID NO: 173985 - RNA, 25 nt, Human
agacaacaucacgggaagaggcuuc

SEQ ID NO: 173986 - RNA, 25 nt, Human
agacaacaucacgggaagaggcuuc

SEQ ID NO: 173987 - RNA, 22 nt, Human
agaccccacccuauccaccccc

SEQ ID NO: 173988 - RNA, 22 nt, Human
agaccccacccuauccaccccc

SEQ ID NO: 173989 - RNA, 24 nt, Human
agacgaaagauggagccagcaagg

SEQ ID NO: 173990 - RNA, 21 nt, Human
agagaaagggguagcagggag

SEQ ID NO: 173991 - RNA, 19 nt, Human
agagagaggaccaaggcug

SEQ ID NO: 173992 - RNA, 19 nt, Human
agagagaggaccaaggcug

SEQ ID NO: 173993 - RNA, 22 nt, Human
agaggaccaaggcuguugacgg

SEQ ID NO: 173994 - RNA, 20 nt, Human
agaggcuggggcugggggcc

SEQ ID NO: 173995 - RNA, 20 nt, Human
agaggcuggggcugggggcc

SEQ ID NO: 173996 - RNA, 26 nt, Human
agaugucacaaggcuaucaugaagcu

SEQ ID NO: 173997 - RNA, 26 nt, Human
agaugucacaaggcuaucaugaagcu

SEQ ID NO: 173998 - RNA, 23 nt, Human
agcaaagacaaacccucugcaag

SEQ ID NO: 173999 - RNA, 20 nt, Human
agccaagaaaaagaagaaga

SEQ ID NO: 174000 - RNA, 24 nt, Human
agccaagaaaaagaagaagauuag

SEQ ID NO: 174001 - RNA, 18 nt, Human
agccagagcggccucucc

SEQ ID NO: 174002 - RNA, 19 nt, Human
aggaagucaccaaggccua

SEQ ID NO: 174003 - RNA, 19 nt, Human
aggaagucaccaaggccua

SEQ ID NO: 174004 - RNA, 18 nt, Human
aggagagggagaugucac

SEQ ID NO: 174005 - RNA, 18 nt, Human
aggaggacuggaagaacu

SEQ ID NO: 174006 - RNA, 25 nt, Human
aggaguccuccacccacagacagcc

SEQ ID NO: 174007 - RNA, 18 nt, Human
aggccagaacugggccga

SEQ ID NO: 174008 - RNA, 20 nt, Human
aggccagaacugggccgaaa

SEQ ID NO: 174009 - RNA, 19 nt, Human
aggcuaaagagcagccuuu

SEQ ID NO: 174010 - RNA, 19 nt, Human
aggcucucuugcugccccc

SEQ ID NO: 174011 - RNA, 24 nt, Human
agucacaggggucaaagagaagga

SEQ ID NO: 174012 - RNA, 30 nt, Human
agucgcuccugcugcugcugcugcuuuccc

SEQ ID NO: 174013 - RNA, 23 nt, Human
agugaccacagugggcuucucuc

SEQ ID NO: 174014 - RNA, 24 nt, Human
aguuuguggucauaauuacucagg

SEQ ID NO: 174015 - RNA, 26 nt, Human
auggagccagcaaggagagggagaug

SEQ ID NO: 174016 - RNA, 21 nt, Human
auggggcaggaaaaacucuag

SEQ ID NO: 174017 - RNA, 19 nt, Human
auuucuuuaaaaccuugcu

SEQ ID NO: 174018 - RNA, 22 nt, Human
caaaaaguagauggagacccca

SEQ ID NO: 174019 - RNA, 22 nt, Human
caaaaaguagauggagacccca

SEQ ID NO: 174020 - RNA, 23 nt, Human
caaaaauagauacccauuggaug

SEQ ID NO: 174021 - RNA, 25 nt, Human
caaaaauagauacccauuggaugaa

SEQ ID NO: 174022 - RNA, 26 nt, Human
caaaccaaaacaaguuuucaacacaa

SEQ ID NO: 174023 - RNA, 26 nt, Human
caacucugcucccagucucagucuca

SEQ ID NO: 174024 - RNA, 19 nt, Human
caauggcgaguaaugccug

SEQ ID NO: 174025 - RNA, 19 nt, Human
caauggcgaguaaugccug

SEQ ID NO: 174026 - RNA, 20 nt, Human
cacaacuugucaaaagugcu

SEQ ID NO: 174027 - RNA, 20 nt, Human
cacaacuugucaaaagugcu

SEQ ID NO: 174028 - RNA, 18 nt, Human
cacacacaaaaauagaua

SEQ ID NO: 174029 - RNA, 19 nt, Human
cacacacaaaaauagauac

SEQ ID NO: 174030 - RNA, 22 nt, Human
cacagccaugcaccacagccaa

SEQ ID NO: 174031 - RNA, 24 nt, Human
caccaaccaggagugaggagcagg

SEQ ID NO: 174032 - RNA, 18 nt, Human
caccucaggcccagaaau

SEQ ID NO: 174033 - RNA, 22 nt, Human
cacugagcaucacggaugcucc

SEQ ID NO: 174034 - RNA, 20 nt, Human
cacuggguuacuacagccag

SEQ ID NO: 174035 - RNA, 20 nt, Human
cacuggguuacuacagccag

SEQ ID NO: 174036 - RNA, 18 nt, Human
cagaagagaaucauggug

SEQ ID NO: 174037 - RNA, 18 nt, Human
cagaagagaaucauggug

SEQ ID NO: 174038 - RNA, 18 nt, Human
cagagcggccucucccag

SEQ ID NO: 174039 - RNA, 18 nt, Human
cagcaaagacaaacccuc

SEQ ID NO: 174040 - RNA, 20 nt, Human
cagcaaagacaaacccucug

SEQ ID NO: 174041 - RNA, 24 nt, Human
cagcagcagagagagaggaaugcu

SEQ ID NO: 174042 - RNA, 20 nt, Human
cagccauccaggaacuggcu

SEQ ID NO: 174043 - RNA, 23 nt, Human
caggaaaggcaggaguccuccac

SEQ ID NO: 174044 - RNA, 23 nt, Human
cagggcugagaggaaaagccaga

SEQ ID NO: 174045 - RNA, 24 nt, Human
caggggaaggggaugaagggaagg

SEQ ID NO: 174046 - RNA, 22 nt, Human
cagugggcuucucuccaaugcc

SEQ ID NO: 174047 - RNA, 22 nt, Human
caugcaccacagccaagaaaaa

SEQ ID NO: 174048 - RNA, 18 nt, Human
ccacagacagccauccag

SEQ ID NO: 174049 - RNA, 26 nt, Human
ccacccacagacagccauccaggaac

SEQ ID NO: 174050 - RNA, 21 nt, Human
ccacccuauccaccccccaac

SEQ ID NO: 174051 - RNA, 21 nt, Human
ccacccuauccaccccccaac

SEQ ID NO: 174052 - RNA, 22 nt, Human
ccacccuauccaccccccaaca

SEQ ID NO: 174053 - RNA, 22 nt, Human
ccacccuauccaccccccaaca

SEQ ID NO: 174054 - RNA, 23 nt, Human
ccagaggcuggggcugggguacc

SEQ ID NO: 174055 - RNA, 23 nt, Human
ccagaggcuggggcugggguacc

SEQ ID NO: 174056 - RNA, 19 nt, Human
cccacccuauccacccccc

SEQ ID NO: 174057 - RNA, 19 nt, Human
cccacccuauccacccccc

SEQ ID NO: 174058 - RNA, 21 nt, Human
cccacccuauccaccccccaa

SEQ ID NO: 174059 - RNA, 21 nt, Human
cccacccuauccaccccccaa

SEQ ID NO: 174060 - RNA, 22 nt, Human
cccaggaagucaccaaggccua

SEQ ID NO: 174061 - RNA, 22 nt, Human
cccaggaagucaccaaggccua

SEQ ID NO: 174062 - RNA, 20 nt, Human
ccccacccuauccacccccc

SEQ ID NO: 174063 - RNA, 20 nt, Human
ccccacccuauccacccccc

SEQ ID NO: 174064 - RNA, 23 nt, Human
ccccacccuauccaccccccaac

SEQ ID NO: 174065 - RNA, 23 nt, Human
ccccacccuauccaccccccaac

SEQ ID NO: 174066 - RNA, 24 nt, Human
ccccacccuauccaccccccaaca

SEQ ID NO: 174067 - RNA, 24 nt, Human
ccccacccuauccaccccccaaca

SEQ ID NO: 174068 - RNA, 21 nt, Human
ccccagcuagugccucuuggg

SEQ ID NO: 174069 - RNA, 23 nt, Human
ccccaggaagucaccaaggccua

SEQ ID NO: 174070 - RNA, 23 nt, Human
ccccaggaagucaccaaggccua

SEQ ID NO: 174071 - RNA, 24 nt, Human
ccccaggaagucaccaaggccuag

SEQ ID NO: 174072 - RNA, 24 nt, Human
ccccaggaagucaccaaggccuag

SEQ ID NO: 174073 - RNA, 21 nt, Human
cccugagcuccacagccaugc

SEQ ID NO: 174074 - RNA, 22 nt, Human
ccucaggcccagaaauugagcu

SEQ ID NO: 174075 - RNA, 22 nt, Human
ccucaggcccagaaauugagcu

SEQ ID NO: 174076 - RNA, 18 nt, Human
ccuccuguuauacugcug

SEQ ID NO: 174077 - RNA, 21 nt, Human
ccucugcaagcuucuguuugg

SEQ ID NO: 174078 - RNA, 20 nt, Human
ccucuugggacagaagcaaa

SEQ ID NO: 174079 - RNA, 25 nt, Human
ccucuugggacagaagcaaaccaaa

SEQ ID NO: 174080 - RNA, 25 nt, Human
ccucuuuuaugaucacucuuuuauu

SEQ ID NO: 174081 - RNA, 25 nt, Human
ccuggucagggcuaggggaagucac

SEQ ID NO: 174082 - RNA, 20 nt, Human
ccuugcugcucuuuggggac

SEQ ID NO: 174083 - RNA, 18 nt, Human
cgaaagcacuacaaaggc

SEQ ID NO: 174084 - RNA, 19 nt, Human
cggagaccggcgcgaccac

SEQ ID NO: 174085 - RNA, 22 nt, Human
cggagaucucaacagugaccac

SEQ ID NO: 174086 - RNA, 22 nt, Human
cggagaucucaacagugaccac

SEQ ID NO: 174087 - RNA, 23 nt, Human
cuacagccaggagagauuugauc

SEQ ID NO: 174088 - RNA, 22 nt, Human
cucaggguuuucaucuccuaag

SEQ ID NO: 174089 - RNA, 23 nt, Human
cucaggguuuucaucuccuaagg

SEQ ID NO: 174090 - RNA, 23 nt, Human
cucaggguuuucaucuccuaagg

SEQ ID NO: 174091 - RNA, 22 nt, Human
cuccaaucagacacaacuuguc

SEQ ID NO: 174092 - RNA, 22 nt, Human
cuccaaucagacacaacuuguc

SEQ ID NO: 174093 - RNA, 23 nt, Human
cuccacagccaugcaccacagcc

SEQ ID NO: 174094 - RNA, 23 nt, Human
cucugcucccagucucagucuca

SEQ ID NO: 174095 - RNA, 21 nt, Human
cugcaagcuucuguuugggga

SEQ ID NO: 174096 - RNA, 20 nt, Human
cugcagagaaagggguagca

SEQ ID NO: 174097 - RNA, 21 nt, Human
cugggucagggcuaggggaag

SEQ ID NO: 174098 - RNA, 24 nt, Human
cuucucuguauacauguucucgac

SEQ ID NO: 174099 - RNA, 22 nt, Human
cuugaagaagagggagguggcc

SEQ ID NO: 174100 - RNA, 18 nt, Human
gaaaaacucuagucgcuc

SEQ ID NO: 174101 - RNA, 18 nt, Human
gaaagcacuacaaaggca

SEQ ID NO: 174102 - RNA, 18 nt, Human
gaaagcacugcaaaggca

SEQ ID NO: 174103 - RNA, 26 nt, Human
gaaaggcaggaguccuccacccacaa

SEQ ID NO: 174104 - RNA, 19 nt, Human
gaacacugagcaucacgga

SEQ ID NO: 174105 - RNA, 22 nt, Human
gaagggaaggaggcuaaagagc

SEQ ID NO: 174106 - RNA, 24 nt, Human
gaccccacccuauccaccccccaa

SEQ ID NO: 174107 - RNA, 24 nt, Human
gaccccacccuauccaccccccaa

SEQ ID NO: 174108 - RNA, 23 nt, Human
gagagagaacugagaacauaaua

SEQ ID NO: 174109 - RNA, 21 nt, Human
gagcaccucaggcccagaaau

SEQ ID NO: 174110 - RNA, 21 nt, Human
gagcaccucaggcccagaaau

SEQ ID NO: 174111 - RNA, 24 nt, Human
gaggcuaaagagcagccuuugugg

SEQ ID NO: 174112 - RNA, 22 nt, Human
gaggucgcggcucacgcucugg

SEQ ID NO: 174113 - RNA, 20 nt, Human
gauagagagaggaccaaggc

SEQ ID NO: 174114 - RNA, 20 nt, Human
gauagagagaggaccaaggc

SEQ ID NO: 174115 - RNA, 21 nt, Human
gaucucuuccuccuguuauac

SEQ ID NO: 174116 - RNA, 23 nt, Human
gcaaagacaaacccucugcaagc

SEQ ID NO: 174117 - RNA, 21 nt, Human
gcaaagccgaguuuccuuagu

SEQ ID NO: 174118 - RNA, 21 nt, Human
gcaaagccgaguuuccuuagu

SEQ ID NO: 174119 - RNA, 20 nt, Human
gcccagaaauugagcuaaag

SEQ ID NO: 174120 - RNA, 20 nt, Human
gcccagaaauugagcuaaag

SEQ ID NO: 174121 - RNA, 23 nt, Human
gcccagaaauugagcuaaagaga

SEQ ID NO: 174122 - RNA, 23 nt, Human
gcccagaaauugagcuaaagaga

SEQ ID NO: 174123 - RNA, 21 nt, Human
gccuuggccucuagucagccu

SEQ ID NO: 174124 - RNA, 20 nt, Human
gcgcgaccaccugcgcggag

SEQ ID NO: 174125 - RNA, 26 nt, Human
gcuccugcugcugcugcugcuuuccc

SEQ ID NO: 174126 - RNA, 24 nt, Human
ggagagagaacugagaacauaaua

SEQ ID NO: 174127 - RNA, 21 nt, Human
ggagaucucaacagugaccac

SEQ ID NO: 174128 - RNA, 20 nt, Human
ggaggcagugacaaaggggg

SEQ ID NO: 174129 - RNA, 21 nt, Human
ggaggcagugacaaagggggc

SEQ ID NO: 174130 - RNA, 23 nt, Human
ggaguccacccugagcuccacag

SEQ ID NO: 174131 - RNA, 21 nt, Human
ggagugaggagcaggcagagg

SEQ ID NO: 174132 - RNA, 24 nt, Human
ggcaauagugggcuucuggaaaaa

SEQ ID NO: 174133 - RNA, 22 nt, Human
ggccuagugccugggucagggc

SEQ ID NO: 174134 - RNA, 23 nt, Human
ggcuaaagagcagccuuuguggg

SEQ ID NO: 174135 - RNA, 20 nt, Human
ggcucucuugcugccccccc

SEQ ID NO: 174136 - RNA, 19 nt, Human
gggaauauuuugcgguuuu

SEQ ID NO: 174137 - RNA, 20 nt, Human
gggacagaagcaaaccaaaa

SEQ ID NO: 174138 - RNA, 21 nt, Human
gggaggcagugacaaaggggg

SEQ ID NO: 174139 - RNA, 20 nt, Human
gggcaggggaaggggaugaa

SEQ ID NO: 174140 - RNA, 18 nt, Human
gggccagggcugagagga

SEQ ID NO: 174141 - RNA, 19 nt, Human
ggggaaggggaugaaggga

SEQ ID NO: 174142 - RNA, 19 nt, Human
gggucagggcuaggggaag

SEQ ID NO: 174143 - RNA, 21 nt, Human
gguuacuacagccaggagaga

SEQ ID NO: 174144 - RNA, 21 nt, Human
gguuacuacagccaggagaga

SEQ ID NO: 174145 - RNA, 20 nt, Human
guccuugauuuggcuuucuu

SEQ ID NO: 174146 - RNA, 18 nt, Human
gucugaggucccucgacc

SEQ ID NO: 174147 - RNA, 18 nt, Human
gucugaggucccucgacc

SEQ ID NO: 174148 - RNA, 22 nt, Human
gugacagaagagaaucauggug

SEQ ID NO: 174149 - RNA, 22 nt, Human
gugacagaagagaaucauggug

SEQ ID NO: 174150 - RNA, 22 nt, Human
gugcugccuuugcugggaggca

SEQ ID NO: 174151 - RNA, 20 nt, Human
guuuguggucauaauuacuc

SEQ ID NO: 174152 - RNA, 20 nt, Human
guuuguggucauaauuacuc

SEQ ID NO: 174153 - RNA, 25 nt, Human
uaagaaaaaaucaacaaaaccaaga

SEQ ID NO: 174154 - RNA, 24 nt, Human
uaauugaauuaaacaaaaauguua

SEQ ID NO: 174155 - RNA, 23 nt, Human
uacacgugaaaugaagagggcca

SEQ ID NO: 174156 - RNA, 30 nt, Human
uagcccuaucauguggucuagaaggugacu

SEQ ID NO: 174157 - RNA, 30 nt, Human; identical to SEQ ID NO: 174156

SEQ ID NO: 174158 - RNA, 21 nt, Human
uaggcucucuugcugcccccc

SEQ ID NO: 174159 - RNA, 21 nt, Human
uagugcagacgaaagauggag

SEQ ID NO: 174160 - RNA, 21 nt, Human
uaucaugaagcuccaaucaga

SEQ ID NO: 174161 - RNA, 21 nt, Human
uaucaugaagcuccaaucaga

SEQ ID NO: 174162 - RNA, 28 nt, Human
ucaacagugaccacagugggcuucucuc

SEQ ID NO: 174163 - RNA, 22 nt, Human
ucacacacaaaaauagauaccc

SEQ ID NO: 174164 - RNA, 24 nt, Human
ucacggaugcuccuugaagaagag

SEQ ID NO: 174165 - RNA, 21 nt, Human
ucacugggaaaguuacagaaa

SEQ ID NO: 174166 - RNA, 21 nt, Human
ucagacacaacuugucaaaag

SEQ ID NO: 174167 - RNA, 21 nt, Human
ucagacacaacuugucaaaag

SEQ ID NO: 174168 - RNA, 21 nt, Human
ucaggauaguguucaggaugc

SEQ ID NO: 174169 - RNA, 21 nt, Human
ucaggauaguguucaggaugc

SEQ ID NO: 174170 - RNA, 23 nt, Human
ucaggauaguguucaggaugcga

SEQ ID NO: 174171 - RNA, 23 nt, Human
ucaggauaguguucaggaugcga

SEQ ID NO: 174172 - RNA, 22 nt, Human
ucaggcccagaaauugagcuaa

SEQ ID NO: 174173 - RNA, 22 nt, Human
ucaggcccagaaauugagcuaa

SEQ ID NO: 174174 - RNA, 21 nt, Human
uccacuggguuacuacagcca

SEQ ID NO: 174175 - RNA, 21 nt, Human
uccacuggguuacuacagcca

SEQ ID NO: 174176 - RNA, 22 nt, Human
uccacuggguuacuacagccag

SEQ ID NO: 174177 - RNA, 21 nt, Human
ucccucgacccuagaacauuc

SEQ ID NO: 174178 - RNA, 23 nt, Human
ucccuuggcaaggggcuuggacc

SEQ ID NO: 174179 - RNA, 25 nt, Human
ucccuuggcaaggggcuuggacccc

SEQ ID NO: 174180 - RNA, 23 nt, Human
uccuccacccacagacagccauc

SEQ ID NO: 174181 - RNA, 20 nt, Human
uccuccuguuauacugcugc

SEQ ID NO: 174182 - RNA, 19 nt, Human
uccugcugcugcugcugcu

SEQ ID NO: 174183 - RNA, 21 nt, Human
ucuagaaggugacagugggcu

SEQ ID NO: 174184 - RNA, 21 nt, Human
ucuagaaggugacagugggcu

SEQ ID NO: 174185 - RNA, 23 nt, Human
ucugagcaccucaggcccagaaa

SEQ ID NO: 174186 - RNA, 23 nt, Human
ucugagcaccucaggcccagaaa

SEQ ID NO: 174187 - RNA, 24 nt, Human
ucugcagagaaagggguagcaggg

SEQ ID NO: 174188 - RNA, 19 nt, Human
ucuuuacaccgcugugguc

SEQ ID NO: 174189 - RNA, 30 nt, Human
ucuuuacaccgcuguggucauuuuuugacu

SEQ ID NO: 174190 - RNA, 21 nt, Human
ugaagcuccaaucagacacaa

SEQ ID NO: 174191 - RNA, 21 nt, Human
ugaagcuccaaucagacacaa

SEQ ID NO: 174192 - RNA, 22 nt, Human
ugacuuuguuuccucagagagg

SEQ ID NO: 174193 - RNA, 22 nt, Human
ugacuuuguuuccucagagagg

SEQ ID NO: 174194 - RNA, 22 nt, Human
ugagcaccucaggcccagaaau

SEQ ID NO: 174195 - RNA, 19 nt, Human
ugagcacuucucuguauac

SEQ ID NO: 174196 - RNA, 20 nt, Human
ugagcgcuggccgcguuugc

SEQ ID NO: 174197 - RNA, 24 nt, Human
ugagguccugcucacauucggguc

SEQ ID NO: 174198 - RNA, 23 nt, Human
ugcagagaaagggguagcaggga

SEQ ID NO: 174199 - RNA, 19 nt, Human
ugccagguauaggcaagca

SEQ ID NO: 174200 - RNA, 18 nt, Human
ugcgagaggcuucuggca

SEQ ID NO: 174201 - RNA, 18 nt, Human
ugcgagaggcuucuggca

SEQ ID NO: 174202 - RNA, 20 nt, Human
ugcugccccccccucuuccu

SEQ ID NO: 174203 - RNA, 24 nt, Human
uggcaaggggcuuggaccuccugg

SEQ ID NO: 174204 - RNA, 25 nt, Human
uggcaaggggcuuggaccuccuggg

SEQ ID NO: 174205 - RNA, 18 nt, Human
uggcugugguuuugaaca

SEQ ID NO: 174206 - RNA, 19 nt, Human
ugggacagaagcaaaccaa

SEQ ID NO: 174207 - RNA, 23 nt, Human
ugggccagguaggggagaggggc

SEQ ID NO: 174208 - RNA, 19 nt, Human
ugguuuugaacacugagca

SEQ ID NO: 174209 - RNA, 18 nt, Human
ugucuagcccuaucaugu

SEQ ID NO: 174210 - RNA, 18 nt, Human
ugucuagcccuaucaugu

SEQ ID NO: 174211 - RNA, 20 nt, Human
uguggucauaauuacucagg

SEQ ID NO: 174212 - RNA, 18 nt, Human
uguuagaaguccggauag

SEQ ID NO: 174213 - RNA, 19 nt, Human
uuacauauuuccccauuuc

SEQ ID NO: 174214 - RNA, 19 nt, Human
uuacauauuuccccauuuc

SEQ ID NO: 174215 - RNA, 27 nt, Human
uuaugaucacucuuuuauuuaagaaaa

SEQ ID NO: 174216 - RNA, 20 nt, Human
uuauuuacauauuuccccau

SEQ ID NO: 174217 - RNA, 20 nt, Human
uuauuuacauauuuccccau

SEQ ID NO: 174218 - RNA, 26 nt, Human
uuccagaggcuggggcugggguaccc

SEQ ID NO: 174219 - RNA, 24 nt, Human
uuccagugagauccacaggguacc

SEQ ID NO: 174220 - RNA, 24 nt, Human
uuccagugagauccacaggguacc

SEQ ID NO: 174221 - RNA, 23 nt, Human
uucucuguauacauguucucgac

SEQ ID NO: 174222 - RNA, 26 nt, Human
uucugagguccugcucacauucgggu

SEQ ID NO: 174223 - RNA, 22 nt, Human
uucuuggccccaggaagucacc

SEQ ID NO: 174224 - RNA, 22 nt, Human
uucuuggccccaggaagucacc

SEQ ID NO: 174225 - RNA, 21 nt, Human
uugaagaagagggagguggcc

SEQ ID NO: 174226 - RNA, 21 nt, Human
uugaauuaaacaaaaauguua

SEQ ID NO: 174227 - RNA, 20 nt, Human
uugcugccccccccucuucc

SEQ ID NO: 174228 - RNA, 24 nt, Human
uuggcuuucuuuacaccgcugugg

SEQ ID NO: 174229 - RNA, 26 nt, Human
uuuaugaucacucuuuuaaccccuag

SEQ ID NO: 174230 - RNA, 28 nt, Human
uuucaacacaaaaccuaguuaaauugug

SEQ ID NO: 174231 - RNA, 19 nt, Human
uuugaaauggucugcugag

SEQ ID NO: 174232 - RNA, 22 nt, Human
uuugaaauggucugcugagaag

SEQ ID NO: 174233 - RNA, 21 nt, Human
uuugaacacugagcaucacgg

SEQ ID NO: 174234 - RNA, 19 nt, Human
uuuuuugacaacucaucag

SEQ ID NO: 174235 - RNA, 18 nt, Human
uuuuuuuuuuucuuuuug

SEQ ID NO: 174236 - RNA, 22 nt, Human
uuuuuuuuuuucuuuuugcuuu

SEQ ID NO: 174237 - RNA, 24 nt, Human
aaccauaucaguaaaacccauacc

SEQ ID NO: 174238 - RNA, 21 nt, Human
caaaaacgcuugcagauacca

SEQ ID NO: 174239 - RNA, 20 nt, Human
cagauaccaucaaagcguca

SEQ ID NO: 174240 - RNA, 22 nt, Human
cgcuuuuuuuuuuuuuuuccuu

SEQ ID NO: 174241 - RNA, 18 nt, Human
cuuuuuuuuuuuuuuucc

SEQ ID NO: 174242 - RNA, 23 nt, Human
gcaaaaacgcuugcagauaccau

SEQ ID NO: 174243 - RNA, 19 nt, Human
gcagaagaaucccuccccu

SEQ ID NO: 174244 - RNA, 19 nt, Human
gcuccccccaccugccucu

SEQ ID NO: 174245 - RNA, 19 nt, Human
gcuuuuuuuuuuuuuuucc

SEQ ID NO: 174246 - RNA, 18 nt, Human
uaagaucagcaaaaacgc

SEQ ID NO: 174247 - RNA, 20 nt, Human
ucugaugguggcucccccca

SEQ ID NO: 174248 - RNA, 18 nt, Human
uggcuccccccaccugcc

SEQ ID NO: 174249 - RNA, 26 nt, Human
uugaugaucugaugguggcucccccc

SEQ ID NO: 174250 - RNA, 23 nt, Human
uugguugcagaagaaucccuccc

SEQ ID NO: 174251 - RNA, 22 nt, Human
uuguauuauucuuaugcuugau

SEQ ID NO: 174252 - RNA, 25 nt, Human
ccuuccuugcuacucccgauugguc

SEQ ID NO: 174253 - RNA, 18 nt, Human
guguaccaaaugcucuuc

SEQ ID NO: 174254 - RNA, 20 nt, Human
ucaaguguguaccaaaugcu

SEQ ID NO: 174255 - RNA, 20 nt, Human
aaccagaaacaaaaacuaga

SEQ ID NO: 174256 - RNA, 25 nt, Human
aaccagaaacaaaaacuagaaaaug

SEQ ID NO: 174257 - RNA, 20 nt, Human
aaccuguggcucuagggagu

SEQ ID NO: 174258 - RNA, 22 nt, Human
aagccaaguuuacuuaagcuaa

SEQ ID NO: 174259 - RNA, 20 nt, Human
aaguauaaugggaaaaggaa

SEQ ID NO: 174260 - RNA, 18 nt, Human
acuuguagcaccauugga

SEQ ID NO: 174261 - RNA, 19 nt, Human
agaaaguucaguacucagg

SEQ ID NO: 174262 - RNA, 24 nt, Human
agaccagcuggaaggaucagggau

SEQ ID NO: 174263 - RNA, 19 nt, Human
agagcagaccagcuggaag

SEQ ID NO: 174264 - RNA, 22 nt, Human
agcaaagccaaguuuacuuaag

SEQ ID NO: 174265 - RNA, 21 nt, Human
agccaccgaauaaacagcccu

SEQ ID NO: 174266 - RNA, 18 nt, Human
aggaaagguaaagccgug

SEQ ID NO: 174267 - RNA, 20 nt, Human
aggaauggacugauguuucu

SEQ ID NO: 174268 - RNA, 22 nt, Human
aggacuuauuggaaauugggga

SEQ ID NO: 174269 - RNA, 20 nt, Human
aggcagcuagaaaauggacu

SEQ ID NO: 174270 - RNA, 20 nt, Human
auauuaagacuucuagaaca

SEQ ID NO: 174271 - RNA, 18 nt, Human
augugggugcacacuugg

SEQ ID NO: 174272 - RNA, 18 nt, Human
auuggcucauacaaccac

SEQ ID NO: 174273 - RNA, 21 nt, Human
auuucacaguucacaucuuua

SEQ ID NO: 174274 - RNA, 21 nt, Human
caaagccaaguuuacuuaagc

SEQ ID NO: 174275 - RNA, 22 nt, Human
caaggggcugaaguaggaauca

SEQ ID NO: 174276 - RNA, 22 nt, Human
cacaccaaggggcugaaguagg

SEQ ID NO: 174277 - RNA, 22 nt, Human
caccagcacucccacccauucc

SEQ ID NO: 174278 - RNA, 23 nt, Human
cagcgacucucugagucaaccca

SEQ ID NO: 174279 - RNA, 19 nt, Human
caugcaagaaauuuaacau

SEQ ID NO: 174280 - RNA, 22 nt, Human
cauuuccauccaugcaugggaa

SEQ ID NO: 174281 - RNA, 22 nt, Human
ccaauggucuccuucccauucu

SEQ ID NO: 174282 - RNA, 18 nt, Human
ccaccgaauaaacagccc

SEQ ID NO: 174283 - RNA, 22 nt, Human
ccacugggagaguguugcucag

SEQ ID NO: 174284 - RNA, 20 nt, Human
ccagcacucccacccauucc

SEQ ID NO: 174285 - RNA, 18 nt, Human
ccaugcaugggaaaaggg

SEQ ID NO: 174286 - RNA, 18 nt, Human
cccaguacuuuuaguacc

SEQ ID NO: 174287 - RNA, 22 nt, Human
cccauauuaagacuucuagaac

SEQ ID NO: 174288 - RNA, 18 nt, Human
ccguuagaaauauuuugu

SEQ ID NO: 174289 - RNA, 21 nt, Human
ccucauccucagcccuguccc

SEQ ID NO: 174290 - RNA, 23 nt, Human
cgaauaaacagcccugaguacau

SEQ ID NO: 174291 - RNA, 19 nt, Human
cuaagccacuuguuccugg

SEQ ID NO: 174292 - RNA, 21 nt, Human
cuagaacaaguuacaaaaaaa

SEQ ID NO: 174293 - RNA, 21 nt, Human
cuagaacaaguuacaaaaaaa

SEQ ID NO: 174294 - RNA, 23 nt, Human
cucauacaaccacauuucaucuc

SEQ ID NO: 174295 - RNA, 19 nt, Human
cucccuaaauaggcaacaa

SEQ ID NO: 174296 - RNA, 26 nt, Human
cugacacuugaggguuacccaauuga

SEQ ID NO: 174297 - RNA, 23 nt, Human
cugaggcugaacuggaagccucc

SEQ ID NO: 174298 - RNA, 18 nt, Human
cuggaagccuuuacccug

SEQ ID NO: 174299 - RNA, 18 nt, Human
cuggguccccaggguucu

SEQ ID NO: 174300 - RNA, 21 nt, Human
cuuccauuuccauccaugcau

SEQ ID NO: 174301 - RNA, 27 nt, Human
cuucuacacagcuuagaacaaugguug

SEQ ID NO: 174302 - RNA, 25 nt, Human
gaaaauguuacucccuaaauaggcc

SEQ ID NO: 174303 - RNA, 22 nt, Human
gaacaaguuacaaaaaaaucuu

SEQ ID NO: 174304 - RNA, 26 nt, Human
gaacaaguuacaaaaaaaucuuccau

SEQ ID NO: 174305 - RNA, 22 nt, Human
gaagaccuauggcaugcaagaa

SEQ ID NO: 174306 - RNA, 19 nt, Human
gaauaaacagcccugagua

SEQ ID NO: 174307 - RNA, 24 nt, Human
gaauccauuguaucuuagaaccga

SEQ ID NO: 174308 - RNA, 21 nt, Human
gaaugcuccucuuggaaugau

SEQ ID NO: 174309 - RNA, 23 nt, Human
gaccagcuggaaggaucagggau

SEQ ID NO: 174310 - RNA, 24 nt, Human
gaugaaugcuccucuuggaaugau

SEQ ID NO: 174311 - RNA, 26 nt, Human
gcaaaccagggagccaccgaauaaac

SEQ ID NO: 174312 - RNA, 26 nt, Human
gcacucccacccauucccguuagaaa

SEQ ID NO: 174313 - RNA, 22 nt, Human
ggaaaaggaaugagaaccugug

SEQ ID NO: 174314 - RNA, 18 nt, Human
ggaaauuggggauaauuc

SEQ ID NO: 174315 - RNA, 20 nt, Human
ggacucaauucugcaagccu

SEQ ID NO: 174316 - RNA, 19 nt, Human
ggaucugccacugggagag

SEQ ID NO: 174317 - RNA, 20 nt, Human
ggguccccaggguucuccuc

SEQ ID NO: 174318 - RNA, 25 nt, Human
guggcucuagggaguuacagaaggg

SEQ ID NO: 174319 - RNA, 27 nt, Human
uaaaaaaucacaaauaugauuggcuca

SEQ ID NO: 174320 - RNA, 20 nt, Human
uaaaauaacugaggcugaac

SEQ ID NO: 174321 - RNA, 23 nt, Human
uaacugaggcugaacuggaagcc

SEQ ID NO: 174322 - RNA, 22 nt, Human
uaagccacuuguuccuggguca

SEQ ID NO: 174323 - RNA, 20 nt, Human
uaagcuaagccacuuguucc

SEQ ID NO: 174324 - RNA, 23 nt, Human
uaccccaucacuaugugaauaaa

SEQ ID NO: 174325 - RNA, 23 nt, Human
uacccuggcacacucaaaaauca

SEQ ID NO: 174326 - RNA, 24 nt, Human
uagaacaggaagcuaagaaauuaa

SEQ ID NO: 174327 - RNA, 20 nt, Human
uagcaccauuggaugugggu

SEQ ID NO: 174328 - RNA, 24 nt, Human
ucacaccaaggggcugaaguagga

SEQ ID NO: 174329 - RNA, 19 nt, Human
uccuucaggccuacaggca

SEQ ID NO: 174330 - RNA, 18 nt, Human
ucuucuggguccccaggg

SEQ ID NO: 174331 - RNA, 21 nt, Human
ugaauugacauaagcccauau

SEQ ID NO: 174332 - RNA, 21 nt, Human
ugacagcgacucucugaguca

SEQ ID NO: 174333 - RNA, 20 nt, Human
ugacauaagcccauauuuca

SEQ ID NO: 174334 - RNA, 27 nt, Human
ugcaagccuucauggcaacagcccaua

SEQ ID NO: 174335 - RNA, 19 nt, Human
uggaaggaucagggaucug

SEQ ID NO: 174336 - RNA, 21 nt, Human
uggagcuucauucuuugagca

SEQ ID NO: 174337 - RNA, 23 nt, Human
uggccuaaaauaccauuuacauc

SEQ ID NO: 174338 - RNA, 24 nt, Human
uggcuggauuuggagagggcagcu

SEQ ID NO: 174339 - RNA, 20 nt, Human
uguaucuuagaaccgaggga

SEQ ID NO: 174340 - RNA, 20 nt, Human
uguguauaauaauaaaauga

SEQ ID NO: 174341 - RNA, 25 nt, Human
uucauuauuuaaaaacucaucuugg

SEQ ID NO: 174342 - RNA, 21 nt, Human
uuuuaaccagaaacaaaaacu

SEQ ID NO: 174343 - RNA, 19 nt, Human
uuuuuuuuuuuuuuggugg

SEQ ID NO: 174344 - RNA, 23 nt, Human
uuuuuuuuuuuuuuuuugguggg

SEQ ID NO: 174345 - RNA, 20 nt, Human
uuuuuuuuuuuuuuuuuugg

SEQ ID NO: 174346 - RNA, 21 nt, Human
acagcacagugcucccgcugu

SEQ ID NO: 174347 - RNA, 22 nt, Human
acccaaaagaaacugaaaggag

SEQ ID NO: 174348 - RNA, 23 nt, Human
agggaaaaacaaacccaaaagaa

SEQ ID NO: 174349 - RNA, 21 nt, Human
caaaagaaacugaaaggagca

SEQ ID NO: 174350 - RNA, 22 nt, Human
cagcacagugcucccgcuguuc

SEQ ID NO: 174351 - RNA, 22 nt, Human
gagcacagcacagugcucccgc

SEQ ID NO: 174352 - RNA, 19 nt, Human
ggaaaaacaaacccaaaag

SEQ ID NO: 174353 - RNA, 27 nt, Human
ggaaaaacaaacccaaaagaaacugaa

SEQ ID NO: 174354 - RNA, 20 nt, Human
gggaaaaacaaacccaaaag

SEQ ID NO: 174355 - RNA, 20 nt, Human
acagccaacauggguuucca

SEQ ID NO: 174356 - RNA, 19 nt, Human
agcaccuaauauaaugcug

SEQ ID NO: 174357 - RNA, 20 nt, Human
aggugcaugugaauuucaug

SEQ ID NO: 174358 - RNA, 18 nt, Human
caagggucuaacgggugg

SEQ ID NO: 174359 - RNA, 21 nt, Human
cagcaccuaauauaaugcugg

SEQ ID NO: 174360 - RNA, 22 nt, Human
caugcaaauggccuguaggugc

SEQ ID NO: 174361 - RNA, 18 nt, Human
ccuguaggugcuuccaag

SEQ ID NO: 174362 - RNA, 23 nt, Human
cgcuacagugucguauuuccugc

SEQ ID NO: 174363 - RNA, 24 nt, Human
cggguggaacuaaaugugcccaca

SEQ ID NO: 174364 - RNA, 25 nt, Human
cuuccaaguucacguagccugaaca

SEQ ID NO: 174365 - RNA, 21 nt, Human
cuugaggaaaauaaauuauuc

SEQ ID NO: 174366 - RNA, 21 nt, Human
gcuuccaaguucacguagccu

SEQ ID NO: 174367 - RNA, 20 nt, Human
ggauuuuuuuuuaaccauau

SEQ ID NO: 174368 - RNA, 24 nt, Human
ggguggaacuaaaugugcccacaa

SEQ ID NO: 174369 - RNA, 24 nt, Human
uaagugucucgucaauguagcuuu

SEQ ID NO: 174370 - RNA, 20 nt, Human
uaauagguuauaaacugaag

SEQ ID NO: 174371 - RNA, 18 nt, Human
ugccauggaaaugugaaa

SEQ ID NO: 174372 - RNA, 19 nt, Human
uggaaagcugcagaaggga

SEQ ID NO: 174373 - RNA, 18 nt, Human
uggccuguaggugcuucc

SEQ ID NO: 174374 - RNA, 19 nt, Human
agagcaaauccccccugcc

SEQ ID NO: 174375 - RNA, 21 nt, Human
agagcaaauccccccugccuu

SEQ ID NO: 174376 - RNA, 22 nt, Human
agcaaauccccccugccuugcc

SEQ ID NO: 174377 - RNA, 23 nt, Human
caacaaguccgucugucaaugac

SEQ ID NO: 174378 - RNA, 19 nt, Human
cccccugccuugcccucac

SEQ ID NO: 174379 - RNA, 24 nt, Human
ccuguggcagagcaaauccccccu

SEQ ID NO: 174380 - RNA, 23 nt, Human
gguccaguagcugcugcauuguu

SEQ ID NO: 174381 - RNA, 18 nt, Human
ucagggugguccaguagc

SEQ ID NO: 174382 - RNA, 21 nt, Human
ucugugaggcaaaaagcugcu

SEQ ID NO: 174383 - RNA, 19 nt, Human
ugacuggccagccccccuc

SEQ ID NO: 174384 - RNA, 18 nt, Human
ugaggggcguguggucaa

SEQ ID NO: 174385 - RNA, 24 nt, Human
ugcccucuucuaggaacagccuug

SEQ ID NO: 174386 - RNA, 21 nt, Human
ugcucagggugguccaguagc

SEQ ID NO: 174387 - RNA, 20 nt, Human
ugcuuuccaguagccugugg

SEQ ID NO: 174388 - RNA, 18 nt, Human
aaagucccucccguuccu

SEQ ID NO: 174389 - RNA, 20 nt, Human
aagaagagucuggaguccug

SEQ ID NO: 174390 - RNA, 22 nt, Human
aagaggaaggggugcagcccgg

SEQ ID NO: 174391 - RNA, 21 nt, Human
aagcaacugagacuguacaga

SEQ ID NO: 174392 - RNA, 21 nt, Human
aaggcugcagaagcaccccca

SEQ ID NO: 174393 - RNA, 25 nt, Human
aagguacaaaauugccuauagaaag

SEQ ID NO: 174394 - RNA, 21 nt, Human
aagucagcuucggaaugccga

SEQ ID NO: 174395 - RNA, 19 nt, Human
acaaaacaggagaaaagag

SEQ ID NO: 174396 - RNA, 23 nt, Human
acaaagccccaucugucuuggcc

SEQ ID NO: 174397 - RNA, 25 nt, Human
acagccaagccaggcccaggagccu

SEQ ID NO: 174398 - RNA, 26 nt, Human
agcaacugagacuguacagagaaaga

SEQ ID NO: 174399 - RNA, 23 nt, Human
aggaaggggugcagcccggggac

SEQ ID NO: 174400 - RNA, 18 nt, Human
aggcccaggagccucugg

SEQ ID NO: 174401 - RNA, 24 nt, Human
agucuggaguccugcucuuugugu

SEQ ID NO: 174402 - RNA, 19 nt, Human
caaaacaggagaaaagagu

SEQ ID NO: 174403 - RNA, 22 nt, Human
caaggaaccacccucccagggc

SEQ ID NO: 174404 - RNA, 20 nt, Human
cacagguaggggacagccaa

SEQ ID NO: 174405 - RNA, 19 nt, Human
caggagccucugggcagag

SEQ ID NO: 174406 - RNA, 22 nt, Human
caggaggcucuagccaaagucc

SEQ ID NO: 174407 - RNA, 20 nt, Human
caucaggggcagcccucugc

SEQ ID NO: 174408 - RNA, 30 nt, Human
cauuucuccacaaagguacaaaauugccua

SEQ ID NO: 174409 - RNA, 22 nt, Human
ccaggccucaagcacguggguc

SEQ ID NO: 174410 - RNA, 18 nt, Human
cccaaggaaccacccucc

SEQ ID NO: 174411 - RNA, 24 nt, Human
cccaucugucuuggcccagcugcc

SEQ ID NO: 174412 - RNA, 19 nt, Human
ccccccgaggugagaugga

SEQ ID NO: 174413 - RNA, 24 nt, Human
ccucugggcagagagaagaugggg

SEQ ID NO: 174414 - RNA, 22 nt, Human
cguuccugggcaucccucuccc

SEQ ID NO: 174415 - RNA, 19 nt, Human
cuagccaaagucccucccg

SEQ ID NO: 174416 - RNA, 23 nt, Human
cugcccccucaagcugugggucu

SEQ ID NO: 174417 - RNA, 22 nt, Human
cugugggucuuugaacgagccu

SEQ ID NO: 174418 - RNA, 21 nt, Human
gagcccaggcugcugagauga

SEQ ID NO: 174419 - RNA, 18 nt, Human
gcacccccagggccacaa

SEQ ID NO: 174420 - RNA, 21 nt, Human
gcagagagaagauggggaggc

SEQ ID NO: 174421 - RNA, 21 nt, Human
gcagcagaggugacccuagga

SEQ ID NO: 174422 - RNA, 20 nt, Human
gccaagccaggcccaggagc

SEQ ID NO: 174423 - RNA, 19 nt, Human
gcccagcugccaggccuca

SEQ ID NO: 174424 - RNA, 21 nt, Human
gccuucucuuccuuguccucu

SEQ ID NO: 174425 - RNA, 25 nt, Human
gcugggccugcucagucauugccag

SEQ ID NO: 174426 - RNA, 24 nt, Human
gcuggggucacucccacauugagg

SEQ ID NO: 174427 - RNA, 19 nt, Human
gcuucucuuuugguaaaaa

SEQ ID NO: 174428 - RNA, 20 nt, Human
ggacacagguaggggacagc

SEQ ID NO: 174429 - RNA, 21 nt, Human
ggaggcaggaggcucuagccc

SEQ ID NO: 174430 - RNA, 18 nt, Human
ggcccagacugcuucucu

SEQ ID NO: 174431 - RNA, 23 nt, Human
ggcugcugagaugaggcguuccu

SEQ ID NO: 174432 - RNA, 20 nt, Human
ggggacacagguaggggaca

SEQ ID NO: 174433 - RNA, 18 nt, Human
ggggaggcaggaggcucu

SEQ ID NO: 174434 - RNA, 19 nt, Human
guccucuggggcugggccu

SEQ ID NO: 174435 - RNA, 21 nt, Human
gugacccuaggagguaagggc

SEQ ID NO: 174436 - RNA, 22 nt, Human
guuccugggcaucccucuccca

SEQ ID NO: 174437 - RNA, 23 nt, Human
uaagggcaacuuuuucaaggcug

SEQ ID NO: 174438 - RNA, 19 nt, Human
uccugcucuuuguguuuug

SEQ ID NO: 174439 - RNA, 23 nt, Human
ucuuugaacgagccuggugggaa

SEQ ID NO: 174440 - RNA, 22 nt, Human
ugagauggaguggccuccuuca

SEQ ID NO: 174441 - RNA, 23 nt, Human
ugagauggaguggccuccuucag

SEQ ID NO: 174442 - RNA, 19 nt, Human
ugaggcguuccugggcauc

SEQ ID NO: 174443 - RNA, 18 nt, Human
ugcagggcaggggaccau

SEQ ID NO: 174444 - RNA, 19 nt, Human
ugccaggccccaucagggg

SEQ ID NO: 174445 - RNA, 18 nt, Human
ugcccaggaggcacaaga

SEQ ID NO: 174446 - RNA, 18 nt, Human
ugccgagcccaggcugcu

SEQ ID NO: 174447 - RNA, 23 nt, Human
uggagcugcagggcaggggacca

SEQ ID NO: 174448 - RNA, 19 nt, Human
uggaguccugcucuuugug

SEQ ID NO: 174449 - RNA, 20 nt, Human
uggaguggccuccuucagcc

SEQ ID NO: 174450 - RNA, 22 nt, Human
uggccuccuucagcccuugccc

SEQ ID NO: 174451 - RNA, 20 nt, Human
uggcuggggucacucccaca

SEQ ID NO: 174452 - RNA, 23 nt, Human
uggcuggggucacucccacauug

SEQ ID NO: 174453 - RNA, 22 nt, Human
ugggaacagagcuaaucagcug

SEQ ID NO: 174454 - RNA, 24 nt, Human
ugggaacagagcuaaucagcuggg

SEQ ID NO: 174455 - RNA, 25 nt, Human
ugggcaucccucucccaaauguccu

SEQ ID NO: 174456 - RNA, 18 nt, Human
uggggaggcaggaggcuc

SEQ ID NO: 174457 - RNA, 21 nt, Human
ugggucuuugaacgagccugg

SEQ ID NO: 174458 - RNA, 22 nt, Human
uguggucagcuugagacaugga

SEQ ID NO: 174459 - RNA, 20 nt, Human
uuccuuggagauguuccuca

SEQ ID NO: 174460 - RNA, 21 nt, Human
uuccuuguccucuggggcugg

SEQ ID NO: 174461 - RNA, 21 nt, Human
uuccuuguccucuggggcugg

SEQ ID NO: 174462 - RNA, 19 nt, Human
uugccaggccccaucaggg

SEQ ID NO: 174463 - RNA, 21 nt, Human
uuggcccagcugccaggccuc

SEQ ID NO: 174464 - RNA, 25 nt, Human
uuuacaaaacaggagaaaagaguga

SEQ ID NO: 174465 - RNA, 20 nt, Human
uuuccuggcagggcaucugg

SEQ ID NO: 174466 - RNA, 20 nt, Human
aaaaagaacacuauuuccug

SEQ ID NO: 174467 - RNA, 20 nt, Human
aaaaggcauucccauaaacu

SEQ ID NO: 174468 - RNA, 20 nt, Human
aaacaguugugagccugguc

SEQ ID NO: 174469 - RNA, 23 nt, Human
aacacgcuuuuuuuuuuuccuuu

SEQ ID NO: 174470 - RNA, 22 nt, Human
aacagcauuucccuuggccccu

SEQ ID NO: 174471 - RNA, 18 nt, Human
aacaggauacuaaugggg

SEQ ID NO: 174472 - RNA, 21 nt, Human
aagacccuuggaaaccaugug

SEQ ID NO: 174473 - RNA, 20 nt, Human
aagacgccucuuuaacaugg

SEQ ID NO: 174474 - RNA, 20 nt, Human
acaggagaucuaguuauuau

SEQ ID NO: 174475 - RNA, 23 nt, Human
accuccagcugcuuccucguucu

SEQ ID NO: 174476 - RNA, 21 nt, Human
acuacuacaaaauuacaggag

SEQ ID NO: 174477 - RNA, 20 nt, Human
acucccgccuuuccucugca

SEQ ID NO: 174478 - RNA, 22 nt, Human
acucccgccuuuccucugcacc

SEQ ID NO: 174479 - RNA, 20 nt, Human
acuguccagaguccucgacu

SEQ ID NO: 174480 - RNA, 18 nt, Human
agaacaaacaagcuuuaa

SEQ ID NO: 174481 - RNA, 20 nt, Human
agccuggucacuuuaucuga

SEQ ID NO: 174482 - RNA, 18 nt, Human
aggcaggcugucggguga

SEQ ID NO: 174483 - RNA, 25 nt, Human
aggcggggaccggaucggcggggaa

SEQ ID NO: 174484 - RNA, 19 nt, Human
aggcgggggcagagugggg

SEQ ID NO: 174485 - RNA, 23 nt, Human
auauauacucuguuccuaaugug

SEQ ID NO: 174486 - RNA, 23 nt, Human
caaaacgcacagugugaauuucc

SEQ ID NO: 174487 - RNA, 21 nt, Human
caacuuuuuaaaaagaacacu

SEQ ID NO: 174488 - RNA, 21 nt, Human
caaucauugaaaucaugacac

SEQ ID NO: 174489 - RNA, 24 nt, Human
cacauagucuccccucccaccacc

SEQ ID NO: 174490 - RNA, 19 nt, Human
caucacuucagguggagaa

SEQ ID NO: 174491 - RNA, 24 nt, Human
ccacacucacuauacauguauaua

SEQ ID NO: 174492 - RNA, 28 nt, Human
ccucugcacagcgcccagcgauccgcuc

SEQ ID NO: 174493 - RNA, 23 nt, Human
ccuguaacaaugacucugcuacu

SEQ ID NO: 174494 - RNA, 18 nt, Human
cgagccgggcacucccgc

SEQ ID NO: 174495 - RNA, 19 nt, Human
cggaaggaaaaaaaaaagg

SEQ ID NO: 174496 - RNA, 22 nt, Human
cguugcucgcgggggcagcuag

SEQ ID NO: 174497 - RNA, 19 nt, Human
cucaccaacagcauuuccc

SEQ ID NO: 174498 - RNA, 21 nt, Human
cucggcucggcccugacaggc

SEQ ID NO: 174499 - RNA, 24 nt, Human
cucuaauauaaauacaaaucucac

SEQ ID NO: 174500 - RNA, 24 nt, Human
cugcccggcgucaccuccagcugc

SEQ ID NO: 174501 - RNA, 23 nt, Human
cuguacauauauacucuguuccu

SEQ ID NO: 174502 - RNA, 21 nt, Human
gagaucuucagaaggucuucg

SEQ ID NO: 174503 - RNA, 21 nt, Human
gagggugugacuugucauuug

SEQ ID NO: 174504 - RNA, 20 nt, Human
gccagacagagagcguaaga

SEQ ID NO: 174505 - RNA, 25 nt, Human
gccucuacuguccagaguccucgac

SEQ ID NO: 174506 - RNA, 19 nt, Human
gccuguguguuucagcaac

SEQ ID NO: 174507 - RNA, 20 nt, Human
ggcagaguggggaggcgggg

SEQ ID NO: 174508 - RNA, 19 nt, Human
ggcgggggcagagugggga

SEQ ID NO: 174509 - RNA, 21 nt, Human
gggcagaguggggaggcgggg

SEQ ID NO: 174510 - RNA, 21 nt, Human
gggggcagcuagucggcggag

SEQ ID NO: 174511 - RNA, 20 nt, Human
gguaggcgggggcagagugg

SEQ ID NO: 174512 - RNA, 23 nt, Human
guccagaguccucgacugguccg

SEQ ID NO: 174513 - RNA, 24 nt, Human
uaaaauacagccauaguacaccug

SEQ ID NO: 174514 - RNA, 20 nt, Human
uaacuagaacaaacaagcuu

SEQ ID NO: 174515 - RNA, 22 nt, Human
uaacuagaacaaacaagcuuua

SEQ ID NO: 174516 - RNA, 20 nt, Human
uaagauacauuacaaauggg

SEQ ID NO: 174517 - RNA, 21 nt, Human
uaaguaagguuuuaacaauau

SEQ ID NO: 174518 - RNA, 23 nt, Human
uaaugugcaacuuuuuaaaaaga

SEQ ID NO: 174519 - RNA, 21 nt, Human
uacaaaugggaagaaaauaca

SEQ ID NO: 174520 - RNA, 22 nt, Human
uagaacaaacaagcuuuaagua

SEQ ID NO: 174521 - RNA, 24 nt, Human
uagaaguauuuuauuuccaaaaag

SEQ ID NO: 174522 - RNA, 18 nt, Human
uagucggcggagcggcgg

SEQ ID NO: 174523 - RNA, 20 nt, Human
uauuauguuuucccucaaug

SEQ ID NO: 174524 - RNA, 24 nt, Human
ucacaaucaugcuuugguucugcu

SEQ ID NO: 174525 - RNA, 18 nt, Human
uccgggguaggcgggggc

SEQ ID NO: 174526 - RNA, 21 nt, Human
ucgguaacugcugaagguaaa

SEQ ID NO: 174527 - RNA, 23 nt, Human
ucggucgucccggggccucuacu

SEQ ID NO: 174528 - RNA, 18 nt, Human
ucucgcacgcgagcgcca

SEQ ID NO: 174529 - RNA, 28 nt, Human
ucucuuacagacaguaaaaugcuuaaau

SEQ ID NO: 174530 - RNA, 20 nt, Human
ucuggagugccagagggaaa

SEQ ID NO: 174531 - RNA, 18 nt, Human
ugaauauaaauaagcaaa

SEQ ID NO: 174532 - RNA, 22 nt, Human
ugacucugcuacuauuuucccc

SEQ ID NO: 174533 - RNA, 22 nt, Human
ugagaacaccagacguacagcc

SEQ ID NO: 174534 - RNA, 23 nt, Human
ugagaacaccagacguacagcca

SEQ ID NO: 174535 - RNA, 19 nt, Human
ugagaggagggaaaagaua

SEQ ID NO: 174536 - RNA, 21 nt, Human
ugaucuauuacuaagccacac

SEQ ID NO: 174537 - RNA, 19 nt, Human
ugcaguuaccaucaccucu

SEQ ID NO: 174538 - RNA, 19 nt, Human
ugcgacagcgagccgggca

SEQ ID NO: 174539 - RNA, 19 nt, Human
ugcuaacuagaacaaacaa

SEQ ID NO: 174540 - RNA, 19 nt, Human
uggagaaacgcugacagug

SEQ ID NO: 174541 - RNA, 24 nt, Human
uggcagcauguuuagcuccucggu

SEQ ID NO: 174542 - RNA, 24 nt, Human
uggccccuaggacauggcguuuug

SEQ ID NO: 174543 - RNA, 20 nt, Human
ugugagccuggucacuuuau

SEQ ID NO: 174544 - RNA, 21 nt, Human
uucccuucuucaaaaacaguu

SEQ ID NO: 174545 - RNA, 22 nt, Human
uuccuugggaggccccuggaaa

SEQ ID NO: 174546 - RNA, 24 nt, Human
uugaaaaacaguuuuccuggaguu

SEQ ID NO: 174547 - RNA, 23 nt, Human
uuuaggaggaagacccuuggaaa

SEQ ID NO: 174548 - RNA, 20 nt, Human
acuccagugaccagcagagc

SEQ ID NO: 174549 - RNA, 24 nt, Human
agaacagaagagcacgugcaaaug

SEQ ID NO: 174550 - RNA, 21 nt, Human
aggucgccagcgagugcgagc

SEQ ID NO: 174551 - RNA, 18 nt, Human
agugcgagcugcgggcgg

SEQ ID NO: 174552 - RNA, 21 nt, Human
cacaguguuugcauuuagcau

SEQ ID NO: 174553 - RNA, 23 nt, Human
cagaagagcacgugcaaaugaua

SEQ ID NO: 174554 - RNA, 19 nt, Human
cagcagagccaacaccuac

SEQ ID NO: 174555 - RNA, 18 nt, Human
caguagggggcuuagcug

SEQ ID NO: 174556 - RNA, 22 nt, Human
cccugcgcgcgcgugcgugccg

SEQ ID NO: 174557 - RNA, 22 nt, Human
cuccagugaccagcagagccaa

SEQ ID NO: 174558 - RNA, 23 nt, Human
cucggcuuggcccugcgccgguu

SEQ ID NO: 174559 - RNA, 19 nt, Human
cuuuguccauauucugaag

SEQ ID NO: 174560 - RNA, 21 nt, Human
gagccaacaccuacgauuuug

SEQ ID NO: 174561 - RNA, 20 nt, Human
gagugcgagcugcgggcggc

SEQ ID NO: 174562 - RNA, 25 nt, Human
gcggcugccucggcuuggcccugcg

SEQ ID NO: 174563 - RNA, 20 nt, Human
uacacaguguuugcauuuag

SEQ ID NO: 174564 - RNA, 23 nt, Human
uauauuugguaggaagaacaggu

SEQ ID NO: 174565 - RNA, 19 nt, Human
ugguaggaagaacagguug

SEQ ID NO: 174566 - RNA, 18 nt, Human
uguggcgggaggagggca

SEQ ID NO: 174567 - RNA, 19 nt, Human
uucuuuguccauauucuga

SEQ ID NO: 174568 - RNA, 21 nt, Human
uuggcagcuggugacacucca

SEQ ID NO: 174569 - RNA, 21 nt, Human
aaaauccgagccagagagccc

SEQ ID NO: 174570 - RNA, 23 nt, Human
aaggaccaaccaaguuucaacca

SEQ ID NO: 174571 - RNA, 26 nt, Human
agagagcccaaaaccuucccacagag

SEQ ID NO: 174572 - RNA, 24 nt, Human
agagcaacuucagccccagcuccc

SEQ ID NO: 174573 - RNA, 18 nt, Human
caaaaccuucccacagag

SEQ ID NO: 174574 - RNA, 18 nt, Human
caaaauccgagccagaga

SEQ ID NO: 174575 - RNA, 30 nt, Human
caagucccaaaguguggucuugucgagggg

SEQ ID NO: 174576 - RNA, 19 nt, Human
cacccccgaguggacaguc

SEQ ID NO: 174577 - RNA, 18 nt, Human
cacuccacccccgagugg

SEQ ID NO: 174578 - RNA, 19 nt, Human
cacucccuucuccucucuc

SEQ ID NO: 174579 - RNA, 19 nt, Human
ccacaguggaugcggcucc

SEQ ID NO: 174580 - RNA, 19 nt, Human
ccccagcucccaaguccca

SEQ ID NO: 174581 - RNA, 22 nt, Human
cccccgaguggacagucuggac

SEQ ID NO: 174582 - RNA, 18 nt, Human
cccccgaugguccucgug

SEQ ID NO: 174583 - RNA, 22 nt, Human
cgagggugcagacaaggaccaa

SEQ ID NO: 174584 - RNA, 19 nt, Human
cgaguggacagucuggacc

SEQ ID NO: 174585 - RNA, 21 nt, Human
cggccccucacucccuucucc

SEQ ID NO: 174586 - RNA, 19 nt, Human
cucccuucuccucucucuc

SEQ ID NO: 174587 - RNA, 22 nt, Human
cuucagccccagcucccaaguc

SEQ ID NO: 174588 - RNA, 18 nt, Human
gaaauaaaaauauagaua

SEQ ID NO: 174589 - RNA, 19 nt, Human
gcagcggccccucacuccc

SEQ ID NO: 174590 - RNA, 23 nt, Human
gcccucauaguagaaauaaaaau

SEQ ID NO: 174591 - RNA, 21 nt, Human
gcucagcuccagucucaagga

SEQ ID NO: 174592 - RNA, 21 nt, Human
ggcagcggccccucacucccu

SEQ ID NO: 174593 - RNA, 18 nt, Human
ggggggguugugcugggg

SEQ ID NO: 174594 - RNA, 22 nt, Human
guacagagcaacuucagcccca

SEQ ID NO: 174595 - RNA, 21 nt, Human
uaacaaaauagauugucucuu

SEQ ID NO: 174596 - RNA, 19 nt, Human
ucacucccuucuccucucu

SEQ ID NO: 174597 - RNA, 22 nt, Human
uccgagccagagagcccaaaac

SEQ ID NO: 174598 - RNA, 23 nt, Human
uccgagccagagagcccaaaacc

SEQ ID NO: 174599 - RNA, 22 nt, Human
ucucacuccacccccgagugga

SEQ ID NO: 174600 - RNA, 23 nt, Human
ucuccaacgaccugcccccgaug

SEQ ID NO: 174601 - RNA, 20 nt, Human
ucuccucucucucuuucucu

SEQ ID NO: 174602 - RNA, 21 nt, Human
ucuccucucucucuuucucuu

SEQ ID NO: 174603 - RNA, 23 nt, Human
ucucucguaugcagacgcucagc

SEQ ID NO: 174604 - RNA, 27 nt, Human
ucuucagucuccaacgaccugcccccg

SEQ ID NO: 174605 - RNA, 26 nt, Human
ugcaaguaacaaaauagauugucucu

SEQ ID NO: 174606 - RNA, 19 nt, Human
ugcugggggggaggggguu

SEQ ID NO: 174607 - RNA, 22 nt, Human
ugcugggggggaggggguucaa

SEQ ID NO: 174608 - RNA, 19 nt, Human
ugcuucccaucucgcucuc

SEQ ID NO: 174609 - RNA, 19 nt, Human
ugggggggaggggguucaa

SEQ ID NO: 174610 - RNA, 19 nt, Human
ugugcugggggggaggggg

SEQ ID NO: 174611 - RNA, 24 nt, Human
uguuuuggggggguugugcugggg

SEQ ID NO: 174612 - RNA, 20 nt, Human
uugaggcuuuagaaauuuau

SEQ ID NO: 174613 - RNA, 26 nt, Human
uuuguuuguuggcagcaacucaacag

SEQ ID NO: 174614 - RNA, 23 nt, Human
aaacgaagcauugcccggauccg

SEQ ID NO: 174615 - RNA, 20 nt, Human
acgccugcccggccagucug

SEQ ID NO: 174616 - RNA, 22 nt, Human
aggcugcugagucacgccugcc

SEQ ID NO: 174617 - RNA, 21 nt, Human
caacagcagcauccuuuagaa

SEQ ID NO: 174618 - RNA, 18 nt, Human
caaguccagggcgccgcu

SEQ ID NO: 174619 - RNA, 22 nt, Human
cacagagccagccgcgcucuag

SEQ ID NO: 174620 - RNA, 24 nt, Human
cagagcucagcacggcgcacccac

SEQ ID NO: 174621 - RNA, 19 nt, Human
cagcggcagucgguuaagu

SEQ ID NO: 174622 - RNA, 21 nt, Human
ccagagcucagcacggcgcac

SEQ ID NO: 174623 - RNA, 23 nt, Human
ccagucuguccuuccuggcccug

SEQ ID NO: 174624 - RNA, 24 nt, Human
ccccccccgccugccagucuccac

SEQ ID NO: 174625 - RNA, 25 nt, Human
cccugccgccaccgggccccuccuc

SEQ ID NO: 174626 - RNA, 25 nt, Human
cccugccgccaccgggccccuccuc

SEQ ID NO: 174627 - RNA, 22 nt, Human
ccuagccuaggccuuccugggc

SEQ ID NO: 174628 - RNA, 22 nt, Human
ccucgcucuccaggcgcccccc

SEQ ID NO: 174629 - RNA, 25 nt, Human
ccucgcucuccaggcgccccccccg

SEQ ID NO: 174630 - RNA, 24 nt, Human
cuagccuaggccuuccugggcgaa

SEQ ID NO: 174631 - RNA, 21 nt, Human
cuccucgggaggccgcgccuc

SEQ ID NO: 174632 - RNA, 18 nt, Human
cucgcucuccaggcgccc

SEQ ID NO: 174633 - RNA, 18 nt, Human
cugaaacuguaccaaguc

SEQ ID NO: 174634 - RNA, 19 nt, Human
cugaaacuguaccaagucc

SEQ ID NO: 174635 - RNA, 18 nt, Human
cugacagccagagcucag

SEQ ID NO: 174636 - RNA, 18 nt, Human
gccccggggcgucaccac

SEQ ID NO: 174637 - RNA, 26 nt, Human
gcccggccagucuguccuuccuggag

SEQ ID NO: 174638 - RNA, 20 nt, Human
gcugcugagucacgccugcc

SEQ ID NO: 174639 - RNA, 21 nt, Human
ggaccagccuggcccugccgc

SEQ ID NO: 174640 - RNA, 18 nt, Human
ggggcgucaccacgucga

SEQ ID NO: 174641 - RNA, 21 nt, Human
uagaaaacgaagcauugcccg

SEQ ID NO: 174642 - RNA, 18 nt, Human
uccuagccuaggccuucc

SEQ ID NO: 174643 - RNA, 22 nt, Human
uccucgggaggccgcgccuccu

SEQ ID NO: 174644 - RNA, 24 nt, Human
uccugggcgagcagccgcuccaga

SEQ ID NO: 174645 - RNA, 19 nt, Human
uccuuccuggcccugaggc

SEQ ID NO: 174646 - RNA, 22 nt, Human
ucuccaggcgccccccccgccu

SEQ ID NO: 174647 - RNA, 27 nt, Human
ucuccaggcgccccccccgccugccag

SEQ ID NO: 174648 - RNA, 18 nt, Human
ugacagccagagcucagc

SEQ ID NO: 174649 - RNA, 21 nt, Human
ugacagccagagcucagcacg

SEQ ID NO: 174650 - RNA, 23 nt, Human
ugcagaguccucagcucggacca

SEQ ID NO: 174651 - RNA, 19 nt, Human
ugccagucuccacgccgca

SEQ ID NO: 174652 - RNA, 18 nt, Human
ugccgagcgcaggcugcu

SEQ ID NO: 174653 - RNA, 19 nt, Human
ugcgaucaaccagcagcua

SEQ ID NO: 174654 - RNA, 23 nt, Human
ugcgaucaaccagcagcuaguua

SEQ ID NO: 174655 - RNA, 24 nt, Human
ugggcgagcagccgcuccagacac

SEQ ID NO: 174656 - RNA, 28 nt, Human
uucaacagcagcauccuuuagaaaacga

SEQ ID NO: 174657 - RNA, 19 nt, Human
uuuuuuuuuuuuuuuguuu

SEQ ID NO: 174658 - RNA, 19 nt, Human
aacacaggagcagccugaa

SEQ ID NO: 174659 - RNA, 23 nt, Human
auggucaaauuuccaacacagga

SEQ ID NO: 174660 - RNA, 25 nt, Human
caaauuuccaacacaggagcagccu

SEQ ID NO: 174661 - RNA, 21 nt, Human
caacacaggagcagccugaac

SEQ ID NO: 174662 - RNA, 22 nt, Human
caacacaggagcagccugaacc

SEQ ID NO: 174663 - RNA, 25 nt, Human
cacaacuucagccccugggaggacu

SEQ ID NO: 174664 - RNA, 19 nt, Human
ccccugggaggacuggcug

SEQ ID NO: 174665 - RNA, 18 nt, Human
cgacugcacacucucaca

SEQ ID NO: 174666 - RNA, 20 nt, Human
gcuguaaagcuuuauuggga

SEQ ID NO: 174667 - RNA, 21 nt, Human
uuuuuuuuuuugcagaaggcu

SEQ ID NO: 174668 - RNA, 21 nt, Human
uuuuuuuuuuuuuuuuugcag

SEQ ID NO: 174669 - RNA, 20 nt, Human
uuuuuuuuuuuuuuuuuugg

SEQ ID NO: 174670 - RNA, 23 nt, Human
agagaauuuucaaauuuucaguc

SEQ ID NO: 174671 - RNA, 18 nt, Human
ucaaauuuucagucacau

SEQ ID NO: 174672 - RNA, 19 nt, Human
ugaagggaagagaaguggc

SEQ ID NO: 174673 - RNA, 22 nt, Human
ugacaucagccauguguguagc

SEQ ID NO: 174674 - RNA, 18 nt, Human
uggcgaagaaugaaggga

SEQ ID NO: 174675 - RNA, 22 nt, Human
ugugacaucagccaugugugua

SEQ ID NO: 174676 - RNA, 27 nt, Human
aaagaauccagaccucagggacccgag

SEQ ID NO: 174677 - RNA, 22 nt, Human
aagaauccagaccucagggacc

SEQ ID NO: 174678 - RNA, 20 nt, Human
acucucacucacacuucaac

SEQ ID NO: 174679 - RNA, 22 nt, Human
cacugaccacacaacccuccgg

SEQ ID NO: 174680 - RNA, 24 nt, Human
ccacacaacccuccggaagccugc

SEQ ID NO: 174681 - RNA, 23 nt, Human
ccggaagccugcugguuccucuu

SEQ ID NO: 174682 - RNA, 18 nt, Human
ccuccggaagccugcugg

SEQ ID NO: 174683 - RNA, 25 nt, Human
ccuugcccuguccuaugcuccuucc

SEQ ID NO: 174684 - RNA, 18 nt, Human
cggagaaagaauccagac

SEQ ID NO: 174685 - RNA, 25 nt, Human
cucacacuucaacucccaguuggau

SEQ ID NO: 174686 - RNA, 21 nt, Human
cucccaguuggaucugccugu

SEQ ID NO: 174687 - RNA, 21 nt, Human
cucgugccuuaagggcugugg

SEQ ID NO: 174688 - RNA, 19 nt, Human
cugcaaaacuuuauugaga

SEQ ID NO: 174689 - RNA, 19 nt, Human
cugcaaaacuuuauugaga

SEQ ID NO: 174690 - RNA, 23 nt, Human
cuuaagggcuguggugccccucc

SEQ ID NO: 174691 - RNA, 20 nt, Human
gagucgccggcucacagcuc

SEQ ID NO: 174692 - RNA, 22 nt, Human
ggugccccuccuuaucccgccu

SEQ ID NO: 174693 - RNA, 20 nt, Human
gugagguucccucgugccuu

SEQ ID NO: 174694 - RNA, 23 nt, Human
guugcucuucaccugcuucuggc

SEQ ID NO: 174695 - RNA, 21 nt, Human
guuuguguguguccgccgugu

SEQ ID NO: 174696 - RNA, 18 nt, Human
ucaguagcggagaaagaa

SEQ ID NO: 174697 - RNA, 20 nt, Human
ugagucacugaccacacaac

SEQ ID NO: 174698 - RNA, 21 nt, Human
ugggacuggcugugugguucu

SEQ ID NO: 174699 - RNA, 21 nt, Human
ugggcuccugggacuggcugu

SEQ ID NO: 174700 - RNA, 19 nt, Human
uguguuuguguguguccgc

SEQ ID NO: 174701 - RNA, 18 nt, Human
uugcucuucaccugcuuc

SEQ ID NO: 174702 - RNA, 18 nt, Human
uuuguguguguccgccgu

SEQ ID NO: 174703 - RNA, 21 nt, Human
aaaaaggaaacaacaaucaga

SEQ ID NO: 174704 - RNA, 21 nt, Human
acccaggucccacgacggcuc

SEQ ID NO: 174705 - RNA, 21 nt, Human
caaacaccagggcccaugagc

SEQ ID NO: 174706 - RNA, 24 nt, Human
caccaaauaaaucacagacgugac

SEQ ID NO: 174707 - RNA, 18 nt, Human
cagcguggcccaccacgu

SEQ ID NO: 174708 - RNA, 21 nt, Human
ccacgcccgaaacaccaaaua

SEQ ID NO: 174709 - RNA, 23 nt, Human
ccacgggguccucacggugggga

SEQ ID NO: 174710 - RNA, 18 nt, Human
cccaccacgugccggggc

SEQ ID NO: 174711 - RNA, 25 nt, Human
gaggagcaugaaucagcuguuccuu

SEQ ID NO: 174712 - RNA, 19 nt, Human
gccacaccugcugucgccc

SEQ ID NO: 174713 - RNA, 19 nt, Human
gcggugcaaacaccagggc

SEQ ID NO: 174714 - RNA, 20 nt, Human
ggacccaggucccacgacgg

SEQ ID NO: 174715 - RNA, 21 nt, Human
ggagcaugaaucagcuguucc

SEQ ID NO: 174716 - RNA, 24 nt, Human
ggggcucggagccccacccuggcc

SEQ ID NO: 174717 - RNA, 20 nt, Human
gucccacgacggcucccaac

SEQ ID NO: 174718 - RNA, 20 nt, Human
guggagcugugugcgcagcc

SEQ ID NO: 174719 - RNA, 22 nt, Human
ucgggaggagaaaaaggaaaca

SEQ ID NO: 174720 - RNA, 22 nt, Human
ugaaucagcuguuccuucggga

SEQ ID NO: 174721 - RNA, 22 nt, Human
uggaaugcuuucucuucaugug

SEQ ID NO: 174722 - RNA, 21 nt, Human
uggccacaccugcugucgccc

SEQ ID NO: 174723 - RNA, 23 nt, Human
ugggcgggcggugacccggggcu

SEQ ID NO: 174724 - RNA, 18 nt, Human
ugucgcccacgggguccu

SEQ ID NO: 174725 - RNA, 23 nt, Human
uucaugugccuggaacgcugggc

SEQ ID NO: 174726 - RNA, 23 nt, Human
aaugauaacaacacaacaucaag

SEQ ID NO: 174727 - RNA, 27 nt, Human
acucaaaauaauuaccaaaaaaaaaaa

SEQ ID NO: 174728 - RNA, 19 nt, Human
caacaucaaggcaaagaga

SEQ ID NO: 174729 - RNA, 21 nt, Human
cacaacaucaaggcaaagaga

SEQ ID NO: 174730 - RNA, 24 nt, Human
cacacagacaaacaugcccaggag

SEQ ID NO: 174731 - RNA, 20 nt, Human
caccgcauggcgcggccggc

SEQ ID NO: 174732 - RNA, 19 nt, Human
caucaaggcaaagagaaca

SEQ ID NO: 174733 - RNA, 20 nt, Human
ccgccgccaccgccgccgcu

SEQ ID NO: 174734 - RNA, 21 nt, Human
ccgccgccaccgccgccgcug

SEQ ID NO: 174735 - RNA, 22 nt, Human
ccgccgccaccgccgccgcugc

SEQ ID NO: 174736 - RNA, 25 nt, Human
ccgggucccuccacguguccgccgc

SEQ ID NO: 174737 - RNA, 19 nt, Human
ccuccacguguccgccgcc

SEQ ID NO: 174738 - RNA, 23 nt, Human
cgggugggcucuggcggccuggg

SEQ ID NO: 174739 - RNA, 30 nt, Human
cucaaaauaauuaccaaaaaaaaaaaaucc

SEQ ID NO: 174740 - RNA, 19 nt, Human
gagcugcggcugcgcccgg

SEQ ID NO: 174741 - RNA, 22 nt, Human
gcacacagacaaacaugcccag

SEQ ID NO: 174742 - RNA, 24 nt, Human
gcccggguucggagcgucgggguc

SEQ ID NO: 174743 - RNA, 20 nt, Human
gccgccgccaccgccgccgc

SEQ ID NO: 174744 - RNA, 26 nt, Human
gggcagaaggcgcgggccgggucccu

SEQ ID NO: 174745 - RNA, 25 nt, Human
gggucccuccacguguccgccgccc

SEQ ID NO: 174746 - RNA, 24 nt, Human
guccgggugcgguggcgggucugg

SEQ ID NO: 174747 - RNA, 24 nt, Human
uaacaacacaacaucaaggcaaag

SEQ ID NO: 174748 - RNA, 18 nt, Human
uacagcacacagacaaac

SEQ ID NO: 174749 - RNA, 19 nt, Human
uacagcacacagacaaaca

SEQ ID NO: 174750 - RNA, 18 nt, Human
ugcgguggcgggucuggc

SEQ ID NO: 174751 - RNA, 19 nt, Human
ugcgguggcgggucugggc

SEQ ID NO: 174752 - RNA, 25 nt, Human
uuaaaugauaacaacacaacaucaa

SEQ ID NO: 174753 - RNA, 20 nt, Human
aaaacuuggaaucaaaaaaa

SEQ ID NO: 174754 - RNA, 21 nt, Human
aaacaagaauuggcucugaac

SEQ ID NO: 174755 - RNA, 26 nt, Human
aaacaagaauuggcucugaaccaaaa

SEQ ID NO: 174756 - RNA, 28 nt, Human
aaaccaaaaagaagggaagaaaauccag

SEQ ID NO: 174757 - RNA, 19 nt, Human
aagaaaccauucauaagaa

SEQ ID NO: 174758 - RNA, 21 nt, Human
aagcauaacagguugaagugg

SEQ ID NO: 174759 - RNA, 28 nt, Human
acagcacagugagaugaggcugaggaaa

SEQ ID NO: 174760 - RNA, 23 nt, Human
acgauagauacgggcaggaggcc

SEQ ID NO: 174761 - RNA, 18 nt, Human
acuccggcgcccagggag

SEQ ID NO: 174762 - RNA, 22 nt, Human
acuccggcgcccagggaggcgg

SEQ ID NO: 174763 - RNA, 20 nt, Human
agaaacugguggggaggaaa

SEQ ID NO: 174764 - RNA, 20 nt, Human
agaaauaagaaggaacaaac

SEQ ID NO: 174765 - RNA, 21 nt, Human
agaagggaagaaaauccagag

SEQ ID NO: 174766 - RNA, 21 nt, Human
agagaaccuucuggggugaug

SEQ ID NO: 174767 - RNA, 20 nt, Human
aggaggccgcugaugcugac

SEQ ID NO: 174768 - RNA, 21 nt, Human
aggcugaggaaacgacuacaa

SEQ ID NO: 174769 - RNA, 20 nt, Human
agugaugaucaaguuacugc

SEQ ID NO: 174770 - RNA, 24 nt, Human
auaaaaucuuccacaggguaaauu

SEQ ID NO: 174771 - RNA, 25 nt, Human
auaaaaucuuccacaggguaaauua

SEQ ID NO: 174772 - RNA, 23 nt, Human
aucaauggcugccaacaauuggg

SEQ ID NO: 174773 - RNA, 19 nt, Human
aucaucccacucaucauau

SEQ ID NO: 174774 - RNA, 19 nt, Human
aucuauuaccgcagaaaua

SEQ ID NO: 174775 - RNA, 21 nt, Human
augaagagagcuaccucagug

SEQ ID NO: 174776 - RNA, 19 nt, Human
augaauaacugauuugcua

SEQ ID NO: 174777 - RNA, 21 nt, Human
auuucucuccccuuuuacucu

SEQ ID NO: 174778 - RNA, 19 nt, Human
caaaaccaaaaagaaggga

SEQ ID NO: 174779 - RNA, 20 nt, Human
caaaacuucacuguagcuaa

SEQ ID NO: 174780 - RNA, 22 nt, Human
caaagaaaacuaaccuauagug

SEQ ID NO: 174781 - RNA, 21 nt, Human
caagagaaccuucugggguga

SEQ ID NO: 174782 - RNA, 19 nt, Human
caccuggaaaaacguucac

SEQ ID NO: 174783 - RNA, 22 nt, Human
caccuggaaaaacguucacaga

SEQ ID NO: 174784 - RNA, 24 nt, Human
caggguaaauuaaaaauaaauuuc

SEQ ID NO: 174785 - RNA, 23 nt, Human
cagugagaugaggcugaggaaac

SEQ ID NO: 174786 - RNA, 24 nt, Human
caucaucuugugaugaagacacug

SEQ ID NO: 174787 - RNA, 23 nt, Human
ccacucaucauauccugcauuuc

SEQ ID NO: 174788 - RNA, 26 nt, Human
ccacugaaucacacaacauggaccaa

SEQ ID NO: 174789 - RNA, 24 nt, Human
ccgccgccugcuggcuucucuucc

SEQ ID NO: 174790 - RNA, 19 nt, Human
ccuacaugaauaacugauu

SEQ ID NO: 174791 - RNA, 20 nt, Human
cgcucggcguugccaggaag

SEQ ID NO: 174792 - RNA, 20 nt, Human
cguugccaggaagccgagag

SEQ ID NO: 174793 - RNA, 19 nt, Human
cuaccauggcucuucccca

SEQ ID NO: 174794 - RNA, 23 nt, Human
cucuccccuuuuacucuucauua

SEQ ID NO: 174795 - RNA, 18 nt, Human
cugaagcuugacuggagu

SEQ ID NO: 174796 - RNA, 24 nt, Human
cugaugcugacgccgccgccgccu

SEQ ID NO: 174797 - RNA, 20 nt, Human
cugcuggcuucucuuccggc

SEQ ID NO: 174798 - RNA, 22 nt, Human
cuucagaaauaagaaggaacaa

SEQ ID NO: 174799 - RNA, 25 nt, Human
gaccaaucucaaaucauuaugcuga

SEQ ID NO: 174800 - RNA, 18 nt, Human
gcugacgccgccgccgcc

SEQ ID NO: 174801 - RNA, 20 nt, Human
ggcgggucccgucgccgcca

SEQ ID NO: 174802 - RNA, 22 nt, Human
ggggugauggaaauauucugaa

SEQ ID NO: 174803 - RNA, 23 nt, Human
uaaaaaaauacuuuuuagagcau

SEQ ID NO: 174804 - RNA, 20 nt, Human
uaaaucauacaacaugauga

SEQ ID NO: 174805 - RNA, 26 nt, Human
uaagaauacacaguacaugacgccgc

SEQ ID NO: 174806 - RNA, 25 nt, Human
uacaacagcauuggcuauaucaggu

SEQ ID NO: 174807 - RNA, 23 nt, Human
uacaagaccaaaacuuggaauca

SEQ ID NO: 174808 - RNA, 20 nt, Human
uaccucaguguuagcagcaa

SEQ ID NO: 174809 - RNA, 19 nt, Human
uauagugguuacaagacca

SEQ ID NO: 174810 - RNA, 26 nt, Human
uaucaauuuaucaaaacucacugaau

SEQ ID NO: 174811 - RNA, 23 nt, Human
uaucagguuuucuuccuucuucc

SEQ ID NO: 174812 - RNA, 21 nt, Human
uauucugaagcuugacuggag

SEQ ID NO: 174813 - RNA, 23 nt, Human
ucagugaugaucaaguuacugcc

SEQ ID NO: 174814 - RNA, 24 nt, Human
uccacacauaaggagagaaaagca

SEQ ID NO: 174815 - RNA, 22 nt, Human
uccuuccacacauaaggagaga

SEQ ID NO: 174816 - RNA, 21 nt, Human
ucucuccccuuuuacucuuca

SEQ ID NO: 174817 - RNA, 20 nt, Human
ucugaaccaaaaccaaaaag

SEQ ID NO: 174818 - RNA, 24 nt, Human
ugaaacaagaauuggcucugaacc

SEQ ID NO: 174819 - RNA, 24 nt, Human
ugaaaggaacugacugagcaggua

SEQ ID NO: 174820 - RNA, 24 nt, Human
ugaaccaaaaccaaaaagaaggga

SEQ ID NO: 174821 - RNA, 24 nt, Human
ugaauaacugauuugcuacauaga

SEQ ID NO: 174822 - RNA, 19 nt, Human
ugaaucacacaacauggac

SEQ ID NO: 174823 - RNA, 19 nt, Human
ugacgccgccgccgccugc

SEQ ID NO: 174824 - RNA, 21 nt, Human
ugagcagguauacaagagaac

SEQ ID NO: 174825 - RNA, 26 nt, Human
ugagugguccuaccauggcucuuccc

SEQ ID NO: 174826 - RNA, 28 nt, Human
ugcaaauaacccaauuaaucugcuaaua

SEQ ID NO: 174827 - RNA, 23 nt, Human
uggaaaaacguucacagagaguu

SEQ ID NO: 174828 - RNA, 18 nt, Human
uggaaagaaaccauucau

SEQ ID NO: 174829 - RNA, 22 nt, Human
uggaaagaaaccauucauaaga

SEQ ID NO: 174830 - RNA, 23 nt, Human
uggaaagaaaccauucauaagaa

SEQ ID NO: 174831 - RNA, 18 nt, Human
uggaacaaagaaaacuaa

SEQ ID NO: 174832 - RNA, 22 nt, Human
uggaacaaagaaaacuaaccua

SEQ ID NO: 174833 - RNA, 23 nt, Human
uggacacacggucagcaugcaua

SEQ ID NO: 174834 - RNA, 18 nt, Human
uggcucugaaccaaaacc

SEQ ID NO: 174835 - RNA, 22 nt, Human
uggggugauggaaauauucuga

SEQ ID NO: 174836 - RNA, 23 nt, Human
ugugugggucacaugacuccggc

SEQ ID NO: 174837 - RNA, 26 nt, Human
uguuaccagugcacaugugaggacag

SEQ ID NO: 174838 - RNA, 18 nt, Human
uguuuguuuuaaaaaaua

SEQ ID NO: 174839 - RNA, 18 nt, Human
uuagucucaaaagccuca

SEQ ID NO: 174840 - RNA, 20 nt, Human
uuagucucaaaagccucaua

SEQ ID NO: 174841 - RNA, 21 nt, Human
uucaccaguuuuccccuugga

SEQ ID NO: 174842 - RNA, 23 nt, Human
uucauaagaauacacaguacaug

SEQ ID NO: 174843 - RNA, 19 nt, Human
uucgaggucuguacuacuc

SEQ ID NO: 174844 - RNA, 20 nt, Human
uugcaaauaagaugaagaga

SEQ ID NO: 174845 - RNA, 21 nt, Human
uuguaguaucagaaacuggug

SEQ ID NO: 174846 - RNA, 18 nt, Human
uugugugggucacaugac

SEQ ID NO: 174847 - RNA, 23 nt, Human
uuuuaaaaucaucccacucauca

SEQ ID NO: 174848 - RNA, 22 nt, Human
aggcagcugcugcuuuuccugg

SEQ ID NO: 174849 - RNA, 23 nt, Human
aggcagcugcugcuuuuccuggu

SEQ ID NO: 174850 - RNA, 19 nt, Human
cagcagcuccagggcccug

SEQ ID NO: 174851 - RNA, 19 nt, Human
ccccagcagcuccagggcc

SEQ ID NO: 174852 - RNA, 19 nt, Human
cuccagggcccugaguucc

SEQ ID NO: 174853 - RNA, 22 nt, Human
cuggucaguggagcccuuggcc

SEQ ID NO: 174854 - RNA, 25 nt, Human
cuucuuuguccaaggugacugagga

SEQ ID NO: 174855 - RNA, 19 nt, Human
cuuggaguuggaaaagaug

SEQ ID NO: 174856 - RNA, 19 nt, Human
cuuggcuuggccccagcag

SEQ ID NO: 174857 - RNA, 19 nt, Human
gcuaagcgggcccagcugg

SEQ ID NO: 174858 - RNA, 22 nt, Human
ggugggcuaagcgggcccagcu

SEQ ID NO: 174859 - RNA, 26 nt, Human
gguuugagguaggggaggccuuggcu

SEQ ID NO: 174860 - RNA, 24 nt, Human
guggagcccuuggccucaugccug

SEQ ID NO: 174861 - RNA, 20 nt, Human
uccugguccuugguagggga

SEQ ID NO: 174862 - RNA, 22 nt, Human
ugaugaacucuuggacccugug

SEQ ID NO: 174863 - RNA, 20 nt, Human
ugccuggugggcuaagcggg

SEQ ID NO: 174864 - RNA, 21 nt, Human
uggaaaagauggaaucugagg

SEQ ID NO: 174865 - RNA, 24 nt, Human
uggagagcaggcagcugcugcuuu

SEQ ID NO: 174866 - RNA, 23 nt, Human
uggagcccuuggccucaugccug

SEQ ID NO: 174867 - RNA, 24 nt, Human
uggagcccuuggccucaugccugg

SEQ ID NO: 174868 - RNA, 20 nt, Human
uggccccagcagcuccaggg

SEQ ID NO: 174869 - RNA, 24 nt, Human
uuccugccagaggcuggagagcag

SEQ ID NO: 174870 - RNA, 22 nt, Human
uuugagguaggggaggccuugg

SEQ ID NO: 174871 - RNA, 21 nt, Human
aaggaggcaggcccagccuga

SEQ ID NO: 174872 - RNA, 19 nt, Human
accaaccaccagcccucac

SEQ ID NO: 174873 - RNA, 26 nt, Human
accaccagcccucaccccagccccag

SEQ ID NO: 174874 - RNA, 21 nt, Human
accagcccucaccccagcccc

SEQ ID NO: 174875 - RNA, 20 nt, Human
acccaaagauuugcaccgug

SEQ ID NO: 174876 - RNA, 23 nt, Human
accccagccccggggcaaagccg

SEQ ID NO: 174877 - RNA, 19 nt, Human
acccuugaacccccuuacc

SEQ ID NO: 174878 - RNA, 21 nt, Human
agcccucaccccagccccaga

SEQ ID NO: 174879 - RNA, 22 nt, Human
aggaagaggggugccuaaucua

SEQ ID NO: 174880 - RNA, 23 nt, Human
aggaagagugaggaacuagaggc

SEQ ID NO: 174881 - RNA, 22 nt, Human
aggacaguguuuccaccuuagg

SEQ ID NO: 174882 - RNA, 19 nt, Human
aggaccaugacccuugaac

SEQ ID NO: 174883 - RNA, 24 nt, Human
aggcagcggcaaaauuucgguccg

SEQ ID NO: 174884 - RNA, 21 nt, Human
caaccaccagcccucacccca

SEQ ID NO: 174885 - RNA, 23 nt, Human
caaccaccagcccucaccccagc

SEQ ID NO: 174886 - RNA, 26 nt, Human
caccccagccccagagccacaaguuc

SEQ ID NO: 174887 - RNA, 19 nt, Human
cacccccucggucccaagg

SEQ ID NO: 174888 - RNA, 21 nt, Human
cagccugacagucagaaaucc

SEQ ID NO: 174889 - RNA, 18 nt, Human
cagcgcggcucagcuccc

SEQ ID NO: 174890 - RNA, 19 nt, Human
cagcgcggggagggcucug

SEQ ID NO: 174891 - RNA, 20 nt, Human
cagcgcggggagggcucugg

SEQ ID NO: 174892 - RNA, 20 nt, Human
caugaagugagucuaggugu

SEQ ID NO: 174893 - RNA, 20 nt, Human
cauuaaggaagaggggugcc

SEQ ID NO: 174894 - RNA, 21 nt, Human
ccaaccaccagcccucacccc

SEQ ID NO: 174895 - RNA, 18 nt, Human
ccaccaggccucugggca

SEQ ID NO: 174896 - RNA, 24 nt, Human
ccagccccagagccacaaguucuc

SEQ ID NO: 174897 - RNA, 24 nt, Human
ccagccccggggcaaagccgggga

SEQ ID NO: 174898 - RNA, 23 nt, Human
cccacagcauugcagagacacaa

SEQ ID NO: 174899 - RNA, 23 nt, Human
ccccagagccacaaguucucucu

SEQ ID NO: 174900 - RNA, 19 nt, Human
cccccauuuccugccccau

SEQ ID NO: 174901 - RNA, 25 nt, Human
ccccccauuuccugccccaugagaa

SEQ ID NO: 174902 - RNA, 19 nt, Human
ccgccgcccggcucuucgc

SEQ ID NO: 174903 - RNA, 19 nt, Human
cggcaaaauuucgguccgg

SEQ ID NO: 174904 - RNA, 20 nt, Human
cuccaggagcucacugaccc

SEQ ID NO: 174905 - RNA, 18 nt, Human
cucccggcucguugcggc

SEQ ID NO: 174906 - RNA, 20 nt, Human
cucccggcucguugcggcug

SEQ ID NO: 174907 - RNA, 20 nt, Human
cucugggcacuggaaaaagg

SEQ ID NO: 174908 - RNA, 21 nt, Human
cucuucuccaggagcucacug

SEQ ID NO: 174909 - RNA, 20 nt, Human
cugaagaugcagaugagggg

SEQ ID NO: 174910 - RNA, 21 nt, Human
cugcccgggggcgguuggcgg

SEQ ID NO: 174911 - RNA, 23 nt, Human
cuggagcgcgcccgaucccuccc

SEQ ID NO: 174912 - RNA, 24 nt, Human
cuggugccccuucuuuugugccca

SEQ ID NO: 174913 - RNA, 19 nt, Human
cuguugcaccccagccccg

SEQ ID NO: 174914 - RNA, 23 nt, Human
cuguugcaccccagccccggggc

SEQ ID NO: 174915 - RNA, 23 nt, Human
gaggcaggcccagccucccaagg

SEQ ID NO: 174916 - RNA, 20 nt, Human
gccacaaguucucucugugg

SEQ ID NO: 174917 - RNA, 18 nt, Human
gccccgggccugaggguc

SEQ ID NO: 174918 - RNA, 20 nt, Human
gcccgggggcgguuggcggg

SEQ ID NO: 174919 - RNA, 25 nt, Human
gcccucaccccagccccagagccac

SEQ ID NO: 174920 - RNA, 18 nt, Human
gcgcggggagggcucugg

SEQ ID NO: 174921 - RNA, 19 nt, Human
gcggggcgcgaggaccaag

SEQ ID NO: 174922 - RNA, 19 nt, Human
gcgguggugguucuggccg

SEQ ID NO: 174923 - RNA, 18 nt, Human
ggaggcaggcccagccug

SEQ ID NO: 174924 - RNA, 21 nt, Human
ggagggcucuggccgccgccc

SEQ ID NO: 174925 - RNA, 18 nt, Human
gggcaucagguucugaaa

SEQ ID NO: 174926 - RNA, 19 nt, Human
gggcugugccgggcucucg

SEQ ID NO: 174927 - RNA, 24 nt, Human
gggguuuguuggaaauuccuggca

SEQ ID NO: 174928 - RNA, 19 nt, Human
ggguccucauggggcuggg

SEQ ID NO: 174929 - RNA, 21 nt, Human
guggagugcaggagggcccug

SEQ ID NO: 174930 - RNA, 23 nt, Human
guggggguggggcuggagcaggu

SEQ ID NO: 174931 - RNA, 20 nt, Human
ucauguggagugcaggaggg

SEQ ID NO: 174932 - RNA, 19 nt, Human
uccccacccccucgguccc

SEQ ID NO: 174933 - RNA, 21 nt, Human
ucccuggcuccgcgucccacu

SEQ ID NO: 174934 - RNA, 22 nt, Human
ucuccaggagcucacugacccu

SEQ ID NO: 174935 - RNA, 22 nt, Human
ugaacccccuuaccuaacguaa

SEQ ID NO: 174936 - RNA, 23 nt, Human
ugaccucaucauguggagugcag

SEQ ID NO: 174937 - RNA, 20 nt, Human
ugagagcuuuggaauccaug

SEQ ID NO: 174938 - RNA, 18 nt, Human
ugagaggacaguguuucc

SEQ ID NO: 174939 - RNA, 19 nt, Human
ugaggaacuagaggcucag

SEQ ID NO: 174940 - RNA, 22 nt, Human
ugaggguccucauggggcuggg

SEQ ID NO: 174941 - RNA, 19 nt, Human
ugcaccccagccccggggc

SEQ ID NO: 174942 - RNA, 18 nt, Human
uggaacucccggggcuuu

SEQ ID NO: 174943 - RNA, 24 nt, Human
uggcagcgcggggagggcucuggc

SEQ ID NO: 174944 - RNA, 24 nt, Human
ugggauuauguguuggggaacuuc

SEQ ID NO: 174945 - RNA, 19 nt, Human
ugggggacccuccugccuc

SEQ ID NO: 174946 - RNA, 18 nt, Human
uggggguggggcuggagc

SEQ ID NO: 174947 - RNA, 23 nt, Human
ugguucuggccguuuccugcccg

SEQ ID NO: 174948 - RNA, 21 nt, Human
ugucuccucucuucuccagga

SEQ ID NO: 174949 - RNA, 18 nt, Human
uguggagugcaggagggc

SEQ ID NO: 174950 - RNA, 23 nt, Human
ugugggggacccuccugccucug

SEQ ID NO: 174951 - RNA, 18 nt, Human
ugugugaugaggaccaug

SEQ ID NO: 174952 - RNA, 24 nt, Human
uguugcaccccagccccggggcaa

SEQ ID NO: 174953 - RNA, 24 nt, Human
uucaccaaccaccagcccucaccc

SEQ ID NO: 174954 - RNA, 25 nt, Human
uucaccaaccaccagcccucacccc

SEQ ID NO: 174955 - RNA, 18 nt, Human
uuccugcccgggggcggu

SEQ ID NO: 174956 - RNA, 24 nt, Human
uuucaccaaccaccagcccucacc

SEQ ID NO: 174957 - RNA, 26 nt, Human
uuuuguggagcgcggcgcgguggugg

SEQ ID NO: 174958 - RNA, 19 nt, Human
acuggccugcaggccccgc

SEQ ID NO: 174959 - RNA, 18 nt, Human
agcucugcacagcugcuc

SEQ ID NO: 174960 - RNA, 18 nt, Human
caccgggcacagagccgu

SEQ ID NO: 174961 - RNA, 18 nt, Human
cagccccgucggcgcggg

SEQ ID NO: 174962 - RNA, 20 nt, Human
cagcugcuccggcacagccc

SEQ ID NO: 174963 - RNA, 18 nt, Human
caggccccgcacccucac

SEQ ID NO: 174964 - RNA, 23 nt, Human
ccccgcacccucaccgugugcug

SEQ ID NO: 174965 - RNA, 26 nt, Human
cccgcacccucaccgugugcuguccu

SEQ ID NO: 174966 - RNA, 19 nt, Human
cgcgccugcagcucugcac

SEQ ID NO: 174967 - RNA, 21 nt, Human
cucugcacagcugcuccggca

SEQ ID NO: 174968 - RNA, 18 nt, Human
cugcacagcugcuccggc

SEQ ID NO: 174969 - RNA, 21 nt, Human
cuggccugcaggccccgcacc

SEQ ID NO: 174970 - RNA, 21 nt, Human
gcaccgggcacagagccgugg

SEQ ID NO: 174971 - RNA, 18 nt, Human
gcgccugcagcucugcac

SEQ ID NO: 174972 - RNA, 21 nt, Human
gcgcgccugcagcucugcaca

SEQ ID NO: 174973 - RNA, 23 nt, Human
ucaccgugugcuguccugggggu

SEQ ID NO: 174974 - RNA, 19 nt, Human
ugcacagcugcuccggccg

SEQ ID NO: 174975 - RNA, 19 nt, Human
uggcaccgggcacagagcc

SEQ ID NO: 174976 - RNA, 22 nt, Human
uggccugcaggccccgcacccu

SEQ ID NO: 174977 - RNA, 18 nt, Human
aaacagaaggaagauuaa

SEQ ID NO: 174978 - RNA, 24 nt, Human
uaagugcccuaaguaguuucucuc

SEQ ID NO: 174979 - RNA, 21 nt, Human
aacauagcuacaaugauaaga

SEQ ID NO: 174980 - RNA, 24 nt, Human
aacauagcuacaaugauaagaagc

SEQ ID NO: 174981 - RNA, 18 nt, Human
aagaagcuacacgccucc

SEQ ID NO: 174982 - RNA, 22 nt, Human
accaauguacgccauacacaua

SEQ ID NO: 174983 - RNA, 24 nt, Human
ccagcgagccgaccuagcgagcgu

SEQ ID NO: 174984 - RNA, 22 nt, Human
ccccagccaccucgggcaccug

SEQ ID NO: 174985 - RNA, 24 nt, Human
ccuguugucaggaccuccugaggc

SEQ ID NO: 174986 - RNA, 19 nt, Human
cgcggagccccggccagcg

SEQ ID NO: 174987 - RNA, 24 nt, Human
cucccuaagauguauaaaggcaaa

SEQ ID NO: 174988 - RNA, 19 nt, Human
cuuggcaaaauaaacugag

SEQ ID NO: 174989 - RNA, 22 nt, Human
gacucaaucguguauucagugg

SEQ ID NO: 174990 - RNA, 23 nt, Human
gcgucugcaggugcugucugucu

SEQ ID NO: 174991 - RNA, 21 nt, Human
ggaaauuccuuguggacaaag

SEQ ID NO: 174992 - RNA, 20 nt, Human
ggagauucuaggccuggccu

SEQ ID NO: 174993 - RNA, 23 nt, Human
ggcacuugcagggccaacuggag

SEQ ID NO: 174994 - RNA, 22 nt, Human
ggcgaggaggagggccaagcac

SEQ ID NO: 174995 - RNA, 24 nt, Human
ggcgugagacggcaggguccugag

SEQ ID NO: 174996 - RNA, 24 nt, Human
uaaacugagacuggucucagauau

SEQ ID NO: 174997 - RNA, 25 nt, Human
uaacauagcuacaaugauaagaagc

SEQ ID NO: 174998 - RNA, 21 nt, Human
uauuugggguucacaaaggcg

SEQ ID NO: 174999 - RNA, 24 nt, Human
ucacugggccagacucaaucgugu

SEQ ID NO: 175000 - RNA, 22 nt, Human
ucaguggaaggcugacugaacc

SEQ ID NO: 175001 - RNA, 22 nt, Human
uccccagccaccucgggcaccu

SEQ ID NO: 175002 - RNA, 18 nt, Human
ucccucuggggcuccccu

SEQ ID NO: 175003 - RNA, 25 nt, Human
ucccucuggggcuccccugagacaa

SEQ ID NO: 175004 - RNA, 26 nt, Human
uccuuguggacaaaggacagacggaa

SEQ ID NO: 175005 - RNA, 22 nt, Human
ucucccuaagauguauaaaggc

SEQ ID NO: 175006 - RNA, 22 nt, Human
ucugcaggugcugucugucugg

SEQ ID NO: 175007 - RNA, 23 nt, Human
ugauaagaagcuacacgccuccc

SEQ ID NO: 175008 - RNA, 21 nt, Human
ugccccguucccuuacuguuu

SEQ ID NO: 175009 - RNA, 18 nt, Human
uggaaggcugacugaacc

SEQ ID NO: 175010 - RNA, 18 nt, Human
uuccuccaggcacuugca

SEQ ID NO: 175011 - RNA, 24 nt, Human
aaaaaaaaucagaggacaauaaaa

SEQ ID NO: 175012 - RNA, 18 nt, Human
aaaaaaagcagcagauaa

SEQ ID NO: 175013 - RNA, 22 nt, Human
aaaagaaaugcaagccuauuaa

SEQ ID NO: 175014 - RNA, 23 nt, Human
aaaagcauccaugacuaucacag

SEQ ID NO: 175015 - RNA, 22 nt, Human
aaaaugccaauuaaacauuuuc

SEQ ID NO: 175016 - RNA, 22 nt, Human
aaacaaaaaaaacuguagagag

SEQ ID NO: 175017 - RNA, 22 nt, Human
aaacaaauguggaacaguagca

SEQ ID NO: 175018 - RNA, 23 nt, Human
aaacaacagaacugaagauuuau

SEQ ID NO: 175019 - RNA, 23 nt, Human
aaauaauuuauugauuagacauc

SEQ ID NO: 175020 - RNA, 21 nt, Human
aacagcccacaaaccaaacaa

SEQ ID NO: 175021 - RNA, 19 nt, Human
aacauucuuaggcacaaga

SEQ ID NO: 175022 - RNA, 24 nt, Human
aacuuggcaaauaucauuagcgag

SEQ ID NO: 175023 - RNA, 19 nt, Human
aagcuaugcuggaguacaa

SEQ ID NO: 175024 - RNA, 18 nt, Human
acaaaaccuuaaaucaca

SEQ ID NO: 175025 - RNA, 24 nt, Human
accaaacaaaaaaaacuguagaga

SEQ ID NO: 175026 - RNA, 21 nt, Human
accccaaggaaaauaaaagca

SEQ ID NO: 175027 - RNA, 23 nt, Human
agaggacaauaaaacugauuuag

SEQ ID NO: 175028 - RNA, 23 nt, Human
agaucagacauuguuaaauuucc

SEQ ID NO: 175029 - RNA, 21 nt, Human
agcccacaaaccaaacaaaaa

SEQ ID NO: 175030 - RNA, 18 nt, Human
aggaaggcugguucacag

SEQ ID NO: 175031 - RNA, 20 nt, Human
aucacagaugaaaacaaaau

SEQ ID NO: 175032 - RNA, 19 nt, Human
augaaagaaaauauaugca

SEQ ID NO: 175033 - RNA, 18 nt, Human
augcuggaguacaaaaac

SEQ ID NO: 175034 - RNA, 21 nt, Human
augcuggaguacaaaaaccug

SEQ ID NO: 175035 - RNA, 22 nt, Human
caaaaaaaacuguagagagaaa

SEQ ID NO: 175036 - RNA, 18 nt, Human
caaauuuccuggggacau

SEQ ID NO: 175037 - RNA, 19 nt, Human
cacguucagcagaaacuac

SEQ ID NO: 175038 - RNA, 21 nt, Human
cacuuuuccuuuuuugcuacu

SEQ ID NO: 175039 - RNA, 22 nt, Human
cagcccacaaaccaaacaaaaa

SEQ ID NO: 175040 - RNA, 23 nt, Human
cauagaagguacaguucuccaga

SEQ ID NO: 175041 - RNA, 18 nt, Human
cccacaaaccaaacaaaa

SEQ ID NO: 175042 - RNA, 21 nt, Human
cccacaaaccaaacaaaaaaa

SEQ ID NO: 175043 - RNA, 18 nt, Human
ccuggggacaugguuuau

SEQ ID NO: 175044 - RNA, 19 nt, Human
cgaugcgacuuuuggaaac

SEQ ID NO: 175045 - RNA, 20 nt, Human
cucauggaaaaggaaaaaaa

SEQ ID NO: 175046 - RNA, 20 nt, Human
cucccauuuaaaacaaaacc

SEQ ID NO: 175047 - RNA, 22 nt, Human
cuguagagagaaauuaaaacua

SEQ ID NO: 175048 - RNA, 19 nt, Human
cugugaaaacaaaugugga

SEQ ID NO: 175049 - RNA, 21 nt, Human
cuuguaaacaucagugugcac

SEQ ID NO: 175050 - RNA, 23 nt, Human
gaaaagaauuccauuaaauauaa

SEQ ID NO: 175051 - RNA, 20 nt, Human
gagaaagacucuuucaaucu

SEQ ID NO: 175052 - RNA, 25 nt, Human
gagaaagacucuuucaaucuuguaa

SEQ ID NO: 175053 - RNA, 21 nt, Human
gccaguugacccaagagcaac

SEQ ID NO: 175054 - RNA, 27 nt, Human
gcuggaguacaaaaaccugaaauucug

SEQ ID NO: 175055 - RNA, 21 nt, Human
ggaggaaagcacuuuuccuuu

SEQ ID NO: 175056 - RNA, 23 nt, Human
gugcaagcaaaccauagaaggua

SEQ ID NO: 175057 - RNA, 20 nt, Human
uaaaaaaagcagcagauaaa

SEQ ID NO: 175058 - RNA, 18 nt, Human
uaaaacaaaaccuuaaau

SEQ ID NO: 175059 - RNA, 29 nt, Human
uaaucaggaaaaaaaaucuuggaaaucuc

SEQ ID NO: 175060 - RNA, 20 nt, Human
uaauugacaacuuuucaauu

SEQ ID NO: 175061 - RNA, 20 nt, Human
uauuuuguauuuucaaagua

SEQ ID NO: 175062 - RNA, 23 nt, Human
uauuuuguauuuucaaaguauuu

SEQ ID NO: 175063 - RNA, 24 nt, Human
uccuuuuuugcuacuuaagaaugu

SEQ ID NO: 175064 - RNA, 21 nt, Human
ucuaaucaggaaaaaaaaucu

SEQ ID NO: 175065 - RNA, 20 nt, Human
ucuccagaaagcauauuuug

SEQ ID NO: 175066 - RNA, 23 nt, Human
ucuccagaaagcauauuuuguua

SEQ ID NO: 175067 - RNA, 19 nt, Human
ucugagcaugaaaauaauu

SEQ ID NO: 175068 - RNA, 19 nt, Human
ugaaaacaaauguggaaca

SEQ ID NO: 175069 - RNA, 24 nt, Human
ugaaagaaaauauaugcauuuuug

SEQ ID NO: 175070 - RNA, 19 nt, Human
ugacagcacguucagcaga

SEQ ID NO: 175071 - RNA, 23 nt, Human
ugacccaagagcaacugaaacau

SEQ ID NO: 175072 - RNA, 21 nt, Human
ugcacauguaaaucuguaagc

SEQ ID NO: 175073 - RNA, 25 nt, Human
ugcauuuuugccaacagacugcucu

SEQ ID NO: 175074 - RNA, 23 nt, Human
uggaaucauaaacaacagaacca

SEQ ID NO: 175075 - RNA, 20 nt, Human
uggaguacaaaaaccugaaa

SEQ ID NO: 175076 - RNA, 20 nt, Human
ugucucaguauucuuuacca

SEQ ID NO: 175077 - RNA, 19 nt, Human
ugugaaaacaaauguggaa

SEQ ID NO: 175078 - RNA, 20 nt, Human
ugugugcacauguaaaucug

SEQ ID NO: 175079 - RNA, 18 nt, Human
ugugugugugugcacaug

SEQ ID NO: 175080 - RNA, 20 nt, Human
ugugugugugugcacaugua

SEQ ID NO: 175081 - RNA, 27 nt, Human
uuaaaaaaugccaauuaaacauuuuca

SEQ ID NO: 175082 - RNA, 23 nt, Human
uuaucuccaaauacccaaauaau

SEQ ID NO: 175083 - RNA, 23 nt, Human
uuccaacagcccacaaaccaaac

SEQ ID NO: 175084 - RNA, 22 nt, Human
uuccaguucuuuuauuuuucua

SEQ ID NO: 175085 - RNA, 24 nt, Human
uuggaaucaguuauuuuuccccac

SEQ ID NO: 175086 - RNA, 21 nt, Human
uuugugugugugugcacaugu

SEQ ID NO: 175087 - RNA, 24 nt, Human
uuuucagcucaauuucagcacccc

SEQ ID NO: 175088 - RNA, 24 nt, Human
aaacauaaucaauaaugcgaucac

SEQ ID NO: 175089 - RNA, 18 nt, Human
aaccugggugcugggggc

SEQ ID NO: 175090 - RNA, 22 nt, Human
aagggcucuuaggaaagaauuc

SEQ ID NO: 175091 - RNA, 22 nt, Human
aaggggcaaaggauucgucaga

SEQ ID NO: 175092 - RNA, 24 nt, Human
aaguaucuucucuuuauuuaaguu

SEQ ID NO: 175093 - RNA, 19 nt, Human
aagugauaucugucaaaau

SEQ ID NO: 175094 - RNA, 24 nt, Human
aauacuagcgugugacagcugccu

SEQ ID NO: 175095 - RNA, 18 nt, Human
acaagggucuggguagac

SEQ ID NO: 175096 - RNA, 20 nt, Human
acagaaacuaacgcaaccgc

SEQ ID NO: 175097 - RNA, 18 nt, Human
acagcugccuggcaucau

SEQ ID NO: 175098 - RNA, 23 nt, Human
accauacgugauuucgaagggau

SEQ ID NO: 175099 - RNA, 24 nt, Human
accgagaggagggggagggcaguu

SEQ ID NO: 175100 - RNA, 25 nt, Human
agaaaagaaauuuaauguaaaaaga

SEQ ID NO: 175101 - RNA, 23 nt, Human
agacacacaguggcccuuucaua

SEQ ID NO: 175102 - RNA, 22 nt, Human
agagaccuauagggcagccucc

SEQ ID NO: 175103 - RNA, 19 nt, Human
agaguucuccucgcucccc

SEQ ID NO: 175104 - RNA, 19 nt, Human
agaugacgaugaucuacag

SEQ ID NO: 175105 - RNA, 21 nt, Human
agccaauacuagcgugugaca

SEQ ID NO: 175106 - RNA, 21 nt, Human
aggaagacacuugcgaaugga

SEQ ID NO: 175107 - RNA, 21 nt, Human
aggaagaggggcgcuccggcc

SEQ ID NO: 175108 - RNA, 19 nt, Human
agggggaggggagucuggc

SEQ ID NO: 175109 - RNA, 24 nt, Human
agggggcagcgguauugcuggcuc

SEQ ID NO: 175110 - RNA, 22 nt, Human
agggggcccggcuggcugcacc

SEQ ID NO: 175111 - RNA, 23 nt, Human
agguauuguuugguucugacccu

SEQ ID NO: 175112 - RNA, 24 nt, Human
aguccccacacccaccccacccag

SEQ ID NO: 175113 - RNA, 20 nt, Human
aguggcaggggugaggagga

SEQ ID NO: 175114 - RNA, 22 nt, Human
aguugcuucuaccacuccccag

SEQ ID NO: 175115 - RNA, 20 nt, Human
auccaaggccgccgcugucc

SEQ ID NO: 175116 - RNA, 20 nt, Human
auccauuucccuccuuacag

SEQ ID NO: 175117 - RNA, 22 nt, Human
caaaggaccccuccccggccca

SEQ ID NO: 175118 - RNA, 21 nt, Human
cacaagggucuggguagacac

SEQ ID NO: 175119 - RNA, 23 nt, Human
cacacccugcucuggccugcacu

SEQ ID NO: 175120 - RNA, 22 nt, Human
caccaggacagacucuggccag

SEQ ID NO: 175121 - RNA, 21 nt, Human
cacccaccccacccagccuuc

SEQ ID NO: 175122 - RNA, 19 nt, Human
cacccagccuucacacacc

SEQ ID NO: 175123 - RNA, 20 nt, Human
cacccagccuucacacaccg

SEQ ID NO: 175124 - RNA, 19 nt, Human
caccccacccagccuucac

SEQ ID NO: 175125 - RNA, 24 nt, Human
caccccacccagccuucacacacc

SEQ ID NO: 175126 - RNA, 19 nt, Human
cagaucacaaugaagccaa

SEQ ID NO: 175127 - RNA, 21 nt, Human
cagcaaagagcgguaucuaga

SEQ ID NO: 175128 - RNA, 21 nt, Human
cagcacagagaagacaacuaa

SEQ ID NO: 175129 - RNA, 19 nt, Human
caggacugugagccaggcc

SEQ ID NO: 175130 - RNA, 19 nt, Human
cagguggcuccuaauccaa

SEQ ID NO: 175131 - RNA, 20 nt, Human
caguagcaccaacuggcugg

SEQ ID NO: 175132 - RNA, 25 nt, Human
cauaaaauggacaaaguacuagcuc

SEQ ID NO: 175133 - RNA, 19 nt, Human
ccaaucccaguccccacac

SEQ ID NO: 175134 - RNA, 21 nt, Human
ccaaucccaguccccacaccc

SEQ ID NO: 175135 - RNA, 23 nt, Human
cccacacccaccccacccagccu

SEQ ID NO: 175136 - RNA, 26 nt, Human
cccacacccaccccacccagccuuca

SEQ ID NO: 175137 - RNA, 24 nt, Human
cccaccccacccagccuucacaca

SEQ ID NO: 175138 - RNA, 19 nt, Human
cccaccgugaaagacagaa

SEQ ID NO: 175139 - RNA, 21 nt, Human
cccaccgugaaagacagaagc

SEQ ID NO: 175140 - RNA, 21 nt, Human
ccccaaagcccccugaagcag

SEQ ID NO: 175141 - RNA, 20 nt, Human
ccccaaucccaguccccaca

SEQ ID NO: 175142 - RNA, 22 nt, Human
ccccacccagccuucacacacc

SEQ ID NO: 175143 - RNA, 25 nt, Human
ccccauaccgggcucuggccccuuc

SEQ ID NO: 175144 - RNA, 26 nt, Human
cccuguccucagcucgcacgcauccg

SEQ ID NO: 175145 - RNA, 19 nt, Human
ccgcaaaggaccccucccc

SEQ ID NO: 175146 - RNA, 20 nt, Human
ccggggccgaggccgguggu

SEQ ID NO: 175147 - RNA, 20 nt, Human
ccugcucuugacgcccggac

SEQ ID NO: 175148 - RNA, 21 nt, Human
cgagaggagggggagggcagu

SEQ ID NO: 175149 - RNA, 19 nt, Human
cgcacacccugcucuggcc

SEQ ID NO: 175150 - RNA, 28 nt, Human
cggagagagaccuauagggcagccucca

SEQ ID NO: 175151 - RNA, 19 nt, Human
cggccuggggaagggggcc

SEQ ID NO: 175152 - RNA, 21 nt, Human
cuaauucuuuccccaaagccc

SEQ ID NO: 175153 - RNA, 23 nt, Human
cucaccgcaaaggaccccucccc

SEQ ID NO: 175154 - RNA, 25 nt, Human
cuccccggcccaccccugcucuuga

SEQ ID NO: 175155 - RNA, 23 nt, Human
cucgcuccccuggggcaugugug

SEQ ID NO: 175156 - RNA, 18 nt, Human
cucucaggcugacgccca

SEQ ID NO: 175157 - RNA, 27 nt, Human
cucuggccugcacuccacagcucgcac

SEQ ID NO: 175158 - RNA, 20 nt, Human
cucuuaggaaagaauucuga

SEQ ID NO: 175159 - RNA, 20 nt, Human
cugcgggcggggcaggacuc

SEQ ID NO: 175160 - RNA, 19 nt, Human
cugcuggccauuaauucug

SEQ ID NO: 175161 - RNA, 20 nt, Human
cuggccauuaauucugaagg

SEQ ID NO: 175162 - RNA, 22 nt, Human
cugugugugcggcgcuggagaa

SEQ ID NO: 175163 - RNA, 19 nt, Human
gaaccugggugcugggggc

SEQ ID NO: 175164 - RNA, 23 nt, Human
gaagacacuugcgaauggaggag

SEQ ID NO: 175165 - RNA, 21 nt, Human
gaagccccccagcuggccaca

SEQ ID NO: 175166 - RNA, 22 nt, Human
gaaggaagaggggcgcuccggc

SEQ ID NO: 175167 - RNA, 24 nt, Human
gacagacucuggccagcaaagagc

SEQ ID NO: 175168 - RNA, 18 nt, Human
gagccagauucauccauu

SEQ ID NO: 175169 - RNA, 19 nt, Human
gaguggaggaggaagcagg

SEQ ID NO: 175170 - RNA, 18 nt, Human
gauucauccauuucccuc

SEQ ID NO: 175171 - RNA, 23 nt, Human
gcaaaacauacucacagauacca

SEQ ID NO: 175172 - RNA, 22 nt, Human
gcacagucguccgugccuugcc

SEQ ID NO: 175173 - RNA, 23 nt, Human
gcaccggcacacucccagguggc

SEQ ID NO: 175174 - RNA, 21 nt, Human
gcagccuccagccaggcuucc

SEQ ID NO: 175175 - RNA, 20 nt, Human
gcccaggaagacacuugcga

SEQ ID NO: 175176 - RNA, 18 nt, Human
gcccauucacacacaucu

SEQ ID NO: 175177 - RNA, 21 nt, Human
gcgcuccggccuggggaaggg

SEQ ID NO: 175178 - RNA, 19 nt, Human
gcgggguaaaggugaaggg

SEQ ID NO: 175179 - RNA, 21 nt, Human
ggaagacacacaguggcccuu

SEQ ID NO: 175180 - RNA, 20 nt, Human
ggaagcugcgaacggcuuug

SEQ ID NO: 175181 - RNA, 21 nt, Human
ggagggagcugcgggcggggc

SEQ ID NO: 175182 - RNA, 18 nt, Human
ggcagccuccagccaggc

SEQ ID NO: 175183 - RNA, 22 nt, Human
ggccaggaguggaggaggaagc

SEQ ID NO: 175184 - RNA, 20 nt, Human
ggccuggggaagggggcccg

SEQ ID NO: 175185 - RNA, 25 nt, Human
gggaggaagacacacaguggcccuu

SEQ ID NO: 175186 - RNA, 19 nt, Human
gggcccggcuggcugcacc

SEQ ID NO: 175187 - RNA, 25 nt, Human
gggccgaggccgguggucuggagga

SEQ ID NO: 175188 - RNA, 20 nt, Human
ggggcuacgcacacccugcu

SEQ ID NO: 175189 - RNA, 24 nt, Human
gggugugggagggagcugcgggcg

SEQ ID NO: 175190 - RNA, 20 nt, Human
ggucugacagaagaaccugg

SEQ ID NO: 175191 - RNA, 22 nt, Human
ggugugggagggagcugcgggc

SEQ ID NO: 175192 - RNA, 23 nt, Human
gucaaaauaaguaaccgucuccc

SEQ ID NO: 175193 - RNA, 21 nt, Human
gucuggguagacacgugggau

SEQ ID NO: 175194 - RNA, 19 nt, Human
guuuuaaaaacaggagugg

SEQ ID NO: 175195 - RNA, 21 nt, Human
uaaaauggacaaaguacuagc

SEQ ID NO: 175196 - RNA, 20 nt, Human
uaaacauagcucaccgcaaa

SEQ ID NO: 175197 - RNA, 21 nt, Human
uaagaaacauaaucaauaaug

SEQ ID NO: 175198 - RNA, 26 nt, Human
uaaugcgaucaccagacuccacccaa

SEQ ID NO: 175199 - RNA, 23 nt, Human
uacgcacacccugcucuggccug

SEQ ID NO: 175200 - RNA, 19 nt, Human
uagaagccaggcaccucuc

SEQ ID NO: 175201 - RNA, 18 nt, Human
uagcagcucgcaggucac

SEQ ID NO: 175202 - RNA, 21 nt, Human
ucaauguaaacauagcucacc

SEQ ID NO: 175203 - RNA, 22 nt, Human
ucagaccaugauggaauacuga

SEQ ID NO: 175204 - RNA, 20 nt, Human
ucccagguggcuccuaaucc

SEQ ID NO: 175205 - RNA, 22 nt, Human
ucccaguccccacacccacccc

SEQ ID NO: 175206 - RNA, 22 nt, Human
uccccacacccaccccacccag

SEQ ID NO: 175207 - RNA, 18 nt, Human
ucccccaggccagcaggu

SEQ ID NO: 175208 - RNA, 21 nt, Human
uccuacagugcaacauguggg

SEQ ID NO: 175209 - RNA, 18 nt, Human
ucgcugggugucacucag

SEQ ID NO: 175210 - RNA, 24 nt, Human
ucugaaggcccagcgugcagggcu

SEQ ID NO: 175211 - RNA, 21 nt, Human
ucugaguuuuaaaaacaggag

SEQ ID NO: 175212 - RNA, 22 nt, Human
ucugcacagucguccgugccuu

SEQ ID NO: 175213 - RNA, 26 nt, Human
ucugugguuuaacaggaccccaaggc

SEQ ID NO: 175214 - RNA, 19 nt, Human
ugaaaauggagauuucaag

SEQ ID NO: 175215 - RNA, 19 nt, Human
ugacgcccaacagggaugc

SEQ ID NO: 175216 - RNA, 23 nt, Human
ugauuucgaagggauugaaaaug

SEQ ID NO: 175217 - RNA, 19 nt, Human
ugcaggagacaggacggca

SEQ ID NO: 175218 - RNA, 24 nt, Human
uggcacacugugucaauguaaaca

SEQ ID NO: 175219 - RNA, 21 nt, Human
uggcaccggcacacucccagg

SEQ ID NO: 175220 - RNA, 18 nt, Human
uggcaggggaggcggaga

SEQ ID NO: 175221 - RNA, 18 nt, Human
uggcaggggugaggagga

SEQ ID NO: 175222 - RNA, 22 nt, Human
uggcccaggaagacacuugcga

SEQ ID NO: 175223 - RNA, 19 nt, Human
uggcuccuaauccaaggcc

SEQ ID NO: 175224 - RNA, 22 nt, Human
uggcugcaccgagaggaggggg

SEQ ID NO: 175225 - RNA, 18 nt, Human
ugggugcugggggcuacg

SEQ ID NO: 175226 - RNA, 19 nt, Human
uguaaaaagacccaaagug

SEQ ID NO: 175227 - RNA, 25 nt, Human
uguaaaaagacccaaagugauaucu

SEQ ID NO: 175228 - RNA, 19 nt, Human
uguaaacauagcucaccgc

SEQ ID NO: 175229 - RNA, 23 nt, Human
ugucacucaguugcggaccggca

SEQ ID NO: 175230 - RNA, 20 nt, Human
ugucucccgcccugaauccu

SEQ ID NO: 175231 - RNA, 26 nt, Human
ugugacagcugccuggcaucauuggu

SEQ ID NO: 175232 - RNA, 22 nt, Human
uucaaggaugguuuccauucau

SEQ ID NO: 175233 - RNA, 20 nt, Human
uucacagauacgcacagcac

SEQ ID NO: 175234 - RNA, 20 nt, Human
uucauacaagacacagggag

SEQ ID NO: 175235 - RNA, 19 nt, Human
uucauccauuucccuccuu

SEQ ID NO: 175236 - RNA, 23 nt, Human
uucucagcuccccccgagcgccc

SEQ ID NO: 175237 - RNA, 18 nt, Human
uucuugccgcugaugugu

SEQ ID NO: 175238 - RNA, 18 nt, Human
uuucaaggaugguuucca

SEQ ID NO: 175239 - RNA, 18 nt, Human
uuucaaggaugguuucca

SEQ ID NO: 175240 - RNA, 22 nt, Human
aaaauacucuucuccuuauuca

SEQ ID NO: 175241 - RNA, 21 nt, Human
aaaauucauuuucccccaccu

SEQ ID NO: 175242 - RNA, 21 nt, Human
aaaccaaacgcaaaaaaaagu

SEQ ID NO: 175243 - RNA, 23 nt, Human
aaagugcugggauuagaagcuga

SEQ ID NO: 175244 - RNA, 21 nt, Human
aagaaaaaaaauacuagaaga

SEQ ID NO: 175245 - RNA, 23 nt, Human
aagaauccauuacaaagucaaaa

SEQ ID NO: 175246 - RNA, 20 nt, Human
aaggaaaaggacaccuuuuc

SEQ ID NO: 175247 - RNA, 23 nt, Human
aaggaaaaggacaccuuuucaac

SEQ ID NO: 175248 - RNA, 24 nt, Human
aagugcugggauuagaagcugagc

SEQ ID NO: 175249 - RNA, 25 nt, Human
aagugcugggauuagaagcugagcc

SEQ ID NO: 175250 - RNA, 19 nt, Human
aaguggaguguauuacaga

SEQ ID NO: 175251 - RNA, 23 nt, Human
aauacuagaagaaaggaaaagga

SEQ ID NO: 175252 - RNA, 19 nt, Human
aaucauagcucacuguagc

SEQ ID NO: 175253 - RNA, 20 nt, Human
acaagaauacaggagaucua

SEQ ID NO: 175254 - RNA, 19 nt, Human
acuacagaugcgugccacc

SEQ ID NO: 175255 - RNA, 20 nt, Human
agaaaaaaaauacuagaaga

SEQ ID NO: 175256 - RNA, 25 nt, Human
agaaaaaaaauacuagaagaaagga

SEQ ID NO: 175257 - RNA, 21 nt, Human
agaaaaaugcacuuggaauaa

SEQ ID NO: 175258 - RNA, 22 nt, Human
agaagcugagccaccaugucca

SEQ ID NO: 175259 - RNA, 22 nt, Human
agacaaguaaaccaaacgcaaa

SEQ ID NO: 175260 - RNA, 24 nt, Human
agacugaagugcagugguguaauc

SEQ ID NO: 175261 - RNA, 23 nt, Human
agccucgaucucccaagcucaag

SEQ ID NO: 175262 - RNA, 23 nt, Human
aguauaugcucuuuuucguacag

SEQ ID NO: 175263 - RNA, 21 nt, Human
agugcagugguguaaucauag

SEQ ID NO: 175264 - RNA, 23 nt, Human
agugcagugguguaaucauagcu

SEQ ID NO: 175265 - RNA, 24 nt, Human
agugcagugguguaaucauagcuc

SEQ ID NO: 175266 - RNA, 23 nt, Human
agugcugggauuagaagcugagc

SEQ ID NO: 175267 - RNA, 22 nt, Human
aguuaaaaaaauacaguaacaa

SEQ ID NO: 175268 - RNA, 24 nt, Human
auagcucacuguagccucgaucuc

SEQ ID NO: 175269 - RNA, 24 nt, Human
auagucuuugguauuacuaguuau

SEQ ID NO: 175270 - RNA, 25 nt, Human
auguaggcuuuuuuuuuuuuuugaa

SEQ ID NO: 175271 - RNA, 24 nt, Human
auuuugcuauguugcccaggcugg

SEQ ID NO: 175272 - RNA, 20 nt, Human
caaaaaaaaguucaccugca

SEQ ID NO: 175273 - RNA, 18 nt, Human
caaaacacacaaacauca

SEQ ID NO: 175274 - RNA, 21 nt, Human
caaagugcugggauuagaagc

SEQ ID NO: 175275 - RNA, 23 nt, Human
caaagugcugggauuagaagcug

SEQ ID NO: 175276 - RNA, 19 nt, Human
caaaugauccucccaccuu

SEQ ID NO: 175277 - RNA, 22 nt, Human
caagaaauuuaaguguuaaaaa

SEQ ID NO: 175278 - RNA, 20 nt, Human
cacacaguaucauuacuuaa

SEQ ID NO: 175279 - RNA, 18 nt, Human
caccauguccagcucaga

SEQ ID NO: 175280 - RNA, 24 nt, Human
cacuuggaauaaguuacauuuagc

SEQ ID NO: 175281 - RNA, 25 nt, Human
cagaauuucuguaguagugcuacau

SEQ ID NO: 175282 - RNA, 22 nt, Human
ccaaagugcugggauuagaagc

SEQ ID NO: 175283 - RNA, 23 nt, Human
ccaaagugcugggauuagaagcu

SEQ ID NO: 175284 - RNA, 19 nt, Human
ccaagcucaagcaaugcuu

SEQ ID NO: 175285 - RNA, 20 nt, Human
ccaccacaccuagguaauuu

SEQ ID NO: 175286 - RNA, 18 nt, Human
ccagccacgcggaccugu

SEQ ID NO: 175287 - RNA, 22 nt, Human
ccucccaccuuugccuaccaaa

SEQ ID NO: 175288 - RNA, 26 nt, Human
cucaaaugauccucccaccuuugccu

SEQ ID NO: 175289 - RNA, 21 nt, Human
cuuccccagccacgcggaccu

SEQ ID NO: 175290 - RNA, 23 nt, Human
gaaaaggacaccuuuucaacaga

SEQ ID NO: 175291 - RNA, 24 nt, Human
gaacuccugagcucaaaugauccu

SEQ ID NO: 175292 - RNA, 19 nt, Human
gcuauguugcccaggcugg

SEQ ID NO: 175293 - RNA, 20 nt, Human
gcuauguugcccaggcuggu

SEQ ID NO: 175294 - RNA, 23 nt, Human
gcuggucuggaacuccugagcuc

SEQ ID NO: 175295 - RNA, 20 nt, Human
ggcuuuuuuuuuuuuuugaa

SEQ ID NO: 175296 - RNA, 21 nt, Human
guauuacagacuaaaaaaugu

SEQ ID NO: 175297 - RNA, 20 nt, Human
uaacagcagugugaaaacgg

SEQ ID NO: 175298 - RNA, 24 nt, Human
uaagaaaaaugcacuuggaauaag

SEQ ID NO: 175299 - RNA, 22 nt, Human
uaagaaaagucauuuaaggaag

SEQ ID NO: 175300 - RNA, 21 nt, Human
uaaggaacuuuaucagaaauu

SEQ ID NO: 175301 - RNA, 20 nt, Human
uaagugcuucaaguggagug

SEQ ID NO: 175302 - RNA, 22 nt, Human
uacagaugcgugccaccacacc

SEQ ID NO: 175303 - RNA, 23 nt, Human
uacaguaacaaaucuuucuuccu

SEQ ID NO: 175304 - RNA, 24 nt, Human
uacaguaacaaaucuuucuuccua

SEQ ID NO: 175305 - RNA, 22 nt, Human
uagagaugagauuuugcuaugu

SEQ ID NO: 175306 - RNA, 24 nt, Human
uagcucacuguagccucgaucucc

SEQ ID NO: 175307 - RNA, 18 nt, Human
uauaaauaagaaaaaugc

SEQ ID NO: 175308 - RNA, 25 nt, Human
uauccccccaaaaaacuaggggaaa

SEQ ID NO: 175309 - RNA, 19 nt, Human
uauguugcccaggcugguc

SEQ ID NO: 175310 - RNA, 22 nt, Human
uauguugcccaggcuggucugg

SEQ ID NO: 175311 - RNA, 23 nt, Human
uauguugcccaggcuggucugga

SEQ ID NO: 175312 - RNA, 24 nt, Human
uauguugcccaggcuggucuggaa

SEQ ID NO: 175313 - RNA, 24 nt, Human
ucacuguagccucgaucucccaag

SEQ ID NO: 175314 - RNA, 21 nt, Human
uccccagccacgcggaccugu

SEQ ID NO: 175315 - RNA, 19 nt, Human
ucuggaacuccugagcuca

SEQ ID NO: 175316 - RNA, 24 nt, Human
ucuugcucagucacacagacugaa

SEQ ID NO: 175317 - RNA, 24 nt, Human
ugaaaagaauccauuacaaaguca

SEQ ID NO: 175318 - RNA, 21 nt, Human
ugaaacagaaacuugcagaau

SEQ ID NO: 175319 - RNA, 19 nt, Human
ugacgaaaaacaaaaaaaa

SEQ ID NO: 175320 - RNA, 19 nt, Human
ugacgaaaaacaaaaaaaa

SEQ ID NO: 175321 - RNA, 21 nt, Human
ugacgaaaaacaaaaaaaaaa

SEQ ID NO: 175322 - RNA, 24 nt, Human
ugagauuuugcuauguugcccagg

SEQ ID NO: 175323 - RNA, 22 nt, Human
ugcagugguguaaucauagcuc

SEQ ID NO: 175324 - RNA, 20 nt, Human
ugccaagaaauuuaaguguu

SEQ ID NO: 175325 - RNA, 24 nt, Human
ugcccaggcuggucuggaacuccu

SEQ ID NO: 175326 - RNA, 28 nt, Human
ugcccaggcuggucuggaacuccugagc

SEQ ID NO: 175327 - RNA, 21 nt, Human
ugccucaccuuccuguauagc

SEQ ID NO: 175328 - RNA, 24 nt, Human
ugccucaccuuccuguauagcugg

SEQ ID NO: 175329 - RNA, 22 nt, Human
ugcuauguugcccaggcugguc

SEQ ID NO: 175330 - RNA, 27 nt, Human
ugcuauguugcccaggcuggucuggaa

SEQ ID NO: 175331 - RNA, 21 nt, Human
uggaacuacagaugcgugcca

SEQ ID NO: 175332 - RNA, 24 nt, Human
uggaacuacagaugcgugccacca

SEQ ID NO: 175333 - RNA, 22 nt, Human
uggaguguauuacagacuaaaa

SEQ ID NO: 175334 - RNA, 21 nt, Human
ugggauuagaagcugagccac

SEQ ID NO: 175335 - RNA, 23 nt, Human
ugggauuagaagcugagccacca

SEQ ID NO: 175336 - RNA, 18 nt, Human
ugguaagaaaaaaaauac

SEQ ID NO: 175337 - RNA, 24 nt, Human
ugguaagaaaaaaaauacuagaag

SEQ ID NO: 175338 - RNA, 23 nt, Human
ugguguaaucauagcucacugua

SEQ ID NO: 175339 - RNA, 24 nt, Human
ugguguaaucauagcucacuguag

SEQ ID NO: 175340 - RNA, 22 nt, Human
uguacaaaacacacaaacauca

SEQ ID NO: 175341 - RNA, 24 nt, Human
uguagagaugagauuuugcuaugu

SEQ ID NO: 175342 - RNA, 24 nt, Human
ugugugaauguagcuauauauaua

SEQ ID NO: 175343 - RNA, 24 nt, Human
uuacaaacaaacaaugagaagaua

SEQ ID NO: 175344 - RNA, 18 nt, Human
uuacagauuuuacccaaa

SEQ ID NO: 175345 - RNA, 23 nt, Human
uucaacagauaguaauuuauaaa

SEQ ID NO: 175346 - RNA, 23 nt, Human
uuccuguauagcuggaacuacag

SEQ ID NO: 175347 - RNA, 20 nt, Human
uucuggaucuguaaaagcuc

SEQ ID NO: 175348 - RNA, 24 nt, Human
uugcauaauuuucaaaaacuacag

SEQ ID NO: 175349 - RNA, 24 nt, Human
uuguagagaugagauuuugcuaug

SEQ ID NO: 175350 - RNA, 23 nt, Human
uugugaagcuuccccagccacgc

SEQ ID NO: 175351 - RNA, 22 nt, Human
uuuacccaaaagaggaauaagc

SEQ ID NO: 175352 - RNA, 21 nt, Human
uuuauuguguuuuccacauag

SEQ ID NO: 175353 - RNA, 25 nt, Human
uuucauuuuuuaauuuuuacuuuuu

SEQ ID NO: 175354 - RNA, 23 nt, Human
uuugguaagaaaaaaaauacuag

SEQ ID NO: 175355 - RNA, 24 nt, Human
uuuguagagaugagauuuugcuau

SEQ ID NO: 175356 - RNA, 21 nt, Human
uuuuaaacuaauaaauucugg

SEQ ID NO: 175357 - RNA, 19 nt, Human
uuuugcuauguugcccagg

SEQ ID NO: 175358 - RNA, 22 nt, Human
uuuugcuauguugcccaggcug

SEQ ID NO: 175359 - RNA, 23 nt, Human
uuuugcuauguugcccaggcugg

SEQ ID NO: 175360 - RNA, 27 nt, Human
uuuugcuauguugcccaggcuggucug

SEQ ID NO: 175361 - RNA, 23 nt, Human
uuuuuguagagaugagauuuugc

SEQ ID NO: 175362 - RNA, 22 nt, Human
uuuuuuuuuuuugaaagagucu

SEQ ID NO: 175363 - RNA, 21 nt, Human
aaaaauaaaaaucaaacugcc

SEQ ID NO: 175364 - RNA, 19 nt, Human
aaaguaguuucacguuugu

SEQ ID NO: 175365 - RNA, 19 nt, Human
aaagugcuggaauuacagg

SEQ ID NO: 175366 - RNA, 24 nt, Human
aaagugcuggaauuacaggcauga

SEQ ID NO: 175367 - RNA, 20 nt, Human
aaauguguagaaaugcauag

SEQ ID NO: 175368 - RNA, 21 nt, Human
aacaaaaaagauguaaacauc

SEQ ID NO: 175369 - RNA, 19 nt, Human
aaccccugaguguaauccc

SEQ ID NO: 175370 - RNA, 19 nt, Human
aacuuccaacccuuauggg

SEQ ID NO: 175371 - RNA, 25 nt, Human
aagcgauucucuugccucagccucc

SEQ ID NO: 175372 - RNA, 18 nt, Human
aagggauaacaauaacaa

SEQ ID NO: 175373 - RNA, 19 nt, Human
aaguagcugggauuacagg

SEQ ID NO: 175374 - RNA, 24 nt, Human
aaguagcugggauuacagguaugc

SEQ ID NO: 175375 - RNA, 26 nt, Human
aagugcuggaauuacaggcaugagcc

SEQ ID NO: 175376 - RNA, 22 nt, Human
aauuacaggcaugagccaccgc

SEQ ID NO: 175377 - RNA, 21 nt, Human
aauugccuucugaaagcccau

SEQ ID NO: 175378 - RNA, 23 nt, Human
aauuuauagguuauauuucccuc

SEQ ID NO: 175379 - RNA, 24 nt, Human
acaaagcaaggauaugggaauuau

SEQ ID NO: 175380 - RNA, 21 nt, Human
accaaguuagagaagagcuag

SEQ ID NO: 175381 - RNA, 24 nt, Human
acccagguuggagugcaauggcau

SEQ ID NO: 175382 - RNA, 22 nt, Human
acccuuaugggacagccuuggg

SEQ ID NO: 175383 - RNA, 22 nt, Human
accuaaaaaacaagcaacccag

SEQ ID NO: 175384 - RNA, 19 nt, Human
accuuggcuaauaaccugu

SEQ ID NO: 175385 - RNA, 23 nt, Human
acucugccucccaaagugcuggg

SEQ ID NO: 175386 - RNA, 26 nt, Human
acucugucacccagguuggagugcaa

SEQ ID NO: 175387 - RNA, 18 nt, Human
agaaaaccacaggaccca

SEQ ID NO: 175388 - RNA, 21 nt, Human
agagaaagcaauuguuaagug

SEQ ID NO: 175389 - RNA, 19 nt, Human
agauguaaacaucuacaaa

SEQ ID NO: 175390 - RNA, 20 nt, Human
agcuuucucccgcuccaggc

SEQ ID NO: 175391 - RNA, 18 nt, Human
aggcacaaauuaccaaca

SEQ ID NO: 175392 - RNA, 19 nt, Human
aggcacaaauuaccaacau

SEQ ID NO: 175393 - RNA, 24 nt, Human
aggcacuaaauguguugaaauuca

SEQ ID NO: 175394 - RNA, 25 nt, Human
aggugauccucccaacucugccucc

SEQ ID NO: 175395 - RNA, 19 nt, Human
aggugugaaaaggagaaac

SEQ ID NO: 175396 - RNA, 24 nt, Human
agguugcuaugaggugucugggau

SEQ ID NO: 175397 - RNA, 18 nt, Human
aguaaaucccaaauguca

SEQ ID NO: 175398 - RNA, 26 nt, Human
aguagcaaaauacaaauugacaauuc

SEQ ID NO: 175399 - RNA, 20 nt, Human
agugaugaagacaacgguac

SEQ ID NO: 175400 - RNA, 26 nt, Human
agugaugaagacaacgguacaaugga

SEQ ID NO: 175401 - RNA, 21 nt, Human
aguggauuucuuuaauugccu

SEQ ID NO: 175402 - RNA, 24 nt, Human
auacaguguaucaaaaucugcaua

SEQ ID NO: 175403 - RNA, 22 nt, Human
aucaucacaguuguuuuuuuuu

SEQ ID NO: 175404 - RNA, 24 nt, Human
auccucccaacucugccucccaaa

SEQ ID NO: 175405 - RNA, 24 nt, Human
aucuuuaaaacacaacaaaaaaga

SEQ ID NO: 175406 - RNA, 21 nt, Human
augggaaugcucaaauugugc

SEQ ID NO: 175407 - RNA, 25 nt, Human
auuuacaugcacaguucauugccac

SEQ ID NO: 175408 - RNA, 23 nt, Human
auuucccucuuaaauuaaaaaac

SEQ ID NO: 175409 - RNA, 24 nt, Human
auuuuuguauuuuuaguagagaca

SEQ ID NO: 175410 - RNA, 24 nt, Human
caaagugcuggaauuacaggcaug

SEQ ID NO: 175411 - RNA, 19 nt, Human
caacaugcuuuaacucugu

SEQ ID NO: 175412 - RNA, 19 nt, Human
caacuuacaaagcaaggau

SEQ ID NO: 175413 - RNA, 22 nt, Human
caagcgauucucuugccucagc

SEQ ID NO: 175414 - RNA, 22 nt, Human
caaguuagagaagagcuagggc

SEQ ID NO: 175415 - RNA, 19 nt, Human
caauggauccuuuuuuuuu

SEQ ID NO: 175416 - RNA, 21 nt, Human
cacaggacccaaguuucaccc

SEQ ID NO: 175417 - RNA, 21 nt, Human
cacaguuuaucaauguccuuc

SEQ ID NO: 175418 - RNA, 19 nt, Human
caccaacgacuaaagagaa

SEQ ID NO: 175419 - RNA, 24 nt, Human
caccaugcccagcuaauuuuugua

SEQ ID NO: 175420 - RNA, 19 nt, Human
caccuaaaaaacaagcaac

SEQ ID NO: 175421 - RNA, 24 nt, Human
caccuaaaaaacaagcaacccaga

SEQ ID NO: 175422 - RNA, 26 nt, Human
caccuaaaaaacaagcaacccagaau

SEQ ID NO: 175423 - RNA, 24 nt, Human
cacucugucacccagguuggagug

SEQ ID NO: 175424 - RNA, 21 nt, Human
cacugcaaccucugccuccug

SEQ ID NO: 175425 - RNA, 23 nt, Human
cacugcaaccucugccuccuggg

SEQ ID NO: 175426 - RNA, 22 nt, Human
cagaaccuggguugcuuguucc

SEQ ID NO: 175427 - RNA, 18 nt, Human
cagcagaaccuggguugc

SEQ ID NO: 175428 - RNA, 21 nt, Human
cagcagaaccuggguugcuug

SEQ ID NO: 175429 - RNA, 22 nt, Human
cagcugcuggguugagcuggag

SEQ ID NO: 175430 - RNA, 22 nt, Human
caguucauugccaccuuucuua

SEQ ID NO: 175431 - RNA, 21 nt, Human
cauuaacaugaaaaugucuuu

SEQ ID NO: 175432 - RNA, 24 nt, Human
ccaaacagacaauccaaguuaagg

SEQ ID NO: 175433 - RNA, 25 nt, Human
ccaaacagacaauccaaguuaaggc

SEQ ID NO: 175434 - RNA, 19 nt, Human
ccaaagugcuggaauuaca

SEQ ID NO: 175435 - RNA, 24 nt, Human
ccaaagugcuggaauuacaggcau

SEQ ID NO: 175436 - RNA, 21 nt, Human
ccaaguagcugggauuacagg

SEQ ID NO: 175437 - RNA, 24 nt, Human
ccaaguagcugggauuacagguau

SEQ ID NO: 175438 - RNA, 19 nt, Human
ccaggccagagagaaagca

SEQ ID NO: 175439 - RNA, 21 nt, Human
cccaaaugucaguggacaauu

SEQ ID NO: 175440 - RNA, 23 nt, Human
cccaaguagcugggauuacaggu

SEQ ID NO: 175441 - RNA, 24 nt, Human
cccaaguagcugggauuacaggua

SEQ ID NO: 175442 - RNA, 22 nt, Human
cccuagagaugaaaguuaaaau

SEQ ID NO: 175443 - RNA, 24 nt, Human
ccuccuggguucaagcgauucucu

SEQ ID NO: 175444 - RNA, 19 nt, Human
ccucugccuccuggguuca

SEQ ID NO: 175445 - RNA, 21 nt, Human
ccuggguucaagcgauucucu

SEQ ID NO: 175446 - RNA, 19 nt, Human
ccuucaagcuugcagcaga

SEQ ID NO: 175447 - RNA, 23 nt, Human
cuaacaccaacgacuaaagagaa

SEQ ID NO: 175448 - RNA, 19 nt, Human
cucaaaccccugacaucag

SEQ ID NO: 175449 - RNA, 24 nt, Human
cucacucugucacccagguuggag

SEQ ID NO: 175450 - RNA, 24 nt, Human
cucacugcaaccucugccuccugg

SEQ ID NO: 175451 - RNA, 24 nt, Human
cucagccucccaaguagcugggau

SEQ ID NO: 175452 - RNA, 18 nt, Human
cuccaggcuccuucaagc

SEQ ID NO: 175453 - RNA, 21 nt, Human
cuccuggguucaagcgauucu

SEQ ID NO: 175454 - RNA, 20 nt, Human
cuccuuucuguagcucccuu

SEQ ID NO: 175455 - RNA, 25 nt, Human
cucuuuaaguucacuuggagcugga

SEQ ID NO: 175456 - RNA, 19 nt, Human
cugcaaccucugccuccug

SEQ ID NO: 175457 - RNA, 23 nt, Human
cugcaaccucugccuccuggguu

SEQ ID NO: 175458 - RNA, 24 nt, Human
cugcaaccucugccuccuggguuc

SEQ ID NO: 175459 - RNA, 20 nt, Human
cuggguugcuuguuccaccu

SEQ ID NO: 175460 - RNA, 20 nt, Human
cugguacuucuaacaccaac

SEQ ID NO: 175461 - RNA, 19 nt, Human
cugucacccagguuggagu

SEQ ID NO: 175462 - RNA, 27 nt, Human
cuuccacuuacaaucagaaaaccacag

SEQ ID NO: 175463 - RNA, 18 nt, Human
cuugaaauauauacugag

SEQ ID NO: 175464 - RNA, 24 nt, Human
cuugccucagccucccaaguagcu

SEQ ID NO: 175465 - RNA, 24 nt, Human
gaacaccuuuguuaaugggaaugc

SEQ ID NO: 175466 - RNA, 22 nt, Human
gaauuacaggcaugagccaccg

SEQ ID NO: 175467 - RNA, 18 nt, Human
gauuacagguaugcgcca

SEQ ID NO: 175468 - RNA, 24 nt, Human
gauuacagguaugcgccaccaugc

SEQ ID NO: 175469 - RNA, 21 nt, Human
gauucucuugccucagccucc

SEQ ID NO: 175470 - RNA, 20 nt, Human
gcaauguugaccaggcuggu

SEQ ID NO: 175471 - RNA, 22 nt, Human
gcccagcuaauuuuuguauuuu

SEQ ID NO: 175472 - RNA, 20 nt, Human
gccucagccucccaaguagc

SEQ ID NO: 175473 - RNA, 24 nt, Human
gcgauucucuugccucagccuccc

SEQ ID NO: 175474 - RNA, 20 nt, Human
gcuacacaacuuccaacccu

SEQ ID NO: 175475 - RNA, 19 nt, Human
gcuugcagcagaaccuggg

SEQ ID NO: 175476 - RNA, 23 nt, Human
ggagaaaaguaaaucccaaaugu

SEQ ID NO: 175477 - RNA, 21 nt, Human
ggagaguuucucaacugugaa

SEQ ID NO: 175478 - RNA, 18 nt, Human
ggauguuccauaugguca

SEQ ID NO: 175479 - RNA, 24 nt, Human
ggauuacagguaugcgccaccaug

SEQ ID NO: 175480 - RNA, 18 nt, Human
gggcacugggaaugccag

SEQ ID NO: 175481 - RNA, 24 nt, Human
gguuauaaucuacucaacauggaa

SEQ ID NO: 175482 - RNA, 22 nt, Human
guaaaaagcagucuuguaaaca

SEQ ID NO: 175483 - RNA, 23 nt, Human
guaaucccaaagaagacaacaug

SEQ ID NO: 175484 - RNA, 20 nt, Human
gugugcaagaccugcuucca

SEQ ID NO: 175485 - RNA, 22 nt, Human
uaaaaaacaaacuuccucuggc

SEQ ID NO: 175486 - RNA, 18 nt, Human
uaaaaaacaagcaaccca

SEQ ID NO: 175487 - RNA, 22 nt, Human
uaaaaagaaauuaagaaacacu

SEQ ID NO: 175488 - RNA, 22 nt, Human
uaaccaaguuagagaagagcua

SEQ ID NO: 175489 - RNA, 22 nt, Human
uaaucccaaagaagacaacaug

SEQ ID NO: 175490 - RNA, 24 nt, Human
uaauuuuuguauuuuuaguagaga

SEQ ID NO: 175491 - RNA, 22 nt, Human
uacaaucagaaaaccacaggac

SEQ ID NO: 175492 - RNA, 23 nt, Human
uacaggcaugagccaccgcgccc

SEQ ID NO: 175493 - RNA, 24 nt, Human
uacagguaugcgccaccaugccca

SEQ ID NO: 175494 - RNA, 19 nt, Human
uacuccaaccuuuuuucaa

SEQ ID NO: 175495 - RNA, 22 nt, Human
uagagacaagguuuugcaaugu

SEQ ID NO: 175496 - RNA, 23 nt, Human
uagggcagggggaauagagguag

SEQ ID NO: 175497 - RNA, 24 nt, Human
uaguagagacaagguuuugcaaug

SEQ ID NO: 175498 - RNA, 20 nt, Human
uagugauauuaccaacuuac

SEQ ID NO: 175499 - RNA, 23 nt, Human
uauauagaaucauauucauagag

SEQ ID NO: 175500 - RNA, 19 nt, Human
ucaacauggaaaauggagc

SEQ ID NO: 175501 - RNA, 19 nt, Human
ucaagcgauucucuugccu

SEQ ID NO: 175502 - RNA, 18 nt, Human
ucacccagguuggagugc

SEQ ID NO: 175503 - RNA, 21 nt, Human
ucacucuuggcuucaccaggu

SEQ ID NO: 175504 - RNA, 24 nt, Human
ucacugcaaccucugccuccuggg

SEQ ID NO: 175505 - RNA, 25 nt, Human
ucacugcaaccucugccuccugggu

SEQ ID NO: 175506 - RNA, 27 nt, Human
ucacugcaaccucugccuccuggguuc

SEQ ID NO: 175507 - RNA, 18 nt, Human
ucagccucccaaguagcu

SEQ ID NO: 175508 - RNA, 20 nt, Human
ucagccucccaaguagcugg

SEQ ID NO: 175509 - RNA, 23 nt, Human
uccaaguuaaggccauuugaaga

SEQ ID NO: 175510 - RNA, 19 nt, Human
ucccaaagaagacaacaug

SEQ ID NO: 175511 - RNA, 24 nt, Human
ucccaaagugcuggaauuacaggc

SEQ ID NO: 175512 - RNA, 19 nt, Human
ucccaaauuuaagagcuaa

SEQ ID NO: 175513 - RNA, 23 nt, Human
ucccaaguagcugggauuacagg

SEQ ID NO: 175514 - RNA, 20 nt, Human
ucccgcuccaggcuccuuca

SEQ ID NO: 175515 - RNA, 21 nt, Human
uccuggguucaagcgauucuc

SEQ ID NO: 175516 - RNA, 24 nt, Human
uccuggguucaagcgauucucuug

SEQ ID NO: 175517 - RNA, 25 nt, Human
ucuacaaaguuuaagguaaaaagca

SEQ ID NO: 175518 - RNA, 23 nt, Human
ucucacucugucacccagguugg

SEQ ID NO: 175519 - RNA, 24 nt, Human
ucucacucugucacccagguugga

SEQ ID NO: 175520 - RNA, 18 nt, Human
ucucuacaaugguggaaa

SEQ ID NO: 175521 - RNA, 19 nt, Human
ucucugcaauccuaaaccu

SEQ ID NO: 175522 - RNA, 24 nt, Human
ucugucacccagguuggagugcaa

SEQ ID NO: 175523 - RNA, 26 nt, Human
ucuugccucagccucccaaguagcug

SEQ ID NO: 175524 - RNA, 19 nt, Human
ugaaagaggcacuaaaugu

SEQ ID NO: 175525 - RNA, 19 nt, Human
ugacaaguccaucauuacc

SEQ ID NO: 175526 - RNA, 24 nt, Human
ugacaucaggugauccucccaacu

SEQ ID NO: 175527 - RNA, 22 nt, Human
ugacugugaaggaaggccaccu

SEQ ID NO: 175528 - RNA, 22 nt, Human
ugagauggagucucacucuguc

SEQ ID NO: 175529 - RNA, 19 nt, Human
ugauggccaaaauucucuu

SEQ ID NO: 175530 - RNA, 18 nt, Human
ugcaauguugaccaggcu

SEQ ID NO: 175531 - RNA, 24 nt, Human
ugcaauguugaccaggcuggucuc

SEQ ID NO: 175532 - RNA, 22 nt, Human
ugccagagaauguccaggccag

SEQ ID NO: 175533 - RNA, 24 nt, Human
ugccucagccucccaaguagcugg

SEQ ID NO: 175534 - RNA, 28 nt, Human
ugcuacacaacuuccaacccuuauggga

SEQ ID NO: 175535 - RNA, 27 nt, Human
ugcuaugaggugucugggaugagcuga

SEQ ID NO: 175536 - RNA, 21 nt, Human
ugcugccagagaauguccagg

SEQ ID NO: 175537 - RNA, 19 nt, Human
uggaagaaacaaauuuaua

SEQ ID NO: 175538 - RNA, 18 nt, Human
uggaauuacaggcaugag

SEQ ID NO: 175539 - RNA, 21 nt, Human
uggaauuacaggcaugagcca

SEQ ID NO: 175540 - RNA, 22 nt, Human
uggaauuacaggcaugagccac

SEQ ID NO: 175541 - RNA, 23 nt, Human
uggaauuacaggcaugagccacc

SEQ ID NO: 175542 - RNA, 24 nt, Human
uggaauuacaggcaugagccaccg

SEQ ID NO: 175543 - RNA, 24 nt, Human
uggaauuacaggcaugagccaccg

SEQ ID NO: 175544 - RNA, 18 nt, Human
uggagaauugggccaaag

SEQ ID NO: 175545 - RNA, 19 nt, Human
uggagugcaauggcaugau

SEQ ID NO: 175546 - RNA, 24 nt, Human
uggagugcaauggcaugaucucag

SEQ ID NO: 175547 - RNA, 21 nt, Human
uggauuucuuuaauugccuuc

SEQ ID NO: 175548 - RNA, 21 nt, Human
uggcagcagcuucugauguuu

SEQ ID NO: 175549 - RNA, 24 nt, Human
uggcaugaucucagcucacugcaa

SEQ ID NO: 175550 - RNA, 20 nt, Human
uggccaaacagacaauccaa

SEQ ID NO: 175551 - RNA, 18 nt, Human
ugggauuacagguaugcg

SEQ ID NO: 175552 - RNA, 21 nt, Human
ugggauuacagguaugcgcca

SEQ ID NO: 175553 - RNA, 22 nt, Human
ugggauuacagguaugcgccac

SEQ ID NO: 175554 - RNA, 24 nt, Human
ugggauuacagguaugcgccacca

SEQ ID NO: 175555 - RNA, 20 nt, Human
uggguucaagcgauucucuu

SEQ ID NO: 175556 - RNA, 23 nt, Human
uggguucaagcgauucucuugcc

SEQ ID NO: 175557 - RNA, 23 nt, Human
uggguugagcuggagaauugggc

SEQ ID NO: 175558 - RNA, 23 nt, Human
uguggcagugcuucaaaaagaug

SEQ ID NO: 175559 - RNA, 23 nt, Human
uguuuuuguuugguagguuuucu

SEQ ID NO: 175560 - RNA, 21 nt, Human
uuaaacaucccuagagaugaa

SEQ ID NO: 175561 - RNA, 18 nt, Human
uuacaaucagaaaaccac

SEQ ID NO: 175562 - RNA, 24 nt, Human
uuaguagagacaagguuuugcaau

SEQ ID NO: 175563 - RNA, 18 nt, Human
uucaaacugaucaggagg

SEQ ID NO: 175564 - RNA, 23 nt, Human
uucaagcgauucucuugccucag

SEQ ID NO: 175565 - RNA, 24 nt, Human
uucacguuuguuaauaaacuguau

SEQ ID NO: 175566 - RNA, 20 nt, Human
uucucaacugugaacaccuu

SEQ ID NO: 175567 - RNA, 19 nt, Human
uugaagcuuuucagcugcu

SEQ ID NO: 175568 - RNA, 26 nt, Human
uugaucacagaucaguagcaaaauac

SEQ ID NO: 175569 - RNA, 19 nt, Human
uugcaauguugaccaggcu

SEQ ID NO: 175570 - RNA, 23 nt, Human
uugccaaaugcaacaggucaugu

SEQ ID NO: 175571 - RNA, 24 nt, Human
uuggagugcaauggcaugaucuca

SEQ ID NO: 175572 - RNA, 20 nt, Human
uugggaaaaaaauaaugauu

SEQ ID NO: 175573 - RNA, 20 nt, Human
uuucaaaaaagcagcaugac

SEQ ID NO: 175574 - RNA, 26 nt, Human
uuucuacagaaacauacaguguauca

SEQ ID NO: 175575 - RNA, 20 nt, Human
uuugcaaacacacaaguaau

SEQ ID NO: 175576 - RNA, 18 nt, Human
uuuggagcuauacagagu

SEQ ID NO: 175577 - RNA, 24 nt, Human
uuuuuaguagagacaagguuuugc

SEQ ID NO: 175578 - RNA, 20 nt, Human
uuuuuguauuuuuaguagag

SEQ ID NO: 175579 - RNA, 26 nt, Human
uuuuuuuuuuuugagauggagucuca

SEQ ID NO: 175580 - RNA, 22 nt, Human
uuuuuuuuuuuuuugagaugga

SEQ ID NO: 175581 - RNA, 27 nt, Human
uuuuuuuuuuuuuuuuuuuuuuugggg

SEQ ID NO: 175582 - RNA, 19 nt, Human
aaagacccuucucuccgcc

SEQ ID NO: 175583 - RNA, 25 nt, Human
aaccucgcugauuuuuuuucaucuc

SEQ ID NO: 175584 - RNA, 24 nt, Human
aauggugaugguuuuaaccccaaa

SEQ ID NO: 175585 - RNA, 22 nt, Human
agagcacugggguccccugccc

SEQ ID NO: 175586 - RNA, 21 nt, Human
agcggcggggcgcgcggggag

SEQ ID NO: 175587 - RNA, 20 nt, Human
aggcgccggggguggccagg

SEQ ID NO: 175588 - RNA, 19 nt, Human
auagaaauuauuaucuaca

SEQ ID NO: 175589 - RNA, 22 nt, Human
auggaaacucaaccauaaggau

SEQ ID NO: 175590 - RNA, 19 nt, Human
caaagcacggagagugcga

SEQ ID NO: 175591 - RNA, 23 nt, Human
caacagugccuacuacugcaucc

SEQ ID NO: 175592 - RNA, 18 nt, Human
cacaauauuacuucucuu

SEQ ID NO: 175593 - RNA, 19 nt, Human
cagcagugcacugugcggc

SEQ ID NO: 175594 - RNA, 20 nt, Human
cagcgccaccuccccagugg

SEQ ID NO: 175595 - RNA, 26 nt, Human
cagugggcuggcgccucccccccugg

SEQ ID NO: 175596 - RNA, 18 nt, Human
ccccgcacugcccagcgc

SEQ ID NO: 175597 - RNA, 22 nt, Human
ccccgcgcaucccgcgcgccca

SEQ ID NO: 175598 - RNA, 22 nt, Human
ccccgcgcaucccgcgcgccca

SEQ ID NO: 175599 - RNA, 23 nt, Human
cccgcgcaucccgcgcgcccaau

SEQ ID NO: 175600 - RNA, 26 nt, Human
cccgcgcgcccagcgccaccucccca

SEQ ID NO: 175601 - RNA, 19 nt, Human
ccgacuguaucucauaaug

SEQ ID NO: 175602 - RNA, 20 nt, Human
ccgcgcagguggaaagaccc

SEQ ID NO: 175603 - RNA, 18 nt, Human
cgacuguaucucauaaug

SEQ ID NO: 175604 - RNA, 22 nt, Human
cgacuguaucucauaaugacug

SEQ ID NO: 175605 - RNA, 19 nt, Human
cgagcggcggggcgcgcgg

SEQ ID NO: 175606 - RNA, 23 nt, Human
cgccuccgacucccucccggcuu

SEQ ID NO: 175607 - RNA, 18 nt, Human
cgcgcagguggaaagacc

SEQ ID NO: 175608 - RNA, 21 nt, Human
cgcgcccagcgccaccucccc

SEQ ID NO: 175609 - RNA, 22 nt, Human
cuauaaagccaguuucacagga

SEQ ID NO: 175610 - RNA, 18 nt, Human
cucccucccggcuuuucc

SEQ ID NO: 175611 - RNA, 18 nt, Human
cuccugcagagaaggcuc

SEQ ID NO: 175612 - RNA, 23 nt, Human
cugcaccuguugcucggagccgc

SEQ ID NO: 175613 - RNA, 19 nt, Human
cugcgcgaccacggagccu

SEQ ID NO: 175614 - RNA, 19 nt, Human
cugucccggcgagcggcgg

SEQ ID NO: 175615 - RNA, 19 nt, Human
cuuccuggugguggauaga

SEQ ID NO: 175616 - RNA, 24 nt, Human
cuuccuggugguggauagagucga

SEQ ID NO: 175617 - RNA, 19 nt, Human
cuuuauguacaggcaugac

SEQ ID NO: 175618 - RNA, 18 nt, Human
cuuugcgccgcgaccuuc

SEQ ID NO: 175619 - RNA, 23 nt, Human
gacaggcuuccaaagcucugugc

SEQ ID NO: 175620 - RNA, 20 nt, Human
gagcuucccccgaggcgcga

SEQ ID NO: 175621 - RNA, 24 nt, Human
gauagcaggcgccggggguggcca

SEQ ID NO: 175622 - RNA, 18 nt, Human
gcagagaaggcuccccgc

SEQ ID NO: 175623 - RNA, 23 nt, Human
gcccggagcuggaccuucucggg

SEQ ID NO: 175624 - RNA, 19 nt, Human
ggauagagucgggugccag

SEQ ID NO: 175625 - RNA, 18 nt, Human
ggcgccggggguggccag

SEQ ID NO: 175626 - RNA, 23 nt, Human
gggagggagggcgggauagcagg

SEQ ID NO: 175627 - RNA, 23 nt, Human
gggcgcgcggggagggagggcgg

SEQ ID NO: 175628 - RNA, 21 nt, Human
gguggguucgggagcccggag

SEQ ID NO: 175629 - RNA, 24 nt, Human
gguucgggagcccggagcuggacc

SEQ ID NO: 175630 - RNA, 21 nt, Human
guggaaagacccuucucuccg

SEQ ID NO: 175631 - RNA, 24 nt, Human
uaaagcucaaauuuuuuuucuaaa

SEQ ID NO: 175632 - RNA, 19 nt, Human
uaagacaguggucucugac

SEQ ID NO: 175633 - RNA, 23 nt, Human
uagacugcaaauauuccugacca

SEQ ID NO: 175634 - RNA, 24 nt, Human
uagacugcaaauauuccugaccau

SEQ ID NO: 175635 - RNA, 24 nt, Human
uaguucacaauauuacuucucuua

SEQ ID NO: 175636 - RNA, 28 nt, Human
ucaaaaacuuauuugcaucuuccacugu

SEQ ID NO: 175637 - RNA, 18 nt, Human
ucccgcgcgcccagcgcc

SEQ ID NO: 175638 - RNA, 19 nt, Human
ucccgcgcgcccagcgcca

SEQ ID NO: 175639 - RNA, 21 nt, Human
ucgccggcgguuuucccuggc

SEQ ID NO: 175640 - RNA, 18 nt, Human
ucuauaaagccaguuuca

SEQ ID NO: 175641 - RNA, 21 nt, Human
ucuccgccuuaccgcuccaga

SEQ ID NO: 175642 - RNA, 19 nt, Human
ucucugcugcaacugagag

SEQ ID NO: 175643 - RNA, 20 nt, Human
ucuuuuguuucugaaacaua

SEQ ID NO: 175644 - RNA, 21 nt, Human
ugagguaaaccgacuguaucu

SEQ ID NO: 175645 - RNA, 21 nt, Human
uggccaaaaaauucaucauug

SEQ ID NO: 175646 - RNA, 27 nt, Human
uggccaaaaaauucaucauuguguguc

SEQ ID NO: 175647 - RNA, 20 nt, Human
uguaaacacacaucaauaua

SEQ ID NO: 175648 - RNA, 21 nt, Human
ugucccggcgagcggcggggc

SEQ ID NO: 175649 - RNA, 19 nt, Human
ugucugaagaggaauaaaa

SEQ ID NO: 175650 - RNA, 18 nt, Human
ugugcggcuccugcagag

SEQ ID NO: 175651 - RNA, 23 nt, Human
uucagaaagccuucuuuccacuu

SEQ ID NO: 175652 - RNA, 24 nt, Human
aaaacaaaaaaggauucaaggccc

SEQ ID NO: 175653 - RNA, 22 nt, Human
acaaaaaaggauucaaggcccu

SEQ ID NO: 175654 - RNA, 23 nt, Human
gaaaacaaaaaaggauucaaggc

SEQ ID NO: 175655 - RNA, 21 nt, Human
ucagcaagacuguugaaaaca

SEQ ID NO: 175656 - RNA, 22 nt, Human
ugaaaacaaaaaaggauucaag

SEQ ID NO: 175657 - RNA, 22 nt, Human
acagcugggaucagcccagggc

SEQ ID NO: 175658 - RNA, 24 nt, Human
agcccaggcuggucuugaacuccu

SEQ ID NO: 175659 - RNA, 21 nt, Human
aggcacggaggagggcauggg

SEQ ID NO: 175660 - RNA, 24 nt, Human
cagcccugggcuggugggaccccu

SEQ ID NO: 175661 - RNA, 21 nt, Human
cccagcgccggcguuuacuuc

SEQ ID NO: 175662 - RNA, 23 nt, Human
ccccucacagagaagccgggaaa

SEQ ID NO: 175663 - RNA, 18 nt, Human
cccugcaggggcuugugg

SEQ ID NO: 175664 - RNA, 19 nt, Human
cccugggcuggugggaccc

SEQ ID NO: 175665 - RNA, 19 nt, Human
ccgcucccugcaggggcuu

SEQ ID NO: 175666 - RNA, 21 nt, Human
ccugcagugggcagcagugac

SEQ ID NO: 175667 - RNA, 19 nt, Human
ccuggacucccggccagga

SEQ ID NO: 175668 - RNA, 24 nt, Human
cgcgcgccgcccgggcccgcuccc

SEQ ID NO: 175669 - RNA, 23 nt, Human
cggcgacccgaccucgaucgcgc

SEQ ID NO: 175670 - RNA, 19 nt, Human
cugcaggggcuugugggcc

SEQ ID NO: 175671 - RNA, 22 nt, Human
cuucaccucagggacccugcag

SEQ ID NO: 175672 - RNA, 23 nt, Human
gacccucacagagaagcugggaa

SEQ ID NO: 175673 - RNA, 18 nt, Human
gaggucuugcucuguagc

SEQ ID NO: 175674 - RNA, 20 nt, Human
gaucagcccugggcuggugg

SEQ ID NO: 175675 - RNA, 19 nt, Human
gcccgcucccugcaggggc

SEQ ID NO: 175676 - RNA, 19 nt, Human
gcccugggcuggugggacc

SEQ ID NO: 175677 - RNA, 24 nt, Human
gcucuguagcccaggcuggucuug

SEQ ID NO: 175678 - RNA, 22 nt, Human
ggcauggguguggccgggccga

SEQ ID NO: 175679 - RNA, 19 nt, Human
ggccgggccgggguggggg

SEQ ID NO: 175680 - RNA, 18 nt, Human
ggcuggucuugaacuccu

SEQ ID NO: 175681 - RNA, 18 nt, Human
gggcauggguguggccgg

SEQ ID NO: 175682 - RNA, 18 nt, Human
gggcauggguguggccgg

SEQ ID NO: 175683 - RNA, 19 nt, Human
uaggaaagaugaggucuug

SEQ ID NO: 175684 - RNA, 19 nt, Human
ucccugcaggggcuugugg

SEQ ID NO: 175685 - RNA, 20 nt, Human
ucccugcaggggcuuguggg

SEQ ID NO: 175686 - RNA, 25 nt, Human
ucgcgcgccgcccgggcccgcuccc

SEQ ID NO: 175687 - RNA, 24 nt, Human
ucuguagcccaggcuggucuugaa

SEQ ID NO: 175688 - RNA, 18 nt, Human
ucuugcucuguagcccag

SEQ ID NO: 175689 - RNA, 19 nt, Human
ucuugcucuguagcccagg

SEQ ID NO: 175690 - RNA, 23 nt, Human
ucuugcucuguagcccaggcugg

SEQ ID NO: 175691 - RNA, 24 nt, Human
ucuugcucuguagcccaggcuggu

SEQ ID NO: 175692 - RNA, 22 nt, Human
ugcagugggcagcagugacccc

SEQ ID NO: 175693 - RNA, 19 nt, Human
ugcucuguagcccaggcug

SEQ ID NO: 175694 - RNA, 20 nt, Human
ugcucuguagcccaggcugg

SEQ ID NO: 175695 - RNA, 24 nt, Human
ugcuggugacacacagcugggauc

SEQ ID NO: 175696 - RNA, 21 nt, Human
uggccgggccggggugggggc

SEQ ID NO: 175697 - RNA, 19 nt, Human
ugggaccccucacagagaa

SEQ ID NO: 175698 - RNA, 24 nt, Human
ugggcagcagugacccucacagag

SEQ ID NO: 175699 - RNA, 20 nt, Human
uggguguggccgggccgggg

SEQ ID NO: 175700 - RNA, 20 nt, Human
uguauuuuuuuuuuuuagga

SEQ ID NO: 175701 - RNA, 24 nt, Human
uuaggaaagaugaggucuugcucu

SEQ ID NO: 175702 - RNA, 24 nt, Human
uuuuuuuuuuuuuuuuuuucacug

SEQ ID NO: 175703 - RNA, 21 nt, Human
aaacaagagcuaaagcucaag

SEQ ID NO: 175704 - RNA, 20 nt, Human
aaacaguaguaaacaagacu

SEQ ID NO: 175705 - RNA, 22 nt, Human
aaaccaaaggauaccuuuauac

SEQ ID NO: 175706 - RNA, 19 nt, Human
aaagcucaaguuuguaagc

SEQ ID NO: 175707 - RNA, 24 nt, Human
aaaucuuccuuucuuugcagaggc

SEQ ID NO: 175708 - RNA, 22 nt, Human
aacacaaaccugcaugaaauga

SEQ ID NO: 175709 - RNA, 24 nt, Human
aagaaaaaaaaucacaggucaccc

SEQ ID NO: 175710 - RNA, 21 nt, Human
aaucacaggucacccuuuuuu

SEQ ID NO: 175711 - RNA, 24 nt, Human
aaugccaagguacuguucuguaca

SEQ ID NO: 175712 - RNA, 20 nt, Human
acacaccugguaaaagugcc

SEQ ID NO: 175713 - RNA, 27 nt, Human
acagcagucagacaugaguucccuuca

SEQ ID NO: 175714 - RNA, 20 nt, Human
acuacgaaaaugugcagaca

SEQ ID NO: 175715 - RNA, 22 nt, Human
acucaacacucucuagaacccc

SEQ ID NO: 175716 - RNA, 25 nt, Human
acucaacacucucuagaaccccaua

SEQ ID NO: 175717 - RNA, 21 nt, Human
acuggcauacaguccaaucua

SEQ ID NO: 175718 - RNA, 22 nt, Human
acugguacacaaaacaauucug

SEQ ID NO: 175719 - RNA, 19 nt, Human
acuguucuguacaggacau

SEQ ID NO: 175720 - RNA, 20 nt, Human
acuuagaaaaugguuuugcu

SEQ ID NO: 175721 - RNA, 23 nt, Human
acuucaacacaauauuuuaauau

SEQ ID NO: 175722 - RNA, 23 nt, Human
agcggcccgaguccugcgcgcgc

SEQ ID NO: 175723 - RNA, 23 nt, Human
aggaaguuucuagaagaaauucc

SEQ ID NO: 175724 - RNA, 23 nt, Human
agugcaguggaaaagcagucuug

SEQ ID NO: 175725 - RNA, 22 nt, Human
auaacaguuuggcacuuagcag

SEQ ID NO: 175726 - RNA, 23 nt, Human
auguuuggauauguugauuugca

SEQ ID NO: 175727 - RNA, 21 nt, Human
caaacccuaaacaguaguaaa

SEQ ID NO: 175728 - RNA, 22 nt, Human
caaagaguuaccauaccaaagc

SEQ ID NO: 175729 - RNA, 21 nt, Human
cacaaaccugcaugaaaugag

SEQ ID NO: 175730 - RNA, 18 nt, Human
cacucaacacucucuaga

SEQ ID NO: 175731 - RNA, 19 nt, Human
cacucucuagaaccccaua

SEQ ID NO: 175732 - RNA, 21 nt, Human
cagaagcuggagcccccggga

SEQ ID NO: 175733 - RNA, 22 nt, Human
cagcugacugguacacaaaaca

SEQ ID NO: 175734 - RNA, 24 nt, Human
cauauaagauaaaaaccuuacacc

SEQ ID NO: 175735 - RNA, 20 nt, Human
cauuaucuaauuucugcagu

SEQ ID NO: 175736 - RNA, 19 nt, Human
cauuguacugacuuccagc

SEQ ID NO: 175737 - RNA, 25 nt, Human
ccaacaucuacagccacauuuaacu

SEQ ID NO: 175738 - RNA, 24 nt, Human
ccacacucaacacucucuagaacc

SEQ ID NO: 175739 - RNA, 21 nt, Human
ccaccaaagaguuaccauacc

SEQ ID NO: 175740 - RNA, 22 nt, Human
ccccauaggcacagcaucuuuc

SEQ ID NO: 175741 - RNA, 22 nt, Human
cccgacaccguccggccggacc

SEQ ID NO: 175742 - RNA, 18 nt, Human
ccucgagcggcccgaguc

SEQ ID NO: 175743 - RNA, 21 nt, Human
cggcuccacagguacuacccc

SEQ ID NO: 175744 - RNA, 19 nt, Human
cuaaaacucucacuaguga

SEQ ID NO: 175745 - RNA, 21 nt, Human
cuaaagcucaaguuuguaagc

SEQ ID NO: 175746 - RNA, 24 nt, Human
cuauccugagccaccaauuccaac

SEQ ID NO: 175747 - RNA, 21 nt, Human
cucaacacucucuagaacccu

SEQ ID NO: 175748 - RNA, 25 nt, Human
cucccgacaccguccggccggaccc

SEQ ID NO: 175749 - RNA, 21 nt, Human
cucuugggucaggaucucgca

SEQ ID NO: 175750 - RNA, 23 nt, Human
cugcgcgcgcgcccgcccggccc

SEQ ID NO: 175751 - RNA, 19 nt, Human
gaaaggagggaaggaggaa

SEQ ID NO: 175752 - RNA, 20 nt, Human
gagacuaacuggcauacagu

SEQ ID NO: 175753 - RNA, 24 nt, Human
gagcagaagcuggagcccccggga

SEQ ID NO: 175754 - RNA, 26 nt, Human
gagccaccaauuccaacacacaccug

SEQ ID NO: 175755 - RNA, 18 nt, Human
gagcggcccgaguccugc

SEQ ID NO: 175756 - RNA, 25 nt, Human
gagcuauguuauggugcucuugggu

SEQ ID NO: 175757 - RNA, 18 nt, Human
ggcgcccgcuccucugcc

SEQ ID NO: 175758 - RNA, 21 nt, Human
ggcuccacagguacuacccca

SEQ ID NO: 175759 - RNA, 23 nt, Human
guacuguucuguacaggacauuu

SEQ ID NO: 175760 - RNA, 25 nt, Human
gucuuggcauguuuggauauguuga

SEQ ID NO: 175761 - RNA, 21 nt, Human
uaaaacacaaaccugcaugaa

SEQ ID NO: 175762 - RNA, 23 nt, Human
uaacauuuuaggcacaaaccuua

SEQ ID NO: 175763 - RNA, 24 nt, Human
uaagaaaaaaaaucacaggucacc

SEQ ID NO: 175764 - RNA, 20 nt, Human
uaagacaaguuuucaaaccc

SEQ ID NO: 175765 - RNA, 22 nt, Human
uaagaccuauccugagccacca

SEQ ID NO: 175766 - RNA, 26 nt, Human
uaagugauguuuuucauaugcauguu

SEQ ID NO: 175767 - RNA, 22 nt, Human
uaaguggaauguuaaaacacaa

SEQ ID NO: 175768 - RNA, 23 nt, Human
uacaggacauuucaccaaagcaa

SEQ ID NO: 175769 - RNA, 24 nt, Human
uacaggacauuucaccaaagcaaa

SEQ ID NO: 175770 - RNA, 19 nt, Human
uaccauaccaaagcccagc

SEQ ID NO: 175771 - RNA, 18 nt, Human
uacguauuugaauacagc

SEQ ID NO: 175772 - RNA, 24 nt, Human
uacuaggaauaaauggagacuaac

SEQ ID NO: 175773 - RNA, 18 nt, Human
uaggaaaggagggaagga

SEQ ID NO: 175774 - RNA, 21 nt, Human
uaggaauaaauggagacuaac

SEQ ID NO: 175775 - RNA, 20 nt, Human
uaguuugcuuucauuaaaaa

SEQ ID NO: 175776 - RNA, 23 nt, Human
uaguuugcuuucauuaaaaagau

SEQ ID NO: 175777 - RNA, 22 nt, Human
uauuacaaagacuagauucuua

SEQ ID NO: 175778 - RNA, 18 nt, Human
uauuuuacaugauagcaa

SEQ ID NO: 175779 - RNA, 24 nt, Human
ucaacaguuacguguucucccaaa

SEQ ID NO: 175780 - RNA, 19 nt, Human
ucacaugagggcugcaacc

SEQ ID NO: 175781 - RNA, 24 nt, Human
ucaguuacuguuuuaauguucccc

SEQ ID NO: 175782 - RNA, 20 nt, Human
uccacagguacuaccccaga

SEQ ID NO: 175783 - RNA, 20 nt, Human
ucccccaaugagaagugggg

SEQ ID NO: 175784 - RNA, 24 nt, Human
uccgcgcucugagcagaagcugga

SEQ ID NO: 175785 - RNA, 28 nt, Human
uccucugccgacggguccggcucccgac

SEQ ID NO: 175786 - RNA, 20 nt, Human
ucuaaaacuaauaucuaguu

SEQ ID NO: 175787 - RNA, 22 nt, Human
ucuaagucaacacagaagcgag

SEQ ID NO: 175788 - RNA, 19 nt, Human
ucuaccagccaaacuuuac

SEQ ID NO: 175789 - RNA, 18 nt, Human
ucuagaaccccauaggca

SEQ ID NO: 175790 - RNA, 22 nt, Human
ucuaguuguaaaaagaaaaauc

SEQ ID NO: 175791 - RNA, 24 nt, Human
ucuccgcgcucugagcagaagcug

SEQ ID NO: 175792 - RNA, 22 nt, Human
ucugcaguuauagagucaauga

SEQ ID NO: 175793 - RNA, 19 nt, Human
ucuggcuaaaauggagagu

SEQ ID NO: 175794 - RNA, 22 nt, Human
ugaaauuaaaaaaaaaaaacac

SEQ ID NO: 175795 - RNA, 25 nt, Human
ugaacugaaauuaaaaaaaaaaaac

SEQ ID NO: 175796 - RNA, 19 nt, Human
ugagaagugggguaaagug

SEQ ID NO: 175797 - RNA, 18 nt, Human
ugagcagaagcuggagcc

SEQ ID NO: 175798 - RNA, 20 nt, Human
ugagcagaagcuggagcccc

SEQ ID NO: 175799 - RNA, 18 nt, Human
ugaguucccuucagggaa

SEQ ID NO: 175800 - RNA, 21 nt, Human
ugauagcaauucccacucccu

SEQ ID NO: 175801 - RNA, 23 nt, Human
ugggguaaaguggguugagguga

SEQ ID NO: 175802 - RNA, 18 nt, Human
uguacaggacauuucacc

SEQ ID NO: 175803 - RNA, 19 nt, Human
uguuauggugcucuugggu

SEQ ID NO: 175804 - RNA, 25 nt, Human
uuaccauaccaaagcccagcacaga

SEQ ID NO: 175805 - RNA, 22 nt, Human
uucuguacaggacauuucacca

SEQ ID NO: 175806 - RNA, 20 nt, Human
uuuauaaaaucuccuacuca

SEQ ID NO: 175807 - RNA, 22 nt, Human
uuuguaagcaucauaaaaccac

SEQ ID NO: 175808 - RNA, 24 nt, Human
aaaaugauugaaucaucauuacca

SEQ ID NO: 175809 - RNA, 19 nt, Human
acaacaccaagaaacaaaa

SEQ ID NO: 175810 - RNA, 23 nt, Human
acagugcaagaauuucccaaaaa

SEQ ID NO: 175811 - RNA, 22 nt, Human
accaaaaacuugccauaacaac

SEQ ID NO: 175812 - RNA, 22 nt, Human
agaaagagggcuaguggguggg

SEQ ID NO: 175813 - RNA, 23 nt, Human
agacucacagacgugagcaggac

SEQ ID NO: 175814 - RNA, 22 nt, Human
agagaaagagggcuagugggug

SEQ ID NO: 175815 - RNA, 22 nt, Human
aggagaggggaggguggggaug

SEQ ID NO: 175816 - RNA, 23 nt, Human
cacacacuuggaacagagagaga

SEQ ID NO: 175817 - RNA, 24 nt, Human
caccaagaaacaaaaaauguuuaa

SEQ ID NO: 175818 - RNA, 22 nt, Human
cagaguggagcugagaagaggg

SEQ ID NO: 175819 - RNA, 19 nt, Human
caggcucaggagaggggag

SEQ ID NO: 175820 - RNA, 19 nt, Human
ccacacgcaccagaucaaa

SEQ ID NO: 175821 - RNA, 21 nt, Human
ccagaucaaauaacuuggaua

SEQ ID NO: 175822 - RNA, 23 nt, Human
cccccccucuccaccucuuuucc

SEQ ID NO: 175823 - RNA, 22 nt, Human
ccccccucuccaccucuuuucu

SEQ ID NO: 175824 - RNA, 23 nt, Human
cccucuccaccucuuuucuggaa

SEQ ID NO: 175825 - RNA, 18 nt, Human
ccuugccuucuuccugcc

SEQ ID NO: 175826 - RNA, 26 nt, Human
ccuugccuucuuccugccuucucucc

SEQ ID NO: 175827 - RNA, 22 nt, Human
cucuccuuuccuucucucucuu

SEQ ID NO: 175828 - RNA, 21 nt, Human
cucucucuuucuuauuccccc

SEQ ID NO: 175829 - RNA, 23 nt, Human
cuuuuuuuuuuuuuuuuuaaaug

SEQ ID NO: 175830 - RNA, 21 nt, Human
uaacaacaccaagaaacaaaa

SEQ ID NO: 175831 - RNA, 23 nt, Human
ucuuuccugcuuuuuuuuuuuuu

SEQ ID NO: 175832 - RNA, 18 nt, Human
ugacuugggaucuuuccu

SEQ ID NO: 175833 - RNA, 23 nt, Human
ugauugaaucaucauuaccaaaa

SEQ ID NO: 175834 - RNA, 23 nt, Human
ugccauaacaacaccaagaaaca

SEQ ID NO: 175835 - RNA, 19 nt, Human
uggaacagagagagagaga

SEQ ID NO: 175836 - RNA, 21 nt, Human
ugggaaaggacagacucacag

SEQ ID NO: 175837 - RNA, 27 nt, Human
ugggaucuuuccugcuuuuuuuuuuuu

SEQ ID NO: 175838 - RNA, 22 nt, Human
uugccacacagagagaaagagg

SEQ ID NO: 175839 - RNA, 21 nt, Human
uugccuucuuccugccuucuc

SEQ ID NO: 175840 - RNA, 25 nt, Human
uuucuuauucccccccucuccaccu

SEQ ID NO: 175841 - RNA, 26 nt, Human
uuugacuugggaucuuuccugcuuuu

SEQ ID NO: 175842 - RNA, 21 nt, Human
aggccccuccccucuucaagg

SEQ ID NO: 175843 - RNA, 18 nt, Human
caaggggucuacauggca

SEQ ID NO: 175844 - RNA, 18 nt, Human
ccagcagugagggucucu

SEQ ID NO: 175845 - RNA, 22 nt, Human
cccagcagugagggucucucuc

SEQ ID NO: 175846 - RNA, 22 nt, Human
cggcucccuaggccccuccccu

SEQ ID NO: 175847 - RNA, 25 nt, Human
cggcugacugucgaacaggaggagc

SEQ ID NO: 175848 - RNA, 18 nt, Human
gaggaggggagauucagu

SEQ ID NO: 175849 - RNA, 20 nt, Human
gcggcucccuaggccccucc

SEQ ID NO: 175850 - RNA, 19 nt, Human
ggagauucagugugguggg

SEQ ID NO: 175851 - RNA, 21 nt, Human
gucgaacaggaggagcagaga

SEQ ID NO: 175852 - RNA, 18 nt, Human
ucccuaggccccuccccu

SEQ ID NO: 175853 - RNA, 22 nt, Human
ucuuccucuugugcucuugcug

SEQ ID NO: 175854 - RNA, 21 nt, Human
ucuugcuggggcugguggucc

SEQ ID NO: 175855 - RNA, 21 nt, Human
ugagcgauguggcucggcugg

SEQ ID NO: 175856 - RNA, 20 nt, Human
uugugcucuugcuggggcug

SEQ ID NO: 175857 - RNA, 18 nt, Human
aaaccagcggggccugcc

SEQ ID NO: 175858 - RNA, 24 nt, Human
aaagaguuggucccgaggccuggg

SEQ ID NO: 175859 - RNA, 22 nt, Human
aaauguucccacuauaccaaau

SEQ ID NO: 175860 - RNA, 22 nt, Human
aacaugagagugccaggaaggg

SEQ ID NO: 175861 - RNA, 20 nt, Human
aacauuauucucggcugucc

SEQ ID NO: 175862 - RNA, 21 nt, Human
aacggggauaaaauauagagc

SEQ ID NO: 175863 - RNA, 26 nt, Human
aaggagaaaauagcagggucacgauc

SEQ ID NO: 175864 - RNA, 21 nt, Human
aagggagagggcaaguccaga

SEQ ID NO: 175865 - RNA, 19 nt, Human
aaugcaagagcacagagag

SEQ ID NO: 175866 - RNA, 20 nt, Human
acaaggcuuggauucaaauc

SEQ ID NO: 175867 - RNA, 26 nt, Human
accaccagggccuagcccuggcucug

SEQ ID NO: 175868 - RNA, 24 nt, Human
accagacccugcuggagccgccgu

SEQ ID NO: 175869 - RNA, 19 nt, Human
accagacugggagauucuu

SEQ ID NO: 175870 - RNA, 22 nt, Human
accccuuaaccagacccugcug

SEQ ID NO: 175871 - RNA, 22 nt, Human
accucaggcccuaagcacacug

SEQ ID NO: 175872 - RNA, 21 nt, Human
acucaccgcaccaaaccagcg

SEQ ID NO: 175873 - RNA, 18 nt, Human
agacugugggccaagcaa

SEQ ID NO: 175874 - RNA, 20 nt, Human
agagaacaggagaacccaca

SEQ ID NO: 175875 - RNA, 23 nt, Human
agagcgccugcagcugccugccu

SEQ ID NO: 175876 - RNA, 19 nt, Human
agaggaaaagggaaugaga

SEQ ID NO: 175877 - RNA, 20 nt, Human
agagggcaaguccagagcag

SEQ ID NO: 175878 - RNA, 18 nt, Human
agaucaggcccuggagac

SEQ ID NO: 175879 - RNA, 21 nt, Human
agcaggugugcacagcacagg

SEQ ID NO: 175880 - RNA, 20 nt, Human
agcuggggcccuggaaggag

SEQ ID NO: 175881 - RNA, 19 nt, Human
aggaaaagggaaugagaga

SEQ ID NO: 175882 - RNA, 23 nt, Human
aggaaaagggaaugagagaaugc

SEQ ID NO: 175883 - RNA, 24 nt, Human
aggaggagagcgccugcagcugcc

SEQ ID NO: 175884 - RNA, 21 nt, Human
aggagggaaacaggcagagaa

SEQ ID NO: 175885 - RNA, 21 nt, Human
agggaaacaggcagagaagga

SEQ ID NO: 175886 - RNA, 23 nt, Human
caaacuccaggcucugcuccaua

SEQ ID NO: 175887 - RNA, 19 nt, Human
caaagaguuggucccgagg

SEQ ID NO: 175888 - RNA, 29 nt, Human
caaagcaaauguucccacuauaccaaauu

SEQ ID NO: 175889 - RNA, 21 nt, Human
caacccccaaucucaccccag

SEQ ID NO: 175890 - RNA, 21 nt, Human
caacuucuggcuuccacagcu

SEQ ID NO: 175891 - RNA, 23 nt, Human
cacaccuuggccuccaggccuaa

SEQ ID NO: 175892 - RNA, 21 nt, Human
caccaaaccagcggggccugc

SEQ ID NO: 175893 - RNA, 19 nt, Human
caccucaggcccuaagcac

SEQ ID NO: 175894 - RNA, 22 nt, Human
cacugcguggcggccacguggc

SEQ ID NO: 175895 - RNA, 18 nt, Human
cacugugugaccuugagu

SEQ ID NO: 175896 - RNA, 27 nt, Human
cagaaggaugaagguuugaaucucacu

SEQ ID NO: 175897 - RNA, 23 nt, Human
cagacacaaggcuuggauucaaa

SEQ ID NO: 175898 - RNA, 18 nt, Human
cagcacaggaugcuucca

SEQ ID NO: 175899 - RNA, 22 nt, Human
cagcauuaucuugugaugugau

SEQ ID NO: 175900 - RNA, 18 nt, Human
cagcugccugccugggag

SEQ ID NO: 175901 - RNA, 20 nt, Human
caggagacggaaugguccag

SEQ ID NO: 175902 - RNA, 24 nt, Human
caucacucugguccaacccccaau

SEQ ID NO: 175903 - RNA, 20 nt, Human
ccaaaccagcggggccugcc

SEQ ID NO: 175904 - RNA, 18 nt, Human
ccaagcugggugcaaaac

SEQ ID NO: 175905 - RNA, 22 nt, Human
ccacaaguuucauucucuuccu

SEQ ID NO: 175906 - RNA, 23 nt, Human
ccacagcuggacccaaagugcag

SEQ ID NO: 175907 - RNA, 21 nt, Human
ccagcacguccauucuuccca

SEQ ID NO: 175908 - RNA, 21 nt, Human
ccagugcccagagcagggugu

SEQ ID NO: 175909 - RNA, 20 nt, Human
cccacaccaggguggaaagg

SEQ ID NO: 175910 - RNA, 19 nt, Human
cccacaccuuggccuccag

SEQ ID NO: 175911 - RNA, 21 nt, Human
cccacaccuuggccuccaggc

SEQ ID NO: 175912 - RNA, 24 nt, Human
cccuuaaccagacccugcuggagc

SEQ ID NO: 175913 - RNA, 19 nt, Human
ccgagcucuggagcccugg

SEQ ID NO: 175914 - RNA, 19 nt, Human
ccgagcucuggagcccugg

SEQ ID NO: 175915 - RNA, 22 nt, Human
ccgcaccaaaccagcggggccu

SEQ ID NO: 175916 - RNA, 18 nt, Human
ccgguccuaagcuuuuca

SEQ ID NO: 175917 - RNA, 20 nt, Human
ccuagcccuggcucugccca

SEQ ID NO: 175918 - RNA, 25 nt, Human
ccuagcccuggcucugcccauugac

SEQ ID NO: 175919 - RNA, 23 nt, Human
ccucccucacccugcacagccgg

SEQ ID NO: 175920 - RNA, 22 nt, Human
ccugcagcugccugccugggag

SEQ ID NO: 175921 - RNA, 18 nt, Human
ccugggcugaggccuggg

SEQ ID NO: 175922 - RNA, 21 nt, Human
ccuugagucaguccucacucu

SEQ ID NO: 175923 - RNA, 19 nt, Human
ccuuggccuccaggccuaa

SEQ ID NO: 175924 - RNA, 20 nt, Human
cgauggagaaguggggcugg

SEQ ID NO: 175925 - RNA, 21 nt, Human
cggaaugguccagugcugggc

SEQ ID NO: 175926 - RNA, 21 nt, Human
cguccauucuucccagacagc

SEQ ID NO: 175927 - RNA, 24 nt, Human
cgugcaguagcacccgugggugug

SEQ ID NO: 175928 - RNA, 21 nt, Human
cuaacaauaccagauccgaga

SEQ ID NO: 175929 - RNA, 22 nt, Human
cuauguggggccacuuccuguc

SEQ ID NO: 175930 - RNA, 23 nt, Human
cucagaagacgugacaaacaguc

SEQ ID NO: 175931 - RNA, 20 nt, Human
cuccacacaccaccagggcc

SEQ ID NO: 175932 - RNA, 21 nt, Human
cuccuggcucagcagccaagg

SEQ ID NO: 175933 - RNA, 20 nt, Human
cucuguaccucaggcucccc

SEQ ID NO: 175934 - RNA, 18 nt, Human
cuggcucagcagccaagg

SEQ ID NO: 175935 - RNA, 23 nt, Human
cugggugaggcuuuuuaccuguu

SEQ ID NO: 175936 - RNA, 18 nt, Human
cugugggccaagcacagg

SEQ ID NO: 175937 - RNA, 23 nt, Human
cuuccgguccuaagcuuuucauu

SEQ ID NO: 175938 - RNA, 23 nt, Human
gaaccagauaucuaagguuuuag

SEQ ID NO: 175939 - RNA, 21 nt, Human
gaagggaggagggaaacaggc

SEQ ID NO: 175940 - RNA, 20 nt, Human
gacugggucugccugggugc

SEQ ID NO: 175941 - RNA, 22 nt, Human
gagcagcacuggggucagggua

SEQ ID NO: 175942 - RNA, 24 nt, Human
gagcaggugugcacagcacaggau

SEQ ID NO: 175943 - RNA, 21 nt, Human
gcacacugcguggcggccacg

SEQ ID NO: 175944 - RNA, 18 nt, Human
gcacucucuccuaccaga

SEQ ID NO: 175945 - RNA, 23 nt, Human
gccugggcugaggccugggcccu

SEQ ID NO: 175946 - RNA, 18 nt, Human
ggaaaggaagggaggagg

SEQ ID NO: 175947 - RNA, 23 nt, Human
ggaaugguccagugcugggcugg

SEQ ID NO: 175948 - RNA, 21 nt, Human
ggaugggggucaucuggguga

SEQ ID NO: 175949 - RNA, 22 nt, Human
ggcccugggaagugacagcagc

SEQ ID NO: 175950 - RNA, 21 nt, Human
ggccugggcugaggccugggc

SEQ ID NO: 175951 - RNA, 23 nt, Human
ggcggccacguggcucugcagca

SEQ ID NO: 175952 - RNA, 18 nt, Human
gggaaacaggcagagaag

SEQ ID NO: 175953 - RNA, 18 nt, Human
gggagagaggagagagca

SEQ ID NO: 175954 - RNA, 19 nt, Human
gggaugggggucaucuggg

SEQ ID NO: 175955 - RNA, 21 nt, Human
ggggucaucugggugaggcuu

SEQ ID NO: 175956 - RNA, 19 nt, Human
gucacgaucagaauccagu

SEQ ID NO: 175957 - RNA, 22 nt, Human
guccaacccccaaucucacccc

SEQ ID NO: 175958 - RNA, 19 nt, Human
gugcuccacacaccaccag

SEQ ID NO: 175959 - RNA, 18 nt, Human
guggcucugcagcacucc

SEQ ID NO: 175960 - RNA, 21 nt, Human
guuggucccgaggccugggcu

SEQ ID NO: 175961 - RNA, 24 nt, Human
uaagaugaugaagacagcaaaaca

SEQ ID NO: 175962 - RNA, 19 nt, Human
uaagguuuuagcuccuggc

SEQ ID NO: 175963 - RNA, 21 nt, Human
uaccucaggcucccccacuga

SEQ ID NO: 175964 - RNA, 18 nt, Human
ucagaagacgugacaaac

SEQ ID NO: 175965 - RNA, 19 nt, Human
ucagaauccaguucaucug

SEQ ID NO: 175966 - RNA, 21 nt, Human
ucagagagacugaaagucauu

SEQ ID NO: 175967 - RNA, 22 nt, Human
ucaggcccuggagacagaagga

SEQ ID NO: 175968 - RNA, 26 nt, Human
ucagugaagauuuguugaucugacag

SEQ ID NO: 175969 - RNA, 22 nt, Human
uccacacaccaccagggcccuu

SEQ ID NO: 175970 - RNA, 19 nt, Human
uccauagucucaaacucca

SEQ ID NO: 175971 - RNA, 19 nt, Human
ucccagcauucccagugcc

SEQ ID NO: 175972 - RNA, 20 nt, Human
ucccugaaaccgcccaacuu

SEQ ID NO: 175973 - RNA, 22 nt, Human
ucccuuaacuuccucugggccu

SEQ ID NO: 175974 - RNA, 23 nt, Human
uccuaagccucaguuuccccauc

SEQ ID NO: 175975 - RNA, 22 nt, Human
uccucacucuucucuguaccuc

SEQ ID NO: 175976 - RNA, 18 nt, Human
uccucuguaaaauggggu

SEQ ID NO: 175977 - RNA, 26 nt, Human
ucgcacauuacugagcccacaucaug

SEQ ID NO: 175978 - RNA, 23 nt, Human
ucucagacaaauccuccuggcuu

SEQ ID NO: 175979 - RNA, 19 nt, Human
ucucgcacauuacugagcc

SEQ ID NO: 175980 - RNA, 19 nt, Human
ucuuuuuucccccagaggu

SEQ ID NO: 175981 - RNA, 18 nt, Human
ugaagacagcaaaacaag

SEQ ID NO: 175982 - RNA, 18 nt, Human
ugaccuugagucaguccu

SEQ ID NO: 175983 - RNA, 20 nt, Human
ugagagaaugcaagagcaca

SEQ ID NO: 175984 - RNA, 22 nt, Human
ugagagaggacaucacucuggu

SEQ ID NO: 175985 - RNA, 26 nt, Human
ugagucaguccucacucuucucugua

SEQ ID NO: 175986 - RNA, 18 nt, Human
ugauagcugagagaggac

SEQ ID NO: 175987 - RNA, 24 nt, Human
ugcaaaacagaaccagauaucuaa

SEQ ID NO: 175988 - RNA, 21 nt, Human
ugcaagagcacagagagaaca

SEQ ID NO: 175989 - RNA, 21 nt, Human
ugccaagcugggugcaaaaca

SEQ ID NO: 175990 - RNA, 19 nt, Human
ugcccagagcagggugugg

SEQ ID NO: 175991 - RNA, 20 nt, Human
uggaaaggaagggaggaggg

SEQ ID NO: 175992 - RNA, 22 nt, Human
uggaaaggaagggaggagggaa

SEQ ID NO: 175993 - RNA, 20 nt, Human
uggcuuccacagcuggaccc

SEQ ID NO: 175994 - RNA, 22 nt, Human
uggggcccuggaaggagauuuu

SEQ ID NO: 175995 - RNA, 23 nt, Human
uggggcugcgauggagaaguggg

SEQ ID NO: 175996 - RNA, 23 nt, Human
ugguaaagaucaggcccuggaga

SEQ ID NO: 175997 - RNA, 18 nt, Human
ugguaugagggauggggg

SEQ ID NO: 175998 - RNA, 24 nt, Human
uguccugggcuguaauuuggagac

SEQ ID NO: 175999 - RNA, 20 nt, Human
uucagagagacugaaaguca

SEQ ID NO: 176000 - RNA, 18 nt, Human
uucuucccagacagcuca

SEQ ID NO: 176001 - RNA, 20 nt, Human
uuggcccucccucacccugc

SEQ ID NO: 176002 - RNA, 27 nt, Human
uuuagcuccuggcucagcagccaaggu

SEQ ID NO: 176003 - RNA, 22 nt, Human
aagcggcgcgcgccgccggcuc

SEQ ID NO: 176004 - RNA, 22 nt, Human
acaaaacccggaaggaccccgc

SEQ ID NO: 176005 - RNA, 20 nt, Human
acacacgagaaccuucaaag

SEQ ID NO: 176006 - RNA, 20 nt, Human
agcaggguggauguucaggg

SEQ ID NO: 176007 - RNA, 24 nt, Human
agugcgucaagccaccccagcagg

SEQ ID NO: 176008 - RNA, 24 nt, Human
caaaacccggaaggaccccgccga

SEQ ID NO: 176009 - RNA, 23 nt, Human
caccgcgugacgcggcgccgggu

SEQ ID NO: 176010 - RNA, 19 nt, Human
cagcacuggacgcggagag

SEQ ID NO: 176011 - RNA, 26 nt, Human
cagcagcagcagcagagcggcgcgag

SEQ ID NO: 176012 - RNA, 23 nt, Human
cgacacaaaacccggaaggaccc

SEQ ID NO: 176013 - RNA, 22 nt, Human
cgagcgaacagauuugcacaga

SEQ ID NO: 176014 - RNA, 18 nt, Human
cgccgcguaaacgacgcg

SEQ ID NO: 176015 - RNA, 23 nt, Human
cggcggaggaggagcgagggucg

SEQ ID NO: 176016 - RNA, 20 nt, Human
gaagugcgucaagccacccc

SEQ ID NO: 176017 - RNA, 19 nt, Human
gaccugcaggccgagacac

SEQ ID NO: 176018 - RNA, 22 nt, Human
gagcgaacagauuugcacagaa

SEQ ID NO: 176019 - RNA, 19 nt, Human
gaguaguuuuuuuuuuuuu

SEQ ID NO: 176020 - RNA, 24 nt, Human
gcagcagcagagcggcgcgagcac

SEQ ID NO: 176021 - RNA, 20 nt, Human
gccugcggcccugggcuguc

SEQ ID NO: 176022 - RNA, 18 nt, Human
gcggcggcgggcaaggag

SEQ ID NO: 176023 - RNA, 21 nt, Human
gcguaaacgacgcggcgcgcg

SEQ ID NO: 176024 - RNA, 18 nt, Human
gggaggcggcggcgggca

SEQ ID NO: 176025 - RNA, 23 nt, Human
gggcggcagcagcagcagcagag

SEQ ID NO: 176026 - RNA, 21 nt, Human
guggauguucagggacacagc

SEQ ID NO: 176027 - RNA, 21 nt, Human
guggcgacggaagcggcgcgc

SEQ ID NO: 176028 - RNA, 21 nt, Human
ucgacacaaaacccggaagga

SEQ ID NO: 176029 - RNA, 24 nt, Human
ucuuuuguaaaguggacauaagag

SEQ ID NO: 176030 - RNA, 27 nt, Human
ugagccugcggcccugggcuguccagg

SEQ ID NO: 176031 - RNA, 23 nt, Human
uggacauaagaguaguuuuuuuu

SEQ ID NO: 176032 - RNA, 19 nt, Human
uggauguucagggacacag

SEQ ID NO: 176033 - RNA, 22 nt, Human
uggauguucagggacacagcuc

SEQ ID NO: 176034 - RNA, 18 nt, Human
ugggaguaaucacaaugc

SEQ ID NO: 176035 - RNA, 25 nt, Human
uuguggggguaaaaucaggcagcca

SEQ ID NO: 176036 - RNA, 24 nt, Human
agggcugaaguggggugggaggug

SEQ ID NO: 176037 - RNA, 19 nt, Human
agguggcuaggcucugaag

SEQ ID NO: 176038 - RNA, 23 nt, Human
aucaguuuuucaggggacagggc

SEQ ID NO: 176039 - RNA, 22 nt, Human
caggggacagggcugaaguggg

SEQ ID NO: 176040 - RNA, 20 nt, Human
ccuggugccucucaggucuc

SEQ ID NO: 176041 - RNA, 25 nt, Human
ugggagguguguggugccaaccacg

SEQ ID NO: 176042 - RNA, 18 nt, Human
uggggugggagguggcua

SEQ ID NO: 176043 - RNA, 20 nt, Human
uggggugggagguggcuagg

SEQ ID NO: 176044 - RNA, 21 nt, Human
uggggugggagguggcuaggc

SEQ ID NO: 176045 - RNA, 22 nt, Human
uggggugggagguggcuaggcu

SEQ ID NO: 176046 - RNA, 25 nt, Human
uggggugggagguggcuaggcucuu

SEQ ID NO: 176047 - RNA, 22 nt, Human
aaaaaaacaaacaucauaaaga

SEQ ID NO: 176048 - RNA, 23 nt, Human
aaaaaaacaaacaucauaaagag

SEQ ID NO: 176049 - RNA, 18 nt, Human
aaaaaugacaaaaaaaca

SEQ ID NO: 176050 - RNA, 21 nt, Human
aaacaaacaucauaaagagac

SEQ ID NO: 176051 - RNA, 21 nt, Human
acaaaaaaacaaacaucauaa

SEQ ID NO: 176052 - RNA, 24 nt, Human
acaaaguacagcaacugguaacaa

SEQ ID NO: 176053 - RNA, 26 nt, Human
acaaaguacagcaacugguaacaaac

SEQ ID NO: 176054 - RNA, 25 nt, Human
acccgagagcccuccgcucggcccc

SEQ ID NO: 176055 - RNA, 19 nt, Human
accgcgcggcgcggcgggu

SEQ ID NO: 176056 - RNA, 21 nt, Human
acgcggagccgguggaaaagu

SEQ ID NO: 176057 - RNA, 22 nt, Human
acuggcacuuuuuuuugccccc

SEQ ID NO: 176058 - RNA, 21 nt, Human
agagcccuccgcucggccccc

SEQ ID NO: 176059 - RNA, 25 nt, Human
agaucagcauuuuuggacccuuaau

SEQ ID NO: 176060 - RNA, 19 nt, Human
agccaacggcggggggcgc

SEQ ID NO: 176061 - RNA, 19 nt, Human
agccacaggugcccggcgc

SEQ ID NO: 176062 - RNA, 18 nt, Human
aucccuucuaucuguccc

SEQ ID NO: 176063 - RNA, 21 nt, Human
augaaauuaaggucaagggcu

SEQ ID NO: 176064 - RNA, 18 nt, Human
augacaaaaaaacaaaca

SEQ ID NO: 176065 - RNA, 18 nt, Human
caaaaaaaauacacaaau

SEQ ID NO: 176066 - RNA, 21 nt, Human
caaaaaugacaaaaaaacaaa

SEQ ID NO: 176067 - RNA, 20 nt, Human
caaauugcuaaggccccacu

SEQ ID NO: 176068 - RNA, 23 nt, Human
caccauggcaaccccuuagaucc

SEQ ID NO: 176069 - RNA, 20 nt, Human
cacccgagagcccuccgcuc

SEQ ID NO: 176070 - RNA, 20 nt, Human
cagaagguccccuuucgcuc

SEQ ID NO: 176071 - RNA, 19 nt, Human
cagcggcggccgccgggag

SEQ ID NO: 176072 - RNA, 19 nt, Human
caugcuugcuuccucccgg

SEQ ID NO: 176073 - RNA, 20 nt, Human
ccacaugcuugcuuccuccc

SEQ ID NO: 176074 - RNA, 21 nt, Human
ccacuggucagcaccuucccu

SEQ ID NO: 176075 - RNA, 24 nt, Human
cccacaugcuugcuuccucccgga

SEQ ID NO: 176076 - RNA, 22 nt, Human
ccccaaccaucccuucuaucug

SEQ ID NO: 176077 - RNA, 22 nt, Human
cccgcagccaacggcggggggc

SEQ ID NO: 176078 - RNA, 19 nt, Human
cccgcucucccacccgaga

SEQ ID NO: 176079 - RNA, 22 nt, Human
ccgcagccaacggcggggggcg

SEQ ID NO: 176080 - RNA, 23 nt, Human
ccgccgggagaggaggggaaagg

SEQ ID NO: 176081 - RNA, 19 nt, Human
ccgcugguggcagaagguc

SEQ ID NO: 176082 - RNA, 25 nt, Human
ccgcugguggcagaagguccccuuu

SEQ ID NO: 176083 - RNA, 23 nt, Human
ccggugguggcgggagaggcucu

SEQ ID NO: 176084 - RNA, 18 nt, Human
ccuccuucccaacccuuc

SEQ ID NO: 176085 - RNA, 21 nt, Human
ccucuaaggcaaucgccaccc

SEQ ID NO: 176086 - RNA, 19 nt, Human
cgagcacgggagugggacg

SEQ ID NO: 176087 - RNA, 22 nt, Human
cgggggggugcgggccgcgggg

SEQ ID NO: 176088 - RNA, 22 nt, Human
cucacugucgccccgggggggu

SEQ ID NO: 176089 - RNA, 22 nt, Human
cugaacacugcagcuagcuuuc

SEQ ID NO: 176090 - RNA, 21 nt, Human
cugaagcauacaauuuauaaa

SEQ ID NO: 176091 - RNA, 22 nt, Human
cuggacggcagacgaguuggga

SEQ ID NO: 176092 - RNA, 19 nt, Human
cuggcugcgguggcuuccu

SEQ ID NO: 176093 - RNA, 24 nt, Human
cuucauaaauccaugcgcgccgcu

SEQ ID NO: 176094 - RNA, 24 nt, Human
cuuccuggaaaugaacagcugucg

SEQ ID NO: 176095 - RNA, 23 nt, Human
cuucuaucugucccaagccacag

SEQ ID NO: 176096 - RNA, 22 nt, Human
cuugcuuccucccggacguccu

SEQ ID NO: 176097 - RNA, 18 nt, Human
gaggcgagcacgggagug

SEQ ID NO: 176098 - RNA, 22 nt, Human
gccggcuguccccgugccggcu

SEQ ID NO: 176099 - RNA, 18 nt, Human
gccgggagaggaggggaa

SEQ ID NO: 176100 - RNA, 20 nt, Human
gcggcgggugcauuuugcuc

SEQ ID NO: 176101 - RNA, 21 nt, Human
ggacgcggagccgguggaaaa

SEQ ID NO: 176102 - RNA, 19 nt, Human
ggcaauauacauucuccgc

SEQ ID NO: 176103 - RNA, 20 nt, Human
ggcacuuuuuuuugcccccu

SEQ ID NO: 176104 - RNA, 20 nt, Human
gggagcggcggacgcggagc

SEQ ID NO: 176105 - RNA, 19 nt, Human
gggaguuucuggagcuugg

SEQ ID NO: 176106 - RNA, 24 nt, Human
guggaaaaguuuguccaaguccug

SEQ ID NO: 176107 - RNA, 23 nt, Human
uaaaacaaauaaccaaaaaaaau

SEQ ID NO: 176108 - RNA, 23 nt, Human
uaaagaacaaaaaugacaaaaaa

SEQ ID NO: 176109 - RNA, 23 nt, Human
uaaagagacuuucauacauggca

SEQ ID NO: 176110 - RNA, 21 nt, Human
uaaggcaguuuggaaaugcau

SEQ ID NO: 176111 - RNA, 19 nt, Human
uacuguucugucccccaca

SEQ ID NO: 176112 - RNA, 22 nt, Human
uagcaacccugauaggagcaga

SEQ ID NO: 176113 - RNA, 20 nt, Human
uauccaaaaccaauuuaggg

SEQ ID NO: 176114 - RNA, 18 nt, Human
uauccucacuggccacaa

SEQ ID NO: 176115 - RNA, 22 nt, Human
ucaacaccauggcaaccccuua

SEQ ID NO: 176116 - RNA, 21 nt, Human
uccaagaagucaagcuccgga

SEQ ID NO: 176117 - RNA, 18 nt, Human
uccaugcgcgccgcuggc

SEQ ID NO: 176118 - RNA, 18 nt, Human
uccaugcgcgccgcuggc

SEQ ID NO: 176119 - RNA, 19 nt, Human
uccaugcgcgccgcuggcu

SEQ ID NO: 176120 - RNA, 20 nt, Human
uccaugcgcgccgcuggcug

SEQ ID NO: 176121 - RNA, 21 nt, Human
uccaugcgcgccgcuggcuga

SEQ ID NO: 176122 - RNA, 19 nt, Human
ucccaagccacaggugccc

SEQ ID NO: 176123 - RNA, 24 nt, Human
uccccaaccaucccuucuaucugu

SEQ ID NO: 176124 - RNA, 20 nt, Human
ucccgcucucccacccgaga

SEQ ID NO: 176125 - RNA, 19 nt, Human
ucgaggcgagcacgggagu

SEQ ID NO: 176126 - RNA, 23 nt, Human
ucggcccccggugguggcgggag

SEQ ID NO: 176127 - RNA, 24 nt, Human
ucucccgcagccaacggcgggggg

SEQ ID NO: 176128 - RNA, 28 nt, Human
ugacaaaaaaacaaacaucauaaagaga

SEQ ID NO: 176129 - RNA, 22 nt, Human
ugcaaauauaauuccuccuucc

SEQ ID NO: 176130 - RNA, 21 nt, Human
ugcccggcgcggggucgaggc

SEQ ID NO: 176131 - RNA, 22 nt, Human
ugcggccggcuguccccgugcc

SEQ ID NO: 176132 - RNA, 22 nt, Human
uggaugugaguuuaaaacuuuu

SEQ ID NO: 176133 - RNA, 25 nt, Human
uggaugugaguuuaaaacuuuuaau

SEQ ID NO: 176134 - RNA, 20 nt, Human
uggcaaccccuuagaucagc

SEQ ID NO: 176135 - RNA, 19 nt, Human
ugugcuaagagaucagagu

SEQ ID NO: 176136 - RNA, 23 nt, Human
uuaaggcaguuuggaaaugcauu

SEQ ID NO: 176137 - RNA, 22 nt, Human
uuaauccuaagaaaugugcuaa

SEQ ID NO: 176138 - RNA, 25 nt, Human
uucuauauacaaaguacagcaacug

SEQ ID NO: 176139 - RNA, 20 nt, Human
uucucuugaaaauaagaauu

SEQ ID NO: 176140 - RNA, 20 nt, Human
uugcauuguucaacaccaug

SEQ ID NO: 176141 - RNA, 20 nt, Human
uugcuuccucccggacgucc

SEQ ID NO: 176142 - RNA, 23 nt, Human
uuggaaaugcauuuguacauuuc

SEQ ID NO: 176143 - RNA, 18 nt, Human
aaccaucaccagcaaggc

SEQ ID NO: 176144 - RNA, 19 nt, Human
aaccucacugccucacccc

SEQ ID NO: 176145 - RNA, 21 nt, Human
aaccucacugccucaccccac

SEQ ID NO: 176146 - RNA, 22 nt, Human
aacugcaggaccuaacagccuc

SEQ ID NO: 176147 - RNA, 27 nt, Human
aagucccggcccccuggagaaucccac

SEQ ID NO: 176148 - RNA, 20 nt, Human
acacaggcuggacgugcggc

SEQ ID NO: 176149 - RNA, 27 nt, Human
acagacccagauggucacuguccugga

SEQ ID NO: 176150 - RNA, 22 nt, Human
acgcuggcugcacccacccagc

SEQ ID NO: 176151 - RNA, 18 nt, Human
acuuaugcauagagaaaa

SEQ ID NO: 176152 - RNA, 21 nt, Human
agacaggcagcacagcgcggc

SEQ ID NO: 176153 - RNA, 23 nt, Human
agaggaagagggggcaggaaagc

SEQ ID NO: 176154 - RNA, 18 nt, Human
agcugggguggggggcuu

SEQ ID NO: 176155 - RNA, 26 nt, Human
aggaaagcugggguggggggcuucug

SEQ ID NO: 176156 - RNA, 23 nt, Human
aggaagagggggcaggaaagcuu

SEQ ID NO: 176157 - RNA, 18 nt, Human
aggcagugggcagacugg

SEQ ID NO: 176158 - RNA, 18 nt, Human
aggccagguccugcuggc

SEQ ID NO: 176159 - RNA, 22 nt, Human
aggcccagcggcgacuccggga

SEQ ID NO: 176160 - RNA, 21 nt, Human
aggcugccugcccguucccgc

SEQ ID NO: 176161 - RNA, 23 nt, Human
aggcugguucucugggcuguggc

SEQ ID NO: 176162 - RNA, 23 nt, Human
aggcuuuguggggaggcugggcc

SEQ ID NO: 176163 - RNA, 22 nt, Human
aggugccgccgacuguggucgg

SEQ ID NO: 176164 - RNA, 21 nt, Human
auugccccaacccccagguga

SEQ ID NO: 176165 - RNA, 24 nt, Human
cacagacccagauggucacugucc

SEQ ID NO: 176166 - RNA, 20 nt, Human
cacccagcccucaacagagc

SEQ ID NO: 176167 - RNA, 19 nt, Human
cacccagggaagggagcga

SEQ ID NO: 176168 - RNA, 22 nt, Human
cacccagggaagggagcgacag

SEQ ID NO: 176169 - RNA, 19 nt, Human
caccuacaagcucaccuuc

SEQ ID NO: 176170 - RNA, 21 nt, Human
cacuuuauaaguuuuuaaaca

SEQ ID NO: 176171 - RNA, 19 nt, Human
cagcucucugggccuaacc

SEQ ID NO: 176172 - RNA, 19 nt, Human
caggcaccuacaagcucac

SEQ ID NO: 176173 - RNA, 19 nt, Human
caggccagguccugcuggc

SEQ ID NO: 176174 - RNA, 20 nt, Human
caggugguucuccuccacag

SEQ ID NO: 176175 - RNA, 18 nt, Human
ccacccagcccucaacag

SEQ ID NO: 176176 - RNA, 23 nt, Human
ccagaaguuccacgugccccugg

SEQ ID NO: 176177 - RNA, 23 nt, Human
ccagacccucagucugggcugcu

SEQ ID NO: 176178 - RNA, 20 nt, Human
ccagauggucacuguccugg

SEQ ID NO: 176179 - RNA, 24 nt, Human
cccacacuggagccgccgcagaag

SEQ ID NO: 176180 - RNA, 21 nt, Human
cccacauguggaggugagagc

SEQ ID NO: 176181 - RNA, 22 nt, Human
cccagcggcgacuccgggaccc

SEQ ID NO: 176182 - RNA, 20 nt, Human
ccccacacuggagccgccgc

SEQ ID NO: 176183 - RNA, 19 nt, Human
cccccggaagccacgccgu

SEQ ID NO: 176184 - RNA, 23 nt, Human
ccccugguccuacaucaccuacc

SEQ ID NO: 176185 - RNA, 19 nt, Human
ccuacaagcucaccuucga

SEQ ID NO: 176186 - RNA, 21 nt, Human
ccugacuuacugggcuguggc

SEQ ID NO: 176187 - RNA, 20 nt, Human
ccugcaggugguucuccucc

SEQ ID NO: 176188 - RNA, 18 nt, Human
cgaguguuccuaggcugg

SEQ ID NO: 176189 - RNA, 19 nt, Human
cggcaaccgcugggcgaug

SEQ ID NO: 176190 - RNA, 24 nt, Human
cucacuugcuuugagcucccaaaa

SEQ ID NO: 176191 - RNA, 25 nt, Human
cucuacgaggacacacccgucacuc

SEQ ID NO: 176192 - RNA, 19 nt, Human
cugcaggugguucuccucc

SEQ ID NO: 176193 - RNA, 18 nt, Human
cugcugaauucucucagg

SEQ ID NO: 176194 - RNA, 18 nt, Human
cuggcagcgggaggcugc

SEQ ID NO: 176195 - RNA, 20 nt, Human
cugguccugggcgguggcag

SEQ ID NO: 176196 - RNA, 18 nt, Human
cuguggucggaggugaga

SEQ ID NO: 176197 - RNA, 19 nt, Human
gaaaagcuuucauuugcug

SEQ ID NO: 176198 - RNA, 21 nt, Human
gagagccccagugggcuggag

SEQ ID NO: 176199 - RNA, 21 nt, Human
gagcauuggcucaccacuucc

SEQ ID NO: 176200 - RNA, 21 nt, Human
gagccaacuccagcucucugg

SEQ ID NO: 176201 - RNA, 21 nt, Human
gaggugagaccagggaguagg

SEQ ID NO: 176202 - RNA, 23 nt, Human
gagugucccucuggugcggaagg

SEQ ID NO: 176203 - RNA, 22 nt, Human
gauggcaagaacaugugaaaag

SEQ ID NO: 176204 - RNA, 18 nt, Human
gcccucaacagagcgggc

SEQ ID NO: 176205 - RNA, 23 nt, Human
gcugggccaagggugauucaucc

SEQ ID NO: 176206 - RNA, 18 nt, Human
ggaaagcuucuacccaca

SEQ ID NO: 176207 - RNA, 18 nt, Human
ggcacucugagaaggugc

SEQ ID NO: 176208 - RNA, 19 nt, Human
ggcuucugguccccaucuc

SEQ ID NO: 176209 - RNA, 26 nt, Human
gggcagcugugacucaggugucaaug

SEQ ID NO: 176210 - RNA, 24 nt, Human
gggcagugucugaggcccacuggg

SEQ ID NO: 176211 - RNA, 25 nt, Human
ggggugucaucccgaguguuccuag

SEQ ID NO: 176212 - RNA, 18 nt, Human
gucccuagacugcucugg

SEQ ID NO: 176213 - RNA, 22 nt, Human
gugggacaacaguggcgcgaag

SEQ ID NO: 176214 - RNA, 22 nt, Human
gugggcuggagggggcugaggc

SEQ ID NO: 176215 - RNA, 23 nt, Human
gugggcuggagggggcugaggcu

SEQ ID NO: 176216 - RNA, 21 nt, Human
uaaccucacugccucacccca

SEQ ID NO: 176217 - RNA, 26 nt, Human
uaaccucacugccucaccccacacug

SEQ ID NO: 176218 - RNA, 19 nt, Human
uaggccuggacacaggcug

SEQ ID NO: 176219 - RNA, 19 nt, Human
uaggcugguucucugggcu

SEQ ID NO: 176220 - RNA, 21 nt, Human
uaggugguuugcugcuauccc

SEQ ID NO: 176221 - RNA, 24 nt, Human
uagugccagcaccugcaaagcugu

SEQ ID NO: 176222 - RNA, 21 nt, Human
ucacugccucaccccacacug

SEQ ID NO: 176223 - RNA, 18 nt, Human
ucaggcuuuguggggagg

SEQ ID NO: 176224 - RNA, 21 nt, Human
uccacgugccccugguccuac

SEQ ID NO: 176225 - RNA, 21 nt, Human
ucccuuuuugcuucucugugu

SEQ ID NO: 176226 - RNA, 18 nt, Human
uccuuggugugauaaggg

SEQ ID NO: 176227 - RNA, 18 nt, Human
ucuccuggccucuccauc

SEQ ID NO: 176228 - RNA, 20 nt, Human
ucucugggccuaaccucacu

SEQ ID NO: 176229 - RNA, 24 nt, Human
ucucugggccuaaccucacugccu

SEQ ID NO: 176230 - RNA, 20 nt, Human
ucuugcucaugggauaaauu

SEQ ID NO: 176231 - RNA, 21 nt, Human
ugagaaggugccgccgacugu

SEQ ID NO: 176232 - RNA, 23 nt, Human
ugagaccagggaguaggccugga

SEQ ID NO: 176233 - RNA, 21 nt, Human
ugcacccacccagcccucaac

SEQ ID NO: 176234 - RNA, 21 nt, Human
ugcaggugguucuccuccaca

SEQ ID NO: 176235 - RNA, 18 nt, Human
ugccgccgacuguggucg

SEQ ID NO: 176236 - RNA, 18 nt, Human
uggacacaggcuggacgu

SEQ ID NO: 176237 - RNA, 20 nt, Human
uggcuucuguggaguguccc

SEQ ID NO: 176238 - RNA, 20 nt, Human
ugggagacuuuuucccuuuu

SEQ ID NO: 176239 - RNA, 23 nt, Human
ugggaugcagacccaggaaagcu

SEQ ID NO: 176240 - RNA, 21 nt, Human
ugggcuggagggggcugaggc

SEQ ID NO: 176241 - RNA, 21 nt, Human
ugggugaggguccugcaggug

SEQ ID NO: 176242 - RNA, 21 nt, Human
uggucggaggugagaccaggg

SEQ ID NO: 176243 - RNA, 22 nt, Human
uguuggggccagauaggugguu

SEQ ID NO: 176244 - RNA, 28 nt, Human
uguuuuaaccaucaccagcaaggcccag

SEQ ID NO: 176245 - RNA, 19 nt, Human
uucaucugagccaacucca

SEQ ID NO: 176246 - RNA, 18 nt, Human
uuucccggcaaccgcugg

SEQ ID NO: 176247 - RNA, 24 nt, Human
uuugagcucccaaaagaaaggugu

SEQ ID NO: 176248 - RNA, 25 nt, Human
aaaaaaaaaaaaaaaagcauaaaaa

SEQ ID NO: 176249 - RNA, 22 nt, Human
aaaaaaaagcauaaaaaucuug

SEQ ID NO: 176250 - RNA, 22 nt, Human
aaaaugcuuugaaauaacauga

SEQ ID NO: 176251 - RNA, 19 nt, Human
aaacuucuaaaaguacccc

SEQ ID NO: 176252 - RNA, 22 nt, Human
aagcaggcacuuucuguugacu

SEQ ID NO: 176253 - RNA, 23 nt, Human
aauugcuuuuuauacagacucgu

SEQ ID NO: 176254 - RNA, 19 nt, Human
acacuaaucaucauuuugu

SEQ ID NO: 176255 - RNA, 25 nt, Human
agagauauacuuuaaggcagccuuc

SEQ ID NO: 176256 - RNA, 22 nt, Human
agauauacuuuaaggcagccuu

SEQ ID NO: 176257 - RNA, 18 nt, Human
agugcuacucuuugaaca

SEQ ID NO: 176258 - RNA, 28 nt, Human
aucauuuuguaaaaaaaaaaaaaaaaaa

SEQ ID NO: 176259 - RNA, 22 nt, Human
auuacacuagaucauucuaaac

SEQ ID NO: 176260 - RNA, 21 nt, Human
auugguauaaaacagcccugu

SEQ ID NO: 176261 - RNA, 22 nt, Human
cacauuaucacacuaaucauca

SEQ ID NO: 176262 - RNA, 23 nt, Human
cacuagaucauucuaaacacagc

SEQ ID NO: 176263 - RNA, 21 nt, Human
cagcacauuaucacacuaauc

SEQ ID NO: 176264 - RNA, 23 nt, Human
cauagauaagagauauacuuuaa

SEQ ID NO: 176265 - RNA, 18 nt, Human
cuaaacacagccaugugc

SEQ ID NO: 176266 - RNA, 19 nt, Human
cuaaacacagccaugugcu

SEQ ID NO: 176267 - RNA, 22 nt, Human
gaacuaaacugacuauacugga

SEQ ID NO: 176268 - RNA, 25 nt, Human
guaaagcaggcacuuucuguugacu

SEQ ID NO: 176269 - RNA, 27 nt, Human
guacugaaaacuucuaaaaguacccca

SEQ ID NO: 176270 - RNA, 21 nt, Human
guauaaaacagcccuguccca

SEQ ID NO: 176271 - RNA, 25 nt, Human
uaaaaaaaaaaaaaaaaaaaagcau

SEQ ID NO: 176272 - RNA, 21 nt, Human
uaaaacagcccugucccaggu

SEQ ID NO: 176273 - RNA, 22 nt, Human
uaaaacagcccugucccaggua

SEQ ID NO: 176274 - RNA, 19 nt, Human
uaacaugaaaucaaugaac

SEQ ID NO: 176275 - RNA, 20 nt, Human
uaagagauauacuuuaaggc

SEQ ID NO: 176276 - RNA, 19 nt, Human
uaccccagauauuugguca

SEQ ID NO: 176277 - RNA, 20 nt, Human
uagcaaaauaggauuaacua

SEQ ID NO: 176278 - RNA, 21 nt, Human
ucugucuaucuuucuccaaaa

SEQ ID NO: 176279 - RNA, 21 nt, Human
ucuugcaauuauaaaaauguc

SEQ ID NO: 176280 - RNA, 21 nt, Human
ugaugacauuuuucugucuuc

SEQ ID NO: 176281 - RNA, 18 nt, Human
ugcuuugaaauaacauga

SEQ ID NO: 176282 - RNA, 25 nt, Human
uguaaaaaaaaaaaaaaaaaaaagc

SEQ ID NO: 176283 - RNA, 28 nt, Human
uguaaagcaggcacuuucuguugacuua

SEQ ID NO: 176284 - RNA, 18 nt, Human
ugucccagguauacaagg

SEQ ID NO: 176285 - RNA, 22 nt, Human
ugucuaucuuucuccaaaacag

SEQ ID NO: 176286 - RNA, 22 nt, Human
uucugucuaucuuucuccaaaa

SEQ ID NO: 176287 - RNA, 20 nt, Human
aacaucacagcauuugcagu

SEQ ID NO: 176288 - RNA, 23 nt, Human
aagaaauucauggucaacagcug

SEQ ID NO: 176289 - RNA, 21 nt, Human
acaaguaauacuuuauaauga

SEQ ID NO: 176290 - RNA, 22 nt, Human
acagcauuugcaguaaguccau

SEQ ID NO: 176291 - RNA, 19 nt, Human
acuacauuuauugaauacu

SEQ ID NO: 176292 - RNA, 20 nt, Human
aggaugggggcagguaagaa

SEQ ID NO: 176293 - RNA, 21 nt, Human
augaaguuccucuaagaaaca

SEQ ID NO: 176294 - RNA, 21 nt, Human
caaauuccuauugcuaagaaa

SEQ ID NO: 176295 - RNA, 28 nt, Human
caguaaguccauuucuccagugaagccc

SEQ ID NO: 176296 - RNA, 22 nt, Human
cccaccuuauuuucaguuuagc

SEQ ID NO: 176297 - RNA, 18 nt, Human
ccucagagaccgcgcucc

SEQ ID NO: 176298 - RNA, 23 nt, Human
cuggcggggucgccgcuccccuc

SEQ ID NO: 176299 - RNA, 21 nt, Human
gaagaagccgccgccgccagg

SEQ ID NO: 176300 - RNA, 22 nt, Human
gcuggcggggucgccgcucccc

SEQ ID NO: 176301 - RNA, 24 nt, Human
uaaaauaccuauauagcauccauu

SEQ ID NO: 176302 - RNA, 21 nt, Human
uaaacauuuuuaaaaacugug

SEQ ID NO: 176303 - RNA, 24 nt, Human
uaauaagcuauacauauacuacaa

SEQ ID NO: 176304 - RNA, 22 nt, Human
uacaaguaauacuuuauaauga

SEQ ID NO: 176305 - RNA, 22 nt, Human
ucacagcauuugcaguaagucc

SEQ ID NO: 176306 - RNA, 19 nt, Human
uccucuaagaaacaucacu

SEQ ID NO: 176307 - RNA, 24 nt, Human
ugcuaagaaauucauggucaacag

SEQ ID NO: 176308 - RNA, 21 nt, Human
uguaaacuacauuuauugaau

SEQ ID NO: 176309 - RNA, 22 nt, Human
uugaauacuuacuggacacauc

SEQ ID NO: 176310 - RNA, 21 nt, Human
uuuguacaaguaauacuuuau

SEQ ID NO: 176311 - RNA, 19 nt, Human
uuuuuuuuuuuuaggaucu

SEQ ID NO: 176312 - RNA, 23 nt, Human
uuuuuuuuuuuuuuuuuuuuagg

SEQ ID NO: 176313 - RNA, 19 nt, Human
aaaaauaaagaaggagggc

SEQ ID NO: 176314 - RNA, 20 nt, Human
aaacaccaaggaacaguccu

SEQ ID NO: 176315 - RNA, 20 nt, Human
aaagaaggagggcugcaaag

SEQ ID NO: 176316 - RNA, 24 nt, Human
aaagagcugggauuacaggcguga

SEQ ID NO: 176317 - RNA, 23 nt, Human
aaagaucgacgaaugagauccaa

SEQ ID NO: 176318 - RNA, 18 nt, Human
aaagaugccagacucaaa

SEQ ID NO: 176319 - RNA, 22 nt, Human
aaagggaggagguacaugcagu

SEQ ID NO: 176320 - RNA, 18 nt, Human
aaaugagaaagggaggag

SEQ ID NO: 176321 - RNA, 22 nt, Human
aacaccacacgcaaucuccaaa

SEQ ID NO: 176322 - RNA, 24 nt, Human
aacagcuugugggcacagcuggca

SEQ ID NO: 176323 - RNA, 24 nt, Human
aaccaacuuggaacaccauuuggc

SEQ ID NO: 176324 - RNA, 24 nt, Human
aaccuugauuucaaccagaaacgg

SEQ ID NO: 176325 - RNA, 18 nt, Human
aacugggugugguccugu

SEQ ID NO: 176326 - RNA, 19 nt, Human
aagaagacagagccaucug

SEQ ID NO: 176327 - RNA, 18 nt, Human
aagaagcagaguaguacg

SEQ ID NO: 176328 - RNA, 21 nt, Human
aagacagagccaucuggggga

SEQ ID NO: 176329 - RNA, 21 nt, Human
aagacccugggccaagaacuu

SEQ ID NO: 176330 - RNA, 21 nt, Human
aagagcugggauuacaggcgu

SEQ ID NO: 176331 - RNA, 18 nt, Human
aagaugccagacucaaaa

SEQ ID NO: 176332 - RNA, 25 nt, Human
aagcaaacagagaaauuucugaaau

SEQ ID NO: 176333 - RNA, 24 nt, Human
aagcaccaagacauaaaacaaaac

SEQ ID NO: 176334 - RNA, 18 nt, Human
aagcagcugggggaagga

SEQ ID NO: 176335 - RNA, 18 nt, Human
aagcaugugacagugacc

SEQ ID NO: 176336 - RNA, 22 nt, Human
aagcccuggagacaagggagcc

SEQ ID NO: 176337 - RNA, 19 nt, Human
aagccugggucccagaagg

SEQ ID NO: 176338 - RNA, 18 nt, Human
aaggaccacaaaguucca

SEQ ID NO: 176339 - RNA, 23 nt, Human
aaggagggcugcaaaggauucug

SEQ ID NO: 176340 - RNA, 19 nt, Human
aauugcuucuucaccucca

SEQ ID NO: 176341 - RNA, 24 nt, Human
acaaagcaauuaccacuagcaccc

SEQ ID NO: 176342 - RNA, 20 nt, Human
acacgcacacaucaugaaug

SEQ ID NO: 176343 - RNA, 21 nt, Human
acagggccauuauaguguccu

SEQ ID NO: 176344 - RNA, 22 nt, Human
acauuccacugcaaucccacua

SEQ ID NO: 176345 - RNA, 18 nt, Human
accacaaaguuccagccu

SEQ ID NO: 176346 - RNA, 20 nt, Human
accacacgcacacaucauga

SEQ ID NO: 176347 - RNA, 21 nt, Human
acccaaaguggucaaugggaa

SEQ ID NO: 176348 - RNA, 21 nt, Human
acccacgugcccugaccuuac

SEQ ID NO: 176349 - RNA, 23 nt, Human
acccagcagaguccuggcagccu

SEQ ID NO: 176350 - RNA, 23 nt, Human
accccuacaaaacucggcaagga

SEQ ID NO: 176351 - RNA, 20 nt, Human
accccugguuggugaauucg

SEQ ID NO: 176352 - RNA, 22 nt, Human
accucaccccacccccagagac

SEQ ID NO: 176353 - RNA, 20 nt, Human
accuccaggaaagccucaac

SEQ ID NO: 176354 - RNA, 23 nt, Human
accucggccucccaaagagcugg

SEQ ID NO: 176355 - RNA, 18 nt, Human
acgggguuucaccauguu

SEQ ID NO: 176356 - RNA, 19 nt, Human
acgggguuucaccauguua

SEQ ID NO: 176357 - RNA, 20 nt, Human
acgggguuucaccauguuag

SEQ ID NO: 176358 - RNA, 24 nt, Human
acgggguuucaccauguuagccag

SEQ ID NO: 176359 - RNA, 18 nt, Human
acguaguuccauccugac

SEQ ID NO: 176360 - RNA, 18 nt, Human
acuaccaaaaacccacca

SEQ ID NO: 176361 - RNA, 21 nt, Human
acuagcacccauuuuucauaa

SEQ ID NO: 176362 - RNA, 23 nt, Human
acucagccuggucuggccuuaac

SEQ ID NO: 176363 - RNA, 20 nt, Human
acugcaaucccacuaaaguu

SEQ ID NO: 176364 - RNA, 24 nt, Human
acugccucagccugccgaauaguu

SEQ ID NO: 176365 - RNA, 20 nt, Human
agaaaacagaucaaacaagc

SEQ ID NO: 176366 - RNA, 21 nt, Human
agaaaacagaucaaacaagca

SEQ ID NO: 176367 - RNA, 21 nt, Human
agaaagaaaggaaguacguga

SEQ ID NO: 176368 - RNA, 22 nt, Human
agaaaggaaguacgugaagggg

SEQ ID NO: 176369 - RNA, 22 nt, Human
agaaaggaaguacgugaagggg

SEQ ID NO: 176370 - RNA, 23 nt, Human
agaaaggaaguacgugaaggggg

SEQ ID NO: 176371 - RNA, 18 nt, Human
agaaagggaggagguaca

SEQ ID NO: 176372 - RNA, 21 nt, Human
agaaggagggcugcaaaggau

SEQ ID NO: 176373 - RNA, 21 nt, Human
agacaccucccaggaagcccu

SEQ ID NO: 176374 - RNA, 21 nt, Human
agacacucgcuuuagcagcca

SEQ ID NO: 176375 - RNA, 18 nt, Human
agacagagccaucugggg

SEQ ID NO: 176376 - RNA, 24 nt, Human
agacagagccaucugggggauggc

SEQ ID NO: 176377 - RNA, 22 nt, Human
agacauaaaacaaaacaacaac

SEQ ID NO: 176378 - RNA, 22 nt, Human
agaccagacuuuuccagggauu

SEQ ID NO: 176379 - RNA, 24 nt, Human
agacucaaaaggcgacaucagugg

SEQ ID NO: 176380 - RNA, 23 nt, Human
agacuuuuccagggauuggaaga

SEQ ID NO: 176381 - RNA, 18 nt, Human
agagaaggaggugagggg

SEQ ID NO: 176382 - RNA, 19 nt, Human
agagaaggaggugagggga

SEQ ID NO: 176383 - RNA, 23 nt, Human
agagcccucccuacccugauccu

SEQ ID NO: 176384 - RNA, 24 nt, Human
agagcugggauuacaggcgugagc

SEQ ID NO: 176385 - RNA, 22 nt, Human
agagggcaggagaagggaauuu

SEQ ID NO: 176386 - RNA, 19 nt, Human
agauguggacucccagaau

SEQ ID NO: 176387 - RNA, 22 nt, Human
agcagagacgggguuucaccau

SEQ ID NO: 176388 - RNA, 18 nt, Human
agcaggaccccccgaagc

SEQ ID NO: 176389 - RNA, 19 nt, Human
agcccagccccccucccca

SEQ ID NO: 176390 - RNA, 21 nt, Human
agccuguggugggcggcccgg

SEQ ID NO: 176391 - RNA, 22 nt, Human
agcuaaguccucaccuaagcac

SEQ ID NO: 176392 - RNA, 23 nt, Human
agcugaucuguaccccacuuaac

SEQ ID NO: 176393 - RNA, 20 nt, Human
agcugccuggaacccacgac

SEQ ID NO: 176394 - RNA, 19 nt, Human
aggaagcagcaagcuggaa

SEQ ID NO: 176395 - RNA, 18 nt, Human
aggaaguacgugaagggg

SEQ ID NO: 176396 - RNA, 18 nt, Human
aggagagagggugggggg

SEQ ID NO: 176397 - RNA, 20 nt, Human
aggaggagccuggggaacug

SEQ ID NO: 176398 - RNA, 19 nt, Human
aggaggccgcagagcaggg

SEQ ID NO: 176399 - RNA, 20 nt, Human
aggcagccagaggguggaag

SEQ ID NO: 176400 - RNA, 19 nt, Human
aggccaggcugugugauca

SEQ ID NO: 176401 - RNA, 18 nt, Human
agggaggagguacaugca

SEQ ID NO: 176402 - RNA, 18 nt, Human
agggcacaagcaugugac

SEQ ID NO: 176403 - RNA, 19 nt, Human
agggcugugggucugucuu

SEQ ID NO: 176404 - RNA, 21 nt, Human
agguaguuccauccugaccuc

SEQ ID NO: 176405 - RNA, 20 nt, Human
aggugguggcgaugggccuu

SEQ ID NO: 176406 - RNA, 22 nt, Human
agucacacucagaccagacuuu

SEQ ID NO: 176407 - RNA, 20 nt, Human
agugacagaaaacuguacaa

SEQ ID NO: 176408 - RNA, 24 nt, Human
agugacagaaaacuguacaaggga

SEQ ID NO: 176409 - RNA, 20 nt, Human
agugcaguggcccgaucuug

SEQ ID NO: 176410 - RNA, 24 nt, Human
agugcaguggcccgaucuugguuc

SEQ ID NO: 176411 - RNA, 20 nt, Human
auaaaacaaaacaacaaccc

SEQ ID NO: 176412 - RNA, 19 nt, Human
auagggguucuggacuguu

SEQ ID NO: 176413 - RNA, 20 nt, Human
aucauaccucaauaaaccug

SEQ ID NO: 176414 - RNA, 22 nt, Human
aucccauggacagauccuacca

SEQ ID NO: 176415 - RNA, 21 nt, Human
augaagcaacagauccaggaa

SEQ ID NO: 176416 - RNA, 23 nt, Human
augggacaaaggaggccgcagag

SEQ ID NO: 176417 - RNA, 21 nt, Human
augggccccauggugggagcc

SEQ ID NO: 176418 - RNA, 22 nt, Human
auguccagaaggagcgggaagc

SEQ ID NO: 176419 - RNA, 22 nt, Human
auucugauccugacaccuggcu

SEQ ID NO: 176420 - RNA, 20 nt, Human
caaaaacccaccacgcgcca

SEQ ID NO: 176421 - RNA, 24 nt, Human
caaagagcugggauuacaggcgug

SEQ ID NO: 176422 - RNA, 23 nt, Human
caagacauaaaacaaaacaacaa

SEQ ID NO: 176423 - RNA, 21 nt, Human
caagcuggaaguggucgugca

SEQ ID NO: 176424 - RNA, 18 nt, Human
caaggaccgugugacacu

SEQ ID NO: 176425 - RNA, 21 nt, Human
caauucucauucaaugaaaga

SEQ ID NO: 176426 - RNA, 21 nt, Human
cacacagcugccuggaaccca

SEQ ID NO: 176427 - RNA, 19 nt, Human
cacacaucaugaaugacuc

SEQ ID NO: 176428 - RNA, 20 nt, Human
cacagcaaccaacuuggaac

SEQ ID NO: 176429 - RNA, 23 nt, Human
caccaagacauaaaacaaaacaa

SEQ ID NO: 176430 - RNA, 26 nt, Human
caccaagacauaaaacaaaacaacaa

SEQ ID NO: 176431 - RNA, 19 nt, Human
caccacgcgccaaaaggcg

SEQ ID NO: 176432 - RNA, 24 nt, Human
caccagugacagaaaacuguacaa

SEQ ID NO: 176433 - RNA, 18 nt, Human
caccauguaccaccaucc

SEQ ID NO: 176434 - RNA, 22 nt, Human
caccauguuagccaggaugguc

SEQ ID NO: 176435 - RNA, 24 nt, Human
caccauguuagccaggauggucuc

SEQ ID NO: 176436 - RNA, 21 nt, Human
caccccacccccagagacacc

SEQ ID NO: 176437 - RNA, 23 nt, Human
caccccacccccagagacaccuc

SEQ ID NO: 176438 - RNA, 22 nt, Human
caccccaccccgagagagcacc

SEQ ID NO: 176439 - RNA, 25 nt, Human
caccuucuacccaugauucugaucc

SEQ ID NO: 176440 - RNA, 23 nt, Human
cacuuugaauaaacccagcuaag

SEQ ID NO: 176441 - RNA, 19 nt, Human
cagaaucucagggccgcca

SEQ ID NO: 176442 - RNA, 24 nt, Human
cagacacagcaugaacacguguac

SEQ ID NO: 176443 - RNA, 22 nt, Human
cagagacgggguuucaccaugu

SEQ ID NO: 176444 - RNA, 21 nt, Human
cagagcagggccaguccugug

SEQ ID NO: 176445 - RNA, 20 nt, Human
cagauggcgccugaucucau

SEQ ID NO: 176446 - RNA, 25 nt, Human
cagcaaccaacuuggaacaccauuu

SEQ ID NO: 176447 - RNA, 22 nt, Human
cagcaugccuggcuugucuuga

SEQ ID NO: 176448 - RNA, 24 nt, Human
cagcaugccuggcuugucuugagc

SEQ ID NO: 176449 - RNA, 21 nt, Human
cagcucucuccccucuccuca

SEQ ID NO: 176450 - RNA, 21 nt, Human
cagcuuaguggaguguuuacc

SEQ ID NO: 176451 - RNA, 19 nt, Human
caggccccagcuugcuggc

SEQ ID NO: 176452 - RNA, 18 nt, Human
caggcuacgugggggggc

SEQ ID NO: 176453 - RNA, 21 nt, Human
cagggcaccguggcggacagg

SEQ ID NO: 176454 - RNA, 19 nt, Human
cagggcucuggaaugucca

SEQ ID NO: 176455 - RNA, 19 nt, Human
cagggggguggugcggggg

SEQ ID NO: 176456 - RNA, 18 nt, Human
cagguugcagcagacgug

SEQ ID NO: 176457 - RNA, 19 nt, Human
caucucucucaccaggacu

SEQ ID NO: 176458 - RNA, 19 nt, Human
caugacccaaccccagauc

SEQ ID NO: 176459 - RNA, 24 nt, Human
caugacccaaccccagaucuggac

SEQ ID NO: 176460 - RNA, 23 nt, Human
caugacccaaccccagaucuggg

SEQ ID NO: 176461 - RNA, 23 nt, Human
cauuauaguguccucagauuaga

SEQ ID NO: 176462 - RNA, 20 nt, Human
cauuccacugcaaucccacu

SEQ ID NO: 176463 - RNA, 22 nt, Human
ccaaagagcugggauuacaggc

SEQ ID NO: 176464 - RNA, 23 nt, Human
ccaaagagcugggauuacaggcg

SEQ ID NO: 176465 - RNA, 24 nt, Human
ccaaagagcugggauuacaggcgu

SEQ ID NO: 176466 - RNA, 19 nt, Human
ccaaccucaccccaccccc

SEQ ID NO: 176467 - RNA, 23 nt, Human
ccaacgcccaauacauagccaag

SEQ ID NO: 176468 - RNA, 19 nt, Human
ccagaaggagcgggaagca

SEQ ID NO: 176469 - RNA, 28 nt, Human
ccagccccccuccccagcaggacccccc

SEQ ID NO: 176470 - RNA, 20 nt, Human
ccagggauuggaagauggag

SEQ ID NO: 176471 - RNA, 21 nt, Human
ccagugcccaccagugacaga

SEQ ID NO: 176472 - RNA, 18 nt, Human
ccauggacagauccuacc

SEQ ID NO: 176473 - RNA, 23 nt, Human
cccaaagagcugggauuacaggc

SEQ ID NO: 176474 - RNA, 23 nt, Human
cccaagcuggagugcaguggccc

SEQ ID NO: 176475 - RNA, 23 nt, Human
cccaagucacacucagaccagac

SEQ ID NO: 176476 - RNA, 23 nt, Human
cccacgugcccugaccuuacauu

SEQ ID NO: 176477 - RNA, 23 nt, Human
cccagccccccuccccagcagga

SEQ ID NO: 176478 - RNA, 23 nt, Human
cccagguucaagcgauucuacug

SEQ ID NO: 176479 - RNA, 18 nt, Human
ccccaaccucaccccacc

SEQ ID NO: 176480 - RNA, 19 nt, Human
ccccaaccucaccccaccc

SEQ ID NO: 176481 - RNA, 18 nt, Human
ccccagcaggaccccccg

SEQ ID NO: 176482 - RNA, 18 nt, Human
ccccccuccccagcagga

SEQ ID NO: 176483 - RNA, 20 nt, Human
ccccgaggaagcagcugggg

SEQ ID NO: 176484 - RNA, 21 nt, Human
ccccgggggcucaggcuuccu

SEQ ID NO: 176485 - RNA, 23 nt, Human
ccccucgcucaugcuucucccgg

SEQ ID NO: 176486 - RNA, 22 nt, Human
cccgcccacuuugaauaaaccc

SEQ ID NO: 176487 - RNA, 24 nt, Human
cccucccuacccugauccuccaaa

SEQ ID NO: 176488 - RNA, 21 nt, Human
cccugaggguggaggcgcugg

SEQ ID NO: 176489 - RNA, 21 nt, Human
ccgaauaguugggacuacagg

SEQ ID NO: 176490 - RNA, 24 nt, Human
ccgccucccagguucaagcgauuc

SEQ ID NO: 176491 - RNA, 18 nt, Human
ccgucccuuccccuccca

SEQ ID NO: 176492 - RNA, 19 nt, Human
ccuacccugauccuccaaa

SEQ ID NO: 176493 - RNA, 18 nt, Human
ccucaccccacccccaga

SEQ ID NO: 176494 - RNA, 20 nt, Human
ccucaccccacccccagaga

SEQ ID NO: 176495 - RNA, 19 nt, Human
ccucagagacaagggcagg

SEQ ID NO: 176496 - RNA, 21 nt, Human
ccucagauuagaucuuagcac

SEQ ID NO: 176497 - RNA, 22 nt, Human
ccucaggggucacacucagccu

SEQ ID NO: 176498 - RNA, 23 nt, Human
ccucauucuuaacagcucauaaa

SEQ ID NO: 176499 - RNA, 23 nt, Human
ccuccaaaaauggacuggcccaa

SEQ ID NO: 176500 - RNA, 19 nt, Human
ccuccaaagcccuggagac

SEQ ID NO: 176501 - RNA, 22 nt, Human
ccucccagguucaagcgauucu

SEQ ID NO: 176502 - RNA, 22 nt, Human
ccuccccggcaaauuucaaccc

SEQ ID NO: 176503 - RNA, 24 nt, Human
ccuccuaaaaccccuggugaugaa

SEQ ID NO: 176504 - RNA, 26 nt, Human
ccuccugacagccaugccccagcauu

SEQ ID NO: 176505 - RNA, 19 nt, Human
ccucugagacgagcugguu

SEQ ID NO: 176506 - RNA, 24 nt, Human
ccugaacaccacacgcaaucucca

SEQ ID NO: 176507 - RNA, 21 nt, Human
ccugaagccuuuggacgagcu

SEQ ID NO: 176508 - RNA, 22 nt, Human
ccugaccccacgcuguucccac

SEQ ID NO: 176509 - RNA, 18 nt, Human
ccugagggggagacaaga

SEQ ID NO: 176510 - RNA, 20 nt, Human
ccugcagcuggaaguaaaau

SEQ ID NO: 176511 - RNA, 19 nt, Human
ccuggcagccucuucggcu

SEQ ID NO: 176512 - RNA, 23 nt, Human
ccuggcccuaaucuucaccuggc

SEQ ID NO: 176513 - RNA, 23 nt, Human
ccugggccaagaacuuccagggc

SEQ ID NO: 176514 - RNA, 24 nt, Human
ccuucaaaauuuaaacucuuuaaa

SEQ ID NO: 176515 - RNA, 21 nt, Human
ccuuugugcugaccuuuuugg

SEQ ID NO: 176516 - RNA, 23 nt, Human
cgaaagcaauucucauucaauga

SEQ ID NO: 176517 - RNA, 23 nt, Human
cgaaugagauccaaacggucauu

SEQ ID NO: 176518 - RNA, 23 nt, Human
cgaggaagcagcugggggaagga

SEQ ID NO: 176519 - RNA, 19 nt, Human
cggcaaauuucaacccagc

SEQ ID NO: 176520 - RNA, 18 nt, Human
cgggagagugggggccag

SEQ ID NO: 176521 - RNA, 22 nt, Human
cgugagccaccgugcccgaccc

SEQ ID NO: 176522 - RNA, 25 nt, Human
cgugagccaccgugcccgacccuua

SEQ ID NO: 176523 - RNA, 20 nt, Human
cuaaagccgugagcaaacgc

SEQ ID NO: 176524 - RNA, 22 nt, Human
cuaaagccgugagcaaacgcua

SEQ ID NO: 176525 - RNA, 24 nt, Human
cuaaaguuucccucaaacaccaag

SEQ ID NO: 176526 - RNA, 19 nt, Human
cuaagcaccaagacauaaa

SEQ ID NO: 176527 - RNA, 20 nt, Human
cuaauuuuuuguauuuuuag

SEQ ID NO: 176528 - RNA, 23 nt, Human
cuaccaaaaacccaccacgcgcc

SEQ ID NO: 176529 - RNA, 21 nt, Human
cucaaacaccaaggaacaguc

SEQ ID NO: 176530 - RNA, 22 nt, Human
cucaagaauagcccagacccgc

SEQ ID NO: 176531 - RNA, 22 nt, Human
cucaccccacccccagagacac

SEQ ID NO: 176532 - RNA, 23 nt, Human
cucacucuaucccagggaugaac

SEQ ID NO: 176533 - RNA, 20 nt, Human
cucaugcuucucccggcccc

SEQ ID NO: 176534 - RNA, 20 nt, Human
cucaugcuucucccggcccc

SEQ ID NO: 176535 - RNA, 19 nt, Human
cuccaaaaauggacuggcc

SEQ ID NO: 176536 - RNA, 19 nt, Human
cuccaaaggccaucgcccc

SEQ ID NO: 176537 - RNA, 24 nt, Human
cuccagcugcgacaaggacuccau

SEQ ID NO: 176538 - RNA, 22 nt, Human
cucccagaaugcaaugggaaaa

SEQ ID NO: 176539 - RNA, 25 nt, Human
cuccuaaaaccccuggugaugaaca

SEQ ID NO: 176540 - RNA, 22 nt, Human
cuccugaccucgugaucugccc

SEQ ID NO: 176541 - RNA, 21 nt, Human
cuccugagggggagacaagag

SEQ ID NO: 176542 - RNA, 22 nt, Human
cugacagccaugccccagcauu

SEQ ID NO: 176543 - RNA, 24 nt, Human
cugaccccacgcuguucccacgcu

SEQ ID NO: 176544 - RNA, 23 nt, Human
cugagacgagcugguuuguuucc

SEQ ID NO: 176545 - RNA, 24 nt, Human
cugauccuccaaagcccuggagac

SEQ ID NO: 176546 - RNA, 23 nt, Human
cugccaccauguaccaccaucca

SEQ ID NO: 176547 - RNA, 21 nt, Human
cuggccucugagacgagcugg

SEQ ID NO: 176548 - RNA, 21 nt, Human
cugggccagggcaagcagggg

SEQ ID NO: 176549 - RNA, 18 nt, Human
cugucacccaagcuggag

SEQ ID NO: 176550 - RNA, 19 nt, Human
cuguugacucuagcccugg

SEQ ID NO: 176551 - RNA, 23 nt, Human
cuucaccuccaggaaagccucaa

SEQ ID NO: 176552 - RNA, 19 nt, Human
cuucccugacgacagggcc

SEQ ID NO: 176553 - RNA, 19 nt, Human
cuugaggccccgggggcuc

SEQ ID NO: 176554 - RNA, 22 nt, Human
cuuugaauguuuggaaaucauc

SEQ ID NO: 176555 - RNA, 20 nt, Human
gaaagcuucccaagucacac

SEQ ID NO: 176556 - RNA, 21 nt, Human
gaagacccugggccaagaacu

SEQ ID NO: 176557 - RNA, 23 nt, Human
gaagcaacagauccaggaaagca

SEQ ID NO: 176558 - RNA, 24 nt, Human
gaauaguugggacuacaggugugc

SEQ ID NO: 176559 - RNA, 24 nt, Human
gacaaccuaguguggccacaagag

SEQ ID NO: 176560 - RNA, 23 nt, Human
gacaagggagccagcuggaggaa

SEQ ID NO: 176561 - RNA, 22 nt, Human
gaccucgugaucugcccaccuc

SEQ ID NO: 176562 - RNA, 22 nt, Human
gaccucgugaucugcccaccuc

SEQ ID NO: 176563 - RNA, 24 nt, Human
gaccucgugaucugcccaccucgg

SEQ ID NO: 176564 - RNA, 18 nt, Human
gagaaggaggugagggga

SEQ ID NO: 176565 - RNA, 21 nt, Human
gagaaggaggugaggggauga

SEQ ID NO: 176566 - RNA, 24 nt, Human
gagacgggguuucaccauguuagc

SEQ ID NO: 176567 - RNA, 18 nt, Human
gagagucugcuaugccug

SEQ ID NO: 176568 - RNA, 20 nt, Human
gagcagaucugcuggcugag

SEQ ID NO: 176569 - RNA, 21 nt, Human
gagccuguggugggcggcccg

SEQ ID NO: 176570 - RNA, 22 nt, Human
gaggaagcagcugggggaagga

SEQ ID NO: 176571 - RNA, 22 nt, Human
gaggggaugaggggggaaagag

SEQ ID NO: 176572 - RNA, 18 nt, Human
gauuacaggcgugagcca

SEQ ID NO: 176573 - RNA, 21 nt, Human
gauuacaggcgugagccaccg

SEQ ID NO: 176574 - RNA, 24 nt, Human
gauuacaggcgugagccaccgugc

SEQ ID NO: 176575 - RNA, 22 nt, Human
gcaaucuccgccucccagguuc

SEQ ID NO: 176576 - RNA, 23 nt, Human
gcaccaagacauaaaacaaaaca

SEQ ID NO: 176577 - RNA, 26 nt, Human
gcaccuucuacccaugauucugaucc

SEQ ID NO: 176578 - RNA, 23 nt, Human
gcacuaccaaaaacccaccacgc

SEQ ID NO: 176579 - RNA, 18 nt, Human
gcagcuggaaguaaaauc

SEQ ID NO: 176580 - RNA, 22 nt, Human
gcagggcucuggaauguccaga

SEQ ID NO: 176581 - RNA, 18 nt, Human
gccaacagggugcugagu

SEQ ID NO: 176582 - RNA, 20 nt, Human
gccaagccuuccuccuaaaa

SEQ ID NO: 176583 - RNA, 21 nt, Human
gccaagccuuccuccuaaaac

SEQ ID NO: 176584 - RNA, 18 nt, Human
gcccagccccccucccca

SEQ ID NO: 176585 - RNA, 20 nt, Human
gccccgggggcucaggcuuc

SEQ ID NO: 176586 - RNA, 24 nt, Human
gccgcagagcagggccaguccugu

SEQ ID NO: 176587 - RNA, 19 nt, Human
gccucccaaagagcuggga

SEQ ID NO: 176588 - RNA, 23 nt, Human
gccuggaacccacgacucccgag

SEQ ID NO: 176589 - RNA, 24 nt, Human
gccugggucccagaagggagcaga

SEQ ID NO: 176590 - RNA, 19 nt, Human
gccuggucuggccuuaacu

SEQ ID NO: 176591 - RNA, 18 nt, Human
gcuaaguuggggccccug

SEQ ID NO: 176592 - RNA, 19 nt, Human
gcuccuggggaguagacuc

SEQ ID NO: 176593 - RNA, 25 nt, Human
gcucugucacccaagcuggagugca

SEQ ID NO: 176594 - RNA, 25 nt, Human
gcuggagugcaguggcccgaucuug

SEQ ID NO: 176595 - RNA, 22 nt, Human
gcuggcagggugggggcagggg

SEQ ID NO: 176596 - RNA, 24 nt, Human
ggaaagaaaccccugguuggugaa

SEQ ID NO: 176597 - RNA, 18 nt, Human
ggagagagggaaaggagg

SEQ ID NO: 176598 - RNA, 22 nt, Human
ggagugcuggcgggagacacgg

SEQ ID NO: 176599 - RNA, 18 nt, Human
ggaugaggggggaaagag

SEQ ID NO: 176600 - RNA, 20 nt, Human
ggccaaacagcagcacugaa

SEQ ID NO: 176601 - RNA, 18 nt, Human
ggccaagaacuuccaggg

SEQ ID NO: 176602 - RNA, 18 nt, Human
ggcccaggguggucccac

SEQ ID NO: 176603 - RNA, 19 nt, Human
ggccgcagagcagggccag

SEQ ID NO: 176604 - RNA, 19 nt, Human
ggccugggaauauggggga

SEQ ID NO: 176605 - RNA, 21 nt, Human
gggaagggcuggcaggguggg

SEQ ID NO: 176606 - RNA, 23 nt, Human
gggaauaugggggagcccccagc

SEQ ID NO: 176607 - RNA, 20 nt, Human
gggagaaaguaaugagcugg

SEQ ID NO: 176608 - RNA, 18 nt, Human
gggaugaggggggaaaga

SEQ ID NO: 176609 - RNA, 22 nt, Human
gggcacagcuggcauuuggagg

SEQ ID NO: 176610 - RNA, 18 nt, Human
gggcaccguggcggacag

SEQ ID NO: 176611 - RNA, 19 nt, Human
gggcaggggccuccccgag

SEQ ID NO: 176612 - RNA, 22 nt, Human
gggcaggggccuccccgaggaa

SEQ ID NO: 176613 - RNA, 24 nt, Human
gggcuggcagggugggggcagggg

SEQ ID NO: 176614 - RNA, 25 nt, Human
gggguaaagagaaggaggugagggg

SEQ ID NO: 176615 - RNA, 23 nt, Human
gggguuucaccauguuagccagg

SEQ ID NO: 176616 - RNA, 27 nt, Human
ggguggaggcagguagaaggggccggg

SEQ ID NO: 176617 - RNA, 21 nt, Human
ggguucuggacuguugacucu

SEQ ID NO: 176618 - RNA, 22 nt, Human
ggguuucaccauguuagccagg

SEQ ID NO: 176619 - RNA, 21 nt, Human
gguagaaggggcugacuuguu

SEQ ID NO: 176620 - RNA, 18 nt, Human
gguagagaaagggagaaa

SEQ ID NO: 176621 - RNA, 21 nt, Human
gguagggaaagaaaccccugg

SEQ ID NO: 176622 - RNA, 19 nt, Human
gguccuaggagaaacuacc

SEQ ID NO: 176623 - RNA, 20 nt, Human
ggucucgaucuccugaccuc

SEQ ID NO: 176624 - RNA, 24 nt, Human
gguuucaccauguuagccaggaug

SEQ ID NO: 176625 - RNA, 23 nt, Human
guagggauggcaaggauuauggg

SEQ ID NO: 176626 - RNA, 21 nt, Human
gucacacucagccuggucugg

SEQ ID NO: 176627 - RNA, 24 nt, Human
gugaucugcccaccucggccuccc

SEQ ID NO: 176628 - RNA, 21 nt, Human
gugcacggaggucccgacagg

SEQ ID NO: 176629 - RNA, 24 nt, Human
guggggugcagguacaggccaggc

SEQ ID NO: 176630 - RNA, 21 nt, Human
guggguuacagccuccacugg

SEQ ID NO: 176631 - RNA, 19 nt, Human
uaaaacaaaacaacaaccc

SEQ ID NO: 176632 - RNA, 22 nt, Human
uaaaacaaaacaacaacccgga

SEQ ID NO: 176633 - RNA, 24 nt, Human
uaaaacaaaacaacaacccggaua

SEQ ID NO: 176634 - RNA, 24 nt, Human
uaaaacaaaacaacaacccggaua

SEQ ID NO: 176635 - RNA, 21 nt, Human
uaaacacuccuugucaagacu

SEQ ID NO: 176636 - RNA, 20 nt, Human
uaaagaaggagggcugcaaa

SEQ ID NO: 176637 - RNA, 18 nt, Human
uaaagccgugagcaaacg

SEQ ID NO: 176638 - RNA, 23 nt, Human
uaaaguuucccucaaacaccaag

SEQ ID NO: 176639 - RNA, 22 nt, Human
uaagacgauguccaggcuacgu

SEQ ID NO: 176640 - RNA, 23 nt, Human
uaaggucucccacucugcauccu

SEQ ID NO: 176641 - RNA, 21 nt, Human
uaaguccucaccuaagcacca

SEQ ID NO: 176642 - RNA, 21 nt, Human
uaaugagcugggccaaacagc

SEQ ID NO: 176643 - RNA, 24 nt, Human
uaauuuuuuguauuuuuagcagag

SEQ ID NO: 176644 - RNA, 25 nt, Human
uaauuuuuuguauuuuuagcagaga

SEQ ID NO: 176645 - RNA, 25 nt, Human
uacaaaacucggcaaggaccacaaa

SEQ ID NO: 176646 - RNA, 19 nt, Human
uacagaaaacagaucaaac

SEQ ID NO: 176647 - RNA, 23 nt, Human
uacaggcgugagccaccgugccc

SEQ ID NO: 176648 - RNA, 21 nt, Human
uacaggguacaucauuggaaa

SEQ ID NO: 176649 - RNA, 20 nt, Human
uacaggugugcaccaccaca

SEQ ID NO: 176650 - RNA, 22 nt, Human
uaccaaaaacccaccacgcgcc

SEQ ID NO: 176651 - RNA, 25 nt, Human
uaccacggcaucucucucaccagga

SEQ ID NO: 176652 - RNA, 19 nt, Human
uaccuugaggccccggggg

SEQ ID NO: 176653 - RNA, 18 nt, Human
uagaucuuagcacaaugg

SEQ ID NO: 176654 - RNA, 22 nt, Human
uagcacguugacugaaagacca

SEQ ID NO: 176655 - RNA, 24 nt, Human
uagcagagacgggguuucaccaug

SEQ ID NO: 176656 - RNA, 26 nt, Human
uagcagagacgggguuucaccauguu

SEQ ID NO: 176657 - RNA, 18 nt, Human
uagcagagcacugccucc

SEQ ID NO: 176658 - RNA, 22 nt, Human
uagggauggcaaggauuauggg

SEQ ID NO: 176659 - RNA, 19 nt, Human
uaugggacaaaggaggccg

SEQ ID NO: 176660 - RNA, 24 nt, Human
uauuuccaaaagggacuuuggcuc

SEQ ID NO: 176661 - RNA, 24 nt, Human
ucaccauguuagccaggauggucu

SEQ ID NO: 176662 - RNA, 19 nt, Human
ucacugcaaucuccgccuc

SEQ ID NO: 176663 - RNA, 24 nt, Human
ucacugcaaucuccgccucccagg

SEQ ID NO: 176664 - RNA, 25 nt, Human
ucacugcaaucuccgccucccaggu

SEQ ID NO: 176665 - RNA, 19 nt, Human
ucacugguuacccuugagc

SEQ ID NO: 176666 - RNA, 20 nt, Human
ucagcaugccuggcuugucu

SEQ ID NO: 176667 - RNA, 24 nt, Human
uccaaagcccuggagacaagggag

SEQ ID NO: 176668 - RNA, 24 nt, Human
uccauccugaccucuccaggcaug

SEQ ID NO: 176669 - RNA, 19 nt, Human
ucccaaagagcugggauua

SEQ ID NO: 176670 - RNA, 23 nt, Human
ucccaaagagcugggauuacagg

SEQ ID NO: 176671 - RNA, 24 nt, Human
ucccaaagagcugggauuacaggc

SEQ ID NO: 176672 - RNA, 23 nt, Human
ucccaccgcagaaauucuccuug

SEQ ID NO: 176673 - RNA, 23 nt, Human
ucccagggaugaacagaggacuc

SEQ ID NO: 176674 - RNA, 19 nt, Human
ucccagguucaagcgauuc

SEQ ID NO: 176675 - RNA, 24 nt, Human
ucccagguucaagcgauucuacug

SEQ ID NO: 176676 - RNA, 23 nt, Human
ucccagucaccccaccccgagag

SEQ ID NO: 176677 - RNA, 19 nt, Human
uccccgaggaagcagcugg

SEQ ID NO: 176678 - RNA, 21 nt, Human
uccccgaggaagcagcugggg

SEQ ID NO: 176679 - RNA, 24 nt, Human
ucccgacuagaaucugccccucgc

SEQ ID NO: 176680 - RNA, 23 nt, Human
ucccugaggguggaggcgcuggg

SEQ ID NO: 176681 - RNA, 18 nt, Human
ucccuggauucuuucugc

SEQ ID NO: 176682 - RNA, 19 nt, Human
uccgucccuuccccuccca

SEQ ID NO: 176683 - RNA, 18 nt, Human
uccuccaaagcccuggag

SEQ ID NO: 176684 - RNA, 23 nt, Human
uccuccaaagcccuggagacaag

SEQ ID NO: 176685 - RNA, 22 nt, Human
ucggcaaggaccacaaaguucc

SEQ ID NO: 176686 - RNA, 25 nt, Human
ucuccaaaggccaucgccccaaccu

SEQ ID NO: 176687 - RNA, 18 nt, Human
ucuccaaagugcagucuu

SEQ ID NO: 176688 - RNA, 20 nt, Human
ucucucaccaggacuugagg

SEQ ID NO: 176689 - RNA, 21 nt, Human
ucucugguucgcauagagagg

SEQ ID NO: 176690 - RNA, 21 nt, Human
ucuggaauguccagaaggagc

SEQ ID NO: 176691 - RNA, 24 nt, Human
ucugggccagggcaagccgggguc

SEQ ID NO: 176692 - RNA, 24 nt, Human
ucugucacccaagcuggagugcag

SEQ ID NO: 176693 - RNA, 24 nt, Human
ucuugcucugucacccaagcugga

SEQ ID NO: 176694 - RNA, 20 nt, Human
ugaacaagacacagcuuagu

SEQ ID NO: 176695 - RNA, 20 nt, Human
ugaaugaauaacagagggaa

SEQ ID NO: 176696 - RNA, 24 nt, Human
ugaaugaaugcagauuaaucagaa

SEQ ID NO: 176697 - RNA, 21 nt, Human
ugacccaaccccagaucugga

SEQ ID NO: 176698 - RNA, 21 nt, Human
ugaccccacgcuguucccacg

SEQ ID NO: 176699 - RNA, 21 nt, Human
ugagaaagccagauguggacu

SEQ ID NO: 176700 - RNA, 23 nt, Human
ugagaaagccagauguggacucc

SEQ ID NO: 176701 - RNA, 18 nt, Human
ugagaaagggaggaggua

SEQ ID NO: 176702 - RNA, 18 nt, Human
ugagacugggaagggcug

SEQ ID NO: 176703 - RNA, 22 nt, Human
ugagauggagucuugcucuguc

SEQ ID NO: 176704 - RNA, 19 nt, Human
ugagcacccauccgucccu

SEQ ID NO: 176705 - RNA, 21 nt, Human
ugagggggagacaagaguccu

SEQ ID NO: 176706 - RNA, 18 nt, Human
ugaguggagguagaaagg

SEQ ID NO: 176707 - RNA, 22 nt, Human
ugaguggagguagaaaggaggc

SEQ ID NO: 176708 - RNA, 22 nt, Human
ugaguugugcuuguugaauucu

SEQ ID NO: 176709 - RNA, 24 nt, Human
ugaguugugcuuguugaauucugc

SEQ ID NO: 176710 - RNA, 24 nt, Human
ugaucugcccaccucggccuccca

SEQ ID NO: 176711 - RNA, 23 nt, Human
ugcaaucuccgccucccagguuc

SEQ ID NO: 176712 - RNA, 25 nt, Human
ugcacuaccaaaaacccaccacgcg

SEQ ID NO: 176713 - RNA, 19 nt, Human
ugcaucagucuccugggug

SEQ ID NO: 176714 - RNA, 23 nt, Human
ugcccaccagugacagaaaacug

SEQ ID NO: 176715 - RNA, 23 nt, Human
ugccgaauaguugggacuacagg

SEQ ID NO: 176716 - RNA, 24 nt, Human
ugccgaauaguugggacuacaggu

SEQ ID NO: 176717 - RNA, 20 nt, Human
ugccgaaugacguaguucca

SEQ ID NO: 176718 - RNA, 24 nt, Human
ugccucagccugccgaauaguugg

SEQ ID NO: 176719 - RNA, 21 nt, Human
ugccuguccagugcccaccag

SEQ ID NO: 176720 - RNA, 24 nt, Human
ugcucugucacccaagcuggagug

SEQ ID NO: 176721 - RNA, 18 nt, Human
ugcuggaagggaagcgcc

SEQ ID NO: 176722 - RNA, 23 nt, Human
uggaacaccauuuggcuuaagga

SEQ ID NO: 176723 - RNA, 19 nt, Human
uggaagggaagcgccccca

SEQ ID NO: 176724 - RNA, 20 nt, Human
uggacuggcccaaacugggc

SEQ ID NO: 176725 - RNA, 18 nt, Human
uggagacaagggagccag

SEQ ID NO: 176726 - RNA, 24 nt, Human
uggagaggguacaauguucuuauu

SEQ ID NO: 176727 - RNA, 22 nt, Human
uggaggcagguagaaggggcug

SEQ ID NO: 176728 - RNA, 19 nt, Human
uggagucuugcucugucac

SEQ ID NO: 176729 - RNA, 19 nt, Human
uggagugcaguggcccgau

SEQ ID NO: 176730 - RNA, 23 nt, Human
uggagugcaguggcccgaucuug

SEQ ID NO: 176731 - RNA, 24 nt, Human
uggagugcaguggcccgaucuugg

SEQ ID NO: 176732 - RNA, 21 nt, Human
uggauucuuucugcacuacca

SEQ ID NO: 176733 - RNA, 20 nt, Human
uggauuuccagggcaugggc

SEQ ID NO: 176734 - RNA, 22 nt, Human
uggauuuccagggcaugggcuc

SEQ ID NO: 176735 - RNA, 22 nt, Human
uggcaccuucuacccaugauuc

SEQ ID NO: 176736 - RNA, 18 nt, Human
uggcagggugggggcagg

SEQ ID NO: 176737 - RNA, 21 nt, Human
uggcccaggagagaggguggg

SEQ ID NO: 176738 - RNA, 23 nt, Human
ugggaaaaaaauaaagaaggagg

SEQ ID NO: 176739 - RNA, 19 nt, Human
ugggaagggcuggcagggu

SEQ ID NO: 176740 - RNA, 20 nt, Human
ugggaagggcuggcagggug

SEQ ID NO: 176741 - RNA, 21 nt, Human
ugggacuacaggugugcacca

SEQ ID NO: 176742 - RNA, 24 nt, Human
ugggacuacaggugugcaccacca

SEQ ID NO: 176743 - RNA, 20 nt, Human
ugggagcccagccccccucc

SEQ ID NO: 176744 - RNA, 22 nt, Human
ugggaucaggguuucaacagug

SEQ ID NO: 176745 - RNA, 21 nt, Human
ugggauuacaggcgugagcca

SEQ ID NO: 176746 - RNA, 22 nt, Human
ugggauuacaggcgugagccac

SEQ ID NO: 176747 - RNA, 23 nt, Human
ugggauuacaggcgugagccacc

SEQ ID NO: 176748 - RNA, 23 nt, Human
ugggauuacaggcgugagccacc

SEQ ID NO: 176749 - RNA, 24 nt, Human
ugggauuacaggcgugagccaccg

SEQ ID NO: 176750 - RNA, 23 nt, Human
ugggccccauggugggagcccag

SEQ ID NO: 176751 - RNA, 18 nt, Human
ugggggaaggauggauug

SEQ ID NO: 176752 - RNA, 24 nt, Human
ugggggccagggcagcccaaaggu

SEQ ID NO: 176753 - RNA, 28 nt, Human
uggguccacacagcugccuggaacccac

SEQ ID NO: 176754 - RNA, 18 nt, Human
ugggugcggcugugagcu

SEQ ID NO: 176755 - RNA, 24 nt, Human
uggguggaggcagguagaaggggc

SEQ ID NO: 176756 - RNA, 18 nt, Human
uggucaaugggaaagaug

SEQ ID NO: 176757 - RNA, 22 nt, Human
ugguggagaauguguuugcugu

SEQ ID NO: 176758 - RNA, 23 nt, Human
ugguggagaauguguuugcugug

SEQ ID NO: 176759 - RNA, 22 nt, Human
ugguggcgaugggccuuguagg

SEQ ID NO: 176760 - RNA, 24 nt, Human
ugguugcaauguuucaagaacaag

SEQ ID NO: 176761 - RNA, 20 nt, Human
uguaauggaaaagucaauga

SEQ ID NO: 176762 - RNA, 21 nt, Human
uguauuuuuagcagagacggg

SEQ ID NO: 176763 - RNA, 25 nt, Human
ugucacagcaaccaacuuggaacac

SEQ ID NO: 176764 - RNA, 18 nt, Human
uguccagaaggagcggga

SEQ ID NO: 176765 - RNA, 19 nt, Human
uguccaggcuacguggggg

SEQ ID NO: 176766 - RNA, 20 nt, Human
ugugaagggguugcuuccgg

SEQ ID NO: 176767 - RNA, 20 nt, Human
ugugcaucagucuccugggu

SEQ ID NO: 176768 - RNA, 18 nt, Human
uguggugggcggcccggg

SEQ ID NO: 176769 - RNA, 26 nt, Human
uguuagaaaauuccacuuucauaggg

SEQ ID NO: 176770 - RNA, 23 nt, Human
uguugcugucuaccuuccaucca

SEQ ID NO: 176771 - RNA, 19 nt, Human
uuaacugggugugguccug

SEQ ID NO: 176772 - RNA, 19 nt, Human
uuaacugggugugguccug

SEQ ID NO: 176773 - RNA, 20 nt, Human
uuaacugggugugguccugu

SEQ ID NO: 176774 - RNA, 24 nt, Human
uuagcagagacgggguuucaccau

SEQ ID NO: 176775 - RNA, 20 nt, Human
uucaaagccuccaacgcccc

SEQ ID NO: 176776 - RNA, 23 nt, Human
uucaacaguguuacuuauaaauu

SEQ ID NO: 176777 - RNA, 23 nt, Human
uucaagcgauucuacugccucag

SEQ ID NO: 176778 - RNA, 22 nt, Human
uuccagggauuggaagauggag

SEQ ID NO: 176779 - RNA, 21 nt, Human
uucccugaggguggaggcgcu

SEQ ID NO: 176780 - RNA, 18 nt, Human
uucugcauccauccacuc

SEQ ID NO: 176781 - RNA, 23 nt, Human
uuguauuuuuagcagagacgggg

SEQ ID NO: 176782 - RNA, 19 nt, Human
uuucaccauguuagccagg

SEQ ID NO: 176783 - RNA, 20 nt, Human
uuucaccauguuagccagga

SEQ ID NO: 176784 - RNA, 24 nt, Human
uuucugcacuaccaaaaacccacc

SEQ ID NO: 176785 - RNA, 23 nt, Human
uuuguuuccaucccugaagccuu

SEQ ID NO: 176786 - RNA, 24 nt, Human
uuuuuagcagagacgggguuucac

SEQ ID NO: 176787 - RNA, 24 nt, Human
uuuuugagauggagucuugcucug

SEQ ID NO: 176788 - RNA, 21 nt, Human
uuuuuguauuuuuagcagaga

SEQ ID NO: 176789 - RNA, 24 nt, Human
uuuuuuguauuuuuagcagagacg

SEQ ID NO: 176790 - RNA, 20 nt, Human
aaaacucacggcacagcccc

SEQ ID NO: 176791 - RNA, 23 nt, Human
aaaauaacagccccagaucuccc

SEQ ID NO: 176792 - RNA, 20 nt, Human
aaacacauaaugaaagaaac

SEQ ID NO: 176793 - RNA, 21 nt, Human
aaacucacggcacagccccaa

SEQ ID NO: 176794 - RNA, 22 nt, Human
aacucaguucccaucagacaca

SEQ ID NO: 176795 - RNA, 22 nt, Human
aaugaaagaaacauauauuuua

SEQ ID NO: 176796 - RNA, 23 nt, Human
aauggaaaucuuuauuuuuaaac

SEQ ID NO: 176797 - RNA, 23 nt, Human
aauucuuucucaagagccaaaaa

SEQ ID NO: 176798 - RNA, 18 nt, Human
aggaagagaagacagugg

SEQ ID NO: 176799 - RNA, 24 nt, Human
aguaauaggaauauucaaaaaugu

SEQ ID NO: 176800 - RNA, 20 nt, Human
auagaagacaacugcucaca

SEQ ID NO: 176801 - RNA, 24 nt, Human
augucccuucaucuucucucuucc

SEQ ID NO: 176802 - RNA, 24 nt, Human
caauucauaagaauucuuucucaa

SEQ ID NO: 176803 - RNA, 22 nt, Human
cacagccccaaggaugucccuu

SEQ ID NO: 176804 - RNA, 24 nt, Human
cagccccagaucucccucuuuaaa

SEQ ID NO: 176805 - RNA, 21 nt, Human
cccagaucucccucuuuaaau

SEQ ID NO: 176806 - RNA, 18 nt, Human
ccccagaucucccucuuu

SEQ ID NO: 176807 - RNA, 23 nt, Human
cccuaagccgcacaaggggaccc

SEQ ID NO: 176808 - RNA, 20 nt, Human
cccuucaucuucucucuucc

SEQ ID NO: 176809 - RNA, 23 nt, Human
ccgcacaaggggacccgccuccu

SEQ ID NO: 176810 - RNA, 23 nt, Human
ccucuguggcaguggcuuuuccu

SEQ ID NO: 176811 - RNA, 21 nt, Human
ccugucaccuaugccagcaaa

SEQ ID NO: 176812 - RNA, 21 nt, Human
cgagagcacgacucgguggag

SEQ ID NO: 176813 - RNA, 19 nt, Human
cuuccaacccaagcugcuc

SEQ ID NO: 176814 - RNA, 24 nt, Human
gaaaauauauaaauuaucgcccua

SEQ ID NO: 176815 - RNA, 21 nt, Human
gaggaagagaagacaguggcc

SEQ ID NO: 176816 - RNA, 18 nt, Human
gaggugccaccugcugga

SEQ ID NO: 176817 - RNA, 20 nt, Human
gaggugccaccugcuggagc

SEQ ID NO: 176818 - RNA, 21 nt, Human
gcaaaacucacggcacagccc

SEQ ID NO: 176819 - RNA, 20 nt, Human
guauuuuguauuuuugguga

SEQ ID NO: 176820 - RNA, 27 nt, Human
uaaaaauaacagccccagaucucccuc

SEQ ID NO: 176821 - RNA, 23 nt, Human
uauaaaaacugcaauuugaaacc

SEQ ID NO: 176822 - RNA, 23 nt, Human
uaugccagcaaaacucacggcac

SEQ ID NO: 176823 - RNA, 21 nt, Human
uauuuuguauuuuuggugacc

SEQ ID NO: 176824 - RNA, 25 nt, Human
ucacuuagaaaacuucuuugggauc

SEQ ID NO: 176825 - RNA, 20 nt, Human
ucuggcgcgcggguuggggc

SEQ ID NO: 176826 - RNA, 23 nt, Human
ugcaucaaagcauauuuauuuaa

SEQ ID NO: 176827 - RNA, 21 nt, Human
uggaggaggaagagaagacag

SEQ ID NO: 176828 - RNA, 21 nt, Human
uggccugcagcgauguaugca

SEQ ID NO: 176829 - RNA, 26 nt, Human
ugggagacuuguuccgcacuagguga

SEQ ID NO: 176830 - RNA, 21 nt, Human
ugggaucauagaagacaacug

SEQ ID NO: 176831 - RNA, 24 nt, Human
ugucccuucaucuucucucuucca

SEQ ID NO: 176832 - RNA, 21 nt, Human
uucacaaaggccaacaacuca

SEQ ID NO: 176833 - RNA, 27 nt, Human
uucaggcuguuuuaaaaaagaaaaauc

SEQ ID NO: 176834 - RNA, 23 nt, Human
uuccgcacuaggugacagcuguu

SEQ ID NO: 176835 - RNA, 24 nt, Human
uucgcugcgcacgcgcacaggacc

SEQ ID NO: 176836 - RNA, 21 nt, Human
uuuguauuuuuggugaccaaa

SEQ ID NO: 176837 - RNA, 21 nt, Human
uuuuuggugaccaaacucugg

SEQ ID NO: 176838 - RNA, 20 nt, Human
caccccuccucuggaggcca

SEQ ID NO: 176839 - RNA, 23 nt, Human
ccucuggaggccaugcucugugc

SEQ ID NO: 176840 - RNA, 22 nt, Human
gagaaggacaccaccccuccuc

SEQ ID NO: 176841 - RNA, 18 nt, Human
gcggaggguucggccgcc

SEQ ID NO: 176842 - RNA, 21 nt, Human
gcggaggguucggccgccuug

SEQ ID NO: 176843 - RNA, 21 nt, Human
gcuggugguugcggaggguuc

SEQ ID NO: 176844 - RNA, 18 nt, Human
ucccaggggguguccugc

SEQ ID NO: 176845 - RNA, 22 nt, Human
ucccaggggguguccuggcucc

SEQ ID NO: 176846 - RNA, 20 nt, Human
ugccuggggcccagagacuu

SEQ ID NO: 176847 - RNA, 23 nt, Human
uggggauuaaccugggcuggugg

SEQ ID NO: 176848 - RNA, 23 nt, Human
aagcaggcaccagcucacccucc

SEQ ID NO: 176849 - RNA, 19 nt, Human
aagccagaggagaagaggg

SEQ ID NO: 176850 - RNA, 19 nt, Human
aaguggacccgccaauccc

SEQ ID NO: 176851 - RNA, 19 nt, Human
accaccaagucuccaaguc

SEQ ID NO: 176852 - RNA, 21 nt, Human
accccaaaagaguuuaaaaau

SEQ ID NO: 176853 - RNA, 19 nt, Human
agccucucagcggugggga

SEQ ID NO: 176854 - RNA, 20 nt, Human
aggcaggaguggugucggcu

SEQ ID NO: 176855 - RNA, 18 nt, Human
agggcuccuguggcuacg

SEQ ID NO: 176856 - RNA, 21 nt, Human
aguucggcuauuucagagagg

SEQ ID NO: 176857 - RNA, 18 nt, Human
auccuccggccgcccugg

SEQ ID NO: 176858 - RNA, 21 nt, Human
caacuggaccccaaaagaguu

SEQ ID NO: 176859 - RNA, 23 nt, Human
caaucccgaggaagaaccggagg

SEQ ID NO: 176860 - RNA, 20 nt, Human
cacagcagcuucggccucaa

SEQ ID NO: 176861 - RNA, 18 nt, Human
caccaagucuccaagucc

SEQ ID NO: 176862 - RNA, 23 nt, Human
cagaccaccaagucuccaagucc

SEQ ID NO: 176863 - RNA, 25 nt, Human
cagcagcuucggccucaaagccaag

SEQ ID NO: 176864 - RNA, 19 nt, Human
cagccguggggaggggagg

SEQ ID NO: 176865 - RNA, 20 nt, Human
cagcucagaccaccaagucu

SEQ ID NO: 176866 - RNA, 21 nt, Human
caggagagggggugcugggcc

SEQ ID NO: 176867 - RNA, 26 nt, Human
caggcugagguccccacaaaucugcc

SEQ ID NO: 176868 - RNA, 25 nt, Human
caggguaggagcuggggguagagug

SEQ ID NO: 176869 - RNA, 24 nt, Human
ccaaucccgaggaagaaccggagg

SEQ ID NO: 176870 - RNA, 19 nt, Human
cccagcccuggccugggaa

SEQ ID NO: 176871 - RNA, 22 nt, Human
ccccagagcccuggcaagugga

SEQ ID NO: 176872 - RNA, 18 nt, Human
ccccucggcauccuccgg

SEQ ID NO: 176873 - RNA, 18 nt, Human
ccgcccggcuccggcccc

SEQ ID NO: 176874 - RNA, 24 nt, Human
ccgcccggcuccggccccucggca

SEQ ID NO: 176875 - RNA, 21 nt, Human
ccggccccucggcauccuccg

SEQ ID NO: 176876 - RNA, 25 nt, Human
ccucgcgcucgggcccgcccggcuc

SEQ ID NO: 176877 - RNA, 18 nt, Human
ccucugagagugaaggag

SEQ ID NO: 176878 - RNA, 21 nt, Human
ccuggccguggccacucuggc

SEQ ID NO: 176879 - RNA, 21 nt, Human
ccugggcagcggucaggugcg

SEQ ID NO: 176880 - RNA, 22 nt, Human
ccugugacccagcccuggccug

SEQ ID NO: 176881 - RNA, 22 nt, Human
cgaggaagaaccggaggacuug

SEQ ID NO: 176882 - RNA, 22 nt, Human
cgcucaguaaggggacacaguc

SEQ ID NO: 176883 - RNA, 19 nt, Human
cgggagccccgagggcgac

SEQ ID NO: 176884 - RNA, 23 nt, Human
cucccuggccguggccacucugg

SEQ ID NO: 176885 - RNA, 19 nt, Human
cucggccucugagagugaa

SEQ ID NO: 176886 - RNA, 20 nt, Human
cucuggcuuuggcucagccc

SEQ ID NO: 176887 - RNA, 20 nt, Human
cuggcaggcugcugggcgcc

SEQ ID NO: 176888 - RNA, 25 nt, Human
cugucccguccccuccuuuucucua

SEQ ID NO: 176889 - RNA, 24 nt, Human
cugugacccagcccuggccuggga

SEQ ID NO: 176890 - RNA, 23 nt, Human
gacggcaacggccacacgcagcc

SEQ ID NO: 176891 - RNA, 20 nt, Human
gacucggccucugagaguga

SEQ ID NO: 176892 - RNA, 18 nt, Human
gaggggagggacucggcc

SEQ ID NO: 176893 - RNA, 24 nt, Human
gaggggguugaaggguuagcagaa

SEQ ID NO: 176894 - RNA, 21 nt, Human
gaucugggagacguuuccccu

SEQ ID NO: 176895 - RNA, 23 nt, Human
gcacguccggaggcuggcggggc

SEQ ID NO: 176896 - RNA, 18 nt, Human
gcagcggucaggugcgga

SEQ ID NO: 176897 - RNA, 22 nt, Human
gccucaaagccaagggagcgau

SEQ ID NO: 176898 - RNA, 22 nt, Human
gcgcgggcggcucagggucugg

SEQ ID NO: 176899 - RNA, 18 nt, Human
gcugcugggcgcccucca

SEQ ID NO: 176900 - RNA, 19 nt, Human
gcuggcggggcuuacaggg

SEQ ID NO: 176901 - RNA, 21 nt, Human
ggaagaaccggaggacuuggg

SEQ ID NO: 176902 - RNA, 19 nt, Human
ggagaagagggugcaggcu

SEQ ID NO: 176903 - RNA, 21 nt, Human
ggccgagccgggcaggcagga

SEQ ID NO: 176904 - RNA, 25 nt, Human
ggccguggccacucuggcuuuggcu

SEQ ID NO: 176905 - RNA, 18 nt, Human
gggaacauucacaguaac

SEQ ID NO: 176906 - RNA, 18 nt, Human
gggccgagccgggcaggc

SEQ ID NO: 176907 - RNA, 22 nt, Human
gggccgagccgggcaggcagga

SEQ ID NO: 176908 - RNA, 21 nt, Human
ggugucggcuucgggaaaugc

SEQ ID NO: 176909 - RNA, 18 nt, Human
guagagugcgccucgcgc

SEQ ID NO: 176910 - RNA, 21 nt, Human
guccccacaaaucugccccca

SEQ ID NO: 176911 - RNA, 20 nt, Human
guccccuccuuuucucuaca

SEQ ID NO: 176912 - RNA, 20 nt, Human
guccggaggcuggcggggcu

SEQ ID NO: 176913 - RNA, 20 nt, Human
guccuuguuguucuccaaac

SEQ ID NO: 176914 - RNA, 22 nt, Human
gucugucccguccccuccuuuu

SEQ ID NO: 176915 - RNA, 19 nt, Human
guggacccgccaaucccga

SEQ ID NO: 176916 - RNA, 21 nt, Human
guggacccgccaaucccgagg

SEQ ID NO: 176917 - RNA, 20 nt, Human
guggccacucuggcuuuggc

SEQ ID NO: 176918 - RNA, 23 nt, Human
uaggaggcgaggggguugaaggg

SEQ ID NO: 176919 - RNA, 21 nt, Human
ucaaagcaggcaccagcucac

SEQ ID NO: 176920 - RNA, 21 nt, Human
ucagggucugggugcagacgg

SEQ ID NO: 176921 - RNA, 24 nt, Human
ucccaaaaagaauugcaaagcucc

SEQ ID NO: 176922 - RNA, 19 nt, Human
uccccacaaaucugccccc

SEQ ID NO: 176923 - RNA, 21 nt, Human
uccggccccucggcauccucc

SEQ ID NO: 176924 - RNA, 24 nt, Human
uccuguggcuacguacaaucaacu

SEQ ID NO: 176925 - RNA, 18 nt, Human
ucggccucaaagccaagg

SEQ ID NO: 176926 - RNA, 21 nt, Human
ugacccagcccuggccuggga

SEQ ID NO: 176927 - RNA, 23 nt, Human
uggcaaguggacccgccaauccc

SEQ ID NO: 176928 - RNA, 25 nt, Human
uggcaggcugcugggcgcccuccuc

SEQ ID NO: 176929 - RNA, 18 nt, Human
uggccacucuggcuuugg

SEQ ID NO: 176930 - RNA, 19 nt, Human
uggccacucuggcuuuggc

SEQ ID NO: 176931 - RNA, 21 nt, Human
uggccacucuggcuuuggcuc

SEQ ID NO: 176932 - RNA, 19 nt, Human
ugggcgcccuccaggagag

SEQ ID NO: 176933 - RNA, 20 nt, Human
uggggaggggagggacucgg

SEQ ID NO: 176934 - RNA, 21 nt, Human
ugggugcagacggcaacggcc

SEQ ID NO: 176935 - RNA, 20 nt, Human
uuccugugacccagcccugg

SEQ ID NO: 176936 - RNA, 21 nt, Human
uuuggcucagcccagccugga

SEQ ID NO: 176937 - RNA, 21 nt, Human
aaaaggcucucugaaacccuc

SEQ ID NO: 176938 - RNA, 19 nt, Human
aaacaaacgaaagaaagca

SEQ ID NO: 176939 - RNA, 21 nt, Human
aaacgaaagaaagcaguucuu

SEQ ID NO: 176940 - RNA, 21 nt, Human
aagaaagcaguucuuaagacu

SEQ ID NO: 176941 - RNA, 19 nt, Human
agacaccacagugagcucc

SEQ ID NO: 176942 - RNA, 24 nt, Human
agaugcaauaaagucauuguacag

SEQ ID NO: 176943 - RNA, 19 nt, Human
caagucgaaagggacugca

SEQ ID NO: 176944 - RNA, 19 nt, Human
cagcuuugaacaaaugauu

SEQ ID NO: 176945 - RNA, 18 nt, Human
cauguaggccuagaaaaa

SEQ ID NO: 176946 - RNA, 21 nt, Human
ccugggaggucggggggcucc

SEQ ID NO: 176947 - RNA, 21 nt, Human
ccuucaaaaacauauauccau

SEQ ID NO: 176948 - RNA, 19 nt, Human
cgucgcgcccucucgccgg

SEQ ID NO: 176949 - RNA, 21 nt, Human
cucucgccgggcccggaaccc

SEQ ID NO: 176950 - RNA, 23 nt, Human
cuuuuuuuuauuuucuuuuaaug

SEQ ID NO: 176951 - RNA, 24 nt, Human
gaaacaaacaaacgaaagaaagca

SEQ ID NO: 176952 - RNA, 21 nt, Human
gaaacccucaauggcaacugg

SEQ ID NO: 176953 - RNA, 18 nt, Human
gcggggagggaagggcgg

SEQ ID NO: 176954 - RNA, 23 nt, Human
gggagggaagggcgguccgccug

SEQ ID NO: 176955 - RNA, 19 nt, Human
gggcccggaacccgcgcgg

SEQ ID NO: 176956 - RNA, 19 nt, Human
ggggaugggaaggcuggga

SEQ ID NO: 176957 - RNA, 21 nt, Human
ggggggaugggaaggcuggga

SEQ ID NO: 176958 - RNA, 20 nt, Human
gucgcgcccucucgccgggc

SEQ ID NO: 176959 - RNA, 23 nt, Human
uauacaacaguucggucuguaua

SEQ ID NO: 176960 - RNA, 19 nt, Human
ucagugguuggaacacaga

SEQ ID NO: 176961 - RNA, 28 nt, Human
ucagugguuggaacacagaccggggucc

SEQ ID NO: 176962 - RNA, 21 nt, Human
uccaucgcguuuaggcuucau

SEQ ID NO: 176963 - RNA, 19 nt, Human
ucggucuguauaauaugau

SEQ ID NO: 176964 - RNA, 22 nt, Human
ucgucgcgcccucucgccgggc

SEQ ID NO: 176965 - RNA, 25 nt, Human
ugaaacaaacaaacgaaagaaagca

SEQ ID NO: 176966 - RNA, 18 nt, Human
ugaaaggaaacaaaacug

SEQ ID NO: 176967 - RNA, 21 nt, Human
ugaaaggaaacaaaacuggca

SEQ ID NO: 176968 - RNA, 18 nt, Human
ugaaugauuugcuuucgg

SEQ ID NO: 176969 - RNA, 19 nt, Human
ugaauuauacauacaaaca

SEQ ID NO: 176970 - RNA, 21 nt, Human
ugagagagaaggaaaauauug

SEQ ID NO: 176971 - RNA, 21 nt, Human
uggggggaugggaaggcuggg

SEQ ID NO: 176972 - RNA, 22 nt, Human
uuauacauacaaacaacaauua

SEQ ID NO: 176973 - RNA, 23 nt, Human
uuccuuaaacuucuuggcauccu

SEQ ID NO: 176974 - RNA, 23 nt, Human
uugaaacaaacaaacgaaagaaa

SEQ ID NO: 176975 - RNA, 21 nt, Human
uuuguccauuugaauaucaga

SEQ ID NO: 176976 - RNA, 22 nt, Human
uuuuuuuuucuuuucucuuuuu

SEQ ID NO: 176977 - RNA, 20 nt, Human
aaacacaaugcaaaacccac

SEQ ID NO: 176978 - RNA, 23 nt, Human
aacgauaauaugcgugggaggaa

SEQ ID NO: 176979 - RNA, 20 nt, Human
aagaagucuccaacucacag

SEQ ID NO: 176980 - RNA, 21 nt, Human
aaggacaucuugggaaagaag

SEQ ID NO: 176981 - RNA, 24 nt, Human
accaacucgcuuaaaaauauauac

SEQ ID NO: 176982 - RNA, 19 nt, Human
agaaaacgacggcaacaac

SEQ ID NO: 176983 - RNA, 20 nt, Human
agaaguugccagcugcauuu

SEQ ID NO: 176984 - RNA, 23 nt, Human
caagucccagguccgugcaggaa

SEQ ID NO: 176985 - RNA, 24 nt, Human
caagucccagguccgugcaggaau

SEQ ID NO: 176986 - RNA, 20 nt, Human
caccugggggagaaguugcc

SEQ ID NO: 176987 - RNA, 23 nt, Human
cacgcggggagagaaaacgacgg

SEQ ID NO: 176988 - RNA, 18 nt, Human
cagggcccggcccuccgc

SEQ ID NO: 176989 - RNA, 25 nt, Human
ccaacacccgcuuccccuaaccaga

SEQ ID NO: 176990 - RNA, 20 nt, Human
ccagggccuccuucuuugcu

SEQ ID NO: 176991 - RNA, 27 nt, Human
ccagggccuccuucuuugcuauccucc

SEQ ID NO: 176992 - RNA, 20 nt, Human
ccccugggagcccagggccu

SEQ ID NO: 176993 - RNA, 25 nt, Human
cccugggagcccagggccuccuucu

SEQ ID NO: 176994 - RNA, 23 nt, Human
ccuucuuugcuauccuccaaguc

SEQ ID NO: 176995 - RNA, 18 nt, Human
cggggagagaaaacgacg

SEQ ID NO: 176996 - RNA, 19 nt, Human
cuggagcaggggucccagg

SEQ ID NO: 176997 - RNA, 19 nt, Human
cuguagcuccccaggaagu

SEQ ID NO: 176998 - RNA, 21 nt, Human
gaaaaaaccaacucgcuuaaa

SEQ ID NO: 176999 - RNA, 23 nt, Human
gagcaaaggccggcagcaggggg

SEQ ID NO: 177000 - RNA, 19 nt, Human
gagcaggggucccagggcc

SEQ ID NO: 177001 - RNA, 25 nt, Human
gagccacgcggggagagaaaacgac

SEQ ID NO: 177002 - RNA, 18 nt, Human
gcauuuugaugaggcugc

SEQ ID NO: 177003 - RNA, 22 nt, Human
gccacaguggggaacgcagggg

SEQ ID NO: 177004 - RNA, 19 nt, Human
gccuguccccaggggcccg

SEQ ID NO: 177005 - RNA, 18 nt, Human
ggagucagauuugguauu

SEQ ID NO: 177006 - RNA, 20 nt, Human
ggcaagggccuguccccagg

SEQ ID NO: 177007 - RNA, 26 nt, Human
ggcaagggccuguccccaggggcccg

SEQ ID NO: 177008 - RNA, 22 nt, Human
gggaacgcaggggacaaggaca

SEQ ID NO: 177009 - RNA, 25 nt, Human
gggaaggcaccugggggagaaguug

SEQ ID NO: 177010 - RNA, 24 nt, Human
gggacaaggacaucuugggaaaga

SEQ ID NO: 177011 - RNA, 22 nt, Human
ggggaaaaaaccaacucgcuua

SEQ ID NO: 177012 - RNA, 23 nt, Human
ggggucccagggcccggcccucc

SEQ ID NO: 177013 - RNA, 22 nt, Human
uaagugccccuguagcucccca

SEQ ID NO: 177014 - RNA, 19 nt, Human
uauacguauuaaauccagc

SEQ ID NO: 177015 - RNA, 24 nt, Human
ucaaaaaucaaaggggaaaaaacc

SEQ ID NO: 177016 - RNA, 21 nt, Human
ucagauccuucggugcuagaa

SEQ ID NO: 177017 - RNA, 18 nt, Human
uccaacacccgcuucccc

SEQ ID NO: 177018 - RNA, 22 nt, Human
uccaacacccgcuuccccuaac

SEQ ID NO: 177019 - RNA, 18 nt, Human
ucccagggcccggcccuc

SEQ ID NO: 177020 - RNA, 20 nt, Human
ucccucgcaggucaaggagc

SEQ ID NO: 177021 - RNA, 21 nt, Human
ucgcaggucaaggagccacgc

SEQ ID NO: 177022 - RNA, 20 nt, Human
ugagaaaauccaacacccgc

SEQ ID NO: 177023 - RNA, 25 nt, Human
ugcaaaacccacggucuaggccaca

SEQ ID NO: 177024 - RNA, 18 nt, Human
ugcaggaauuugaggagg

SEQ ID NO: 177025 - RNA, 22 nt, Human
ugccccuguagcuccccaggaa

SEQ ID NO: 177026 - RNA, 21 nt, Human
ugggcucccuccagucccauc

SEQ ID NO: 177027 - RNA, 19 nt, Human
uuugaggagggaagaggga

SEQ ID NO: 177028 - RNA, 24 nt, Human
aacaucucuuucaaaauaaaggca

SEQ ID NO: 177029 - RNA, 24 nt, Human
aacucuggugaaauagguuuccau

SEQ ID NO: 177030 - RNA, 22 nt, Human
accccaggcgccgaagguccgu

SEQ ID NO: 177031 - RNA, 18 nt, Human
acuggcccuucccuucca

SEQ ID NO: 177032 - RNA, 19 nt, Human
agaaacgucagucacagug

SEQ ID NO: 177033 - RNA, 27 nt, Human
agaagaagcacaugauuuuggacaaaa

SEQ ID NO: 177034 - RNA, 22 nt, Human
agcuuggcgccgcggcuggacc

SEQ ID NO: 177035 - RNA, 25 nt, Human
aggcgccgaagguccguggggagcc

SEQ ID NO: 177036 - RNA, 18 nt, Human
aucuucucucacucuuuc

SEQ ID NO: 177037 - RNA, 23 nt, Human
caaauggccucaagugaucuucu

SEQ ID NO: 177038 - RNA, 21 nt, Human
caaugcagucuugcaaacuga

SEQ ID NO: 177039 - RNA, 18 nt, Human
cagcagcaaguccuccca

SEQ ID NO: 177040 - RNA, 19 nt, Human
cagcgcagucgccacuguc

SEQ ID NO: 177041 - RNA, 22 nt, Human
caggcaaggcccagguccuagu

SEQ ID NO: 177042 - RNA, 23 nt, Human
cauagcaggcaaggcccaggucc

SEQ ID NO: 177043 - RNA, 20 nt, Human
cccagcucgacagguugccc

SEQ ID NO: 177044 - RNA, 22 nt, Human
cccccggggcccgcgaccccag

SEQ ID NO: 177045 - RNA, 18 nt, Human
ccccgcucuccgccccgg

SEQ ID NO: 177046 - RNA, 20 nt, Human
ccccgcucuccgccccggga

SEQ ID NO: 177047 - RNA, 21 nt, Human
ccgccgccuccgugucgagcu

SEQ ID NO: 177048 - RNA, 23 nt, Human
ccgcgaccccaggcgccgaaggu

SEQ ID NO: 177049 - RNA, 21 nt, Human
ccucaugaaccgacucagccu

SEQ ID NO: 177050 - RNA, 23 nt, Human
ccucccagcucgacagguugccc

SEQ ID NO: 177051 - RNA, 20 nt, Human
ccuggcuucuggaaguggag

SEQ ID NO: 177052 - RNA, 18 nt, Human
cgagcugaggcgucccgc

SEQ ID NO: 177053 - RNA, 23 nt, Human
cgaggaagagaugggggaaggcg

SEQ ID NO: 177054 - RNA, 23 nt, Human
cgccggggccccgcucuccgccc

SEQ ID NO: 177055 - RNA, 21 nt, Human
cgcggcggagcccucccugcc

SEQ ID NO: 177056 - RNA, 22 nt, Human
cgcucuccgccccgggagcagg

SEQ ID NO: 177057 - RNA, 19 nt, Human
cggcugcucgggugcgaag

SEQ ID NO: 177058 - RNA, 21 nt, Human
cgggagcaggaggaggacgag

SEQ ID NO: 177059 - RNA, 22 nt, Human
cuagaguauuuacaaaugcuau

SEQ ID NO: 177060 - RNA, 22 nt, Human
cucaagugaucuucuccaugaa

SEQ ID NO: 177061 - RNA, 19 nt, Human
cugcaacgcaaauugcacu

SEQ ID NO: 177062 - RNA, 19 nt, Human
cuggcccuucccuuccauc

SEQ ID NO: 177063 - RNA, 22 nt, Human
cuuggcgccgcggcuggaccac

SEQ ID NO: 177064 - RNA, 18 nt, Human
gaaauauaaaaugggaug

SEQ ID NO: 177065 - RNA, 18 nt, Human
gaaccgacucagccucca

SEQ ID NO: 177066 - RNA, 18 nt, Human
gaccucaugaaccgacuc

SEQ ID NO: 177067 - RNA, 22 nt, Human
gaccucaugaaccgacucagcc

SEQ ID NO: 177068 - RNA, 18 nt, Human
gagcagcagcgagcgggc

SEQ ID NO: 177069 - RNA, 23 nt, Human
gagcagcagcgagcgggccgggg

SEQ ID NO: 177070 - RNA, 19 nt, Human
gccccgaagggaugcgaag

SEQ ID NO: 177071 - RNA, 21 nt, Human
gcgagcgggccggggguccgg

SEQ ID NO: 177072 - RNA, 18 nt, Human
gcugcucgggugcgaagg

SEQ ID NO: 177073 - RNA, 18 nt, Human
ggagcccucccugccucc

SEQ ID NO: 177074 - RNA, 19 nt, Human
ggagcccucccugccuccu

SEQ ID NO: 177075 - RNA, 20 nt, Human
ggcaaggcccagguccuagu

SEQ ID NO: 177076 - RNA, 23 nt, Human
gguccggccgccgccuccguguc

SEQ ID NO: 177077 - RNA, 24 nt, Human
uaagagaccucaugaaccgacuca

SEQ ID NO: 177078 - RNA, 22 nt, Human
uaaguuaaaauguuuacauuca

SEQ ID NO: 177079 - RNA, 22 nt, Human
uaccuagaguauuuacaaaugc

SEQ ID NO: 177080 - RNA, 22 nt, Human
uagcaggcaaggcccagguccu

SEQ ID NO: 177081 - RNA, 22 nt, Human
uaggacaucccauucaaaaaaa

SEQ ID NO: 177082 - RNA, 25 nt, Human
ucagugaacagcagcaaguccuccc

SEQ ID NO: 177083 - RNA, 19 nt, Human
uccacaguaaaauaaaggg

SEQ ID NO: 177084 - RNA, 21 nt, Human
uccacaguaaaauaaaggggg

SEQ ID NO: 177085 - RNA, 22 nt, Human
ucccgcaguugcuggcgccgcc

SEQ ID NO: 177086 - RNA, 21 nt, Human
ucccugccuccuggcggcgug

SEQ ID NO: 177087 - RNA, 18 nt, Human
uccucccagcucgacagg

SEQ ID NO: 177088 - RNA, 20 nt, Human
uccuggcuucuggaagugga

SEQ ID NO: 177089 - RNA, 18 nt, Human
ucucuuucaaaauaaagg

SEQ ID NO: 177090 - RNA, 22 nt, Human
ugaacagcagcaaguccuccca

SEQ ID NO: 177091 - RNA, 21 nt, Human
ugagagaagauuuguucuuga

SEQ ID NO: 177092 - RNA, 20 nt, Human
ugcaaaugauuuaacacuga

SEQ ID NO: 177093 - RNA, 21 nt, Human
ugcacuggcccuucccuucca

SEQ ID NO: 177094 - RNA, 25 nt, Human
ugcgaaggggcucagcuuggcgccg

SEQ ID NO: 177095 - RNA, 23 nt, Human
ugcugcaacgcaaauugcacuuu

SEQ ID NO: 177096 - RNA, 20 nt, Human
uggaaaagguaugaagaaau

SEQ ID NO: 177097 - RNA, 26 nt, Human
uggaacaaccaaaauugaucagaaga

SEQ ID NO: 177098 - RNA, 19 nt, Human
uggccucaagugaucuucu

SEQ ID NO: 177099 - RNA, 19 nt, Human
uggggagccccgaagggau

SEQ ID NO: 177100 - RNA, 21 nt, Human
uguauacauggaagaaaaaua

SEQ ID NO: 177101 - RNA, 21 nt, Human
ugucuggaccgcugcacaaaa

SEQ ID NO: 177102 - RNA, 19 nt, Human
uuuacagauaccuagagua

SEQ ID NO: 177103 - RNA, 21 nt, Human
uuugauaagagaccucaugaa

SEQ ID NO: 177104 - RNA, 22 nt, Human
uuuuuuuuuuuuuuuuuuacag

SEQ ID NO: 177105 - RNA, 18 nt, Human
aaaaauuacccaaauucc

SEQ ID NO: 177106 - RNA, 21 nt, Human
aaagaaaauuaaaaacagagg

SEQ ID NO: 177107 - RNA, 19 nt, Human
aaaguaauagaagcaaacc

SEQ ID NO: 177108 - RNA, 21 nt, Human
aacauucauggaaaauucacu

SEQ ID NO: 177109 - RNA, 21 nt, Human
aagaaaaguaauagaagcaaa

SEQ ID NO: 177110 - RNA, 25 nt, Human
accugguucuacuuaggaucugugu

SEQ ID NO: 177111 - RNA, 22 nt, Human
agaaaaagagacaauuaccugg

SEQ ID NO: 177112 - RNA, 27 nt, Human
aguaauagaagcaaaccaggcuuacga

SEQ ID NO: 177113 - RNA, 23 nt, Human
aguagcauauaucacaauguuga

SEQ ID NO: 177114 - RNA, 24 nt, Human
auuacccaaauuccuuauuagaaa

SEQ ID NO: 177115 - RNA, 19 nt, Human
auuccuguaaauuuuugga

SEQ ID NO: 177116 - RNA, 22 nt, Human
cacauacaguaucaacacuaaa

SEQ ID NO: 177117 - RNA, 23 nt, Human
caggugacuaauuuuuucuuggu

SEQ ID NO: 177118 - RNA, 22 nt, Human
cccuaagcuucuuagguguauc

SEQ ID NO: 177119 - RNA, 21 nt, Human
ccgcgucgcucgugccgaauu

SEQ ID NO: 177120 - RNA, 22 nt, Human
cgaccccuguuaaggagaugau

SEQ ID NO: 177121 - RNA, 19 nt, Human
cgcccuggcccggcugguc

SEQ ID NO: 177122 - RNA, 18 nt, Human
cggaauguuccuggccuc

SEQ ID NO: 177123 - RNA, 26 nt, Human
cuccuuuagaaaaaaagagauaaucu

SEQ ID NO: 177124 - RNA, 18 nt, Human
cugauagcgaaauccaau

SEQ ID NO: 177125 - RNA, 20 nt, Human
gaccaacauuucaagcugcc

SEQ ID NO: 177126 - RNA, 21 nt, Human
gcaaaccaggcuuacgacccc

SEQ ID NO: 177127 - RNA, 20 nt, Human
uacacauacaguaucaacac

SEQ ID NO: 177128 - RNA, 20 nt, Human
uacacuaaacauuccuguaa

SEQ ID NO: 177129 - RNA, 22 nt, Human
uagaaaaaaagagauaaucuga

SEQ ID NO: 177130 - RNA, 20 nt, Human
uagaaaaagagacaauuacc

SEQ ID NO: 177131 - RNA, 21 nt, Human
uaucacaauguugagaugaga

SEQ ID NO: 177132 - RNA, 19 nt, Human
ucuauagaagaggaaaaaa

SEQ ID NO: 177133 - RNA, 23 nt, Human
ugaaaugagguaagauguauaug

SEQ ID NO: 177134 - RNA, 22 nt, Human
ugauagcgaaauccaauuacac

SEQ ID NO: 177135 - RNA, 21 nt, Human
ugauucuauuuuggaucugug

SEQ ID NO: 177136 - RNA, 24 nt, Human
uggaaagaaaauuaaaaacagagg

SEQ ID NO: 177137 - RNA, 25 nt, Human
uguaaacaaaucuuagaugaccaaa

SEQ ID NO: 177138 - RNA, 22 nt, Human
uuaaagcaggagaaugaaccuu

SEQ ID NO: 177139 - RNA, 22 nt, Human
uuaaagcaggagaaugaaccuu

SEQ ID NO: 177140 - RNA, 18 nt, Human
uuauacuugaagccaaau

SEQ ID NO: 177141 - RNA, 20 nt, Human
uuggaucuguguacauucua

SEQ ID NO: 177142 - RNA, 18 nt, Human
acacugcugcuccacggg

SEQ ID NO: 177143 - RNA, 21 nt, Human
acauaagcaugggggcugggg

SEQ ID NO: 177144 - RNA, 19 nt, Human
acccgcugcugcuuuaagg

SEQ ID NO: 177145 - RNA, 22 nt, Human
acuggcccugcugugcccucuu

SEQ ID NO: 177146 - RNA, 19 nt, Human
agcugccauuuuuccuggc

SEQ ID NO: 177147 - RNA, 20 nt, Human
agcugccauuuuuccuggcu

SEQ ID NO: 177148 - RNA, 18 nt, Human
aggauccacuaaacaaaa

SEQ ID NO: 177149 - RNA, 24 nt, Human
agugccuccuugaguaucugcucc

SEQ ID NO: 177150 - RNA, 19 nt, Human
auccacuaaacaaaaacaa

SEQ ID NO: 177151 - RNA, 23 nt, Human
auccacuaaacaaaaacaaggau

SEQ ID NO: 177152 - RNA, 24 nt, Human
cagcacacagcgcauguucacaua

SEQ ID NO: 177153 - RNA, 21 nt, Human
cagugagcucacccuaggccu

SEQ ID NO: 177154 - RNA, 20 nt, Human
ccauuuuuccuggcuggugc

SEQ ID NO: 177155 - RNA, 22 nt, Human
cccaaaccauugccccugggcu

SEQ ID NO: 177156 - RNA, 18 nt, Human
ccuggcuggugccauagg

SEQ ID NO: 177157 - RNA, 18 nt, Human
cuagucucuucuuuuccu

SEQ ID NO: 177158 - RNA, 21 nt, Human
cuccaggaaagacaaacaguc

SEQ ID NO: 177159 - RNA, 18 nt, Human
cucuucuuuuccuuaccc

SEQ ID NO: 177160 - RNA, 19 nt, Human
cugaaggauagaggaucca

SEQ ID NO: 177161 - RNA, 23 nt, Human
cugaucuuguguuuguacggaca

SEQ ID NO: 177162 - RNA, 22 nt, Human
cuggggcuuacugaucuuuuuc

SEQ ID NO: 177163 - RNA, 26 nt, Human
cuuacccucagcccugauccgguucc

SEQ ID NO: 177164 - RNA, 23 nt, Human
cuuuaagagcugccauuuuuccu

SEQ ID NO: 177165 - RNA, 22 nt, Human
gacucugucccuuuaaugccca

SEQ ID NO: 177166 - RNA, 21 nt, Human
ggggccuccagccccuggcac

SEQ ID NO: 177167 - RNA, 21 nt, Human
ggggcuggggggacacugggg

SEQ ID NO: 177168 - RNA, 21 nt, Human
gucauuagaugaagagaagac

SEQ ID NO: 177169 - RNA, 25 nt, Human
uacccucagcccugaucuuguguuu

SEQ ID NO: 177170 - RNA, 22 nt, Human
ucacauaagcaugggggcuggg

SEQ ID NO: 177171 - RNA, 20 nt, Human
uccacgggcccaguucugca

SEQ ID NO: 177172 - RNA, 21 nt, Human
uccacuaaacaaaaacaagga

SEQ ID NO: 177173 - RNA, 18 nt, Human
ucugucccuuuaaugccc

SEQ ID NO: 177174 - RNA, 21 nt, Human
ugcccaggcugagcccagugc

SEQ ID NO: 177175 - RNA, 22 nt, Human
ugggggcuggggggacacuggg

SEQ ID NO: 177176 - RNA, 18 nt, Human
aaaaauaccacaaauaaa

SEQ ID NO: 177177 - RNA, 22 nt, Human
aaaguaugcagcuuuaugccaa

SEQ ID NO: 177178 - RNA, 27 nt, Human
aaggcacugucacaaucaguccaacug

SEQ ID NO: 177179 - RNA, 24 nt, Human
accaccccucacccaugaucucag

SEQ ID NO: 177180 - RNA, 21 nt, Human
acuuguaauuuguuccuccuc

SEQ ID NO: 177181 - RNA, 22 nt, Human
agaaaaacugcuugagaaacau

SEQ ID NO: 177182 - RNA, 19 nt, Human
agaauucaacguggacccc

SEQ ID NO: 177183 - RNA, 21 nt, Human
auuguggggcagacaauuguu

SEQ ID NO: 177184 - RNA, 22 nt, Human
caacaugcaccaccccucaccc

SEQ ID NO: 177185 - RNA, 19 nt, Human
caagcuauauacagcagcu

SEQ ID NO: 177186 - RNA, 20 nt, Human
caccccucacccaugaucuc

SEQ ID NO: 177187 - RNA, 20 nt, Human
cagcagcuuaaaaccucagu

SEQ ID NO: 177188 - RNA, 25 nt, Human
cucagaaacuacucagaaaaacugc

SEQ ID NO: 177189 - RNA, 22 nt, Human
cuucuggaggguggggagaagu

SEQ ID NO: 177190 - RNA, 24 nt, Human
gcuuaaaaccucaguguuucuuuu

SEQ ID NO: 177191 - RNA, 24 nt, Human
guuauagaaaaauaccacaaauaa

SEQ ID NO: 177192 - RNA, 23 nt, Human
uaaaucucaacaugcaccacccc

SEQ ID NO: 177193 - RNA, 23 nt, Human
uaacagucacaaaauuggcauac

SEQ ID NO: 177194 - RNA, 18 nt, Human
uacgacaaauacuuguca

SEQ ID NO: 177195 - RNA, 27 nt, Human
uagaaaaauaccacaaauaaaaauuag

SEQ ID NO: 177196 - RNA, 19 nt, Human
uauacuggacaacacgggg

SEQ ID NO: 177197 - RNA, 20 nt, Human
ucaaaaucacauaugauaca

SEQ ID NO: 177198 - RNA, 23 nt, Human
ucagaaaaacugcuugagaaaca

SEQ ID NO: 177199 - RNA, 24 nt, Human
ucucacaagcuauauacagcagcu

SEQ ID NO: 177200 - RNA, 18 nt, Human
ucuggaggguggggagaa

SEQ ID NO: 177201 - RNA, 25 nt, Human
ucugugauuauaaaacagauuuguu

SEQ ID NO: 177202 - RNA, 25 nt, Human
ugagaaaaucauucacauguaaaag

SEQ ID NO: 177203 - RNA, 23 nt, Human
ugaguuaaaacauuuucaguuau

SEQ ID NO: 177204 - RNA, 19 nt, Human
uggaggguggggagaagug

SEQ ID NO: 177205 - RNA, 22 nt, Human
uuaaagaaaagagguuucucac

SEQ ID NO: 177206 - RNA, 21 nt, Human
uuaaaucucaacaugcaccac

SEQ ID NO: 177207 - RNA, 22 nt, Human
uuaaaucucaacaugcaccacc

SEQ ID NO: 177208 - RNA, 23 nt, Human
uuagugcuauucaagguguucau

SEQ ID NO: 177209 - RNA, 22 nt, Human
uugucuaaaaaucugugauuau

SEQ ID NO: 177210 - RNA, 19 nt, Human
aaaaagaaacaaagaaaca

SEQ ID NO: 177211 - RNA, 21 nt, Human
aaaacacaaaaugagacacgg

SEQ ID NO: 177212 - RNA, 23 nt, Human
aaaauaaaacacaaaaugagaca

SEQ ID NO: 177213 - RNA, 18 nt, Human
aagaaaacaaaacacaaa

SEQ ID NO: 177214 - RNA, 20 nt, Human
aaucauacaugacaaaugau

SEQ ID NO: 177215 - RNA, 21 nt, Human
aauuagccaggaaagcaaaau

SEQ ID NO: 177216 - RNA, 25 nt, Human
acaauuugaaaaaaagaaacaaaga

SEQ ID NO: 177217 - RNA, 27 nt, Human
acacaauuugaaaaaaagaaacaaaga

SEQ ID NO: 177218 - RNA, 18 nt, Human
acagugauaacaagaaaa

SEQ ID NO: 177219 - RNA, 20 nt, Human
agaaaacaaaacacaaaucu

SEQ ID NO: 177220 - RNA, 18 nt, Human
agaaagacugagauacug

SEQ ID NO: 177221 - RNA, 21 nt, Human
agccaccaaauauccaucuua

SEQ ID NO: 177222 - RNA, 21 nt, Human
agugauaacaagaaaacaaaa

SEQ ID NO: 177223 - RNA, 27 nt, Human
caaaacacaaaucugcaucugguggag

SEQ ID NO: 177224 - RNA, 19 nt, Human
caaaagcuuuuuauugauu

SEQ ID NO: 177225 - RNA, 26 nt, Human
cacaaaauaaaacacaaaaugagaca

SEQ ID NO: 177226 - RNA, 21 nt, Human
cacaaaaugagacacggauga

SEQ ID NO: 177227 - RNA, 21 nt, Human
ccauuugagaauccuagcugc

SEQ ID NO: 177228 - RNA, 21 nt, Human
cggaugaguucauacguaaug

SEQ ID NO: 177229 - RNA, 19 nt, Human
cgggcgcuggagcucuagc

SEQ ID NO: 177230 - RNA, 18 nt, Human
gaaaaaaagaaacaaaga

SEQ ID NO: 177231 - RNA, 20 nt, Human
gaaaaaaagaaacaaagaaa

SEQ ID NO: 177232 - RNA, 27 nt, Human
gaacaaauagagccaccaaauauccau

SEQ ID NO: 177233 - RNA, 22 nt, Human
gagaucacaaaauaaaacacaa

SEQ ID NO: 177234 - RNA, 22 nt, Human
ggucgaguggggccugagcggg

SEQ ID NO: 177235 - RNA, 23 nt, Human
gugauaacaagaaaacaaaacac

SEQ ID NO: 177236 - RNA, 19 nt, Human
uaauggcuuuuauauuacc

SEQ ID NO: 177237 - RNA, 22 nt, Human
uacauguuauaagcugugugac

SEQ ID NO: 177238 - RNA, 23 nt, Human
ucagaaagacugagauacuggca

SEQ ID NO: 177239 - RNA, 18 nt, Human
ucagaacaaauagagcca

SEQ ID NO: 177240 - RNA, 25 nt, Human
ucagaacaaauagagccaccaaaua

SEQ ID NO: 177241 - RNA, 21 nt, Human
uccuagcugcuaagaugacuu

SEQ ID NO: 177242 - RNA, 19 nt, Human
ucuccuaucuacuuaaaua

SEQ ID NO: 177243 - RNA, 24 nt, Human
ugaaaaaaagaaacaaagaaacaa

SEQ ID NO: 177244 - RNA, 19 nt, Human
ugaaaugcuacaauuacca

SEQ ID NO: 177245 - RNA, 22 nt, Human
ugaaaugcuacaauuaccauuu

SEQ ID NO: 177246 - RNA, 18 nt, Human
ugaguucauacguaaugg

SEQ ID NO: 177247 - RNA, 22 nt, Human
aaagugcagagugguugggcuu

SEQ ID NO: 177248 - RNA, 20 nt, Human
aagccuggugggaagcacug

SEQ ID NO: 177249 - RNA, 20 nt, Human
accccggaggcgucuccgag

SEQ ID NO: 177250 - RNA, 21 nt, Human
accugucagcggauccaaaau

SEQ ID NO: 177251 - RNA, 21 nt, Human
agaaggagccuguuuccugga

SEQ ID NO: 177252 - RNA, 22 nt, Human
agaggaagaacuggaggaggug

SEQ ID NO: 177253 - RNA, 22 nt, Human
agcagaugggagaagagaagga

SEQ ID NO: 177254 - RNA, 22 nt, Human
agcuggggcuaucaacauucuc

SEQ ID NO: 177255 - RNA, 19 nt, Human
aggaaagccuggugggaag

SEQ ID NO: 177256 - RNA, 22 nt, Human
aggaauggagcgcagaggagga

SEQ ID NO: 177257 - RNA, 27 nt, Human
aggcagaggcugcagaugacagcugag

SEQ ID NO: 177258 - RNA, 20 nt, Human
aggcugcagaugacagcuga

SEQ ID NO: 177259 - RNA, 23 nt, Human
agguggcccagggcuaaugggag

SEQ ID NO: 177260 - RNA, 20 nt, Human
aguaaaagaggaagaacugg

SEQ ID NO: 177261 - RNA, 18 nt, Human
agucaacucuccaaacug

SEQ ID NO: 177262 - RNA, 19 nt, Human
augccuccccagagcugcc

SEQ ID NO: 177263 - RNA, 23 nt, Human
cacugcagggccggcacacggau

SEQ ID NO: 177264 - RNA, 25 nt, Human
cagcaacagcagcucugacuuggcc

SEQ ID NO: 177265 - RNA, 21 nt, Human
cagucaacucuccaaacugac

SEQ ID NO: 177266 - RNA, 19 nt, Human
cccagagcugccgggcugg

SEQ ID NO: 177267 - RNA, 23 nt, Human
cccauccaaguggcagcaacagc

SEQ ID NO: 177268 - RNA, 19 nt, Human
ccccaccugccuacccucc

SEQ ID NO: 177269 - RNA, 21 nt, Human
ccuggugggaagcacuggucc

SEQ ID NO: 177270 - RNA, 21 nt, Human
cggcacacggaugccucccca

SEQ ID NO: 177271 - RNA, 22 nt, Human
cgggacgggcaguagagccggg

SEQ ID NO: 177272 - RNA, 20 nt, Human
cgggcaguagagccggguac

SEQ ID NO: 177273 - RNA, 21 nt, Human
gacugcacaguccgccaggau

SEQ ID NO: 177274 - RNA, 21 nt, Human
gaggaagaacuggaggaggug

SEQ ID NO: 177275 - RNA, 22 nt, Human
gaggaggaaaaaggucccacag

SEQ ID NO: 177276 - RNA, 21 nt, Human
gccagucaacucuccaaacug

SEQ ID NO: 177277 - RNA, 23 nt, Human
gcccccaccugccuacccuccau

SEQ ID NO: 177278 - RNA, 19 nt, Human
gcuggaggcagaggcugca

SEQ ID NO: 177279 - RNA, 18 nt, Human
ggacagccagaagugggg

SEQ ID NO: 177280 - RNA, 20 nt, Human
ggaggagguggcccagggcu

SEQ ID NO: 177281 - RNA, 24 nt, Human
guucacucucaggcugaaccccca

SEQ ID NO: 177282 - RNA, 19 nt, Human
uaaaaaguccacuguuguu

SEQ ID NO: 177283 - RNA, 18 nt, Human
uagagccggguaccuucc

SEQ ID NO: 177284 - RNA, 24 nt, Human
uccaaguggcagcaacagcagcuc

SEQ ID NO: 177285 - RNA, 21 nt, Human
uccccauccaaguggcagcaa

SEQ ID NO: 177286 - RNA, 23 nt, Human
ucccccacccagcccccaccugc

SEQ ID NO: 177287 - RNA, 22 nt, Human
ucuccaaacugaccaacuaauu

SEQ ID NO: 177288 - RNA, 23 nt, Human
ucuccgagcagcucucccggcuc

SEQ ID NO: 177289 - RNA, 22 nt, Human
ugaagagcuuguggcccgcagg

SEQ ID NO: 177290 - RNA, 22 nt, Human
uggcagcaacagcagcucugac

SEQ ID NO: 177291 - RNA, 20 nt, Human
ugggagaagagaaggagcug

SEQ ID NO: 177292 - RNA, 19 nt, Human
ugggagugggaaacaaagu

SEQ ID NO: 177293 - RNA, 19 nt, Human
ugggcagucccccacccag

SEQ ID NO: 177294 - RNA, 24 nt, Human
uggggucaaggaaagccugguggc

SEQ ID NO: 177295 - RNA, 22 nt, Human
uuaguaaaagaggaagaacugg

SEQ ID NO: 177296 - RNA, 19 nt, Human
uucacucucaggcugaacc

SEQ ID NO: 177297 - RNA, 23 nt, Human
uugaggcugaagucaggguggga

SEQ ID NO: 177298 - RNA, 23 nt, Human
aaacaugauuuugaucauuguac

SEQ ID NO: 177299 - RNA, 22 nt, Human
aaacucggaaagauuucaagua

SEQ ID NO: 177300 - RNA, 22 nt, Human
aaaucaucagugaggauuauac

SEQ ID NO: 177301 - RNA, 22 nt, Human
acacagcaucuuuuaaagucca

SEQ ID NO: 177302 - RNA, 27 nt, Human
acacagcaucuuuuaaagucgaaacuc

SEQ ID NO: 177303 - RNA, 20 nt, Human
acagucuuuuuuuuuuuuuu

SEQ ID NO: 177304 - RNA, 19 nt, Human
agacaaagucuacauauac

SEQ ID NO: 177305 - RNA, 19 nt, Human
agacuuggccagaccaaug

SEQ ID NO: 177306 - RNA, 23 nt, Human
augaguguuaagaauuagaaaag

SEQ ID NO: 177307 - RNA, 22 nt, Human
cacauaagacaaagucuacaua

SEQ ID NO: 177308 - RNA, 24 nt, Human
cacucaauuccuacuccugcccau

SEQ ID NO: 177309 - RNA, 21 nt, Human
caguuuaguuacacagcaucu

SEQ ID NO: 177310 - RNA, 23 nt, Human
cccaagacuuuuaccuaagacuc

SEQ ID NO: 177311 - RNA, 18 nt, Human
ccucuggagaacauaaag

SEQ ID NO: 177312 - RNA, 21 nt, Human
cuacauauacuagguaaacac

SEQ ID NO: 177313 - RNA, 19 nt, Human
cuguucccuugucuguucu

SEQ ID NO: 177314 - RNA, 22 nt, Human
cuuggccagaccaaugcccaaa

SEQ ID NO: 177315 - RNA, 22 nt, Human
gaaguuauaaucuggaugaacu

SEQ ID NO: 177316 - RNA, 19 nt, Human
gggucaaaaaugucaaaaa

SEQ ID NO: 177317 - RNA, 19 nt, Human
guugcacaauuuacagucu

SEQ ID NO: 177318 - RNA, 19 nt, Human
uaagaagcuagggugguug

SEQ ID NO: 177319 - RNA, 23 nt, Human
uaaguaauugaauuauuucaguu

SEQ ID NO: 177320 - RNA, 21 nt, Human
uacauugucuucacuaagaag

SEQ ID NO: 177321 - RNA, 23 nt, Human
uacauugucuucacuaagaagcu

SEQ ID NO: 177322 - RNA, 23 nt, Human
ucaaaaaugucaaaaaaaauccc

SEQ ID NO: 177323 - RNA, 19 nt, Human
ucaauuccuacuccugccc

SEQ ID NO: 177324 - RNA, 21 nt, Human
uccaccuuccucuggagaaca

SEQ ID NO: 177325 - RNA, 26 nt, Human
uccuaggacuuuugacacauaagaca

SEQ ID NO: 177326 - RNA, 19 nt, Human
uccugagugguaccagcuu

SEQ ID NO: 177327 - RNA, 23 nt, Human
ucuaaagugucccauugaaguua

SEQ ID NO: 177328 - RNA, 21 nt, Human
ucuacauauacuagguaaaca

SEQ ID NO: 177329 - RNA, 23 nt, Human
ucuacauauacuagguaaacaca

SEQ ID NO: 177330 - RNA, 21 nt, Human
ugaauuauuucaguuuaguua

SEQ ID NO: 177331 - RNA, 25 nt, Human
ugacacauaagacaaagucuacaua

SEQ ID NO: 177332 - RNA, 21 nt, Human
ugcccaaauauuucccaagac

SEQ ID NO: 177333 - RNA, 25 nt, Human
uggaagaauaaacuucuccugagug

SEQ ID NO: 177334 - RNA, 22 nt, Human
uggcauuaugugaauuuguuua

SEQ ID NO: 177335 - RNA, 23 nt, Human
ugggacauuguagacuuggccag

SEQ ID NO: 177336 - RNA, 18 nt, Human
ugggucaaaaaugucaaa

SEQ ID NO: 177337 - RNA, 25 nt, Human
uuacagucuuuuuuuuuuuuuuaag

SEQ ID NO: 177338 - RNA, 24 nt, Human
uuaguuacacagcaucuuuuaaag

SEQ ID NO: 177339 - RNA, 21 nt, Human
uugggacauuguagacuuggc

SEQ ID NO: 177340 - RNA, 24 nt, Human
uuuagcuugaaaucaucagugagg

SEQ ID NO: 177341 - RNA, 23 nt, Human
uuuguuuaauccagugucaauug

SEQ ID NO: 177342 - RNA, 25 nt, Human
agaaaguauccuaguugucuuccca

SEQ ID NO: 177343 - RNA, 18 nt, Human
agagagucuugcagcacc

SEQ ID NO: 177344 - RNA, 20 nt, Human
ccccuggguggcuccaacuc

SEQ ID NO: 177345 - RNA, 21 nt, Human
gcaaaucaucauacuugucau

SEQ ID NO: 177346 - RNA, 20 nt, Human
ucccagaagcucagugguuu

SEQ ID NO: 177347 - RNA, 18 nt, Human
uccccuggguggcuccaa

SEQ ID NO: 177348 - RNA, 24 nt, Human
aaaaagcacaggcgcaggugcaag

SEQ ID NO: 177349 - RNA, 20 nt, Human
aaaauaacuuuuccaaaagc

SEQ ID NO: 177350 - RNA, 18 nt, Human
aaacaccaccaacuacaa

SEQ ID NO: 177351 - RNA, 21 nt, Human
aagaacauagaaaacccuuaa

SEQ ID NO: 177352 - RNA, 22 nt, Human
aauaaaaacacacagaaaggga

SEQ ID NO: 177353 - RNA, 19 nt, Human
acaaaaaauaaaaaaggaa

SEQ ID NO: 177354 - RNA, 21 nt, Human
acaaagaaaauuuaaaagucu

SEQ ID NO: 177355 - RNA, 24 nt, Human
agaagacaauaaaacauauuuaag

SEQ ID NO: 177356 - RNA, 24 nt, Human
agagcaggaugccauuuuagguga

SEQ ID NO: 177357 - RNA, 20 nt, Human
agcaggaugccauuuuaggu

SEQ ID NO: 177358 - RNA, 18 nt, Human
agccaacccucaaacacc

SEQ ID NO: 177359 - RNA, 22 nt, Human
aucauacaauauuuuaugacaa

SEQ ID NO: 177360 - RNA, 25 nt, Human
caaaaaauaaaaaaggaaaaaacaa

SEQ ID NO: 177361 - RNA, 18 nt, Human
cagcugcaggugaggcug

SEQ ID NO: 177362 - RNA, 26 nt, Human
cagugucucuucagguuuaaaauucu

SEQ ID NO: 177363 - RNA, 26 nt, Human
ccaaaagcaguaauaccucaaauuaa

SEQ ID NO: 177364 - RNA, 20 nt, Human
ccaguucacuucuuccaaac

SEQ ID NO: 177365 - RNA, 18 nt, Human
cccucaaacaccaccaac

SEQ ID NO: 177366 - RNA, 23 nt, Human
cuaaaauuaaggcuaagcauuau

SEQ ID NO: 177367 - RNA, 20 nt, Human
ggagauaauuuucuucuuca

SEQ ID NO: 177368 - RNA, 23 nt, Human
uaaaauaaaaacacacagaaagg

SEQ ID NO: 177369 - RNA, 25 nt, Human
uaaaauaaaaacacacagaaaggga

SEQ ID NO: 177370 - RNA, 21 nt, Human
uaaaauaacuuuuccaaaagc

SEQ ID NO: 177371 - RNA, 22 nt, Human
uaaguuucuuuucucugauuau

SEQ ID NO: 177372 - RNA, 19 nt, Human
uacagauugaacuagggag

SEQ ID NO: 177373 - RNA, 18 nt, Human
uagagaagacaauaaaac

SEQ ID NO: 177374 - RNA, 20 nt, Human
ucauacaauauuuuaugaca

SEQ ID NO: 177375 - RNA, 21 nt, Human
ucuaaaauuaaggcuaagccg

SEQ ID NO: 177376 - RNA, 18 nt, Human
ucuagccaacccucaaac

SEQ ID NO: 177377 - RNA, 18 nt, Human
ucugauuauuugaucaag

SEQ ID NO: 177378 - RNA, 18 nt, Human
ucuguagucuuauuucac

SEQ ID NO: 177379 - RNA, 25 nt, Human
ucuucacagacaaagaucuuuaagu

SEQ ID NO: 177380 - RNA, 21 nt, Human
ugaucaaggaacaaacuauau

SEQ ID NO: 177381 - RNA, 21 nt, Human
ugcacauauuuauaaaauaac

SEQ ID NO: 177382 - RNA, 24 nt, Human
uggcacaaaauccaggcuuucauu

SEQ ID NO: 177383 - RNA, 20 nt, Human
uggcuucuuauacaaucuau

SEQ ID NO: 177384 - RNA, 20 nt, Human
uucacagacaaagaucuuua

SEQ ID NO: 177385 - RNA, 22 nt, Human
uuccaaacaaaagaauucacag

SEQ ID NO: 177386 - RNA, 20 nt, Human
uugaauguugacauaucauc

SEQ ID NO: 177387 - RNA, 19 nt, Human
uuugaucaaggaacaaacu

SEQ ID NO: 177388 - RNA, 20 nt, Human
agaugggagggagggagggc

SEQ ID NO: 177389 - RNA, 20 nt, Human
agaugggagggagggagggc

SEQ ID NO: 177390 - RNA, 18 nt, Human
auccaugguuaaaagugg

SEQ ID NO: 177391 - RNA, 18 nt, Human
auccaugguuaaaagugg

SEQ ID NO: 177392 - RNA, 18 nt, Human
aucugaacgacuucagaa

SEQ ID NO: 177393 - RNA, 20 nt, Human
cacucuccucucaagagaag

SEQ ID NO: 177394 - RNA, 20 nt, Human
cacucuccucucaagagaag

SEQ ID NO: 177395 - RNA, 22 nt, Human
cagcauaaggcacuacccccag

SEQ ID NO: 177396 - RNA, 22 nt, Human
cagcauaaggcacuacccccag

SEQ ID NO: 177397 - RNA, 20 nt, Human
ccagaugggagggagggagg

SEQ ID NO: 177398 - RNA, 20 nt, Human
ccagaugggagggagggagg

SEQ ID NO: 177399 - RNA, 22 nt, Human
ccagcauaaggcacuaccccca

SEQ ID NO: 177400 - RNA, 22 nt, Human
ccagcauaaggcacuaccccca

SEQ ID NO: 177401 - RNA, 18 nt, Human
cucacucugcuccaacac

SEQ ID NO: 177402 - RNA, 18 nt, Human
cucacucugcuccaacac

SEQ ID NO: 177403 - RNA, 18 nt, Human
cucacuucccacuccauc

SEQ ID NO: 177404 - RNA, 25 nt, Human
cuccagaaaggggcuugagaguuuc

SEQ ID NO: 177405 - RNA, 19 nt, Human
cuuuauuuuccucucccuc

SEQ ID NO: 177406 - RNA, 19 nt, Human
cuuuauuuuccucucccuc

SEQ ID NO: 177407 - RNA, 25 nt, Human
gacuucagaagggaaauuuugauau

SEQ ID NO: 177408 - RNA, 21 nt, Human
gcggagcaacgacggcgaccg

SEQ ID NO: 177409 - RNA, 25 nt, Human
uccaugguuaaaaguggauugagac

SEQ ID NO: 177410 - RNA, 25 nt, Human
uccaugguuaaaaguggauugagac

SEQ ID NO: 177411 - RNA, 19 nt, Human
ucugcuccaacacccagca

SEQ ID NO: 177412 - RNA, 21 nt, Human
ucugcuccaacacccagcaua

SEQ ID NO: 177413 - RNA, 21 nt, Human
uggagucugcucucauccaug

SEQ ID NO: 177414 - RNA, 21 nt, Human
uggagucugcucucauccaug

SEQ ID NO: 177415 - RNA, 22 nt, Human
uucccacuccauccgccaccuc

SEQ ID NO: 177416 - RNA, 23 nt, Human
uuuuuuuuuucagaugugcaggu

SEQ ID NO: 177417 - RNA, 23 nt, Human
uuuuuuuuuucagaugugcaggu

SEQ ID NO: 177418 - RNA, 21 nt, Human
uuuuuuuuuuuuuuuuuucag

SEQ ID NO: 177419 - RNA, 21 nt, Human
uuuuuuuuuuuuuuuuuucag

SEQ ID NO: 177420 - RNA, 27 nt, Human
aaauaagaagaaaauaacagaaucuag

SEQ ID NO: 177421 - RNA, 24 nt, Human
aagaagcuugaaaauuuuauuuaa

SEQ ID NO: 177422 - RNA, 22 nt, Human
aagacaaagguuucaggaagaa

SEQ ID NO: 177423 - RNA, 29 nt, Human
acuucauccaaaauaagaagaaaauaacu

SEQ ID NO: 177424 - RNA, 26 nt, Human
agcaauguggccucagaauacaccuc

SEQ ID NO: 177425 - RNA, 19 nt, Human
caaacaucccacguggcua

SEQ ID NO: 177426 - RNA, 20 nt, Human
cagaauacaccucuuaaauu

SEQ ID NO: 177427 - RNA, 23 nt, Human
cagaucggaauaauuuacauuua

SEQ ID NO: 177428 - RNA, 24 nt, Human
cucuuaaauuuacaggacuuaaca

SEQ ID NO: 177429 - RNA, 19 nt, Human
cuuugauacauugaaagcu

SEQ ID NO: 177430 - RNA, 23 nt, Human
gagcaagcccucuuugggaacuu

SEQ ID NO: 177431 - RNA, 20 nt, Human
gcuguagaacagagcaggug

SEQ ID NO: 177432 - RNA, 22 nt, Human
ggaacuuuugaugugcucugug

SEQ ID NO: 177433 - RNA, 20 nt, Human
uaagaagaaaauaacagaau

SEQ ID NO: 177434 - RNA, 24 nt, Human
uauuauuauaaugcagauauguca

SEQ ID NO: 177435 - RNA, 24 nt, Human
uccaaaauaagaagaaaauaacag

SEQ ID NO: 177436 - RNA, 25 nt, Human
uccaaaauaagaagaaaauaacaga

SEQ ID NO: 177437 - RNA, 20 nt, Human
ucucuuuccaauuucaccac

SEQ ID NO: 177438 - RNA, 25 nt, Human
ugugaagaugaucuugaauagugau

SEQ ID NO: 177439 - RNA, 25 nt, Human
uuagcaauauuuugauaaaacuuuu

SEQ ID NO: 177440 - RNA, 20 nt, Human
uuggcuacacaacacuaaaa

SEQ ID NO: 177441 - RNA, 24 nt, Human
uuggcuacacaacacuaaaagaaa

SEQ ID NO: 177442 - RNA, 24 nt, Human
uuuacauuuacaaauuauaucaua

SEQ ID NO: 177443 - RNA, 21 nt, Human
uuuagcaauauuuugauaaaa

SEQ ID NO: 177444 - RNA, 21 nt, Human
uuuaucgcuaaauguaaacag

SEQ ID NO: 177445 - RNA, 25 nt, Human
uuucaaacaucccacguggcuagca

SEQ ID NO: 177446 - RNA, 19 nt, Human
uuuccaauuucaccacugu

SEQ ID NO: 177447 - RNA, 21 nt, Human
uuuggcuacacaacacuaaaa

SEQ ID NO: 177448 - RNA, 21 nt, Human
uuuguaauuuuuggcuacaca

SEQ ID NO: 177449 - RNA, 26 nt, Human
aagcugccccuuugagccucagggcc

SEQ ID NO: 177450 - RNA, 26 nt, Human
aaggcaggugcagggagaggaggccc

SEQ ID NO: 177451 - RNA, 23 nt, Human
acagccacacugggggugggggg

SEQ ID NO: 177452 - RNA, 24 nt, Human
acgcaguucacggcacagccccca

SEQ ID NO: 177453 - RNA, 22 nt, Human
aggcaggugcagggagaggagg

SEQ ID NO: 177454 - RNA, 18 nt, Human
caaugcaguccuggugug

SEQ ID NO: 177455 - RNA, 19 nt, Human
cacagcccccacucccgcc

SEQ ID NO: 177456 - RNA, 21 nt, Human
cacgcaguucacggcacagcc

SEQ ID NO: 177457 - RNA, 20 nt, Human
cagcccccacucccgcccug

SEQ ID NO: 177458 - RNA, 22 nt, Human
ccaaucucgcagacagccacac

SEQ ID NO: 177459 - RNA, 23 nt, Human
cccccacucccgcccuggacucc

SEQ ID NO: 177460 - RNA, 18 nt, Human
cccccagccucagcuggc

SEQ ID NO: 177461 - RNA, 21 nt, Human
cccccagccucagcugggcgu

SEQ ID NO: 177462 - RNA, 19 nt, Human
ccccgcccccagccucagc

SEQ ID NO: 177463 - RNA, 23 nt, Human
cccgcccccagccucagcugggc

SEQ ID NO: 177464 - RNA, 24 nt, Human
ccgcccuggacuccucugcucacc

SEQ ID NO: 177465 - RNA, 24 nt, Human
ccucagggcccgcgcggcgcugcu

SEQ ID NO: 177466 - RNA, 21 nt, Human
ccucccacaucuggcaggggc

SEQ ID NO: 177467 - RNA, 21 nt, Human
ccucugggcagcuagcugccu

SEQ ID NO: 177468 - RNA, 24 nt, Human
ccucugggugccagaguccagccc

SEQ ID NO: 177469 - RNA, 24 nt, Human
ccugaagcugccccuuugagccuc

SEQ ID NO: 177470 - RNA, 24 nt, Human
ccuggccagugggguguccucccc

SEQ ID NO: 177471 - RNA, 25 nt, Human
ccuggccagugggguguccuccccu

SEQ ID NO: 177472 - RNA, 18 nt, Human
cgcagacagccacacugg

SEQ ID NO: 177473 - RNA, 21 nt, Human
cucccccgcccccagccucag

SEQ ID NO: 177474 - RNA, 20 nt, Human
cucugcaccagggacaaggc

SEQ ID NO: 177475 - RNA, 23 nt, Human
cucugggcagcuagcugccuccc

SEQ ID NO: 177476 - RNA, 19 nt, Human
gcagcuagcugccucccac

SEQ ID NO: 177477 - RNA, 23 nt, Human
gcaggugcagggagaggaggccc

SEQ ID NO: 177478 - RNA, 21 nt, Human
gcccuggacuccucugcucac

SEQ ID NO: 177479 - RNA, 18 nt, Human
ggcacagcccccacuccc

SEQ ID NO: 177480 - RNA, 22 nt, Human
ggcacagcccccacucccgccc

SEQ ID NO: 177481 - RNA, 19 nt, Human
gggcccgcgcggcgcugcu

SEQ ID NO: 177482 - RNA, 18 nt, Human
gggcguccuggccagugg

SEQ ID NO: 177483 - RNA, 20 nt, Human
uccaugcacaugggacgugc

SEQ ID NO: 177484 - RNA, 22 nt, Human
uccaugcacaugggacgugccg

SEQ ID NO: 177485 - RNA, 19 nt, Human
uccccgccguccucugggc

SEQ ID NO: 177486 - RNA, 19 nt, Human
ucucgcagacagccacacu

SEQ ID NO: 177487 - RNA, 23 nt, Human
ucucgcagacagccacacugggg

SEQ ID NO: 177488 - RNA, 21 nt, Human
ugccagaguccagcccuagcu

SEQ ID NO: 177489 - RNA, 21 nt, Human
uggcagagcagcagagccugg

SEQ ID NO: 177490 - RNA, 19 nt, Human
uggggcaaugcaguccugg

SEQ ID NO: 177491 - RNA, 21 nt, Human
uggggcguccuggccaguggg

SEQ ID NO: 177492 - RNA, 18 nt, Human
ugggggugggggguaggu

SEQ ID NO: 177493 - RNA, 20 nt, Human
ugguguguguguacgcuccu

SEQ ID NO: 177494 - RNA, 23 nt, Human
uuggcucccccgcccccagccuc

SEQ ID NO: 177495 - RNA, 18 nt, Human
aaaaaaaagaagaagaag

SEQ ID NO: 177496 - RNA, 19 nt, Human
aaaaaaacccaauaccucu

SEQ ID NO: 177497 - RNA, 21 nt, Human
aaaaaaacccaauaccucugc

SEQ ID NO: 177498 - RNA, 19 nt, Human
aaaaaacaaaaaaacccaa

SEQ ID NO: 177499 - RNA, 22 nt, Human
aaaaaacaaaaaaacccaauac

SEQ ID NO: 177500 - RNA, 18 nt, Human
aaaaaagaagaagaagaa

SEQ ID NO: 177501 - RNA, 22 nt, Human
aaaaacaaaaaaacccaauacc

SEQ ID NO: 177502 - RNA, 20 nt, Human
aaaaggcaaaaguaucuaca

SEQ ID NO: 177503 - RNA, 21 nt, Human
aaacaagaccggacagacaga

SEQ ID NO: 177504 - RNA, 24 nt, Human
aaacaagaccggacagacagacaa

SEQ ID NO: 177505 - RNA, 23 nt, Human
aaacagaaguagagaggagggac

SEQ ID NO: 177506 - RNA, 21 nt, Human
aaacaugaccaaagugaaguc

SEQ ID NO: 177507 - RNA, 22 nt, Human
aaaccgggaccagaagcuucca

SEQ ID NO: 177508 - RNA, 22 nt, Human
aacauuacgacugcuaaaaaua

SEQ ID NO: 177509 - RNA, 25 nt, Human
aacccaauaccucugccaucuugcc

SEQ ID NO: 177510 - RNA, 21 nt, Human
aagaagaaaguagaggcucaa

SEQ ID NO: 177511 - RNA, 24 nt, Human
aagacccacauagaccacaaagga

SEQ ID NO: 177512 - RNA, 23 nt, Human
aagccaaccaucacuguacuuaa

SEQ ID NO: 177513 - RNA, 19 nt, Human
aaggaccccggggcgcuuc

SEQ ID NO: 177514 - RNA, 20 nt, Human
aaugaggacaagacccacau

SEQ ID NO: 177515 - RNA, 22 nt, Human
acaaaaaaacccaauaccucug

SEQ ID NO: 177516 - RNA, 18 nt, Human
acaaaggaaacucaauaa

SEQ ID NO: 177517 - RNA, 23 nt, Human
acaagacccacauagaccacaaa

SEQ ID NO: 177518 - RNA, 22 nt, Human
accgcacuaaauauuuuagcac

SEQ ID NO: 177519 - RNA, 22 nt, Human
acuaaagacuagaguaaaacag

SEQ ID NO: 177520 - RNA, 23 nt, Human
agaagaagaagaaacauuuugag

SEQ ID NO: 177521 - RNA, 22 nt, Human
agacauuccaccaccuucccuu

SEQ ID NO: 177522 - RNA, 21 nt, Human
caaaaacauagacauuccacc

SEQ ID NO: 177523 - RNA, 22 nt, Human
caaaaacauagacauuccacca

SEQ ID NO: 177524 - RNA, 20 nt, Human
caacgcacacacacugaaug

SEQ ID NO: 177525 - RNA, 21 nt, Human
caagaccggacagacagacaa

SEQ ID NO: 177526 - RNA, 22 nt, Human
caauaccucugccaucuugccc

SEQ ID NO: 177527 - RNA, 22 nt, Human
caauagaagguagaaaugugcc

SEQ ID NO: 177528 - RNA, 24 nt, Human
caaugggcuguggccggagucacc

SEQ ID NO: 177529 - RNA, 21 nt, Human
cacaaaggaaacucaauaaac

SEQ ID NO: 177530 - RNA, 23 nt, Human
cacaguaaaaucaaaaacauaga

SEQ ID NO: 177531 - RNA, 19 nt, Human
cacuaugucaaccaaauac

SEQ ID NO: 177532 - RNA, 24 nt, Human
cacuguacuuaaacuccagaaaga

SEQ ID NO: 177533 - RNA, 24 nt, Human
cagagcaauaccgcacuaaauauu

SEQ ID NO: 177534 - RNA, 19 nt, Human
cagccgcugccguucggga

SEQ ID NO: 177535 - RNA, 22 nt, Human
cauuccaccaccuucccuuggu

SEQ ID NO: 177536 - RNA, 22 nt, Human
cauucugugcucguucaggugc

SEQ ID NO: 177537 - RNA, 22 nt, Human
ccaaccaucacuguacuuaaac

SEQ ID NO: 177538 - RNA, 24 nt, Human
ccagaaagaaaaagcuaggaaaca

SEQ ID NO: 177539 - RNA, 22 nt, Human
ccaggauuaaaauaccuauacc

SEQ ID NO: 177540 - RNA, 23 nt, Human
cccaauaccucugccaucuugcc

SEQ ID NO: 177541 - RNA, 22 nt, Human
cccgccgcagccgcugccguuc

SEQ ID NO: 177542 - RNA, 18 nt, Human
ccgccgcagccgcugccg

SEQ ID NO: 177543 - RNA, 22 nt, Human
cgagaauacacucguaaacaac

SEQ ID NO: 177544 - RNA, 18 nt, Human
cgcuuugguuaaaacguu

SEQ ID NO: 177545 - RNA, 19 nt, Human
cgggaaggaccccggggcg

SEQ ID NO: 177546 - RNA, 21 nt, Human
cgggaccagaagcuuccagug

SEQ ID NO: 177547 - RNA, 24 nt, Human
cuaauguuuauacugggcuagauu

SEQ ID NO: 177548 - RNA, 18 nt, Human
cuaauucuucucccuucc

SEQ ID NO: 177549 - RNA, 23 nt, Human
cuaggaaacagaaguagagagga

SEQ ID NO: 177550 - RNA, 19 nt, Human
gaaaaaaacaaaaaaaccc

SEQ ID NO: 177551 - RNA, 23 nt, Human
gaaaaaaacaaaaaaacccaaua

SEQ ID NO: 177552 - RNA, 20 nt, Human
gcacuaaauauuuuagcacu

SEQ ID NO: 177553 - RNA, 18 nt, Human
gcuagauuuaaaaaggua

SEQ ID NO: 177554 - RNA, 23 nt, Human
ggacaagacccacauagaccaca

SEQ ID NO: 177555 - RNA, 18 nt, Human
ggccggagucaccugagg

SEQ ID NO: 177556 - RNA, 19 nt, Human
uaaaaaaaagaagaagaag

SEQ ID NO: 177557 - RNA, 19 nt, Human
uaaaauaccuauaccaucu

SEQ ID NO: 177558 - RNA, 22 nt, Human
uaaaauaccuauaccaucuaua

SEQ ID NO: 177559 - RNA, 19 nt, Human
uaaaaucaaaaacauagac

SEQ ID NO: 177560 - RNA, 28 nt, Human
uaaaaucaaaaacauagacauuccacca

SEQ ID NO: 177561 - RNA, 23 nt, Human
uaaaccuauaaaguuaaaacuga

SEQ ID NO: 177562 - RNA, 24 nt, Human
uaaacuccagaaagaaaaagcuag

SEQ ID NO: 177563 - RNA, 19 nt, Human
uaagaacacuucuaggaaa

SEQ ID NO: 177564 - RNA, 27 nt, Human
uaagacaacagccuguggauacauuag

SEQ ID NO: 177565 - RNA, 27 nt, Human
uaagauuaaaaaaaagaagaagaagaa

SEQ ID NO: 177566 - RNA, 25 nt, Human
uaauaaacaugaccaaagugaaguc

SEQ ID NO: 177567 - RNA, 24 nt, Human
uaauguuuauacugggcuagauuu

SEQ ID NO: 177568 - RNA, 20 nt, Human
uacaaugaggacaagaccca

SEQ ID NO: 177569 - RNA, 25 nt, Human
uacacuaauucuucucccuucccag

SEQ ID NO: 177570 - RNA, 22 nt, Human
uacuaaagacuagaguaaaaca

SEQ ID NO: 177571 - RNA, 24 nt, Human
uacuauuugaaaaaaauacacuaa

SEQ ID NO: 177572 - RNA, 19 nt, Human
uacucaagccaaccaucac

SEQ ID NO: 177573 - RNA, 22 nt, Human
uagaguaaaacagacaaaguca

SEQ ID NO: 177574 - RNA, 18 nt, Human
uaggaaauguuagaacaa

SEQ ID NO: 177575 - RNA, 23 nt, Human
uaugcuuaugaggcaaauuacug

SEQ ID NO: 177576 - RNA, 23 nt, Human
uauugaaauacaucaaauucuua

SEQ ID NO: 177577 - RNA, 23 nt, Human
ucaaaaacauagacauuccacca

SEQ ID NO: 177578 - RNA, 20 nt, Human
ucacacuuguuuuuacuuua

SEQ ID NO: 177579 - RNA, 20 nt, Human
ucacuguacuuaaacuccaa

SEQ ID NO: 177580 - RNA, 25 nt, Human
ucuucucccuucccaggccccucug

SEQ ID NO: 177581 - RNA, 23 nt, Human
ucuugccccaucauaacccaaaa

SEQ ID NO: 177582 - RNA, 21 nt, Human
ugaaaaugaugggcacucuca

SEQ ID NO: 177583 - RNA, 21 nt, Human
ugaagagcacuaugucaacca

SEQ ID NO: 177584 - RNA, 22 nt, Human
ugaagagcacuaugucaaccaa

SEQ ID NO: 177585 - RNA, 19 nt, Human
ugaccaaagugaagucugu

SEQ ID NO: 177586 - RNA, 20 nt, Human
uggaaaaaaacaaaaaaacc

SEQ ID NO: 177587 - RNA, 20 nt, Human
uggaauguacaaacaagacc

SEQ ID NO: 177588 - RNA, 25 nt, Human
uggaauguacaaacaagaccggaca

SEQ ID NO: 177589 - RNA, 20 nt, Human
uggcaagaagaaaguagagg

SEQ ID NO: 177590 - RNA, 22 nt, Human
uggcaagaagaaaguagaggcu

SEQ ID NO: 177591 - RNA, 25 nt, Human
ugugcacauacuuacacuauuagca

SEQ ID NO: 177592 - RNA, 23 nt, Human
uuaaaaaucccccaaauggacuc

SEQ ID NO: 177593 - RNA, 23 nt, Human
uuaacucacaguaaaaucaaaaa

SEQ ID NO: 177594 - RNA, 21 nt, Human
uuugacuuccuagaaauaauu

SEQ ID NO: 177595 - RNA, 22 nt, Human
uuuuagcacuuucggcacuaca

SEQ ID NO: 177596 - RNA, 19 nt, Human
uuuuuuuuuuuuuuuuuaa

SEQ ID NO: 177597 - RNA, 22 nt, Human
aaugcugcuugggguuucuucc

SEQ ID NO: 177598 - RNA, 22 nt, Human
aaugcugcuugggguuucuucc

SEQ ID NO: 177599 - RNA, 18 nt, Human
accccucagccuucccca

SEQ ID NO: 177600 - RNA, 28 nt, Human
accuccuccauggagcccccucccauug

SEQ ID NO: 177601 - RNA, 28 nt, Human
accuccuccauggagcccccucccauug

SEQ ID NO: 177602 - RNA, 20 nt, Human
agcaacucccuucugggaaa

SEQ ID NO: 177603 - RNA, 19 nt, Human
agccccuggccugcccuuu

SEQ ID NO: 177604 - RNA, 19 nt, Human
agccugggugcuguggggc

SEQ ID NO: 177605 - RNA, 24 nt, Human
agcugccugaggcuggcagcccag

SEQ ID NO: 177606 - RNA, 24 nt, Human
aggcaagaaaauggccaggacugg

SEQ ID NO: 177607 - RNA, 24 nt, Human
aggcaagaaaauggccaggacugg

SEQ ID NO: 177608 - RNA, 21 nt, Human
aggcagggccauugcugggcg

SEQ ID NO: 177609 - RNA, 20 nt, Human
aggcugcaggugacuguguc

SEQ ID NO: 177610 - RNA, 21 nt, Human
aggcugcaggugacugugucu

SEQ ID NO: 177611 - RNA, 18 nt, Human
aggcuucuccgccgcagg

SEQ ID NO: 177612 - RNA, 19 nt, Human
aggcuucugaaguggaaau

SEQ ID NO: 177613 - RNA, 23 nt, Human
agguucagucacaguuuccuccu

SEQ ID NO: 177614 - RNA, 18 nt, Human
cacaucugccagccaagg

SEQ ID NO: 177615 - RNA, 24 nt, Human
cacugagccuggauguucuccagg

SEQ ID NO: 177616 - RNA, 19 nt, Human
cagcagccagcguggggag

SEQ ID NO: 177617 - RNA, 23 nt, Human
cagcagccagcguggggagcugg

SEQ ID NO: 177618 - RNA, 19 nt, Human
cagcguggggagcugggac

SEQ ID NO: 177619 - RNA, 24 nt, Human
caggaugaguucccagggaaguga

SEQ ID NO: 177620 - RNA, 23 nt, Human
cauggagcccccucccauugcuc

SEQ ID NO: 177621 - RNA, 23 nt, Human
cauggagcccccucccauugcuc

SEQ ID NO: 177622 - RNA, 19 nt, Human
ccagggaagugaggccaca

SEQ ID NO: 177623 - RNA, 19 nt, Human
ccaucccagaaucacaagc

SEQ ID NO: 177624 - RNA, 19 nt, Human
ccaucccagaaucacaagc

SEQ ID NO: 177625 - RNA, 22 nt, Human
ccauugcucccugggccucuug

SEQ ID NO: 177626 - RNA, 22 nt, Human
ccauugcucccugggccucuug

SEQ ID NO: 177627 - RNA, 23 nt, Human
ccauugcugggcgcuuggguggc

SEQ ID NO: 177628 - RNA, 22 nt, Human
ccccaguaggcuucugaagugg

SEQ ID NO: 177629 - RNA, 23 nt, Human
cccccucccauugcucccugggc

SEQ ID NO: 177630 - RNA, 23 nt, Human
cccccucccauugcucccugggc

SEQ ID NO: 177631 - RNA, 25 nt, Human
ccccuuggggcagaggcuugggggc

SEQ ID NO: 177632 - RNA, 25 nt, Human
ccccuuggggcagaggcuugggggc

SEQ ID NO: 177633 - RNA, 19 nt, Human
cccugggccucuugagccu

SEQ ID NO: 177634 - RNA, 19 nt, Human
cccugggccucuugagccu

SEQ ID NO: 177635 - RNA, 25 nt, Human
cccugggucccugggagaauguggu

SEQ ID NO: 177636 - RNA, 22 nt, Human
cccuucuggacccuuccucacu

SEQ ID NO: 177637 - RNA, 28 nt, Human
cccuuugugggccccuuggggcagaggc

SEQ ID NO: 177638 - RNA, 28 nt, Human
cccuuugugggccccuuggggcagaggc

SEQ ID NO: 177639 - RNA, 21 nt, Human
ccgcacccccguuagggcccu

SEQ ID NO: 177640 - RNA, 27 nt, Human
ccuccauggagcccccucccauugcuc

SEQ ID NO: 177641 - RNA, 27 nt, Human
ccuccauggagcccccucccauugcuc

SEQ ID NO: 177642 - RNA, 21 nt, Human
ccucccauugcucccugggcc

SEQ ID NO: 177643 - RNA, 21 nt, Human
ccucccauugcucccugggcc

SEQ ID NO: 177644 - RNA, 25 nt, Human
ccuccugccccgccaggcugcgagc

SEQ ID NO: 177645 - RNA, 18 nt, Human
ccuccuuuucauuguucu

SEQ ID NO: 177646 - RNA, 22 nt, Human
ccugaggcuggcagcccagggc

SEQ ID NO: 177647 - RNA, 21 nt, Human
ccuggcugcccuuuuggccca

SEQ ID NO: 177648 - RNA, 20 nt, Human
ccugggugcuguggggcugu

SEQ ID NO: 177649 - RNA, 22 nt, Human
ccuguggcagcaacggcugcuu

SEQ ID NO: 177650 - RNA, 21 nt, Human
cgcucuguuccccagcgguaa

SEQ ID NO: 177651 - RNA, 22 nt, Human
cguuagggcccuggggcugucc

SEQ ID NO: 177652 - RNA, 24 nt, Human
cucacugagccuggauguucucca

SEQ ID NO: 177653 - RNA, 18 nt, Human
cuccccuuugugggcccc

SEQ ID NO: 177654 - RNA, 18 nt, Human
cuccccuuugugggcccc

SEQ ID NO: 177655 - RNA, 18 nt, Human
cuccgaggggcuaagagg

SEQ ID NO: 177656 - RNA, 24 nt, Human
cucuccgaggggcuaagagguaga

SEQ ID NO: 177657 - RNA, 23 nt, Human
cugccgcacccccguuagggccc

SEQ ID NO: 177658 - RNA, 21 nt, Human
cugcuccagccagguguggag

SEQ ID NO: 177659 - RNA, 20 nt, Human
cugcuccugccgcacccccg

SEQ ID NO: 177660 - RNA, 22 nt, Human
cugggagaaugugguucuccuc

SEQ ID NO: 177661 - RNA, 18 nt, Human
cugggugaugagcagccc

SEQ ID NO: 177662 - RNA, 18 nt, Human
cugggugaugagcagccc

SEQ ID NO: 177663 - RNA, 18 nt, Human
cuggucaagcuguuggag

SEQ ID NO: 177664 - RNA, 19 nt, Human
cuucccagagccugggccc

SEQ ID NO: 177665 - RNA, 21 nt, Human
gagaaagguggggggcuucca

SEQ ID NO: 177666 - RNA, 18 nt, Human
gagagaaaaggucucugg

SEQ ID NO: 177667 - RNA, 18 nt, Human
gagagaaaaggucucugg

SEQ ID NO: 177668 - RNA, 19 nt, Human
gagaugcuccugccugcug

SEQ ID NO: 177669 - RNA, 21 nt, Human
gagcaacucccuucugggaaa

SEQ ID NO: 177670 - RNA, 22 nt, Human
gagccagcgcuaugggagcuga

SEQ ID NO: 177671 - RNA, 22 nt, Human
gagccagcgcuaugggagcuga

SEQ ID NO: 177672 - RNA, 25 nt, Human
gagcugccugaggcuggcagcccag

SEQ ID NO: 177673 - RNA, 21 nt, Human
gaggccacagcaggauccaga

SEQ ID NO: 177674 - RNA, 21 nt, Human
gaggcuugggggcucugucuc

SEQ ID NO: 177675 - RNA, 21 nt, Human
gaggcuugggggcucugucuc

SEQ ID NO: 177676 - RNA, 24 nt, Human
gagguucagucacaguuuccuccu

SEQ ID NO: 177677 - RNA, 18 nt, Human
gcaagcauucccuucugg

SEQ ID NO: 177678 - RNA, 20 nt, Human
gcaugucauaugaugggguu

SEQ ID NO: 177679 - RNA, 21 nt, Human
gccgcacccccguuagggccc

SEQ ID NO: 177680 - RNA, 22 nt, Human
gccgcacccccguuagggcccu

SEQ ID NO: 177681 - RNA, 18 nt, Human
gccuccugccccgccagg

SEQ ID NO: 177682 - RNA, 19 nt, Human
gcucuguuccccagcggua

SEQ ID NO: 177683 - RNA, 19 nt, Human
ggagcccccucccauugcu

SEQ ID NO: 177684 - RNA, 19 nt, Human
ggagcccccucccauugcu

SEQ ID NO: 177685 - RNA, 23 nt, Human
ggagcugggaccccucagccuuc

SEQ ID NO: 177686 - RNA, 21 nt, Human
ggcaugucauaugaugggguu

SEQ ID NO: 177687 - RNA, 21 nt, Human
ggcaugucauaugaugggguu

SEQ ID NO: 177688 - RNA, 21 nt, Human
ggccuagcacaugcuguagcc

SEQ ID NO: 177689 - RNA, 24 nt, Human
ggcuaagagguagaugcuuuggga

SEQ ID NO: 177690 - RNA, 22 nt, Human
gggcaccccuucccagagccug

SEQ ID NO: 177691 - RNA, 20 nt, Human
ggggcuuccagagucucugu

SEQ ID NO: 177692 - RNA, 22 nt, Human
ggguccugacaaggccaggccu

SEQ ID NO: 177693 - RNA, 24 nt, Human
gugggccccuuggggcagaggcuu

SEQ ID NO: 177694 - RNA, 26 nt, Human
guuaacacaucugccagccaaggggc

SEQ ID NO: 177695 - RNA, 22 nt, Human
uagaugcuuugggaggcagaga

SEQ ID NO: 177696 - RNA, 22 nt, Human
uaugaugggguugucccuuggg

SEQ ID NO: 177697 - RNA, 22 nt, Human
uaugaugggguugucccuuggg

SEQ ID NO: 177698 - RNA, 20 nt, Human
ucagccuuccccaguaggcu

SEQ ID NO: 177699 - RNA, 21 nt, Human
ucaggcaagaaaauggccagg

SEQ ID NO: 177700 - RNA, 21 nt, Human
ucaggcaagaaaauggccagg

SEQ ID NO: 177701 - RNA, 21 nt, Human
ucagugggaaauguccucucc

SEQ ID NO: 177702 - RNA, 18 nt, Human
uccauggagcccccuccc

SEQ ID NO: 177703 - RNA, 18 nt, Human
uccauggagcccccuccc

SEQ ID NO: 177704 - RNA, 22 nt, Human
ucccagaaucacaagccacuca

SEQ ID NO: 177705 - RNA, 22 nt, Human
ucccagaaucacaagccacuca

SEQ ID NO: 177706 - RNA, 18 nt, Human
ucccagggaagugaggcc

SEQ ID NO: 177707 - RNA, 23 nt, Human
uccccacacaggaugaguuccca

SEQ ID NO: 177708 - RNA, 20 nt, Human
uccccagcgguauggcaggc

SEQ ID NO: 177709 - RNA, 18 nt, Human
uccccuuugugggccccu

SEQ ID NO: 177710 - RNA, 18 nt, Human
uccccuuugugggccccu

SEQ ID NO: 177711 - RNA, 20 nt, Human
ucccugcgcuugcggccacu

SEQ ID NO: 177712 - RNA, 24 nt, Human
ucccugcgcuugcggccacugcuc

SEQ ID NO: 177713 - RNA, 20 nt, Human
ucccugggagaaugugguuc

SEQ ID NO: 177714 - RNA, 20 nt, Human
ucccugggccucuugagccu

SEQ ID NO: 177715 - RNA, 20 nt, Human
ucccugggccucuugagccu

SEQ ID NO: 177716 - RNA, 20 nt, Human
uccugccugcugaggccuag

SEQ ID NO: 177717 - RNA, 23 nt, Human
uccugguuguguugagcuguggg

SEQ ID NO: 177718 - RNA, 22 nt, Human
ucggcauuuccugcuccagcca

SEQ ID NO: 177719 - RNA, 20 nt, Human
ucucccuucugugaccuggg

SEQ ID NO: 177720 - RNA, 20 nt, Human
ucuccucgggcugguuuggg

SEQ ID NO: 177721 - RNA, 18 nt, Human
ugagcagccccuggccug

SEQ ID NO: 177722 - RNA, 21 nt, Human
ugagccuggauguucuccagg

SEQ ID NO: 177723 - RNA, 21 nt, Human
ugaggccuagcacaugcugua

SEQ ID NO: 177724 - RNA, 19 nt, Human
ugccugaggcuggcagccc

SEQ ID NO: 177725 - RNA, 19 nt, Human
uggagagcugccugaggcu

SEQ ID NO: 177726 - RNA, 20 nt, Human
uggagagcugccugaggcug

SEQ ID NO: 177727 - RNA, 22 nt, Human
uggagccugggugcuguggggc

SEQ ID NO: 177728 - RNA, 20 nt, Human
uggcagagucaaggcugucu

SEQ ID NO: 177729 - RNA, 20 nt, Human
uggcaggcggccuggguccu

SEQ ID NO: 177730 - RNA, 20 nt, Human
uggcccaggucuaggucugg

SEQ ID NO: 177731 - RNA, 19 nt, Human
uggccugcccuuuuggccc

SEQ ID NO: 177732 - RNA, 25 nt, Human
uggccugcccuuuuggcccaggucu

SEQ ID NO: 177733 - RNA, 19 nt, Human
ugggaaauugauuccagcg

SEQ ID NO: 177734 - RNA, 18 nt, Human
uggggcagaggcuugggg

SEQ ID NO: 177735 - RNA, 18 nt, Human
uggggcagaggcuugggg

SEQ ID NO: 177736 - RNA, 19 nt, Human
uggggcagaggcuuggggg

SEQ ID NO: 177737 - RNA, 20 nt, Human
uggggcagaggcuugggggc

SEQ ID NO: 177738 - RNA, 28 nt, Human
uggggugugcugaaugcugaccacuggg

SEQ ID NO: 177739 - RNA, 28 nt, Human
uggggugugcugaaugcugaccacuggg

SEQ ID NO: 177740 - RNA, 22 nt, Human
ugucugggccuggcuccuugug

SEQ ID NO: 177741 - RNA, 18 nt, Human
uucauuguucuccaacga

SEQ ID NO: 177742 - RNA, 20 nt, Human
uugcugggcgcuuggguggc

SEQ ID NO: 177743 - RNA, 24 nt, Human
uuggggcagaggcuugggggcucu

SEQ ID NO: 177744 - RNA, 24 nt, Human
uuggggcagaggcuugggggcucu

SEQ ID NO: 177745 - RNA, 26 nt, Human
uugugggccccuuggggcagaggcuu

SEQ ID NO: 177746 - RNA, 26 nt, Human
uugugggccccuuggggcagaggcuu

SEQ ID NO: 177747 - RNA, 20 nt, Human
uuucauuguucuccaacgag

SEQ ID NO: 177748 - RNA, 23 nt, Human
uuugaguaauuaggcugcaggug

SEQ ID NO: 177749 - RNA, 24 nt, Human
aagugggcaggguugggccccuuu

SEQ ID NO: 177750 - RNA, 25 nt, Human
agcaagaacucucccccaaagugga

SEQ ID NO: 177751 - RNA, 18 nt, Human
cacacaaaccccucuggu

SEQ ID NO: 177752 - RNA, 21 nt, Human
cacuguuccuccugccucuuc

SEQ ID NO: 177753 - RNA, 25 nt, Human
caggguugggccccuuucacccacc

SEQ ID NO: 177754 - RNA, 18 nt, Human
cccuugggcgggcugggc

SEQ ID NO: 177755 - RNA, 25 nt, Human
ccuccugccucuucagccacacaaa

SEQ ID NO: 177756 - RNA, 24 nt, Human
cucccacauguucugcuggcacaa

SEQ ID NO: 177757 - RNA, 19 nt, Human
cuggaaacggggcuucuuc

SEQ ID NO: 177758 - RNA, 20 nt, Human
cuguuccuccugccucuuca

SEQ ID NO: 177759 - RNA, 29 nt, Human
ggcugggcugaagugggcaggguugggcc

SEQ ID NO: 177760 - RNA, 24 nt, Human
gggcaggguugggccccuuucacc

SEQ ID NO: 177761 - RNA, 21 nt, Human
guccccuugggcgggcugggc

SEQ ID NO: 177762 - RNA, 24 nt, Human
uacacuguuccuccugccucuuca

SEQ ID NO: 177763 - RNA, 28 nt, Human
uacccugggcugcggaugcccuggaaac

SEQ ID NO: 177764 - RNA, 24 nt, Human
ucgagagcaagaacucucccccaa

SEQ ID NO: 177765 - RNA, 22 nt, Human
ugaagugggcaggguugggccc

SEQ ID NO: 177766 - RNA, 24 nt, Human
uggaaacggggcuucuuccuccca

SEQ ID NO: 177767 - RNA, 22 nt, Human
ugggccccuuucacccacccag

SEQ ID NO: 177768 - RNA, 19 nt, Human
aaaagaaacaucauagaua

SEQ ID NO: 177769 - RNA, 20 nt, Human
aaaagaaacaucauagauaa

SEQ ID NO: 177770 - RNA, 23 nt, Human
aacaaaggaaaugacaaaggaaa

SEQ ID NO: 177771 - RNA, 28 nt, Human
aaugacaaaggaaaauuaacgagagaaa

SEQ ID NO: 177772 - RNA, 23 nt, Human
agaaaacaguacaguucuaucau

SEQ ID NO: 177773 - RNA, 20 nt, Human
aggaaaugacaaaggaaaag

SEQ ID NO: 177774 - RNA, 19 nt, Human
aggugcuagaaacccaaga

SEQ ID NO: 177775 - RNA, 20 nt, Human
aggugcuagaaacccaagau

SEQ ID NO: 177776 - RNA, 23 nt, Human
aguaagaauuuaaaaauguacaa

SEQ ID NO: 177777 - RNA, 19 nt, Human
caagauuacccuugaagca

SEQ ID NO: 177778 - RNA, 24 nt, Human
caauuaccaguacauuuacaaaac

SEQ ID NO: 177779 - RNA, 21 nt, Human
cacuggcccagaaaacaguac

SEQ ID NO: 177780 - RNA, 21 nt, Human
caggucccagguagucuuuaa

SEQ ID NO: 177781 - RNA, 18 nt, Human
cccaagauuacccuugaa

SEQ ID NO: 177782 - RNA, 20 nt, Human
cuccuccuccuccuccuccu

SEQ ID NO: 177783 - RNA, 20 nt, Human
cuccuccuccuccuccuccu

SEQ ID NO: 177784 - RNA, 20 nt, Human
cuccuccuccuccuccuccu

SEQ ID NO: 177785 - RNA, 21 nt, Human
cugacggcggucgcccgcuuc

SEQ ID NO: 177786 - RNA, 18 nt, Human
guacuguagccaguucgu

SEQ ID NO: 177787 - RNA, 23 nt, Human
uaaaagaacaaaaauuuacagua

SEQ ID NO: 177788 - RNA, 22 nt, Human
uagauaaggugcuagaaaccca

SEQ ID NO: 177789 - RNA, 21 nt, Human
uauguacauguacacuguaua

SEQ ID NO: 177790 - RNA, 24 nt, Human
uauuccaauugcaaaagaaacauc

SEQ ID NO: 177791 - RNA, 21 nt, Human
uccagaguaagaauuuaaaaa

SEQ ID NO: 177792 - RNA, 19 nt, Human
ucuggcucacuggcccaga

SEQ ID NO: 177793 - RNA, 21 nt, Human
ucuggcucacuggcccagaaa

SEQ ID NO: 177794 - RNA, 22 nt, Human
ugcaaaagaaacaucauagaua

SEQ ID NO: 177795 - RNA, 24 nt, Human
uggcucacuggcccagaaaacagu

SEQ ID NO: 177796 - RNA, 22 nt, Human
uuaauguagacaacaaaggaaa

SEQ ID NO: 177797 - RNA, 22 nt, Human
uucuggcucacuggcccagaaa

SEQ ID NO: 177798 - RNA, 19 nt, Human
uuggggcaaggugaccaag

SEQ ID NO: 177799 - RNA, 20 nt, Human
uuuuuuuucagaguucaaug

SEQ ID NO: 177800 - RNA, 22 nt, Human
uuuuuuuuuuuuuuuuuuucag

SEQ ID NO: 177801 - RNA, 19 nt, Human
aaaggaaaaauauauugca

SEQ ID NO: 177802 - RNA, 21 nt, Human
acaacauacugucaaauauga

SEQ ID NO: 177803 - RNA, 22 nt, Human
agccuggucugcgcucgggccc

SEQ ID NO: 177804 - RNA, 21 nt, Human
aggaaauuacagguaaguuau

SEQ ID NO: 177805 - RNA, 24 nt, Human
aggacgcggugcccgaggcccgag

SEQ ID NO: 177806 - RNA, 20 nt, Human
aggcccgagagagacccgag

SEQ ID NO: 177807 - RNA, 22 nt, Human
auuguaauuaaauugcuugguu

SEQ ID NO: 177808 - RNA, 22 nt, Human
caagauaaguauuuaaaacuug

SEQ ID NO: 177809 - RNA, 19 nt, Human
caccgguggcugcggcucc

SEQ ID NO: 177810 - RNA, 19 nt, Human
ccggcgccgcgcggcugga

SEQ ID NO: 177811 - RNA, 22 nt, Human
ccggcuccggcuacugcggccg

SEQ ID NO: 177812 - RNA, 24 nt, Human
ccggcuccggcuacugcggccgca

SEQ ID NO: 177813 - RNA, 18 nt, Human
cgggcccgagggaggccg

SEQ ID NO: 177814 - RNA, 19 nt, Human
cuggucugcgcucgggccc

SEQ ID NO: 177815 - RNA, 22 nt, Human
gacaggaaaaauaucuucuucc

SEQ ID NO: 177816 - RNA, 23 nt, Human
gcggcggcgggaaaggaaggcac

SEQ ID NO: 177817 - RNA, 20 nt, Human
gcgggaaaggaaggcaccgg

SEQ ID NO: 177818 - RNA, 19 nt, Human
gcugcgggcgggcgggcag

SEQ ID NO: 177819 - RNA, 23 nt, Human
ggcgggcgggcaggcaggcggcc

SEQ ID NO: 177820 - RNA, 18 nt, Human
ggcugcgggcgggcgggc

SEQ ID NO: 177821 - RNA, 19 nt, Human
gggcaggcaggcggccgcc

SEQ ID NO: 177822 - RNA, 19 nt, Human
gggcugcgggcgggcgggc

SEQ ID NO: 177823 - RNA, 18 nt, Human
ggggcugcgggcgggcgg

SEQ ID NO: 177824 - RNA, 21 nt, Human
gucugcgcucgggcccgaggg

SEQ ID NO: 177825 - RNA, 19 nt, Human
uaaggaaagcaauacagag

SEQ ID NO: 177826 - RNA, 23 nt, Human
uagaaaacaauaguuuaaggaaa

SEQ ID NO: 177827 - RNA, 22 nt, Human
uauaauaagaguuaagaagcaa

SEQ ID NO: 177828 - RNA, 20 nt, Human
uauacauuacccugauaccu

SEQ ID NO: 177829 - RNA, 27 nt, Human
uaucuaacaacaaauuuucuugauuua

SEQ ID NO: 177830 - RNA, 26 nt, Human
ucaaugacaggaaaaauaucuucuuc

SEQ ID NO: 177831 - RNA, 19 nt, Human
ugacaggaaaaauaucuuc

SEQ ID NO: 177832 - RNA, 23 nt, Human
ugccucaaugacaccauuuacag

SEQ ID NO: 177833 - RNA, 24 nt, Human
uuuaacaauuguaauuaaauugcu

SEQ ID NO: 177834 - RNA, 23 nt, Human
aaaaaaggacaggugcgccaggu

SEQ ID NO: 177835 - RNA, 19 nt, Human
aaaaggacaggugcgccag

SEQ ID NO: 177836 - RNA, 22 nt, Human
aaaaugcugugugaaauuuccc

SEQ ID NO: 177837 - RNA, 26 nt, Human
aaacaaucaaaauuacuuccugaagc

SEQ ID NO: 177838 - RNA, 19 nt, Human
agagacucacacuuuccuc

SEQ ID NO: 177839 - RNA, 18 nt, Human
aucaaaauuacuuccuga

SEQ ID NO: 177840 - RNA, 24 nt, Human
caacugaacuuuaccauugcuaga

SEQ ID NO: 177841 - RNA, 23 nt, Human
ccagaauccuugacuucuacucc

SEQ ID NO: 177842 - RNA, 27 nt, Human
ccugcaugcacacugcuauuauguccc

SEQ ID NO: 177843 - RNA, 21 nt, Human
cucccaacucaauaagagauc

SEQ ID NO: 177844 - RNA, 23 nt, Human
cuccugcuaauaagcuaagugaa

SEQ ID NO: 177845 - RNA, 26 nt, Human
cugcaugcacacugcuauuauguccc

SEQ ID NO: 177846 - RNA, 22 nt, Human
uaagcuaagugaacuuagguca

SEQ ID NO: 177847 - RNA, 23 nt, Human
uacaaugguaauccauuaaauac

SEQ ID NO: 177848 - RNA, 22 nt, Human
uacuaucuguguuucuuugcac

SEQ ID NO: 177849 - RNA, 19 nt, Human
uacucagaauuuuuacuac

SEQ ID NO: 177850 - RNA, 19 nt, Human
uagaauaagaaccagaauc

SEQ ID NO: 177851 - RNA, 21 nt, Human
uagaauaagaaccagaauccu

SEQ ID NO: 177852 - RNA, 21 nt, Human
ucccugccuccugccugcaug

SEQ ID NO: 177853 - RNA, 22 nt, Human
ucugaaaaauagaagaaaaaag

SEQ ID NO: 177854 - RNA, 24 nt, Human
ucugaaaccuaaucagaaaaaaaa

SEQ ID NO: 177855 - RNA, 19 nt, Human
ugaaaagguuaggaaacua

SEQ ID NO: 177856 - RNA, 25 nt, Human
ugccugcaugcacacugcuauuaug

SEQ ID NO: 177857 - RNA, 20 nt, Human
uggcagccucuagggaugug

SEQ ID NO: 177858 - RNA, 20 nt, Human
ugggaaaaguccuagaauag

SEQ ID NO: 177859 - RNA, 18 nt, Human
uguaaaaauuucuuccug

SEQ ID NO: 177860 - RNA, 21 nt, Human
uguuaggcugucucuguuaug

SEQ ID NO: 177861 - RNA, 19 nt, Human
uuccugaagcuauuuuggc

SEQ ID NO: 177862 - RNA, 21 nt, Human
uuggcagccucuagggaugug

SEQ ID NO: 177863 - RNA, 23 nt, Human
uuguagccaguuucaaaaugcug

SEQ ID NO: 177864 - RNA, 18 nt, Human
uuuuuuuuuuuaagcaaa

SEQ ID NO: 177865 - RNA, 19 nt, Human
aaacagcuccugggcugcc

SEQ ID NO: 177866 - RNA, 24 nt, Human
aaaccagagcucaagcacaggaga

SEQ ID NO: 177867 - RNA, 22 nt, Human
aauuuucaguuguguguggguu

SEQ ID NO: 177868 - RNA, 24 nt, Human
acaggaaaaggugagagauggagg

SEQ ID NO: 177869 - RNA, 22 nt, Human
agagauggaggaggcaauuuuc

SEQ ID NO: 177870 - RNA, 24 nt, Human
agcacaggagaagaggaacccaca

SEQ ID NO: 177871 - RNA, 24 nt, Human
agcuucauguuuaauggguggaga

SEQ ID NO: 177872 - RNA, 20 nt, Human
aucuuccaagcuccccauug

SEQ ID NO: 177873 - RNA, 22 nt, Human
auguauuuucaaaaaugaaaac

SEQ ID NO: 177874 - RNA, 21 nt, Human
caaacagcuccugggcugcca

SEQ ID NO: 177875 - RNA, 19 nt, Human
caaaccuauaccccucccc

SEQ ID NO: 177876 - RNA, 19 nt, Human
caauauugaaaagccaagc

SEQ ID NO: 177877 - RNA, 21 nt, Human
cacaauauugaaaagccaagc

SEQ ID NO: 177878 - RNA, 21 nt, Human
cagcuccugggcugccauuug

SEQ ID NO: 177879 - RNA, 23 nt, Human
cagcuccugggcugccauuugcu

SEQ ID NO: 177880 - RNA, 19 nt, Human
caggaaaaggugagagaug

SEQ ID NO: 177881 - RNA, 19 nt, Human
cauuuucaucugacagggg

SEQ ID NO: 177882 - RNA, 18 nt, Human
cccacagucugacccugc

SEQ ID NO: 177883 - RNA, 21 nt, Human
cccacagucugacccugcuau

SEQ ID NO: 177884 - RNA, 18 nt, Human
cccacucgggauauagga

SEQ ID NO: 177885 - RNA, 18 nt, Human
cccuccccagacuuggga

SEQ ID NO: 177886 - RNA, 25 nt, Human
ccuauaccccuccccagacuuggga

SEQ ID NO: 177887 - RNA, 21 nt, Human
cucacaauauugaaaagccaa

SEQ ID NO: 177888 - RNA, 22 nt, Human
cucuuucaaacagccuuucaaa

SEQ ID NO: 177889 - RNA, 23 nt, Human
cuuuauuaaacauuccucuuuca

SEQ ID NO: 177890 - RNA, 19 nt, Human
gaacccacagucugacccu

SEQ ID NO: 177891 - RNA, 23 nt, Human
gcagagauccaccgucugugccc

SEQ ID NO: 177892 - RNA, 21 nt, Human
gcuucauguuuaaugggugga

SEQ ID NO: 177893 - RNA, 25 nt, Human
ggguggagauuuuuaaaaaucuguu

SEQ ID NO: 177894 - RNA, 20 nt, Human
ggguuugauuuaaggcuuug

SEQ ID NO: 177895 - RNA, 21 nt, Human
gguuugauuuaaggcuuuggc

SEQ ID NO: 177896 - RNA, 21 nt, Human
guggagcggcaaugcugcugc

SEQ ID NO: 177897 - RNA, 21 nt, Human
uaaacuggacaaacagcuccu

SEQ ID NO: 177898 - RNA, 23 nt, Human
uaaacuggacaaacagcuccugg

SEQ ID NO: 177899 - RNA, 20 nt, Human
uaggaaaaagguugguagcg

SEQ ID NO: 177900 - RNA, 23 nt, Human
ucaaaccuauaccccuccccaga

SEQ ID NO: 177901 - RNA, 18 nt, Human
uccccagacuugggaacu

SEQ ID NO: 177902 - RNA, 24 nt, Human
ucuuccaagcuccccauuggaaca

SEQ ID NO: 177903 - RNA, 20 nt, Human
ugcuaaacuggacaaacagc

SEQ ID NO: 177904 - RNA, 20 nt, Human
ugcugaggcgcaugcgugug

SEQ ID NO: 177905 - RNA, 22 nt, Human
uucaaaaaugaaaacauugagc

SEQ ID NO: 177906 - RNA, 25 nt, Human
uucagaccucacaauauugaaaagc

SEQ ID NO: 177907 - RNA, 18 nt, Human
uugguagcgccagcucuc

SEQ ID NO: 177908 - RNA, 18 nt, Human
acgccgggcccccuccgg

SEQ ID NO: 177909 - RNA, 20 nt, Human
ccccuccggcuccggaagcu

SEQ ID NO: 177910 - RNA, 18 nt, Human
ccccugcgggugagguag

SEQ ID NO: 177911 - RNA, 23 nt, Human
ccuccggcuccggaagcuggacg

SEQ ID NO: 177912 - RNA, 27 nt, Human
gccgggcccccuccggcuccggaagcu

SEQ ID NO: 177913 - RNA, 24 nt, Human
ggagggauaggguuuggggaggga

SEQ ID NO: 177914 - RNA, 21 nt, Human
gggauaggguuuggggaggga

SEQ ID NO: 177915 - RNA, 21 nt, Human
ggggcuggguacgccgggccc

SEQ ID NO: 177916 - RNA, 18 nt, Human
guuuggggagggaacagg

SEQ ID NO: 177917 - RNA, 20 nt, Human
uacgccgggcccccuccggc

SEQ ID NO: 177918 - RNA, 20 nt, Human
uacgccgggcccccuccggc

SEQ ID NO: 177919 - RNA, 20 nt, Human
ucccuccuucccccugcggg

SEQ ID NO: 177920 - RNA, 18 nt, Human
uccggcuccggaagcugg

SEQ ID NO: 177921 - RNA, 18 nt, Human
ugagguaggagggauagg

SEQ ID NO: 177922 - RNA, 22 nt, Human
uggacgcucaccucggcucccc

SEQ ID NO: 177923 - RNA, 22 nt, Human
aaccccugaagccaucacucaa

SEQ ID NO: 177924 - RNA, 19 nt, Human
aagcucuuggggaccaggc

SEQ ID NO: 177925 - RNA, 18 nt, Human
acagaacagugcuggaca

SEQ ID NO: 177926 - RNA, 23 nt, Human
acagagcugcacgcuugggggug

SEQ ID NO: 177927 - RNA, 20 nt, Human
acagugcuggacaaggcaug

SEQ ID NO: 177928 - RNA, 18 nt, Human
accacggcugggcaaggu

SEQ ID NO: 177929 - RNA, 21 nt, Human
agaacagugcuggacaaggca

SEQ ID NO: 177930 - RNA, 20 nt, Human
agaauccgagguggagacau

SEQ ID NO: 177931 - RNA, 22 nt, Human
agaauccgagguggagacauuc

SEQ ID NO: 177932 - RNA, 19 nt, Human
agggcugcggcccaaagau

SEQ ID NO: 177933 - RNA, 20 nt, Human
caaccccugaagccaucacu

SEQ ID NO: 177934 - RNA, 24 nt, Human
cacacacagugaaggcugggacag

SEQ ID NO: 177935 - RNA, 20 nt, Human
cagagaaauaaaaagcuuua

SEQ ID NO: 177936 - RNA, 18 nt, Human
caggaauccaagccucca

SEQ ID NO: 177937 - RNA, 24 nt, Human
caggaauccaagccuccaaagcuc

SEQ ID NO: 177938 - RNA, 21 nt, Human
caguuugggcugaacuuccaa

SEQ ID NO: 177939 - RNA, 21 nt, Human
caucacucaagcuaaaaugag

SEQ ID NO: 177940 - RNA, 21 nt, Human
cauggcccccuucaguuuggg

SEQ ID NO: 177941 - RNA, 18 nt, Human
ccaagccuccaaagcucu

SEQ ID NO: 177942 - RNA, 20 nt, Human
ccaccacggcugggcaaggu

SEQ ID NO: 177943 - RNA, 23 nt, Human
ccccaacccaggagaccucucac

SEQ ID NO: 177944 - RNA, 21 nt, Human
ccucucacacacagugaaggc

SEQ ID NO: 177945 - RNA, 19 nt, Human
ccugggggccaccacggcu

SEQ ID NO: 177946 - RNA, 23 nt, Human
cuggacaaggcauggcccccuuc

SEQ ID NO: 177947 - RNA, 19 nt, Human
gaaugguccccauaccccc

SEQ ID NO: 177948 - RNA, 24 nt, Human
gaaugguccccauaccccccaccc

SEQ ID NO: 177949 - RNA, 22 nt, Human
gagcaguucugguccucaggga

SEQ ID NO: 177950 - RNA, 21 nt, Human
gaggacccuuggcuggagugu

SEQ ID NO: 177951 - RNA, 20 nt, Human
gccaucacucaagcuaaaau

SEQ ID NO: 177952 - RNA, 19 nt, Human
ggaccaggccugggggcca

SEQ ID NO: 177953 - RNA, 18 nt, Human
ggccucccccgcagcgga

SEQ ID NO: 177954 - RNA, 19 nt, Human
ggccucccccgcagcggag

SEQ ID NO: 177955 - RNA, 19 nt, Human
ggcugaacuuccaaccccu

SEQ ID NO: 177956 - RNA, 21 nt, Human
gguggagacauuccaggucag

SEQ ID NO: 177957 - RNA, 20 nt, Human
uaaaaugagcaguucugguc

SEQ ID NO: 177958 - RNA, 21 nt, Human
uaaaaugagcaguucuggucc

SEQ ID NO: 177959 - RNA, 21 nt, Human
ucacucaagcuaaaaugagca

SEQ ID NO: 177960 - RNA, 24 nt, Human
ucagggcugcggcccaaagauggg

SEQ ID NO: 177961 - RNA, 18 nt, Human
uccagaaagagcugcagg

SEQ ID NO: 177962 - RNA, 20 nt, Human
uccccauaccccccaccccu

SEQ ID NO: 177963 - RNA, 22 nt, Human
ugaaggcugggacagagcugca

SEQ ID NO: 177964 - RNA, 21 nt, Human
ugaaugguccccauacccccc

SEQ ID NO: 177965 - RNA, 22 nt, Human
ugaaugguccccauacccccca

SEQ ID NO: 177966 - RNA, 20 nt, Human
ugacagaacagugcuggaca

SEQ ID NO: 177967 - RNA, 19 nt, Human
ugccagggaaugaaugguc

SEQ ID NO: 177968 - RNA, 24 nt, Human
ugccugaagguccagaaagagcug

SEQ ID NO: 177969 - RNA, 18 nt, Human
uggagugucucaagcuga

SEQ ID NO: 177970 - RNA, 19 nt, Human
ugggacagagcugcacgcu

SEQ ID NO: 177971 - RNA, 22 nt, Human
ugggacagagcugcacgcuugg

SEQ ID NO: 177972 - RNA, 22 nt, Human
ugggcugaacuuccaaccccug

SEQ ID NO: 177973 - RNA, 23 nt, Human
ugggggagacugacagaacagug

SEQ ID NO: 177974 - RNA, 19 nt, Human
aaaguaaggaaagucugaa

SEQ ID NO: 177975 - RNA, 20 nt, Human
acacuacacaguacaguauu

SEQ ID NO: 177976 - RNA, 23 nt, Human
accagaaaaauggucacauuuaa

SEQ ID NO: 177977 - RNA, 19 nt, Human
agaugaacauuuaaugcua

SEQ ID NO: 177978 - RNA, 24 nt, Human
cacaguacaguauuagagcagaau

SEQ ID NO: 177979 - RNA, 21 nt, Human
cacauuuaaaauucucaaaau

SEQ ID NO: 177980 - RNA, 19 nt, Human
caggugacauccugccccc

SEQ ID NO: 177981 - RNA, 19 nt, Human
cauccugccccauucugag

SEQ ID NO: 177982 - RNA, 26 nt, Human
cauccugccccauucugagcacuuca

SEQ ID NO: 177983 - RNA, 24 nt, Human
cauuuugcuaagucccugagcacu

SEQ ID NO: 177984 - RNA, 24 nt, Human
ccucaaggcuaccuuuacuccucc

SEQ ID NO: 177985 - RNA, 20 nt, Human
cuuuaugcaucggccucuuc

SEQ ID NO: 177986 - RNA, 22 nt, Human
gauuuucccuccgucguggccu

SEQ ID NO: 177987 - RNA, 18 nt, Human
gccucuuccccagccacc

SEQ ID NO: 177988 - RNA, 23 nt, Human
gccucuuccccagccacccuggu

SEQ ID NO: 177989 - RNA, 24 nt, Human
ggccucuuccccagccacccuggu

SEQ ID NO: 177990 - RNA, 20 nt, Human
gugaagggcagucuucuaug

SEQ ID NO: 177991 - RNA, 24 nt, Human
guggccuugaagguugucaguuug

SEQ ID NO: 177992 - RNA, 26 nt, Human
guuuuguguauccuucuucuuguuca

SEQ ID NO: 177993 - RNA, 24 nt, Human
uaaauuauuuacaaaaaucauuua

SEQ ID NO: 177994 - RNA, 21 nt, Human
uaacugugcucugcagaaacc

SEQ ID NO: 177995 - RNA, 25 nt, Human
uagagcagaauauaaauuauuuaca

SEQ ID NO: 177996 - RNA, 20 nt, Human
uccacaaugccuugcuaccu

SEQ ID NO: 177997 - RNA, 22 nt, Human
uccacaaugccuugcuaccugc

SEQ ID NO: 177998 - RNA, 22 nt, Human
ucccugagcacuuugaacaggc

SEQ ID NO: 177999 - RNA, 21 nt, Human
uccucccacuauuaacucuag

SEQ ID NO: 178000 - RNA, 21 nt, Human
ucuacuagagucccugcccca

SEQ ID NO: 178001 - RNA, 19 nt, Human
ugauuccaggugacauccu

SEQ ID NO: 178002 - RNA, 18 nt, Human
ugcucuggccucaaggcu

SEQ ID NO: 178003 - RNA, 19 nt, Human
uuccaggugacauccugcc

SEQ ID NO: 178004 - RNA, 23 nt, Human
uucucugacaagaagaucuacua

SEQ ID NO: 178005 - RNA, 23 nt, Human
uugaagguugucaguuugcauuu

SEQ ID NO: 178006 - RNA, 27 nt, Human
uugaagguugucaguuugcauuuaauc

SEQ ID NO: 178007 - RNA, 19 nt, Human
uuguguauccuucuucuug

SEQ ID NO: 178008 - RNA, 21 nt, Human
uuuccacaaugccuugcuacc

SEQ ID NO: 178009 - RNA, 19 nt, Human
aacaggcuccucuucccag

SEQ ID NO: 178010 - RNA, 21 nt, Human
acaaaaacaggcuccucuucc

SEQ ID NO: 178011 - RNA, 24 nt, Human
acagccagaucccgccucucucaa

SEQ ID NO: 178012 - RNA, 22 nt, Human
agcaagacuaaaauuggccaaa

SEQ ID NO: 178013 - RNA, 22 nt, Human
agguguuauaaaagauuccuuc

SEQ ID NO: 178014 - RNA, 23 nt, Human
auaaaagaaagccucauccaucc

SEQ ID NO: 178015 - RNA, 18 nt, Human
auuuugcaacauacucca

SEQ ID NO: 178016 - RNA, 19 nt, Human
caagacuaaaauuggccaa

SEQ ID NO: 178017 - RNA, 24 nt, Human
caaggauccacagccuggccucuc

SEQ ID NO: 178018 - RNA, 18 nt, Human
cacaagugacaucucaaa

SEQ ID NO: 178019 - RNA, 22 nt, Human
cacagccuggccucucagcucu

SEQ ID NO: 178020 - RNA, 23 nt, Human
caccccacuguuuuucaaaacaa

SEQ ID NO: 178021 - RNA, 18 nt, Human
cagcaagacuaaaauugg

SEQ ID NO: 178022 - RNA, 19 nt, Human
caggaaacgugacacaagu

SEQ ID NO: 178023 - RNA, 21 nt, Human
caucaagaaacagcaagacua

SEQ ID NO: 178024 - RNA, 24 nt, Human
caucaagaaacagcaagacuaaaa

SEQ ID NO: 178025 - RNA, 19 nt, Human
caugccacccccgcccccu

SEQ ID NO: 178026 - RNA, 22 nt, Human
cccaccccacuguuuuucaaaa

SEQ ID NO: 178027 - RNA, 20 nt, Human
cccacgggauagaaaauagc

SEQ ID NO: 178028 - RNA, 24 nt, Human
cccacuguuuuucaaaacaagagc

SEQ ID NO: 178029 - RNA, 18 nt, Human
cccgagaguccagcugcu

SEQ ID NO: 178030 - RNA, 21 nt, Human
cccguggcagguugcugaagc

SEQ ID NO: 178031 - RNA, 20 nt, Human
cccuccucccucugccuccc

SEQ ID NO: 178032 - RNA, 18 nt, Human
cucauccaucccagcucc

SEQ ID NO: 178033 - RNA, 23 nt, Human
cugaagcuauaaacgugguccug

SEQ ID NO: 178034 - RNA, 18 nt, Human
cuggccucucagcucuuc

SEQ ID NO: 178035 - RNA, 26 nt, Human
cuguaagucuuuuuuccaaacucacu

SEQ ID NO: 178036 - RNA, 19 nt, Human
cuuccugcuaguccccuag

SEQ ID NO: 178037 - RNA, 20 nt, Human
gccucauccaucccagcucc

SEQ ID NO: 178038 - RNA, 22 nt, Human
gcucuggcaggcgugccgcuuc

SEQ ID NO: 178039 - RNA, 24 nt, Human
ggccccaccccacuguuuuucaaa

SEQ ID NO: 178040 - RNA, 23 nt, Human
gguuaacauuacgaaggcaaaag

SEQ ID NO: 178041 - RNA, 18 nt, Human
guagccagguccugaagc

SEQ ID NO: 178042 - RNA, 22 nt, Human
uaaacuaauauagaggugagca

SEQ ID NO: 178043 - RNA, 19 nt, Human
uacagccagaucccgccuc

SEQ ID NO: 178044 - RNA, 18 nt, Human
uacguagccagguccuga

SEQ ID NO: 178045 - RNA, 19 nt, Human
uacugccauucagggaaug

SEQ ID NO: 178046 - RNA, 18 nt, Human
uagaaaauagcuucuguu

SEQ ID NO: 178047 - RNA, 20 nt, Human
ucaagagaccgucaaaaucu

SEQ ID NO: 178048 - RNA, 21 nt, Human
ucaucccgagaguccagcugc

SEQ ID NO: 178049 - RNA, 21 nt, Human
uccaaacucacucguuucucu

SEQ ID NO: 178050 - RNA, 21 nt, Human
ucccuccucccucugccuccc

SEQ ID NO: 178051 - RNA, 24 nt, Human
ucucuuguuguucguggcaaggau

SEQ ID NO: 178052 - RNA, 18 nt, Human
ugaaagccagaguugaag

SEQ ID NO: 178053 - RNA, 23 nt, Human
ugaagcccagccuucccuccucc

SEQ ID NO: 178054 - RNA, 22 nt, Human
ugaagugaugagcucuggcagg

SEQ ID NO: 178055 - RNA, 19 nt, Human
ugagcaucaagaaacagca

SEQ ID NO: 178056 - RNA, 22 nt, Human
ugagcgcagugaaagccagagu

SEQ ID NO: 178057 - RNA, 20 nt, Human
uggcaggcgugccgcuuccu

SEQ ID NO: 178058 - RNA, 18 nt, Human
uggccucucagcucuucc

SEQ ID NO: 178059 - RNA, 22 nt, Human
ugucugguugagcacaguggug

SEQ ID NO: 178060 - RNA, 18 nt, Human
uucccaugccacccccgc

SEQ ID NO: 178061 - RNA, 24 nt, Human
uuucaucccgagaguccagcugcu

SEQ ID NO: 178062 - RNA, 19 nt, Human
uuuuuggccccaccccacu

SEQ ID NO: 178063 - RNA, 19 nt, Human
aacaguuucaggcuccucu

SEQ ID NO: 178064 - RNA, 21 nt, Human
aaggaaguucucuuuccauca

SEQ ID NO: 178065 - RNA, 21 nt, Human
caaaugugaacaaccaugucc

SEQ ID NO: 178066 - RNA, 24 nt, Human
cacaauccuuuaguagcuucucuc

SEQ ID NO: 178067 - RNA, 26 nt, Human
cagaauggaaaagcuaccagcaggca

SEQ ID NO: 178068 - RNA, 20 nt, Human
cagcaaaugugaacaaccau

SEQ ID NO: 178069 - RNA, 24 nt, Human
cagcagguggcuccaucacucucc

SEQ ID NO: 178070 - RNA, 21 nt, Human
cagcauucacccaggcagcaa

SEQ ID NO: 178071 - RNA, 21 nt, Human
caggcuccucuuuaauaucug

SEQ ID NO: 178072 - RNA, 20 nt, Human
ccagagaaaucaugcagaaa

SEQ ID NO: 178073 - RNA, 22 nt, Human
ccagagaaaucaugcagaaaca

SEQ ID NO: 178074 - RNA, 19 nt, Human
cccacacugucccagcaag

SEQ ID NO: 178075 - RNA, 18 nt, Human
ccccugaucuucuaaccc

SEQ ID NO: 178076 - RNA, 22 nt, Human
cccuccuucacucucccuauca

SEQ ID NO: 178077 - RNA, 18 nt, Human
ccuaaaggaugccacgaa

SEQ ID NO: 178078 - RNA, 23 nt, Human
ccuccuucacucucccuaucaca

SEQ ID NO: 178079 - RNA, 19 nt, Human
ccuuuaguagcuucucucc

SEQ ID NO: 178080 - RNA, 20 nt, Human
gaagguggaggaggacacaa

SEQ ID NO: 178081 - RNA, 21 nt, Human
gcccuggucucccacccacac

SEQ ID NO: 178082 - RNA, 22 nt, Human
ggagacagguggagaccgagca

SEQ ID NO: 178083 - RNA, 20 nt, Human
gggcagcagguggcuccauc

SEQ ID NO: 178084 - RNA, 19 nt, Human
guaagacagcaagcccaga

SEQ ID NO: 178085 - RNA, 21 nt, Human
gugaagacuggcgguguuccg

SEQ ID NO: 178086 - RNA, 18 nt, Human
uaggggugagagaacaag

SEQ ID NO: 178087 - RNA, 20 nt, Human
uaguagcuucucuccugcuu

SEQ ID NO: 178088 - RNA, 21 nt, Human
ucaugcagaaacauucucaag

SEQ ID NO: 178089 - RNA, 25 nt, Human
uccaagugaagacuggcgguguucc

SEQ ID NO: 178090 - RNA, 19 nt, Human
uccacagaauggaaaagcu

SEQ ID NO: 178091 - RNA, 22 nt, Human
uccacagaauggaaaagcuacc

SEQ ID NO: 178092 - RNA, 18 nt, Human
ucccacccacacuguccc

SEQ ID NO: 178093 - RNA, 21 nt, Human
ucucagguaagacagcaagcc

SEQ ID NO: 178094 - RNA, 24 nt, Human
ucuccugcuuagggaugaucucuu

SEQ ID NO: 178095 - RNA, 20 nt, Human
ugaaaucaagugcucuacca

SEQ ID NO: 178096 - RNA, 18 nt, Human
ugagagaacaagcagcau

SEQ ID NO: 178097 - RNA, 25 nt, Human
ugcucuaccacauaucccuccuuca

SEQ ID NO: 178098 - RNA, 21 nt, Human
uggcgguguuccguggcagca

SEQ ID NO: 178099 - RNA, 27 nt, Human
uuaacaguacagaaggaaguucucuuu

SEQ ID NO: 178100 - RNA, 22 nt, Human
uuaguagcuucucuccugcuua

SEQ ID NO: 178101 - RNA, 21 nt, Human
uuagugagaaaguuaguggag

SEQ ID NO: 178102 - RNA, 21 nt, Human
uuccaucaaaguucuccucca

SEQ ID NO: 178103 - RNA, 19 nt, Human
uuguacaugcucuugcccc

SEQ ID NO: 178104 - RNA, 20 nt, Human
agcaaggagacaccugagaa

SEQ ID NO: 178105 - RNA, 20 nt, Human
agccagaguggcaugagugu

SEQ ID NO: 178106 - RNA, 18 nt, Human
aggcggcaguggagcccg

SEQ ID NO: 178107 - RNA, 22 nt, Human
ccggcucccgccucucgcccug

SEQ ID NO: 178108 - RNA, 18 nt, Human
cgguuagcgacaccugcc

SEQ ID NO: 178109 - RNA, 22 nt, Human
gagaggcggcaguggagcccgg

SEQ ID NO: 178110 - RNA, 19 nt, Human
gagcucggagaggcggcag

SEQ ID NO: 178111 - RNA, 22 nt, Human
gagugucuuggcuccccuccuc

SEQ ID NO: 178112 - RNA, 18 nt, Human
gcggcaguggagcccggg

SEQ ID NO: 178113 - RNA, 18 nt, Human
gcggcaguggagcccggg

SEQ ID NO: 178114 - RNA, 24 nt, Human
ggagaggcggcaguggagcccggg

SEQ ID NO: 178115 - RNA, 20 nt, Human
ggcaguggagcccggguccu

SEQ ID NO: 178116 - RNA, 24 nt, Human
ucuuggcuccccuccucucccucc

SEQ ID NO: 178117 - RNA, 19 nt, Human
ugacagcaaggagacaccu

SEQ ID NO: 178118 - RNA, 23 nt, Human
ugagguccgcgucacaagagcuc

SEQ ID NO: 178119 - RNA, 21 nt, Human
uggcuccccuccucucccucc

SEQ ID NO: 178120 - RNA, 21 nt, Human
ugguauccaaggggcuggggg

SEQ ID NO: 178121 - RNA, 25 nt, Human
uuuuuuuuuuuuuuuuuuguuuuuu

SEQ ID NO: 178122 - RNA, 27 nt, Human
uuuuuuuuuuuuuuuuuuuuuuugggg

SEQ ID NO: 178123 - RNA, 19 nt, Human
aaaaccucuucacuuccag

SEQ ID NO: 178124 - RNA, 19 nt, Human
aagcaacaaaaccucuuca

SEQ ID NO: 178125 - RNA, 24 nt, Human
aaucauaggauauugugaaaaaga

SEQ ID NO: 178126 - RNA, 24 nt, Human
agcaaaugcaguguaucgcaaaau

SEQ ID NO: 178127 - RNA, 20 nt, Human
cacuguacaagcaacaaaac

SEQ ID NO: 178128 - RNA, 19 nt, Human
caguaguuuuuuuuucccc

SEQ ID NO: 178129 - RNA, 25 nt, Human
cucuucacuuccaguuauuuccaau

SEQ ID NO: 178130 - RNA, 21 nt, Human
cugacacuguacaagcaacaa

SEQ ID NO: 178131 - RNA, 23 nt, Human
cugacacuguacaagcaacaaaa

SEQ ID NO: 178132 - RNA, 22 nt, Human
gugaaaaagacgcauauuauau

SEQ ID NO: 178133 - RNA, 19 nt, Human
uaaaaauagcaccagcaaa

SEQ ID NO: 178134 - RNA, 24 nt, Human
uaacaguaguuuuuuuuuccccau

SEQ ID NO: 178135 - RNA, 30 nt, Human
uagcaccagcaaaugcaguguaucgcaaaa

SEQ ID NO: 178136 - RNA, 19 nt, Human
uaguuuuuuuuuccccauc

SEQ ID NO: 178137 - RNA, 21 nt, Human
ucgguaauacuaaaaguuucu

SEQ ID NO: 178138 - RNA, 24 nt, Human
ucuauccaccacuaauuuaagaca

SEQ ID NO: 178139 - RNA, 23 nt, Human
ucuuucauuagcaguguuaacag

SEQ ID NO: 178140 - RNA, 20 nt, Human
ugacacuguacaagcaacaa

SEQ ID NO: 178141 - RNA, 24 nt, Human
uuaaagggcauuuucuuucauuag

SEQ ID NO: 178142 - RNA, 22 nt, Human
uuaagacaacucugcuggcuug

SEQ ID NO: 178143 - RNA, 28 nt, Human
uuagcaguguuaacaguaguuuuuuuuu

SEQ ID NO: 178144 - RNA, 18 nt, Human
agcgcagcgcgggucugc

SEQ ID NO: 178145 - RNA, 20 nt, Human
cgaggagggcgcacgcggcg

SEQ ID NO: 178146 - RNA, 23 nt, Human
cucugcagcugcgggcggcugcc

SEQ ID NO: 178147 - RNA, 22 nt, Human
ggagcgcagcgcgggucugcug

SEQ ID NO: 178148 - RNA, 19 nt, Human
uaacuagacacagaaaggg

SEQ ID NO: 178149 - RNA, 27 nt, Human
uccuucgaacuauuugucaagugaaua

SEQ ID NO: 178150 - RNA, 19 nt, Human
aacccucccaggcuuuccu

SEQ ID NO: 178151 - RNA, 21 nt, Human
aagccaugccccuccaacugg

SEQ ID NO: 178152 - RNA, 22 nt, Human
acccucccaggcuuuccuguug

SEQ ID NO: 178153 - RNA, 19 nt, Human
acuauggauuauuuuuccc

SEQ ID NO: 178154 - RNA, 20 nt, Human
caacccucccaggcuuuccu

SEQ ID NO: 178155 - RNA, 18 nt, Human
caaggguuuuggagcgag

SEQ ID NO: 178156 - RNA, 23 nt, Human
caccuccuugcaucccaacaacc

SEQ ID NO: 178157 - RNA, 19 nt, Human
caggcucccuuuccuccuc

SEQ ID NO: 178158 - RNA, 23 nt, Human
caucccaacaacccucccaggcu

SEQ ID NO: 178159 - RNA, 18 nt, Human
cauuuccuuagccuuccc

SEQ ID NO: 178160 - RNA, 23 nt, Human
ccaacaacccucccaggcuuucc

SEQ ID NO: 178161 - RNA, 19 nt, Human
ccagcacccacucucaccc

SEQ ID NO: 178162 - RNA, 20 nt, Human
cccaacaacccucccaggcu

SEQ ID NO: 178163 - RNA, 20 nt, Human
cccccugucuccuuuucauc

SEQ ID NO: 178164 - RNA, 24 nt, Human
ccucuacuccccaaggguuuugga

SEQ ID NO: 178165 - RNA, 18 nt, Human
ccugccuccccagccccg

SEQ ID NO: 178166 - RNA, 19 nt, Human
cgggcacggggaggagcug

SEQ ID NO: 178167 - RNA, 21 nt, Human
cucccaggcuuuccuguugug

SEQ ID NO: 178168 - RNA, 18 nt, Human
cuccuucccucuacuccc

SEQ ID NO: 178169 - RNA, 26 nt, Human
cuccuuuucaucaccuccuugcaucc

SEQ ID NO: 178170 - RNA, 19 nt, Human
cucugaaggaaccguccug

SEQ ID NO: 178171 - RNA, 23 nt, Human
cuggcucacugcuguuguuuucu

SEQ ID NO: 178172 - RNA, 21 nt, Human
gaccugcccgccugugcuccu

SEQ ID NO: 178173 - RNA, 18 nt, Human
gccaugccccuccaacug

SEQ ID NO: 178174 - RNA, 21 nt, Human
ggagcugggaaggagcgggcc

SEQ ID NO: 178175 - RNA, 20 nt, Human
gggagggagagcaggcuccc

SEQ ID NO: 178176 - RNA, 18 nt, Human
ggguguggggagggagag

SEQ ID NO: 178177 - RNA, 18 nt, Human
guggagccccuuuggccu

SEQ ID NO: 178178 - RNA, 23 nt, Human
guguaugcuuuggguggggugug

SEQ ID NO: 178179 - RNA, 19 nt, Human
uaacuuccaucagucucug

SEQ ID NO: 178180 - RNA, 20 nt, Human
ucccaacaacccucccaggc

SEQ ID NO: 178181 - RNA, 21 nt, Human
ucccccugucuccuuuucauc

SEQ ID NO: 178182 - RNA, 22 nt, Human
uccucuggcucacugcuguugu

SEQ ID NO: 178183 - RNA, 22 nt, Human
ucucacccgcugccgggcugga

SEQ ID NO: 178184 - RNA, 22 nt, Human
ugcccgccugugcuccucuggc

SEQ ID NO: 178185 - RNA, 28 nt, Human
ugcccgccugugcuccucuggcucacug

SEQ ID NO: 178186 - RNA, 24 nt, Human
ugcuguuugcucugaaggaaccgu

SEQ ID NO: 178187 - RNA, 27 nt, Human
ugggaaggagcgggccggcaucucccu

SEQ ID NO: 178188 - RNA, 19 nt, Human
uggggagggagagcaggcu

SEQ ID NO: 178189 - RNA, 18 nt, Human
ugggguguggggagggag

SEQ ID NO: 178190 - RNA, 21 nt, Human
ugggugggguguggggaggga

SEQ ID NO: 178191 - RNA, 19 nt, Human
uguaugcuuuggguggggu

SEQ ID NO: 178192 - RNA, 23 nt, Human
uucccccugucuccuuuucauca

SEQ ID NO: 178193 - RNA, 22 nt, Human
uuggagcgagcuggccuccucc

SEQ ID NO: 178194 - RNA, 19 nt, Human
uugugcccaggggcaugca

SEQ ID NO: 178195 - RNA, 21 nt, Human
cacuccuucuauucccauuuc

SEQ ID NO: 178196 - RNA, 24 nt, Human
ccuucuauucccauuucugacauc

SEQ ID NO: 178197 - RNA, 23 nt, Human
cuccuucuauucccauuucugac

SEQ ID NO: 178198 - RNA, 21 nt, Human
uaaaagauuuacccuaagaac

SEQ ID NO: 178199 - RNA, 21 nt, Human
uaagaacacuccuucuauucc

SEQ ID NO: 178200 - RNA, 21 nt, Human
ugacauuucgaucuaaguggu

SEQ ID NO: 178201 - RNA, 20 nt, Human
aaaggaguggacuuucaaaa

SEQ ID NO: 178202 - RNA, 18 nt, Human
aaccgcccccuuucuccu

SEQ ID NO: 178203 - RNA, 19 nt, Human
aagacagagggccagugcu

SEQ ID NO: 178204 - RNA, 20 nt, Human
aagagaacagcggcagcagc

SEQ ID NO: 178205 - RNA, 24 nt, Human
agcggcagcagcaaaggugccucu

SEQ ID NO: 178206 - RNA, 21 nt, Human
aggaagacagagggccagugc

SEQ ID NO: 178207 - RNA, 20 nt, Human
aggcacaaaugugauuugag

SEQ ID NO: 178208 - RNA, 18 nt, Human
aggugaggagaaauggug

SEQ ID NO: 178209 - RNA, 21 nt, Human
agucucaucggaaagcacugu

SEQ ID NO: 178210 - RNA, 27 nt, Human
caaaagcagcggcagcagcuggagacc

SEQ ID NO: 178211 - RNA, 18 nt, Human
cacagcuuccugaccccu

SEQ ID NO: 178212 - RNA, 23 nt, Human
cacccaagcuguguagaugcucc

SEQ ID NO: 178213 - RNA, 24 nt, Human
cacuccucaacucuauccaagccc

SEQ ID NO: 178214 - RNA, 24 nt, Human
cagcagcaguagcagcagaaggaa

SEQ ID NO: 178215 - RNA, 22 nt, Human
cagcaguagcagcagaaggaaa

SEQ ID NO: 178216 - RNA, 26 nt, Human
cagcaguagcagcagaaggaaaggcu

SEQ ID NO: 178217 - RNA, 21 nt, Human
caggaaggggcucuugggaug

SEQ ID NO: 178218 - RNA, 21 nt, Human
caguggcaccuguggcucucc

SEQ ID NO: 178219 - RNA, 20 nt, Human
caucagcagacgggcagcaa

SEQ ID NO: 178220 - RNA, 22 nt, Human
caugaaaggaguggacuuucaa

SEQ ID NO: 178221 - RNA, 20 nt, Human
ccaggagugcaggaaggggc

SEQ ID NO: 178222 - RNA, 20 nt, Human
ccaggcacaaaugugauuug

SEQ ID NO: 178223 - RNA, 21 nt, Human
ccagucccauaguggaaaugc

SEQ ID NO: 178224 - RNA, 23 nt, Human
ccucugugauuccaggagugcag

SEQ ID NO: 178225 - RNA, 19 nt, Human
cggcagcagcaaaggugcc

SEQ ID NO: 178226 - RNA, 28 nt, Human
cggcagcagcaguagcagcagaaggaaa

SEQ ID NO: 178227 - RNA, 19 nt, Human
cucacacuccucaacucua

SEQ ID NO: 178228 - RNA, 24 nt, Human
cuccugagaggugcuuaggagagu

SEQ ID NO: 178229 - RNA, 21 nt, Human
cucuauccaagcccucuccuc

SEQ ID NO: 178230 - RNA, 20 nt, Human
cucuccucuucucucccacu

SEQ ID NO: 178231 - RNA, 21 nt, Human
cugaaugacaccaaagagaac

SEQ ID NO: 178232 - RNA, 18 nt, Human
cugaccccucugugauuc

SEQ ID NO: 178233 - RNA, 19 nt, Human
cugaccccucugugauucc

SEQ ID NO: 178234 - RNA, 20 nt, Human
cugcacaacugacugagggc

SEQ ID NO: 178235 - RNA, 20 nt, Human
cuguguagaugcuccugccu

SEQ ID NO: 178236 - RNA, 24 nt, Human
cuuauuggaauccccuuucaccca

SEQ ID NO: 178237 - RNA, 18 nt, Human
gaaaaaccaugaaaggag

SEQ ID NO: 178238 - RNA, 19 nt, Human
gagaacagcggcagcagcc

SEQ ID NO: 178239 - RNA, 27 nt, Human
gcagcggcagcagcaguagcagcagaa

SEQ ID NO: 178240 - RNA, 19 nt, Human
gcucuugggaugugccacc

SEQ ID NO: 178241 - RNA, 24 nt, Human
ggagaaauggugggcugagucuca

SEQ ID NO: 178242 - RNA, 23 nt, Human
ggcagcaauccucagccagggga

SEQ ID NO: 178243 - RNA, 24 nt, Human
gggcucuugggaugugccacccag

SEQ ID NO: 178244 - RNA, 18 nt, Human
uaaaagggggccuuuagc

SEQ ID NO: 178245 - RNA, 22 nt, Human
uagcagcagaaggaaaggcuuu

SEQ ID NO: 178246 - RNA, 19 nt, Human
uagcccaagucacacucag

SEQ ID NO: 178247 - RNA, 20 nt, Human
uccagaggcugagaaggccc

SEQ ID NO: 178248 - RNA, 21 nt, Human
ucccagggacaggaagucacc

SEQ ID NO: 178249 - RNA, 23 nt, Human
ucccauucagagucugucucccu

SEQ ID NO: 178250 - RNA, 19 nt, Human
ugagacucuugaagucugc

SEQ ID NO: 178251 - RNA, 21 nt, Human
ugaggaggcaguggcaccugu

SEQ ID NO: 178252 - RNA, 22 nt, Human
ugauuugaggaggcaguggcac

SEQ ID NO: 178253 - RNA, 23 nt, Human
uggaaaugcucucguauccagac

SEQ ID NO: 178254 - RNA, 21 nt, Human
uggccagccgcugaaugacac

SEQ ID NO: 178255 - RNA, 20 nt, Human
ugggaugugccacccaggaa

SEQ ID NO: 178256 - RNA, 22 nt, Human
uguguguuuguauccaguccca

SEQ ID NO: 178257 - RNA, 24 nt, Human
uuccugaccccucugugauuccag

SEQ ID NO: 178258 - RNA, 18 nt, Human
uuuggcaggaaaaaccau

SEQ ID NO: 178259 - RNA, 18 nt, Human
aaaacaauauuguauaca

SEQ ID NO: 178260 - RNA, 21 nt, Human
aagaaaagagaaacuuacuau

SEQ ID NO: 178261 - RNA, 22 nt, Human
aagcaaaauuuuaaugcaugua

SEQ ID NO: 178262 - RNA, 18 nt, Human
acugcaguguugcaaagg

SEQ ID NO: 178263 - RNA, 22 nt, Human
acuguagcauacucuaggccua

SEQ ID NO: 178264 - RNA, 21 nt, Human
agcucaaaaacucuggaaauc

SEQ ID NO: 178265 - RNA, 22 nt, Human
aggaaaaugccccugaagaaaa

SEQ ID NO: 178266 - RNA, 20 nt, Human
auccauuccucauuuggagg

SEQ ID NO: 178267 - RNA, 20 nt, Human
augaacgcuuaauauaaauc

SEQ ID NO: 178268 - RNA, 18 nt, Human
auuuaaucugcuaauuug

SEQ ID NO: 178269 - RNA, 22 nt, Human
caaccucuagaaaaaugauucu

SEQ ID NO: 178270 - RNA, 23 nt, Human
cacuuuauacagccaucaugaau

SEQ ID NO: 178271 - RNA, 20 nt, Human
cauaaaaacugcaguguugc

SEQ ID NO: 178272 - RNA, 22 nt, Human
ccuucuagcucaaaaacucugg

SEQ ID NO: 178273 - RNA, 19 nt, Human
gacugccuuuuaagauaau

SEQ ID NO: 178274 - RNA, 22 nt, Human
gagaaacuuacuauuuuacuga

SEQ ID NO: 178275 - RNA, 22 nt, Human
gagauuuaaacacaaugacagu

SEQ ID NO: 178276 - RNA, 21 nt, Human
gcugcaccaucccuauuuuug

SEQ ID NO: 178277 - RNA, 23 nt, Human
uaaaaaaggagacacuuauuuac

SEQ ID NO: 178278 - RNA, 18 nt, Human
uaccaaguauacuaccau

SEQ ID NO: 178279 - RNA, 18 nt, Human
uacuuuucuuuugcuuuu

SEQ ID NO: 178280 - RNA, 22 nt, Human
uagcucaaaaacucuggaaauc

SEQ ID NO: 178281 - RNA, 22 nt, Human
uauaccaaaguaaauaaaaaag

SEQ ID NO: 178282 - RNA, 22 nt, Human
ucaaggagaaucgcuuucauuu

SEQ ID NO: 178283 - RNA, 24 nt, Human
ucacagcuucaaaauuguugaggg

SEQ ID NO: 178284 - RNA, 21 nt, Human
ugaaauguccuuaguguaaaa

SEQ ID NO: 178285 - RNA, 23 nt, Human
ugacaguaaaccauugaaauuuc

SEQ ID NO: 178286 - RNA, 22 nt, Human
ugacugccuuuuaagauaaugc

SEQ ID NO: 178287 - RNA, 23 nt, Human
ugagagacaacuugccacaccag

SEQ ID NO: 178288 - RNA, 19 nt, Human
ugauuguaauauaaccauc

SEQ ID NO: 178289 - RNA, 21 nt, Human
uggaugguuaaaugccaacca

SEQ ID NO: 178290 - RNA, 20 nt, Human
uguaagaaauaauuucauuu

SEQ ID NO: 178291 - RNA, 19 nt, Human
uguaauauaaccaucuaau

SEQ ID NO: 178292 - RNA, 24 nt, Human
uguuuuuuaugugauaaaccuggu

SEQ ID NO: 178293 - RNA, 23 nt, Human
uuaaagaaaauccauuccucauu

SEQ ID NO: 178294 - RNA, 20 nt, Human
uuaguuuacauacuguagcu

SEQ ID NO: 178295 - RNA, 18 nt, Human
uucuccaaguaugcuaca

SEQ ID NO: 178296 - RNA, 21 nt, Human
aaacagcaaaucaaccuccaa

SEQ ID NO: 178297 - RNA, 22 nt, Human
aaaucaaccuccaacggggcca

SEQ ID NO: 178298 - RNA, 18 nt, Human
aacacaaagacaagaaac

SEQ ID NO: 178299 - RNA, 18 nt, Human
aagggcugggaggggcug

SEQ ID NO: 178300 - RNA, 20 nt, Human
aagggcugggaggggcuggg

SEQ ID NO: 178301 - RNA, 23 nt, Human
acaaagacaagaaacaaaacagc

SEQ ID NO: 178302 - RNA, 22 nt, Human
acagaacacaaagacaagaaac

SEQ ID NO: 178303 - RNA, 19 nt, Human
acagagcagaagaauuagg

SEQ ID NO: 178304 - RNA, 20 nt, Human
acagagcagaagaauuaggg

SEQ ID NO: 178305 - RNA, 18 nt, Human
agaacacaaagacaagaa

SEQ ID NO: 178306 - RNA, 19 nt, Human
agacaagaaacaaaacagc

SEQ ID NO: 178307 - RNA, 21 nt, Human
agaggaugcuauccaaccccc

SEQ ID NO: 178308 - RNA, 20 nt, Human
agaguuggugggggggaggu

SEQ ID NO: 178309 - RNA, 22 nt, Human
agcagaagaauuaggggugggg

SEQ ID NO: 178310 - RNA, 22 nt, Human
agcccucgaggagaacagacac

SEQ ID NO: 178311 - RNA, 24 nt, Human
agcggugggggcagaagucaccuu

SEQ ID NO: 178312 - RNA, 21 nt, Human
aggagaacagacacaggcugg

SEQ ID NO: 178313 - RNA, 21 nt, Human
aggauaaggaagggccaagaa

SEQ ID NO: 178314 - RNA, 24 nt, Human
aggauaaggaagggccaagaaaga

SEQ ID NO: 178315 - RNA, 20 nt, Human
aggccacuacagugggggua

SEQ ID NO: 178316 - RNA, 24 nt, Human
caaaacagcaaaucaaccuccaac

SEQ ID NO: 178317 - RNA, 22 nt, Human
caagaaacaaaacagcaaauca

SEQ ID NO: 178318 - RNA, 26 nt, Human
caaguaccacagaacacaaagacaag

SEQ ID NO: 178319 - RNA, 24 nt, Human
caccgcagcagucgccgccgccac

SEQ ID NO: 178320 - RNA, 23 nt, Human
cagaaagggugggucaaaguuaa

SEQ ID NO: 178321 - RNA, 19 nt, Human
cagaacacaaagacaagaa

SEQ ID NO: 178322 - RNA, 20 nt, Human
cagaacacaaagacaagaaa

SEQ ID NO: 178323 - RNA, 20 nt, Human
cagacacaggcuggggcagc

SEQ ID NO: 178324 - RNA, 20 nt, Human
cagcaaaucaaccuccaacg

SEQ ID NO: 178325 - RNA, 18 nt, Human
caugcccaagccuucccc

SEQ ID NO: 178326 - RNA, 27 nt, Human
ccacagaacacaaagacaagaaacaaa

SEQ ID NO: 178327 - RNA, 19 nt, Human
ccacuacaguggggguaag

SEQ ID NO: 178328 - RNA, 23 nt, Human
ccagcgcccgcucggcuccuccu

SEQ ID NO: 178329 - RNA, 19 nt, Human
ccgccgccaccgccgccgc

SEQ ID NO: 178330 - RNA, 21 nt, Human
ccgccgccaccgccgccgccg

SEQ ID NO: 178331 - RNA, 18 nt, Human
ccuccacgucuucccaaa

SEQ ID NO: 178332 - RNA, 24 nt, Human
cgcucggcuccuccuccuccuuca

SEQ ID NO: 178333 - RNA, 27 nt, Human
cuacaguggggguaagagcgguggggg

SEQ ID NO: 178334 - RNA, 24 nt, Human
cuauccaaccccccaucucccaag

SEQ ID NO: 178335 - RNA, 18 nt, Human
cuuccccacucccccagg

SEQ ID NO: 178336 - RNA, 23 nt, Human
cuuugugcugggagggccccuuc

SEQ ID NO: 178337 - RNA, 24 nt, Human
gaaacaaaacagcaaaucaaccuc

SEQ ID NO: 178338 - RNA, 21 nt, Human
gaggugggggcaucuccaaag

SEQ ID NO: 178339 - RNA, 22 nt, Human
gcagggcacacugggguuuggg

SEQ ID NO: 178340 - RNA, 25 nt, Human
gcucacucgacagcccucaggccac

SEQ ID NO: 178341 - RNA, 19 nt, Human
ggaaggggacacauucacu

SEQ ID NO: 178342 - RNA, 19 nt, Human
ggcagcaggggcugggggc

SEQ ID NO: 178343 - RNA, 20 nt, Human
ggcagcaggggcugggggcg

SEQ ID NO: 178344 - RNA, 21 nt, Human
ggcuccuccuccuccuucacc

SEQ ID NO: 178345 - RNA, 20 nt, Human
gggaagcagaggaugcugga

SEQ ID NO: 178346 - RNA, 21 nt, Human
gggaagcagaggaugcuggag

SEQ ID NO: 178347 - RNA, 20 nt, Human
ggggcagcaggggcuggggg

SEQ ID NO: 178348 - RNA, 25 nt, Human
ggggcagggcacacugggguuuggg

SEQ ID NO: 178349 - RNA, 18 nt, Human
ggguaagagcgguggggg

SEQ ID NO: 178350 - RNA, 22 nt, Human
gggugaugggaacguggugggg

SEQ ID NO: 178351 - RNA, 21 nt, Human
ggucaggccucggugccagcg

SEQ ID NO: 178352 - RNA, 23 nt, Human
guggugggggaagcagaggaugc

SEQ ID NO: 178353 - RNA, 22 nt, Human
uaagagcggugggggcagaagu

SEQ ID NO: 178354 - RNA, 29 nt, Human
uaccacagaacacaaagacaagaaacaaa

SEQ ID NO: 178355 - RNA, 20 nt, Human
uagaauaaauuaggggggag

SEQ ID NO: 178356 - RNA, 25 nt, Human
uauccaaccccccaucucccaagcc

SEQ ID NO: 178357 - RNA, 21 nt, Human
ucccccaggcugggcaagggc

SEQ ID NO: 178358 - RNA, 19 nt, Human
uccuaggauaaggaagggc

SEQ ID NO: 178359 - RNA, 22 nt, Human
uccuccacgucuucccaaacag

SEQ ID NO: 178360 - RNA, 24 nt, Human
ucgccgccgccaccgccgccgccg

SEQ ID NO: 178361 - RNA, 19 nt, Human
ucucuccaacacgcgagag

SEQ ID NO: 178362 - RNA, 20 nt, Human
ugcugggagggccccuucuc

SEQ ID NO: 178363 - RNA, 23 nt, Human
ugggagguuuuguuuucugugaa

SEQ ID NO: 178364 - RNA, 20 nt, Human
uggggcagcaggggcugggg

SEQ ID NO: 178365 - RNA, 18 nt, Human
uggggguaagagcggugg

SEQ ID NO: 178366 - RNA, 24 nt, Human
uggggguaagagcggugggggcag

SEQ ID NO: 178367 - RNA, 20 nt, Human
ugggugaugggaacguggug

SEQ ID NO: 178368 - RNA, 27 nt, Human
ugugcugggagggccccuucucuccaa

SEQ ID NO: 178369 - RNA, 24 nt, Human
uucccaccuccuucugcuuggcuc

SEQ ID NO: 178370 - RNA, 21 nt, Human
uuccuccacgucuucccaaac

SEQ ID NO: 178371 - RNA, 23 nt, Human
uuuauugggagguuuuguuuucu

SEQ ID NO: 178372 - RNA, 26 nt, Human
uuuauugggagguuuuguuuucugug

SEQ ID NO: 178373 - RNA, 23 nt, Human
aaaaaaaagccaguuugguuaaa

SEQ ID NO: 178374 - RNA, 20 nt, Human
aaacuuccggaugcuguccc

SEQ ID NO: 178375 - RNA, 23 nt, Human
aacauuugacauaauacaaaaua

SEQ ID NO: 178376 - RNA, 23 nt, Human
aagagaaagagaggaaaauggag

SEQ ID NO: 178377 - RNA, 19 nt, Human
aauagccacuccaugaaac

SEQ ID NO: 178378 - RNA, 21 nt, Human
aaucauuuggagccauuuuga

SEQ ID NO: 178379 - RNA, 18 nt, Human
acaggcuuucuccaaaug

SEQ ID NO: 178380 - RNA, 23 nt, Human
acgaggcugggaggcgcucuugg

SEQ ID NO: 178381 - RNA, 22 nt, Human
agcuggcgacaaggcgagaccg

SEQ ID NO: 178382 - RNA, 18 nt, Human
aggcgcggacgcaggacc

SEQ ID NO: 178383 - RNA, 19 nt, Human
aggcugggaggcgcucuug

SEQ ID NO: 178384 - RNA, 20 nt, Human
cacagcgcucuucauucucu

SEQ ID NO: 178385 - RNA, 18 nt, Human
cacgccugagauacaaaa

SEQ ID NO: 178386 - RNA, 18 nt, Human
caguacagaaaucauuug

SEQ ID NO: 178387 - RNA, 21 nt, Human
cauuuucauuacaaaagcagg

SEQ ID NO: 178388 - RNA, 24 nt, Human
ccagaauuuggcuuuauuuugcag

SEQ ID NO: 178389 - RNA, 24 nt, Human
ccauuuugagacagaaguagaggc

SEQ ID NO: 178390 - RNA, 25 nt, Human
cgcuuccucuccccuucucucucaa

SEQ ID NO: 178391 - RNA, 22 nt, Human
cuagaaaaaaaaaaaagccagu

SEQ ID NO: 178392 - RNA, 22 nt, Human
cuucacuagaaaaaaaaaaaag

SEQ ID NO: 178393 - RNA, 25 nt, Human
gaagaagccacgccugagauacaaa

SEQ ID NO: 178394 - RNA, 21 nt, Human
gaaggggaguauuuacuggca

SEQ ID NO: 178395 - RNA, 20 nt, Human
gacccgagcaaggaaaaggc

SEQ ID NO: 178396 - RNA, 19 nt, Human
gcaggcgcggacgcaggac

SEQ ID NO: 178397 - RNA, 21 nt, Human
gcaguacagaaaucauuugga

SEQ ID NO: 178398 - RNA, 23 nt, Human
ggacgcaggacccgagcaaggaa

SEQ ID NO: 178399 - RNA, 18 nt, Human
uaaauugaacagaaugug

SEQ ID NO: 178400 - RNA, 25 nt, Human
uaacuucacuagaaaaaaaaaaaag

SEQ ID NO: 178401 - RNA, 22 nt, Human
uacugcauugcagcuuggucca

SEQ ID NO: 178402 - RNA, 26 nt, Human
uagaaaaaaaaaaaagccaguuuggu

SEQ ID NO: 178403 - RNA, 20 nt, Human
uauguucgcuuccucucccc

SEQ ID NO: 178404 - RNA, 25 nt, Human
uauugauuucauuauaugcauuauu

SEQ ID NO: 178405 - RNA, 26 nt, Human
ucaacuuuauuagguuaaaacaccac

SEQ ID NO: 178406 - RNA, 23 nt, Human
ucacuagaaaaaaaaaaaagcca

SEQ ID NO: 178407 - RNA, 24 nt, Human
ucauuacaaaagcaggccuuacaa

SEQ ID NO: 178408 - RNA, 20 nt, Human
uccaaaugacucccuauguc

SEQ ID NO: 178409 - RNA, 24 nt, Human
uccugaaccucaagaggacagaug

SEQ ID NO: 178410 - RNA, 19 nt, Human
ucugugucgguaucccaau

SEQ ID NO: 178411 - RNA, 21 nt, Human
ucuugggcgcgaaggaaaggg

SEQ ID NO: 178412 - RNA, 22 nt, Human
uggcacagcgcucuucauucuc

SEQ ID NO: 178413 - RNA, 22 nt, Human
uguggcuaugcuauuugggccc

SEQ ID NO: 178414 - RNA, 24 nt, Human
uucgcuuccucuccccuucucucu

SEQ ID NO: 178415 - RNA, 19 nt, Human
uugagacagaaguagaggc

SEQ ID NO: 178416 - RNA, 21 nt, Human
uugagacagaaguagaggcuc

SEQ ID NO: 178417 - RNA, 20 nt, Human
uuuagaaucuccugaaccuu

SEQ ID NO: 178418 - RNA, 21 nt, Human
uuuaugcccacauaaaccaaa

SEQ ID NO: 178419 - RNA, 22 nt, Human
uuuaugcccacauaaaccaaac

SEQ ID NO: 178420 - RNA, 25 nt, Human
uuuauguucgcuuccucuccccuuc

SEQ ID NO: 178421 - RNA, 18 nt, Human
aauggccuucaacaaggg

SEQ ID NO: 178422 - RNA, 20 nt, Human
acauacaagggucaaccaaa

SEQ ID NO: 178423 - RNA, 18 nt, Human
augugaacaccaaacaca

SEQ ID NO: 178424 - RNA, 21 nt, Human
cagggguucucuucucaacuu

SEQ ID NO: 178425 - RNA, 26 nt, Human
cauaaauaugcuuuaucaaauguuaa

SEQ ID NO: 178426 - RNA, 20 nt, Human
cauacaagggucaaccaaag

SEQ ID NO: 178427 - RNA, 18 nt, Human
ccaaaauagaagaaacac

SEQ ID NO: 178428 - RNA, 19 nt, Human
ccacucucucccuucuccg

SEQ ID NO: 178429 - RNA, 21 nt, Human
cccacaaggcuaauacgcuag

SEQ ID NO: 178430 - RNA, 19 nt, Human
cucauugacagcuuucuua

SEQ ID NO: 178431 - RNA, 18 nt, Human
cugagcgcacguuccagg

SEQ ID NO: 178432 - RNA, 18 nt, Human
gaacaccaaacacauccu

SEQ ID NO: 178433 - RNA, 21 nt, Human
gauucguagaaaguuuucccu

SEQ ID NO: 178434 - RNA, 22 nt, Human
ggaaaccacaucuaacuuaagu

SEQ ID NO: 178435 - RNA, 22 nt, Human
gugaacaccaaacacauccucu

SEQ ID NO: 178436 - RNA, 22 nt, Human
uaagacauauagguaaaaacuu

SEQ ID NO: 178437 - RNA, 30 nt, Human
uagaaaguuuucccuccuuugaagaaacuc

SEQ ID NO: 178438 - RNA, 23 nt, Human
uauccaaaauagaagaaacacau

SEQ ID NO: 178439 - RNA, 19 nt, Human
ucaaagucacauaucagaa

SEQ ID NO: 178440 - RNA, 18 nt, Human
ucagacuucugauuauac

SEQ ID NO: 178441 - RNA, 22 nt, Human
uccaaaauagaagaaacacaug

SEQ ID NO: 178442 - RNA, 26 nt, Human
uccaaaauagaagaaacacaugugaa

SEQ ID NO: 178443 - RNA, 21 nt, Human
ucccacucucucccuucuccg

SEQ ID NO: 178444 - RNA, 20 nt, Human
ucccagugcugagcgcacgu

SEQ ID NO: 178445 - RNA, 20 nt, Human
uccgcgcugggauacccggg

SEQ ID NO: 178446 - RNA, 19 nt, Human
ucgaaaguucugcgggcug

SEQ ID NO: 178447 - RNA, 21 nt, Human
ucucgggccgucccccuuacu

SEQ ID NO: 178448 - RNA, 19 nt, Human
ucugggugacccuggguuc

SEQ ID NO: 178449 - RNA, 21 nt, Human
ugaaaaagauagaaaauggua

SEQ ID NO: 178450 - RNA, 19 nt, Human
ugaacaccaaacacauccu

SEQ ID NO: 178451 - RNA, 23 nt, Human
ugacuaaauagaaucugauucaa

SEQ ID NO: 178452 - RNA, 21 nt, Human
ugggaaaaauuuuuaaugaug

SEQ ID NO: 178453 - RNA, 19 nt, Human
ugugaacaccaaacacauc

SEQ ID NO: 178454 - RNA, 21 nt, Human
uucagacuucugauuauacau

SEQ ID NO: 178455 - RNA, 19 nt, Human
uugcuaagccuuuguuucc

SEQ ID NO: 178456 - RNA, 25 nt, Human
uuggccucaaagucacauaucagaa

SEQ ID NO: 178457 - RNA, 21 nt, Human
uuuccuggaaauaaauacuga

SEQ ID NO: 178458 - RNA, 21 nt, Human
uuugcuaagccuuuguuucca

SEQ ID NO: 178459 - RNA, 22 nt, Human
uuuguaagcuuuacuucccuac

SEQ ID NO: 178460 - RNA, 21 nt, Human
aaaaacaucuagggaccagag

SEQ ID NO: 178461 - RNA, 18 nt, Human
aaagagccuauguccaca

SEQ ID NO: 178462 - RNA, 21 nt, Human
aacuacaagccgucagagaca

SEQ ID NO: 178463 - RNA, 21 nt, Human
aagguaucaauaguccuaaaa

SEQ ID NO: 178464 - RNA, 24 nt, Human
aaucaucaccccucggccucuaga

SEQ ID NO: 178465 - RNA, 23 nt, Human
acaagccgucagagacaagagaa

SEQ ID NO: 178466 - RNA, 19 nt, Human
acccccuccucuucucuuc

SEQ ID NO: 178467 - RNA, 21 nt, Human
accccucggccucuagaacag

SEQ ID NO: 178468 - RNA, 22 nt, Human
acccuuucggugugucccacca

SEQ ID NO: 178469 - RNA, 18 nt, Human
accuauggccaaagagcc

SEQ ID NO: 178470 - RNA, 19 nt, Human
acugaagggaaaacacaca

SEQ ID NO: 178471 - RNA, 19 nt, Human
agagacccuuucggugugu

SEQ ID NO: 178472 - RNA, 18 nt, Human
aggaaggguccagcugca

SEQ ID NO: 178473 - RNA, 21 nt, Human
aggagaccacaauugagucua

SEQ ID NO: 178474 - RNA, 18 nt, Human
aggagagucaacaugaug

SEQ ID NO: 178475 - RNA, 21 nt, Human
aguccuaaaaugcagcaacuc

SEQ ID NO: 178476 - RNA, 19 nt, Human
auggccaaagagccuaugu

SEQ ID NO: 178477 - RNA, 23 nt, Human
augugaagccagagacccuuucg

SEQ ID NO: 178478 - RNA, 23 nt, Human
auucccguugguaauuucagcuu

SEQ ID NO: 178479 - RNA, 21 nt, Human
auuuccaaccuaaaauucuga

SEQ ID NO: 178480 - RNA, 20 nt, Human
caaaacagcuagauaccagc

SEQ ID NO: 178481 - RNA, 21 nt, Human
caaacaagcaugacacacuuc

SEQ ID NO: 178482 - RNA, 23 nt, Human
caagggaaggaaggguccagcug

SEQ ID NO: 178483 - RNA, 23 nt, Human
caauuaucaccacuaugccaucc

SEQ ID NO: 178484 - RNA, 21 nt, Human
cacagccgaccgcucguagcc

SEQ ID NO: 178485 - RNA, 22 nt, Human
caccaagggaaggaagggucca

SEQ ID NO: 178486 - RNA, 19 nt, Human
caccuauggccaaagagcc

SEQ ID NO: 178487 - RNA, 27 nt, Human
cagaaguuucuccucuuugggugaaac

SEQ ID NO: 178488 - RNA, 24 nt, Human
cagggugaugagaaaaugugaagc

SEQ ID NO: 178489 - RNA, 22 nt, Human
cauccccaacaccuauggccaa

SEQ ID NO: 178490 - RNA, 20 nt, Human
ccaaaacagcuagauaccag

SEQ ID NO: 178491 - RNA, 21 nt, Human
cccaacaccuauggccaaaga

SEQ ID NO: 178492 - RNA, 25 nt, Human
cccauaacuacaagccgucagagac

SEQ ID NO: 178493 - RNA, 24 nt, Human
ccccaacaccuauggccaaagagc

SEQ ID NO: 178494 - RNA, 23 nt, Human
ccccagauacuauuaaguccuuu

SEQ ID NO: 178495 - RNA, 23 nt, Human
ccccucggccucuagaacagcuc

SEQ ID NO: 178496 - RNA, 23 nt, Human
ccgucagagacaagagaagcugc

SEQ ID NO: 178497 - RNA, 23 nt, Human
ccuauggccaaagagccuauguc

SEQ ID NO: 178498 - RNA, 23 nt, Human
ccuccaaaacagcuagauaccag

SEQ ID NO: 178499 - RNA, 19 nt, Human
cgaggagaccaauguaaug

SEQ ID NO: 178500 - RNA, 18 nt, Human
cggagcugguggcacaga

SEQ ID NO: 178501 - RNA, 18 nt, Human
cggccucuagaacagcuc

SEQ ID NO: 178502 - RNA, 18 nt, Human
cgggcccacgcggacaag

SEQ ID NO: 178503 - RNA, 23 nt, Human
cuaaaaugcagcaacuccaucuc

SEQ ID NO: 178504 - RNA, 22 nt, Human
cuccucuucucuucagaaaggg

SEQ ID NO: 178505 - RNA, 19 nt, Human
cuccugccccauaacuaca

SEQ ID NO: 178506 - RNA, 21 nt, Human
cugcagcgggcgcaguaccag

SEQ ID NO: 178507 - RNA, 19 nt, Human
cugguggcacagagguugu

SEQ ID NO: 178508 - RNA, 18 nt, Human
gaacagcuccagauucga

SEQ ID NO: 178509 - RNA, 18 nt, Human
gaagacggagguccgcgc

SEQ ID NO: 178510 - RNA, 21 nt, Human
gagacaagagaagcugccaca

SEQ ID NO: 178511 - RNA, 25 nt, Human
gagguccgcgcggcgaagccaaaga

SEQ ID NO: 178512 - RNA, 21 nt, Human
gauugagugagaucccauugc

SEQ ID NO: 178513 - RNA, 23 nt, Human
gauuuugcccuucugaugaggca

SEQ ID NO: 178514 - RNA, 18 nt, Human
gcaguuucuucaaggugu

SEQ ID NO: 178515 - RNA, 21 nt, Human
gcauucccguugguaauuuca

SEQ ID NO: 178516 - RNA, 19 nt, Human
gccucuagaacagcuccag

SEQ ID NO: 178517 - RNA, 21 nt, Human
gugaagccagagacccuuucg

SEQ ID NO: 178518 - RNA, 25 nt, Human
guuuuugucucuacaucccauauuu

SEQ ID NO: 178519 - RNA, 27 nt, Human
uaaaaaaagguaucaauaguccuaaaa

SEQ ID NO: 178520 - RNA, 19 nt, Human
uaaaacugaagggaaaaca

SEQ ID NO: 178521 - RNA, 21 nt, Human
uaacugcagaggugaaagaug

SEQ ID NO: 178522 - RNA, 24 nt, Human
uaaguccuuuacucgaggagacca

SEQ ID NO: 178523 - RNA, 22 nt, Human
uaauagcuguuugucauccucu

SEQ ID NO: 178524 - RNA, 20 nt, Human
uagaacagcuccagauucga

SEQ ID NO: 178525 - RNA, 21 nt, Human
uagagaugaccaacacucugc

SEQ ID NO: 178526 - RNA, 23 nt, Human
uaucuuuggcuuuaaucugauuc

SEQ ID NO: 178527 - RNA, 18 nt, Human
ucaaaaucaucaccccuc

SEQ ID NO: 178528 - RNA, 21 nt, Human
ucagauccaccguugucuaug

SEQ ID NO: 178529 - RNA, 18 nt, Human
ucaucaccccucggccuc

SEQ ID NO: 178530 - RNA, 22 nt, Human
uccaucucaaacaagcaugaca

SEQ ID NO: 178531 - RNA, 30 nt, Human
uccccaacaccuauggccaaagagccuauu

SEQ ID NO: 178532 - RNA, 23 nt, Human
uccucuugguuuauagauaaaca

SEQ ID NO: 178533 - RNA, 23 nt, Human
ucuccaaagaguaucuuuggcuu

SEQ ID NO: 178534 - RNA, 24 nt, Human
ucuccuaugacucgaaacgggggu

SEQ ID NO: 178535 - RNA, 21 nt, Human
ucugaaguuuccucuugguuu

SEQ ID NO: 178536 - RNA, 24 nt, Human
ucugacaggagagucaacaugaug

SEQ ID NO: 178537 - RNA, 22 nt, Human
ucuuuggcuuuaaucugauucu

SEQ ID NO: 178538 - RNA, 23 nt, Human
ucuuuuggauuacugcaaaaaca

SEQ ID NO: 178539 - RNA, 22 nt, Human
ugaaucacuucuucuaaagcuu

SEQ ID NO: 178540 - RNA, 21 nt, Human
ugagaaaaugugaagccagag

SEQ ID NO: 178541 - RNA, 22 nt, Human
ugagaucccauugcaacaguuc

SEQ ID NO: 178542 - RNA, 21 nt, Human
ugcauguucugucacaacugu

SEQ ID NO: 178543 - RNA, 24 nt, Human
uggcuaaguagcaaccuuuuguua

SEQ ID NO: 178544 - RNA, 22 nt, Human
uuccaguggcuaaguagcaacc

SEQ ID NO: 178545 - RNA, 26 nt, Human
uucucuucagaaagggcaauuucaaa

SEQ ID NO: 178546 - RNA, 18 nt, Human
uugcaacaguucaccucc

SEQ ID NO: 178547 - RNA, 18 nt, Human
uugguaauuucagcuucu

SEQ ID NO: 178548 - RNA, 24 nt, Human
uuuauaauuaaauaguauuuaggg

SEQ ID NO: 178549 - RNA, 19 nt, Human
uuuguuauaaaacugaagg

SEQ ID NO: 178550 - RNA, 19 nt, Human
aaagucaugcccugccccc

SEQ ID NO: 178551 - RNA, 21 nt, Human
aaccaaaagacaaaacaagcc

SEQ ID NO: 178552 - RNA, 23 nt, Human
aaccaaaagacaaaacaagccuc

SEQ ID NO: 178553 - RNA, 21 nt, Human
aagaggccuuuagaaauggga

SEQ ID NO: 178554 - RNA, 23 nt, Human
aagaggccuuuagaaaugggaca

SEQ ID NO: 178555 - RNA, 22 nt, Human
aagcagcagucccaggggcuca

SEQ ID NO: 178556 - RNA, 19 nt, Human
aaggcagcagcagugcccu

SEQ ID NO: 178557 - RNA, 22 nt, Human
aagugcaacuggucacccacaa

SEQ ID NO: 178558 - RNA, 24 nt, Human
aagugcaacuggucacccacaacc

SEQ ID NO: 178559 - RNA, 18 nt, Human
aagugcugagaaucaagc

SEQ ID NO: 178560 - RNA, 24 nt, Human
aauugccuccuccuccaucucuac

SEQ ID NO: 178561 - RNA, 18 nt, Human
acacagcaaggaagaggc

SEQ ID NO: 178562 - RNA, 20 nt, Human
acacaggaggcugagguggg

SEQ ID NO: 178563 - RNA, 20 nt, Human
accaaaagacaaaacaagcc

SEQ ID NO: 178564 - RNA, 25 nt, Human
accucaucccucuccacguacacaa

SEQ ID NO: 178565 - RNA, 23 nt, Human
agacguguggcaguggcuuacug

SEQ ID NO: 178566 - RNA, 24 nt, Human
agaggagggaggggagcagcuggg

SEQ ID NO: 178567 - RNA, 21 nt, Human
agaggcuggggcggccuggua

SEQ ID NO: 178568 - RNA, 19 nt, Human
agcagcugggguggugggg

SEQ ID NO: 178569 - RNA, 20 nt, Human
agcagcugggguggugggga

SEQ ID NO: 178570 - RNA, 19 nt, Human
agccccccucuaucccucc

SEQ ID NO: 178571 - RNA, 24 nt, Human
agcuacacaggaggcugagguggg

SEQ ID NO: 178572 - RNA, 19 nt, Human
agcugggggccaggcagcc

SEQ ID NO: 178573 - RNA, 21 nt, Human
aggagggaggggagcagcugg

SEQ ID NO: 178574 - RNA, 21 nt, Human
aggcugagguggguagacugc

SEQ ID NO: 178575 - RNA, 22 nt, Human
aggcugcaggaauaugagccag

SEQ ID NO: 178576 - RNA, 19 nt, Human
agggaggggagcagcuggg

SEQ ID NO: 178577 - RNA, 23 nt, Human
aguuucuuguuaguuggaguugc

SEQ ID NO: 178578 - RNA, 19 nt, Human
aguuuuccuccagcagccu

SEQ ID NO: 178579 - RNA, 22 nt, Human
aucccaauugccuccuccucca

SEQ ID NO: 178580 - RNA, 23 nt, Human
auccccuuucucuccuguuucag

SEQ ID NO: 178581 - RNA, 27 nt, Human
aucccucuccacguacacaacagaucc

SEQ ID NO: 178582 - RNA, 20 nt, Human
aucugggcaggugacugccc

SEQ ID NO: 178583 - RNA, 23 nt, Human
augggacaaagucaugcccugcc

SEQ ID NO: 178584 - RNA, 24 nt, Human
auuagcagcagcagcagcagcagg

SEQ ID NO: 178585 - RNA, 20 nt, Human
auugccuccuccuccaucuc

SEQ ID NO: 178586 - RNA, 23 nt, Human
caacuggucacccacaaccccua

SEQ ID NO: 178587 - RNA, 20 nt, Human
caagccucuggccagggcua

SEQ ID NO: 178588 - RNA, 23 nt, Human
caagccucuggccagggcuaccu

SEQ ID NO: 178589 - RNA, 20 nt, Human
caagcucccaccugcccaca

SEQ ID NO: 178590 - RNA, 18 nt, Human
cacaggaggcugaggugg

SEQ ID NO: 178591 - RNA, 19 nt, Human
cacaggaggcugagguggg

SEQ ID NO: 178592 - RNA, 22 nt, Human
cacggggcaguccuccugggcu

SEQ ID NO: 178593 - RNA, 22 nt, Human
cacuaugggguggagaggguca

SEQ ID NO: 178594 - RNA, 21 nt, Human
cagaucccccaagugcugaga

SEQ ID NO: 178595 - RNA, 28 nt, Human
cagcagcagcagcagcagguggcaggaa

SEQ ID NO: 178596 - RNA, 19 nt, Human
cagcagugcccugaagauu

SEQ ID NO: 178597 - RNA, 22 nt, Human
cagcagugcccugaagauuagc

SEQ ID NO: 178598 - RNA, 24 nt, Human
cagcuacacaggaggcugaggugg

SEQ ID NO: 178599 - RNA, 20 nt, Human
cauaaaaaccaaaagacaaa

SEQ ID NO: 178600 - RNA, 22 nt, Human
caucccucuccacguacacaac

SEQ ID NO: 178601 - RNA, 21 nt, Human
caucucuaccagcguccccuc

SEQ ID NO: 178602 - RNA, 19 nt, Human
ccaaaagacaaaacaagcc

SEQ ID NO: 178603 - RNA, 23 nt, Human
ccaaucuauaaucccagcuacac

SEQ ID NO: 178604 - RNA, 21 nt, Human
ccagcagaggcggagcaacua

SEQ ID NO: 178605 - RNA, 24 nt, Human
cccacagcugggggccaggcagcc

SEQ ID NO: 178606 - RNA, 22 nt, Human
ccccaagugcugagaaucaagc

SEQ ID NO: 178607 - RNA, 21 nt, Human
ccccagguggcaggacguccc

SEQ ID NO: 178608 - RNA, 19 nt, Human
ccccauggauacauccccu

SEQ ID NO: 178609 - RNA, 18 nt, Human
ccccccgcccuccucccc

SEQ ID NO: 178610 - RNA, 19 nt, Human
ccccuucucuccuuccucc

SEQ ID NO: 178611 - RNA, 22 nt, Human
ccccuucucuccuuccuccuca

SEQ ID NO: 178612 - RNA, 19 nt, Human
ccccuuucucuccuguuuc

SEQ ID NO: 178613 - RNA, 20 nt, Human
cccgcccuccuccccuucuc

SEQ ID NO: 178614 - RNA, 18 nt, Human
cccuccuccccuucucuc

SEQ ID NO: 178615 - RNA, 19 nt, Human
cccugagcacccggccucc

SEQ ID NO: 178616 - RNA, 22 nt, Human
ccgcccuccuccccuucucucc

SEQ ID NO: 178617 - RNA, 25 nt, Human
ccuccuccccuucucuccuuccucc

SEQ ID NO: 178618 - RNA, 24 nt, Human
ccucuccacguacacaacagaucc

SEQ ID NO: 178619 - RNA, 24 nt, Human
ccucucuguacccacagcuggggg

SEQ ID NO: 178620 - RNA, 23 nt, Human
ccugcccacagcgugcccacaga

SEQ ID NO: 178621 - RNA, 23 nt, Human
cuagaauacuggguacauuuugu

SEQ ID NO: 178622 - RNA, 25 nt, Human
cuccaaucuauaaucccagcuacac

SEQ ID NO: 178623 - RNA, 18 nt, Human
cucccagucccaucucug

SEQ ID NO: 178624 - RNA, 19 nt, Human
cuccugggcuugaccucuc

SEQ ID NO: 178625 - RNA, 20 nt, Human
cucuaccagcguccccucca

SEQ ID NO: 178626 - RNA, 21 nt, Human
cucugggcacagaucccacca

SEQ ID NO: 178627 - RNA, 23 nt, Human
cugcuugagcccaggaguucaag

SEQ ID NO: 178628 - RNA, 24 nt, Human
cugcuugagcccaggaguucaagg

SEQ ID NO: 178629 - RNA, 19 nt, Human
cuuagacugaucaggguca

SEQ ID NO: 178630 - RNA, 19 nt, Human
gacagaggagggaggggag

SEQ ID NO: 178631 - RNA, 18 nt, Human
gacuaaaggcagcagcag

SEQ ID NO: 178632 - RNA, 21 nt, Human
gagaggagaacccugaagugg

SEQ ID NO: 178633 - RNA, 25 nt, Human
gagcagcuggggugguggggagcuc

SEQ ID NO: 178634 - RNA, 22 nt, Human
gaggagggaggggagcagcugg

SEQ ID NO: 178635 - RNA, 25 nt, Human
gaggcugagguggguagacugcuug

SEQ ID NO: 178636 - RNA, 18 nt, Human
gcaccucaucccucucca

SEQ ID NO: 178637 - RNA, 21 nt, Human
gcacugggguggacgugucag

SEQ ID NO: 178638 - RNA, 20 nt, Human
gcagaggcggagcaacuauc

SEQ ID NO: 178639 - RNA, 20 nt, Human
gcagcagcagugcccugaag

SEQ ID NO: 178640 - RNA, 24 nt, Human
gcagucccaggggcucagaggcug

SEQ ID NO: 178641 - RNA, 20 nt, Human
gcaguccuccugggcuugac

SEQ ID NO: 178642 - RNA, 19 nt, Human
gcccacagcgugcccacag

SEQ ID NO: 178643 - RNA, 22 nt, Human
gcccaggaguucaaggucagcc

SEQ ID NO: 178644 - RNA, 24 nt, Human
gcccuugggggugaguuucuugac

SEQ ID NO: 178645 - RNA, 22 nt, Human
gcucagaggcuggggcggccug

SEQ ID NO: 178646 - RNA, 21 nt, Human
gcugcuggccaugccccucca

SEQ ID NO: 178647 - RNA, 21 nt, Human
ggacaaagucaugcccugccc

SEQ ID NO: 178648 - RNA, 20 nt, Human
ggagaacaacccucugagcu

SEQ ID NO: 178649 - RNA, 21 nt, Human
ggagaacaacccucugagcug

SEQ ID NO: 178650 - RNA, 19 nt, Human
ggagcagcugggguggugg

SEQ ID NO: 178651 - RNA, 18 nt, Human
ggagggaggggagcagcu

SEQ ID NO: 178652 - RNA, 25 nt, Human
gggaaaggacaccaagucuugggga

SEQ ID NO: 178653 - RNA, 21 nt, Human
gggagcagcuggggugguggg

SEQ ID NO: 178654 - RNA, 20 nt, Human
gggaggggagcagcuggggu

SEQ ID NO: 178655 - RNA, 23 nt, Human
gggcacagaucccaccagucugc

SEQ ID NO: 178656 - RNA, 21 nt, Human
gggcagcaagcugaccuaggg

SEQ ID NO: 178657 - RNA, 25 nt, Human
gggcaguccuccugggcuugaccuc

SEQ ID NO: 178658 - RNA, 20 nt, Human
gggcucagaggcuggggcgg

SEQ ID NO: 178659 - RNA, 18 nt, Human
ggggagcagcuggggugg

SEQ ID NO: 178660 - RNA, 18 nt, Human
ggguagacugcuugagcc

SEQ ID NO: 178661 - RNA, 27 nt, Human
gggugguggggagcucaggucgaaguc

SEQ ID NO: 178662 - RNA, 22 nt, Human
gggugguggggagcucaggucu

SEQ ID NO: 178663 - RNA, 24 nt, Human
gguagacugcuugagcccaggagu

SEQ ID NO: 178664 - RNA, 24 nt, Human
gguggcuccaaucuauaaucccag

SEQ ID NO: 178665 - RNA, 21 nt, Human
guccccuccagucugcacggg

SEQ ID NO: 178666 - RNA, 29 nt, Human
gugcccacagauggcaucccuggauggcc

SEQ ID NO: 178667 - RNA, 18 nt, Human
gugccccccgcccuccuc

SEQ ID NO: 178668 - RNA, 23 nt, Human
gugggugcacugggguggacgug

SEQ ID NO: 178669 - RNA, 18 nt, Human
gugggugccgucuggcag

SEQ ID NO: 178670 - RNA, 21 nt, Human
uaacaacaggaaucagggaug

SEQ ID NO: 178671 - RNA, 24 nt, Human
uagcagcagcagcagcagcaggug

SEQ ID NO: 178672 - RNA, 18 nt, Human
uaggugccccccgcccuc

SEQ ID NO: 178673 - RNA, 27 nt, Human
ucacuuugcucgugccucaguuuuaca

SEQ ID NO: 178674 - RNA, 23 nt, Human
uccaaucuauaaucccagcuaca

SEQ ID NO: 178675 - RNA, 23 nt, Human
uccacguacacaacagauccccc

SEQ ID NO: 178676 - RNA, 21 nt, Human
uccauaacaacaggaaucagg

SEQ ID NO: 178677 - RNA, 21 nt, Human
ucccaccucauaaaaaccaaa

SEQ ID NO: 178678 - RNA, 23 nt, Human
ucccagcaccucaucccucucca

SEQ ID NO: 178679 - RNA, 19 nt, Human
ucccaggggcucagaggcu

SEQ ID NO: 178680 - RNA, 21 nt, Human
uccccuucucuccuuccuccu

SEQ ID NO: 178681 - RNA, 19 nt, Human
ucccuggauggcagcucag

SEQ ID NO: 178682 - RNA, 24 nt, Human
ucccuggauggcagcucaggugga

SEQ ID NO: 178683 - RNA, 23 nt, Human
uccuccagcagccugaggaaacu

SEQ ID NO: 178684 - RNA, 19 nt, Human
uccuuaauucccacaaucc

SEQ ID NO: 178685 - RNA, 19 nt, Human
uccuucugggaucugggca

SEQ ID NO: 178686 - RNA, 19 nt, Human
ucuccuuccuccucauucu

SEQ ID NO: 178687 - RNA, 21 nt, Human
ucucuaccagcguccccucca

SEQ ID NO: 178688 - RNA, 23 nt, Human
ugagcccaggaguucaaggucag

SEQ ID NO: 178689 - RNA, 18 nt, Human
ugagcugggcaugguggc

SEQ ID NO: 178690 - RNA, 21 nt, Human
ugccaucccaauugccuccuc

SEQ ID NO: 178691 - RNA, 23 nt, Human
ugcccacagcgugcccacagaug

SEQ ID NO: 178692 - RNA, 22 nt, Human
ugcccugaagauuagcagcagc

SEQ ID NO: 178693 - RNA, 22 nt, Human
uggcaacaguuuccauaacaac

SEQ ID NO: 178694 - RNA, 21 nt, Human
uggccagggcuaccuugucug

SEQ ID NO: 178695 - RNA, 27 nt, Human
uggccaugccccuccagacugcccuug

SEQ ID NO: 178696 - RNA, 21 nt, Human
ugggcaggugacugccccagg

SEQ ID NO: 178697 - RNA, 21 nt, Human
uggggugguggggagcucagg

SEQ ID NO: 178698 - RNA, 21 nt, Human
uggguacauuuugugugugag

SEQ ID NO: 178699 - RNA, 22 nt, Human
ugggugggugccgucuggcagg

SEQ ID NO: 178700 - RNA, 19 nt, Human
uguaguaggugccccccgc

SEQ ID NO: 178701 - RNA, 19 nt, Human
ugucuguggggccuucccu

SEQ ID NO: 178702 - RNA, 25 nt, Human
uguggcaguggcuuacugggguuaa

SEQ ID NO: 178703 - RNA, 19 nt, Human
uguggggccuucccuuucc

SEQ ID NO: 178704 - RNA, 22 nt, Human
uuagggaaaagcagccggucac

SEQ ID NO: 178705 - RNA, 18 nt, Human
uucaagaggaugagucac

SEQ ID NO: 178706 - RNA, 21 nt, Human
uuccuccucauucuaacgcaa

SEQ ID NO: 178707 - RNA, 21 nt, Human
uugagcccaggaguucaaggu

SEQ ID NO: 178708 - RNA, 24 nt, Human
uuguaugccuagugccaucccucc

SEQ ID NO: 178709 - RNA, 28 nt, Human
uuuuacaauuguaaaauagggcacuacc

SEQ ID NO: 178710 - RNA, 18 nt, Human
aacaaaggcgcccaaagc

SEQ ID NO: 178711 - RNA, 19 nt, Human
acaggcaguguccugggga

SEQ ID NO: 178712 - RNA, 18 nt, Human
cuggggaccacccaacug

SEQ ID NO: 178713 - RNA, 22 nt, Human
ucccaugagcucuggcugacca

SEQ ID NO: 178714 - RNA, 25 nt, Human
uccccacaggcaguguccuggggac

SEQ ID NO: 178715 - RNA, 21 nt, Human
uccgaacaaaggcgcccaaag

SEQ ID NO: 178716 - RNA, 20 nt, Human
ugcacuuuaaugagugcccu

SEQ ID NO: 178717 - RNA, 18 nt, Human
ugcccugccccuauccaa

SEQ ID NO: 178718 - RNA, 23 nt, Human
uguccuggggaccacccaacuga

SEQ ID NO: 178719 - RNA, 18 nt, Human
aaauauuagcauuugucc

SEQ ID NO: 178720 - RNA, 21 nt, Human
aagaagggggaaggaagaaac

SEQ ID NO: 178721 - RNA, 24 nt, Human
acagagccuuccuucccacaugcc

SEQ ID NO: 178722 - RNA, 24 nt, Human
accucaucaaagugaaaauaccac

SEQ ID NO: 178723 - RNA, 25 nt, Human
accucauuucuucuggcagcuccag

SEQ ID NO: 178724 - RNA, 24 nt, Human
acuuuauuaacuuaaaacaucacu

SEQ ID NO: 178725 - RNA, 18 nt, Human
agaaaucuuuaaaauauc

SEQ ID NO: 178726 - RNA, 25 nt, Human
agaaaucuuuaaaauaucagcuuaa

SEQ ID NO: 178727 - RNA, 19 nt, Human
agaaaugauuccuccaaga

SEQ ID NO: 178728 - RNA, 22 nt, Human
agagggcccuggcggcgcgucc

SEQ ID NO: 178729 - RNA, 20 nt, Human
agcagagugguggcaagcag

SEQ ID NO: 178730 - RNA, 18 nt, Human
agcccccggcggagaggg

SEQ ID NO: 178731 - RNA, 22 nt, Human
aggagaccuugacacccaaucc

SEQ ID NO: 178732 - RNA, 22 nt, Human
aggcaagcagggagcagagugg

SEQ ID NO: 178733 - RNA, 24 nt, Human
agggaguggaggcaagcagggagc

SEQ ID NO: 178734 - RNA, 24 nt, Human
agggggaaggaagaaaccugaagg

SEQ ID NO: 178735 - RNA, 22 nt, Human
agucagggguugugacuucagu

SEQ ID NO: 178736 - RNA, 21 nt, Human
augaaugacaucuuguccaca

SEQ ID NO: 178737 - RNA, 19 nt, Human
auggugccugguacuuggu

SEQ ID NO: 178738 - RNA, 23 nt, Human
caaaagaaaggagucaacagacc

SEQ ID NO: 178739 - RNA, 25 nt, Human
caaccucaucaaagugaaaauacca

SEQ ID NO: 178740 - RNA, 22 nt, Human
caagaagggggaaggaagaaac

SEQ ID NO: 178741 - RNA, 30 nt, Human
cacccaaaagaaaggagucaacagaccccc

SEQ ID NO: 178742 - RNA, 22 nt, Human
cagaauucccuccaagaguaag

SEQ ID NO: 178743 - RNA, 23 nt, Human
cagagugguggcaagcagggagg

SEQ ID NO: 178744 - RNA, 18 nt, Human
cagcacccaaaagaaagg

SEQ ID NO: 178745 - RNA, 25 nt, Human
cagcccuacugaagggaggaccucu

SEQ ID NO: 178746 - RNA, 18 nt, Human
cauugcuugugcuuuuac

SEQ ID NO: 178747 - RNA, 26 nt, Human
ccaaaagaaaggagucaacagacccc

SEQ ID NO: 178748 - RNA, 24 nt, Human
ccaaaagaaaggagucaacagacu

SEQ ID NO: 178749 - RNA, 23 nt, Human
ccaagagucccuggagccgcugu

SEQ ID NO: 178750 - RNA, 23 nt, Human
ccagaaggaaaaaaauaaaaguu

SEQ ID NO: 178751 - RNA, 21 nt, Human
cccaauaccuaacauggugcc

SEQ ID NO: 178752 - RNA, 25 nt, Human
cccacggucacuccgagggcuugcu

SEQ ID NO: 178753 - RNA, 20 nt, Human
cccacugcgccccaagaguc

SEQ ID NO: 178754 - RNA, 25 nt, Human
ccgagcccccggcggagagggcccc

SEQ ID NO: 178755 - RNA, 29 nt, Human
ccgagcccccggcggagagggcccuggcg

SEQ ID NO: 178756 - RNA, 20 nt, Human
ccuccaagaguaagaacaga

SEQ ID NO: 178757 - RNA, 25 nt, Human
ccuccaagaguaagaacagacccag

SEQ ID NO: 178758 - RNA, 20 nt, Human
ccucuaauccccucucauua

SEQ ID NO: 178759 - RNA, 19 nt, Human
ccuggagccgcugucaccc

SEQ ID NO: 178760 - RNA, 19 nt, Human
cgaagccuagggagucacu

SEQ ID NO: 178761 - RNA, 22 nt, Human
cucagccccagcccggaggaga

SEQ ID NO: 178762 - RNA, 30 nt, Human
cucagccccagcccggaggagaccuugacc

SEQ ID NO: 178763 - RNA, 23 nt, Human
cuccagugaugagguuuucacag

SEQ ID NO: 178764 - RNA, 25 nt, Human
cuccagugaugagguuuucacagcc

SEQ ID NO: 178765 - RNA, 20 nt, Human
cucuaugguacacauggagg

SEQ ID NO: 178766 - RNA, 24 nt, Human
cugagugaaugaaugacaucuugu

SEQ ID NO: 178767 - RNA, 20 nt, Human
cugcgccccaagagucccug

SEQ ID NO: 178768 - RNA, 18 nt, Human
cugguacuugguagccgg

SEQ ID NO: 178769 - RNA, 23 nt, Human
cuuccacacaaauaucuggggua

SEQ ID NO: 178770 - RNA, 20 nt, Human
cuucugcuucuucuuggggg

SEQ ID NO: 178771 - RNA, 21 nt, Human
gagcagagugguggcaagcag

SEQ ID NO: 178772 - RNA, 23 nt, Human
gagccuauuuguguccgaagccu

SEQ ID NO: 178773 - RNA, 22 nt, Human
gaggagcagucagggguuguga

SEQ ID NO: 178774 - RNA, 27 nt, Human
gcucagccccagcccggaggagaccuu

SEQ ID NO: 178775 - RNA, 22 nt, Human
ggaaaugggaaggacugugggg

SEQ ID NO: 178776 - RNA, 18 nt, Human
gguacuugguagccggug

SEQ ID NO: 178777 - RNA, 24 nt, Human
guaggucaagaagggggaaggaag

SEQ ID NO: 178778 - RNA, 23 nt, Human
uaacacucacucuucuuucuaga

SEQ ID NO: 178779 - RNA, 20 nt, Human
uaccaaccucaucaaaguga

SEQ ID NO: 178780 - RNA, 28 nt, Human
uaccaaccucaucaaagugaaaauacca

SEQ ID NO: 178781 - RNA, 25 nt, Human
uaccucauuucuucuggcagcucca

SEQ ID NO: 178782 - RNA, 20 nt, Human
uagccucgauggugcaucuc

SEQ ID NO: 178783 - RNA, 22 nt, Human
uagcucagaaaucuuuaaaaua

SEQ ID NO: 178784 - RNA, 23 nt, Human
ucagaauucccuccaagaguaag

SEQ ID NO: 178785 - RNA, 20 nt, Human
uccaagaguaagaacagacc

SEQ ID NO: 178786 - RNA, 19 nt, Human
uccccacugcgccccaaga

SEQ ID NO: 178787 - RNA, 21 nt, Human
ucccuggagccgcugucaccc

SEQ ID NO: 178788 - RNA, 22 nt, Human
uccgaagccuagggagucacuu

SEQ ID NO: 178789 - RNA, 25 nt, Human
uccuccucuuccacacaaauaucug

SEQ ID NO: 178790 - RNA, 23 nt, Human
ucugcagacuggaccuggggucu

SEQ ID NO: 178791 - RNA, 20 nt, Human
ucuuguccacaggcauugcu

SEQ ID NO: 178792 - RNA, 24 nt, Human
ugaaaauaccaccuuuccccccuc

SEQ ID NO: 178793 - RNA, 27 nt, Human
ugaagacagagccuuccuucccacaug

SEQ ID NO: 178794 - RNA, 22 nt, Human
ugacuucagucucucuucccca

SEQ ID NO: 178795 - RNA, 19 nt, Human
uggggucuggaaagucaga

SEQ ID NO: 178796 - RNA, 18 nt, Human
uguagcugcugcuugcag

SEQ ID NO: 178797 - RNA, 24 nt, Human
uguuuacaccugauaaaauccaaa

SEQ ID NO: 178798 - RNA, 22 nt, Human
uuaacacucacucuucuuucua

SEQ ID NO: 178799 - RNA, 25 nt, Human
uuagcuuuugaggagcagucagggg

SEQ ID NO: 178800 - RNA, 21 nt, Human
uuccuccaagauuuauaggca

SEQ ID NO: 178801 - RNA, 22 nt, Human
uugcugagugaaugaaugacau

SEQ ID NO: 178802 - RNA, 19 nt, Human
uuuaaaauaucagcuuaac

SEQ ID NO: 178803 - RNA, 22 nt, Human
acaugugggauguccacuucuc

SEQ ID NO: 178804 - RNA, 23 nt, Human
agaaguuggagaaguggagggau

SEQ ID NO: 178805 - RNA, 18 nt, Human
agagucgcccacuugaaa

SEQ ID NO: 178806 - RNA, 21 nt, Human
aggaaagaaaaggagaaagga

SEQ ID NO: 178807 - RNA, 24 nt, Human
aggagaaaggaguccagagggcca

SEQ ID NO: 178808 - RNA, 24 nt, Human
aggagcaagccuggacacagagca

SEQ ID NO: 178809 - RNA, 19 nt, Human
aggaggggcuccacggaug

SEQ ID NO: 178810 - RNA, 24 nt, Human
auugugcacgcuuuuaaauagaga

SEQ ID NO: 178811 - RNA, 18 nt, Human
caagcuguuuuacuaugg

SEQ ID NO: 178812 - RNA, 27 nt, Human
caaugauucccuucuccucuggcgacu

SEQ ID NO: 178813 - RNA, 20 nt, Human
cacagagcauggguagcuag

SEQ ID NO: 178814 - RNA, 18 nt, Human
cacuuggguagaaggcac

SEQ ID NO: 178815 - RNA, 22 nt, Human
ccgugggcuccuccgugggcuc

SEQ ID NO: 178816 - RNA, 22 nt, Human
ccguucggacgcuggggcuccu

SEQ ID NO: 178817 - RNA, 25 nt, Human
ccuggacacagagcauggguagcua

SEQ ID NO: 178818 - RNA, 19 nt, Human
cgagaagaaaauguugaag

SEQ ID NO: 178819 - RNA, 21 nt, Human
cggcuacagaaagccacauac

SEQ ID NO: 178820 - RNA, 22 nt, Human
cucgagggggucugcccguucg

SEQ ID NO: 178821 - RNA, 18 nt, Human
gaaggcacguggaagcug

SEQ ID NO: 178822 - RNA, 20 nt, Human
gagaaguggagggauguggg

SEQ ID NO: 178823 - RNA, 21 nt, Human
gagcacgcagaacauguggga

SEQ ID NO: 178824 - RNA, 21 nt, Human
gagccgugaucagauuaaaca

SEQ ID NO: 178825 - RNA, 18 nt, Human
gcuccuccgugggcuccg

SEQ ID NO: 178826 - RNA, 24 nt, Human
ggacgcuggggcuccuccgugggc

SEQ ID NO: 178827 - RNA, 20 nt, Human
ggaguccagagggccaaugc

SEQ ID NO: 178828 - RNA, 20 nt, Human
ggcuccuccgugggcuccgu

SEQ ID NO: 178829 - RNA, 19 nt, Human
uaaaacuaacucuaguguu

SEQ ID NO: 178830 - RNA, 20 nt, Human
uaaaagguucacaguuacuc

SEQ ID NO: 178831 - RNA, 23 nt, Human
uaccacggcuacagaaagccaca

SEQ ID NO: 178832 - RNA, 20 nt, Human
uaggaugaacaguuuggccg

SEQ ID NO: 178833 - RNA, 18 nt, Human
ucaggacacagagaaaca

SEQ ID NO: 178834 - RNA, 26 nt, Human
ucugcuguaagcaaaagcacuugggu

SEQ ID NO: 178835 - RNA, 22 nt, Human
ugcugccagggcuuaaaaagag

SEQ ID NO: 178836 - RNA, 22 nt, Human
uggaaucagaugaaagguggug

SEQ ID NO: 178837 - RNA, 21 nt, Human
uggacuuauaggaggcauagg

SEQ ID NO: 178838 - RNA, 18 nt, Human
uggagaaguggagggaug

SEQ ID NO: 178839 - RNA, 21 nt, Human
uggaugcaggaggggcuccac

SEQ ID NO: 178840 - RNA, 24 nt, Human
aaaaagcuuggcaucaauguaggc

SEQ ID NO: 178841 - RNA, 21 nt, Human
aaaugcuaguacauauauaaa

SEQ ID NO: 178842 - RNA, 20 nt, Human
aagaggaaacuccgggucug

SEQ ID NO: 178843 - RNA, 18 nt, Human
aaggugaacaucaguacc

SEQ ID NO: 178844 - RNA, 22 nt, Human
aaguuacaaacugucccuuuaa

SEQ ID NO: 178845 - RNA, 23 nt, Human
acagcccaaguuacaaacugucc

SEQ ID NO: 178846 - RNA, 21 nt, Human
agcucgaagggccgaguuggg

SEQ ID NO: 178847 - RNA, 19 nt, Human
agguuuuucacagaagccc

SEQ ID NO: 178848 - RNA, 19 nt, Human
auacagcauaucccaaagc

SEQ ID NO: 178849 - RNA, 24 nt, Human
caaacugucccuuuaaaauacagc

SEQ ID NO: 178850 - RNA, 25 nt, Human
caaagcccacucuugguaagaaucu

SEQ ID NO: 178851 - RNA, 21 nt, Human
cagcugcggcgaggagccagu

SEQ ID NO: 178852 - RNA, 20 nt, Human
caggacgauuuccgagcaga

SEQ ID NO: 178853 - RNA, 20 nt, Human
caucaucaucaucgaaaaca

SEQ ID NO: 178854 - RNA, 23 nt, Human
caucaucgaaaacacagccccag

SEQ ID NO: 178855 - RNA, 24 nt, Human
ccaaaguucagcuccauccaguga

SEQ ID NO: 178856 - RNA, 19 nt, Human
ccaaccuggacucaaccga

SEQ ID NO: 178857 - RNA, 27 nt, Human
ccaccgccgccggcgacucagcuccgg

SEQ ID NO: 178858 - RNA, 27 nt, Human
cccaaguuacaaacugucccuuuaaaa

SEQ ID NO: 178859 - RNA, 18 nt, Human
cccccaaaaaaaucccga

SEQ ID NO: 178860 - RNA, 22 nt, Human
ccccccaaaaaaaucccgagcc

SEQ ID NO: 178861 - RNA, 20 nt, Human
ccccgaaggaucacaagaag

SEQ ID NO: 178862 - RNA, 18 nt, Human
ccccuccuucccuuuccg

SEQ ID NO: 178863 - RNA, 22 nt, Human
ccccuccuucccuuuccgggcu

SEQ ID NO: 178864 - RNA, 18 nt, Human
cccgcccccccaaaaaaa

SEQ ID NO: 178865 - RNA, 23 nt, Human
cgacccaaccuggacucaaccga

SEQ ID NO: 178866 - RNA, 23 nt, Human
cuaggaaaagaaaaaaaagaaaa

SEQ ID NO: 178867 - RNA, 26 nt, Human
cuccuaaacuggaauuucagcuauac

SEQ ID NO: 178868 - RNA, 18 nt, Human
cuugccgagggagcucag

SEQ ID NO: 178869 - RNA, 21 nt, Human
gaaaaaaaaaaaauguuccag

SEQ ID NO: 178870 - RNA, 28 nt, Human
gagaacaggaaacagauaaccgguaccc

SEQ ID NO: 178871 - RNA, 18 nt, Human
gcccaaaguucagcucca

SEQ ID NO: 178872 - RNA, 22 nt, Human
gcuaggaaaagaaaaaaaagaa

SEQ ID NO: 178873 - RNA, 21 nt, Human
ggaagcggcgcggagaauggc

SEQ ID NO: 178874 - RNA, 18 nt, Human
ggaggcgguuccgcuuuu

SEQ ID NO: 178875 - RNA, 19 nt, Human
ggccagaaguaaaacuguu

SEQ ID NO: 178876 - RNA, 26 nt, Human
ggcgggaggcgguuccgcuuuuaggg

SEQ ID NO: 178877 - RNA, 24 nt, Human
guaagaaucuucuuuguggcaaaa

SEQ ID NO: 178878 - RNA, 24 nt, Human
guuuuuucuuuuguacaagagugc

SEQ ID NO: 178879 - RNA, 23 nt, Human
uaagaaucuucuuuguggcaaaa

SEQ ID NO: 178880 - RNA, 25 nt, Human
uacaguacauaaacaucagcgugga

SEQ ID NO: 178881 - RNA, 19 nt, Human
uaggaaaagaaaaaaaaga

SEQ ID NO: 178882 - RNA, 18 nt, Human
uaggaaaggccagaagua

SEQ ID NO: 178883 - RNA, 20 nt, Human
uaucccaaagccuucugagu

SEQ ID NO: 178884 - RNA, 25 nt, Human
ucacagaagccccgaaggaucacaa

SEQ ID NO: 178885 - RNA, 28 nt, Human
ucagggcaaugguguccccgcccccucc

SEQ ID NO: 178886 - RNA, 20 nt, Human
ucauuaaaggagauauggga

SEQ ID NO: 178887 - RNA, 20 nt, Human
uccccgcccccccaaaaaaa

SEQ ID NO: 178888 - RNA, 18 nt, Human
uccccgcccccuccuucc

SEQ ID NO: 178889 - RNA, 24 nt, Human
uccccgcccccuccuucccuuucc

SEQ ID NO: 178890 - RNA, 22 nt, Human
uccccggacagcugugcugcuc

SEQ ID NO: 178891 - RNA, 19 nt, Human
ugaacaucaguaccagcug

SEQ ID NO: 178892 - RNA, 22 nt, Human
ugcgcuaggaaaagaaaaaaaa

SEQ ID NO: 178893 - RNA, 21 nt, Human
uggaagcggcgcggagaaugg

SEQ ID NO: 178894 - RNA, 25 nt, Human
uuaaaauacagcauaucccaaagcc

SEQ ID NO: 178895 - RNA, 25 nt, Human
uugaauggaacuguuucucaacuga

SEQ ID NO: 178896 - RNA, 23 nt, Human
uugcuuuacagcccaaguuacaa

SEQ ID NO: 178897 - RNA, 23 nt, Human
uuggaagcggcgcggagaauggc

SEQ ID NO: 178898 - RNA, 27 nt, Human
aaaaccaucuccauccuugaggcacuc

SEQ ID NO: 178899 - RNA, 19 nt, Human
aaaccugggaggagacagg

SEQ ID NO: 178900 - RNA, 24 nt, Human
aaagagaaaggggaaaggaggagg

SEQ ID NO: 178901 - RNA, 22 nt, Human
aacaacaacaauaauaauagcc

SEQ ID NO: 178902 - RNA, 22 nt, Human
aaccugggaggagacagguuca

SEQ ID NO: 178903 - RNA, 24 nt, Human
aagaaaggggaaaccacacaauau

SEQ ID NO: 178904 - RNA, 24 nt, Human
aauaauaguaguaacaacaacaau

SEQ ID NO: 178905 - RNA, 18 nt, Human
aaucagccccaaauccaa

SEQ ID NO: 178906 - RNA, 21 nt, Human
acaaaaacuucuccagagaag

SEQ ID NO: 178907 - RNA, 21 nt, Human
accagcugcagacccaccagc

SEQ ID NO: 178908 - RNA, 21 nt, Human
acccacgagaaagcaaagaag

SEQ ID NO: 178909 - RNA, 18 nt, Human
acccccuccaccgccauc

SEQ ID NO: 178910 - RNA, 24 nt, Human
agaaaccugggaggagacagguuu

SEQ ID NO: 178911 - RNA, 18 nt, Human
agaaagaagcuggugccc

SEQ ID NO: 178912 - RNA, 23 nt, Human
agaagacagcaggaaagcuugag

SEQ ID NO: 178913 - RNA, 26 nt, Human
agaagacagcaggaaagcuugagggc

SEQ ID NO: 178914 - RNA, 19 nt, Human
agacccaccagccccaccc

SEQ ID NO: 178915 - RNA, 24 nt, Human
agagagaaaaacaccaggagaaag

SEQ ID NO: 178916 - RNA, 19 nt, Human
agagucccuuccgcugcag

SEQ ID NO: 178917 - RNA, 21 nt, Human
agcaaagaagccaacaaagga

SEQ ID NO: 178918 - RNA, 21 nt, Human
agcacggugcgaacccccucc

SEQ ID NO: 178919 - RNA, 20 nt, Human
agcaggaaagcuugagggcc

SEQ ID NO: 178920 - RNA, 19 nt, Human
agcagugguaaucagcccc

SEQ ID NO: 178921 - RNA, 22 nt, Human
agccaagcagugguaaucagcc

SEQ ID NO: 178922 - RNA, 18 nt, Human
agcgacaaggugggaaaa

SEQ ID NO: 178923 - RNA, 25 nt, Human
aggaaagaaaggggaaaccacacaa

SEQ ID NO: 178924 - RNA, 18 nt, Human
aggaaagagaaaggggaa

SEQ ID NO: 178925 - RNA, 23 nt, Human
aggaggaggagggagaagacagc

SEQ ID NO: 178926 - RNA, 18 nt, Human
aggagggagaagacagca

SEQ ID NO: 178927 - RNA, 18 nt, Human
aggcacagcccagagucc

SEQ ID NO: 178928 - RNA, 24 nt, Human
aggccugccaaaggacccacgaga

SEQ ID NO: 178929 - RNA, 18 nt, Human
aggcucuuguccggucuc

SEQ ID NO: 178930 - RNA, 19 nt, Human
agugaagggcauuucuaga

SEQ ID NO: 178931 - RNA, 18 nt, Human
auguguauauacauauau

SEQ ID NO: 178932 - RNA, 22 nt, Human
auuauagacaacaguauuaaaa

SEQ ID NO: 178933 - RNA, 20 nt, Human
caacaauaauaauagccaag

SEQ ID NO: 178934 - RNA, 18 nt, Human
cacacaauauauguauau

SEQ ID NO: 178935 - RNA, 19 nt, Human
caccagagcccagccaggc

SEQ ID NO: 178936 - RNA, 22 nt, Human
cacuccgugcuacagucagggg

SEQ ID NO: 178937 - RNA, 22 nt, Human
cagcaggaaagcuugagggccc

SEQ ID NO: 178938 - RNA, 24 nt, Human
cagcaggaaagcuugagggcccac

SEQ ID NO: 178939 - RNA, 22 nt, Human
caggagcccccaccagagccca

SEQ ID NO: 178940 - RNA, 20 nt, Human
caggcacagcccagaguccc

SEQ ID NO: 178941 - RNA, 18 nt, Human
caggcucuuguccggucu

SEQ ID NO: 178942 - RNA, 20 nt, Human
cagugguaaucagccccaaa

SEQ ID NO: 178943 - RNA, 24 nt, Human
caucuccauccuugaagccaaagg

SEQ ID NO: 178944 - RNA, 21 nt, Human
ccacaccagcugcagacccac

SEQ ID NO: 178945 - RNA, 22 nt, Human
ccaccagccccacccgagggca

SEQ ID NO: 178946 - RNA, 22 nt, Human
ccagagaagaaaccugggagga

SEQ ID NO: 178947 - RNA, 22 nt, Human
ccagccagccucaggcacagcc

SEQ ID NO: 178948 - RNA, 21 nt, Human
ccagccaggcugacuggggca

SEQ ID NO: 178949 - RNA, 19 nt, Human
ccagcugcagacccaccag

SEQ ID NO: 178950 - RNA, 23 nt, Human
ccccaacacuccgugcuacaguc

SEQ ID NO: 178951 - RNA, 23 nt, Human
ccccagccccaacacuccgugcu

SEQ ID NO: 178952 - RNA, 18 nt, Human
cccccagccccaacacuc

SEQ ID NO: 178953 - RNA, 19 nt, Human
ccccgcugccccgcugacc

SEQ ID NO: 178954 - RNA, 18 nt, Human
ccccucccucuccccaaa

SEQ ID NO: 178955 - RNA, 23 nt, Human
ccggcaccagaguuuccccugcc

SEQ ID NO: 178956 - RNA, 22 nt, Human
ccucauggccagccccgcugcc

SEQ ID NO: 178957 - RNA, 23 nt, Human
ccucauggccagccccgcugccc

SEQ ID NO: 178958 - RNA, 23 nt, Human
ccuccuggagcuggcccccagcc

SEQ ID NO: 178959 - RNA, 22 nt, Human
ccucgccacaagggcucuccca

SEQ ID NO: 178960 - RNA, 21 nt, Human
ccucuggcuggaggggguggg

SEQ ID NO: 178961 - RNA, 19 nt, Human
cgaacccccuccaccgcca

SEQ ID NO: 178962 - RNA, 20 nt, Human
cgaacccccuccaccgccau

SEQ ID NO: 178963 - RNA, 23 nt, Human
cgaacccccuccaccgccauccg

SEQ ID NO: 178964 - RNA, 19 nt, Human
cgagaaagcaaagaagcca

SEQ ID NO: 178965 - RNA, 24 nt, Human
cgagaaagcaaagaagccaacaaa

SEQ ID NO: 178966 - RNA, 18 nt, Human
cgagggcagagagggagg

SEQ ID NO: 178967 - RNA, 23 nt, Human
cgauucucgccucuggcuggagg

SEQ ID NO: 178968 - RNA, 24 nt, Human
cggcaccagaguuuccccugccag

SEQ ID NO: 178969 - RNA, 18 nt, Human
cucccuuggguaaaaaaa

SEQ ID NO: 178970 - RNA, 20 nt, Human
cucucaagcccuccuggagc

SEQ ID NO: 178971 - RNA, 22 nt, Human
cucugcuucagaaggguccaga

SEQ ID NO: 178972 - RNA, 21 nt, Human
cugccagcccccagcgggucc

SEQ ID NO: 178973 - RNA, 24 nt, Human
cugccaggggaccccugggccagc

SEQ ID NO: 178974 - RNA, 21 nt, Human
cugccccgcugaccgaugccc

SEQ ID NO: 178975 - RNA, 21 nt, Human
cugccccgcugaccgaugccc

SEQ ID NO: 178976 - RNA, 19 nt, Human
cugcugccucucgacgccc

SEQ ID NO: 178977 - RNA, 20 nt, Human
cugcugccucucgacgcccc

SEQ ID NO: 178978 - RNA, 19 nt, Human
gaaagagaaaggggaaagg

SEQ ID NO: 178979 - RNA, 22 nt, Human
gaagacagcaggaaagcuugag

SEQ ID NO: 178980 - RNA, 20 nt, Human
gagaaagcaaagaagccaac

SEQ ID NO: 178981 - RNA, 21 nt, Human
gagggcaaaaccaucuccauc

SEQ ID NO: 178982 - RNA, 20 nt, Human
gaugaagaucccgaguccug

SEQ ID NO: 178983 - RNA, 25 nt, Human
gcaaaaccaucuccauccuugaagc

SEQ ID NO: 178984 - RNA, 19 nt, Human
gcacagcccagagucccuu

SEQ ID NO: 178985 - RNA, 21 nt, Human
gcaccagaguuuccccugcca

SEQ ID NO: 178986 - RNA, 18 nt, Human
gcccagagucccuuccgc

SEQ ID NO: 178987 - RNA, 18 nt, Human
gcugccccgcugaccgau

SEQ ID NO: 178988 - RNA, 18 nt, Human
ggaaaggaggaggaggga

SEQ ID NO: 178989 - RNA, 23 nt, Human
ggaggagacagguucagcgacaa

SEQ ID NO: 178990 - RNA, 19 nt, Human
ggaucaggagcccccaccg

SEQ ID NO: 178991 - RNA, 24 nt, Human
ggcaaaaccaucuccauccuugaa

SEQ ID NO: 178992 - RNA, 18 nt, Human
ggcuggaggggguggggu

SEQ ID NO: 178993 - RNA, 19 nt, Human
gggaaaggaggaggaggga

SEQ ID NO: 178994 - RNA, 21 nt, Human
gggcagccuggggaagcagcu

SEQ ID NO: 178995 - RNA, 21 nt, Human
gggguggggugagaggcgggc

SEQ ID NO: 178996 - RNA, 22 nt, Human
ggguccccagagugggcagccu

SEQ ID NO: 178997 - RNA, 23 nt, Human
gucuaggaaaugaggaaagagaa

SEQ ID NO: 178998 - RNA, 22 nt, Human
gugcugcagacacacacccggc

SEQ ID NO: 178999 - RNA, 20 nt, Human
gugugugugugucugugugu

SEQ ID NO: 179000 - RNA, 25 nt, Human
uaacaacaacaauaauaauagccaa

SEQ ID NO: 179001 - RNA, 22 nt, Human
uacaaaaacuucuccagagaag

SEQ ID NO: 179002 - RNA, 20 nt, Human
uauauggauguguauauaca

SEQ ID NO: 179003 - RNA, 20 nt, Human
uauauggauguguauauaca

SEQ ID NO: 179004 - RNA, 22 nt, Human
uauauguauauggauguguaua

SEQ ID NO: 179005 - RNA, 24 nt, Human
uauauguauauggauguguauaua

SEQ ID NO: 179006 - RNA, 26 nt, Human
uauauguauauggauguguauauaca

SEQ ID NO: 179007 - RNA, 23 nt, Human
uauguacauacaguugacguacg

SEQ ID NO: 179008 - RNA, 22 nt, Human
uauguauauggauguguauaua

SEQ ID NO: 179009 - RNA, 22 nt, Human
uauguuaggagaggagccccgg

SEQ ID NO: 179010 - RNA, 18 nt, Human
uccagagaagaaaccugg

SEQ ID NO: 179011 - RNA, 25 nt, Human
uccagagagaaaaacaccaggagaa

SEQ ID NO: 179012 - RNA, 22 nt, Human
ucccagcuaguccacccgauga

SEQ ID NO: 179013 - RNA, 18 nt, Human
uccccaaagggaggccug

SEQ ID NO: 179014 - RNA, 22 nt, Human
uccccagagugggcagccuggg

SEQ ID NO: 179015 - RNA, 20 nt, Human
ucccgaguccugcgauucuc

SEQ ID NO: 179016 - RNA, 21 nt, Human
uccggucucugcuucagaagg

SEQ ID NO: 179017 - RNA, 22 nt, Human
ucgccacaagggcucucccagg

SEQ ID NO: 179018 - RNA, 21 nt, Human
ucuccccucccucuccccaaa

SEQ ID NO: 179019 - RNA, 20 nt, Human
ucucgacgccccccuugccc

SEQ ID NO: 179020 - RNA, 21 nt, Human
ucucuccccucccucucccca

SEQ ID NO: 179021 - RNA, 22 nt, Human
ucucuccccucccucuccccaa

SEQ ID NO: 179022 - RNA, 18 nt, Human
ugccaggggaccccuggg

SEQ ID NO: 179023 - RNA, 24 nt, Human
ugccucgccacaagggcucuccca

SEQ ID NO: 179024 - RNA, 21 nt, Human
ugcgaacccccuccaccgcca

SEQ ID NO: 179025 - RNA, 21 nt, Human
uggacccucauggccagcccc

SEQ ID NO: 179026 - RNA, 19 nt, Human
uggaugcggaucaggagcc

SEQ ID NO: 179027 - RNA, 19 nt, Human
ugggaggagacagguucag

SEQ ID NO: 179028 - RNA, 22 nt, Human
ugggaggagacagguucagcga

SEQ ID NO: 179029 - RNA, 24 nt, Human
ugggcagccuggggaagcagcugu

SEQ ID NO: 179030 - RNA, 19 nt, Human
ugggccagcucucaggcug

SEQ ID NO: 179031 - RNA, 23 nt, Human
ugggguauuauuuccauaguuuu

SEQ ID NO: 179032 - RNA, 21 nt, Human
uggucucuccccucccucucc

SEQ ID NO: 179033 - RNA, 22 nt, Human
uguauauggauguguauauaca

SEQ ID NO: 179034 - RNA, 23 nt, Human
uguauauggauguguauauacau

SEQ ID NO: 179035 - RNA, 19 nt, Human
ugucuuucucccuugggua

SEQ ID NO: 179036 - RNA, 18 nt, Human
uguguauauacauauaug

SEQ ID NO: 179037 - RNA, 19 nt, Human
ugugugugucugugugugu

SEQ ID NO: 179038 - RNA, 18 nt, Human
uguugcuuaaaaaaagga

SEQ ID NO: 179039 - RNA, 23 nt, Human
uguugcuuaaaaaaaggaaagaa

SEQ ID NO: 179040 - RNA, 20 nt, Human
uucaaaaauauucugacucg

SEQ ID NO: 179041 - RNA, 20 nt, Human
uuccccugccaggggacccc

SEQ ID NO: 179042 - RNA, 24 nt, Human
uuguccugcccccagccagccuca

SEQ ID NO: 179043 - RNA, 18 nt, Human
aagcagagucaaaccaca

SEQ ID NO: 179044 - RNA, 18 nt, Human
acacagccccucccucuc

SEQ ID NO: 179045 - RNA, 18 nt, Human
accacacaccagagugca

SEQ ID NO: 179046 - RNA, 25 nt, Human
accagagugcaaauagcugggggug

SEQ ID NO: 179047 - RNA, 22 nt, Human
acccuugagcccccacaguccc

SEQ ID NO: 179048 - RNA, 22 nt, Human
agaaaagcagagucaaaccaca

SEQ ID NO: 179049 - RNA, 20 nt, Human
agacacccauaggaggcccc

SEQ ID NO: 179050 - RNA, 18 nt, Human
aggccaaugaaugaagga

SEQ ID NO: 179051 - RNA, 23 nt, Human
agggggaagagucacuugaggcc

SEQ ID NO: 179052 - RNA, 21 nt, Human
agugaccggucccucugcccc

SEQ ID NO: 179053 - RNA, 21 nt, Human
augaaggagacacaccgagaa

SEQ ID NO: 179054 - RNA, 22 nt, Human
caaguucuuccaaggcuacacu

SEQ ID NO: 179055 - RNA, 19 nt, Human
cacaaacccaggcccagcc

SEQ ID NO: 179056 - RNA, 22 nt, Human
cacaaacccaggcccagccucc

SEQ ID NO: 179057 - RNA, 23 nt, Human
cacaaacccaggcccagccuccu

SEQ ID NO: 179058 - RNA, 23 nt, Human
caccagagugcaaauagcugggg

SEQ ID NO: 179059 - RNA, 18 nt, Human
cacggacagauggaugga

SEQ ID NO: 179060 - RNA, 25 nt, Human
cacuggguuccuauggaggaggccu

SEQ ID NO: 179061 - RNA, 21 nt, Human
cagcaggggcggggccggagc

SEQ ID NO: 179062 - RNA, 22 nt, Human
cagccccucccucuccaggucc

SEQ ID NO: 179063 - RNA, 18 nt, Human
caugacccaaguucuucc

SEQ ID NO: 179064 - RNA, 19 nt, Human
caugggccucuggcauuac

SEQ ID NO: 179065 - RNA, 20 nt, Human
cauuacccuugagcccccac

SEQ ID NO: 179066 - RNA, 23 nt, Human
ccagagugcaaauagcugggggu

SEQ ID NO: 179067 - RNA, 19 nt, Human
ccaggucccggugauggag

SEQ ID NO: 179068 - RNA, 21 nt, Human
cccagccuggcccccugaggc

SEQ ID NO: 179069 - RNA, 25 nt, Human
cccaugacccaaguucuuccaaggc

SEQ ID NO: 179070 - RNA, 25 nt, Human
ccccaacagcugugcuuccucccca

SEQ ID NO: 179071 - RNA, 20 nt, Human
ccccacagccccucgcuggg

SEQ ID NO: 179072 - RNA, 22 nt, Human
ccccacagucccucagggggcc

SEQ ID NO: 179073 - RNA, 23 nt, Human
ccccacagucccucagggggccc

SEQ ID NO: 179074 - RNA, 18 nt, Human
ccccagcugggguugggg

SEQ ID NO: 179075 - RNA, 22 nt, Human
ccccccagucacuggguuccua

SEQ ID NO: 179076 - RNA, 20 nt, Human
ccccucccucuccagguccc

SEQ ID NO: 179077 - RNA, 19 nt, Human
cccucugccccuuccucuc

SEQ ID NO: 179078 - RNA, 20 nt, Human
ccggagcaggagggggaaga

SEQ ID NO: 179079 - RNA, 18 nt, Human
ccucccucuccagguccc

SEQ ID NO: 179080 - RNA, 23 nt, Human
ccucugccccuuccucuccccag

SEQ ID NO: 179081 - RNA, 22 nt, Human
ccugagguccuggcccuucccc

SEQ ID NO: 179082 - RNA, 22 nt, Human
cggaagaaaagcagagucaaac

SEQ ID NO: 179083 - RNA, 20 nt, Human
cucacacacugaccccacuu

SEQ ID NO: 179084 - RNA, 21 nt, Human
cuccagcauggcccccgaguu

SEQ ID NO: 179085 - RNA, 23 nt, Human
cugaggcugugaccacagggcca

SEQ ID NO: 179086 - RNA, 24 nt, Human
cuuccaaggcuacacagccccucc

SEQ ID NO: 179087 - RNA, 20 nt, Human
cuucccauaaggcauaagag

SEQ ID NO: 179088 - RNA, 24 nt, Human
cuugagcccccacagucccucagg

SEQ ID NO: 179089 - RNA, 19 nt, Human
gaaggagacacaccgagaa

SEQ ID NO: 179090 - RNA, 19 nt, Human
gaccacagggccaauccgg

SEQ ID NO: 179091 - RNA, 20 nt, Human
gcaaagggaaacccccagga

SEQ ID NO: 179092 - RNA, 21 nt, Human
gccaggugagguucccccagc

SEQ ID NO: 179093 - RNA, 18 nt, Human
gccuacaggggugugggg

SEQ ID NO: 179094 - RNA, 20 nt, Human
gcuccagcauggcccccgag

SEQ ID NO: 179095 - RNA, 19 nt, Human
ggacagacguaagacaccc

SEQ ID NO: 179096 - RNA, 19 nt, Human
ggagaagcaccaggccugg

SEQ ID NO: 179097 - RNA, 18 nt, Human
ggauggacagacguaaga

SEQ ID NO: 179098 - RNA, 24 nt, Human
ggccaugggcaacaaagggugucc

SEQ ID NO: 179099 - RNA, 22 nt, Human
ggcccaauggcaaagggaaacc

SEQ ID NO: 179100 - RNA, 22 nt, Human
ggcugggccuucccauaaggcc

SEQ ID NO: 179101 - RNA, 19 nt, Human
gggccggagcaggaggggg

SEQ ID NO: 179102 - RNA, 21 nt, Human
gggccucuggcauuacccuug

SEQ ID NO: 179103 - RNA, 21 nt, Human
gggcugggccugagguccugg

SEQ ID NO: 179104 - RNA, 19 nt, Human
ggggcugggccugaggucc

SEQ ID NO: 179105 - RNA, 20 nt, Human
gguccccagcuccagcaugg

SEQ ID NO: 179106 - RNA, 22 nt, Human
gguuggggcugggccugagguc

SEQ ID NO: 179107 - RNA, 24 nt, Human
gucaccccccagucacuggguucc

SEQ ID NO: 179108 - RNA, 20 nt, Human
gucccucugccccuuccucu

SEQ ID NO: 179109 - RNA, 20 nt, Human
guguaggcgucaccccccag

SEQ ID NO: 179110 - RNA, 22 nt, Human
uaaggcauaagagacagguggg

SEQ ID NO: 179111 - RNA, 18 nt, Human
uacccuugagcccccaca

SEQ ID NO: 179112 - RNA, 22 nt, Human
uacccuugagcccccacagucc

SEQ ID NO: 179113 - RNA, 20 nt, Human
uauggaggaggccuaagcug

SEQ ID NO: 179114 - RNA, 21 nt, Human
ucaaaccacacaccagagugc

SEQ ID NO: 179115 - RNA, 23 nt, Human
ucaaaccacacaccagagugcaa

SEQ ID NO: 179116 - RNA, 22 nt, Human
ucacuggguuccuauggaggag

SEQ ID NO: 179117 - RNA, 23 nt, Human
ucacuggguuccuauggaggagg

SEQ ID NO: 179118 - RNA, 20 nt, Human
uccaggucccggugauggag

SEQ ID NO: 179119 - RNA, 24 nt, Human
uccaggucccggugauggagaccc

SEQ ID NO: 179120 - RNA, 19 nt, Human
uccuuggccaccaaugccu

SEQ ID NO: 179121 - RNA, 22 nt, Human
ucgcuggggccaugggccucug

SEQ ID NO: 179122 - RNA, 19 nt, Human
ucugccccuuccucucccc

SEQ ID NO: 179123 - RNA, 20 nt, Human
ucugccccuuccucucccca

SEQ ID NO: 179124 - RNA, 23 nt, Human
ugccccuuccucuccccagcccc

SEQ ID NO: 179125 - RNA, 21 nt, Human
uggauggacagacguaagaca

SEQ ID NO: 179126 - RNA, 20 nt, Human
uggauggacagacguaagag

SEQ ID NO: 179127 - RNA, 20 nt, Human
uggggcugggccugaggucc

SEQ ID NO: 179128 - RNA, 20 nt, Human
ugggguuggggcugggccug

SEQ ID NO: 179129 - RNA, 20 nt, Human
uuuggcucagcaggggcggg

SEQ ID NO: 179130 - RNA, 19 nt, Human
aaaugauucacuuuugacu

SEQ ID NO: 179131 - RNA, 19 nt, Human
aacauggucugugccaccu

SEQ ID NO: 179132 - RNA, 18 nt, Human
aagacagcgaggggcagg

SEQ ID NO: 179133 - RNA, 19 nt, Human
aagacagcgaggggcaggg

SEQ ID NO: 179134 - RNA, 23 nt, Human
aagcauggaauugcaacagggcu

SEQ ID NO: 179135 - RNA, 19 nt, Human
aagccuggcaaggggcagg

SEQ ID NO: 179136 - RNA, 18 nt, Human
agaaaugcccagggcccc

SEQ ID NO: 179137 - RNA, 21 nt, Human
agacccccaccccccaccccc

SEQ ID NO: 179138 - RNA, 23 nt, Human
agagacccccaccccccaccccc

SEQ ID NO: 179139 - RNA, 19 nt, Human
agaggcagggcuggggacu

SEQ ID NO: 179140 - RNA, 18 nt, Human
agccauuugccacgaagc

SEQ ID NO: 179141 - RNA, 27 nt, Human
agcgaggggcagggaagggauaugacc

SEQ ID NO: 179142 - RNA, 23 nt, Human
aggcaccuuccugggccaccucc

SEQ ID NO: 179143 - RNA, 20 nt, Human
agggaggaaccagggaacag

SEQ ID NO: 179144 - RNA, 18 nt, Human
agguagucaguaggaugg

SEQ ID NO: 179145 - RNA, 27 nt, Human
aucaccuccagacccaacaucucgcug

SEQ ID NO: 179146 - RNA, 22 nt, Human
aucucaucaccuccagacccaa

SEQ ID NO: 179147 - RNA, 19 nt, Human
augaagcagugaaaccugc

SEQ ID NO: 179148 - RNA, 22 nt, Human
augaagcagugaaaccugcuug

SEQ ID NO: 179149 - RNA, 27 nt, Human
auggcagcaggagcugguuggcggggg

SEQ ID NO: 179150 - RNA, 20 nt, Human
auugcaacagggcugcagcc

SEQ ID NO: 179151 - RNA, 19 nt, Human
caaaacaagggcagcagag

SEQ ID NO: 179152 - RNA, 20 nt, Human
caaaacaagggcagcagagc

SEQ ID NO: 179153 - RNA, 20 nt, Human
caacagggcugcagccccuu

SEQ ID NO: 179154 - RNA, 21 nt, Human
caagcacacaacucaucacuc

SEQ ID NO: 179155 - RNA, 21 nt, Human
caagcuggcgggggccaagca

SEQ ID NO: 179156 - RNA, 19 nt, Human
caccccccaccccaguggc

SEQ ID NO: 179157 - RNA, 19 nt, Human
caccccccaccccccaccc

SEQ ID NO: 179158 - RNA, 22 nt, Human
caccuacgccaagccugggggu

SEQ ID NO: 179159 - RNA, 21 nt, Human
cacuccgcaccccugacagca

SEQ ID NO: 179160 - RNA, 22 nt, Human
cacuccgcaccccugacagcau

SEQ ID NO: 179161 - RNA, 22 nt, Human
cacuccguggccauuccaggac

SEQ ID NO: 179162 - RNA, 23 nt, Human
cacugaccucaacaguaacgagu

SEQ ID NO: 179163 - RNA, 22 nt, Human
cagcaaaacaagggcagcagag

SEQ ID NO: 179164 - RNA, 22 nt, Human
cagcagcaguuugguucucagc

SEQ ID NO: 179165 - RNA, 18 nt, Human
cagcagcuagaguggcug

SEQ ID NO: 179166 - RNA, 19 nt, Human
cagcaggagcugguuggcg

SEQ ID NO: 179167 - RNA, 18 nt, Human
caggagcugguuggcggg

SEQ ID NO: 179168 - RNA, 24 nt, Human
cagggcugcagcagccagucucug

SEQ ID NO: 179169 - RNA, 21 nt, Human
cagggcugcagccccuugggc

SEQ ID NO: 179170 - RNA, 22 nt, Human
ccacaccacaugccaucuggug

SEQ ID NO: 179171 - RNA, 18 nt, Human
ccacaucaaagcuacaag

SEQ ID NO: 179172 - RNA, 22 nt, Human
ccacaucaaagcuacaagcacu

SEQ ID NO: 179173 - RNA, 18 nt, Human
ccaccccccaccccccac

SEQ ID NO: 179174 - RNA, 25 nt, Human
ccaccuuccuuuccccagagauguc

SEQ ID NO: 179175 - RNA, 18 nt, Human
cccaacaucucgcugaca

SEQ ID NO: 179176 - RNA, 21 nt, Human
cccaguggcuucagugaaugc

SEQ ID NO: 179177 - RNA, 23 nt, Human
cccauaguaaggaauaaggaagc

SEQ ID NO: 179178 - RNA, 24 nt, Human
ccccaguggcuucagugaaugcca

SEQ ID NO: 179179 - RNA, 18 nt, Human
cccccaccccccacccca

SEQ ID NO: 179180 - RNA, 23 nt, Human
cccccaccccccaccccaguggc

SEQ ID NO: 179181 - RNA, 24 nt, Human
cccccaccccccaccccccacccc

SEQ ID NO: 179182 - RNA, 20 nt, Human
ccccccaccccccaccccag

SEQ ID NO: 179183 - RNA, 19 nt, Human
ccccuugggccgugcaucu

SEQ ID NO: 179184 - RNA, 22 nt, Human
cccugacagcauauggccacuu

SEQ ID NO: 179185 - RNA, 22 nt, Human
ccucaguagcuggggaacaguu

SEQ ID NO: 179186 - RNA, 22 nt, Human
ccugaggccuccuguguccagc

SEQ ID NO: 179187 - RNA, 18 nt, Human
ccuggcuucaagguggag

SEQ ID NO: 179188 - RNA, 24 nt, Human
ccuuauucugggccaggcaccuuc

SEQ ID NO: 179189 - RNA, 25 nt, Human
cgggaccagagcccuccucgucuca

SEQ ID NO: 179190 - RNA, 21 nt, Human
cugaccucaacaguaacgagu

SEQ ID NO: 179191 - RNA, 18 nt, Human
cugcagcagccagucucu

SEQ ID NO: 179192 - RNA, 19 nt, Human
cugggcagcacauuaggac

SEQ ID NO: 179193 - RNA, 21 nt, Human
cuuguucaccugggcuccgca

SEQ ID NO: 179194 - RNA, 22 nt, Human
cuuguucaccugggcuccgcaa

SEQ ID NO: 179195 - RNA, 21 nt, Human
cuuuagagacccccacccccc

SEQ ID NO: 179196 - RNA, 22 nt, Human
gacaagcuggcgggggccaagc

SEQ ID NO: 179197 - RNA, 20 nt, Human
gacccaacaucucgcugaca

SEQ ID NO: 179198 - RNA, 19 nt, Human
gacccccaccccccacccc

SEQ ID NO: 179199 - RNA, 20 nt, Human
gacccccaccccccaccccc

SEQ ID NO: 179200 - RNA, 23 nt, Human
gacccccaccccccaccccccac

SEQ ID NO: 179201 - RNA, 21 nt, Human
gagaaggggaaauacuggcuc

SEQ ID NO: 179202 - RNA, 20 nt, Human
gcaaaacaagggcagcagag

SEQ ID NO: 179203 - RNA, 24 nt, Human
gcagcaggagcugguuggcggggg

SEQ ID NO: 179204 - RNA, 20 nt, Human
gcagccugccuggcuucaag

SEQ ID NO: 179205 - RNA, 20 nt, Human
gcagcuagaguggcugggac

SEQ ID NO: 179206 - RNA, 26 nt, Human
gccaccuuccuuuccccagagauguc

SEQ ID NO: 179207 - RNA, 19 nt, Human
gccagggacaagcacacaa

SEQ ID NO: 179208 - RNA, 18 nt, Human
gcugguuggcgggggaag

SEQ ID NO: 179209 - RNA, 24 nt, Human
gcuucagugaaugccaguagaagg

SEQ ID NO: 179210 - RNA, 23 nt, Human
gcuuguucaccugggcuccgcaa

SEQ ID NO: 179211 - RNA, 22 nt, Human
ggaagccuggcaaggggcaggg

SEQ ID NO: 179212 - RNA, 23 nt, Human
ggacaagcuggcgggggccaagc

SEQ ID NO: 179213 - RNA, 18 nt, Human
ggacacagccugccacug

SEQ ID NO: 179214 - RNA, 21 nt, Human
ggaguacaugucccaggauca

SEQ ID NO: 179215 - RNA, 26 nt, Human
ggauggcagcaggagcugguuggcgg

SEQ ID NO: 179216 - RNA, 21 nt, Human
ggccaaauuccauguccugcc

SEQ ID NO: 179217 - RNA, 18 nt, Human
ggcugcagccccuugggc

SEQ ID NO: 179218 - RNA, 18 nt, Human
gggaggaaccagggaaca

SEQ ID NO: 179219 - RNA, 18 nt, Human
gggaggccaaagcaguag

SEQ ID NO: 179220 - RNA, 23 nt, Human
gggcagccugccuggcuucaagg

SEQ ID NO: 179221 - RNA, 23 nt, Human
uaacaugcagcaaaacaagggca

SEQ ID NO: 179222 - RNA, 24 nt, Human
uaauuccacagacauucccagggc

SEQ ID NO: 179223 - RNA, 23 nt, Human
uagagacccccaccccccacccc

SEQ ID NO: 179224 - RNA, 25 nt, Human
uagagacccccaccccccacccccc

SEQ ID NO: 179225 - RNA, 19 nt, Human
uagaguggcgguagauucc

SEQ ID NO: 179226 - RNA, 27 nt, Human
uagauuccaaggggaggauagcaguuu

SEQ ID NO: 179227 - RNA, 24 nt, Human
ucaaauaacuguaaugucuagagc

SEQ ID NO: 179228 - RNA, 25 nt, Human
ucaacaguaacgaguaacacucaaa

SEQ ID NO: 179229 - RNA, 21 nt, Human
ucacauccagcagcuagagug

SEQ ID NO: 179230 - RNA, 19 nt, Human
ucagcagaaaugcccaggg

SEQ ID NO: 179231 - RNA, 19 nt, Human
ucccagaaagcugaguacc

SEQ ID NO: 179232 - RNA, 21 nt, Human
ucccagaaagcugaguaccuc

SEQ ID NO: 179233 - RNA, 21 nt, Human
uccccagagauguccgauugc

SEQ ID NO: 179234 - RNA, 19 nt, Human
ucucagggcagccugccug

SEQ ID NO: 179235 - RNA, 21 nt, Human
ucucagggcagccugccuggc

SEQ ID NO: 179236 - RNA, 25 nt, Human
ucucagggcagccugccuggcucca

SEQ ID NO: 179237 - RNA, 23 nt, Human
ucucagggcagccugccuggcuu

SEQ ID NO: 179238 - RNA, 19 nt, Human
ucucuggaaagcucuugga

SEQ ID NO: 179239 - RNA, 25 nt, Human
ucuuuagagacccccaccccccacc

SEQ ID NO: 179240 - RNA, 18 nt, Human
ugacagcauauggccacu

SEQ ID NO: 179241 - RNA, 20 nt, Human
ugacagugccccucaguagc

SEQ ID NO: 179242 - RNA, 19 nt, Human
ugagaggagagggaggcca

SEQ ID NO: 179243 - RNA, 19 nt, Human
ugaggauguggcucuugug

SEQ ID NO: 179244 - RNA, 20 nt, Human
ugaggccuccuguguccagc

SEQ ID NO: 179245 - RNA, 20 nt, Human
ugagguuucugggcagcaca

SEQ ID NO: 179246 - RNA, 23 nt, Human
ugcagcaaaacaagggcagcaga

SEQ ID NO: 179247 - RNA, 21 nt, Human
ugcccagggccccuguuccac

SEQ ID NO: 179248 - RNA, 21 nt, Human
ugcugagcuuguucaccuggg

SEQ ID NO: 179249 - RNA, 19 nt, Human
uggagaucacagcguccuc

SEQ ID NO: 179250 - RNA, 19 nt, Human
uggcucuuguggggaauga

SEQ ID NO: 179251 - RNA, 18 nt, Human
uggcugggacaagcuggc

SEQ ID NO: 179252 - RNA, 20 nt, Human
uggcugggacaagcuggcgg

SEQ ID NO: 179253 - RNA, 24 nt, Human
ugggcuccgcaagcuucccccgug

SEQ ID NO: 179254 - RNA, 19 nt, Human
uggggauggcagcaggagc

SEQ ID NO: 179255 - RNA, 22 nt, Human
uggggauggcagcaggagcugg

SEQ ID NO: 179256 - RNA, 20 nt, Human
uggucugugccaccuuccuu

SEQ ID NO: 179257 - RNA, 18 nt, Human
uguccagccacaggugcc

SEQ ID NO: 179258 - RNA, 21 nt, Human
ugucuagagcauaacacaaag

SEQ ID NO: 179259 - RNA, 20 nt, Human
ugugaggauguggcucuugu

SEQ ID NO: 179260 - RNA, 23 nt, Human
uguggcucuuguggggaaugaaa

SEQ ID NO: 179261 - RNA, 18 nt, Human
uuccaaggggaggauagc

SEQ ID NO: 179262 - RNA, 20 nt, Human
uuccacaucaaagcuacaag

SEQ ID NO: 179263 - RNA, 25 nt, Human
uuuagagacccccaccccccacccc

SEQ ID NO: 179264 - RNA, 21 nt, Human
uuugugauccugaggccuccu

SEQ ID NO: 179265 - RNA, 20 nt, Human
uuuuccuuccuaucccuagu

SEQ ID NO: 179266 - RNA, 24 nt, Human
aaaaugcugggauuacaggcguga

SEQ ID NO: 179267 - RNA, 26 nt, Human
aaaugcugggauuacaggcgugagcc

SEQ ID NO: 179268 - RNA, 20 nt, Human
aaccuccaccuccugggccc

SEQ ID NO: 179269 - RNA, 26 nt, Human
aaccuuauccuaggaggacaguuuca

SEQ ID NO: 179270 - RNA, 24 nt, Human
aagccacuuuaaaccuuauccuag

SEQ ID NO: 179271 - RNA, 24 nt, Human
aagcgauucucaugccucagccuc

SEQ ID NO: 179272 - RNA, 20 nt, Human
aagggguuuugccauguugg

SEQ ID NO: 179273 - RNA, 24 nt, Human
aagggguuuugccauguuggccag

SEQ ID NO: 179274 - RNA, 18 nt, Human
acaggcacccaccaccac

SEQ ID NO: 179275 - RNA, 20 nt, Human
acccagcccccaaaaagcca

SEQ ID NO: 179276 - RNA, 23 nt, Human
accucagccucccaaaaugcugg

SEQ ID NO: 179277 - RNA, 24 nt, Human
agcgauucucaugccucagccucc

SEQ ID NO: 179278 - RNA, 24 nt, Human
aggagugcaguggcucgaucucgg

SEQ ID NO: 179279 - RNA, 20 nt, Human
aggcaggugggucacccucg

SEQ ID NO: 179280 - RNA, 24 nt, Human
agggguuuugccauguuggccagg

SEQ ID NO: 179281 - RNA, 20 nt, Human
agugcaguggcucgaucucg

SEQ ID NO: 179282 - RNA, 24 nt, Human
agugcaguggcucgaucucggcuc

SEQ ID NO: 179283 - RNA, 24 nt, Human
caaaaugcugggauuacaggcgug

SEQ ID NO: 179284 - RNA, 20 nt, Human
caaaccaucaguccauucgu

SEQ ID NO: 179285 - RNA, 23 nt, Human
caaccuccaccuccugggcccaa

SEQ ID NO: 179286 - RNA, 24 nt, Human
caaccuccaccuccugggcccaag

SEQ ID NO: 179287 - RNA, 24 nt, Human
caccacgucuggcuaauuuuugua

SEQ ID NO: 179288 - RNA, 22 nt, Human
cacggcacccagcccccaaaaa

SEQ ID NO: 179289 - RNA, 21 nt, Human
cacugcaaccuccaccuccug

SEQ ID NO: 179290 - RNA, 23 nt, Human
cacugcaaccuccaccuccuggg

SEQ ID NO: 179291 - RNA, 19 nt, Human
cagccuccuggguaguugg

SEQ ID NO: 179292 - RNA, 21 nt, Human
caggcacccaccaccacgucu

SEQ ID NO: 179293 - RNA, 20 nt, Human
cauagcaaacacuugggaac

SEQ ID NO: 179294 - RNA, 21 nt, Human
cauagcaaacacuugggaaca

SEQ ID NO: 179295 - RNA, 24 nt, Human
caugccucagccuccuggguaguu

SEQ ID NO: 179296 - RNA, 24 nt, Human
cauguuggccaggcuggucucgaa

SEQ ID NO: 179297 - RNA, 22 nt, Human
ccaaaaugcugggauuacaggc

SEQ ID NO: 179298 - RNA, 22 nt, Human
ccaaaaugcugggauuacaggc

SEQ ID NO: 179299 - RNA, 24 nt, Human
ccaaaaugcugggauuacaggcgu

SEQ ID NO: 179300 - RNA, 24 nt, Human
ccaccuccugggcccaagcgauuc

SEQ ID NO: 179301 - RNA, 19 nt, Human
ccauguuggccaggcuggu

SEQ ID NO: 179302 - RNA, 23 nt, Human
ccauguuggccaggcuggucucg

SEQ ID NO: 179303 - RNA, 26 nt, Human
ccccaaaaaaaaaaaaaaaacuuuug

SEQ ID NO: 179304 - RNA, 22 nt, Human
ccccaaaaagccacuuuaaacc

SEQ ID NO: 179305 - RNA, 21 nt, Human
cccccaaaaaaaaaaaaaaaa

SEQ ID NO: 179306 - RNA, 23 nt, Human
cccccaaaaagccacuuuaaacc

SEQ ID NO: 179307 - RNA, 21 nt, Human
ccccccaaaaaaaaaaaaaaa

SEQ ID NO: 179308 - RNA, 18 nt, Human
ccccgcccccccaaaaaa

SEQ ID NO: 179309 - RNA, 19 nt, Human
cccgcccccccaaaaaaaa

SEQ ID NO: 179310 - RNA, 26 nt, Human
cccgcccccccaaaaaaaaaaaaaaa

SEQ ID NO: 179311 - RNA, 18 nt, Human
ccuggccucaagugaucu

SEQ ID NO: 179312 - RNA, 24 nt, Human
ccuggccucaagugaucugcccac

SEQ ID NO: 179313 - RNA, 20 nt, Human
ccugggcccaagcgauucuc

SEQ ID NO: 179314 - RNA, 22 nt, Human
ccuggguaguuggauuacaggc

SEQ ID NO: 179315 - RNA, 24 nt, Human
cucaagugaucugcccaccucagc

SEQ ID NO: 179316 - RNA, 24 nt, Human
cucacugcaaccuccaccuccugg

SEQ ID NO: 179317 - RNA, 27 nt, Human
cucacugcaaccuccaccuccugggcc

SEQ ID NO: 179318 - RNA, 21 nt, Human
cuccugggcccaagcgauucu

SEQ ID NO: 179319 - RNA, 18 nt, Human
cucuguugcccaggagug

SEQ ID NO: 179320 - RNA, 18 nt, Human
cugcaaccuccaccuccu

SEQ ID NO: 179321 - RNA, 23 nt, Human
cugcaaccuccaccuccugggcc

SEQ ID NO: 179322 - RNA, 21 nt, Human
cugcucacgcgguguguugca

SEQ ID NO: 179323 - RNA, 24 nt, Human
gaaccccgcccccccaaaaaaaaa

SEQ ID NO: 179324 - RNA, 19 nt, Human
gaagggguuuugccauguu

SEQ ID NO: 179325 - RNA, 22 nt, Human
gagaauuuuuuucaaauaaaug

SEQ ID NO: 179326 - RNA, 18 nt, Human
gauuacaggcgugagcca

SEQ ID NO: 179327 - RNA, 23 nt, Human
gauuacaggcgugagccacggca

SEQ ID NO: 179328 - RNA, 20 nt, Human
gcaaccuccaccuccugggc

SEQ ID NO: 179329 - RNA, 22 nt, Human
gcacccagcccccaaaaagcca

SEQ ID NO: 179330 - RNA, 20 nt, Human
gccauguuggccaggcuggu

SEQ ID NO: 179331 - RNA, 22 nt, Human
gccauguuggccaggcuggucu

SEQ ID NO: 179332 - RNA, 23 nt, Human
gcgauucucaugccucagccucc

SEQ ID NO: 179333 - RNA, 23 nt, Human
gcuggucucgaacuccuggccuc

SEQ ID NO: 179334 - RNA, 19 nt, Human
ggaguuaaaaacagcuuua

SEQ ID NO: 179335 - RNA, 19 nt, Human
ggauuacaggcacccacca

SEQ ID NO: 179336 - RNA, 22 nt, Human
ggauuacaggcacccaccacca

SEQ ID NO: 179337 - RNA, 24 nt, Human
ggccucaagugaucugcccaccuc

SEQ ID NO: 179338 - RNA, 24 nt, Human
ggcuggucucgaacuccuggccuc

SEQ ID NO: 179339 - RNA, 22 nt, Human
gggguuuugccauguuggccag

SEQ ID NO: 179340 - RNA, 23 nt, Human
gggguuuugccauguuggccagg

SEQ ID NO: 179341 - RNA, 23 nt, Human
guagagaagggguuuugccaugu

SEQ ID NO: 179342 - RNA, 22 nt, Human
gucugugacuggcugcuucuac

SEQ ID NO: 179343 - RNA, 24 nt, Human
gugaucugcccaccucagccuccc

SEQ ID NO: 179344 - RNA, 18 nt, Human
uaaugcagguaacacugc

SEQ ID NO: 179345 - RNA, 23 nt, Human
uaauguaauaaugcagguaacac

SEQ ID NO: 179346 - RNA, 24 nt, Human
uaauuuuuguauuuuuaguagaga

SEQ ID NO: 179347 - RNA, 24 nt, Human
uacaggcgugagccacggcaccca

SEQ ID NO: 179348 - RNA, 22 nt, Human
uagagaagggguuuugccaugu

SEQ ID NO: 179349 - RNA, 24 nt, Human
uaguagagaagggguuuugccaug

SEQ ID NO: 179350 - RNA, 21 nt, Human
uauuucagauuaucagugauu

SEQ ID NO: 179351 - RNA, 24 nt, Human
ucaaauaaauguccauugcauaga

SEQ ID NO: 179352 - RNA, 23 nt, Human
ucacugcaaccuccaccuccugg

SEQ ID NO: 179353 - RNA, 24 nt, Human
ucacugcaaccuccaccuccuggg

SEQ ID NO: 179354 - RNA, 25 nt, Human
ucacugcaaccuccaccuccugggc

SEQ ID NO: 179355 - RNA, 27 nt, Human
ucacugcaaccuccaccuccugggccc

SEQ ID NO: 179356 - RNA, 18 nt, Human
ucagccucccaaaaugcu

SEQ ID NO: 179357 - RNA, 21 nt, Human
ucagccuccuggguaguugga

SEQ ID NO: 179358 - RNA, 24 nt, Human
ucccaaaaugcugggauuacaggc

SEQ ID NO: 179359 - RNA, 21 nt, Human
uccccaagagccacuuuauuu

SEQ ID NO: 179360 - RNA, 21 nt, Human
uccugggcccaagcgauucuc

SEQ ID NO: 179361 - RNA, 23 nt, Human
uccuggguaguuggauuacaggc

SEQ ID NO: 179362 - RNA, 24 nt, Human
uccuggguaguuggauuacaggca

SEQ ID NO: 179363 - RNA, 21 nt, Human
ucucgaacuccuggccucaag

SEQ ID NO: 179364 - RNA, 18 nt, Human
ucugaaaauuacaagugg

SEQ ID NO: 179365 - RNA, 22 nt, Human
ucugcacccaacaucuggcccc

SEQ ID NO: 179366 - RNA, 21 nt, Human
ucugcccaccucagccuccca

SEQ ID NO: 179367 - RNA, 24 nt, Human
ucugcccaccucagccucccaaaa

SEQ ID NO: 179368 - RNA, 19 nt, Human
ucuguugcccaggagugca

SEQ ID NO: 179369 - RNA, 19 nt, Human
ucuugcucuguugcccagg

SEQ ID NO: 179370 - RNA, 20 nt, Human
ucuugcucuguugcccagga

SEQ ID NO: 179371 - RNA, 21 nt, Human
ucuugcucuguugcccaggag

SEQ ID NO: 179372 - RNA, 22 nt, Human
ugagacgaagucuugcucuguu

SEQ ID NO: 179373 - RNA, 24 nt, Human
ugaucugcccaccucagccuccca

SEQ ID NO: 179374 - RNA, 22 nt, Human
ugcaguggcucgaucucggcuc

SEQ ID NO: 179375 - RNA, 24 nt, Human
ugccauguuggccaggcuggucuc

SEQ ID NO: 179376 - RNA, 27 nt, Human
ugccauguuggccaggcuggucucgaa

SEQ ID NO: 179377 - RNA, 20 nt, Human
ugccucagccuccuggguag

SEQ ID NO: 179378 - RNA, 20 nt, Human
ugccucagccuccuggguag

SEQ ID NO: 179379 - RNA, 22 nt, Human
ugcggaggaggcagguggguca

SEQ ID NO: 179380 - RNA, 23 nt, Human
ugcgucuaaccucuuccuggccu

SEQ ID NO: 179381 - RNA, 18 nt, Human
ugcucuguugcccaggag

SEQ ID NO: 179382 - RNA, 24 nt, Human
ugcugggauuacaggcgugagcca

SEQ ID NO: 179383 - RNA, 21 nt, Human
ugcuucuacaucugcacccaa

SEQ ID NO: 179384 - RNA, 24 nt, Human
ugcuuuauuuccuugguuccucua

SEQ ID NO: 179385 - RNA, 19 nt, Human
uggauuacaggcacccacc

SEQ ID NO: 179386 - RNA, 23 nt, Human
uggauuacaggcacccaccacca

SEQ ID NO: 179387 - RNA, 23 nt, Human
uggcagggugcaggaccuuaagu

SEQ ID NO: 179388 - RNA, 24 nt, Human
uggccaggcuggucucgaacuccu

SEQ ID NO: 179389 - RNA, 18 nt, Human
uggccucaagugaucugc

SEQ ID NO: 179390 - RNA, 18 nt, Human
ugggauuacaggcgugag

SEQ ID NO: 179391 - RNA, 19 nt, Human
ugggauuacaggcgugagc

SEQ ID NO: 179392 - RNA, 21 nt, Human
ugggauuacaggcgugagcca

SEQ ID NO: 179393 - RNA, 22 nt, Human
ugggauuacaggcgugagccac

SEQ ID NO: 179394 - RNA, 22 nt, Human
ugggauuacaggcgugagccac

SEQ ID NO: 179395 - RNA, 23 nt, Human
ugggauuacaggcgugagccacg

SEQ ID NO: 179396 - RNA, 24 nt, Human
ugggauuacaggcgugagccacgg

SEQ ID NO: 179397 - RNA, 26 nt, Human
ugggauuacaggcgugagccacggca

SEQ ID NO: 179398 - RNA, 27 nt, Human
ugggauuacaggcgugagccacggcac

SEQ ID NO: 179399 - RNA, 18 nt, Human
ugguacauuaaauugcuu

SEQ ID NO: 179400 - RNA, 18 nt, Human
ugugacuggcugcuucua

SEQ ID NO: 179401 - RNA, 22 nt, Human
uuaaaaacagcuuuagaacccc

SEQ ID NO: 179402 - RNA, 18 nt, Human
uuaguagagaagggguuu

SEQ ID NO: 179403 - RNA, 22 nt, Human
uuaguagagaagggguuuugcc

SEQ ID NO: 179404 - RNA, 24 nt, Human
uuaguagagaagggguuuugccau

SEQ ID NO: 179405 - RNA, 19 nt, Human
uuggauuacaggcacccac

SEQ ID NO: 179406 - RNA, 19 nt, Human
uuuaauuaagaaaacaugu

SEQ ID NO: 179407 - RNA, 23 nt, Human
uuuugccauguuggccaggcugg

SEQ ID NO: 179408 - RNA, 24 nt, Human
uuuuuaguagagaagggguuuugc

SEQ ID NO: 179409 - RNA, 20 nt, Human
uuuuuguauuuuuaguagag

SEQ ID NO: 179410 - RNA, 30 nt, Human
uuuuuuuuuuuuuuuuuuuauacuuuuaaa

SEQ ID NO: 179411 - RNA, 24 nt, Human
acauaacuguggcugcuuuugauu

SEQ ID NO: 179412 - RNA, 22 nt, Human
agacaaaaaaaagauuaacuaa

SEQ ID NO: 179413 - RNA, 29 nt, Human
aggcuaaaagacaaaaaaaaggggacccc

SEQ ID NO: 179414 - RNA, 18 nt, Human
auuaguuggugcaagaaa

SEQ ID NO: 179415 - RNA, 20 nt, Human
caaaucagaccuacauaacu

SEQ ID NO: 179416 - RNA, 19 nt, Human
cacagaacucuccgcccuc

SEQ ID NO: 179417 - RNA, 20 nt, Human
cacagaacucuccgcccucc

SEQ ID NO: 179418 - RNA, 26 nt, Human
cccgaugccuacaugaauccuuccca

SEQ ID NO: 179419 - RNA, 18 nt, Human
ccgcccuccucagccgcc

SEQ ID NO: 179420 - RNA, 22 nt, Human
cggaauaaacacaacauugaug

SEQ ID NO: 179421 - RNA, 25 nt, Human
cuaaaauaagcuaugagguccaauc

SEQ ID NO: 179422 - RNA, 22 nt, Human
cucuccgcccuccucagccgcc

SEQ ID NO: 179423 - RNA, 20 nt, Human
gaccuacauaacuguggcug

SEQ ID NO: 179424 - RNA, 20 nt, Human
ggcuaaaagacaaaaaaaag

SEQ ID NO: 179425 - RNA, 19 nt, Human
uaaaauaagcuaugagguc

SEQ ID NO: 179426 - RNA, 19 nt, Human
uaguaggauagaguuggug

SEQ ID NO: 179427 - RNA, 21 nt, Human
uaugacauucaaaucagaccu

SEQ ID NO: 179428 - RNA, 23 nt, Human
ucacuugcaccaccccuacucac

SEQ ID NO: 179429 - RNA, 19 nt, Human
ugagguccaaucaagaaug

SEQ ID NO: 179430 - RNA, 21 nt, Human
ugcaccaccccuacucaccua

SEQ ID NO: 179431 - RNA, 18 nt, Human
ugccuggaagcaagucuu

SEQ ID NO: 179432 - RNA, 18 nt, Human
ugcgccaucccggucaca

SEQ ID NO: 179433 - RNA, 26 nt, Human
uguacagaggggcuucuaaccucaag

SEQ ID NO: 179434 - RNA, 21 nt, Human
uuauaauguggacuuaggcuc

SEQ ID NO: 179435 - RNA, 22 nt, Human
uucaccacagaacucuccgccc

SEQ ID NO: 179436 - RNA, 19 nt, Human
uucccgaugccuacaugaa

SEQ ID NO: 179437 - RNA, 20 nt, Human
uugcaccaccccuacucacc

SEQ ID NO: 179438 - RNA, 26 nt, Human
uuuugauuaucuguacagaggggcuu

SEQ ID NO: 179439 - RNA, 19 nt, Human
uuuuuuuuuuugccuggaa

SEQ ID NO: 179440 - RNA, 21 nt, Human
uuuuuuuuuuuuuugccugga

SEQ ID NO: 179441 - RNA, 22 nt, Human
uuuuuuuuuuuuuuuugccugg

SEQ ID NO: 179442 - RNA, 18 nt, Human
uuuuuuuuuuuuuuuuug

SEQ ID NO: 179443 - RNA, 21 nt, Human
uuuuuuuuuuuuuuuuugccu

SEQ ID NO: 179444 - RNA, 24 nt, Human
uuuuuuuuuuuuuuuuuugccugg

SEQ ID NO: 179445 - RNA, 24 nt, Human
aauaugcagcaucugaggccuggg

SEQ ID NO: 179446 - RNA, 18 nt, Human
acagaaucuucuucaggg

SEQ ID NO: 179447 - RNA, 18 nt, Human
acagaaucuucuucaggg

SEQ ID NO: 179448 - RNA, 18 nt, Human
acagaaucuucuucaggg

SEQ ID NO: 179449 - RNA, 22 nt, Human
acccuucaccaggccugacagc

SEQ ID NO: 179450 - RNA, 20 nt, Human
agaaagcagcuagagggcuc

SEQ ID NO: 179451 - RNA, 20 nt, Human
agcagcagacaggggcccca

SEQ ID NO: 179452 - RNA, 20 nt, Human
agccuuguccuccuggagca

SEQ ID NO: 179453 - RNA, 20 nt, Human
agcucagagagggugagcgg

SEQ ID NO: 179454 - RNA, 21 nt, Human
aggacccgagcugguguucca

SEQ ID NO: 179455 - RNA, 21 nt, Human
aggaggccaccugagccuggc

SEQ ID NO: 179456 - RNA, 22 nt, Human
aggccaggaggccaccugagcc

SEQ ID NO: 179457 - RNA, 24 nt, Human
aggccaggaggccaccugagccug

SEQ ID NO: 179458 - RNA, 18 nt, Human
aguaucuugucccuggau

SEQ ID NO: 179459 - RNA, 20 nt, Human
cacacagcacuggggcacag

SEQ ID NO: 179460 - RNA, 18 nt, Human
cacacccuucaccaggcc

SEQ ID NO: 179461 - RNA, 21 nt, Human
cacuugccuugcugaggccug

SEQ ID NO: 179462 - RNA, 19 nt, Human
cagaacaggcccugccucc

SEQ ID NO: 179463 - RNA, 22 nt, Human
cagacaggggccccaagccuug

SEQ ID NO: 179464 - RNA, 22 nt, Human
cagcagcagacaggggccccaa

SEQ ID NO: 179465 - RNA, 18 nt, Human
ccagcagcagacaggggc

SEQ ID NO: 179466 - RNA, 24 nt, Human
ccagcagcagacaggggccccaag

SEQ ID NO: 179467 - RNA, 24 nt, Human
ccagcagcagacgggggccccaag

SEQ ID NO: 179468 - RNA, 24 nt, Human
ccagcagcagacgggggccccaag

SEQ ID NO: 179469 - RNA, 18 nt, Human
ccccgggucccagcuggg

SEQ ID NO: 179470 - RNA, 27 nt, Human
cccuucaccaggccugacagcgcuccu

SEQ ID NO: 179471 - RNA, 18 nt, Human
ccgggucaggguuaaggg

SEQ ID NO: 179472 - RNA, 24 nt, Human
ccucacuugccuugcugaggccug

SEQ ID NO: 179473 - RNA, 18 nt, Human
ccugaaggucaagggagg

SEQ ID NO: 179474 - RNA, 18 nt, Human
ccugaaggucaagggagg

SEQ ID NO: 179475 - RNA, 22 nt, Human
ccugguccuggugaguaucuug

SEQ ID NO: 179476 - RNA, 19 nt, Human
cucacacucugcugaagcc

SEQ ID NO: 179477 - RNA, 19 nt, Human
cucacacucugcugaagcc

SEQ ID NO: 179478 - RNA, 19 nt, Human
cucacacucugcugaagcc

SEQ ID NO: 179479 - RNA, 19 nt, Human
cucuagcugguuucucugu

SEQ ID NO: 179480 - RNA, 19 nt, Human
cugcucucacuucugggcu

SEQ ID NO: 179481 - RNA, 21 nt, Human
cuggggcacagccaacugcuc

SEQ ID NO: 179482 - RNA, 20 nt, Human
cuucagggacucucugauca

SEQ ID NO: 179483 - RNA, 20 nt, Human
cuucagggacucucugauca

SEQ ID NO: 179484 - RNA, 20 nt, Human
cuucagggacucucugauca

SEQ ID NO: 179485 - RNA, 22 nt, Human
cuucucguucuccugaagguca

SEQ ID NO: 179486 - RNA, 22 nt, Human
cuucucguucuccugaagguca

SEQ ID NO: 179487 - RNA, 19 nt, Human
gaaagacaggaggauuugg

SEQ ID NO: 179488 - RNA, 19 nt, Human
gaaagacaggaggauuugg

SEQ ID NO: 179489 - RNA, 19 nt, Human
gaaagacaggaggauuugg

SEQ ID NO: 179490 - RNA, 18 nt, Human
gaggccuggggacagugg

SEQ ID NO: 179491 - RNA, 19 nt, Human
gaguaucuugucccuggau

SEQ ID NO: 179492 - RNA, 21 nt, Human
gccacagaaucuucuucaggg

SEQ ID NO: 179493 - RNA, 21 nt, Human
gccucuagcugguuucucugu

SEQ ID NO: 179494 - RNA, 18 nt, Human
gccuuguccuccuggagc

SEQ ID NO: 179495 - RNA, 18 nt, Human
gggacagugggggcccag

SEQ ID NO: 179496 - RNA, 18 nt, Human
gggacagugggggcccag

SEQ ID NO: 179497 - RNA, 24 nt, Human
uaaccggggucucccucacacucu

SEQ ID NO: 179498 - RNA, 24 nt, Human
uaaccggggucucccucacacucu

SEQ ID NO: 179499 - RNA, 24 nt, Human
uaaccggggucucccucacacucu

SEQ ID NO: 179500 - RNA, 23 nt, Human
uagccacagaaucuucuucaggg

SEQ ID NO: 179501 - RNA, 23 nt, Human
uagccacagaaucuucuucaggg

SEQ ID NO: 179502 - RNA, 20 nt, Human
uagcugguuucucugucucc

SEQ ID NO: 179503 - RNA, 20 nt, Human
uagcugguuucucugucucc

SEQ ID NO: 179504 - RNA, 19 nt, Human
uagcugguuucucugucuu

SEQ ID NO: 179505 - RNA, 19 nt, Human
uagcugguuucucugucuu

SEQ ID NO: 179506 - RNA, 21 nt, Human
ucagccuuguccuccuggagc

SEQ ID NO: 179507 - RNA, 19 nt, Human
uccaaagagccucaggagc

SEQ ID NO: 179508 - RNA, 19 nt, Human
uccaccagcucagagaggg

SEQ ID NO: 179509 - RNA, 19 nt, Human
uccagccuggaugacggca

SEQ ID NO: 179510 - RNA, 19 nt, Human
uccagccuggaugacggca

SEQ ID NO: 179511 - RNA, 19 nt, Human
uccagccuggaugacggca

SEQ ID NO: 179512 - RNA, 20 nt, Human
ucccucugucucuagcuggu

SEQ ID NO: 179513 - RNA, 22 nt, Human
ucuccaguugaacucugcugug

SEQ ID NO: 179514 - RNA, 22 nt, Human
ucuccaguugaacucugcugug

SEQ ID NO: 179515 - RNA, 18 nt, Human
ucucccucacacucugcu

SEQ ID NO: 179516 - RNA, 18 nt, Human
ucucccucacacucugcu

SEQ ID NO: 179517 - RNA, 18 nt, Human
ucucccucacacucugcu

SEQ ID NO: 179518 - RNA, 22 nt, Human
ugaggaaauaaccggggucucc

SEQ ID NO: 179519 - RNA, 22 nt, Human
ugaggaaauaaccggggucucc

SEQ ID NO: 179520 - RNA, 22 nt, Human
ugaggaaauaaccggggucucc

SEQ ID NO: 179521 - RNA, 19 nt, Human
ugcccuucagucuuccaga

SEQ ID NO: 179522 - RNA, 19 nt, Human
ugccugggguguuggccac

SEQ ID NO: 179523 - RNA, 19 nt, Human
ugccugggguguuggccac

SEQ ID NO: 179524 - RNA, 19 nt, Human
ugccugggguguuggccac

SEQ ID NO: 179525 - RNA, 25 nt, Human
ugccuugcugcccuucagucuucca

SEQ ID NO: 179526 - RNA, 21 nt, Human
ugcugcccuucagucuuccag

SEQ ID NO: 179527 - RNA, 22 nt, Human
uggauugcuugucagccuuguc

SEQ ID NO: 179528 - RNA, 22 nt, Human
ugucagccuuguccuccuggag

SEQ ID NO: 179529 - RNA, 18 nt, Human
uuccuggagguccaaaga

SEQ ID NO: 179530 - RNA, 26 nt, Human
uuccugguccuggugaguaucuuguc

SEQ ID NO: 179531 - RNA, 21 nt, Human
uugccacuccgacaccccggg

SEQ ID NO: 179532 - RNA, 19 nt, Human
uuuugggcugcacccgcag

SEQ ID NO: 179533 - RNA, 20 nt, Human
aacuucuucuucauggcucu

SEQ ID NO: 179534 - RNA, 18 nt, Human
acagaaucuucuucagag

SEQ ID NO: 179535 - RNA, 26 nt, Human
acagaggccgacaaugaccagcacca

SEQ ID NO: 179536 - RNA, 22 nt, Human
acccuucaccaggccugacagc

SEQ ID NO: 179537 - RNA, 18 nt, Human
accucagcuuuucugcug

SEQ ID NO: 179538 - RNA, 20 nt, Human
agaaagcagcuagagggcuc

SEQ ID NO: 179539 - RNA, 20 nt, Human
agaacaccucacacaagaca

SEQ ID NO: 179540 - RNA, 18 nt, Human
agaacaggcccugccucc

SEQ ID NO: 179541 - RNA, 22 nt, Human
agccagagacagaggccgacaa

SEQ ID NO: 179542 - RNA, 21 nt, Human
aggaagaggccaaccccgaug

SEQ ID NO: 179543 - RNA, 24 nt, Human
aggaggauuugguggaaacagcug

SEQ ID NO: 179544 - RNA, 19 nt, Human
aggccgagggcagccagag

SEQ ID NO: 179545 - RNA, 18 nt, Human
agggaggccaccuggagc

SEQ ID NO: 179546 - RNA, 23 nt, Human
agggcagccgcccaugccgcugg

SEQ ID NO: 179547 - RNA, 22 nt, Human
agguccucagcugucacaaugc

SEQ ID NO: 179548 - RNA, 18 nt, Human
aguaucuugucccuggau

SEQ ID NO: 179549 - RNA, 18 nt, Human
cacacccuucaccaggcc

SEQ ID NO: 179550 - RNA, 26 nt, Human
caccacuaacuucuucuucauggcuc

SEQ ID NO: 179551 - RNA, 20 nt, Human
caccaggaccacggccagcg

SEQ ID NO: 179552 - RNA, 19 nt, Human
cacggccagcaggcccagc

SEQ ID NO: 179553 - RNA, 21 nt, Human
cagaacaccucacacaagaca

SEQ ID NO: 179554 - RNA, 19 nt, Human
cagcaccaggaccacggcc

SEQ ID NO: 179555 - RNA, 18 nt, Human
cagccagagacagaggcc

SEQ ID NO: 179556 - RNA, 24 nt, Human
caggcaccgccaccgacagcccuc

SEQ ID NO: 179557 - RNA, 22 nt, Human
caggggaagcccgucccccaau

SEQ ID NO: 179558 - RNA, 22 nt, Human
cagggucagucucucccccucc

SEQ ID NO: 179559 - RNA, 21 nt, Human
caguccgcuuguuuuccagga

SEQ ID NO: 179560 - RNA, 24 nt, Human
ccaacaccccgggucccagccggg

SEQ ID NO: 179561 - RNA, 21 nt, Human
ccagcaccaggaccacggcca

SEQ ID NO: 179562 - RNA, 24 nt, Human
ccagcagcagacgggggccccaag

SEQ ID NO: 179563 - RNA, 22 nt, Human
cccaaaguccucuuccucaucc

SEQ ID NO: 179564 - RNA, 23 nt, Human
cccaggcaccgccaccgacagcc

SEQ ID NO: 179565 - RNA, 21 nt, Human
cccaugccgcuggugugccag

SEQ ID NO: 179566 - RNA, 22 nt, Human
ccccaaaguccucuuccucauc

SEQ ID NO: 179567 - RNA, 18 nt, Human
ccccgggucccagccggg

SEQ ID NO: 179568 - RNA, 23 nt, Human
cccgcagugugucccucccaauc

SEQ ID NO: 179569 - RNA, 18 nt, Human
cccgggucccagccggga

SEQ ID NO: 179570 - RNA, 20 nt, Human
cccugccuccucccugcccu

SEQ ID NO: 179571 - RNA, 23 nt, Human
ccgcagugugucccucccaaucu

SEQ ID NO: 179572 - RNA, 18 nt, Human
ccgggucaggguuaaggg

SEQ ID NO: 179573 - RNA, 18 nt, Human
ccguuguagaaggccugg

SEQ ID NO: 179574 - RNA, 25 nt, Human
ccuucaccaggccugacagcgcucc

SEQ ID NO: 179575 - RNA, 23 nt, Human
cgagggcagccagagacagaggc

SEQ ID NO: 179576 - RNA, 21 nt, Human
cgccaagcccuugcccacagg

SEQ ID NO: 179577 - RNA, 20 nt, Human
cggccauggcagcccuggug

SEQ ID NO: 179578 - RNA, 19 nt, Human
cucacacucugcugaagcc

SEQ ID NO: 179579 - RNA, 18 nt, Human
cuccaacaccccgggucc

SEQ ID NO: 179580 - RNA, 23 nt, Human
cuccaacaccccgggucccagcc

SEQ ID NO: 179581 - RNA, 19 nt, Human
cuccaagcacugcuuggca

SEQ ID NO: 179582 - RNA, 22 nt, Human
cugcugcccuucagucuuccag

SEQ ID NO: 179583 - RNA, 18 nt, Human
cuuggcauccgcggccau

SEQ ID NO: 179584 - RNA, 19 nt, Human
gaaagacaggaggauuugg

SEQ ID NO: 179585 - RNA, 21 nt, Human
gaagcaccuuucuaucccggc

SEQ ID NO: 179586 - RNA, 24 nt, Human
gaagcaccuuucuaucccggccga

SEQ ID NO: 179587 - RNA, 22 nt, Human
gaccucagcuuuucugcuguug

SEQ ID NO: 179588 - RNA, 18 nt, Human
gagacagaggccgacaau

SEQ ID NO: 179589 - RNA, 19 nt, Human
gaguaucuugucccuggau

SEQ ID NO: 179590 - RNA, 19 nt, Human
gauggugaggaagaggcca

SEQ ID NO: 179591 - RNA, 18 nt, Human
gcaccgccaccgacagcc

SEQ ID NO: 179592 - RNA, 22 nt, Human
gcagaacaccucacacaagaca

SEQ ID NO: 179593 - RNA, 20 nt, Human
gccaaccccgaugcccaugc

SEQ ID NO: 179594 - RNA, 19 nt, Human
gccacuccaacaccccggg

SEQ ID NO: 179595 - RNA, 18 nt, Human
gcugcucgaugacagucc

SEQ ID NO: 179596 - RNA, 18 nt, Human
gcuggaugcugggcugga

SEQ ID NO: 179597 - RNA, 19 nt, Human
gcuggcaaaggccagccug

SEQ ID NO: 179598 - RNA, 18 nt, Human
ggaagaggcgagcccagg

SEQ ID NO: 179599 - RNA, 20 nt, Human
ggaggccaccuggagccugg

SEQ ID NO: 179600 - RNA, 19 nt, Human
ggcaccgccaccgacagcc

SEQ ID NO: 179601 - RNA, 21 nt, Human
ggcagcccugguguacacaug

SEQ ID NO: 179602 - RNA, 20 nt, Human
ggccugggcacccucgaugg

SEQ ID NO: 179603 - RNA, 20 nt, Human
gucacaaugcccccucagcc

SEQ ID NO: 179604 - RNA, 24 nt, Human
uaaccggggucucccucacacucu

SEQ ID NO: 179605 - RNA, 23 nt, Human
uagccacagaaucuucuucagag

SEQ ID NO: 179606 - RNA, 21 nt, Human
ucagccuugucugccuggagc

SEQ ID NO: 179607 - RNA, 23 nt, Human
ucagccuugucugccuggagcaa

SEQ ID NO: 179608 - RNA, 20 nt, Human
ucagcugucacaaugccccc

SEQ ID NO: 179609 - RNA, 21 nt, Human
ucagcugucacaaugcccccu

SEQ ID NO: 179610 - RNA, 19 nt, Human
uccaaagagccucaggagc

SEQ ID NO: 179611 - RNA, 19 nt, Human
uccacugcagagccaccgu

SEQ ID NO: 179612 - RNA, 19 nt, Human
uccagccuggaugacggca

SEQ ID NO: 179613 - RNA, 22 nt, Human
uccaggacugccgccaagcccu

SEQ ID NO: 179614 - RNA, 19 nt, Human
uccccaggcaccgccaccg

SEQ ID NO: 179615 - RNA, 20 nt, Human
ucccccaaaguccucuuccu

SEQ ID NO: 179616 - RNA, 25 nt, Human
uccgcggccauggcagcccuggugu

SEQ ID NO: 179617 - RNA, 22 nt, Human
uccuuggaggccgagggcagcc

SEQ ID NO: 179618 - RNA, 18 nt, Human
ucucccucacacucugcu

SEQ ID NO: 179619 - RNA, 22 nt, Human
ugaacaugcuggcaaaggccag

SEQ ID NO: 179620 - RNA, 22 nt, Human
ugaggaaauaaccggggucucc

SEQ ID NO: 179621 - RNA, 21 nt, Human
ugaggaagaggccaaccccga

SEQ ID NO: 179622 - RNA, 21 nt, Human
ugcccacagggaagcccuggc

SEQ ID NO: 179623 - RNA, 19 nt, Human
ugccugggguguuggccac

SEQ ID NO: 179624 - RNA, 21 nt, Human
ugcugcugcccuucagucuuc

SEQ ID NO: 179625 - RNA, 22 nt, Human
uggauugcuugucagccuuguc

SEQ ID NO: 179626 - RNA, 23 nt, Human
uggcaaaggccagccugggggcc

SEQ ID NO: 179627 - RNA, 20 nt, Human
ugucacaaugcccccucagc

SEQ ID NO: 179628 - RNA, 23 nt, Human
ugucagguuccuuggaggccgag

SEQ ID NO: 179629 - RNA, 19 nt, Human
ugugggcauucaugagccc

SEQ ID NO: 179630 - RNA, 19 nt, Human
uucacaaucugggccauga

SEQ ID NO: 179631 - RNA, 18 nt, Human
uuccuggagguccaaaga

SEQ ID NO: 179632 - RNA, 19 nt, Human
uuccuuggaggccgagggc

SEQ ID NO: 179633 - RNA, 22 nt, Human
uuccuuggaggccgagggcagc

SEQ ID NO: 179634 - RNA, 24 nt, Human
uuccuuggaggccgagggcagcca

SEQ ID NO: 179635 - RNA, 21 nt, Human
uugccacuccaacaccccggg

SEQ ID NO: 179636 - RNA, 19 nt, Human
aagccacagcugcccucca

SEQ ID NO: 179637 - RNA, 21 nt, Human
acccugagugguucggggagu

SEQ ID NO: 179638 - RNA, 20 nt, Human
agcuagaagccacagcugcc

SEQ ID NO: 179639 - RNA, 18 nt, Human
aggaaugucucgaccuug

SEQ ID NO: 179640 - RNA, 20 nt, Human
aggacccugagugguucggg

SEQ ID NO: 179641 - RNA, 22 nt, Human
aggagaggcacuggggaggggu

SEQ ID NO: 179642 - RNA, 23 nt, Human
cacaggacccugagugguucggg

SEQ ID NO: 179643 - RNA, 26 nt, Human
cacccgggcagcuagaagccacagcu

SEQ ID NO: 179644 - RNA, 23 nt, Human
cagggccaggagaggcacugggg

SEQ ID NO: 179645 - RNA, 23 nt, Human
cagggccaggagaggcacugggg

SEQ ID NO: 179646 - RNA, 24 nt, Human
ccaggagaggcacuggggaggggu

SEQ ID NO: 179647 - RNA, 20 nt, Human
cggcacugcacgaugcgcaa

SEQ ID NO: 179648 - RNA, 20 nt, Human
cuccacagagcggcacugca

SEQ ID NO: 179649 - RNA, 19 nt, Human
cugaagcaguagagcagcc

SEQ ID NO: 179650 - RNA, 20 nt, Human
cugaagcaguagagcagccc

SEQ ID NO: 179651 - RNA, 18 nt, Human
gagaggcacuggggaggg

SEQ ID NO: 179652 - RNA, 18 nt, Human
gagaggcacuggggaggg

SEQ ID NO: 179653 - RNA, 18 nt, Human
gcacgaugcgcaggaaug

SEQ ID NO: 179654 - RNA, 19 nt, Human
ggagaggcacuggggaggg

SEQ ID NO: 179655 - RNA, 23 nt, Human
gggcacuggaguggcaacuucca

SEQ ID NO: 179656 - RNA, 23 nt, Human
gggcacuggaguggcaacuucca

SEQ ID NO: 179657 - RNA, 18 nt, Human
ggggaggggucacaggga

SEQ ID NO: 179658 - RNA, 18 nt, Human
ggggaggggucacaggga

SEQ ID NO: 179659 - RNA, 20 nt, Human
uccacagagcggcacugcac

SEQ ID NO: 179660 - RNA, 19 nt, Human
uccagggccaggagaggca

SEQ ID NO: 179661 - RNA, 19 nt, Human
uccagggccaggagaggca

SEQ ID NO: 179662 - RNA, 19 nt, Human
aagccacagcugcccucca

SEQ ID NO: 179663 - RNA, 21 nt, Human
acccugagugguucggggagu

SEQ ID NO: 179664 - RNA, 20 nt, Human
agcuagaagccacagcugcc

SEQ ID NO: 179665 - RNA, 18 nt, Human
aggaaugucucgaccuug

SEQ ID NO: 179666 - RNA, 22 nt, Human
aggagaggcacuggggaggggu

SEQ ID NO: 179667 - RNA, 22 nt, Human
aggagaggcacuggggaggggu

SEQ ID NO: 179668 - RNA, 23 nt, Human
cacaggacccugagugguucggg

SEQ ID NO: 179669 - RNA, 26 nt, Human
cacccgggcagcuagaagccacagcu

SEQ ID NO: 179670 - RNA, 24 nt, Human
ccaggagaggcacuggggaggggu

SEQ ID NO: 179671 - RNA, 20 nt, Human
cggcacugcacgaugcgcaa

SEQ ID NO: 179672 - RNA, 20 nt, Human
cuccacagagcggcacugca

SEQ ID NO: 179673 - RNA, 20 nt, Human
cugaagcaguagagcagccc

SEQ ID NO: 179674 - RNA, 18 nt, Human
gagaggcacuggggaggg

SEQ ID NO: 179675 - RNA, 18 nt, Human
gcacgaugcgcaggaaug

SEQ ID NO: 179676 - RNA, 19 nt, Human
ggagaggcacuggggaggg

SEQ ID NO: 179677 - RNA, 18 nt, Human
ggggaggggucacaggga

SEQ ID NO: 179678 - RNA, 18 nt, Human
ggggaggggucacaggga

SEQ ID NO: 179679 - RNA, 20 nt, Human
uccacagagcggcacugcac

SEQ ID NO: 179680 - RNA, 24 nt, Human
ugagcagugcgucaucguugugcg

SEQ ID NO: 179681 - RNA, 24 nt, Human
aaacguuauugccccagucaauuc

SEQ ID NO: 179682 - RNA, 22 nt, Human
aacaacaacaacaaaaaugaag

SEQ ID NO: 179683 - RNA, 21 nt, Human
aacaacaacaacaacaacaaa

SEQ ID NO: 179684 - RNA, 19 nt, Human
aacauggugaaaccccguc

SEQ ID NO: 179685 - RNA, 20 nt, Human
aacauggugaaaccccgucu

SEQ ID NO: 179686 - RNA, 21 nt, Human
aacauggugaaaccccgucuc

SEQ ID NO: 179687 - RNA, 18 nt, Human
aacauuuugggaaaaggc

SEQ ID NO: 179688 - RNA, 20 nt, Human
aaccauagcagcaaaguagc

SEQ ID NO: 179689 - RNA, 20 nt, Human
aagacaaucacugcuacuaa

SEQ ID NO: 179690 - RNA, 23 nt, Human
acaacaacaacaacaaaaaugaa

SEQ ID NO: 179691 - RNA, 21 nt, Human
acaacaacaacaacaacaaaa

SEQ ID NO: 179692 - RNA, 22 nt, Human
acaacaacaacaacaacaaaaa

SEQ ID NO: 179693 - RNA, 21 nt, Human
acaccuguaaucccagcacuu

SEQ ID NO: 179694 - RNA, 22 nt, Human
acagagcgagacucugucucaa

SEQ ID NO: 179695 - RNA, 25 nt, Human
accaaaguaccaaaaugacauucug

SEQ ID NO: 179696 - RNA, 21 nt, Human
accccauccugucacuccccc

SEQ ID NO: 179697 - RNA, 22 nt, Human
accccauccugucacuccccca

SEQ ID NO: 179698 - RNA, 23 nt, Human
accccauccugucacucccccaa

SEQ ID NO: 179699 - RNA, 23 nt, Human
accccgucucugcuaaaauacaa

SEQ ID NO: 179700 - RNA, 23 nt, Human
accgcacucuagccuggcgacag

SEQ ID NO: 179701 - RNA, 25 nt, Human
accgcacucuagccuggcgacagag

SEQ ID NO: 179702 - RNA, 22 nt, Human
accuccgagcuucgccucugau

SEQ ID NO: 179703 - RNA, 22 nt, Human
accuuauucccuuccuggauaa

SEQ ID NO: 179704 - RNA, 21 nt, Human
agaaagaaaguuucuuuuagc

SEQ ID NO: 179705 - RNA, 25 nt, Human
agcaaaguagcagaaaaucuaucaa

SEQ ID NO: 179706 - RNA, 24 nt, Human
agcacuuugggaggccgagucggg

SEQ ID NO: 179707 - RNA, 23 nt, Human
agccuggcaugguggugcgugcc

SEQ ID NO: 179708 - RNA, 21 nt, Human
agccuggcgacagagcgagac

SEQ ID NO: 179709 - RNA, 23 nt, Human
agccuggcgacagagcgagacuc

SEQ ID NO: 179710 - RNA, 22 nt, Human
aggcacgggaaucgccugaacc

SEQ ID NO: 179711 - RNA, 22 nt, Human
aggcacgggaaucgccugaacc

SEQ ID NO: 179712 - RNA, 24 nt, Human
aggcacgggaaucgccugaaccug

SEQ ID NO: 179713 - RNA, 21 nt, Human
aggccgagucggguggaucac

SEQ ID NO: 179714 - RNA, 24 nt, Human
agguggagauugcagugagucaag

SEQ ID NO: 179715 - RNA, 27 nt, Human
agguugcuucuuuuucuucugaaugcu

SEQ ID NO: 179716 - RNA, 19 nt, Human
aguaaaaaaugaugaaacu

SEQ ID NO: 179717 - RNA, 19 nt, Human
aguaucaaaaauuaacacc

SEQ ID NO: 179718 - RNA, 24 nt, Human
agucggguggaucacgaggucagg

SEQ ID NO: 179719 - RNA, 22 nt, Human
auacguagcucuugggaaacca

SEQ ID NO: 179720 - RNA, 21 nt, Human
auccuggccaacauggugaaa

SEQ ID NO: 179721 - RNA, 24 nt, Human
aucgcgccaccgcacucuagccug

SEQ ID NO: 179722 - RNA, 28 nt, Human
auuaaaaacauagccauucaaugcuuag

SEQ ID NO: 179723 - RNA, 26 nt, Human
caaaaugacauucugagacugauuga

SEQ ID NO: 179724 - RNA, 23 nt, Human
caaaaugauuucuaaauuacuga

SEQ ID NO: 179725 - RNA, 23 nt, Human
caaacgcuuuaaaguuuucuaaa

SEQ ID NO: 179726 - RNA, 22 nt, Human
caacaaaaaauuagccugugcu

SEQ ID NO: 179727 - RNA, 22 nt, Human
caacaacaaaaaugaaugaugu

SEQ ID NO: 179728 - RNA, 18 nt, Human
caacaacaacaacaacaa

SEQ ID NO: 179729 - RNA, 21 nt, Human
caacaacaacaacaacaaaaa

SEQ ID NO: 179730 - RNA, 23 nt, Human
caacauggugaaaccccgucucu

SEQ ID NO: 179731 - RNA, 23 nt, Human
cacacagcuuugaauugaauuag

SEQ ID NO: 179732 - RNA, 20 nt, Human
caccaaaguaccaaaaugac

SEQ ID NO: 179733 - RNA, 23 nt, Human
caccgcacucuagccuggcgaca

SEQ ID NO: 179734 - RNA, 19 nt, Human
caccuguaaucccagcacu

SEQ ID NO: 179735 - RNA, 24 nt, Human
caccuguaaucccagcacuuuggg

SEQ ID NO: 179736 - RNA, 22 nt, Human
cacgcacuaaaaaacucacucc

SEQ ID NO: 179737 - RNA, 22 nt, Human
cacucuagccuggcgacagagc

SEQ ID NO: 179738 - RNA, 23 nt, Human
cacucuagccuggcgacagagcg

SEQ ID NO: 179739 - RNA, 24 nt, Human
cagcacuuugggaggccgagucgg

SEQ ID NO: 179740 - RNA, 26 nt, Human
cagcacuuugggaggccgagucgggu

SEQ ID NO: 179741 - RNA, 21 nt, Human
ccaaaguaccaaaaugacauu

SEQ ID NO: 179742 - RNA, 19 nt, Human
ccaccgcacucuagccugg

SEQ ID NO: 179743 - RNA, 19 nt, Human
ccaccgcacucuagccugg

SEQ ID NO: 179744 - RNA, 20 nt, Human
ccaccgcacucuagccuggc

SEQ ID NO: 179745 - RNA, 23 nt, Human
ccaccgcacucuagccuggcgac

SEQ ID NO: 179746 - RNA, 21 nt, Human
cccaaugcucucaagaaugau

SEQ ID NO: 179747 - RNA, 28 nt, Human
cccacaauauuaagacaaucacugcuac

SEQ ID NO: 179748 - RNA, 24 nt, Human
cccauccugucacucccccaaaaa

SEQ ID NO: 179749 - RNA, 23 nt, Human
ccccauccugucacucccccaaa

SEQ ID NO: 179750 - RNA, 22 nt, Human
ccuggccaacauggugaaaccc

SEQ ID NO: 179751 - RNA, 23 nt, Human
ccuggccaacauggugaaacccc

SEQ ID NO: 179752 - RNA, 24 nt, Human
ccuggccaacauggugaaaccccg

SEQ ID NO: 179753 - RNA, 21 nt, Human
ccuggcgacagagcgagacuc

SEQ ID NO: 179754 - RNA, 19 nt, Human
ccuguagucccagcuacuc

SEQ ID NO: 179755 - RNA, 21 nt, Human
ccuguagucccagcuacucag

SEQ ID NO: 179756 - RNA, 23 nt, Human
ccugucacucccccaaaaaaggu

SEQ ID NO: 179757 - RNA, 24 nt, Human
cgagaccauccuggccaacauggu

SEQ ID NO: 179758 - RNA, 24 nt, Human
cgagucggguggaucacgagguca

SEQ ID NO: 179759 - RNA, 19 nt, Human
cguagcucuugggaaacca

SEQ ID NO: 179760 - RNA, 21 nt, Human
cuauacauuaaaaacauagcc

SEQ ID NO: 179761 - RNA, 18 nt, Human
cucaccucuaguuuuuag

SEQ ID NO: 179762 - RNA, 24 nt, Human
cugagacugauugagguauuuagc

SEQ ID NO: 179763 - RNA, 20 nt, Human
cugugggagguggagauugc

SEQ ID NO: 179764 - RNA, 22 nt, Human
cuuacaccuguaaucccagcac

SEQ ID NO: 179765 - RNA, 23 nt, Human
gaaacaaaaacuuauuucuugaa

SEQ ID NO: 179766 - RNA, 23 nt, Human
gagauugcagugagucaagaucg

SEQ ID NO: 179767 - RNA, 24 nt, Human
gaucuuaucucucaccaucugcac

SEQ ID NO: 179768 - RNA, 22 nt, Human
gcaaaguagcagaaaaucuauc

SEQ ID NO: 179769 - RNA, 23 nt, Human
gcacucuagccuggcgacagagc

SEQ ID NO: 179770 - RNA, 24 nt, Human
gccaacauggugaaaccccgucuc

SEQ ID NO: 179771 - RNA, 24 nt, Human
gcgacagagcgagacucugucuca

SEQ ID NO: 179772 - RNA, 20 nt, Human
gcgugccuguagucccagcu

SEQ ID NO: 179773 - RNA, 28 nt, Human
gcuaaaauacaaaaaaauuagccugguc

SEQ ID NO: 179774 - RNA, 19 nt, Human
ggaccuccgagcuucgccu

SEQ ID NO: 179775 - RNA, 23 nt, Human
ggagauugcagugagucaagauc

SEQ ID NO: 179776 - RNA, 24 nt, Human
ggagauugcagugagucaagaucg

SEQ ID NO: 179777 - RNA, 18 nt, Human
ggaggcugaggcacggga

SEQ ID NO: 179778 - RNA, 23 nt, Human
ggcacgguggcuuacaccuguaa

SEQ ID NO: 179779 - RNA, 23 nt, Human
gggagguggagauugcagugagu

SEQ ID NO: 179780 - RNA, 21 nt, Human
gguggaucacgaggucaggag

SEQ ID NO: 179781 - RNA, 23 nt, Human
gguggcuuacaccuguaauccca

SEQ ID NO: 179782 - RNA, 24 nt, Human
gguggcuuacaccuguaaucccag

SEQ ID NO: 179783 - RNA, 18 nt, Human
gucuggggagguauaaaa

SEQ ID NO: 179784 - RNA, 21 nt, Human
gugaaaccccgucucugcuaa

SEQ ID NO: 179785 - RNA, 18 nt, Human
guggugcgugccuguagu

SEQ ID NO: 179786 - RNA, 20 nt, Human
uaaaagggcuuuguaaaaaa

SEQ ID NO: 179787 - RNA, 23 nt, Human
uaaaauacaaaaaaauuagccug

SEQ ID NO: 179788 - RNA, 22 nt, Human
uaaaauagccaugcuugaaguc

SEQ ID NO: 179789 - RNA, 21 nt, Human
uaagaaacaacaaaaaauuag

SEQ ID NO: 179790 - RNA, 21 nt, Human
uaagacaaucacugcuacuaa

SEQ ID NO: 179791 - RNA, 22 nt, Human
uaagacaaucacugcuacuaaa

SEQ ID NO: 179792 - RNA, 22 nt, Human
uaagcuuuuuuaaaaaaugaga

SEQ ID NO: 179793 - RNA, 22 nt, Human
uaaguugaucugugcaaacgcu

SEQ ID NO: 179794 - RNA, 22 nt, Human
uaauuuucaguuaucugugggg

SEQ ID NO: 179795 - RNA, 24 nt, Human
uacaccuguaaucccagcacuuug

SEQ ID NO: 179796 - RNA, 18 nt, Human
uagcagcaaaguagcaga

SEQ ID NO: 179797 - RNA, 27 nt, Human
uagcagcaaaguagcagaaaauccuaa

SEQ ID NO: 179798 - RNA, 23 nt, Human
uagccugugcuaugguuugcauu

SEQ ID NO: 179799 - RNA, 25 nt, Human
uauagaaauguugucaggcuguugu

SEQ ID NO: 179800 - RNA, 18 nt, Human
uaucugauuaagcauucu

SEQ ID NO: 179801 - RNA, 21 nt, Human
uauucuucacugagaugagau

SEQ ID NO: 179802 - RNA, 20 nt, Human
uauuuuugccuucuugcuuc

SEQ ID NO: 179803 - RNA, 19 nt, Human
ucaacaacaacaacaacaa

SEQ ID NO: 179804 - RNA, 24 nt, Human
ucaacaacaacaacaacaacaaaa

SEQ ID NO: 179805 - RNA, 22 nt, Human
ucaacauuuugggaaaaggcau

SEQ ID NO: 179806 - RNA, 25 nt, Human
ucacgaggucaggagacucgagacc

SEQ ID NO: 179807 - RNA, 18 nt, Human
uccugaaccgcaaaagcc

SEQ ID NO: 179808 - RNA, 19 nt, Human
uccugaaccgcaaaagcca

SEQ ID NO: 179809 - RNA, 19 nt, Human
ucuaaauuacugagguugc

SEQ ID NO: 179810 - RNA, 22 nt, Human
ucuagccuggcgacagagcgag

SEQ ID NO: 179811 - RNA, 23 nt, Human
ucuagccuggcgacagagcgaga

SEQ ID NO: 179812 - RNA, 23 nt, Human
ucucugcuaaaauacaaaaaaau

SEQ ID NO: 179813 - RNA, 19 nt, Human
ucuguggggacugaaaacc

SEQ ID NO: 179814 - RNA, 21 nt, Human
ugaaccgcaaaagccaccuga

SEQ ID NO: 179815 - RNA, 21 nt, Human
ugagguugcuucuuuuucuuc

SEQ ID NO: 179816 - RNA, 21 nt, Human
ugaguaugugucugguuauag

SEQ ID NO: 179817 - RNA, 22 nt, Human
ugagucaagaucgcgccaccgc

SEQ ID NO: 179818 - RNA, 23 nt, Human
ugagucaagaucgcgccaccgca

SEQ ID NO: 179819 - RNA, 20 nt, Human
ugauaacagaagcacauuau

SEQ ID NO: 179820 - RNA, 20 nt, Human
ugauuaagcauucuucuuau

SEQ ID NO: 179821 - RNA, 22 nt, Human
ugcauuggccaaaacauuaaac

SEQ ID NO: 179822 - RNA, 24 nt, Human
ugccuguagucccagcuacucagg

SEQ ID NO: 179823 - RNA, 24 nt, Human
uggccaacauggugaaaccccguc

SEQ ID NO: 179824 - RNA, 21 nt, Human
uggcuuacaccuguaauccca

SEQ ID NO: 179825 - RNA, 22 nt, Human
uggcuuacaccuguaaucccag

SEQ ID NO: 179826 - RNA, 24 nt, Human
uggcuuacaccuguaaucccagca

SEQ ID NO: 179827 - RNA, 24 nt, Human
ugggaggccgagucggguggauca

SEQ ID NO: 179828 - RNA, 29 nt, Human
ugggagguggagauugcagugacaacggu

SEQ ID NO: 179829 - RNA, 24 nt, Human
ugggagguggagauugcagugagu

SEQ ID NO: 179830 - RNA, 18 nt, Human
uggugcgugccuguaguc

SEQ ID NO: 179831 - RNA, 24 nt, Human
ugguggugcgugccuguaguccca

SEQ ID NO: 179832 - RNA, 25 nt, Human
ugugaaacaaaaacuuauuucuuga

SEQ ID NO: 179833 - RNA, 26 nt, Human
ugugaaauaguaagauagucuuccaa

SEQ ID NO: 179834 - RNA, 19 nt, Human
ugugaacagauuccgcugc

SEQ ID NO: 179835 - RNA, 18 nt, Human
uguuuuggcuuaaacguu

SEQ ID NO: 179836 - RNA, 20 nt, Human
uuagccuggcaugguggugc

SEQ ID NO: 179837 - RNA, 23 nt, Human
uuaucuguggggacugaaaaccu

SEQ ID NO: 179838 - RNA, 20 nt, Human
uuccuaaaaaaggucugcga

SEQ ID NO: 179839 - RNA, 22 nt, Human
uugcagugagucaagaucgcgc

SEQ ID NO: 179840 - RNA, 22 nt, Human
uuuggugaagaaagguuuucuu

SEQ ID NO: 179841 - RNA, 23 nt, Human
acacagagggaccacagaaguca

SEQ ID NO: 179842 - RNA, 19 nt, Human
acagggaccucaaaagaga

SEQ ID NO: 179843 - RNA, 24 nt, Human
acccgugguagcugcccaaauuca

SEQ ID NO: 179844 - RNA, 21 nt, Human
agacagggaggaagggcugca

SEQ ID NO: 179845 - RNA, 19 nt, Human
agagguagacauacaggga

SEQ ID NO: 179846 - RNA, 18 nt, Human
agcauggcagacccgugg

SEQ ID NO: 179847 - RNA, 22 nt, Human
agggaccucaaaagagagucag

SEQ ID NO: 179848 - RNA, 20 nt, Human
aguguggacuccaguggcgu

SEQ ID NO: 179849 - RNA, 18 nt, Human
auggcagacccgugguag

SEQ ID NO: 179850 - RNA, 23 nt, Human
caccagccucaguaagccuuggc

SEQ ID NO: 179851 - RNA, 22 nt, Human
cagaagucagagguagacauac

SEQ ID NO: 179852 - RNA, 20 nt, Human
cagccucaguaagccuuggc

SEQ ID NO: 179853 - RNA, 22 nt, Human
caguggcucccuccaccagccu

SEQ ID NO: 179854 - RNA, 21 nt, Human
ccccaggccccaguaagaggc

SEQ ID NO: 179855 - RNA, 20 nt, Human
ccccuugcuccuccagagca

SEQ ID NO: 179856 - RNA, 24 nt, Human
ccuugggcuagagccccaggcccc

SEQ ID NO: 179857 - RNA, 24 nt, Human
gaccacagaagucagagguagaca

SEQ ID NO: 179858 - RNA, 18 nt, Human
gagguagacauacaggga

SEQ ID NO: 179859 - RNA, 20 nt, Human
gagguagacauacagggacc

SEQ ID NO: 179860 - RNA, 22 nt, Human
gcagacccgugguagcugccca

SEQ ID NO: 179861 - RNA, 24 nt, Human
gugagcccagcaguggcucccucc

SEQ ID NO: 179862 - RNA, 19 nt, Human
uccaccagccucaguaagc

SEQ ID NO: 179863 - RNA, 21 nt, Human
uccagagcauggcagacccgu

SEQ ID NO: 179864 - RNA, 26 nt, Human
ugcagagacagggaggaagggcugca

SEQ ID NO: 179865 - RNA, 18 nt, Human
uggcccccuugcuccucc

SEQ ID NO: 179866 - RNA, 22 nt, Human
uuggcuccucugagccuugggc

SEQ ID NO: 179867 - RNA, 23 nt, Human
agauguugagacuccagugaacu

SEQ ID NO: 179868 - RNA, 24 nt, Human
agugguucuccauguuuuuaccag

SEQ ID NO: 179869 - RNA, 28 nt, Human
cacagccacggcucccacugccagcacc

SEQ ID NO: 179870 - RNA, 20 nt, Human
cagccacggcucccacugcc

SEQ ID NO: 179871 - RNA, 19 nt, Human
cccacugccagcaccagcc

SEQ ID NO: 179872 - RNA, 23 nt, Human
gauagaagcugaacccaccucuu

SEQ ID NO: 179873 - RNA, 23 nt, Human
uacauagugguucuccauguuuu

SEQ ID NO: 179874 - RNA, 18 nt, Human
uccaccuuguuccucaga

SEQ ID NO: 179875 - RNA, 20 nt, Human
uucuacauagugguucucca

SEQ ID NO: 179876 - RNA, 25 nt, Human
uucuacauagugguucuccauguuu

SEQ ID NO: 179877 - RNA, 18 nt, Human
aaucgaguccugagcugg

SEQ ID NO: 179878 - RNA, 21 nt, Human
cagaaucgaguccugagcugg

SEQ ID NO: 179879 - RNA, 18 nt, Human
gagcagacuuccuuucca

SEQ ID NO: 179880 - RNA, 20 nt, Human
ggugcuaagugaagggcaga

SEQ ID NO: 179881 - RNA, 23 nt, Human
uaggggucuccuuccccugauuu

SEQ ID NO: 179882 - RNA, 21 nt, Human
ucaguagucauuuuaauaaau

SEQ ID NO: 179883 - RNA, 21 nt, Human
uccccugauuucuggaccuuc

SEQ ID NO: 179884 - RNA, 18 nt, Human
ucuggaccuucugagccu

SEQ ID NO: 179885 - RNA, 21 nt, Human
ugaagggcagaaucgaguccu

SEQ ID NO: 179886 - RNA, 19 nt, Human
ugagcagacuuccuuucca

SEQ ID NO: 179887 - RNA, 24 nt, Human
uggggcugaggcaggugcuaagug

SEQ ID NO: 179888 - RNA, 19 nt, Human
uucuggaccuucugagccu

SEQ ID NO: 179889 - RNA, 20 nt, Human
uuucuggaccuucugagccu

SEQ ID NO: 179890 - RNA, 20 nt, Human
aaccuguuggcucugacuua

SEQ ID NO: 179891 - RNA, 27 nt, Human
aaucccaacuugggugccccugcccac

SEQ ID NO: 179892 - RNA, 25 nt, Human
acccuaggcccccuucucgcuuccc

SEQ ID NO: 179893 - RNA, 21 nt, Human
acucaauaaauccaugcuaac

SEQ ID NO: 179894 - RNA, 23 nt, Human
acucaauaaauccaugcuaacug

SEQ ID NO: 179895 - RNA, 22 nt, Human
acucaguugucaucuccagaag

SEQ ID NO: 179896 - RNA, 20 nt, Human
auccuguucuccagcucucc

SEQ ID NO: 179897 - RNA, 21 nt, Human
caccugaaaugaaaucccaac

SEQ ID NO: 179898 - RNA, 24 nt, Human
caccugaaaugaaaucccaacuug

SEQ ID NO: 179899 - RNA, 24 nt, Human
cacuccuaagaaucuccaaugcac

SEQ ID NO: 179900 - RNA, 20 nt, Human
cagggaccuuuuuucuguuu

SEQ ID NO: 179901 - RNA, 23 nt, Human
cauuccauagcguguguggaacu

SEQ ID NO: 179902 - RNA, 22 nt, Human
ccacccuaggcccccuucucgc

SEQ ID NO: 179903 - RNA, 23 nt, Human
ccacuucucugucucuccccaac

SEQ ID NO: 179904 - RNA, 20 nt, Human
cccaagagacacuccuaaga

SEQ ID NO: 179905 - RNA, 22 nt, Human
ccccaaagugaucucuuucacc

SEQ ID NO: 179906 - RNA, 25 nt, Human
ccccacucaguugucaucuccagaa

SEQ ID NO: 179907 - RNA, 29 nt, Human
cccccaagagacacuccuaagaaucucca

SEQ ID NO: 179908 - RNA, 19 nt, Human
cccuaggcccccuucucgc

SEQ ID NO: 179909 - RNA, 24 nt, Human
cccugcccacuucucugucucucc

SEQ ID NO: 179910 - RNA, 20 nt, Human
ccugcagccccugccaccgc

SEQ ID NO: 179911 - RNA, 19 nt, Human
ccuggucacuugcuccugc

SEQ ID NO: 179912 - RNA, 18 nt, Human
ccuguucuccagcucucc

SEQ ID NO: 179913 - RNA, 18 nt, Human
cgccucccagaccacccu

SEQ ID NO: 179914 - RNA, 20 nt, Human
cuccguacugggccuggcac

SEQ ID NO: 179915 - RNA, 21 nt, Human
cuccuuggagacgccucccag

SEQ ID NO: 179916 - RNA, 21 nt, Human
cucuuucaccucuuucgggga

SEQ ID NO: 179917 - RNA, 19 nt, Human
cuguuuccuucaccauuuc

SEQ ID NO: 179918 - RNA, 20 nt, Human
gcagggaccuuuuuucuguu

SEQ ID NO: 179919 - RNA, 24 nt, Human
ggccuguccccaguccugcuccug

SEQ ID NO: 179920 - RNA, 26 nt, Human
uaaaaaauaaaauauuacccccaaga

SEQ ID NO: 179921 - RNA, 23 nt, Human
uaaauccaugcuaacugaacaga

SEQ ID NO: 179922 - RNA, 18 nt, Human
ucccagaccacccuaggc

SEQ ID NO: 179923 - RNA, 21 nt, Human
ucccagaccacccuaggcccc

SEQ ID NO: 179924 - RNA, 19 nt, Human
uccccaaccuguuggcucu

SEQ ID NO: 179925 - RNA, 18 nt, Human
ucugucucuccccaaccu

SEQ ID NO: 179926 - RNA, 24 nt, Human
ugaaaugaaaucccaacuugggug

SEQ ID NO: 179927 - RNA, 19 nt, Human
ugagcgccuuccugcccaa

SEQ ID NO: 179928 - RNA, 23 nt, Human
ugaucucuuucaccucuuucggg

SEQ ID NO: 179929 - RNA, 21 nt, Human
ugcaggggcgaucaggccugu

SEQ ID NO: 179930 - RNA, 18 nt, Human
ugcuccugcagccccugc

SEQ ID NO: 179931 - RNA, 19 nt, Human
ugcuccugcagccccugcc

SEQ ID NO: 179932 - RNA, 21 nt, Human
uguucacggucuguuuucccc

SEQ ID NO: 179933 - RNA, 19 nt, Human
uguuuuguguucacggucu

SEQ ID NO: 179934 - RNA, 22 nt, Human
uuaauucuacuccagccaaggc

SEQ ID NO: 179935 - RNA, 18 nt, Human
uucggggauggcuuaagu

SEQ ID NO: 179936 - RNA, 22 nt, Human
uuggagacgccucccagaccac

SEQ ID NO: 179937 - RNA, 24 nt, Human
uugggugccccugcccacuucucu

SEQ ID NO: 179938 - RNA, 21 nt, Human
aaaaauccaugagaaagguuc

SEQ ID NO: 179939 - RNA, 18 nt, Human
aaaacccaagaauaccag

SEQ ID NO: 179940 - RNA, 25 nt, Human
aaaagaccuaagauguucaggaagu

SEQ ID NO: 179941 - RNA, 22 nt, Human
aaaaggcauuuggagaaacugg

SEQ ID NO: 179942 - RNA, 18 nt, Human
aaagaacacucuccagaa

SEQ ID NO: 179943 - RNA, 18 nt, Human
aaguugcuggucacucca

SEQ ID NO: 179944 - RNA, 23 nt, Human
aauuaguaauuuucauuguacaa

SEQ ID NO: 179945 - RNA, 23 nt, Human
acccaucuaccccauacaccccc

SEQ ID NO: 179946 - RNA, 23 nt, Human
agaaaaaggaaauucauuucagu

SEQ ID NO: 179947 - RNA, 19 nt, Human
agaacacucuccagaacac

SEQ ID NO: 179948 - RNA, 24 nt, Human
agaauacaaguucugaauuacugu

SEQ ID NO: 179949 - RNA, 18 nt, Human
aggaaaacccaagaauac

SEQ ID NO: 179950 - RNA, 21 nt, Human
aggaaguauuuauuccuggcc

SEQ ID NO: 179951 - RNA, 21 nt, Human
agggaaaaacauuuuaggaga

SEQ ID NO: 179952 - RNA, 19 nt, Human
agugauugaacuccuugga

SEQ ID NO: 179953 - RNA, 22 nt, Human
aguggaaucuugaugcuuucaa

SEQ ID NO: 179954 - RNA, 21 nt, Human
auccucugucuuuuucuuguu

SEQ ID NO: 179955 - RNA, 21 nt, Human
augaaaaggcaaguucaggca

SEQ ID NO: 179956 - RNA, 21 nt, Human
auuccuggccagaauuauuuc

SEQ ID NO: 179957 - RNA, 22 nt, Human
auuccuggccagaauuauuuca

SEQ ID NO: 179958 - RNA, 25 nt, Human
caaaugcauggaaaaucuuauucug

SEQ ID NO: 179959 - RNA, 22 nt, Human
caacaugcaccucucuuauccc

SEQ ID NO: 179960 - RNA, 24 nt, Human
caacaugcaccucucuuauccccu

SEQ ID NO: 179961 - RNA, 19 nt, Human
caccauauuggcccacacc

SEQ ID NO: 179962 - RNA, 23 nt, Human
cacccaucuaccccauacaccuc

SEQ ID NO: 179963 - RNA, 21 nt, Human
caccuggugcacuuucuacag

SEQ ID NO: 179964 - RNA, 21 nt, Human
cagaauuauuucaguuucuug

SEQ ID NO: 179965 - RNA, 21 nt, Human
cauaugugcauuauuuucaaa

SEQ ID NO: 179966 - RNA, 27 nt, Human
caucccaacugucuuaaaaauguuuac

SEQ ID NO: 179967 - RNA, 24 nt, Human
caugcaagaagaaaagugucauac

SEQ ID NO: 179968 - RNA, 20 nt, Human
ccaauacaugacaaacaaaa

SEQ ID NO: 179969 - RNA, 21 nt, Human
ccagaacacaugaucugaugg

SEQ ID NO: 179970 - RNA, 19 nt, Human
cccauacacccccagugaa

SEQ ID NO: 179971 - RNA, 23 nt, Human
cccaucuaccccauacaccccca

SEQ ID NO: 179972 - RNA, 19 nt, Human
ccccagugaaccuagguau

SEQ ID NO: 179973 - RNA, 24 nt, Human
ccccauacacccccagugaaccua

SEQ ID NO: 179974 - RNA, 18 nt, Human
ccccucccucuccaccca

SEQ ID NO: 179975 - RNA, 26 nt, Human
ccugacuuuagcucaaaaaaaaaaaa

SEQ ID NO: 179976 - RNA, 19 nt, Human
cuaaugucuuuguguuuuc

SEQ ID NO: 179977 - RNA, 23 nt, Human
cuacagcaccuuuuuucuucucc

SEQ ID NO: 179978 - RNA, 23 nt, Human
cuccaaaagacugcuaaacucau

SEQ ID NO: 179979 - RNA, 22 nt, Human
cuuucaaccucucuugcauucc

SEQ ID NO: 179980 - RNA, 18 nt, Human
gaacacaugaucugaugg

SEQ ID NO: 179981 - RNA, 20 nt, Human
gaaguaaaaugaaaaggcaa

SEQ ID NO: 179982 - RNA, 20 nt, Human
gaauccucuuucaaccucuc

SEQ ID NO: 179983 - RNA, 23 nt, Human
gaugguaaugauauugugcaagg

SEQ ID NO: 179984 - RNA, 18 nt, Human
gcauuuggagaaacuggu

SEQ ID NO: 179985 - RNA, 20 nt, Human
gcuauauccuaaaaaaagga

SEQ ID NO: 179986 - RNA, 23 nt, Human
gcugcuguuugguacuuuccuca

SEQ ID NO: 179987 - RNA, 24 nt, Human
ggaaaaacauuuuaggagaaaaaa

SEQ ID NO: 179988 - RNA, 23 nt, Human
gggcaccacucuuuugcuuaaaa

SEQ ID NO: 179989 - RNA, 25 nt, Human
uaaaaugaaaaggcaaguucaggca

SEQ ID NO: 179990 - RNA, 21 nt, Human
uaauaguccacucuaagcauu

SEQ ID NO: 179991 - RNA, 22 nt, Human
uaauuuucauuguacaaaacug

SEQ ID NO: 179992 - RNA, 25 nt, Human
uacagcaccuuuuuucuucuccaca

SEQ ID NO: 179993 - RNA, 18 nt, Human
uaccaagaauaaaaaaag

SEQ ID NO: 179994 - RNA, 22 nt, Human
uaccccauacacccccagugaa

SEQ ID NO: 179995 - RNA, 20 nt, Human
uaucuauguaucaccuaaug

SEQ ID NO: 179996 - RNA, 21 nt, Human
uauguagcugacaugcaugca

SEQ ID NO: 179997 - RNA, 25 nt, Human
ucacauacacagaaccauugcuacg

SEQ ID NO: 179998 - RNA, 20 nt, Human
ucagaaaaaggaaauucauu

SEQ ID NO: 179999 - RNA, 18 nt, Human
uccacaauugaguggaau

SEQ ID NO: 180000 - RNA, 19 nt, Human
uccaugagaaagguucaaa

SEQ ID NO: 180001 - RNA, 23 nt, Human
uccccucccucuccacccaucua

SEQ ID NO: 180002 - RNA, 21 nt, Human
uccuaaaaaaaggagagaaaa

SEQ ID NO: 180003 - RNA, 22 nt, Human
ucucuuauccccucccucucca

SEQ ID NO: 180004 - RNA, 23 nt, Human
ucuugaugcuuucaagccuguau

SEQ ID NO: 180005 - RNA, 27 nt, Human
ugaaaaggcaaguucaggcacucagac

SEQ ID NO: 180006 - RNA, 18 nt, Human
ugaaagaaaagugcugau

SEQ ID NO: 180007 - RNA, 19 nt, Human
ugaaugugaguaguagcug

SEQ ID NO: 180008 - RNA, 22 nt, Human
ugacaaacaaaacaaacucuuc

SEQ ID NO: 180009 - RNA, 25 nt, Human
ugagaaagguucaaauuugaacacc

SEQ ID NO: 180010 - RNA, 21 nt, Human
ugcaaaauucauuuaggcaca

SEQ ID NO: 180011 - RNA, 19 nt, Human
uggaauguuuuagcaggga

SEQ ID NO: 180012 - RNA, 23 nt, Human
uggaauguuuuagcagggacuua

SEQ ID NO: 180013 - RNA, 18 nt, Human
uguguuuucuaagccuca

SEQ ID NO: 180014 - RNA, 23 nt, Human
uguugaaaagaccuaagauguuc

SEQ ID NO: 180015 - RNA, 19 nt, Human
uuaaauaccaacaugcacc

SEQ ID NO: 180016 - RNA, 22 nt, Human
uuaacaaaaccaguauccauaa

SEQ ID NO: 180017 - RNA, 22 nt, Human
uuaacaccuggugcacuuucua

SEQ ID NO: 180018 - RNA, 24 nt, Human
uuaaguaggaaaacccaagaauac

SEQ ID NO: 180019 - RNA, 28 nt, Human
uuaauaguccacucuaagcauuuuuucu

SEQ ID NO: 180020 - RNA, 25 nt, Human
uuacugcuauauccuaaaaaaagga

SEQ ID NO: 180021 - RNA, 19 nt, Human
uuagccacaauuaccaccc

SEQ ID NO: 180022 - RNA, 21 nt, Human
uucaccaaucuucugugauga

SEQ ID NO: 180023 - RNA, 21 nt, Human
uuggagaaacugguagauguc

SEQ ID NO: 180024 - RNA, 23 nt, Human
uuggcccacaccacaaaaaucca

SEQ ID NO: 180025 - RNA, 23 nt, Human
uuguauguguacuacugaauccu

SEQ ID NO: 180026 - RNA, 22 nt, Human
uuucaccaaucuucugugauga

SEQ ID NO: 180027 - RNA, 21 nt, Human
uuucagaaaaaggaaauucau

SEQ ID NO: 180028 - RNA, 24 nt, Human
uuucagaaaaaggaaauucauuuc

SEQ ID NO: 180029 - RNA, 22 nt, Human
uuuggagaaacugguagauguc

SEQ ID NO: 180030 - RNA, 18 nt, Human
uuugugaguuuauacugu

SEQ ID NO: 180031 - RNA, 21 nt, Human
uuuugcuuaaaaguagugaag

SEQ ID NO: 180032 - RNA, 23 nt, Human
aaaaggccagagggcccccagua

SEQ ID NO: 180033 - RNA, 19 nt, Human
aacaguagaacuaggaagg

SEQ ID NO: 180034 - RNA, 22 nt, Human
acuucucaggaccccucuguug

SEQ ID NO: 180035 - RNA, 21 nt, Human
agguggagguggggacgaugg

SEQ ID NO: 180036 - RNA, 22 nt, Human
caaaaggccagagggcccccag

SEQ ID NO: 180037 - RNA, 19 nt, Human
caagcaccugcuuccccag

SEQ ID NO: 180038 - RNA, 18 nt, Human
caccaggaaggccucagg

SEQ ID NO: 180039 - RNA, 19 nt, Human
caccugcuuccccagccca

SEQ ID NO: 180040 - RNA, 28 nt, Human
cauggccagcaagcaccugcuuccccag

SEQ ID NO: 180041 - RNA, 21 nt, Human
ccaaauccggcacaagcucug

SEQ ID NO: 180042 - RNA, 18 nt, Human
ccaggagggggcaggggg

SEQ ID NO: 180043 - RNA, 21 nt, Human
ccccagcccagucaucucugc

SEQ ID NO: 180044 - RNA, 25 nt, Human
cccccaguacccuuggccaagagcu

SEQ ID NO: 180045 - RNA, 21 nt, Human
ccuccgucgccugccugccgg

SEQ ID NO: 180046 - RNA, 24 nt, Human
cuccauggccagcaagcaccugcu

SEQ ID NO: 180047 - RNA, 22 nt, Human
cugugaggagaggguuugagga

SEQ ID NO: 180048 - RNA, 20 nt, Human
cugugcgaucaaggcugacc

SEQ ID NO: 180049 - RNA, 23 nt, Human
gaaggccucagguguucaagaac

SEQ ID NO: 180050 - RNA, 20 nt, Human
ggagaggaagccguagugcc

SEQ ID NO: 180051 - RNA, 21 nt, Human
ggcggcccagguggagguggg

SEQ ID NO: 180052 - RNA, 19 nt, Human
uccaggagggggcaggggg

SEQ ID NO: 180053 - RNA, 22 nt, Human
uccccagcccagucaucucugc

SEQ ID NO: 180054 - RNA, 22 nt, Human
uccccagcccagucaucucugg

SEQ ID NO: 180055 - RNA, 18 nt, Human
uccccuugacagggccaa

SEQ ID NO: 180056 - RNA, 19 nt, Human
ugacagggccaaauccggc

SEQ ID NO: 180057 - RNA, 23 nt, Human
ugagguugggguaaguuggcucu

SEQ ID NO: 180058 - RNA, 23 nt, Human
ugcaaaaggccagagggccccca

SEQ ID NO: 180059 - RNA, 18 nt, Human
ugccgggcggcccaggug

SEQ ID NO: 180060 - RNA, 18 nt, Human
ugugaggagaggguuuga

SEQ ID NO: 180061 - RNA, 22 nt, Human
ugugaggagaggguuugaggac

SEQ ID NO: 180062 - RNA, 20 nt, Human
uguugggugacauaagccac

SEQ ID NO: 180063 - RNA, 18 nt, Human
aagagcacauauaaugca

SEQ ID NO: 180064 - RNA, 24 nt, Human
aaggagcugcagggugacagaugu

SEQ ID NO: 180065 - RNA, 21 nt, Human
acaguugaccggguggggaca

SEQ ID NO: 180066 - RNA, 23 nt, Human
acucccuagcagggcugacaccu

SEQ ID NO: 180067 - RNA, 18 nt, Human
acuugcucggugaccagg

SEQ ID NO: 180068 - RNA, 20 nt, Human
agaaggaaagguugcaacau

SEQ ID NO: 180069 - RNA, 19 nt, Human
agacaacagauucaagagc

SEQ ID NO: 180070 - RNA, 20 nt, Human
agacaacagauucaagagca

SEQ ID NO: 180071 - RNA, 21 nt, Human
agacuccauugggcaccucag

SEQ ID NO: 180072 - RNA, 23 nt, Human
agagcacauauaaugcaaguucc

SEQ ID NO: 180073 - RNA, 24 nt, Human
agagggaggagaagccaagggcaa

SEQ ID NO: 180074 - RNA, 19 nt, Human
agcauaaagacaaugaaga

SEQ ID NO: 180075 - RNA, 24 nt, Human
aggagaagccaagggcaacccaag

SEQ ID NO: 180076 - RNA, 21 nt, Human
aggcuucuggccauaacgaac

SEQ ID NO: 180077 - RNA, 18 nt, Human
agggaacagaugccaaaa

SEQ ID NO: 180078 - RNA, 18 nt, Human
agggaacagaugccaaaa

SEQ ID NO: 180079 - RNA, 26 nt, Human
agggagggugaucaggucaaggaggu

SEQ ID NO: 180080 - RNA, 21 nt, Human
aggguggggagggaacugcag

SEQ ID NO: 180081 - RNA, 27 nt, Human
agugagaaagcaucaguucagaaggga

SEQ ID NO: 180082 - RNA, 19 nt, Human
auacuggguagaggguggg

SEQ ID NO: 180083 - RNA, 25 nt, Human
aucccuuccaggccagcuuuugcca

SEQ ID NO: 180084 - RNA, 27 nt, Human
auucuaucccucuggcuaucccuucca

SEQ ID NO: 180085 - RNA, 23 nt, Human
caacagauucaagagcacauaua

SEQ ID NO: 180086 - RNA, 22 nt, Human
caaggccaucucaccacuacuc

SEQ ID NO: 180087 - RNA, 21 nt, Human
caagggagaaagggaagggau

SEQ ID NO: 180088 - RNA, 21 nt, Human
cacagccagggaacagaugcc

SEQ ID NO: 180089 - RNA, 21 nt, Human
cacagccagggaacagaugcc

SEQ ID NO: 180090 - RNA, 23 nt, Human
cacggucgagugcuuguguacuu

SEQ ID NO: 180091 - RNA, 23 nt, Human
cagaagggacacgucuucuacug

SEQ ID NO: 180092 - RNA, 22 nt, Human
cagagcccugguuauaguuucu

SEQ ID NO: 180093 - RNA, 24 nt, Human
cagcacgagcauacggaauaugaa

SEQ ID NO: 180094 - RNA, 23 nt, Human
cagcauaaagacaaugaagacau

SEQ ID NO: 180095 - RNA, 23 nt, Human
cagccaggcuaaggaggagggac

SEQ ID NO: 180096 - RNA, 23 nt, Human
caggcacugauuaaagucggggg

SEQ ID NO: 180097 - RNA, 19 nt, Human
cagggugacagauguuggc

SEQ ID NO: 180098 - RNA, 25 nt, Human
cagugcagccacagccaaccccuug

SEQ ID NO: 180099 - RNA, 24 nt, Human
cagugcagccacagccagcauaaa

SEQ ID NO: 180100 - RNA, 26 nt, Human
cauucuaucccucuggcuaucccuuc

SEQ ID NO: 180101 - RNA, 21 nt, Human
ccaaggcauuuguaaagcuga

SEQ ID NO: 180102 - RNA, 25 nt, Human
ccaaucgcccaucuuggcacagcca

SEQ ID NO: 180103 - RNA, 19 nt, Human
ccacaaugaagcccaccuc

SEQ ID NO: 180104 - RNA, 21 nt, Human
ccacaaugaagcccaccucca

SEQ ID NO: 180105 - RNA, 25 nt, Human
cccacaaugaagcccaccuccaugg

SEQ ID NO: 180106 - RNA, 23 nt, Human
ccccccaggaagacucagcagcu

SEQ ID NO: 180107 - RNA, 19 nt, Human
cccuucuuucccucuaccc

SEQ ID NO: 180108 - RNA, 22 nt, Human
cccuucuuucccucuacccugu

SEQ ID NO: 180109 - RNA, 23 nt, Human
ccuccuuuguucccaccuggucc

SEQ ID NO: 180110 - RNA, 23 nt, Human
ccucucugagccuccuuuguucc

SEQ ID NO: 180111 - RNA, 25 nt, Human
ccuucagggaauggcugggugaaca

SEQ ID NO: 180112 - RNA, 20 nt, Human
cggucgagugcuuguguacu

SEQ ID NO: 180113 - RNA, 23 nt, Human
cuaccacggucgagugcuugugu

SEQ ID NO: 180114 - RNA, 20 nt, Human
cuaugcccacagaggggcca

SEQ ID NO: 180115 - RNA, 24 nt, Human
cucccuggacuuuccuuccguggg

SEQ ID NO: 180116 - RNA, 19 nt, Human
cuccugaccucguacuugc

SEQ ID NO: 180117 - RNA, 24 nt, Human
cugaguagagggaggagaagccaa

SEQ ID NO: 180118 - RNA, 23 nt, Human
cuucugcuucuuuuccuccuccc

SEQ ID NO: 180119 - RNA, 24 nt, Human
gaacuuagagaacgcauuugguag

SEQ ID NO: 180120 - RNA, 20 nt, Human
gacaacagauucaagagcaa

SEQ ID NO: 180121 - RNA, 20 nt, Human
gaggagggagggugaucagg

SEQ ID NO: 180122 - RNA, 21 nt, Human
gccaagggcaacccaaggcca

SEQ ID NO: 180123 - RNA, 19 nt, Human
gcggugaccuggugagacu

SEQ ID NO: 180124 - RNA, 26 nt, Human
ggggagggaacugcagucuggguggg

SEQ ID NO: 180125 - RNA, 18 nt, Human
ggguagaggguggggagg

SEQ ID NO: 180126 - RNA, 20 nt, Human
gucucccagugcuugcugcc

SEQ ID NO: 180127 - RNA, 18 nt, Human
guuuguguguacagugac

SEQ ID NO: 180128 - RNA, 18 nt, Human
uagaauuaaugagcaacg

SEQ ID NO: 180129 - RNA, 19 nt, Human
uaucccagagcccugguua

SEQ ID NO: 180130 - RNA, 22 nt, Human
ucaaaggagccaagcagugaug

SEQ ID NO: 180131 - RNA, 21 nt, Human
ucauucuaucccucuggcuau

SEQ ID NO: 180132 - RNA, 22 nt, Human
uccaggcacugauuaaagucgg

SEQ ID NO: 180133 - RNA, 20 nt, Human
uccauggagacaacagauuc

SEQ ID NO: 180134 - RNA, 20 nt, Human
uccccaggagucugcuccug

SEQ ID NO: 180135 - RNA, 20 nt, Human
ucccccagggccauucucca

SEQ ID NO: 180136 - RNA, 18 nt, Human
ucccucuggcuaucccuu

SEQ ID NO: 180137 - RNA, 18 nt, Human
ucccuggacuuuccuucc

SEQ ID NO: 180138 - RNA, 21 nt, Human
uccuuuguucccaccuggucc

SEQ ID NO: 180139 - RNA, 25 nt, Human
uccuuuguucccaccugguccugau

SEQ ID NO: 180140 - RNA, 23 nt, Human
ucuuccagcccaggugguagagu

SEQ ID NO: 180141 - RNA, 20 nt, Human
ucuuuccucucugagccucc

SEQ ID NO: 180142 - RNA, 18 nt, Human
ugaaaggcuucguauacu

SEQ ID NO: 180143 - RNA, 18 nt, Human
ugaagggauugaagaauu

SEQ ID NO: 180144 - RNA, 20 nt, Human
ugaccuggugagacuccauu

SEQ ID NO: 180145 - RNA, 24 nt, Human
ugacucccuagcagggcugacacc

SEQ ID NO: 180146 - RNA, 24 nt, Human
ugacucccuagcagggcugacacc

SEQ ID NO: 180147 - RNA, 22 nt, Human
ugagaaagcaucaguucagaag

SEQ ID NO: 180148 - RNA, 22 nt, Human
ugcccagcacgagcauacggaa

SEQ ID NO: 180149 - RNA, 22 nt, Human
ugcccagcacgagcauacggaa

SEQ ID NO: 180150 - RNA, 21 nt, Human
uggaggagggagggugaucag

SEQ ID NO: 180151 - RNA, 20 nt, Human
uggcugaugaucuggucagg

SEQ ID NO: 180152 - RNA, 21 nt, Human
uggcugaugaucuggucaggg

SEQ ID NO: 180153 - RNA, 18 nt, Human
uggggaaauuccacuggc

SEQ ID NO: 180154 - RNA, 21 nt, Human
uggguugucaccucucuuacu

SEQ ID NO: 180155 - RNA, 22 nt, Human
uggucaggguucgagagaggac

SEQ ID NO: 180156 - RNA, 18 nt, Human
uguaauccucugccuguc

SEQ ID NO: 180157 - RNA, 20 nt, Human
uguaauccucugccugucug

SEQ ID NO: 180158 - RNA, 20 nt, Human
uguguucucccaggagggac

SEQ ID NO: 180159 - RNA, 21 nt, Human
uuccagcccaggugguagagu

SEQ ID NO: 180160 - RNA, 27 nt, Human
uucccuucuuucccucuacccuguuuc

SEQ ID NO: 180161 - RNA, 22 nt, Human
uuccgugggcuucuucacacuc

SEQ ID NO: 180162 - RNA, 19 nt, Human
uuuguaaagcugaggcugc

SEQ ID NO: 180163 - RNA, 25 nt, Human
uuuuuuuuuuuuuuuuuuaacaagg

SEQ ID NO: 180164 - RNA, 25 nt, Human
accccagacaccuccuccuuuuccu

SEQ ID NO: 180165 - RNA, 25 nt, Human
accuccuccuuuuccuuguggccag

SEQ ID NO: 180166 - RNA, 19 nt, Human
agagggaagagggaagggu

SEQ ID NO: 180167 - RNA, 19 nt, Human
agcaccccugcccucugcu

SEQ ID NO: 180168 - RNA, 20 nt, Human
agcacuauuccuccuuuacu

SEQ ID NO: 180169 - RNA, 24 nt, Human
aggaaggccccgggaggaagggaa

SEQ ID NO: 180170 - RNA, 20 nt, Human
aggcagagagaggccuuggg

SEQ ID NO: 180171 - RNA, 20 nt, Human
agggugcaggcaacaagggc

SEQ ID NO: 180172 - RNA, 19 nt, Human
aucccaucucuuguaccca

SEQ ID NO: 180173 - RNA, 23 nt, Human
aucccuccucacugaugugacuc

SEQ ID NO: 180174 - RNA, 21 nt, Human
caacaagggcagcccacacuc

SEQ ID NO: 180175 - RNA, 25 nt, Human
caaccccugcuccaacuuaucugcc

SEQ ID NO: 180176 - RNA, 21 nt, Human
cacaccucccugucacugcca

SEQ ID NO: 180177 - RNA, 19 nt, Human
cacauguccacagcacccc

SEQ ID NO: 180178 - RNA, 20 nt, Human
cacccucccuucuccaccuc

SEQ ID NO: 180179 - RNA, 21 nt, Human
caccuggcugcugcugcccuu

SEQ ID NO: 180180 - RNA, 25 nt, Human
ccacagcaccccugcccucugcucc

SEQ ID NO: 180181 - RNA, 22 nt, Human
ccaccccuccagcuccucaaaa

SEQ ID NO: 180182 - RNA, 22 nt, Human
ccagagagagggagagggaaga

SEQ ID NO: 180183 - RNA, 24 nt, Human
cccaccccuccagcuccucaaaag

SEQ ID NO: 180184 - RNA, 20 nt, Human
ccccaccccuccagcuccuc

SEQ ID NO: 180185 - RNA, 19 nt, Human
ccccagacaccuccuccuu

SEQ ID NO: 180186 - RNA, 19 nt, Human
ccccugcccucugcuccuc

SEQ ID NO: 180187 - RNA, 24 nt, Human
ccccugcccucugcuccucuuacc

SEQ ID NO: 180188 - RNA, 18 nt, Human
cccucccuucuccaccca

SEQ ID NO: 180189 - RNA, 18 nt, Human
cccugcccucugcuccuc

SEQ ID NO: 180190 - RNA, 21 nt, Human
cccugcccucugcuccucuua

SEQ ID NO: 180191 - RNA, 23 nt, Human
cccuucuccacccacauguccac

SEQ ID NO: 180192 - RNA, 22 nt, Human
ccgggaggaagggaaguagcca

SEQ ID NO: 180193 - RNA, 25 nt, Human
ccucaaaaggaaggccccgggagga

SEQ ID NO: 180194 - RNA, 20 nt, Human
ccucauucacaccucccugu

SEQ ID NO: 180195 - RNA, 24 nt, Human
ccuggcugcugcugcccuuuccca

SEQ ID NO: 180196 - RNA, 19 nt, Human
cgcccagggcagggucggg

SEQ ID NO: 180197 - RNA, 19 nt, Human
cucccaguaaccuugagca

SEQ ID NO: 180198 - RNA, 24 nt, Human
cucccugucacugccacaccuggc

SEQ ID NO: 180199 - RNA, 23 nt, Human
cucccuucuccacccacaugucc

SEQ ID NO: 180200 - RNA, 19 nt, Human
cucuagcuccccaccccuc

SEQ ID NO: 180201 - RNA, 22 nt, Human
cugcuccaacuuaucugccugc

SEQ ID NO: 180202 - RNA, 18 nt, Human
cugcuucucucucccuaa

SEQ ID NO: 180203 - RNA, 22 nt, Human
gaagggaaguagccagggaagg

SEQ ID NO: 180204 - RNA, 24 nt, Human
gaagggaaguagccagggaaggaa

SEQ ID NO: 180205 - RNA, 18 nt, Human
gacaccuccuccuuuucc

SEQ ID NO: 180206 - RNA, 21 nt, Human
gagaaggaggggcucgcccag

SEQ ID NO: 180207 - RNA, 19 nt, Human
gccacaccuggcugcugcu

SEQ ID NO: 180208 - RNA, 21 nt, Human
ggaggaagggaaguagccagg

SEQ ID NO: 180209 - RNA, 22 nt, Human
gggaggaagggaaguagccagg

SEQ ID NO: 180210 - RNA, 27 nt, Human
gggucgggggugggaugggagguugcc

SEQ ID NO: 180211 - RNA, 22 nt, Human
uaacucccucaccccagacacc

SEQ ID NO: 180212 - RNA, 23 nt, Human
uagcuccccaccccuccagcucc

SEQ ID NO: 180213 - RNA, 23 nt, Human
uccacagcaccccugcccucugc

SEQ ID NO: 180214 - RNA, 18 nt, Human
uccccagcaggcagaggc

SEQ ID NO: 180215 - RNA, 22 nt, Human
uccccagcaggcagaggccugu

SEQ ID NO: 180216 - RNA, 18 nt, Human
ucccucaccccagacacc

SEQ ID NO: 180217 - RNA, 18 nt, Human
uccucaaaaggaaggccc

SEQ ID NO: 180218 - RNA, 19 nt, Human
ucgcccagggcagggucgg

SEQ ID NO: 180219 - RNA, 19 nt, Human
ucucccuaacucccucacc

SEQ ID NO: 180220 - RNA, 19 nt, Human
ucucuuguacccagugguc

SEQ ID NO: 180221 - RNA, 19 nt, Human
ucugccugcuucucucucc

SEQ ID NO: 180222 - RNA, 23 nt, Human
ucuuacccacaucccuccucacu

SEQ ID NO: 180223 - RNA, 19 nt, Human
ugacuccagaaacagggua

SEQ ID NO: 180224 - RNA, 24 nt, Human
ugcaggcaacaagggcagcccaca

SEQ ID NO: 180225 - RNA, 24 nt, Human
ugccucauucacaccucccuguca

SEQ ID NO: 180226 - RNA, 26 nt, Human
ugcuggccacccucccuucuccaccc

SEQ ID NO: 180227 - RNA, 22 nt, Human
uggccucuagcuccccaccccu

SEQ ID NO: 180228 - RNA, 23 nt, Human
uggcugcugcugcccuuucccag

SEQ ID NO: 180229 - RNA, 18 nt, Human
uuacccacaucccuccuc

SEQ ID NO: 180230 - RNA, 21 nt, Human
aaacaagagguggauucaagg

SEQ ID NO: 180231 - RNA, 23 nt, Human
aaauaaccagcucaaggucucac

SEQ ID NO: 180232 - RNA, 20 nt, Human
aacacuuuaugagcagaacc

SEQ ID NO: 180233 - RNA, 25 nt, Human
aacagagcuaguaugcuggaaggaa

SEQ ID NO: 180234 - RNA, 22 nt, Human
aagagguggauucaaggccagg

SEQ ID NO: 180235 - RNA, 22 nt, Human
accucauuuaaucucuuagaau

SEQ ID NO: 180236 - RNA, 23 nt, Human
accuccucuucccuucuccgcug

SEQ ID NO: 180237 - RNA, 19 nt, Human
acucacaacgacccucuga

SEQ ID NO: 180238 - RNA, 22 nt, Human
acucauuacugugaaauuuaga

SEQ ID NO: 180239 - RNA, 18 nt, Human
agauccagggaauaucua

SEQ ID NO: 180240 - RNA, 21 nt, Human
aggggagaccaguucaggugg

SEQ ID NO: 180241 - RNA, 23 nt, Human
aggucaagucacucacuuaaaac

SEQ ID NO: 180242 - RNA, 18 nt, Human
agugccccauaaaugcug

SEQ ID NO: 180243 - RNA, 21 nt, Human
aguucugacuuguucaauacu

SEQ ID NO: 180244 - RNA, 22 nt, Human
caagcugcagauaggaaacuga

SEQ ID NO: 180245 - RNA, 22 nt, Human
caaggucucacagcugcugggu

SEQ ID NO: 180246 - RNA, 20 nt, Human
caccuccucuucccuucucc

SEQ ID NO: 180247 - RNA, 22 nt, Human
cagagccugugcucuccaccac

SEQ ID NO: 180248 - RNA, 20 nt, Human
caggcaugaaguuaaacacu

SEQ ID NO: 180249 - RNA, 22 nt, Human
caggccuuaacucacacaucuu

SEQ ID NO: 180250 - RNA, 20 nt, Human
cccaagcugcagauaggaaa

SEQ ID NO: 180251 - RNA, 21 nt, Human
cccccagccacacuaguugcc

SEQ ID NO: 180252 - RNA, 18 nt, Human
ccccuggagcugacuugc

SEQ ID NO: 180253 - RNA, 19 nt, Human
ccucccaguccuggaguga

SEQ ID NO: 180254 - RNA, 23 nt, Human
ccuggggaagcccagccaccccc

SEQ ID NO: 180255 - RNA, 18 nt, Human
ccuugugguggaaagaug

SEQ ID NO: 180256 - RNA, 23 nt, Human
cuccugcccuagaccagauucuu

SEQ ID NO: 180257 - RNA, 20 nt, Human
cugaguucugacuuguucaa

SEQ ID NO: 180258 - RNA, 23 nt, Human
cugauaauaacaaucaccauuua

SEQ ID NO: 180259 - RNA, 22 nt, Human
cuggagcugacuugcaccucug

SEQ ID NO: 180260 - RNA, 23 nt, Human
gccugccuguccacgugugugug

SEQ ID NO: 180261 - RNA, 20 nt, Human
gcgccuggugggggccgugc

SEQ ID NO: 180262 - RNA, 20 nt, Human
gcucuccaccaccuccucuu

SEQ ID NO: 180263 - RNA, 24 nt, Human
gcugggccuggggaagccgugcac

SEQ ID NO: 180264 - RNA, 21 nt, Human
ggaaaaaccaucguaugaaug

SEQ ID NO: 180265 - RNA, 25 nt, Human
ggggagaccaguucagguggggggu

SEQ ID NO: 180266 - RNA, 21 nt, Human
gguaguuauuacagugcuccu

SEQ ID NO: 180267 - RNA, 21 nt, Human
gucaagucacucacuuaaaac

SEQ ID NO: 180268 - RNA, 21 nt, Human
gugcaugugagucccccugga

SEQ ID NO: 180269 - RNA, 23 nt, Human
guguggacgggugggucugccug

SEQ ID NO: 180270 - RNA, 26 nt, Human
uaaaacaagagguggauucaaggcca

SEQ ID NO: 180271 - RNA, 25 nt, Human
uaaccaaaggcaacagagcuaguau

SEQ ID NO: 180272 - RNA, 19 nt, Human
uaacucacacaucuuccuc

SEQ ID NO: 180273 - RNA, 23 nt, Human
uaaucucuuagaaugaccccaua

SEQ ID NO: 180274 - RNA, 25 nt, Human
uacucacaacgacccucugaguuca

SEQ ID NO: 180275 - RNA, 19 nt, Human
uagauccagggaauaucua

SEQ ID NO: 180276 - RNA, 24 nt, Human
uaguaugcuggaaggaagcaaaua

SEQ ID NO: 180277 - RNA, 18 nt, Human
uauaacuuaaccaaaggc

SEQ ID NO: 180278 - RNA, 19 nt, Human
uauuacagugcuccucacu

SEQ ID NO: 180279 - RNA, 21 nt, Human
uccagggaauaucuagagaaa

SEQ ID NO: 180280 - RNA, 19 nt, Human
ucccugcucccugugcugg

SEQ ID NO: 180281 - RNA, 25 nt, Human
ucguaugaaugaauaggugacuuua

SEQ ID NO: 180282 - RNA, 21 nt, Human
ugacucagaggguguggacgg

SEQ ID NO: 180283 - RNA, 18 nt, Human
ugagucccccuggagcug

SEQ ID NO: 180284 - RNA, 21 nt, Human
uggaaggaagcaaauaugcuu

SEQ ID NO: 180285 - RNA, 22 nt, Human
uggaaggaagcaaauaugcuuu

SEQ ID NO: 180286 - RNA, 19 nt, Human
ugggccuaugugcauguga

SEQ ID NO: 180287 - RNA, 19 nt, Human
uggguggugaagaggggag

SEQ ID NO: 180288 - RNA, 19 nt, Human
ugugcaugugagucccccu

SEQ ID NO: 180289 - RNA, 20 nt, Human
ugugcaugugagucccccug

SEQ ID NO: 180290 - RNA, 19 nt, Human
ugugguggaaagaugugcu

SEQ ID NO: 180291 - RNA, 21 nt, Human
uuggguaccagagccugugcu

SEQ ID NO: 180292 - RNA, 18 nt, Human
uuuauugaguguuuacuc

SEQ ID NO: 180293 - RNA, 22 nt, Human
acuacuccucagggcucuccug

SEQ ID NO: 180294 - RNA, 22 nt, Human
agcugcagagcagagggggaac

SEQ ID NO: 180295 - RNA, 22 nt, Human
ccccacucucagguugcaccua

SEQ ID NO: 180296 - RNA, 18 nt, Human
ccucagggcucuccuggc

SEQ ID NO: 180297 - RNA, 23 nt, Human
ccucauggcuuagcucccccacu

SEQ ID NO: 180298 - RNA, 25 nt, Human
cuagagccuccccauccaggcccaa

SEQ ID NO: 180299 - RNA, 19 nt, Human
cuccccauccaggcccaac

SEQ ID NO: 180300 - RNA, 20 nt, Human
cuccucagggcucuccuggc

SEQ ID NO: 180301 - RNA, 23 nt, Human
ggcuuagcucccccacucucagg

SEQ ID NO: 180302 - RNA, 18 nt, Human
gggaagguuuucggggaa

SEQ ID NO: 180303 - RNA, 18 nt, Human
uccucagggcucuccugg

SEQ ID NO: 180304 - RNA, 18 nt, Human
ugccccuaccucauggcu

SEQ ID NO: 180305 - RNA, 18 nt, Human
uggcuggaguugaggacu

SEQ ID NO: 180306 - RNA, 21 nt, Human
uggcuggaguugaggacuagg

SEQ ID NO: 180307 - RNA, 24 nt, Human
uggggcagguggcuggaguugagg

SEQ ID NO: 180308 - RNA, 22 nt, Human
aaaccagcuucaggucggccgg

SEQ ID NO: 180309 - RNA, 20 nt, Human
aauaaaaucaaagucuauga

SEQ ID NO: 180310 - RNA, 24 nt, Human
agcauucuuuuugcugcauuuucu

SEQ ID NO: 180311 - RNA, 24 nt, Human
cacccccaaagguagcuggcccaa

SEQ ID NO: 180312 - RNA, 18 nt, Human
ccaaugguaaggauccga

SEQ ID NO: 180313 - RNA, 27 nt, Human
ccaaugguaaggauccgaauucuuccu

SEQ ID NO: 180314 - RNA, 24 nt, Human
ccccaaagguagcuggcccaaccu

SEQ ID NO: 180315 - RNA, 23 nt, Human
ccggcgauugcggccgguuuccu

SEQ ID NO: 180316 - RNA, 18 nt, Human
cuauagcauucuuuuugc

SEQ ID NO: 180317 - RNA, 21 nt, Human
gggaauccaugaguugguagg

SEQ ID NO: 180318 - RNA, 18 nt, Human
uauggcaauggggggggu

SEQ ID NO: 180319 - RNA, 22 nt, Human
uaugucaugcagagacucaaau

SEQ ID NO: 180320 - RNA, 22 nt, Human
uccuggcccaaaaguguuugag

SEQ ID NO: 180321 - RNA, 23 nt, Human
ucuugggaauccaugaguuggua

SEQ ID NO: 180322 - RNA, 24 nt, Human
ugcagagacucaaauccuggccca

SEQ ID NO: 180323 - RNA, 22 nt, Human
uggaagauuccaaugguaagga

SEQ ID NO: 180324 - RNA, 22 nt, Human
uggauguuuaaaaaaaaaaaaa

SEQ ID NO: 180325 - RNA, 20 nt, Human
ugucaugcagagacucaaau

SEQ ID NO: 180326 - RNA, 24 nt, Human
uguggauguuuaaaaaaaaaaaaa

SEQ ID NO: 180327 - RNA, 25 nt, Human
uguggauguuuaaaaaaaaaaaaac

SEQ ID NO: 180328 - RNA, 23 nt, Human
uuuaaaaaaaaaaaaaccaccaa

SEQ ID NO: 180329 - RNA, 25 nt, Human
uuuuaagccacaggucuacuuggag

SEQ ID NO: 180330 - RNA, 18 nt, Human
ugggcuuuuaagauuaac

SEQ ID NO: 180331 - RNA, 18 nt, Human
aaagacacaggcuuucau

SEQ ID NO: 180332 - RNA, 18 nt, Human
agaaucccucaaagacac

SEQ ID NO: 180333 - RNA, 18 nt, Human
cacugcagggaugcaggg

SEQ ID NO: 180334 - RNA, 22 nt, Human
cagcccugcagauauguaugca

SEQ ID NO: 180335 - RNA, 23 nt, Human
ccagccucccggcucugcagucg

SEQ ID NO: 180336 - RNA, 23 nt, Human
cccucaaagacacaggcuuucau

SEQ ID NO: 180337 - RNA, 19 nt, Human
cggcgcccaggccggccgc

SEQ ID NO: 180338 - RNA, 25 nt, Human
cuuccaaaauaaaaaucacuaccac

SEQ ID NO: 180339 - RNA, 21 nt, Human
gcucugcagucggcgcccagg

SEQ ID NO: 180340 - RNA, 23 nt, Human
gcuuccauuccagcccugcagau

SEQ ID NO: 180341 - RNA, 20 nt, Human
gggcuuuggcacugcaggga

SEQ ID NO: 180342 - RNA, 22 nt, Human
uaaaaaucacuaccaccuuuaa

SEQ ID NO: 180343 - RNA, 19 nt, Human
uagaaucccucaaagacac

SEQ ID NO: 180344 - RNA, 19 nt, Human
ucugcagucggcgcccagg

SEQ ID NO: 180345 - RNA, 21 nt, Human
ugaaauguggcaugacaggga

SEQ ID NO: 180346 - RNA, 23 nt, Human
uucaggguagaaucccucaaaga

SEQ ID NO: 180347 - RNA, 26 nt, Human
aaaaaaaaaaaaccucacacagaaaa

SEQ ID NO: 180348 - RNA, 18 nt, Human
aaaaaaccucacacagaa

SEQ ID NO: 180349 - RNA, 22 nt, Human
aaaaagaggagaacacucagaa

SEQ ID NO: 180350 - RNA, 19 nt, Human
accguccccugccccggcc

SEQ ID NO: 180351 - RNA, 25 nt, Human
acgcaaaacacaaaauggcucccaa

SEQ ID NO: 180352 - RNA, 30 nt, Human
acgcaaaacacaaaauggcucccaauccag

SEQ ID NO: 180353 - RNA, 18 nt, Human
aggcaacuggcacaugug

SEQ ID NO: 180354 - RNA, 22 nt, Human
caaaauggcucccaauccaggc

SEQ ID NO: 180355 - RNA, 26 nt, Human
caaaauggcucccaauccaggcaaag

SEQ ID NO: 180356 - RNA, 18 nt, Human
cacauguggaagcagaau

SEQ ID NO: 180357 - RNA, 18 nt, Human
cagaaaaagaggagaaca

SEQ ID NO: 180358 - RNA, 20 nt, Human
ccaccguccccugccccggg

SEQ ID NO: 180359 - RNA, 21 nt, Human
cccacagauggcacaguccac

SEQ ID NO: 180360 - RNA, 27 nt, Human
cccccggguggcggcugcgcccggccu

SEQ ID NO: 180361 - RNA, 23 nt, Human
ccgcgcucuuggccccucuccug

SEQ ID NO: 180362 - RNA, 27 nt, Human
ccgucuuccaaccaucagcuucgacuc

SEQ ID NO: 180363 - RNA, 18 nt, Human
ccuggagccccuuucgcu

SEQ ID NO: 180364 - RNA, 24 nt, Human
ccuggccucggucccccggguggc

SEQ ID NO: 180365 - RNA, 20 nt, Human
ccuuuaaacuuagggacaga

SEQ ID NO: 180366 - RNA, 24 nt, Human
cgcucuuggccccucuccuggccu

SEQ ID NO: 180367 - RNA, 21 nt, Human
cuccuggccucggucccccgg

SEQ ID NO: 180368 - RNA, 18 nt, Human
gacagagauuacagagau

SEQ ID NO: 180369 - RNA, 20 nt, Human
ggcacauguggaagcagaau

SEQ ID NO: 180370 - RNA, 23 nt, Human
ggccaccguccccugccccggcc

SEQ ID NO: 180371 - RNA, 20 nt, Human
ggccuggagccccuuucgcu

SEQ ID NO: 180372 - RNA, 25 nt, Human
uaaaaaaaaaaaaaccucacacaga

SEQ ID NO: 180373 - RNA, 20 nt, Human
uacgcaaaacacaaaauggc

SEQ ID NO: 180374 - RNA, 18 nt, Human
uaugacaucugcaaacuu

SEQ ID NO: 180375 - RNA, 24 nt, Human
ucagccgcgcucuuggccccucuc

SEQ ID NO: 180376 - RNA, 22 nt, Human
ugcagauuaaaaaaaaaaaaac

SEQ ID NO: 180377 - RNA, 23 nt, Human
ugcagauuaaaaaaaaaaaaacc

SEQ ID NO: 180378 - RNA, 21 nt, Human
ugccacauuaaaaguuaaagu

SEQ ID NO: 180379 - RNA, 21 nt, Human
ugcccugggauuucccacaga

SEQ ID NO: 180380 - RNA, 24 nt, Human
ugcccugggauuucccacagaugg

SEQ ID NO: 180381 - RNA, 23 nt, Human
uggcggcugcgcccggccuggag

SEQ ID NO: 180382 - RNA, 26 nt, Human
uguaaacauuugcccugggauuuccc

SEQ ID NO: 180383 - RNA, 21 nt, Human
uuaaaaaaaaaaaaaccucac

SEQ ID NO: 180384 - RNA, 19 nt, Human
acagacuauacauagcccc

SEQ ID NO: 180385 - RNA, 24 nt, Human
acauagcccccagcccauaccucc

SEQ ID NO: 180386 - RNA, 20 nt, Human
aucaaauuucuccucaaaac

SEQ ID NO: 180387 - RNA, 19 nt, Human
augcaguuccuuuauuauc

SEQ ID NO: 180388 - RNA, 19 nt, Human
cagacuauacauagccccc

SEQ ID NO: 180389 - RNA, 19 nt, Human
caucuugugcaggggacug

SEQ ID NO: 180390 - RNA, 21 nt, Human
ccagcccauaccucccauccc

SEQ ID NO: 180391 - RNA, 23 nt, Human
ccccagcccauaccucccauccc

SEQ ID NO: 180392 - RNA, 21 nt, Human
cccccagcccauaccucccau

SEQ ID NO: 180393 - RNA, 20 nt, Human
cguauacagacuauacauag

SEQ ID NO: 180394 - RNA, 19 nt, Human
cucccaucccuggggcauc

SEQ ID NO: 180395 - RNA, 23 nt, Human
gaugcaguuccuuuauuaucagg

SEQ ID NO: 180396 - RNA, 22 nt, Human
uagcccccagcccauaccuccc

SEQ ID NO: 180397 - RNA, 21 nt, Human
uaggaaaugcgaucugugaug

SEQ ID NO: 180398 - RNA, 18 nt, Human
uauacagacuauacauag

SEQ ID NO: 180399 - RNA, 20 nt, Human
ugauggaugagauucccuac

SEQ ID NO: 180400 - RNA, 20 nt, Human
uuccuuuauuaucaggaaac

SEQ ID NO: 180401 - RNA, 18 nt, Human
aaaaagacaagacagcug

SEQ ID NO: 180402 - RNA, 20 nt, Human
aaaaagacaagacagcuggu

SEQ ID NO: 180403 - RNA, 19 nt, Human
aagaagccggaacagcgcg

SEQ ID NO: 180404 - RNA, 22 nt, Human
aagcaccaaaggcuggaaagca

SEQ ID NO: 180405 - RNA, 18 nt, Human
aaggagaggccuuuuuac

SEQ ID NO: 180406 - RNA, 23 nt, Human
accccagaccccucugcuggcuc

SEQ ID NO: 180407 - RNA, 21 nt, Human
agacagcuggaauccccaggc

SEQ ID NO: 180408 - RNA, 20 nt, Human
agccggaacagcgcgguccu

SEQ ID NO: 180409 - RNA, 21 nt, Human
aggaaggugggugagggcugg

SEQ ID NO: 180410 - RNA, 23 nt, Human
aggcaguggcugaggcagacguc

SEQ ID NO: 180411 - RNA, 21 nt, Human
aggugaaggcugggcuccuug

SEQ ID NO: 180412 - RNA, 26 nt, Human
auuguucugaggaauaauccaaaaga

SEQ ID NO: 180413 - RNA, 22 nt, Human
caagguauguuagagaccucaa

SEQ ID NO: 180414 - RNA, 21 nt, Human
caccaaaggcuggaaagcacu

SEQ ID NO: 180415 - RNA, 22 nt, Human
cagacgucuccaucucagccgc

SEQ ID NO: 180416 - RNA, 21 nt, Human
cagaguauccaguauagcauu

SEQ ID NO: 180417 - RNA, 20 nt, Human
cagccaccaccaaaggagag

SEQ ID NO: 180418 - RNA, 18 nt, Human
caguggcugaggcagacg

SEQ ID NO: 180419 - RNA, 21 nt, Human
caguggcugaggcagacgucu

SEQ ID NO: 180420 - RNA, 21 nt, Human
cauccagguauaaucugugcu

SEQ ID NO: 180421 - RNA, 19 nt, Human
ccaaaggcugaccccagac

SEQ ID NO: 180422 - RNA, 18 nt, Human
ccaaaggcuggaaagcac

SEQ ID NO: 180423 - RNA, 19 nt, Human
cccucugcuggcucagaau

SEQ ID NO: 180424 - RNA, 23 nt, Human
ccuccaggaucccacuuuuggcu

SEQ ID NO: 180425 - RNA, 22 nt, Human
ccuguaagcaccaaaggcugga

SEQ ID NO: 180426 - RNA, 18 nt, Human
ccuguccuauggagacuu

SEQ ID NO: 180427 - RNA, 25 nt, Human
cggccuccaggaucccacuuuuggc

SEQ ID NO: 180428 - RNA, 21 nt, Human
cggggaagccagcggccucca

SEQ ID NO: 180429 - RNA, 22 nt, Human
cucaagaguuaggcuucauaga

SEQ ID NO: 180430 - RNA, 19 nt, Human
cucugggcagcgaugaccc

SEQ ID NO: 180431 - RNA, 22 nt, Human
cuuucugcauauccuuugaaag

SEQ ID NO: 180432 - RNA, 23 nt, Human
gagggcuggaucagggguggugu

SEQ ID NO: 180433 - RNA, 28 nt, Human
gaucacagaugcggugccuugaacguuu

SEQ ID NO: 180434 - RNA, 19 nt, Human
gcucugggcagcgaugacc

SEQ ID NO: 180435 - RNA, 18 nt, Human
gcuggaauccccaggcuc

SEQ ID NO: 180436 - RNA, 21 nt, Human
gugggggaaggugaaggcugg

SEQ ID NO: 180437 - RNA, 18 nt, Human
uaaucugugcuuuuccuc

SEQ ID NO: 180438 - RNA, 23 nt, Human
uccaaaagaccagagaggaugcc

SEQ ID NO: 180439 - RNA, 23 nt, Human
ucugaagcggccauugcgcaaca

SEQ ID NO: 180440 - RNA, 20 nt, Human
ugcugcugccgcugcagcca

SEQ ID NO: 180441 - RNA, 20 nt, Human
uggaaaaagacaagacagcu

SEQ ID NO: 180442 - RNA, 21 nt, Human
uggaaaaagacaagacagcug

SEQ ID NO: 180443 - RNA, 19 nt, Human
uggaaagcacuguguaaau

SEQ ID NO: 180444 - RNA, 23 nt, Human
uggggugggggaaggugaaggcu

SEQ ID NO: 180445 - RNA, 25 nt, Human
ugguaggccacgggguugauggggu

SEQ ID NO: 180446 - RNA, 19 nt, Human
ugugucgguaaagcagcac

SEQ ID NO: 180447 - RNA, 23 nt, Human
uguuagagaccucaagaguuagg

SEQ ID NO: 180448 - RNA, 19 nt, Human
uuacccgggucggggaagc

SEQ ID NO: 180449 - RNA, 20 nt, Human
uuccuguccuauggagacuu

SEQ ID NO: 180450 - RNA, 30 nt, Human
uugaucacagaugcggugccuugaacguuu

SEQ ID NO: 180451 - RNA, 24 nt, Human
uuggcuucuugcuucucggaggca

SEQ ID NO: 180452 - RNA, 20 nt, Human
uuuuggcuucuugcuucucg

SEQ ID NO: 180453 - RNA, 23 nt, Human
aacuaaaaaaacagccaaaacaa

SEQ ID NO: 180454 - RNA, 20 nt, Human
acagaacuaaaaaaacagcc

SEQ ID NO: 180455 - RNA, 23 nt, Human
acuuuaggguuuuucagaguccu

SEQ ID NO: 180456 - RNA, 22 nt, Human
cagaacuaaaaaaacagccaaa

SEQ ID NO: 180457 - RNA, 18 nt, Human
cccuagaauacuuuaggg

SEQ ID NO: 180458 - RNA, 20 nt, Human
cguugguugcagucuuuuuu

SEQ ID NO: 180459 - RNA, 24 nt, Human
cugaaauggaagacaguuucuccc

SEQ ID NO: 180460 - RNA, 22 nt, Human
uaaaaaaacagccaaaacaaag

SEQ ID NO: 180461 - RNA, 23 nt, Human
uaaaaaaacagccaaaacaaagu

SEQ ID NO: 180462 - RNA, 22 nt, Human
uaacaauacugauucaaaacug

SEQ ID NO: 180463 - RNA, 24 nt, Human
uaacaauacugauucaaaacugaa

SEQ ID NO: 180464 - RNA, 22 nt, Human
uacagaacuaaaaaaacagcca

SEQ ID NO: 180465 - RNA, 23 nt, Human
uacugauucaaaacugaaaugga

SEQ ID NO: 180466 - RNA, 18 nt, Human
uccauaaaaggaauauaa

SEQ ID NO: 180467 - RNA, 23 nt, Human
ucucauuacuucagcucucuucg

SEQ ID NO: 180468 - RNA, 21 nt, Human
augcggugcugggcagugccc

SEQ ID NO: 180469 - RNA, 21 nt, Human
cagguaggaggccgagccccg

SEQ ID NO: 180470 - RNA, 19 nt, Human
cccaccgugggggacgggg

SEQ ID NO: 180471 - RNA, 20 nt, Human
cgagccccgagcccccgccc

SEQ ID NO: 180472 - RNA, 26 nt, Human
cgggguggaggguggguugggggcag

SEQ ID NO: 180473 - RNA, 18 nt, Human
ggcagguaggaggccgag

SEQ ID NO: 180474 - RNA, 21 nt, Human
gggacgggguggagggugggu

SEQ ID NO: 180475 - RNA, 23 nt, Human
gggggacgggguggagggugggu

SEQ ID NO: 180476 - RNA, 21 nt, Human
gguggaggguggguugggggc

SEQ ID NO: 180477 - RNA, 23 nt, Human
ucaaaaagaauuuauuccggaca

SEQ ID NO: 180478 - RNA, 18 nt, Human
uggaggguggguuggggg

SEQ ID NO: 180479 - RNA, 23 nt, Human
uuuuuuuuuuuuuuuuuuuucca

SEQ ID NO: 180480 - RNA, 24 nt, Human
uuuuuuuuuuuuuuuuuuuuuccu

SEQ ID NO: 180481 - RNA, 19 nt, Human
aaagcacucacauaaaucc

SEQ ID NO: 180482 - RNA, 24 nt, Human
aaaggaaacauaaagugcuucuag

SEQ ID NO: 180483 - RNA, 19 nt, Human
aacugcaguaucacagacg

SEQ ID NO: 180484 - RNA, 22 nt, Human
acaacuuugaggcacaaucuaa

SEQ ID NO: 180485 - RNA, 24 nt, Human
acggaggagucacccacacuacgc

SEQ ID NO: 180486 - RNA, 22 nt, Human
acucacauaaauccauuucacc

SEQ ID NO: 180487 - RNA, 25 nt, Human
agaagaaggcaaaugcagccucuga

SEQ ID NO: 180488 - RNA, 21 nt, Human
agacuucuaguguuuacuccc

SEQ ID NO: 180489 - RNA, 18 nt, Human
aggaacggaggagucacc

SEQ ID NO: 180490 - RNA, 18 nt, Human
aggaauugaaaccccaga

SEQ ID NO: 180491 - RNA, 27 nt, Human
aguuacacaacuauauucaaggacagc

SEQ ID NO: 180492 - RNA, 20 nt, Human
auaaauccauuucacccaaa

SEQ ID NO: 180493 - RNA, 18 nt, Human
auaucauuuccuuccucc

SEQ ID NO: 180494 - RNA, 23 nt, Human
aucaugaagaccuugggauaggg

SEQ ID NO: 180495 - RNA, 22 nt, Human
aucauuuccuuccuccuccccu

SEQ ID NO: 180496 - RNA, 26 nt, Human
auugaaaccccagaagauaacuacaa

SEQ ID NO: 180497 - RNA, 21 nt, Human
cacaaucuaaauacuaaaaau

SEQ ID NO: 180498 - RNA, 23 nt, Human
cacaauggucaaacucacugaag

SEQ ID NO: 180499 - RNA, 20 nt, Human
cacugcuugaaaaccagaau

SEQ ID NO: 180500 - RNA, 22 nt, Human
cacugcuugaaaaccagaauga

SEQ ID NO: 180501 - RNA, 20 nt, Human
cacuuuguacuuuacugaaa

SEQ ID NO: 180502 - RNA, 23 nt, Human
cagaagaaggcaaaugcagccuc

SEQ ID NO: 180503 - RNA, 25 nt, Human
cagaagauaacuacaacaaaaacau

SEQ ID NO: 180504 - RNA, 21 nt, Human
cagcccaagagccaagagcac

SEQ ID NO: 180505 - RNA, 22 nt, Human
caggugucccuagagcaguuuu

SEQ ID NO: 180506 - RNA, 18 nt, Human
caguuuuguacuaaagac

SEQ ID NO: 180507 - RNA, 27 nt, Human
cauuuccuuccuccuccccuuuccccu

SEQ ID NO: 180508 - RNA, 25 nt, Human
ccaaaggucuuccacuagagucuag

SEQ ID NO: 180509 - RNA, 21 nt, Human
ccaaggaacggaggagucacc

SEQ ID NO: 180510 - RNA, 20 nt, Human
ccacgguacuccagcccaag

SEQ ID NO: 180511 - RNA, 23 nt, Human
ccacgguacuccagcccaagagc

SEQ ID NO: 180512 - RNA, 24 nt, Human
ccauaucauuuccuuccuccuccc

SEQ ID NO: 180513 - RNA, 22 nt, Human
cccaaggaacggaggagucacc

SEQ ID NO: 180514 - RNA, 19 nt, Human
cccacacuacgccucggcc

SEQ ID NO: 180515 - RNA, 28 nt, Human
cccucaccacgguacuccagcccaagag

SEQ ID NO: 180516 - RNA, 20 nt, Human
ccucggcccugugccgccuu

SEQ ID NO: 180517 - RNA, 18 nt, Human
ccuuccuccuccccuuuc

SEQ ID NO: 180518 - RNA, 20 nt, Human
ccuugggauagggaagacuc

SEQ ID NO: 180519 - RNA, 20 nt, Human
cggggaagaccacugagcug

SEQ ID NO: 180520 - RNA, 18 nt, Human
cuauuuguuuaaagcacu

SEQ ID NO: 180521 - RNA, 22 nt, Human
cucggcccugugccgccuuaac

SEQ ID NO: 180522 - RNA, 22 nt, Human
cuucugaaaucucaaaggagaa

SEQ ID NO: 180523 - RNA, 18 nt, Human
gacgacgggacccaagga

SEQ ID NO: 180524 - RNA, 24 nt, Human
gcucucaagaguaccuacucuuuu

SEQ ID NO: 180525 - RNA, 20 nt, Human
ggaauugaaaccccagaaga

SEQ ID NO: 180526 - RNA, 18 nt, Human
ggacccaaggaacggagg

SEQ ID NO: 180527 - RNA, 23 nt, Human
guacuaaagacuucuaguguuua

SEQ ID NO: 180528 - RNA, 20 nt, Human
guauguaaauaucuugaauc

SEQ ID NO: 180529 - RNA, 20 nt, Human
uaaauauagucauccacaaa

SEQ ID NO: 180530 - RNA, 23 nt, Human
uaacuaaguuaucacugaacaua

SEQ ID NO: 180531 - RNA, 23 nt, Human
uacuccagcccaagagccaagag

SEQ ID NO: 180532 - RNA, 24 nt, Human
uccuuccuccuccccuuucccaaa

SEQ ID NO: 180533 - RNA, 20 nt, Human
ucuaaauacuaaaaaugauu

SEQ ID NO: 180534 - RNA, 21 nt, Human
ugaaaaggaacagcugaaaua

SEQ ID NO: 180535 - RNA, 25 nt, Human
ugaggcacaaucuaaauacuaaaaa

SEQ ID NO: 180536 - RNA, 24 nt, Human
ugaguugagcugauugaugcccuc

SEQ ID NO: 180537 - RNA, 20 nt, Human
ugcagccuagcccagugucu

SEQ ID NO: 180538 - RNA, 21 nt, Human
ugcaguaucacagacgacggg

SEQ ID NO: 180539 - RNA, 21 nt, Human
uggcauggccuuuccaaaggu

SEQ ID NO: 180540 - RNA, 26 nt, Human
uggcauggccuuuccaaaggucuucc

SEQ ID NO: 180541 - RNA, 21 nt, Human
uguguaggaaucaccaggugu

SEQ ID NO: 180542 - RNA, 24 nt, Human
uuaaauccauuaauaauccaugaa

SEQ ID NO: 180543 - RNA, 19 nt, Human
uuauaauaagaagaaaucc

SEQ ID NO: 180544 - RNA, 18 nt, Human
uucccaaauaaauaaggu

SEQ ID NO: 180545 - RNA, 22 nt, Human
uuccguugugaaaaaaguuguu

SEQ ID NO: 180546 - RNA, 23 nt, Human
uugaaaaccagaaugacugaaca

SEQ ID NO: 180547 - RNA, 22 nt, Human
uugaaaccccagaagauaacua

SEQ ID NO: 180548 - RNA, 27 nt, Human
uuuaaagcacucacauaaauccauuuc

SEQ ID NO: 180549 - RNA, 21 nt, Human
uuuaugagaaauauaaacauc

SEQ ID NO: 180550 - RNA, 23 nt, Human
uuuccuuccuccuccccuuuccc

SEQ ID NO: 180551 - RNA, 23 nt, Human
uuucucacaugacagcugggagu

SEQ ID NO: 180552 - RNA, 23 nt, Human
aaacagcuucccuuugagagaag

SEQ ID NO: 180553 - RNA, 21 nt, Human
aacagcugcuggcaguggccc

SEQ ID NO: 180554 - RNA, 20 nt, Human
aagagccacuuucagaacca

SEQ ID NO: 180555 - RNA, 22 nt, Human
aagcaacccagacacacaaaca

SEQ ID NO: 180556 - RNA, 23 nt, Human
aagcaacccagacacacaaacag

SEQ ID NO: 180557 - RNA, 20 nt, Human
aaggaccccagggagggcag

SEQ ID NO: 180558 - RNA, 22 nt, Human
acaaagccccucaaaaagaaac

SEQ ID NO: 180559 - RNA, 20 nt, Human
acagcaauaaagaaaaguga

SEQ ID NO: 180560 - RNA, 18 nt, Human
accccagggagggcaggc

SEQ ID NO: 180561 - RNA, 20 nt, Human
acccggccugcagcaaggac

SEQ ID NO: 180562 - RNA, 23 nt, Human
accuacagccauuuccagaaaca

SEQ ID NO: 180563 - RNA, 19 nt, Human
accuugaguuugagucugg

SEQ ID NO: 180564 - RNA, 20 nt, Human
acugcacucucccaaacaac

SEQ ID NO: 180565 - RNA, 23 nt, Human
agaaccaccuccucuugcaagcc

SEQ ID NO: 180566 - RNA, 21 nt, Human
agaggcaggcaccaaaacaac

SEQ ID NO: 180567 - RNA, 20 nt, Human
agccugccuccauggugcug

SEQ ID NO: 180568 - RNA, 18 nt, Human
aggaggcacugcccauuu

SEQ ID NO: 180569 - RNA, 26 nt, Human
aggauguaugugugugugugugugug

SEQ ID NO: 180570 - RNA, 21 nt, Human
aggcaggcaccaaaacaacuc

SEQ ID NO: 180571 - RNA, 23 nt, Human
agguaaucuacacccacagucug

SEQ ID NO: 180572 - RNA, 19 nt, Human
agucagaauugcccauugu

SEQ ID NO: 180573 - RNA, 19 nt, Human
agugggggaauuucaaagg

SEQ ID NO: 180574 - RNA, 19 nt, Human
auaaaguauuuccaaggag

SEQ ID NO: 180575 - RNA, 22 nt, Human
augugugugugugugugugugu

SEQ ID NO: 180576 - RNA, 23 nt, Human
auguguguguguguguguguguu

SEQ ID NO: 180577 - RNA, 21 nt, Human
auugugcacacagacuauuca

SEQ ID NO: 180578 - RNA, 20 nt, Human
caaaaagaaacugggcagug

SEQ ID NO: 180579 - RNA, 23 nt, Human
caaacaaagccccucaaaaagaa

SEQ ID NO: 180580 - RNA, 24 nt, Human
caaacaaagccccucaaaaagaaa

SEQ ID NO: 180581 - RNA, 20 nt, Human
caaacagcuucccuuugaga

SEQ ID NO: 180582 - RNA, 20 nt, Human
caaauaccuggaggagaagc

SEQ ID NO: 180583 - RNA, 20 nt, Human
caacccagacacacaaacag

SEQ ID NO: 180584 - RNA, 21 nt, Human
caagagacagcguguggucac

SEQ ID NO: 180585 - RNA, 23 nt, Human
caagugaugcaagcagaggaggc

SEQ ID NO: 180586 - RNA, 24 nt, Human
cacacaaacagcuucccuuugaga

SEQ ID NO: 180587 - RNA, 22 nt, Human
caccaaaacaacucaaauaccu

SEQ ID NO: 180588 - RNA, 22 nt, Human
cacccggccugcagcaaggacc

SEQ ID NO: 180589 - RNA, 18 nt, Human
caccgucucaaugcucau

SEQ ID NO: 180590 - RNA, 23 nt, Human
caccuacagccauuuccagaaac

SEQ ID NO: 180591 - RNA, 25 nt, Human
caccuacagccauuuccagaaacag

SEQ ID NO: 180592 - RNA, 20 nt, Human
caccuccucuugcaagcccu

SEQ ID NO: 180593 - RNA, 21 nt, Human
caggcaccaaaacaacucaaa

SEQ ID NO: 180594 - RNA, 19 nt, Human
cauuuaccugucugauggg

SEQ ID NO: 180595 - RNA, 21 nt, Human
ccaaacaacaucacuacaacc

SEQ ID NO: 180596 - RNA, 22 nt, Human
ccaaacaacaucacuacaacca

SEQ ID NO: 180597 - RNA, 24 nt, Human
ccaaacaacaucacuacaaccaug

SEQ ID NO: 180598 - RNA, 22 nt, Human
ccaaauucucaagagacagcgu

SEQ ID NO: 180599 - RNA, 19 nt, Human
ccagaaacagcugcuggca

SEQ ID NO: 180600 - RNA, 20 nt, Human
ccagaaacagcugcuggcag

SEQ ID NO: 180601 - RNA, 21 nt, Human
cccaaacaaagccccucaaaa

SEQ ID NO: 180602 - RNA, 19 nt, Human
cccucugcucuccccggag

SEQ ID NO: 180603 - RNA, 20 nt, Human
cccugauucucugggcaugg

SEQ ID NO: 180604 - RNA, 19 nt, Human
ccuacagccauuuccagaa

SEQ ID NO: 180605 - RNA, 23 nt, Human
ccucugggcuccuggaaguggca

SEQ ID NO: 180606 - RNA, 21 nt, Human
ccuggauuggccacccggccu

SEQ ID NO: 180607 - RNA, 24 nt, Human
ccugggagugucucucccaccugg

SEQ ID NO: 180608 - RNA, 26 nt, Human
cgucggaacccucugcucuccccgga

SEQ ID NO: 180609 - RNA, 23 nt, Human
cuacugcacucucccaaacaaca

SEQ ID NO: 180610 - RNA, 24 nt, Human
cucaacaccaccuacagccauuuc

SEQ ID NO: 180611 - RNA, 20 nt, Human
cucauaccccagggcugggu

SEQ ID NO: 180612 - RNA, 20 nt, Human
cucccaaacaacaucacuac

SEQ ID NO: 180613 - RNA, 22 nt, Human
cuccucauuuucacagcgaucg

SEQ ID NO: 180614 - RNA, 22 nt, Human
cugcccugauucucugggcaug

SEQ ID NO: 180615 - RNA, 20 nt, Human
gagaagacaggggagggugg

SEQ ID NO: 180616 - RNA, 22 nt, Human
gaugagggggcaagaugaggga

SEQ ID NO: 180617 - RNA, 19 nt, Human
gcaacccagacacacaaac

SEQ ID NO: 180618 - RNA, 24 nt, Human
ggaauccgucggaacccucugcuc

SEQ ID NO: 180619 - RNA, 25 nt, Human
ggagaagucagaauugcccauuguu

SEQ ID NO: 180620 - RNA, 22 nt, Human
ggcagguaaucuacacccacag

SEQ ID NO: 180621 - RNA, 18 nt, Human
ggguuuggggagggaaag

SEQ ID NO: 180622 - RNA, 21 nt, Human
gugggggaggcugcaggcagg

SEQ ID NO: 180623 - RNA, 23 nt, Human
gugucuggggaaagguuuugggg

SEQ ID NO: 180624 - RNA, 21 nt, Human
gugugugugugugugugugug

SEQ ID NO: 180625 - RNA, 21 nt, Human
gugugugugugugugugugug

SEQ ID NO: 180626 - RNA, 21 nt, Human
gugugugugugugugugugug

SEQ ID NO: 180627 - RNA, 19 nt, Human
uaagcaacccagacacaca

SEQ ID NO: 180628 - RNA, 19 nt, Human
uacaagcucccaagugggg

SEQ ID NO: 180629 - RNA, 21 nt, Human
uaccuggaggagaagcgagcc

SEQ ID NO: 180630 - RNA, 24 nt, Human
uaccugucugauggguuuggggag

SEQ ID NO: 180631 - RNA, 19 nt, Human
uacuacugcacucucccaa

SEQ ID NO: 180632 - RNA, 23 nt, Human
uacuacugcacucucccaaacaa

SEQ ID NO: 180633 - RNA, 18 nt, Human
uagguuuccccguccagu

SEQ ID NO: 180634 - RNA, 18 nt, Human
uaugugugugugugugug

SEQ ID NO: 180635 - RNA, 23 nt, Human
uaugugugugugugugugugugu

SEQ ID NO: 180636 - RNA, 22 nt, Human
ucaaaaagaaacugggcaguga

SEQ ID NO: 180637 - RNA, 20 nt, Human
ucacagauaaaguauuucca

SEQ ID NO: 180638 - RNA, 21 nt, Human
ucccaaacaacaucacuacaa

SEQ ID NO: 180639 - RNA, 23 nt, Human
ucccaccauuuaaaagggagaga

SEQ ID NO: 180640 - RNA, 19 nt, Human
uccccggagguccugacuc

SEQ ID NO: 180641 - RNA, 20 nt, Human
uccccgguggcaagccugcc

SEQ ID NO: 180642 - RNA, 24 nt, Human
uccucuugcaagccccaguuucac

SEQ ID NO: 180643 - RNA, 23 nt, Human
uccugacucccaagagcgagcuc

SEQ ID NO: 180644 - RNA, 21 nt, Human
ucggaacccucugcucucccc

SEQ ID NO: 180645 - RNA, 23 nt, Human
ucggaacccucugcucuccccgg

SEQ ID NO: 180646 - RNA, 20 nt, Human
ucucaacaccaccuacagcc

SEQ ID NO: 180647 - RNA, 20 nt, Human
ucucucuuggcccucugggc

SEQ ID NO: 180648 - RNA, 23 nt, Human
ucugggggaaccccaagggccug

SEQ ID NO: 180649 - RNA, 24 nt, Human
ucuguguuuggcugagguuagaag

SEQ ID NO: 180650 - RNA, 18 nt, Human
ugagagaagacaggggag

SEQ ID NO: 180651 - RNA, 21 nt, Human
ugagagaagacaggggagggu

SEQ ID NO: 180652 - RNA, 22 nt, Human
ugagagaagacaggggagggug

SEQ ID NO: 180653 - RNA, 18 nt, Human
ugagggaaauaagcaacc

SEQ ID NO: 180654 - RNA, 24 nt, Human
ugagggaaauaagcaacccagaca

SEQ ID NO: 180655 - RNA, 20 nt, Human
ugagggggcaagaugaggga

SEQ ID NO: 180656 - RNA, 22 nt, Human
ugauggggacuauugguuuccc

SEQ ID NO: 180657 - RNA, 18 nt, Human
ugauggguuuggggaggg

SEQ ID NO: 180658 - RNA, 18 nt, Human
ugauuugcggcucugucu

SEQ ID NO: 180659 - RNA, 19 nt, Human
ugcaagcagaggaggcucc

SEQ ID NO: 180660 - RNA, 24 nt, Human
ugcuccagaaacuucuuuugcagc

SEQ ID NO: 180661 - RNA, 24 nt, Human
uggcaagccugcccugauucucug

SEQ ID NO: 180662 - RNA, 21 nt, Human
uggcaguggcccaaacaaagc

SEQ ID NO: 180663 - RNA, 22 nt, Human
uggcccaaacaaagccccucaa

SEQ ID NO: 180664 - RNA, 19 nt, Human
ugggagaagucagaauugc

SEQ ID NO: 180665 - RNA, 24 nt, Human
uggguuuggggagggaaagcagga

SEQ ID NO: 180666 - RNA, 19 nt, Human
uggugaccccaagugaugc

SEQ ID NO: 180667 - RNA, 22 nt, Human
ugucugggggaaccccaagggc

SEQ ID NO: 180668 - RNA, 21 nt, Human
ugugcacacagacuauucaca

SEQ ID NO: 180669 - RNA, 18 nt, Human
ugugugugugucccuucc

SEQ ID NO: 180670 - RNA, 22 nt, Human
ugugugugugugucccuuccuu

SEQ ID NO: 180671 - RNA, 18 nt, Human
ugugugugugugugugug

SEQ ID NO: 180672 - RNA, 18 nt, Human
ugugugugugugugugug

SEQ ID NO: 180673 - RNA, 18 nt, Human
ugugugugugugugugug

SEQ ID NO: 180674 - RNA, 18 nt, Human
ugugugugugugugugug

SEQ ID NO: 180675 - RNA, 18 nt, Human
ugugugugugugugugug

SEQ ID NO: 180676 - RNA, 18 nt, Human
ugugugugugugugugug

SEQ ID NO: 180677 - RNA, 18 nt, Human
ugugugugugugugugug

SEQ ID NO: 180678 - RNA, 18 nt, Human
ugugugugugugugugug

SEQ ID NO: 180679 - RNA, 18 nt, Human
ugugugugugugugugug

SEQ ID NO: 180680 - RNA, 21 nt, Human
ugugugugugugugugugugu

SEQ ID NO: 180681 - RNA, 21 nt, Human
ugugugugugugugugugugu

SEQ ID NO: 180682 - RNA, 21 nt, Human
ugugugugugugugugugugu

SEQ ID NO: 180683 - RNA, 21 nt, Human
ugugugugugugugugugugu

SEQ ID NO: 180684 - RNA, 21 nt, Human
ugugugugugugugugugugu

SEQ ID NO: 180685 - RNA, 21 nt, Human
ugugugugugugugugugugu

SEQ ID NO: 180686 - RNA, 21 nt, Human
ugugugugugugugugugugu

SEQ ID NO: 180687 - RNA, 21 nt, Human
ugugugugugugugugugugu

SEQ ID NO: 180688 - RNA, 21 nt, Human
ugugugugugugugugugugu

SEQ ID NO: 180689 - RNA, 21 nt, Human
ugugugugugugugugugugu

SEQ ID NO: 180690 - RNA, 21 nt, Human
ugugugugugugugugugugu

SEQ ID NO: 180691 - RNA, 21 nt, Human
ugugugugugugugugugugu

SEQ ID NO: 180692 - RNA, 22 nt, Human
ugugugugugugugugugugug

SEQ ID NO: 180693 - RNA, 22 nt, Human
ugugugugugugugugugugug

SEQ ID NO: 180694 - RNA, 22 nt, Human
ugugugugugugugugugugug

SEQ ID NO: 180695 - RNA, 22 nt, Human
ugugugugugugugugugugug

SEQ ID NO: 180696 - RNA, 23 nt, Human
uuauuugugggggaggcugcagg

SEQ ID NO: 180697 - RNA, 21 nt, Human
uuccagaaacagcugcuggca

SEQ ID NO: 180698 - RNA, 24 nt, Human
uugaguuugagucugggguugauu

SEQ ID NO: 180699 - RNA, 18 nt, Human
uuggggcuuccucaccau

SEQ ID NO: 180700 - RNA, 22 nt, Human
uuuaaaauagacuuggcagcuc

SEQ ID NO: 180701 - RNA, 21 nt, Human
aaaaccagaaagcgcuauugc

SEQ ID NO: 180702 - RNA, 20 nt, Human
accacggagagcguccagac

SEQ ID NO: 180703 - RNA, 18 nt, Human
agggaggcggggaacagg

SEQ ID NO: 180704 - RNA, 21 nt, Human
auaauccagauguuaaaggga

SEQ ID NO: 180705 - RNA, 19 nt, Human
caaaaccagaaagcgcuau

SEQ ID NO: 180706 - RNA, 18 nt, Human
caccacggagagcgucca

SEQ ID NO: 180707 - RNA, 19 nt, Human
cagcggcggcugcgaggcg

SEQ ID NO: 180708 - RNA, 21 nt, Human
ccagcgugucuguugccuccc

SEQ ID NO: 180709 - RNA, 24 nt, Human
cccacguuccccucucccagccuc

SEQ ID NO: 180710 - RNA, 23 nt, Human
cuccagcgugucuguugccuccc

SEQ ID NO: 180711 - RNA, 23 nt, Human
cucccagccucccccaaccuuuc

SEQ ID NO: 180712 - RNA, 21 nt, Human
gcggggaacaggggcgcggag

SEQ ID NO: 180713 - RNA, 23 nt, Human
ggcgcggagggagagccccaggg

SEQ ID NO: 180714 - RNA, 20 nt, Human
ggggaacaggggcgcggagg

SEQ ID NO: 180715 - RNA, 23 nt, Human
guuccccucucccagccuccccc

SEQ ID NO: 180716 - RNA, 24 nt, Human
ucagcaccacggagagcguccaga

SEQ ID NO: 180717 - RNA, 20 nt, Human
ucucucagauuccugugcua

SEQ ID NO: 180718 - RNA, 19 nt, Human
aacccagaaagacaaagcc

SEQ ID NO: 180719 - RNA, 23 nt, Human
aggcaagaaggucccagggucug

SEQ ID NO: 180720 - RNA, 21 nt, Human
caagcacaacacugaggcaag

SEQ ID NO: 180721 - RNA, 28 nt, Human
cacaacacugaggcaagaaggucccagg

SEQ ID NO: 180722 - RNA, 25 nt, Human
cagaaagacaaagccucagaacuga

SEQ ID NO: 180723 - RNA, 21 nt, Human
ccagaaagacaaagccucaga

SEQ ID NO: 180724 - RNA, 19 nt, Human
ccagaaagaugcuaggaca

SEQ ID NO: 180725 - RNA, 24 nt, Human
ccccccucccucaaucuucuccuc

SEQ ID NO: 180726 - RNA, 25 nt, Human
ccucccucaaucuucuccucuguca

SEQ ID NO: 180727 - RNA, 20 nt, Human
ccuugaaaaucaaaaagaga

SEQ ID NO: 180728 - RNA, 20 nt, Human
gaaucccccagcugcuuuuc

SEQ ID NO: 180729 - RNA, 19 nt, Human
gcacaacacugaggcaaga

SEQ ID NO: 180730 - RNA, 21 nt, Human
uacaagcacaacacugaggca

SEQ ID NO: 180731 - RNA, 22 nt, Human
uacaagcacaacacugaggcaa

SEQ ID NO: 180732 - RNA, 23 nt, Human
uacaagcacaacacugaggcaag

SEQ ID NO: 180733 - RNA, 22 nt, Human
ucaguuaacccagaaagacaaa

SEQ ID NO: 180734 - RNA, 18 nt, Human
ucccccagcugcuuuucc

SEQ ID NO: 180735 - RNA, 22 nt, Human
ugagaaaaaagaaaaagugcca

SEQ ID NO: 180736 - RNA, 22 nt, Human
ugauuccagaaagaugcuagga

SEQ ID NO: 180737 - RNA, 19 nt, Human
ugggaccaucaguuaaccc

SEQ ID NO: 180738 - RNA, 20 nt, Human
uguccagauucaaucaaaau

SEQ ID NO: 180739 - RNA, 23 nt, Human
uuaacccagaaagacaaagccuc

SEQ ID NO: 180740 - RNA, 22 nt, Human
uuggcaggaaccuaguuuccuu

SEQ ID NO: 180741 - RNA, 20 nt, Human
aaaaugagugagaugaaaug

SEQ ID NO: 180742 - RNA, 18 nt, Human
aaaucaccuggaauuaau

SEQ ID NO: 180743 - RNA, 19 nt, Human
aagaagagcagcaacagcc

SEQ ID NO: 180744 - RNA, 21 nt, Human
acacaccuauggcagagacac

SEQ ID NO: 180745 - RNA, 24 nt, Human
accugcuccaagcgccgcccgccg

SEQ ID NO: 180746 - RNA, 18 nt, Human
agaaagacagaaugaaaa

SEQ ID NO: 180747 - RNA, 25 nt, Human
agacagaaugaaaauguacaaucua

SEQ ID NO: 180748 - RNA, 26 nt, Human
agacagaaugaaaauguacaaucuaa

SEQ ID NO: 180749 - RNA, 18 nt, Human
aggaaaacuuaauauucu

SEQ ID NO: 180750 - RNA, 21 nt, Human
aggaagaagagcagcaacagc

SEQ ID NO: 180751 - RNA, 18 nt, Human
aguggagagucacagugu

SEQ ID NO: 180752 - RNA, 23 nt, Human
augaaaauguacaaucuaacccc

SEQ ID NO: 180753 - RNA, 19 nt, Human
augaaaugucugaagugcc

SEQ ID NO: 180754 - RNA, 19 nt, Human
caaggcauggggaaccaga

SEQ ID NO: 180755 - RNA, 25 nt, Human
caccuucguuccuagagauacaaag

SEQ ID NO: 180756 - RNA, 19 nt, Human
cacgauccugaaaauaguc

SEQ ID NO: 180757 - RNA, 18 nt, Human
cagcauugagcagaagug

SEQ ID NO: 180758 - RNA, 23 nt, Human
ccacacgcacacauauacacaua

SEQ ID NO: 180759 - RNA, 23 nt, Human
cccgcaguaugcggaccccuucu

SEQ ID NO: 180760 - RNA, 25 nt, Human
cgcacacauauacacauacacaccu

SEQ ID NO: 180761 - RNA, 22 nt, Human
cucagcauugagcagaagugga

SEQ ID NO: 180762 - RNA, 22 nt, Human
cuucugaauugaccauuugcau

SEQ ID NO: 180763 - RNA, 19 nt, Human
gaaaaaacaaaucaccugg

SEQ ID NO: 180764 - RNA, 21 nt, Human
gaaaauguacaaucuaacccc

SEQ ID NO: 180765 - RNA, 19 nt, Human
gaaguggagagucacagug

SEQ ID NO: 180766 - RNA, 23 nt, Human
gaauguucguucuucccugacug

SEQ ID NO: 180767 - RNA, 19 nt, Human
gcuccagcagcaaaggaag

SEQ ID NO: 180768 - RNA, 19 nt, Human
ggcagagacacuuucuucu

SEQ ID NO: 180769 - RNA, 22 nt, Human
gugaaaaaacaaaucaccugga

SEQ ID NO: 180770 - RNA, 23 nt, Human
uaacuaauuauuuucccauuuug

SEQ ID NO: 180771 - RNA, 18 nt, Human
uaagaaaaguagauugug

SEQ ID NO: 180772 - RNA, 21 nt, Human
uaauaugaaauagaauccccu

SEQ ID NO: 180773 - RNA, 22 nt, Human
uacaaaaaugagugagaugaaa

SEQ ID NO: 180774 - RNA, 22 nt, Human
uacacaccuauggcagagacac

SEQ ID NO: 180775 - RNA, 27 nt, Human
uaccacacgcacacauauacacauaca

SEQ ID NO: 180776 - RNA, 24 nt, Human
uagaauccccuaauaaauauuuua

SEQ ID NO: 180777 - RNA, 19 nt, Human
uaggugcugggcaacaguu

SEQ ID NO: 180778 - RNA, 26 nt, Human
uauacacauacacaccuauggcagag

SEQ ID NO: 180779 - RNA, 22 nt, Human
uauacacauacacaccuauggu

SEQ ID NO: 180780 - RNA, 18 nt, Human
uauauaacauauaaacac

SEQ ID NO: 180781 - RNA, 22 nt, Human
uaugcggaccccuucucagcau

SEQ ID NO: 180782 - RNA, 19 nt, Human
uauuuuauauucauuaaaa

SEQ ID NO: 180783 - RNA, 18 nt, Human
uccaaggcauggggaacc

SEQ ID NO: 180784 - RNA, 25 nt, Human
uccaaggcauggggaaccagaaaga

SEQ ID NO: 180785 - RNA, 23 nt, Human
uccccgcaguaugcggaccccuu

SEQ ID NO: 180786 - RNA, 18 nt, Human
ucccguauuuccaccuuc

SEQ ID NO: 180787 - RNA, 21 nt, Human
ucugaagugccuaggugcugg

SEQ ID NO: 180788 - RNA, 21 nt, Human
ugaaaaaacaaaucaccugga

SEQ ID NO: 180789 - RNA, 18 nt, Human
ugaaauuacaaaaaugag

SEQ ID NO: 180790 - RNA, 20 nt, Human
ugaaauuacaaaaaugagug

SEQ ID NO: 180791 - RNA, 19 nt, Human
ugaagugccuaggugcugg

SEQ ID NO: 180792 - RNA, 20 nt, Human
ugaagugccuaggugcuggg

SEQ ID NO: 180793 - RNA, 22 nt, Human
ugcauagcuaaccaaaauacaa

SEQ ID NO: 180794 - RNA, 19 nt, Human
ugcuccaagcgccgcccgc

SEQ ID NO: 180795 - RNA, 26 nt, Human
uggaauuaauaugaaauagaaucccc

SEQ ID NO: 180796 - RNA, 24 nt, Human
ugggcaacaguucucuaaagcucc

SEQ ID NO: 180797 - RNA, 25 nt, Human
uguaacuaauuauuuucccauuuug

SEQ ID NO: 180798 - RNA, 23 nt, Human
uguauaccacacgcacacauaua

SEQ ID NO: 180799 - RNA, 28 nt, Human
uguauaccacacgcacacauauacacag

SEQ ID NO: 180800 - RNA, 19 nt, Human
uuauauguacaauccucca

SEQ ID NO: 180801 - RNA, 22 nt, Human
uucuucccugacugagacccag

SEQ ID NO: 180802 - RNA, 20 nt, Human
aaaaugcaauguugcuauga

SEQ ID NO: 180803 - RNA, 21 nt, Human
aaggaguaggucacaaugaaa

SEQ ID NO: 180804 - RNA, 18 nt, Human
acaaaguuuaaacaauau

SEQ ID NO: 180805 - RNA, 20 nt, Human
acaauauguaauacaaccuu

SEQ ID NO: 180806 - RNA, 20 nt, Human
acaaucaaauggcauccaaa

SEQ ID NO: 180807 - RNA, 22 nt, Human
acagauauuacaugaucaugcu

SEQ ID NO: 180808 - RNA, 21 nt, Human
aggcgccccugcccacaaucg

SEQ ID NO: 180809 - RNA, 20 nt, Human
auuugcaguuuacacuaacu

SEQ ID NO: 180810 - RNA, 21 nt, Human
ccacaguuuuauuacaaucaa

SEQ ID NO: 180811 - RNA, 20 nt, Human
cggaggcgccccugcccaca

SEQ ID NO: 180812 - RNA, 21 nt, Human
cggaggcgccccugcccacaa

SEQ ID NO: 180813 - RNA, 23 nt, Human
gcaguuuacacuaacugaagaga

SEQ ID NO: 180814 - RNA, 19 nt, Human
uaccauagcaggauucagc

SEQ ID NO: 180815 - RNA, 22 nt, Human
uaugcuuguccuucauuuguua

SEQ ID NO: 180816 - RNA, 23 nt, Human
uauguucacuauacauauauaca

SEQ ID NO: 180817 - RNA, 22 nt, Human
ucaaauggcauccaaaaugcaa

SEQ ID NO: 180818 - RNA, 19 nt, Human
ugaaaacuugaauuucaga

SEQ ID NO: 180819 - RNA, 18 nt, Human
ugcuaugaaaauucaaaa

SEQ ID NO: 180820 - RNA, 22 nt, Human
uggaauuuuauuuuguacaaau

SEQ ID NO: 180821 - RNA, 25 nt, Human
uguaauacaaccuuuuuaaaucugu

SEQ ID NO: 180822 - RNA, 24 nt, Human
ugugauaauaccaucuaaaauuuu

SEQ ID NO: 180823 - RNA, 22 nt, Human
uguugcuaugaaaauucaaaag

SEQ ID NO: 180824 - RNA, 23 nt, Human
uuggcauuuaugaaaggaguagg

SEQ ID NO: 180825 - RNA, 21 nt, Human
uuugaaauacuacauacauua

SEQ ID NO: 180826 - RNA, 18 nt, Human
aaaagcuguuugugcccc

SEQ ID NO: 180827 - RNA, 22 nt, Human
aaacauaguugaaaaacacugg

SEQ ID NO: 180828 - RNA, 22 nt, Human
aaagaacacauucaaaauacca

SEQ ID NO: 180829 - RNA, 23 nt, Human
aaagagcucauccagaagaaaac

SEQ ID NO: 180830 - RNA, 26 nt, Human
aaagagcucauccagaagaaaaccaa

SEQ ID NO: 180831 - RNA, 19 nt, Human
aaagaggacaauugagggu

SEQ ID NO: 180832 - RNA, 23 nt, Human
aagcuguuugugcccccaaauuc

SEQ ID NO: 180833 - RNA, 22 nt, Human
acaguaagaaacgcaugccaaa

SEQ ID NO: 180834 - RNA, 25 nt, Human
agaaagaacacauucaaaauaccac

SEQ ID NO: 180835 - RNA, 24 nt, Human
agagcucauccagaagaaaaccaa

SEQ ID NO: 180836 - RNA, 21 nt, Human
agaggacaauugagggucagu

SEQ ID NO: 180837 - RNA, 18 nt, Human
aguggagagaugcaugua

SEQ ID NO: 180838 - RNA, 20 nt, Human
auaacagaguguuccgcaug

SEQ ID NO: 180839 - RNA, 24 nt, Human
auucaaaauaccacugauuucaua

SEQ ID NO: 180840 - RNA, 27 nt, Human
caaagagcucauccagaagaaaaccaa

SEQ ID NO: 180841 - RNA, 19 nt, Human
cacaguguucaggauuauc

SEQ ID NO: 180842 - RNA, 23 nt, Human
cagaagaaaaccaagauggcccg

SEQ ID NO: 180843 - RNA, 18 nt, Human
cagcaaaaugauuuuagc

SEQ ID NO: 180844 - RNA, 21 nt, Human
cagcaaaaugauuuuagcuaa

SEQ ID NO: 180845 - RNA, 23 nt, Human
caguaagaaacgcaugccaaaga

SEQ ID NO: 180846 - RNA, 22 nt, Human
cauucaaaauaccacugauuuc

SEQ ID NO: 180847 - RNA, 24 nt, Human
cauucaaaauaccacugauuucau

SEQ ID NO: 180848 - RNA, 19 nt, Human
ccagaacuugucacagucu

SEQ ID NO: 180849 - RNA, 19 nt, Human
ccucugcacuugugccucu

SEQ ID NO: 180850 - RNA, 22 nt, Human
ccucugcacuugugccucugau

SEQ ID NO: 180851 - RNA, 22 nt, Human
cugagccaaaagaggaaaaaag

SEQ ID NO: 180852 - RNA, 21 nt, Human
cugcacuugugccucugaucc

SEQ ID NO: 180853 - RNA, 20 nt, Human
gaccacagccucugcacuug

SEQ ID NO: 180854 - RNA, 21 nt, Human
gagaacaguaagaaacgcaug

SEQ ID NO: 180855 - RNA, 20 nt, Human
gcccugugauuaagagcaag

SEQ ID NO: 180856 - RNA, 25 nt, Human
ggagcucuuucacagauacacucuu

SEQ ID NO: 180857 - RNA, 23 nt, Human
ggaggacaagguggagaacacug

SEQ ID NO: 180858 - RNA, 24 nt, Human
ggaggacaagguggagaacacugg

SEQ ID NO: 180859 - RNA, 24 nt, Human
gggcaguagcagauaaccaacugu

SEQ ID NO: 180860 - RNA, 19 nt, Human
ggguccugugaccuuucac

SEQ ID NO: 180861 - RNA, 24 nt, Human
guugguccacuuuuaaauacugag

SEQ ID NO: 180862 - RNA, 24 nt, Human
uacaaacuccauaaagucaagcag

SEQ ID NO: 180863 - RNA, 25 nt, Human
uacugagccaaaagaggaaaaaagc

SEQ ID NO: 180864 - RNA, 20 nt, Human
uagaacaggcaaacuucaug

SEQ ID NO: 180865 - RNA, 18 nt, Human
uagcagauaaccaacugu

SEQ ID NO: 180866 - RNA, 25 nt, Human
ucagagcagcgauuuucaagguggg

SEQ ID NO: 180867 - RNA, 18 nt, Human
ucaucauuugcaaugcca

SEQ ID NO: 180868 - RNA, 22 nt, Human
ucuagaacaggcaaacuucaug

SEQ ID NO: 180869 - RNA, 18 nt, Human
ucuuacaauucuagaaca

SEQ ID NO: 180870 - RNA, 23 nt, Human
ugaaaaacacuggcuuagaggua

SEQ ID NO: 180871 - RNA, 23 nt, Human
ugagauguguggaggacaaggug

SEQ ID NO: 180872 - RNA, 21 nt, Human
ugaggagggacgucagcaugg

SEQ ID NO: 180873 - RNA, 23 nt, Human
ugaggagggacgucagcaugggg

SEQ ID NO: 180874 - RNA, 18 nt, Human
uggcccggucaaccuucu

SEQ ID NO: 180875 - RNA, 19 nt, Human
ugggaugggauggggugga

SEQ ID NO: 180876 - RNA, 22 nt, Human
ugggaugggguggaguugagug

SEQ ID NO: 180877 - RNA, 23 nt, Human
ugggaugggguggaguugagugg

SEQ ID NO: 180878 - RNA, 23 nt, Human
uguaguuagaaagaacacauuca

SEQ ID NO: 180879 - RNA, 22 nt, Human
uguaguuagaaagaaccggggc

SEQ ID NO: 180880 - RNA, 22 nt, Human
uuaacaaucuuacaauucuaga

SEQ ID NO: 180881 - RNA, 22 nt, Human
uucauaauacaaacuccauaaa

SEQ ID NO: 180882 - RNA, 20 nt, Human
uucugaaaaccaaagagcuc

SEQ ID NO: 180883 - RNA, 24 nt, Human
uuucauaugauuucuccaauuggg

SEQ ID NO: 180884 - RNA, 20 nt, Human
aaaaaaaaaaaauuaggaaa

SEQ ID NO: 180885 - RNA, 19 nt, Human
aaacaaaacaaaagaaauu

SEQ ID NO: 180886 - RNA, 23 nt, Human
aaacagaaucaaaguggugccuc

SEQ ID NO: 180887 - RNA, 20 nt, Human
aaacaugaccauccaaaaca

SEQ ID NO: 180888 - RNA, 18 nt, Human
aacaaaagaaauuagcac

SEQ ID NO: 180889 - RNA, 18 nt, Human
aagaagacaaagauuauu

SEQ ID NO: 180890 - RNA, 23 nt, Human
acaaaacaaaagaaauuagcaca

SEQ ID NO: 180891 - RNA, 26 nt, Human
acaaaacaaaagaaauuagcacagag

SEQ ID NO: 180892 - RNA, 27 nt, Human
acaaaacaaaagaaauuagcacagaga

SEQ ID NO: 180893 - RNA, 19 nt, Human
acaaaagaaauuagcacag

SEQ ID NO: 180894 - RNA, 20 nt, Human
accgcaauuuauuguucauu

SEQ ID NO: 180895 - RNA, 18 nt, Human
acuccaaagaagacaaag

SEQ ID NO: 180896 - RNA, 22 nt, Human
acuccaaagaagacaaagauua

SEQ ID NO: 180897 - RNA, 19 nt, Human
agaaaaaacaugaccaucc

SEQ ID NO: 180898 - RNA, 18 nt, Human
agaaucaaaguggugccu

SEQ ID NO: 180899 - RNA, 20 nt, Human
augaccauccaaaacagaau

SEQ ID NO: 180900 - RNA, 24 nt, Human
caaugcauguauuuaaaacauccu

SEQ ID NO: 180901 - RNA, 24 nt, Human
caccaccugccaaaaaaaaaaaau

SEQ ID NO: 180902 - RNA, 23 nt, Human
cauccucaaacauuuaaaagaca

SEQ ID NO: 180903 - RNA, 21 nt, Human
caugaccauccaaaacagaau

SEQ ID NO: 180904 - RNA, 23 nt, Human
cgccucuggauucuuuuagguuu

SEQ ID NO: 180905 - RNA, 25 nt, Human
cucaguggugguaauaauagccuuu

SEQ ID NO: 180906 - RNA, 21 nt, Human
gccaaaaaaaaaaaauuagga

SEQ ID NO: 180907 - RNA, 23 nt, Human
gggaaacggaggagaaaaaacau

SEQ ID NO: 180908 - RNA, 23 nt, Human
uagcacagagauguuucaccaug

SEQ ID NO: 180909 - RNA, 25 nt, Human
uaggaaacaaaacaaaagaaauuag

SEQ ID NO: 180910 - RNA, 18 nt, Human
uagguuuccaccgcaauu

SEQ ID NO: 180911 - RNA, 21 nt, Human
ucaaacauuuaaaagacauua

SEQ ID NO: 180912 - RNA, 22 nt, Human
ucccaccaccugccaaaaaaaa

SEQ ID NO: 180913 - RNA, 20 nt, Human
ugccucagauguuuccaacu

SEQ ID NO: 180914 - RNA, 23 nt, Human
uguauuuaaaacauccucaaaca

SEQ ID NO: 180915 - RNA, 21 nt, Human
uguuacacaaguuuuugugug

SEQ ID NO: 180916 - RNA, 22 nt, Human
uuaggaaacaaaacaaaagaaa

SEQ ID NO: 180917 - RNA, 19 nt, Human
uuuaaaagacauuaucggg

SEQ ID NO: 180918 - RNA, 18 nt, Human
uuuuuuagguuuccaccg

SEQ ID NO: 180919 - RNA, 20 nt, Human
uuuuuuuuuuuuagguuucc

SEQ ID NO: 180920 - RNA, 23 nt, Human
uuuuuuuuuuuuuuuuuuuuagg

SEQ ID NO: 180921 - RNA, 23 nt, Human
aaaaaaaaaaacuucuuaaagag

SEQ ID NO: 180922 - RNA, 18 nt, Human
aaacuacagagcccacca

SEQ ID NO: 180923 - RNA, 18 nt, Human
aacagcaucaaaugguca

SEQ ID NO: 180924 - RNA, 20 nt, Human
aacagcuaauccagcucugc

SEQ ID NO: 180925 - RNA, 25 nt, Human
aagaaaacuccaguaacacugaaau

SEQ ID NO: 180926 - RNA, 23 nt, Human
aagcacauaugauacuaaagcca

SEQ ID NO: 180927 - RNA, 19 nt, Human
aagcaggaaucggcacaua

SEQ ID NO: 180928 - RNA, 20 nt, Human
aaggggauauagaaaaagga

SEQ ID NO: 180929 - RNA, 26 nt, Human
aagucuugaaaaucacacuauuugcu

SEQ ID NO: 180930 - RNA, 24 nt, Human
aauaaaucauggaagaccacacaa

SEQ ID NO: 180931 - RNA, 23 nt, Human
aauaucagaacuccucacuaaca

SEQ ID NO: 180932 - RNA, 20 nt, Human
acaacagcaucaaaugguca

SEQ ID NO: 180933 - RNA, 29 nt, Human
acaauagaaaaaucacaagaaaucuggaa

SEQ ID NO: 180934 - RNA, 25 nt, Human
acacagcuucagagaaggggaacgc

SEQ ID NO: 180935 - RNA, 22 nt, Human
acauaaaaacugcauaguaugc

SEQ ID NO: 180936 - RNA, 18 nt, Human
acccuguaauaucuuugg

SEQ ID NO: 180937 - RNA, 25 nt, Human
acucagcauccuccccauggaagcu

SEQ ID NO: 180938 - RNA, 21 nt, Human
acuccaguaacacugaaauga

SEQ ID NO: 180939 - RNA, 24 nt, Human
acugaaaugacaaauguaaaauau

SEQ ID NO: 180940 - RNA, 19 nt, Human
agaaaaagaaaaaaaaagg

SEQ ID NO: 180941 - RNA, 19 nt, Human
agaaaaaggaaaauuuuuc

SEQ ID NO: 180942 - RNA, 23 nt, Human
agaaaaaggaaaauuuuucaaaa

SEQ ID NO: 180943 - RNA, 19 nt, Human
agaaaacuccaguaacacu

SEQ ID NO: 180944 - RNA, 20 nt, Human
agaaguccauuugugugcau

SEQ ID NO: 180945 - RNA, 19 nt, Human
agacaaauggcaaaguucu

SEQ ID NO: 180946 - RNA, 22 nt, Human
agacuggaagugaaaaugaaag

SEQ ID NO: 180947 - RNA, 24 nt, Human
agccaacagcaaacagcccaagca

SEQ ID NO: 180948 - RNA, 22 nt, Human
auaaagcuuuaaauuaacauga

SEQ ID NO: 180949 - RNA, 22 nt, Human
auuaccaaagaugagaccagca

SEQ ID NO: 180950 - RNA, 19 nt, Human
caaauaaaucauggaagac

SEQ ID NO: 180951 - RNA, 21 nt, Human
caaauguaaaauauacaucac

SEQ ID NO: 180952 - RNA, 22 nt, Human
caagacaaagaauuauagguca

SEQ ID NO: 180953 - RNA, 24 nt, Human
cacacaaccguaagugcauauagu

SEQ ID NO: 180954 - RNA, 28 nt, Human
caccuggaggcugcuggaguaaggugcc

SEQ ID NO: 180955 - RNA, 21 nt, Human
cacuaccagauagaaauacac

SEQ ID NO: 180956 - RNA, 21 nt, Human
cacucagcauccuccccaugg

SEQ ID NO: 180957 - RNA, 23 nt, Human
cagaaauaggaggcauuuucuga

SEQ ID NO: 180958 - RNA, 22 nt, Human
cagaacuccucacuaacaugcc

SEQ ID NO: 180959 - RNA, 24 nt, Human
cagacaacagcaucaaauggucaa

SEQ ID NO: 180960 - RNA, 20 nt, Human
cagccaacagcaaacagccc

SEQ ID NO: 180961 - RNA, 18 nt, Human
caguggcaggagccacug

SEQ ID NO: 180962 - RNA, 27 nt, Human
caucaccauaaauugaaaauucacaaa

SEQ ID NO: 180963 - RNA, 21 nt, Human
ccccaaggaggacaaaucucu

SEQ ID NO: 180964 - RNA, 18 nt, Human
cccuagaagcuaaaaaaa

SEQ ID NO: 180965 - RNA, 22 nt, Human
ccucggggaacgcggucugugg

SEQ ID NO: 180966 - RNA, 21 nt, Human
ccugaauuaccaacccaagac

SEQ ID NO: 180967 - RNA, 20 nt, Human
ccugccagacagacaacagc

SEQ ID NO: 180968 - RNA, 18 nt, Human
cgccggguccgucagcgc

SEQ ID NO: 180969 - RNA, 26 nt, Human
cuaaagccaaaacaaaaagaucuuug

SEQ ID NO: 180970 - RNA, 19 nt, Human
cuacagagcccaccaagaa

SEQ ID NO: 180971 - RNA, 20 nt, Human
cucacucagcauccucccca

SEQ ID NO: 180972 - RNA, 23 nt, Human
cucuuuuuauuauagaaaagccu

SEQ ID NO: 180973 - RNA, 19 nt, Human
cugcugcugcugcugcugc

SEQ ID NO: 180974 - RNA, 19 nt, Human
cugcugcugcugcugcugc

SEQ ID NO: 180975 - RNA, 18 nt, Human
cuuucagaauaacuuugg

SEQ ID NO: 180976 - RNA, 19 nt, Human
cuuuccaaaugaauccuga

SEQ ID NO: 180977 - RNA, 28 nt, Human
gaaaaagcacauaugauacuaaagccaa

SEQ ID NO: 180978 - RNA, 24 nt, Human
gaaaagccucaaaaucauugguaa

SEQ ID NO: 180979 - RNA, 19 nt, Human
gaggaugcuccgggcgugg

SEQ ID NO: 180980 - RNA, 20 nt, Human
gauauagaaaaaggaaaauu

SEQ ID NO: 180981 - RNA, 19 nt, Human
gccaacagcaaacagccca

SEQ ID NO: 180982 - RNA, 19 nt, Human
gcucacucagcauccuccc

SEQ ID NO: 180983 - RNA, 20 nt, Human
gcugcaguugcacaucccuu

SEQ ID NO: 180984 - RNA, 21 nt, Human
ggaaacugcucacucagcauc

SEQ ID NO: 180985 - RNA, 22 nt, Human
ggaaugauccagugguccccca

SEQ ID NO: 180986 - RNA, 20 nt, Human
ggcagcuacuuggguguggu

SEQ ID NO: 180987 - RNA, 23 nt, Human
ggccgugguuucaccaaaggagg

SEQ ID NO: 180988 - RNA, 20 nt, Human
ggcucggacucccgcagcgg

SEQ ID NO: 180989 - RNA, 18 nt, Human
gggcagcagugggguaua

SEQ ID NO: 180990 - RNA, 20 nt, Human
gggcaguggcaggagccacu

SEQ ID NO: 180991 - RNA, 19 nt, Human
gggugcugcugcugcugcu

SEQ ID NO: 180992 - RNA, 23 nt, Human
guaaaaagcaacacuaccugauu

SEQ ID NO: 180993 - RNA, 18 nt, Human
gucaacagcuaauccagc

SEQ ID NO: 180994 - RNA, 19 nt, Human
gugcugcugcugcugcugc

SEQ ID NO: 180995 - RNA, 20 nt, Human
gugcugcugcugcugcugcu

SEQ ID NO: 180996 - RNA, 21 nt, Human
gugguuccggcucggacuccc

SEQ ID NO: 180997 - RNA, 20 nt, Human
uaaaauauacaucacuacca

SEQ ID NO: 180998 - RNA, 23 nt, Human
uaaacacagcuucagagaagucc

SEQ ID NO: 180999 - RNA, 19 nt, Human
uaaagccaaaacaaaaaga

SEQ ID NO: 181000 - RNA, 28 nt, Human
uaacacugaaaugacaaauguaaaauau

SEQ ID NO: 181001 - RNA, 28 nt, Human
uaacggcacauuuaauuaaacaacaaag

SEQ ID NO: 181002 - RNA, 18 nt, Human
uaacuccuagaaaauccu

SEQ ID NO: 181003 - RNA, 22 nt, Human
uaaggugccaucaggcauguaa

SEQ ID NO: 181004 - RNA, 21 nt, Human
uacauucacacauacguuuug

SEQ ID NO: 181005 - RNA, 21 nt, Human
uacuauggaaaacauaaaaac

SEQ ID NO: 181006 - RNA, 20 nt, Human
uagaaaaagaaaaaaaaagg

SEQ ID NO: 181007 - RNA, 23 nt, Human
uagaaaaaucacaagaaaucugg

SEQ ID NO: 181008 - RNA, 19 nt, Human
uagcacagucaacagcauu

SEQ ID NO: 181009 - RNA, 24 nt, Human
uauagcauauuaccaaagaugaga

SEQ ID NO: 181010 - RNA, 20 nt, Human
uauggaaaacauaaaaacug

SEQ ID NO: 181011 - RNA, 21 nt, Human
uauggaaaacauaaaaacugc

SEQ ID NO: 181012 - RNA, 23 nt, Human
uauuaccaaagaugagaccagca

SEQ ID NO: 181013 - RNA, 19 nt, Human
ucaugaagcuagggugaga

SEQ ID NO: 181014 - RNA, 22 nt, Human
uccacaauuaaauagguaagug

SEQ ID NO: 181015 - RNA, 22 nt, Human
uccauuugugugcaugugugug

SEQ ID NO: 181016 - RNA, 21 nt, Human
ucccaaagagaucagauuugu

SEQ ID NO: 181017 - RNA, 21 nt, Human
uccggcucggacucccgcagc

SEQ ID NO: 181018 - RNA, 23 nt, Human
uccucggggaacgcggucugugg

SEQ ID NO: 181019 - RNA, 24 nt, Human
uccugaauuaccaacccaagacaa

SEQ ID NO: 181020 - RNA, 18 nt, Human
ugaaaaaagaugaaaacu

SEQ ID NO: 181021 - RNA, 18 nt, Human
ugaaagcaccuggaggcu

SEQ ID NO: 181022 - RNA, 18 nt, Human
ugaaaugacaaauguaaa

SEQ ID NO: 181023 - RNA, 21 nt, Human
ugaauccugaauuaccaaccc

SEQ ID NO: 181024 - RNA, 18 nt, Human
ugcaugugugugugugcu

SEQ ID NO: 181025 - RNA, 25 nt, Human
ugccagaaauaggaggcauuuucug

SEQ ID NO: 181026 - RNA, 24 nt, Human
ugcgggugcugcugcugcugcugc

SEQ ID NO: 181027 - RNA, 20 nt, Human
ugcuccgggcgugggcggcc

SEQ ID NO: 181028 - RNA, 21 nt, Human
ugcugcugcugcugcugcugc

SEQ ID NO: 181029 - RNA, 21 nt, Human
ugcugcugcugcugcugcugc

SEQ ID NO: 181030 - RNA, 21 nt, Human
ugcugcugcugcugcugcugc

SEQ ID NO: 181031 - RNA, 21 nt, Human
ugcugcugcugcugcugcugc

SEQ ID NO: 181032 - RNA, 21 nt, Human
ugcugcugcugcugcugcugc

SEQ ID NO: 181033 - RNA, 21 nt, Human
ugcugcugcugcugcugcugc

SEQ ID NO: 181034 - RNA, 21 nt, Human
ugcugcugcugcugcugcugc

SEQ ID NO: 181035 - RNA, 18 nt, Human
ugcuucuaaaggcaaccu

SEQ ID NO: 181036 - RNA, 19 nt, Human
uggaaaacauaaaaacugc

SEQ ID NO: 181037 - RNA, 22 nt, Human
uggcaggagccacuggcuuaga

SEQ ID NO: 181038 - RNA, 23 nt, Human
ugggaacagcuucgggccuggug

SEQ ID NO: 181039 - RNA, 22 nt, Human
uggugcagcuaaggaacauugg

SEQ ID NO: 181040 - RNA, 20 nt, Human
ugucgggcagcaguggggua

SEQ ID NO: 181041 - RNA, 20 nt, Human
ugugcaugugugugugugcu

SEQ ID NO: 181042 - RNA, 19 nt, Human
ugugugcaugugugugugu

SEQ ID NO: 181043 - RNA, 19 nt, Human
ugugugcaugugugugugu

SEQ ID NO: 181044 - RNA, 20 nt, Human
ugugugcaugugugugugug

SEQ ID NO: 181045 - RNA, 24 nt, Human
uuauggagggagauuguuuuauuu

SEQ ID NO: 181046 - RNA, 20 nt, Human
uucaacugucuuguuucauu

SEQ ID NO: 181047 - RNA, 18 nt, Human
uucagagaaguccauuug

SEQ ID NO: 181048 - RNA, 22 nt, Human
uucauguacuugagcucauuuc

SEQ ID NO: 181049 - RNA, 24 nt, Human
uuugugugcaugugugugugugcu

SEQ ID NO: 181050 - RNA, 18 nt, Human
aaaaaaucguuauacaca

SEQ ID NO: 181051 - RNA, 20 nt, Human
aaaagaaaaauuagucaggg

SEQ ID NO: 181052 - RNA, 19 nt, Human
aaagaaaaauuagucaggg

SEQ ID NO: 181053 - RNA, 19 nt, Human
aacccgguggccccauccc

SEQ ID NO: 181054 - RNA, 19 nt, Human
acacagcacuuugccccuc

SEQ ID NO: 181055 - RNA, 24 nt, Human
acagacaagacaggcacccggagc

SEQ ID NO: 181056 - RNA, 23 nt, Human
acagcccccucccuaaauccacg

SEQ ID NO: 181057 - RNA, 21 nt, Human
acaucacagcccccucccuaa

SEQ ID NO: 181058 - RNA, 21 nt, Human
acccugccagcucccagcacc

SEQ ID NO: 181059 - RNA, 21 nt, Human
agaaaaaaauuuuaaaaaaga

SEQ ID NO: 181060 - RNA, 21 nt, Human
agaaacaggaacugacacagc

SEQ ID NO: 181061 - RNA, 18 nt, Human
agaggggcagagugugcc

SEQ ID NO: 181062 - RNA, 24 nt, Human
agcacuuugggaggcugagguagg

SEQ ID NO: 181063 - RNA, 19 nt, Human
agccugggcaacgcaguga

SEQ ID NO: 181064 - RNA, 21 nt, Human
aggaaagagcugagguuagca

SEQ ID NO: 181065 - RNA, 21 nt, Human
aggcaagaaaaaccgucaggg

SEQ ID NO: 181066 - RNA, 19 nt, Human
aggcacccggagcguuggc

SEQ ID NO: 181067 - RNA, 19 nt, Human
aggcugagguaggaggaug

SEQ ID NO: 181068 - RNA, 22 nt, Human
aggcugaggugagaggaucacu

SEQ ID NO: 181069 - RNA, 24 nt, Human
agggaagacuagcuggggagaggu

SEQ ID NO: 181070 - RNA, 22 nt, Human
agguaggaggauggauggcuug

SEQ ID NO: 181071 - RNA, 25 nt, Human
aggugggaaggaaagagcugagguu

SEQ ID NO: 181072 - RNA, 23 nt, Human
agucagggguggcagcaugugcc

SEQ ID NO: 181073 - RNA, 20 nt, Human
auccccggcucgagucccca

SEQ ID NO: 181074 - RNA, 18 nt, Human
caagaaaaaccgucaggg

SEQ ID NO: 181075 - RNA, 19 nt, Human
caagaaagaacauucccuc

SEQ ID NO: 181076 - RNA, 22 nt, Human
caagaaagaacauucccuccug

SEQ ID NO: 181077 - RNA, 19 nt, Human
caagacaggcacccggagc

SEQ ID NO: 181078 - RNA, 20 nt, Human
cacacagacaagacaggcac

SEQ ID NO: 181079 - RNA, 20 nt, Human
cacagcugccgcaaagaaug

SEQ ID NO: 181080 - RNA, 25 nt, Human
cacccggagcguuggcaucaacccg

SEQ ID NO: 181081 - RNA, 27 nt, Human
cacccuccaccaucugagaagccacac

SEQ ID NO: 181082 - RNA, 20 nt, Human
cacgcccaccccccagcaac

SEQ ID NO: 181083 - RNA, 21 nt, Human
cacgcugggaggcuggcuccc

SEQ ID NO: 181084 - RNA, 24 nt, Human
cacgcuuguaaucucagcacuuug

SEQ ID NO: 181085 - RNA, 25 nt, Human
cacuugugcacacacacacacacag

SEQ ID NO: 181086 - RNA, 25 nt, Human
cagcacccuccaccaucugagaagg

SEQ ID NO: 181087 - RNA, 24 nt, Human
cagcacuuugggaggcugagguag

SEQ ID NO: 181088 - RNA, 24 nt, Human
cagcacuuugggaggcugagguag

SEQ ID NO: 181089 - RNA, 24 nt, Human
cagcaugugccuguggucuuagcu

SEQ ID NO: 181090 - RNA, 22 nt, Human
cagcucccagcacccuccacca

SEQ ID NO: 181091 - RNA, 19 nt, Human
cagcugaagcaggcggcag

SEQ ID NO: 181092 - RNA, 21 nt, Human
caggaggcugagggcggacac

SEQ ID NO: 181093 - RNA, 20 nt, Human
caggaguuugaggcugcaga

SEQ ID NO: 181094 - RNA, 26 nt, Human
cagggcagccacguucaaccccuugg

SEQ ID NO: 181095 - RNA, 21 nt, Human
caucacagcccccucccuaaa

SEQ ID NO: 181096 - RNA, 27 nt, Human
ccacacagacaagacaggcacccggag

SEQ ID NO: 181097 - RNA, 23 nt, Human
cccagcaacccagcugaagcagg

SEQ ID NO: 181098 - RNA, 25 nt, Human
cccagcacccuccaccaucugagaa

SEQ ID NO: 181099 - RNA, 24 nt, Human
cccaggaguuugaggcugcagagu

SEQ ID NO: 181100 - RNA, 18 nt, Human
cccaucccuggcaaacac

SEQ ID NO: 181101 - RNA, 20 nt, Human
cccccggacagaggggcaga

SEQ ID NO: 181102 - RNA, 20 nt, Human
cccuaaauccacgcccaccc

SEQ ID NO: 181103 - RNA, 22 nt, Human
ccuaaauccacgcccacccccc

SEQ ID NO: 181104 - RNA, 20 nt, Human
ccugccagcucccagcaccc

SEQ ID NO: 181105 - RNA, 22 nt, Human
ccuguggucuuagcuacuuggg

SEQ ID NO: 181106 - RNA, 22 nt, Human
cgcagugagaaaaaaauuuuaa

SEQ ID NO: 181107 - RNA, 18 nt, Human
cgcccaccccccagcaac

SEQ ID NO: 181108 - RNA, 21 nt, Human
cgcccaccccccagcaaccca

SEQ ID NO: 181109 - RNA, 21 nt, Human
cgcccaccccccagcaacccc

SEQ ID NO: 181110 - RNA, 20 nt, Human
cggcucgaguccccaggagg

SEQ ID NO: 181111 - RNA, 24 nt, Human
cgggaggaggggacggggaagggg

SEQ ID NO: 181112 - RNA, 21 nt, Human
cucccagcacccuccaccauc

SEQ ID NO: 181113 - RNA, 18 nt, Human
cucccccacccccucucc

SEQ ID NO: 181114 - RNA, 22 nt, Human
gacggggaaggggaggcggccc

SEQ ID NO: 181115 - RNA, 22 nt, Human
gagaaaaaaauuuuaaaaaaga

SEQ ID NO: 181116 - RNA, 22 nt, Human
gaggaggggacggggaagggga

SEQ ID NO: 181117 - RNA, 19 nt, Human
gagguaggaggauggaugg

SEQ ID NO: 181118 - RNA, 24 nt, Human
gaucacuggagcccaggaguuuga

SEQ ID NO: 181119 - RNA, 25 nt, Human
gaucacuggagcccaggaguuugag

SEQ ID NO: 181120 - RNA, 21 nt, Human
gcacccuccaccaucugagaa

SEQ ID NO: 181121 - RNA, 23 nt, Human
ggaagaccccaguuucuuguuuu

SEQ ID NO: 181122 - RNA, 21 nt, Human
ggagaggaagaccccaguuuc

SEQ ID NO: 181123 - RNA, 23 nt, Human
ggaggcugaggugagaggaucac

SEQ ID NO: 181124 - RNA, 18 nt, Human
ggaguuugaggcugcaga

SEQ ID NO: 181125 - RNA, 19 nt, Human
ggcggacacccgacugucc

SEQ ID NO: 181126 - RNA, 24 nt, Human
gggaagaaacaggaacugacacag

SEQ ID NO: 181127 - RNA, 23 nt, Human
gggaaggaaagagcugagguuag

SEQ ID NO: 181128 - RNA, 25 nt, Human
gggcaacgcagugagaaaaaaauuu

SEQ ID NO: 181129 - RNA, 26 nt, Human
gggcacagcacgcugggaggcuggcc

SEQ ID NO: 181130 - RNA, 18 nt, Human
ggggacggggaaggggag

SEQ ID NO: 181131 - RNA, 25 nt, Human
ggggagagguucgggggagaggaag

SEQ ID NO: 181132 - RNA, 30 nt, Human
ggugacagggcagccacguucaagaaagaa

SEQ ID NO: 181133 - RNA, 24 nt, Human
ggugguucacgcuuguaaucucag

SEQ ID NO: 181134 - RNA, 19 nt, Human
uacaguacuaguuuugucu

SEQ ID NO: 181135 - RNA, 19 nt, Human
uacuaguuuugucuccgag

SEQ ID NO: 181136 - RNA, 23 nt, Human
uagucagggguggcagcaugugc

SEQ ID NO: 181137 - RNA, 21 nt, Human
ucacagcccccucccuaaauc

SEQ ID NO: 181138 - RNA, 23 nt, Human
ucacgcuuguaaucucagcacuu

SEQ ID NO: 181139 - RNA, 23 nt, Human
ucacuggagcccaggaguuugag

SEQ ID NO: 181140 - RNA, 26 nt, Human
ucacuggagcccaggaguuugaggcu

SEQ ID NO: 181141 - RNA, 24 nt, Human
ucagggguggcagcaugugccugu

SEQ ID NO: 181142 - RNA, 25 nt, Human
uccacgcccaccccccagcaaccca

SEQ ID NO: 181143 - RNA, 22 nt, Human
uccccaggaggcugagggcgga

SEQ ID NO: 181144 - RNA, 22 nt, Human
ucgggaggaggggacggggaag

SEQ ID NO: 181145 - RNA, 20 nt, Human
ugacacagcacuuugccccu

SEQ ID NO: 181146 - RNA, 21 nt, Human
ugacacagcacuuugccccuc

SEQ ID NO: 181147 - RNA, 25 nt, Human
ugacagggcagccacguucaagaaa

SEQ ID NO: 181148 - RNA, 21 nt, Human
ugacucaaauaacuuaggcaa

SEQ ID NO: 181149 - RNA, 19 nt, Human
ugagaagccacacagacaa

SEQ ID NO: 181150 - RNA, 20 nt, Human
ugagggcggacacccgacug

SEQ ID NO: 181151 - RNA, 19 nt, Human
ugagguaggaggauggaug

SEQ ID NO: 181152 - RNA, 21 nt, Human
ugagguaggaggauggauggc

SEQ ID NO: 181153 - RNA, 20 nt, Human
ugaggugagaggaucacugg

SEQ ID NO: 181154 - RNA, 24 nt, Human
ugaggugagaggaucacuggagcc

SEQ ID NO: 181155 - RNA, 21 nt, Human
ugagguuagcaaggggcuacg

SEQ ID NO: 181156 - RNA, 19 nt, Human
ugcugaggugacagggcag

SEQ ID NO: 181157 - RNA, 19 nt, Human
uggcaaacacaugcgcgug

SEQ ID NO: 181158 - RNA, 19 nt, Human
uggcagcaugugccugugg

SEQ ID NO: 181159 - RNA, 24 nt, Human
uggcagcaugugccuguggucuua

SEQ ID NO: 181160 - RNA, 21 nt, Human
uggcucccccacccccucucc

SEQ ID NO: 181161 - RNA, 21 nt, Human
ugggaaggaaagagcugaggu

SEQ ID NO: 181162 - RNA, 19 nt, Human
ugggaggcugagguaggag

SEQ ID NO: 181163 - RNA, 19 nt, Human
ugggaggcugagguaggag

SEQ ID NO: 181164 - RNA, 22 nt, Human
ugggaggcugagguaggaggau

SEQ ID NO: 181165 - RNA, 19 nt, Human
ugggaggcugaggugagag

SEQ ID NO: 181166 - RNA, 24 nt, Human
ugggaggcugaggugagaggauca

SEQ ID NO: 181167 - RNA, 19 nt, Human
uggggagagguucggggga

SEQ ID NO: 181168 - RNA, 21 nt, Human
ugucuggaaggacccugccag

SEQ ID NO: 181169 - RNA, 26 nt, Human
ugugcacacacacacacacaggucac

SEQ ID NO: 181170 - RNA, 19 nt, Human
ugugcacacacacacacag

SEQ ID NO: 181171 - RNA, 24 nt, Human
ugugccaggaaaugggaagaaaca

SEQ ID NO: 181172 - RNA, 27 nt, Human
ugugccaggaaaugggaagaaacagga

SEQ ID NO: 181173 - RNA, 22 nt, Human
uucaagaaagaacauucccucc

SEQ ID NO: 181174 - RNA, 25 nt, Human
uucgggaggaggggacggggaaggg

SEQ ID NO: 181175 - RNA, 22 nt, Human
uugagccaaagaguuugagacc

SEQ ID NO: 181176 - RNA, 18 nt, Human
uugggaggcugaggugag

SEQ ID NO: 181177 - RNA, 25 nt, Human
uugggaggcugaggugagaggauca

SEQ ID NO: 181178 - RNA, 23 nt, Human
uugugacucaaauaacuuaggca

SEQ ID NO: 181179 - RNA, 20 nt, Human
uuuguuugacagccuguugg

SEQ ID NO: 181180 - RNA, 24 nt, Human
cuugucaaaaaaaaaaaaaaaaaa

SEQ ID NO: 181181 - RNA, 21 nt, Human
ucaaaaaaaaaaaaaaaaaaa

SEQ ID NO: 181182 - RNA, 22 nt, Human
ugucaaaaaaaaaaaaaaaaaa

SEQ ID NO: 181183 - RNA, 25 nt, Human
ugucaaaaaaaaaaaaaaaaaaacu

SEQ ID NO: 181184 - RNA, 24 nt, Human
uuuuuuuuuuuuuuuuuuuuucag

SEQ ID NO: 181185 - RNA, 18 nt, Human
aaaaaaaaaaaaaaaagc

SEQ ID NO: 181186 - RNA, 22 nt, Human
aaaaaaaaaagcugacucuuac

SEQ ID NO: 181187 - RNA, 20 nt, Human
aaaaaaaaagcugacucuua

SEQ ID NO: 181188 - RNA, 24 nt, Human
aaaagagaacaauuaguuaacaug

SEQ ID NO: 181189 - RNA, 24 nt, Human
aaaaggcccuggccaaauaacucc

SEQ ID NO: 181190 - RNA, 25 nt, Human
aaaauaccaaaauggcucucuggug

SEQ ID NO: 181191 - RNA, 18 nt, Human
aaguuacaugugaagagg

SEQ ID NO: 181192 - RNA, 22 nt, Human
agaaguuacaugugaagaggau

SEQ ID NO: 181193 - RNA, 21 nt, Human
agcaacugacugcucuugacu

SEQ ID NO: 181194 - RNA, 25 nt, Human
agccacagagcaaggcugcacagcc

SEQ ID NO: 181195 - RNA, 25 nt, Human
agccagacuccaaacagggagccca

SEQ ID NO: 181196 - RNA, 21 nt, Human
agccagccagacuccaaacag

SEQ ID NO: 181197 - RNA, 18 nt, Human
aggaggcuuuuuauuuaa

SEQ ID NO: 181198 - RNA, 18 nt, Human
aggauagugaggaaguca

SEQ ID NO: 181199 - RNA, 21 nt, Human
augaaacacucaacccaagga

SEQ ID NO: 181200 - RNA, 24 nt, Human
augcaguuacaaaguaguuagaaa

SEQ ID NO: 181201 - RNA, 28 nt, Human
caaaauaccaaaauggcucucuggugua

SEQ ID NO: 181202 - RNA, 24 nt, Human
caaauucugacaguuuuaaugaaa

SEQ ID NO: 181203 - RNA, 24 nt, Human
cacaccuacuucuuaaauguguua

SEQ ID NO: 181204 - RNA, 24 nt, Human
cagcauguacuuauucuauucuaa

SEQ ID NO: 181205 - RNA, 24 nt, Human
ccaaauaacucccaaaugaaacac

SEQ ID NO: 181206 - RNA, 19 nt, Human
ccaaaugaaacacucaacc

SEQ ID NO: 181207 - RNA, 23 nt, Human
ccacagagcaaggcugcacagcc

SEQ ID NO: 181208 - RNA, 19 nt, Human
ccaccuucugaaaaggcca

SEQ ID NO: 181209 - RNA, 18 nt, Human
ccagaaaaaauaagcaag

SEQ ID NO: 181210 - RNA, 18 nt, Human
cugacucuuacacauaua

SEQ ID NO: 181211 - RNA, 22 nt, Human
cuguuccuccccagcacuagca

SEQ ID NO: 181212 - RNA, 18 nt, Human
cuugacuguuccucccca

SEQ ID NO: 181213 - RNA, 19 nt, Human
gcagaaugcaaagccucua

SEQ ID NO: 181214 - RNA, 24 nt, Human
ggccauuggcaaugcucagagcca

SEQ ID NO: 181215 - RNA, 22 nt, Human
guuaaaaaaaaaaaaaaaagcu

SEQ ID NO: 181216 - RNA, 22 nt, Human
uaaaaaaaaaaaaaaaagcuga

SEQ ID NO: 181217 - RNA, 23 nt, Human
uaaacagaaacagguuuuauauu

SEQ ID NO: 181218 - RNA, 25 nt, Human
uagaguuaaaaaaaaaaaaaaaagc

SEQ ID NO: 181219 - RNA, 18 nt, Human
ucauaaacagaaacaggu

SEQ ID NO: 181220 - RNA, 22 nt, Human
uccaccauuuugcagguaugaa

SEQ ID NO: 181221 - RNA, 22 nt, Human
ucccaaaugaaacacucaaccc

SEQ ID NO: 181222 - RNA, 28 nt, Human
ucugguguaggugauuucuucuucaaag

SEQ ID NO: 181223 - RNA, 21 nt, Human
ugaagaggauagugaggaagu

SEQ ID NO: 181224 - RNA, 22 nt, Human
ugacuuguugagaaugguaucc

SEQ ID NO: 181225 - RNA, 18 nt, Human
ugaguaggggccauuggc

SEQ ID NO: 181226 - RNA, 19 nt, Human
ugaguaggggccauuggca

SEQ ID NO: 181227 - RNA, 23 nt, Human
ugaguaggggccauuggcaaugc

SEQ ID NO: 181228 - RNA, 21 nt, Human
ugcaaagccucuaaaaggaga

SEQ ID NO: 181229 - RNA, 21 nt, Human
ugcagaaugcaaagccucuaa

SEQ ID NO: 181230 - RNA, 19 nt, Human
uggcaaugcucagagccag

SEQ ID NO: 181231 - RNA, 19 nt, Human
ugggaaaagccacagagca

SEQ ID NO: 181232 - RNA, 21 nt, Human
ugggaaaagccacagagcaag

SEQ ID NO: 181233 - RNA, 24 nt, Human
uguguugggaaaagccacagagca

SEQ ID NO: 181234 - RNA, 24 nt, Human
uguuaagugauuaaaggcaauuuu

SEQ ID NO: 181235 - RNA, 19 nt, Human
uuaaauguguuaaaguuac

SEQ ID NO: 181236 - RNA, 22 nt, Human
uuaaugagucaggagagaaagg

SEQ ID NO: 181237 - RNA, 18 nt, Human
uuacagcagcauguacuu

SEQ ID NO: 181238 - RNA, 22 nt, Human
uuacagugugucccagacucau

SEQ ID NO: 181239 - RNA, 21 nt, Human
uuagaaauuucugaagggugu

SEQ ID NO: 181240 - RNA, 24 nt, Human
uuagaguuaaaaaaaaaaaaaaaa

SEQ ID NO: 181241 - RNA, 18 nt, Human
uucacuguuugagucaag

SEQ ID NO: 181242 - RNA, 19 nt, Human
uucugaaggguguuagagu

SEQ ID NO: 181243 - RNA, 20 nt, Human
uugacuguuccuccccagca

SEQ ID NO: 181244 - RNA, 22 nt, Human
uugaggaccaugccaccuucug

SEQ ID NO: 181245 - RNA, 23 nt, Human
aaaaaaacgaccuugauauucca

SEQ ID NO: 181246 - RNA, 23 nt, Human
aaaauaaccccaauacccccucu

SEQ ID NO: 181247 - RNA, 20 nt, Human
aacacacauaauccacaaaa

SEQ ID NO: 181248 - RNA, 24 nt, Human
aaccacagcuggccugccacagcc

SEQ ID NO: 181249 - RNA, 22 nt, Human
aaccacuucccuugcucucuac

SEQ ID NO: 181250 - RNA, 22 nt, Human
aaccccaauacccccucuguca

SEQ ID NO: 181251 - RNA, 20 nt, Human
aacuugaccccucuauccca

SEQ ID NO: 181252 - RNA, 22 nt, Human
aagaaaaguuuccaccacgagg

SEQ ID NO: 181253 - RNA, 20 nt, Human
aagagcagagguaggagaca

SEQ ID NO: 181254 - RNA, 24 nt, Human
aagcaaacaagcaauucuguaaaa

SEQ ID NO: 181255 - RNA, 24 nt, Human
aagcaagauuaacugggcacaugg

SEQ ID NO: 181256 - RNA, 22 nt, Human
acaagcaagagaccaaagccau

SEQ ID NO: 181257 - RNA, 19 nt, Human
acauaauccacaaaaccau

SEQ ID NO: 181258 - RNA, 19 nt, Human
accaucuaagaaccacuuc

SEQ ID NO: 181259 - RNA, 21 nt, Human
acccaaaagggucuugagggc

SEQ ID NO: 181260 - RNA, 21 nt, Human
accccucuaucccagccaaac

SEQ ID NO: 181261 - RNA, 20 nt, Human
agaaaaccacagcuggccug

SEQ ID NO: 181262 - RNA, 24 nt, Human
agaaacccaaaagggucuugaggg

SEQ ID NO: 181263 - RNA, 24 nt, Human
agcaaaacacacauaauccacaaa

SEQ ID NO: 181264 - RNA, 23 nt, Human
aggagacaguugaagcaaacaag

SEQ ID NO: 181265 - RNA, 23 nt, Human
aggcagguugguggguuaagguc

SEQ ID NO: 181266 - RNA, 18 nt, Human
aguaagaaccuuuucuuc

SEQ ID NO: 181267 - RNA, 23 nt, Human
aguggcguucgcgccucuccucu

SEQ ID NO: 181268 - RNA, 23 nt, Human
caaaacacacauaauccacaaaa

SEQ ID NO: 181269 - RNA, 21 nt, Human
caacacaagaaccagaaaaug

SEQ ID NO: 181270 - RNA, 18 nt, Human
caagagcagagguaggag

SEQ ID NO: 181271 - RNA, 23 nt, Human
caagagcagagguaggagacagu

SEQ ID NO: 181272 - RNA, 22 nt, Human
cacccuccuccccacuaaugca

SEQ ID NO: 181273 - RNA, 18 nt, Human
caccggagcuuucuggga

SEQ ID NO: 181274 - RNA, 24 nt, Human
cacuaaaaagcuucagugauaggg

SEQ ID NO: 181275 - RNA, 22 nt, Human
cagaaaauaaccccaauacccc

SEQ ID NO: 181276 - RNA, 22 nt, Human
cagccaacucuuaucucuaaac

SEQ ID NO: 181277 - RNA, 21 nt, Human
cagugauagggaaaaaaagga

SEQ ID NO: 181278 - RNA, 20 nt, Human
ccaaacaaagaaagcaagau

SEQ ID NO: 181279 - RNA, 18 nt, Human
ccaacacaagaaccagaa

SEQ ID NO: 181280 - RNA, 21 nt, Human
ccaagccaggcuagucccaca

SEQ ID NO: 181281 - RNA, 22 nt, Human
ccacaagcaagagaccaaagcc

SEQ ID NO: 181282 - RNA, 23 nt, Human
ccacagcuggccugccacagcca

SEQ ID NO: 181283 - RNA, 21 nt, Human
ccagccaaacaaagaaagcaa

SEQ ID NO: 181284 - RNA, 23 nt, Human
ccaucuaagaaccacuucccuug

SEQ ID NO: 181285 - RNA, 26 nt, Human
cccaaccccuaccuucucuccuaauu

SEQ ID NO: 181286 - RNA, 23 nt, Human
cccacaagcaagagaccaaagcc

SEQ ID NO: 181287 - RNA, 19 nt, Human
ccccaauacccccucuguc

SEQ ID NO: 181288 - RNA, 19 nt, Human
ccccacccuccuccccacu

SEQ ID NO: 181289 - RNA, 19 nt, Human
ccccuaccuucucuccuaa

SEQ ID NO: 181290 - RNA, 19 nt, Human
ccgaagcagcuggagcgcg

SEQ ID NO: 181291 - RNA, 19 nt, Human
ccuccaagagcagagguug

SEQ ID NO: 181292 - RNA, 19 nt, Human
ccucuuucucagacucuag

SEQ ID NO: 181293 - RNA, 19 nt, Human
ccuggaagaagaguccccc

SEQ ID NO: 181294 - RNA, 21 nt, Human
cgaacaggcagguuggugggu

SEQ ID NO: 181295 - RNA, 25 nt, Human
cggcccgggggguguccgaacaggg

SEQ ID NO: 181296 - RNA, 20 nt, Human
cgucaggucuuccccuuuca

SEQ ID NO: 181297 - RNA, 21 nt, Human
cuaagaaccacuucccuugcu

SEQ ID NO: 181298 - RNA, 20 nt, Human
cuccuaauucccacuuuuaa

SEQ ID NO: 181299 - RNA, 28 nt, Human
cucgagaucucuccccggagggcucuuc

SEQ ID NO: 181300 - RNA, 23 nt, Human
cucgagaucucuccccggaguuc

SEQ ID NO: 181301 - RNA, 18 nt, Human
cugcaaacgugcucuguc

SEQ ID NO: 181302 - RNA, 19 nt, Human
cugccacagccaacacaag

SEQ ID NO: 181303 - RNA, 21 nt, Human
cugccacagccaacacaagaa

SEQ ID NO: 181304 - RNA, 23 nt, Human
cuucauaauuuucauucguugcu

SEQ ID NO: 181305 - RNA, 19 nt, Human
gaagguguucccagccaca

SEQ ID NO: 181306 - RNA, 18 nt, Human
gaccaagcaguaagaacc

SEQ ID NO: 181307 - RNA, 22 nt, Human
gagcuuucugggagagggcgau

SEQ ID NO: 181308 - RNA, 22 nt, Human
gauucccaaccccuaccuucuc

SEQ ID NO: 181309 - RNA, 26 nt, Human
gcaccggagcuuucugggagagggcg

SEQ ID NO: 181310 - RNA, 19 nt, Human
gccacggagaucaagugac

SEQ ID NO: 181311 - RNA, 21 nt, Human
gcccuguccccaucuccucca

SEQ ID NO: 181312 - RNA, 18 nt, Human
gcuagucccacaagcaag

SEQ ID NO: 181313 - RNA, 20 nt, Human
gcuggagcgcgacccggagg

SEQ ID NO: 181314 - RNA, 22 nt, Human
ggagaggaggccgcaguacugc

SEQ ID NO: 181315 - RNA, 19 nt, Human
gggacagacagcggccggc

SEQ ID NO: 181316 - RNA, 24 nt, Human
gggcaguuacacaguuuguuuaca

SEQ ID NO: 181317 - RNA, 21 nt, Human
gggcauuuagucccaagccag

SEQ ID NO: 181318 - RNA, 22 nt, Human
gggggguguccgaacaggcagg

SEQ ID NO: 181319 - RNA, 20 nt, Human
ggggguguccgaacaggcag

SEQ ID NO: 181320 - RNA, 21 nt, Human
guaagaaccuuuucuucuuuc

SEQ ID NO: 181321 - RNA, 19 nt, Human
guggcguucgcgccucucc

SEQ ID NO: 181322 - RNA, 19 nt, Human
guuaggagaggagaggagg

SEQ ID NO: 181323 - RNA, 24 nt, Human
uaacaugcucaaguugaacagcca

SEQ ID NO: 181324 - RNA, 23 nt, Human
uaacuuuuuaagaaaaguuucca

SEQ ID NO: 181325 - RNA, 19 nt, Human
uaagaaaaguuuccaccac

SEQ ID NO: 181326 - RNA, 21 nt, Human
uaaggucuuaaucuugacucg

SEQ ID NO: 181327 - RNA, 22 nt, Human
uacaaaauuacaaguguuuuga

SEQ ID NO: 181328 - RNA, 22 nt, Human
uacacaguuuguuuacaaugag

SEQ ID NO: 181329 - RNA, 18 nt, Human
uaggaggggcucaacagc

SEQ ID NO: 181330 - RNA, 21 nt, Human
ucagcagucuuaacaaagaca

SEQ ID NO: 181331 - RNA, 23 nt, Human
ucaguaacaugcucaaguugaac

SEQ ID NO: 181332 - RNA, 20 nt, Human
ucccaagccaggcuaguccc

SEQ ID NO: 181333 - RNA, 20 nt, Human
ucccagaucaccaucuaaga

SEQ ID NO: 181334 - RNA, 22 nt, Human
ucccagccacagaaagucaagc

SEQ ID NO: 181335 - RNA, 20 nt, Human
uccccacccuccuccccacu

SEQ ID NO: 181336 - RNA, 21 nt, Human
ucccuugcucucuacucaaaa

SEQ ID NO: 181337 - RNA, 26 nt, Human
ucuacucaaaaugagaugcuuuauuu

SEQ ID NO: 181338 - RNA, 19 nt, Human
ucuccagagggugggcagg

SEQ ID NO: 181339 - RNA, 18 nt, Human
ucuccccacccuccuccc

SEQ ID NO: 181340 - RNA, 19 nt, Human
ucuccccacccuccucccc

SEQ ID NO: 181341 - RNA, 20 nt, Human
ucuccccacccuccucccca

SEQ ID NO: 181342 - RNA, 19 nt, Human
ugacucgagaucucucccc

SEQ ID NO: 181343 - RNA, 26 nt, Human
ugaguuacaaucgggacaacugggag

SEQ ID NO: 181344 - RNA, 18 nt, Human
ugauagggaaaaaaagga

SEQ ID NO: 181345 - RNA, 23 nt, Human
ugauucccaaccccuaccuucuc

SEQ ID NO: 181346 - RNA, 20 nt, Human
uggaagaagagucccccuuc

SEQ ID NO: 181347 - RNA, 20 nt, Human
ugggagagggggaagaguug

SEQ ID NO: 181348 - RNA, 23 nt, Human
ugggcagggcagaaacccaaaag

SEQ ID NO: 181349 - RNA, 21 nt, Human
ugucuccccacccuccucccc

SEQ ID NO: 181350 - RNA, 23 nt, Human
uucagcuaccuggaagaagaguc

SEQ ID NO: 181351 - RNA, 21 nt, Human
uuuauuucuaauccgacuauu

SEQ ID NO: 181352 - RNA, 24 nt, Human
uuucagcuaccuggaagaagaguc

SEQ ID NO: 181353 - RNA, 19 nt, Human
uuuuauguuaggcugauuu

SEQ ID NO: 181354 - RNA, 23 nt, Human
uuuuuuuuuuuuuuuauguuagg

SEQ ID NO: 181355 - RNA, 22 nt, Human
aaaaaaaaaaagagugaaagag

SEQ ID NO: 181356 - RNA, 22 nt, Human
aaaaaaaagcgaaaaaucgaaa

SEQ ID NO: 181357 - RNA, 24 nt, Human
aaaaagcgaaaaaucgaaaucaag

SEQ ID NO: 181358 - RNA, 20 nt, Human
aaagcagcugcuggugaggc

SEQ ID NO: 181359 - RNA, 22 nt, Human
aaauacuuuugccccuucauug

SEQ ID NO: 181360 - RNA, 19 nt, Human
aacauggugaaaccccauc

SEQ ID NO: 181361 - RNA, 20 nt, Human
aacauggugaaaccccaucu

SEQ ID NO: 181362 - RNA, 20 nt, Human
aacauggugaaaccccaucu

SEQ ID NO: 181363 - RNA, 21 nt, Human
aacauggugaaaccccaucuc

SEQ ID NO: 181364 - RNA, 24 nt, Human
aagcagcugcuggugaggcucuuu

SEQ ID NO: 181365 - RNA, 24 nt, Human
aagccuggaagcaacauguuucuc

SEQ ID NO: 181366 - RNA, 25 nt, Human
aagcgaaaaaucgaaaucaagccug

SEQ ID NO: 181367 - RNA, 20 nt, Human
aauugcuugaacccaggagg

SEQ ID NO: 181368 - RNA, 24 nt, Human
aauugcuugaacccaggaggcgga

SEQ ID NO: 181369 - RNA, 23 nt, Human
acaaaaaaaaaaagagugaaaga

SEQ ID NO: 181370 - RNA, 20 nt, Human
acaaaacagaggaaaaggga

SEQ ID NO: 181371 - RNA, 24 nt, Human
acaaagugagauucugucucaaaa

SEQ ID NO: 181372 - RNA, 22 nt, Human
acagagcacuccuaauaucucc

SEQ ID NO: 181373 - RNA, 23 nt, Human
acagagcacuccuaauaucuccc

SEQ ID NO: 181374 - RNA, 24 nt, Human
acagaggaaaagggaccuuccuca

SEQ ID NO: 181375 - RNA, 18 nt, Human
acaggaguugucuuaaga

SEQ ID NO: 181376 - RNA, 24 nt, Human
acccaggaggcggagguugcagug

SEQ ID NO: 181377 - RNA, 18 nt, Human
accccaucucuacuaaaa

SEQ ID NO: 181378 - RNA, 23 nt, Human
accggacacuauggcuuuggccc

SEQ ID NO: 181379 - RNA, 28 nt, Human
accuuccucacaccgcuccauucugcug

SEQ ID NO: 181380 - RNA, 20 nt, Human
acucugucaccaggcuggag

SEQ ID NO: 181381 - RNA, 19 nt, Human
acugcacuccagccuggug

SEQ ID NO: 181382 - RNA, 20 nt, Human
agaaaggaaauaaaaauuag

SEQ ID NO: 181383 - RNA, 27 nt, Human
agaaaggaaauaaaaauuaggggaccc

SEQ ID NO: 181384 - RNA, 23 nt, Human
agaacucagggcugguguguguu

SEQ ID NO: 181385 - RNA, 22 nt, Human
agaauugcuugaacccaggagg

SEQ ID NO: 181386 - RNA, 22 nt, Human
agagagagagucauaaagauuc

SEQ ID NO: 181387 - RNA, 22 nt, Human
agaggaaaagggaccuuccuca

SEQ ID NO: 181388 - RNA, 22 nt, Human
agaggacaaggcaugcacgguc

SEQ ID NO: 181389 - RNA, 19 nt, Human
agauucuucagguccuaaa

SEQ ID NO: 181390 - RNA, 22 nt, Human
agccgggcgugguggcagggcc

SEQ ID NO: 181391 - RNA, 18 nt, Human
agccuggugacaaaguga

SEQ ID NO: 181392 - RNA, 23 nt, Human
agcuacuugggaggcugaggcag

SEQ ID NO: 181393 - RNA, 18 nt, Human
aggacuccaagacugagg

SEQ ID NO: 181394 - RNA, 23 nt, Human
aggcaggagaauugcuugaaccc

SEQ ID NO: 181395 - RNA, 24 nt, Human
aggcaggagaauugcuugaaccca

SEQ ID NO: 181396 - RNA, 24 nt, Human
aggcaugcacggucugagaucaga

SEQ ID NO: 181397 - RNA, 21 nt, Human
aggccaagguggacggaucac

SEQ ID NO: 181398 - RNA, 19 nt, Human
aggcggagguugcagugag

SEQ ID NO: 181399 - RNA, 24 nt, Human
aggcggagguugcagugaggugag

SEQ ID NO: 181400 - RNA, 21 nt, Human
aggcugaggcaggagaauugc

SEQ ID NO: 181401 - RNA, 24 nt, Human
aggcugaggcaggagaauugcuug

SEQ ID NO: 181402 - RNA, 24 nt, Human
agguggacggaucacgaggucaag

SEQ ID NO: 181403 - RNA, 23 nt, Human
agucacagaaguuaagggaggaa

SEQ ID NO: 181404 - RNA, 24 nt, Human
agugacaaaaaaaaaaagagugaa

SEQ ID NO: 181405 - RNA, 23 nt, Human
aguggcucaugccuguaauccag

SEQ ID NO: 181406 - RNA, 24 nt, Human
auaaagauucuucagguccuaaaa

SEQ ID NO: 181407 - RNA, 21 nt, Human
auccuggccaacauggugaaa

SEQ ID NO: 181408 - RNA, 23 nt, Human
aucuuuaaucaaaaaggaaaaau

SEQ ID NO: 181409 - RNA, 21 nt, Human
auggugccacaggaguugucu

SEQ ID NO: 181410 - RNA, 24 nt, Human
auugcaccacugcacuccagccug

SEQ ID NO: 181411 - RNA, 27 nt, Human
caacagagcacuccuaauaucuccccc

SEQ ID NO: 181412 - RNA, 24 nt, Human
caacauggugaaaccccaucucua

SEQ ID NO: 181413 - RNA, 26 nt, Human
caagguggacggaucacgaggucaag

SEQ ID NO: 181414 - RNA, 18 nt, Human
cacacacccuaccucucc

SEQ ID NO: 181415 - RNA, 25 nt, Human
caccacugcacuccagccuggugac

SEQ ID NO: 181416 - RNA, 22 nt, Human
cacccuaccucuccaggauaca

SEQ ID NO: 181417 - RNA, 26 nt, Human
cacccucucuuccuuggaccccugcu

SEQ ID NO: 181418 - RNA, 19 nt, Human
cacuauggcuuuggcccug

SEQ ID NO: 181419 - RNA, 21 nt, Human
cacuccagccuggugacaaag

SEQ ID NO: 181420 - RNA, 20 nt, Human
cacuccuaauaucuccccca

SEQ ID NO: 181421 - RNA, 18 nt, Human
cacugcacuccagccugg

SEQ ID NO: 181422 - RNA, 18 nt, Human
cacugcacuccagccugg

SEQ ID NO: 181423 - RNA, 22 nt, Human
cacugcacuccagccuggugac

SEQ ID NO: 181424 - RNA, 23 nt, Human
cacugcacuccagccuggugaca

SEQ ID NO: 181425 - RNA, 25 nt, Human
cacugcacuccagccuggugacaaa

SEQ ID NO: 181426 - RNA, 28 nt, Human
cagccuaaaauguaagugguacaaaaug

SEQ ID NO: 181427 - RNA, 24 nt, Human
cagcgcuuugcaaggccaaggugg

SEQ ID NO: 181428 - RNA, 18 nt, Human
cagugaggugagauugca

SEQ ID NO: 181429 - RNA, 19 nt, Human
cauaccucuccuagcacug

SEQ ID NO: 181430 - RNA, 23 nt, Human
caugccuguaauccagcgcuuug

SEQ ID NO: 181431 - RNA, 18 nt, Human
ccaagggauuccuccccc

SEQ ID NO: 181432 - RNA, 25 nt, Human
ccaagguggacggaucacgagguca

SEQ ID NO: 181433 - RNA, 23 nt, Human
ccacacacccuaccucuccagga

SEQ ID NO: 181434 - RNA, 19 nt, Human
ccacugcacuccagccugg

SEQ ID NO: 181435 - RNA, 19 nt, Human
ccacugcacuccagccugg

SEQ ID NO: 181436 - RNA, 19 nt, Human
ccacugcacuccagccugg

SEQ ID NO: 181437 - RNA, 23 nt, Human
ccacugcacuccagccuggugac

SEQ ID NO: 181438 - RNA, 24 nt, Human
ccacugcacuccagccuggugaca

SEQ ID NO: 181439 - RNA, 21 nt, Human
cccacacacccuaccucucca

SEQ ID NO: 181440 - RNA, 18 nt, Human
ccccaagggauuccuccc

SEQ ID NO: 181441 - RNA, 19 nt, Human
ccccaagggauuccucccc

SEQ ID NO: 181442 - RNA, 21 nt, Human
ccccacacacccuaccucucc

SEQ ID NO: 181443 - RNA, 21 nt, Human
cccccaagggauuccuccccc

SEQ ID NO: 181444 - RNA, 19 nt, Human
cccugggcuaucaagaacu

SEQ ID NO: 181445 - RNA, 18 nt, Human
ccgcuccauucugcugug

SEQ ID NO: 181446 - RNA, 22 nt, Human
ccuggccaacauggugaaaccc

SEQ ID NO: 181447 - RNA, 23 nt, Human
ccuggccaacauggugaaacccc

SEQ ID NO: 181448 - RNA, 24 nt, Human
ccuggccaacauggugaaacccca

SEQ ID NO: 181449 - RNA, 22 nt, Human
ccuguaguccaagcuacuuggg

SEQ ID NO: 181450 - RNA, 24 nt, Human
cgagaccauccuggccaacauggu

SEQ ID NO: 181451 - RNA, 22 nt, Human
cggcuggguguaguggcucaug

SEQ ID NO: 181452 - RNA, 18 nt, Human
cuaaaacacucugguucc

SEQ ID NO: 181453 - RNA, 25 nt, Human
cuaccucuccaggauacacugcacc

SEQ ID NO: 181454 - RNA, 22 nt, Human
cucaaaaaaaaaaaaaagcgaa

SEQ ID NO: 181455 - RNA, 25 nt, Human
cucaaaaaaaaaaaaaagcgaaaaa

SEQ ID NO: 181456 - RNA, 23 nt, Human
cucacucugucaccaggcuggag

SEQ ID NO: 181457 - RNA, 23 nt, Human
cucaugccuguaauccagcgcuu

SEQ ID NO: 181458 - RNA, 20 nt, Human
cuccaaaagcagcugcuggu

SEQ ID NO: 181459 - RNA, 24 nt, Human
cucccccacacacccuaccucucc

SEQ ID NO: 181460 - RNA, 18 nt, Human
cucugguucccauuccuu

SEQ ID NO: 181461 - RNA, 23 nt, Human
cuggccaacauggugaaacccca

SEQ ID NO: 181462 - RNA, 20 nt, Human
cuuggcaaacacaaaacaga

SEQ ID NO: 181463 - RNA, 20 nt, Human
cuuuuuuuuuugagacagag

SEQ ID NO: 181464 - RNA, 21 nt, Human
gaaauaaaaauuagucacaga

SEQ ID NO: 181465 - RNA, 18 nt, Human
gaacucagggcuggugug

SEQ ID NO: 181466 - RNA, 24 nt, Human
gacaaagugagauucugucucaaa

SEQ ID NO: 181467 - RNA, 21 nt, Human
gacacuauggcuuuggcccug

SEQ ID NO: 181468 - RNA, 24 nt, Human
gacagagucucacucugucaccag

SEQ ID NO: 181469 - RNA, 20 nt, Human
gacucacuguagaaagggga

SEQ ID NO: 181470 - RNA, 23 nt, Human
gagauugcaccacugcacuccag

SEQ ID NO: 181471 - RNA, 19 nt, Human
gaggcucuuuagagagaau

SEQ ID NO: 181472 - RNA, 21 nt, Human
gaggcucuuucccaucugccu

SEQ ID NO: 181473 - RNA, 23 nt, Human
gagguugcagugaggugagauug

SEQ ID NO: 181474 - RNA, 18 nt, Human
gcacggucugagaucaga

SEQ ID NO: 181475 - RNA, 22 nt, Human
gcagccuugugauccccacagc

SEQ ID NO: 181476 - RNA, 22 nt, Human
gcaggagaauugcuugaaccca

SEQ ID NO: 181477 - RNA, 24 nt, Human
gccaacauggugaaaccccaucuc

SEQ ID NO: 181478 - RNA, 23 nt, Human
gccacccucucuuccuuggaccc

SEQ ID NO: 181479 - RNA, 20 nt, Human
gcccugggcuaucaagaacu

SEQ ID NO: 181480 - RNA, 18 nt, Human
gcugcucauaccucuccu

SEQ ID NO: 181481 - RNA, 24 nt, Human
ggacacuauggcuuuggcccugug

SEQ ID NO: 181482 - RNA, 19 nt, Human
ggacggaucacgaggucaa

SEQ ID NO: 181483 - RNA, 18 nt, Human
ggagguugcagugaggug

SEQ ID NO: 181484 - RNA, 22 nt, Human
ggagguugcagugaggugagau

SEQ ID NO: 181485 - RNA, 24 nt, Human
ggagguugcagugaggugagauug

SEQ ID NO: 181486 - RNA, 24 nt, Human
ggccuguaguccaagcuacuuggg

SEQ ID NO: 181487 - RNA, 19 nt, Human
ggcuggguguaguggcuca

SEQ ID NO: 181488 - RNA, 21 nt, Human
ggcuggguguaguggcucaug

SEQ ID NO: 181489 - RNA, 23 nt, Human
ggcuggguguaguggcucaugcc

SEQ ID NO: 181490 - RNA, 22 nt, Human
gggacacaucacacugcacagc

SEQ ID NO: 181491 - RNA, 23 nt, Human
gguguaguggcucaugccuguaa

SEQ ID NO: 181492 - RNA, 19 nt, Human
guacaaaaugauuuucagu

SEQ ID NO: 181493 - RNA, 21 nt, Human
guccuugccacccuuaauuau

SEQ ID NO: 181494 - RNA, 20 nt, Human
gucucaaaaaaaaaaaaaag

SEQ ID NO: 181495 - RNA, 24 nt, Human
gugacaaagugagauucugucuca

SEQ ID NO: 181496 - RNA, 21 nt, Human
uaaaugccuuccaguauuggu

SEQ ID NO: 181497 - RNA, 21 nt, Human
uaacagggggccggaggagaa

SEQ ID NO: 181498 - RNA, 18 nt, Human
uagugacaaaaaaaaaaa

SEQ ID NO: 181499 - RNA, 22 nt, Human
uaguggcucaugccuguaaucc

SEQ ID NO: 181500 - RNA, 21 nt, Human
uaucucccccaagggauuccu

SEQ ID NO: 181501 - RNA, 23 nt, Human
ucaaaaaaaaaaaaaagcgaaaa

SEQ ID NO: 181502 - RNA, 18 nt, Human
ucaaaugagcccagaacu

SEQ ID NO: 181503 - RNA, 23 nt, Human
ucacaccgcuccauucugcugug

SEQ ID NO: 181504 - RNA, 24 nt, Human
ucacgaggucaagagaucgagacc

SEQ ID NO: 181505 - RNA, 23 nt, Human
ucagagguugugacguggccacc

SEQ ID NO: 181506 - RNA, 19 nt, Human
ucagcccagcagacgcccu

SEQ ID NO: 181507 - RNA, 22 nt, Human
uccagccuggugacaaagugag

SEQ ID NO: 181508 - RNA, 20 nt, Human
ucccccaagggauuccuccc

SEQ ID NO: 181509 - RNA, 21 nt, Human
uccuuggaccccugcuccaaa

SEQ ID NO: 181510 - RNA, 21 nt, Human
ucucacucugucaccaggcug

SEQ ID NO: 181511 - RNA, 23 nt, Human
ucucacucugucaccaggcugga

SEQ ID NO: 181512 - RNA, 21 nt, Human
ucucuacuaaaaauacacaaa

SEQ ID NO: 181513 - RNA, 22 nt, Human
ucugucucaaaaaaaaaaaaaa

SEQ ID NO: 181514 - RNA, 23 nt, Human
ucugucucaaaaaaaaaaaaaag

SEQ ID NO: 181515 - RNA, 19 nt, Human
ugaaaccccaucucuacua

SEQ ID NO: 181516 - RNA, 18 nt, Human
ugaaagagagagagucau

SEQ ID NO: 181517 - RNA, 20 nt, Human
ugacguggccacccaugagc

SEQ ID NO: 181518 - RNA, 18 nt, Human
ugagacagagucucacuc

SEQ ID NO: 181519 - RNA, 22 nt, Human
ugagacagagucucacucuguc

SEQ ID NO: 181520 - RNA, 22 nt, Human
ugagcccagaacucagggcugg

SEQ ID NO: 181521 - RNA, 24 nt, Human
ugaggcaggagaauugcuugaacc

SEQ ID NO: 181522 - RNA, 25 nt, Human
ugaggcaggagaauugcuugaaccc

SEQ ID NO: 181523 - RNA, 23 nt, Human
ugaggcaggcagccuugugaucc

SEQ ID NO: 181524 - RNA, 21 nt, Human
ugcaccacugcacuccagccu

SEQ ID NO: 181525 - RNA, 24 nt, Human
ugccacaggaguugucuuaagagg

SEQ ID NO: 181526 - RNA, 22 nt, Human
uggaccccugcuccaaaagcag

SEQ ID NO: 181527 - RNA, 24 nt, Human
uggcaaacacaaaacagaggaaaa

SEQ ID NO: 181528 - RNA, 24 nt, Human
uggccaacauggugaaaccccauc

SEQ ID NO: 181529 - RNA, 19 nt, Human
uggcucaugccuguaaucc

SEQ ID NO: 181530 - RNA, 22 nt, Human
uggcucaugccuguaauccagc

SEQ ID NO: 181531 - RNA, 23 nt, Human
uggcucaugccuguaauccagcg

SEQ ID NO: 181532 - RNA, 19 nt, Human
ugggaggcugaggcaggag

SEQ ID NO: 181533 - RNA, 22 nt, Human
ugggaggcugaggcaggagaau

SEQ ID NO: 181534 - RNA, 24 nt, Human
uuaaaggggggcagagagugggag

SEQ ID NO: 181535 - RNA, 18 nt, Human
uuagccgggcgugguggc

SEQ ID NO: 181536 - RNA, 20 nt, Human
uuagugacaaaaaaaaaaag

SEQ ID NO: 181537 - RNA, 24 nt, Human
uugaacccaggaggcggagguugc

SEQ ID NO: 181538 - RNA, 23 nt, Human
uugcaccacugcacuccagccug

SEQ ID NO: 181539 - RNA, 22 nt, Human
uugcagugaggugagauugcac

SEQ ID NO: 181540 - RNA, 25 nt, Human
uugccacccuuaauuauauuuccag

SEQ ID NO: 181541 - RNA, 24 nt, Human
uugcuugaacccaggaggcggagg

SEQ ID NO: 181542 - RNA, 24 nt, Human
uugggacacaucacacugcacagc

SEQ ID NO: 181543 - RNA, 23 nt, Human
uugggaggcugaggcaggagaau

SEQ ID NO: 181544 - RNA, 22 nt, Human
uuucccaucugccucauucacc

SEQ ID NO: 181545 - RNA, 21 nt, Human
aacgcaaagcgacccaaaccc

SEQ ID NO: 181546 - RNA, 23 nt, Human
agcggcagcaggggccgcagggg

SEQ ID NO: 181547 - RNA, 22 nt, Human
caaacgcaaagcgacccaaacc

SEQ ID NO: 181548 - RNA, 22 nt, Human
caccggagacucugcggggauu

SEQ ID NO: 181549 - RNA, 22 nt, Human
cagcgcagcggcagcaggggcc

SEQ ID NO: 181550 - RNA, 22 nt, Human
ccccauccccgcagcgcgucug

SEQ ID NO: 181551 - RNA, 20 nt, Human
ccccgcagcgcgucugcacc

SEQ ID NO: 181552 - RNA, 22 nt, Human
cggccgggacagcgcagcggca

SEQ ID NO: 181553 - RNA, 26 nt, Human
cggcggcagggcggagcgcggcagag

SEQ ID NO: 181554 - RNA, 25 nt, Human
cugcuacaaaccucggcggggcggc

SEQ ID NO: 181555 - RNA, 18 nt, Human
gccgggacagcgcagcgg

SEQ ID NO: 181556 - RNA, 20 nt, Human
gcggagcgcggcagagggca

SEQ ID NO: 181557 - RNA, 22 nt, Human
gcggcagcaggggccgcagggg

SEQ ID NO: 181558 - RNA, 19 nt, Human
ggccgggacagcgcagcgg

SEQ ID NO: 181559 - RNA, 20 nt, Human
ggcgugcggucggcggcagg

SEQ ID NO: 181560 - RNA, 19 nt, Human
ggggauuguagccggaggg

SEQ ID NO: 181561 - RNA, 19 nt, Human
ucccggcugcuacaaaccu

SEQ ID NO: 181562 - RNA, 22 nt, Human
ucggcggggcggccccgcucuu

SEQ ID NO: 181563 - RNA, 21 nt, Human
ucugcaccggagacucugcgg

SEQ ID NO: 181564 - RNA, 20 nt, Human
ugcggccgggacagcgcagc

SEQ ID NO: 181565 - RNA, 21 nt, Human
uucaaguaaagugaaugugau

SEQ ID NO: 181566 - RNA, 19 nt, Human
aggaauucaguccccagcc

SEQ ID NO: 181567 - RNA, 25 nt, Human
aggcguggggaccggggcuguaggg

SEQ ID NO: 181568 - RNA, 20 nt, Human
auuuaaagucuugguuguuc

SEQ ID NO: 181569 - RNA, 21 nt, Human
ccacaggccucuucuuuucuu

SEQ ID NO: 181570 - RNA, 22 nt, Human
cuagggguuccaaguccccagu

SEQ ID NO: 181571 - RNA, 22 nt, Human
ggccucuucuuuucuuaguucc

SEQ ID NO: 181572 - RNA, 22 nt, Human
gggaccggggcuguaggggggc

SEQ ID NO: 181573 - RNA, 22 nt, Human
uccccagucaccuugaggacuc

SEQ ID NO: 181574 - RNA, 22 nt, Human
ucuugguuguucagguccuagg

SEQ ID NO: 181575 - RNA, 20 nt, Human
ugcaguaggaggaagguuuc

SEQ ID NO: 181576 - RNA, 18 nt, Human
ugucuucuaggcgugggg

SEQ ID NO: 181577 - RNA, 19 nt, Human
uuccaaguccccagucacc

SEQ ID NO: 181578 - RNA, 18 nt, Human
aaaugggccaccuagagg

SEQ ID NO: 181579 - RNA, 20 nt, Human
aacaggugaagauggucaga

SEQ ID NO: 181580 - RNA, 18 nt, Human
accuagaggagcagugga

SEQ ID NO: 181581 - RNA, 28 nt, Human
agggaauaauggagagcaaccgguaccc

SEQ ID NO: 181582 - RNA, 22 nt, Human
cagacccuccaagguggggucc

SEQ ID NO: 181583 - RNA, 19 nt, Human
ccgccgccuccagccauuu

SEQ ID NO: 181584 - RNA, 19 nt, Human
ccuccagccauuugagccu

SEQ ID NO: 181585 - RNA, 21 nt, Human
ccuggaccugugccccucgga

SEQ ID NO: 181586 - RNA, 23 nt, Human
gagccuggaccugugccccucgg

SEQ ID NO: 181587 - RNA, 22 nt, Human
gcaggagccuggaccugugccc

SEQ ID NO: 181588 - RNA, 21 nt, Human
gcgugcccgccgccuccagcc

SEQ ID NO: 181589 - RNA, 19 nt, Human
ggcuuagaagggaauaaug

SEQ ID NO: 181590 - RNA, 19 nt, Human
uaaaugggccaccuagagg

SEQ ID NO: 181591 - RNA, 21 nt, Human
uaauggagagcaacauuucuc

SEQ ID NO: 181592 - RNA, 22 nt, Human
uacaacaaaccauaaaugggcc

SEQ ID NO: 181593 - RNA, 22 nt, Human
ucucugcggaacaggugaagau

SEQ ID NO: 181594 - RNA, 19 nt, Human
ugugcgugcccgccgccuc

SEQ ID NO: 181595 - RNA, 23 nt, Human
aaaaaagaaagaaaaacaaagaa

SEQ ID NO: 181596 - RNA, 19 nt, Human
aaagaaaaacaaagaaagg

SEQ ID NO: 181597 - RNA, 22 nt, Human
aaagaaagaaaaacaaagaaag

SEQ ID NO: 181598 - RNA, 19 nt, Human
aagaaagaaaaacaaagaa

SEQ ID NO: 181599 - RNA, 22 nt, Human
aagcagguuuggacgcuuccac

SEQ ID NO: 181600 - RNA, 22 nt, Human
agaaaaacaaagaaagggagag

SEQ ID NO: 181601 - RNA, 22 nt, Human
agaaagggagagagaaagagaa

SEQ ID NO: 181602 - RNA, 18 nt, Human
agaaggcaggcgggagag

SEQ ID NO: 181603 - RNA, 19 nt, Human
agacagaagagaggacaca

SEQ ID NO: 181604 - RNA, 19 nt, Human
agacgcugcuuugucccca

SEQ ID NO: 181605 - RNA, 19 nt, Human
agagaaagagaaaaagaga

SEQ ID NO: 181606 - RNA, 24 nt, Human
agagaaagagaaaaagagaaaggu

SEQ ID NO: 181607 - RNA, 20 nt, Human
aggagacagaagagaggaca

SEQ ID NO: 181608 - RNA, 20 nt, Human
cagcggcuccuggcugcggc

SEQ ID NO: 181609 - RNA, 22 nt, Human
cagcggcuccuggcugcggcgg

SEQ ID NO: 181610 - RNA, 22 nt, Human
ccccgaagccuccaggcagcag

SEQ ID NO: 181611 - RNA, 18 nt, Human
ccgaagccuccaggcagc

SEQ ID NO: 181612 - RNA, 23 nt, Human
cgaagccuccaggcagcaggaga

SEQ ID NO: 181613 - RNA, 20 nt, Human
cuggcugcggcggcggcgac

SEQ ID NO: 181614 - RNA, 23 nt, Human
gaacagacuuggggggagauggg

SEQ ID NO: 181615 - RNA, 19 nt, Human
gagaaagagaaaaagagaa

SEQ ID NO: 181616 - RNA, 24 nt, Human
gagcagccagaagcucugacggaa

SEQ ID NO: 181617 - RNA, 18 nt, Human
gcagcggcuccuggcugc

SEQ ID NO: 181618 - RNA, 18 nt, Human
gccccgaagccuccaggc

SEQ ID NO: 181619 - RNA, 22 nt, Human
gccccgaagccuccaggcagca

SEQ ID NO: 181620 - RNA, 20 nt, Human
gcgggagagccccgaagccu

SEQ ID NO: 181621 - RNA, 20 nt, Human
ggcgccugcgcggggcggcg

SEQ ID NO: 181622 - RNA, 18 nt, Human
ggcgggggcgccugcgcg

SEQ ID NO: 181623 - RNA, 18 nt, Human
uaaaaaagaaagaaaaac

SEQ ID NO: 181624 - RNA, 21 nt, Human
ucugggccccgagaaggcagg

SEQ ID NO: 181625 - RNA, 24 nt, Human
ucuucuuuuaaaaaagaaagaaaa

SEQ ID NO: 181626 - RNA, 19 nt, Human
ugcgcggggcggcgcgggg

SEQ ID NO: 181627 - RNA, 20 nt, Human
uggacgcuuccacucgagcc

SEQ ID NO: 181628 - RNA, 25 nt, Human
uggcccaaucggugccuugcgucug

SEQ ID NO: 181629 - RNA, 19 nt, Human
uggcugcggcggcggcgac

SEQ ID NO: 181630 - RNA, 18 nt, Human
ugggaaaagcagguuugg

SEQ ID NO: 181631 - RNA, 19 nt, Human
ccggaagggucggcgccgc

SEQ ID NO: 181632 - RNA, 24 nt, Human
cggcggugacggcgacaguacgag

SEQ ID NO: 181633 - RNA, 21 nt, Human
gggccggagccgcggcgguga

SEQ ID NO: 181634 - RNA, 21 nt, Human
ggugacggcgacaguacgaga

SEQ ID NO: 181635 - RNA, 21 nt, Human
gucggcgccgcgggcugaggu

SEQ ID NO: 181636 - RNA, 24 nt, Human
aaaaaaaaaucuccucccgcggca

SEQ ID NO: 181637 - RNA, 23 nt, Human
aaaaacacacaccccacaugccc

SEQ ID NO: 181638 - RNA, 22 nt, Human
aaaaagccaccuccccaaacac

SEQ ID NO: 181639 - RNA, 23 nt, Human
aaaacacacaccccacaugccca

SEQ ID NO: 181640 - RNA, 19 nt, Human
aaacacacaccccacaugc

SEQ ID NO: 181641 - RNA, 23 nt, Human
aaacacaguccccucguucccca

SEQ ID NO: 181642 - RNA, 24 nt, Human
aaacacaguccccucguuccccac

SEQ ID NO: 181643 - RNA, 21 nt, Human
aagaagcgggcaggagaaaga

SEQ ID NO: 181644 - RNA, 22 nt, Human
aagguaaaaacacacaccccac

SEQ ID NO: 181645 - RNA, 22 nt, Human
aaucuccucccgcggcagagcc

SEQ ID NO: 181646 - RNA, 19 nt, Human
acaaaacagaaacgccccc

SEQ ID NO: 181647 - RNA, 20 nt, Human
acaucacaaagcggaacaaa

SEQ ID NO: 181648 - RNA, 22 nt, Human
accacugccugggacucuccug

SEQ ID NO: 181649 - RNA, 23 nt, Human
accugagaauauucuguaaaagu

SEQ ID NO: 181650 - RNA, 24 nt, Human
acgucccucucucugccucucggg

SEQ ID NO: 181651 - RNA, 26 nt, Human
acuuagccccgcagcgccccggccgg

SEQ ID NO: 181652 - RNA, 24 nt, Human
agaaaaaagcgagccauaagucaa

SEQ ID NO: 181653 - RNA, 20 nt, Human
agagaagcccccguggcucc

SEQ ID NO: 181654 - RNA, 23 nt, Human
agagauguacauccccugauaac

SEQ ID NO: 181655 - RNA, 20 nt, Human
agccacagggggcugcggug

SEQ ID NO: 181656 - RNA, 20 nt, Human
agccagggcaggguggccgu

SEQ ID NO: 181657 - RNA, 25 nt, Human
agccaguguuggccccggaggcaca

SEQ ID NO: 181658 - RNA, 24 nt, Human
agcccggggacccuucccagccuc

SEQ ID NO: 181659 - RNA, 24 nt, Human
agcgagccauaagucaaggccaga

SEQ ID NO: 181660 - RNA, 22 nt, Human
aggcaccccugcccugggccug

SEQ ID NO: 181661 - RNA, 22 nt, Human
aggccuggaagcugcccaggcc

SEQ ID NO: 181662 - RNA, 20 nt, Human
aggcggggcgggccggcccg

SEQ ID NO: 181663 - RNA, 21 nt, Human
agggggcugcggugugggggc

SEQ ID NO: 181664 - RNA, 19 nt, Human
aguccccacccacccucgc

SEQ ID NO: 181665 - RNA, 20 nt, Human
aguccccucguuccccaccu

SEQ ID NO: 181666 - RNA, 23 nt, Human
auccaaguggccuuucucccagu

SEQ ID NO: 181667 - RNA, 22 nt, Human
aucccgucucccugggccuggg

SEQ ID NO: 181668 - RNA, 18 nt, Human
caaaacagaaacgccccc

SEQ ID NO: 181669 - RNA, 22 nt, Human
caaaacagaaacgcccccaucc

SEQ ID NO: 181670 - RNA, 22 nt, Human
caaagcggaacaaaacagaaac

SEQ ID NO: 181671 - RNA, 25 nt, Human
cacacaccccacaugccccccugag

SEQ ID NO: 181672 - RNA, 20 nt, Human
caccaagguaaaaacacaca

SEQ ID NO: 181673 - RNA, 25 nt, Human
caccaccuuccacgcgccccuggcc

SEQ ID NO: 181674 - RNA, 21 nt, Human
cacccacccucgcuguuucca

SEQ ID NO: 181675 - RNA, 25 nt, Human
caccccacaugcccacguggcccca

SEQ ID NO: 181676 - RNA, 19 nt, Human
cacccccucuucaggaguc

SEQ ID NO: 181677 - RNA, 20 nt, Human
cacccccucuucaggaguca

SEQ ID NO: 181678 - RNA, 21 nt, Human
caccuugugcaaucuaggccc

SEQ ID NO: 181679 - RNA, 19 nt, Human
cacgcgccccuggccaaag

SEQ ID NO: 181680 - RNA, 20 nt, Human
cacgugggcuccgguggggu

SEQ ID NO: 181681 - RNA, 20 nt, Human
cagcgccccggccugcgugc

SEQ ID NO: 181682 - RNA, 22 nt, Human
caggaucugcugccaccacugg

SEQ ID NO: 181683 - RNA, 18 nt, Human
caggccuggaagcugccc

SEQ ID NO: 181684 - RNA, 21 nt, Human
cagucaacagcagacgaaaga

SEQ ID NO: 181685 - RNA, 20 nt, Human
caugcccacguggccccaca

SEQ ID NO: 181686 - RNA, 25 nt, Human
ccacccacccucgcuguuuccaaau

SEQ ID NO: 181687 - RNA, 19 nt, Human
ccaccuccccaaacacagu

SEQ ID NO: 181688 - RNA, 21 nt, Human
ccaccuccccaaacacagucc

SEQ ID NO: 181689 - RNA, 21 nt, Human
ccagagucacugggggcacgg

SEQ ID NO: 181690 - RNA, 18 nt, Human
cccacacguggcaagggu

SEQ ID NO: 181691 - RNA, 24 nt, Human
cccacacguggcaagggugggggu

SEQ ID NO: 181692 - RNA, 22 nt, Human
cccacaugcccacguggcccca

SEQ ID NO: 181693 - RNA, 23 nt, Human
cccacccccucuucaggagucca

SEQ ID NO: 181694 - RNA, 20 nt, Human
cccagggugggcgaccgagg

SEQ ID NO: 181695 - RNA, 23 nt, Human
ccccaagcagccaguguuggccc

SEQ ID NO: 181696 - RNA, 24 nt, Human
ccccaagcagccaguguuggcccc

SEQ ID NO: 181697 - RNA, 25 nt, Human
ccccacacguggcaagggugggggu

SEQ ID NO: 181698 - RNA, 24 nt, Human
ccccacccacccucgcuguuucca

SEQ ID NO: 181699 - RNA, 24 nt, Human
cccccacccccucuucaggagucc

SEQ ID NO: 181700 - RNA, 18 nt, Human
ccccccggcccccggccc

SEQ ID NO: 181701 - RNA, 22 nt, Human
cccccggcccccggcccggccc

SEQ ID NO: 181702 - RNA, 22 nt, Human
ccccugauaacugugaaauaaa

SEQ ID NO: 181703 - RNA, 24 nt, Human
cccgcagcgccccggccugcgugc

SEQ ID NO: 181704 - RNA, 20 nt, Human
cccgcccggcagcgcaggcu

SEQ ID NO: 181705 - RNA, 24 nt, Human
cccgccgcggcccuccggccucgg

SEQ ID NO: 181706 - RNA, 18 nt, Human
cccggaaccacagggcgc

SEQ ID NO: 181707 - RNA, 21 nt, Human
cccggccaugagagagggccc

SEQ ID NO: 181708 - RNA, 18 nt, Human
cccggcccccggcccggc

SEQ ID NO: 181709 - RNA, 24 nt, Human
cccggcccccggcccggcccuggc

SEQ ID NO: 181710 - RNA, 23 nt, Human
cccggcccggcccuggccggagc

SEQ ID NO: 181711 - RNA, 25 nt, Human
cccgggggcggcgcucgggggcggg

SEQ ID NO: 181712 - RNA, 23 nt, Human
cccugcccugggccugcaacacc

SEQ ID NO: 181713 - RNA, 22 nt, Human
ccgagggagccccccacccccu

SEQ ID NO: 181714 - RNA, 23 nt, Human
ccgagggagccccccacccccuc

SEQ ID NO: 181715 - RNA, 19 nt, Human
ccgccgcccgccgcggccc

SEQ ID NO: 181716 - RNA, 18 nt, Human
ccgccgccgccccccggc

SEQ ID NO: 181717 - RNA, 19 nt, Human
ccgccgcggcccuccggcc

SEQ ID NO: 181718 - RNA, 20 nt, Human
ccgccgcggcccuccggccu

SEQ ID NO: 181719 - RNA, 23 nt, Human
ccgccgcggcccuccggccucgg

SEQ ID NO: 181720 - RNA, 21 nt, Human
ccgcggcccuccggccucggc

SEQ ID NO: 181721 - RNA, 18 nt, Human
ccggccucggccaccggc

SEQ ID NO: 181722 - RNA, 26 nt, Human
ccgugucuccaucccgucucccuggg

SEQ ID NO: 181723 - RNA, 21 nt, Human
ccuaauacuuagccccgcagc

SEQ ID NO: 181724 - RNA, 22 nt, Human
ccucccgcggcagagccccggc

SEQ ID NO: 181725 - RNA, 21 nt, Human
ccugcccugggccugcaacac

SEQ ID NO: 181726 - RNA, 23 nt, Human
ccuugccccugggugccacuggc

SEQ ID NO: 181727 - RNA, 23 nt, Human
cgagccauaagucaaggccagaa

SEQ ID NO: 181728 - RNA, 33 nt, Human
cggaacaaaacagaaacgcccccauccaaguug

SEQ ID NO: 181729 - RNA, 22 nt, Human
cggagggagagauguacauccc

SEQ ID NO: 181730 - RNA, 19 nt, Human
cggcccccggcccggcccu

SEQ ID NO: 181731 - RNA, 23 nt, Human
cggccgccugcccgccgccgccc

SEQ ID NO: 181732 - RNA, 19 nt, Human
cggggcgggccggcccggg

SEQ ID NO: 181733 - RNA, 18 nt, Human
cgggggcugcugccgccc

SEQ ID NO: 181734 - RNA, 23 nt, Human
cguggcuccagcccggggacccu

SEQ ID NO: 181735 - RNA, 21 nt, Human
cuaccucugcuuuuuuggggg

SEQ ID NO: 181736 - RNA, 22 nt, Human
cuccaucccgucucccugggcc

SEQ ID NO: 181737 - RNA, 21 nt, Human
cuccguggaaggaagguccug

SEQ ID NO: 181738 - RNA, 24 nt, Human
cucucggguacacaccugagaaua

SEQ ID NO: 181739 - RNA, 19 nt, Human
cugcgugcugggcgacucc

SEQ ID NO: 181740 - RNA, 19 nt, Human
cuggaagcugcccaggccg

SEQ ID NO: 181741 - RNA, 19 nt, Human
cugggucccguccgccagg

SEQ ID NO: 181742 - RNA, 27 nt, Human
cuuuuuuggggggcaggggaucaggca

SEQ ID NO: 181743 - RNA, 19 nt, Human
gaaaaagccaccuccccaa

SEQ ID NO: 181744 - RNA, 20 nt, Human
gaaaaagccaccuccccaaa

SEQ ID NO: 181745 - RNA, 23 nt, Human
gaaaaagccaccuccccaaacac

SEQ ID NO: 181746 - RNA, 21 nt, Human
gaacaaaacagaaacgccccc

SEQ ID NO: 181747 - RNA, 20 nt, Human
gacaaggccacgcacagagc

SEQ ID NO: 181748 - RNA, 19 nt, Human
gagccgggggacccagggc

SEQ ID NO: 181749 - RNA, 18 nt, Human
gaggcccagagucacugg

SEQ ID NO: 181750 - RNA, 25 nt, Human
gcagacgaaaaagccaccuccccaa

SEQ ID NO: 181751 - RNA, 21 nt, Human
gcaggguggccgugcagcccu

SEQ ID NO: 181752 - RNA, 21 nt, Human
gccaguguuggccccggaggc

SEQ ID NO: 181753 - RNA, 24 nt, Human
gccaugagagagggcccagggugu

SEQ ID NO: 181754 - RNA, 19 nt, Human
gccccuggccaaagugcga

SEQ ID NO: 181755 - RNA, 28 nt, Human
gcccggcccuggccggagccgccucggc

SEQ ID NO: 181756 - RNA, 19 nt, Human
gcccuggccggagccgccu

SEQ ID NO: 181757 - RNA, 19 nt, Human
gcccugggccugcaacacc

SEQ ID NO: 181758 - RNA, 21 nt, Human
gccgccugcccgccgccgccc

SEQ ID NO: 181759 - RNA, 18 nt, Human
gcgcugggcgucaauaac

SEQ ID NO: 181760 - RNA, 20 nt, Human
gcggcccccggggcuguggc

SEQ ID NO: 181761 - RNA, 24 nt, Human
gcggcggccgaggcggggcgggcc

SEQ ID NO: 181762 - RNA, 19 nt, Human
gcucuagccagggcagggu

SEQ ID NO: 181763 - RNA, 21 nt, Human
ggaaggccuaauacuuagccc

SEQ ID NO: 181764 - RNA, 22 nt, Human
ggcaggcaccccugcccugggc

SEQ ID NO: 181765 - RNA, 19 nt, Human
ggccggagccgccucggcc

SEQ ID NO: 181766 - RNA, 24 nt, Human
ggccgggggcugcugccgcccggg

SEQ ID NO: 181767 - RNA, 18 nt, Human
ggcgggccggcccggggc

SEQ ID NO: 181768 - RNA, 19 nt, Human
ggcggggccccaugcuggc

SEQ ID NO: 181769 - RNA, 22 nt, Human
ggcugcagggcggggccccaug

SEQ ID NO: 181770 - RNA, 19 nt, Human
gggcgucaauaacuuaaaa

SEQ ID NO: 181771 - RNA, 24 nt, Human
ggggcaggcaccccugcccugggc

SEQ ID NO: 181772 - RNA, 22 nt, Human
gggggcucugugaggcccagag

SEQ ID NO: 181773 - RNA, 21 nt, Human
ggguuggaaggacagccacag

SEQ ID NO: 181774 - RNA, 20 nt, Human
ggucguggccagccaggccu

SEQ ID NO: 181775 - RNA, 21 nt, Human
ggugcgcucuagccagggcag

SEQ ID NO: 181776 - RNA, 19 nt, Human
gucuccgagucuccacgcc

SEQ ID NO: 181777 - RNA, 18 nt, Human
gugaugaagaaaagaagc

SEQ ID NO: 181778 - RNA, 23 nt, Human
gugcuggcuucccgcuccccggg

SEQ ID NO: 181779 - RNA, 19 nt, Human
gugcugggcgacuccaccc

SEQ ID NO: 181780 - RNA, 23 nt, Human
guggccccacacguggcaagggu

SEQ ID NO: 181781 - RNA, 18 nt, Human
uaaaaaaggggaaaaacg

SEQ ID NO: 181782 - RNA, 23 nt, Human
uagccagggcaggguggccgugc

SEQ ID NO: 181783 - RNA, 19 nt, Human
ucaaggggccccgggaggc

SEQ ID NO: 181784 - RNA, 21 nt, Human
ucacaaagcggaacaaaacag

SEQ ID NO: 181785 - RNA, 22 nt, Human
ucaccgggggaccaucccucca

SEQ ID NO: 181786 - RNA, 18 nt, Human
ucacgagaaaucguuggc

SEQ ID NO: 181787 - RNA, 22 nt, Human
ucaggaguccagugggcaaagc

SEQ ID NO: 181788 - RNA, 18 nt, Human
uccacgccuuuugugaug

SEQ ID NO: 181789 - RNA, 22 nt, Human
ucccagccucugcagagggacg

SEQ ID NO: 181790 - RNA, 18 nt, Human
uccccaaacacagucccc

SEQ ID NO: 181791 - RNA, 24 nt, Human
uccccacccacccucgcuguuucc

SEQ ID NO: 181792 - RNA, 23 nt, Human
uccccgggggcggcgcucggggg

SEQ ID NO: 181793 - RNA, 21 nt, Human
ucccucucucugccucucggg

SEQ ID NO: 181794 - RNA, 22 nt, Human
ucccugggaaggccuaauacuu

SEQ ID NO: 181795 - RNA, 27 nt, Human
ucccugggaaggccuaauacuuagccc

SEQ ID NO: 181796 - RNA, 21 nt, Human
uccugccccgugucuccaucc

SEQ ID NO: 181797 - RNA, 24 nt, Human
uccuugccccugggugccacuggc

SEQ ID NO: 181798 - RNA, 18 nt, Human
ucuccgagucuccacgcc

SEQ ID NO: 181799 - RNA, 23 nt, Human
ucuccgagucuccacgccuuuug

SEQ ID NO: 181800 - RNA, 19 nt, Human
ucuguaaaaguccccaccc

SEQ ID NO: 181801 - RNA, 23 nt, Human
ugaaaaaaaaaaaaucuccuccc

SEQ ID NO: 181802 - RNA, 20 nt, Human
ugacaucacaaagcggaaca

SEQ ID NO: 181803 - RNA, 24 nt, Human
ugagaauauucuguaaaagucccc

SEQ ID NO: 181804 - RNA, 19 nt, Human
ugagagagggcccagggug

SEQ ID NO: 181805 - RNA, 20 nt, Human
ugaggcccagagucacuggg

SEQ ID NO: 181806 - RNA, 22 nt, Human
ugcccacguggccccacacgug

SEQ ID NO: 181807 - RNA, 18 nt, Human
ugcccugggccugcaaca

SEQ ID NO: 181808 - RNA, 18 nt, Human
ugccugccaccaccuucc

SEQ ID NO: 181809 - RNA, 23 nt, Human
ugcgaagcccggaaccacagggc

SEQ ID NO: 181810 - RNA, 20 nt, Human
ugcuggcuucccgcuccccg

SEQ ID NO: 181811 - RNA, 19 nt, Human
ugcuugggacaaggccacg

SEQ ID NO: 181812 - RNA, 20 nt, Human
uggcaaggguggggguuggc

SEQ ID NO: 181813 - RNA, 20 nt, Human
uggccggagccgccucggcc

SEQ ID NO: 181814 - RNA, 23 nt, Human
uggccgggggcugcugccgcccg

SEQ ID NO: 181815 - RNA, 21 nt, Human
uggcugcagggcggggcccca

SEQ ID NO: 181816 - RNA, 23 nt, Human
ugggacaaggccacgcacagagc

SEQ ID NO: 181817 - RNA, 21 nt, Human
ugggaugcuuggcacgccccc

SEQ ID NO: 181818 - RNA, 19 nt, Human
ugggggacauuggcacggg

SEQ ID NO: 181819 - RNA, 22 nt, Human
uggucggagaagguggucggca

SEQ ID NO: 181820 - RNA, 24 nt, Human
ugugaaauaaaaaccauuuguuaa

SEQ ID NO: 181821 - RNA, 25 nt, Human
ugugaggcccagagucacugggggc

SEQ ID NO: 181822 - RNA, 18 nt, Human
ugugaugaagaaaagaag

SEQ ID NO: 181823 - RNA, 20 nt, Human
uuccacgcgccccuggccaa

SEQ ID NO: 181824 - RNA, 21 nt, Human
uuugcaguggccgggggcugc

SEQ ID NO: 181825 - RNA, 23 nt, Human
aaauaaaacaaggaguuugcaaa

SEQ ID NO: 181826 - RNA, 25 nt, Human
aaauaucuuccaaguuccaucaccc

SEQ ID NO: 181827 - RNA, 21 nt, Human
aagacgggggccgacuugagc

SEQ ID NO: 181828 - RNA, 21 nt, Human
aagucaagaaaauaauuauaa

SEQ ID NO: 181829 - RNA, 24 nt, Human
aaucuuauagccaaaagucaagaa

SEQ ID NO: 181830 - RNA, 19 nt, Human
acccgaauccucggcccgg

SEQ ID NO: 181831 - RNA, 21 nt, Human
acccgaauccucggcccggcc

SEQ ID NO: 181832 - RNA, 22 nt, Human
acccgacggggcgacgcggccc

SEQ ID NO: 181833 - RNA, 24 nt, Human
agcucaguacccgacggggcgacg

SEQ ID NO: 181834 - RNA, 23 nt, Human
aguuccuggcaugggacuggcuc

SEQ ID NO: 181835 - RNA, 18 nt, Human
aucucuguccccacgauc

SEQ ID NO: 181836 - RNA, 22 nt, Human
ccccgggcacccgaauccucgg

SEQ ID NO: 181837 - RNA, 25 nt, Human
ccccgggcacccgaauccucggccc

SEQ ID NO: 181838 - RNA, 23 nt, Human
cgaauccucggcccggccgcuca

SEQ ID NO: 181839 - RNA, 21 nt, Human
cggccgcucacccggccagca

SEQ ID NO: 181840 - RNA, 22 nt, Human
cucaaauaucuuccaaguuccu

SEQ ID NO: 181841 - RNA, 23 nt, Human
cucggcccggccgcucacccggc

SEQ ID NO: 181842 - RNA, 21 nt, Human
cuggcucuggugaugucagaa

SEQ ID NO: 181843 - RNA, 21 nt, Human
gaaaacaccaaauucaaaaau

SEQ ID NO: 181844 - RNA, 21 nt, Human
gaagcacuugcaaauaaaaca

SEQ ID NO: 181845 - RNA, 21 nt, Human
gaauccucggcccggccgcuc

SEQ ID NO: 181846 - RNA, 26 nt, Human
gaucuacaugacauccuuaguuccuu

SEQ ID NO: 181847 - RNA, 18 nt, Human
gaugucagaagcacuugc

SEQ ID NO: 181848 - RNA, 18 nt, Human
gccccgggcacccgaauc

SEQ ID NO: 181849 - RNA, 21 nt, Human
ggcacagggguguggaaagaa

SEQ ID NO: 181850 - RNA, 18 nt, Human
gggcgacgcggccccggg

SEQ ID NO: 181851 - RNA, 21 nt, Human
uacacaaaaucuuauagccaa

SEQ ID NO: 181852 - RNA, 26 nt, Human
uacacaaaaucuuauagccaaaaguu

SEQ ID NO: 181853 - RNA, 20 nt, Human
uagaaaacaccaaauucaaa

SEQ ID NO: 181854 - RNA, 24 nt, Human
uagaaaacaccaaauucaaaaauu

SEQ ID NO: 181855 - RNA, 18 nt, Human
uauguugguaaacucaaa

SEQ ID NO: 181856 - RNA, 22 nt, Human
uauguugguaaacucaaauauc

SEQ ID NO: 181857 - RNA, 24 nt, Human
ucaguacccgacggggcgacgcgg

SEQ ID NO: 181858 - RNA, 20 nt, Human
uccaucacccaucucugucc

SEQ ID NO: 181859 - RNA, 25 nt, Human
ugaucuauaaacuaacaggcuccuu

SEQ ID NO: 181860 - RNA, 20 nt, Human
uggcaugggacuggcucugg

SEQ ID NO: 181861 - RNA, 18 nt, Human
ugggacuggcucugguga

SEQ ID NO: 181862 - RNA, 20 nt, Human
ugucagaagcacuugcaaau

SEQ ID NO: 181863 - RNA, 18 nt, Human
uguccccacgaucuacau

SEQ ID NO: 181864 - RNA, 23 nt, Human
uuccaaguuccaucacccaucuc

SEQ ID NO: 181865 - RNA, 23 nt, Human
uugggauguaaggacuuuuaaag

SEQ ID NO: 181866 - RNA, 22 nt, Human
uuugcaaaucacaucuucuguu

SEQ ID NO: 181867 - RNA, 21 nt, Human
aacccccagcccagccggccc

SEQ ID NO: 181868 - RNA, 24 nt, Human
acugagucaagcaagggcaggagu

SEQ ID NO: 181869 - RNA, 24 nt, Human
agauagaccagggacacuaggggu

SEQ ID NO: 181870 - RNA, 23 nt, Human
aggaagcccggcucggcgguggc

SEQ ID NO: 181871 - RNA, 21 nt, Human
aggacacgcugugagccaccg

SEQ ID NO: 181872 - RNA, 18 nt, Human
aggagguggggaggccag

SEQ ID NO: 181873 - RNA, 22 nt, Human
agggcggggcgguggcgggaaa

SEQ ID NO: 181874 - RNA, 23 nt, Human
agggugaggugggggccccaggg

SEQ ID NO: 181875 - RNA, 19 nt, Human
aggguggggacgggaggga

SEQ ID NO: 181876 - RNA, 23 nt, Human
agugacaguguuuuccagcgguc

SEQ ID NO: 181877 - RNA, 18 nt, Human
agugcugggaacagggug

SEQ ID NO: 181878 - RNA, 22 nt, Human
agugcugggaacagggugggga

SEQ ID NO: 181879 - RNA, 19 nt, Human
augcagcaugcccagcccc

SEQ ID NO: 181880 - RNA, 23 nt, Human
caacccccagcccagccggcccu

SEQ ID NO: 181881 - RNA, 23 nt, Human
caagggcaggaguacccuggggg

SEQ ID NO: 181882 - RNA, 19 nt, Human
cacccacagagggucccag

SEQ ID NO: 181883 - RNA, 18 nt, Human
caccucccacccgcccgc

SEQ ID NO: 181884 - RNA, 23 nt, Human
cagcagcgggccguccguccccc

SEQ ID NO: 181885 - RNA, 20 nt, Human
cagcaugcccagcccccagc

SEQ ID NO: 181886 - RNA, 22 nt, Human
cagccacucccaccucccaccc

SEQ ID NO: 181887 - RNA, 22 nt, Human
caggaguacccuggggggcggc

SEQ ID NO: 181888 - RNA, 21 nt, Human
cagggcuccccgcccaccucc

SEQ ID NO: 181889 - RNA, 20 nt, Human
cagguuccuggaaggcguuc

SEQ ID NO: 181890 - RNA, 20 nt, Human
caucgcccccgggccccugc

SEQ ID NO: 181891 - RNA, 23 nt, Human
ccacccacccaaguccucaaucc

SEQ ID NO: 181892 - RNA, 19 nt, Human
ccacgcccgaaggcgccug

SEQ ID NO: 181893 - RNA, 22 nt, Human
ccacucccaccucccacccgcc

SEQ ID NO: 181894 - RNA, 23 nt, Human
ccagaguccacgcccgaaggcgc

SEQ ID NO: 181895 - RNA, 31 nt, Human
ccagcccagccggcccuggagagggcuccgg

SEQ ID NO: 181896 - RNA, 22 nt, Human
ccagggcuccccgcccaccucc

SEQ ID NO: 181897 - RNA, 19 nt, Human
cccacccgcccgccggugc

SEQ ID NO: 181898 - RNA, 23 nt, Human
cccaccuccagaccugcucagac

SEQ ID NO: 181899 - RNA, 18 nt, Human
cccagcccagccggcccu

SEQ ID NO: 181900 - RNA, 19 nt, Human
cccagggaccuagacuucc

SEQ ID NO: 181901 - RNA, 22 nt, Human
ccccaccgcagacuggguccug

SEQ ID NO: 181902 - RNA, 23 nt, Human
cccccaccgcagacuggguccug

SEQ ID NO: 181903 - RNA, 22 nt, Human
cccccagcccagccggcccugg

SEQ ID NO: 181904 - RNA, 25 nt, Human
ccccgcccaccuccagaccugcuca

SEQ ID NO: 181905 - RNA, 21 nt, Human
ccccuaguccacagguuccug

SEQ ID NO: 181906 - RNA, 18 nt, Human
cccugcagaaggugaggg

SEQ ID NO: 181907 - RNA, 18 nt, Human
ccuggagagggcuccggg

SEQ ID NO: 181908 - RNA, 22 nt, Human
ccuugccugaaacacccaggaa

SEQ ID NO: 181909 - RNA, 21 nt, Human
cgcccggagauggggcuccug

SEQ ID NO: 181910 - RNA, 19 nt, Human
cgggugcgcagggaggcug

SEQ ID NO: 181911 - RNA, 20 nt, Human
cugccccagguggggccugg

SEQ ID NO: 181912 - RNA, 20 nt, Human
cuggaaggcguuccuucucc

SEQ ID NO: 181913 - RNA, 25 nt, Human
cuggaaggcguuccuucucccaaug

SEQ ID NO: 181914 - RNA, 18 nt, Human
gagaggcagagaagagag

SEQ ID NO: 181915 - RNA, 19 nt, Human
gagccaccgagcucugaaa

SEQ ID NO: 181916 - RNA, 18 nt, Human
gaggcugccuuuuccuug

SEQ ID NO: 181917 - RNA, 19 nt, Human
gagggcggggcgguggcgg

SEQ ID NO: 181918 - RNA, 19 nt, Human
gccccagguggggccuggg

SEQ ID NO: 181919 - RNA, 20 nt, Human
gcccccgggccccugcuggc

SEQ ID NO: 181920 - RNA, 18 nt, Human
gcccgaaggcgccugaag

SEQ ID NO: 181921 - RNA, 20 nt, Human
ggacacgcugugagccaccg

SEQ ID NO: 181922 - RNA, 24 nt, Human
ggacgggaggagguggggaggcca

SEQ ID NO: 181923 - RNA, 18 nt, Human
ggagagggugaggugggg

SEQ ID NO: 181924 - RNA, 18 nt, Human
ggagauggggcuccugag

SEQ ID NO: 181925 - RNA, 22 nt, Human
ggaggagguggggaggccaggg

SEQ ID NO: 181926 - RNA, 18 nt, Human
gggaacaggguggggacg

SEQ ID NO: 181927 - RNA, 23 nt, Human
gggaggagguggggaggccaggg

SEQ ID NO: 181928 - RNA, 22 nt, Human
gggcaggaguacccuggggggc

SEQ ID NO: 181929 - RNA, 24 nt, Human
gggggccccagggagggcggggcg

SEQ ID NO: 181930 - RNA, 23 nt, Human
gugccgccugccccagguggggc

SEQ ID NO: 181931 - RNA, 24 nt, Human
uaagaugcagcaugcccagccccc

SEQ ID NO: 181932 - RNA, 22 nt, Human
uacaaaagguuaagaugcagca

SEQ ID NO: 181933 - RNA, 25 nt, Human
uacccuggggggcggcuguccuggu

SEQ ID NO: 181934 - RNA, 24 nt, Human
uacuagccccaucccagggugugc

SEQ ID NO: 181935 - RNA, 18 nt, Human
uagagugcgccagagucc

SEQ ID NO: 181936 - RNA, 18 nt, Human
ucccagaacccugcccag

SEQ ID NO: 181937 - RNA, 19 nt, Human
ucccagaacccugcccagg

SEQ ID NO: 181938 - RNA, 18 nt, Human
ucccagggugugcgucac

SEQ ID NO: 181939 - RNA, 21 nt, Human
uccccugauuucuucaccuuu

SEQ ID NO: 181940 - RNA, 21 nt, Human
ucccugcagccacucccaccu

SEQ ID NO: 181941 - RNA, 28 nt, Human
uccgcaaaccggggcaggaccggggucc

SEQ ID NO: 181942 - RNA, 21 nt, Human
uccugagagaugcccacccac

SEQ ID NO: 181943 - RNA, 23 nt, Human
uccuugccugaaacacccaggaa

SEQ ID NO: 181944 - RNA, 20 nt, Human
ucgcccccgggccccugcug

SEQ ID NO: 181945 - RNA, 23 nt, Human
ucggcgguggcaaggcuugagug

SEQ ID NO: 181946 - RNA, 20 nt, Human
ugaaacacccaggaagcccg

SEQ ID NO: 181947 - RNA, 25 nt, Human
ugaaacacccaggaagcccggcucg

SEQ ID NO: 181948 - RNA, 21 nt, Human
ugaaacacccaggaagcccuu

SEQ ID NO: 181949 - RNA, 24 nt, Human
ugaggugggggccccagggagggc

SEQ ID NO: 181950 - RNA, 22 nt, Human
ugagugcugggaacaggguggg

SEQ ID NO: 181951 - RNA, 18 nt, Human
ugcaaagggaagucccug

SEQ ID NO: 181952 - RNA, 22 nt, Human
ugcccacccacccaaguccuca

SEQ ID NO: 181953 - RNA, 18 nt, Human
ugcccaggaggugacacg

SEQ ID NO: 181954 - RNA, 24 nt, Human
ugcuccuucccuuucaaaggaggg

SEQ ID NO: 181955 - RNA, 21 nt, Human
ugcugggaacaggguggggac

SEQ ID NO: 181956 - RNA, 23 nt, Human
ugggaacaggguggggacgggag

SEQ ID NO: 181957 - RNA, 21 nt, Human
uggggacgggaggaggugggg

SEQ ID NO: 181958 - RNA, 22 nt, Human
uuuccuugggggucacccccca

SEQ ID NO: 181959 - RNA, 26 nt, Human
aaaaaaacaaaacagaacaacuuugg

SEQ ID NO: 181960 - RNA, 22 nt, Human
aaaacagaacaacuuuggucaa

SEQ ID NO: 181961 - RNA, 25 nt, Human
aaacaaaacagaacaacuuugguca

SEQ ID NO: 181962 - RNA, 27 nt, Human
aaaccaaaucuaacguggaaucuaaug

SEQ ID NO: 181963 - RNA, 19 nt, Human
aaaguaggaaaaaucaaaa

SEQ ID NO: 181964 - RNA, 24 nt, Human
aacuuggaaacuacuuaccaguag

SEQ ID NO: 181965 - RNA, 23 nt, Human
acacacacacacacacacacaca

SEQ ID NO: 181966 - RNA, 23 nt, Human
acacacacacacacacacacaca

SEQ ID NO: 181967 - RNA, 23 nt, Human
acacacacacacacacacacaca

SEQ ID NO: 181968 - RNA, 23 nt, Human
acacacacacacacacacacaca

SEQ ID NO: 181969 - RNA, 23 nt, Human
acacacacacacacacacacaca

SEQ ID NO: 181970 - RNA, 23 nt, Human
acacacacacacacacacacaca

SEQ ID NO: 181971 - RNA, 23 nt, Human
acacacacacacacacacacaca

SEQ ID NO: 181972 - RNA, 32 nt, Human
acacacacacacacacacacacaaauauagug

SEQ ID NO: 181973 - RNA, 19 nt, Human
acauaaagaaucuaaacua

SEQ ID NO: 181974 - RNA, 23 nt, Human
acccuaaaauccuaaguugccac

SEQ ID NO: 181975 - RNA, 24 nt, Human
agacagcaacgggcggcuguuccu

SEQ ID NO: 181976 - RNA, 22 nt, Human
agagccugccgccgcucccucc

SEQ ID NO: 181977 - RNA, 22 nt, Human
agcgagagccugccgccgcucc

SEQ ID NO: 181978 - RNA, 23 nt, Human
agguauauuuauguuauuuccaa

SEQ ID NO: 181979 - RNA, 18 nt, Human
auaaagcuguuuaaaacu

SEQ ID NO: 181980 - RNA, 22 nt, Human
auaaucucaagcaaguggagaa

SEQ ID NO: 181981 - RNA, 25 nt, Human
aucaauauacuagagcccagcuuua

SEQ ID NO: 181982 - RNA, 20 nt, Human
aucaccuuugaggcaaugca

SEQ ID NO: 181983 - RNA, 19 nt, Human
aucagccaaauauuaaaau

SEQ ID NO: 181984 - RNA, 25 nt, Human
aucuuaagaacauuucaauaaaaca

SEQ ID NO: 181985 - RNA, 25 nt, Human
caaaacagaacaacuuuggucaagu

SEQ ID NO: 181986 - RNA, 21 nt, Human
caacccagugacaacacguaa

SEQ ID NO: 181987 - RNA, 26 nt, Human
cacacacacacacacaaauauacuuc

SEQ ID NO: 181988 - RNA, 18 nt, Human
cacacacacacacacaca

SEQ ID NO: 181989 - RNA, 20 nt, Human
cacacacacacacacacaca

SEQ ID NO: 181990 - RNA, 20 nt, Human
cacacacacacacacacaca

SEQ ID NO: 181991 - RNA, 20 nt, Human
cacacacacacacacacaca

SEQ ID NO: 181992 - RNA, 20 nt, Human
cacacacacacacacacaca

SEQ ID NO: 181993 - RNA, 20 nt, Human
cacacacacacacacacaca

SEQ ID NO: 181994 - RNA, 20 nt, Human
cacacacacacacacacaca

SEQ ID NO: 181995 - RNA, 20 nt, Human
cacacacacacacacacaca

SEQ ID NO: 181996 - RNA, 20 nt, Human
cacacacacacacacacaca

SEQ ID NO: 181997 - RNA, 20 nt, Human
cacacacacacacacacaca

SEQ ID NO: 181998 - RNA, 20 nt, Human
cacacacacacacacacaca

SEQ ID NO: 181999 - RNA, 20 nt, Human
cacacacacacacacacaca

SEQ ID NO: 182000 - RNA, 22 nt, Human
cacacacacacacacacacaca

SEQ ID NO: 182001 - RNA, 22 nt, Human
cacacacacacacacacacaca

SEQ ID NO: 182002 - RNA, 22 nt, Human
cacacacacacacacacacaca

SEQ ID NO: 182003 - RNA, 22 nt, Human
cacacacacacacacacacaca

SEQ ID NO: 182004 - RNA, 26 nt, Human
cacacacacacacacacacacacaaa

SEQ ID NO: 182005 - RNA, 26 nt, Human
cacacacacacacacacacacacaca

SEQ ID NO: 182006 - RNA, 26 nt, Human
cacacacacacacacacacacacaca

SEQ ID NO: 182007 - RNA, 26 nt, Human
cacacacacacacacacacacacaca

SEQ ID NO: 182008 - RNA, 26 nt, Human
cacacacacacacacacacacacaca

SEQ ID NO: 182009 - RNA, 26 nt, Human
cacacacacacacacacacacacaca

SEQ ID NO: 182010 - RNA, 26 nt, Human
cacacacacacacacacacacacaca

SEQ ID NO: 182011 - RNA, 23 nt, Human
cacauaaagaaucuaaacuaaca

SEQ ID NO: 182012 - RNA, 25 nt, Human
cacgaccaggcucugcuucccggcc

SEQ ID NO: 182013 - RNA, 20 nt, Human
cacuauuacucauuuucuaa

SEQ ID NO: 182014 - RNA, 18 nt, Human
cagaaaucaucaauauac

SEQ ID NO: 182015 - RNA, 24 nt, Human
cagaauaaaguucaggauuucauu

SEQ ID NO: 182016 - RNA, 20 nt, Human
cagcuuuaacacuguccuuc

SEQ ID NO: 182017 - RNA, 21 nt, Human
caguggccgcugcacucccgc

SEQ ID NO: 182018 - RNA, 21 nt, Human
cauuaaugauggucaccaaua

SEQ ID NO: 182019 - RNA, 21 nt, Human
ccaagcccagccgagcucggc

SEQ ID NO: 182020 - RNA, 23 nt, Human
ccacgccgcccccaccacuuccu

SEQ ID NO: 182021 - RNA, 25 nt, Human
ccaucugucacauuuaagaaagguc

SEQ ID NO: 182022 - RNA, 20 nt, Human
cccacaaaaaugcucuuagg

SEQ ID NO: 182023 - RNA, 20 nt, Human
cccaccacuuccuaagcgga

SEQ ID NO: 182024 - RNA, 21 nt, Human
cccccaagucccggguuuggg

SEQ ID NO: 182025 - RNA, 19 nt, Human
ccgccgcucccuccgcgcc

SEQ ID NO: 182026 - RNA, 26 nt, Human
ccgcgcccgagugcgggcuccaagca

SEQ ID NO: 182027 - RNA, 18 nt, Human
ccgcugcacucccgccgg

SEQ ID NO: 182028 - RNA, 19 nt, Human
ccgcugcacucccgccggu

SEQ ID NO: 182029 - RNA, 21 nt, Human
ccgcugcacucccgccggugg

SEQ ID NO: 182030 - RNA, 22 nt, Human
ccgcugcacucccgccgguggc

SEQ ID NO: 182031 - RNA, 24 nt, Human
ccucaagggaaauaaaagccucac

SEQ ID NO: 182032 - RNA, 20 nt, Human
ccuccaaaugaaacagauau

SEQ ID NO: 182033 - RNA, 24 nt, Human
ccuuauauuacauucuguguugcu

SEQ ID NO: 182034 - RNA, 23 nt, Human
cgaccaggcucugcuucccggcc

SEQ ID NO: 182035 - RNA, 21 nt, Human
cgcccccaccacuuccuaagc

SEQ ID NO: 182036 - RNA, 24 nt, Human
cgcccgagugcgggcuccaagcac

SEQ ID NO: 182037 - RNA, 23 nt, Human
cuagagcccagcuuuaacacugu

SEQ ID NO: 182038 - RNA, 19 nt, Human
cucagcgcccccaaguccc

SEQ ID NO: 182039 - RNA, 22 nt, Human
cugcaagacucuagucuacaga

SEQ ID NO: 182040 - RNA, 21 nt, Human
cugccgccgcucccuccgcgc

SEQ ID NO: 182041 - RNA, 23 nt, Human
cugccgccgcucccuccgcgccc

SEQ ID NO: 182042 - RNA, 28 nt, Human
gccacgccgcccccaccacuuccuaagc

SEQ ID NO: 182043 - RNA, 18 nt, Human
ggguggggagugcuguuu

SEQ ID NO: 182044 - RNA, 21 nt, Human
gggugggguggggagugcugu

SEQ ID NO: 182045 - RNA, 18 nt, Human
ggugccgaaagcgagagc

SEQ ID NO: 182046 - RNA, 20 nt, Human
uaaaaacuaaguguguacaa

SEQ ID NO: 182047 - RNA, 26 nt, Human
uaaaacacauaaaauuuaaagaacaa

SEQ ID NO: 182048 - RNA, 21 nt, Human
uaaaaccuaaaaauaaugucg

SEQ ID NO: 182049 - RNA, 25 nt, Human
uaaaauuaaugaaaacauaucuuuc

SEQ ID NO: 182050 - RNA, 25 nt, Human
uaaagaacaaaucauguuauuaaaa

SEQ ID NO: 182051 - RNA, 19 nt, Human
uaaagaaucuaaacuaaca

SEQ ID NO: 182052 - RNA, 19 nt, Human
uaagaugacaucaccuuug

SEQ ID NO: 182053 - RNA, 22 nt, Human
uacaaagaagaaaauccuccaa

SEQ ID NO: 182054 - RNA, 25 nt, Human
uacacacacacacacacacacacac

SEQ ID NO: 182055 - RNA, 25 nt, Human
uacacacacacacacacacacacag

SEQ ID NO: 182056 - RNA, 23 nt, Human
uacacacacacacacacacacag

SEQ ID NO: 182057 - RNA, 27 nt, Human
uacaggacaugaacauaaaggacauac

SEQ ID NO: 182058 - RNA, 21 nt, Human
uauacuagagcccagcuuuaa

SEQ ID NO: 182059 - RNA, 25 nt, Human
ucaaagauccuucuuguuaucuucc

SEQ ID NO: 182060 - RNA, 23 nt, Human
ucaguaucuagcugauacauaac

SEQ ID NO: 182061 - RNA, 23 nt, Human
ucaguuaaaaaaacaaaacagaa

SEQ ID NO: 182062 - RNA, 21 nt, Human
uccaagaugaguaaaaaaaug

SEQ ID NO: 182063 - RNA, 20 nt, Human
uccaagcacaggggaauccu

SEQ ID NO: 182064 - RNA, 22 nt, Human
ugaaaggcacauaaagaaucua

SEQ ID NO: 182065 - RNA, 18 nt, Human
ugagggugggguggggag

SEQ ID NO: 182066 - RNA, 23 nt, Human
ugagggugggguggggagugcug

SEQ ID NO: 182067 - RNA, 23 nt, Human
ugauaauuacauuugaaauuagu

SEQ ID NO: 182068 - RNA, 19 nt, Human
uggccgcgcugcagccucg

SEQ ID NO: 182069 - RNA, 19 nt, Human
ugggguggggagugcuguu

SEQ ID NO: 182070 - RNA, 24 nt, Human
uggguacaguggccgcugcacucc

SEQ ID NO: 182071 - RNA, 22 nt, Human
uguauacauacauuugcauagu

SEQ ID NO: 182072 - RNA, 22 nt, Human
uguauacauacauuugcauauu

SEQ ID NO: 182073 - RNA, 24 nt, Human
uuaaaaccuaaaaauaaugucggu

SEQ ID NO: 182074 - RNA, 21 nt, Human
uuaaauaguugauccaaaggc

SEQ ID NO: 182075 - RNA, 24 nt, Human
uuacacagaauaaaguucaggauu

SEQ ID NO: 182076 - RNA, 26 nt, Human
uuacuuucaguuaaaaaaacaaaaca

SEQ ID NO: 182077 - RNA, 20 nt, Human
uuccaagaugaguaaaaaaa

SEQ ID NO: 182078 - RNA, 19 nt, Human
uugaaaaugcauuuuacca

SEQ ID NO: 182079 - RNA, 23 nt, Human
uugaaauuaguuauauguauaaa

SEQ ID NO: 182080 - RNA, 23 nt, Human
uugaauuucauacacagcuucac

SEQ ID NO: 182081 - RNA, 18 nt, Human
uuuaaagaacaaaucaug

SEQ ID NO: 182082 - RNA, 20 nt, Human
uuuaaggaacuuugauaacu

SEQ ID NO: 182083 - RNA, 19 nt, Human
uuuaugguuacacacacac

SEQ ID NO: 182084 - RNA, 21 nt, Human
uuuuauuuucuuaaaguagga

SEQ ID NO: 182085 - RNA, 18 nt, Human
uuuuuuuuuuuuuuuuug

SEQ ID NO: 182086 - RNA, 30 nt, Human
aacaagacaaugguuaaaaaccagaacagg

SEQ ID NO: 182087 - RNA, 24 nt, Human
accagcaucucagacaagggccga

SEQ ID NO: 182088 - RNA, 24 nt, Human
acucagcaugugccccccuccccu

SEQ ID NO: 182089 - RNA, 22 nt, Human
agaacaaagagaggaaagagga

SEQ ID NO: 182090 - RNA, 20 nt, Human
agaacaagacaaugguuaaa

SEQ ID NO: 182091 - RNA, 23 nt, Human
agaacaagacaaugguuaaaaac

SEQ ID NO: 182092 - RNA, 18 nt, Human
agaacagaugcccagaag

SEQ ID NO: 182093 - RNA, 21 nt, Human
agacaagggcaggcuucaaac

SEQ ID NO: 182094 - RNA, 21 nt, Human
agacaaugguuaaaaaccaga

SEQ ID NO: 182095 - RNA, 24 nt, Human
aggaggcucccuguaaacauuugg

SEQ ID NO: 182096 - RNA, 22 nt, Human
aggggccccuccagacgcagcc

SEQ ID NO: 182097 - RNA, 22 nt, Human
caccaccagcccucugcgggaa

SEQ ID NO: 182098 - RNA, 23 nt, Human
caccagcccucugcgggaagcac

SEQ ID NO: 182099 - RNA, 18 nt, Human
caggcuucaaacagggag

SEQ ID NO: 182100 - RNA, 21 nt, Human
caggggccccuccagacgcag

SEQ ID NO: 182101 - RNA, 23 nt, Human
caucacagaacaagacaaugguu

SEQ ID NO: 182102 - RNA, 22 nt, Human
caucuuccucagggguuggggg

SEQ ID NO: 182103 - RNA, 23 nt, Human
ccacuccgcucccaccaccagcc

SEQ ID NO: 182104 - RNA, 22 nt, Human
ccccacacggcccacggcccgg

SEQ ID NO: 182105 - RNA, 18 nt, Human
ccccccuccccucaucac

SEQ ID NO: 182106 - RNA, 23 nt, Human
ccccgcccgacccacuccgcucc

SEQ ID NO: 182107 - RNA, 19 nt, Human
cccgacccacuccgcuccc

SEQ ID NO: 182108 - RNA, 21 nt, Human
cccggcucggccccgcccgac

SEQ ID NO: 182109 - RNA, 21 nt, Human
ccgccggcccggccgccgccc

SEQ ID NO: 182110 - RNA, 21 nt, Human
ccuacgucuggagcugagggg

SEQ ID NO: 182111 - RNA, 19 nt, Human
ccuguggcaaccccucccc

SEQ ID NO: 182112 - RNA, 18 nt, Human
cgacccacuccgcuccca

SEQ ID NO: 182113 - RNA, 22 nt, Human
cgcccgacccacuccgcuccca

SEQ ID NO: 182114 - RNA, 20 nt, Human
cucccaccaccagcccucug

SEQ ID NO: 182115 - RNA, 23 nt, Human
cuccccucaucacagaacaagac

SEQ ID NO: 182116 - RNA, 24 nt, Human
cuggggguccaggcuggagaagca

SEQ ID NO: 182117 - RNA, 25 nt, Human
gaacaagacaaugguuaaaaaccag

SEQ ID NO: 182118 - RNA, 21 nt, Human
gagaagcaggggccccuccag

SEQ ID NO: 182119 - RNA, 20 nt, Human
gaggggacagggggagcuga

SEQ ID NO: 182120 - RNA, 25 nt, Human
gccggcccggccgccgcccggcccc

SEQ ID NO: 182121 - RNA, 22 nt, Human
gcucccaccaccagcccucugc

SEQ ID NO: 182122 - RNA, 20 nt, Human
ggacugggcaggaggcuccc

SEQ ID NO: 182123 - RNA, 21 nt, Human
ggagaagcaggggccccucca

SEQ ID NO: 182124 - RNA, 19 nt, Human
ggcgggggaacaggcgggg

SEQ ID NO: 182125 - RNA, 23 nt, Human
ggcugguguugggcaaagcuggg

SEQ ID NO: 182126 - RNA, 22 nt, Human
gggacagggggagcugagaaca

SEQ ID NO: 182127 - RNA, 21 nt, Human
gggccccuccagacgcagccu

SEQ ID NO: 182128 - RNA, 23 nt, Human
ggggacagggggagcugagaaca

SEQ ID NO: 182129 - RNA, 21 nt, Human
ggggacugggcaggaggcucc

SEQ ID NO: 182130 - RNA, 24 nt, Human
ggguugggggacugggcaggaggc

SEQ ID NO: 182131 - RNA, 21 nt, Human
gugcuuuuuccuuuggggccu

SEQ ID NO: 182132 - RNA, 18 nt, Human
ucagcaugugccccccuc

SEQ ID NO: 182133 - RNA, 22 nt, Human
ucccaccaccagcccucugcgg

SEQ ID NO: 182134 - RNA, 18 nt, Human
ucucagacaagggcaggc

SEQ ID NO: 182135 - RNA, 20 nt, Human
ucucagacaagggcaggcuu

SEQ ID NO: 182136 - RNA, 22 nt, Human
ugaggggacagggggagcugag

SEQ ID NO: 182137 - RNA, 22 nt, Human
ugcccagaaggggguaccaugg

SEQ ID NO: 182138 - RNA, 23 nt, Human
uggcgucucacgcuucuugugcu

SEQ ID NO: 182139 - RNA, 18 nt, Human
ugggcaggaggcucccug

SEQ ID NO: 182140 - RNA, 18 nt, Human
ugggggacugggcaggag

SEQ ID NO: 182141 - RNA, 21 nt, Human
ugggggacugggcaggaggcu

SEQ ID NO: 182142 - RNA, 18 nt, Human
uggggguccaggcuggag

SEQ ID NO: 182143 - RNA, 18 nt, Human
ugguguugggcaaagcug

SEQ ID NO: 182144 - RNA, 21 nt, Human
ugugcuuuuuccuuuggggcc

SEQ ID NO: 182145 - RNA, 20 nt, Human
uguugggcaaagcugggggu

SEQ ID NO: 182146 - RNA, 22 nt, Human
uguugggcaaagcugggggucc

SEQ ID NO: 182147 - RNA, 24 nt, Human
uuaaaaaccagaacagaugcccag

SEQ ID NO: 182148 - RNA, 22 nt, Human
uugggggguacaaagucggcgg

SEQ ID NO: 182149 - RNA, 20 nt, Human
aaaaacuaccaacaaaggca

SEQ ID NO: 182150 - RNA, 25 nt, Human
aaaaagaaucacaaaaaaaguuaaa

SEQ ID NO: 182151 - RNA, 19 nt, Human
aaaaagauuggaccccaaa

SEQ ID NO: 182152 - RNA, 19 nt, Human
aaaaaugaaccacuggugg

SEQ ID NO: 182153 - RNA, 18 nt, Human
aaaagaacauacuggcua

SEQ ID NO: 182154 - RNA, 20 nt, Human
aaaaggaaacagaagacagu

SEQ ID NO: 182155 - RNA, 24 nt, Human
aaacaagaggcaccauguacaaaa

SEQ ID NO: 182156 - RNA, 18 nt, Human
aaacaagcaagaaucaaa

SEQ ID NO: 182157 - RNA, 24 nt, Human
aaacagaagacaguauuuccagaa

SEQ ID NO: 182158 - RNA, 20 nt, Human
aaagucccaaaaugcaacag

SEQ ID NO: 182159 - RNA, 23 nt, Human
aacccauucucagacaaaggcua

SEQ ID NO: 182160 - RNA, 20 nt, Human
aagaaggggggaaaaaaaga

SEQ ID NO: 182161 - RNA, 22 nt, Human
aagaaggggggaaaaaaagagu

SEQ ID NO: 182162 - RNA, 22 nt, Human
aagaggcaccauguacaaaacu

SEQ ID NO: 182163 - RNA, 18 nt, Human
aagaguuccuacuaaaga

SEQ ID NO: 182164 - RNA, 19 nt, Human
acaaacaagguuaaccuuc

SEQ ID NO: 182165 - RNA, 19 nt, Human
acagcaaaaggugucuggu

SEQ ID NO: 182166 - RNA, 24 nt, Human
acauucugcaaaggcaaaaggaaa

SEQ ID NO: 182167 - RNA, 23 nt, Human
accccaaaaggcacugcccaaac

SEQ ID NO: 182168 - RNA, 22 nt, Human
agacaaacaagcaagaaucaaa

SEQ ID NO: 182169 - RNA, 20 nt, Human
agcaaaaggugucuggucuc

SEQ ID NO: 182170 - RNA, 18 nt, Human
agcaaaccugggcucuuu

SEQ ID NO: 182171 - RNA, 22 nt, Human
agcuaugauuuuccaaaaagaa

SEQ ID NO: 182172 - RNA, 24 nt, Human
aggaaaagguauauucaaaaugag

SEQ ID NO: 182173 - RNA, 22 nt, Human
aggagcaaaccugggcucuuua

SEQ ID NO: 182174 - RNA, 18 nt, Human
aucaaguuuuucccacac

SEQ ID NO: 182175 - RNA, 23 nt, Human
augacaaaguggaaaaaaguccc

SEQ ID NO: 182176 - RNA, 18 nt, Human
augagacagcaaaaggug

SEQ ID NO: 182177 - RNA, 21 nt, Human
augcagauauaacauaaaacu

SEQ ID NO: 182178 - RNA, 20 nt, Human
auguacacaugacaaagugg

SEQ ID NO: 182179 - RNA, 25 nt, Human
caaaaagaaucacaaaaaaaguuaa

SEQ ID NO: 182180 - RNA, 25 nt, Human
caaaaugaguaacaacuaccaaccc

SEQ ID NO: 182181 - RNA, 23 nt, Human
caaaggcuaaagcacauucugca

SEQ ID NO: 182182 - RNA, 18 nt, Human
caaaguaaaagcaugcac

SEQ ID NO: 182183 - RNA, 18 nt, Human
caacagaaaaggccauga

SEQ ID NO: 182184 - RNA, 26 nt, Human
caagcaaaauguaaaucugcaaaaug

SEQ ID NO: 182185 - RNA, 19 nt, Human
cacaucaaaagaugaaaua

SEQ ID NO: 182186 - RNA, 24 nt, Human
caccacauuuacaaaguaaaagca

SEQ ID NO: 182187 - RNA, 23 nt, Human
cacuuuaguaguucuuccaauuc

SEQ ID NO: 182188 - RNA, 20 nt, Human
cagcaccucaacuucacauc

SEQ ID NO: 182189 - RNA, 21 nt, Human
caguaaaaacgauggcaaaca

SEQ ID NO: 182190 - RNA, 23 nt, Human
caguauagaaagacuacaguuga

SEQ ID NO: 182191 - RNA, 22 nt, Human
ccaaaaagauuggaccccaaaa

SEQ ID NO: 182192 - RNA, 21 nt, Human
ccaauccaaaaagauuggacc

SEQ ID NO: 182193 - RNA, 22 nt, Human
ccaauccaaaaagauuggaccc

SEQ ID NO: 182194 - RNA, 28 nt, Human
ccacacaagcaaaauguaaaucugcaaa

SEQ ID NO: 182195 - RNA, 21 nt, Human
ccacuggugguuuaagaaggg

SEQ ID NO: 182196 - RNA, 23 nt, Human
ccagaaaagacuaguuacaaaca

SEQ ID NO: 182197 - RNA, 23 nt, Human
cggcggcgggagaggggacacgg

SEQ ID NO: 182198 - RNA, 19 nt, Human
cgggagaggggacacgggc

SEQ ID NO: 182199 - RNA, 27 nt, Human
cuaaacccauucucagacaaaggcuaa

SEQ ID NO: 182200 - RNA, 19 nt, Human
cuagaaucuuauugcagaa

SEQ ID NO: 182201 - RNA, 20 nt, Human
cucaaaaugcauucucuuca

SEQ ID NO: 182202 - RNA, 22 nt, Human
cucagacaaaggcuaaagcaca

SEQ ID NO: 182203 - RNA, 20 nt, Human
cuucacaucuuccauaagca

SEQ ID NO: 182204 - RNA, 21 nt, Human
gaaaaaaagaguaagcuacau

SEQ ID NO: 182205 - RNA, 24 nt, Human
gaaucaaucgccaauugaagcuga

SEQ ID NO: 182206 - RNA, 21 nt, Human
gaguaacaacuaccaacccug

SEQ ID NO: 182207 - RNA, 18 nt, Human
gcugcugccauucccugg

SEQ ID NO: 182208 - RNA, 19 nt, Human
gcugcugccauucccuggu

SEQ ID NO: 182209 - RNA, 25 nt, Human
ggaaagaauuauaaguaauuaugga

SEQ ID NO: 182210 - RNA, 24 nt, Human
guuucucaacagaaaaggccauga

SEQ ID NO: 182211 - RNA, 22 nt, Human
uaaaaacuaccaacaaaggcac

SEQ ID NO: 182212 - RNA, 19 nt, Human
uaaacccauucucagacaa

SEQ ID NO: 182213 - RNA, 18 nt, Human
uaacagauuaaaaaugua

SEQ ID NO: 182214 - RNA, 20 nt, Human
uaacugagacaaacaagcaa

SEQ ID NO: 182215 - RNA, 24 nt, Human
uaagauucugcaugcugcugccau

SEQ ID NO: 182216 - RNA, 21 nt, Human
uacaaaauauugugcuaaaga

SEQ ID NO: 182217 - RNA, 24 nt, Human
uacaauaaggaaaagguauauuca

SEQ ID NO: 182218 - RNA, 23 nt, Human
uaccaacaaaggcacugaacugc

SEQ ID NO: 182219 - RNA, 19 nt, Human
uaccaagaguuaaaaacaa

SEQ ID NO: 182220 - RNA, 21 nt, Human
uagcagcaaagucacugguuc

SEQ ID NO: 182221 - RNA, 24 nt, Human
uaguaguucuuccaauuccaaugu

SEQ ID NO: 182222 - RNA, 21 nt, Human
uauagccccaguaaccggaaa

SEQ ID NO: 182223 - RNA, 18 nt, Human
uauuacaccaaaagacua

SEQ ID NO: 182224 - RNA, 20 nt, Human
ucaaaaugcauucucuucau

SEQ ID NO: 182225 - RNA, 18 nt, Human
ucacuaacauccaugcuu

SEQ ID NO: 182226 - RNA, 20 nt, Human
ucaugugcauaguuaagauu

SEQ ID NO: 182227 - RNA, 23 nt, Human
uccaaaaagauuggaccccaaaa

SEQ ID NO: 182228 - RNA, 25 nt, Human
uccaagaagcugacuuuaucauacu

SEQ ID NO: 182229 - RNA, 21 nt, Human
uccaaugucugacuuuagcau

SEQ ID NO: 182230 - RNA, 19 nt, Human
uccaauuccaaugucugac

SEQ ID NO: 182231 - RNA, 25 nt, Human
ugaaaaaaccuuaaaaaugaaccac

SEQ ID NO: 182232 - RNA, 24 nt, Human
ugaaauagaauccaauccaaaaag

SEQ ID NO: 182233 - RNA, 23 nt, Human
ugaaaugcucaaaaugcauucuc

SEQ ID NO: 182234 - RNA, 22 nt, Human
ugagacaaacaagcaagaauca

SEQ ID NO: 182235 - RNA, 27 nt, Human
ugagacaaacaagcaagaaucaaagug

SEQ ID NO: 182236 - RNA, 18 nt, Human
ugcaacaguuucagcaaa

SEQ ID NO: 182237 - RNA, 24 nt, Human
ugcacaaacaagguuaaccuucaa

SEQ ID NO: 182238 - RNA, 23 nt, Human
ugcucaaaaugcauucucuucau

SEQ ID NO: 182239 - RNA, 24 nt, Human
uggaccccaaaaggcacugcccaa

SEQ ID NO: 182240 - RNA, 23 nt, Human
ugggugugucuguauccaagaag

SEQ ID NO: 182241 - RNA, 21 nt, Human
uguauuuauagccccaguaac

SEQ ID NO: 182242 - RNA, 22 nt, Human
ugucuggucucaacacuccaca

SEQ ID NO: 182243 - RNA, 23 nt, Human
ugugcuaaagagugcuaagauuc

SEQ ID NO: 182244 - RNA, 20 nt, Human
uuaaaaguucccuaauacaa

SEQ ID NO: 182245 - RNA, 20 nt, Human
uuaguaguucuuccaauucc

SEQ ID NO: 182246 - RNA, 21 nt, Human
uucaaaaugaguaacaacuac

SEQ ID NO: 182247 - RNA, 22 nt, Human
uucaaaaugaguaacaacuacc

SEQ ID NO: 182248 - RNA, 25 nt, Human
uucccacaccuaaagaaaauuccau

SEQ ID NO: 182249 - RNA, 19 nt, Human
aaaaagcaauagagaguug

SEQ ID NO: 182250 - RNA, 25 nt, Human
aacagaagcuacacaaccaaaccug

SEQ ID NO: 182251 - RNA, 18 nt, Human
accaaaccugaggggaca

SEQ ID NO: 182252 - RNA, 23 nt, Human
accaaaccugaggggacagaggu

SEQ ID NO: 182253 - RNA, 30 nt, Human
accgcaaacucccaacuaaauggcuguaag

SEQ ID NO: 182254 - RNA, 23 nt, Human
acucugaaugugacuguaaaagg

SEQ ID NO: 182255 - RNA, 24 nt, Human
agggaccaucucucgucagccugc

SEQ ID NO: 182256 - RNA, 24 nt, Human
aggggacagagguagccagaggcu

SEQ ID NO: 182257 - RNA, 18 nt, Human
aucuaccaaguucuccuc

SEQ ID NO: 182258 - RNA, 21 nt, Human
caacaacaaagagaaucuaag

SEQ ID NO: 182259 - RNA, 19 nt, Human
caacagaagcuacacaacc

SEQ ID NO: 182260 - RNA, 19 nt, Human
caccgcaaacucccaacua

SEQ ID NO: 182261 - RNA, 18 nt, Human
cagaacgggacagacggc

SEQ ID NO: 182262 - RNA, 25 nt, Human
cagugucggcaaugagagucggugg

SEQ ID NO: 182263 - RNA, 20 nt, Human
cauggggcuggcagucaggc

SEQ ID NO: 182264 - RNA, 22 nt, Human
ccacccggagagauucugcugc

SEQ ID NO: 182265 - RNA, 23 nt, Human
cccaccgcaaacucccaacuaaa

SEQ ID NO: 182266 - RNA, 23 nt, Human
ccccugcccaccgcaaacuccca

SEQ ID NO: 182267 - RNA, 22 nt, Human
cccugcccaccgcaaacuccca

SEQ ID NO: 182268 - RNA, 23 nt, Human
cccugcccaccgcaaacucccaa

SEQ ID NO: 182269 - RNA, 26 nt, Human
cguuucuucucccucccccugccccc

SEQ ID NO: 182270 - RNA, 24 nt, Human
cuccccaucuaccaaguucuccuc

SEQ ID NO: 182271 - RNA, 24 nt, Human
cucuuuccugcugcugaaagagau

SEQ ID NO: 182272 - RNA, 19 nt, Human
cuggcagucaggcaguccg

SEQ ID NO: 182273 - RNA, 20 nt, Human
gacggcagcgagauggaacu

SEQ ID NO: 182274 - RNA, 18 nt, Human
uaagaaagaagacuaugc

SEQ ID NO: 182275 - RNA, 25 nt, Human
uaauugggcucccacccggagagau

SEQ ID NO: 182276 - RNA, 23 nt, Human
uagagaguuggagacgugugcgg

SEQ ID NO: 182277 - RNA, 22 nt, Human
ucauaaagggagaaucagagac

SEQ ID NO: 182278 - RNA, 21 nt, Human
uccgucgcaggguggcggcca

SEQ ID NO: 182279 - RNA, 21 nt, Human
uccugcgacggcuccucucuu

SEQ ID NO: 182280 - RNA, 19 nt, Human
ucgacuccaagucuugggc

SEQ ID NO: 182281 - RNA, 22 nt, Human
ugauaacguggaaaaaaaaacc

SEQ ID NO: 182282 - RNA, 25 nt, Human
ugcggcuccugcgacggcuccucuc

SEQ ID NO: 182283 - RNA, 20 nt, Human
uggaaaaaaaaaccaacugu

SEQ ID NO: 182284 - RNA, 18 nt, Human
uggcauggggcuggcagu

SEQ ID NO: 182285 - RNA, 19 nt, Human
uggcucagggcaugcacga

SEQ ID NO: 182286 - RNA, 24 nt, Human
uggcuguaaggaagacgcgcggag

SEQ ID NO: 182287 - RNA, 19 nt, Human
ugggaagggaccaucucuc

SEQ ID NO: 182288 - RNA, 21 nt, Human
ugggaugcugcgggaagccgu

SEQ ID NO: 182289 - RNA, 21 nt, Human
ugucggcaaugagagucggug

SEQ ID NO: 182290 - RNA, 21 nt, Human
uucaaaugccugaggccagca

SEQ ID NO: 182291 - RNA, 22 nt, Human
uuucuucucccucccccugccc

SEQ ID NO: 182292 - RNA, 25 nt, Human
aaaaaaaacacaacccguuucccaa

SEQ ID NO: 182293 - RNA, 25 nt, Human
aaaaaaacacaacccguuucccaaa

SEQ ID NO: 182294 - RNA, 22 nt, Human
aaaaaaccccuacaaaggcuau

SEQ ID NO: 182295 - RNA, 24 nt, Human
aaaugugaagacucaacuaaaacc

SEQ ID NO: 182296 - RNA, 22 nt, Human
aacacggcaaaggaaaaaaaac

SEQ ID NO: 182297 - RNA, 20 nt, Human
aacccguuucccaaagacua

SEQ ID NO: 182298 - RNA, 21 nt, Human
aaggaaccaaaaaaccccuac

SEQ ID NO: 182299 - RNA, 19 nt, Human
aaguaaaaacaaaaacuga

SEQ ID NO: 182300 - RNA, 22 nt, Human
aauggugaguuuuccuuuuuuu

SEQ ID NO: 182301 - RNA, 25 nt, Human
agcaggguuugcaguggccuguggc

SEQ ID NO: 182302 - RNA, 24 nt, Human
agccgggaccggaaauccaacacg

SEQ ID NO: 182303 - RNA, 24 nt, Human
aggauuggucaugaaaacggcggg

SEQ ID NO: 182304 - RNA, 18 nt, Human
aggcagcaggguuugcag

SEQ ID NO: 182305 - RNA, 18 nt, Human
aggcagggguggggaggg

SEQ ID NO: 182306 - RNA, 20 nt, Human
aggcagggguggggaggggc

SEQ ID NO: 182307 - RNA, 25 nt, Human
auccccacaugagagagcggacaca

SEQ ID NO: 182308 - RNA, 20 nt, Human
caaaaaaccccuacaaaggc

SEQ ID NO: 182309 - RNA, 25 nt, Human
caaaaaaccccuacaaaggcuaucc

SEQ ID NO: 182310 - RNA, 21 nt, Human
caacacggcaaaggaaaaaaa

SEQ ID NO: 182311 - RNA, 24 nt, Human
cacaacccguuucccaaagacuag

SEQ ID NO: 182312 - RNA, 24 nt, Human
cacacacgaagggaggugucagcc

SEQ ID NO: 182313 - RNA, 20 nt, Human
caccggagccccaggcggcg

SEQ ID NO: 182314 - RNA, 18 nt, Human
cagaugggcccugccccc

SEQ ID NO: 182315 - RNA, 19 nt, Human
cagcaaagauuaagucuua

SEQ ID NO: 182316 - RNA, 20 nt, Human
cagcacaaacauccccacau

SEQ ID NO: 182317 - RNA, 21 nt, Human
cagcaggguuugcaguggccu

SEQ ID NO: 182318 - RNA, 19 nt, Human
cagggcaccgaaacaaagg

SEQ ID NO: 182319 - RNA, 19 nt, Human
cagggcaccgaaacaaagg

SEQ ID NO: 182320 - RNA, 18 nt, Human
cagguggcgucuguggug

SEQ ID NO: 182321 - RNA, 22 nt, Human
cagugcaccgcaccggagcccc

SEQ ID NO: 182322 - RNA, 24 nt, Human
ccccccagcaggagcuccaggggc

SEQ ID NO: 182323 - RNA, 19 nt, Human
ccgcaccggagccccaggc

SEQ ID NO: 182324 - RNA, 19 nt, Human
ccugagcacacuccucgga

SEQ ID NO: 182325 - RNA, 24 nt, Human
cgggacaaaaguaaaaacaaaaac

SEQ ID NO: 182326 - RNA, 23 nt, Human
cuacuggccagugagagcugugc

SEQ ID NO: 182327 - RNA, 23 nt, Human
cucggcgggacaaaaguaaaaac

SEQ ID NO: 182328 - RNA, 20 nt, Human
cugaucuguggggugggggg

SEQ ID NO: 182329 - RNA, 21 nt, Human
cuguggugucugggcggccgg

SEQ ID NO: 182330 - RNA, 27 nt, Human
gaaaaaaaaaaaaaaggaaccaaaaaa

SEQ ID NO: 182331 - RNA, 22 nt, Human
gagccccaggcggcagaugggc

SEQ ID NO: 182332 - RNA, 23 nt, Human
gcaggcagcaggguuugcagugg

SEQ ID NO: 182333 - RNA, 18 nt, Human
gcagggguggggaggggc

SEQ ID NO: 182334 - RNA, 23 nt, Human
gccccaggcggcagaugggcccu

SEQ ID NO: 182335 - RNA, 23 nt, Human
gcgggacaaaaguaaaaacaaaa

SEQ ID NO: 182336 - RNA, 25 nt, Human
ggaaaaaaaacacaacccguuuccc

SEQ ID NO: 182337 - RNA, 21 nt, Human
ggaaaacugaucuguggggug

SEQ ID NO: 182338 - RNA, 21 nt, Human
ggaaauccaacacggcaaagg

SEQ ID NO: 182339 - RNA, 21 nt, Human
ggcagaugggcccugcccccc

SEQ ID NO: 182340 - RNA, 19 nt, Human
ggcggcagaugggcccugc

SEQ ID NO: 182341 - RNA, 23 nt, Human
ggggcgcacacacgaagggaggu

SEQ ID NO: 182342 - RNA, 23 nt, Human
gucuucuucagcaaagauuaagu

SEQ ID NO: 182343 - RNA, 21 nt, Human
guggcuuagggccgccaggug

SEQ ID NO: 182344 - RNA, 18 nt, Human
guguucuuuuuggcagcu

SEQ ID NO: 182345 - RNA, 19 nt, Human
uaagcuacaaagcacauga

SEQ ID NO: 182346 - RNA, 24 nt, Human
uacaaagcacaugagaaauguucu

SEQ ID NO: 182347 - RNA, 18 nt, Human
uaggaaaacugaucugug

SEQ ID NO: 182348 - RNA, 26 nt, Human
uaggaaaacugaucuguggggugggg

SEQ ID NO: 182349 - RNA, 23 nt, Human
ucaaaguagaaaugacauaggau

SEQ ID NO: 182350 - RNA, 23 nt, Human
uccaacacggcaaaggaaaaaaa

SEQ ID NO: 182351 - RNA, 18 nt, Human
ucuacagaaauacacagc

SEQ ID NO: 182352 - RNA, 19 nt, Human
ucuacagaaauacacagcc

SEQ ID NO: 182353 - RNA, 21 nt, Human
ucugugggguggggggcuggu

SEQ ID NO: 182354 - RNA, 18 nt, Human
ucuguggugucugggcgg

SEQ ID NO: 182355 - RNA, 18 nt, Human
ugaaaaaaaaaaaaaagg

SEQ ID NO: 182356 - RNA, 24 nt, Human
ugaaaaaaaaaaaaaaggaaccaa

SEQ ID NO: 182357 - RNA, 25 nt, Human
ugaaaaaaaaaaaaaaggaaccaaa

SEQ ID NO: 182358 - RNA, 23 nt, Human
ugcaguggccuguggccuucugg

SEQ ID NO: 182359 - RNA, 24 nt, Human
ugcuuuuucuauacgaaccuggag

SEQ ID NO: 182360 - RNA, 22 nt, Human
uggagugagcguguggcgggag

SEQ ID NO: 182361 - RNA, 22 nt, Human
ugggcggccggcaggcagcagg

SEQ ID NO: 182362 - RNA, 18 nt, Human
uggucaugaaaacggcgg

SEQ ID NO: 182363 - RNA, 23 nt, Human
uguggccuucuggaaagcccggc

SEQ ID NO: 182364 - RNA, 26 nt, Human
uguucuguuuuuccuuucaaauucua

SEQ ID NO: 182365 - RNA, 21 nt, Human
uguuuuuuuuuuccaucuugu

SEQ ID NO: 182366 - RNA, 24 nt, Human
uuaagcuacaaagcacaugagaaa

SEQ ID NO: 182367 - RNA, 23 nt, Human
uuguuuucuauggggcuggauuu

SEQ ID NO: 182368 - RNA, 23 nt, Human
uuugcaagaaaaagaaauaugga

SEQ ID NO: 182369 - RNA, 23 nt, Human
aaagagagagagacagaaagaaa

SEQ ID NO: 182370 - RNA, 24 nt, Human
aaagagagagagacagaaagaaac

SEQ ID NO: 182371 - RNA, 19 nt, Human
aagaaaaaaagggaaauca

SEQ ID NO: 182372 - RNA, 23 nt, Human
aagaaaaagagagagagacagaa

SEQ ID NO: 182373 - RNA, 19 nt, Human
aaugugcugggacuguacu

SEQ ID NO: 182374 - RNA, 18 nt, Human
acacacacccucccgccu

SEQ ID NO: 182375 - RNA, 18 nt, Human
agaaaagaaaaagagaga

SEQ ID NO: 182376 - RNA, 18 nt, Human
agaaagaaacaagucuua

SEQ ID NO: 182377 - RNA, 22 nt, Human
agcgggggaagaaaaaaaggga

SEQ ID NO: 182378 - RNA, 21 nt, Human
auagaaaagaaaaagagagag

SEQ ID NO: 182379 - RNA, 19 nt, Human
auuaugcaaauuguuuucc

SEQ ID NO: 182380 - RNA, 22 nt, Human
cacacccucccgccucgcuccc

SEQ ID NO: 182381 - RNA, 19 nt, Human
cacagaguccaggacggca

SEQ ID NO: 182382 - RNA, 19 nt, Human
caccagggaagggcagggc

SEQ ID NO: 182383 - RNA, 24 nt, Human
cagccgcgcacacacacccucccg

SEQ ID NO: 182384 - RNA, 19 nt, Human
ccaggccggggccaccagg

SEQ ID NO: 182385 - RNA, 18 nt, Human
cccccgccgcccggucgc

SEQ ID NO: 182386 - RNA, 24 nt, Human
ccccgccgcccggucgcgcguccg

SEQ ID NO: 182387 - RNA, 20 nt, Human
cccgccggcaccccugcuca

SEQ ID NO: 182388 - RNA, 18 nt, Human
cccgggcacagcgcgggg

SEQ ID NO: 182389 - RNA, 19 nt, Human
ccgccgagcccccgccgcc

SEQ ID NO: 182390 - RNA, 19 nt, Human
ccgccgagcccccgccgcc

SEQ ID NO: 182391 - RNA, 20 nt, Human
ccgccgagcccccgccgccc

SEQ ID NO: 182392 - RNA, 23 nt, Human
ccgccgagcccccgccgcccggu

SEQ ID NO: 182393 - RNA, 19 nt, Human
ccgcgcacacacacccucc

SEQ ID NO: 182394 - RNA, 24 nt, Human
ccgcgcacacacacccucccgccu

SEQ ID NO: 182395 - RNA, 20 nt, Human
cgccucgcucccuugaggca

SEQ ID NO: 182396 - RNA, 21 nt, Human
cgggcacagcgcgggggcggc

SEQ ID NO: 182397 - RNA, 22 nt, Human
cugcagcccgccggcaccccug

SEQ ID NO: 182398 - RNA, 22 nt, Human
cuuccaaagugccuccgcugca

SEQ ID NO: 182399 - RNA, 22 nt, Human
gaaaaagagagagagacagaaa

SEQ ID NO: 182400 - RNA, 19 nt, Human
gacacgcucacacagaguc

SEQ ID NO: 182401 - RNA, 19 nt, Human
gcacacacacccucccgcc

SEQ ID NO: 182402 - RNA, 18 nt, Human
gcagcccgccggcacccc

SEQ ID NO: 182403 - RNA, 21 nt, Human
gccucgcucccuugaggcagc

SEQ ID NO: 182404 - RNA, 23 nt, Human
gcucacagccgcgcacacacacc

SEQ ID NO: 182405 - RNA, 20 nt, Human
ggcacagcgcgggggcggcg

SEQ ID NO: 182406 - RNA, 20 nt, Human
gggcacagcgcgggggcggc

SEQ ID NO: 182407 - RNA, 18 nt, Human
gggcgcggugggagcgga

SEQ ID NO: 182408 - RNA, 23 nt, Human
uacacugagucacaagguuugcc

SEQ ID NO: 182409 - RNA, 22 nt, Human
uagagaggaaaugugcugggaa

SEQ ID NO: 182410 - RNA, 19 nt, Human
uagcccaccagggaagggc

SEQ ID NO: 182411 - RNA, 20 nt, Human
uagcccaccagggaagggca

SEQ ID NO: 182412 - RNA, 23 nt, Human
uagcgggggaagaaaaaaaggga

SEQ ID NO: 182413 - RNA, 24 nt, Human
uaucuucaauagcccaccagggaa

SEQ ID NO: 182414 - RNA, 18 nt, Human
uccaaagugccuccgcug

SEQ ID NO: 182415 - RNA, 19 nt, Human
uccaaagugccuccgcugc

SEQ ID NO: 182416 - RNA, 19 nt, Human
uccacagaaauacaguccc

SEQ ID NO: 182417 - RNA, 20 nt, Human
ucccgggcacagcgcggggg

SEQ ID NO: 182418 - RNA, 22 nt, Human
uccgcugcagcccgccggcacc

SEQ ID NO: 182419 - RNA, 21 nt, Human
ugagaauuuaaaauacacuga

SEQ ID NO: 182420 - RNA, 19 nt, Human
ugccuaaaaaaagauagag

SEQ ID NO: 182421 - RNA, 23 nt, Human
uggccgccgagcccccgccgccc

SEQ ID NO: 182422 - RNA, 19 nt, Human
aaacauguggaaguugacu

SEQ ID NO: 182423 - RNA, 19 nt, Human
aacaucuaagcaagcugaa

SEQ ID NO: 182424 - RNA, 19 nt, Human
aacaucuaagcaagcugaa

SEQ ID NO: 182425 - RNA, 19 nt, Human
aaguucugucuccucccgg

SEQ ID NO: 182426 - RNA, 18 nt, Human
aauuuuuauuuugauuuu

SEQ ID NO: 182427 - RNA, 18 nt, Human
aauuuuuauuuugauuuu

SEQ ID NO: 182428 - RNA, 20 nt, Human
acaaggagaaucuggacggc

SEQ ID NO: 182429 - RNA, 19 nt, Human
accauguuguagcugcugc

SEQ ID NO: 182430 - RNA, 18 nt, Human
acccuaugaggugagaag

SEQ ID NO: 182431 - RNA, 18 nt, Human
acccuaugaggugagaag

SEQ ID NO: 182432 - RNA, 24 nt, Human
acgaaggugcaugcgcugaaugau

SEQ ID NO: 182433 - RNA, 25 nt, Human
acuccuucauccucccacagagccu

SEQ ID NO: 182434 - RNA, 19 nt, Human
acuuucucagcgagcagau

SEQ ID NO: 182435 - RNA, 24 nt, Human
acuuuuguggccuuuuuuccuuuu

SEQ ID NO: 182436 - RNA, 24 nt, Human
acuuuuguggccuuuuuuccuuuu

SEQ ID NO: 182437 - RNA, 20 nt, Human
agcaagaagaagggaugggg

SEQ ID NO: 182438 - RNA, 18 nt, Human
agcaccuaccuuccugac

SEQ ID NO: 182439 - RNA, 21 nt, Human
agcaccugaauccaugaaaac

SEQ ID NO: 182440 - RNA, 24 nt, Human
agcuggcccggaggucccagccuc

SEQ ID NO: 182441 - RNA, 19 nt, Human
aggaucacagagauggugc

SEQ ID NO: 182442 - RNA, 19 nt, Human
agggaacuuuuguggccuu

SEQ ID NO: 182443 - RNA, 19 nt, Human
agggaacuuuuguggccuu

SEQ ID NO: 182444 - RNA, 21 nt, Human
agggaugggaaaaaaggggaa

SEQ ID NO: 182445 - RNA, 26 nt, Human
caccacgaagaugauggcagucaacu

SEQ ID NO: 182446 - RNA, 19 nt, Human
caccugaauccaugaaaac

SEQ ID NO: 182447 - RNA, 21 nt, Human
cacugccaucgcuguugcucc

SEQ ID NO: 182448 - RNA, 21 nt, Human
caggcacgcacuccuucaucc

SEQ ID NO: 182449 - RNA, 24 nt, Human
cccacagagccuuggcaugcucag

SEQ ID NO: 182450 - RNA, 20 nt, Human
ccgaagcacauuggcugcug

SEQ ID NO: 182451 - RNA, 19 nt, Human
ccgguccucuugccuggga

SEQ ID NO: 182452 - RNA, 18 nt, Human
ccuccugcaggcgguugg

SEQ ID NO: 182453 - RNA, 23 nt, Human
ccucucugagcaagaagaaggga

SEQ ID NO: 182454 - RNA, 23 nt, Human
ccuggaacuuggucucaaagauu

SEQ ID NO: 182455 - RNA, 19 nt, Human
ccuuccugaccacuuaaga

SEQ ID NO: 182456 - RNA, 26 nt, Human
cgagcaaauucuggaaaguaguccuc

SEQ ID NO: 182457 - RNA, 26 nt, Human
cgcuguugcuccuugcagccugcggg

SEQ ID NO: 182458 - RNA, 23 nt, Human
cggaggucccagccucaccuccu

SEQ ID NO: 182459 - RNA, 18 nt, Human
cucaccuccuugugagga

SEQ ID NO: 182460 - RNA, 19 nt, Human
cuccacggggggcaccagg

SEQ ID NO: 182461 - RNA, 18 nt, Human
cucccgggcuccucucgc

SEQ ID NO: 182462 - RNA, 18 nt, Human
cucuucgccgcccucucc

SEQ ID NO: 182463 - RNA, 24 nt, Human
cuugccucucugagcaagaagaag

SEQ ID NO: 182464 - RNA, 23 nt, Human
cuugcuuguugaggaacaggauc

SEQ ID NO: 182465 - RNA, 21 nt, Human
cuuggcccgggucacgcgugg

SEQ ID NO: 182466 - RNA, 20 nt, Human
gaaaaagggaagcaccuacu

SEQ ID NO: 182467 - RNA, 20 nt, Human
gaagggaugggaaaaaaggg

SEQ ID NO: 182468 - RNA, 21 nt, Human
gacagaggagacugaggcgag

SEQ ID NO: 182469 - RNA, 21 nt, Human
gagcaagaagaagggauggga

SEQ ID NO: 182470 - RNA, 20 nt, Human
gauccucagaaacucaucuc

SEQ ID NO: 182471 - RNA, 23 nt, Human
gcagagagcggcuccgaagcaca

SEQ ID NO: 182472 - RNA, 18 nt, Human
gccuuuuuuccuuuuucu

SEQ ID NO: 182473 - RNA, 18 nt, Human
gccuuuuuuccuuuuucu

SEQ ID NO: 182474 - RNA, 22 nt, Human
gcggcggcggcggcggcggggc

SEQ ID NO: 182475 - RNA, 19 nt, Human
gcggcggcggcggcggggc

SEQ ID NO: 182476 - RNA, 22 nt, Human
gcggcggcggcggggcgcggcc

SEQ ID NO: 182477 - RNA, 23 nt, Human
ggacacggcagcgaagcaggucc

SEQ ID NO: 182478 - RNA, 20 nt, Human
ggaugaccauguuguagcug

SEQ ID NO: 182479 - RNA, 19 nt, Human
ggcccggaggucccagccu

SEQ ID NO: 182480 - RNA, 18 nt, Human
ggcggcggcggcggcggc

SEQ ID NO: 182481 - RNA, 19 nt, Human
ggcggcggcggcggcggcg

SEQ ID NO: 182482 - RNA, 19 nt, Human
ggcggcggcggcggcggcg

SEQ ID NO: 182483 - RNA, 30 nt, Human
ggggcgcggccgggcugcggcggcggcggg

SEQ ID NO: 182484 - RNA, 19 nt, Human
ggguccucuucgccgcccu

SEQ ID NO: 182485 - RNA, 21 nt, Human
ggugagaagcuggcccggagg

SEQ ID NO: 182486 - RNA, 20 nt, Human
gugcaugcgcugaaugaugu

SEQ ID NO: 182487 - RNA, 19 nt, Human
guuccagaugcucuugaag

SEQ ID NO: 182488 - RNA, 18 nt, Human
uaagaacuuucuaaagcu

SEQ ID NO: 182489 - RNA, 24 nt, Human
uaagcaagcugaagggaaaagggg

SEQ ID NO: 182490 - RNA, 24 nt, Human
uaagcaagcugaagggaaaagggg

SEQ ID NO: 182491 - RNA, 20 nt, Human
uaaugcugcacaacacaaua

SEQ ID NO: 182492 - RNA, 21 nt, Human
uaaugcugcacaacacaauau

SEQ ID NO: 182493 - RNA, 24 nt, Human
uacaauuacguuucacuuuuaauu

SEQ ID NO: 182494 - RNA, 24 nt, Human
uacaauuacguuucacuuuuaauu

SEQ ID NO: 182495 - RNA, 18 nt, Human
uacuuggcccgggucacg

SEQ ID NO: 182496 - RNA, 25 nt, Human
uagauuccgcagccuaagacucgag

SEQ ID NO: 182497 - RNA, 23 nt, Human
ucacucgggggaagggaaagguu

SEQ ID NO: 182498 - RNA, 23 nt, Human
ucacucgggggaagggaaagguu

SEQ ID NO: 182499 - RNA, 24 nt, Human
ucacucgggggaagggaaagguug

SEQ ID NO: 182500 - RNA, 24 nt, Human
ucacucgggggaagggaaagguug

SEQ ID NO: 182501 - RNA, 25 nt, Human
uccgggcucgggaguagcauccucc

SEQ ID NO: 182502 - RNA, 24 nt, Human
uccucuucgccgcccucuccauua

SEQ ID NO: 182503 - RNA, 24 nt, Human
uccuuuuucuguaggccgccuuaa

SEQ ID NO: 182504 - RNA, 24 nt, Human
uccuuuuucuguaggccgccuuaa

SEQ ID NO: 182505 - RNA, 18 nt, Human
ucucaaagauuccagaag

SEQ ID NO: 182506 - RNA, 23 nt, Human
ucucaaagauuccagaagucagg

SEQ ID NO: 182507 - RNA, 21 nt, Human
ucuccacuggcagugcugauc

SEQ ID NO: 182508 - RNA, 19 nt, Human
ucuccagcaccugaaucca

SEQ ID NO: 182509 - RNA, 22 nt, Human
ucucgaaugaaguacuuggccc

SEQ ID NO: 182510 - RNA, 21 nt, Human
ucugcagagagcggcuccgaa

SEQ ID NO: 182511 - RNA, 20 nt, Human
ucugucuccucccgggcucc

SEQ ID NO: 182512 - RNA, 23 nt, Human
ucuuagauuccgcagccuaagac

SEQ ID NO: 182513 - RNA, 20 nt, Human
ugacgaaggugcaugcgcug

SEQ ID NO: 182514 - RNA, 19 nt, Human
ugaggugagaagcuggccc

SEQ ID NO: 182515 - RNA, 21 nt, Human
ugaggugagaagcuggcccgg

SEQ ID NO: 182516 - RNA, 22 nt, Human
ugagucuuagauuccgcagccu

SEQ ID NO: 182517 - RNA, 24 nt, Human
ugaucacgucgaucuuguccagga

SEQ ID NO: 182518 - RNA, 18 nt, Human
ugccaucgcuguugcucc

SEQ ID NO: 182519 - RNA, 23 nt, Human
uggcagugcugauccucagaaac

SEQ ID NO: 182520 - RNA, 24 nt, Human
uggcagugcugauccucagaaacu

SEQ ID NO: 182521 - RNA, 19 nt, Human
uggcaugcucauagaauuc

SEQ ID NO: 182522 - RNA, 20 nt, Human
uggcccggaggucccagccu

SEQ ID NO: 182523 - RNA, 22 nt, Human
ugggagaggacagaggagacug

SEQ ID NO: 182524 - RNA, 24 nt, Human
uggugcgcagccaucuguuguucc

SEQ ID NO: 182525 - RNA, 18 nt, Human
uggugggugauuaacugc

SEQ ID NO: 182526 - RNA, 18 nt, Human
uggugggugauuaacugc

SEQ ID NO: 182527 - RNA, 24 nt, Human
ugucacggcagucguugaacacac

SEQ ID NO: 182528 - RNA, 25 nt, Human
ugucacggcagucguugaacacacg

SEQ ID NO: 182529 - RNA, 22 nt, Human
uguggccuuuuuuccuuuuucu

SEQ ID NO: 182530 - RNA, 22 nt, Human
uguggccuuuuuuccuuuuucu

SEQ ID NO: 182531 - RNA, 23 nt, Human
uguugaggaacaggaucacagag

SEQ ID NO: 182532 - RNA, 25 nt, Human
uuaauuuuuauuuugauuuuuuuua

SEQ ID NO: 182533 - RNA, 20 nt, Human
uugauguccugcacuuuggu

SEQ ID NO: 182534 - RNA, 24 nt, Human
uugcuccuugcagccugcgggucc

SEQ ID NO: 182535 - RNA, 23 nt, Human
uuggaacaucuaagcaagcugaa

SEQ ID NO: 182536 - RNA, 21 nt, Human
uuggucucaaagauuccagaa

SEQ ID NO: 182537 - RNA, 26 nt, Human
uuuaauuuuuauuuugauuuuuuuua

SEQ ID NO: 182538 - RNA, 26 nt, Human
uuuaauuuuuauuuugauuuuuuuua

SEQ ID NO: 182539 - RNA, 23 nt, Human
uuuguggccuuuuuuccuuuuuc

SEQ ID NO: 182540 - RNA, 23 nt, Human
uuuguggccuuuuuuccuuuuuc

SEQ ID NO: 182541 - RNA, 24 nt, Human
uuuguggccuuuuuuccuuuuucu

SEQ ID NO: 182542 - RNA, 24 nt, Human
uuuguggccuuuuuuccuuuuucu

SEQ ID NO: 182543 - RNA, 27 nt, Human
uuuguuugcugcugcuguuuuauuuau

SEQ ID NO: 182544 - RNA, 23 nt, Human
uuuuaccagauucuccagcaccu

SEQ ID NO: 182545 - RNA, 23 nt, Human
uuuuguggccuuuuuuccuuuuu

SEQ ID NO: 182546 - RNA, 23 nt, Human
uuuuguggccuuuuuuccuuuuu

SEQ ID NO: 182547 - RNA, 19 nt, Human
agcaggugguucuucugga

SEQ ID NO: 182548 - RNA, 23 nt, Human
cagcagcaggcgaagggacagag

SEQ ID NO: 182549 - RNA, 20 nt, Human
cccgacugcagcacaggccc

SEQ ID NO: 182550 - RNA, 22 nt, Human
ccucccaggcacccuucuggcc

SEQ ID NO: 182551 - RNA, 22 nt, Human
cgaagggacagagugagcaggu

SEQ ID NO: 182552 - RNA, 18 nt, Human
cucccaggcacccuucug

SEQ ID NO: 182553 - RNA, 24 nt, Human
gagcaggugguucuucuggaugga

SEQ ID NO: 182554 - RNA, 21 nt, Human
gcaggcgaagggacagaguga

SEQ ID NO: 182555 - RNA, 19 nt, Human
gccccaggaggaccugcaa

SEQ ID NO: 182556 - RNA, 19 nt, Human
ggagugcaaauugugcccc

SEQ ID NO: 182557 - RNA, 21 nt, Human
ggauggaggggauccccagaa

SEQ ID NO: 182558 - RNA, 21 nt, Human
ggggagugcaaauugugcccc

SEQ ID NO: 182559 - RNA, 21 nt, Human
ucccaggcacccuucuggccc

SEQ ID NO: 182560 - RNA, 22 nt, Human
ucccaggcacccuucuggcccc

SEQ ID NO: 182561 - RNA, 25 nt, Human
uccccagaaccuggccucccaggca

SEQ ID NO: 182562 - RNA, 23 nt, Human
uccccgacugcagcacaggcccu

SEQ ID NO: 182563 - RNA, 18 nt, Human
uggccucccaggcacccu

SEQ ID NO: 182564 - RNA, 19 nt, Human
acuccaucuccaaagaaug

SEQ ID NO: 182565 - RNA, 22 nt, Human
caacuuggcuccccuaaaagcu

SEQ ID NO: 182566 - RNA, 22 nt, Human
caguuuuguauuaaguuggaaa

SEQ ID NO: 182567 - RNA, 20 nt, Human
ccaguacuggaaccugugcu

SEQ ID NO: 182568 - RNA, 21 nt, Human
ccaucuccaaagaauggauuc

SEQ ID NO: 182569 - RNA, 19 nt, Human
cgauggcaggugagagagc

SEQ ID NO: 182570 - RNA, 21 nt, Human
gagacucccuacuucaacugg

SEQ ID NO: 182571 - RNA, 24 nt, Human
guagggucuuguacucugccuaca

SEQ ID NO: 182572 - RNA, 19 nt, Human
ucuccaaagaauggauuca

SEQ ID NO: 182573 - RNA, 18 nt, Human
ugaaaagaacguaugaaa

SEQ ID NO: 182574 - RNA, 19 nt, Human
ugaaaagaacguaugaaau

SEQ ID NO: 182575 - RNA, 19 nt, Human
ugagauggaagagaaggaa

SEQ ID NO: 182576 - RNA, 20 nt, Human
ugcaauagcuaucccacuuu

SEQ ID NO: 182577 - RNA, 23 nt, Human
uggaaaaccaguacuggaaccug

SEQ ID NO: 182578 - RNA, 22 nt, Human
uggaagagaaggaaaaaaguug

SEQ ID NO: 182579 - RNA, 23 nt, Human
ugggauugaguaucccaacuugg

SEQ ID NO: 182580 - RNA, 19 nt, Human
uugaguaucccaacuuggc

SEQ ID NO: 182581 - RNA, 24 nt, Human
uuucaggccccuaauccucucucg

SEQ ID NO: 182582 - RNA, 31 nt, Human
aaaaaaaaaaaaaaaccaaaaaacaaaaaag

SEQ ID NO: 182583 - RNA, 23 nt, Human
aaaaaaaaccaaaaaacaaaaaa

SEQ ID NO: 182584 - RNA, 23 nt, Human
aaaaaaaccaaaaaacaaaaaac

SEQ ID NO: 182585 - RNA, 26 nt, Human
aaaaaacaaaaaaaaaugccagagaa

SEQ ID NO: 182586 - RNA, 26 nt, Human
aaaaaacaaaaaacaaaaaaaaaugc

SEQ ID NO: 182587 - RNA, 22 nt, Human
aaaaaagaccaccugaaaaaaa

SEQ ID NO: 182588 - RNA, 22 nt, Human
aaaacaaaaaaaaaugccagag

SEQ ID NO: 182589 - RNA, 23 nt, Human
aaaacaaaaaaaaaugccagaga

SEQ ID NO: 182590 - RNA, 29 nt, Human
aaacaaaaaacaaaaaaaaaugccagagg

SEQ ID NO: 182591 - RNA, 19 nt, Human
aaacaaagcagaaaacccc

SEQ ID NO: 182592 - RNA, 19 nt, Human
aaccaaaaaacaaaaaaca

SEQ ID NO: 182593 - RNA, 20 nt, Human
aaccaaaaaacaaaaaacaa

SEQ ID NO: 182594 - RNA, 21 nt, Human
aaccaaaaaacaaaaaacaaa

SEQ ID NO: 182595 - RNA, 26 nt, Human
aaccaaaaaacaaaaaacaaaaaaaa

SEQ ID NO: 182596 - RNA, 19 nt, Human
aagaauacucaacugcauu

SEQ ID NO: 182597 - RNA, 21 nt, Human
aagacacuuagcuauuguuca

SEQ ID NO: 182598 - RNA, 19 nt, Human
aagcuguuuuuuaaaaaga

SEQ ID NO: 182599 - RNA, 24 nt, Human
acaaaaaagaccaccugaaaaaaa

SEQ ID NO: 182600 - RNA, 23 nt, Human
acauucuuuaggcccccuguuuu

SEQ ID NO: 182601 - RNA, 24 nt, Human
acucagcaaagccacaaauaauuu

SEQ ID NO: 182602 - RNA, 18 nt, Human
acugcagaggcuuaugua

SEQ ID NO: 182603 - RNA, 22 nt, Human
agaaggaaaaccagguuuugau

SEQ ID NO: 182604 - RNA, 22 nt, Human
agacacaaaaaagaccaccuga

SEQ ID NO: 182605 - RNA, 18 nt, Human
agacacuuagcuauuguu

SEQ ID NO: 182606 - RNA, 21 nt, Human
agagacagaucguccagauaa

SEQ ID NO: 182607 - RNA, 22 nt, Human
agcaagccagacacaaaaaaga

SEQ ID NO: 182608 - RNA, 22 nt, Human
aggcagaggccaaggggugggg

SEQ ID NO: 182609 - RNA, 24 nt, Human
aggcagaggccaagggguggggga

SEQ ID NO: 182610 - RNA, 19 nt, Human
aggcaggcgccccgggccc

SEQ ID NO: 182611 - RNA, 23 nt, Human
aggccagagcucgggcagcgagc

SEQ ID NO: 182612 - RNA, 22 nt, Human
aggcgcggggcaugcugggacc

SEQ ID NO: 182613 - RNA, 19 nt, Human
agucuucaagagaccucga

SEQ ID NO: 182614 - RNA, 21 nt, Human
auaggcaggcgccccgggccc

SEQ ID NO: 182615 - RNA, 22 nt, Human
augugugugugugcaugugugu

SEQ ID NO: 182616 - RNA, 22 nt, Human
augugugugugugcaugugugu

SEQ ID NO: 182617 - RNA, 32 nt, Human
caaaaaaaaaaaaaaaaccaaaaaacaaaaaa

SEQ ID NO: 182618 - RNA, 26 nt, Human
caaaaaacaaaaaaaaaugccagaga

SEQ ID NO: 182619 - RNA, 20 nt, Human
caaagcagaaaaccccaccc

SEQ ID NO: 182620 - RNA, 18 nt, Human
caagccagacacaaaaaa

SEQ ID NO: 182621 - RNA, 24 nt, Human
cacaaaaaagaccaccugaaaaaa

SEQ ID NO: 182622 - RNA, 24 nt, Human
cacagacccugcacugguccuccc

SEQ ID NO: 182623 - RNA, 18 nt, Human
caccauaggcaggcgccc

SEQ ID NO: 182624 - RNA, 18 nt, Human
caccauuaacaagaggac

SEQ ID NO: 182625 - RNA, 23 nt, Human
cagaaaaccccaccauuaacaag

SEQ ID NO: 182626 - RNA, 22 nt, Human
cagaaugaaauggugcugagca

SEQ ID NO: 182627 - RNA, 22 nt, Human
cagcagggaaggugcacagacc

SEQ ID NO: 182628 - RNA, 21 nt, Human
cagcuacugcacagagagagg

SEQ ID NO: 182629 - RNA, 21 nt, Human
caggggcaccaccccuugcuc

SEQ ID NO: 182630 - RNA, 19 nt, Human
caggguauuuuauuuucuu

SEQ ID NO: 182631 - RNA, 18 nt, Human
cagggucccagcagggcc

SEQ ID NO: 182632 - RNA, 24 nt, Human
ccaaaaaaaaaaaaaaaaccaaaa

SEQ ID NO: 182633 - RNA, 21 nt, Human
ccagaaugaaauggugcugag

SEQ ID NO: 182634 - RNA, 21 nt, Human
cccaccauuaacaagaggagg

SEQ ID NO: 182635 - RNA, 23 nt, Human
ccccaccauuaacaagaggacac

SEQ ID NO: 182636 - RNA, 31 nt, Human
ccccuugcuccccuuccuucacucagcaaaa

SEQ ID NO: 182637 - RNA, 20 nt, Human
cccugcacugguccucccuc

SEQ ID NO: 182638 - RNA, 18 nt, Human
ccggcagugccucuccuc

SEQ ID NO: 182639 - RNA, 18 nt, Human
ccuaggccagagcucggg

SEQ ID NO: 182640 - RNA, 19 nt, Human
ccuccaggugacaggggug

SEQ ID NO: 182641 - RNA, 22 nt, Human
ccucccucaggccacaacgcug

SEQ ID NO: 182642 - RNA, 22 nt, Human
cggcuccuaaggucccaggucc

SEQ ID NO: 182643 - RNA, 22 nt, Human
cucagcaagccagacacaaaaa

SEQ ID NO: 182644 - RNA, 21 nt, Human
cuccggcagugccucuccucu

SEQ ID NO: 182645 - RNA, 23 nt, Human
cugaaaaaaaauauguuuugaaa

SEQ ID NO: 182646 - RNA, 20 nt, Human
cugguccucccucuugguca

SEQ ID NO: 182647 - RNA, 19 nt, Human
cugugauuccgcacacuga

SEQ ID NO: 182648 - RNA, 21 nt, Human
cuucacguccuuggcugugau

SEQ ID NO: 182649 - RNA, 20 nt, Human
cuuuaggcccccuguuuucu

SEQ ID NO: 182650 - RNA, 22 nt, Human
gaaaaaaaauauguuuugaaaa

SEQ ID NO: 182651 - RNA, 26 nt, Human
gaaacaccacgagauuuggccaaaaa

SEQ ID NO: 182652 - RNA, 21 nt, Human
gaggcagaggccaaggggugg

SEQ ID NO: 182653 - RNA, 23 nt, Human
gcagggccucccucaggccacaa

SEQ ID NO: 182654 - RNA, 19 nt, Human
gccaaaaaaaaaaaaaaaa

SEQ ID NO: 182655 - RNA, 20 nt, Human
gcccagaucagggucccagc

SEQ ID NO: 182656 - RNA, 18 nt, Human
gcccugggacaggaaggc

SEQ ID NO: 182657 - RNA, 20 nt, Human
gcccugggacaggaaggccc

SEQ ID NO: 182658 - RNA, 18 nt, Human
gcggggcaugcugggacc

SEQ ID NO: 182659 - RNA, 20 nt, Human
gcuccggcagugccucuccu

SEQ ID NO: 182660 - RNA, 21 nt, Human
gcugugauuccgcacacugac

SEQ ID NO: 182661 - RNA, 18 nt, Human
ggaaggugcacagacccu

SEQ ID NO: 182662 - RNA, 20 nt, Human
ggccaacucaggaaggcaaa

SEQ ID NO: 182663 - RNA, 24 nt, Human
ggggcaugcugggaccaggggcac

SEQ ID NO: 182664 - RNA, 18 nt, Human
ggggccaaggaggcagag

SEQ ID NO: 182665 - RNA, 20 nt, Human
ggugcacagacccugcacug

SEQ ID NO: 182666 - RNA, 19 nt, Human
guggguuucaccauaggca

SEQ ID NO: 182667 - RNA, 19 nt, Human
gugugugcaugugugugug

SEQ ID NO: 182668 - RNA, 23 nt, Human
uaaaaacaaagcagaaaacccca

SEQ ID NO: 182669 - RNA, 18 nt, Human
uaaaaagagcugugagug

SEQ ID NO: 182670 - RNA, 21 nt, Human
uaacaagaggacacugcagag

SEQ ID NO: 182671 - RNA, 22 nt, Human
uagaagaaaagcuggaauccca

SEQ ID NO: 182672 - RNA, 24 nt, Human
uagaggauuuugccaucuccagau

SEQ ID NO: 182673 - RNA, 21 nt, Human
ucaggcgcggggcaugcuggg

SEQ ID NO: 182674 - RNA, 22 nt, Human
ucccaggugaaagaaccuucuu

SEQ ID NO: 182675 - RNA, 23 nt, Human
uccccagcuucucuuucccccgu

SEQ ID NO: 182676 - RNA, 23 nt, Human
ugaaaaaaaauauguuuugaaaa

SEQ ID NO: 182677 - RNA, 24 nt, Human
ugacaccccguggguuucaccaua

SEQ ID NO: 182678 - RNA, 22 nt, Human
ugagcagcugugugcaggccag

SEQ ID NO: 182679 - RNA, 18 nt, Human
ugcauauuuugaagcugu

SEQ ID NO: 182680 - RNA, 22 nt, Human
ugcauuugaaauuuucuggauu

SEQ ID NO: 182681 - RNA, 18 nt, Human
ugccagagaaggaaaacc

SEQ ID NO: 182682 - RNA, 21 nt, Human
ugccucagcccugcugccuau

SEQ ID NO: 182683 - RNA, 25 nt, Human
uggccaaaaaaaaaaaaaaaaccaa

SEQ ID NO: 182684 - RNA, 20 nt, Human
uggcugugauuccgcacacu

SEQ ID NO: 182685 - RNA, 20 nt, Human
ugggaccaggggcaccaccc

SEQ ID NO: 182686 - RNA, 21 nt, Human
ugugauuccgcacacugaccu

SEQ ID NO: 182687 - RNA, 19 nt, Human
ugugugugugcaugugugu

SEQ ID NO: 182688 - RNA, 20 nt, Human
ugugugugugcaugugugug

SEQ ID NO: 182689 - RNA, 21 nt, Human
ugugugugugugcaugugugu

SEQ ID NO: 182690 - RNA, 22 nt, Human
ugugugugugugcaugugugug

SEQ ID NO: 182691 - RNA, 22 nt, Human
ugugugugugugcaugugugug

SEQ ID NO: 182692 - RNA, 22 nt, Human
uguuguauugguuuuugcugca

SEQ ID NO: 182693 - RNA, 19 nt, Human
uguuugcagaaaugugggg

SEQ ID NO: 182694 - RNA, 21 nt, Human
uugacuuucauccaaucccca

SEQ ID NO: 182695 - RNA, 23 nt, Human
uuggccaaaaaaaaaaaaaaaac

SEQ ID NO: 182696 - RNA, 21 nt, Human
uuuacacucagcaagccagac

SEQ ID NO: 182697 - RNA, 21 nt, Human
uuugccaucuccagaugugug

SEQ ID NO: 182698 - RNA, 25 nt, Human
aaaaaggaaauaugaaugcuuccaa

SEQ ID NO: 182699 - RNA, 26 nt, Human
aaaaaggaaauaugaaugcuuccaaa

SEQ ID NO: 182700 - RNA, 27 nt, Human
aaaaaggaaauaugaaugcuuccaaaa

SEQ ID NO: 182701 - RNA, 20 nt, Human
aaaacaaagacgauggcccc

SEQ ID NO: 182702 - RNA, 23 nt, Human
aaagaaaaagaacaccuaaggac

SEQ ID NO: 182703 - RNA, 23 nt, Human
aaagaacaccuaaggacugaguc

SEQ ID NO: 182704 - RNA, 18 nt, Human
aacaaagcccucagcaug

SEQ ID NO: 182705 - RNA, 20 nt, Human
aaccugcuuuccaaacgcug

SEQ ID NO: 182706 - RNA, 21 nt, Human
aagaaaaagaacaccuaagga

SEQ ID NO: 182707 - RNA, 25 nt, Human
aagaaaacaaagacgauggccccgg

SEQ ID NO: 182708 - RNA, 25 nt, Human
aagacaaaaaagaaaacaaagacga

SEQ ID NO: 182709 - RNA, 24 nt, Human
aauaaagaaaacagugacuuaucc

SEQ ID NO: 182710 - RNA, 24 nt, Human
aauacaaaagguggaaagggguaa

SEQ ID NO: 182711 - RNA, 21 nt, Human
aauauggcaaacaaucaaaau

SEQ ID NO: 182712 - RNA, 18 nt, Human
acaaaaaagaaaacaaag

SEQ ID NO: 182713 - RNA, 23 nt, Human
acaaaaaagaaaacaaagacgau

SEQ ID NO: 182714 - RNA, 23 nt, Human
acaaaacagggucacuggucuaa

SEQ ID NO: 182715 - RNA, 28 nt, Human
acagagcagcaacgagaaguggacagag

SEQ ID NO: 182716 - RNA, 22 nt, Human
acaucagagaggcugcccuaga

SEQ ID NO: 182717 - RNA, 23 nt, Human
agaaaacaggauggagaagccac

SEQ ID NO: 182718 - RNA, 24 nt, Human
agaagauagacaggaugggucagg

SEQ ID NO: 182719 - RNA, 24 nt, Human
agacaaaaaagaaaacaaagacga

SEQ ID NO: 182720 - RNA, 26 nt, Human
agacaaaaaagaaaacaaaggggacc

SEQ ID NO: 182721 - RNA, 22 nt, Human
agacagaaaauuaaaaaccagg

SEQ ID NO: 182722 - RNA, 23 nt, Human
agacagaaaauuaaaaaccaggg

SEQ ID NO: 182723 - RNA, 21 nt, Human
agacgauggccccggaaggaa

SEQ ID NO: 182724 - RNA, 21 nt, Human
agcacagagaucuuucucuca

SEQ ID NO: 182725 - RNA, 21 nt, Human
agcacaggacaggcaucucuc

SEQ ID NO: 182726 - RNA, 24 nt, Human
aggaggaacauggugcuggaucug

SEQ ID NO: 182727 - RNA, 20 nt, Human
aggaggaacauggugcuggg

SEQ ID NO: 182728 - RNA, 24 nt, Human
agugcggggggcggggcggggggu

SEQ ID NO: 182729 - RNA, 20 nt, Human
auacaaaagguggaaagggg

SEQ ID NO: 182730 - RNA, 22 nt, Human
aucccgcuacccaagcguguag

SEQ ID NO: 182731 - RNA, 18 nt, Human
augaaugcuuccaaaauc

SEQ ID NO: 182732 - RNA, 23 nt, Human
auggcuucugaacauguucuuuu

SEQ ID NO: 182733 - RNA, 20 nt, Human
caacaucagagaggcugccc

SEQ ID NO: 182734 - RNA, 24 nt, Human
caagacaaaaaagaaaacaaagac

SEQ ID NO: 182735 - RNA, 21 nt, Human
cacucgccgcccgcucccgcc

SEQ ID NO: 182736 - RNA, 27 nt, Human
cagagcagcaacgagaaguggacagag

SEQ ID NO: 182737 - RNA, 20 nt, Human
cagauccaggccuaccgcaa

SEQ ID NO: 182738 - RNA, 18 nt, Human
cauggcuucugaacaugu

SEQ ID NO: 182739 - RNA, 25 nt, Human
ccaacagcagucguuugcaacagaa

SEQ ID NO: 182740 - RNA, 22 nt, Human
ccacaaaacagggucacugguc

SEQ ID NO: 182741 - RNA, 19 nt, Human
ccacccaauauggcaaaca

SEQ ID NO: 182742 - RNA, 19 nt, Human
ccaggccuaccgcaagguc

SEQ ID NO: 182743 - RNA, 22 nt, Human
ccagggacugaauuuacaucau

SEQ ID NO: 182744 - RNA, 24 nt, Human
cccaagcguguagagccgcgcgcu

SEQ ID NO: 182745 - RNA, 21 nt, Human
cccacaccgccgccucggccg

SEQ ID NO: 182746 - RNA, 20 nt, Human
cccacagaaccugcuuucca

SEQ ID NO: 182747 - RNA, 22 nt, Human
cccacagaaccugcuuuccaaa

SEQ ID NO: 182748 - RNA, 24 nt, Human
cccacagaaccugcuuuccaaacg

SEQ ID NO: 182749 - RNA, 20 nt, Human
cccacucgccgcccgcuccc

SEQ ID NO: 182750 - RNA, 21 nt, Human
ccccgcaugugcuuggccccu

SEQ ID NO: 182751 - RNA, 22 nt, Human
ccccgcuccccacucgccgccc

SEQ ID NO: 182752 - RNA, 18 nt, Human
cccggccccgcuccccac

SEQ ID NO: 182753 - RNA, 21 nt, Human
cccuccccacccucagaaucc

SEQ ID NO: 182754 - RNA, 21 nt, Human
cccucccucucucucccuccc

SEQ ID NO: 182755 - RNA, 21 nt, Human
cccucccucucucucccuccc

SEQ ID NO: 182756 - RNA, 20 nt, Human
ccgcaaggucacagcacagu

SEQ ID NO: 182757 - RNA, 18 nt, Human
ccgccgccgccgccgccg

SEQ ID NO: 182758 - RNA, 20 nt, Human
ccgccgccgccgccgccgcc

SEQ ID NO: 182759 - RNA, 18 nt, Human
ccgccgccgccgccuccg

SEQ ID NO: 182760 - RNA, 21 nt, Human
ccgccgccgccuccguccgcc

SEQ ID NO: 182761 - RNA, 22 nt, Human
ccgccgccgccuccguccgccc

SEQ ID NO: 182762 - RNA, 23 nt, Human
ccgccgccgccuccguccgcccc

SEQ ID NO: 182763 - RNA, 19 nt, Human
ccgccgccucggccgccgc

SEQ ID NO: 182764 - RNA, 20 nt, Human
ccgccgccucggccgccgcu

SEQ ID NO: 182765 - RNA, 21 nt, Human
ccucagaauccaacagcaguc

SEQ ID NO: 182766 - RNA, 21 nt, Human
ccuccguccgccccucagacg

SEQ ID NO: 182767 - RNA, 20 nt, Human
ccuuuugaaguucugagggg

SEQ ID NO: 182768 - RNA, 18 nt, Human
cgccgcccgcucccgcuc

SEQ ID NO: 182769 - RNA, 23 nt, Human
cgccgccgccgccgccgccuccg

SEQ ID NO: 182770 - RNA, 18 nt, Human
cgcgcccacaccgccgcc

SEQ ID NO: 182771 - RNA, 21 nt, Human
cgcucccgccgccgccgccgc

SEQ ID NO: 182772 - RNA, 18 nt, Human
cggccugacgcgcccaca

SEQ ID NO: 182773 - RNA, 19 nt, Human
cggggggucccacagaacc

SEQ ID NO: 182774 - RNA, 23 nt, Human
cuccacucccggccccgcucccc

SEQ ID NO: 182775 - RNA, 23 nt, Human
cuccauggcauccacaugcuacu

SEQ ID NO: 182776 - RNA, 24 nt, Human
cucccgccgccgccgccgccgccu

SEQ ID NO: 182777 - RNA, 23 nt, Human
cugacgcgcccacaccgccgccu

SEQ ID NO: 182778 - RNA, 20 nt, Human
gagcagcaacgagaagugga

SEQ ID NO: 182779 - RNA, 18 nt, Human
gagccaccucagaugugg

SEQ ID NO: 182780 - RNA, 22 nt, Human
gagccgcgcgcuguacugcuuc

SEQ ID NO: 182781 - RNA, 21 nt, Human
gcucggcaggucgucgcgcuc

SEQ ID NO: 182782 - RNA, 24 nt, Human
ggacugaauuuacaucauugacaa

SEQ ID NO: 182783 - RNA, 18 nt, Human
ggagugcggggggcgggg

SEQ ID NO: 182784 - RNA, 21 nt, Human
gggcuucuggucuggucucca

SEQ ID NO: 182785 - RNA, 30 nt, Human
gggucaggaggaacauggugcuggaucugg

SEQ ID NO: 182786 - RNA, 24 nt, Human
guccccgcaugugcuuggccccau

SEQ ID NO: 182787 - RNA, 20 nt, Human
gugcagagagcucuacagag

SEQ ID NO: 182788 - RNA, 19 nt, Human
guuugugugcaacaaugau

SEQ ID NO: 182789 - RNA, 19 nt, Human
uaaaaaggaaauaugaaug

SEQ ID NO: 182790 - RNA, 20 nt, Human
uaaaauuaaauacaaaaggu

SEQ ID NO: 182791 - RNA, 22 nt, Human
uaaagaaaacagugacuuaucc

SEQ ID NO: 182792 - RNA, 21 nt, Human
uaaauuugucucagcgcccuc

SEQ ID NO: 182793 - RNA, 24 nt, Human
uaagaguaaacccacccaauaugg

SEQ ID NO: 182794 - RNA, 27 nt, Human
uacagaguuguuggacggaaagagaaa

SEQ ID NO: 182795 - RNA, 22 nt, Human
uagaauguugcagaaaacagga

SEQ ID NO: 182796 - RNA, 24 nt, Human
uaggagggcaggcucuucacuccc

SEQ ID NO: 182797 - RNA, 18 nt, Human
uaugccacguuugugugc

SEQ ID NO: 182798 - RNA, 20 nt, Human
ucaagacaaaaaagaaaaca

SEQ ID NO: 182799 - RNA, 19 nt, Human
uccccgcaugugcuuggcc

SEQ ID NO: 182800 - RNA, 21 nt, Human
ucccgccgccgccgccgccgc

SEQ ID NO: 182801 - RNA, 19 nt, Human
ucccgcuacccaagcgugu

SEQ ID NO: 182802 - RNA, 24 nt, Human
ucccgcucccgccgccgccgccgc

SEQ ID NO: 182803 - RNA, 22 nt, Human
ucccucucucucccuccccacc

SEQ ID NO: 182804 - RNA, 18 nt, Human
uccgcgggcgcugcgggc

SEQ ID NO: 182805 - RNA, 19 nt, Human
ucggccgccgcucggcagg

SEQ ID NO: 182806 - RNA, 23 nt, Human
ucucucccuccccacccucagaa

SEQ ID NO: 182807 - RNA, 20 nt, Human
ucugacaauuacacucaagu

SEQ ID NO: 182808 - RNA, 24 nt, Human
ucugagaucauuauuuucaaaaca

SEQ ID NO: 182809 - RNA, 18 nt, Human
ugaacacuggccuugaaa

SEQ ID NO: 182810 - RNA, 18 nt, Human
ugaaggaaaaaagaucuu

SEQ ID NO: 182811 - RNA, 19 nt, Human
ugaaggagugcggggggcg

SEQ ID NO: 182812 - RNA, 21 nt, Human
ugaaguucugaggggaggugu

SEQ ID NO: 182813 - RNA, 20 nt, Human
ugacaacaucagagaggcug

SEQ ID NO: 182814 - RNA, 25 nt, Human
ugacugaaauuuggacacgaugacc

SEQ ID NO: 182815 - RNA, 20 nt, Human
ugacuuaucccgcuacccaa

SEQ ID NO: 182816 - RNA, 22 nt, Human
ugagaagauagacaggaugggu

SEQ ID NO: 182817 - RNA, 24 nt, Human
ugagaagauagacaggauggguca

SEQ ID NO: 182818 - RNA, 24 nt, Human
ugagaucauuauuuucaaaacauu

SEQ ID NO: 182819 - RNA, 21 nt, Human
ugccacagagcagcaacgaga

SEQ ID NO: 182820 - RNA, 19 nt, Human
ugcccuagacucucugguu

SEQ ID NO: 182821 - RNA, 20 nt, Human
ugcggggggcggggcggggg

SEQ ID NO: 182822 - RNA, 21 nt, Human
uggaaaagugugucugucuga

SEQ ID NO: 182823 - RNA, 18 nt, Human
uggaaagggguaagggug

SEQ ID NO: 182824 - RNA, 21 nt, Human
uggacggaaagagaaagaagg

SEQ ID NO: 182825 - RNA, 19 nt, Human
ugggucaggaggaacaugg

SEQ ID NO: 182826 - RNA, 21 nt, Human
ugguaacgcguccaaguugga

SEQ ID NO: 182827 - RNA, 20 nt, Human
ugugaugggaaugagccacc

SEQ ID NO: 182828 - RNA, 20 nt, Human
uguugaacacaaaggaauac

SEQ ID NO: 182829 - RNA, 21 nt, Human
uguugcagaaaacaggaugga

SEQ ID NO: 182830 - RNA, 22 nt, Human
uguugcagaaaacaggauggag

SEQ ID NO: 182831 - RNA, 21 nt, Human
uucuaugccacguuugugugc

SEQ ID NO: 182832 - RNA, 24 nt, Human
uucucugaucacgcauuugagacc

SEQ ID NO: 182833 - RNA, 20 nt, Human
uugaaaacagagguuccucc

SEQ ID NO: 182834 - RNA, 20 nt, Human
uuggacggaaagagaaagaa

SEQ ID NO: 182835 - RNA, 19 nt, Human
uuugagcauuucuacagca

SEQ ID NO: 182836 - RNA, 20 nt, Human
uuugugugcaacaaugaucu

SEQ ID NO: 182837 - RNA, 24 nt, Human
uuuugaaguucugaggggaggugu

SEQ ID NO: 182838 - RNA, 20 nt, Human
uuuuuuuuuuuuaaagaaau

SEQ ID NO: 182839 - RNA, 30 nt, Human
aaaaagccagccccugggguuuccaccucu

SEQ ID NO: 182840 - RNA, 23 nt, Human
aaaaccaguuuuaaaaaagccag

SEQ ID NO: 182841 - RNA, 19 nt, Human
aaaauuaaaauaaaaccag

SEQ ID NO: 182842 - RNA, 22 nt, Human
aaaccaguuuuaaaaaagccag

SEQ ID NO: 182843 - RNA, 25 nt, Human
aaccaguuuuaaaaaagccagcccc

SEQ ID NO: 182844 - RNA, 22 nt, Human
accccagggcagcagaaggaug

SEQ ID NO: 182845 - RNA, 19 nt, Human
agaguuggaauuggcuccu

SEQ ID NO: 182846 - RNA, 31 nt, Human
agccccugggguuuccaccuccugccuccgg

SEQ ID NO: 182847 - RNA, 21 nt, Human
agcgcugccuccccagagcgg

SEQ ID NO: 182848 - RNA, 19 nt, Human
aggcggcggcggcggcggc

SEQ ID NO: 182849 - RNA, 24 nt, Human
aggcggcggcggcggcggcggcgg

SEQ ID NO: 182850 - RNA, 23 nt, Human
auggaaaaacugaaaauauaaua

SEQ ID NO: 182851 - RNA, 24 nt, Human
auuccauccccuucuuaucuccac

SEQ ID NO: 182852 - RNA, 19 nt, Human
cagcagaaggaugagggcc

SEQ ID NO: 182853 - RNA, 24 nt, Human
cagccccugggguuuccaccuccu

SEQ ID NO: 182854 - RNA, 20 nt, Human
cagcuccuggccgcuggccc

SEQ ID NO: 182855 - RNA, 23 nt, Human
cagggacccaaggccccguggcc

SEQ ID NO: 182856 - RNA, 25 nt, Human
ccagccccgcagcccuggccuguaa

SEQ ID NO: 182857 - RNA, 21 nt, Human
ccagggcagcagaaggaugag

SEQ ID NO: 182858 - RNA, 18 nt, Human
cccaaggccccguggccc

SEQ ID NO: 182859 - RNA, 24 nt, Human
ccccgccgccagcgcugccucccc

SEQ ID NO: 182860 - RNA, 19 nt, Human
ccccguggcccggggaagg

SEQ ID NO: 182861 - RNA, 22 nt, Human
cccguggcccggggaagggggc

SEQ ID NO: 182862 - RNA, 18 nt, Human
ccgaggccuguggcggug

SEQ ID NO: 182863 - RNA, 22 nt, Human
ccgcagcccuggccuguagugu

SEQ ID NO: 182864 - RNA, 24 nt, Human
ccgccgccagcgcugccuccccag

SEQ ID NO: 182865 - RNA, 23 nt, Human
ccuccugccuccggcccuccaga

SEQ ID NO: 182866 - RNA, 21 nt, Human
ccucuucccccauuccauccc

SEQ ID NO: 182867 - RNA, 24 nt, Human
ccugggguuuccaccuccugccuc

SEQ ID NO: 182868 - RNA, 21 nt, Human
cggcccuccagaggggugagg

SEQ ID NO: 182869 - RNA, 22 nt, Human
cgggaggaaccaaaccugggug

SEQ ID NO: 182870 - RNA, 19 nt, Human
cgggcggcgcugucuuccu

SEQ ID NO: 182871 - RNA, 23 nt, Human
cuccucuucccccauuccauccc

SEQ ID NO: 182872 - RNA, 18 nt, Human
cuggccuguagugugggc

SEQ ID NO: 182873 - RNA, 25 nt, Human
cuucccccauuccauccccuucuua

SEQ ID NO: 182874 - RNA, 20 nt, Human
gccagccccgcagcccuggc

SEQ ID NO: 182875 - RNA, 24 nt, Human
gccccgggaggaaccaaaccuggg

SEQ ID NO: 182876 - RNA, 21 nt, Human
gccgccagcgcugccucccca

SEQ ID NO: 182877 - RNA, 20 nt, Human
gcgcugccuccccagagcgg

SEQ ID NO: 182878 - RNA, 21 nt, Human
gcgcugccuccccagagcgga

SEQ ID NO: 182879 - RNA, 23 nt, Human
gcggcggaggcggcggcggcggc

SEQ ID NO: 182880 - RNA, 20 nt, Human
gcggcggcggcggcggcggc

SEQ ID NO: 182881 - RNA, 20 nt, Human
gcggcggcggcggcggcggc

SEQ ID NO: 182882 - RNA, 20 nt, Human
gcggcggcggcggcggcggc

SEQ ID NO: 182883 - RNA, 23 nt, Human
gcggcggcggcggcggcggcggc

SEQ ID NO: 182884 - RNA, 23 nt, Human
gcggcggcggcggcggcggcggc

SEQ ID NO: 182885 - RNA, 23 nt, Human
gcggcggcggcggcggcggcggc

SEQ ID NO: 182886 - RNA, 23 nt, Human
gcggcggcggcggcggcggcggc

SEQ ID NO: 182887 - RNA, 20 nt, Human
ggacgggggcugggggaggc

SEQ ID NO: 182888 - RNA, 23 nt, Human
ggaggcggcggcggcggcggcgg

SEQ ID NO: 182889 - RNA, 23 nt, Human
ggagggcagggacccaaggcccc

SEQ ID NO: 182890 - RNA, 24 nt, Human
ggcaggguugggggcggcuggggg

SEQ ID NO: 182891 - RNA, 21 nt, Human
ggccugggcccagugggggug

SEQ ID NO: 182892 - RNA, 23 nt, Human
ggcggcggcggcggcggcggcgg

SEQ ID NO: 182893 - RNA, 23 nt, Human
ggcggcggcggcggcggcggcgg

SEQ ID NO: 182894 - RNA, 23 nt, Human
ggcggcggcggcggcggcggcgg

SEQ ID NO: 182895 - RNA, 18 nt, Human
ggcugggggaggcagcuc

SEQ ID NO: 182896 - RNA, 25 nt, Human
gggcaggguugggggcggcuggggg

SEQ ID NO: 182897 - RNA, 22 nt, Human
gggugaggccccaaccccaggg

SEQ ID NO: 182898 - RNA, 21 nt, Human
guggcggugggacucugcggc

SEQ ID NO: 182899 - RNA, 21 nt, Human
uaaaaaagccagccccugggg

SEQ ID NO: 182900 - RNA, 24 nt, Human
uccacagugggggccccgggagga

SEQ ID NO: 182901 - RNA, 18 nt, Human
ucccccauuccauccccu

SEQ ID NO: 182902 - RNA, 19 nt, Human
uccccuucuuaucuccaca

SEQ ID NO: 182903 - RNA, 18 nt, Human
uccucaguggccccagcc

SEQ ID NO: 182904 - RNA, 21 nt, Human
uccuggccgcuggcccgaggc

SEQ ID NO: 182905 - RNA, 22 nt, Human
ugaggccccaaccccagggcag

SEQ ID NO: 182906 - RNA, 26 nt, Human
uggaaaaacugaaaauauaauaaaaa

SEQ ID NO: 182907 - RNA, 20 nt, Human
uggcccgaggccuguggcgg

SEQ ID NO: 182908 - RNA, 21 nt, Human
uggccugggcccagugggggu

SEQ ID NO: 182909 - RNA, 24 nt, Human
ugggagggcagggacccaaggccc

SEQ ID NO: 182910 - RNA, 22 nt, Human
ugggcagggccccuccuggccu

SEQ ID NO: 182911 - RNA, 25 nt, Human
ugggggccgcgggacgggggcuggg

SEQ ID NO: 182912 - RNA, 22 nt, Human
ugggggcggcugggggccgcgg

SEQ ID NO: 182913 - RNA, 21 nt, Human
ugggugggagggcagggaccc

SEQ ID NO: 182914 - RNA, 19 nt, Human
uguagugugggcaugggca

SEQ ID NO: 182915 - RNA, 23 nt, Human
uuuccaccuccugccuccggccc

SEQ ID NO: 182916 - RNA, 22 nt, Human
uuuuuuuuuuuuuuuuuuacag

SEQ ID NO: 182917 - RNA, 25 nt, Human
aagucugcugggccugcaaagggcu

SEQ ID NO: 182918 - RNA, 22 nt, Human
agagaaaaaaagguagaaaaag

SEQ ID NO: 182919 - RNA, 20 nt, Human
agagaaggauggacaggucu

SEQ ID NO: 182920 - RNA, 19 nt, Human
agccauagucacagggcca

SEQ ID NO: 182921 - RNA, 25 nt, Human
agcuggccuggccuggccuggcccc

SEQ ID NO: 182922 - RNA, 19 nt, Human
aggagcuggccuggccugg

SEQ ID NO: 182923 - RNA, 18 nt, Human
aggcaggagcugagauua

SEQ ID NO: 182924 - RNA, 18 nt, Human
agggagaggcugugagga

SEQ ID NO: 182925 - RNA, 21 nt, Human
agggagaggcugugaggacug

SEQ ID NO: 182926 - RNA, 19 nt, Human
agguaguggcucuggggga

SEQ ID NO: 182927 - RNA, 23 nt, Human
caaaccccaaccagcugccucug

SEQ ID NO: 182928 - RNA, 20 nt, Human
caccugaaugagaugggguc

SEQ ID NO: 182929 - RNA, 21 nt, Human
cagagccauagucacagggcc

SEQ ID NO: 182930 - RNA, 18 nt, Human
cagcuccgguuccuggga

SEQ ID NO: 182931 - RNA, 23 nt, Human
cagcugcgacgcccgcgcccgcc

SEQ ID NO: 182932 - RNA, 20 nt, Human
cagggggcugcugagugugu

SEQ ID NO: 182933 - RNA, 20 nt, Human
cagggugguggggaagaggg

SEQ ID NO: 182934 - RNA, 25 nt, Human
caggugucuuaggagagaaaaaaag

SEQ ID NO: 182935 - RNA, 23 nt, Human
ccaugcuccccacugcccucaaa

SEQ ID NO: 182936 - RNA, 23 nt, Human
ccccugugucccugaugcugccu

SEQ ID NO: 182937 - RNA, 20 nt, Human
cccgcgcccgcccgucaccu

SEQ ID NO: 182938 - RNA, 19 nt, Human
cccuauaccacccaggccu

SEQ ID NO: 182939 - RNA, 20 nt, Human
ccgcgcccgcccgucaccug

SEQ ID NO: 182940 - RNA, 18 nt, Human
ccuagggccuggggccuc

SEQ ID NO: 182941 - RNA, 21 nt, Human
ccugaugcugccucccaaagg

SEQ ID NO: 182942 - RNA, 18 nt, Human
ccugcaaagggcugggga

SEQ ID NO: 182943 - RNA, 24 nt, Human
cgucaccugcccaggcucugcugc

SEQ ID NO: 182944 - RNA, 21 nt, Human
cucagcugcgacgcccgcgcc

SEQ ID NO: 182945 - RNA, 19 nt, Human
cucuggcuggaccucggcc

SEQ ID NO: 182946 - RNA, 22 nt, Human
cugccucccaaaggcacagucc

SEQ ID NO: 182947 - RNA, 26 nt, Human
cuuaggagagaaaaaaagguagaaaa

SEQ ID NO: 182948 - RNA, 23 nt, Human
gaaagguacaggggacccacaga

SEQ ID NO: 182949 - RNA, 21 nt, Human
gacaaaccccaaccagcugcc

SEQ ID NO: 182950 - RNA, 18 nt, Human
gacuguggggagggaagg

SEQ ID NO: 182951 - RNA, 20 nt, Human
gagauggggucgggcagggg

SEQ ID NO: 182952 - RNA, 21 nt, Human
gccaaacgcccuauaccaccc

SEQ ID NO: 182953 - RNA, 21 nt, Human
gccauagucacagggccaaac

SEQ ID NO: 182954 - RNA, 21 nt, Human
gcccuauaccacccaggccug

SEQ ID NO: 182955 - RNA, 21 nt, Human
gcccucaaaggagaaagcuua

SEQ ID NO: 182956 - RNA, 18 nt, Human
gccucugggucugauccu

SEQ ID NO: 182957 - RNA, 22 nt, Human
gcugcugaguguguucacugcc

SEQ ID NO: 182958 - RNA, 21 nt, Human
ggaggaauccuagggccuggg

SEQ ID NO: 182959 - RNA, 21 nt, Human
ggagggaaggccaugggagga

SEQ ID NO: 182960 - RNA, 20 nt, Human
ggcacagucccaugcucccc

SEQ ID NO: 182961 - RNA, 19 nt, Human
ggcacccggaauauagaag

SEQ ID NO: 182962 - RNA, 19 nt, Human
ggcgggggguugggggggc

SEQ ID NO: 182963 - RNA, 18 nt, Human
gggagggaaggccauggg

SEQ ID NO: 182964 - RNA, 19 nt, Human
ggggaggaauccuagggcc

SEQ ID NO: 182965 - RNA, 22 nt, Human
ggugguggggaagaggguuugg

SEQ ID NO: 182966 - RNA, 21 nt, Human
gucaccugcccaggcucugcu

SEQ ID NO: 182967 - RNA, 24 nt, Human
guucacugccuuccacuucccuuc

SEQ ID NO: 182968 - RNA, 19 nt, Human
uagaagagaacaccugaau

SEQ ID NO: 182969 - RNA, 22 nt, Human
uagaagagaacaccugaauggu

SEQ ID NO: 182970 - RNA, 23 nt, Human
uauaccacccaggccuggacaaa

SEQ ID NO: 182971 - RNA, 23 nt, Human
uccacuucccuuucuccagccuc

SEQ ID NO: 182972 - RNA, 23 nt, Human
ucccaaaggcacagucccaugcu

SEQ ID NO: 182973 - RNA, 24 nt, Human
uccccacugcccucaaaggagaaa

SEQ ID NO: 182974 - RNA, 18 nt, Human
ucccugaugcugccuccc

SEQ ID NO: 182975 - RNA, 19 nt, Human
ucuggauaauccuucuucu

SEQ ID NO: 182976 - RNA, 24 nt, Human
ucuggcucuugggcucuggcugga

SEQ ID NO: 182977 - RNA, 22 nt, Human
ucuugggcucuggcuggaccuc

SEQ ID NO: 182978 - RNA, 18 nt, Human
ugagauggggucgggcag

SEQ ID NO: 182979 - RNA, 18 nt, Human
ugagauuagaaaggacug

SEQ ID NO: 182980 - RNA, 21 nt, Human
ugaugcugccucccaaaggca

SEQ ID NO: 182981 - RNA, 19 nt, Human
ugccagaggagcuggccug

SEQ ID NO: 182982 - RNA, 22 nt, Human
uggaccucggccggguuuccag

SEQ ID NO: 182983 - RNA, 24 nt, Human
uggccuggccuggccccgaccggc

SEQ ID NO: 182984 - RNA, 24 nt, Human
ugggagccuccuuacucccucagc

SEQ ID NO: 182985 - RNA, 18 nt, Human
ugggaggagauggggcag

SEQ ID NO: 182986 - RNA, 19 nt, Human
ugggaggagauggggcagu

SEQ ID NO: 182987 - RNA, 23 nt, Human
ugggaggagauggggcaguucuu

SEQ ID NO: 182988 - RNA, 20 nt, Human
uggggaagaggguuugguga

SEQ ID NO: 182989 - RNA, 19 nt, Human
ugggggaggaauccuaggg

SEQ ID NO: 182990 - RNA, 20 nt, Human
ugguggggaagaggguuugg

SEQ ID NO: 182991 - RNA, 22 nt, Human
uuagaaaggacugaucuggaua

SEQ ID NO: 182992 - RNA, 20 nt, Human
uucuucucgacaaaccccaa

SEQ ID NO: 182993 - RNA, 23 nt, Human
uucuuugccccugugucccugau

SEQ ID NO: 182994 - RNA, 18 nt, Human
aagcuuccagagucagca

SEQ ID NO: 182995 - RNA, 21 nt, Human
acaauaaaaacacauucuaaa

SEQ ID NO: 182996 - RNA, 26 nt, Human
acgcuuagugaccugugagccauggg

SEQ ID NO: 182997 - RNA, 20 nt, Human
cacaucgagaaauaucagac

SEQ ID NO: 182998 - RNA, 19 nt, Human
cagcacugggagccacaga

SEQ ID NO: 182999 - RNA, 19 nt, Human
cugggagccacagagcaga

SEQ ID NO: 183000 - RNA, 24 nt, Human
cuucuaucacagaccagucaccag

SEQ ID NO: 183001 - RNA, 23 nt, Human
gaaaaagauacuuuuacaauaaa

SEQ ID NO: 183002 - RNA, 21 nt, Human
gagagggaagcggagagcggg

SEQ ID NO: 183003 - RNA, 19 nt, Human
gcaauaaacucuaagcucc

SEQ ID NO: 183004 - RNA, 19 nt, Human
gcagugcugaaggcucaca

SEQ ID NO: 183005 - RNA, 21 nt, Human
gcuacacugcaauaaacucua

SEQ ID NO: 183006 - RNA, 21 nt, Human
uaaaaaguguuccaaaagaaa

SEQ ID NO: 183007 - RNA, 22 nt, Human
uaaaaucagcacuuccagagga

SEQ ID NO: 183008 - RNA, 21 nt, Human
uaaagcuuccagagucagcac

SEQ ID NO: 183009 - RNA, 18 nt, Human
uaacugcugaauucuacu

SEQ ID NO: 183010 - RNA, 19 nt, Human
ucagguauacaugagugca

SEQ ID NO: 183011 - RNA, 22 nt, Human
ugaccugugagccauggguugc

SEQ ID NO: 183012 - RNA, 21 nt, Human
uggaauauauuaacugcugaa

SEQ ID NO: 183013 - RNA, 23 nt, Human
uguauuuccagaggugacaguuu

SEQ ID NO: 183014 - RNA, 20 nt, Human
uguuccaaaagaaaaauacu

SEQ ID NO: 183015 - RNA, 21 nt, Human
uuccaaaagaaaaauacugua

SEQ ID NO: 183016 - RNA, 23 nt, Human
uuggaauuggaauuugcuucuau

SEQ ID NO: 183017 - RNA, 23 nt, Human
uuuaaaaaguguuccaaaagaaa

SEQ ID NO: 183018 - RNA, 24 nt, Human
uuuaaaaaguguuccaaaagaaaa

SEQ ID NO: 183019 - RNA, 20 nt, Human
uuuuuuuuuuuuuuuuugcu

SEQ ID NO: 183020 - RNA, 20 nt, Human
uuuuuuuuuuuuuuuuuugg

SEQ ID NO: 183021 - RNA, 19 nt, Human
aaaccuucauuuuccaaaa

SEQ ID NO: 183022 - RNA, 24 nt, Human
aaagugcugggauuacaggcguga

SEQ ID NO: 183023 - RNA, 18 nt, Human
aacauggugaaacccugu

SEQ ID NO: 183024 - RNA, 19 nt, Human
aacauggugaaacccuguc

SEQ ID NO: 183025 - RNA, 20 nt, Human
aacauggugaaacccugucc

SEQ ID NO: 183026 - RNA, 21 nt, Human
aacauuucucugccaaaguca

SEQ ID NO: 183027 - RNA, 19 nt, Human
aagugcugggauuacaggc

SEQ ID NO: 183028 - RNA, 19 nt, Human
aagugcugggauuacaggc

SEQ ID NO: 183029 - RNA, 26 nt, Human
aagugcugggauuacaggcgugagcc

SEQ ID NO: 183030 - RNA, 23 nt, Human
aaucaccgaacccggggggcaga

SEQ ID NO: 183031 - RNA, 21 nt, Human
acaccaaagaacagauguccu

SEQ ID NO: 183032 - RNA, 20 nt, Human
acaccuguaauccagcaccu

SEQ ID NO: 183033 - RNA, 18 nt, Human
accaaagaacagaugucc

SEQ ID NO: 183034 - RNA, 24 nt, Human
accugaggucaggaguucaagacc

SEQ ID NO: 183035 - RNA, 18 nt, Human
acgggguuucaccauguu

SEQ ID NO: 183036 - RNA, 18 nt, Human
acgggguuucaccauguu

SEQ ID NO: 183037 - RNA, 19 nt, Human
acgggguuucaccauguuu

SEQ ID NO: 183038 - RNA, 21 nt, Human
acgggguuucaccauguuuca

SEQ ID NO: 183039 - RNA, 18 nt, Human
acugcacuccagccuggg

SEQ ID NO: 183040 - RNA, 18 nt, Human
acugcacuccagccuggg

SEQ ID NO: 183041 - RNA, 21 nt, Human
agaaagaauagcaucuacaaa

SEQ ID NO: 183042 - RNA, 22 nt, Human
agaccaaaagugaaaacaggga

SEQ ID NO: 183043 - RNA, 26 nt, Human
agacucagaaacugagcagccaagcu

SEQ ID NO: 183044 - RNA, 20 nt, Human
agaggcgggcggaucaccug

SEQ ID NO: 183045 - RNA, 18 nt, Human
agagguugcauugagcca

SEQ ID NO: 183046 - RNA, 21 nt, Human
agagguugcauugagccacug

SEQ ID NO: 183047 - RNA, 23 nt, Human
agaguucuaagaaggcuuccucu

SEQ ID NO: 183048 - RNA, 18 nt, Human
agcagccaagcuuccuuc

SEQ ID NO: 183049 - RNA, 22 nt, Human
agccgggcguggugcaugugcc

SEQ ID NO: 183050 - RNA, 22 nt, Human
agccuggccaacauggugaaac

SEQ ID NO: 183051 - RNA, 24 nt, Human
agccuggccaacauggugaaaccc

SEQ ID NO: 183052 - RNA, 21 nt, Human
aggcagaggcgggcggaucac

SEQ ID NO: 183053 - RNA, 23 nt, Human
aggcaggagaaucaccgaacccg

SEQ ID NO: 183054 - RNA, 24 nt, Human
aggcaggagaaucaccgaacccgg

SEQ ID NO: 183055 - RNA, 22 nt, Human
aggcgggcggaucaccugaggu

SEQ ID NO: 183056 - RNA, 26 nt, Human
aggcgggcggaucaccugaggucagg

SEQ ID NO: 183057 - RNA, 23 nt, Human
aggcugaggcaggagaaucaccg

SEQ ID NO: 183058 - RNA, 24 nt, Human
aggugugauggcuuacaccuguaa

SEQ ID NO: 183059 - RNA, 22 nt, Human
aguaagaagacaucagaaagaa

SEQ ID NO: 183060 - RNA, 18 nt, Human
agugcugggauuacaggc

SEQ ID NO: 183061 - RNA, 20 nt, Human
auggcuuacaccuguaaucc

SEQ ID NO: 183062 - RNA, 30 nt, Human
auguuucaccauguuagccagggcggucuu

SEQ ID NO: 183063 - RNA, 24 nt, Human
auugagccacugcacuccagccug

SEQ ID NO: 183064 - RNA, 21 nt, Human
caaaaaaaaaucagccgggcg

SEQ ID NO: 183065 - RNA, 21 nt, Human
caaaauagaaaucugaaagau

SEQ ID NO: 183066 - RNA, 24 nt, Human
caaagugcugggauuacaggcgug

SEQ ID NO: 183067 - RNA, 25 nt, Human
caacauggugaaacccuguccacua

SEQ ID NO: 183068 - RNA, 24 nt, Human
caagaccagccuggccaacauggu

SEQ ID NO: 183069 - RNA, 24 nt, Human
caagaggcugaggcaggagaauca

SEQ ID NO: 183070 - RNA, 22 nt, Human
caccauguuagccagggcgguc

SEQ ID NO: 183071 - RNA, 24 nt, Human
caccauguuagccagggcggucuc

SEQ ID NO: 183072 - RNA, 21 nt, Human
caccccagacucagaaacuga

SEQ ID NO: 183073 - RNA, 23 nt, Human
caccugaggucaggaguucaaga

SEQ ID NO: 183074 - RNA, 18 nt, Human
caccuguaauccagcacc

SEQ ID NO: 183075 - RNA, 23 nt, Human
caccuguaauccagcaccuuggg

SEQ ID NO: 183076 - RNA, 26 nt, Human
caccuguaauccagcaccuugggagg

SEQ ID NO: 183077 - RNA, 20 nt, Human
caccuugggaggcagaggcu

SEQ ID NO: 183078 - RNA, 22 nt, Human
cacuccagccugggguucaugc

SEQ ID NO: 183079 - RNA, 18 nt, Human
cacugcacuccagccugg

SEQ ID NO: 183080 - RNA, 19 nt, Human
cacugcacuccagccuggg

SEQ ID NO: 183081 - RNA, 19 nt, Human
cacugcacuccagccuggg

SEQ ID NO: 183082 - RNA, 24 nt, Human
cacugcacuccagccugggguuca

SEQ ID NO: 183083 - RNA, 19 nt, Human
cagagcagauuucaccaug

SEQ ID NO: 183084 - RNA, 19 nt, Human
cagcaaggccugaaggucu

SEQ ID NO: 183085 - RNA, 24 nt, Human
cagcaccuugggaggcagaggcgg

SEQ ID NO: 183086 - RNA, 24 nt, Human
cagccacucaagaggcugaggcag

SEQ ID NO: 183087 - RNA, 24 nt, Human
caggcgugagccacugugcccggc

SEQ ID NO: 183088 - RNA, 22 nt, Human
caugccauucuccugccucagc

SEQ ID NO: 183089 - RNA, 18 nt, Human
cauugagccacugcacuc

SEQ ID NO: 183090 - RNA, 20 nt, Human
ccaaagugcugggauuacag

SEQ ID NO: 183091 - RNA, 22 nt, Human
ccaaagugcugggauuacaggc

SEQ ID NO: 183092 - RNA, 22 nt, Human
ccaaagugcugggauuacaggc

SEQ ID NO: 183093 - RNA, 24 nt, Human
ccaaagugcugggauuacaggcgu

SEQ ID NO: 183094 - RNA, 21 nt, Human
ccaagcuuccuucccaggaau

SEQ ID NO: 183095 - RNA, 20 nt, Human
ccacugcacuccagccuggg

SEQ ID NO: 183096 - RNA, 20 nt, Human
ccacugcacuccagccuggg

SEQ ID NO: 183097 - RNA, 21 nt, Human
ccacugcacuccagccugggg

SEQ ID NO: 183098 - RNA, 22 nt, Human
ccacugcacuccagccuggggu

SEQ ID NO: 183099 - RNA, 23 nt, Human
ccacugugcccggccuggaagga

SEQ ID NO: 183100 - RNA, 21 nt, Human
cccgccaccacacccagcuaa

SEQ ID NO: 183101 - RNA, 22 nt, Human
ccuggccaacauggugaaaccc

SEQ ID NO: 183102 - RNA, 24 nt, Human
ccuggccaacauggugaaacccug

SEQ ID NO: 183103 - RNA, 24 nt, Human
cgccucggccucccaaagugcugg

SEQ ID NO: 183104 - RNA, 24 nt, Human
cggaucaccugaggucaggaguuc

SEQ ID NO: 183105 - RNA, 27 nt, Human
cggaucaccugaggucaggaguucaag

SEQ ID NO: 183106 - RNA, 24 nt, Human
cgggcggaucaccugaggucagga

SEQ ID NO: 183107 - RNA, 23 nt, Human
cuaauuuuuuguauuuuuaguag

SEQ ID NO: 183108 - RNA, 23 nt, Human
cuccagccugggguucaugccau

SEQ ID NO: 183109 - RNA, 24 nt, Human
cuccugaccucgugauccgcccgc

SEQ ID NO: 183110 - RNA, 23 nt, Human
cugccucagccucccgaguagcu

SEQ ID NO: 183111 - RNA, 21 nt, Human
cuggacccgccaccacaccca

SEQ ID NO: 183112 - RNA, 24 nt, Human
cuggccaacauggugaaacccugu

SEQ ID NO: 183113 - RNA, 18 nt, Human
gaaagaauagcaucuaca

SEQ ID NO: 183114 - RNA, 22 nt, Human
gaccucgugauccgcccgccuc

SEQ ID NO: 183115 - RNA, 22 nt, Human
gaccucgugauccgcccgccuc

SEQ ID NO: 183116 - RNA, 24 nt, Human
gaccucgugauccgcccgccucgg

SEQ ID NO: 183117 - RNA, 20 nt, Human
gagacgggguuucaccaugu

SEQ ID NO: 183118 - RNA, 25 nt, Human
gaggcgggcggaucaccugagguca

SEQ ID NO: 183119 - RNA, 21 nt, Human
gaucaccugaggucaggaguu

SEQ ID NO: 183120 - RNA, 23 nt, Human
gaucaccugaggucaggaguuca

SEQ ID NO: 183121 - RNA, 24 nt, Human
gaucaccugaggucaggaguucaa

SEQ ID NO: 183122 - RNA, 18 nt, Human
gauuacaggcgugagcca

SEQ ID NO: 183123 - RNA, 21 nt, Human
gauuacaggcgugagccacug

SEQ ID NO: 183124 - RNA, 24 nt, Human
gauuacaggcgugagccacugugc

SEQ ID NO: 183125 - RNA, 21 nt, Human
gcagccaagcuuccuucccag

SEQ ID NO: 183126 - RNA, 22 nt, Human
gcauugagccacugcacuccag

SEQ ID NO: 183127 - RNA, 22 nt, Human
gccaacauggugaaacccuguc

SEQ ID NO: 183128 - RNA, 20 nt, Human
gccucagccucccgaguagc

SEQ ID NO: 183129 - RNA, 23 nt, Human
ggaucaccugaggucaggaguuc

SEQ ID NO: 183130 - RNA, 18 nt, Human
ggcagagguugcauugag

SEQ ID NO: 183131 - RNA, 21 nt, Human
ggcggaucaccugaggucagg

SEQ ID NO: 183132 - RNA, 23 nt, Human
ggcggucucgaucuccugaccuc

SEQ ID NO: 183133 - RNA, 24 nt, Human
gggccaggugugauggcuuacacc

SEQ ID NO: 183134 - RNA, 20 nt, Human
ggggaaaggugacucuggaa

SEQ ID NO: 183135 - RNA, 19 nt, Human
ggucauccuaaagacaaga

SEQ ID NO: 183136 - RNA, 20 nt, Human
guaauguugaguccuucagu

SEQ ID NO: 183137 - RNA, 23 nt, Human
guagagacgggguuucaccaugu

SEQ ID NO: 183138 - RNA, 24 nt, Human
gugauccgcccgccucggccuccc

SEQ ID NO: 183139 - RNA, 22 nt, Human
guuguagaaaccuucauuuucc

SEQ ID NO: 183140 - RNA, 31 nt, Human
guuuugagagguucuuaaaauagaguucccc

SEQ ID NO: 183141 - RNA, 22 nt, Human
uaaaaguacccauaaaaaccug

SEQ ID NO: 183142 - RNA, 24 nt, Human
uaaaaguacccauaaaaaccuguc

SEQ ID NO: 183143 - RNA, 21 nt, Human
uaaaauagaguuccagacgcc

SEQ ID NO: 183144 - RNA, 20 nt, Human
uaacccacuaggaaggauau

SEQ ID NO: 183145 - RNA, 24 nt, Human
uaauuuuuuguauuuuuaguagag

SEQ ID NO: 183146 - RNA, 25 nt, Human
uaauuuuuuguauuuuuaguagaga

SEQ ID NO: 183147 - RNA, 20 nt, Human
uacaaaaaaaaaucagccgg

SEQ ID NO: 183148 - RNA, 23 nt, Human
uacaccuguaauccagcaccuug

SEQ ID NO: 183149 - RNA, 23 nt, Human
uacaggcgugagccacugugccc

SEQ ID NO: 183150 - RNA, 23 nt, Human
uacaggcgugagccacugugccc

SEQ ID NO: 183151 - RNA, 19 nt, Human
uacccauaaaaaccuguca

SEQ ID NO: 183152 - RNA, 21 nt, Human
uagaaaccuucauuuuccaaa

SEQ ID NO: 183153 - RNA, 22 nt, Human
uagagacgggguuucaccaugu

SEQ ID NO: 183154 - RNA, 22 nt, Human
uagcuggacccgccaccacacc

SEQ ID NO: 183155 - RNA, 27 nt, Human
uagcuggacccgccaccacacccagcu

SEQ ID NO: 183156 - RNA, 18 nt, Human
uaggaguggggaaaggug

SEQ ID NO: 183157 - RNA, 24 nt, Human
uaguagagacgggguuucaccaug

SEQ ID NO: 183158 - RNA, 27 nt, Human
uaguagagacgggguuucaccauguuu

SEQ ID NO: 183159 - RNA, 19 nt, Human
ucaauaccauccuuucaaa

SEQ ID NO: 183160 - RNA, 23 nt, Human
ucaccugaggucaggaguucaag

SEQ ID NO: 183161 - RNA, 21 nt, Human
ucagaaagaauagcaucuaca

SEQ ID NO: 183162 - RNA, 18 nt, Human
ucagaacaguaacaaaaa

SEQ ID NO: 183163 - RNA, 21 nt, Human
ucagccucccgaguagcugga

SEQ ID NO: 183164 - RNA, 23 nt, Human
ucaggagcucuggagagaagguc

SEQ ID NO: 183165 - RNA, 24 nt, Human
ucagugguauuaauacauuaguaa

SEQ ID NO: 183166 - RNA, 20 nt, Human
ucauccuaaagacaagaacu

SEQ ID NO: 183167 - RNA, 19 nt, Human
uccaaaauagaaaucugaa

SEQ ID NO: 183168 - RNA, 24 nt, Human
uccagaacauuaucucaccccaga

SEQ ID NO: 183169 - RNA, 24 nt, Human
ucccaaagugcugggauuacaggc

SEQ ID NO: 183170 - RNA, 18 nt, Human
ucggccucccaaagugcu

SEQ ID NO: 183171 - RNA, 24 nt, Human
ucuccugccucagccucccgagua

SEQ ID NO: 183172 - RNA, 18 nt, Human
ugagcuaaaaugaccccu

SEQ ID NO: 183173 - RNA, 19 nt, Human
ugaggcaggagaaucaccg

SEQ ID NO: 183174 - RNA, 23 nt, Human
ugaggcaggagaaucaccgaacc

SEQ ID NO: 183175 - RNA, 24 nt, Human
ugaggcaggagaaucaccgaaccc

SEQ ID NO: 183176 - RNA, 24 nt, Human
ugccucagccucccgaguagcugg

SEQ ID NO: 183177 - RNA, 24 nt, Human
ugcugggauuacaggcgugagcca

SEQ ID NO: 183178 - RNA, 24 nt, Human
uggccaacauggugaaacccuguc

SEQ ID NO: 183179 - RNA, 19 nt, Human
uggcucagaacaguaacaa

SEQ ID NO: 183180 - RNA, 19 nt, Human
uggcuuacaccuguaaucc

SEQ ID NO: 183181 - RNA, 23 nt, Human
uggcuuacaccuguaauccagca

SEQ ID NO: 183182 - RNA, 18 nt, Human
ugggaggcagaggcgggc

SEQ ID NO: 183183 - RNA, 19 nt, Human
ugggaggcagaggcgggcg

SEQ ID NO: 183184 - RNA, 24 nt, Human
ugggaggcagaggcgggcggauca

SEQ ID NO: 183185 - RNA, 18 nt, Human
ugggauuacaggcgugag

SEQ ID NO: 183186 - RNA, 21 nt, Human
ugggauuacaggcgugagcca

SEQ ID NO: 183187 - RNA, 22 nt, Human
ugggauuacaggcgugagccac

SEQ ID NO: 183188 - RNA, 22 nt, Human
ugggauuacaggcgugagccac

SEQ ID NO: 183189 - RNA, 22 nt, Human
ugggauuacaggcgugagccac

SEQ ID NO: 183190 - RNA, 24 nt, Human
ugggauuacaggcgugagccacug

SEQ ID NO: 183191 - RNA, 26 nt, Human
ugggauuacaggcgugagccacugug

SEQ ID NO: 183192 - RNA, 19 nt, Human
uggggaaaggugacucugg

SEQ ID NO: 183193 - RNA, 22 nt, Human
uggugcaugugcccgcaauccc

SEQ ID NO: 183194 - RNA, 20 nt, Human
uguacagagcagauuucacc

SEQ ID NO: 183195 - RNA, 22 nt, Human
uguagcugcuuuggcacagaaa

SEQ ID NO: 183196 - RNA, 19 nt, Human
ugucugaacaauaaccagg

SEQ ID NO: 183197 - RNA, 21 nt, Human
ugugcccgcaaucccagccac

SEQ ID NO: 183198 - RNA, 23 nt, Human
uuacaccaaagaacagauguccu

SEQ ID NO: 183199 - RNA, 18 nt, Human
uuaguagagacgggguuu

SEQ ID NO: 183200 - RNA, 22 nt, Human
uuaguagagacgggguuucacc

SEQ ID NO: 183201 - RNA, 24 nt, Human
uuaguagagacgggguuucaccau

SEQ ID NO: 183202 - RNA, 18 nt, Human
uuauuugaacacugaaac

SEQ ID NO: 183203 - RNA, 19 nt, Human
uucaugccauucuccugcc

SEQ ID NO: 183204 - RNA, 26 nt, Human
uuggcacagaaaauuguggugucuac

SEQ ID NO: 183205 - RNA, 19 nt, Human
uugggaggcagaggcgggc

SEQ ID NO: 183206 - RNA, 23 nt, Human
uuguauuuuuaguagagacgggg

SEQ ID NO: 183207 - RNA, 22 nt, Human
uuucaccauguuagccagggcg

SEQ ID NO: 183208 - RNA, 20 nt, Human
uuuggcacagaaaauuguga

SEQ ID NO: 183209 - RNA, 19 nt, Human
uuuucacacuaacccacua

SEQ ID NO: 183210 - RNA, 24 nt, Human
uuuuuaguagagacgggguuucac

SEQ ID NO: 183211 - RNA, 21 nt, Human
uuuuuguauuuuuaguagaga

SEQ ID NO: 183212 - RNA, 24 nt, Human
uuuuuuguauuuuuaguagagacg

SEQ ID NO: 183213 - RNA, 21 nt, Human
acaucaaugucccaggagccc

SEQ ID NO: 183214 - RNA, 21 nt, Human
acuccauucccccaaaaacaa

SEQ ID NO: 183215 - RNA, 23 nt, Human
agaucuuuaaacaugcauagccu

SEQ ID NO: 183216 - RNA, 22 nt, Human
agcagaaaagaagugacaccaa

SEQ ID NO: 183217 - RNA, 21 nt, Human
agugguggcagacauacucaa

SEQ ID NO: 183218 - RNA, 20 nt, Human
auggaaugacuccauucccc

SEQ ID NO: 183219 - RNA, 24 nt, Human
auugcaauuucaauaucuucaacc

SEQ ID NO: 183220 - RNA, 21 nt, Human
cacuuuugcuuccccaucccu

SEQ ID NO: 183221 - RNA, 23 nt, Human
caggagcccggaggcucuucagg

SEQ ID NO: 183222 - RNA, 18 nt, Human
cauucccccaaaaacaag

SEQ ID NO: 183223 - RNA, 24 nt, Human
ccaccuagaguuaacaauggucac

SEQ ID NO: 183224 - RNA, 22 nt, Human
cccuccuccaggcaguucguca

SEQ ID NO: 183225 - RNA, 22 nt, Human
cugaacacuucacaguaucauc

SEQ ID NO: 183226 - RNA, 21 nt, Human
cuucaggccccucucaaagac

SEQ ID NO: 183227 - RNA, 23 nt, Human
gcauagccuagaguuuccagaau

SEQ ID NO: 183228 - RNA, 20 nt, Human
ggcucuucaggccccucuca

SEQ ID NO: 183229 - RNA, 22 nt, Human
gggauagcagaaaagaagugac

SEQ ID NO: 183230 - RNA, 21 nt, Human
gggcugggggauagcagaaaa

SEQ ID NO: 183231 - RNA, 23 nt, Human
ggggggcugggggauagcagaaa

SEQ ID NO: 183232 - RNA, 23 nt, Human
gucccaggagcccggaggcucuu

SEQ ID NO: 183233 - RNA, 19 nt, Human
uacaucaaugucccaggag

SEQ ID NO: 183234 - RNA, 19 nt, Human
uagcagaaaagaagugaca

SEQ ID NO: 183235 - RNA, 25 nt, Human
uagcagaaaagaagugacaccaaaa

SEQ ID NO: 183236 - RNA, 20 nt, Human
uauuccccuccuccaggcaa

SEQ ID NO: 183237 - RNA, 19 nt, Human
ucccccaaaaacaagauga

SEQ ID NO: 183238 - RNA, 23 nt, Human
ucccccaaaaacaagaugauugc

SEQ ID NO: 183239 - RNA, 19 nt, Human
ucccucugucucuccugcc

SEQ ID NO: 183240 - RNA, 23 nt, Human
ugacuccauucccccaaaaacaa

SEQ ID NO: 183241 - RNA, 26 nt, Human
uuaacaauggucacuuuugcuucccc

SEQ ID NO: 183242 - RNA, 19 nt, Human
uuccccuccuccaggcagu

SEQ ID NO: 183243 - RNA, 22 nt, Human
uuuuauauauuccccuccucca

SEQ ID NO: 183244 - RNA, 21 nt, Human
aagagggggucugaagaggac

SEQ ID NO: 183245 - RNA, 21 nt, Human
agacaacucagcggcgcgcgg

SEQ ID NO: 183246 - RNA, 23 nt, Human
agccgcgaagaacuaagaggggg

SEQ ID NO: 183247 - RNA, 23 nt, Human
aggcccggcggcggguaccagga

SEQ ID NO: 183248 - RNA, 27 nt, Human
agggagggaaggcagagcuuguggggg

SEQ ID NO: 183249 - RNA, 21 nt, Human
cacccucgguccgaugcgcgc

SEQ ID NO: 183250 - RNA, 21 nt, Human
cacuggaucauaaggaguggu

SEQ ID NO: 183251 - RNA, 20 nt, Human
cagcggcgcgcggcgggggc

SEQ ID NO: 183252 - RNA, 22 nt, Human
ccaggaggucucaguuuuccuc

SEQ ID NO: 183253 - RNA, 20 nt, Human
ccuugccagcccucuguucc

SEQ ID NO: 183254 - RNA, 21 nt, Human
cuaaguuuccgguucugugcu

SEQ ID NO: 183255 - RNA, 24 nt, Human
gccuugccagcccucuguuccagc

SEQ ID NO: 183256 - RNA, 18 nt, Human
gcgcgccuugccagcccu

SEQ ID NO: 183257 - RNA, 20 nt, Human
ggccgauucgugggucggug

SEQ ID NO: 183258 - RNA, 23 nt, Human
ggcuccgaacuuugucucuaagu

SEQ ID NO: 183259 - RNA, 18 nt, Human
ggugggucgugggccgug

SEQ ID NO: 183260 - RNA, 18 nt, Human
ucacuggaucauaaggag

SEQ ID NO: 183261 - RNA, 20 nt, Human
uccagcuccacacccggccc

SEQ ID NO: 183262 - RNA, 22 nt, Human
ucggugggucgugggccguggg

SEQ ID NO: 183263 - RNA, 24 nt, Human
ucucuugaauaucacuggaucaua

SEQ ID NO: 183264 - RNA, 19 nt, Human
ucugugcucagcggcucca

SEQ ID NO: 183265 - RNA, 21 nt, Human
ugaagaggaccagggagggaa

SEQ ID NO: 183266 - RNA, 24 nt, Human
ugggucggugggucgugggccgug

SEQ ID NO: 183267 - RNA, 23 nt, Human
aguaauaguaugcaugagaaaaa

SEQ ID NO: 183268 - RNA, 21 nt, Human
gaauuuguuuaauuuuuuuuc

SEQ ID NO: 183269 - RNA, 23 nt, Human
uaguaguaauaguaugcaugaga

SEQ ID NO: 183270 - RNA, 20 nt, Human
uuaguaguaauaguaugcau

SEQ ID NO: 183271 - RNA, 20 nt, Human
uuuuuuuuuuaccacacccc

SEQ ID NO: 183272 - RNA, 24 nt, Human
uuuuuuuuuuuuuuuaccacaccc

SEQ ID NO: 183273 - RNA, 22 nt, Human
aagugcuuccuaaggacugccc

SEQ ID NO: 183274 - RNA, 22 nt, Human
aaguucuccuagcucacucuuc

SEQ ID NO: 183275 - RNA, 27 nt, Human
aauaaugggagaaaagaagggagggcc

SEQ ID NO: 183276 - RNA, 18 nt, Human
acccagcagguggaggaa

SEQ ID NO: 183277 - RNA, 19 nt, Human
agaagagcacacucuccaa

SEQ ID NO: 183278 - RNA, 21 nt, Human
agacuugggcuuggcugaaga

SEQ ID NO: 183279 - RNA, 20 nt, Human
agagggaaaagacggagggg

SEQ ID NO: 183280 - RNA, 24 nt, Human
agagggacagacacucagggcagg

SEQ ID NO: 183281 - RNA, 18 nt, Human
agauaaagcagauggccc

SEQ ID NO: 183282 - RNA, 21 nt, Human
aggacccacccaacccuggcc

SEQ ID NO: 183283 - RNA, 23 nt, Human
aggaugagaguagagggaaaaga

SEQ ID NO: 183284 - RNA, 20 nt, Human
aggugggaguggggaauggg

SEQ ID NO: 183285 - RNA, 22 nt, Human
aggugggaguggggaauggguu

SEQ ID NO: 183286 - RNA, 24 nt, Human
caccccaccacccauggggccaac

SEQ ID NO: 183287 - RNA, 22 nt, Human
cagaagagcacacucuccaagu

SEQ ID NO: 183288 - RNA, 23 nt, Human
cagagacccagcagguggaggaa

SEQ ID NO: 183289 - RNA, 21 nt, Human
caggacccacccaacccuggc

SEQ ID NO: 183290 - RNA, 23 nt, Human
cauggggccaaccgcucggccag

SEQ ID NO: 183291 - RNA, 21 nt, Human
ccaagaugcuuuguguugccc

SEQ ID NO: 183292 - RNA, 25 nt, Human
cccaacccuggcccccagcccaaac

SEQ ID NO: 183293 - RNA, 25 nt, Human
cccaccacccauggggccaaccgcu

SEQ ID NO: 183294 - RNA, 24 nt, Human
ccccgcuucgccugcuuucuccuc

SEQ ID NO: 183295 - RNA, 20 nt, Human
cccuaaccuccuuaaccaag

SEQ ID NO: 183296 - RNA, 19 nt, Human
cccuagacagaccugaucc

SEQ ID NO: 183297 - RNA, 18 nt, Human
cccugggggucuaggaga

SEQ ID NO: 183298 - RNA, 22 nt, Human
ccggccccuaaccuccuuaacc

SEQ ID NO: 183299 - RNA, 22 nt, Human
ccuccugaggcaaguccuagac

SEQ ID NO: 183300 - RNA, 22 nt, Human
ccugcuuucuccuccuuccccc

SEQ ID NO: 183301 - RNA, 21 nt, Human
cuagaccggccccuaaccucc

SEQ ID NO: 183302 - RNA, 26 nt, Human
cugauccugccacagaagagcacacu

SEQ ID NO: 183303 - RNA, 21 nt, Human
cugugaugaagagaaggugac

SEQ ID NO: 183304 - RNA, 20 nt, Human
gaaggugggaguggggaaug

SEQ ID NO: 183305 - RNA, 21 nt, Human
gagacccagcagguggaggaa

SEQ ID NO: 183306 - RNA, 24 nt, Human
gagacccagcagguggaggaaaua

SEQ ID NO: 183307 - RNA, 24 nt, Human
gcccaaacuacucuggcguggaag

SEQ ID NO: 183308 - RNA, 19 nt, Human
ggagaaaagaguugaaggu

SEQ ID NO: 183309 - RNA, 21 nt, Human
ggagaaaagaguugaaggugg

SEQ ID NO: 183310 - RNA, 24 nt, Human
ggccagccacacuguccucagagu

SEQ ID NO: 183311 - RNA, 20 nt, Human
gggaguggggaauggguuca

SEQ ID NO: 183312 - RNA, 19 nt, Human
gggcuuggcugaagaggga

SEQ ID NO: 183313 - RNA, 23 nt, Human
guccuagaccggccccuaaccuc

SEQ ID NO: 183314 - RNA, 20 nt, Human
uaacuucacaaacucuuguu

SEQ ID NO: 183315 - RNA, 26 nt, Human
uagaccggccccuaaccuccuuaacc

SEQ ID NO: 183316 - RNA, 20 nt, Human
ucacaccccaccacccaugg

SEQ ID NO: 183317 - RNA, 21 nt, Human
ucacuggcucccugggggucu

SEQ ID NO: 183318 - RNA, 20 nt, Human
ucccaggugguguaagugcu

SEQ ID NO: 183319 - RNA, 22 nt, Human
ucccugggggucuaggagacuu

SEQ ID NO: 183320 - RNA, 22 nt, Human
uccuagaccggccccuaaccuc

SEQ ID NO: 183321 - RNA, 20 nt, Human
uccugccacagaagagcaca

SEQ ID NO: 183322 - RNA, 24 nt, Human
uccuggacucagguaaguaguguu

SEQ ID NO: 183323 - RNA, 19 nt, Human
ucuaggagacuugggcuug

SEQ ID NO: 183324 - RNA, 19 nt, Human
ugaggcuguccuuccuccu

SEQ ID NO: 183325 - RNA, 21 nt, Human
ugcccucuggggucuuggggu

SEQ ID NO: 183326 - RNA, 21 nt, Human
uggcugaagagggacagacac

SEQ ID NO: 183327 - RNA, 23 nt, Human
uggcugaagagggacagacacuc

SEQ ID NO: 183328 - RNA, 18 nt, Human
uggguucacaaugcauuu

SEQ ID NO: 183329 - RNA, 26 nt, Human
uguccuuccuccugaggcaaguccua

SEQ ID NO: 183330 - RNA, 24 nt, Human
ugugaugaagagaaggugacaguu

SEQ ID NO: 183331 - RNA, 20 nt, Human
uguucccagcaaggucagca

SEQ ID NO: 183332 - RNA, 24 nt, Human
uuucuccuccuucccuucccaccu

SEQ ID NO: 183333 - RNA, 18 nt, Human
aaaaaagaagggagaaga

SEQ ID NO: 183334 - RNA, 20 nt, Human
agaguccugggugccgaccu

SEQ ID NO: 183335 - RNA, 24 nt, Human
aggaaggaggcgcgcgugggagga

SEQ ID NO: 183336 - RNA, 24 nt, Human
aggcgagaggaugaugcggggugg

SEQ ID NO: 183337 - RNA, 22 nt, Human
agggcgccccggcggcgaggaa

SEQ ID NO: 183338 - RNA, 24 nt, Human
agggggcggcggagcggagggcgg

SEQ ID NO: 183339 - RNA, 24 nt, Human
agugcaaaagcgggcgagaaggga

SEQ ID NO: 183340 - RNA, 21 nt, Human
caaagauacugggagggaaga

SEQ ID NO: 183341 - RNA, 20 nt, Human
caccuggagggggcggcgga

SEQ ID NO: 183342 - RNA, 18 nt, Human
cagauguucuccgcaacc

SEQ ID NO: 183343 - RNA, 23 nt, Human
cagcgagggaagaaaagaguaau

SEQ ID NO: 183344 - RNA, 25 nt, Human
cagcuguuagccuggaacagccgcu

SEQ ID NO: 183345 - RNA, 21 nt, Human
caguggcaccgagagggcgcc

SEQ ID NO: 183346 - RNA, 20 nt, Human
caguucaucuggggaagggg

SEQ ID NO: 183347 - RNA, 24 nt, Human
ccagcgagggaagaaaagaguaau

SEQ ID NO: 183348 - RNA, 22 nt, Human
cccacagcuguuagccuggaac

SEQ ID NO: 183349 - RNA, 26 nt, Human
cccacagcuguuagccuggaacagcc

SEQ ID NO: 183350 - RNA, 26 nt, Human
ccccaggucaguccaaaagcaaagau

SEQ ID NO: 183351 - RNA, 20 nt, Human
cccccggggcagcccccgcc

SEQ ID NO: 183352 - RNA, 23 nt, Human
cccgggacccuagaggaggcggg

SEQ ID NO: 183353 - RNA, 25 nt, Human
cccgggcuugaccuuaguggaaagc

SEQ ID NO: 183354 - RNA, 24 nt, Human
cccuccaggagcgaggcgagagga

SEQ ID NO: 183355 - RNA, 19 nt, Human
cccucuggcccgagagccu

SEQ ID NO: 183356 - RNA, 21 nt, Human
cccucuggcccgagagccugu

SEQ ID NO: 183357 - RNA, 21 nt, Human
ccgcaaccuuccggaagugga

SEQ ID NO: 183358 - RNA, 19 nt, Human
ccgccgagcucccgccgcc

SEQ ID NO: 183359 - RNA, 20 nt, Human
ccgccgagcucccgccgccu

SEQ ID NO: 183360 - RNA, 24 nt, Human
ccucaacugacugccccccggggc

SEQ ID NO: 183361 - RNA, 23 nt, Human
ccuccgccgagcucccgccgccu

SEQ ID NO: 183362 - RNA, 18 nt, Human
cgagaagggaaacccaag

SEQ ID NO: 183363 - RNA, 21 nt, Human
cgagagggcgccccggcggcg

SEQ ID NO: 183364 - RNA, 18 nt, Human
cgaggaccggauguggcg

SEQ ID NO: 183365 - RNA, 24 nt, Human
cggggcuagcaggugacgucagcg

SEQ ID NO: 183366 - RNA, 25 nt, Human
cucaacugacugccccccggggcag

SEQ ID NO: 183367 - RNA, 22 nt, Human
cugaggcuauacuacaaagccc

SEQ ID NO: 183368 - RNA, 22 nt, Human
gacaaggacuuuuggggggagg

SEQ ID NO: 183369 - RNA, 20 nt, Human
gagagggcgccccggcggcg

SEQ ID NO: 183370 - RNA, 23 nt, Human
gagcugguugugguguuuuccag

SEQ ID NO: 183371 - RNA, 21 nt, Human
gcaaagauacugggagggaag

SEQ ID NO: 183372 - RNA, 20 nt, Human
gcccucuggcccgagagccu

SEQ ID NO: 183373 - RNA, 21 nt, Human
gcgagaagggaaacccaagcg

SEQ ID NO: 183374 - RNA, 20 nt, Human
gcggcgauggaaggcggacg

SEQ ID NO: 183375 - RNA, 24 nt, Human
gcggcggcgauggaaggcggacgg

SEQ ID NO: 183376 - RNA, 22 nt, Human
ggaacgaugauaaggagcaggu

SEQ ID NO: 183377 - RNA, 23 nt, Human
ggaaggaggcgcgcgugggagga

SEQ ID NO: 183378 - RNA, 18 nt, Human
ggaaggggcuacaaagca

SEQ ID NO: 183379 - RNA, 24 nt, Human
ggacaaggacuuuuggggggaggu

SEQ ID NO: 183380 - RNA, 19 nt, Human
ggagagggggcguggacac

SEQ ID NO: 183381 - RNA, 19 nt, Human
ggagggaagauggcgcugg

SEQ ID NO: 183382 - RNA, 19 nt, Human
ggcgagaagggaaacccaa

SEQ ID NO: 183383 - RNA, 25 nt, Human
gggcgagaagggaaacccaagcggg

SEQ ID NO: 183384 - RNA, 21 nt, Human
gggcgccccggcggcgaggaa

SEQ ID NO: 183385 - RNA, 19 nt, Human
uaagugcaaaagcgggcga

SEQ ID NO: 183386 - RNA, 25 nt, Human
uacagaucauaagugcaaaagcggg

SEQ ID NO: 183387 - RNA, 18 nt, Human
uacccccaggucagucca

SEQ ID NO: 183388 - RNA, 25 nt, Human
uaccuugcgcucccgggagaaccua

SEQ ID NO: 183389 - RNA, 24 nt, Human
ucaccuggagggggcggcggagcg

SEQ ID NO: 183390 - RNA, 21 nt, Human
ugagagccaguggcaccgaga

SEQ ID NO: 183391 - RNA, 23 nt, Human
ugagagccaguggcaccgagagg

SEQ ID NO: 183392 - RNA, 26 nt, Human
ugagagccaguggcaccgagagggcg

SEQ ID NO: 183393 - RNA, 20 nt, Human
ugagaguccugggugccgac

SEQ ID NO: 183394 - RNA, 19 nt, Human
ugaggagcugguuguggug

SEQ ID NO: 183395 - RNA, 20 nt, Human
ugccccccggggcagccccc

SEQ ID NO: 183396 - RNA, 19 nt, Human
ugcuggacuacaccggggg

SEQ ID NO: 183397 - RNA, 22 nt, Human
ugcuggacuacaccgggggcac

SEQ ID NO: 183398 - RNA, 18 nt, Human
uggagggggcggcggagc

SEQ ID NO: 183399 - RNA, 18 nt, Human
ugggagggaagauggcgc

SEQ ID NO: 183400 - RNA, 21 nt, Human
ugggagggaagauggcgcugg

SEQ ID NO: 183401 - RNA, 22 nt, Human
ugggguggcagaggggagauac

SEQ ID NO: 183402 - RNA, 20 nt, Human
aaauccacucucccuuccag

SEQ ID NO: 183403 - RNA, 21 nt, Human
acacccuguuuuaugggcagg

SEQ ID NO: 183404 - RNA, 23 nt, Human
aggacagcagagggagucagggg

SEQ ID NO: 183405 - RNA, 24 nt, Human
aggcaggggcuggguugcccagga

SEQ ID NO: 183406 - RNA, 18 nt, Human
aggcccgggagagagcag

SEQ ID NO: 183407 - RNA, 18 nt, Human
agucaggggagggagacu

SEQ ID NO: 183408 - RNA, 22 nt, Human
cacccuguuuuaugggcaggga

SEQ ID NO: 183409 - RNA, 19 nt, Human
caggggcuggguugcccag

SEQ ID NO: 183410 - RNA, 20 nt, Human
cagguccugcccuuuuugua

SEQ ID NO: 183411 - RNA, 18 nt, Human
cauggcugcaaggagcag

SEQ ID NO: 183412 - RNA, 20 nt, Human
ccagccaaauccacucuccc

SEQ ID NO: 183413 - RNA, 19 nt, Human
ccaggagcauggcugcaag

SEQ ID NO: 183414 - RNA, 18 nt, Human
cccagccaaauccacucu

SEQ ID NO: 183415 - RNA, 18 nt, Human
ccccgcacaauccuagac

SEQ ID NO: 183416 - RNA, 20 nt, Human
ccccugagaggggaggacag

SEQ ID NO: 183417 - RNA, 24 nt, Human
cccgaggaaacgcagauccaccga

SEQ ID NO: 183418 - RNA, 19 nt, Human
cccgggaucugaggacagg

SEQ ID NO: 183419 - RNA, 18 nt, Human
cgaggaaacgcagaucca

SEQ ID NO: 183420 - RNA, 19 nt, Human
gagcagggugcagggggca

SEQ ID NO: 183421 - RNA, 23 nt, Human
gagccugcagcuuaaucuuucuc

SEQ ID NO: 183422 - RNA, 21 nt, Human
gaggcaggggcuggguugccc

SEQ ID NO: 183423 - RNA, 18 nt, Human
gaucuuguucucucacca

SEQ ID NO: 183424 - RNA, 25 nt, Human
gaucuuguucucucaccagccccgc

SEQ ID NO: 183425 - RNA, 21 nt, Human
gcagagguugcugacguuccc

SEQ ID NO: 183426 - RNA, 22 nt, Human
ggacagcagagggagucagggg

SEQ ID NO: 183427 - RNA, 23 nt, Human
gggcagccgcugagaugccuuuc

SEQ ID NO: 183428 - RNA, 20 nt, Human
gggugcagggggcaggaagu

SEQ ID NO: 183429 - RNA, 22 nt, Human
uccacaggacaaggugagaggg

SEQ ID NO: 183430 - RNA, 20 nt, Human
ucccgggaucugaggacagg

SEQ ID NO: 183431 - RNA, 18 nt, Human
uggcugcaaggagcagga

SEQ ID NO: 183432 - RNA, 21 nt, Human
uggcugcaaggagcaggaggg

SEQ ID NO: 183433 - RNA, 22 nt, Human
uugacacuuuauuccccugaga

SEQ ID NO: 183434 - RNA, 18 nt, Human
uuguaugucaucuccccc

SEQ ID NO: 183435 - RNA, 18 nt, Human
uuuuaugggcagggagcc

SEQ ID NO: 183436 - RNA, 22 nt, Human
acugauugcuuccaaugaucau

SEQ ID NO: 183437 - RNA, 21 nt, Human
agauacaaacgccuuuuaacc

SEQ ID NO: 183438 - RNA, 19 nt, Human
cacacacauagugucagau

SEQ ID NO: 183439 - RNA, 20 nt, Human
cuagggcggcggcacccucu

SEQ ID NO: 183440 - RNA, 23 nt, Human
cucgaguuuuuuuuuuuuuuuuu

SEQ ID NO: 183441 - RNA, 20 nt, Human
gaguuuuuuuuuuuuuuuuu

SEQ ID NO: 183442 - RNA, 22 nt, Human
gaguuuuuuuuuuuuuuuuuuc

SEQ ID NO: 183443 - RNA, 19 nt, Human
gauugcuuccaaugaucau

SEQ ID NO: 183444 - RNA, 21 nt, Human
gccuagggcggcggcacccuc

SEQ ID NO: 183445 - RNA, 21 nt, Human
gcggcggcacccucugcagcc

SEQ ID NO: 183446 - RNA, 18 nt, Human
ggcggcggcacccucugc

SEQ ID NO: 183447 - RNA, 18 nt, Human
ggcggggucugggauucu

SEQ ID NO: 183448 - RNA, 19 nt, Human
guggugcuccugcuggggg

SEQ ID NO: 183449 - RNA, 19 nt, Human
gugguggggaagaguaaac

SEQ ID NO: 183450 - RNA, 20 nt, Human
uaaaacacacacauaguguc

SEQ ID NO: 183451 - RNA, 18 nt, Human
uaaacugauugcuuccaa

SEQ ID NO: 183452 - RNA, 22 nt, Human
ugcuuccaaugaucaucucuuc

SEQ ID NO: 183453 - RNA, 20 nt, Human
ugucucuuccuuuacuuccc

SEQ ID NO: 183454 - RNA, 22 nt, Human
uuuuuuuuuuuuuuucauguuu

SEQ ID NO: 183455 - RNA, 20 nt, Human
aaaaacagccaggaggaggc

SEQ ID NO: 183456 - RNA, 19 nt, Human
aaaaacggcuuccaccuuc

SEQ ID NO: 183457 - RNA, 21 nt, Human
aaacagccaggaggaggcagc

SEQ ID NO: 183458 - RNA, 19 nt, Human
aaacaggcacaaaaacagc

SEQ ID NO: 183459 - RNA, 20 nt, Human
aaacaggcacaaaaacagcc

SEQ ID NO: 183460 - RNA, 20 nt, Human
aaacaggcacaaaaacagcc

SEQ ID NO: 183461 - RNA, 23 nt, Human
aaacaggcacaaaaacagccagg

SEQ ID NO: 183462 - RNA, 24 nt, Human
aaacaggcacaaaaacagccagga

SEQ ID NO: 183463 - RNA, 25 nt, Human
aagacaaugaaaggaagccgguacc

SEQ ID NO: 183464 - RNA, 22 nt, Human
aauccacccccagguucuccua

SEQ ID NO: 183465 - RNA, 19 nt, Human
acaaaacacugguaccaaa

SEQ ID NO: 183466 - RNA, 28 nt, Human
acaaacauucucccuauagcuaaacucc

SEQ ID NO: 183467 - RNA, 19 nt, Human
agaaagaccugccuuuccc

SEQ ID NO: 183468 - RNA, 21 nt, Human
agacaaugaaaggaagccaga

SEQ ID NO: 183469 - RNA, 20 nt, Human
agagaaaagcugugaaagug

SEQ ID NO: 183470 - RNA, 23 nt, Human
agaggugguauccaauauacaua

SEQ ID NO: 183471 - RNA, 21 nt, Human
agcaggagagcgggacacuca

SEQ ID NO: 183472 - RNA, 27 nt, Human
aggaggaggcagcauccacuccaugaa

SEQ ID NO: 183473 - RNA, 22 nt, Human
aguauguaaaacagaggagcca

SEQ ID NO: 183474 - RNA, 24 nt, Human
agugaggccuuucacaaaaacaca

SEQ ID NO: 183475 - RNA, 21 nt, Human
aucacauuguaaacaaaucca

SEQ ID NO: 183476 - RNA, 21 nt, Human
caaacaggcacaaaaacagcc

SEQ ID NO: 183477 - RNA, 22 nt, Human
caaacaggcacaaaaacagcca

SEQ ID NO: 183478 - RNA, 21 nt, Human
caaacaggcacaaaaacagcu

SEQ ID NO: 183479 - RNA, 21 nt, Human
caauaaguucacccacuuauc

SEQ ID NO: 183480 - RNA, 19 nt, Human
cacauuguaaacaaaucca

SEQ ID NO: 183481 - RNA, 23 nt, Human
caccaugugaauuuaagcaggac

SEQ ID NO: 183482 - RNA, 22 nt, Human
cacccacccaaauccaccccca

SEQ ID NO: 183483 - RNA, 22 nt, Human
cacccccagguucuccuaguuc

SEQ ID NO: 183484 - RNA, 26 nt, Human
caccuucugccuuuuggugcuggaga

SEQ ID NO: 183485 - RNA, 19 nt, Human
cacugguaccaaacauagc

SEQ ID NO: 183486 - RNA, 26 nt, Human
cagaacaaaaaguuuaaaacucccaa

SEQ ID NO: 183487 - RNA, 21 nt, Human
cagcaguagcuucaaacaggc

SEQ ID NO: 183488 - RNA, 22 nt, Human
cagccucauggccaagaacaau

SEQ ID NO: 183489 - RNA, 18 nt, Human
caggcacaaaaacagcca

SEQ ID NO: 183490 - RNA, 22 nt, Human
caggccugugcaagaaggacuc

SEQ ID NO: 183491 - RNA, 22 nt, Human
cauuguaaacaaauccauugau

SEQ ID NO: 183492 - RNA, 21 nt, Human
ccacccaaauccacccccagg

SEQ ID NO: 183493 - RNA, 20 nt, Human
ccaggaggaggcagcaucca

SEQ ID NO: 183494 - RNA, 26 nt, Human
ccauggcugaagcagaaccggggucc

SEQ ID NO: 183495 - RNA, 24 nt, Human
cccacccacccaaauccaccccca

SEQ ID NO: 183496 - RNA, 18 nt, Human
ccccacccacccaaaucc

SEQ ID NO: 183497 - RNA, 21 nt, Human
cugcuuccuugcacuuauuuu

SEQ ID NO: 183498 - RNA, 25 nt, Human
gaacaaaaaguuuaaaacucccaac

SEQ ID NO: 183499 - RNA, 20 nt, Human
gaagccagagcaacagacca

SEQ ID NO: 183500 - RNA, 24 nt, Human
gaagccuccucuuuggccccaccc

SEQ ID NO: 183501 - RNA, 21 nt, Human
gaaggccuaagacaaugaaag

SEQ ID NO: 183502 - RNA, 23 nt, Human
gaaugacggcacaaucacauaga

SEQ ID NO: 183503 - RNA, 22 nt, Human
gaggaggcagcauccacuccau

SEQ ID NO: 183504 - RNA, 18 nt, Human
gagugugucauaugugug

SEQ ID NO: 183505 - RNA, 24 nt, Human
gaguugugacuaaacucacacuua

SEQ ID NO: 183506 - RNA, 21 nt, Human
gcucugggggaaaaacggcuu

SEQ ID NO: 183507 - RNA, 22 nt, Human
ggcacaaaaacagccaggagga

SEQ ID NO: 183508 - RNA, 20 nt, Human
ggcuuccaccuucugccuuu

SEQ ID NO: 183509 - RNA, 22 nt, Human
gggcucugggggaaaaacggcu

SEQ ID NO: 183510 - RNA, 24 nt, Human
guaaaacagaggagccacagugag

SEQ ID NO: 183511 - RNA, 21 nt, Human
uaaguuacaaacauucucccu

SEQ ID NO: 183512 - RNA, 23 nt, Human
uacuugacacuaggucccagcac

SEQ ID NO: 183513 - RNA, 18 nt, Human
uagaaaagcuaaagacaa

SEQ ID NO: 183514 - RNA, 18 nt, Human
uagcccuuaggccugggc

SEQ ID NO: 183515 - RNA, 19 nt, Human
ucaaccaaggggcaggccu

SEQ ID NO: 183516 - RNA, 23 nt, Human
uccaauauacauaagccccuaau

SEQ ID NO: 183517 - RNA, 19 nt, Human
ucccagccucauggccaag

SEQ ID NO: 183518 - RNA, 18 nt, Human
ucccugagggagagaaga

SEQ ID NO: 183519 - RNA, 18 nt, Human
ucccugagggagagaagu

SEQ ID NO: 183520 - RNA, 19 nt, Human
ucuuucccagaaauggagg

SEQ ID NO: 183521 - RNA, 22 nt, Human
ugaaaguggaagaaggaaggga

SEQ ID NO: 183522 - RNA, 22 nt, Human
ugacuaaacucacacuuaagcu

SEQ ID NO: 183523 - RNA, 21 nt, Human
uggaagaaggaagggaucguu

SEQ ID NO: 183524 - RNA, 21 nt, Human
uggccaagaacaauaaguuca

SEQ ID NO: 183525 - RNA, 20 nt, Human
uggcugggccccuugaggcu

SEQ ID NO: 183526 - RNA, 22 nt, Human
uguccagaccguccccuuggcu

SEQ ID NO: 183527 - RNA, 24 nt, Human
ugugaaccauggcugaagcagaac

SEQ ID NO: 183528 - RNA, 21 nt, Human
ugugucauaugugugaaccau

SEQ ID NO: 183529 - RNA, 22 nt, Human
uuagauauugagaguuugugcc

SEQ ID NO: 183530 - RNA, 23 nt, Human
uugcacuuguuacugaccaaaga

SEQ ID NO: 183531 - RNA, 23 nt, Human
uuuaaaacucccaaccuggguuu

SEQ ID NO: 183532 - RNA, 20 nt, Human
uuuccagaaagaccugccuu

SEQ ID NO: 183533 - RNA, 22 nt, Human
uuuccuggcacucaccuccuag

SEQ ID NO: 183534 - RNA, 26 nt, Human
uuuuuuuuuuuuuugaaaauacugga

SEQ ID NO: 183535 - RNA, 22 nt, Human
aaaaagcuagcaucuguaucac

SEQ ID NO: 183536 - RNA, 21 nt, Human
aaacuaaaagaccucuuuagu

SEQ ID NO: 183537 - RNA, 24 nt, Human
aaagaagaaaaacucgugcuagaa

SEQ ID NO: 183538 - RNA, 19 nt, Human
aaccccauaauucaucccu

SEQ ID NO: 183539 - RNA, 21 nt, Human
aagaaaaacucgugcuagaaa

SEQ ID NO: 183540 - RNA, 21 nt, Human
aagaggcuaaaaacuaaauca

SEQ ID NO: 183541 - RNA, 19 nt, Human
aagcucacauguucaggac

SEQ ID NO: 183542 - RNA, 24 nt, Human
acugaaacucagagacacuugcug

SEQ ID NO: 183543 - RNA, 18 nt, Human
agaggcuaaaaacuaaau

SEQ ID NO: 183544 - RNA, 25 nt, Human
aucauuuugccuuaacauuuccccu

SEQ ID NO: 183545 - RNA, 21 nt, Human
caaaaugaguacuuaagcuca

SEQ ID NO: 183546 - RNA, 19 nt, Human
caaagccuuuuaccuguuu

SEQ ID NO: 183547 - RNA, 22 nt, Human
caaucaaauuagauccagacaa

SEQ ID NO: 183548 - RNA, 21 nt, Human
caccuggauuuagcccuuggg

SEQ ID NO: 183549 - RNA, 24 nt, Human
cacuggggacaaaaugaguacuua

SEQ ID NO: 183550 - RNA, 24 nt, Human
cacuguucaaaguaguuaguccca

SEQ ID NO: 183551 - RNA, 22 nt, Human
ccagacaagguugaguauaaac

SEQ ID NO: 183552 - RNA, 19 nt, Human
ccuggaucucuguggcugg

SEQ ID NO: 183553 - RNA, 21 nt, Human
ccuguagacauacaauagcau

SEQ ID NO: 183554 - RNA, 21 nt, Human
ccuugggcugucaaaugcccu

SEQ ID NO: 183555 - RNA, 19 nt, Human
cuggcugaaccaucugugg

SEQ ID NO: 183556 - RNA, 18 nt, Human
cuggugauggcaaggaca

SEQ ID NO: 183557 - RNA, 19 nt, Human
cuugacauuacauggcuac

SEQ ID NO: 183558 - RNA, 22 nt, Human
gaaagaggcuaaaaacuaaauc

SEQ ID NO: 183559 - RNA, 26 nt, Human
gacuuuucuguuuuccuaucuuccuu

SEQ ID NO: 183560 - RNA, 20 nt, Human
gaguacugugacuuuucugu

SEQ ID NO: 183561 - RNA, 21 nt, Human
gauggcaaggacagugaagga

SEQ ID NO: 183562 - RNA, 18 nt, Human
ggaauuuuuccaggacau

SEQ ID NO: 183563 - RNA, 18 nt, Human
ggaguccccaaagccugg

SEQ ID NO: 183564 - RNA, 22 nt, Human
guccccaaagccuggaucucug

SEQ ID NO: 183565 - RNA, 22 nt, Human
guuaguaauggucauuccuucu

SEQ ID NO: 183566 - RNA, 23 nt, Human
uaaaucaaacacuggucgauaag

SEQ ID NO: 183567 - RNA, 22 nt, Human
uacaauagcaugcaaucuaaag

SEQ ID NO: 183568 - RNA, 24 nt, Human
uagcaucuguaucacuaacccugc

SEQ ID NO: 183569 - RNA, 21 nt, Human
uagcaugcaaucuaaagaaga

SEQ ID NO: 183570 - RNA, 22 nt, Human
ucaacacuguucaaaguaguua

SEQ ID NO: 183571 - RNA, 21 nt, Human
ucagagacacuugcuggcuug

SEQ ID NO: 183572 - RNA, 20 nt, Human
ucccagaccagaugccuucc

SEQ ID NO: 183573 - RNA, 20 nt, Human
ucucuguggcuggugauggc

SEQ ID NO: 183574 - RNA, 19 nt, Human
ucuguuuuccuaucuuccu

SEQ ID NO: 183575 - RNA, 20 nt, Human
ucuuucauuccugagauaga

SEQ ID NO: 183576 - RNA, 22 nt, Human
ugagauagagagaacugaguca

SEQ ID NO: 183577 - RNA, 20 nt, Human
ugaguauaaacuaaaagacc

SEQ ID NO: 183578 - RNA, 20 nt, Human
ugcaaucuaaagaagaaaaa

SEQ ID NO: 183579 - RNA, 21 nt, Human
ugcccuguagacauacaauag

SEQ ID NO: 183580 - RNA, 24 nt, Human
uggcaaggacagugaaggacagga

SEQ ID NO: 183581 - RNA, 19 nt, Human
uguaaggauuucugaaauu

SEQ ID NO: 183582 - RNA, 23 nt, Human
ugucaaaugcccuguagacauac

SEQ ID NO: 183583 - RNA, 26 nt, Human
uuaacauuuccccuguuguggauugg

SEQ ID NO: 183584 - RNA, 22 nt, Human
uuacugcuggcugaaccaucug

SEQ ID NO: 183585 - RNA, 19 nt, Human
uuagucccagaccagaugc

SEQ ID NO: 183586 - RNA, 24 nt, Human
uugaguacugugacuuuucuguuu

SEQ ID NO: 183587 - RNA, 23 nt, Human
uugccuagcauuacugcuggcug

SEQ ID NO: 183588 - RNA, 26 nt, Human
uuuaaaaauccucacauaaagcccuu

SEQ ID NO: 183589 - RNA, 24 nt, Human
uuuaguacuaaaauagucuauacu

SEQ ID NO: 183590 - RNA, 18 nt, Human
uuugaugggaaagaggcu

SEQ ID NO: 183591 - RNA, 21 nt, Human
cucaaggaagagcuguggaug

SEQ ID NO: 183592 - RNA, 20 nt, Human
gcucaaggaagagcugugga

SEQ ID NO: 183593 - RNA, 21 nt, Human
aaaaaacacuuucuaaaaacu

SEQ ID NO: 183594 - RNA, 22 nt, Human
aacaaaacaggauaaccauugg

SEQ ID NO: 183595 - RNA, 24 nt, Human
aacaacagauccaauuaaaaucca

SEQ ID NO: 183596 - RNA, 25 nt, Human
aagaaaaaugaaaacaacagaucca

SEQ ID NO: 183597 - RNA, 21 nt, Human
aaguggcuauuuugacuuaga

SEQ ID NO: 183598 - RNA, 21 nt, Human
acacaacaucauccagccccu

SEQ ID NO: 183599 - RNA, 19 nt, Human
aggaaagagauuuucucac

SEQ ID NO: 183600 - RNA, 18 nt, Human
agggccauaugccugaaa

SEQ ID NO: 183601 - RNA, 22 nt, Human
augauaaugaagaaaaaugaaa

SEQ ID NO: 183602 - RNA, 22 nt, Human
cacaacacucuuccuaagugaa

SEQ ID NO: 183603 - RNA, 22 nt, Human
caggacagagcuucaagccuug

SEQ ID NO: 183604 - RNA, 18 nt, Human
cagggccauaugccugaa

SEQ ID NO: 183605 - RNA, 19 nt, Human
ccucagcuucucuguguac

SEQ ID NO: 183606 - RNA, 24 nt, Human
cuaaaacagagcaggccaaacgca

SEQ ID NO: 183607 - RNA, 19 nt, Human
cucgaacacuggacaaaua

SEQ ID NO: 183608 - RNA, 18 nt, Human
cugcagcagccaaagcag

SEQ ID NO: 183609 - RNA, 19 nt, Human
cugcagcagccaaagcagg

SEQ ID NO: 183610 - RNA, 19 nt, Human
cuguguacuggcugucucc

SEQ ID NO: 183611 - RNA, 24 nt, Human
gaacacuggacaaauauauucacu

SEQ ID NO: 183612 - RNA, 21 nt, Human
gagcacucgaacacuggacaa

SEQ ID NO: 183613 - RNA, 19 nt, Human
gaucagggccauaugccug

SEQ ID NO: 183614 - RNA, 20 nt, Human
guguaacugcuguaagugca

SEQ ID NO: 183615 - RNA, 18 nt, Human
uaaauauuguaguugcug

SEQ ID NO: 183616 - RNA, 18 nt, Human
uaacacauucucaaaaca

SEQ ID NO: 183617 - RNA, 23 nt, Human
uaaccgaaucuaaaguccauguu

SEQ ID NO: 183618 - RNA, 19 nt, Human
uaacuguagcaccucagca

SEQ ID NO: 183619 - RNA, 25 nt, Human
uaacuucaaaaaacacuuucuaaaa

SEQ ID NO: 183620 - RNA, 18 nt, Human
uaaguggaccagcaacca

SEQ ID NO: 183621 - RNA, 18 nt, Human
uaaguucugacucaucua

SEQ ID NO: 183622 - RNA, 19 nt, Human
uacaucaaaacuaaguucu

SEQ ID NO: 183623 - RNA, 23 nt, Human
uaccugagcuccuuuuugacugu

SEQ ID NO: 183624 - RNA, 23 nt, Human
uagaaucaauccaacugacugca

SEQ ID NO: 183625 - RNA, 23 nt, Human
uaguugcuguuauuacacauuaa

SEQ ID NO: 183626 - RNA, 22 nt, Human
uaugccugaaaugaacaaaaca

SEQ ID NO: 183627 - RNA, 25 nt, Human
uaugucaaauuuugucccugagaua

SEQ ID NO: 183628 - RNA, 20 nt, Human
uauuguaguugcuguuauua

SEQ ID NO: 183629 - RNA, 21 nt, Human
uauuuacuauauacauuaucu

SEQ ID NO: 183630 - RNA, 21 nt, Human
uauuuugacuuagauggugca

SEQ ID NO: 183631 - RNA, 24 nt, Human
ucccaggacagagcuucaagccuu

SEQ ID NO: 183632 - RNA, 21 nt, Human
ucuaggagaauuacaaaaaaa

SEQ ID NO: 183633 - RNA, 21 nt, Human
ugaaaugaacaaaacaggaua

SEQ ID NO: 183634 - RNA, 21 nt, Human
ugaaaugaacaaaacaggaua

SEQ ID NO: 183635 - RNA, 19 nt, Human
ugagcagcuuagaccaguc

SEQ ID NO: 183636 - RNA, 20 nt, Human
ugagcagcuuagaccagucc

SEQ ID NO: 183637 - RNA, 23 nt, Human
uggaaagacauacaaauaugaaa

SEQ ID NO: 183638 - RNA, 27 nt, Human
uguaagugcauuuauauguguuuaugu

SEQ ID NO: 183639 - RNA, 23 nt, Human
uguacuggcugucuccugaaucu

SEQ ID NO: 183640 - RNA, 19 nt, Human
ugugaaagaucaaagguua

SEQ ID NO: 183641 - RNA, 22 nt, Human
uguugagcacucgaacacugga

SEQ ID NO: 183642 - RNA, 23 nt, Human
uuagaaucaauccaacugacugc

SEQ ID NO: 183643 - RNA, 18 nt, Human
uuauugguucauuuauua

SEQ ID NO: 183644 - RNA, 20 nt, Human
uucacaacacucuuccuaag

SEQ ID NO: 183645 - RNA, 18 nt, Human
uucccaggacagagcuuc

SEQ ID NO: 183646 - RNA, 18 nt, Human
uucuguccaacauacaga

SEQ ID NO: 183647 - RNA, 19 nt, Human
uucuuuuauagguuaucug

SEQ ID NO: 183648 - RNA, 19 nt, Human
uugaaauauuuauauccuc

SEQ ID NO: 183649 - RNA, 22 nt, Human
uuuauuauacuuguuuauucug

SEQ ID NO: 183650 - RNA, 22 nt, Human
aaaaaaaauacagugagaacaa

SEQ ID NO: 183651 - RNA, 25 nt, Human
aaaaaaauacagugagaacaaagac

SEQ ID NO: 183652 - RNA, 22 nt, Human
aaaaacaugaacagagcuuggg

SEQ ID NO: 183653 - RNA, 23 nt, Human
aaacaggacuuaaagccagccca

SEQ ID NO: 183654 - RNA, 20 nt, Human
aagagaccagagacagccac

SEQ ID NO: 183655 - RNA, 27 nt, Human
aagagaccagagacagccacuccugac

SEQ ID NO: 183656 - RNA, 21 nt, Human
aaggaagagaccagagacagc

SEQ ID NO: 183657 - RNA, 20 nt, Human
accacaagaggaauaaucaa

SEQ ID NO: 183658 - RNA, 20 nt, Human
acgggacggagggacgcaca

SEQ ID NO: 183659 - RNA, 20 nt, Human
agaaagaggcgugcagggau

SEQ ID NO: 183660 - RNA, 22 nt, Human
aggaauaaucaagaacuguggc

SEQ ID NO: 183661 - RNA, 25 nt, Human
auaaaaaaaauacagugagaacaaa

SEQ ID NO: 183662 - RNA, 20 nt, Human
aucacuucaucagaaagagg

SEQ ID NO: 183663 - RNA, 23 nt, Human
cacaaaaacaugaacagagcuug

SEQ ID NO: 183664 - RNA, 18 nt, Human
cagagcuugggugacaug

SEQ ID NO: 183665 - RNA, 19 nt, Human
caggcuccggggugacccc

SEQ ID NO: 183666 - RNA, 19 nt, Human
cagggauccaucugcagag

SEQ ID NO: 183667 - RNA, 19 nt, Human
ccaggauaaaaaaaauaca

SEQ ID NO: 183668 - RNA, 27 nt, Human
cccaggauaaaaaaaauacagugagaa

SEQ ID NO: 183669 - RNA, 19 nt, Human
ccccaggauaaaaaaaaua

SEQ ID NO: 183670 - RNA, 22 nt, Human
cuccggggugaccccgggacgg

SEQ ID NO: 183671 - RNA, 18 nt, Human
cugacacaugggcagagu

SEQ ID NO: 183672 - RNA, 21 nt, Human
cugacacaugggcagaguuuc

SEQ ID NO: 183673 - RNA, 24 nt, Human
gacuagcuacagacaccuacuaca

SEQ ID NO: 183674 - RNA, 20 nt, Human
gcuacagacaccuacuacaa

SEQ ID NO: 183675 - RNA, 20 nt, Human
ggacgcacagguagcugaag

SEQ ID NO: 183676 - RNA, 18 nt, Human
uaaagccagcccagaaac

SEQ ID NO: 183677 - RNA, 20 nt, Human
uaaagccagcccagaaacuc

SEQ ID NO: 183678 - RNA, 23 nt, Human
uaaaggaagagaccagagacagc

SEQ ID NO: 183679 - RNA, 22 nt, Human
uaacacauugcacgaggaaguc

SEQ ID NO: 183680 - RNA, 21 nt, Human
uagcugaagggcgagaggccg

SEQ ID NO: 183681 - RNA, 20 nt, Human
uaucuguguguuugugugug

SEQ ID NO: 183682 - RNA, 23 nt, Human
ucaagaacuguggccccaggaua

SEQ ID NO: 183683 - RNA, 21 nt, Human
ucagcuaaaggaagagaccag

SEQ ID NO: 183684 - RNA, 23 nt, Human
uccuuugacuuuaggucaagcuu

SEQ ID NO: 183685 - RNA, 18 nt, Human
ucuguguguuugugugug

SEQ ID NO: 183686 - RNA, 18 nt, Human
ugaaaugcuacacagguc

SEQ ID NO: 183687 - RNA, 22 nt, Human
ugaacagagcuugggugacaug

SEQ ID NO: 183688 - RNA, 19 nt, Human
ugaagugcucaaucugaaa

SEQ ID NO: 183689 - RNA, 22 nt, Human
ugagaacaaagaccucaggagu

SEQ ID NO: 183690 - RNA, 21 nt, Human
ugaugaacaucauaaaaaaug

SEQ ID NO: 183691 - RNA, 20 nt, Human
uggccccaggauaaaaaaaa

SEQ ID NO: 183692 - RNA, 19 nt, Human
uggguugcuuuuucaaaca

SEQ ID NO: 183693 - RNA, 23 nt, Human
uguuaguauuuuugauagugaag

SEQ ID NO: 183694 - RNA, 23 nt, Human
uuaaccacaagaggaauaaucaa

SEQ ID NO: 183695 - RNA, 21 nt, Human
uuccagguguggucuugaaga

SEQ ID NO: 183696 - RNA, 19 nt, Human
aaaaaaaaaauuccaggga

SEQ ID NO: 183697 - RNA, 23 nt, Human
aaaaaacacaaauuaagcacugc

SEQ ID NO: 183698 - RNA, 20 nt, Human
aaaacaagaaucacuagcca

SEQ ID NO: 183699 - RNA, 24 nt, Human
aaaacagaaagaaauacagcacac

SEQ ID NO: 183700 - RNA, 23 nt, Human
aaaagagaacagaguuagauaug

SEQ ID NO: 183701 - RNA, 19 nt, Human
aaacaaaacaaaacaaaaa

SEQ ID NO: 183702 - RNA, 25 nt, Human
aaacagaaagaaauacagcacacaa

SEQ ID NO: 183703 - RNA, 19 nt, Human
aaacagcugcacccaaagc

SEQ ID NO: 183704 - RNA, 26 nt, Human
aaaccagguauuaaaaaaacagaaag

SEQ ID NO: 183705 - RNA, 18 nt, Human
aaagaaauacagcacaca

SEQ ID NO: 183706 - RNA, 18 nt, Human
aaagauguaccucuuccc

SEQ ID NO: 183707 - RNA, 19 nt, Human
aaauggccuuuaaucaaag

SEQ ID NO: 183708 - RNA, 18 nt, Human
aacaaccaaaagagaaca

SEQ ID NO: 183709 - RNA, 23 nt, Human
aacguugggguguuuuauuuugg

SEQ ID NO: 183710 - RNA, 19 nt, Human
aagaguucacaaaccauca

SEQ ID NO: 183711 - RNA, 23 nt, Human
aagccaaaacaaaacaaaacaaa

SEQ ID NO: 183712 - RNA, 26 nt, Human
aagccaaaacaaaacaaaacaaaaaa

SEQ ID NO: 183713 - RNA, 19 nt, Human
aagcuauaaaauuuaagca

SEQ ID NO: 183714 - RNA, 22 nt, Human
aaguaauuccaaacuggaauaa

SEQ ID NO: 183715 - RNA, 24 nt, Human
aaugcuccacaaaaguaaaaagaa

SEQ ID NO: 183716 - RNA, 23 nt, Human
acaaaacaaaacaaaaaaccugu

SEQ ID NO: 183717 - RNA, 22 nt, Human
acacaaaaaacucaaacaaccc

SEQ ID NO: 183718 - RNA, 20 nt, Human
acacugcucccaagaacaau

SEQ ID NO: 183719 - RNA, 27 nt, Human
acagaaagaaauacagcacacaaaaaa

SEQ ID NO: 183720 - RNA, 26 nt, Human
accccaaaguaugaaugcuaaagagu

SEQ ID NO: 183721 - RNA, 22 nt, Human
acuaaacagcugcacccaaagc

SEQ ID NO: 183722 - RNA, 22 nt, Human
agaaacaaucugggucauucug

SEQ ID NO: 183723 - RNA, 23 nt, Human
agaaagaaauacagcacacaaaa

SEQ ID NO: 183724 - RNA, 25 nt, Human
agaaagaaauacagcacacaaaaaa

SEQ ID NO: 183725 - RNA, 21 nt, Human
agccaaaggcaauaagaaagu

SEQ ID NO: 183726 - RNA, 24 nt, Human
agcucauguaacuucagcauccac

SEQ ID NO: 183727 - RNA, 19 nt, Human
aguuaugaacaccuaugag

SEQ ID NO: 183728 - RNA, 23 nt, Human
aguuucugaacaaccaaaagaga

SEQ ID NO: 183729 - RNA, 23 nt, Human
augaagccaaaacaaaacaaaac

SEQ ID NO: 183730 - RNA, 21 nt, Human
caaaacaaaacaaaacaaaaa

SEQ ID NO: 183731 - RNA, 24 nt, Human
caaaacaaaacaaaacaaaaaacc

SEQ ID NO: 183732 - RNA, 21 nt, Human
caaaccaucagaccaauauca

SEQ ID NO: 183733 - RNA, 23 nt, Human
caaagcagaaacaaucuggguca

SEQ ID NO: 183734 - RNA, 21 nt, Human
caagaguucacaaaccaucag

SEQ ID NO: 183735 - RNA, 22 nt, Human
cacaaaaaacucaaacaaccca

SEQ ID NO: 183736 - RNA, 19 nt, Human
cacacaaaaaacucaaaca

SEQ ID NO: 183737 - RNA, 23 nt, Human
cacugcuuaagaaaaaaaaaaaa

SEQ ID NO: 183738 - RNA, 18 nt, Human
cagcaagaguucacaaac

SEQ ID NO: 183739 - RNA, 18 nt, Human
cagcugcacccaaagcag

SEQ ID NO: 183740 - RNA, 23 nt, Human
caguaggugccaauuugaguuua

SEQ ID NO: 183741 - RNA, 20 nt, Human
cauacaauaacaacauuaag

SEQ ID NO: 183742 - RNA, 18 nt, Human
cauguaacuucagcaucc

SEQ ID NO: 183743 - RNA, 25 nt, Human
ccaaaacaaaacaaaacaaaaaacc

SEQ ID NO: 183744 - RNA, 18 nt, Human
ccaauaucaauaagguaa

SEQ ID NO: 183745 - RNA, 19 nt, Human
cccaacccuagacuccaga

SEQ ID NO: 183746 - RNA, 21 nt, Human
cccaacccuagacuccagacc

SEQ ID NO: 183747 - RNA, 18 nt, Human
ccugaagaaaaaucucug

SEQ ID NO: 183748 - RNA, 24 nt, Human
cuaaacagcugcacccaaagcaga

SEQ ID NO: 183749 - RNA, 22 nt, Human
cuauaccacucucccuuccuga

SEQ ID NO: 183750 - RNA, 20 nt, Human
cuauguaaaguaacauacac

SEQ ID NO: 183751 - RNA, 19 nt, Human
cugaacgagaucaaacuga

SEQ ID NO: 183752 - RNA, 18 nt, Human
gaaaagcugacagagagc

SEQ ID NO: 183753 - RNA, 22 nt, Human
gaacuaaacagcugcacccaaa

SEQ ID NO: 183754 - RNA, 25 nt, Human
gacugucucuggcagugauuuccau

SEQ ID NO: 183755 - RNA, 19 nt, Human
gcuccacaaaaguaaaaag

SEQ ID NO: 183756 - RNA, 21 nt, Human
uaaagcuauaaaauuuaagca

SEQ ID NO: 183757 - RNA, 30 nt, Human
uaaaguaacauacacugcucccaagaaccg

SEQ ID NO: 183758 - RNA, 19 nt, Human
uaacaacauacaauaacaa

SEQ ID NO: 183759 - RNA, 20 nt, Human
uaacaacauacaauaacaac

SEQ ID NO: 183760 - RNA, 23 nt, Human
uaacauacacugcucccaagaac

SEQ ID NO: 183761 - RNA, 21 nt, Human
uacacugcucccaagaacaau

SEQ ID NO: 183762 - RNA, 22 nt, Human
uacacugcucccaagaacaaug

SEQ ID NO: 183763 - RNA, 23 nt, Human
uacagcacacaaaaaacucaaac

SEQ ID NO: 183764 - RNA, 21 nt, Human
uaccaaauaaagauacaagga

SEQ ID NO: 183765 - RNA, 21 nt, Human
uacucuaugaagccaaaacaa

SEQ ID NO: 183766 - RNA, 19 nt, Human
uagaggacacuguaacuac

SEQ ID NO: 183767 - RNA, 23 nt, Human
uauaaaauuuaagcaugggcaua

SEQ ID NO: 183768 - RNA, 22 nt, Human
uauaccacucucccuuccugaa

SEQ ID NO: 183769 - RNA, 18 nt, Human
uaugaagccaaaacaaaa

SEQ ID NO: 183770 - RNA, 22 nt, Human
uaugaagccaaaacaaaacaaa

SEQ ID NO: 183771 - RNA, 19 nt, Human
ucugaacuaaacagcugca

SEQ ID NO: 183772 - RNA, 21 nt, Human
ugaaaacaagaaucacuagcc

SEQ ID NO: 183773 - RNA, 22 nt, Human
ugaaaagcugacagagagccug

SEQ ID NO: 183774 - RNA, 21 nt, Human
ugaacaugaacacaugacagg

SEQ ID NO: 183775 - RNA, 24 nt, Human
ugaagccaaaacaaaacaaaacaa

SEQ ID NO: 183776 - RNA, 20 nt, Human
ugacaggaaccgcugcuaug

SEQ ID NO: 183777 - RNA, 24 nt, Human
ugagguguugaguuuuuaaguuuu

SEQ ID NO: 183778 - RNA, 23 nt, Human
ugcacccaaagcagaaacaaucu

SEQ ID NO: 183779 - RNA, 22 nt, Human
ugcccaacccuagacuccagac

SEQ ID NO: 183780 - RNA, 20 nt, Human
ugcuuaagaaaaaaaaaaaa

SEQ ID NO: 183781 - RNA, 24 nt, Human
ugcuuuuuaaaaguuuauuuuaca

SEQ ID NO: 183782 - RNA, 24 nt, Human
uguucuacguaucuugauacuuca

SEQ ID NO: 183783 - RNA, 21 nt, Human
uuaaaaaacacaaauuaagca

SEQ ID NO: 183784 - RNA, 24 nt, Human
uuaaauauuuaacauguagcucau

SEQ ID NO: 183785 - RNA, 23 nt, Human
uuagugccugcuuuuuaaaaguu

SEQ ID NO: 183786 - RNA, 19 nt, Human
uucaguaaggaaaaaaaga

SEQ ID NO: 183787 - RNA, 23 nt, Human
uuccauauuagugcaauguuacu

SEQ ID NO: 183788 - RNA, 22 nt, Human
uuuuuuuuuuuuuuuuuuacag

SEQ ID NO: 183789 - RNA, 21 nt, Human
aaacaacauaaaacucuuccc

SEQ ID NO: 183790 - RNA, 21 nt, Human
aaauguugaaguuucugaacc

SEQ ID NO: 183791 - RNA, 21 nt, Human
aacaaugagguacugccauuu

SEQ ID NO: 183792 - RNA, 23 nt, Human
aacugcuucuuaauggcagcaau

SEQ ID NO: 183793 - RNA, 20 nt, Human
aacuucccuuucucuuuccu

SEQ ID NO: 183794 - RNA, 21 nt, Human
aagaaaaaacuaucaccauuu

SEQ ID NO: 183795 - RNA, 22 nt, Human
aagcagccuguugcugauugcc

SEQ ID NO: 183796 - RNA, 18 nt, Human
aauuccauaauucuugcu

SEQ ID NO: 183797 - RNA, 23 nt, Human
acccuaaaaauaaauaggaaagg

SEQ ID NO: 183798 - RNA, 19 nt, Human
acccuguuguccuuuucuu

SEQ ID NO: 183799 - RNA, 22 nt, Human
accucaaaauguauugcacaag

SEQ ID NO: 183800 - RNA, 24 nt, Human
acuccuuuucagaagcagccuguu

SEQ ID NO: 183801 - RNA, 18 nt, Human
acuucccuuucucuuucc

SEQ ID NO: 183802 - RNA, 19 nt, Human
acuuucugacucaagccua

SEQ ID NO: 183803 - RNA, 18 nt, Human
agcuucuaauaaggcuuc

SEQ ID NO: 183804 - RNA, 18 nt, Human
auggcagcaauuuuuugu

SEQ ID NO: 183805 - RNA, 22 nt, Human
caaguguggacaguuuuccaag

SEQ ID NO: 183806 - RNA, 22 nt, Human
cagaaaaaauccacuaaguuuc

SEQ ID NO: 183807 - RNA, 19 nt, Human
caguaguguuuuuuccucu

SEQ ID NO: 183808 - RNA, 20 nt, Human
ccaaugccuuuaacuccucc

SEQ ID NO: 183809 - RNA, 21 nt, Human
cccaagagaaaacugaagaaa

SEQ ID NO: 183810 - RNA, 19 nt, Human
ccucuaggcuuuuguuacu

SEQ ID NO: 183811 - RNA, 23 nt, Human
ccucugaaaaauauaaguacaaa

SEQ ID NO: 183812 - RNA, 24 nt, Human
ccuuugauuuuaacucaagcugga

SEQ ID NO: 183813 - RNA, 18 nt, Human
cucagagugucaacuuua

SEQ ID NO: 183814 - RNA, 19 nt, Human
cuuuauuuaucuguuucuc

SEQ ID NO: 183815 - RNA, 23 nt, Human
gacaaugagaaauccuagaaaga

SEQ ID NO: 183816 - RNA, 24 nt, Human
gaggggcccugaaugacaacuuca

SEQ ID NO: 183817 - RNA, 22 nt, Human
gccuguugcugauugccuccuu

SEQ ID NO: 183818 - RNA, 24 nt, Human
gccuucaugcucuuaauuugauuu

SEQ ID NO: 183819 - RNA, 18 nt, Human
ggggcccugaaugacaac

SEQ ID NO: 183820 - RNA, 21 nt, Human
guccuuuucuucuccuaacuc

SEQ ID NO: 183821 - RNA, 20 nt, Human
guuguccuuuucuucuccua

SEQ ID NO: 183822 - RNA, 21 nt, Human
uaaaaauaaauaggaaaggua

SEQ ID NO: 183823 - RNA, 23 nt, Human
uaaacaacauaaaacucuuccca

SEQ ID NO: 183824 - RNA, 18 nt, Human
uaaaggcagucugcaacu

SEQ ID NO: 183825 - RNA, 21 nt, Human
uaauuuaucagaaaaaaucca

SEQ ID NO: 183826 - RNA, 18 nt, Human
uacaugaggggcccugaa

SEQ ID NO: 183827 - RNA, 21 nt, Human
uagugaugaaauggcugcuuc

SEQ ID NO: 183828 - RNA, 19 nt, Human
uaguguuuuuuccucugaa

SEQ ID NO: 183829 - RNA, 24 nt, Human
uauacuguucuucuuucucuucca

SEQ ID NO: 183830 - RNA, 25 nt, Human
uaucagaaaaaauccacuaaguuuc

SEQ ID NO: 183831 - RNA, 21 nt, Human
ucaaccucuagcuuuucaaga

SEQ ID NO: 183832 - RNA, 25 nt, Human
ucaagagcagaaauuuucucuuuac

SEQ ID NO: 183833 - RNA, 20 nt, Human
ucaccucaaaauguauugca

SEQ ID NO: 183834 - RNA, 23 nt, Human
ucacucaaauggcuuucuguacc

SEQ ID NO: 183835 - RNA, 21 nt, Human
uccaagcagcagucacccaau

SEQ ID NO: 183836 - RNA, 18 nt, Human
uccaaugccuuuaacucc

SEQ ID NO: 183837 - RNA, 23 nt, Human
uccacugacuuaaguuuuucuuc

SEQ ID NO: 183838 - RNA, 18 nt, Human
uccuuccuucuguaaggc

SEQ ID NO: 183839 - RNA, 18 nt, Human
ucugcuaauuuugcagcc

SEQ ID NO: 183840 - RNA, 21 nt, Human
ucuggaauucuucaucugugg

SEQ ID NO: 183841 - RNA, 21 nt, Human
ucuguaccuuuuuuauacugu

SEQ ID NO: 183842 - RNA, 25 nt, Human
ucuuaauuugauuuucuuuuucuuu

SEQ ID NO: 183843 - RNA, 22 nt, Human
ucuugcucuugucgucuuccau

SEQ ID NO: 183844 - RNA, 27 nt, Human
ucuuucuucuuaguuucaaguucagcu

SEQ ID NO: 183845 - RNA, 25 nt, Human
ugaaugacaacuucauucucaaaga

SEQ ID NO: 183846 - RNA, 26 nt, Human
ugaaugacaacuucauucucaaagag

SEQ ID NO: 183847 - RNA, 18 nt, Human
ugagguacugccauuugg

SEQ ID NO: 183848 - RNA, 24 nt, Human
ugaugaaauggcugcuucuuuuuc

SEQ ID NO: 183849 - RNA, 19 nt, Human
ugauuagcucauuuguuuu

SEQ ID NO: 183850 - RNA, 21 nt, Human
ugcauacaauacaguuaugua

SEQ ID NO: 183851 - RNA, 22 nt, Human
ugcuucuuuuucggauaggcug

SEQ ID NO: 183852 - RNA, 18 nt, Human
uggaauaaacuugguuuu

SEQ ID NO: 183853 - RNA, 19 nt, Human
uggaauucuucaucugugg

SEQ ID NO: 183854 - RNA, 18 nt, Human
uggucuuuuggcuacaug

SEQ ID NO: 183855 - RNA, 20 nt, Human
ugugaacuucccuuucucuu

SEQ ID NO: 183856 - RNA, 20 nt, Human
ugugcaagagaauucacaug

SEQ ID NO: 183857 - RNA, 19 nt, Human
ugugcaaguuuuaauuaac

SEQ ID NO: 183858 - RNA, 23 nt, Human
uguuacaagacuuucaauaucag

SEQ ID NO: 183859 - RNA, 22 nt, Human
uguuacuuuuuucaugugaaga

SEQ ID NO: 183860 - RNA, 23 nt, Human
uuacuaccuacuaauguugauua

SEQ ID NO: 183861 - RNA, 20 nt, Human
uuaguuguuuacuaagacug

SEQ ID NO: 183862 - RNA, 18 nt, Human
uucaaacucuggaauucu

SEQ ID NO: 183863 - RNA, 23 nt, Human
uucaacagaucaaccugaauaaa

SEQ ID NO: 183864 - RNA, 21 nt, Human
uucaagaugaagaucggagcc

SEQ ID NO: 183865 - RNA, 21 nt, Human
uucaauaucagccuucaugcu

SEQ ID NO: 183866 - RNA, 27 nt, Human
uucaauaucagccuucaugcucuuaau

SEQ ID NO: 183867 - RNA, 21 nt, Human
uucauggaauaaacuugguuu

SEQ ID NO: 183868 - RNA, 23 nt, Human
uucauggaauaaacuugguuuuc

SEQ ID NO: 183869 - RNA, 21 nt, Human
uuccauucacccuuuaaacaa

SEQ ID NO: 183870 - RNA, 20 nt, Human
uuccucugaaaaauauaagu

SEQ ID NO: 183871 - RNA, 24 nt, Human
uuccucugaaaaauauaaguacaa

SEQ ID NO: 183872 - RNA, 26 nt, Human
uucuccaucuugcucuugucgucuuc

SEQ ID NO: 183873 - RNA, 18 nt, Human
uucuucuuucucuuccau

SEQ ID NO: 183874 - RNA, 20 nt, Human
uugaaguuucugaaccaauu

SEQ ID NO: 183875 - RNA, 21 nt, Human
uugaugcuguguaaaucuuga

SEQ ID NO: 183876 - RNA, 25 nt, Human
uuucacacuuaaauucacauguucu

SEQ ID NO: 183877 - RNA, 22 nt, Human
uuucugaaccaauucuuugugu

SEQ ID NO: 183878 - RNA, 20 nt, Human
uuugagacuuuaacucuguu

SEQ ID NO: 183879 - RNA, 22 nt, Human
aauacaauuaguuucccugauu

SEQ ID NO: 183880 - RNA, 22 nt, Human
acaaccaaucacugcaacaacu

SEQ ID NO: 183881 - RNA, 21 nt, Human
auauauuaggaccacuaaacu

SEQ ID NO: 183882 - RNA, 21 nt, Human
caaccaaucacugcaacaacu

SEQ ID NO: 183883 - RNA, 19 nt, Human
cagaggugaacaaccccac

SEQ ID NO: 183884 - RNA, 20 nt, Human
cagaucccaagucuagaaag

SEQ ID NO: 183885 - RNA, 18 nt, Human
ccgccguccugggccgcg

SEQ ID NO: 183886 - RNA, 22 nt, Human
cuguacagaggugaacaacccc

SEQ ID NO: 183887 - RNA, 23 nt, Human
gaaaaagacaaccaaucacugca

SEQ ID NO: 183888 - RNA, 20 nt, Human
gaaauuggaagauuuaggua

SEQ ID NO: 183889 - RNA, 22 nt, Human
uaaaaagauuuacaccaaucaa

SEQ ID NO: 183890 - RNA, 21 nt, Human
uagaaaaagacaaccaaucac

SEQ ID NO: 183891 - RNA, 18 nt, Human
uauaaaaaaaaaacuuuu

SEQ ID NO: 183892 - RNA, 21 nt, Human
uauaaaaagauuuacaccaau

SEQ ID NO: 183893 - RNA, 25 nt, Human
uauaaaaagauuuacaccaaucaag

SEQ ID NO: 183894 - RNA, 19 nt, Human
ucagauaaagcagagcuga

SEQ ID NO: 183895 - RNA, 19 nt, Human
ucuagaaaaagacaaccaa

SEQ ID NO: 183896 - RNA, 21 nt, Human
ugaauuauaaaaaaaaaacuu

SEQ ID NO: 183897 - RNA, 22 nt, Human
ugcacuguucucagaaauuuua

SEQ ID NO: 183898 - RNA, 19 nt, Human
uuuuagaaacucuuaccau

SEQ ID NO: 183899 - RNA, 21 nt, Human
uuuuuuuuuuuucuuuuauuu

SEQ ID NO: 183900 - RNA, 24 nt, Human
uuuuuuuuuuuuuuuuuuucuuuu

SEQ ID NO: 183901 - RNA, 23 nt, Human
aaauauuagcauugauacccauu

SEQ ID NO: 183902 - RNA, 23 nt, Human
aacaggaaagaacaaaagggucu

SEQ ID NO: 183903 - RNA, 21 nt, Human
aaccccuuccuuccucaccuc

SEQ ID NO: 183904 - RNA, 21 nt, Human
aagagccagaaccuuugggug

SEQ ID NO: 183905 - RNA, 21 nt, Human
aagcuagaagacgaggccaga

SEQ ID NO: 183906 - RNA, 21 nt, Human
acacuggauuaugaccagacc

SEQ ID NO: 183907 - RNA, 19 nt, Human
acagauggggugggcugaa

SEQ ID NO: 183908 - RNA, 20 nt, Human
acccauuuuauccuccaacu

SEQ ID NO: 183909 - RNA, 21 nt, Human
agagcaggaccaagcacugga

SEQ ID NO: 183910 - RNA, 24 nt, Human
agauauccucccacaaggcccuuc

SEQ ID NO: 183911 - RNA, 18 nt, Human
agcagacauuccuugucc

SEQ ID NO: 183912 - RNA, 21 nt, Human
aggaguugccacuggggauac

SEQ ID NO: 183913 - RNA, 20 nt, Human
aggccaacacuggacagcaa

SEQ ID NO: 183914 - RNA, 24 nt, Human
aguacacugccucucucucccucc

SEQ ID NO: 183915 - RNA, 18 nt, Human
agugcagcccgggcugcc

SEQ ID NO: 183916 - RNA, 21 nt, Human
auuagcagugugggaacugag

SEQ ID NO: 183917 - RNA, 18 nt, Human
auucacuauuggggcugg

SEQ ID NO: 183918 - RNA, 23 nt, Human
caaaagauauccucccacaaggc

SEQ ID NO: 183919 - RNA, 21 nt, Human
caagcuagaagacgaggccag

SEQ ID NO: 183920 - RNA, 18 nt, Human
caaguacacugccucucu

SEQ ID NO: 183921 - RNA, 26 nt, Human
caaguacacugccucucucucccucc

SEQ ID NO: 183922 - RNA, 20 nt, Human
cacugccucucucucccucc

SEQ ID NO: 183923 - RNA, 23 nt, Human
cacugccucucucucccuccuga

SEQ ID NO: 183924 - RNA, 18 nt, Human
cagagaaagaaagaaacc

SEQ ID NO: 183925 - RNA, 22 nt, Human
caguagcaccgacucgcucucu

SEQ ID NO: 183926 - RNA, 19 nt, Human
cauagcagauuacagagaa

SEQ ID NO: 183927 - RNA, 19 nt, Human
cauguacaccagcauuaca

SEQ ID NO: 183928 - RNA, 24 nt, Human
ccaaaagauauccucccacaaggc

SEQ ID NO: 183929 - RNA, 18 nt, Human
ccagaacaguccuguggc

SEQ ID NO: 183930 - RNA, 18 nt, Human
ccagagcaggaccaagca

SEQ ID NO: 183931 - RNA, 24 nt, Human
ccagcauuacaaaugauccuguaa

SEQ ID NO: 183932 - RNA, 23 nt, Human
ccaguagcaccgacucgcucucu

SEQ ID NO: 183933 - RNA, 24 nt, Human
ccaguagcaccgacucgcucucuc

SEQ ID NO: 183934 - RNA, 20 nt, Human
cccaccaaagcagcaaggaa

SEQ ID NO: 183935 - RNA, 20 nt, Human
ccccccagagcagacauucc

SEQ ID NO: 183936 - RNA, 25 nt, Human
cccccucucaccacccacugaggcc

SEQ ID NO: 183937 - RNA, 20 nt, Human
ccccuacaacaggaaagaac

SEQ ID NO: 183938 - RNA, 24 nt, Human
ccccuacaacaggaaagaacaaaa

SEQ ID NO: 183939 - RNA, 19 nt, Human
ccccuuccuuccucaccuc

SEQ ID NO: 183940 - RNA, 19 nt, Human
cccgcugcgccuacccgga

SEQ ID NO: 183941 - RNA, 18 nt, Human
ccggcgccaguagcaccg

SEQ ID NO: 183942 - RNA, 21 nt, Human
ccggcgccaguagcaccgacu

SEQ ID NO: 183943 - RNA, 27 nt, Human
ccuaaccuagccuuaaccuccaaaggc

SEQ ID NO: 183944 - RNA, 22 nt, Human
ccucccuccaggagaugggggc

SEQ ID NO: 183945 - RNA, 18 nt, Human
cgccaguagcaccgacuc

SEQ ID NO: 183946 - RNA, 20 nt, Human
cggcacccagguccaguccc

SEQ ID NO: 183947 - RNA, 30 nt, Human
cucacuguuaugcacacguaucagcugcuu

SEQ ID NO: 183948 - RNA, 18 nt, Human
cugcauaccugacacagc

SEQ ID NO: 183949 - RNA, 19 nt, Human
cugcugccuccugggaagc

SEQ ID NO: 183950 - RNA, 26 nt, Human
cugcugccuccugggaagccccagug

SEQ ID NO: 183951 - RNA, 24 nt, Human
gaggccagagcagcuuucauagua

SEQ ID NO: 183952 - RNA, 20 nt, Human
gcaacuuugggucagacugc

SEQ ID NO: 183953 - RNA, 23 nt, Human
gcagauuacagagaaagaaagaa

SEQ ID NO: 183954 - RNA, 25 nt, Human
gcagauuacagagaaagaaagaaac

SEQ ID NO: 183955 - RNA, 23 nt, Human
ggacaaggacacaugacagagga

SEQ ID NO: 183956 - RNA, 24 nt, Human
ggacagcaaccccuuccuuccuca

SEQ ID NO: 183957 - RNA, 18 nt, Human
ggcagcggcuccgcucgg

SEQ ID NO: 183958 - RNA, 20 nt, Human
ggccaaaagauauccuccca

SEQ ID NO: 183959 - RNA, 20 nt, Human
ggcugagcugugcaggaaga

SEQ ID NO: 183960 - RNA, 19 nt, Human
gggccguccccagguggag

SEQ ID NO: 183961 - RNA, 20 nt, Human
gggcuccagggucccuuccc

SEQ ID NO: 183962 - RNA, 24 nt, Human
ggguccagucaacacagcagagga

SEQ ID NO: 183963 - RNA, 21 nt, Human
ggguuugcuuuaaaugaaggg

SEQ ID NO: 183964 - RNA, 23 nt, Human
gguggagugcagggccuaaccua

SEQ ID NO: 183965 - RNA, 20 nt, Human
gucccagggcuccagggucc

SEQ ID NO: 183966 - RNA, 18 nt, Human
uaacaggaguugccacug

SEQ ID NO: 183967 - RNA, 21 nt, Human
uaaccuagccuuaaccuccaa

SEQ ID NO: 183968 - RNA, 24 nt, Human
uaaccuccaaaggcaccuggggug

SEQ ID NO: 183969 - RNA, 20 nt, Human
uacacggccaaaagauaucc

SEQ ID NO: 183970 - RNA, 19 nt, Human
uacagauggggugggcuga

SEQ ID NO: 183971 - RNA, 21 nt, Human
uagaagacgaggccagagcag

SEQ ID NO: 183972 - RNA, 22 nt, Human
uagaauuuccaacgcaccuccc

SEQ ID NO: 183973 - RNA, 22 nt, Human
uagcaccgacucgcucucucgg

SEQ ID NO: 183974 - RNA, 23 nt, Human
uauccucccacaaggcccauggc

SEQ ID NO: 183975 - RNA, 21 nt, Human
uauucacuauuggggcugggu

SEQ ID NO: 183976 - RNA, 20 nt, Human
ucaaagcgaccaggccaaca

SEQ ID NO: 183977 - RNA, 21 nt, Human
ucccagggcuccagggucccu

SEQ ID NO: 183978 - RNA, 20 nt, Human
uccccuaauucccccuuggg

SEQ ID NO: 183979 - RNA, 20 nt, Human
uccccuacaacaggaaagaa

SEQ ID NO: 183980 - RNA, 26 nt, Human
ucccugaggaagaagaaauauugugg

SEQ ID NO: 183981 - RNA, 23 nt, Human
ucccugcauguacaccagcauua

SEQ ID NO: 183982 - RNA, 18 nt, Human
ucccuggaaauauuagca

SEQ ID NO: 183983 - RNA, 21 nt, Human
ucccuuccaguacagaugggg

SEQ ID NO: 183984 - RNA, 23 nt, Human
uccugcauuccagcagacuugac

SEQ ID NO: 183985 - RNA, 19 nt, Human
ugaggaagaagaaauauug

SEQ ID NO: 183986 - RNA, 19 nt, Human
ugaguucccugcauguaca

SEQ ID NO: 183987 - RNA, 22 nt, Human
ugaugaggggccguccccaggu

SEQ ID NO: 183988 - RNA, 23 nt, Human
ugccacuggggauacaggucugu

SEQ ID NO: 183989 - RNA, 19 nt, Human
uggacagcaaccccuuccu

SEQ ID NO: 183990 - RNA, 22 nt, Human
uggggagaacagcuuccucccc

SEQ ID NO: 183991 - RNA, 25 nt, Human
ugggguggggagaacagcuuccucc

SEQ ID NO: 183992 - RNA, 21 nt, Human
ugggguugggaaccgugcgug

SEQ ID NO: 183993 - RNA, 18 nt, Human
ugggucagacugccaggc

SEQ ID NO: 183994 - RNA, 19 nt, Human
ugucccaccaaagcagcaa

SEQ ID NO: 183995 - RNA, 22 nt, Human
ugugcaggaagaaucaaagcga

SEQ ID NO: 183996 - RNA, 22 nt, Human
uguuugggacuugaaagggggu

SEQ ID NO: 183997 - RNA, 21 nt, Human
uucacacuggauuaugaccag

SEQ ID NO: 183998 - RNA, 19 nt, Human
uuccuuccucaccucaucu

SEQ ID NO: 183999 - RNA, 27 nt, Human
uuugcuaauuugggacccucccuccaa

SEQ ID NO: 184000 - RNA, 18 nt, Human
aaaacacagcacagagaa

SEQ ID NO: 184001 - RNA, 21 nt, Human
accagggugugaaagcggugg

SEQ ID NO: 184002 - RNA, 18 nt, Human
agaccagggugugaaagc

SEQ ID NO: 184003 - RNA, 23 nt, Human
caagacagucaacuucucccucc

SEQ ID NO: 184004 - RNA, 24 nt, Human
cagcacagagaaacuguggcuuca

SEQ ID NO: 184005 - RNA, 21 nt, Human
cuaauuaucaagacagucaac

SEQ ID NO: 184006 - RNA, 18 nt, Human
guggcuucagcucaaccu

SEQ ID NO: 184007 - RNA, 27 nt, Human
ucaacuucucccuccgauguuuccuua

SEQ ID NO: 184008 - RNA, 19 nt, Human
ucuugcauucauccugcug

SEQ ID NO: 184009 - RNA, 19 nt, Human
ugaaagcgguggcugucaa

SEQ ID NO: 184010 - RNA, 23 nt, Human
ugucacagaguccaucacuguca

SEQ ID NO: 184011 - RNA, 18 nt, Human
uguguuagaaaacacagc

SEQ ID NO: 184012 - RNA, 19 nt, Human
aaacuagaggacuggcucu

SEQ ID NO: 184013 - RNA, 18 nt, Human
aggccacggcuccggcuc

SEQ ID NO: 184014 - RNA, 27 nt, Human
cacacacacacacacuugcaggcugug

SEQ ID NO: 184015 - RNA, 23 nt, Human
caccacgaaaagauguccuauca

SEQ ID NO: 184016 - RNA, 18 nt, Human
ccccccucucucuuucac

SEQ ID NO: 184017 - RNA, 18 nt, Human
cccccucucucuuucaca

SEQ ID NO: 184018 - RNA, 20 nt, Human
ccggcaggccacggcuccgg

SEQ ID NO: 184019 - RNA, 22 nt, Human
ccucccagaguucaagaacaaa

SEQ ID NO: 184020 - RNA, 19 nt, Human
ccucugggccccccucucu

SEQ ID NO: 184021 - RNA, 24 nt, Human
cggcccggcaggccacggcuccgg

SEQ ID NO: 184022 - RNA, 22 nt, Human
cggccucugggccccccucucu

SEQ ID NO: 184023 - RNA, 22 nt, Human
gcuguucagccacugagcgugg

SEQ ID NO: 184024 - RNA, 21 nt, Human
ggaaagcacuggugcacacca

SEQ ID NO: 184025 - RNA, 20 nt, Human
guggaaagcacuggugcaca

SEQ ID NO: 184026 - RNA, 20 nt, Human
ucugaaggugcagcaugagg

SEQ ID NO: 184027 - RNA, 18 nt, Human
ugcacaccacgaaaagau

SEQ ID NO: 184028 - RNA, 20 nt, Human
ugcuguucagccacugagcg

SEQ ID NO: 184029 - RNA, 20 nt, Human
ugggaaugcuguucagccac

SEQ ID NO: 184030 - RNA, 22 nt, Human
uucacacacacacacacuugca

SEQ ID NO: 184031 - RNA, 19 nt, Human
uugcaggcugugggaaugc

SEQ ID NO: 184032 - RNA, 26 nt, Human
uuuuuccaccucugcaauuuuuauuc

SEQ ID NO: 184033 - RNA, 22 nt, Human
uuuuuuuuuuuuuuuuccaccu

SEQ ID NO: 184034 - RNA, 18 nt, Human
uuuuuuuuuuuuuuuuug

SEQ ID NO: 184035 - RNA, 18 nt, Human
uuuuuuuuuuuuuuuuug

SEQ ID NO: 184036 - RNA, 18 nt, Human
aaugccgcagccgacacc

SEQ ID NO: 184037 - RNA, 21 nt, Human
accuccaaaggcucuaauccc

SEQ ID NO: 184038 - RNA, 19 nt, Human
acuuuggugguacuggacg

SEQ ID NO: 184039 - RNA, 22 nt, Human
agaaagagcagggagaccagac

SEQ ID NO: 184040 - RNA, 20 nt, Human
agaagcacguggccgccaca

SEQ ID NO: 184041 - RNA, 18 nt, Human
aggcagggaacacacaug

SEQ ID NO: 184042 - RNA, 18 nt, Human
auccuucuuaccacaguc

SEQ ID NO: 184043 - RNA, 22 nt, Human
augucaugauuaaauauccuuc

SEQ ID NO: 184044 - RNA, 21 nt, Human
auucacacuuuggcuccuuca

SEQ ID NO: 184045 - RNA, 23 nt, Human
cacaaccaugcagaaagagcagg

SEQ ID NO: 184046 - RNA, 18 nt, Human
cacacacaacacuccuuu

SEQ ID NO: 184047 - RNA, 24 nt, Human
cacuuuggcuccuucagacaacuu

SEQ ID NO: 184048 - RNA, 23 nt, Human
caugauuaaauauccuucuuacc

SEQ ID NO: 184049 - RNA, 23 nt, Human
cccacauucacacuuuggcuccu

SEQ ID NO: 184050 - RNA, 25 nt, Human
ccgacacccacauucacacuuuggc

SEQ ID NO: 184051 - RNA, 26 nt, Human
ccgacacccacauucacacuuuggcu

SEQ ID NO: 184052 - RNA, 25 nt, Human
ccuccaaaggcucuaaucccagucu

SEQ ID NO: 184053 - RNA, 18 nt, Human
cuccaaaggcucuaaucc

SEQ ID NO: 184054 - RNA, 26 nt, Human
gaaccaaagcuuaggacuagggacac

SEQ ID NO: 184055 - RNA, 23 nt, Human
guagaacacaauagaauggcuca

SEQ ID NO: 184056 - RNA, 23 nt, Human
guauguacauguagguuugugca

SEQ ID NO: 184057 - RNA, 21 nt, Human
gucacccuaaagaaccaaagc

SEQ ID NO: 184058 - RNA, 23 nt, Human
uaaagaaccaaagcuuaggacua

SEQ ID NO: 184059 - RNA, 25 nt, Human
uagaacacaauagaauggcucaaaa

SEQ ID NO: 184060 - RNA, 21 nt, Human
uaggugaaguagaacacaaua

SEQ ID NO: 184061 - RNA, 22 nt, Human
uauguacauguagguuugugca

SEQ ID NO: 184062 - RNA, 20 nt, Human
uauguacguguccgugcaug

SEQ ID NO: 184063 - RNA, 20 nt, Human
ucaugauuaaauauccuucu

SEQ ID NO: 184064 - RNA, 19 nt, Human
uccuucagacaacuugauc

SEQ ID NO: 184065 - RNA, 21 nt, Human
ucucaagggauguucucuuca

SEQ ID NO: 184066 - RNA, 21 nt, Human
ucucaagggauguucucuuca

SEQ ID NO: 184067 - RNA, 25 nt, Human
ucucaugaucaaaguacucuuuuau

SEQ ID NO: 184068 - RNA, 19 nt, Human
ugacagagaacuacuuugg

SEQ ID NO: 184069 - RNA, 23 nt, Human
ugccucaccagagcagcuuucag

SEQ ID NO: 184070 - RNA, 24 nt, Human
ugggacuagaauuuguacagagaa

SEQ ID NO: 184071 - RNA, 18 nt, Human
uguacagagucaaacacc

SEQ ID NO: 184072 - RNA, 19 nt, Human
aaaagaacggcaaugacaa

SEQ ID NO: 184073 - RNA, 22 nt, Human
aacuaggccuucucucaaagcc

SEQ ID NO: 184074 - RNA, 23 nt, Human
aacucuuugagaaaaguuggaga

SEQ ID NO: 184075 - RNA, 22 nt, Human
aaguuggagaaaaaaggaccgg

SEQ ID NO: 184076 - RNA, 23 nt, Human
acaccacauucaacaaagggagg

SEQ ID NO: 184077 - RNA, 22 nt, Human
agagaaaccaggccgcaauaag

SEQ ID NO: 184078 - RNA, 20 nt, Human
agagacaacaucccaacugg

SEQ ID NO: 184079 - RNA, 19 nt, Human
agagcagauggugguucuu

SEQ ID NO: 184080 - RNA, 22 nt, Human
agugggugaagccugaacccag

SEQ ID NO: 184081 - RNA, 20 nt, Human
caaagccuagaauauccucu

SEQ ID NO: 184082 - RNA, 22 nt, Human
caagcaguagaaugggaugaaa

SEQ ID NO: 184083 - RNA, 22 nt, Human
caauagcagaggcugaagacag

SEQ ID NO: 184084 - RNA, 20 nt, Human
cagagacaacaucccaacug

SEQ ID NO: 184085 - RNA, 20 nt, Human
cagugugagaugagaggcug

SEQ ID NO: 184086 - RNA, 24 nt, Human
cauuauuucccuugcuggaguggc

SEQ ID NO: 184087 - RNA, 20 nt, Human
ccacucaccaccauccaccc

SEQ ID NO: 184088 - RNA, 20 nt, Human
ccugaacccagcuagcagca

SEQ ID NO: 184089 - RNA, 23 nt, Human
cgagauaaaguacaguuuccuac

SEQ ID NO: 184090 - RNA, 25 nt, Human
cugcauuauuucccuugcuggagug

SEQ ID NO: 184091 - RNA, 21 nt, Human
gacaacaucccaacuggagaa

SEQ ID NO: 184092 - RNA, 21 nt, Human
gagaaaaaaggaccggggaga

SEQ ID NO: 184093 - RNA, 21 nt, Human
gagaguuugguuuaauauucc

SEQ ID NO: 184094 - RNA, 21 nt, Human
gauccacucaccaccauccac

SEQ ID NO: 184095 - RNA, 18 nt, Human
gggaggacagacacgagg

SEQ ID NO: 184096 - RNA, 18 nt, Human
guuguuccaagaugggag

SEQ ID NO: 184097 - RNA, 23 nt, Human
uaaaaaaucuuugcguguaagga

SEQ ID NO: 184098 - RNA, 23 nt, Human
uaaagcuucugaaauauugcaau

SEQ ID NO: 184099 - RNA, 23 nt, Human
uaccacccugcgccgcuggacuc

SEQ ID NO: 184100 - RNA, 20 nt, Human
uagaauauccucuuuccugg

SEQ ID NO: 184101 - RNA, 19 nt, Human
ucaauagcagaggcugaag

SEQ ID NO: 184102 - RNA, 19 nt, Human
uccaagaugggaggacaga

SEQ ID NO: 184103 - RNA, 26 nt, Human
uccuacucuccacuauucuuugcuga

SEQ ID NO: 184104 - RNA, 30 nt, Human
ucucucauugucugugugaagcucucaauu

SEQ ID NO: 184105 - RNA, 21 nt, Human
ucuuugagaaaaguuggagga

SEQ ID NO: 184106 - RNA, 23 nt, Human
ucuuugcugaaaagggugagggu

SEQ ID NO: 184107 - RNA, 22 nt, Human
ugaaaagggugaggguacagca

SEQ ID NO: 184108 - RNA, 20 nt, Human
ugagaaacauucaaaugcug

SEQ ID NO: 184109 - RNA, 23 nt, Human
ugaguguuacacacuguggcuga

SEQ ID NO: 184110 - RNA, 20 nt, Human
ugcuggaguggcagcagccu

SEQ ID NO: 184111 - RNA, 25 nt, Human
uggagaaaaaaggaccggggagagu

SEQ ID NO: 184112 - RNA, 18 nt, Human
uggcagcagccucauugg

SEQ ID NO: 184113 - RNA, 22 nt, Human
uggcagcagccucauugguuuu

SEQ ID NO: 184114 - RNA, 24 nt, Human
ugguuagagcagauggugguucuu

SEQ ID NO: 184115 - RNA, 22 nt, Human
ugucucuguuuccucgcaccag

SEQ ID NO: 184116 - RNA, 19 nt, Human
uuugagaaaaguuggagaa

SEQ ID NO: 184117 - RNA, 24 nt, Human
aaaggaacuaagaccccuccccua

SEQ ID NO: 184118 - RNA, 25 nt, Human
aacuagauuccaauaggagagccca

SEQ ID NO: 184119 - RNA, 18 nt, Human
agaaaaaggaacuaagac

SEQ ID NO: 184120 - RNA, 19 nt, Human
agguccccaaaccucccac

SEQ ID NO: 184121 - RNA, 20 nt, Human
caacccccaacuagauuccu

SEQ ID NO: 184122 - RNA, 20 nt, Human
cagaaagaccuccgaaggca

SEQ ID NO: 184123 - RNA, 22 nt, Human
cagggaaaaagaaaauaaaacc

SEQ ID NO: 184124 - RNA, 22 nt, Human
cagggaaaaagaaaauaaaacc

SEQ ID NO: 184125 - RNA, 24 nt, Human
ccacaggcucuucucucaaggucc

SEQ ID NO: 184126 - RNA, 30 nt, Human
ccccuaucacccuguguuccuuaccccucu

SEQ ID NO: 184127 - RNA, 20 nt, Human
cccuguguuccuuaccccuc

SEQ ID NO: 184128 - RNA, 21 nt, Human
ccgccaaguccaugucauuac

SEQ ID NO: 184129 - RNA, 20 nt, Human
cuaaacagggaaaaagaaaa

SEQ ID NO: 184130 - RNA, 20 nt, Human
cuaaacagggaaaaagaaaa

SEQ ID NO: 184131 - RNA, 23 nt, Human
cuagaaaaugcuaaacagggaaa

SEQ ID NO: 184132 - RNA, 23 nt, Human
cuagaaaaugcuaaacagggaaa

SEQ ID NO: 184133 - RNA, 21 nt, Human
cucaagguccccaaaccuccc

SEQ ID NO: 184134 - RNA, 19 nt, Human
cuccaacccccaacuagau

SEQ ID NO: 184135 - RNA, 25 nt, Human
cuguguuccuuaccccuccaacccc

SEQ ID NO: 184136 - RNA, 19 nt, Human
ggcucuucucucaaggucc

SEQ ID NO: 184137 - RNA, 24 nt, Human
uacagaaaaaggaacuaagacccc

SEQ ID NO: 184138 - RNA, 21 nt, Human
uaccccuucugcuuuggcugg

SEQ ID NO: 184139 - RNA, 24 nt, Human
ucucaagguccccaaaccucccac

SEQ ID NO: 184140 - RNA, 20 nt, Human
ucugcuuuggcugggacuga

SEQ ID NO: 184141 - RNA, 20 nt, Human
ucugugcauaaaugcaugug

SEQ ID NO: 184142 - RNA, 21 nt, Human
ugauacagaaaaaggaacuaa

SEQ ID NO: 184143 - RNA, 25 nt, Human
ugauacagaaaaaggaacuaagacc

SEQ ID NO: 184144 - RNA, 22 nt, Human
ugcagcaucgggagcuuugucu

SEQ ID NO: 184145 - RNA, 19 nt, Human
ugcauaaaugcauguggga

SEQ ID NO: 184146 - RNA, 24 nt, Human
ugucuuguccccccgccaagucca

SEQ ID NO: 184147 - RNA, 23 nt, Human
ugugaagacagggcuucugauac

SEQ ID NO: 184148 - RNA, 24 nt, Human
ugugggaaccaugcuguauucugc

SEQ ID NO: 184149 - RNA, 20 nt, Human
uugucuuguccccccgccaa

SEQ ID NO: 184150 - RNA, 22 nt, Human
uuuccagauuuucuucugugca

SEQ ID NO: 184151 - RNA, 21 nt, Human
agcaccagaguuuggaaggga

SEQ ID NO: 184152 - RNA, 22 nt, Human
agcgccgguucucuccucagga

SEQ ID NO: 184153 - RNA, 21 nt, Human
agggccccucgggcagggucc

SEQ ID NO: 184154 - RNA, 21 nt, Human
caggacgcaccgguucucucc

SEQ ID NO: 184155 - RNA, 23 nt, Human
cauugugccccaugguccuccca

SEQ ID NO: 184156 - RNA, 18 nt, Human
ccccaugguccucccaag

SEQ ID NO: 184157 - RNA, 20 nt, Human
ccccaugguccucccaagcc

SEQ ID NO: 184158 - RNA, 18 nt, Human
cccguguugcccagcgcc

SEQ ID NO: 184159 - RNA, 20 nt, Human
cccguguugcccagcgccgg

SEQ ID NO: 184160 - RNA, 21 nt, Human
cgcauugugccccaugguccu

SEQ ID NO: 184161 - RNA, 22 nt, Human
cugggccugcaggugggguggg

SEQ ID NO: 184162 - RNA, 24 nt, Human
cugggccugcaggugggguggguc

SEQ ID NO: 184163 - RNA, 19 nt, Human
gagggccccucgggcaggg

SEQ ID NO: 184164 - RNA, 21 nt, Human
gccccaugguccucccaagcc

SEQ ID NO: 184165 - RNA, 19 nt, Human
ggacgcaccgguucucucc

SEQ ID NO: 184166 - RNA, 21 nt, Human
ggcaggaguucugucccacgg

SEQ ID NO: 184167 - RNA, 20 nt, Human
gggccugcaggugggguggg

SEQ ID NO: 184168 - RNA, 18 nt, Human
ucccaagccuggaagugc

SEQ ID NO: 184169 - RNA, 22 nt, Human
ucccucgggguagggugggcag

SEQ ID NO: 184170 - RNA, 24 nt, Human
ucgaguuugcaggcccguguugcc

SEQ ID NO: 184171 - RNA, 18 nt, Human
uggaagggagacgcagca

SEQ ID NO: 184172 - RNA, 22 nt, Human
uggaagugcggguucgccuccc

SEQ ID NO: 184173 - RNA, 18 nt, Human
uggaccgcauugugcccc

SEQ ID NO: 184174 - RNA, 18 nt, Human
ugggcagcggaggaggcg

SEQ ID NO: 184175 - RNA, 23 nt, Human
uucgccucccucgggguagggug

SEQ ID NO: 184176 - RNA, 24 nt, Human
aaaaugcugggauuacaggcauga

SEQ ID NO: 184177 - RNA, 26 nt, Human
aaaugcugggauuacaggcaugagcc

SEQ ID NO: 184178 - RNA, 18 nt, Human
aagaacacaaacuucaag

SEQ ID NO: 184179 - RNA, 24 nt, Human
acggaguuucagcauuuuggccag

SEQ ID NO: 184180 - RNA, 19 nt, Human
acugcaaccuccacccccu

SEQ ID NO: 184181 - RNA, 20 nt, Human
agcaauucuccugccuuggc

SEQ ID NO: 184182 - RNA, 23 nt, Human
agcaauucuccugccuuggccuc

SEQ ID NO: 184183 - RNA, 24 nt, Human
aggugauccaccugccucagccuc

SEQ ID NO: 184184 - RNA, 22 nt, Human
aguagagacggaguuucagcau

SEQ ID NO: 184185 - RNA, 19 nt, Human
aguagcugggauuacaggc

SEQ ID NO: 184186 - RNA, 24 nt, Human
auuuuuguauuuuuaguagagacg

SEQ ID NO: 184187 - RNA, 24 nt, Human
caaaaugcugggauuacaggcaug

SEQ ID NO: 184188 - RNA, 24 nt, Human
caaccuccacccccugaguucgag

SEQ ID NO: 184189 - RNA, 24 nt, Human
caccaugccuggcuaauuuuugua

SEQ ID NO: 184190 - RNA, 23 nt, Human
caccugccucagccucccaaaau

SEQ ID NO: 184191 - RNA, 21 nt, Human
cacugcaaccuccacccccug

SEQ ID NO: 184192 - RNA, 24 nt, Human
cagagucuugcucuguugcccagg

SEQ ID NO: 184193 - RNA, 23 nt, Human
caggcgccugccaccaugccugg

SEQ ID NO: 184194 - RNA, 22 nt, Human
caggcugauuuugaacugcuga

SEQ ID NO: 184195 - RNA, 22 nt, Human
caggugauccaccugccucagc

SEQ ID NO: 184196 - RNA, 23 nt, Human
ccaaaaugcugggauuacaggca

SEQ ID NO: 184197 - RNA, 24 nt, Human
ccaaaaugcugggauuacaggcau

SEQ ID NO: 184198 - RNA, 19 nt, Human
ccacccccugaguucgagc

SEQ ID NO: 184199 - RNA, 26 nt, Human
ccaccugccucagccucccaaaaugc

SEQ ID NO: 184200 - RNA, 24 nt, Human
cccaaaaugcugggauuacaggca

SEQ ID NO: 184201 - RNA, 21 nt, Human
ccccaaagaaggugaaagcuc

SEQ ID NO: 184202 - RNA, 23 nt, Human
cccgaguagcugggauuacaggc

SEQ ID NO: 184203 - RNA, 24 nt, Human
cccgaguagcugggauuacaggcg

SEQ ID NO: 184204 - RNA, 24 nt, Human
cccugaguucgagcaauucuccug

SEQ ID NO: 184205 - RNA, 22 nt, Human
ccgaguagcugggauuacaggc

SEQ ID NO: 184206 - RNA, 26 nt, Human
ccuagccuggccuugauuccgguucc

SEQ ID NO: 184207 - RNA, 26 nt, Human
cucacugcaaccuccacccccugagu

SEQ ID NO: 184208 - RNA, 23 nt, Human
cucaggugauccaccugccucag

SEQ ID NO: 184209 - RNA, 20 nt, Human
cucuguugcccaggcuggag

SEQ ID NO: 184210 - RNA, 25 nt, Human
cucuguugcccaggcuggagugcaa

SEQ ID NO: 184211 - RNA, 20 nt, Human
cugaccucaggugauccacc

SEQ ID NO: 184212 - RNA, 23 nt, Human
cugcaaccuccacccccugaguu

SEQ ID NO: 184213 - RNA, 24 nt, Human
cugcaaccuccacccccugaguuc

SEQ ID NO: 184214 - RNA, 23 nt, Human
cugccucagccucccaaaaugcu

SEQ ID NO: 184215 - RNA, 24 nt, Human
cugccucagccucccaaaaugcug

SEQ ID NO: 184216 - RNA, 23 nt, Human
cugccuuggccucccgaguagcu

SEQ ID NO: 184217 - RNA, 24 nt, Human
cuuggccucccgaguagcugggau

SEQ ID NO: 184218 - RNA, 24 nt, Human
gaccucaggugauccaccugccuc

SEQ ID NO: 184219 - RNA, 19 nt, Human
gagagccccaaagaaggug

SEQ ID NO: 184220 - RNA, 24 nt, Human
gagggaagaacacaaacuucaagg

SEQ ID NO: 184221 - RNA, 26 nt, Human
gaguagcugggauuacaggcgccugc

SEQ ID NO: 184222 - RNA, 21 nt, Human
gagugcaauggcacaaucuca

SEQ ID NO: 184223 - RNA, 18 nt, Human
gauuacaggcaugagcca

SEQ ID NO: 184224 - RNA, 19 nt, Human
gauuacaggcaugagccac

SEQ ID NO: 184225 - RNA, 22 nt, Human
gauuacaggcaugagccacugc

SEQ ID NO: 184226 - RNA, 18 nt, Human
gauuacaggcgccugcca

SEQ ID NO: 184227 - RNA, 24 nt, Human
gauuacaggcgccugccaccaugc

SEQ ID NO: 184228 - RNA, 22 nt, Human
gcaaccuccacccccugaguuc

SEQ ID NO: 184229 - RNA, 19 nt, Human
gcccaggcuggagugcaau

SEQ ID NO: 184230 - RNA, 20 nt, Human
gccuuggccucccgaguagc

SEQ ID NO: 184231 - RNA, 23 nt, Human
gcugaccucaggugauccaccug

SEQ ID NO: 184232 - RNA, 19 nt, Human
gcuggagugcaauggcaca

SEQ ID NO: 184233 - RNA, 23 nt, Human
ggaguuucagcauuuuggccagg

SEQ ID NO: 184234 - RNA, 22 nt, Human
ggauuacaggcaugagccacug

SEQ ID NO: 184235 - RNA, 24 nt, Human
ggugauccaccugccucagccucc

SEQ ID NO: 184236 - RNA, 18 nt, Human
guagcugggauuacaggc

SEQ ID NO: 184237 - RNA, 18 nt, Human
gugauccaccugccucag

SEQ ID NO: 184238 - RNA, 24 nt, Human
gugauccaccugccucagccuccc

SEQ ID NO: 184239 - RNA, 21 nt, Human
gugcugaagggagccauugcc

SEQ ID NO: 184240 - RNA, 22 nt, Human
guggaaagcagaagugcugaag

SEQ ID NO: 184241 - RNA, 24 nt, Human
uaauuuuuguauuuuuaguagaga

SEQ ID NO: 184242 - RNA, 24 nt, Human
uacaggcaugagccacugcgccca

SEQ ID NO: 184243 - RNA, 21 nt, Human
uacgcagacuucccaugcagc

SEQ ID NO: 184244 - RNA, 19 nt, Human
uagccuggccuugauucug

SEQ ID NO: 184245 - RNA, 20 nt, Human
uaguagagacggaguuucag

SEQ ID NO: 184246 - RNA, 26 nt, Human
uaguagagacggaguuucagcauuuu

SEQ ID NO: 184247 - RNA, 18 nt, Human
ucacugcaaccuccaccc

SEQ ID NO: 184248 - RNA, 20 nt, Human
ucacugcaaccuccaccccc

SEQ ID NO: 184249 - RNA, 21 nt, Human
ucacugcaaccuccacccccu

SEQ ID NO: 184250 - RNA, 22 nt, Human
ucacugcaaccuccacccccug

SEQ ID NO: 184251 - RNA, 27 nt, Human
ucacugcaaccuccacccccugaguuc

SEQ ID NO: 184252 - RNA, 22 nt, Human
ucaggugauccaccugccucag

SEQ ID NO: 184253 - RNA, 24 nt, Human
uccaccugccucagccucccaaaa

SEQ ID NO: 184254 - RNA, 24 nt, Human
ucccaaaaugcugggauuacaggc

SEQ ID NO: 184255 - RNA, 23 nt, Human
ucccaugcagcuccgaugagaac

SEQ ID NO: 184256 - RNA, 24 nt, Human
ucccgaguagcugggauuacaggc

SEQ ID NO: 184257 - RNA, 19 nt, Human
uccuaaccuagccuggccu

SEQ ID NO: 184258 - RNA, 18 nt, Human
ucuguugcccaggcugga

SEQ ID NO: 184259 - RNA, 24 nt, Human
ucuguugcccaggcuggagugcaa

SEQ ID NO: 184260 - RNA, 22 nt, Human
ucuugcucuguugcccaggcug

SEQ ID NO: 184261 - RNA, 23 nt, Human
ucuugcucuguugcccaggcugg

SEQ ID NO: 184262 - RNA, 24 nt, Human
ucuugcucuguugcccaggcugga

SEQ ID NO: 184263 - RNA, 24 nt, Human
ugaccucaggugauccaccugccu

SEQ ID NO: 184264 - RNA, 18 nt, Human
ugagacagagucuugcuc

SEQ ID NO: 184265 - RNA, 22 nt, Human
ugagacagagucuugcucuguu

SEQ ID NO: 184266 - RNA, 18 nt, Human
ugcccaggcuggagugca

SEQ ID NO: 184267 - RNA, 21 nt, Human
ugcccaggcuggagugcaaug

SEQ ID NO: 184268 - RNA, 24 nt, Human
ugcccaggcuggagugcaauggca

SEQ ID NO: 184269 - RNA, 24 nt, Human
ugccucagccucccaaaaugcugg

SEQ ID NO: 184270 - RNA, 20 nt, Human
ugccuuggccucccgaguaa

SEQ ID NO: 184271 - RNA, 22 nt, Human
uggaaagcagaagugcugaagg

SEQ ID NO: 184272 - RNA, 19 nt, Human
uggagugcaauggcacaau

SEQ ID NO: 184273 - RNA, 24 nt, Human
uggcacaaucucaacucacugcaa

SEQ ID NO: 184274 - RNA, 24 nt, Human
uggccaggcugauuuugaacugcu

SEQ ID NO: 184275 - RNA, 18 nt, Human
ugggauuacaggcaugag

SEQ ID NO: 184276 - RNA, 19 nt, Human
ugggauuacaggcaugagc

SEQ ID NO: 184277 - RNA, 21 nt, Human
ugggauuacaggcaugagcca

SEQ ID NO: 184278 - RNA, 22 nt, Human
ugggauuacaggcaugagccac

SEQ ID NO: 184279 - RNA, 22 nt, Human
ugggauuacaggcaugagccac

SEQ ID NO: 184280 - RNA, 24 nt, Human
ugggauuacaggcaugagccacug

SEQ ID NO: 184281 - RNA, 26 nt, Human
ugggauuacaggcaugagccacugcg

SEQ ID NO: 184282 - RNA, 21 nt, Human
ugggauuacaggcgccugcca

SEQ ID NO: 184283 - RNA, 22 nt, Human
ugggauuacaggcgccugccac

SEQ ID NO: 184284 - RNA, 24 nt, Human
ugggauuacaggcgccugccacca

SEQ ID NO: 184285 - RNA, 25 nt, Human
ugggauuacaggcgccugccaccau

SEQ ID NO: 184286 - RNA, 21 nt, Human
uguauuuuuaguagagacgga

SEQ ID NO: 184287 - RNA, 20 nt, Human
uguugcccaggcuggagugc

SEQ ID NO: 184288 - RNA, 18 nt, Human
uuaguagagacggaguuu

SEQ ID NO: 184289 - RNA, 24 nt, Human
uuaguagagacggaguuucagcau

SEQ ID NO: 184290 - RNA, 28 nt, Human
uucccaugcagcuccgaugagaacacaa

SEQ ID NO: 184291 - RNA, 24 nt, Human
uugcucuguugcccaggcuggagu

SEQ ID NO: 184292 - RNA, 23 nt, Human
uuguauuuuuaguagagacggag

SEQ ID NO: 184293 - RNA, 19 nt, Human
uuuuuaguagagacggagu

SEQ ID NO: 184294 - RNA, 20 nt, Human
uuuuuguauuuuuaguagag

SEQ ID NO: 184295 - RNA, 24 nt, Human
aagcgauccuccugccuuggccuc

SEQ ID NO: 184296 - RNA, 24 nt, Human
aaguagagauggggucucacuaug

SEQ ID NO: 184297 - RNA, 24 nt, Human
acuauguugcccaggcuggucuug

SEQ ID NO: 184298 - RNA, 25 nt, Human
acuauguugcccaggcuggucuuga

SEQ ID NO: 184299 - RNA, 23 nt, Human
aguagagauggggucucacuaug

SEQ ID NO: 184300 - RNA, 18 nt, Human
auggggucucacuauguu

SEQ ID NO: 184301 - RNA, 19 nt, Human
auggggucucacuauguug

SEQ ID NO: 184302 - RNA, 24 nt, Human
auggggucucacuauguugcccag

SEQ ID NO: 184303 - RNA, 21 nt, Human
auguauacauaauuguacaua

SEQ ID NO: 184304 - RNA, 21 nt, Human
caagaaaugccuaaacgcuau

SEQ ID NO: 184305 - RNA, 22 nt, Human
caagcgauccuccugccuuggc

SEQ ID NO: 184306 - RNA, 27 nt, Human
caagcgauccuccugccuuggccuccc

SEQ ID NO: 184307 - RNA, 27 nt, Human
caagcgauccuccugccuuggccuccc

SEQ ID NO: 184308 - RNA, 24 nt, Human
cacagugcuaggauuacagacaug

SEQ ID NO: 184309 - RNA, 19 nt, Human
cacuauguugcccaggcug

SEQ ID NO: 184310 - RNA, 24 nt, Human
cacuauguugcccaggcuggucuu

SEQ ID NO: 184311 - RNA, 27 nt, Human
cacuauguugcccaggcuggucuugaa

SEQ ID NO: 184312 - RNA, 25 nt, Human
cagugcuaggauuacagacaugauc

SEQ ID NO: 184313 - RNA, 24 nt, Human
ccacagugcuaggauuacagacau

SEQ ID NO: 184314 - RNA, 20 nt, Human
ccacugcacuuggcccagug

SEQ ID NO: 184315 - RNA, 21 nt, Human
ccacugcacuuggcccagugg

SEQ ID NO: 184316 - RNA, 21 nt, Human
ccuccugccuuggccucccac

SEQ ID NO: 184317 - RNA, 24 nt, Human
ccugccuuggccucccacagugcu

SEQ ID NO: 184318 - RNA, 18 nt, Human
ccugggcucaagcgaucc

SEQ ID NO: 184319 - RNA, 23 nt, Human
ccugggcucaagcgauccuccug

SEQ ID NO: 184320 - RNA, 24 nt, Human
cucaagcgauccuccugccuuggc

SEQ ID NO: 184321 - RNA, 21 nt, Human
cucagcccuguccugagcucu

SEQ ID NO: 184322 - RNA, 23 nt, Human
cuccugggcucaagcgauccucc

SEQ ID NO: 184323 - RNA, 19 nt, Human
cuggucuugaacuccuggg

SEQ ID NO: 184324 - RNA, 20 nt, Human
gaaaugccuaaacgcuauaa

SEQ ID NO: 184325 - RNA, 23 nt, Human
gauuacagacaugauccacugca

SEQ ID NO: 184326 - RNA, 18 nt, Human
gcccuguccugagcucug

SEQ ID NO: 184327 - RNA, 24 nt, Human
gcuauaauaaauauagaacuuuac

SEQ ID NO: 184328 - RNA, 22 nt, Human
ggauuacagacaugauccacug

SEQ ID NO: 184329 - RNA, 18 nt, Human
ggcuggucuugaacuccu

SEQ ID NO: 184330 - RNA, 22 nt, Human
gggcucaagcgauccuccugcc

SEQ ID NO: 184331 - RNA, 22 nt, Human
gggucucacuauguugcccagg

SEQ ID NO: 184332 - RNA, 18 nt, Human
gugcauuaucuuauuuuu

SEQ ID NO: 184333 - RNA, 24 nt, Human
uaaguagagauggggucucacuau

SEQ ID NO: 184334 - RNA, 22 nt, Human
uagagauggggucucacuaugu

SEQ ID NO: 184335 - RNA, 21 nt, Human
uaggauuacagacaugaucca

SEQ ID NO: 184336 - RNA, 24 nt, Human
uaggauuacagacaugauccacug

SEQ ID NO: 184337 - RNA, 20 nt, Human
uauguugcccaggcuggucu

SEQ ID NO: 184338 - RNA, 23 nt, Human
uauguugcccaggcuggucuuga

SEQ ID NO: 184339 - RNA, 24 nt, Human
uauguugcccaggcuggucuugaa

SEQ ID NO: 184340 - RNA, 21 nt, Human
uccucagcccuguccugagcu

SEQ ID NO: 184341 - RNA, 21 nt, Human
uccugggcucaagcgauccuc

SEQ ID NO: 184342 - RNA, 22 nt, Human
uccugggcucaagcgauccucc

SEQ ID NO: 184343 - RNA, 24 nt, Human
uccugggcucaagcgauccuccug

SEQ ID NO: 184344 - RNA, 21 nt, Human
uccuucagaaaguaaauauga

SEQ ID NO: 184345 - RNA, 18 nt, Human
ucucacuauguugcccag

SEQ ID NO: 184346 - RNA, 19 nt, Human
ucucacuauguugcccagg

SEQ ID NO: 184347 - RNA, 23 nt, Human
ucucacuauguugcccaggcugg

SEQ ID NO: 184348 - RNA, 24 nt, Human
ucucacuauguugcccaggcuggu

SEQ ID NO: 184349 - RNA, 26 nt, Human
ucucacuauguugcccaggcuggucu

SEQ ID NO: 184350 - RNA, 27 nt, Human
ucucacuauguugcccaggcuggucuu

SEQ ID NO: 184351 - RNA, 23 nt, Human
ucuugaacuccugggcucaagcg

SEQ ID NO: 184352 - RNA, 25 nt, Human
ugaacuccugggcucaagcgauccu

SEQ ID NO: 184353 - RNA, 18 nt, Human
ugagagggguggagacgg

SEQ ID NO: 184354 - RNA, 20 nt, Human
ugagagggguggagacggug

SEQ ID NO: 184355 - RNA, 24 nt, Human
ugcccaggcuggucuugaacuccu

SEQ ID NO: 184356 - RNA, 28 nt, Human
ugcccaggcuggucuugaacuccugggc

SEQ ID NO: 184357 - RNA, 24 nt, Human
ugcuaggauuacagacaugaucca

SEQ ID NO: 184358 - RNA, 24 nt, Human
ugggcucaagcgauccuccugccu

SEQ ID NO: 184359 - RNA, 24 nt, Human
uggggucucacuauguugcccagg

SEQ ID NO: 184360 - RNA, 20 nt, Human
uguacauauuuauggggugg

SEQ ID NO: 184361 - RNA, 21 nt, Human
uguauacauaauuguacauau

SEQ ID NO: 184362 - RNA, 19 nt, Human
uuccucagcccuguccuga

SEQ ID NO: 184363 - RNA, 19 nt, Human
uuuuaaguagagauggggu

SEQ ID NO: 184364 - RNA, 23 nt, Human
aggccuggcuaacugucucugga

SEQ ID NO: 184365 - RNA, 21 nt, Human
agguccuggcugaggccuggg

SEQ ID NO: 184366 - RNA, 25 nt, Human
aggugcuccugucuggccugaaagg

SEQ ID NO: 184367 - RNA, 18 nt, Human
agugugcccagcccaggc

SEQ ID NO: 184368 - RNA, 18 nt, Human
cagguucugggggccugg

SEQ ID NO: 184369 - RNA, 26 nt, Human
cccagcccaggccuggcuaacugucu

SEQ ID NO: 184370 - RNA, 20 nt, Human
ccccuggcuggagccagguu

SEQ ID NO: 184371 - RNA, 18 nt, Human
ccucagggacuggccccc

SEQ ID NO: 184372 - RNA, 23 nt, Human
cuggagccagguucugggggccu

SEQ ID NO: 184373 - RNA, 19 nt, Human
cuggcugaggccugggugg

SEQ ID NO: 184374 - RNA, 19 nt, Human
cuggcugaggccugggugg

SEQ ID NO: 184375 - RNA, 19 nt, Human
cuucuccucugggaaacca

SEQ ID NO: 184376 - RNA, 22 nt, Human
gacaggcuggcucccuucucgg

SEQ ID NO: 184377 - RNA, 20 nt, Human
ggugacuagggaagguggag

SEQ ID NO: 184378 - RNA, 18 nt, Human
guggagugugcccagccc

SEQ ID NO: 184379 - RNA, 20 nt, Human
ucucgggucucagccuucuc

SEQ ID NO: 184380 - RNA, 22 nt, Human
ucugggcuucuggugguuuggg

SEQ ID NO: 184381 - RNA, 21 nt, Human
ugagggcggcugugaagccuu

SEQ ID NO: 184382 - RNA, 22 nt, Human
uggagugugcccagcccaggcc

SEQ ID NO: 184383 - RNA, 22 nt, Human
uggcuggagccagguucugggg

SEQ ID NO: 184384 - RNA, 23 nt, Human
uggcuggagccagguucuggggg

SEQ ID NO: 184385 - RNA, 19 nt, Human
ugggcuucuggugguuugg

SEQ ID NO: 184386 - RNA, 21 nt, Human
ugguggagucuggggaccugc

SEQ ID NO: 184387 - RNA, 19 nt, Human
ugguuugggcugaccaggc

SEQ ID NO: 184388 - RNA, 19 nt, Human
ugugaagccuuuggucagg

SEQ ID NO: 184389 - RNA, 27 nt, Human
uugguggagucuggggaccugccucag

SEQ ID NO: 184390 - RNA, 23 nt, Human
aacacacgucacccgcugacacu

SEQ ID NO: 184391 - RNA, 19 nt, Human
aacagcccuggaccccagc

SEQ ID NO: 184392 - RNA, 25 nt, Human
aagcagcacuaagcggccucccagg

SEQ ID NO: 184393 - RNA, 27 nt, Human
aagcagcacuaagcggccucccaguag

SEQ ID NO: 184394 - RNA, 26 nt, Human
aagcagcacuaagcggccucccagug

SEQ ID NO: 184395 - RNA, 19 nt, Human
aagccggcggcggcggcgg

SEQ ID NO: 184396 - RNA, 21 nt, Human
aaggacucaaaagaacacacg

SEQ ID NO: 184397 - RNA, 22 nt, Human
acaccacaccaccccuccccag

SEQ ID NO: 184398 - RNA, 19 nt, Human
accacaccaccccucccca

SEQ ID NO: 184399 - RNA, 20 nt, Human
accaggguccaaggugggcc

SEQ ID NO: 184400 - RNA, 20 nt, Human
accccaggccucuccaggcu

SEQ ID NO: 184401 - RNA, 22 nt, Human
acccuccaaguccuccuccccc

SEQ ID NO: 184402 - RNA, 19 nt, Human
acugcagggucugugggag

SEQ ID NO: 184403 - RNA, 20 nt, Human
acugcagggucugugggagg

SEQ ID NO: 184404 - RNA, 18 nt, Human
agacaacaaaagccggcg

SEQ ID NO: 184405 - RNA, 18 nt, Human
agccggcggcggcggcgg

SEQ ID NO: 184406 - RNA, 18 nt, Human
aggcagaaaggcaggcga

SEQ ID NO: 184407 - RNA, 25 nt, Human
aggcagccggaggugccccugagga

SEQ ID NO: 184408 - RNA, 21 nt, Human
aggcaggcgaggccaggccug

SEQ ID NO: 184409 - RNA, 18 nt, Human
aggccuggggcugggacc

SEQ ID NO: 184410 - RNA, 23 nt, Human
aggccuggggcugggaccucugc

SEQ ID NO: 184411 - RNA, 20 nt, Human
aggcggcggcggccgaggag

SEQ ID NO: 184412 - RNA, 20 nt, Human
aucaucucagaggcucugcc

SEQ ID NO: 184413 - RNA, 23 nt, Human
augaaaagcaaagcagcacuaag

SEQ ID NO: 184414 - RNA, 22 nt, Human
caaaauuaaaaggcagaaaggc

SEQ ID NO: 184415 - RNA, 21 nt, Human
caacaccacaccaccccuccc

SEQ ID NO: 184416 - RNA, 22 nt, Human
caaggccugcccugugagcccu

SEQ ID NO: 184417 - RNA, 21 nt, Human
caccacaccaccccuccccag

SEQ ID NO: 184418 - RNA, 24 nt, Human
caccacaccaccccuccccagggc

SEQ ID NO: 184419 - RNA, 21 nt, Human
caccaccccuccccagggcca

SEQ ID NO: 184420 - RNA, 22 nt, Human
cacccagacagcccgugcgggg

SEQ ID NO: 184421 - RNA, 19 nt, Human
caccccuccccagggccac

SEQ ID NO: 184422 - RNA, 21 nt, Human
caccccuccccagggccaccu

SEQ ID NO: 184423 - RNA, 20 nt, Human
cacccuggcacuggcagggu

SEQ ID NO: 184424 - RNA, 20 nt, Human
cacccuggcacuggcagggu

SEQ ID NO: 184425 - RNA, 21 nt, Human
cagacccuccaaguccuccuc

SEQ ID NO: 184426 - RNA, 19 nt, Human
cagagccaaggucccggcg

SEQ ID NO: 184427 - RNA, 20 nt, Human
cagagcccacgcugccuccc

SEQ ID NO: 184428 - RNA, 19 nt, Human
cagcaaggccugcccugug

SEQ ID NO: 184429 - RNA, 19 nt, Human
cagccaccagcaucccugu

SEQ ID NO: 184430 - RNA, 23 nt, Human
cagcggguugcuuugaggccucc

SEQ ID NO: 184431 - RNA, 23 nt, Human
caggacagcugcccccagacccu

SEQ ID NO: 184432 - RNA, 23 nt, Human
caggaggucaccaggguccaagg

SEQ ID NO: 184433 - RNA, 19 nt, Human
caggcgaggccaggccugg

SEQ ID NO: 184434 - RNA, 21 nt, Human
cagggccaccuggcagcuggg

SEQ ID NO: 184435 - RNA, 20 nt, Human
cagggcccugauggccucag

SEQ ID NO: 184436 - RNA, 18 nt, Human
caggguccaaggugggcc

SEQ ID NO: 184437 - RNA, 20 nt, Human
caguggugcugucucaggcg

SEQ ID NO: 184438 - RNA, 22 nt, Human
ccaacaccacaccaccccuccc

SEQ ID NO: 184439 - RNA, 23 nt, Human
ccaacagcccuggaccccagcaa

SEQ ID NO: 184440 - RNA, 18 nt, Human
ccagaggcggcggcggcc

SEQ ID NO: 184441 - RNA, 21 nt, Human
cccaacaccacaccaccccuc

SEQ ID NO: 184442 - RNA, 20 nt, Human
cccagcuuccccuccuccag

SEQ ID NO: 184443 - RNA, 22 nt, Human
cccccggccacccgcccgcgcc

SEQ ID NO: 184444 - RNA, 20 nt, Human
cccccugcaggaccccuucc

SEQ ID NO: 184445 - RNA, 19 nt, Human
ccccuucccaacaccacac

SEQ ID NO: 184446 - RNA, 24 nt, Human
ccccuucccaacaccacaccaccc

SEQ ID NO: 184447 - RNA, 19 nt, Human
cccucccugucccacccca

SEQ ID NO: 184448 - RNA, 21 nt, Human
cccucgggguccuccaacagc

SEQ ID NO: 184449 - RNA, 19 nt, Human
cccuggaccccagcaaggc

SEQ ID NO: 184450 - RNA, 23 nt, Human
cccuggaccccagcaaggccugc

SEQ ID NO: 184451 - RNA, 18 nt, Human
cccugggccuuugggccc

SEQ ID NO: 184452 - RNA, 22 nt, Human
ccgcccgcgccucucucggauc

SEQ ID NO: 184453 - RNA, 22 nt, Human
ccggcggcggcggcggcgcggg

SEQ ID NO: 184454 - RNA, 24 nt, Human
ccggcggcggcggcggcgcggggc

SEQ ID NO: 184455 - RNA, 21 nt, Human
ccucacugcagggucuguggg

SEQ ID NO: 184456 - RNA, 18 nt, Human
ccuccaaguccuccuccc

SEQ ID NO: 184457 - RNA, 19 nt, Human
ccuccaaguccuccucccc

SEQ ID NO: 184458 - RNA, 21 nt, Human
ccucccugucccaccccaggc

SEQ ID NO: 184459 - RNA, 22 nt, Human
ccugcagacgcuggggccccuc

SEQ ID NO: 184460 - RNA, 19 nt, Human
ccugcaggaccccuuccca

SEQ ID NO: 184461 - RNA, 18 nt, Human
ccugcgcugaggggaggg

SEQ ID NO: 184462 - RNA, 19 nt, Human
ccugcgcugaggggagggc

SEQ ID NO: 184463 - RNA, 20 nt, Human
ccuggggcugggaccucugc

SEQ ID NO: 184464 - RNA, 21 nt, Human
cgagguccgaacgcucgcucg

SEQ ID NO: 184465 - RNA, 24 nt, Human
cggaggugccccugaggucccuga

SEQ ID NO: 184466 - RNA, 24 nt, Human
cggcggcgcccccggccacccgcc

SEQ ID NO: 184467 - RNA, 21 nt, Human
cggcggcgcggggcgcgcggg

SEQ ID NO: 184468 - RNA, 23 nt, Human
cggcggcggcgcggggcgcgcgg

SEQ ID NO: 184469 - RNA, 24 nt, Human
cggcggcggcggcggcgcggggcg

SEQ ID NO: 184470 - RNA, 19 nt, Human
cgggguccuccaacagccc

SEQ ID NO: 184471 - RNA, 18 nt, Human
cggugcagggagcugggg

SEQ ID NO: 184472 - RNA, 21 nt, Human
cucaaaagaacacacgucacc

SEQ ID NO: 184473 - RNA, 22 nt, Human
cuccagcggguugcuuugaggc

SEQ ID NO: 184474 - RNA, 18 nt, Human
cucccccugcaggacccc

SEQ ID NO: 184475 - RNA, 19 nt, Human
cuccucccccugcaggacc

SEQ ID NO: 184476 - RNA, 21 nt, Human
cuccugaucccaaaacaucuu

SEQ ID NO: 184477 - RNA, 21 nt, Human
cugaucccaaaacaucuaaag

SEQ ID NO: 184478 - RNA, 22 nt, Human
cugcagccugcgcugaggggag

SEQ ID NO: 184479 - RNA, 18 nt, Human
cugcagggucugugggag

SEQ ID NO: 184480 - RNA, 24 nt, Human
cugcccccagacccuccaaguccu

SEQ ID NO: 184481 - RNA, 21 nt, Human
cugcggcggugcagggagcug

SEQ ID NO: 184482 - RNA, 18 nt, Human
cuggcugggucgggaagg

SEQ ID NO: 184483 - RNA, 26 nt, Human
gacaggaagugucaguaaauggaugc

SEQ ID NO: 184484 - RNA, 21 nt, Human
gaccccuucccaacaccacac

SEQ ID NO: 184485 - RNA, 19 nt, Human
gaccugaccagcaaccggg

SEQ ID NO: 184486 - RNA, 19 nt, Human
gacgcuggggccccucaag

SEQ ID NO: 184487 - RNA, 21 nt, Human
gaugcauguuuggaaaagccc

SEQ ID NO: 184488 - RNA, 23 nt, Human
gcaaagcagcacuaagcggccuc

SEQ ID NO: 184489 - RNA, 23 nt, Human
gcaggcgaggccaggccuggggc

SEQ ID NO: 184490 - RNA, 20 nt, Human
gcagggucugugggaggaca

SEQ ID NO: 184491 - RNA, 21 nt, Human
gcaucacugugccagaguccc

SEQ ID NO: 184492 - RNA, 21 nt, Human
gccaccagcaucccugugagc

SEQ ID NO: 184493 - RNA, 21 nt, Human
gcccugcagugcagcuggcug

SEQ ID NO: 184494 - RNA, 18 nt, Human
gccugccccugcucagag

SEQ ID NO: 184495 - RNA, 20 nt, Human
gcggagacaacaaaagccgg

SEQ ID NO: 184496 - RNA, 21 nt, Human
gcggcggcggccgaggaggcg

SEQ ID NO: 184497 - RNA, 18 nt, Human
gcggcggcggcggcgcgg

SEQ ID NO: 184498 - RNA, 21 nt, Human
gcggcggcggcggcgcggggc

SEQ ID NO: 184499 - RNA, 19 nt, Human
gcuccugaucccaaaacau

SEQ ID NO: 184500 - RNA, 19 nt, Human
gcucgcugugggcuccagc

SEQ ID NO: 184501 - RNA, 21 nt, Human
gcugcuguccuggcgcccggc

SEQ ID NO: 184502 - RNA, 24 nt, Human
gcuggggggagggcuaggcagccg

SEQ ID NO: 184503 - RNA, 22 nt, Human
ggaccccuucccaacaccacac

SEQ ID NO: 184504 - RNA, 19 nt, Human
ggaggugccccugaggucc

SEQ ID NO: 184505 - RNA, 19 nt, Human
ggagucccagugggaggag

SEQ ID NO: 184506 - RNA, 20 nt, Human
ggagugcugcuguccuggcg

SEQ ID NO: 184507 - RNA, 20 nt, Human
ggcagggcccugauggccuc

SEQ ID NO: 184508 - RNA, 18 nt, Human
ggccggcggcgcccccgg

SEQ ID NO: 184509 - RNA, 23 nt, Human
ggccuggggcagggcccugaugg

SEQ ID NO: 184510 - RNA, 18 nt, Human
ggcgcgcgcggcucgcgg

SEQ ID NO: 184511 - RNA, 19 nt, Human
ggcggcgcggggcgcgcgg

SEQ ID NO: 184512 - RNA, 20 nt, Human
ggcucugcugggagucccag

SEQ ID NO: 184513 - RNA, 21 nt, Human
ggcuggugggcucugcuggga

SEQ ID NO: 184514 - RNA, 19 nt, Human
gggccagggcuggcuggug

SEQ ID NO: 184515 - RNA, 21 nt, Human
gggccggcggcgcccccggcc

SEQ ID NO: 184516 - RNA, 18 nt, Human
ggggccgggcucugcagc

SEQ ID NO: 184517 - RNA, 20 nt, Human
ggugcagggagcugggggga

SEQ ID NO: 184518 - RNA, 21 nt, Human
gugcagcuggcugggucggga

SEQ ID NO: 184519 - RNA, 21 nt, Human
gugggaggaggcggggaggaa

SEQ ID NO: 184520 - RNA, 21 nt, Human
guucaggacagcugcccccag

SEQ ID NO: 184521 - RNA, 24 nt, Human
uauuaugggguggacuugccugug

SEQ ID NO: 184522 - RNA, 23 nt, Human
ucagaggcucugccagacccugg

SEQ ID NO: 184523 - RNA, 19 nt, Human
ucaggcgucacccugcaga

SEQ ID NO: 184524 - RNA, 23 nt, Human
ucaguccuuggccucugucccug

SEQ ID NO: 184525 - RNA, 23 nt, Human
uccacugugcgggacggugauga

SEQ ID NO: 184526 - RNA, 24 nt, Human
ucccaacaccacaccaccccuccc

SEQ ID NO: 184527 - RNA, 25 nt, Human
ucccaacaccacaccaccccucccc

SEQ ID NO: 184528 - RNA, 21 nt, Human
ucccaccccaggccucuccag

SEQ ID NO: 184529 - RNA, 24 nt, Human
ucccagcugaccugaggaccucau

SEQ ID NO: 184530 - RNA, 22 nt, Human
ucccugggccuuugggcccagc

SEQ ID NO: 184531 - RNA, 25 nt, Human
ucccugggccuuugggcccagcuuu

SEQ ID NO: 184532 - RNA, 22 nt, Human
ucccugugagcaggugacagcc

SEQ ID NO: 184533 - RNA, 22 nt, Human
uccucagacuccucagcagugg

SEQ ID NO: 184534 - RNA, 21 nt, Human
ucgcugugggcuccagcgggu

SEQ ID NO: 184535 - RNA, 18 nt, Human
ucggauccuggccggguc

SEQ ID NO: 184536 - RNA, 18 nt, Human
ucucagaggcucugccag

SEQ ID NO: 184537 - RNA, 21 nt, Human
ucucagaggcucugccagacc

SEQ ID NO: 184538 - RNA, 19 nt, Human
ucucuggaggcuggggggu

SEQ ID NO: 184539 - RNA, 23 nt, Human
ucugagcccugaccugugucacc

SEQ ID NO: 184540 - RNA, 18 nt, Human
ucugcagccugcgcugag

SEQ ID NO: 184541 - RNA, 21 nt, Human
ucugccagacccuggauggcg

SEQ ID NO: 184542 - RNA, 19 nt, Human
ugaaauacauggcuuuugg

SEQ ID NO: 184543 - RNA, 18 nt, Human
ugaggaugggagcaggcg

SEQ ID NO: 184544 - RNA, 18 nt, Human
ugagugacaggaggucaa

SEQ ID NO: 184545 - RNA, 21 nt, Human
ugaugaaaagcaaagcagcac

SEQ ID NO: 184546 - RNA, 20 nt, Human
ugccagacccuggauggcgg

SEQ ID NO: 184547 - RNA, 22 nt, Human
uggacuugccuguguugggggc

SEQ ID NO: 184548 - RNA, 21 nt, Human
uggcagcuggggcacaggagg

SEQ ID NO: 184549 - RNA, 21 nt, Human
uggcaggguuauuauggggug

SEQ ID NO: 184550 - RNA, 22 nt, Human
uggcugggucgggaagggaccu

SEQ ID NO: 184551 - RNA, 19 nt, Human
ugggaggagcgaacagcuc

SEQ ID NO: 184552 - RNA, 21 nt, Human
uggggaccugaccagcaaccg

SEQ ID NO: 184553 - RNA, 23 nt, Human
uggggccccucaagggcgcaggg

SEQ ID NO: 184554 - RNA, 23 nt, Human
uggugcugucucaggcgucaccc

SEQ ID NO: 184555 - RNA, 18 nt, Human
uguggaggaaggacacag

SEQ ID NO: 184556 - RNA, 19 nt, Human
uucccaacaccacaccacc

SEQ ID NO: 184557 - RNA, 26 nt, Human
uucccgugugcagugcggggucucac

SEQ ID NO: 184558 - RNA, 22 nt, Human
aagccuggcaguggcccugagg

SEQ ID NO: 184559 - RNA, 18 nt, Human
agaaagggagggagugag

SEQ ID NO: 184560 - RNA, 23 nt, Human
agaaagugguucccuuuaucgag

SEQ ID NO: 184561 - RNA, 21 nt, Human
agagagaacgauagaaaggga

SEQ ID NO: 184562 - RNA, 24 nt, Human
agccggagcgagagcagucccagg

SEQ ID NO: 184563 - RNA, 22 nt, Human
cacaugugcugggcaccaggca

SEQ ID NO: 184564 - RNA, 19 nt, Human
cagucccaggacucggcaa

SEQ ID NO: 184565 - RNA, 21 nt, Human
gauagaaagggagggagugag

SEQ ID NO: 184566 - RNA, 19 nt, Human
gccggagcgagagcagucc

SEQ ID NO: 184567 - RNA, 19 nt, Human
ggacucggcaagccuggca

SEQ ID NO: 184568 - RNA, 19 nt, Human
gguuuuuuuucuuucuuug

SEQ ID NO: 184569 - RNA, 22 nt, Human
uaccugggcgcugggcgagggc

SEQ ID NO: 184570 - RNA, 19 nt, Human
uaggagagcgcgggagagu

SEQ ID NO: 184571 - RNA, 25 nt, Human
uauacaggauaacaaaaaaaaaaaa

SEQ ID NO: 184572 - RNA, 18 nt, Human
uccaugcaaagagagaac

SEQ ID NO: 184573 - RNA, 19 nt, Human
ucccaggacucggcaagcc

SEQ ID NO: 184574 - RNA, 20 nt, Human
ugagagagaaagacauggua

SEQ ID NO: 184575 - RNA, 24 nt, Human
uggcacaacuugaugguuuuuuuu

SEQ ID NO: 184576 - RNA, 24 nt, Human
uguagggcagcacaugugcugggc

SEQ ID NO: 184577 - RNA, 21 nt, Human
uuuuuuuuuuuuuuuuuauuu

SEQ ID NO: 184578 - RNA, 18 nt, Human
aaaaaaaagaaaaucacc

SEQ ID NO: 184579 - RNA, 19 nt, Human
aaaaaaacaccccuaaacc

SEQ ID NO: 184580 - RNA, 21 nt, Human
aaaaaaacaccccuaaaccca

SEQ ID NO: 184581 - RNA, 22 nt, Human
aaaaaacaccccuaaacccaag

SEQ ID NO: 184582 - RNA, 23 nt, Human
aaaaagcaaagucacuaggaugg

SEQ ID NO: 184583 - RNA, 19 nt, Human
aaaacccacaaacgaaaug

SEQ ID NO: 184584 - RNA, 22 nt, Human
aaaaucacaaaugcacaacuaa

SEQ ID NO: 184585 - RNA, 23 nt, Human
aaacaaaaacugggaucccaaaa

SEQ ID NO: 184586 - RNA, 24 nt, Human
aacccacaaacgaaaugagaaaaa

SEQ ID NO: 184587 - RNA, 19 nt, Human
aacugggaucccaaaacaa

SEQ ID NO: 184588 - RNA, 22 nt, Human
aacuggugccuuuuaacuuuuu

SEQ ID NO: 184589 - RNA, 21 nt, Human
aagaaaaacaacacauacaaa

SEQ ID NO: 184590 - RNA, 22 nt, Human
aagaaaaacaacacauacaaaa

SEQ ID NO: 184591 - RNA, 19 nt, Human
aagaaaaagacucaaauga

SEQ ID NO: 184592 - RNA, 21 nt, Human
aagaaaaagacucaaaugaga

SEQ ID NO: 184593 - RNA, 18 nt, Human
aagaaacaaggcgagauc

SEQ ID NO: 184594 - RNA, 21 nt, Human
aagaaacaaggcgagaucaca

SEQ ID NO: 184595 - RNA, 23 nt, Human
aagcaggaagagacagaagggac

SEQ ID NO: 184596 - RNA, 22 nt, Human
aagucagcacuucuuaaaccag

SEQ ID NO: 184597 - RNA, 20 nt, Human
aagugugaacaugugauaac

SEQ ID NO: 184598 - RNA, 20 nt, Human
aauaacagggagaaauggaa

SEQ ID NO: 184599 - RNA, 19 nt, Human
acacaaacaaccucuuugu

SEQ ID NO: 184600 - RNA, 18 nt, Human
accccaccccauccccca

SEQ ID NO: 184601 - RNA, 24 nt, Human
accccaccccaucccccaagaaaa

SEQ ID NO: 184602 - RNA, 23 nt, Human
accccaucccccaagaaaaacaa

SEQ ID NO: 184603 - RNA, 28 nt, Human
accuuauacucucuuaaaacaaaaacug

SEQ ID NO: 184604 - RNA, 21 nt, Human
acucccaccccaccccauccc

SEQ ID NO: 184605 - RNA, 24 nt, Human
agaaaaaaacauacaaacaaauaa

SEQ ID NO: 184606 - RNA, 18 nt, Human
agacuucugggaacuccu

SEQ ID NO: 184607 - RNA, 23 nt, Human
agcucuaccuacucccaccccac

SEQ ID NO: 184608 - RNA, 18 nt, Human
aggaagagacagaauuuu

SEQ ID NO: 184609 - RNA, 20 nt, Human
aggcggaggagacgcggggc

SEQ ID NO: 184610 - RNA, 22 nt, Human
agggggcuagguaagaaaaaga

SEQ ID NO: 184611 - RNA, 20 nt, Human
agguaagaaaaagacucaaa

SEQ ID NO: 184612 - RNA, 20 nt, Human
auacaaaaaucuggacaccu

SEQ ID NO: 184613 - RNA, 21 nt, Human
auaguucuguaccuacacugu

SEQ ID NO: 184614 - RNA, 25 nt, Human
aucacaaaugcacaacuaacuauag

SEQ ID NO: 184615 - RNA, 21 nt, Human
auucucagcucuaccuacucc

SEQ ID NO: 184616 - RNA, 22 nt, Human
caacacauacaaaaaucuggaa

SEQ ID NO: 184617 - RNA, 24 nt, Human
caagaaaaacaacacauacaaaaa

SEQ ID NO: 184618 - RNA, 22 nt, Human
cacauaguaaaaacuguacauu

SEQ ID NO: 184619 - RNA, 26 nt, Human
caccaauaaaugaaguacacauaacc

SEQ ID NO: 184620 - RNA, 23 nt, Human
caccccaucccccaagaaaaaca

SEQ ID NO: 184621 - RNA, 24 nt, Human
caccccaucccccaagaaaaacaa

SEQ ID NO: 184622 - RNA, 18 nt, Human
cagaagccugcuugugcc

SEQ ID NO: 184623 - RNA, 22 nt, Human
cagacaaaaacuuugcccgaag

SEQ ID NO: 184624 - RNA, 25 nt, Human
cagacaaaaacuuugcccgaguguu

SEQ ID NO: 184625 - RNA, 23 nt, Human
cagggugggcuagcuaaccugcc

SEQ ID NO: 184626 - RNA, 23 nt, Human
caugcacagacaaaaacuuugcc

SEQ ID NO: 184627 - RNA, 21 nt, Human
cauggcaaguccuuuguuuua

SEQ ID NO: 184628 - RNA, 22 nt, Human
ccaaaacaaauggagauacaca

SEQ ID NO: 184629 - RNA, 24 nt, Human
ccaccccaucccccaagaaaaaca

SEQ ID NO: 184630 - RNA, 18 nt, Human
ccacguuuaacaugguuu

SEQ ID NO: 184631 - RNA, 27 nt, Human
cccaagaaaaacaacacauacaaaaau

SEQ ID NO: 184632 - RNA, 24 nt, Human
cccacaaacgaaaugagaaaaaaa

SEQ ID NO: 184633 - RNA, 26 nt, Human
cccaccccaccccaucccccaagaaa

SEQ ID NO: 184634 - RNA, 18 nt, Human
ccccaagaaaaacaacac

SEQ ID NO: 184635 - RNA, 21 nt, Human
ccccaauauuccauuuugacc

SEQ ID NO: 184636 - RNA, 23 nt, Human
ccccaccccaucccccaagaaaa

SEQ ID NO: 184637 - RNA, 21 nt, Human
cccugagcccaggcuguaccc

SEQ ID NO: 184638 - RNA, 24 nt, Human
cccugagcuaucaaguaauuaugu

SEQ ID NO: 184639 - RNA, 23 nt, Human
cccuuuuccucccaaaacugaau

SEQ ID NO: 184640 - RNA, 19 nt, Human
ccuaagugggcuccuuggc

SEQ ID NO: 184641 - RNA, 23 nt, Human
ccucgcgucaggcaacggucccc

SEQ ID NO: 184642 - RNA, 20 nt, Human
ccuuggcugauaucuuggau

SEQ ID NO: 184643 - RNA, 23 nt, Human
cgaaaugagaaaaaaacauacaa

SEQ ID NO: 184644 - RNA, 24 nt, Human
cgaguggagcuggagggagaagga

SEQ ID NO: 184645 - RNA, 22 nt, Human
cggcagcgggccgagggcuggg

SEQ ID NO: 184646 - RNA, 18 nt, Human
cuaccuacucccaccccc

SEQ ID NO: 184647 - RNA, 22 nt, Human
cucccaaaacugaaugagaaaa

SEQ ID NO: 184648 - RNA, 25 nt, Human
cucccaaaacugaaugagaaaacaa

SEQ ID NO: 184649 - RNA, 18 nt, Human
cuccccuaagugggcucc

SEQ ID NO: 184650 - RNA, 22 nt, Human
cuggagggagaaggaguuggag

SEQ ID NO: 184651 - RNA, 21 nt, Human
cuggcggagucggggacuagc

SEQ ID NO: 184652 - RNA, 21 nt, Human
cuuuguggguuuuagguucgg

SEQ ID NO: 184653 - RNA, 23 nt, Human
gaaaaaaaaacccacaaacgaaa

SEQ ID NO: 184654 - RNA, 25 nt, Human
gaaauacguacauguuacgugccaa

SEQ ID NO: 184655 - RNA, 19 nt, Human
gagggagaaggaguuggag

SEQ ID NO: 184656 - RNA, 20 nt, Human
gagggagaaggaguuggagu

SEQ ID NO: 184657 - RNA, 20 nt, Human
gagggagaaggaguuggagu

SEQ ID NO: 184658 - RNA, 23 nt, Human
gaguuggaguugguggaagaggc

SEQ ID NO: 184659 - RNA, 26 nt, Human
ggaagggauucccaaggcaguuguuc

SEQ ID NO: 184660 - RNA, 19 nt, Human
ggcgaaaaguagagcuggg

SEQ ID NO: 184661 - RNA, 19 nt, Human
gguaaggacacaaggaagg

SEQ ID NO: 184662 - RNA, 20 nt, Human
guuugaaaucucgaccacuc

SEQ ID NO: 184663 - RNA, 23 nt, Human
uaaaaaaaaacaccccuaaaccc

SEQ ID NO: 184664 - RNA, 22 nt, Human
uaaaaagcaaagucacuaggau

SEQ ID NO: 184665 - RNA, 22 nt, Human
uaaaaucacaaaugcacaacua

SEQ ID NO: 184666 - RNA, 26 nt, Human
uaaaugaaguacacauaaccuccuuc

SEQ ID NO: 184667 - RNA, 18 nt, Human
uaagaaaaagacucaaau

SEQ ID NO: 184668 - RNA, 19 nt, Human
uaagaaacaaggcgagauc

SEQ ID NO: 184669 - RNA, 18 nt, Human
uaauuuaaaaaaaagaaa

SEQ ID NO: 184670 - RNA, 20 nt, Human
uacaaacaaauaauagagug

SEQ ID NO: 184671 - RNA, 19 nt, Human
uacacaugcacagacaaaa

SEQ ID NO: 184672 - RNA, 24 nt, Human
uacacaugcacagacaaaaacuuu

SEQ ID NO: 184673 - RNA, 20 nt, Human
uaggaugguagaaaagugau

SEQ ID NO: 184674 - RNA, 19 nt, Human
ucccaccccaccccauccc

SEQ ID NO: 184675 - RNA, 21 nt, Human
ucccaccccaccccauccccc

SEQ ID NO: 184676 - RNA, 18 nt, Human
ucccuuuuccucccaaaa

SEQ ID NO: 184677 - RNA, 20 nt, Human
ucccuuuuccucccaaaacu

SEQ ID NO: 184678 - RNA, 23 nt, Human
ugaacaauaacacaaacaaccuc

SEQ ID NO: 184679 - RNA, 19 nt, Human
ugaaugagaaaacaaaguc

SEQ ID NO: 184680 - RNA, 21 nt, Human
ugauaaaaucacaaaugcaca

SEQ ID NO: 184681 - RNA, 22 nt, Human
ugauaaaaucacaaaugcacaa

SEQ ID NO: 184682 - RNA, 20 nt, Human
ugauaaauaaaaccugcuuc

SEQ ID NO: 184683 - RNA, 24 nt, Human
ugauaagagggggcuagguaagaa

SEQ ID NO: 184684 - RNA, 19 nt, Human
ugccaagaagggacccugg

SEQ ID NO: 184685 - RNA, 20 nt, Human
ugccaagaagggacccuggu

SEQ ID NO: 184686 - RNA, 19 nt, Human
uggaagaggcgagcaggcg

SEQ ID NO: 184687 - RNA, 19 nt, Human
uggcuagcucucagacagc

SEQ ID NO: 184688 - RNA, 19 nt, Human
uggcuagcucucagacagc

SEQ ID NO: 184689 - RNA, 19 nt, Human
ugguuugcuuguaagaaac

SEQ ID NO: 184690 - RNA, 19 nt, Human
uguaagaaacaaggcgaga

SEQ ID NO: 184691 - RNA, 24 nt, Human
uguccauucauuuaaaaagcaaag

SEQ ID NO: 184692 - RNA, 21 nt, Human
ugugaacaugaaaacuagcac

SEQ ID NO: 184693 - RNA, 21 nt, Human
uguuucaauauaaaaauagag

SEQ ID NO: 184694 - RNA, 25 nt, Human
uuacaacugaagauugaacaauaac

SEQ ID NO: 184695 - RNA, 19 nt, Human
uucucagcucuaccuacuc

SEQ ID NO: 184696 - RNA, 22 nt, Human
uucuggcuagcucucagacagc

SEQ ID NO: 184697 - RNA, 21 nt, Human
uuuaaaaaaaagaaaaucacc

SEQ ID NO: 184698 - RNA, 23 nt, Human
uuuacaacagcccccaauauucc

SEQ ID NO: 184699 - RNA, 18 nt, Human
aaagucacuucugugccc

SEQ ID NO: 184700 - RNA, 21 nt, Human
aaaugcuucucaagaaucuac

SEQ ID NO: 184701 - RNA, 23 nt, Human
aaaugcuucucaagaaucuaccc

SEQ ID NO: 184702 - RNA, 25 nt, Human
accccauaacuuauagacauucaga

SEQ ID NO: 184703 - RNA, 23 nt, Human
agauacacuaaauucuucuuauu

SEQ ID NO: 184704 - RNA, 22 nt, Human
aggaaggggcuuggaauugaua

SEQ ID NO: 184705 - RNA, 20 nt, Human
auagacauucagacauuucc

SEQ ID NO: 184706 - RNA, 22 nt, Human
caaaaauggaagagucucuuga

SEQ ID NO: 184707 - RNA, 22 nt, Human
caaagucacuucugugcccuuc

SEQ ID NO: 184708 - RNA, 22 nt, Human
caccaaauaguuaacagcuuua

SEQ ID NO: 184709 - RNA, 18 nt, Human
cagcuuuauuggagauau

SEQ ID NO: 184710 - RNA, 24 nt, Human
cuacuugccauuguauguuuugau

SEQ ID NO: 184711 - RNA, 28 nt, Human
cucaagaaucuaccccauaacuuauaga

SEQ ID NO: 184712 - RNA, 19 nt, Human
cucgcccugcgcgcccugg

SEQ ID NO: 184713 - RNA, 20 nt, Human
gaaaugcuucucaagaaucu

SEQ ID NO: 184714 - RNA, 25 nt, Human
ggucaaaauuaucaagguucuucag

SEQ ID NO: 184715 - RNA, 20 nt, Human
gugucauuuaaacguugagu

SEQ ID NO: 184716 - RNA, 30 nt, Human
uaacuuauagacauucagacauuuccuuuu

SEQ ID NO: 184717 - RNA, 19 nt, Human
ucaaagucacuucugugcc

SEQ ID NO: 184718 - RNA, 20 nt, Human
ucuacagcuugcaaaaaugg

SEQ ID NO: 184719 - RNA, 24 nt, Human
ugaaaugcuucucaagaaucuacc

SEQ ID NO: 184720 - RNA, 20 nt, Human
ugaaauuauaugaaaugcuu

SEQ ID NO: 184721 - RNA, 21 nt, Human
ugauaauaaaauuacagauac

SEQ ID NO: 184722 - RNA, 23 nt, Human
ugggagcagaggcacaauaccaa

SEQ ID NO: 184723 - RNA, 20 nt, Human
ugugucauuuaaacguugag

SEQ ID NO: 184724 - RNA, 22 nt, Human
uugaauauaauagaauacaaau

SEQ ID NO: 184725 - RNA, 19 nt, Human
uuguuacauugaaaaagga

SEQ ID NO: 184726 - RNA, 18 nt, Human
uuuucauugucuggcaaa

SEQ ID NO: 184727 - RNA, 23 nt, Human
uuuuuuuuuuuuuuuuccaccaa

SEQ ID NO: 184728 - RNA, 21 nt, Human
aaaaaaaaacccucacaacgu

SEQ ID NO: 184729 - RNA, 23 nt, Human
aaaaaaaacccucacaacgugag

SEQ ID NO: 184730 - RNA, 18 nt, Human
aaaacgaggaagagaagg

SEQ ID NO: 184731 - RNA, 19 nt, Human
aaacaagguccccacagau

SEQ ID NO: 184732 - RNA, 22 nt, Human
aaccccacggccggugcgcucu

SEQ ID NO: 184733 - RNA, 18 nt, Human
aagaggaagcaguucagu

SEQ ID NO: 184734 - RNA, 22 nt, Human
aaggaaaagaaguguuuaaaaa

SEQ ID NO: 184735 - RNA, 22 nt, Human
aagggcuggcugggaaggcugc

SEQ ID NO: 184736 - RNA, 25 nt, Human
acaagcgagagcgaguguguaugcg

SEQ ID NO: 184737 - RNA, 18 nt, Human
acaagguccccacagaua

SEQ ID NO: 184738 - RNA, 23 nt, Human
accuugccccucaagccgaaagc

SEQ ID NO: 184739 - RNA, 23 nt, Human
agaauaaacaagguccccacaga

SEQ ID NO: 184740 - RNA, 19 nt, Human
aggaaaauuauuuucuuuc

SEQ ID NO: 184741 - RNA, 19 nt, Human
aggaagagagaaauccugg

SEQ ID NO: 184742 - RNA, 24 nt, Human
aggaagcaguucagucuggcaccc

SEQ ID NO: 184743 - RNA, 21 nt, Human
aggcagcggcgcgcuccucgc

SEQ ID NO: 184744 - RNA, 24 nt, Human
aguaagaauucucucuagaauaaa

SEQ ID NO: 184745 - RNA, 19 nt, Human
caagccgaaagcccgccag

SEQ ID NO: 184746 - RNA, 22 nt, Human
cacggccggugcgcucuucacc

SEQ ID NO: 184747 - RNA, 20 nt, Human
cagcccucuggacugcgcuc

SEQ ID NO: 184748 - RNA, 19 nt, Human
cauaaaagcaaaugaaggu

SEQ ID NO: 184749 - RNA, 22 nt, Human
ccauggggguucagagcugcaa

SEQ ID NO: 184750 - RNA, 23 nt, Human
ccauucagauagcuaaaaugcag

SEQ ID NO: 184751 - RNA, 22 nt, Human
ccccacggccggugcgcucuuc

SEQ ID NO: 184752 - RNA, 19 nt, Human
cccccgggagggagaugga

SEQ ID NO: 184753 - RNA, 21 nt, Human
ccccucaagccgaaagcccgc

SEQ ID NO: 184754 - RNA, 22 nt, Human
ccucuagcccccagauggaaac

SEQ ID NO: 184755 - RNA, 18 nt, Human
ccuugccccucaagccga

SEQ ID NO: 184756 - RNA, 21 nt, Human
ccuugccccucaagccgaaag

SEQ ID NO: 184757 - RNA, 22 nt, Human
cgaguguguaugcgcgcgugug

SEQ ID NO: 184758 - RNA, 23 nt, Human
cgaguuccgagccgcagaauccu

SEQ ID NO: 184759 - RNA, 19 nt, Human
cgggagggagauggacaag

SEQ ID NO: 184760 - RNA, 24 nt, Human
cggugcgcucuucaccuugccccu

SEQ ID NO: 184761 - RNA, 20 nt, Human
cuccugaaauaggaagagag

SEQ ID NO: 184762 - RNA, 21 nt, Human
cugcugccuugcuccucuagc

SEQ ID NO: 184763 - RNA, 18 nt, Human
cugggaaggcugcugccu

SEQ ID NO: 184764 - RNA, 23 nt, Human
cuugcuccucuagcccccagaug

SEQ ID NO: 184765 - RNA, 18 nt, Human
gaagagaaggaaaagaag

SEQ ID NO: 184766 - RNA, 18 nt, Human
gagcgcugcgggcucggc

SEQ ID NO: 184767 - RNA, 20 nt, Human
gagcugcaauccgaguuccg

SEQ ID NO: 184768 - RNA, 19 nt, Human
gcagcggcgcgcuccucgc

SEQ ID NO: 184769 - RNA, 23 nt, Human
gcaguuucaucugaccaaaaacc

SEQ ID NO: 184770 - RNA, 20 nt, Human
gcgcgcgccggcucccccgg

SEQ ID NO: 184771 - RNA, 18 nt, Human
gcgcugcgggcucggcuc

SEQ ID NO: 184772 - RNA, 21 nt, Human
gcuaaaaugcaguuucaucug

SEQ ID NO: 184773 - RNA, 21 nt, Human
gcugggaaggcugcugccuug

SEQ ID NO: 184774 - RNA, 21 nt, Human
ggaaggcugcugccuugcucc

SEQ ID NO: 184775 - RNA, 23 nt, Human
gggcuggcugggaaggcugcugc

SEQ ID NO: 184776 - RNA, 20 nt, Human
ggggacgagcagcgcagccc

SEQ ID NO: 184777 - RNA, 18 nt, Human
gguucagagcugcaaucc

SEQ ID NO: 184778 - RNA, 26 nt, Human
uaagccagauggacgauggcaagcca

SEQ ID NO: 184779 - RNA, 26 nt, Human
uagaauaaacaagguccccacagaua

SEQ ID NO: 184780 - RNA, 21 nt, Human
ucaaaacgaggaagagaagga

SEQ ID NO: 184781 - RNA, 22 nt, Human
uccagcucgguaaaccccacgg

SEQ ID NO: 184782 - RNA, 25 nt, Human
uccccacagauagcugaaggaaaga

SEQ ID NO: 184783 - RNA, 22 nt, Human
ugaaauaggaagagagaaaucc

SEQ ID NO: 184784 - RNA, 18 nt, Human
ugaaggaaagaggaagca

SEQ ID NO: 184785 - RNA, 21 nt, Human
ugaaggaaagaggaagcaguu

SEQ ID NO: 184786 - RNA, 19 nt, Human
ugagcucgagguucuuggg

SEQ ID NO: 184787 - RNA, 19 nt, Human
ugcagcauaaaagcaaaug

SEQ ID NO: 184788 - RNA, 21 nt, Human
ugccuugcuccucuagccccc

SEQ ID NO: 184789 - RNA, 22 nt, Human
ugccuugcuccucuagccccca

SEQ ID NO: 184790 - RNA, 24 nt, Human
ugggaaaacaaaaagggaggcaga

SEQ ID NO: 184791 - RNA, 18 nt, Human
uggggaugugugugcgug

SEQ ID NO: 184792 - RNA, 20 nt, Human
uguaugcgcgcgugugucug

SEQ ID NO: 184793 - RNA, 19 nt, Human
ugugcggcaaaggugggag

SEQ ID NO: 184794 - RNA, 18 nt, Human
uguguaugcgcgcgugug

SEQ ID NO: 184795 - RNA, 22 nt, Human
uguuugcuuuuuuguugaaaau

SEQ ID NO: 184796 - RNA, 24 nt, Human
uucuuucuuccuuuuuuauuuuaa

SEQ ID NO: 184797 - RNA, 23 nt, Human
uuuaaaugagaaaaaaaaaaacc

SEQ ID NO: 184798 - RNA, 25 nt, Human
uuuuuauuuuaaaugagaaaaaaaa

SEQ ID NO: 184799 - RNA, 19 nt, Human
aaagaugagaagacucugc

SEQ ID NO: 184800 - RNA, 21 nt, Human
acuagguaccccaggcuucug

SEQ ID NO: 184801 - RNA, 20 nt, Human
aggcugccaguggcuugaca

SEQ ID NO: 184802 - RNA, 18 nt, Human
aggcuucugcuggucucc

SEQ ID NO: 184803 - RNA, 23 nt, Human
aucacccccgccaccaagcaggc

SEQ ID NO: 184804 - RNA, 18 nt, Human
aucuggagagggacaggg

SEQ ID NO: 184805 - RNA, 24 nt, Human
caguggcuugacaguucaggaucu

SEQ ID NO: 184806 - RNA, 22 nt, Human
cauacaucacccccgccaccaa

SEQ ID NO: 184807 - RNA, 21 nt, Human
ccaacccuucuccacauacau

SEQ ID NO: 184808 - RNA, 22 nt, Human
cccaggcuucugcuggucucca

SEQ ID NO: 184809 - RNA, 24 nt, Human
ccccauagccuccuguccuccagu

SEQ ID NO: 184810 - RNA, 18 nt, Human
cccugggaguccuggaga

SEQ ID NO: 184811 - RNA, 19 nt, Human
ccuccagugaaaagaugag

SEQ ID NO: 184812 - RNA, 23 nt, Human
ccuggccugggcccuggccccac

SEQ ID NO: 184813 - RNA, 21 nt, Human
cggccuggccugggcccuggc

SEQ ID NO: 184814 - RNA, 20 nt, Human
cuggccugggcccuggcccc

SEQ ID NO: 184815 - RNA, 20 nt, Human
gagaagacucugcucccugg

SEQ ID NO: 184816 - RNA, 21 nt, Human
ggagaaagccccacaucugga

SEQ ID NO: 184817 - RNA, 21 nt, Human
ggcaugaggcugccaguggcu

SEQ ID NO: 184818 - RNA, 20 nt, Human
uaccccaggcuucugcuggu

SEQ ID NO: 184819 - RNA, 24 nt, Human
uccuccagugaaaagaugagaaga

SEQ ID NO: 184820 - RNA, 21 nt, Human
ucuccaggugcguagcugggc

SEQ ID NO: 184821 - RNA, 23 nt, Human
ucuggagagggacagggcaacug

SEQ ID NO: 184822 - RNA, 20 nt, Human
ucuggcaaaugugguggcau

SEQ ID NO: 184823 - RNA, 26 nt, Human
uggagagggacagggcaacugcauuu

SEQ ID NO: 184824 - RNA, 25 nt, Human
uggcaaaugugguggcaugagaaga

SEQ ID NO: 184825 - RNA, 19 nt, Human
uuccaccccucccagagga

SEQ ID NO: 184826 - RNA, 21 nt, Human
uucuggcaaaugugguggcau

SEQ ID NO: 184827 - RNA, 28 nt, Human
aaacaaaaagagaaugugucacaucuaa

SEQ ID NO: 184828 - RNA, 19 nt, Human
aaacagaugcaaaacuaau

SEQ ID NO: 184829 - RNA, 25 nt, Human
aaacagaugcaaaacuaaugugcau

SEQ ID NO: 184830 - RNA, 24 nt, Human
aaagaaaaaaauauacuuaaaagc

SEQ ID NO: 184831 - RNA, 20 nt, Human
aaagcuggcaaauacaccaa

SEQ ID NO: 184832 - RNA, 22 nt, Human
aauggcaaauacaaauaaagua

SEQ ID NO: 184833 - RNA, 27 nt, Human
agaaaaagaaaaaaauauacuuaaaag

SEQ ID NO: 184834 - RNA, 23 nt, Human
caaaacagaugcaaaacuaaugu

SEQ ID NO: 184835 - RNA, 23 nt, Human
caaauacaccaacaccuuaaagu

SEQ ID NO: 184836 - RNA, 18 nt, Human
cacaaaacagaugcaaaa

SEQ ID NO: 184837 - RNA, 22 nt, Human
cagaaucagagccucggcccgg

SEQ ID NO: 184838 - RNA, 19 nt, Human
caggucacaaaacagaugc

SEQ ID NO: 184839 - RNA, 23 nt, Human
caggucacaaaacagaugcaaaa

SEQ ID NO: 184840 - RNA, 23 nt, Human
ccaggguggagucggccuccccc

SEQ ID NO: 184841 - RNA, 22 nt, Human
ccccagaaucagagccucggcc

SEQ ID NO: 184842 - RNA, 18 nt, Human
ccuccagccaggguggag

SEQ ID NO: 184843 - RNA, 19 nt, Human
gcaaauacaccaacaccuu

SEQ ID NO: 184844 - RNA, 21 nt, Human
ggaauaaacaaaaagagaaug

SEQ ID NO: 184845 - RNA, 22 nt, Human
uaaaguacagcaaauaaagcug

SEQ ID NO: 184846 - RNA, 25 nt, Human
uacagcaaauaaagcuggcaaauac

SEQ ID NO: 184847 - RNA, 23 nt, Human
ucacaaaacagaugcaaaacuaa

SEQ ID NO: 184848 - RNA, 21 nt, Human
ucagagccucggcccgggugc

SEQ ID NO: 184849 - RNA, 18 nt, Human
uccuccagccagggugga

SEQ ID NO: 184850 - RNA, 18 nt, Human
ucucugguuguuacaugg

SEQ ID NO: 184851 - RNA, 19 nt, Human
ugaauggcaaauacaaaua

SEQ ID NO: 184852 - RNA, 24 nt, Human
ugugcauugaaaaugagaaaaaga

SEQ ID NO: 184853 - RNA, 24 nt, Human
uuacauggugauuugucguuucua

SEQ ID NO: 184854 - RNA, 21 nt, Human
uucuauguuuguuggcugugg

SEQ ID NO: 184855 - RNA, 19 nt, Human
aagcccacaaccagagggu

SEQ ID NO: 184856 - RNA, 26 nt, Human
aagcccacaaccagagggugcucugg

SEQ ID NO: 184857 - RNA, 20 nt, Human
acuucagccaauucuaacac

SEQ ID NO: 184858 - RNA, 21 nt, Human
agacauggaggggcugggggu

SEQ ID NO: 184859 - RNA, 21 nt, Human
agagaaaggggagucacagag

SEQ ID NO: 184860 - RNA, 19 nt, Human
aggcgcgugggcgcgcggc

SEQ ID NO: 184861 - RNA, 20 nt, Human
agucacagaggaggcugcag

SEQ ID NO: 184862 - RNA, 21 nt, Human
caaaaacacuucagccaauuc

SEQ ID NO: 184863 - RNA, 24 nt, Human
caaaaacacuucagccaauucuaa

SEQ ID NO: 184864 - RNA, 25 nt, Human
ccaagcccacaaccagagggugcuc

SEQ ID NO: 184865 - RNA, 22 nt, Human
cgcgagccgaggaggaaggagc

SEQ ID NO: 184866 - RNA, 24 nt, Human
cgcgcagcaagcgaggcgcguggg

SEQ ID NO: 184867 - RNA, 21 nt, Human
gagaccagccuucccugcuaa

SEQ ID NO: 184868 - RNA, 19 nt, Human
ggacgagaagagaaagggg

SEQ ID NO: 184869 - RNA, 19 nt, Human
ggacuagaagguacacuga

SEQ ID NO: 184870 - RNA, 21 nt, Human
ggacuagaagguacacugagu

SEQ ID NO: 184871 - RNA, 23 nt, Human
ucagaaaagucagcugcacaaaa

SEQ ID NO: 184872 - RNA, 23 nt, Human
ugggggagaccagccuucccugg

SEQ ID NO: 184873 - RNA, 18 nt, Human
uggggguuaggcuggggg

SEQ ID NO: 184874 - RNA, 23 nt, Human
aaaauccaggugcagacccaccg

SEQ ID NO: 184875 - RNA, 20 nt, Human
accacagagggaccuuucca

SEQ ID NO: 184876 - RNA, 19 nt, Human
agcugcagcagcacuggga

SEQ ID NO: 184877 - RNA, 20 nt, Human
aggugggcagaguggggaaa

SEQ ID NO: 184878 - RNA, 24 nt, Human
caagugagaauauggaguguuugg

SEQ ID NO: 184879 - RNA, 19 nt, Human
cagcagcacugggacucca

SEQ ID NO: 184880 - RNA, 24 nt, Human
caguguguguuguuucccucuaug

SEQ ID NO: 184881 - RNA, 21 nt, Human
cauauauuuacuguaucagau

SEQ ID NO: 184882 - RNA, 21 nt, Human
ccaccgcuucucucuaagcag

SEQ ID NO: 184883 - RNA, 20 nt, Human
ccagaggguguggcuguuag

SEQ ID NO: 184884 - RNA, 24 nt, Human
ccuuccgcccucucauaggcccca

SEQ ID NO: 184885 - RNA, 18 nt, Human
cuccagcuccauccaugu

SEQ ID NO: 184886 - RNA, 19 nt, Human
cucccuccucccaccuucc

SEQ ID NO: 184887 - RNA, 23 nt, Human
cucccuccucccaccuuccgccc

SEQ ID NO: 184888 - RNA, 21 nt, Human
cugcagcagcacugggacucc

SEQ ID NO: 184889 - RNA, 19 nt, Human
gaucucucccuccucccac

SEQ ID NO: 184890 - RNA, 18 nt, Human
gaucuuguucuuucuuua

SEQ ID NO: 184891 - RNA, 22 nt, Human
gcucccacuuacaagugagaau

SEQ ID NO: 184892 - RNA, 18 nt, Human
gcugcagcagcacuggga

SEQ ID NO: 184893 - RNA, 19 nt, Human
gcuguuagugugucucucu

SEQ ID NO: 184894 - RNA, 22 nt, Human
ggaauuguguacagagacuguu

SEQ ID NO: 184895 - RNA, 22 nt, Human
gggagcgaggaaguaaacugug

SEQ ID NO: 184896 - RNA, 19 nt, Human
ggguacaugcgcaggaagu

SEQ ID NO: 184897 - RNA, 22 nt, Human
ggugggcagaguggggaaaugc

SEQ ID NO: 184898 - RNA, 20 nt, Human
gguguggcuguuaguguguc

SEQ ID NO: 184899 - RNA, 19 nt, Human
gucauggggguuuguuaca

SEQ ID NO: 184900 - RNA, 22 nt, Human
gucauggggguuuguuacacag

SEQ ID NO: 184901 - RNA, 23 nt, Human
uacacagauuauuucaucacccu

SEQ ID NO: 184902 - RNA, 19 nt, Human
uacuuugauuggcaugggc

SEQ ID NO: 184903 - RNA, 18 nt, Human
uagugugucucucuacuc

SEQ ID NO: 184904 - RNA, 21 nt, Human
uaugaaggauaauggccucca

SEQ ID NO: 184905 - RNA, 23 nt, Human
uaugaaggauaauggccuccagc

SEQ ID NO: 184906 - RNA, 19 nt, Human
ucaagaggaagaggaaaua

SEQ ID NO: 184907 - RNA, 24 nt, Human
ucagagcugcagcagcacugggga

SEQ ID NO: 184908 - RNA, 21 nt, Human
ucauaggccccaguguguguu

SEQ ID NO: 184909 - RNA, 20 nt, Human
ucccugcaaagggcaugauc

SEQ ID NO: 184910 - RNA, 21 nt, Human
ucucauaggccccagugugug

SEQ ID NO: 184911 - RNA, 22 nt, Human
ucucccuccucccaccuuccgc

SEQ ID NO: 184912 - RNA, 19 nt, Human
ucucuggugacgugggaau

SEQ ID NO: 184913 - RNA, 23 nt, Human
ugcagucauauauuuacuguauc

SEQ ID NO: 184914 - RNA, 18 nt, Human
ugcucagagcugcagcag

SEQ ID NO: 184915 - RNA, 18 nt, Human
uggaaagacauucaagag

SEQ ID NO: 184916 - RNA, 21 nt, Human
uggccuccagcuccauccaug

SEQ ID NO: 184917 - RNA, 24 nt, Human
ugggcagaguggggaaaugcagug

SEQ ID NO: 184918 - RNA, 18 nt, Human
uguggaaggagacaugag

SEQ ID NO: 184919 - RNA, 20 nt, Human
uguggaaggagacaugagua

SEQ ID NO: 184920 - RNA, 21 nt, Human
uguuacauacauaaaggugug

SEQ ID NO: 184921 - RNA, 24 nt, Human
uuacaagugagaauauggaguguu

SEQ ID NO: 184922 - RNA, 20 nt, Human
uucaucacccuaaguaucca

SEQ ID NO: 184923 - RNA, 26 nt, Human
uuccugaucucucccuccucccaccu

SEQ ID NO: 184924 - RNA, 23 nt, Human
uuuccugaucucucccuccuccc

SEQ ID NO: 184925 - RNA, 20 nt, Human
aaaacgccaccaucaagcug

SEQ ID NO: 184926 - RNA, 21 nt, Human
aaaagccaaaagugucaacau

SEQ ID NO: 184927 - RNA, 18 nt, Human
aaaaggaagcaaaaugaa

SEQ ID NO: 184928 - RNA, 22 nt, Human
aaaauacaaacucuaauaccag

SEQ ID NO: 184929 - RNA, 21 nt, Human
aaacuaguuaccgaaaucaaa

SEQ ID NO: 184930 - RNA, 18 nt, Human
aaagguaagccugguguc

SEQ ID NO: 184931 - RNA, 19 nt, Human
aaccagggccuacaguaau

SEQ ID NO: 184932 - RNA, 18 nt, Human
aagcaaaaugaaccccaa

SEQ ID NO: 184933 - RNA, 20 nt, Human
acaauguuaacaaagauaag

SEQ ID NO: 184934 - RNA, 26 nt, Human
acacaaauauaucacuacacuuucaa

SEQ ID NO: 184935 - RNA, 24 nt, Human
accacacuuuauaaaacacuacag

SEQ ID NO: 184936 - RNA, 27 nt, Human
agaaagaacaggaagaugccgguaccc

SEQ ID NO: 184937 - RNA, 22 nt, Human
auaaaacacuacagguaaacca

SEQ ID NO: 184938 - RNA, 30 nt, Human
auauuaauggaagccuuuucaaauauaucc

SEQ ID NO: 184939 - RNA, 19 nt, Human
auccauggcccgagguccu

SEQ ID NO: 184940 - RNA, 20 nt, Human
augccacagauaucccuagu

SEQ ID NO: 184941 - RNA, 23 nt, Human
auuuauuacauuuugcaagcacu

SEQ ID NO: 184942 - RNA, 24 nt, Human
caaaaugaaccccaaauuaauuaa

SEQ ID NO: 184943 - RNA, 25 nt, Human
caguagaauccauggcccgaggucc

SEQ ID NO: 184944 - RNA, 27 nt, Human
cauaaagaaaaggaagcaaaaugaacc

SEQ ID NO: 184945 - RNA, 22 nt, Human
cauggcccgagguccugcuuca

SEQ ID NO: 184946 - RNA, 25 nt, Human
ccaccuucauaaagguaauuaauuu

SEQ ID NO: 184947 - RNA, 20 nt, Human
ccccuaccuacuacaagaac

SEQ ID NO: 184948 - RNA, 26 nt, Human
gaagacacuuuacagcauucuuguag

SEQ ID NO: 184949 - RNA, 20 nt, Human
gaaugcauaaucaugccaca

SEQ ID NO: 184950 - RNA, 20 nt, Human
gggaaauaccuuuuaagaac

SEQ ID NO: 184951 - RNA, 19 nt, Human
gguuggauggcccuuaguu

SEQ ID NO: 184952 - RNA, 22 nt, Human
guacacaaguguauuuauuaca

SEQ ID NO: 184953 - RNA, 22 nt, Human
uaaaaacacaaauauaucacua

SEQ ID NO: 184954 - RNA, 24 nt, Human
uaaaaacacaaauauaucacuaca

SEQ ID NO: 184955 - RNA, 23 nt, Human
uaaaacacuacagguaaaccaac

SEQ ID NO: 184956 - RNA, 18 nt, Human
uaacaaagauaagaagca

SEQ ID NO: 184957 - RNA, 20 nt, Human
uaacaaagauaagaagcacu

SEQ ID NO: 184958 - RNA, 24 nt, Human
uaagaaauaaugcaaaagguguua

SEQ ID NO: 184959 - RNA, 22 nt, Human
uaaguugaaaagacaguuuuaa

SEQ ID NO: 184960 - RNA, 23 nt, Human
uaauaaaccaccuucauaaaggu

SEQ ID NO: 184961 - RNA, 21 nt, Human
uacaaacucuaauaccagaaa

SEQ ID NO: 184962 - RNA, 21 nt, Human
uacaaagcacucugugaaaau

SEQ ID NO: 184963 - RNA, 22 nt, Human
uacaauguuaacaaagauaaga

SEQ ID NO: 184964 - RNA, 20 nt, Human
uaccagaaauaaaagccaaa

SEQ ID NO: 184965 - RNA, 21 nt, Human
uaccagaaauaaaagccaaaa

SEQ ID NO: 184966 - RNA, 19 nt, Human
uaccuaguuuuauacacug

SEQ ID NO: 184967 - RNA, 19 nt, Human
uagaagacacuuuacagca

SEQ ID NO: 184968 - RNA, 19 nt, Human
uagauugaugaaaacauga

SEQ ID NO: 184969 - RNA, 19 nt, Human
uagauugaugaaaacauga

SEQ ID NO: 184970 - RNA, 21 nt, Human
uaggggccucugaccacacuu

SEQ ID NO: 184971 - RNA, 23 nt, Human
uaguaucuuugauuuuacagaac

SEQ ID NO: 184972 - RNA, 25 nt, Human
uaucacaaacuguuaagacacggaa

SEQ ID NO: 184973 - RNA, 24 nt, Human
uauguacaaaacagauuaauugua

SEQ ID NO: 184974 - RNA, 24 nt, Human
ucaaaaacgccaccaucaagcugu

SEQ ID NO: 184975 - RNA, 24 nt, Human
ucacaaacuguuaagacacggaac

SEQ ID NO: 184976 - RNA, 19 nt, Human
ugaaaacaugaaccagggc

SEQ ID NO: 184977 - RNA, 23 nt, Human
ugaaaauacaaacucuaauacca

SEQ ID NO: 184978 - RNA, 25 nt, Human
ugaaauaaaaacacaaauauaucac

SEQ ID NO: 184979 - RNA, 23 nt, Human
ugaaccagggccuacaguaauau

SEQ ID NO: 184980 - RNA, 22 nt, Human
ugcauucaaaugguagaaagaa

SEQ ID NO: 184981 - RNA, 21 nt, Human
ugcuacaaagcacucugugaa

SEQ ID NO: 184982 - RNA, 19 nt, Human
uggaagccuuuucaaauau

SEQ ID NO: 184983 - RNA, 20 nt, Human
uggaaggcugcaagcaaagc

SEQ ID NO: 184984 - RNA, 21 nt, Human
uggcacauuuauguacaaaac

SEQ ID NO: 184985 - RNA, 22 nt, Human
uggcacauuuauguacaaaaca

SEQ ID NO: 184986 - RNA, 19 nt, Human
ugggaagugguuaaaaauc

SEQ ID NO: 184987 - RNA, 18 nt, Human
uuaacaaagauaagaagc

SEQ ID NO: 184988 - RNA, 18 nt, Human
uuaguaucuuugauuuua

SEQ ID NO: 184989 - RNA, 19 nt, Human
uucaauagucuacaguagu

SEQ ID NO: 184990 - RNA, 26 nt, Human
uugaagguuaccuguaguuaaacuag

SEQ ID NO: 184991 - RNA, 18 nt, Human
aaaaugcuuuucccccug

SEQ ID NO: 184992 - RNA, 19 nt, Human
aaaauugcagaaaccuaga

SEQ ID NO: 184993 - RNA, 23 nt, Human
accauccaccaaaaaugcuuuuc

SEQ ID NO: 184994 - RNA, 23 nt, Human
auuaaaacgguucucuuccauuu

SEQ ID NO: 184995 - RNA, 20 nt, Human
caccaaaaaugcuuuucccc

SEQ ID NO: 184996 - RNA, 20 nt, Human
cagaaaauguaaguauucca

SEQ ID NO: 184997 - RNA, 25 nt, Human
cauuucaucuucagcacuuguuuuc

SEQ ID NO: 184998 - RNA, 25 nt, Human
ccccccaacacacacuuguuuuucc

SEQ ID NO: 184999 - RNA, 18 nt, Human
cccccuguuccccccaac

SEQ ID NO: 185000 - RNA, 21 nt, Human
cccuguuccccccaacacaca

SEQ ID NO: 185001 - RNA, 20 nt, Human
ccuccucuuccuuuucuuuu

SEQ ID NO: 185002 - RNA, 20 nt, Human
ccucuuccuuuucuuuugga

SEQ ID NO: 185003 - RNA, 18 nt, Human
ccuuuucuuuuggacucc

SEQ ID NO: 185004 - RNA, 25 nt, Human
cuauuuacaaauuacuguaacaaaa

SEQ ID NO: 185005 - RNA, 20 nt, Human
cuccgucucuuauuuacacc

SEQ ID NO: 185006 - RNA, 19 nt, Human
cucuuccauuucaucuuca

SEQ ID NO: 185007 - RNA, 22 nt, Human
cuuccuuuucuuuuggacuccc

SEQ ID NO: 185008 - RNA, 23 nt, Human
uaaauaacugaauccuuuucaaa

SEQ ID NO: 185009 - RNA, 25 nt, Human
uaugagaacauuauuuuaaaaagga

SEQ ID NO: 185010 - RNA, 18 nt, Human
uauuucaugcuacagagc

SEQ ID NO: 185011 - RNA, 22 nt, Human
ucagcacuuguuuucauuuuca

SEQ ID NO: 185012 - RNA, 22 nt, Human
ucaucuggcuuauuugaggguc

SEQ ID NO: 185013 - RNA, 25 nt, Human
ucuggagugucagugauauuucaug

SEQ ID NO: 185014 - RNA, 20 nt, Human
ucuuccuuuucuuuuggacu

SEQ ID NO: 185015 - RNA, 22 nt, Human
ucuuccuuuucuuuuggacucc

SEQ ID NO: 185016 - RNA, 26 nt, Human
ugaaccaugugaucauaaaaaaauug

SEQ ID NO: 185017 - RNA, 18 nt, Human
ugacaaaacaaaauccag

SEQ ID NO: 185018 - RNA, 18 nt, Human
ugacaaaacaaaauccag

SEQ ID NO: 185019 - RNA, 19 nt, Human
ugcuuuagucuggaguguc

SEQ ID NO: 185020 - RNA, 22 nt, Human
uggaaauagccaccagaucuca

SEQ ID NO: 185021 - RNA, 20 nt, Human
uggcuuauuugagggucauu

SEQ ID NO: 185022 - RNA, 24 nt, Human
uggcuuauuugagggucauuuggu

SEQ ID NO: 185023 - RNA, 27 nt, Human
uguuuuuccuccucuuccuuuucuuuu

SEQ ID NO: 185024 - RNA, 20 nt, Human
uuagaacauauuugcaaagu

SEQ ID NO: 185025 - RNA, 21 nt, Human
uucagcacuuguuuucauuuu

SEQ ID NO: 185026 - RNA, 20 nt, Human
uucccccuguuccccccaac

SEQ ID NO: 185027 - RNA, 20 nt, Human
uuucuuuuggacuccccucc

SEQ ID NO: 185028 - RNA, 23 nt, Human
uuuuucuucaaauuuucaucugg

SEQ ID NO: 185029 - RNA, 18 nt, Human
acucccuccccgucccca

SEQ ID NO: 185030 - RNA, 22 nt, Human
acugggaggccugggagccugu

SEQ ID NO: 185031 - RNA, 24 nt, Human
agccugaaauguguggccuguguc

SEQ ID NO: 185032 - RNA, 21 nt, Human
agcgggaaggaggcugggagc

SEQ ID NO: 185033 - RNA, 23 nt, Human
aggagagauccagaauccagagc

SEQ ID NO: 185034 - RNA, 22 nt, Human
aggcugggagccuagcgggaaa

SEQ ID NO: 185035 - RNA, 20 nt, Human
aggggacucagaguaccuug

SEQ ID NO: 185036 - RNA, 21 nt, Human
agggucuuucugcugagccuc

SEQ ID NO: 185037 - RNA, 18 nt, Human
aggugcacagcccagccc

SEQ ID NO: 185038 - RNA, 24 nt, Human
caaacaaauacaaaaaaggacauu

SEQ ID NO: 185039 - RNA, 19 nt, Human
cacagcccagcccuggccu

SEQ ID NO: 185040 - RNA, 21 nt, Human
cagaauccagagcugugcuga

SEQ ID NO: 185041 - RNA, 18 nt, Human
cagaguaccuugcgcugc

SEQ ID NO: 185042 - RNA, 23 nt, Human
caggagagauccagaauccagag

SEQ ID NO: 185043 - RNA, 22 nt, Human
caggggucugcggggcagcagg

SEQ ID NO: 185044 - RNA, 22 nt, Human
caugcuuguccaggacugggag

SEQ ID NO: 185045 - RNA, 23 nt, Human
cccagcccuggccugagcugagc

SEQ ID NO: 185046 - RNA, 18 nt, Human
ccccugcagagggguggc

SEQ ID NO: 185047 - RNA, 23 nt, Human
ccuaaacagucugcgcucggccu

SEQ ID NO: 185048 - RNA, 23 nt, Human
cgauggauccccuuugucaguuc

SEQ ID NO: 185049 - RNA, 24 nt, Human
cuggggagguggcuggggaaaggg

SEQ ID NO: 185050 - RNA, 21 nt, Human
cuugcuggggagguggcuggg

SEQ ID NO: 185051 - RNA, 19 nt, Human
cuuucugcugagccucgcc

SEQ ID NO: 185052 - RNA, 27 nt, Human
gaggcaggugcacagccccccaagggg

SEQ ID NO: 185053 - RNA, 22 nt, Human
gcacagcccagcccuggccuga

SEQ ID NO: 185054 - RNA, 18 nt, Human
gcagagggguggccgaug

SEQ ID NO: 185055 - RNA, 25 nt, Human
ggaaagaaaggccuccauuguucag

SEQ ID NO: 185056 - RNA, 20 nt, Human
ggaaggaggcugggagccua

SEQ ID NO: 185057 - RNA, 18 nt, Human
ggaggaagugggucuggg

SEQ ID NO: 185058 - RNA, 21 nt, Human
ggcaucugcugagauuucagg

SEQ ID NO: 185059 - RNA, 22 nt, Human
ggccugggagccugucaaagag

SEQ ID NO: 185060 - RNA, 24 nt, Human
gggaaagaaaggccuccauuguuc

SEQ ID NO: 185061 - RNA, 20 nt, Human
gggaaggaggcugggagccu

SEQ ID NO: 185062 - RNA, 18 nt, Human
ggggagguggcuggggaa

SEQ ID NO: 185063 - RNA, 19 nt, Human
gggucugggucagugggag

SEQ ID NO: 185064 - RNA, 24 nt, Human
gguccgggaggaagggacaggggu

SEQ ID NO: 185065 - RNA, 20 nt, Human
guagcgggaaggaggcuggg

SEQ ID NO: 185066 - RNA, 22 nt, Human
uccccaccaggacucccagguc

SEQ ID NO: 185067 - RNA, 24 nt, Human
ucccgugacugcacaugcuugucc

SEQ ID NO: 185068 - RNA, 20 nt, Human
uccgcuggcaaccagccuga

SEQ ID NO: 185069 - RNA, 21 nt, Human
ucucucccugccacagaugaa

SEQ ID NO: 185070 - RNA, 18 nt, Human
uggccugagcugagcucc

SEQ ID NO: 185071 - RNA, 21 nt, Human
uggccugugucucuucaacuc

SEQ ID NO: 185072 - RNA, 22 nt, Human
ugggcaucugcugagauuucag

SEQ ID NO: 185073 - RNA, 25 nt, Human
ugucaaagagcucuggggguugcag

SEQ ID NO: 185074 - RNA, 22 nt, Human
uucagguugcuugcuggggagg

SEQ ID NO: 185075 - RNA, 22 nt, Human
uucugggucauuugcagccugc

SEQ ID NO: 185076 - RNA, 22 nt, Human
uugcagccugccuucagggucu

SEQ ID NO: 185077 - RNA, 24 nt, Human
uuguccaggacugggaggccuggg

SEQ ID NO: 185078 - RNA, 18 nt, Human
aagagaaaagggacuuga

SEQ ID NO: 185079 - RNA, 20 nt, Human
aagagaaaagggacuugaua

SEQ ID NO: 185080 - RNA, 21 nt, Human
cacuuccacuucugucgaagg

SEQ ID NO: 185081 - RNA, 19 nt, Human
cagaauauccauugacgcc

SEQ ID NO: 185082 - RNA, 21 nt, Human
gagaaaagggacuugauagua

SEQ ID NO: 185083 - RNA, 22 nt, Human
uaaaauagcucuuucuggaaac

SEQ ID NO: 185084 - RNA, 18 nt, Human
uaaaaugaagauaaugaa

SEQ ID NO: 185085 - RNA, 23 nt, Human
uacagaauauccauugacgccag

SEQ ID NO: 185086 - RNA, 19 nt, Human
ugcuucuguuaaaauagcu

SEQ ID NO: 185087 - RNA, 20 nt, Human
ugggcugacuuuaauugcug

SEQ ID NO: 185088 - RNA, 21 nt, Human
uguccaucaaaagucugugug

SEQ ID NO: 185089 - RNA, 24 nt, Human
uuaaaaugaagauaaugaauuuau

SEQ ID NO: 185090 - RNA, 21 nt, Human
uucagcacuuccacuucuguc

SEQ ID NO: 185091 - RNA, 23 nt, Human
uuuauuuuuucaagagaaaaggg

SEQ ID NO: 185092 - RNA, 23 nt, Human
auaacaauugaaagaaugagaac

SEQ ID NO: 185093 - RNA, 22 nt, Human
caguaaacaaaugaaugcauuu

SEQ ID NO: 185094 - RNA, 22 nt, Human
cauaacaauugaaagaaugaga

SEQ ID NO: 185095 - RNA, 23 nt, Human
ucccuuggaaaguugagugaaaa

SEQ ID NO: 185096 - RNA, 21 nt, Human
uggaaaguugagugaaaacaa

SEQ ID NO: 185097 - RNA, 25 nt, Human
aggucccugccucuuucucaguguu

SEQ ID NO: 185098 - RNA, 27 nt, Human
caccuacuccccuuucccacgacccuc

SEQ ID NO: 185099 - RNA, 22 nt, Human
cacgacccucagccugcccccu

SEQ ID NO: 185100 - RNA, 24 nt, Human
cccccaccuacuccccuuucccac

SEQ ID NO: 185101 - RNA, 21 nt, Human
ccucagccugcccccuccucu

SEQ ID NO: 185102 - RNA, 23 nt, Human
ccugccucuuucucaguguuccc

SEQ ID NO: 185103 - RNA, 24 nt, Human
gcaaggcacagagguagucccuuu

SEQ ID NO: 185104 - RNA, 27 nt, Human
gcacagagguagucccuuuaggucccu

SEQ ID NO: 185105 - RNA, 18 nt, Human
gcccccuccucuagauuc

SEQ ID NO: 185106 - RNA, 20 nt, Human
uacuccccuuucccacgacc

SEQ ID NO: 185107 - RNA, 24 nt, Human
ucaguguucccccaccuacucccc

SEQ ID NO: 185108 - RNA, 21 nt, Human
ucccccaccuacuccccuuuc

SEQ ID NO: 185109 - RNA, 23 nt, Human
uuucucaguguucccccaccuac

SEQ ID NO: 185110 - RNA, 24 nt, Human
aaaaauuauaggagaaaccgguac

SEQ ID NO: 185111 - RNA, 20 nt, Human
aaauaucauuggaauagaaa

SEQ ID NO: 185112 - RNA, 19 nt, Human
aacaaaacagcaauaaaaa

SEQ ID NO: 185113 - RNA, 22 nt, Human
aauaaaaacucuacaguauacc

SEQ ID NO: 185114 - RNA, 26 nt, Human
aauuuuuuaaaaaucccugaauuugu

SEQ ID NO: 185115 - RNA, 27 nt, Human
acagcaauaaaaacucuacaguauacc

SEQ ID NO: 185116 - RNA, 24 nt, Human
agaaaccauaucuggaccugaaca

SEQ ID NO: 185117 - RNA, 22 nt, Human
agacucugggcugccgcagcuu

SEQ ID NO: 185118 - RNA, 25 nt, Human
agacucugggcugccgcagcuuuuu

SEQ ID NO: 185119 - RNA, 18 nt, Human
agagaaugugcugaugcc

SEQ ID NO: 185120 - RNA, 22 nt, Human
agccccuuucuggcugugcugu

SEQ ID NO: 185121 - RNA, 24 nt, Human
aggaggccugcuggcugcaggggu

SEQ ID NO: 185122 - RNA, 18 nt, Human
auccauuuuuuuuuuuuu

SEQ ID NO: 185123 - RNA, 20 nt, Human
aucucuacuccucccuccaa

SEQ ID NO: 185124 - RNA, 22 nt, Human
caaaaaaauaaaauaaaacuag

SEQ ID NO: 185125 - RNA, 24 nt, Human
caaaugccacuagccaccuggaua

SEQ ID NO: 185126 - RNA, 18 nt, Human
cacacuccuccagaaauc

SEQ ID NO: 185127 - RNA, 19 nt, Human
ccaauguuaaaaauuugac

SEQ ID NO: 185128 - RNA, 23 nt, Human
cccaaccuaauuaccaaauauca

SEQ ID NO: 185129 - RNA, 18 nt, Human
ccccuuucuggcugugcu

SEQ ID NO: 185130 - RNA, 18 nt, Human
cccuuuguuaacgacucc

SEQ ID NO: 185131 - RNA, 21 nt, Human
ccgguaggaaauauuuuccuc

SEQ ID NO: 185132 - RNA, 24 nt, Human
ccucccuccaaaaaggauuaauuc

SEQ ID NO: 185133 - RNA, 21 nt, Human
gaacaaaacagcaauaaaaac

SEQ ID NO: 185134 - RNA, 19 nt, Human
gacucugggcugccgcagc

SEQ ID NO: 185135 - RNA, 21 nt, Human
gagugugcuagaugagagaau

SEQ ID NO: 185136 - RNA, 26 nt, Human
gaguuuggcaauccaucuugguuguu

SEQ ID NO: 185137 - RNA, 24 nt, Human
gauaacgugacauuuuaagaaaaa

SEQ ID NO: 185138 - RNA, 24 nt, Human
ggaaagguuagcccagccuaaagu

SEQ ID NO: 185139 - RNA, 19 nt, Human
ggacuuuuuuuucaggagg

SEQ ID NO: 185140 - RNA, 18 nt, Human
ggcaauccaucuugguug

SEQ ID NO: 185141 - RNA, 20 nt, Human
uaaaguagcagacucugggc

SEQ ID NO: 185142 - RNA, 24 nt, Human
uaaaugugagcuuauuuacauuua

SEQ ID NO: 185143 - RNA, 22 nt, Human
uaaccaaugaguuuccuggagg

SEQ ID NO: 185144 - RNA, 18 nt, Human
uacaguauaccuucaaac

SEQ ID NO: 185145 - RNA, 18 nt, Human
uagaugagagaaugugcu

SEQ ID NO: 185146 - RNA, 25 nt, Human
uagcagcuuucuggcuuugaaguuu

SEQ ID NO: 185147 - RNA, 22 nt, Human
uauaggagaaaccauaucugga

SEQ ID NO: 185148 - RNA, 18 nt, Human
ucaggaggccugcuggcu

SEQ ID NO: 185149 - RNA, 22 nt, Human
uccagaaaucugucuuccccaa

SEQ ID NO: 185150 - RNA, 20 nt, Human
uccaggggcacaaauucagc

SEQ ID NO: 185151 - RNA, 22 nt, Human
uccuguuaauuuucuuuuucuu

SEQ ID NO: 185152 - RNA, 18 nt, Human
ucuacuccucccuccaaa

SEQ ID NO: 185153 - RNA, 28 nt, Human
ucucuauauuaucaaaugccacuagcca

SEQ ID NO: 185154 - RNA, 19 nt, Human
uggaauaaccaaugaguuu

SEQ ID NO: 185155 - RNA, 22 nt, Human
ugugcuaaaauaaacucaauga

SEQ ID NO: 185156 - RNA, 23 nt, Human
uuacugaacaaaacagcaauaaa

SEQ ID NO: 185157 - RNA, 22 nt, Human
uuagauuugaccuauaauuacu

SEQ ID NO: 185158 - RNA, 24 nt, Human
uucaccacucugacacuauggacc

SEQ ID NO: 185159 - RNA, 18 nt, Human
uugcuccugaccugggca

SEQ ID NO: 185160 - RNA, 22 nt, Human
uuucagguuauauaucucuacu

SEQ ID NO: 185161 - RNA, 25 nt, Human
uuugcuccugaccugggcacaaaug

SEQ ID NO: 185162 - RNA, 27 nt, Human
uuuuuauccauuuuuuuuuuuuuuuuu

SEQ ID NO: 185163 - RNA, 22 nt, Human
uuuuuuuucaauuugcuccuga

SEQ ID NO: 185164 - RNA, 19 nt, Human
uuuuuuuuuuuuacaggga

SEQ ID NO: 185165 - RNA, 21 nt, Human
uuuuuuuuuuuuuuuuacagg

SEQ ID NO: 185166 - RNA, 25 nt, Human
uuuuuuuuuuuuuuuuuuacagggg

SEQ ID NO: 185167 - RNA, 21 nt, Human
aagcagccccagggugaccag

SEQ ID NO: 185168 - RNA, 26 nt, Human
acaguggccucuccguguggcuuucc

SEQ ID NO: 185169 - RNA, 19 nt, Human
accagcaccuugcaucucc

SEQ ID NO: 185170 - RNA, 18 nt, Human
acccugcggggcgagcgc

SEQ ID NO: 185171 - RNA, 20 nt, Human
accgugggcacagaggacac

SEQ ID NO: 185172 - RNA, 25 nt, Human
agaaagaagcgugauucuccuugaa

SEQ ID NO: 185173 - RNA, 23 nt, Human
agcggcaggcaggguuggcgggg

SEQ ID NO: 185174 - RNA, 19 nt, Human
agcucccgagucacacccu

SEQ ID NO: 185175 - RNA, 24 nt, Human
aggagccagaagccacaucugacc

SEQ ID NO: 185176 - RNA, 18 nt, Human
aggcaggguuggcgggga

SEQ ID NO: 185177 - RNA, 25 nt, Human
aggcaggugcagcggcaggcagggu

SEQ ID NO: 185178 - RNA, 18 nt, Human
augacguggccgugccuu

SEQ ID NO: 185179 - RNA, 19 nt, Human
cacagaggacacaccgcga

SEQ ID NO: 185180 - RNA, 20 nt, Human
caccccggagcagacggcgg

SEQ ID NO: 185181 - RNA, 19 nt, Human
caccgcaguuguccccagc

SEQ ID NO: 185182 - RNA, 25 nt, Human
caccgcgacguccagcucagaccca

SEQ ID NO: 185183 - RNA, 21 nt, Human
cagacaggaaacuccccagga

SEQ ID NO: 185184 - RNA, 20 nt, Human
cagcaccuugcaucuccagc

SEQ ID NO: 185185 - RNA, 21 nt, Human
cagcaccuugcaucuccagcg

SEQ ID NO: 185186 - RNA, 19 nt, Human
cagcauguuuuccuucucc

SEQ ID NO: 185187 - RNA, 20 nt, Human
cagcauguuuuccuucuccu

SEQ ID NO: 185188 - RNA, 21 nt, Human
cagcgaaucucacuccuacuu

SEQ ID NO: 185189 - RNA, 18 nt, Human
cagcucagacccaccagc

SEQ ID NO: 185190 - RNA, 22 nt, Human
cagcucccgagucacacccugg

SEQ ID NO: 185191 - RNA, 20 nt, Human
caggaggagcaccuguggug

SEQ ID NO: 185192 - RNA, 22 nt, Human
caggcaccgccagccccggcuc

SEQ ID NO: 185193 - RNA, 24 nt, Human
caggccgaagggguccucaggcac

SEQ ID NO: 185194 - RNA, 24 nt, Human
caggugcagcggcaggcaggguug

SEQ ID NO: 185195 - RNA, 20 nt, Human
caguccacaugagugcaauu

SEQ ID NO: 185196 - RNA, 22 nt, Human
caguggccucuccguguggcuu

SEQ ID NO: 185197 - RNA, 18 nt, Human
caguucccccacgguggc

SEQ ID NO: 185198 - RNA, 27 nt, Human
ccagaagccacaucugaccgcaguuua

SEQ ID NO: 185199 - RNA, 22 nt, Human
ccagccucaucagcuuuucuua

SEQ ID NO: 185200 - RNA, 23 nt, Human
ccaggaggagcaccugugguggu

SEQ ID NO: 185201 - RNA, 19 nt, Human
ccaggcaagcgugacccuc

SEQ ID NO: 185202 - RNA, 24 nt, Human
ccaguccacaugagugcaauugcc

SEQ ID NO: 185203 - RNA, 22 nt, Human
ccauccuggaagauggaggacg

SEQ ID NO: 185204 - RNA, 19 nt, Human
cccacacggcagcucgcac

SEQ ID NO: 185205 - RNA, 23 nt, Human
ccccaccagggccgccucuccug

SEQ ID NO: 185206 - RNA, 21 nt, Human
ccccacgguggcagauuugcu

SEQ ID NO: 185207 - RNA, 20 nt, Human
ccccaugagggcagagcgag

SEQ ID NO: 185208 - RNA, 20 nt, Human
ccccgaggagccagaagcca

SEQ ID NO: 185209 - RNA, 21 nt, Human
cccuggcugggccuaugcggc

SEQ ID NO: 185210 - RNA, 22 nt, Human
ccucaugcggggcggccacuuc

SEQ ID NO: 185211 - RNA, 21 nt, Human
ccuggcacccgacuaacccac

SEQ ID NO: 185212 - RNA, 23 nt, Human
cgaaucucacuccuacuucuagg

SEQ ID NO: 185213 - RNA, 18 nt, Human
cgcugcugcuccucgugg

SEQ ID NO: 185214 - RNA, 20 nt, Human
cggagaauaaaccucccucc

SEQ ID NO: 185215 - RNA, 22 nt, Human
cguccagcucagacccaccagc

SEQ ID NO: 185216 - RNA, 21 nt, Human
cgugacccucgcgaggccccg

SEQ ID NO: 185217 - RNA, 23 nt, Human
cuccagcgucaguucccccacgg

SEQ ID NO: 185218 - RNA, 22 nt, Human
cugcugcuccucgugggccugg

SEQ ID NO: 185219 - RNA, 21 nt, Human
cuggcacccgacuaacccaca

SEQ ID NO: 185220 - RNA, 21 nt, Human
cuugaagugagccuggcauuu

SEQ ID NO: 185221 - RNA, 19 nt, Human
gaagauggaggacgcucag

SEQ ID NO: 185222 - RNA, 21 nt, Human
gagcagcauguuuuccuucuc

SEQ ID NO: 185223 - RNA, 25 nt, Human
gagcgcuuugggauuguagcaauuc

SEQ ID NO: 185224 - RNA, 24 nt, Human
gagcugggugacaggcuggucacc

SEQ ID NO: 185225 - RNA, 23 nt, Human
gaggagcugggugacaggcuggu

SEQ ID NO: 185226 - RNA, 22 nt, Human
gcaggcggagaauaaaccuccc

SEQ ID NO: 185227 - RNA, 23 nt, Human
gccucuuccccaccagggccgcc

SEQ ID NO: 185228 - RNA, 19 nt, Human
gcucagacccaccagcacc

SEQ ID NO: 185229 - RNA, 24 nt, Human
ggaggacgcucaggcgugcaccag

SEQ ID NO: 185230 - RNA, 21 nt, Human
ggaggcgagggcccuccgcgu

SEQ ID NO: 185231 - RNA, 18 nt, Human
ggggaggagcugggugac

SEQ ID NO: 185232 - RNA, 19 nt, Human
ggggaggagcugggugaca

SEQ ID NO: 185233 - RNA, 18 nt, Human
ggguccucaggcaccgcc

SEQ ID NO: 185234 - RNA, 23 nt, Human
ggguuggcggggaggagcugggu

SEQ ID NO: 185235 - RNA, 18 nt, Human
gucaccgcuggccuuugg

SEQ ID NO: 185236 - RNA, 24 nt, Human
gugcagcggcaggcaggguuggcg

SEQ ID NO: 185237 - RNA, 19 nt, Human
guuccuguguaacugaggc

SEQ ID NO: 185238 - RNA, 20 nt, Human
guuggcggggaggagcuggg

SEQ ID NO: 185239 - RNA, 20 nt, Human
uaacccacacggcagcucgc

SEQ ID NO: 185240 - RNA, 23 nt, Human
uaacugaggcgcuucacccacag

SEQ ID NO: 185241 - RNA, 22 nt, Human
uaagcagccccagggugaccag

SEQ ID NO: 185242 - RNA, 21 nt, Human
uagaaagaagcgugauucucc

SEQ ID NO: 185243 - RNA, 23 nt, Human
uagaaagaagcgugauucuccuu

SEQ ID NO: 185244 - RNA, 20 nt, Human
uagcucagaccgugggcaca

SEQ ID NO: 185245 - RNA, 25 nt, Human
uauuucauuguccuggcacccgacu

SEQ ID NO: 185246 - RNA, 22 nt, Human
ucaccagccucaucagcuuuuc

SEQ ID NO: 185247 - RNA, 19 nt, Human
ucaccgcaguuguccccag

SEQ ID NO: 185248 - RNA, 23 nt, Human
ucaccgcaguuguccccagcugu

SEQ ID NO: 185249 - RNA, 18 nt, Human
ucaccgcaguuguccccg

SEQ ID NO: 185250 - RNA, 21 nt, Human
uccagcgucaguucccccacg

SEQ ID NO: 185251 - RNA, 22 nt, Human
ucccuccccggacucucggggc

SEQ ID NO: 185252 - RNA, 21 nt, Human
uccgagugcgcccccuacugg

SEQ ID NO: 185253 - RNA, 19 nt, Human
uccguggaggcgagggccc

SEQ ID NO: 185254 - RNA, 21 nt, Human
uccucagaagggaacuucagc

SEQ ID NO: 185255 - RNA, 20 nt, Human
ucuccaggcggagggguggg

SEQ ID NO: 185256 - RNA, 18 nt, Human
ucugaccgcaguuuagag

SEQ ID NO: 185257 - RNA, 18 nt, Human
ugacaaaggcugaacguc

SEQ ID NO: 185258 - RNA, 19 nt, Human
ugacaaaggcugaacguca

SEQ ID NO: 185259 - RNA, 18 nt, Human
ugagggcagagcgaggcc

SEQ ID NO: 185260 - RNA, 19 nt, Human
ugagggcagagcgaggccc

SEQ ID NO: 185261 - RNA, 22 nt, Human
ugcagcggcaggcaggguuggc

SEQ ID NO: 185262 - RNA, 21 nt, Human
uggccuuuggacccugcgggg

SEQ ID NO: 185263 - RNA, 18 nt, Human
uggcggggaggagcuggg

SEQ ID NO: 185264 - RNA, 21 nt, Human
ugggaagaacagaugcuccuc

SEQ ID NO: 185265 - RNA, 23 nt, Human
uggguuggguuuguuaacugcag

SEQ ID NO: 185266 - RNA, 23 nt, Human
ugucaacaagcagugacugaacc

SEQ ID NO: 185267 - RNA, 22 nt, Human
uguguccacccaggugugugca

SEQ ID NO: 185268 - RNA, 18 nt, Human
ugugugaagagugcaagg

SEQ ID NO: 185269 - RNA, 19 nt, Human
uucaagauuugccgaaagg

SEQ ID NO: 185270 - RNA, 21 nt, Human
uuggacccugcggggcgagcg

SEQ ID NO: 185271 - RNA, 23 nt, Human
uuuuuacaucaucaccgcaguug

SEQ ID NO: 185272 - RNA, 18 nt, Human
aagcaaaugaaauaucac

SEQ ID NO: 185273 - RNA, 22 nt, Human
aauacaguggcaaauuauacaa

SEQ ID NO: 185274 - RNA, 20 nt, Human
ccccaagcuucccuagacac

SEQ ID NO: 185275 - RNA, 18 nt, Human
cuucaaagaauuaagagg

SEQ ID NO: 185276 - RNA, 23 nt, Human
guaaaaggagcagaaccccaagc

SEQ ID NO: 185277 - RNA, 27 nt, Human
uaaaaauguauuuugaaaagauuuuac

SEQ ID NO: 185278 - RNA, 19 nt, Human
uacaguuaagcaaaugaaa

SEQ ID NO: 185279 - RNA, 21 nt, Human
uagacacugagacucgucuug

SEQ ID NO: 185280 - RNA, 26 nt, Human
ucccuagacacugagacucgucuugg

SEQ ID NO: 185281 - RNA, 23 nt, Human
uugaaaagauuuuacauacagau

SEQ ID NO: 185282 - RNA, 24 nt, Human
uugguaauagucgcaaccuuucac

SEQ ID NO: 185283 - RNA, 25 nt, Human
uuuuuuuuuuuuuuuuuuuauuuuu

SEQ ID NO: 185284 - RNA, 28 nt, Human
aaacaggaaggaggugaguaaggucuag

SEQ ID NO: 185285 - RNA, 24 nt, Human
aaagcaacagagauaaguaagguc

SEQ ID NO: 185286 - RNA, 20 nt, Human
aacacagugagacccugucu

SEQ ID NO: 185287 - RNA, 21 nt, Human
aacacagugagacccugucuc

SEQ ID NO: 185288 - RNA, 21 nt, Human
aaggaggugaguaaggucuag

SEQ ID NO: 185289 - RNA, 19 nt, Human
aaggagguuauguauggag

SEQ ID NO: 185290 - RNA, 19 nt, Human
aauaaauacccuuucuucu

SEQ ID NO: 185291 - RNA, 18 nt, Human
aauuagccaggcauggug

SEQ ID NO: 185292 - RNA, 20 nt, Human
acccagcacagugcccuaca

SEQ ID NO: 185293 - RNA, 23 nt, Human
accuucuucccaaaccuucuggc

SEQ ID NO: 185294 - RNA, 22 nt, Human
acuacugcacuccagccugggc

SEQ ID NO: 185295 - RNA, 25 nt, Human
acuacugcacuccagccugggcaac

SEQ ID NO: 185296 - RNA, 18 nt, Human
acugcacuccagccuggg

SEQ ID NO: 185297 - RNA, 19 nt, Human
acugcacuccagccugggc

SEQ ID NO: 185298 - RNA, 20 nt, Human
acugcacuccagccugggca

SEQ ID NO: 185299 - RNA, 21 nt, Human
acugcacuccagccugggcaa

SEQ ID NO: 185300 - RNA, 22 nt, Human
acugcacuccagccugggcaac

SEQ ID NO: 185301 - RNA, 23 nt, Human
acugcacuccagccugggcaaca

SEQ ID NO: 185302 - RNA, 25 nt, Human
acugcacuccagccugggcaacaac

SEQ ID NO: 185303 - RNA, 21 nt, Human
agaaggagaugguuugcaggg

SEQ ID NO: 185304 - RNA, 19 nt, Human
agaccaggagagaagggac

SEQ ID NO: 185305 - RNA, 19 nt, Human
agagauaaguaaggucacc

SEQ ID NO: 185306 - RNA, 22 nt, Human
agcacuuugggaggccaaggca

SEQ ID NO: 185307 - RNA, 21 nt, Human
agccaggcaugguggcucaca

SEQ ID NO: 185308 - RNA, 24 nt, Human
agccugggaaacauagugagacuc

SEQ ID NO: 185309 - RNA, 22 nt, Human
agccugggcaacacagugagac

SEQ ID NO: 185310 - RNA, 24 nt, Human
agccugggcaacacagugagaccc

SEQ ID NO: 185311 - RNA, 19 nt, Human
aggaaggaggugaguaagg

SEQ ID NO: 185312 - RNA, 20 nt, Human
aggaaggaggugaguaaggu

SEQ ID NO: 185313 - RNA, 21 nt, Human
aggaaggaggugaguaagguc

SEQ ID NO: 185314 - RNA, 23 nt, Human
aggcaggaggaucucuugagccc

SEQ ID NO: 185315 - RNA, 24 nt, Human
aggcaggaggaucucuugagccca

SEQ ID NO: 185316 - RNA, 24 nt, Human
aggcaugguggcucacauuugugg

SEQ ID NO: 185317 - RNA, 18 nt, Human
agggaaaaguuggaggag

SEQ ID NO: 185318 - RNA, 19 nt, Human
agggaagagaugagguugg

SEQ ID NO: 185319 - RNA, 21 nt, Human
aggggcuuugcaaacauaaug

SEQ ID NO: 185320 - RNA, 18 nt, Human
aggucuagaucagaggua

SEQ ID NO: 185321 - RNA, 19 nt, Human
agguggaggcugcagugag

SEQ ID NO: 185322 - RNA, 22 nt, Human
agguggaggcugcagugagcca

SEQ ID NO: 185323 - RNA, 22 nt, Human
aucugagcacuuugggaggcca

SEQ ID NO: 185324 - RNA, 23 nt, Human
auggggcccccugagccccuucc

SEQ ID NO: 185325 - RNA, 22 nt, Human
caacacagugagacccugucuc

SEQ ID NO: 185326 - RNA, 18 nt, Human
caagaaauacaugagaaa

SEQ ID NO: 185327 - RNA, 23 nt, Human
caaucgccaaacugugaugggau

SEQ ID NO: 185328 - RNA, 23 nt, Human
cacaagaaauacaugagaaagug

SEQ ID NO: 185329 - RNA, 19 nt, Human
cacaccuucuucccaaacc

SEQ ID NO: 185330 - RNA, 21 nt, Human
cacagacuuuuauccacuugu

SEQ ID NO: 185331 - RNA, 24 nt, Human
cacaucucuaaucugagcacuuug

SEQ ID NO: 185332 - RNA, 24 nt, Human
caccaaccucacucuuccuaaguu

SEQ ID NO: 185333 - RNA, 23 nt, Human
caccagaccaggagagaagggac

SEQ ID NO: 185334 - RNA, 21 nt, Human
caccuucuucccaaaccuucu

SEQ ID NO: 185335 - RNA, 20 nt, Human
caggagguggaggcugcagu

SEQ ID NO: 185336 - RNA, 19 nt, Human
cauacaauuugcauacacc

SEQ ID NO: 185337 - RNA, 23 nt, Human
cauccucagucuugacuuggaga

SEQ ID NO: 185338 - RNA, 21 nt, Human
caucuccuccuucaggaggcc

SEQ ID NO: 185339 - RNA, 25 nt, Human
caucuccuccuucaggaggcccucc

SEQ ID NO: 185340 - RNA, 23 nt, Human
cauuuguggucccagcuacucgg

SEQ ID NO: 185341 - RNA, 24 nt, Human
cauuuguggucccagcuacucggg

SEQ ID NO: 185342 - RNA, 21 nt, Human
ccagcacagugcccuacauaa

SEQ ID NO: 185343 - RNA, 26 nt, Human
cccacaccuucuucccaaaccuucug

SEQ ID NO: 185344 - RNA, 19 nt, Human
cccagaaagcaacagagau

SEQ ID NO: 185345 - RNA, 23 nt, Human
ccccagaaagcaacagagauaag

SEQ ID NO: 185346 - RNA, 19 nt, Human
ccccagccccacccagcac

SEQ ID NO: 185347 - RNA, 21 nt, Human
ccccugagccccuuccuugga

SEQ ID NO: 185348 - RNA, 24 nt, Human
ccccugagccccuuccuuggaggc

SEQ ID NO: 185349 - RNA, 21 nt, Human
cccuccacaaucgccaaacug

SEQ ID NO: 185350 - RNA, 22 nt, Human
ccugggcaacacagugagaccc

SEQ ID NO: 185351 - RNA, 18 nt, Human
ccuggugggggcugaggg

SEQ ID NO: 185352 - RNA, 20 nt, Human
ccugugaaggcaaggccagg

SEQ ID NO: 185353 - RNA, 20 nt, Human
ccuucaggaggcccuccaca

SEQ ID NO: 185354 - RNA, 21 nt, Human
cgcugacugcagugccugcgc

SEQ ID NO: 185355 - RNA, 22 nt, Human
cggcuucuggggcgcuuccccu

SEQ ID NO: 185356 - RNA, 20 nt, Human
cuacugcacuccagccuggg

SEQ ID NO: 185357 - RNA, 21 nt, Human
cuacugcacuccagccugggc

SEQ ID NO: 185358 - RNA, 22 nt, Human
cugcagugagccacgacugcac

SEQ ID NO: 185359 - RNA, 20 nt, Human
cugcagugccugcgcgcggc

SEQ ID NO: 185360 - RNA, 18 nt, Human
cugcauuucuccuuccac

SEQ ID NO: 185361 - RNA, 19 nt, Human
cuggcccacgggggcugug

SEQ ID NO: 185362 - RNA, 21 nt, Human
cugggcugggcugggaagggc

SEQ ID NO: 185363 - RNA, 22 nt, Human
gaagguucuggaaaaggaggug

SEQ ID NO: 185364 - RNA, 20 nt, Human
gacacagcgcaguuagggag

SEQ ID NO: 185365 - RNA, 21 nt, Human
gacugugggaugagaggggaa

SEQ ID NO: 185366 - RNA, 23 nt, Human
gacuuuuauccacuuguuggaaa

SEQ ID NO: 185367 - RNA, 23 nt, Human
gagaaggagaugguuugcagggc

SEQ ID NO: 185368 - RNA, 19 nt, Human
gagaagggacugugggaug

SEQ ID NO: 185369 - RNA, 24 nt, Human
gagcacuuugggaggccaaggcag

SEQ ID NO: 185370 - RNA, 25 nt, Human
gagcacuuugggaggccaaggcagg

SEQ ID NO: 185371 - RNA, 19 nt, Human
gaggaucucuugagcccag

SEQ ID NO: 185372 - RNA, 21 nt, Human
gagguuauguauggagucagu

SEQ ID NO: 185373 - RNA, 18 nt, Human
gcaggggagggacuccag

SEQ ID NO: 185374 - RNA, 31 nt, Human
gccacgacugcacuacugcacuccagccugg

SEQ ID NO: 185375 - RNA, 24 nt, Human
gcccaggagguggaggcugcagug

SEQ ID NO: 185376 - RNA, 22 nt, Human
gcccaggaguucaagaucagcc

SEQ ID NO: 185377 - RNA, 20 nt, Human
gcgggggaauguucuagaag

SEQ ID NO: 185378 - RNA, 24 nt, Human
gcuggagagcccaggagguggagg

SEQ ID NO: 185379 - RNA, 22 nt, Human
ggaaaaguuggaggagggaugg

SEQ ID NO: 185380 - RNA, 22 nt, Human
ggagcgggaggccauggggccc

SEQ ID NO: 185381 - RNA, 22 nt, Human
ggaggcccuccacaaucgccaa

SEQ ID NO: 185382 - RNA, 18 nt, Human
ggaggcugcagugagcca

SEQ ID NO: 185383 - RNA, 18 nt, Human
ggaggcugcagugagcca

SEQ ID NO: 185384 - RNA, 21 nt, Human
ggcaggggagggacuccagac

SEQ ID NO: 185385 - RNA, 20 nt, Human
ggcugcagugagccacgacu

SEQ ID NO: 185386 - RNA, 18 nt, Human
gggaagggcagagcuuga

SEQ ID NO: 185387 - RNA, 21 nt, Human
gggaugagaggggaaaacugg

SEQ ID NO: 185388 - RNA, 21 nt, Human
ggggaacauggugggaugugg

SEQ ID NO: 185389 - RNA, 18 nt, Human
ggguaggcugggcugggc

SEQ ID NO: 185390 - RNA, 22 nt, Human
gucuggcacaggguggacaaag

SEQ ID NO: 185391 - RNA, 23 nt, Human
guggcucacauuuguggucccag

SEQ ID NO: 185392 - RNA, 24 nt, Human
guggcucacauuuguggucccagc

SEQ ID NO: 185393 - RNA, 21 nt, Human
gugggauguggucuacaggga

SEQ ID NO: 185394 - RNA, 20 nt, Human
gugggggcugagggauuggg

SEQ ID NO: 185395 - RNA, 23 nt, Human
gugucaacgagggaguauggggg

SEQ ID NO: 185396 - RNA, 23 nt, Human
guucuggaaaaggaggugucugg

SEQ ID NO: 185397 - RNA, 20 nt, Human
uacaccagaccaggagagaa

SEQ ID NO: 185398 - RNA, 20 nt, Human
uacugcacuccagccugggc

SEQ ID NO: 185399 - RNA, 22 nt, Human
uacugcacuccagccugggcaa

SEQ ID NO: 185400 - RNA, 23 nt, Human
uacugcacuccagccugggcaac

SEQ ID NO: 185401 - RNA, 24 nt, Human
uacugcacuccagccugggcaaca

SEQ ID NO: 185402 - RNA, 20 nt, Human
uacugcacuccagccugggg

SEQ ID NO: 185403 - RNA, 21 nt, Human
uagccauauugaaguaauaau

SEQ ID NO: 185404 - RNA, 23 nt, Human
uaggaccccagaaagcaacagag

SEQ ID NO: 185405 - RNA, 18 nt, Human
uauuugucuuuauuuucu

SEQ ID NO: 185406 - RNA, 24 nt, Human
uccagccugggcaacacagugaga

SEQ ID NO: 185407 - RNA, 22 nt, Human
ucccacaccuucuucccaaacc

SEQ ID NO: 185408 - RNA, 25 nt, Human
uccccagccccacccagcacagugc

SEQ ID NO: 185409 - RNA, 20 nt, Human
uccccggucuugacaacggc

SEQ ID NO: 185410 - RNA, 24 nt, Human
uccgggaguguuuauggaggagac

SEQ ID NO: 185411 - RNA, 24 nt, Human
ucgcugggcaauggugagaaggag

SEQ ID NO: 185412 - RNA, 22 nt, Human
ucuacagggaagagaugagguu

SEQ ID NO: 185413 - RNA, 23 nt, Human
ucucuugagcccaggaguucaag

SEQ ID NO: 185414 - RNA, 24 nt, Human
ucuggccagacauggcggcucaca

SEQ ID NO: 185415 - RNA, 24 nt, Human
ucuugagcccaggaguucaagauc

SEQ ID NO: 185416 - RNA, 21 nt, Human
ucuuguauucuuaugaauauu

SEQ ID NO: 185417 - RNA, 25 nt, Human
ugaagucaguucaccgcugacugca

SEQ ID NO: 185418 - RNA, 20 nt, Human
ugacacaaaaauuggucucc

SEQ ID NO: 185419 - RNA, 21 nt, Human
ugagagggaaaaguuggagga

SEQ ID NO: 185420 - RNA, 23 nt, Human
ugagagggaaaaguuggaggagg

SEQ ID NO: 185421 - RNA, 20 nt, Human
ugagaggggaaaacugggga

SEQ ID NO: 185422 - RNA, 18 nt, Human
ugagauaggacacagcgc

SEQ ID NO: 185423 - RNA, 19 nt, Human
ugagauuaauaaagagguu

SEQ ID NO: 185424 - RNA, 23 nt, Human
ugagcccaggaguucaagaucag

SEQ ID NO: 185425 - RNA, 18 nt, Human
ugagccccuuccuuggag

SEQ ID NO: 185426 - RNA, 20 nt, Human
ugagggauugggaugaaguc

SEQ ID NO: 185427 - RNA, 20 nt, Human
ugaguucugacauucucccu

SEQ ID NO: 185428 - RNA, 22 nt, Human
ugaugggaucugggagcacaaa

SEQ ID NO: 185429 - RNA, 23 nt, Human
ugauugcccuucacuugaguucu

SEQ ID NO: 185430 - RNA, 21 nt, Human
ugcacuacugcacuccagccu

SEQ ID NO: 185431 - RNA, 22 nt, Human
uggaaaccaaauguuugacuua

SEQ ID NO: 185432 - RNA, 21 nt, Human
uggaaaguucaggcaaugugg

SEQ ID NO: 185433 - RNA, 24 nt, Human
uggccagacauggcggcucacauc

SEQ ID NO: 185434 - RNA, 21 nt, Human
uggcucacauuugugguccca

SEQ ID NO: 185435 - RNA, 22 nt, Human
uggcucacauuuguggucccag

SEQ ID NO: 185436 - RNA, 24 nt, Human
uggcucacauuuguggucccagcu

SEQ ID NO: 185437 - RNA, 23 nt, Human
ugggaugaagucaguucaccgcu

SEQ ID NO: 185438 - RNA, 22 nt, Human
ugggaugagaggggaaaacugg

SEQ ID NO: 185439 - RNA, 24 nt, Human
ugggcaacacagugagacccuguc

SEQ ID NO: 185440 - RNA, 22 nt, Human
uggggacggaagggaaauuuca

SEQ ID NO: 185441 - RNA, 22 nt, Human
ugggggcugagggauugggaug

SEQ ID NO: 185442 - RNA, 24 nt, Human
ugggugggagugcuggcauuuccu

SEQ ID NO: 185443 - RNA, 21 nt, Human
uggugagaaggagaugguuug

SEQ ID NO: 185444 - RNA, 24 nt, Human
uggugagaaggagaugguuugcag

SEQ ID NO: 185445 - RNA, 24 nt, Human
ugguggcucacauuugugguccca

SEQ ID NO: 185446 - RNA, 24 nt, Human
ugguuugcagggcaauuaggaagu

SEQ ID NO: 185447 - RNA, 20 nt, Human
ugucccacaccuucuuccca

SEQ ID NO: 185448 - RNA, 20 nt, Human
uguggucccagcuacucggg

SEQ ID NO: 185449 - RNA, 20 nt, Human
uguuggaaaguucaggcaag

SEQ ID NO: 185450 - RNA, 22 nt, Human
uuaucuagaaacuuagaauugc

SEQ ID NO: 185451 - RNA, 21 nt, Human
uucaaggagguuauguaugga

SEQ ID NO: 185452 - RNA, 20 nt, Human
uugcccuucacuugaguucu

SEQ ID NO: 185453 - RNA, 20 nt, Human
uuggguaggcugggcugggc

SEQ ID NO: 185454 - RNA, 21 nt, Human
uuucuacaaaaaguacaaaaa

SEQ ID NO: 185455 - RNA, 24 nt, Human
uuucuucuugucccacaccuucuu

SEQ ID NO: 185456 - RNA, 22 nt, Human
uuugcaaacauaaugacucuau

SEQ ID NO: 185457 - RNA, 19 nt, Human
aaacaagcaaaaugcacca

SEQ ID NO: 185458 - RNA, 19 nt, Human
aaacaagcaaaaugcacca

SEQ ID NO: 185459 - RNA, 25 nt, Human
aaacugaacuccggggagacgcacc

SEQ ID NO: 185460 - RNA, 23 nt, Human
aaauacagacaauagaccaaagu

SEQ ID NO: 185461 - RNA, 18 nt, Human
aacacaggguggcucugc

SEQ ID NO: 185462 - RNA, 20 nt, Human
aacauaauaaacaagcaaaa

SEQ ID NO: 185463 - RNA, 20 nt, Human
aaugaagagggcaggcugga

SEQ ID NO: 185464 - RNA, 21 nt, Human
aaugaagagggcaggcuggaa

SEQ ID NO: 185465 - RNA, 21 nt, Human
acaagcaaaaugcaccacgug

SEQ ID NO: 185466 - RNA, 19 nt, Human
acacagcagucucugaccc

SEQ ID NO: 185467 - RNA, 20 nt, Human
acacagcagucucugacccc

SEQ ID NO: 185468 - RNA, 20 nt, Human
acagaggugggagagggagg

SEQ ID NO: 185469 - RNA, 25 nt, Human
acagcaaaaauauuuauugagugcc

SEQ ID NO: 185470 - RNA, 19 nt, Human
acaggcacaauccuaggca

SEQ ID NO: 185471 - RNA, 25 nt, Human
acauaauaaacaagcaaaaugcacc

SEQ ID NO: 185472 - RNA, 20 nt, Human
acuccacugcccuagagugg

SEQ ID NO: 185473 - RNA, 19 nt, Human
acuccuuccccccuccccc

SEQ ID NO: 185474 - RNA, 19 nt, Human
acuccuuccccccuccccc

SEQ ID NO: 185475 - RNA, 18 nt, Human
agaaaaaacacaggacca

SEQ ID NO: 185476 - RNA, 23 nt, Human
agaaaaaacacaggaccaagauc

SEQ ID NO: 185477 - RNA, 18 nt, Human
agagggcaggcuggaaca

SEQ ID NO: 185478 - RNA, 21 nt, Human
agccagaaugugcucagcugu

SEQ ID NO: 185479 - RNA, 19 nt, Human
agcccuggaggcagucagc

SEQ ID NO: 185480 - RNA, 18 nt, Human
aggcacaucaagguuuga

SEQ ID NO: 185481 - RNA, 18 nt, Human
aggcagcgggcagacaga

SEQ ID NO: 185482 - RNA, 18 nt, Human
aggcagcgggcagacaga

SEQ ID NO: 185483 - RNA, 20 nt, Human
agugcccagagggaucccac

SEQ ID NO: 185484 - RNA, 20 nt, Human
auaaaacuccuuccccccuc

SEQ ID NO: 185485 - RNA, 25 nt, Human
augaguaaagggggaagggaugggg

SEQ ID NO: 185486 - RNA, 18 nt, Human
augccuaggguuagagug

SEQ ID NO: 185487 - RNA, 18 nt, Human
auuucauccaccaagcaa

SEQ ID NO: 185488 - RNA, 24 nt, Human
auuucauccaccaagcaaaauuca

SEQ ID NO: 185489 - RNA, 23 nt, Human
caaaaugcaccacguguccaaug

SEQ ID NO: 185490 - RNA, 24 nt, Human
caaaauucauugacaccaacuuuu

SEQ ID NO: 185491 - RNA, 18 nt, Human
caccaggccgacagggag

SEQ ID NO: 185492 - RNA, 19 nt, Human
caccaggccgacagggagg

SEQ ID NO: 185493 - RNA, 20 nt, Human
cacccuggugauacuuucgc

SEQ ID NO: 185494 - RNA, 19 nt, Human
cacuguucccuuugcucag

SEQ ID NO: 185495 - RNA, 19 nt, Human
cacuuaacaagaccccuag

SEQ ID NO: 185496 - RNA, 18 nt, Human
cagaacaccaggccgaca

SEQ ID NO: 185497 - RNA, 19 nt, Human
cagacaauagaccaaaguc

SEQ ID NO: 185498 - RNA, 21 nt, Human
cagacaauagaccaaaguccc

SEQ ID NO: 185499 - RNA, 20 nt, Human
cagcuguaaagacuggcuaa

SEQ ID NO: 185500 - RNA, 21 nt, Human
caggcuggaacagugcuucuc

SEQ ID NO: 185501 - RNA, 23 nt, Human
caucaucugguaaaacugaacuc

SEQ ID NO: 185502 - RNA, 19 nt, Human
ccacagaacaccaggccga

SEQ ID NO: 185503 - RNA, 22 nt, Human
ccaggccuucagugacccuggc

SEQ ID NO: 185504 - RNA, 23 nt, Human
cccagagggaucccacagaacac

SEQ ID NO: 185505 - RNA, 19 nt, Human
ccccauguggccuggaggc

SEQ ID NO: 185506 - RNA, 18 nt, Human
cccugggcugcagagcuc

SEQ ID NO: 185507 - RNA, 23 nt, Human
ccggcaaauacagacaauagacc

SEQ ID NO: 185508 - RNA, 23 nt, Human
ccuguggucguuagcccugaaac

SEQ ID NO: 185509 - RNA, 18 nt, Human
ccuuuccucucucuucuc

SEQ ID NO: 185510 - RNA, 24 nt, Human
cgcuuuaaaaugcaggugccuggg

SEQ ID NO: 185511 - RNA, 18 nt, Human
cguggggcucugggcaca

SEQ ID NO: 185512 - RNA, 22 nt, Human
cuaugaguaaagggggaaggga

SEQ ID NO: 185513 - RNA, 21 nt, Human
cucaaaccuuuccucucucuu

SEQ ID NO: 185514 - RNA, 18 nt, Human
cucgccugugaaccugcc

SEQ ID NO: 185515 - RNA, 18 nt, Human
cuuucgcgugugagugcc

SEQ ID NO: 185516 - RNA, 19 nt, Human
gacaauagaccaaaguccc

SEQ ID NO: 185517 - RNA, 18 nt, Human
gaccacgccauccccugc

SEQ ID NO: 185518 - RNA, 23 nt, Human
gagcacaggauuccagcccugga

SEQ ID NO: 185519 - RNA, 21 nt, Human
gcaaauacagacaauagacca

SEQ ID NO: 185520 - RNA, 23 nt, Human
gcagaaaaaacacaggaccaaga

SEQ ID NO: 185521 - RNA, 21 nt, Human
gcagcgggcagacagaggugg

SEQ ID NO: 185522 - RNA, 20 nt, Human
ggaugggagggagcaggggc

SEQ ID NO: 185523 - RNA, 25 nt, Human
ggcacagagggagcacaggauucca

SEQ ID NO: 185524 - RNA, 23 nt, Human
ggcagacagaggugggagaggga

SEQ ID NO: 185525 - RNA, 18 nt, Human
ggccuccuggaucagacu

SEQ ID NO: 185526 - RNA, 20 nt, Human
ggcuucucggccugggagcu

SEQ ID NO: 185527 - RNA, 23 nt, Human
ggguuagagugcagacccugugg

SEQ ID NO: 185528 - RNA, 21 nt, Human
ggugcaguggaagugauaggu

SEQ ID NO: 185529 - RNA, 21 nt, Human
gguggaggaaugagacggggu

SEQ ID NO: 185530 - RNA, 21 nt, Human
gugcaguggaagugauagguc

SEQ ID NO: 185531 - RNA, 25 nt, Human
gugcucagcuguaaagacuggggcc

SEQ ID NO: 185532 - RNA, 21 nt, Human
uaaacaagcaaaaugcaccac

SEQ ID NO: 185533 - RNA, 21 nt, Human
uaacgaccgaagacuuuuagu

SEQ ID NO: 185534 - RNA, 21 nt, Human
uaagugcagacucucaguacc

SEQ ID NO: 185535 - RNA, 18 nt, Human
uagcugggcaccucacug

SEQ ID NO: 185536 - RNA, 21 nt, Human
uaugaguaaagggggaaggga

SEQ ID NO: 185537 - RNA, 25 nt, Human
ucacaagguagcaucuuaagucccu

SEQ ID NO: 185538 - RNA, 18 nt, Human
ucacuuaaccucccugag

SEQ ID NO: 185539 - RNA, 22 nt, Human
ucagcaccugcugugggccagg

SEQ ID NO: 185540 - RNA, 28 nt, Human
ucagcaccugcugugggccaggccuuca

SEQ ID NO: 185541 - RNA, 21 nt, Human
ucccacagaacaccaggccga

SEQ ID NO: 185542 - RNA, 19 nt, Human
uccgacuccacugcccuag

SEQ ID NO: 185543 - RNA, 20 nt, Human
uccgacuccacugcccuaga

SEQ ID NO: 185544 - RNA, 22 nt, Human
ugaagagggcaggcuggaacag

SEQ ID NO: 185545 - RNA, 19 nt, Human
ugagcaugugaugccuagg

SEQ ID NO: 185546 - RNA, 22 nt, Human
ugauaggucagaggugcaaguu

SEQ ID NO: 185547 - RNA, 25 nt, Human
ugcaggugccugggucccgccccuc

SEQ ID NO: 185548 - RNA, 24 nt, Human
ugcauacaggcacaauccuaggca

SEQ ID NO: 185549 - RNA, 18 nt, Human
ugcuguagucuuagaguu

SEQ ID NO: 185550 - RNA, 26 nt, Human
ugcuucugccuuggaagcacuuuggg

SEQ ID NO: 185551 - RNA, 22 nt, Human
uggaagcacuuugggcaguggu

SEQ ID NO: 185552 - RNA, 23 nt, Human
uggcuucucggccugggagcuuu

SEQ ID NO: 185553 - RNA, 22 nt, Human
ugggcacagagggagcacagga

SEQ ID NO: 185554 - RNA, 19 nt, Human
uggggcucugggcacagag

SEQ ID NO: 185555 - RNA, 22 nt, Human
uggggcucugggcacagaggga

SEQ ID NO: 185556 - RNA, 21 nt, Human
uuagcccugaaacugggcaag

SEQ ID NO: 185557 - RNA, 21 nt, Human
uucauucugauggagagaaaa

SEQ ID NO: 185558 - RNA, 21 nt, Human
uuccccccucccccaucaucu

SEQ ID NO: 185559 - RNA, 23 nt, Human
uucccuuugcucagcaccugcug

SEQ ID NO: 185560 - RNA, 19 nt, Human
uuccucucucuucuccaaa

SEQ ID NO: 185561 - RNA, 22 nt, Human
uugaucacugcggcaggagucc

SEQ ID NO: 185562 - RNA, 23 nt, Human
gaaauggccgggaaggcuccccc

SEQ ID NO: 185563 - RNA, 21 nt, Human
uccuggaugucuguggaccuc

SEQ ID NO: 185564 - RNA, 23 nt, Human
uccuggaugucuguggaccucug

SEQ ID NO: 185565 - RNA, 18 nt, Human
uggaccucugaccugccc

SEQ ID NO: 185566 - RNA, 20 nt, Human
uggagagacccuuggagcug

SEQ ID NO: 185567 - RNA, 20 nt, Human
uggcugcaucuuccuggaug

SEQ ID NO: 185568 - RNA, 20 nt, Human
aaacacccagacucuggcuc

SEQ ID NO: 185569 - RNA, 24 nt, Human
aagccacauuucccaacuuguguu

SEQ ID NO: 185570 - RNA, 18 nt, Human
aauccagcucacuaagaa

SEQ ID NO: 185571 - RNA, 25 nt, Human
aaugacugaaaacaaauguccagcu

SEQ ID NO: 185572 - RNA, 24 nt, Human
acaacaaagacuauuuacaaugca

SEQ ID NO: 185573 - RNA, 24 nt, Human
accggucucccugucccuggccuc

SEQ ID NO: 185574 - RNA, 20 nt, Human
acugcaaucuagcuggauuu

SEQ ID NO: 185575 - RNA, 19 nt, Human
agagccaacgauauuagga

SEQ ID NO: 185576 - RNA, 19 nt, Human
agccuuuuacuuuuuuucu

SEQ ID NO: 185577 - RNA, 22 nt, Human
aggcaccuguucuuugaaaaug

SEQ ID NO: 185578 - RNA, 22 nt, Human
aggucuaaagcccauagauggg

SEQ ID NO: 185579 - RNA, 24 nt, Human
aguuucgcccuucccgcugcucca

SEQ ID NO: 185580 - RNA, 18 nt, Human
auaaacauaaguacuucg

SEQ ID NO: 185581 - RNA, 21 nt, Human
auaaugacugaaaacaaaugu

SEQ ID NO: 185582 - RNA, 24 nt, Human
caaaacacugaguacaauauuggu

SEQ ID NO: 185583 - RNA, 27 nt, Human
cacccaguaauaggucuaaagcccaua

SEQ ID NO: 185584 - RNA, 24 nt, Human
cacuguaaauaaauccuucccaca

SEQ ID NO: 185585 - RNA, 19 nt, Human
cagaauaacuaauauggca

SEQ ID NO: 185586 - RNA, 19 nt, Human
cagauacuauuaaaccccc

SEQ ID NO: 185587 - RNA, 24 nt, Human
cagccccgcuccuccggcggcuca

SEQ ID NO: 185588 - RNA, 20 nt, Human
cagccggccugcgggcugga

SEQ ID NO: 185589 - RNA, 22 nt, Human
ccacaauuuaacagucugcuac

SEQ ID NO: 185590 - RNA, 18 nt, Human
ccagcuauuuuuuuaacc

SEQ ID NO: 185591 - RNA, 20 nt, Human
ccaugccggccacucgcccc

SEQ ID NO: 185592 - RNA, 19 nt, Human
ccccagcccccgccguggc

SEQ ID NO: 185593 - RNA, 23 nt, Human
cccccgccguggcucucgcacaa

SEQ ID NO: 185594 - RNA, 18 nt, Human
cccccgggcagccggccu

SEQ ID NO: 185595 - RNA, 27 nt, Human
ccccgccgcccccgggcagccggccug

SEQ ID NO: 185596 - RNA, 21 nt, Human
cccgcggcgcugcucgcuccg

SEQ ID NO: 185597 - RNA, 19 nt, Human
ccgcagcggcgcagggacg

SEQ ID NO: 185598 - RNA, 18 nt, Human
ccgccgcagcggcgcagg

SEQ ID NO: 185599 - RNA, 19 nt, Human
ccgcgcgggcucggccccu

SEQ ID NO: 185600 - RNA, 20 nt, Human
ccggcccggcgcagcggcgg

SEQ ID NO: 185601 - RNA, 21 nt, Human
ccggcgcagcggcgggggccu

SEQ ID NO: 185602 - RNA, 24 nt, Human
ccgggccggcccggcgcagcggcg

SEQ ID NO: 185603 - RNA, 21 nt, Human
ccucagauacuauuaaacccc

SEQ ID NO: 185604 - RNA, 22 nt, Human
ccucccgcgccggccucucccg

SEQ ID NO: 185605 - RNA, 23 nt, Human
ccucccgcgccggccucucccgc

SEQ ID NO: 185606 - RNA, 22 nt, Human
ccuccgaugucccccgccgccc

SEQ ID NO: 185607 - RNA, 19 nt, Human
ccugagauuaaggaugaaa

SEQ ID NO: 185608 - RNA, 25 nt, Human
ccugucccuggccucucaaugcagc

SEQ ID NO: 185609 - RNA, 19 nt, Human
cgacuaaacccacacagca

SEQ ID NO: 185610 - RNA, 23 nt, Human
cgccccagcccccgccguggcuc

SEQ ID NO: 185611 - RNA, 22 nt, Human
cggcgcagggacgcggcgcucc

SEQ ID NO: 185612 - RNA, 19 nt, Human
cggcggcucaggccagccg

SEQ ID NO: 185613 - RNA, 23 nt, Human
cggcgggggccgcgcucugccau

SEQ ID NO: 185614 - RNA, 26 nt, Human
cuacuacaccuaagauccuuuucaag

SEQ ID NO: 185615 - RNA, 24 nt, Human
cucacaguucuagcugggacaguc

SEQ ID NO: 185616 - RNA, 22 nt, Human
cucacuaagaaauaaacauaag

SEQ ID NO: 185617 - RNA, 20 nt, Human
cucgcuccgcugcccuccga

SEQ ID NO: 185618 - RNA, 25 nt, Human
cugcgggcuggagcgggggucucuu

SEQ ID NO: 185619 - RNA, 18 nt, Human
cugcucgcuccgcugccc

SEQ ID NO: 185620 - RNA, 19 nt, Human
cuggagcgggggucucuuc

SEQ ID NO: 185621 - RNA, 24 nt, Human
cuucagccaugccggccacucgcc

SEQ ID NO: 185622 - RNA, 21 nt, Human
cuuccucggcgguccgcgcgg

SEQ ID NO: 185623 - RNA, 22 nt, Human
cuucgugucauaauuacucccc

SEQ ID NO: 185624 - RNA, 19 nt, Human
gccaccaaaucccucagau

SEQ ID NO: 185625 - RNA, 22 nt, Human
gccggccacucgccccagcccc

SEQ ID NO: 185626 - RNA, 20 nt, Human
gcgccggccucucccgcggc

SEQ ID NO: 185627 - RNA, 19 nt, Human
gcgcugcucgcuccgcugc

SEQ ID NO: 185628 - RNA, 18 nt, Human
gcgguccgcgcgggcucg

SEQ ID NO: 185629 - RNA, 21 nt, Human
gcucgcuccgcugcccuccga

SEQ ID NO: 185630 - RNA, 20 nt, Human
ggaaauuuccauuuaauagc

SEQ ID NO: 185631 - RNA, 18 nt, Human
gggcuggagcgggggucu

SEQ ID NO: 185632 - RNA, 20 nt, Human
ggguucacucuauaaacacu

SEQ ID NO: 185633 - RNA, 21 nt, Human
guggcucucgcacaaacaccc

SEQ ID NO: 185634 - RNA, 20 nt, Human
guuguccugagauuaaggau

SEQ ID NO: 185635 - RNA, 22 nt, Human
uaaaaacaucuucagguuuuag

SEQ ID NO: 185636 - RNA, 24 nt, Human
uaaaauuagcaagauauuuucuuc

SEQ ID NO: 185637 - RNA, 22 nt, Human
uaaaccacaauuuaacagucug

SEQ ID NO: 185638 - RNA, 20 nt, Human
uacagaagugcuucccagau

SEQ ID NO: 185639 - RNA, 18 nt, Human
uaccauauagcacaaaga

SEQ ID NO: 185640 - RNA, 19 nt, Human
uauaaauugcuuaaacaaa

SEQ ID NO: 185641 - RNA, 24 nt, Human
uauggaucagaaaaaacuaacauu

SEQ ID NO: 185642 - RNA, 19 nt, Human
uauuaaacccccacauuag

SEQ ID NO: 185643 - RNA, 19 nt, Human
uauuaaacugcaaucuagc

SEQ ID NO: 185644 - RNA, 25 nt, Human
ucaaaaaacauauugaacaauuaua

SEQ ID NO: 185645 - RNA, 18 nt, Human
ucagcaguccgccgcagc

SEQ ID NO: 185646 - RNA, 23 nt, Human
uccaagcuauugcuaggugacau

SEQ ID NO: 185647 - RNA, 23 nt, Human
ucgcaccggucucccugucccug

SEQ ID NO: 185648 - RNA, 18 nt, Human
ucucaaugcagcggcucu

SEQ ID NO: 185649 - RNA, 21 nt, Human
ucucccgcggcgcugcucgcu

SEQ ID NO: 185650 - RNA, 21 nt, Human
ucucccugucccuggccucuc

SEQ ID NO: 185651 - RNA, 21 nt, Human
ugaacagaagccacauuuccc

SEQ ID NO: 185652 - RNA, 19 nt, Human
ugagauuaaggaugaaaca

SEQ ID NO: 185653 - RNA, 18 nt, Human
ugauuuugguugacgggg

SEQ ID NO: 185654 - RNA, 19 nt, Human
uggcucucgcacaaacacc

SEQ ID NO: 185655 - RNA, 20 nt, Human
uuaacacuuuuauauaucug

SEQ ID NO: 185656 - RNA, 22 nt, Human
uuagccaaaucgacuaaaccca

SEQ ID NO: 185657 - RNA, 23 nt, Human
uuauaacuuuaagacuccaccca

SEQ ID NO: 185658 - RNA, 18 nt, Human
uuauaugcacaguaugua

SEQ ID NO: 185659 - RNA, 18 nt, Human
uuauauugcucuacuaca

SEQ ID NO: 185660 - RNA, 18 nt, Human
uuuauacaaacuacauga

SEQ ID NO: 185661 - RNA, 21 nt, Human
uuuuuggcccugcaguaaguu

SEQ ID NO: 185662 - RNA, 23 nt, Human
cagcagccagguccagacagcaa

SEQ ID NO: 185663 - RNA, 19 nt, Human
gaucagcagccagguccag

SEQ ID NO: 185664 - RNA, 24 nt, Human
guugcuccuggggaucguuaagau

SEQ ID NO: 185665 - RNA, 21 nt, Human
aaaaaacagcauuggaaucgg

SEQ ID NO: 185666 - RNA, 25 nt, Human
aaaaaacagcauuggaaucggggac

SEQ ID NO: 185667 - RNA, 22 nt, Human
aaagcccagcccgggaguccgu

SEQ ID NO: 185668 - RNA, 22 nt, Human
aaggaggcccugggagaggagg

SEQ ID NO: 185669 - RNA, 23 nt, Human
aagucugcggcugacuggccugg

SEQ ID NO: 185670 - RNA, 24 nt, Human
aaucacuugaacccgggaggugga

SEQ ID NO: 185671 - RNA, 18 nt, Human
acaaaggcccagauggac

SEQ ID NO: 185672 - RNA, 18 nt, Human
acaccacugcacuccagc

SEQ ID NO: 185673 - RNA, 20 nt, Human
acaccacugcacuccagccu

SEQ ID NO: 185674 - RNA, 18 nt, Human
acaccaggcagcuccugg

SEQ ID NO: 185675 - RNA, 20 nt, Human
acagagcaacuggagccaca

SEQ ID NO: 185676 - RNA, 18 nt, Human
acagaggaugcagagugc

SEQ ID NO: 185677 - RNA, 21 nt, Human
acaggcagugugcgacgaggc

SEQ ID NO: 185678 - RNA, 24 nt, Human
acugcacuccagccugugugacag

SEQ ID NO: 185679 - RNA, 26 nt, Human
acugcacuccagccugugugacagag

SEQ ID NO: 185680 - RNA, 20 nt, Human
agcugcugcugugcuccugg

SEQ ID NO: 185681 - RNA, 18 nt, Human
aggagagugucaggcucu

SEQ ID NO: 185682 - RNA, 18 nt, Human
aggcaugagaaucacuug

SEQ ID NO: 185683 - RNA, 24 nt, Human
aggcaugagaaucacuugaacccg

SEQ ID NO: 185684 - RNA, 24 nt, Human
aggcugaggcaugagaaucacuug

SEQ ID NO: 185685 - RNA, 20 nt, Human
agggagggagggggccuggg

SEQ ID NO: 185686 - RNA, 23 nt, Human
agggagggagggggccugggcuc

SEQ ID NO: 185687 - RNA, 19 nt, Human
agguggagguuacgaugag

SEQ ID NO: 185688 - RNA, 24 nt, Human
agguggagguuacgaugagccaag

SEQ ID NO: 185689 - RNA, 24 nt, Human
aucacaccacugcacuccagccug

SEQ ID NO: 185690 - RNA, 19 nt, Human
caaacauuuacagcagaca

SEQ ID NO: 185691 - RNA, 21 nt, Human
cacaccacugcacuccagccu

SEQ ID NO: 185692 - RNA, 24 nt, Human
cacauuucugucccaggcaggggc

SEQ ID NO: 185693 - RNA, 27 nt, Human
caccacugcacuccagccugugugaca

SEQ ID NO: 185694 - RNA, 21 nt, Human
caccaggcagcuccuggaaac

SEQ ID NO: 185695 - RNA, 21 nt, Human
caccuguaaucccagcuacuc

SEQ ID NO: 185696 - RNA, 19 nt, Human
cacgcacgccucacauacc

SEQ ID NO: 185697 - RNA, 23 nt, Human
cacuccagccugugugacagagc

SEQ ID NO: 185698 - RNA, 24 nt, Human
cacuccagccugugugacagagcg

SEQ ID NO: 185699 - RNA, 19 nt, Human
cacugcacuccagccugug

SEQ ID NO: 185700 - RNA, 22 nt, Human
cacugcacuccagccuguguga

SEQ ID NO: 185701 - RNA, 24 nt, Human
cacugcacuccagccugugugaca

SEQ ID NO: 185702 - RNA, 23 nt, Human
cagacccucaagauccaaggccu

SEQ ID NO: 185703 - RNA, 19 nt, Human
cagcuccuggaaaccacuc

SEQ ID NO: 185704 - RNA, 21 nt, Human
cagcuccuggaaaccacuccc

SEQ ID NO: 185705 - RNA, 23 nt, Human
cauacaaaggcccagauggacag

SEQ ID NO: 185706 - RNA, 21 nt, Human
cauuucugucccaggcagggg

SEQ ID NO: 185707 - RNA, 18 nt, Human
ccaccuguaaucccagcu

SEQ ID NO: 185708 - RNA, 25 nt, Human
ccaccuguaaucccagcuacucggg

SEQ ID NO: 185709 - RNA, 18 nt, Human
ccacugcacuccagccug

SEQ ID NO: 185710 - RNA, 18 nt, Human
ccacugcacuccagccug

SEQ ID NO: 185711 - RNA, 19 nt, Human
ccacugcacuccagccugu

SEQ ID NO: 185712 - RNA, 21 nt, Human
ccacugcacuccagccugugu

SEQ ID NO: 185713 - RNA, 24 nt, Human
ccacugcacuccagccugugugac

SEQ ID NO: 185714 - RNA, 25 nt, Human
ccacugcacuccagccugugugaca

SEQ ID NO: 185715 - RNA, 20 nt, Human
ccagcccacgcaucgguacc

SEQ ID NO: 185716 - RNA, 21 nt, Human
ccagggaagauggagggagga

SEQ ID NO: 185717 - RNA, 21 nt, Human
ccagggcucuggcccugaagg

SEQ ID NO: 185718 - RNA, 24 nt, Human
ccaucucuccauggucguugggcu

SEQ ID NO: 185719 - RNA, 18 nt, Human
cccccagcaaugagggcu

SEQ ID NO: 185720 - RNA, 22 nt, Human
cccccagcugugaacgaaggag

SEQ ID NO: 185721 - RNA, 19 nt, Human
cccugggccccauucgccc

SEQ ID NO: 185722 - RNA, 19 nt, Human
cccugggccccauucgccc

SEQ ID NO: 185723 - RNA, 20 nt, Human
ccgagccuggcucaggggca

SEQ ID NO: 185724 - RNA, 22 nt, Human
ccgccagggcucuggcccugaa

SEQ ID NO: 185725 - RNA, 24 nt, Human
ccuacaacaggccagcaaucuacc

SEQ ID NO: 185726 - RNA, 23 nt, Human
ccucaagauccaaggccuggccc

SEQ ID NO: 185727 - RNA, 21 nt, Human
ccugggagaggaggagaaccc

SEQ ID NO: 185728 - RNA, 19 nt, Human
ccugggcucagagguaggc

SEQ ID NO: 185729 - RNA, 21 nt, Human
ccuguaaucccagcuacucgg

SEQ ID NO: 185730 - RNA, 21 nt, Human
cgagcugcugcugugcuccug

SEQ ID NO: 185731 - RNA, 20 nt, Human
cgaguaguccccaaggccaa

SEQ ID NO: 185732 - RNA, 21 nt, Human
cgccuggagcuauuugggggc

SEQ ID NO: 185733 - RNA, 24 nt, Human
cgggaggcugaggcaugagaauca

SEQ ID NO: 185734 - RNA, 29 nt, Human
cgggagguggagguuacgaugacaacggu

SEQ ID NO: 185735 - RNA, 24 nt, Human
cgggagguggagguuacgaugagc

SEQ ID NO: 185736 - RNA, 23 nt, Human
cguugggcuuuccaaagucugcg

SEQ ID NO: 185737 - RNA, 20 nt, Human
cuccagcuggguugggacag

SEQ ID NO: 185738 - RNA, 19 nt, Human
cuccuggaaaccacucccc

SEQ ID NO: 185739 - RNA, 19 nt, Human
cuggagcuauuugggggcu

SEQ ID NO: 185740 - RNA, 21 nt, Human
cuguaaucccagcuacucggg

SEQ ID NO: 185741 - RNA, 19 nt, Human
cuuaggagagugucaggcu

SEQ ID NO: 185742 - RNA, 21 nt, Human
cuugaacccgggagguggagg

SEQ ID NO: 185743 - RNA, 19 nt, Human
cuugauucucuucuacagu

SEQ ID NO: 185744 - RNA, 23 nt, Human
gaacauccuucccaucuucaagg

SEQ ID NO: 185745 - RNA, 20 nt, Human
gaagauggagggaggacugg

SEQ ID NO: 185746 - RNA, 23 nt, Human
gaagucaccaccuguaaucccag

SEQ ID NO: 185747 - RNA, 19 nt, Human
gacuggggggcugagggag

SEQ ID NO: 185748 - RNA, 23 nt, Human
gagaaucacuugaacccgggagg

SEQ ID NO: 185749 - RNA, 18 nt, Human
gagcugcugcugugcucc

SEQ ID NO: 185750 - RNA, 20 nt, Human
gaggaggucagucucagucc

SEQ ID NO: 185751 - RNA, 18 nt, Human
gaggcccugggagaggag

SEQ ID NO: 185752 - RNA, 24 nt, Human
gcacuccagccugugugacagagc

SEQ ID NO: 185753 - RNA, 21 nt, Human
gcaggggcacaggauuaagga

SEQ ID NO: 185754 - RNA, 20 nt, Human
gccaagaucacaccacugca

SEQ ID NO: 185755 - RNA, 21 nt, Human
gcccccagcaaugagggcugg

SEQ ID NO: 185756 - RNA, 19 nt, Human
gcuccaggaguucuugcuu

SEQ ID NO: 185757 - RNA, 22 nt, Human
ggaagucuuccaggauucccag

SEQ ID NO: 185758 - RNA, 23 nt, Human
ggacuggggggcugagggaggga

SEQ ID NO: 185759 - RNA, 19 nt, Human
ggagggaggacuggggggc

SEQ ID NO: 185760 - RNA, 20 nt, Human
ggccuggggcugggccuggc

SEQ ID NO: 185761 - RNA, 22 nt, Human
ggccuggggcugggccuggcuc

SEQ ID NO: 185762 - RNA, 21 nt, Human
ggcgagcugcugcugugcucc

SEQ ID NO: 185763 - RNA, 22 nt, Human
ggcggccgagggcgccuggagc

SEQ ID NO: 185764 - RNA, 21 nt, Human
gggagggagggggccugggcu

SEQ ID NO: 185765 - RNA, 19 nt, Human
ggggcugggccuggcucgg

SEQ ID NO: 185766 - RNA, 21 nt, Human
gggugccaccugagguuaaaa

SEQ ID NO: 185767 - RNA, 19 nt, Human
gucacucuuggaagucacc

SEQ ID NO: 185768 - RNA, 22 nt, Human
gucucaguccuuggaguggugg

SEQ ID NO: 185769 - RNA, 18 nt, Human
guugggacagaugugggg

SEQ ID NO: 185770 - RNA, 21 nt, Human
uaaaaagaacauccuucccau

SEQ ID NO: 185771 - RNA, 22 nt, Human
uaaggagagaccaggccuccag

SEQ ID NO: 185772 - RNA, 22 nt, Human
uacaacaggccagcaaucuacc

SEQ ID NO: 185773 - RNA, 23 nt, Human
uacaaugaacauguacuucuuuu

SEQ ID NO: 185774 - RNA, 19 nt, Human
uaccagacugaauguuggc

SEQ ID NO: 185775 - RNA, 21 nt, Human
uaccgagccuggcucaggggc

SEQ ID NO: 185776 - RNA, 22 nt, Human
uacgaugagccaagaucacacc

SEQ ID NO: 185777 - RNA, 23 nt, Human
uaggcagcauggcggcgcacuuc

SEQ ID NO: 185778 - RNA, 24 nt, Human
uaguccccaaggccaauucaaaag

SEQ ID NO: 185779 - RNA, 23 nt, Human
ucacaccacugcacuccagccug

SEQ ID NO: 185780 - RNA, 24 nt, Human
ucacuugaacccgggagguggagg

SEQ ID NO: 185781 - RNA, 21 nt, Human
ucagggugagcaagggcaaug

SEQ ID NO: 185782 - RNA, 21 nt, Human
ucaucugugucccuaccaccu

SEQ ID NO: 185783 - RNA, 23 nt, Human
uccagccugugugacagagcgag

SEQ ID NO: 185784 - RNA, 24 nt, Human
uccagccugugugacagagcgaga

SEQ ID NO: 185785 - RNA, 24 nt, Human
uccccaaggccaauucaaaagccc

SEQ ID NO: 185786 - RNA, 19 nt, Human
ucccgugggagcugaguga

SEQ ID NO: 185787 - RNA, 18 nt, Human
uccguccaccauggcaac

SEQ ID NO: 185788 - RNA, 18 nt, Human
uccuggaaaccacucccc

SEQ ID NO: 185789 - RNA, 25 nt, Human
ucgggaggcugaggcaugagaauca

SEQ ID NO: 185790 - RNA, 23 nt, Human
ucugcggcugacuggccuggggc

SEQ ID NO: 185791 - RNA, 19 nt, Human
ugacuggccuggggcuggg

SEQ ID NO: 185792 - RNA, 20 nt, Human
ugaggcaugagaaucacuug

SEQ ID NO: 185793 - RNA, 24 nt, Human
ugaggcaugagaaucacuugaacc

SEQ ID NO: 185794 - RNA, 18 nt, Human
ugagggagggagggggcc

SEQ ID NO: 185795 - RNA, 19 nt, Human
ugcccugggccccauucgc

SEQ ID NO: 185796 - RNA, 23 nt, Human
uggaaaccacuccccaaaaaaca

SEQ ID NO: 185797 - RNA, 23 nt, Human
uggcaggaggagugaccaggucg

SEQ ID NO: 185798 - RNA, 19 nt, Human
uggccuggggcugggccug

SEQ ID NO: 185799 - RNA, 21 nt, Human
uggccuggggcugggccuggc

SEQ ID NO: 185800 - RNA, 23 nt, Human
uggccuggggcugggccuggcuc

SEQ ID NO: 185801 - RNA, 21 nt, Human
uggcucgggggccacaggcag

SEQ ID NO: 185802 - RNA, 21 nt, Human
ugggagaggaggagaacccca

SEQ ID NO: 185803 - RNA, 26 nt, Human
ugggagaggaggagaaccccagggaa

SEQ ID NO: 185804 - RNA, 23 nt, Human
ugggauggaaaccagacgggacu

SEQ ID NO: 185805 - RNA, 23 nt, Human
ugggcggccgagggcgccuggag

SEQ ID NO: 185806 - RNA, 19 nt, Human
uguagcuccaggaguucuu

SEQ ID NO: 185807 - RNA, 18 nt, Human
uuaaggaugugccagacc

SEQ ID NO: 185808 - RNA, 20 nt, Human
uucugucccaggcaggggca

SEQ ID NO: 185809 - RNA, 24 nt, Human
uuuccaaauucucuacaaugaaca

SEQ ID NO: 185810 - RNA, 22 nt, Human
uuuuuuuuuuuuuuuugcuagg

SEQ ID NO: 185811 - RNA, 18 nt, Human
uuuuuuuuuuuuuuuuug

SEQ ID NO: 185812 - RNA, 20 nt, Human
uuuuuuuuuuuuuuuuugcu

SEQ ID NO: 185813 - RNA, 23 nt, Human
uuuuuuuuuuuuuuuuuugcuag

SEQ ID NO: 185814 - RNA, 25 nt, Human
aaaauaccaccaccaauaccaacca

SEQ ID NO: 185815 - RNA, 19 nt, Human
aacucccgugcccucucuc

SEQ ID NO: 185816 - RNA, 18 nt, Human
aauggcaagagcugcugg

SEQ ID NO: 185817 - RNA, 18 nt, Human
accaauaccaaccaacac

SEQ ID NO: 185818 - RNA, 19 nt, Human
accacaccacccucuggcc

SEQ ID NO: 185819 - RNA, 22 nt, Human
accccacccuucccaugcccaa

SEQ ID NO: 185820 - RNA, 23 nt, Human
accccagccucagcccuagccag

SEQ ID NO: 185821 - RNA, 25 nt, Human
acuaagcaaaagcugugugcagaga

SEQ ID NO: 185822 - RNA, 23 nt, Human
acuggccccagccccauaucccu

SEQ ID NO: 185823 - RNA, 20 nt, Human
agagaccccagccucagccc

SEQ ID NO: 185824 - RNA, 21 nt, Human
agagaccccagccucagcccu

SEQ ID NO: 185825 - RNA, 25 nt, Human
agcugaugcuucuccaaggcugcug

SEQ ID NO: 185826 - RNA, 24 nt, Human
agcugggaaaaggugaucccacaa

SEQ ID NO: 185827 - RNA, 20 nt, Human
aggaaacacuaagcaaaagc

SEQ ID NO: 185828 - RNA, 22 nt, Human
aggaaggcauuuaauggaucau

SEQ ID NO: 185829 - RNA, 22 nt, Human
aguccuuugugacccuuuucuc

SEQ ID NO: 185830 - RNA, 18 nt, Human
aguuucuagucccaguuc

SEQ ID NO: 185831 - RNA, 21 nt, Human
auggaaaccccacccuuccca

SEQ ID NO: 185832 - RNA, 27 nt, Human
caacacaguuccuacagucucaaucaa

SEQ ID NO: 185833 - RNA, 22 nt, Human
caagagcugcuggggaguagaa

SEQ ID NO: 185834 - RNA, 20 nt, Human
cacagccaaguccaaggcuu

SEQ ID NO: 185835 - RNA, 18 nt, Human
cacccucuggcccugccu

SEQ ID NO: 185836 - RNA, 22 nt, Human
cagccaagaccaacucccgugc

SEQ ID NO: 185837 - RNA, 28 nt, Human
cagcccuagccagcugggaaaaggugau

SEQ ID NO: 185838 - RNA, 20 nt, Human
cagcgacccugcugaucucu

SEQ ID NO: 185839 - RNA, 26 nt, Human
cagcugggaaaaggugaucccacagc

SEQ ID NO: 185840 - RNA, 21 nt, Human
caggaaacacuaagcaaaagc

SEQ ID NO: 185841 - RNA, 20 nt, Human
caggcccaucccccauccua

SEQ ID NO: 185842 - RNA, 22 nt, Human
cauaacuggccccagccccaua

SEQ ID NO: 185843 - RNA, 24 nt, Human
cauccuguuggcucuguuccugac

SEQ ID NO: 185844 - RNA, 21 nt, Human
cauuuccccuuuugaugcuca

SEQ ID NO: 185845 - RNA, 22 nt, Human
ccaaccaacacaguuccuacag

SEQ ID NO: 185846 - RNA, 23 nt, Human
ccaacucccgugcccucucucca

SEQ ID NO: 185847 - RNA, 20 nt, Human
ccaagaccaacucccgugcc

SEQ ID NO: 185848 - RNA, 22 nt, Human
ccaauaccaaccaacacaguuc

SEQ ID NO: 185849 - RNA, 25 nt, Human
ccacccucuggcccugccuugaucc

SEQ ID NO: 185850 - RNA, 22 nt, Human
ccaugaggagagagaucaggga

SEQ ID NO: 185851 - RNA, 22 nt, Human
cccucuggcccugccuugaucc

SEQ ID NO: 185852 - RNA, 26 nt, Human
ccggcucccaugugauagcuccucuc

SEQ ID NO: 185853 - RNA, 21 nt, Human
ccuccgaguguccagcggccc

SEQ ID NO: 185854 - RNA, 24 nt, Human
ccuccugucacaggcccauccccc

SEQ ID NO: 185855 - RNA, 21 nt, Human
ccuucccaugcccaaccuuaa

SEQ ID NO: 185856 - RNA, 21 nt, Human
cuacagucucaaucaaugaac

SEQ ID NO: 185857 - RNA, 21 nt, Human
cuaucccacucccaccagccc

SEQ ID NO: 185858 - RNA, 26 nt, Human
cugugugcagagaccccagccucagc

SEQ ID NO: 185859 - RNA, 21 nt, Human
gaccccagccucagcccuagc

SEQ ID NO: 185860 - RNA, 19 nt, Human
gacccuuuucucucgucac

SEQ ID NO: 185861 - RNA, 19 nt, Human
gagaccacaccacccucug

SEQ ID NO: 185862 - RNA, 19 nt, Human
gcccucucuccaacccagu

SEQ ID NO: 185863 - RNA, 24 nt, Human
guggucccagauggguguccuguc

SEQ ID NO: 185864 - RNA, 22 nt, Human
guucaaauagagaccacaccac

SEQ ID NO: 185865 - RNA, 29 nt, Human
uaagcaaaagcugugugcagagaccccaa

SEQ ID NO: 185866 - RNA, 24 nt, Human
uaccaaccaacacaguuccuacag

SEQ ID NO: 185867 - RNA, 22 nt, Human
uagaaggagcacaaaauuuagu

SEQ ID NO: 185868 - RNA, 20 nt, Human
uagcagucaaagaucacagc

SEQ ID NO: 185869 - RNA, 25 nt, Human
uaggauggacagguggucccagaug

SEQ ID NO: 185870 - RNA, 22 nt, Human
ucccaccagcccauuuccccuu

SEQ ID NO: 185871 - RNA, 18 nt, Human
ucccaugcccaaccuuaa

SEQ ID NO: 185872 - RNA, 23 nt, Human
ucccggcucccaugugauagcuc

SEQ ID NO: 185873 - RNA, 19 nt, Human
uccucagaauggcaagagc

SEQ ID NO: 185874 - RNA, 19 nt, Human
uccuguuggcucuguuccu

SEQ ID NO: 185875 - RNA, 19 nt, Human
ucgcugccaugaggagaga

SEQ ID NO: 185876 - RNA, 23 nt, Human
ucuccucagaauggcaagagcug

SEQ ID NO: 185877 - RNA, 23 nt, Human
ucucugggauagugccucaguuu

SEQ ID NO: 185878 - RNA, 25 nt, Human
ugaaaauaccaccaccaauaccaac

SEQ ID NO: 185879 - RNA, 27 nt, Human
ugaaucuucugaauuucaguuuccuca

SEQ ID NO: 185880 - RNA, 22 nt, Human
ugacccaggaaacacuaagcaa

SEQ ID NO: 185881 - RNA, 19 nt, Human
ugagcagucccggcuccca

SEQ ID NO: 185882 - RNA, 20 nt, Human
ugaggagagagaucagggag

SEQ ID NO: 185883 - RNA, 24 nt, Human
uggcaagagcugcugggggacguc

SEQ ID NO: 185884 - RNA, 19 nt, Human
ugggaaaaggugaucccac

SEQ ID NO: 185885 - RNA, 19 nt, Human
uucauccuguuggcucugu

SEQ ID NO: 185886 - RNA, 23 nt, Human
uucugggcauuacuaacucugug

SEQ ID NO: 185887 - RNA, 22 nt, Human
uugaaaauaccaccaccaauac

SEQ ID NO: 185888 - RNA, 22 nt, Human
uugaugcucagugagccaggaa

SEQ ID NO: 185889 - RNA, 25 nt, Human
uuuccugauuucuugucuccucaac

SEQ ID NO: 185890 - RNA, 25 nt, Human
uuuucucucgucaccgucucaccau

SEQ ID NO: 185891 - RNA, 23 nt, Human
acccccaugugugaauccaccaa

SEQ ID NO: 185892 - RNA, 18 nt, Human
agaagcagguggaggagu

SEQ ID NO: 185893 - RNA, 19 nt, Human
agaagcagguggaggaguu

SEQ ID NO: 185894 - RNA, 24 nt, Human
agauggcagaauggagccuaaagc

SEQ ID NO: 185895 - RNA, 20 nt, Human
agguccuggaggacccccau

SEQ ID NO: 185896 - RNA, 25 nt, Human
cagcaacucagccccugucggagau

SEQ ID NO: 185897 - RNA, 20 nt, Human
cagcagacacccuuucuccu

SEQ ID NO: 185898 - RNA, 22 nt, Human
cagcagacacccuuucuccucc

SEQ ID NO: 185899 - RNA, 27 nt, Human
cagcagacacccuuucuccuccuguuc

SEQ ID NO: 185900 - RNA, 23 nt, Human
cagcagggcaccugcugugaccu

SEQ ID NO: 185901 - RNA, 18 nt, Human
ccacaugccaguucuggg

SEQ ID NO: 185902 - RNA, 18 nt, Human
ccagauauccagcagggc

SEQ ID NO: 185903 - RNA, 21 nt, Human
ccagauauccagcagggcacc

SEQ ID NO: 185904 - RNA, 22 nt, Human
ccaggcccauggaggggugcaa

SEQ ID NO: 185905 - RNA, 20 nt, Human
ccccacggaaaccacccucc

SEQ ID NO: 185906 - RNA, 21 nt, Human
ccccacggaaaccacccuccu

SEQ ID NO: 185907 - RNA, 22 nt, Human
ccccacggaaaccacccuccuu

SEQ ID NO: 185908 - RNA, 19 nt, Human
ccccugccccagcccagcu

SEQ ID NO: 185909 - RNA, 20 nt, Human
ccugcccaucuuggccuggg

SEQ ID NO: 185910 - RNA, 22 nt, Human
ccugccccagcccagcuccagc

SEQ ID NO: 185911 - RNA, 26 nt, Human
ccugcgcugggauguagauggcagaa

SEQ ID NO: 185912 - RNA, 21 nt, Human
ccugcuguggcuguaacccag

SEQ ID NO: 185913 - RNA, 21 nt, Human
cgacgcccaggcugccauccu

SEQ ID NO: 185914 - RNA, 27 nt, Human
cgcccaggcugccauccucuugggggc

SEQ ID NO: 185915 - RNA, 20 nt, Human
cgugggccucaccaggcagc

SEQ ID NO: 185916 - RNA, 21 nt, Human
cucagcgaccaggaaguugug

SEQ ID NO: 185917 - RNA, 18 nt, Human
cuccagcaacucagcccc

SEQ ID NO: 185918 - RNA, 19 nt, Human
cucuugucccuugcuccuc

SEQ ID NO: 185919 - RNA, 23 nt, Human
cuguccucugcuccucuuguccc

SEQ ID NO: 185920 - RNA, 22 nt, Human
cugugaguuucacaaaccaccu

SEQ ID NO: 185921 - RNA, 20 nt, Human
cuuccugcuguggcuguaac

SEQ ID NO: 185922 - RNA, 20 nt, Human
gagcccuuagggcccucuuc

SEQ ID NO: 185923 - RNA, 23 nt, Human
gaggaguuucaguagcuuugucc

SEQ ID NO: 185924 - RNA, 21 nt, Human
gauguagauggcagaauggag

SEQ ID NO: 185925 - RNA, 20 nt, Human
gggcagcaaaaccuccagaa

SEQ ID NO: 185926 - RNA, 23 nt, Human
gggugcagaugggaaagcugagg

SEQ ID NO: 185927 - RNA, 21 nt, Human
gggugcagcugagguccugga

SEQ ID NO: 185928 - RNA, 21 nt, Human
gguccaguugucuucugggca

SEQ ID NO: 185929 - RNA, 18 nt, Human
gugcagcugagguccugg

SEQ ID NO: 185930 - RNA, 19 nt, Human
uaggccucagccccuucca

SEQ ID NO: 185931 - RNA, 21 nt, Human
ucaccaggcagcagacacccu

SEQ ID NO: 185932 - RNA, 19 nt, Human
ucaggcuucacccugcgcu

SEQ ID NO: 185933 - RNA, 21 nt, Human
uccacaugccaguucuggggc

SEQ ID NO: 185934 - RNA, 19 nt, Human
uccccugccccagcccagc

SEQ ID NO: 185935 - RNA, 22 nt, Human
uccccugccccagcccagcucc

SEQ ID NO: 185936 - RNA, 26 nt, Human
ucccuugcuccuccggccccucaccu

SEQ ID NO: 185937 - RNA, 19 nt, Human
uccgugggccucaccaggc

SEQ ID NO: 185938 - RNA, 18 nt, Human
ucuuggccuggggaccac

SEQ ID NO: 185939 - RNA, 22 nt, Human
ugagugucucuccagugguucu

SEQ ID NO: 185940 - RNA, 23 nt, Human
ugccccagcccagcuccagcaac

SEQ ID NO: 185941 - RNA, 21 nt, Human
ugcuguggcuguaacccagau

SEQ ID NO: 185942 - RNA, 18 nt, Human
uggagccuaaagcugcag

SEQ ID NO: 185943 - RNA, 21 nt, Human
uggaugagcccccacggaaac

SEQ ID NO: 185944 - RNA, 23 nt, Human
uggccuggggaccaccugugagu

SEQ ID NO: 185945 - RNA, 22 nt, Human
ugggcucucaggcuucacccug

SEQ ID NO: 185946 - RNA, 23 nt, Human
uuccugcuguggcuguaacccag

SEQ ID NO: 185947 - RNA, 22 nt, Human
uucuuugugacaccugcccauc

SEQ ID NO: 185948 - RNA, 18 nt, Human
aaaaagucuccucacccu

SEQ ID NO: 185949 - RNA, 24 nt, Human
aaaucaaucaaggaaaaaccccaa

SEQ ID NO: 185950 - RNA, 24 nt, Human
aaccccaaaaccaaaaaaaagucu

SEQ ID NO: 185951 - RNA, 21 nt, Human
aagcacaauccugauucccac

SEQ ID NO: 185952 - RNA, 20 nt, Human
aagcagagaugcaggaguuc

SEQ ID NO: 185953 - RNA, 24 nt, Human
aagcagcagugucuuccagaaaaa

SEQ ID NO: 185954 - RNA, 18 nt, Human
aagcauuucaacacagaa

SEQ ID NO: 185955 - RNA, 20 nt, Human
aagcauuucaacacagaacc

SEQ ID NO: 185956 - RNA, 19 nt, Human
aauauuuguaaucacuuuc

SEQ ID NO: 185957 - RNA, 21 nt, Human
aaucaaggaaaaaccccaaaa

SEQ ID NO: 185958 - RNA, 21 nt, Human
acaaacccuauaaaaaaaaau

SEQ ID NO: 185959 - RNA, 19 nt, Human
acacugcucacacacauac

SEQ ID NO: 185960 - RNA, 22 nt, Human
acauacauacacaaacccuaua

SEQ ID NO: 185961 - RNA, 21 nt, Human
accccaaaaccaaaaaaaagu

SEQ ID NO: 185962 - RNA, 23 nt, Human
augcaagcagagaugcaggaguu

SEQ ID NO: 185963 - RNA, 21 nt, Human
caaggaaaaaccccaaaacca

SEQ ID NO: 185964 - RNA, 24 nt, Human
caaggaaaaaccccaaaaccaaaa

SEQ ID NO: 185965 - RNA, 28 nt, Human
caaugaguuccaucuuccacaagagucc

SEQ ID NO: 185966 - RNA, 20 nt, Human
cacacacauacauacacaaa

SEQ ID NO: 185967 - RNA, 22 nt, Human
cacccuaaauugaggauuucua

SEQ ID NO: 185968 - RNA, 28 nt, Human
cauacauacacaaacccuauaaaaaaaa

SEQ ID NO: 185969 - RNA, 24 nt, Human
ccaaaaccaaaaaaaagucuccuc

SEQ ID NO: 185970 - RNA, 24 nt, Human
ccaaaaccaaaaaaaagucuccuc

SEQ ID NO: 185971 - RNA, 18 nt, Human
cccaaaaccaaaaaaaag

SEQ ID NO: 185972 - RNA, 19 nt, Human
cccacuaugaaaacaaaau

SEQ ID NO: 185973 - RNA, 21 nt, Human
cccacuaugaaaacaaaauca

SEQ ID NO: 185974 - RNA, 19 nt, Human
cgcccgcggaagagcccag

SEQ ID NO: 185975 - RNA, 22 nt, Human
gaaacaccuacaauucaaugua

SEQ ID NO: 185976 - RNA, 18 nt, Human
gagaaagagaauucaaug

SEQ ID NO: 185977 - RNA, 18 nt, Human
gcaggaguucuucaagca

SEQ ID NO: 185978 - RNA, 24 nt, Human
ggaaaaaccccaaaaccaaaaaaa

SEQ ID NO: 185979 - RNA, 24 nt, Human
ggaguucuucaagcauuucaacac

SEQ ID NO: 185980 - RNA, 18 nt, Human
uaaaagcagcagugucuu

SEQ ID NO: 185981 - RNA, 23 nt, Human
uaaagcacaauccugauucccac

SEQ ID NO: 185982 - RNA, 25 nt, Human
uaaagcacaauccugauucccacua

SEQ ID NO: 185983 - RNA, 21 nt, Human
uaacugcaggcucaauaaagc

SEQ ID NO: 185984 - RNA, 23 nt, Human
ucacacacauacauacacaaacc

SEQ ID NO: 185985 - RNA, 20 nt, Human
ucuggaaaauggacaaugag

SEQ ID NO: 185986 - RNA, 24 nt, Human
ugaaaacaaaaucaaucaaggaaa

SEQ ID NO: 185987 - RNA, 25 nt, Human
ugaaaacaaaaucaaucaaggaaaa

SEQ ID NO: 185988 - RNA, 21 nt, Human
ugaguuccaucuuccacaaga

SEQ ID NO: 185989 - RNA, 27 nt, Human
ugcucacacacauacauacacaaaccc

SEQ ID NO: 185990 - RNA, 30 nt, Human
uuuacacugcucacacacauacauacagug

SEQ ID NO: 185991 - RNA, 19 nt, Human
aaacagcccacaagcauca

SEQ ID NO: 185992 - RNA, 21 nt, Human
aacagagaagucuugucucuu

SEQ ID NO: 185993 - RNA, 23 nt, Human
acagaacgcugacaaacagccca

SEQ ID NO: 185994 - RNA, 20 nt, Human
agaacgcugacaaacagccc

SEQ ID NO: 185995 - RNA, 24 nt, Human
aucacagaacgcugacaaacagcc

SEQ ID NO: 185996 - RNA, 24 nt, Human
auuaauucaucaaugcuuuuaaag

SEQ ID NO: 185997 - RNA, 18 nt, Human
cacagaacgcugacaaac

SEQ ID NO: 185998 - RNA, 20 nt, Human
cacagaacgcugacaaacag

SEQ ID NO: 185999 - RNA, 18 nt, Human
caucgaauucgcuuuuac

SEQ ID NO: 186000 - RNA, 23 nt, Human
ccacaagcaucaacugaggcauu

SEQ ID NO: 186001 - RNA, 21 nt, Human
uacaaggcuuuguuugcacag

SEQ ID NO: 186002 - RNA, 24 nt, Human
uagaaaguaaacagagaagucuug

SEQ ID NO: 186003 - RNA, 20 nt, Human
ucuugucucuuuguaguuug

SEQ ID NO: 186004 - RNA, 19 nt, Human
ugacaaacagcccacaagc

SEQ ID NO: 186005 - RNA, 21 nt, Human
ugacaaacagcccacaagcau

SEQ ID NO: 186006 - RNA, 25 nt, Human
uggauguagaucaauuuuuacacag

SEQ ID NO: 186007 - RNA, 24 nt, Human
uuaaaauuccuuuccuuccauauu

SEQ ID NO: 186008 - RNA, 23 nt, Human
uuaguucuuagaaaguaaacaga

SEQ ID NO: 186009 - RNA, 19 nt, Human
uucauuaucacagaacgcu

SEQ ID NO: 186010 - RNA, 24 nt, Human
uucuuuguugucuaaaguucuaau

SEQ ID NO: 186011 - RNA, 21 nt, Human
uuuuaaaauuccuuuccuucc

SEQ ID NO: 186012 - RNA, 27 nt, Human
uuuuaaaauuccuuuccuuccauauuu

SEQ ID NO: 186013 - RNA, 24 nt, Human
uuuuuacacagauaucagcaguug

SEQ ID NO: 186014 - RNA, 22 nt, Human
aaaacuguuuacauaagauccu

SEQ ID NO: 186015 - RNA, 19 nt, Human
aaacuacaaagcaaaucaa

SEQ ID NO: 186016 - RNA, 18 nt, Human
aagaggcccaagacagau

SEQ ID NO: 186017 - RNA, 20 nt, Human
aagaugucaacaaacuacaa

SEQ ID NO: 186018 - RNA, 18 nt, Human
acuacaaagcaaaucaac

SEQ ID NO: 186019 - RNA, 22 nt, Human
agaugucaacaaacuacaaagc

SEQ ID NO: 186020 - RNA, 20 nt, Human
agcucacagaugagcaauau

SEQ ID NO: 186021 - RNA, 20 nt, Human
agcucgccugccgcucugga

SEQ ID NO: 186022 - RNA, 21 nt, Human
caagacagauaagccugccgg

SEQ ID NO: 186023 - RNA, 24 nt, Human
caagacagauaagccugccgggug

SEQ ID NO: 186024 - RNA, 30 nt, Human
cagcgcgccccuccuccaucucgcaguccu

SEQ ID NO: 186025 - RNA, 20 nt, Human
ccccagcucgccugccgcuc

SEQ ID NO: 186026 - RNA, 20 nt, Human
ccgcagcgcgccccuccucc

SEQ ID NO: 186027 - RNA, 22 nt, Human
ccggaccccagcucgccugccg

SEQ ID NO: 186028 - RNA, 19 nt, Human
cgcagcgcgccccuccucc

SEQ ID NO: 186029 - RNA, 25 nt, Human
cgccccuccuccaucucgcaguccg

SEQ ID NO: 186030 - RNA, 18 nt, Human
cuccaucucgcaguccgg

SEQ ID NO: 186031 - RNA, 18 nt, Human
gaugaugcaggacuagag

SEQ ID NO: 186032 - RNA, 22 nt, Human
uagaauaaaguccauuacuauc

SEQ ID NO: 186033 - RNA, 23 nt, Human
ucucgcaguccggaccccagcuc

SEQ ID NO: 186034 - RNA, 22 nt, Human
ugacaaaagaggcccaagacag

SEQ ID NO: 186035 - RNA, 23 nt, Human
ugagcaauaugugacaaaagagg

SEQ ID NO: 186036 - RNA, 19 nt, Human
ugugacaaaagaggcccaa

SEQ ID NO: 186037 - RNA, 19 nt, Human
aaaacaaaaacaaacaacg

SEQ ID NO: 186038 - RNA, 18 nt, Human
aaaagcaauuauaaaagc

SEQ ID NO: 186039 - RNA, 28 nt, Human
aaacaaaaacaaacaacgaaaauuacac

SEQ ID NO: 186040 - RNA, 25 nt, Human
aaacaacgaaaauuacacaagggcu

SEQ ID NO: 186041 - RNA, 18 nt, Human
aaagugcugggaucacaa

SEQ ID NO: 186042 - RNA, 20 nt, Human
aaauaaaaucugccaggcug

SEQ ID NO: 186043 - RNA, 23 nt, Human
aaaugagagacccagggaggucc

SEQ ID NO: 186044 - RNA, 18 nt, Human
aacaaaaacaaacaacga

SEQ ID NO: 186045 - RNA, 20 nt, Human
aacaaaaacaaacaacgaaa

SEQ ID NO: 186046 - RNA, 19 nt, Human
aacacaaugaaaccccguc

SEQ ID NO: 186047 - RNA, 20 nt, Human
aacacaaugaaaccccgucu

SEQ ID NO: 186048 - RNA, 20 nt, Human
aacauggcaaaacccugucu

SEQ ID NO: 186049 - RNA, 21 nt, Human
aacauggcaaaacccugucuc

SEQ ID NO: 186050 - RNA, 23 nt, Human
aagcacuuugggaggccgaggca

SEQ ID NO: 186051 - RNA, 24 nt, Human
aagcacuuugggaggccgaggcag

SEQ ID NO: 186052 - RNA, 25 nt, Human
aagcacuuugggaggccgaggcagg

SEQ ID NO: 186053 - RNA, 21 nt, Human
aagcccccgaccccuuagcac

SEQ ID NO: 186054 - RNA, 22 nt, Human
aagcccccgaccccuuagcacc

SEQ ID NO: 186055 - RNA, 24 nt, Human
aagcgcucuaaaccccaaaggaaa

SEQ ID NO: 186056 - RNA, 26 nt, Human
aagugcugggaucacaagcgcgagcc

SEQ ID NO: 186057 - RNA, 20 nt, Human
aaugauuuaaggucagagga

SEQ ID NO: 186058 - RNA, 24 nt, Human
aauugcuugaacccgggaggcaga

SEQ ID NO: 186059 - RNA, 23 nt, Human
acacagagugagacucugucuca

SEQ ID NO: 186060 - RNA, 21 nt, Human
acacaugcuccacuccaugca

SEQ ID NO: 186061 - RNA, 21 nt, Human
acaccuguaauccaagcacuu

SEQ ID NO: 186062 - RNA, 24 nt, Human
acagagugagacucugucucaaaa

SEQ ID NO: 186063 - RNA, 18 nt, Human
accacucuaucuuccuca

SEQ ID NO: 186064 - RNA, 24 nt, Human
accccgucuguacuaaaaauacaa

SEQ ID NO: 186065 - RNA, 25 nt, Human
accccuuagcacgaguuaauucuaa

SEQ ID NO: 186066 - RNA, 24 nt, Human
acccugucucuacuaaaaauacaa

SEQ ID NO: 186067 - RNA, 21 nt, Human
accuguaauccaagcacuuug

SEQ ID NO: 186068 - RNA, 24 nt, Human
acuccagccugggacacagaguga

SEQ ID NO: 186069 - RNA, 18 nt, Human
acucuggaggcugagacu

SEQ ID NO: 186070 - RNA, 18 nt, Human
acugcacuccagccuggg

SEQ ID NO: 186071 - RNA, 24 nt, Human
acugcacuccagccugggacacag

SEQ ID NO: 186072 - RNA, 24 nt, Human
acugugccacugcacuccagccug

SEQ ID NO: 186073 - RNA, 23 nt, Human
agaaaggagcuagaguuggccug

SEQ ID NO: 186074 - RNA, 23 nt, Human
agaaggucagagcagauuguuuu

SEQ ID NO: 186075 - RNA, 22 nt, Human
agaauucuugccuuuacucuuc

SEQ ID NO: 186076 - RNA, 22 nt, Human
agacuauaggcaugcgccacca

SEQ ID NO: 186077 - RNA, 18 nt, Human
agagagugaacaugcccc

SEQ ID NO: 186078 - RNA, 22 nt, Human
agagcagcccagggagucccca

SEQ ID NO: 186079 - RNA, 21 nt, Human
agagccucauucggccugaaa

SEQ ID NO: 186080 - RNA, 18 nt, Human
agaggacaaaacugaugu

SEQ ID NO: 186081 - RNA, 18 nt, Human
agagguugcagugagccg

SEQ ID NO: 186082 - RNA, 24 nt, Human
agagguugcagugagccgagacug

SEQ ID NO: 186083 - RNA, 19 nt, Human
agcacucacccagcugcug

SEQ ID NO: 186084 - RNA, 24 nt, Human
agcacuuugggaggccgaggcagg

SEQ ID NO: 186085 - RNA, 18 nt, Human
agcagcccagggaguccc

SEQ ID NO: 186086 - RNA, 24 nt, Human
agccaggaaaugagagacccaggg

SEQ ID NO: 186087 - RNA, 24 nt, Human
agccagggcaaggaaacagauccc

SEQ ID NO: 186088 - RNA, 20 nt, Human
agcccagggaguccccacaa

SEQ ID NO: 186089 - RNA, 21 nt, Human
agccgagacugugccacugca

SEQ ID NO: 186090 - RNA, 24 nt, Human
agccgggcguggugguggggcgcc

SEQ ID NO: 186091 - RNA, 18 nt, Human
agccuggccaacauggca

SEQ ID NO: 186092 - RNA, 24 nt, Human
agccuggccaacauggcaaaaccc

SEQ ID NO: 186093 - RNA, 24 nt, Human
agccugggacacagagugagacuc

SEQ ID NO: 186094 - RNA, 21 nt, Human
aggcagagguugcagugagcc

SEQ ID NO: 186095 - RNA, 24 nt, Human
aggcagagguugcagugagccgag

SEQ ID NO: 186096 - RNA, 24 nt, Human
aggcaggagaauugcuugaacccg

SEQ ID NO: 186097 - RNA, 18 nt, Human
aggcaggcggaucacaag

SEQ ID NO: 186098 - RNA, 23 nt, Human
aggcaggcggaucacaagucagg

SEQ ID NO: 186099 - RNA, 18 nt, Human
aggcaggcggaucaccug

SEQ ID NO: 186100 - RNA, 26 nt, Human
aggcaggcggaucaccugaggucagg

SEQ ID NO: 186101 - RNA, 21 nt, Human
aggccgaggcaggcggaucac

SEQ ID NO: 186102 - RNA, 23 nt, Human
aggccgaggcaggcggaucacaa

SEQ ID NO: 186103 - RNA, 18 nt, Human
aggcggaucacaagucag

SEQ ID NO: 186104 - RNA, 20 nt, Human
aggcggaucacaagucagga

SEQ ID NO: 186105 - RNA, 21 nt, Human
aggcugaggcaggagaauugc

SEQ ID NO: 186106 - RNA, 24 nt, Human
aggcugaggcaggagaauugcuug

SEQ ID NO: 186107 - RNA, 20 nt, Human
aggggcgggggaauucaggc

SEQ ID NO: 186108 - RNA, 20 nt, Human
aggugauccgccucagucuc

SEQ ID NO: 186109 - RNA, 21 nt, Human
aucaacuggaaccuccccaaa

SEQ ID NO: 186110 - RNA, 22 nt, Human
augacacaggggaggccgggca

SEQ ID NO: 186111 - RNA, 23 nt, Human
augcgccaccacaccaggcuaau

SEQ ID NO: 186112 - RNA, 24 nt, Human
caaagugcugggaucacaagcgcg

SEQ ID NO: 186113 - RNA, 24 nt, Human
caacauggcaaaacccugucucua

SEQ ID NO: 186114 - RNA, 24 nt, Human
caaggcaggcggaucaccugaggu

SEQ ID NO: 186115 - RNA, 26 nt, Human
caaggcaggcggaucaccugagguca

SEQ ID NO: 186116 - RNA, 23 nt, Human
caaucaacuggaaccuccccaaa

SEQ ID NO: 186117 - RNA, 24 nt, Human
cacaagcgcgagccaccaugccca

SEQ ID NO: 186118 - RNA, 24 nt, Human
cacagagugagacucugucucaaa

SEQ ID NO: 186119 - RNA, 19 nt, Human
cacaguauacugccugcca

SEQ ID NO: 186120 - RNA, 21 nt, Human
caccacuuugggaggccaagg

SEQ ID NO: 186121 - RNA, 24 nt, Human
caccacuuugggaggccaaggcag

SEQ ID NO: 186122 - RNA, 20 nt, Human
cacccccccaaaaaacuuua

SEQ ID NO: 186123 - RNA, 23 nt, Human
caccuguaauccaagcacuuugg

SEQ ID NO: 186124 - RNA, 24 nt, Human
caccuguaauccaagcacuuuggg

SEQ ID NO: 186125 - RNA, 23 nt, Human
cacuaaaaauuacacaguauacu

SEQ ID NO: 186126 - RNA, 22 nt, Human
cacuccagccugggacacagag

SEQ ID NO: 186127 - RNA, 23 nt, Human
cacuccagccugggacacagagu

SEQ ID NO: 186128 - RNA, 24 nt, Human
cacuccagccugggacacagagug

SEQ ID NO: 186129 - RNA, 18 nt, Human
cacugcacuccagccugg

SEQ ID NO: 186130 - RNA, 19 nt, Human
cacugcacuccagccuggg

SEQ ID NO: 186131 - RNA, 19 nt, Human
cacugcacuccagccuggg

SEQ ID NO: 186132 - RNA, 24 nt, Human
cacugcacuccagccugggacaca

SEQ ID NO: 186133 - RNA, 22 nt, Human
cagagcagauuguuuuguuguu

SEQ ID NO: 186134 - RNA, 23 nt, Human
cagaggaacaacuuaagcgcucu

SEQ ID NO: 186135 - RNA, 20 nt, Human
cagauaagaaaaugcagcca

SEQ ID NO: 186136 - RNA, 24 nt, Human
cagcuacucgggaggcugaggcag

SEQ ID NO: 186137 - RNA, 24 nt, Human
caggcggaucaccugaggucagga

SEQ ID NO: 186138 - RNA, 19 nt, Human
cagggcaggggcagccugu

SEQ ID NO: 186139 - RNA, 21 nt, Human
caggggaggccgggcacggug

SEQ ID NO: 186140 - RNA, 24 nt, Human
caguagagacgagguuucuccaug

SEQ ID NO: 186141 - RNA, 24 nt, Human
caugcgccaccacaccaggcuaau

SEQ ID NO: 186142 - RNA, 21 nt, Human
cauucaaacacauauacccau

SEQ ID NO: 186143 - RNA, 25 nt, Human
cauucaacaaacauuuacugagcac

SEQ ID NO: 186144 - RNA, 21 nt, Human
cauuuggacaaaauguacaga

SEQ ID NO: 186145 - RNA, 19 nt, Human
cauuugggaaacucaugug

SEQ ID NO: 186146 - RNA, 19 nt, Human
cauuugggaaacucaugug

SEQ ID NO: 186147 - RNA, 19 nt, Human
ccaaagugcugggaucaca

SEQ ID NO: 186148 - RNA, 23 nt, Human
ccacuccaugcacauucuguccu

SEQ ID NO: 186149 - RNA, 19 nt, Human
ccacugcacuccagccugg

SEQ ID NO: 186150 - RNA, 20 nt, Human
ccacugcacuccagccuggg

SEQ ID NO: 186151 - RNA, 20 nt, Human
ccacugcacuccagccuggg

SEQ ID NO: 186152 - RNA, 21 nt, Human
ccacugcacuccagccuggga

SEQ ID NO: 186153 - RNA, 22 nt, Human
ccacugcacuccagccugggac

SEQ ID NO: 186154 - RNA, 22 nt, Human
ccaggaaaugagagacccaggg

SEQ ID NO: 186155 - RNA, 19 nt, Human
ccaugucggucaggcuggu

SEQ ID NO: 186156 - RNA, 20 nt, Human
ccauucaaacacauauaccc

SEQ ID NO: 186157 - RNA, 23 nt, Human
cccccaaaaaacuuuacugucac

SEQ ID NO: 186158 - RNA, 22 nt, Human
cccgcagucccagcuacucugg

SEQ ID NO: 186159 - RNA, 23 nt, Human
cccgcagucccagcuacucugga

SEQ ID NO: 186160 - RNA, 23 nt, Human
cccggcuaacacaaugaaacccc

SEQ ID NO: 186161 - RNA, 24 nt, Human
cccggcuaacacaaugaaaccccg

SEQ ID NO: 186162 - RNA, 24 nt, Human
ccgccucagucucccaaagugcug

SEQ ID NO: 186163 - RNA, 23 nt, Human
ccucaggugauccgccucagucu

SEQ ID NO: 186164 - RNA, 19 nt, Human
ccucuaaucccagcuacuc

SEQ ID NO: 186165 - RNA, 18 nt, Human
ccugaccucaggugaucc

SEQ ID NO: 186166 - RNA, 22 nt, Human
ccugaggucaggagcucgagac

SEQ ID NO: 186167 - RNA, 22 nt, Human
ccuggccaacauggcaaaaccc

SEQ ID NO: 186168 - RNA, 24 nt, Human
ccuggccaacauggcaaaacccug

SEQ ID NO: 186169 - RNA, 24 nt, Human
ccuguaauccaagcacuuugggag

SEQ ID NO: 186170 - RNA, 21 nt, Human
cgagaccagccuggccaacau

SEQ ID NO: 186171 - RNA, 27 nt, Human
cgaggcaggcggaucacaagucaggag

SEQ ID NO: 186172 - RNA, 20 nt, Human
cgaguuaauucuaagucacc

SEQ ID NO: 186173 - RNA, 24 nt, Human
cgcccgcagucccagcuacucugg

SEQ ID NO: 186174 - RNA, 24 nt, Human
cgccucuaaucccagcuacucggg

SEQ ID NO: 186175 - RNA, 27 nt, Human
cggaucaccugaggucaggagcucgag

SEQ ID NO: 186176 - RNA, 24 nt, Human
cgggaggcagagguugcagugagc

SEQ ID NO: 186177 - RNA, 20 nt, Human
cggguccugugugugugggu

SEQ ID NO: 186178 - RNA, 24 nt, Human
cggucaggcuggucuagaacuccu

SEQ ID NO: 186179 - RNA, 23 nt, Human
cgugaaaggaugaaagcucuuaa

SEQ ID NO: 186180 - RNA, 21 nt, Human
cuaacugccccauagccccua

SEQ ID NO: 186181 - RNA, 19 nt, Human
cuagccccccucccaacac

SEQ ID NO: 186182 - RNA, 19 nt, Human
cucaaaacaaaaacaaaca

SEQ ID NO: 186183 - RNA, 22 nt, Human
cucacgccugugaucccaccac

SEQ ID NO: 186184 - RNA, 24 nt, Human
cucacgccugugaucccaccacuu

SEQ ID NO: 186185 - RNA, 23 nt, Human
cuggaggcugagacuauaggcau

SEQ ID NO: 186186 - RNA, 19 nt, Human
cuguuucgagggguccagg

SEQ ID NO: 186187 - RNA, 24 nt, Human
gaccccuuagcacgaguuaauucu

SEQ ID NO: 186188 - RNA, 26 nt, Human
gaccucaggugauccgccucagucuc

SEQ ID NO: 186189 - RNA, 23 nt, Human
gagaauugcuugaacccgggagg

SEQ ID NO: 186190 - RNA, 23 nt, Human
gagacgagguuucuccaugucgg

SEQ ID NO: 186191 - RNA, 23 nt, Human
gagacugugccacugcacuccag

SEQ ID NO: 186192 - RNA, 20 nt, Human
gaggcugagacuauaggcau

SEQ ID NO: 186193 - RNA, 23 nt, Human
gaucacaagucaggagaucaaga

SEQ ID NO: 186194 - RNA, 18 nt, Human
gaucaccugaggucagga

SEQ ID NO: 186195 - RNA, 24 nt, Human
gaucaccugaggucaggagcucga

SEQ ID NO: 186196 - RNA, 24 nt, Human
gcacuccagccugggacacagagu

SEQ ID NO: 186197 - RNA, 24 nt, Human
gccaacauggcaaaacccugucuc

SEQ ID NO: 186198 - RNA, 24 nt, Human
gccccauucaaacacauauaccca

SEQ ID NO: 186199 - RNA, 23 nt, Human
gccucagucucccaaagugcugg

SEQ ID NO: 186200 - RNA, 24 nt, Human
gccucagucucccaaagugcuggg

SEQ ID NO: 186201 - RNA, 20 nt, Human
gcgguggcuuacaccuguaa

SEQ ID NO: 186202 - RNA, 22 nt, Human
gcuccacuccaugcacauucug

SEQ ID NO: 186203 - RNA, 23 nt, Human
gcuggucuagaacuccugaccuc

SEQ ID NO: 186204 - RNA, 23 nt, Human
ggagcccgucucacaagccgccu

SEQ ID NO: 186205 - RNA, 24 nt, Human
ggaggccgggcacgguggcucacg

SEQ ID NO: 186206 - RNA, 18 nt, Human
ggaucaccugaggucagg

SEQ ID NO: 186207 - RNA, 24 nt, Human
ggcugggcggggugcgguggcuua

SEQ ID NO: 186208 - RNA, 24 nt, Human
ggcuggucuagaacuccugaccuc

SEQ ID NO: 186209 - RNA, 18 nt, Human
gggcacgguggcucacgc

SEQ ID NO: 186210 - RNA, 24 nt, Human
gggcacgguggcucacgccuguga

SEQ ID NO: 186211 - RNA, 19 nt, Human
gggugcgguggcuuacacc

SEQ ID NO: 186212 - RNA, 25 nt, Human
gguacacauuugggaaacucaugug

SEQ ID NO: 186213 - RNA, 23 nt, Human
gguggcucacgccugugauccca

SEQ ID NO: 186214 - RNA, 24 nt, Human
gguggcuuacaccuguaauccaag

SEQ ID NO: 186215 - RNA, 19 nt, Human
guccgggugcagagcagcc

SEQ ID NO: 186216 - RNA, 20 nt, Human
gugauccgccucagucuccc

SEQ ID NO: 186217 - RNA, 18 nt, Human
guuccuagccccccuccc

SEQ ID NO: 186218 - RNA, 24 nt, Human
guugcagugagccgagacugugcc

SEQ ID NO: 186219 - RNA, 26 nt, Human
uaaaaugacacaggggaggccgggca

SEQ ID NO: 186220 - RNA, 18 nt, Human
uaaaccccaaaggaaaug

SEQ ID NO: 186221 - RNA, 21 nt, Human
uaacuucucuguccccacccc

SEQ ID NO: 186222 - RNA, 22 nt, Human
uaacuucucuguccccaccccc

SEQ ID NO: 186223 - RNA, 24 nt, Human
uaagucaccacucuaucuuccuca

SEQ ID NO: 186224 - RNA, 24 nt, Human
uacaccuguaauccaagcacuuug

SEQ ID NO: 186225 - RNA, 20 nt, Human
uagaguccucuguuucgagg

SEQ ID NO: 186226 - RNA, 24 nt, Human
uagccggguguguuggcuggcgcc

SEQ ID NO: 186227 - RNA, 25 nt, Human
uaggaaaugcugcuaacugccccau

SEQ ID NO: 186228 - RNA, 21 nt, Human
ucaaaagcaauuauaaaagca

SEQ ID NO: 186229 - RNA, 26 nt, Human
ucaacaaacauuuacugagcaccugc

SEQ ID NO: 186230 - RNA, 19 nt, Human
ucaauagaucccaaucuaa

SEQ ID NO: 186231 - RNA, 23 nt, Human
ucaaucaacuggaaccuccccaa

SEQ ID NO: 186232 - RNA, 19 nt, Human
ucaccugaggucaggagcu

SEQ ID NO: 186233 - RNA, 24 nt, Human
ucaguagagacgagguuucuccau

SEQ ID NO: 186234 - RNA, 19 nt, Human
ucaucacccaggaugcggg

SEQ ID NO: 186235 - RNA, 23 nt, Human
uccagccugggacacagagugag

SEQ ID NO: 186236 - RNA, 24 nt, Human
uccagccugggacacagagugaga

SEQ ID NO: 186237 - RNA, 25 nt, Human
uccaugcacauucuguccccugcca

SEQ ID NO: 186238 - RNA, 18 nt, Human
ucccaaagugcugggauc

SEQ ID NO: 186239 - RNA, 26 nt, Human
ucccaacacacacaugcuccacucca

SEQ ID NO: 186240 - RNA, 21 nt, Human
ucccaaucuaaagagccucau

SEQ ID NO: 186241 - RNA, 18 nt, Human
ucccaccacuuugggagg

SEQ ID NO: 186242 - RNA, 21 nt, Human
uccccacccccccaaaaaacu

SEQ ID NO: 186243 - RNA, 23 nt, Human
uccccacccccccaaaaaacuuu

SEQ ID NO: 186244 - RNA, 18 nt, Human
uccccagguaacugaggg

SEQ ID NO: 186245 - RNA, 23 nt, Human
uccccagguaacugaggggcggg

SEQ ID NO: 186246 - RNA, 21 nt, Human
uccgugaaaggaugaaagcuc

SEQ ID NO: 186247 - RNA, 23 nt, Human
ucgggaggcugaggcaggagaau

SEQ ID NO: 186248 - RNA, 21 nt, Human
ucucuacuaaaaauacaaaaa

SEQ ID NO: 186249 - RNA, 24 nt, Human
ucuguacuaaaaauacaaaaaauu

SEQ ID NO: 186250 - RNA, 20 nt, Human
ucuugggcuaccaggaaguc

SEQ ID NO: 186251 - RNA, 19 nt, Human
ugaaagcucuuaacuucuc

SEQ ID NO: 186252 - RNA, 21 nt, Human
ugaccucaggugauccgccuc

SEQ ID NO: 186253 - RNA, 22 nt, Human
ugaccucaggugauccgccuca

SEQ ID NO: 186254 - RNA, 22 nt, Human
ugacugagcccgguuucuguuu

SEQ ID NO: 186255 - RNA, 24 nt, Human
ugagaaccauguucaccacuuugg

SEQ ID NO: 186256 - RNA, 20 nt, Human
ugagaaggaugcaguucaug

SEQ ID NO: 186257 - RNA, 21 nt, Human
ugagacuauaggcaugcgcca

SEQ ID NO: 186258 - RNA, 24 nt, Human
ugagacuauaggcaugcgccacca

SEQ ID NO: 186259 - RNA, 25 nt, Human
ugagauaaggaaugauuuaagguca

SEQ ID NO: 186260 - RNA, 22 nt, Human
ugagccgagacugugccacugc

SEQ ID NO: 186261 - RNA, 24 nt, Human
ugaggcaggagaauugcuugaacc

SEQ ID NO: 186262 - RNA, 25 nt, Human
ugaggcaggagaauugcuugaaccc

SEQ ID NO: 186263 - RNA, 18 nt, Human
ugcccaacccccagaagu

SEQ ID NO: 186264 - RNA, 26 nt, Human
ugcugggaucacaagcgcgagccacc

SEQ ID NO: 186265 - RNA, 23 nt, Human
ugcugguaagaauucuugccuuu

SEQ ID NO: 186266 - RNA, 21 nt, Human
uggaggcugagacuauaggca

SEQ ID NO: 186267 - RNA, 18 nt, Human
uggaugcugccacagcag

SEQ ID NO: 186268 - RNA, 18 nt, Human
uggcaagguucuuaagug

SEQ ID NO: 186269 - RNA, 24 nt, Human
uggccaacauggcaaaacccuguc

SEQ ID NO: 186270 - RNA, 24 nt, Human
uggcucacgccugugaucccacca

SEQ ID NO: 186271 - RNA, 19 nt, Human
uggcuuacaccuguaaucc

SEQ ID NO: 186272 - RNA, 20 nt, Human
uggcuuacaccuguaaucca

SEQ ID NO: 186273 - RNA, 21 nt, Human
ugggacacagagugagacucu

SEQ ID NO: 186274 - RNA, 24 nt, Human
ugggaggccaaggcaggcggauca

SEQ ID NO: 186275 - RNA, 20 nt, Human
ugggaggccgaggcaggcgg

SEQ ID NO: 186276 - RNA, 24 nt, Human
ugggaggccgaggcaggcggauca

SEQ ID NO: 186277 - RNA, 22 nt, Human
ugggaucacaagcgcgagccac

SEQ ID NO: 186278 - RNA, 24 nt, Human
ugggaucacaagcgcgagccacca

SEQ ID NO: 186279 - RNA, 23 nt, Human
uggucuagaacuccugaccucag

SEQ ID NO: 186280 - RNA, 18 nt, Human
uguguggguuggaugcug

SEQ ID NO: 186281 - RNA, 18 nt, Human
uuagccgggcgugguggu

SEQ ID NO: 186282 - RNA, 25 nt, Human
uuagccgggcguggugguggggcgc

SEQ ID NO: 186283 - RNA, 25 nt, Human
uuagccggguguguuggcuggcgcc

SEQ ID NO: 186284 - RNA, 19 nt, Human
uucaucacccaggaugcgg

SEQ ID NO: 186285 - RNA, 19 nt, Human
uugcagugagccgagacug

SEQ ID NO: 186286 - RNA, 22 nt, Human
uugcagugagccgagacugugc

SEQ ID NO: 186287 - RNA, 18 nt, Human
uugcuugaacccgggagg

SEQ ID NO: 186288 - RNA, 24 nt, Human
uugcuugaacccgggaggcagagg

SEQ ID NO: 186289 - RNA, 25 nt, Human
uugggaggccgaggcaggcggauca

SEQ ID NO: 186290 - RNA, 21 nt, Human
uuguagcuugagaaaggagcu

SEQ ID NO: 186291 - RNA, 20 nt, Human
uuguuguuguucuucuuggg

SEQ ID NO: 186292 - RNA, 20 nt, Human
uuugaagaaggucagagcag

SEQ ID NO: 186293 - RNA, 19 nt, Human
aaaaugcccacauguguua

SEQ ID NO: 186294 - RNA, 20 nt, Human
aggagacaguccugaauucu

SEQ ID NO: 186295 - RNA, 20 nt, Human
auucuccuauuaccuggcca

SEQ ID NO: 186296 - RNA, 22 nt, Human
caacucacccaaagagcagucc

SEQ ID NO: 186297 - RNA, 20 nt, Human
ccacauguguuauuucaccu

SEQ ID NO: 186298 - RNA, 20 nt, Human
gggcagucuagggcugaaac

SEQ ID NO: 186299 - RNA, 22 nt, Human
ugaguuucucagccuucaauuc

SEQ ID NO: 186300 - RNA, 18 nt, Human
ugggaggcuggggagaga

SEQ ID NO: 186301 - RNA, 19 nt, Human
ugggaggcuggggagagau

SEQ ID NO: 186302 - RNA, 21 nt, Human
ugggaggcuggggagagauug

SEQ ID NO: 186303 - RNA, 23 nt, Human
uucuuucuauaauggaagaaguu

SEQ ID NO: 186304 - RNA, 25 nt, Human
uuuuuuuuuuucuuuuuuuauuuuu

SEQ ID NO: 186305 - RNA, 25 nt, Human
uuuuuuuuuuuuuuuuuuucuuuuu

SEQ ID NO: 186306 - RNA, 23 nt, Human
aaaaaaauaaacuucacaaaaac

SEQ ID NO: 186307 - RNA, 27 nt, Human
aaaacaacagaaagcaaaccgguaccc

SEQ ID NO: 186308 - RNA, 22 nt, Human
aaaaccaaccaauaaacaaaac

SEQ ID NO: 186309 - RNA, 24 nt, Human
aaacaaaaauaauaacuuuuucua

SEQ ID NO: 186310 - RNA, 19 nt, Human
aaacaaaacaacagaaagc

SEQ ID NO: 186311 - RNA, 21 nt, Human
aaacaaaacaacagaaagcaa

SEQ ID NO: 186312 - RNA, 22 nt, Human
aaacaaaacaacagaaagcaaa

SEQ ID NO: 186313 - RNA, 20 nt, Human
aaaccaugugagaaaaaaag

SEQ ID NO: 186314 - RNA, 19 nt, Human
aaaggaaccguucccggug

SEQ ID NO: 186315 - RNA, 20 nt, Human
aaagugugauauuccaauaa

SEQ ID NO: 186316 - RNA, 21 nt, Human
aaauaaugcuuuuacagauaa

SEQ ID NO: 186317 - RNA, 26 nt, Human
aaauaccagaaaucauaauauaagcu

SEQ ID NO: 186318 - RNA, 26 nt, Human
aacaaaacaacagaaagcaaacaaaa

SEQ ID NO: 186319 - RNA, 22 nt, Human
aacaacagaaagcaaacaaaaa

SEQ ID NO: 186320 - RNA, 22 nt, Human
aaccaauaaacaaaacaacaga

SEQ ID NO: 186321 - RNA, 22 nt, Human
aaccauugaaacauuucauuga

SEQ ID NO: 186322 - RNA, 23 nt, Human
aaccauugaaacauuucauugau

SEQ ID NO: 186323 - RNA, 19 nt, Human
aagaaacuuagggcagugg

SEQ ID NO: 186324 - RNA, 20 nt, Human
aagaaacuuagggcaguggu

SEQ ID NO: 186325 - RNA, 23 nt, Human
aaguaaacucuaauuggaaccaa

SEQ ID NO: 186326 - RNA, 19 nt, Human
aaguucacacaucuguauc

SEQ ID NO: 186327 - RNA, 23 nt, Human
aaugaaacaaaaaauaaaaaucu

SEQ ID NO: 186328 - RNA, 18 nt, Human
acaaaaaccaaccaauaa

SEQ ID NO: 186329 - RNA, 26 nt, Human
acaaaacaacagaaagcaaacaaaaa

SEQ ID NO: 186330 - RNA, 19 nt, Human
acaacuucccaguucuccu

SEQ ID NO: 186331 - RNA, 22 nt, Human
accacagacaccacaaagccug

SEQ ID NO: 186332 - RNA, 26 nt, Human
acuuuauaccaaaucaacaaaaacca

SEQ ID NO: 186333 - RNA, 23 nt, Human
agaaugagacucacagacucuaa

SEQ ID NO: 186334 - RNA, 19 nt, Human
aguggauuacaguacuuua

SEQ ID NO: 186335 - RNA, 26 nt, Human
caaaaaccacauaauacaaccuucag

SEQ ID NO: 186336 - RNA, 24 nt, Human
caaaacaacagaaagcaaacaaaa

SEQ ID NO: 186337 - RNA, 22 nt, Human
caaaacaauaguaguaugaaaa

SEQ ID NO: 186338 - RNA, 20 nt, Human
caaccaauaaacaaaacaac

SEQ ID NO: 186339 - RNA, 18 nt, Human
caacuucccaguucuccu

SEQ ID NO: 186340 - RNA, 24 nt, Human
caauguaaaacgucugcuucuuuu

SEQ ID NO: 186341 - RNA, 21 nt, Human
cacaaaaaccaaccaauaaac

SEQ ID NO: 186342 - RNA, 21 nt, Human
cacaaagagaacugaucugau

SEQ ID NO: 186343 - RNA, 25 nt, Human
cacaaauugugcaggaugucauacu

SEQ ID NO: 186344 - RNA, 19 nt, Human
cacaaggcuaaagauuuac

SEQ ID NO: 186345 - RNA, 23 nt, Human
cacacaucuguaucuuaaagaau

SEQ ID NO: 186346 - RNA, 23 nt, Human
cacagacaccacaaagccugaca

SEQ ID NO: 186347 - RNA, 19 nt, Human
cagaaaguauaaacaagac

SEQ ID NO: 186348 - RNA, 23 nt, Human
cagccucagucaagucucaugau

SEQ ID NO: 186349 - RNA, 23 nt, Human
cagcugacuuaaaauauaaacau

SEQ ID NO: 186350 - RNA, 24 nt, Human
caguaagcccuaaccaguccaaac

SEQ ID NO: 186351 - RNA, 23 nt, Human
caucuguaucuuaaagaaugaga

SEQ ID NO: 186352 - RNA, 20 nt, Human
cauugaaacauuucauugau

SEQ ID NO: 186353 - RNA, 20 nt, Human
ccaaauccuuaaaacugcug

SEQ ID NO: 186354 - RNA, 21 nt, Human
ccaaauccuuaaaacugcuga

SEQ ID NO: 186355 - RNA, 19 nt, Human
ccaaccaauaaacaaaaca

SEQ ID NO: 186356 - RNA, 19 nt, Human
ccauacauuuuacugaaaa

SEQ ID NO: 186357 - RNA, 23 nt, Human
cccuugacagcugacuuaaaaua

SEQ ID NO: 186358 - RNA, 24 nt, Human
cugaaugugcagaaaguauaaaca

SEQ ID NO: 186359 - RNA, 18 nt, Human
gagaaaaaaaggaaaaag

SEQ ID NO: 186360 - RNA, 18 nt, Human
gagcauuuagcacugaua

SEQ ID NO: 186361 - RNA, 19 nt, Human
gaugauaccacagacaccc

SEQ ID NO: 186362 - RNA, 23 nt, Human
gcaacaacuucccaguucuccua

SEQ ID NO: 186363 - RNA, 23 nt, Human
gcuacaagaaucaaaaagcaaaa

SEQ ID NO: 186364 - RNA, 24 nt, Human
gggccacaauugcucagcagagaa

SEQ ID NO: 186365 - RNA, 21 nt, Human
gugccaaaaauguaaaacuua

SEQ ID NO: 186366 - RNA, 20 nt, Human
uaaacaaaacaacagaaagc

SEQ ID NO: 186367 - RNA, 26 nt, Human
uaagcaacaacuucccaguucuccua

SEQ ID NO: 186368 - RNA, 20 nt, Human
uaaggcuguggucuccccuu

SEQ ID NO: 186369 - RNA, 24 nt, Human
uacaagaaucaaaaagcaaaacca

SEQ ID NO: 186370 - RNA, 25 nt, Human
uacaagaaucaaaaagcaaaaccau

SEQ ID NO: 186371 - RNA, 23 nt, Human
uacaaggcgguuuuuaaagugug

SEQ ID NO: 186372 - RNA, 23 nt, Human
uaccaaaaaaaaaauaaacuuca

SEQ ID NO: 186373 - RNA, 26 nt, Human
uaccaaaaaaaaaauaaacuucacaa

SEQ ID NO: 186374 - RNA, 21 nt, Human
uaccaaaucaacaaaaaccac

SEQ ID NO: 186375 - RNA, 22 nt, Human
uaccacagacaccacaaagccu

SEQ ID NO: 186376 - RNA, 23 nt, Human
uaccacagacaccacaaagccug

SEQ ID NO: 186377 - RNA, 23 nt, Human
uagauaacccuuuaaggcaacau

SEQ ID NO: 186378 - RNA, 19 nt, Human
uagaugcaugaccaugacc

SEQ ID NO: 186379 - RNA, 19 nt, Human
uaggauuauaggugaacua

SEQ ID NO: 186380 - RNA, 21 nt, Human
uaggauuauaggugaacuauu

SEQ ID NO: 186381 - RNA, 23 nt, Human
uauaaacaagacugugccuucag

SEQ ID NO: 186382 - RNA, 19 nt, Human
uauaagaacaaggaaaaga

SEQ ID NO: 186383 - RNA, 21 nt, Human
uauaagaacaaggaaaagaua

SEQ ID NO: 186384 - RNA, 24 nt, Human
uauuaugucaguuuaucagcauua

SEQ ID NO: 186385 - RNA, 23 nt, Human
uauugauauucucuuuacagaag

SEQ ID NO: 186386 - RNA, 18 nt, Human
ucaagaaaauuaacaggc

SEQ ID NO: 186387 - RNA, 18 nt, Human
uccaauaauucauuggca

SEQ ID NO: 186388 - RNA, 19 nt, Human
uccccagaacuuacaaggc

SEQ ID NO: 186389 - RNA, 20 nt, Human
ucccuuggcuauuugcucca

SEQ ID NO: 186390 - RNA, 21 nt, Human
ucccuuggcuauuugcuccag

SEQ ID NO: 186391 - RNA, 20 nt, Human
uccgaagaguuuuguuugug

SEQ ID NO: 186392 - RNA, 21 nt, Human
uccucuuuucuuccacuuguu

SEQ ID NO: 186393 - RNA, 20 nt, Human
ucuaaaauaccagaaaucau

SEQ ID NO: 186394 - RNA, 21 nt, Human
ucuaugguacuaugcuccaaa

SEQ ID NO: 186395 - RNA, 24 nt, Human
ucucuaaauacuacuggcauuuaa

SEQ ID NO: 186396 - RNA, 19 nt, Human
ucugcagucaugcuuccuc

SEQ ID NO: 186397 - RNA, 25 nt, Human
ucuuacaaguuguauauuuagaacc

SEQ ID NO: 186398 - RNA, 21 nt, Human
ucuucaaacuucuaaaauuag

SEQ ID NO: 186399 - RNA, 22 nt, Human
ugaaaauauaauccacaaagag

SEQ ID NO: 186400 - RNA, 20 nt, Human
ugaacuauugcaaagacugc

SEQ ID NO: 186401 - RNA, 23 nt, Human
ugaauuggaaaaacuuuauacca

SEQ ID NO: 186402 - RNA, 19 nt, Human
ugaccaguuacugauuuga

SEQ ID NO: 186403 - RNA, 22 nt, Human
ugaucugcagucaugcuuccuc

SEQ ID NO: 186404 - RNA, 21 nt, Human
ugcaaaggaaccguucccggu

SEQ ID NO: 186405 - RNA, 24 nt, Human
ugcagaaaguauaaacaagacugg

SEQ ID NO: 186406 - RNA, 23 nt, Human
ugcauuauuagaacugcucaguu

SEQ ID NO: 186407 - RNA, 22 nt, Human
ugcccaaauccuuaaaacugcc

SEQ ID NO: 186408 - RNA, 24 nt, Human
ugcuuuuugcuuuauaauaaucug

SEQ ID NO: 186409 - RNA, 25 nt, Human
uggaauauaguagcuacaagaauca

SEQ ID NO: 186410 - RNA, 19 nt, Human
uggcagucagcaggaucac

SEQ ID NO: 186411 - RNA, 22 nt, Human
uggcagucagcaggaucacucu

SEQ ID NO: 186412 - RNA, 22 nt, Human
uggggagagagauugcuucugu

SEQ ID NO: 186413 - RNA, 19 nt, Human
uguaaggcuuuccagaaau

SEQ ID NO: 186414 - RNA, 26 nt, Human
uguuuuaaagucuucaaacuucuaaa

SEQ ID NO: 186415 - RNA, 18 nt, Human
uuacugauuugauuuccc

SEQ ID NO: 186416 - RNA, 20 nt, Human
uuagaugcaugaccaugacc

SEQ ID NO: 186417 - RNA, 21 nt, Human
uuagucuuugcaaaacaauag

SEQ ID NO: 186418 - RNA, 20 nt, Human
uuauuagaacugcucaguug

SEQ ID NO: 186419 - RNA, 24 nt, Human
uucacaaggcuaaagauuuacaga

SEQ ID NO: 186420 - RNA, 23 nt, Human
uucuuaauuacaaaccuuugcug

SEQ ID NO: 186421 - RNA, 20 nt, Human
uugaaacauuucauugauuu

SEQ ID NO: 186422 - RNA, 18 nt, Human
uugcuuuauaauaaucug

SEQ ID NO: 186423 - RNA, 21 nt, Human
uuuaaagucuucaaacuucua

SEQ ID NO: 186424 - RNA, 25 nt, Human
uuucuuauuuuaccauuuccgaaga

SEQ ID NO: 186425 - RNA, 28 nt, Human
aaaauaccaagguaaauaaauacaagca

SEQ ID NO: 186426 - RNA, 18 nt, Human
aaacaucuguagaccaug

SEQ ID NO: 186427 - RNA, 21 nt, Human
aaccccuggcugcaguuuucc

SEQ ID NO: 186428 - RNA, 27 nt, Human
aagaaagaaagaaauaaugaccucuag

SEQ ID NO: 186429 - RNA, 26 nt, Human
aagguaaauaaauacaagcaggguca

SEQ ID NO: 186430 - RNA, 21 nt, Human
acccaggauuucagaggucuu

SEQ ID NO: 186431 - RNA, 24 nt, Human
acccuaucacacacccaaacaggg

SEQ ID NO: 186432 - RNA, 23 nt, Human
agaaaauccuuuacccaggauuu

SEQ ID NO: 186433 - RNA, 23 nt, Human
agaaagaaauaaugaccucuagu

SEQ ID NO: 186434 - RNA, 18 nt, Human
agaaagccacauuuuacu

SEQ ID NO: 186435 - RNA, 24 nt, Human
agauggauaagagucuuccaagug

SEQ ID NO: 186436 - RNA, 19 nt, Human
agcuaggagguaaggccag

SEQ ID NO: 186437 - RNA, 23 nt, Human
agguaaauaaauacaagcagggu

SEQ ID NO: 186438 - RNA, 23 nt, Human
aguuacuaaaagaguagauacaa

SEQ ID NO: 186439 - RNA, 19 nt, Human
auccaacacuuucaauaga

SEQ ID NO: 186440 - RNA, 24 nt, Human
augaaacaaucucuccuuucagau

SEQ ID NO: 186441 - RNA, 24 nt, Human
caaaagaaaacaaaaagcccuuca

SEQ ID NO: 186442 - RNA, 25 nt, Human
caagaaaaaauaccaagguaaauaa

SEQ ID NO: 186443 - RNA, 20 nt, Human
cagagcuuaacuacuccuuu

SEQ ID NO: 186444 - RNA, 18 nt, Human
caucaauaaauagaaguu

SEQ ID NO: 186445 - RNA, 23 nt, Human
caucccuuucaaccccuggcugc

SEQ ID NO: 186446 - RNA, 21 nt, Human
cauggaccaagugaugacaac

SEQ ID NO: 186447 - RNA, 19 nt, Human
caugucugucucucaagaa

SEQ ID NO: 186448 - RNA, 19 nt, Human
ccagaaagguaggcaaguu

SEQ ID NO: 186449 - RNA, 21 nt, Human
cccuaucacacacccaaacag

SEQ ID NO: 186450 - RNA, 20 nt, Human
ccuuagucuuuuccaaaaug

SEQ ID NO: 186451 - RNA, 21 nt, Human
cuacggaagucucaucaauaa

SEQ ID NO: 186452 - RNA, 22 nt, Human
cuccuuagucuuuuccaaaaug

SEQ ID NO: 186453 - RNA, 23 nt, Human
gaaaauccuuuacccaggauuuc

SEQ ID NO: 186454 - RNA, 19 nt, Human
gaacccuaucacacaccca

SEQ ID NO: 186455 - RNA, 20 nt, Human
gaagauguagacucuuaucc

SEQ ID NO: 186456 - RNA, 18 nt, Human
gacagcauacagaggagg

SEQ ID NO: 186457 - RNA, 21 nt, Human
gacccacuucaguuccucaga

SEQ ID NO: 186458 - RNA, 20 nt, Human
gaggaggguggggcaggggg

SEQ ID NO: 186459 - RNA, 21 nt, Human
gaguagauacaaaggucagga

SEQ ID NO: 186460 - RNA, 23 nt, Human
gaguugggcguuuuuuuuuucuu

SEQ ID NO: 186461 - RNA, 19 nt, Human
gauaagagucuuccaagug

SEQ ID NO: 186462 - RNA, 24 nt, Human
ggccauggaagaaaacgugggcuu

SEQ ID NO: 186463 - RNA, 23 nt, Human
guauuaugggagauaccaagaaa

SEQ ID NO: 186464 - RNA, 19 nt, Human
guauuuuuucuagaagaug

SEQ ID NO: 186465 - RNA, 23 nt, Human
uaaaagaguagauacaaagguca

SEQ ID NO: 186466 - RNA, 18 nt, Human
uaacacagcauucucaca

SEQ ID NO: 186467 - RNA, 26 nt, Human
uaccaauaaacauauauacaaacaaa

SEQ ID NO: 186468 - RNA, 22 nt, Human
uauagcuaacuagaaaaggggg

SEQ ID NO: 186469 - RNA, 21 nt, Human
uauauacaaacaaaagaaaac

SEQ ID NO: 186470 - RNA, 21 nt, Human
ucaggaaguaauuacaaugca

SEQ ID NO: 186471 - RNA, 26 nt, Human
uccaacacuuucaauagauguguuga

SEQ ID NO: 186472 - RNA, 20 nt, Human
ucuucaagucugcauccccu

SEQ ID NO: 186473 - RNA, 25 nt, Human
ucuuccaaguguaccagggggaaau

SEQ ID NO: 186474 - RNA, 25 nt, Human
ucuugaaauuaaaaaaaaaaaaaag

SEQ ID NO: 186475 - RNA, 24 nt, Human
ugaaauuaaaaaaaaaaaaaagaa

SEQ ID NO: 186476 - RNA, 25 nt, Human
ugaauuguacacacuuaagguguaa

SEQ ID NO: 186477 - RNA, 23 nt, Human
ugacccacuucaguuccucagac

SEQ ID NO: 186478 - RNA, 19 nt, Human
ugagaacccuaucacacac

SEQ ID NO: 186479 - RNA, 23 nt, Human
ugagaacccuaucacacacccaa

SEQ ID NO: 186480 - RNA, 18 nt, Human
ugagaagguguuuggagg

SEQ ID NO: 186481 - RNA, 22 nt, Human
ugagaagguguuuggaggggag

SEQ ID NO: 186482 - RNA, 23 nt, Human
ugagaagguguuuggaggggagg

SEQ ID NO: 186483 - RNA, 21 nt, Human
ugaggaggguggggcaggggg

SEQ ID NO: 186484 - RNA, 25 nt, Human
ugcaagaaaaaauaccaagguaaau

SEQ ID NO: 186485 - RNA, 21 nt, Human
ugggcguuuuuuuuuucuuuc

SEQ ID NO: 186486 - RNA, 21 nt, Human
uggggcagggggauagggguu

SEQ ID NO: 186487 - RNA, 22 nt, Human
uggggcagggggauagggguuc

SEQ ID NO: 186488 - RNA, 18 nt, Human
uggguuugaggugauggu

SEQ ID NO: 186489 - RNA, 22 nt, Human
uuaacauccugcauuuauccaa

SEQ ID NO: 186490 - RNA, 21 nt, Human
uucaagagauggauaaguagc

SEQ ID NO: 186491 - RNA, 21 nt, Human
uucuccuuagucuuuuccaaa

SEQ ID NO: 186492 - RNA, 24 nt, Human
uucuccuuagucuuuuccaaaaug

SEQ ID NO: 186493 - RNA, 20 nt, Human
uuggguuugaggugauggug

SEQ ID NO: 186494 - RNA, 22 nt, Human
uuuaacauuuuuagcggaugca

SEQ ID NO: 186495 - RNA, 18 nt, Human
uuuccacauuaucuacgg

SEQ ID NO: 186496 - RNA, 20 nt, Human
uuucuagaagauguagacuc

SEQ ID NO: 186497 - RNA, 21 nt, Human
cuucaaguugaaacagguuuc

SEQ ID NO: 186498 - RNA, 23 nt, Human
uacggugucuucaaguugaaaca

SEQ ID NO: 186499 - RNA, 18 nt, Human
ugugguggcuggcugucc

SEQ ID NO: 186500 - RNA, 23 nt, Human
uuccugguuugauuucuuucauu

SEQ ID NO: 186501 - RNA, 19 nt, Human
accuaguauuuuggaguua

SEQ ID NO: 186502 - RNA, 19 nt, Human
aguuacaugcccaaacaua

SEQ ID NO: 186503 - RNA, 24 nt, Human
gaggaagaaaccaguacauucuug

SEQ ID NO: 186504 - RNA, 23 nt, Human
uaacuggcuuacagauucaucug

SEQ ID NO: 186505 - RNA, 23 nt, Human
ucaaaugcagacaacuuguugcu

SEQ ID NO: 186506 - RNA, 25 nt, Human
ucgucccauucuuuucacauacucu

SEQ ID NO: 186507 - RNA, 18 nt, Human
ugaccagugaucaaaugc

SEQ ID NO: 186508 - RNA, 24 nt, Human
uuuuuacaaucugaccagugauca

SEQ ID NO: 186509 - RNA, 18 nt, Human
aaaauaucccccacaccc

SEQ ID NO: 186510 - RNA, 27 nt, Human
aaaauaucccccacacccuccaaaagc

SEQ ID NO: 186511 - RNA, 23 nt, Human
aaaccaaaacaaaauauccccca

SEQ ID NO: 186512 - RNA, 19 nt, Human
aacagugguugaucacuuu

SEQ ID NO: 186513 - RNA, 21 nt, Human
aaccaaaacaaaauauccccc

SEQ ID NO: 186514 - RNA, 20 nt, Human
aaccugcagaaaaaccaaaa

SEQ ID NO: 186515 - RNA, 22 nt, Human
aagagccccauagaaggaacag

SEQ ID NO: 186516 - RNA, 18 nt, Human
aagcaacaagaaacccuc

SEQ ID NO: 186517 - RNA, 22 nt, Human
acaaaauaucccccacacccuc

SEQ ID NO: 186518 - RNA, 26 nt, Human
acaaaauaucccccacacccuccaaa

SEQ ID NO: 186519 - RNA, 19 nt, Human
acagucuucccagccacau

SEQ ID NO: 186520 - RNA, 18 nt, Human
acagugcagagaacaugg

SEQ ID NO: 186521 - RNA, 22 nt, Human
acccucaugugauccauuccau

SEQ ID NO: 186522 - RNA, 19 nt, Human
accuuggaaucccacccac

SEQ ID NO: 186523 - RNA, 18 nt, Human
agacauuagagcaagagc

SEQ ID NO: 186524 - RNA, 18 nt, Human
agaggauuuggagauaca

SEQ ID NO: 186525 - RNA, 18 nt, Human
agccgguggcaaaguccc

SEQ ID NO: 186526 - RNA, 24 nt, Human
agcggucaguccucccccggcccc

SEQ ID NO: 186527 - RNA, 23 nt, Human
aggauuuccaaauuuccuggcug

SEQ ID NO: 186528 - RNA, 22 nt, Human
agggacugcugccccaagccag

SEQ ID NO: 186529 - RNA, 21 nt, Human
aguaucugcagaaggacccac

SEQ ID NO: 186530 - RNA, 22 nt, Human
agugcagagaacaugggggcuu

SEQ ID NO: 186531 - RNA, 19 nt, Human
aguguaggaacagggcgag

SEQ ID NO: 186532 - RNA, 25 nt, Human
auggaaccugcagaaaaaccaaaac

SEQ ID NO: 186533 - RNA, 22 nt, Human
caaaagcaacaagaaacccuca

SEQ ID NO: 186534 - RNA, 22 nt, Human
caaaauaucccccacacccucc

SEQ ID NO: 186535 - RNA, 20 nt, Human
caaaguccccauuuguccuc

SEQ ID NO: 186536 - RNA, 22 nt, Human
caagaaacccucaugugaucca

SEQ ID NO: 186537 - RNA, 23 nt, Human
caagaggcuaccugggguccagc

SEQ ID NO: 186538 - RNA, 24 nt, Human
caagaggcuaccugggguccagca

SEQ ID NO: 186539 - RNA, 20 nt, Human
cacacccuccaaaagcaaca

SEQ ID NO: 186540 - RNA, 30 nt, Human
caccccacgauucaguugggccucaccuuu

SEQ ID NO: 186541 - RNA, 23 nt, Human
caccuuggaaucccacccacaac

SEQ ID NO: 186542 - RNA, 25 nt, Human
cacuucaucacccagagggccucuu

SEQ ID NO: 186543 - RNA, 18 nt, Human
cagaaaaaccaaaacaaa

SEQ ID NO: 186544 - RNA, 19 nt, Human
caguccucccccggccccc

SEQ ID NO: 186545 - RNA, 23 nt, Human
cauuuuucuuuaaagguuaaagg

SEQ ID NO: 186546 - RNA, 22 nt, Human
ccaaaacaaaauaucccccaca

SEQ ID NO: 186547 - RNA, 25 nt, Human
ccaacaccagucuggcccaccagcu

SEQ ID NO: 186548 - RNA, 19 nt, Human
ccacccacaaccuccuuaa

SEQ ID NO: 186549 - RNA, 24 nt, Human
ccagcuggccuucggcccgaguca

SEQ ID NO: 186550 - RNA, 21 nt, Human
ccagggucccuccaccucuac

SEQ ID NO: 186551 - RNA, 21 nt, Human
ccauagcaacggaaaggaccc

SEQ ID NO: 186552 - RNA, 19 nt, Human
cccacaaccuccuuaacuc

SEQ ID NO: 186553 - RNA, 24 nt, Human
ccccacacccuccaaaagcaacaa

SEQ ID NO: 186554 - RNA, 20 nt, Human
cccccacacccuccaaaagc

SEQ ID NO: 186555 - RNA, 22 nt, Human
ccccgcggccccgcagcgccga

SEQ ID NO: 186556 - RNA, 20 nt, Human
ccccugaagcccugcuaggu

SEQ ID NO: 186557 - RNA, 20 nt, Human
ccccuuggcuaggauuucca

SEQ ID NO: 186558 - RNA, 19 nt, Human
ccgcuccacgcacgcccgc

SEQ ID NO: 186559 - RNA, 21 nt, Human
ccggcccccaaacacuaaccu

SEQ ID NO: 186560 - RNA, 23 nt, Human
ccucaacgcaacggucaucucca

SEQ ID NO: 186561 - RNA, 21 nt, Human
ccuccaaccaacaccagucug

SEQ ID NO: 186562 - RNA, 21 nt, Human
cgaugcuagagguuaugcuuc

SEQ ID NO: 186563 - RNA, 22 nt, Human
cgcuccacgcacgcccgccugc

SEQ ID NO: 186564 - RNA, 18 nt, Human
cggaaaggacccgaggug

SEQ ID NO: 186565 - RNA, 20 nt, Human
cguggugccugccuuccaac

SEQ ID NO: 186566 - RNA, 19 nt, Human
cucccccggcccccaaaca

SEQ ID NO: 186567 - RNA, 21 nt, Human
cugccccaagccagaauauuu

SEQ ID NO: 186568 - RNA, 20 nt, Human
cuggagaccccauuggagcu

SEQ ID NO: 186569 - RNA, 24 nt, Human
cuggcccaccagcugguccccugg

SEQ ID NO: 186570 - RNA, 20 nt, Human
cuguguguguggcaggggag

SEQ ID NO: 186571 - RNA, 23 nt, Human
cuguguguguggcaggggagggg

SEQ ID NO: 186572 - RNA, 24 nt, Human
gaaccugcagaaaaaccaaaacaa

SEQ ID NO: 186573 - RNA, 24 nt, Human
gagaacaugggggcuuugaauggc

SEQ ID NO: 186574 - RNA, 19 nt, Human
gaguaucugcagaaggacc

SEQ ID NO: 186575 - RNA, 21 nt, Human
gaugaucaagggaagaaggga

SEQ ID NO: 186576 - RNA, 18 nt, Human
gcaacggucaucuccaag

SEQ ID NO: 186577 - RNA, 22 nt, Human
gcccccgcuccacgcacgcccg

SEQ ID NO: 186578 - RNA, 18 nt, Human
gcggucaguccucccccg

SEQ ID NO: 186579 - RNA, 22 nt, Human
ggaacagugguugaucacuuuc

SEQ ID NO: 186580 - RNA, 20 nt, Human
ggaaucccacccacaaccuu

SEQ ID NO: 186581 - RNA, 19 nt, Human
ggcccccaaacacuaaccu

SEQ ID NO: 186582 - RNA, 22 nt, Human
ggccucuucuuuggcacaugcc

SEQ ID NO: 186583 - RNA, 23 nt, Human
ggcugugaggcggccugguucgg

SEQ ID NO: 186584 - RNA, 18 nt, Human
gggaaggggcggggccug

SEQ ID NO: 186585 - RNA, 25 nt, Human
gggagccccccaccuccaaccaaca

SEQ ID NO: 186586 - RNA, 18 nt, Human
ggggagaggugauaagag

SEQ ID NO: 186587 - RNA, 20 nt, Human
guaucugcagaaggacccac

SEQ ID NO: 186588 - RNA, 18 nt, Human
gugcaaaccaccaggcaa

SEQ ID NO: 186589 - RNA, 20 nt, Human
guggcaggggaggggcgggc

SEQ ID NO: 186590 - RNA, 21 nt, Human
uaacaaaggaaugacuugcuc

SEQ ID NO: 186591 - RNA, 19 nt, Human
uacacgaaauccccuuggc

SEQ ID NO: 186592 - RNA, 24 nt, Human
uacacgaaauccccuuggcuagga

SEQ ID NO: 186593 - RNA, 24 nt, Human
uacccccagaggaugaaacagucu

SEQ ID NO: 186594 - RNA, 23 nt, Human
uagacauuagagcaagagcccca

SEQ ID NO: 186595 - RNA, 23 nt, Human
uaucccccacacccuccaaaagc

SEQ ID NO: 186596 - RNA, 24 nt, Human
ucaggacagauggaaaccaugaca

SEQ ID NO: 186597 - RNA, 24 nt, Human
ucaguccucccccggcccccaaac

SEQ ID NO: 186598 - RNA, 24 nt, Human
ucaguugggccucaccuuggaauc

SEQ ID NO: 186599 - RNA, 20 nt, Human
uccaaaagcaacaagaaacc

SEQ ID NO: 186600 - RNA, 22 nt, Human
uccaagaggcuaccuggggucc

SEQ ID NO: 186601 - RNA, 20 nt, Human
uccacgcacgcccgccugcg

SEQ ID NO: 186602 - RNA, 21 nt, Human
uccacgcacgcccgccugcgg

SEQ ID NO: 186603 - RNA, 22 nt, Human
ucccggaggggcuuucagcugg

SEQ ID NO: 186604 - RNA, 23 nt, Human
ucccggaggggcuuucagcugga

SEQ ID NO: 186605 - RNA, 19 nt, Human
uccucccccggcccccaaa

SEQ ID NO: 186606 - RNA, 22 nt, Human
ucucaccauagacauuagagca

SEQ ID NO: 186607 - RNA, 21 nt, Human
ucucugcauccuagugggaac

SEQ ID NO: 186608 - RNA, 18 nt, Human
ucuguucuacccccagag

SEQ ID NO: 186609 - RNA, 18 nt, Human
ugaaaugugcaaaccacc

SEQ ID NO: 186610 - RNA, 24 nt, Human
ugacagaaacaaugggcuuggaaa

SEQ ID NO: 186611 - RNA, 26 nt, Human
ugcagaaaaaccaaaacaaaauaucc

SEQ ID NO: 186612 - RNA, 19 nt, Human
ugcagaaggacccacccuc

SEQ ID NO: 186613 - RNA, 23 nt, Human
ugccagggucccuccaccucuac

SEQ ID NO: 186614 - RNA, 21 nt, Human
ugccguggugccugccuucca

SEQ ID NO: 186615 - RNA, 21 nt, Human
ugcggcgcggccgcggccccc

SEQ ID NO: 186616 - RNA, 23 nt, Human
ugcugccccaagccagaauauuu

SEQ ID NO: 186617 - RNA, 19 nt, Human
uggaaucccacccacaacc

SEQ ID NO: 186618 - RNA, 22 nt, Human
uggaaucccacccacaaccucc

SEQ ID NO: 186619 - RNA, 21 nt, Human
uggcaaaguccccauuugucc

SEQ ID NO: 186620 - RNA, 20 nt, Human
uggccaaacagugcagagaa

SEQ ID NO: 186621 - RNA, 18 nt, Human
uguguguggcaggggagg

SEQ ID NO: 186622 - RNA, 22 nt, Human
uguguguggcaggggaggggcg

SEQ ID NO: 186623 - RNA, 19 nt, Human
uguucuacccccagaggau

SEQ ID NO: 186624 - RNA, 22 nt, Human
uucauggaaccugcagaaaaac

SEQ ID NO: 186625 - RNA, 18 nt, Human
uucuuuggcacaugccag

SEQ ID NO: 186626 - RNA, 19 nt, Human
uuuccaaauuuccuggcug

SEQ ID NO: 186627 - RNA, 21 nt, Human
uuugaauggccgagauguucg

SEQ ID NO: 186628 - RNA, 24 nt, Human
uuuuuuuuuuuuugagaaauauca

SEQ ID NO: 186629 - RNA, 18 nt, Human
uuuuuuuuuuuuuuuuug

SEQ ID NO: 186630 - RNA, 23 nt, Human
aagucucuugagguugcaggaau

SEQ ID NO: 186631 - RNA, 19 nt, Human
aauccgcccgccucuccuc

SEQ ID NO: 186632 - RNA, 20 nt, Human
aggaaucuccagagaaacau

SEQ ID NO: 186633 - RNA, 23 nt, Human
aggagcaagauccaggccugagc

SEQ ID NO: 186634 - RNA, 20 nt, Human
agggggaggaggagccugga

SEQ ID NO: 186635 - RNA, 22 nt, Human
auccgcccgccucuccucgcca

SEQ ID NO: 186636 - RNA, 21 nt, Human
cacccuuguuccucacagagg

SEQ ID NO: 186637 - RNA, 24 nt, Human
cacucuucagggagguuccccacc

SEQ ID NO: 186638 - RNA, 21 nt, Human
cagccaccaccccgagaacac

SEQ ID NO: 186639 - RNA, 19 nt, Human
caugacacccacccaaaca

SEQ ID NO: 186640 - RNA, 18 nt, Human
ccaggcucugguuggguc

SEQ ID NO: 186641 - RNA, 21 nt, Human
ccaugacacccacccaaacac

SEQ ID NO: 186642 - RNA, 19 nt, Human
cccagccaccaccccgaga

SEQ ID NO: 186643 - RNA, 21 nt, Human
cccaugacacccacccaaaca

SEQ ID NO: 186644 - RNA, 21 nt, Human
cccuccccaaauccgcccgcc

SEQ ID NO: 186645 - RNA, 19 nt, Human
ccgccgaggugauccuggc

SEQ ID NO: 186646 - RNA, 20 nt, Human
ccuccaggcugagccgacuc

SEQ ID NO: 186647 - RNA, 18 nt, Human
cgccgaggugauccuggc

SEQ ID NO: 186648 - RNA, 19 nt, Human
cuccaggcugagccgacuc

SEQ ID NO: 186649 - RNA, 20 nt, Human
cugccagggggaggaggagc

SEQ ID NO: 186650 - RNA, 20 nt, Human
gcccgccucuccucgccacc

SEQ ID NO: 186651 - RNA, 18 nt, Human
ggaaucuccagagaaaca

SEQ ID NO: 186652 - RNA, 19 nt, Human
ggccagguccucagggccc

SEQ ID NO: 186653 - RNA, 20 nt, Human
uaaagcagaaauguauuuau

SEQ ID NO: 186654 - RNA, 18 nt, Human
uauuuggcuggaguguga

SEQ ID NO: 186655 - RNA, 23 nt, Human
uccagagaaacauaggcgcugcc

SEQ ID NO: 186656 - RNA, 18 nt, Human
uccccaaauccgcccgcc

SEQ ID NO: 186657 - RNA, 22 nt, Human
ucguaccugcccggugaccagg

SEQ ID NO: 186658 - RNA, 21 nt, Human
ucucuugagguugcaggaauu

SEQ ID NO: 186659 - RNA, 18 nt, Human
ugacacccacccaaacac

SEQ ID NO: 186660 - RNA, 21 nt, Human
ugauccuggcaggaggcuggg

SEQ ID NO: 186661 - RNA, 23 nt, Human
ugcccagccaccaccccgagaac

SEQ ID NO: 186662 - RNA, 24 nt, Human
ugcccggggccagguccucagggc

SEQ ID NO: 186663 - RNA, 19 nt, Human
uggcuggagugugaccgcc

SEQ ID NO: 186664 - RNA, 23 nt, Human
uggggacacccaugacacccagc

SEQ ID NO: 186665 - RNA, 21 nt, Human
uggguggggacacccaugaca

SEQ ID NO: 186666 - RNA, 24 nt, Human
uuuuuuuuuuuuuuuuuaauaaag

SEQ ID NO: 186667 - RNA, 21 nt, Human
aaauauacacccucaaagucu

SEQ ID NO: 186668 - RNA, 21 nt, Human
accaaagacaaauccaaucca

SEQ ID NO: 186669 - RNA, 18 nt, Human
agccagcagcccgccuug

SEQ ID NO: 186670 - RNA, 18 nt, Human
agccgccgccgccgcgcc

SEQ ID NO: 186671 - RNA, 24 nt, Human
caauccacccgcccggggccgccu

SEQ ID NO: 186672 - RNA, 24 nt, Human
cagccccaccagagcaggggcucc

SEQ ID NO: 186673 - RNA, 20 nt, Human
cagucggcggucagcaacgg

SEQ ID NO: 186674 - RNA, 19 nt, Human
ccacuguggacuuggaggc

SEQ ID NO: 186675 - RNA, 18 nt, Human
cccaagaguuucccccuc

SEQ ID NO: 186676 - RNA, 21 nt, Human
ccgccgccgccgcgccgccgc

SEQ ID NO: 186677 - RNA, 23 nt, Human
ccgccgccgccgcgccgccgcuu

SEQ ID NO: 186678 - RNA, 20 nt, Human
ccgccgccgcgccgccgcuu

SEQ ID NO: 186679 - RNA, 22 nt, Human
ccgccucggaaaacagaccuga

SEQ ID NO: 186680 - RNA, 21 nt, Human
ccgcgccgccgcuucuuccuc

SEQ ID NO: 186681 - RNA, 19 nt, Human
ccgcugcucgggcugccgc

SEQ ID NO: 186682 - RNA, 21 nt, Human
ccgcugcugccggagccgggg

SEQ ID NO: 186683 - RNA, 19 nt, Human
ccggcucccggggucuccc

SEQ ID NO: 186684 - RNA, 23 nt, Human
cgccgcugcugccggagccgggg

SEQ ID NO: 186685 - RNA, 22 nt, Human
cgccucggaaaacagaccugag

SEQ ID NO: 186686 - RNA, 24 nt, Human
cggcggggcugucagcgccugggg

SEQ ID NO: 186687 - RNA, 20 nt, Human
cggcucccggggucuccccu

SEQ ID NO: 186688 - RNA, 22 nt, Human
cuccccgcuaaaaugccuugga

SEQ ID NO: 186689 - RNA, 22 nt, Human
cugagacaguagagaaauuuac

SEQ ID NO: 186690 - RNA, 28 nt, Human
gaaaauauacacccucaaagucucacuu

SEQ ID NO: 186691 - RNA, 22 nt, Human
gccgccgcugcugccggagccg

SEQ ID NO: 186692 - RNA, 25 nt, Human
gggcugccgccgcugcugccggagc

SEQ ID NO: 186693 - RNA, 21 nt, Human
gggugcugccgcugcugcugc

SEQ ID NO: 186694 - RNA, 20 nt, Human
ucaccaaagacaaauccaau

SEQ ID NO: 186695 - RNA, 19 nt, Human
uccaauccacccgcccggg

SEQ ID NO: 186696 - RNA, 20 nt, Human
uccacuacuuccacuucuaa

SEQ ID NO: 186697 - RNA, 19 nt, Human
uccacuguggacuuggagg

SEQ ID NO: 186698 - RNA, 24 nt, Human
ucgacgggauggacggccuccuuc

SEQ ID NO: 186699 - RNA, 18 nt, Human
ucggcggucagcaacgga

SEQ ID NO: 186700 - RNA, 21 nt, Human
ucgggcugccgccgcugcugc

SEQ ID NO: 186701 - RNA, 24 nt, Human
ucuggaagucuugagucacauuuu

SEQ ID NO: 186702 - RNA, 23 nt, Human
ugagucacauuuuuuuuuuuuuu

SEQ ID NO: 186703 - RNA, 18 nt, Human
ugcugccgcugcugcugc

SEQ ID NO: 186704 - RNA, 18 nt, Human
uggaaauuucuuugagaa

SEQ ID NO: 186705 - RNA, 24 nt, Human
uguucaccaaagacaaauccaauc

SEQ ID NO: 186706 - RNA, 18 nt, Human
uugaggcucuggaagucu

SEQ ID NO: 186707 - RNA, 19 nt, Human
uuuuuuuuuugauaacccc

SEQ ID NO: 186708 - RNA, 21 nt, Human
acagagagcacgcaccccaca

SEQ ID NO: 186709 - RNA, 22 nt, Human
acagggcccuguaaucccaugc

SEQ ID NO: 186710 - RNA, 21 nt, Human
acagugcugaaggcucaggug

SEQ ID NO: 186711 - RNA, 22 nt, Human
accuuugucccagggauggccc

SEQ ID NO: 186712 - RNA, 18 nt, Human
acggaggacacuggggac

SEQ ID NO: 186713 - RNA, 19 nt, Human
agaagggacagcuuugggc

SEQ ID NO: 186714 - RNA, 22 nt, Human
agaggccgggguggcagcacag

SEQ ID NO: 186715 - RNA, 23 nt, Human
aggcagaggcagaccuaucuggg

SEQ ID NO: 186716 - RNA, 23 nt, Human
agggaccaggcugugggagcugg

SEQ ID NO: 186717 - RNA, 21 nt, Human
agggauggcccaggcccugcc

SEQ ID NO: 186718 - RNA, 20 nt, Human
agugcugaaggcucaggugu

SEQ ID NO: 186719 - RNA, 24 nt, Human
caaaacgaguaauaaaaauuggcu

SEQ ID NO: 186720 - RNA, 24 nt, Human
caacugcuggugggggccucgggc

SEQ ID NO: 186721 - RNA, 22 nt, Human
cacacagagagcacgcacccca

SEQ ID NO: 186722 - RNA, 21 nt, Human
cacagccucgcccuauccccu

SEQ ID NO: 186723 - RNA, 21 nt, Human
cacaggccuagggcauacaga

SEQ ID NO: 186724 - RNA, 23 nt, Human
caccccacaggcgcacacaggaa

SEQ ID NO: 186725 - RNA, 21 nt, Human
cacggagaagagcugaaggga

SEQ ID NO: 186726 - RNA, 18 nt, Human
cagacccagcgcugacaa

SEQ ID NO: 186727 - RNA, 19 nt, Human
cagagcccaguaucaggga

SEQ ID NO: 186728 - RNA, 24 nt, Human
cagcacagugcugaaggcucaggu

SEQ ID NO: 186729 - RNA, 20 nt, Human
cagccugagcccagggcagc

SEQ ID NO: 186730 - RNA, 19 nt, Human
caggacagagcccaguauc

SEQ ID NO: 186731 - RNA, 19 nt, Human
caggagccaaggcgggggc

SEQ ID NO: 186732 - RNA, 23 nt, Human
cagugcugaaggcucagguguga

SEQ ID NO: 186733 - RNA, 28 nt, Human
ccacggagaagagcugaagggacgcacc

SEQ ID NO: 186734 - RNA, 20 nt, Human
ccagacccagcgcugacaag

SEQ ID NO: 186735 - RNA, 22 nt, Human
ccagacccagcgcugacaagca

SEQ ID NO: 186736 - RNA, 23 nt, Human
ccagacccagcgcugacaagcac

SEQ ID NO: 186737 - RNA, 26 nt, Human
ccagacccagcgcugacaagcacuga

SEQ ID NO: 186738 - RNA, 24 nt, Human
ccagggcugggaccuggggcacag

SEQ ID NO: 186739 - RNA, 18 nt, Human
cccacccccuccuagggc

SEQ ID NO: 186740 - RNA, 24 nt, Human
ccccagacccagcgcugacaagca

SEQ ID NO: 186741 - RNA, 20 nt, Human
cccccaggagccaaggcggg

SEQ ID NO: 186742 - RNA, 19 nt, Human
cccgcucuccagccagggc

SEQ ID NO: 186743 - RNA, 18 nt, Human
cccuauccccuucaccca

SEQ ID NO: 186744 - RNA, 20 nt, Human
ccgcucuccagccagggcug

SEQ ID NO: 186745 - RNA, 25 nt, Human
ccuagggcugggcuugggcguuucu

SEQ ID NO: 186746 - RNA, 22 nt, Human
ccucgcccuauccccuucaccc

SEQ ID NO: 186747 - RNA, 22 nt, Human
ccucugccacgucccgcucucc

SEQ ID NO: 186748 - RNA, 18 nt, Human
ccuuugucccagggaugg

SEQ ID NO: 186749 - RNA, 20 nt, Human
cgccaggucugcggcgggaa

SEQ ID NO: 186750 - RNA, 20 nt, Human
cguacaaauacauaaauaca

SEQ ID NO: 186751 - RNA, 19 nt, Human
cuagggcugggcuugggcg

SEQ ID NO: 186752 - RNA, 19 nt, Human
cugcuaccgccaacugcug

SEQ ID NO: 186753 - RNA, 18 nt, Human
cugggcuugggcguuucu

SEQ ID NO: 186754 - RNA, 18 nt, Human
gacuugaguggacaaugg

SEQ ID NO: 186755 - RNA, 22 nt, Human
gagcuccacggagaagagcuga

SEQ ID NO: 186756 - RNA, 20 nt, Human
gaggguugaccagggaugcc

SEQ ID NO: 186757 - RNA, 21 nt, Human
gccccagacccagcgcugaca

SEQ ID NO: 186758 - RNA, 23 nt, Human
gcccuguaaucccaugcuacccu

SEQ ID NO: 186759 - RNA, 20 nt, Human
gccucgcccuauccccuuca

SEQ ID NO: 186760 - RNA, 23 nt, Human
gcuggaaggcagaggcagaccua

SEQ ID NO: 186761 - RNA, 19 nt, Human
gcugugggagcuggaaggc

SEQ ID NO: 186762 - RNA, 20 nt, Human
ggagcuggaaggcagaggca

SEQ ID NO: 186763 - RNA, 18 nt, Human
ggauggcccaggcccugc

SEQ ID NO: 186764 - RNA, 19 nt, Human
ggcugauggguaucacagg

SEQ ID NO: 186765 - RNA, 21 nt, Human
ggcuugggcguuucugaaaga

SEQ ID NO: 186766 - RNA, 22 nt, Human
gggcguuucugaaagagguguc

SEQ ID NO: 186767 - RNA, 21 nt, Human
uaagaaugcucuggucgcuau

SEQ ID NO: 186768 - RNA, 20 nt, Human
uacagaaagccccgagcucc

SEQ ID NO: 186769 - RNA, 21 nt, Human
uacagaaagccccgagcucca

SEQ ID NO: 186770 - RNA, 18 nt, Human
uacagaggccccagaccc

SEQ ID NO: 186771 - RNA, 20 nt, Human
uagcugcuaccgccaacugc

SEQ ID NO: 186772 - RNA, 21 nt, Human
uaucagggaccaggcuguggg

SEQ ID NO: 186773 - RNA, 23 nt, Human
ucacccacacagguacacacaga

SEQ ID NO: 186774 - RNA, 18 nt, Human
uccggaauguuugagggu

SEQ ID NO: 186775 - RNA, 21 nt, Human
uccuagggcugggcuugggcg

SEQ ID NO: 186776 - RNA, 23 nt, Human
ucgcccuauccccuucacccaca

SEQ ID NO: 186777 - RNA, 19 nt, Human
ucucuggccacuuuggcac

SEQ ID NO: 186778 - RNA, 21 nt, Human
ucugggaagggccagggcugg

SEQ ID NO: 186779 - RNA, 24 nt, Human
ucugggaagggccagggcugggac

SEQ ID NO: 186780 - RNA, 25 nt, Human
ucuguguuccccaggccacgacuug

SEQ ID NO: 186781 - RNA, 23 nt, Human
ugaggguugaccagggaugcccc

SEQ ID NO: 186782 - RNA, 26 nt, Human
uggaaggcagaggcagaccuaucugg

SEQ ID NO: 186783 - RNA, 20 nt, Human
uggacaauggggaagaucac

SEQ ID NO: 186784 - RNA, 18 nt, Human
uggcacaggccuagggca

SEQ ID NO: 186785 - RNA, 21 nt, Human
uggcagcacagugcugaaggc

SEQ ID NO: 186786 - RNA, 19 nt, Human
uggcaguggcuccucugcc

SEQ ID NO: 186787 - RNA, 21 nt, Human
uggcugcccccaggagccaag

SEQ ID NO: 186788 - RNA, 18 nt, Human
ugggaagggccagggcug

SEQ ID NO: 186789 - RNA, 18 nt, Human
ugggaccaggauggccac

SEQ ID NO: 186790 - RNA, 19 nt, Human
ugggaccaggauggccauc

SEQ ID NO: 186791 - RNA, 22 nt, Human
ugggccccagagguagcagccu

SEQ ID NO: 186792 - RNA, 22 nt, Human
ugugggagcuggaaggcagagg

SEQ ID NO: 186793 - RNA, 18 nt, Human
uuaaauauggaaaaaaca

SEQ ID NO: 186794 - RNA, 18 nt, Human
uuccccaggccacgacuu

SEQ ID NO: 186795 - RNA, 19 nt, Human
uuggcacaggccuagggca

SEQ ID NO: 186796 - RNA, 23 nt, Human
uuucugaaagaggugucugcagg

SEQ ID NO: 186797 - RNA, 22 nt, Human
uuuggcacaggccuagggcaua

SEQ ID NO: 186798 - RNA, 22 nt, Human
aaaaaaagauauaaacaaagaa

SEQ ID NO: 186799 - RNA, 19 nt, Human
aaagugcuggaauugcagg

SEQ ID NO: 186800 - RNA, 24 nt, Human
aaagugcuggaauugcaggcauga

SEQ ID NO: 186801 - RNA, 19 nt, Human
aaauagccaagagaccgag

SEQ ID NO: 186802 - RNA, 19 nt, Human
aaaugcucauuuucugggc

SEQ ID NO: 186803 - RNA, 22 nt, Human
aagaaagaaaaagaaaauaaaa

SEQ ID NO: 186804 - RNA, 26 nt, Human
aagugcuggaauugcaggcaugagcc

SEQ ID NO: 186805 - RNA, 23 nt, Human
aauugcaggcaugagccaccgca

SEQ ID NO: 186806 - RNA, 21 nt, Human
acaccgggcuaauuuuuguau

SEQ ID NO: 186807 - RNA, 24 nt, Human
accucaugauccaucugccuuggc

SEQ ID NO: 186808 - RNA, 25 nt, Human
acgggguuuacaacauguuggccag

SEQ ID NO: 186809 - RNA, 23 nt, Human
acucaacuaaauuuacagaaugc

SEQ ID NO: 186810 - RNA, 19 nt, Human
agccaccgcaccuggccug

SEQ ID NO: 186811 - RNA, 20 nt, Human
agcgaagaaagaugaaggga

SEQ ID NO: 186812 - RNA, 20 nt, Human
aggacuugaaauagccaaga

SEQ ID NO: 186813 - RNA, 20 nt, Human
aggcauuaguuuuuuaaaag

SEQ ID NO: 186814 - RNA, 26 nt, Human
agggaaaaaaagauauaaacaaagaa

SEQ ID NO: 186815 - RNA, 28 nt, Human
agggaaaaaaagauauaaacaaagaaaa

SEQ ID NO: 186816 - RNA, 19 nt, Human
aguauagaagcgaagaaag

SEQ ID NO: 186817 - RNA, 24 nt, Human
agugcaauguugcgaucuuggcuc

SEQ ID NO: 186818 - RNA, 24 nt, Human
auagccaagagaccgagcucccaa

SEQ ID NO: 186819 - RNA, 19 nt, Human
auccaucugccuuggccuc

SEQ ID NO: 186820 - RNA, 24 nt, Human
augauccaucugccuuggccuccc

SEQ ID NO: 186821 - RNA, 19 nt, Human
augguaaaaggcugaugcu

SEQ ID NO: 186822 - RNA, 24 nt, Human
auuuuuguauuuuuaguagagacg

SEQ ID NO: 186823 - RNA, 24 nt, Human
caaagugcuggaauugcaggcaug

SEQ ID NO: 186824 - RNA, 24 nt, Human
caacauguuggccaggcuagucuu

SEQ ID NO: 186825 - RNA, 19 nt, Human
caagagaagccauaagaug

SEQ ID NO: 186826 - RNA, 19 nt, Human
caaggacaagagaagccau

SEQ ID NO: 186827 - RNA, 22 nt, Human
caaguugaagcaauuuguacca

SEQ ID NO: 186828 - RNA, 24 nt, Human
caccacaccgggcuaauuuuugua

SEQ ID NO: 186829 - RNA, 22 nt, Human
caccgcaccuggccuguucaac

SEQ ID NO: 186830 - RNA, 21 nt, Human
cacuacaaccuccgccuccug

SEQ ID NO: 186831 - RNA, 20 nt, Human
caggcaugagccaccgcacc

SEQ ID NO: 186832 - RNA, 24 nt, Human
cauguuggccaggcuagucuugaa

SEQ ID NO: 186833 - RNA, 20 nt, Human
cauucaaaugugcacagcag

SEQ ID NO: 186834 - RNA, 19 nt, Human
ccaaagugcuggaauugca

SEQ ID NO: 186835 - RNA, 24 nt, Human
ccaaagugcuggaauugcaggcau

SEQ ID NO: 186836 - RNA, 23 nt, Human
cccggguaacugggauuauagau

SEQ ID NO: 186837 - RNA, 24 nt, Human
ccgauggcauaugguagugcaagg

SEQ ID NO: 186838 - RNA, 27 nt, Human
ccgccuccuggguucaagcaauucuuu

SEQ ID NO: 186839 - RNA, 24 nt, Human
ccucagugaaaacugagacuuuac

SEQ ID NO: 186840 - RNA, 19 nt, Human
ccuccgccuccuggguuca

SEQ ID NO: 186841 - RNA, 24 nt, Human
ccuccuggguucaagcaauucucc

SEQ ID NO: 186842 - RNA, 21 nt, Human
ccugaccucaugauccaucug

SEQ ID NO: 186843 - RNA, 23 nt, Human
ccuggguucaagcaauucuccug

SEQ ID NO: 186844 - RNA, 24 nt, Human
cgggguuuacaacauguuggccag

SEQ ID NO: 186845 - RNA, 18 nt, Human
cuaagcccauaggucucc

SEQ ID NO: 186846 - RNA, 21 nt, Human
cuaagcccauaggucuccuuc

SEQ ID NO: 186847 - RNA, 21 nt, Human
cuacaaccuccgccuccuggg

SEQ ID NO: 186848 - RNA, 23 nt, Human
cuacaaccuccgccuccuggguu

SEQ ID NO: 186849 - RNA, 24 nt, Human
cuacaaccuccgccuccuggguuc

SEQ ID NO: 186850 - RNA, 21 nt, Human
cuccuggguucaagcaauucu

SEQ ID NO: 186851 - RNA, 18 nt, Human
cucuguuccuaggacuuu

SEQ ID NO: 186852 - RNA, 23 nt, Human
cugccuuggccucccaaagugcu

SEQ ID NO: 186853 - RNA, 23 nt, Human
cugcugcacauuagaaucaccug

SEQ ID NO: 186854 - RNA, 24 nt, Human
cuugcucuugcugcccagccugga

SEQ ID NO: 186855 - RNA, 18 nt, Human
gaaagcacaagagggcug

SEQ ID NO: 186856 - RNA, 20 nt, Human
gaccucaugauccaucugcc

SEQ ID NO: 186857 - RNA, 21 nt, Human
gaccucaugauccaucugccu

SEQ ID NO: 186858 - RNA, 21 nt, Human
gaccucaugauccaucugccu

SEQ ID NO: 186859 - RNA, 24 nt, Human
gaccucaugauccaucugccuugg

SEQ ID NO: 186860 - RNA, 22 nt, Human
gaguggggaucagaaugucuau

SEQ ID NO: 186861 - RNA, 18 nt, Human
gcacagcagugccugcca

SEQ ID NO: 186862 - RNA, 19 nt, Human
gccuuggccucccaaagug

SEQ ID NO: 186863 - RNA, 22 nt, Human
gccuuggccucccaaagugcug

SEQ ID NO: 186864 - RNA, 19 nt, Human
gcgaagaaagaugaaggga

SEQ ID NO: 186865 - RNA, 23 nt, Human
gcuagucuugaaccccugaccuc

SEQ ID NO: 186866 - RNA, 18 nt, Human
gcucuugcugcccagccu

SEQ ID NO: 186867 - RNA, 22 nt, Human
gcuggagggcugcuggcugcuu

SEQ ID NO: 186868 - RNA, 26 nt, Human
ggaaaaaaagauauaaacaaagaaaa

SEQ ID NO: 186869 - RNA, 22 nt, Human
ggcuggagggcugcuggcugcu

SEQ ID NO: 186870 - RNA, 18 nt, Human
gggaaagcacaagagggc

SEQ ID NO: 186871 - RNA, 19 nt, Human
gggacauuugaaaaguugc

SEQ ID NO: 186872 - RNA, 24 nt, Human
gggguuuacaacauguuggccagg

SEQ ID NO: 186873 - RNA, 23 nt, Human
ggguuuacaacauguuggccagg

SEQ ID NO: 186874 - RNA, 20 nt, Human
guaaauuauuuccacaaaau

SEQ ID NO: 186875 - RNA, 24 nt, Human
guagagacgggguuuacaacaugu

SEQ ID NO: 186876 - RNA, 21 nt, Human
guuccuuuucccugcccucag

SEQ ID NO: 186877 - RNA, 21 nt, Human
uaaaagaucccuagaugauuc

SEQ ID NO: 186878 - RNA, 24 nt, Human
uaauuuuuguauuuuuaguagaga

SEQ ID NO: 186879 - RNA, 23 nt, Human
uacaacauguuggccaggcuagu

SEQ ID NO: 186880 - RNA, 20 nt, Human
uaccugggaguggggaucag

SEQ ID NO: 186881 - RNA, 25 nt, Human
uaguagagacgggguuuacaacaug

SEQ ID NO: 186882 - RNA, 28 nt, Human
ucaaaauaaaccugaguguuguccggac

SEQ ID NO: 186883 - RNA, 19 nt, Human
ucaagcaauucuccugccu

SEQ ID NO: 186884 - RNA, 22 nt, Human
ucaccuggggagcuucugaaau

SEQ ID NO: 186885 - RNA, 23 nt, Human
ucacuacaaccuccgccuccugg

SEQ ID NO: 186886 - RNA, 24 nt, Human
ucacuacaaccuccgccuccuggg

SEQ ID NO: 186887 - RNA, 27 nt, Human
ucacuacaaccuccgccuccuggguuc

SEQ ID NO: 186888 - RNA, 21 nt, Human
ucacugaaauugaaaauuauu

SEQ ID NO: 186889 - RNA, 20 nt, Human
ucagaaacauuuguuuccag

SEQ ID NO: 186890 - RNA, 21 nt, Human
ucaggacuugaaauagccaag

SEQ ID NO: 186891 - RNA, 22 nt, Human
ucaggacuugaaauagccaaga

SEQ ID NO: 186892 - RNA, 21 nt, Human
ucaguuuaucaaaauaaaccu

SEQ ID NO: 186893 - RNA, 23 nt, Human
ucaguuuaucaaaauaaaccuga

SEQ ID NO: 186894 - RNA, 22 nt, Human
uccacaaaauugcaaaagaaac

SEQ ID NO: 186895 - RNA, 24 nt, Human
ucccaaagugcuggaauugcaggc

SEQ ID NO: 186896 - RNA, 24 nt, Human
uccgccuccuggguucaagcaauu

SEQ ID NO: 186897 - RNA, 21 nt, Human
uccuggguucaagcaauucuc

SEQ ID NO: 186898 - RNA, 24 nt, Human
uccuggguucaagcaauucuccug

SEQ ID NO: 186899 - RNA, 18 nt, Human
ucucauaccugggagugg

SEQ ID NO: 186900 - RNA, 19 nt, Human
ugaagaaagaaaaagaaaa

SEQ ID NO: 186901 - RNA, 18 nt, Human
ugagauagagucuugcuc

SEQ ID NO: 186902 - RNA, 23 nt, Human
ugcaaaagaaacugucacugaaa

SEQ ID NO: 186903 - RNA, 22 nt, Human
ugcaauguugcgaucuuggcuc

SEQ ID NO: 186904 - RNA, 21 nt, Human
ugccucaggcucccggguaac

SEQ ID NO: 186905 - RNA, 24 nt, Human
ugccucaggcucccggguaacugg

SEQ ID NO: 186906 - RNA, 21 nt, Human
ugccugccaaacucugcugca

SEQ ID NO: 186907 - RNA, 18 nt, Human
uggaauugcaggcaugag

SEQ ID NO: 186908 - RNA, 21 nt, Human
uggaauugcaggcaugagcca

SEQ ID NO: 186909 - RNA, 23 nt, Human
uggaauugcaggcaugagccacc

SEQ ID NO: 186910 - RNA, 24 nt, Human
uggaauugcaggcaugagccaccg

SEQ ID NO: 186911 - RNA, 19 nt, Human
uggagugcaauguugcgau

SEQ ID NO: 186912 - RNA, 23 nt, Human
uggagugcaauguugcgaucuug

SEQ ID NO: 186913 - RNA, 24 nt, Human
uggagugcaauguugcgaucuugg

SEQ ID NO: 186914 - RNA, 24 nt, Human
uggccaggcuagucuugaaccccu

SEQ ID NO: 186915 - RNA, 21 nt, Human
ugggauuauagaugugcacca

SEQ ID NO: 186916 - RNA, 24 nt, Human
ugggauuauagaugugcaccacca

SEQ ID NO: 186917 - RNA, 19 nt, Human
ugggcacaccacaaaguuc

SEQ ID NO: 186918 - RNA, 21 nt, Human
uggguucaagcaauucuccug

SEQ ID NO: 186919 - RNA, 23 nt, Human
uggguucaagcaauucuccugcc

SEQ ID NO: 186920 - RNA, 24 nt, Human
uggguucaagcaauucuccugccu

SEQ ID NO: 186921 - RNA, 21 nt, Human
uguauuuuuaguagagacggg

SEQ ID NO: 186922 - RNA, 20 nt, Human
ugugcaaggacaagagaagc

SEQ ID NO: 186923 - RNA, 24 nt, Human
uguugcgaucuuggcucacuacaa

SEQ ID NO: 186924 - RNA, 18 nt, Human
uuaguagagacgggguuu

SEQ ID NO: 186925 - RNA, 25 nt, Human
uuaguagagacgggguuuacaacau

SEQ ID NO: 186926 - RNA, 21 nt, Human
uucaagcaauucuccugccuc

SEQ ID NO: 186927 - RNA, 25 nt, Human
uucaagcaauucuccugccucaggc

SEQ ID NO: 186928 - RNA, 24 nt, Human
uucgaggauuaugucagccgagac

SEQ ID NO: 186929 - RNA, 23 nt, Human
uucucauaccugggaguggggau

SEQ ID NO: 186930 - RNA, 21 nt, Human
uucuccugccucaggcucccg

SEQ ID NO: 186931 - RNA, 22 nt, Human
uucuccugccucaggcucccgg

SEQ ID NO: 186932 - RNA, 23 nt, Human
uuguauuuuuaguagagacgggg

SEQ ID NO: 186933 - RNA, 24 nt, Human
uuuguuuccagcuucaaaauccuu

SEQ ID NO: 186934 - RNA, 21 nt, Human
uuuuuaguagagacgggguuu

SEQ ID NO: 186935 - RNA, 21 nt, Human
uuuuuauaaguauagaagcga

SEQ ID NO: 186936 - RNA, 20 nt, Human
uuuuuguauuuuuaguagag

SEQ ID NO: 186937 - RNA, 19 nt, Human
aaagggcugaaggagcugg

SEQ ID NO: 186938 - RNA, 20 nt, Human
aagagagcacccucuucacc

SEQ ID NO: 186939 - RNA, 20 nt, Human
acccagaccaggcgggaagg

SEQ ID NO: 186940 - RNA, 20 nt, Human
accccccccaccccaccccg

SEQ ID NO: 186941 - RNA, 21 nt, Human
accccccccaccccaccccgc

SEQ ID NO: 186942 - RNA, 23 nt, Human
accccccccaccccaccccgcca

SEQ ID NO: 186943 - RNA, 21 nt, Human
acgccaggcaagagagcaccc

SEQ ID NO: 186944 - RNA, 20 nt, Human
aggagguggcaggaccagaa

SEQ ID NO: 186945 - RNA, 18 nt, Human
aggcagugggugaaggcg

SEQ ID NO: 186946 - RNA, 20 nt, Human
aggcagugggugaaggcggg

SEQ ID NO: 186947 - RNA, 21 nt, Human
aggcagugggugaaggcgggg

SEQ ID NO: 186948 - RNA, 21 nt, Human
aggcaucaagagcaaguacag

SEQ ID NO: 186949 - RNA, 23 nt, Human
caagagagcacccucuucaccgc

SEQ ID NO: 186950 - RNA, 18 nt, Human
caccccccccaccccacc

SEQ ID NO: 186951 - RNA, 18 nt, Human
caccccccccaccccacc

SEQ ID NO: 186952 - RNA, 19 nt, Human
caccccccccaccccaccc

SEQ ID NO: 186953 - RNA, 21 nt, Human
cacccgucugggaaacagcuc

SEQ ID NO: 186954 - RNA, 22 nt, Human
cagaaagggcugaaggagcugg

SEQ ID NO: 186955 - RNA, 26 nt, Human
cagaaagggcugaaggagcugggaca

SEQ ID NO: 186956 - RNA, 19 nt, Human
cagagccucccagggcucc

SEQ ID NO: 186957 - RNA, 21 nt, Human
caggagguggcaggaccagaa

SEQ ID NO: 186958 - RNA, 23 nt, Human
cccaccccgccaggcaucaagag

SEQ ID NO: 186959 - RNA, 25 nt, Human
cccagcaccccccccaccccacccc

SEQ ID NO: 186960 - RNA, 21 nt, Human
cccagcaccccccccaccccc

SEQ ID NO: 186961 - RNA, 22 nt, Human
cccagccuggccccagcugggg

SEQ ID NO: 186962 - RNA, 20 nt, Human
ccccaccccaccccgccagg

SEQ ID NO: 186963 - RNA, 23 nt, Human
ccccccaccccaccccgccaggc

SEQ ID NO: 186964 - RNA, 24 nt, Human
ccccccaccccaccccgccaggca

SEQ ID NO: 186965 - RNA, 18 nt, Human
cccccccaccccaccccg

SEQ ID NO: 186966 - RNA, 19 nt, Human
ccccccccaccccaccccg

SEQ ID NO: 186967 - RNA, 21 nt, Human
ccccccccaccccaccccgcc

SEQ ID NO: 186968 - RNA, 23 nt, Human
ccccccccaccccaccccgccag

SEQ ID NO: 186969 - RNA, 26 nt, Human
ccccccccaccccaccccgccaggca

SEQ ID NO: 186970 - RNA, 21 nt, Human
cccgccccacccgucugggaa

SEQ ID NO: 186971 - RNA, 26 nt, Human
cgccaggcaagagagcacccucuucu

SEQ ID NO: 186972 - RNA, 24 nt, Human
cgggaaggcagcucaggagguggc

SEQ ID NO: 186973 - RNA, 19 nt, Human
gaaagggcugaaggagcug

SEQ ID NO: 186974 - RNA, 22 nt, Human
gagaggcaggggcccagcaccc

SEQ ID NO: 186975 - RNA, 19 nt, Human
gcagggugggagggggcag

SEQ ID NO: 186976 - RNA, 19 nt, Human
gcccagcaccccccccacc

SEQ ID NO: 186977 - RNA, 24 nt, Human
gcuccagagccucccagggcuccu

SEQ ID NO: 186978 - RNA, 18 nt, Human
gcugaaggagcugggaca

SEQ ID NO: 186979 - RNA, 19 nt, Human
ggagggacagaaagggcug

SEQ ID NO: 186980 - RNA, 21 nt, Human
ggcuuagugggcaggguggga

SEQ ID NO: 186981 - RNA, 23 nt, Human
gggaaggcagcucaggagguggc

SEQ ID NO: 186982 - RNA, 18 nt, Human
gggcagggugggaggggg

SEQ ID NO: 186983 - RNA, 21 nt, Human
gggcagggugggagggggcag

SEQ ID NO: 186984 - RNA, 21 nt, Human
gggcccagcaccccccccacc

SEQ ID NO: 186985 - RNA, 19 nt, Human
ggggcccagcacccccccc

SEQ ID NO: 186986 - RNA, 22 nt, Human
uacccagaccaggcgggaaggc

SEQ ID NO: 186987 - RNA, 18 nt, Human
ucacugggagggacagaa

SEQ ID NO: 186988 - RNA, 22 nt, Human
uccagagccucccagggcuccc

SEQ ID NO: 186989 - RNA, 21 nt, Human
ugcagagaggcaggggcccag

SEQ ID NO: 186990 - RNA, 23 nt, Human
uggcaggaccagaagugggaaug

SEQ ID NO: 186991 - RNA, 19 nt, Human
ugggagggggcagccgugc

SEQ ID NO: 186992 - RNA, 23 nt, Human
uuagugggcagggugggaggggg

SEQ ID NO: 186993 - RNA, 24 nt, Human
aaaacccccccgagacagcagcac

SEQ ID NO: 186994 - RNA, 24 nt, Human
aaacacccucauagaugaaaaccc

SEQ ID NO: 186995 - RNA, 22 nt, Human
aagcagccgggguaggaggggc

SEQ ID NO: 186996 - RNA, 22 nt, Human
acccuuccaaggcugggccccu

SEQ ID NO: 186997 - RNA, 23 nt, Human
agccagcggagcgccccgaacaa

SEQ ID NO: 186998 - RNA, 26 nt, Human
ccaguuacccuuccaaggcugggccc

SEQ ID NO: 186999 - RNA, 18 nt, Human
ccccgaacaagcacugua

SEQ ID NO: 187000 - RNA, 22 nt, Human
ccccgagacagcagcacugcaa

SEQ ID NO: 187001 - RNA, 20 nt, Human
cccgaacaagcacuguaagg

SEQ ID NO: 187002 - RNA, 19 nt, Human
ccggaggcucggccccucc

SEQ ID NO: 187003 - RNA, 19 nt, Human
cgccccgaacaagcacugu

SEQ ID NO: 187004 - RNA, 21 nt, Human
cucauccggcccccgcccuac

SEQ ID NO: 187005 - RNA, 22 nt, Human
cucgccuuggucuggcagagac

SEQ ID NO: 187006 - RNA, 23 nt, Human
gaaaaggcuggagagugcgcccc

SEQ ID NO: 187007 - RNA, 20 nt, Human
gaccagcacccaucucgagg

SEQ ID NO: 187008 - RNA, 18 nt, Human
gagcgccccgaacaagca

SEQ ID NO: 187009 - RNA, 22 nt, Human
gcaggcgccuccuuuuaacugg

SEQ ID NO: 187010 - RNA, 21 nt, Human
gccugaggucccgccucaucc

SEQ ID NO: 187011 - RNA, 23 nt, Human
uaagaucaagguguuccucccuc

SEQ ID NO: 187012 - RNA, 20 nt, Human
uaagccggaaggagcagcag

SEQ ID NO: 187013 - RNA, 21 nt, Human
ucauagaugaaaaccccccuc

SEQ ID NO: 187014 - RNA, 22 nt, Human
uccaagaagccagcggagcgcc

SEQ ID NO: 187015 - RNA, 20 nt, Human
ucccgccucauccggccccc

SEQ ID NO: 187016 - RNA, 22 nt, Human
uggcccaggcaaccaggcggca

SEQ ID NO: 187017 - RNA, 19 nt, Human
uggucuggcagagacuggg

SEQ ID NO: 187018 - RNA, 18 nt, Human
uguccaagaagccagcgg

SEQ ID NO: 187019 - RNA, 21 nt, Human
aaugcugagguccagcagugu

SEQ ID NO: 187020 - RNA, 25 nt, Human
agaggaaaaggaaacaggcagaggg

SEQ ID NO: 187021 - RNA, 23 nt, Human
agagugagccccgcagagaggcc

SEQ ID NO: 187022 - RNA, 18 nt, Human
aggcaaggcucugcagug

SEQ ID NO: 187023 - RNA, 24 nt, Human
aggcagaggggaaaggcaaggcuc

SEQ ID NO: 187024 - RNA, 20 nt, Human
aucuguguguugagcaguuc

SEQ ID NO: 187025 - RNA, 19 nt, Human
cacgccucucagacaccac

SEQ ID NO: 187026 - RNA, 19 nt, Human
cagacaccacccaugaggg

SEQ ID NO: 187027 - RNA, 21 nt, Human
caggcagaggggaaaggcaag

SEQ ID NO: 187028 - RNA, 19 nt, Human
caggcccuucacgccucuc

SEQ ID NO: 187029 - RNA, 25 nt, Human
cccuuuauuggucucuucuagcaga

SEQ ID NO: 187030 - RNA, 25 nt, Human
cuagcagaguggcuccaggcccuuc

SEQ ID NO: 187031 - RNA, 23 nt, Human
cucuucuagcagaguggcuccag

SEQ ID NO: 187032 - RNA, 21 nt, Human
cugcauccuaaggcuccucag

SEQ ID NO: 187033 - RNA, 25 nt, Human
gaggggaaaggcaaggcucugcagu

SEQ ID NO: 187034 - RNA, 18 nt, Human
gcccagagcuuacccaag

SEQ ID NO: 187035 - RNA, 23 nt, Human
ggaaacaggcagaggggaaaggc

SEQ ID NO: 187036 - RNA, 24 nt, Human
ggacugauaucaagggaaugcuga

SEQ ID NO: 187037 - RNA, 19 nt, Human
ggcuccaggcccuucacgc

SEQ ID NO: 187038 - RNA, 20 nt, Human
ggcuccucaggacuggaugg

SEQ ID NO: 187039 - RNA, 24 nt, Human
ggugaagcgcagagugagccccgg

SEQ ID NO: 187040 - RNA, 21 nt, Human
gugaagcgcagagugagcccc

SEQ ID NO: 187041 - RNA, 24 nt, Human
uaggagaucuguguguugagcagu

SEQ ID NO: 187042 - RNA, 20 nt, Human
ucugcagugaaggggacuga

SEQ ID NO: 187043 - RNA, 21 nt, Human
ugaaggggacugauaucaagg

SEQ ID NO: 187044 - RNA, 25 nt, Human
uggaguaggagaucuguguguugag

SEQ ID NO: 187045 - RNA, 22 nt, Human
uggcuccaggcccuucacgccu

SEQ ID NO: 187046 - RNA, 25 nt, Human
ugugaaggcccagagcuuacccaag

SEQ ID NO: 187047 - RNA, 18 nt, Human
uuuuuuuuuuuuuugccg

SEQ ID NO: 187048 - RNA, 20 nt, Human
uuuuuuuuuuuuuuuugccg

SEQ ID NO: 187049 - RNA, 23 nt, Human
uuuuuuuuuuuuuuuuugccguu

SEQ ID NO: 187050 - RNA, 27 nt, Human
uuuuuuuuuuuuuuuuuuuuuuugggg

SEQ ID NO: 187051 - RNA, 24 nt, Human
aaacacccacauugcacccacacc

SEQ ID NO: 187052 - RNA, 21 nt, Human
aagacgccaccccugccaugg

SEQ ID NO: 187053 - RNA, 21 nt, Human
acacagaugguacacauuccc

SEQ ID NO: 187054 - RNA, 20 nt, Human
acacauucccagaaagacac

SEQ ID NO: 187055 - RNA, 19 nt, Human
acagaugguacacauuccc

SEQ ID NO: 187056 - RNA, 22 nt, Human
acaugccuggcaguacacagaa

SEQ ID NO: 187057 - RNA, 22 nt, Human
acggauuucuuccugaacaaag

SEQ ID NO: 187058 - RNA, 21 nt, Human
agacccagaaacuucugggga

SEQ ID NO: 187059 - RNA, 19 nt, Human
agcagaacaauuggaccua

SEQ ID NO: 187060 - RNA, 19 nt, Human
agcugcaggcacacagaug

SEQ ID NO: 187061 - RNA, 18 nt, Human
agcugguuuuuccuuugg

SEQ ID NO: 187062 - RNA, 19 nt, Human
aggagugggggguugggga

SEQ ID NO: 187063 - RNA, 23 nt, Human
agggagaacugugggguggggau

SEQ ID NO: 187064 - RNA, 18 nt, Human
agguggaagucagguccc

SEQ ID NO: 187065 - RNA, 23 nt, Human
aguggaccagugaggggugaggg

SEQ ID NO: 187066 - RNA, 25 nt, Human
augcacacacacacaaucacgcaua

SEQ ID NO: 187067 - RNA, 18 nt, Human
auugcacccacacccaca

SEQ ID NO: 187068 - RNA, 27 nt, Human
auugcacccacacccacaugccuggca

SEQ ID NO: 187069 - RNA, 21 nt, Human
cacccacacccacaugccugg

SEQ ID NO: 187070 - RNA, 24 nt, Human
cacccacacccacaugccuggcaa

SEQ ID NO: 187071 - RNA, 23 nt, Human
cagaaagacacauagguagacac

SEQ ID NO: 187072 - RNA, 20 nt, Human
cagaacaauuggaccuagag

SEQ ID NO: 187073 - RNA, 23 nt, Human
cagaacuguaugcauccauuugu

SEQ ID NO: 187074 - RNA, 21 nt, Human
cagcuccccaccuccccgucc

SEQ ID NO: 187075 - RNA, 18 nt, Human
caggcucaggggaggucc

SEQ ID NO: 187076 - RNA, 19 nt, Human
caggcucaggggagguccg

SEQ ID NO: 187077 - RNA, 21 nt, Human
caguacacagaacuguaugca

SEQ ID NO: 187078 - RNA, 24 nt, Human
caugcacacacacacaaucacgca

SEQ ID NO: 187079 - RNA, 21 nt, Human
cauuugugccaggcuggggcc

SEQ ID NO: 187080 - RNA, 23 nt, Human
ccacaagggcuuugggccccucc

SEQ ID NO: 187081 - RNA, 18 nt, Human
ccauuugugccaggcugg

SEQ ID NO: 187082 - RNA, 18 nt, Human
cccaugcacacacacaca

SEQ ID NO: 187083 - RNA, 24 nt, Human
cccgucccggggcgacagugacau

SEQ ID NO: 187084 - RNA, 20 nt, Human
ccgaaggagcagggguggca

SEQ ID NO: 187085 - RNA, 22 nt, Human
ccgcugccugaucccuggccac

SEQ ID NO: 187086 - RNA, 21 nt, Human
ccggggcgacagugacauaag

SEQ ID NO: 187087 - RNA, 18 nt, Human
ccugaaugcacuaagggc

SEQ ID NO: 187088 - RNA, 21 nt, Human
ccuucaggaaguaggaguggg

SEQ ID NO: 187089 - RNA, 21 nt, Human
ccuugguugaucucagggagg

SEQ ID NO: 187090 - RNA, 24 nt, Human
cgcauaccuguaggcaugugugua

SEQ ID NO: 187091 - RNA, 24 nt, Human
cggauuucuuccugaacaaagucc

SEQ ID NO: 187092 - RNA, 24 nt, Human
cggccaagccgagacccuugcagc

SEQ ID NO: 187093 - RNA, 21 nt, Human
cuacacagcugcaggcacaca

SEQ ID NO: 187094 - RNA, 19 nt, Human
cucaugaagacgccacccc

SEQ ID NO: 187095 - RNA, 24 nt, Human
cugcaggcacacagaugguacaca

SEQ ID NO: 187096 - RNA, 23 nt, Human
cuguacacccaugcacacacaca

SEQ ID NO: 187097 - RNA, 22 nt, Human
gaacaauuggaccuagagcugg

SEQ ID NO: 187098 - RNA, 20 nt, Human
gaagacgccaccccugccau

SEQ ID NO: 187099 - RNA, 22 nt, Human
gagcagggguggcaucccugcc

SEQ ID NO: 187100 - RNA, 21 nt, Human
gagcugguuuuuccuuugggu

SEQ ID NO: 187101 - RNA, 19 nt, Human
gcuggccccaagguugagg

SEQ ID NO: 187102 - RNA, 18 nt, Human
gcuuugggccccucccuc

SEQ ID NO: 187103 - RNA, 21 nt, Human
ggaccagugaggggugagggc

SEQ ID NO: 187104 - RNA, 18 nt, Human
ggagugggggguugggga

SEQ ID NO: 187105 - RNA, 22 nt, Human
ggcagagagguggaagucaggu

SEQ ID NO: 187106 - RNA, 18 nt, Human
ggccccucccucaugaag

SEQ ID NO: 187107 - RNA, 24 nt, Human
ggccuuagccugaaugcacuaagg

SEQ ID NO: 187108 - RNA, 18 nt, Human
ggcgacagugacauaagc

SEQ ID NO: 187109 - RNA, 20 nt, Human
gggggguuggggaguguggu

SEQ ID NO: 187110 - RNA, 22 nt, Human
guguaaacacccacauugcacc

SEQ ID NO: 187111 - RNA, 24 nt, Human
uaagcaaaucugggcagagaggug

SEQ ID NO: 187112 - RNA, 26 nt, Human
uacacccaugcacacacacacaauca

SEQ ID NO: 187113 - RNA, 26 nt, Human
uacacccaugcacacacacacaauca

SEQ ID NO: 187114 - RNA, 20 nt, Human
uaggaaaggggucugugaug

SEQ ID NO: 187115 - RNA, 20 nt, Human
uagugugguuggagacacgg

SEQ ID NO: 187116 - RNA, 18 nt, Human
uccccaccuccccguccc

SEQ ID NO: 187117 - RNA, 19 nt, Human
ucccuguggacgugggagg

SEQ ID NO: 187118 - RNA, 23 nt, Human
ucccuguggacgugggaggccgg

SEQ ID NO: 187119 - RNA, 18 nt, Human
uccgcggccaagccgaga

SEQ ID NO: 187120 - RNA, 19 nt, Human
uccuccgaaggagcagggg

SEQ ID NO: 187121 - RNA, 23 nt, Human
ucgccugagccgcugccugaucc

SEQ ID NO: 187122 - RNA, 18 nt, Human
ucucagggagaacugugg

SEQ ID NO: 187123 - RNA, 21 nt, Human
ugaagacgccaccccugccau

SEQ ID NO: 187124 - RNA, 21 nt, Human
ugaggggugagggcacguccu

SEQ ID NO: 187125 - RNA, 22 nt, Human
ugagguaucaguuagagcagaa

SEQ ID NO: 187126 - RNA, 20 nt, Human
ugagguguccggcgcucccu

SEQ ID NO: 187127 - RNA, 18 nt, Human
ugagugauaggaaagggg

SEQ ID NO: 187128 - RNA, 19 nt, Human
ugcccaggggccuuagccu

SEQ ID NO: 187129 - RNA, 19 nt, Human
ugccuggcaguacacagaa

SEQ ID NO: 187130 - RNA, 19 nt, Human
uggacgugggaggccgguc

SEQ ID NO: 187131 - RNA, 19 nt, Human
uggaggcagugggagaugc

SEQ ID NO: 187132 - RNA, 18 nt, Human
uggcuguacacccaugca

SEQ ID NO: 187133 - RNA, 25 nt, Human
ugggcagacggggugagucucaagc

SEQ ID NO: 187134 - RNA, 24 nt, Human
ugggcagagagguggaagucaggu

SEQ ID NO: 187135 - RNA, 22 nt, Human
uggggagugugguagacccaga

SEQ ID NO: 187136 - RNA, 24 nt, Human
ugugauggguagauagugugguug

SEQ ID NO: 187137 - RNA, 24 nt, Human
uguguaaacacccacauugcaccc

SEQ ID NO: 187138 - RNA, 23 nt, Human
uucaggaaguaggaguggggggu

SEQ ID NO: 187139 - RNA, 23 nt, Human
uugugccaggcuggggccuugag

SEQ ID NO: 187140 - RNA, 20 nt, Human
uuuuuuuuuuuuuuuugcug

SEQ ID NO: 187141 - RNA, 18 nt, Human
uuuuuuuuuuuuuuuuug

SEQ ID NO: 187142 - RNA, 20 nt, Human
uuuuuuuuuuuuuuuuugcu

SEQ ID NO: 187143 - RNA, 19 nt, Human
aagcccagcaggccauggg

SEQ ID NO: 187144 - RNA, 18 nt, Human
agcccagcaggccauggg

SEQ ID NO: 187145 - RNA, 22 nt, Human
cugggagccagcggcuccuccc

SEQ ID NO: 187146 - RNA, 22 nt, Human
gcaggccaugggaccuuccucc

SEQ ID NO: 187147 - RNA, 21 nt, Human
gggcgugggcaggggcucggg

SEQ ID NO: 187148 - RNA, 27 nt, Human
ucccacaagguagccaggggugggggc

SEQ ID NO: 187149 - RNA, 21 nt, Human
uggauuuucgggucugcccca

SEQ ID NO: 187150 - RNA, 19 nt, Human
uuuuuuuuuuuuuuucuaa

SEQ ID NO: 187151 - RNA, 23 nt, Human
aaaaacacaaauaaaaaaccuca

SEQ ID NO: 187152 - RNA, 21 nt, Human
aaaaacacauaaagacugaac

SEQ ID NO: 187153 - RNA, 19 nt, Human
aaaaacucgaaugccugac

SEQ ID NO: 187154 - RNA, 23 nt, Human
aaaacaaacaucaguugcaugga

SEQ ID NO: 187155 - RNA, 23 nt, Human
aaacaggaaacacucugaagcaa

SEQ ID NO: 187156 - RNA, 20 nt, Human
aaaccagucagauggcauca

SEQ ID NO: 187157 - RNA, 20 nt, Human
aaaggaaacuggaggcuacu

SEQ ID NO: 187158 - RNA, 24 nt, Human
aaagugcugggauuauaggcguga

SEQ ID NO: 187159 - RNA, 20 nt, Human
aacacauaaagacugaacac

SEQ ID NO: 187160 - RNA, 19 nt, Human
aacauggcaaaaccccauc

SEQ ID NO: 187161 - RNA, 21 nt, Human
aacauggcaaaaccccaucuc

SEQ ID NO: 187162 - RNA, 21 nt, Human
aacauggcaaaaccccaucuc

SEQ ID NO: 187163 - RNA, 21 nt, Human
aagauccagccucuuuucacc

SEQ ID NO: 187164 - RNA, 21 nt, Human
aagcagcagcacauugagaac

SEQ ID NO: 187165 - RNA, 20 nt, Human
aaggaggggagccuggcugg

SEQ ID NO: 187166 - RNA, 18 nt, Human
aaggggagaaaaaaaaug

SEQ ID NO: 187167 - RNA, 23 nt, Human
aaggggcuccuggggagcuugac

SEQ ID NO: 187168 - RNA, 21 nt, Human
aaguaaagagcacagcaacug

SEQ ID NO: 187169 - RNA, 23 nt, Human
aaguaggcauucuuugaaaaacu

SEQ ID NO: 187170 - RNA, 19 nt, Human
aagugcugggauuauaggc

SEQ ID NO: 187171 - RNA, 19 nt, Human
aagugcugggauuauaggc

SEQ ID NO: 187172 - RNA, 22 nt, Human
aagugggcagaucacuugaggu

SEQ ID NO: 187173 - RNA, 26 nt, Human
aagugggcagaucacuugaggucagg

SEQ ID NO: 187174 - RNA, 24 nt, Human
aaucacuugaacccgggaggcgga

SEQ ID NO: 187175 - RNA, 20 nt, Human
aaucuccgccucccgggcuc

SEQ ID NO: 187176 - RNA, 20 nt, Human
acaaacaaaaacacaaauaa

SEQ ID NO: 187177 - RNA, 24 nt, Human
acagagugagacuccaucucaaaa

SEQ ID NO: 187178 - RNA, 22 nt, Human
acaggagaaucacuugaacccg

SEQ ID NO: 187179 - RNA, 23 nt, Human
acaggcgcccgccaccacacccg

SEQ ID NO: 187180 - RNA, 23 nt, Human
accaagaaauacaccugagaaga

SEQ ID NO: 187181 - RNA, 24 nt, Human
accacagcaccaguguucagcagc

SEQ ID NO: 187182 - RNA, 18 nt, Human
accagagcucacagaaac

SEQ ID NO: 187183 - RNA, 19 nt, Human
acccaggcuggagugcagg

SEQ ID NO: 187184 - RNA, 24 nt, Human
accccaucucuacuaaaaacacaa

SEQ ID NO: 187185 - RNA, 24 nt, Human
accgcgccacugcacuccagccug

SEQ ID NO: 187186 - RNA, 20 nt, Human
accugauucucugccaacaa

SEQ ID NO: 187187 - RNA, 24 nt, Human
accuuaauaccccuaaaagauuca

SEQ ID NO: 187188 - RNA, 20 nt, Human
acggggcuucaccgucguag

SEQ ID NO: 187189 - RNA, 24 nt, Human
acggggcuucaccgucguagccag

SEQ ID NO: 187190 - RNA, 19 nt, Human
acuccagccugggccacag

SEQ ID NO: 187191 - RNA, 24 nt, Human
acuccagccugggccacagaguga

SEQ ID NO: 187192 - RNA, 18 nt, Human
acugcacuccagccuggg

SEQ ID NO: 187193 - RNA, 24 nt, Human
acugcacuccagccugggccacag

SEQ ID NO: 187194 - RNA, 18 nt, Human
acuuacagacgcacacaa

SEQ ID NO: 187195 - RNA, 24 nt, Human
acuugaggucaggaguucgagauc

SEQ ID NO: 187196 - RNA, 26 nt, Human
agaaaaaaaaugugucaugcaaagag

SEQ ID NO: 187197 - RNA, 27 nt, Human
agaaaaaaaaugugucaugcaaagagg

SEQ ID NO: 187198 - RNA, 18 nt, Human
agaaaaagaaguaaagag

SEQ ID NO: 187199 - RNA, 18 nt, Human
agacaggagaaucacuug

SEQ ID NO: 187200 - RNA, 24 nt, Human
agacaggagaaucacuugaacccg

SEQ ID NO: 187201 - RNA, 22 nt, Human
agaccgcgccacugcacuccag

SEQ ID NO: 187202 - RNA, 19 nt, Human
agacugaacaccacugaug

SEQ ID NO: 187203 - RNA, 19 nt, Human
agagguagggggcauggau

SEQ ID NO: 187204 - RNA, 21 nt, Human
agagguuccuagccugggagg

SEQ ID NO: 187205 - RNA, 20 nt, Human
agaucacuugaggucaggaa

SEQ ID NO: 187206 - RNA, 23 nt, Human
agaucacuugaggucaggaguuc

SEQ ID NO: 187207 - RNA, 24 nt, Human
agcacagcaacugacucaucucuu

SEQ ID NO: 187208 - RNA, 24 nt, Human
agcacuuuggggguccgaaguggg

SEQ ID NO: 187209 - RNA, 21 nt, Human
agccgggugugauggcucaug

SEQ ID NO: 187210 - RNA, 18 nt, Human
agccuccagaguagcugg

SEQ ID NO: 187211 - RNA, 24 nt, Human
agccugggccacagagugagacuc

SEQ ID NO: 187212 - RNA, 18 nt, Human
aggaaacuggaggcuacu

SEQ ID NO: 187213 - RNA, 23 nt, Human
aggaagagugagaggcugaccuu

SEQ ID NO: 187214 - RNA, 21 nt, Human
aggagaagggaaagcagcagc

SEQ ID NO: 187215 - RNA, 19 nt, Human
aggcaagggugggagcaga

SEQ ID NO: 187216 - RNA, 19 nt, Human
aggcacccccaaagcaagg

SEQ ID NO: 187217 - RNA, 24 nt, Human
aggcggagguugcagugagccaag

SEQ ID NO: 187218 - RNA, 20 nt, Human
aggcgugagccacugcaccc

SEQ ID NO: 187219 - RNA, 24 nt, Human
aggcugagacaggagaaucacuug

SEQ ID NO: 187220 - RNA, 22 nt, Human
agggauccugggccauggucuu

SEQ ID NO: 187221 - RNA, 21 nt, Human
agggggcauggauaggggaga

SEQ ID NO: 187222 - RNA, 21 nt, Human
agggggcuggccagugguggg

SEQ ID NO: 187223 - RNA, 22 nt, Human
agguagggggcauggauagggg

SEQ ID NO: 187224 - RNA, 20 nt, Human
aguaaccugaaggaagagug

SEQ ID NO: 187225 - RNA, 18 nt, Human
aguagcugggacuacagg

SEQ ID NO: 187226 - RNA, 19 nt, Human
aguagcugggacuacaggc

SEQ ID NO: 187227 - RNA, 21 nt, Human
agugacaccagagcucacaga

SEQ ID NO: 187228 - RNA, 20 nt, Human
agugcaggggcgcgaucuug

SEQ ID NO: 187229 - RNA, 24 nt, Human
agugcaggggcgcgaucuuggcuc

SEQ ID NO: 187230 - RNA, 21 nt, Human
aucacuugaggucaggaguuc

SEQ ID NO: 187231 - RNA, 24 nt, Human
augaucauggagaugagugacacc

SEQ ID NO: 187232 - RNA, 23 nt, Human
auggcucaugccugcagucccag

SEQ ID NO: 187233 - RNA, 24 nt, Human
caaacaaaaacacaaauaaaaaac

SEQ ID NO: 187234 - RNA, 24 nt, Human
caaauaaaaaaccucaucaaaugu

SEQ ID NO: 187235 - RNA, 27 nt, Human
caagggcaccgcacagccacagggaag

SEQ ID NO: 187236 - RNA, 19 nt, Human
cacaaaauuugaaaacuag

SEQ ID NO: 187237 - RNA, 21 nt, Human
cacacaaaauuugaaaacuag

SEQ ID NO: 187238 - RNA, 24 nt, Human
cacaccuggaaucccagcacuuug

SEQ ID NO: 187239 - RNA, 24 nt, Human
cacagagugagacuccaucucaaa

SEQ ID NO: 187240 - RNA, 18 nt, Human
caccaacaggacagcaga

SEQ ID NO: 187241 - RNA, 19 nt, Human
cacccuccaaccuuggguu

SEQ ID NO: 187242 - RNA, 24 nt, Human
caccgucguagccaggauggucuc

SEQ ID NO: 187243 - RNA, 20 nt, Human
caccugagaagaaagacaaa

SEQ ID NO: 187244 - RNA, 23 nt, Human
caccuggaaucccagcacuuugg

SEQ ID NO: 187245 - RNA, 24 nt, Human
caccuggaaucccagcacuuuggg

SEQ ID NO: 187246 - RNA, 22 nt, Human
cacuccagccugggccacagag

SEQ ID NO: 187247 - RNA, 22 nt, Human
cacuccagccugggccacagag

SEQ ID NO: 187248 - RNA, 24 nt, Human
cacuccagccugggccacagagug

SEQ ID NO: 187249 - RNA, 18 nt, Human
cacugcacuccagccugg

SEQ ID NO: 187250 - RNA, 19 nt, Human
cacugcacuccagccuggg

SEQ ID NO: 187251 - RNA, 20 nt, Human
cacugcacuccagccugggc

SEQ ID NO: 187252 - RNA, 24 nt, Human
cacugcacuccagccugggccaca

SEQ ID NO: 187253 - RNA, 23 nt, Human
cacuugaggucaggaguucgaga

SEQ ID NO: 187254 - RNA, 19 nt, Human
cagagguagggggcaugga

SEQ ID NO: 187255 - RNA, 19 nt, Human
cagagugagacuccaucuc

SEQ ID NO: 187256 - RNA, 27 nt, Human
cagaucacuugaggucaggaguucgag

SEQ ID NO: 187257 - RNA, 24 nt, Human
cagcacuuuggggguccgaagugg

SEQ ID NO: 187258 - RNA, 18 nt, Human
cagcccagaguagggcaa

SEQ ID NO: 187259 - RNA, 20 nt, Human
cagcccggcaaacauggcaa

SEQ ID NO: 187260 - RNA, 19 nt, Human
caggccgaagcggggacag

SEQ ID NO: 187261 - RNA, 21 nt, Human
caggcgcccgccaccacaccc

SEQ ID NO: 187262 - RNA, 23 nt, Human
cagggauccugggccauggucuu

SEQ ID NO: 187263 - RNA, 24 nt, Human
cagugaccuugacucucuucagcu

SEQ ID NO: 187264 - RNA, 24 nt, Human
caucaaauguguuaaaagcaugau

SEQ ID NO: 187265 - RNA, 22 nt, Human
caucuccaaauccaaagcccaa

SEQ ID NO: 187266 - RNA, 20 nt, Human
caugacaaaccccugcuaac

SEQ ID NO: 187267 - RNA, 21 nt, Human
caugacaaaccccugcuaacu

SEQ ID NO: 187268 - RNA, 22 nt, Human
caugccauucuccugccucagc

SEQ ID NO: 187269 - RNA, 18 nt, Human
cauguugacagguagcaa

SEQ ID NO: 187270 - RNA, 22 nt, Human
ccaaagugcugggauuauaggc

SEQ ID NO: 187271 - RNA, 24 nt, Human
ccaaagugcugggauuauaggcgu

SEQ ID NO: 187272 - RNA, 18 nt, Human
ccaagaccgcgccacugc

SEQ ID NO: 187273 - RNA, 24 nt, Human
ccaauucauucuccucaucuaccc

SEQ ID NO: 187274 - RNA, 19 nt, Human
ccacugcacccggccaugg

SEQ ID NO: 187275 - RNA, 19 nt, Human
ccacugcacccggccaugg

SEQ ID NO: 187276 - RNA, 20 nt, Human
ccacugcacuccagccuggg

SEQ ID NO: 187277 - RNA, 21 nt, Human
ccacugcacuccagccugggc

SEQ ID NO: 187278 - RNA, 24 nt, Human
ccacugcacuccagccugggccac

SEQ ID NO: 187279 - RNA, 23 nt, Human
ccagaguagcugggacuacaggc

SEQ ID NO: 187280 - RNA, 21 nt, Human
ccagcacuuuggggguccgaa

SEQ ID NO: 187281 - RNA, 20 nt, Human
ccagccccagcaggcuuagc

SEQ ID NO: 187282 - RNA, 20 nt, Human
ccagguaaguuuaugauggg

SEQ ID NO: 187283 - RNA, 23 nt, Human
ccauccaagacagucuuccacaa

SEQ ID NO: 187284 - RNA, 26 nt, Human
ccaucucaaaaaacaaacaaaaacac

SEQ ID NO: 187285 - RNA, 22 nt, Human
ccauuggcagcagcucaugggc

SEQ ID NO: 187286 - RNA, 26 nt, Human
ccauuggcagcagcucuguuucuccc

SEQ ID NO: 187287 - RNA, 20 nt, Human
cccaucuccaaauccaaagc

SEQ ID NO: 187288 - RNA, 23 nt, Human
ccccaaagcaaggaucuuggccu

SEQ ID NO: 187289 - RNA, 22 nt, Human
cccugcuaacuuuaaaaccacc

SEQ ID NO: 187290 - RNA, 23 nt, Human
ccucaaguagaccacccuaauuc

SEQ ID NO: 187291 - RNA, 22 nt, Human
ccuccccucucucccucuuaaa

SEQ ID NO: 187292 - RNA, 18 nt, Human
ccucugcugauugacuuc

SEQ ID NO: 187293 - RNA, 18 nt, Human
ccugcagucccagcuacu

SEQ ID NO: 187294 - RNA, 18 nt, Human
ccugcagucccagcuacu

SEQ ID NO: 187295 - RNA, 21 nt, Human
ccugcagucccagcuacuugg

SEQ ID NO: 187296 - RNA, 19 nt, Human
ccuguucacacagagagag

SEQ ID NO: 187297 - RNA, 24 nt, Human
cgaagugggcagaucacuugaggu

SEQ ID NO: 187298 - RNA, 26 nt, Human
cgaagugggcagaucacuugagguca

SEQ ID NO: 187299 - RNA, 26 nt, Human
cgccacugcacuccagccugggccac

SEQ ID NO: 187300 - RNA, 19 nt, Human
cgccucccgggcucaugcc

SEQ ID NO: 187301 - RNA, 22 nt, Human
cggcaaacauggcaaaacccca

SEQ ID NO: 187302 - RNA, 22 nt, Human
cggcucacaccuggaaucccag

SEQ ID NO: 187303 - RNA, 24 nt, Human
cgggaggcggagguugcagugagc

SEQ ID NO: 187304 - RNA, 21 nt, Human
cguugaaacaaaaugagugcc

SEQ ID NO: 187305 - RNA, 20 nt, Human
cuaaaaacacaaaaaaccag

SEQ ID NO: 187306 - RNA, 24 nt, Human
cucacaccuggaaucccagcacuu

SEQ ID NO: 187307 - RNA, 24 nt, Human
cucagccuccagaguagcugggac

SEQ ID NO: 187308 - RNA, 24 nt, Human
cucaugccugcagucccagcuacu

SEQ ID NO: 187309 - RNA, 21 nt, Human
cucauugccuggagaugcucu

SEQ ID NO: 187310 - RNA, 18 nt, Human
cuccacaugagcuccagg

SEQ ID NO: 187311 - RNA, 22 nt, Human
cuccaucucaaaaaacaaacaa

SEQ ID NO: 187312 - RNA, 20 nt, Human
cucccuuucuucucgaguuu

SEQ ID NO: 187313 - RNA, 24 nt, Human
cuccugaccucgugauccgcccgc

SEQ ID NO: 187314 - RNA, 21 nt, Human
cuccuggagucuuccucuucu

SEQ ID NO: 187315 - RNA, 23 nt, Human
cucgacacuggaaucagcaguug

SEQ ID NO: 187316 - RNA, 20 nt, Human
cucugaagcaacgcugccau

SEQ ID NO: 187317 - RNA, 23 nt, Human
cucugucacccaggcuggagugc

SEQ ID NO: 187318 - RNA, 21 nt, Human
cucuucccaucuccaaaucca

SEQ ID NO: 187319 - RNA, 19 nt, Human
cugagaaauaauucccuuu

SEQ ID NO: 187320 - RNA, 23 nt, Human
cugccucagccuccagaguagcu

SEQ ID NO: 187321 - RNA, 23 nt, Human
cuuccacucugauaaccaauuca

SEQ ID NO: 187322 - RNA, 18 nt, Human
cuucucuuuccuucaggc

SEQ ID NO: 187323 - RNA, 23 nt, Human
cuuuagagauggugagagauugg

SEQ ID NO: 187324 - RNA, 19 nt, Human
gaaaacuagcuuguccaca

SEQ ID NO: 187325 - RNA, 18 nt, Human
gaaagggaacaguuccca

SEQ ID NO: 187326 - RNA, 18 nt, Human
gacagguagcaacagagu

SEQ ID NO: 187327 - RNA, 22 nt, Human
gaccucgugauccgcccgccuc

SEQ ID NO: 187328 - RNA, 22 nt, Human
gaccucgugauccgcccgccuc

SEQ ID NO: 187329 - RNA, 23 nt, Human
gagaaucacuugaacccgggagg

SEQ ID NO: 187330 - RNA, 21 nt, Human
gaggcacccccaaagcaagga

SEQ ID NO: 187331 - RNA, 18 nt, Human
gagguugcagugagccaa

SEQ ID NO: 187332 - RNA, 23 nt, Human
gagguugcagugagccaagaccg

SEQ ID NO: 187333 - RNA, 25 nt, Human
gaguagcugggacuacaggcgcccg

SEQ ID NO: 187334 - RNA, 24 nt, Human
gaucacuugaggucaggaguucga

SEQ ID NO: 187335 - RNA, 24 nt, Human
gauggcucaugccugcagucccag

SEQ ID NO: 187336 - RNA, 18 nt, Human
gauuauaggcgugagcca

SEQ ID NO: 187337 - RNA, 22 nt, Human
gauuauaggcgugagccacugc

SEQ ID NO: 187338 - RNA, 23 nt, Human
gauuauaggcgugagccacugca

SEQ ID NO: 187339 - RNA, 21 nt, Human
gcaaacauggcaaaaccccau

SEQ ID NO: 187340 - RNA, 23 nt, Human
gcacuccagccugggccacagag

SEQ ID NO: 187341 - RNA, 19 nt, Human
gcagcagcucuguuucucc

SEQ ID NO: 187342 - RNA, 22 nt, Human
gcaggggcgcgaucuuggcuca

SEQ ID NO: 187343 - RNA, 20 nt, Human
gccaagaccgcgccacugca

SEQ ID NO: 187344 - RNA, 22 nt, Human
gccacugcacuccagccugggc

SEQ ID NO: 187345 - RNA, 18 nt, Human
gcccaccaacaggacagc

SEQ ID NO: 187346 - RNA, 26 nt, Human
gccgaaguucagagaucuucggaccg

SEQ ID NO: 187347 - RNA, 18 nt, Human
gccuccccucucucccuc

SEQ ID NO: 187348 - RNA, 23 nt, Human
gccucggccucccaaagugcugg

SEQ ID NO: 187349 - RNA, 25 nt, Human
gcugcaaaugccuucuuccugcugg

SEQ ID NO: 187350 - RNA, 25 nt, Human
gcuggagugcaggggcgcgaucuug

SEQ ID NO: 187351 - RNA, 18 nt, Human
ggacagcagagagcaagg

SEQ ID NO: 187352 - RNA, 18 nt, Human
ggagguugcagugagcca

SEQ ID NO: 187353 - RNA, 20 nt, Human
ggagguugcagugagccaag

SEQ ID NO: 187354 - RNA, 20 nt, Human
ggagugcaggggcgcgaucu

SEQ ID NO: 187355 - RNA, 25 nt, Human
ggcagaucacuugaggucaggaguu

SEQ ID NO: 187356 - RNA, 19 nt, Human
ggcagcagcucaugggcac

SEQ ID NO: 187357 - RNA, 24 nt, Human
ggcucugucacccaggcuggagug

SEQ ID NO: 187358 - RNA, 21 nt, Human
gggaauuggaggugaaaggga

SEQ ID NO: 187359 - RNA, 22 nt, Human
gggaauuggaggugaaagggaa

SEQ ID NO: 187360 - RNA, 24 nt, Human
gggagggagaaacgcagggugugu

SEQ ID NO: 187361 - RNA, 22 nt, Human
gggcuucaccgucguagccagg

SEQ ID NO: 187362 - RNA, 25 nt, Human
ggggagcuugacgguccaucgguuu

SEQ ID NO: 187363 - RNA, 20 nt, Human
ggucucaaucuccugaccuc

SEQ ID NO: 187364 - RNA, 20 nt, Human
ggugugauggcucaugccug

SEQ ID NO: 187365 - RNA, 21 nt, Human
ggugugauggcucaugccugc

SEQ ID NO: 187366 - RNA, 21 nt, Human
guccucagguucacagaucua

SEQ ID NO: 187367 - RNA, 24 nt, Human
gugauccgcccgccucggccuccc

SEQ ID NO: 187368 - RNA, 19 nt, Human
guggcuuucuugaguucug

SEQ ID NO: 187369 - RNA, 21 nt, Human
gugggguagagagagugccua

SEQ ID NO: 187370 - RNA, 23 nt, Human
uaaaaaacaaacaucaguugcaa

SEQ ID NO: 187371 - RNA, 20 nt, Human
uaaaaacacaaaaaaccagc

SEQ ID NO: 187372 - RNA, 21 nt, Human
uaaaaacacaaaaaaccagcc

SEQ ID NO: 187373 - RNA, 23 nt, Human
uaaaagauacaguaauucaacac

SEQ ID NO: 187374 - RNA, 24 nt, Human
uaaaagauacaguaauucaacaca

SEQ ID NO: 187375 - RNA, 18 nt, Human
uaaagagcacagcaacug

SEQ ID NO: 187376 - RNA, 23 nt, Human
uaaagagcacagcaacugacuca

SEQ ID NO: 187377 - RNA, 22 nt, Human
uaacaaggaauuccagaaacag

SEQ ID NO: 187378 - RNA, 20 nt, Human
uaaccuacuaguauacuccc

SEQ ID NO: 187379 - RNA, 23 nt, Human
uaagugaucccugggucuuacaa

SEQ ID NO: 187380 - RNA, 23 nt, Human
uacaggcgcccgccaccacaccc

SEQ ID NO: 187381 - RNA, 24 nt, Human
uacccuaaaguuuccuguucacac

SEQ ID NO: 187382 - RNA, 19 nt, Human
uagaggcaggcaagggugg

SEQ ID NO: 187383 - RNA, 22 nt, Human
uagcuaauaggaaggaggggag

SEQ ID NO: 187384 - RNA, 19 nt, Human
uauaggcgugagccacugc

SEQ ID NO: 187385 - RNA, 23 nt, Human
ucaaaaaacaaacaaaaacacaa

SEQ ID NO: 187386 - RNA, 24 nt, Human
ucaaaugcucuccucugcugauug

SEQ ID NO: 187387 - RNA, 18 nt, Human
ucacccaggcuggagugc

SEQ ID NO: 187388 - RNA, 24 nt, Human
ucaccgcaaucuccgccucccggg

SEQ ID NO: 187389 - RNA, 25 nt, Human
ucaccgcaaucuccgccucccgggc

SEQ ID NO: 187390 - RNA, 24 nt, Human
ucaccgucguagccaggauggucu

SEQ ID NO: 187391 - RNA, 18 nt, Human
ucacgcugcauuucucag

SEQ ID NO: 187392 - RNA, 24 nt, Human
ucacuugaacccgggaggcggagg

SEQ ID NO: 187393 - RNA, 20 nt, Human
ucacuugaggucaggaguuc

SEQ ID NO: 187394 - RNA, 22 nt, Human
ucagaagauguggagaaaaaga

SEQ ID NO: 187395 - RNA, 18 nt, Human
ucaggccgaagcggggac

SEQ ID NO: 187396 - RNA, 20 nt, Human
uccaagcagugaagcugggg

SEQ ID NO: 187397 - RNA, 26 nt, Human
uccacaagauccagccucuuuucacc

SEQ ID NO: 187398 - RNA, 24 nt, Human
uccagaaacaggaaacacucugaa

SEQ ID NO: 187399 - RNA, 24 nt, Human
uccagaguagcugggacuacaggc

SEQ ID NO: 187400 - RNA, 23 nt, Human
uccagccugggccacagagugag

SEQ ID NO: 187401 - RNA, 24 nt, Human
uccagccugggccacagagugaga

SEQ ID NO: 187402 - RNA, 24 nt, Human
ucccaaagugcugggauuauaggc

SEQ ID NO: 187403 - RNA, 19 nt, Human
ucccauuggcagcagcucu

SEQ ID NO: 187404 - RNA, 18 nt, Human
uccccugaggccuccauu

SEQ ID NO: 187405 - RNA, 21 nt, Human
ucccgggcucaugccauucuc

SEQ ID NO: 187406 - RNA, 24 nt, Human
ucccgggcucaugccauucuccug

SEQ ID NO: 187407 - RNA, 18 nt, Human
ucccgugcaugagaagac

SEQ ID NO: 187408 - RNA, 18 nt, Human
uccugaaucacaauggcc

SEQ ID NO: 187409 - RNA, 18 nt, Human
ucggccucccaaagugcu

SEQ ID NO: 187410 - RNA, 19 nt, Human
ucuccaaauccaaagccca

SEQ ID NO: 187411 - RNA, 19 nt, Human
ucuccgccucccgggcuca

SEQ ID NO: 187412 - RNA, 24 nt, Human
ucuccugccucagccuccagagua

SEQ ID NO: 187413 - RNA, 20 nt, Human
ucucugccaacaaacuacuu

SEQ ID NO: 187414 - RNA, 19 nt, Human
ucuggcucugucacccagg

SEQ ID NO: 187415 - RNA, 23 nt, Human
ucuggcucugucacccaggcugg

SEQ ID NO: 187416 - RNA, 24 nt, Human
ucuggcucugucacccaggcugga

SEQ ID NO: 187417 - RNA, 24 nt, Human
ucugucacccaggcuggagugcag

SEQ ID NO: 187418 - RNA, 21 nt, Human
ugaaacaaaaugagugccccc

SEQ ID NO: 187419 - RNA, 19 nt, Human
ugaaaucuccagguaguac

SEQ ID NO: 187420 - RNA, 22 nt, Human
ugaagcaacgcugccauccaag

SEQ ID NO: 187421 - RNA, 26 nt, Human
ugaagcuggggccaagugucuacagg

SEQ ID NO: 187422 - RNA, 19 nt, Human
ugacaggccaacggcugcu

SEQ ID NO: 187423 - RNA, 20 nt, Human
ugagacaggagaaucacuug

SEQ ID NO: 187424 - RNA, 24 nt, Human
ugagacaggagaaucacuugaacc

SEQ ID NO: 187425 - RNA, 22 nt, Human
ugagaugaucauggagaugagu

SEQ ID NO: 187426 - RNA, 18 nt, Human
ugaguucugucuuggucc

SEQ ID NO: 187427 - RNA, 22 nt, Human
ugauaaacugaguagugaauca

SEQ ID NO: 187428 - RNA, 24 nt, Human
ugauggcucaugccugcaguccca

SEQ ID NO: 187429 - RNA, 21 nt, Human
ugccuauuguaaacaaaagca

SEQ ID NO: 187430 - RNA, 24 nt, Human
ugccucagccuccagaguagcugg

SEQ ID NO: 187431 - RNA, 19 nt, Human
ugccuccccucucucccuc

SEQ ID NO: 187432 - RNA, 24 nt, Human
ugccugcagucccagcuacuuggg

SEQ ID NO: 187433 - RNA, 22 nt, Human
uggaggaacagaaauauuaaga

SEQ ID NO: 187434 - RNA, 23 nt, Human
uggagugcaggggcgcgaucuug

SEQ ID NO: 187435 - RNA, 24 nt, Human
uggagugcaggggcgcgaucuugg

SEQ ID NO: 187436 - RNA, 20 nt, Human
uggauuguaucucacugaug

SEQ ID NO: 187437 - RNA, 19 nt, Human
uggcagagagguuccuagc

SEQ ID NO: 187438 - RNA, 26 nt, Human
uggcagagagguuccuagccugggag

SEQ ID NO: 187439 - RNA, 20 nt, Human
uggcagcagcucaugggcac

SEQ ID NO: 187440 - RNA, 21 nt, Human
uggcagcagcucuguuucucc

SEQ ID NO: 187441 - RNA, 22 nt, Human
uggcauucuuuagcuacgaaau

SEQ ID NO: 187442 - RNA, 24 nt, Human
uggcucugucacccaggcuggagu

SEQ ID NO: 187443 - RNA, 21 nt, Human
ugggacuacaggcgcccgcca

SEQ ID NO: 187444 - RNA, 22 nt, Human
ugggacuacaggcgcccgccac

SEQ ID NO: 187445 - RNA, 24 nt, Human
ugggacuacaggcgcccgccacca

SEQ ID NO: 187446 - RNA, 19 nt, Human
ugggagcagagauggguga

SEQ ID NO: 187447 - RNA, 24 nt, Human
ugggaggcugagacaggagaauca

SEQ ID NO: 187448 - RNA, 19 nt, Human
ugggauuauaggcgugagc

SEQ ID NO: 187449 - RNA, 21 nt, Human
ugggauuauaggcgugagcca

SEQ ID NO: 187450 - RNA, 22 nt, Human
ugggauuauaggcgugagccac

SEQ ID NO: 187451 - RNA, 22 nt, Human
ugggauuauaggcgugagccac

SEQ ID NO: 187452 - RNA, 24 nt, Human
ugggauuauaggcgugagccacug

SEQ ID NO: 187453 - RNA, 18 nt, Human
ugggcagaucacuugagg

SEQ ID NO: 187454 - RNA, 24 nt, Human
ugggcagaucacuugaggucagga

SEQ ID NO: 187455 - RNA, 24 nt, Human
uggggguaccaagaaauacaccug

SEQ ID NO: 187456 - RNA, 25 nt, Human
uggggguaccaagaaauacaccuga

SEQ ID NO: 187457 - RNA, 20 nt, Human
uggggguccgaagugggcag

SEQ ID NO: 187458 - RNA, 24 nt, Human
uggggguccgaagugggcagauca

SEQ ID NO: 187459 - RNA, 24 nt, Human
ugggguagagagagugccuauugu

SEQ ID NO: 187460 - RNA, 22 nt, Human
ugguagugucucgcuugcuccu

SEQ ID NO: 187461 - RNA, 22 nt, Human
ugucuugguccuguccauucuu

SEQ ID NO: 187462 - RNA, 24 nt, Human
uguuagaaaaccauucaaaaaaag

SEQ ID NO: 187463 - RNA, 25 nt, Human
uguuagaaaaccauucaaaaaaagu

SEQ ID NO: 187464 - RNA, 23 nt, Human
uuaacccucuucauccugcaugc

SEQ ID NO: 187465 - RNA, 24 nt, Human
uuagcagagacggggcuucaccgu

SEQ ID NO: 187466 - RNA, 22 nt, Human
uucaaaaaaaaaaaguaaaaga

SEQ ID NO: 187467 - RNA, 24 nt, Human
uucagagaucuccuuuucuaacuc

SEQ ID NO: 187468 - RNA, 18 nt, Human
uuccuccacaugagcucc

SEQ ID NO: 187469 - RNA, 20 nt, Human
uuccuccacaugagcuccag

SEQ ID NO: 187470 - RNA, 20 nt, Human
uucugucuugguccugucca

SEQ ID NO: 187471 - RNA, 18 nt, Human
uucuugcaguacugaugc

SEQ ID NO: 187472 - RNA, 24 nt, Human
uugaacccgggaggcggagguugc

SEQ ID NO: 187473 - RNA, 22 nt, Human
uugcagugagccaagaccgcgc

SEQ ID NO: 187474 - RNA, 25 nt, Human
uugggaggcugagacaggagaauca

SEQ ID NO: 187475 - RNA, 24 nt, Human
uuuaaaguucccuaacaaggaauu

SEQ ID NO: 187476 - RNA, 24 nt, Human
uuucucaguggcaaagagaaaugg

SEQ ID NO: 187477 - RNA, 22 nt, Human
uuuguagcuaauaggaaggagg

SEQ ID NO: 187478 - RNA, 23 nt, Human
uuuuauuuuuuugguuugguuuu

SEQ ID NO: 187479 - RNA, 23 nt, Human
uuuuccccaguggcuuucuugag

SEQ ID NO: 187480 - RNA, 22 nt, Human
aacgugaagcuuuuggaagaga

SEQ ID NO: 187481 - RNA, 26 nt, Human
aagcaagugucaauauuauucuccac

SEQ ID NO: 187482 - RNA, 20 nt, Human
aagggagacaaauucaagca

SEQ ID NO: 187483 - RNA, 18 nt, Human
accacucugaaagagggu

SEQ ID NO: 187484 - RNA, 20 nt, Human
acugugccuccuccucccca

SEQ ID NO: 187485 - RNA, 19 nt, Human
agcaucagaguuacugcau

SEQ ID NO: 187486 - RNA, 19 nt, Human
agcuucuguccccugaaga

SEQ ID NO: 187487 - RNA, 19 nt, Human
aggcagauguagauagaug

SEQ ID NO: 187488 - RNA, 18 nt, Human
auggauccacuuugugcu

SEQ ID NO: 187489 - RNA, 24 nt, Human
auuucauuucccugccccccuccc

SEQ ID NO: 187490 - RNA, 23 nt, Human
caagaagggagacaaauucaagc

SEQ ID NO: 187491 - RNA, 24 nt, Human
cacaccccugaggggggcagaaaa

SEQ ID NO: 187492 - RNA, 24 nt, Human
caccccugaggggggcagaaaagc

SEQ ID NO: 187493 - RNA, 21 nt, Human
caccucuuacucccuccucca

SEQ ID NO: 187494 - RNA, 26 nt, Human
cagacaaaaagcuucuguccccugaa

SEQ ID NO: 187495 - RNA, 18 nt, Human
cagccuuuuuuccuugcc

SEQ ID NO: 187496 - RNA, 19 nt, Human
caggacaaaacuccauuuc

SEQ ID NO: 187497 - RNA, 28 nt, Human
cauuaacugugccuccuccuccccaccu

SEQ ID NO: 187498 - RNA, 22 nt, Human
ccccaccucuuacucccuccuc

SEQ ID NO: 187499 - RNA, 24 nt, Human
ccccaccucuuacucccuccucca

SEQ ID NO: 187500 - RNA, 25 nt, Human
ccccaccucuuacucccuccuccaa

SEQ ID NO: 187501 - RNA, 25 nt, Human
ccccacugccuuccacacaccccug

SEQ ID NO: 187502 - RNA, 22 nt, Human
ccccccucccaacucccccacu

SEQ ID NO: 187503 - RNA, 19 nt, Human
cccccucccaacuccccca

SEQ ID NO: 187504 - RNA, 20 nt, Human
cccugaggggggcagaaaag

SEQ ID NO: 187505 - RNA, 25 nt, Human
ccuccaaacuaacccuagucagccc

SEQ ID NO: 187506 - RNA, 27 nt, Human
ccuccaaacuaacccuagucagcccug

SEQ ID NO: 187507 - RNA, 22 nt, Human
ccucccaacucccccacugccu

SEQ ID NO: 187508 - RNA, 21 nt, Human
ccucuuacucccuccuccaaa

SEQ ID NO: 187509 - RNA, 23 nt, Human
ccugccccccucccaacuccccc

SEQ ID NO: 187510 - RNA, 23 nt, Human
cucccaacucccccacugccuuc

SEQ ID NO: 187511 - RNA, 21 nt, Human
cucccuccuccaaacuaaccc

SEQ ID NO: 187512 - RNA, 22 nt, Human
cugccccccucccaacuccccc

SEQ ID NO: 187513 - RNA, 18 nt, Human
gaagagaagggguugagu

SEQ ID NO: 187514 - RNA, 24 nt, Human
gaagggagacaaauucaagcauca

SEQ ID NO: 187515 - RNA, 26 nt, Human
gcagcuccagacaaaaagggaacgcc

SEQ ID NO: 187516 - RNA, 20 nt, Human
ggggggcagaaaagcaagug

SEQ ID NO: 187517 - RNA, 24 nt, Human
gggguugaguuuaugucuuggcuu

SEQ ID NO: 187518 - RNA, 24 nt, Human
guauguauauauagucauggaguc

SEQ ID NO: 187519 - RNA, 25 nt, Human
gucuuggcuuugacaccgaguuauu

SEQ ID NO: 187520 - RNA, 27 nt, Human
gugccuccuccuccccaccucuuacuc

SEQ ID NO: 187521 - RNA, 23 nt, Human
guugaguuuaugucuuggcuuug

SEQ ID NO: 187522 - RNA, 25 nt, Human
uaaaaaguuguguguguacacaggc

SEQ ID NO: 187523 - RNA, 23 nt, Human
uaauuaccagcccaauugccaau

SEQ ID NO: 187524 - RNA, 21 nt, Human
ucauggaguccagccuuuuuu

SEQ ID NO: 187525 - RNA, 22 nt, Human
ucccugccccccucccaacucc

SEQ ID NO: 187526 - RNA, 18 nt, Human
ucuugugggcagcuccag

SEQ ID NO: 187527 - RNA, 18 nt, Human
ugaagcuuuuggaagaga

SEQ ID NO: 187528 - RNA, 22 nt, Human
ugcaucaacuaauuaccagccc

SEQ ID NO: 187529 - RNA, 18 nt, Human
ugccuuccacacaccccu

SEQ ID NO: 187530 - RNA, 20 nt, Human
uggaagagaagggguugagu

SEQ ID NO: 187531 - RNA, 24 nt, Human
ugugccuccuccuccccaccucuu

SEQ ID NO: 187532 - RNA, 23 nt, Human
ugugcugucuuccauguaccacu

SEQ ID NO: 187533 - RNA, 18 nt, Human
uuccauguaccacucuga

SEQ ID NO: 187534 - RNA, 18 nt, Human
uuucccugccccccuccc

SEQ ID NO: 187535 - RNA, 20 nt, Human
aaaaagaaauccuagaguug

SEQ ID NO: 187536 - RNA, 24 nt, Human
aaaacaaagaaggagugcaaaaaa

SEQ ID NO: 187537 - RNA, 21 nt, Human
aaaacucuuccauguccacaa

SEQ ID NO: 187538 - RNA, 23 nt, Human
aaaacucuuccauguccacaacc

SEQ ID NO: 187539 - RNA, 21 nt, Human
aaacaaagaaggagugcaagg

SEQ ID NO: 187540 - RNA, 24 nt, Human
aaagaaggagugcaaaaaagugau

SEQ ID NO: 187541 - RNA, 19 nt, Human
aaagcacauggaauaaagg

SEQ ID NO: 187542 - RNA, 21 nt, Human
aaagcacauggaauaaagguu

SEQ ID NO: 187543 - RNA, 25 nt, Human
aaaugccuaccacagugacaccuuu

SEQ ID NO: 187544 - RNA, 19 nt, Human
aacaaaagaacauucugga

SEQ ID NO: 187545 - RNA, 24 nt, Human
aacgggucaccaacagaaccaaaa

SEQ ID NO: 187546 - RNA, 19 nt, Human
aaggcugaaguacccaggu

SEQ ID NO: 187547 - RNA, 22 nt, Human
aagugaucaauacaaaaaaagu

SEQ ID NO: 187548 - RNA, 22 nt, Human
acaaaaauaaaagucaaauguc

SEQ ID NO: 187549 - RNA, 19 nt, Human
acaaaauaugccaaaugcc

SEQ ID NO: 187550 - RNA, 20 nt, Human
acaacccugagcuguccccu

SEQ ID NO: 187551 - RNA, 20 nt, Human
acaagacacacuaauaacaa

SEQ ID NO: 187552 - RNA, 20 nt, Human
acacgccaggccaauuuaca

SEQ ID NO: 187553 - RNA, 19 nt, Human
acagaaccaaaaaaaaggu

SEQ ID NO: 187554 - RNA, 21 nt, Human
acagaaccaaaaaaaaggucc

SEQ ID NO: 187555 - RNA, 23 nt, Human
acagcacgaagacaaccaggugc

SEQ ID NO: 187556 - RNA, 24 nt, Human
acagcacgaagacaaccaggugcc

SEQ ID NO: 187557 - RNA, 19 nt, Human
acaguggguaucacguggc

SEQ ID NO: 187558 - RNA, 22 nt, Human
acaucacaaaucuaccgccagc

SEQ ID NO: 187559 - RNA, 22 nt, Human
accaacagaaccaaaaaaaagg

SEQ ID NO: 187560 - RNA, 22 nt, Human
acccaucucgcucugggucccc

SEQ ID NO: 187561 - RNA, 22 nt, Human
acugugguugcuugacugaguc

SEQ ID NO: 187562 - RNA, 23 nt, Human
agaaaagaaaaucacaggcagag

SEQ ID NO: 187563 - RNA, 21 nt, Human
agagaagacaaaacaucuagg

SEQ ID NO: 187564 - RNA, 20 nt, Human
agcaaacaaaagaacauucu

SEQ ID NO: 187565 - RNA, 22 nt, Human
agcagcagggguaaggcaguga

SEQ ID NO: 187566 - RNA, 23 nt, Human
agccugugccuguggccccugca

SEQ ID NO: 187567 - RNA, 19 nt, Human
aggaagaaaaugcaauuga

SEQ ID NO: 187568 - RNA, 26 nt, Human
aggcagagauacaaagucaacaggcu

SEQ ID NO: 187569 - RNA, 19 nt, Human
aggcagucgucaggcaggc

SEQ ID NO: 187570 - RNA, 22 nt, Human
aggcgaggccauucagccugcu

SEQ ID NO: 187571 - RNA, 19 nt, Human
agggacaucagccgugaaa

SEQ ID NO: 187572 - RNA, 18 nt, Human
agggggccacccgagggg

SEQ ID NO: 187573 - RNA, 24 nt, Human
aguguuacuauacgguagacugac

SEQ ID NO: 187574 - RNA, 18 nt, Human
augaagcaaagcacaugg

SEQ ID NO: 187575 - RNA, 19 nt, Human
auggaauaaagguuuuguc

SEQ ID NO: 187576 - RNA, 25 nt, Human
auuucuaauuacaagaaacagaaca

SEQ ID NO: 187577 - RNA, 21 nt, Human
caaaaaaaagguccuccguac

SEQ ID NO: 187578 - RNA, 19 nt, Human
caaaacaacccugagcugu

SEQ ID NO: 187579 - RNA, 24 nt, Human
caaaacaucuaggcugaggcacau

SEQ ID NO: 187580 - RNA, 22 nt, Human
caaaugccuaccacagugacag

SEQ ID NO: 187581 - RNA, 19 nt, Human
caacccugagcuguccccu

SEQ ID NO: 187582 - RNA, 21 nt, Human
caagacacacuaauaacaaga

SEQ ID NO: 187583 - RNA, 26 nt, Human
cacauggaauaaagguuuugucucuu

SEQ ID NO: 187584 - RNA, 25 nt, Human
caccaacagaaccaaaaaaaagguc

SEQ ID NO: 187585 - RNA, 22 nt, Human
caccacaguaguuugucgccug

SEQ ID NO: 187586 - RNA, 21 nt, Human
caccacugcagcagcaggggu

SEQ ID NO: 187587 - RNA, 20 nt, Human
cacccgaggggcggagggga

SEQ ID NO: 187588 - RNA, 21 nt, Human
caccgcuggccgaugacgggu

SEQ ID NO: 187589 - RNA, 19 nt, Human
caccgcuuggacuccacac

SEQ ID NO: 187590 - RNA, 18 nt, Human
cacgaagacaaccaggug

SEQ ID NO: 187591 - RNA, 21 nt, Human
cacuaauaacaagaggaucug

SEQ ID NO: 187592 - RNA, 22 nt, Human
cacuccaguguucacuuccucc

SEQ ID NO: 187593 - RNA, 24 nt, Human
cacucucacaccugaucacuaagc

SEQ ID NO: 187594 - RNA, 22 nt, Human
cagaaaagagaagacaaaacau

SEQ ID NO: 187595 - RNA, 18 nt, Human
cagcagcagggguaaggc

SEQ ID NO: 187596 - RNA, 21 nt, Human
caggcggcggcccccaggagc

SEQ ID NO: 187597 - RNA, 22 nt, Human
caggcuccaaaacaacccugag

SEQ ID NO: 187598 - RNA, 21 nt, Human
caggugugucucaaggaggcu

SEQ ID NO: 187599 - RNA, 19 nt, Human
cagucggagcacccggggc

SEQ ID NO: 187600 - RNA, 22 nt, Human
cagucgucaggcaggcguuugg

SEQ ID NO: 187601 - RNA, 23 nt, Human
caguggggcggauuuggggcaau

SEQ ID NO: 187602 - RNA, 19 nt, Human
caucagccgugaaacgacu

SEQ ID NO: 187603 - RNA, 18 nt, Human
ccaaaacaacccugagcu

SEQ ID NO: 187604 - RNA, 24 nt, Human
ccaaaugccuaccacagugacacc

SEQ ID NO: 187605 - RNA, 24 nt, Human
ccaagccaagaugaucauuccagu

SEQ ID NO: 187606 - RNA, 19 nt, Human
ccacugucccggacgcccg

SEQ ID NO: 187607 - RNA, 23 nt, Human
ccagcacacauuaauagaagcca

SEQ ID NO: 187608 - RNA, 18 nt, Human
ccaugcccuccccaauuu

SEQ ID NO: 187609 - RNA, 19 nt, Human
ccucugggaacauuugggg

SEQ ID NO: 187610 - RNA, 20 nt, Human
ccugcagcguuuccuugucu

SEQ ID NO: 187611 - RNA, 21 nt, Human
ccugcagcugcugcuuccugc

SEQ ID NO: 187612 - RNA, 22 nt, Human
ccugggcgcccacccucccagg

SEQ ID NO: 187613 - RNA, 22 nt, Human
ccugugcacaauauuuucagaa

SEQ ID NO: 187614 - RNA, 24 nt, Human
ccuguggccccugcagcguuuccu

SEQ ID NO: 187615 - RNA, 19 nt, Human
ccuugaaaaggguuuaccu

SEQ ID NO: 187616 - RNA, 21 nt, Human
cgccacaucccccuccuacaa

SEQ ID NO: 187617 - RNA, 21 nt, Human
cgcccggacgcccgggcgcgc

SEQ ID NO: 187618 - RNA, 20 nt, Human
cgcucuggguccccaggugc

SEQ ID NO: 187619 - RNA, 26 nt, Human
cggcggcuaacgggucaccaacagaa

SEQ ID NO: 187620 - RNA, 23 nt, Human
cgggucaccaacagaaccaaaaa

SEQ ID NO: 187621 - RNA, 22 nt, Human
cuagcugcucuguguucacugg

SEQ ID NO: 187622 - RNA, 22 nt, Human
cuauguacagaaugaagcaaag

SEQ ID NO: 187623 - RNA, 24 nt, Human
cucaacuugguguuaggccccagc

SEQ ID NO: 187624 - RNA, 23 nt, Human
cucuguagcacugucugcugggg

SEQ ID NO: 187625 - RNA, 19 nt, Human
cugacccuaagccagcaga

SEQ ID NO: 187626 - RNA, 18 nt, Human
cugaggcacauguuucuu

SEQ ID NO: 187627 - RNA, 22 nt, Human
cugaguccacaaaauaugccaa

SEQ ID NO: 187628 - RNA, 18 nt, Human
cugcccauucaaaacucu

SEQ ID NO: 187629 - RNA, 21 nt, Human
cuggcugccggucacugggcu

SEQ ID NO: 187630 - RNA, 18 nt, Human
cugggaacauuuggggac

SEQ ID NO: 187631 - RNA, 18 nt, Human
cugugaaucagagucaag

SEQ ID NO: 187632 - RNA, 18 nt, Human
cuuauuuguacaaaaaua

SEQ ID NO: 187633 - RNA, 20 nt, Human
cuugcccgcccccagaaagg

SEQ ID NO: 187634 - RNA, 22 nt, Human
gaaaauucuucauuuguauacc

SEQ ID NO: 187635 - RNA, 20 nt, Human
gaaacagaacaucagucccu

SEQ ID NO: 187636 - RNA, 20 nt, Human
gaaacgccacaucccccucc

SEQ ID NO: 187637 - RNA, 22 nt, Human
gacacacuaauaacaagaggau

SEQ ID NO: 187638 - RNA, 21 nt, Human
gaccaagugacaacucaagcc

SEQ ID NO: 187639 - RNA, 22 nt, Human
gagcgcggccuugaccgcagcc

SEQ ID NO: 187640 - RNA, 23 nt, Human
gaggguguggaggacccucuggg

SEQ ID NO: 187641 - RNA, 18 nt, Human
gccacaucccccuccuac

SEQ ID NO: 187642 - RNA, 22 nt, Human
gcccaagccaagaugaucauuc

SEQ ID NO: 187643 - RNA, 24 nt, Human
gcccauucaaaacucuuucuguau

SEQ ID NO: 187644 - RNA, 22 nt, Human
gcccccaggagcgcggccuuga

SEQ ID NO: 187645 - RNA, 22 nt, Human
gccgugaaacgacucacaccac

SEQ ID NO: 187646 - RNA, 20 nt, Human
gccugugccuguggccccug

SEQ ID NO: 187647 - RNA, 21 nt, Human
gcgcccacccucccaggcggc

SEQ ID NO: 187648 - RNA, 21 nt, Human
gcgcgaggccagcgagcuggg

SEQ ID NO: 187649 - RNA, 24 nt, Human
gcucuggguccccaggugcagaau

SEQ ID NO: 187650 - RNA, 19 nt, Human
ggacgcccgggcgcgcgcg

SEQ ID NO: 187651 - RNA, 18 nt, Human
ggagagccccgcggggcg

SEQ ID NO: 187652 - RNA, 20 nt, Human
ggcagugaucguucuagaac

SEQ ID NO: 187653 - RNA, 24 nt, Human
ggcggaggggaccaagugacaacu

SEQ ID NO: 187654 - RNA, 18 nt, Human
gggcgcccacccucccag

SEQ ID NO: 187655 - RNA, 23 nt, Human
ggggaccaagugacaacucaagc

SEQ ID NO: 187656 - RNA, 21 nt, Human
guacacagaaaaaagaaaucc

SEQ ID NO: 187657 - RNA, 24 nt, Human
guaccgcucuuaucacauuuccac

SEQ ID NO: 187658 - RNA, 23 nt, Human
uaacaagaaagcuuuucaaguau

SEQ ID NO: 187659 - RNA, 18 nt, Human
uaacgggucaccaacaga

SEQ ID NO: 187660 - RNA, 21 nt, Human
uaacugcaauguccgucccua

SEQ ID NO: 187661 - RNA, 18 nt, Human
uaagccagcagaggagga

SEQ ID NO: 187662 - RNA, 18 nt, Human
uaagcggcccaagccaag

SEQ ID NO: 187663 - RNA, 22 nt, Human
uacaaaaauaccugaaaguuua

SEQ ID NO: 187664 - RNA, 21 nt, Human
uacauggaguuucauuuagaa

SEQ ID NO: 187665 - RNA, 23 nt, Human
uaccgccagcuugcccgccccca

SEQ ID NO: 187666 - RNA, 20 nt, Human
uaccucgagccagugaagag

SEQ ID NO: 187667 - RNA, 24 nt, Human
uacguacacagaaaaaagaaaucc

SEQ ID NO: 187668 - RNA, 18 nt, Human
uagaguuguuuuuccuug

SEQ ID NO: 187669 - RNA, 19 nt, Human
uauaaauaugaaauacugc

SEQ ID NO: 187670 - RNA, 19 nt, Human
uauaaauaugaaauacugc

SEQ ID NO: 187671 - RNA, 28 nt, Human
uaugccaaaugccuaccacagugacacc

SEQ ID NO: 187672 - RNA, 22 nt, Human
uauguacagaaugaagcaaagc

SEQ ID NO: 187673 - RNA, 18 nt, Human
uauuaagugcagaaaaga

SEQ ID NO: 187674 - RNA, 20 nt, Human
ucaaauguccuuccgucccc

SEQ ID NO: 187675 - RNA, 19 nt, Human
ucaaggaggcuggcccacg

SEQ ID NO: 187676 - RNA, 27 nt, Human
ucacagcagcaaaucgucguuuaaguc

SEQ ID NO: 187677 - RNA, 21 nt, Human
ucacgagccaaagagcuaugu

SEQ ID NO: 187678 - RNA, 22 nt, Human
ucacugcaguuugcacugugac

SEQ ID NO: 187679 - RNA, 20 nt, Human
ucagaaauuuccuucugcaa

SEQ ID NO: 187680 - RNA, 21 nt, Human
ucagccgugaaacgacucaca

SEQ ID NO: 187681 - RNA, 20 nt, Human
ucauacugucagguauuaag

SEQ ID NO: 187682 - RNA, 20 nt, Human
uccaaaggaauaaagucucc

SEQ ID NO: 187683 - RNA, 25 nt, Human
uccacaccgugguagucggcagagg

SEQ ID NO: 187684 - RNA, 21 nt, Human
uccaguguucacuuccuccag

SEQ ID NO: 187685 - RNA, 22 nt, Human
uccaguguucacuuccuccagu

SEQ ID NO: 187686 - RNA, 18 nt, Human
uccauguccacaaccacu

SEQ ID NO: 187687 - RNA, 18 nt, Human
ucccaggcggcggccccc

SEQ ID NO: 187688 - RNA, 21 nt, Human
uccccaggugcagaaucgaug

SEQ ID NO: 187689 - RNA, 20 nt, Human
ucccggacgcccggacgccc

SEQ ID NO: 187690 - RNA, 21 nt, Human
uccuaagcggcccaagccaag

SEQ ID NO: 187691 - RNA, 19 nt, Human
uccucagccugcccugugc

SEQ ID NO: 187692 - RNA, 18 nt, Human
uccugcacugugcagaac

SEQ ID NO: 187693 - RNA, 19 nt, Human
ucucacaccugaucacuaa

SEQ ID NO: 187694 - RNA, 19 nt, Human
ucugacccuaagccagcag

SEQ ID NO: 187695 - RNA, 21 nt, Human
ugaagcuugugacacugcucu

SEQ ID NO: 187696 - RNA, 21 nt, Human
ugacaaaacucuuccaugucc

SEQ ID NO: 187697 - RNA, 22 nt, Human
ugacaucacaaaucuaccgcca

SEQ ID NO: 187698 - RNA, 20 nt, Human
ugacucaucucccggagcgg

SEQ ID NO: 187699 - RNA, 25 nt, Human
ugagaggacccaggugaggaccugg

SEQ ID NO: 187700 - RNA, 22 nt, Human
ugagcuguccccuuuacauuca

SEQ ID NO: 187701 - RNA, 26 nt, Human
ugaggaccuggcugccggucacuggg

SEQ ID NO: 187702 - RNA, 23 nt, Human
ugcagaacaagacacacuaauaa

SEQ ID NO: 187703 - RNA, 20 nt, Human
ugcagcagcagggguaaggc

SEQ ID NO: 187704 - RNA, 23 nt, Human
ugcaucagaaauuuccuucugca

SEQ ID NO: 187705 - RNA, 24 nt, Human
ugcgaaaggaagaaaaugcaauug

SEQ ID NO: 187706 - RNA, 21 nt, Human
ugcuggggcggccacccuggc

SEQ ID NO: 187707 - RNA, 18 nt, Human
uggaaaacaacuagagug

SEQ ID NO: 187708 - RNA, 25 nt, Human
uggaaaacaacuagaguguggucug

SEQ ID NO: 187709 - RNA, 20 nt, Human
uggccccugcagcguuuccu

SEQ ID NO: 187710 - RNA, 19 nt, Human
uggcgggcggcuaauccgc

SEQ ID NO: 187711 - RNA, 19 nt, Human
uggcuuauggggguuuuca

SEQ ID NO: 187712 - RNA, 21 nt, Human
ugggaagggcuggguuuguca

SEQ ID NO: 187713 - RNA, 23 nt, Human
ugggaagggcuggguuugucauu

SEQ ID NO: 187714 - RNA, 19 nt, Human
ugggccugcagcugcugcu

SEQ ID NO: 187715 - RNA, 23 nt, Human
ugggccugcagcugcugcuuccu

SEQ ID NO: 187716 - RNA, 24 nt, Human
uguacagaaugaagcaaagcacau

SEQ ID NO: 187717 - RNA, 25 nt, Human
ugucccggacgcccggacgcccggg

SEQ ID NO: 187718 - RNA, 18 nt, Human
uguggaaacgcaaggcug

SEQ ID NO: 187719 - RNA, 19 nt, Human
uguggucagcgccaaagcc

SEQ ID NO: 187720 - RNA, 20 nt, Human
uguucacuggcuuauggggg

SEQ ID NO: 187721 - RNA, 19 nt, Human
uuaaaaacauguuuugcua

SEQ ID NO: 187722 - RNA, 23 nt, Human
uuauggggguuuucagcaggacg

SEQ ID NO: 187723 - RNA, 21 nt, Human
uucacagcagcaaaucgucgu

SEQ ID NO: 187724 - RNA, 21 nt, Human
uucuucacuccaguguucacu

SEQ ID NO: 187725 - RNA, 20 nt, Human
uuggggacccauauucaguu

SEQ ID NO: 187726 - RNA, 21 nt, Human
uuuccaaaggaauaaagucuc

SEQ ID NO: 187727 - RNA, 23 nt, Human
uuuguacaaaaauaccugaaagu

SEQ ID NO: 187728 - RNA, 18 nt, Human
agcgcucugcaggugugg

SEQ ID NO: 187729 - RNA, 27 nt, Human
agggggcggaggaggaggguggggagg

SEQ ID NO: 187730 - RNA, 24 nt, Human
agggggcggggagggcgcgagagc

SEQ ID NO: 187731 - RNA, 18 nt, Human
aggguggggagaggggag

SEQ ID NO: 187732 - RNA, 18 nt, Human
cacuggcauugcucccgc

SEQ ID NO: 187733 - RNA, 21 nt, Human
cacuggcauugcucccgcgcc

SEQ ID NO: 187734 - RNA, 18 nt, Human
cccauccgggacgcgagg

SEQ ID NO: 187735 - RNA, 21 nt, Human
ccccggcgcgcuggaggcggg

SEQ ID NO: 187736 - RNA, 22 nt, Human
ccgggaccgccgccuccucagg

SEQ ID NO: 187737 - RNA, 24 nt, Human
cgcucggggccacuggcauugcuc

SEQ ID NO: 187738 - RNA, 18 nt, Human
cgcucggggccccggcgg

SEQ ID NO: 187739 - RNA, 20 nt, Human
cggccggggggcucgggcgu

SEQ ID NO: 187740 - RNA, 19 nt, Human
cgguggguggggcgcgcgg

SEQ ID NO: 187741 - RNA, 19 nt, Human
cuggcauugcucccgcgcc

SEQ ID NO: 187742 - RNA, 19 nt, Human
gaccgccgccuccucaggu

SEQ ID NO: 187743 - RNA, 21 nt, Human
gacgcaggcgggauagggguc

SEQ ID NO: 187744 - RNA, 20 nt, Human
gagagcggcuggccggcccc

SEQ ID NO: 187745 - RNA, 18 nt, Human
gagaggggaggagcggcc

SEQ ID NO: 187746 - RNA, 25 nt, Human
gagcuaucugcgaggcggcggggga

SEQ ID NO: 187747 - RNA, 20 nt, Human
gaggggaggagcggccggug

SEQ ID NO: 187748 - RNA, 23 nt, Human
gcaggugaaauacauucuuuuca

SEQ ID NO: 187749 - RNA, 22 nt, Human
gccccggcgcgcuggaggcggg

SEQ ID NO: 187750 - RNA, 18 nt, Human
gcgaggcaaggcgcggag

SEQ ID NO: 187751 - RNA, 20 nt, Human
gcggagggggcggggagggc

SEQ ID NO: 187752 - RNA, 21 nt, Human
ggagaagggguuugcgcggcg

SEQ ID NO: 187753 - RNA, 23 nt, Human
ggaggaggaggguggggagaggg

SEQ ID NO: 187754 - RNA, 19 nt, Human
ggaggaggguggggagagg

SEQ ID NO: 187755 - RNA, 23 nt, Human
ggcggggagggcgcgagagcggc

SEQ ID NO: 187756 - RNA, 20 nt, Human
ggcgggggaggggagggggc

SEQ ID NO: 187757 - RNA, 25 nt, Human
gggcggggagggcgcgagagcggcu

SEQ ID NO: 187758 - RNA, 18 nt, Human
ggggaggggagggggcgg

SEQ ID NO: 187759 - RNA, 20 nt, Human
ggggagggggcggaggagga

SEQ ID NO: 187760 - RNA, 19 nt, Human
ggggcggggagggcgcgag

SEQ ID NO: 187761 - RNA, 20 nt, Human
ucacaugauaauguuuucgc

SEQ ID NO: 187762 - RNA, 22 nt, Human
ucaggugggcaccggggcgcga

SEQ ID NO: 187763 - RNA, 20 nt, Human
ucgccgccugcgcucggggc

SEQ ID NO: 187764 - RNA, 18 nt, Human
ugccgggaggacgcaggc

SEQ ID NO: 187765 - RNA, 23 nt, Human
ugcgcucggggccccggcggcug

SEQ ID NO: 187766 - RNA, 20 nt, Human
uggggagaggggaggagcgg

SEQ ID NO: 187767 - RNA, 22 nt, Human
ugugguggccucgccgccugcg

SEQ ID NO: 187768 - RNA, 24 nt, Human
uuuauggucuuuuauuauuuuucu

SEQ ID NO: 187769 - RNA, 20 nt, Human
uuuuauuauuuuucuugagu

SEQ ID NO: 187770 - RNA, 30 nt, Human
aaaaaaaagacaaaggaggggaaagaggaa

SEQ ID NO: 187771 - RNA, 30 nt, Human
aaauccaacgcccccucccacccccuaaag

SEQ ID NO: 187772 - RNA, 24 nt, Human
agaagagaaaaaaggaugaaaaaa

SEQ ID NO: 187773 - RNA, 25 nt, Human
agaagagaaaaaaggaugaaaaaaa

SEQ ID NO: 187774 - RNA, 21 nt, Human
agggagggaggagggcugagc

SEQ ID NO: 187775 - RNA, 24 nt, Human
augaaaaaaaagacaaaggagggg

SEQ ID NO: 187776 - RNA, 24 nt, Human
cccccucccacccccuaaaguucc

SEQ ID NO: 187777 - RNA, 25 nt, Human
ccccuaaaguuccaaccaaagugag

SEQ ID NO: 187778 - RNA, 25 nt, Human
cucccacccccuaaaguuccaacca

SEQ ID NO: 187779 - RNA, 21 nt, Human
cugagcccccgaauucacugg

SEQ ID NO: 187780 - RNA, 20 nt, Human
cugcacucccucacaggcug

SEQ ID NO: 187781 - RNA, 18 nt, Human
gaagggagggaggagggc

SEQ ID NO: 187782 - RNA, 18 nt, Human
gacaaaggaggggaaaga

SEQ ID NO: 187783 - RNA, 19 nt, Human
gagcagcagugaaaauuug

SEQ ID NO: 187784 - RNA, 20 nt, Human
ggaagggagggaggagggcu

SEQ ID NO: 187785 - RNA, 18 nt, Human
gggggaagggagggagga

SEQ ID NO: 187786 - RNA, 20 nt, Human
guuccaaccaaagugagagg

SEQ ID NO: 187787 - RNA, 21 nt, Human
uaaaguuccaaccaaagugag

SEQ ID NO: 187788 - RNA, 21 nt, Human
uaaauccaacgcccccuccca

SEQ ID NO: 187789 - RNA, 18 nt, Human
ucagaggcagcuuguggg

SEQ ID NO: 187790 - RNA, 22 nt, Human
ucagugcucagcagccugaagc

SEQ ID NO: 187791 - RNA, 18 nt, Human
uccaaccaaagugagagg

SEQ ID NO: 187792 - RNA, 25 nt, Human
ucccucacaggcugcugucagaggc

SEQ ID NO: 187793 - RNA, 25 nt, Human
ugauggacagaagagaaaaaaggau

SEQ ID NO: 187794 - RNA, 25 nt, Human
ugcugucagaggcagcuuguggguu

SEQ ID NO: 187795 - RNA, 25 nt, Human
uuuuuuauuauuggcgucagcuagg

SEQ ID NO: 187796 - RNA, 19 nt, Human
uuuuuugguuucuuguuuu

SEQ ID NO: 187797 - RNA, 26 nt, Human
uuuuuuuuuuuugguuucuuguuuuu

SEQ ID NO: 187798 - RNA, 19 nt, Human
aaccgccugggcugccccc

SEQ ID NO: 187799 - RNA, 21 nt, Human
aaggagagggggccacccaag

SEQ ID NO: 187800 - RNA, 22 nt, Human
accuccagagcuaggagaagga

SEQ ID NO: 187801 - RNA, 18 nt, Human
acuaguauaaaacagagc

SEQ ID NO: 187802 - RNA, 29 nt, Human
aggcaaagaagcagaggagaagggacccc

SEQ ID NO: 187803 - RNA, 20 nt, Human
agggaggcaaagaagcagag

SEQ ID NO: 187804 - RNA, 20 nt, Human
agggaggcaaagaagcagag

SEQ ID NO: 187805 - RNA, 18 nt, Human
aggugguaggaggguguc

SEQ ID NO: 187806 - RNA, 19 nt, Human
cagagcagaucaacuggcc

SEQ ID NO: 187807 - RNA, 25 nt, Human
cagagcuaggagaaggagagggggg

SEQ ID NO: 187808 - RNA, 22 nt, Human
cagcaccuccagagcuaggaga

SEQ ID NO: 187809 - RNA, 27 nt, Human
caucccguccccuguggccgcgcccca

SEQ ID NO: 187810 - RNA, 19 nt, Human
ccacccaaggccuucccuu

SEQ ID NO: 187811 - RNA, 21 nt, Human
ccacccaaggccuucccuuga

SEQ ID NO: 187812 - RNA, 22 nt, Human
cccccacuucucccauaauucc

SEQ ID NO: 187813 - RNA, 23 nt, Human
cccugcccuagagcagcaccucc

SEQ ID NO: 187814 - RNA, 19 nt, Human
cccuugaggagagggguca

SEQ ID NO: 187815 - RNA, 20 nt, Human
ccgcuccucaucccgucccc

SEQ ID NO: 187816 - RNA, 18 nt, Human
ccugcccuagagcagcac

SEQ ID NO: 187817 - RNA, 18 nt, Human
ccuguggccgcgccccag

SEQ ID NO: 187818 - RNA, 20 nt, Human
cgucuaggaacccccagauu

SEQ ID NO: 187819 - RNA, 21 nt, Human
cucaucccguccccuguggcc

SEQ ID NO: 187820 - RNA, 23 nt, Human
cugagggaggcaaagaagcagag

SEQ ID NO: 187821 - RNA, 20 nt, Human
cuggaguggcggaacccucc

SEQ ID NO: 187822 - RNA, 23 nt, Human
gagcagaucaacuggccucucgg

SEQ ID NO: 187823 - RNA, 21 nt, Human
gagcagcaccuccagagcuag

SEQ ID NO: 187824 - RNA, 18 nt, Human
gaggcaaagaagcagagg

SEQ ID NO: 187825 - RNA, 23 nt, Human
gagggggccacccaaggccuucc

SEQ ID NO: 187826 - RNA, 18 nt, Human
gccuucccuugaggagag

SEQ ID NO: 187827 - RNA, 19 nt, Human
gcgugaaaccgccugggcu

SEQ ID NO: 187828 - RNA, 21 nt, Human
ggcaaagaagcagaggagaaa

SEQ ID NO: 187829 - RNA, 25 nt, Human
gggggcuguuuucuaucugagggag

SEQ ID NO: 187830 - RNA, 24 nt, Human
guccccuguggccgcgccccagag

SEQ ID NO: 187831 - RNA, 19 nt, Human
gucuguacaaagugugggg

SEQ ID NO: 187832 - RNA, 18 nt, Human
uacaggugguaggagggu

SEQ ID NO: 187833 - RNA, 24 nt, Human
uauugucacuaguauaaaacagag

SEQ ID NO: 187834 - RNA, 23 nt, Human
ucagaggcgggggggagcccugu

SEQ ID NO: 187835 - RNA, 19 nt, Human
ucucccauaauucccugcc

SEQ ID NO: 187836 - RNA, 25 nt, Human
ucucccauaauucccugcccuagag

SEQ ID NO: 187837 - RNA, 19 nt, Human
ucugagcgagagaggggcu

SEQ ID NO: 187838 - RNA, 19 nt, Human
ucugagggaggcaaagaag

SEQ ID NO: 187839 - RNA, 23 nt, Human
ugcccccacuucucccauaauuc

SEQ ID NO: 187840 - RNA, 23 nt, Human
uggagugggggcuguuuucuauc

SEQ ID NO: 187841 - RNA, 23 nt, Human
uggauggguggaggggcggcggg

SEQ ID NO: 187842 - RNA, 23 nt, Human
uguggggcgugaaaccgccuggg

SEQ ID NO: 187843 - RNA, 22 nt, Human
aaaacaaaaccaaaccagaaaa

SEQ ID NO: 187844 - RNA, 23 nt, Human
aaaacaaaaccaaaccagaaaac

SEQ ID NO: 187845 - RNA, 18 nt, Human
aaacaaaaccaaaccaga

SEQ ID NO: 187846 - RNA, 22 nt, Human
aaacaaaaccaaaccagaaaac

SEQ ID NO: 187847 - RNA, 23 nt, Human
aaagcagaaaacaaaaccaaacc

SEQ ID NO: 187848 - RNA, 18 nt, Human
aagaccugccugcuggcu

SEQ ID NO: 187849 - RNA, 22 nt, Human
aagcagaaaacaaaaccaaacc

SEQ ID NO: 187850 - RNA, 24 nt, Human
aagcagaaaacaaaaccaaaccag

SEQ ID NO: 187851 - RNA, 26 nt, Human
aagcagaaaacaaaaccaaaccagaa

SEQ ID NO: 187852 - RNA, 20 nt, Human
aagcggaaagugaaaggagg

SEQ ID NO: 187853 - RNA, 21 nt, Human
accaaaccagaaaaccaccgg

SEQ ID NO: 187854 - RNA, 19 nt, Human
acgggaugacagagacugc

SEQ ID NO: 187855 - RNA, 23 nt, Human
acuuucaucuacaacccccuagc

SEQ ID NO: 187856 - RNA, 24 nt, Human
agaaaacaaaaccaaaccagaaaa

SEQ ID NO: 187857 - RNA, 26 nt, Human
agaaaacaaaaccaaaccagaaaacc

SEQ ID NO: 187858 - RNA, 23 nt, Human
agaaacugugcuagguuagacaa

SEQ ID NO: 187859 - RNA, 20 nt, Human
agaggaaggaggcaggaagc

SEQ ID NO: 187860 - RNA, 21 nt, Human
agcacccaccacuuccuuggu

SEQ ID NO: 187861 - RNA, 25 nt, Human
agcagaaaacaaaaccaaaccagaa

SEQ ID NO: 187862 - RNA, 21 nt, Human
agcagaaggcggugcccagaa

SEQ ID NO: 187863 - RNA, 24 nt, Human
agcugcuugcccccauuccagggc

SEQ ID NO: 187864 - RNA, 21 nt, Human
agcuuagaaacugugcuaggu

SEQ ID NO: 187865 - RNA, 23 nt, Human
aggauccucccccgagucuacuc

SEQ ID NO: 187866 - RNA, 22 nt, Human
aguaaaagcagaaaacaaaacc

SEQ ID NO: 187867 - RNA, 18 nt, Human
aucagaaggggaagcgga

SEQ ID NO: 187868 - RNA, 19 nt, Human
caacaagaccugccugcug

SEQ ID NO: 187869 - RNA, 18 nt, Human
caagaccugccugcuggc

SEQ ID NO: 187870 - RNA, 21 nt, Human
cacaccauccuccaugcauca

SEQ ID NO: 187871 - RNA, 23 nt, Human
caggcacuuucaucuacaacccc

SEQ ID NO: 187872 - RNA, 18 nt, Human
cccacgggucugcuccca

SEQ ID NO: 187873 - RNA, 18 nt, Human
cccccgagucuacucugc

SEQ ID NO: 187874 - RNA, 19 nt, Human
cccucugcgccccucgagc

SEQ ID NO: 187875 - RNA, 20 nt, Human
ccgggccugcugaaaagcuc

SEQ ID NO: 187876 - RNA, 19 nt, Human
cgcccggccccgcugaggg

SEQ ID NO: 187877 - RNA, 26 nt, Human
cggucuggcagccuggguagcuuaga

SEQ ID NO: 187878 - RNA, 22 nt, Human
cuagcagaaggcggugcccaga

SEQ ID NO: 187879 - RNA, 19 nt, Human
cuccuggaucccggcgucu

SEQ ID NO: 187880 - RNA, 19 nt, Human
cugcucucaggcgggcaag

SEQ ID NO: 187881 - RNA, 22 nt, Human
cugcugcucucaggcgggcaag

SEQ ID NO: 187882 - RNA, 25 nt, Human
cuuuccgggccugcugaaaagcuca

SEQ ID NO: 187883 - RNA, 21 nt, Human
gaaggucaagaggggagagau

SEQ ID NO: 187884 - RNA, 24 nt, Human
gagggggagcacccaccacuuccu

SEQ ID NO: 187885 - RNA, 21 nt, Human
gcccugaggcccacggguccc

SEQ ID NO: 187886 - RNA, 18 nt, Human
ggagggggagcacccacc

SEQ ID NO: 187887 - RNA, 22 nt, Human
ggcagagcaccagcugcggggc

SEQ ID NO: 187888 - RNA, 22 nt, Human
ggcagcacggucgcucggucug

SEQ ID NO: 187889 - RNA, 21 nt, Human
uaccgcggggcagagcaccag

SEQ ID NO: 187890 - RNA, 23 nt, Human
ucacaccauccuccaugcaucag

SEQ ID NO: 187891 - RNA, 21 nt, Human
ucaggcgggcaagggaggccc

SEQ ID NO: 187892 - RNA, 21 nt, Human
ucccuggaggggagugggugg

SEQ ID NO: 187893 - RNA, 21 nt, Human
uccgggccugcugaaaagcuc

SEQ ID NO: 187894 - RNA, 22 nt, Human
uccuggaucccggcgucugcuc

SEQ ID NO: 187895 - RNA, 20 nt, Human
ugaggucucugcugcucucc

SEQ ID NO: 187896 - RNA, 20 nt, Human
ugcccagaaaagggaauucc

SEQ ID NO: 187897 - RNA, 20 nt, Human
ugcugcugcucucaggcggg

SEQ ID NO: 187898 - RNA, 25 nt, Human
uggaaguaaaagcagaaaacaaaac

SEQ ID NO: 187899 - RNA, 19 nt, Human
uggcaggcuccagcucccg

SEQ ID NO: 187900 - RNA, 19 nt, Human
uggguagcuuagaaacugu

SEQ ID NO: 187901 - RNA, 24 nt, Human
uucaucuacaacccccuagcagaa

SEQ ID NO: 187902 - RNA, 22 nt, Human
uuccuuggucugcugaugaggu

SEQ ID NO: 187903 - RNA, 22 nt, Human
acaauaccagggcacgguuugc

SEQ ID NO: 187904 - RNA, 19 nt, Human
agagaaucacaccuucccu

SEQ ID NO: 187905 - RNA, 21 nt, Human
aucagaaucacucuuuccuca

SEQ ID NO: 187906 - RNA, 20 nt, Human
cccggaccuggcaguacaga

SEQ ID NO: 187907 - RNA, 22 nt, Human
ccgacccggaccuggcaguaca

SEQ ID NO: 187908 - RNA, 23 nt, Human
ccugggugugucugacaauacca

SEQ ID NO: 187909 - RNA, 21 nt, Human
guuugcuucccggcccuccau

SEQ ID NO: 187910 - RNA, 23 nt, Human
uaccagggcacgguuugcuuccc

SEQ ID NO: 187911 - RNA, 24 nt, Human
ugcuucccggcccuccaucucuac

SEQ ID NO: 187912 - RNA, 19 nt, Human
uggcucugccuguggaucc

SEQ ID NO: 187913 - RNA, 25 nt, Human
uucccuuggcucugccuguggaucc

SEQ ID NO: 187914 - RNA, 21 nt, Human
uuccucagagaaucacaccuu

SEQ ID NO: 187915 - RNA, 27 nt, Human
aaaaagaagcccagguccaaucauaga

SEQ ID NO: 187916 - RNA, 26 nt, Human
aaagaacaucaaaaaaggaaaaggga

SEQ ID NO: 187917 - RNA, 21 nt, Human
acacacuaagacacacuaaca

SEQ ID NO: 187918 - RNA, 25 nt, Human
agaaaagggugaaagaacaucaaaa

SEQ ID NO: 187919 - RNA, 18 nt, Human
agacacacuaacaacuga

SEQ ID NO: 187920 - RNA, 21 nt, Human
aucaaaaaaggaaaagggaca

SEQ ID NO: 187921 - RNA, 21 nt, Human
caaaaaaggaaaagggacagc

SEQ ID NO: 187922 - RNA, 22 nt, Human
cacacuaagacacacuaacaac

SEQ ID NO: 187923 - RNA, 18 nt, Human
caucaaaaaaggaaaagg

SEQ ID NO: 187924 - RNA, 22 nt, Human
caucaaaaaaggaaaagggaca

SEQ ID NO: 187925 - RNA, 19 nt, Human
ccccccuuucccuuuauuc

SEQ ID NO: 187926 - RNA, 21 nt, Human
ccuccugcaguuccuuccuug

SEQ ID NO: 187927 - RNA, 22 nt, Human
ccuugcuugcuugcuuccuucc

SEQ ID NO: 187928 - RNA, 23 nt, Human
ccuugcuugcuugcuuccuuccu

SEQ ID NO: 187929 - RNA, 20 nt, Human
cuguucuuuuccuccugcag

SEQ ID NO: 187930 - RNA, 18 nt, Human
cuuuucgcuguucugccu

SEQ ID NO: 187931 - RNA, 19 nt, Human
gcacugaaggguuugggau

SEQ ID NO: 187932 - RNA, 24 nt, Human
gccugcuccccaaggggucuccau

SEQ ID NO: 187933 - RNA, 21 nt, Human
gccuguucuuuuccuccugca

SEQ ID NO: 187934 - RNA, 20 nt, Human
ggguuugggauggggcuggg

SEQ ID NO: 187935 - RNA, 23 nt, Human
ggugaaagaacaucaaaaaagga

SEQ ID NO: 187936 - RNA, 21 nt, Human
ggugguugcguuucauuuugu

SEQ ID NO: 187937 - RNA, 21 nt, Human
ucaaaaaaggaaaagggacag

SEQ ID NO: 187938 - RNA, 23 nt, Human
ugaaagaacaucaaaaaaggaaa

SEQ ID NO: 187939 - RNA, 18 nt, Human
ugcaguuuccucauuagu

SEQ ID NO: 187940 - RNA, 20 nt, Human
ugcaguuuccucauuagugu

SEQ ID NO: 187941 - RNA, 20 nt, Human
ugcauuggcgaaaaagaagc

SEQ ID NO: 187942 - RNA, 21 nt, Human
uggcacugaaggguuugggau

SEQ ID NO: 187943 - RNA, 18 nt, Human
ugggauggggcuggggag

SEQ ID NO: 187944 - RNA, 22 nt, Human
uggggagccgagccugcucccc

SEQ ID NO: 187945 - RNA, 26 nt, Human
ugguugcguuucauuuuguuguuguu

SEQ ID NO: 187946 - RNA, 23 nt, Human
ugguuuuucaauucuucaggaaa

SEQ ID NO: 187947 - RNA, 21 nt, Human
uguucuuuuccuccugcaguu

SEQ ID NO: 187948 - RNA, 23 nt, Human
uguuguuuuuggcacugaagggu

SEQ ID NO: 187949 - RNA, 25 nt, Human
uugaaucauccuucuuguggucgca

SEQ ID NO: 187950 - RNA, 18 nt, Human
uugcuugcuuccuuccuu

SEQ ID NO: 187951 - RNA, 26 nt, Human
uuugguguuucccccccuuucccuuu

SEQ ID NO: 187952 - RNA, 21 nt, Human
uuuucauccucacuuagcaaa

SEQ ID NO: 187953 - RNA, 24 nt, Human
aaacacacaagaaaaccauugugu

SEQ ID NO: 187954 - RNA, 22 nt, Human
aaccauuguguaaggcacucaa

SEQ ID NO: 187955 - RNA, 21 nt, Human
aagaaaaguagagcauccaca

SEQ ID NO: 187956 - RNA, 21 nt, Human
aauaaacacacaagaaaacca

SEQ ID NO: 187957 - RNA, 20 nt, Human
aauauaccccuuuuuuuuuu

SEQ ID NO: 187958 - RNA, 23 nt, Human
aauuaaucauuccuuacaauuca

SEQ ID NO: 187959 - RNA, 18 nt, Human
aggacucacguaagggac

SEQ ID NO: 187960 - RNA, 19 nt, Human
auaccccuuuuuuuuuccu

SEQ ID NO: 187961 - RNA, 21 nt, Human
auaccccuuuuuuuuuccuuu

SEQ ID NO: 187962 - RNA, 21 nt, Human
caagagacuaacaauaguggc

SEQ ID NO: 187963 - RNA, 22 nt, Human
cauguccaccacgcuuugucug

SEQ ID NO: 187964 - RNA, 18 nt, Human
ccccuuuuuuuuuccuuu

SEQ ID NO: 187965 - RNA, 18 nt, Human
ccuccucuuccuucuuug

SEQ ID NO: 187966 - RNA, 23 nt, Human
ccuccucuuccuucuuuggcugu

SEQ ID NO: 187967 - RNA, 18 nt, Human
ccuuguuccucauggcau

SEQ ID NO: 187968 - RNA, 24 nt, Human
cucacguaagggacagcaugcacu

SEQ ID NO: 187969 - RNA, 22 nt, Human
cucuuccuucuuuggcuguuuu

SEQ ID NO: 187970 - RNA, 19 nt, Human
cugcuuugggaaauucugg

SEQ ID NO: 187971 - RNA, 22 nt, Human
cuuccauguuagcugugcaugu

SEQ ID NO: 187972 - RNA, 22 nt, Human
cuuuuuuuuuccuuuuccuccu

SEQ ID NO: 187973 - RNA, 24 nt, Human
gacuaacaauaguggcugcagaaa

SEQ ID NO: 187974 - RNA, 19 nt, Human
gucacacugacauucauuc

SEQ ID NO: 187975 - RNA, 20 nt, Human
uaacaauaguggcugcagaa

SEQ ID NO: 187976 - RNA, 19 nt, Human
uaccccuuuuuuuuuccuu

SEQ ID NO: 187977 - RNA, 22 nt, Human
uagagcauccacaauauacccc

SEQ ID NO: 187978 - RNA, 29 nt, Human
uagauccucugcauuuugagacagcaauu

SEQ ID NO: 187979 - RNA, 21 nt, Human
uaguggcugcagaaacagguu

SEQ ID NO: 187980 - RNA, 22 nt, Human
uauaccccuuuuuuuuuccuuu

SEQ ID NO: 187981 - RNA, 23 nt, Human
uauaccccuuuuuuuuuccuuuu

SEQ ID NO: 187982 - RNA, 20 nt, Human
uauuuaagaauucuuggcug

SEQ ID NO: 187983 - RNA, 18 nt, Human
ucacgagagaucagucac

SEQ ID NO: 187984 - RNA, 19 nt, Human
ugcagaaacagguuuguug

SEQ ID NO: 187985 - RNA, 19 nt, Human
ugccaggacucacguaagg

SEQ ID NO: 187986 - RNA, 26 nt, Human
ugccuuguuccucauggcaucauuca

SEQ ID NO: 187987 - RNA, 20 nt, Human
uggaugccucucaccacuuu

SEQ ID NO: 187988 - RNA, 21 nt, Human
uggcugaaagaaaagucuuca

SEQ ID NO: 187989 - RNA, 20 nt, Human
uuagcaccaagcugcuaaaa

SEQ ID NO: 187990 - RNA, 21 nt, Human
aaaacgaagcugacaagagca

SEQ ID NO: 187991 - RNA, 21 nt, Human
aaaacgaagcugacaagagca

SEQ ID NO: 187992 - RNA, 20 nt, Human
aaacgaagcugacaagagca

SEQ ID NO: 187993 - RNA, 20 nt, Human
aaacgaagcugacaagagca

SEQ ID NO: 187994 - RNA, 19 nt, Human
aacgugcaugccaugcacg

SEQ ID NO: 187995 - RNA, 21 nt, Human
aacucaggagucgucaaaaua

SEQ ID NO: 187996 - RNA, 22 nt, Human
acucucucucuuauucgcuggc

SEQ ID NO: 187997 - RNA, 26 nt, Human
aggcacugaaggaaaaaaaaaaucag

SEQ ID NO: 187998 - RNA, 19 nt, Human
aucacgccucacaggugug

SEQ ID NO: 187999 - RNA, 19 nt, Human
cacccccuccccuuaacuu

SEQ ID NO: 188000 - RNA, 19 nt, Human
cacccccuccccuuaacuu

SEQ ID NO: 188001 - RNA, 24 nt, Human
caucacgccucacaggggucuucc

SEQ ID NO: 188002 - RNA, 27 nt, Human
ccacacuaguccuccuccuccuccgcg

SEQ ID NO: 188003 - RNA, 23 nt, Human
ccacguuuucggugauuuccucu

SEQ ID NO: 188004 - RNA, 22 nt, Human
ccccacacuaguccuccuccuc

SEQ ID NO: 188005 - RNA, 21 nt, Human
ccgcgccgccgccuccucuuc

SEQ ID NO: 188006 - RNA, 21 nt, Human
ccguuuucggugauuuccucu

SEQ ID NO: 188007 - RNA, 20 nt, Human
ccuccucuucuuccucuucu

SEQ ID NO: 188008 - RNA, 18 nt, Human
ccucuucuucucucuccc

SEQ ID NO: 188009 - RNA, 18 nt, Human
ccucuucuucucucuccc

SEQ ID NO: 188010 - RNA, 25 nt, Human
cgccuaaaacgaagcugacaagagc

SEQ ID NO: 188011 - RNA, 18 nt, Human
cucacucuuccuuuccac

SEQ ID NO: 188012 - RNA, 20 nt, Human
cuccgcgccgccgccuccuc

SEQ ID NO: 188013 - RNA, 24 nt, Human
cucgcucacucuuccuuuccaccc

SEQ ID NO: 188014 - RNA, 24 nt, Human
cucucucccucuuacucucucucu

SEQ ID NO: 188015 - RNA, 19 nt, Human
cuuccuuuccaccccacac

SEQ ID NO: 188016 - RNA, 22 nt, Human
cuugcucgcucacucuuccuuu

SEQ ID NO: 188017 - RNA, 22 nt, Human
gcacugaaggaaaaaaaaaauc

SEQ ID NO: 188018 - RNA, 24 nt, Human
gccuaaaacgaagcugacaagagc

SEQ ID NO: 188019 - RNA, 23 nt, Human
gcgcaacucaggagucgucaaaa

SEQ ID NO: 188020 - RNA, 20 nt, Human
gcucgcucacucuuccuuuc

SEQ ID NO: 188021 - RNA, 20 nt, Human
uaauagaaaaagaaaaagaa

SEQ ID NO: 188022 - RNA, 22 nt, Human
uaauagaaaaagaaaaagaauu

SEQ ID NO: 188023 - RNA, 19 nt, Human
uauaauaaauauuaauaca

SEQ ID NO: 188024 - RNA, 22 nt, Human
uauaauaaauauuaauacauca

SEQ ID NO: 188025 - RNA, 19 nt, Human
ucaaggguuugaugcaugu

SEQ ID NO: 188026 - RNA, 21 nt, Human
uccuccgcgccgccgccuccu

SEQ ID NO: 188027 - RNA, 19 nt, Human
ucgcuggcucuuacacccc

SEQ ID NO: 188028 - RNA, 21 nt, Human
ucgcuggcucuuacacccccu

SEQ ID NO: 188029 - RNA, 23 nt, Human
ucgcuggcucuuacacccccucc

SEQ ID NO: 188030 - RNA, 23 nt, Human
ucgcuggcucuuacacccccucc

SEQ ID NO: 188031 - RNA, 19 nt, Human
ucucucucccucuuacucu

SEQ ID NO: 188032 - RNA, 21 nt, Human
ucucucuuauucgcuggcucu

SEQ ID NO: 188033 - RNA, 22 nt, Human
ucuuccucuucuucucucuccc

SEQ ID NO: 188034 - RNA, 19 nt, Human
ucuuccuuuccaccccaca

SEQ ID NO: 188035 - RNA, 21 nt, Human
ugaagcagccacguuuucggu

SEQ ID NO: 188036 - RNA, 21 nt, Human
ugacaagagcaugggcgcaac

SEQ ID NO: 188037 - RNA, 21 nt, Human
ugacaagagcaugggcgcaac

SEQ ID NO: 188038 - RNA, 24 nt, Human
ugacagaacucuuacaaugcagcu

SEQ ID NO: 188039 - RNA, 19 nt, Human
ugcucgcucacucuuccuu

SEQ ID NO: 188040 - RNA, 23 nt, Human
uggcucaggauccuugaagcagg

SEQ ID NO: 188041 - RNA, 18 nt, Human
uucaagcaaagcaaaaag

SEQ ID NO: 188042 - RNA, 24 nt, Human
uugcauugucgcgagucucagagu

SEQ ID NO: 188043 - RNA, 21 nt, Human
agcuggcuggcaaggcugagc

SEQ ID NO: 188044 - RNA, 21 nt, Human
caaaagucgggggauaggcac

SEQ ID NO: 188045 - RNA, 20 nt, Human
ccgcggagcuggcuggcaag

SEQ ID NO: 188046 - RNA, 22 nt, Human
ccggacgcccgagagaugcacc

SEQ ID NO: 188047 - RNA, 22 nt, Human
cucagugcugucgcuagcccau

SEQ ID NO: 188048 - RNA, 22 nt, Human
cucccggagcccagagaccagc

SEQ ID NO: 188049 - RNA, 19 nt, Human
cucuggaugcuccgguucc

SEQ ID NO: 188050 - RNA, 20 nt, Human
gagcucucucggggcuccuc

SEQ ID NO: 188051 - RNA, 22 nt, Human
gaucugcaggaacgucucccuc

SEQ ID NO: 188052 - RNA, 24 nt, Human
gcggagcuggcuggcaaggcugag

SEQ ID NO: 188053 - RNA, 21 nt, Human
gcuccuccuccuccucuucca

SEQ ID NO: 188054 - RNA, 25 nt, Human
gcugccggacgcccgagagaugcac

SEQ ID NO: 188055 - RNA, 23 nt, Human
ggauaggcacagacagaggaggg

SEQ ID NO: 188056 - RNA, 19 nt, Human
gggccgcagaccgcggagg

SEQ ID NO: 188057 - RNA, 21 nt, Human
gggggauaggcacagacagag

SEQ ID NO: 188058 - RNA, 23 nt, Human
ucccggagcccagagaccagcug

SEQ ID NO: 188059 - RNA, 22 nt, Human
ucccucauucguccuuugguca

SEQ ID NO: 188060 - RNA, 22 nt, Human
uggcucccggagcccagagacc

SEQ ID NO: 188061 - RNA, 21 nt, Human
agaacauccuuaaggcgccga

SEQ ID NO: 188062 - RNA, 20 nt, Human
aggaggccugggcucuugug

SEQ ID NO: 188063 - RNA, 20 nt, Human
aggaggccugggcucuugug

SEQ ID NO: 188064 - RNA, 22 nt, Human
aggcagguggcagcucuggucc

SEQ ID NO: 188065 - RNA, 23 nt, Human
agggaugaagucuuccuucugcc

SEQ ID NO: 188066 - RNA, 21 nt, Human
aucccucaccaugagcuccca

SEQ ID NO: 188067 - RNA, 18 nt, Human
caaacuccucuuuucccc

SEQ ID NO: 188068 - RNA, 19 nt, Human
caaacuccucuuuuccccc

SEQ ID NO: 188069 - RNA, 18 nt, Human
cagccccagagggaugaa

SEQ ID NO: 188070 - RNA, 19 nt, Human
caggaggcuccuggcccaa

SEQ ID NO: 188071 - RNA, 20 nt, Human
caggggguccucucuccucu

SEQ ID NO: 188072 - RNA, 19 nt, Human
ccaaacuccucuuuucccc

SEQ ID NO: 188073 - RNA, 21 nt, Human
ccaagcagcuggccugagagc

SEQ ID NO: 188074 - RNA, 21 nt, Human
cccaaacuccucuuuuccccu

SEQ ID NO: 188075 - RNA, 19 nt, Human
cccaagcagcuggccugag

SEQ ID NO: 188076 - RNA, 20 nt, Human
cccaagcagcuggccugaga

SEQ ID NO: 188077 - RNA, 23 nt, Human
cccaggccugagguccccacccc

SEQ ID NO: 188078 - RNA, 30 nt, Human
ccccagagggaugaagucuuccuucugccc

SEQ ID NO: 188079 - RNA, 18 nt, Human
ccucugcagggcugcggc

SEQ ID NO: 188080 - RNA, 19 nt, Human
ccucugcccagcccccagg

SEQ ID NO: 188081 - RNA, 21 nt, Human
ccugagguccccaccccaguu

SEQ ID NO: 188082 - RNA, 24 nt, Human
cuuuggccuuggcuaucucggccg

SEQ ID NO: 188083 - RNA, 21 nt, Human
gaggaugaagcccaagcagcu

SEQ ID NO: 188084 - RNA, 21 nt, Human
gaggggcaggugaguuuggcc

SEQ ID NO: 188085 - RNA, 20 nt, Human
gccagaacaggggcugccag

SEQ ID NO: 188086 - RNA, 21 nt, Human
gcggcagaaacuucugacucu

SEQ ID NO: 188087 - RNA, 20 nt, Human
gcugcaucuuugggcauccu

SEQ ID NO: 188088 - RNA, 23 nt, Human
ggaggagaguugaggggcagggg

SEQ ID NO: 188089 - RNA, 21 nt, Human
ggcagccaugcuagaacaucc

SEQ ID NO: 188090 - RNA, 23 nt, Human
guaggaggccugggcucuugugg

SEQ ID NO: 188091 - RNA, 24 nt, Human
uaagggcaggaggcuccuggccca

SEQ ID NO: 188092 - RNA, 20 nt, Human
uagaacauccuuaaggcgcc

SEQ ID NO: 188093 - RNA, 20 nt, Human
uaucucggcuggcagcuuua

SEQ ID NO: 188094 - RNA, 18 nt, Human
ucagaagauuaggaccac

SEQ ID NO: 188095 - RNA, 20 nt, Human
ucccauaccccaaacuccuc

SEQ ID NO: 188096 - RNA, 25 nt, Human
uccccuguguagcucugucuucaac

SEQ ID NO: 188097 - RNA, 19 nt, Human
uccuagaggauuaggaacc

SEQ ID NO: 188098 - RNA, 19 nt, Human
ugcuuccuuuggccuuggc

SEQ ID NO: 188099 - RNA, 20 nt, Human
uggaagaaauggcaauauaa

SEQ ID NO: 188100 - RNA, 22 nt, Human
uggaggagaguugaggggcagg

SEQ ID NO: 188101 - RNA, 23 nt, Human
uggcagcucugguccccaagccc

SEQ ID NO: 188102 - RNA, 21 nt, Human
uggcagcuuuagaaacccaca

SEQ ID NO: 188103 - RNA, 23 nt, Human
uggccugagagccugcuggcuuc

SEQ ID NO: 188104 - RNA, 25 nt, Human
uggcggccucuguuugugcauucuc

SEQ ID NO: 188105 - RNA, 24 nt, Human
uggguaucccucaccaugagcucc

SEQ ID NO: 188106 - RNA, 20 nt, Human
ugugagaaauucaggggguc

SEQ ID NO: 188107 - RNA, 19 nt, Human
ugugucucuggccucacgg

SEQ ID NO: 188108 - RNA, 20 nt, Human
uucagaagauuaggaccacg

SEQ ID NO: 188109 - RNA, 21 nt, Human
uuccuuuggccuuggcuaucu

SEQ ID NO: 188110 - RNA, 18 nt, Human
uugaggggcaggugaguu

SEQ ID NO: 188111 - RNA, 24 nt, Human
uuggccuuggcuaucucggcuggc

SEQ ID NO: 188112 - RNA, 25 nt, Human
uuuggccuuggcuaucucggcuggc

SEQ ID NO: 188113 - RNA, 21 nt, Human
aacgagggagccugggaagga

SEQ ID NO: 188114 - RNA, 22 nt, Human
aagagaaacccaacgagggagc

SEQ ID NO: 188115 - RNA, 21 nt, Human
aaggggaagaaggggcuuuga

SEQ ID NO: 188116 - RNA, 24 nt, Human
aauagauaacuaacacaagaauca

SEQ ID NO: 188117 - RNA, 18 nt, Human
acaacaaacagagccugg

SEQ ID NO: 188118 - RNA, 18 nt, Human
accgagaagagaagcagu

SEQ ID NO: 188119 - RNA, 18 nt, Human
agaccgagaagagaagca

SEQ ID NO: 188120 - RNA, 26 nt, Human
agagaaacccaacgagggagccuggg

SEQ ID NO: 188121 - RNA, 19 nt, Human
agagaagcagucuaaggac

SEQ ID NO: 188122 - RNA, 23 nt, Human
agagaagcagucuaaggacugag

SEQ ID NO: 188123 - RNA, 21 nt, Human
aggggaagaaggggcuuugag

SEQ ID NO: 188124 - RNA, 22 nt, Human
cccacaacaaacagagccuggg

SEQ ID NO: 188125 - RNA, 23 nt, Human
gacugagcccuggagccccacaa

SEQ ID NO: 188126 - RNA, 20 nt, Human
gagccuggggagaaagagaa

SEQ ID NO: 188127 - RNA, 18 nt, Human
uaagagccauuuggcugg

SEQ ID NO: 188128 - RNA, 22 nt, Human
uagauaacuaacacaagaauca

SEQ ID NO: 188129 - RNA, 19 nt, Human
ugaaguaguggagaaagac

SEQ ID NO: 188130 - RNA, 18 nt, Human
ugagagugacuggcugug

SEQ ID NO: 188131 - RNA, 21 nt, Human
ugggagaaggggaagaagggg

SEQ ID NO: 188132 - RNA, 20 nt, Human
uuuggcuggugggaucauug

SEQ ID NO: 188133 - RNA, 21 nt, Human
uuuuuuuuuuuuaaaagcugu

SEQ ID NO: 188134 - RNA, 21 nt, Human
uuuuuuuuuuuuuuuuaaaag

SEQ ID NO: 188135 - RNA, 25 nt, Human
aaaaaaaauggauaucauuucaugu

SEQ ID NO: 188136 - RNA, 20 nt, Human
aaaagagccaacaacaacaa

SEQ ID NO: 188137 - RNA, 24 nt, Human
aaaagagccaacaacaacaacaac

SEQ ID NO: 188138 - RNA, 21 nt, Human
aaaauaccucccuacaucuuc

SEQ ID NO: 188139 - RNA, 22 nt, Human
aaacuagaaaauccugaucuga

SEQ ID NO: 188140 - RNA, 20 nt, Human
aaagagauuccuguagcucu

SEQ ID NO: 188141 - RNA, 24 nt, Human
aaauaccucccuacaucuucuucc

SEQ ID NO: 188142 - RNA, 19 nt, Human
aacaaaauaccucccuaca

SEQ ID NO: 188143 - RNA, 20 nt, Human
aacaacaacaacaacaaaau

SEQ ID NO: 188144 - RNA, 22 nt, Human
aaccuaaaaccaugcuagccuu

SEQ ID NO: 188145 - RNA, 19 nt, Human
aagagccaacaacaacaac

SEQ ID NO: 188146 - RNA, 21 nt, Human
aauauaggaaaucauaacauc

SEQ ID NO: 188147 - RNA, 21 nt, Human
aaugacaaauacuuugaggaa

SEQ ID NO: 188148 - RNA, 23 nt, Human
aaugcaucauuauugccaacaua

SEQ ID NO: 188149 - RNA, 23 nt, Human
acuauaaugaagguagcacaguc

SEQ ID NO: 188150 - RNA, 18 nt, Human
acucugggagggaagggg

SEQ ID NO: 188151 - RNA, 19 nt, Human
acuguuuuuauuuugucug

SEQ ID NO: 188152 - RNA, 18 nt, Human
agauuauggcaugaagcc

SEQ ID NO: 188153 - RNA, 21 nt, Human
aggggagccuggaguucuugg

SEQ ID NO: 188154 - RNA, 21 nt, Human
auaaaacauuaauggaagauu

SEQ ID NO: 188155 - RNA, 20 nt, Human
aucacgaacacacugauuug

SEQ ID NO: 188156 - RNA, 25 nt, Human
auccaaugcaucauuauugccaaca

SEQ ID NO: 188157 - RNA, 18 nt, Human
caacaacaacaaaauacc

SEQ ID NO: 188158 - RNA, 23 nt, Human
caacaacaacaacaaaauaccuc

SEQ ID NO: 188159 - RNA, 18 nt, Human
caacaacaacaacaacaa

SEQ ID NO: 188160 - RNA, 21 nt, Human
caagaccaucgaagccgaggg

SEQ ID NO: 188161 - RNA, 19 nt, Human
cacacuuagaucucggaga

SEQ ID NO: 188162 - RNA, 22 nt, Human
cacauaguucucagcaguggcc

SEQ ID NO: 188163 - RNA, 23 nt, Human
caccaacagagagaauaacucag

SEQ ID NO: 188164 - RNA, 18 nt, Human
caccagaagggaggaaau

SEQ ID NO: 188165 - RNA, 22 nt, Human
cagcgcgcuccccuggcugucc

SEQ ID NO: 188166 - RNA, 19 nt, Human
cagggcugauggcugcggc

SEQ ID NO: 188167 - RNA, 20 nt, Human
cagggcugauggcugcggcc

SEQ ID NO: 188168 - RNA, 21 nt, Human
caggguagauccaagagugcc

SEQ ID NO: 188169 - RNA, 21 nt, Human
caucucggccgccucagcagc

SEQ ID NO: 188170 - RNA, 21 nt, Human
ccaacaacaacaacaacaaaa

SEQ ID NO: 188171 - RNA, 23 nt, Human
ccaccggguuuagcggguucccg

SEQ ID NO: 188172 - RNA, 19 nt, Human
ccagaagggaggaaaugca

SEQ ID NO: 188173 - RNA, 23 nt, Human
ccccaugcauaaguauuccccuc

SEQ ID NO: 188174 - RNA, 23 nt, Human
cccucucuguuucuaacuuaaaa

SEQ ID NO: 188175 - RNA, 23 nt, Human
ccucagcagccaccggguuuagc

SEQ ID NO: 188176 - RNA, 18 nt, Human
ccugaucugagaaagugu

SEQ ID NO: 188177 - RNA, 18 nt, Human
ccuggaguucuuggggug

SEQ ID NO: 188178 - RNA, 18 nt, Human
ccuggcugucccgcgcug

SEQ ID NO: 188179 - RNA, 24 nt, Human
ccuguagcucuccccaccugaggg

SEQ ID NO: 188180 - RNA, 22 nt, Human
cgagaaggucgaggaugcagug

SEQ ID NO: 188181 - RNA, 21 nt, Human
cgcuccuggucaucuccaggg

SEQ ID NO: 188182 - RNA, 20 nt, Human
cuaaaaccaugcuagccuuc

SEQ ID NO: 188183 - RNA, 24 nt, Human
cuagccuucggcagacagauggca

SEQ ID NO: 188184 - RNA, 20 nt, Human
cuccagggcugauggcugcg

SEQ ID NO: 188185 - RNA, 21 nt, Human
cuccagggcugauggcugcgg

SEQ ID NO: 188186 - RNA, 20 nt, Human
cucccuacaucuucuuccuc

SEQ ID NO: 188187 - RNA, 20 nt, Human
cugaacaagaccaucgaagc

SEQ ID NO: 188188 - RNA, 24 nt, Human
cugauggcugcggccgcgauucuc

SEQ ID NO: 188189 - RNA, 23 nt, Human
cugcggccccagcgcgcuccccu

SEQ ID NO: 188190 - RNA, 19 nt, Human
cugugcuaacaggcucccc

SEQ ID NO: 188191 - RNA, 19 nt, Human
gagaauaacucagaaggga

SEQ ID NO: 188192 - RNA, 23 nt, Human
gagggucccucgggccuuuggcu

SEQ ID NO: 188193 - RNA, 23 nt, Human
gaugugucuuggaaaugaacuau

SEQ ID NO: 188194 - RNA, 21 nt, Human
gauuauggcaugaagccgugu

SEQ ID NO: 188195 - RNA, 21 nt, Human
gauuugaggaguuuggggugg

SEQ ID NO: 188196 - RNA, 24 nt, Human
gcagcagggcucgcagccucucuc

SEQ ID NO: 188197 - RNA, 29 nt, Human
gccaccaacagagagaauaaccgguuucg

SEQ ID NO: 188198 - RNA, 24 nt, Human
gcuaauuggacaccaccauggcug

SEQ ID NO: 188199 - RNA, 21 nt, Human
gcuccuggucaucuccagggc

SEQ ID NO: 188200 - RNA, 24 nt, Human
gcuguuggugcaugucaccacauu

SEQ ID NO: 188201 - RNA, 28 nt, Human
ggacauccaacauuuacccuccagaaca

SEQ ID NO: 188202 - RNA, 23 nt, Human
ggaguucuuggggugagccuggg

SEQ ID NO: 188203 - RNA, 23 nt, Human
ggccuuuggcuccagaugugucu

SEQ ID NO: 188204 - RNA, 21 nt, Human
ggcucugcagcagggcucgca

SEQ ID NO: 188205 - RNA, 22 nt, Human
ggguucccgcaugcugcggccc

SEQ ID NO: 188206 - RNA, 22 nt, Human
ggugagccugggcugugaugga

SEQ ID NO: 188207 - RNA, 21 nt, Human
uaacagauacuauacaacccu

SEQ ID NO: 188208 - RNA, 20 nt, Human
uaauuuuuaaacuagaaaaa

SEQ ID NO: 188209 - RNA, 20 nt, Human
uacagugcagaugcauucuu

SEQ ID NO: 188210 - RNA, 20 nt, Human
uacauggugggcugaccuua

SEQ ID NO: 188211 - RNA, 21 nt, Human
uacccuccagaacauuggcca

SEQ ID NO: 188212 - RNA, 22 nt, Human
uagauaaaacauuaauggaaga

SEQ ID NO: 188213 - RNA, 21 nt, Human
uauacaacccugagucaucac

SEQ ID NO: 188214 - RNA, 20 nt, Human
uaugaagugguuugccacca

SEQ ID NO: 188215 - RNA, 21 nt, Human
uauggcaugaagccgugugca

SEQ ID NO: 188216 - RNA, 24 nt, Human
ucacaagauuccuugaguggaaga

SEQ ID NO: 188217 - RNA, 19 nt, Human
uccagggcugauggcugcg

SEQ ID NO: 188218 - RNA, 21 nt, Human
ucccagccggaggcucugcag

SEQ ID NO: 188219 - RNA, 18 nt, Human
uccccuggcugucccgcg

SEQ ID NO: 188220 - RNA, 24 nt, Human
uccgcaucgcccccacggggggcg

SEQ ID NO: 188221 - RNA, 20 nt, Human
uccuacaucucuguuggugc

SEQ ID NO: 188222 - RNA, 19 nt, Human
uccugaucugagaaagugu

SEQ ID NO: 188223 - RNA, 18 nt, Human
ucuaacuuaaaaaaaaaa

SEQ ID NO: 188224 - RNA, 21 nt, Human
ucucacuaaacuguauccaca

SEQ ID NO: 188225 - RNA, 18 nt, Human
ugaagccgugugcaaaag

SEQ ID NO: 188226 - RNA, 24 nt, Human
ugaagccgugugcaaaagagccaa

SEQ ID NO: 188227 - RNA, 19 nt, Human
ugaaggcuuuugauuugag

SEQ ID NO: 188228 - RNA, 18 nt, Human
ugagaaaauuacauggug

SEQ ID NO: 188229 - RNA, 23 nt, Human
ugagaaagugucauaacauagca

SEQ ID NO: 188230 - RNA, 18 nt, Human
ugaguggaagauuauggc

SEQ ID NO: 188231 - RNA, 19 nt, Human
ugaguggaagauuauggca

SEQ ID NO: 188232 - RNA, 19 nt, Human
ugcuaugaagugguuugcc

SEQ ID NO: 188233 - RNA, 19 nt, Human
ugcucagcacacaccucac

SEQ ID NO: 188234 - RNA, 20 nt, Human
uggaggauacucaggguaga

SEQ ID NO: 188235 - RNA, 19 nt, Human
uggcaugaagccgugugca

SEQ ID NO: 188236 - RNA, 21 nt, Human
uggcauuguacuucuuacaga

SEQ ID NO: 188237 - RNA, 19 nt, Human
ugggagggaagggguaaca

SEQ ID NO: 188238 - RNA, 20 nt, Human
uguauuagagaaaccauuag

SEQ ID NO: 188239 - RNA, 21 nt, Human
ugucugugucagguuuacaug

SEQ ID NO: 188240 - RNA, 24 nt, Human
uuacucugggagggaagggguaac

SEQ ID NO: 188241 - RNA, 22 nt, Human
uucccuauagauaaaacauuaa

SEQ ID NO: 188242 - RNA, 22 nt, Human
uucucagcgcucacccgguccc

SEQ ID NO: 188243 - RNA, 19 nt, Human
uugcuuauucuguauuaga

SEQ ID NO: 188244 - RNA, 23 nt, Human
uuguacuucuuacagaucacagu

SEQ ID NO: 188245 - RNA, 23 nt, Human
uuucaugucauauaugcacaggu

SEQ ID NO: 188246 - RNA, 22 nt, Human
aaacaagaaaggagcaaauggg

SEQ ID NO: 188247 - RNA, 19 nt, Human
aaacacaaauggccuccca

SEQ ID NO: 188248 - RNA, 24 nt, Human
aaagcauaggaaacaucccccucu

SEQ ID NO: 188249 - RNA, 23 nt, Human
aaaggagcaaaugggaaccaagu

SEQ ID NO: 188250 - RNA, 20 nt, Human
aaauggccucccaaccucug

SEQ ID NO: 188251 - RNA, 22 nt, Human
aacucgucgacucccuugguuu

SEQ ID NO: 188252 - RNA, 22 nt, Human
aagaaagacgaaggauaaauga

SEQ ID NO: 188253 - RNA, 19 nt, Human
aagaagccugcucgucuag

SEQ ID NO: 188254 - RNA, 25 nt, Human
aagaaggagagaacugugaaaagga

SEQ ID NO: 188255 - RNA, 20 nt, Human
aagacgaaggauaaaugaac

SEQ ID NO: 188256 - RNA, 22 nt, Human
aagcagcaugaauuuagccaga

SEQ ID NO: 188257 - RNA, 25 nt, Human
aagcagcaugaauuuagccagagcc

SEQ ID NO: 188258 - RNA, 20 nt, Human
aaggagcucuuccacaccag

SEQ ID NO: 188259 - RNA, 20 nt, Human
aaucauggcugugaaauucg

SEQ ID NO: 188260 - RNA, 22 nt, Human
acagaaucuucuuuaucaagga

SEQ ID NO: 188261 - RNA, 25 nt, Human
acccaccuuaaccucucuguucccu

SEQ ID NO: 188262 - RNA, 22 nt, Human
acucugggcucaagucacauuc

SEQ ID NO: 188263 - RNA, 25 nt, Human
acucugggcucaagucacauuccca

SEQ ID NO: 188264 - RNA, 19 nt, Human
acuuguuuauguaccuugc

SEQ ID NO: 188265 - RNA, 24 nt, Human
agaaacaauaaaagagucaagguu

SEQ ID NO: 188266 - RNA, 19 nt, Human
agaaggagagaacugugaa

SEQ ID NO: 188267 - RNA, 24 nt, Human
agaagggaucaaagcauaggaaac

SEQ ID NO: 188268 - RNA, 18 nt, Human
agcauaggaaacaucccc

SEQ ID NO: 188269 - RNA, 21 nt, Human
agccaaaccucuagacggaca

SEQ ID NO: 188270 - RNA, 19 nt, Human
aggaagcccgcaugcagcc

SEQ ID NO: 188271 - RNA, 19 nt, Human
aggaagguagaagggcuuc

SEQ ID NO: 188272 - RNA, 21 nt, Human
aggaggagagauggugcuggu

SEQ ID NO: 188273 - RNA, 25 nt, Human
agugcagcucauuucucuuaaaugu

SEQ ID NO: 188274 - RNA, 26 nt, Human
agugugcaugaacacacaugcacgca

SEQ ID NO: 188275 - RNA, 22 nt, Human
caaagcauaggaaacauccccc

SEQ ID NO: 188276 - RNA, 22 nt, Human
caagaaaggagcaaaugggaac

SEQ ID NO: 188277 - RNA, 21 nt, Human
caagucucuuccccucuuuuc

SEQ ID NO: 188278 - RNA, 19 nt, Human
caaguugaaacaguugcca

SEQ ID NO: 188279 - RNA, 21 nt, Human
caauccaccugcucuuguccc

SEQ ID NO: 188280 - RNA, 18 nt, Human
caccaccacuaucgaguc

SEQ ID NO: 188281 - RNA, 27 nt, Human
cacgcgacccacagccuuacccucccg

SEQ ID NO: 188282 - RNA, 19 nt, Human
cacucugccaccaaugacc

SEQ ID NO: 188283 - RNA, 19 nt, Human
cagaaucuucuuuaucaag

SEQ ID NO: 188284 - RNA, 22 nt, Human
cagaugucaucuaagcagcaug

SEQ ID NO: 188285 - RNA, 21 nt, Human
cagccaggcccaaagaggugg

SEQ ID NO: 188286 - RNA, 22 nt, Human
cagcuucacucaaagaggauau

SEQ ID NO: 188287 - RNA, 26 nt, Human
caugaacacacaugcacgcacaaucc

SEQ ID NO: 188288 - RNA, 18 nt, Human
cauucuccuuauuccaga

SEQ ID NO: 188289 - RNA, 20 nt, Human
ccagagcugcacucauggag

SEQ ID NO: 188290 - RNA, 22 nt, Human
cccacccagccaggcccaaaga

SEQ ID NO: 188291 - RNA, 20 nt, Human
ccccgucacccuccgugaca

SEQ ID NO: 188292 - RNA, 18 nt, Human
ccccugcugagagggccc

SEQ ID NO: 188293 - RNA, 25 nt, Human
cccgcaugcagcccuuccuuucucc

SEQ ID NO: 188294 - RNA, 22 nt, Human
cccucccguacccaccuuaacc

SEQ ID NO: 188295 - RNA, 23 nt, Human
cccucccguacccaccuuaaccu

SEQ ID NO: 188296 - RNA, 23 nt, Human
cccucucugcccccgucucccau

SEQ ID NO: 188297 - RNA, 22 nt, Human
ccuuggguucuguucaccacca

SEQ ID NO: 188298 - RNA, 19 nt, Human
cuaaauggucucacauaga

SEQ ID NO: 188299 - RNA, 19 nt, Human
cugcugagagggcccaugg

SEQ ID NO: 188300 - RNA, 18 nt, Human
gaaaagcuaccuuugugc

SEQ ID NO: 188301 - RNA, 26 nt, Human
gaagaaggagagaacugugaaaagga

SEQ ID NO: 188302 - RNA, 19 nt, Human
gaagcccgcaugcagcccu

SEQ ID NO: 188303 - RNA, 23 nt, Human
gacuccuuacuucuucaaagguc

SEQ ID NO: 188304 - RNA, 24 nt, Human
gacuccuuacuucuucaaaggucc

SEQ ID NO: 188305 - RNA, 23 nt, Human
gagcaaaugggaaccaaguucac

SEQ ID NO: 188306 - RNA, 27 nt, Human
gagccucuuuccuuucacaaggcacuc

SEQ ID NO: 188307 - RNA, 22 nt, Human
gcagcccuuccuuucuccgcuc

SEQ ID NO: 188308 - RNA, 21 nt, Human
gccuuacccucccguacccac

SEQ ID NO: 188309 - RNA, 23 nt, Human
gcgacccacagccuuacccuccc

SEQ ID NO: 188310 - RNA, 21 nt, Human
gcucaaugguacaaucugaga

SEQ ID NO: 188311 - RNA, 18 nt, Human
ggaggaagcccgcaugca

SEQ ID NO: 188312 - RNA, 26 nt, Human
ggucccucucugcccccgucucccau

SEQ ID NO: 188313 - RNA, 21 nt, Human
guuuguagaagccaaaccucu

SEQ ID NO: 188314 - RNA, 22 nt, Human
guuuuggggggaagaagccugc

SEQ ID NO: 188315 - RNA, 24 nt, Human
uaaaugucaagcucauuucucuua

SEQ ID NO: 188316 - RNA, 18 nt, Human
uacacaugggugcaagug

SEQ ID NO: 188317 - RNA, 20 nt, Human
uacccuaccauacacgacuc

SEQ ID NO: 188318 - RNA, 22 nt, Human
uaccuuugugcucacauagccu

SEQ ID NO: 188319 - RNA, 23 nt, Human
uagacggacagauuaagggagug

SEQ ID NO: 188320 - RNA, 23 nt, Human
uagccagagccucuuuccuuuca

SEQ ID NO: 188321 - RNA, 24 nt, Human
uaucauaacguacuuuccaguuug

SEQ ID NO: 188322 - RNA, 22 nt, Human
ucaaacaaguugaaacaguugc

SEQ ID NO: 188323 - RNA, 25 nt, Human
ucaaacaaguugaaacaguugccaa

SEQ ID NO: 188324 - RNA, 23 nt, Human
ucaucucaugggaacaggaauug

SEQ ID NO: 188325 - RNA, 26 nt, Human
uccaagucucuuccccucuuuucgua

SEQ ID NO: 188326 - RNA, 23 nt, Human
uccacauaagaaagacgaaggau

SEQ ID NO: 188327 - RNA, 20 nt, Human
uccacucugccaccaaugac

SEQ ID NO: 188328 - RNA, 20 nt, Human
ucccacccagccaggcccaa

SEQ ID NO: 188329 - RNA, 24 nt, Human
ucccauuuccaagucucuuccccu

SEQ ID NO: 188330 - RNA, 21 nt, Human
uccccugcugagagggcccau

SEQ ID NO: 188331 - RNA, 18 nt, Human
ucccuuuagccuuccugg

SEQ ID NO: 188332 - RNA, 21 nt, Human
uccucaccuaaaugaaaagau

SEQ ID NO: 188333 - RNA, 21 nt, Human
uccuggaagguucuugguuca

SEQ ID NO: 188334 - RNA, 23 nt, Human
uccuuacuucuucaaagguccgu

SEQ ID NO: 188335 - RNA, 20 nt, Human
ucuagacggacagauuaagg

SEQ ID NO: 188336 - RNA, 22 nt, Human
ucuagcuucagguuaagugaga

SEQ ID NO: 188337 - RNA, 24 nt, Human
ucugagagggaacagguguugcag

SEQ ID NO: 188338 - RNA, 23 nt, Human
ucugcuuggcacaugauuccuag

SEQ ID NO: 188339 - RNA, 22 nt, Human
ucugggcucaagucacauuccc

SEQ ID NO: 188340 - RNA, 23 nt, Human
ucuugcaggauugcucaccgccu

SEQ ID NO: 188341 - RNA, 24 nt, Human
ucuuuuugguucucccagcuucac

SEQ ID NO: 188342 - RNA, 21 nt, Human
ugaacacacaugcacgcacaa

SEQ ID NO: 188343 - RNA, 25 nt, Human
ugacaugcgcaucacgcgacccaca

SEQ ID NO: 188344 - RNA, 21 nt, Human
ugagagggcccauggcaucau

SEQ ID NO: 188345 - RNA, 23 nt, Human
ugcaagugugcaugaacacacau

SEQ ID NO: 188346 - RNA, 19 nt, Human
ugcagcccuuccuuucucc

SEQ ID NO: 188347 - RNA, 22 nt, Human
ugccaccaaugaccuuggguuc

SEQ ID NO: 188348 - RNA, 18 nt, Human
ugcugagagggcccaugg

SEQ ID NO: 188349 - RNA, 22 nt, Human
ugggaauguccagucccuucuu

SEQ ID NO: 188350 - RNA, 18 nt, Human
uguagaagccaaaccucu

SEQ ID NO: 188351 - RNA, 19 nt, Human
ugugucuugaagagaugca

SEQ ID NO: 188352 - RNA, 22 nt, Human
uucaccaccacuaucgagucuc

SEQ ID NO: 188353 - RNA, 24 nt, Human
uucacccccgucacccuccgugac

SEQ ID NO: 188354 - RNA, 18 nt, Human
uucguucuuccccaaacc

SEQ ID NO: 188355 - RNA, 25 nt, Human
uucuaccaagaguguucacucuggg

SEQ ID NO: 188356 - RNA, 22 nt, Human
uugggaauguccagucccuucu

SEQ ID NO: 188357 - RNA, 22 nt, Human
uuuguagaaucuuuucguccca

SEQ ID NO: 188358 - RNA, 20 nt, Human
uuuguucaagaauccacucu

SEQ ID NO: 188359 - RNA, 21 nt, Human
uuuucgucccaagugugggca

SEQ ID NO: 188360 - RNA, 20 nt, Human
uuuuggggggaagaagccug

SEQ ID NO: 188361 - RNA, 22 nt, Human
uuuuugggcuuauauauaaaca

SEQ ID NO: 188362 - RNA, 19 nt, Human
aaagcccagcccucaccau

SEQ ID NO: 188363 - RNA, 19 nt, Human
aaagguggguuuaaugucc

SEQ ID NO: 188364 - RNA, 22 nt, Human
aagaaacucuagccagguagag

SEQ ID NO: 188365 - RNA, 19 nt, Human
aagacaucaucugucacug

SEQ ID NO: 188366 - RNA, 28 nt, Human
agagaauccagcuggcucggagccugag

SEQ ID NO: 188367 - RNA, 18 nt, Human
agcaaaagcccagcccuc

SEQ ID NO: 188368 - RNA, 18 nt, Human
aggcagagaauccagcug

SEQ ID NO: 188369 - RNA, 20 nt, Human
augucccagugcucugauga

SEQ ID NO: 188370 - RNA, 24 nt, Human
caaguuccagccuccaugcccaca

SEQ ID NO: 188371 - RNA, 19 nt, Human
cagcaaaagcccagcccuc

SEQ ID NO: 188372 - RNA, 20 nt, Human
cagcaaaagcccagcccuca

SEQ ID NO: 188373 - RNA, 25 nt, Human
cagcaaaagcccagcccucaccaug

SEQ ID NO: 188374 - RNA, 22 nt, Human
cagcacacccuccuggcagaac

SEQ ID NO: 188375 - RNA, 21 nt, Human
caggcuccccccgcgggagga

SEQ ID NO: 188376 - RNA, 18 nt, Human
caguaacuggcuagcccc

SEQ ID NO: 188377 - RNA, 19 nt, Human
caugcccacagcaggcaug

SEQ ID NO: 188378 - RNA, 22 nt, Human
cccacagcacacccuccuggca

SEQ ID NO: 188379 - RNA, 19 nt, Human
ccccacagcacacccuccu

SEQ ID NO: 188380 - RNA, 22 nt, Human
ccccagggaagggagagccuca

SEQ ID NO: 188381 - RNA, 21 nt, Human
ccccccgcgggaggagggggc

SEQ ID NO: 188382 - RNA, 23 nt, Human
ccugccugccgcuuaacccugac

SEQ ID NO: 188383 - RNA, 20 nt, Human
cggcucaaggacacucgcga

SEQ ID NO: 188384 - RNA, 24 nt, Human
cuagccccagggaagggagagccu

SEQ ID NO: 188385 - RNA, 23 nt, Human
gacaucaucugucacuggggucc

SEQ ID NO: 188386 - RNA, 20 nt, Human
gaggacagcaaaagcccagc

SEQ ID NO: 188387 - RNA, 24 nt, Human
gcucugaugagaagaaacucuagc

SEQ ID NO: 188388 - RNA, 18 nt, Human
ggacacucgcgauggcuc

SEQ ID NO: 188389 - RNA, 21 nt, Human
ggaucgggauggcccugccuc

SEQ ID NO: 188390 - RNA, 20 nt, Human
gguagaagccagaaaagccc

SEQ ID NO: 188391 - RNA, 23 nt, Human
gguagaagccagaaaagcccaau

SEQ ID NO: 188392 - RNA, 18 nt, Human
gucacccgcggcucaagg

SEQ ID NO: 188393 - RNA, 21 nt, Human
gucccauggccaggauuucau

SEQ ID NO: 188394 - RNA, 18 nt, Human
guuuaaugucccagugcu

SEQ ID NO: 188395 - RNA, 18 nt, Human
ucacugaugaccauggaa

SEQ ID NO: 188396 - RNA, 22 nt, Human
ucaggagucugacccccacagc

SEQ ID NO: 188397 - RNA, 19 nt, Human
ugacccccacagcacaccc

SEQ ID NO: 188398 - RNA, 23 nt, Human
ugacccccacagcacacccuccu

SEQ ID NO: 188399 - RNA, 21 nt, Human
ugagaagaggacagcaaaagc

SEQ ID NO: 188400 - RNA, 19 nt, Human
ugaggcuacugaggucacu

SEQ ID NO: 188401 - RNA, 18 nt, Human
ugaggucacugaugacca

SEQ ID NO: 188402 - RNA, 22 nt, Human
ugccucaaccacaaguuccagc

SEQ ID NO: 188403 - RNA, 21 nt, Human
uggcucgaguguacguggcaa

SEQ ID NO: 188404 - RNA, 19 nt, Human
uucaugguagaagccagaa

SEQ ID NO: 188405 - RNA, 22 nt, Human
uuuuuuuuuucugggaaaaggu

SEQ ID NO: 188406 - RNA, 24 nt, Human
uuuuuuuuuuuuuuuuuuucuggg

SEQ ID NO: 188407 - RNA, 21 nt, Human
agggggcgguggggcccccgg

SEQ ID NO: 188408 - RNA, 20 nt, Human
augacccuguucuguugggg

SEQ ID NO: 188409 - RNA, 19 nt, Human
caguuccacugcuuuccuu

SEQ ID NO: 188410 - RNA, 18 nt, Human
ccagaaccagggggcgca

SEQ ID NO: 188411 - RNA, 19 nt, Human
cccgccgggcggccucuuu

SEQ ID NO: 188412 - RNA, 26 nt, Human
cuucccaacccacgcggguccugucc

SEQ ID NO: 188413 - RNA, 27 nt, Human
guugagggaccaaauccucuccggcuu

SEQ ID NO: 188414 - RNA, 22 nt, Human
guuggggggauggcgggggggc

SEQ ID NO: 188415 - RNA, 22 nt, Human
uccacugcuuuccuucccaacc

SEQ ID NO: 188416 - RNA, 23 nt, Human
uccagaaccagggggcgcaggac

SEQ ID NO: 188417 - RNA, 21 nt, Human
uggccugcgcugaccaagggg

SEQ ID NO: 188418 - RNA, 24 nt, Human
uguuggggggauggcgggggggcc

SEQ ID NO: 188419 - RNA, 22 nt, Human
uucccaacccacgcggguccug

SEQ ID NO: 188420 - RNA, 26 nt, Human
aaaaaaaaacacaaaaccaaacaaac

SEQ ID NO: 188421 - RNA, 23 nt, Human
aaaaaaacacaaccuucacuaag

SEQ ID NO: 188422 - RNA, 22 nt, Human
aaaaaaagagcaaauucuccaa

SEQ ID NO: 188423 - RNA, 25 nt, Human
aaaaaagagcaaauucuccaagcaa

SEQ ID NO: 188424 - RNA, 19 nt, Human
aaaaacccagaaggcccag

SEQ ID NO: 188425 - RNA, 23 nt, Human
aaacaaacaaaccaacaaaaaaa

SEQ ID NO: 188426 - RNA, 22 nt, Human
aaacaaaccaacaaaaaaaacc

SEQ ID NO: 188427 - RNA, 21 nt, Human
aaacaacuucuauacugaaau

SEQ ID NO: 188428 - RNA, 24 nt, Human
aaacacaaaaccaaacaaacaaac

SEQ ID NO: 188429 - RNA, 22 nt, Human
aaaccaaacaaacaaaccaaca

SEQ ID NO: 188430 - RNA, 22 nt, Human
aaaccaacaaaaaaaaccucca

SEQ ID NO: 188431 - RNA, 20 nt, Human
aaacccagaaggcccagaaa

SEQ ID NO: 188432 - RNA, 20 nt, Human
aacaauaucugacacugauc

SEQ ID NO: 188433 - RNA, 30 nt, Human
aacacaaaaccaaacaaacaaaccaacaag

SEQ ID NO: 188434 - RNA, 24 nt, Human
aacacaauauucaaauauuaaacu

SEQ ID NO: 188435 - RNA, 24 nt, Human
aaccaaacaaacaaaccaacaaaa

SEQ ID NO: 188436 - RNA, 20 nt, Human
aacccagaaggcccagaaau

SEQ ID NO: 188437 - RNA, 22 nt, Human
aagaaaaaaaaaguauguucua

SEQ ID NO: 188438 - RNA, 20 nt, Human
aagaaaaacaaauacaaauu

SEQ ID NO: 188439 - RNA, 20 nt, Human
aagaaaauacuagaagaaaa

SEQ ID NO: 188440 - RNA, 20 nt, Human
aagagcaaauucuccaagca

SEQ ID NO: 188441 - RNA, 20 nt, Human
aagcaaaaacacaacaucaa

SEQ ID NO: 188442 - RNA, 26 nt, Human
aagcaagcaacagaaaaaagggaccc

SEQ ID NO: 188443 - RNA, 25 nt, Human
aagcacauacacaaagguagacucc

SEQ ID NO: 188444 - RNA, 22 nt, Human
acaaaaccaaacaaacaaacca

SEQ ID NO: 188445 - RNA, 28 nt, Human
acaaaaccaaacaaacaaaccaacaaaa

SEQ ID NO: 188446 - RNA, 22 nt, Human
acacaaaaccaaacaaacaaac

SEQ ID NO: 188447 - RNA, 24 nt, Human
acacaaaaccaaacaaacaaacca

SEQ ID NO: 188448 - RNA, 19 nt, Human
acacaaaagacacauaaga

SEQ ID NO: 188449 - RNA, 20 nt, Human
acagagcaagaccccaucuc

SEQ ID NO: 188450 - RNA, 24 nt, Human
acagagcaagaccccaucucaaaa

SEQ ID NO: 188451 - RNA, 27 nt, Human
acaugucuuccuagguauuucacaucc

SEQ ID NO: 188452 - RNA, 22 nt, Human
accaaacaaacaaaccaacaaa

SEQ ID NO: 188453 - RNA, 18 nt, Human
accccaucucaaaaaaaa

SEQ ID NO: 188454 - RNA, 23 nt, Human
accccaucucaaaaaaaaacaca

SEQ ID NO: 188455 - RNA, 19 nt, Human
acuccuaaagaaaacaacu

SEQ ID NO: 188456 - RNA, 24 nt, Human
acugcacuccagccugggcgacag

SEQ ID NO: 188457 - RNA, 26 nt, Human
acugcacuccagccugggcgacagag

SEQ ID NO: 188458 - RNA, 21 nt, Human
agaaaaaggaaaaaagcaaag

SEQ ID NO: 188459 - RNA, 19 nt, Human
agaaaaauaagcaaaaaca

SEQ ID NO: 188460 - RNA, 22 nt, Human
agaaaacaacuucuauacugaa

SEQ ID NO: 188461 - RNA, 22 nt, Human
agaaggcccagaaauuggccua

SEQ ID NO: 188462 - RNA, 26 nt, Human
agacagaaaaaggagaagagggaccc

SEQ ID NO: 188463 - RNA, 27 nt, Human
agacugcucccuucauuacccaaaaaa

SEQ ID NO: 188464 - RNA, 22 nt, Human
agauugcagugagccgagaucc

SEQ ID NO: 188465 - RNA, 20 nt, Human
agcaaaaacacaacaucaaa

SEQ ID NO: 188466 - RNA, 21 nt, Human
agcaaaaacacaacaucaaaa

SEQ ID NO: 188467 - RNA, 18 nt, Human
aggcuggcgcggcggcgg

SEQ ID NO: 188468 - RNA, 24 nt, Human
auaaaauauccuacagcugucuaa

SEQ ID NO: 188469 - RNA, 18 nt, Human
auacuaaaauaucagacc

SEQ ID NO: 188470 - RNA, 19 nt, Human
auagagcagacuacaaagc

SEQ ID NO: 188471 - RNA, 23 nt, Human
auaugggaacauauugacaauau

SEQ ID NO: 188472 - RNA, 24 nt, Human
auccugccacugcacuccagccug

SEQ ID NO: 188473 - RNA, 24 nt, Human
auugcagugagccgagauccugcc

SEQ ID NO: 188474 - RNA, 20 nt, Human
caaaaacacuuucaccuaac

SEQ ID NO: 188475 - RNA, 22 nt, Human
caaaaccaaacaaacaaaccaa

SEQ ID NO: 188476 - RNA, 21 nt, Human
caaacaaacaaaccaacaaag

SEQ ID NO: 188477 - RNA, 24 nt, Human
caaaccaacaaaaaaaaccuccac

SEQ ID NO: 188478 - RNA, 22 nt, Human
caaaggacggacauucuuaaga

SEQ ID NO: 188479 - RNA, 18 nt, Human
caacaaaaaaaaccucca

SEQ ID NO: 188480 - RNA, 19 nt, Human
caacaaaaaaaaccuccac

SEQ ID NO: 188481 - RNA, 26 nt, Human
caacaaaaaaaaccuccacuuuccag

SEQ ID NO: 188482 - RNA, 19 nt, Human
caagcaagcaacagaaaaa

SEQ ID NO: 188483 - RNA, 23 nt, Human
caauacacaauauauugcaaaau

SEQ ID NO: 188484 - RNA, 20 nt, Human
cacagcuguugcuuuaccca

SEQ ID NO: 188485 - RNA, 23 nt, Human
cacaugaacucuuccauaucauc

SEQ ID NO: 188486 - RNA, 23 nt, Human
cacuccagccugggcgacagagc

SEQ ID NO: 188487 - RNA, 19 nt, Human
cacugcacuccagccuggg

SEQ ID NO: 188488 - RNA, 20 nt, Human
cacugcacuccagccugggc

SEQ ID NO: 188489 - RNA, 20 nt, Human
cacugcacuccagccugggc

SEQ ID NO: 188490 - RNA, 22 nt, Human
cacugcacuccagccugggcga

SEQ ID NO: 188491 - RNA, 24 nt, Human
cacugcacuccagccugggcgaca

SEQ ID NO: 188492 - RNA, 26 nt, Human
cacugcacuccagccugggcgacaga

SEQ ID NO: 188493 - RNA, 19 nt, Human
cagaaaaaggagaagagca

SEQ ID NO: 188494 - RNA, 18 nt, Human
cagcaaggaacucaagcc

SEQ ID NO: 188495 - RNA, 22 nt, Human
cagcaucuacucaaaagggaag

SEQ ID NO: 188496 - RNA, 19 nt, Human
caggccccgcuacuagcgc

SEQ ID NO: 188497 - RNA, 20 nt, Human
cagugagccgagauccugcc

SEQ ID NO: 188498 - RNA, 25 nt, Human
caugaaagucaccuucugaaagaca

SEQ ID NO: 188499 - RNA, 20 nt, Human
caugcaaacaugcauacaau

SEQ ID NO: 188500 - RNA, 23 nt, Human
cauggccaaugaauaugaaaaaa

SEQ ID NO: 188501 - RNA, 18 nt, Human
ccaaacaaacaaaccaac

SEQ ID NO: 188502 - RNA, 21 nt, Human
ccaaacaaacaaaccaacaaa

SEQ ID NO: 188503 - RNA, 20 nt, Human
ccaaauauuaacaccaauua

SEQ ID NO: 188504 - RNA, 20 nt, Human
ccacugcacuccagccuggg

SEQ ID NO: 188505 - RNA, 21 nt, Human
ccacugcacuccagccugggc

SEQ ID NO: 188506 - RNA, 21 nt, Human
ccacugcacuccagccugggc

SEQ ID NO: 188507 - RNA, 24 nt, Human
ccacugcacuccagccugggcgac

SEQ ID NO: 188508 - RNA, 22 nt, Human
ccauaucauccagcuuccagaa

SEQ ID NO: 188509 - RNA, 18 nt, Human
ccccaucucaaaaaaaaa

SEQ ID NO: 188510 - RNA, 21 nt, Human
cgaaauaaaaucaaaucccua

SEQ ID NO: 188511 - RNA, 19 nt, Human
cgacagagcaagaccccau

SEQ ID NO: 188512 - RNA, 22 nt, Human
cgagauccugccacugcacucc

SEQ ID NO: 188513 - RNA, 24 nt, Human
cgagauccugccacugcacuccag

SEQ ID NO: 188514 - RNA, 22 nt, Human
cuauacugaaauaccacaaacu

SEQ ID NO: 188515 - RNA, 20 nt, Human
cuauuugauagguaagaaaa

SEQ ID NO: 188516 - RNA, 19 nt, Human
cuccaagcaagcaacagaa

SEQ ID NO: 188517 - RNA, 23 nt, Human
cuccggggcacgagcggggcaaa

SEQ ID NO: 188518 - RNA, 24 nt, Human
cucuuccauaucauccagcuucca

SEQ ID NO: 188519 - RNA, 22 nt, Human
cugaucuugauacuaguuagaa

SEQ ID NO: 188520 - RNA, 19 nt, Human
gaaaaaaaacacaaccuuc

SEQ ID NO: 188521 - RNA, 22 nt, Human
gaaaaaacccagaaggcccaga

SEQ ID NO: 188522 - RNA, 25 nt, Human
gaaaaauaagcaaaaacacaacauc

SEQ ID NO: 188523 - RNA, 24 nt, Human
gaacucuuccauaucauccagcuu

SEQ ID NO: 188524 - RNA, 19 nt, Human
gauuacagggaacugugug

SEQ ID NO: 188525 - RNA, 24 nt, Human
gcacuccagccugggcgacagagc

SEQ ID NO: 188526 - RNA, 22 nt, Human
gccacugcacuccagccugggc

SEQ ID NO: 188527 - RNA, 24 nt, Human
gccacugcacuccagccugggcga

SEQ ID NO: 188528 - RNA, 23 nt, Human
ggaaacagugagugucaagaggg

SEQ ID NO: 188529 - RNA, 21 nt, Human
ggacauucuuaagaacuuaua

SEQ ID NO: 188530 - RNA, 18 nt, Human
ggcuucuccuguaccaga

SEQ ID NO: 188531 - RNA, 23 nt, Human
gguaagaaaaaggaaaaaagcaa

SEQ ID NO: 188532 - RNA, 19 nt, Human
guguacuaccaaauauuaa

SEQ ID NO: 188533 - RNA, 23 nt, Human
guuugugauuacacagcuguugc

SEQ ID NO: 188534 - RNA, 24 nt, Human
uaaaacuaaugagaaucuuagguc

SEQ ID NO: 188535 - RNA, 20 nt, Human
uaaaauauccuacagcuguc

SEQ ID NO: 188536 - RNA, 21 nt, Human
uaaaauauccuacagcugucu

SEQ ID NO: 188537 - RNA, 22 nt, Human
uaaacaaaauuuaaauuccuuu

SEQ ID NO: 188538 - RNA, 22 nt, Human
uaagaaaaaggaaaaaagcaaa

SEQ ID NO: 188539 - RNA, 22 nt, Human
uaagaaaauacuagaagaaaau

SEQ ID NO: 188540 - RNA, 21 nt, Human
uaagacacaaaagacacauaa

SEQ ID NO: 188541 - RNA, 24 nt, Human
uaagcaaaaacacaacaaccccgg

SEQ ID NO: 188542 - RNA, 25 nt, Human
uaagcaaaaacacaacaucaaaaug

SEQ ID NO: 188543 - RNA, 18 nt, Human
uaauuauucaauuugcaa

SEQ ID NO: 188544 - RNA, 21 nt, Human
uacaaaaauacuuucaagcac

SEQ ID NO: 188545 - RNA, 23 nt, Human
uacaauauaugacaaaggacgga

SEQ ID NO: 188546 - RNA, 19 nt, Human
uaccaaauauuaacaccaa

SEQ ID NO: 188547 - RNA, 20 nt, Human
uagaaaaaacccagaaggcc

SEQ ID NO: 188548 - RNA, 20 nt, Human
uaggugccuggaacaacuaa

SEQ ID NO: 188549 - RNA, 18 nt, Human
uauaagucaaaagugagc

SEQ ID NO: 188550 - RNA, 22 nt, Human
uaugccaaaaaaagagcaaauu

SEQ ID NO: 188551 - RNA, 21 nt, Human
ucaaaaacacuuucaccuaac

SEQ ID NO: 188552 - RNA, 20 nt, Human
ucaagcacaugaaagucacc

SEQ ID NO: 188553 - RNA, 19 nt, Human
ucaagccaggugaugcaca

SEQ ID NO: 188554 - RNA, 21 nt, Human
ucacauacugaaccaauuggu

SEQ ID NO: 188555 - RNA, 28 nt, Human
uccaagcaagcaacagaaaaaauaugaa

SEQ ID NO: 188556 - RNA, 26 nt, Human
uccaagcaagcaacagaaaggaguuc

SEQ ID NO: 188557 - RNA, 25 nt, Human
uccagcaucuacucaaaagggaagu

SEQ ID NO: 188558 - RNA, 24 nt, Human
uccagccugggcgacagagcaaga

SEQ ID NO: 188559 - RNA, 24 nt, Human
ucccucaacaauaucugacacuga

SEQ ID NO: 188560 - RNA, 21 nt, Human
ucuauacugaaauaccacaaa

SEQ ID NO: 188561 - RNA, 20 nt, Human
ucuauggaugugauuaagau

SEQ ID NO: 188562 - RNA, 22 nt, Human
ucucaaaaaaaaacacaaaacu

SEQ ID NO: 188563 - RNA, 18 nt, Human
ucucaaaaacacuuucac

SEQ ID NO: 188564 - RNA, 23 nt, Human
ucucaaaaacacuuucaccuaac

SEQ ID NO: 188565 - RNA, 22 nt, Human
ugaaaaaaaacacaaccuucac

SEQ ID NO: 188566 - RNA, 26 nt, Human
ugaaaaaaaacacaaccuucacuaag

SEQ ID NO: 188567 - RNA, 20 nt, Human
ugaaagacauguaauaaaug

SEQ ID NO: 188568 - RNA, 22 nt, Human
ugaaauaagaaaauacuagaag

SEQ ID NO: 188569 - RNA, 21 nt, Human
ugaaauaccacaaacuauguu

SEQ ID NO: 188570 - RNA, 24 nt, Human
ugaaugagcaauucucaaaagaau

SEQ ID NO: 188571 - RNA, 19 nt, Human
ugacacugaucuugauacu

SEQ ID NO: 188572 - RNA, 22 nt, Human
ugagccgagauccugccacugc

SEQ ID NO: 188573 - RNA, 19 nt, Human
ugcgcgggcugaggcuggc

SEQ ID NO: 188574 - RNA, 19 nt, Human
ugggcuuuuuuuauaacua

SEQ ID NO: 188575 - RNA, 22 nt, Human
uguaaaagugaaauaagaaaau

SEQ ID NO: 188576 - RNA, 23 nt, Human
uguaaguuaauuucucuggagac

SEQ ID NO: 188577 - RNA, 23 nt, Human
uguagaaaaaacccagaaggccc

SEQ ID NO: 188578 - RNA, 24 nt, Human
uguagaaaaaacccagaaggccca

SEQ ID NO: 188579 - RNA, 22 nt, Human
ugucaagaggggacacacagag

SEQ ID NO: 188580 - RNA, 28 nt, Human
uuaaaaauuuccuuuucaccccaaacuu

SEQ ID NO: 188581 - RNA, 20 nt, Human
uuaaagcgauaauuauugac

SEQ ID NO: 188582 - RNA, 18 nt, Human
uuacagggaacugugugu

SEQ ID NO: 188583 - RNA, 18 nt, Human
uucaagcacauacacaaa

SEQ ID NO: 188584 - RNA, 21 nt, Human
uucaagcacaugaaagucacc

SEQ ID NO: 188585 - RNA, 22 nt, Human
uucacugaaagacauguaauaa

SEQ ID NO: 188586 - RNA, 24 nt, Human
uucuauacugaaauaccacaaacu

SEQ ID NO: 188587 - RNA, 19 nt, Human
uugcagugagccgagaucc

SEQ ID NO: 188588 - RNA, 21 nt, Human
uugcagugagccgagaucccc

SEQ ID NO: 188589 - RNA, 21 nt, Human
uugcagugagccgagauccug

SEQ ID NO: 188590 - RNA, 22 nt, Human
uugcagugagccgagauccugc

SEQ ID NO: 188591 - RNA, 19 nt, Human
uuggcuuaaagaaaaaaaa

SEQ ID NO: 188592 - RNA, 19 nt, Human
uuuaacaaaaaaaaaaugc

SEQ ID NO: 188593 - RNA, 21 nt, Human
uuucaagcacaugaaagucac

SEQ ID NO: 188594 - RNA, 22 nt, Human
uuucaagcacaugaaagucacc

SEQ ID NO: 188595 - RNA, 20 nt, Human
aaacgaaacacagaugucac

SEQ ID NO: 188596 - RNA, 23 nt, Human
aagaaucugggucgcagcaggug

SEQ ID NO: 188597 - RNA, 19 nt, Human
aagagcagcaggagcugag

SEQ ID NO: 188598 - RNA, 23 nt, Human
aagcgggagugggggcagcaugg

SEQ ID NO: 188599 - RNA, 25 nt, Human
aagcgggagugggggcagcaugguc

SEQ ID NO: 188600 - RNA, 20 nt, Human
aagcugccacagucccugcc

SEQ ID NO: 188601 - RNA, 22 nt, Human
aaggcgguggaggcaggagagc

SEQ ID NO: 188602 - RNA, 23 nt, Human
aagggccacucccgucuccaacc

SEQ ID NO: 188603 - RNA, 20 nt, Human
acaaagacagacacauccug

SEQ ID NO: 188604 - RNA, 24 nt, Human
acaaagacagacacauccugcaga

SEQ ID NO: 188605 - RNA, 26 nt, Human
acacaccuuccagaacuuagagcccc

SEQ ID NO: 188606 - RNA, 21 nt, Human
accacccccuccacacuccug

SEQ ID NO: 188607 - RNA, 18 nt, Human
accauuggcuggugcucc

SEQ ID NO: 188608 - RNA, 25 nt, Human
acccaggccuccuuucccuaagagc

SEQ ID NO: 188609 - RNA, 24 nt, Human
acccugaaucucagagcauccucc

SEQ ID NO: 188610 - RNA, 21 nt, Human
acccugggccuacagggcccc

SEQ ID NO: 188611 - RNA, 22 nt, Human
accuagugguggcagagccgug

SEQ ID NO: 188612 - RNA, 18 nt, Human
acgagggucagcuccacc

SEQ ID NO: 188613 - RNA, 21 nt, Human
acugccaucuccccagcuguc

SEQ ID NO: 188614 - RNA, 22 nt, Human
agacagacgccccgaagcucuc

SEQ ID NO: 188615 - RNA, 18 nt, Human
agagacagaccaacagga

SEQ ID NO: 188616 - RNA, 20 nt, Human
agagcauccuccuccccggc

SEQ ID NO: 188617 - RNA, 19 nt, Human
agagccagcgcccucagca

SEQ ID NO: 188618 - RNA, 18 nt, Human
agagcccaggugcuccuc

SEQ ID NO: 188619 - RNA, 24 nt, Human
agagggaggcacccggaggcuggu

SEQ ID NO: 188620 - RNA, 18 nt, Human
agccacgccacccagccu

SEQ ID NO: 188621 - RNA, 21 nt, Human
agccccacccugaaucucaga

SEQ ID NO: 188622 - RNA, 24 nt, Human
agcgccaggcccaggguaccuggc

SEQ ID NO: 188623 - RNA, 18 nt, Human
agcugcagacgcccggga

SEQ ID NO: 188624 - RNA, 24 nt, Human
aggaaguguucucuucagggguug

SEQ ID NO: 188625 - RNA, 19 nt, Human
aggaggccgccagccgggc

SEQ ID NO: 188626 - RNA, 25 nt, Human
aggaggccgccagccgggcuguacc

SEQ ID NO: 188627 - RNA, 18 nt, Human
aggcacccggaggcuggu

SEQ ID NO: 188628 - RNA, 19 nt, Human
aggcgguggaggcaggaga

SEQ ID NO: 188629 - RNA, 22 nt, Human
agggaggcacccggaggcuggu

SEQ ID NO: 188630 - RNA, 21 nt, Human
aggguaccuggcagcccagcc

SEQ ID NO: 188631 - RNA, 22 nt, Human
aguucaguccucaaaugggucc

SEQ ID NO: 188632 - RNA, 20 nt, Human
augccccucaaacgaccgag

SEQ ID NO: 188633 - RNA, 20 nt, Human
caaggcgguggaggcaggag

SEQ ID NO: 188634 - RNA, 20 nt, Human
cacagaaaacacgccugaag

SEQ ID NO: 188635 - RNA, 22 nt, Human
cacagggaugcccccauccccu

SEQ ID NO: 188636 - RNA, 21 nt, Human
caccagaagagacaaaaauuc

SEQ ID NO: 188637 - RNA, 19 nt, Human
caccccacuagcucucgcc

SEQ ID NO: 188638 - RNA, 25 nt, Human
caccccacuagcucucgccuggggg

SEQ ID NO: 188639 - RNA, 23 nt, Human
caccccgucagagagaggaccgg

SEQ ID NO: 188640 - RNA, 20 nt, Human
cacccucugugcacacaccu

SEQ ID NO: 188641 - RNA, 19 nt, Human
cacucccgucuccaaccac

SEQ ID NO: 188642 - RNA, 22 nt, Human
cacugccaucuccccagcuguc

SEQ ID NO: 188643 - RNA, 28 nt, Human
cagaaaacacgccugaacccccugaaag

SEQ ID NO: 188644 - RNA, 21 nt, Human
cagagccaggaucagucucug

SEQ ID NO: 188645 - RNA, 21 nt, Human
cagcaggaagcaaaaccaagg

SEQ ID NO: 188646 - RNA, 20 nt, Human
cagccccacccugaaucuca

SEQ ID NO: 188647 - RNA, 18 nt, Human
cagccccccgcgcggcag

SEQ ID NO: 188648 - RNA, 19 nt, Human
cagccccccgcgcggcagg

SEQ ID NO: 188649 - RNA, 18 nt, Human
cagccgaugguaccauug

SEQ ID NO: 188650 - RNA, 19 nt, Human
cagcuaaaacgaaacacag

SEQ ID NO: 188651 - RNA, 23 nt, Human
caggcccccuggaauacaccaca

SEQ ID NO: 188652 - RNA, 23 nt, Human
cagggacggcccagggcaccacc

SEQ ID NO: 188653 - RNA, 24 nt, Human
cagggcaccaccaugcuuucccuc

SEQ ID NO: 188654 - RNA, 18 nt, Human
cagguacuucugugagga

SEQ ID NO: 188655 - RNA, 22 nt, Human
cagguggcuugggacguggcuu

SEQ ID NO: 188656 - RNA, 19 nt, Human
caguaaauggggccguuuc

SEQ ID NO: 188657 - RNA, 19 nt, Human
cauccugguuuugcugcca

SEQ ID NO: 188658 - RNA, 22 nt, Human
caucuccccagcuguccccacc

SEQ ID NO: 188659 - RNA, 20 nt, Human
caugcuuucccuccaccccc

SEQ ID NO: 188660 - RNA, 19 nt, Human
ccaacauucacagaaaaca

SEQ ID NO: 188661 - RNA, 18 nt, Human
ccaagggcugcugucccc

SEQ ID NO: 188662 - RNA, 19 nt, Human
ccacccccuccacacuccu

SEQ ID NO: 188663 - RNA, 19 nt, Human
ccagacccagccccccgcg

SEQ ID NO: 188664 - RNA, 20 nt, Human
ccagggaacagagggagggc

SEQ ID NO: 188665 - RNA, 19 nt, Human
ccagguuccagccugcacu

SEQ ID NO: 188666 - RNA, 23 nt, Human
cccacacucucuggguccaggca

SEQ ID NO: 188667 - RNA, 21 nt, Human
cccacguccccauucuggaca

SEQ ID NO: 188668 - RNA, 18 nt, Human
cccagccccccgcgcggc

SEQ ID NO: 188669 - RNA, 21 nt, Human
cccaugagcacccucugugca

SEQ ID NO: 188670 - RNA, 18 nt, Human
ccccagagggagcucggg

SEQ ID NO: 188671 - RNA, 20 nt, Human
ccccauccccuucuggccag

SEQ ID NO: 188672 - RNA, 22 nt, Human
ccccgcgcggcaggggcccucc

SEQ ID NO: 188673 - RNA, 21 nt, Human
ccccggaucccugcgcugccc

SEQ ID NO: 188674 - RNA, 22 nt, Human
cccucccacccagugcugagag

SEQ ID NO: 188675 - RNA, 20 nt, Human
ccuacagggccaggcacagc

SEQ ID NO: 188676 - RNA, 18 nt, Human
ccucagcccggagcagca

SEQ ID NO: 188677 - RNA, 23 nt, Human
ccucuagucccucagcccggagc

SEQ ID NO: 188678 - RNA, 19 nt, Human
ccugcacugccaucucccc

SEQ ID NO: 188679 - RNA, 18 nt, Human
ccuuccagccaacccugg

SEQ ID NO: 188680 - RNA, 20 nt, Human
cgaaacacagaugucaccuu

SEQ ID NO: 188681 - RNA, 19 nt, Human
cgacacaagccaagaauuc

SEQ ID NO: 188682 - RNA, 27 nt, Human
cggacccgcgacagaaacugcccccuu

SEQ ID NO: 188683 - RNA, 21 nt, Human
cggacgcugaaggccggccug

SEQ ID NO: 188684 - RNA, 20 nt, Human
cggcaaaggccagggcacug

SEQ ID NO: 188685 - RNA, 21 nt, Human
cggccgcgcccccaccggacc

SEQ ID NO: 188686 - RNA, 20 nt, Human
cuaguguuccuuuguuugcc

SEQ ID NO: 188687 - RNA, 21 nt, Human
cucucucccuguuccucccca

SEQ ID NO: 188688 - RNA, 21 nt, Human
cugcccccuuccugggccacu

SEQ ID NO: 188689 - RNA, 22 nt, Human
cugccuccagcaggaagcaaaa

SEQ ID NO: 188690 - RNA, 20 nt, Human
cuggagccauugccugccua

SEQ ID NO: 188691 - RNA, 22 nt, Human
cuguggagugggacggugggga

SEQ ID NO: 188692 - RNA, 20 nt, Human
cuucagggguugccagcccc

SEQ ID NO: 188693 - RNA, 22 nt, Human
cuuccagaacuuagagccccaa

SEQ ID NO: 188694 - RNA, 18 nt, Human
cuugacccaggccuccuu

SEQ ID NO: 188695 - RNA, 19 nt, Human
gaaaacacgccugaacccu

SEQ ID NO: 188696 - RNA, 18 nt, Human
gaaaggaugggagggggg

SEQ ID NO: 188697 - RNA, 22 nt, Human
gaaugccugguggccugcgggg

SEQ ID NO: 188698 - RNA, 18 nt, Human
gacccagccccccgcgcg

SEQ ID NO: 188699 - RNA, 19 nt, Human
gacgcugaaggccggccug

SEQ ID NO: 188700 - RNA, 19 nt, Human
gacggcccagggcaccacc

SEQ ID NO: 188701 - RNA, 19 nt, Human
gagauguccucuagucccu

SEQ ID NO: 188702 - RNA, 21 nt, Human
gagcagcaggagcugagugag

SEQ ID NO: 188703 - RNA, 24 nt, Human
gagcauccuccuccccggcaaagg

SEQ ID NO: 188704 - RNA, 22 nt, Human
gaggagagggguagagagccca

SEQ ID NO: 188705 - RNA, 18 nt, Human
gcacacaccuuccagaac

SEQ ID NO: 188706 - RNA, 18 nt, Human
gcagggguggcugcccca

SEQ ID NO: 188707 - RNA, 21 nt, Human
gcauaaccucgaaaagggggc

SEQ ID NO: 188708 - RNA, 18 nt, Human
gccaacgcccucccaccc

SEQ ID NO: 188709 - RNA, 19 nt, Human
gcccaggguaccuggcagc

SEQ ID NO: 188710 - RNA, 20 nt, Human
gccccugccucuguccccag

SEQ ID NO: 188711 - RNA, 20 nt, Human
gccugguggccugcgggggu

SEQ ID NO: 188712 - RNA, 20 nt, Human
gcugcccucgggaaagcagc

SEQ ID NO: 188713 - RNA, 21 nt, Human
gcuuugcaccaagggcugcug

SEQ ID NO: 188714 - RNA, 22 nt, Human
ggaaagacggggacaaugcaga

SEQ ID NO: 188715 - RNA, 21 nt, Human
ggaagagacagaccaacagga

SEQ ID NO: 188716 - RNA, 19 nt, Human
ggagcagcagaugagaggc

SEQ ID NO: 188717 - RNA, 21 nt, Human
ggagcugagugaggcacaggg

SEQ ID NO: 188718 - RNA, 20 nt, Human
gggacugggcugcuuuugcc

SEQ ID NO: 188719 - RNA, 20 nt, Human
gggaggggggcgcagcugag

SEQ ID NO: 188720 - RNA, 22 nt, Human
gggaggggggcgcagcugaggu

SEQ ID NO: 188721 - RNA, 21 nt, Human
gggcccuccuggccaccgcac

SEQ ID NO: 188722 - RNA, 21 nt, Human
ggggacugggcugcuuuugcc

SEQ ID NO: 188723 - RNA, 18 nt, Human
guaaaugugugccgugac

SEQ ID NO: 188724 - RNA, 21 nt, Human
gucacccucuguccaccguga

SEQ ID NO: 188725 - RNA, 18 nt, Human
gugcguguccagaaugcc

SEQ ID NO: 188726 - RNA, 18 nt, Human
gugugugcagauggaagg

SEQ ID NO: 188727 - RNA, 21 nt, Human
gugugugugugugugugugug

SEQ ID NO: 188728 - RNA, 22 nt, Human
uagccggcgcccccaaagcagu

SEQ ID NO: 188729 - RNA, 18 nt, Human
ucacugcagcuggccugc

SEQ ID NO: 188730 - RNA, 26 nt, Human
ucacugcagcuggccugccggucccc

SEQ ID NO: 188731 - RNA, 27 nt, Human
ucacugcagcuggccugccggucccuc

SEQ ID NO: 188732 - RNA, 21 nt, Human
ucaggccacagcuccaggcau

SEQ ID NO: 188733 - RNA, 21 nt, Human
uccaagccagcucaggucugc

SEQ ID NO: 188734 - RNA, 23 nt, Human
uccccaguggacuugguuuuguu

SEQ ID NO: 188735 - RNA, 18 nt, Human
ucccuaagagcagcagga

SEQ ID NO: 188736 - RNA, 21 nt, Human
ucccugccugcccaccuuggc

SEQ ID NO: 188737 - RNA, 18 nt, Human
ucgcugggcagggguggc

SEQ ID NO: 188738 - RNA, 20 nt, Human
ucucuggcuuugcaccaagg

SEQ ID NO: 188739 - RNA, 22 nt, Human
ucugcgcucucgcugggcaggg

SEQ ID NO: 188740 - RNA, 21 nt, Human
ucuuaaagugcaacgagcccc

SEQ ID NO: 188741 - RNA, 19 nt, Human
ugacaaagacagacacauc

SEQ ID NO: 188742 - RNA, 21 nt, Human
ugacccaggccuccuuucccu

SEQ ID NO: 188743 - RNA, 24 nt, Human
ugagcauaaccucgaaaagggggc

SEQ ID NO: 188744 - RNA, 22 nt, Human
ugaggagagggguagagagccc

SEQ ID NO: 188745 - RNA, 23 nt, Human
ugaucugcagagccagcgcccuc

SEQ ID NO: 188746 - RNA, 22 nt, Human
ugcacugccaucuccccagcug

SEQ ID NO: 188747 - RNA, 23 nt, Human
ugcacugccaucuccccagcugu

SEQ ID NO: 188748 - RNA, 18 nt, Human
ugccccagaccuaguuuc

SEQ ID NO: 188749 - RNA, 24 nt, Human
ugcccccauccccuucuggccagc

SEQ ID NO: 188750 - RNA, 18 nt, Human
ugccccugccucuguccc

SEQ ID NO: 188751 - RNA, 23 nt, Human
ugccgugacacccaguaugcgac

SEQ ID NO: 188752 - RNA, 18 nt, Human
ugcgagucccaugagcac

SEQ ID NO: 188753 - RNA, 25 nt, Human
ugcugggguccagggcugggggagu

SEQ ID NO: 188754 - RNA, 19 nt, Human
uggaaggugggaagagaca

SEQ ID NO: 188755 - RNA, 18 nt, Human
uggaauacaccacagauc

SEQ ID NO: 188756 - RNA, 19 nt, Human
uggacaagccaacgcccuc

SEQ ID NO: 188757 - RNA, 18 nt, Human
uggacacagacgaugucc

SEQ ID NO: 188758 - RNA, 23 nt, Human
uggcucccaugcaagugcccucc

SEQ ID NO: 188759 - RNA, 19 nt, Human
ugggaggggggcgcagcug

SEQ ID NO: 188760 - RNA, 20 nt, Human
ugggaggggggcgcagcuga

SEQ ID NO: 188761 - RNA, 21 nt, Human
uggugugagcagcuacguggg

SEQ ID NO: 188762 - RNA, 31 nt, Human
ugugaaguuuugugugugugugugugugugg

SEQ ID NO: 188763 - RNA, 19 nt, Human
ugugcaugggggcucccuu

SEQ ID NO: 188764 - RNA, 18 nt, Human
ugugugugugcgugucca

SEQ ID NO: 188765 - RNA, 18 nt, Human
ugugugugugugcguguc

SEQ ID NO: 188766 - RNA, 18 nt, Human
ugugugugugugugugug

SEQ ID NO: 188767 - RNA, 18 nt, Human
ugugugugugugugugug

SEQ ID NO: 188768 - RNA, 18 nt, Human
ugugugugugugugugug

SEQ ID NO: 188769 - RNA, 18 nt, Human
ugugugugugugugugug

SEQ ID NO: 188770 - RNA, 18 nt, Human
ugugugugugugugugug

SEQ ID NO: 188771 - RNA, 18 nt, Human
ugugugugugugugugug

SEQ ID NO: 188772 - RNA, 18 nt, Human
ugugugugugugugugug

SEQ ID NO: 188773 - RNA, 21 nt, Human
ugugugugugugugugugugc

SEQ ID NO: 188774 - RNA, 24 nt, Human
ugugugugugugugugugugcgug

SEQ ID NO: 188775 - RNA, 21 nt, Human
ugugugugugugugugugugu

SEQ ID NO: 188776 - RNA, 21 nt, Human
ugugugugugugugugugugu

SEQ ID NO: 188777 - RNA, 21 nt, Human
ugugugugugugugugugugu

SEQ ID NO: 188778 - RNA, 21 nt, Human
ugugugugugugugugugugu

SEQ ID NO: 188779 - RNA, 21 nt, Human
ugugugugugugugugugugu

SEQ ID NO: 188780 - RNA, 21 nt, Human
ugugugugugugugugugugu

SEQ ID NO: 188781 - RNA, 21 nt, Human
ugugugugugugugugugugu

SEQ ID NO: 188782 - RNA, 21 nt, Human
ugugugugugugugugugugu

SEQ ID NO: 188783 - RNA, 21 nt, Human
ugugugugugugugugugugu

SEQ ID NO: 188784 - RNA, 21 nt, Human
ugugugugugugugugugugu

SEQ ID NO: 188785 - RNA, 21 nt, Human
ugugugugugugugugugugu

SEQ ID NO: 188786 - RNA, 21 nt, Human
ugugugugugugugugugugu

SEQ ID NO: 188787 - RNA, 22 nt, Human
ugugugugugugugugugugug

SEQ ID NO: 188788 - RNA, 22 nt, Human
ugugugugugugugugugugug

SEQ ID NO: 188789 - RNA, 22 nt, Human
ugugugugugugugugugugug

SEQ ID NO: 188790 - RNA, 22 nt, Human
ugugugugugugugugugugug

SEQ ID NO: 188791 - RNA, 19 nt, Human
uuaauuacuggaaggguuu

SEQ ID NO: 188792 - RNA, 18 nt, Human
uuccagccaacccugggc

SEQ ID NO: 188793 - RNA, 22 nt, Human
uuccagccaacccugggccuac

SEQ ID NO: 188794 - RNA, 23 nt, Human
uugccagccccacccugaaucuc

SEQ ID NO: 188795 - RNA, 19 nt, Human
uuggccauugagaacugga

SEQ ID NO: 188796 - RNA, 19 nt, Human
uuggcuggugcucccacug

SEQ ID NO: 188797 - RNA, 24 nt, Human
uuugugugugugugugugugugug

SEQ ID NO: 188798 - RNA, 19 nt, Human
aaaaaaaugauauaaccug

SEQ ID NO: 188799 - RNA, 18 nt, Human
aaacauggaaccaaaguc

SEQ ID NO: 188800 - RNA, 19 nt, Human
aaauagcagaaauaaaaag

SEQ ID NO: 188801 - RNA, 28 nt, Human
aaccacuucauuaauaacauaucuccac

SEQ ID NO: 188802 - RNA, 18 nt, Human
aagaauccgaauccuggc

SEQ ID NO: 188803 - RNA, 23 nt, Human
aagaggccacaaugugauugaua

SEQ ID NO: 188804 - RNA, 20 nt, Human
aagaguuucggcccucuugg

SEQ ID NO: 188805 - RNA, 20 nt, Human
aagcacuuuuuggugauaau

SEQ ID NO: 188806 - RNA, 25 nt, Human
aaggcuucgaguaauucaagaaucc

SEQ ID NO: 188807 - RNA, 20 nt, Human
aaguagcuguggaaaaucuu

SEQ ID NO: 188808 - RNA, 22 nt, Human
aaguggauuacauguccaugga

SEQ ID NO: 188809 - RNA, 19 nt, Human
acaacagcaaauagcagaa

SEQ ID NO: 188810 - RNA, 24 nt, Human
acaaugaaaacauggaaccaaaag

SEQ ID NO: 188811 - RNA, 21 nt, Human
acacaacagcaaauagcagaa

SEQ ID NO: 188812 - RNA, 19 nt, Human
acgcuggucccgcugcagg

SEQ ID NO: 188813 - RNA, 21 nt, Human
acucucaguuuuugugcacuu

SEQ ID NO: 188814 - RNA, 21 nt, Human
acuggaugccacguggucugu

SEQ ID NO: 188815 - RNA, 26 nt, Human
agaaaaaauccuuuuauuggugguaa

SEQ ID NO: 188816 - RNA, 23 nt, Human
agaguaauaaagugaucacaguu

SEQ ID NO: 188817 - RNA, 19 nt, Human
agaguuucggcccucuugg

SEQ ID NO: 188818 - RNA, 20 nt, Human
agcagcaggggguccaugca

SEQ ID NO: 188819 - RNA, 20 nt, Human
aggcagcagcagcaguagcg

SEQ ID NO: 188820 - RNA, 25 nt, Human
agugacaauaggauagaauuauuug

SEQ ID NO: 188821 - RNA, 23 nt, Human
caaacacaagucaaucuacaaaa

SEQ ID NO: 188822 - RNA, 20 nt, Human
caaagucucaugcugaugga

SEQ ID NO: 188823 - RNA, 24 nt, Human
caaauaauagaagaaaucaaaaca

SEQ ID NO: 188824 - RNA, 23 nt, Human
caacaauggucguccaaggccuu

SEQ ID NO: 188825 - RNA, 24 nt, Human
caagaagcugaacaacuuguauca

SEQ ID NO: 188826 - RNA, 23 nt, Human
caagccgaaggaaaacacauuua

SEQ ID NO: 188827 - RNA, 25 nt, Human
caagccgaaggaaaacacauuuaca

SEQ ID NO: 188828 - RNA, 21 nt, Human
caaggugaagaguuucggccc

SEQ ID NO: 188829 - RNA, 20 nt, Human
caauaggauagaauuauuug

SEQ ID NO: 188830 - RNA, 21 nt, Human
cacaaacacaagucaaucuac

SEQ ID NO: 188831 - RNA, 21 nt, Human
cacaacagcaaauagcagaag

SEQ ID NO: 188832 - RNA, 19 nt, Human
caccgccuccuuccccuuc

SEQ ID NO: 188833 - RNA, 23 nt, Human
cagcagcaguagcggcagcagca

SEQ ID NO: 188834 - RNA, 22 nt, Human
cagcagcggucuccuguccucc

SEQ ID NO: 188835 - RNA, 25 nt, Human
cagcaggggguccaugcaccuuucu

SEQ ID NO: 188836 - RNA, 19 nt, Human
cagcucacuccgaaugcau

SEQ ID NO: 188837 - RNA, 26 nt, Human
ccaacaauggucguccaaggccuuuu

SEQ ID NO: 188838 - RNA, 23 nt, Human
ccacucccaggcuuuuccuccca

SEQ ID NO: 188839 - RNA, 21 nt, Human
ccagcgccgccucucccggag

SEQ ID NO: 188840 - RNA, 24 nt, Human
cccauaaucaggauaauaguaggc

SEQ ID NO: 188841 - RNA, 27 nt, Human
ccccaagacgcccagcgccgccucucc

SEQ ID NO: 188842 - RNA, 25 nt, Human
cccgcaccugcucugucuggcucca

SEQ ID NO: 188843 - RNA, 18 nt, Human
cccucucuuccuacuuaa

SEQ ID NO: 188844 - RNA, 20 nt, Human
ccgccucuacaagcuggagg

SEQ ID NO: 188845 - RNA, 23 nt, Human
ccuccuccaccaccgccuccuuc

SEQ ID NO: 188846 - RNA, 18 nt, Human
ccugagucuccugaagau

SEQ ID NO: 188847 - RNA, 20 nt, Human
ccuugccaagcauggcccag

SEQ ID NO: 188848 - RNA, 19 nt, Human
ccuuucuucccagagaagg

SEQ ID NO: 188849 - RNA, 23 nt, Human
cgaaggaaaacacauuuacaaga

SEQ ID NO: 188850 - RNA, 24 nt, Human
cgaggccccccacucccaggcuuu

SEQ ID NO: 188851 - RNA, 20 nt, Human
cgcacccccaagacgcccag

SEQ ID NO: 188852 - RNA, 24 nt, Human
cgccaacaauggucguccaaggcc

SEQ ID NO: 188853 - RNA, 23 nt, Human
cggcgcgcacccccaagacgccc

SEQ ID NO: 188854 - RNA, 23 nt, Human
cgucuccuccucuggguccucca

SEQ ID NO: 188855 - RNA, 25 nt, Human
cuacuagguugacauugacagguca

SEQ ID NO: 188856 - RNA, 19 nt, Human
cucccaggcuuuuccuccc

SEQ ID NO: 188857 - RNA, 19 nt, Human
cuccuccaccaccgccucc

SEQ ID NO: 188858 - RNA, 19 nt, Human
cuggucccgcugcaggcuc

SEQ ID NO: 188859 - RNA, 19 nt, Human
gaacauaaggcauaaacaa

SEQ ID NO: 188860 - RNA, 19 nt, Human
gacacaggaauaaaagucc

SEQ ID NO: 188861 - RNA, 23 nt, Human
gaggacgagguccacagccugcc

SEQ ID NO: 188862 - RNA, 21 nt, Human
gcauauauauaucuaugcaca

SEQ ID NO: 188863 - RNA, 20 nt, Human
ggcucccggcgcgcaccccc

SEQ ID NO: 188864 - RNA, 20 nt, Human
gggaaucugcagagcagcag

SEQ ID NO: 188865 - RNA, 19 nt, Human
guagcacgccugaugaagc

SEQ ID NO: 188866 - RNA, 19 nt, Human
guccaaggccuuugccucc

SEQ ID NO: 188867 - RNA, 25 nt, Human
gucuggccuggcccuucccuucccc

SEQ ID NO: 188868 - RNA, 21 nt, Human
uaaauucugaacaaaugaugc

SEQ ID NO: 188869 - RNA, 18 nt, Human
uacaaugaaaacauggaa

SEQ ID NO: 188870 - RNA, 18 nt, Human
uagcacgccugaugaagc

SEQ ID NO: 188871 - RNA, 25 nt, Human
uagcagaaauaaaaaguuaugacag

SEQ ID NO: 188872 - RNA, 25 nt, Human
uagcggcagcagcagcagcggucuc

SEQ ID NO: 188873 - RNA, 21 nt, Human
uauaaaauguaccuuuuauuu

SEQ ID NO: 188874 - RNA, 24 nt, Human
uauaucuaugcacaauugugcaaa

SEQ ID NO: 188875 - RNA, 22 nt, Human
uauuacacaacagcaaauagca

SEQ ID NO: 188876 - RNA, 20 nt, Human
uauuagggauguauauuagu

SEQ ID NO: 188877 - RNA, 23 nt, Human
uauuagggauguauauuaguggc

SEQ ID NO: 188878 - RNA, 19 nt, Human
ucaaaacagcaagaaaaaa

SEQ ID NO: 188879 - RNA, 22 nt, Human
ucaaaacagcaagaaaaaaucc

SEQ ID NO: 188880 - RNA, 23 nt, Human
ucacucucaguuuuugugcacuu

SEQ ID NO: 188881 - RNA, 26 nt, Human
ucagaaaauaucugaaaaauaaguuc

SEQ ID NO: 188882 - RNA, 18 nt, Human
uccaaggccuuugccucc

SEQ ID NO: 188883 - RNA, 24 nt, Human
uccacaaauaauagaagaaaucaa

SEQ ID NO: 188884 - RNA, 21 nt, Human
ucccggcgcgcacccccaaga

SEQ ID NO: 188885 - RNA, 21 nt, Human
ucccucucuuccuacuuaagg

SEQ ID NO: 188886 - RNA, 23 nt, Human
ucccucucuuccuacuuaaggca

SEQ ID NO: 188887 - RNA, 22 nt, Human
ucgccaacaauggucguccaag

SEQ ID NO: 188888 - RNA, 19 nt, Human
ucucaaagcuggcacugga

SEQ ID NO: 188889 - RNA, 21 nt, Human
ucucccggaguggugccccuc

SEQ ID NO: 188890 - RNA, 21 nt, Human
ucuuguuccggccuuuucccc

SEQ ID NO: 188891 - RNA, 19 nt, Human
ugaaaaccuugagccauag

SEQ ID NO: 188892 - RNA, 19 nt, Human
ugaaauauaaguaauacaa

SEQ ID NO: 188893 - RNA, 23 nt, Human
ugaacguguucaccaaaagucuu

SEQ ID NO: 188894 - RNA, 23 nt, Human
ugaagagagaccccuguaccgcu

SEQ ID NO: 188895 - RNA, 23 nt, Human
ugacaauaggauagaauuauuug

SEQ ID NO: 188896 - RNA, 19 nt, Human
ugacauaaagacuaauacu

SEQ ID NO: 188897 - RNA, 21 nt, Human
ugacauaaagacuaauacucu

SEQ ID NO: 188898 - RNA, 20 nt, Human
ugagaaaucagcagcuucaa

SEQ ID NO: 188899 - RNA, 22 nt, Human
ugagaagcugaucauguguuuu

SEQ ID NO: 188900 - RNA, 21 nt, Human
ugaggagucugucagcccagc

SEQ ID NO: 188901 - RNA, 19 nt, Human
ugccagccgcguucccacg

SEQ ID NO: 188902 - RNA, 22 nt, Human
ugccuccuccaccaccgccucc

SEQ ID NO: 188903 - RNA, 20 nt, Human
uggaauggauguuaaauucu

SEQ ID NO: 188904 - RNA, 25 nt, Human
uggcacaaacacaagucaaucuaca

SEQ ID NO: 188905 - RNA, 22 nt, Human
uggcccuucccuuccccgcacc

SEQ ID NO: 188906 - RNA, 18 nt, Human
uggccugaacauuuuuug

SEQ ID NO: 188907 - RNA, 20 nt, Human
ugguauaggguauguaugug

SEQ ID NO: 188908 - RNA, 20 nt, Human
ugugggcauauauauaucua

SEQ ID NO: 188909 - RNA, 19 nt, Human
uuacacaacagcaaauagc

SEQ ID NO: 188910 - RNA, 23 nt, Human
uucaaaccacuucauuaauaaca

SEQ ID NO: 188911 - RNA, 22 nt, Human
uucccacgcuggucccgcugca

SEQ ID NO: 188912 - RNA, 21 nt, Human
uuccugagucuccugaagaug

SEQ ID NO: 188913 - RNA, 21 nt, Human
uuggugguaaaaagggauugu

SEQ ID NO: 188914 - RNA, 26 nt, Human
uuuaaaccaguaauaguugcuaugag

SEQ ID NO: 188915 - RNA, 21 nt, Human
uuugcucuuauuccuguuuuc

SEQ ID NO: 188916 - RNA, 18 nt, Human
uuuguucuuuaacugaag

SEQ ID NO: 188917 - RNA, 24 nt, Human
uuuuuuuucaaagucucaugcuga

SEQ ID NO: 188918 - RNA, 23 nt, Human
aagaacugaacugcaauucacaa

SEQ ID NO: 188919 - RNA, 21 nt, Human
acagaugcuuuuuauuuugug

SEQ ID NO: 188920 - RNA, 18 nt, Human
acuucauaggaaaaaagg

SEQ ID NO: 188921 - RNA, 22 nt, Human
agagccugucacaaaauuccuc

SEQ ID NO: 188922 - RNA, 19 nt, Human
agccuagaaaguucuagca

SEQ ID NO: 188923 - RNA, 21 nt, Human
caacaaggaccuacaaaaaac

SEQ ID NO: 188924 - RNA, 23 nt, Human
cacuuuugucuaacagucuaaaa

SEQ ID NO: 188925 - RNA, 25 nt, Human
ccaaugugucaugcuaguccucucu

SEQ ID NO: 188926 - RNA, 18 nt, Human
ccucgcaccgacaacucc

SEQ ID NO: 188927 - RNA, 22 nt, Human
ccucucucauuuccaaacugga

SEQ ID NO: 188928 - RNA, 23 nt, Human
cuguuacacauaauguaacuuua

SEQ ID NO: 188929 - RNA, 20 nt, Human
gagcacuuuugucuaacagu

SEQ ID NO: 188930 - RNA, 21 nt, Human
gagccugcacccgggcucugg

SEQ ID NO: 188931 - RNA, 21 nt, Human
gcgguggcagcggcggcggug

SEQ ID NO: 188932 - RNA, 21 nt, Human
gcucuguuuccauauucugga

SEQ ID NO: 188933 - RNA, 21 nt, Human
ggaaaaaagguuacauaauau

SEQ ID NO: 188934 - RNA, 20 nt, Human
ggcagcggcggcggugagcc

SEQ ID NO: 188935 - RNA, 19 nt, Human
uaaaaacacaagaacugaa

SEQ ID NO: 188936 - RNA, 22 nt, Human
uaauacagaugcuuuuuauuuu

SEQ ID NO: 188937 - RNA, 22 nt, Human
uacaacaaggaccuacaaaaaa

SEQ ID NO: 188938 - RNA, 25 nt, Human
uacaacaaggaccuacaaaaaacuu

SEQ ID NO: 188939 - RNA, 18 nt, Human
uauucuggagcugcacgu

SEQ ID NO: 188940 - RNA, 23 nt, Human
ucaaugguggagccaauguguca

SEQ ID NO: 188941 - RNA, 22 nt, Human
ucacuauauacaguccucaaaa

SEQ ID NO: 188942 - RNA, 20 nt, Human
ucaugguugguccuccucau

SEQ ID NO: 188943 - RNA, 18 nt, Human
uccauauucuggagcugc

SEQ ID NO: 188944 - RNA, 24 nt, Human
uccauauucuggagcugcacguga

SEQ ID NO: 188945 - RNA, 19 nt, Human
ugaccaugucagacccugu

SEQ ID NO: 188946 - RNA, 23 nt, Human
ugagcacuuuugucuaacagucu

SEQ ID NO: 188947 - RNA, 21 nt, Human
uggcagcggcggcggugagcc

SEQ ID NO: 188948 - RNA, 18 nt, Human
ugguggagccaauguguc

SEQ ID NO: 188949 - RNA, 21 nt, Human
ugucaugcuaguccucucuca

SEQ ID NO: 188950 - RNA, 23 nt, Human
uguuuuuuuuuuuuuguuuuuuu

SEQ ID NO: 188951 - RNA, 22 nt, Human
uuaauacagaugcuuuuuauuu

SEQ ID NO: 188952 - RNA, 22 nt, Human
uuacacauaauguaacuuuaau

SEQ ID NO: 188953 - RNA, 21 nt, Human
uucuaaaaaaagguacuaggg

SEQ ID NO: 188954 - RNA, 22 nt, Human
uucuaaaaaaagguacuagggu

SEQ ID NO: 188955 - RNA, 19 nt, Human
uucugggggaauuguuaau

SEQ ID NO: 188956 - RNA, 23 nt, Human
uugcucuguuuccauauucugga

SEQ ID NO: 188957 - RNA, 26 nt, Human
uuguuuuuuuuuuuuuguuuuuuuuu

SEQ ID NO: 188958 - RNA, 20 nt, Human
uuuccaaacuggaucuuugg

SEQ ID NO: 188959 - RNA, 25 nt, Human
uuuugcucuguuuccauauucugga

SEQ ID NO: 188960 - RNA, 24 nt, Human
uuuuuauuuuuuucuuuuguuuuu

SEQ ID NO: 188961 - RNA, 25 nt, Human
uuuuuguuuuuuuuuuuuguuuuuu

SEQ ID NO: 188962 - RNA, 33 nt, Human
uuuuuucuuuuguuuuuuuuuuuuuguuuuuuu

SEQ ID NO: 188963 - RNA, 21 nt, Human
aaaaggccaagaguacaagca

SEQ ID NO: 188964 - RNA, 21 nt, Human
aaacaaagagauaagagaaca

SEQ ID NO: 188965 - RNA, 18 nt, Human
aacagcacagacagagac

SEQ ID NO: 188966 - RNA, 24 nt, Human
aagaaagcaggaggagccgguacc

SEQ ID NO: 188967 - RNA, 23 nt, Human
aagaguacaagcagccggggacg

SEQ ID NO: 188968 - RNA, 23 nt, Human
aagcagccggggacgccagagag

SEQ ID NO: 188969 - RNA, 21 nt, Human
aagcagccggggacgccagga

SEQ ID NO: 188970 - RNA, 22 nt, Human
acagaggccaccaggaggacgc

SEQ ID NO: 188971 - RNA, 24 nt, Human
acagcacagacagagacgaaggga

SEQ ID NO: 188972 - RNA, 18 nt, Human
acagggcuggagacagac

SEQ ID NO: 188973 - RNA, 21 nt, Human
accaucaccaaacacccaggc

SEQ ID NO: 188974 - RNA, 23 nt, Human
agaaagacagggcuggagacaga

SEQ ID NO: 188975 - RNA, 23 nt, Human
agaaaggagacacagaaaaggcc

SEQ ID NO: 188976 - RNA, 24 nt, Human
agaaaggagacacagaaaaggcca

SEQ ID NO: 188977 - RNA, 26 nt, Human
agaacaggaaagaaaacggcagaaaa

SEQ ID NO: 188978 - RNA, 21 nt, Human
agagacgaagggagggagaga

SEQ ID NO: 188979 - RNA, 24 nt, Human
agagggaaaaggugaaacaaagag

SEQ ID NO: 188980 - RNA, 20 nt, Human
agccagaaaggagacacaga

SEQ ID NO: 188981 - RNA, 21 nt, Human
aggaaagaaaacggcagaaaa

SEQ ID NO: 188982 - RNA, 21 nt, Human
aggcaagagccagaaaggaga

SEQ ID NO: 188983 - RNA, 21 nt, Human
aggccccuggccccacggccu

SEQ ID NO: 188984 - RNA, 21 nt, Human
aggcggaggcaagagccagaa

SEQ ID NO: 188985 - RNA, 20 nt, Human
augaagcagaggagaacagg

SEQ ID NO: 188986 - RNA, 24 nt, Human
auuuuuuuuccuuuuuucucuuuu

SEQ ID NO: 188987 - RNA, 22 nt, Human
caacacacucgagauuuguuuu

SEQ ID NO: 188988 - RNA, 23 nt, Human
caacagcacagacagagacgaag

SEQ ID NO: 188989 - RNA, 21 nt, Human
caagagccagaaaggagacac

SEQ ID NO: 188990 - RNA, 23 nt, Human
caagagccagaaaggagacacag

SEQ ID NO: 188991 - RNA, 23 nt, Human
cacacggcagaugggcggggcag

SEQ ID NO: 188992 - RNA, 19 nt, Human
cacagacagagacgaaggg

SEQ ID NO: 188993 - RNA, 26 nt, Human
cacagaggccaccaggaggacgcagc

SEQ ID NO: 188994 - RNA, 25 nt, Human
caccaggaggacgcagcacuuggca

SEQ ID NO: 188995 - RNA, 22 nt, Human
cacuccuagcccuggcaggccc

SEQ ID NO: 188996 - RNA, 19 nt, Human
cagaaagacagggcuggag

SEQ ID NO: 188997 - RNA, 19 nt, Human
cagaaagacagggcuggag

SEQ ID NO: 188998 - RNA, 22 nt, Human
cagaaagacagggcuggagaca

SEQ ID NO: 188999 - RNA, 18 nt, Human
cagacgggcggggcaggc

SEQ ID NO: 189000 - RNA, 20 nt, Human
cagcagugauggcugggggc

SEQ ID NO: 189001 - RNA, 21 nt, Human
cagcagugauggcugggggcu

SEQ ID NO: 189002 - RNA, 23 nt, Human
cagccaaccgcguagcccaugcu

SEQ ID NO: 189003 - RNA, 19 nt, Human
caggccccuggccccacgg

SEQ ID NO: 189004 - RNA, 18 nt, Human
cagggcagcuucagcagc

SEQ ID NO: 189005 - RNA, 20 nt, Human
ccaugcugcuacccucuccc

SEQ ID NO: 189006 - RNA, 22 nt, Human
cccacgggcaggcaagacagcu

SEQ ID NO: 189007 - RNA, 21 nt, Human
ccccucguccuccuguugcuc

SEQ ID NO: 189008 - RNA, 22 nt, Human
ccccucguccuccuguugcuca

SEQ ID NO: 189009 - RNA, 19 nt, Human
cccggccccucguccuccc

SEQ ID NO: 189010 - RNA, 18 nt, Human
ccgcguagcccaugcugc

SEQ ID NO: 189011 - RNA, 20 nt, Human
ccguguggucggcaggaggg

SEQ ID NO: 189012 - RNA, 21 nt, Human
ccugagccccugugguuuggg

SEQ ID NO: 189013 - RNA, 25 nt, Human
ccugugguuuggggccgggaggggc

SEQ ID NO: 189014 - RNA, 22 nt, Human
ccuuggguguggcccuggcccc

SEQ ID NO: 189015 - RNA, 20 nt, Human
cggcagaaaagugacacugg

SEQ ID NO: 189016 - RNA, 27 nt, Human
cggcagaaaagugacacuggugggacc

SEQ ID NO: 189017 - RNA, 19 nt, Human
cggggcaggcgggcaggcu

SEQ ID NO: 189018 - RNA, 24 nt, Human
cguagcccaugcugcuacccucuc

SEQ ID NO: 189019 - RNA, 23 nt, Human
cgucaauaaccaucaccaaacac

SEQ ID NO: 189020 - RNA, 20 nt, Human
cuccuagcccuggcaggccc

SEQ ID NO: 189021 - RNA, 18 nt, Human
cuccugcugcucagcucc

SEQ ID NO: 189022 - RNA, 23 nt, Human
cucuuuugcaacauguaagguuu

SEQ ID NO: 189023 - RNA, 21 nt, Human
cuggggaaggguggcagggag

SEQ ID NO: 189024 - RNA, 19 nt, Human
gaaagcaggaggagcugag

SEQ ID NO: 189025 - RNA, 21 nt, Human
gacgcagcacuuggcaacaca

SEQ ID NO: 189026 - RNA, 21 nt, Human
gagaacaggaaagaaaacggc

SEQ ID NO: 189027 - RNA, 19 nt, Human
gaggacaaagaggaugaga

SEQ ID NO: 189028 - RNA, 25 nt, Human
gaggcaagagccagaaaggagacac

SEQ ID NO: 189029 - RNA, 18 nt, Human
gcagcuucagcagcaggg

SEQ ID NO: 189030 - RNA, 23 nt, Human
gcaggcugcgggccacagggaca

SEQ ID NO: 189031 - RNA, 20 nt, Human
gccccggccccucguccucc

SEQ ID NO: 189032 - RNA, 18 nt, Human
ggagacacagaaaaggcc

SEQ ID NO: 189033 - RNA, 21 nt, Human
ggcacugaacuccgugugguc

SEQ ID NO: 189034 - RNA, 21 nt, Human
ggcggggcaggcgggcaagac

SEQ ID NO: 189035 - RNA, 22 nt, Human
gggaaggguggcagggagaggg

SEQ ID NO: 189036 - RNA, 20 nt, Human
gggcagcuucagcagcaggg

SEQ ID NO: 189037 - RNA, 21 nt, Human
gggcagcuucagcagcagggg

SEQ ID NO: 189038 - RNA, 19 nt, Human
ggggaaggguggcagggag

SEQ ID NO: 189039 - RNA, 18 nt, Human
ggggacgccagagaggga

SEQ ID NO: 189040 - RNA, 22 nt, Human
guggcccuggcccgacgcaccu

SEQ ID NO: 189041 - RNA, 22 nt, Human
guggucggcaggaggggcaggc

SEQ ID NO: 189042 - RNA, 24 nt, Human
uacaagcagccggggacgccagag

SEQ ID NO: 189043 - RNA, 23 nt, Human
uacccucucccaccuccuuguca

SEQ ID NO: 189044 - RNA, 24 nt, Human
uccuagcccuggcaggccccuggc

SEQ ID NO: 189045 - RNA, 21 nt, Human
ucucccaccuccuugucacuc

SEQ ID NO: 189046 - RNA, 21 nt, Human
ugaaacaaagagauaagagaa

SEQ ID NO: 189047 - RNA, 19 nt, Human
ugcccacgggcaggcaaga

SEQ ID NO: 189048 - RNA, 19 nt, Human
uggcaggccccuggcccca

SEQ ID NO: 189049 - RNA, 19 nt, Human
uggcagggagaggggagca

SEQ ID NO: 189050 - RNA, 20 nt, Human
uggcagggagaggggagcaa

SEQ ID NO: 189051 - RNA, 23 nt, Human
uggcagggagaggggagcaaugg

SEQ ID NO: 189052 - RNA, 22 nt, Human
uggcccgacgcaccuuccacag

SEQ ID NO: 189053 - RNA, 22 nt, Human
uggcuuuuuuguguuuugauua

SEQ ID NO: 189054 - RNA, 22 nt, Human
ugggcggggcaggcgggcaggc

SEQ ID NO: 189055 - RNA, 19 nt, Human
uggggccgggaggggcaau

SEQ ID NO: 189056 - RNA, 21 nt, Human
uguggcccuggcccgacgcac

SEQ ID NO: 189057 - RNA, 21 nt, Human
ugugguuuggggccgggaggg

SEQ ID NO: 189058 - RNA, 19 nt, Human
uuagaaauguucuugguau

SEQ ID NO: 189059 - RNA, 18 nt, Human
uuguuuucguuuuggcuu

SEQ ID NO: 189060 - RNA, 23 nt, Human
uuuuguguuuugauuuuuuuucc

SEQ ID NO: 189061 - RNA, 18 nt, Human
uuuuuuccuuuuuucucu

SEQ ID NO: 189062 - RNA, 24 nt, Human
aaaacuaucagugaaaaacaaaug

SEQ ID NO: 189063 - RNA, 23 nt, Human
aaaacuguggaaaaguuuucagc

SEQ ID NO: 189064 - RNA, 21 nt, Human
aaaccacaugaauguaaaacu

SEQ ID NO: 189065 - RNA, 22 nt, Human
aaacuaucagugaaaaacaaau

SEQ ID NO: 189066 - RNA, 24 nt, Human
aaagugcugggauuacagguguga

SEQ ID NO: 189067 - RNA, 20 nt, Human
aacauagugagaccucgucu

SEQ ID NO: 189068 - RNA, 25 nt, Human
aagagcccuauacaaucacgagggu

SEQ ID NO: 189069 - RNA, 21 nt, Human
aagccuccaacccagaacucc

SEQ ID NO: 189070 - RNA, 22 nt, Human
aagccuccaacccagaacucca

SEQ ID NO: 189071 - RNA, 19 nt, Human
aaguaacugggauuacagg

SEQ ID NO: 189072 - RNA, 25 nt, Human
aaguaacugggauuacaggcaccca

SEQ ID NO: 189073 - RNA, 18 nt, Human
aagugcugggauuacagg

SEQ ID NO: 189074 - RNA, 19 nt, Human
aagugcugggauuacaggu

SEQ ID NO: 189075 - RNA, 21 nt, Human
aauuacuuaaaaccugcagaa

SEQ ID NO: 189076 - RNA, 18 nt, Human
aauuccauaacuuaaacc

SEQ ID NO: 189077 - RNA, 20 nt, Human
acaaaugcaccccugcuccu

SEQ ID NO: 189078 - RNA, 22 nt, Human
acacaaaugcaccccugcuccu

SEQ ID NO: 189079 - RNA, 22 nt, Human
acagaggggaggaaaacagcug

SEQ ID NO: 189080 - RNA, 18 nt, Human
acagcucacugcaaccuc

SEQ ID NO: 189081 - RNA, 21 nt, Human
acaggcacccaccaucacacc

SEQ ID NO: 189082 - RNA, 20 nt, Human
acaggguuucaccacauugg

SEQ ID NO: 189083 - RNA, 24 nt, Human
acaggguuucaccacauuggccag

SEQ ID NO: 189084 - RNA, 21 nt, Human
acauuggccaggcuggucucg

SEQ ID NO: 189085 - RNA, 23 nt, Human
accacaugaauguaaaacugugg

SEQ ID NO: 189086 - RNA, 22 nt, Human
accacggccaugacucucuguc

SEQ ID NO: 189087 - RNA, 19 nt, Human
acccaggcuggaguacagu

SEQ ID NO: 189088 - RNA, 22 nt, Human
acccauccccaacccgaacaca

SEQ ID NO: 189089 - RNA, 21 nt, Human
acccccacugaacaccacaga

SEQ ID NO: 189090 - RNA, 22 nt, Human
accucgucucuacaaaaaauaa

SEQ ID NO: 189091 - RNA, 24 nt, Human
acucuaagucugaccuugcccaau

SEQ ID NO: 189092 - RNA, 23 nt, Human
agaaguucgagaccagccugggc

SEQ ID NO: 189093 - RNA, 23 nt, Human
agacagaggggcggggagcgcuc

SEQ ID NO: 189094 - RNA, 23 nt, Human
agaggggcggggagcgcucugag

SEQ ID NO: 189095 - RNA, 21 nt, Human
agaguuccugccagagaggcc

SEQ ID NO: 189096 - RNA, 24 nt, Human
agaugcacagccccaggucuccuc

SEQ ID NO: 189097 - RNA, 18 nt, Human
agcccauggcauugggaa

SEQ ID NO: 189098 - RNA, 23 nt, Human
agccugggcaacauagugagacc

SEQ ID NO: 189099 - RNA, 24 nt, Human
agccugggcaacauagugagaccu

SEQ ID NO: 189100 - RNA, 25 nt, Human
agccugggcaacauagugagaccuc

SEQ ID NO: 189101 - RNA, 22 nt, Human
aggcaagaggaagaaaggagag

SEQ ID NO: 189102 - RNA, 18 nt, Human
aggcaggaggaucgcucg

SEQ ID NO: 189103 - RNA, 21 nt, Human
aggcugaagcgggaggauugc

SEQ ID NO: 189104 - RNA, 24 nt, Human
aggcugaagcgggaggauugcuug

SEQ ID NO: 189105 - RNA, 21 nt, Human
agggaguacacagaggggagg

SEQ ID NO: 189106 - RNA, 21 nt, Human
aggucgaaacuucagugagcu

SEQ ID NO: 189107 - RNA, 24 nt, Human
aggugauccaccugccucggccuc

SEQ ID NO: 189108 - RNA, 24 nt, Human
aggugcgauggcucacguuuguaa

SEQ ID NO: 189109 - RNA, 20 nt, Human
agguggaggcaggaggaucg

SEQ ID NO: 189110 - RNA, 23 nt, Human
aguacaguggcacaaucacagcu

SEQ ID NO: 189111 - RNA, 20 nt, Human
aguuaauuacuuaaaaccug

SEQ ID NO: 189112 - RNA, 23 nt, Human
aucgugccacugcacuccagccu

SEQ ID NO: 189113 - RNA, 20 nt, Human
auggcucacguuuguaaucc

SEQ ID NO: 189114 - RNA, 24 nt, Human
augguuacuauacagaagcucuuc

SEQ ID NO: 189115 - RNA, 24 nt, Human
auuuuuguauuuuuaguagagaca

SEQ ID NO: 189116 - RNA, 24 nt, Human
caaagugcugggauuacaggugug

SEQ ID NO: 189117 - RNA, 25 nt, Human
caaaugaaacguccuaaugugcacu

SEQ ID NO: 189118 - RNA, 23 nt, Human
caacacaaaugcaccccugcucc

SEQ ID NO: 189119 - RNA, 24 nt, Human
caacauagugagaccucgucucua

SEQ ID NO: 189120 - RNA, 19 nt, Human
caaccccauguuucauucu

SEQ ID NO: 189121 - RNA, 19 nt, Human
caacccccacugaacacca

SEQ ID NO: 189122 - RNA, 23 nt, Human
caaccuccaccucccagguucaa

SEQ ID NO: 189123 - RNA, 22 nt, Human
caagcgauucuccugccucagc

SEQ ID NO: 189124 - RNA, 27 nt, Human
caagcgauucuccugccucagccuccc

SEQ ID NO: 189125 - RNA, 21 nt, Human
cacaccuggcuaauuuuugua

SEQ ID NO: 189126 - RNA, 24 nt, Human
cacauuggccaggcuggucucgaa

SEQ ID NO: 189127 - RNA, 21 nt, Human
caccacauuggccaggcuggu

SEQ ID NO: 189128 - RNA, 24 nt, Human
caccacauuggccaggcuggucuc

SEQ ID NO: 189129 - RNA, 27 nt, Human
caccacauuggccaggcuggucucgaa

SEQ ID NO: 189130 - RNA, 22 nt, Human
caccaugccuggccaagguugg

SEQ ID NO: 189131 - RNA, 18 nt, Human
cacccaccaucacaccug

SEQ ID NO: 189132 - RNA, 19 nt, Human
cacccucaccacggccaug

SEQ ID NO: 189133 - RNA, 20 nt, Human
caccgaguguggaaaagccc

SEQ ID NO: 189134 - RNA, 23 nt, Human
caccugccucggccucccaaagu

SEQ ID NO: 189135 - RNA, 25 nt, Human
cacgccccauuacccaugagagagc

SEQ ID NO: 189136 - RNA, 24 nt, Human
cacggucaaaaccaacugcgcacc

SEQ ID NO: 189137 - RNA, 24 nt, Human
cacguuuguaauccgaacacuuug

SEQ ID NO: 189138 - RNA, 21 nt, Human
cacugcaaccuccaccuccca

SEQ ID NO: 189139 - RNA, 25 nt, Human
cacugcacuccagccuaaaacagug

SEQ ID NO: 189140 - RNA, 19 nt, Human
cacugcacuccagccuaag

SEQ ID NO: 189141 - RNA, 19 nt, Human
cacugcacuccagccuaag

SEQ ID NO: 189142 - RNA, 27 nt, Human
cacugcacuccagccuaagaaauugag

SEQ ID NO: 189143 - RNA, 25 nt, Human
cacuuuggcucuggggaguuagcuc

SEQ ID NO: 189144 - RNA, 23 nt, Human
cagaagcucuucuguagaagucu

SEQ ID NO: 189145 - RNA, 22 nt, Human
cagacuagagaauguauacuga

SEQ ID NO: 189146 - RNA, 18 nt, Human
cagaugcacagccccagg

SEQ ID NO: 189147 - RNA, 23 nt, Human
cagcaaaugcaggaaaacuuucc

SEQ ID NO: 189148 - RNA, 24 nt, Human
cagcccaagccucuuccuccccag

SEQ ID NO: 189149 - RNA, 23 nt, Human
cagccucccaaguaacugggauu

SEQ ID NO: 189150 - RNA, 21 nt, Human
cagcucacugcaaccuccacc

SEQ ID NO: 189151 - RNA, 24 nt, Human
cagcuccuccuccacuccaacccc

SEQ ID NO: 189152 - RNA, 24 nt, Human
cagggacauaaaauuccauaacuu

SEQ ID NO: 189153 - RNA, 24 nt, Human
caggguuucaccacauuggccagg

SEQ ID NO: 189154 - RNA, 22 nt, Human
caggugauccaccugccucggc

SEQ ID NO: 189155 - RNA, 21 nt, Human
caguggaccacaggugagacc

SEQ ID NO: 189156 - RNA, 21 nt, Human
ccaaagugcugggauuacagg

SEQ ID NO: 189157 - RNA, 21 nt, Human
ccaaagugcugggauuacagg

SEQ ID NO: 189158 - RNA, 24 nt, Human
ccaaagugcugggauuacaggugu

SEQ ID NO: 189159 - RNA, 23 nt, Human
ccaaguaacugggauuacaggca

SEQ ID NO: 189160 - RNA, 18 nt, Human
ccacacugcccaaucccc

SEQ ID NO: 189161 - RNA, 24 nt, Human
ccaccucccagguucaagcgauuc

SEQ ID NO: 189162 - RNA, 20 nt, Human
ccacugcacuccagccuaag

SEQ ID NO: 189163 - RNA, 23 nt, Human
ccacugcacuccagccuaagaaa

SEQ ID NO: 189164 - RNA, 24 nt, Human
ccacugcacuccagccuaagaaau

SEQ ID NO: 189165 - RNA, 18 nt, Human
ccagggcuucaucauccu

SEQ ID NO: 189166 - RNA, 21 nt, Human
ccauccacuugggauucaccc

SEQ ID NO: 189167 - RNA, 22 nt, Human
cccaagccucuuccuccccagg

SEQ ID NO: 189168 - RNA, 19 nt, Human
cccaaguaacugggauuac

SEQ ID NO: 189169 - RNA, 24 nt, Human
cccaaguaacugggauuacaggca

SEQ ID NO: 189170 - RNA, 19 nt, Human
cccacugaacaccacagaa

SEQ ID NO: 189171 - RNA, 23 nt, Human
cccaggccuggcgcucagcuugc

SEQ ID NO: 189172 - RNA, 20 nt, Human
cccagggcuucaucauccuc

SEQ ID NO: 189173 - RNA, 20 nt, Human
cccagguucaagcgauucuc

SEQ ID NO: 189174 - RNA, 23 nt, Human
cccagguucaagcgauucuccug

SEQ ID NO: 189175 - RNA, 20 nt, Human
cccauccccaacccgaacac

SEQ ID NO: 189176 - RNA, 20 nt, Human
cccaugcaugcaaaaaaaca

SEQ ID NO: 189177 - RNA, 21 nt, Human
cccauguuucauucugggguc

SEQ ID NO: 189178 - RNA, 19 nt, Human
cccucaaaacuagcuccag

SEQ ID NO: 189179 - RNA, 19 nt, Human
cccuccgugccagaggaau

SEQ ID NO: 189180 - RNA, 18 nt, Human
ccgcaaaccaggcaaagc

SEQ ID NO: 189181 - RNA, 24 nt, Human
ccggaccucaggugauccaccugc

SEQ ID NO: 189182 - RNA, 19 nt, Human
ccucaaagaauucaaaccc

SEQ ID NO: 189183 - RNA, 19 nt, Human
ccuccaacccagaacucca

SEQ ID NO: 189184 - RNA, 24 nt, Human
ccucccagguucaagcgauucucc

SEQ ID NO: 189185 - RNA, 21 nt, Human
ccugcagaagcaccuaguccc

SEQ ID NO: 189186 - RNA, 18 nt, Human
ccuggcgcucagcuugca

SEQ ID NO: 189187 - RNA, 21 nt, Human
ccugggcaacauagugagacc

SEQ ID NO: 189188 - RNA, 21 nt, Human
ccuugcccaaucccgggggga

SEQ ID NO: 189189 - RNA, 23 nt, Human
cgaacacaacacaaaugcacccc

SEQ ID NO: 189190 - RNA, 18 nt, Human
cgaaugugagaaagccac

SEQ ID NO: 189191 - RNA, 24 nt, Human
cgagaccagccugggcaacauagu

SEQ ID NO: 189192 - RNA, 23 nt, Human
cgccccauuacccaugagagagc

SEQ ID NO: 189193 - RNA, 22 nt, Human
cgcucugucacccaggcuggag

SEQ ID NO: 189194 - RNA, 22 nt, Human
cggggagggacaccgggguccu

SEQ ID NO: 189195 - RNA, 19 nt, Human
cuaaacccauccccaaccc

SEQ ID NO: 189196 - RNA, 23 nt, Human
cuaauuuuuguauuuuuaguaga

SEQ ID NO: 189197 - RNA, 22 nt, Human
cuacaaaaaauaaaacauuagc

SEQ ID NO: 189198 - RNA, 20 nt, Human
cuauacagcuuccaccucga

SEQ ID NO: 189199 - RNA, 24 nt, Human
cucacguuuguaauccgaacacuu

SEQ ID NO: 189200 - RNA, 19 nt, Human
cucacucccgcgcccacug

SEQ ID NO: 189201 - RNA, 24 nt, Human
cucacugcaaccuccaccucccag

SEQ ID NO: 189202 - RNA, 22 nt, Human
cucagcucacucccgcgcccac

SEQ ID NO: 189203 - RNA, 18 nt, Human
cucaggaggcugaagcgg

SEQ ID NO: 189204 - RNA, 21 nt, Human
cuccagccuaagaaauugagc

SEQ ID NO: 189205 - RNA, 19 nt, Human
cucccgcaaaccaggcaaa

SEQ ID NO: 189206 - RNA, 23 nt, Human
cuccugccucagccucccaagua

SEQ ID NO: 189207 - RNA, 24 nt, Human
cucgcucugucacccaggcuggag

SEQ ID NO: 189208 - RNA, 25 nt, Human
cugaucuuaaacaguggucaauuua

SEQ ID NO: 189209 - RNA, 23 nt, Human
cugcaaccuccaccucccagguu

SEQ ID NO: 189210 - RNA, 24 nt, Human
cugcaaccuccaccucccagguuc

SEQ ID NO: 189211 - RNA, 21 nt, Human
cugcaugggaaaguuuguaug

SEQ ID NO: 189212 - RNA, 23 nt, Human
cugccucggccucccaaagugcu

SEQ ID NO: 189213 - RNA, 19 nt, Human
cugucacccaggcuggagu

SEQ ID NO: 189214 - RNA, 19 nt, Human
cuguggugaggaagcauga

SEQ ID NO: 189215 - RNA, 23 nt, Human
cuucacacuggggagauauccuc

SEQ ID NO: 189216 - RNA, 21 nt, Human
cuuccacuuuggcucugggga

SEQ ID NO: 189217 - RNA, 21 nt, Human
cuucggugcaggucagcucuc

SEQ ID NO: 189218 - RNA, 23 nt, Human
cuuucuagagcuagaaccuucuc

SEQ ID NO: 189219 - RNA, 24 nt, Human
gaagcgggaggauugcuugagccc

SEQ ID NO: 189220 - RNA, 25 nt, Human
gaccgaaugugagaaagccacagga

SEQ ID NO: 189221 - RNA, 23 nt, Human
gaccucaggugauccaccugccu

SEQ ID NO: 189222 - RNA, 24 nt, Human
gaccucaggugauccaccugccuc

SEQ ID NO: 189223 - RNA, 20 nt, Human
gagaagcugcaugggaaagu

SEQ ID NO: 189224 - RNA, 22 nt, Human
gaguucacaguggagaaaacca

SEQ ID NO: 189225 - RNA, 21 nt, Human
gaucgugccacugcacuccag

SEQ ID NO: 189226 - RNA, 18 nt, Human
gauuacaggugugagcca

SEQ ID NO: 189227 - RNA, 21 nt, Human
gauuacaggugugagccacca

SEQ ID NO: 189228 - RNA, 24 nt, Human
gauuacaggugugagccaccaugc

SEQ ID NO: 189229 - RNA, 21 nt, Human
gauucuccugccucagccucc

SEQ ID NO: 189230 - RNA, 19 nt, Human
gauucugaaucacagaguu

SEQ ID NO: 189231 - RNA, 22 nt, Human
gcaaccuccaccucccagguuc

SEQ ID NO: 189232 - RNA, 19 nt, Human
gccagagaggcccacaggc

SEQ ID NO: 189233 - RNA, 19 nt, Human
gccccaggucuccucuugc

SEQ ID NO: 189234 - RNA, 24 nt, Human
gcgauucuccugccucagccuccc

SEQ ID NO: 189235 - RNA, 19 nt, Human
gcgcgggcucggggcgcgg

SEQ ID NO: 189236 - RNA, 21 nt, Human
gcgcggggagggacaccgggg

SEQ ID NO: 189237 - RNA, 23 nt, Human
gcgcggggagggacaccgggguc

SEQ ID NO: 189238 - RNA, 19 nt, Human
gcuaggugcgauggcucac

SEQ ID NO: 189239 - RNA, 21 nt, Human
gcuccuccuccacuccaaccc

SEQ ID NO: 189240 - RNA, 25 nt, Human
gcucugucacccaggcuggaguaca

SEQ ID NO: 189241 - RNA, 19 nt, Human
gcuggaguacaguggcaca

SEQ ID NO: 189242 - RNA, 18 nt, Human
ggaaaacuuucccuugga

SEQ ID NO: 189243 - RNA, 18 nt, Human
ggaaggagagcgcgggcu

SEQ ID NO: 189244 - RNA, 24 nt, Human
ggaccucaggugauccaccugccu

SEQ ID NO: 189245 - RNA, 18 nt, Human
ggagacagaggggcgggg

SEQ ID NO: 189246 - RNA, 24 nt, Human
ggauuacaggugugagccaccaug

SEQ ID NO: 189247 - RNA, 25 nt, Human
ggcggggagcgcucugagggcgggg

SEQ ID NO: 189248 - RNA, 24 nt, Human
gggcgcggggagggacaccggggu

SEQ ID NO: 189249 - RNA, 23 nt, Human
ggggagacagaggggcggggagc

SEQ ID NO: 189250 - RNA, 21 nt, Human
ggggagcgcucugagggcggg

SEQ ID NO: 189251 - RNA, 22 nt, Human
ggggaugggggaaagcccaugg

SEQ ID NO: 189252 - RNA, 28 nt, Human
ggggugauuuaagggaguacacagaggg

SEQ ID NO: 189253 - RNA, 18 nt, Human
ggguccuggggagaaggc

SEQ ID NO: 189254 - RNA, 24 nt, Human
gucaacccccacugaacaccacag

SEQ ID NO: 189255 - RNA, 24 nt, Human
gugauccaccugccucggccuccc

SEQ ID NO: 189256 - RNA, 18 nt, Human
gugcaugcuguggagaua

SEQ ID NO: 189257 - RNA, 19 nt, Human
gugcaugcuguggagauac

SEQ ID NO: 189258 - RNA, 23 nt, Human
guggcacaaucacagcucacugc

SEQ ID NO: 189259 - RNA, 18 nt, Human
uaaaaccugcagaagcac

SEQ ID NO: 189260 - RNA, 21 nt, Human
uaaauaugacaacaucuucag

SEQ ID NO: 189261 - RNA, 19 nt, Human
uaagagaaaccacacugga

SEQ ID NO: 189262 - RNA, 21 nt, Human
uaagagaaaccacacuggaag

SEQ ID NO: 189263 - RNA, 24 nt, Human
uaauuuuuguauuuuuaguagaga

SEQ ID NO: 189264 - RNA, 23 nt, Human
uacagcuuccaccucgaggcaag

SEQ ID NO: 189265 - RNA, 22 nt, Human
uacaggugugagccaccaugcc

SEQ ID NO: 189266 - RNA, 23 nt, Human
uacaggugugagccaccaugccu

SEQ ID NO: 189267 - RNA, 21 nt, Human
uagaagaaaacccacaaaacu

SEQ ID NO: 189268 - RNA, 18 nt, Human
uagcuccagacaucacag

SEQ ID NO: 189269 - RNA, 19 nt, Human
uaguagagacaggguuuca

SEQ ID NO: 189270 - RNA, 23 nt, Human
ucaaaaccaacugcgcaccagag

SEQ ID NO: 189271 - RNA, 19 nt, Human
ucaacacaguggaccacag

SEQ ID NO: 189272 - RNA, 24 nt, Human
ucacugcaaccuccaccucccagg

SEQ ID NO: 189273 - RNA, 25 nt, Human
ucacugcaaccuccaccucccaggu

SEQ ID NO: 189274 - RNA, 27 nt, Human
ucacugcaaccuccaccucccagguuc

SEQ ID NO: 189275 - RNA, 18 nt, Human
ucacugcucccaaccugg

SEQ ID NO: 189276 - RNA, 18 nt, Human
ucagcucacucccgcgcc

SEQ ID NO: 189277 - RNA, 21 nt, Human
ucaggugauccaccugccucg

SEQ ID NO: 189278 - RNA, 23 nt, Human
uccaaauaaauuggaccucaaag

SEQ ID NO: 189279 - RNA, 19 nt, Human
uccacacauagaagaaaac

SEQ ID NO: 189280 - RNA, 25 nt, Human
uccacacauagaagaaaacccacaa

SEQ ID NO: 189281 - RNA, 18 nt, Human
uccacuuuggcucugggg

SEQ ID NO: 189282 - RNA, 24 nt, Human
uccauacccguccugagccaucca

SEQ ID NO: 189283 - RNA, 23 nt, Human
ucccaaagugcugggauuacagg

SEQ ID NO: 189284 - RNA, 23 nt, Human
ucccaaccuggagcuccuaaacc

SEQ ID NO: 189285 - RNA, 24 nt, Human
ucccaaguaacugggauuacaggc

SEQ ID NO: 189286 - RNA, 20 nt, Human
ucccagagaggaacacugca

SEQ ID NO: 189287 - RNA, 21 nt, Human
ucccagguucaagcgauucuc

SEQ ID NO: 189288 - RNA, 24 nt, Human
ucccagguucaagcgauucuccug

SEQ ID NO: 189289 - RNA, 23 nt, Human
uccccaggccuggcgcucagcuu

SEQ ID NO: 189290 - RNA, 24 nt, Human
ucccggggggaugggggaaagccc

SEQ ID NO: 189291 - RNA, 21 nt, Human
uccuaaacccauccccaaccc

SEQ ID NO: 189292 - RNA, 20 nt, Human
uccucuugcugagacagcuc

SEQ ID NO: 189293 - RNA, 18 nt, Human
ucggccucccaaagugcu

SEQ ID NO: 189294 - RNA, 21 nt, Human
ucucacaucacuaacauuaca

SEQ ID NO: 189295 - RNA, 21 nt, Human
ucucccgcaaaccaggcaaag

SEQ ID NO: 189296 - RNA, 19 nt, Human
ucucgcucugucacccagg

SEQ ID NO: 189297 - RNA, 23 nt, Human
ucucgcucugucacccaggcugg

SEQ ID NO: 189298 - RNA, 24 nt, Human
ucucgcucugucacccaggcugga

SEQ ID NO: 189299 - RNA, 25 nt, Human
ucucgcucugucacccaggcuggag

SEQ ID NO: 189300 - RNA, 26 nt, Human
ucucgcucugucacccaggcuggagu

SEQ ID NO: 189301 - RNA, 18 nt, Human
ucugucacccaggcugga

SEQ ID NO: 189302 - RNA, 24 nt, Human
ucugucacccaggcuggaguacag

SEQ ID NO: 189303 - RNA, 25 nt, Human
ucugucacugcucccaaccuggagc

SEQ ID NO: 189304 - RNA, 23 nt, Human
ucuguggugaggaagcaugaagc

SEQ ID NO: 189305 - RNA, 22 nt, Human
ugaaaaacaaaugugcgugcaa

SEQ ID NO: 189306 - RNA, 18 nt, Human
ugaaacguccuaaugugc

SEQ ID NO: 189307 - RNA, 20 nt, Human
ugacaacaucuucaguaacu

SEQ ID NO: 189308 - RNA, 20 nt, Human
ugacugaggggaggaaaucu

SEQ ID NO: 189309 - RNA, 22 nt, Human
ugagcaagacccuaucucgaaa

SEQ ID NO: 189310 - RNA, 19 nt, Human
ugaggggaggaaaucuccc

SEQ ID NO: 189311 - RNA, 20 nt, Human
ugaggggaggaaaucucccg

SEQ ID NO: 189312 - RNA, 19 nt, Human
ugagugccuccauccagau

SEQ ID NO: 189313 - RNA, 23 nt, Human
ugaucaaagaggcuaggugcgau

SEQ ID NO: 189314 - RNA, 21 nt, Human
ugcaaucaguguagaaaugcc

SEQ ID NO: 189315 - RNA, 21 nt, Human
ugccagaggaauccuacccag

SEQ ID NO: 189316 - RNA, 24 nt, Human
ugccucagccucccaaguaacugg

SEQ ID NO: 189317 - RNA, 21 nt, Human
ugccucggccucccaaagugc

SEQ ID NO: 189318 - RNA, 24 nt, Human
ugccucggccucccaaagugcugg

SEQ ID NO: 189319 - RNA, 18 nt, Human
ugccuggccaagguuggg

SEQ ID NO: 189320 - RNA, 19 nt, Human
ugccuggccaagguugggg

SEQ ID NO: 189321 - RNA, 19 nt, Human
ugcgggaagccaggacucu

SEQ ID NO: 189322 - RNA, 24 nt, Human
ugcugggauuacaggugugagcca

SEQ ID NO: 189323 - RNA, 20 nt, Human
uggaauaaauaauucuggaa

SEQ ID NO: 189324 - RNA, 21 nt, Human
uggaauaaauaauucuggaaa

SEQ ID NO: 189325 - RNA, 20 nt, Human
uggaauaagccuccaaccca

SEQ ID NO: 189326 - RNA, 19 nt, Human
uggaguacaguggcacaau

SEQ ID NO: 189327 - RNA, 21 nt, Human
uggcaagaaaacacgccccau

SEQ ID NO: 189328 - RNA, 20 nt, Human
uggcacaaucacagcucacu

SEQ ID NO: 189329 - RNA, 24 nt, Human
uggcacaaucacagcucacugcaa

SEQ ID NO: 189330 - RNA, 28 nt, Human
uggcacaaucacagcucacugcaaccuc

SEQ ID NO: 189331 - RNA, 19 nt, Human
uggcagagugugaaagucg

SEQ ID NO: 189332 - RNA, 23 nt, Human
uggccaggcuggucucgaacucc

SEQ ID NO: 189333 - RNA, 19 nt, Human
uggcucacguuuguaaucc

SEQ ID NO: 189334 - RNA, 20 nt, Human
uggcucacguuuguaauccg

SEQ ID NO: 189335 - RNA, 19 nt, Human
ugggagguggaggcaggag

SEQ ID NO: 189336 - RNA, 23 nt, Human
ugggagguggaggcaggaggauc

SEQ ID NO: 189337 - RNA, 19 nt, Human
ugggauuacaggcacccac

SEQ ID NO: 189338 - RNA, 21 nt, Human
ugggauuacaggcacccacca

SEQ ID NO: 189339 - RNA, 22 nt, Human
ugggauuacaggcacccaccau

SEQ ID NO: 189340 - RNA, 18 nt, Human
ugggauuacaggugugag

SEQ ID NO: 189341 - RNA, 22 nt, Human
ugggauuacaggugugagccac

SEQ ID NO: 189342 - RNA, 23 nt, Human
ugggauuacaggugugagccacc

SEQ ID NO: 189343 - RNA, 24 nt, Human
ugggauuacaggugugagccacca

SEQ ID NO: 189344 - RNA, 25 nt, Human
ugggauuacaggugugagccaccau

SEQ ID NO: 189345 - RNA, 20 nt, Human
ugggccucgcggugcaucag

SEQ ID NO: 189346 - RNA, 21 nt, Human
uggggagaaggcgcucggggc

SEQ ID NO: 189347 - RNA, 23 nt, Human
ugggggaaagcccauggcauugg

SEQ ID NO: 189348 - RNA, 20 nt, Human
uggguauggucgugcgcacc

SEQ ID NO: 189349 - RNA, 24 nt, Human
uguaaacauggaauaagccuccaa

SEQ ID NO: 189350 - RNA, 20 nt, Human
uguaauccgaacacuuuggg

SEQ ID NO: 189351 - RNA, 22 nt, Human
uguauguuggauaaaguguggu

SEQ ID NO: 189352 - RNA, 21 nt, Human
uguggaaaagcccucuugugg

SEQ ID NO: 189353 - RNA, 18 nt, Human
uguggugaggaagcauga

SEQ ID NO: 189354 - RNA, 20 nt, Human
uguggugaggaagcaugaag

SEQ ID NO: 189355 - RNA, 22 nt, Human
uguggugaggaagcaugaagcu

SEQ ID NO: 189356 - RNA, 20 nt, Human
uuagcuggguauggucgugc

SEQ ID NO: 189357 - RNA, 20 nt, Human
uuagcuggguauggucgugc

SEQ ID NO: 189358 - RNA, 18 nt, Human
uuaguagagacaggguuu

SEQ ID NO: 189359 - RNA, 21 nt, Human
uucaagcgauucuccugccuc

SEQ ID NO: 189360 - RNA, 23 nt, Human
uucaagcgauucuccugccucag

SEQ ID NO: 189361 - RNA, 24 nt, Human
uucaagcgauucuccugccucagc

SEQ ID NO: 189362 - RNA, 21 nt, Human
uucacccucaccacggccaug

SEQ ID NO: 189363 - RNA, 20 nt, Human
uucauucuggggucuacacg

SEQ ID NO: 189364 - RNA, 19 nt, Human
uuccacacugcccaauccc

SEQ ID NO: 189365 - RNA, 19 nt, Human
uuccauacccguccugagc

SEQ ID NO: 189366 - RNA, 22 nt, Human
uuccugccagagaggcccacag

SEQ ID NO: 189367 - RNA, 18 nt, Human
uugagcaagacccuaucu

SEQ ID NO: 189368 - RNA, 20 nt, Human
uuuguuuuuuugagacagag

SEQ ID NO: 189369 - RNA, 24 nt, Human
uuuuuaguagagacaggguuucac

SEQ ID NO: 189370 - RNA, 20 nt, Human
uuuuuguauuuuuaguagag

SEQ ID NO: 189371 - RNA, 23 nt, Human
aaaaaaaaaaacaugaugugcag

SEQ ID NO: 189372 - RNA, 18 nt, Human
aaaauauucauauacccu

SEQ ID NO: 189373 - RNA, 22 nt, Human
aaaauuucaaaaccuugcaacc

SEQ ID NO: 189374 - RNA, 23 nt, Human
aaaauuuuuccaaauauuccacu

SEQ ID NO: 189375 - RNA, 21 nt, Human
aaacaaggcauucgaaaacaa

SEQ ID NO: 189376 - RNA, 23 nt, Human
aaagagccggggcgggacuugag

SEQ ID NO: 189377 - RNA, 19 nt, Human
aacauggugaaacccaauc

SEQ ID NO: 189378 - RNA, 20 nt, Human
aacauggugaaacccaaucu

SEQ ID NO: 189379 - RNA, 21 nt, Human
aacauggugaaacccaaucuc

SEQ ID NO: 189380 - RNA, 18 nt, Human
aagacaggucagccccaa

SEQ ID NO: 189381 - RNA, 23 nt, Human
aagugcaaagguccucacaaacu

SEQ ID NO: 189382 - RNA, 19 nt, Human
acaauaucacagaauugaa

SEQ ID NO: 189383 - RNA, 24 nt, Human
acauaagcagcaagauuaacgaaa

SEQ ID NO: 189384 - RNA, 18 nt, Human
accuggguguugggaauu

SEQ ID NO: 189385 - RNA, 20 nt, Human
agaaaauuucaaaaccuugc

SEQ ID NO: 189386 - RNA, 19 nt, Human
agccaauaccuuccuuuua

SEQ ID NO: 189387 - RNA, 21 nt, Human
agccaauaccuuccuuuuaug

SEQ ID NO: 189388 - RNA, 19 nt, Human
agggggcaugaacaaaacc

SEQ ID NO: 189389 - RNA, 18 nt, Human
agugacuuauuaagccca

SEQ ID NO: 189390 - RNA, 25 nt, Human
auacaugcuuuuuuuccuaaagucc

SEQ ID NO: 189391 - RNA, 21 nt, Human
auccuggccaacauggugaaa

SEQ ID NO: 189392 - RNA, 21 nt, Human
augaacaaaaccucaagacau

SEQ ID NO: 189393 - RNA, 19 nt, Human
augccuguaaucccagcac

SEQ ID NO: 189394 - RNA, 24 nt, Human
caacauggugaaacccaaucucua

SEQ ID NO: 189395 - RNA, 24 nt, Human
cacaaacuguacagaaaauuucaa

SEQ ID NO: 189396 - RNA, 21 nt, Human
cacaauugcagccaaguuggc

SEQ ID NO: 189397 - RNA, 24 nt, Human
cacuuuuggagaccaagccaggag

SEQ ID NO: 189398 - RNA, 18 nt, Human
caggucagccccaaaacg

SEQ ID NO: 189399 - RNA, 25 nt, Human
caugccuguaaucccagcacuuuug

SEQ ID NO: 189400 - RNA, 21 nt, Human
cccaaaacgguccuguggcuc

SEQ ID NO: 189401 - RNA, 20 nt, Human
cccgaggucaagagauggag

SEQ ID NO: 189402 - RNA, 21 nt, Human
ccgggaaagcccaggggcucc

SEQ ID NO: 189403 - RNA, 21 nt, Human
ccuccggugaugggaagcggg

SEQ ID NO: 189404 - RNA, 19 nt, Human
ccugcaggcacggaggggg

SEQ ID NO: 189405 - RNA, 22 nt, Human
ccuggccaacauggugaaaccc

SEQ ID NO: 189406 - RNA, 22 nt, Human
ccuggccaacauggugaaaccc

SEQ ID NO: 189407 - RNA, 23 nt, Human
ccuggccaacauggugaaaccca

SEQ ID NO: 189408 - RNA, 22 nt, Human
cgaaaacaaacagugaaccgag

SEQ ID NO: 189409 - RNA, 18 nt, Human
cucaagacaugaaaaauc

SEQ ID NO: 189410 - RNA, 19 nt, Human
cucaagacaugaaaaaucc

SEQ ID NO: 189411 - RNA, 24 nt, Human
cucaugccuguaaucccagcacuu

SEQ ID NO: 189412 - RNA, 19 nt, Human
cuccggcugcugcgguggc

SEQ ID NO: 189413 - RNA, 20 nt, Human
cugagggucuuccuccucca

SEQ ID NO: 189414 - RNA, 22 nt, Human
cugcgguggcggcggcggcgcu

SEQ ID NO: 189415 - RNA, 21 nt, Human
gaaaacaaggcauucgaaaac

SEQ ID NO: 189416 - RNA, 25 nt, Human
gaaaacaaggcauucgaaaacaaac

SEQ ID NO: 189417 - RNA, 24 nt, Human
gccaacauggugaaacccaaucuc

SEQ ID NO: 189418 - RNA, 21 nt, Human
gcuccugcaggcacggagggu

SEQ ID NO: 189419 - RNA, 20 nt, Human
gcugcgguggcggcggcggc

SEQ ID NO: 189420 - RNA, 22 nt, Human
gcuggauauggugacucaugcc

SEQ ID NO: 189421 - RNA, 24 nt, Human
ggagaccauccuggccaacauggu

SEQ ID NO: 189422 - RNA, 24 nt, Human
ggauauggugacucaugccuguaa

SEQ ID NO: 189423 - RNA, 23 nt, Human
ggcugcugcgguggcggcggcgg

SEQ ID NO: 189424 - RNA, 21 nt, Human
ggcuggauauggugacucaug

SEQ ID NO: 189425 - RNA, 22 nt, Human
ggcuggauauggugacucaugc

SEQ ID NO: 189426 - RNA, 18 nt, Human
gggaagcuccuccgguga

SEQ ID NO: 189427 - RNA, 22 nt, Human
gggcucgccgagguccgggccc

SEQ ID NO: 189428 - RNA, 22 nt, Human
gggugggggaauccggggaggg

SEQ ID NO: 189429 - RNA, 24 nt, Human
ggugacucaugccuguaaucccag

SEQ ID NO: 189430 - RNA, 25 nt, Human
guggcggcggcggcgcugacgacgc

SEQ ID NO: 189431 - RNA, 21 nt, Human
guggggcauacuuucucagca

SEQ ID NO: 189432 - RNA, 22 nt, Human
uacaaacaguaaaaaacauaca

SEQ ID NO: 189433 - RNA, 18 nt, Human
uaccaaagauaggugggg

SEQ ID NO: 189434 - RNA, 19 nt, Human
uaccuggguguugggaauu

SEQ ID NO: 189435 - RNA, 20 nt, Human
uacgacaucagauggcaaag

SEQ ID NO: 189436 - RNA, 23 nt, Human
uacuggcaugcauuccaaagauc

SEQ ID NO: 189437 - RNA, 26 nt, Human
uagggaagguccacaauugcagccaa

SEQ ID NO: 189438 - RNA, 22 nt, Human
uauuccaccgucugagagaaua

SEQ ID NO: 189439 - RNA, 19 nt, Human
ucaagagauggagaccauc

SEQ ID NO: 189440 - RNA, 20 nt, Human
ucacacugaucagucaaagg

SEQ ID NO: 189441 - RNA, 22 nt, Human
ucagccaaguguuugccccaua

SEQ ID NO: 189442 - RNA, 23 nt, Human
ucagugguccauucuaaagagcc

SEQ ID NO: 189443 - RNA, 22 nt, Human
ucaugccuguaaucccagcacu

SEQ ID NO: 189444 - RNA, 18 nt, Human
uccucacaaacuguacag

SEQ ID NO: 189445 - RNA, 23 nt, Human
uccuccaugguuccauggaaugg

SEQ ID NO: 189446 - RNA, 22 nt, Human
uccucuaacacuggucucccgg

SEQ ID NO: 189447 - RNA, 19 nt, Human
uccuguggcucucaguggu

SEQ ID NO: 189448 - RNA, 23 nt, Human
ucucuacuaaaaauacaaaaauu

SEQ ID NO: 189449 - RNA, 20 nt, Human
ugaaaacaaggcauucgaaa

SEQ ID NO: 189450 - RNA, 23 nt, Human
ugaaaacaaggcauucgaaaaca

SEQ ID NO: 189451 - RNA, 21 nt, Human
ugaacaaaaccucaagacaug

SEQ ID NO: 189452 - RNA, 21 nt, Human
ugacucaugccuguaauccca

SEQ ID NO: 189453 - RNA, 24 nt, Human
ugacucaugccuguaaucccagca

SEQ ID NO: 189454 - RNA, 19 nt, Human
ugaguuucaacacucccuu

SEQ ID NO: 189455 - RNA, 21 nt, Human
ugcaaagguccucacaaacug

SEQ ID NO: 189456 - RNA, 18 nt, Human
ugccuggagucagccagg

SEQ ID NO: 189457 - RNA, 23 nt, Human
ugccuguaaucccagcacuuuug

SEQ ID NO: 189458 - RNA, 18 nt, Human
ugcgguggcggcggcggc

SEQ ID NO: 189459 - RNA, 25 nt, Human
ugcugcgguggcggcggcggcgcug

SEQ ID NO: 189460 - RNA, 19 nt, Human
uggaaagagggaauuuuuc

SEQ ID NO: 189461 - RNA, 22 nt, Human
uggaaagagggaauuuuucagc

SEQ ID NO: 189462 - RNA, 18 nt, Human
uggagggaacgguggugg

SEQ ID NO: 189463 - RNA, 19 nt, Human
uggcagugcugaugucagu

SEQ ID NO: 189464 - RNA, 23 nt, Human
uggcagugcugaugucagugacu

SEQ ID NO: 189465 - RNA, 24 nt, Human
uggccaacauggugaaacccaauc

SEQ ID NO: 189466 - RNA, 22 nt, Human
ugggaagcggguaggaccaaag

SEQ ID NO: 189467 - RNA, 23 nt, Human
ugggcucgccgagguccgggccc

SEQ ID NO: 189468 - RNA, 25 nt, Human
ugguagggaagguccacaauugcag

SEQ ID NO: 189469 - RNA, 24 nt, Human
uggugacucaugccuguaauccca

SEQ ID NO: 189470 - RNA, 19 nt, Human
uggugggcucgccgagguc

SEQ ID NO: 189471 - RNA, 24 nt, Human
ugucagugacuuauuaagcccaga

SEQ ID NO: 189472 - RNA, 21 nt, Human
uguuuuagucugccaagauug

SEQ ID NO: 189473 - RNA, 18 nt, Human
uuaaaauuuuaauuguuu

SEQ ID NO: 189474 - RNA, 25 nt, Human
uuauacagucauguacagauguacu

SEQ ID NO: 189475 - RNA, 23 nt, Human
uucaaaaccuugcaaccuagaag

SEQ ID NO: 189476 - RNA, 20 nt, Human
uucagccaaguguuugcccc

SEQ ID NO: 189477 - RNA, 24 nt, Human
uuggcuggauauggugacucaugc

SEQ ID NO: 189478 - RNA, 23 nt, Human
uugucuuaaaaaaaaaaaacaug

SEQ ID NO: 189479 - RNA, 25 nt, Human
uuuaaaauuuuuccaaauauuccuu

SEQ ID NO: 189480 - RNA, 19 nt, Human
uuuagaaaaccuggguuca

SEQ ID NO: 189481 - RNA, 23 nt, Human
uuuagaaaaccuggguucagcca

SEQ ID NO: 189482 - RNA, 21 nt, Human
uuucaaaaccuugcaaccuag

SEQ ID NO: 189483 - RNA, 23 nt, Human
uuuggucuuuaaacaucuuuuuu

SEQ ID NO: 189484 - RNA, 25 nt, Human
aaacauuccuuuauuauuagaaaua

SEQ ID NO: 189485 - RNA, 24 nt, Human
cacaaucacagaaaaauacaagaa

SEQ ID NO: 189486 - RNA, 22 nt, Human
cucacaaucacagaaaaauaca

SEQ ID NO: 189487 - RNA, 23 nt, Human
cucgaguuuuuuuuuuuuuuuuu

SEQ ID NO: 189488 - RNA, 20 nt, Human
gaguuuuuuuuuuuuuuuuu

SEQ ID NO: 189489 - RNA, 21 nt, Human
guuuuuuuuuuuuuuuuuugg

SEQ ID NO: 189490 - RNA, 24 nt, Human
uaacugcucaugaauaagcaauac

SEQ ID NO: 189491 - RNA, 18 nt, Human
uacaagaauaacaucaga

SEQ ID NO: 189492 - RNA, 25 nt, Human
ucacaaucacagaaaaauacaagaa

SEQ ID NO: 189493 - RNA, 18 nt, Human
ucuacggagaucuccagg

SEQ ID NO: 189494 - RNA, 23 nt, Human
ugaauaagcaauacuuuagcuug

SEQ ID NO: 189495 - RNA, 19 nt, Human
ugugggacaggaacgggag

SEQ ID NO: 189496 - RNA, 20 nt, Human
uuagcuugacacucauuggu

SEQ ID NO: 189497 - RNA, 21 nt, Human
uugcauuuauuuuuagcacaa

SEQ ID NO: 189498 - RNA, 22 nt, Human
aaaagcaccuggccacaggguc

SEQ ID NO: 189499 - RNA, 20 nt, Human
aaccggguagcgcucagacu

SEQ ID NO: 189500 - RNA, 21 nt, Human
acgcacacgcgcacacacaca

SEQ ID NO: 189501 - RNA, 19 nt, Human
cacacaaacaccccugugg

SEQ ID NO: 189502 - RNA, 23 nt, Human
cacacgcgcacacacacaaacac

SEQ ID NO: 189503 - RNA, 19 nt, Human
cacccuccgaguggggucc

SEQ ID NO: 189504 - RNA, 23 nt, Human
cagaaugggguccagggagaauu

SEQ ID NO: 189505 - RNA, 18 nt, Human
cagcaaccggguagcgcu

SEQ ID NO: 189506 - RNA, 18 nt, Human
ccacugaaacggggaggg

SEQ ID NO: 189507 - RNA, 20 nt, Human
ccgaguggggucccgagggc

SEQ ID NO: 189508 - RNA, 18 nt, Human
cgcacacacacaaacacc

SEQ ID NO: 189509 - RNA, 19 nt, Human
cgcacacgcgcacacacac

SEQ ID NO: 189510 - RNA, 21 nt, Human
cgcgcacacacacaaacaccc

SEQ ID NO: 189511 - RNA, 20 nt, Human
cuugggcagcagcaaccggg

SEQ ID NO: 189512 - RNA, 21 nt, Human
gagaauuugguuagggggagg

SEQ ID NO: 189513 - RNA, 21 nt, Human
gagcagagggcacccuccgag

SEQ ID NO: 189514 - RNA, 18 nt, Human
gcagcaaccggguagcgc

SEQ ID NO: 189515 - RNA, 19 nt, Human
ggaggccugagcagagggc

SEQ ID NO: 189516 - RNA, 23 nt, Human
ggcugcagagucuucaguacugu

SEQ ID NO: 189517 - RNA, 24 nt, Human
gggcacccuccgaguggggucccg

SEQ ID NO: 189518 - RNA, 18 nt, Human
gggcagcagcaaccgggu

SEQ ID NO: 189519 - RNA, 21 nt, Human
uagggaaaagcaccuggccac

SEQ ID NO: 189520 - RNA, 20 nt, Human
ucugccugcguccgacuccg

SEQ ID NO: 189521 - RNA, 23 nt, Human
ugagcagagggcacccuccgagu

SEQ ID NO: 189522 - RNA, 18 nt, Human
ugcagagucuucaguacu

SEQ ID NO: 189523 - RNA, 23 nt, Human
uggccacaggguccacugaaacg

SEQ ID NO: 189524 - RNA, 26 nt, Human
uuuauugaaacgcacacgcgcacaca

SEQ ID NO: 189525 - RNA, 22 nt, Human
uuugccacaacccccuucugac

SEQ ID NO: 189526 - RNA, 18 nt, Human
uuuuuuuuuuuuuuuuug

SEQ ID NO: 189527 - RNA, 23 nt, Human
aaaaaagcauuaauuggaagacu

SEQ ID NO: 189528 - RNA, 19 nt, Human
aaacaaguuuaaaccagaa

SEQ ID NO: 189529 - RNA, 23 nt, Human
accaacagguagccuagauauaa

SEQ ID NO: 189530 - RNA, 23 nt, Human
caaggaaaucuuguugaugaucc

SEQ ID NO: 189531 - RNA, 22 nt, Human
cacagcaaacaaguuuaaacca

SEQ ID NO: 189532 - RNA, 20 nt, Human
uauuuugcacaaggaaaucu

SEQ ID NO: 189533 - RNA, 25 nt, Human
ugaaugguaacagcucggggccuuu

SEQ ID NO: 189534 - RNA, 20 nt, Human
ugcagaacucagucucuuag

SEQ ID NO: 189535 - RNA, 22 nt, Human
uggagcgcgccggagaggcugg

SEQ ID NO: 189536 - RNA, 22 nt, Human
uuaaaccagaagaugcugcuug

SEQ ID NO: 189537 - RNA, 26 nt, Human
aaaaccacaaacauaaacugguccug

SEQ ID NO: 189538 - RNA, 26 nt, Human
aaaauacccccaacucaaccccaccc

SEQ ID NO: 189539 - RNA, 19 nt, Human
aaacugguccugguauuuc

SEQ ID NO: 189540 - RNA, 22 nt, Human
aaccacaaacauaaacuggucc

SEQ ID NO: 189541 - RNA, 20 nt, Human
aacucaaccccacccccaca

SEQ ID NO: 189542 - RNA, 27 nt, Human
accccacccccacaacauuucccccaa

SEQ ID NO: 189543 - RNA, 23 nt, Human
aggugggguggggacggccggaa

SEQ ID NO: 189544 - RNA, 23 nt, Human
auccauucuguccucucggcccu

SEQ ID NO: 189545 - RNA, 23 nt, Human
auuagaaaauacccccaacucaa

SEQ ID NO: 189546 - RNA, 20 nt, Human
caaaaccacaaacauaaacu

SEQ ID NO: 189547 - RNA, 21 nt, Human
caaaaccacaaacauaaacug

SEQ ID NO: 189548 - RNA, 23 nt, Human
caaauaauuuuucccaaaaccac

SEQ ID NO: 189549 - RNA, 18 nt, Human
caacucaaccccaccccc

SEQ ID NO: 189550 - RNA, 24 nt, Human
cagcuaagaaacaguuuagagaaa

SEQ ID NO: 189551 - RNA, 22 nt, Human
cauucuguccucucggcccuga

SEQ ID NO: 189552 - RNA, 23 nt, Human
ccaacucaaccccacccccacaa

SEQ ID NO: 189553 - RNA, 26 nt, Human
ccaacucaaccccacccccacaacau

SEQ ID NO: 189554 - RNA, 22 nt, Human
ccacaacauuucccccaacaca

SEQ ID NO: 189555 - RNA, 23 nt, Human
ccacccccacaacauuuccccca

SEQ ID NO: 189556 - RNA, 25 nt, Human
ccacccccacaacauuucccccaac

SEQ ID NO: 189557 - RNA, 24 nt, Human
cccaacucaaccccacccccacaa

SEQ ID NO: 189558 - RNA, 24 nt, Human
cccacccccacaacauuuccccca

SEQ ID NO: 189559 - RNA, 23 nt, Human
ccccaacucaaccccacccccac

SEQ ID NO: 189560 - RNA, 27 nt, Human
ccccacccccacaacauuucccccaac

SEQ ID NO: 189561 - RNA, 18 nt, Human
ccucucggcccugagagg

SEQ ID NO: 189562 - RNA, 19 nt, Human
cgaggugggguggggacgg

SEQ ID NO: 189563 - RNA, 21 nt, Human
cgcgcgaccacuaacccgcuu

SEQ ID NO: 189564 - RNA, 18 nt, Human
cggcugggacugcggagg

SEQ ID NO: 189565 - RNA, 25 nt, Human
cucauuuauugucacuguuccaaau

SEQ ID NO: 189566 - RNA, 18 nt, Human
gcucggcugggacugcgg

SEQ ID NO: 189567 - RNA, 19 nt, Human
gggcgcgcgaccacuaacc

SEQ ID NO: 189568 - RNA, 24 nt, Human
uacccccaacucaaccccaccccc

SEQ ID NO: 189569 - RNA, 24 nt, Human
ucacuguuccaaauguacaaaaaa

SEQ ID NO: 189570 - RNA, 21 nt, Human
ucccaaaaccacaaacauaaa

SEQ ID NO: 189571 - RNA, 19 nt, Human
ucucugauggaagaguccu

SEQ ID NO: 189572 - RNA, 23 nt, Human
ugcagcuaagaaacaguuuagag

SEQ ID NO: 189573 - RNA, 26 nt, Human
uguacaaaaaaaauuagaaaauaccc

SEQ ID NO: 189574 - RNA, 21 nt, Human
uucccaaaaccacaaacauaa

SEQ ID NO: 189575 - RNA, 23 nt, Human
uuuauugucacuguuccaaaugu

SEQ ID NO: 189576 - RNA, 30 nt, Human
uuuuuuuuugacaguuuaaaggggucucaa

SEQ ID NO: 189577 - RNA, 22 nt, Human
uuuuuuuuuuuuuuuuugacag

SEQ ID NO: 189578 - RNA, 27 nt, Human
uuuuuuuuuuuuuuuuuuuuuuugggg

SEQ ID NO: 189579 - RNA, 20 nt, Human
aaaggcuuagaauuaaaccc

SEQ ID NO: 189580 - RNA, 24 nt, Human
aaccgagugaagaugaagauaaga

SEQ ID NO: 189581 - RNA, 18 nt, Human
aaggcuuagaauuaaacc

SEQ ID NO: 189582 - RNA, 19 nt, Human
aaggcuuagaauuaaaccc

SEQ ID NO: 189583 - RNA, 22 nt, Human
acaacaauggaugcaaggguuc

SEQ ID NO: 189584 - RNA, 22 nt, Human
acccccaccuacaccacucagg

SEQ ID NO: 189585 - RNA, 21 nt, Human
agccauaaagcaaaaccgucc

SEQ ID NO: 189586 - RNA, 19 nt, Human
auaaagcaaaaccgucccu

SEQ ID NO: 189587 - RNA, 19 nt, Human
caccuacaccacucaggag

SEQ ID NO: 189588 - RNA, 18 nt, Human
cagggggcaaaaucaagg

SEQ ID NO: 189589 - RNA, 19 nt, Human
cagggggcaaaaucaaggg

SEQ ID NO: 189590 - RNA, 22 nt, Human
ccacccccaccuacaccacuca

SEQ ID NO: 189591 - RNA, 27 nt, Human
cccacccccaccuacaccacucaggag

SEQ ID NO: 189592 - RNA, 21 nt, Human
ccccacccccaccuacaccac

SEQ ID NO: 189593 - RNA, 20 nt, Human
cucucugucacuauuuugac

SEQ ID NO: 189594 - RNA, 24 nt, Human
cugcaucaguucuuucuaccucca

SEQ ID NO: 189595 - RNA, 25 nt, Human
gcaaaaccgucccucagggggcaaa

SEQ ID NO: 189596 - RNA, 26 nt, Human
gcaaaaccgucccucagggggcaaaa

SEQ ID NO: 189597 - RNA, 20 nt, Human
gccuccccacccccaccuac

SEQ ID NO: 189598 - RNA, 23 nt, Human
gccuccccacccccaccuacacc

SEQ ID NO: 189599 - RNA, 19 nt, Human
gcucuuugccuucuuuaau

SEQ ID NO: 189600 - RNA, 21 nt, Human
gcugcaguuuacuaagaacuu

SEQ ID NO: 189601 - RNA, 23 nt, Human
gugauccaucauuugggccuccc

SEQ ID NO: 189602 - RNA, 21 nt, Human
uaacaacaacaaaacuuagcc

SEQ ID NO: 189603 - RNA, 21 nt, Human
uaaguuaacaacaacaaaacu

SEQ ID NO: 189604 - RNA, 23 nt, Human
uacaccacucaggagcauucuga

SEQ ID NO: 189605 - RNA, 21 nt, Human
uagaauuaaacccacucugca

SEQ ID NO: 189606 - RNA, 22 nt, Human
uagucugagucucccuggcugc

SEQ ID NO: 189607 - RNA, 22 nt, Human
uauaauggugauccaucauuug

SEQ ID NO: 189608 - RNA, 20 nt, Human
ucccuggcugcaguuuacua

SEQ ID NO: 189609 - RNA, 21 nt, Human
ucuaccuccauucuagucuga

SEQ ID NO: 189610 - RNA, 23 nt, Human
uucaaaacucucugucacuauuu

SEQ ID NO: 189611 - RNA, 21 nt, Human
uuccugucuagccauaaagca

SEQ ID NO: 189612 - RNA, 27 nt, Human
aaaaauaacagaauggcuuucauugac

SEQ ID NO: 189613 - RNA, 27 nt, Human
aaaaauucaaaacacagaauagaaacc

SEQ ID NO: 189614 - RNA, 20 nt, Human
aaaccaagaaggagcccaug

SEQ ID NO: 189615 - RNA, 26 nt, Human
aaagaagagagagacaaagaggugac

SEQ ID NO: 189616 - RNA, 25 nt, Human
aaauuugaagauacauugcuaagcu

SEQ ID NO: 189617 - RNA, 18 nt, Human
aagaagagagagacaaag

SEQ ID NO: 189618 - RNA, 19 nt, Human
aagacagaagggauuaaac

SEQ ID NO: 189619 - RNA, 24 nt, Human
aauagaaaccauacucagaaagaa

SEQ ID NO: 189620 - RNA, 25 nt, Human
aauggcuuucauugaccuuaauuuu

SEQ ID NO: 189621 - RNA, 23 nt, Human
aauuugcguaucuacuuuuccuc

SEQ ID NO: 189622 - RNA, 19 nt, Human
acaccacacucuccccucu

SEQ ID NO: 189623 - RNA, 19 nt, Human
accagcacucucugccucu

SEQ ID NO: 189624 - RNA, 21 nt, Human
acuugugacacaacucacaaa

SEQ ID NO: 189625 - RNA, 18 nt, Human
agaagagagagacaaaga

SEQ ID NO: 189626 - RNA, 18 nt, Human
agacagaccagcacucuc

SEQ ID NO: 189627 - RNA, 22 nt, Human
agacgaugacaaaaaugagagc

SEQ ID NO: 189628 - RNA, 22 nt, Human
agagagacaaagaggugacugg

SEQ ID NO: 189629 - RNA, 23 nt, Human
agcaaaaaccaagaaggagccca

SEQ ID NO: 189630 - RNA, 19 nt, Human
aggguggguggauguauuu

SEQ ID NO: 189631 - RNA, 20 nt, Human
augaggccuguaugccuucc

SEQ ID NO: 189632 - RNA, 24 nt, Human
augcuaagucaaguccugcccagc

SEQ ID NO: 189633 - RNA, 24 nt, Human
cacagaauagaaaccauacucaga

SEQ ID NO: 189634 - RNA, 22 nt, Human
cacagauugcaggcuggggcaa

SEQ ID NO: 189635 - RNA, 20 nt, Human
caccucucuccugucuauug

SEQ ID NO: 189636 - RNA, 28 nt, Human
cacugcauuagaaaauaaaaauucaaaa

SEQ ID NO: 189637 - RNA, 21 nt, Human
cagaaaccgaaccccagugcu

SEQ ID NO: 189638 - RNA, 19 nt, Human
cagaagggauuaaacaguu

SEQ ID NO: 189639 - RNA, 26 nt, Human
cagcaaaaaccaagaaggagcccaug

SEQ ID NO: 189640 - RNA, 19 nt, Human
cagcagcaaaaaccaagaa

SEQ ID NO: 189641 - RNA, 24 nt, Human
cauuuaggaugaucuguuucuuuu

SEQ ID NO: 189642 - RNA, 22 nt, Human
ccucucuaacuggcaacaggga

SEQ ID NO: 189643 - RNA, 22 nt, Human
cgugaauugauccagaagaugc

SEQ ID NO: 189644 - RNA, 19 nt, Human
cugaaucuucaagucagac

SEQ ID NO: 189645 - RNA, 19 nt, Human
cuuaagauaggacaggaga

SEQ ID NO: 189646 - RNA, 20 nt, Human
cuucccagacagaccagcac

SEQ ID NO: 189647 - RNA, 19 nt, Human
gacaggagaaauaaaagac

SEQ ID NO: 189648 - RNA, 19 nt, Human
gagaacagaaagacagaag

SEQ ID NO: 189649 - RNA, 18 nt, Human
ggacaauauacagaccuc

SEQ ID NO: 189650 - RNA, 19 nt, Human
gggucuuaggaacaucacc

SEQ ID NO: 189651 - RNA, 21 nt, Human
guaucugggacaagggucuua

SEQ ID NO: 189652 - RNA, 25 nt, Human
uaacagaauggcuuucauugaccuu

SEQ ID NO: 189653 - RNA, 19 nt, Human
uaagucaaguccugcccag

SEQ ID NO: 189654 - RNA, 24 nt, Human
uaagugagaaugcuaaaaauaaca

SEQ ID NO: 189655 - RNA, 23 nt, Human
uagaaaauaaaaauucaaaacac

SEQ ID NO: 189656 - RNA, 22 nt, Human
ucaaaacacagaauagaaacca

SEQ ID NO: 189657 - RNA, 23 nt, Human
ucaaaacacagaauagaaaccau

SEQ ID NO: 189658 - RNA, 19 nt, Human
ucaccagagacauuuggac

SEQ ID NO: 189659 - RNA, 20 nt, Human
ucagaaagaagagagagaca

SEQ ID NO: 189660 - RNA, 21 nt, Human
uccacugcauuagaaaauaaa

SEQ ID NO: 189661 - RNA, 21 nt, Human
ucuacuuuuccuccuucuaaa

SEQ ID NO: 189662 - RNA, 20 nt, Human
ugacaaaaaugagagcagaa

SEQ ID NO: 189663 - RNA, 21 nt, Human
ugacaaaaaugagagcagaaa

SEQ ID NO: 189664 - RNA, 20 nt, Human
ugacacaacucacaaauguu

SEQ ID NO: 189665 - RNA, 21 nt, Human
ugacucacuugugacacaacu

SEQ ID NO: 189666 - RNA, 20 nt, Human
ugaguuagaguccaaacauu

SEQ ID NO: 189667 - RNA, 19 nt, Human
ugauaaugacucacuugug

SEQ ID NO: 189668 - RNA, 27 nt, Human
ugcauuagaaaauaaaaauucaaaaca

SEQ ID NO: 189669 - RNA, 21 nt, Human
ugccugguggaugaggccugu

SEQ ID NO: 189670 - RNA, 23 nt, Human
ugcuaaaaauaacagaauggcuu

SEQ ID NO: 189671 - RNA, 18 nt, Human
ugguaucaucagccaagg

SEQ ID NO: 189672 - RNA, 27 nt, Human
uggugggcuggguugacucccccagcu

SEQ ID NO: 189673 - RNA, 21 nt, Human
ugugagaacagaaagacagaa

SEQ ID NO: 189674 - RNA, 22 nt, Human
uucaaaacacagaauagaaacc

SEQ ID NO: 189675 - RNA, 22 nt, Human
uuccuccuucuaaaaauaguuc

SEQ ID NO: 189676 - RNA, 22 nt, Human
uugacucccccagcucauacau

SEQ ID NO: 189677 - RNA, 19 nt, Human
uugcguaucuacuuuuccu

SEQ ID NO: 189678 - RNA, 19 nt, Human
acagaagaaaaagaaaaag

SEQ ID NO: 189679 - RNA, 20 nt, Human
acagaagaaaaagaaaaaga

SEQ ID NO: 189680 - RNA, 18 nt, Human
agaagaaaaagaaaaaga

SEQ ID NO: 189681 - RNA, 20 nt, Human
aguaacuggugguuuuuccu

SEQ ID NO: 189682 - RNA, 19 nt, Human
caccuuuuccuuccuuccu

SEQ ID NO: 189683 - RNA, 21 nt, Human
cagcauuaaguucucccacag

SEQ ID NO: 189684 - RNA, 18 nt, Human
cccacagaagaaaaagaa

SEQ ID NO: 189685 - RNA, 19 nt, Human
ccucuuggcuuuucacucc

SEQ ID NO: 189686 - RNA, 20 nt, Human
ccugugcagcuggcugcucg

SEQ ID NO: 189687 - RNA, 18 nt, Human
ccuuccuccuuuucuucc

SEQ ID NO: 189688 - RNA, 23 nt, Human
ccuuccuccuuuucuuccuuuug

SEQ ID NO: 189689 - RNA, 18 nt, Human
ccuuccuuccuccuuuuc

SEQ ID NO: 189690 - RNA, 19 nt, Human
ccuuccuuccuccuuuucu

SEQ ID NO: 189691 - RNA, 28 nt, Human
ccuuuuccuuccuuccuccuuuuuuuuc

SEQ ID NO: 189692 - RNA, 25 nt, Human
cuuccuuccuccuuuucuuccuuuu

SEQ ID NO: 189693 - RNA, 23 nt, Human
gacuucguccucuuggcuuuuca

SEQ ID NO: 189694 - RNA, 18 nt, Human
gugcagcuggcugcucgg

SEQ ID NO: 189695 - RNA, 19 nt, Human
gugcagcuggcugcucggg

SEQ ID NO: 189696 - RNA, 19 nt, Human
ucaccuuuuccuuccuucc

SEQ ID NO: 189697 - RNA, 22 nt, Human
uccuuccuccuuuucuuccuuu

SEQ ID NO: 189698 - RNA, 22 nt, Human
uccuuuugucuuuauguugggg

SEQ ID NO: 189699 - RNA, 24 nt, Human
ucucccacagaagaaaaagaaaaa

SEQ ID NO: 189700 - RNA, 26 nt, Human
uuuuccuuccuuccuccuuuucuucc

SEQ ID NO: 189701 - RNA, 22 nt, Human
aaaaaaaaaaagaaacaacaca

SEQ ID NO: 189702 - RNA, 23 nt, Human
aaaaaaaaaagaaacaacacaca

SEQ ID NO: 189703 - RNA, 30 nt, Human
aagaaacaacacacacacacacacacagug

SEQ ID NO: 189704 - RNA, 22 nt, Human
acacacacacucauagcagagc

SEQ ID NO: 189705 - RNA, 24 nt, Human
caacacacacacacacacacacuc

SEQ ID NO: 189706 - RNA, 18 nt, Human
cacacacacacacacaca

SEQ ID NO: 189707 - RNA, 25 nt, Human
cacacacacacacacacucauagca

SEQ ID NO: 189708 - RNA, 25 nt, Human
cacacacacacacucauagcagagc

SEQ ID NO: 189709 - RNA, 23 nt, Human
cacacacacacucauagcagagc

SEQ ID NO: 189710 - RNA, 19 nt, Human
gcagagcugcucugcucgc

SEQ ID NO: 189711 - RNA, 19 nt, Human
ggacaguuccaaaaggcaa

SEQ ID NO: 189712 - RNA, 24 nt, Human
ugacaugggugggcccugccccuc

SEQ ID NO: 189713 - RNA, 19 nt, Human
ugacauuuuagacaauuuu

SEQ ID NO: 189714 - RNA, 25 nt, Human
ugagggaaggacaguuccaaaaggc

SEQ ID NO: 189715 - RNA, 23 nt, Human
uggauacuguaaaaaaaaaaaaa

SEQ ID NO: 189716 - RNA, 22 nt, Human
uguaaaaaaaaaaaaaagaaac

SEQ ID NO: 189717 - RNA, 24 nt, Human
uuggauacuguaaaaaaaaaaaaa

SEQ ID NO: 189718 - RNA, 21 nt, Human
uuuuuggauacuguaaaaaaa

SEQ ID NO: 189719 - RNA, 20 nt, Human
aaauggaggcaggggcgccc

SEQ ID NO: 189720 - RNA, 18 nt, Human
aagggcccggcccggggg

SEQ ID NO: 189721 - RNA, 19 nt, Human
acaaagcuauugccaaauc

SEQ ID NO: 189722 - RNA, 23 nt, Human
acaugugcacacacacucgcaca

SEQ ID NO: 189723 - RNA, 22 nt, Human
agagcucucaauaugagaaagc

SEQ ID NO: 189724 - RNA, 18 nt, Human
agaggcggcggcggcagc

SEQ ID NO: 189725 - RNA, 20 nt, Human
aggcggcggggcagaagggc

SEQ ID NO: 189726 - RNA, 23 nt, Human
aggcggcggggcagaagggccgg

SEQ ID NO: 189727 - RNA, 20 nt, Human
agggcccggcccgggggcuu

SEQ ID NO: 189728 - RNA, 23 nt, Human
augugcacacacacucgcacacu

SEQ ID NO: 189729 - RNA, 21 nt, Human
cagaagggccgggagcuagcg

SEQ ID NO: 189730 - RNA, 23 nt, Human
cagcagcucaacccuccuccucg

SEQ ID NO: 189731 - RNA, 18 nt, Human
cagcugaauuugaaccuu

SEQ ID NO: 189732 - RNA, 18 nt, Human
caguggcauagcagagcu

SEQ ID NO: 189733 - RNA, 20 nt, Human
caguggcauagcagagcucu

SEQ ID NO: 189734 - RNA, 21 nt, Human
cccgcgccgcugccggcuccg

SEQ ID NO: 189735 - RNA, 23 nt, Human
cccgcgccgcugccggcuccgug

SEQ ID NO: 189736 - RNA, 22 nt, Human
ccgcacggccucccgcgccgcu

SEQ ID NO: 189737 - RNA, 31 nt, Human
ccgccgccgccagggaagccgccgccgccgg

SEQ ID NO: 189738 - RNA, 18 nt, Human
ccgccgccgccgccgcca

SEQ ID NO: 189739 - RNA, 26 nt, Human
ccgccgccgccgccgccacugcccgg

SEQ ID NO: 189740 - RNA, 18 nt, Human
ccgccgccgccgccgccg

SEQ ID NO: 189741 - RNA, 18 nt, Human
ccgccgccgccgccgccg

SEQ ID NO: 189742 - RNA, 18 nt, Human
ccgccgccgccgccgccg

SEQ ID NO: 189743 - RNA, 18 nt, Human
ccgccgccgccgccgccg

SEQ ID NO: 189744 - RNA, 18 nt, Human
ccgccgccgccgccgccg

SEQ ID NO: 189745 - RNA, 24 nt, Human
ccgccgccgccgccgccgccgccg

SEQ ID NO: 189746 - RNA, 24 nt, Human
ccgccgccgccgccgccgccgccg

SEQ ID NO: 189747 - RNA, 24 nt, Human
ccgccgccgccgccgccgccgccg

SEQ ID NO: 189748 - RNA, 20 nt, Human
ccgcugcugcucccgccgcc

SEQ ID NO: 189749 - RNA, 23 nt, Human
ccgcugcugcucccgccgccgcc

SEQ ID NO: 189750 - RNA, 21 nt, Human
ccgugugugugguggacagag

SEQ ID NO: 189751 - RNA, 20 nt, Human
ccucccgcgccgcugccggc

SEQ ID NO: 189752 - RNA, 21 nt, Human
cgccgccgccgccgccgccac

SEQ ID NO: 189753 - RNA, 23 nt, Human
cggcagcagcucaacccuccucc

SEQ ID NO: 189754 - RNA, 25 nt, Human
cggcagcagcuccagucccgacugg

SEQ ID NO: 189755 - RNA, 26 nt, Human
cggcggcguggacguuggggccccgg

SEQ ID NO: 189756 - RNA, 19 nt, Human
cuaaggggaaaaugaaaaa

SEQ ID NO: 189757 - RNA, 22 nt, Human
cugcugcugccgcugcugcucc

SEQ ID NO: 189758 - RNA, 19 nt, Human
gaaaaauucaacaguggca

SEQ ID NO: 189759 - RNA, 21 nt, Human
gcagcagcucaacccuccucc

SEQ ID NO: 189760 - RNA, 19 nt, Human
gccccgcaggaaggacggc

SEQ ID NO: 189761 - RNA, 23 nt, Human
gccgagucgcugcugcugcugcc

SEQ ID NO: 189762 - RNA, 22 nt, Human
gccgcaagggcccggcccgggg

SEQ ID NO: 189763 - RNA, 30 nt, Human
gccgccgccgccagggaagccgccgccggc

SEQ ID NO: 189764 - RNA, 22 nt, Human
gccgcugcugcucccgccgccg

SEQ ID NO: 189765 - RNA, 22 nt, Human
gcugcucccgccgccgccgccg

SEQ ID NO: 189766 - RNA, 21 nt, Human
ggaaggacggcacgaacucgg

SEQ ID NO: 189767 - RNA, 21 nt, Human
ggccgcgcugagguucucccg

SEQ ID NO: 189768 - RNA, 23 nt, Human
ggccggagaggagugggcaacgc

SEQ ID NO: 189769 - RNA, 20 nt, Human
gggaaggcggcggggcagaa

SEQ ID NO: 189770 - RNA, 18 nt, Human
ggggagagguuuaucaau

SEQ ID NO: 189771 - RNA, 19 nt, Human
uaacaugguaguugccuuu

SEQ ID NO: 189772 - RNA, 27 nt, Human
uagcagagcucucaauaugagaaagcu

SEQ ID NO: 189773 - RNA, 19 nt, Human
uaggcuucugcagucaauu

SEQ ID NO: 189774 - RNA, 25 nt, Human
ucaacaguggcauagcagagcucuc

SEQ ID NO: 189775 - RNA, 25 nt, Human
uccacacucgcgacgacgacagagg

SEQ ID NO: 189776 - RNA, 21 nt, Human
ucccgccgccgccgccgccgc

SEQ ID NO: 189777 - RNA, 23 nt, Human
ucccgccgccgccgccgccgccg

SEQ ID NO: 189778 - RNA, 18 nt, Human
ucccgcugggccucggcc

SEQ ID NO: 189779 - RNA, 19 nt, Human
uccucuugagaggauucca

SEQ ID NO: 189780 - RNA, 21 nt, Human
ucgccgcggcagcagcuccag

SEQ ID NO: 189781 - RNA, 19 nt, Human
ucgccgcggcagcagcucu

SEQ ID NO: 189782 - RNA, 19 nt, Human
ugaagugagggcuagggac

SEQ ID NO: 189783 - RNA, 18 nt, Human
ugccggcugaaggccgcg

SEQ ID NO: 189784 - RNA, 26 nt, Human
ugccggcugaaggccgcgcugagguu

SEQ ID NO: 189785 - RNA, 21 nt, Human
ugcucccgccgccgccgccgc

SEQ ID NO: 189786 - RNA, 21 nt, Human
ugcugcugcugccgcugcugc

SEQ ID NO: 189787 - RNA, 19 nt, Human
ugggaaaaauucaacagug

SEQ ID NO: 189788 - RNA, 22 nt, Human
uggggguggcggcgcugccggg

SEQ ID NO: 189789 - RNA, 20 nt, Human
ugugaaguaggcuucugcag

SEQ ID NO: 189790 - RNA, 23 nt, Human
ugugaaguaggcuucugcaguca

SEQ ID NO: 189791 - RNA, 20 nt, Human
ugugcacacacacucgcaca

SEQ ID NO: 189792 - RNA, 25 nt, Human
ugugcacacacacucgcacacucac

SEQ ID NO: 189793 - RNA, 21 nt, Human
cagaagaucuaugggucccac

SEQ ID NO: 189794 - RNA, 24 nt, Human
ccacugcccgccacacgugucucc

SEQ ID NO: 189795 - RNA, 24 nt, Human
ccagcucggucccgcgccggcgcu

SEQ ID NO: 189796 - RNA, 18 nt, Human
ccgcccgccgccagcucg

SEQ ID NO: 189797 - RNA, 24 nt, Human
cgcgggcucgggcagaagcagcag

SEQ ID NO: 189798 - RNA, 24 nt, Human
cgggagagggcgcgcgugagggcc

SEQ ID NO: 189799 - RNA, 25 nt, Human
gcagaagcagcaggaagccucggaa

SEQ ID NO: 189800 - RNA, 20 nt, Human
gcgcgcgugagggccgcggg

SEQ ID NO: 189801 - RNA, 20 nt, Human
ggaaggcgcgcgccgcccgc

SEQ ID NO: 189802 - RNA, 21 nt, Human
gggcucgggcagaagcagcag

SEQ ID NO: 189803 - RNA, 18 nt, Human
aaugacaaauacagagga

SEQ ID NO: 189804 - RNA, 21 nt, Human
aggaggauaccccucaggagg

SEQ ID NO: 189805 - RNA, 24 nt, Human
auggaaagcugggggaagguacca

SEQ ID NO: 189806 - RNA, 23 nt, Human
caagucaggcacuggaaccugcu

SEQ ID NO: 189807 - RNA, 21 nt, Human
cacucccccuccuccuaccac

SEQ ID NO: 189808 - RNA, 20 nt, Human
caguccuaucccaagucagg

SEQ ID NO: 189809 - RNA, 27 nt, Human
caguuuuauuuaaggcagaauuaggga

SEQ ID NO: 189810 - RNA, 21 nt, Human
ccccuccacucccccuccucc

SEQ ID NO: 189811 - RNA, 22 nt, Human
ccccuccuccuaccacucaguc

SEQ ID NO: 189812 - RNA, 20 nt, Human
cccuccacucccccuccucc

SEQ ID NO: 189813 - RNA, 20 nt, Human
ccuuccauaaaaacuuugga

SEQ ID NO: 189814 - RNA, 19 nt, Human
ccuuuaccucagagcagcu

SEQ ID NO: 189815 - RNA, 19 nt, Human
cugaugaggggcugacagg

SEQ ID NO: 189816 - RNA, 21 nt, Human
cuuccauaaaaacuuuggagg

SEQ ID NO: 189817 - RNA, 25 nt, Human
gacaaauacagaggauagaaggucc

SEQ ID NO: 189818 - RNA, 19 nt, Human
gacaggaguggggcagggu

SEQ ID NO: 189819 - RNA, 19 nt, Human
gaggggcugacaggagugg

SEQ ID NO: 189820 - RNA, 25 nt, Human
gcacuggaaccugcugaaaaggcug

SEQ ID NO: 189821 - RNA, 20 nt, Human
gccccuccacucccccuccu

SEQ ID NO: 189822 - RNA, 23 nt, Human
gcuaugccccuccacucccccuc

SEQ ID NO: 189823 - RNA, 23 nt, Human
uaagggagacacaacuuuucugg

SEQ ID NO: 189824 - RNA, 18 nt, Human
uauacccacaucucaagg

SEQ ID NO: 189825 - RNA, 18 nt, Human
ugacaggaguggggcagg

SEQ ID NO: 189826 - RNA, 19 nt, Human
ugagcuauacccacaucuc

SEQ ID NO: 189827 - RNA, 18 nt, Human
ugaugaggggcugacagg

SEQ ID NO: 189828 - RNA, 22 nt, Human
ugaugaggggcugacaggagug

SEQ ID NO: 189829 - RNA, 20 nt, Human
uggaaagcugggggaaggua

SEQ ID NO: 189830 - RNA, 24 nt, Human
uggaccuuuaccucagagcagcuu

SEQ ID NO: 189831 - RNA, 20 nt, Human
uggggcaggguucauggacc

SEQ ID NO: 189832 - RNA, 20 nt, Human
ugggggcgucuagaucucau

SEQ ID NO: 189833 - RNA, 23 nt, Human
uuaaggcagaauuagggaaaggc

SEQ ID NO: 189834 - RNA, 20 nt, Human
uuagggaaaggcuaugcccc

SEQ ID NO: 189835 - RNA, 18 nt, Human
uucauggaccuuuaccuc

SEQ ID NO: 189836 - RNA, 21 nt, Human
aaaucaauuuuaacuaagugg

SEQ ID NO: 189837 - RNA, 22 nt, Human
aacacuuagguaaagcacuuaa

SEQ ID NO: 189838 - RNA, 24 nt, Human
agaaaucaauuuuaacuaaguggg

SEQ ID NO: 189839 - RNA, 23 nt, Human
cagauccuaaugagaagaaauca

SEQ ID NO: 189840 - RNA, 21 nt, Human
gcuuuguuaaaugcugucacc

SEQ ID NO: 189841 - RNA, 25 nt, Human
guagcagucuccuggagguuucucu

SEQ ID NO: 189842 - RNA, 19 nt, Human
uagcagucuccuggagguu

SEQ ID NO: 189843 - RNA, 21 nt, Human
ucuccuggagguuucucuaag

SEQ ID NO: 189844 - RNA, 24 nt, Human
cuugcauguucuuagccuccaugg

SEQ ID NO: 189845 - RNA, 22 nt, Human
uaaagcacuucauuguugcaaa

SEQ ID NO: 189846 - RNA, 22 nt, Human
uucauuagcuuuacaacaggca

SEQ ID NO: 189847 - RNA, 21 nt, Human
uuuuuuuuuuuuuugcaaaua

SEQ ID NO: 189848 - RNA, 18 nt, Human
uuuuuuuuuuuuuuuuug

SEQ ID NO: 189849 - RNA, 21 nt, Human
uuuuuuuuuuuuuuuuugcaa

SEQ ID NO: 189850 - RNA, 23 nt, Human
uuuuuuuuuuuuuuuuugcaaau

SEQ ID NO: 189851 - RNA, 23 nt, Human
aagagaacaggauaaggagagca

SEQ ID NO: 189852 - RNA, 19 nt, Human
agagaacaggauaaggaga

SEQ ID NO: 189853 - RNA, 21 nt, Human
aggauaaggagagcagaaaga

SEQ ID NO: 189854 - RNA, 23 nt, Human
aggggauaaggauaagagaacag

SEQ ID NO: 189855 - RNA, 22 nt, Human
auuaggcagagacuggagggga

SEQ ID NO: 189856 - RNA, 24 nt, Human
auugcauucauuacuaccauuuua

SEQ ID NO: 189857 - RNA, 24 nt, Human
auugcauucauuacuaccauuuuc

SEQ ID NO: 189858 - RNA, 23 nt, Human
caaaaaaguuuuccaauaaagau

SEQ ID NO: 189859 - RNA, 25 nt, Human
caaaagacccaacuuaggacccaac

SEQ ID NO: 189860 - RNA, 18 nt, Human
caaagcgccaggucagcg

SEQ ID NO: 189861 - RNA, 22 nt, Human
caacuuaauacauagauagcac

SEQ ID NO: 189862 - RNA, 25 nt, Human
cacaaaagacccaacuuaggaccca

SEQ ID NO: 189863 - RNA, 21 nt, Human
caggaacaugaguagcccaau

SEQ ID NO: 189864 - RNA, 20 nt, Human
cuaacuuaaauaccagccuc

SEQ ID NO: 189865 - RNA, 23 nt, Human
cuuuucaggcuuucuggagucca

SEQ ID NO: 189866 - RNA, 21 nt, Human
gauaagagaacaggauaagga

SEQ ID NO: 189867 - RNA, 24 nt, Human
ggaggccuggagccgcacaaagcg

SEQ ID NO: 189868 - RNA, 22 nt, Human
ggauaagagaacaggauaagga

SEQ ID NO: 189869 - RNA, 18 nt, Human
uagaaagacacucaggag

SEQ ID NO: 189870 - RNA, 18 nt, Human
uagcuuuucaggcuuucu

SEQ ID NO: 189871 - RNA, 23 nt, Human
ucucuaggaacacacugucacuc

SEQ ID NO: 189872 - RNA, 21 nt, Human
uggcuaacacugauugcauuc

SEQ ID NO: 189873 - RNA, 23 nt, Human
uuacuaccauuuuauuuauuaca

SEQ ID NO: 189874 - RNA, 24 nt, Human
uuucaggcuuucuggaguccacuc

SEQ ID NO: 189875 - RNA, 23 nt, Human
uuuuuuuuuuuuuuuuuuuaaug

SEQ ID NO: 189876 - RNA, 20 nt, Human
aaacaggagaaaggaacgaa

SEQ ID NO: 189877 - RNA, 24 nt, Human
aaagaugggaauaaacaggagaaa

SEQ ID NO: 189878 - RNA, 19 nt, Human
aagcagacacaaccacuaa

SEQ ID NO: 189879 - RNA, 21 nt, Human
aagcagacacaaccacuaaca

SEQ ID NO: 189880 - RNA, 23 nt, Human
aagcagacacaaccacuaacagg

SEQ ID NO: 189881 - RNA, 23 nt, Human
aaggcagggaccaugcugcagga

SEQ ID NO: 189882 - RNA, 19 nt, Human
agcaggcugaguaugggcu

SEQ ID NO: 189883 - RNA, 19 nt, Human
aggcagggaccaugcugca

SEQ ID NO: 189884 - RNA, 24 nt, Human
aggccuaaaccgagcagggcucag

SEQ ID NO: 189885 - RNA, 23 nt, Human
agggaaggguaaugaugggaggg

SEQ ID NO: 189886 - RNA, 18 nt, Human
augcagaguccagcugcg

SEQ ID NO: 189887 - RNA, 20 nt, Human
cagcaggcugaguaugggcu

SEQ ID NO: 189888 - RNA, 29 nt, Human
cagcucggggcugagcuccacaggcgagg

SEQ ID NO: 189889 - RNA, 18 nt, Human
ccaggcaggcccuuuaaa

SEQ ID NO: 189890 - RNA, 18 nt, Human
ccagucaaugcugcuccu

SEQ ID NO: 189891 - RNA, 25 nt, Human
cugaggcuucaaagggccugcaugg

SEQ ID NO: 189892 - RNA, 20 nt, Human
cugcacagccugggcagcag

SEQ ID NO: 189893 - RNA, 22 nt, Human
gacagggguuuagggggaguga

SEQ ID NO: 189894 - RNA, 20 nt, Human
gccuaaaccgagcagggcuc

SEQ ID NO: 189895 - RNA, 19 nt, Human
gcgcugcacagccugggca

SEQ ID NO: 189896 - RNA, 21 nt, Human
gcucggggcugagcuccacag

SEQ ID NO: 189897 - RNA, 18 nt, Human
gcugggaugcagagucca

SEQ ID NO: 189898 - RNA, 19 nt, Human
gcugguuggugcggauucc

SEQ ID NO: 189899 - RNA, 18 nt, Human
ggccuaaaccgagcaggg

SEQ ID NO: 189900 - RNA, 19 nt, Human
uagugcagggaaggguaau

SEQ ID NO: 189901 - RNA, 18 nt, Human
uaguggguagcugaggcu

SEQ ID NO: 189902 - RNA, 23 nt, Human
uccuucaugcaacacggggacag

SEQ ID NO: 189903 - RNA, 19 nt, Human
ugcacagccugggcagcag

SEQ ID NO: 189904 - RNA, 18 nt, Human
ugcaggagcagggccugu

SEQ ID NO: 189905 - RNA, 23 nt, Human
ugcgcugcacagccugggcagca

SEQ ID NO: 189906 - RNA, 21 nt, Human
uggcuuuagugcagggaaggg

SEQ ID NO: 189907 - RNA, 22 nt, Human
ugggaggggauguucacgaagg

SEQ ID NO: 189908 - RNA, 19 nt, Human
uuuagggggagugaagagg

SEQ ID NO: 189909 - RNA, 20 nt, Human
aaacaggagaaaggaacgaa

SEQ ID NO: 189910 - RNA, 24 nt, Human
aaagaugggaauaaacaggagaaa

SEQ ID NO: 189911 - RNA, 20 nt, Human
aagcagacacaaccacuaac

SEQ ID NO: 189912 - RNA, 21 nt, Human
aagcagacacaaccacuaaca

SEQ ID NO: 189913 - RNA, 23 nt, Human
aagcagacacaaccacuaacagg

SEQ ID NO: 189914 - RNA, 23 nt, Human
aaggcagggaccaugcugcagga

SEQ ID NO: 189915 - RNA, 24 nt, Human
acucccaccuccugccuucaaggc

SEQ ID NO: 189916 - RNA, 19 nt, Human
agcaggcugaguaugggcu

SEQ ID NO: 189917 - RNA, 19 nt, Human
aggcagggaccaugcugca

SEQ ID NO: 189918 - RNA, 18 nt, Human
augcagaguccagcugcg

SEQ ID NO: 189919 - RNA, 22 nt, Human
cagcaggcugaguaugggcucc

SEQ ID NO: 189920 - RNA, 29 nt, Human
cagcucggggcugagcuccacaggcgagg

SEQ ID NO: 189921 - RNA, 18 nt, Human
ccaggcaggcccuuuaaa

SEQ ID NO: 189922 - RNA, 20 nt, Human
ccagucaaugcugcuccuuc

SEQ ID NO: 189923 - RNA, 23 nt, Human
ccucacucccaccuccugccuuc

SEQ ID NO: 189924 - RNA, 21 nt, Human
cuccucacucccaccuccugc

SEQ ID NO: 189925 - RNA, 25 nt, Human
cugaggcuucaaagggccugcaugg

SEQ ID NO: 189926 - RNA, 20 nt, Human
cugcacagccugggcagcag

SEQ ID NO: 189927 - RNA, 22 nt, Human
gacagggguuuagggggaguga

SEQ ID NO: 189928 - RNA, 23 nt, Human
gcgcugcacagccugggcagcag

SEQ ID NO: 189929 - RNA, 21 nt, Human
gcucggggcugagcuccacag

SEQ ID NO: 189930 - RNA, 23 nt, Human
gcugcgcugcacagccugggcag

SEQ ID NO: 189931 - RNA, 18 nt, Human
gcugggaugcagagucca

SEQ ID NO: 189932 - RNA, 18 nt, Human
ggaauaaacaggagaaag

SEQ ID NO: 189933 - RNA, 19 nt, Human
uagugcagggaaggguaau

SEQ ID NO: 189934 - RNA, 18 nt, Human
uaguggguagcugaggcu

SEQ ID NO: 189935 - RNA, 23 nt, Human
uccuucaugcaacacggggacag

SEQ ID NO: 189936 - RNA, 19 nt, Human
ugcacagccugggcagcag

SEQ ID NO: 189937 - RNA, 18 nt, Human
ugcaggagcagggccugu

SEQ ID NO: 189938 - RNA, 26 nt, Human
ugcagggaaggguaaugaugggaggg

SEQ ID NO: 189939 - RNA, 23 nt, Human
ugcgcugcacagccugggcagca

SEQ ID NO: 189940 - RNA, 21 nt, Human
uggcuuuagugcagggaaggg

SEQ ID NO: 189941 - RNA, 22 nt, Human
ugggaggggauguucacgaagg

SEQ ID NO: 189942 - RNA, 19 nt, Human
uuuagggggagugaagagg

SEQ ID NO: 189943 - RNA, 21 nt, Human
aagagcgcugaccccuuacgg

SEQ ID NO: 189944 - RNA, 22 nt, Human
aagcucugcaagucugccuccu

SEQ ID NO: 189945 - RNA, 24 nt, Human
aaucucguuuuuucuaguacccac

SEQ ID NO: 189946 - RNA, 23 nt, Human
aaugucugccuauuccuugaagc

SEQ ID NO: 189947 - RNA, 24 nt, Human
acaagcucugcaagucugccuccu

SEQ ID NO: 189948 - RNA, 19 nt, Human
acauaagugcuauucauug

SEQ ID NO: 189949 - RNA, 21 nt, Human
aggacuagggaaacugugagc

SEQ ID NO: 189950 - RNA, 24 nt, Human
caacugugcaaucucguuuuuucu

SEQ ID NO: 189951 - RNA, 23 nt, Human
caagagaaacucagcuggacacc

SEQ ID NO: 189952 - RNA, 18 nt, Human
cacagccuauccuuccuc

SEQ ID NO: 189953 - RNA, 21 nt, Human
cagcagccuugcugaaauguc

SEQ ID NO: 189954 - RNA, 22 nt, Human
cagccuauccuuccucagcagc

SEQ ID NO: 189955 - RNA, 24 nt, Human
caggacgguuuccgaacuccgguu

SEQ ID NO: 189956 - RNA, 19 nt, Human
cauaagggggcggggccca

SEQ ID NO: 189957 - RNA, 19 nt, Human
cauccuaauuuccacagcc

SEQ ID NO: 189958 - RNA, 20 nt, Human
ccccgaggcgggacccgggc

SEQ ID NO: 189959 - RNA, 22 nt, Human
ccccuuacggacaggaugaaac

SEQ ID NO: 189960 - RNA, 24 nt, Human
ccccuuacggacaggaugaaacaa

SEQ ID NO: 189961 - RNA, 19 nt, Human
ccgccccguucuccguccc

SEQ ID NO: 189962 - RNA, 20 nt, Human
ccuacagcccuugaacucag

SEQ ID NO: 189963 - RNA, 22 nt, Human
ccuugccuccgcggcuccacag

SEQ ID NO: 189964 - RNA, 24 nt, Human
cggcguugggguucagggccuggc

SEQ ID NO: 189965 - RNA, 22 nt, Human
cuauucauugaaaagagcaaag

SEQ ID NO: 189966 - RNA, 18 nt, Human
cucacccagucuucacag

SEQ ID NO: 189967 - RNA, 22 nt, Human
cucuccaacugugcaaucucgu

SEQ ID NO: 189968 - RNA, 21 nt, Human
cugacuccgccuccgccccgu

SEQ ID NO: 189969 - RNA, 18 nt, Human
gaagccuucucagaacca

SEQ ID NO: 189970 - RNA, 22 nt, Human
gaggacuagggaaacugugagc

SEQ ID NO: 189971 - RNA, 22 nt, Human
gcaaagcaagagcgcugacccc

SEQ ID NO: 189972 - RNA, 24 nt, Human
ggcuagcccaccagucugaaauac

SEQ ID NO: 189973 - RNA, 19 nt, Human
gucccuugccuccgcggcu

SEQ ID NO: 189974 - RNA, 23 nt, Human
uagcccaccagucugaaauacug

SEQ ID NO: 189975 - RNA, 19 nt, Human
ucaguuggggaguagggaa

SEQ ID NO: 189976 - RNA, 24 nt, Human
uccacagccuauccuuccucagca

SEQ ID NO: 189977 - RNA, 20 nt, Human
ucugcaagucugccuccugc

SEQ ID NO: 189978 - RNA, 22 nt, Human
ugaaaagagcaaagcaagagcg

SEQ ID NO: 189979 - RNA, 21 nt, Human
ugaaacaaaacaagcucugca

SEQ ID NO: 189980 - RNA, 22 nt, Human
ugaaacaaaacaagcucugcaa

SEQ ID NO: 189981 - RNA, 20 nt, Human
ugccuuuaucacacuaaacu

SEQ ID NO: 189982 - RNA, 23 nt, Human
ugcgcaggcgcgacuaaugccgg

SEQ ID NO: 189983 - RNA, 19 nt, Human
ugggcaugaaccuacagcc

SEQ ID NO: 189984 - RNA, 19 nt, Human
uucuccgucccuugccucc

SEQ ID NO: 189985 - RNA, 20 nt, Human
aaacaggagaaaggaacgaa

SEQ ID NO: 189986 - RNA, 24 nt, Human
aaagaugggaauaaacaggagaaa

SEQ ID NO: 189987 - RNA, 20 nt, Human
aagcagauacaaccacuaac

SEQ ID NO: 189988 - RNA, 23 nt, Human
aagcagauacaaccacuaacagg

SEQ ID NO: 189989 - RNA, 19 nt, Human
agcaggcugaguaugggcu

SEQ ID NO: 189990 - RNA, 19 nt, Human
aggcaggggccaugcugca

SEQ ID NO: 189991 - RNA, 22 nt, Human
aggcaggggccaugcugcagga

SEQ ID NO: 189992 - RNA, 23 nt, Human
agggaaggguaguguugggaggg

SEQ ID NO: 189993 - RNA, 22 nt, Human
agucaaugcugucaugcaacac

SEQ ID NO: 189994 - RNA, 23 nt, Human
agugcagggaaggguaguguugg

SEQ ID NO: 189995 - RNA, 24 nt, Human
aucuucaaggucgucacuuccaac

SEQ ID NO: 189996 - RNA, 24 nt, Human
aucuucaaggucgucacuuccaac

SEQ ID NO: 189997 - RNA, 18 nt, Human
augcagaguccagcugcg

SEQ ID NO: 189998 - RNA, 22 nt, Human
cagcaggcugaguaugggcucc

SEQ ID NO: 189999 - RNA, 29 nt, Human
cagcucagggcugagcuccacaggcgagg

SEQ ID NO: 190000 - RNA, 25 nt, Human
ccaccgccaccuccgaguguucagg

SEQ ID NO: 190001 - RNA, 21 nt, Human
ccccucggccccgcugcgccc

SEQ ID NO: 190002 - RNA, 18 nt, Human
cccgcccccucggccccg

SEQ ID NO: 190003 - RNA, 20 nt, Human
cccucggccccgcugcgccc

SEQ ID NO: 190004 - RNA, 23 nt, Human
ccuagcgccagacccgcccccuc

SEQ ID NO: 190005 - RNA, 18 nt, Human
cgcugcacagccugggca

SEQ ID NO: 190006 - RNA, 25 nt, Human
cugaggcuucaaagggccugcaugg

SEQ ID NO: 190007 - RNA, 19 nt, Human
cugaggcuuuauuuugauc

SEQ ID NO: 190008 - RNA, 19 nt, Human
cugcacagccugggcagca

SEQ ID NO: 190009 - RNA, 20 nt, Human
cugcacagccugggcagcag

SEQ ID NO: 190010 - RNA, 18 nt, Human
gaacugcgaccuccucug

SEQ ID NO: 190011 - RNA, 20 nt, Human
gacccgcccccucggccccg

SEQ ID NO: 190012 - RNA, 24 nt, Human
gaucuucaaggucgucacuuccaa

SEQ ID NO: 190013 - RNA, 24 nt, Human
gaucuucaaggucgucacuuccaa

SEQ ID NO: 190014 - RNA, 21 nt, Human
gcucagggcugagcuccacag

SEQ ID NO: 190015 - RNA, 23 nt, Human
gcugcgcugcacagccugggcag

SEQ ID NO: 190016 - RNA, 18 nt, Human
gcugggaugcagagucca

SEQ ID NO: 190017 - RNA, 18 nt, Human
ggaauaaacaggagaaag

SEQ ID NO: 190018 - RNA, 18 nt, Human
ggaggcacggagcagguu

SEQ ID NO: 190019 - RNA, 23 nt, Human
ggcacggagcagguugcuggauc

SEQ ID NO: 190020 - RNA, 22 nt, Human
ggguucccggcacgcaggggcu

SEQ ID NO: 190021 - RNA, 19 nt, Human
uagugcagggaaggguagu

SEQ ID NO: 190022 - RNA, 24 nt, Human
ucaaagcagauacaaccacuaaca

SEQ ID NO: 190023 - RNA, 18 nt, Human
ucaaugcugucaugcaac

SEQ ID NO: 190024 - RNA, 20 nt, Human
ugaggcuuuauuuugaucag

SEQ ID NO: 190025 - RNA, 19 nt, Human
ugcacagccugggcagcag

SEQ ID NO: 190026 - RNA, 18 nt, Human
ugcaggagcagggccugu

SEQ ID NO: 190027 - RNA, 19 nt, Human
uggaaggaguaagauccac

SEQ ID NO: 190028 - RNA, 21 nt, Human
uggcuuuagugcagggaaggg

SEQ ID NO: 190029 - RNA, 21 nt, Human
ugggguucccggcacgcaggg

SEQ ID NO: 190030 - RNA, 20 nt, Human
uuuuuuuuuuuuuuuguggc

SEQ ID NO: 190031 - RNA, 18 nt, Human
uuuuuuuuuuuuuuuuug

SEQ ID NO: 190032 - RNA, 19 nt, Human
uuuuuuuuuuuuuuuuugu

SEQ ID NO: 190033 - RNA, 23 nt, Human
uuuuuuuuuuuuuuuuuuugugg

SEQ ID NO: 190034 - RNA, 23 nt, Human
aaaaaggaagaaggcagguccag

SEQ ID NO: 190035 - RNA, 22 nt, Human
aaagaaggaaaaaggaagaagg

SEQ ID NO: 190036 - RNA, 24 nt, Human
aaaugaccaaggaaauuuaugaac

SEQ ID NO: 190037 - RNA, 26 nt, Human
aacagaagacaaaaaaccacccacaa

SEQ ID NO: 190038 - RNA, 23 nt, Human
acacccauccacuaagcucuggc

SEQ ID NO: 190039 - RNA, 21 nt, Human
acagaagacaaaaaaccaccc

SEQ ID NO: 190040 - RNA, 24 nt, Human
acagaagacaaaaaaccacccaca

SEQ ID NO: 190041 - RNA, 21 nt, Human
accacccacaauucgaggaca

SEQ ID NO: 190042 - RNA, 18 nt, Human
agaagacaaaaaaccacc

SEQ ID NO: 190043 - RNA, 26 nt, Human
agaagagaaaagcacugacaggaaaa

SEQ ID NO: 190044 - RNA, 18 nt, Human
agaaggaaaaaggaagaa

SEQ ID NO: 190045 - RNA, 22 nt, Human
agaaggcagguccagggaguca

SEQ ID NO: 190046 - RNA, 22 nt, Human
agagaaaagcacugacaggaaa

SEQ ID NO: 190047 - RNA, 21 nt, Human
agcaaagggagcagggcauac

SEQ ID NO: 190048 - RNA, 21 nt, Human
aggaacagagggauguggccg

SEQ ID NO: 190049 - RNA, 19 nt, Human
aggaagaaggcagguccag

SEQ ID NO: 190050 - RNA, 21 nt, Human
aggaagaaggcagguccaggg

SEQ ID NO: 190051 - RNA, 24 nt, Human
aggagggggacuuugauggaggac

SEQ ID NO: 190052 - RNA, 21 nt, Human
aggauaucuagaucagggaag

SEQ ID NO: 190053 - RNA, 20 nt, Human
agggaagucuaucaggacag

SEQ ID NO: 190054 - RNA, 22 nt, Human
agggagucaggcuguccuccag

SEQ ID NO: 190055 - RNA, 19 nt, Human
agucaggcuguccuccagg

SEQ ID NO: 190056 - RNA, 21 nt, Human
aguccugaguucaagggagcc

SEQ ID NO: 190057 - RNA, 22 nt, Human
agucugccugggagcugcucag

SEQ ID NO: 190058 - RNA, 25 nt, Human
auggucuuugaggacagugcuaggg

SEQ ID NO: 190059 - RNA, 23 nt, Human
auucugcagacaggcaucagcgg

SEQ ID NO: 190060 - RNA, 18 nt, Human
caaaaaaccacccacaau

SEQ ID NO: 190061 - RNA, 22 nt, Human
cacacacacacacacacccauc

SEQ ID NO: 190062 - RNA, 21 nt, Human
cagcccccuuccccaucagcc

SEQ ID NO: 190063 - RNA, 20 nt, Human
cagcggagcggggcucagac

SEQ ID NO: 190064 - RNA, 18 nt, Human
cagugcuagggagcucag

SEQ ID NO: 190065 - RNA, 19 nt, Human
caucacacggagcuggggu

SEQ ID NO: 190066 - RNA, 21 nt, Human
ccacccacaauucgaggacag

SEQ ID NO: 190067 - RNA, 18 nt, Human
cccacacacacacacaca

SEQ ID NO: 190068 - RNA, 21 nt, Human
cccacacacacacacacaccc

SEQ ID NO: 190069 - RNA, 22 nt, Human
cccacacacacacacacaccca

SEQ ID NO: 190070 - RNA, 19 nt, Human
cccacagugaggaacagag

SEQ ID NO: 190071 - RNA, 21 nt, Human
ccccacacacacacacacacc

SEQ ID NO: 190072 - RNA, 22 nt, Human
ccccacacacacacacacaccc

SEQ ID NO: 190073 - RNA, 22 nt, Human
ccccaucagccuagccccucuu

SEQ ID NO: 190074 - RNA, 24 nt, Human
cccccacacacacacacacaccca

SEQ ID NO: 190075 - RNA, 24 nt, Human
cccccuuccccaucagccuagccc

SEQ ID NO: 190076 - RNA, 19 nt, Human
ccugggagcugcucagccc

SEQ ID NO: 190077 - RNA, 25 nt, Human
ccugggagcugcucagcccccuucc

SEQ ID NO: 190078 - RNA, 18 nt, Human
cucaaagaagagaaaagc

SEQ ID NO: 190079 - RNA, 23 nt, Human
cucaaagaagagaaaagcacuga

SEQ ID NO: 190080 - RNA, 24 nt, Human
cugaucaccacccccacacacaca

SEQ ID NO: 190081 - RNA, 20 nt, Human
cugccugaucaccaccccca

SEQ ID NO: 190082 - RNA, 18 nt, Human
gacagggugaaagaaggc

SEQ ID NO: 190083 - RNA, 21 nt, Human
gacauggcaggcaugguucag

SEQ ID NO: 190084 - RNA, 19 nt, Human
gaguagaaagaaggaaaaa

SEQ ID NO: 190085 - RNA, 25 nt, Human
ggaaaggaagacguuaggaggggga

SEQ ID NO: 190086 - RNA, 22 nt, Human
gggacuuugauggaggacagug

SEQ ID NO: 190087 - RNA, 23 nt, Human
ggggagcugaagcuuuaaagagc

SEQ ID NO: 190088 - RNA, 23 nt, Human
ggugcggauucugcagacaggca

SEQ ID NO: 190089 - RNA, 21 nt, Human
guuggcuccucccucccaucu

SEQ ID NO: 190090 - RNA, 21 nt, Human
uaauccccacagugaggaaca

SEQ ID NO: 190091 - RNA, 18 nt, Human
uagaagaaaggaagccaa

SEQ ID NO: 190092 - RNA, 20 nt, Human
ucacacggagcugggguagg

SEQ ID NO: 190093 - RNA, 18 nt, Human
ucagcccccuuccccauc

SEQ ID NO: 190094 - RNA, 23 nt, Human
ucaggacagggugaaagaaggca

SEQ ID NO: 190095 - RNA, 21 nt, Human
uccugaguucaagggagccuc

SEQ ID NO: 190096 - RNA, 23 nt, Human
ugaaccugccugaucaccacccc

SEQ ID NO: 190097 - RNA, 18 nt, Human
ugaggaacuuggcacaga

SEQ ID NO: 190098 - RNA, 22 nt, Human
ugcuagggagcucagagaucag

SEQ ID NO: 190099 - RNA, 18 nt, Human
uggcuccucccucccauc

SEQ ID NO: 190100 - RNA, 24 nt, Human
uggcuguggacaacagaagacaaa

SEQ ID NO: 190101 - RNA, 29 nt, Human
ugggauacguuuuauugagaagugucauu

SEQ ID NO: 190102 - RNA, 19 nt, Human
cccgcucagagucccccca

SEQ ID NO: 190103 - RNA, 21 nt, Human
ccuggagaaaggaaggcaaac

SEQ ID NO: 190104 - RNA, 21 nt, Human
cgcucagaguccccccaaccc

SEQ ID NO: 190105 - RNA, 20 nt, Human
gacugcggcggcgaaacucc

SEQ ID NO: 190106 - RNA, 23 nt, Human
uggcgaagacugcggcggcgaaa

SEQ ID NO: 190107 - RNA, 18 nt, Human
ugguccuggagaaaggaa

SEQ ID NO: 190108 - RNA, 24 nt, Human
aagcagaggcucaggcugagccca

SEQ ID NO: 190109 - RNA, 18 nt, Human
acacaaggccucagugug

SEQ ID NO: 190110 - RNA, 22 nt, Human
auuauccaaaaucaaaaugaaa

SEQ ID NO: 190111 - RNA, 19 nt, Human
caggcggcuguggaagaca

SEQ ID NO: 190112 - RNA, 22 nt, Human
ccaaaaucaaaaugaaaugcag

SEQ ID NO: 190113 - RNA, 19 nt, Human
gacaggguggggauggugg

SEQ ID NO: 190114 - RNA, 28 nt, Human
gcucccaugggccauuagaaaugaaaau

SEQ ID NO: 190115 - RNA, 19 nt, Human
gcucugggacuugggcaag

SEQ ID NO: 190116 - RNA, 18 nt, Human
gcuguggaagacagggug

SEQ ID NO: 190117 - RNA, 20 nt, Human
ggaagacaggguggggaugg

SEQ ID NO: 190118 - RNA, 21 nt, Human
gggcaagucuuaggcaagcca

SEQ ID NO: 190119 - RNA, 20 nt, Human
ggggaugguggcuucgggag

SEQ ID NO: 190120 - RNA, 23 nt, Human
ggugaggugcucugggacuuggg

SEQ ID NO: 190121 - RNA, 23 nt, Human
ggugcaagggugagguuucccag

SEQ ID NO: 190122 - RNA, 21 nt, Human
guuuauuauccaaaaucaaaa

SEQ ID NO: 190123 - RNA, 20 nt, Human
ugcucugggacuugggcaag

SEQ ID NO: 190124 - RNA, 18 nt, Human
uggaagacagggugggga

SEQ ID NO: 190125 - RNA, 20 nt, Human
uggaagacaggguggggaug

SEQ ID NO: 190126 - RNA, 21 nt, Human
ugggacuugggcaagucuuag

SEQ ID NO: 190127 - RNA, 22 nt, Human
ugggcaagucuuaggcaagcca

SEQ ID NO: 190128 - RNA, 19 nt, Human
aaggacagcggggauggcc

SEQ ID NO: 190129 - RNA, 19 nt, Human
acgcggugugggcagcagc

SEQ ID NO: 190130 - RNA, 22 nt, Human
agcucuuuauauauugcagauu

SEQ ID NO: 190131 - RNA, 18 nt, Human
agggacuggggcaagagg

SEQ ID NO: 190132 - RNA, 21 nt, Human
gaauccuuguugcuaaucucc

SEQ ID NO: 190133 - RNA, 20 nt, Human
ggcggcaaggacagcgggga

SEQ ID NO: 190134 - RNA, 21 nt, Human
uaaaaaggggcaaguaaguaa

SEQ ID NO: 190135 - RNA, 19 nt, Human
uagcagcacugccaaggac

SEQ ID NO: 190136 - RNA, 22 nt, Human
ucugugcagagcuucacaugaa

SEQ ID NO: 190137 - RNA, 24 nt, Human
ucuuacugguuauguaugcugcac

SEQ ID NO: 190138 - RNA, 23 nt, Human
ugaagcuggagagaagggacugg

SEQ ID NO: 190139 - RNA, 21 nt, Human
ugaggaguagcagcacugcca

SEQ ID NO: 190140 - RNA, 20 nt, Human
ugugcagagcuucacaugaa

SEQ ID NO: 190141 - RNA, 19 nt, Human
uguuacugauuuguaggag

SEQ ID NO: 190142 - RNA, 24 nt, Human
uuuguaggagcucuuuauauauug

SEQ ID NO: 190143 - RNA, 20 nt, Human
acccugcuccccgcaucucc

SEQ ID NO: 190144 - RNA, 18 nt, Human
agaaaaggcacacagccu

SEQ ID NO: 190145 - RNA, 22 nt, Human
aggcagauccagggcuagaguu

SEQ ID NO: 190146 - RNA, 21 nt, Human
aggccucuucagcccacccag

SEQ ID NO: 190147 - RNA, 24 nt, Human
cacaacaaaagcggaugagaaaag

SEQ ID NO: 190148 - RNA, 24 nt, Human
cacaugcgugugacagaugagggg

SEQ ID NO: 190149 - RNA, 19 nt, Human
cacccugcuccccgcaucu

SEQ ID NO: 190150 - RNA, 22 nt, Human
caucucagccucacgacugccc

SEQ ID NO: 190151 - RNA, 20 nt, Human
caucucccuacuccacccca

SEQ ID NO: 190152 - RNA, 21 nt, Human
ccaucuccucaauuaagacuc

SEQ ID NO: 190153 - RNA, 18 nt, Human
cccugcuccccgcaucuc

SEQ ID NO: 190154 - RNA, 21 nt, Human
cccugcuccccgcaucucccu

SEQ ID NO: 190155 - RNA, 24 nt, Human
ccgacgacuaaggcucagugagac

SEQ ID NO: 190156 - RNA, 18 nt, Human
ccuacuccaccccacaug

SEQ ID NO: 190157 - RNA, 22 nt, Human
ccuccaggccgagaaacuucgc

SEQ ID NO: 190158 - RNA, 23 nt, Human
cgccaggcauuuuaauccgcauu

SEQ ID NO: 190159 - RNA, 25 nt, Human
cgccaggcauuuuaauccgcauucu

SEQ ID NO: 190160 - RNA, 22 nt, Human
cgccugggaccugccgacgacu

SEQ ID NO: 190161 - RNA, 19 nt, Human
cucuucagcccacccagcu

SEQ ID NO: 190162 - RNA, 22 nt, Human
cuucgcgcgacccccuccucca

SEQ ID NO: 190163 - RNA, 18 nt, Human
gaaaaggcacacagccuu

SEQ ID NO: 190164 - RNA, 21 nt, Human
gaaaaggcacacagccuuccc

SEQ ID NO: 190165 - RNA, 24 nt, Human
gacagaugaggggacugaggugga

SEQ ID NO: 190166 - RNA, 22 nt, Human
gcgacccccuccuccaggccga

SEQ ID NO: 190167 - RNA, 19 nt, Human
gguguuacggugagcacgc

SEQ ID NO: 190168 - RNA, 19 nt, Human
uccccgcaucucccuacuc

SEQ ID NO: 190169 - RNA, 21 nt, Human
uccccgcaucucccuacuccc

SEQ ID NO: 190170 - RNA, 22 nt, Human
ucucccaucuccucaauuaaga

SEQ ID NO: 190171 - RNA, 19 nt, Human
ugagaaaaggcacacagcc

SEQ ID NO: 190172 - RNA, 24 nt, Human
ugagguggaacaaguuucagcagg

SEQ ID NO: 190173 - RNA, 24 nt, Human
ugcgugugacagaugaggggacug

SEQ ID NO: 190174 - RNA, 18 nt, Human
uuuccaggccucuucagc

SEQ ID NO: 190175 - RNA, 21 nt, Human
aaacacagcaaagacaccugc

SEQ ID NO: 190176 - RNA, 20 nt, Human
aagaagcagauaggaagaca

SEQ ID NO: 190177 - RNA, 26 nt, Human
aaguaacaaacgaggaagaaaggaac

SEQ ID NO: 190178 - RNA, 22 nt, Human
acccucuuccugcuucucguca

SEQ ID NO: 190179 - RNA, 18 nt, Human
agaaaaacacagcaaaga

SEQ ID NO: 190180 - RNA, 26 nt, Human
aggaagacagucuucagaccccgaag

SEQ ID NO: 190181 - RNA, 25 nt, Human
agggaguaacagaagguuaacaggg

SEQ ID NO: 190182 - RNA, 19 nt, Human
cacugcacccucuuccugc

SEQ ID NO: 190183 - RNA, 21 nt, Human
cagaccccgagcaucagcaag

SEQ ID NO: 190184 - RNA, 23 nt, Human
cagaccccgagcaucagcaagaa

SEQ ID NO: 190185 - RNA, 19 nt, Human
caucacauugcccaugagc

SEQ ID NO: 190186 - RNA, 22 nt, Human
caucacauugcccaugagcccc

SEQ ID NO: 190187 - RNA, 27 nt, Human
ccacuggcgguggcggcggcggcggcg

SEQ ID NO: 190188 - RNA, 22 nt, Human
ccacuggcgguggcggcggcuu

SEQ ID NO: 190189 - RNA, 19 nt, Human
cccacgccggcacugcacc

SEQ ID NO: 190190 - RNA, 20 nt, Human
cccaugagcccauucuacuc

SEQ ID NO: 190191 - RNA, 25 nt, Human
ccccgccugcccgcacgcacgccca

SEQ ID NO: 190192 - RNA, 19 nt, Human
cccgcacgcacgcccagcg

SEQ ID NO: 190193 - RNA, 21 nt, Human
ccgagcaucagcaagaacacu

SEQ ID NO: 190194 - RNA, 19 nt, Human
ccucgcacgacucgccgcc

SEQ ID NO: 190195 - RNA, 20 nt, Human
cgccgcccccuuccugcgcc

SEQ ID NO: 190196 - RNA, 21 nt, Human
cgccuccgccucggccggccg

SEQ ID NO: 190197 - RNA, 22 nt, Human
cggcacugcacccucuuccugc

SEQ ID NO: 190198 - RNA, 21 nt, Human
cggcagcggcgguagcugagg

SEQ ID NO: 190199 - RNA, 22 nt, Human
cuaugggcaaacuugcucuaaa

SEQ ID NO: 190200 - RNA, 23 nt, Human
cucuugauuguguaucuguaacu

SEQ ID NO: 190201 - RNA, 26 nt, Human
cugaacugcuccucuccucagccgca

SEQ ID NO: 190202 - RNA, 22 nt, Human
cugcacccucuuccugcuucuc

SEQ ID NO: 190203 - RNA, 24 nt, Human
cuucucgucagcgcccccgccugc

SEQ ID NO: 190204 - RNA, 23 nt, Human
gaaccauuuagaaguggagaaaa

SEQ ID NO: 190205 - RNA, 26 nt, Human
gacucgccgcccccuuccugcgccuc

SEQ ID NO: 190206 - RNA, 18 nt, Human
gagcaucagcaagaacac

SEQ ID NO: 190207 - RNA, 24 nt, Human
gcaagaagcagauaggaagacagu

SEQ ID NO: 190208 - RNA, 18 nt, Human
gcccccgccugcccgcac

SEQ ID NO: 190209 - RNA, 24 nt, Human
gcgcugacccgccaggucgggguc

SEQ ID NO: 190210 - RNA, 19 nt, Human
gcggcggcggcagcggcgg

SEQ ID NO: 190211 - RNA, 20 nt, Human
gcggcggcggcggcggcagc

SEQ ID NO: 190212 - RNA, 20 nt, Human
gcgguggcggcggcggcggc

SEQ ID NO: 190213 - RNA, 19 nt, Human
ggagaaaaacacagcaaag

SEQ ID NO: 190214 - RNA, 23 nt, Human
ggcggcggcagcggcgguagcug

SEQ ID NO: 190215 - RNA, 25 nt, Human
ggcggcggcggcggcagcggcggua

SEQ ID NO: 190216 - RNA, 20 nt, Human
ggcgguggcggcggcggcgg

SEQ ID NO: 190217 - RNA, 23 nt, Human
ggcgguggcggcggcggcggcgg

SEQ ID NO: 190218 - RNA, 28 nt, Human
gggaguaacagaagguuaaccgguaccc

SEQ ID NO: 190219 - RNA, 25 nt, Human
gguggcggcggcggcggcggcagcg

SEQ ID NO: 190220 - RNA, 20 nt, Human
guggcggcggcggcggcggc

SEQ ID NO: 190221 - RNA, 21 nt, Human
guggcggcggcggcggcggca

SEQ ID NO: 190222 - RNA, 22 nt, Human
uaacaaacgaggaagaaaggaa

SEQ ID NO: 190223 - RNA, 23 nt, Human
uagaaguggagaaaaacacagca

SEQ ID NO: 190224 - RNA, 23 nt, Human
ucagcaagaacacucuugauugu

SEQ ID NO: 190225 - RNA, 22 nt, Human
ucgccgcccccuuccugcgccu

SEQ ID NO: 190226 - RNA, 19 nt, Human
ucuguuccagggcaaaacu

SEQ ID NO: 190227 - RNA, 22 nt, Human
ucuucagaccccgagcaucagc

SEQ ID NO: 190228 - RNA, 18 nt, Human
ugaguuugguaauuugca

SEQ ID NO: 190229 - RNA, 21 nt, Human
ugcccgcacgcacgcccagcg

SEQ ID NO: 190230 - RNA, 18 nt, Human
uggcggcggcggcggcgg

SEQ ID NO: 190231 - RNA, 18 nt, Human
uggcgguggcggcggcgg

SEQ ID NO: 190232 - RNA, 18 nt, Human
uucucccagggaguaaca

SEQ ID NO: 190233 - RNA, 21 nt, Human
uuggaauaaacaaauauugca

SEQ ID NO: 190234 - RNA, 22 nt, Human
aagccgccgcucggugucgggu

SEQ ID NO: 190235 - RNA, 22 nt, Human
aagggucacugagagccugaag

SEQ ID NO: 190236 - RNA, 20 nt, Human
aaguagcugggacugcaggc

SEQ ID NO: 190237 - RNA, 20 nt, Human
aaguagcugggacugcaggc

SEQ ID NO: 190238 - RNA, 23 nt, Human
aaugcaguggcaccaucauaguu

SEQ ID NO: 190239 - RNA, 27 nt, Human
acagagccucacucuaggauggcgaag

SEQ ID NO: 190240 - RNA, 24 nt, Human
acccaggcuggagugcaguggcgu

SEQ ID NO: 190241 - RNA, 22 nt, Human
acccagugggcagcacaggccc

SEQ ID NO: 190242 - RNA, 21 nt, Human
acggggcccugggagucaggg

SEQ ID NO: 190243 - RNA, 21 nt, Human
acuuuuuuuuuuuugugccag

SEQ ID NO: 190244 - RNA, 22 nt, Human
agaaguuacccagugggcagca

SEQ ID NO: 190245 - RNA, 20 nt, Human
agccaaaacugaagacuuac

SEQ ID NO: 190246 - RNA, 20 nt, Human
aggaccccaacccuaggcgc

SEQ ID NO: 190247 - RNA, 23 nt, Human
aggaccccaacccuaggcgccuc

SEQ ID NO: 190248 - RNA, 19 nt, Human
aggaggaggaggacaauaa

SEQ ID NO: 190249 - RNA, 22 nt, Human
aggaggaggaggacaauaagaa

SEQ ID NO: 190250 - RNA, 21 nt, Human
aggcaucugaagauuccagaa

SEQ ID NO: 190251 - RNA, 23 nt, Human
aggcaucugaagauuccagaagg

SEQ ID NO: 190252 - RNA, 19 nt, Human
aggccgagccaggaggagg

SEQ ID NO: 190253 - RNA, 18 nt, Human
aggcuggagugcaguggc

SEQ ID NO: 190254 - RNA, 19 nt, Human
agggaggccgagccaggag

SEQ ID NO: 190255 - RNA, 23 nt, Human
agugcaguggcguggugucagcu

SEQ ID NO: 190256 - RNA, 24 nt, Human
agugcaguggcguggugucagcuc

SEQ ID NO: 190257 - RNA, 18 nt, Human
auaguucacugcagccuu

SEQ ID NO: 190258 - RNA, 20 nt, Human
aucccggggaagccgccgcu

SEQ ID NO: 190259 - RNA, 22 nt, Human
augugguggauaagucacagcu

SEQ ID NO: 190260 - RNA, 25 nt, Human
auucugucacccaggcuggaaugca

SEQ ID NO: 190261 - RNA, 23 nt, Human
caaccuccaccucccagguucaa

SEQ ID NO: 190262 - RNA, 20 nt, Human
caagugaaucucgugccuca

SEQ ID NO: 190263 - RNA, 22 nt, Human
cacagcaaccuccaccucccag

SEQ ID NO: 190264 - RNA, 24 nt, Human
cacccaggcuggagugcaguggcg

SEQ ID NO: 190265 - RNA, 26 nt, Human
cagaaggaagggccagaggaggagau

SEQ ID NO: 190266 - RNA, 21 nt, Human
cagcugggacaacaggcuccc

SEQ ID NO: 190267 - RNA, 19 nt, Human
caucaugcccagccaaaac

SEQ ID NO: 190268 - RNA, 24 nt, Human
cauucugucacccaggcuggaaug

SEQ ID NO: 190269 - RNA, 22 nt, Human
cccaacccuaggcgccucuggc

SEQ ID NO: 190270 - RNA, 23 nt, Human
cccaaguagcugggacugcaggc

SEQ ID NO: 190271 - RNA, 25 nt, Human
cccaaguagcugggacugcaggcgc

SEQ ID NO: 190272 - RNA, 22 nt, Human
ccucccagguucaagugaaucu

SEQ ID NO: 190273 - RNA, 22 nt, Human
ccugagcgaggaccccaacccu

SEQ ID NO: 190274 - RNA, 19 nt, Human
cuaggauggcgaaggggca

SEQ ID NO: 190275 - RNA, 22 nt, Human
cucacagcaaccuccaccuccc

SEQ ID NO: 190276 - RNA, 27 nt, Human
cucacagcaaccuccaccucccagguu

SEQ ID NO: 190277 - RNA, 23 nt, Human
cucugugccugagcgaggacccc

SEQ ID NO: 190278 - RNA, 18 nt, Human
cugucacccaggcuggag

SEQ ID NO: 190279 - RNA, 24 nt, Human
cuuagccucccaaguagcugggac

SEQ ID NO: 190280 - RNA, 22 nt, Human
gcaaccuccaccucccagguuc

SEQ ID NO: 190281 - RNA, 21 nt, Human
gcgugcgcgucccucgauccc

SEQ ID NO: 190282 - RNA, 20 nt, Human
gcuggaaugcaguggcacca

SEQ ID NO: 190283 - RNA, 19 nt, Human
gcuggagugcaguggcgug

SEQ ID NO: 190284 - RNA, 24 nt, Human
ggacugcaggcgcucaccaucaug

SEQ ID NO: 190285 - RNA, 23 nt, Human
ggagauggcuuaacuuuuccaga

SEQ ID NO: 190286 - RNA, 18 nt, Human
ggcgaaggggcagugaga

SEQ ID NO: 190287 - RNA, 20 nt, Human
ggcuggagugcaguggcgug

SEQ ID NO: 190288 - RNA, 18 nt, Human
gggcccugggagucaggg

SEQ ID NO: 190289 - RNA, 23 nt, Human
gucucacugucacccaggcugga

SEQ ID NO: 190290 - RNA, 19 nt, Human
uaagaaggccuaacaggca

SEQ ID NO: 190291 - RNA, 18 nt, Human
uaagucacagcugaagag

SEQ ID NO: 190292 - RNA, 22 nt, Human
uaguucacugcagccuugaacu

SEQ ID NO: 190293 - RNA, 24 nt, Human
ucacagcaaccuccaccucccagg

SEQ ID NO: 190294 - RNA, 19 nt, Human
ucacccaggcuggaaugca

SEQ ID NO: 190295 - RNA, 24 nt, Human
ucacccaggcuggagugcaguggc

SEQ ID NO: 190296 - RNA, 18 nt, Human
ucacugcagccuugaacu

SEQ ID NO: 190297 - RNA, 21 nt, Human
ucacugcagccuugaacuggg

SEQ ID NO: 190298 - RNA, 22 nt, Human
ucauucugucacccaggcugga

SEQ ID NO: 190299 - RNA, 24 nt, Human
ucccaaguagcugggacugcaggc

SEQ ID NO: 190300 - RNA, 21 nt, Human
ucccagguucaagugaaucuc

SEQ ID NO: 190301 - RNA, 21 nt, Human
ucccagguucaagugaaucuc

SEQ ID NO: 190302 - RNA, 22 nt, Human
ucucacugucacccaggcugga

SEQ ID NO: 190303 - RNA, 24 nt, Human
ucucacugucacccaggcuggagu

SEQ ID NO: 190304 - RNA, 19 nt, Human
ucucugugccugagcgagg

SEQ ID NO: 190305 - RNA, 24 nt, Human
ucugucacccaggcuggaaugcag

SEQ ID NO: 190306 - RNA, 19 nt, Human
ugagacagagucucacugu

SEQ ID NO: 190307 - RNA, 22 nt, Human
ugagggaggccgagccaggagg

SEQ ID NO: 190308 - RNA, 21 nt, Human
ugcccagccaaaacugaagac

SEQ ID NO: 190309 - RNA, 24 nt, Human
ugccucagccuacggaacagcugg

SEQ ID NO: 190310 - RNA, 19 nt, Human
uggaaugcaguggcaccau

SEQ ID NO: 190311 - RNA, 26 nt, Human
uggagugcaguggcguggggcucuag

SEQ ID NO: 190312 - RNA, 22 nt, Human
uggagugcaguggcgugguguc

SEQ ID NO: 190313 - RNA, 23 nt, Human
uggagugcaguggcgugguguca

SEQ ID NO: 190314 - RNA, 19 nt, Human
uggcaccaucauaguucac

SEQ ID NO: 190315 - RNA, 24 nt, Human
uggcguggugucagcucacagcaa

SEQ ID NO: 190316 - RNA, 19 nt, Human
uggcuacuuuuuuuuuuuu

SEQ ID NO: 190317 - RNA, 21 nt, Human
ugggacugcaggcgcucacca

SEQ ID NO: 190318 - RNA, 24 nt, Human
ugggcuuagccucccaaguagcug

SEQ ID NO: 190319 - RNA, 21 nt, Human
ugucacccaggcuggagugca

SEQ ID NO: 190320 - RNA, 23 nt, Human
uucaagugaaucucgugccucag

SEQ ID NO: 190321 - RNA, 27 nt, Human
uucacugcagccuugaacugggcuccg

SEQ ID NO: 190322 - RNA, 22 nt, Human
uuucauucugucacccaggcug

SEQ ID NO: 190323 - RNA, 23 nt, Human
uuucauucugucacccaggcugg

SEQ ID NO: 190324 - RNA, 24 nt, Human
uuucauucugucacccaggcugga

SEQ ID NO: 190325 - RNA, 26 nt, Human
uuuuuuuuuuuugugccaggauuuca

SEQ ID NO: 190326 - RNA, 22 nt, Human
aaaaaaauguacacagaaaaaa

SEQ ID NO: 190327 - RNA, 24 nt, Human
aaauguacacagaaaaaaacgaca

SEQ ID NO: 190328 - RNA, 22 nt, Human
aacaucuuuuuuuuuuuuuuuu

SEQ ID NO: 190329 - RNA, 20 nt, Human
aagaaugaaggauggaggag

SEQ ID NO: 190330 - RNA, 23 nt, Human
aagaaugaaggauggaggaggaa

SEQ ID NO: 190331 - RNA, 18 nt, Human
acaaccaaaaaaccucag

SEQ ID NO: 190332 - RNA, 21 nt, Human
acagaaaaaaacgacaaccaa

SEQ ID NO: 190333 - RNA, 22 nt, Human
acagaaaaaaacgacaaccaaa

SEQ ID NO: 190334 - RNA, 24 nt, Human
acaguaacagucaaauacuagaga

SEQ ID NO: 190335 - RNA, 26 nt, Human
acauacacauguacauauaugugugu

SEQ ID NO: 190336 - RNA, 21 nt, Human
acauguacauauaugugugug

SEQ ID NO: 190337 - RNA, 23 nt, Human
aggaaaaaaauguacacagaaaa

SEQ ID NO: 190338 - RNA, 26 nt, Human
aggaaaaaaauguacacagaaaaaaa

SEQ ID NO: 190339 - RNA, 21 nt, Human
aggaggaauacuuaaggucua

SEQ ID NO: 190340 - RNA, 25 nt, Human
agucuuuuaaaauauauauguacau

SEQ ID NO: 190341 - RNA, 21 nt, Human
auacacauguacauauaugug

SEQ ID NO: 190342 - RNA, 30 nt, Human
auauguacauacacauguacauauaugugg

SEQ ID NO: 190343 - RNA, 19 nt, Human
aucgauucgccaaggacag

SEQ ID NO: 190344 - RNA, 20 nt, Human
aucuuaaaaaaaucuuagca

SEQ ID NO: 190345 - RNA, 18 nt, Human
auguacauauaugugugu

SEQ ID NO: 190346 - RNA, 25 nt, Human
caaccaaaaaaccucagauuuuauc

SEQ ID NO: 190347 - RNA, 21 nt, Human
caacucuagacaggaaguaac

SEQ ID NO: 190348 - RNA, 18 nt, Human
cacagaaaaaaacgacaa

SEQ ID NO: 190349 - RNA, 24 nt, Human
cacagaaccaaugaugucuucuga

SEQ ID NO: 190350 - RNA, 18 nt, Human
cacuccugugaggucauc

SEQ ID NO: 190351 - RNA, 18 nt, Human
cagcgccauugucuucug

SEQ ID NO: 190352 - RNA, 25 nt, Human
cagcgccauugucuucugacaaaau

SEQ ID NO: 190353 - RNA, 23 nt, Human
caggaacaaaauauggcacgaag

SEQ ID NO: 190354 - RNA, 22 nt, Human
caggaaguaacuaacuggguug

SEQ ID NO: 190355 - RNA, 20 nt, Human
cagggacuccaaaccacaaa

SEQ ID NO: 190356 - RNA, 20 nt, Human
cauacacauguacauauaug

SEQ ID NO: 190357 - RNA, 21 nt, Human
cauaguucucucaaucucaca

SEQ ID NO: 190358 - RNA, 24 nt, Human
cauguacauauaugugugugugug

SEQ ID NO: 190359 - RNA, 21 nt, Human
cauuugcacucaaagaaaaac

SEQ ID NO: 190360 - RNA, 22 nt, Human
ccaucuuaaaaaaaucuuagca

SEQ ID NO: 190361 - RNA, 19 nt, Human
cccuucuuuccuuucaguc

SEQ ID NO: 190362 - RNA, 21 nt, Human
ccugugccauaaacuuaggaa

SEQ ID NO: 190363 - RNA, 19 nt, Human
cgcagcaguagccaccgcc

SEQ ID NO: 190364 - RNA, 18 nt, Human
cucugggaguuggcgugg

SEQ ID NO: 190365 - RNA, 25 nt, Human
cugacaacuguuuccugaugguuga

SEQ ID NO: 190366 - RNA, 27 nt, Human
cuuaggaaaaaaauguacacagaaaaa

SEQ ID NO: 190367 - RNA, 24 nt, Human
cuuuuuuuuuuuuuuuuugcacuu

SEQ ID NO: 190368 - RNA, 20 nt, Human
gaaacacagaaccaaugaug

SEQ ID NO: 190369 - RNA, 24 nt, Human
gaaggauggaggaggaauacuuaa

SEQ ID NO: 190370 - RNA, 18 nt, Human
gagcaacagucucccuuu

SEQ ID NO: 190371 - RNA, 23 nt, Human
gcgccauugucuucugacaaaau

SEQ ID NO: 190372 - RNA, 21 nt, Human
ggucgaguuccgcugcgcuuc

SEQ ID NO: 190373 - RNA, 22 nt, Human
guacauauaugugugugugugu

SEQ ID NO: 190374 - RNA, 20 nt, Human
uacacagaaaaaaacgacaa

SEQ ID NO: 190375 - RNA, 23 nt, Human
uacacagaaaaaaacgacaacca

SEQ ID NO: 190376 - RNA, 18 nt, Human
uacacauguacauauaug

SEQ ID NO: 190377 - RNA, 20 nt, Human
uacauacacauguacauaua

SEQ ID NO: 190378 - RNA, 20 nt, Human
uacauacacauguacauaua

SEQ ID NO: 190379 - RNA, 24 nt, Human
uacauauauguguguguguguaua

SEQ ID NO: 190380 - RNA, 21 nt, Human
uacccugugccauaaacuuag

SEQ ID NO: 190381 - RNA, 20 nt, Human
uauguacauacacauguaca

SEQ ID NO: 190382 - RNA, 20 nt, Human
ucaaaagcaguuccugagca

SEQ ID NO: 190383 - RNA, 20 nt, Human
ucaaagaaaaacaugcagcg

SEQ ID NO: 190384 - RNA, 22 nt, Human
ucaaagaaaaacaugcagcgcc

SEQ ID NO: 190385 - RNA, 23 nt, Human
ucaaucucacaaaaccuguaagc

SEQ ID NO: 190386 - RNA, 21 nt, Human
ucccuucuuuccuuucagucu

SEQ ID NO: 190387 - RNA, 18 nt, Human
uccggucgaguuccgcug

SEQ ID NO: 190388 - RNA, 20 nt, Human
uccguaggaaacacagaacc

SEQ ID NO: 190389 - RNA, 23 nt, Human
uccguaggaaacacagaaccaau

SEQ ID NO: 190390 - RNA, 19 nt, Human
ucuucuaaagaggugaaaa

SEQ ID NO: 190391 - RNA, 22 nt, Human
ucuucugacaacuguuuccuga

SEQ ID NO: 190392 - RNA, 21 nt, Human
ucuuuuuuuuuuuuuuuuugg

SEQ ID NO: 190393 - RNA, 25 nt, Human
ugaaucaaaagcaguuccugagcaa

SEQ ID NO: 190394 - RNA, 22 nt, Human
ugccauaaacuuaggaaaaaaa

SEQ ID NO: 190395 - RNA, 25 nt, Human
uggaggaggaauacuuaaggucuac

SEQ ID NO: 190396 - RNA, 19 nt, Human
uggcuagaaggugcaggug

SEQ ID NO: 190397 - RNA, 19 nt, Human
ugggaagaggccgaaaccc

SEQ ID NO: 190398 - RNA, 22 nt, Human
ugggaagaggccgaaacccagu

SEQ ID NO: 190399 - RNA, 23 nt, Human
ugggaagaggccgaaacccagug

SEQ ID NO: 190400 - RNA, 20 nt, Human
uguacacagaaaaaaacgac

SEQ ID NO: 190401 - RNA, 23 nt, Human
ugucaggccagguuuccagaguu

SEQ ID NO: 190402 - RNA, 23 nt, Human
ugucuuaauuuaccuccccagca

SEQ ID NO: 190403 - RNA, 18 nt, Human
uguguguauauauauaua

SEQ ID NO: 190404 - RNA, 18 nt, Human
uguguguguauauauaua

SEQ ID NO: 190405 - RNA, 18 nt, Human
uguguguguauauauaua

SEQ ID NO: 190406 - RNA, 23 nt, Human
uguguguguguauauauauauau

SEQ ID NO: 190407 - RNA, 23 nt, Human
uguguguguguguauauauauau

SEQ ID NO: 190408 - RNA, 27 nt, Human
uguguguguguguauauauauauauuu

SEQ ID NO: 190409 - RNA, 19 nt, Human
uuaacuugcugauguaagg

SEQ ID NO: 190410 - RNA, 22 nt, Human
uuagucccuucuuuccuuucag

SEQ ID NO: 190411 - RNA, 18 nt, Human
uucagggacuccaaacca

SEQ ID NO: 190412 - RNA, 23 nt, Human
uuccugagcaacugcaguaaaca

SEQ ID NO: 190413 - RNA, 18 nt, Human
uuggcguggagcagaugu

SEQ ID NO: 190414 - RNA, 21 nt, Human
uuuuuuuuuuuuuugcacuua

SEQ ID NO: 190415 - RNA, 19 nt, Human
uuuuuuuuuuuuuuuuuaa

SEQ ID NO: 190416 - RNA, 19 nt, Human
aaaaaucuggugagauuca

SEQ ID NO: 190417 - RNA, 22 nt, Human
aaaauagaagcaacacauaaaa

SEQ ID NO: 190418 - RNA, 25 nt, Human
aacaccguaacucaaggcucugcug

SEQ ID NO: 190419 - RNA, 19 nt, Human
aacauaggaaccaugagag

SEQ ID NO: 190420 - RNA, 21 nt, Human
aagaagaacuaggaaauaaug

SEQ ID NO: 190421 - RNA, 20 nt, Human
aauagaagcaacacauaaaa

SEQ ID NO: 190422 - RNA, 20 nt, Human
aauccucaacccgaucuuca

SEQ ID NO: 190423 - RNA, 24 nt, Human
acaccguaacucaaggcucugcug

SEQ ID NO: 190424 - RNA, 21 nt, Human
accagccauuccagacccaca

SEQ ID NO: 190425 - RNA, 24 nt, Human
acugaacuaucacaggaauuuuuc

SEQ ID NO: 190426 - RNA, 22 nt, Human
agagguugcauccuuagccccc

SEQ ID NO: 190427 - RNA, 27 nt, Human
aggaaccaugagagauagccgguaccc

SEQ ID NO: 190428 - RNA, 18 nt, Human
aggaacuguucacucagu

SEQ ID NO: 190429 - RNA, 21 nt, Human
aggcagaggccggggugaccg

SEQ ID NO: 190430 - RNA, 22 nt, Human
aggcagggccucgcucagcgcc

SEQ ID NO: 190431 - RNA, 24 nt, Human
aggcagggccucgcucagcgccuu

SEQ ID NO: 190432 - RNA, 22 nt, Human
auaaugccggccacgcgacccc

SEQ ID NO: 190433 - RNA, 18 nt, Human
auuccugucauuuucccu

SEQ ID NO: 190434 - RNA, 24 nt, Human
caacaaauaguggaaaauaugcaa

SEQ ID NO: 190435 - RNA, 22 nt, Human
caagaagaacuaggaaauaaug

SEQ ID NO: 190436 - RNA, 19 nt, Human
caccagccauuccagaccc

SEQ ID NO: 190437 - RNA, 26 nt, Human
caccgccgcauggccgccccgcaggc

SEQ ID NO: 190438 - RNA, 22 nt, Human
cagcauugcuguaaaauccuga

SEQ ID NO: 190439 - RNA, 20 nt, Human
caggucccgcgauguugggg

SEQ ID NO: 190440 - RNA, 22 nt, Human
cauuucuaucuaaaaguagaaa

SEQ ID NO: 190441 - RNA, 22 nt, Human
ccaauccucaacccgaucuuca

SEQ ID NO: 190442 - RNA, 23 nt, Human
ccaauccucaacccgaucuucaa

SEQ ID NO: 190443 - RNA, 18 nt, Human
cccacagucacucugcuc

SEQ ID NO: 190444 - RNA, 19 nt, Human
ccccaauccucaacccgau

SEQ ID NO: 190445 - RNA, 18 nt, Human
ccccgcgcuggcaccucc

SEQ ID NO: 190446 - RNA, 19 nt, Human
ccccuuuucucugcucucc

SEQ ID NO: 190447 - RNA, 21 nt, Human
ccccuuuucucugcucuccca

SEQ ID NO: 190448 - RNA, 19 nt, Human
ccgccuccaggcagcuccg

SEQ ID NO: 190449 - RNA, 19 nt, Human
ccgccuccaggcagcuccg

SEQ ID NO: 190450 - RNA, 20 nt, Human
ccgcgcgcgggcugcggccg

SEQ ID NO: 190451 - RNA, 26 nt, Human
ccgguggccccuuuucucugcucucc

SEQ ID NO: 190452 - RNA, 19 nt, Human
ccugaccccuccucacucc

SEQ ID NO: 190453 - RNA, 29 nt, Human
ccugaccccuccucacuccccgcgcuggc

SEQ ID NO: 190454 - RNA, 21 nt, Human
ccugucaccgccgcauggccg

SEQ ID NO: 190455 - RNA, 23 nt, Human
cgucagagguugcauccuuagcc

SEQ ID NO: 190456 - RNA, 19 nt, Human
cucucacccuccuccuccu

SEQ ID NO: 190457 - RNA, 25 nt, Human
cucugcucucccagcuucucucuca

SEQ ID NO: 190458 - RNA, 22 nt, Human
gaaaauaugcaaucucuuuuuc

SEQ ID NO: 190459 - RNA, 26 nt, Human
gaacgucagagguugcauccuuagcc

SEQ ID NO: 190460 - RNA, 20 nt, Human
gaacugaacuaucacaggaa

SEQ ID NO: 190461 - RNA, 20 nt, Human
gaccgcggcaggcgggcggc

SEQ ID NO: 190462 - RNA, 18 nt, Human
gagagggggcgaggggcc

SEQ ID NO: 190463 - RNA, 24 nt, Human
gagccuagcuucuuguagagcugg

SEQ ID NO: 190464 - RNA, 18 nt, Human
gaucuucaacuucuggua

SEQ ID NO: 190465 - RNA, 26 nt, Human
gcagcuccggggccggggccucgugc

SEQ ID NO: 190466 - RNA, 20 nt, Human
gccgccgcggagcagccucg

SEQ ID NO: 190467 - RNA, 18 nt, Human
gccgggggugccgagggg

SEQ ID NO: 190468 - RNA, 18 nt, Human
gcgaccgguggccccuuu

SEQ ID NO: 190469 - RNA, 20 nt, Human
gcgcgugcggggaagcgggg

SEQ ID NO: 190470 - RNA, 20 nt, Human
gcgcgugcggggaagcgggg

SEQ ID NO: 190471 - RNA, 22 nt, Human
gcggccgccuccaggcagcucc

SEQ ID NO: 190472 - RNA, 22 nt, Human
gcggccgccuccaggcagcucc

SEQ ID NO: 190473 - RNA, 23 nt, Human
gcgggcugcggccgccgcggagc

SEQ ID NO: 190474 - RNA, 22 nt, Human
gggccgggggugccgaggggag

SEQ ID NO: 190475 - RNA, 23 nt, Human
gggcugcggccgccgcggagcag

SEQ ID NO: 190476 - RNA, 24 nt, Human
ggggagcuggcgagcggacgggag

SEQ ID NO: 190477 - RNA, 21 nt, Human
gggggcgaggggcccgugcgu

SEQ ID NO: 190478 - RNA, 19 nt, Human
gguccgaaaagcucuucuc

SEQ ID NO: 190479 - RNA, 28 nt, Human
uaaaauagaauaaacauacaacaaauag

SEQ ID NO: 190480 - RNA, 19 nt, Human
uaaggagagccgugaacaa

SEQ ID NO: 190481 - RNA, 21 nt, Human
uaauucacacgcugagauacu

SEQ ID NO: 190482 - RNA, 20 nt, Human
uacaccagccauuccagacc

SEQ ID NO: 190483 - RNA, 21 nt, Human
uagaaaaacuaaagaacugaa

SEQ ID NO: 190484 - RNA, 22 nt, Human
uagaagguauuucuguuauaca

SEQ ID NO: 190485 - RNA, 24 nt, Human
uagaauaaacauacaacaaauagu

SEQ ID NO: 190486 - RNA, 27 nt, Human
uagcccccugaccccuccucacucccu

SEQ ID NO: 190487 - RNA, 20 nt, Human
uaggaaauaaugccggccac

SEQ ID NO: 190488 - RNA, 23 nt, Human
uauaaaauagaauaaacauacaa

SEQ ID NO: 190489 - RNA, 24 nt, Human
uauuacacagcuugggguaguaac

SEQ ID NO: 190490 - RNA, 24 nt, Human
ucacugggggacagaggcagaggc

SEQ ID NO: 190491 - RNA, 22 nt, Human
ucaucgagcuagccccaauccu

SEQ ID NO: 190492 - RNA, 22 nt, Human
uccccgagugcggccgccucca

SEQ ID NO: 190493 - RNA, 22 nt, Human
uccccgagugcggccgccucca

SEQ ID NO: 190494 - RNA, 21 nt, Human
uccgaaaagcucuucucaacc

SEQ ID NO: 190495 - RNA, 23 nt, Human
uccgcgccacagcaggucccgcg

SEQ ID NO: 190496 - RNA, 24 nt, Human
uccgcgccacagcaggucccgcga

SEQ ID NO: 190497 - RNA, 22 nt, Human
uccucaacccgaucuucaacuu

SEQ ID NO: 190498 - RNA, 26 nt, Human
ucuaaaaguagaaaaaaagguuugua

SEQ ID NO: 190499 - RNA, 18 nt, Human
ucucucacccuccuccuc

SEQ ID NO: 190500 - RNA, 21 nt, Human
ucuggugagauucauuccugu

SEQ ID NO: 190501 - RNA, 20 nt, Human
ugaggggagcuggcgagcgg

SEQ ID NO: 190502 - RNA, 18 nt, Human
ugcggggaagcggggggg

SEQ ID NO: 190503 - RNA, 24 nt, Human
ugcuugugaaaucucaacacaugu

SEQ ID NO: 190504 - RNA, 18 nt, Human
ugggggacagaggcagag

SEQ ID NO: 190505 - RNA, 19 nt, Human
uguuauacaaguauauuac

SEQ ID NO: 190506 - RNA, 20 nt, Human
uguuauacaaguauauuaca

SEQ ID NO: 190507 - RNA, 23 nt, Human
uuccaaauaagguguuuuaagga

SEQ ID NO: 190508 - RNA, 18 nt, Human
uuccagacccacagucac

SEQ ID NO: 190509 - RNA, 22 nt, Human
uuccugucauuuucccugucau

SEQ ID NO: 190510 - RNA, 26 nt, Human
uucucugcucucccagcuucucucuc

SEQ ID NO: 190511 - RNA, 28 nt, Human
uuucccagcauugcuguaaaauccugag

SEQ ID NO: 190512 - RNA, 21 nt, Human
uuuuuuuuuuuuuuuuaccaa

SEQ ID NO: 190513 - RNA, 24 nt, Human
uuuuuuuuuuuuuuuuuaccaagg

SEQ ID NO: 190514 - RNA, 20 nt, Human
agggggcgcggggggggaau

SEQ ID NO: 190515 - RNA, 20 nt, Human
auauccgaauauacauuuug

SEQ ID NO: 190516 - RNA, 20 nt, Human
caacaccacccuccauuggc

SEQ ID NO: 190517 - RNA, 21 nt, Human
ccagccccgcgcaacaccacc

SEQ ID NO: 190518 - RNA, 21 nt, Human
ccccgcgcaacaccacccucc

SEQ ID NO: 190519 - RNA, 19 nt, Human
ccccggccccggcccgcgg

SEQ ID NO: 190520 - RNA, 22 nt, Human
ccccggcccgcggccaggacuc

SEQ ID NO: 190521 - RNA, 21 nt, Human
cccgcgcaacaccacccucca

SEQ ID NO: 190522 - RNA, 27 nt, Human
cccggccccggcccgcggccaggacuc

SEQ ID NO: 190523 - RNA, 27 nt, Human
cccggcccuaaucccagccccgcgcaa

SEQ ID NO: 190524 - RNA, 18 nt, Human
ccuccugccgcugccucc

SEQ ID NO: 190525 - RNA, 26 nt, Human
ccugccagcggcgccccggccccggc

SEQ ID NO: 190526 - RNA, 21 nt, Human
cgccccggcccuaaucccagc

SEQ ID NO: 190527 - RNA, 22 nt, Human
cggcggcgcggcgagggcgggg

SEQ ID NO: 190528 - RNA, 20 nt, Human
cggggagaggagcggagagc

SEQ ID NO: 190529 - RNA, 19 nt, Human
cggggagggggcgcggggg

SEQ ID NO: 190530 - RNA, 20 nt, Human
cugcggcggagggcggggcg

SEQ ID NO: 190531 - RNA, 22 nt, Human
cugcggcggagggcggggcggc

SEQ ID NO: 190532 - RNA, 22 nt, Human
gagggggcgcggggggggaauc

SEQ ID NO: 190533 - RNA, 22 nt, Human
gccccggcccuaaucccagccc

SEQ ID NO: 190534 - RNA, 19 nt, Human
gcggcgcggggagaggagc

SEQ ID NO: 190535 - RNA, 22 nt, Human
gcuggcgcucggcggcccccac

SEQ ID NO: 190536 - RNA, 19 nt, Human
ggaaucggccggccggggg

SEQ ID NO: 190537 - RNA, 21 nt, Human
ggagaggcagagggaggcgag

SEQ ID NO: 190538 - RNA, 20 nt, Human
ggagggaggcgcggggaggg

SEQ ID NO: 190539 - RNA, 20 nt, Human
ggagggaggcgcggggaggg

SEQ ID NO: 190540 - RNA, 20 nt, Human
ggagggggcgcgggggggga

SEQ ID NO: 190541 - RNA, 18 nt, Human
gggaaggagaggcagagg

SEQ ID NO: 190542 - RNA, 21 nt, Human
gggcggcgcggggagaggagc

SEQ ID NO: 190543 - RNA, 23 nt, Human
ggggaaggagaggcagagggagg

SEQ ID NO: 190544 - RNA, 18 nt, Human
ggggagaggagcggagag

SEQ ID NO: 190545 - RNA, 19 nt, Human
ggggagggaggcgcgggga

SEQ ID NO: 190546 - RNA, 23 nt, Human
ggggagggaggcgcggggagggg

SEQ ID NO: 190547 - RNA, 21 nt, Human
ggggagggggcgcgggggggg

SEQ ID NO: 190548 - RNA, 20 nt, Human
ucugagugagguccugauuc

SEQ ID NO: 190549 - RNA, 23 nt, Human
ucuguaaucccaguaagauugcc

SEQ ID NO: 190550 - RNA, 23 nt, Human
ugagugagguccugauucaguac

SEQ ID NO: 190551 - RNA, 21 nt, Human
uguaaucccaguaagauugcc

SEQ ID NO: 190552 - RNA, 20 nt, Human
uuaaaaaggccuugguggca

SEQ ID NO: 190553 - RNA, 19 nt, Human
uucgccccggcccuaaucc

SEQ ID NO: 190554 - RNA, 21 nt, Human
uuggaaaaacuaaaaggcauc

SEQ ID NO: 190555 - RNA, 27 nt, Human
uuuuuuuuuuuuuuuuuacuuauuuaa

SEQ ID NO: 190556 - RNA, 27 nt, Human
aauaaagaaaagcaugcucugagagaa

SEQ ID NO: 190557 - RNA, 22 nt, Human
cgacuccuuggucugcaguccu

SEQ ID NO: 190558 - RNA, 22 nt, Human
uaaagaaaagcaugcucugaga

SEQ ID NO: 190559 - RNA, 20 nt, Human
aggcaggcagugggcaagcc

SEQ ID NO: 190560 - RNA, 18 nt, Human
aggccuccagucacccag

SEQ ID NO: 190561 - RNA, 19 nt, Human
agguugagcugcugggagu

SEQ ID NO: 190562 - RNA, 21 nt, Human
cauggguggcccuuucugcag

SEQ ID NO: 190563 - RNA, 22 nt, Human
ccuccccgggcugcuccucccg

SEQ ID NO: 190564 - RNA, 24 nt, Human
cuccucccgacuggaccaggguag

SEQ ID NO: 190565 - RNA, 20 nt, Human
ggagaaaagagcuucccugc

SEQ ID NO: 190566 - RNA, 23 nt, Human
ggaggcaggcagugggcaagccc

SEQ ID NO: 190567 - RNA, 18 nt, Human
ggggaggcaggcaguggg

SEQ ID NO: 190568 - RNA, 19 nt, Human
uccccgggcugcuccuccc

SEQ ID NO: 190569 - RNA, 20 nt, Human
ugaaguggcagggaaggaca

SEQ ID NO: 190570 - RNA, 21 nt, Human
ugcuccucccgacuggaccag

SEQ ID NO: 190571 - RNA, 22 nt, Human
ugcugggaguggaguaucaugg

SEQ ID NO: 190572 - RNA, 20 nt, Human
ugggaguggaguaucauggg

SEQ ID NO: 190573 - RNA, 22 nt, Human
caggggccucccccuccaacuc

SEQ ID NO: 190574 - RNA, 18 nt, Human
ccccuccaacucuauguc

SEQ ID NO: 190575 - RNA, 20 nt, Human
ccucaggggccucccccucc

SEQ ID NO: 190576 - RNA, 23 nt, Human
cuuuguaccagauccagcugcuc

SEQ ID NO: 190577 - RNA, 24 nt, Human
gcugccucaggggccucccccucc

SEQ ID NO: 190578 - RNA, 24 nt, Human
gcugcucaggcccuggaagggugg

SEQ ID NO: 190579 - RNA, 20 nt, Human
ggauggaagccugccagggu

SEQ ID NO: 190580 - RNA, 20 nt, Human
ggcccuggaaggguggugau

SEQ ID NO: 190581 - RNA, 19 nt, Human
gggccucccccuccaacuc

SEQ ID NO: 190582 - RNA, 23 nt, Human
uauguccgauugcuuuguaccag

SEQ ID NO: 190583 - RNA, 20 nt, Human
ucaggagcugggcugccuca

SEQ ID NO: 190584 - RNA, 18 nt, Human
uccaacucuauguccgau

SEQ ID NO: 190585 - RNA, 21 nt, Human
ugaagggcgaggugucccugg

SEQ ID NO: 190586 - RNA, 23 nt, Human
ugccucaggggccucccccucca

SEQ ID NO: 190587 - RNA, 20 nt, Human
uggaagccugccaggguggu

SEQ ID NO: 190588 - RNA, 24 nt, Human
uguagaaucuuuauucaggagcug

SEQ ID NO: 190589 - RNA, 22 nt, Human
aaacaagaaaacauggaaucua

SEQ ID NO: 190590 - RNA, 22 nt, Human
accacucauaugaauggacaca

SEQ ID NO: 190591 - RNA, 24 nt, Human
acggggaggcuccgagagugugug

SEQ ID NO: 190592 - RNA, 21 nt, Human
agcgacaacguuaagcgcguc

SEQ ID NO: 190593 - RNA, 20 nt, Human
agcggcggcggaggcggcgg

SEQ ID NO: 190594 - RNA, 21 nt, Human
aggcggcgguggcgggaccgg

SEQ ID NO: 190595 - RNA, 20 nt, Human
auauauguguauauauauga

SEQ ID NO: 190596 - RNA, 21 nt, Human
aucucuuuccaccccccauug

SEQ ID NO: 190597 - RNA, 22 nt, Human
aucuuauuucccucauccuccg

SEQ ID NO: 190598 - RNA, 19 nt, Human
caaagcaaugaaagagaca

SEQ ID NO: 190599 - RNA, 25 nt, Human
caacaaagcaaugaaagagacacaa

SEQ ID NO: 190600 - RNA, 21 nt, Human
cacaaucucuuuccacccccc

SEQ ID NO: 190601 - RNA, 26 nt, Human
cacucauaugaauggacacaucuuau

SEQ ID NO: 190602 - RNA, 27 nt, Human
cagcggucaccuccaccuuuuaguagg

SEQ ID NO: 190603 - RNA, 22 nt, Human
ccccggggccgcggagcccccc

SEQ ID NO: 190604 - RNA, 20 nt, Human
ccgccucagcgcccgccucg

SEQ ID NO: 190605 - RNA, 18 nt, Human
cgccgcgcucccgcucac

SEQ ID NO: 190606 - RNA, 19 nt, Human
cggcgccgccucagcgccc

SEQ ID NO: 190607 - RNA, 20 nt, Human
cgggcugggcugggggccgc

SEQ ID NO: 190608 - RNA, 20 nt, Human
cgucggggccgcggggcgcu

SEQ ID NO: 190609 - RNA, 20 nt, Human
gacacaucuuauuucccuca

SEQ ID NO: 190610 - RNA, 22 nt, Human
gagccccccgagccggcugcuc

SEQ ID NO: 190611 - RNA, 20 nt, Human
gccgggcugggcugggggcc

SEQ ID NO: 190612 - RNA, 19 nt, Human
gcgaggacgcgagcggcgg

SEQ ID NO: 190613 - RNA, 19 nt, Human
gcgcaucgccgugcgccgc

SEQ ID NO: 190614 - RNA, 23 nt, Human
gcggccgaggcgguggcggcgac

SEQ ID NO: 190615 - RNA, 18 nt, Human
gcggcggcgccgggcugg

SEQ ID NO: 190616 - RNA, 18 nt, Human
gcggcggcggaggcggcg

SEQ ID NO: 190617 - RNA, 23 nt, Human
gcggcggcggaggcggcgguggc

SEQ ID NO: 190618 - RNA, 18 nt, Human
gcgggaacuuggggcgcc

SEQ ID NO: 190619 - RNA, 21 nt, Human
ggaggcggcgguggcgggacc

SEQ ID NO: 190620 - RNA, 20 nt, Human
ggccgaggcgguggcggcga

SEQ ID NO: 190621 - RNA, 24 nt, Human
ggccgccgccgccucugcugcugc

SEQ ID NO: 190622 - RNA, 23 nt, Human
ggcggcggaggcggcgguggcgg

SEQ ID NO: 190623 - RNA, 22 nt, Human
ggcggcgguggcgggaccggca

SEQ ID NO: 190624 - RNA, 20 nt, Human
ggcugggcugggggccgccg

SEQ ID NO: 190625 - RNA, 20 nt, Human
gggcccgggcucggcggcgg

SEQ ID NO: 190626 - RNA, 19 nt, Human
gggcggggagggcugcggc

SEQ ID NO: 190627 - RNA, 18 nt, Human
gggcugggcugggggccg

SEQ ID NO: 190628 - RNA, 21 nt, Human
uauauguguauauauaugacc

SEQ ID NO: 190629 - RNA, 18 nt, Human
uauguguauauauaugac

SEQ ID NO: 190630 - RNA, 21 nt, Human
ucaacaaagcaaugaaagaga

SEQ ID NO: 190631 - RNA, 20 nt, Human
ucugcugcugcucgcgcggc

SEQ ID NO: 190632 - RNA, 20 nt, Human
ugauaaacaagaaaacaugg

SEQ ID NO: 190633 - RNA, 22 nt, Human
uggacacaucuuauuucccuca

SEQ ID NO: 190634 - RNA, 18 nt, Human
ugguuaguucugaaaggg

SEQ ID NO: 190635 - RNA, 21 nt, Human
uguaugugugauaaacaagaa

SEQ ID NO: 190636 - RNA, 24 nt, Human
uucugggcuugugcuuuuuggagg

SEQ ID NO: 190637 - RNA, 23 nt, Human
uuuccaccccccauuggugaccc

SEQ ID NO: 190638 - RNA, 19 nt, Human
uuuugcugcuuguucucaa

SEQ ID NO: 190639 - RNA, 21 nt, Human
aacugaguccuggucucugca

SEQ ID NO: 190640 - RNA, 22 nt, Human
aagauugugacuuggcuccuga

SEQ ID NO: 190641 - RNA, 20 nt, Human
aggcgacagggugcagacag

SEQ ID NO: 190642 - RNA, 22 nt, Human
aggcgcggagaccgcgguggcc

SEQ ID NO: 190643 - RNA, 20 nt, Human
aggcgcucccucccccacag

SEQ ID NO: 190644 - RNA, 23 nt, Human
agggcaggggaacugaguccugg

SEQ ID NO: 190645 - RNA, 18 nt, Human
aggggaacugaguccugg

SEQ ID NO: 190646 - RNA, 21 nt, Human
agguguccuccgccugggucu

SEQ ID NO: 190647 - RNA, 21 nt, Human
caaacacacuuuaauaaccau

SEQ ID NO: 190648 - RNA, 28 nt, Human
caaacagaagccacuaucaaucaacggg

SEQ ID NO: 190649 - RNA, 18 nt, Human
caaugagucaaaccccaa

SEQ ID NO: 190650 - RNA, 22 nt, Human
caccauggugagaucacgcccg

SEQ ID NO: 190651 - RNA, 18 nt, Human
caccucggggcugugcuu

SEQ ID NO: 190652 - RNA, 22 nt, Human
cacuaggcucagacuagggcag

SEQ ID NO: 190653 - RNA, 18 nt, Human
cagcucaggcgacagggu

SEQ ID NO: 190654 - RNA, 21 nt, Human
cagguguccuccgccuggguc

SEQ ID NO: 190655 - RNA, 25 nt, Human
cagguguccuccgccugggucuguu

SEQ ID NO: 190656 - RNA, 22 nt, Human
cccacagguguccuccgccugg

SEQ ID NO: 190657 - RNA, 21 nt, Human
ccccaaagacuuauaaauagg

SEQ ID NO: 190658 - RNA, 28 nt, Human
cccccugcucacgcuuucuccaagagcc

SEQ ID NO: 190659 - RNA, 21 nt, Human
cccugcugcgaucuccuccug

SEQ ID NO: 190660 - RNA, 18 nt, Human
ccggaucucuagcagcuc

SEQ ID NO: 190661 - RNA, 20 nt, Human
ccuccaggcgcucccucccc

SEQ ID NO: 190662 - RNA, 22 nt, Human
ccugcucacgcuuucuccaaga

SEQ ID NO: 190663 - RNA, 21 nt, Human
ccugcugcgaucuccuccuga

SEQ ID NO: 190664 - RNA, 23 nt, Human
cgacacuaucacaaacacacuuu

SEQ ID NO: 190665 - RNA, 21 nt, Human
cucccucccccacaggugucc

SEQ ID NO: 190666 - RNA, 21 nt, Human
cucugcacugaaaccugcuuc

SEQ ID NO: 190667 - RNA, 19 nt, Human
gccugggucuguuccaggc

SEQ ID NO: 190668 - RNA, 22 nt, Human
gcuuccggaucucuagcagcuc

SEQ ID NO: 190669 - RNA, 24 nt, Human
gcuuccggaucucuagcagcucca

SEQ ID NO: 190670 - RNA, 18 nt, Human
ggagaccgcgguggcccc

SEQ ID NO: 190671 - RNA, 20 nt, Human
ggugucucuuacccugcugc

SEQ ID NO: 190672 - RNA, 19 nt, Human
gugcagacaggcgcggagg

SEQ ID NO: 190673 - RNA, 24 nt, Human
uagggcaggggaacugaguccugg

SEQ ID NO: 190674 - RNA, 22 nt, Human
ucagacuagggcaggggaacug

SEQ ID NO: 190675 - RNA, 24 nt, Human
ucagaggcucuacacaucuucaag

SEQ ID NO: 190676 - RNA, 22 nt, Human
uccuccaggcgcucccuccccc

SEQ ID NO: 190677 - RNA, 18 nt, Human
ucgcaaauccgcaccaug

SEQ ID NO: 190678 - RNA, 18 nt, Human
ucgcugcucuagcgcagg

SEQ ID NO: 190679 - RNA, 19 nt, Human
ugacuacaauuaucugaua

SEQ ID NO: 190680 - RNA, 19 nt, Human
ugacucugagcugaguccc

SEQ ID NO: 190681 - RNA, 21 nt, Human
ugacucugagcugagucccuc

SEQ ID NO: 190682 - RNA, 23 nt, Human
ugagauugcaggugacuccauca

SEQ ID NO: 190683 - RNA, 24 nt, Human
ugcuuucagaggcucuacacaucu

SEQ ID NO: 190684 - RNA, 26 nt, Human
uuaagguuuuuuuuuuuuuucuugaa

SEQ ID NO: 190685 - RNA, 18 nt, Human
uuucuugaagagcugaag

SEQ ID NO: 190686 - RNA, 20 nt, Human
uuuuuuuuucuugaagagcu

SEQ ID NO: 190687 - RNA, 20 nt, Human
uuuuuuuuuucuugaagagc

SEQ ID NO: 190688 - RNA, 18 nt, Human
uuuuuuuuuuuuuucuug

SEQ ID NO: 190689 - RNA, 20 nt, Human
aauccauacauguuccugcc

SEQ ID NO: 190690 - RNA, 26 nt, Human
acaaaacacagaaaccagacggcaaa

SEQ ID NO: 190691 - RNA, 23 nt, Human
acaaaucauuccccagcuaccag

SEQ ID NO: 190692 - RNA, 25 nt, Human
acgcccagagaagaaccuugaagac

SEQ ID NO: 190693 - RNA, 21 nt, Human
agacagguguugauaaaucca

SEQ ID NO: 190694 - RNA, 21 nt, Human
agcuggaucuaucggcccagc

SEQ ID NO: 190695 - RNA, 18 nt, Human
aggauggcuuccauggag

SEQ ID NO: 190696 - RNA, 21 nt, Human
augacggcagcaguucuccug

SEQ ID NO: 190697 - RNA, 21 nt, Human
auggcugccgaagugggagac

SEQ ID NO: 190698 - RNA, 19 nt, Human
caaaacacagaaaccagac

SEQ ID NO: 190699 - RNA, 22 nt, Human
caaaacacagaaaccagacggc

SEQ ID NO: 190700 - RNA, 21 nt, Human
caccaaauuucucuaucacaa

SEQ ID NO: 190701 - RNA, 18 nt, Human
cagaauguugcaggccuc

SEQ ID NO: 190702 - RNA, 18 nt, Human
caucaggagcgucugcau

SEQ ID NO: 190703 - RNA, 20 nt, Human
ccagagaagaaccuugaaga

SEQ ID NO: 190704 - RNA, 19 nt, Human
ccaucuggcccugcacucc

SEQ ID NO: 190705 - RNA, 18 nt, Human
cccagaauguugcaggcc

SEQ ID NO: 190706 - RNA, 21 nt, Human
cggcagcaguucuccugucuu

SEQ ID NO: 190707 - RNA, 24 nt, Human
cggucggcugucuccauggagucc

SEQ ID NO: 190708 - RNA, 27 nt, Human
cucaugacggcagcaguucuccugucu

SEQ ID NO: 190709 - RNA, 21 nt, Human
cuccauggaguccccaucugg

SEQ ID NO: 190710 - RNA, 21 nt, Human
cuccuggggccacagggauug

SEQ ID NO: 190711 - RNA, 19 nt, Human
gaaaguauucuccaaagag

SEQ ID NO: 190712 - RNA, 18 nt, Human
gaaccuugaagacuaaug

SEQ ID NO: 190713 - RNA, 18 nt, Human
gagaggaaggaaaaguga

SEQ ID NO: 190714 - RNA, 21 nt, Human
gcaggccucuuggaugagcuu

SEQ ID NO: 190715 - RNA, 21 nt, Human
gcccagagaagaaccuugaag

SEQ ID NO: 190716 - RNA, 20 nt, Human
gccgcagcugcuccuggggc

SEQ ID NO: 190717 - RNA, 18 nt, Human
gggaaaauuaagcccagg

SEQ ID NO: 190718 - RNA, 20 nt, Human
uaaccuguuacaacaaaaca

SEQ ID NO: 190719 - RNA, 24 nt, Human
uagaacucuucagcuggaucuauc

SEQ ID NO: 190720 - RNA, 18 nt, Human
uagggaggcugaaggaca

SEQ ID NO: 190721 - RNA, 25 nt, Human
ucagcugcugacugucggcauagcu

SEQ ID NO: 190722 - RNA, 20 nt, Human
uccauacauguuccugccgc

SEQ ID NO: 190723 - RNA, 21 nt, Human
uccauacauguuccugccgca

SEQ ID NO: 190724 - RNA, 24 nt, Human
uccauggagacacccagaauguug

SEQ ID NO: 190725 - RNA, 25 nt, Human
uccauggagacacccagaauguugc

SEQ ID NO: 190726 - RNA, 23 nt, Human
uccauggaguccccaucuggccc

SEQ ID NO: 190727 - RNA, 20 nt, Human
ucccugagcacuugcuucug

SEQ ID NO: 190728 - RNA, 24 nt, Human
ucuccugucuucauuucccugagc

SEQ ID NO: 190729 - RNA, 22 nt, Human
ucugcugcguuucugucgggga

SEQ ID NO: 190730 - RNA, 19 nt, Human
ucuggcccugcacucccca

SEQ ID NO: 190731 - RNA, 19 nt, Human
ucuucauuucccugagcac

SEQ ID NO: 190732 - RNA, 28 nt, Human
ugaaaguauucuccaaagaguuucagga

SEQ ID NO: 190733 - RNA, 23 nt, Human
ugaaggacauuuaacguguuuca

SEQ ID NO: 190734 - RNA, 24 nt, Human
ugacggcagcaguucuccugucuu

SEQ ID NO: 190735 - RNA, 22 nt, Human
ugacugucggcauagcucauga

SEQ ID NO: 190736 - RNA, 18 nt, Human
ugagaggaaggaaaagug

SEQ ID NO: 190737 - RNA, 19 nt, Human
ugccgcagcugcuccuggg

SEQ ID NO: 190738 - RNA, 20 nt, Human
ugccgcagcugcuccugggg

SEQ ID NO: 190739 - RNA, 18 nt, Human
ugccucugaacaucggcu

SEQ ID NO: 190740 - RNA, 18 nt, Human
uggaucuaucggcccagc

SEQ ID NO: 190741 - RNA, 18 nt, Human
uguagaacucuucagcug

SEQ ID NO: 190742 - RNA, 20 nt, Human
uguuccugccgcagcugcuc

SEQ ID NO: 190743 - RNA, 22 nt, Human
uuaaccuguuacaacaaaacac

SEQ ID NO: 190744 - RNA, 20 nt, Human
uuacaacaaaacacagaaac

SEQ ID NO: 190745 - RNA, 27 nt, Human
uucagaauugaaaguauucuccaaaga

SEQ ID NO: 190746 - RNA, 19 nt, Human
uugaagacuaauguaugua

SEQ ID NO: 190747 - RNA, 20 nt, Human
uuuggaugccucugaacauc

SEQ ID NO: 190748 - RNA, 21 nt, Human
uuuucaauuuuucccauguuu

SEQ ID NO: 190749 - RNA, 21 nt, Human
uuuuuuggaugccucugaaca

SEQ ID NO: 190750 - RNA, 24 nt, Human
aaaaguaauagaaagcagagccgg

SEQ ID NO: 190751 - RNA, 22 nt, Human
aaacagauuugguaaacaugau

SEQ ID NO: 190752 - RNA, 18 nt, Human
aagaacugcuccugggcu

SEQ ID NO: 190753 - RNA, 23 nt, Human
aggcagaggcggcagcggcgggg

SEQ ID NO: 190754 - RNA, 20 nt, Human
aggcggcagcggcggggggg

SEQ ID NO: 190755 - RNA, 22 nt, Human
aguagauuuuaagacacaugaa

SEQ ID NO: 190756 - RNA, 18 nt, Human
auauacauauacauauau

SEQ ID NO: 190757 - RNA, 21 nt, Human
caaaagaaaaucuguauccau

SEQ ID NO: 190758 - RNA, 21 nt, Human
caacaugauauaaacuuuauu

SEQ ID NO: 190759 - RNA, 18 nt, Human
cacguguuaggagaaaac

SEQ ID NO: 190760 - RNA, 22 nt, Human
cccccacgcagagguacggccg

SEQ ID NO: 190761 - RNA, 20 nt, Human
ccuaaaaaguaauagaaagc

SEQ ID NO: 190762 - RNA, 22 nt, Human
ccuacuacuugcagaucaccau

SEQ ID NO: 190763 - RNA, 21 nt, Human
cuagucuguacuccucuucac

SEQ ID NO: 190764 - RNA, 21 nt, Human
cuccucuucaccccauaaucc

SEQ ID NO: 190765 - RNA, 22 nt, Human
cuguacuccucuucaccccaua

SEQ ID NO: 190766 - RNA, 24 nt, Human
uaaacagauuugguaaacaugaua

SEQ ID NO: 190767 - RNA, 18 nt, Human
uaaagccuaaaaaguaau

SEQ ID NO: 190768 - RNA, 20 nt, Human
uaaauauacacauggccaaa

SEQ ID NO: 190769 - RNA, 19 nt, Human
uaggagaaaacuggaaccu

SEQ ID NO: 190770 - RNA, 18 nt, Human
uagggaagaacugcuccu

SEQ ID NO: 190771 - RNA, 21 nt, Human
uauacacauggccaaacacug

SEQ ID NO: 190772 - RNA, 20 nt, Human
ucaaaagccaaacuuuagau

SEQ ID NO: 190773 - RNA, 18 nt, Human
uccugggcuuggcacgug

SEQ ID NO: 190774 - RNA, 20 nt, Human
ucuguauccauagggaagaa

SEQ ID NO: 190775 - RNA, 22 nt, Human
ugagagauauaucuagaagaaa

SEQ ID NO: 190776 - RNA, 18 nt, Human
uggacaaggacaaaagaa

SEQ ID NO: 190777 - RNA, 22 nt, Human
uggacaaggacaaaagaaaauc

SEQ ID NO: 190778 - RNA, 19 nt, Human
ugguaaacaugauauaaau

SEQ ID NO: 190779 - RNA, 19 nt, Human
aagccaguaaacaaaaacg

SEQ ID NO: 190780 - RNA, 26 nt, Human
aauuuaaaaaaucuuaugaauacaga

SEQ ID NO: 190781 - RNA, 24 nt, Human
agaacacacaucugauucaugcaa

SEQ ID NO: 190782 - RNA, 23 nt, Human
agaaggaaagccaguaaacaaaa

SEQ ID NO: 190783 - RNA, 19 nt, Human
agacagggcagccaagccu

SEQ ID NO: 190784 - RNA, 21 nt, Human
auaaaaucuucucaaguucua

SEQ ID NO: 190785 - RNA, 22 nt, Human
auaaaaucuucucaaguucuag

SEQ ID NO: 190786 - RNA, 25 nt, Human
auaagaauaaaaucuucucaaguuc

SEQ ID NO: 190787 - RNA, 21 nt, Human
cuagauagucuauucauuucu

SEQ ID NO: 190788 - RNA, 18 nt, Human
cucaggaaaauguaagcu

SEQ ID NO: 190789 - RNA, 22 nt, Human
cuucucaaguucuagauagucu

SEQ ID NO: 190790 - RNA, 21 nt, Human
gaacacacaucugauucaugc

SEQ ID NO: 190791 - RNA, 21 nt, Human
gaacacacaucugauucaugc

SEQ ID NO: 190792 - RNA, 21 nt, Human
gccaguaaacaaaaacgauaa

SEQ ID NO: 190793 - RNA, 21 nt, Human
uaaaaucuucucaaguucuag

SEQ ID NO: 190794 - RNA, 21 nt, Human
uagcuuuuauucuugccuaau

SEQ ID NO: 190795 - RNA, 19 nt, Human
uccauguuccagacagggc

SEQ ID NO: 190796 - RNA, 21 nt, Human
ucccuggaacaacugcuggaa

SEQ ID NO: 190797 - RNA, 20 nt, Human
ucgcugccucagugcagcug

SEQ ID NO: 190798 - RNA, 21 nt, Human
ugagaacacacaucugauuca

SEQ ID NO: 190799 - RNA, 22 nt, Human
ugcaagaaaguccauguuccag

SEQ ID NO: 190800 - RNA, 19 nt, Human
uguaagcuuucaggacacu

SEQ ID NO: 190801 - RNA, 18 nt, Human
aaauaccauggcacaugg

SEQ ID NO: 190802 - RNA, 19 nt, Human
aagguccagaagagcccga

SEQ ID NO: 190803 - RNA, 23 nt, Human
accccaccuccucaaaggggggu

SEQ ID NO: 190804 - RNA, 24 nt, Human
agaagagcccgaggaacacagccc

SEQ ID NO: 190805 - RNA, 21 nt, Human
agcaguucaccccaccuccuc

SEQ ID NO: 190806 - RNA, 22 nt, Human
agcaguucaccccaccuccuca

SEQ ID NO: 190807 - RNA, 24 nt, Human
caaaucccugccaaggagcaguuc

SEQ ID NO: 190808 - RNA, 23 nt, Human
cacccacccucccaggacccaaa

SEQ ID NO: 190809 - RNA, 19 nt, Human
caguucaccccaccuccuc

SEQ ID NO: 190810 - RNA, 22 nt, Human
cauggccugguauccacggugc

SEQ ID NO: 190811 - RNA, 21 nt, Human
ccagcaaugcagugucacaaa

SEQ ID NO: 190812 - RNA, 25 nt, Human
ccauggcacauggccugguauccac

SEQ ID NO: 190813 - RNA, 19 nt, Human
cccaggacccaaauaccau

SEQ ID NO: 190814 - RNA, 21 nt, Human
ccugguauccacggugcaagg

SEQ ID NO: 190815 - RNA, 21 nt, Human
ccuuuauuucacccacccucc

SEQ ID NO: 190816 - RNA, 20 nt, Human
gggaaguccggggcucgggc

SEQ ID NO: 190817 - RNA, 23 nt, Human
gggagcagggcccagacccuguc

SEQ ID NO: 190818 - RNA, 25 nt, Human
uauuucacccacccucccaggaccc

SEQ ID NO: 190819 - RNA, 20 nt, Human
ucacagggccggucccccug

SEQ ID NO: 190820 - RNA, 25 nt, Human
ucacccacccucccaggacccaaau

SEQ ID NO: 190821 - RNA, 22 nt, Human
uccacggugcaagguccagaag

SEQ ID NO: 190822 - RNA, 25 nt, Human
uccacggugcaagguccagaagagc

SEQ ID NO: 190823 - RNA, 20 nt, Human
uccggggccgggccucacuu

SEQ ID NO: 190824 - RNA, 18 nt, Human
ugccugggguccacugca

SEQ ID NO: 190825 - RNA, 19 nt, Human
ugccugggguccacugcag

SEQ ID NO: 190826 - RNA, 21 nt, Human
ugccugggguccacugcagau

SEQ ID NO: 190827 - RNA, 24 nt, Human
ugucacaaaucccugccaaggagc

SEQ ID NO: 190828 - RNA, 22 nt, Human
uucacccacccucccaggaccc

SEQ ID NO: 190829 - RNA, 24 nt, Human
aacaauuucuugaacugaagugag

SEQ ID NO: 190830 - RNA, 18 nt, Human
agagaagauucaaauccu

SEQ ID NO: 190831 - RNA, 23 nt, Human
agauacuggagaguuauucugcu

SEQ ID NO: 190832 - RNA, 21 nt, Human
cagaacaauuucuugaacuga

SEQ ID NO: 190833 - RNA, 21 nt, Human
caugcagaccacuggcauagc

SEQ ID NO: 190834 - RNA, 24 nt, Human
ccaggcagaacaauuucuugaacc

SEQ ID NO: 190835 - RNA, 24 nt, Human
cguaauuucuugcccaggcagaac

SEQ ID NO: 190836 - RNA, 27 nt, Human
cuaugcauucacaauccugucaaggac

SEQ ID NO: 190837 - RNA, 23 nt, Human
cucaaaugucuucaguuuacugc

SEQ ID NO: 190838 - RNA, 22 nt, Human
guaauuucuugcccaggcagaa

SEQ ID NO: 190839 - RNA, 18 nt, Human
ucaaauccuggagcccuu

SEQ ID NO: 190840 - RNA, 20 nt, Human
ugaagugagcuuucccauug

SEQ ID NO: 190841 - RNA, 18 nt, Human
ugccaaguaauucaccgc

SEQ ID NO: 190842 - RNA, 20 nt, Human
ugucaaggacuccagucugu

SEQ ID NO: 190843 - RNA, 23 nt, Human
uguccauuucuuugcauccucua

SEQ ID NO: 190844 - RNA, 20 nt, Human
uguuuugaaaaucacucugc

SEQ ID NO: 190845 - RNA, 25 nt, Human
uugaaaaucacucugcggaugcuga

SEQ ID NO: 190846 - RNA, 24 nt, Human
aaggggguggcucaaugcugcugc

SEQ ID NO: 190847 - RNA, 21 nt, Human
accccaggauguuccaaccac

SEQ ID NO: 190848 - RNA, 23 nt, Human
accccagguaaagagcagagcaa

SEQ ID NO: 190849 - RNA, 18 nt, Human
aggcugggucggggguca

SEQ ID NO: 190850 - RNA, 24 nt, Human
cagcaaccccagguaaagagcaga

SEQ ID NO: 190851 - RNA, 21 nt, Human
ccacagaggagugaaggcccc

SEQ ID NO: 190852 - RNA, 19 nt, Human
cccagggcggccgcagcca

SEQ ID NO: 190853 - RNA, 22 nt, Human
ccgcagccagcccggccagcgc

SEQ ID NO: 190854 - RNA, 19 nt, Human
cggcccagggcggccgcag

SEQ ID NO: 190855 - RNA, 26 nt, Human
gagaaagaaaaaccggccgagucuug

SEQ ID NO: 190856 - RNA, 20 nt, Human
gcggccgcagccagcccggc

SEQ ID NO: 190857 - RNA, 22 nt, Human
gggcggccgcagccagcccggc

SEQ ID NO: 190858 - RNA, 18 nt, Human
gggucuguccaucaggga

SEQ ID NO: 190859 - RNA, 22 nt, Human
gguaaagagcagagcaagccgu

SEQ ID NO: 190860 - RNA, 21 nt, Human
ggugccgagaacagacagcaa

SEQ ID NO: 190861 - RNA, 18 nt, Human
gguggggcccggcccagg

SEQ ID NO: 190862 - RNA, 24 nt, Human
guccaucagggagaaagaaaaacc

SEQ ID NO: 190863 - RNA, 22 nt, Human
guccucgacagcaaccccagga

SEQ ID NO: 190864 - RNA, 20 nt, Human
uccacaugcuggccaagggc

SEQ ID NO: 190865 - RNA, 19 nt, Human
uccagagugagagauaggg

SEQ ID NO: 190866 - RNA, 20 nt, Human
ucgccugccaaggggguggc

SEQ ID NO: 190867 - RNA, 24 nt, Human
ugaaggccccagcccuucacgaug

SEQ ID NO: 190868 - RNA, 24 nt, Human
ugaggaaaucgggcucuuccagag

SEQ ID NO: 190869 - RNA, 25 nt, Human
uggccaagggcacagagcugccgua

SEQ ID NO: 190870 - RNA, 21 nt, Human
uggggcccggcccagggcggc

SEQ ID NO: 190871 - RNA, 20 nt, Human
agaaaaucuuuuauuuccac

SEQ ID NO: 190872 - RNA, 23 nt, Human
aggaggcacuuguucugcugcug

SEQ ID NO: 190873 - RNA, 24 nt, Human
augaccacaaaacccaggccagaa

SEQ ID NO: 190874 - RNA, 20 nt, Human
ccacaaaacccaggccagaa

SEQ ID NO: 190875 - RNA, 21 nt, Human
cggggaggaagggacacgcag

SEQ ID NO: 190876 - RNA, 21 nt, Human
ggaagggacacgcagguggua

SEQ ID NO: 190877 - RNA, 19 nt, Human
uagaugaccacaaaaccca

SEQ ID NO: 190878 - RNA, 25 nt, Human
ucccugcuagaauagaugaccacaa

SEQ ID NO: 190879 - RNA, 22 nt, Human
ucggggaggaagggacacgcag

SEQ ID NO: 190880 - RNA, 27 nt, Human
ucggggaggaagggacacgcagguggu

SEQ ID NO: 190881 - RNA, 24 nt, Human
ucugccgugaacaguccaggaggc

SEQ ID NO: 190882 - RNA, 23 nt, Human
aaauauccagaacugaacaaaag

SEQ ID NO: 190883 - RNA, 21 nt, Human
aagcagaacacuguccauaua

SEQ ID NO: 190884 - RNA, 22 nt, Human
aagcauuuuagcaugcugccuu

SEQ ID NO: 190885 - RNA, 21 nt, Human
aaugaaaaccucuagcaacug

SEQ ID NO: 190886 - RNA, 22 nt, Human
accaauaagucuuuuauuuuuu

SEQ ID NO: 190887 - RNA, 23 nt, Human
acugauuuugaaccaggcucugc

SEQ ID NO: 190888 - RNA, 23 nt, Human
caagcuaaauaggauuaaaaagc

SEQ ID NO: 190889 - RNA, 22 nt, Human
cacugcagguaaccaucagaga

SEQ ID NO: 190890 - RNA, 21 nt, Human
cacugggcaauucuaaaauuc

SEQ ID NO: 190891 - RNA, 20 nt, Human
cacuguccauauaacagaau

SEQ ID NO: 190892 - RNA, 22 nt, Human
caggcggccggggcagccucag

SEQ ID NO: 190893 - RNA, 19 nt, Human
caggcucugcagauuuuaa

SEQ ID NO: 190894 - RNA, 21 nt, Human
caucuucagacacuaaggaca

SEQ ID NO: 190895 - RNA, 23 nt, Human
ccaacaagcaagcaaggaacaga

SEQ ID NO: 190896 - RNA, 22 nt, Human
ccgggugcgcaggcggccgggg

SEQ ID NO: 190897 - RNA, 18 nt, Human
cggccggggcagccucag

SEQ ID NO: 190898 - RNA, 25 nt, Human
cugcagguaaccaucagagaacaca

SEQ ID NO: 190899 - RNA, 21 nt, Human
gaauugcugcuucacaacuuu

SEQ ID NO: 190900 - RNA, 18 nt, Human
gagaauuucugaaacaag

SEQ ID NO: 190901 - RNA, 20 nt, Human
gcagaacacuguccauauaa

SEQ ID NO: 190902 - RNA, 22 nt, Human
uacacucacucacucuggcagc

SEQ ID NO: 190903 - RNA, 23 nt, Human
uacuguacacagaaaacugguga

SEQ ID NO: 190904 - RNA, 21 nt, Human
uaggauuaaaaagcagaacac

SEQ ID NO: 190905 - RNA, 21 nt, Human
uauccagaacugaacaaaagc

SEQ ID NO: 190906 - RNA, 23 nt, Human
uccauauaacagaauugcugcuu

SEQ ID NO: 190907 - RNA, 23 nt, Human
ucucaacccagcucuagauacua

SEQ ID NO: 190908 - RNA, 22 nt, Human
ugaaacaagcuaaauaggauua

SEQ ID NO: 190909 - RNA, 21 nt, Human
ugaaaggagaauuacacucac

SEQ ID NO: 190910 - RNA, 18 nt, Human
ugaaagguacacaaccaa

SEQ ID NO: 190911 - RNA, 24 nt, Human
ugaagggagugacugauuuugaac

SEQ ID NO: 190912 - RNA, 21 nt, Human
ugaguuucccuuacuuuguau

SEQ ID NO: 190913 - RNA, 19 nt, Human
ugccaugucugcuucugaa

SEQ ID NO: 190914 - RNA, 23 nt, Human
uuacuguacacagaaaacuggug

SEQ ID NO: 190915 - RNA, 23 nt, Human
uucagacacuaaggacaggaaau

SEQ ID NO: 190916 - RNA, 24 nt, Human
aaaaaaugccaccacuaaugccau

SEQ ID NO: 190917 - RNA, 20 nt, Human
aaaaagaaacagccccucca

SEQ ID NO: 190918 - RNA, 18 nt, Human
aaacagccccuccaucac

SEQ ID NO: 190919 - RNA, 18 nt, Human
aaccaggaagugaaucgg

SEQ ID NO: 190920 - RNA, 23 nt, Human
aagcagagagaccacagccgagg

SEQ ID NO: 190921 - RNA, 18 nt, Human
aagcccucguugcuucuc

SEQ ID NO: 190922 - RNA, 23 nt, Human
aagccgaugaccauccaacccug

SEQ ID NO: 190923 - RNA, 19 nt, Human
aagugaccucugaagaaag

SEQ ID NO: 190924 - RNA, 22 nt, Human
acagccccuccaucacccacau

SEQ ID NO: 190925 - RNA, 24 nt, Human
acagccgagguguuucucagauac

SEQ ID NO: 190926 - RNA, 20 nt, Human
acaggacauugucuaacuac

SEQ ID NO: 190927 - RNA, 25 nt, Human
accacccaacaggacauugucuaac

SEQ ID NO: 190928 - RNA, 23 nt, Human
accuuccaaacauuucaaaaguc

SEQ ID NO: 190929 - RNA, 21 nt, Human
acgacacucucgguggccccu

SEQ ID NO: 190930 - RNA, 22 nt, Human
acgcaacaggaccacccaacag

SEQ ID NO: 190931 - RNA, 22 nt, Human
agaacugagguagugaggguag

SEQ ID NO: 190932 - RNA, 20 nt, Human
agcagagagaccacagccga

SEQ ID NO: 190933 - RNA, 19 nt, Human
agcagagagcaucucuaga

SEQ ID NO: 190934 - RNA, 18 nt, Human
agcagaggcgccgucucc

SEQ ID NO: 190935 - RNA, 19 nt, Human
agcccagaaggcguuggug

SEQ ID NO: 190936 - RNA, 26 nt, Human
agccggcgcuggaggccccgagggca

SEQ ID NO: 190937 - RNA, 20 nt, Human
auaaaguuucccgucucaua

SEQ ID NO: 190938 - RNA, 21 nt, Human
auaaaguuucccgucucauaa

SEQ ID NO: 190939 - RNA, 21 nt, Human
aucuuucuucccaacguccac

SEQ ID NO: 190940 - RNA, 18 nt, Human
auuacugcucgcuuuugc

SEQ ID NO: 190941 - RNA, 21 nt, Human
caacagcguuucccuuugaaa

SEQ ID NO: 190942 - RNA, 20 nt, Human
cacacaacgcccaccagcug

SEQ ID NO: 190943 - RNA, 19 nt, Human
cacccacauuccccaagcc

SEQ ID NO: 190944 - RNA, 21 nt, Human
caccuguacaacacagaucca

SEQ ID NO: 190945 - RNA, 18 nt, Human
cacgaacccgcagagcag

SEQ ID NO: 190946 - RNA, 21 nt, Human
cacggaaaaagaaacagcccc

SEQ ID NO: 190947 - RNA, 22 nt, Human
cagaggagaucuccacgcaaca

SEQ ID NO: 190948 - RNA, 22 nt, Human
cauccaacccugacucaccuga

SEQ ID NO: 190949 - RNA, 23 nt, Human
cauuuuuaacgacacucucggug

SEQ ID NO: 190950 - RNA, 23 nt, Human
ccaaaggcuaaacugcuucaggu

SEQ ID NO: 190951 - RNA, 22 nt, Human
ccaagccaagagcagucaaggg

SEQ ID NO: 190952 - RNA, 24 nt, Human
ccacacggaaaaagaaacagcccc

SEQ ID NO: 190953 - RNA, 20 nt, Human
ccacccacacggaaaaagaa

SEQ ID NO: 190954 - RNA, 18 nt, Human
cccacacggaaaaagaaa

SEQ ID NO: 190955 - RNA, 21 nt, Human
cccacauuccccaagccaccu

SEQ ID NO: 190956 - RNA, 25 nt, Human
cccacggccuuccuaucccgucucu

SEQ ID NO: 190957 - RNA, 21 nt, Human
cccccgcgggcgcggguccuc

SEQ ID NO: 190958 - RNA, 22 nt, Human
cccggccccgccuccgcccagc

SEQ ID NO: 190959 - RNA, 22 nt, Human
ccgagggcagcgauuggccucu

SEQ ID NO: 190960 - RNA, 19 nt, Human
ccgccuccgcccagccccc

SEQ ID NO: 190961 - RNA, 24 nt, Human
ccgcgcucuggcugccucggccca

SEQ ID NO: 190962 - RNA, 25 nt, Human
ccgggagcaguggguggacuuccuc

SEQ ID NO: 190963 - RNA, 24 nt, Human
ccucccugcagccccugcccgcaa

SEQ ID NO: 190964 - RNA, 18 nt, Human
ccuccgcccagcccccgc

SEQ ID NO: 190965 - RNA, 22 nt, Human
ccucugaaagccgaugaccauc

SEQ ID NO: 190966 - RNA, 23 nt, Human
ccucugaaagccgaugaccaucc

SEQ ID NO: 190967 - RNA, 23 nt, Human
cgagcaucgcccuccgagacuga

SEQ ID NO: 190968 - RNA, 24 nt, Human
cgaugaccauccaacccugacuca

SEQ ID NO: 190969 - RNA, 23 nt, Human
cgcggaccugcagaccugcgccc

SEQ ID NO: 190970 - RNA, 18 nt, Human
cgcggguccucuccuccu

SEQ ID NO: 190971 - RNA, 18 nt, Human
cggaagcccggccccgcc

SEQ ID NO: 190972 - RNA, 22 nt, Human
cggcgcuggaggccccgagggc

SEQ ID NO: 190973 - RNA, 21 nt, Human
cgggcaagagcggagaccacc

SEQ ID NO: 190974 - RNA, 23 nt, Human
cuaaaaaguggccacgccucucc

SEQ ID NO: 190975 - RNA, 23 nt, Human
cuaagccacccacauuccccaag

SEQ ID NO: 190976 - RNA, 26 nt, Human
cuccaucacccacaucuuguacacaa

SEQ ID NO: 190977 - RNA, 24 nt, Human
cuccucccugcagccccugcccgc

SEQ ID NO: 190978 - RNA, 18 nt, Human
cuccuccucccugcagcc

SEQ ID NO: 190979 - RNA, 18 nt, Human
cugaaauauccuacgagc

SEQ ID NO: 190980 - RNA, 19 nt, Human
cugcgcccgggagcagugg

SEQ ID NO: 190981 - RNA, 21 nt, Human
gacagcuucaaggguagaagu

SEQ ID NO: 190982 - RNA, 20 nt, Human
gaccauccaacccugacuca

SEQ ID NO: 190983 - RNA, 20 nt, Human
gaccucugaagaaagcccag

SEQ ID NO: 190984 - RNA, 20 nt, Human
gagaccaagccaagagcagu

SEQ ID NO: 190985 - RNA, 20 nt, Human
gaguucucccacggccuucc

SEQ ID NO: 190986 - RNA, 18 nt, Human
gccucuuccgcgcucugg

SEQ ID NO: 190987 - RNA, 21 nt, Human
gcgccgucuccgggaauccgc

SEQ ID NO: 190988 - RNA, 20 nt, Human
gcggaccugcagaccugcgc

SEQ ID NO: 190989 - RNA, 18 nt, Human
ggaaaaagaaacagcccc

SEQ ID NO: 190990 - RNA, 25 nt, Human
ggccacgccucuccacguaaacaca

SEQ ID NO: 190991 - RNA, 18 nt, Human
ggccccgccuccgcccag

SEQ ID NO: 190992 - RNA, 20 nt, Human
ggcuuugaggagggcaguga

SEQ ID NO: 190993 - RNA, 18 nt, Human
gggcagugggcgcggacc

SEQ ID NO: 190994 - RNA, 19 nt, Human
gugaggguagagaccaagc

SEQ ID NO: 190995 - RNA, 22 nt, Human
uaaacacauccagcugacacag

SEQ ID NO: 190996 - RNA, 22 nt, Human
uaaagcagagagaccacagccg

SEQ ID NO: 190997 - RNA, 23 nt, Human
uagauccucuaagccacccacau

SEQ ID NO: 190998 - RNA, 21 nt, Human
uaggauuuaaagcagagagac

SEQ ID NO: 190999 - RNA, 22 nt, Human
ucacccacaucuuguacacaaa

SEQ ID NO: 191000 - RNA, 19 nt, Human
ucagaggugcuaaauaccu

SEQ ID NO: 191001 - RNA, 18 nt, Human
uccaaaggcuaaacugcu

SEQ ID NO: 191002 - RNA, 21 nt, Human
uccaaaugaaagucagucacc

SEQ ID NO: 191003 - RNA, 18 nt, Human
uccacgaguagaauuucu

SEQ ID NO: 191004 - RNA, 19 nt, Human
ucccugaacauucccgugg

SEQ ID NO: 191005 - RNA, 25 nt, Human
uccuccuuuauuacaacgaugccca

SEQ ID NO: 191006 - RNA, 25 nt, Human
uccucuauccaaaggcuaaacugcu

SEQ ID NO: 191007 - RNA, 21 nt, Human
uccuucgggcaagagcggaga

SEQ ID NO: 191008 - RNA, 20 nt, Human
ucuaaauguuuccuuagccc

SEQ ID NO: 191009 - RNA, 20 nt, Human
ucuguccggaagcccggccc

SEQ ID NO: 191010 - RNA, 27 nt, Human
ugaaauauccuacgagcaucgcccucc

SEQ ID NO: 191011 - RNA, 18 nt, Human
ugaccucugaagaaagcc

SEQ ID NO: 191012 - RNA, 26 nt, Human
ugagauacacagcauauugugccccc

SEQ ID NO: 191013 - RNA, 19 nt, Human
uggaaagagcugaguggaa

SEQ ID NO: 191014 - RNA, 20 nt, Human
uggaaagagcugaguggaaa

SEQ ID NO: 191015 - RNA, 19 nt, Human
uggaaugugcaugagaaau

SEQ ID NO: 191016 - RNA, 20 nt, Human
uggccccugacagcuaccuu

SEQ ID NO: 191017 - RNA, 20 nt, Human
ugggcgcggaccugcagacc

SEQ ID NO: 191018 - RNA, 23 nt, Human
uggguggacuuccucgccacgaa

SEQ ID NO: 191019 - RNA, 24 nt, Human
ugucuaacuacacacaacgcccac

SEQ ID NO: 191020 - RNA, 21 nt, Human
uguugucaagcagagagcauc

SEQ ID NO: 191021 - RNA, 19 nt, Human
uucaaggguagaagugacc

SEQ ID NO: 191022 - RNA, 22 nt, Human
uucccuggaaugugcaugagaa

SEQ ID NO: 191023 - RNA, 30 nt, Human
uucucgugaaauaaaguuucccgucucauu

SEQ ID NO: 191024 - RNA, 21 nt, Human
uucugguccucagagaagcug

SEQ ID NO: 191025 - RNA, 23 nt, Human
uuuaacgacacucucgguggccc

SEQ ID NO: 191026 - RNA, 19 nt, Human
uuuagagcaagcccucguu

SEQ ID NO: 191027 - RNA, 24 nt, Human
uuuugugugaggcacucaaaugga

SEQ ID NO: 191028 - RNA, 19 nt, Human
aaaaaaacuaccaaagaca

SEQ ID NO: 191029 - RNA, 21 nt, Human
aaaaagguuaaucucacccuc

SEQ ID NO: 191030 - RNA, 23 nt, Human
aaacaaacguagaugaauucaac

SEQ ID NO: 191031 - RNA, 22 nt, Human
aacaaugaaaccagacucaaaa

SEQ ID NO: 191032 - RNA, 21 nt, Human
aacacacaaaagcaagcauuc

SEQ ID NO: 191033 - RNA, 20 nt, Human
aacgccuuauagagggaaug

SEQ ID NO: 191034 - RNA, 22 nt, Human
aagaaaaucuaaacuucaucua

SEQ ID NO: 191035 - RNA, 24 nt, Human
aaguagucaauauaguacaaaaac

SEQ ID NO: 191036 - RNA, 23 nt, Human
aauguguguguuugugugugugu

SEQ ID NO: 191037 - RNA, 22 nt, Human
aggaggucaaagcaguuuguac

SEQ ID NO: 191038 - RNA, 28 nt, Human
aggcagaugucagugccaugcccuuccu

SEQ ID NO: 191039 - RNA, 24 nt, Human
auguguguguuugugugugugugu

SEQ ID NO: 191040 - RNA, 28 nt, Human
auuaugcuaacacacaaaagcaagcauu

SEQ ID NO: 191041 - RNA, 22 nt, Human
caaaagcaagcauucaaggaaa

SEQ ID NO: 191042 - RNA, 24 nt, Human
caaaagcaagcauucaaggaaaca

SEQ ID NO: 191043 - RNA, 19 nt, Human
cagaauucucaaacaauuc

SEQ ID NO: 191044 - RNA, 21 nt, Human
cagccuccagaacuaggaaga

SEQ ID NO: 191045 - RNA, 20 nt, Human
ccagaacuaggaagaaaaua

SEQ ID NO: 191046 - RNA, 31 nt, Human
ccaugcccuucgccuucccagccuccagaaa

SEQ ID NO: 191047 - RNA, 21 nt, Human
cccuucgccuucccagccucc

SEQ ID NO: 191048 - RNA, 23 nt, Human
ccuuauagagggaaugggcuucu

SEQ ID NO: 191049 - RNA, 24 nt, Human
cuuuuuuguuuuuuguuuuugcuu

SEQ ID NO: 191050 - RNA, 24 nt, Human
gagcagagauuuuuuuccccauca

SEQ ID NO: 191051 - RNA, 21 nt, Human
gcaaaaaaacuaccaaagaca

SEQ ID NO: 191052 - RNA, 21 nt, Human
gcccuucgccuucccagccuc

SEQ ID NO: 191053 - RNA, 18 nt, Human
ggaaacauuuguucuuua

SEQ ID NO: 191054 - RNA, 20 nt, Human
ggaaugggcuucugaugaaa

SEQ ID NO: 191055 - RNA, 24 nt, Human
ggcagaugucagugccaugcccuu

SEQ ID NO: 191056 - RNA, 21 nt, Human
ggucaugguaucuucacagga

SEQ ID NO: 191057 - RNA, 19 nt, Human
guaauauuauaucuugccu

SEQ ID NO: 191058 - RNA, 23 nt, Human
gucacgauuaggucaugaggacu

SEQ ID NO: 191059 - RNA, 20 nt, Human
guuuuuuguuuuugcuuuuu

SEQ ID NO: 191060 - RNA, 22 nt, Human
uaaaaauuaugcuaacacacaa

SEQ ID NO: 191061 - RNA, 21 nt, Human
uaaaguaucacaggaaggucu

SEQ ID NO: 191062 - RNA, 19 nt, Human
uaaaugauaaaugugugug

SEQ ID NO: 191063 - RNA, 26 nt, Human
uaaauucuguagcucugguuaagaag

SEQ ID NO: 191064 - RNA, 18 nt, Human
uacaaaaacacucuccga

SEQ ID NO: 191065 - RNA, 21 nt, Human
uagcaaaaagguuaaucucac

SEQ ID NO: 191066 - RNA, 23 nt, Human
uaggacuuuaguguccccuuaau

SEQ ID NO: 191067 - RNA, 22 nt, Human
uauaguaaccuauuaaaauauu

SEQ ID NO: 191068 - RNA, 18 nt, Human
uauaguaaucauucaugu

SEQ ID NO: 191069 - RNA, 21 nt, Human
ucacaggaaggucuuuuuugu

SEQ ID NO: 191070 - RNA, 18 nt, Human
ucauuuccucucucuuca

SEQ ID NO: 191071 - RNA, 20 nt, Human
uccacauuugguuuggugaa

SEQ ID NO: 191072 - RNA, 21 nt, Human
ugaaauuguacaacuuaggca

SEQ ID NO: 191073 - RNA, 22 nt, Human
ugacagcuguauagucacaguc

SEQ ID NO: 191074 - RNA, 21 nt, Human
ugagcugguuccugaaguuag

SEQ ID NO: 191075 - RNA, 24 nt, Human
ugcaaaaaaacuaccaaagacaac

SEQ ID NO: 191076 - RNA, 22 nt, Human
ugccauuguaacaguguuggga

SEQ ID NO: 191077 - RNA, 22 nt, Human
ugcccuucgccuucccagccuc

SEQ ID NO: 191078 - RNA, 21 nt, Human
ugccuugcugcuuuguuauca

SEQ ID NO: 191079 - RNA, 24 nt, Human
ugccuugcugcuuuguuaucaugc

SEQ ID NO: 191080 - RNA, 20 nt, Human
ugcuugccuugcugcuuugu

SEQ ID NO: 191081 - RNA, 18 nt, Human
ugcuuuguuaucaugcag

SEQ ID NO: 191082 - RNA, 20 nt, Human
uggaacucauuauaaugaaa

SEQ ID NO: 191083 - RNA, 21 nt, Human
uguccgguuugcacaucuugu

SEQ ID NO: 191084 - RNA, 19 nt, Human
uguguguguauggcauuuc

SEQ ID NO: 191085 - RNA, 23 nt, Human
uguguguguguauggcauuucug

SEQ ID NO: 191086 - RNA, 24 nt, Human
uguguguguguguauggcauuucu

SEQ ID NO: 191087 - RNA, 18 nt, Human
ugugugugugugugugug

SEQ ID NO: 191088 - RNA, 18 nt, Human
ugugugugugugugugug

SEQ ID NO: 191089 - RNA, 18 nt, Human
ugugugugugugugugug

SEQ ID NO: 191090 - RNA, 22 nt, Human
ugugugugugugugugugugag

SEQ ID NO: 191091 - RNA, 21 nt, Human
ugugugugugugugugugugu

SEQ ID NO: 191092 - RNA, 21 nt, Human
ugugugugugugugugugugu

SEQ ID NO: 191093 - RNA, 23 nt, Human
uguguguguguguguguguguaa

SEQ ID NO: 191094 - RNA, 22 nt, Human
uguguguguguguguguguguu

SEQ ID NO: 191095 - RNA, 18 nt, Human
uguguguguuugugugug

SEQ ID NO: 191096 - RNA, 31 nt, Human
uguguguguuugugugugugugugugugugg

SEQ ID NO: 191097 - RNA, 26 nt, Human
uguguguguuuguguguguguguguu

SEQ ID NO: 191098 - RNA, 22 nt, Human
uguuuuugcuuuuuaaguuuua

SEQ ID NO: 191099 - RNA, 23 nt, Human
uuaaaaaacauguaucaacagaa

SEQ ID NO: 191100 - RNA, 18 nt, Human
uuaauaagagaaacuggg

SEQ ID NO: 191101 - RNA, 25 nt, Human
uuaauauuaaacaaacguagaugaa

SEQ ID NO: 191102 - RNA, 23 nt, Human
uuaauuauucacuaaauucugua

SEQ ID NO: 191103 - RNA, 21 nt, Human
uucaaggaggucaaagcaguu

SEQ ID NO: 191104 - RNA, 23 nt, Human
uuccugaaguuagugcaaaaaaa

SEQ ID NO: 191105 - RNA, 18 nt, Human
uugccuguucagcaauga

SEQ ID NO: 191106 - RNA, 22 nt, Human
uuguuuuuuguuuuugcuuuuu

SEQ ID NO: 191107 - RNA, 24 nt, Human
uuucaguggaaugcaagcuucagu

SEQ ID NO: 191108 - RNA, 19 nt, Human
uuugcacaucuuguugaau

SEQ ID NO: 191109 - RNA, 24 nt, Human
uuugugugugugugugugugugug

SEQ ID NO: 191110 - RNA, 22 nt, Human
uuuguguucuuuccacauuugg

SEQ ID NO: 191111 - RNA, 25 nt, Human
uuuuccccaucauugagucacugga

SEQ ID NO: 191112 - RNA, 23 nt, Human
uuuuguuuuuuguuuuugcuuuu

SEQ ID NO: 191113 - RNA, 21 nt, Human
uuuuucacuugacugaagucu

SEQ ID NO: 191114 - RNA, 21 nt, Human
uuuuuguuuuuuguuuuugcu

SEQ ID NO: 191115 - RNA, 19 nt, Human
aaaaaaacuaccaaagaca

SEQ ID NO: 191116 - RNA, 18 nt, Human
acaggcagcaugcaggcc

SEQ ID NO: 191117 - RNA, 22 nt, Human
aggggcauaagcaaaggaauag

SEQ ID NO: 191118 - RNA, 18 nt, Human
gaggcaggagaacaggga

SEQ ID NO: 191119 - RNA, 21 nt, Human
gcaaaaaaacuaccaaagaca

SEQ ID NO: 191120 - RNA, 21 nt, Human
gugaggcaggagaacagggaa

SEQ ID NO: 191121 - RNA, 20 nt, Human
uagaaguagagaauacagua

SEQ ID NO: 191122 - RNA, 22 nt, Human
uaggauagccagggguaggggc

SEQ ID NO: 191123 - RNA, 23 nt, Human
uaggauagccagggguaggggca

SEQ ID NO: 191124 - RNA, 21 nt, Human
ugagcugguuccugaaguuag

SEQ ID NO: 191125 - RNA, 22 nt, Human
ugaggcaggagaacagggaauu

SEQ ID NO: 191126 - RNA, 24 nt, Human
ugcaaaaaaacuaccaaagacaac

SEQ ID NO: 191127 - RNA, 23 nt, Human
uuccugaaguuagugcaaaaaaa

SEQ ID NO: 191128 - RNA, 21 nt, Human
accccagcacccccucacccu

SEQ ID NO: 191129 - RNA, 26 nt, Human
agcacccccucacccucaacaaggac

SEQ ID NO: 191130 - RNA, 26 nt, Human
agcccccggguaccccagcacccccu

SEQ ID NO: 191131 - RNA, 25 nt, Human
aggccgggccaggccgggccggggg

SEQ ID NO: 191132 - RNA, 23 nt, Human
aggggugcugggcgauggggugu

SEQ ID NO: 191133 - RNA, 21 nt, Human
agguggcuaucucgggaagaa

SEQ ID NO: 191134 - RNA, 24 nt, Human
cacuccucccgcgcgggccgaggg

SEQ ID NO: 191135 - RNA, 27 nt, Human
cagcccccggguaccccagcacccccu

SEQ ID NO: 191136 - RNA, 24 nt, Human
ccagugagcugauguuguccugca

SEQ ID NO: 191137 - RNA, 19 nt, Human
cccagcacccccucacccu

SEQ ID NO: 191138 - RNA, 23 nt, Human
cccagcacccccucacccucaac

SEQ ID NO: 191139 - RNA, 24 nt, Human
cccagcacccccucacccucaaca

SEQ ID NO: 191140 - RNA, 22 nt, Human
cccagcccccggguaccccagc

SEQ ID NO: 191141 - RNA, 24 nt, Human
cccaugugcccagauuuucuccca

SEQ ID NO: 191142 - RNA, 24 nt, Human
cccugggucccugggaguggccuc

SEQ ID NO: 191143 - RNA, 21 nt, Human
ccucccugggcaggcaccuag

SEQ ID NO: 191144 - RNA, 22 nt, Human
ccucccugggcaggcaccuagu

SEQ ID NO: 191145 - RNA, 22 nt, Human
ccuccuccguuccucccugggc

SEQ ID NO: 191146 - RNA, 21 nt, Human
ccucugggguggccaucgccu

SEQ ID NO: 191147 - RNA, 18 nt, Human
ccugggcgucagcccggg

SEQ ID NO: 191148 - RNA, 22 nt, Human
cgcgcgggccgaggggaggggc

SEQ ID NO: 191149 - RNA, 21 nt, Human
cgcucccgggcuccugacccu

SEQ ID NO: 191150 - RNA, 21 nt, Human
cggcaccugggucacacuccu

SEQ ID NO: 191151 - RNA, 20 nt, Human
cggcgagaggaagcggcacc

SEQ ID NO: 191152 - RNA, 23 nt, Human
cucugggguggccaucgccuccc

SEQ ID NO: 191153 - RNA, 23 nt, Human
cuggaucaauggcagacaaaggu

SEQ ID NO: 191154 - RNA, 25 nt, Human
cugggcgaugggguguauuuuuccu

SEQ ID NO: 191155 - RNA, 22 nt, Human
cugggguggccaucgccucccu

SEQ ID NO: 191156 - RNA, 22 nt, Human
cuuccccagcccccggguaccc

SEQ ID NO: 191157 - RNA, 21 nt, Human
cuuguagcgcgaguccuccuc

SEQ ID NO: 191158 - RNA, 21 nt, Human
cuuuuagcucuggcaccugcu

SEQ ID NO: 191159 - RNA, 19 nt, Human
gagaugggggaggcauuca

SEQ ID NO: 191160 - RNA, 21 nt, Human
gaguccuccuccguuccuccc

SEQ ID NO: 191161 - RNA, 20 nt, Human
ggagaugggggaggcauuca

SEQ ID NO: 191162 - RNA, 23 nt, Human
ggccgggccaggccgggccgggg

SEQ ID NO: 191163 - RNA, 22 nt, Human
ggggagggucgcgcucccgggc

SEQ ID NO: 191164 - RNA, 20 nt, Human
guccuccuccguuccucccu

SEQ ID NO: 191165 - RNA, 19 nt, Human
guggagcaaaagguggccu

SEQ ID NO: 191166 - RNA, 18 nt, Human
guggcuaucucgggaaga

SEQ ID NO: 191167 - RNA, 25 nt, Human
uaccccagcacccccucacccucaa

SEQ ID NO: 191168 - RNA, 21 nt, Human
ucccugggcaggcaccuagug

SEQ ID NO: 191169 - RNA, 23 nt, Human
ucccugggucccugggaguggcc

SEQ ID NO: 191170 - RNA, 22 nt, Human
ucucccaccuccguggagcaaa

SEQ ID NO: 191171 - RNA, 21 nt, Human
ucuggugguaucagcaggggu

SEQ ID NO: 191172 - RNA, 22 nt, Human
ugacuuauuuccuugcuucccc

SEQ ID NO: 191173 - RNA, 19 nt, Human
ugagcugauguuguccugc

SEQ ID NO: 191174 - RNA, 23 nt, Human
uggagaugggggaggcauucagg

SEQ ID NO: 191175 - RNA, 21 nt, Human
uggaucaauggcagacaaagg

SEQ ID NO: 191176 - RNA, 23 nt, Human
uggaucaauggcagacaaaggua

SEQ ID NO: 191177 - RNA, 24 nt, Human
ugggcgaugggguguauuuuuccu

SEQ ID NO: 191178 - RNA, 22 nt, Human
ugggggaggcauucagggaagu

SEQ ID NO: 191179 - RNA, 21 nt, Human
uuccccagcccccggguaccc

SEQ ID NO: 191180 - RNA, 24 nt, Human
uuccugauggagaugggggaggca

SEQ ID NO: 191181 - RNA, 18 nt, Human
uucucccaccuccgugga

SEQ ID NO: 191182 - RNA, 19 nt, Human
aaaaaaacuaccaaagaca

SEQ ID NO: 191183 - RNA, 22 nt, Human
aggcaagaucaggcagcaugca

SEQ ID NO: 191184 - RNA, 24 nt, Human
caagaucaggcagcaugcaggcca

SEQ ID NO: 191185 - RNA, 23 nt, Human
cuccugaaguuagugcaaaaaaa

SEQ ID NO: 191186 - RNA, 21 nt, Human
gaauacaguaauaggcaggag

SEQ ID NO: 191187 - RNA, 21 nt, Human
gcaaaaaaacuaccaaagaca

SEQ ID NO: 191188 - RNA, 19 nt, Human
uacaguaauaggcaggaga

SEQ ID NO: 191189 - RNA, 21 nt, Human
uacaguaauaggcaggagaac

SEQ ID NO: 191190 - RNA, 24 nt, Human
ugcaaaaaaacuaccaaagacaac

SEQ ID NO: 191191 - RNA, 22 nt, Human
uggggcauaagcaaaggaauag

SEQ ID NO: 191192 - RNA, 21 nt, Human
uuagaaguagagaauacagua

SEQ ID NO: 191193 - RNA, 23 nt, Human
uuuuauuuuuauuuagaaguaga

SEQ ID NO: 191194 - RNA, 25 nt, Human
aaaccucuggcaccaccgcagagua

SEQ ID NO: 191195 - RNA, 18 nt, Human
aaagccccagaccugaaa

SEQ ID NO: 191196 - RNA, 19 nt, Human
aaucacaccccuccugccc

SEQ ID NO: 191197 - RNA, 22 nt, Human
acagcacagcacacaugagggg

SEQ ID NO: 191198 - RNA, 19 nt, Human
accccggaggugucuaggg

SEQ ID NO: 191199 - RNA, 22 nt, Human
accccggaggugucuagggaau

SEQ ID NO: 191200 - RNA, 25 nt, Human
accccuccugcccuccccucucaac

SEQ ID NO: 191201 - RNA, 22 nt, Human
agaaagacaggaaggcaucugg

SEQ ID NO: 191202 - RNA, 22 nt, Human
agaaaggaagaguaggaucugg

SEQ ID NO: 191203 - RNA, 19 nt, Human
agaacccagugaccucagu

SEQ ID NO: 191204 - RNA, 22 nt, Human
agagcaguugggaauaagccag

SEQ ID NO: 191205 - RNA, 24 nt, Human
agcagagaggcaggacaggcgggg

SEQ ID NO: 191206 - RNA, 18 nt, Human
agccagguuagggguggg

SEQ ID NO: 191207 - RNA, 25 nt, Human
aggaaggcaucuggacugagacugu

SEQ ID NO: 191208 - RNA, 26 nt, Human
aggcagagccuggcucugacauggug

SEQ ID NO: 191209 - RNA, 18 nt, Human
aggcaggacaggcgggga

SEQ ID NO: 191210 - RNA, 21 nt, Human
aggcagggcacaguuugggga

SEQ ID NO: 191211 - RNA, 18 nt, Human
agggccagaaagacagga

SEQ ID NO: 191212 - RNA, 22 nt, Human
agggugcggggccgaguagcug

SEQ ID NO: 191213 - RNA, 18 nt, Human
aggugcaggacgcucggc

SEQ ID NO: 191214 - RNA, 24 nt, Human
agugcagaucuggagcggggguuu

SEQ ID NO: 191215 - RNA, 19 nt, Human
cacaccccuccugcccucc

SEQ ID NO: 191216 - RNA, 21 nt, Human
caccaaagcugaaggcagggc

SEQ ID NO: 191217 - RNA, 19 nt, Human
caccccuccugcccucccc

SEQ ID NO: 191218 - RNA, 23 nt, Human
cacuccaaucacaccccuccugc

SEQ ID NO: 191219 - RNA, 18 nt, Human
caggaaggggggcuccgg

SEQ ID NO: 191220 - RNA, 20 nt, Human
caggacaggcggggagugug

SEQ ID NO: 191221 - RNA, 23 nt, Human
caucccucccagagccccacuuc

SEQ ID NO: 191222 - RNA, 23 nt, Human
ccaagcggugcagacacagcaca

SEQ ID NO: 191223 - RNA, 20 nt, Human
ccaaucacaccccuccugcc

SEQ ID NO: 191224 - RNA, 18 nt, Human
ccacagaguugcgcuugc

SEQ ID NO: 191225 - RNA, 26 nt, Human
ccagcggcccguuccggggauccucc

SEQ ID NO: 191226 - RNA, 22 nt, Human
ccaugccagguuuccuaaaacc

SEQ ID NO: 191227 - RNA, 24 nt, Human
ccccuccugcccuccccucucaac

SEQ ID NO: 191228 - RNA, 21 nt, Human
cccuccugcccuccccucuca

SEQ ID NO: 191229 - RNA, 21 nt, Human
cccucucaacugcaaaccaag

SEQ ID NO: 191230 - RNA, 21 nt, Human
cccuuucaccaaagcugaagg

SEQ ID NO: 191231 - RNA, 21 nt, Human
ccuccaggcagagccuggcuc

SEQ ID NO: 191232 - RNA, 26 nt, Human
ccuccccucucaacugcaaaccaagc

SEQ ID NO: 191233 - RNA, 27 nt, Human
ccuccugcccuccccucucaacugcaa

SEQ ID NO: 191234 - RNA, 21 nt, Human
cggggugcugagugagcugga

SEQ ID NO: 191235 - RNA, 21 nt, Human
cuaaaaccucuggcaccaccg

SEQ ID NO: 191236 - RNA, 23 nt, Human
cuaaaaccucuggcaccaccgca

SEQ ID NO: 191237 - RNA, 22 nt, Human
cuccugcccuccccucucaacu

SEQ ID NO: 191238 - RNA, 21 nt, Human
cugaaagugccccggcucugg

SEQ ID NO: 191239 - RNA, 22 nt, Human
cuggagccagagaaaggcacgg

SEQ ID NO: 191240 - RNA, 24 nt, Human
cuggaggggguggaguguuuggcg

SEQ ID NO: 191241 - RNA, 21 nt, Human
cuggagugcaggaacuuggaa

SEQ ID NO: 191242 - RNA, 20 nt, Human
cuucuggaguugaaauggag

SEQ ID NO: 191243 - RNA, 22 nt, Human
gaacaucccucccagagcccca

SEQ ID NO: 191244 - RNA, 19 nt, Human
gacugggugggggcacugc

SEQ ID NO: 191245 - RNA, 18 nt, Human
gacuguguguccuccaga

SEQ ID NO: 191246 - RNA, 22 nt, Human
gacuguguguccuccagaagga

SEQ ID NO: 191247 - RNA, 19 nt, Human
gagccagagaaaggcacgg

SEQ ID NO: 191248 - RNA, 25 nt, Human
gagggcuagaacaucccucccagag

SEQ ID NO: 191249 - RNA, 20 nt, Human
gaggugcaggacgcucggcc

SEQ ID NO: 191250 - RNA, 24 nt, Human
gaugacaggagccggauggaggga

SEQ ID NO: 191251 - RNA, 20 nt, Human
gauucuggagugcaggaacu

SEQ ID NO: 191252 - RNA, 23 nt, Human
gcagagccuggcucugacaugcc

SEQ ID NO: 191253 - RNA, 20 nt, Human
gcaggaacuuggaaacugga

SEQ ID NO: 191254 - RNA, 21 nt, Human
gcaggaaggggggcuccgggg

SEQ ID NO: 191255 - RNA, 20 nt, Human
gcauccucucucuggagcag

SEQ ID NO: 191256 - RNA, 23 nt, Human
gcggugcagacacagcacagcac

SEQ ID NO: 191257 - RNA, 19 nt, Human
gcucugacaugccagggag

SEQ ID NO: 191258 - RNA, 19 nt, Human
ggaagcuugcaagacgcuc

SEQ ID NO: 191259 - RNA, 24 nt, Human
ggccagaaagacaggaaggcaucu

SEQ ID NO: 191260 - RNA, 21 nt, Human
ggcucugacaugccagggagg

SEQ ID NO: 191261 - RNA, 21 nt, Human
ggcucuggacuugaucgcccc

SEQ ID NO: 191262 - RNA, 20 nt, Human
gggaagacagccagcucugu

SEQ ID NO: 191263 - RNA, 21 nt, Human
gggcuagaacaucccucccag

SEQ ID NO: 191264 - RNA, 19 nt, Human
ggggaagacagccagcucu

SEQ ID NO: 191265 - RNA, 18 nt, Human
gggggcucuaaaagcccc

SEQ ID NO: 191266 - RNA, 18 nt, Human
uaaaaccucuggcaccac

SEQ ID NO: 191267 - RNA, 31 nt, Human
uaccuucaaacucugaaagugccccggcucu

SEQ ID NO: 191268 - RNA, 18 nt, Human
uagaagccaggaccuaga

SEQ ID NO: 191269 - RNA, 19 nt, Human
ucacaccccuccugcccuc

SEQ ID NO: 191270 - RNA, 21 nt, Human
ucaguucuggaucaugggaaa

SEQ ID NO: 191271 - RNA, 19 nt, Human
uccagaaggaaugagcagc

SEQ ID NO: 191272 - RNA, 25 nt, Human
uccugcccuccccucucaacugcaa

SEQ ID NO: 191273 - RNA, 26 nt, Human
ucuaaaagccccagaccugaaagcac

SEQ ID NO: 191274 - RNA, 25 nt, Human
ucucaacugcaaaccaagcggugca

SEQ ID NO: 191275 - RNA, 21 nt, Human
ucuccagguagggaccccgga

SEQ ID NO: 191276 - RNA, 25 nt, Human
ucuccagguagggaccccggaggug

SEQ ID NO: 191277 - RNA, 22 nt, Human
ucuccggacacacuccaaucac

SEQ ID NO: 191278 - RNA, 24 nt, Human
ucuccggacacacuccaaucacac

SEQ ID NO: 191279 - RNA, 22 nt, Human
ucugaaagugccccggcucugg

SEQ ID NO: 191280 - RNA, 25 nt, Human
ucuggagugcaggaacuuggaaacu

SEQ ID NO: 191281 - RNA, 23 nt, Human
ugaaagugccccggcucuggacu

SEQ ID NO: 191282 - RNA, 21 nt, Human
ugaaauggaggaccaucugcu

SEQ ID NO: 191283 - RNA, 18 nt, Human
ugccccggcucuggacuu

SEQ ID NO: 191284 - RNA, 24 nt, Human
ugcccuccccucucaacugcaaac

SEQ ID NO: 191285 - RNA, 18 nt, Human
ugcugagugagcuggagg

SEQ ID NO: 191286 - RNA, 20 nt, Human
uggagccagagaaaggcacg

SEQ ID NO: 191287 - RNA, 23 nt, Human
ugggaagcgguccaggcccaggg

SEQ ID NO: 191288 - RNA, 24 nt, Human
ugggcagagcaguugggaauaagc

SEQ ID NO: 191289 - RNA, 18 nt, Human
ugggggcacugcggggcc

SEQ ID NO: 191290 - RNA, 22 nt, Human
uggugcccgacgggaagcuugc

SEQ ID NO: 191291 - RNA, 20 nt, Human
uguaugcuguagaauuugua

SEQ ID NO: 191292 - RNA, 23 nt, Human
uguccacagaguugcgcuugcug

SEQ ID NO: 191293 - RNA, 19 nt, Human
uucccuggagggagaucuc

SEQ ID NO: 191294 - RNA, 23 nt, Human
uuccuaaaaccucuggcaccacc

SEQ ID NO: 191295 - RNA, 21 nt, Human
uucuggaucaugggaaaggga

SEQ ID NO: 191296 - RNA, 25 nt, Human
uugcugccgcugguggaggaggugc

SEQ ID NO: 191297 - RNA, 19 nt, Human
uuggcggacuggguggggg

SEQ ID NO: 191298 - RNA, 27 nt, Human
uuuucaucucaucuccggacacacucc

SEQ ID NO: 191299 - RNA, 23 nt, Human
cgggggcuuaguuugcuuccugu

SEQ ID NO: 191300 - RNA, 20 nt, Human
cuucucaggaaggcugcccu

SEQ ID NO: 191301 - RNA, 22 nt, Human
uaaaucuggacuuggcuccaga

SEQ ID NO: 191302 - RNA, 19 nt, Human
ucucaggaaggcugcccug

SEQ ID NO: 191303 - RNA, 22 nt, Human
ucucaggaaggcugcccugguu

SEQ ID NO: 191304 - RNA, 20 nt, Human
cacccaccccacugcacccc

SEQ ID NO: 191305 - RNA, 24 nt, Human
cacccaccccacugcaccccugga

SEQ ID NO: 191306 - RNA, 19 nt, Human
cacccguccucacccaccc

SEQ ID NO: 191307 - RNA, 22 nt, Human
cccaccccacugcaccccugga

SEQ ID NO: 191308 - RNA, 24 nt, Human
ccucccugucccucccacccgucc

SEQ ID NO: 191309 - RNA, 18 nt, Human
gacagcgagggggucccc

SEQ ID NO: 191310 - RNA, 19 nt, Human
gagacccagugugggugcu

SEQ ID NO: 191311 - RNA, 26 nt, Human
gcuggccccggccccgagccgguucc

SEQ ID NO: 191312 - RNA, 23 nt, Human
ggaaggguccuguggagacagcg

SEQ ID NO: 191313 - RNA, 20 nt, Human
gguccuguggagacagcgag

SEQ ID NO: 191314 - RNA, 23 nt, Human
uauuggucccucccugucccucc

SEQ ID NO: 191315 - RNA, 19 nt, Human
ucccugucccucccacccg

SEQ ID NO: 191316 - RNA, 18 nt, Human
uccuguggagacagcgag

SEQ ID NO: 191317 - RNA, 20 nt, Human
ugauuuauuggucccucccu

SEQ ID NO: 191318 - RNA, 21 nt, Human
ugggugcuggccccggccccg

SEQ ID NO: 191319 - RNA, 19 nt, Human
uggucccucccugucccuc

SEQ ID NO: 191320 - RNA, 20 nt, Human
uggucccucccugucccucc

SEQ ID NO: 191321 - RNA, 20 nt, Human
ugucccucccacccguccuc

SEQ ID NO: 191322 - RNA, 22 nt, Human
uuaugauuuauuggucccuccc

SEQ ID NO: 191323 - RNA, 20 nt, Human
aaaacacacaagcccccccc

SEQ ID NO: 191324 - RNA, 24 nt, Human
aaaaggagaaaauuauuuacagaa

SEQ ID NO: 191325 - RNA, 25 nt, Human
aaacaagccaacaaaacacacaagc

SEQ ID NO: 191326 - RNA, 19 nt, Human
aaacacacaagcccccccc

SEQ ID NO: 191327 - RNA, 24 nt, Human
aaacuaaguacuagcccuagauau

SEQ ID NO: 191328 - RNA, 22 nt, Human
aaagacagcaaaauuuucccgg

SEQ ID NO: 191329 - RNA, 18 nt, Human
aacaaaacacacaagccc

SEQ ID NO: 191330 - RNA, 22 nt, Human
aacaaaacacacaagccccccc

SEQ ID NO: 191331 - RNA, 19 nt, Human
aacuacuuauaauaaagga

SEQ ID NO: 191332 - RNA, 25 nt, Human
aagaaaauagggaggccgaaagggc

SEQ ID NO: 191333 - RNA, 19 nt, Human
aagacagcaaaauuuuccc

SEQ ID NO: 191334 - RNA, 21 nt, Human
aagcaaagacaccucuuguac

SEQ ID NO: 191335 - RNA, 19 nt, Human
aaggaaaacucacucaccc

SEQ ID NO: 191336 - RNA, 20 nt, Human
aaggaaacuggguuugggcc

SEQ ID NO: 191337 - RNA, 19 nt, Human
acaaaacacacaagccccc

SEQ ID NO: 191338 - RNA, 22 nt, Human
acaaaacacacaagcccccccc

SEQ ID NO: 191339 - RNA, 24 nt, Human
acagcaaaauuuucccggcacaag

SEQ ID NO: 191340 - RNA, 18 nt, Human
accccacuccccuucccu

SEQ ID NO: 191341 - RNA, 22 nt, Human
accucuuguacaggaggaacaa

SEQ ID NO: 191342 - RNA, 25 nt, Human
acugcccgcccacucccccuccccc

SEQ ID NO: 191343 - RNA, 22 nt, Human
acugccuugugucuucucccca

SEQ ID NO: 191344 - RNA, 23 nt, Human
agaacaaacugccuugugucuuc

SEQ ID NO: 191345 - RNA, 21 nt, Human
agaacagaagggggcaaaagg

SEQ ID NO: 191346 - RNA, 23 nt, Human
agaacagaagggggcaaaaggug

SEQ ID NO: 191347 - RNA, 19 nt, Human
agaaggaaacuggguuugg

SEQ ID NO: 191348 - RNA, 22 nt, Human
agccaacaaaacacacaagccc

SEQ ID NO: 191349 - RNA, 19 nt, Human
agccggcuuugcgaggccc

SEQ ID NO: 191350 - RNA, 25 nt, Human
agccggcuuugcgaggcccagcccc

SEQ ID NO: 191351 - RNA, 22 nt, Human
aggcgccuuccaaagggccagc

SEQ ID NO: 191352 - RNA, 19 nt, Human
auccaucgauugcguggaa

SEQ ID NO: 191353 - RNA, 23 nt, Human
aucgauugcguggaaaaaccuag

SEQ ID NO: 191354 - RNA, 21 nt, Human
auggcaaacaagccaacaaaa

SEQ ID NO: 191355 - RNA, 23 nt, Human
auggcaaacaagccaacaaaaca

SEQ ID NO: 191356 - RNA, 22 nt, Human
auuuacagaaaauaggagacag

SEQ ID NO: 191357 - RNA, 21 nt, Human
caaaacacacaagcccccccc

SEQ ID NO: 191358 - RNA, 19 nt, Human
caaacaagccaacaaaaca

SEQ ID NO: 191359 - RNA, 24 nt, Human
caaacaagccaacaaaacacacaa

SEQ ID NO: 191360 - RNA, 21 nt, Human
caaagacagcaaaauuuuccc

SEQ ID NO: 191361 - RNA, 24 nt, Human
caacaaaacacacaagcccccccc

SEQ ID NO: 191362 - RNA, 21 nt, Human
caagcaaagacaccucuugua

SEQ ID NO: 191363 - RNA, 20 nt, Human
caagccaacaaaacacacaa

SEQ ID NO: 191364 - RNA, 24 nt, Human
caagccaacaaaacacacaagccc

SEQ ID NO: 191365 - RNA, 19 nt, Human
caccaaaccaagcaaagac

SEQ ID NO: 191366 - RNA, 24 nt, Human
caccucucuccugcuggccaaagg

SEQ ID NO: 191367 - RNA, 19 nt, Human
cacucccccucccccuccc

SEQ ID NO: 191368 - RNA, 24 nt, Human
cagaacaaacugccuugugucuuc

SEQ ID NO: 191369 - RNA, 20 nt, Human
cagaagggggcaaaaggugg

SEQ ID NO: 191370 - RNA, 22 nt, Human
cagaagggggcaaaagguggug

SEQ ID NO: 191371 - RNA, 18 nt, Human
cagaucuagcucuguaaa

SEQ ID NO: 191372 - RNA, 22 nt, Human
cagccccaccaaaccaagcaaa

SEQ ID NO: 191373 - RNA, 21 nt, Human
caggaggaacaaaaauccaga

SEQ ID NO: 191374 - RNA, 22 nt, Human
caucaagagagaaaaaaggaga

SEQ ID NO: 191375 - RNA, 18 nt, Human
ccaaaccaagcaaagaca

SEQ ID NO: 191376 - RNA, 18 nt, Human
ccaacaaaacacacaagc

SEQ ID NO: 191377 - RNA, 20 nt, Human
ccaacaaaacacacaagccc

SEQ ID NO: 191378 - RNA, 21 nt, Human
ccaacaaaacacacaagcccc

SEQ ID NO: 191379 - RNA, 23 nt, Human
ccaacaaaacacacaagcccccc

SEQ ID NO: 191380 - RNA, 21 nt, Human
ccacucccccucccccucccg

SEQ ID NO: 191381 - RNA, 20 nt, Human
ccagccccgccggucugucg

SEQ ID NO: 191382 - RNA, 21 nt, Human
ccccaccaaaccaagcaaaga

SEQ ID NO: 191383 - RNA, 26 nt, Human
ccccaccaaaccaagcaaagacaccu

SEQ ID NO: 191384 - RNA, 30 nt, Human
ccccaccaaaccaagcaaagacaccucuuu

SEQ ID NO: 191385 - RNA, 18 nt, Human
cccgcaaaucccuaaccc

SEQ ID NO: 191386 - RNA, 20 nt, Human
ccucucuccugcuggccaaa

SEQ ID NO: 191387 - RNA, 25 nt, Human
ccucuuguacaggaggaacaaaaau

SEQ ID NO: 191388 - RNA, 21 nt, Human
ccugagccccugacuaccggg

SEQ ID NO: 191389 - RNA, 21 nt, Human
cuaacaaaaaugagaaggaaa

SEQ ID NO: 191390 - RNA, 22 nt, Human
cuaccgggccagucuggagugc

SEQ ID NO: 191391 - RNA, 19 nt, Human
cucaaggaaaacucacuca

SEQ ID NO: 191392 - RNA, 18 nt, Human
cucccuuuucccagcucc

SEQ ID NO: 191393 - RNA, 18 nt, Human
cucgccgagccggcuuug

SEQ ID NO: 191394 - RNA, 21 nt, Human
cucggcaccgggcucugccuc

SEQ ID NO: 191395 - RNA, 21 nt, Human
cugaagccacaaagauccccc

SEQ ID NO: 191396 - RNA, 26 nt, Human
cugaagccacaaagaucccccaaugg

SEQ ID NO: 191397 - RNA, 18 nt, Human
cugagccccugacuaccg

SEQ ID NO: 191398 - RNA, 21 nt, Human
cugagccccugacuaccgggc

SEQ ID NO: 191399 - RNA, 18 nt, Human
cugcccgcccacuccccc

SEQ ID NO: 191400 - RNA, 22 nt, Human
cugccucccuuuucccagcucc

SEQ ID NO: 191401 - RNA, 22 nt, Human
cugcucccuaccaccucucucc

SEQ ID NO: 191402 - RNA, 22 nt, Human
cuuggcugacuccccacccuuc

SEQ ID NO: 191403 - RNA, 21 nt, Human
gaaaauaggagacaggaggga

SEQ ID NO: 191404 - RNA, 20 nt, Human
gaccgcggugaggacagggc

SEQ ID NO: 191405 - RNA, 22 nt, Human
gagccccugacuaccgggccag

SEQ ID NO: 191406 - RNA, 18 nt, Human
gagcucgccgagccggcu

SEQ ID NO: 191407 - RNA, 20 nt, Human
gauauguauauauacacaaa

SEQ ID NO: 191408 - RNA, 19 nt, Human
gauauuccugcuaaccuca

SEQ ID NO: 191409 - RNA, 25 nt, Human
gcaaaacaaaauauaaguacauucu

SEQ ID NO: 191410 - RNA, 20 nt, Human
gcagccccaccaaaccaagc

SEQ ID NO: 191411 - RNA, 21 nt, Human
gcccacucccccucccccucc

SEQ ID NO: 191412 - RNA, 23 nt, Human
gcugaagccacaaagauccccca

SEQ ID NO: 191413 - RNA, 21 nt, Human
gggggggggacgcgcaagugc

SEQ ID NO: 191414 - RNA, 24 nt, Human
gggugggggggggacgcgcaagug

SEQ ID NO: 191415 - RNA, 21 nt, Human
gguggugagcaucaagagaga

SEQ ID NO: 191416 - RNA, 20 nt, Human
gucuuccuaggacacaaucc

SEQ ID NO: 191417 - RNA, 24 nt, Human
gugggggggggacgcgcaagugcg

SEQ ID NO: 191418 - RNA, 23 nt, Human
uaaaaauaagagaaagacaacug

SEQ ID NO: 191419 - RNA, 22 nt, Human
uaaaauuacaaagacagcaaaa

SEQ ID NO: 191420 - RNA, 18 nt, Human
uaacaaaaaugagaagga

SEQ ID NO: 191421 - RNA, 30 nt, Human
uacacaaacacacacaugcacacagaucuu

SEQ ID NO: 191422 - RNA, 18 nt, Human
uagauauguauauauaca

SEQ ID NO: 191423 - RNA, 20 nt, Human
uagccagaacaaacugccuu

SEQ ID NO: 191424 - RNA, 19 nt, Human
uagggaggccgaaagggca

SEQ ID NO: 191425 - RNA, 18 nt, Human
uauaaagucagaacagaa

SEQ ID NO: 191426 - RNA, 23 nt, Human
uauaauaaaggacucaaaaagag

SEQ ID NO: 191427 - RNA, 24 nt, Human
uauauacacaaacacacacaugca

SEQ ID NO: 191428 - RNA, 26 nt, Human
uauauacacaaacacacacaugcaca

SEQ ID NO: 191429 - RNA, 28 nt, Human
uauauacacaaacacacacaugcacaca

SEQ ID NO: 191430 - RNA, 18 nt, Human
uauauauacacaaacaca

SEQ ID NO: 191431 - RNA, 18 nt, Human
ucaaaaagagaucgggag

SEQ ID NO: 191432 - RNA, 22 nt, Human
ucaguuucucccuuuuccaauu

SEQ ID NO: 191433 - RNA, 24 nt, Human
ucccaaaucgacugcaguaagucu

SEQ ID NO: 191434 - RNA, 21 nt, Human
uccgcaagaaaagacuucauu

SEQ ID NO: 191435 - RNA, 19 nt, Human
uccugagccccugacuacc

SEQ ID NO: 191436 - RNA, 19 nt, Human
ucuccugcuggccaaaggu

SEQ ID NO: 191437 - RNA, 22 nt, Human
ucugccucccuuuucccagcuc

SEQ ID NO: 191438 - RNA, 22 nt, Human
ucugccuccucugccucccccc

SEQ ID NO: 191439 - RNA, 19 nt, Human
ucugccucugccuccucuc

SEQ ID NO: 191440 - RNA, 21 nt, Human
ucugccucugccucugccucc

SEQ ID NO: 191441 - RNA, 21 nt, Human
ucugccucugccucugccucc

SEQ ID NO: 191442 - RNA, 20 nt, Human
ucugcuccugagccccugac

SEQ ID NO: 191443 - RNA, 23 nt, Human
ugaaacucucacaacgggugccc

SEQ ID NO: 191444 - RNA, 18 nt, Human
ugacuaccgggccagucu

SEQ ID NO: 191445 - RNA, 18 nt, Human
ugacuccccacccuuccc

SEQ ID NO: 191446 - RNA, 18 nt, Human
ugagaaggaaacuggguu

SEQ ID NO: 191447 - RNA, 26 nt, Human
ugagccccugacuaccgggccagucu

SEQ ID NO: 191448 - RNA, 21 nt, Human
ugcccaacucaaggaaaacuc

SEQ ID NO: 191449 - RNA, 18 nt, Human
ugccucugccucugccuc

SEQ ID NO: 191450 - RNA, 18 nt, Human
ugccucugccucugccuc

SEQ ID NO: 191451 - RNA, 19 nt, Human
ugccuugugucuucucccc

SEQ ID NO: 191452 - RNA, 21 nt, Human
ugcucaccacugggaggugga

SEQ ID NO: 191453 - RNA, 21 nt, Human
ugcuguccuugcacaacuggu

SEQ ID NO: 191454 - RNA, 22 nt, Human
uggcaaacaagccaacaaaaca

SEQ ID NO: 191455 - RNA, 19 nt, Human
uggcuacauccuagcugac

SEQ ID NO: 191456 - RNA, 20 nt, Human
uggcuacauccuagcugacu

SEQ ID NO: 191457 - RNA, 20 nt, Human
uuagcggcggcgggcggacc

SEQ ID NO: 191458 - RNA, 20 nt, Human
uuuacagaaaauaggagaca

SEQ ID NO: 191459 - RNA, 19 nt, Human
uauaaaccugacgaagcag

SEQ ID NO: 191460 - RNA, 18 nt, Human
agccuuuuggguuuuaga

SEQ ID NO: 191461 - RNA, 27 nt, Human
cagaaaagacaauaaguaaucucaaac

SEQ ID NO: 191462 - RNA, 21 nt, Human
uaaucucaaacugucagaaca

SEQ ID NO: 191463 - RNA, 21 nt, Human
uggguggcucugaaaagagcc

SEQ ID NO: 191464 - RNA, 21 nt, Human
aagcgugagcgagagcaauuc

SEQ ID NO: 191465 - RNA, 22 nt, Human
aagcgugagcgagagcaauucg

SEQ ID NO: 191466 - RNA, 19 nt, Human
gccggaagcagaggcacug

SEQ ID NO: 191467 - RNA, 22 nt, Human
gcucugaaaagagccuuugggu

SEQ ID NO: 191468 - RNA, 21 nt, Human
uggguggcucugaaaagagcc

SEQ ID NO: 191469 - RNA, 22 nt, Human
aacugcuagaagagaauaagcu

SEQ ID NO: 191470 - RNA, 21 nt, Human
agccuuuggggcuuuguugcg

SEQ ID NO: 191471 - RNA, 25 nt, Human
cuuuggggcuuuguugcgguuuuca

SEQ ID NO: 191472 - RNA, 27 nt, Human
cuuuggggcuuuguugcgguuuucaca

SEQ ID NO: 191473 - RNA, 18 nt, Human
gcuuuguugcgguuuuca

SEQ ID NO: 191474 - RNA, 22 nt, Human
ggcaagaaacugcuagaagaga

SEQ ID NO: 191475 - RNA, 24 nt, Human
ggcuuuguugcgguuuucacacgc

SEQ ID NO: 191476 - RNA, 19 nt, Human
uggcaagaaacugcuagaa

SEQ ID NO: 191477 - RNA, 24 nt, Human
uggcaagaaacugcuagaagagaa

SEQ ID NO: 191478 - RNA, 21 nt, Human
uggguggcucugaaaagagcc

SEQ ID NO: 191479 - RNA, 21 nt, Human
uguugcgguuuucacacgcca

SEQ ID NO: 191480 - RNA, 23 nt, Human
aacuccugccuggcgaucgggaa

SEQ ID NO: 191481 - RNA, 24 nt, Human
agcgauaguagucaccgagagaaa

SEQ ID NO: 191482 - RNA, 18 nt, Human
cacaggugccccuucgag

SEQ ID NO: 191483 - RNA, 22 nt, Human
cgagagaaacuccugccuggcg

SEQ ID NO: 191484 - RNA, 20 nt, Human
cgggcugggcccacuugggc

SEQ ID NO: 191485 - RNA, 18 nt, Human
cuuuugaguucacaggug

SEQ ID NO: 191486 - RNA, 19 nt, Human
gacagcgauaguagucacc

SEQ ID NO: 191487 - RNA, 22 nt, Human
gaguucacaggugccccuucga

SEQ ID NO: 191488 - RNA, 19 nt, Human
ucacaggugccccuucgag

SEQ ID NO: 191489 - RNA, 21 nt, Human
uggguggcucugaaaagagcc

SEQ ID NO: 191490 - RNA, 22 nt, Human
uuugaguucacaggugccccuu

SEQ ID NO: 191491 - RNA, 23 nt, Human
aaccaguuuuauugcaaaaggac

SEQ ID NO: 191492 - RNA, 20 nt, Human
acaagaaaaagaacuucggu

SEQ ID NO: 191493 - RNA, 24 nt, Human
accgccgcgccgcuuccgcugccc

SEQ ID NO: 191494 - RNA, 24 nt, Human
accuaguuaugagaccaaccacac

SEQ ID NO: 191495 - RNA, 24 nt, Human
agaaaaacucaaccuaguuaugag

SEQ ID NO: 191496 - RNA, 21 nt, Human
agagcccuuauaaauaaaauc

SEQ ID NO: 191497 - RNA, 23 nt, Human
agauguaaccuaacccaacacca

SEQ ID NO: 191498 - RNA, 24 nt, Human
agcaacuugucacuccugagcaac

SEQ ID NO: 191499 - RNA, 25 nt, Human
agcaagaaguaucacccaucccuuc

SEQ ID NO: 191500 - RNA, 21 nt, Human
aguaucacccaucccuucugc

SEQ ID NO: 191501 - RNA, 21 nt, Human
aucaagucauaaccaguuuua

SEQ ID NO: 191502 - RNA, 24 nt, Human
aucucuauaaaaaugauuuuccca

SEQ ID NO: 191503 - RNA, 28 nt, Human
cacuccugagcaacagugcucacauugc

SEQ ID NO: 191504 - RNA, 20 nt, Human
cacuuggaucaagucauaac

SEQ ID NO: 191505 - RNA, 24 nt, Human
cagaagaaaaccaacuggacucua

SEQ ID NO: 191506 - RNA, 18 nt, Human
cagcagaggagaaaaacu

SEQ ID NO: 191507 - RNA, 21 nt, Human
cagccccaauuguuaaacacu

SEQ ID NO: 191508 - RNA, 20 nt, Human
cagugcucacaucacugagg

SEQ ID NO: 191509 - RNA, 24 nt, Human
ccaggacaguaaccagauguaacc

SEQ ID NO: 191510 - RNA, 21 nt, Human
cccuuauaaauaaaauccccc

SEQ ID NO: 191511 - RNA, 22 nt, Human
cccuugaaaaagcccacauucu

SEQ ID NO: 191512 - RNA, 18 nt, Human
ccgccgcgccgcuuccgc

SEQ ID NO: 191513 - RNA, 23 nt, Human
ccgccgcgccgcuuccgcugccc

SEQ ID NO: 191514 - RNA, 18 nt, Human
ccgcgccgcuuccgcugc

SEQ ID NO: 191515 - RNA, 24 nt, Human
cgaaaaaccagcaccgcccaacga

SEQ ID NO: 191516 - RNA, 21 nt, Human
gcuggugugaauaacucguuu

SEQ ID NO: 191517 - RNA, 24 nt, Human
gcuuccgcugcccgaggaagagcc

SEQ ID NO: 191518 - RNA, 18 nt, Human
guuuugugcuccuccccc

SEQ ID NO: 191519 - RNA, 25 nt, Human
uaaauuacacacaccuuaaugacaa

SEQ ID NO: 191520 - RNA, 23 nt, Human
uaacagccccaauuguuaaacac

SEQ ID NO: 191521 - RNA, 18 nt, Human
uaacccaacaccaucuua

SEQ ID NO: 191522 - RNA, 19 nt, Human
uacaaaacgccauaaaaac

SEQ ID NO: 191523 - RNA, 22 nt, Human
uaucacagugauguauggucag

SEQ ID NO: 191524 - RNA, 21 nt, Human
uaugcaagguauaaaugcgca

SEQ ID NO: 191525 - RNA, 23 nt, Human
ugaccuaaaaacuucaguaaauu

SEQ ID NO: 191526 - RNA, 19 nt, Human
ugagaccaaccacacaaca

SEQ ID NO: 191527 - RNA, 18 nt, Human
ugccacaagaaaaagaac

SEQ ID NO: 191528 - RNA, 18 nt, Human
ugcuccucccccacacca

SEQ ID NO: 191529 - RNA, 22 nt, Human
uggaaggccaucucuauaaaaa

SEQ ID NO: 191530 - RNA, 23 nt, Human
uggaaggccaucucuauaaaaau

SEQ ID NO: 191531 - RNA, 22 nt, Human
uggcagagguucagugggcugg

SEQ ID NO: 191532 - RNA, 22 nt, Human
uucuauagcugccagguuuacu

SEQ ID NO: 191533 - RNA, 21 nt, Human
uucuccgaccgccgcgccgcu

SEQ ID NO: 191534 - RNA, 24 nt, Human
uuuuuuuuuuuuuaaaggaaacug

SEQ ID NO: 191535 - RNA, 20 nt, Human
gaguggcucugaaaagagcc

SEQ ID NO: 191536 - RNA, 19 nt, Human
ggcucugagaagagccuuu

SEQ ID NO: 191537 - RNA, 18 nt, Human
aggggcucugaaaagagc

SEQ ID NO: 191538 - RNA, 21 nt, Human
cuucuugggcugauaggaaua

SEQ ID NO: 191539 - RNA, 20 nt, Human
gcucugaaaagagccuuuug

SEQ ID NO: 191540 - RNA, 18 nt, Human
guuggacagacuucuugg

SEQ ID NO: 191541 - RNA, 20 nt, Human
ugaaaagagccuuuuggggu

SEQ ID NO: 191542 - RNA, 20 nt, Human
ugaaaagagccuuuuggggu

SEQ ID NO: 191543 - RNA, 22 nt, Human
gcucugaaaagagccuuugggu

SEQ ID NO: 191544 - RNA, 26 nt, Human
ucugaaaagagccuuuggguuuuaag

SEQ ID NO: 191545 - RNA, 21 nt, Human
uggguggcucugaaaagagcc

SEQ ID NO: 191546 - RNA, 21 nt, Human
ucucagguggcgagauagccc

SEQ ID NO: 191547 - RNA, 21 nt, Human
uggggugaacguugcgcaacc

SEQ ID NO: 191548 - RNA, 20 nt, Human
uuaaaagagccuuuggggug

SEQ ID NO: 191549 - RNA, 22 nt, Human
aagcccccacguccauagccaa

SEQ ID NO: 191550 - RNA, 21 nt, Human
aagggccuuugggaucgaaac

SEQ ID NO: 191551 - RNA, 21 nt, Human
aagggccuuugggaucgaaac

SEQ ID NO: 191552 - RNA, 23 nt, Human
aaguguccaacuccucagaugag

SEQ ID NO: 191553 - RNA, 23 nt, Human
accaauaaagcaacugcugguuu

SEQ ID NO: 191554 - RNA, 22 nt, Human
agccagugacuucuguagcauu

SEQ ID NO: 191555 - RNA, 22 nt, Human
aguguuugcagccacaucugaa

SEQ ID NO: 191556 - RNA, 19 nt, Human
auaguaguuauugucuaca

SEQ ID NO: 191557 - RNA, 24 nt, Human
auucagaguccgacacaagccccc

SEQ ID NO: 191558 - RNA, 19 nt, Human
caaguguuugcagccacau

SEQ ID NO: 191559 - RNA, 20 nt, Human
caaguguuugcagccacauc

SEQ ID NO: 191560 - RNA, 23 nt, Human
cacaucugaagaccaauaaagca

SEQ ID NO: 191561 - RNA, 25 nt, Human
ccgacacaagcccccacguccauag

SEQ ID NO: 191562 - RNA, 20 nt, Human
cucagaugagcaaguggucg

SEQ ID NO: 191563 - RNA, 19 nt, Human
cuggaaggcaaggcuugca

SEQ ID NO: 191564 - RNA, 20 nt, Human
cugguaagcuucuggaaggc

SEQ ID NO: 191565 - RNA, 24 nt, Human
guaagcuucuggaaggcaaggcuu

SEQ ID NO: 191566 - RNA, 24 nt, Human
guugugaugguaagcuccuggagg

SEQ ID NO: 191567 - RNA, 22 nt, Human
uaagcuccuggagggcaagucu

SEQ ID NO: 191568 - RNA, 23 nt, Human
uacuggacuguuuauucuuaaau

SEQ ID NO: 191569 - RNA, 21 nt, Human
uauugucuacauuucucagca

SEQ ID NO: 191570 - RNA, 19 nt, Human
ucuguagcauuaggauucu

SEQ ID NO: 191571 - RNA, 20 nt, Human
uuccccgguuucccagcagc

SEQ ID NO: 191572 - RNA, 18 nt, Human
uucucccaaauacauaca

SEQ ID NO: 191573 - RNA, 21 nt, Human
caagcuguggagaaaucagca

SEQ ID NO: 191574 - RNA, 20 nt, Human
ggcggcccugaaaagggccu

SEQ ID NO: 191575 - RNA, 19 nt, Human
gggccuuugguucagaaau

SEQ ID NO: 191576 - RNA, 23 nt, Human
ugcaagcuguggagaaaucagca

SEQ ID NO: 191577 - RNA, 19 nt, Human
uguggagaaaucagcaacc

SEQ ID NO: 191578 - RNA, 19 nt, Human
aaagggccguugguuuugc

SEQ ID NO: 191579 - RNA, 19 nt, Human
cgguaguguacuguagagg

SEQ ID NO: 191580 - RNA, 23 nt, Human
uuugcgguaguguacuguagagg

SEQ ID NO: 191581 - RNA, 21 nt, Human
aagggccuuuuaugggugagc

SEQ ID NO: 191582 - RNA, 22 nt, Human
ugaaaagggccuuuuaugggug

SEQ ID NO: 191583 - RNA, 18 nt, Human
uaaaaagggccuuuuguu

SEQ ID NO: 191584 - RNA, 22 nt, Human
uaaaaagggccuuuuguugaua

SEQ ID NO: 191585 - RNA, 23 nt, Human
ugggggcccuaaaaagggccuuu

SEQ ID NO: 191586 - RNA, 24 nt, Human
ugggggcccuaaaaagggccuuuu

SEQ ID NO: 191587 - RNA, 23 nt, Human
caggagaccgcguauucuuagau

SEQ ID NO: 191588 - RNA, 24 nt, Human
uuuuuguuuuuugaaguucucagg

SEQ ID NO: 191589 - RNA, 21 nt, Human
ccuuugguugaaaaugaaaau

SEQ ID NO: 191590 - RNA, 21 nt, Human
ggccuuugguugaaaaugaaa

SEQ ID NO: 191591 - RNA, 20 nt, Human
ggcggcccugaaaagggccu

SEQ ID NO: 191592 - RNA, 23 nt, Human
ugaaaaugaaaauaagagugcag

SEQ ID NO: 191593 - RNA, 23 nt, Human
ggccauuggaagaaaacugacgg

SEQ ID NO: 191594 - RNA, 20 nt, Human
uggaagaaaacugacgaaaa

SEQ ID NO: 191595 - RNA, 18 nt, Human
gcccugagaagggccuuu

SEQ ID NO: 191596 - RNA, 18 nt, Human
ugagaagggccuuugagg

SEQ ID NO: 191597 - RNA, 19 nt, Human
cucacuuaaccgccaaagc

SEQ ID NO: 191598 - RNA, 21 nt, Human
ugcaaggaaaggccuggccuc

SEQ ID NO: 191599 - RNA, 22 nt, Human
cuuaggggcccuaaaaagggcc

SEQ ID NO: 191600 - RNA, 21 nt, Human
uuuuuagagaaugacugggcu

SEQ ID NO: 191601 - RNA, 24 nt, Human
aagcuggagaguaguaccccaggg

SEQ ID NO: 191602 - RNA, 23 nt, Human
agcguguguuuucucugccuucu

SEQ ID NO: 191603 - RNA, 23 nt, Human
aggcacagagggcgacugguagg

SEQ ID NO: 191604 - RNA, 19 nt, Human
aggcaguuacaaaauggcu

SEQ ID NO: 191605 - RNA, 26 nt, Human
caaaauggcuacugggcuuccuccca

SEQ ID NO: 191606 - RNA, 23 nt, Human
ccagggaaaggaagggcagagga

SEQ ID NO: 191607 - RNA, 27 nt, Human
ccucccaagcuggagaguaguacccca

SEQ ID NO: 191608 - RNA, 20 nt, Human
ggaaaggaagggcagaggag

SEQ ID NO: 191609 - RNA, 18 nt, Human
uaggcaguuacaaaaugg

SEQ ID NO: 191610 - RNA, 19 nt, Human
ucccaagcuggagaguagu

SEQ ID NO: 191611 - RNA, 26 nt, Human
uccucccaagcuggagaguaguaccc

SEQ ID NO: 191612 - RNA, 19 nt, Human
uuuuuuuuuuuuuuuuugu

SEQ ID NO: 191613 - RNA, 27 nt, Human
uuuuuuuuuuuuuuuuuuuuuuugggg

SEQ ID NO: 191614 - RNA, 19 nt, Human
acagacagguguguguggu

SEQ ID NO: 191615 - RNA, 18 nt, Human
acagggcuuucuuccaga

SEQ ID NO: 191616 - RNA, 24 nt, Human
acccagugccggaguuugucuucu

SEQ ID NO: 191617 - RNA, 23 nt, Human
accccuggccacccuggccucuc

SEQ ID NO: 191618 - RNA, 21 nt, Human
acugccggcagcugggguuag

SEQ ID NO: 191619 - RNA, 21 nt, Human
agaacugcccucaccaccccu

SEQ ID NO: 191620 - RNA, 18 nt, Human
agagagguggcuucagau

SEQ ID NO: 191621 - RNA, 18 nt, Human
agcaaacccagugccgga

SEQ ID NO: 191622 - RNA, 24 nt, Human
aggcacuuuaaucagggagcaacg

SEQ ID NO: 191623 - RNA, 18 nt, Human
aucccagucccucccuaa

SEQ ID NO: 191624 - RNA, 21 nt, Human
caccccuggccacccuggccu

SEQ ID NO: 191625 - RNA, 21 nt, Human
caccguggugagaagccuggg

SEQ ID NO: 191626 - RNA, 19 nt, Human
cacugccggcagcuggggu

SEQ ID NO: 191627 - RNA, 21 nt, Human
cagugggcucuaccuuccaau

SEQ ID NO: 191628 - RNA, 24 nt, Human
caucugcacagacaggugugugug

SEQ ID NO: 191629 - RNA, 20 nt, Human
ccaccccuggccacccuggc

SEQ ID NO: 191630 - RNA, 22 nt, Human
cccagugccggaguuugucuuc

SEQ ID NO: 191631 - RNA, 23 nt, Human
ccccaaagcacagggcuuucuuc

SEQ ID NO: 191632 - RNA, 20 nt, Human
ccucuugggaggaacaggca

SEQ ID NO: 191633 - RNA, 19 nt, Human
cucuuggcugccacucuag

SEQ ID NO: 191634 - RNA, 22 nt, Human
cucuugggaggaacaggcagag

SEQ ID NO: 191635 - RNA, 23 nt, Human
cugcccucaccaccccuggccac

SEQ ID NO: 191636 - RNA, 21 nt, Human
gagagauggucuuggcugaag

SEQ ID NO: 191637 - RNA, 20 nt, Human
gaggaacaggcagagaggug

SEQ ID NO: 191638 - RNA, 23 nt, Human
ggccucuugggaggaacaggcag

SEQ ID NO: 191639 - RNA, 18 nt, Human
uagugcacugacugagcg

SEQ ID NO: 191640 - RNA, 25 nt, Human
ucccccaaagcacagggcuuucuuc

SEQ ID NO: 191641 - RNA, 25 nt, Human
ucuuggcugaaggcacuuuaaucag

SEQ ID NO: 191642 - RNA, 23 nt, Human
ucuuggcugccacucuaggccuc

SEQ ID NO: 191643 - RNA, 20 nt, Human
ugagaagccugggcaaagca

SEQ ID NO: 191644 - RNA, 19 nt, Human
ugccggcagcugggguuag

SEQ ID NO: 191645 - RNA, 19 nt, Human
ugccuagaauucugcacac

SEQ ID NO: 191646 - RNA, 20 nt, Human
ugcuuuuugaaggaggcguu

SEQ ID NO: 191647 - RNA, 23 nt, Human
uggcugccacucuaggccucggg

SEQ ID NO: 191648 - RNA, 23 nt, Human
uggggaaagagguuuaauauccc

SEQ ID NO: 191649 - RNA, 22 nt, Human
uuagugcacugacugagcgagg

SEQ ID NO: 191650 - RNA, 23 nt, Human
uucgaagucacacuucaccagga

SEQ ID NO: 191651 - RNA, 19 nt, Human
uugggaggaacaggcagag

SEQ ID NO: 191652 - RNA, 19 nt, Human
uugucuucucguuacucug

SEQ ID NO: 191653 - RNA, 18 nt, Human
uuuuuuuuuuuuuuuuug

SEQ ID NO: 191654 - RNA, 20 nt, Human
uuuuuuuuuuuuuuuuugcu

SEQ ID NO: 191655 - RNA, 27 nt, Human
uuuuuuuuuuuuuuuuuuuugcugggg

SEQ ID NO: 191656 - RNA, 21 nt, Human
aaacaaccacccacacaucuc

SEQ ID NO: 191657 - RNA, 19 nt, Human
aagcucagaacacuggcaa

SEQ ID NO: 191658 - RNA, 19 nt, Human
aaucucaguugaccucuuu

SEQ ID NO: 191659 - RNA, 21 nt, Human
acaacagagaccaaaaacaac

SEQ ID NO: 191660 - RNA, 21 nt, Human
acagagaccaaaaacaaccac

SEQ ID NO: 191661 - RNA, 23 nt, Human
accaccauauuuauguaucuaaa

SEQ ID NO: 191662 - RNA, 28 nt, Human
agagaacacaucuuuaggacacagauaa

SEQ ID NO: 191663 - RNA, 22 nt, Human
caacagagaccaaaaacaacca

SEQ ID NO: 191664 - RNA, 24 nt, Human
caacagagaccaaaaacaaccacc

SEQ ID NO: 191665 - RNA, 19 nt, Human
caaccacccacacaucuca

SEQ ID NO: 191666 - RNA, 28 nt, Human
caguugaccucuuucccaacugcaaacc

SEQ ID NO: 191667 - RNA, 18 nt, Human
cccaacugcaaacccuca

SEQ ID NO: 191668 - RNA, 21 nt, Human
cccacacaucucaugugagau

SEQ ID NO: 191669 - RNA, 24 nt, Human
cugauuauugaaaagcucagaaca

SEQ ID NO: 191670 - RNA, 18 nt, Human
cuuucccaacugcaaacc

SEQ ID NO: 191671 - RNA, 25 nt, Human
gacaacagagaccaaaaacaaccac

SEQ ID NO: 191672 - RNA, 19 nt, Human
gaggagcuaggaacuacaa

SEQ ID NO: 191673 - RNA, 20 nt, Human
uaacgcugaccaccauauuu

SEQ ID NO: 191674 - RNA, 31 nt, Human
uccaaaucucaguugaccucuuucccaacuu

SEQ ID NO: 191675 - RNA, 21 nt, Human
uccaauauuucuccacuuuau

SEQ ID NO: 191676 - RNA, 23 nt, Human
uccacuuuauuaacgcugaccac

SEQ ID NO: 191677 - RNA, 19 nt, Human
ucccugaaagagcaguaaa

SEQ ID NO: 191678 - RNA, 19 nt, Human
ugccuagugugaguguugc

SEQ ID NO: 191679 - RNA, 25 nt, Human
uggaaucuuggcugacguccgcgag

SEQ ID NO: 191680 - RNA, 26 nt, Human
uggaaucuuggcugacguccgcgagg

SEQ ID NO: 191681 - RNA, 19 nt, Human
ugugaguguugcacagaaa

SEQ ID NO: 191682 - RNA, 23 nt, Human
aaaggcaagauccaggugcugcu

SEQ ID NO: 191683 - RNA, 19 nt, Human
aacugaaugaccaugaaac

SEQ ID NO: 191684 - RNA, 18 nt, Human
aagccagacucugggggc

SEQ ID NO: 191685 - RNA, 18 nt, Human
aagcugcagguaguaaaa

SEQ ID NO: 191686 - RNA, 25 nt, Human
aauuauuucuuaauggagaaucuau

SEQ ID NO: 191687 - RNA, 24 nt, Human
acaaaaaugacaagguucaaaaaa

SEQ ID NO: 191688 - RNA, 22 nt, Human
acgcagcaacagugagcauggu

SEQ ID NO: 191689 - RNA, 18 nt, Human
acgcgcgaggcgggcagc

SEQ ID NO: 191690 - RNA, 18 nt, Human
agcauucccacaggcacu

SEQ ID NO: 191691 - RNA, 18 nt, Human
aggcaauucuucacaaaa

SEQ ID NO: 191692 - RNA, 21 nt, Human
caaaauguagggcaagacuca

SEQ ID NO: 191693 - RNA, 25 nt, Human
caaaccaugcaaacagagauaugcu

SEQ ID NO: 191694 - RNA, 19 nt, Human
caaagagcauucccacagg

SEQ ID NO: 191695 - RNA, 18 nt, Human
cacucggggcacuggcug

SEQ ID NO: 191696 - RNA, 18 nt, Human
cacuugcuugccaguggc

SEQ ID NO: 191697 - RNA, 20 nt, Human
cagcgaggagacccgggcag

SEQ ID NO: 191698 - RNA, 23 nt, Human
cagcggcggcgacagcgaggagg

SEQ ID NO: 191699 - RNA, 20 nt, Human
caugaaaaccgaccuccugc

SEQ ID NO: 191700 - RNA, 25 nt, Human
cauguuugcuccaaggcaccaaggg

SEQ ID NO: 191701 - RNA, 21 nt, Human
ccaaaauguagggcaagacuc

SEQ ID NO: 191702 - RNA, 25 nt, Human
ccaaggcaccaaggguguaaagcug

SEQ ID NO: 191703 - RNA, 24 nt, Human
ccaggugcugcucgcugcagugcu

SEQ ID NO: 191704 - RNA, 21 nt, Human
cccacgcagcaacagugagca

SEQ ID NO: 191705 - RNA, 27 nt, Human
ccuccugcaaaccaugcaaacagagau

SEQ ID NO: 191706 - RNA, 19 nt, Human
cgcugcagugcuucacaga

SEQ ID NO: 191707 - RNA, 19 nt, Human
cggcgacagcgaggagacc

SEQ ID NO: 191708 - RNA, 27 nt, Human
cgggcagggaagacgcgcgaggcgggc

SEQ ID NO: 191709 - RNA, 18 nt, Human
cugacccauucagcagca

SEQ ID NO: 191710 - RNA, 19 nt, Human
cugacccauucagcagcag

SEQ ID NO: 191711 - RNA, 22 nt, Human
cugacccauucagcagcagcau

SEQ ID NO: 191712 - RNA, 19 nt, Human
gaaaaaagacacagacaga

SEQ ID NO: 191713 - RNA, 20 nt, Human
gaccuccugcaaaccaugca

SEQ ID NO: 191714 - RNA, 24 nt, Human
gaggcgggcagccgcggaaagcca

SEQ ID NO: 191715 - RNA, 19 nt, Human
gccgcggaaagccagacuc

SEQ ID NO: 191716 - RNA, 19 nt, Human
ggaaaaaagacacagacag

SEQ ID NO: 191717 - RNA, 20 nt, Human
ggaaaaaagacacagacaga

SEQ ID NO: 191718 - RNA, 19 nt, Human
ggcagccgcggaaagccag

SEQ ID NO: 191719 - RNA, 21 nt, Human
guggcagcggcggcgacagcg

SEQ ID NO: 191720 - RNA, 20 nt, Human
ucaaaaaacauguuugcucc

SEQ ID NO: 191721 - RNA, 19 nt, Human
ucuuauaaaggcaagaucc

SEQ ID NO: 191722 - RNA, 21 nt, Human
ugaacagacuaaaaaagggaa

SEQ ID NO: 191723 - RNA, 21 nt, Human
ugaccaaagagcauucccaca

SEQ ID NO: 191724 - RNA, 19 nt, Human
ugcagguaguaaaauguuc

SEQ ID NO: 191725 - RNA, 19 nt, Human
ugcccaaaauguagggcaa

SEQ ID NO: 191726 - RNA, 22 nt, Human
ugccuaaauuaccaacuuuuac

SEQ ID NO: 191727 - RNA, 24 nt, Human
ugcugacccauucagcagcagcau

SEQ ID NO: 191728 - RNA, 19 nt, Human
uggaaagcgcucucaggug

SEQ ID NO: 191729 - RNA, 21 nt, Human
uggcagcggcggcgacagcga

SEQ ID NO: 191730 - RNA, 24 nt, Human
ugugugagggaaugucugaccaaa

SEQ ID NO: 191731 - RNA, 19 nt, Human
uucacaaaaaugacaaggu

SEQ ID NO: 191732 - RNA, 22 nt, Human
uucacgacgagcugaauaaaga

SEQ ID NO: 191733 - RNA, 25 nt, Human
uucagcagcagcaucuucacgacga

SEQ ID NO: 191734 - RNA, 21 nt, Human
uuuuuuuuuuuuuuuuugccu

SEQ ID NO: 191735 - RNA, 24 nt, Human
uuuuuuuuuuuuuuuuuugccuaa

SEQ ID NO: 191736 - RNA, 27 nt, Human
uuuuuuuuuuuuuuuuuuuuuuugggg

SEQ ID NO: 191737 - RNA, 24 nt, Human
aacuuguuuucuccgcgagccccg

SEQ ID NO: 191738 - RNA, 23 nt, Human
aagagccuaauccccaaauccgc

SEQ ID NO: 191739 - RNA, 22 nt, Human
agacugaauuucccgcacggaa

SEQ ID NO: 191740 - RNA, 24 nt, Human
agccccgacugccacgggccggga

SEQ ID NO: 191741 - RNA, 23 nt, Human
agcccucggcccaccaccaugac

SEQ ID NO: 191742 - RNA, 18 nt, Human
agcggcggcggcggcggc

SEQ ID NO: 191743 - RNA, 19 nt, Human
aggcugcggcggccgagca

SEQ ID NO: 191744 - RNA, 21 nt, Human
caaaacaccggcgucggcgcg

SEQ ID NO: 191745 - RNA, 21 nt, Human
cacaguggaucccuggaggcc

SEQ ID NO: 191746 - RNA, 20 nt, Human
caccaugacccgggccgggc

SEQ ID NO: 191747 - RNA, 21 nt, Human
cagcagggcuggaccgaggcc

SEQ ID NO: 191748 - RNA, 22 nt, Human
cagcagggcuggaccgaggccu

SEQ ID NO: 191749 - RNA, 20 nt, Human
cagcgcggcgaggcugcggc

SEQ ID NO: 191750 - RNA, 22 nt, Human
cagcgcggcgaggcugcggcgg

SEQ ID NO: 191751 - RNA, 24 nt, Human
caggacugcaaaacaccggcgucg

SEQ ID NO: 191752 - RNA, 20 nt, Human
caguggaucccuggaggccg

SEQ ID NO: 191753 - RNA, 23 nt, Human
cauuagaauguccgauaacacaa

SEQ ID NO: 191754 - RNA, 20 nt, Human
ccaugacccgggccgggcug

SEQ ID NO: 191755 - RNA, 22 nt, Human
cccucagccaaucagcguccac

SEQ ID NO: 191756 - RNA, 18 nt, Human
ccgcgagccccgacugcc

SEQ ID NO: 191757 - RNA, 20 nt, Human
ccgggccgggcuggacugcc

SEQ ID NO: 191758 - RNA, 19 nt, Human
ccucgcaccguccgccaac

SEQ ID NO: 191759 - RNA, 21 nt, Human
cgccacgccgcccggguaccc

SEQ ID NO: 191760 - RNA, 23 nt, Human
cgccacgccgcccggguacccgg

SEQ ID NO: 191761 - RNA, 21 nt, Human
cgcccggguacccggcagauc

SEQ ID NO: 191762 - RNA, 20 nt, Human
cggcccgagagcugcgccgg

SEQ ID NO: 191763 - RNA, 19 nt, Human
cggcggcccgagagcugcg

SEQ ID NO: 191764 - RNA, 23 nt, Human
cggcggcggcggcggcccgagag

SEQ ID NO: 191765 - RNA, 18 nt, Human
cgggagagcugugccgcg

SEQ ID NO: 191766 - RNA, 19 nt, Human
cgggccgucgcugcgccuc

SEQ ID NO: 191767 - RNA, 18 nt, Human
cgggccugggagcggcgg

SEQ ID NO: 191768 - RNA, 23 nt, Human
cguccgccaaccaaucaacgcgc

SEQ ID NO: 191769 - RNA, 19 nt, Human
cucgcaccguccgccaacc

SEQ ID NO: 191770 - RNA, 22 nt, Human
cugccgagcugcccaggacugc

SEQ ID NO: 191771 - RNA, 28 nt, Human
cugggagcggcggcggcggcggcccuuu

SEQ ID NO: 191772 - RNA, 19 nt, Human
gagcagcccucggcccacc

SEQ ID NO: 191773 - RNA, 20 nt, Human
gagcggcggcggcggcggcc

SEQ ID NO: 191774 - RNA, 24 nt, Human
gcccucggcccaccaccaugaccc

SEQ ID NO: 191775 - RNA, 18 nt, Human
gccgggcuggacugccga

SEQ ID NO: 191776 - RNA, 19 nt, Human
gcggcggcggcggcggccc

SEQ ID NO: 191777 - RNA, 18 nt, Human
ggaaagccaguuaccuaa

SEQ ID NO: 191778 - RNA, 19 nt, Human
ggaccagcaggaaagccag

SEQ ID NO: 191779 - RNA, 20 nt, Human
ggccgagcagcccucggccc

SEQ ID NO: 191780 - RNA, 20 nt, Human
ggcggcggcggcggcccgag

SEQ ID NO: 191781 - RNA, 25 nt, Human
ggcggcggcggcggcccgagagcug

SEQ ID NO: 191782 - RNA, 21 nt, Human
ggcugcggcggccgagcagcc

SEQ ID NO: 191783 - RNA, 20 nt, Human
gggagcggcggcggcggcgg

SEQ ID NO: 191784 - RNA, 18 nt, Human
gggcuggacugccgagcg

SEQ ID NO: 191785 - RNA, 23 nt, Human
uagaauguccgauaacacaagcc

SEQ ID NO: 191786 - RNA, 19 nt, Human
ucccgcacggaccagcagg

SEQ ID NO: 191787 - RNA, 21 nt, Human
ucggcgcgucgcagccaauca

SEQ ID NO: 191788 - RNA, 22 nt, Human
ugcauuagaauguccgauaaca

SEQ ID NO: 191789 - RNA, 23 nt, Human
ugccacgggccgggagacgggcc

SEQ ID NO: 191790 - RNA, 21 nt, Human
uggcagaaaacucccagcagg

SEQ ID NO: 191791 - RNA, 18 nt, Human
ugggagcggcggcggcgg

SEQ ID NO: 191792 - RNA, 19 nt, Human
ugggagcggcggcggcggc

SEQ ID NO: 191793 - RNA, 22 nt, Human
uucuccgcgagccccgacugcc

SEQ ID NO: 191794 - RNA, 22 nt, Human
aaaacagucaaagcuuaaaaga

SEQ ID NO: 191795 - RNA, 19 nt, Human
aacaauacuucugaaguaa

SEQ ID NO: 191796 - RNA, 20 nt, Human
aguaaaacaaugaaaaauuu

SEQ ID NO: 191797 - RNA, 22 nt, Human
caaccauauugaaauuuaaucc

SEQ ID NO: 191798 - RNA, 23 nt, Human
caacugagccacuuaucuguacu

SEQ ID NO: 191799 - RNA, 25 nt, Human
caagaaaaacuaaacguuggguuua

SEQ ID NO: 191800 - RNA, 27 nt, Human
cacauaaguuuuuuucccccucauauc

SEQ ID NO: 191801 - RNA, 24 nt, Human
cccccucauaucuuccauucaaaa

SEQ ID NO: 191802 - RNA, 20 nt, Human
gcucaacugagccacuuauc

SEQ ID NO: 191803 - RNA, 19 nt, Human
uaacaaaacaauacuucug

SEQ ID NO: 191804 - RNA, 28 nt, Human
uaacaaaauguaucacaagaaaaacuaa

SEQ ID NO: 191805 - RNA, 30 nt, Human
uccuucccaaaacagucaaagcuuaaaaaa

SEQ ID NO: 191806 - RNA, 25 nt, Human
ucuguacuacaguaugguacuugaa

SEQ ID NO: 191807 - RNA, 23 nt, Human
uggguuuaacaaaacaauacuuc

SEQ ID NO: 191808 - RNA, 22 nt, Human
ugugcucaacugagccacuuau

SEQ ID NO: 191809 - RNA, 23 nt, Human
uuacacagguuaacaaaauguau

SEQ ID NO: 191810 - RNA, 23 nt, Human
aaaaaaaaaaagguuaacaaaag

SEQ ID NO: 191811 - RNA, 19 nt, Human
aaaaagcagcuuaaggaca

SEQ ID NO: 191812 - RNA, 19 nt, Human
aaaguaaaauuagccaaag

SEQ ID NO: 191813 - RNA, 19 nt, Human
aaaguucucaggucucucc

SEQ ID NO: 191814 - RNA, 26 nt, Human
aagaaagaaaaguuuuauaaucugag

SEQ ID NO: 191815 - RNA, 18 nt, Human
aagagccacccaaauagc

SEQ ID NO: 191816 - RNA, 23 nt, Human
acacaguuuaauaagagccaccc

SEQ ID NO: 191817 - RNA, 20 nt, Human
acccugggaggugcuguucu

SEQ ID NO: 191818 - RNA, 19 nt, Human
accuaccugcugcuggccc

SEQ ID NO: 191819 - RNA, 19 nt, Human
accugcugcuggcccccuu

SEQ ID NO: 191820 - RNA, 22 nt, Human
acuguuaagaaagaaagaaaag

SEQ ID NO: 191821 - RNA, 24 nt, Human
agaaaaaagcagcuuaaggacaaa

SEQ ID NO: 191822 - RNA, 23 nt, Human
agaagaaaaaagcagcuuaagga

SEQ ID NO: 191823 - RNA, 22 nt, Human
agcaaauuuaaaaaaaaaaaaa

SEQ ID NO: 191824 - RNA, 18 nt, Human
agcaggggcaggagcagg

SEQ ID NO: 191825 - RNA, 20 nt, Human
agccugagguccucagcugg

SEQ ID NO: 191826 - RNA, 18 nt, Human
aggaagguuacaauaaga

SEQ ID NO: 191827 - RNA, 22 nt, Human
aguaaaaaacaggcacauacaa

SEQ ID NO: 191828 - RNA, 26 nt, Human
aguacuaacaccaaggaagugaaaau

SEQ ID NO: 191829 - RNA, 20 nt, Human
caauuucucucucuucccuc

SEQ ID NO: 191830 - RNA, 22 nt, Human
caccucuacaauuaauagcuga

SEQ ID NO: 191831 - RNA, 22 nt, Human
cagaaaggagguugguuaaucc

SEQ ID NO: 191832 - RNA, 24 nt, Human
cagugcugaauuuagcaacuauaa

SEQ ID NO: 191833 - RNA, 20 nt, Human
caucuaaugcuaagaguaaa

SEQ ID NO: 191834 - RNA, 24 nt, Human
caucuaaugcuaagaguaaaaaac

SEQ ID NO: 191835 - RNA, 19 nt, Human
ccaauuaauagaagaaaaa

SEQ ID NO: 191836 - RNA, 19 nt, Human
cccaauuucucucucuucc

SEQ ID NO: 191837 - RNA, 24 nt, Human
ccccaaagauuccuuaucugugaa

SEQ ID NO: 191838 - RNA, 23 nt, Human
ccugcugcuggcccccuuucuuc

SEQ ID NO: 191839 - RNA, 23 nt, Human
ccuggggucucccacccugggag

SEQ ID NO: 191840 - RNA, 22 nt, Human
cucaucugcuacuucaugacaa

SEQ ID NO: 191841 - RNA, 18 nt, Human
cuggggucucccacccug

SEQ ID NO: 191842 - RNA, 18 nt, Human
cuuaaggacaaauuauga

SEQ ID NO: 191843 - RNA, 18 nt, Human
cuuugcacaugaaacucc

SEQ ID NO: 191844 - RNA, 24 nt, Human
cuuugugcuaaacugacugcccuc

SEQ ID NO: 191845 - RNA, 19 nt, Human
gaaaauaccuggugggucu

SEQ ID NO: 191846 - RNA, 25 nt, Human
gagcaggggcaggagcaggggaugc

SEQ ID NO: 191847 - RNA, 23 nt, Human
gccagaaaggccuggggucuccc

SEQ ID NO: 191848 - RNA, 27 nt, Human
ggaggggagagcuuuaugcaggagugg

SEQ ID NO: 191849 - RNA, 24 nt, Human
gggcaggagcaggggaugcagacg

SEQ ID NO: 191850 - RNA, 19 nt, Human
ggggucucccacccuggga

SEQ ID NO: 191851 - RNA, 20 nt, Human
uaaaaaacaggcacauacaa

SEQ ID NO: 191852 - RNA, 21 nt, Human
uaaaaugguuauuuaugaagg

SEQ ID NO: 191853 - RNA, 23 nt, Human
uaaaaugguuauuuaugaaggca

SEQ ID NO: 191854 - RNA, 19 nt, Human
uaaacugacugcccucuca

SEQ ID NO: 191855 - RNA, 23 nt, Human
uaacaccaaggaagugaaaauac

SEQ ID NO: 191856 - RNA, 23 nt, Human
uacaauaagaaugugaauagagu

SEQ ID NO: 191857 - RNA, 22 nt, Human
uacacaguuuaauaagagccac

SEQ ID NO: 191858 - RNA, 18 nt, Human
uaccuaggaaaguucuca

SEQ ID NO: 191859 - RNA, 24 nt, Human
uaccuaggaaaguucucaggucuc

SEQ ID NO: 191860 - RNA, 22 nt, Human
uacuaaccucaaacucccaugu

SEQ ID NO: 191861 - RNA, 19 nt, Human
ucaggguccccaauuucuc

SEQ ID NO: 191862 - RNA, 23 nt, Human
uccagaccugcugccagaaaggc

SEQ ID NO: 191863 - RNA, 21 nt, Human
ucccacccugggaggugcugu

SEQ ID NO: 191864 - RNA, 22 nt, Human
ucccauguaagcauuuggggga

SEQ ID NO: 191865 - RNA, 20 nt, Human
ucuacaauuaauagcugaag

SEQ ID NO: 191866 - RNA, 18 nt, Human
ucugaaaauaccuggugg

SEQ ID NO: 191867 - RNA, 24 nt, Human
ugagguccucagcuggucacagga

SEQ ID NO: 191868 - RNA, 21 nt, Human
ugauaaguacaaaauacacag

SEQ ID NO: 191869 - RNA, 22 nt, Human
ugccagaaaggccuggggucuc

SEQ ID NO: 191870 - RNA, 19 nt, Human
ugccaucagccuaaccaac

SEQ ID NO: 191871 - RNA, 21 nt, Human
ugcuuugugcuaaacugacca

SEQ ID NO: 191872 - RNA, 21 nt, Human
uggcuaccgggguguggucag

SEQ ID NO: 191873 - RNA, 21 nt, Human
ugggggauacguguagugaua

SEQ ID NO: 191874 - RNA, 22 nt, Human
uguagugauaaguacaaaauac

SEQ ID NO: 191875 - RNA, 18 nt, Human
ugugguuauucuucucac

SEQ ID NO: 191876 - RNA, 18 nt, Human
uucaggguccccaauuuc

SEQ ID NO: 191877 - RNA, 21 nt, Human
uucuugucccugauggcaccu

SEQ ID NO: 191878 - RNA, 19 nt, Human
uugcuaucaaucuguuucc

SEQ ID NO: 191879 - RNA, 21 nt, Human
uuuaaaaaaaaaaaaaaaggu

SEQ ID NO: 191880 - RNA, 26 nt, Human
uuuaaaaaaaaaaaaaaagguuaaca

SEQ ID NO: 191881 - RNA, 26 nt, Human
uuuuguagccgagcaggggcaggagc

SEQ ID NO: 191882 - RNA, 18 nt, Human
aggaagggaggggacggg

SEQ ID NO: 191883 - RNA, 26 nt, Human
aggaagggaggggacgggggcagggc

SEQ ID NO: 191884 - RNA, 19 nt, Human
agggaggggacgggggcag

SEQ ID NO: 191885 - RNA, 18 nt, Human
caggaauaaauaaggaag

SEQ ID NO: 191886 - RNA, 21 nt, Human
cgucugucuggcugucccacu

SEQ ID NO: 191887 - RNA, 18 nt, Human
ggaaaacaaaagaaccag

SEQ ID NO: 191888 - RNA, 23 nt, Human
ggaagggaggggacgggggcagg

SEQ ID NO: 191889 - RNA, 18 nt, Human
gggacgggggcagggcag

SEQ ID NO: 191890 - RNA, 24 nt, Human
ucuggggcagcaggaauaaauaag

SEQ ID NO: 191891 - RNA, 18 nt, Human
uguucuggggcagcagga

SEQ ID NO: 191892 - RNA, 21 nt, Human
uguucuggggcagcaggaaua

SEQ ID NO: 191893 - RNA, 25 nt, Human
aaacagaauacagguuaauaaacaa

SEQ ID NO: 191894 - RNA, 23 nt, Human
aagaaguaucaccaauuaccgcc

SEQ ID NO: 191895 - RNA, 27 nt, Human
aagcaaugaaauaaaagggauugcuau

SEQ ID NO: 191896 - RNA, 21 nt, Human
acccauuccaauucucuccag

SEQ ID NO: 191897 - RNA, 26 nt, Human
acccucugcacagugucucuuuguca

SEQ ID NO: 191898 - RNA, 22 nt, Human
aggacacccauugaaaagucaa

SEQ ID NO: 191899 - RNA, 18 nt, Human
caccaauuaccgccaccc

SEQ ID NO: 191900 - RNA, 24 nt, Human
cacccauugaaaagucaaaagcaa

SEQ ID NO: 191901 - RNA, 20 nt, Human
cacccucugcacagugucuc

SEQ ID NO: 191902 - RNA, 18 nt, Human
cacuuuagccugccaggg

SEQ ID NO: 191903 - RNA, 18 nt, Human
ccgccacccauuccaauu

SEQ ID NO: 191904 - RNA, 24 nt, Human
cuaaacacauuuucaauguuuucu

SEQ ID NO: 191905 - RNA, 24 nt, Human
cuaaagaugugauuggaaaucuac

SEQ ID NO: 191906 - RNA, 19 nt, Human
cugccaggggaugacguug

SEQ ID NO: 191907 - RNA, 22 nt, Human
gcuuuauuucucucuaagaagu

SEQ ID NO: 191908 - RNA, 26 nt, Human
gucaaguaauacaugcugaaaaaaaa

SEQ ID NO: 191909 - RNA, 22 nt, Human
uaaaagguuccuaggacaccca

SEQ ID NO: 191910 - RNA, 23 nt, Human
uaaaagguuccuaggacacccau

SEQ ID NO: 191911 - RNA, 26 nt, Human
uaaaagguuccuaggacacccauuga

SEQ ID NO: 191912 - RNA, 23 nt, Human
uaggacacccauugaaaagggag

SEQ ID NO: 191913 - RNA, 19 nt, Human
ucagacacuaaagauguga

SEQ ID NO: 191914 - RNA, 25 nt, Human
ucuaaacacauuuucaauguuuucu

SEQ ID NO: 191915 - RNA, 24 nt, Human
ugaaaagucaaaagcaaugaaaua

SEQ ID NO: 191916 - RNA, 18 nt, Human
ugaaguggggaauuacag

SEQ ID NO: 191917 - RNA, 20 nt, Human
uggaaaagaacgacacccuu

SEQ ID NO: 191918 - RNA, 20 nt, Human
uucuucccaaaaaugcuuua

SEQ ID NO: 191919 - RNA, 18 nt, Human
uugcuaccuccaauuuua

SEQ ID NO: 191920 - RNA, 20 nt, Human
acaaagaagggcauggaaca

SEQ ID NO: 191921 - RNA, 28 nt, Human
acagaaugggguccaggaaggacagcau

SEQ ID NO: 191922 - RNA, 24 nt, Human
agaaaugugggaaauaugggccgg

SEQ ID NO: 191923 - RNA, 19 nt, Human
agaaugggguccaggaagg

SEQ ID NO: 191924 - RNA, 18 nt, Human
agggccugaagcacaggg

SEQ ID NO: 191925 - RNA, 22 nt, Human
agggguuuggagggccugaagc

SEQ ID NO: 191926 - RNA, 21 nt, Human
ccuccugugggcaaccucagc

SEQ ID NO: 191927 - RNA, 23 nt, Human
ccugugggcaaccucagcagucu

SEQ ID NO: 191928 - RNA, 21 nt, Human
gaaggacagcaucacacacug

SEQ ID NO: 191929 - RNA, 18 nt, Human
gacagaaugggguccagg

SEQ ID NO: 191930 - RNA, 20 nt, Human
gacgcagccacucaaagccu

SEQ ID NO: 191931 - RNA, 21 nt, Human
gcaagagagcaacauauaaua

SEQ ID NO: 191932 - RNA, 20 nt, Human
ggccugaagcacaggggugg

SEQ ID NO: 191933 - RNA, 21 nt, Human
gugggcaaccucagcagucug

SEQ ID NO: 191934 - RNA, 21 nt, Human
uccuccugugggcaaccucag

SEQ ID NO: 191935 - RNA, 24 nt, Human
ugaucuguccuuuugagaucuuuu

SEQ ID NO: 191936 - RNA, 20 nt, Human
uggggaacacagggguuugg

SEQ ID NO: 191937 - RNA, 21 nt, Human
aaacaaguguccuuagcucuc

SEQ ID NO: 191938 - RNA, 24 nt, Human
aaauaagcacagcagguagagcug

SEQ ID NO: 191939 - RNA, 18 nt, Human
aacacagagggugggcug

SEQ ID NO: 191940 - RNA, 21 nt, Human
aacagcaaagccuggaagaga

SEQ ID NO: 191941 - RNA, 21 nt, Human
aacccugcaggaggcccuagc

SEQ ID NO: 191942 - RNA, 22 nt, Human
aagaaccaggguggcuaguggg

SEQ ID NO: 191943 - RNA, 18 nt, Human
aagccaggggcagggagg

SEQ ID NO: 191944 - RNA, 18 nt, Human
aagccaggggcagggagg

SEQ ID NO: 191945 - RNA, 24 nt, Human
aagccaggggcagggaggggggga

SEQ ID NO: 191946 - RNA, 22 nt, Human
acagacacagggucccauuuca

SEQ ID NO: 191947 - RNA, 18 nt, Human
acauaaaugagcacugac

SEQ ID NO: 191948 - RNA, 22 nt, Human
accacacgcacacaggcugaca

SEQ ID NO: 191949 - RNA, 21 nt, Human
accacaggccuggccugggcg

SEQ ID NO: 191950 - RNA, 18 nt, Human
acccccagcccagccccc

SEQ ID NO: 191951 - RNA, 22 nt, Human
acccuguuccaccccacaaccc

SEQ ID NO: 191952 - RNA, 20 nt, Human
agaaaggaugaagaacaggg

SEQ ID NO: 191953 - RNA, 26 nt, Human
agacagccaggucccucaagucaaca

SEQ ID NO: 191954 - RNA, 24 nt, Human
agagaagcagguggaugugaacug

SEQ ID NO: 191955 - RNA, 20 nt, Human
agaggaggcagggguugggg

SEQ ID NO: 191956 - RNA, 19 nt, Human
agagggagggagggagagg

SEQ ID NO: 191957 - RNA, 20 nt, Human
agaggggagaggggcugggc

SEQ ID NO: 191958 - RNA, 21 nt, Human
agaggggagaggggcugggcc

SEQ ID NO: 191959 - RNA, 20 nt, Human
agaggugcugugugaagggg

SEQ ID NO: 191960 - RNA, 22 nt, Human
agaucuggaauccuaagcaaau

SEQ ID NO: 191961 - RNA, 21 nt, Human
agcaagcgggcagagauggga

SEQ ID NO: 191962 - RNA, 22 nt, Human
agccaggggcagggaggggggg

SEQ ID NO: 191963 - RNA, 24 nt, Human
agccugggcagucccagaaggccu

SEQ ID NO: 191964 - RNA, 21 nt, Human
aggaggccucagucccagccc

SEQ ID NO: 191965 - RNA, 20 nt, Human
aggcagggguuggggguagg

SEQ ID NO: 191966 - RNA, 21 nt, Human
aggcagggguuggggguaggg

SEQ ID NO: 191967 - RNA, 21 nt, Human
aggcugacaagcaauaggaga

SEQ ID NO: 191968 - RNA, 19 nt, Human
aggcuggggcaggugagca

SEQ ID NO: 191969 - RNA, 19 nt, Human
agggagggagggagaggag

SEQ ID NO: 191970 - RNA, 19 nt, Human
aggggcagggaggggggga

SEQ ID NO: 191971 - RNA, 20 nt, Human
aggggcugggccauggaugg

SEQ ID NO: 191972 - RNA, 18 nt, Human
aguggauggagaucugga

SEQ ID NO: 191973 - RNA, 19 nt, Human
aucccacccaccgcccccc

SEQ ID NO: 191974 - RNA, 20 nt, Human
augaggcugaugggagcuga

SEQ ID NO: 191975 - RNA, 25 nt, Human
caaauaagcacagcagguagagcca

SEQ ID NO: 191976 - RNA, 18 nt, Human
caacaagaaccagggugg

SEQ ID NO: 191977 - RNA, 21 nt, Human
cacagcagguagagccaggcu

SEQ ID NO: 191978 - RNA, 21 nt, Human
caccccacaacccugcaggag

SEQ ID NO: 191979 - RNA, 25 nt, Human
cagagggugggcuggugacagacac

SEQ ID NO: 191980 - RNA, 19 nt, Human
cagaguuggagagccuggg

SEQ ID NO: 191981 - RNA, 19 nt, Human
cagcacaggaguagagagg

SEQ ID NO: 191982 - RNA, 20 nt, Human
cagcacaggaguagagagga

SEQ ID NO: 191983 - RNA, 21 nt, Human
cagccaggucccucaagucaa

SEQ ID NO: 191984 - RNA, 23 nt, Human
caggaggcccuagcccaccuucu

SEQ ID NO: 191985 - RNA, 26 nt, Human
caggaggguauagauccuuuauuucc

SEQ ID NO: 191986 - RNA, 18 nt, Human
caggggcagggagggggg

SEQ ID NO: 191987 - RNA, 21 nt, Human
caggggcagggagggggggau

SEQ ID NO: 191988 - RNA, 19 nt, Human
caggucccucaagucaaca

SEQ ID NO: 191989 - RNA, 26 nt, Human
caggugagcacucggggagcuuaucc

SEQ ID NO: 191990 - RNA, 21 nt, Human
cagugaccaaagggccaugag

SEQ ID NO: 191991 - RNA, 20 nt, Human
ccaacaugugggaaagggca

SEQ ID NO: 191992 - RNA, 21 nt, Human
ccagaaggccucucuuccucc

SEQ ID NO: 191993 - RNA, 24 nt, Human
cccagcccuaacccccagcccagc

SEQ ID NO: 191994 - RNA, 18 nt, Human
cccaggccacuggcagaa

SEQ ID NO: 191995 - RNA, 27 nt, Human
cccauagccugggcagucccagaaggc

SEQ ID NO: 191996 - RNA, 24 nt, Human
ccccacaacccugcaggaggcccu

SEQ ID NO: 191997 - RNA, 23 nt, Human
cccccagcuauugaggaacaaag

SEQ ID NO: 191998 - RNA, 22 nt, Human
ccccugggcugccauguggccc

SEQ ID NO: 191999 - RNA, 21 nt, Human
cccuaacccccagcccagccc

SEQ ID NO: 192000 - RNA, 21 nt, Human
cccugggcugccauguggccc

SEQ ID NO: 192001 - RNA, 26 nt, Human
ccuaacccccagcccagcccccagga

SEQ ID NO: 192002 - RNA, 25 nt, Human
ccuagcccaccuucugguccccugg

SEQ ID NO: 192003 - RNA, 23 nt, Human
ccucaagcugucuguggggccuc

SEQ ID NO: 192004 - RNA, 19 nt, Human
ccucacccacccacacaca

SEQ ID NO: 192005 - RNA, 19 nt, Human
ccucucccgggcuucuccu

SEQ ID NO: 192006 - RNA, 21 nt, Human
ccugcaccacacgcacacagg

SEQ ID NO: 192007 - RNA, 19 nt, Human
ccugcaggaggcccuagcc

SEQ ID NO: 192008 - RNA, 20 nt, Human
ccugcaggaggccucagucc

SEQ ID NO: 192009 - RNA, 20 nt, Human
ccuggacacccccaggccac

SEQ ID NO: 192010 - RNA, 19 nt, Human
ccugggguauagaggaggc

SEQ ID NO: 192011 - RNA, 18 nt, Human
ccugggucagcccccagg

SEQ ID NO: 192012 - RNA, 18 nt, Human
ccuuagcucucugagccu

SEQ ID NO: 192013 - RNA, 19 nt, Human
ccuugcuggugaaggccuu

SEQ ID NO: 192014 - RNA, 23 nt, Human
cgcacacaggcugacaagcaaua

SEQ ID NO: 192015 - RNA, 24 nt, Human
cggaaugaggcugaugggagcuga

SEQ ID NO: 192016 - RNA, 21 nt, Human
cuagcccaccuucugacaccc

SEQ ID NO: 192017 - RNA, 18 nt, Human
cuccaccaucccacccac

SEQ ID NO: 192018 - RNA, 22 nt, Human
cucccagacuuugggguuucug

SEQ ID NO: 192019 - RNA, 24 nt, Human
cugaggcgcagugugggggcacag

SEQ ID NO: 192020 - RNA, 22 nt, Human
cuggggagaggagacccuguuc

SEQ ID NO: 192021 - RNA, 18 nt, Human
cuuccucccaggccgugg

SEQ ID NO: 192022 - RNA, 23 nt, Human
gacaggcugggacgggucggacc

SEQ ID NO: 192023 - RNA, 23 nt, Human
gaccacaggccuggccugggcgg

SEQ ID NO: 192024 - RNA, 20 nt, Human
gacggguaccaggacagcac

SEQ ID NO: 192025 - RNA, 21 nt, Human
gagaauggggacaggcuggga

SEQ ID NO: 192026 - RNA, 21 nt, Human
gagggucugcggguguggggc

SEQ ID NO: 192027 - RNA, 20 nt, Human
gcacacaggcugacaagcaa

SEQ ID NO: 192028 - RNA, 20 nt, Human
gcagggguuggggguagggg

SEQ ID NO: 192029 - RNA, 20 nt, Human
gccaggggcagggagggggg

SEQ ID NO: 192030 - RNA, 20 nt, Human
gccccccguguuuguuuuga

SEQ ID NO: 192031 - RNA, 27 nt, Human
gcuguguggccccaaacaaguguccuu

SEQ ID NO: 192032 - RNA, 21 nt, Human
ggaacagcaaagccuggaaga

SEQ ID NO: 192033 - RNA, 19 nt, Human
ggaacagcaaagccuggag

SEQ ID NO: 192034 - RNA, 18 nt, Human
ggaagacagccagguccc

SEQ ID NO: 192035 - RNA, 25 nt, Human
ggacaggcugggacgggucggaccc

SEQ ID NO: 192036 - RNA, 24 nt, Human
ggaugggaaggagggucugcgggu

SEQ ID NO: 192037 - RNA, 20 nt, Human
gggacuguuccaacuguggc

SEQ ID NO: 192038 - RNA, 22 nt, Human
gggcagaacauggaagaggaag

SEQ ID NO: 192039 - RNA, 22 nt, Human
gggcagaacauggaagaggaag

SEQ ID NO: 192040 - RNA, 19 nt, Human
gggcagagaugggaagcug

SEQ ID NO: 192041 - RNA, 19 nt, Human
gggcaucaaggggugaggg

SEQ ID NO: 192042 - RNA, 27 nt, Human
gggcuuggccaggcagcaggaggggcc

SEQ ID NO: 192043 - RNA, 21 nt, Human
ggggcuuggccaggcagcagg

SEQ ID NO: 192044 - RNA, 19 nt, Human
gggguuggggguaggggaa

SEQ ID NO: 192045 - RNA, 19 nt, Human
ggguuucuggcuggggaga

SEQ ID NO: 192046 - RNA, 21 nt, Human
ggguuucuggcuggggagagg

SEQ ID NO: 192047 - RNA, 20 nt, Human
gguauagaggaggcaggggu

SEQ ID NO: 192048 - RNA, 20 nt, Human
guccuuagcucucugagccu

SEQ ID NO: 192049 - RNA, 18 nt, Human
gugaaggccuuugucccc

SEQ ID NO: 192050 - RNA, 25 nt, Human
guggccccaaacaaguguccuuagc

SEQ ID NO: 192051 - RNA, 20 nt, Human
uaacccccagcccagccccc

SEQ ID NO: 192052 - RNA, 18 nt, Human
uagauccuuuauuuccug

SEQ ID NO: 192053 - RNA, 18 nt, Human
uaucagaaggacacggaa

SEQ ID NO: 192054 - RNA, 19 nt, Human
uaugcaaaguccaugcaaa

SEQ ID NO: 192055 - RNA, 18 nt, Human
ucacccacccacacacag

SEQ ID NO: 192056 - RNA, 21 nt, Human
uccaccaucccacccaccgcc

SEQ ID NO: 192057 - RNA, 18 nt, Human
uccaugcaaauaagcaca

SEQ ID NO: 192058 - RNA, 20 nt, Human
ucccagaaggccucucuucc

SEQ ID NO: 192059 - RNA, 20 nt, Human
ucccucaagucaacaagaac

SEQ ID NO: 192060 - RNA, 21 nt, Human
ucccugaagacguuggaaaag

SEQ ID NO: 192061 - RNA, 27 nt, Human
ucccugaagacguuggaaaagccucca

SEQ ID NO: 192062 - RNA, 23 nt, Human
uccuccagccugggucagccccc

SEQ ID NO: 192063 - RNA, 21 nt, Human
ucucccgggcuucuccugccc

SEQ ID NO: 192064 - RNA, 19 nt, Human
ucuuccucccaggccgugg

SEQ ID NO: 192065 - RNA, 22 nt, Human
ugaagaacagggaagacagcca

SEQ ID NO: 192066 - RNA, 22 nt, Human
ugaaggggaucagaggugucua

SEQ ID NO: 192067 - RNA, 23 nt, Human
ugaaggggaucagaggugucuau

SEQ ID NO: 192068 - RNA, 23 nt, Human
ugacaagcaauaggagauugaga

SEQ ID NO: 192069 - RNA, 20 nt, Human
ugacacgccugcugaagcca

SEQ ID NO: 192070 - RNA, 19 nt, Human
ugacagacacaggguccca

SEQ ID NO: 192071 - RNA, 18 nt, Human
ugaggaacaaaggugugg

SEQ ID NO: 192072 - RNA, 19 nt, Human
ugaggaacaaagguguggg

SEQ ID NO: 192073 - RNA, 19 nt, Human
ugaggcgcagugugggggc

SEQ ID NO: 192074 - RNA, 18 nt, Human
ugaggcugaugggagcug

SEQ ID NO: 192075 - RNA, 25 nt, Human
ugcaccacacgcacacaggcugaca

SEQ ID NO: 192076 - RNA, 26 nt, Human
ugcaggcugcugggaacagcaaagcc

SEQ ID NO: 192077 - RNA, 24 nt, Human
ugcaugagugucacaaggucaucu

SEQ ID NO: 192078 - RNA, 18 nt, Human
ugccauguggcccaggcc

SEQ ID NO: 192079 - RNA, 22 nt, Human
ugccauguggcccaggccuggc

SEQ ID NO: 192080 - RNA, 20 nt, Human
ugcuccaccaucccacccac

SEQ ID NO: 192081 - RNA, 19 nt, Human
ugcugccacugcugcagag

SEQ ID NO: 192082 - RNA, 18 nt, Human
ugcugcugccacugcugc

SEQ ID NO: 192083 - RNA, 20 nt, Human
ugcugugugaaggggggcag

SEQ ID NO: 192084 - RNA, 20 nt, Human
uggaauccuaagcaaaugcc

SEQ ID NO: 192085 - RNA, 21 nt, Human
uggccaggcagcaggaggggc

SEQ ID NO: 192086 - RNA, 18 nt, Human
uggcccaggccuggcagc

SEQ ID NO: 192087 - RNA, 20 nt, Human
uggccccaaacaaguguccu

SEQ ID NO: 192088 - RNA, 22 nt, Human
uggccccaaacaaguguccuuc

SEQ ID NO: 192089 - RNA, 27 nt, Human
ugggaagcugaggcgcaggacagagag

SEQ ID NO: 192090 - RNA, 24 nt, Human
ugggcaucaaggggugaggggcac

SEQ ID NO: 192091 - RNA, 24 nt, Human
uggggcauugaugaccacaggccu

SEQ ID NO: 192092 - RNA, 24 nt, Human
uguggggcuuggccaggcagcagg

SEQ ID NO: 192093 - RNA, 21 nt, Human
uguuccaacuguggcccuugc

SEQ ID NO: 192094 - RNA, 20 nt, Human
uuaaagaggcagggcucaca

SEQ ID NO: 192095 - RNA, 21 nt, Human
uuccaccccacaacccugcag

SEQ ID NO: 192096 - RNA, 21 nt, Human
uugcccccugcaugcgccaua

SEQ ID NO: 192097 - RNA, 19 nt, Human
uuugggguuucuggcuggg

SEQ ID NO: 192098 - RNA, 30 nt, Human
uuuguuuugacugcugcugccacugcugcc

SEQ ID NO: 192099 - RNA, 19 nt, Human
aauaaaaaucaaaggcucu

SEQ ID NO: 192100 - RNA, 23 nt, Human
accacucuucaggucuuccgcug

SEQ ID NO: 192101 - RNA, 27 nt, Human
aggcucuguucugaccacucuucaggu

SEQ ID NO: 192102 - RNA, 18 nt, Human
cagccucagcaaggauga

SEQ ID NO: 192103 - RNA, 20 nt, Human
ccccagccucagcaaggaug

SEQ ID NO: 192104 - RNA, 18 nt, Human
ccgccugcugucucgacc

SEQ ID NO: 192105 - RNA, 21 nt, Human
ccugcggugguugccccagcc

SEQ ID NO: 192106 - RNA, 25 nt, Human
ccuuguagcccaggagcacagacug

SEQ ID NO: 192107 - RNA, 33 nt, Human
cucgaccugcggugguugccccagccucagccg

SEQ ID NO: 192108 - RNA, 20 nt, Human
cucuguucugaccacucuuc

SEQ ID NO: 192109 - RNA, 22 nt, Human
cugaccacucuucaggucuucc

SEQ ID NO: 192110 - RNA, 21 nt, Human
gaggcaucugcuccaacuggu

SEQ ID NO: 192111 - RNA, 22 nt, Human
uccgcugaaacggaaaagugca

SEQ ID NO: 192112 - RNA, 20 nt, Human
ugaaaaagguguuguaccug

SEQ ID NO: 192113 - RNA, 26 nt, Human
ugccccagccucagcaaggaugacuu

SEQ ID NO: 192114 - RNA, 27 nt, Human
ugcuccaacuggugcggggcccugcug

SEQ ID NO: 192115 - RNA, 21 nt, Human
ugggaccaucucaggcugggu

SEQ ID NO: 192116 - RNA, 24 nt, Human
uuaaccucaaauagugccaguccc

SEQ ID NO: 192117 - RNA, 19 nt, Human
uuuccucugauaguuuguu

SEQ ID NO: 192118 - RNA, 18 nt, Human
uuuuuuuuuuuuuuuccg

SEQ ID NO: 192119 - RNA, 21 nt, Human
uuuuuuuuuuuuuuuccgugg

SEQ ID NO: 192120 - RNA, 19 nt, Human
uuuuuuuuuuuuuuuuccg

SEQ ID NO: 192121 - RNA, 21 nt, Human
uuuuuuuuuuuuuuuuuccgu

SEQ ID NO: 192122 - RNA, 20 nt, Human
acccagcaaguucguggcuc

SEQ ID NO: 192123 - RNA, 21 nt, Human
aggacccuuuccccuccacuc

SEQ ID NO: 192124 - RNA, 22 nt, Human
caaguucguggcucggggccca

SEQ ID NO: 192125 - RNA, 25 nt, Human
caauaaauacccucccuggagaccc

SEQ ID NO: 192126 - RNA, 24 nt, Human
ccagcagcucuccucuggccuccc

SEQ ID NO: 192127 - RNA, 18 nt, Human
ccccugaagacccuugag

SEQ ID NO: 192128 - RNA, 21 nt, Human
cccucccuggagacccagaag

SEQ ID NO: 192129 - RNA, 22 nt, Human
ccugaccaauaaauacccuccc

SEQ ID NO: 192130 - RNA, 18 nt, Human
ggagacccagaaguccca

SEQ ID NO: 192131 - RNA, 24 nt, Human
gggaaacugaggcccagagaacca

SEQ ID NO: 192132 - RNA, 21 nt, Human
guggcucggggcccagcagcu

SEQ ID NO: 192133 - RNA, 21 nt, Human
ucccuggagacccagaagucc

SEQ ID NO: 192134 - RNA, 18 nt, Human
uccucuggccuccccuga

SEQ ID NO: 192135 - RNA, 22 nt, Human
ucggggcccagcagcucuccuc

SEQ ID NO: 192136 - RNA, 21 nt, Human
ugaccaauaaauacccucccu

SEQ ID NO: 192137 - RNA, 21 nt, Human
uggcagaggagggaaacugag

SEQ ID NO: 192138 - RNA, 18 nt, Human
uggccgggcucucucuuc

SEQ ID NO: 192139 - RNA, 18 nt, Human
uggcucggggcccagcag

SEQ ID NO: 192140 - RNA, 19 nt, Human
uggcucggggcccagcagc

SEQ ID NO: 192141 - RNA, 24 nt, Human
uggcucggggcccagcagcucucc

SEQ ID NO: 192142 - RNA, 19 nt, Human
uuggcagaggagggaaacu

SEQ ID NO: 192143 - RNA, 21 nt, Human
aaaaaaaaaaaaaaaaagccu

SEQ ID NO: 192144 - RNA, 24 nt, Human
aaaaaaaaaaaaaaaagccugugg

SEQ ID NO: 192145 - RNA, 26 nt, Human
aaaaaaaaaaaaaaagccuguggaag

SEQ ID NO: 192146 - RNA, 23 nt, Human
aaaaaaaaaaagccuguggaaga

SEQ ID NO: 192147 - RNA, 26 nt, Human
aaaaacaacauuuaaaaaggauaggg

SEQ ID NO: 192148 - RNA, 19 nt, Human
aaaaagccuguggaagacu

SEQ ID NO: 192149 - RNA, 21 nt, Human
aaaagaaauaaaaacaaaaag

SEQ ID NO: 192150 - RNA, 24 nt, Human
aaagaaauaaaaacaaaaaguuaa

SEQ ID NO: 192151 - RNA, 19 nt, Human
aaauacagcacagccacgg

SEQ ID NO: 192152 - RNA, 21 nt, Human
aaguuagguuguauagguuga

SEQ ID NO: 192153 - RNA, 26 nt, Human
aauccuuuucuuccaugauaacccac

SEQ ID NO: 192154 - RNA, 22 nt, Human
acaguaaggaaaaagugcauaa

SEQ ID NO: 192155 - RNA, 18 nt, Human
agaaaaguaaaauagaga

SEQ ID NO: 192156 - RNA, 21 nt, Human
agaauugggagaaaagucuuu

SEQ ID NO: 192157 - RNA, 20 nt, Human
agacucagcagaacccagga

SEQ ID NO: 192158 - RNA, 22 nt, Human
agucccagcagcagugauaugu

SEQ ID NO: 192159 - RNA, 23 nt, Human
augaaaauaaacccauauaaaug

SEQ ID NO: 192160 - RNA, 24 nt, Human
cacagccacggccuuuaaaacuuc

SEQ ID NO: 192161 - RNA, 21 nt, Human
caugauaacccacauaaagca

SEQ ID NO: 192162 - RNA, 22 nt, Human
ccaggacuggguaauucuuucc

SEQ ID NO: 192163 - RNA, 18 nt, Human
ccugucuguguggucccg

SEQ ID NO: 192164 - RNA, 19 nt, Human
cuguguggucccggagggu

SEQ ID NO: 192165 - RNA, 18 nt, Human
cuuaaaaaaaaaaaaaaa

SEQ ID NO: 192166 - RNA, 18 nt, Human
cuuaaaaaaaaaaaaaaa

SEQ ID NO: 192167 - RNA, 21 nt, Human
gagacgaccggccaaaaaaaa

SEQ ID NO: 192168 - RNA, 20 nt, Human
uaaaaagaaaauccuuccua

SEQ ID NO: 192169 - RNA, 22 nt, Human
uaaaaaggauaggggagucuua

SEQ ID NO: 192170 - RNA, 23 nt, Human
uacagcacagccacggccuuuaa

SEQ ID NO: 192171 - RNA, 23 nt, Human
uaggccaaaacacuuucaggcgg

SEQ ID NO: 192172 - RNA, 24 nt, Human
uauaaauuuuuuaagaacuuauuu

SEQ ID NO: 192173 - RNA, 21 nt, Human
uaucaaacaguccauaaguua

SEQ ID NO: 192174 - RNA, 23 nt, Human
uauuggccuuuucuaaaagaaau

SEQ ID NO: 192175 - RNA, 22 nt, Human
uauuuuaaaaaaggaagaacag

SEQ ID NO: 192176 - RNA, 21 nt, Human
ucaucuaucaaacaguccaua

SEQ ID NO: 192177 - RNA, 19 nt, Human
ucccagcagcagugauaug

SEQ ID NO: 192178 - RNA, 19 nt, Human
ucgguggcgggcaguuucc

SEQ ID NO: 192179 - RNA, 26 nt, Human
ucuaaaagaaauaaaaacaaaaaguu

SEQ ID NO: 192180 - RNA, 22 nt, Human
ucuuuucuuuucuuuucuuuuu

SEQ ID NO: 192181 - RNA, 18 nt, Human
ucuuuuuuuuuuuuuuug

SEQ ID NO: 192182 - RNA, 23 nt, Human
ucuuuuuuuuuuuuuuugugcuu

SEQ ID NO: 192183 - RNA, 19 nt, Human
ugagguauauaggccaaaa

SEQ ID NO: 192184 - RNA, 19 nt, Human
ugcauaaacaaagaauuca

SEQ ID NO: 192185 - RNA, 23 nt, Human
uggcagaaaaguaaaauagagaa

SEQ ID NO: 192186 - RNA, 24 nt, Human
ugguucaaugggcugcucgaagcc

SEQ ID NO: 192187 - RNA, 23 nt, Human
uguggaagacucagcagaaccca

SEQ ID NO: 192188 - RNA, 19 nt, Human
uguuuuacuuuggcagaau

SEQ ID NO: 192189 - RNA, 20 nt, Human
uuaaaaaaaaaaaaaaaaaa

SEQ ID NO: 192190 - RNA, 20 nt, Human
uuaaaaaaaaaaaaaaaaaa

SEQ ID NO: 192191 - RNA, 22 nt, Human
uucucuuuauguuuccguugca

SEQ ID NO: 192192 - RNA, 21 nt, Human
uuuaaaagguagagagagaga

SEQ ID NO: 192193 - RNA, 29 nt, Human
uuucuuuucuuuucuuuuuuuuuuuuuuu

SEQ ID NO: 192194 - RNA, 25 nt, Human
uuucuuuuuuuuuuuuuuugugcuu

SEQ ID NO: 192195 - RNA, 19 nt, Human
uuugucuuuaagauuggca

SEQ ID NO: 192196 - RNA, 23 nt, Human
uuuucuuuuuucuuuucuuuuuu

SEQ ID NO: 192197 - RNA, 25 nt, Human
aaaaaaaaaaaaaaaagcagguaaa

SEQ ID NO: 192198 - RNA, 19 nt, Human
aaaaaaaaaaaaaagcagg

SEQ ID NO: 192199 - RNA, 19 nt, Human
aaaaaacuugaccugaaaa

SEQ ID NO: 192200 - RNA, 20 nt, Human
aaaaaagcagguaaaaauaa

SEQ ID NO: 192201 - RNA, 21 nt, Human
aaaaagcagguaaaaauaaau

SEQ ID NO: 192202 - RNA, 18 nt, Human
aaaacacagcacucccuc

SEQ ID NO: 192203 - RNA, 24 nt, Human
aaaacacagcacucccuccucccu

SEQ ID NO: 192204 - RNA, 22 nt, Human
aaacagccaaaaacagccucag

SEQ ID NO: 192205 - RNA, 21 nt, Human
aaagcaagaaccuuaggaugu

SEQ ID NO: 192206 - RNA, 25 nt, Human
aaauaagugcaguauaaaaaacuug

SEQ ID NO: 192207 - RNA, 22 nt, Human
aaaugcugaagaaaaacaagcc

SEQ ID NO: 192208 - RNA, 21 nt, Human
aacacagcacucccuccuccc

SEQ ID NO: 192209 - RNA, 25 nt, Human
aaccagucgaggucaaacguuguga

SEQ ID NO: 192210 - RNA, 22 nt, Human
aagaaaaacaagcccuuagcga

SEQ ID NO: 192211 - RNA, 21 nt, Human
aagaaacggggauaaagcuga

SEQ ID NO: 192212 - RNA, 18 nt, Human
aagaacaguagccugaaa

SEQ ID NO: 192213 - RNA, 22 nt, Human
aagcaacccuuaagucaaaggc

SEQ ID NO: 192214 - RNA, 23 nt, Human
aagcaagcaacccuuaagucaaa

SEQ ID NO: 192215 - RNA, 22 nt, Human
aagcagacaggcagucugaaaa

SEQ ID NO: 192216 - RNA, 19 nt, Human
aagcagcagagggaaaaca

SEQ ID NO: 192217 - RNA, 22 nt, Human
acacagaauccccugcagcccu

SEQ ID NO: 192218 - RNA, 23 nt, Human
acacagcacucccuccucccucc

SEQ ID NO: 192219 - RNA, 23 nt, Human
acacccaaggccucuguguagcu

SEQ ID NO: 192220 - RNA, 18 nt, Human
acagacaagcuaagaacc

SEQ ID NO: 192221 - RNA, 24 nt, Human
acccugucuuuucucuuccauucc

SEQ ID NO: 192222 - RNA, 21 nt, Human
accuccuuccgcagguugccg

SEQ ID NO: 192223 - RNA, 22 nt, Human
agaaaaacaagcccuuagcgaa

SEQ ID NO: 192224 - RNA, 22 nt, Human
agaaaaaccagucgaggucaaa

SEQ ID NO: 192225 - RNA, 22 nt, Human
agagaaaggaucuccagccucc

SEQ ID NO: 192226 - RNA, 21 nt, Human
agcacucccuccucccuccca

SEQ ID NO: 192227 - RNA, 18 nt, Human
agccaaaaacagccucag

SEQ ID NO: 192228 - RNA, 22 nt, Human
agccaaaaacagccucaggagg

SEQ ID NO: 192229 - RNA, 18 nt, Human
agccggggcuccgcccca

SEQ ID NO: 192230 - RNA, 21 nt, Human
aggccagcccagcaaccuggg

SEQ ID NO: 192231 - RNA, 22 nt, Human
aggugacugcagugauaccuca

SEQ ID NO: 192232 - RNA, 22 nt, Human
aguaaaugcugaagaaaaacaa

SEQ ID NO: 192233 - RNA, 31 nt, Human
auaaaaaacuugaccugaaaauuaaaaaaag

SEQ ID NO: 192234 - RNA, 25 nt, Human
auuaaaaaaaaaaaaaaaagcaggu

SEQ ID NO: 192235 - RNA, 18 nt, Human
auuuguccuuuggaccau

SEQ ID NO: 192236 - RNA, 20 nt, Human
caaaaacagccucaggaggc

SEQ ID NO: 192237 - RNA, 18 nt, Human
caaaacgcugagaacagc

SEQ ID NO: 192238 - RNA, 21 nt, Human
caaaacgcugagaacagccug

SEQ ID NO: 192239 - RNA, 20 nt, Human
caaagauaaccauuuuggau

SEQ ID NO: 192240 - RNA, 19 nt, Human
caaccagcagucuuaccag

SEQ ID NO: 192241 - RNA, 19 nt, Human
caacuucugagugcccucu

SEQ ID NO: 192242 - RNA, 22 nt, Human
caagaaacggggauaaagcuga

SEQ ID NO: 192243 - RNA, 19 nt, Human
caagcagacaggcagucug

SEQ ID NO: 192244 - RNA, 22 nt, Human
caagcagacaggcagucugaaa

SEQ ID NO: 192245 - RNA, 19 nt, Human
caaggccagcccagcaacc

SEQ ID NO: 192246 - RNA, 21 nt, Human
cacaacuucugagugcccucu

SEQ ID NO: 192247 - RNA, 23 nt, Human
cacagacaagcuaagaacccauc

SEQ ID NO: 192248 - RNA, 18 nt, Human
cacagugcaaggcagagc

SEQ ID NO: 192249 - RNA, 25 nt, Human
caccacaaucucuuuguuccuccug

SEQ ID NO: 192250 - RNA, 21 nt, Human
caccauuccuggacccuguuu

SEQ ID NO: 192251 - RNA, 23 nt, Human
cacccugucuuuucucuuccauu

SEQ ID NO: 192252 - RNA, 23 nt, Human
caccuggaaaacccuugaguucg

SEQ ID NO: 192253 - RNA, 20 nt, Human
cagcagaacgauugccugga

SEQ ID NO: 192254 - RNA, 22 nt, Human
cagcagucuuaccagaaacucg

SEQ ID NO: 192255 - RNA, 22 nt, Human
caggaucccagguuuuaaacuc

SEQ ID NO: 192256 - RNA, 19 nt, Human
caggucaaagcagccgcga

SEQ ID NO: 192257 - RNA, 30 nt, Human
cagugauaccucaaaaaauguggcuuugaa

SEQ ID NO: 192258 - RNA, 22 nt, Human
cauacacuaaccggcccagcuc

SEQ ID NO: 192259 - RNA, 20 nt, Human
cauugcacuuuacccgcucu

SEQ ID NO: 192260 - RNA, 22 nt, Human
ccaaggccagcccagcaaccug

SEQ ID NO: 192261 - RNA, 21 nt, Human
ccacugaaugggacuuaacuu

SEQ ID NO: 192262 - RNA, 24 nt, Human
ccagcaaccugggcgcuggcgccc

SEQ ID NO: 192263 - RNA, 19 nt, Human
ccagcccagcaaccugggc

SEQ ID NO: 192264 - RNA, 24 nt, Human
ccccaaaagcagcagagggaaaac

SEQ ID NO: 192265 - RNA, 18 nt, Human
ccccugcagcccugcauc

SEQ ID NO: 192266 - RNA, 18 nt, Human
cccuccucccucccaccc

SEQ ID NO: 192267 - RNA, 22 nt, Human
cccuccucccucccacccuguc

SEQ ID NO: 192268 - RNA, 18 nt, Human
cccucuugucugcugucc

SEQ ID NO: 192269 - RNA, 23 nt, Human
cccugucuuuucucuuccauucc

SEQ ID NO: 192270 - RNA, 26 nt, Human
ccugaaaauuaaaaaaaaaaaaaaaa

SEQ ID NO: 192271 - RNA, 21 nt, Human
ccugcagcccugcaucugggg

SEQ ID NO: 192272 - RNA, 18 nt, Human
ccuguaccugccuguuuu

SEQ ID NO: 192273 - RNA, 20 nt, Human
ccuguaccugccuguuuuug

SEQ ID NO: 192274 - RNA, 24 nt, Human
ccugucuuuucucuuccauucccc

SEQ ID NO: 192275 - RNA, 22 nt, Human
ccuuagcaaaugccugcugccu

SEQ ID NO: 192276 - RNA, 18 nt, Human
ccuuaggauguaggaacc

SEQ ID NO: 192277 - RNA, 19 nt, Human
cgcggcgggaccccccugc

SEQ ID NO: 192278 - RNA, 21 nt, Human
cggcccagcucgcucaguagg

SEQ ID NO: 192279 - RNA, 23 nt, Human
cuaaaacacagcacucccuccuc

SEQ ID NO: 192280 - RNA, 21 nt, Human
cucaaaacgcugagaacagcc

SEQ ID NO: 192281 - RNA, 18 nt, Human
cugagcaguuuccaggug

SEQ ID NO: 192282 - RNA, 20 nt, Human
cugccuuccagccuucaugg

SEQ ID NO: 192283 - RNA, 21 nt, Human
cugccuuccagccuucauggg

SEQ ID NO: 192284 - RNA, 21 nt, Human
cuuuccuuuuuaaugugcacu

SEQ ID NO: 192285 - RNA, 21 nt, Human
cuuuucugaacauguuggggc

SEQ ID NO: 192286 - RNA, 18 nt, Human
cuuuuuaucuccccagca

SEQ ID NO: 192287 - RNA, 21 nt, Human
gaucuccagccucccagaagc

SEQ ID NO: 192288 - RNA, 23 nt, Human
gcagcagagggaaaacagccaaa

SEQ ID NO: 192289 - RNA, 23 nt, Human
gcagugccggaggcggcgcccac

SEQ ID NO: 192290 - RNA, 23 nt, Human
gccaaaaacagccucaggaggca

SEQ ID NO: 192291 - RNA, 23 nt, Human
gccccaauugccaccuugaaaac

SEQ ID NO: 192292 - RNA, 24 nt, Human
gccccaauugccaccuugaaaacc

SEQ ID NO: 192293 - RNA, 18 nt, Human
gccucaggaggcaugaga

SEQ ID NO: 192294 - RNA, 19 nt, Human
gccugcugccuuccagccu

SEQ ID NO: 192295 - RNA, 18 nt, Human
gcggcggcuccaugcccc

SEQ ID NO: 192296 - RNA, 20 nt, Human
gggcugggagaaccuccuuc

SEQ ID NO: 192297 - RNA, 24 nt, Human
gucuuuucucuuccauuccccuuc

SEQ ID NO: 192298 - RNA, 23 nt, Human
gugcagugccggaggcggcgccc

SEQ ID NO: 192299 - RNA, 19 nt, Human
guguugccuccucuaaaca

SEQ ID NO: 192300 - RNA, 24 nt, Human
uacaaaauaacuuagaaaaaccag

SEQ ID NO: 192301 - RNA, 25 nt, Human
uacagguuaaaauacccaagacuuc

SEQ ID NO: 192302 - RNA, 20 nt, Human
uacccgcucugcuugggggc

SEQ ID NO: 192303 - RNA, 22 nt, Human
ucaaaaaauguggcuuugaaga

SEQ ID NO: 192304 - RNA, 18 nt, Human
ucagcaggcccgcggcgg

SEQ ID NO: 192305 - RNA, 22 nt, Human
uccaagauuguagccaauuuga

SEQ ID NO: 192306 - RNA, 23 nt, Human
uccaagauuguagccaauuugau

SEQ ID NO: 192307 - RNA, 18 nt, Human
ucccagaagccugcugug

SEQ ID NO: 192308 - RNA, 19 nt, Human
ucccagaagccugcugugc

SEQ ID NO: 192309 - RNA, 21 nt, Human
ucccagguuuuaaacucaaaa

SEQ ID NO: 192310 - RNA, 25 nt, Human
ucccuccucccucccacccugucuu

SEQ ID NO: 192311 - RNA, 19 nt, Human
ucccuggaauguugaugug

SEQ ID NO: 192312 - RNA, 23 nt, Human
ucucaaagauaaccauuuuggau

SEQ ID NO: 192313 - RNA, 23 nt, Human
ucuccagccucccagaagccugc

SEQ ID NO: 192314 - RNA, 21 nt, Human
ucuccugccaccucugguugu

SEQ ID NO: 192315 - RNA, 19 nt, Human
ucuggguaggggaaggggg

SEQ ID NO: 192316 - RNA, 18 nt, Human
ucuuuucugaacauguug

SEQ ID NO: 192317 - RNA, 25 nt, Human
ugaaaacacagaauccccugcagcc

SEQ ID NO: 192318 - RNA, 21 nt, Human
ugaaaagcuuuccauuggaga

SEQ ID NO: 192319 - RNA, 23 nt, Human
ugaagaaagugaaguggggagug

SEQ ID NO: 192320 - RNA, 21 nt, Human
ugagaaaggacauuuggaggg

SEQ ID NO: 192321 - RNA, 24 nt, Human
ugagaaaggacauuuggagggcaa

SEQ ID NO: 192322 - RNA, 22 nt, Human
ugagaacacgcuugccuccugc

SEQ ID NO: 192323 - RNA, 24 nt, Human
ugaggaaaguugacgaccacagug

SEQ ID NO: 192324 - RNA, 25 nt, Human
ugaggagaauggauggucucaaaga

SEQ ID NO: 192325 - RNA, 21 nt, Human
ugagugcccucuggagcccag

SEQ ID NO: 192326 - RNA, 24 nt, Human
ugaugaggguagaagaggugacug

SEQ ID NO: 192327 - RNA, 18 nt, Human
ugcagugccggaggcggc

SEQ ID NO: 192328 - RNA, 23 nt, Human
ugccaaggaauccguccaagcag

SEQ ID NO: 192329 - RNA, 21 nt, Human
ugcccaaagaucaggcuucug

SEQ ID NO: 192330 - RNA, 27 nt, Human
ugcccauuguuucuuacuaguuucuug

SEQ ID NO: 192331 - RNA, 19 nt, Human
ugccugccugcgcucuggg

SEQ ID NO: 192332 - RNA, 21 nt, Human
ugccuuagcaaaugccugcug

SEQ ID NO: 192333 - RNA, 22 nt, Human
ugcugguucugcacggguuagc

SEQ ID NO: 192334 - RNA, 18 nt, Human
uggaacacccaaggccuc

SEQ ID NO: 192335 - RNA, 21 nt, Human
uggacccuguuuucugaugcc

SEQ ID NO: 192336 - RNA, 24 nt, Human
uggagggcaagcaagcaacccuua

SEQ ID NO: 192337 - RNA, 18 nt, Human
uggccugcaggucccagu

SEQ ID NO: 192338 - RNA, 22 nt, Human
uggcuguaagaauucccuggag

SEQ ID NO: 192339 - RNA, 21 nt, Human
ugggaauaauccugcccuuga

SEQ ID NO: 192340 - RNA, 21 nt, Human
ugggagaaccuccuuccgcag

SEQ ID NO: 192341 - RNA, 18 nt, Human
ugggguaucucacauaaa

SEQ ID NO: 192342 - RNA, 21 nt, Human
ugugcagaugcaagcagacag

SEQ ID NO: 192343 - RNA, 18 nt, Human
uguggcuuugaagaaagu

SEQ ID NO: 192344 - RNA, 23 nt, Human
uguggcuuugaagaaagugaagu

SEQ ID NO: 192345 - RNA, 24 nt, Human
uuagcaaaugccugcugccuucca

SEQ ID NO: 192346 - RNA, 23 nt, Human
uuagcacaacuucugagugcccu

SEQ ID NO: 192347 - RNA, 21 nt, Human
uucagugcuaacucccugcug

SEQ ID NO: 192348 - RNA, 22 nt, Human
uuucucuuccauuccccuuccc

SEQ ID NO: 192349 - RNA, 23 nt, Human
uuuuccuuugcguuuuucuugac

SEQ ID NO: 192350 - RNA, 21 nt, Human
uuuuuuuuuuccuuugcguuu

SEQ ID NO: 192351 - RNA, 22 nt, Human
uuuuuuuuuuuuuuuuuccuuu

SEQ ID NO: 192352 - RNA, 23 nt, Human
uuuuuuuuuuuuuuuuuuccuuu

SEQ ID NO: 192353 - RNA, 27 nt, Human
uuuuuuuuuuuuuuuuuuccuuugggg

SEQ ID NO: 192354 - RNA, 21 nt, Human
acucuaaacaguauuuuaaaa

SEQ ID NO: 192355 - RNA, 19 nt, Human
agucaucagauuuuucaca

SEQ ID NO: 192356 - RNA, 24 nt, Human
auaacuuuuaguauaagcaaaaug

SEQ ID NO: 192357 - RNA, 18 nt, Human
auuuauuauacuguuuaa

SEQ ID NO: 192358 - RNA, 18 nt, Human
cccgcggcugaggaagga

SEQ ID NO: 192359 - RNA, 23 nt, Human
uaaaugcaauauaugcucauaaa

SEQ ID NO: 192360 - RNA, 19 nt, Human
uauaagcaaaaugucacaa

SEQ ID NO: 192361 - RNA, 20 nt, Human
uaugcucauaaacucuaaac

SEQ ID NO: 192362 - RNA, 23 nt, Human
ucucuccaaaagaaaauauucaa

SEQ ID NO: 192363 - RNA, 23 nt, Human
uguacagaaaauuugcaagcuuc

SEQ ID NO: 192364 - RNA, 18 nt, Human
uugcaagcuuccuguaca

SEQ ID NO: 192365 - RNA, 20 nt, Human
aagcaagcccgcgauccuga

SEQ ID NO: 192366 - RNA, 23 nt, Human
aaggccucugaggguuaacaagg

SEQ ID NO: 192367 - RNA, 23 nt, Human
aauggugggcaaugggugagagg

SEQ ID NO: 192368 - RNA, 23 nt, Human
acgggggaaaccugcgcagcccu

SEQ ID NO: 192369 - RNA, 28 nt, Human
caagagaagcuaagcuuauuaauggugg

SEQ ID NO: 192370 - RNA, 21 nt, Human
ccacauauccaagccccugaa

SEQ ID NO: 192371 - RNA, 30 nt, Human
ccaguucacuauuccacauauccaagcccu

SEQ ID NO: 192372 - RNA, 18 nt, Human
cccguacugggacgcgaa

SEQ ID NO: 192373 - RNA, 22 nt, Human
gcgaaccuuugaaccccuccag

SEQ ID NO: 192374 - RNA, 20 nt, Human
ggaaagcaagcccgcgaucc

SEQ ID NO: 192375 - RNA, 18 nt, Human
ggcaaugggugagaggug

SEQ ID NO: 192376 - RNA, 25 nt, Human
ggcaaugggugagagguggaaagga

SEQ ID NO: 192377 - RNA, 23 nt, Human
uaagcuuauuaauggugggcaau

SEQ ID NO: 192378 - RNA, 21 nt, Human
ugagguggcaagagaagcuaa

SEQ ID NO: 192379 - RNA, 19 nt, Human
ugagugacaaacugacaug

SEQ ID NO: 192380 - RNA, 18 nt, Human
uggaaaggacuugaaggc

SEQ ID NO: 192381 - RNA, 20 nt, Human
uggaaaggacuugaaggccu

SEQ ID NO: 192382 - RNA, 23 nt, Human
uggcaagagaagcuaagcuuauu

SEQ ID NO: 192383 - RNA, 20 nt, Human
ugugagaaauugagcgaggc

SEQ ID NO: 192384 - RNA, 24 nt, Human
uuuuagcauaaauaaagguuuuau

SEQ ID NO: 192385 - RNA, 19 nt, Human
acgggugcaggaaggggag

SEQ ID NO: 192386 - RNA, 19 nt, Human
aggaaggggaggaggggcu

SEQ ID NO: 192387 - RNA, 25 nt, Human
aggggcuggggggaggcccaagggg

SEQ ID NO: 192388 - RNA, 18 nt, Human
agucuguggggaccagaa

SEQ ID NO: 192389 - RNA, 22 nt, Human
cacucagacuuuauucaaagac

SEQ ID NO: 192390 - RNA, 18 nt, Human
ccacucagacuuuauuca

SEQ ID NO: 192391 - RNA, 20 nt, Human
cgggugcaggaaggggagga

SEQ ID NO: 192392 - RNA, 22 nt, Human
gaggaggggcuggggggaggcc

SEQ ID NO: 192393 - RNA, 18 nt, Human
gcaggaaggggaggaggg

SEQ ID NO: 192394 - RNA, 23 nt, Human
ggcuggggggaggcccaaggggc

SEQ ID NO: 192395 - RNA, 23 nt, Human
gggaggcccaaggggcaagaagc

SEQ ID NO: 192396 - RNA, 22 nt, Human
gggugcaggaaggggaggaggg

SEQ ID NO: 192397 - RNA, 21 nt, Human
ucaaagaccacggggguacgg

SEQ ID NO: 192398 - RNA, 20 nt, Human
ucucucugagucugugggga

SEQ ID NO: 192399 - RNA, 23 nt, Human
ugcaggaaggggaggaggggcug

SEQ ID NO: 192400 - RNA, 19 nt, Human
agaccaggaagggccggug

SEQ ID NO: 192401 - RNA, 21 nt, Human
aggaagggccggugcaaggag

SEQ ID NO: 192402 - RNA, 18 nt, Human
aggaggggaggagggccc

SEQ ID NO: 192403 - RNA, 18 nt, Human
agucuguggggaccagaa

SEQ ID NO: 192404 - RNA, 24 nt, Human
caaagaccaggaagggccggugca

SEQ ID NO: 192405 - RNA, 22 nt, Human
cacucagacuuuauucaaagac

SEQ ID NO: 192406 - RNA, 23 nt, Human
gccgcccacucagacuuuauuca

SEQ ID NO: 192407 - RNA, 24 nt, Human
gugcaaggaggggaggagggcccg

SEQ ID NO: 192408 - RNA, 19 nt, Human
ucucucugagucugugggg

SEQ ID NO: 192409 - RNA, 23 nt, Human
ugcaaggaggggaggagggcccg

SEQ ID NO: 192410 - RNA, 21 nt, Human
aaggcccuucauaauaucccc

SEQ ID NO: 192411 - RNA, 21 nt, Human
auuggacagcaagaaagcgag

SEQ ID NO: 192412 - RNA, 18 nt, Human
cuagugaacacaguugug

SEQ ID NO: 192413 - RNA, 19 nt, Human
ggaacaaaggaaccuuuaa

SEQ ID NO: 192414 - RNA, 18 nt, Human
uaguaguuggacuuaggg

SEQ ID NO: 192415 - RNA, 24 nt, Human
ucaaggcccuucauaauauccccc

SEQ ID NO: 192416 - RNA, 23 nt, Human
agaaaauagaaucuagggaaaua

SEQ ID NO: 192417 - RNA, 18 nt, Human
aggaaacaguccaggauc

SEQ ID NO: 192418 - RNA, 19 nt, Human
cagaagccauacccuugaa

SEQ ID NO: 192419 - RNA, 21 nt, Human
uaggcagaagccauacccuug

SEQ ID NO: 192420 - RNA, 21 nt, Human
ugaaguaggcauuguguuccc

SEQ ID NO: 192421 - RNA, 23 nt, Human
uuaggcagaagccauacccuuga

SEQ ID NO: 192422 - RNA, 18 nt, Human
aagcagauaugugcugcu

SEQ ID NO: 192423 - RNA, 21 nt, Human
aggccugagagcuugcuagug

SEQ ID NO: 192424 - RNA, 25 nt, Human
cagaaggcuuucucucaaggccaag

SEQ ID NO: 192425 - RNA, 20 nt, Human
ccuguguccucaggggugga

SEQ ID NO: 192426 - RNA, 20 nt, Human
cugcugccucucugucuggc

SEQ ID NO: 192427 - RNA, 19 nt, Human
gccaggccugagagcuugc

SEQ ID NO: 192428 - RNA, 20 nt, Human
gcuggauccugaggcucuuu

SEQ ID NO: 192429 - RNA, 21 nt, Human
gcuugcuagugauugcagcug

SEQ ID NO: 192430 - RNA, 20 nt, Human
gugcagaaggagggugucag

SEQ ID NO: 192431 - RNA, 22 nt, Human
gugcagaaggagggugucaggg

SEQ ID NO: 192432 - RNA, 21 nt, Human
ucucaaggccaagcccagucc

SEQ ID NO: 192433 - RNA, 18 nt, Human
ugcuggauccugaggcuc

SEQ ID NO: 192434 - RNA, 25 nt, Human
uuacugccgaaguucuggcccccug

SEQ ID NO: 192435 - RNA, 22 nt, Human
aaagccuauccuugaaagcucu

SEQ ID NO: 192436 - RNA, 22 nt, Human
ucucagacguuccagaagcgag

SEQ ID NO: 192437 - RNA, 23 nt, Human
ugcagaauaaagccuauccuuga

SEQ ID NO: 192438 - RNA, 22 nt, Human
aaagccuauccuugaaagcucu

SEQ ID NO: 192439 - RNA, 21 nt, Human
aggagcuuauugauaaccuca

SEQ ID NO: 192440 - RNA, 22 nt, Human
ccucagacguuccagaagcgag

SEQ ID NO: 192441 - RNA, 21 nt, Human
gcucugcaucaugggcaguga

SEQ ID NO: 192442 - RNA, 23 nt, Human
ugcagaauaaagccuauccuuga

SEQ ID NO: 192443 - RNA, 19 nt, Human
uugaaagcucugcaucaug

SEQ ID NO: 192444 - RNA, 23 nt, Human
aacccgccgcgcccugcgacccc

SEQ ID NO: 192445 - RNA, 23 nt, Human
caggggucccgcggccuccaggg

SEQ ID NO: 192446 - RNA, 25 nt, Human
ccccgcgcuggaacccgccgcgccc

SEQ ID NO: 192447 - RNA, 18 nt, Human
ccgcagcuucgccgcccg

SEQ ID NO: 192448 - RNA, 18 nt, Human
ccgccgcgcccugcgacc

SEQ ID NO: 192449 - RNA, 19 nt, Human
ccgccgcgcccugcgaccc

SEQ ID NO: 192450 - RNA, 20 nt, Human
ccgcugcgccugcgcggacc

SEQ ID NO: 192451 - RNA, 24 nt, Human
cgccgcgccgcagcuucgccgccc

SEQ ID NO: 192452 - RNA, 24 nt, Human
cgccuggggaucccgcggccaccc

SEQ ID NO: 192453 - RNA, 24 nt, Human
cuccagggggcgccgcgccgcagc

SEQ ID NO: 192454 - RNA, 25 nt, Human
gcgccgcgccgcagcuucgccgccc

SEQ ID NO: 192455 - RNA, 23 nt, Human
ggcagggugggcagcugcacugg

SEQ ID NO: 192456 - RNA, 20 nt, Human
guggggcuggggaaccucca

SEQ ID NO: 192457 - RNA, 18 nt, Human
accugcuccagcccgugg

SEQ ID NO: 192458 - RNA, 21 nt, Human
agucgccaacccgaacccaga

SEQ ID NO: 192459 - RNA, 20 nt, Human
caacccgaacccagagcagc

SEQ ID NO: 192460 - RNA, 22 nt, Human
caacccgaacccagagcagcag

SEQ ID NO: 192461 - RNA, 18 nt, Human
cacgccgccgccgccgcc

SEQ ID NO: 192462 - RNA, 22 nt, Human
cagcccgugguccccagaccaa

SEQ ID NO: 192463 - RNA, 20 nt, Human
ccgcggccagccugcccuuc

SEQ ID NO: 192464 - RNA, 19 nt, Human
cgccgccgccgccgccccg

SEQ ID NO: 192465 - RNA, 20 nt, Human
cuucacgccgccgccgccgc

SEQ ID NO: 192466 - RNA, 24 nt, Human
gcuccagcccgugguccccagacc

SEQ ID NO: 192467 - RNA, 19 nt, Human
uaaauuuccaccugcucca

SEQ ID NO: 192468 - RNA, 21 nt, Human
aaaaaacaaaaacaaaacaaa

SEQ ID NO: 192469 - RNA, 22 nt, Human
aaaaaagagaaaagaaaaaaga

SEQ ID NO: 192470 - RNA, 21 nt, Human
aaaaacacaacaaaugcagca

SEQ ID NO: 192471 - RNA, 23 nt, Human
aaaacaaaacaaaacaaaaaaaa

SEQ ID NO: 192472 - RNA, 24 nt, Human
aaaagaaaacagaaccagacaccc

SEQ ID NO: 192473 - RNA, 24 nt, Human
aaacaaaaacaaaacaaaacaaaa

SEQ ID NO: 192474 - RNA, 19 nt, Human
aaacaaaacaaaacaaaaa

SEQ ID NO: 192475 - RNA, 22 nt, Human
aaacaaaacaaaacaaaacaaa

SEQ ID NO: 192476 - RNA, 25 nt, Human
aaaguaaaaaaacaaaaacaaaaca

SEQ ID NO: 192477 - RNA, 25 nt, Human
aacaaaacaaaacaaaaaaaagaga

SEQ ID NO: 192478 - RNA, 26 nt, Human
aacaaaacaaaacaaaacaaaaaaaa

SEQ ID NO: 192479 - RNA, 18 nt, Human
aacaacaacaaaaaaggg

SEQ ID NO: 192480 - RNA, 24 nt, Human
aagaaaaaagauuacacauucugu

SEQ ID NO: 192481 - RNA, 21 nt, Human
aagaagaaaaaaguaaaaaaa

SEQ ID NO: 192482 - RNA, 24 nt, Human
aagaagaaaaaaguaaaaaaacaa

SEQ ID NO: 192483 - RNA, 26 nt, Human
aagaagaaaaaaguaaaaaaacaaaa

SEQ ID NO: 192484 - RNA, 29 nt, Human
aagaagagggggaggguagaagagguggg

SEQ ID NO: 192485 - RNA, 19 nt, Human
aagagaaaggggagaggag

SEQ ID NO: 192486 - RNA, 20 nt, Human
aagcgggaagggagccccuc

SEQ ID NO: 192487 - RNA, 20 nt, Human
aaugcugggacgggguggga

SEQ ID NO: 192488 - RNA, 19 nt, Human
aauuccuuucacacacccc

SEQ ID NO: 192489 - RNA, 24 nt, Human
acaaaacaaaaaaaagagaaaaga

SEQ ID NO: 192490 - RNA, 24 nt, Human
acaaaacaaaacaaaaaaaagaga

SEQ ID NO: 192491 - RNA, 22 nt, Human
acaaaacaaaacaaaacaaaaa

SEQ ID NO: 192492 - RNA, 22 nt, Human
acaacaacaaaaaagggacaaa

SEQ ID NO: 192493 - RNA, 19 nt, Human
acaggaccaggugaguggg

SEQ ID NO: 192494 - RNA, 24 nt, Human
acuccaagcagaucccccagccuc

SEQ ID NO: 192495 - RNA, 22 nt, Human
acucuggggagggccaagaggg

SEQ ID NO: 192496 - RNA, 21 nt, Human
agaaaacagaaccagacaccc

SEQ ID NO: 192497 - RNA, 19 nt, Human
agaaaacuccaagcagauc

SEQ ID NO: 192498 - RNA, 18 nt, Human
agaagaggugggagcaca

SEQ ID NO: 192499 - RNA, 23 nt, Human
agaagcuggaggccgcugagucc

SEQ ID NO: 192500 - RNA, 20 nt, Human
agagagaaagagaaagggga

SEQ ID NO: 192501 - RNA, 25 nt, Human
agagggggaggguagaagagguggg

SEQ ID NO: 192502 - RNA, 18 nt, Human
agccugaggaagggaagu

SEQ ID NO: 192503 - RNA, 26 nt, Human
agcuaacaacaacaaaaaagggacaa

SEQ ID NO: 192504 - RNA, 19 nt, Human
agcuguccuuccuuuguuc

SEQ ID NO: 192505 - RNA, 23 nt, Human
aggacaggcaaaagggcagaggg

SEQ ID NO: 192506 - RNA, 23 nt, Human
aggcaaaagggcagagggcaggg

SEQ ID NO: 192507 - RNA, 19 nt, Human
aggcgcgcgagagaaggga

SEQ ID NO: 192508 - RNA, 20 nt, Human
agggacaaaaccccacacgc

SEQ ID NO: 192509 - RNA, 22 nt, Human
aggggagggcuggaaagauugg

SEQ ID NO: 192510 - RNA, 23 nt, Human
aggggagggcuggaaagauuggc

SEQ ID NO: 192511 - RNA, 22 nt, Human
aggggggucuggagaagaaucc

SEQ ID NO: 192512 - RNA, 22 nt, Human
auccaggacaaggaggccccag

SEQ ID NO: 192513 - RNA, 19 nt, Human
auccaggggcuagucagcu

SEQ ID NO: 192514 - RNA, 25 nt, Human
augguaauauugagucacagggguu

SEQ ID NO: 192515 - RNA, 24 nt, Human
caaaaacaaaacaaaacaaaacaa

SEQ ID NO: 192516 - RNA, 25 nt, Human
caaaaacaaaacaaaacaaaacaaa

SEQ ID NO: 192517 - RNA, 20 nt, Human
caaaauagcacaaaacgaca

SEQ ID NO: 192518 - RNA, 23 nt, Human
caacaaaaaagggacaaaacccc

SEQ ID NO: 192519 - RNA, 20 nt, Human
caacaggaaguugggcuggg

SEQ ID NO: 192520 - RNA, 23 nt, Human
caacaggaaguugggcugggugg

SEQ ID NO: 192521 - RNA, 23 nt, Human
caagcagaucccccagccucgga

SEQ ID NO: 192522 - RNA, 18 nt, Human
caaggggaagaaaagaaa

SEQ ID NO: 192523 - RNA, 18 nt, Human
cacaaggggaagaaaaga

SEQ ID NO: 192524 - RNA, 20 nt, Human
cacacagcgguagacgacuc

SEQ ID NO: 192525 - RNA, 19 nt, Human
cacagcgguagacgacucc

SEQ ID NO: 192526 - RNA, 23 nt, Human
cacagcuaacaacaacaaaaaag

SEQ ID NO: 192527 - RNA, 25 nt, Human
cacccaggccagggugccaggaaag

SEQ ID NO: 192528 - RNA, 19 nt, Human
cacccccuuucgucuaagg

SEQ ID NO: 192529 - RNA, 21 nt, Human
cacccuuuccaugacgauuug

SEQ ID NO: 192530 - RNA, 18 nt, Human
cacugagcagggugggcc

SEQ ID NO: 192531 - RNA, 18 nt, Human
cagaaagaucccugccaa

SEQ ID NO: 192532 - RNA, 28 nt, Human
cagaaccagacacccaggccagggugcc

SEQ ID NO: 192533 - RNA, 21 nt, Human
cagaaccagacacccaggccg

SEQ ID NO: 192534 - RNA, 22 nt, Human
cagaaguuugggguggggggca

SEQ ID NO: 192535 - RNA, 23 nt, Human
cagaaguuugggguggggggcag

SEQ ID NO: 192536 - RNA, 24 nt, Human
cagaggucgguaggggagggcugg

SEQ ID NO: 192537 - RNA, 22 nt, Human
cagcaggccccucguggcagau

SEQ ID NO: 192538 - RNA, 23 nt, Human
cagcccucccucaagcuccccua

SEQ ID NO: 192539 - RNA, 23 nt, Human
ccaagaagaaaaaaguaaaaaaa

SEQ ID NO: 192540 - RNA, 18 nt, Human
ccaagcugccuccaagga

SEQ ID NO: 192541 - RNA, 21 nt, Human
ccaaggugacuaaacgugaca

SEQ ID NO: 192542 - RNA, 20 nt, Human
ccagcagcccuguuugggag

SEQ ID NO: 192543 - RNA, 18 nt, Human
cccaagcugccuccaagg

SEQ ID NO: 192544 - RNA, 23 nt, Human
ccccagcuuuuccuccagaaaga

SEQ ID NO: 192545 - RNA, 23 nt, Human
cccccagccucggagccuggccu

SEQ ID NO: 192546 - RNA, 18 nt, Human
ccccuuuuuucuuuuucc

SEQ ID NO: 192547 - RNA, 21 nt, Human
ccccuuuuuucuuuuuccuuc

SEQ ID NO: 192548 - RNA, 25 nt, Human
cccgucgccccgacuacuuguccgg

SEQ ID NO: 192549 - RNA, 24 nt, Human
cccucaauuccuuucacacacccc

SEQ ID NO: 192550 - RNA, 18 nt, Human
cccucguggcagauuuca

SEQ ID NO: 192551 - RNA, 21 nt, Human
cccuggaggacacaggcugcu

SEQ ID NO: 192552 - RNA, 24 nt, Human
cccugggagccgccaucuugagcc

SEQ ID NO: 192553 - RNA, 22 nt, Human
ccgccaucuuaacugcccuccu

SEQ ID NO: 192554 - RNA, 18 nt, Human
ccuaggcucgacccuaua

SEQ ID NO: 192555 - RNA, 23 nt, Human
ccuauagaugcggagugaucgcc

SEQ ID NO: 192556 - RNA, 24 nt, Human
ccuccccgcaaaagucucucccca

SEQ ID NO: 192557 - RNA, 22 nt, Human
ccucccucaagcuccccuaggc

SEQ ID NO: 192558 - RNA, 21 nt, Human
ccugcccuggcuggccccagc

SEQ ID NO: 192559 - RNA, 21 nt, Human
ccugguuccccuccauucucc

SEQ ID NO: 192560 - RNA, 23 nt, Human
ccuuuggcucuucccuuucuucu

SEQ ID NO: 192561 - RNA, 19 nt, Human
cgacuccauggaggccgcc

SEQ ID NO: 192562 - RNA, 18 nt, Human
cgccuaggcucaagaagc

SEQ ID NO: 192563 - RNA, 21 nt, Human
cgcgcuccucucucugcuuuc

SEQ ID NO: 192564 - RNA, 19 nt, Human
cgcugcccaggccgccgcg

SEQ ID NO: 192565 - RNA, 23 nt, Human
cggggcuccuugccccuuuuuuc

SEQ ID NO: 192566 - RNA, 19 nt, Human
cggggugggaggggugggc

SEQ ID NO: 192567 - RNA, 26 nt, Human
cgugacauuuuccacagcgaaauaua

SEQ ID NO: 192568 - RNA, 23 nt, Human
cuacacagucacccucccaagcu

SEQ ID NO: 192569 - RNA, 25 nt, Human
cuccaaggacgccugguuccccucc

SEQ ID NO: 192570 - RNA, 18 nt, Human
cuccccuaggcucgaccc

SEQ ID NO: 192571 - RNA, 18 nt, Human
cucccucaagcuccccua

SEQ ID NO: 192572 - RNA, 20 nt, Human
cuccucucucugcuuuccca

SEQ ID NO: 192573 - RNA, 18 nt, Human
cugcccaggccgccgcgg

SEQ ID NO: 192574 - RNA, 18 nt, Human
cugcccaggccgccgcgg

SEQ ID NO: 192575 - RNA, 21 nt, Human
cugccucugcuuccucccaac

SEQ ID NO: 192576 - RNA, 18 nt, Human
cugcuuccucccaacagc

SEQ ID NO: 192577 - RNA, 20 nt, Human
cugcuuccucccaacagcaa

SEQ ID NO: 192578 - RNA, 21 nt, Human
cuggccccagcuuuuccucca

SEQ ID NO: 192579 - RNA, 20 nt, Human
cugggacggggugggagggg

SEQ ID NO: 192580 - RNA, 22 nt, Human
gaaagagaaaggggagaggagu

SEQ ID NO: 192581 - RNA, 18 nt, Human
gaagaaaagaaaacagaa

SEQ ID NO: 192582 - RNA, 23 nt, Human
gaagcaggggggucuggagaaga

SEQ ID NO: 192583 - RNA, 21 nt, Human
gacaaggaggccccagcccuc

SEQ ID NO: 192584 - RNA, 20 nt, Human
gacagaaguuuggggugggg

SEQ ID NO: 192585 - RNA, 20 nt, Human
gaggguagaagaggugggag

SEQ ID NO: 192586 - RNA, 19 nt, Human
gccccuuuuuucuuuuucc

SEQ ID NO: 192587 - RNA, 21 nt, Human
gccgcggggcuccuugccccu

SEQ ID NO: 192588 - RNA, 24 nt, Human
gccuaggcucaagaagcuggaggc

SEQ ID NO: 192589 - RNA, 18 nt, Human
gccuccaaggacgccugg

SEQ ID NO: 192590 - RNA, 19 nt, Human
gcgaaauauacuauaauac

SEQ ID NO: 192591 - RNA, 20 nt, Human
gcgccuaggcucaagaagcu

SEQ ID NO: 192592 - RNA, 18 nt, Human
gcuccucucucugcuuuc

SEQ ID NO: 192593 - RNA, 19 nt, Human
gcuccuugccccuuuuuuc

SEQ ID NO: 192594 - RNA, 19 nt, Human
gcucgcgagggugaagugc

SEQ ID NO: 192595 - RNA, 18 nt, Human
ggacaaggaggccccagc

SEQ ID NO: 192596 - RNA, 23 nt, Human
ggagggggcauggggagagcugg

SEQ ID NO: 192597 - RNA, 21 nt, Human
ggcagagggcaggggccagca

SEQ ID NO: 192598 - RNA, 18 nt, Human
ggccugaguuccaugcug

SEQ ID NO: 192599 - RNA, 20 nt, Human
ggcgggaggcccugggagcc

SEQ ID NO: 192600 - RNA, 20 nt, Human
ggcggugccgguggugcuca

SEQ ID NO: 192601 - RNA, 20 nt, Human
ggcuggguggcaaacagcag

SEQ ID NO: 192602 - RNA, 21 nt, Human
gggaagaaaagaaaacagaac

SEQ ID NO: 192603 - RNA, 21 nt, Human
gggagcacaaaggccucugag

SEQ ID NO: 192604 - RNA, 21 nt, Human
gggcagagggcaggggccagc

SEQ ID NO: 192605 - RNA, 18 nt, Human
gggcauggggagagcugg

SEQ ID NO: 192606 - RNA, 23 nt, Human
gggcgggaggcccugggagccgc

SEQ ID NO: 192607 - RNA, 20 nt, Human
ggggagaggagugaacagcg

SEQ ID NO: 192608 - RNA, 24 nt, Human
ggggagaggagugaacagcggcuc

SEQ ID NO: 192609 - RNA, 19 nt, Human
ggggaggguagaagaggug

SEQ ID NO: 192610 - RNA, 22 nt, Human
ggggccagcaacaggaaguugg

SEQ ID NO: 192611 - RNA, 20 nt, Human
gggggagguggagcaguggc

SEQ ID NO: 192612 - RNA, 18 nt, Human
ggggugggcccuggcggg

SEQ ID NO: 192613 - RNA, 20 nt, Human
gggugggaggggugggcccu

SEQ ID NO: 192614 - RNA, 23 nt, Human
ggugggccgggggagccugagga

SEQ ID NO: 192615 - RNA, 21 nt, Human
gguuccccuccauucuccacc

SEQ ID NO: 192616 - RNA, 25 nt, Human
guaaaaaaacaaaaacaaaacaaaa

SEQ ID NO: 192617 - RNA, 23 nt, Human
guaaaacaacaggaccaggugag

SEQ ID NO: 192618 - RNA, 22 nt, Human
gucacccucccaagcugccucc

SEQ ID NO: 192619 - RNA, 23 nt, Human
guccuuccuuuguuccagcggcc

SEQ ID NO: 192620 - RNA, 22 nt, Human
gugcggccugcagggaggucug

SEQ ID NO: 192621 - RNA, 28 nt, Human
uaaaaaaacaaaaacaaaacaaaacaaa

SEQ ID NO: 192622 - RNA, 23 nt, Human
uaaaaaacacaacaaaugcagca

SEQ ID NO: 192623 - RNA, 19 nt, Human
uaaaacaacaggaccaggu

SEQ ID NO: 192624 - RNA, 19 nt, Human
uaacugcccuccuucccuu

SEQ ID NO: 192625 - RNA, 20 nt, Human
uaauacaacaaaccagaggc

SEQ ID NO: 192626 - RNA, 24 nt, Human
uaggggagggcuggaaagauuggc

SEQ ID NO: 192627 - RNA, 21 nt, Human
uauuuuaaaaacagagagaaa

SEQ ID NO: 192628 - RNA, 21 nt, Human
ucacaccucuccugcccuggc

SEQ ID NO: 192629 - RNA, 21 nt, Human
uccaugacgauuugggggagg

SEQ ID NO: 192630 - RNA, 21 nt, Human
uccaugcugcacagcugcugc

SEQ ID NO: 192631 - RNA, 19 nt, Human
ucccccagccucggagccu

SEQ ID NO: 192632 - RNA, 24 nt, Human
ucccccagccucggagccuggccu

SEQ ID NO: 192633 - RNA, 22 nt, Human
uccccgcaaaagucucucccca

SEQ ID NO: 192634 - RNA, 19 nt, Human
uccccuaggcucgacccua

SEQ ID NO: 192635 - RNA, 21 nt, Human
ucccuuuggcucuucccuuuc

SEQ ID NO: 192636 - RNA, 19 nt, Human
uccgcaagagccgcccgaa

SEQ ID NO: 192637 - RNA, 23 nt, Human
uccuccagaaagaucccugccaa

SEQ ID NO: 192638 - RNA, 22 nt, Human
ucgacagaaguuuggggugggg

SEQ ID NO: 192639 - RNA, 23 nt, Human
ucucgcucaccccgucuccgcaa

SEQ ID NO: 192640 - RNA, 22 nt, Human
ucugccucugcuuccucccccc

SEQ ID NO: 192641 - RNA, 23 nt, Human
ugaaagugugaacuucaccaauu

SEQ ID NO: 192642 - RNA, 19 nt, Human
ugaacagcggcucgcgagg

SEQ ID NO: 192643 - RNA, 23 nt, Human
ugagaaaauguguaagcuuccug

SEQ ID NO: 192644 - RNA, 20 nt, Human
ugaggacaggcaaaagggca

SEQ ID NO: 192645 - RNA, 18 nt, Human
ugagugggcuccaaggug

SEQ ID NO: 192646 - RNA, 19 nt, Human
ugcaaccuaaaaaacacaa

SEQ ID NO: 192647 - RNA, 19 nt, Human
ugccaggaaagccacucug

SEQ ID NO: 192648 - RNA, 18 nt, Human
ugcccuagccucccuugu

SEQ ID NO: 192649 - RNA, 19 nt, Human
ugccugcccccgaccuggc

SEQ ID NO: 192650 - RNA, 19 nt, Human
ugcggaaaccagcagcccu

SEQ ID NO: 192651 - RNA, 19 nt, Human
ugcggccugcagggagguc

SEQ ID NO: 192652 - RNA, 22 nt, Human
ugcuggcaagccuugcuccucg

SEQ ID NO: 192653 - RNA, 20 nt, Human
uggagaagaauccaggggcu

SEQ ID NO: 192654 - RNA, 19 nt, Human
uggagcaguggcugcggaa

SEQ ID NO: 192655 - RNA, 18 nt, Human
uggcaaacagcaggcccc

SEQ ID NO: 192656 - RNA, 22 nt, Human
uggcagauuucacaccucuccu

SEQ ID NO: 192657 - RNA, 21 nt, Human
uggcggguguuccugaagcag

SEQ ID NO: 192658 - RNA, 18 nt, Human
uggcucuucccuuucuuc

SEQ ID NO: 192659 - RNA, 18 nt, Human
ugggaaagaagaggggga

SEQ ID NO: 192660 - RNA, 21 nt, Human
ugggaggggugggcccuggcg

SEQ ID NO: 192661 - RNA, 19 nt, Human
ugggguggggggcagaaaa

SEQ ID NO: 192662 - RNA, 25 nt, Human
uguacacagcuaacaacaacaaaaa

SEQ ID NO: 192663 - RNA, 20 nt, Human
uguccgggcgcucccgcuua

SEQ ID NO: 192664 - RNA, 21 nt, Human
uuacucuacaauagugaacgg

SEQ ID NO: 192665 - RNA, 23 nt, Human
uuagccaagaagaaaaaaguaaa

SEQ ID NO: 192666 - RNA, 23 nt, Human
uuccaugcugcacagcugcugcu

SEQ ID NO: 192667 - RNA, 22 nt, Human
uucuccacccuuuccaugacga

SEQ ID NO: 192668 - RNA, 20 nt, Human
uuuaaaaugggaaagaagag

SEQ ID NO: 192669 - RNA, 23 nt, Human
uuucuuuuuccuucuuuucuuuu

SEQ ID NO: 192670 - RNA, 18 nt, Human
aggaagggggugugggcc

SEQ ID NO: 192671 - RNA, 19 nt, Human
aggaagggggugugggccc

SEQ ID NO: 192672 - RNA, 18 nt, Human
auuuugaaaguuucccuu

SEQ ID NO: 192673 - RNA, 20 nt, Human
auuuugaaaguuucccuucc

SEQ ID NO: 192674 - RNA, 26 nt, Human
caccugggcacccccuggcccugccc

SEQ ID NO: 192675 - RNA, 18 nt, Human
caccuugcagccaccacc

SEQ ID NO: 192676 - RNA, 23 nt, Human
cauuccaggaaauagaaauauca

SEQ ID NO: 192677 - RNA, 21 nt, Human
ccaccaccugggcacccccug

SEQ ID NO: 192678 - RNA, 21 nt, Human
ccaccugggcacccccuggcc

SEQ ID NO: 192679 - RNA, 22 nt, Human
ccccccagcucggcagccccug

SEQ ID NO: 192680 - RNA, 19 nt, Human
cccccuggcccugcccugg

SEQ ID NO: 192681 - RNA, 22 nt, Human
cccccuggcccugcccuggucc

SEQ ID NO: 192682 - RNA, 22 nt, Human
ccucgcagcuugagcgcccccc

SEQ ID NO: 192683 - RNA, 19 nt, Human
ccugggcacccccuggccc

SEQ ID NO: 192684 - RNA, 19 nt, Human
cgcagcuugagcgcccccc

SEQ ID NO: 192685 - RNA, 21 nt, Human
cgcagcuugagcgccccccca

SEQ ID NO: 192686 - RNA, 21 nt, Human
cgucucgcgggcagcccggau

SEQ ID NO: 192687 - RNA, 18 nt, Human
cucgcagcuugagcgccc

SEQ ID NO: 192688 - RNA, 23 nt, Human
gcugaagcgagggugggugucug

SEQ ID NO: 192689 - RNA, 26 nt, Human
gggugucugggaguaggaagggggug

SEQ ID NO: 192690 - RNA, 23 nt, Human
gggugugggcccuggcggauggu

SEQ ID NO: 192691 - RNA, 22 nt, Human
uauuuugaaaguuucccuucca

SEQ ID NO: 192692 - RNA, 24 nt, Human
uccaaaucacagcuguaacuaaaa

SEQ ID NO: 192693 - RNA, 22 nt, Human
uccaaccuacccacuggacaga

SEQ ID NO: 192694 - RNA, 19 nt, Human
uccaggaaauagaaauauc

SEQ ID NO: 192695 - RNA, 22 nt, Human
ucgcagcuugagcgccccccca

SEQ ID NO: 192696 - RNA, 19 nt, Human
ucugggaguaggaaggggg

SEQ ID NO: 192697 - RNA, 20 nt, Human
uggcauuuauaucuuuuauu

SEQ ID NO: 192698 - RNA, 20 nt, Human
uggcugaagcgagggugggu

SEQ ID NO: 192699 - RNA, 23 nt, Human
ugggaguaggaaggggguguggg

SEQ ID NO: 192700 - RNA, 19 nt, Human
uggugcuggagccaccuug

SEQ ID NO: 192701 - RNA, 22 nt, Human
uguggcugaagcgagggugggu

SEQ ID NO: 192702 - RNA, 23 nt, Human
uugaaaguuucccuuccaaauca

SEQ ID NO: 192703 - RNA, 21 nt, Human
uuugaaaguuucccuuccaaa

SEQ ID NO: 192704 - RNA, 20 nt, Human
aggcggcgccgggcagugcg

SEQ ID NO: 192705 - RNA, 18 nt, Human
aggguggggggcgggcgg

SEQ ID NO: 192706 - RNA, 24 nt, Human
auggggguguggggguuaaugggg

SEQ ID NO: 192707 - RNA, 26 nt, Human
caaguauugcacuuagaaaacgaucc

SEQ ID NO: 192708 - RNA, 19 nt, Human
cacggcggcgggaccccag

SEQ ID NO: 192709 - RNA, 18 nt, Human
cagccacugggccgcccc

SEQ ID NO: 192710 - RNA, 20 nt, Human
ccaccuagaggguggggggc

SEQ ID NO: 192711 - RNA, 21 nt, Human
ccccagccucccccccgcgcc

SEQ ID NO: 192712 - RNA, 22 nt, Human
ccccagccucccccccgcgccc

SEQ ID NO: 192713 - RNA, 21 nt, Human
cccccgcgcccugcgcagcca

SEQ ID NO: 192714 - RNA, 21 nt, Human
cccccgcgcccugcgcagccg

SEQ ID NO: 192715 - RNA, 22 nt, Human
ccccgccggcccugcccguccg

SEQ ID NO: 192716 - RNA, 24 nt, Human
ccccuggcccgccugggcccgcgg

SEQ ID NO: 192717 - RNA, 26 nt, Human
cccugcgcagccaggccugccccucc

SEQ ID NO: 192718 - RNA, 18 nt, Human
ccgccgccgccgccgccg

SEQ ID NO: 192719 - RNA, 20 nt, Human
ccgccgccgccgccgccggg

SEQ ID NO: 192720 - RNA, 19 nt, Human
ccgccggcccugcccgucc

SEQ ID NO: 192721 - RNA, 24 nt, Human
ccuggcccgccugggguccccugg

SEQ ID NO: 192722 - RNA, 20 nt, Human
cgcagccaggccugccccuc

SEQ ID NO: 192723 - RNA, 26 nt, Human
cgcagccaggccugccccucggugcc

SEQ ID NO: 192724 - RNA, 19 nt, Human
cgccugggcccgcggggcg

SEQ ID NO: 192725 - RNA, 19 nt, Human
cgcgcgcggacgggggccg

SEQ ID NO: 192726 - RNA, 21 nt, Human
cguccaacuacggcuaccuac

SEQ ID NO: 192727 - RNA, 23 nt, Human
cgucccugucuuacagcuggggg

SEQ ID NO: 192728 - RNA, 21 nt, Human
cuccccgaggucaccggggga

SEQ ID NO: 192729 - RNA, 23 nt, Human
cugcgcagccaggccugccccuc

SEQ ID NO: 192730 - RNA, 19 nt, Human
gaggguggggggcgggcgg

SEQ ID NO: 192731 - RNA, 22 nt, Human
gaggguggggggcgggcggggc

SEQ ID NO: 192732 - RNA, 25 nt, Human
gcagccaggccugccccucggugcc

SEQ ID NO: 192733 - RNA, 23 nt, Human
gcaggggcgaugggggugggcgc

SEQ ID NO: 192734 - RNA, 18 nt, Human
gccgggggcgcggagggg

SEQ ID NO: 192735 - RNA, 24 nt, Human
gcggagccgccgccgccgccgccg

SEQ ID NO: 192736 - RNA, 20 nt, Human
gcgggaccccagccuccccc

SEQ ID NO: 192737 - RNA, 21 nt, Human
gcuuuggucuggaugacggcc

SEQ ID NO: 192738 - RNA, 29 nt, Human
ggaccccagccucccccccgcgcccugcc

SEQ ID NO: 192739 - RNA, 18 nt, Human
ggagggaggcggggugcu

SEQ ID NO: 192740 - RNA, 19 nt, Human
ggagggggcugccccgccg

SEQ ID NO: 192741 - RNA, 22 nt, Human
ggcagcgggaagccggcgggcc

SEQ ID NO: 192742 - RNA, 18 nt, Human
ggcauggcuuuggucugg

SEQ ID NO: 192743 - RNA, 21 nt, Human
gggacggccgggggcgcggag

SEQ ID NO: 192744 - RNA, 19 nt, Human
gggcgcggggcgaugaggg

SEQ ID NO: 192745 - RNA, 22 nt, Human
gggcugccccgccggcccugcc

SEQ ID NO: 192746 - RNA, 19 nt, Human
ggggcaggggcgauggggg

SEQ ID NO: 192747 - RNA, 24 nt, Human
ggggcguggggggccacggugggg

SEQ ID NO: 192748 - RNA, 18 nt, Human
ggggggccacgguggggg

SEQ ID NO: 192749 - RNA, 21 nt, Human
gggguguggggguuaaugggg

SEQ ID NO: 192750 - RNA, 23 nt, Human
ggugccagugcuggagggaggcg

SEQ ID NO: 192751 - RNA, 19 nt, Human
gucuggaugacggccccgc

SEQ ID NO: 192752 - RNA, 21 nt, Human
uacagcugggggaacugaggc

SEQ ID NO: 192753 - RNA, 18 nt, Human
ucuauggcuucugggcgg

SEQ ID NO: 192754 - RNA, 18 nt, Human
ugaggcaccgaggugaag

SEQ ID NO: 192755 - RNA, 19 nt, Human
ugaggggggacggccgggg

SEQ ID NO: 192756 - RNA, 18 nt, Human
ugcacuuagaaaacgauc

SEQ ID NO: 192757 - RNA, 22 nt, Human
ugcgcggaaugggggugugggg

SEQ ID NO: 192758 - RNA, 21 nt, Human
ugcuggagggaggcggggugc

SEQ ID NO: 192759 - RNA, 21 nt, Human
ugcuggagggaggcggggugc

SEQ ID NO: 192760 - RNA, 21 nt, Human
uggcuuuggucuggaugacgg

SEQ ID NO: 192761 - RNA, 19 nt, Human
ugggggaacugaggcaccc

SEQ ID NO: 192762 - RNA, 24 nt, Human
uggggggcgggcggggcuccacag

SEQ ID NO: 192763 - RNA, 19 nt, Human
uguggggguuaauggggcg

SEQ ID NO: 192764 - RNA, 18 nt, Human
uuuuuuuuuuuuuuuuug

SEQ ID NO: 192765 - RNA, 22 nt, Human
uuuuuuuuuuuuuuuuuuuggc

SEQ ID NO: 192766 - RNA, 24 nt, Human
aaauagucuauaaaagcaagugac

SEQ ID NO: 192767 - RNA, 20 nt, Human
aagaagaaagaagagggaag

SEQ ID NO: 192768 - RNA, 25 nt, Human
acaguuaaaccugaaggaagaagga

SEQ ID NO: 192769 - RNA, 31 nt, Human
acauauacacaucuuacauacauauacauag

SEQ ID NO: 192770 - RNA, 25 nt, Human
acauauacauauacauauucauaua

SEQ ID NO: 192771 - RNA, 20 nt, Human
accccaucugccuuucucug

SEQ ID NO: 192772 - RNA, 23 nt, Human
accccaucugccuuucucuggcu

SEQ ID NO: 192773 - RNA, 28 nt, Human
accugccugcucccuccucccucccccu

SEQ ID NO: 192774 - RNA, 21 nt, Human
acucccaccccugcccagccc

SEQ ID NO: 192775 - RNA, 22 nt, Human
acucccaccccugcccagcccc

SEQ ID NO: 192776 - RNA, 21 nt, Human
agaaaagaagaaagaagaggg

SEQ ID NO: 192777 - RNA, 23 nt, Human
agaagaaagaagagggaaggaag

SEQ ID NO: 192778 - RNA, 23 nt, Human
agaagaaagaagagggaaggaag

SEQ ID NO: 192779 - RNA, 25 nt, Human
agaagaaagaagagggaaggaaggg

SEQ ID NO: 192780 - RNA, 25 nt, Human
agaagaaagaagagggaaggaaggg

SEQ ID NO: 192781 - RNA, 21 nt, Human
agagggaaggaagggcccagc

SEQ ID NO: 192782 - RNA, 20 nt, Human
agcaagugaccaaaaaucua

SEQ ID NO: 192783 - RNA, 22 nt, Human
agcaagugaccaaaaaucuaua

SEQ ID NO: 192784 - RNA, 19 nt, Human
agcucgccucgccuccucu

SEQ ID NO: 192785 - RNA, 24 nt, Human
agcucgccucgccuccucugcccc

SEQ ID NO: 192786 - RNA, 20 nt, Human
agggaaccgcuccggagugc

SEQ ID NO: 192787 - RNA, 23 nt, Human
agggcagccccuuucugggggcc

SEQ ID NO: 192788 - RNA, 24 nt, Human
aguggcuaucuacauggcucuaca

SEQ ID NO: 192789 - RNA, 21 nt, Human
auauacauauacauauucaua

SEQ ID NO: 192790 - RNA, 21 nt, Human
auggcagcuguuucucuaaau

SEQ ID NO: 192791 - RNA, 24 nt, Human
cacaucugcucuaagaaccgccaa

SEQ ID NO: 192792 - RNA, 21 nt, Human
caccuccucccgggcccggcu

SEQ ID NO: 192793 - RNA, 22 nt, Human
cacuggccacucccaccccugc

SEQ ID NO: 192794 - RNA, 21 nt, Human
cagagauggggagagaggggg

SEQ ID NO: 192795 - RNA, 25 nt, Human
cagaguggagcuccaaguuacagcu

SEQ ID NO: 192796 - RNA, 19 nt, Human
cagccugcgggccaaggcg

SEQ ID NO: 192797 - RNA, 20 nt, Human
cagggcccuggcccuuuucu

SEQ ID NO: 192798 - RNA, 19 nt, Human
cagugcacagccugcgggc

SEQ ID NO: 192799 - RNA, 22 nt, Human
caguuaaaccugaaggaagaag

SEQ ID NO: 192800 - RNA, 20 nt, Human
cauuugggaccugccugcuc

SEQ ID NO: 192801 - RNA, 20 nt, Human
ccaaggcggguugcugggug

SEQ ID NO: 192802 - RNA, 23 nt, Human
ccaccccugcccagccccggaga

SEQ ID NO: 192803 - RNA, 19 nt, Human
ccccgcccccgcggggaac

SEQ ID NO: 192804 - RNA, 19 nt, Human
ccccggagaccccaucugc

SEQ ID NO: 192805 - RNA, 21 nt, Human
ccccugcccagccccggagac

SEQ ID NO: 192806 - RNA, 18 nt, Human
cccgcccccgcggggaac

SEQ ID NO: 192807 - RNA, 21 nt, Human
cccgcgcucccuucuugccuc

SEQ ID NO: 192808 - RNA, 23 nt, Human
cccgcgggagggcuggcuguccg

SEQ ID NO: 192809 - RNA, 19 nt, Human
cccgggcuuuguggcuggc

SEQ ID NO: 192810 - RNA, 18 nt, Human
cccggggcucccgccgca

SEQ ID NO: 192811 - RNA, 22 nt, Human
cccggggcucccgccgcaaccg

SEQ ID NO: 192812 - RNA, 20 nt, Human
cccugcccagccccggagag

SEQ ID NO: 192813 - RNA, 24 nt, Human
cccuuucugggggcagaguggagc

SEQ ID NO: 192814 - RNA, 20 nt, Human
ccgagcggagcccagcgacc

SEQ ID NO: 192815 - RNA, 23 nt, Human
ccgcacacgugugcgcacaugug

SEQ ID NO: 192816 - RNA, 18 nt, Human
ccgcccgccggucagucc

SEQ ID NO: 192817 - RNA, 19 nt, Human
ccgcgcuacaccuccuccc

SEQ ID NO: 192818 - RNA, 22 nt, Human
ccggcccgucccggggcucccg

SEQ ID NO: 192819 - RNA, 21 nt, Human
ccgggcccggcugggcgcggg

SEQ ID NO: 192820 - RNA, 22 nt, Human
ccuagaccaugcagugcacagc

SEQ ID NO: 192821 - RNA, 26 nt, Human
ccuagaccaugcagugcacagccugc

SEQ ID NO: 192822 - RNA, 18 nt, Human
ccucagggcccuggcccu

SEQ ID NO: 192823 - RNA, 19 nt, Human
cgccgcgcuacaccuccuc

SEQ ID NO: 192824 - RNA, 25 nt, Human
cgcuacauagcuauacauauacaca

SEQ ID NO: 192825 - RNA, 21 nt, Human
cgcuccgaguccccgggcucg

SEQ ID NO: 192826 - RNA, 21 nt, Human
cggccggagaggcucugcggc

SEQ ID NO: 192827 - RNA, 21 nt, Human
cggggcucccgccgcaaccga

SEQ ID NO: 192828 - RNA, 22 nt, Human
cgugugcgcacaugugaguggc

SEQ ID NO: 192829 - RNA, 23 nt, Human
cuaggcccucagggcccuggccg

SEQ ID NO: 192830 - RNA, 28 nt, Human
cuccagguccgcccgccggucaguccgc

SEQ ID NO: 192831 - RNA, 18 nt, Human
cuccgaguccccgggcuc

SEQ ID NO: 192832 - RNA, 22 nt, Human
cucuaaaugaacacaaugacac

SEQ ID NO: 192833 - RNA, 21 nt, Human
cucugccccggcccguccggc

SEQ ID NO: 192834 - RNA, 18 nt, Human
cugaaggaagaaggaagg

SEQ ID NO: 192835 - RNA, 18 nt, Human
cugucucgccgcccgggc

SEQ ID NO: 192836 - RNA, 18 nt, Human
cuucuugccucccucccu

SEQ ID NO: 192837 - RNA, 22 nt, Human
cuuucucuggcuuuugcauuug

SEQ ID NO: 192838 - RNA, 20 nt, Human
gaaagaagagggaaggaagg

SEQ ID NO: 192839 - RNA, 20 nt, Human
gaccugccugcucccuccuc

SEQ ID NO: 192840 - RNA, 21 nt, Human
gagcgcggcgccgcggacggg

SEQ ID NO: 192841 - RNA, 24 nt, Human
gcacagccugcgggccaaggcggg

SEQ ID NO: 192842 - RNA, 23 nt, Human
gccccggagaccccaucugccuu

SEQ ID NO: 192843 - RNA, 19 nt, Human
gccccuuucugggggcaga

SEQ ID NO: 192844 - RNA, 21 nt, Human
gcccgcgcgggucccgggcgu

SEQ ID NO: 192845 - RNA, 18 nt, Human
gcccggcugggcgcgggg

SEQ ID NO: 192846 - RNA, 20 nt, Human
gcccucagggcccuggcccu

SEQ ID NO: 192847 - RNA, 19 nt, Human
gcccuggcccuuuucuccc

SEQ ID NO: 192848 - RNA, 20 nt, Human
gcccuggcccuuuucuccca

SEQ ID NO: 192849 - RNA, 23 nt, Human
gcggcgcgccgcccggcuccagg

SEQ ID NO: 192850 - RNA, 18 nt, Human
ggagagagggggccugcu

SEQ ID NO: 192851 - RNA, 22 nt, Human
ggccaaggcggguugcugggug

SEQ ID NO: 192852 - RNA, 24 nt, Human
ggcccuggcccuuuucucccaagg

SEQ ID NO: 192853 - RNA, 25 nt, Human
ggcccuggcccuuuucucccaaggu

SEQ ID NO: 192854 - RNA, 18 nt, Human
gggaacaaugggcgccgg

SEQ ID NO: 192855 - RNA, 23 nt, Human
gggcccuggcccuuuucucccaa

SEQ ID NO: 192856 - RNA, 20 nt, Human
gggcuccagguccgcccgcc

SEQ ID NO: 192857 - RNA, 18 nt, Human
ggugugugcuugaggccc

SEQ ID NO: 192858 - RNA, 24 nt, Human
gguuauuuucugcugucuuuuguu

SEQ ID NO: 192859 - RNA, 23 nt, Human
gugggggcagccucaggcgccca

SEQ ID NO: 192860 - RNA, 24 nt, Human
guuaaaccugaaggaagaaggaag

SEQ ID NO: 192861 - RNA, 19 nt, Human
uaaacuagaccgcacacgg

SEQ ID NO: 192862 - RNA, 26 nt, Human
uaaacuagaccgcacacgugugcgca

SEQ ID NO: 192863 - RNA, 21 nt, Human
uacauauucauauacagaucu

SEQ ID NO: 192864 - RNA, 22 nt, Human
uagaaaaaaugcuaggcccuca

SEQ ID NO: 192865 - RNA, 21 nt, Human
uccggcccgucccggggcucc

SEQ ID NO: 192866 - RNA, 23 nt, Human
uccuuugccgccggcgugggggc

SEQ ID NO: 192867 - RNA, 21 nt, Human
ucuaaaugaacacaaugacac

SEQ ID NO: 192868 - RNA, 22 nt, Human
ucuacagagcgcuacauagcua

SEQ ID NO: 192869 - RNA, 22 nt, Human
ucuauaaaagcaagugaccaaa

SEQ ID NO: 192870 - RNA, 23 nt, Human
ucucccaaggucgcaggcuucug

SEQ ID NO: 192871 - RNA, 20 nt, Human
ucugccuuucucuggcuuuu

SEQ ID NO: 192872 - RNA, 23 nt, Human
ucugcggccgcggcgcucaggga

SEQ ID NO: 192873 - RNA, 20 nt, Human
ugaccaaaaaucuauagcuu

SEQ ID NO: 192874 - RNA, 19 nt, Human
ugagaggucaggcugggac

SEQ ID NO: 192875 - RNA, 19 nt, Human
ugccccggcccguccggcc

SEQ ID NO: 192876 - RNA, 24 nt, Human
ugcggccgcggcgcucagggaacc

SEQ ID NO: 192877 - RNA, 19 nt, Human
ugcuaggcccucagggccc

SEQ ID NO: 192878 - RNA, 23 nt, Human
ugcugucuuuuguuuuucuggag

SEQ ID NO: 192879 - RNA, 21 nt, Human
ugcuugggcaggcugcgcgcc

SEQ ID NO: 192880 - RNA, 18 nt, Human
uggccacccgcgagcucg

SEQ ID NO: 192881 - RNA, 24 nt, Human
uggggagagagggggccugcugcg

SEQ ID NO: 192882 - RNA, 20 nt, Human
ugggggcagaguggagcucc

SEQ ID NO: 192883 - RNA, 23 nt, Human
ugugaguggcuaucuacauggcu

SEQ ID NO: 192884 - RNA, 23 nt, Human
uuacauacauauacauauacaua

SEQ ID NO: 192885 - RNA, 22 nt, Human
uucucuggcuuuugcauuuggg

SEQ ID NO: 192886 - RNA, 23 nt, Human
uuuuucuggugugugugguuuuu

SEQ ID NO: 192887 - RNA, 23 nt, Human
acccacuucuccaggauccuccc

SEQ ID NO: 192888 - RNA, 19 nt, Human
auccucccagcccccaggc

SEQ ID NO: 192889 - RNA, 20 nt, Human
ccaggauccucccagccccc

SEQ ID NO: 192890 - RNA, 20 nt, Human
cccaggcuggcuuucccucc

SEQ ID NO: 192891 - RNA, 21 nt, Human
cccccaggcuggcuuucccuc

SEQ ID NO: 192892 - RNA, 24 nt, Human
gggcaaccccaggauggggaaggg

SEQ ID NO: 192893 - RNA, 23 nt, Human
uagagcagaauucagacucagcu

SEQ ID NO: 192894 - RNA, 18 nt, Human
ucagccaucuauguuccc

SEQ ID NO: 192895 - RNA, 19 nt, Human
uccccaaccgcgagagccc

SEQ ID NO: 192896 - RNA, 18 nt, Human
uccccacccacuucucca

SEQ ID NO: 192897 - RNA, 18 nt, Human
ucuguccccacccacuuc

SEQ ID NO: 192898 - RNA, 21 nt, Human
uuccccaaccgcgagagcccc

SEQ ID NO: 192899 - RNA, 25 nt, Human
uucuccaggauccucccagccccca

SEQ ID NO: 192900 - RNA, 20 nt, Human
aaaaagccaggaaccuugag

SEQ ID NO: 192901 - RNA, 20 nt, Human
agggcagaggccugggccag

SEQ ID NO: 192902 - RNA, 23 nt, Human
caggacagggcccgaagaacgac

SEQ ID NO: 192903 - RNA, 18 nt, Human
ccaggacagggcccgaag

SEQ ID NO: 192904 - RNA, 20 nt, Human
ccuuuuuucugggggcugac

SEQ ID NO: 192905 - RNA, 23 nt, Human
cgggaaaggagaugucuguggug

SEQ ID NO: 192906 - RNA, 26 nt, Human
cucagggugggguagccgggaaagga

SEQ ID NO: 192907 - RNA, 19 nt, Human
gcagaggccugggccagga

SEQ ID NO: 192908 - RNA, 18 nt, Human
gggcagaggccugggcca

SEQ ID NO: 192909 - RNA, 19 nt, Human
gggccaggacagggcccga

SEQ ID NO: 192910 - RNA, 23 nt, Human
gggccaggacagggcccgaagaa

SEQ ID NO: 192911 - RNA, 19 nt, Human
ucuguggugguucaaaaag

SEQ ID NO: 192912 - RNA, 18 nt, Human
ugccuuuuuucugggggc

SEQ ID NO: 192913 - RNA, 22 nt, Human
ugggugggcagagggcagaggc

SEQ ID NO: 192914 - RNA, 22 nt, Human
ugguucaaaaagccaggaaccu

SEQ ID NO: 192915 - RNA, 20 nt, Human
uuuauugccuuuuuucuggg

SEQ ID NO: 192916 - RNA, 24 nt, Human
aaaaaaaucaacucucuagccuuc

SEQ ID NO: 192917 - RNA, 24 nt, Human
aaaaacacaaaauaagcugggcau

SEQ ID NO: 192918 - RNA, 18 nt, Human
aaaauauccaucgucaca

SEQ ID NO: 192919 - RNA, 20 nt, Human
aaaauauccaucgucacaga

SEQ ID NO: 192920 - RNA, 20 nt, Human
aaagcaccauucccaaucaa

SEQ ID NO: 192921 - RNA, 24 nt, Human
aaagugcugggaccacaggcauga

SEQ ID NO: 192922 - RNA, 20 nt, Human
aaaguuacagaaucacauuu

SEQ ID NO: 192923 - RNA, 20 nt, Human
aacauggcaguuacucaucu

SEQ ID NO: 192924 - RNA, 19 nt, Human
aacauggugaaacaccauc

SEQ ID NO: 192925 - RNA, 20 nt, Human
aacauggugaaacaccaucu

SEQ ID NO: 192926 - RNA, 21 nt, Human
aacauggugaaacaccaucuc

SEQ ID NO: 192927 - RNA, 23 nt, Human
aacccuugccuuuaagaggcaaa

SEQ ID NO: 192928 - RNA, 18 nt, Human
aaccuagccacuuacagc

SEQ ID NO: 192929 - RNA, 20 nt, Human
aaccuagccacuuacagcga

SEQ ID NO: 192930 - RNA, 21 nt, Human
aacuauagacauugcaaccuu

SEQ ID NO: 192931 - RNA, 22 nt, Human
aagaggcaaaugaacaugaaca

SEQ ID NO: 192932 - RNA, 24 nt, Human
aagugagagaaucgcuugagccug

SEQ ID NO: 192933 - RNA, 24 nt, Human
aagugaucugccugccuuggccuc

SEQ ID NO: 192934 - RNA, 25 nt, Human
aagugcuuggguauaacugaccuag

SEQ ID NO: 192935 - RNA, 20 nt, Human
aaucgcuugaaccuggaagg

SEQ ID NO: 192936 - RNA, 18 nt, Human
aaucgcuugagccuggga

SEQ ID NO: 192937 - RNA, 22 nt, Human
aauucucuuuuuagucgcuggc

SEQ ID NO: 192938 - RNA, 21 nt, Human
acaaaacuaugaccacaggca

SEQ ID NO: 192939 - RNA, 19 nt, Human
acaccuguaauccuagaac

SEQ ID NO: 192940 - RNA, 22 nt, Human
acagcgugaccaugucucaaaa

SEQ ID NO: 192941 - RNA, 18 nt, Human
acaggguuucgccauguu

SEQ ID NO: 192942 - RNA, 19 nt, Human
acaggguuucgccauguug

SEQ ID NO: 192943 - RNA, 24 nt, Human
acaggguuucgccauguugaccag

SEQ ID NO: 192944 - RNA, 21 nt, Human
acaggugcccaccaccacacc

SEQ ID NO: 192945 - RNA, 19 nt, Human
acauggcaaaacuccaucu

SEQ ID NO: 192946 - RNA, 19 nt, Human
acauggugaaacaccaucu

SEQ ID NO: 192947 - RNA, 24 nt, Human
accacacuaaaaugccuuucaaua

SEQ ID NO: 192948 - RNA, 24 nt, Human
accacaggcaugagcgaccaugcc

SEQ ID NO: 192949 - RNA, 23 nt, Human
accacuguacucagccugggcga

SEQ ID NO: 192950 - RNA, 24 nt, Human
acccugucucuacuaaaaacacaa

SEQ ID NO: 192951 - RNA, 25 nt, Human
acuccagccugggcaacaagaguga

SEQ ID NO: 192952 - RNA, 19 nt, Human
acucgucacccaggcuuga

SEQ ID NO: 192953 - RNA, 18 nt, Human
acugcacuccagccuugg

SEQ ID NO: 192954 - RNA, 19 nt, Human
acugcacuccagccuuggc

SEQ ID NO: 192955 - RNA, 19 nt, Human
acugcacuccagccuuggg

SEQ ID NO: 192956 - RNA, 24 nt, Human
acuggacagcaaaagucuacaaaa

SEQ ID NO: 192957 - RNA, 20 nt, Human
acuuuauacagucaccaagu

SEQ ID NO: 192958 - RNA, 20 nt, Human
agaacuuugggaggccaagg

SEQ ID NO: 192959 - RNA, 24 nt, Human
agaacuuugggaggccaagguggg

SEQ ID NO: 192960 - RNA, 22 nt, Human
agaaucacauuuuaaaccacca

SEQ ID NO: 192961 - RNA, 18 nt, Human
agacaaaauaagcaugua

SEQ ID NO: 192962 - RNA, 18 nt, Human
agacaggguuucgccaug

SEQ ID NO: 192963 - RNA, 18 nt, Human
agacaggguuucgccaug

SEQ ID NO: 192964 - RNA, 24 nt, Human
agcacuuugggaggccgaggcagg

SEQ ID NO: 192965 - RNA, 21 nt, Human
agccagccgagaucgcaccac

SEQ ID NO: 192966 - RNA, 23 nt, Human
agccaggcgugguggcgggugcc

SEQ ID NO: 192967 - RNA, 24 nt, Human
agcgaucacgccauugcacuccag

SEQ ID NO: 192968 - RNA, 22 nt, Human
agcugggcaugguggcgcaugc

SEQ ID NO: 192969 - RNA, 23 nt, Human
aggaggcugaggcaggagaauca

SEQ ID NO: 192970 - RNA, 23 nt, Human
aggaguccaagaccagucuggcc

SEQ ID NO: 192971 - RNA, 20 nt, Human
aggaguuugagaccagccug

SEQ ID NO: 192972 - RNA, 26 nt, Human
aggcagaucacccgacgucgggaguu

SEQ ID NO: 192973 - RNA, 18 nt, Human
aggcaggagaaucacuug

SEQ ID NO: 192974 - RNA, 22 nt, Human
aggcaggcagaucacccgacgu

SEQ ID NO: 192975 - RNA, 21 nt, Human
aggccaagguggguggaucac

SEQ ID NO: 192976 - RNA, 19 nt, Human
aggcggagguugcagugag

SEQ ID NO: 192977 - RNA, 19 nt, Human
aggcggagguugcggugag

SEQ ID NO: 192978 - RNA, 22 nt, Human
aggcggagguugcggugagcag

SEQ ID NO: 192979 - RNA, 24 nt, Human
aggcgugguggcucacgccuguaa

SEQ ID NO: 192980 - RNA, 24 nt, Human
aggcugaggcaggagaaucacuug

SEQ ID NO: 192981 - RNA, 24 nt, Human
aggcugagucaggagaaucgcuug

SEQ ID NO: 192982 - RNA, 27 nt, Human
aggcugcagccagccgagaucgcacca

SEQ ID NO: 192983 - RNA, 22 nt, Human
aggucaggaguccaagaccagu

SEQ ID NO: 192984 - RNA, 24 nt, Human
agguggguggaucacgaggucagg

SEQ ID NO: 192985 - RNA, 24 nt, Human
agucaggagaaucgcuugaaccug

SEQ ID NO: 192986 - RNA, 19 nt, Human
agucuggccaacaugguga

SEQ ID NO: 192987 - RNA, 24 nt, Human
agugauucuugugccucagccucc

SEQ ID NO: 192988 - RNA, 20 nt, Human
agugcaguggcacaauccug

SEQ ID NO: 192989 - RNA, 19 nt, Human
agugcucuuuuuuuccccu

SEQ ID NO: 192990 - RNA, 22 nt, Human
aguggcuaccacacuggacagc

SEQ ID NO: 192991 - RNA, 24 nt, Human
aucacaaaacuaugaccacaggca

SEQ ID NO: 192992 - RNA, 20 nt, Human
aucacgaggucaggaguccc

SEQ ID NO: 192993 - RNA, 24 nt, Human
aucacgccauugcacuccagccug

SEQ ID NO: 192994 - RNA, 19 nt, Human
aucauaucuuuaaaagggg

SEQ ID NO: 192995 - RNA, 25 nt, Human
aucgcaccacugcacuccagccuug

SEQ ID NO: 192996 - RNA, 23 nt, Human
auugcaccacuguacucagccug

SEQ ID NO: 192997 - RNA, 24 nt, Human
auugcacuccagccugggcaacaa

SEQ ID NO: 192998 - RNA, 25 nt, Human
auugcacuccagccugggcaacaag

SEQ ID NO: 192999 - RNA, 24 nt, Human
auugcuugagcucaggaguuugag

SEQ ID NO: 193000 - RNA, 24 nt, Human
auuggccggacgugguggcucaca

SEQ ID NO: 193001 - RNA, 21 nt, Human
caaaauaagcauguagguggc

SEQ ID NO: 193002 - RNA, 24 nt, Human
caaagugcugggaccacaggcaug

SEQ ID NO: 193003 - RNA, 23 nt, Human
caaaugaacaugaacacaaaaca

SEQ ID NO: 193004 - RNA, 23 nt, Human
caaccuccaccucccaaguucaa

SEQ ID NO: 193005 - RNA, 24 nt, Human
caagaccagucuggccaacauggu

SEQ ID NO: 193006 - RNA, 24 nt, Human
caagccagucuuaguuuuaaauca

SEQ ID NO: 193007 - RNA, 24 nt, Human
caagguggguggaucacgagguca

SEQ ID NO: 193008 - RNA, 22 nt, Human
caagugaucugccugccuuggc

SEQ ID NO: 193009 - RNA, 22 nt, Human
caagugauucuugugccucagc

SEQ ID NO: 193010 - RNA, 27 nt, Human
caagugauucuugugccucagccuccc

SEQ ID NO: 193011 - RNA, 19 nt, Human
cacaaaacuaugaccacag

SEQ ID NO: 193012 - RNA, 24 nt, Human
cacaccuguaauccuagaacuuug

SEQ ID NO: 193013 - RNA, 20 nt, Human
cacagaaaguucuauuagac

SEQ ID NO: 193014 - RNA, 24 nt, Human
cacccgcagucccagcuacuuggg

SEQ ID NO: 193015 - RNA, 23 nt, Human
caccuguaauccuagaacuuugg

SEQ ID NO: 193016 - RNA, 24 nt, Human
caccuguaauccuagaacuuuggg

SEQ ID NO: 193017 - RNA, 24 nt, Human
cacgccugcaaucccagcacuuug

SEQ ID NO: 193018 - RNA, 24 nt, Human
cacgccuguaaucccagcacuuug

SEQ ID NO: 193019 - RNA, 23 nt, Human
cacuccagccugggcaacaagag

SEQ ID NO: 193020 - RNA, 24 nt, Human
cacuccagccugggcaacaagagu

SEQ ID NO: 193021 - RNA, 25 nt, Human
cacuccagccugggcaacaagagug

SEQ ID NO: 193022 - RNA, 21 nt, Human
cacucccgcuccgaagccgga

SEQ ID NO: 193023 - RNA, 18 nt, Human
cacucgucacccaggcuu

SEQ ID NO: 193024 - RNA, 21 nt, Human
cacugcaaccuccaccuccca

SEQ ID NO: 193025 - RNA, 19 nt, Human
cacugcacuccagccuugg

SEQ ID NO: 193026 - RNA, 20 nt, Human
cacugcacuccagccuuggc

SEQ ID NO: 193027 - RNA, 20 nt, Human
cacugcacuccagccuuggc

SEQ ID NO: 193028 - RNA, 22 nt, Human
cacugcacuccagccuuggcga

SEQ ID NO: 193029 - RNA, 24 nt, Human
cacugcacuccagccuuggcgaca

SEQ ID NO: 193030 - RNA, 19 nt, Human
cacuguacucagccugggc

SEQ ID NO: 193031 - RNA, 24 nt, Human
cagaucacccgacgucgggaguuc

SEQ ID NO: 193032 - RNA, 24 nt, Human
cagcacuuugggaggccgaggcag

SEQ ID NO: 193033 - RNA, 24 nt, Human
cagcacuuugggaggccgaggcag

SEQ ID NO: 193034 - RNA, 20 nt, Human
cagcacuuuggggagccaag

SEQ ID NO: 193035 - RNA, 21 nt, Human
cagcacuuuggggagccaagg

SEQ ID NO: 193036 - RNA, 22 nt, Human
cagcauggagaaacccugucuc

SEQ ID NO: 193037 - RNA, 24 nt, Human
cagccuguccagcauggagaaacc

SEQ ID NO: 193038 - RNA, 24 nt, Human
cagcuacucaggaggcugaggcag

SEQ ID NO: 193039 - RNA, 24 nt, Human
caggcagaucacccgacgucggga

SEQ ID NO: 193040 - RNA, 24 nt, Human
caggguuucgccauguugaccagg

SEQ ID NO: 193041 - RNA, 24 nt, Human
caggugcccaccaccacaccuggc

SEQ ID NO: 193042 - RNA, 22 nt, Human
caucugaauaccccuuaaauac

SEQ ID NO: 193043 - RNA, 21 nt, Human
caugagacauuucuguuuugu

SEQ ID NO: 193044 - RNA, 24 nt, Human
caugcuuguaaucccagcuacuug

SEQ ID NO: 193045 - RNA, 24 nt, Human
cauguugaccaggcuggucucaaa

SEQ ID NO: 193046 - RNA, 18 nt, Human
cauugcacuccagccugg

SEQ ID NO: 193047 - RNA, 19 nt, Human
cauugcacuccagccuggg

SEQ ID NO: 193048 - RNA, 21 nt, Human
cauugcacuccagccugggca

SEQ ID NO: 193049 - RNA, 23 nt, Human
cauugcacuccagccugggcaac

SEQ ID NO: 193050 - RNA, 24 nt, Human
cauugcacuccagccugggcaaca

SEQ ID NO: 193051 - RNA, 20 nt, Human
cauuuaaccacaagccaguc

SEQ ID NO: 193052 - RNA, 18 nt, Human
cauuuagggcuccugcac

SEQ ID NO: 193053 - RNA, 24 nt, Human
ccaaagugcugggaccacaggcau

SEQ ID NO: 193054 - RNA, 20 nt, Human
ccacugcacuccagccuugg

SEQ ID NO: 193055 - RNA, 20 nt, Human
ccacugcacuccagccuugg

SEQ ID NO: 193056 - RNA, 21 nt, Human
ccacugcacuccagccuuggc

SEQ ID NO: 193057 - RNA, 23 nt, Human
ccacugcacuccagccuuggcga

SEQ ID NO: 193058 - RNA, 24 nt, Human
ccacugcacuccagccuuggcgac

SEQ ID NO: 193059 - RNA, 19 nt, Human
ccacuguacucagccuggg

SEQ ID NO: 193060 - RNA, 20 nt, Human
ccacuguacucagccugggc

SEQ ID NO: 193061 - RNA, 20 nt, Human
ccacuguacucagccugggc

SEQ ID NO: 193062 - RNA, 23 nt, Human
ccagcauggagaaacccugucuc

SEQ ID NO: 193063 - RNA, 24 nt, Human
ccaggaugccaaaaaaaaaaaaaa

SEQ ID NO: 193064 - RNA, 24 nt, Human
ccaggcagggccugguggcucacg

SEQ ID NO: 193065 - RNA, 22 nt, Human
ccauguugaccaggcuggucuc

SEQ ID NO: 193066 - RNA, 20 nt, Human
ccauugcacuccagccuggg

SEQ ID NO: 193067 - RNA, 21 nt, Human
ccauugcacuccagccugggc

SEQ ID NO: 193068 - RNA, 22 nt, Human
ccauugcacuccagccugggca

SEQ ID NO: 193069 - RNA, 23 nt, Human
ccauugcacuccagccugggcaa

SEQ ID NO: 193070 - RNA, 24 nt, Human
ccauugcacuccagccugggcaac

SEQ ID NO: 193071 - RNA, 22 nt, Human
cccaaguagcugagacuacagg

SEQ ID NO: 193072 - RNA, 23 nt, Human
cccgaccucaagugaucugccug

SEQ ID NO: 193073 - RNA, 23 nt, Human
cccgacgucgggaguucaagacc

SEQ ID NO: 193074 - RNA, 21 nt, Human
cccgcagucccagcuacuugg

SEQ ID NO: 193075 - RNA, 22 nt, Human
ccugcaaucccagcacuuuggg

SEQ ID NO: 193076 - RNA, 19 nt, Human
ccugcaaucccagcuacuc

SEQ ID NO: 193077 - RNA, 21 nt, Human
ccugcaaucccagcuacucag

SEQ ID NO: 193078 - RNA, 22 nt, Human
ccugcaaucccagcuacucagg

SEQ ID NO: 193079 - RNA, 22 nt, Human
ccugccuuggccucccaaagug

SEQ ID NO: 193080 - RNA, 19 nt, Human
ccuugugcucaccaucucc

SEQ ID NO: 193081 - RNA, 24 nt, Human
cgaagcacuagaaaugaaaacaug

SEQ ID NO: 193082 - RNA, 18 nt, Human
cgaccucaagugaucugc

SEQ ID NO: 193083 - RNA, 24 nt, Human
cgagaucgcaccacugcacuccag

SEQ ID NO: 193084 - RNA, 21 nt, Human
cgcaccacugcacuccagccu

SEQ ID NO: 193085 - RNA, 24 nt, Human
cgccauguugaccaggcuggucuc

SEQ ID NO: 193086 - RNA, 22 nt, Human
cgcccgaccucaagugaucugc

SEQ ID NO: 193087 - RNA, 23 nt, Human
cgccugcaaucccagcacuuugg

SEQ ID NO: 193088 - RNA, 23 nt, Human
cgccuguaaucccagcacuuugg

SEQ ID NO: 193089 - RNA, 24 nt, Human
cgccuguaaucccagcacuuuggg

SEQ ID NO: 193090 - RNA, 24 nt, Human
cggauugcuugagcucaggaguuu

SEQ ID NO: 193091 - RNA, 22 nt, Human
cuaccacacuggacagcaaaag

SEQ ID NO: 193092 - RNA, 24 nt, Human
cuagaaaaccaaguaaacaaucua

SEQ ID NO: 193093 - RNA, 19 nt, Human
cuagaacauggcaguuacu

SEQ ID NO: 193094 - RNA, 18 nt, Human
cucaagugaucugccugc

SEQ ID NO: 193095 - RNA, 20 nt, Human
cucaagugaucugccugccu

SEQ ID NO: 193096 - RNA, 22 nt, Human
cucacaccuguaauccuagaac

SEQ ID NO: 193097 - RNA, 24 nt, Human
cucacaccuguaauccuagaacuu

SEQ ID NO: 193098 - RNA, 22 nt, Human
cucacgccugcaaucccagcac

SEQ ID NO: 193099 - RNA, 24 nt, Human
cucacgccugcaaucccagcacuu

SEQ ID NO: 193100 - RNA, 22 nt, Human
cucacgccuguaaucccagcac

SEQ ID NO: 193101 - RNA, 24 nt, Human
cucacgccuguaaucccagcacuu

SEQ ID NO: 193102 - RNA, 24 nt, Human
cucacugcaaccuccaccucccaa

SEQ ID NO: 193103 - RNA, 21 nt, Human
cucccaaguagcugagacuac

SEQ ID NO: 193104 - RNA, 18 nt, Human
cugaaaucuuuaaaggau

SEQ ID NO: 193105 - RNA, 18 nt, Human
cugaagguauauaucccu

SEQ ID NO: 193106 - RNA, 23 nt, Human
cugcaaccuccaccucccaaguu

SEQ ID NO: 193107 - RNA, 24 nt, Human
cugcaaccuccaccucccaaguuc

SEQ ID NO: 193108 - RNA, 20 nt, Human
cugcagccagccgagaucgc

SEQ ID NO: 193109 - RNA, 21 nt, Human
cugcagccagccgagaucgca

SEQ ID NO: 193110 - RNA, 23 nt, Human
cugccuuggccucccaaagugcu

SEQ ID NO: 193111 - RNA, 23 nt, Human
cuggccaacauggugaaacacca

SEQ ID NO: 193112 - RNA, 18 nt, Human
cuggucucaaacgcccga

SEQ ID NO: 193113 - RNA, 20 nt, Human
cugguucuaguccuagaccc

SEQ ID NO: 193114 - RNA, 19 nt, Human
cuucucagucuucucacug

SEQ ID NO: 193115 - RNA, 23 nt, Human
cuugagcucaggaguuugagacc

SEQ ID NO: 193116 - RNA, 25 nt, Human
cuugugccucagccucccaaguagc

SEQ ID NO: 193117 - RNA, 19 nt, Human
gaaaaaauaaaugagaaaa

SEQ ID NO: 193118 - RNA, 23 nt, Human
gaacacucccgcuccgaagccgg

SEQ ID NO: 193119 - RNA, 22 nt, Human
gaaccuggaaggcggagguugc

SEQ ID NO: 193120 - RNA, 18 nt, Human
gaagcacuagaaaugaaa

SEQ ID NO: 193121 - RNA, 23 nt, Human
gaccucaagugaucugccugccu

SEQ ID NO: 193122 - RNA, 23 nt, Human
gacgugguggcucacaccuguaa

SEQ ID NO: 193123 - RNA, 21 nt, Human
gagaaacccugucucuacuaa

SEQ ID NO: 193124 - RNA, 21 nt, Human
gagugcaguggcacaauccug

SEQ ID NO: 193125 - RNA, 22 nt, Human
gagugcaguggcacaauccugg

SEQ ID NO: 193126 - RNA, 24 nt, Human
gaucacccgacgucgggaguucaa

SEQ ID NO: 193127 - RNA, 24 nt, Human
gaucacgaggucaggaguccaaga

SEQ ID NO: 193128 - RNA, 22 nt, Human
gauugcuugagcucaggaguuu

SEQ ID NO: 193129 - RNA, 24 nt, Human
gauugcuugagcucaggaguuuga

SEQ ID NO: 193130 - RNA, 20 nt, Human
gcaccacugcacuccagccu

SEQ ID NO: 193131 - RNA, 22 nt, Human
gcaccauucccaaucaaauaca

SEQ ID NO: 193132 - RNA, 24 nt, Human
gccaacauggugaaacaccaucuc

SEQ ID NO: 193133 - RNA, 22 nt, Human
gccauugcacuccagccugggc

SEQ ID NO: 193134 - RNA, 24 nt, Human
gccauugcacuccagccugggcaa

SEQ ID NO: 193135 - RNA, 20 nt, Human
gccgagaucgcaccacugca

SEQ ID NO: 193136 - RNA, 22 nt, Human
gccuuggccucccaaagugcug

SEQ ID NO: 193137 - RNA, 20 nt, Human
gcuuguaaucccagcuacuu

SEQ ID NO: 193138 - RNA, 24 nt, Human
ggaccacaggcaugagcgaccaug

SEQ ID NO: 193139 - RNA, 19 nt, Human
ggagguugcagugagauug

SEQ ID NO: 193140 - RNA, 18 nt, Human
ggagguugcggugagcag

SEQ ID NO: 193141 - RNA, 24 nt, Human
ggagguugcggugagcagcgauca

SEQ ID NO: 193142 - RNA, 26 nt, Human
ggagguugcggugagcagcggcuagg

SEQ ID NO: 193143 - RNA, 22 nt, Human
ggauugcuugagcucaggaguu

SEQ ID NO: 193144 - RNA, 23 nt, Human
ggcaaaugaacaugaacacaaaa

SEQ ID NO: 193145 - RNA, 21 nt, Human
ggccaggcgugguggcucacg

SEQ ID NO: 193146 - RNA, 21 nt, Human
ggcgcaugcuuguaaucccag

SEQ ID NO: 193147 - RNA, 22 nt, Human
ggcgcaugcuuguaaucccagc

SEQ ID NO: 193148 - RNA, 20 nt, Human
gggcaugguggcgaacaccc

SEQ ID NO: 193149 - RNA, 24 nt, Human
gggccugguggcucacgccugcaa

SEQ ID NO: 193150 - RNA, 23 nt, Human
ggguggaucacgaggucaggagu

SEQ ID NO: 193151 - RNA, 24 nt, Human
gguggcgcaugcuuguaaucccag

SEQ ID NO: 193152 - RNA, 24 nt, Human
gguggcucacaccuguaauccuag

SEQ ID NO: 193153 - RNA, 24 nt, Human
gguggcucacgccugcaaucccag

SEQ ID NO: 193154 - RNA, 24 nt, Human
gguggcucacgccuguaaucccag

SEQ ID NO: 193155 - RNA, 21 nt, Human
guagagacaggguuucgccau

SEQ ID NO: 193156 - RNA, 19 nt, Human
guagcugagacuacaggug

SEQ ID NO: 193157 - RNA, 23 nt, Human
gucaauacaguagccacuagcca

SEQ ID NO: 193158 - RNA, 18 nt, Human
gucaugagacauuucugu

SEQ ID NO: 193159 - RNA, 24 nt, Human
gugauucuugugccucagccuccc

SEQ ID NO: 193160 - RNA, 22 nt, Human
gugccucagccucccaaguagc

SEQ ID NO: 193161 - RNA, 23 nt, Human
gugccucagccucccaaguagcu

SEQ ID NO: 193162 - RNA, 20 nt, Human
guggcucacaccuguaaucc

SEQ ID NO: 193163 - RNA, 22 nt, Human
uaaaaacacaaaauaagcuggg

SEQ ID NO: 193164 - RNA, 21 nt, Human
uaaaaauacaaaaauuagcca

SEQ ID NO: 193165 - RNA, 19 nt, Human
uaaaaucuccaaggacuac

SEQ ID NO: 193166 - RNA, 21 nt, Human
uaaaaucuccaaggacuacuc

SEQ ID NO: 193167 - RNA, 31 nt, Human
uaaauauauucacauaaccaguuauauaaaa

SEQ ID NO: 193168 - RNA, 19 nt, Human
uaaauuccccaccagaacu

SEQ ID NO: 193169 - RNA, 20 nt, Human
uaacugaccuagaacauggc

SEQ ID NO: 193170 - RNA, 25 nt, Human
uaacuugcuacuauuuuaaaagcau

SEQ ID NO: 193171 - RNA, 23 nt, Human
uaagaggcaaaugaacaugaaca

SEQ ID NO: 193172 - RNA, 22 nt, Human
uacaggugcccaccaccacacc

SEQ ID NO: 193173 - RNA, 22 nt, Human
uacauaauuggccaggcguggu

SEQ ID NO: 193174 - RNA, 19 nt, Human
uacaucuggcccuuguuuu

SEQ ID NO: 193175 - RNA, 24 nt, Human
uagaacuuugggaggccaaggugg

SEQ ID NO: 193176 - RNA, 21 nt, Human
uagagacaggguuucgccaug

SEQ ID NO: 193177 - RNA, 22 nt, Human
uagagacaggguuucgccaugu

SEQ ID NO: 193178 - RNA, 21 nt, Human
uaggacuucaaauaugaauua

SEQ ID NO: 193179 - RNA, 18 nt, Human
uauacagucaccaagucc

SEQ ID NO: 193180 - RNA, 18 nt, Human
ucaaaaaacaaacuaaac

SEQ ID NO: 193181 - RNA, 25 nt, Human
ucaaaaaacaaacuaaacgccacaa

SEQ ID NO: 193182 - RNA, 26 nt, Human
ucacacauaauuuuaaaauuugugua

SEQ ID NO: 193183 - RNA, 19 nt, Human
ucacaucuucucagucuuc

SEQ ID NO: 193184 - RNA, 18 nt, Human
ucaccaaguccucugcua

SEQ ID NO: 193185 - RNA, 23 nt, Human
ucacccgacgucgggaguucaag

SEQ ID NO: 193186 - RNA, 24 nt, Human
ucacgaggucaggaguccaagacc

SEQ ID NO: 193187 - RNA, 23 nt, Human
ucacgccauugcacuccagccug

SEQ ID NO: 193188 - RNA, 18 nt, Human
ucacugcaaccuccaccu

SEQ ID NO: 193189 - RNA, 19 nt, Human
ucacugcaaccuccaccuc

SEQ ID NO: 193190 - RNA, 24 nt, Human
ucacugcaaccuccaccucccaag

SEQ ID NO: 193191 - RNA, 27 nt, Human
ucacugcaaccuccaccucccaaguuc

SEQ ID NO: 193192 - RNA, 18 nt, Human
ucagccucccaaguagcu

SEQ ID NO: 193193 - RNA, 21 nt, Human
ucagccucccaaguagcugag

SEQ ID NO: 193194 - RNA, 23 nt, Human
ucaguauguaauuauacacuguu

SEQ ID NO: 193195 - RNA, 27 nt, Human
uccaggaugccaaaaaaaaaaaaaauc

SEQ ID NO: 193196 - RNA, 23 nt, Human
uccaucgucacagaaaguucuau

SEQ ID NO: 193197 - RNA, 24 nt, Human
uccaucgucacagaaaguucuauu

SEQ ID NO: 193198 - RNA, 18 nt, Human
ucccaaagugcugggacc

SEQ ID NO: 193199 - RNA, 24 nt, Human
ucccaaagugcugggaccacaggc

SEQ ID NO: 193200 - RNA, 23 nt, Human
ucccaaguagcugagacuacagg

SEQ ID NO: 193201 - RNA, 20 nt, Human
ucccaaguucaagugauucu

SEQ ID NO: 193202 - RNA, 20 nt, Human
ucccaaguucaagugauucu

SEQ ID NO: 193203 - RNA, 21 nt, Human
ucccacaaagauacaguucuc

SEQ ID NO: 193204 - RNA, 20 nt, Human
ucccugaauaccacuaacuu

SEQ ID NO: 193205 - RNA, 23 nt, Human
ucgcaccacugcacuccagccuu

SEQ ID NO: 193206 - RNA, 22 nt, Human
ucgccauguugaccaggcuggu

SEQ ID NO: 193207 - RNA, 24 nt, Human
ucgcuugaaccuggaaggcggagg

SEQ ID NO: 193208 - RNA, 24 nt, Human
ucgcuugagccugggaaauagagg

SEQ ID NO: 193209 - RNA, 21 nt, Human
ucuacaaaauauccaucguca

SEQ ID NO: 193210 - RNA, 21 nt, Human
ucucaaacgcccgaccucaag

SEQ ID NO: 193211 - RNA, 19 nt, Human
ucuccaaggacuacucuaa

SEQ ID NO: 193212 - RNA, 19 nt, Human
ucuggccaacauggugaaa

SEQ ID NO: 193213 - RNA, 24 nt, Human
ucuggccaacauggugaaacacca

SEQ ID NO: 193214 - RNA, 28 nt, Human
ucuguaucuaucuuaauauguuuccugu

SEQ ID NO: 193215 - RNA, 23 nt, Human
ugaaaaccaggcagggccuggug

SEQ ID NO: 193216 - RNA, 20 nt, Human
ugaaacaccaucuccacuaa

SEQ ID NO: 193217 - RNA, 21 nt, Human
ugaaacaccaucuccacuaaa

SEQ ID NO: 193218 - RNA, 22 nt, Human
ugaaacaccaucuccacuaaaa

SEQ ID NO: 193219 - RNA, 18 nt, Human
ugaauuacagcaagcuuu

SEQ ID NO: 193220 - RNA, 19 nt, Human
ugacauuuagggcugcugc

SEQ ID NO: 193221 - RNA, 23 nt, Human
ugaccaggcuggucucaaacgcc

SEQ ID NO: 193222 - RNA, 18 nt, Human
ugagaccauggauucaca

SEQ ID NO: 193223 - RNA, 21 nt, Human
ugagacuacaggugcccacca

SEQ ID NO: 193224 - RNA, 24 nt, Human
ugagacuacaggugcccaccacca

SEQ ID NO: 193225 - RNA, 24 nt, Human
ugagccugggaaauagaggcugca

SEQ ID NO: 193226 - RNA, 20 nt, Human
ugaggcaggagaaucacuug

SEQ ID NO: 193227 - RNA, 21 nt, Human
ugaggcaggagaaucacuugc

SEQ ID NO: 193228 - RNA, 24 nt, Human
ugaggcaggagaaucacuugcaac

SEQ ID NO: 193229 - RNA, 24 nt, Human
ugagucaggagaaucgcuugaacc

SEQ ID NO: 193230 - RNA, 20 nt, Human
ugauucuugugccucagccu

SEQ ID NO: 193231 - RNA, 21 nt, Human
ugcaccacuguacucagccug

SEQ ID NO: 193232 - RNA, 19 nt, Human
ugcacuccagccugggcaa

SEQ ID NO: 193233 - RNA, 27 nt, Human
ugccaaaaaaaaaaaaaaucaacucuc

SEQ ID NO: 193234 - RNA, 25 nt, Human
ugcccaccaccacaccuggcuaacu

SEQ ID NO: 193235 - RNA, 24 nt, Human
ugccucagccucccaaguagcuga

SEQ ID NO: 193236 - RNA, 24 nt, Human
ugccugcaaucccagcuacucagg

SEQ ID NO: 193237 - RNA, 18 nt, Human
ugccugccuuggccuccc

SEQ ID NO: 193238 - RNA, 19 nt, Human
ugcugggaccacaggcaug

SEQ ID NO: 193239 - RNA, 20 nt, Human
ugcugggaccacaggcauga

SEQ ID NO: 193240 - RNA, 21 nt, Human
ugcuugguucuaagacaguga

SEQ ID NO: 193241 - RNA, 22 nt, Human
ugcuuguaaucccagcuacuug

SEQ ID NO: 193242 - RNA, 23 nt, Human
ugcuuguaaucccagcuacuuga

SEQ ID NO: 193243 - RNA, 29 nt, Human
uggaaggcggagguugcagugacaacggu

SEQ ID NO: 193244 - RNA, 24 nt, Human
uggaaggcggagguugcggugagc

SEQ ID NO: 193245 - RNA, 19 nt, Human
uggcaaaagcaccauuccc

SEQ ID NO: 193246 - RNA, 24 nt, Human
uggcacaauccuggcucacugcaa

SEQ ID NO: 193247 - RNA, 18 nt, Human
uggccaacauggugaaac

SEQ ID NO: 193248 - RNA, 21 nt, Human
uggcgcaugcuuguaauccca

SEQ ID NO: 193249 - RNA, 22 nt, Human
uggcgcaugcuuguaaucccag

SEQ ID NO: 193250 - RNA, 24 nt, Human
uggcgggugccugcaaucccagcu

SEQ ID NO: 193251 - RNA, 19 nt, Human
uggcucacaccuguaaucc

SEQ ID NO: 193252 - RNA, 21 nt, Human
uggcucacaccuguaauccua

SEQ ID NO: 193253 - RNA, 24 nt, Human
uggcucacgccugcaaucccagca

SEQ ID NO: 193254 - RNA, 22 nt, Human
uggcucacgccuguaaucccag

SEQ ID NO: 193255 - RNA, 24 nt, Human
uggcucacgccuguaaucccagca

SEQ ID NO: 193256 - RNA, 24 nt, Human
ugggaagcugaagugagagaaucg

SEQ ID NO: 193257 - RNA, 24 nt, Human
ugggaccacaggcaugagcgacca

SEQ ID NO: 193258 - RNA, 22 nt, Human
ugggaccacauggcaaaacucc

SEQ ID NO: 193259 - RNA, 23 nt, Human
ugggaggccaagguggguggauc

SEQ ID NO: 193260 - RNA, 24 nt, Human
ugggaggccaagguggguggauca

SEQ ID NO: 193261 - RNA, 20 nt, Human
ugggaggccgaggcaggcag

SEQ ID NO: 193262 - RNA, 24 nt, Human
ugggaggccgaggcaggcagauca

SEQ ID NO: 193263 - RNA, 25 nt, Human
ugggcaugguggcgcaugcuuguaa

SEQ ID NO: 193264 - RNA, 22 nt, Human
ugggcgaaaagggcgaaacucc

SEQ ID NO: 193265 - RNA, 24 nt, Human
ugguggcgcaugcuuguaauccca

SEQ ID NO: 193266 - RNA, 22 nt, Human
ugguggcucacaccuguaaucc

SEQ ID NO: 193267 - RNA, 24 nt, Human
ugguggcucacgccugcaauccca

SEQ ID NO: 193268 - RNA, 24 nt, Human
ugguggcucacgccuguaauccca

SEQ ID NO: 193269 - RNA, 18 nt, Human
uguaaucccagcuacuug

SEQ ID NO: 193270 - RNA, 24 nt, Human
uguagagacaggguuucgccaugu

SEQ ID NO: 193271 - RNA, 21 nt, Human
ugucuggcauaaaugcugcag

SEQ ID NO: 193272 - RNA, 21 nt, Human
uuacacaucacaaaacuauga

SEQ ID NO: 193273 - RNA, 23 nt, Human
uuacuaacgaagucuaaucauau

SEQ ID NO: 193274 - RNA, 18 nt, Human
uuagcugggcaugguggc

SEQ ID NO: 193275 - RNA, 18 nt, Human
uuaguuugacuuagauug

SEQ ID NO: 193276 - RNA, 20 nt, Human
uucaaagucugaaaucuuua

SEQ ID NO: 193277 - RNA, 23 nt, Human
uucaagugauucuugugccucag

SEQ ID NO: 193278 - RNA, 18 nt, Human
uucucagcugcaccagca

SEQ ID NO: 193279 - RNA, 24 nt, Human
uugaaccuggaaggcggagguugc

SEQ ID NO: 193280 - RNA, 25 nt, Human
uugagaggcugagucaggagaaucg

SEQ ID NO: 193281 - RNA, 24 nt, Human
uugagugcaguggcacaauccugg

SEQ ID NO: 193282 - RNA, 22 nt, Human
uugcaccacuguacucagccug

SEQ ID NO: 193283 - RNA, 24 nt, Human
uugggaagcugaagugagagaauc

SEQ ID NO: 193284 - RNA, 25 nt, Human
uugggaggccgaggcaggcagauca

SEQ ID NO: 193285 - RNA, 24 nt, Human
uuguagagacaggguuucgccaug

SEQ ID NO: 193286 - RNA, 21 nt, Human
uuuaucuucaacccuugccuu

SEQ ID NO: 193287 - RNA, 24 nt, Human
uuucacucgucacccaggcuugag

SEQ ID NO: 193288 - RNA, 24 nt, Human
uuucgccauguugaccaggcuggu

SEQ ID NO: 193289 - RNA, 24 nt, Human
uuuguagagacaggguuucgccau

SEQ ID NO: 193290 - RNA, 23 nt, Human
uuuuaaauuccccaccagaacuc

SEQ ID NO: 193291 - RNA, 23 nt, Human
uuuuuuguagagacaggguuucg

SEQ ID NO: 193292 - RNA, 24 nt, Human
uuuuuuguagagacaggguuucgc

SEQ ID NO: 193293 - RNA, 24 nt, Human
aaaacacagcucagugacacucuu

SEQ ID NO: 193294 - RNA, 19 nt, Human
aaacacagcucagugacac

SEQ ID NO: 193295 - RNA, 19 nt, Human
aaacaggaacauguacaac

SEQ ID NO: 193296 - RNA, 21 nt, Human
aaacaggaggcugguccaggg

SEQ ID NO: 193297 - RNA, 19 nt, Human
aaacaucaccuacauagac

SEQ ID NO: 193298 - RNA, 22 nt, Human
aaaugacccccuccaugaagau

SEQ ID NO: 193299 - RNA, 27 nt, Human
aacaaaagcaaucuccccacagcccac

SEQ ID NO: 193300 - RNA, 21 nt, Human
aaccucacuccaccccgcaac

SEQ ID NO: 193301 - RNA, 24 nt, Human
acaaaagcaaucuccccacagccc

SEQ ID NO: 193302 - RNA, 21 nt, Human
acaaagagcacuucugccaca

SEQ ID NO: 193303 - RNA, 20 nt, Human
acaaguccacaucucagcug

SEQ ID NO: 193304 - RNA, 19 nt, Human
acagcccacccccaaaacu

SEQ ID NO: 193305 - RNA, 24 nt, Human
acgccaccccagggcuagcaagga

SEQ ID NO: 193306 - RNA, 18 nt, Human
acgggaggaaguuccacc

SEQ ID NO: 193307 - RNA, 20 nt, Human
acggugcaaagcagugagac

SEQ ID NO: 193308 - RNA, 20 nt, Human
agagggacagguggaagcuu

SEQ ID NO: 193309 - RNA, 24 nt, Human
agaguuccaacauuuccuccacuu

SEQ ID NO: 193310 - RNA, 20 nt, Human
agaugugucuauaugcacau

SEQ ID NO: 193311 - RNA, 25 nt, Human
agcagagcucccaaauccagcuccu

SEQ ID NO: 193312 - RNA, 21 nt, Human
agcagcaacaguucugagaac

SEQ ID NO: 193313 - RNA, 22 nt, Human
agcagcucccuccuucccagga

SEQ ID NO: 193314 - RNA, 24 nt, Human
agccacaugacagucgccaaccuu

SEQ ID NO: 193315 - RNA, 20 nt, Human
agcccagcgauaugcauucc

SEQ ID NO: 193316 - RNA, 18 nt, Human
agccccugccucgucuca

SEQ ID NO: 193317 - RNA, 23 nt, Human
aggaagcgggggagggacaaagc

SEQ ID NO: 193318 - RNA, 19 nt, Human
aggcagacgccaccccagg

SEQ ID NO: 193319 - RNA, 21 nt, Human
aggcagcaccugcacagaguu

SEQ ID NO: 193320 - RNA, 18 nt, Human
aggcagguccacguuggc

SEQ ID NO: 193321 - RNA, 18 nt, Human
aggccuggcagaggcugc

SEQ ID NO: 193322 - RNA, 25 nt, Human
aggcgggaggcgggugggggggacc

SEQ ID NO: 193323 - RNA, 26 nt, Human
aggcgggaggcgggugggggggaccc

SEQ ID NO: 193324 - RNA, 19 nt, Human
aggcucagacaaaacacag

SEQ ID NO: 193325 - RNA, 24 nt, Human
agggaaccagcccgccccugcccc

SEQ ID NO: 193326 - RNA, 22 nt, Human
agggaccuguccuggggauagg

SEQ ID NO: 193327 - RNA, 22 nt, Human
aggggcucccuuugagcagggg

SEQ ID NO: 193328 - RNA, 21 nt, Human
aggugacuaucaggagaaagg

SEQ ID NO: 193329 - RNA, 23 nt, Human
aguggaggcugcucacagccagg

SEQ ID NO: 193330 - RNA, 19 nt, Human
aguuccaccugccaggcgg

SEQ ID NO: 193331 - RNA, 18 nt, Human
auccagaauccacuucca

SEQ ID NO: 193332 - RNA, 24 nt, Human
aucucuuuacugauauaauuaaau

SEQ ID NO: 193333 - RNA, 21 nt, Human
augagaaacaggagcccccaa

SEQ ID NO: 193334 - RNA, 24 nt, Human
augucagcgggugcucaggagggc

SEQ ID NO: 193335 - RNA, 18 nt, Human
auucaucuccggagcaca

SEQ ID NO: 193336 - RNA, 19 nt, Human
caaagccugcucacggcac

SEQ ID NO: 193337 - RNA, 22 nt, Human
caacauuuccuccacuuaccac

SEQ ID NO: 193338 - RNA, 22 nt, Human
caagcucagcugacagucccuc

SEQ ID NO: 193339 - RNA, 23 nt, Human
caagggcacagacuuccaaaggc

SEQ ID NO: 193340 - RNA, 20 nt, Human
caaugaaugagcccugcccu

SEQ ID NO: 193341 - RNA, 22 nt, Human
cacacagaacuaaccucacucc

SEQ ID NO: 193342 - RNA, 21 nt, Human
cacaccccaccagggagaccc

SEQ ID NO: 193343 - RNA, 23 nt, Human
cacagccagucggcaagcagagc

SEQ ID NO: 193344 - RNA, 20 nt, Human
cacauggggugcagcacagc

SEQ ID NO: 193345 - RNA, 21 nt, Human
caccccaccagggagacccag

SEQ ID NO: 193346 - RNA, 22 nt, Human
caccggggcaaugaauggggcu

SEQ ID NO: 193347 - RNA, 19 nt, Human
caccgugcaagaugucagc

SEQ ID NO: 193348 - RNA, 18 nt, Human
cagaagcauucaggucug

SEQ ID NO: 193349 - RNA, 21 nt, Human
cagacacacagaacuaaccuc

SEQ ID NO: 193350 - RNA, 22 nt, Human
cagagcucccaaauccagcucc

SEQ ID NO: 193351 - RNA, 25 nt, Human
cagcccacccccaaaacuugacaac

SEQ ID NO: 193352 - RNA, 19 nt, Human
cagcggaagggaggcacau

SEQ ID NO: 193353 - RNA, 20 nt, Human
caggaaaaagcuaggaugag

SEQ ID NO: 193354 - RNA, 28 nt, Human
caggaaaacaaaagcaaucuccccacag

SEQ ID NO: 193355 - RNA, 22 nt, Human
caggagcccccaaccaauacgg

SEQ ID NO: 193356 - RNA, 21 nt, Human
caguccccggaggccucgggc

SEQ ID NO: 193357 - RNA, 19 nt, Human
cauccagaauccacuucca

SEQ ID NO: 193358 - RNA, 23 nt, Human
cauccugagcucuccaagguccc

SEQ ID NO: 193359 - RNA, 23 nt, Human
ccaaauccagcuccuacaucagc

SEQ ID NO: 193360 - RNA, 18 nt, Human
ccaagcuuugcuguugac

SEQ ID NO: 193361 - RNA, 22 nt, Human
ccaccaggacugcagacacucc

SEQ ID NO: 193362 - RNA, 22 nt, Human
ccaccagggagacccaggccag

SEQ ID NO: 193363 - RNA, 20 nt, Human
ccacccccaaaacuugacaa

SEQ ID NO: 193364 - RNA, 19 nt, Human
ccaccugcccacuaacgcc

SEQ ID NO: 193365 - RNA, 18 nt, Human
ccacgccggccagcauga

SEQ ID NO: 193366 - RNA, 27 nt, Human
ccagagcgggguguucuccgggucucc

SEQ ID NO: 193367 - RNA, 20 nt, Human
ccagcaggaaaacaaaagca

SEQ ID NO: 193368 - RNA, 23 nt, Human
ccagcaggaaaacaaaagcaauc

SEQ ID NO: 193369 - RNA, 22 nt, Human
ccaggaagaaccgacacgggca

SEQ ID NO: 193370 - RNA, 28 nt, Human
ccagggcuagcaaggaacaggaguggga

SEQ ID NO: 193371 - RNA, 21 nt, Human
ccaucuucgccagugggaucc

SEQ ID NO: 193372 - RNA, 18 nt, Human
cccacagcccacccccaa

SEQ ID NO: 193373 - RNA, 19 nt, Human
cccacagcccacccccaaa

SEQ ID NO: 193374 - RNA, 21 nt, Human
cccacagcccacccccaaaac

SEQ ID NO: 193375 - RNA, 22 nt, Human
cccaccaggacugcagacacuc

SEQ ID NO: 193376 - RNA, 20 nt, Human
ccccacuugggucagagccc

SEQ ID NO: 193377 - RNA, 21 nt, Human
cccccaaaacuugacaaccaa

SEQ ID NO: 193378 - RNA, 25 nt, Human
ccccuuucuaccgcuccugcugccc

SEQ ID NO: 193379 - RNA, 18 nt, Human
cccgcagcggaagggagg

SEQ ID NO: 193380 - RNA, 19 nt, Human
cccucuggaggacagcucc

SEQ ID NO: 193381 - RNA, 19 nt, Human
cccugcuggcuccagggga

SEQ ID NO: 193382 - RNA, 21 nt, Human
ccgaggaggaggggcugcagu

SEQ ID NO: 193383 - RNA, 21 nt, Human
ccucacuccaccccgcaacgg

SEQ ID NO: 193384 - RNA, 23 nt, Human
ccuccuucccaggagggccaggc

SEQ ID NO: 193385 - RNA, 18 nt, Human
ccugacuccacccaccag

SEQ ID NO: 193386 - RNA, 20 nt, Human
ccugacugguggguggagaa

SEQ ID NO: 193387 - RNA, 21 nt, Human
ccugcccccgcagguucugcc

SEQ ID NO: 193388 - RNA, 18 nt, Human
ccugcccugaccacgucc

SEQ ID NO: 193389 - RNA, 22 nt, Human
ccuggccagcagcugugguccc

SEQ ID NO: 193390 - RNA, 23 nt, Human
ccuggccagcagcuguggucccg

SEQ ID NO: 193391 - RNA, 19 nt, Human
ccuggcucgccucuagggc

SEQ ID NO: 193392 - RNA, 21 nt, Human
ccugugauacugcugucucag

SEQ ID NO: 193393 - RNA, 18 nt, Human
ccuugugaaugcauaaac

SEQ ID NO: 193394 - RNA, 24 nt, Human
ccuuuagggcacagggccuucuca

SEQ ID NO: 193395 - RNA, 19 nt, Human
cgacgggcaugaccaaacc

SEQ ID NO: 193396 - RNA, 23 nt, Human
cgacgggcaugaccaaaccaagc

SEQ ID NO: 193397 - RNA, 23 nt, Human
cgaugagcacagaucugcacucu

SEQ ID NO: 193398 - RNA, 21 nt, Human
cgccccugcccccgcagguuc

SEQ ID NO: 193399 - RNA, 24 nt, Human
cggaccccuuucuaccgcuccugc

SEQ ID NO: 193400 - RNA, 23 nt, Human
cggggccacgccggccagcauga

SEQ ID NO: 193401 - RNA, 18 nt, Human
cgggggcagaagggaugc

SEQ ID NO: 193402 - RNA, 19 nt, Human
cgucucacagccagucggc

SEQ ID NO: 193403 - RNA, 23 nt, Human
cguggccgggggcccuguccacc

SEQ ID NO: 193404 - RNA, 19 nt, Human
cuaaccucacuccaccccg

SEQ ID NO: 193405 - RNA, 19 nt, Human
cucacagguagcaagagag

SEQ ID NO: 193406 - RNA, 24 nt, Human
cucagagcugcugacauaaccugc

SEQ ID NO: 193407 - RNA, 23 nt, Human
cucagcagcucucaagaucuucc

SEQ ID NO: 193408 - RNA, 23 nt, Human
cucaggcucagccccaccaggac

SEQ ID NO: 193409 - RNA, 20 nt, Human
cuccaaggcuggcaguuacc

SEQ ID NO: 193410 - RNA, 22 nt, Human
cuccggagcacacaggcagguc

SEQ ID NO: 193411 - RNA, 26 nt, Human
cuccuacaucagcagcagcccggcca

SEQ ID NO: 193412 - RNA, 18 nt, Human
cucuauguugagcccagc

SEQ ID NO: 193413 - RNA, 23 nt, Human
cugacuccacccaccagacacac

SEQ ID NO: 193414 - RNA, 19 nt, Human
cugacugguggguggagaa

SEQ ID NO: 193415 - RNA, 18 nt, Human
cugagcagcucccuccuu

SEQ ID NO: 193416 - RNA, 23 nt, Human
cuggcccagaugcaagagcagcu

SEQ ID NO: 193417 - RNA, 22 nt, Human
cugucccugacuggugggugga

SEQ ID NO: 193418 - RNA, 18 nt, Human
cuuccaggaagaaccgac

SEQ ID NO: 193419 - RNA, 18 nt, Human
cuuccagguugccuucag

SEQ ID NO: 193420 - RNA, 21 nt, Human
cuucccaggagggccaggccc

SEQ ID NO: 193421 - RNA, 18 nt, Human
cuucuacugcaggacagc

SEQ ID NO: 193422 - RNA, 20 nt, Human
cuuugggggugggggacacc

SEQ ID NO: 193423 - RNA, 18 nt, Human
gaagaugggggcgagggg

SEQ ID NO: 193424 - RNA, 25 nt, Human
gaccacggugcaaagcagugagacc

SEQ ID NO: 193425 - RNA, 18 nt, Human
gaccaucuucgccagugg

SEQ ID NO: 193426 - RNA, 18 nt, Human
gagagaagggagaauggu

SEQ ID NO: 193427 - RNA, 21 nt, Human
gagcucccaaauccagcuccu

SEQ ID NO: 193428 - RNA, 19 nt, Human
gagcucuccaaggucccuc

SEQ ID NO: 193429 - RNA, 18 nt, Human
gaggaugucugcugggaa

SEQ ID NO: 193430 - RNA, 18 nt, Human
gaugcaagagcagcugca

SEQ ID NO: 193431 - RNA, 18 nt, Human
gauguacaauguuugcag

SEQ ID NO: 193432 - RNA, 19 nt, Human
gauguacaauguuugcagc

SEQ ID NO: 193433 - RNA, 19 nt, Human
gcaacaaccagcaggugac

SEQ ID NO: 193434 - RNA, 19 nt, Human
gcaaggaacaggaguggga

SEQ ID NO: 193435 - RNA, 21 nt, Human
gcacaccccaccagggagacc

SEQ ID NO: 193436 - RNA, 23 nt, Human
gcacggcaguccccggaggccuc

SEQ ID NO: 193437 - RNA, 19 nt, Human
gcaggacagcagaggggcc

SEQ ID NO: 193438 - RNA, 19 nt, Human
gccaccugcccacuaacgc

SEQ ID NO: 193439 - RNA, 18 nt, Human
gccaggcggccacacacc

SEQ ID NO: 193440 - RNA, 19 nt, Human
gccagucggcaagcagagc

SEQ ID NO: 193441 - RNA, 22 nt, Human
gcucugaaaugacccccuccau

SEQ ID NO: 193442 - RNA, 24 nt, Human
ggaaaacaaaagcaaucuccccac

SEQ ID NO: 193443 - RNA, 19 nt, Human
ggaaggccucaggcucagc

SEQ ID NO: 193444 - RNA, 20 nt, Human
ggaggaggggcugcaguuga

SEQ ID NO: 193445 - RNA, 19 nt, Human
ggagggcuaugccaguggc

SEQ ID NO: 193446 - RNA, 18 nt, Human
ggcacagggccuucucag

SEQ ID NO: 193447 - RNA, 23 nt, Human
ggccugugauacugcugucucag

SEQ ID NO: 193448 - RNA, 21 nt, Human
ggcgagggguguccuuuaggg

SEQ ID NO: 193449 - RNA, 19 nt, Human
ggcugcugucccugacugg

SEQ ID NO: 193450 - RNA, 22 nt, Human
gggagacccaggccaguguucc

SEQ ID NO: 193451 - RNA, 18 nt, Human
gggcaaugaauggggcuc

SEQ ID NO: 193452 - RNA, 18 nt, Human
gggccaacagccagccug

SEQ ID NO: 193453 - RNA, 22 nt, Human
gggcgagggguguccuuuaggg

SEQ ID NO: 193454 - RNA, 24 nt, Human
ggggcaaugaauggggcucugggc

SEQ ID NO: 193455 - RNA, 21 nt, Human
ggggcagaagggaugcugggc

SEQ ID NO: 193456 - RNA, 20 nt, Human
gguggggcuccgggacucgc

SEQ ID NO: 193457 - RNA, 19 nt, Human
gguggguggagaacgacag

SEQ ID NO: 193458 - RNA, 18 nt, Human
guccucaguccugcugug

SEQ ID NO: 193459 - RNA, 19 nt, Human
uaaccucacuccaccccgc

SEQ ID NO: 193460 - RNA, 24 nt, Human
uacaucagcagcagcccggccauc

SEQ ID NO: 193461 - RNA, 22 nt, Human
uaccagcaggaaaacaaaagca

SEQ ID NO: 193462 - RNA, 25 nt, Human
uacccaaaacaucgacgggcaugac

SEQ ID NO: 193463 - RNA, 19 nt, Human
uacgaugggugcuugccac

SEQ ID NO: 193464 - RNA, 19 nt, Human
uacuuuauguauaugcgug

SEQ ID NO: 193465 - RNA, 24 nt, Human
uaggaugagaaacaggagccccca

SEQ ID NO: 193466 - RNA, 18 nt, Human
uagggaccaagcuggcuc

SEQ ID NO: 193467 - RNA, 19 nt, Human
uagggcugaggaagcagag

SEQ ID NO: 193468 - RNA, 22 nt, Human
uauagaugugucuauaugcaca

SEQ ID NO: 193469 - RNA, 20 nt, Human
uaucaggagaaaggaccugg

SEQ ID NO: 193470 - RNA, 20 nt, Human
uaugccaguggcuacaggag

SEQ ID NO: 193471 - RNA, 18 nt, Human
uauugcugucuacuaucc

SEQ ID NO: 193472 - RNA, 22 nt, Human
ucagacaaaacacagcucagug

SEQ ID NO: 193473 - RNA, 22 nt, Human
uccaaaggcuccggccccagcu

SEQ ID NO: 193474 - RNA, 21 nt, Human
uccaaggucccucagcagcuc

SEQ ID NO: 193475 - RNA, 18 nt, Human
uccaggaagaaccgacac

SEQ ID NO: 193476 - RNA, 21 nt, Human
ucccaaaccuucuagcgggcu

SEQ ID NO: 193477 - RNA, 19 nt, Human
uccccggaggccucgggcc

SEQ ID NO: 193478 - RNA, 22 nt, Human
ucccgagcuccacguggggcuc

SEQ ID NO: 193479 - RNA, 24 nt, Human
ucccuuugagcaggggcucccuuu

SEQ ID NO: 193480 - RNA, 18 nt, Human
ucggaccccuuucuaccg

SEQ ID NO: 193481 - RNA, 27 nt, Human
ucggaccccuuucuaccgcuccugcug

SEQ ID NO: 193482 - RNA, 18 nt, Human
ucgggccgacucgcggcg

SEQ ID NO: 193483 - RNA, 19 nt, Human
ucgggccgacucgcggcgc

SEQ ID NO: 193484 - RNA, 18 nt, Human
ucuaccgcuccugcugcc

SEQ ID NO: 193485 - RNA, 22 nt, Human
ucuagggcugaggaagcagagc

SEQ ID NO: 193486 - RNA, 20 nt, Human
ucucacuccuacacgugacc

SEQ ID NO: 193487 - RNA, 20 nt, Human
ucucgucaguccuucccuuu

SEQ ID NO: 193488 - RNA, 18 nt, Human
ucugagccauccugagcu

SEQ ID NO: 193489 - RNA, 21 nt, Human
ucuggguggggcuccgggacu

SEQ ID NO: 193490 - RNA, 22 nt, Human
ucugugcccgaggaggaggggc

SEQ ID NO: 193491 - RNA, 24 nt, Human
ugaaaugacccccuccaugaagau

SEQ ID NO: 193492 - RNA, 22 nt, Human
ugaagucauuuuuacuaaugag

SEQ ID NO: 193493 - RNA, 24 nt, Human
ugacagggaggcugcugucccugg

SEQ ID NO: 193494 - RNA, 20 nt, Human
ugacugguggguggagaacg

SEQ ID NO: 193495 - RNA, 18 nt, Human
ugagaaacaggagccccc

SEQ ID NO: 193496 - RNA, 18 nt, Human
ugagaagaaaagagagaa

SEQ ID NO: 193497 - RNA, 20 nt, Human
ugagaagaaaagagagaagg

SEQ ID NO: 193498 - RNA, 21 nt, Human
ugagcagcucccuccuuccca

SEQ ID NO: 193499 - RNA, 22 nt, Human
ugagcagcucccuccuucccag

SEQ ID NO: 193500 - RNA, 20 nt, Human
ugagcaggggcucccuuuca

SEQ ID NO: 193501 - RNA, 23 nt, Human
ugcaaagcagugagaccugggca

SEQ ID NO: 193502 - RNA, 21 nt, Human
ugccaagacaccaagcuuugc

SEQ ID NO: 193503 - RNA, 22 nt, Human
ugccacauggcagagacacgca

SEQ ID NO: 193504 - RNA, 19 nt, Human
ugcccgaggaggaggggcu

SEQ ID NO: 193505 - RNA, 23 nt, Human
ugccgggugucuagcacccccag

SEQ ID NO: 193506 - RNA, 19 nt, Human
ugcgccggcggaggcgggg

SEQ ID NO: 193507 - RNA, 22 nt, Human
ugcugggcucugucacuaacag

SEQ ID NO: 193508 - RNA, 19 nt, Human
uggaacgggggcagaaggg

SEQ ID NO: 193509 - RNA, 19 nt, Human
uggcagaaaugagggugga

SEQ ID NO: 193510 - RNA, 18 nt, Human
uggcaugcacaccccacc

SEQ ID NO: 193511 - RNA, 20 nt, Human
uggcccagaugcaagagcag

SEQ ID NO: 193512 - RNA, 23 nt, Human
ugggaaggaugcucacagguagc

SEQ ID NO: 193513 - RNA, 25 nt, Human
ugggagcuggugggaaaagccucau

SEQ ID NO: 193514 - RNA, 20 nt, Human
uggggauaggaguggcggcu

SEQ ID NO: 193515 - RNA, 22 nt, Human
ugggggugggggacaccuacug

SEQ ID NO: 193516 - RNA, 21 nt, Human
uggucacccacauggggugca

SEQ ID NO: 193517 - RNA, 27 nt, Human
ugguuuccauuuuuucccuuuaauuug

SEQ ID NO: 193518 - RNA, 24 nt, Human
uguccgucacgcggcuaacuugac

SEQ ID NO: 193519 - RNA, 18 nt, Human
uguccuuuagggcacagg

SEQ ID NO: 193520 - RNA, 21 nt, Human
ugugauacugcugucucagag

SEQ ID NO: 193521 - RNA, 23 nt, Human
ugugauacugcugucucagagcu

SEQ ID NO: 193522 - RNA, 24 nt, Human
uguggccaccugcccacuaacgcc

SEQ ID NO: 193523 - RNA, 18 nt, Human
ugugggcagcauacaagu

SEQ ID NO: 193524 - RNA, 21 nt, Human
uguugggagcuggugggaaaa

SEQ ID NO: 193525 - RNA, 19 nt, Human
uuaagggccuccucaaaca

SEQ ID NO: 193526 - RNA, 24 nt, Human
uuacaaauguaaacaucuagccaa

SEQ ID NO: 193527 - RNA, 24 nt, Human
uuccauuuuuucccuuuaauuugg

SEQ ID NO: 193528 - RNA, 20 nt, Human
uugccuggcucgccucuagg

SEQ ID NO: 193529 - RNA, 19 nt, Human
uuuaaugacuuggcuccuc

SEQ ID NO: 193530 - RNA, 28 nt, Human
aaaaaugaaaauaguaucucaaaaagga

SEQ ID NO: 193531 - RNA, 22 nt, Human
aaaacagaaccaaucuaaaaau

SEQ ID NO: 193532 - RNA, 20 nt, Human
aagaauggguggcaaggugg

SEQ ID NO: 193533 - RNA, 21 nt, Human
aagcuacuaagcaggcacuug

SEQ ID NO: 193534 - RNA, 23 nt, Human
accuccaccugcagaauuaggag

SEQ ID NO: 193535 - RNA, 20 nt, Human
aggaagccagagcuggagag

SEQ ID NO: 193536 - RNA, 24 nt, Human
aggcacuuggcauuucaggaguuu

SEQ ID NO: 193537 - RNA, 23 nt, Human
auaagggcaccuuuccaaagcua

SEQ ID NO: 193538 - RNA, 22 nt, Human
ccucccgucccuaccgucaguc

SEQ ID NO: 193539 - RNA, 19 nt, Human
ccuugguuucugucccugg

SEQ ID NO: 193540 - RNA, 18 nt, Human
cgggaagaauggguggca

SEQ ID NO: 193541 - RNA, 19 nt, Human
cuacuaagcaggcacuugg

SEQ ID NO: 193542 - RNA, 24 nt, Human
cucaaaaaggaaacuagacuagca

SEQ ID NO: 193543 - RNA, 20 nt, Human
cuggaagagcucacccagca

SEQ ID NO: 193544 - RNA, 23 nt, Human
cuuuccaaagcuacuaagcaggc

SEQ ID NO: 193545 - RNA, 22 nt, Human
gaaaauaguaucucaaaaagga

SEQ ID NO: 193546 - RNA, 22 nt, Human
gaaccaaucuaaaaauggcuga

SEQ ID NO: 193547 - RNA, 19 nt, Human
gaacgggaagaaugggugg

SEQ ID NO: 193548 - RNA, 19 nt, Human
gagaagacagacagagggc

SEQ ID NO: 193549 - RNA, 22 nt, Human
gagaagacagacagagggcagg

SEQ ID NO: 193550 - RNA, 22 nt, Human
gagcucacccagcacagcugcc

SEQ ID NO: 193551 - RNA, 18 nt, Human
gccuugguuucugucccu

SEQ ID NO: 193552 - RNA, 19 nt, Human
gccuugguuucugucccug

SEQ ID NO: 193553 - RNA, 20 nt, Human
ggagccugaaaaaaacagga

SEQ ID NO: 193554 - RNA, 23 nt, Human
gugagggacucagcaggaagcca

SEQ ID NO: 193555 - RNA, 20 nt, Human
uacacagagaaauagaaaau

SEQ ID NO: 193556 - RNA, 19 nt, Human
uacgaaaacagaaccaauc

SEQ ID NO: 193557 - RNA, 19 nt, Human
uagaaaauauaaaaucuga

SEQ ID NO: 193558 - RNA, 22 nt, Human
uagaauguucaauaagggcacc

SEQ ID NO: 193559 - RNA, 22 nt, Human
uagcaaccuccaccugcagaau

SEQ ID NO: 193560 - RNA, 22 nt, Human
ucagucgguccguccgcccucc

SEQ ID NO: 193561 - RNA, 22 nt, Human
uccuugaagacccagccacccc

SEQ ID NO: 193562 - RNA, 20 nt, Human
ucugagggguuggggaagaa

SEQ ID NO: 193563 - RNA, 24 nt, Human
ucuuaugguugcauaaaaguaucc

SEQ ID NO: 193564 - RNA, 22 nt, Human
ugagggguuggggaagaaacgu

SEQ ID NO: 193565 - RNA, 23 nt, Human
ugagggguuggggaagaaacgug

SEQ ID NO: 193566 - RNA, 23 nt, Human
ugcagaauuaggagaagacagac

SEQ ID NO: 193567 - RNA, 19 nt, Human
uggcucacuugaggccagu

SEQ ID NO: 193568 - RNA, 22 nt, Human
ugucuuaugguugcauaaaagu

SEQ ID NO: 193569 - RNA, 22 nt, Human
uucaaaguuaagaacgggaaga

SEQ ID NO: 193570 - RNA, 19 nt, Human
uuucaggaguuugucuuau

SEQ ID NO: 193571 - RNA, 23 nt, Human
aaaauaaauacaguccaugccaa

SEQ ID NO: 193572 - RNA, 21 nt, Human
aagaaaaacaaaaacgaaaaa

SEQ ID NO: 193573 - RNA, 23 nt, Human
aauuacuucuuuaauagaucagu

SEQ ID NO: 193574 - RNA, 23 nt, Human
acauuuuccuuucaauauuuucu

SEQ ID NO: 193575 - RNA, 21 nt, Human
agaaaaacaaaaacgaaaaag

SEQ ID NO: 193576 - RNA, 22 nt, Human
aggccggugggaggagaggagg

SEQ ID NO: 193577 - RNA, 24 nt, Human
aucaguuuuuuugacauaauaacu

SEQ ID NO: 193578 - RNA, 23 nt, Human
caaaaacgaaaaagccauuugaa

SEQ ID NO: 193579 - RNA, 22 nt, Human
caaaguaguauaaaaugaagcc

SEQ ID NO: 193580 - RNA, 27 nt, Human
caaaguaguauaaaaugaagccagaag

SEQ ID NO: 193581 - RNA, 24 nt, Human
cacaauaaaacuugccaagaaaaa

SEQ ID NO: 193582 - RNA, 21 nt, Human
caccgggcuccuccuccugcu

SEQ ID NO: 193583 - RNA, 23 nt, Human
cagcucagaaaggccaauuacuu

SEQ ID NO: 193584 - RNA, 18 nt, Human
ccgggcuccuccuccugc

SEQ ID NO: 193585 - RNA, 19 nt, Human
ccggugggaggagaggagg

SEQ ID NO: 193586 - RNA, 20 nt, Human
ccuccuccugcugcugcugc

SEQ ID NO: 193587 - RNA, 22 nt, Human
ccuccuccugcugcugcugcua

SEQ ID NO: 193588 - RNA, 23 nt, Human
ccuccugcugcugcugcugcugc

SEQ ID NO: 193589 - RNA, 21 nt, Human
cgaaaaagccauuugaaaaua

SEQ ID NO: 193590 - RNA, 21 nt, Human
cucacaauaaaacuugccaag

SEQ ID NO: 193591 - RNA, 23 nt, Human
gagaaaagggcugagggaaacgu

SEQ ID NO: 193592 - RNA, 21 nt, Human
gaucaguuuuuuugacauaau

SEQ ID NO: 193593 - RNA, 20 nt, Human
gcugcugccgccgcggcucg

SEQ ID NO: 193594 - RNA, 19 nt, Human
gcugcugcugcugccgccg

SEQ ID NO: 193595 - RNA, 22 nt, Human
ggagagaaaagggcugagggaa

SEQ ID NO: 193596 - RNA, 23 nt, Human
ggaggagaggagggggcgccggg

SEQ ID NO: 193597 - RNA, 18 nt, Human
guggagaaaagaaauuuu

SEQ ID NO: 193598 - RNA, 19 nt, Human
uaaaaugaagccagaaguc

SEQ ID NO: 193599 - RNA, 23 nt, Human
uaaaaugaagccagaagucuuca

SEQ ID NO: 193600 - RNA, 22 nt, Human
uauaaaaugaagccagaagucu

SEQ ID NO: 193601 - RNA, 26 nt, Human
uauaaaaugaagccagaagucuucaa

SEQ ID NO: 193602 - RNA, 22 nt, Human
uccaugccaaaguaguauaaaa

SEQ ID NO: 193603 - RNA, 21 nt, Human
uccuccugcugcugcugcugc

SEQ ID NO: 193604 - RNA, 22 nt, Human
uccugcugcugcugcugcugcc

SEQ ID NO: 193605 - RNA, 19 nt, Human
ugagggaaacgugggggcg

SEQ ID NO: 193606 - RNA, 21 nt, Human
ugcugcugcugcugcugcugc

SEQ ID NO: 193607 - RNA, 21 nt, Human
ugcugcugcugcugcugcugc

SEQ ID NO: 193608 - RNA, 18 nt, Human
ugggaggagaggaggggg

SEQ ID NO: 193609 - RNA, 20 nt, Human
ugggaggagaggagggggcg

SEQ ID NO: 193610 - RNA, 22 nt, Human
aaaaauaauuaaaaaccuuuga

SEQ ID NO: 193611 - RNA, 23 nt, Human
aaaacaaaacaaaacaaaauucc

SEQ ID NO: 193612 - RNA, 19 nt, Human
aaaauuccuccaaaucaac

SEQ ID NO: 193613 - RNA, 24 nt, Human
aaaauuccuccaaaucaacucccc

SEQ ID NO: 193614 - RNA, 18 nt, Human
aaacaaaacaaaacaaaa

SEQ ID NO: 193615 - RNA, 22 nt, Human
aaacaaaacaaaacaaaacaaa

SEQ ID NO: 193616 - RNA, 26 nt, Human
aaacaaaacaaaacaaaauuccucca

SEQ ID NO: 193617 - RNA, 18 nt, Human
aaacaagucccaagaccg

SEQ ID NO: 193618 - RNA, 21 nt, Human
aaaccacagugcucgcacagu

SEQ ID NO: 193619 - RNA, 21 nt, Human
aaacgauagcuccaacgagcu

SEQ ID NO: 193620 - RNA, 18 nt, Human
aaagggauauaaagugcu

SEQ ID NO: 193621 - RNA, 20 nt, Human
aaagguaaaaaaaaauguac

SEQ ID NO: 193622 - RNA, 23 nt, Human
aacccagccacaaaaauccacca

SEQ ID NO: 193623 - RNA, 19 nt, Human
aaccuccagguguaggaaa

SEQ ID NO: 193624 - RNA, 18 nt, Human
aacuucugcccccaaguc

SEQ ID NO: 193625 - RNA, 23 nt, Human
aagauuuagacauuauuaccauu

SEQ ID NO: 193626 - RNA, 24 nt, Human
aaggaaacaaacaaaacaaaacaa

SEQ ID NO: 193627 - RNA, 22 nt, Human
aaggagauaaaaggaaacaaac

SEQ ID NO: 193628 - RNA, 22 nt, Human
aaggaggccagaagagccugcc

SEQ ID NO: 193629 - RNA, 21 nt, Human
aaggggccgggcggcccuggg

SEQ ID NO: 193630 - RNA, 23 nt, Human
aaggucccucugucccccacccg

SEQ ID NO: 193631 - RNA, 21 nt, Human
aagucaacacagcugugcgga

SEQ ID NO: 193632 - RNA, 24 nt, Human
aagugcucgcuugcugacucccag

SEQ ID NO: 193633 - RNA, 19 nt, Human
aauaaaccgucacaaggcc

SEQ ID NO: 193634 - RNA, 20 nt, Human
acacaguaaugcucucagca

SEQ ID NO: 193635 - RNA, 21 nt, Human
acccaaguggguaaagagccc

SEQ ID NO: 193636 - RNA, 20 nt, Human
acggaggggaaaaacacacc

SEQ ID NO: 193637 - RNA, 24 nt, Human
acggugagggcugggucacagacg

SEQ ID NO: 193638 - RNA, 23 nt, Human
agaaaaacugaaacaccuugaca

SEQ ID NO: 193639 - RNA, 24 nt, Human
agaaaaaggcuaaagguccaagga

SEQ ID NO: 193640 - RNA, 23 nt, Human
agaaaacccagccacaaaaaucc

SEQ ID NO: 193641 - RNA, 19 nt, Human
agaaacucaagccagcucc

SEQ ID NO: 193642 - RNA, 21 nt, Human
agacagacagacaagagaaca

SEQ ID NO: 193643 - RNA, 22 nt, Human
agacagagacagacagacaaga

SEQ ID NO: 193644 - RNA, 22 nt, Human
agcaguccauguuaucccauca

SEQ ID NO: 193645 - RNA, 22 nt, Human
agccacaaaaauccaccagagc

SEQ ID NO: 193646 - RNA, 23 nt, Human
agccacaaaaauccaccagagca

SEQ ID NO: 193647 - RNA, 19 nt, Human
aggaagaaaaaggcuaaag

SEQ ID NO: 193648 - RNA, 24 nt, Human
aggcauuuuucuucuuccccaaag

SEQ ID NO: 193649 - RNA, 19 nt, Human
aggucccucugucccccac

SEQ ID NO: 193650 - RNA, 20 nt, Human
agugcccccaaggccuuugc

SEQ ID NO: 193651 - RNA, 24 nt, Human
auaaaaggaaacaaacaaaacaaa

SEQ ID NO: 193652 - RNA, 19 nt, Human
auauauuuauaucuauaua

SEQ ID NO: 193653 - RNA, 22 nt, Human
aucguaacacugcaagugugcc

SEQ ID NO: 193654 - RNA, 22 nt, Human
caaaacaaaacaaaauuccucc

SEQ ID NO: 193655 - RNA, 23 nt, Human
caaaacaaaacaaaauuccucca

SEQ ID NO: 193656 - RNA, 25 nt, Human
caaaacaaaacaaaauuccuccaaa

SEQ ID NO: 193657 - RNA, 22 nt, Human
caaaauuccuccaaaucaacuc

SEQ ID NO: 193658 - RNA, 23 nt, Human
caaacaaaacaaaacaaaacaaa

SEQ ID NO: 193659 - RNA, 20 nt, Human
caaaugucaugagaggggaa

SEQ ID NO: 193660 - RNA, 24 nt, Human
caagacagagacagacagacaaga

SEQ ID NO: 193661 - RNA, 19 nt, Human
caaucagaauaaaccguca

SEQ ID NO: 193662 - RNA, 31 nt, Human
caccagagcaauaaaaaaaaaggcacaaacc

SEQ ID NO: 193663 - RNA, 21 nt, Human
caccgcuaugguucacagagg

SEQ ID NO: 193664 - RNA, 20 nt, Human
caccuaaaaguaauuaaaaa

SEQ ID NO: 193665 - RNA, 25 nt, Human
cagaaccagagcccugggacgcugg

SEQ ID NO: 193666 - RNA, 19 nt, Human
cagagcccugggacgcugg

SEQ ID NO: 193667 - RNA, 19 nt, Human
cagcacugccaggcucggc

SEQ ID NO: 193668 - RNA, 18 nt, Human
cagcagcccagugaccaa

SEQ ID NO: 193669 - RNA, 22 nt, Human
cagccccuggccccggagauga

SEQ ID NO: 193670 - RNA, 20 nt, Human
cagccgggacgcggccacgg

SEQ ID NO: 193671 - RNA, 21 nt, Human
cagcgcuggcccccgccuccc

SEQ ID NO: 193672 - RNA, 21 nt, Human
cagcucggccgccuguugcca

SEQ ID NO: 193673 - RNA, 18 nt, Human
ccaaacucccaccaacac

SEQ ID NO: 193674 - RNA, 18 nt, Human
ccacaaaaauccaccaga

SEQ ID NO: 193675 - RNA, 18 nt, Human
ccacagugcucgcacagu

SEQ ID NO: 193676 - RNA, 18 nt, Human
ccacaugcuucacgaccg

SEQ ID NO: 193677 - RNA, 19 nt, Human
ccaggcucggcuggccaca

SEQ ID NO: 193678 - RNA, 20 nt, Human
cccaagaccguucugccugc

SEQ ID NO: 193679 - RNA, 23 nt, Human
cccaaggccuuugcaaaggaaga

SEQ ID NO: 193680 - RNA, 20 nt, Human
cccacccgggugcagacccc

SEQ ID NO: 193681 - RNA, 19 nt, Human
cccacggccgcgcgcgggg

SEQ ID NO: 193682 - RNA, 19 nt, Human
cccagccagugcccccaag

SEQ ID NO: 193683 - RNA, 22 nt, Human
cccccaagucugaacccaauau

SEQ ID NO: 193684 - RNA, 19 nt, Human
cccccagcucacauuccug

SEQ ID NO: 193685 - RNA, 20 nt, Human
cccccagcucacauuccugu

SEQ ID NO: 193686 - RNA, 18 nt, Human
ccccccgccgcacaccgc

SEQ ID NO: 193687 - RNA, 19 nt, Human
cccccgccucccacggccg

SEQ ID NO: 193688 - RNA, 21 nt, Human
cccccgccucccacggccgcg

SEQ ID NO: 193689 - RNA, 18 nt, Human
ccccgcgcccccgccccg

SEQ ID NO: 193690 - RNA, 23 nt, Human
cccgccgcacaccgcuaugguuc

SEQ ID NO: 193691 - RNA, 25 nt, Human
cccgccgcacaccgcuaugguucac

SEQ ID NO: 193692 - RNA, 26 nt, Human
cccgccgcacaccgcuaugguucaca

SEQ ID NO: 193693 - RNA, 18 nt, Human
cccgcgcccccgccccgg

SEQ ID NO: 193694 - RNA, 22 nt, Human
cccguggcuguugcacgcuggg

SEQ ID NO: 193695 - RNA, 18 nt, Human
cccuccagaaccagagcc

SEQ ID NO: 193696 - RNA, 24 nt, Human
cccuccucuccuucaagguuuugu

SEQ ID NO: 193697 - RNA, 18 nt, Human
cccugggacgcuggggag

SEQ ID NO: 193698 - RNA, 23 nt, Human
cccugggugcuccaagagagccc

SEQ ID NO: 193699 - RNA, 19 nt, Human
ccgaaaagaccuacggucc

SEQ ID NO: 193700 - RNA, 22 nt, Human
ccgcaucuccucagccugcgcc

SEQ ID NO: 193701 - RNA, 23 nt, Human
ccgccgggcugcagccccuggcc

SEQ ID NO: 193702 - RNA, 22 nt, Human
ccgcgccgcaucuccucagccu

SEQ ID NO: 193703 - RNA, 22 nt, Human
ccggcgcgcgggcucgggcucg

SEQ ID NO: 193704 - RNA, 20 nt, Human
ccgggacagccgccugcugg

SEQ ID NO: 193705 - RNA, 25 nt, Human
ccgggacggugagggcugggucaca

SEQ ID NO: 193706 - RNA, 21 nt, Human
ccgggggcccaggcugggagg

SEQ ID NO: 193707 - RNA, 18 nt, Human
ccuccgggacagccgccu

SEQ ID NO: 193708 - RNA, 20 nt, Human
ccugacgauguggucagaga

SEQ ID NO: 193709 - RNA, 18 nt, Human
cgagggcagggcagacgc

SEQ ID NO: 193710 - RNA, 24 nt, Human
cgccgcaucuccucagccugcgcc

SEQ ID NO: 193711 - RNA, 18 nt, Human
cgccgggccggggcugcg

SEQ ID NO: 193712 - RNA, 20 nt, Human
cgcgcggggcggguguggac

SEQ ID NO: 193713 - RNA, 22 nt, Human
cggcaaggucucaugagccagg

SEQ ID NO: 193714 - RNA, 23 nt, Human
cggccgccuguugccacaggcuc

SEQ ID NO: 193715 - RNA, 23 nt, Human
cggccgcgcgcggggcgggugug

SEQ ID NO: 193716 - RNA, 22 nt, Human
cggcggcggccggcucuagccc

SEQ ID NO: 193717 - RNA, 22 nt, Human
cgggcucgggcucgggcggcgg

SEQ ID NO: 193718 - RNA, 23 nt, Human
cggggcgcggggcgggcggcgga

SEQ ID NO: 193719 - RNA, 20 nt, Human
cguacaaaaauaaaaacaaa

SEQ ID NO: 193720 - RNA, 19 nt, Human
cgugccucccccugccagg

SEQ ID NO: 193721 - RNA, 18 nt, Human
cucaaaauuuccacggaa

SEQ ID NO: 193722 - RNA, 24 nt, Human
cucaagccagcucccccagcucac

SEQ ID NO: 193723 - RNA, 21 nt, Human
cucccccagcucacauuccuu

SEQ ID NO: 193724 - RNA, 19 nt, Human
cuccgcgccgcaucuccuc

SEQ ID NO: 193725 - RNA, 22 nt, Human
cuccgggacagccgccugcugg

SEQ ID NO: 193726 - RNA, 22 nt, Human
cuccgggacagccgccugcugg

SEQ ID NO: 193727 - RNA, 21 nt, Human
cuccuuucuuccacggcgucc

SEQ ID NO: 193728 - RNA, 19 nt, Human
cucgagagagacaggcagu

SEQ ID NO: 193729 - RNA, 20 nt, Human
cucguaauacuacuaguguu

SEQ ID NO: 193730 - RNA, 20 nt, Human
cuggacgcuugcuguggaga

SEQ ID NO: 193731 - RNA, 20 nt, Human
cugugccaugaauggggaau

SEQ ID NO: 193732 - RNA, 25 nt, Human
cuugcgggacccgccagagugugcu

SEQ ID NO: 193733 - RNA, 24 nt, Human
cuuuaaaaaaaaaauaagcuacaa

SEQ ID NO: 193734 - RNA, 22 nt, Human
cuuuccauaagcaccuugagag

SEQ ID NO: 193735 - RNA, 22 nt, Human
gaaacaaacaaaacaaaacaaa

SEQ ID NO: 193736 - RNA, 23 nt, Human
gacaaaguggcccuccagaacca

SEQ ID NO: 193737 - RNA, 20 nt, Human
gacaauggcccgcgggcgcc

SEQ ID NO: 193738 - RNA, 18 nt, Human
gaccuacggucccuccuc

SEQ ID NO: 193739 - RNA, 25 nt, Human
gacggugcuccgcggcggggcagcc

SEQ ID NO: 193740 - RNA, 20 nt, Human
gacugcuuaaagugaaaucu

SEQ ID NO: 193741 - RNA, 20 nt, Human
gacuucagaaaacccagcca

SEQ ID NO: 193742 - RNA, 20 nt, Human
gagccugcuagcugggcccu

SEQ ID NO: 193743 - RNA, 19 nt, Human
gcaaacuuccccgcccucc

SEQ ID NO: 193744 - RNA, 22 nt, Human
gcaauaaaaaaaaaggcacaaa

SEQ ID NO: 193745 - RNA, 24 nt, Human
gccagcucccccagcucacauucc

SEQ ID NO: 193746 - RNA, 19 nt, Human
gccgccgggggcccaggcu

SEQ ID NO: 193747 - RNA, 22 nt, Human
gccgcugccugccgugcccacc

SEQ ID NO: 193748 - RNA, 20 nt, Human
gccugggcggcagaaaggcu

SEQ ID NO: 193749 - RNA, 19 nt, Human
gcgccgggccggggcugcg

SEQ ID NO: 193750 - RNA, 19 nt, Human
gcgcgggcgggugcgcggg

SEQ ID NO: 193751 - RNA, 18 nt, Human
gcgcgucgccggcgucug

SEQ ID NO: 193752 - RNA, 21 nt, Human
gcggcgcggguggaaaggucc

SEQ ID NO: 193753 - RNA, 23 nt, Human
gcggcggacaauggcccgcgggc

SEQ ID NO: 193754 - RNA, 18 nt, Human
gcggcggccccacaaccu

SEQ ID NO: 193755 - RNA, 20 nt, Human
gcggcggcggcggcgcgggc

SEQ ID NO: 193756 - RNA, 19 nt, Human
gcggcggcggggacggugc

SEQ ID NO: 193757 - RNA, 21 nt, Human
gcuaugcagagaaugaggcca

SEQ ID NO: 193758 - RNA, 27 nt, Human
gcuggcccccgccucccacggccgcgc

SEQ ID NO: 193759 - RNA, 23 nt, Human
gcugggcccugccacugcucugu

SEQ ID NO: 193760 - RNA, 21 nt, Human
ggaaaaacacaccaccccucg

SEQ ID NO: 193761 - RNA, 18 nt, Human
ggaacagaaaggcauuuu

SEQ ID NO: 193762 - RNA, 18 nt, Human
ggagaagagccgagugug

SEQ ID NO: 193763 - RNA, 19 nt, Human
ggagcuugagaaaacauga

SEQ ID NO: 193764 - RNA, 30 nt, Human
ggaggcuguucgggcggcggcggcggcggg

SEQ ID NO: 193765 - RNA, 18 nt, Human
ggaguuguggguaauaaa

SEQ ID NO: 193766 - RNA, 19 nt, Human
ggcgggcggcggcggccgg

SEQ ID NO: 193767 - RNA, 21 nt, Human
ggcugcaguggaaaaacccaa

SEQ ID NO: 193768 - RNA, 18 nt, Human
ggcugcgcggggcgcggg

SEQ ID NO: 193769 - RNA, 21 nt, Human
gggcggcgcucgccuggcccg

SEQ ID NO: 193770 - RNA, 20 nt, Human
gggcggcggcggggacggug

SEQ ID NO: 193771 - RNA, 23 nt, Human
gggcggcggcggggacggugcuc

SEQ ID NO: 193772 - RNA, 18 nt, Human
gggcuggccacguggcug

SEQ ID NO: 193773 - RNA, 21 nt, Human
gggggcccaggcugggaggcu

SEQ ID NO: 193774 - RNA, 23 nt, Human
gggggcccaggcugggaggcugu

SEQ ID NO: 193775 - RNA, 18 nt, Human
gggugcagaccccccgcc

SEQ ID NO: 193776 - RNA, 19 nt, Human
ggucaggcaaucauacccu

SEQ ID NO: 193777 - RNA, 24 nt, Human
guaaacuuuaccaaacuccgaaac

SEQ ID NO: 193778 - RNA, 20 nt, Human
gugcuccaagagagccccac

SEQ ID NO: 193779 - RNA, 20 nt, Human
guggcugcaguggaaaaacc

SEQ ID NO: 193780 - RNA, 22 nt, Human
uaaaaaguacaauuucuuaaga

SEQ ID NO: 193781 - RNA, 28 nt, Human
uaaaaggaaacaaacaaaacaaaacaaa

SEQ ID NO: 193782 - RNA, 21 nt, Human
uaaaaugaaaguacaaacuug

SEQ ID NO: 193783 - RNA, 25 nt, Human
uaaaaugaaaguacaaacuuguagg

SEQ ID NO: 193784 - RNA, 20 nt, Human
uaaacagcaauaaagcaaaa

SEQ ID NO: 193785 - RNA, 19 nt, Human
uaaagaaaaacugaaacac

SEQ ID NO: 193786 - RNA, 22 nt, Human
uaaagagccccacgugugcccc

SEQ ID NO: 193787 - RNA, 19 nt, Human
uaaccuggccacugagcag

SEQ ID NO: 193788 - RNA, 24 nt, Human
uaaguucaauaagacgcaaacuuc

SEQ ID NO: 193789 - RNA, 21 nt, Human
uaccaaacuccgaaacucggc

SEQ ID NO: 193790 - RNA, 23 nt, Human
uauccugacgauguggucagaga

SEQ ID NO: 193791 - RNA, 21 nt, Human
ucaaugcccauaaaacacggu

SEQ ID NO: 193792 - RNA, 18 nt, Human
ucagaaaacccagccaca

SEQ ID NO: 193793 - RNA, 25 nt, Human
ucagcacauuugugaagcuggagug

SEQ ID NO: 193794 - RNA, 19 nt, Human
uccaagaaucugcacucau

SEQ ID NO: 193795 - RNA, 22 nt, Human
uccagguguaggaaacuuaaaa

SEQ ID NO: 193796 - RNA, 23 nt, Human
uccauaagcaccuugagagcaaa

SEQ ID NO: 193797 - RNA, 21 nt, Human
ucccacggccgcgcgcggggc

SEQ ID NO: 193798 - RNA, 19 nt, Human
ucccccagcucacauuccu

SEQ ID NO: 193799 - RNA, 20 nt, Human
ucccccagcucacauuccug

SEQ ID NO: 193800 - RNA, 20 nt, Human
ucccuggguuccuugcagcc

SEQ ID NO: 193801 - RNA, 21 nt, Human
uccucagacuucagaaaaccc

SEQ ID NO: 193802 - RNA, 19 nt, Human
ucgagaccugugggccugg

SEQ ID NO: 193803 - RNA, 19 nt, Human
ucgggcggcggcggcggcg

SEQ ID NO: 193804 - RNA, 24 nt, Human
ucuacaaaaagaagaauggaauga

SEQ ID NO: 193805 - RNA, 21 nt, Human
ucucagagcugaccaucagca

SEQ ID NO: 193806 - RNA, 24 nt, Human
ucuccucagccugcgccgccaccc

SEQ ID NO: 193807 - RNA, 18 nt, Human
ucugcuuaaaaaaaaaaa

SEQ ID NO: 193808 - RNA, 19 nt, Human
ucuguccaguuuuguuuuc

SEQ ID NO: 193809 - RNA, 18 nt, Human
ucugucccguguucccug

SEQ ID NO: 193810 - RNA, 24 nt, Human
ugaaagguaaaaaaaaauguacaa

SEQ ID NO: 193811 - RNA, 28 nt, Human
ugaacagaggcguccgcuggcuucugca

SEQ ID NO: 193812 - RNA, 20 nt, Human
ugaauggggaauggaccagc

SEQ ID NO: 193813 - RNA, 22 nt, Human
ugacagaugaaacgugccuccc

SEQ ID NO: 193814 - RNA, 24 nt, Human
ugacaugcucaaaaggucuuugga

SEQ ID NO: 193815 - RNA, 20 nt, Human
ugacucccagccagugcccc

SEQ ID NO: 193816 - RNA, 21 nt, Human
ugagcacguggcugugaccag

SEQ ID NO: 193817 - RNA, 22 nt, Human
ugagccagguaacccacaaguu

SEQ ID NO: 193818 - RNA, 21 nt, Human
ugcagagaaugaggccaagga

SEQ ID NO: 193819 - RNA, 26 nt, Human
ugcauucauuuuauauauauauauau

SEQ ID NO: 193820 - RNA, 23 nt, Human
ugccacggaggggaaaaacacac

SEQ ID NO: 193821 - RNA, 22 nt, Human
ugcgggacccgccagagugugc

SEQ ID NO: 193822 - RNA, 22 nt, Human
ugcucgcuugcugacucccagc

SEQ ID NO: 193823 - RNA, 23 nt, Human
ugcucucagcacauuugugaagc

SEQ ID NO: 193824 - RNA, 22 nt, Human
ugcugacaugcucaaaaggucu

SEQ ID NO: 193825 - RNA, 18 nt, Human
uggccgggcauccuaagc

SEQ ID NO: 193826 - RNA, 18 nt, Human
ugggaggcuguucgggcg

SEQ ID NO: 193827 - RNA, 21 nt, Human
ugggcccugccacugcucugu

SEQ ID NO: 193828 - RNA, 23 nt, Human
ugggcccugccacugcucugugc

SEQ ID NO: 193829 - RNA, 21 nt, Human
uggguaauaaacuuuaagcac

SEQ ID NO: 193830 - RNA, 22 nt, Human
ugguggggcgugggcacguggg

SEQ ID NO: 193831 - RNA, 19 nt, Human
uuaaaaaaaaaaagugaga

SEQ ID NO: 193832 - RNA, 18 nt, Human
uucacagaggcgggccac

SEQ ID NO: 193833 - RNA, 23 nt, Human
uucacgaccagauggagaugcuc

SEQ ID NO: 193834 - RNA, 22 nt, Human
uucauuuuauauauauauauau

SEQ ID NO: 193835 - RNA, 18 nt, Human
uugcacgcuggguguccc

SEQ ID NO: 193836 - RNA, 24 nt, Human
uuggugucacuccgaaaagaccua

SEQ ID NO: 193837 - RNA, 18 nt, Human
uuuacagaaaaauuucca

SEQ ID NO: 193838 - RNA, 19 nt, Human
uuuacagaaaaauuuccaa

SEQ ID NO: 193839 - RNA, 24 nt, Human
uuucuuggcugagcuucaagacag

SEQ ID NO: 193840 - RNA, 24 nt, Human
uuuuaaucaaguuuguuuuguauu

SEQ ID NO: 193841 - RNA, 23 nt, Human
aaaacaaaaggccccaggaggga

SEQ ID NO: 193842 - RNA, 22 nt, Human
aaaaggacagacagaaugcagg

SEQ ID NO: 193843 - RNA, 25 nt, Human
aaacaaacacacaagcacacuauga

SEQ ID NO: 193844 - RNA, 26 nt, Human
aaacaaacacacaagcacacuaugaa

SEQ ID NO: 193845 - RNA, 22 nt, Human
aaaccaguccucuccuucccca

SEQ ID NO: 193846 - RNA, 23 nt, Human
aaauccauauccagggagacaaa

SEQ ID NO: 193847 - RNA, 18 nt, Human
aacaaacacacaagcaca

SEQ ID NO: 193848 - RNA, 18 nt, Human
aaccaaggcaccgacuuc

SEQ ID NO: 193849 - RNA, 21 nt, Human
aagacaccaccacccccugca

SEQ ID NO: 193850 - RNA, 22 nt, Human
aagagucagcccccuaggagcc

SEQ ID NO: 193851 - RNA, 21 nt, Human
aagcuggcguugggggcuggg

SEQ ID NO: 193852 - RNA, 23 nt, Human
aaggagagaaaguauauguggua

SEQ ID NO: 193853 - RNA, 24 nt, Human
aaucagcugaaaccaaggcaccga

SEQ ID NO: 193854 - RNA, 22 nt, Human
acacacuuucacccucucagcc

SEQ ID NO: 193855 - RNA, 21 nt, Human
accagccacagggagagagug

SEQ ID NO: 193856 - RNA, 25 nt, Human
accauccccaggauccaaaacaaaa

SEQ ID NO: 193857 - RNA, 22 nt, Human
agacggacgggacgggagcccg

SEQ ID NO: 193858 - RNA, 27 nt, Human
agacugcaggccacagcuugggcacca

SEQ ID NO: 193859 - RNA, 21 nt, Human
agagagacagacgauaacaga

SEQ ID NO: 193860 - RNA, 18 nt, Human
agaggaaggaggaggaga

SEQ ID NO: 193861 - RNA, 20 nt, Human
agaggaaggaggaggagagg

SEQ ID NO: 193862 - RNA, 23 nt, Human
agaggaaggaggaggagaggggu

SEQ ID NO: 193863 - RNA, 18 nt, Human
agcaggaggggcaaggcu

SEQ ID NO: 193864 - RNA, 19 nt, Human
agccgacuccuggaucccu

SEQ ID NO: 193865 - RNA, 18 nt, Human
aggaagcuggcguugggg

SEQ ID NO: 193866 - RNA, 19 nt, Human
aggaaggaggaggagaggg

SEQ ID NO: 193867 - RNA, 18 nt, Human
aggaggaaaaggacagac

SEQ ID NO: 193868 - RNA, 22 nt, Human
aggaggaaaaggacagacagaa

SEQ ID NO: 193869 - RNA, 19 nt, Human
aggaggagaggggucugca

SEQ ID NO: 193870 - RNA, 21 nt, Human
aggcagucaggcacucagaac

SEQ ID NO: 193871 - RNA, 19 nt, Human
aggcugugaggagugugag

SEQ ID NO: 193872 - RNA, 19 nt, Human
agggaugggggccggggcg

SEQ ID NO: 193873 - RNA, 19 nt, Human
aggggccgggagccugggg

SEQ ID NO: 193874 - RNA, 18 nt, Human
agguauggaagcuccagc

SEQ ID NO: 193875 - RNA, 21 nt, Human
agguggaagccacagggcugg

SEQ ID NO: 193876 - RNA, 20 nt, Human
agguggggagcagaccuggu

SEQ ID NO: 193877 - RNA, 19 nt, Human
agugcugagaccaagagga

SEQ ID NO: 193878 - RNA, 21 nt, Human
auccaaaacaaaaggccccag

SEQ ID NO: 193879 - RNA, 20 nt, Human
auccugcucaggcccccaua

SEQ ID NO: 193880 - RNA, 22 nt, Human
auguaaacagauugguggggcc

SEQ ID NO: 193881 - RNA, 26 nt, Human
caaaucagcugaaaccaaggcaccga

SEQ ID NO: 193882 - RNA, 21 nt, Human
caccaccacccccugcagagg

SEQ ID NO: 193883 - RNA, 21 nt, Human
caccauccccaggauccaaaa

SEQ ID NO: 193884 - RNA, 19 nt, Human
cacugagccuggccccauc

SEQ ID NO: 193885 - RNA, 20 nt, Human
cagccccggggaaggggaag

SEQ ID NO: 193886 - RNA, 18 nt, Human
cagccccuggcagggcuc

SEQ ID NO: 193887 - RNA, 23 nt, Human
caggauccaaaacaaaaggcccc

SEQ ID NO: 193888 - RNA, 20 nt, Human
cagggcugggggccugaggc

SEQ ID NO: 193889 - RNA, 21 nt, Human
cagggugggugcccaccuccc

SEQ ID NO: 193890 - RNA, 23 nt, Human
cagggugggugcccaccuccccu

SEQ ID NO: 193891 - RNA, 27 nt, Human
ccaggaaaccaguccucuccuucccca

SEQ ID NO: 193892 - RNA, 22 nt, Human
cccacacacuuucacccucuca

SEQ ID NO: 193893 - RNA, 20 nt, Human
cccacagccccuggcagggc

SEQ ID NO: 193894 - RNA, 21 nt, Human
cccauccccaucccccaggag

SEQ ID NO: 193895 - RNA, 22 nt, Human
ccccacacacuuucacccucuc

SEQ ID NO: 193896 - RNA, 19 nt, Human
ccccagaacuggagaguac

SEQ ID NO: 193897 - RNA, 25 nt, Human
ccccaggauccaaaacaaaaggccc

SEQ ID NO: 193898 - RNA, 18 nt, Human
ccccauccccauccccca

SEQ ID NO: 193899 - RNA, 22 nt, Human
ccccuaggagccacuucccauc

SEQ ID NO: 193900 - RNA, 24 nt, Human
ccccucugcagggaccaccuucuc

SEQ ID NO: 193901 - RNA, 21 nt, Human
cccgcagcaugcuggauggcu

SEQ ID NO: 193902 - RNA, 19 nt, Human
cccuccuggucuuagcucc

SEQ ID NO: 193903 - RNA, 20 nt, Human
cccuucuagaaccuccauuc

SEQ ID NO: 193904 - RNA, 19 nt, Human
ccuccuggccccugagaac

SEQ ID NO: 193905 - RNA, 20 nt, Human
ccugccccuccccuggcucc

SEQ ID NO: 193906 - RNA, 22 nt, Human
ccuggccccugagaacccagga

SEQ ID NO: 193907 - RNA, 19 nt, Human
cggcagcaccuccucgacu

SEQ ID NO: 193908 - RNA, 23 nt, Human
cggcagcagcggcggcggcagcg

SEQ ID NO: 193909 - RNA, 23 nt, Human
cggcggcagcagcggcggcggca

SEQ ID NO: 193910 - RNA, 18 nt, Human
cggcuucgcgggcggcgg

SEQ ID NO: 193911 - RNA, 23 nt, Human
cgggacgggagcccggggccgcc

SEQ ID NO: 193912 - RNA, 23 nt, Human
cgggaggggguggagcugcggug

SEQ ID NO: 193913 - RNA, 23 nt, Human
cggguuacaaaauacuuaacuga

SEQ ID NO: 193914 - RNA, 22 nt, Human
cuaaaacaaacacacaagcaca

SEQ ID NO: 193915 - RNA, 20 nt, Human
cuagaaccuccauucucacc

SEQ ID NO: 193916 - RNA, 21 nt, Human
cuagaaccuccauucucacca

SEQ ID NO: 193917 - RNA, 19 nt, Human
cucacagacugcaggccac

SEQ ID NO: 193918 - RNA, 19 nt, Human
cucagaacggcauccccgc

SEQ ID NO: 193919 - RNA, 21 nt, Human
cuccaucuuugcggcggcucc

SEQ ID NO: 193920 - RNA, 26 nt, Human
cuccauucucaccauccccaggaucc

SEQ ID NO: 193921 - RNA, 20 nt, Human
cuccuggaucccuggguucu

SEQ ID NO: 193922 - RNA, 23 nt, Human
cuccuggccccugagaacccagg

SEQ ID NO: 193923 - RNA, 32 nt, Human
cugagaccaagaggaaggaggaggagagggga

SEQ ID NO: 193924 - RNA, 22 nt, Human
cugcaggccacagcuugggcac

SEQ ID NO: 193925 - RNA, 20 nt, Human
cugcagggaccaccuucucc

SEQ ID NO: 193926 - RNA, 22 nt, Human
cugcagggaccaccuucucccc

SEQ ID NO: 193927 - RNA, 20 nt, Human
cugguggucagcaaagggag

SEQ ID NO: 193928 - RNA, 19 nt, Human
cuucgcgggcggcggcggc

SEQ ID NO: 193929 - RNA, 26 nt, Human
cuucuagaaccuccauucucaccauc

SEQ ID NO: 193930 - RNA, 18 nt, Human
gaaagaaggggaaagggu

SEQ ID NO: 193931 - RNA, 22 nt, Human
gaaccagaccagccacagggag

SEQ ID NO: 193932 - RNA, 18 nt, Human
gaaggaggaggagagggg

SEQ ID NO: 193933 - RNA, 23 nt, Human
gacgggaggggguggagcugcgg

SEQ ID NO: 193934 - RNA, 24 nt, Human
gacuccugccccuccccuggcucc

SEQ ID NO: 193935 - RNA, 19 nt, Human
gacuucccguucccuccuc

SEQ ID NO: 193936 - RNA, 18 nt, Human
gagaacccaggaaaccag

SEQ ID NO: 193937 - RNA, 18 nt, Human
gaggacgaaagaagggga

SEQ ID NO: 193938 - RNA, 23 nt, Human
gaggaggagaggggucugcagag

SEQ ID NO: 193939 - RNA, 19 nt, Human
gaggaucuaaaacaaacac

SEQ ID NO: 193940 - RNA, 19 nt, Human
gauggugaggacgaaagaa

SEQ ID NO: 193941 - RNA, 21 nt, Human
gcagggugggugcccaccucc

SEQ ID NO: 193942 - RNA, 20 nt, Human
gccccuggcagggcuccugg

SEQ ID NO: 193943 - RNA, 18 nt, Human
gccugaggcagcguagag

SEQ ID NO: 193944 - RNA, 24 nt, Human
gccuggagccccucugcagggacc

SEQ ID NO: 193945 - RNA, 21 nt, Human
gccuggccccauccccauccc

SEQ ID NO: 193946 - RNA, 23 nt, Human
gcgaggcagucaggcacucagaa

SEQ ID NO: 193947 - RNA, 23 nt, Human
gcggcagcagcggcggcggcagc

SEQ ID NO: 193948 - RNA, 24 nt, Human
gcggcggcggcagcggcggcagca

SEQ ID NO: 193949 - RNA, 19 nt, Human
gcgggcggcggcggcagca

SEQ ID NO: 193950 - RNA, 24 nt, Human
gcuucgcgggcggcggcggcagca

SEQ ID NO: 193951 - RNA, 24 nt, Human
ggacgggagcccggggccgccgug

SEQ ID NO: 193952 - RNA, 22 nt, Human
ggaggagaggggucugcagaga

SEQ ID NO: 193953 - RNA, 19 nt, Human
ggaggccauccgaguaagg

SEQ ID NO: 193954 - RNA, 21 nt, Human
ggaggggguggagcugcggug

SEQ ID NO: 193955 - RNA, 21 nt, Human
ggauccaaaacaaaaggcccc

SEQ ID NO: 193956 - RNA, 26 nt, Human
ggcaagacagcccuccucacagacug

SEQ ID NO: 193957 - RNA, 21 nt, Human
ggcagcagcggcggcggcagc

SEQ ID NO: 193958 - RNA, 20 nt, Human
ggcauccccuggaagccuug

SEQ ID NO: 193959 - RNA, 21 nt, Human
ggcggcagcagcggcggcggc

SEQ ID NO: 193960 - RNA, 21 nt, Human
ggcggcagcggcggcagcacc

SEQ ID NO: 193961 - RNA, 23 nt, Human
ggcggcggcagcagcggcggcgg

SEQ ID NO: 193962 - RNA, 18 nt, Human
ggcggcuccuccggcucc

SEQ ID NO: 193963 - RNA, 23 nt, Human
gggaaagagaagggacagcgccc

SEQ ID NO: 193964 - RNA, 22 nt, Human
gggacgggagcccggggccgcc

SEQ ID NO: 193965 - RNA, 21 nt, Human
gguacuggggaggaggaggaa

SEQ ID NO: 193966 - RNA, 18 nt, Human
gguggucagcaaagggag

SEQ ID NO: 193967 - RNA, 18 nt, Human
guagaggagcaggagggg

SEQ ID NO: 193968 - RNA, 19 nt, Human
uaaaacaaacacacaagca

SEQ ID NO: 193969 - RNA, 26 nt, Human
uaggagccacuucccaucuuuggucg

SEQ ID NO: 193970 - RNA, 22 nt, Human
ucagcccccuaggagccacuuc

SEQ ID NO: 193971 - RNA, 22 nt, Human
uccauauccagggagacaaagc

SEQ ID NO: 193972 - RNA, 19 nt, Human
uccaucuuugcggcggcuc

SEQ ID NO: 193973 - RNA, 18 nt, Human
uccccaggauccaaaaca

SEQ ID NO: 193974 - RNA, 19 nt, Human
uccccaggauccaaaacaa

SEQ ID NO: 193975 - RNA, 24 nt, Human
uccccuggcucccucaauccugac

SEQ ID NO: 193976 - RNA, 24 nt, Human
ucccucaauccugcucaggccccc

SEQ ID NO: 193977 - RNA, 19 nt, Human
ucccuggguucuggccuua

SEQ ID NO: 193978 - RNA, 24 nt, Human
ucccuggguucuggccuuaccccu

SEQ ID NO: 193979 - RNA, 19 nt, Human
uccgaguaagguggggagc

SEQ ID NO: 193980 - RNA, 19 nt, Human
uccuggccccugagaaccc

SEQ ID NO: 193981 - RNA, 26 nt, Human
ucuagaaccuccauucucaccauccc

SEQ ID NO: 193982 - RNA, 19 nt, Human
ucuagagcugagguggaag

SEQ ID NO: 193983 - RNA, 20 nt, Human
ucuuugguuuccuacaggcu

SEQ ID NO: 193984 - RNA, 19 nt, Human
ugacagcaggggggcucuc

SEQ ID NO: 193985 - RNA, 19 nt, Human
ugagaacccaggaaaccag

SEQ ID NO: 193986 - RNA, 18 nt, Human
ugagguggaagccacagg

SEQ ID NO: 193987 - RNA, 21 nt, Human
ugccagcagaggggcagggag

SEQ ID NO: 193988 - RNA, 20 nt, Human
ugcccaggcugugccagcaa

SEQ ID NO: 193989 - RNA, 22 nt, Human
ugccccuccccuggcucccuca

SEQ ID NO: 193990 - RNA, 21 nt, Human
ugggaaagagaagggacagcg

SEQ ID NO: 193991 - RNA, 25 nt, Human
uggggaggaggaggaaggaagaguu

SEQ ID NO: 193992 - RNA, 22 nt, Human
ugggggcugggacgggaggggg

SEQ ID NO: 193993 - RNA, 20 nt, Human
uggguucuggccuuaccccu

SEQ ID NO: 193994 - RNA, 20 nt, Human
ugguggggcccuggagauag

SEQ ID NO: 193995 - RNA, 21 nt, Human
ugugugacuuuuuguuuuuaa

SEQ ID NO: 193996 - RNA, 18 nt, Human
agagggaccguauucugg

SEQ ID NO: 193997 - RNA, 21 nt, Human
agcguuucaaccagccccgcu

SEQ ID NO: 193998 - RNA, 23 nt, Human
auccaagguacaggcuggaauga

SEQ ID NO: 193999 - RNA, 19 nt, Human
cacuccgccagaucccgcc

SEQ ID NO: 194000 - RNA, 21 nt, Human
cagccccgcuccucaggggac

SEQ ID NO: 194001 - RNA, 26 nt, Human
ccaagguacaggcuggaaugagcuac

SEQ ID NO: 194002 - RNA, 20 nt, Human
ccacuccgccagaucccgcc

SEQ ID NO: 194003 - RNA, 18 nt, Human
ccacugagcugccccccu

SEQ ID NO: 194004 - RNA, 27 nt, Human
ccaugccugccaguuaacuccccuccc

SEQ ID NO: 194005 - RNA, 18 nt, Human
ccccccuuuccuucuggg

SEQ ID NO: 194006 - RNA, 18 nt, Human
cccuuuccuucugggcug

SEQ ID NO: 194007 - RNA, 21 nt, Human
cccuuuccuucugggcuggag

SEQ ID NO: 194008 - RNA, 18 nt, Human
ccgcuccucaggggacug

SEQ ID NO: 194009 - RNA, 23 nt, Human
ccucauccaagguacaggcugga

SEQ ID NO: 194010 - RNA, 26 nt, Human
ccucccgccaauguuauccucaugau

SEQ ID NO: 194011 - RNA, 18 nt, Human
cucuuggggccacugagc

SEQ ID NO: 194012 - RNA, 20 nt, Human
cuggaguaguggugccccuc

SEQ ID NO: 194013 - RNA, 26 nt, Human
uaacuccccucccgccaauguuaucc

SEQ ID NO: 194014 - RNA, 18 nt, Human
uaucgugggccucagaag

SEQ ID NO: 194015 - RNA, 19 nt, Human
uaucgugggccucagaagg

SEQ ID NO: 194016 - RNA, 25 nt, Human
ucagaaggugaagagggaccguauu

SEQ ID NO: 194017 - RNA, 23 nt, Human
ucagcucccucuuggggccacug

SEQ ID NO: 194018 - RNA, 22 nt, Human
ucuaucgugggccucagaaggu

SEQ ID NO: 194019 - RNA, 21 nt, Human
ucugggcuggaguaguggugc

SEQ ID NO: 194020 - RNA, 21 nt, Human
ugaggaggcuuggccccugcc

SEQ ID NO: 194021 - RNA, 20 nt, Human
ugccaguuaacuccccuccc

SEQ ID NO: 194022 - RNA, 20 nt, Human
uucugggcuggaguaguggu

SEQ ID NO: 194023 - RNA, 21 nt, Human
aaaagccuugaagacuuugcc

SEQ ID NO: 194024 - RNA, 19 nt, Human
aaacagagaaggcuccccg

SEQ ID NO: 194025 - RNA, 21 nt, Human
aaagacacacacacacgccuc

SEQ ID NO: 194026 - RNA, 25 nt, Human
aacaugcauacauacacaggguaug

SEQ ID NO: 194027 - RNA, 18 nt, Human
aagcaggcaggcuguucu

SEQ ID NO: 194028 - RNA, 24 nt, Human
acacacacgcucacacacacgccu

SEQ ID NO: 194029 - RNA, 21 nt, Human
acacgcucacacacacgccuc

SEQ ID NO: 194030 - RNA, 23 nt, Human
acucacacacacgcucacacaca

SEQ ID NO: 194031 - RNA, 23 nt, Human
acucacacacaugcucacacaca

SEQ ID NO: 194032 - RNA, 24 nt, Human
agcacccaucugcuccaccagggc

SEQ ID NO: 194033 - RNA, 18 nt, Human
agccggagccaguccucc

SEQ ID NO: 194034 - RNA, 23 nt, Human
agccggagccaguccuccucugu

SEQ ID NO: 194035 - RNA, 23 nt, Human
aggaagcacaggacucccagagc

SEQ ID NO: 194036 - RNA, 22 nt, Human
agggagcaggguaaacuggaaa

SEQ ID NO: 194037 - RNA, 25 nt, Human
aggucccaagggcauggugggcggg

SEQ ID NO: 194038 - RNA, 26 nt, Human
cacacacacgcucacacacacgccuc

SEQ ID NO: 194039 - RNA, 18 nt, Human
caccagggcaucgccagg

SEQ ID NO: 194040 - RNA, 22 nt, Human
cagaaacagagaaggcuccccg

SEQ ID NO: 194041 - RNA, 21 nt, Human
cagccuagggacagagagagg

SEQ ID NO: 194042 - RNA, 19 nt, Human
caggaagcacaggacuccc

SEQ ID NO: 194043 - RNA, 21 nt, Human
cauuggaucaggaagcacagg

SEQ ID NO: 194044 - RNA, 22 nt, Human
ccagagcagccuccccuccucc

SEQ ID NO: 194045 - RNA, 25 nt, Human
ccccaaaagccuugaagacuuugcc

SEQ ID NO: 194046 - RNA, 20 nt, Human
ccccagaaacagagaaggcu

SEQ ID NO: 194047 - RNA, 21 nt, Human
ccccagaaacagagaaggcuc

SEQ ID NO: 194048 - RNA, 24 nt, Human
ccccaggccuggacccccaaaagc

SEQ ID NO: 194049 - RNA, 22 nt, Human
ccccccuagccccuagagccua

SEQ ID NO: 194050 - RNA, 24 nt, Human
ccccucagccucccucaggcucac

SEQ ID NO: 194051 - RNA, 19 nt, Human
cccggugguagagggaagc

SEQ ID NO: 194052 - RNA, 20 nt, Human
cccugugggggucgccgccc

SEQ ID NO: 194053 - RNA, 19 nt, Human
ccucuuggcuccccacucc

SEQ ID NO: 194054 - RNA, 18 nt, Human
ccuggggcagccuaggga

SEQ ID NO: 194055 - RNA, 27 nt, Human
cgccucacucacacacacgcucacaca

SEQ ID NO: 194056 - RNA, 27 nt, Human
cgccucacucacacacaugcucacaca

SEQ ID NO: 194057 - RNA, 23 nt, Human
cggugguagagggaagcuuccag

SEQ ID NO: 194058 - RNA, 24 nt, Human
cucacucacacacacgcucacaca

SEQ ID NO: 194059 - RNA, 24 nt, Human
cucacucacacacaugcucacaca

SEQ ID NO: 194060 - RNA, 21 nt, Human
cucuaaagacccaggaauggg

SEQ ID NO: 194061 - RNA, 20 nt, Human
cugcacagggccuggggcag

SEQ ID NO: 194062 - RNA, 20 nt, Human
cugcacagggccuggggcag

SEQ ID NO: 194063 - RNA, 24 nt, Human
cugugugcaaagucugggguuugc

SEQ ID NO: 194064 - RNA, 20 nt, Human
cuugaccccaggccuggacc

SEQ ID NO: 194065 - RNA, 18 nt, Human
cuuggcuccccacucccc

SEQ ID NO: 194066 - RNA, 18 nt, Human
gcauggugggcgggcaga

SEQ ID NO: 194067 - RNA, 22 nt, Human
gccccagaaacagagaaggcuc

SEQ ID NO: 194068 - RNA, 19 nt, Human
gccuagggacagagagagg

SEQ ID NO: 194069 - RNA, 27 nt, Human
gccuggacccccaaaagccuugaagac

SEQ ID NO: 194070 - RNA, 21 nt, Human
gcucacacacauuuuccuucu

SEQ ID NO: 194071 - RNA, 23 nt, Human
ggcaguggccgaggggucccagg

SEQ ID NO: 194072 - RNA, 28 nt, Human
ggccuggacccccaaaagccuugaagac

SEQ ID NO: 194073 - RNA, 20 nt, Human
ggcugcggcugagggccugg

SEQ ID NO: 194074 - RNA, 20 nt, Human
ggcugcggcugagggccugg

SEQ ID NO: 194075 - RNA, 24 nt, Human
gggcaguggccgaggggucccagg

SEQ ID NO: 194076 - RNA, 26 nt, Human
gggcaucgccaggagguugauguagg

SEQ ID NO: 194077 - RNA, 21 nt, Human
gggcugcggcugagggccugg

SEQ ID NO: 194078 - RNA, 19 nt, Human
gggguuagaagagaaccag

SEQ ID NO: 194079 - RNA, 20 nt, Human
gguagagggaagcuuccaga

SEQ ID NO: 194080 - RNA, 18 nt, Human
guagagggaagcuuccag

SEQ ID NO: 194081 - RNA, 18 nt, Human
uacauacacaggguaugg

SEQ ID NO: 194082 - RNA, 19 nt, Human
uagaagagaaccagguccc

SEQ ID NO: 194083 - RNA, 18 nt, Human
uagagccuaggaagggcc

SEQ ID NO: 194084 - RNA, 21 nt, Human
uaggaagggccagccugucug

SEQ ID NO: 194085 - RNA, 19 nt, Human
uaucuucucucccaccccu

SEQ ID NO: 194086 - RNA, 28 nt, Human
uaucuucucucccaccccuucccccuca

SEQ ID NO: 194087 - RNA, 21 nt, Human
ucaggguccucuccaguuccc

SEQ ID NO: 194088 - RNA, 19 nt, Human
uccaguucccauucuagac

SEQ ID NO: 194089 - RNA, 24 nt, Human
ucccaccccuucccccucagucag

SEQ ID NO: 194090 - RNA, 22 nt, Human
ucccagggguaugcugcgcuuc

SEQ ID NO: 194091 - RNA, 19 nt, Human
uccccacuccccccuagcc

SEQ ID NO: 194092 - RNA, 21 nt, Human
uccccacuccccccuagcccc

SEQ ID NO: 194093 - RNA, 19 nt, Human
uccccgagugggcaguggc

SEQ ID NO: 194094 - RNA, 20 nt, Human
ucccucaggcucacuugaca

SEQ ID NO: 194095 - RNA, 24 nt, Human
ucccucaggcucacuugacaaugg

SEQ ID NO: 194096 - RNA, 18 nt, Human
uccuucuugaccccaggc

SEQ ID NO: 194097 - RNA, 24 nt, Human
ucuaaagacccaggaaugggggcu

SEQ ID NO: 194098 - RNA, 25 nt, Human
ucucuaaagacccaggaaugggggc

SEQ ID NO: 194099 - RNA, 19 nt, Human
ucugaggaagcaggugaga

SEQ ID NO: 194100 - RNA, 22 nt, Human
ucuguaucuucucucccacccc

SEQ ID NO: 194101 - RNA, 21 nt, Human
ugaccccaggccuggaccccc

SEQ ID NO: 194102 - RNA, 20 nt, Human
ugagagggacuaccccugca

SEQ ID NO: 194103 - RNA, 24 nt, Human
ugagcccgacggagccggagccag

SEQ ID NO: 194104 - RNA, 18 nt, Human
ugauccccccucagccuc

SEQ ID NO: 194105 - RNA, 21 nt, Human
ugcauacauacacaggguaug

SEQ ID NO: 194106 - RNA, 22 nt, Human
ugcccacaggaucucuaaagac

SEQ ID NO: 194107 - RNA, 20 nt, Human
ugcucacacacauuuuccuu

SEQ ID NO: 194108 - RNA, 18 nt, Human
uggcaaaacacucucaug

SEQ ID NO: 194109 - RNA, 20 nt, Human
uggcaaaacacucucauggg

SEQ ID NO: 194110 - RNA, 25 nt, Human
uggcuccccacuccccccuagcccc

SEQ ID NO: 194111 - RNA, 20 nt, Human
ugggauaacugucaaagcag

SEQ ID NO: 194112 - RNA, 21 nt, Human
ugguagagggaagcuuccaga

SEQ ID NO: 194113 - RNA, 23 nt, Human
ugguuccaacuacuugcccacug

SEQ ID NO: 194114 - RNA, 25 nt, Human
uguaucuucucucccaccccuuccc

SEQ ID NO: 194115 - RNA, 20 nt, Human
ugucaaagcaggcaggcugu

SEQ ID NO: 194116 - RNA, 23 nt, Human
ugucaaagcaggcaggcuguucu

SEQ ID NO: 194117 - RNA, 20 nt, Human
ugucuguaucuucucuccca

SEQ ID NO: 194118 - RNA, 19 nt, Human
uuccuauguggggugggaa

SEQ ID NO: 194119 - RNA, 18 nt, Human
uugaagacuuugccagag

SEQ ID NO: 194120 - RNA, 20 nt, Human
uuuuuuuuuuuaaagcaaau

SEQ ID NO: 194121 - RNA, 19 nt, Human
uuuuuuuuuuuuuuuuuaa

SEQ ID NO: 194122 - RNA, 22 nt, Human
aaaauacuccccuccccaauuc

SEQ ID NO: 194123 - RNA, 24 nt, Human
aaacaacaccagcggacuucuccc

SEQ ID NO: 194124 - RNA, 19 nt, Human
aaaccguuccgcagccacc

SEQ ID NO: 194125 - RNA, 25 nt, Human
aacaacaccagcggacuucucccca

SEQ ID NO: 194126 - RNA, 25 nt, Human
aacccugccucucagcugccuccug

SEQ ID NO: 194127 - RNA, 22 nt, Human
acccucucucccagggcuccac

SEQ ID NO: 194128 - RNA, 19 nt, Human
aucaguacccucucuccca

SEQ ID NO: 194129 - RNA, 24 nt, Human
aucuccuucuuccccuagguccag

SEQ ID NO: 194130 - RNA, 22 nt, Human
auuucauuuguguguguguguu

SEQ ID NO: 194131 - RNA, 23 nt, Human
cagcggacuucuccccaccuccc

SEQ ID NO: 194132 - RNA, 28 nt, Human
cagcggacuucuccccaccucccagucu

SEQ ID NO: 194133 - RNA, 23 nt, Human
ccaccuggaugguccugaggccc

SEQ ID NO: 194134 - RNA, 18 nt, Human
ccagcggacuucucccca

SEQ ID NO: 194135 - RNA, 24 nt, Human
ccagcggacuucuccccaccuccc

SEQ ID NO: 194136 - RNA, 24 nt, Human
ccccaauucgcuuaaaaauaauuu

SEQ ID NO: 194137 - RNA, 22 nt, Human
cccuagguccaguugaggacuc

SEQ ID NO: 194138 - RNA, 19 nt, Human
cccugccucucagcugccu

SEQ ID NO: 194139 - RNA, 27 nt, Human
ccuccugcccuacaaaccggguccuuc

SEQ ID NO: 194140 - RNA, 21 nt, Human
cugccacuugaugccccuugg

SEQ ID NO: 194141 - RNA, 22 nt, Human
gccucucagcugccuccugccc

SEQ ID NO: 194142 - RNA, 22 nt, Human
gccucuucaccccaggaagcca

SEQ ID NO: 194143 - RNA, 20 nt, Human
guccaguugaggacucuggg

SEQ ID NO: 194144 - RNA, 19 nt, Human
uaaaaccguuccgcagcca

SEQ ID NO: 194145 - RNA, 24 nt, Human
uaagaugauuaaaauacuccccuc

SEQ ID NO: 194146 - RNA, 21 nt, Human
uaggcaccacuccucagcucu

SEQ ID NO: 194147 - RNA, 18 nt, Human
ucccagggcuccaccugg

SEQ ID NO: 194148 - RNA, 22 nt, Human
ugaggcccaaacccugccucuc

SEQ ID NO: 194149 - RNA, 19 nt, Human
ugcccuacaaacuggugac

SEQ ID NO: 194150 - RNA, 19 nt, Human
uggggugccugccucuuca

SEQ ID NO: 194151 - RNA, 30 nt, Human
uucaaagauuuuauuaaaaaaaccaaagaa

SEQ ID NO: 194152 - RNA, 23 nt, Human
uuuuuuuuuuuuuuuuuuuuagg

SEQ ID NO: 194153 - RNA, 19 nt, Human
aaguauauccucagacucu

SEQ ID NO: 194154 - RNA, 21 nt, Human
aggcguggagcagcccggcuu

SEQ ID NO: 194155 - RNA, 19 nt, Human
caagcugaaccacagaagc

SEQ ID NO: 194156 - RNA, 21 nt, Human
caagcugaaccacagaagcug

SEQ ID NO: 194157 - RNA, 20 nt, Human
cacagaagcugccugucuac

SEQ ID NO: 194158 - RNA, 23 nt, Human
ccccaagaaaaaugcauguacac

SEQ ID NO: 194159 - RNA, 20 nt, Human
cucacagauggacacgcagg

SEQ ID NO: 194160 - RNA, 22 nt, Human
gcugaaccacagaagcugccug

SEQ ID NO: 194161 - RNA, 24 nt, Human
ggcguggagcagcccggcuucccu

SEQ ID NO: 194162 - RNA, 22 nt, Human
gucuacccucggcccuuucuca

SEQ ID NO: 194163 - RNA, 19 nt, Human
uaucaugucacaagcugaa

SEQ ID NO: 194164 - RNA, 23 nt, Human
ucaugucacaagcugaaccacag

SEQ ID NO: 194165 - RNA, 18 nt, Human
ucccucuugccaguccug

SEQ ID NO: 194166 - RNA, 26 nt, Human
ugcauguacacauaagcacacagugu

SEQ ID NO: 194167 - RNA, 21 nt, Human
ugugggucaugagccccuaug

SEQ ID NO: 194168 - RNA, 18 nt, Human
uucacagagucccugaag

SEQ ID NO: 194169 - RNA, 22 nt, Human
uucuguguuauauaucauguca

SEQ ID NO: 194170 - RNA, 20 nt, Human
uuguauccuauuguggguca

SEQ ID NO: 194171 - RNA, 22 nt, Human
acagaugcucaacacucccacc

SEQ ID NO: 194172 - RNA, 18 nt, Human
acagcagcaggaacaggg

SEQ ID NO: 194173 - RNA, 27 nt, Human
agaaaugggggcaacgauggggaagga

SEQ ID NO: 194174 - RNA, 23 nt, Human
agagagaccaguaggaagagggu

SEQ ID NO: 194175 - RNA, 23 nt, Human
agaggagagcagguugggguggg

SEQ ID NO: 194176 - RNA, 21 nt, Human
agaggugagagccagguggcc

SEQ ID NO: 194177 - RNA, 22 nt, Human
agcagcaggaacaggguggggg

SEQ ID NO: 194178 - RNA, 18 nt, Human
agcaggaacagggugggg

SEQ ID NO: 194179 - RNA, 22 nt, Human
aggaaaaaggacagcuaggagu

SEQ ID NO: 194180 - RNA, 20 nt, Human
aggccucuuccuccaccccc

SEQ ID NO: 194181 - RNA, 19 nt, Human
agggagaggggccagggua

SEQ ID NO: 194182 - RNA, 22 nt, Human
agggagaggggccaggguaaaa

SEQ ID NO: 194183 - RNA, 22 nt, Human
agguccuuggcccgaacaacuu

SEQ ID NO: 194184 - RNA, 18 nt, Human
agguuggggugggaaagg

SEQ ID NO: 194185 - RNA, 20 nt, Human
aguagaagaggagagcaggu

SEQ ID NO: 194186 - RNA, 18 nt, Human
aguagcacccagacagca

SEQ ID NO: 194187 - RNA, 24 nt, Human
auggaaaggagccccuccccuaca

SEQ ID NO: 194188 - RNA, 24 nt, Human
auggggaaggagcagaauggagag

SEQ ID NO: 194189 - RNA, 18 nt, Human
auuccuaccccugauccc

SEQ ID NO: 194190 - RNA, 20 nt, Human
auugcucccuccucugcgcg

SEQ ID NO: 194191 - RNA, 26 nt, Human
caaaaagaaagucaucaagccccaaa

SEQ ID NO: 194192 - RNA, 24 nt, Human
caaagccccagcuacaaaaagaaa

SEQ ID NO: 194193 - RNA, 18 nt, Human
caacacugagggggccag

SEQ ID NO: 194194 - RNA, 20 nt, Human
caagggagaggggccagggu

SEQ ID NO: 194195 - RNA, 21 nt, Human
cacccagacagcagcaggaac

SEQ ID NO: 194196 - RNA, 19 nt, Human
caccccgcauuugaggauu

SEQ ID NO: 194197 - RNA, 18 nt, Human
cagaauggagagcacaca

SEQ ID NO: 194198 - RNA, 22 nt, Human
cagagcccaagggagaggggcc

SEQ ID NO: 194199 - RNA, 18 nt, Human
cagcagcaggaacagggg

SEQ ID NO: 194200 - RNA, 20 nt, Human
cagcagcaggaacagggugg

SEQ ID NO: 194201 - RNA, 23 nt, Human
cagcaggaacagggugggggcuc

SEQ ID NO: 194202 - RNA, 23 nt, Human
cagcuaggagucuucccaagcau

SEQ ID NO: 194203 - RNA, 19 nt, Human
caggccccagcagaagccu

SEQ ID NO: 194204 - RNA, 19 nt, Human
cagguccuuggcccgaaca

SEQ ID NO: 194205 - RNA, 18 nt, Human
cauagagagaccaguagg

SEQ ID NO: 194206 - RNA, 18 nt, Human
ccaagcggaaggaacaca

SEQ ID NO: 194207 - RNA, 21 nt, Human
ccacccaaauggguaaaguca

SEQ ID NO: 194208 - RNA, 23 nt, Human
ccaccccccgcccgguccccacu

SEQ ID NO: 194209 - RNA, 18 nt, Human
ccagacagcagcaggaac

SEQ ID NO: 194210 - RNA, 19 nt, Human
ccagacagcagcaggaaca

SEQ ID NO: 194211 - RNA, 23 nt, Human
cccacccaaauggguaaagucaa

SEQ ID NO: 194212 - RNA, 22 nt, Human
ccccgcccgguccccacuccuc

SEQ ID NO: 194213 - RNA, 25 nt, Human
ccccgcccgguccccacuccuccuc

SEQ ID NO: 194214 - RNA, 25 nt, Human
cccucccaggccccacaagcccacc

SEQ ID NO: 194215 - RNA, 22 nt, Human
ccgcacggacggggcgggcgcg

SEQ ID NO: 194216 - RNA, 19 nt, Human
ccgcccgguccccacuccu

SEQ ID NO: 194217 - RNA, 18 nt, Human
ccgcuccgcuccggcccc

SEQ ID NO: 194218 - RNA, 21 nt, Human
ccggcccucgcgcggcccccg

SEQ ID NO: 194219 - RNA, 18 nt, Human
ccuaccccugaucccaac

SEQ ID NO: 194220 - RNA, 19 nt, Human
ccucccaggccccacaagc

SEQ ID NO: 194221 - RNA, 24 nt, Human
ccuccugugcugcccccaccccgc

SEQ ID NO: 194222 - RNA, 22 nt, Human
ccuuccauuccuaccccugauc

SEQ ID NO: 194223 - RNA, 21 nt, Human
cgccucgaugguggcccccgg

SEQ ID NO: 194224 - RNA, 22 nt, Human
cgcuccggcccucgcgcggccc

SEQ ID NO: 194225 - RNA, 21 nt, Human
cggaucggggcaaggcuccgg

SEQ ID NO: 194226 - RNA, 20 nt, Human
cggcccucgcgcggcccccg

SEQ ID NO: 194227 - RNA, 21 nt, Human
cgugcggcgguggcggcgccg

SEQ ID NO: 194228 - RNA, 19 nt, Human
cuaggagucuucccaagca

SEQ ID NO: 194229 - RNA, 23 nt, Human
cuaggagucuucccaagcauccu

SEQ ID NO: 194230 - RNA, 19 nt, Human
cucauuccagggagaagac

SEQ ID NO: 194231 - RNA, 23 nt, Human
cucccaggccccacaagcccacc

SEQ ID NO: 194232 - RNA, 19 nt, Human
cucccuccucugcgcgagg

SEQ ID NO: 194233 - RNA, 23 nt, Human
cucucuguccucucaguggguua

SEQ ID NO: 194234 - RNA, 22 nt, Human
cucugcgcgaggccucuuccuc

SEQ ID NO: 194235 - RNA, 23 nt, Human
cuggaaggaacaucaaagcccca

SEQ ID NO: 194236 - RNA, 21 nt, Human
cugugcugcccccaccccgca

SEQ ID NO: 194237 - RNA, 21 nt, Human
cuucccaagcauccuauuugu

SEQ ID NO: 194238 - RNA, 21 nt, Human
gaacaacuuggaagccccaaa

SEQ ID NO: 194239 - RNA, 25 nt, Human
gaaggaacacaguggccucaacuca

SEQ ID NO: 194240 - RNA, 25 nt, Human
gacacuggaaggaacaucaaagccc

SEQ ID NO: 194241 - RNA, 21 nt, Human
gacagcagcaggaacagggug

SEQ ID NO: 194242 - RNA, 25 nt, Human
gacagcagcaggaacagggugacga

SEQ ID NO: 194243 - RNA, 21 nt, Human
gagagugggagaaggguguca

SEQ ID NO: 194244 - RNA, 19 nt, Human
gagcacacaaaggguuagg

SEQ ID NO: 194245 - RNA, 18 nt, Human
gaggugagagccaggugg

SEQ ID NO: 194246 - RNA, 20 nt, Human
gcauagagagaccaguagga

SEQ ID NO: 194247 - RNA, 22 nt, Human
gccccgggcuccgcgccgggcc

SEQ ID NO: 194248 - RNA, 22 nt, Human
gcgcgagcccaaguuugcgcgu

SEQ ID NO: 194249 - RNA, 18 nt, Human
gcggcgguggcggcgccg

SEQ ID NO: 194250 - RNA, 18 nt, Human
ggaagagggugggagagg

SEQ ID NO: 194251 - RNA, 18 nt, Human
ggacagaugcucaacacu

SEQ ID NO: 194252 - RNA, 21 nt, Human
ggacagaugcucaacacuccc

SEQ ID NO: 194253 - RNA, 22 nt, Human
ggagucuucccaagcauccuau

SEQ ID NO: 194254 - RNA, 18 nt, Human
ggcccccggcccgagcuc

SEQ ID NO: 194255 - RNA, 19 nt, Human
ggcgcggugggugcgcgcu

SEQ ID NO: 194256 - RNA, 22 nt, Human
gggacagaugcucaacacuccc

SEQ ID NO: 194257 - RNA, 20 nt, Human
gggacaggagcucagaagga

SEQ ID NO: 194258 - RNA, 21 nt, Human
gggcaaggcuccggcgcggug

SEQ ID NO: 194259 - RNA, 19 nt, Human
gggcgccccgggcuccgcg

SEQ ID NO: 194260 - RNA, 23 nt, Human
ggucggcaaaaggaaaaaugggu

SEQ ID NO: 194261 - RNA, 23 nt, Human
gucuuuuccuuuaugucugggug

SEQ ID NO: 194262 - RNA, 19 nt, Human
guuugaaauucaauugcuc

SEQ ID NO: 194263 - RNA, 23 nt, Human
uaaagucaacccuucaggucucc

SEQ ID NO: 194264 - RNA, 21 nt, Human
uaacuacaacucccaaaacuc

SEQ ID NO: 194265 - RNA, 21 nt, Human
uacaaaaagaaagucaucaag

SEQ ID NO: 194266 - RNA, 26 nt, Human
uaccccugaucccaacccagaggucc

SEQ ID NO: 194267 - RNA, 21 nt, Human
uagaggugagagccagguggc

SEQ ID NO: 194268 - RNA, 22 nt, Human
uaggaagagggugggagagggc

SEQ ID NO: 194269 - RNA, 19 nt, Human
ucaaucaucaaggauuuau

SEQ ID NO: 194270 - RNA, 19 nt, Human
ucagagaucuaaaggggga

SEQ ID NO: 194271 - RNA, 21 nt, Human
uccaagcggaaggaacacagu

SEQ ID NO: 194272 - RNA, 23 nt, Human
ucccaggccccacaagcccaccc

SEQ ID NO: 194273 - RNA, 21 nt, Human
ucccaggccccagcagaagcc

SEQ ID NO: 194274 - RNA, 19 nt, Human
uccgggcgccccgggcucc

SEQ ID NO: 194275 - RNA, 21 nt, Human
ucggggcaaggcuccggcgcg

SEQ ID NO: 194276 - RNA, 19 nt, Human
ugacaacacugagggggcc

SEQ ID NO: 194277 - RNA, 24 nt, Human
ugacuauaagcuggccuugagcaa

SEQ ID NO: 194278 - RNA, 18 nt, Human
ugagaaaugacacuggaa

SEQ ID NO: 194279 - RNA, 21 nt, Human
ugccccucccaggccccacaa

SEQ ID NO: 194280 - RNA, 19 nt, Human
ugcuccauccuuccauucc

SEQ ID NO: 194281 - RNA, 21 nt, Human
uggaaaauagcuccaagcgga

SEQ ID NO: 194282 - RNA, 19 nt, Human
uggagaggaaaaaggacag

SEQ ID NO: 194283 - RNA, 21 nt, Human
uggcccgaacaacuuggaagc

SEQ ID NO: 194284 - RNA, 21 nt, Human
uggguaaagucaacccuucag

SEQ ID NO: 194285 - RNA, 20 nt, Human
ugguggcccccggcccgagc

SEQ ID NO: 194286 - RNA, 19 nt, Human
ugucaggaggugggagcag

SEQ ID NO: 194287 - RNA, 21 nt, Human
ugucaggaggugggagcaguu

SEQ ID NO: 194288 - RNA, 21 nt, Human
uguguggagaggaaaaaggac

SEQ ID NO: 194289 - RNA, 23 nt, Human
uguguggagaggaaaaaggacag

SEQ ID NO: 194290 - RNA, 19 nt, Human
uguugucaaucaucaagga

SEQ ID NO: 194291 - RNA, 22 nt, Human
uuccuaccccugaucccaaccc

SEQ ID NO: 194292 - RNA, 25 nt, Human
uuggcccgaacaacuuggaagcccc

SEQ ID NO: 194293 - RNA, 21 nt, Human
aagagcgucaacaauuuacgg

SEQ ID NO: 194294 - RNA, 25 nt, Human
acaccuacacacaauccgggaaaac

SEQ ID NO: 194295 - RNA, 22 nt, Human
accauugugugguuggguuugg

SEQ ID NO: 194296 - RNA, 26 nt, Human
caaaacggucaguagccagaaggucc

SEQ ID NO: 194297 - RNA, 22 nt, Human
cacacacagccaggcgcuaggc

SEQ ID NO: 194298 - RNA, 22 nt, Human
cacagccaggcgcuaggcuccc

SEQ ID NO: 194299 - RNA, 26 nt, Human
caggagcuggagucuguuaucuuagc

SEQ ID NO: 194300 - RNA, 24 nt, Human
caguagccagaagguccguccuga

SEQ ID NO: 194301 - RNA, 23 nt, Human
ccucugucagccugccagcuuuu

SEQ ID NO: 194302 - RNA, 21 nt, Human
cggguggaccaggagcuggag

SEQ ID NO: 194303 - RNA, 25 nt, Human
cucacaccuacacacaauccgggaa

SEQ ID NO: 194304 - RNA, 20 nt, Human
ggacguuuauuuccugaggu

SEQ ID NO: 194305 - RNA, 24 nt, Human
uacacacaauccgggaaaaccaca

SEQ ID NO: 194306 - RNA, 22 nt, Human
uagcacgaaugcucaugaccuu

SEQ ID NO: 194307 - RNA, 23 nt, Human
ucaaggacguuuauuuccugagg

SEQ ID NO: 194308 - RNA, 23 nt, Human
ucaaggacguuuauuuccugagg

SEQ ID NO: 194309 - RNA, 18 nt, Human
ucagauugagacaaacca

SEQ ID NO: 194310 - RNA, 25 nt, Human
ucucacaccuacacacaauccggga

SEQ ID NO: 194311 - RNA, 21 nt, Human
ucugucagccugccagcuuuu

SEQ ID NO: 194312 - RNA, 21 nt, Human
ugagacaaaccauuguguggu

SEQ ID NO: 194313 - RNA, 22 nt, Human
ugagcgggcacggccaggccug

SEQ ID NO: 194314 - RNA, 23 nt, Human
ugagcgggcacggccaggccugg

SEQ ID NO: 194315 - RNA, 23 nt, Human
uggaccaggagcuggagucuguu

SEQ ID NO: 194316 - RNA, 19 nt, Human
uggagcagguccugagcgg

SEQ ID NO: 194317 - RNA, 23 nt, Human
uggagcagguccugagcgggcac

SEQ ID NO: 194318 - RNA, 18 nt, Human
uuaguguuaaacagugga

SEQ ID NO: 194319 - RNA, 22 nt, Human
aaggaugcugcauaucuuggcu

SEQ ID NO: 194320 - RNA, 23 nt, Human
agaaaagagacuuaguauaugga

SEQ ID NO: 194321 - RNA, 21 nt, Human
agccgagacgcucccgacgca

SEQ ID NO: 194322 - RNA, 23 nt, Human
aggcggcgaggcgagaggcgggg

SEQ ID NO: 194323 - RNA, 19 nt, Human
aggcggcgggacggcgagg

SEQ ID NO: 194324 - RNA, 19 nt, Human
aggcggcgggacggcgagg

SEQ ID NO: 194325 - RNA, 23 nt, Human
caccggcggcagggcggcagggc

SEQ ID NO: 194326 - RNA, 21 nt, Human
ccccuuaauaacaaaauacaa

SEQ ID NO: 194327 - RNA, 19 nt, Human
cggcagggcggcagggcgg

SEQ ID NO: 194328 - RNA, 19 nt, Human
cggcagggcggcagggcgg

SEQ ID NO: 194329 - RNA, 19 nt, Human
cggcagggcggcagggcgg

SEQ ID NO: 194330 - RNA, 19 nt, Human
cggcagggcggcagggcgg

SEQ ID NO: 194331 - RNA, 19 nt, Human
cggcagggcggcagggcgg

SEQ ID NO: 194332 - RNA, 19 nt, Human
cggcagggcggcagggugg

SEQ ID NO: 194333 - RNA, 20 nt, Human
cgggaggacgugagguggcg

SEQ ID NO: 194334 - RNA, 22 nt, Human
cuugggaagcacuguccccucc

SEQ ID NO: 194335 - RNA, 21 nt, Human
ggacuugcagcuggaacuugg

SEQ ID NO: 194336 - RNA, 21 nt, Human
gggcggcagggcggcagggcg

SEQ ID NO: 194337 - RNA, 20 nt, Human
uaacaaaauacaaauccaau

SEQ ID NO: 194338 - RNA, 23 nt, Human
uaaguucuugguucaguggguca

SEQ ID NO: 194339 - RNA, 23 nt, Human
ucagcuguuuaagucaaugccuu

SEQ ID NO: 194340 - RNA, 23 nt, Human
ugagaaggaugcugcauaucuug

SEQ ID NO: 194341 - RNA, 18 nt, Human
ugcagcuggaacuuggga

SEQ ID NO: 194342 - RNA, 23 nt, Human
ugccuggagaaaagcugccagga

SEQ ID NO: 194343 - RNA, 24 nt, Human
uggcagggcggcaaggcggcggga

SEQ ID NO: 194344 - RNA, 26 nt, Human
aaaaauuaacugaaaaucuaaacuua

SEQ ID NO: 194345 - RNA, 20 nt, Human
agaaauagacucuaaaauca

SEQ ID NO: 194346 - RNA, 20 nt, Human
agccuguauccaagaauacu

SEQ ID NO: 194347 - RNA, 23 nt, Human
agggaaaaagacauuuacuaaac

SEQ ID NO: 194348 - RNA, 20 nt, Human
auaacugaaguaccuaaagc

SEQ ID NO: 194349 - RNA, 21 nt, Human
aucccaaucucuccccaugaa

SEQ ID NO: 194350 - RNA, 19 nt, Human
caaccgcugccggcccagc

SEQ ID NO: 194351 - RNA, 24 nt, Human
caugaaaagccuacuucauaacug

SEQ ID NO: 194352 - RNA, 28 nt, Human
cauuacuagaagaaaggagggaaaaaga

SEQ ID NO: 194353 - RNA, 22 nt, Human
ccaauacagggaaaucacuaga

SEQ ID NO: 194354 - RNA, 19 nt, Human
ccaugaaaagccuacuuca

SEQ ID NO: 194355 - RNA, 19 nt, Human
ccggguccccuccucucag

SEQ ID NO: 194356 - RNA, 19 nt, Human
ccuggacacucacccggga

SEQ ID NO: 194357 - RNA, 19 nt, Human
cuagaagaaaggagggaaa

SEQ ID NO: 194358 - RNA, 18 nt, Human
cucuccccaugaaaagcc

SEQ ID NO: 194359 - RNA, 21 nt, Human
cuggacacucacccgggaacc

SEQ ID NO: 194360 - RNA, 21 nt, Human
gcaaugccgcgagcuaacucc

SEQ ID NO: 194361 - RNA, 20 nt, Human
gccuggacacucacccggga

SEQ ID NO: 194362 - RNA, 22 nt, Human
gccuggacacucacccgggaac

SEQ ID NO: 194363 - RNA, 19 nt, Human
uaaaaaaggugaaguggac

SEQ ID NO: 194364 - RNA, 25 nt, Human
uaaagcccaugaacugcauuacuag

SEQ ID NO: 194365 - RNA, 18 nt, Human
uaccuaaagcccaugaac

SEQ ID NO: 194366 - RNA, 23 nt, Human
uauggauacuucuuuguucuugg

SEQ ID NO: 194367 - RNA, 19 nt, Human
uccccaugaaaagccuacu

SEQ ID NO: 194368 - RNA, 21 nt, Human
ucuaaacuuaauauggauacu

SEQ ID NO: 194369 - RNA, 18 nt, Human
ucucauagaaauagacuc

SEQ ID NO: 194370 - RNA, 23 nt, Human
ugaaaagccuacuucauaacuga

SEQ ID NO: 194371 - RNA, 23 nt, Human
ugaaguggacaaucaguauuuca

SEQ ID NO: 194372 - RNA, 28 nt, Human
ugaaguggacaaucaguauuucaaaccc

SEQ ID NO: 194373 - RNA, 18 nt, Human
uggauacuucuuuguucu

SEQ ID NO: 194374 - RNA, 22 nt, Human
uucaaacccaauacagggaaau

SEQ ID NO: 194375 - RNA, 22 nt, Human
uuuuuuuuuuuuuuuucaucuu

SEQ ID NO: 194376 - RNA, 24 nt, Human
aaacauauguaacaauacacaaau

SEQ ID NO: 194377 - RNA, 22 nt, Human
acaaagggaacugugcaucuau

SEQ ID NO: 194378 - RNA, 18 nt, Human
acuguaguucauuaguga

SEQ ID NO: 194379 - RNA, 24 nt, Human
acuguaguucauuagugauccauu

SEQ ID NO: 194380 - RNA, 18 nt, Human
agaugaaguccaacuacc

SEQ ID NO: 194381 - RNA, 21 nt, Human
agcaaagcaauuaagugagaa

SEQ ID NO: 194382 - RNA, 19 nt, Human
auagaugaaguccaacuac

SEQ ID NO: 194383 - RNA, 18 nt, Human
ccauuacuucauccaaau

SEQ ID NO: 194384 - RNA, 18 nt, Human
ccugcaguucacugcacu

SEQ ID NO: 194385 - RNA, 18 nt, Human
ccuugagggaaaaaaaag

SEQ ID NO: 194386 - RNA, 20 nt, Human
gaaauuaaaacauucucccu

SEQ ID NO: 194387 - RNA, 26 nt, Human
uaacaauacacaaauuuaaaaauuuu

SEQ ID NO: 194388 - RNA, 18 nt, Human
uaauuucuuacacaucuc

SEQ ID NO: 194389 - RNA, 24 nt, Human
uagcccaucagagcucuuuauaau

SEQ ID NO: 194390 - RNA, 23 nt, Human
ucacccaaauagcccaucagagc

SEQ ID NO: 194391 - RNA, 24 nt, Human
ucuacauaaaagcugucaaaguuu

SEQ ID NO: 194392 - RNA, 21 nt, Human
ucucccuugagggaaaaaaaa

SEQ ID NO: 194393 - RNA, 25 nt, Human
ugcaaaauaauggaauauacuuuaa

SEQ ID NO: 194394 - RNA, 18 nt, Human
uucuacugauacaaacag

SEQ ID NO: 194395 - RNA, 21 nt, Human
aaacagguccucggugacuuu

SEQ ID NO: 194396 - RNA, 20 nt, Human
aaagagccuuaggacccagu

SEQ ID NO: 194397 - RNA, 19 nt, Human
aagaaacccaaugauaauc

SEQ ID NO: 194398 - RNA, 20 nt, Human
aaggacagggccaugaaagc

SEQ ID NO: 194399 - RNA, 25 nt, Human
aaguacugaaggugguauugcuucg

SEQ ID NO: 194400 - RNA, 19 nt, Human
aagugaccacagcuuccac

SEQ ID NO: 194401 - RNA, 19 nt, Human
acacacagacaaguucuga

SEQ ID NO: 194402 - RNA, 19 nt, Human
accccauucccacccccug

SEQ ID NO: 194403 - RNA, 22 nt, Human
acgcuaugguaugccuguaggc

SEQ ID NO: 194404 - RNA, 19 nt, Human
acugagcacaagagcauca

SEQ ID NO: 194405 - RNA, 22 nt, Human
agaugucaaagacaugauggcc

SEQ ID NO: 194406 - RNA, 21 nt, Human
aggaaaugcaaagagaggagg

SEQ ID NO: 194407 - RNA, 21 nt, Human
aggcccaaacucuucugucag

SEQ ID NO: 194408 - RNA, 20 nt, Human
aggcuuagaaguugggcacu

SEQ ID NO: 194409 - RNA, 24 nt, Human
agggugauguagagggagcccugc

SEQ ID NO: 194410 - RNA, 23 nt, Human
aggguuuaggaagguccaaaggg

SEQ ID NO: 194411 - RNA, 20 nt, Human
augcagcaucucaugggcac

SEQ ID NO: 194412 - RNA, 18 nt, Human
cacauguggccccacgcc

SEQ ID NO: 194413 - RNA, 25 nt, Human
cacugcucagcccccugguuucuuc

SEQ ID NO: 194414 - RNA, 19 nt, Human
cacuggcaggcaucaaugg

SEQ ID NO: 194415 - RNA, 23 nt, Human
cacuggcaggcaucaaugguguu

SEQ ID NO: 194416 - RNA, 22 nt, Human
cacuuugaugugucuucggacc

SEQ ID NO: 194417 - RNA, 20 nt, Human
cagagaccuaauccccuccu

SEQ ID NO: 194418 - RNA, 19 nt, Human
cagaggguggucauacucc

SEQ ID NO: 194419 - RNA, 18 nt, Human
cagcaucucaugggcaca

SEQ ID NO: 194420 - RNA, 22 nt, Human
caugcaggugcagaggggccuu

SEQ ID NO: 194421 - RNA, 18 nt, Human
ccacgcuaugguaugccu

SEQ ID NO: 194422 - RNA, 19 nt, Human
ccauacccuuucaaacugc

SEQ ID NO: 194423 - RNA, 19 nt, Human
cccaguagucccgguucau

SEQ ID NO: 194424 - RNA, 21 nt, Human
ccccaccccauucccaccccc

SEQ ID NO: 194425 - RNA, 21 nt, Human
cccuccaacaagaaaaguagc

SEQ ID NO: 194426 - RNA, 20 nt, Human
ccuaacuuuuuccauaagcu

SEQ ID NO: 194427 - RNA, 23 nt, Human
ccuuagccacgcuaugguaugcc

SEQ ID NO: 194428 - RNA, 23 nt, Human
cuaagaauagugaugaaggucuu

SEQ ID NO: 194429 - RNA, 24 nt, Human
cucaagcucaagucaccagaagau

SEQ ID NO: 194430 - RNA, 21 nt, Human
cuccaagaccaucugacccag

SEQ ID NO: 194431 - RNA, 18 nt, Human
cuccuucacugccauccg

SEQ ID NO: 194432 - RNA, 18 nt, Human
cuggauuguucuuccaca

SEQ ID NO: 194433 - RNA, 18 nt, Human
cugucagcuucuucagag

SEQ ID NO: 194434 - RNA, 22 nt, Human
gaccccaccccauucccacccc

SEQ ID NO: 194435 - RNA, 25 nt, Human
gacccucucuccuuagugaccccac

SEQ ID NO: 194436 - RNA, 20 nt, Human
gacuuuuccaguaagaaagg

SEQ ID NO: 194437 - RNA, 21 nt, Human
ggauacugacgaaugaggaca

SEQ ID NO: 194438 - RNA, 22 nt, Human
ggccaugaaagcaaaaagagcc

SEQ ID NO: 194439 - RNA, 22 nt, Human
gguauugcuguaucacuuugau

SEQ ID NO: 194440 - RNA, 23 nt, Human
guaaaauucacacauguggcccc

SEQ ID NO: 194441 - RNA, 21 nt, Human
guagagggagcccugcagaca

SEQ ID NO: 194442 - RNA, 23 nt, Human
guccagccucaauccugagaauu

SEQ ID NO: 194443 - RNA, 20 nt, Human
gugcagaggggccuuagcca

SEQ ID NO: 194444 - RNA, 18 nt, Human
guuugagauucagagagg

SEQ ID NO: 194445 - RNA, 20 nt, Human
uaaaaugacugagguguaag

SEQ ID NO: 194446 - RNA, 18 nt, Human
uaugccuguaggcggaac

SEQ ID NO: 194447 - RNA, 23 nt, Human
ucacacauguggccccacgcccu

SEQ ID NO: 194448 - RNA, 19 nt, Human
ucacugccauccgcagaaa

SEQ ID NO: 194449 - RNA, 22 nt, Human
ucagagcucaagcucaagucac

SEQ ID NO: 194450 - RNA, 25 nt, Human
uccaagaccaucugacccagacggg

SEQ ID NO: 194451 - RNA, 19 nt, Human
uccacagacagauacucac

SEQ ID NO: 194452 - RNA, 18 nt, Human
uccuuagugaccccaccc

SEQ ID NO: 194453 - RNA, 20 nt, Human
ucucagcccuggauuguucu

SEQ ID NO: 194454 - RNA, 26 nt, Human
ucuccagcuccuucacuggggccgcc

SEQ ID NO: 194455 - RNA, 24 nt, Human
ucugccacucucuugccauacccu

SEQ ID NO: 194456 - RNA, 23 nt, Human
ugaaggacagggccaugaaagca

SEQ ID NO: 194457 - RNA, 24 nt, Human
ugaaugaugucacugagcacaaga

SEQ ID NO: 194458 - RNA, 22 nt, Human
ugacccagacgggcaaaacugg

SEQ ID NO: 194459 - RNA, 19 nt, Human
ugaccccaccccauuccca

SEQ ID NO: 194460 - RNA, 23 nt, Human
ugaccccaccccauucccacccc

SEQ ID NO: 194461 - RNA, 24 nt, Human
ugaccccaccccauucccaccccc

SEQ ID NO: 194462 - RNA, 25 nt, Human
ugaccccaccccauucccacccccu

SEQ ID NO: 194463 - RNA, 20 nt, Human
ugaggcacccaugacaaaga

SEQ ID NO: 194464 - RNA, 20 nt, Human
ugccugucagagcucaagcu

SEQ ID NO: 194465 - RNA, 20 nt, Human
ugcucagcccccugguuucu

SEQ ID NO: 194466 - RNA, 19 nt, Human
uggaguugaggcacccaug

SEQ ID NO: 194467 - RNA, 21 nt, Human
uggcuccugacccucucuccu

SEQ ID NO: 194468 - RNA, 23 nt, Human
uggcugggggguugcugaugagg

SEQ ID NO: 194469 - RNA, 22 nt, Human
ugguaagcagaugucaaagaca

SEQ ID NO: 194470 - RNA, 25 nt, Human
ugguguugagaaguucauauacaug

SEQ ID NO: 194471 - RNA, 19 nt, Human
ugucugccacucucuugcc

SEQ ID NO: 194472 - RNA, 22 nt, Human
uuacuuccacagacagauacuc

SEQ ID NO: 194473 - RNA, 25 nt, Human
uucaaauuuuucuccauuaucaacu

SEQ ID NO: 194474 - RNA, 22 nt, Human
uucaauccgugacagaaguaaa

SEQ ID NO: 194475 - RNA, 24 nt, Human
uuccacagacagauacucacaggc

SEQ ID NO: 194476 - RNA, 21 nt, Human
uucugaaugaugucacugagc

SEQ ID NO: 194477 - RNA, 24 nt, Human
uugaggcacccaugacaaagaaga

SEQ ID NO: 194478 - RNA, 21 nt, Human
uuucuucggacaaagaggaaa

SEQ ID NO: 194479 - RNA, 21 nt, Human
aacagagucaucagcuuucag

SEQ ID NO: 194480 - RNA, 19 nt, Human
aagaaugacaucccccacu

SEQ ID NO: 194481 - RNA, 18 nt, Human
aagacaccaugagggugg

SEQ ID NO: 194482 - RNA, 19 nt, Human
accaggcaggcugggccac

SEQ ID NO: 194483 - RNA, 18 nt, Human
acuaguccauggccugcu

SEQ ID NO: 194484 - RNA, 24 nt, Human
agaagcuggaagccacucuuugcu

SEQ ID NO: 194485 - RNA, 21 nt, Human
aggaagcccaaccaggcaggc

SEQ ID NO: 194486 - RNA, 18 nt, Human
aggcacgcugggucagca

SEQ ID NO: 194487 - RNA, 18 nt, Human
agggagggggaagggcug

SEQ ID NO: 194488 - RNA, 25 nt, Human
agucaucagcuuucaguggcccaga

SEQ ID NO: 194489 - RNA, 22 nt, Human
aguccaggauuccaauuuggca

SEQ ID NO: 194490 - RNA, 25 nt, Human
auacauuucuagaaauuucaauacc

SEQ ID NO: 194491 - RNA, 23 nt, Human
aucauauuauuuccauguaaaau

SEQ ID NO: 194492 - RNA, 20 nt, Human
auccagauaagcuugauugc

SEQ ID NO: 194493 - RNA, 24 nt, Human
aucggugggugcauggccuucugg

SEQ ID NO: 194494 - RNA, 19 nt, Human
augcugcacugcagacccc

SEQ ID NO: 194495 - RNA, 22 nt, Human
caaugaguuuuucucuuggucu

SEQ ID NO: 194496 - RNA, 18 nt, Human
caccaugaggguggaugg

SEQ ID NO: 194497 - RNA, 21 nt, Human
cacuuggccucaguucaaagu

SEQ ID NO: 194498 - RNA, 19 nt, Human
cagaaggaaauauaaugua

SEQ ID NO: 194499 - RNA, 19 nt, Human
cagcaacaacccauugacc

SEQ ID NO: 194500 - RNA, 22 nt, Human
cagcggcccauuaaugcugcac

SEQ ID NO: 194501 - RNA, 22 nt, Human
cagcugagguucucaucuacca

SEQ ID NO: 194502 - RNA, 21 nt, Human
caugccccuuugagugugggg

SEQ ID NO: 194503 - RNA, 20 nt, Human
caugcucauggcagcaacaa

SEQ ID NO: 194504 - RNA, 24 nt, Human
cauuacuuuugugaugaggagauc

SEQ ID NO: 194505 - RNA, 20 nt, Human
ccacauuacuuuugugauga

SEQ ID NO: 194506 - RNA, 20 nt, Human
ccagaggagccaucugggua

SEQ ID NO: 194507 - RNA, 24 nt, Human
cccaauacucagccuaccuucaau

SEQ ID NO: 194508 - RNA, 21 nt, Human
cccacauuacuuuugugauga

SEQ ID NO: 194509 - RNA, 20 nt, Human
cccauccagggcuccucuuu

SEQ ID NO: 194510 - RNA, 22 nt, Human
ccccagccugaguccgccagcc

SEQ ID NO: 194511 - RNA, 23 nt, Human
ccccaggaagcccaaccaggcag

SEQ ID NO: 194512 - RNA, 20 nt, Human
cccccgggggaacagaguca

SEQ ID NO: 194513 - RNA, 18 nt, Human
ccccuauccgguucuugu

SEQ ID NO: 194514 - RNA, 22 nt, Human
ccugcaacacuggccccaggaa

SEQ ID NO: 194515 - RNA, 22 nt, Human
cucauggcagcaacaacccauu

SEQ ID NO: 194516 - RNA, 19 nt, Human
cuccagagguuguacaugc

SEQ ID NO: 194517 - RNA, 18 nt, Human
cuguguaugagucauccu

SEQ ID NO: 194518 - RNA, 20 nt, Human
cuuggccucaguucaaagug

SEQ ID NO: 194519 - RNA, 19 nt, Human
gagggagggggaagggcug

SEQ ID NO: 194520 - RNA, 19 nt, Human
gagggagggggaagggcug

SEQ ID NO: 194521 - RNA, 23 nt, Human
gauugcuccuucugcuucuccac

SEQ ID NO: 194522 - RNA, 28 nt, Human
gcagaccccagccugaguccgccagcca

SEQ ID NO: 194523 - RNA, 18 nt, Human
gcaggcugggccacuuca

SEQ ID NO: 194524 - RNA, 20 nt, Human
gcugccccccgggggaacag

SEQ ID NO: 194525 - RNA, 20 nt, Human
gcugggccacuucaucugug

SEQ ID NO: 194526 - RNA, 24 nt, Human
ggccucaguucaaagugaaauuuc

SEQ ID NO: 194527 - RNA, 18 nt, Human
ggccugcugggagugcac

SEQ ID NO: 194528 - RNA, 19 nt, Human
gggagggggaagggcuggg

SEQ ID NO: 194529 - RNA, 20 nt, Human
gggaguucccauccagggcu

SEQ ID NO: 194530 - RNA, 22 nt, Human
ggucuacauccuggcguugagg

SEQ ID NO: 194531 - RNA, 22 nt, Human
guagagcaaagaaacuaaagaa

SEQ ID NO: 194532 - RNA, 23 nt, Human
guagauauggcugccccccgggg

SEQ ID NO: 194533 - RNA, 22 nt, Human
guagguucccccuauccgguuc

SEQ ID NO: 194534 - RNA, 18 nt, Human
guccaguuguagauaugg

SEQ ID NO: 194535 - RNA, 23 nt, Human
guucccauccagggcuccucuuu

SEQ ID NO: 194536 - RNA, 18 nt, Human
uaagaacuuggagaacug

SEQ ID NO: 194537 - RNA, 19 nt, Human
uaagaacuuggagaacugg

SEQ ID NO: 194538 - RNA, 24 nt, Human
uaaguccaggauuccaauuuggca

SEQ ID NO: 194539 - RNA, 18 nt, Human
uacaugcucauggcagca

SEQ ID NO: 194540 - RNA, 23 nt, Human
uagaagacaccaugaggguggau

SEQ ID NO: 194541 - RNA, 22 nt, Human
uagagcaaagaaacuaaagaaa

SEQ ID NO: 194542 - RNA, 18 nt, Human
uccagauaagcuugauug

SEQ ID NO: 194543 - RNA, 21 nt, Human
ucccaucaagccuauauucuu

SEQ ID NO: 194544 - RNA, 18 nt, Human
uccuugaaagaaguagaa

SEQ ID NO: 194545 - RNA, 23 nt, Human
ucggugggugcauggccuucugg

SEQ ID NO: 194546 - RNA, 23 nt, Human
ucuaaaacaugaagagguaacuc

SEQ ID NO: 194547 - RNA, 18 nt, Human
ucucaucuaccacacuga

SEQ ID NO: 194548 - RNA, 21 nt, Human
ucuucuuuguccacugaagca

SEQ ID NO: 194549 - RNA, 23 nt, Human
ugaagaggaggaagaaaucaugg

SEQ ID NO: 194550 - RNA, 21 nt, Human
ugacaucccccacuucagccu

SEQ ID NO: 194551 - RNA, 21 nt, Human
ugagcaguaaguggcaauguu

SEQ ID NO: 194552 - RNA, 21 nt, Human
ugagggagggggaagggcugg

SEQ ID NO: 194553 - RNA, 18 nt, Human
ugcagaccccagccugag

SEQ ID NO: 194554 - RNA, 19 nt, Human
ugccaggugcccacguaga

SEQ ID NO: 194555 - RNA, 21 nt, Human
ugccaggugcccacguagagc

SEQ ID NO: 194556 - RNA, 19 nt, Human
ugccccuuugagugugggg

SEQ ID NO: 194557 - RNA, 25 nt, Human
uggagaacuggcuuuccugaggaga

SEQ ID NO: 194558 - RNA, 19 nt, Human
uggauucccaauacucagc

SEQ ID NO: 194559 - RNA, 21 nt, Human
uggcaggguuuacugggaugg

SEQ ID NO: 194560 - RNA, 22 nt, Human
uggccccaggaagcccaaccag

SEQ ID NO: 194561 - RNA, 22 nt, Human
uggcuaggagcagacacuuuuc

SEQ ID NO: 194562 - RNA, 20 nt, Human
uguacaugcucauggcagca

SEQ ID NO: 194563 - RNA, 19 nt, Human
ugucucaucuucuuugucc

SEQ ID NO: 194564 - RNA, 19 nt, Human
ugugaugaggagaucuugg

SEQ ID NO: 194565 - RNA, 21 nt, Human
ugugaugaggagaucuuggcu

SEQ ID NO: 194566 - RNA, 20 nt, Human
uucaguggcccagaggagcc

SEQ ID NO: 194567 - RNA, 19 nt, Human
uuccugaguccuugaaaga

SEQ ID NO: 194568 - RNA, 23 nt, Human
uugauugcuccuucugcuucucc

SEQ ID NO: 194569 - RNA, 24 nt, Human
uuucucuuggucucuacuuuguga

SEQ ID NO: 194570 - RNA, 21 nt, Human
uuuggauucccaauacucagc

SEQ ID NO: 194571 - RNA, 24 nt, Human
uuugugaugaggagaucuuggcua

SEQ ID NO: 194572 - RNA, 22 nt, Human
uuuuuuuuuuuuuuuuuuucag

SEQ ID NO: 194573 - RNA, 18 nt, Human
aacacaguccuacaugua

SEQ ID NO: 194574 - RNA, 21 nt, Human
aagaaaggagaaagaaaaaaa

SEQ ID NO: 194575 - RNA, 23 nt, Human
acacuugaaagaaaggagaaaga

SEQ ID NO: 194576 - RNA, 20 nt, Human
acgcgcacaggcggaccuuc

SEQ ID NO: 194577 - RNA, 20 nt, Human
agaaaggagaaagaaaaaaa

SEQ ID NO: 194578 - RNA, 25 nt, Human
auauacaugacacaaacauuauaua

SEQ ID NO: 194579 - RNA, 22 nt, Human
caagacgacucacgacacuuga

SEQ ID NO: 194580 - RNA, 24 nt, Human
caaggggacaccugggagagggga

SEQ ID NO: 194581 - RNA, 18 nt, Human
cacagcagcgagugcucu

SEQ ID NO: 194582 - RNA, 19 nt, Human
cacucccuccucccgccug

SEQ ID NO: 194583 - RNA, 18 nt, Human
cagcagcgagugcucugc

SEQ ID NO: 194584 - RNA, 28 nt, Human
cauauacaugacacaaacauuauauaua

SEQ ID NO: 194585 - RNA, 23 nt, Human
cauuacgggugagaagacccuug

SEQ ID NO: 194586 - RNA, 22 nt, Human
ccagucagucucuccacucccu

SEQ ID NO: 194587 - RNA, 22 nt, Human
cccacaaguaaaaaggcuuuau

SEQ ID NO: 194588 - RNA, 20 nt, Human
ccgccuggcucgaggacgga

SEQ ID NO: 194589 - RNA, 18 nt, Human
cgacacuugaaagaaagg

SEQ ID NO: 194590 - RNA, 18 nt, Human
gacaccaaauggccuucu

SEQ ID NO: 194591 - RNA, 22 nt, Human
gcagcgagugcucugcugccuu

SEQ ID NO: 194592 - RNA, 21 nt, Human
ggaagucgagcguccacagug

SEQ ID NO: 194593 - RNA, 22 nt, Human
gucagucucuccacucccuccu

SEQ ID NO: 194594 - RNA, 29 nt, Human
uacacaguuauuuccaauauacaaucaag

SEQ ID NO: 194595 - RNA, 18 nt, Human
uacagucuacacagcagc

SEQ ID NO: 194596 - RNA, 19 nt, Human
uaugcuacaaggggacacc

SEQ ID NO: 194597 - RNA, 22 nt, Human
ucuacacagcagcgagugcucu

SEQ ID NO: 194598 - RNA, 19 nt, Human
ucucaggccugacgcgcag

SEQ ID NO: 194599 - RNA, 21 nt, Human
ucucaggccugacgcgcaggg

SEQ ID NO: 194600 - RNA, 21 nt, Human
ucuccagcuuccucccagguc

SEQ ID NO: 194601 - RNA, 23 nt, Human
ucuccagcuuccucccaggucuc

SEQ ID NO: 194602 - RNA, 20 nt, Human
ucucuccacucccuccuccc

SEQ ID NO: 194603 - RNA, 23 nt, Human
ugacgcgcagggcccggccgccu

SEQ ID NO: 194604 - RNA, 18 nt, Human
ugagaagacccuuggaag

SEQ ID NO: 194605 - RNA, 22 nt, Human
ugcucugcugccuggcucaggc

SEQ ID NO: 194606 - RNA, 23 nt, Human
uggaugcauucaaguaauacuaa

SEQ ID NO: 194607 - RNA, 21 nt, Human
uguucacagaaaggccucaau

SEQ ID NO: 194608 - RNA, 20 nt, Human
uugguuuaaauauccucugg

SEQ ID NO: 194609 - RNA, 23 nt, Human
uuuguuacacaguuauuuccaau

SEQ ID NO: 194610 - RNA, 28 nt, Human
acagcucuggccucugcuggcucugccc

SEQ ID NO: 194611 - RNA, 21 nt, Human
cagcucuggccucugcuggcu

SEQ ID NO: 194612 - RNA, 22 nt, Human
ccaccuacagggacaaaaagug

SEQ ID NO: 194613 - RNA, 24 nt, Human
ccuacagggacaaaaaguguuauc

SEQ ID NO: 194614 - RNA, 20 nt, Human
gcucuggccucugcuggcuc

SEQ ID NO: 194615 - RNA, 19 nt, Human
gggcuggauuuagaacguc

SEQ ID NO: 194616 - RNA, 21 nt, Human
uaaagaagugaugcacaaaug

SEQ ID NO: 194617 - RNA, 22 nt, Human
uaacuuucucuaaagaagugau

SEQ ID NO: 194618 - RNA, 18 nt, Human
uaagcagaacacagacuu

SEQ ID NO: 194619 - RNA, 18 nt, Human
uagaaaguuuuagcaugu

SEQ ID NO: 194620 - RNA, 24 nt, Human
uagaacgucacuaauuaaaauccu

SEQ ID NO: 194621 - RNA, 23 nt, Human
ucaccuuauagcuccgcugacaa

SEQ ID NO: 194622 - RNA, 23 nt, Human
ucucuccuaagcagaacacagac

SEQ ID NO: 194623 - RNA, 21 nt, Human
ugaacacuugcccagccagca

SEQ ID NO: 194624 - RNA, 18 nt, Human
ugccccacguguauaggg

SEQ ID NO: 194625 - RNA, 21 nt, Human
uuaucucuccuaagcagaaca

SEQ ID NO: 194626 - RNA, 23 nt, Human
aacagcacaaaggcuauagguuu

SEQ ID NO: 194627 - RNA, 18 nt, Human
aacccaaaggagaauagc

SEQ ID NO: 194628 - RNA, 23 nt, Human
aacuuaaaagaccucaggggcag

SEQ ID NO: 194629 - RNA, 18 nt, Human
acacugacuccagccugg

SEQ ID NO: 194630 - RNA, 18 nt, Human
acagcacaaaggcuauag

SEQ ID NO: 194631 - RNA, 19 nt, Human
acugacuccagccuggcug

SEQ ID NO: 194632 - RNA, 23 nt, Human
agaacaccuccaagccccuacau

SEQ ID NO: 194633 - RNA, 21 nt, Human
agccuggcuccacuaccauuc

SEQ ID NO: 194634 - RNA, 21 nt, Human
aggggcacgcaggcaaggggc

SEQ ID NO: 194635 - RNA, 24 nt, Human
augccacauuacucuuuauugaau

SEQ ID NO: 194636 - RNA, 21 nt, Human
caccuccaagccccuacaucu

SEQ ID NO: 194637 - RNA, 18 nt, Human
cacugacuccagccuggc

SEQ ID NO: 194638 - RNA, 19 nt, Human
cagaacaccuccaagcccc

SEQ ID NO: 194639 - RNA, 21 nt, Human
cagcaagaaacccaaaggaga

SEQ ID NO: 194640 - RNA, 25 nt, Human
ccacuguccagaacaccuccaagcc

SEQ ID NO: 194641 - RNA, 25 nt, Human
ccagaacaccuccaagccccuacau

SEQ ID NO: 194642 - RNA, 24 nt, Human
ccagcaccggccccuuucucucca

SEQ ID NO: 194643 - RNA, 22 nt, Human
cccgcuggucuccccucucgga

SEQ ID NO: 194644 - RNA, 18 nt, Human
ccggccccuuucucucca

SEQ ID NO: 194645 - RNA, 22 nt, Human
ccuccccacuguccagaacacc

SEQ ID NO: 194646 - RNA, 18 nt, Human
cucuaggggagggaggug

SEQ ID NO: 194647 - RNA, 19 nt, Human
cuuacccuaacgccauuca

SEQ ID NO: 194648 - RNA, 21 nt, Human
gcaaggcagaacagcacaaag

SEQ ID NO: 194649 - RNA, 22 nt, Human
gcacgcaggcaaggggcacgaa

SEQ ID NO: 194650 - RNA, 19 nt, Human
gcaggugucuggaauaugg

SEQ ID NO: 194651 - RNA, 23 nt, Human
gcccucaacuuaaaagaccucag

SEQ ID NO: 194652 - RNA, 18 nt, Human
gcgccagcaccggccccu

SEQ ID NO: 194653 - RNA, 23 nt, Human
gucuggagcccuccccacugucc

SEQ ID NO: 194654 - RNA, 21 nt, Human
guggaagccuggcuccacuac

SEQ ID NO: 194655 - RNA, 25 nt, Human
uacagccagcacccuccucggugcc

SEQ ID NO: 194656 - RNA, 20 nt, Human
uacccuaacgccauucacac

SEQ ID NO: 194657 - RNA, 19 nt, Human
uaggggagggagguggaug

SEQ ID NO: 194658 - RNA, 24 nt, Human
uauggucaggagugggaggggagg

SEQ ID NO: 194659 - RNA, 19 nt, Human
ucucuccaagcacaggggc

SEQ ID NO: 194660 - RNA, 24 nt, Human
ucuuuugugaccagguugggucug

SEQ ID NO: 194661 - RNA, 20 nt, Human
ugaaugcgagcgccagcacc

SEQ ID NO: 194662 - RNA, 23 nt, Human
ugcagcagcaagaaacccaaagg

SEQ ID NO: 194663 - RNA, 19 nt, Human
ugcccuuacccuaacgcca

SEQ ID NO: 194664 - RNA, 21 nt, Human
uggccaggaugcaguggaagc

SEQ ID NO: 194665 - RNA, 24 nt, Human
uggcugugcccuuacccuaacgcc

SEQ ID NO: 194666 - RNA, 22 nt, Human
ugguuguauaaaauugcagcag

SEQ ID NO: 194667 - RNA, 20 nt, Human
ugucuggaauauggucagga

SEQ ID NO: 194668 - RNA, 19 nt, Human
uuagggcaggugucuggaa

SEQ ID NO: 194669 - RNA, 22 nt, Human
uuggagauauaaugcagaagug

SEQ ID NO: 194670 - RNA, 20 nt, Human
uuuuuuuuuaaacacaggua

SEQ ID NO: 194671 - RNA, 20 nt, Human
uuuuuuuuuuaaacacaggg

SEQ ID NO: 194672 - RNA, 22 nt, Human
ccucgggacccgacuucccgcc

SEQ ID NO: 194673 - RNA, 23 nt, Human
cgagccggagccucgggacccga

SEQ ID NO: 194674 - RNA, 20 nt, Human
cuguggccuuuuuccccucc

SEQ ID NO: 194675 - RNA, 19 nt, Human
uacagauugcuguggccuu

SEQ ID NO: 194676 - RNA, 18 nt, Human
ucccgcccggcccggauc

SEQ ID NO: 194677 - RNA, 23 nt, Human
ucuaauaucuuauuuuacaugau

SEQ ID NO: 194678 - RNA, 21 nt, Human
agcuaacucuguucacaacgu

SEQ ID NO: 194679 - RNA, 19 nt, Human
cuaacucuguucacaacgu

SEQ ID NO: 194680 - RNA, 18 nt, Human
guccaguucuccucuucc

SEQ ID NO: 194681 - RNA, 21 nt, Human
uuaccagcuaacucuguucac

SEQ ID NO: 194682 - RNA, 25 nt, Human
uuuaagaggacauuuaccagcuaac

SEQ ID NO: 194683 - RNA, 26 nt, Human
aaaaaagaaaaugguuuaaaagaaga

SEQ ID NO: 194684 - RNA, 26 nt, Human
aaaaaagaaaaugguuuaaaagaaga

SEQ ID NO: 194685 - RNA, 22 nt, Human
aaaaacacccaucauacuaccc

SEQ ID NO: 194686 - RNA, 21 nt, Human
aaaaacaccucuucacaaccc

SEQ ID NO: 194687 - RNA, 19 nt, Human
aaaaagaaaaugguuuaaa

SEQ ID NO: 194688 - RNA, 19 nt, Human
aaaaagaaaaugguuuaaa

SEQ ID NO: 194689 - RNA, 25 nt, Human
aaaaagaaaaugguuuaaaagaaga

SEQ ID NO: 194690 - RNA, 25 nt, Human
aaaaagaaaaugguuuaaaagaaga

SEQ ID NO: 194691 - RNA, 25 nt, Human
aaaaagaaaaugguuuaaaagaaga

SEQ ID NO: 194692 - RNA, 25 nt, Human
aaaaagaaaaugguuuaaaagaaga

SEQ ID NO: 194693 - RNA, 28 nt, Human
aaaaagaaaaugguuuaaaagaagagau

SEQ ID NO: 194694 - RNA, 28 nt, Human
aaaaagaaaaugguuuaaaagaagagau

SEQ ID NO: 194695 - RNA, 22 nt, Human
aaacacaugccaucuggauaua

SEQ ID NO: 194696 - RNA, 22 nt, Human
aaacacaugccaucuggauaua

SEQ ID NO: 194697 - RNA, 21 nt, Human
aaagcaacaggucuuucagaa

SEQ ID NO: 194698 - RNA, 28 nt, Human
aacacccaucauacuacccacagauagc

SEQ ID NO: 194699 - RNA, 24 nt, Human
aacaggucuuucagaacuuuaguu

SEQ ID NO: 194700 - RNA, 24 nt, Human
aaucacauuuacuuuuuucuacau

SEQ ID NO: 194701 - RNA, 24 nt, Human
aaucacauuuacuuuuuucuacau

SEQ ID NO: 194702 - RNA, 21 nt, Human
aaucuccgcuucuuuuggggg

SEQ ID NO: 194703 - RNA, 21 nt, Human
aaucuccgcuucuuuuggggg

SEQ ID NO: 194704 - RNA, 19 nt, Human
aaugaaggaagccucuaga

SEQ ID NO: 194705 - RNA, 20 nt, Human
acaaggagagaccagguaga

SEQ ID NO: 194706 - RNA, 20 nt, Human
acaaucagauggaagaaucc

SEQ ID NO: 194707 - RNA, 24 nt, Human
acauaacuuuucuaaccacaaaaa

SEQ ID NO: 194708 - RNA, 24 nt, Human
acauaacuuuucuaaccacaaaaa

SEQ ID NO: 194709 - RNA, 22 nt, Human
acaugccaucuggauauauaua

SEQ ID NO: 194710 - RNA, 22 nt, Human
acaugccaucuggauauauaua

SEQ ID NO: 194711 - RNA, 27 nt, Human
accggcaugcaggaacucagaaaccua

SEQ ID NO: 194712 - RNA, 23 nt, Human
acuacccacagauagccaugaug

SEQ ID NO: 194713 - RNA, 24 nt, Human
agcacccugggauuacaggcguga

SEQ ID NO: 194714 - RNA, 24 nt, Human
aggaacucagaaaccuaaaugggg

SEQ ID NO: 194715 - RNA, 18 nt, Human
agguucaacucucuccug

SEQ ID NO: 194716 - RNA, 20 nt, Human
aucuccgcuucuuuuggggg

SEQ ID NO: 194717 - RNA, 20 nt, Human
aucuccgcuucuuuuggggg

SEQ ID NO: 194718 - RNA, 21 nt, Human
augacauagguguaugucucu

SEQ ID NO: 194719 - RNA, 19 nt, Human
caaggagagaccagguaga

SEQ ID NO: 194720 - RNA, 24 nt, Human
cacaccuguaaucucagcacccug

SEQ ID NO: 194721 - RNA, 23 nt, Human
cacagcuagggaucaccggcaug

SEQ ID NO: 194722 - RNA, 20 nt, Human
caccuguaaucucagcaccc

SEQ ID NO: 194723 - RNA, 24 nt, Human
caccuguaaucucagcacccuggg

SEQ ID NO: 194724 - RNA, 20 nt, Human
cagaaaaugcauagauacau

SEQ ID NO: 194725 - RNA, 24 nt, Human
cagauggaagaauccccaaggcuu

SEQ ID NO: 194726 - RNA, 21 nt, Human
cagcacccugggauuacaggc

SEQ ID NO: 194727 - RNA, 21 nt, Human
cagcacccugggauuacaggc

SEQ ID NO: 194728 - RNA, 20 nt, Human
caggagaugcccaguaaaac

SEQ ID NO: 194729 - RNA, 20 nt, Human
caggagaugcccaguaaaac

SEQ ID NO: 194730 - RNA, 24 nt, Human
caggcgugagccaccgugcccggc

SEQ ID NO: 194731 - RNA, 18 nt, Human
ccaauuagaaaaaacacc

SEQ ID NO: 194732 - RNA, 23 nt, Human
ccagguagaaaauuauugugauu

SEQ ID NO: 194733 - RNA, 22 nt, Human
cccacagauagccaugaugcuu

SEQ ID NO: 194734 - RNA, 18 nt, Human
cccacagugagucugcag

SEQ ID NO: 194735 - RNA, 19 nt, Human
cccacagugagucugcagg

SEQ ID NO: 194736 - RNA, 20 nt, Human
ccugaaacaugaagagcuca

SEQ ID NO: 194737 - RNA, 23 nt, Human
ccugaagcaccugcccuucaaga

SEQ ID NO: 194738 - RNA, 23 nt, Human
ccugaagcaccugcccuucaaga

SEQ ID NO: 194739 - RNA, 22 nt, Human
ccuuucaagauauuugccuccu

SEQ ID NO: 194740 - RNA, 24 nt, Human
cggggauggcuccagaagucaccc

SEQ ID NO: 194741 - RNA, 24 nt, Human
cggggauggcuccagaagucaccc

SEQ ID NO: 194742 - RNA, 19 nt, Human
cucacaccuguaaucucag

SEQ ID NO: 194743 - RNA, 24 nt, Human
cucacaccuguaaucucagcaccc

SEQ ID NO: 194744 - RNA, 22 nt, Human
cucagcacccugggauuacagg

SEQ ID NO: 194745 - RNA, 23 nt, Human
cuccuaccugcuaaaaacaccca

SEQ ID NO: 194746 - RNA, 21 nt, Human
cuccugaaacaugaagagcuc

SEQ ID NO: 194747 - RNA, 18 nt, Human
cugaaacaugaagagcuc

SEQ ID NO: 194748 - RNA, 18 nt, Human
cugaagcaccugcccuuc

SEQ ID NO: 194749 - RNA, 18 nt, Human
cugggauuacaggcguga

SEQ ID NO: 194750 - RNA, 18 nt, Human
cuucauagcugugcaacu

SEQ ID NO: 194751 - RNA, 23 nt, Human
gaaaagcaacaggucuuucagaa

SEQ ID NO: 194752 - RNA, 23 nt, Human
gaaaagcaacaggucuuucagaa

SEQ ID NO: 194753 - RNA, 20 nt, Human
gaacucagaaaccuaaaugg

SEQ ID NO: 194754 - RNA, 21 nt, Human
gaggaaaugaacagagaaggc

SEQ ID NO: 194755 - RNA, 18 nt, Human
gauuacaggcgugagcca

SEQ ID NO: 194756 - RNA, 21 nt, Human
gauuacaggcgugagccaccg

SEQ ID NO: 194757 - RNA, 24 nt, Human
gauuacaggcgugagccaccgugc

SEQ ID NO: 194758 - RNA, 22 nt, Human
gccacgucccaggguucaaagc

SEQ ID NO: 194759 - RNA, 18 nt, Human
gccuccuaccugcuaaaa

SEQ ID NO: 194760 - RNA, 19 nt, Human
gcuagggaucaccggcaug

SEQ ID NO: 194761 - RNA, 26 nt, Human
gcuuggugacagaugaguuacugggu

SEQ ID NO: 194762 - RNA, 24 nt, Human
ggaggaaaugaaggaagccucuag

SEQ ID NO: 194763 - RNA, 20 nt, Human
ggcaggguggcucacaccug

SEQ ID NO: 194764 - RNA, 20 nt, Human
ggcaggguggcucacaccug

SEQ ID NO: 194765 - RNA, 20 nt, Human
ggcaggguggcucacaccug

SEQ ID NO: 194766 - RNA, 23 nt, Human
ggcaggguggcucacaccuguaa

SEQ ID NO: 194767 - RNA, 23 nt, Human
ggcaggguggcucacaccuguaa

SEQ ID NO: 194768 - RNA, 27 nt, Human
ggcuuggugacagaugaguuacugggu

SEQ ID NO: 194769 - RNA, 18 nt, Human
gggacaggugccucuucc

SEQ ID NO: 194770 - RNA, 24 nt, Human
gggcaggguggcucacaccuguaa

SEQ ID NO: 194771 - RNA, 23 nt, Human
ggggauggcuccagaagucaccc

SEQ ID NO: 194772 - RNA, 23 nt, Human
ggggauggcuccagaagucaccc

SEQ ID NO: 194773 - RNA, 22 nt, Human
ggugacggaggaaaugaaggaa

SEQ ID NO: 194774 - RNA, 19 nt, Human
gguggcucacaccuguaau

SEQ ID NO: 194775 - RNA, 23 nt, Human
gguggcucacaccuguaaucuca

SEQ ID NO: 194776 - RNA, 24 nt, Human
gguggcucacaccuguaaucucag

SEQ ID NO: 194777 - RNA, 22 nt, Human
gguucaacucucuccugaaaca

SEQ ID NO: 194778 - RNA, 21 nt, Human
guaguaacauaaaguaaacac

SEQ ID NO: 194779 - RNA, 20 nt, Human
gugaaacacuaggugaucca

SEQ ID NO: 194780 - RNA, 18 nt, Human
uaaaaaagaaauggggau

SEQ ID NO: 194781 - RNA, 20 nt, Human
uaaaguaaacacaugccauc

SEQ ID NO: 194782 - RNA, 20 nt, Human
uaaaguaaacacaugccauc

SEQ ID NO: 194783 - RNA, 22 nt, Human
uaagaagugcaugcaguaaugc

SEQ ID NO: 194784 - RNA, 23 nt, Human
uacaggcgugagccaccgugccc

SEQ ID NO: 194785 - RNA, 18 nt, Human
uaccacauuuaugcagcc

SEQ ID NO: 194786 - RNA, 18 nt, Human
uaccacauuuaugcagcc

SEQ ID NO: 194787 - RNA, 23 nt, Human
uacuagaguagcaucccaaauga

SEQ ID NO: 194788 - RNA, 22 nt, Human
uagccaugaugcuuuuucuggg

SEQ ID NO: 194789 - RNA, 19 nt, Human
uaucagaacaaggagagac

SEQ ID NO: 194790 - RNA, 22 nt, Human
uaugcagccaagugcauguagu

SEQ ID NO: 194791 - RNA, 22 nt, Human
uaugcagccaagugcauguagu

SEQ ID NO: 194792 - RNA, 24 nt, Human
uaugguauccugaagcaccugccc

SEQ ID NO: 194793 - RNA, 24 nt, Human
uaugguauccugaagcaccugccc

SEQ ID NO: 194794 - RNA, 21 nt, Human
ucaaaggaaaaguugaacggg

SEQ ID NO: 194795 - RNA, 24 nt, Human
ucaagacagaaugcuuguaccaca
